United States Patent 8,461,315 (MICRORNAS AND USES THEREOF) - sequence listing, part 6

SEQ ID NO: 133313 - RNA, 64 nt, Homo Sapiens; identical to SEQ ID NO: 60359

SEQ ID NO: 133314 - RNA, 64 nt, Homo Sapiens; identical to SEQ ID NO: 60360

SEQ ID NO: 133315 - RNA, 64 nt, Homo Sapiens; identical to SEQ ID NO: 60361

SEQ ID NO: 133316 - RNA, 64 nt, Homo Sapiens; identical to SEQ ID NO: 60362

SEQ ID NO: 133317 - RNA, 64 nt, Homo Sapiens; identical to SEQ ID NO: 60363

SEQ ID NO: 133318 - RNA, 64 nt, Homo Sapiens; identical to SEQ ID NO: 60364

SEQ ID NO: 133319 - RNA, 64 nt, Homo Sapiens; identical to SEQ ID NO: 60365

SEQ ID NO: 133320 - RNA, 64 nt, Homo Sapiens; identical to SEQ ID NO: 60366

SEQ ID NO: 133321 - RNA, 64 nt, Homo Sapiens; identical to SEQ ID NO: 60367

SEQ ID NO: 133322 - RNA, 64 nt, Homo Sapiens; identical to SEQ ID NO: 60368

SEQ ID NO: 133323 - RNA, 64 nt, Homo Sapiens; identical to SEQ ID NO: 60369

SEQ ID NO: 133324 - RNA, 64 nt, Homo Sapiens; identical to SEQ ID NO: 60370

SEQ ID NO: 133325 - RNA, 64 nt, Homo Sapiens; identical to SEQ ID NO: 60371

SEQ ID NO: 133326 - RNA, 64 nt, Homo Sapiens; identical to SEQ ID NO: 60372

SEQ ID NO: 133327 - RNA, 64 nt, Homo Sapiens; identical to SEQ ID NO: 60373

SEQ ID NO: 133328 - RNA, 64 nt, Homo Sapiens; identical to SEQ ID NO: 60374

SEQ ID NO: 133329 - RNA, 64 nt, Homo Sapiens; identical to SEQ ID NO: 49066

SEQ ID NO: 133330 - RNA, 64 nt, Homo Sapiens; identical to SEQ ID NO: 49067

SEQ ID NO: 133331 - RNA, 64 nt, Homo Sapiens; identical to SEQ ID NO: 49068

SEQ ID NO: 133332 - RNA, 64 nt, Homo Sapiens; identical to SEQ ID NO: 49069

SEQ ID NO: 133333 - RNA, 64 nt, Homo Sapiens; identical to SEQ ID NO: 49070

SEQ ID NO: 133334 - RNA, 64 nt, Homo Sapiens; identical to SEQ ID NO: 49071

SEQ ID NO: 133335 - RNA, 64 nt, Homo Sapiens; identical to SEQ ID NO: 49072

SEQ ID NO: 133336 - RNA, 64 nt, Homo Sapiens; identical to SEQ ID NO: 49073

SEQ ID NO: 133337 - RNA, 64 nt, Homo Sapiens; identical to SEQ ID NO: 49074

SEQ ID NO: 133338 - RNA, 64 nt, Homo Sapiens; identical to SEQ ID NO: 49075

SEQ ID NO: 133339 - RNA, 64 nt, Homo Sapiens; identical to SEQ ID NO: 49076

SEQ ID NO: 133340 - RNA, 64 nt, Homo Sapiens; identical to SEQ ID NO: 49077

SEQ ID NO: 133341 - RNA, 64 nt, Homo Sapiens; identical to SEQ ID NO: 49078

SEQ ID NO: 133342 - RNA, 64 nt, Homo Sapiens; identical to SEQ ID NO: 49079

SEQ ID NO: 133343 - RNA, 64 nt, Homo Sapiens; identical to SEQ ID NO: 49080

SEQ ID NO: 133344 - RNA, 64 nt, Homo Sapiens; identical to SEQ ID NO: 49081

SEQ ID NO: 133345 - RNA, 64 nt, Homo Sapiens; identical to SEQ ID NO: 49082

SEQ ID NO: 133346 - RNA, 64 nt, Homo Sapiens; identical to SEQ ID NO: 49083

SEQ ID NO: 133347 - RNA, 64 nt, Homo Sapiens; identical to SEQ ID NO: 49084

SEQ ID NO: 133348 - RNA, 64 nt, Homo Sapiens; identical to SEQ ID NO: 49085

SEQ ID NO: 133349 - RNA, 64 nt, Homo Sapiens; identical to SEQ ID NO: 49086

SEQ ID NO: 133350 - RNA, 64 nt, Homo Sapiens; identical to SEQ ID NO: 49087

SEQ ID NO: 133351 - RNA, 64 nt, Homo Sapiens; identical to SEQ ID NO: 49088

SEQ ID NO: 133352 - RNA, 64 nt, Homo Sapiens; identical to SEQ ID NO: 49089

SEQ ID NO: 133353 - RNA, 64 nt, Homo Sapiens; identical to SEQ ID NO: 49090

SEQ ID NO: 133354 - RNA, 64 nt, Homo Sapiens; identical to SEQ ID NO: 49091

SEQ ID NO: 133355 - RNA, 64 nt, Homo Sapiens; identical to SEQ ID NO: 49092

SEQ ID NO: 133356 - RNA, 64 nt, Homo Sapiens; identical to SEQ ID NO: 49093

SEQ ID NO: 133357 - RNA, 64 nt, Homo Sapiens; identical to SEQ ID NO: 49094

SEQ ID NO: 133358 - RNA, 64 nt, Homo Sapiens; identical to SEQ ID NO: 49095

SEQ ID NO: 133359 - RNA, 64 nt, Homo Sapiens; identical to SEQ ID NO: 49096

SEQ ID NO: 133360 - RNA, 64 nt, Homo Sapiens; identical to SEQ ID NO: 49097

SEQ ID NO: 133361 - RNA, 64 nt, Homo Sapiens; identical to SEQ ID NO: 49098

SEQ ID NO: 133362 - RNA, 64 nt, Homo Sapiens; identical to SEQ ID NO: 49099

SEQ ID NO: 133363 - RNA, 64 nt, Homo Sapiens; identical to SEQ ID NO: 49100

SEQ ID NO: 133364 - RNA, 64 nt, Homo Sapiens; identical to SEQ ID NO: 49101

SEQ ID NO: 133365 - RNA, 64 nt, Homo Sapiens; identical to SEQ ID NO: 49102

SEQ ID NO: 133366 - RNA, 64 nt, Homo Sapiens; identical to SEQ ID NO: 49103

SEQ ID NO: 133367 - RNA, 64 nt, Homo Sapiens; identical to SEQ ID NO: 49104

SEQ ID NO: 133368 - RNA, 64 nt, Homo Sapiens; identical to SEQ ID NO: 49105

SEQ ID NO: 133369 - RNA, 64 nt, Homo Sapiens; identical to SEQ ID NO: 49106

SEQ ID NO: 133370 - RNA, 64 nt, Homo Sapiens; identical to SEQ ID NO: 49107

SEQ ID NO: 133371 - RNA, 64 nt, Homo Sapiens; identical to SEQ ID NO: 49108

SEQ ID NO: 133372 - RNA, 64 nt, Homo Sapiens; identical to SEQ ID NO: 49109

SEQ ID NO: 133373 - RNA, 64 nt, Homo Sapiens; identical to SEQ ID NO: 49110

SEQ ID NO: 133374 - RNA, 64 nt, Homo Sapiens; identical to SEQ ID NO: 49111

SEQ ID NO: 133375 - RNA, 64 nt, Homo Sapiens; identical to SEQ ID NO: 49112

SEQ ID NO: 133376 - RNA, 64 nt, Homo Sapiens; identical to SEQ ID NO: 49113

SEQ ID NO: 133377 - RNA, 64 nt, Homo Sapiens; identical to SEQ ID NO: 49114

SEQ ID NO: 133378 - RNA, 64 nt, Homo Sapiens; identical to SEQ ID NO: 49115

SEQ ID NO: 133379 - RNA, 64 nt, Homo Sapiens; identical to SEQ ID NO: 49116

SEQ ID NO: 133380 - RNA, 64 nt, Homo Sapiens; identical to SEQ ID NO: 49117

SEQ ID NO: 133381 - RNA, 64 nt, Homo Sapiens; identical to SEQ ID NO: 49118

SEQ ID NO: 133382 - RNA, 64 nt, Homo Sapiens; identical to SEQ ID NO: 49119

SEQ ID NO: 133383 - RNA, 64 nt, Homo Sapiens; identical to SEQ ID NO: 49120

SEQ ID NO: 133384 - RNA, 64 nt, Homo Sapiens; identical to SEQ ID NO: 49121

SEQ ID NO: 133385 - RNA, 64 nt, Homo Sapiens; identical to SEQ ID NO: 49122

SEQ ID NO: 133386 - RNA, 64 nt, Homo Sapiens; identical to SEQ ID NO: 49123

SEQ ID NO: 133387 - RNA, 64 nt, Homo Sapiens; identical to SEQ ID NO: 49124

SEQ ID NO: 133388 - RNA, 64 nt, Homo Sapiens; identical to SEQ ID NO: 49125

SEQ ID NO: 133389 - RNA, 64 nt, Homo Sapiens; identical to SEQ ID NO: 49126

SEQ ID NO: 133390 - RNA, 64 nt, Homo Sapiens; identical to SEQ ID NO: 49127

SEQ ID NO: 133391 - RNA, 64 nt, Homo Sapiens; identical to SEQ ID NO: 49128

SEQ ID NO: 133392 - RNA, 64 nt, Homo Sapiens; identical to SEQ ID NO: 49129

SEQ ID NO: 133393 - RNA, 64 nt, Homo Sapiens; identical to SEQ ID NO: 49130

SEQ ID NO: 133394 - RNA, 64 nt, Homo Sapiens; identical to SEQ ID NO: 49131

SEQ ID NO: 133395 - RNA, 64 nt, Homo Sapiens; identical to SEQ ID NO: 49132

SEQ ID NO: 133396 - RNA, 64 nt, Homo Sapiens; identical to SEQ ID NO: 49133

SEQ ID NO: 133397 - RNA, 64 nt, Homo Sapiens; identical to SEQ ID NO: 49134

SEQ ID NO: 133398 - RNA, 64 nt, Homo Sapiens; identical to SEQ ID NO: 49135

SEQ ID NO: 133399 - RNA, 64 nt, Homo Sapiens; identical to SEQ ID NO: 49136

SEQ ID NO: 133400 - RNA, 64 nt, Homo Sapiens; identical to SEQ ID NO: 49137

SEQ ID NO: 133401 - RNA, 64 nt, Homo Sapiens; identical to SEQ ID NO: 49138

SEQ ID NO: 133402 - RNA, 64 nt, Homo Sapiens
aauuuuucucucuuagaucuuccagcagccccagggguaggaagcuccucuuaguacuaagaga

SEQ ID NO: 133403 - RNA, 64 nt, Homo Sapiens
uacuacccccuucuacacucagcucccagacacaggguaggaggggggacugcuggcuacugca

SEQ ID NO: 133404 - RNA, 64 nt, Homo Sapiens
auuggagagagaauugcacaaugacuuugggaguggguaggaucuuuuacaugucuguguauuc

SEQ ID NO: 133405 - RNA, 64 nt, Homo Sapiens
agccuuuccucagucugagauuacggacaccauaggguaggaauccccuaugucagaggagguc

SEQ ID NO: 133406 - RNA, 64 nt, Homo Sapiens; identical to SEQ ID NO: 105086

SEQ ID NO: 133407 - RNA, 64 nt, Homo Sapiens; identical to SEQ ID NO: 105087

SEQ ID NO: 133408 - RNA, 64 nt, Homo Sapiens; identical to SEQ ID NO: 105088

SEQ ID NO: 133409 - RNA, 64 nt, Homo Sapiens; identical to SEQ ID NO: 105089

SEQ ID NO: 133410 - RNA, 64 nt, Homo Sapiens
augcacaaacuuggcuucuuuaaccaagaauauuauuggaaaauucucuaaaaguuaauagggu

SEQ ID NO: 133411 - RNA, 64 nt, Homo Sapiens
ugggccaaagaaacauugccuugaggaagauaugauuggaaaaucaagaguguagaagaauaaa

SEQ ID NO: 133412 - RNA, 64 nt, Homo Sapiens
ccacugucuguguuuuuuugcuuuguuaaguucuauuggaaaaauuauuguauuuguuucuggu

SEQ ID NO: 133413 - RNA, 64 nt, Homo Sapiens
auuucauaugcaaagcauauugcuuuauauuuagauuggaaagacauugccaaaaacuaaaugg

SEQ ID NO: 133414 - RNA, 64 nt, Homo Sapiens
aagaaaaaaggccuugaauugguuaaauguaucaauuggaaaggcuaaaugucugucucuaaag

SEQ ID NO: 133415 - RNA, 64 nt, Homo Sapiens
auugaauauauuguaggauuuuguucaaaagauaauuggaaaaauaaauauauuuugcaaauug

SEQ ID NO: 133416 - RNA, 59 nt, Homo Sapiens
gcuaaaauuuuaauauaguuauaaacuuuauuggaaaaucacuaauuaaagaagauuga

SEQ ID NO: 133417 - RNA, 64 nt, Homo Sapiens
auacuaguccuuuuaaggggaguuuuuguuagagauuggaaauuaucugugagauuugacacua

SEQ ID NO: 133418 - RNA, 64 nt, Homo Sapiens
aaaauuuuucaaagaacaaaugcuugcauccuagauuggaaauuuucaaauaaacauauauucu

SEQ ID NO: 133419 - RNA, 64 nt, Homo Sapiens
auauuaacaggguagcuccugagccuuucccuuuauuggaaacuuuaacugcaguguuaauaua

SEQ ID NO: 133420 - RNA, 64 nt, Homo Sapiens
uuaucuuuuuuuggagggguggaugcugcauuucauuggaaaugucauuuuuccaaaguuucua

SEQ ID NO: 133421 - RNA, 64 nt, Homo Sapiens
uuuuaaacaaccaagcuaaacauugcuguauuauauuggaaaaguuuuaaaaagaaauuauucu

SEQ ID NO: 133422 - RNA, 64 nt, Homo Sapiens
ucuucuagcugaaucugaaaaauacaucuuaaacauuggaaagcucaaaccauuaaggguuaaa

SEQ ID NO: 133423 - RNA, 64 nt, Homo Sapiens
acucauuucaauguuuuccugagguggagccuucauuggaaaggggaaagagggauucuagggu

SEQ ID NO: 133424 - RNA, 64 nt, Homo Sapiens
uuuuggucugacauuuuuguagccuucuguuauuauuggaaauagucucuuacauaagcugauu

SEQ ID NO: 133425 - RNA, 64 nt, Homo Sapiens
uucuuucaagaaucuuuagagauaaggauugcacauuggaaaaguaaaccauguuucauuccuu

SEQ ID NO: 133426 - RNA, 64 nt, Homo Sapiens
cuuagccaguuuguuuuucagagccuguagucuuauuggaaaucuauuuuaucagugugcuuua

SEQ ID NO: 133427 - RNA, 64 nt, Homo Sapiens
uucccagaacuuauuagaaacgauuccggauggcauuggaaaacuaaagaaacugucaaucuug

SEQ ID NO: 133428 - RNA, 64 nt, Homo Sapiens
gaaauuguuauuuuaacagacccugccuaaaagcauuggaaaacuaaagaaguugagcaacuug

SEQ ID NO: 133429 - RNA, 64 nt, Homo Sapiens
uuuucucuguccugaacccccagguaugggugaaauuggaaauuacuaaucuauuggaaaucag

SEQ ID NO: 133430 - RNA, 64 nt, Homo Sapiens
cccagguaugggugaaauuggaaauuacuaaucuauuggaaaucaguuccugacauaguaaagu

SEQ ID NO: 133431 - RNA, 64 nt, Homo Sapiens
cugugacaucuguugaacauaugugguuguauauauuggaaauguacauauccaauaugaaaua

SEQ ID NO: 133432 - RNA, 64 nt, Homo Sapiens
cugcaccuguauucauuguggaacuuccucuuucauuggaaacuuucuuacucaagaaugacgg

SEQ ID NO: 133433 - RNA, 64 nt, Homo Sapiens
gccagaaaucuuugccaagguccugguuaaaaaaauuggaaacgguuuucuuagccccagcuuu

SEQ ID NO: 133434 - RNA, 64 nt, Homo Sapiens
gauggcccugcuccuuuucugcugaacauuuaguauuggaaacuccuacuucccuuuucauuaa

SEQ ID NO: 133435 - RNA, 64 nt, Homo Sapiens
gauggcucacugauuuuugaaaagccugaauaaaauuggaaagacuggaaaguuaggagaacug

SEQ ID NO: 133436 - RNA, 64 nt, Homo Sapiens
auagaaucaagagcaaaacugcacaaacuugcacauuggaaagugcaacaaguucccgugauug

SEQ ID NO: 133437 - RNA, 64 nt, Homo Sapiens
caaguucuugacauuggucuguuuugcugugaauauuggaaaugcuuaggaucuucagacccaa

SEQ ID NO: 133438 - RNA, 64 nt, Homo Sapiens
acuacuucuauaaugcuuauuaugguaaaauaaaauuggaaaaaauuaaaacugaccuauaaga

SEQ ID NO: 133439 - RNA, 64 nt, Homo Sapiens
uguauccagucugaagaugugacccgcaacaaguauuggaaaaaaggguacaugcuuuaaaacc

SEQ ID NO: 133440 - RNA, 64 nt, Homo Sapiens
aaaagaggcccaagugcaaaaagccuuuuccugaauuggaaaggaacaagauaccaggcacuua

SEQ ID NO: 133441 - RNA, 64 nt, Homo Sapiens
uguauaaaaugaguauucccauuaauagucacugauuggaaauuauucuguugcuguuugucaa

SEQ ID NO: 133442 - RNA, 64 nt, Homo Sapiens
gcuuuguuuuuguuuuucuuuuguaccuagucucauuggaaaugacuaguauucugccucauuu

SEQ ID NO: 133443 - RNA, 64 nt, Homo Sapiens
cugcuccuuuacgauauuccaaauaguuuuuuacauuggaaaaacuaauucuugggauucuuuc

SEQ ID NO: 133444 - RNA, 64 nt, Homo Sapiens
acuauauauauauauacacacauaguuuuagcaaauuggaaauaauauauucauuuguauggca

SEQ ID NO: 133445 - RNA, 64 nt, Homo Sapiens
caguugucuugaggguaugauaaguccacaaaaaauuggaaagcaucuuacccauuuucuucac

SEQ ID NO: 133446 - RNA, 64 nt, Homo Sapiens
ucugaaaacacuugcugagaaccaaauuuauuccauuggaaaaacccucuguggagcuauaagc

SEQ ID NO: 133447 - RNA, 64 nt, Homo Sapiens
aacucuauggcuugggcacgauuaaacaaaucacauuggaaauaauuuuauuuuaccugagaaa

SEQ ID NO: 133448 - RNA, 64 nt, Homo Sapiens
uacucuauaaauguguggaaacacaaaaggacucauuggaaagaucucucagcuccuugcacag

SEQ ID NO: 133449 - RNA, 64 nt, Homo Sapiens
uuagguauuaaacacuucagaauaucaauguaaaauuggaaaauaaggaacugggggcauuugu

SEQ ID NO: 133450 - RNA, 64 nt, Homo Sapiens
agccggcuucccugagggaggagaacacuggauuauuggaaauguuuuaaucacucuugccauu

SEQ ID NO: 133451 - RNA, 64 nt, Homo Sapiens
gcuguucaucccagcacugucuaagcuaguaaaaauuggaaacaauuuaaguaucuagcacauu

SEQ ID NO: 133452 - RNA, 64 nt, Homo Sapiens
aaaagaaaaguguugggaaugaagcaagugauugauuggaaaacauacugaauggaagaaauau

SEQ ID NO: 133453 - RNA, 64 nt, Homo Sapiens
aacuuugaaauauauggucuaauguuuaagcagaauuggaaaagacuaagaucgguuaacaaau

SEQ ID NO: 133454 - RNA, 64 nt, Homo Sapiens
agaaaguguucuguuacaaaauguaacuguuaccauuggaaauuucacgucauaggaaguuagc

SEQ ID NO: 133455 - RNA, 64 nt, Homo Sapiens
gaaaauacuaguaguuuuauauuuggaugacauaauuggaaaagcagauuagcugcuacuacuu

SEQ ID NO: 133456 - RNA, 64 nt, Homo Sapiens
cauuacaucacuaaauucauuagauuuugucugcauuggaaagauacucuucuagcauaucuuu

SEQ ID NO: 133457 - RNA, 64 nt, Homo Sapiens
guaugcaugaagacaugaagaggaauuuccagauauuggaaacauagccaguugaggaaguaga

SEQ ID NO: 133458 - RNA, 64 nt, Homo Sapiens
uuguguguuuaaugcaaaugacauaugugaacucauuggaaauauuguuuuaaugcuuguacgu

SEQ ID NO: 133459 - RNA, 64 nt, Homo Sapiens
cacauuauucuuuaauaaucuguuuauuaauaagccaugauauguguauguaaauauucuuaca

SEQ ID NO: 133460 - RNA, 64 nt, Homo Sapiens
aaaauguauagccugccaaauguuguuuucauaaccaugauauuguuuugaaaaaauuuuaucu

SEQ ID NO: 133461 - RNA, 64 nt, Homo Sapiens
aagaucuuuuuucagguggacagcuucauaauuuccaugauacaucuuuaaugucuaagaaauc

SEQ ID NO: 133462 - RNA, 64 nt, Homo Sapiens
gauggggaaacuaaggucagaggucucauuaucuccaugauaaauucacaauauccaaugaaga

SEQ ID NO: 133463 - RNA, 64 nt, Homo Sapiens
aaggaaccaacuguaggcaccucuccagggccuagggagacaaguguccucucuucugcauaca

SEQ ID NO: 133464 - RNA, 64 nt, Homo Sapiens
gucucagaaugggacugccaacuggcucauuggugggagacacaguauccucaaaccuguggcc

SEQ ID NO: 133465 - RNA, 64 nt, Homo Sapiens
agcuuuggagacacaaaagauccugccccaggucgggagacagcagagagguauccucagcccc

SEQ ID NO: 133466 - RNA, 64 nt, Homo Sapiens
cggaggagcaggugggaagaccggcugcgagagagggagacaccgaugagacgccaugcagauc

SEQ ID NO: 133467 - RNA, 64 nt, Homo Sapiens
aauauauaauugaaucagaguaaucauaaugcaggggagacauucaaauuagagacaagggaga

SEQ ID NO: 133468 - RNA, 64 nt, Homo Sapiens
uguuccauuuugcaacauccugcaacaccauccugggagacaagagcauuacccagcuuggcuu

SEQ ID NO: 133469 - RNA, 64 nt, Homo Sapiens
ugcaccccugaguugggcagccuggcauggugcagggagacaucgccucccauucugcaccaca

SEQ ID NO: 133470 - RNA, 64 nt, Homo Sapiens
gcugcuccccaacaccugcccccuggaggacagagggagacaggcuccucaggcccagcugcuc

SEQ ID NO: 133471 - RNA, 64 nt, Homo Sapiens
uaguuauaagugaagcaugguugaauaccagcuggggagacacuagggaagggagcuuuguaag

SEQ ID NO: 133472 - RNA, 64 nt, Homo Sapiens
aacggaugcaagucacagucuuaacacagccugugggagacaagcaguuugugugcucacagua

SEQ ID NO: 133473 - RNA, 64 nt, Homo Sapiens
ccaccugcagagguccccagacccaaagcaggacgggagacaacugcuuggaggagcgaagagc

SEQ ID NO: 133474 - RNA, 64 nt, Homo Sapiens
agcugauucacaggaggaggggagguuggggggcgggagacaaaaaccacaccucuuuuuauau

SEQ ID NO: 133475 - RNA, 64 nt, Homo Sapiens
uugaggggacggcaggcccggcugcccuggaacugggagacagggagaauccccugccgggguc

SEQ ID NO: 133476 - RNA, 64 nt, Homo Sapiens
ugagggggcugaggcaugagaaucacuugaaccugggagacagagguugcaaugaaccgagaua

SEQ ID NO: 133477 - RNA, 64 nt, Homo Sapiens
accuuucccaugccuccucuggagccuucgccuggggagacagaacccagagagaaacaagaga

SEQ ID NO: 133478 - RNA, 64 nt, Homo Sapiens
gaugagcccagauuucuucccccuccaucucucagggagacaaagaaccuccuuccuggaccaa

SEQ ID NO: 133479 - RNA, 64 nt, Homo Sapiens
caagguaugccugauggcugagugacaucauccagggagacacaacucaauggacauccguugc

SEQ ID NO: 133480 - RNA, 64 nt, Homo Sapiens
aaaucucauccacagcuaccuauggagaacagaagggagacaagacuucucaccaaucagacuu

SEQ ID NO: 133481 - RNA, 64 nt, Homo Sapiens
gaccaagagcaggggauagaagaaauccagaguggggagacagagagacgcagaagagaggaac

SEQ ID NO: 133482 - RNA, 64 nt, Homo Sapiens
gaccuggagggugggguauggagacucagggagagggagacaaugacccaaagggagagaaaca

SEQ ID NO: 133483 - RNA, 64 nt, Homo Sapiens
uagacacuacuuauuuguuaauauguaucuacaugggagacagguuuuuuaaagcaaauccugu

SEQ ID NO: 133484 - RNA, 64 nt, Homo Sapiens
cucauggcucauggcucaugagggcugggcagcugggagacaggcaauauuggaggcugacugu

SEQ ID NO: 133485 - RNA, 64 nt, Homo Sapiens
gaaaaauuacuuuuuguuuguuuauaaacucagacuugccuauuuuauuuuaaaagcggcuuac

SEQ ID NO: 133486 - RNA, 64 nt, Homo Sapiens
auaauaccaagagcuuguauuguuaccuuagucacuugccuagcaguguguggcuuuaaaaacu

SEQ ID NO: 133487 - RNA, 64 nt, Homo Sapiens
aagcacuuugucucuguucaugugugaaugugaacuugccuaguuaauagauggggucaaauuc

SEQ ID NO: 133488 - RNA, 64 nt, Homo Sapiens
cuugaagaaaaaaaacaaaauucccacugcuucacuugccuaguauuucuuuguuccuucucca

SEQ ID NO: 133489 - RNA, 64 nt, Homo Sapiens
gcuccuccgguuggccuggaacccacucuuccccgccucacaggaugcccaggcagccacagaa

SEQ ID NO: 133490 - RNA, 64 nt, Homo Sapiens
agagauacuugcaguuccaggcacagggcaggaggccucacagaaucccucaccuaguccugcu

SEQ ID NO: 133491 - RNA, 64 nt, Homo Sapiens
caauuaacugccuugaacauagagaaaaauuaaggccucacaggaugagucuccauucucugua

SEQ ID NO: 133492 - RNA, 64 nt, Homo Sapiens
uguucccacaacaauggcccuuucacaagcucuugccucacaaccccugcagaaguccuucaac

SEQ ID NO: 133493 - RNA, 64 nt, Homo Sapiens
uggggcuguuaccuuccucagcuuccaggcuggggccucacaggaagcccggcucuccuacucu

SEQ ID NO: 133494 - RNA, 64 nt, Homo Sapiens
cuuucugcuggggcugaaguagugccuuccuccagccucacaacggacuggaugugccgugggc

SEQ ID NO: 133495 - RNA, 64 nt, Homo Sapiens
gauucaucuucauaaucuccaguuuuuucacagugccucacagaguuaaucaugccuuuuggag

SEQ ID NO: 133496 - RNA, 64 nt, Homo Sapiens
agagauuccucaguaaucuccaaucucucauagugccucacaggguuggucaauggcuuuugga

SEQ ID NO: 133497 - RNA, 64 nt, Homo Sapiens
caccgauucagcugccaggguucggacagauugggccucacagcuuuccacacgugccuuugau

SEQ ID NO: 133498 - RNA, 64 nt, Homo Sapiens
ggaaggggauggguaguggaggccuggguggucggccucacauguauuuuagggguuguuuggg

SEQ ID NO: 133499 - RNA, 64 nt, Homo Sapiens
cccggagggccugcucccggccccccugcacucugccucacaaaggucuauauuauauaaaucu

SEQ ID NO: 133500 - RNA, 64 nt, Homo Sapiens
uugagcugcugcugucacuccuccaccgagggaggccucacaaaccacaggacgcugcaacggg

SEQ ID NO: 133501 - RNA, 64 nt, Homo Sapiens
cgcugaguuggguuugugacucuucccucucccugccucacaggauugugacuccccagccccu

SEQ ID NO: 133502 - RNA, 64 nt, Homo Sapiens
ggaucugagaugguuuuugcaucuuuccaggagagccucacauucuucuuccagguuguaucac

SEQ ID NO: 133503 - RNA, 64 nt, Homo Sapiens
agggagggggccccacaggccaccccagacgagagccucacaggauguaaaucagaaaugcaga

SEQ ID NO: 133504 - RNA, 64 nt, Homo Sapiens
agcaguuugugggcugguuugggcuggccccacagccucacaggaccuguuugcauggagaaau

SEQ ID NO: 133505 - RNA, 64 nt, Homo Sapiens
uggcaaccugagccacacaggccuccaccccugcgccucacaggggucgcuggcguuggagcgg

SEQ ID NO: 133506 - RNA, 64 nt, Homo Sapiens
gcuucuuaacagauggcauuuucugugacucuaggccucacaaaagagccagaguucuggaccc

SEQ ID NO: 133507 - RNA, 64 nt, Homo Sapiens
cagugacaccucggguccuugaugaccucucgcugccucacaaggguucccacuaggaugcaga

SEQ ID NO: 133508 - RNA, 64 nt, Homo Sapiens
caggaaauuuggaaauccuaugccgaaccaggccgccucacagcagggagaaaucgguaacagu

SEQ ID NO: 133509 - RNA, 64 nt, Homo Sapiens
agggagaagacaaggccccagcccuccucugggagccucacaccugagaccagcaggacaaggc

SEQ ID NO: 133510 - RNA, 64 nt, Homo Sapiens
ccaccaugcgggccucagguggcagagaggcccagccucacaggccuguggccccacacaccag

SEQ ID NO: 133511 - RNA, 62 nt, Homo Sapiens
auuaaacuccuggaucuucaucccauuaccagaaagaccaaaaaacuaugaagaaacagaag

SEQ ID NO: 133512 - RNA, 62 nt, Homo Sapiens
uucccuuugauggcuguguguuuucucuuuuuaaagaccaacguguccuuguuuuuccuugu

SEQ ID NO: 133513 - RNA, 62 nt, Homo Sapiens
gaaguugucauucagggccccucauguagccaaaagaccaagaaaaaucuggcccacagaua

SEQ ID NO: 133514 - RNA, 62 nt, Homo Sapiens
uuuuauucagguugaucuguugaauauuugcuaaagaccaguucuuuaagcuaagacaugua

SEQ ID NO: 133515 - RNA, 62 nt, Homo Sapiens
uacccagcacccaugaaauauuuuugucuuaaaaagaccacaaguaaaaccaugcuguagaa

SEQ ID NO: 133516 - RNA, 62 nt, Homo Sapiens
guaauuuuucugaacuucuguauugacauguaaaagaccaaagaaagaaccucuuuccugaa

SEQ ID NO: 133517 - RNA, 62 nt, Homo Sapiens
uauguaaccauuuuaaacgugguuucuauaggaaagaccaacauuuguuuagcuugcuuggc

SEQ ID NO: 133518 - RNA, 62 nt, Homo Sapiens
auggaaaccccaguggaaucagauuuucccucaaagaccaugaugguaucggacuaguuuuc

SEQ ID NO: 133519 - RNA, 62 nt, Homo Sapiens
aucuggaguuugaggugugugaguacaaacugaaagaccacuucaaagccaaggacgucgau

SEQ ID NO: 133520 - RNA, 62 nt, Homo Sapiens
agucguauuggaaguacuaccggaacacauccaaagaccaucaguacugaggagaaagcuaa

SEQ ID NO: 133521 - RNA, 62 nt, Homo Sapiens
ccaugccuucaagucagcaucaggcuuagggcaaagaccaggccucugaagcugccucuugu

SEQ ID NO: 133522 - RNA, 62 nt, Homo Sapiens
agcuucuugggacuucaaccaucuucuuucugaaagaccaaaucuaauguaaccaguaacgu

SEQ ID NO: 133523 - RNA, 62 nt, Homo Sapiens
auuuuuuaucuagagaccagcauguucuccccaaagaccaagauauucugccaaaauaucag

SEQ ID NO: 133524 - RNA, 62 nt, Homo Sapiens
auuuuuugucuagagaccagcauguucuccccaaagaccagaauauucuaccuaaauaucaa

SEQ ID NO: 133525 - RNA, 62 nt, Homo Sapiens
uaccuaaauaucaaggccaggauuuucuaccuaaagaccaggacuuuuuaucuagagaccag

SEQ ID NO: 133526 - RNA, 62 nt, Homo Sapiens
auuuucuacccagagaccaagguguucuucccaaagaccaaaauauucuacccauaugucag

SEQ ID NO: 133527 - RNA, 62 nt, Homo Sapiens
auuuucuacccagagaccaagguuaucuuccuaaagaccaaaauauucuacccauaugucag

SEQ ID NO: 133528 - RNA, 62 nt, Homo Sapiens
aaccauguauauucaccacuaggacagguuaaaaagaccauuguauguuuuucuauuucuga

SEQ ID NO: 133529 - RNA, 62 nt, Homo Sapiens
auggcuauuagaaauccacauucuuacacaagaaagaccauauuagaaucuaaggaaaacau

SEQ ID NO: 133530 - RNA, 62 nt, Homo Sapiens
acaaagucuccaagaaauaugggacuaugugaaaagaccaaaucuaccucugauugguguac

SEQ ID NO: 133531 - RNA, 62 nt, Homo Sapiens
auaccagccgcugcaaaaucaugccaaaauguaaagaccaucgagacuaggaagaaacugca

SEQ ID NO: 133532 - RNA, 64 nt, Homo Sapiens
aaaauauaucuaaaguauugguaaucuaauaaauccauucuagaggucaaaugcuuuccaaaaa

SEQ ID NO: 133533 - RNA, 64 nt, Homo Sapiens
uuuaacuuccauaucugccauacaguccuugcauccauucuauuacuacaccaaacaccuuuag

SEQ ID NO: 133534 - RNA, 64 nt, Homo Sapiens
auuuuaaugcauagcaguauguuugaaaaauagaccauucuaaaaagcccaugauaccuuacug

SEQ ID NO: 133535 - RNA, 64 nt, Homo Sapiens
ggugccaugaaguuggggaguugggugaauuaucccauucuaguuacagaggagcuuuccuuaa

SEQ ID NO: 133536 - RNA, 64 nt, Homo Sapiens
ggucacugaaaggcccuguaccuguacugugaguccauucuagauacaugccuucacaucacaa

SEQ ID NO: 133537 - RNA, 64 nt, Homo Sapiens
uggagauuuggcuuuuccaagucccagauaguucccauucuacuuuaaacuauucugucuagau

SEQ ID NO: 133538 - RNA, 64 nt, Homo Sapiens
uauuuuauaauugagaacucuuacauaguagaauccauucuauaauacauguguugacaaagcu

SEQ ID NO: 133539 - RNA, 64 nt, Homo Sapiens
uugauagccugguuaaaaguuagauccucuauuaccauucuaagcacauucacuucuauauuga

SEQ ID NO: 133540 - RNA, 63 nt, Homo Sapiens
cccacaagcuaccuggaggggccagcaaguccugcuguccacauguccuugugcccacacuga

SEQ ID NO: 133541 - RNA, 63 nt, Homo Sapiens
cuuggcccccucguccccaucuucuccccuccugcuguccaugcugccucucggccccuccgc

SEQ ID NO: 133542 - RNA, 63 nt, Homo Sapiens
cuuaauagacuucucuuacauaaauaacccugggcuguccagcgacuuggggcugagagagua

SEQ ID NO: 133543 - RNA, 63 nt, Homo Sapiens
cagacuuugagccugcaucuuugcuugagccuggcuguccaacuuuccgacacauuuaccaaa

SEQ ID NO: 133544 - RNA, 63 nt, Homo Sapiens
accuggaggcugagcaggccggaguggauggaugcuguccagacguagccaccuggccucugu

SEQ ID NO: 133545 - RNA, 63 nt, Homo Sapiens
accagaacccuggggucagacccaucuccuguagcuguccaucacacugacaggcuucuuccu

SEQ ID NO: 133546 - RNA, 63 nt, Homo Sapiens
uucugcuauggaaacaaugcugcuuuucucucagcuguccaaaguucagccguuccuccuucc

SEQ ID NO: 133547 - RNA, 63 nt, Homo Sapiens
cuaggagaggaggauggggggcugagcacucaggcuguccauugaaaccccuuguccaugaau

SEQ ID NO: 133548 - RNA, 63 nt, Homo Sapiens
uugagucagacugcucccggcagccuuuguccagcuguccacaauucccacaucuugccaaga

SEQ ID NO: 133549 - RNA, 63 nt, Homo Sapiens
ugcaugugacuccucaaaccgacacagucuugagcuguccacagccaggagauggggugaagg

SEQ ID NO: 133550 - RNA, 64 nt, Homo Sapiens
gcuagcgucccuacugccucccgacuccucaguggaggaggagcugcggucccucuggugucug

SEQ ID NO: 133551 - RNA, 64 nt, Homo Sapiens
agcuaaucccauggcgagaugggggcucacuccggaggaggagccaggcagcagggccuuccug

SEQ ID NO: 133552 - RNA, 64 nt, Homo Sapiens
gcuugagguuccaaccuggagccacagugugugagaggaggaggagagggagaauucuguucuc

SEQ ID NO: 133553 - RNA, 64 nt, Homo Sapiens
ugagguuccaaccuggagccacagugugugagaggaggaggagagggagaauucuguucuccca

SEQ ID NO: 133554 - RNA, 64 nt, Homo Sapiens
aacuuggauaggcaguagauauuuuugcccaccugaggaggaacucagucaagcuguugcuuaa

SEQ ID NO: 133555 - RNA, 64 nt, Homo Sapiens
cauuuguucuuuccagagcuaacugauaagaguggaggaggaaugccuucuccuaagagucagu

SEQ ID NO: 133556 - RNA, 64 nt, Homo Sapiens
cagauacauggggaacugcauaucggaggugguggaggaggaggaggaggaggaaggcaaagcc

SEQ ID NO: 133557 - RNA, 64 nt, Homo Sapiens
auacauggggaacugcauaucggaggugguggaggaggaggaggaggaggaaggcaaagccccu

SEQ ID NO: 133558 - RNA, 64 nt, Homo Sapiens
cauggggaacugcauaucggaggugguggaggaggaggaggaggaggaaggcaaagccccugga

SEQ ID NO: 133559 - RNA, 64 nt, Homo Sapiens
ggggaacugcauaucggaggugguggaggaggaggaggaggaggaaggcaaagccccuggaaau

SEQ ID NO: 133560 - RNA, 64 nt, Homo Sapiens
gaacugcauaucggaggugguggaggaggaggaggaggaggaaggcaaagccccuggaaaugug

SEQ ID NO: 133561 - RNA, 64 nt, Homo Sapiens
ccacagcuucaugacccacccugaauucgccauagaggaggaguugccacgaacaccacuccug

SEQ ID NO: 133562 - RNA, 64 nt, Homo Sapiens
ggaguugccacgaacaccacuccuggaugaggaagaggaggaaaauccugacaaggcuucuaag

SEQ ID NO: 133563 - RNA, 64 nt, Homo Sapiens
ucuuuuaggacagauucucagaugggaugaucuggaggaggaggaaaaagauacacucccuugg

SEQ ID NO: 133564 - RNA, 64 nt, Homo Sapiens
uuuaggacagauucucagaugggaugaucuggaggaggaggaaaaagauacacucccuuggggc

SEQ ID NO: 133565 - RNA, 64 nt, Homo Sapiens
gcgaggacaguggcacuucaaggaggaggaggaggaggaggaagugagcaggaggaggaagagg

SEQ ID NO: 133566 - RNA, 64 nt, Homo Sapiens
aaggcgaggacaguggcacuaggaggaggaggaggaggaggaggggaugagcaggaggaggaag

SEQ ID NO: 133567 - RNA, 64 nt, Homo Sapiens
aggaaggcgaggacaguggcaagaggaggaggaggaggaggaggggaggaugagcaggaggagg

SEQ ID NO: 133568 - RNA, 64 nt, Homo Sapiens
aggaggaaggcgaggacaguaggaagaggaggaggaggaggaggggaggaggaugagcaggagg

SEQ ID NO: 133569 - RNA, 64 nt, Homo Sapiens
aggaggaggaaggcgaggacaggaggaagaggaggaggaggaggagaggaggaggaugagcagg

SEQ ID NO: 133570 - RNA, 64 nt, Homo Sapiens
aggaggaggaggaaggcgagaggaggaggaagaggaggaggaggggaagaggaggaggaugagc

SEQ ID NO: 133571 - RNA, 64 nt, Homo Sapiens
aggaggaggaggaggaaggcagcaggaggaggaagaggaggaggccuggaagaggaggaggaug

SEQ ID NO: 133572 - RNA, 64 nt, Homo Sapiens
aggaggaggaggaggaggagaggaggaugagcaggaggaggaagccugcagagccuggaagagg

SEQ ID NO: 133573 - RNA, 64 nt, Homo Sapiens
agcaggaggaggaagaggagagagccuggaagaggaggaggaugaggcagucagcagccccugc

SEQ ID NO: 133574 - RNA, 64 nt, Homo Sapiens
augagcaggaggaggaagagugcagagccuggaagaggaggaggcccaggcagucagcagcccc

SEQ ID NO: 133575 - RNA, 64 nt, Homo Sapiens
aggcucugggcuccucugcagagaggaggaggaggaggaggagaggccgggagacagaugaggc

SEQ ID NO: 133576 - RNA, 64 nt, Homo Sapiens
agaaggcucugggcuccucuggcgagaggaggaggaggaggaggucaggccgggagacagauga

SEQ ID NO: 133577 - RNA, 64 nt, Homo Sapiens
aggagaaggcucugggcuccugaggcgagaggaggaggaggaggguaucaggccgggagacaga

SEQ ID NO: 133578 - RNA, 64 nt, Homo Sapiens
aggaggagaaggcucugggcagaugaggcgagaggaggaggaggcugguaucaggccgggagac

SEQ ID NO: 133579 - RNA, 64 nt, Homo Sapiens
aggaggaggagaaggcucuggacagaugaggcgagaggaggagguaucugguaucaggccggga

SEQ ID NO: 133580 - RNA, 64 nt, Homo Sapiens
aggaggcgagggaaucagaagggaaagcagcccugaggaggaagucagacacugaccuucugcu

SEQ ID NO: 133581 - RNA, 64 nt, Homo Sapiens
cagaagauggcgucagcuucaagaggaggaggaugaggaggacagaaggaccuugcagaggacg

SEQ ID NO: 133582 - RNA, 64 nt, Homo Sapiens
aggaggacacagaagauggccagaggacgaagaggaggaggaugaagauggaagaaggaccuug

SEQ ID NO: 133583 - RNA, 64 nt, Homo Sapiens
augaggaggacacagaagauuugcagaggacgaagaggaggagggacaagauggaagaaggacc

SEQ ID NO: 133584 - RNA, 64 nt, Homo Sapiens
cagguggucuaagugcugacuggguuuauagggggaggaggaggggaaaggaggaggggagugg

SEQ ID NO: 133585 - RNA, 64 nt, Homo Sapiens
uuuagauuuagugaagaugguuugggaagcuauggaggaggacuucagcaacaaacaaacuuug

SEQ ID NO: 133586 - RNA, 64 nt, Homo Sapiens
ucuuggauguaagggaugagagcagcaucaagaggaggaggacagaaaagcaagaagaaaagac

SEQ ID NO: 133587 - RNA, 64 nt, Homo Sapiens
acaucuuggauguaagggaugacagcagcaucaagaggaggaggcaggaaaagcaagaagaaaa

SEQ ID NO: 133588 - RNA, 64 nt, Homo Sapiens
ugaaccuagaagauagagguggcagcaacaggaggaggaggacuaugcagccgaagaaagaaga

SEQ ID NO: 133589 - RNA, 64 nt, Homo Sapiens
acuugaaccuagaagauagaagaggcagcaacaggaggaggaggcccaugcagccgaagaaaga

SEQ ID NO: 133590 - RNA, 64 nt, Homo Sapiens
aagcuacagcaucugaaaggaaaggaggcagaaagaggaggaagccccaaaaaaaagaaaaaga

SEQ ID NO: 133591 - RNA, 64 nt, Homo Sapiens
uggggcccacucaacacacccagaagacccaugggaggaggaggucaaagcaaacacgugggug

SEQ ID NO: 133592 - RNA, 64 nt, Homo Sapiens
gggugagaacaccuuuccucuguaacaaguggaggaggaggagggcuucucagccaccccgugg

SEQ ID NO: 133593 - RNA, 64 nt, Homo Sapiens
agggggugagaacaccuuucugguguaacaaguggaggaggaggggggcuucucagccaccccg

SEQ ID NO: 133594 - RNA, 64 nt, Homo Sapiens
aauggguucaagaucaucauggaugaccgugcuugaggaggaagcugcuguugccaucagagga

SEQ ID NO: 133595 - RNA, 64 nt, Homo Sapiens
accgugcuugaggaggaagaugcuguugccaucagaggaggauggguuccuuucccagagguuc

SEQ ID NO: 133596 - RNA, 64 nt, Homo Sapiens
gccugccguuccaacuugccgggaggggcaagaggaggaggagaggggcgcaggacucggucaa

SEQ ID NO: 133597 - RNA, 64 nt, Homo Sapiens
agagccugccguuccaacuucaagggaggggcaagaggaggaggcugggggcgcaggacucggu

SEQ ID NO: 133598 - RNA, 64 nt, Homo Sapiens
ugggaagagguuucuguaaccccugcccuggugugaggaggaaauggcucuggccuggcugccu

SEQ ID NO: 133599 - RNA, 64 nt, Homo Sapiens
caggcaagcuggaacuuggguggggaggggacaugaggaggauaaacagcugacuguggcuuca

SEQ ID NO: 133600 - RNA, 64 nt, Homo Sapiens
ccugucccagcuccaggaaggggaguucuggguggaggaggaggaguuccucagggaguuugac

SEQ ID NO: 133601 - RNA, 64 nt, Homo Sapiens
gucccagcuccaggaaggggaguucuggguggaggaggaggaguuccucagggaguuugacgag

SEQ ID NO: 133602 - RNA, 64 nt, Homo Sapiens
aaggcugguggacagacccaagggcaggagccuagaggaggaaacuggccucuggccugggaaa

SEQ ID NO: 133603 - RNA, 64 nt, Homo Sapiens
uaacauagaugccugggccuacuuuacaguucuggaggaggagggcaguugaccuuugccaaac

SEQ ID NO: 133604 - RNA, 64 nt, Homo Sapiens
auuucacuggcagccuccacuagaauuuggugaagaggaggaggaggagauugaugacaagcaa

SEQ ID NO: 133605 - RNA, 64 nt, Homo Sapiens
ucacuggcagccuccacuagaauuuggugaagaggaggaggaggagauugaugacaagcaaguu

SEQ ID NO: 133606 - RNA, 64 nt, Homo Sapiens
cuggcagccuccacuagaauuuggugaagaggaggaggaggagauugaugacaagcaaguuacu

SEQ ID NO: 133607 - RNA, 64 nt, Homo Sapiens
ggagaaacccuugaaaagacaucaagcacagaaggaggaggaggagguuuaggucaagaagaag

SEQ ID NO: 133608 - RNA, 64 nt, Homo Sapiens
gaaacccuugaaaagacaucaagcacagaaggaggaggaggagguuuaggucaagaagaagaug

SEQ ID NO: 133609 - RNA, 64 nt, Homo Sapiens
gccagcacgccuguccucccccggggccaaggcagaggaggaggacgacauccugaccugcugc

SEQ ID NO: 133610 - RNA, 64 nt, Homo Sapiens
agcacgccuguccucccccggggccaaggcagaggaggaggacgacauccugaccugcugcuga

SEQ ID NO: 133611 - RNA, 52 nt, Homo Sapiens
gauucagcagaagauccugauggaggaggaggauaccaagagagaggugccc

SEQ ID NO: 133612 - RNA, 55 nt, Homo Sapiens
gauucagcagaagauccugauggaggaggaggauaccaagagagaggugcccaag

SEQ ID NO: 133613 - RNA, 64 nt, Homo Sapiens
uggaaaccugggguggguugggacccugagugaggaggaggagccacaccucccucaccgcgca

SEQ ID NO: 133614 - RNA, 64 nt, Homo Sapiens
agcuggaaaccugggguggggcaggacccugagugaggaggaggccccacaccucccucaccgc

SEQ ID NO: 133615 - RNA, 64 nt, Homo Sapiens
caaagaaucacaaggaaccugaggaggaagaggagaggaggaaguggagaaguuccuuagcagg

SEQ ID NO: 133616 - RNA, 64 nt, Homo Sapiens
aggagaggaggaagcaaagaaguuccuuagcagggaggaggaagaacauuuguaccccuggaga

SEQ ID NO: 133617 - RNA, 64 nt, Homo Sapiens
cuggaggccaggacacuguuaaagguuuucuggggaggaggaggugacugagaacaggcuugga

SEQ ID NO: 133618 - RNA, 64 nt, Homo Sapiens
aagacacagagacaaggugaagggccaggcccuggaggaggauggcgaguugccuuagagcgca

SEQ ID NO: 133619 - RNA, 64 nt, Homo Sapiens
ucccugggccagggucuguguuaaugcuucauaugaggaggaugcucacaguacagcaugugcc

SEQ ID NO: 133620 - RNA, 64 nt, Homo Sapiens
accuccgccagauccugcaguccugcagcgggaggaggaggagcacuacauaacuuccuacgua

SEQ ID NO: 133621 - RNA, 64 nt, Homo Sapiens
agcaccuccgccagauccugguauccugcagcgggaggaggaggugaacuacauaacuuccuac

SEQ ID NO: 133622 - RNA, 64 nt, Homo Sapiens
acaagauccucagcaacgaacuagaaaacgaagggaggaggagcggguccucugggaaguuacu

SEQ ID NO: 133623 - RNA, 64 nt, Homo Sapiens
ggaugggggcugaagagcagaaggcagaggaggagaggaggaaaugcugggaggucagcugguc

SEQ ID NO: 133624 - RNA, 64 nt, Homo Sapiens
ggaggaaaggaugggggcugagcuggucaaggcagaggaggagagugcugucugcugggagguc

SEQ ID NO: 133625 - RNA, 64 nt, Homo Sapiens
aaaugaaaaguuguucccagagcacagaggggaggaggaggacuaccaguuucucaggcugggg

SEQ ID NO: 133626 - RNA, 64 nt, Homo Sapiens
acuaaaugaaaaguuguuccgggagcacagaggggaggaggaggaucaccaguuucucaggcug

SEQ ID NO: 133627 - RNA, 64 nt, Homo Sapiens
agggggugcugcguggaaggcggcaggggcugaggaggaggagccugacuuaggagucagagcc

SEQ ID NO: 133628 - RNA, 64 nt, Homo Sapiens
agcagggggugcugcguggagcccggcaggggcugaggaggaggugccugacuuaggagucaga

SEQ ID NO: 133629 - RNA, 64 nt, Homo Sapiens
auguggaagagguaaaaagcauccacuuauggaggaggaggagaaaacuuaguuaaauaauucc

SEQ ID NO: 133630 - RNA, 64 nt, Homo Sapiens
agaauguggaagagguaaaauccauccacuuauggaggaggaggaucaaacuuaguuaaauaau

SEQ ID NO: 133631 - RNA, 64 nt, Homo Sapiens
aguggcuugacuuugagcuaaggcugaaguacaggaggaggaggaggagagggccggauguggg

SEQ ID NO: 133632 - RNA, 64 nt, Homo Sapiens
ggcuugacuuugagcuaaggcugaaguacaggaggaggaggaggagagggccggaugugggugu

SEQ ID NO: 133633 - RNA, 64 nt, Homo Sapiens
uugacuuugagcuaaggcugaaguacaggaggaggaggaggagagggccggaugugggugugga

SEQ ID NO: 133634 - RNA, 64 nt, Homo Sapiens
uuuccccacugcaggacccacuuugagaaggaccgaggaggaggauuuggguuguuuuguuagg

SEQ ID NO: 133635 - RNA, 64 nt, Homo Sapiens
ccccacugcaggacccacuuugagaaggaccgaggaggaggauuuggguuguuuuguuaggggu

SEQ ID NO: 133636 - RNA, 64 nt, Homo Sapiens
uacugugcugaaagucagcccacgucggagcggugaggaggagccacagcacauggggugccac

SEQ ID NO: 133637 - RNA, 64 nt, Homo Sapiens
cuccagaguguucucagcuagauuugauuugguugaggaggaacuguggcccuccguaaguuau

SEQ ID NO: 133638 - RNA, 64 nt, Homo Sapiens
gcgcgagugagcaggggccaaggaggagaaggaggaggaggagacuggagcucaagcagugagg

SEQ ID NO: 133639 - RNA, 63 nt, Homo Sapiens
agagcgcgagugagcaggggggaggaggagaaggaggaggaggcccuggagcucaagcaguga

SEQ ID NO: 133640 - RNA, 51 nt, Homo Sapiens
aggaggaggaggagagcgcgggaggaggagacccuggagcucaagcaguga

SEQ ID NO: 133641 - RNA, 64 nt, Homo Sapiens
cacucuccaauugacccgccugggaacaagggaugaggaggaguugggggcuggggggaauccu

SEQ ID NO: 133642 - RNA, 64 nt, Homo Sapiens
aaguaagcugcuuagaaggcccuggaagggaagugaggaggagggacaaggaagaugacuaguu

SEQ ID NO: 133643 - RNA, 64 nt, Homo Sapiens
gggaaggcuggcagguagguguacuuguugggaggaggaggaaacuggggacagaagggcccau

SEQ ID NO: 133644 - RNA, 64 nt, Homo Sapiens
aaagggaaggcuggcagguacauguacuuguugggaggaggaggccacuggggacagaagggcc

SEQ ID NO: 133645 - RNA, 64 nt, Homo Sapiens
ccggggacccacucugcccagccggagggacgcggaggaggaagaggguagacaggggcgaccu

SEQ ID NO: 133646 - RNA, 64 nt, Homo Sapiens
ccucccucuuuuccccuugcccccucugcagccggaggaggagauguugaggggaggaggccag

SEQ ID NO: 133647 - RNA, 64 nt, Homo Sapiens
ggaagcgcagcagcgggagcuaggggcgggggcggaggaggacacgaacuggaaggggguucac

SEQ ID NO: 133648 - RNA, 64 nt, Homo Sapiens
ucgggccuuuggcgagagcuccacggaaagugaugaggaggaagaagagggcuguggucauaca

SEQ ID NO: 133649 - RNA, 64 nt, Homo Sapiens
uucccucucuucugccugauagagggaagaggaagaggaggacgaacagagauccugaaauucu

SEQ ID NO: 133650 - RNA, 64 nt, Homo Sapiens
agacucugucucaauuaauuuuuuuuuuuuaaaggaggaggaucuccauggguaagugguuucu

SEQ ID NO: 133651 - RNA, 64 nt, Homo Sapiens
gggggcagagaagugaugaagggaaauguucuuagaggaggaaauauccuuuguccuguucaga

SEQ ID NO: 133652 - RNA, 64 nt, Homo Sapiens
ucaugcuggagggaggcugggcggguacagcgcggaggaggagggaggccaggcgggcauggcg

SEQ ID NO: 133653 - RNA, 64 nt, Homo Sapiens
cggaggaggagggaggccaggcgggcauggcguggaggaggagggaggccgggcggucacagca

SEQ ID NO: 133654 - RNA, 64 nt, Homo Sapiens
uggaggaggagggaggccgggcggucacagcauggaggaggagggaggcgcugcugguguucuu

SEQ ID NO: 133655 - RNA, 64 nt, Homo Sapiens
ccgggugccuguuugguggccagggcagccugaggaggaggaggcggucccacagcucuccucc

SEQ ID NO: 133656 - RNA, 64 nt, Homo Sapiens
aggccgggugccuguuugguucccagggcagccugaggaggaggaggcggucccacagcucucc

SEQ ID NO: 133657 - RNA, 64 nt, Homo Sapiens
cagcucccucgcuccaguggggugugccccagaggaggaggaaucccagccacguuuacaggaa

SEQ ID NO: 133658 - RNA, 64 nt, Homo Sapiens
aaucagcucccucgcuccaggaaggugugccccagaggaggaggggccccagccacguuuacag

SEQ ID NO: 133659 - RNA, 64 nt, Homo Sapiens
ugucuccaccccaugggcccacacccaggugggggaggaggaagccacugcaucuguuggcuca

SEQ ID NO: 133660 - RNA, 64 nt, Homo Sapiens
gggcaucugucugugggagcccagaggcugcagggaggaggaggagggagguaucuggugugag

SEQ ID NO: 133661 - RNA, 64 nt, Homo Sapiens
caucugucugugggagcccagaggcugcagggaggaggaggagggagguaucuggugugagcgu

SEQ ID NO: 133662 - RNA, 64 nt, Homo Sapiens
gagggcccaggcaggcggccuauccugauccuuggaggaggaggaagaggaggccacuguggcc

SEQ ID NO: 133663 - RNA, 64 nt, Homo Sapiens
ggcccaggcaggcggccuauccugauccuuggaggaggaggaagaggaggccacuguggcccgu

SEQ ID NO: 133664 - RNA, 64 nt, Homo Sapiens
gauucuguagugaagaggucugacaccauguguggaggaggaggaacgaucagucaagagaugu

SEQ ID NO: 133665 - RNA, 64 nt, Homo Sapiens
ucuguagugaagaggucugacaccauguguggaggaggaggaacgaucagucaagagauguccu

SEQ ID NO: 133666 - RNA, 64 nt, Homo Sapiens
gccuggggaggagggggaggaagacaagaaggaagaggaggaggagaaggaagacgaggagcug

SEQ ID NO: 133667 - RNA, 64 nt, Homo Sapiens
uggggaggagggggaggaagacaagaaggaagaggaggaggagaaggaagacgaggagcuggac

SEQ ID NO: 133668 - RNA, 64 nt, Homo Sapiens
aaagggaagaauuagguuugggcggguugggugggaggaggaagaaggcucaucuugagaagca

SEQ ID NO: 133669 - RNA, 64 nt, Homo Sapiens
aaagggaagaauuagguuugggcggguugggugggaggaggaaguuuguugccacugagaagca

SEQ ID NO: 133670 - RNA, 64 nt, Homo Sapiens
aaagaugaggauugcauacagaaugaaugacagagaggaggaaaucaacuaaauuuuaaugaac

SEQ ID NO: 133671 - RNA, 64 nt, Homo Sapiens
ugcuagagaacagcaggucuacugagucuacauggaggaggaaaguauuuaaguggauugaaua

SEQ ID NO: 133672 - RNA, 64 nt, Homo Sapiens
uugguggguuucauacacccacccucucaaggcagaggaggagucagggcacauuucugaccga

SEQ ID NO: 133673 - RNA, 64 nt, Homo Sapiens
uguuuauugucacugggaauguaaacauugaagagaggaggauuggcaguuaacuggcuuuaca

SEQ ID NO: 133674 - RNA, 64 nt, Homo Sapiens
gauuguaccuucccaagcccgcccagugggaugggaggaggaggagaaggggggccuugggccg

SEQ ID NO: 133675 - RNA, 64 nt, Homo Sapiens
uguaccuucccaagcccgcccagugggaugggaggaggaggagaaggggggccuugggccgcug

SEQ ID NO: 133676 - RNA, 64 nt, Homo Sapiens
gagcucugcuggcaugagcccauggcgccugcuggaggaggagaggucuuuuagccugcccuug

SEQ ID NO: 133677 - RNA, 50 nt, Homo Sapiens
auuccaucuuggcagaaaccgaggaggaauaacgccauguguggaacuag

SEQ ID NO: 133678 - RNA, 64 nt, Homo Sapiens
gcccuucagguuugcugaaauaguuuggggaaaggaggaggagacugcucccuuacagaccugg

SEQ ID NO: 133679 - RNA, 64 nt, Homo Sapiens
cagguacccucuaugccaauacucacaggccuuggaggaggaggcuucuggcuuccaacuggag

SEQ ID NO: 133680 - RNA, 64 nt, Homo Sapiens
aagaagaaaagagaagaaggagaaggagaugaaggaggaggaggaggagaaggagaagaagaag

SEQ ID NO: 133681 - RNA, 64 nt, Homo Sapiens
aagaaaagagaagaaggagaaggagaugaaggaggaggaggaggagaaggagaagaagaagaag

SEQ ID NO: 133682 - RNA, 64 nt, Homo Sapiens
aaaagagaagaaggagaaggagaugaaggaggaggaggaggagaaggagaagaagaagaagaag

SEQ ID NO: 133683 - RNA, 64 nt, Homo Sapiens
ugggacagaagaagaggaugaggaugagauggaagaggaggaggaggaggagcuggaggaggag

SEQ ID NO: 133684 - RNA, 64 nt, Homo Sapiens
gacagaagaagaggaugaggaugagauggaagaggaggaggaggaggagcuggaggaggagguc

SEQ ID NO: 133685 - RNA, 64 nt, Homo Sapiens
agaagaagaggaugaggaugagauggaagaggaggaggaggaggagcuggaggaggaggucgac

SEQ ID NO: 133686 - RNA, 64 nt, Homo Sapiens
agaagaggaugaggaugagauggaagaggaggaggaggaggagcuggaggaggaggucgacgag

SEQ ID NO: 133687 - RNA, 64 nt, Homo Sapiens
ggaugagauggaagaggaggaggaggaggagcuggaggaggaggucgacgagcugcagacgaca

SEQ ID NO: 133688 - RNA, 64 nt, Homo Sapiens
uccacagcccuggaggaacuggggcuccuggaaggaggaggaggcucuccacuguccacccuaa

SEQ ID NO: 133689 - RNA, 64 nt, Homo Sapiens
ggccggacgaguucauggggaucugggggguggggaggaggaagccguugaaucugggagggaa

SEQ ID NO: 133690 - RNA, 64 nt, Homo Sapiens
auauuuagcucuguggaauucagugacaaaaugggaggaggaaagagaguuuguaaggucaugc

SEQ ID NO: 133691 - RNA, 64 nt, Homo Sapiens
gccugugccacccucagagaagaagaaaggagcugaggaggagaagccaaagaggaggaggcag

SEQ ID NO: 133692 - RNA, 64 nt, Homo Sapiens
agaagaagaaaggagcugaggaggagaagccaaagaggaggaggcaggagaagcaggcagccug

SEQ ID NO: 133693 - RNA, 64 nt, Homo Sapiens
caacaccagcaacucgagagcugggaaacucaaggaggaggaagaaaaucaaaaccacccuacu

SEQ ID NO: 133694 - RNA, 64 nt, Homo Sapiens
cccuacucccuggggugaggaaagaacaggaggggaggaggaggagugugcucugcacuugccu

SEQ ID NO: 133695 - RNA, 64 nt, Homo Sapiens
uacucccuggggugaggaaagaacaggaggggaggaggaggagugugcucugcacuugccuugc

SEQ ID NO: 133696 - RNA, 64 nt, Homo Sapiens
accugggcucuccacagccccaucaaagaacagagaggaggaggagggagaaauggccaccaca

SEQ ID NO: 133697 - RNA, 64 nt, Homo Sapiens
ugggcucuccacagccccaucaaagaacagagaggaggaggagggagaaauggccaccacauca

SEQ ID NO: 133698 - RNA, 64 nt, Homo Sapiens
cgguagcgacuauuacgacccgucagagccgacggaggaggaggagccuuccaaacagagaggu

SEQ ID NO: 133699 - RNA, 64 nt, Homo Sapiens
uagcgacuauuacgacccgucagagccgacggaggaggaggagccuuccaaacagagaggugag

SEQ ID NO: 133700 - RNA, 64 nt, Homo Sapiens
gcacagcccucagcaucaacagcccgauggggaugaggaggagaggagagugaggggccccgcc

SEQ ID NO: 133701 - RNA, 64 nt, Homo Sapiens
ccucccugucggagagugaggcaaggcugccgucgaggaggacagggggggcggaagcgggagc

SEQ ID NO: 133702 - RNA, 64 nt, Homo Sapiens
cagggccaaaggaauccucaggaauucgagagaggaggaggaccccuccagaagcccucgucug

SEQ ID NO: 133703 - RNA, 64 nt, Homo Sapiens
acccagggccaaaggaaucccugggaauucgagagaggaggaggugcccuccagaagcccucgu

SEQ ID NO: 133704 - RNA, 64 nt, Homo Sapiens
caggugaggaggcugcagaagcuuauuagaggaggaggaggagugaagucugugacaagaagcu

SEQ ID NO: 133705 - RNA, 64 nt, Homo Sapiens
agucaggugaggaggcugcagcugcuuauuagaggaggaggaggccagaagucugugacaagaa

SEQ ID NO: 133706 - RNA, 64 nt, Homo Sapiens
aggagucaggugaggaggcugaagcugcuuauuagaggaggagguauccagaagucugugacaa

SEQ ID NO: 133707 - RNA, 64 nt, Homo Sapiens
cagagguguaccugcggaaggcuucgccaaugaggaggaggaggugccaugaagacuguccgga

SEQ ID NO: 133708 - RNA, 64 nt, Homo Sapiens
aggcagagguguaccugcggggagcuucgccaaugaggaggaggcagugccaugaagacugucc

SEQ ID NO: 133709 - RNA, 64 nt, Homo Sapiens
uagaugaaguuuacugaaucagaggaaucagacagaggaggauagcucuuuccagaauccacac

SEQ ID NO: 133710 - RNA, 64 nt, Homo Sapiens
gcuucuugugcugcagaagcucguugacaagacugaggaggauuucaagagcaaccaaguaaag

SEQ ID NO: 133711 - RNA, 64 nt, Homo Sapiens
uguguguaugcauguguuugggaaguaacacacagaggaggaugcguaggacagaaugugagga

SEQ ID NO: 133712 - RNA, 64 nt, Homo Sapiens
uaacacacagaggaggauguguaggacagaaugugaggaggaaguuuguguaacuauuuguacc

SEQ ID NO: 133713 - RNA, 64 nt, Homo Sapiens
aucuuuuuuuaauugccauuugauuuuuauuguggaggaggaggaucuaauauauaauauucaa

SEQ ID NO: 133714 - RNA, 64 nt, Homo Sapiens
uuuuuuuaauugccauuugauuuuuauuguggaggaggaggaucuaauauauaauauucaauac

SEQ ID NO: 133715 - RNA, 64 nt, Homo Sapiens
ucgagaagaagugaccaugggcugggaggagguggaggaggaggaagaggagaaggaaaaguga

SEQ ID NO: 133716 - RNA, 64 nt, Homo Sapiens
agaagaagugaccaugggcugggaggagguggaggaggaggaagaggagaaggaaaagugacga

SEQ ID NO: 133717 - RNA, 64 nt, Homo Sapiens
aggaggaagaggagaaggaaaagugacgaagagagaggaggaggggggccccagauggcccuuc

SEQ ID NO: 133718 - RNA, 64 nt, Homo Sapiens
caguucgguuaugcagucaauuauuucuuuuuaagaggaggaggauucacuuggguguugggau

SEQ ID NO: 133719 - RNA, 64 nt, Homo Sapiens
uucgguuaugcagucaauuauuucuuuuuaagaggaggaggauucacuuggguguugggaucaa

SEQ ID NO: 133720 - RNA, 64 nt, Homo Sapiens
gccuccggcagaagaaugagaugugaagaaagaggaggaggagccaucuuucguaagaucagug

SEQ ID NO: 133721 - RNA, 64 nt, Homo Sapiens
agcgccuccggcagaagaaugugaugugaagaaagaggaggagggaucaucuuucguaagauca

SEQ ID NO: 133722 - RNA, 64 nt, Homo Sapiens
gcaaacccgagggcccagcguggcagagcuggaggaggaggaggugccagcaaugaguuggcac

SEQ ID NO: 133723 - RNA, 64 nt, Homo Sapiens
agggcaaacccgagggcccacacuggcagagcuggaggaggagggcgugccagcaaugaguugg

SEQ ID NO: 133724 - RNA, 64 nt, Homo Sapiens
cccucgucccccuaggagcaaagcaauugaggaggaggaggaacucacugagugaaggcacaua

SEQ ID NO: 133725 - RNA, 64 nt, Homo Sapiens
aaccccucgucccccuaggaauaaagcaauugaggaggaggagggguucacugagugaaggcac

SEQ ID NO: 133726 - RNA, 64 nt, Homo Sapiens
aggaaccccucgucccccuacacauaaagcaauugaggaggagguuggguucacugagugaagg

SEQ ID NO: 133727 - RNA, 64 nt, Homo Sapiens
uagcagacacauccaguaucugggauaaagggaggaggaggagcauaccaaauauuggggaaag

SEQ ID NO: 133728 - RNA, 64 nt, Homo Sapiens
agcuagcagacacauccaguaagugggauaaagggaggaggaggaucauaccaaauauugggga

SEQ ID NO: 133729 - RNA, 64 nt, Homo Sapiens
cuugguccaugcugagcaucuggagagugaggaggaggaggagccacccccauaggagauggac

SEQ ID NO: 133730 - RNA, 64 nt, Homo Sapiens
agccuugguccaugcugagcgacuggagagugaggaggaggaggccccacccccauaggagaug

SEQ ID NO: 133731 - RNA, 64 nt, Homo Sapiens
aggagccuugguccaugcugauggacuggagagugaggaggaggccgccccacccccauaggag

SEQ ID NO: 133732 - RNA, 64 nt, Homo Sapiens
cacugcacaggcaguuauuuagcagcugaucucugaggaggaggucuucugcagcaguacuauc

SEQ ID NO: 133733 - RNA, 64 nt, Homo Sapiens
ccagcuuucugguuaagguuguuuuugcggggaggaggaggaaauggagaacucuuggccaaag

SEQ ID NO: 133734 - RNA, 64 nt, Homo Sapiens
aaaccagcuuucugguuaagaagguuuuugcggggaggaggaggcaguggagaacucuuggcca

SEQ ID NO: 133735 - RNA, 64 nt, Homo Sapiens
cagccauugccauccaguggggagauggguuagggaggaggacgggcugacuccucuccuguaa

SEQ ID NO: 133736 - RNA, 64 nt, Homo Sapiens
gaaaguuguggggcauaagacaccgggaaugagggaggaggaagacaguuguguuuucucuuua

SEQ ID NO: 133737 - RNA, 64 nt, Homo Sapiens
cggggugguggcaauggucguggaggccgagggcgaggaggacccaugggccguggaggcuaug

SEQ ID NO: 133738 - RNA, 64 nt, Homo Sapiens
ggcuauggaggugguggcagugguggugguggccgaggaggauuucccaguggaggugguggcg

SEQ ID NO: 133739 - RNA, 64 nt, Homo Sapiens
cuuaacuagccgagagaugcugccucuaggcagagaggaggagagguguugccggcuggagggc

SEQ ID NO: 133740 - RNA, 64 nt, Homo Sapiens
caaccagugaacaccagcugugaaggccuugggagaggaggaacaggcccuugggcagaugcag

SEQ ID NO: 133741 - RNA, 64 nt, Homo Sapiens
cccucugagcaacagacugcuugucuugcuaggagaggaggauggggggcugagcacucaggcu

SEQ ID NO: 133742 - RNA, 64 nt, Homo Sapiens
uacucuuggcccaccgcagaucuguagccagucagaggaggaggagaaggagccccucagcaga

SEQ ID NO: 133743 - RNA, 64 nt, Homo Sapiens
ucuuggcccaccgcagaucuguagccagucagaggaggaggagaaggagccccucagcagagug

SEQ ID NO: 133744 - RNA, 64 nt, Homo Sapiens
guaucuaucgucaucuggagcaagggauaaguuugaggaggaucuaaauuuuuuacauuccgag

SEQ ID NO: 133745 - RNA, 64 nt, Homo Sapiens
gaagggaauuagaaaagucacaaggccucagagggaggaggaggguuggauauccaguaaugau

SEQ ID NO: 133746 - RNA, 64 nt, Homo Sapiens
caauugggauggcgcuaggccgcugguagagauggaggaggaggcccgugcagacuggagggga

SEQ ID NO: 133747 - RNA, 64 nt, Homo Sapiens
gagagaaggggaggagggcggcuugcguuagaaugaggaggaagcuggaggggcauggccagca

SEQ ID NO: 133748 - RNA, 64 nt, Homo Sapiens
aaaaacaggccgagugaaggagcucagugccgaggaggaggaagcaaacugcucagcgcgucuc

SEQ ID NO: 133749 - RNA, 64 nt, Homo Sapiens
aagaaaaacaggccgagugacucagcucagugccgaggaggagggagcaaacugcucagcgcgu

SEQ ID NO: 133750 - RNA, 64 nt, Homo Sapiens
aaggggaaggaagagagaggguagucagaggagggaggaggaaugaggcaccaggaaaggggug

SEQ ID NO: 133751 - RNA, 64 nt, Homo Sapiens
ugggcagggccugcaccagggcaguggguugcaggaggaggagcaagggagcagggcuuacuga

SEQ ID NO: 133752 - RNA, 64 nt, Homo Sapiens
ugguggagaccagggacagguguuucuucuaagggaggaggacacuugcucccugccccagacc

SEQ ID NO: 133753 - RNA, 64 nt, Homo Sapiens
uccgccccacccucuacagcgcaggaggcguucggaggaggaguucccuagaguccagcacacu

SEQ ID NO: 133754 - RNA, 64 nt, Homo Sapiens
aucgggggcagagucguuggagacugaagaggaagaggaggaggagaaggggagugagcggccg

SEQ ID NO: 133755 - RNA, 64 nt, Homo Sapiens
gggggcagagucguuggagacugaagaggaagaggaggaggagaaggggagugagcggccgccc

SEQ ID NO: 133756 - RNA, 64 nt, Homo Sapiens
aacaaacaaacacaugggggagagagacuuggaagaggaggaggaggaggagaaggaggagaga

SEQ ID NO: 133757 - RNA, 64 nt, Homo Sapiens
aaacaaacacaugggggagagagacuuggaagaggaggaggaggaggagaaggaggagagagag

SEQ ID NO: 133758 - RNA, 64 nt, Homo Sapiens
caaacacaugggggagagagacuuggaagaggaggaggaggaggagaaggaggagagagagggg

SEQ ID NO: 133759 - RNA, 64 nt, Homo Sapiens
acacaugggggagagagacuuggaagaggaggaggaggaggagaaggaggagagagaggggaag

SEQ ID NO: 133760 - RNA, 64 nt, Homo Sapiens
ccauggucgggacagugcccuggccuuugccggggaggaggaugcucugagauucagggugggg

SEQ ID NO: 133761 - RNA, 64 nt, Homo Sapiens
ccagugacuuccccaggaguguggaggggguggugaggaggagcaccugggcucucuaccccuc

SEQ ID NO: 133762 - RNA, 64 nt, Homo Sapiens
ccggcagcuggcgcaccaggcccagcagcagcuggaggaggaggaggaggauacgccagucagc

SEQ ID NO: 133763 - RNA, 64 nt, Homo Sapiens
gcagcuggcgcaccaggcccagcagcagcuggaggaggaggaggaggauacgccagucagcccc

SEQ ID NO: 133764 - RNA, 64 nt, Homo Sapiens
gcuggcgcaccaggcccagcagcagcuggaggaggaggaggaggauacgccagucagccccaag

SEQ ID NO: 133765 - RNA, 64 nt, Homo Sapiens
ggcgcaccaggcccagcagcagcuggaggaggaggaggaggauacgccagucagccccaaggag

SEQ ID NO: 133766 - RNA, 60 nt, Homo Sapiens
augagcaguggcuggagauccgaggacgaggaggaggacuagugucuuccaguccccuga

SEQ ID NO: 133767 - RNA, 57 nt, Homo Sapiens
acuaugagcaguggcuggagcgaggacgaggaggaggagugucuuccaguccccuga

SEQ ID NO: 133768 - RNA, 64 nt, Homo Sapiens
agaugcgcaguuaccucaugaggcggggagggaggaggaggagaggccaaguugggggcccagg

SEQ ID NO: 133769 - RNA, 64 nt, Homo Sapiens
agaagaugcgcaguuaccucaggaggcggggagggaggaggagguagggccaaguugggggccc

SEQ ID NO: 133770 - RNA, 64 nt, Homo Sapiens
auaacuuaggccuagccucuaauggggcugugaggaggaggauugugcuaaugccccuugggga

SEQ ID NO: 133771 - RNA, 64 nt, Homo Sapiens
auuauaacuuaggccuagccggaaauggggcugugaggaggaggcuggugcuaaugccccuugg

SEQ ID NO: 133772 - RNA, 64 nt, Homo Sapiens
gucuagaggccugaaauccuaggccacugaagaggaggaggagguucaucuggaaguuaaagug

SEQ ID NO: 133773 - RNA, 64 nt, Homo Sapiens
agggucuagaggccugaaaugugaggccacugaagaggaggaggaacuucaucuggaaguuaaa

SEQ ID NO: 133774 - RNA, 64 nt, Homo Sapiens
ugggagcuggaggugugacauguggugggggcgagaggaggacuguguggagugaaagagucac

SEQ ID NO: 133775 - RNA, 64 nt, Homo Sapiens
caggaucgaauggaaggggggccugggcacuucagaggaggagcacccagccugucacgacaga

SEQ ID NO: 133776 - RNA, 64 nt, Homo Sapiens
agacuccaaggagcuacugacauuccuaagaguggaggaggaggaggagccuugcugggccagg

SEQ ID NO: 133777 - RNA, 64 nt, Homo Sapiens
cuccaaggagcuacugacauuccuaagaguggaggaggaggaggagccuugcugggccagggaa

SEQ ID NO: 133778 - RNA, 64 nt, Homo Sapiens
caaggagcuacugacauuccuaagaguggaggaggaggaggagccuugcugggccagggaaaca

SEQ ID NO: 133779 - RNA, 64 nt, Homo Sapiens
uagggccugcauggagaaggguucugcccugccugaggaggaggacacagcacaagggcacauu

SEQ ID NO: 133780 - RNA, 64 nt, Homo Sapiens
ggccugcauggagaaggguucugcccugccugaggaggaggacacagcacaagggcacauugcc

SEQ ID NO: 133781 - RNA, 64 nt, Homo Sapiens
cggguucaacuaaauccaggaggagcuguggucagaggaggagccggcgccuggccacgccaac

SEQ ID NO: 133782 - RNA, 64 nt, Homo Sapiens
gcagaguugcagaggucccuguagagauaaagcugaggaggaggcugugugugauggcucuggc

SEQ ID NO: 133783 - RNA, 64 nt, Homo Sapiens
gcuuuucccugugggccagggaugcucggucccagaggaggaccuagugacaucaugggacagg

SEQ ID NO: 133784 - RNA, 64 nt, Homo Sapiens
ugcguuggcagaacccugggugggcaggcacccggaggaggagcagcagcugugucauccugug

SEQ ID NO: 133785 - RNA, 64 nt, Homo Sapiens
gacgggaggggaccauuuggugugggcaacgguggaggaggagagugacaucgccgggggaggu

SEQ ID NO: 133786 - RNA, 64 nt, Homo Sapiens
ccagcugggcucggucccccgccggagagaaggggaggaggacuugcugccagagagaccugcu

SEQ ID NO: 133787 - RNA, 64 nt, Homo Sapiens
ugccuuaucgucugcaaguguucuccaagggaaggaggaggaaacugugguguuccuuucuucc

SEQ ID NO: 133788 - RNA, 64 nt, Homo Sapiens
aauaguagcaagagcugcaaagcaggcaggaagggaggaggagagccaggugagcaguggagag

SEQ ID NO: 133789 - RNA, 64 nt, Homo Sapiens
gagugccugaggcaggagaauugcaugaacccgggaggaggaggaggagguugcagugagccga

SEQ ID NO: 133790 - RNA, 64 nt, Homo Sapiens
ugccugaggcaggagaauugcaugaacccgggaggaggaggaggagguugcagugagccgagau

SEQ ID NO: 133791 - RNA, 64 nt, Homo Sapiens
cugaggcaggagaauugcaugaacccgggaggaggaggaggagguugcagugagccgagauagc

SEQ ID NO: 133792 - RNA, 64 nt, Homo Sapiens
aggcagagaaggaggagaccgaggggugaagaaggaggaggaagugagcgugugauuguagaca

SEQ ID NO: 133793 - RNA, 64 nt, Homo Sapiens
cuaaaaaugucacgaauaugcuuacuacagaaaugaggaggaugugggagggaguuacugaagu

SEQ ID NO: 133794 - RNA, 64 nt, Homo Sapiens
agcugaccuguuggcugaaaaggcccagaucaccgaggaggaggcaaaacuucuggcccagaag

SEQ ID NO: 133795 - RNA, 64 nt, Homo Sapiens
aaugcagcgcaucaaggccacagcgauucgcacggaggaggagaagcgccugauggagcagaag

SEQ ID NO: 133796 - RNA, 64 nt, Homo Sapiens
cccgccgaccguggcguuggcccugcuguccucagaggaggaggaggaggaggcagcuccggca

SEQ ID NO: 133797 - RNA, 64 nt, Homo Sapiens
gccgaccguggcguuggcccugcuguccucagaggaggaggaggaggaggcagcuccggcagcc

SEQ ID NO: 133798 - RNA, 64 nt, Homo Sapiens
gaccguggcguuggcccugcuguccucagaggaggaggaggaggaggcagcuccggcagccaca

SEQ ID NO: 133799 - RNA, 64 nt, Homo Sapiens
cguggcguuggcccugcuguccucagaggaggaggaggaggaggcagcuccggcagccacagaa

SEQ ID NO: 133800 - RNA, 64 nt, Homo Sapiens
gggaggcugcagaugccuggcccauugcucccaagaggaggagauagacuggggggaucagcug

SEQ ID NO: 133801 - RNA, 64 nt, Homo Sapiens
ggccuggaaagcuuugguagaaggaagacacugggaggaggagaaagccaccuucaggccuggg

SEQ ID NO: 133802 - RNA, 64 nt, Homo Sapiens
caagggagcagggcagcucucugccuuggcagaggaggaggaguaugaccagaggauuauuuuc

SEQ ID NO: 133803 - RNA, 64 nt, Homo Sapiens
agucaagggagcagggcagcuuccugccuuggcagaggaggagguccaugaccagaggauuauu

SEQ ID NO: 133804 - RNA, 64 nt, Homo Sapiens
gggggguccaggucuuuucagcaggaagcaggaggaggaggagaccagaggguggaaggcccug

SEQ ID NO: 133805 - RNA, 64 nt, Homo Sapiens
agagggggguccaggucuuucuggcaggaagcaggaggaggagggguccagaggguggaaggcc

SEQ ID NO: 133806 - RNA, 64 nt, Homo Sapiens
uggaaccucuccauauacuuucuaagcucugggggaggaggaggaugggaccuccuggacccag

SEQ ID NO: 133807 - RNA, 64 nt, Homo Sapiens
aaccucuccauauacuuucuaagcucugggggaggaggaggaugggaccuccuggacccagcuu

SEQ ID NO: 133808 - RNA, 64 nt, Homo Sapiens
aaaugugaagaaacuccuuucaucucagcagguagaggaggacugaugacacgagcugccaugg

SEQ ID NO: 133809 - RNA, 64 nt, Homo Sapiens
ccaguccugagagaacuccaucaauccaguccaagaggaggaggacgaaggccuagacucagcu

SEQ ID NO: 133810 - RNA, 64 nt, Homo Sapiens
guccugagagaacuccaucaauccaguccaagaggaggaggacgaaggccuagacucagcugaa

SEQ ID NO: 133811 - RNA, 64 nt, Homo Sapiens
aggguggcugugaagggaagucuuuguugcaaaggaggaggaggaaaagggaggacuugguagg

SEQ ID NO: 133812 - RNA, 64 nt, Homo Sapiens
guggcugugaagggaagucuuuguugcaaaggaggaggaggaaaagggaggacuugguaggguu

SEQ ID NO: 133813 - RNA, 64 nt, Homo Sapiens
gcuccucauccggacugaggaagacgaggacagggaggaggaaaaggaggaagaggaggacaaa

SEQ ID NO: 133814 - RNA, 64 nt, Homo Sapiens
ggaagacgaggacagggaggaggaaaaggaggaagaggaggacaaaaagggggaggagaagguu

SEQ ID NO: 133815 - RNA, 64 nt, Homo Sapiens
ccagguccugguggagccuuaggaggaggaggaggaggaggaggagaagaggaggaggaggagg

SEQ ID NO: 133816 - RNA, 64 nt, Homo Sapiens
aggccagguccugguggagcaggaggaggaggaggaggaggaggggaagaagaggaggaggagg

SEQ ID NO: 133817 - RNA, 64 nt, Homo Sapiens
aggaggccagguccugguggaggaggaggaggaggaggaggaggggaggaagaagaggaggagg

SEQ ID NO: 133818 - RNA, 64 nt, Homo Sapiens
aggaggaggccagguccuggaggaggaggaggaggaggaggaggggaggaggaagaagaggagg

SEQ ID NO: 133819 - RNA, 64 nt, Homo Sapiens
aggaggaggaggccagguccaggaggaggaggaggaggaggaggggaggaggaggaagaagagg

SEQ ID NO: 133820 - RNA, 64 nt, Homo Sapiens
aggaggaggaggaggccaggaggaggaggaggaggaggaggaggggaggaggaggaggaagaag

SEQ ID NO: 133821 - RNA, 64 nt, Homo Sapiens
aggaggaggaggaggaggccaagaggaggaggaggaggaggaggggaggaggaggaggaggaag

SEQ ID NO: 133822 - RNA, 64 nt, Homo Sapiens
aggaggaggaggaggaggagaggaagaggaggaggaggaggaggcccaaccccaugggaggagg

SEQ ID NO: 133823 - RNA, 64 nt, Homo Sapiens
aggaggaggaggaggaggagaggaggaagaggaggaggaggaggaaccccaaccccaugggagg

SEQ ID NO: 133824 - RNA, 64 nt, Homo Sapiens
aggaggaggaggaggaggagaggaggaggaagaggaggaggaggcccaaccccaaccccauggg

SEQ ID NO: 133825 - RNA, 64 nt, Homo Sapiens
aggaggaggaggaggaggaggggaggaggaggaagaggaggaggaaucccaaccccaaccccau

SEQ ID NO: 133826 - RNA, 64 nt, Homo Sapiens
aggaggaggaggaggaggagcaaccccaugggaggaggaggaagcauggcccuaaucccaaccc

SEQ ID NO: 133827 - RNA, 64 nt, Homo Sapiens
aggaggaagaagaggaggagccccaaccccaugggaggaggagggaucauggcccuaaucccaa

SEQ ID NO: 133828 - RNA, 64 nt, Homo Sapiens
aaggauccucacaggaggauauccaguccaagaggaggaggacgguccugagagaacuccauca

SEQ ID NO: 133829 - RNA, 64 nt, Homo Sapiens
acgaaggauccucacaggagucaauccaguccaagaggaggaggccaguccugagagaacucca

SEQ ID NO: 133830 - RNA, 64 nt, Homo Sapiens
aaucaguagaucuuggcaauucagauaauauguuuuuuccuacuucaacagaagaacaauauaa

SEQ ID NO: 133831 - RNA, 64 nt, Homo Sapiens
guuaucuuuuccuuaaauaucccucuagagguauuuuuccuaagugguauuguacgguguauac

SEQ ID NO: 133832 - RNA, 64 nt, Homo Sapiens
ccauaauauauuugagcagucccugcugacauuuuuuuccuaaccuuuugcuauuauaaauaau

SEQ ID NO: 133833 - RNA, 64 nt, Homo Sapiens
agccgacauuccaugcccugaccaauccuacugcuuuuccuaaaaacagaauaauuuggugugc

SEQ ID NO: 133834 - RNA, 64 nt, Homo Sapiens
aaacagaauaauuuggugugcauucuuucagacuuuuuccuauacauuuuauauguagaaaugu

SEQ ID NO: 133835 - RNA, 64 nt, Homo Sapiens
agauuuguuucuuaaugggugugaccaauccuguuuuuccuaugcucugggugaauagagccug

SEQ ID NO: 133836 - RNA, 64 nt, Homo Sapiens
uuuucauguaaguuuaauuaucugcauuuaucuuuuuuccuaguuuuucuaauacuaauguuau

SEQ ID NO: 133837 - RNA, 64 nt, Homo Sapiens
uauuuuaucuuuauauaguuuguuugcaagaguauuuuccuaauaacuucacaguaugaaugug

SEQ ID NO: 133838 - RNA, 64 nt, Homo Sapiens
caacuuucaauggaagagaauuuuagugcuuuuuuuuuccuaaaauagauauuaagcugcuguu

SEQ ID NO: 133839 - RNA, 64 nt, Homo Sapiens
gugcgugcguguguauguucugaguccacuucuuuuuuccuaaauaacacuacagggauuuugu

SEQ ID NO: 133840 - RNA, 64 nt, Homo Sapiens
ucuuuacaugauagcauuaucuuuuuauaauuuuuuuuccuaagauaaacaaaugcauaguuuu

SEQ ID NO: 133841 - RNA, 64 nt, Homo Sapiens
agggagcuacauagagcaauuuaaaugcaaauuuuuuuccuaacaacuuacaaggugacuagcu

SEQ ID NO: 133842 - RNA, 64 nt, Homo Sapiens
cuaauuuaucuuuagaaauuuaugugaaaaaugguuuuccuauacuggauaaagcaauuccccu

SEQ ID NO: 133843 - RNA, 64 nt, Homo Sapiens
guguuugcaccugucuuucauuugucauaagagauuuuccuauuucuucuacccaauagaauau

SEQ ID NO: 133844 - RNA, 64 nt, Homo Sapiens
gagcugguuggacuaaugagacugaggaagcagcuuuuccuacgaucugcauuauguaaucaca

SEQ ID NO: 133845 - RNA, 64 nt, Homo Sapiens
uuuauauacagggucuuuuuucuuuaccgauguauuuuccuacucauagccaaccaauaaauuc

SEQ ID NO: 133846 - RNA, 64 nt, Homo Sapiens
cugaugucaaacuuaugcauucugggguuuguccuuuuccuaccuuaugaacuaccucucaguc

SEQ ID NO: 133847 - RNA, 64 nt, Homo Sapiens
gacguauaugcuagaugucaguuugcuuuuucccuuuuccuacauuuagccauuugugaaaugg

SEQ ID NO: 133848 - RNA, 64 nt, Homo Sapiens
aaaauggccagcauaaaugcuguuuauauucacguuuuccuaggugugugugugcaggccacag

SEQ ID NO: 133849 - RNA, 64 nt, Homo Sapiens
gaacccuaucaacugucuuauguacguuacaugauuuuccuacacucuguaauuuugcugaggu

SEQ ID NO: 133850 - RNA, 64 nt, Homo Sapiens
uauguuuuuaaagcaauuaucuagggucaccucauuuuccuaaaagacauauaaauaagcucau

SEQ ID NO: 133851 - RNA, 64 nt, Homo Sapiens
gaaaucaugguuuaguaaacgauuccagagcucuuuuuccuacugguacugcagugagggccuu

SEQ ID NO: 133852 - RNA, 64 nt, Homo Sapiens
uuuuuaaagguacaguauauggggauuguuucguuuuuccuagcaggggaaccuuaguuaauaa

SEQ ID NO: 133853 - RNA, 64 nt, Homo Sapiens
gcaaauuuugucucaaucuuuuuucccuccaugauuuuccuaugugcuuccucuggcauucacu

SEQ ID NO: 133854 - RNA, 64 nt, Homo Sapiens
gguuuacaaguauuuagaacugcgagcagucauuuuuuccuaaaccucuuaccagucagcugcc

SEQ ID NO: 133855 - RNA, 64 nt, Homo Sapiens
agagcuuggcucauaaccaauuucguaggugggcuuuuccuauccuuaaauacccacaccuuuu

SEQ ID NO: 133856 - RNA, 64 nt, Homo Sapiens
ggacaccugaggaaaggguacuaccuuaaaaaucuuuuccuauagucuugguaaauuuuaaaug

SEQ ID NO: 133857 - RNA, 64 nt, Homo Sapiens
agcuaagucugucuuuuuucuuaggaaauaaagguuuuccuaggauacauuuaaguguuuugcu

SEQ ID NO: 133858 - RNA, 64 nt, Homo Sapiens
ugcuacuuuggcagagcuaauuacugaagugcuguuuuccuaggaaggaauagcaggagaaauu

SEQ ID NO: 133859 - RNA, 64 nt, Homo Sapiens
uuuaugcuuuugggauacagacauugggugucucuuuuccuagagggaugucaggugcaucauu

SEQ ID NO: 133860 - RNA, 64 nt, Homo Sapiens
ugaugccuuccuuuauuacaaagcauucuuuuuuuuuuccuaguuuguuuugaagcuggcaucu

SEQ ID NO: 133861 - RNA, 64 nt, Homo Sapiens
aagaguugaugucugcuaguuuaauuagauuuccuuuuccuagucagaauucuuuuuuaaaauu

SEQ ID NO: 133862 - RNA, 64 nt, Homo Sapiens
gaaguaauaugcucucauuucuuuguaaucuagauuuuccuauguugaaugcuuaaagcaaggc

SEQ ID NO: 133863 - RNA, 64 nt, Homo Sapiens
auuuugagcaaaccacauaaucucucuagguccauuuuccuaaccacaagauaaagauguuaca

SEQ ID NO: 133864 - RNA, 64 nt, Homo Sapiens
uaauuucacauucuaauauaaauugaagagauuauuuuccuauguuucgcaagugauuuuagcu

SEQ ID NO: 133865 - RNA, 64 nt, Homo Sapiens
ccaggguacacaauuuaaguugcaaauauuacuauuuuccuaaacugacuuaucauucauaagu

SEQ ID NO: 133866 - RNA, 64 nt, Homo Sapiens
auuuaucuguucaaauuuguuguuuuagaccauauuuuccuauugugguacuaaaauuugcuac

SEQ ID NO: 133867 - RNA, 64 nt, Homo Sapiens
uauccuauuagccuguaaauuuuugucuucaacuuuuuccuagcccugaaaccuuuccggugug

SEQ ID NO: 133868 - RNA, 64 nt, Homo Sapiens
guugcuggguuugggaguaaaauaacgcacaguauuuuccuaagucuacuauccuuuuuuauug

SEQ ID NO: 133869 - RNA, 64 nt, Homo Sapiens
augcuuuuuagcuguggcuaugauggauuuuauuuuuuccuaggucaagcuguguaaaagucau

SEQ ID NO: 133870 - RNA, 64 nt, Homo Sapiens
guuugaggauuuuccaagcguguaauaaugauguuuuuccuaacaugacagaugaguaguaaau

SEQ ID NO: 133871 - RNA, 64 nt, Homo Sapiens
gaguaguggcuuaucucugacuauuggcccucaguuuuccuacaguucugugucaaaagauggc

SEQ ID NO: 133872 - RNA, 64 nt, Homo Sapiens
accauuuauaauuauuagugucagugguauccuuuuuuccuaaggaauauuguacccagugacu

SEQ ID NO: 133873 - RNA, 64 nt, Homo Sapiens
aguugacauuuguuuuuaguaauuuaaguguucauuuuccuaucauucugugugaguauaccac

SEQ ID NO: 133874 - RNA, 64 nt, Homo Sapiens
gccaaggauaauguacuagugaacugauggaggcuuuuccuaaguuauauuuugggaacacaua

SEQ ID NO: 133875 - RNA, 64 nt, Homo Sapiens
ucuacuuuauaucucauauuacauaucagcucuauuuuccuacaguuuuuuuuaguaacuaugc

SEQ ID NO: 133876 - RNA, 64 nt, Homo Sapiens
aggucuagaaaugcuuaaacguauugaucagcauuuuuccuaagcuucacaaugaaaauucauu

SEQ ID NO: 133877 - RNA, 64 nt, Homo Sapiens
ugguuugagaaacaggcugaaucucacaugcuguuuuuccuauuuugguuaugugcagggaauc

SEQ ID NO: 133878 - RNA, 64 nt, Homo Sapiens
guugaagcauuuguucccagagacacagacauacuuuuccuaaagguugggguacuacgaucac

SEQ ID NO: 133879 - RNA, 64 nt, Homo Sapiens
uguguuauuccugguuuaaucugggagcacugcguuuuccuagcgaacuuuuguaucuuuuauc

SEQ ID NO: 133880 - RNA, 64 nt, Homo Sapiens
cagguaaaacugggcuuuuacggauucaaguaccuuuuccuacacagacaauauuuuagaagga

SEQ ID NO: 133881 - RNA, 64 nt, Homo Sapiens
gcagcucauaggugcuagcuuuauuaucugagccuuuuccuaauuaaacccuuauacuaucuuu

SEQ ID NO: 133882 - RNA, 64 nt, Homo Sapiens
cccuuauacuaucuuuuuauucugccauugaugcuuuuccuaaauaagauuccuacacuuuauu

SEQ ID NO: 133883 - RNA, 64 nt, Homo Sapiens
aaggaagauccucuuuguuuguucaaaggaccaguuuuccuaggccaaagaagucucuucccca

SEQ ID NO: 133884 - RNA, 64 nt, Homo Sapiens
ccaugacccacagccaucugguuaugucuuauuuuuuuccuaaaagauaauguuuauuuuuaaa

SEQ ID NO: 133885 - RNA, 64 nt, Homo Sapiens
cagggaaguccuuugguaacugcaauauacaagauuuuccuauuaagccucuugguaagaggca

SEQ ID NO: 133886 - RNA, 64 nt, Homo Sapiens
uuauaaaguuccuucagugguugccucacuugcguuuuccuacaagauguaagacuguuuauaa

SEQ ID NO: 133887 - RNA, 64 nt, Homo Sapiens
caugaaugcgagaaauggcucacgucuccaugguuuuuccuacauacaaccugcccuccaggga

SEQ ID NO: 133888 - RNA, 64 nt, Homo Sapiens
acuaccuuauaaaccugccuucagccaccaagcuuuuuccuaccucucaaaacuggccacugcc

SEQ ID NO: 133889 - RNA, 64 nt, Homo Sapiens
uucuucuccucccccuacccgguuucccucccuguuuuccuaccucuacggcaagcccaaagug

SEQ ID NO: 133890 - RNA, 64 nt, Homo Sapiens
gcacauuuguucugcagacuauugcaggaauguuuuuuccuagcauuucuauauuaucugucca

SEQ ID NO: 133891 - RNA, 64 nt, Homo Sapiens
guuuagaauacugguuuucuauuuacgcaugauauuuuccuaaguaaaauugccaaguggacuu

SEQ ID NO: 133892 - RNA, 64 nt, Homo Sapiens
uauuauugugcuucauggagaauuuuccccucuguuuuccuaaauuguaugagagcuuucacac

SEQ ID NO: 133893 - RNA, 64 nt, Homo Sapiens
uauacuuccuuaaaguaaauguaaugauuucuucuuuuccuauugaccaguacagauagauaug

SEQ ID NO: 133894 - RNA, 64 nt, Homo Sapiens
uagaauggaagccuccaccugugcagcccccuccugaccccaccagggggaagcaccagccuca

SEQ ID NO: 133895 - RNA, 64 nt, Homo Sapiens
uccaggcaggaaaccccgagcagggccccugaagugaccccagcucguggagcucuaacugauu

SEQ ID NO: 133896 - RNA, 64 nt, Homo Sapiens
uguggcugccaggccaaggcagucacaggggcccugaccccaggccacacagacggacaugggc

SEQ ID NO: 133897 - RNA, 64 nt, Homo Sapiens
agugaugaggcugguuagcggaugugggaggcugugaccccagggggccauagggugcggugga

SEQ ID NO: 133898 - RNA, 64 nt, Homo Sapiens
aaagcauaacaccaaucccaggggaacagaccagugaccccagacugucacuggcuggcuccua

SEQ ID NO: 133899 - RNA, 64 nt, Homo Sapiens
gccaaguggggauggggccuucaacagccaagugugaccccacugcuggacuucugugggcccc

SEQ ID NO: 133900 - RNA, 64 nt, Homo Sapiens
ugguuaugacagggagcucccaggccaggccacaugaccccacagguaggcugaccccauggac

SEQ ID NO: 133901 - RNA, 64 nt, Homo Sapiens
ucccaggccaggccacaugaccccacagguaggcugaccccauggacccacuggagacuuugag

SEQ ID NO: 133902 - RNA, 64 nt, Homo Sapiens
cagcucgagcaugcccugagucccuccugcagccugaccccaggaucucagaguccagucaagu

SEQ ID NO: 133903 - RNA, 64 nt, Homo Sapiens
ccaccugucuucucucccacagcuucccucugccugaccccaggagggucccagccuggccacc

SEQ ID NO: 133904 - RNA, 64 nt, Homo Sapiens
acugcuggguuuucauggguaggaaagcuuguccugaccccagcagcaaagagguggcaggucg

SEQ ID NO: 133905 - RNA, 64 nt, Homo Sapiens
acuuuuuuuucucucucucucuaguauucuaaacugaccccaugaccaacugagaauuuauuuu

SEQ ID NO: 133906 - RNA, 64 nt, Homo Sapiens
uccuuccagcuagugacccacaugccauuuguacugaccccaucaccuacucacacaggcauuu

SEQ ID NO: 133907 - RNA, 64 nt, Homo Sapiens
uggccaagcugaggugcccaggagaagaaagaggugaccccagggcacaggagcuaccugugug

SEQ ID NO: 133908 - RNA, 64 nt, Homo Sapiens
agguuaauccccuguugccaccccuuagacaccaugaccccauccagguuccuccacugcccca

SEQ ID NO: 133909 - RNA, 64 nt, Homo Sapiens
gucagggaggcugcccccagucccaaagauggggugaccccagggcagaccaguggggaucuga

SEQ ID NO: 133910 - RNA, 64 nt, Homo Sapiens
gccuuccagaaaccuguccucugcagcucggucuugaccccaagccugcuggugaccugaacuu

SEQ ID NO: 133911 - RNA, 64 nt, Homo Sapiens
gcuggugcuggcgcugcugggucagggcugcccgugaccccagacaccacuguccauccuguga

SEQ ID NO: 133912 - RNA, 64 nt, Homo Sapiens
aggcuccaguucugggcuggccccacggcugcccugaccccaggccuacagcgggacacccuga

SEQ ID NO: 133913 - RNA, 64 nt, Homo Sapiens
gcugcccugaccccaggaggacagcgggacacccugaccccacgcaauaaagcagacuauuccu

SEQ ID NO: 133914 - RNA, 64 nt, Homo Sapiens
uucucucugauucccacaggucagcuccuaccucugaccccagcaccccccaccccccacagcg

SEQ ID NO: 133915 - RNA, 64 nt, Homo Sapiens
uucucuuugaucucugaaucccagcuccuaccucugaccccaacuuuaaccccccaccugagcc

SEQ ID NO: 133916 - RNA, 64 nt, Homo Sapiens
ugugcaauuccuuguuaaagaaaugcuacuuuauuaagaagaugcuggcugcuuuguguuagaa

SEQ ID NO: 133917 - RNA, 64 nt, Homo Sapiens
uugagccuaaaucaaagcaaaccaauaccauugauaagaagaagauaaaaacaaaauauuuugg

SEQ ID NO: 133918 - RNA, 64 nt, Homo Sapiens
agucaacugaggaaaaaaaauaauuaaacaggccuaagaagaaaucaaaaaccauaagacaccu

SEQ ID NO: 133919 - RNA, 64 nt, Homo Sapiens
gaacuuuggagguuuggagcuugaagagaauggcuaagaagauuugaauuauagggagggaaca

SEQ ID NO: 133920 - RNA, 64 nt, Homo Sapiens
ugaugguucacguuggggugauuuaauccaguuauaagaagaaguucauguccaaacguccucu

SEQ ID NO: 133921 - RNA, 64 nt, Homo Sapiens
aaggggaagaaugaaagcuguuccuugguccuaguaagaagacaaacugcuucccuuacuuugc

SEQ ID NO: 133922 - RNA, 64 nt, Homo Sapiens
uggagaaaaaaauauauauagcuucuggcuuccauaagaagaaaaaaacagggugcuccuccug

SEQ ID NO: 133923 - RNA, 64 nt, Homo Sapiens
cuuugagaugcauuaugagaauuuuuauauuuuuuaagaagauagagagcacaaguuggccuac

SEQ ID NO: 133924 - RNA, 64 nt, Homo Sapiens
ggcuagggaguuuaucccuuuuucgaauuauuuuuaagaagaugccaauauaauuuuuguaaga

SEQ ID NO: 133925 - RNA, 64 nt, Homo Sapiens
auggaauauauucugcguuuauaaaacuaguuuuuaagaagaaauuuuuuuuggccuaugaaau

SEQ ID NO: 133926 - RNA, 64 nt, Homo Sapiens
guuuaagaauuaauuuacauuaaaguguuuauguuaagaagauugggccaggugggguggcuca

SEQ ID NO: 133927 - RNA, 64 nt, Homo Sapiens
aggugcaacuucuaagaguuuuccuguaaguaauuaagaagacuaaguagccccagagauaaga

SEQ ID NO: 133928 - RNA, 64 nt, Homo Sapiens
uucagaaacuaaagcccucacugucauuauucuuuaagaagaugaaauuacucuggauguuugg

SEQ ID NO: 133929 - RNA, 64 nt, Homo Sapiens
uuaauucaugcaaaaugaaggaggaagccuggucuaagaagauacugucuuucaauagaaauga

SEQ ID NO: 133930 - RNA, 64 nt, Homo Sapiens
auagaaccaacagcaucugagcccucaacaccaacagcaccauccucuguagcagacaggccuc

SEQ ID NO: 133931 - RNA, 64 nt, Homo Sapiens
ggcucccucugggucauauggugcagacugugaccagcaccaggcaggcaguccugucugcgug

SEQ ID NO: 133932 - RNA, 64 nt, Homo Sapiens
gcucugagugggccugcucucuguagacugaauucagcaccagugaaaggcuuugagaaggacg

SEQ ID NO: 133933 - RNA, 64 nt, Homo Sapiens
ccauagaggcccaggcaccaccaggagcagcagccagcaccaccuacacaggagucuucagacc

SEQ ID NO: 133934 - RNA, 64 nt, Homo Sapiens
ggcuugcugccuuguuuccuaccccucccagccgcagcaccaagggacccagugcccucugcag

SEQ ID NO: 133935 - RNA, 64 nt, Homo Sapiens
cagggcagguuuggggagcccgcuuggagccucccagcaccagauucugauuuggcccccugcc

SEQ ID NO: 133936 - RNA, 64 nt, Homo Sapiens
agaacguguacgacgagcuggggggcagcccaggcagcaccagcgcggccacgugcacgcgccg

SEQ ID NO: 133937 - RNA, 64 nt, Homo Sapiens
augccaggaaagaccaaagcagaugcugcugacccagcaccacuucccagccaggagcccccca

SEQ ID NO: 133938 - RNA, 64 nt, Homo Sapiens
ggugagccgccugccaguggaggacagcaccccucagcaccacccacccucauucagagcacac

SEQ ID NO: 133939 - RNA, 64 nt, Homo Sapiens
gguucugagucagggugaucuguggacgggaccccagcaccaagucuacgggugccagaucagu

SEQ ID NO: 133940 - RNA, 64 nt, Homo Sapiens
ugagcaaaccccugugguccggcucauucugaagcagcaccaacguuccaguuccaagcaugga

SEQ ID NO: 133941 - RNA, 64 nt, Homo Sapiens
agagccaaggccuugggagcggauccuuccaaaccagcaccaacaucccgguuccaagccuaga

SEQ ID NO: 133942 - RNA, 64 nt, Homo Sapiens
uccugcacugcacuucugccgugagcucccugcccagcaccacccucccucugcccucccgucu

SEQ ID NO: 133943 - RNA, 64 nt, Homo Sapiens
gccaggcagucacuguuccuugagccagcgacaacagcaccagaauccccaguucuuagccagu

SEQ ID NO: 133944 - RNA, 64 nt, Homo Sapiens
auuacuaccuuuuaaaauauuuuagauaaaugcacagcaccacagcaccacaucuaagcauuag

SEQ ID NO: 133945 - RNA, 64 nt, Homo Sapiens
cuuuuaaaauauuuuagauaaaugcacagcaccacagcaccacaucuaagcauuagugaugggu

SEQ ID NO: 133946 - RNA, 64 nt, Homo Sapiens
agcauguucaccacuggucguucagcagccacgacagcaccaugugagauggcgagguggcugg

SEQ ID NO: 133947 - RNA, 64 nt, Homo Sapiens
cgacagcaccaugugagauggcgagguggcuggacagcaccagcagcgcaucccggcgggaacc

SEQ ID NO: 133948 - RNA, 64 nt, Homo Sapiens
gcggcccucggaagucuggucgcaguggcaaagccagcaccauggccagcagagcggugagcag

SEQ ID NO: 133949 - RNA, 64 nt, Homo Sapiens
caugaaaguucagccaaugcccagagugaccaagcagcaccagcaggccugcccaggaugcuga

SEQ ID NO: 133950 - RNA, 64 nt, Homo Sapiens
agagagccaaaauguguggcccuguccccaagcucagcaccaccggccaugaccagagguugcu

SEQ ID NO: 133951 - RNA, 64 nt, Homo Sapiens
aagccccccuggagcaucuuuucuaacccuaacccagcaccacaaagguagggccaauuaagga

SEQ ID NO: 133952 - RNA, 64 nt, Homo Sapiens
gcagaggcccagccagcccucggggagcauggcucagcaccagaacagguggucugguggauag

SEQ ID NO: 133953 - RNA, 64 nt, Homo Sapiens
auguccuccuuucuccuuugugcccagccugagucagcaccaaucccgcauucagaaccuccca

SEQ ID NO: 133954 - RNA, 64 nt, Homo Sapiens
aucugaaaagccagauaugccuguuuccuuuucccagcaccaugccuguggaggggacagucag

SEQ ID NO: 133955 - RNA, 64 nt, Homo Sapiens
aggaaugugacucccugggcccccagauggcgagcagcaccaccuccaagccgucaucaucauc

SEQ ID NO: 133956 - RNA, 64 nt, Homo Sapiens
gucccucuacuacaggcaguggaccuuggcccggcagcaccacgcugacuauagcaaccagcug

SEQ ID NO: 133957 - RNA, 64 nt, Homo Sapiens
ugcuggucaguggcagaacuuucuccuugugguccagcaccaccagcugcguaccucccgcugc

SEQ ID NO: 133958 - RNA, 64 nt, Homo Sapiens
ccaggggcuauuuuugugacaacgaaugcagccacagcaccagaacaagaggcugguuuuuaau

SEQ ID NO: 133959 - RNA, 64 nt, Homo Sapiens
cugugcccguccucggccccccacccugaagugccagcaccaccagcaccagauccuccgccgc

SEQ ID NO: 133960 - RNA, 64 nt, Homo Sapiens
uccucggccccccacccugaagugccagcaccaccagcaccagauccuccgccgccacaccgca

SEQ ID NO: 133961 - RNA, 64 nt, Homo Sapiens
ugagccccggacucugcuuacccugauggcugcucagcaccacagagugcuugggcugagggac

SEQ ID NO: 133962 - RNA, 64 nt, Homo Sapiens
aucagccagacaugucuagggugagaccagugcucagcaccacccgccaaggaacacugaugag

SEQ ID NO: 133963 - RNA, 64 nt, Homo Sapiens
uaggcaccgcauucugaucuggacaaagucgggacagcaccaucccagccccgaagccagggcc

SEQ ID NO: 133964 - RNA, 64 nt, Homo Sapiens
cugacaucgccagccgacgcccugaaucuuggugcagcaccaaccgcgugccuguguggcggga

SEQ ID NO: 133965 - RNA, 64 nt, Homo Sapiens
uaacaccacacacacgcagcaggagcgaaccggucagcaccaagacccacuuggagccccugca

SEQ ID NO: 133966 - RNA, 64 nt, Homo Sapiens
cucgggagcugcugagccaccucugauagaaagccagcaccagcugccgaaauucaagagccag

SEQ ID NO: 133967 - RNA, 64 nt, Homo Sapiens; identical to SEQ ID NO: 97553

SEQ ID NO: 133968 - RNA, 64 nt, Homo Sapiens; identical to SEQ ID NO: 97554

SEQ ID NO: 133969 - RNA, 64 nt, Homo Sapiens; identical to SEQ ID NO: 97555

SEQ ID NO: 133970 - RNA, 64 nt, Homo Sapiens; identical to SEQ ID NO: 97556

SEQ ID NO: 133971 - RNA, 64 nt, Homo Sapiens
ucuauuguucaagaguaacagguuuaacucaugaccaagugauguacauccaagugauguauuc

SEQ ID NO: 133972 - RNA, 64 nt, Homo Sapiens
uaacagguuuaacucaugaccaagugauguacauccaagugauguauucuggaaacgauggaau

SEQ ID NO: 133973 - RNA, 64 nt, Homo Sapiens
guuaccuuuacaauggagacaucuaccagaucauccaagugauuaaauuuaacaucaucaauga

SEQ ID NO: 133974 - RNA, 64 nt, Homo Sapiens
ggccaggcuggagugcagccucaaccuccuggguccaagugauccucccaccucagcacacaac

SEQ ID NO: 133975 - RNA, 64 nt, Homo Sapiens
gacugccaucauugaugaucacugugaaaauugaccaagugauguguuuacauuuacugaaaug

SEQ ID NO: 133976 - RNA, 64 nt, Homo Sapiens
caguaauuaauaucuccuggaacacuauagagaaccaagugaccgacucauuuacaacugaaac

SEQ ID NO: 133977 - RNA, 64 nt, Homo Sapiens
gugaggaauuauggauauauucugcuagcaauuuccaagugacaagacauuagcucuauggaau

SEQ ID NO: 133978 - RNA, 64 nt, Homo Sapiens
caaagugaccuggacaagauuucugaugaaagaaccaagugaccugucagaaaucuugaacaug

SEQ ID NO: 133979 - RNA, 64 nt, Homo Sapiens
accaccucuuauaaugcuccuuuuccacugugagccaagugaccuugggagagguaagauggug

SEQ ID NO: 133980 - RNA, 64 nt, Homo Sapiens
aacaaggugcuucucuacuuccaccaauaaacuuccaagugagucccuaauuuuugcagguugg

SEQ ID NO: 133981 - RNA, 64 nt, Homo Sapiens
cagccacagggacccaagcaaauaaccaggacagccaagugaagauuuaaaaacaaauuggaag

SEQ ID NO: 133982 - RNA, 64 nt, Homo Sapiens
gacacagguggucuaaaaauguuaaccaacacccccaagugacuggugagcucagaaaccuacu

SEQ ID NO: 133983 - RNA, 64 nt, Homo Sapiens
ugugugcauuuuuuauaacuaggugcuggagaucccaagugaaggaugcuggcaaggagcggga

SEQ ID NO: 133984 - RNA, 64 nt, Homo Sapiens
aauaugcucaguuaauuucauuuacaaaugcuuuccaagugauggggaagaaauguaaaagaau

SEQ ID NO: 133985 - RNA, 64 nt, Homo Sapiens
uccagcugauguaucuaauaauuuuuuguuaaaaccaagugauuuaaauaagauuacagagaaa

SEQ ID NO: 133986 - RNA, 64 nt, Homo Sapiens
cagugucuucaucacaagauugcugaccguguguccaagugagccacugagauguauuuaugca

SEQ ID NO: 133987 - RNA, 64 nt, Homo Sapiens
aaaaaaaaaaaacuagaaagcaaaacuauuugauccaagugaaaacagaucuuuuucugucuau

SEQ ID NO: 133988 - RNA, 64 nt, Homo Sapiens
agcaaccaaguccaggaaaugucuucuuaacugcccaagugaaaugauggggaaaacaagcugu

SEQ ID NO: 133989 - RNA, 64 nt, Homo Sapiens
uuuucagucuuucaaauagccccaaccuuuauuuccaagugacagauccauuucuguguguucc

SEQ ID NO: 133990 - RNA, 64 nt, Homo Sapiens
ggccauuuucggacgcagccgcagcuccacccucccaagugacaguggucaacaggaagaccca

SEQ ID NO: 133991 - RNA, 64 nt, Homo Sapiens
ugucugcgaguggcuaguuuuaccugccagauaaccaagugagaugccuacccacgugccugcu

SEQ ID NO: 133992 - RNA, 64 nt, Homo Sapiens
acgaggccaaggcugaaacccccagcgugggaccccaagugaagccucagcacauccgacaccu

SEQ ID NO: 133993 - RNA, 64 nt, Homo Sapiens
ugagucauugcaagggagaccgcuuugugcuacaguagcagaguuuuuaaauauuguguauggc

SEQ ID NO: 133994 - RNA, 64 nt, Homo Sapiens
caagauuuuuuuuaauauaguuacaagcuaguaaguagcagagcguuaaauaacuuaucugugg

SEQ ID NO: 133995 - RNA, 64 nt, Homo Sapiens
gcucagcucaugggccucaucccuucucucccagguagcagaaaacgcuuuuuauuguauucaa

SEQ ID NO: 133996 - RNA, 64 nt, Homo Sapiens
accuugcaaagaugcagucaccauagauguccacguagcagagacugacuuaggaucugagaua

SEQ ID NO: 133997 - RNA, 64 nt, Homo Sapiens
guggcugcccaggggcugccggacauacaguuucguagcagaacaugcucacaugcacauauau

SEQ ID NO: 133998 - RNA, 64 nt, Homo Sapiens
uuccacaaaaaugcuuauuuuuuuaugaaaacauguagcagauuuaguacaucauagcacuuua

SEQ ID NO: 133999 - RNA, 64 nt, Homo Sapiens
aaucuuuucacaggaagaauuguauuugcaacggguagcagaauuggacaaaauuacuuaugaa

SEQ ID NO: 134000 - RNA, 64 nt, Homo Sapiens
gcuucuagauuacaaaaauaugacaaucuuguaaguagcagacuauggagaaaaaugaguuacc

SEQ ID NO: 134001 - RNA, 64 nt, Homo Sapiens
cagucaguaaaccugugagacugcuggaggaaauguagcagacagcauggaggcugggacccag

SEQ ID NO: 134002 - RNA, 64 nt, Homo Sapiens
aaacugauguuacauuagguuccaauucgcaauaguagcagagacugacaugcuuuuauugacc

SEQ ID NO: 134003 - RNA, 64 nt, Homo Sapiens
aacaggugcuaugugaccaggaaucuagccgggaguagcagaggcccugucuucugaagucuca

SEQ ID NO: 134004 - RNA, 64 nt, Homo Sapiens
auggugcugguaggagguuaucagaguaaggaagguagcagauauaggugcagggugccuguca

SEQ ID NO: 134005 - RNA, 64 nt, Homo Sapiens
cagagcuagacuguaaagguaauuugggauucauguagcagagaagaggggaacuugauucaaa

SEQ ID NO: 134006 - RNA, 64 nt, Homo Sapiens
accaggcagacagaaccuugugauaugagacaauguagcagaauugaguuaaaaauggcacuuu

SEQ ID NO: 134007 - RNA, 64 nt, Homo Sapiens
cucucucgaccugauguguagacgcucacuuccaguagcagaaccaccuuaguugugucuuaca

SEQ ID NO: 134008 - RNA, 64 nt, Homo Sapiens
agacucagaagguauauuaggacauuuggaaucaguagcagagcaaagccucuuugaaaaaaac

SEQ ID NO: 134009 - RNA, 64 nt, Homo Sapiens
gcuguugcucaaaauguauuuacgcaugugggacccucguuauccuggcucuggugcugccauc

SEQ ID NO: 134010 - RNA, 64 nt, Homo Sapiens
ggagaagcuuuagcuucauuuuacuaaaaagauuccucguuauuguuguugccaaagagaaaca

SEQ ID NO: 134011 - RNA, 64 nt, Homo Sapiens
caagaaacuguucgaaaaagaacaaaaacacuucccucguuauuuucucucauuuuuugaugag

SEQ ID NO: 134012 - RNA, 64 nt, Homo Sapiens
ugauguggaaaccauauugguaaaguuguuaaucccucguuauggagaacugaucuuaagcuau

SEQ ID NO: 134013 - RNA, 64 nt, Homo Sapiens
cagaagaagucaguaguuauguguccuucgcguuccucguuaaguccugugggcgcucugcccu

SEQ ID NO: 134014 - RNA, 64 nt, Homo Sapiens
uuuaguaucuguuccccaacuuacccuguagaaaccucguuauuaaccaguguuccagucuuaa

SEQ ID NO: 134015 - RNA, 64 nt, Homo Sapiens
guuagguauaaagacauaaaaaugugugucaagcccucguuagcugaugagguaaaugcaugga

SEQ ID NO: 134016 - RNA, 64 nt, Homo Sapiens
gcugcuccuucccaccccucagaacagcucugauccucguuaauaccuggcugcgugugcagcu

SEQ ID NO: 134017 - RNA, 64 nt, Homo Sapiens
ccacgaccagauaagaaucauauacgccaaauucccucguuauggcaaaccacgccaugaccca

SEQ ID NO: 134018 - RNA, 64 nt, Homo Sapiens
caugauuuauccaaaguuucaccagcuuauaauuccucguuaugaaugauuguuauuuuuaaaa

SEQ ID NO: 134019 - RNA, 64 nt, Homo Sapiens
ucuucaccccuagcugucaguuuggcagauuuucccucguuaccuccaguucgacucagaaccu

SEQ ID NO: 134020 - RNA, 64 nt, Homo Sapiens
agcucgagaagggccugaccuaaaggucagguccccucguuaaaaaaauauguacgucuagcuc

SEQ ID NO: 134021 - RNA, 64 nt, Homo Sapiens
ucuaugguucauaugcuucucccugaauguuaggccucguuagcggagcucaugugagucagga

SEQ ID NO: 134022 - RNA, 64 nt, Homo Sapiens
gaggguccuguuccucucuuaagccacuccuugcccucguuaaagaaaguaacaagcucagagg

SEQ ID NO: 134023 - RNA, 64 nt, Homo Sapiens
ggauauagucuuuauccuaacuuagguuuugaagccucguuauucugcaaacaguggaacaugg

SEQ ID NO: 134024 - RNA, 64 nt, Homo Sapiens
acaugagcuuauauuuugggacugaauugccugaccucguuaucugcacuuuaugaauuaaaaa

SEQ ID NO: 134025 - RNA, 64 nt, Homo Sapiens
agaggaaaaccaaaacccuuugaaacaguaucauccucguuagugcauacauaacugaagcaug

SEQ ID NO: 134026 - RNA, 64 nt, Homo Sapiens
cuauccaccaccccacccaccuuugcagggaauaccucguuagagaauggccugagacagugcg

SEQ ID NO: 134027 - RNA, 64 nt, Homo Sapiens
ucccacgcacaccugagcuuucggcaugcucccaccucguuaaaggugauuucccucuccccau

SEQ ID NO: 134028 - RNA, 64 nt, Homo Sapiens
acguccuuggccagcuuaauggccuuccccucggccucguuaagcaucccugugacgcucucaa

SEQ ID NO: 134029 - RNA, 64 nt, Homo Sapiens
cuggaacagcuuuuuguccuguacccaguguuacccucguuauuuuguaaccuuccaauuccug

SEQ ID NO: 134030 - RNA, 64 nt, Homo Sapiens
acuguaaaaugguaaacguguguauuauaucuggccucguuauauaguguauauauauguauac

SEQ ID NO: 134031 - RNA, 64 nt, Homo Sapiens
cuagagugguucuauuuggucuucaguguuuuagccucguuaguucauauuuggcaugcagcuu

SEQ ID NO: 134032 - RNA, 64 nt, Homo Sapiens
cuccgggaugaccuuguagguuuuagcagagacaccucguuaagcuccaagcgccuggagugcu

SEQ ID NO: 134033 - RNA, 64 nt, Homo Sapiens
uguaccuuugggguauuauuuuguggcccgugacccucguuauuguuacagcugaguguauguu

SEQ ID NO: 134034 - RNA, 64 nt, Homo Sapiens
cuuccucugauuuacauucacacaauaaagaaccccucguuagcucuuucuguugaaaagcaca

SEQ ID NO: 134035 - RNA, 64 nt, Homo Sapiens
aaacccagccugaccgcuucugacgccgggauggccucguuacuagacuuuucuuuuuaaggaa

SEQ ID NO: 134036 - RNA, 64 nt, Homo Sapiens
uaaucgcugccucuaggggagcugauuguagcagccucguuagugucacccccuccucccugau

SEQ ID NO: 134037 - RNA, 64 nt, Homo Sapiens
uguguuuccaucagcucccuguccuccuuucuucccucguuauugaucuauagacauuaggaag

SEQ ID NO: 134038 - RNA, 64 nt, Homo Sapiens
cccagggucugccgucuagagaacccagcuggccccucguuagccugcacuccgugaccucuga

SEQ ID NO: 134039 - RNA, 64 nt, Homo Sapiens
aaggccagaaaaggcagccagauccccagggcagccucguuaggacaaggcugugccaggcugg

SEQ ID NO: 134040 - RNA, 64 nt, Homo Sapiens
cucaccucgugauauccacacugcucccaauucaccucguuacuuuuccaaaaucaggcuuugu

SEQ ID NO: 134041 - RNA, 64 nt, Homo Sapiens
ccuuuucuuaaaauauucucgcaaaauuuuacuaccucguuaaccaguaagugaaguacagaua

SEQ ID NO: 134042 - RNA, 64 nt, Homo Sapiens
acauggcuuccuaaauggccgagcauccgucuccccucguuaacuuaucccugcacacggcaca

SEQ ID NO: 134043 - RNA, 64 nt, Homo Sapiens
cacaggaucccacgaauuuauaacuccccaacucccucguuaauuguguguugcaggggggcag

SEQ ID NO: 134044 - RNA, 64 nt, Homo Sapiens
aucuguguagacgaagggggcaucuggccuuacaccucguuagggaagagaaacaggguguugu

SEQ ID NO: 134045 - RNA, 64 nt, Homo Sapiens
aauauuacaacagcauuguuuuuuccuuguuuuuccucguuacccuuucaguuauguauauuug

SEQ ID NO: 134046 - RNA, 64 nt, Homo Sapiens
aaauuccucccagucagggguuucuucugucucaccucguuagaguaguuccuuuuuguuucau

SEQ ID NO: 134047 - RNA, 64 nt, Homo Sapiens
ucugauccaauguaauuggcugcgucuggcuaauucuaagcacuaaagucuacaucuaagcuau

SEQ ID NO: 134048 - RNA, 64 nt, Homo Sapiens
acugcuggugaaccaauaccauaagcauguauuaucuaagcacuugaucaagaaauauacaugu

SEQ ID NO: 134049 - RNA, 64 nt, Homo Sapiens
caggucggugagaggacaagagggacucccauguucuaagcaccuguuccuggccaggcucuag

SEQ ID NO: 134050 - RNA, 64 nt, Homo Sapiens
gcaccuguuccuggccaggcucuaggccaggcucucuaagcacauuucuccuuucauucccccu

SEQ ID NO: 134051 - RNA, 64 nt, Homo Sapiens
ggggcuuucggggagggcgccuaguccccccagcucuaagcagccaggagggaccugcaucuaa

SEQ ID NO: 134052 - RNA, 64 nt, Homo Sapiens
ccccccagcucuaagcagccaggagggaccugcaucuaagcaucuggguugccauggcaauggc

SEQ ID NO: 134053 - RNA, 64 nt, Homo Sapiens
uuuuucccaguaugcccuagaagguggccgugccucuaagcaugucaauuggacuccuuccaga

SEQ ID NO: 134054 - RNA, 64 nt, Homo Sapiens
ggaaagaaaacugacuuuguacaaugaaaauuguucuaagcaaaucuuuucuccagguaguagg

SEQ ID NO: 134055 - RNA, 64 nt, Homo Sapiens
aggagucuccugcugaugcgugauagcuuaagcuuggggagaaggucuuuuccacugccuagcu

SEQ ID NO: 134056 - RNA, 64 nt, Homo Sapiens
gagaaggucuuuuccacugccuagcuaagcagucuggggagagcauggggaucauuucuaugug

SEQ ID NO: 134057 - RNA, 64 nt, Homo Sapiens
aacucauguuaccucugcaggccuucacagcuaauggggagaggaggucuucauggcagaccag

SEQ ID NO: 134058 - RNA, 64 nt, Homo Sapiens
ugaaugguacgggugaggagcggcagaagcuguguggggagauacucgccuuuccugccccagc

SEQ ID NO: 134059 - RNA, 64 nt, Homo Sapiens
accagcugggugcuugggcagagagugugacauguggggagaggggguugggggagaggcugag

SEQ ID NO: 134060 - RNA, 64 nt, Homo Sapiens
cugugggccuggagauaaaauucuugggggguguuggggagagaacugagaacucccucuggaa

SEQ ID NO: 134061 - RNA, 64 nt, Homo Sapiens
agcaucccauuugcccacacgcuguucuggggacuggggagauugaauugaauugugcaauguu

SEQ ID NO: 134062 - RNA, 64 nt, Homo Sapiens
cuaagcccuccgauguguguucagaaugagguccuggggagaauaucuuuaccucugauagagg

SEQ ID NO: 134063 - RNA, 64 nt, Homo Sapiens
cuucacccucaguuuccucacuugaggagugggauggggagaacagagaguagcuguguuugaa

SEQ ID NO: 134064 - RNA, 64 nt, Homo Sapiens
agagcaauuuauacuuuacccucaggcuguccucuggggagaaggugccauggucuuagguguc

SEQ ID NO: 134065 - RNA, 64 nt, Homo Sapiens
ggugacuccauugacccagccugcaggggggucuuggggagagugccauggugagggcuaucug

SEQ ID NO: 134066 - RNA, 64 nt, Homo Sapiens
guacuguuccugaacacuggagacuccaggccccuggggagacuuuccagagaguggcuggaag

SEQ ID NO: 134067 - RNA, 64 nt, Homo Sapiens
aggauggagauaggauggagcaaccacacgcuguuggggagagagaugugcucccugaaacaga

SEQ ID NO: 134068 - RNA, 64 nt, Homo Sapiens
acauccuccucugauggccaauuuuuccaagucuuggggagaaaccacuguuuuccuugcuguu

SEQ ID NO: 134069 - RNA, 64 nt, Homo Sapiens
ucugaaaagacaguugugugcauggaugugugcguggggagaaagaacguggguaagauguccc

SEQ ID NO: 134070 - RNA, 64 nt, Homo Sapiens
uccagucccacuccugucaccccacgcucugcacuggggagaaaacgggaggugcucgugcugg

SEQ ID NO: 134071 - RNA, 64 nt, Homo Sapiens
agcauacgccaggagccuccccgcacugaaggaguggggagaagcucccuucccccuaagccaa

SEQ ID NO: 134072 - RNA, 64 nt, Homo Sapiens
gagggguggcaugaugaggaugcccaccaggggcuggggagaagggcuagaaugcccgggcugg

SEQ ID NO: 134073 - RNA, 64 nt, Homo Sapiens
gucuucuuggcagcuuaacauugacuucuugguuuggggagaaauaaauuuuguuucagaauuu

SEQ ID NO: 134074 - RNA, 64 nt, Homo Sapiens
uguaggaauccuuugagaaugugauuccuuuugauggggagaaagggcaaauuauuuuaauauu

SEQ ID NO: 134075 - RNA, 64 nt, Homo Sapiens
ggaagaggcagggaguaauccuucaggauggauguggggagaguguggacagccagaggggcca

SEQ ID NO: 134076 - RNA, 64 nt, Homo Sapiens
auggcucagaggaaggguggcccacagacacugguggggagaccucuguauggaggcugcucac

SEQ ID NO: 134077 - RNA, 64 nt, Homo Sapiens
gauuucccugcagaccucaagaggagcagcagcuuggggagaggaacuaagccaggccuggcug

SEQ ID NO: 134078 - RNA, 64 nt, Homo Sapiens
cuucucuccuugccccccgcccccgagguagggguggggagaugucaccgcuggcccuuagaga

SEQ ID NO: 134079 - RNA, 64 nt, Homo Sapiens
caugcagugugaguagaaggaagucaacaauauguggggagagcacucgguugucuuuacuuuu

SEQ ID NO: 134080 - RNA, 64 nt, Homo Sapiens
agccuuucugaaucuauaauaaugguacuucuacuggggagaguguaauauuuuggacugcugu

SEQ ID NO: 134081 - RNA, 64 nt, Homo Sapiens
agcuuucagagucuucacuggcaguagggggagauggggagaggaaugaucucugcccagcccc

SEQ ID NO: 134082 - RNA, 64 nt, Homo Sapiens
aagagagaguggguuugggaagagugagggugguuggggagaggggaccgaugugccucauugu

SEQ ID NO: 134083 - RNA, 64 nt, Homo Sapiens
uauuaaacaugggaaacugaagcccuugaagguuuggggagagggggguaucaggcagggaggg

SEQ ID NO: 134084 - RNA, 64 nt, Homo Sapiens
ugccauugcccagggguagcccuucgguaugggcuggggagaaggguuggucuucugccagggu

SEQ ID NO: 134085 - RNA, 64 nt, Homo Sapiens
ggccccccagccagggaucccagaggcugaggguuggggagaggaagccaucaucucauuaccu

SEQ ID NO: 134086 - RNA, 64 nt, Homo Sapiens
acucuuacguugcuugagucucugacagccagucuggggagauggaaggcugggugcuucuugc

SEQ ID NO: 134087 - RNA, 64 nt, Homo Sapiens
acauuuuagaaucucuaguggaaagagcccugacuggggagagacucgccugcagagcagccca

SEQ ID NO: 134088 - RNA, 64 nt, Homo Sapiens
agauguuuugaguuauuucccuuaaguguuucacuggggagagaacagggagugcuccuccagc

SEQ ID NO: 134089 - RNA, 64 nt, Homo Sapiens
cucagaauguguggacaggucagcuuagaagagauggggagauucaggaucccccugugccaga

SEQ ID NO: 134090 - RNA, 64 nt, Homo Sapiens
gaccuggacacuagggucaggcggggugcugugguggggagaggcauggcuggggugggggugg

SEQ ID NO: 134091 - RNA, 64 nt, Homo Sapiens
gcugugguggggagaggcauggcugggguggggguggggagaccugguuggccgugguccagcu

SEQ ID NO: 134092 - RNA, 64 nt, Homo Sapiens
uacagcccuauccccccuccuugcuucugugaaauggggagacaaagcacuuuugcucuccaaa

SEQ ID NO: 134093 - RNA, 64 nt, Homo Sapiens
ucugaagcugaugcuuauuaaaacaaaugauguauggggagaggagaaggaagggcaaggaagg

SEQ ID NO: 134094 - RNA, 64 nt, Homo Sapiens
uagggugggaggcagggcaaggcuguuuauaauuuggggagagacucugcugcuucccaaggau

SEQ ID NO: 134095 - RNA, 64 nt, Homo Sapiens
ucuuaacucugcugcuucccugucacuagggcaguggggagacgugcucuccuguuggugugua

SEQ ID NO: 134096 - RNA, 64 nt, Homo Sapiens
aacuccuuggccuagcccaccccaggagggucuauggggagaggggagcccucaucuugaaggg

SEQ ID NO: 134097 - RNA, 64 nt, Homo Sapiens
uggacaguucacacccugcacguggagcaggcgguggggagagauuucucuuuguggggcuugg

SEQ ID NO: 134098 - RNA, 64 nt, Homo Sapiens
gcaauaucaucugggagauuucagauugccaauuuggggagacaccaaucccugccucugccca

SEQ ID NO: 134099 - RNA, 64 nt, Homo Sapiens
agagaaagggcucccaccugggacgugugggcccuggggagagggagaaaccugccaugcucug

SEQ ID NO: 134100 - RNA, 64 nt, Homo Sapiens
cuaacaagguguggagugucagcgaggugcaauguggggagaauacauuguagaauauaagguu

SEQ ID NO: 134101 - RNA, 64 nt, Homo Sapiens
ugguggacgcagaccuugagaacaaccuaaauuauggggagaauuuuaaaauguuaaacuguaa

SEQ ID NO: 134102 - RNA, 64 nt, Homo Sapiens
aaggagaaagagugagggcaaugaagggcgaugguggggagacucggugggugaauggggagac

SEQ ID NO: 134103 - RNA, 64 nt, Homo Sapiens
ugaagggcgaugguggggagacucggugggugaauggggagaccagaaagaaagaguccacaga

SEQ ID NO: 134104 - RNA, 64 nt, Homo Sapiens
uguacacuagcaggaugggucuugggaguuggcauggggagauuguaagggcuguaucuccgcg

SEQ ID NO: 134105 - RNA, 64 nt, Homo Sapiens
ggagagaggagugaccgggacuggagccagggucuggggagagcaacagcaccaggcuuuuccu

SEQ ID NO: 134106 - RNA, 64 nt, Homo Sapiens
caaccuuggccgacaugcagcauccacccccggcuggggagaggccccgcggucgcucaggggc

SEQ ID NO: 134107 - RNA, 64 nt, Homo Sapiens
ggcuagcugcggugcuccuugcugguuuuuaacuuggggagaaacaccggguuucagcuuucuu

SEQ ID NO: 134108 - RNA, 64 nt, Homo Sapiens
ugagccaccaugccuggccaggacauauuugaaauggggagauuuuaaaaauucugaugauuag

SEQ ID NO: 134109 - RNA, 64 nt, Homo Sapiens
gugggcucagcuuuggcugugcauuggaaucaccuggggagauuuguaagcuucugcugucugg

SEQ ID NO: 134110 - RNA, 64 nt, Homo Sapiens
uggaccugucacaugaaauggaucagcacuugaauggggagaaguggagggagaggcccugggc

SEQ ID NO: 134111 - RNA, 64 nt, Homo Sapiens
uuguuugcacuauuggacuuaggagugccgaggguggggagauggagcugcccgucucagugug

SEQ ID NO: 134112 - RNA, 64 nt, Homo Sapiens
cuucuguucucugcugagggccaauacccuacuguggggagagauggcacaccagaugcuuuug

SEQ ID NO: 134113 - RNA, 64 nt, Homo Sapiens
uaaucacucugagucacaggugugggauggagaguggggagaggcacuuaaucuguaaccccca

SEQ ID NO: 134114 - RNA, 64 nt, Homo Sapiens
cccagcccagcugcucugcccagagcugggugaguggggagacaccucagagccccgcaaaacc

SEQ ID NO: 134115 - RNA, 64 nt, Homo Sapiens
uguccuuuccaguggccuggcuccgcuguguggauggggagaucggggccagaggcagaacccu

SEQ ID NO: 134116 - RNA, 64 nt, Homo Sapiens
acaucacagagcagccagccagcuggaggggagguggggagagaggcccugccaccaaguugag

SEQ ID NO: 134117 - RNA, 64 nt, Homo Sapiens
ugcuugaaccugggaggugguuuggaggcugagguggggagaauaugccuguaaucccagcuac

SEQ ID NO: 134118 - RNA, 64 nt, Homo Sapiens
uaauaaaacaauauuaacuuaauauuuacagauguggggagaugaaaaauuggaugcguaaagu

SEQ ID NO: 134119 - RNA, 64 nt, Homo Sapiens
gauuguccuuaaaccuaagcuacugaaagcacccuggggagauugggagcugaggggaggaucu

SEQ ID NO: 134120 - RNA, 64 nt, Homo Sapiens
aagccauccccgaaagaggugaaagagaucacuuuggggagagcuggagaacaggauucuaggc

SEQ ID NO: 134121 - RNA, 64 nt, Homo Sapiens
uuggcuggaguagaauuaagucagagccaacagguggggagagacagagaagugggcaggggca

SEQ ID NO: 134122 - RNA, 64 nt, Homo Sapiens
ggcuuugugguuuuuagaguugcaucuaugaaccuggggagauuaugugcuuucccaagcguuc

SEQ ID NO: 134123 - RNA, 64 nt, Homo Sapiens
aggacaacguucuaaaaguacaauuauuucuuauuggggagauuacagguaguuuggcaaagca

SEQ ID NO: 134124 - RNA, 64 nt, Homo Sapiens
acaaaauugguguuuagauucauucccaugugacuggggagaaggcggguacuccagcuugugg

SEQ ID NO: 134125 - RNA, 64 nt, Homo Sapiens
ugugauguucuugguuuucuguucuuugcauuuguggggagaugacuaacaauucaacagugau

SEQ ID NO: 134126 - RNA, 64 nt, Homo Sapiens
ggccgagucuccgacugucucgagucucugggucugucuacacucuggcucugucuacacuggc

SEQ ID NO: 134127 - RNA, 64 nt, Homo Sapiens
ggccgagucucugggucugugcccagccuggcucugucuacacuggggccagcgucgccgggcu

SEQ ID NO: 134128 - RNA, 64 nt, Homo Sapiens
agcuggugacuauaaauaauauuuuaaaaugcugugucuacaccaucaagacugugucuacacu

SEQ ID NO: 134129 - RNA, 64 nt, Homo Sapiens
auuuuaaaaugcugugucuacaccaucaagacugugucuacacuaucuuggcugaacgagaaga

SEQ ID NO: 134130 - RNA, 64 nt, Homo Sapiens
uuacagaagccaggaaaaguguauuagaaacuguugucuacaccacuuuuaauuggugaacaau

SEQ ID NO: 134131 - RNA, 64 nt, Homo Sapiens
aaacauuguaucuucucuguggaugcucaggccuugucuacaaugaggcuuuacaaccuuccuu

SEQ ID NO: 134132 - RNA, 64 nt, Homo Sapiens
agguugcaaacugcucacuucuugcauuuucccaugucuacagcuagagaacucuuugggaucc

SEQ ID NO: 134133 - RNA, 64 nt, Homo Sapiens
uuguuauaaagaugggagcaguguucuuuccagaugucuacaugcuaggcagaaacuagaaguc

SEQ ID NO: 134134 - RNA, 64 nt, Homo Sapiens
uuaacuagcauguuaacugcacuuuucauuacgugaauggaacuuaccuaaccacagggcucag

SEQ ID NO: 134135 - RNA, 64 nt, Homo Sapiens
guuuuauucauaaauuaaaugucuacaugugccagaauggaaaggaaacaaggggagacaacuu

SEQ ID NO: 134136 - RNA, 64 nt, Homo Sapiens
gaggagaggggcuaagacauguaccaacaggaaggaauggaagauuaaaaguuagaagaaauga

SEQ ID NO: 134137 - RNA, 64 nt, Homo Sapiens
gagcaaaggaaaauuuuaagucgauauacucauagaauggaaguucuaauguccagcugcucca

SEQ ID NO: 134138 - RNA, 64 nt, Homo Sapiens
cauuagcugugugcauauaaaaagauuuucagcugaauggaacucaucuuuaaagcuuuuacua

SEQ ID NO: 134139 - RNA, 64 nt, Homo Sapiens
ucuuucacuucauuauaugcauugagagguugaugaauggaaauuuuuucuuugaaaaccuggg

SEQ ID NO: 134140 - RNA, 64 nt, Homo Sapiens
ugaugggaaauaugacuucaauccaacuagaaaugaauggaagacaguuguguggaaauguaug

SEQ ID NO: 134141 - RNA, 64 nt, Homo Sapiens
uuauacaucguugguggcucggagugugugcucugaauggaaaggaacuaaccguuguaaugca

SEQ ID NO: 134142 - RNA, 64 nt, Homo Sapiens
ccuuucacucuuggcuuucuuauguugcuuucaugaauggaauggaaaaaagaugacucaguua

SEQ ID NO: 134143 - RNA, 64 nt, Homo Sapiens
cacucuuggcuuucuuauguugcuuucaugaauggaauggaaaaaagaugacucaguuaaggca

SEQ ID NO: 134144 - RNA, 64 nt, Homo Sapiens
gagaugcccacaggagguccccugcugaggaauggaauggaaugaacagagcuccgucauguag

SEQ ID NO: 134145 - RNA, 64 nt, Homo Sapiens
gaauggagaugcccacaggauguagccugcugaggaauggaauguacugaacagagcuccguca

SEQ ID NO: 134146 - RNA, 64 nt, Homo Sapiens
uucaccaggacuccauucuuaggacucuaagccagaauggaaaaaaacaccugaccaccauuua

SEQ ID NO: 134147 - RNA, 64 nt, Homo Sapiens
gcucugucucccuaacucaacacauuuuuugggggaauggaaaaaacaaaccuccuugggaauc

SEQ ID NO: 134148 - RNA, 64 nt, Homo Sapiens
auuuguuggcguaauuuuuggagggaauggaaaggaauggaaaguauuugauuuuauucuugca

SEQ ID NO: 134149 - RNA, 64 nt, Homo Sapiens
gaauggaaagauuuguuggcuauucuugcagagggaauggaaaggccuaacaguuauuugauuu

SEQ ID NO: 134150 - RNA, 64 nt, Homo Sapiens
uauuuuaaauuuauauuugaacacagucaaaucugaauggaaauacauuuaaauaagcauuucu

SEQ ID NO: 134151 - RNA, 64 nt, Homo Sapiens
uguuuuggaaugucccccacuuggagaguuugaggaauggaaaugagaaucggaggagaaauaa

SEQ ID NO: 134152 - RNA, 64 nt, Homo Sapiens
aaacauagcaauugucaagcauggaauguuaacugaauggaauucaauuuuuuaaacuaacaaa

SEQ ID NO: 134153 - RNA, 64 nt, Homo Sapiens
aaagaauauuuucugaagaucuaaacucuaccaagaauggaaacugcaggacuguuacucacua

SEQ ID NO: 134154 - RNA, 64 nt, Homo Sapiens
cagugaacggaaaacacagaugucaaaaugcagagaauggaaaacucuguaggguacuguaauu

SEQ ID NO: 134155 - RNA, 64 nt, Homo Sapiens
ggagucugagaucuguacugacaauuaguuuacagaauggaaaaacauuugaguaaccaucaac

SEQ ID NO: 134156 - RNA, 64 nt, Homo Sapiens
ugucaauuuuuucaggaccuuaguuccagcagcagaauggaaaaauccuugaagcccaggcuga

SEQ ID NO: 134157 - RNA, 64 nt, Homo Sapiens
uggaauguacaguauuuugcuagugcauuucaaggaauggaaucuucuccaguaugaaauuacc

SEQ ID NO: 134158 - RNA, 64 nt, Homo Sapiens
aaaauucuuuucucuacagcuggcaaccaggaaggaauggaaaauuguaugggagaagauacug

SEQ ID NO: 134159 - RNA, 64 nt, Homo Sapiens
uaaugcagauauuucuguggucuucaacuuauuagaauggaagauucagacugaaauguuugug

SEQ ID NO: 134160 - RNA, 64 nt, Homo Sapiens
cagcacacuccguccccucuagaaguagagaagagaauggaaaguguaucuucuccccagugac

SEQ ID NO: 134161 - RNA, 64 nt, Homo Sapiens
guugagcauuuaguacaaguuccauagucugagagaauggaaucaaaaaaaugugacagaaugu

SEQ ID NO: 134162 - RNA, 64 nt, Homo Sapiens
gcccuuuccuuaaggagacaaagaaagugcauuagaauggaauuaaaauucaccuuacagugcu

SEQ ID NO: 134163 - RNA, 64 nt, Homo Sapiens
ugaugcacaccaacaagaggaucuuugcacagaugaauggaaguagggcacaagauggucugug

SEQ ID NO: 134164 - RNA, 62 nt, Homo Sapiens
aacagauaauucugaaauaaucagcagaaacggaauggaaugccaagaaucugcauugagaa

SEQ ID NO: 134165 - RNA, 64 nt, Homo Sapiens
uaaaaccgauaccuguccugcaggucuaaaauuugaauggaaauucaagcacaaguacugggga

SEQ ID NO: 134166 - RNA, 64 nt, Homo Sapiens
guuacuuugacauaggaauugacuucuuuuccuugaauggaaaacacuuugaaauaauaauaaa

SEQ ID NO: 134167 - RNA, 64 nt, Homo Sapiens
gauauuugucauauauuuaagaaaaagcuaaaaagaauggaaaucgcaugacuauaacuuaagu

SEQ ID NO: 134168 - RNA, 64 nt, Homo Sapiens
cgcaugacuauaacuuaagugaaaaagcuaaaaagaauggaaaugauauuugucguauauugaa

SEQ ID NO: 134169 - RNA, 64 nt, Homo Sapiens
cacuuugaaauaauaauaaagacuucuuuuccuugaauggaaaaguuacuuugacauaggaauu

SEQ ID NO: 134170 - RNA, 64 nt, Homo Sapiens
uugacaauauuagauaauauaacaauaauugggagaauggaauaauguaaaagaagagauacuu

SEQ ID NO: 134171 - RNA, 64 nt, Homo Sapiens
guaaauuacaugacacaaaaagagaaaauucaaggaauggaagacaagagccaacucccaguuu

SEQ ID NO: 134172 - RNA, 64 nt, Homo Sapiens
uuaauaacaaaugggccaaaggugucagucuuaggaauggaaguggaaauuauuuugugucuca

SEQ ID NO: 134173 - RNA, 64 nt, Homo Sapiens
gaugggucaccucucuucauugugcugucacugugaauggaaagacaaaaaggaggugcccccc

SEQ ID NO: 134174 - RNA, 64 nt, Homo Sapiens
cuucccuggugauggucucuggauguccuuccaagaauggaaucuaaagacccgccccccgguu

SEQ ID NO: 134175 - RNA, 64 nt, Homo Sapiens
aagcaguuuacucuagacuacuggagaguguggggaauggaaaggaauaagggaggagagggga

SEQ ID NO: 134176 - RNA, 64 nt, Homo Sapiens
cguccuaccgugcagccacaggacacucgugauggaauggaaauuguggagaugagaagguggu

SEQ ID NO: 134177 - RNA, 64 nt, Homo Sapiens
gacagcaagcacaggugagucagugugcucgugggaauggaaagcggagcgggggugagggggg

SEQ ID NO: 134178 - RNA, 64 nt, Homo Sapiens
cugccuggugaaguuucaaguguucagcagaccucucugguaacauaucuggaauauuguuguu

SEQ ID NO: 134179 - RNA, 64 nt, Homo Sapiens
aaggguuggucuucuguauccucugcuguugagccucugguaagcuuucaucucccaugaacuc

SEQ ID NO: 134180 - RNA, 64 nt, Homo Sapiens
ucuguagccaauucccauauagugccugccgugccucugguacaccuuggggcuggcccauagc

SEQ ID NO: 134181 - RNA, 64 nt, Homo Sapiens
acugucagacgcacacgcgccugggcagcgucugcucugguaggccagcccagcccacgccgag

SEQ ID NO: 134182 - RNA, 64 nt, Homo Sapiens
aaaaucaaauaccuuagagaauugucacauuucucucugguagaaaaaacaauuuguauucaau

SEQ ID NO: 134183 - RNA, 64 nt, Homo Sapiens
auuaagacucacacagaaucauuggaaaagaacucucugguauuguugauuuuuaauauauuug

SEQ ID NO: 134184 - RNA, 64 nt, Homo Sapiens
agaacuuaaugaaccugaacccaggcuucucuagcucugguaacgugugauuguuuucacuaca

SEQ ID NO: 134185 - RNA, 64 nt, Homo Sapiens
agguagcuaccauggcuuguuucaaggaaggaaacucugguacgguggcacccucaggagugga

SEQ ID NO: 134186 - RNA, 64 nt, Homo Sapiens
aguguccucuuuguuuuuguaacuggucuucuuccucugguaucauucugugcccuuaaugcuu

SEQ ID NO: 134187 - RNA, 64 nt, Homo Sapiens
uguuucaggaagcucuucuaggguguauugacaacucugguauuauggaggccaauuacauggc

SEQ ID NO: 134188 - RNA, 64 nt, Homo Sapiens
aguggcccagacgcugcuuuauguauaaacucaccucugguaacagauuuuaagcauuuuguaa

SEQ ID NO: 134189 - RNA, 64 nt, Homo Sapiens
aggagugagugagccccucacgcaugcuuucugccucugguaacugccauuugccagccuaaug

SEQ ID NO: 134190 - RNA, 64 nt, Homo Sapiens
aaaugacagcuucacagccccuugaggagugaccaagccacaaaguaaauccuaaagccacaac

SEQ ID NO: 134191 - RNA, 64 nt, Homo Sapiens
cuugaggagugaccaagccacaaaguaaauccuaaagccacaaccccuucuaccacugagcugc

SEQ ID NO: 134192 - RNA, 64 nt, Homo Sapiens
guagauuacauaauuagcaguauccaauauuuuaaagccacaaaaaguagucuuaaaaucaaag

SEQ ID NO: 134193 - RNA, 64 nt, Homo Sapiens
gaugccacauguuaguauauugaaugugccuaugaagccacaaacuagauaaauguguguugaa

SEQ ID NO: 134194 - RNA, 64 nt, Homo Sapiens
auaagaaugucagccuagccauuaggcuauuucaaagccacagccucugggcaaguggauauuu

SEQ ID NO: 134195 - RNA, 64 nt, Homo Sapiens
ccgagcuguauguuggccccgggcuuccacucugaagccacagcauagaagcugccaaggcuug

SEQ ID NO: 134196 - RNA, 64 nt, Homo Sapiens
guuaagugaccucagguaacagccacagaguugaaagccacagaacgaaagccacagaguugaa

SEQ ID NO: 134197 - RNA, 64 nt, Homo Sapiens
guugaaagccacagaguuaaagccacagaguugaaagccacagaauaccgccaucuuacacgaa

SEQ ID NO: 134198 - RNA, 64 nt, Homo Sapiens
guugaaagccacagaguugagccaucuuacacgaaagccacagagguguccauggcccuauacc

SEQ ID NO: 134199 - RNA, 64 nt, Homo Sapiens
gaauaggaaggcaaucucuauuuccaaaaggucaaagccacauaaaggagaagaggccaugcac

SEQ ID NO: 134200 - RNA, 64 nt, Homo Sapiens
gaaaaaaguugccuuucuuuauccgauucuguauaagccacauacaauuacuuuuagcuguaac

SEQ ID NO: 134201 - RNA, 64 nt, Homo Sapiens
uuagaccccccaccuguguuccucaaucacacugaagccacagcugggcccaccgaggugcuau

SEQ ID NO: 134202 - RNA, 64 nt, Homo Sapiens
gcccuucaguuuggucugcuccgccuggggcagaaagccacaaacuccauccagauccggaacg

SEQ ID NO: 134203 - RNA, 64 nt, Homo Sapiens
acacuaccagucauucccaucgcuuugcaaucacaagccacaggaugagaaguucugacucacu

SEQ ID NO: 134204 - RNA, 64 nt, Homo Sapiens
uuaauaacugaaggccagagagauuaauuugccaaagccacaccuuuaugcuaauuaugauugg

SEQ ID NO: 134205 - RNA, 64 nt, Homo Sapiens
cacgucccugguuaaaggugagagcuaaagugacaagccacauccaacuucugucccauuuuuc

SEQ ID NO: 134206 - RNA, 64 nt, Homo Sapiens
gcaagauuuggcaggugagcaugugguuuucucaaagccacacaaccucaggcucagagagguu

SEQ ID NO: 134207 - RNA, 64 nt, Homo Sapiens
acaaaaaaaagccagugccuccacaucacaaaaaaagccacaucuucuacaauaguguggaaag

SEQ ID NO: 134208 - RNA, 64 nt, Homo Sapiens
acaaaaaaagccacaucacauacaauaguguggaaagccacaucuaaaugggauucuggacuuc

SEQ ID NO: 134209 - RNA, 64 nt, Homo Sapiens
acacacaugcuuaccuaaugcaucacugugacaaaagccacacgcauuaucaguaacuuugcuu

SEQ ID NO: 134210 - RNA, 64 nt, Homo Sapiens
guucaaauggaugacugaucuccugaguacacugaagccacaggcugguggccauguucucuga

SEQ ID NO: 134211 - RNA, 64 nt, Homo Sapiens
ccuaaaaauccagacucuuucgauacccaggaccaagccacagcagguccuccaucccaacagc

SEQ ID NO: 134212 - RNA, 64 nt, Homo Sapiens
aguucauccaggcccaacugugagcaaggagcacaagccacaagucuuccagaggaugcuugau

SEQ ID NO: 134213 - RNA, 64 nt, Homo Sapiens
guguucacacuucuucaguaaugucugaacuugaaagccacagaguggcauaaaacaaugugug

SEQ ID NO: 134214 - RNA, 64 nt, Homo Sapiens
auauauaggauauuggacucugcuuagcauuuucaagccacauagcaugacuguuuuuugaaua

SEQ ID NO: 134215 - RNA, 64 nt, Homo Sapiens
guuuccaaauuuagagcuucugcauacagucuuaaagccacagaggcuuguaaaaauauagguu

SEQ ID NO: 134216 - RNA, 64 nt, Homo Sapiens
uugguuuuguuuuuuuggaaaugagugggccacuaagccacacuuucccuucauccugcuuaau

SEQ ID NO: 134217 - RNA, 64 nt, Homo Sapiens
acacucuugacccuacacugaaggcugaaggcagaagccacaagaggccuugagugccaccccc

SEQ ID NO: 134218 - RNA, 64 nt, Homo Sapiens
acccagaugguggaggaugugaagggauugcaccaagccacauucacucucucuguggccuuuc

SEQ ID NO: 134219 - RNA, 64 nt, Homo Sapiens
gugauggacucugugacauggucagguugagcugaagccacaguuucucugugcuguguuuucu

SEQ ID NO: 134220 - RNA, 64 nt, Homo Sapiens
gggacugcucaauuucuaaugugaucuauucaagaagccacauauaaaaaggcauugagggcuc

SEQ ID NO: 134221 - RNA, 64 nt, Homo Sapiens
ccggagccccugggagcccuaaaaauuccaacagaagccacaggguuuucuuucuuuaaaaaaa

SEQ ID NO: 134222 - RNA, 64 nt, Homo Sapiens
gugagcacucuggggugggaccacgucccugcggaagccacaggccacggacgacgcgagggcc

SEQ ID NO: 134223 - RNA, 64 nt, Homo Sapiens
ugagaaaaagaaaagaaagcaagaacagaaaacgaagccacaggaagggaaguagacauuguau

SEQ ID NO: 134224 - RNA, 64 nt, Homo Sapiens
cauacaccagguucuuucuacaauccugguggaaaagccacagaaccuucuuccugcccuucuu

SEQ ID NO: 134225 - RNA, 64 nt, Homo Sapiens
ugcugaguauucugucacagacaagccuccauuaaagccacagcagugcuacccaccacacaca

SEQ ID NO: 134226 - RNA, 64 nt, Homo Sapiens
auuccaggaccccuuucuuguuguggcugccaugaagccacagcuccuuggggaagugaccugc

SEQ ID NO: 134227 - RNA, 64 nt, Homo Sapiens
agaggaagcaggccgagagacuugcaccuuggccaagccacacaaucaguggggcagccagagc

SEQ ID NO: 134228 - RNA, 64 nt, Homo Sapiens
agcagggccugguguggaaccagggagcugugggaagccacagcagaaauggaagaaaaacagg

SEQ ID NO: 134229 - RNA, 62 nt, Homo Sapiens
aaggauccuaaggaugugacagggagaguggccaguuggaaggcacugcuaaaaugauucac

SEQ ID NO: 134230 - RNA, 62 nt, Homo Sapiens
uucuggcacucuuccugcauucaucccacucucaguuggauuggccgugaagauuuucaucc

SEQ ID NO: 134231 - RNA, 62 nt, Homo Sapiens
ccauugauacaaggcugcugaggccuggucuccaguuggaaauauaauuaaggguggcaagg

SEQ ID NO: 134232 - RNA, 62 nt, Homo Sapiens
gaaauauaauuaaggguggcaaggacuggagucaguuggagagugcauagccagucugugaa

SEQ ID NO: 134233 - RNA, 62 nt, Homo Sapiens
uucuuucaugcuuaacacagcuguaucuaacccaguuggauuaagacauuuaggagaaccug

SEQ ID NO: 134234 - RNA, 62 nt, Homo Sapiens
agaaucauaguuaagugguauaugauucugaacaguuggaauguguacaagucauuuuguga

SEQ ID NO: 134235 - RNA, 62 nt, Homo Sapiens
cagagccagucuuccuccucaguuauaggacacaguuggaagcuaucaaagcacauaaaacc

SEQ ID NO: 134236 - RNA, 62 nt, Homo Sapiens
ugaagacacguucuugccagugcuggaggaaucaguuggaauauuauuauuugaauggaugc

SEQ ID NO: 134237 - RNA, 62 nt, Homo Sapiens
aacccauuccacuguaugagguuuucagaccucaguuggauguggagaaguuaucaacuggu

SEQ ID NO: 134238 - RNA, 62 nt, Homo Sapiens
cuccagauagccacugccuugaagaaaaccuucaguuggaucgaggccacuggguaacaaca

SEQ ID NO: 134239 - RNA, 62 nt, Homo Sapiens
uggacagcuaaaaugugauuauuuuccaagcucaguuggaccuccagacccaucacugacca

SEQ ID NO: 134240 - RNA, 62 nt, Homo Sapiens
aacaccuuggggggugaagcugucaaugccaccaguuggaccuccauacauucugagcuaac

SEQ ID NO: 134241 - RNA, 62 nt, Homo Sapiens
ccuuauuuccagagaaccagacguuuguuucccaguuggaaagaagacaguugagcacuuca

SEQ ID NO: 134242 - RNA, 64 nt, Homo Sapiens
cuaguggcuuguccucaccacccccuuauaguuugggcuucagccuguggcugucuggaaagcc

SEQ ID NO: 134243 - RNA, 64 nt, Homo Sapiens
uccucgacaucacuguucauuauuuugggcaugugggcuucaacgagugauauggagcaagaga

SEQ ID NO: 134244 - RNA, 64 nt, Homo Sapiens
gcagguggggugagaauugggcugcugggauggugggcuucaggagccaggagggcguucuuag

SEQ ID NO: 134245 - RNA, 64 nt, Homo Sapiens
auguugccaagcuagucuacuuuuuguagagacagggcuucaccugccaccaugcccagcugau

SEQ ID NO: 134246 - RNA, 52 nt, Homo Sapiens
aguuaaaagacuggggucuuaggggcuucacaaugcgcugaaagacgaguaa

SEQ ID NO: 134247 - RNA, 64 nt, Homo Sapiens
ucuguaaagcaaucaauugucuauagcuguagaugggcuucacauaauaauaauaaaaccaugu

SEQ ID NO: 134248 - RNA, 64 nt, Homo Sapiens
aguaagagccaaccaacugaacauuaaaguacuugggcuucagauacauuguuuucacuguauc

SEQ ID NO: 134249 - RNA, 64 nt, Homo Sapiens
ucuaagaacuucauugcccuaaaaaggaggagcugggcuucagcuuggcucgucauuuccucuu

SEQ ID NO: 134250 - RNA, 64 nt, Homo Sapiens
cugggggcaguggacagggaagaggaaggaugaagggcuucaggguuccccugagagggugcua

SEQ ID NO: 134251 - RNA, 64 nt, Homo Sapiens
gauguuuggggggggugguucaucuugccagccugggcuucagggagaccaugaguggggcugg

SEQ ID NO: 134252 - RNA, 64 nt, Homo Sapiens
ugcaggaggccucucucaggcugugucauuggcagggcuucacacauccuaggugcucuccagg

SEQ ID NO: 134253 - RNA, 64 nt, Homo Sapiens
cccaugcuggucccuuggugacacuaagucucaagggcuucagccuucaucucuagcugcagaa

SEQ ID NO: 134254 - RNA, 64 nt, Homo Sapiens
cucauggauguuauuuggugggaaaaaaacaaaagggcuucaguuaauugucuugcucucuaug

SEQ ID NO: 134255 - RNA, 64 nt, Homo Sapiens
ccuccagcgggaguccagucaaguccuaggagcugggcuucauuaaugucauuuuuuuuuuaau

SEQ ID NO: 134256 - RNA, 64 nt, Homo Sapiens
auggcucacguagcugaaaaggaugggcuagauugggcuucaggcugcaucccaggacuccaaa

SEQ ID NO: 134257 - RNA, 64 nt, Homo Sapiens
cagcucugcuuucauuugaguuggcuuuauucuugggcuucacaguguggccccacagcaccag

SEQ ID NO: 134258 - RNA, 64 nt, Homo Sapiens
uucgcgugagaaguccccuuccaucccagagggugggcuucagggcgcacagcaugagaggcuc

SEQ ID NO: 134259 - RNA, 64 nt, Homo Sapiens
uccagugaauuagugucaugucagcaucagcucagggcuucaucguggggcucucaguuccgau

SEQ ID NO: 134260 - RNA, 64 nt, Homo Sapiens
gccagccuguggauccaagagacaguccccaccugggcuucacggcauccuugcagccaccucu

SEQ ID NO: 134261 - RNA, 64 nt, Homo Sapiens
gcaucugugucauggccaucgcccggcggucagugggcuucagaugggccugugcauccuggcc

SEQ ID NO: 134262 - RNA, 64 nt, Homo Sapiens
uucccaaacaguuguccaacaguuagacauugaggggcuucacuguuaccaggcauguaacaga

SEQ ID NO: 134263 - RNA, 64 nt, Homo Sapiens
ugcccuugaguuggucuccccggcugcucugcgggggcuucacuggcuucggagugagcgcgaa

SEQ ID NO: 134264 - RNA, 64 nt, Homo Sapiens
caugaaauuaauaaaacuuaacugcuuuauccaggggcuucaccuaaacaagccugauuuaggc

SEQ ID NO: 134265 - RNA, 64 nt, Homo Sapiens
aucuuggccaggcuggucuuuuuuaguagagacggggcuucaccugcccggcuaauguuuguau

SEQ ID NO: 134266 - RNA, 64 nt, Homo Sapiens
gcaauaaccuugccuuugcuaagacccccuccgagggcuucaggggggccugccaagggggggc

SEQ ID NO: 134267 - RNA, 64 nt, Homo Sapiens
ggcuguguggccugggaauaccauguggaagguugggcuucaaguuaacaggaucagacaccag

SEQ ID NO: 134268 - RNA, 64 nt, Homo Sapiens
agucugaagcaggcgccagggccucugguguacggggcuucagccugcuugcuugugguggcug

SEQ ID NO: 134269 - RNA, 64 nt, Homo Sapiens
gcuucagccugcuugcuugugguggcugucuguggggcuucagccugacuguccgugguggcug

SEQ ID NO: 134270 - RNA, 64 nt, Homo Sapiens
ccccuccuccaaacacacacagaaugggcugguuucuuucaaguuuaaaaaaagcccccuucuc

SEQ ID NO: 134271 - RNA, 64 nt, Homo Sapiens
cugacagcugccuuugaaacccaaagccucggguucuuucaagcuacauguacuaaauugucga

SEQ ID NO: 134272 - RNA, 64 nt, Homo Sapiens
acuucuaacggcugauugguauggaccgagauuaucuuucaauugaagugacuaaucgagaugu

SEQ ID NO: 134273 - RNA, 64 nt, Homo Sapiens
agugcaagagcagaagagccccaagcagacuaugucuuucaagauguacagaagacugacaaca

SEQ ID NO: 134274 - RNA, 64 nt, Homo Sapiens
ucaaugccaaaagccaagggccaaaagacuaaaaucuuucaacguuuguagcagcuucaaguga

SEQ ID NO: 134275 - RNA, 64 nt, Homo Sapiens
ccauacuucccccgcccccaagucaccuuaacuaucuuucaauuguuuuacuuguauaugaugu

SEQ ID NO: 134276 - RNA, 64 nt, Homo Sapiens
caguugugugcaaaggcaaggcuugcuuuuccugucuuucaacccuaucuugcuuuuccugucu

SEQ ID NO: 134277 - RNA, 64 nt, Homo Sapiens
uuuccugucuuucaacccuaucuugcuuuuccugucuuucaacccuaucuugcuuucauugucu

SEQ ID NO: 134278 - RNA, 64 nt, Homo Sapiens
cucuuaaauuuuauauguaaaauuaaauuuuagaucuuucaauauguaaggagcuaaagcugaa

SEQ ID NO: 134279 - RNA, 64 nt, Homo Sapiens
uguauuagaagauuuuagaauagcuguauauuuaucuuucaaaaaugaguuuuaagaaggugcu

SEQ ID NO: 134280 - RNA, 64 nt, Homo Sapiens
gagaagccuaaaacaaacaacuuacucgauguuuucuuucaacuaucacuggaaauucauuuuc

SEQ ID NO: 134281 - RNA, 64 nt, Homo Sapiens
gagugcaacauugagaauaacaagguaguaggucucuuucaacuauuucucuaugauggucauu

SEQ ID NO: 134282 - RNA, 64 nt, Homo Sapiens
cuuuuucuuuguuugauuuuuucccuaucugguuucuuucaauaucaguagauaagguguauuu

SEQ ID NO: 134283 - RNA, 64 nt, Homo Sapiens
caugucuacuggcaacuaaucuucuuuuaaugcuucuuucaagguuuuccuucccuccagagaa

SEQ ID NO: 134284 - RNA, 64 nt, Homo Sapiens
caaaauauuaaaauauaagugaggaucuucaacaucuuucaaaaaugcauuuauauagucuuac

SEQ ID NO: 134285 - RNA, 64 nt, Homo Sapiens
aauuaagaauuuuuuaucuuaggcaaagugugucucuuucaauucauuaacuuauuaauuuuau

SEQ ID NO: 134286 - RNA, 64 nt, Homo Sapiens
ugguuuaaauaggcugguccuacauguauuagguucuuucaaguuugacugggaggucaccuuu

SEQ ID NO: 134287 - RNA, 64 nt, Homo Sapiens
ccaaacucuggugaacuguuggacuggguagaaaucuuucaagaagcuugaaaauaaggccaua

SEQ ID NO: 134288 - RNA, 64 nt, Homo Sapiens
uccuuucaaaucauguucuuauaccuaauuuuagucuuucaaaugaauguacuguaaugcuugu

SEQ ID NO: 134289 - RNA, 64 nt, Homo Sapiens
ugaacuauuuuuaucacaguauuauuuauugcuuucuuucaauaaaguacugaagcauuuucca

SEQ ID NO: 134290 - RNA, 64 nt, Homo Sapiens
cugggagacagauaaggagguguguauacacugaucuuucaaguccccuggucuaccgcguuga

SEQ ID NO: 134291 - RNA, 64 nt, Homo Sapiens
uuuuauuuuaaagaaaacucuccugccuucaaguucuuucaaguaccaagaugaagccacuggu

SEQ ID NO: 134292 - RNA, 64 nt, Homo Sapiens
ccagccaggcuacacacagagauacuaguuucagucuuucaaagguacaggcugugcauuuuaa

SEQ ID NO: 134293 - RNA, 64 nt, Homo Sapiens
agugugccaucuccaauauuuuaguuuuuuuuuuucuuucaaccgauuauaauuaagguucauu

SEQ ID NO: 134294 - RNA, 64 nt, Homo Sapiens
cagagccauauauaugucugacaaaauugucuucucuuucaaacgugauaaaucauaauacuag

SEQ ID NO: 134295 - RNA, 64 nt, Homo Sapiens
aaugucaguaggaccuuccuaggaaagccuguauucuuucaauguagugcacgucguggguauu

SEQ ID NO: 134296 - RNA, 64 nt, Homo Sapiens
auaugagguccuaaugaaguacuacaguuuucauucuuucaaggguagacuaaaauauaguuua

SEQ ID NO: 134297 - RNA, 64 nt, Homo Sapiens
auacuguacuucauuuaacagaaugauugauuuuucuuucaaucagcauguucaccaaaaauag

SEQ ID NO: 134298 - RNA, 64 nt, Homo Sapiens
agucaacauuuuauauaauguuucaauaaauguuucuuucaauaaagauacuaugugcccuuca

SEQ ID NO: 134299 - RNA, 64 nt, Homo Sapiens
cuguuauaaauuaaggucuuaauaccuuuucugcucuuucaaauaacucuaaugaauauucaag

SEQ ID NO: 134300 - RNA, 64 nt, Homo Sapiens
cgagauaauuacauaauucagauaccuuuaaucaucuuucaagaaagaggcuccucccauucaa

SEQ ID NO: 134301 - RNA, 64 nt, Homo Sapiens
gggaagauacaacuuacacaguggggccuauuguucuuucaagaacccuuuuuuuagcuuauag

SEQ ID NO: 134302 - RNA, 64 nt, Homo Sapiens
ggaucugauccuuuugaauucauggacuauggacucuuucaaaggcccagguaauuuuuuguuu

SEQ ID NO: 134303 - RNA, 64 nt, Homo Sapiens
ucgcacacuagacuucagugagcauauauuacaaucuuucaaaguacugcugaauguuuuccag

SEQ ID NO: 134304 - RNA, 64 nt, Homo Sapiens
uuuuuuuuucagaauaaacaacuaaauaacuguauuagaaaaaaaagaaacuuacuaaauauca

SEQ ID NO: 134305 - RNA, 64 nt, Homo Sapiens
acauuuacuguuucuguuauaauaaaaggguauguuagaaaaacaaaaaggaggcugggcaugg

SEQ ID NO: 134306 - RNA, 64 nt, Homo Sapiens
cguaagggaacucauaaaggggcccuagaaaggcuuagaaaagguucucacaucagaguucucu

SEQ ID NO: 134307 - RNA, 64 nt, Homo Sapiens
aagcuuaaucuaacguuuucuuuuaaaacugauuuuagaaaaagcaaaaaaaaaacaaaacagu

SEQ ID NO: 134308 - RNA, 64 nt, Homo Sapiens
uggggugaucuuuccaggaauuaauucugggaaauuagaaaaaguacagauaaaauacauucuu

SEQ ID NO: 134309 - RNA, 64 nt, Homo Sapiens
gggaaaaaaauccaguguuaaaguuuuuggaaacuuagaaaagaauuucuuugaacacuucuga

SEQ ID NO: 134310 - RNA, 64 nt, Homo Sapiens
uaaugugauuacagguagagacaccaaauugucuuuagaaaaauuaaugacauuuaucuucaaa

SEQ ID NO: 134311 - RNA, 64 nt, Homo Sapiens
gaaauuuauuucuuauuuccuaacauugaauucguuagaaaaaacagcgucaccucacucuuca

SEQ ID NO: 134312 - RNA, 64 nt, Homo Sapiens
gucauguugauuuuccuuaugaacccgaagccauuuagaaaaucccugugugucaaaauuacau

SEQ ID NO: 134313 - RNA, 64 nt, Homo Sapiens
ugaaagcauacuguugaaacccgcaguguugcauuuagaaaacaguugaacagaaugucaaugu

SEQ ID NO: 134314 - RNA, 64 nt, Homo Sapiens
auucaugcaaaaaaacauuuaaucugcaucuguuuuagaaaagggggaaaugaagcaacuuguc

SEQ ID NO: 134315 - RNA, 64 nt, Homo Sapiens
aaagccuauuccaucaacugugaaagcuggggaauuagaaaaaauaauaagucgcugucaggug

SEQ ID NO: 134316 - RNA, 64 nt, Homo Sapiens
uaugccuagggaaacucagggcuucuaguuucucuuagaaaagcuaagagaagauaaggucuga

SEQ ID NO: 134317 - RNA, 64 nt, Homo Sapiens
aaaaaugugugaauaacauuauauuauguauaaauuagaaaauguguuaacuucacuucuuugu

SEQ ID NO: 134318 - RNA, 64 nt, Homo Sapiens
acaaguagagaauacuacauuuaucucugcaauuuuagaaaauggcccucuguuggcacaggca

SEQ ID NO: 134319 - RNA, 64 nt, Homo Sapiens
ccccaggguaggucuguggcauacuuuaaaacauuuagaaaacagagauauucauaauucugca

SEQ ID NO: 134320 - RNA, 64 nt, Homo Sapiens
uuaauagaaguucuaagcgggaaugaaggggcgcuuagaaaacguggaagacgucaaacaagcu

SEQ ID NO: 134321 - RNA, 64 nt, Homo Sapiens
gguaaauaaagcaaguauaugaccuguuugccuuuuagaaaauugacugcuugugucuuuuuau

SEQ ID NO: 134322 - RNA, 64 nt, Homo Sapiens
aaacaacauaguuuucugaauugcuuuuuuuguuuuagaaaaaaaauggacacauaugcucaug

SEQ ID NO: 134323 - RNA, 64 nt, Homo Sapiens
aaacuuccauuuuuaaaaauuuagaguuuagucauuagaaaaaauaauggacuggaaaguuaua

SEQ ID NO: 134324 - RNA, 64 nt, Homo Sapiens
ucuacuuuuaguaggcuaaucaacaaugaaaggguuagaaaauugcuguggaacauccagguga

SEQ ID NO: 134325 - RNA, 64 nt, Homo Sapiens
uucauugccuaaguucauuucaaagaauuuguauuuagaaaagguuuauauuauuagugaaaac

SEQ ID NO: 134326 - RNA, 64 nt, Homo Sapiens
uuuugcaucuuuuuucaaaguuuaaugugaacuuuuagaaaagugauuaauguugcccuaauac

SEQ ID NO: 134327 - RNA, 64 nt, Homo Sapiens
cuuuauauguuuuuaauggauuuuuuuuuaaguauuagaaaaugacacauaacacgggcagcug

SEQ ID NO: 134328 - RNA, 64 nt, Homo Sapiens
uguagcugucaucauuugguguagcugcuuuucuuuagaaaauaucggaugagagguuggaaau

SEQ ID NO: 134329 - RNA, 64 nt, Homo Sapiens
aaauuuucuguuuugcaauaaaauauuuauucuguuagaaaaaauacaugguucuuaacuauuc

SEQ ID NO: 134330 - RNA, 64 nt, Homo Sapiens
acaguuuuauuaugacacuagauacaguaaauuuuuagaaaaaaauaccauuuacaguauuauu

SEQ ID NO: 134331 - RNA, 64 nt, Homo Sapiens
uagucuuuugccagagaaacugagguaacugucauuagaaaagguuucuuaaaauacucacaaa

SEQ ID NO: 134332 - RNA, 64 nt, Homo Sapiens
guuggguuuuuuucuuauuguuuucuccccaggguuagaaaaauugguauaaguuccuaauuaa

SEQ ID NO: 134333 - RNA, 64 nt, Homo Sapiens
ugcuaaagguucugggaagcuaauaauugaauuauuagaaaaacauuucagaauaggaaguaaa

SEQ ID NO: 134334 - RNA, 64 nt, Homo Sapiens
guaucuucguaacuucauauuaauauaaguuucuuuagaaaacccaaguuuuuaaucguuuuug

SEQ ID NO: 134335 - RNA, 64 nt, Homo Sapiens
uuuuccuguguauuaaaccuuuccauuuuacguuuuagaaaauuuuauguauuuuaaaauaagg

SEQ ID NO: 134336 - RNA, 64 nt, Homo Sapiens
auuggaaauauucccaucaaaugguuaaucuuauuuagaaaaugggcauauuagaaaaaguccu

SEQ ID NO: 134337 - RNA, 64 nt, Homo Sapiens
ucaaaugguuaaucuuauuuagaaaaugggcauauuagaaaaaguccuuccaagaugauuuugg

SEQ ID NO: 134338 - RNA, 64 nt, Homo Sapiens
uuagaagaggggugggugcaccgaaauacaaguuuuagaaaaucuuuaaaagaggucuuucucc

SEQ ID NO: 134339 - RNA, 64 nt, Homo Sapiens
uucagccauccuagaaacuauaaccauuucugguuuagaaaacaggugcaauaaaguuccuuuc

SEQ ID NO: 134340 - RNA, 64 nt, Homo Sapiens
uguugguuaaggcagcugcaagggggauaguaucuuagaaaaccgaaagaggcagaaacaggua

SEQ ID NO: 134341 - RNA, 64 nt, Homo Sapiens
uagauaauucccauaagauguugguaguauaugauuagaaaaaccaugcuuguguuuauuuuug

SEQ ID NO: 134342 - RNA, 64 nt, Homo Sapiens
acuuuuuuuuuuuuuugagacauacaggaagcucuuagaaaagauacuuuagggagcagccaca

SEQ ID NO: 134343 - RNA, 64 nt, Homo Sapiens
cauaccuauccagacauaaauauguguauguaaauuagaaaauaguugucuauacucaacugga

SEQ ID NO: 134344 - RNA, 64 nt, Homo Sapiens
ucagacuuuuguuuuugggggauuucucacuagcuuagaaaaugugauauaucaugguaaaauu

SEQ ID NO: 134345 - RNA, 64 nt, Homo Sapiens
uucuaggaacagggugaaccaaaauugauuucacuuagaaaaacagagaacaaauuaaaauuga

SEQ ID NO: 134346 - RNA, 64 nt, Homo Sapiens
ggugcuuaauugcaauaaaaaaaacugagauaauuuagaaaacaauuuuuuuucucucuugaac

SEQ ID NO: 134347 - RNA, 64 nt, Homo Sapiens
uggaggugguacucaacagccuuauucaugaggcuuagaaaacacaaagacauuagaauaccua

SEQ ID NO: 134348 - RNA, 64 nt, Homo Sapiens
cuguaaacaggcuuuagucauuaaugugagagacuuagaaaaaaugcuuagaguggacuauuaa

SEQ ID NO: 134349 - RNA, 64 nt, Homo Sapiens
auuguauagaauggauuuagcugccauuuauauuuuagaaaacuuguguucuuuugcauguaaa

SEQ ID NO: 134350 - RNA, 64 nt, Homo Sapiens
uaaaaucacaguagauuuuauguuugugauacaauuagaaaauauuucccuuuuauguuuucuc

SEQ ID NO: 134351 - RNA, 64 nt, Homo Sapiens
acauguucaauucuguaaguuuacaugugcagaguuagaaaauguuaaugcagauaaaacaagu

SEQ ID NO: 134352 - RNA, 64 nt, Homo Sapiens
cacuccguuucagaauuguuguuuguauuagccuuuagaaaaaacagaaauucuauuuugguau

SEQ ID NO: 134353 - RNA, 64 nt, Homo Sapiens
ugcauacuuuuaaaacaagucuuuuauaaagcauuuagaaaaaagguccuuagaaaagacuuug

SEQ ID NO: 134354 - RNA, 64 nt, Homo Sapiens
cuuugcuuuuauaaagcauuuaauuauaugguccuuagaaaagaaguuguguauauagagacca

SEQ ID NO: 134355 - RNA, 64 nt, Homo Sapiens
acaauuauuccaaaccaaauuuuaauuuuugcuuuuagaaaagggaguuuaaaaaugguaucaa

SEQ ID NO: 134356 - RNA, 64 nt, Homo Sapiens
aaaacuuuaucagggaaacuaagauucuuuuaaauuagaaaauauucucuauuugaauuauuuc

SEQ ID NO: 134357 - RNA, 64 nt, Homo Sapiens
augaauagagacauauuaaaauaauguuuacaucuuagaaaaaacauagauagugcuaguaaua

SEQ ID NO: 134358 - RNA, 64 nt, Homo Sapiens
uaaauuuaauuuuaccaauaaauauucccauaauuuagaaaaggaugucgacuugcuaauuuca

SEQ ID NO: 134359 - RNA, 64 nt, Homo Sapiens
gauuguaauuaguuuuguauuuucuauacugguguuagaaaacauauguuuacauuugauuaac

SEQ ID NO: 134360 - RNA, 64 nt, Homo Sapiens
uucauaauguccuguauaaauguuuuuacugcuuuuagaaaauaaagaaaaaaaacuugguuca

SEQ ID NO: 134361 - RNA, 64 nt, Homo Sapiens
ucuuuggauauuguaauucuuaacugguuguaaauuagaaaagcugggauuacauauggugugc

SEQ ID NO: 134362 - RNA, 64 nt, Homo Sapiens
auuuuuuuuuuauuuuauuuuauuguuuuuuuuuuuagaaaaacaccacuuuuauuauguacaa

SEQ ID NO: 134363 - RNA, 64 nt, Homo Sapiens
auuguuugucuguugcgcauggcagucucaauacuuagaaaauugagagaaaaaaaaaucaaag

SEQ ID NO: 134364 - RNA, 64 nt, Homo Sapiens
caggauuugucccacucuguaagaggagcaaccauuagaaaaugcacuggaccgccauuaggca

SEQ ID NO: 134365 - RNA, 64 nt, Homo Sapiens
gauugcuucguuuuuaaaauaacgcauguccauuuuagaaaauuagaaaaucagucccaccacc

SEQ ID NO: 134366 - RNA, 64 nt, Homo Sapiens
cguuuuuaaaauaacgcauguccauuuuagaaaauuagaaaaucagucccaccacccaaagauu

SEQ ID NO: 134367 - RNA, 64 nt, Homo Sapiens
uaaacuuugaacauugauauccaugggaauaggauuagaaaaggauugcuuucuauauauaaua

SEQ ID NO: 134368 - RNA, 64 nt, Homo Sapiens
gguauuuuuucccagcugacaugauuucucaguguuagaaaacaaacccuuagaacuuuccuuu

SEQ ID NO: 134369 - RNA, 64 nt, Homo Sapiens
cuaaguuuuuaaaaauaaauuauaaacuuggagauuagaaaaauaaagcaguugcuguagaaua

SEQ ID NO: 134370 - RNA, 64 nt, Homo Sapiens
cuuugcuuuagaguuaaauauuccuaucuuaaguuuagaaaaauacaaaaaaccauuccaagga

SEQ ID NO: 134371 - RNA, 64 nt, Homo Sapiens
aagagaggaaucuauuucuuucuccugaaacaauuuagaaaauaguuauccauugacuagaaau

SEQ ID NO: 134372 - RNA, 64 nt, Homo Sapiens
agugcaaaacagguguucuuaucuaaaacgucaauuagaaaauuaucugcgguuguuaaucuac

SEQ ID NO: 134373 - RNA, 64 nt, Homo Sapiens
uuaugcaggaaaccuccugcaaagcugaaacugauuagaaaauucuuuauauuuuaaaauagcu

SEQ ID NO: 134374 - RNA, 64 nt, Homo Sapiens
ucugaugauugauugauuacuguccagguacauuuuagaaaaaguguucuucuuccaguuuguu

SEQ ID NO: 134375 - RNA, 64 nt, Homo Sapiens
gaaaaaugucucuuucaguuuguucuguaaauauuuagaaaagugacagcugucaaccucagag

SEQ ID NO: 134376 - RNA, 64 nt, Homo Sapiens
uguauaaauuacuggugcaucauuuguuuaaauuuuagaaaaccaauagcuauagucucuucag

SEQ ID NO: 134377 - RNA, 64 nt, Homo Sapiens
uuaauauuucagugaaaguuuuuuagcugauuaauuagaaaaauacuuuugaaauuuuuguagc

SEQ ID NO: 134378 - RNA, 64 nt, Homo Sapiens
agugaccauuauucacagguugugcuuuauugaauuagaaaauuuauguuaugaggauauaaug

SEQ ID NO: 134379 - RNA, 64 nt, Homo Sapiens
aacugaagaugaaauauauaacacugcacuuuguuuagaaaaaauuuucuguagacucuaagau

SEQ ID NO: 134380 - RNA, 64 nt, Homo Sapiens
uaugagggagcaaaaguuagacugagaacaaacguuagaaaaucacuucagauuguguuugaaa

SEQ ID NO: 134381 - RNA, 64 nt, Homo Sapiens
augacuuuggaagugcagaaacagaaggauacuguuagaaaauccuaacauuggucuccgugca

SEQ ID NO: 134382 - RNA, 64 nt, Homo Sapiens
acaucuccuagggaaugaugaaaacagcaggcuauuagaaaauuauuucauauaguucucgugu

SEQ ID NO: 134383 - RNA, 64 nt, Homo Sapiens
agcuuccuaaugcauguguugcauuauugcagcauuagaaaaggagagguagcauuuuugcuga

SEQ ID NO: 134384 - RNA, 64 nt, Homo Sapiens
agcacuuugauucuauguugaguuuguuucuauauuagaaaagcagcaagucaguaaucccccg

SEQ ID NO: 134385 - RNA, 64 nt, Homo Sapiens
cgugacuaucagugaaagaaguuuaauuuucagguuagaaaaugugaucuggcaguuuaugcau

SEQ ID NO: 134386 - RNA, 64 nt, Homo Sapiens
aaagcaaacacaaaaccuuggcaaauucaggggcuuagaaaauguagucagugauucuuuacuu

SEQ ID NO: 134387 - RNA, 64 nt, Homo Sapiens
cuacagucgucgauuuuuagaaauugugguacacuuagaaaauuguuacucugguuguugugcc

SEQ ID NO: 134388 - RNA, 64 nt, Homo Sapiens
ucacccaccaugccgcacauacgacccaggacaauuagaaaaauuucugagaaggugaacuguu

SEQ ID NO: 134389 - RNA, 64 nt, Homo Sapiens
aaaacgugaacaaacuuagauuccugguuccguuuuagaaaaggaaaacccaauacagucuagu

SEQ ID NO: 134390 - RNA, 64 nt, Homo Sapiens
ccgacuucuuccaucuauuuaaagauuuagaacuuuagaaaauggcugauuguauuuuaucucu

SEQ ID NO: 134391 - RNA, 64 nt, Homo Sapiens
uagcacaugcuuuugaaaauaauuuauuuccacuuuagaaaagucuaguccaaaggccaaagcu

SEQ ID NO: 134392 - RNA, 64 nt, Homo Sapiens
aucuaaccuggcuuguuuagggccauaccacuaauuagaaaaucugugcuagaaccugugucuu

SEQ ID NO: 134393 - RNA, 64 nt, Homo Sapiens
aaaauuuagaguauaaauugucuuauauuucaaauuagaaaaguucaaaugaaguuuaauugug

SEQ ID NO: 134394 - RNA, 64 nt, Homo Sapiens
gguagagccaagcugaggaauccuuuuaagauuauuagaaaacaugcccugaagagaguuguuc

SEQ ID NO: 134395 - RNA, 64 nt, Homo Sapiens
caccuggcccauaguuguauuuuuuuuaggucacuuagaaaaauaugucauguauuuuacauuu

SEQ ID NO: 134396 - RNA, 64 nt, Homo Sapiens
guuuauccaauauugaguaaguucugaaacaguuuuagaaaaaauuuucuuuuuguuaaaugug

SEQ ID NO: 134397 - RNA, 64 nt, Homo Sapiens
aaaaaagauuacccuuaguguauguguuuuaauauuagaaaauuggcauauguacuuuauuuuu

SEQ ID NO: 134398 - RNA, 64 nt, Homo Sapiens
gcuuuaugauaaauguugccgaaaccaggucuauuuagaaaaugagcuuugcaccucuuuggua

SEQ ID NO: 134399 - RNA, 64 nt, Homo Sapiens
acgcccacaugcuaauaugguuuaguaucuaagguuagaaaaccccuaaaaauaaauuaugaca

SEQ ID NO: 134400 - RNA, 64 nt, Homo Sapiens
ugugguguuuuuuuuguuuguuuguuuguuuguuuuagaaaaauugggauuuccccccaccccg

SEQ ID NO: 134401 - RNA, 64 nt, Homo Sapiens
accagcacaagagaauuagagcuucagugagaauuuagaaaaauuauacuaaagugagaugcau

SEQ ID NO: 134402 - RNA, 64 nt, Homo Sapiens
auauguauauuuuuuuaauuuaacaugaacacccuuagaaaauguguccuaucuaucuuccaaa

SEQ ID NO: 134403 - RNA, 64 nt, Homo Sapiens
ugaacucuucugcaaaaauggauauuauuagaaauuagaaaaaaauuacuaauuuuacacauua

SEQ ID NO: 134404 - RNA, 64 nt, Homo Sapiens
uuuugugcaaaagcuucaaauuaaaacagcugcauuagaaaaagaggcgcuucuccccuccccu

SEQ ID NO: 134405 - RNA, 64 nt, Homo Sapiens
cucagaauuauuuuuaaaaagaaaucuggucuuguuagaaaacaaaauuuuauuuugugcucau

SEQ ID NO: 134406 - RNA, 64 nt, Homo Sapiens
gauuuagauguauagaaaaguaagaaaaucuuacuuagaaaaaagccccuugaaacuugcagga

SEQ ID NO: 134407 - RNA, 64 nt, Homo Sapiens
ccaaauagcauucuuauucacuuuaugccgguauuuagaaaaaauaaauuauagcaaguaugau

SEQ ID NO: 134408 - RNA, 64 nt, Homo Sapiens
aaaguugauaguuaaagaaccgagaucccaucucuuagaaaaaccuccagcuuuggcaacagaa

SEQ ID NO: 134409 - RNA, 64 nt, Homo Sapiens
uaauguuugaaauacgaaggacuucugguuugguuuagaaaaagaggagaggaaaaguugauua

SEQ ID NO: 134410 - RNA, 64 nt, Homo Sapiens
aaaagcaauuaucuuucagagcauaagugaaaauuuagaaaauucauaaaucugccuuuauguu

SEQ ID NO: 134411 - RNA, 64 nt, Homo Sapiens
uuagggugauaggauauucaaaaauccauuucuuuuagaaaaaaauuuauauuugucacuuuaa

SEQ ID NO: 134412 - RNA, 64 nt, Homo Sapiens
auucaauacaauuguaauguagaaauauaagaauuuagaaaaaaguaaacuugccauuugguua

SEQ ID NO: 134413 - RNA, 64 nt, Homo Sapiens
guauccauuaaaguaacuuuuuuaacuaugagaauuagaaaauaagggacaacagggguuaaaa

SEQ ID NO: 134414 - RNA, 64 nt, Homo Sapiens
uccaaacaaaucuuucuacgcuuaaaugaucaaauuagaaaaaccaauuccuauaauuaauaug

SEQ ID NO: 134415 - RNA, 64 nt, Homo Sapiens
ucuugugcuugcuucggcagcauauauacugaaauuagaaaaagaaaacuuuucuuuuuuauua

SEQ ID NO: 134416 - RNA, 64 nt, Homo Sapiens
uaaaauggaaauaacaaagcaacuguuagaaaaauuagaaaauuuucccaacucacaggcaagc

SEQ ID NO: 134417 - RNA, 64 nt, Homo Sapiens
uagaaaauuuaaaauggaaacaggcaagcaacuguuagaaaaauaucacaguauucccaacuca

SEQ ID NO: 134418 - RNA, 64 nt, Homo Sapiens
aacucauaaaacucauaaugacuauucucuuugauuagaaaauagguuugagaaacaggcugac

SEQ ID NO: 134419 - RNA, 64 nt, Homo Sapiens
aaacgaacucugguuggggucuaagugggagaaauuagaaaacauccagaagccagaggaugga

SEQ ID NO: 134420 - RNA, 64 nt, Homo Sapiens
caggaaacuuguuuuuuuaacgucagccagauauuuagaaaauaaccucaaaaguguuuauaug

SEQ ID NO: 134421 - RNA, 64 nt, Homo Sapiens
accaaaagagguuguuaauuagcacauauuccuuuuagaaaaauguuucagaaaccucagucuu

SEQ ID NO: 134422 - RNA, 64 nt, Homo Sapiens
aacaccaaaccaaaagaagguaggagugccauuuuuagaaaagacacaacuuuaauuccuguca

SEQ ID NO: 134423 - RNA, 64 nt, Homo Sapiens
uauuuaaguguugucuaaacaguugauuuuuacuuuagaaaagaucaucuucaacuguuuauug

SEQ ID NO: 134424 - RNA, 64 nt, Homo Sapiens
uuucacgcagauccuugguuuuugagaugguaccuuagaaaaagcaguuccgugguugaauaua

SEQ ID NO: 134425 - RNA, 64 nt, Homo Sapiens
uuacacgcaguuccgugguuuuugagaugguaccuuagaaaaagcccaaucccaggccuuguga

SEQ ID NO: 134426 - RNA, 64 nt, Homo Sapiens
ugggacugcagugcccaaggaauuucugcucugguuagaaaaaggacucugcuucaguccacuu

SEQ ID NO: 134427 - RNA, 64 nt, Homo Sapiens
aaaaggacucugcuucaguccacuucugcucugguuagaaaaaggacucugcuucaguccacag

SEQ ID NO: 134428 - RNA, 64 nt, Homo Sapiens
agcaugaaagauuccgcccaguuuucacuuauucuuagaaaacaaagaaagugcacugcaugcu

SEQ ID NO: 134429 - RNA, 64 nt, Homo Sapiens
gauuccgugaacacagauguauuugauuuuguuauuagaaaaauuugggggaauucccucccaa

SEQ ID NO: 134430 - RNA, 64 nt, Homo Sapiens
uucugaaaaucaacaaccuuagaaggauuuugucuuagaaaauuuccuuggcuuuaguuuuaua

SEQ ID NO: 134431 - RNA, 64 nt, Homo Sapiens
agaaaauuuccuuggcuuuaguuuuauaucauauuuagaaaauaauaaugaaaagcauccccaa

SEQ ID NO: 134432 - RNA, 64 nt, Homo Sapiens
uauuguguaacacauaaugaaauagaaaauuauauuagaaaaaccuaaugaaugcagaaagaau

SEQ ID NO: 134433 - RNA, 64 nt, Homo Sapiens
ccaggcuaaugaaugcagaaaaaguucuucuuuauuagaaaauucaaccagaaguuaaggaggu

SEQ ID NO: 134434 - RNA, 64 nt, Homo Sapiens
uuuugguagagagaaucagggagggaggagagaguuagaaaaauggauggggagguuuuggaca

SEQ ID NO: 134435 - RNA, 64 nt, Homo Sapiens
aagggcagagaguccuggagaguuacagaggguguuagaaaacauaucaaguuaaagguuaacc

SEQ ID NO: 134436 - RNA, 64 nt, Homo Sapiens
cugauuugagaacaaaaggagcuaacaccugacuuuagaaaaugguacacacuguuggcaaaag

SEQ ID NO: 134437 - RNA, 64 nt, Homo Sapiens
aauugcauugcaaagcucuugaauagagugguauuuagaaaauauguguuuuuguucuuuugaa

SEQ ID NO: 134438 - RNA, 64 nt, Homo Sapiens
uaacauuuaucuuuagguggcuccuuuuacagaauuagaaaaguacuuuacuaaauuaauacuc

SEQ ID NO: 134439 - RNA, 64 nt, Homo Sapiens
auaugcuuacauuuuucacuaauucaaaaauaaauuagaaaaauugauucacagcuuauuaucc

SEQ ID NO: 134440 - RNA, 64 nt, Homo Sapiens
agcauuuuucuaaaugcucaauaaagcaaaucuauuagaaaaaacagcaaacugcacugcacuu

SEQ ID NO: 134441 - RNA, 64 nt, Homo Sapiens
guccuuauucagaaacuuuuaaaguacuuauacuuuagaaaacaggagacaguaguagccauaa

SEQ ID NO: 134442 - RNA, 64 nt, Homo Sapiens
uuugccgauaccuuguacacggacuauuucucaguuagaaaacucaugaaucugaaaggagaaa

SEQ ID NO: 134443 - RNA, 64 nt, Homo Sapiens
aaaauucugggccuuacuugaucccaaaaaugucuuagaaaauaugauguauuuaugcccuuau

SEQ ID NO: 134444 - RNA, 64 nt, Homo Sapiens
aggauuuguuuuguuagggagcccauugagguuuuuagaaaagcacugcagugggcucggauag

SEQ ID NO: 134445 - RNA, 64 nt, Homo Sapiens
uaaguauuuacuuuuuuaaaauuuauuuuauucuuuagaaaacuuaauuuaagcagagcuuagc

SEQ ID NO: 134446 - RNA, 64 nt, Homo Sapiens
gcauuauuugaucugaaaugugcugguuucaagauuagaaaaugccucauucucuuucuaaucu

SEQ ID NO: 134447 - RNA, 64 nt, Homo Sapiens
gcccguuaguggcucuauuggucaacaguguaguuuagaaaauggccucuuagguuuuaacgau

SEQ ID NO: 134448 - RNA, 64 nt, Homo Sapiens
aguuuacaaccuuauuccaugcugucuuucagauuuagaaaagaucuaauuucugucucagcug

SEQ ID NO: 134449 - RNA, 64 nt, Homo Sapiens
ucagcucuuacaacaagaacagaaaacaugcuaauuagaaaaaguccugcuuuaaguaauaugu

SEQ ID NO: 134450 - RNA, 64 nt, Homo Sapiens
auuccuaccaaggacaauuuauuaaucaauugacuuagaaaauagggggagaaaucauucauug

SEQ ID NO: 134451 - RNA, 64 nt, Homo Sapiens
uagggggagaaaucauucauuggagcuucuuucuuuagaaaagacuuugguuauaagccuuuug

SEQ ID NO: 134452 - RNA, 64 nt, Homo Sapiens
uuuaucaucuuuuaaacagguucaugggacagaguuagaaaacugggaaugaauaagacaucca

SEQ ID NO: 134453 - RNA, 64 nt, Homo Sapiens
cuucuggguaguaauuacauugugguauuaauauuuagaaaaauggaccucagcaguguauuua

SEQ ID NO: 134454 - RNA, 64 nt, Homo Sapiens
aaauaugaacaacuuucaacacaaacuacugcaauuagaaaauaaugauguaaagaaaucagau

SEQ ID NO: 134455 - RNA, 64 nt, Homo Sapiens
auuauaguuauuaauauugauguucuauauuucuuuagaaaaagauauuuuacaaaauaccaac

SEQ ID NO: 134456 - RNA, 64 nt, Homo Sapiens
ugaaaaagacaagauuuauggguguguauuuacuuuagaaaaaauuauuuaauuggguggggca

SEQ ID NO: 134457 - RNA, 64 nt, Homo Sapiens
aaguucuagcauuuuaguagagugggauguggacuuagaaaaucugcuucauccuguugcuggc

SEQ ID NO: 134458 - RNA, 64 nt, Homo Sapiens
cacccaggcuagagugcaauggcaccaucuuggcucacugcaaccucuaccuccuggguucaag

SEQ ID NO: 134459 - RNA, 64 nt, Homo Sapiens
ucaccaggcuggagugcagugccgcaaucucggcucacugcaaccuccgccucccagguucaag

SEQ ID NO: 134460 - RNA, 64 nt, Homo Sapiens
cacccaggcugcagugcaauggcgcgaucucagcucacugcaaccuccaccuccggguucaagc

SEQ ID NO: 134461 - RNA, 64 nt, Homo Sapiens
uugccagacuggagugcaguggcacgaucucggcucacugcaaccucugccucccggguucaag

SEQ ID NO: 134462 - RNA, 64 nt, Homo Sapiens
uucaguugugggccuccagucuucuggaaugucuucacugcagcugcuggaaaucacugcuuuc

SEQ ID NO: 134463 - RNA, 64 nt, Homo Sapiens
uagccaggcuggagugcaguggcauaaucucagcucacugcaaccucugcuucccggguucaag

SEQ ID NO: 134464 - RNA, 64 nt, Homo Sapiens
cgcccaggcuggaguguaguggcgcagucucagcucacugcaaccuccaccucccggguucaag

SEQ ID NO: 134465 - RNA, 64 nt, Homo Sapiens
cucugccuccuugguucaagggcguggucuuggcucacugcaacugcccaggcuggagugcguu

SEQ ID NO: 134466 - RNA, 64 nt, Homo Sapiens
cucugccuccugggugcaagggcacgaucucggcucacugcaaccgcgcaggguggagugcggu

SEQ ID NO: 134467 - RNA, 64 nt, Homo Sapiens
cuccaccucccggguucaaggguacgaucuuggcucacugcaaccacucaggcuggagugcagu

SEQ ID NO: 134468 - RNA, 64 nt, Homo Sapiens
caggcuggagugcagugguauuugagaugaagucucacugcacuuuuuguuuuuauuuuuguuu

SEQ ID NO: 134469 - RNA, 64 nt, Homo Sapiens
cuccgccucccagguucaagggugugaucuuagcucacugcaaccacccaggcuggagugcugu

SEQ ID NO: 134470 - RNA, 64 nt, Homo Sapiens
agcacgcccuccugggccguaguagugcaccaucucacugcagugcccugcgccaccucacugc

SEQ ID NO: 134471 - RNA, 64 nt, Homo Sapiens
agugcaccaucucacugcagagcccugcgccaccucacugcagucuuuugugcccaagcucacc

SEQ ID NO: 134472 - RNA, 64 nt, Homo Sapiens
cuucgccaccuggguuccagggaaugauuucagcucacugcaacucgcuauugucaccagggcu

SEQ ID NO: 134473 - RNA, 64 nt, Homo Sapiens
cuccgccucccggguucaagggcacaaucucggcucacugcauccgcccaggcuggagugcaau

SEQ ID NO: 134474 - RNA, 64 nt, Homo Sapiens
ggauggaugaacaucagugcaaagagaguaccuuucacugcauuagagauuuuuuucaacccua

SEQ ID NO: 134475 - RNA, 64 nt, Homo Sapiens
cuccgccuccuggguucaggggugugaucucggcucacugcaaccgccaaggcuggagugcagu

SEQ ID NO: 134476 - RNA, 64 nt, Homo Sapiens
agugaccaagccagcaggucacaggcagguccagucacugcaaagauggaacaugugcuuggcc

SEQ ID NO: 134477 - RNA, 64 nt, Homo Sapiens
cucugccucccggguucgagggcauaaucucagcucacugcagucacccaggcuguagugcagu

SEQ ID NO: 134478 - RNA, 64 nt, Homo Sapiens
cuccgccuccuggguucaagggcgcgaacucggcucacugcaaccgcccaggcuggagugcagu

SEQ ID NO: 134479 - RNA, 64 nt, Homo Sapiens
cccugccucccgggcucaagggcgcaaucuuugcucacugcaacgcccaggcugggggugcaau

SEQ ID NO: 134480 - RNA, 64 nt, Homo Sapiens
auugaaaaauggcauucacucuuacagaugguguucacugcaagccccagaagcauauggcaug

SEQ ID NO: 134481 - RNA, 64 nt, Homo Sapiens
cccccaagcuggaguacaaugacaggaucucggcucacugcaagcucugccucccggguucaag

SEQ ID NO: 134482 - RNA, 64 nt, Homo Sapiens
cacccaggcuggagugcaguggugcgaucucggcucacugcaagcuccgccucccggguucuca

SEQ ID NO: 134483 - RNA, 64 nt, Homo Sapiens
ccaggcuggagugcaauggugcaaugaccucggcucacugcaaccucugccuccuggguucaag

SEQ ID NO: 134484 - RNA, 64 nt, Homo Sapiens
cacccaggcuggagugcaauggcgcaaucucagcucacugcaaccucugccucccggguucaag

SEQ ID NO: 134485 - RNA, 64 nt, Homo Sapiens
ugcccaggcuggagugcaguggcgugaucuuggcucacugcaaccucugccucccagcuucaag

SEQ ID NO: 134486 - RNA, 64 nt, Homo Sapiens
cacccaggcuggagagcaguggcgugaucucggcucacugcaagcuccgccucccggguucacg

SEQ ID NO: 134487 - RNA, 64 nt, Homo Sapiens
cacccaggcuggaaugcaauggcaccaucuuggcucacugcaaccucugcuuccuggguucaag

SEQ ID NO: 134488 - RNA, 64 nt, Homo Sapiens
cacccaggcuagagugcgguggugugaucuuggcucacugcaaccucccccuccuggguucaag

SEQ ID NO: 134489 - RNA, 64 nt, Homo Sapiens
ugcucaggcuggagugcaguggugcaaucuuggcucacugcaaccuacaccucccggguucaag

SEQ ID NO: 134490 - RNA, 64 nt, Homo Sapiens
ugcccaggcuggacaacaauggcgcgaucucggcucacugcaaccuccaccucccggauucaag

SEQ ID NO: 134491 - RNA, 64 nt, Homo Sapiens
cauccaggcugaaguccaaucccacaaucauggcucacugcagccaccaccuccugagcucaag

SEQ ID NO: 134492 - RNA, 64 nt, Homo Sapiens
cacccaggcuggagugcaguggcaccaucuuggcucacugcagccucugccuccugggcucaaa

SEQ ID NO: 134493 - RNA, 64 nt, Homo Sapiens
ucuugcucugucacccaggccgugcaaucucggcucacugcaaccuccgccuccugggucaaau

SEQ ID NO: 134494 - RNA, 64 nt, Homo Sapiens
cgcucgcgcuggagugcaguggcaugaucucggcucacugcaagcuccgccucccagguucaug

SEQ ID NO: 134495 - RNA, 64 nt, Homo Sapiens
cacccaggcuggaaugcaguggugugaucuuggcucacugcaaccuccacuucccggguucaag

SEQ ID NO: 134496 - RNA, 64 nt, Homo Sapiens
cccccaggcuggagugcaguggcacaaugacgacucacugcagccucaaccuccuggggccaag

SEQ ID NO: 134497 - RNA, 64 nt, Homo Sapiens
ccaaguuacuggacaccaggacaaaccagguagaucacugcauccgguuccuccucuuucugcc

SEQ ID NO: 134498 - RNA, 64 nt, Homo Sapiens
ugcccaggcuggagugcaauggugcaauuucagcucacugcaaucucugccacccggauucaag

SEQ ID NO: 134499 - RNA, 64 nt, Homo Sapiens
uuuguaauauggaaaucuuuuacauuuuuccuauucacugcacuuuuuuauuguuuuuauuucu

SEQ ID NO: 134500 - RNA, 64 nt, Homo Sapiens
ucaccaggcuggagugcaguggcaugaucucggcucacugcaaccuccaacucccugguuuaag

SEQ ID NO: 134501 - RNA, 64 nt, Homo Sapiens
ucuccaggcuggagugcaguggcgucaucucggcucacugcaaccuccgccucccagguucaag

SEQ ID NO: 134502 - RNA, 64 nt, Homo Sapiens
cagcuucccaaagugcugggauuacaggugugagucacugcacccagccgaguugcuuucuuac

SEQ ID NO: 134503 - RNA, 64 nt, Homo Sapiens
ccaggcuggaggagugcaguggugugaucucagcucacugcaaccuccaccucccagguucaag

SEQ ID NO: 134504 - RNA, 64 nt, Homo Sapiens
cgcccaggcuggaacgcaguggugacaucucggcucacugcaaccuccaccucccagguucaag

SEQ ID NO: 134505 - RNA, 64 nt, Homo Sapiens
ugcccagacuagaguacaauauugcaaucacagcucacugcagccucaaacuccugggcucaag

SEQ ID NO: 134506 - RNA, 64 nt, Homo Sapiens
auauagcaauacaaccaauaauuuguuuuauguuucacugcauauaaauauuuccauuaaauca

SEQ ID NO: 134507 - RNA, 64 nt, Homo Sapiens
cguccaggcuggagugcgcuggcuugaucuuggcucacugcagccucaauguccccaggcucag

SEQ ID NO: 134508 - RNA, 64 nt, Homo Sapiens
cacccaggcuggaguacaguggguugaucauggcucacugcauccuugacuuccugggcucaag

SEQ ID NO: 134509 - RNA, 64 nt, Homo Sapiens
ugccagggcuggagugcaauggcgugaucuuggcucacugcaaccuccgccucccggguucaag

SEQ ID NO: 134510 - RNA, 64 nt, Homo Sapiens
cgcccuggcuggagugcaauggugugaucucagcucacugcacccuccgccucucggguucaag

SEQ ID NO: 134511 - RNA, 64 nt, Homo Sapiens
cacccagacuagaggucaguggcaggaucucagcucacugcaaccucugccuccugggcucaag

SEQ ID NO: 134512 - RNA, 64 nt, Homo Sapiens
cuccaccuccuggguucaaggaugccaucucagcucacugcaaccacacaggcuggaaugcagu

SEQ ID NO: 134513 - RNA, 64 nt, Homo Sapiens
cuccgccucccaaguucacuggcgcgaucucagcucacugcaagugcccaggcuggaguacagu

SEQ ID NO: 134514 - RNA, 64 nt, Homo Sapiens
cuccgccucccaguucaaguggugcgaucucagcucacugcaacuacccaggcuggagugcaau

SEQ ID NO: 134515 - RNA, 64 nt, Homo Sapiens
guugucacagcucauaaauaagaguuucaugugaucacugcagucuacaaaaugaauauuauca

SEQ ID NO: 134516 - RNA, 64 nt, Homo Sapiens
auggugggggcccuuacugugguagaaaccauugucacugcaaggcagcccugcuugggauuca

SEQ ID NO: 134517 - RNA, 64 nt, Homo Sapiens
gugucuagaaaaguaaggauaauuuucuuccuucucacugcagccccaagcucuuauuaaccuu

SEQ ID NO: 134518 - RNA, 64 nt, Homo Sapiens
cuccuccuccuggauucaagggcaugaucugggcucacugcaaccacccaggcuggaguguagu

SEQ ID NO: 134519 - RNA, 64 nt, Homo Sapiens
cuccgccucccggguucacgggcucgaucucggcucacugcaagcgcccaggcuggagugcagu

SEQ ID NO: 134520 - RNA, 64 nt, Homo Sapiens
cuccgucucuuagguucaagggcaugaucucagcucacugcaacugcugaggcuggagugaaau

SEQ ID NO: 134521 - RNA, 64 nt, Homo Sapiens
cuccaccucccagguucaagggugcaaucucggcucacugcaacuugcucugcuggagugcggu

SEQ ID NO: 134522 - RNA, 64 nt, Homo Sapiens
cacccaggcuagagugcaauggcacgaucucggcucacugcaagcucugcguccuggguugacg

SEQ ID NO: 134523 - RNA, 64 nt, Homo Sapiens
cgcccaggcuggagugcaguggcgcgaucucgacucacugcaagcuccgccucccggguucacg

SEQ ID NO: 134524 - RNA, 64 nt, Homo Sapiens
ucgccaggcuggagugcaguggugccaucucggcucacugcagcacugucucggcucacugcag

SEQ ID NO: 134525 - RNA, 64 nt, Homo Sapiens
gugccaucucggcucacugcagcacugucucggcucacugcagccuccgccucccguauucaag

SEQ ID NO: 134526 - RNA, 64 nt, Homo Sapiens
ccagcagaggcuagaggaauaugcuagaaaauccucacugcacucaugggaacagugcagcaac

SEQ ID NO: 134527 - RNA, 64 nt, Homo Sapiens
cuuugccuccuagguucaagggugcaaccucggcucacugcaacugcccaggagggagugcagu

SEQ ID NO: 134528 - RNA, 64 nt, Homo Sapiens
cuccgccucccguauucaagagcacugucucggcucacugcagcgugccaucucggcucacugc

SEQ ID NO: 134529 - RNA, 64 nt, Homo Sapiens
acugucucggcucacugcagggugccaucucggcucacugcagcucgccaggcuggagugcagu

SEQ ID NO: 134530 - RNA, 64 nt, Homo Sapiens
cucugccucccggguucaagggugcgaucucagcucacugcaucugcccaggcuggagugcagu

SEQ ID NO: 134531 - RNA, 64 nt, Homo Sapiens
ugggaaauuaagagauccagaauuuuaacuaaaaucacugcauaaggaaaaagaaauccuuugg

SEQ ID NO: 134532 - RNA, 64 nt, Homo Sapiens
aaaagcuugaugaaaggacaguuaaguauuuugaucacugcauuuuguuugaaacuugugucau

SEQ ID NO: 134533 - RNA, 64 nt, Homo Sapiens
ugcccaggcuggagugcaguggcgcaauuucagcucacugcaaccucugccucccagguucaag

SEQ ID NO: 134534 - RNA, 64 nt, Homo Sapiens
caccuaggcuacagugcaguggugugaucacagcucacugcagccucgacuucccaggcucaag

SEQ ID NO: 134535 - RNA, 64 nt, Homo Sapiens
cgcccaggcuagagugcaauggcgugaucucggcucacugcaaccuccaccucccagauucaag

SEQ ID NO: 134536 - RNA, 64 nt, Homo Sapiens
ugauuuaguuuuuggguuucuuugagacagggucucacugcauugcccuugcugaccucaaauu

SEQ ID NO: 134537 - RNA, 64 nt, Homo Sapiens
acccaggcuagaguacagugggaacagucauggcucacugcagcuuaagcucacugccugggcu

SEQ ID NO: 134538 - RNA, 64 nt, Homo Sapiens
cuccgccucccagguucaagggugcaaucucagcucacugcaaccacccaggcuggagugcagu

SEQ ID NO: 134539 - RNA, 64 nt, Homo Sapiens
cuugacuucccaggcucaggacaaaaaucucggcucacugcagcccaggcuagagugcaguggc

SEQ ID NO: 134540 - RNA, 64 nt, Homo Sapiens
cgcccaggcuggagugcaguggcgcgaucucggcucacugcaaccucugcccccuggguucaag

SEQ ID NO: 134541 - RNA, 64 nt, Homo Sapiens
uugcccgggcuggaaugcaauggcgcgauucagcucacugcaaucuccgccucccggguucaag

SEQ ID NO: 134542 - RNA, 64 nt, Homo Sapiens
cucuuuaauaguaccaggcacauugucagcugccucacugcauauacauuuuuaugaaaaauuu

SEQ ID NO: 134543 - RNA, 64 nt, Homo Sapiens
aaucaugugacugucacgugggaagcuuuggggcucacugcagauagguuccaggaaagcucgu

SEQ ID NO: 134544 - RNA, 64 nt, Homo Sapiens
ucaaggcccccuuuccgcuccagucccuggccacucacugcaguauuaagugccuucugugugu

SEQ ID NO: 134545 - RNA, 64 nt, Homo Sapiens
ggaugauggaacugaaucgaucuguuuuccgaagucacugcagcggaggaccgggaugcuggau

SEQ ID NO: 134546 - RNA, 64 nt, Homo Sapiens
ugcucaggcuggaguacaguggcauaaucacagcucacugcaaccucaauccugggcucaagug

SEQ ID NO: 134547 - RNA, 64 nt, Homo Sapiens
cccccaggcuggagugcaguggcucgaucucugcucacugcaagcuccgccuccuggguucaug

SEQ ID NO: 134548 - RNA, 64 nt, Homo Sapiens
cucugucuccuggguucaugggcgcgaucucggcucacugcaagcgcccaggcuugagugcagu

SEQ ID NO: 134549 - RNA, 64 nt, Homo Sapiens
cuccaccuccuggguucaagggugcaaucucagcucacugcaauuugccaggcuggagugcggu

SEQ ID NO: 134550 - RNA, 64 nt, Homo Sapiens
ucuuugguccagccagacccugggcccucucuccucacugcaccaggaccugaugccaagaaag

SEQ ID NO: 134551 - RNA, 64 nt, Homo Sapiens
ucugaaaagaagcugaguugucuccaggcugcugucacugcauccaggacucugucagcucugc

SEQ ID NO: 134552 - RNA, 64 nt, Homo Sapiens
ugcccagcccagaguacaguggcacuaucucagcucacugcaaucuccgccucccugguucaag

SEQ ID NO: 134553 - RNA, 64 nt, Homo Sapiens
cacccaggcuggagugcuguggugcaaucucggcucacugcaaccucugccucccgaguucaag

SEQ ID NO: 134554 - RNA, 64 nt, Homo Sapiens
cucugccucccagguucaagggcgcaauuucagcucacugcaaccacugaggcuggagugcagu

SEQ ID NO: 134555 - RNA, 64 nt, Homo Sapiens
cucagccuccccgauucacgggcgcgaucucggcucacugcaagcacccagacuggagugcagu

SEQ ID NO: 134556 - RNA, 64 nt, Homo Sapiens
cuccaccuccuggguucaagggcgcaauuucggcucacugcaacucaucaggcuggagugcagu

SEQ ID NO: 134557 - RNA, 64 nt, Homo Sapiens
cugggugacacuccagccuggguugugucacaguucacugcagcucgaggaugcaauuaauugu

SEQ ID NO: 134558 - RNA, 64 nt, Homo Sapiens
cucaacugccccagguuuaaggugcaaucucagcucacugcagccucccaggcuagagugcagu

SEQ ID NO: 134559 - RNA, 64 nt, Homo Sapiens
cucugccucuuggguucaagggugugaucucggcucacugcaaccaccuaggcuagagugcagu

SEQ ID NO: 134560 - RNA, 64 nt, Homo Sapiens
cacccagguuggagugccauggcaugaucuuggcucacugcaaccuccaccuccugggucaagc

SEQ ID NO: 134561 - RNA, 64 nt, Homo Sapiens
ugcccaugcuggagugcaguggcgugaucauagcucacugcagccuugaauuccuaggcuccag

SEQ ID NO: 134562 - RNA, 64 nt, Homo Sapiens
ugcccaggcuggagugcaguggcacaaucucagcucacugcaagcuccgccuccuggguucacg

SEQ ID NO: 134563 - RNA, 64 nt, Homo Sapiens
cuccgccuuccggguucaagggugugaucucggcucacugcaacuguccaggcuggagugcaau

SEQ ID NO: 134564 - RNA, 64 nt, Homo Sapiens
cucaaccuccuggguucaagggugcaaucacagcucacugcagcugcccaggcuagagugcaau

SEQ ID NO: 134565 - RNA, 64 nt, Homo Sapiens
uuccaccuccuggguuccagggcgugaucucggcucacugcaaccacccgggcuggagugcagu

SEQ ID NO: 134566 - RNA, 64 nt, Homo Sapiens
cuucgccuccuggguucaagggcaugaucucagcucacugcaaccacccaggcuggagugcaau

SEQ ID NO: 134567 - RNA, 64 nt, Homo Sapiens
uucugccucccagguucaagggcaugaucucggcucacugcaaccgcccaggcuggagugcagu

SEQ ID NO: 134568 - RNA, 64 nt, Homo Sapiens
cucugccuccuagauucaagugguugaucuuggcucacugcaacacccaggcuguguagugcag

SEQ ID NO: 134569 - RNA, 64 nt, Homo Sapiens
ugcccaggcuggagggcaauggcgcgaucucagcucacugcaaccuccgucuccuggguucuug

SEQ ID NO: 134570 - RNA, 64 nt, Homo Sapiens
ugcccaggcuggaguacaauggugcgaucuuggcucacugcaaccuccaccuccuggguucaag

SEQ ID NO: 134571 - RNA, 64 nt, Homo Sapiens
ugucacccaggcuggagugcaguggugcgaucgcucacugcaaccucagccuccuggauuuaag

SEQ ID NO: 134572 - RNA, 64 nt, Homo Sapiens
cacccaggcuggagugcaguggcgugaucuuggcucacugcaaccucugccuccuggguucaag

SEQ ID NO: 134573 - RNA, 64 nt, Homo Sapiens
cgcccaggcuggagugcaguggcaggaucucggcucacugcaaucuagguggaggucuuuuuaa

SEQ ID NO: 134574 - RNA, 64 nt, Homo Sapiens
ugaaaguguuuuugagaauuuuuauauauauuacucacugcagagaucauguucauuuacauuc

SEQ ID NO: 134575 - RNA, 64 nt, Homo Sapiens
cacccagguuggagugcaguggcgugaucucagcucacugcaaccuccaccucgcagguucaag

SEQ ID NO: 134576 - RNA, 64 nt, Homo Sapiens
cuccuaagcuggagugcaguggcaucaucucagcucacugcaaccucugccucccagguucaag

SEQ ID NO: 134577 - RNA, 64 nt, Homo Sapiens
cucugccuccuggguucaagggugcgaucuuggcucacugcaacugcccaggcuggagugcagu

SEQ ID NO: 134578 - RNA, 64 nt, Homo Sapiens
cuuacuccuaggcucaaguuagugcaaucacagcucacugcaaccaccugagcucuagugcagu

SEQ ID NO: 134579 - RNA, 64 nt, Homo Sapiens
caccuaggcuggaaugcaguggugcaaucauagcucacugcagccuugacccccucccugaccu

SEQ ID NO: 134580 - RNA, 64 nt, Homo Sapiens
cgcccaggauggagugcaguggcgcgaucuuagcucacugcaagcuccgccucccagguucaca

SEQ ID NO: 134581 - RNA, 64 nt, Homo Sapiens
ugcccaggcuggcgugcaguggugcgaucuggguucacugcaaccuccgccucuuggguucaag

SEQ ID NO: 134582 - RNA, 64 nt, Homo Sapiens
cgcccagucuggaaugcagugguaugaucacggcucacugcagccucaaccuccugggcuaagu

SEQ ID NO: 134583 - RNA, 64 nt, Homo Sapiens
cuccccggcuggagcgcaguggcacgaucgcggcucacugcagccuccauccucuggguucaag

SEQ ID NO: 134584 - RNA, 64 nt, Homo Sapiens
cgcccaggcuggaaugcaguugugagaucucggcucacugcaagcuccgccucccggguucacg

SEQ ID NO: 134585 - RNA, 64 nt, Homo Sapiens
cacccaggcuggagugcaguggcaugauuucggcucacugcaaccucugucuccuggguucaaa

SEQ ID NO: 134586 - RNA, 64 nt, Homo Sapiens
cuucacuuucuucaaagccacauuuuuugagguaucacugcagucaccucuucuacccucauca

SEQ ID NO: 134587 - RNA, 64 nt, Homo Sapiens
ucuccagggaauucuuacagccaaguugugacagucacugcauuugccugcuucuuuccagaaa

SEQ ID NO: 134588 - RNA, 64 nt, Homo Sapiens
uuuguguaaauuucucaaaguguugccuucaucuucacugcaauguuucaguuugaaaauauuu

SEQ ID NO: 134589 - RNA, 64 nt, Homo Sapiens
cucugccucccagguuccagggugugaucucggcucacugcaacuacccaggcuggagugcagu

SEQ ID NO: 134590 - RNA, 64 nt, Homo Sapiens
uccagcccccuuugccagggucagagcagcacugucacugcaagcaacagaagccuaguccugu

SEQ ID NO: 134591 - RNA, 64 nt, Homo Sapiens
cuccaccuccuggguucaugggcgcgaucucggcucacugcaagcacccaggcuggagugcagu

SEQ ID NO: 134592 - RNA, 64 nt, Homo Sapiens
agccgaagcuggacuguacugcugccaucucggcucacugcaaccucccugccugauucuccug

SEQ ID NO: 134593 - RNA, 64 nt, Homo Sapiens
ugugagagugaacugggacacaagcuagucuagcucacugcagccaagcaaacccuguugaugg

SEQ ID NO: 134594 - RNA, 64 nt, Homo Sapiens
cuugaccucccaggcgcacaggugccaucaugacucacugcagccacccaggcuggagugcagu

SEQ ID NO: 134595 - RNA, 64 nt, Homo Sapiens
cuccaccucccugauucaagggcgugaucuuggcucacugcaaccucccaggcuggagugcagu

SEQ ID NO: 134596 - RNA, 64 nt, Homo Sapiens
cucccaggcuggagcguaguaaugcaaucauagcucacugcagccuggaacuccuuggcucaag

SEQ ID NO: 134597 - RNA, 64 nt, Homo Sapiens
cacccaggcuggagugcaguagcaugaucagggaucacugcaaccucugccuccuggguucaag

SEQ ID NO: 134598 - RNA, 64 nt, Homo Sapiens
ugcccacgcaggagugcaguggcaugcucucagcucacugcagcccugacugccuaggcuccag

SEQ ID NO: 134599 - RNA, 64 nt, Homo Sapiens
uuugaccuccugggcuuaggagugcaaacauagcucacugcagccuggaaugacgaagugaagu

SEQ ID NO: 134600 - RNA, 64 nt, Homo Sapiens
cuccacaucccggguucaagggcgugaucucggcucacugcaacugcccaggcuggagugcagu

SEQ ID NO: 134601 - RNA, 64 nt, Homo Sapiens
uggagcuggggcuggggcugcauucccuggagacucacugcaaguuccugcccaggaggcugag

SEQ ID NO: 134602 - RNA, 64 nt, Homo Sapiens
ugcccaggcuggagugcaguggcgugaucucggcucacugcaagcucggccuccuggguucaaa

SEQ ID NO: 134603 - RNA, 64 nt, Homo Sapiens
ugcccaggcuggagugcaguggcgugaucucggcucacugcaaccuccacccccggggaucaag

SEQ ID NO: 134604 - RNA, 64 nt, Homo Sapiens
cucccaggcuggagugcuauggugcaauuuuuguucacugcaaccucugccuuccaagaucaag

SEQ ID NO: 134605 - RNA, 64 nt, Homo Sapiens
cgcccagguuggagugcaguggcgcaaucucggcucacugcaagcuccgccucccggguucacg

SEQ ID NO: 134606 - RNA, 64 nt, Homo Sapiens
cacccaggcuggagugcaguggugugaucuuggcucacugcaaccuccgccuccuggguuccaa

SEQ ID NO: 134607 - RNA, 64 nt, Homo Sapiens
caacagagaugcccugagggguuguguagguuguucacugcaggaaguccccugguuaagaagg

SEQ ID NO: 134608 - RNA, 64 nt, Homo Sapiens
cccccaggcuggagugcaguggcaugaucuuggcucacugcagccuccgccucccagguucaag

SEQ ID NO: 134609 - RNA, 64 nt, Homo Sapiens
ugcccaggcuggaguguagugguguguucuuggcucacugcacccuccgccuccugggcucaag

SEQ ID NO: 134610 - RNA, 64 nt, Homo Sapiens
cacccaggcuguagugcgguggcgcgaucucggcucacugcaaccuccgccucccggguucaag

SEQ ID NO: 134611 - RNA, 64 nt, Homo Sapiens
cuccgccucccagauucacgggugggaucucggcucacugcaaguaaccaggcuggagugcagu

SEQ ID NO: 134612 - RNA, 64 nt, Homo Sapiens
cuccaccuccuggguucaagggcacaaucucggcucacugcauccgcccagacuggaguccagu

SEQ ID NO: 134613 - RNA, 64 nt, Homo Sapiens
uuccgccucccggguucaagggcgcgaucuaggcucacugcaacucgccaggcuggagugcagu

SEQ ID NO: 134614 - RNA, 64 nt, Homo Sapiens
cucugccucccggguucaagggcgcgaucuuggcucacugcaaccgcucaggcuggagugccau

SEQ ID NO: 134615 - RNA, 64 nt, Homo Sapiens
cuccacuucucagguucaagggcacaaucuuggcucacugcaacuugccaggcuggagugcagu

SEQ ID NO: 134616 - RNA, 64 nt, Homo Sapiens
cuccgccuccuggguucacgggcgcgaucucagcucacugcaagugcccaggcuggagugcagu

SEQ ID NO: 134617 - RNA, 64 nt, Homo Sapiens
gaaccugacaguggucaacuugugcaccucuuccucacugcacgaccuggaugcugcuggaggg

SEQ ID NO: 134618 - RNA, 64 nt, Homo Sapiens
ugcagcucucgcucugccucggaacaccagcaccucacugcaucucuccuguguaaagccaucc

SEQ ID NO: 134619 - RNA, 64 nt, Homo Sapiens
cucugucucccgggcucaagggugugaucucagcucacugcagccaucuaggcuggagugcagu

SEQ ID NO: 134620 - RNA, 64 nt, Homo Sapiens
cucugccuccugguucaagcggugcgaucucagcucacugcaacuacccaggcuggagugcagu

SEQ ID NO: 134621 - RNA, 64 nt, Homo Sapiens
cucugccucccggguucaugggcgcgaucucagcucacugcaagagcccaggccagagugcagu

SEQ ID NO: 134622 - RNA, 64 nt, Homo Sapiens
uuccgccuccuguguucaagggcgugaucuuggcucacugcaacugcccaggcuggagugcagu

SEQ ID NO: 134623 - RNA, 64 nt, Homo Sapiens
cgcccaggcuggaguacaauggcacgaucuuggcucacugcaaccuccgccucccggguucaag

SEQ ID NO: 134624 - RNA, 64 nt, Homo Sapiens
ugcccaggcuggagugcaguggcgccaucucggcucacugcaaccuccgccucccagguucaag

SEQ ID NO: 134625 - RNA, 64 nt, Homo Sapiens
cgcccgggcugcaguucaguggugcaaucucagcucacugcaagcucugccucccagguuccaa

SEQ ID NO: 134626 - RNA, 64 nt, Homo Sapiens
aggccauuugaggcugcagugagcuaugauuguaucacugcacuccagccuagaugacagaacg

SEQ ID NO: 134627 - RNA, 64 nt, Homo Sapiens
ggcccucggugugaagaugaaccuuccaccgucuucacugcauccuggagugcaaaaauaaaau

SEQ ID NO: 134628 - RNA, 64 nt, Homo Sapiens
cacccaggcuggagugcaguggcacauucucggcucacugcaacuuccgccuccuggguucaag

SEQ ID NO: 134629 - RNA, 64 nt, Homo Sapiens
uuuucaucucuagggaccaggugcagaacugcagucacugcacgaaagacgcaccagcccagaa

SEQ ID NO: 134630 - RNA, 64 nt, Homo Sapiens
cuccgcuucccugguucaagggcgaaaucccugcucacugcagcugcccaggcuggagugcagu

SEQ ID NO: 134631 - RNA, 64 nt, Homo Sapiens
cacccaggugggagugugguggcacaaucucggcucacugcaaccuccaccuccugaguucaag

SEQ ID NO: 134632 - RNA, 64 nt, Homo Sapiens
cgcccaggcuggagugcagugucacgaucucagcucacugcaaccuccgccucccagguacaag

SEQ ID NO: 134633 - RNA, 64 nt, Homo Sapiens
gagcaggacugccgagcucacacccaugguggcuucacugcaagaccgggugaggcuggacggu

SEQ ID NO: 134634 - RNA, 64 nt, Homo Sapiens
cugcagggcucuugcugccaccagagcgcaggggucacugcacgcugagcucgcgugcagccac

SEQ ID NO: 134635 - RNA, 64 nt, Homo Sapiens
ccugcagccacccacgcaccgugccauguggccuucacugcagccuguucccaucucuauucag

SEQ ID NO: 134636 - RNA, 64 nt, Homo Sapiens
cucgccucccucuugcuggcuuuguaccuaucgcucacugcauggcuuccucuuacgugcuagc

SEQ ID NO: 134637 - RNA, 64 nt, Homo Sapiens
agaccguccuugugacuuuuuaaagagguggggcucacugcaacuggggagaacacuuagcaua

SEQ ID NO: 134638 - RNA, 64 nt, Homo Sapiens
cacccaggcuggagugcaguggugugaucucggcucacugcaaccuccaccucccggauucaag

SEQ ID NO: 134639 - RNA, 64 nt, Homo Sapiens
uccugucacaagcugggaugugguucugaaugguucacugcagccucagaaugaaaguucaugu

SEQ ID NO: 134640 - RNA, 64 nt, Homo Sapiens
gucuaaagguagaugcaaauuacuccacagagccucacugcaguggauaacucagaagucacug

SEQ ID NO: 134641 - RNA, 64 nt, Homo Sapiens
cuccaccuccuggguucaagggcacagucuuggcucacugcaacugugcaggcuggagugcagu

SEQ ID NO: 134642 - RNA, 64 nt, Homo Sapiens
cuccaccucccggguucaagggcacgaucuuggcucacugcaacugugcaggcuguagugcagu

SEQ ID NO: 134643 - RNA, 64 nt, Homo Sapiens
cuccgccucccagguucaggggcgcaaucuuggcucacugcaacuugccaggcuggagugcagu

SEQ ID NO: 134644 - RNA, 64 nt, Homo Sapiens
aaguggguuuuagaaaauaaauucaguaccauugucacugcaauuuaaaaaucauuuuaguaga

SEQ ID NO: 134645 - RNA, 64 nt, Homo Sapiens
auacugcugucagaugaauaacuccuagcucuuuucacugcaucgccagggucaaggacucgug

SEQ ID NO: 134646 - RNA, 64 nt, Homo Sapiens
gaacaggaucuacaggucuuugaucuggaaacuaagacuagagaagucuuaagagaugacugcu

SEQ ID NO: 134647 - RNA, 64 nt, Homo Sapiens
ggaagacucaaacacgauauuacccaaguuccugagacuagagaaguguauaagucugaggaca

SEQ ID NO: 134648 - RNA, 64 nt, Homo Sapiens
ccaaacaucacgagaucauaguauuaggaaagagagacuagauaguccuaauaguacucuauuc

SEQ ID NO: 134649 - RNA, 64 nt, Homo Sapiens
aaucuucuuuccauaguagaucucagccuccaguagacuagacgugucucugcuguacagggcc

SEQ ID NO: 134650 - RNA, 64 nt, Homo Sapiens
cuucaguuauauuuaauuauuguuaaggaguuuaagacuagaaagacuagagugcuuucuaguc

SEQ ID NO: 134651 - RNA, 64 nt, Homo Sapiens
uauuuaauuauuguuaaggaguuuaagacuagaaagacuagagugcuuucuaguccaaauagag

SEQ ID NO: 134652 - RNA, 64 nt, Homo Sapiens
acgugugguucauccaucaucugcugcacauagcagacuagaauucugggaacccugugcaauu

SEQ ID NO: 134653 - RNA, 64 nt, Homo Sapiens
uugaccggcugccguuugaggacuuuggucacccagacuagacaccuucugugcucauguuugg

SEQ ID NO: 134654 - RNA, 64 nt, Homo Sapiens
gagggguggagggauguuccccugagccaggcugagacuagaaccccaucuucccugagccagg

SEQ ID NO: 134655 - RNA, 64 nt, Homo Sapiens
gagacuagaaccccaucuucccugagccaggcugagacuagaaccccaucuuccccaccacgcc

SEQ ID NO: 134656 - RNA, 64 nt, Homo Sapiens
guuguauguaucuaagauaaaagagaaauaauguuccuacaauaaaauauguuuccugagagau

SEQ ID NO: 134657 - RNA, 64 nt, Homo Sapiens
aaaccuguuuuccauuuguauucacuuuccuuuuuccuacaauggucucuuucgaaagcauuaa

SEQ ID NO: 134658 - RNA, 64 nt, Homo Sapiens
uuuuugaugaauuucuagguguuugggucacaguuccuacaaauacggaaaaggggguuaaaaa

SEQ ID NO: 134659 - RNA, 64 nt, Homo Sapiens
augauauuuuucucugauaauuuaauaucuacucuccuacaaaagcucaagccugaagauacaa

SEQ ID NO: 134660 - RNA, 54 nt, Homo Sapiens
gugaguauggcaaaacuuaauugauccuacaagcuuacuacacauaggaaaauu

SEQ ID NO: 134661 - RNA, 64 nt, Homo Sapiens
uacugaaaguugagaaaauucguacuggagagaauccuacaaaugugaaaaauguggcaaaucc

SEQ ID NO: 134662 - RNA, 64 nt, Homo Sapiens
cuaaauaaaaugguacuuacaguaacccaacauuuccuacaacacuuugguuucguuuuuaaga

SEQ ID NO: 134663 - RNA, 64 nt, Homo Sapiens
ggccuaugucucagaagagcggagcacuggagaauccuacaaauuuaggagacauuagugaauu

SEQ ID NO: 134664 - RNA, 64 nt, Homo Sapiens
uacuaaacauaagagaauucauaccauagagaaauccuacaaauaugaagaaugugacaaagcu

SEQ ID NO: 134665 - RNA, 64 nt, Homo Sapiens
cuugauuauagguaauauucauauuggaaaaauuuccuacaaguaagaacaauguggcaaaguu

SEQ ID NO: 134666 - RNA, 64 nt, Homo Sapiens
gggagggaggguguggguguguggccaugggcagacagccgaaaugagaaccucgggguuugag

SEQ ID NO: 134667 - RNA, 64 nt, Homo Sapiens
aaccuguacagucauuuuucuacugacuuaauaaacagccgagcugucccuugaugcugagugu

SEQ ID NO: 134668 - RNA, 64 nt, Homo Sapiens
uucucaaagguugaaaaaaugcuuuuaauuuuucacagccgagaaacagugcagcaguauaugu

SEQ ID NO: 134669 - RNA, 64 nt, Homo Sapiens
uguccagggagaauacuggcuucauuacacuuguacagccgaguucuucccgcauuacugcugu

SEQ ID NO: 134670 - RNA, 64 nt, Homo Sapiens
cuggggaggagccuuaucaauuauucagcaucagacagccgacacuuugaucagaggaugcaua

SEQ ID NO: 134671 - RNA, 64 nt, Homo Sapiens
acacacgccuagggaugagcggccuggugguuuaacagccgaagcuggauucuacugaaguaga

SEQ ID NO: 134672 - RNA, 64 nt, Homo Sapiens
cuucagccugccuggggugagaggucagugcaccacagccgaggcuggagcacagggagcuucu

SEQ ID NO: 134673 - RNA, 64 nt, Homo Sapiens
agcagccaccccgccugcuucuggaggugccuccacagccgaccucacccucuaggcccugugc

SEQ ID NO: 134674 - RNA, 64 nt, Homo Sapiens
ggcagccucugucaggccuucaggguucagcaguacagccgagacucgacucugugccucccuc

SEQ ID NO: 134675 - RNA, 64 nt, Homo Sapiens
ugcugcaggucagcaacuguuguccugcucacccacagccgaucgugcuuguggagggccugac

SEQ ID NO: 134676 - RNA, 64 nt, Homo Sapiens
ccugucuugcaauggggggaaugcuccgucucaaacagccgaaaccuccuccuuccugccugug

SEQ ID NO: 134677 - RNA, 64 nt, Homo Sapiens
ccugcgcccagugauguuuccacggugccuguacacagccgagcagcauuuccguugaaggacu

SEQ ID NO: 134678 - RNA, 63 nt, Homo Sapiens
agaugcccaugccuguguagccgccaccgagggacagccgagggaccgauggacgaggggaca

SEQ ID NO: 134679 - RNA, 64 nt, Homo Sapiens
cacuccaucccagauuuguuccgacguguaacucacagccgaagcaucauuuaucuugaacauu

SEQ ID NO: 134680 - RNA, 64 nt, Homo Sapiens
uguggccucuugcucugaagagacacagaugcucacagccgaccguuggagaugcucaacagcu

SEQ ID NO: 134681 - RNA, 64 nt, Homo Sapiens
ugaagcgcaggaaagaaaggcccauuccccucgcacagccgagcuuuuacucccugagcacggg

SEQ ID NO: 134682 - RNA, 64 nt, Homo Sapiens
gacaggcccacccugcagcucaggcaccaagaaaacagccgauacuggcagccauugcagcucc

SEQ ID NO: 134683 - RNA, 64 nt, Homo Sapiens
agagagcagcucagugucacacugggagcugggcacagccgaucuccuuccagaaggguucugu

SEQ ID NO: 134684 - RNA, 64 nt, Homo Sapiens
uagucccaacgcguuugcaaccuaccuuuuuaacacagccgaacauaagugcuuuuggaaguca

SEQ ID NO: 134685 - RNA, 64 nt, Homo Sapiens
cccgccacugauucagugagcuggagauuggaucacagccgaaggaguaaaggugcugcaauga

SEQ ID NO: 134686 - RNA, 64 nt, Homo Sapiens
uuuuauauggcaccuuucugagggaggggauuuuacagccgagggaccuccaaagggaacgucc

SEQ ID NO: 134687 - RNA, 64 nt, Homo Sapiens
ccaagagcugguggcucugaacuugugaucccggacagccgaaccuccugccggaggcaugucu

SEQ ID NO: 134688 - RNA, 64 nt, Homo Sapiens
acuuacuccaccuuccauuccucgcccuguccccacagccgaguccugcaucagcccuuuaucc

SEQ ID NO: 134689 - RNA, 64 nt, Homo Sapiens
ucaaagccacauccucuugccccugacagagaagacagccgaagagauccaucucuuggggcuc

SEQ ID NO: 134690 - RNA, 64 nt, Homo Sapiens
auaauguugaccugucagaugggcgguuucagggacagccgagaagcuguggaagccagaaguu

SEQ ID NO: 134691 - RNA, 64 nt, Homo Sapiens
gacacgagcaucacucugcucccacgcucaccugacagccgaggauccaaagcugauucacaaa

SEQ ID NO: 134692 - RNA, 64 nt, Homo Sapiens
cuggcagcccuccaucuggugacgaagcucccugacagccgagaccucuaccacugggcacuga

SEQ ID NO: 134693 - RNA, 64 nt, Homo Sapiens
uuggaguaauguccguguagggcagaguguggugacagccgaacaugcagggagccagggugag

SEQ ID NO: 134694 - RNA, 64 nt, Homo Sapiens
aguggucaagcuagaaugggagacuaguuugugcacagccgagaaacugaggcucaggagagcu

SEQ ID NO: 134695 - RNA, 64 nt, Homo Sapiens
ggcgacagccuucagcuccggggacuccauggagacagccgaccggggagugcagggccagaug

SEQ ID NO: 134696 - RNA, 64 nt, Homo Sapiens
auugucugagguugcuggcuaaccuuaaggauauacagccgaaggguuaauggacuuguuacca

SEQ ID NO: 134697 - RNA, 64 nt, Homo Sapiens
caccugagcaggaccucugagaacuugugagaacacagccgauugcacacccacucagcuccgu

SEQ ID NO: 134698 - RNA, 64 nt, Homo Sapiens
gucagaccaugaggagccaagaccagcaggucccacagccgacagugcccagagcaugcaggga

SEQ ID NO: 134699 - RNA, 64 nt, Homo Sapiens
cugacccacgcuugggcaucaauggcaccuccacacagccgaagcacccggcaucuuggugggg

SEQ ID NO: 134700 - RNA, 64 nt, Homo Sapiens
gaaacuugugccuuuaaacuuuguaaacuuaaacacagccgagaaguugcuucuuuguacuuuu

SEQ ID NO: 134701 - RNA, 64 nt, Homo Sapiens
ugagccaggcaccucuguuuccugcuguuuauugacagccgacggcagcgccuugcccagaccu

SEQ ID NO: 134702 - RNA, 64 nt, Homo Sapiens
uccccaccuuucucggaugcagggccagagugacacagccgaaaaauugcaguuugucuguacu

SEQ ID NO: 134703 - RNA, 64 nt, Homo Sapiens
gugccugggaaccuuccugucuucauccuuagcaacagccgaguggauagaugcccugcuagau

SEQ ID NO: 134704 - RNA, 64 nt, Homo Sapiens
caaggucgcagaaaggcauucuguugacagaugaacagccgaaagcuggccagacccuccugua

SEQ ID NO: 134705 - RNA, 64 nt, Homo Sapiens
accaaccaaaaagaguccaggaccagauggauucacagccgaauucuaccagagguacaaggag

SEQ ID NO: 134706 - RNA, 64 nt, Homo Sapiens
ggccaggacaacgggcuggagggucugggcaacgacagccgagacauguacauggagucugagg

SEQ ID NO: 134707 - RNA, 64 nt, Homo Sapiens
uuuggccuuagucaaugucuaugcccgucacauaacagccgaggcaccgaggcccacagggaag

SEQ ID NO: 134708 - RNA, 64 nt, Homo Sapiens
ggagccagcaccagcaggauacccccguggggggacagccgauggccagagauacaucaauuac

SEQ ID NO: 134709 - RNA, 64 nt, Homo Sapiens
uugcugagcgcgcuuugaaauuguaucaauaaauacagccgaggugacucucgggugaucuucc

SEQ ID NO: 134710 - RNA, 64 nt, Homo Sapiens
uugagaaaugcauagcauuauuuaacacuauugaacagccgacuuugagcauuguuucuucuaa

SEQ ID NO: 134711 - RNA, 64 nt, Homo Sapiens
gagacccagauguuggacaccaggaaggggccccacagccgagacgacguguccagugaccauc

SEQ ID NO: 134712 - RNA, 64 nt, Homo Sapiens
cugacaucuugaucacuggaaagaccagaaauaaacagccgauguggccacauugcugccagcc

SEQ ID NO: 134713 - RNA, 64 nt, Homo Sapiens
cucauuuccaaggcacagcacuucccaggcucugacagccgagaugggcugguucuucccacca

SEQ ID NO: 134714 - RNA, 64 nt, Homo Sapiens
accucauuucguuuauuuuaguagguguaugucuacagccgaugaguucuaccuaacuuacuau

SEQ ID NO: 134715 - RNA, 64 nt, Homo Sapiens
aauccguggggccggcaagccagugccuuaugccacagccgaaggcgccuuccugcagaacaca

SEQ ID NO: 134716 - RNA, 64 nt, Homo Sapiens
agccguggcuccauggccaggaucucuggugcucacagccgagggcugaggugccccggggggu

SEQ ID NO: 134717 - RNA, 64 nt, Homo Sapiens
cuucaauuaggacacagccagauggacaucuaagacagccgaucaucuuuccuugccuaugaca

SEQ ID NO: 134718 - RNA, 64 nt, Homo Sapiens
acuggcgaguauguucuaugagccccuguuuugcacagccgagucccauuuguacuucagcgcu

SEQ ID NO: 134719 - RNA, 64 nt, Homo Sapiens
ggaaacacccuaucuccucuuucuaugggaaugaggcggauacacuauuucuucccuuauaguu

SEQ ID NO: 134720 - RNA, 64 nt, Homo Sapiens
cuacuuuaugaagguaaggaacauuuucauucuuggcggauagccagcccauagcuuugaguug

SEQ ID NO: 134721 - RNA, 64 nt, Homo Sapiens
ugagcccaggaguucgagacgggaggcugaugugggcggauagugccuguaaucccagcacuuu

SEQ ID NO: 134722 - RNA, 64 nt, Homo Sapiens
cccuugaaauuucacauuccuggguuccuuccauggcggauacugcccuggaggggccugacag

SEQ ID NO: 134723 - RNA, 64 nt, Homo Sapiens
cggaacugugaauguacauaggcgacuuagaguuggcggauauuugauucucuuuucucuucgu

SEQ ID NO: 134724 - RNA, 64 nt, Homo Sapiens
aucuuauacuacucuuguauguaagcuccuggagggcggauaacuuauuucugccucuaguuuu

SEQ ID NO: 134725 - RNA, 64 nt, Homo Sapiens
auaagacuauacuagacaaagccuaaaaacuaugggcggauaguggagaaaacuuaauaauugu

SEQ ID NO: 134726 - RNA, 64 nt, Homo Sapiens
cccagcuucuaaggugggcacaaacuugcuaagcggcggauacccagccacagcccaaacacau

SEQ ID NO: 134727 - RNA, 64 nt, Homo Sapiens
uucauaugaucccucccucagcugcgucaggcugggcggauauucaaaagcugacccgccuuuu

SEQ ID NO: 134728 - RNA, 64 nt, Homo Sapiens
cuuauuugccgugaguuuggacggcaccccugcuggcggauagcaagacucuguggaguuuguu

SEQ ID NO: 134729 - RNA, 64 nt, Homo Sapiens
agggugcauuuuaaagguauugaauggauccucaggcggauaaauuguaaagcugcauauucac

SEQ ID NO: 134730 - RNA, 64 nt, Homo Sapiens
cguaggugucuaacacagaggagaguaggaacagggcggauaccugaaggugacuccgagucca

SEQ ID NO: 134731 - RNA, 64 nt, Homo Sapiens
gaccaacgaaguggagauucgauacguggacuacggcggauauaagagggugaaaguagacgug

SEQ ID NO: 134732 - RNA, 64 nt, Homo Sapiens
caccuguagucccagcuacucgggggcugagccaggcggauagcuugagcucagggggccaagg

SEQ ID NO: 134733 - RNA, 64 nt, Homo Sapiens
gaaacuugugagaaugugaugggggcagaggagaggcggauacacuuuuuguuggggguggggu

SEQ ID NO: 134734 - RNA, 64 nt, Homo Sapiens
agucuucagggcuuggcaacugaaauagcuauguggcggauacggaaaacagaggacaauuuga

SEQ ID NO: 134735 - RNA, 64 nt, Homo Sapiens
cucagggacccuguguaggaacgcccgucuuaaaguccagcaugacucacaagggucuuaucag

SEQ ID NO: 134736 - RNA, 64 nt, Homo Sapiens
gacaagcucccguggaaaacgagauguaaaaaugguccagcagaaaguccuuaccucuccccuu

SEQ ID NO: 134737 - RNA, 64 nt, Homo Sapiens
accaaacucugccaggggucccagaaagcccaggguccagcagucucagcacuuggccccuugc

SEQ ID NO: 134738 - RNA, 64 nt, Homo Sapiens
aucuucuucaggcagcugucuccaccuccaggauguccagcaggcugcaaggagaaggaugcca

SEQ ID NO: 134739 - RNA, 64 nt, Homo Sapiens
gaagaaucccccauggaaacugcccuuauccgcuguccagcagcugccagaggccccaggucac

SEQ ID NO: 134740 - RNA, 64 nt, Homo Sapiens
ggaagacgcuuccuuccaggacagcaggcuuugaguccagcacccccagccugccuuugccacc

SEQ ID NO: 134741 - RNA, 64 nt, Homo Sapiens
aguaggcguuagagcauucaagguccagcagaguguccagcaaacuccuucugggcuaacucca

SEQ ID NO: 134742 - RNA, 64 nt, Homo Sapiens
guguccagcaaaaguaggcggggcuaacuccaagguccagcagaaggguugcaguccuccuucu

SEQ ID NO: 134743 - RNA, 64 nt, Homo Sapiens
ggcgcugggugggagggcaccgaacugcaccgugguccagcagacccuggcccaccuucuggag

SEQ ID NO: 134744 - RNA, 64 nt, Homo Sapiens
cauccuggcccacggccugauuauuuggagaaccguccagcauggacaaacccuuggggcuuuu

SEQ ID NO: 134745 - RNA, 64 nt, Homo Sapiens
caaauaaaagacccuugggcucacucccaacagcguccagcacauagggcuggcucacauccag

SEQ ID NO: 134746 - RNA, 64 nt, Homo Sapiens
gggugcccauccccaucucuuucucuggucuucaguccagcacuaggccacagggagcuccacc

SEQ ID NO: 134747 - RNA, 64 nt, Homo Sapiens
agaggaagcugaaugaagaggacgccgccagcgaguccagcagggaguccagcaacgaggauga

SEQ ID NO: 134748 - RNA, 64 nt, Homo Sapiens
augaagaggacgccgccagcgaguccagcagggaguccagcaacgaggaugagggcagcagcuc

SEQ ID NO: 134749 - RNA, 64 nt, Homo Sapiens
accugcuggucaguggcagaugcuucuccuugugguccagcacccggagcugcguaccucccgc

SEQ ID NO: 134750 - RNA, 64 nt, Homo Sapiens
gucuuugagaaugcagucauuaagcaucgcacauguccagcaauuuuucagcagaaaugaagga

SEQ ID NO: 134751 - RNA, 64 nt, Homo Sapiens
cgugccguuucugggcaggagaagacaucaugguguccagcaacucagcaaagccauucuuaag

SEQ ID NO: 134752 - RNA, 64 nt, Homo Sapiens
gaaccacuaggaugugaucugcccuugugggcagguccagcauaguuaggaguuaggcuuuagc

SEQ ID NO: 134753 - RNA, 64 nt, Homo Sapiens
gcuccagccggccggggaugugagucaucccuugguccagcacauccacgcuguauacgccacc

SEQ ID NO: 134754 - RNA, 64 nt, Homo Sapiens
acacugggccaaaggcucacuaccccugugcguuguccagcacacagacacuaugugcauuauu

SEQ ID NO: 134755 - RNA, 64 nt, Homo Sapiens; identical to SEQ ID NO: 53500

SEQ ID NO: 134756 - RNA, 64 nt, Homo Sapiens; identical to SEQ ID NO: 53501

SEQ ID NO: 134757 - RNA, 64 nt, Homo Sapiens; identical to SEQ ID NO: 53502

SEQ ID NO: 134758 - RNA, 64 nt, Homo Sapiens; identical to SEQ ID NO: 53503

SEQ ID NO: 134759 - RNA, 64 nt, Homo Sapiens; identical to SEQ ID NO: 53504

SEQ ID NO: 134760 - RNA, 64 nt, Homo Sapiens; identical to SEQ ID NO: 53505

SEQ ID NO: 134761 - RNA, 64 nt, Homo Sapiens; identical to SEQ ID NO: 53506

SEQ ID NO: 134762 - RNA, 64 nt, Homo Sapiens; identical to SEQ ID NO: 53507

SEQ ID NO: 134763 - RNA, 64 nt, Homo Sapiens; identical to SEQ ID NO: 53508

SEQ ID NO: 134764 - RNA, 64 nt, Homo Sapiens; identical to SEQ ID NO: 53509

SEQ ID NO: 134765 - RNA, 64 nt, Homo Sapiens; identical to SEQ ID NO: 53510

SEQ ID NO: 134766 - RNA, 64 nt, Homo Sapiens; identical to SEQ ID NO: 53511

SEQ ID NO: 134767 - RNA, 64 nt, Homo Sapiens; identical to SEQ ID NO: 53512

SEQ ID NO: 134768 - RNA, 64 nt, Homo Sapiens; identical to SEQ ID NO: 53513

SEQ ID NO: 134769 - RNA, 64 nt, Homo Sapiens; identical to SEQ ID NO: 53514

SEQ ID NO: 134770 - RNA, 64 nt, Homo Sapiens; identical to SEQ ID NO: 53515

SEQ ID NO: 134771 - RNA, 64 nt, Homo Sapiens; identical to SEQ ID NO: 53516

SEQ ID NO: 134772 - RNA, 64 nt, Homo Sapiens; identical to SEQ ID NO: 53517

SEQ ID NO: 134773 - RNA, 64 nt, Homo Sapiens; identical to SEQ ID NO: 53518

SEQ ID NO: 134774 - RNA, 64 nt, Homo Sapiens; identical to SEQ ID NO: 53519

SEQ ID NO: 134775 - RNA, 64 nt, Homo Sapiens; identical to SEQ ID NO: 53520

SEQ ID NO: 134776 - RNA, 54 nt, Homo Sapiens; identical to SEQ ID NO: 53521

SEQ ID NO: 134777 - RNA, 64 nt, Homo Sapiens; identical to SEQ ID NO: 53522

SEQ ID NO: 134778 - RNA, 64 nt, Homo Sapiens; identical to SEQ ID NO: 53523

SEQ ID NO: 134779 - RNA, 64 nt, Homo Sapiens; identical to SEQ ID NO: 53524

SEQ ID NO: 134780 - RNA, 64 nt, Homo Sapiens; identical to SEQ ID NO: 53525

SEQ ID NO: 134781 - RNA, 64 nt, Homo Sapiens; identical to SEQ ID NO: 53526

SEQ ID NO: 134782 - RNA, 64 nt, Homo Sapiens; identical to SEQ ID NO: 53527

SEQ ID NO: 134783 - RNA, 64 nt, Homo Sapiens; identical to SEQ ID NO: 53528

SEQ ID NO: 134784 - RNA, 64 nt, Homo Sapiens; identical to SEQ ID NO: 53529

SEQ ID NO: 134785 - RNA, 64 nt, Homo Sapiens; identical to SEQ ID NO: 53530

SEQ ID NO: 134786 - RNA, 64 nt, Homo Sapiens; identical to SEQ ID NO: 53531

SEQ ID NO: 134787 - RNA, 64 nt, Homo Sapiens; identical to SEQ ID NO: 53532

SEQ ID NO: 134788 - RNA, 64 nt, Homo Sapiens; identical to SEQ ID NO: 53533

SEQ ID NO: 134789 - RNA, 64 nt, Homo Sapiens; identical to SEQ ID NO: 53534

SEQ ID NO: 134790 - RNA, 64 nt, Homo Sapiens; identical to SEQ ID NO: 53535

SEQ ID NO: 134791 - RNA, 64 nt, Homo Sapiens; identical to SEQ ID NO: 53536

SEQ ID NO: 134792 - RNA, 64 nt, Homo Sapiens; identical to SEQ ID NO: 53537

SEQ ID NO: 134793 - RNA, 64 nt, Homo Sapiens; identical to SEQ ID NO: 53538

SEQ ID NO: 134794 - RNA, 64 nt, Homo Sapiens; identical to SEQ ID NO: 53539

SEQ ID NO: 134795 - RNA, 64 nt, Homo Sapiens; identical to SEQ ID NO: 53540

SEQ ID NO: 134796 - RNA, 64 nt, Homo Sapiens; identical to SEQ ID NO: 53541

SEQ ID NO: 134797 - RNA, 64 nt, Homo Sapiens; identical to SEQ ID NO: 53542

SEQ ID NO: 134798 - RNA, 64 nt, Homo Sapiens; identical to SEQ ID NO: 53543

SEQ ID NO: 134799 - RNA, 64 nt, Homo Sapiens; identical to SEQ ID NO: 128175

SEQ ID NO: 134800 - RNA, 64 nt, Homo Sapiens; identical to SEQ ID NO: 128176

SEQ ID NO: 134801 - RNA, 64 nt, Homo Sapiens; identical to SEQ ID NO: 128177

SEQ ID NO: 134802 - RNA, 64 nt, Homo Sapiens; identical to SEQ ID NO: 128178

SEQ ID NO: 134803 - RNA, 64 nt, Homo Sapiens; identical to SEQ ID NO: 128179

SEQ ID NO: 134804 - RNA, 64 nt, Homo Sapiens; identical to SEQ ID NO: 128180

SEQ ID NO: 134805 - RNA, 64 nt, Homo Sapiens; identical to SEQ ID NO: 128181

SEQ ID NO: 134806 - RNA, 64 nt, Homo Sapiens; identical to SEQ ID NO: 128182

SEQ ID NO: 134807 - RNA, 64 nt, Homo Sapiens; identical to SEQ ID NO: 128183

SEQ ID NO: 134808 - RNA, 64 nt, Homo Sapiens; identical to SEQ ID NO: 128184

SEQ ID NO: 134809 - RNA, 64 nt, Homo Sapiens; identical to SEQ ID NO: 128185

SEQ ID NO: 134810 - RNA, 64 nt, Homo Sapiens; identical to SEQ ID NO: 128186

SEQ ID NO: 134811 - RNA, 64 nt, Homo Sapiens; identical to SEQ ID NO: 128187

SEQ ID NO: 134812 - RNA, 64 nt, Homo Sapiens; identical to SEQ ID NO: 128188

SEQ ID NO: 134813 - RNA, 64 nt, Homo Sapiens; identical to SEQ ID NO: 128189

SEQ ID NO: 134814 - RNA, 64 nt, Homo Sapiens; identical to SEQ ID NO: 128190

SEQ ID NO: 134815 - RNA, 64 nt, Homo Sapiens; identical to SEQ ID NO: 128191

SEQ ID NO: 134816 - RNA, 64 nt, Homo Sapiens; identical to SEQ ID NO: 128192

SEQ ID NO: 134817 - RNA, 64 nt, Homo Sapiens; identical to SEQ ID NO: 128193

SEQ ID NO: 134818 - RNA, 64 nt, Homo Sapiens; identical to SEQ ID NO: 128194

SEQ ID NO: 134819 - RNA, 64 nt, Homo Sapiens; identical to SEQ ID NO: 128195

SEQ ID NO: 134820 - RNA, 64 nt, Homo Sapiens; identical to SEQ ID NO: 128196

SEQ ID NO: 134821 - RNA, 64 nt, Homo Sapiens; identical to SEQ ID NO: 128197

SEQ ID NO: 134822 - RNA, 64 nt, Homo Sapiens; identical to SEQ ID NO: 128198

SEQ ID NO: 134823 - RNA, 64 nt, Homo Sapiens; identical to SEQ ID NO: 128199

SEQ ID NO: 134824 - RNA, 64 nt, Homo Sapiens; identical to SEQ ID NO: 128200

SEQ ID NO: 134825 - RNA, 64 nt, Homo Sapiens; identical to SEQ ID NO: 128201

SEQ ID NO: 134826 - RNA, 64 nt, Homo Sapiens; identical to SEQ ID NO: 128202

SEQ ID NO: 134827 - RNA, 64 nt, Homo Sapiens; identical to SEQ ID NO: 128203

SEQ ID NO: 134828 - RNA, 64 nt, Homo Sapiens; identical to SEQ ID NO: 128204

SEQ ID NO: 134829 - RNA, 64 nt, Homo Sapiens; identical to SEQ ID NO: 128205

SEQ ID NO: 134830 - RNA, 64 nt, Homo Sapiens; identical to SEQ ID NO: 128206

SEQ ID NO: 134831 - RNA, 64 nt, Homo Sapiens; identical to SEQ ID NO: 39347

SEQ ID NO: 134832 - RNA, 64 nt, Homo Sapiens; identical to SEQ ID NO: 39348

SEQ ID NO: 134833 - RNA, 64 nt, Homo Sapiens; identical to SEQ ID NO: 39349

SEQ ID NO: 134834 - RNA, 64 nt, Homo Sapiens; identical to SEQ ID NO: 39350

SEQ ID NO: 134835 - RNA, 64 nt, Homo Sapiens; identical to SEQ ID NO: 39351

SEQ ID NO: 134836 - RNA, 64 nt, Homo Sapiens; identical to SEQ ID NO: 39352

SEQ ID NO: 134837 - RNA, 64 nt, Homo Sapiens; identical to SEQ ID NO: 39353

SEQ ID NO: 134838 - RNA, 64 nt, Homo Sapiens; identical to SEQ ID NO: 39354

SEQ ID NO: 134839 - RNA, 64 nt, Homo Sapiens; identical to SEQ ID NO: 39355

SEQ ID NO: 134840 - RNA, 64 nt, Homo Sapiens; identical to SEQ ID NO: 39356

SEQ ID NO: 134841 - RNA, 64 nt, Homo Sapiens; identical to SEQ ID NO: 39357

SEQ ID NO: 134842 - RNA, 64 nt, Homo Sapiens; identical to SEQ ID NO: 39358

SEQ ID NO: 134843 - RNA, 64 nt, Homo Sapiens; identical to SEQ ID NO: 39359

SEQ ID NO: 134844 - RNA, 64 nt, Homo Sapiens; identical to SEQ ID NO: 39360

SEQ ID NO: 134845 - RNA, 64 nt, Homo Sapiens; identical to SEQ ID NO: 39361

SEQ ID NO: 134846 - RNA, 64 nt, Homo Sapiens; identical to SEQ ID NO: 39362

SEQ ID NO: 134847 - RNA, 64 nt, Homo Sapiens; identical to SEQ ID NO: 39363

SEQ ID NO: 134848 - RNA, 64 nt, Homo Sapiens; identical to SEQ ID NO: 39364

SEQ ID NO: 134849 - RNA, 64 nt, Homo Sapiens; identical to SEQ ID NO: 39365

SEQ ID NO: 134850 - RNA, 64 nt, Homo Sapiens; identical to SEQ ID NO: 39366

SEQ ID NO: 134851 - RNA, 64 nt, Homo Sapiens; identical to SEQ ID NO: 39367

SEQ ID NO: 134852 - RNA, 64 nt, Homo Sapiens; identical to SEQ ID NO: 39368

SEQ ID NO: 134853 - RNA, 64 nt, Homo Sapiens; identical to SEQ ID NO: 39369

SEQ ID NO: 134854 - RNA, 64 nt, Homo Sapiens; identical to SEQ ID NO: 39370

SEQ ID NO: 134855 - RNA, 64 nt, Homo Sapiens; identical to SEQ ID NO: 39371

SEQ ID NO: 134856 - RNA, 64 nt, Homo Sapiens; identical to SEQ ID NO: 39372

SEQ ID NO: 134857 - RNA, 64 nt, Homo Sapiens; identical to SEQ ID NO: 39373

SEQ ID NO: 134858 - RNA, 64 nt, Homo Sapiens; identical to SEQ ID NO: 39374

SEQ ID NO: 134859 - RNA, 64 nt, Homo Sapiens; identical to SEQ ID NO: 39375

SEQ ID NO: 134860 - RNA, 64 nt, Homo Sapiens; identical to SEQ ID NO: 39376

SEQ ID NO: 134861 - RNA, 64 nt, Homo Sapiens; identical to SEQ ID NO: 39377

SEQ ID NO: 134862 - RNA, 64 nt, Homo Sapiens; identical to SEQ ID NO: 39378

SEQ ID NO: 134863 - RNA, 64 nt, Homo Sapiens; identical to SEQ ID NO: 39379

SEQ ID NO: 134864 - RNA, 64 nt, Homo Sapiens; identical to SEQ ID NO: 39380

SEQ ID NO: 134865 - RNA, 64 nt, Homo Sapiens; identical to SEQ ID NO: 39381

SEQ ID NO: 134866 - RNA, 64 nt, Homo Sapiens; identical to SEQ ID NO: 39382

SEQ ID NO: 134867 - RNA, 64 nt, Homo Sapiens; identical to SEQ ID NO: 39383

SEQ ID NO: 134868 - RNA, 64 nt, Homo Sapiens; identical to SEQ ID NO: 39384

SEQ ID NO: 134869 - RNA, 64 nt, Homo Sapiens; identical to SEQ ID NO: 39385

SEQ ID NO: 134870 - RNA, 64 nt, Homo Sapiens; identical to SEQ ID NO: 39386

SEQ ID NO: 134871 - RNA, 64 nt, Homo Sapiens; identical to SEQ ID NO: 39387

SEQ ID NO: 134872 - RNA, 64 nt, Homo Sapiens; identical to SEQ ID NO: 39388

SEQ ID NO: 134873 - RNA, 64 nt, Homo Sapiens; identical to SEQ ID NO: 39389

SEQ ID NO: 134874 - RNA, 64 nt, Homo Sapiens; identical to SEQ ID NO: 39390

SEQ ID NO: 134875 - RNA, 64 nt, Homo Sapiens; identical to SEQ ID NO: 39391

SEQ ID NO: 134876 - RNA, 64 nt, Homo Sapiens; identical to SEQ ID NO: 39392

SEQ ID NO: 134877 - RNA, 64 nt, Homo Sapiens; identical to SEQ ID NO: 39393

SEQ ID NO: 134878 - RNA, 64 nt, Homo Sapiens; identical to SEQ ID NO: 39394

SEQ ID NO: 134879 - RNA, 64 nt, Homo Sapiens; identical to SEQ ID NO: 39395

SEQ ID NO: 134880 - RNA, 64 nt, Homo Sapiens; identical to SEQ ID NO: 39396

SEQ ID NO: 134881 - RNA, 64 nt, Homo Sapiens; identical to SEQ ID NO: 39397

SEQ ID NO: 134882 - RNA, 64 nt, Homo Sapiens; identical to SEQ ID NO: 39398

SEQ ID NO: 134883 - RNA, 64 nt, Homo Sapiens; identical to SEQ ID NO: 39399

SEQ ID NO: 134884 - RNA, 64 nt, Homo Sapiens; identical to SEQ ID NO: 39400

SEQ ID NO: 134885 - RNA, 64 nt, Homo Sapiens; identical to SEQ ID NO: 39401

SEQ ID NO: 134886 - RNA, 64 nt, Homo Sapiens; identical to SEQ ID NO: 39402

SEQ ID NO: 134887 - RNA, 64 nt, Homo Sapiens; identical to SEQ ID NO: 39403

SEQ ID NO: 134888 - RNA, 64 nt, Homo Sapiens; identical to SEQ ID NO: 39404

SEQ ID NO: 134889 - RNA, 64 nt, Homo Sapiens; identical to SEQ ID NO: 39405

SEQ ID NO: 134890 - RNA, 64 nt, Homo Sapiens; identical to SEQ ID NO: 39406

SEQ ID NO: 134891 - RNA, 64 nt, Homo Sapiens; identical to SEQ ID NO: 39407

SEQ ID NO: 134892 - RNA, 64 nt, Homo Sapiens; identical to SEQ ID NO: 39408

SEQ ID NO: 134893 - RNA, 64 nt, Homo Sapiens; identical to SEQ ID NO: 39409

SEQ ID NO: 134894 - RNA, 64 nt, Homo Sapiens; identical to SEQ ID NO: 39410

SEQ ID NO: 134895 - RNA, 64 nt, Homo Sapiens; identical to SEQ ID NO: 39411

SEQ ID NO: 134896 - RNA, 64 nt, Homo Sapiens; identical to SEQ ID NO: 39412

SEQ ID NO: 134897 - RNA, 64 nt, Homo Sapiens; identical to SEQ ID NO: 39413

SEQ ID NO: 134898 - RNA, 64 nt, Homo Sapiens; identical to SEQ ID NO: 39414

SEQ ID NO: 134899 - RNA, 64 nt, Homo Sapiens; identical to SEQ ID NO: 39415

SEQ ID NO: 134900 - RNA, 64 nt, Homo Sapiens; identical to SEQ ID NO: 39416

SEQ ID NO: 134901 - RNA, 64 nt, Homo Sapiens; identical to SEQ ID NO: 39417

SEQ ID NO: 134902 - RNA, 64 nt, Homo Sapiens; identical to SEQ ID NO: 39418

SEQ ID NO: 134903 - RNA, 64 nt, Homo Sapiens; identical to SEQ ID NO: 39419

SEQ ID NO: 134904 - RNA, 64 nt, Homo Sapiens; identical to SEQ ID NO: 39420

SEQ ID NO: 134905 - RNA, 64 nt, Homo Sapiens; identical to SEQ ID NO: 39421

SEQ ID NO: 134906 - RNA, 64 nt, Homo Sapiens; identical to SEQ ID NO: 39422

SEQ ID NO: 134907 - RNA, 64 nt, Homo Sapiens; identical to SEQ ID NO: 39423

SEQ ID NO: 134908 - RNA, 64 nt, Homo Sapiens; identical to SEQ ID NO: 39424

SEQ ID NO: 134909 - RNA, 64 nt, Homo Sapiens; identical to SEQ ID NO: 39425

SEQ ID NO: 134910 - RNA, 64 nt, Homo Sapiens; identical to SEQ ID NO: 39426

SEQ ID NO: 134911 - RNA, 64 nt, Homo Sapiens; identical to SEQ ID NO: 39427

SEQ ID NO: 134912 - RNA, 64 nt, Homo Sapiens; identical to SEQ ID NO: 39428

SEQ ID NO: 134913 - RNA, 64 nt, Homo Sapiens; identical to SEQ ID NO: 39429

SEQ ID NO: 134914 - RNA, 64 nt, Homo Sapiens; identical to SEQ ID NO: 39430

SEQ ID NO: 134915 - RNA, 64 nt, Homo Sapiens; identical to SEQ ID NO: 39431

SEQ ID NO: 134916 - RNA, 64 nt, Homo Sapiens; identical to SEQ ID NO: 39432

SEQ ID NO: 134917 - RNA, 64 nt, Homo Sapiens; identical to SEQ ID NO: 39433

SEQ ID NO: 134918 - RNA, 64 nt, Homo Sapiens; identical to SEQ ID NO: 39434

SEQ ID NO: 134919 - RNA, 64 nt, Homo Sapiens; identical to SEQ ID NO: 39435

SEQ ID NO: 134920 - RNA, 64 nt, Homo Sapiens; identical to SEQ ID NO: 39436

SEQ ID NO: 134921 - RNA, 64 nt, Homo Sapiens; identical to SEQ ID NO: 39437

SEQ ID NO: 134922 - RNA, 64 nt, Homo Sapiens; identical to SEQ ID NO: 39438

SEQ ID NO: 134923 - RNA, 64 nt, Homo Sapiens; identical to SEQ ID NO: 39439

SEQ ID NO: 134924 - RNA, 64 nt, Homo Sapiens; identical to SEQ ID NO: 39440

SEQ ID NO: 134925 - RNA, 64 nt, Homo Sapiens; identical to SEQ ID NO: 39441

SEQ ID NO: 134926 - RNA, 64 nt, Homo Sapiens; identical to SEQ ID NO: 39442

SEQ ID NO: 134927 - RNA, 64 nt, Homo Sapiens; identical to SEQ ID NO: 39443

SEQ ID NO: 134928 - RNA, 64 nt, Homo Sapiens; identical to SEQ ID NO: 39444

SEQ ID NO: 134929 - RNA, 64 nt, Homo Sapiens; identical to SEQ ID NO: 39445

SEQ ID NO: 134930 - RNA, 64 nt, Homo Sapiens; identical to SEQ ID NO: 39446

SEQ ID NO: 134931 - RNA, 64 nt, Homo Sapiens; identical to SEQ ID NO: 39447

SEQ ID NO: 134932 - RNA, 64 nt, Homo Sapiens; identical to SEQ ID NO: 39448

SEQ ID NO: 134933 - RNA, 64 nt, Homo Sapiens; identical to SEQ ID NO: 39449

SEQ ID NO: 134934 - RNA, 64 nt, Homo Sapiens; identical to SEQ ID NO: 39450

SEQ ID NO: 134935 - RNA, 64 nt, Homo Sapiens; identical to SEQ ID NO: 39451

SEQ ID NO: 134936 - RNA, 64 nt, Homo Sapiens; identical to SEQ ID NO: 39452

SEQ ID NO: 134937 - RNA, 64 nt, Homo Sapiens; identical to SEQ ID NO: 39453

SEQ ID NO: 134938 - RNA, 64 nt, Homo Sapiens; identical to SEQ ID NO: 39454

SEQ ID NO: 134939 - RNA, 64 nt, Homo Sapiens; identical to SEQ ID NO: 39455

SEQ ID NO: 134940 - RNA, 64 nt, Homo Sapiens; identical to SEQ ID NO: 39456

SEQ ID NO: 134941 - RNA, 64 nt, Homo Sapiens; identical to SEQ ID NO: 39457

SEQ ID NO: 134942 - RNA, 64 nt, Homo Sapiens; identical to SEQ ID NO: 39458

SEQ ID NO: 134943 - RNA, 64 nt, Homo Sapiens; identical to SEQ ID NO: 39459

SEQ ID NO: 134944 - RNA, 64 nt, Homo Sapiens; identical to SEQ ID NO: 39460

SEQ ID NO: 134945 - RNA, 64 nt, Homo Sapiens; identical to SEQ ID NO: 39461

SEQ ID NO: 134946 - RNA, 64 nt, Homo Sapiens; identical to SEQ ID NO: 39462

SEQ ID NO: 134947 - RNA, 64 nt, Homo Sapiens; identical to SEQ ID NO: 39463

SEQ ID NO: 134948 - RNA, 64 nt, Homo Sapiens; identical to SEQ ID NO: 39464

SEQ ID NO: 134949 - RNA, 64 nt, Homo Sapiens; identical to SEQ ID NO: 39465

SEQ ID NO: 134950 - RNA, 64 nt, Homo Sapiens; identical to SEQ ID NO: 39466

SEQ ID NO: 134951 - RNA, 64 nt, Homo Sapiens; identical to SEQ ID NO: 39467

SEQ ID NO: 134952 - RNA, 64 nt, Homo Sapiens; identical to SEQ ID NO: 39468

SEQ ID NO: 134953 - RNA, 64 nt, Homo Sapiens; identical to SEQ ID NO: 39469

SEQ ID NO: 134954 - RNA, 64 nt, Homo Sapiens; identical to SEQ ID NO: 39470

SEQ ID NO: 134955 - RNA, 64 nt, Homo Sapiens; identical to SEQ ID NO: 39471

SEQ ID NO: 134956 - RNA, 64 nt, Homo Sapiens; identical to SEQ ID NO: 39472

SEQ ID NO: 134957 - RNA, 64 nt, Homo Sapiens; identical to SEQ ID NO: 39473

SEQ ID NO: 134958 - RNA, 64 nt, Homo Sapiens; identical to SEQ ID NO: 39474

SEQ ID NO: 134959 - RNA, 64 nt, Homo Sapiens; identical to SEQ ID NO: 39475

SEQ ID NO: 134960 - RNA, 64 nt, Homo Sapiens; identical to SEQ ID NO: 39476

SEQ ID NO: 134961 - RNA, 64 nt, Homo Sapiens; identical to SEQ ID NO: 39477

SEQ ID NO: 134962 - RNA, 64 nt, Homo Sapiens; identical to SEQ ID NO: 39478

SEQ ID NO: 134963 - RNA, 64 nt, Homo Sapiens; identical to SEQ ID NO: 39479

SEQ ID NO: 134964 - RNA, 64 nt, Homo Sapiens; identical to SEQ ID NO: 39480

SEQ ID NO: 134965 - RNA, 64 nt, Homo Sapiens; identical to SEQ ID NO: 39481

SEQ ID NO: 134966 - RNA, 64 nt, Homo Sapiens; identical to SEQ ID NO: 39482

SEQ ID NO: 134967 - RNA, 64 nt, Homo Sapiens; identical to SEQ ID NO: 39483

SEQ ID NO: 134968 - RNA, 64 nt, Homo Sapiens; identical to SEQ ID NO: 39484

SEQ ID NO: 134969 - RNA, 64 nt, Homo Sapiens; identical to SEQ ID NO: 39485

SEQ ID NO: 134970 - RNA, 64 nt, Homo Sapiens; identical to SEQ ID NO: 39486

SEQ ID NO: 134971 - RNA, 64 nt, Homo Sapiens; identical to SEQ ID NO: 39487

SEQ ID NO: 134972 - RNA, 64 nt, Homo Sapiens; identical to SEQ ID NO: 39488

SEQ ID NO: 134973 - RNA, 64 nt, Homo Sapiens; identical to SEQ ID NO: 39489

SEQ ID NO: 134974 - RNA, 64 nt, Homo Sapiens; identical to SEQ ID NO: 39490

SEQ ID NO: 134975 - RNA, 64 nt, Homo Sapiens; identical to SEQ ID NO: 39491

SEQ ID NO: 134976 - RNA, 64 nt, Homo Sapiens; identical to SEQ ID NO: 39492

SEQ ID NO: 134977 - RNA, 64 nt, Homo Sapiens; identical to SEQ ID NO: 39493

SEQ ID NO: 134978 - RNA, 64 nt, Homo Sapiens; identical to SEQ ID NO: 39494

SEQ ID NO: 134979 - RNA, 64 nt, Homo Sapiens; identical to SEQ ID NO: 39495

SEQ ID NO: 134980 - RNA, 64 nt, Homo Sapiens; identical to SEQ ID NO: 39496

SEQ ID NO: 134981 - RNA, 64 nt, Homo Sapiens; identical to SEQ ID NO: 39497

SEQ ID NO: 134982 - RNA, 64 nt, Homo Sapiens; identical to SEQ ID NO: 39498

SEQ ID NO: 134983 - RNA, 64 nt, Homo Sapiens; identical to SEQ ID NO: 39499

SEQ ID NO: 134984 - RNA, 64 nt, Homo Sapiens; identical to SEQ ID NO: 39500

SEQ ID NO: 134985 - RNA, 64 nt, Homo Sapiens; identical to SEQ ID NO: 39501

SEQ ID NO: 134986 - RNA, 64 nt, Homo Sapiens; identical to SEQ ID NO: 39502

SEQ ID NO: 134987 - RNA, 64 nt, Homo Sapiens; identical to SEQ ID NO: 39503

SEQ ID NO: 134988 - RNA, 64 nt, Homo Sapiens; identical to SEQ ID NO: 39504

SEQ ID NO: 134989 - RNA, 64 nt, Homo Sapiens; identical to SEQ ID NO: 39505

SEQ ID NO: 134990 - RNA, 64 nt, Homo Sapiens; identical to SEQ ID NO: 39506

SEQ ID NO: 134991 - RNA, 64 nt, Homo Sapiens; identical to SEQ ID NO: 39507

SEQ ID NO: 134992 - RNA, 64 nt, Homo Sapiens; identical to SEQ ID NO: 39508

SEQ ID NO: 134993 - RNA, 64 nt, Homo Sapiens; identical to SEQ ID NO: 39509

SEQ ID NO: 134994 - RNA, 64 nt, Homo Sapiens; identical to SEQ ID NO: 39510

SEQ ID NO: 134995 - RNA, 64 nt, Homo Sapiens; identical to SEQ ID NO: 39511

SEQ ID NO: 134996 - RNA, 64 nt, Homo Sapiens; identical to SEQ ID NO: 39512

SEQ ID NO: 134997 - RNA, 64 nt, Homo Sapiens; identical to SEQ ID NO: 39513

SEQ ID NO: 134998 - RNA, 64 nt, Homo Sapiens; identical to SEQ ID NO: 39514

SEQ ID NO: 134999 - RNA, 64 nt, Homo Sapiens; identical to SEQ ID NO: 39515

SEQ ID NO: 135000 - RNA, 64 nt, Homo Sapiens; identical to SEQ ID NO: 39516

SEQ ID NO: 135001 - RNA, 64 nt, Homo Sapiens; identical to SEQ ID NO: 39517

SEQ ID NO: 135002 - RNA, 64 nt, Homo Sapiens; identical to SEQ ID NO: 39518

SEQ ID NO: 135003 - RNA, 64 nt, Homo Sapiens; identical to SEQ ID NO: 39519

SEQ ID NO: 135004 - RNA, 64 nt, Homo Sapiens; identical to SEQ ID NO: 39520

SEQ ID NO: 135005 - RNA, 64 nt, Homo Sapiens; identical to SEQ ID NO: 39521

SEQ ID NO: 135006 - RNA, 64 nt, Homo Sapiens; identical to SEQ ID NO: 39522

SEQ ID NO: 135007 - RNA, 64 nt, Homo Sapiens; identical to SEQ ID NO: 39523

SEQ ID NO: 135008 - RNA, 64 nt, Homo Sapiens; identical to SEQ ID NO: 39524

SEQ ID NO: 135009 - RNA, 64 nt, Homo Sapiens; identical to SEQ ID NO: 39525

SEQ ID NO: 135010 - RNA, 64 nt, Homo Sapiens; identical to SEQ ID NO: 39526

SEQ ID NO: 135011 - RNA, 64 nt, Homo Sapiens; identical to SEQ ID NO: 39527

SEQ ID NO: 135012 - RNA, 64 nt, Homo Sapiens; identical to SEQ ID NO: 39528

SEQ ID NO: 135013 - RNA, 64 nt, Homo Sapiens; identical to SEQ ID NO: 39529

SEQ ID NO: 135014 - RNA, 64 nt, Homo Sapiens; identical to SEQ ID NO: 39530

SEQ ID NO: 135015 - RNA, 64 nt, Homo Sapiens; identical to SEQ ID NO: 39531

SEQ ID NO: 135016 - RNA, 64 nt, Homo Sapiens; identical to SEQ ID NO: 39532

SEQ ID NO: 135017 - RNA, 64 nt, Homo Sapiens; identical to SEQ ID NO: 39533

SEQ ID NO: 135018 - RNA, 64 nt, Homo Sapiens; identical to SEQ ID NO: 39534

SEQ ID NO: 135019 - RNA, 64 nt, Homo Sapiens; identical to SEQ ID NO: 39535

SEQ ID NO: 135020 - RNA, 64 nt, Homo Sapiens; identical to SEQ ID NO: 39536

SEQ ID NO: 135021 - RNA, 64 nt, Homo Sapiens; identical to SEQ ID NO: 39537

SEQ ID NO: 135022 - RNA, 64 nt, Homo Sapiens; identical to SEQ ID NO: 39538

SEQ ID NO: 135023 - RNA, 64 nt, Homo Sapiens; identical to SEQ ID NO: 39539

SEQ ID NO: 135024 - RNA, 64 nt, Homo Sapiens; identical to SEQ ID NO: 39540

SEQ ID NO: 135025 - RNA, 64 nt, Homo Sapiens; identical to SEQ ID NO: 39541

SEQ ID NO: 135026 - RNA, 64 nt, Homo Sapiens; identical to SEQ ID NO: 39542

SEQ ID NO: 135027 - RNA, 64 nt, Homo Sapiens; identical to SEQ ID NO: 39543

SEQ ID NO: 135028 - RNA, 64 nt, Homo Sapiens; identical to SEQ ID NO: 39544

SEQ ID NO: 135029 - RNA, 64 nt, Homo Sapiens; identical to SEQ ID NO: 39545

SEQ ID NO: 135030 - RNA, 64 nt, Homo Sapiens; identical to SEQ ID NO: 39546

SEQ ID NO: 135031 - RNA, 64 nt, Homo Sapiens; identical to SEQ ID NO: 39547

SEQ ID NO: 135032 - RNA, 64 nt, Homo Sapiens; identical to SEQ ID NO: 39548

SEQ ID NO: 135033 - RNA, 64 nt, Homo Sapiens; identical to SEQ ID NO: 39549

SEQ ID NO: 135034 - RNA, 64 nt, Homo Sapiens; identical to SEQ ID NO: 39550

SEQ ID NO: 135035 - RNA, 64 nt, Homo Sapiens; identical to SEQ ID NO: 39551

SEQ ID NO: 135036 - RNA, 64 nt, Homo Sapiens; identical to SEQ ID NO: 39552

SEQ ID NO: 135037 - RNA, 64 nt, Homo Sapiens; identical to SEQ ID NO: 39553

SEQ ID NO: 135038 - RNA, 64 nt, Homo Sapiens; identical to SEQ ID NO: 39554

SEQ ID NO: 135039 - RNA, 64 nt, Homo Sapiens; identical to SEQ ID NO: 39555

SEQ ID NO: 135040 - RNA, 64 nt, Homo Sapiens; identical to SEQ ID NO: 39556

SEQ ID NO: 135041 - RNA, 64 nt, Homo Sapiens; identical to SEQ ID NO: 39557

SEQ ID NO: 135042 - RNA, 64 nt, Homo Sapiens; identical to SEQ ID NO: 39558

SEQ ID NO: 135043 - RNA, 64 nt, Homo Sapiens; identical to SEQ ID NO: 39559

SEQ ID NO: 135044 - RNA, 64 nt, Homo Sapiens; identical to SEQ ID NO: 39560

SEQ ID NO: 135045 - RNA, 64 nt, Homo Sapiens; identical to SEQ ID NO: 39561

SEQ ID NO: 135046 - RNA, 64 nt, Homo Sapiens; identical to SEQ ID NO: 39562

SEQ ID NO: 135047 - RNA, 64 nt, Homo Sapiens; identical to SEQ ID NO: 39563

SEQ ID NO: 135048 - RNA, 64 nt, Homo Sapiens; identical to SEQ ID NO: 39564

SEQ ID NO: 135049 - RNA, 64 nt, Homo Sapiens; identical to SEQ ID NO: 39565

SEQ ID NO: 135050 - RNA, 64 nt, Homo Sapiens; identical to SEQ ID NO: 39566

SEQ ID NO: 135051 - RNA, 64 nt, Homo Sapiens; identical to SEQ ID NO: 39567

SEQ ID NO: 135052 - RNA, 64 nt, Homo Sapiens; identical to SEQ ID NO: 39568

SEQ ID NO: 135053 - RNA, 64 nt, Homo Sapiens; identical to SEQ ID NO: 39569

SEQ ID NO: 135054 - RNA, 64 nt, Homo Sapiens; identical to SEQ ID NO: 39570

SEQ ID NO: 135055 - RNA, 64 nt, Homo Sapiens; identical to SEQ ID NO: 39571

SEQ ID NO: 135056 - RNA, 64 nt, Homo Sapiens; identical to SEQ ID NO: 39572

SEQ ID NO: 135057 - RNA, 64 nt, Homo Sapiens; identical to SEQ ID NO: 39573

SEQ ID NO: 135058 - RNA, 64 nt, Homo Sapiens; identical to SEQ ID NO: 39574

SEQ ID NO: 135059 - RNA, 64 nt, Homo Sapiens; identical to SEQ ID NO: 39575

SEQ ID NO: 135060 - RNA, 64 nt, Homo Sapiens; identical to SEQ ID NO: 39576

SEQ ID NO: 135061 - RNA, 64 nt, Homo Sapiens; identical to SEQ ID NO: 39577

SEQ ID NO: 135062 - RNA, 64 nt, Homo Sapiens; identical to SEQ ID NO: 39578

SEQ ID NO: 135063 - RNA, 64 nt, Homo Sapiens; identical to SEQ ID NO: 39579

SEQ ID NO: 135064 - RNA, 64 nt, Homo Sapiens; identical to SEQ ID NO: 39580

SEQ ID NO: 135065 - RNA, 64 nt, Homo Sapiens; identical to SEQ ID NO: 39581

SEQ ID NO: 135066 - RNA, 64 nt, Homo Sapiens; identical to SEQ ID NO: 39582

SEQ ID NO: 135067 - RNA, 64 nt, Homo Sapiens; identical to SEQ ID NO: 39583

SEQ ID NO: 135068 - RNA, 64 nt, Homo Sapiens; identical to SEQ ID NO: 39584

SEQ ID NO: 135069 - RNA, 64 nt, Homo Sapiens; identical to SEQ ID NO: 39585

SEQ ID NO: 135070 - RNA, 64 nt, Homo Sapiens; identical to SEQ ID NO: 39586

SEQ ID NO: 135071 - RNA, 64 nt, Homo Sapiens; identical to SEQ ID NO: 39587

SEQ ID NO: 135072 - RNA, 64 nt, Homo Sapiens; identical to SEQ ID NO: 39588

SEQ ID NO: 135073 - RNA, 64 nt, Homo Sapiens; identical to SEQ ID NO: 39589

SEQ ID NO: 135074 - RNA, 64 nt, Homo Sapiens; identical to SEQ ID NO: 39590

SEQ ID NO: 135075 - RNA, 64 nt, Homo Sapiens; identical to SEQ ID NO: 39591

SEQ ID NO: 135076 - RNA, 64 nt, Homo Sapiens; identical to SEQ ID NO: 39592

SEQ ID NO: 135077 - RNA, 64 nt, Homo Sapiens; identical to SEQ ID NO: 39593

SEQ ID NO: 135078 - RNA, 64 nt, Homo Sapiens; identical to SEQ ID NO: 39594

SEQ ID NO: 135079 - RNA, 64 nt, Homo Sapiens; identical to SEQ ID NO: 39595

SEQ ID NO: 135080 - RNA, 64 nt, Homo Sapiens; identical to SEQ ID NO: 39596

SEQ ID NO: 135081 - RNA, 64 nt, Homo Sapiens; identical to SEQ ID NO: 39597

SEQ ID NO: 135082 - RNA, 64 nt, Homo Sapiens; identical to SEQ ID NO: 39598

SEQ ID NO: 135083 - RNA, 64 nt, Homo Sapiens; identical to SEQ ID NO: 39599

SEQ ID NO: 135084 - RNA, 64 nt, Homo Sapiens; identical to SEQ ID NO: 39600

SEQ ID NO: 135085 - RNA, 64 nt, Homo Sapiens; identical to SEQ ID NO: 39601

SEQ ID NO: 135086 - RNA, 64 nt, Homo Sapiens; identical to SEQ ID NO: 39602

SEQ ID NO: 135087 - RNA, 64 nt, Homo Sapiens; identical to SEQ ID NO: 39603

SEQ ID NO: 135088 - RNA, 64 nt, Homo Sapiens; identical to SEQ ID NO: 39604

SEQ ID NO: 135089 - RNA, 64 nt, Homo Sapiens; identical to SEQ ID NO: 39605

SEQ ID NO: 135090 - RNA, 64 nt, Homo Sapiens; identical to SEQ ID NO: 39606

SEQ ID NO: 135091 - RNA, 64 nt, Homo Sapiens; identical to SEQ ID NO: 39607

SEQ ID NO: 135092 - RNA, 64 nt, Homo Sapiens; identical to SEQ ID NO: 39608

SEQ ID NO: 135093 - RNA, 64 nt, Homo Sapiens; identical to SEQ ID NO: 39609

SEQ ID NO: 135094 - RNA, 64 nt, Homo Sapiens; identical to SEQ ID NO: 39610

SEQ ID NO: 135095 - RNA, 64 nt, Homo Sapiens; identical to SEQ ID NO: 39611

SEQ ID NO: 135096 - RNA, 64 nt, Homo Sapiens; identical to SEQ ID NO: 39612

SEQ ID NO: 135097 - RNA, 64 nt, Homo Sapiens; identical to SEQ ID NO: 39613

SEQ ID NO: 135098 - RNA, 64 nt, Homo Sapiens; identical to SEQ ID NO: 39614

SEQ ID NO: 135099 - RNA, 64 nt, Homo Sapiens; identical to SEQ ID NO: 39615

SEQ ID NO: 135100 - RNA, 64 nt, Homo Sapiens; identical to SEQ ID NO: 39616

SEQ ID NO: 135101 - RNA, 64 nt, Homo Sapiens; identical to SEQ ID NO: 39617

SEQ ID NO: 135102 - RNA, 64 nt, Homo Sapiens; identical to SEQ ID NO: 39618

SEQ ID NO: 135103 - RNA, 64 nt, Homo Sapiens; identical to SEQ ID NO: 39619

SEQ ID NO: 135104 - RNA, 64 nt, Homo Sapiens; identical to SEQ ID NO: 39620

SEQ ID NO: 135105 - RNA, 64 nt, Homo Sapiens; identical to SEQ ID NO: 39621

SEQ ID NO: 135106 - RNA, 64 nt, Homo Sapiens; identical to SEQ ID NO: 39622

SEQ ID NO: 135107 - RNA, 64 nt, Homo Sapiens; identical to SEQ ID NO: 39623

SEQ ID NO: 135108 - RNA, 64 nt, Homo Sapiens; identical to SEQ ID NO: 39624

SEQ ID NO: 135109 - RNA, 64 nt, Homo Sapiens; identical to SEQ ID NO: 39625

SEQ ID NO: 135110 - RNA, 64 nt, Homo Sapiens; identical to SEQ ID NO: 39626

SEQ ID NO: 135111 - RNA, 64 nt, Homo Sapiens; identical to SEQ ID NO: 39627

SEQ ID NO: 135112 - RNA, 64 nt, Homo Sapiens; identical to SEQ ID NO: 39628

SEQ ID NO: 135113 - RNA, 64 nt, Homo Sapiens; identical to SEQ ID NO: 39629

SEQ ID NO: 135114 - RNA, 64 nt, Homo Sapiens; identical to SEQ ID NO: 39630

SEQ ID NO: 135115 - RNA, 64 nt, Homo Sapiens; identical to SEQ ID NO: 39631

SEQ ID NO: 135116 - RNA, 64 nt, Homo Sapiens; identical to SEQ ID NO: 39632

SEQ ID NO: 135117 - RNA, 64 nt, Homo Sapiens; identical to SEQ ID NO: 39633

SEQ ID NO: 135118 - RNA, 64 nt, Homo Sapiens; identical to SEQ ID NO: 39634

SEQ ID NO: 135119 - RNA, 64 nt, Homo Sapiens; identical to SEQ ID NO: 39635

SEQ ID NO: 135120 - RNA, 64 nt, Homo Sapiens; identical to SEQ ID NO: 39636

SEQ ID NO: 135121 - RNA, 64 nt, Homo Sapiens; identical to SEQ ID NO: 39637

SEQ ID NO: 135122 - RNA, 64 nt, Homo Sapiens; identical to SEQ ID NO: 39638

SEQ ID NO: 135123 - RNA, 64 nt, Homo Sapiens; identical to SEQ ID NO: 39639

SEQ ID NO: 135124 - RNA, 64 nt, Homo Sapiens; identical to SEQ ID NO: 39640

SEQ ID NO: 135125 - RNA, 64 nt, Homo Sapiens; identical to SEQ ID NO: 39641

SEQ ID NO: 135126 - RNA, 64 nt, Homo Sapiens; identical to SEQ ID NO: 39642

SEQ ID NO: 135127 - RNA, 64 nt, Homo Sapiens; identical to SEQ ID NO: 39643

SEQ ID NO: 135128 - RNA, 64 nt, Homo Sapiens; identical to SEQ ID NO: 39644

SEQ ID NO: 135129 - RNA, 64 nt, Homo Sapiens; identical to SEQ ID NO: 39645

SEQ ID NO: 135130 - RNA, 64 nt, Homo Sapiens; identical to SEQ ID NO: 39646

SEQ ID NO: 135131 - RNA, 64 nt, Homo Sapiens; identical to SEQ ID NO: 39647

SEQ ID NO: 135132 - RNA, 64 nt, Homo Sapiens; identical to SEQ ID NO: 39648

SEQ ID NO: 135133 - RNA, 64 nt, Homo Sapiens; identical to SEQ ID NO: 39649

SEQ ID NO: 135134 - RNA, 64 nt, Homo Sapiens; identical to SEQ ID NO: 39650

SEQ ID NO: 135135 - RNA, 64 nt, Homo Sapiens; identical to SEQ ID NO: 39651

SEQ ID NO: 135136 - RNA, 64 nt, Homo Sapiens; identical to SEQ ID NO: 39652

SEQ ID NO: 135137 - RNA, 64 nt, Homo Sapiens; identical to SEQ ID NO: 39653

SEQ ID NO: 135138 - RNA, 64 nt, Homo Sapiens; identical to SEQ ID NO: 39654

SEQ ID NO: 135139 - RNA, 64 nt, Homo Sapiens; identical to SEQ ID NO: 39655

SEQ ID NO: 135140 - RNA, 64 nt, Homo Sapiens; identical to SEQ ID NO: 39656

SEQ ID NO: 135141 - RNA, 64 nt, Homo Sapiens; identical to SEQ ID NO: 39657

SEQ ID NO: 135142 - RNA, 64 nt, Homo Sapiens; identical to SEQ ID NO: 39658

SEQ ID NO: 135143 - RNA, 64 nt, Homo Sapiens; identical to SEQ ID NO: 39659

SEQ ID NO: 135144 - RNA, 64 nt, Homo Sapiens; identical to SEQ ID NO: 39660

SEQ ID NO: 135145 - RNA, 64 nt, Homo Sapiens; identical to SEQ ID NO: 39661

SEQ ID NO: 135146 - RNA, 64 nt, Homo Sapiens; identical to SEQ ID NO: 39662

SEQ ID NO: 135147 - RNA, 64 nt, Homo Sapiens; identical to SEQ ID NO: 39663

SEQ ID NO: 135148 - RNA, 64 nt, Homo Sapiens; identical to SEQ ID NO: 39664

SEQ ID NO: 135149 - RNA, 64 nt, Homo Sapiens; identical to SEQ ID NO: 39665

SEQ ID NO: 135150 - RNA, 64 nt, Homo Sapiens; identical to SEQ ID NO: 39666

SEQ ID NO: 135151 - RNA, 64 nt, Homo Sapiens; identical to SEQ ID NO: 39667

SEQ ID NO: 135152 - RNA, 64 nt, Homo Sapiens; identical to SEQ ID NO: 39668

SEQ ID NO: 135153 - RNA, 64 nt, Homo Sapiens; identical to SEQ ID NO: 39669

SEQ ID NO: 135154 - RNA, 64 nt, Homo Sapiens; identical to SEQ ID NO: 39670

SEQ ID NO: 135155 - RNA, 64 nt, Homo Sapiens; identical to SEQ ID NO: 39671

SEQ ID NO: 135156 - RNA, 64 nt, Homo Sapiens; identical to SEQ ID NO: 39672

SEQ ID NO: 135157 - RNA, 64 nt, Homo Sapiens; identical to SEQ ID NO: 39673

SEQ ID NO: 135158 - RNA, 64 nt, Homo Sapiens; identical to SEQ ID NO: 39674

SEQ ID NO: 135159 - RNA, 64 nt, Homo Sapiens; identical to SEQ ID NO: 39675

SEQ ID NO: 135160 - RNA, 64 nt, Homo Sapiens; identical to SEQ ID NO: 39676

SEQ ID NO: 135161 - RNA, 64 nt, Homo Sapiens; identical to SEQ ID NO: 39677

SEQ ID NO: 135162 - RNA, 64 nt, Homo Sapiens; identical to SEQ ID NO: 39678

SEQ ID NO: 135163 - RNA, 64 nt, Homo Sapiens; identical to SEQ ID NO: 39679

SEQ ID NO: 135164 - RNA, 64 nt, Homo Sapiens; identical to SEQ ID NO: 39680

SEQ ID NO: 135165 - RNA, 64 nt, Homo Sapiens; identical to SEQ ID NO: 39681

SEQ ID NO: 135166 - RNA, 64 nt, Homo Sapiens; identical to SEQ ID NO: 39682

SEQ ID NO: 135167 - RNA, 64 nt, Homo Sapiens; identical to SEQ ID NO: 39683

SEQ ID NO: 135168 - RNA, 64 nt, Homo Sapiens; identical to SEQ ID NO: 39684

SEQ ID NO: 135169 - RNA, 64 nt, Homo Sapiens; identical to SEQ ID NO: 39685

SEQ ID NO: 135170 - RNA, 64 nt, Homo Sapiens; identical to SEQ ID NO: 39686

SEQ ID NO: 135171 - RNA, 64 nt, Homo Sapiens; identical to SEQ ID NO: 39687

SEQ ID NO: 135172 - RNA, 64 nt, Homo Sapiens; identical to SEQ ID NO: 39688

SEQ ID NO: 135173 - RNA, 64 nt, Homo Sapiens; identical to SEQ ID NO: 39689

SEQ ID NO: 135174 - RNA, 64 nt, Homo Sapiens; identical to SEQ ID NO: 39690

SEQ ID NO: 135175 - RNA, 64 nt, Homo Sapiens; identical to SEQ ID NO: 39691

SEQ ID NO: 135176 - RNA, 64 nt, Homo Sapiens; identical to SEQ ID NO: 39692

SEQ ID NO: 135177 - RNA, 64 nt, Homo Sapiens; identical to SEQ ID NO: 39693

SEQ ID NO: 135178 - RNA, 64 nt, Homo Sapiens; identical to SEQ ID NO: 39694

SEQ ID NO: 135179 - RNA, 64 nt, Homo Sapiens; identical to SEQ ID NO: 39695

SEQ ID NO: 135180 - RNA, 64 nt, Homo Sapiens; identical to SEQ ID NO: 39696

SEQ ID NO: 135181 - RNA, 64 nt, Homo Sapiens; identical to SEQ ID NO: 39697

SEQ ID NO: 135182 - RNA, 64 nt, Homo Sapiens; identical to SEQ ID NO: 39698

SEQ ID NO: 135183 - RNA, 64 nt, Homo Sapiens; identical to SEQ ID NO: 39699

SEQ ID NO: 135184 - RNA, 64 nt, Homo Sapiens; identical to SEQ ID NO: 39700

SEQ ID NO: 135185 - RNA, 64 nt, Homo Sapiens; identical to SEQ ID NO: 39701

SEQ ID NO: 135186 - RNA, 64 nt, Homo Sapiens; identical to SEQ ID NO: 39702

SEQ ID NO: 135187 - RNA, 64 nt, Homo Sapiens; identical to SEQ ID NO: 39703

SEQ ID NO: 135188 - RNA, 64 nt, Homo Sapiens; identical to SEQ ID NO: 39704

SEQ ID NO: 135189 - RNA, 64 nt, Homo Sapiens; identical to SEQ ID NO: 39705

SEQ ID NO: 135190 - RNA, 64 nt, Homo Sapiens; identical to SEQ ID NO: 39706

SEQ ID NO: 135191 - RNA, 64 nt, Homo Sapiens; identical to SEQ ID NO: 39707

SEQ ID NO: 135192 - RNA, 64 nt, Homo Sapiens; identical to SEQ ID NO: 39708

SEQ ID NO: 135193 - RNA, 64 nt, Homo Sapiens; identical to SEQ ID NO: 39709

SEQ ID NO: 135194 - RNA, 64 nt, Homo Sapiens; identical to SEQ ID NO: 39710

SEQ ID NO: 135195 - RNA, 64 nt, Homo Sapiens; identical to SEQ ID NO: 39711

SEQ ID NO: 135196 - RNA, 64 nt, Homo Sapiens; identical to SEQ ID NO: 39712

SEQ ID NO: 135197 - RNA, 64 nt, Homo Sapiens; identical to SEQ ID NO: 39713

SEQ ID NO: 135198 - RNA, 64 nt, Homo Sapiens; identical to SEQ ID NO: 39714

SEQ ID NO: 135199 - RNA, 64 nt, Homo Sapiens; identical to SEQ ID NO: 39715

SEQ ID NO: 135200 - RNA, 64 nt, Homo Sapiens; identical to SEQ ID NO: 39716

SEQ ID NO: 135201 - RNA, 64 nt, Homo Sapiens; identical to SEQ ID NO: 39717

SEQ ID NO: 135202 - RNA, 64 nt, Homo Sapiens; identical to SEQ ID NO: 39718

SEQ ID NO: 135203 - RNA, 64 nt, Homo Sapiens; identical to SEQ ID NO: 39719

SEQ ID NO: 135204 - RNA, 64 nt, Homo Sapiens; identical to SEQ ID NO: 39720

SEQ ID NO: 135205 - RNA, 64 nt, Homo Sapiens; identical to SEQ ID NO: 39721

SEQ ID NO: 135206 - RNA, 64 nt, Homo Sapiens; identical to SEQ ID NO: 39722

SEQ ID NO: 135207 - RNA, 64 nt, Homo Sapiens; identical to SEQ ID NO: 39723

SEQ ID NO: 135208 - RNA, 64 nt, Homo Sapiens; identical to SEQ ID NO: 39724

SEQ ID NO: 135209 - RNA, 64 nt, Homo Sapiens; identical to SEQ ID NO: 39725

SEQ ID NO: 135210 - RNA, 64 nt, Homo Sapiens; identical to SEQ ID NO: 39726

SEQ ID NO: 135211 - RNA, 64 nt, Homo Sapiens; identical to SEQ ID NO: 39727

SEQ ID NO: 135212 - RNA, 64 nt, Homo Sapiens; identical to SEQ ID NO: 39728

SEQ ID NO: 135213 - RNA, 64 nt, Homo Sapiens; identical to SEQ ID NO: 39729

SEQ ID NO: 135214 - RNA, 64 nt, Homo Sapiens; identical to SEQ ID NO: 39730

SEQ ID NO: 135215 - RNA, 64 nt, Homo Sapiens; identical to SEQ ID NO: 39731

SEQ ID NO: 135216 - RNA, 64 nt, Homo Sapiens; identical to SEQ ID NO: 39732

SEQ ID NO: 135217 - RNA, 64 nt, Homo Sapiens; identical to SEQ ID NO: 39733

SEQ ID NO: 135218 - RNA, 64 nt, Homo Sapiens; identical to SEQ ID NO: 39734

SEQ ID NO: 135219 - RNA, 64 nt, Homo Sapiens; identical to SEQ ID NO: 39735

SEQ ID NO: 135220 - RNA, 64 nt, Homo Sapiens; identical to SEQ ID NO: 39736

SEQ ID NO: 135221 - RNA, 64 nt, Homo Sapiens; identical to SEQ ID NO: 39737

SEQ ID NO: 135222 - RNA, 64 nt, Homo Sapiens; identical to SEQ ID NO: 39738

SEQ ID NO: 135223 - RNA, 64 nt, Homo Sapiens; identical to SEQ ID NO: 39739

SEQ ID NO: 135224 - RNA, 64 nt, Homo Sapiens; identical to SEQ ID NO: 39740

SEQ ID NO: 135225 - RNA, 64 nt, Homo Sapiens; identical to SEQ ID NO: 39741

SEQ ID NO: 135226 - RNA, 64 nt, Homo Sapiens; identical to SEQ ID NO: 39742

SEQ ID NO: 135227 - RNA, 64 nt, Homo Sapiens; identical to SEQ ID NO: 39743

SEQ ID NO: 135228 - RNA, 64 nt, Homo Sapiens; identical to SEQ ID NO: 39744

SEQ ID NO: 135229 - RNA, 64 nt, Homo Sapiens; identical to SEQ ID NO: 39745

SEQ ID NO: 135230 - RNA, 64 nt, Homo Sapiens; identical to SEQ ID NO: 39746

SEQ ID NO: 135231 - RNA, 64 nt, Homo Sapiens; identical to SEQ ID NO: 39747

SEQ ID NO: 135232 - RNA, 64 nt, Homo Sapiens; identical to SEQ ID NO: 39748

SEQ ID NO: 135233 - RNA, 64 nt, Homo Sapiens; identical to SEQ ID NO: 39749

SEQ ID NO: 135234 - RNA, 64 nt, Homo Sapiens; identical to SEQ ID NO: 39750

SEQ ID NO: 135235 - RNA, 64 nt, Homo Sapiens; identical to SEQ ID NO: 39751

SEQ ID NO: 135236 - RNA, 64 nt, Homo Sapiens; identical to SEQ ID NO: 39752

SEQ ID NO: 135237 - RNA, 64 nt, Homo Sapiens; identical to SEQ ID NO: 39753

SEQ ID NO: 135238 - RNA, 64 nt, Homo Sapiens; identical to SEQ ID NO: 39754

SEQ ID NO: 135239 - RNA, 64 nt, Homo Sapiens; identical to SEQ ID NO: 39755

SEQ ID NO: 135240 - RNA, 64 nt, Homo Sapiens; identical to SEQ ID NO: 39756

SEQ ID NO: 135241 - RNA, 64 nt, Homo Sapiens; identical to SEQ ID NO: 39757

SEQ ID NO: 135242 - RNA, 64 nt, Homo Sapiens; identical to SEQ ID NO: 39758

SEQ ID NO: 135243 - RNA, 64 nt, Homo Sapiens; identical to SEQ ID NO: 39759

SEQ ID NO: 135244 - RNA, 64 nt, Homo Sapiens; identical to SEQ ID NO: 39760

SEQ ID NO: 135245 - RNA, 64 nt, Homo Sapiens; identical to SEQ ID NO: 39761

SEQ ID NO: 135246 - RNA, 64 nt, Homo Sapiens; identical to SEQ ID NO: 39762

SEQ ID NO: 135247 - RNA, 64 nt, Homo Sapiens; identical to SEQ ID NO: 39763

SEQ ID NO: 135248 - RNA, 64 nt, Homo Sapiens; identical to SEQ ID NO: 39764

SEQ ID NO: 135249 - RNA, 64 nt, Homo Sapiens; identical to SEQ ID NO: 39765

SEQ ID NO: 135250 - RNA, 64 nt, Homo Sapiens; identical to SEQ ID NO: 39766

SEQ ID NO: 135251 - RNA, 64 nt, Homo Sapiens; identical to SEQ ID NO: 39767

SEQ ID NO: 135252 - RNA, 64 nt, Homo Sapiens; identical to SEQ ID NO: 39768

SEQ ID NO: 135253 - RNA, 64 nt, Homo Sapiens; identical to SEQ ID NO: 39769

SEQ ID NO: 135254 - RNA, 64 nt, Homo Sapiens; identical to SEQ ID NO: 39770

SEQ ID NO: 135255 - RNA, 64 nt, Homo Sapiens; identical to SEQ ID NO: 39771

SEQ ID NO: 135256 - RNA, 64 nt, Homo Sapiens; identical to SEQ ID NO: 39772

SEQ ID NO: 135257 - RNA, 64 nt, Homo Sapiens; identical to SEQ ID NO: 39773

SEQ ID NO: 135258 - RNA, 64 nt, Homo Sapiens; identical to SEQ ID NO: 39774

SEQ ID NO: 135259 - RNA, 64 nt, Homo Sapiens; identical to SEQ ID NO: 39775

SEQ ID NO: 135260 - RNA, 64 nt, Homo Sapiens; identical to SEQ ID NO: 39776

SEQ ID NO: 135261 - RNA, 64 nt, Homo Sapiens; identical to SEQ ID NO: 39777

SEQ ID NO: 135262 - RNA, 64 nt, Homo Sapiens; identical to SEQ ID NO: 39778

SEQ ID NO: 135263 - RNA, 64 nt, Homo Sapiens; identical to SEQ ID NO: 39779

SEQ ID NO: 135264 - RNA, 64 nt, Homo Sapiens; identical to SEQ ID NO: 39780

SEQ ID NO: 135265 - RNA, 64 nt, Homo Sapiens; identical to SEQ ID NO: 39781

SEQ ID NO: 135266 - RNA, 64 nt, Homo Sapiens; identical to SEQ ID NO: 39782

SEQ ID NO: 135267 - RNA, 64 nt, Homo Sapiens; identical to SEQ ID NO: 39783

SEQ ID NO: 135268 - RNA, 64 nt, Homo Sapiens; identical to SEQ ID NO: 39784

SEQ ID NO: 135269 - RNA, 64 nt, Homo Sapiens; identical to SEQ ID NO: 39785

SEQ ID NO: 135270 - RNA, 64 nt, Homo Sapiens; identical to SEQ ID NO: 39786

SEQ ID NO: 135271 - RNA, 64 nt, Homo Sapiens; identical to SEQ ID NO: 39787

SEQ ID NO: 135272 - RNA, 64 nt, Homo Sapiens; identical to SEQ ID NO: 39788

SEQ ID NO: 135273 - RNA, 64 nt, Homo Sapiens; identical to SEQ ID NO: 39789

SEQ ID NO: 135274 - RNA, 64 nt, Homo Sapiens; identical to SEQ ID NO: 39790

SEQ ID NO: 135275 - RNA, 64 nt, Homo Sapiens; identical to SEQ ID NO: 39791

SEQ ID NO: 135276 - RNA, 64 nt, Homo Sapiens; identical to SEQ ID NO: 39792

SEQ ID NO: 135277 - RNA, 64 nt, Homo Sapiens; identical to SEQ ID NO: 39793

SEQ ID NO: 135278 - RNA, 64 nt, Homo Sapiens; identical to SEQ ID NO: 39794

SEQ ID NO: 135279 - RNA, 64 nt, Homo Sapiens; identical to SEQ ID NO: 39795

SEQ ID NO: 135280 - RNA, 64 nt, Homo Sapiens; identical to SEQ ID NO: 39796

SEQ ID NO: 135281 - RNA, 64 nt, Homo Sapiens; identical to SEQ ID NO: 39797

SEQ ID NO: 135282 - RNA, 64 nt, Homo Sapiens; identical to SEQ ID NO: 39798

SEQ ID NO: 135283 - RNA, 64 nt, Homo Sapiens; identical to SEQ ID NO: 39799

SEQ ID NO: 135284 - RNA, 64 nt, Homo Sapiens; identical to SEQ ID NO: 39800

SEQ ID NO: 135285 - RNA, 64 nt, Homo Sapiens; identical to SEQ ID NO: 39801

SEQ ID NO: 135286 - RNA, 64 nt, Homo Sapiens; identical to SEQ ID NO: 39802

SEQ ID NO: 135287 - RNA, 64 nt, Homo Sapiens; identical to SEQ ID NO: 39803

SEQ ID NO: 135288 - RNA, 64 nt, Homo Sapiens; identical to SEQ ID NO: 39804

SEQ ID NO: 135289 - RNA, 64 nt, Homo Sapiens; identical to SEQ ID NO: 39805

SEQ ID NO: 135290 - RNA, 64 nt, Homo Sapiens; identical to SEQ ID NO: 39806

SEQ ID NO: 135291 - RNA, 64 nt, Homo Sapiens; identical to SEQ ID NO: 39807

SEQ ID NO: 135292 - RNA, 64 nt, Homo Sapiens; identical to SEQ ID NO: 39808

SEQ ID NO: 135293 - RNA, 64 nt, Homo Sapiens; identical to SEQ ID NO: 39809

SEQ ID NO: 135294 - RNA, 64 nt, Homo Sapiens; identical to SEQ ID NO: 39810

SEQ ID NO: 135295 - RNA, 64 nt, Homo Sapiens; identical to SEQ ID NO: 39811

SEQ ID NO: 135296 - RNA, 64 nt, Homo Sapiens; identical to SEQ ID NO: 39812

SEQ ID NO: 135297 - RNA, 64 nt, Homo Sapiens; identical to SEQ ID NO: 39813

SEQ ID NO: 135298 - RNA, 64 nt, Homo Sapiens; identical to SEQ ID NO: 39814

SEQ ID NO: 135299 - RNA, 64 nt, Homo Sapiens; identical to SEQ ID NO: 39815

SEQ ID NO: 135300 - RNA, 64 nt, Homo Sapiens; identical to SEQ ID NO: 39816

SEQ ID NO: 135301 - RNA, 64 nt, Homo Sapiens; identical to SEQ ID NO: 39817

SEQ ID NO: 135302 - RNA, 64 nt, Homo Sapiens; identical to SEQ ID NO: 39818

SEQ ID NO: 135303 - RNA, 64 nt, Homo Sapiens; identical to SEQ ID NO: 39819

SEQ ID NO: 135304 - RNA, 64 nt, Homo Sapiens; identical to SEQ ID NO: 39820

SEQ ID NO: 135305 - RNA, 64 nt, Homo Sapiens; identical to SEQ ID NO: 39821

SEQ ID NO: 135306 - RNA, 64 nt, Homo Sapiens; identical to SEQ ID NO: 39822

SEQ ID NO: 135307 - RNA, 64 nt, Homo Sapiens; identical to SEQ ID NO: 39823

SEQ ID NO: 135308 - RNA, 64 nt, Homo Sapiens; identical to SEQ ID NO: 39824

SEQ ID NO: 135309 - RNA, 64 nt, Homo Sapiens; identical to SEQ ID NO: 39825

SEQ ID NO: 135310 - RNA, 64 nt, Homo Sapiens; identical to SEQ ID NO: 39826

SEQ ID NO: 135311 - RNA, 64 nt, Homo Sapiens; identical to SEQ ID NO: 39827

SEQ ID NO: 135312 - RNA, 64 nt, Homo Sapiens; identical to SEQ ID NO: 39828

SEQ ID NO: 135313 - RNA, 64 nt, Homo Sapiens; identical to SEQ ID NO: 39829

SEQ ID NO: 135314 - RNA, 64 nt, Homo Sapiens; identical to SEQ ID NO: 39830

SEQ ID NO: 135315 - RNA, 64 nt, Homo Sapiens; identical to SEQ ID NO: 39831

SEQ ID NO: 135316 - RNA, 64 nt, Homo Sapiens; identical to SEQ ID NO: 39832

SEQ ID NO: 135317 - RNA, 64 nt, Homo Sapiens; identical to SEQ ID NO: 39833

SEQ ID NO: 135318 - RNA, 64 nt, Homo Sapiens; identical to SEQ ID NO: 39834

SEQ ID NO: 135319 - RNA, 64 nt, Homo Sapiens; identical to SEQ ID NO: 39835

SEQ ID NO: 135320 - RNA, 64 nt, Homo Sapiens; identical to SEQ ID NO: 39836

SEQ ID NO: 135321 - RNA, 64 nt, Homo Sapiens; identical to SEQ ID NO: 39837

SEQ ID NO: 135322 - RNA, 64 nt, Homo Sapiens; identical to SEQ ID NO: 39838

SEQ ID NO: 135323 - RNA, 64 nt, Homo Sapiens; identical to SEQ ID NO: 39839

SEQ ID NO: 135324 - RNA, 64 nt, Homo Sapiens; identical to SEQ ID NO: 39840

SEQ ID NO: 135325 - RNA, 64 nt, Homo Sapiens; identical to SEQ ID NO: 39841

SEQ ID NO: 135326 - RNA, 64 nt, Homo Sapiens; identical to SEQ ID NO: 39842

SEQ ID NO: 135327 - RNA, 64 nt, Homo Sapiens; identical to SEQ ID NO: 39843

SEQ ID NO: 135328 - RNA, 64 nt, Homo Sapiens; identical to SEQ ID NO: 39844

SEQ ID NO: 135329 - RNA, 64 nt, Homo Sapiens; identical to SEQ ID NO: 39845

SEQ ID NO: 135330 - RNA, 64 nt, Homo Sapiens; identical to SEQ ID NO: 39846

SEQ ID NO: 135331 - RNA, 64 nt, Homo Sapiens; identical to SEQ ID NO: 39847

SEQ ID NO: 135332 - RNA, 64 nt, Homo Sapiens; identical to SEQ ID NO: 39848

SEQ ID NO: 135333 - RNA, 64 nt, Homo Sapiens; identical to SEQ ID NO: 39849

SEQ ID NO: 135334 - RNA, 64 nt, Homo Sapiens; identical to SEQ ID NO: 39850

SEQ ID NO: 135335 - RNA, 64 nt, Homo Sapiens; identical to SEQ ID NO: 39851

SEQ ID NO: 135336 - RNA, 64 nt, Homo Sapiens; identical to SEQ ID NO: 39852

SEQ ID NO: 135337 - RNA, 64 nt, Homo Sapiens; identical to SEQ ID NO: 39853

SEQ ID NO: 135338 - RNA, 64 nt, Homo Sapiens; identical to SEQ ID NO: 39854

SEQ ID NO: 135339 - RNA, 64 nt, Homo Sapiens; identical to SEQ ID NO: 39855

SEQ ID NO: 135340 - RNA, 64 nt, Homo Sapiens; identical to SEQ ID NO: 39856

SEQ ID NO: 135341 - RNA, 64 nt, Homo Sapiens; identical to SEQ ID NO: 39857

SEQ ID NO: 135342 - RNA, 64 nt, Homo Sapiens; identical to SEQ ID NO: 39858

SEQ ID NO: 135343 - RNA, 64 nt, Homo Sapiens; identical to SEQ ID NO: 39859

SEQ ID NO: 135344 - RNA, 64 nt, Homo Sapiens; identical to SEQ ID NO: 39860

SEQ ID NO: 135345 - RNA, 64 nt, Homo Sapiens; identical to SEQ ID NO: 39861

SEQ ID NO: 135346 - RNA, 64 nt, Homo Sapiens; identical to SEQ ID NO: 39862

SEQ ID NO: 135347 - RNA, 64 nt, Homo Sapiens; identical to SEQ ID NO: 39863

SEQ ID NO: 135348 - RNA, 64 nt, Homo Sapiens; identical to SEQ ID NO: 39864

SEQ ID NO: 135349 - RNA, 64 nt, Homo Sapiens; identical to SEQ ID NO: 39865

SEQ ID NO: 135350 - RNA, 64 nt, Homo Sapiens; identical to SEQ ID NO: 39866

SEQ ID NO: 135351 - RNA, 64 nt, Homo Sapiens; identical to SEQ ID NO: 39867

SEQ ID NO: 135352 - RNA, 64 nt, Homo Sapiens; identical to SEQ ID NO: 39868

SEQ ID NO: 135353 - RNA, 64 nt, Homo Sapiens; identical to SEQ ID NO: 39869

SEQ ID NO: 135354 - RNA, 64 nt, Homo Sapiens; identical to SEQ ID NO: 39870

SEQ ID NO: 135355 - RNA, 64 nt, Homo Sapiens; identical to SEQ ID NO: 39871

SEQ ID NO: 135356 - RNA, 64 nt, Homo Sapiens; identical to SEQ ID NO: 39872

SEQ ID NO: 135357 - RNA, 64 nt, Homo Sapiens; identical to SEQ ID NO: 39873

SEQ ID NO: 135358 - RNA, 64 nt, Homo Sapiens; identical to SEQ ID NO: 39874

SEQ ID NO: 135359 - RNA, 64 nt, Homo Sapiens; identical to SEQ ID NO: 39875

SEQ ID NO: 135360 - RNA, 64 nt, Homo Sapiens; identical to SEQ ID NO: 39876

SEQ ID NO: 135361 - RNA, 64 nt, Homo Sapiens; identical to SEQ ID NO: 39877

SEQ ID NO: 135362 - RNA, 64 nt, Homo Sapiens; identical to SEQ ID NO: 39878

SEQ ID NO: 135363 - RNA, 64 nt, Homo Sapiens; identical to SEQ ID NO: 39879

SEQ ID NO: 135364 - RNA, 64 nt, Homo Sapiens; identical to SEQ ID NO: 39880

SEQ ID NO: 135365 - RNA, 64 nt, Homo Sapiens; identical to SEQ ID NO: 39881

SEQ ID NO: 135366 - RNA, 64 nt, Homo Sapiens; identical to SEQ ID NO: 39882

SEQ ID NO: 135367 - RNA, 64 nt, Homo Sapiens; identical to SEQ ID NO: 39883

SEQ ID NO: 135368 - RNA, 64 nt, Homo Sapiens; identical to SEQ ID NO: 39884

SEQ ID NO: 135369 - RNA, 64 nt, Homo Sapiens; identical to SEQ ID NO: 39885

SEQ ID NO: 135370 - RNA, 64 nt, Homo Sapiens; identical to SEQ ID NO: 39886

SEQ ID NO: 135371 - RNA, 64 nt, Homo Sapiens; identical to SEQ ID NO: 39887

SEQ ID NO: 135372 - RNA, 64 nt, Homo Sapiens; identical to SEQ ID NO: 39888

SEQ ID NO: 135373 - RNA, 64 nt, Homo Sapiens; identical to SEQ ID NO: 39889

SEQ ID NO: 135374 - RNA, 64 nt, Homo Sapiens; identical to SEQ ID NO: 39890

SEQ ID NO: 135375 - RNA, 64 nt, Homo Sapiens; identical to SEQ ID NO: 39891

SEQ ID NO: 135376 - RNA, 64 nt, Homo Sapiens; identical to SEQ ID NO: 39892

SEQ ID NO: 135377 - RNA, 64 nt, Homo Sapiens; identical to SEQ ID NO: 39893

SEQ ID NO: 135378 - RNA, 64 nt, Homo Sapiens; identical to SEQ ID NO: 39894

SEQ ID NO: 135379 - RNA, 64 nt, Homo Sapiens; identical to SEQ ID NO: 39895

SEQ ID NO: 135380 - RNA, 64 nt, Homo Sapiens; identical to SEQ ID NO: 39896

SEQ ID NO: 135381 - RNA, 64 nt, Homo Sapiens; identical to SEQ ID NO: 39897

SEQ ID NO: 135382 - RNA, 64 nt, Homo Sapiens; identical to SEQ ID NO: 39898

SEQ ID NO: 135383 - RNA, 64 nt, Homo Sapiens; identical to SEQ ID NO: 39899

SEQ ID NO: 135384 - RNA, 64 nt, Homo Sapiens; identical to SEQ ID NO: 39900

SEQ ID NO: 135385 - RNA, 64 nt, Homo Sapiens; identical to SEQ ID NO: 39901

SEQ ID NO: 135386 - RNA, 64 nt, Homo Sapiens; identical to SEQ ID NO: 39902

SEQ ID NO: 135387 - RNA, 64 nt, Homo Sapiens; identical to SEQ ID NO: 39903

SEQ ID NO: 135388 - RNA, 64 nt, Homo Sapiens; identical to SEQ ID NO: 39904

SEQ ID NO: 135389 - RNA, 64 nt, Homo Sapiens; identical to SEQ ID NO: 39905

SEQ ID NO: 135390 - RNA, 64 nt, Homo Sapiens; identical to SEQ ID NO: 39906

SEQ ID NO: 135391 - RNA, 64 nt, Homo Sapiens; identical to SEQ ID NO: 39907

SEQ ID NO: 135392 - RNA, 64 nt, Homo Sapiens; identical to SEQ ID NO: 39908

SEQ ID NO: 135393 - RNA, 64 nt, Homo Sapiens; identical to SEQ ID NO: 39909

SEQ ID NO: 135394 - RNA, 64 nt, Homo Sapiens; identical to SEQ ID NO: 39910

SEQ ID NO: 135395 - RNA, 64 nt, Homo Sapiens; identical to SEQ ID NO: 39911

SEQ ID NO: 135396 - RNA, 64 nt, Homo Sapiens; identical to SEQ ID NO: 39912

SEQ ID NO: 135397 - RNA, 64 nt, Homo Sapiens; identical to SEQ ID NO: 39913

SEQ ID NO: 135398 - RNA, 64 nt, Homo Sapiens; identical to SEQ ID NO: 39914

SEQ ID NO: 135399 - RNA, 64 nt, Homo Sapiens; identical to SEQ ID NO: 39915

SEQ ID NO: 135400 - RNA, 64 nt, Homo Sapiens; identical to SEQ ID NO: 39916

SEQ ID NO: 135401 - RNA, 64 nt, Homo Sapiens; identical to SEQ ID NO: 39917

SEQ ID NO: 135402 - RNA, 64 nt, Homo Sapiens; identical to SEQ ID NO: 39918

SEQ ID NO: 135403 - RNA, 64 nt, Homo Sapiens; identical to SEQ ID NO: 39919

SEQ ID NO: 135404 - RNA, 64 nt, Homo Sapiens; identical to SEQ ID NO: 39920

SEQ ID NO: 135405 - RNA, 64 nt, Homo Sapiens; identical to SEQ ID NO: 39921

SEQ ID NO: 135406 - RNA, 64 nt, Homo Sapiens; identical to SEQ ID NO: 39922

SEQ ID NO: 135407 - RNA, 64 nt, Homo Sapiens; identical to SEQ ID NO: 39923

SEQ ID NO: 135408 - RNA, 64 nt, Homo Sapiens; identical to SEQ ID NO: 39924

SEQ ID NO: 135409 - RNA, 64 nt, Homo Sapiens; identical to SEQ ID NO: 39925

SEQ ID NO: 135410 - RNA, 64 nt, Homo Sapiens; identical to SEQ ID NO: 39926

SEQ ID NO: 135411 - RNA, 64 nt, Homo Sapiens; identical to SEQ ID NO: 39927

SEQ ID NO: 135412 - RNA, 64 nt, Homo Sapiens; identical to SEQ ID NO: 39928

SEQ ID NO: 135413 - RNA, 64 nt, Homo Sapiens; identical to SEQ ID NO: 39929

SEQ ID NO: 135414 - RNA, 64 nt, Homo Sapiens; identical to SEQ ID NO: 39930

SEQ ID NO: 135415 - RNA, 64 nt, Homo Sapiens; identical to SEQ ID NO: 39931

SEQ ID NO: 135416 - RNA, 64 nt, Homo Sapiens; identical to SEQ ID NO: 39932

SEQ ID NO: 135417 - RNA, 64 nt, Homo Sapiens; identical to SEQ ID NO: 39933

SEQ ID NO: 135418 - RNA, 64 nt, Homo Sapiens; identical to SEQ ID NO: 39934

SEQ ID NO: 135419 - RNA, 64 nt, Homo Sapiens; identical to SEQ ID NO: 39935

SEQ ID NO: 135420 - RNA, 64 nt, Homo Sapiens; identical to SEQ ID NO: 39936

SEQ ID NO: 135421 - RNA, 64 nt, Homo Sapiens; identical to SEQ ID NO: 39937

SEQ ID NO: 135422 - RNA, 64 nt, Homo Sapiens; identical to SEQ ID NO: 39938

SEQ ID NO: 135423 - RNA, 64 nt, Homo Sapiens; identical to SEQ ID NO: 39939

SEQ ID NO: 135424 - RNA, 64 nt, Homo Sapiens; identical to SEQ ID NO: 39940

SEQ ID NO: 135425 - RNA, 64 nt, Homo Sapiens; identical to SEQ ID NO: 39941

SEQ ID NO: 135426 - RNA, 64 nt, Homo Sapiens; identical to SEQ ID NO: 39942

SEQ ID NO: 135427 - RNA, 64 nt, Homo Sapiens; identical to SEQ ID NO: 39943

SEQ ID NO: 135428 - RNA, 64 nt, Homo Sapiens; identical to SEQ ID NO: 39944

SEQ ID NO: 135429 - RNA, 64 nt, Homo Sapiens; identical to SEQ ID NO: 39945

SEQ ID NO: 135430 - RNA, 64 nt, Homo Sapiens; identical to SEQ ID NO: 39946

SEQ ID NO: 135431 - RNA, 64 nt, Homo Sapiens; identical to SEQ ID NO: 39947

SEQ ID NO: 135432 - RNA, 64 nt, Homo Sapiens; identical to SEQ ID NO: 39948

SEQ ID NO: 135433 - RNA, 64 nt, Homo Sapiens; identical to SEQ ID NO: 39949

SEQ ID NO: 135434 - RNA, 64 nt, Homo Sapiens; identical to SEQ ID NO: 39950

SEQ ID NO: 135435 - RNA, 64 nt, Homo Sapiens; identical to SEQ ID NO: 39951

SEQ ID NO: 135436 - RNA, 64 nt, Homo Sapiens; identical to SEQ ID NO: 39952

SEQ ID NO: 135437 - RNA, 64 nt, Homo Sapiens; identical to SEQ ID NO: 39953

SEQ ID NO: 135438 - RNA, 64 nt, Homo Sapiens; identical to SEQ ID NO: 39954

SEQ ID NO: 135439 - RNA, 64 nt, Homo Sapiens; identical to SEQ ID NO: 39955

SEQ ID NO: 135440 - RNA, 64 nt, Homo Sapiens; identical to SEQ ID NO: 39956

SEQ ID NO: 135441 - RNA, 64 nt, Homo Sapiens; identical to SEQ ID NO: 39957

SEQ ID NO: 135442 - RNA, 64 nt, Homo Sapiens; identical to SEQ ID NO: 39958

SEQ ID NO: 135443 - RNA, 64 nt, Homo Sapiens; identical to SEQ ID NO: 39959

SEQ ID NO: 135444 - RNA, 64 nt, Homo Sapiens; identical to SEQ ID NO: 39960

SEQ ID NO: 135445 - RNA, 64 nt, Homo Sapiens; identical to SEQ ID NO: 39961

SEQ ID NO: 135446 - RNA, 64 nt, Homo Sapiens; identical to SEQ ID NO: 39962

SEQ ID NO: 135447 - RNA, 64 nt, Homo Sapiens; identical to SEQ ID NO: 39963

SEQ ID NO: 135448 - RNA, 64 nt, Homo Sapiens; identical to SEQ ID NO: 39964

SEQ ID NO: 135449 - RNA, 64 nt, Homo Sapiens; identical to SEQ ID NO: 39965

SEQ ID NO: 135450 - RNA, 64 nt, Homo Sapiens; identical to SEQ ID NO: 39966

SEQ ID NO: 135451 - RNA, 64 nt, Homo Sapiens; identical to SEQ ID NO: 39967

SEQ ID NO: 135452 - RNA, 64 nt, Homo Sapiens; identical to SEQ ID NO: 39968

SEQ ID NO: 135453 - RNA, 64 nt, Homo Sapiens; identical to SEQ ID NO: 39969

SEQ ID NO: 135454 - RNA, 64 nt, Homo Sapiens; identical to SEQ ID NO: 39970

SEQ ID NO: 135455 - RNA, 64 nt, Homo Sapiens; identical to SEQ ID NO: 39971

SEQ ID NO: 135456 - RNA, 64 nt, Homo Sapiens; identical to SEQ ID NO: 39972

SEQ ID NO: 135457 - RNA, 64 nt, Homo Sapiens; identical to SEQ ID NO: 39973

SEQ ID NO: 135458 - RNA, 64 nt, Homo Sapiens; identical to SEQ ID NO: 39974

SEQ ID NO: 135459 - RNA, 64 nt, Homo Sapiens; identical to SEQ ID NO: 39975

SEQ ID NO: 135460 - RNA, 64 nt, Homo Sapiens; identical to SEQ ID NO: 39976

SEQ ID NO: 135461 - RNA, 64 nt, Homo Sapiens; identical to SEQ ID NO: 39977

SEQ ID NO: 135462 - RNA, 64 nt, Homo Sapiens; identical to SEQ ID NO: 39978

SEQ ID NO: 135463 - RNA, 64 nt, Homo Sapiens; identical to SEQ ID NO: 39979

SEQ ID NO: 135464 - RNA, 64 nt, Homo Sapiens; identical to SEQ ID NO: 39980

SEQ ID NO: 135465 - RNA, 64 nt, Homo Sapiens; identical to SEQ ID NO: 39981

SEQ ID NO: 135466 - RNA, 64 nt, Homo Sapiens; identical to SEQ ID NO: 39982

SEQ ID NO: 135467 - RNA, 64 nt, Homo Sapiens; identical to SEQ ID NO: 39983

SEQ ID NO: 135468 - RNA, 64 nt, Homo Sapiens; identical to SEQ ID NO: 39984

SEQ ID NO: 135469 - RNA, 64 nt, Homo Sapiens; identical to SEQ ID NO: 39985

SEQ ID NO: 135470 - RNA, 64 nt, Homo Sapiens; identical to SEQ ID NO: 39986

SEQ ID NO: 135471 - RNA, 64 nt, Homo Sapiens; identical to SEQ ID NO: 39987

SEQ ID NO: 135472 - RNA, 64 nt, Homo Sapiens; identical to SEQ ID NO: 39988

SEQ ID NO: 135473 - RNA, 64 nt, Homo Sapiens; identical to SEQ ID NO: 39989

SEQ ID NO: 135474 - RNA, 64 nt, Homo Sapiens; identical to SEQ ID NO: 39990

SEQ ID NO: 135475 - RNA, 64 nt, Homo Sapiens; identical to SEQ ID NO: 39991

SEQ ID NO: 135476 - RNA, 64 nt, Homo Sapiens; identical to SEQ ID NO: 39992

SEQ ID NO: 135477 - RNA, 64 nt, Homo Sapiens; identical to SEQ ID NO: 39993

SEQ ID NO: 135478 - RNA, 64 nt, Homo Sapiens; identical to SEQ ID NO: 39994

SEQ ID NO: 135479 - RNA, 64 nt, Homo Sapiens; identical to SEQ ID NO: 39995

SEQ ID NO: 135480 - RNA, 64 nt, Homo Sapiens; identical to SEQ ID NO: 39996

SEQ ID NO: 135481 - RNA, 64 nt, Homo Sapiens; identical to SEQ ID NO: 39997

SEQ ID NO: 135482 - RNA, 64 nt, Homo Sapiens; identical to SEQ ID NO: 39998

SEQ ID NO: 135483 - RNA, 64 nt, Homo Sapiens; identical to SEQ ID NO: 39999

SEQ ID NO: 135484 - RNA, 64 nt, Homo Sapiens; identical to SEQ ID NO: 40000

SEQ ID NO: 135485 - RNA, 64 nt, Homo Sapiens; identical to SEQ ID NO: 40001

SEQ ID NO: 135486 - RNA, 64 nt, Homo Sapiens; identical to SEQ ID NO: 40002

SEQ ID NO: 135487 - RNA, 64 nt, Homo Sapiens; identical to SEQ ID NO: 40003

SEQ ID NO: 135488 - RNA, 64 nt, Homo Sapiens; identical to SEQ ID NO: 40004

SEQ ID NO: 135489 - RNA, 64 nt, Homo Sapiens; identical to SEQ ID NO: 40005

SEQ ID NO: 135490 - RNA, 64 nt, Homo Sapiens; identical to SEQ ID NO: 40006

SEQ ID NO: 135491 - RNA, 64 nt, Homo Sapiens; identical to SEQ ID NO: 40007

SEQ ID NO: 135492 - RNA, 64 nt, Homo Sapiens; identical to SEQ ID NO: 40008

SEQ ID NO: 135493 - RNA, 64 nt, Homo Sapiens; identical to SEQ ID NO: 40009

SEQ ID NO: 135494 - RNA, 64 nt, Homo Sapiens; identical to SEQ ID NO: 40010

SEQ ID NO: 135495 - RNA, 64 nt, Homo Sapiens; identical to SEQ ID NO: 40011

SEQ ID NO: 135496 - RNA, 64 nt, Homo Sapiens; identical to SEQ ID NO: 40012

SEQ ID NO: 135497 - RNA, 64 nt, Homo Sapiens; identical to SEQ ID NO: 40013

SEQ ID NO: 135498 - RNA, 64 nt, Homo Sapiens; identical to SEQ ID NO: 40014

SEQ ID NO: 135499 - RNA, 64 nt, Homo Sapiens; identical to SEQ ID NO: 40015

SEQ ID NO: 135500 - RNA, 64 nt, Homo Sapiens; identical to SEQ ID NO: 40016

SEQ ID NO: 135501 - RNA, 64 nt, Homo Sapiens; identical to SEQ ID NO: 40017

SEQ ID NO: 135502 - RNA, 64 nt, Homo Sapiens; identical to SEQ ID NO: 40018

SEQ ID NO: 135503 - RNA, 64 nt, Homo Sapiens; identical to SEQ ID NO: 40019

SEQ ID NO: 135504 - RNA, 64 nt, Homo Sapiens; identical to SEQ ID NO: 40020

SEQ ID NO: 135505 - RNA, 64 nt, Homo Sapiens; identical to SEQ ID NO: 40021

SEQ ID NO: 135506 - RNA, 64 nt, Homo Sapiens; identical to SEQ ID NO: 40022

SEQ ID NO: 135507 - RNA, 64 nt, Homo Sapiens; identical to SEQ ID NO: 40023

SEQ ID NO: 135508 - RNA, 64 nt, Homo Sapiens; identical to SEQ ID NO: 40024

SEQ ID NO: 135509 - RNA, 64 nt, Homo Sapiens; identical to SEQ ID NO: 40025

SEQ ID NO: 135510 - RNA, 64 nt, Homo Sapiens; identical to SEQ ID NO: 40026

SEQ ID NO: 135511 - RNA, 64 nt, Homo Sapiens; identical to SEQ ID NO: 40027

SEQ ID NO: 135512 - RNA, 64 nt, Homo Sapiens; identical to SEQ ID NO: 40028

SEQ ID NO: 135513 - RNA, 64 nt, Homo Sapiens; identical to SEQ ID NO: 40029

SEQ ID NO: 135514 - RNA, 64 nt, Homo Sapiens; identical to SEQ ID NO: 40030

SEQ ID NO: 135515 - RNA, 64 nt, Homo Sapiens; identical to SEQ ID NO: 40031

SEQ ID NO: 135516 - RNA, 64 nt, Homo Sapiens; identical to SEQ ID NO: 40032

SEQ ID NO: 135517 - RNA, 64 nt, Homo Sapiens; identical to SEQ ID NO: 40033

SEQ ID NO: 135518 - RNA, 64 nt, Homo Sapiens; identical to SEQ ID NO: 40034

SEQ ID NO: 135519 - RNA, 64 nt, Homo Sapiens; identical to SEQ ID NO: 40035

SEQ ID NO: 135520 - RNA, 64 nt, Homo Sapiens; identical to SEQ ID NO: 40036

SEQ ID NO: 135521 - RNA, 64 nt, Homo Sapiens; identical to SEQ ID NO: 40037

SEQ ID NO: 135522 - RNA, 64 nt, Homo Sapiens; identical to SEQ ID NO: 40038

SEQ ID NO: 135523 - RNA, 64 nt, Homo Sapiens; identical to SEQ ID NO: 40039

SEQ ID NO: 135524 - RNA, 64 nt, Homo Sapiens; identical to SEQ ID NO: 40040

SEQ ID NO: 135525 - RNA, 64 nt, Homo Sapiens; identical to SEQ ID NO: 40041

SEQ ID NO: 135526 - RNA, 64 nt, Homo Sapiens; identical to SEQ ID NO: 40042

SEQ ID NO: 135527 - RNA, 64 nt, Homo Sapiens; identical to SEQ ID NO: 40043

SEQ ID NO: 135528 - RNA, 64 nt, Homo Sapiens; identical to SEQ ID NO: 40044

SEQ ID NO: 135529 - RNA, 64 nt, Homo Sapiens; identical to SEQ ID NO: 40045

SEQ ID NO: 135530 - RNA, 64 nt, Homo Sapiens; identical to SEQ ID NO: 40046

SEQ ID NO: 135531 - RNA, 64 nt, Homo Sapiens; identical to SEQ ID NO: 40047

SEQ ID NO: 135532 - RNA, 64 nt, Homo Sapiens; identical to SEQ ID NO: 40048

SEQ ID NO: 135533 - RNA, 64 nt, Homo Sapiens; identical to SEQ ID NO: 40049

SEQ ID NO: 135534 - RNA, 64 nt, Homo Sapiens; identical to SEQ ID NO: 40050

SEQ ID NO: 135535 - RNA, 64 nt, Homo Sapiens; identical to SEQ ID NO: 40051

SEQ ID NO: 135536 - RNA, 64 nt, Homo Sapiens; identical to SEQ ID NO: 40052

SEQ ID NO: 135537 - RNA, 64 nt, Homo Sapiens; identical to SEQ ID NO: 40053

SEQ ID NO: 135538 - RNA, 64 nt, Homo Sapiens; identical to SEQ ID NO: 40054

SEQ ID NO: 135539 - RNA, 64 nt, Homo Sapiens; identical to SEQ ID NO: 40055

SEQ ID NO: 135540 - RNA, 64 nt, Homo Sapiens; identical to SEQ ID NO: 40056

SEQ ID NO: 135541 - RNA, 64 nt, Homo Sapiens; identical to SEQ ID NO: 40057

SEQ ID NO: 135542 - RNA, 64 nt, Homo Sapiens; identical to SEQ ID NO: 40058

SEQ ID NO: 135543 - RNA, 64 nt, Homo Sapiens; identical to SEQ ID NO: 40059

SEQ ID NO: 135544 - RNA, 64 nt, Homo Sapiens; identical to SEQ ID NO: 40060

SEQ ID NO: 135545 - RNA, 64 nt, Homo Sapiens; identical to SEQ ID NO: 40061

SEQ ID NO: 135546 - RNA, 64 nt, Homo Sapiens; identical to SEQ ID NO: 40062

SEQ ID NO: 135547 - RNA, 64 nt, Homo Sapiens; identical to SEQ ID NO: 40063

SEQ ID NO: 135548 - RNA, 64 nt, Homo Sapiens; identical to SEQ ID NO: 40064

SEQ ID NO: 135549 - RNA, 64 nt, Homo Sapiens; identical to SEQ ID NO: 40065

SEQ ID NO: 135550 - RNA, 64 nt, Homo Sapiens; identical to SEQ ID NO: 40066

SEQ ID NO: 135551 - RNA, 64 nt, Homo Sapiens; identical to SEQ ID NO: 40067

SEQ ID NO: 135552 - RNA, 64 nt, Homo Sapiens; identical to SEQ ID NO: 40068

SEQ ID NO: 135553 - RNA, 64 nt, Homo Sapiens; identical to SEQ ID NO: 40069

SEQ ID NO: 135554 - RNA, 64 nt, Homo Sapiens; identical to SEQ ID NO: 40070

SEQ ID NO: 135555 - RNA, 64 nt, Homo Sapiens; identical to SEQ ID NO: 40071

SEQ ID NO: 135556 - RNA, 64 nt, Homo Sapiens; identical to SEQ ID NO: 40072

SEQ ID NO: 135557 - RNA, 64 nt, Homo Sapiens; identical to SEQ ID NO: 40073

SEQ ID NO: 135558 - RNA, 64 nt, Homo Sapiens; identical to SEQ ID NO: 40074

SEQ ID NO: 135559 - RNA, 64 nt, Homo Sapiens; identical to SEQ ID NO: 40075

SEQ ID NO: 135560 - RNA, 64 nt, Homo Sapiens; identical to SEQ ID NO: 40076

SEQ ID NO: 135561 - RNA, 64 nt, Homo Sapiens; identical to SEQ ID NO: 40077

SEQ ID NO: 135562 - RNA, 64 nt, Homo Sapiens; identical to SEQ ID NO: 40078

SEQ ID NO: 135563 - RNA, 64 nt, Homo Sapiens; identical to SEQ ID NO: 40079

SEQ ID NO: 135564 - RNA, 64 nt, Homo Sapiens; identical to SEQ ID NO: 40080

SEQ ID NO: 135565 - RNA, 64 nt, Homo Sapiens; identical to SEQ ID NO: 40081

SEQ ID NO: 135566 - RNA, 64 nt, Homo Sapiens; identical to SEQ ID NO: 40082

SEQ ID NO: 135567 - RNA, 64 nt, Homo Sapiens; identical to SEQ ID NO: 40083

SEQ ID NO: 135568 - RNA, 64 nt, Homo Sapiens; identical to SEQ ID NO: 40084

SEQ ID NO: 135569 - RNA, 64 nt, Homo Sapiens; identical to SEQ ID NO: 40085

SEQ ID NO: 135570 - RNA, 64 nt, Homo Sapiens; identical to SEQ ID NO: 40086

SEQ ID NO: 135571 - RNA, 64 nt, Homo Sapiens; identical to SEQ ID NO: 40087

SEQ ID NO: 135572 - RNA, 64 nt, Homo Sapiens; identical to SEQ ID NO: 40088

SEQ ID NO: 135573 - RNA, 64 nt, Homo Sapiens; identical to SEQ ID NO: 40089

SEQ ID NO: 135574 - RNA, 64 nt, Homo Sapiens; identical to SEQ ID NO: 40090

SEQ ID NO: 135575 - RNA, 64 nt, Homo Sapiens; identical to SEQ ID NO: 40091

SEQ ID NO: 135576 - RNA, 64 nt, Homo Sapiens; identical to SEQ ID NO: 40092

SEQ ID NO: 135577 - RNA, 64 nt, Homo Sapiens; identical to SEQ ID NO: 40093

SEQ ID NO: 135578 - RNA, 64 nt, Homo Sapiens; identical to SEQ ID NO: 40094

SEQ ID NO: 135579 - RNA, 64 nt, Homo Sapiens; identical to SEQ ID NO: 40095

SEQ ID NO: 135580 - RNA, 64 nt, Homo Sapiens; identical to SEQ ID NO: 40096

SEQ ID NO: 135581 - RNA, 64 nt, Homo Sapiens; identical to SEQ ID NO: 40097

SEQ ID NO: 135582 - RNA, 64 nt, Homo Sapiens; identical to SEQ ID NO: 40098

SEQ ID NO: 135583 - RNA, 64 nt, Homo Sapiens; identical to SEQ ID NO: 40099

SEQ ID NO: 135584 - RNA, 64 nt, Homo Sapiens; identical to SEQ ID NO: 40100

SEQ ID NO: 135585 - RNA, 64 nt, Homo Sapiens; identical to SEQ ID NO: 40101

SEQ ID NO: 135586 - RNA, 64 nt, Homo Sapiens; identical to SEQ ID NO: 40102

SEQ ID NO: 135587 - RNA, 64 nt, Homo Sapiens; identical to SEQ ID NO: 40103

SEQ ID NO: 135588 - RNA, 64 nt, Homo Sapiens; identical to SEQ ID NO: 40104

SEQ ID NO: 135589 - RNA, 64 nt, Homo Sapiens; identical to SEQ ID NO: 40105

SEQ ID NO: 135590 - RNA, 64 nt, Homo Sapiens; identical to SEQ ID NO: 40106

SEQ ID NO: 135591 - RNA, 64 nt, Homo Sapiens; identical to SEQ ID NO: 40107

SEQ ID NO: 135592 - RNA, 64 nt, Homo Sapiens; identical to SEQ ID NO: 40108

SEQ ID NO: 135593 - RNA, 64 nt, Homo Sapiens; identical to SEQ ID NO: 40109

SEQ ID NO: 135594 - RNA, 64 nt, Homo Sapiens; identical to SEQ ID NO: 40110

SEQ ID NO: 135595 - RNA, 64 nt, Homo Sapiens; identical to SEQ ID NO: 40111

SEQ ID NO: 135596 - RNA, 64 nt, Homo Sapiens; identical to SEQ ID NO: 40112

SEQ ID NO: 135597 - RNA, 64 nt, Homo Sapiens; identical to SEQ ID NO: 40113

SEQ ID NO: 135598 - RNA, 64 nt, Homo Sapiens; identical to SEQ ID NO: 40114

SEQ ID NO: 135599 - RNA, 64 nt, Homo Sapiens; identical to SEQ ID NO: 40115

SEQ ID NO: 135600 - RNA, 64 nt, Homo Sapiens; identical to SEQ ID NO: 40116

SEQ ID NO: 135601 - RNA, 64 nt, Homo Sapiens; identical to SEQ ID NO: 40117

SEQ ID NO: 135602 - RNA, 64 nt, Homo Sapiens; identical to SEQ ID NO: 40118

SEQ ID NO: 135603 - RNA, 64 nt, Homo Sapiens; identical to SEQ ID NO: 40119

SEQ ID NO: 135604 - RNA, 64 nt, Homo Sapiens; identical to SEQ ID NO: 40120

SEQ ID NO: 135605 - RNA, 64 nt, Homo Sapiens; identical to SEQ ID NO: 40121

SEQ ID NO: 135606 - RNA, 64 nt, Homo Sapiens; identical to SEQ ID NO: 40122

SEQ ID NO: 135607 - RNA, 64 nt, Homo Sapiens; identical to SEQ ID NO: 40123

SEQ ID NO: 135608 - RNA, 64 nt, Homo Sapiens; identical to SEQ ID NO: 40124

SEQ ID NO: 135609 - RNA, 64 nt, Homo Sapiens; identical to SEQ ID NO: 40125

SEQ ID NO: 135610 - RNA, 64 nt, Homo Sapiens; identical to SEQ ID NO: 40126

SEQ ID NO: 135611 - RNA, 64 nt, Homo Sapiens; identical to SEQ ID NO: 40127

SEQ ID NO: 135612 - RNA, 64 nt, Homo Sapiens; identical to SEQ ID NO: 40128

SEQ ID NO: 135613 - RNA, 64 nt, Homo Sapiens; identical to SEQ ID NO: 40129

SEQ ID NO: 135614 - RNA, 64 nt, Homo Sapiens; identical to SEQ ID NO: 40130

SEQ ID NO: 135615 - RNA, 64 nt, Homo Sapiens; identical to SEQ ID NO: 40131

SEQ ID NO: 135616 - RNA, 64 nt, Homo Sapiens; identical to SEQ ID NO: 40132

SEQ ID NO: 135617 - RNA, 64 nt, Homo Sapiens; identical to SEQ ID NO: 40133

SEQ ID NO: 135618 - RNA, 64 nt, Homo Sapiens; identical to SEQ ID NO: 40134

SEQ ID NO: 135619 - RNA, 64 nt, Homo Sapiens; identical to SEQ ID NO: 40135

SEQ ID NO: 135620 - RNA, 64 nt, Homo Sapiens; identical to SEQ ID NO: 40136

SEQ ID NO: 135621 - RNA, 64 nt, Homo Sapiens; identical to SEQ ID NO: 40137

SEQ ID NO: 135622 - RNA, 64 nt, Homo Sapiens; identical to SEQ ID NO: 40138

SEQ ID NO: 135623 - RNA, 64 nt, Homo Sapiens; identical to SEQ ID NO: 40139

SEQ ID NO: 135624 - RNA, 64 nt, Homo Sapiens; identical to SEQ ID NO: 40140

SEQ ID NO: 135625 - RNA, 64 nt, Homo Sapiens; identical to SEQ ID NO: 40141

SEQ ID NO: 135626 - RNA, 64 nt, Homo Sapiens; identical to SEQ ID NO: 40142

SEQ ID NO: 135627 - RNA, 64 nt, Homo Sapiens; identical to SEQ ID NO: 40143

SEQ ID NO: 135628 - RNA, 64 nt, Homo Sapiens; identical to SEQ ID NO: 40144

SEQ ID NO: 135629 - RNA, 64 nt, Homo Sapiens; identical to SEQ ID NO: 40145

SEQ ID NO: 135630 - RNA, 64 nt, Homo Sapiens; identical to SEQ ID NO: 40146

SEQ ID NO: 135631 - RNA, 64 nt, Homo Sapiens; identical to SEQ ID NO: 40147

SEQ ID NO: 135632 - RNA, 64 nt, Homo Sapiens; identical to SEQ ID NO: 40148

SEQ ID NO: 135633 - RNA, 64 nt, Homo Sapiens; identical to SEQ ID NO: 40149

SEQ ID NO: 135634 - RNA, 64 nt, Homo Sapiens; identical to SEQ ID NO: 40150

SEQ ID NO: 135635 - RNA, 64 nt, Homo Sapiens; identical to SEQ ID NO: 40151

SEQ ID NO: 135636 - RNA, 64 nt, Homo Sapiens; identical to SEQ ID NO: 40152

SEQ ID NO: 135637 - RNA, 64 nt, Homo Sapiens; identical to SEQ ID NO: 40153

SEQ ID NO: 135638 - RNA, 64 nt, Homo Sapiens; identical to SEQ ID NO: 40154

SEQ ID NO: 135639 - RNA, 64 nt, Homo Sapiens; identical to SEQ ID NO: 40155

SEQ ID NO: 135640 - RNA, 64 nt, Homo Sapiens; identical to SEQ ID NO: 40156

SEQ ID NO: 135641 - RNA, 64 nt, Homo Sapiens; identical to SEQ ID NO: 40157

SEQ ID NO: 135642 - RNA, 64 nt, Homo Sapiens; identical to SEQ ID NO: 40158

SEQ ID NO: 135643 - RNA, 64 nt, Homo Sapiens; identical to SEQ ID NO: 40159

SEQ ID NO: 135644 - RNA, 64 nt, Homo Sapiens; identical to SEQ ID NO: 40160

SEQ ID NO: 135645 - RNA, 64 nt, Homo Sapiens; identical to SEQ ID NO: 40161

SEQ ID NO: 135646 - RNA, 64 nt, Homo Sapiens; identical to SEQ ID NO: 40162

SEQ ID NO: 135647 - RNA, 64 nt, Homo Sapiens; identical to SEQ ID NO: 40163

SEQ ID NO: 135648 - RNA, 64 nt, Homo Sapiens; identical to SEQ ID NO: 40164

SEQ ID NO: 135649 - RNA, 64 nt, Homo Sapiens; identical to SEQ ID NO: 40165

SEQ ID NO: 135650 - RNA, 64 nt, Homo Sapiens; identical to SEQ ID NO: 40166

SEQ ID NO: 135651 - RNA, 64 nt, Homo Sapiens; identical to SEQ ID NO: 40167

SEQ ID NO: 135652 - RNA, 64 nt, Homo Sapiens; identical to SEQ ID NO: 40168

SEQ ID NO: 135653 - RNA, 64 nt, Homo Sapiens; identical to SEQ ID NO: 40169

SEQ ID NO: 135654 - RNA, 64 nt, Homo Sapiens; identical to SEQ ID NO: 40170

SEQ ID NO: 135655 - RNA, 64 nt, Homo Sapiens; identical to SEQ ID NO: 40171

SEQ ID NO: 135656 - RNA, 64 nt, Homo Sapiens; identical to SEQ ID NO: 40172

SEQ ID NO: 135657 - RNA, 64 nt, Homo Sapiens; identical to SEQ ID NO: 40173

SEQ ID NO: 135658 - RNA, 64 nt, Homo Sapiens; identical to SEQ ID NO: 40174

SEQ ID NO: 135659 - RNA, 64 nt, Homo Sapiens; identical to SEQ ID NO: 40175

SEQ ID NO: 135660 - RNA, 64 nt, Homo Sapiens; identical to SEQ ID NO: 40176

SEQ ID NO: 135661 - RNA, 64 nt, Homo Sapiens; identical to SEQ ID NO: 40177

SEQ ID NO: 135662 - RNA, 64 nt, Homo Sapiens; identical to SEQ ID NO: 40178

SEQ ID NO: 135663 - RNA, 64 nt, Homo Sapiens; identical to SEQ ID NO: 40179

SEQ ID NO: 135664 - RNA, 64 nt, Homo Sapiens; identical to SEQ ID NO: 40180

SEQ ID NO: 135665 - RNA, 64 nt, Homo Sapiens; identical to SEQ ID NO: 40181

SEQ ID NO: 135666 - RNA, 64 nt, Homo Sapiens; identical to SEQ ID NO: 40182

SEQ ID NO: 135667 - RNA, 64 nt, Homo Sapiens; identical to SEQ ID NO: 40183

SEQ ID NO: 135668 - RNA, 64 nt, Homo Sapiens; identical to SEQ ID NO: 40184

SEQ ID NO: 135669 - RNA, 64 nt, Homo Sapiens; identical to SEQ ID NO: 40185

SEQ ID NO: 135670 - RNA, 64 nt, Homo Sapiens; identical to SEQ ID NO: 40186

SEQ ID NO: 135671 - RNA, 64 nt, Homo Sapiens; identical to SEQ ID NO: 40187

SEQ ID NO: 135672 - RNA, 64 nt, Homo Sapiens; identical to SEQ ID NO: 40188

SEQ ID NO: 135673 - RNA, 64 nt, Homo Sapiens; identical to SEQ ID NO: 40189

SEQ ID NO: 135674 - RNA, 64 nt, Homo Sapiens; identical to SEQ ID NO: 40190

SEQ ID NO: 135675 - RNA, 64 nt, Homo Sapiens; identical to SEQ ID NO: 40191

SEQ ID NO: 135676 - RNA, 64 nt, Homo Sapiens; identical to SEQ ID NO: 40192

SEQ ID NO: 135677 - RNA, 64 nt, Homo Sapiens; identical to SEQ ID NO: 40193

SEQ ID NO: 135678 - RNA, 64 nt, Homo Sapiens; identical to SEQ ID NO: 40194

SEQ ID NO: 135679 - RNA, 64 nt, Homo Sapiens; identical to SEQ ID NO: 40195

SEQ ID NO: 135680 - RNA, 64 nt, Homo Sapiens; identical to SEQ ID NO: 40196

SEQ ID NO: 135681 - RNA, 64 nt, Homo Sapiens; identical to SEQ ID NO: 40197

SEQ ID NO: 135682 - RNA, 64 nt, Homo Sapiens; identical to SEQ ID NO: 40198

SEQ ID NO: 135683 - RNA, 64 nt, Homo Sapiens; identical to SEQ ID NO: 40199

SEQ ID NO: 135684 - RNA, 64 nt, Homo Sapiens; identical to SEQ ID NO: 40200

SEQ ID NO: 135685 - RNA, 64 nt, Homo Sapiens; identical to SEQ ID NO: 40201

SEQ ID NO: 135686 - RNA, 64 nt, Homo Sapiens; identical to SEQ ID NO: 40202

SEQ ID NO: 135687 - RNA, 64 nt, Homo Sapiens; identical to SEQ ID NO: 40203

SEQ ID NO: 135688 - RNA, 64 nt, Homo Sapiens; identical to SEQ ID NO: 40204

SEQ ID NO: 135689 - RNA, 64 nt, Homo Sapiens; identical to SEQ ID NO: 40205

SEQ ID NO: 135690 - RNA, 64 nt, Homo Sapiens; identical to SEQ ID NO: 40206

SEQ ID NO: 135691 - RNA, 64 nt, Homo Sapiens; identical to SEQ ID NO: 40207

SEQ ID NO: 135692 - RNA, 64 nt, Homo Sapiens; identical to SEQ ID NO: 40208

SEQ ID NO: 135693 - RNA, 64 nt, Homo Sapiens; identical to SEQ ID NO: 40209

SEQ ID NO: 135694 - RNA, 64 nt, Homo Sapiens; identical to SEQ ID NO: 40210

SEQ ID NO: 135695 - RNA, 64 nt, Homo Sapiens; identical to SEQ ID NO: 40211

SEQ ID NO: 135696 - RNA, 64 nt, Homo Sapiens; identical to SEQ ID NO: 40212

SEQ ID NO: 135697 - RNA, 64 nt, Homo Sapiens; identical to SEQ ID NO: 40213

SEQ ID NO: 135698 - RNA, 64 nt, Homo Sapiens; identical to SEQ ID NO: 40214

SEQ ID NO: 135699 - RNA, 64 nt, Homo Sapiens; identical to SEQ ID NO: 40215

SEQ ID NO: 135700 - RNA, 64 nt, Homo Sapiens; identical to SEQ ID NO: 40216

SEQ ID NO: 135701 - RNA, 64 nt, Homo Sapiens; identical to SEQ ID NO: 40217

SEQ ID NO: 135702 - RNA, 64 nt, Homo Sapiens; identical to SEQ ID NO: 40218

SEQ ID NO: 135703 - RNA, 64 nt, Homo Sapiens; identical to SEQ ID NO: 40219

SEQ ID NO: 135704 - RNA, 64 nt, Homo Sapiens; identical to SEQ ID NO: 40220

SEQ ID NO: 135705 - RNA, 64 nt, Homo Sapiens; identical to SEQ ID NO: 40221

SEQ ID NO: 135706 - RNA, 64 nt, Homo Sapiens; identical to SEQ ID NO: 40222

SEQ ID NO: 135707 - RNA, 64 nt, Homo Sapiens; identical to SEQ ID NO: 40223

SEQ ID NO: 135708 - RNA, 64 nt, Homo Sapiens; identical to SEQ ID NO: 40224

SEQ ID NO: 135709 - RNA, 64 nt, Homo Sapiens; identical to SEQ ID NO: 40225

SEQ ID NO: 135710 - RNA, 64 nt, Homo Sapiens; identical to SEQ ID NO: 40226

SEQ ID NO: 135711 - RNA, 64 nt, Homo Sapiens; identical to SEQ ID NO: 40227

SEQ ID NO: 135712 - RNA, 64 nt, Homo Sapiens; identical to SEQ ID NO: 40228

SEQ ID NO: 135713 - RNA, 64 nt, Homo Sapiens; identical to SEQ ID NO: 40229

SEQ ID NO: 135714 - RNA, 64 nt, Homo Sapiens; identical to SEQ ID NO: 40230

SEQ ID NO: 135715 - RNA, 64 nt, Homo Sapiens; identical to SEQ ID NO: 40231

SEQ ID NO: 135716 - RNA, 64 nt, Homo Sapiens; identical to SEQ ID NO: 40232

SEQ ID NO: 135717 - RNA, 64 nt, Homo Sapiens; identical to SEQ ID NO: 40233

SEQ ID NO: 135718 - RNA, 64 nt, Homo Sapiens; identical to SEQ ID NO: 40234

SEQ ID NO: 135719 - RNA, 64 nt, Homo Sapiens; identical to SEQ ID NO: 40235

SEQ ID NO: 135720 - RNA, 64 nt, Homo Sapiens; identical to SEQ ID NO: 40236

SEQ ID NO: 135721 - RNA, 64 nt, Homo Sapiens; identical to SEQ ID NO: 40237

SEQ ID NO: 135722 - RNA, 64 nt, Homo Sapiens; identical to SEQ ID NO: 40238

SEQ ID NO: 135723 - RNA, 64 nt, Homo Sapiens; identical to SEQ ID NO: 40239

SEQ ID NO: 135724 - RNA, 64 nt, Homo Sapiens; identical to SEQ ID NO: 40240

SEQ ID NO: 135725 - RNA, 64 nt, Homo Sapiens; identical to SEQ ID NO: 40241

SEQ ID NO: 135726 - RNA, 64 nt, Homo Sapiens; identical to SEQ ID NO: 40242

SEQ ID NO: 135727 - RNA, 64 nt, Homo Sapiens; identical to SEQ ID NO: 40243

SEQ ID NO: 135728 - RNA, 64 nt, Homo Sapiens; identical to SEQ ID NO: 40244

SEQ ID NO: 135729 - RNA, 64 nt, Homo Sapiens; identical to SEQ ID NO: 40245

SEQ ID NO: 135730 - RNA, 64 nt, Homo Sapiens; identical to SEQ ID NO: 40246

SEQ ID NO: 135731 - RNA, 64 nt, Homo Sapiens; identical to SEQ ID NO: 40247

SEQ ID NO: 135732 - RNA, 64 nt, Homo Sapiens; identical to SEQ ID NO: 40248

SEQ ID NO: 135733 - RNA, 64 nt, Homo Sapiens; identical to SEQ ID NO: 40249

SEQ ID NO: 135734 - RNA, 64 nt, Homo Sapiens; identical to SEQ ID NO: 40250

SEQ ID NO: 135735 - RNA, 64 nt, Homo Sapiens; identical to SEQ ID NO: 40251

SEQ ID NO: 135736 - RNA, 64 nt, Homo Sapiens; identical to SEQ ID NO: 40252

SEQ ID NO: 135737 - RNA, 64 nt, Homo Sapiens; identical to SEQ ID NO: 40253

SEQ ID NO: 135738 - RNA, 64 nt, Homo Sapiens; identical to SEQ ID NO: 40254

SEQ ID NO: 135739 - RNA, 64 nt, Homo Sapiens; identical to SEQ ID NO: 40255

SEQ ID NO: 135740 - RNA, 64 nt, Homo Sapiens; identical to SEQ ID NO: 40256

SEQ ID NO: 135741 - RNA, 64 nt, Homo Sapiens; identical to SEQ ID NO: 40257

SEQ ID NO: 135742 - RNA, 64 nt, Homo Sapiens; identical to SEQ ID NO: 40258

SEQ ID NO: 135743 - RNA, 64 nt, Homo Sapiens; identical to SEQ ID NO: 40259

SEQ ID NO: 135744 - RNA, 64 nt, Homo Sapiens; identical to SEQ ID NO: 40260

SEQ ID NO: 135745 - RNA, 64 nt, Homo Sapiens; identical to SEQ ID NO: 40261

SEQ ID NO: 135746 - RNA, 64 nt, Homo Sapiens; identical to SEQ ID NO: 40262

SEQ ID NO: 135747 - RNA, 64 nt, Homo Sapiens; identical to SEQ ID NO: 40263

SEQ ID NO: 135748 - RNA, 64 nt, Homo Sapiens; identical to SEQ ID NO: 40264

SEQ ID NO: 135749 - RNA, 64 nt, Homo Sapiens; identical to SEQ ID NO: 40265

SEQ ID NO: 135750 - RNA, 64 nt, Homo Sapiens; identical to SEQ ID NO: 40266

SEQ ID NO: 135751 - RNA, 64 nt, Homo Sapiens; identical to SEQ ID NO: 40267

SEQ ID NO: 135752 - RNA, 64 nt, Homo Sapiens; identical to SEQ ID NO: 40268

SEQ ID NO: 135753 - RNA, 64 nt, Homo Sapiens; identical to SEQ ID NO: 40269

SEQ ID NO: 135754 - RNA, 64 nt, Homo Sapiens; identical to SEQ ID NO: 40270

SEQ ID NO: 135755 - RNA, 64 nt, Homo Sapiens; identical to SEQ ID NO: 40271

SEQ ID NO: 135756 - RNA, 64 nt, Homo Sapiens; identical to SEQ ID NO: 40272

SEQ ID NO: 135757 - RNA, 64 nt, Homo Sapiens; identical to SEQ ID NO: 40273

SEQ ID NO: 135758 - RNA, 64 nt, Homo Sapiens; identical to SEQ ID NO: 40274

SEQ ID NO: 135759 - RNA, 64 nt, Homo Sapiens; identical to SEQ ID NO: 40275

SEQ ID NO: 135760 - RNA, 64 nt, Homo Sapiens; identical to SEQ ID NO: 40276

SEQ ID NO: 135761 - RNA, 64 nt, Homo Sapiens; identical to SEQ ID NO: 40277

SEQ ID NO: 135762 - RNA, 64 nt, Homo Sapiens; identical to SEQ ID NO: 40278

SEQ ID NO: 135763 - RNA, 64 nt, Homo Sapiens; identical to SEQ ID NO: 40279

SEQ ID NO: 135764 - RNA, 64 nt, Homo Sapiens; identical to SEQ ID NO: 40280

SEQ ID NO: 135765 - RNA, 64 nt, Homo Sapiens; identical to SEQ ID NO: 40281

SEQ ID NO: 135766 - RNA, 64 nt, Homo Sapiens; identical to SEQ ID NO: 40282

SEQ ID NO: 135767 - RNA, 64 nt, Homo Sapiens; identical to SEQ ID NO: 40283

SEQ ID NO: 135768 - RNA, 64 nt, Homo Sapiens; identical to SEQ ID NO: 40284

SEQ ID NO: 135769 - RNA, 64 nt, Homo Sapiens; identical to SEQ ID NO: 40285

SEQ ID NO: 135770 - RNA, 64 nt, Homo Sapiens; identical to SEQ ID NO: 40286

SEQ ID NO: 135771 - RNA, 64 nt, Homo Sapiens; identical to SEQ ID NO: 40287

SEQ ID NO: 135772 - RNA, 64 nt, Homo Sapiens; identical to SEQ ID NO: 40288

SEQ ID NO: 135773 - RNA, 64 nt, Homo Sapiens; identical to SEQ ID NO: 40289

SEQ ID NO: 135774 - RNA, 64 nt, Homo Sapiens; identical to SEQ ID NO: 40290

SEQ ID NO: 135775 - RNA, 64 nt, Homo Sapiens; identical to SEQ ID NO: 40291

SEQ ID NO: 135776 - RNA, 64 nt, Homo Sapiens; identical to SEQ ID NO: 40292

SEQ ID NO: 135777 - RNA, 64 nt, Homo Sapiens; identical to SEQ ID NO: 40293

SEQ ID NO: 135778 - RNA, 64 nt, Homo Sapiens; identical to SEQ ID NO: 40294

SEQ ID NO: 135779 - RNA, 64 nt, Homo Sapiens; identical to SEQ ID NO: 40295

SEQ ID NO: 135780 - RNA, 64 nt, Homo Sapiens; identical to SEQ ID NO: 40296

SEQ ID NO: 135781 - RNA, 64 nt, Homo Sapiens; identical to SEQ ID NO: 40297

SEQ ID NO: 135782 - RNA, 64 nt, Homo Sapiens; identical to SEQ ID NO: 40298

SEQ ID NO: 135783 - RNA, 64 nt, Homo Sapiens; identical to SEQ ID NO: 40299

SEQ ID NO: 135784 - RNA, 64 nt, Homo Sapiens; identical to SEQ ID NO: 40300

SEQ ID NO: 135785 - RNA, 64 nt, Homo Sapiens; identical to SEQ ID NO: 40301

SEQ ID NO: 135786 - RNA, 64 nt, Homo Sapiens; identical to SEQ ID NO: 40302

SEQ ID NO: 135787 - RNA, 64 nt, Homo Sapiens; identical to SEQ ID NO: 40303

SEQ ID NO: 135788 - RNA, 64 nt, Homo Sapiens; identical to SEQ ID NO: 40304

SEQ ID NO: 135789 - RNA, 64 nt, Homo Sapiens; identical to SEQ ID NO: 40305

SEQ ID NO: 135790 - RNA, 64 nt, Homo Sapiens; identical to SEQ ID NO: 40306

SEQ ID NO: 135791 - RNA, 64 nt, Homo Sapiens; identical to SEQ ID NO: 40307

SEQ ID NO: 135792 - RNA, 64 nt, Homo Sapiens; identical to SEQ ID NO: 40308

SEQ ID NO: 135793 - RNA, 64 nt, Homo Sapiens; identical to SEQ ID NO: 40309

SEQ ID NO: 135794 - RNA, 64 nt, Homo Sapiens; identical to SEQ ID NO: 40310

SEQ ID NO: 135795 - RNA, 64 nt, Homo Sapiens; identical to SEQ ID NO: 40311

SEQ ID NO: 135796 - RNA, 64 nt, Homo Sapiens; identical to SEQ ID NO: 40312

SEQ ID NO: 135797 - RNA, 64 nt, Homo Sapiens; identical to SEQ ID NO: 40313

SEQ ID NO: 135798 - RNA, 64 nt, Homo Sapiens; identical to SEQ ID NO: 40314

SEQ ID NO: 135799 - RNA, 64 nt, Homo Sapiens; identical to SEQ ID NO: 40315

SEQ ID NO: 135800 - RNA, 64 nt, Homo Sapiens; identical to SEQ ID NO: 40316

SEQ ID NO: 135801 - RNA, 64 nt, Homo Sapiens; identical to SEQ ID NO: 40317

SEQ ID NO: 135802 - RNA, 64 nt, Homo Sapiens; identical to SEQ ID NO: 40318

SEQ ID NO: 135803 - RNA, 64 nt, Homo Sapiens; identical to SEQ ID NO: 40319

SEQ ID NO: 135804 - RNA, 64 nt, Homo Sapiens; identical to SEQ ID NO: 40320

SEQ ID NO: 135805 - RNA, 64 nt, Homo Sapiens; identical to SEQ ID NO: 40321

SEQ ID NO: 135806 - RNA, 64 nt, Homo Sapiens; identical to SEQ ID NO: 40322

SEQ ID NO: 135807 - RNA, 64 nt, Homo Sapiens; identical to SEQ ID NO: 40323

SEQ ID NO: 135808 - RNA, 64 nt, Homo Sapiens; identical to SEQ ID NO: 40324

SEQ ID NO: 135809 - RNA, 64 nt, Homo Sapiens; identical to SEQ ID NO: 40325

SEQ ID NO: 135810 - RNA, 64 nt, Homo Sapiens; identical to SEQ ID NO: 40326

SEQ ID NO: 135811 - RNA, 64 nt, Homo Sapiens; identical to SEQ ID NO: 40327

SEQ ID NO: 135812 - RNA, 64 nt, Homo Sapiens; identical to SEQ ID NO: 40328

SEQ ID NO: 135813 - RNA, 64 nt, Homo Sapiens; identical to SEQ ID NO: 40329

SEQ ID NO: 135814 - RNA, 64 nt, Homo Sapiens; identical to SEQ ID NO: 40330

SEQ ID NO: 135815 - RNA, 64 nt, Homo Sapiens; identical to SEQ ID NO: 40331

SEQ ID NO: 135816 - RNA, 64 nt, Homo Sapiens; identical to SEQ ID NO: 40332

SEQ ID NO: 135817 - RNA, 64 nt, Homo Sapiens; identical to SEQ ID NO: 40333

SEQ ID NO: 135818 - RNA, 64 nt, Homo Sapiens; identical to SEQ ID NO: 40334

SEQ ID NO: 135819 - RNA, 64 nt, Homo Sapiens; identical to SEQ ID NO: 40335

SEQ ID NO: 135820 - RNA, 64 nt, Homo Sapiens; identical to SEQ ID NO: 40336

SEQ ID NO: 135821 - RNA, 64 nt, Homo Sapiens; identical to SEQ ID NO: 40337

SEQ ID NO: 135822 - RNA, 64 nt, Homo Sapiens; identical to SEQ ID NO: 40338

SEQ ID NO: 135823 - RNA, 64 nt, Homo Sapiens; identical to SEQ ID NO: 40339

SEQ ID NO: 135824 - RNA, 64 nt, Homo Sapiens; identical to SEQ ID NO: 40340

SEQ ID NO: 135825 - RNA, 64 nt, Homo Sapiens; identical to SEQ ID NO: 40341

SEQ ID NO: 135826 - RNA, 64 nt, Homo Sapiens; identical to SEQ ID NO: 40342

SEQ ID NO: 135827 - RNA, 64 nt, Homo Sapiens; identical to SEQ ID NO: 40343

SEQ ID NO: 135828 - RNA, 64 nt, Homo Sapiens; identical to SEQ ID NO: 40344

SEQ ID NO: 135829 - RNA, 64 nt, Homo Sapiens; identical to SEQ ID NO: 40345

SEQ ID NO: 135830 - RNA, 64 nt, Homo Sapiens; identical to SEQ ID NO: 40346

SEQ ID NO: 135831 - RNA, 64 nt, Homo Sapiens; identical to SEQ ID NO: 40347

SEQ ID NO: 135832 - RNA, 64 nt, Homo Sapiens; identical to SEQ ID NO: 40348

SEQ ID NO: 135833 - RNA, 64 nt, Homo Sapiens; identical to SEQ ID NO: 40349

SEQ ID NO: 135834 - RNA, 64 nt, Homo Sapiens; identical to SEQ ID NO: 40350

SEQ ID NO: 135835 - RNA, 64 nt, Homo Sapiens; identical to SEQ ID NO: 40351

SEQ ID NO: 135836 - RNA, 64 nt, Homo Sapiens; identical to SEQ ID NO: 40352

SEQ ID NO: 135837 - RNA, 64 nt, Homo Sapiens; identical to SEQ ID NO: 40353

SEQ ID NO: 135838 - RNA, 64 nt, Homo Sapiens; identical to SEQ ID NO: 40354

SEQ ID NO: 135839 - RNA, 64 nt, Homo Sapiens; identical to SEQ ID NO: 40355

SEQ ID NO: 135840 - RNA, 64 nt, Homo Sapiens; identical to SEQ ID NO: 40356

SEQ ID NO: 135841 - RNA, 64 nt, Homo Sapiens; identical to SEQ ID NO: 40357

SEQ ID NO: 135842 - RNA, 64 nt, Homo Sapiens; identical to SEQ ID NO: 40358

SEQ ID NO: 135843 - RNA, 64 nt, Homo Sapiens; identical to SEQ ID NO: 40359

SEQ ID NO: 135844 - RNA, 64 nt, Homo Sapiens; identical to SEQ ID NO: 40360

SEQ ID NO: 135845 - RNA, 64 nt, Homo Sapiens; identical to SEQ ID NO: 40361

SEQ ID NO: 135846 - RNA, 64 nt, Homo Sapiens; identical to SEQ ID NO: 40362

SEQ ID NO: 135847 - RNA, 64 nt, Homo Sapiens; identical to SEQ ID NO: 40363

SEQ ID NO: 135848 - RNA, 64 nt, Homo Sapiens; identical to SEQ ID NO: 40364

SEQ ID NO: 135849 - RNA, 64 nt, Homo Sapiens; identical to SEQ ID NO: 40365

SEQ ID NO: 135850 - RNA, 64 nt, Homo Sapiens; identical to SEQ ID NO: 40366

SEQ ID NO: 135851 - RNA, 64 nt, Homo Sapiens; identical to SEQ ID NO: 40367

SEQ ID NO: 135852 - RNA, 64 nt, Homo Sapiens; identical to SEQ ID NO: 40368

SEQ ID NO: 135853 - RNA, 64 nt, Homo Sapiens; identical to SEQ ID NO: 40369

SEQ ID NO: 135854 - RNA, 64 nt, Homo Sapiens; identical to SEQ ID NO: 40370

SEQ ID NO: 135855 - RNA, 64 nt, Homo Sapiens; identical to SEQ ID NO: 40371

SEQ ID NO: 135856 - RNA, 64 nt, Homo Sapiens; identical to SEQ ID NO: 40372

SEQ ID NO: 135857 - RNA, 64 nt, Homo Sapiens; identical to SEQ ID NO: 40373

SEQ ID NO: 135858 - RNA, 64 nt, Homo Sapiens; identical to SEQ ID NO: 40374

SEQ ID NO: 135859 - RNA, 64 nt, Homo Sapiens; identical to SEQ ID NO: 40375

SEQ ID NO: 135860 - RNA, 64 nt, Homo Sapiens; identical to SEQ ID NO: 40376

SEQ ID NO: 135861 - RNA, 64 nt, Homo Sapiens; identical to SEQ ID NO: 40377

SEQ ID NO: 135862 - RNA, 64 nt, Homo Sapiens; identical to SEQ ID NO: 40378

SEQ ID NO: 135863 - RNA, 64 nt, Homo Sapiens; identical to SEQ ID NO: 40379

SEQ ID NO: 135864 - RNA, 64 nt, Homo Sapiens; identical to SEQ ID NO: 40380

SEQ ID NO: 135865 - RNA, 64 nt, Homo Sapiens; identical to SEQ ID NO: 40381

SEQ ID NO: 135866 - RNA, 64 nt, Homo Sapiens; identical to SEQ ID NO: 40382

SEQ ID NO: 135867 - RNA, 64 nt, Homo Sapiens; identical to SEQ ID NO: 40383

SEQ ID NO: 135868 - RNA, 64 nt, Homo Sapiens; identical to SEQ ID NO: 40384

SEQ ID NO: 135869 - RNA, 64 nt, Homo Sapiens; identical to SEQ ID NO: 40385

SEQ ID NO: 135870 - RNA, 64 nt, Homo Sapiens; identical to SEQ ID NO: 40386

SEQ ID NO: 135871 - RNA, 64 nt, Homo Sapiens; identical to SEQ ID NO: 40387

SEQ ID NO: 135872 - RNA, 64 nt, Homo Sapiens; identical to SEQ ID NO: 40388

SEQ ID NO: 135873 - RNA, 64 nt, Homo Sapiens; identical to SEQ ID NO: 40389

SEQ ID NO: 135874 - RNA, 64 nt, Homo Sapiens; identical to SEQ ID NO: 40390

SEQ ID NO: 135875 - RNA, 64 nt, Homo Sapiens; identical to SEQ ID NO: 40391

SEQ ID NO: 135876 - RNA, 64 nt, Homo Sapiens; identical to SEQ ID NO: 40392

SEQ ID NO: 135877 - RNA, 64 nt, Homo Sapiens; identical to SEQ ID NO: 40393

SEQ ID NO: 135878 - RNA, 64 nt, Homo Sapiens; identical to SEQ ID NO: 40394

SEQ ID NO: 135879 - RNA, 64 nt, Homo Sapiens; identical to SEQ ID NO: 40395

SEQ ID NO: 135880 - RNA, 64 nt, Homo Sapiens; identical to SEQ ID NO: 40396

SEQ ID NO: 135881 - RNA, 64 nt, Homo Sapiens; identical to SEQ ID NO: 40397

SEQ ID NO: 135882 - RNA, 64 nt, Homo Sapiens; identical to SEQ ID NO: 40398

SEQ ID NO: 135883 - RNA, 64 nt, Homo Sapiens; identical to SEQ ID NO: 40399

SEQ ID NO: 135884 - RNA, 64 nt, Homo Sapiens; identical to SEQ ID NO: 40400

SEQ ID NO: 135885 - RNA, 64 nt, Homo Sapiens; identical to SEQ ID NO: 40401

SEQ ID NO: 135886 - RNA, 64 nt, Homo Sapiens; identical to SEQ ID NO: 40402

SEQ ID NO: 135887 - RNA, 64 nt, Homo Sapiens; identical to SEQ ID NO: 40403

SEQ ID NO: 135888 - RNA, 64 nt, Homo Sapiens; identical to SEQ ID NO: 40404

SEQ ID NO: 135889 - RNA, 64 nt, Homo Sapiens; identical to SEQ ID NO: 40405

SEQ ID NO: 135890 - RNA, 64 nt, Homo Sapiens; identical to SEQ ID NO: 40406

SEQ ID NO: 135891 - RNA, 64 nt, Homo Sapiens; identical to SEQ ID NO: 40407

SEQ ID NO: 135892 - RNA, 64 nt, Homo Sapiens; identical to SEQ ID NO: 40408

SEQ ID NO: 135893 - RNA, 64 nt, Homo Sapiens; identical to SEQ ID NO: 40409

SEQ ID NO: 135894 - RNA, 64 nt, Homo Sapiens; identical to SEQ ID NO: 40410

SEQ ID NO: 135895 - RNA, 64 nt, Homo Sapiens; identical to SEQ ID NO: 40411

SEQ ID NO: 135896 - RNA, 64 nt, Homo Sapiens; identical to SEQ ID NO: 40412

SEQ ID NO: 135897 - RNA, 64 nt, Homo Sapiens; identical to SEQ ID NO: 40413

SEQ ID NO: 135898 - RNA, 64 nt, Homo Sapiens; identical to SEQ ID NO: 40414

SEQ ID NO: 135899 - RNA, 64 nt, Homo Sapiens; identical to SEQ ID NO: 40415

SEQ ID NO: 135900 - RNA, 64 nt, Homo Sapiens; identical to SEQ ID NO: 40416

SEQ ID NO: 135901 - RNA, 64 nt, Homo Sapiens; identical to SEQ ID NO: 40417

SEQ ID NO: 135902 - RNA, 64 nt, Homo Sapiens; identical to SEQ ID NO: 40418

SEQ ID NO: 135903 - RNA, 64 nt, Homo Sapiens; identical to SEQ ID NO: 40419

SEQ ID NO: 135904 - RNA, 64 nt, Homo Sapiens; identical to SEQ ID NO: 40420

SEQ ID NO: 135905 - RNA, 64 nt, Homo Sapiens; identical to SEQ ID NO: 40421

SEQ ID NO: 135906 - RNA, 64 nt, Homo Sapiens; identical to SEQ ID NO: 40422

SEQ ID NO: 135907 - RNA, 64 nt, Homo Sapiens; identical to SEQ ID NO: 40423

SEQ ID NO: 135908 - RNA, 64 nt, Homo Sapiens; identical to SEQ ID NO: 40424

SEQ ID NO: 135909 - RNA, 64 nt, Homo Sapiens; identical to SEQ ID NO: 40425

SEQ ID NO: 135910 - RNA, 64 nt, Homo Sapiens; identical to SEQ ID NO: 40426

SEQ ID NO: 135911 - RNA, 64 nt, Homo Sapiens; identical to SEQ ID NO: 40427

SEQ ID NO: 135912 - RNA, 64 nt, Homo Sapiens; identical to SEQ ID NO: 40428

SEQ ID NO: 135913 - RNA, 64 nt, Homo Sapiens; identical to SEQ ID NO: 40429

SEQ ID NO: 135914 - RNA, 64 nt, Homo Sapiens; identical to SEQ ID NO: 40430

SEQ ID NO: 135915 - RNA, 64 nt, Homo Sapiens; identical to SEQ ID NO: 40431

SEQ ID NO: 135916 - RNA, 64 nt, Homo Sapiens; identical to SEQ ID NO: 40432

SEQ ID NO: 135917 - RNA, 64 nt, Homo Sapiens; identical to SEQ ID NO: 40433

SEQ ID NO: 135918 - RNA, 64 nt, Homo Sapiens; identical to SEQ ID NO: 40434

SEQ ID NO: 135919 - RNA, 64 nt, Homo Sapiens; identical to SEQ ID NO: 40435

SEQ ID NO: 135920 - RNA, 64 nt, Homo Sapiens; identical to SEQ ID NO: 40436

SEQ ID NO: 135921 - RNA, 64 nt, Homo Sapiens; identical to SEQ ID NO: 40437

SEQ ID NO: 135922 - RNA, 64 nt, Homo Sapiens; identical to SEQ ID NO: 40438

SEQ ID NO: 135923 - RNA, 64 nt, Homo Sapiens; identical to SEQ ID NO: 40439

SEQ ID NO: 135924 - RNA, 64 nt, Homo Sapiens; identical to SEQ ID NO: 40440

SEQ ID NO: 135925 - RNA, 64 nt, Homo Sapiens; identical to SEQ ID NO: 40441

SEQ ID NO: 135926 - RNA, 64 nt, Homo Sapiens; identical to SEQ ID NO: 40442

SEQ ID NO: 135927 - RNA, 64 nt, Homo Sapiens; identical to SEQ ID NO: 40443

SEQ ID NO: 135928 - RNA, 64 nt, Homo Sapiens; identical to SEQ ID NO: 40444

SEQ ID NO: 135929 - RNA, 64 nt, Homo Sapiens; identical to SEQ ID NO: 40445

SEQ ID NO: 135930 - RNA, 64 nt, Homo Sapiens; identical to SEQ ID NO: 40446

SEQ ID NO: 135931 - RNA, 64 nt, Homo Sapiens; identical to SEQ ID NO: 40447

SEQ ID NO: 135932 - RNA, 64 nt, Homo Sapiens; identical to SEQ ID NO: 40448

SEQ ID NO: 135933 - RNA, 64 nt, Homo Sapiens; identical to SEQ ID NO: 40449

SEQ ID NO: 135934 - RNA, 64 nt, Homo Sapiens; identical to SEQ ID NO: 40450

SEQ ID NO: 135935 - RNA, 64 nt, Homo Sapiens; identical to SEQ ID NO: 40451

SEQ ID NO: 135936 - RNA, 64 nt, Homo Sapiens; identical to SEQ ID NO: 40452

SEQ ID NO: 135937 - RNA, 64 nt, Homo Sapiens; identical to SEQ ID NO: 40453

SEQ ID NO: 135938 - RNA, 64 nt, Homo Sapiens; identical to SEQ ID NO: 40454

SEQ ID NO: 135939 - RNA, 64 nt, Homo Sapiens; identical to SEQ ID NO: 40455

SEQ ID NO: 135940 - RNA, 64 nt, Homo Sapiens; identical to SEQ ID NO: 40456

SEQ ID NO: 135941 - RNA, 64 nt, Homo Sapiens; identical to SEQ ID NO: 40457

SEQ ID NO: 135942 - RNA, 64 nt, Homo Sapiens; identical to SEQ ID NO: 40458

SEQ ID NO: 135943 - RNA, 64 nt, Homo Sapiens; identical to SEQ ID NO: 40459

SEQ ID NO: 135944 - RNA, 64 nt, Homo Sapiens; identical to SEQ ID NO: 40460

SEQ ID NO: 135945 - RNA, 64 nt, Homo Sapiens; identical to SEQ ID NO: 40461

SEQ ID NO: 135946 - RNA, 64 nt, Homo Sapiens; identical to SEQ ID NO: 40462

SEQ ID NO: 135947 - RNA, 64 nt, Homo Sapiens; identical to SEQ ID NO: 40463

SEQ ID NO: 135948 - RNA, 64 nt, Homo Sapiens; identical to SEQ ID NO: 40464

SEQ ID NO: 135949 - RNA, 64 nt, Homo Sapiens; identical to SEQ ID NO: 40465

SEQ ID NO: 135950 - RNA, 64 nt, Homo Sapiens; identical to SEQ ID NO: 40466

SEQ ID NO: 135951 - RNA, 64 nt, Homo Sapiens; identical to SEQ ID NO: 40467

SEQ ID NO: 135952 - RNA, 64 nt, Homo Sapiens; identical to SEQ ID NO: 40468

SEQ ID NO: 135953 - RNA, 64 nt, Homo Sapiens; identical to SEQ ID NO: 40469

SEQ ID NO: 135954 - RNA, 64 nt, Homo Sapiens; identical to SEQ ID NO: 40470

SEQ ID NO: 135955 - RNA, 64 nt, Homo Sapiens; identical to SEQ ID NO: 40471

SEQ ID NO: 135956 - RNA, 64 nt, Homo Sapiens; identical to SEQ ID NO: 40472

SEQ ID NO: 135957 - RNA, 64 nt, Homo Sapiens; identical to SEQ ID NO: 40473

SEQ ID NO: 135958 - RNA, 64 nt, Homo Sapiens; identical to SEQ ID NO: 40474

SEQ ID NO: 135959 - RNA, 64 nt, Homo Sapiens; identical to SEQ ID NO: 40475

SEQ ID NO: 135960 - RNA, 64 nt, Homo Sapiens; identical to SEQ ID NO: 40476

SEQ ID NO: 135961 - RNA, 64 nt, Homo Sapiens; identical to SEQ ID NO: 40477

SEQ ID NO: 135962 - RNA, 64 nt, Homo Sapiens; identical to SEQ ID NO: 40478

SEQ ID NO: 135963 - RNA, 64 nt, Homo Sapiens; identical to SEQ ID NO: 40479

SEQ ID NO: 135964 - RNA, 64 nt, Homo Sapiens; identical to SEQ ID NO: 40480

SEQ ID NO: 135965 - RNA, 64 nt, Homo Sapiens; identical to SEQ ID NO: 40481

SEQ ID NO: 135966 - RNA, 64 nt, Homo Sapiens; identical to SEQ ID NO: 40482

SEQ ID NO: 135967 - RNA, 64 nt, Homo Sapiens; identical to SEQ ID NO: 40483

SEQ ID NO: 135968 - RNA, 64 nt, Homo Sapiens; identical to SEQ ID NO: 40484

SEQ ID NO: 135969 - RNA, 64 nt, Homo Sapiens; identical to SEQ ID NO: 40485

SEQ ID NO: 135970 - RNA, 64 nt, Homo Sapiens; identical to SEQ ID NO: 40486

SEQ ID NO: 135971 - RNA, 64 nt, Homo Sapiens; identical to SEQ ID NO: 40487

SEQ ID NO: 135972 - RNA, 64 nt, Homo Sapiens; identical to SEQ ID NO: 40488

SEQ ID NO: 135973 - RNA, 64 nt, Homo Sapiens; identical to SEQ ID NO: 40489

SEQ ID NO: 135974 - RNA, 64 nt, Homo Sapiens; identical to SEQ ID NO: 40490

SEQ ID NO: 135975 - RNA, 64 nt, Homo Sapiens; identical to SEQ ID NO: 40491

SEQ ID NO: 135976 - RNA, 64 nt, Homo Sapiens; identical to SEQ ID NO: 40492

SEQ ID NO: 135977 - RNA, 64 nt, Homo Sapiens; identical to SEQ ID NO: 40493

SEQ ID NO: 135978 - RNA, 64 nt, Homo Sapiens; identical to SEQ ID NO: 40494

SEQ ID NO: 135979 - RNA, 64 nt, Homo Sapiens; identical to SEQ ID NO: 40495

SEQ ID NO: 135980 - RNA, 64 nt, Homo Sapiens; identical to SEQ ID NO: 40496

SEQ ID NO: 135981 - RNA, 64 nt, Homo Sapiens; identical to SEQ ID NO: 40497

SEQ ID NO: 135982 - RNA, 64 nt, Homo Sapiens; identical to SEQ ID NO: 40498

SEQ ID NO: 135983 - RNA, 64 nt, Homo Sapiens; identical to SEQ ID NO: 40499

SEQ ID NO: 135984 - RNA, 64 nt, Homo Sapiens; identical to SEQ ID NO: 40500

SEQ ID NO: 135985 - RNA, 64 nt, Homo Sapiens; identical to SEQ ID NO: 40501

SEQ ID NO: 135986 - RNA, 64 nt, Homo Sapiens; identical to SEQ ID NO: 40502

SEQ ID NO: 135987 - RNA, 64 nt, Homo Sapiens; identical to SEQ ID NO: 40503

SEQ ID NO: 135988 - RNA, 64 nt, Homo Sapiens; identical to SEQ ID NO: 40504

SEQ ID NO: 135989 - RNA, 64 nt, Homo Sapiens; identical to SEQ ID NO: 40505

SEQ ID NO: 135990 - RNA, 64 nt, Homo Sapiens; identical to SEQ ID NO: 40506

SEQ ID NO: 135991 - RNA, 64 nt, Homo Sapiens; identical to SEQ ID NO: 40507

SEQ ID NO: 135992 - RNA, 64 nt, Homo Sapiens; identical to SEQ ID NO: 40508

SEQ ID NO: 135993 - RNA, 64 nt, Homo Sapiens; identical to SEQ ID NO: 40509

SEQ ID NO: 135994 - RNA, 64 nt, Homo Sapiens; identical to SEQ ID NO: 40510

SEQ ID NO: 135995 - RNA, 64 nt, Homo Sapiens; identical to SEQ ID NO: 40511

SEQ ID NO: 135996 - RNA, 64 nt, Homo Sapiens; identical to SEQ ID NO: 40512

SEQ ID NO: 135997 - RNA, 64 nt, Homo Sapiens; identical to SEQ ID NO: 40513

SEQ ID NO: 135998 - RNA, 64 nt, Homo Sapiens; identical to SEQ ID NO: 40514

SEQ ID NO: 135999 - RNA, 64 nt, Homo Sapiens; identical to SEQ ID NO: 40515

SEQ ID NO: 136000 - RNA, 64 nt, Homo Sapiens; identical to SEQ ID NO: 40516

SEQ ID NO: 136001 - RNA, 64 nt, Homo Sapiens; identical to SEQ ID NO: 40517

SEQ ID NO: 136002 - RNA, 64 nt, Homo Sapiens; identical to SEQ ID NO: 40518

SEQ ID NO: 136003 - RNA, 64 nt, Homo Sapiens; identical to SEQ ID NO: 40519

SEQ ID NO: 136004 - RNA, 64 nt, Homo Sapiens; identical to SEQ ID NO: 40520

SEQ ID NO: 136005 - RNA, 64 nt, Homo Sapiens; identical to SEQ ID NO: 40521

SEQ ID NO: 136006 - RNA, 64 nt, Homo Sapiens; identical to SEQ ID NO: 40522

SEQ ID NO: 136007 - RNA, 64 nt, Homo Sapiens; identical to SEQ ID NO: 40523

SEQ ID NO: 136008 - RNA, 64 nt, Homo Sapiens; identical to SEQ ID NO: 40524

SEQ ID NO: 136009 - RNA, 64 nt, Homo Sapiens; identical to SEQ ID NO: 40525

SEQ ID NO: 136010 - RNA, 64 nt, Homo Sapiens; identical to SEQ ID NO: 40526

SEQ ID NO: 136011 - RNA, 64 nt, Homo Sapiens; identical to SEQ ID NO: 40527

SEQ ID NO: 136012 - RNA, 64 nt, Homo Sapiens; identical to SEQ ID NO: 40528

SEQ ID NO: 136013 - RNA, 64 nt, Homo Sapiens; identical to SEQ ID NO: 40529

SEQ ID NO: 136014 - RNA, 64 nt, Homo Sapiens; identical to SEQ ID NO: 40530

SEQ ID NO: 136015 - RNA, 64 nt, Homo Sapiens; identical to SEQ ID NO: 40531

SEQ ID NO: 136016 - RNA, 64 nt, Homo Sapiens; identical to SEQ ID NO: 40532

SEQ ID NO: 136017 - RNA, 64 nt, Homo Sapiens; identical to SEQ ID NO: 40533

SEQ ID NO: 136018 - RNA, 64 nt, Homo Sapiens; identical to SEQ ID NO: 40534

SEQ ID NO: 136019 - RNA, 64 nt, Homo Sapiens; identical to SEQ ID NO: 40535

SEQ ID NO: 136020 - RNA, 64 nt, Homo Sapiens; identical to SEQ ID NO: 40536

SEQ ID NO: 136021 - RNA, 64 nt, Homo Sapiens; identical to SEQ ID NO: 40537

SEQ ID NO: 136022 - RNA, 64 nt, Homo Sapiens; identical to SEQ ID NO: 40538

SEQ ID NO: 136023 - RNA, 64 nt, Homo Sapiens; identical to SEQ ID NO: 40539

SEQ ID NO: 136024 - RNA, 64 nt, Homo Sapiens; identical to SEQ ID NO: 40540

SEQ ID NO: 136025 - RNA, 64 nt, Homo Sapiens; identical to SEQ ID NO: 40541

SEQ ID NO: 136026 - RNA, 64 nt, Homo Sapiens; identical to SEQ ID NO: 40542

SEQ ID NO: 136027 - RNA, 64 nt, Homo Sapiens; identical to SEQ ID NO: 40543

SEQ ID NO: 136028 - RNA, 64 nt, Homo Sapiens; identical to SEQ ID NO: 40544

SEQ ID NO: 136029 - RNA, 64 nt, Homo Sapiens; identical to SEQ ID NO: 40545

SEQ ID NO: 136030 - RNA, 64 nt, Homo Sapiens; identical to SEQ ID NO: 40546

SEQ ID NO: 136031 - RNA, 64 nt, Homo Sapiens; identical to SEQ ID NO: 40547

SEQ ID NO: 136032 - RNA, 64 nt, Homo Sapiens; identical to SEQ ID NO: 40548

SEQ ID NO: 136033 - RNA, 64 nt, Homo Sapiens; identical to SEQ ID NO: 40549

SEQ ID NO: 136034 - RNA, 64 nt, Homo Sapiens; identical to SEQ ID NO: 40550

SEQ ID NO: 136035 - RNA, 64 nt, Homo Sapiens; identical to SEQ ID NO: 40551

SEQ ID NO: 136036 - RNA, 64 nt, Homo Sapiens; identical to SEQ ID NO: 40552

SEQ ID NO: 136037 - RNA, 64 nt, Homo Sapiens; identical to SEQ ID NO: 40553

SEQ ID NO: 136038 - RNA, 64 nt, Homo Sapiens; identical to SEQ ID NO: 40554

SEQ ID NO: 136039 - RNA, 64 nt, Homo Sapiens; identical to SEQ ID NO: 40555

SEQ ID NO: 136040 - RNA, 64 nt, Homo Sapiens; identical to SEQ ID NO: 40556

SEQ ID NO: 136041 - RNA, 64 nt, Homo Sapiens; identical to SEQ ID NO: 40557

SEQ ID NO: 136042 - RNA, 64 nt, Homo Sapiens; identical to SEQ ID NO: 40558

SEQ ID NO: 136043 - RNA, 64 nt, Homo Sapiens; identical to SEQ ID NO: 40559

SEQ ID NO: 136044 - RNA, 64 nt, Homo Sapiens; identical to SEQ ID NO: 40560

SEQ ID NO: 136045 - RNA, 64 nt, Homo Sapiens; identical to SEQ ID NO: 40561

SEQ ID NO: 136046 - RNA, 64 nt, Homo Sapiens; identical to SEQ ID NO: 40562

SEQ ID NO: 136047 - RNA, 64 nt, Homo Sapiens; identical to SEQ ID NO: 40563

SEQ ID NO: 136048 - RNA, 64 nt, Homo Sapiens; identical to SEQ ID NO: 40564

SEQ ID NO: 136049 - RNA, 64 nt, Homo Sapiens; identical to SEQ ID NO: 40565

SEQ ID NO: 136050 - RNA, 64 nt, Homo Sapiens; identical to SEQ ID NO: 40566

SEQ ID NO: 136051 - RNA, 64 nt, Homo Sapiens; identical to SEQ ID NO: 40567

SEQ ID NO: 136052 - RNA, 64 nt, Homo Sapiens; identical to SEQ ID NO: 40568

SEQ ID NO: 136053 - RNA, 64 nt, Homo Sapiens; identical to SEQ ID NO: 40569

SEQ ID NO: 136054 - RNA, 64 nt, Homo Sapiens; identical to SEQ ID NO: 40570

SEQ ID NO: 136055 - RNA, 64 nt, Homo Sapiens; identical to SEQ ID NO: 40571

SEQ ID NO: 136056 - RNA, 64 nt, Homo Sapiens; identical to SEQ ID NO: 40572

SEQ ID NO: 136057 - RNA, 64 nt, Homo Sapiens; identical to SEQ ID NO: 40573

SEQ ID NO: 136058 - RNA, 64 nt, Homo Sapiens; identical to SEQ ID NO: 40574

SEQ ID NO: 136059 - RNA, 64 nt, Homo Sapiens; identical to SEQ ID NO: 40575

SEQ ID NO: 136060 - RNA, 64 nt, Homo Sapiens; identical to SEQ ID NO: 40576

SEQ ID NO: 136061 - RNA, 64 nt, Homo Sapiens; identical to SEQ ID NO: 40577

SEQ ID NO: 136062 - RNA, 64 nt, Homo Sapiens; identical to SEQ ID NO: 40578

SEQ ID NO: 136063 - RNA, 64 nt, Homo Sapiens; identical to SEQ ID NO: 40579

SEQ ID NO: 136064 - RNA, 64 nt, Homo Sapiens; identical to SEQ ID NO: 40580

SEQ ID NO: 136065 - RNA, 64 nt, Homo Sapiens; identical to SEQ ID NO: 40581

SEQ ID NO: 136066 - RNA, 64 nt, Homo Sapiens; identical to SEQ ID NO: 40582

SEQ ID NO: 136067 - RNA, 64 nt, Homo Sapiens; identical to SEQ ID NO: 40583

SEQ ID NO: 136068 - RNA, 64 nt, Homo Sapiens; identical to SEQ ID NO: 40584

SEQ ID NO: 136069 - RNA, 64 nt, Homo Sapiens; identical to SEQ ID NO: 40585

SEQ ID NO: 136070 - RNA, 64 nt, Homo Sapiens; identical to SEQ ID NO: 40586

SEQ ID NO: 136071 - RNA, 64 nt, Homo Sapiens; identical to SEQ ID NO: 40587

SEQ ID NO: 136072 - RNA, 64 nt, Homo Sapiens; identical to SEQ ID NO: 40588

SEQ ID NO: 136073 - RNA, 64 nt, Homo Sapiens; identical to SEQ ID NO: 40589

SEQ ID NO: 136074 - RNA, 64 nt, Homo Sapiens; identical to SEQ ID NO: 40590

SEQ ID NO: 136075 - RNA, 64 nt, Homo Sapiens; identical to SEQ ID NO: 40591

SEQ ID NO: 136076 - RNA, 64 nt, Homo Sapiens; identical to SEQ ID NO: 40592

SEQ ID NO: 136077 - RNA, 64 nt, Homo Sapiens; identical to SEQ ID NO: 40593

SEQ ID NO: 136078 - RNA, 64 nt, Homo Sapiens; identical to SEQ ID NO: 40594

SEQ ID NO: 136079 - RNA, 64 nt, Homo Sapiens; identical to SEQ ID NO: 40595

SEQ ID NO: 136080 - RNA, 64 nt, Homo Sapiens; identical to SEQ ID NO: 40596

SEQ ID NO: 136081 - RNA, 64 nt, Homo Sapiens; identical to SEQ ID NO: 40597

SEQ ID NO: 136082 - RNA, 64 nt, Homo Sapiens; identical to SEQ ID NO: 40598

SEQ ID NO: 136083 - RNA, 64 nt, Homo Sapiens; identical to SEQ ID NO: 40599

SEQ ID NO: 136084 - RNA, 64 nt, Homo Sapiens; identical to SEQ ID NO: 40600

SEQ ID NO: 136085 - RNA, 64 nt, Homo Sapiens; identical to SEQ ID NO: 40601

SEQ ID NO: 136086 - RNA, 64 nt, Homo Sapiens; identical to SEQ ID NO: 40602

SEQ ID NO: 136087 - RNA, 64 nt, Homo Sapiens; identical to SEQ ID NO: 40603

SEQ ID NO: 136088 - RNA, 64 nt, Homo Sapiens; identical to SEQ ID NO: 40604

SEQ ID NO: 136089 - RNA, 64 nt, Homo Sapiens; identical to SEQ ID NO: 40605

SEQ ID NO: 136090 - RNA, 64 nt, Homo Sapiens; identical to SEQ ID NO: 40606

SEQ ID NO: 136091 - RNA, 64 nt, Homo Sapiens; identical to SEQ ID NO: 40607

SEQ ID NO: 136092 - RNA, 64 nt, Homo Sapiens; identical to SEQ ID NO: 40608

SEQ ID NO: 136093 - RNA, 64 nt, Homo Sapiens; identical to SEQ ID NO: 40609

SEQ ID NO: 136094 - RNA, 64 nt, Homo Sapiens; identical to SEQ ID NO: 40610

SEQ ID NO: 136095 - RNA, 64 nt, Homo Sapiens; identical to SEQ ID NO: 40611

SEQ ID NO: 136096 - RNA, 64 nt, Homo Sapiens; identical to SEQ ID NO: 40612

SEQ ID NO: 136097 - RNA, 64 nt, Homo Sapiens; identical to SEQ ID NO: 40613

SEQ ID NO: 136098 - RNA, 64 nt, Homo Sapiens; identical to SEQ ID NO: 40614

SEQ ID NO: 136099 - RNA, 64 nt, Homo Sapiens; identical to SEQ ID NO: 40615

SEQ ID NO: 136100 - RNA, 64 nt, Homo Sapiens; identical to SEQ ID NO: 40616

SEQ ID NO: 136101 - RNA, 64 nt, Homo Sapiens; identical to SEQ ID NO: 40617

SEQ ID NO: 136102 - RNA, 64 nt, Homo Sapiens; identical to SEQ ID NO: 40618

SEQ ID NO: 136103 - RNA, 64 nt, Homo Sapiens; identical to SEQ ID NO: 40619

SEQ ID NO: 136104 - RNA, 64 nt, Homo Sapiens; identical to SEQ ID NO: 40620

SEQ ID NO: 136105 - RNA, 64 nt, Homo Sapiens; identical to SEQ ID NO: 40621

SEQ ID NO: 136106 - RNA, 64 nt, Homo Sapiens; identical to SEQ ID NO: 40622

SEQ ID NO: 136107 - RNA, 64 nt, Homo Sapiens; identical to SEQ ID NO: 40623

SEQ ID NO: 136108 - RNA, 64 nt, Homo Sapiens; identical to SEQ ID NO: 40624

SEQ ID NO: 136109 - RNA, 64 nt, Homo Sapiens; identical to SEQ ID NO: 40625

SEQ ID NO: 136110 - RNA, 64 nt, Homo Sapiens; identical to SEQ ID NO: 40626

SEQ ID NO: 136111 - RNA, 64 nt, Homo Sapiens; identical to SEQ ID NO: 40627

SEQ ID NO: 136112 - RNA, 64 nt, Homo Sapiens; identical to SEQ ID NO: 40628

SEQ ID NO: 136113 - RNA, 64 nt, Homo Sapiens; identical to SEQ ID NO: 40629

SEQ ID NO: 136114 - RNA, 64 nt, Homo Sapiens; identical to SEQ ID NO: 40630

SEQ ID NO: 136115 - RNA, 64 nt, Homo Sapiens; identical to SEQ ID NO: 40631

SEQ ID NO: 136116 - RNA, 64 nt, Homo Sapiens; identical to SEQ ID NO: 40632

SEQ ID NO: 136117 - RNA, 64 nt, Homo Sapiens; identical to SEQ ID NO: 40633

SEQ ID NO: 136118 - RNA, 64 nt, Homo Sapiens; identical to SEQ ID NO: 40634

SEQ ID NO: 136119 - RNA, 64 nt, Homo Sapiens; identical to SEQ ID NO: 40635

SEQ ID NO: 136120 - RNA, 64 nt, Homo Sapiens; identical to SEQ ID NO: 40636

SEQ ID NO: 136121 - RNA, 64 nt, Homo Sapiens; identical to SEQ ID NO: 40637

SEQ ID NO: 136122 - RNA, 64 nt, Homo Sapiens; identical to SEQ ID NO: 40638

SEQ ID NO: 136123 - RNA, 64 nt, Homo Sapiens; identical to SEQ ID NO: 40639

SEQ ID NO: 136124 - RNA, 64 nt, Homo Sapiens; identical to SEQ ID NO: 40640

SEQ ID NO: 136125 - RNA, 64 nt, Homo Sapiens; identical to SEQ ID NO: 40641

SEQ ID NO: 136126 - RNA, 64 nt, Homo Sapiens; identical to SEQ ID NO: 40642

SEQ ID NO: 136127 - RNA, 64 nt, Homo Sapiens; identical to SEQ ID NO: 40643

SEQ ID NO: 136128 - RNA, 64 nt, Homo Sapiens; identical to SEQ ID NO: 40644

SEQ ID NO: 136129 - RNA, 64 nt, Homo Sapiens; identical to SEQ ID NO: 40645

SEQ ID NO: 136130 - RNA, 64 nt, Homo Sapiens; identical to SEQ ID NO: 40646

SEQ ID NO: 136131 - RNA, 64 nt, Homo Sapiens; identical to SEQ ID NO: 40647

SEQ ID NO: 136132 - RNA, 64 nt, Homo Sapiens; identical to SEQ ID NO: 40648

SEQ ID NO: 136133 - RNA, 64 nt, Homo Sapiens; identical to SEQ ID NO: 40649

SEQ ID NO: 136134 - RNA, 64 nt, Homo Sapiens; identical to SEQ ID NO: 40650

SEQ ID NO: 136135 - RNA, 64 nt, Homo Sapiens; identical to SEQ ID NO: 40651

SEQ ID NO: 136136 - RNA, 64 nt, Homo Sapiens; identical to SEQ ID NO: 40652

SEQ ID NO: 136137 - RNA, 64 nt, Homo Sapiens; identical to SEQ ID NO: 40653

SEQ ID NO: 136138 - RNA, 64 nt, Homo Sapiens; identical to SEQ ID NO: 40654

SEQ ID NO: 136139 - RNA, 64 nt, Homo Sapiens; identical to SEQ ID NO: 40655

SEQ ID NO: 136140 - RNA, 64 nt, Homo Sapiens; identical to SEQ ID NO: 40656

SEQ ID NO: 136141 - RNA, 64 nt, Homo Sapiens; identical to SEQ ID NO: 40657

SEQ ID NO: 136142 - RNA, 64 nt, Homo Sapiens; identical to SEQ ID NO: 40658

SEQ ID NO: 136143 - RNA, 64 nt, Homo Sapiens; identical to SEQ ID NO: 40659

SEQ ID NO: 136144 - RNA, 64 nt, Homo Sapiens; identical to SEQ ID NO: 40660

SEQ ID NO: 136145 - RNA, 64 nt, Homo Sapiens; identical to SEQ ID NO: 40661

SEQ ID NO: 136146 - RNA, 64 nt, Homo Sapiens; identical to SEQ ID NO: 40662

SEQ ID NO: 136147 - RNA, 64 nt, Homo Sapiens; identical to SEQ ID NO: 40663

SEQ ID NO: 136148 - RNA, 64 nt, Homo Sapiens; identical to SEQ ID NO: 40664

SEQ ID NO: 136149 - RNA, 64 nt, Homo Sapiens; identical to SEQ ID NO: 40665

SEQ ID NO: 136150 - RNA, 64 nt, Homo Sapiens; identical to SEQ ID NO: 40666

SEQ ID NO: 136151 - RNA, 64 nt, Homo Sapiens; identical to SEQ ID NO: 40667

SEQ ID NO: 136152 - RNA, 64 nt, Homo Sapiens; identical to SEQ ID NO: 40668

SEQ ID NO: 136153 - RNA, 64 nt, Homo Sapiens; identical to SEQ ID NO: 40669

SEQ ID NO: 136154 - RNA, 64 nt, Homo Sapiens; identical to SEQ ID NO: 40670

SEQ ID NO: 136155 - RNA, 64 nt, Homo Sapiens; identical to SEQ ID NO: 40671

SEQ ID NO: 136156 - RNA, 64 nt, Homo Sapiens; identical to SEQ ID NO: 40672

SEQ ID NO: 136157 - RNA, 64 nt, Homo Sapiens; identical to SEQ ID NO: 40673

SEQ ID NO: 136158 - RNA, 64 nt, Homo Sapiens; identical to SEQ ID NO: 40674

SEQ ID NO: 136159 - RNA, 64 nt, Homo Sapiens; identical to SEQ ID NO: 40675

SEQ ID NO: 136160 - RNA, 64 nt, Homo Sapiens; identical to SEQ ID NO: 40676

SEQ ID NO: 136161 - RNA, 64 nt, Homo Sapiens; identical to SEQ ID NO: 40677

SEQ ID NO: 136162 - RNA, 64 nt, Homo Sapiens; identical to SEQ ID NO: 40678

SEQ ID NO: 136163 - RNA, 64 nt, Homo Sapiens; identical to SEQ ID NO: 40679

SEQ ID NO: 136164 - RNA, 64 nt, Homo Sapiens; identical to SEQ ID NO: 40680

SEQ ID NO: 136165 - RNA, 64 nt, Homo Sapiens; identical to SEQ ID NO: 40681

SEQ ID NO: 136166 - RNA, 64 nt, Homo Sapiens; identical to SEQ ID NO: 40682

SEQ ID NO: 136167 - RNA, 64 nt, Homo Sapiens; identical to SEQ ID NO: 40683

SEQ ID NO: 136168 - RNA, 64 nt, Homo Sapiens; identical to SEQ ID NO: 40684

SEQ ID NO: 136169 - RNA, 64 nt, Homo Sapiens; identical to SEQ ID NO: 40685

SEQ ID NO: 136170 - RNA, 64 nt, Homo Sapiens; identical to SEQ ID NO: 40686

SEQ ID NO: 136171 - RNA, 64 nt, Homo Sapiens; identical to SEQ ID NO: 40687

SEQ ID NO: 136172 - RNA, 64 nt, Homo Sapiens; identical to SEQ ID NO: 40688

SEQ ID NO: 136173 - RNA, 64 nt, Homo Sapiens; identical to SEQ ID NO: 40689

SEQ ID NO: 136174 - RNA, 64 nt, Homo Sapiens; identical to SEQ ID NO: 40690

SEQ ID NO: 136175 - RNA, 64 nt, Homo Sapiens; identical to SEQ ID NO: 40691

SEQ ID NO: 136176 - RNA, 64 nt, Homo Sapiens; identical to SEQ ID NO: 40692

SEQ ID NO: 136177 - RNA, 64 nt, Homo Sapiens; identical to SEQ ID NO: 40693

SEQ ID NO: 136178 - RNA, 64 nt, Homo Sapiens; identical to SEQ ID NO: 40694

SEQ ID NO: 136179 - RNA, 64 nt, Homo Sapiens; identical to SEQ ID NO: 40695

SEQ ID NO: 136180 - RNA, 64 nt, Homo Sapiens; identical to SEQ ID NO: 40696

SEQ ID NO: 136181 - RNA, 64 nt, Homo Sapiens; identical to SEQ ID NO: 40697

SEQ ID NO: 136182 - RNA, 64 nt, Homo Sapiens; identical to SEQ ID NO: 40698

SEQ ID NO: 136183 - RNA, 64 nt, Homo Sapiens; identical to SEQ ID NO: 40699

SEQ ID NO: 136184 - RNA, 64 nt, Homo Sapiens; identical to SEQ ID NO: 40700

SEQ ID NO: 136185 - RNA, 64 nt, Homo Sapiens; identical to SEQ ID NO: 40701

SEQ ID NO: 136186 - RNA, 64 nt, Homo Sapiens; identical to SEQ ID NO: 40702

SEQ ID NO: 136187 - RNA, 64 nt, Homo Sapiens; identical to SEQ ID NO: 40703

SEQ ID NO: 136188 - RNA, 64 nt, Homo Sapiens; identical to SEQ ID NO: 40704

SEQ ID NO: 136189 - RNA, 64 nt, Homo Sapiens; identical to SEQ ID NO: 40705

SEQ ID NO: 136190 - RNA, 64 nt, Homo Sapiens; identical to SEQ ID NO: 40706

SEQ ID NO: 136191 - RNA, 64 nt, Homo Sapiens; identical to SEQ ID NO: 40707

SEQ ID NO: 136192 - RNA, 64 nt, Homo Sapiens; identical to SEQ ID NO: 40708

SEQ ID NO: 136193 - RNA, 64 nt, Homo Sapiens; identical to SEQ ID NO: 40709

SEQ ID NO: 136194 - RNA, 64 nt, Homo Sapiens; identical to SEQ ID NO: 40710

SEQ ID NO: 136195 - RNA, 64 nt, Homo Sapiens; identical to SEQ ID NO: 40711

SEQ ID NO: 136196 - RNA, 64 nt, Homo Sapiens; identical to SEQ ID NO: 40712

SEQ ID NO: 136197 - RNA, 64 nt, Homo Sapiens; identical to SEQ ID NO: 40713

SEQ ID NO: 136198 - RNA, 64 nt, Homo Sapiens; identical to SEQ ID NO: 40714

SEQ ID NO: 136199 - RNA, 64 nt, Homo Sapiens; identical to SEQ ID NO: 40715

SEQ ID NO: 136200 - RNA, 64 nt, Homo Sapiens; identical to SEQ ID NO: 40716

SEQ ID NO: 136201 - RNA, 64 nt, Homo Sapiens; identical to SEQ ID NO: 40717

SEQ ID NO: 136202 - RNA, 64 nt, Homo Sapiens; identical to SEQ ID NO: 40718

SEQ ID NO: 136203 - RNA, 64 nt, Homo Sapiens; identical to SEQ ID NO: 40719

SEQ ID NO: 136204 - RNA, 64 nt, Homo Sapiens; identical to SEQ ID NO: 40720

SEQ ID NO: 136205 - RNA, 64 nt, Homo Sapiens; identical to SEQ ID NO: 40721

SEQ ID NO: 136206 - RNA, 64 nt, Homo Sapiens; identical to SEQ ID NO: 40722

SEQ ID NO: 136207 - RNA, 64 nt, Homo Sapiens; identical to SEQ ID NO: 40723

SEQ ID NO: 136208 - RNA, 64 nt, Homo Sapiens; identical to SEQ ID NO: 40724

SEQ ID NO: 136209 - RNA, 64 nt, Homo Sapiens; identical to SEQ ID NO: 40725

SEQ ID NO: 136210 - RNA, 64 nt, Homo Sapiens; identical to SEQ ID NO: 40726

SEQ ID NO: 136211 - RNA, 64 nt, Homo Sapiens; identical to SEQ ID NO: 40727

SEQ ID NO: 136212 - RNA, 64 nt, Homo Sapiens; identical to SEQ ID NO: 40728

SEQ ID NO: 136213 - RNA, 64 nt, Homo Sapiens; identical to SEQ ID NO: 40729

SEQ ID NO: 136214 - RNA, 64 nt, Homo Sapiens; identical to SEQ ID NO: 40730

SEQ ID NO: 136215 - RNA, 64 nt, Homo Sapiens; identical to SEQ ID NO: 40731

SEQ ID NO: 136216 - RNA, 64 nt, Homo Sapiens; identical to SEQ ID NO: 40732

SEQ ID NO: 136217 - RNA, 64 nt, Homo Sapiens; identical to SEQ ID NO: 40733

SEQ ID NO: 136218 - RNA, 64 nt, Homo Sapiens; identical to SEQ ID NO: 40734

SEQ ID NO: 136219 - RNA, 64 nt, Homo Sapiens; identical to SEQ ID NO: 40735

SEQ ID NO: 136220 - RNA, 64 nt, Homo Sapiens; identical to SEQ ID NO: 40736

SEQ ID NO: 136221 - RNA, 64 nt, Homo Sapiens; identical to SEQ ID NO: 40737

SEQ ID NO: 136222 - RNA, 64 nt, Homo Sapiens; identical to SEQ ID NO: 40738

SEQ ID NO: 136223 - RNA, 64 nt, Homo Sapiens; identical to SEQ ID NO: 40739

SEQ ID NO: 136224 - RNA, 64 nt, Homo Sapiens; identical to SEQ ID NO: 40740

SEQ ID NO: 136225 - RNA, 64 nt, Homo Sapiens; identical to SEQ ID NO: 40741

SEQ ID NO: 136226 - RNA, 64 nt, Homo Sapiens; identical to SEQ ID NO: 40742

SEQ ID NO: 136227 - RNA, 64 nt, Homo Sapiens; identical to SEQ ID NO: 40743

SEQ ID NO: 136228 - RNA, 64 nt, Homo Sapiens; identical to SEQ ID NO: 40744

SEQ ID NO: 136229 - RNA, 64 nt, Homo Sapiens; identical to SEQ ID NO: 40745

SEQ ID NO: 136230 - RNA, 64 nt, Homo Sapiens; identical to SEQ ID NO: 40746

SEQ ID NO: 136231 - RNA, 64 nt, Homo Sapiens; identical to SEQ ID NO: 40747

SEQ ID NO: 136232 - RNA, 64 nt, Homo Sapiens; identical to SEQ ID NO: 40748

SEQ ID NO: 136233 - RNA, 64 nt, Homo Sapiens; identical to SEQ ID NO: 40749

SEQ ID NO: 136234 - RNA, 64 nt, Homo Sapiens; identical to SEQ ID NO: 40750

SEQ ID NO: 136235 - RNA, 64 nt, Homo Sapiens; identical to SEQ ID NO: 40751

SEQ ID NO: 136236 - RNA, 64 nt, Homo Sapiens; identical to SEQ ID NO: 40752

SEQ ID NO: 136237 - RNA, 64 nt, Homo Sapiens; identical to SEQ ID NO: 40753

SEQ ID NO: 136238 - RNA, 64 nt, Homo Sapiens; identical to SEQ ID NO: 40754

SEQ ID NO: 136239 - RNA, 64 nt, Homo Sapiens; identical to SEQ ID NO: 40755

SEQ ID NO: 136240 - RNA, 64 nt, Homo Sapiens; identical to SEQ ID NO: 40756

SEQ ID NO: 136241 - RNA, 64 nt, Homo Sapiens; identical to SEQ ID NO: 40757

SEQ ID NO: 136242 - RNA, 64 nt, Homo Sapiens; identical to SEQ ID NO: 40758

SEQ ID NO: 136243 - RNA, 64 nt, Homo Sapiens; identical to SEQ ID NO: 40759

SEQ ID NO: 136244 - RNA, 64 nt, Homo Sapiens; identical to SEQ ID NO: 40760

SEQ ID NO: 136245 - RNA, 64 nt, Homo Sapiens; identical to SEQ ID NO: 40761

SEQ ID NO: 136246 - RNA, 64 nt, Homo Sapiens; identical to SEQ ID NO: 40762

SEQ ID NO: 136247 - RNA, 64 nt, Homo Sapiens; identical to SEQ ID NO: 40763

SEQ ID NO: 136248 - RNA, 64 nt, Homo Sapiens; identical to SEQ ID NO: 40764

SEQ ID NO: 136249 - RNA, 64 nt, Homo Sapiens; identical to SEQ ID NO: 40765

SEQ ID NO: 136250 - RNA, 64 nt, Homo Sapiens; identical to SEQ ID NO: 40766

SEQ ID NO: 136251 - RNA, 64 nt, Homo Sapiens; identical to SEQ ID NO: 40767

SEQ ID NO: 136252 - RNA, 64 nt, Homo Sapiens; identical to SEQ ID NO: 40768

SEQ ID NO: 136253 - RNA, 64 nt, Homo Sapiens; identical to SEQ ID NO: 40769

SEQ ID NO: 136254 - RNA, 64 nt, Homo Sapiens; identical to SEQ ID NO: 40770

SEQ ID NO: 136255 - RNA, 64 nt, Homo Sapiens; identical to SEQ ID NO: 40771

SEQ ID NO: 136256 - RNA, 64 nt, Homo Sapiens; identical to SEQ ID NO: 40772

SEQ ID NO: 136257 - RNA, 64 nt, Homo Sapiens; identical to SEQ ID NO: 40773

SEQ ID NO: 136258 - RNA, 64 nt, Homo Sapiens; identical to SEQ ID NO: 40774

SEQ ID NO: 136259 - RNA, 64 nt, Homo Sapiens; identical to SEQ ID NO: 40775

SEQ ID NO: 136260 - RNA, 64 nt, Homo Sapiens; identical to SEQ ID NO: 40776

SEQ ID NO: 136261 - RNA, 64 nt, Homo Sapiens; identical to SEQ ID NO: 40777

SEQ ID NO: 136262 - RNA, 64 nt, Homo Sapiens; identical to SEQ ID NO: 40778

SEQ ID NO: 136263 - RNA, 64 nt, Homo Sapiens; identical to SEQ ID NO: 40779

SEQ ID NO: 136264 - RNA, 64 nt, Homo Sapiens; identical to SEQ ID NO: 40780

SEQ ID NO: 136265 - RNA, 64 nt, Homo Sapiens; identical to SEQ ID NO: 40781

SEQ ID NO: 136266 - RNA, 64 nt, Homo Sapiens; identical to SEQ ID NO: 40782

SEQ ID NO: 136267 - RNA, 64 nt, Homo Sapiens; identical to SEQ ID NO: 40783

SEQ ID NO: 136268 - RNA, 64 nt, Homo Sapiens; identical to SEQ ID NO: 40784

SEQ ID NO: 136269 - RNA, 64 nt, Homo Sapiens; identical to SEQ ID NO: 40785

SEQ ID NO: 136270 - RNA, 64 nt, Homo Sapiens; identical to SEQ ID NO: 40786

SEQ ID NO: 136271 - RNA, 64 nt, Homo Sapiens; identical to SEQ ID NO: 40787

SEQ ID NO: 136272 - RNA, 64 nt, Homo Sapiens; identical to SEQ ID NO: 40788

SEQ ID NO: 136273 - RNA, 64 nt, Homo Sapiens; identical to SEQ ID NO: 40789

SEQ ID NO: 136274 - RNA, 64 nt, Homo Sapiens; identical to SEQ ID NO: 40790

SEQ ID NO: 136275 - RNA, 64 nt, Homo Sapiens; identical to SEQ ID NO: 40791

SEQ ID NO: 136276 - RNA, 64 nt, Homo Sapiens; identical to SEQ ID NO: 40792

SEQ ID NO: 136277 - RNA, 64 nt, Homo Sapiens; identical to SEQ ID NO: 40793

SEQ ID NO: 136278 - RNA, 64 nt, Homo Sapiens; identical to SEQ ID NO: 40794

SEQ ID NO: 136279 - RNA, 64 nt, Homo Sapiens; identical to SEQ ID NO: 40795

SEQ ID NO: 136280 - RNA, 64 nt, Homo Sapiens; identical to SEQ ID NO: 40796

SEQ ID NO: 136281 - RNA, 64 nt, Homo Sapiens; identical to SEQ ID NO: 40797

SEQ ID NO: 136282 - RNA, 64 nt, Homo Sapiens; identical to SEQ ID NO: 40798

SEQ ID NO: 136283 - RNA, 64 nt, Homo Sapiens; identical to SEQ ID NO: 40799

SEQ ID NO: 136284 - RNA, 64 nt, Homo Sapiens; identical to SEQ ID NO: 40800

SEQ ID NO: 136285 - RNA, 64 nt, Homo Sapiens; identical to SEQ ID NO: 40801

SEQ ID NO: 136286 - RNA, 64 nt, Homo Sapiens; identical to SEQ ID NO: 40802

SEQ ID NO: 136287 - RNA, 64 nt, Homo Sapiens; identical to SEQ ID NO: 40803

SEQ ID NO: 136288 - RNA, 64 nt, Homo Sapiens; identical to SEQ ID NO: 40804

SEQ ID NO: 136289 - RNA, 64 nt, Homo Sapiens; identical to SEQ ID NO: 40805

SEQ ID NO: 136290 - RNA, 64 nt, Homo Sapiens; identical to SEQ ID NO: 40806

SEQ ID NO: 136291 - RNA, 64 nt, Homo Sapiens; identical to SEQ ID NO: 40807

SEQ ID NO: 136292 - RNA, 64 nt, Homo Sapiens; identical to SEQ ID NO: 40808

SEQ ID NO: 136293 - RNA, 64 nt, Homo Sapiens; identical to SEQ ID NO: 40809

SEQ ID NO: 136294 - RNA, 64 nt, Homo Sapiens; identical to SEQ ID NO: 40810

SEQ ID NO: 136295 - RNA, 64 nt, Homo Sapiens; identical to SEQ ID NO: 40811

SEQ ID NO: 136296 - RNA, 64 nt, Homo Sapiens; identical to SEQ ID NO: 40812

SEQ ID NO: 136297 - RNA, 64 nt, Homo Sapiens; identical to SEQ ID NO: 40813

SEQ ID NO: 136298 - RNA, 64 nt, Homo Sapiens; identical to SEQ ID NO: 40814

SEQ ID NO: 136299 - RNA, 64 nt, Homo Sapiens; identical to SEQ ID NO: 40815

SEQ ID NO: 136300 - RNA, 64 nt, Homo Sapiens; identical to SEQ ID NO: 40816

SEQ ID NO: 136301 - RNA, 64 nt, Homo Sapiens; identical to SEQ ID NO: 40817

SEQ ID NO: 136302 - RNA, 64 nt, Homo Sapiens; identical to SEQ ID NO: 40818

SEQ ID NO: 136303 - RNA, 64 nt, Homo Sapiens; identical to SEQ ID NO: 40819

SEQ ID NO: 136304 - RNA, 64 nt, Homo Sapiens; identical to SEQ ID NO: 40820

SEQ ID NO: 136305 - RNA, 64 nt, Homo Sapiens; identical to SEQ ID NO: 40821

SEQ ID NO: 136306 - RNA, 64 nt, Homo Sapiens; identical to SEQ ID NO: 40822

SEQ ID NO: 136307 - RNA, 64 nt, Homo Sapiens; identical to SEQ ID NO: 40823

SEQ ID NO: 136308 - RNA, 64 nt, Homo Sapiens; identical to SEQ ID NO: 40824

SEQ ID NO: 136309 - RNA, 64 nt, Homo Sapiens; identical to SEQ ID NO: 40825

SEQ ID NO: 136310 - RNA, 64 nt, Homo Sapiens; identical to SEQ ID NO: 40826

SEQ ID NO: 136311 - RNA, 64 nt, Homo Sapiens; identical to SEQ ID NO: 40827

SEQ ID NO: 136312 - RNA, 64 nt, Homo Sapiens; identical to SEQ ID NO: 40828

SEQ ID NO: 136313 - RNA, 64 nt, Homo Sapiens; identical to SEQ ID NO: 40829

SEQ ID NO: 136314 - RNA, 64 nt, Homo Sapiens; identical to SEQ ID NO: 40830

SEQ ID NO: 136315 - RNA, 64 nt, Homo Sapiens; identical to SEQ ID NO: 40831

SEQ ID NO: 136316 - RNA, 64 nt, Homo Sapiens; identical to SEQ ID NO: 40832

SEQ ID NO: 136317 - RNA, 64 nt, Homo Sapiens; identical to SEQ ID NO: 40833

SEQ ID NO: 136318 - RNA, 64 nt, Homo Sapiens; identical to SEQ ID NO: 40834

SEQ ID NO: 136319 - RNA, 64 nt, Homo Sapiens; identical to SEQ ID NO: 40835

SEQ ID NO: 136320 - RNA, 64 nt, Homo Sapiens; identical to SEQ ID NO: 40836

SEQ ID NO: 136321 - RNA, 64 nt, Homo Sapiens; identical to SEQ ID NO: 40837

SEQ ID NO: 136322 - RNA, 64 nt, Homo Sapiens; identical to SEQ ID NO: 40838

SEQ ID NO: 136323 - RNA, 64 nt, Homo Sapiens; identical to SEQ ID NO: 40839

SEQ ID NO: 136324 - RNA, 64 nt, Homo Sapiens; identical to SEQ ID NO: 40840

SEQ ID NO: 136325 - RNA, 64 nt, Homo Sapiens; identical to SEQ ID NO: 40841

SEQ ID NO: 136326 - RNA, 64 nt, Homo Sapiens; identical to SEQ ID NO: 40842

SEQ ID NO: 136327 - RNA, 64 nt, Homo Sapiens; identical to SEQ ID NO: 40843

SEQ ID NO: 136328 - RNA, 64 nt, Homo Sapiens; identical to SEQ ID NO: 40844

SEQ ID NO: 136329 - RNA, 64 nt, Homo Sapiens; identical to SEQ ID NO: 40845

SEQ ID NO: 136330 - RNA, 64 nt, Homo Sapiens; identical to SEQ ID NO: 40846

SEQ ID NO: 136331 - RNA, 64 nt, Homo Sapiens; identical to SEQ ID NO: 40847

SEQ ID NO: 136332 - RNA, 64 nt, Homo Sapiens; identical to SEQ ID NO: 40848

SEQ ID NO: 136333 - RNA, 64 nt, Homo Sapiens; identical to SEQ ID NO: 40849

SEQ ID NO: 136334 - RNA, 64 nt, Homo Sapiens; identical to SEQ ID NO: 40850

SEQ ID NO: 136335 - RNA, 64 nt, Homo Sapiens; identical to SEQ ID NO: 40851

SEQ ID NO: 136336 - RNA, 64 nt, Homo Sapiens; identical to SEQ ID NO: 40852

SEQ ID NO: 136337 - RNA, 64 nt, Homo Sapiens; identical to SEQ ID NO: 40853

SEQ ID NO: 136338 - RNA, 64 nt, Homo Sapiens; identical to SEQ ID NO: 40854

SEQ ID NO: 136339 - RNA, 64 nt, Homo Sapiens; identical to SEQ ID NO: 40855

SEQ ID NO: 136340 - RNA, 64 nt, Homo Sapiens; identical to SEQ ID NO: 40856

SEQ ID NO: 136341 - RNA, 64 nt, Homo Sapiens; identical to SEQ ID NO: 40857

SEQ ID NO: 136342 - RNA, 64 nt, Homo Sapiens; identical to SEQ ID NO: 40858

SEQ ID NO: 136343 - RNA, 64 nt, Homo Sapiens; identical to SEQ ID NO: 40859

SEQ ID NO: 136344 - RNA, 64 nt, Homo Sapiens; identical to SEQ ID NO: 40860

SEQ ID NO: 136345 - RNA, 64 nt, Homo Sapiens; identical to SEQ ID NO: 40861

SEQ ID NO: 136346 - RNA, 64 nt, Homo Sapiens; identical to SEQ ID NO: 40862

SEQ ID NO: 136347 - RNA, 64 nt, Homo Sapiens; identical to SEQ ID NO: 40863

SEQ ID NO: 136348 - RNA, 64 nt, Homo Sapiens; identical to SEQ ID NO: 40864

SEQ ID NO: 136349 - RNA, 64 nt, Homo Sapiens; identical to SEQ ID NO: 40865

SEQ ID NO: 136350 - RNA, 64 nt, Homo Sapiens; identical to SEQ ID NO: 40866

SEQ ID NO: 136351 - RNA, 64 nt, Homo Sapiens; identical to SEQ ID NO: 40867

SEQ ID NO: 136352 - RNA, 64 nt, Homo Sapiens; identical to SEQ ID NO: 40868

SEQ ID NO: 136353 - RNA, 64 nt, Homo Sapiens; identical to SEQ ID NO: 40869

SEQ ID NO: 136354 - RNA, 64 nt, Homo Sapiens; identical to SEQ ID NO: 40870

SEQ ID NO: 136355 - RNA, 64 nt, Homo Sapiens; identical to SEQ ID NO: 40871

SEQ ID NO: 136356 - RNA, 64 nt, Homo Sapiens; identical to SEQ ID NO: 40872

SEQ ID NO: 136357 - RNA, 64 nt, Homo Sapiens; identical to SEQ ID NO: 40873

SEQ ID NO: 136358 - RNA, 64 nt, Homo Sapiens; identical to SEQ ID NO: 40874

SEQ ID NO: 136359 - RNA, 64 nt, Homo Sapiens; identical to SEQ ID NO: 40875

SEQ ID NO: 136360 - RNA, 64 nt, Homo Sapiens; identical to SEQ ID NO: 40876

SEQ ID NO: 136361 - RNA, 64 nt, Homo Sapiens; identical to SEQ ID NO: 40877

SEQ ID NO: 136362 - RNA, 64 nt, Homo Sapiens; identical to SEQ ID NO: 40878

SEQ ID NO: 136363 - RNA, 64 nt, Homo Sapiens; identical to SEQ ID NO: 40879

SEQ ID NO: 136364 - RNA, 64 nt, Homo Sapiens; identical to SEQ ID NO: 40880

SEQ ID NO: 136365 - RNA, 64 nt, Homo Sapiens; identical to SEQ ID NO: 40881

SEQ ID NO: 136366 - RNA, 64 nt, Homo Sapiens; identical to SEQ ID NO: 40882

SEQ ID NO: 136367 - RNA, 64 nt, Homo Sapiens; identical to SEQ ID NO: 40883

SEQ ID NO: 136368 - RNA, 64 nt, Homo Sapiens; identical to SEQ ID NO: 40884

SEQ ID NO: 136369 - RNA, 64 nt, Homo Sapiens; identical to SEQ ID NO: 40885

SEQ ID NO: 136370 - RNA, 64 nt, Homo Sapiens; identical to SEQ ID NO: 40886

SEQ ID NO: 136371 - RNA, 64 nt, Homo Sapiens; identical to SEQ ID NO: 40887

SEQ ID NO: 136372 - RNA, 64 nt, Homo Sapiens; identical to SEQ ID NO: 40888

SEQ ID NO: 136373 - RNA, 64 nt, Homo Sapiens; identical to SEQ ID NO: 40889

SEQ ID NO: 136374 - RNA, 64 nt, Homo Sapiens; identical to SEQ ID NO: 40890

SEQ ID NO: 136375 - RNA, 64 nt, Homo Sapiens; identical to SEQ ID NO: 40891

SEQ ID NO: 136376 - RNA, 64 nt, Homo Sapiens; identical to SEQ ID NO: 40892

SEQ ID NO: 136377 - RNA, 64 nt, Homo Sapiens; identical to SEQ ID NO: 40893

SEQ ID NO: 136378 - RNA, 64 nt, Homo Sapiens; identical to SEQ ID NO: 40894

SEQ ID NO: 136379 - RNA, 64 nt, Homo Sapiens; identical to SEQ ID NO: 40895

SEQ ID NO: 136380 - RNA, 64 nt, Homo Sapiens; identical to SEQ ID NO: 40896

SEQ ID NO: 136381 - RNA, 64 nt, Homo Sapiens; identical to SEQ ID NO: 40897

SEQ ID NO: 136382 - RNA, 64 nt, Homo Sapiens; identical to SEQ ID NO: 40898

SEQ ID NO: 136383 - RNA, 64 nt, Homo Sapiens; identical to SEQ ID NO: 40899

SEQ ID NO: 136384 - RNA, 64 nt, Homo Sapiens; identical to SEQ ID NO: 40900

SEQ ID NO: 136385 - RNA, 64 nt, Homo Sapiens; identical to SEQ ID NO: 40901

SEQ ID NO: 136386 - RNA, 64 nt, Homo Sapiens; identical to SEQ ID NO: 40902

SEQ ID NO: 136387 - RNA, 64 nt, Homo Sapiens; identical to SEQ ID NO: 40903

SEQ ID NO: 136388 - RNA, 64 nt, Homo Sapiens; identical to SEQ ID NO: 40904

SEQ ID NO: 136389 - RNA, 64 nt, Homo Sapiens; identical to SEQ ID NO: 40905

SEQ ID NO: 136390 - RNA, 64 nt, Homo Sapiens; identical to SEQ ID NO: 40906

SEQ ID NO: 136391 - RNA, 64 nt, Homo Sapiens; identical to SEQ ID NO: 40907

SEQ ID NO: 136392 - RNA, 64 nt, Homo Sapiens; identical to SEQ ID NO: 40908

SEQ ID NO: 136393 - RNA, 64 nt, Homo Sapiens; identical to SEQ ID NO: 40909

SEQ ID NO: 136394 - RNA, 64 nt, Homo Sapiens; identical to SEQ ID NO: 40910

SEQ ID NO: 136395 - RNA, 64 nt, Homo Sapiens; identical to SEQ ID NO: 40911

SEQ ID NO: 136396 - RNA, 64 nt, Homo Sapiens; identical to SEQ ID NO: 40912

SEQ ID NO: 136397 - RNA, 64 nt, Homo Sapiens; identical to SEQ ID NO: 40913

SEQ ID NO: 136398 - RNA, 64 nt, Homo Sapiens; identical to SEQ ID NO: 40914

SEQ ID NO: 136399 - RNA, 64 nt, Homo Sapiens; identical to SEQ ID NO: 40915

SEQ ID NO: 136400 - RNA, 64 nt, Homo Sapiens; identical to SEQ ID NO: 40916

SEQ ID NO: 136401 - RNA, 64 nt, Homo Sapiens; identical to SEQ ID NO: 40917

SEQ ID NO: 136402 - RNA, 64 nt, Homo Sapiens; identical to SEQ ID NO: 40918

SEQ ID NO: 136403 - RNA, 64 nt, Homo Sapiens; identical to SEQ ID NO: 40919

SEQ ID NO: 136404 - RNA, 64 nt, Homo Sapiens; identical to SEQ ID NO: 40920

SEQ ID NO: 136405 - RNA, 64 nt, Homo Sapiens; identical to SEQ ID NO: 40921

SEQ ID NO: 136406 - RNA, 64 nt, Homo Sapiens; identical to SEQ ID NO: 40922

SEQ ID NO: 136407 - RNA, 64 nt, Homo Sapiens; identical to SEQ ID NO: 40923

SEQ ID NO: 136408 - RNA, 64 nt, Homo Sapiens; identical to SEQ ID NO: 40924

SEQ ID NO: 136409 - RNA, 64 nt, Homo Sapiens; identical to SEQ ID NO: 40925

SEQ ID NO: 136410 - RNA, 64 nt, Homo Sapiens; identical to SEQ ID NO: 40926

SEQ ID NO: 136411 - RNA, 64 nt, Homo Sapiens; identical to SEQ ID NO: 40927

SEQ ID NO: 136412 - RNA, 64 nt, Homo Sapiens; identical to SEQ ID NO: 40928

SEQ ID NO: 136413 - RNA, 64 nt, Homo Sapiens; identical to SEQ ID NO: 40929

SEQ ID NO: 136414 - RNA, 64 nt, Homo Sapiens; identical to SEQ ID NO: 40930

SEQ ID NO: 136415 - RNA, 64 nt, Homo Sapiens; identical to SEQ ID NO: 40931

SEQ ID NO: 136416 - RNA, 64 nt, Homo Sapiens; identical to SEQ ID NO: 40932

SEQ ID NO: 136417 - RNA, 64 nt, Homo Sapiens; identical to SEQ ID NO: 40933

SEQ ID NO: 136418 - RNA, 64 nt, Homo Sapiens; identical to SEQ ID NO: 40934

SEQ ID NO: 136419 - RNA, 64 nt, Homo Sapiens; identical to SEQ ID NO: 40935

SEQ ID NO: 136420 - RNA, 64 nt, Homo Sapiens; identical to SEQ ID NO: 40936

SEQ ID NO: 136421 - RNA, 64 nt, Homo Sapiens; identical to SEQ ID NO: 40937

SEQ ID NO: 136422 - RNA, 64 nt, Homo Sapiens; identical to SEQ ID NO: 40938

SEQ ID NO: 136423 - RNA, 64 nt, Homo Sapiens; identical to SEQ ID NO: 40939

SEQ ID NO: 136424 - RNA, 64 nt, Homo Sapiens; identical to SEQ ID NO: 40940

SEQ ID NO: 136425 - RNA, 64 nt, Homo Sapiens; identical to SEQ ID NO: 40941

SEQ ID NO: 136426 - RNA, 64 nt, Homo Sapiens; identical to SEQ ID NO: 40942

SEQ ID NO: 136427 - RNA, 64 nt, Homo Sapiens; identical to SEQ ID NO: 40943

SEQ ID NO: 136428 - RNA, 64 nt, Homo Sapiens; identical to SEQ ID NO: 40944

SEQ ID NO: 136429 - RNA, 64 nt, Homo Sapiens; identical to SEQ ID NO: 40945

SEQ ID NO: 136430 - RNA, 64 nt, Homo Sapiens; identical to SEQ ID NO: 40946

SEQ ID NO: 136431 - RNA, 64 nt, Homo Sapiens; identical to SEQ ID NO: 40947

SEQ ID NO: 136432 - RNA, 64 nt, Homo Sapiens; identical to SEQ ID NO: 40948

SEQ ID NO: 136433 - RNA, 64 nt, Homo Sapiens; identical to SEQ ID NO: 40949

SEQ ID NO: 136434 - RNA, 64 nt, Homo Sapiens; identical to SEQ ID NO: 40950

SEQ ID NO: 136435 - RNA, 64 nt, Homo Sapiens; identical to SEQ ID NO: 40951

SEQ ID NO: 136436 - RNA, 64 nt, Homo Sapiens; identical to SEQ ID NO: 40952

SEQ ID NO: 136437 - RNA, 64 nt, Homo Sapiens; identical to SEQ ID NO: 40953

SEQ ID NO: 136438 - RNA, 64 nt, Homo Sapiens; identical to SEQ ID NO: 40954

SEQ ID NO: 136439 - RNA, 64 nt, Homo Sapiens; identical to SEQ ID NO: 40955

SEQ ID NO: 136440 - RNA, 64 nt, Homo Sapiens; identical to SEQ ID NO: 40956

SEQ ID NO: 136441 - RNA, 64 nt, Homo Sapiens; identical to SEQ ID NO: 40957

SEQ ID NO: 136442 - RNA, 64 nt, Homo Sapiens; identical to SEQ ID NO: 40958

SEQ ID NO: 136443 - RNA, 64 nt, Homo Sapiens; identical to SEQ ID NO: 40959

SEQ ID NO: 136444 - RNA, 64 nt, Homo Sapiens; identical to SEQ ID NO: 40960

SEQ ID NO: 136445 - RNA, 64 nt, Homo Sapiens; identical to SEQ ID NO: 40961

SEQ ID NO: 136446 - RNA, 64 nt, Homo Sapiens; identical to SEQ ID NO: 40962

SEQ ID NO: 136447 - RNA, 64 nt, Homo Sapiens; identical to SEQ ID NO: 40963

SEQ ID NO: 136448 - RNA, 64 nt, Homo Sapiens; identical to SEQ ID NO: 40964

SEQ ID NO: 136449 - RNA, 64 nt, Homo Sapiens; identical to SEQ ID NO: 40965

SEQ ID NO: 136450 - RNA, 64 nt, Homo Sapiens; identical to SEQ ID NO: 40966

SEQ ID NO: 136451 - RNA, 64 nt, Homo Sapiens; identical to SEQ ID NO: 40967

SEQ ID NO: 136452 - RNA, 64 nt, Homo Sapiens; identical to SEQ ID NO: 40968

SEQ ID NO: 136453 - RNA, 64 nt, Homo Sapiens; identical to SEQ ID NO: 40969

SEQ ID NO: 136454 - RNA, 64 nt, Homo Sapiens; identical to SEQ ID NO: 40970

SEQ ID NO: 136455 - RNA, 64 nt, Homo Sapiens; identical to SEQ ID NO: 40971

SEQ ID NO: 136456 - RNA, 64 nt, Homo Sapiens; identical to SEQ ID NO: 40972

SEQ ID NO: 136457 - RNA, 64 nt, Homo Sapiens; identical to SEQ ID NO: 40973

SEQ ID NO: 136458 - RNA, 64 nt, Homo Sapiens; identical to SEQ ID NO: 40974

SEQ ID NO: 136459 - RNA, 64 nt, Homo Sapiens; identical to SEQ ID NO: 40975

SEQ ID NO: 136460 - RNA, 64 nt, Homo Sapiens; identical to SEQ ID NO: 40976

SEQ ID NO: 136461 - RNA, 64 nt, Homo Sapiens; identical to SEQ ID NO: 40977

SEQ ID NO: 136462 - RNA, 64 nt, Homo Sapiens; identical to SEQ ID NO: 40978

SEQ ID NO: 136463 - RNA, 64 nt, Homo Sapiens; identical to SEQ ID NO: 40979

SEQ ID NO: 136464 - RNA, 64 nt, Homo Sapiens; identical to SEQ ID NO: 40980

SEQ ID NO: 136465 - RNA, 64 nt, Homo Sapiens; identical to SEQ ID NO: 40981

SEQ ID NO: 136466 - RNA, 64 nt, Homo Sapiens; identical to SEQ ID NO: 40982

SEQ ID NO: 136467 - RNA, 64 nt, Homo Sapiens; identical to SEQ ID NO: 40983

SEQ ID NO: 136468 - RNA, 64 nt, Homo Sapiens; identical to SEQ ID NO: 40984

SEQ ID NO: 136469 - RNA, 64 nt, Homo Sapiens; identical to SEQ ID NO: 40985

SEQ ID NO: 136470 - RNA, 64 nt, Homo Sapiens; identical to SEQ ID NO: 40986

SEQ ID NO: 136471 - RNA, 64 nt, Homo Sapiens; identical to SEQ ID NO: 40987

SEQ ID NO: 136472 - RNA, 64 nt, Homo Sapiens; identical to SEQ ID NO: 40988

SEQ ID NO: 136473 - RNA, 64 nt, Homo Sapiens; identical to SEQ ID NO: 40989

SEQ ID NO: 136474 - RNA, 64 nt, Homo Sapiens; identical to SEQ ID NO: 40990

SEQ ID NO: 136475 - RNA, 64 nt, Homo Sapiens; identical to SEQ ID NO: 40991

SEQ ID NO: 136476 - RNA, 64 nt, Homo Sapiens; identical to SEQ ID NO: 40992

SEQ ID NO: 136477 - RNA, 64 nt, Homo Sapiens; identical to SEQ ID NO: 40993

SEQ ID NO: 136478 - RNA, 64 nt, Homo Sapiens; identical to SEQ ID NO: 40994

SEQ ID NO: 136479 - RNA, 64 nt, Homo Sapiens; identical to SEQ ID NO: 40995

SEQ ID NO: 136480 - RNA, 64 nt, Homo Sapiens; identical to SEQ ID NO: 40996

SEQ ID NO: 136481 - RNA, 64 nt, Homo Sapiens; identical to SEQ ID NO: 40997

SEQ ID NO: 136482 - RNA, 64 nt, Homo Sapiens; identical to SEQ ID NO: 40998

SEQ ID NO: 136483 - RNA, 64 nt, Homo Sapiens; identical to SEQ ID NO: 40999

SEQ ID NO: 136484 - RNA, 64 nt, Homo Sapiens; identical to SEQ ID NO: 41000

SEQ ID NO: 136485 - RNA, 64 nt, Homo Sapiens; identical to SEQ ID NO: 41001

SEQ ID NO: 136486 - RNA, 64 nt, Homo Sapiens; identical to SEQ ID NO: 41002

SEQ ID NO: 136487 - RNA, 64 nt, Homo Sapiens; identical to SEQ ID NO: 41003

SEQ ID NO: 136488 - RNA, 64 nt, Homo Sapiens; identical to SEQ ID NO: 41004

SEQ ID NO: 136489 - RNA, 64 nt, Homo Sapiens; identical to SEQ ID NO: 41005

SEQ ID NO: 136490 - RNA, 64 nt, Homo Sapiens; identical to SEQ ID NO: 41006

SEQ ID NO: 136491 - RNA, 63 nt, Homo Sapiens; identical to SEQ ID NO: 41007

SEQ ID NO: 136492 - RNA, 64 nt, Homo Sapiens; identical to SEQ ID NO: 41008

SEQ ID NO: 136493 - RNA, 64 nt, Homo Sapiens; identical to SEQ ID NO: 41009

SEQ ID NO: 136494 - RNA, 64 nt, Homo Sapiens; identical to SEQ ID NO: 41010

SEQ ID NO: 136495 - RNA, 64 nt, Homo Sapiens; identical to SEQ ID NO: 41011

SEQ ID NO: 136496 - RNA, 64 nt, Homo Sapiens; identical to SEQ ID NO: 41012

SEQ ID NO: 136497 - RNA, 64 nt, Homo Sapiens; identical to SEQ ID NO: 41013

SEQ ID NO: 136498 - RNA, 64 nt, Homo Sapiens; identical to SEQ ID NO: 41014

SEQ ID NO: 136499 - RNA, 64 nt, Homo Sapiens; identical to SEQ ID NO: 41015

SEQ ID NO: 136500 - RNA, 64 nt, Homo Sapiens; identical to SEQ ID NO: 41016

SEQ ID NO: 136501 - RNA, 64 nt, Homo Sapiens; identical to SEQ ID NO: 41017

SEQ ID NO: 136502 - RNA, 64 nt, Homo Sapiens; identical to SEQ ID NO: 41018

SEQ ID NO: 136503 - RNA, 64 nt, Homo Sapiens; identical to SEQ ID NO: 41019

SEQ ID NO: 136504 - RNA, 64 nt, Homo Sapiens; identical to SEQ ID NO: 41020

SEQ ID NO: 136505 - RNA, 64 nt, Homo Sapiens; identical to SEQ ID NO: 41021

SEQ ID NO: 136506 - RNA, 64 nt, Homo Sapiens; identical to SEQ ID NO: 41022

SEQ ID NO: 136507 - RNA, 64 nt, Homo Sapiens; identical to SEQ ID NO: 41023

SEQ ID NO: 136508 - RNA, 64 nt, Homo Sapiens; identical to SEQ ID NO: 41024

SEQ ID NO: 136509 - RNA, 64 nt, Homo Sapiens; identical to SEQ ID NO: 41025

SEQ ID NO: 136510 - RNA, 64 nt, Homo Sapiens; identical to SEQ ID NO: 41026

SEQ ID NO: 136511 - RNA, 64 nt, Homo Sapiens; identical to SEQ ID NO: 41027

SEQ ID NO: 136512 - RNA, 64 nt, Homo Sapiens; identical to SEQ ID NO: 41028

SEQ ID NO: 136513 - RNA, 64 nt, Homo Sapiens; identical to SEQ ID NO: 41029

SEQ ID NO: 136514 - RNA, 64 nt, Homo Sapiens; identical to SEQ ID NO: 41030

SEQ ID NO: 136515 - RNA, 64 nt, Homo Sapiens; identical to SEQ ID NO: 41031

SEQ ID NO: 136516 - RNA, 64 nt, Homo Sapiens; identical to SEQ ID NO: 41032

SEQ ID NO: 136517 - RNA, 64 nt, Homo Sapiens; identical to SEQ ID NO: 41033

SEQ ID NO: 136518 - RNA, 64 nt, Homo Sapiens; identical to SEQ ID NO: 41034

SEQ ID NO: 136519 - RNA, 64 nt, Homo Sapiens; identical to SEQ ID NO: 41035

SEQ ID NO: 136520 - RNA, 64 nt, Homo Sapiens; identical to SEQ ID NO: 41036

SEQ ID NO: 136521 - RNA, 64 nt, Homo Sapiens; identical to SEQ ID NO: 41037

SEQ ID NO: 136522 - RNA, 64 nt, Homo Sapiens; identical to SEQ ID NO: 41038

SEQ ID NO: 136523 - RNA, 64 nt, Homo Sapiens; identical to SEQ ID NO: 41039

SEQ ID NO: 136524 - RNA, 64 nt, Homo Sapiens; identical to SEQ ID NO: 41040

SEQ ID NO: 136525 - RNA, 64 nt, Homo Sapiens; identical to SEQ ID NO: 41041

SEQ ID NO: 136526 - RNA, 64 nt, Homo Sapiens; identical to SEQ ID NO: 41042

SEQ ID NO: 136527 - RNA, 64 nt, Homo Sapiens; identical to SEQ ID NO: 41043

SEQ ID NO: 136528 - RNA, 64 nt, Homo Sapiens; identical to SEQ ID NO: 41044

SEQ ID NO: 136529 - RNA, 64 nt, Homo Sapiens; identical to SEQ ID NO: 41045

SEQ ID NO: 136530 - RNA, 64 nt, Homo Sapiens; identical to SEQ ID NO: 41046

SEQ ID NO: 136531 - RNA, 64 nt, Homo Sapiens; identical to SEQ ID NO: 41047

SEQ ID NO: 136532 - RNA, 64 nt, Homo Sapiens; identical to SEQ ID NO: 41048

SEQ ID NO: 136533 - RNA, 64 nt, Homo Sapiens; identical to SEQ ID NO: 41049

SEQ ID NO: 136534 - RNA, 64 nt, Homo Sapiens; identical to SEQ ID NO: 41050

SEQ ID NO: 136535 - RNA, 64 nt, Homo Sapiens; identical to SEQ ID NO: 41051

SEQ ID NO: 136536 - RNA, 64 nt, Homo Sapiens; identical to SEQ ID NO: 41052

SEQ ID NO: 136537 - RNA, 64 nt, Homo Sapiens; identical to SEQ ID NO: 41053

SEQ ID NO: 136538 - RNA, 64 nt, Homo Sapiens; identical to SEQ ID NO: 41054

SEQ ID NO: 136539 - RNA, 64 nt, Homo Sapiens; identical to SEQ ID NO: 41055

SEQ ID NO: 136540 - RNA, 64 nt, Homo Sapiens; identical to SEQ ID NO: 41056

SEQ ID NO: 136541 - RNA, 64 nt, Homo Sapiens; identical to SEQ ID NO: 41057

SEQ ID NO: 136542 - RNA, 64 nt, Homo Sapiens; identical to SEQ ID NO: 41058

SEQ ID NO: 136543 - RNA, 64 nt, Homo Sapiens; identical to SEQ ID NO: 41059

SEQ ID NO: 136544 - RNA, 64 nt, Homo Sapiens; identical to SEQ ID NO: 41060

SEQ ID NO: 136545 - RNA, 64 nt, Homo Sapiens; identical to SEQ ID NO: 41061

SEQ ID NO: 136546 - RNA, 64 nt, Homo Sapiens; identical to SEQ ID NO: 41062

SEQ ID NO: 136547 - RNA, 64 nt, Homo Sapiens; identical to SEQ ID NO: 41063

SEQ ID NO: 136548 - RNA, 64 nt, Homo Sapiens; identical to SEQ ID NO: 41064

SEQ ID NO: 136549 - RNA, 64 nt, Homo Sapiens; identical to SEQ ID NO: 41065

SEQ ID NO: 136550 - RNA, 64 nt, Homo Sapiens; identical to SEQ ID NO: 41066

SEQ ID NO: 136551 - RNA, 64 nt, Homo Sapiens; identical to SEQ ID NO: 41067

SEQ ID NO: 136552 - RNA, 64 nt, Homo Sapiens; identical to SEQ ID NO: 41068

SEQ ID NO: 136553 - RNA, 64 nt, Homo Sapiens; identical to SEQ ID NO: 41069

SEQ ID NO: 136554 - RNA, 64 nt, Homo Sapiens; identical to SEQ ID NO: 41070

SEQ ID NO: 136555 - RNA, 64 nt, Homo Sapiens; identical to SEQ ID NO: 41071

SEQ ID NO: 136556 - RNA, 64 nt, Homo Sapiens; identical to SEQ ID NO: 41072

SEQ ID NO: 136557 - RNA, 64 nt, Homo Sapiens; identical to SEQ ID NO: 41073

SEQ ID NO: 136558 - RNA, 64 nt, Homo Sapiens; identical to SEQ ID NO: 41074

SEQ ID NO: 136559 - RNA, 64 nt, Homo Sapiens; identical to SEQ ID NO: 41075

SEQ ID NO: 136560 - RNA, 64 nt, Homo Sapiens; identical to SEQ ID NO: 41076

SEQ ID NO: 136561 - RNA, 64 nt, Homo Sapiens; identical to SEQ ID NO: 41077

SEQ ID NO: 136562 - RNA, 64 nt, Homo Sapiens; identical to SEQ ID NO: 41078

SEQ ID NO: 136563 - RNA, 64 nt, Homo Sapiens; identical to SEQ ID NO: 41079

SEQ ID NO: 136564 - RNA, 64 nt, Homo Sapiens; identical to SEQ ID NO: 41080

SEQ ID NO: 136565 - RNA, 64 nt, Homo Sapiens; identical to SEQ ID NO: 41081

SEQ ID NO: 136566 - RNA, 64 nt, Homo Sapiens; identical to SEQ ID NO: 41082

SEQ ID NO: 136567 - RNA, 64 nt, Homo Sapiens; identical to SEQ ID NO: 41083

SEQ ID NO: 136568 - RNA, 64 nt, Homo Sapiens; identical to SEQ ID NO: 41084

SEQ ID NO: 136569 - RNA, 64 nt, Homo Sapiens; identical to SEQ ID NO: 41085

SEQ ID NO: 136570 - RNA, 64 nt, Homo Sapiens; identical to SEQ ID NO: 41086

SEQ ID NO: 136571 - RNA, 64 nt, Homo Sapiens; identical to SEQ ID NO: 41087

SEQ ID NO: 136572 - RNA, 64 nt, Homo Sapiens; identical to SEQ ID NO: 41088

SEQ ID NO: 136573 - RNA, 64 nt, Homo Sapiens; identical to SEQ ID NO: 41089

SEQ ID NO: 136574 - RNA, 64 nt, Homo Sapiens; identical to SEQ ID NO: 41090

SEQ ID NO: 136575 - RNA, 64 nt, Homo Sapiens; identical to SEQ ID NO: 41091

SEQ ID NO: 136576 - RNA, 64 nt, Homo Sapiens; identical to SEQ ID NO: 41092

SEQ ID NO: 136577 - RNA, 64 nt, Homo Sapiens; identical to SEQ ID NO: 41093

SEQ ID NO: 136578 - RNA, 64 nt, Homo Sapiens; identical to SEQ ID NO: 41094

SEQ ID NO: 136579 - RNA, 64 nt, Homo Sapiens; identical to SEQ ID NO: 41095

SEQ ID NO: 136580 - RNA, 64 nt, Homo Sapiens; identical to SEQ ID NO: 41096

SEQ ID NO: 136581 - RNA, 64 nt, Homo Sapiens; identical to SEQ ID NO: 41097

SEQ ID NO: 136582 - RNA, 64 nt, Homo Sapiens; identical to SEQ ID NO: 41098

SEQ ID NO: 136583 - RNA, 64 nt, Homo Sapiens; identical to SEQ ID NO: 41099

SEQ ID NO: 136584 - RNA, 64 nt, Homo Sapiens; identical to SEQ ID NO: 41100

SEQ ID NO: 136585 - RNA, 64 nt, Homo Sapiens; identical to SEQ ID NO: 41101

SEQ ID NO: 136586 - RNA, 64 nt, Homo Sapiens; identical to SEQ ID NO: 41102

SEQ ID NO: 136587 - RNA, 64 nt, Homo Sapiens; identical to SEQ ID NO: 41103

SEQ ID NO: 136588 - RNA, 64 nt, Homo Sapiens; identical to SEQ ID NO: 41104

SEQ ID NO: 136589 - RNA, 64 nt, Homo Sapiens; identical to SEQ ID NO: 41105

SEQ ID NO: 136590 - RNA, 64 nt, Homo Sapiens; identical to SEQ ID NO: 41106

SEQ ID NO: 136591 - RNA, 64 nt, Homo Sapiens; identical to SEQ ID NO: 41107

SEQ ID NO: 136592 - RNA, 64 nt, Homo Sapiens; identical to SEQ ID NO: 41108

SEQ ID NO: 136593 - RNA, 64 nt, Homo Sapiens; identical to SEQ ID NO: 41109

SEQ ID NO: 136594 - RNA, 64 nt, Homo Sapiens; identical to SEQ ID NO: 41110

SEQ ID NO: 136595 - RNA, 64 nt, Homo Sapiens; identical to SEQ ID NO: 41111

SEQ ID NO: 136596 - RNA, 64 nt, Homo Sapiens; identical to SEQ ID NO: 41112

SEQ ID NO: 136597 - RNA, 64 nt, Homo Sapiens; identical to SEQ ID NO: 41113

SEQ ID NO: 136598 - RNA, 64 nt, Homo Sapiens; identical to SEQ ID NO: 41114

SEQ ID NO: 136599 - RNA, 64 nt, Homo Sapiens; identical to SEQ ID NO: 41115

SEQ ID NO: 136600 - RNA, 64 nt, Homo Sapiens; identical to SEQ ID NO: 41116

SEQ ID NO: 136601 - RNA, 64 nt, Homo Sapiens; identical to SEQ ID NO: 41117

SEQ ID NO: 136602 - RNA, 64 nt, Homo Sapiens; identical to SEQ ID NO: 41118

SEQ ID NO: 136603 - RNA, 64 nt, Homo Sapiens; identical to SEQ ID NO: 41119

SEQ ID NO: 136604 - RNA, 64 nt, Homo Sapiens; identical to SEQ ID NO: 41120

SEQ ID NO: 136605 - RNA, 64 nt, Homo Sapiens; identical to SEQ ID NO: 41121

SEQ ID NO: 136606 - RNA, 64 nt, Homo Sapiens; identical to SEQ ID NO: 41122

SEQ ID NO: 136607 - RNA, 64 nt, Homo Sapiens; identical to SEQ ID NO: 41123

SEQ ID NO: 136608 - RNA, 64 nt, Homo Sapiens; identical to SEQ ID NO: 41124

SEQ ID NO: 136609 - RNA, 64 nt, Homo Sapiens; identical to SEQ ID NO: 41125

SEQ ID NO: 136610 - RNA, 64 nt, Homo Sapiens; identical to SEQ ID NO: 41126

SEQ ID NO: 136611 - RNA, 64 nt, Homo Sapiens; identical to SEQ ID NO: 41127

SEQ ID NO: 136612 - RNA, 64 nt, Homo Sapiens; identical to SEQ ID NO: 41128

SEQ ID NO: 136613 - RNA, 64 nt, Homo Sapiens; identical to SEQ ID NO: 41129

SEQ ID NO: 136614 - RNA, 64 nt, Homo Sapiens; identical to SEQ ID NO: 41130

SEQ ID NO: 136615 - RNA, 64 nt, Homo Sapiens; identical to SEQ ID NO: 41131

SEQ ID NO: 136616 - RNA, 64 nt, Homo Sapiens; identical to SEQ ID NO: 41132

SEQ ID NO: 136617 - RNA, 64 nt, Homo Sapiens; identical to SEQ ID NO: 41133

SEQ ID NO: 136618 - RNA, 64 nt, Homo Sapiens; identical to SEQ ID NO: 41134

SEQ ID NO: 136619 - RNA, 64 nt, Homo Sapiens; identical to SEQ ID NO: 41135

SEQ ID NO: 136620 - RNA, 64 nt, Homo Sapiens; identical to SEQ ID NO: 41136

SEQ ID NO: 136621 - RNA, 64 nt, Homo Sapiens; identical to SEQ ID NO: 41137

SEQ ID NO: 136622 - RNA, 64 nt, Homo Sapiens; identical to SEQ ID NO: 41138

SEQ ID NO: 136623 - RNA, 64 nt, Homo Sapiens; identical to SEQ ID NO: 41139

SEQ ID NO: 136624 - RNA, 64 nt, Homo Sapiens; identical to SEQ ID NO: 41140

SEQ ID NO: 136625 - RNA, 64 nt, Homo Sapiens; identical to SEQ ID NO: 41141

SEQ ID NO: 136626 - RNA, 64 nt, Homo Sapiens; identical to SEQ ID NO: 41142

SEQ ID NO: 136627 - RNA, 64 nt, Homo Sapiens; identical to SEQ ID NO: 41143

SEQ ID NO: 136628 - RNA, 64 nt, Homo Sapiens; identical to SEQ ID NO: 41144

SEQ ID NO: 136629 - RNA, 64 nt, Homo Sapiens; identical to SEQ ID NO: 41145

SEQ ID NO: 136630 - RNA, 64 nt, Homo Sapiens; identical to SEQ ID NO: 41146

SEQ ID NO: 136631 - RNA, 64 nt, Homo Sapiens; identical to SEQ ID NO: 41147

SEQ ID NO: 136632 - RNA, 64 nt, Homo Sapiens; identical to SEQ ID NO: 41148

SEQ ID NO: 136633 - RNA, 64 nt, Homo Sapiens; identical to SEQ ID NO: 41149

SEQ ID NO: 136634 - RNA, 64 nt, Homo Sapiens; identical to SEQ ID NO: 41150

SEQ ID NO: 136635 - RNA, 64 nt, Homo Sapiens; identical to SEQ ID NO: 41151

SEQ ID NO: 136636 - RNA, 64 nt, Homo Sapiens; identical to SEQ ID NO: 41152

SEQ ID NO: 136637 - RNA, 64 nt, Homo Sapiens; identical to SEQ ID NO: 41153

SEQ ID NO: 136638 - RNA, 64 nt, Homo Sapiens; identical to SEQ ID NO: 41154

SEQ ID NO: 136639 - RNA, 64 nt, Homo Sapiens; identical to SEQ ID NO: 41155

SEQ ID NO: 136640 - RNA, 64 nt, Homo Sapiens; identical to SEQ ID NO: 41156

SEQ ID NO: 136641 - RNA, 64 nt, Homo Sapiens; identical to SEQ ID NO: 41157

SEQ ID NO: 136642 - RNA, 64 nt, Homo Sapiens; identical to SEQ ID NO: 41158

SEQ ID NO: 136643 - RNA, 64 nt, Homo Sapiens; identical to SEQ ID NO: 41159

SEQ ID NO: 136644 - RNA, 64 nt, Homo Sapiens; identical to SEQ ID NO: 41160

SEQ ID NO: 136645 - RNA, 64 nt, Homo Sapiens; identical to SEQ ID NO: 41161

SEQ ID NO: 136646 - RNA, 64 nt, Homo Sapiens; identical to SEQ ID NO: 41162

SEQ ID NO: 136647 - RNA, 64 nt, Homo Sapiens; identical to SEQ ID NO: 41163

SEQ ID NO: 136648 - RNA, 64 nt, Homo Sapiens; identical to SEQ ID NO: 41164

SEQ ID NO: 136649 - RNA, 64 nt, Homo Sapiens; identical to SEQ ID NO: 41165

SEQ ID NO: 136650 - RNA, 64 nt, Homo Sapiens; identical to SEQ ID NO: 41166

SEQ ID NO: 136651 - RNA, 64 nt, Homo Sapiens; identical to SEQ ID NO: 41167

SEQ ID NO: 136652 - RNA, 64 nt, Homo Sapiens; identical to SEQ ID NO: 41168

SEQ ID NO: 136653 - RNA, 64 nt, Homo Sapiens; identical to SEQ ID NO: 41169

SEQ ID NO: 136654 - RNA, 64 nt, Homo Sapiens; identical to SEQ ID NO: 41170

SEQ ID NO: 136655 - RNA, 64 nt, Homo Sapiens; identical to SEQ ID NO: 41171

SEQ ID NO: 136656 - RNA, 64 nt, Homo Sapiens; identical to SEQ ID NO: 41172

SEQ ID NO: 136657 - RNA, 64 nt, Homo Sapiens; identical to SEQ ID NO: 41173

SEQ ID NO: 136658 - RNA, 64 nt, Homo Sapiens; identical to SEQ ID NO: 41174

SEQ ID NO: 136659 - RNA, 64 nt, Homo Sapiens; identical to SEQ ID NO: 41175

SEQ ID NO: 136660 - RNA, 64 nt, Homo Sapiens; identical to SEQ ID NO: 41176

SEQ ID NO: 136661 - RNA, 64 nt, Homo Sapiens; identical to SEQ ID NO: 41177

SEQ ID NO: 136662 - RNA, 64 nt, Homo Sapiens; identical to SEQ ID NO: 41178

SEQ ID NO: 136663 - RNA, 64 nt, Homo Sapiens; identical to SEQ ID NO: 41179

SEQ ID NO: 136664 - RNA, 64 nt, Homo Sapiens; identical to SEQ ID NO: 41180

SEQ ID NO: 136665 - RNA, 64 nt, Homo Sapiens; identical to SEQ ID NO: 41181

SEQ ID NO: 136666 - RNA, 64 nt, Homo Sapiens; identical to SEQ ID NO: 41182

SEQ ID NO: 136667 - RNA, 64 nt, Homo Sapiens; identical to SEQ ID NO: 41183

SEQ ID NO: 136668 - RNA, 64 nt, Homo Sapiens; identical to SEQ ID NO: 41184

SEQ ID NO: 136669 - RNA, 64 nt, Homo Sapiens; identical to SEQ ID NO: 41185

SEQ ID NO: 136670 - RNA, 64 nt, Homo Sapiens; identical to SEQ ID NO: 41186

SEQ ID NO: 136671 - RNA, 64 nt, Homo Sapiens; identical to SEQ ID NO: 41187

SEQ ID NO: 136672 - RNA, 64 nt, Homo Sapiens; identical to SEQ ID NO: 41188

SEQ ID NO: 136673 - RNA, 64 nt, Homo Sapiens; identical to SEQ ID NO: 41189

SEQ ID NO: 136674 - RNA, 64 nt, Homo Sapiens; identical to SEQ ID NO: 41190

SEQ ID NO: 136675 - RNA, 64 nt, Homo Sapiens; identical to SEQ ID NO: 41191

SEQ ID NO: 136676 - RNA, 64 nt, Homo Sapiens; identical to SEQ ID NO: 41192

SEQ ID NO: 136677 - RNA, 64 nt, Homo Sapiens; identical to SEQ ID NO: 41193

SEQ ID NO: 136678 - RNA, 64 nt, Homo Sapiens; identical to SEQ ID NO: 41194

SEQ ID NO: 136679 - RNA, 64 nt, Homo Sapiens; identical to SEQ ID NO: 41195

SEQ ID NO: 136680 - RNA, 64 nt, Homo Sapiens; identical to SEQ ID NO: 41196

SEQ ID NO: 136681 - RNA, 64 nt, Homo Sapiens; identical to SEQ ID NO: 41197

SEQ ID NO: 136682 - RNA, 64 nt, Homo Sapiens; identical to SEQ ID NO: 41198

SEQ ID NO: 136683 - RNA, 64 nt, Homo Sapiens; identical to SEQ ID NO: 41199

SEQ ID NO: 136684 - RNA, 64 nt, Homo Sapiens; identical to SEQ ID NO: 41200

SEQ ID NO: 136685 - RNA, 64 nt, Homo Sapiens; identical to SEQ ID NO: 41201

SEQ ID NO: 136686 - RNA, 64 nt, Homo Sapiens; identical to SEQ ID NO: 41202

SEQ ID NO: 136687 - RNA, 64 nt, Homo Sapiens; identical to SEQ ID NO: 41203

SEQ ID NO: 136688 - RNA, 64 nt, Homo Sapiens; identical to SEQ ID NO: 41204

SEQ ID NO: 136689 - RNA, 64 nt, Homo Sapiens; identical to SEQ ID NO: 41205

SEQ ID NO: 136690 - RNA, 64 nt, Homo Sapiens; identical to SEQ ID NO: 41206

SEQ ID NO: 136691 - RNA, 64 nt, Homo Sapiens; identical to SEQ ID NO: 41207

SEQ ID NO: 136692 - RNA, 64 nt, Homo Sapiens; identical to SEQ ID NO: 41208

SEQ ID NO: 136693 - RNA, 64 nt, Homo Sapiens; identical to SEQ ID NO: 41209

SEQ ID NO: 136694 - RNA, 64 nt, Homo Sapiens; identical to SEQ ID NO: 41210

SEQ ID NO: 136695 - RNA, 64 nt, Homo Sapiens; identical to SEQ ID NO: 41211

SEQ ID NO: 136696 - RNA, 64 nt, Homo Sapiens; identical to SEQ ID NO: 41212

SEQ ID NO: 136697 - RNA, 64 nt, Homo Sapiens; identical to SEQ ID NO: 41213

SEQ ID NO: 136698 - RNA, 64 nt, Homo Sapiens; identical to SEQ ID NO: 41214

SEQ ID NO: 136699 - RNA, 64 nt, Homo Sapiens; identical to SEQ ID NO: 41215

SEQ ID NO: 136700 - RNA, 64 nt, Homo Sapiens; identical to SEQ ID NO: 41216

SEQ ID NO: 136701 - RNA, 64 nt, Homo Sapiens; identical to SEQ ID NO: 41217

SEQ ID NO: 136702 - RNA, 64 nt, Homo Sapiens; identical to SEQ ID NO: 41218

SEQ ID NO: 136703 - RNA, 64 nt, Homo Sapiens; identical to SEQ ID NO: 41219

SEQ ID NO: 136704 - RNA, 64 nt, Homo Sapiens; identical to SEQ ID NO: 41220

SEQ ID NO: 136705 - RNA, 64 nt, Homo Sapiens; identical to SEQ ID NO: 41221

SEQ ID NO: 136706 - RNA, 64 nt, Homo Sapiens; identical to SEQ ID NO: 41222

SEQ ID NO: 136707 - RNA, 64 nt, Homo Sapiens; identical to SEQ ID NO: 41223

SEQ ID NO: 136708 - RNA, 64 nt, Homo Sapiens; identical to SEQ ID NO: 41224

SEQ ID NO: 136709 - RNA, 64 nt, Homo Sapiens; identical to SEQ ID NO: 41225

SEQ ID NO: 136710 - RNA, 64 nt, Homo Sapiens; identical to SEQ ID NO: 41226

SEQ ID NO: 136711 - RNA, 64 nt, Homo Sapiens; identical to SEQ ID NO: 41227

SEQ ID NO: 136712 - RNA, 64 nt, Homo Sapiens; identical to SEQ ID NO: 41228

SEQ ID NO: 136713 - RNA, 64 nt, Homo Sapiens; identical to SEQ ID NO: 41229

SEQ ID NO: 136714 - RNA, 64 nt, Homo Sapiens; identical to SEQ ID NO: 41230

SEQ ID NO: 136715 - RNA, 64 nt, Homo Sapiens; identical to SEQ ID NO: 41231

SEQ ID NO: 136716 - RNA, 64 nt, Homo Sapiens; identical to SEQ ID NO: 41232

SEQ ID NO: 136717 - RNA, 64 nt, Homo Sapiens; identical to SEQ ID NO: 41233

SEQ ID NO: 136718 - RNA, 64 nt, Homo Sapiens; identical to SEQ ID NO: 41234

SEQ ID NO: 136719 - RNA, 64 nt, Homo Sapiens; identical to SEQ ID NO: 41235

SEQ ID NO: 136720 - RNA, 62 nt, Homo Sapiens; identical to SEQ ID NO: 41236

SEQ ID NO: 136721 - RNA, 60 nt, Homo Sapiens; identical to SEQ ID NO: 41237

SEQ ID NO: 136722 - RNA, 58 nt, Homo Sapiens; identical to SEQ ID NO: 41238

SEQ ID NO: 136723 - RNA, 56 nt, Homo Sapiens; identical to SEQ ID NO: 41239

SEQ ID NO: 136724 - RNA, 54 nt, Homo Sapiens; identical to SEQ ID NO: 41240

SEQ ID NO: 136725 - RNA, 64 nt, Homo Sapiens; identical to SEQ ID NO: 41241

SEQ ID NO: 136726 - RNA, 64 nt, Homo Sapiens; identical to SEQ ID NO: 41242

SEQ ID NO: 136727 - RNA, 64 nt, Homo Sapiens; identical to SEQ ID NO: 41243

SEQ ID NO: 136728 - RNA, 64 nt, Homo Sapiens; identical to SEQ ID NO: 41244

SEQ ID NO: 136729 - RNA, 64 nt, Homo Sapiens; identical to SEQ ID NO: 41245

SEQ ID NO: 136730 - RNA, 64 nt, Homo Sapiens; identical to SEQ ID NO: 41246

SEQ ID NO: 136731 - RNA, 64 nt, Homo Sapiens; identical to SEQ ID NO: 41247

SEQ ID NO: 136732 - RNA, 64 nt, Homo Sapiens; identical to SEQ ID NO: 41248

SEQ ID NO: 136733 - RNA, 64 nt, Homo Sapiens; identical to SEQ ID NO: 41249

SEQ ID NO: 136734 - RNA, 64 nt, Homo Sapiens; identical to SEQ ID NO: 41250

SEQ ID NO: 136735 - RNA, 64 nt, Homo Sapiens; identical to SEQ ID NO: 41251

SEQ ID NO: 136736 - RNA, 64 nt, Homo Sapiens; identical to SEQ ID NO: 41252

SEQ ID NO: 136737 - RNA, 64 nt, Homo Sapiens; identical to SEQ ID NO: 41253

SEQ ID NO: 136738 - RNA, 64 nt, Homo Sapiens; identical to SEQ ID NO: 41254

SEQ ID NO: 136739 - RNA, 64 nt, Homo Sapiens; identical to SEQ ID NO: 41255

SEQ ID NO: 136740 - RNA, 64 nt, Homo Sapiens; identical to SEQ ID NO: 41256

SEQ ID NO: 136741 - RNA, 64 nt, Homo Sapiens; identical to SEQ ID NO: 41257

SEQ ID NO: 136742 - RNA, 64 nt, Homo Sapiens; identical to SEQ ID NO: 41258

SEQ ID NO: 136743 - RNA, 64 nt, Homo Sapiens; identical to SEQ ID NO: 41259

SEQ ID NO: 136744 - RNA, 64 nt, Homo Sapiens; identical to SEQ ID NO: 41260

SEQ ID NO: 136745 - RNA, 64 nt, Homo Sapiens; identical to SEQ ID NO: 41261

SEQ ID NO: 136746 - RNA, 64 nt, Homo Sapiens; identical to SEQ ID NO: 41262

SEQ ID NO: 136747 - RNA, 64 nt, Homo Sapiens; identical to SEQ ID NO: 41263

SEQ ID NO: 136748 - RNA, 64 nt, Homo Sapiens; identical to SEQ ID NO: 41264

SEQ ID NO: 136749 - RNA, 64 nt, Homo Sapiens; identical to SEQ ID NO: 41265

SEQ ID NO: 136750 - RNA, 64 nt, Homo Sapiens; identical to SEQ ID NO: 41266

SEQ ID NO: 136751 - RNA, 64 nt, Homo Sapiens; identical to SEQ ID NO: 41267

SEQ ID NO: 136752 - RNA, 64 nt, Homo Sapiens; identical to SEQ ID NO: 41268

SEQ ID NO: 136753 - RNA, 64 nt, Homo Sapiens; identical to SEQ ID NO: 41269

SEQ ID NO: 136754 - RNA, 64 nt, Homo Sapiens; identical to SEQ ID NO: 41270

SEQ ID NO: 136755 - RNA, 64 nt, Homo Sapiens; identical to SEQ ID NO: 41271

SEQ ID NO: 136756 - RNA, 64 nt, Homo Sapiens; identical to SEQ ID NO: 41272

SEQ ID NO: 136757 - RNA, 64 nt, Homo Sapiens; identical to SEQ ID NO: 41273

SEQ ID NO: 136758 - RNA, 64 nt, Homo Sapiens; identical to SEQ ID NO: 41274

SEQ ID NO: 136759 - RNA, 64 nt, Homo Sapiens; identical to SEQ ID NO: 41275

SEQ ID NO: 136760 - RNA, 64 nt, Homo Sapiens; identical to SEQ ID NO: 41276

SEQ ID NO: 136761 - RNA, 64 nt, Homo Sapiens; identical to SEQ ID NO: 41277

SEQ ID NO: 136762 - RNA, 64 nt, Homo Sapiens; identical to SEQ ID NO: 41278

SEQ ID NO: 136763 - RNA, 64 nt, Homo Sapiens; identical to SEQ ID NO: 41279

SEQ ID NO: 136764 - RNA, 64 nt, Homo Sapiens; identical to SEQ ID NO: 41280

SEQ ID NO: 136765 - RNA, 64 nt, Homo Sapiens; identical to SEQ ID NO: 41281

SEQ ID NO: 136766 - RNA, 64 nt, Homo Sapiens; identical to SEQ ID NO: 41282

SEQ ID NO: 136767 - RNA, 64 nt, Homo Sapiens; identical to SEQ ID NO: 41283

SEQ ID NO: 136768 - RNA, 64 nt, Homo Sapiens; identical to SEQ ID NO: 41284

SEQ ID NO: 136769 - RNA, 64 nt, Homo Sapiens; identical to SEQ ID NO: 41285

SEQ ID NO: 136770 - RNA, 64 nt, Homo Sapiens; identical to SEQ ID NO: 41286

SEQ ID NO: 136771 - RNA, 64 nt, Homo Sapiens; identical to SEQ ID NO: 41287

SEQ ID NO: 136772 - RNA, 64 nt, Homo Sapiens; identical to SEQ ID NO: 41288

SEQ ID NO: 136773 - RNA, 64 nt, Homo Sapiens; identical to SEQ ID NO: 41289

SEQ ID NO: 136774 - RNA, 64 nt, Homo Sapiens; identical to SEQ ID NO: 41290

SEQ ID NO: 136775 - RNA, 64 nt, Homo Sapiens; identical to SEQ ID NO: 41291

SEQ ID NO: 136776 - RNA, 64 nt, Homo Sapiens; identical to SEQ ID NO: 41292

SEQ ID NO: 136777 - RNA, 64 nt, Homo Sapiens; identical to SEQ ID NO: 41293

SEQ ID NO: 136778 - RNA, 64 nt, Homo Sapiens; identical to SEQ ID NO: 41294

SEQ ID NO: 136779 - RNA, 64 nt, Homo Sapiens; identical to SEQ ID NO: 41295

SEQ ID NO: 136780 - RNA, 64 nt, Homo Sapiens; identical to SEQ ID NO: 41296

SEQ ID NO: 136781 - RNA, 64 nt, Homo Sapiens; identical to SEQ ID NO: 41297

SEQ ID NO: 136782 - RNA, 64 nt, Homo Sapiens; identical to SEQ ID NO: 41298

SEQ ID NO: 136783 - RNA, 64 nt, Homo Sapiens; identical to SEQ ID NO: 41299

SEQ ID NO: 136784 - RNA, 64 nt, Homo Sapiens; identical to SEQ ID NO: 41300

SEQ ID NO: 136785 - RNA, 64 nt, Homo Sapiens; identical to SEQ ID NO: 41301

SEQ ID NO: 136786 - RNA, 64 nt, Homo Sapiens; identical to SEQ ID NO: 41302

SEQ ID NO: 136787 - RNA, 64 nt, Homo Sapiens; identical to SEQ ID NO: 41303

SEQ ID NO: 136788 - RNA, 64 nt, Homo Sapiens; identical to SEQ ID NO: 41304

SEQ ID NO: 136789 - RNA, 64 nt, Homo Sapiens; identical to SEQ ID NO: 41305

SEQ ID NO: 136790 - RNA, 64 nt, Homo Sapiens; identical to SEQ ID NO: 41306

SEQ ID NO: 136791 - RNA, 64 nt, Homo Sapiens; identical to SEQ ID NO: 41307

SEQ ID NO: 136792 - RNA, 64 nt, Homo Sapiens; identical to SEQ ID NO: 41308

SEQ ID NO: 136793 - RNA, 64 nt, Homo Sapiens; identical to SEQ ID NO: 41309

SEQ ID NO: 136794 - RNA, 64 nt, Homo Sapiens; identical to SEQ ID NO: 41310

SEQ ID NO: 136795 - RNA, 64 nt, Homo Sapiens; identical to SEQ ID NO: 41311

SEQ ID NO: 136796 - RNA, 64 nt, Homo Sapiens; identical to SEQ ID NO: 41312

SEQ ID NO: 136797 - RNA, 64 nt, Homo Sapiens; identical to SEQ ID NO: 41313

SEQ ID NO: 136798 - RNA, 64 nt, Homo Sapiens; identical to SEQ ID NO: 41314

SEQ ID NO: 136799 - RNA, 64 nt, Homo Sapiens; identical to SEQ ID NO: 41315

SEQ ID NO: 136800 - RNA, 64 nt, Homo Sapiens; identical to SEQ ID NO: 41316

SEQ ID NO: 136801 - RNA, 64 nt, Homo Sapiens; identical to SEQ ID NO: 41317

SEQ ID NO: 136802 - RNA, 64 nt, Homo Sapiens; identical to SEQ ID NO: 41318

SEQ ID NO: 136803 - RNA, 64 nt, Homo Sapiens; identical to SEQ ID NO: 41319

SEQ ID NO: 136804 - RNA, 64 nt, Homo Sapiens; identical to SEQ ID NO: 41320

SEQ ID NO: 136805 - RNA, 64 nt, Homo Sapiens; identical to SEQ ID NO: 41321

SEQ ID NO: 136806 - RNA, 64 nt, Homo Sapiens; identical to SEQ ID NO: 41322

SEQ ID NO: 136807 - RNA, 64 nt, Homo Sapiens; identical to SEQ ID NO: 41323

SEQ ID NO: 136808 - RNA, 64 nt, Homo Sapiens; identical to SEQ ID NO: 41324

SEQ ID NO: 136809 - RNA, 64 nt, Homo Sapiens; identical to SEQ ID NO: 41325

SEQ ID NO: 136810 - RNA, 64 nt, Homo Sapiens; identical to SEQ ID NO: 41326

SEQ ID NO: 136811 - RNA, 64 nt, Homo Sapiens; identical to SEQ ID NO: 41327

SEQ ID NO: 136812 - RNA, 64 nt, Homo Sapiens; identical to SEQ ID NO: 41328

SEQ ID NO: 136813 - RNA, 64 nt, Homo Sapiens; identical to SEQ ID NO: 41329

SEQ ID NO: 136814 - RNA, 64 nt, Homo Sapiens; identical to SEQ ID NO: 41330

SEQ ID NO: 136815 - RNA, 64 nt, Homo Sapiens; identical to SEQ ID NO: 41331

SEQ ID NO: 136816 - RNA, 64 nt, Homo Sapiens; identical to SEQ ID NO: 41332

SEQ ID NO: 136817 - RNA, 64 nt, Homo Sapiens; identical to SEQ ID NO: 41333

SEQ ID NO: 136818 - RNA, 64 nt, Homo Sapiens; identical to SEQ ID NO: 41334

SEQ ID NO: 136819 - RNA, 64 nt, Homo Sapiens; identical to SEQ ID NO: 41335

SEQ ID NO: 136820 - RNA, 64 nt, Homo Sapiens; identical to SEQ ID NO: 41336

SEQ ID NO: 136821 - RNA, 64 nt, Homo Sapiens; identical to SEQ ID NO: 41337

SEQ ID NO: 136822 - RNA, 64 nt, Homo Sapiens; identical to SEQ ID NO: 41338

SEQ ID NO: 136823 - RNA, 64 nt, Homo Sapiens; identical to SEQ ID NO: 41339

SEQ ID NO: 136824 - RNA, 64 nt, Homo Sapiens; identical to SEQ ID NO: 41340

SEQ ID NO: 136825 - RNA, 64 nt, Homo Sapiens; identical to SEQ ID NO: 41341

SEQ ID NO: 136826 - RNA, 64 nt, Homo Sapiens; identical to SEQ ID NO: 41342

SEQ ID NO: 136827 - RNA, 64 nt, Homo Sapiens; identical to SEQ ID NO: 41343

SEQ ID NO: 136828 - RNA, 64 nt, Homo Sapiens; identical to SEQ ID NO: 41344

SEQ ID NO: 136829 - RNA, 64 nt, Homo Sapiens; identical to SEQ ID NO: 41345

SEQ ID NO: 136830 - RNA, 64 nt, Homo Sapiens; identical to SEQ ID NO: 41346

SEQ ID NO: 136831 - RNA, 64 nt, Homo Sapiens; identical to SEQ ID NO: 41347

SEQ ID NO: 136832 - RNA, 64 nt, Homo Sapiens; identical to SEQ ID NO: 41348

SEQ ID NO: 136833 - RNA, 64 nt, Homo Sapiens; identical to SEQ ID NO: 41349

SEQ ID NO: 136834 - RNA, 64 nt, Homo Sapiens; identical to SEQ ID NO: 41350

SEQ ID NO: 136835 - RNA, 64 nt, Homo Sapiens; identical to SEQ ID NO: 41351

SEQ ID NO: 136836 - RNA, 64 nt, Homo Sapiens; identical to SEQ ID NO: 41352

SEQ ID NO: 136837 - RNA, 64 nt, Homo Sapiens; identical to SEQ ID NO: 41353

SEQ ID NO: 136838 - RNA, 64 nt, Homo Sapiens; identical to SEQ ID NO: 41354

SEQ ID NO: 136839 - RNA, 64 nt, Homo Sapiens; identical to SEQ ID NO: 41355

SEQ ID NO: 136840 - RNA, 64 nt, Homo Sapiens; identical to SEQ ID NO: 41356

SEQ ID NO: 136841 - RNA, 64 nt, Homo Sapiens; identical to SEQ ID NO: 41357

SEQ ID NO: 136842 - RNA, 64 nt, Homo Sapiens; identical to SEQ ID NO: 41358

SEQ ID NO: 136843 - RNA, 64 nt, Homo Sapiens; identical to SEQ ID NO: 41359

SEQ ID NO: 136844 - RNA, 64 nt, Homo Sapiens; identical to SEQ ID NO: 41360

SEQ ID NO: 136845 - RNA, 64 nt, Homo Sapiens; identical to SEQ ID NO: 41361

SEQ ID NO: 136846 - RNA, 64 nt, Homo Sapiens; identical to SEQ ID NO: 41362

SEQ ID NO: 136847 - RNA, 64 nt, Homo Sapiens; identical to SEQ ID NO: 41363

SEQ ID NO: 136848 - RNA, 64 nt, Homo Sapiens; identical to SEQ ID NO: 41364

SEQ ID NO: 136849 - RNA, 64 nt, Homo Sapiens; identical to SEQ ID NO: 41365

SEQ ID NO: 136850 - RNA, 64 nt, Homo Sapiens; identical to SEQ ID NO: 41366

SEQ ID NO: 136851 - RNA, 64 nt, Homo Sapiens; identical to SEQ ID NO: 41367

SEQ ID NO: 136852 - RNA, 64 nt, Homo Sapiens; identical to SEQ ID NO: 41368

SEQ ID NO: 136853 - RNA, 64 nt, Homo Sapiens; identical to SEQ ID NO: 41369

SEQ ID NO: 136854 - RNA, 64 nt, Homo Sapiens; identical to SEQ ID NO: 41370

SEQ ID NO: 136855 - RNA, 64 nt, Homo Sapiens; identical to SEQ ID NO: 41371

SEQ ID NO: 136856 - RNA, 64 nt, Homo Sapiens; identical to SEQ ID NO: 41372

SEQ ID NO: 136857 - RNA, 64 nt, Homo Sapiens; identical to SEQ ID NO: 41373

SEQ ID NO: 136858 - RNA, 64 nt, Homo Sapiens; identical to SEQ ID NO: 41374

SEQ ID NO: 136859 - RNA, 64 nt, Homo Sapiens; identical to SEQ ID NO: 41375

SEQ ID NO: 136860 - RNA, 64 nt, Homo Sapiens; identical to SEQ ID NO: 41376

SEQ ID NO: 136861 - RNA, 64 nt, Homo Sapiens; identical to SEQ ID NO: 41377

SEQ ID NO: 136862 - RNA, 64 nt, Homo Sapiens; identical to SEQ ID NO: 41378

SEQ ID NO: 136863 - RNA, 64 nt, Homo Sapiens; identical to SEQ ID NO: 41379

SEQ ID NO: 136864 - RNA, 64 nt, Homo Sapiens; identical to SEQ ID NO: 41380

SEQ ID NO: 136865 - RNA, 64 nt, Homo Sapiens; identical to SEQ ID NO: 41381

SEQ ID NO: 136866 - RNA, 64 nt, Homo Sapiens; identical to SEQ ID NO: 41382

SEQ ID NO: 136867 - RNA, 64 nt, Homo Sapiens; identical to SEQ ID NO: 41383

SEQ ID NO: 136868 - RNA, 64 nt, Homo Sapiens; identical to SEQ ID NO: 41384

SEQ ID NO: 136869 - RNA, 64 nt, Homo Sapiens; identical to SEQ ID NO: 41385

SEQ ID NO: 136870 - RNA, 64 nt, Homo Sapiens; identical to SEQ ID NO: 41386

SEQ ID NO: 136871 - RNA, 64 nt, Homo Sapiens; identical to SEQ ID NO: 41387

SEQ ID NO: 136872 - RNA, 64 nt, Homo Sapiens; identical to SEQ ID NO: 41388

SEQ ID NO: 136873 - RNA, 64 nt, Homo Sapiens; identical to SEQ ID NO: 41389

SEQ ID NO: 136874 - RNA, 64 nt, Homo Sapiens; identical to SEQ ID NO: 41390

SEQ ID NO: 136875 - RNA, 64 nt, Homo Sapiens; identical to SEQ ID NO: 41391

SEQ ID NO: 136876 - RNA, 64 nt, Homo Sapiens; identical to SEQ ID NO: 41392

SEQ ID NO: 136877 - RNA, 64 nt, Homo Sapiens; identical to SEQ ID NO: 41393

SEQ ID NO: 136878 - RNA, 64 nt, Homo Sapiens; identical to SEQ ID NO: 41394

SEQ ID NO: 136879 - RNA, 64 nt, Homo Sapiens; identical to SEQ ID NO: 41395

SEQ ID NO: 136880 - RNA, 64 nt, Homo Sapiens; identical to SEQ ID NO: 41396

SEQ ID NO: 136881 - RNA, 64 nt, Homo Sapiens; identical to SEQ ID NO: 41397

SEQ ID NO: 136882 - RNA, 64 nt, Homo Sapiens; identical to SEQ ID NO: 41398

SEQ ID NO: 136883 - RNA, 64 nt, Homo Sapiens; identical to SEQ ID NO: 41399

SEQ ID NO: 136884 - RNA, 64 nt, Homo Sapiens; identical to SEQ ID NO: 41400

SEQ ID NO: 136885 - RNA, 64 nt, Homo Sapiens; identical to SEQ ID NO: 41401

SEQ ID NO: 136886 - RNA, 64 nt, Homo Sapiens; identical to SEQ ID NO: 41402

SEQ ID NO: 136887 - RNA, 64 nt, Homo Sapiens; identical to SEQ ID NO: 41403

SEQ ID NO: 136888 - RNA, 64 nt, Homo Sapiens; identical to SEQ ID NO: 41404

SEQ ID NO: 136889 - RNA, 64 nt, Homo Sapiens; identical to SEQ ID NO: 41405

SEQ ID NO: 136890 - RNA, 64 nt, Homo Sapiens; identical to SEQ ID NO: 41406

SEQ ID NO: 136891 - RNA, 64 nt, Homo Sapiens; identical to SEQ ID NO: 41407

SEQ ID NO: 136892 - RNA, 64 nt, Homo Sapiens; identical to SEQ ID NO: 41408

SEQ ID NO: 136893 - RNA, 64 nt, Homo Sapiens; identical to SEQ ID NO: 41409

SEQ ID NO: 136894 - RNA, 64 nt, Homo Sapiens; identical to SEQ ID NO: 41410

SEQ ID NO: 136895 - RNA, 64 nt, Homo Sapiens; identical to SEQ ID NO: 41411

SEQ ID NO: 136896 - RNA, 64 nt, Homo Sapiens; identical to SEQ ID NO: 41412

SEQ ID NO: 136897 - RNA, 64 nt, Homo Sapiens; identical to SEQ ID NO: 41413

SEQ ID NO: 136898 - RNA, 64 nt, Homo Sapiens; identical to SEQ ID NO: 41414

SEQ ID NO: 136899 - RNA, 64 nt, Homo Sapiens; identical to SEQ ID NO: 41415

SEQ ID NO: 136900 - RNA, 64 nt, Homo Sapiens; identical to SEQ ID NO: 41416

SEQ ID NO: 136901 - RNA, 64 nt, Homo Sapiens; identical to SEQ ID NO: 41417

SEQ ID NO: 136902 - RNA, 64 nt, Homo Sapiens; identical to SEQ ID NO: 41418

SEQ ID NO: 136903 - RNA, 64 nt, Homo Sapiens; identical to SEQ ID NO: 41419

SEQ ID NO: 136904 - RNA, 64 nt, Homo Sapiens; identical to SEQ ID NO: 41420

SEQ ID NO: 136905 - RNA, 64 nt, Homo Sapiens; identical to SEQ ID NO: 41421

SEQ ID NO: 136906 - RNA, 64 nt, Homo Sapiens; identical to SEQ ID NO: 41422

SEQ ID NO: 136907 - RNA, 64 nt, Homo Sapiens; identical to SEQ ID NO: 41423

SEQ ID NO: 136908 - RNA, 64 nt, Homo Sapiens; identical to SEQ ID NO: 41424

SEQ ID NO: 136909 - RNA, 64 nt, Homo Sapiens; identical to SEQ ID NO: 41425

SEQ ID NO: 136910 - RNA, 64 nt, Homo Sapiens; identical to SEQ ID NO: 41426

SEQ ID NO: 136911 - RNA, 64 nt, Homo Sapiens; identical to SEQ ID NO: 41427

SEQ ID NO: 136912 - RNA, 64 nt, Homo Sapiens; identical to SEQ ID NO: 41428

SEQ ID NO: 136913 - RNA, 64 nt, Homo Sapiens; identical to SEQ ID NO: 41429

SEQ ID NO: 136914 - RNA, 64 nt, Homo Sapiens; identical to SEQ ID NO: 41430

SEQ ID NO: 136915 - RNA, 64 nt, Homo Sapiens; identical to SEQ ID NO: 41431

SEQ ID NO: 136916 - RNA, 64 nt, Homo Sapiens; identical to SEQ ID NO: 41432

SEQ ID NO: 136917 - RNA, 64 nt, Homo Sapiens; identical to SEQ ID NO: 41433

SEQ ID NO: 136918 - RNA, 64 nt, Homo Sapiens; identical to SEQ ID NO: 41434

SEQ ID NO: 136919 - RNA, 64 nt, Homo Sapiens; identical to SEQ ID NO: 41435

SEQ ID NO: 136920 - RNA, 64 nt, Homo Sapiens; identical to SEQ ID NO: 41436

SEQ ID NO: 136921 - RNA, 64 nt, Homo Sapiens; identical to SEQ ID NO: 41437

SEQ ID NO: 136922 - RNA, 64 nt, Homo Sapiens; identical to SEQ ID NO: 41438

SEQ ID NO: 136923 - RNA, 64 nt, Homo Sapiens; identical to SEQ ID NO: 41439

SEQ ID NO: 136924 - RNA, 64 nt, Homo Sapiens; identical to SEQ ID NO: 41440

SEQ ID NO: 136925 - RNA, 64 nt, Homo Sapiens; identical to SEQ ID NO: 41441

SEQ ID NO: 136926 - RNA, 64 nt, Homo Sapiens; identical to SEQ ID NO: 41442

SEQ ID NO: 136927 - RNA, 64 nt, Homo Sapiens; identical to SEQ ID NO: 41443

SEQ ID NO: 136928 - RNA, 64 nt, Homo Sapiens; identical to SEQ ID NO: 41444

SEQ ID NO: 136929 - RNA, 64 nt, Homo Sapiens; identical to SEQ ID NO: 41445

SEQ ID NO: 136930 - RNA, 64 nt, Homo Sapiens; identical to SEQ ID NO: 41446

SEQ ID NO: 136931 - RNA, 64 nt, Homo Sapiens; identical to SEQ ID NO: 41447

SEQ ID NO: 136932 - RNA, 64 nt, Homo Sapiens; identical to SEQ ID NO: 41448

SEQ ID NO: 136933 - RNA, 64 nt, Homo Sapiens; identical to SEQ ID NO: 41449

SEQ ID NO: 136934 - RNA, 64 nt, Homo Sapiens; identical to SEQ ID NO: 41450

SEQ ID NO: 136935 - RNA, 64 nt, Homo Sapiens; identical to SEQ ID NO: 41451

SEQ ID NO: 136936 - RNA, 64 nt, Homo Sapiens; identical to SEQ ID NO: 41452

SEQ ID NO: 136937 - RNA, 64 nt, Homo Sapiens; identical to SEQ ID NO: 41453

SEQ ID NO: 136938 - RNA, 64 nt, Homo Sapiens; identical to SEQ ID NO: 41454

SEQ ID NO: 136939 - RNA, 64 nt, Homo Sapiens; identical to SEQ ID NO: 41455

SEQ ID NO: 136940 - RNA, 64 nt, Homo Sapiens; identical to SEQ ID NO: 41456

SEQ ID NO: 136941 - RNA, 64 nt, Homo Sapiens; identical to SEQ ID NO: 41457

SEQ ID NO: 136942 - RNA, 64 nt, Homo Sapiens; identical to SEQ ID NO: 41458

SEQ ID NO: 136943 - RNA, 64 nt, Homo Sapiens; identical to SEQ ID NO: 41459

SEQ ID NO: 136944 - RNA, 64 nt, Homo Sapiens; identical to SEQ ID NO: 41460

SEQ ID NO: 136945 - RNA, 64 nt, Homo Sapiens; identical to SEQ ID NO: 41461

SEQ ID NO: 136946 - RNA, 64 nt, Homo Sapiens; identical to SEQ ID NO: 41462

SEQ ID NO: 136947 - RNA, 64 nt, Homo Sapiens; identical to SEQ ID NO: 41463

SEQ ID NO: 136948 - RNA, 64 nt, Homo Sapiens; identical to SEQ ID NO: 41464

SEQ ID NO: 136949 - RNA, 64 nt, Homo Sapiens; identical to SEQ ID NO: 41465

SEQ ID NO: 136950 - RNA, 64 nt, Homo Sapiens; identical to SEQ ID NO: 41466

SEQ ID NO: 136951 - RNA, 64 nt, Homo Sapiens; identical to SEQ ID NO: 41467

SEQ ID NO: 136952 - RNA, 64 nt, Homo Sapiens; identical to SEQ ID NO: 41468

SEQ ID NO: 136953 - RNA, 64 nt, Homo Sapiens; identical to SEQ ID NO: 41469

SEQ ID NO: 136954 - RNA, 64 nt, Homo Sapiens; identical to SEQ ID NO: 41470

SEQ ID NO: 136955 - RNA, 64 nt, Homo Sapiens; identical to SEQ ID NO: 41471

SEQ ID NO: 136956 - RNA, 64 nt, Homo Sapiens; identical to SEQ ID NO: 41472

SEQ ID NO: 136957 - RNA, 64 nt, Homo Sapiens; identical to SEQ ID NO: 41473

SEQ ID NO: 136958 - RNA, 64 nt, Homo Sapiens; identical to SEQ ID NO: 41474

SEQ ID NO: 136959 - RNA, 64 nt, Homo Sapiens; identical to SEQ ID NO: 41475

SEQ ID NO: 136960 - RNA, 64 nt, Homo Sapiens; identical to SEQ ID NO: 41476

SEQ ID NO: 136961 - RNA, 64 nt, Homo Sapiens; identical to SEQ ID NO: 41477

SEQ ID NO: 136962 - RNA, 64 nt, Homo Sapiens; identical to SEQ ID NO: 41478

SEQ ID NO: 136963 - RNA, 64 nt, Homo Sapiens; identical to SEQ ID NO: 41479

SEQ ID NO: 136964 - RNA, 64 nt, Homo Sapiens; identical to SEQ ID NO: 41480

SEQ ID NO: 136965 - RNA, 64 nt, Homo Sapiens; identical to SEQ ID NO: 41481

SEQ ID NO: 136966 - RNA, 64 nt, Homo Sapiens; identical to SEQ ID NO: 41482

SEQ ID NO: 136967 - RNA, 64 nt, Homo Sapiens; identical to SEQ ID NO: 41483

SEQ ID NO: 136968 - RNA, 64 nt, Homo Sapiens; identical to SEQ ID NO: 41484

SEQ ID NO: 136969 - RNA, 64 nt, Homo Sapiens; identical to SEQ ID NO: 41485

SEQ ID NO: 136970 - RNA, 64 nt, Homo Sapiens; identical to SEQ ID NO: 41486

SEQ ID NO: 136971 - RNA, 64 nt, Homo Sapiens; identical to SEQ ID NO: 41487

SEQ ID NO: 136972 - RNA, 64 nt, Homo Sapiens; identical to SEQ ID NO: 41488

SEQ ID NO: 136973 - RNA, 64 nt, Homo Sapiens; identical to SEQ ID NO: 41489

SEQ ID NO: 136974 - RNA, 64 nt, Homo Sapiens; identical to SEQ ID NO: 41490

SEQ ID NO: 136975 - RNA, 64 nt, Homo Sapiens; identical to SEQ ID NO: 41491

SEQ ID NO: 136976 - RNA, 64 nt, Homo Sapiens; identical to SEQ ID NO: 41492

SEQ ID NO: 136977 - RNA, 64 nt, Homo Sapiens; identical to SEQ ID NO: 41493

SEQ ID NO: 136978 - RNA, 64 nt, Homo Sapiens; identical to SEQ ID NO: 41494

SEQ ID NO: 136979 - RNA, 64 nt, Homo Sapiens; identical to SEQ ID NO: 41495

SEQ ID NO: 136980 - RNA, 64 nt, Homo Sapiens; identical to SEQ ID NO: 41496

SEQ ID NO: 136981 - RNA, 64 nt, Homo Sapiens; identical to SEQ ID NO: 41497

SEQ ID NO: 136982 - RNA, 64 nt, Homo Sapiens; identical to SEQ ID NO: 41498

SEQ ID NO: 136983 - RNA, 64 nt, Homo Sapiens; identical to SEQ ID NO: 41499

SEQ ID NO: 136984 - RNA, 64 nt, Homo Sapiens; identical to SEQ ID NO: 41500

SEQ ID NO: 136985 - RNA, 64 nt, Homo Sapiens; identical to SEQ ID NO: 41501

SEQ ID NO: 136986 - RNA, 64 nt, Homo Sapiens; identical to SEQ ID NO: 41502

SEQ ID NO: 136987 - RNA, 64 nt, Homo Sapiens; identical to SEQ ID NO: 41503

SEQ ID NO: 136988 - RNA, 64 nt, Homo Sapiens; identical to SEQ ID NO: 41504

SEQ ID NO: 136989 - RNA, 64 nt, Homo Sapiens; identical to SEQ ID NO: 41505

SEQ ID NO: 136990 - RNA, 64 nt, Homo Sapiens; identical to SEQ ID NO: 41506

SEQ ID NO: 136991 - RNA, 64 nt, Homo Sapiens; identical to SEQ ID NO: 41507

SEQ ID NO: 136992 - RNA, 64 nt, Homo Sapiens; identical to SEQ ID NO: 41508

SEQ ID NO: 136993 - RNA, 64 nt, Homo Sapiens; identical to SEQ ID NO: 41509

SEQ ID NO: 136994 - RNA, 64 nt, Homo Sapiens; identical to SEQ ID NO: 41510

SEQ ID NO: 136995 - RNA, 64 nt, Homo Sapiens; identical to SEQ ID NO: 41511

SEQ ID NO: 136996 - RNA, 64 nt, Homo Sapiens; identical to SEQ ID NO: 41512

SEQ ID NO: 136997 - RNA, 64 nt, Homo Sapiens; identical to SEQ ID NO: 41513

SEQ ID NO: 136998 - RNA, 64 nt, Homo Sapiens; identical to SEQ ID NO: 41514

SEQ ID NO: 136999 - RNA, 64 nt, Homo Sapiens; identical to SEQ ID NO: 41515

SEQ ID NO: 137000 - RNA, 64 nt, Homo Sapiens; identical to SEQ ID NO: 41516

SEQ ID NO: 137001 - RNA, 64 nt, Homo Sapiens; identical to SEQ ID NO: 41517

SEQ ID NO: 137002 - RNA, 64 nt, Homo Sapiens; identical to SEQ ID NO: 41518

SEQ ID NO: 137003 - RNA, 64 nt, Homo Sapiens; identical to SEQ ID NO: 41519

SEQ ID NO: 137004 - RNA, 64 nt, Homo Sapiens; identical to SEQ ID NO: 41520

SEQ ID NO: 137005 - RNA, 64 nt, Homo Sapiens; identical to SEQ ID NO: 41521

SEQ ID NO: 137006 - RNA, 64 nt, Homo Sapiens; identical to SEQ ID NO: 41522

SEQ ID NO: 137007 - RNA, 64 nt, Homo Sapiens; identical to SEQ ID NO: 41523

SEQ ID NO: 137008 - RNA, 64 nt, Homo Sapiens; identical to SEQ ID NO: 41524

SEQ ID NO: 137009 - RNA, 64 nt, Homo Sapiens; identical to SEQ ID NO: 41525

SEQ ID NO: 137010 - RNA, 64 nt, Homo Sapiens; identical to SEQ ID NO: 41526

SEQ ID NO: 137011 - RNA, 64 nt, Homo Sapiens; identical to SEQ ID NO: 41527

SEQ ID NO: 137012 - RNA, 64 nt, Homo Sapiens; identical to SEQ ID NO: 41528

SEQ ID NO: 137013 - RNA, 64 nt, Homo Sapiens; identical to SEQ ID NO: 41529

SEQ ID NO: 137014 - RNA, 64 nt, Homo Sapiens; identical to SEQ ID NO: 41530

SEQ ID NO: 137015 - RNA, 64 nt, Homo Sapiens; identical to SEQ ID NO: 41531

SEQ ID NO: 137016 - RNA, 64 nt, Homo Sapiens; identical to SEQ ID NO: 41532

SEQ ID NO: 137017 - RNA, 64 nt, Homo Sapiens; identical to SEQ ID NO: 41533

SEQ ID NO: 137018 - RNA, 64 nt, Homo Sapiens; identical to SEQ ID NO: 41534

SEQ ID NO: 137019 - RNA, 64 nt, Homo Sapiens; identical to SEQ ID NO: 41535

SEQ ID NO: 137020 - RNA, 64 nt, Homo Sapiens; identical to SEQ ID NO: 41536

SEQ ID NO: 137021 - RNA, 64 nt, Homo Sapiens; identical to SEQ ID NO: 41537

SEQ ID NO: 137022 - RNA, 64 nt, Homo Sapiens; identical to SEQ ID NO: 41538

SEQ ID NO: 137023 - RNA, 64 nt, Homo Sapiens; identical to SEQ ID NO: 41539

SEQ ID NO: 137024 - RNA, 64 nt, Homo Sapiens; identical to SEQ ID NO: 41540

SEQ ID NO: 137025 - RNA, 64 nt, Homo Sapiens; identical to SEQ ID NO: 41541

SEQ ID NO: 137026 - RNA, 64 nt, Homo Sapiens; identical to SEQ ID NO: 41542

SEQ ID NO: 137027 - RNA, 64 nt, Homo Sapiens; identical to SEQ ID NO: 41543

SEQ ID NO: 137028 - RNA, 64 nt, Homo Sapiens; identical to SEQ ID NO: 41544

SEQ ID NO: 137029 - RNA, 64 nt, Homo Sapiens; identical to SEQ ID NO: 41545

SEQ ID NO: 137030 - RNA, 64 nt, Homo Sapiens; identical to SEQ ID NO: 41546

SEQ ID NO: 137031 - RNA, 64 nt, Homo Sapiens; identical to SEQ ID NO: 41547

SEQ ID NO: 137032 - RNA, 64 nt, Homo Sapiens; identical to SEQ ID NO: 41548

SEQ ID NO: 137033 - RNA, 64 nt, Homo Sapiens; identical to SEQ ID NO: 41549

SEQ ID NO: 137034 - RNA, 64 nt, Homo Sapiens; identical to SEQ ID NO: 41550

SEQ ID NO: 137035 - RNA, 64 nt, Homo Sapiens; identical to SEQ ID NO: 41551

SEQ ID NO: 137036 - RNA, 64 nt, Homo Sapiens; identical to SEQ ID NO: 41552

SEQ ID NO: 137037 - RNA, 64 nt, Homo Sapiens; identical to SEQ ID NO: 41553

SEQ ID NO: 137038 - RNA, 64 nt, Homo Sapiens; identical to SEQ ID NO: 41554

SEQ ID NO: 137039 - RNA, 64 nt, Homo Sapiens; identical to SEQ ID NO: 41555

SEQ ID NO: 137040 - RNA, 64 nt, Homo Sapiens; identical to SEQ ID NO: 41556

SEQ ID NO: 137041 - RNA, 64 nt, Homo Sapiens; identical to SEQ ID NO: 41557

SEQ ID NO: 137042 - RNA, 64 nt, Homo Sapiens; identical to SEQ ID NO: 41558

SEQ ID NO: 137043 - RNA, 64 nt, Homo Sapiens; identical to SEQ ID NO: 41559

SEQ ID NO: 137044 - RNA, 64 nt, Homo Sapiens; identical to SEQ ID NO: 41560

SEQ ID NO: 137045 - RNA, 64 nt, Homo Sapiens; identical to SEQ ID NO: 41561

SEQ ID NO: 137046 - RNA, 64 nt, Homo Sapiens; identical to SEQ ID NO: 41562

SEQ ID NO: 137047 - RNA, 64 nt, Homo Sapiens; identical to SEQ ID NO: 41563

SEQ ID NO: 137048 - RNA, 64 nt, Homo Sapiens; identical to SEQ ID NO: 41564

SEQ ID NO: 137049 - RNA, 64 nt, Homo Sapiens; identical to SEQ ID NO: 41565

SEQ ID NO: 137050 - RNA, 64 nt, Homo Sapiens; identical to SEQ ID NO: 41566

SEQ ID NO: 137051 - RNA, 64 nt, Homo Sapiens; identical to SEQ ID NO: 41567

SEQ ID NO: 137052 - RNA, 64 nt, Homo Sapiens; identical to SEQ ID NO: 41568

SEQ ID NO: 137053 - RNA, 64 nt, Homo Sapiens; identical to SEQ ID NO: 41569

SEQ ID NO: 137054 - RNA, 64 nt, Homo Sapiens; identical to SEQ ID NO: 41570

SEQ ID NO: 137055 - RNA, 64 nt, Homo Sapiens; identical to SEQ ID NO: 41571

SEQ ID NO: 137056 - RNA, 64 nt, Homo Sapiens; identical to SEQ ID NO: 41572

SEQ ID NO: 137057 - RNA, 64 nt, Homo Sapiens; identical to SEQ ID NO: 41573

SEQ ID NO: 137058 - RNA, 64 nt, Homo Sapiens; identical to SEQ ID NO: 41574

SEQ ID NO: 137059 - RNA, 64 nt, Homo Sapiens; identical to SEQ ID NO: 41575

SEQ ID NO: 137060 - RNA, 64 nt, Homo Sapiens; identical to SEQ ID NO: 41576

SEQ ID NO: 137061 - RNA, 64 nt, Homo Sapiens; identical to SEQ ID NO: 41577

SEQ ID NO: 137062 - RNA, 64 nt, Homo Sapiens; identical to SEQ ID NO: 41578

SEQ ID NO: 137063 - RNA, 64 nt, Homo Sapiens; identical to SEQ ID NO: 41579

SEQ ID NO: 137064 - RNA, 64 nt, Homo Sapiens; identical to SEQ ID NO: 41580

SEQ ID NO: 137065 - RNA, 64 nt, Homo Sapiens; identical to SEQ ID NO: 41581

SEQ ID NO: 137066 - RNA, 64 nt, Homo Sapiens; identical to SEQ ID NO: 41582

SEQ ID NO: 137067 - RNA, 64 nt, Homo Sapiens; identical to SEQ ID NO: 41583

SEQ ID NO: 137068 - RNA, 64 nt, Homo Sapiens; identical to SEQ ID NO: 41584

SEQ ID NO: 137069 - RNA, 64 nt, Homo Sapiens; identical to SEQ ID NO: 41585

SEQ ID NO: 137070 - RNA, 64 nt, Homo Sapiens; identical to SEQ ID NO: 41586

SEQ ID NO: 137071 - RNA, 64 nt, Homo Sapiens; identical to SEQ ID NO: 41587

SEQ ID NO: 137072 - RNA, 64 nt, Homo Sapiens; identical to SEQ ID NO: 41588

SEQ ID NO: 137073 - RNA, 64 nt, Homo Sapiens; identical to SEQ ID NO: 41589

SEQ ID NO: 137074 - RNA, 64 nt, Homo Sapiens; identical to SEQ ID NO: 41590

SEQ ID NO: 137075 - RNA, 64 nt, Homo Sapiens; identical to SEQ ID NO: 41591

SEQ ID NO: 137076 - RNA, 64 nt, Homo Sapiens; identical to SEQ ID NO: 41592

SEQ ID NO: 137077 - RNA, 64 nt, Homo Sapiens; identical to SEQ ID NO: 41593

SEQ ID NO: 137078 - RNA, 64 nt, Homo Sapiens; identical to SEQ ID NO: 41594

SEQ ID NO: 137079 - RNA, 64 nt, Homo Sapiens; identical to SEQ ID NO: 41595

SEQ ID NO: 137080 - RNA, 64 nt, Homo Sapiens; identical to SEQ ID NO: 41596

SEQ ID NO: 137081 - RNA, 64 nt, Homo Sapiens; identical to SEQ ID NO: 41597

SEQ ID NO: 137082 - RNA, 64 nt, Homo Sapiens; identical to SEQ ID NO: 41598

SEQ ID NO: 137083 - RNA, 64 nt, Homo Sapiens; identical to SEQ ID NO: 41599

SEQ ID NO: 137084 - RNA, 64 nt, Homo Sapiens; identical to SEQ ID NO: 41600

SEQ ID NO: 137085 - RNA, 64 nt, Homo Sapiens; identical to SEQ ID NO: 41601

SEQ ID NO: 137086 - RNA, 64 nt, Homo Sapiens; identical to SEQ ID NO: 41602

SEQ ID NO: 137087 - RNA, 64 nt, Homo Sapiens; identical to SEQ ID NO: 41603

SEQ ID NO: 137088 - RNA, 64 nt, Homo Sapiens; identical to SEQ ID NO: 41604

SEQ ID NO: 137089 - RNA, 64 nt, Homo Sapiens; identical to SEQ ID NO: 41605

SEQ ID NO: 137090 - RNA, 64 nt, Homo Sapiens; identical to SEQ ID NO: 41606

SEQ ID NO: 137091 - RNA, 64 nt, Homo Sapiens; identical to SEQ ID NO: 41607

SEQ ID NO: 137092 - RNA, 64 nt, Homo Sapiens; identical to SEQ ID NO: 41608

SEQ ID NO: 137093 - RNA, 64 nt, Homo Sapiens; identical to SEQ ID NO: 41609

SEQ ID NO: 137094 - RNA, 64 nt, Homo Sapiens; identical to SEQ ID NO: 41610

SEQ ID NO: 137095 - RNA, 64 nt, Homo Sapiens; identical to SEQ ID NO: 41611

SEQ ID NO: 137096 - RNA, 64 nt, Homo Sapiens; identical to SEQ ID NO: 41612

SEQ ID NO: 137097 - RNA, 64 nt, Homo Sapiens; identical to SEQ ID NO: 41613

SEQ ID NO: 137098 - RNA, 64 nt, Homo Sapiens; identical to SEQ ID NO: 41614

SEQ ID NO: 137099 - RNA, 64 nt, Homo Sapiens; identical to SEQ ID NO: 41615

SEQ ID NO: 137100 - RNA, 64 nt, Homo Sapiens; identical to SEQ ID NO: 41616

SEQ ID NO: 137101 - RNA, 64 nt, Homo Sapiens; identical to SEQ ID NO: 41617

SEQ ID NO: 137102 - RNA, 64 nt, Homo Sapiens; identical to SEQ ID NO: 41618

SEQ ID NO: 137103 - RNA, 64 nt, Homo Sapiens; identical to SEQ ID NO: 41619

SEQ ID NO: 137104 - RNA, 64 nt, Homo Sapiens; identical to SEQ ID NO: 41620

SEQ ID NO: 137105 - RNA, 64 nt, Homo Sapiens; identical to SEQ ID NO: 41621

SEQ ID NO: 137106 - RNA, 63 nt, Homo Sapiens; identical to SEQ ID NO: 41622

SEQ ID NO: 137107 - RNA, 64 nt, Homo Sapiens; identical to SEQ ID NO: 41623

SEQ ID NO: 137108 - RNA, 64 nt, Homo Sapiens; identical to SEQ ID NO: 41624

SEQ ID NO: 137109 - RNA, 64 nt, Homo Sapiens; identical to SEQ ID NO: 41625

SEQ ID NO: 137110 - RNA, 64 nt, Homo Sapiens; identical to SEQ ID NO: 41626

SEQ ID NO: 137111 - RNA, 64 nt, Homo Sapiens; identical to SEQ ID NO: 41627

SEQ ID NO: 137112 - RNA, 64 nt, Homo Sapiens; identical to SEQ ID NO: 41628

SEQ ID NO: 137113 - RNA, 64 nt, Homo Sapiens; identical to SEQ ID NO: 41629

SEQ ID NO: 137114 - RNA, 64 nt, Homo Sapiens; identical to SEQ ID NO: 41630

SEQ ID NO: 137115 - RNA, 64 nt, Homo Sapiens; identical to SEQ ID NO: 41631

SEQ ID NO: 137116 - RNA, 64 nt, Homo Sapiens; identical to SEQ ID NO: 41632

SEQ ID NO: 137117 - RNA, 64 nt, Homo Sapiens; identical to SEQ ID NO: 41633

SEQ ID NO: 137118 - RNA, 64 nt, Homo Sapiens; identical to SEQ ID NO: 41634

SEQ ID NO: 137119 - RNA, 64 nt, Homo Sapiens; identical to SEQ ID NO: 41635

SEQ ID NO: 137120 - RNA, 64 nt, Homo Sapiens; identical to SEQ ID NO: 41636

SEQ ID NO: 137121 - RNA, 64 nt, Homo Sapiens; identical to SEQ ID NO: 41637

SEQ ID NO: 137122 - RNA, 64 nt, Homo Sapiens; identical to SEQ ID NO: 41638

SEQ ID NO: 137123 - RNA, 64 nt, Homo Sapiens; identical to SEQ ID NO: 41639

SEQ ID NO: 137124 - RNA, 64 nt, Homo Sapiens; identical to SEQ ID NO: 41640

SEQ ID NO: 137125 - RNA, 64 nt, Homo Sapiens; identical to SEQ ID NO: 41641

SEQ ID NO: 137126 - RNA, 64 nt, Homo Sapiens; identical to SEQ ID NO: 41642

SEQ ID NO: 137127 - RNA, 64 nt, Homo Sapiens; identical to SEQ ID NO: 41643

SEQ ID NO: 137128 - RNA, 64 nt, Homo Sapiens; identical to SEQ ID NO: 41644

SEQ ID NO: 137129 - RNA, 64 nt, Homo Sapiens; identical to SEQ ID NO: 41645

SEQ ID NO: 137130 - RNA, 64 nt, Homo Sapiens; identical to SEQ ID NO: 41646

SEQ ID NO: 137131 - RNA, 64 nt, Homo Sapiens; identical to SEQ ID NO: 41647

SEQ ID NO: 137132 - RNA, 64 nt, Homo Sapiens; identical to SEQ ID NO: 41648

SEQ ID NO: 137133 - RNA, 64 nt, Homo Sapiens; identical to SEQ ID NO: 41649

SEQ ID NO: 137134 - RNA, 64 nt, Homo Sapiens; identical to SEQ ID NO: 41650

SEQ ID NO: 137135 - RNA, 64 nt, Homo Sapiens; identical to SEQ ID NO: 41651

SEQ ID NO: 137136 - RNA, 64 nt, Homo Sapiens; identical to SEQ ID NO: 41652

SEQ ID NO: 137137 - RNA, 64 nt, Homo Sapiens; identical to SEQ ID NO: 41653

SEQ ID NO: 137138 - RNA, 64 nt, Homo Sapiens; identical to SEQ ID NO: 41654

SEQ ID NO: 137139 - RNA, 64 nt, Homo Sapiens; identical to SEQ ID NO: 41655

SEQ ID NO: 137140 - RNA, 64 nt, Homo Sapiens; identical to SEQ ID NO: 41656

SEQ ID NO: 137141 - RNA, 64 nt, Homo Sapiens; identical to SEQ ID NO: 41657

SEQ ID NO: 137142 - RNA, 64 nt, Homo Sapiens; identical to SEQ ID NO: 41658

SEQ ID NO: 137143 - RNA, 64 nt, Homo Sapiens; identical to SEQ ID NO: 41659

SEQ ID NO: 137144 - RNA, 64 nt, Homo Sapiens; identical to SEQ ID NO: 41660

SEQ ID NO: 137145 - RNA, 64 nt, Homo Sapiens; identical to SEQ ID NO: 41661

SEQ ID NO: 137146 - RNA, 64 nt, Homo Sapiens; identical to SEQ ID NO: 41662

SEQ ID NO: 137147 - RNA, 64 nt, Homo Sapiens; identical to SEQ ID NO: 41663

SEQ ID NO: 137148 - RNA, 64 nt, Homo Sapiens; identical to SEQ ID NO: 41664

SEQ ID NO: 137149 - RNA, 64 nt, Homo Sapiens; identical to SEQ ID NO: 41665

SEQ ID NO: 137150 - RNA, 64 nt, Homo Sapiens; identical to SEQ ID NO: 41666

SEQ ID NO: 137151 - RNA, 64 nt, Homo Sapiens; identical to SEQ ID NO: 41667

SEQ ID NO: 137152 - RNA, 64 nt, Homo Sapiens; identical to SEQ ID NO: 41668

SEQ ID NO: 137153 - RNA, 64 nt, Homo Sapiens; identical to SEQ ID NO: 41669

SEQ ID NO: 137154 - RNA, 64 nt, Homo Sapiens; identical to SEQ ID NO: 41670

SEQ ID NO: 137155 - RNA, 64 nt, Homo Sapiens; identical to SEQ ID NO: 41671

SEQ ID NO: 137156 - RNA, 64 nt, Homo Sapiens; identical to SEQ ID NO: 41672

SEQ ID NO: 137157 - RNA, 64 nt, Homo Sapiens; identical to SEQ ID NO: 41673

SEQ ID NO: 137158 - RNA, 64 nt, Homo Sapiens; identical to SEQ ID NO: 41674

SEQ ID NO: 137159 - RNA, 64 nt, Homo Sapiens; identical to SEQ ID NO: 41675

SEQ ID NO: 137160 - RNA, 64 nt, Homo Sapiens; identical to SEQ ID NO: 41676

SEQ ID NO: 137161 - RNA, 64 nt, Homo Sapiens; identical to SEQ ID NO: 41677

SEQ ID NO: 137162 - RNA, 64 nt, Homo Sapiens; identical to SEQ ID NO: 41678

SEQ ID NO: 137163 - RNA, 64 nt, Homo Sapiens; identical to SEQ ID NO: 41679

SEQ ID NO: 137164 - RNA, 64 nt, Homo Sapiens; identical to SEQ ID NO: 41680

SEQ ID NO: 137165 - RNA, 64 nt, Homo Sapiens; identical to SEQ ID NO: 41681

SEQ ID NO: 137166 - RNA, 64 nt, Homo Sapiens; identical to SEQ ID NO: 41682

SEQ ID NO: 137167 - RNA, 64 nt, Homo Sapiens; identical to SEQ ID NO: 41683

SEQ ID NO: 137168 - RNA, 64 nt, Homo Sapiens; identical to SEQ ID NO: 41684

SEQ ID NO: 137169 - RNA, 64 nt, Homo Sapiens; identical to SEQ ID NO: 41685

SEQ ID NO: 137170 - RNA, 64 nt, Homo Sapiens; identical to SEQ ID NO: 41686

SEQ ID NO: 137171 - RNA, 64 nt, Homo Sapiens; identical to SEQ ID NO: 41687

SEQ ID NO: 137172 - RNA, 64 nt, Homo Sapiens; identical to SEQ ID NO: 41688

SEQ ID NO: 137173 - RNA, 64 nt, Homo Sapiens; identical to SEQ ID NO: 41689

SEQ ID NO: 137174 - RNA, 64 nt, Homo Sapiens; identical to SEQ ID NO: 41690

SEQ ID NO: 137175 - RNA, 64 nt, Homo Sapiens; identical to SEQ ID NO: 41691

SEQ ID NO: 137176 - RNA, 64 nt, Homo Sapiens; identical to SEQ ID NO: 41692

SEQ ID NO: 137177 - RNA, 64 nt, Homo Sapiens; identical to SEQ ID NO: 41693

SEQ ID NO: 137178 - RNA, 64 nt, Homo Sapiens; identical to SEQ ID NO: 41694

SEQ ID NO: 137179 - RNA, 64 nt, Homo Sapiens; identical to SEQ ID NO: 41695

SEQ ID NO: 137180 - RNA, 64 nt, Homo Sapiens; identical to SEQ ID NO: 41696

SEQ ID NO: 137181 - RNA, 64 nt, Homo Sapiens; identical to SEQ ID NO: 41697

SEQ ID NO: 137182 - RNA, 64 nt, Homo Sapiens; identical to SEQ ID NO: 41698

SEQ ID NO: 137183 - RNA, 64 nt, Homo Sapiens; identical to SEQ ID NO: 41699

SEQ ID NO: 137184 - RNA, 64 nt, Homo Sapiens; identical to SEQ ID NO: 41700

SEQ ID NO: 137185 - RNA, 64 nt, Homo Sapiens; identical to SEQ ID NO: 41701

SEQ ID NO: 137186 - RNA, 64 nt, Homo Sapiens; identical to SEQ ID NO: 41702

SEQ ID NO: 137187 - RNA, 64 nt, Homo Sapiens; identical to SEQ ID NO: 41703

SEQ ID NO: 137188 - RNA, 64 nt, Homo Sapiens; identical to SEQ ID NO: 41704

SEQ ID NO: 137189 - RNA, 64 nt, Homo Sapiens; identical to SEQ ID NO: 41705

SEQ ID NO: 137190 - RNA, 64 nt, Homo Sapiens; identical to SEQ ID NO: 41706

SEQ ID NO: 137191 - RNA, 64 nt, Homo Sapiens; identical to SEQ ID NO: 41707

SEQ ID NO: 137192 - RNA, 64 nt, Homo Sapiens; identical to SEQ ID NO: 41708

SEQ ID NO: 137193 - RNA, 64 nt, Homo Sapiens; identical to SEQ ID NO: 41709

SEQ ID NO: 137194 - RNA, 64 nt, Homo Sapiens; identical to SEQ ID NO: 41710

SEQ ID NO: 137195 - RNA, 64 nt, Homo Sapiens; identical to SEQ ID NO: 41711

SEQ ID NO: 137196 - RNA, 64 nt, Homo Sapiens; identical to SEQ ID NO: 41712

SEQ ID NO: 137197 - RNA, 64 nt, Homo Sapiens; identical to SEQ ID NO: 41713

SEQ ID NO: 137198 - RNA, 64 nt, Homo Sapiens; identical to SEQ ID NO: 41714

SEQ ID NO: 137199 - RNA, 64 nt, Homo Sapiens; identical to SEQ ID NO: 41715

SEQ ID NO: 137200 - RNA, 64 nt, Homo Sapiens; identical to SEQ ID NO: 41716

SEQ ID NO: 137201 - RNA, 64 nt, Homo Sapiens; identical to SEQ ID NO: 41717

SEQ ID NO: 137202 - RNA, 64 nt, Homo Sapiens; identical to SEQ ID NO: 41718

SEQ ID NO: 137203 - RNA, 64 nt, Homo Sapiens; identical to SEQ ID NO: 41719

SEQ ID NO: 137204 - RNA, 64 nt, Homo Sapiens; identical to SEQ ID NO: 41720

SEQ ID NO: 137205 - RNA, 64 nt, Homo Sapiens; identical to SEQ ID NO: 41721

SEQ ID NO: 137206 - RNA, 64 nt, Homo Sapiens; identical to SEQ ID NO: 41722

SEQ ID NO: 137207 - RNA, 64 nt, Homo Sapiens; identical to SEQ ID NO: 41723

SEQ ID NO: 137208 - RNA, 64 nt, Homo Sapiens; identical to SEQ ID NO: 41724

SEQ ID NO: 137209 - RNA, 64 nt, Homo Sapiens; identical to SEQ ID NO: 41725

SEQ ID NO: 137210 - RNA, 64 nt, Homo Sapiens; identical to SEQ ID NO: 41726

SEQ ID NO: 137211 - RNA, 64 nt, Homo Sapiens; identical to SEQ ID NO: 41727

SEQ ID NO: 137212 - RNA, 64 nt, Homo Sapiens; identical to SEQ ID NO: 41728

SEQ ID NO: 137213 - RNA, 64 nt, Homo Sapiens; identical to SEQ ID NO: 41729

SEQ ID NO: 137214 - RNA, 64 nt, Homo Sapiens; identical to SEQ ID NO: 41730

SEQ ID NO: 137215 - RNA, 64 nt, Homo Sapiens; identical to SEQ ID NO: 41731

SEQ ID NO: 137216 - RNA, 64 nt, Homo Sapiens; identical to SEQ ID NO: 41732

SEQ ID NO: 137217 - RNA, 64 nt, Homo Sapiens; identical to SEQ ID NO: 41733

SEQ ID NO: 137218 - RNA, 64 nt, Homo Sapiens; identical to SEQ ID NO: 41734

SEQ ID NO: 137219 - RNA, 64 nt, Homo Sapiens; identical to SEQ ID NO: 41735

SEQ ID NO: 137220 - RNA, 64 nt, Homo Sapiens; identical to SEQ ID NO: 41736

SEQ ID NO: 137221 - RNA, 64 nt, Homo Sapiens; identical to SEQ ID NO: 41737

SEQ ID NO: 137222 - RNA, 64 nt, Homo Sapiens; identical to SEQ ID NO: 41738

SEQ ID NO: 137223 - RNA, 64 nt, Homo Sapiens; identical to SEQ ID NO: 41739

SEQ ID NO: 137224 - RNA, 64 nt, Homo Sapiens; identical to SEQ ID NO: 41740

SEQ ID NO: 137225 - RNA, 64 nt, Homo Sapiens; identical to SEQ ID NO: 41741

SEQ ID NO: 137226 - RNA, 64 nt, Homo Sapiens; identical to SEQ ID NO: 41742

SEQ ID NO: 137227 - RNA, 64 nt, Homo Sapiens; identical to SEQ ID NO: 41743

SEQ ID NO: 137228 - RNA, 64 nt, Homo Sapiens; identical to SEQ ID NO: 41744

SEQ ID NO: 137229 - RNA, 64 nt, Homo Sapiens; identical to SEQ ID NO: 41745

SEQ ID NO: 137230 - RNA, 64 nt, Homo Sapiens; identical to SEQ ID NO: 41746

SEQ ID NO: 137231 - RNA, 64 nt, Homo Sapiens; identical to SEQ ID NO: 41747

SEQ ID NO: 137232 - RNA, 64 nt, Homo Sapiens; identical to SEQ ID NO: 41748

SEQ ID NO: 137233 - RNA, 64 nt, Homo Sapiens; identical to SEQ ID NO: 41749

SEQ ID NO: 137234 - RNA, 64 nt, Homo Sapiens; identical to SEQ ID NO: 41750

SEQ ID NO: 137235 - RNA, 64 nt, Homo Sapiens; identical to SEQ ID NO: 41751

SEQ ID NO: 137236 - RNA, 64 nt, Homo Sapiens; identical to SEQ ID NO: 41752

SEQ ID NO: 137237 - RNA, 64 nt, Homo Sapiens; identical to SEQ ID NO: 41753

SEQ ID NO: 137238 - RNA, 64 nt, Homo Sapiens; identical to SEQ ID NO: 41754

SEQ ID NO: 137239 - RNA, 64 nt, Homo Sapiens; identical to SEQ ID NO: 41755

SEQ ID NO: 137240 - RNA, 64 nt, Homo Sapiens; identical to SEQ ID NO: 41756

SEQ ID NO: 137241 - RNA, 64 nt, Homo Sapiens; identical to SEQ ID NO: 41757

SEQ ID NO: 137242 - RNA, 64 nt, Homo Sapiens; identical to SEQ ID NO: 41758

SEQ ID NO: 137243 - RNA, 64 nt, Homo Sapiens; identical to SEQ ID NO: 41759

SEQ ID NO: 137244 - RNA, 64 nt, Homo Sapiens; identical to SEQ ID NO: 41760

SEQ ID NO: 137245 - RNA, 64 nt, Homo Sapiens; identical to SEQ ID NO: 41761

SEQ ID NO: 137246 - RNA, 64 nt, Homo Sapiens; identical to SEQ ID NO: 41762

SEQ ID NO: 137247 - RNA, 64 nt, Homo Sapiens; identical to SEQ ID NO: 41763

SEQ ID NO: 137248 - RNA, 64 nt, Homo Sapiens; identical to SEQ ID NO: 41764

SEQ ID NO: 137249 - RNA, 64 nt, Homo Sapiens; identical to SEQ ID NO: 41765

SEQ ID NO: 137250 - RNA, 64 nt, Homo Sapiens; identical to SEQ ID NO: 41766

SEQ ID NO: 137251 - RNA, 64 nt, Homo Sapiens; identical to SEQ ID NO: 41767

SEQ ID NO: 137252 - RNA, 64 nt, Homo Sapiens; identical to SEQ ID NO: 41768

SEQ ID NO: 137253 - RNA, 64 nt, Homo Sapiens; identical to SEQ ID NO: 41769

SEQ ID NO: 137254 - RNA, 64 nt, Homo Sapiens; identical to SEQ ID NO: 41770

SEQ ID NO: 137255 - RNA, 64 nt, Homo Sapiens; identical to SEQ ID NO: 41771

SEQ ID NO: 137256 - RNA, 64 nt, Homo Sapiens; identical to SEQ ID NO: 41772

SEQ ID NO: 137257 - RNA, 64 nt, Homo Sapiens; identical to SEQ ID NO: 41773

SEQ ID NO: 137258 - RNA, 64 nt, Homo Sapiens; identical to SEQ ID NO: 41774

SEQ ID NO: 137259 - RNA, 64 nt, Homo Sapiens; identical to SEQ ID NO: 41775

SEQ ID NO: 137260 - RNA, 64 nt, Homo Sapiens; identical to SEQ ID NO: 41776

SEQ ID NO: 137261 - RNA, 64 nt, Homo Sapiens; identical to SEQ ID NO: 41777

SEQ ID NO: 137262 - RNA, 64 nt, Homo Sapiens; identical to SEQ ID NO: 41778

SEQ ID NO: 137263 - RNA, 64 nt, Homo Sapiens; identical to SEQ ID NO: 41779

SEQ ID NO: 137264 - RNA, 64 nt, Homo Sapiens; identical to SEQ ID NO: 41780

SEQ ID NO: 137265 - RNA, 64 nt, Homo Sapiens; identical to SEQ ID NO: 41781

SEQ ID NO: 137266 - RNA, 64 nt, Homo Sapiens; identical to SEQ ID NO: 41782

SEQ ID NO: 137267 - RNA, 64 nt, Homo Sapiens; identical to SEQ ID NO: 41783

SEQ ID NO: 137268 - RNA, 64 nt, Homo Sapiens; identical to SEQ ID NO: 41784

SEQ ID NO: 137269 - RNA, 64 nt, Homo Sapiens; identical to SEQ ID NO: 41785

SEQ ID NO: 137270 - RNA, 64 nt, Homo Sapiens; identical to SEQ ID NO: 41786

SEQ ID NO: 137271 - RNA, 64 nt, Homo Sapiens; identical to SEQ ID NO: 41787

SEQ ID NO: 137272 - RNA, 64 nt, Homo Sapiens; identical to SEQ ID NO: 41788

SEQ ID NO: 137273 - RNA, 64 nt, Homo Sapiens; identical to SEQ ID NO: 41789

SEQ ID NO: 137274 - RNA, 64 nt, Homo Sapiens; identical to SEQ ID NO: 41790

SEQ ID NO: 137275 - RNA, 64 nt, Homo Sapiens; identical to SEQ ID NO: 41791

SEQ ID NO: 137276 - RNA, 64 nt, Homo Sapiens; identical to SEQ ID NO: 41792

SEQ ID NO: 137277 - RNA, 64 nt, Homo Sapiens; identical to SEQ ID NO: 41793

SEQ ID NO: 137278 - RNA, 64 nt, Homo Sapiens; identical to SEQ ID NO: 41794

SEQ ID NO: 137279 - RNA, 64 nt, Homo Sapiens; identical to SEQ ID NO: 41795

SEQ ID NO: 137280 - RNA, 64 nt, Homo Sapiens; identical to SEQ ID NO: 41796

SEQ ID NO: 137281 - RNA, 64 nt, Homo Sapiens; identical to SEQ ID NO: 41797

SEQ ID NO: 137282 - RNA, 64 nt, Homo Sapiens; identical to SEQ ID NO: 41798

SEQ ID NO: 137283 - RNA, 64 nt, Homo Sapiens; identical to SEQ ID NO: 41799

SEQ ID NO: 137284 - RNA, 64 nt, Homo Sapiens; identical to SEQ ID NO: 41800

SEQ ID NO: 137285 - RNA, 64 nt, Homo Sapiens; identical to SEQ ID NO: 41801

SEQ ID NO: 137286 - RNA, 64 nt, Homo Sapiens; identical to SEQ ID NO: 41802

SEQ ID NO: 137287 - RNA, 64 nt, Homo Sapiens; identical to SEQ ID NO: 41803

SEQ ID NO: 137288 - RNA, 64 nt, Homo Sapiens; identical to SEQ ID NO: 41804

SEQ ID NO: 137289 - RNA, 64 nt, Homo Sapiens; identical to SEQ ID NO: 41805

SEQ ID NO: 137290 - RNA, 64 nt, Homo Sapiens; identical to SEQ ID NO: 41806

SEQ ID NO: 137291 - RNA, 64 nt, Homo Sapiens; identical to SEQ ID NO: 41807

SEQ ID NO: 137292 - RNA, 64 nt, Homo Sapiens; identical to SEQ ID NO: 41808

SEQ ID NO: 137293 - RNA, 64 nt, Homo Sapiens; identical to SEQ ID NO: 41809

SEQ ID NO: 137294 - RNA, 64 nt, Homo Sapiens; identical to SEQ ID NO: 41810

SEQ ID NO: 137295 - RNA, 64 nt, Homo Sapiens; identical to SEQ ID NO: 41811

SEQ ID NO: 137296 - RNA, 64 nt, Homo Sapiens; identical to SEQ ID NO: 41812

SEQ ID NO: 137297 - RNA, 64 nt, Homo Sapiens; identical to SEQ ID NO: 41813

SEQ ID NO: 137298 - RNA, 64 nt, Homo Sapiens; identical to SEQ ID NO: 41814

SEQ ID NO: 137299 - RNA, 64 nt, Homo Sapiens; identical to SEQ ID NO: 41815

SEQ ID NO: 137300 - RNA, 64 nt, Homo Sapiens; identical to SEQ ID NO: 41816

SEQ ID NO: 137301 - RNA, 64 nt, Homo Sapiens; identical to SEQ ID NO: 41817

SEQ ID NO: 137302 - RNA, 64 nt, Homo Sapiens; identical to SEQ ID NO: 41818

SEQ ID NO: 137303 - RNA, 64 nt, Homo Sapiens; identical to SEQ ID NO: 41819

SEQ ID NO: 137304 - RNA, 64 nt, Homo Sapiens; identical to SEQ ID NO: 41820

SEQ ID NO: 137305 - RNA, 64 nt, Homo Sapiens; identical to SEQ ID NO: 41821

SEQ ID NO: 137306 - RNA, 64 nt, Homo Sapiens; identical to SEQ ID NO: 41822

SEQ ID NO: 137307 - RNA, 64 nt, Homo Sapiens; identical to SEQ ID NO: 41823

SEQ ID NO: 137308 - RNA, 64 nt, Homo Sapiens; identical to SEQ ID NO: 41824

SEQ ID NO: 137309 - RNA, 64 nt, Homo Sapiens; identical to SEQ ID NO: 41825

SEQ ID NO: 137310 - RNA, 64 nt, Homo Sapiens; identical to SEQ ID NO: 41826

SEQ ID NO: 137311 - RNA, 64 nt, Homo Sapiens; identical to SEQ ID NO: 41827

SEQ ID NO: 137312 - RNA, 64 nt, Homo Sapiens; identical to SEQ ID NO: 41828

SEQ ID NO: 137313 - RNA, 64 nt, Homo Sapiens; identical to SEQ ID NO: 41829

SEQ ID NO: 137314 - RNA, 64 nt, Homo Sapiens; identical to SEQ ID NO: 41830

SEQ ID NO: 137315 - RNA, 64 nt, Homo Sapiens; identical to SEQ ID NO: 41831

SEQ ID NO: 137316 - RNA, 64 nt, Homo Sapiens; identical to SEQ ID NO: 41832

SEQ ID NO: 137317 - RNA, 64 nt, Homo Sapiens; identical to SEQ ID NO: 41833

SEQ ID NO: 137318 - RNA, 64 nt, Homo Sapiens; identical to SEQ ID NO: 41834

SEQ ID NO: 137319 - RNA, 64 nt, Homo Sapiens; identical to SEQ ID NO: 41835

SEQ ID NO: 137320 - RNA, 64 nt, Homo Sapiens; identical to SEQ ID NO: 41836

SEQ ID NO: 137321 - RNA, 64 nt, Homo Sapiens; identical to SEQ ID NO: 41837

SEQ ID NO: 137322 - RNA, 64 nt, Homo Sapiens; identical to SEQ ID NO: 41838

SEQ ID NO: 137323 - RNA, 64 nt, Homo Sapiens; identical to SEQ ID NO: 41839

SEQ ID NO: 137324 - RNA, 64 nt, Homo Sapiens; identical to SEQ ID NO: 41840

SEQ ID NO: 137325 - RNA, 64 nt, Homo Sapiens; identical to SEQ ID NO: 41841

SEQ ID NO: 137326 - RNA, 64 nt, Homo Sapiens; identical to SEQ ID NO: 41842

SEQ ID NO: 137327 - RNA, 64 nt, Homo Sapiens; identical to SEQ ID NO: 41843

SEQ ID NO: 137328 - RNA, 64 nt, Homo Sapiens; identical to SEQ ID NO: 41844

SEQ ID NO: 137329 - RNA, 64 nt, Homo Sapiens; identical to SEQ ID NO: 41845

SEQ ID NO: 137330 - RNA, 64 nt, Homo Sapiens; identical to SEQ ID NO: 41846

SEQ ID NO: 137331 - RNA, 64 nt, Homo Sapiens; identical to SEQ ID NO: 41847

SEQ ID NO: 137332 - RNA, 64 nt, Homo Sapiens; identical to SEQ ID NO: 41848

SEQ ID NO: 137333 - RNA, 64 nt, Homo Sapiens; identical to SEQ ID NO: 41849

SEQ ID NO: 137334 - RNA, 64 nt, Homo Sapiens; identical to SEQ ID NO: 41850

SEQ ID NO: 137335 - RNA, 64 nt, Homo Sapiens; identical to SEQ ID NO: 41851

SEQ ID NO: 137336 - RNA, 64 nt, Homo Sapiens; identical to SEQ ID NO: 41852

SEQ ID NO: 137337 - RNA, 64 nt, Homo Sapiens; identical to SEQ ID NO: 41853

SEQ ID NO: 137338 - RNA, 64 nt, Homo Sapiens; identical to SEQ ID NO: 41854

SEQ ID NO: 137339 - RNA, 64 nt, Homo Sapiens; identical to SEQ ID NO: 41855

SEQ ID NO: 137340 - RNA, 64 nt, Homo Sapiens; identical to SEQ ID NO: 41856

SEQ ID NO: 137341 - RNA, 64 nt, Homo Sapiens; identical to SEQ ID NO: 41857

SEQ ID NO: 137342 - RNA, 64 nt, Homo Sapiens; identical to SEQ ID NO: 41858

SEQ ID NO: 137343 - RNA, 64 nt, Homo Sapiens; identical to SEQ ID NO: 41859

SEQ ID NO: 137344 - RNA, 64 nt, Homo Sapiens; identical to SEQ ID NO: 41860

SEQ ID NO: 137345 - RNA, 64 nt, Homo Sapiens; identical to SEQ ID NO: 41861

SEQ ID NO: 137346 - RNA, 64 nt, Homo Sapiens; identical to SEQ ID NO: 41862

SEQ ID NO: 137347 - RNA, 64 nt, Homo Sapiens; identical to SEQ ID NO: 41863

SEQ ID NO: 137348 - RNA, 64 nt, Homo Sapiens; identical to SEQ ID NO: 41864

SEQ ID NO: 137349 - RNA, 64 nt, Homo Sapiens; identical to SEQ ID NO: 41865

SEQ ID NO: 137350 - RNA, 64 nt, Homo Sapiens; identical to SEQ ID NO: 41866

SEQ ID NO: 137351 - RNA, 64 nt, Homo Sapiens; identical to SEQ ID NO: 41867

SEQ ID NO: 137352 - RNA, 64 nt, Homo Sapiens; identical to SEQ ID NO: 41868

SEQ ID NO: 137353 - RNA, 64 nt, Homo Sapiens; identical to SEQ ID NO: 41869

SEQ ID NO: 137354 - RNA, 64 nt, Homo Sapiens; identical to SEQ ID NO: 41870

SEQ ID NO: 137355 - RNA, 64 nt, Homo Sapiens; identical to SEQ ID NO: 41871

SEQ ID NO: 137356 - RNA, 64 nt, Homo Sapiens; identical to SEQ ID NO: 41872

SEQ ID NO: 137357 - RNA, 64 nt, Homo Sapiens; identical to SEQ ID NO: 41873

SEQ ID NO: 137358 - RNA, 64 nt, Homo Sapiens; identical to SEQ ID NO: 41874

SEQ ID NO: 137359 - RNA, 64 nt, Homo Sapiens; identical to SEQ ID NO: 41875

SEQ ID NO: 137360 - RNA, 64 nt, Homo Sapiens; identical to SEQ ID NO: 41876

SEQ ID NO: 137361 - RNA, 64 nt, Homo Sapiens; identical to SEQ ID NO: 41877

SEQ ID NO: 137362 - RNA, 64 nt, Homo Sapiens; identical to SEQ ID NO: 41878

SEQ ID NO: 137363 - RNA, 64 nt, Homo Sapiens; identical to SEQ ID NO: 41879

SEQ ID NO: 137364 - RNA, 64 nt, Homo Sapiens; identical to SEQ ID NO: 41880

SEQ ID NO: 137365 - RNA, 64 nt, Homo Sapiens; identical to SEQ ID NO: 41881

SEQ ID NO: 137366 - RNA, 64 nt, Homo Sapiens; identical to SEQ ID NO: 41882

SEQ ID NO: 137367 - RNA, 64 nt, Homo Sapiens; identical to SEQ ID NO: 41883

SEQ ID NO: 137368 - RNA, 64 nt, Homo Sapiens; identical to SEQ ID NO: 41884

SEQ ID NO: 137369 - RNA, 64 nt, Homo Sapiens; identical to SEQ ID NO: 41885

SEQ ID NO: 137370 - RNA, 64 nt, Homo Sapiens; identical to SEQ ID NO: 41886

SEQ ID NO: 137371 - RNA, 64 nt, Homo Sapiens; identical to SEQ ID NO: 41887

SEQ ID NO: 137372 - RNA, 64 nt, Homo Sapiens; identical to SEQ ID NO: 41888

SEQ ID NO: 137373 - RNA, 64 nt, Homo Sapiens; identical to SEQ ID NO: 41889

SEQ ID NO: 137374 - RNA, 64 nt, Homo Sapiens; identical to SEQ ID NO: 41890

SEQ ID NO: 137375 - RNA, 64 nt, Homo Sapiens; identical to SEQ ID NO: 41891

SEQ ID NO: 137376 - RNA, 64 nt, Homo Sapiens; identical to SEQ ID NO: 41892

SEQ ID NO: 137377 - RNA, 64 nt, Homo Sapiens; identical to SEQ ID NO: 41893

SEQ ID NO: 137378 - RNA, 64 nt, Homo Sapiens; identical to SEQ ID NO: 41894

SEQ ID NO: 137379 - RNA, 64 nt, Homo Sapiens; identical to SEQ ID NO: 41895

SEQ ID NO: 137380 - RNA, 64 nt, Homo Sapiens; identical to SEQ ID NO: 41896

SEQ ID NO: 137381 - RNA, 64 nt, Homo Sapiens; identical to SEQ ID NO: 41897

SEQ ID NO: 137382 - RNA, 64 nt, Homo Sapiens; identical to SEQ ID NO: 41898

SEQ ID NO: 137383 - RNA, 64 nt, Homo Sapiens; identical to SEQ ID NO: 41899

SEQ ID NO: 137384 - RNA, 64 nt, Homo Sapiens; identical to SEQ ID NO: 41900

SEQ ID NO: 137385 - RNA, 64 nt, Homo Sapiens; identical to SEQ ID NO: 41901

SEQ ID NO: 137386 - RNA, 64 nt, Homo Sapiens; identical to SEQ ID NO: 41902

SEQ ID NO: 137387 - RNA, 64 nt, Homo Sapiens; identical to SEQ ID NO: 41903

SEQ ID NO: 137388 - RNA, 64 nt, Homo Sapiens; identical to SEQ ID NO: 41904

SEQ ID NO: 137389 - RNA, 64 nt, Homo Sapiens; identical to SEQ ID NO: 41905

SEQ ID NO: 137390 - RNA, 64 nt, Homo Sapiens; identical to SEQ ID NO: 41906

SEQ ID NO: 137391 - RNA, 64 nt, Homo Sapiens; identical to SEQ ID NO: 41907

SEQ ID NO: 137392 - RNA, 64 nt, Homo Sapiens; identical to SEQ ID NO: 41908

SEQ ID NO: 137393 - RNA, 64 nt, Homo Sapiens; identical to SEQ ID NO: 41909

SEQ ID NO: 137394 - RNA, 64 nt, Homo Sapiens; identical to SEQ ID NO: 41910

SEQ ID NO: 137395 - RNA, 64 nt, Homo Sapiens; identical to SEQ ID NO: 41911

SEQ ID NO: 137396 - RNA, 64 nt, Homo Sapiens; identical to SEQ ID NO: 41912

SEQ ID NO: 137397 - RNA, 64 nt, Homo Sapiens; identical to SEQ ID NO: 41913

SEQ ID NO: 137398 - RNA, 64 nt, Homo Sapiens; identical to SEQ ID NO: 41914

SEQ ID NO: 137399 - RNA, 64 nt, Homo Sapiens; identical to SEQ ID NO: 41915

SEQ ID NO: 137400 - RNA, 64 nt, Homo Sapiens; identical to SEQ ID NO: 41916

SEQ ID NO: 137401 - RNA, 64 nt, Homo Sapiens; identical to SEQ ID NO: 41917

SEQ ID NO: 137402 - RNA, 64 nt, Homo Sapiens; identical to SEQ ID NO: 41918

SEQ ID NO: 137403 - RNA, 64 nt, Homo Sapiens; identical to SEQ ID NO: 41919

SEQ ID NO: 137404 - RNA, 64 nt, Homo Sapiens; identical to SEQ ID NO: 41920

SEQ ID NO: 137405 - RNA, 64 nt, Homo Sapiens; identical to SEQ ID NO: 41921

SEQ ID NO: 137406 - RNA, 64 nt, Homo Sapiens; identical to SEQ ID NO: 41922

SEQ ID NO: 137407 - RNA, 64 nt, Homo Sapiens; identical to SEQ ID NO: 41923

SEQ ID NO: 137408 - RNA, 64 nt, Homo Sapiens; identical to SEQ ID NO: 41924

SEQ ID NO: 137409 - RNA, 64 nt, Homo Sapiens; identical to SEQ ID NO: 41925

SEQ ID NO: 137410 - RNA, 64 nt, Homo Sapiens; identical to SEQ ID NO: 41926

SEQ ID NO: 137411 - RNA, 64 nt, Homo Sapiens; identical to SEQ ID NO: 41927

SEQ ID NO: 137412 - RNA, 64 nt, Homo Sapiens; identical to SEQ ID NO: 41928

SEQ ID NO: 137413 - RNA, 64 nt, Homo Sapiens; identical to SEQ ID NO: 41929

SEQ ID NO: 137414 - RNA, 64 nt, Homo Sapiens; identical to SEQ ID NO: 41930

SEQ ID NO: 137415 - RNA, 64 nt, Homo Sapiens; identical to SEQ ID NO: 41931

SEQ ID NO: 137416 - RNA, 64 nt, Homo Sapiens; identical to SEQ ID NO: 41932

SEQ ID NO: 137417 - RNA, 64 nt, Homo Sapiens; identical to SEQ ID NO: 41933

SEQ ID NO: 137418 - RNA, 64 nt, Homo Sapiens; identical to SEQ ID NO: 41934

SEQ ID NO: 137419 - RNA, 64 nt, Homo Sapiens; identical to SEQ ID NO: 41935

SEQ ID NO: 137420 - RNA, 64 nt, Homo Sapiens; identical to SEQ ID NO: 41936

SEQ ID NO: 137421 - RNA, 64 nt, Homo Sapiens; identical to SEQ ID NO: 41937

SEQ ID NO: 137422 - RNA, 64 nt, Homo Sapiens; identical to SEQ ID NO: 41938

SEQ ID NO: 137423 - RNA, 64 nt, Homo Sapiens; identical to SEQ ID NO: 41939

SEQ ID NO: 137424 - RNA, 64 nt, Homo Sapiens; identical to SEQ ID NO: 41940

SEQ ID NO: 137425 - RNA, 64 nt, Homo Sapiens; identical to SEQ ID NO: 41941

SEQ ID NO: 137426 - RNA, 64 nt, Homo Sapiens; identical to SEQ ID NO: 41942

SEQ ID NO: 137427 - RNA, 64 nt, Homo Sapiens; identical to SEQ ID NO: 41943

SEQ ID NO: 137428 - RNA, 64 nt, Homo Sapiens; identical to SEQ ID NO: 41944

SEQ ID NO: 137429 - RNA, 64 nt, Homo Sapiens; identical to SEQ ID NO: 41945

SEQ ID NO: 137430 - RNA, 64 nt, Homo Sapiens; identical to SEQ ID NO: 41946

SEQ ID NO: 137431 - RNA, 64 nt, Homo Sapiens; identical to SEQ ID NO: 41947

SEQ ID NO: 137432 - RNA, 64 nt, Homo Sapiens; identical to SEQ ID NO: 41948

SEQ ID NO: 137433 - RNA, 64 nt, Homo Sapiens; identical to SEQ ID NO: 41949

SEQ ID NO: 137434 - RNA, 64 nt, Homo Sapiens; identical to SEQ ID NO: 41950

SEQ ID NO: 137435 - RNA, 64 nt, Homo Sapiens; identical to SEQ ID NO: 41951

SEQ ID NO: 137436 - RNA, 64 nt, Homo Sapiens; identical to SEQ ID NO: 41952

SEQ ID NO: 137437 - RNA, 64 nt, Homo Sapiens; identical to SEQ ID NO: 41953

SEQ ID NO: 137438 - RNA, 64 nt, Homo Sapiens; identical to SEQ ID NO: 41954

SEQ ID NO: 137439 - RNA, 64 nt, Homo Sapiens; identical to SEQ ID NO: 41955

SEQ ID NO: 137440 - RNA, 64 nt, Homo Sapiens; identical to SEQ ID NO: 41956

SEQ ID NO: 137441 - RNA, 64 nt, Homo Sapiens; identical to SEQ ID NO: 41957

SEQ ID NO: 137442 - RNA, 64 nt, Homo Sapiens; identical to SEQ ID NO: 41958

SEQ ID NO: 137443 - RNA, 64 nt, Homo Sapiens; identical to SEQ ID NO: 41959

SEQ ID NO: 137444 - RNA, 64 nt, Homo Sapiens; identical to SEQ ID NO: 41960

SEQ ID NO: 137445 - RNA, 64 nt, Homo Sapiens; identical to SEQ ID NO: 41961

SEQ ID NO: 137446 - RNA, 64 nt, Homo Sapiens; identical to SEQ ID NO: 41962

SEQ ID NO: 137447 - RNA, 64 nt, Homo Sapiens; identical to SEQ ID NO: 41963

SEQ ID NO: 137448 - RNA, 64 nt, Homo Sapiens; identical to SEQ ID NO: 41964

SEQ ID NO: 137449 - RNA, 64 nt, Homo Sapiens; identical to SEQ ID NO: 41965

SEQ ID NO: 137450 - RNA, 64 nt, Homo Sapiens; identical to SEQ ID NO: 41966

SEQ ID NO: 137451 - RNA, 64 nt, Homo Sapiens; identical to SEQ ID NO: 41967

SEQ ID NO: 137452 - RNA, 64 nt, Homo Sapiens; identical to SEQ ID NO: 41968

SEQ ID NO: 137453 - RNA, 64 nt, Homo Sapiens; identical to SEQ ID NO: 41969

SEQ ID NO: 137454 - RNA, 64 nt, Homo Sapiens; identical to SEQ ID NO: 41970

SEQ ID NO: 137455 - RNA, 64 nt, Homo Sapiens; identical to SEQ ID NO: 41971

SEQ ID NO: 137456 - RNA, 64 nt, Homo Sapiens; identical to SEQ ID NO: 41972

SEQ ID NO: 137457 - RNA, 64 nt, Homo Sapiens; identical to SEQ ID NO: 41973

SEQ ID NO: 137458 - RNA, 64 nt, Homo Sapiens; identical to SEQ ID NO: 41974

SEQ ID NO: 137459 - RNA, 64 nt, Homo Sapiens; identical to SEQ ID NO: 41975

SEQ ID NO: 137460 - RNA, 64 nt, Homo Sapiens; identical to SEQ ID NO: 41976

SEQ ID NO: 137461 - RNA, 64 nt, Homo Sapiens; identical to SEQ ID NO: 41977

SEQ ID NO: 137462 - RNA, 64 nt, Homo Sapiens; identical to SEQ ID NO: 41978

SEQ ID NO: 137463 - RNA, 64 nt, Homo Sapiens; identical to SEQ ID NO: 41979

SEQ ID NO: 137464 - RNA, 64 nt, Homo Sapiens; identical to SEQ ID NO: 41980

SEQ ID NO: 137465 - RNA, 64 nt, Homo Sapiens; identical to SEQ ID NO: 41981

SEQ ID NO: 137466 - RNA, 64 nt, Homo Sapiens; identical to SEQ ID NO: 41982

SEQ ID NO: 137467 - RNA, 64 nt, Homo Sapiens; identical to SEQ ID NO: 41983

SEQ ID NO: 137468 - RNA, 64 nt, Homo Sapiens; identical to SEQ ID NO: 41984

SEQ ID NO: 137469 - RNA, 64 nt, Homo Sapiens; identical to SEQ ID NO: 41985

SEQ ID NO: 137470 - RNA, 64 nt, Homo Sapiens; identical to SEQ ID NO: 41986

SEQ ID NO: 137471 - RNA, 64 nt, Homo Sapiens; identical to SEQ ID NO: 41987

SEQ ID NO: 137472 - RNA, 64 nt, Homo Sapiens; identical to SEQ ID NO: 41988

SEQ ID NO: 137473 - RNA, 64 nt, Homo Sapiens; identical to SEQ ID NO: 41989

SEQ ID NO: 137474 - RNA, 64 nt, Homo Sapiens; identical to SEQ ID NO: 41990

SEQ ID NO: 137475 - RNA, 64 nt, Homo Sapiens; identical to SEQ ID NO: 41991

SEQ ID NO: 137476 - RNA, 64 nt, Homo Sapiens; identical to SEQ ID NO: 41992

SEQ ID NO: 137477 - RNA, 64 nt, Homo Sapiens; identical to SEQ ID NO: 41993

SEQ ID NO: 137478 - RNA, 64 nt, Homo Sapiens; identical to SEQ ID NO: 41994

SEQ ID NO: 137479 - RNA, 64 nt, Homo Sapiens; identical to SEQ ID NO: 41995

SEQ ID NO: 137480 - RNA, 64 nt, Homo Sapiens; identical to SEQ ID NO: 41996

SEQ ID NO: 137481 - RNA, 64 nt, Homo Sapiens; identical to SEQ ID NO: 41997

SEQ ID NO: 137482 - RNA, 64 nt, Homo Sapiens; identical to SEQ ID NO: 41998

SEQ ID NO: 137483 - RNA, 64 nt, Homo Sapiens; identical to SEQ ID NO: 41999

SEQ ID NO: 137484 - RNA, 64 nt, Homo Sapiens; identical to SEQ ID NO: 42000

SEQ ID NO: 137485 - RNA, 64 nt, Homo Sapiens; identical to SEQ ID NO: 42001

SEQ ID NO: 137486 - RNA, 64 nt, Homo Sapiens; identical to SEQ ID NO: 42002

SEQ ID NO: 137487 - RNA, 64 nt, Homo Sapiens; identical to SEQ ID NO: 42003

SEQ ID NO: 137488 - RNA, 64 nt, Homo Sapiens; identical to SEQ ID NO: 42004

SEQ ID NO: 137489 - RNA, 64 nt, Homo Sapiens; identical to SEQ ID NO: 42005

SEQ ID NO: 137490 - RNA, 64 nt, Homo Sapiens; identical to SEQ ID NO: 42006

SEQ ID NO: 137491 - RNA, 64 nt, Homo Sapiens; identical to SEQ ID NO: 42007

SEQ ID NO: 137492 - RNA, 64 nt, Homo Sapiens; identical to SEQ ID NO: 42008

SEQ ID NO: 137493 - RNA, 64 nt, Homo Sapiens; identical to SEQ ID NO: 42009

SEQ ID NO: 137494 - RNA, 64 nt, Homo Sapiens; identical to SEQ ID NO: 42010

SEQ ID NO: 137495 - RNA, 64 nt, Homo Sapiens; identical to SEQ ID NO: 42011

SEQ ID NO: 137496 - RNA, 64 nt, Homo Sapiens; identical to SEQ ID NO: 42012

SEQ ID NO: 137497 - RNA, 64 nt, Homo Sapiens; identical to SEQ ID NO: 42013

SEQ ID NO: 137498 - RNA, 64 nt, Homo Sapiens; identical to SEQ ID NO: 42014

SEQ ID NO: 137499 - RNA, 64 nt, Homo Sapiens; identical to SEQ ID NO: 42015

SEQ ID NO: 137500 - RNA, 64 nt, Homo Sapiens; identical to SEQ ID NO: 42016

SEQ ID NO: 137501 - RNA, 64 nt, Homo Sapiens; identical to SEQ ID NO: 42017

SEQ ID NO: 137502 - RNA, 64 nt, Homo Sapiens; identical to SEQ ID NO: 42018

SEQ ID NO: 137503 - RNA, 64 nt, Homo Sapiens; identical to SEQ ID NO: 42019

SEQ ID NO: 137504 - RNA, 64 nt, Homo Sapiens; identical to SEQ ID NO: 42020

SEQ ID NO: 137505 - RNA, 64 nt, Homo Sapiens; identical to SEQ ID NO: 42021

SEQ ID NO: 137506 - RNA, 64 nt, Homo Sapiens; identical to SEQ ID NO: 42022

SEQ ID NO: 137507 - RNA, 64 nt, Homo Sapiens; identical to SEQ ID NO: 42023

SEQ ID NO: 137508 - RNA, 64 nt, Homo Sapiens; identical to SEQ ID NO: 42024

SEQ ID NO: 137509 - RNA, 64 nt, Homo Sapiens; identical to SEQ ID NO: 42025

SEQ ID NO: 137510 - RNA, 64 nt, Homo Sapiens; identical to SEQ ID NO: 42026

SEQ ID NO: 137511 - RNA, 64 nt, Homo Sapiens; identical to SEQ ID NO: 42027

SEQ ID NO: 137512 - RNA, 64 nt, Homo Sapiens; identical to SEQ ID NO: 42028

SEQ ID NO: 137513 - RNA, 64 nt, Homo Sapiens; identical to SEQ ID NO: 42029

SEQ ID NO: 137514 - RNA, 64 nt, Homo Sapiens; identical to SEQ ID NO: 42030

SEQ ID NO: 137515 - RNA, 64 nt, Homo Sapiens; identical to SEQ ID NO: 42031

SEQ ID NO: 137516 - RNA, 64 nt, Homo Sapiens; identical to SEQ ID NO: 42032

SEQ ID NO: 137517 - RNA, 64 nt, Homo Sapiens; identical to SEQ ID NO: 42033

SEQ ID NO: 137518 - RNA, 64 nt, Homo Sapiens; identical to SEQ ID NO: 42034

SEQ ID NO: 137519 - RNA, 64 nt, Homo Sapiens; identical to SEQ ID NO: 42035

SEQ ID NO: 137520 - RNA, 64 nt, Homo Sapiens; identical to SEQ ID NO: 42036

SEQ ID NO: 137521 - RNA, 64 nt, Homo Sapiens; identical to SEQ ID NO: 42037

SEQ ID NO: 137522 - RNA, 64 nt, Homo Sapiens; identical to SEQ ID NO: 42038

SEQ ID NO: 137523 - RNA, 64 nt, Homo Sapiens; identical to SEQ ID NO: 42039

SEQ ID NO: 137524 - RNA, 64 nt, Homo Sapiens; identical to SEQ ID NO: 42040

SEQ ID NO: 137525 - RNA, 64 nt, Homo Sapiens; identical to SEQ ID NO: 42041

SEQ ID NO: 137526 - RNA, 64 nt, Homo Sapiens; identical to SEQ ID NO: 42042

SEQ ID NO: 137527 - RNA, 64 nt, Homo Sapiens; identical to SEQ ID NO: 42043

SEQ ID NO: 137528 - RNA, 64 nt, Homo Sapiens; identical to SEQ ID NO: 42044

SEQ ID NO: 137529 - RNA, 64 nt, Homo Sapiens; identical to SEQ ID NO: 42045

SEQ ID NO: 137530 - RNA, 64 nt, Homo Sapiens; identical to SEQ ID NO: 42046

SEQ ID NO: 137531 - RNA, 64 nt, Homo Sapiens; identical to SEQ ID NO: 42047

SEQ ID NO: 137532 - RNA, 64 nt, Homo Sapiens; identical to SEQ ID NO: 42048

SEQ ID NO: 137533 - RNA, 64 nt, Homo Sapiens; identical to SEQ ID NO: 42049

SEQ ID NO: 137534 - RNA, 64 nt, Homo Sapiens; identical to SEQ ID NO: 42050

SEQ ID NO: 137535 - RNA, 64 nt, Homo Sapiens; identical to SEQ ID NO: 42051

SEQ ID NO: 137536 - RNA, 64 nt, Homo Sapiens; identical to SEQ ID NO: 42052

SEQ ID NO: 137537 - RNA, 64 nt, Homo Sapiens; identical to SEQ ID NO: 42053

SEQ ID NO: 137538 - RNA, 64 nt, Homo Sapiens; identical to SEQ ID NO: 42054

SEQ ID NO: 137539 - RNA, 64 nt, Homo Sapiens; identical to SEQ ID NO: 42055

SEQ ID NO: 137540 - RNA, 64 nt, Homo Sapiens; identical to SEQ ID NO: 42056

SEQ ID NO: 137541 - RNA, 64 nt, Homo Sapiens; identical to SEQ ID NO: 42057

SEQ ID NO: 137542 - RNA, 64 nt, Homo Sapiens; identical to SEQ ID NO: 42058

SEQ ID NO: 137543 - RNA, 64 nt, Homo Sapiens; identical to SEQ ID NO: 42059

SEQ ID NO: 137544 - RNA, 64 nt, Homo Sapiens; identical to SEQ ID NO: 42060

SEQ ID NO: 137545 - RNA, 64 nt, Homo Sapiens; identical to SEQ ID NO: 42061

SEQ ID NO: 137546 - RNA, 64 nt, Homo Sapiens; identical to SEQ ID NO: 42062

SEQ ID NO: 137547 - RNA, 64 nt, Homo Sapiens; identical to SEQ ID NO: 42063

SEQ ID NO: 137548 - RNA, 64 nt, Homo Sapiens; identical to SEQ ID NO: 42064

SEQ ID NO: 137549 - RNA, 64 nt, Homo Sapiens; identical to SEQ ID NO: 42065

SEQ ID NO: 137550 - RNA, 64 nt, Homo Sapiens; identical to SEQ ID NO: 42066

SEQ ID NO: 137551 - RNA, 64 nt, Homo Sapiens; identical to SEQ ID NO: 42067

SEQ ID NO: 137552 - RNA, 64 nt, Homo Sapiens; identical to SEQ ID NO: 42068

SEQ ID NO: 137553 - RNA, 64 nt, Homo Sapiens; identical to SEQ ID NO: 42069

SEQ ID NO: 137554 - RNA, 64 nt, Homo Sapiens; identical to SEQ ID NO: 42070

SEQ ID NO: 137555 - RNA, 64 nt, Homo Sapiens; identical to SEQ ID NO: 42071

SEQ ID NO: 137556 - RNA, 64 nt, Homo Sapiens; identical to SEQ ID NO: 42072

SEQ ID NO: 137557 - RNA, 64 nt, Homo Sapiens; identical to SEQ ID NO: 42073

SEQ ID NO: 137558 - RNA, 64 nt, Homo Sapiens; identical to SEQ ID NO: 42074

SEQ ID NO: 137559 - RNA, 64 nt, Homo Sapiens; identical to SEQ ID NO: 42075

SEQ ID NO: 137560 - RNA, 64 nt, Homo Sapiens; identical to SEQ ID NO: 42076

SEQ ID NO: 137561 - RNA, 64 nt, Homo Sapiens; identical to SEQ ID NO: 42077

SEQ ID NO: 137562 - RNA, 64 nt, Homo Sapiens; identical to SEQ ID NO: 42078

SEQ ID NO: 137563 - RNA, 64 nt, Homo Sapiens; identical to SEQ ID NO: 42079

SEQ ID NO: 137564 - RNA, 64 nt, Homo Sapiens; identical to SEQ ID NO: 42080

SEQ ID NO: 137565 - RNA, 64 nt, Homo Sapiens; identical to SEQ ID NO: 42081

SEQ ID NO: 137566 - RNA, 64 nt, Homo Sapiens; identical to SEQ ID NO: 42082

SEQ ID NO: 137567 - RNA, 64 nt, Homo Sapiens; identical to SEQ ID NO: 42083

SEQ ID NO: 137568 - RNA, 64 nt, Homo Sapiens; identical to SEQ ID NO: 42084

SEQ ID NO: 137569 - RNA, 64 nt, Homo Sapiens; identical to SEQ ID NO: 42085

SEQ ID NO: 137570 - RNA, 64 nt, Homo Sapiens; identical to SEQ ID NO: 42086

SEQ ID NO: 137571 - RNA, 64 nt, Homo Sapiens; identical to SEQ ID NO: 42087

SEQ ID NO: 137572 - RNA, 64 nt, Homo Sapiens; identical to SEQ ID NO: 42088

SEQ ID NO: 137573 - RNA, 64 nt, Homo Sapiens; identical to SEQ ID NO: 42089

SEQ ID NO: 137574 - RNA, 64 nt, Homo Sapiens; identical to SEQ ID NO: 42090

SEQ ID NO: 137575 - RNA, 64 nt, Homo Sapiens; identical to SEQ ID NO: 42091

SEQ ID NO: 137576 - RNA, 64 nt, Homo Sapiens; identical to SEQ ID NO: 42092

SEQ ID NO: 137577 - RNA, 64 nt, Homo Sapiens; identical to SEQ ID NO: 42093

SEQ ID NO: 137578 - RNA, 64 nt, Homo Sapiens; identical to SEQ ID NO: 42094

SEQ ID NO: 137579 - RNA, 64 nt, Homo Sapiens; identical to SEQ ID NO: 42095

SEQ ID NO: 137580 - RNA, 64 nt, Homo Sapiens; identical to SEQ ID NO: 42096

SEQ ID NO: 137581 - RNA, 64 nt, Homo Sapiens; identical to SEQ ID NO: 42097

SEQ ID NO: 137582 - RNA, 64 nt, Homo Sapiens; identical to SEQ ID NO: 42098

SEQ ID NO: 137583 - RNA, 64 nt, Homo Sapiens; identical to SEQ ID NO: 42099

SEQ ID NO: 137584 - RNA, 64 nt, Homo Sapiens; identical to SEQ ID NO: 42100

SEQ ID NO: 137585 - RNA, 64 nt, Homo Sapiens; identical to SEQ ID NO: 42101

SEQ ID NO: 137586 - RNA, 64 nt, Homo Sapiens; identical to SEQ ID NO: 42102

SEQ ID NO: 137587 - RNA, 64 nt, Homo Sapiens; identical to SEQ ID NO: 42103

SEQ ID NO: 137588 - RNA, 64 nt, Homo Sapiens; identical to SEQ ID NO: 42104

SEQ ID NO: 137589 - RNA, 64 nt, Homo Sapiens; identical to SEQ ID NO: 42105

SEQ ID NO: 137590 - RNA, 64 nt, Homo Sapiens; identical to SEQ ID NO: 42106

SEQ ID NO: 137591 - RNA, 64 nt, Homo Sapiens; identical to SEQ ID NO: 42107

SEQ ID NO: 137592 - RNA, 64 nt, Homo Sapiens; identical to SEQ ID NO: 42108

SEQ ID NO: 137593 - RNA, 64 nt, Homo Sapiens; identical to SEQ ID NO: 42109

SEQ ID NO: 137594 - RNA, 64 nt, Homo Sapiens; identical to SEQ ID NO: 42110

SEQ ID NO: 137595 - RNA, 64 nt, Homo Sapiens; identical to SEQ ID NO: 42111

SEQ ID NO: 137596 - RNA, 64 nt, Homo Sapiens; identical to SEQ ID NO: 42112

SEQ ID NO: 137597 - RNA, 64 nt, Homo Sapiens; identical to SEQ ID NO: 42113

SEQ ID NO: 137598 - RNA, 64 nt, Homo Sapiens; identical to SEQ ID NO: 42114

SEQ ID NO: 137599 - RNA, 64 nt, Homo Sapiens; identical to SEQ ID NO: 42115

SEQ ID NO: 137600 - RNA, 64 nt, Homo Sapiens; identical to SEQ ID NO: 42116

SEQ ID NO: 137601 - RNA, 64 nt, Homo Sapiens; identical to SEQ ID NO: 42117

SEQ ID NO: 137602 - RNA, 64 nt, Homo Sapiens; identical to SEQ ID NO: 42118

SEQ ID NO: 137603 - RNA, 64 nt, Homo Sapiens; identical to SEQ ID NO: 42119

SEQ ID NO: 137604 - RNA, 64 nt, Homo Sapiens; identical to SEQ ID NO: 42120

SEQ ID NO: 137605 - RNA, 64 nt, Homo Sapiens; identical to SEQ ID NO: 42121

SEQ ID NO: 137606 - RNA, 64 nt, Homo Sapiens; identical to SEQ ID NO: 42122

SEQ ID NO: 137607 - RNA, 64 nt, Homo Sapiens; identical to SEQ ID NO: 42123

SEQ ID NO: 137608 - RNA, 64 nt, Homo Sapiens; identical to SEQ ID NO: 42124

SEQ ID NO: 137609 - RNA, 64 nt, Homo Sapiens; identical to SEQ ID NO: 42125

SEQ ID NO: 137610 - RNA, 64 nt, Homo Sapiens; identical to SEQ ID NO: 42126

SEQ ID NO: 137611 - RNA, 64 nt, Homo Sapiens; identical to SEQ ID NO: 42127

SEQ ID NO: 137612 - RNA, 64 nt, Homo Sapiens; identical to SEQ ID NO: 42128

SEQ ID NO: 137613 - RNA, 64 nt, Homo Sapiens; identical to SEQ ID NO: 42129

SEQ ID NO: 137614 - RNA, 64 nt, Homo Sapiens; identical to SEQ ID NO: 42130

SEQ ID NO: 137615 - RNA, 64 nt, Homo Sapiens; identical to SEQ ID NO: 42131

SEQ ID NO: 137616 - RNA, 64 nt, Homo Sapiens; identical to SEQ ID NO: 42132

SEQ ID NO: 137617 - RNA, 64 nt, Homo Sapiens; identical to SEQ ID NO: 42133

SEQ ID NO: 137618 - RNA, 64 nt, Homo Sapiens; identical to SEQ ID NO: 42134

SEQ ID NO: 137619 - RNA, 64 nt, Homo Sapiens; identical to SEQ ID NO: 42135

SEQ ID NO: 137620 - RNA, 64 nt, Homo Sapiens; identical to SEQ ID NO: 42136

SEQ ID NO: 137621 - RNA, 64 nt, Homo Sapiens; identical to SEQ ID NO: 42137

SEQ ID NO: 137622 - RNA, 64 nt, Homo Sapiens; identical to SEQ ID NO: 42138

SEQ ID NO: 137623 - RNA, 64 nt, Homo Sapiens; identical to SEQ ID NO: 42139

SEQ ID NO: 137624 - RNA, 64 nt, Homo Sapiens; identical to SEQ ID NO: 42140

SEQ ID NO: 137625 - RNA, 64 nt, Homo Sapiens; identical to SEQ ID NO: 42141

SEQ ID NO: 137626 - RNA, 64 nt, Homo Sapiens; identical to SEQ ID NO: 42142

SEQ ID NO: 137627 - RNA, 64 nt, Homo Sapiens; identical to SEQ ID NO: 42143

SEQ ID NO: 137628 - RNA, 64 nt, Homo Sapiens; identical to SEQ ID NO: 42144

SEQ ID NO: 137629 - RNA, 64 nt, Homo Sapiens; identical to SEQ ID NO: 42145

SEQ ID NO: 137630 - RNA, 64 nt, Homo Sapiens; identical to SEQ ID NO: 42146

SEQ ID NO: 137631 - RNA, 64 nt, Homo Sapiens; identical to SEQ ID NO: 42147

SEQ ID NO: 137632 - RNA, 64 nt, Homo Sapiens; identical to SEQ ID NO: 42148

SEQ ID NO: 137633 - RNA, 64 nt, Homo Sapiens; identical to SEQ ID NO: 42149

SEQ ID NO: 137634 - RNA, 64 nt, Homo Sapiens; identical to SEQ ID NO: 42150

SEQ ID NO: 137635 - RNA, 64 nt, Homo Sapiens; identical to SEQ ID NO: 42151

SEQ ID NO: 137636 - RNA, 64 nt, Homo Sapiens; identical to SEQ ID NO: 42152

SEQ ID NO: 137637 - RNA, 64 nt, Homo Sapiens; identical to SEQ ID NO: 42153

SEQ ID NO: 137638 - RNA, 64 nt, Homo Sapiens; identical to SEQ ID NO: 42154

SEQ ID NO: 137639 - RNA, 64 nt, Homo Sapiens; identical to SEQ ID NO: 42155

SEQ ID NO: 137640 - RNA, 64 nt, Homo Sapiens; identical to SEQ ID NO: 42156

SEQ ID NO: 137641 - RNA, 64 nt, Homo Sapiens; identical to SEQ ID NO: 42157

SEQ ID NO: 137642 - RNA, 64 nt, Homo Sapiens; identical to SEQ ID NO: 42158

SEQ ID NO: 137643 - RNA, 64 nt, Homo Sapiens; identical to SEQ ID NO: 42159

SEQ ID NO: 137644 - RNA, 64 nt, Homo Sapiens; identical to SEQ ID NO: 42160

SEQ ID NO: 137645 - RNA, 64 nt, Homo Sapiens; identical to SEQ ID NO: 42161

SEQ ID NO: 137646 - RNA, 64 nt, Homo Sapiens; identical to SEQ ID NO: 42162

SEQ ID NO: 137647 - RNA, 64 nt, Homo Sapiens; identical to SEQ ID NO: 42163

SEQ ID NO: 137648 - RNA, 64 nt, Homo Sapiens; identical to SEQ ID NO: 42164

SEQ ID NO: 137649 - RNA, 64 nt, Homo Sapiens; identical to SEQ ID NO: 42165

SEQ ID NO: 137650 - RNA, 64 nt, Homo Sapiens; identical to SEQ ID NO: 42166

SEQ ID NO: 137651 - RNA, 64 nt, Homo Sapiens; identical to SEQ ID NO: 42167

SEQ ID NO: 137652 - RNA, 64 nt, Homo Sapiens; identical to SEQ ID NO: 42168

SEQ ID NO: 137653 - RNA, 64 nt, Homo Sapiens; identical to SEQ ID NO: 42169

SEQ ID NO: 137654 - RNA, 64 nt, Homo Sapiens; identical to SEQ ID NO: 42170

SEQ ID NO: 137655 - RNA, 64 nt, Homo Sapiens; identical to SEQ ID NO: 42171

SEQ ID NO: 137656 - RNA, 64 nt, Homo Sapiens; identical to SEQ ID NO: 42172

SEQ ID NO: 137657 - RNA, 64 nt, Homo Sapiens; identical to SEQ ID NO: 42173

SEQ ID NO: 137658 - RNA, 64 nt, Homo Sapiens; identical to SEQ ID NO: 42174

SEQ ID NO: 137659 - RNA, 64 nt, Homo Sapiens; identical to SEQ ID NO: 42175

SEQ ID NO: 137660 - RNA, 64 nt, Homo Sapiens; identical to SEQ ID NO: 42176

SEQ ID NO: 137661 - RNA, 64 nt, Homo Sapiens; identical to SEQ ID NO: 42177

SEQ ID NO: 137662 - RNA, 64 nt, Homo Sapiens; identical to SEQ ID NO: 42178

SEQ ID NO: 137663 - RNA, 64 nt, Homo Sapiens; identical to SEQ ID NO: 42179

SEQ ID NO: 137664 - RNA, 64 nt, Homo Sapiens; identical to SEQ ID NO: 42180

SEQ ID NO: 137665 - RNA, 64 nt, Homo Sapiens; identical to SEQ ID NO: 42181

SEQ ID NO: 137666 - RNA, 64 nt, Homo Sapiens; identical to SEQ ID NO: 42182

SEQ ID NO: 137667 - RNA, 64 nt, Homo Sapiens; identical to SEQ ID NO: 42183

SEQ ID NO: 137668 - RNA, 64 nt, Homo Sapiens; identical to SEQ ID NO: 42184

SEQ ID NO: 137669 - RNA, 64 nt, Homo Sapiens; identical to SEQ ID NO: 42185

SEQ ID NO: 137670 - RNA, 64 nt, Homo Sapiens; identical to SEQ ID NO: 42186

SEQ ID NO: 137671 - RNA, 64 nt, Homo Sapiens; identical to SEQ ID NO: 42187

SEQ ID NO: 137672 - RNA, 64 nt, Homo Sapiens; identical to SEQ ID NO: 42188

SEQ ID NO: 137673 - RNA, 64 nt, Homo Sapiens; identical to SEQ ID NO: 42189

SEQ ID NO: 137674 - RNA, 64 nt, Homo Sapiens; identical to SEQ ID NO: 42190

SEQ ID NO: 137675 - RNA, 64 nt, Homo Sapiens; identical to SEQ ID NO: 42191

SEQ ID NO: 137676 - RNA, 64 nt, Homo Sapiens; identical to SEQ ID NO: 42192

SEQ ID NO: 137677 - RNA, 64 nt, Homo Sapiens; identical to SEQ ID NO: 42193

SEQ ID NO: 137678 - RNA, 64 nt, Homo Sapiens; identical to SEQ ID NO: 42194

SEQ ID NO: 137679 - RNA, 64 nt, Homo Sapiens; identical to SEQ ID NO: 42195

SEQ ID NO: 137680 - RNA, 64 nt, Homo Sapiens; identical to SEQ ID NO: 42196

SEQ ID NO: 137681 - RNA, 64 nt, Homo Sapiens; identical to SEQ ID NO: 42197

SEQ ID NO: 137682 - RNA, 64 nt, Homo Sapiens; identical to SEQ ID NO: 42198

SEQ ID NO: 137683 - RNA, 64 nt, Homo Sapiens; identical to SEQ ID NO: 42199

SEQ ID NO: 137684 - RNA, 64 nt, Homo Sapiens; identical to SEQ ID NO: 42200

SEQ ID NO: 137685 - RNA, 64 nt, Homo Sapiens; identical to SEQ ID NO: 42201

SEQ ID NO: 137686 - RNA, 64 nt, Homo Sapiens; identical to SEQ ID NO: 42202

SEQ ID NO: 137687 - RNA, 64 nt, Homo Sapiens; identical to SEQ ID NO: 42203

SEQ ID NO: 137688 - RNA, 64 nt, Homo Sapiens; identical to SEQ ID NO: 42204

SEQ ID NO: 137689 - RNA, 64 nt, Homo Sapiens; identical to SEQ ID NO: 42205

SEQ ID NO: 137690 - RNA, 64 nt, Homo Sapiens; identical to SEQ ID NO: 42206

SEQ ID NO: 137691 - RNA, 64 nt, Homo Sapiens; identical to SEQ ID NO: 42207

SEQ ID NO: 137692 - RNA, 64 nt, Homo Sapiens; identical to SEQ ID NO: 42208

SEQ ID NO: 137693 - RNA, 64 nt, Homo Sapiens; identical to SEQ ID NO: 42209

SEQ ID NO: 137694 - RNA, 64 nt, Homo Sapiens; identical to SEQ ID NO: 42210

SEQ ID NO: 137695 - RNA, 64 nt, Homo Sapiens; identical to SEQ ID NO: 42211

SEQ ID NO: 137696 - RNA, 64 nt, Homo Sapiens; identical to SEQ ID NO: 42212

SEQ ID NO: 137697 - RNA, 64 nt, Homo Sapiens; identical to SEQ ID NO: 42213

SEQ ID NO: 137698 - RNA, 64 nt, Homo Sapiens; identical to SEQ ID NO: 42214

SEQ ID NO: 137699 - RNA, 64 nt, Homo Sapiens; identical to SEQ ID NO: 42215

SEQ ID NO: 137700 - RNA, 64 nt, Homo Sapiens; identical to SEQ ID NO: 42216

SEQ ID NO: 137701 - RNA, 64 nt, Homo Sapiens; identical to SEQ ID NO: 42217

SEQ ID NO: 137702 - RNA, 64 nt, Homo Sapiens; identical to SEQ ID NO: 42218

SEQ ID NO: 137703 - RNA, 64 nt, Homo Sapiens; identical to SEQ ID NO: 42219

SEQ ID NO: 137704 - RNA, 64 nt, Homo Sapiens; identical to SEQ ID NO: 42220

SEQ ID NO: 137705 - RNA, 64 nt, Homo Sapiens; identical to SEQ ID NO: 42221

SEQ ID NO: 137706 - RNA, 64 nt, Homo Sapiens; identical to SEQ ID NO: 42222

SEQ ID NO: 137707 - RNA, 64 nt, Homo Sapiens; identical to SEQ ID NO: 42223

SEQ ID NO: 137708 - RNA, 64 nt, Homo Sapiens; identical to SEQ ID NO: 42224

SEQ ID NO: 137709 - RNA, 64 nt, Homo Sapiens; identical to SEQ ID NO: 42225

SEQ ID NO: 137710 - RNA, 64 nt, Homo Sapiens; identical to SEQ ID NO: 42226

SEQ ID NO: 137711 - RNA, 64 nt, Homo Sapiens; identical to SEQ ID NO: 42227

SEQ ID NO: 137712 - RNA, 64 nt, Homo Sapiens; identical to SEQ ID NO: 42228

SEQ ID NO: 137713 - RNA, 64 nt, Homo Sapiens; identical to SEQ ID NO: 42229

SEQ ID NO: 137714 - RNA, 64 nt, Homo Sapiens; identical to SEQ ID NO: 42230

SEQ ID NO: 137715 - RNA, 64 nt, Homo Sapiens; identical to SEQ ID NO: 42231

SEQ ID NO: 137716 - RNA, 64 nt, Homo Sapiens; identical to SEQ ID NO: 42232

SEQ ID NO: 137717 - RNA, 64 nt, Homo Sapiens; identical to SEQ ID NO: 42233

SEQ ID NO: 137718 - RNA, 64 nt, Homo Sapiens; identical to SEQ ID NO: 42234

SEQ ID NO: 137719 - RNA, 64 nt, Homo Sapiens; identical to SEQ ID NO: 42235

SEQ ID NO: 137720 - RNA, 64 nt, Homo Sapiens
cucagcaugggcucagcagauucccaguuguugacugugacagggguucaguagaggccccggu

SEQ ID NO: 137721 - RNA, 64 nt, Homo Sapiens
ggcccucccacuucccucuucucacauggcaucacugugacacucaguggcuggucaagcuuuu

SEQ ID NO: 137722 - RNA, 64 nt, Homo Sapiens
auucuaauaaacaaggacuauugcugauaguaggcugugacauacugucuugugaaaugguuuc

SEQ ID NO: 137723 - RNA, 64 nt, Homo Sapiens
uguugggagcauuuccaggcaucuuuuaagggaacugugacaaacagccucgggcagaugaaca

SEQ ID NO: 137724 - RNA, 64 nt, Homo Sapiens
ugccccccagauugcugcaauuacauccagaguucugugacacagaagauguuuguguaucugu

SEQ ID NO: 137725 - RNA, 64 nt, Homo Sapiens
ccaaugugaauuucuaccaaagaacugaagugugcugugacaagaugcguuucauguagccagc

SEQ ID NO: 137726 - RNA, 64 nt, Homo Sapiens
ucuaaaaucaaccaggcuaccaagcaugauuuugcugugacaaaucugccaggccucgagcauc

SEQ ID NO: 137727 - RNA, 64 nt, Homo Sapiens
ucuaagaucaaccagguuacgcaugaugauuuugcugugacaaugccaggccccaagcaucuga

SEQ ID NO: 137728 - RNA, 64 nt, Homo Sapiens
aaugagaaugucgcuuuagcugaaauucaaauggcugugacaauuuaccgaaaugaugaaguaa

SEQ ID NO: 137729 - RNA, 64 nt, Homo Sapiens
ucucuccugcuccucuucggaguagaaauaaaggcugugacacaaggaagccagugggguggga

SEQ ID NO: 137730 - RNA, 64 nt, Homo Sapiens
uguaugccuucauuuuguauacuuacugcccugccugugacaguuuuuacagcuuagacuuugu

SEQ ID NO: 137731 - RNA, 64 nt, Homo Sapiens
cauagcucauaaacuaccccaaggccaucugacccugugacaggugacccgacuccacuccagg

SEQ ID NO: 137732 - RNA, 64 nt, Homo Sapiens
aggcauuaaauaaaaccgaggguuguugauuuugcugugacaguacacuaaaucaauacuauau

SEQ ID NO: 137733 - RNA, 64 nt, Homo Sapiens
uaugagacucgaugauaacaguaugguacugcuucugugacaaauaucgugccuuaacaaugug

SEQ ID NO: 137734 - RNA, 64 nt, Homo Sapiens
gggucuccauccuccaugggggcucagccaggugcugugacaccccccuucugaaugaagccuu

SEQ ID NO: 137735 - RNA, 64 nt, Homo Sapiens
ccaugagacagucccagaacacggcagcugcuggcugugacaaugguuucaccauccuuagacc

SEQ ID NO: 137736 - RNA, 64 nt, Homo Sapiens
cugaguccaaacccuugugcucagaggggacaaccugugacacccuuccggggggagccugucc

SEQ ID NO: 137737 - RNA, 64 nt, Homo Sapiens
cugcuguuaccaacugaagauggagggcugagcccugugacaaccagcccagguaggggcagga

SEQ ID NO: 137738 - RNA, 64 nt, Homo Sapiens
ugaguucucaaauuggaaaggcguguuuccauuuuaaagugaguagcagcaucuguuuuuuguu

SEQ ID NO: 137739 - RNA, 64 nt, Homo Sapiens
uuuauguauguuuuguacauucauauguuuuaaauaaagugaaagugguuugaaauuaccucuu

SEQ ID NO: 137740 - RNA, 64 nt, Homo Sapiens
cauggaagcagcauuacuuuuuccuaaagugaauuaaagugaauguuaauuuuauguccuuuuu

SEQ ID NO: 137741 - RNA, 64 nt, Homo Sapiens
uaaagugaaucauggaagcauguccuuuuuuuccuaaagugaauuggaauuuuuguuaauuuua

SEQ ID NO: 137742 - RNA, 64 nt, Homo Sapiens
cugcaauguaacauagguauaugaugagccugcauaaagugaaguucaaauauuguuuaaugga

SEQ ID NO: 137743 - RNA, 64 nt, Homo Sapiens
auucuguagaucagaugaauucucaucucucuauuaaagugaauuuccucuggucauuucagac

SEQ ID NO: 137744 - RNA, 64 nt, Homo Sapiens
accuuaauguguauagagacugauagcucacuuguaaagugacuauuaugaauuugaaguuaag

SEQ ID NO: 137745 - RNA, 64 nt, Homo Sapiens
caccuuucaugcugcuccagaggaagaaucuuuuuaaagugaccuuaauauaucaugcaguaaa

SEQ ID NO: 137746 - RNA, 64 nt, Homo Sapiens
uuugucaagagaucuuucagaaaauauaagccuuuaaagugaagaagaggagccaguugugcug

SEQ ID NO: 137747 - RNA, 64 nt, Homo Sapiens
guaagagaaaaccauuuuuaaucuuaguuaaaauuaaagugaauuaguaguauaucauuuuacu

SEQ ID NO: 137748 - RNA, 64 nt, Homo Sapiens
auuaaccagaaaagaaacaugcguuugauuaaaauaaagugacuagaaguccauauacugaaga

SEQ ID NO: 137749 - RNA, 64 nt, Homo Sapiens
ugcucucaaauaucaaauuuugugaaaaaaauauuaaagugauuuauaacaaccguguuuuauu

SEQ ID NO: 137750 - RNA, 64 nt, Homo Sapiens
cuacaauaaaaggcugcggcagcgccuuucuucuuaaagugaggaggacaaauuugcaaaagaa

SEQ ID NO: 137751 - RNA, 64 nt, Homo Sapiens
aaaggaaagagaaaaauuaaguuagggcagucaguaaagugagcuuuagaaagaaacuggaauu

SEQ ID NO: 137752 - RNA, 64 nt, Homo Sapiens
ggaaauguaauggauaauugaaugcuugguuauguaaagugauuaauagugugacaacgaugaa

SEQ ID NO: 137753 - RNA, 64 nt, Homo Sapiens
gcaaaaaacauuguccugaaguacagcauaaagcuaaagugaaguuuuuaaaagcuggaagauu

SEQ ID NO: 137754 - RNA, 64 nt, Homo Sapiens
augucuaacugugaucaaacuuuauuuuauauaguaaagugauucucuguuauauauugugaaa

SEQ ID NO: 137755 - RNA, 64 nt, Homo Sapiens
gacaaacccuuugaaugaaaauccagcacaaucauaaagugaaugacuugcuuacaucuagauu

SEQ ID NO: 137756 - RNA, 64 nt, Homo Sapiens
aucuuuuuuccccccaaguuuuuaacugaaugucuaaagugauugagauuuagauaaacuacau

SEQ ID NO: 137757 - RNA, 64 nt, Homo Sapiens
gccuuuagucguggguuacauaugcuugagcuuuuaaagugauguugucaaguuucuagcuuca

SEQ ID NO: 137758 - RNA, 64 nt, Homo Sapiens
ggcucaaugaauaguagcuguuuuuauuucuauguaaagugaguagcgguaguugaugggagcu

SEQ ID NO: 137759 - RNA, 64 nt, Homo Sapiens
aaaauagauguuacaguucuuaaaggcagugcuuuaaagugaaguucauucuguuuccaaaggc

SEQ ID NO: 137760 - RNA, 64 nt, Homo Sapiens
uuaaaugguuaaucauggccuuuuaaaaauaaaauaaagugauaccuuuacaaugaagacaaaa

SEQ ID NO: 137761 - RNA, 64 nt, Homo Sapiens
ugaucaacagcaaaauagaguucugaauuucuuuuaaagugaugauauauuauuuugugaaacu

SEQ ID NO: 137762 - RNA, 64 nt, Homo Sapiens
gguaagagaauuuauuuacuaaaugcacuauguauaaagugaaagauaguuuacuuaucugacu

SEQ ID NO: 137763 - RNA, 64 nt, Homo Sapiens
uuagagcuucagugagaauuuagaaaaauuauacuaaagugagaugcauuuuuucucauuuuca

SEQ ID NO: 137764 - RNA, 64 nt, Homo Sapiens
cacaaaaaugguuuuguuucagcaaauauugcuauaaagugaguguugcagcccaccacaauaa

SEQ ID NO: 137765 - RNA, 64 nt, Homo Sapiens
cugcucugccuauggaguagugacgucauaaccuuaaagugacaugauuuguacaaaaaucacu

SEQ ID NO: 137766 - RNA, 64 nt, Homo Sapiens
aaaauguguugugcucuuuauuaaugucauuuaauaaagugaccguaguugaaacuuaaacuau

SEQ ID NO: 137767 - RNA, 64 nt, Homo Sapiens
gaaaugguuuuaauguucuuauccauuucuugauuaaagugauuaugaaauacuuuuguacuua

SEQ ID NO: 137768 - RNA, 64 nt, Homo Sapiens; identical to SEQ ID NO: 120916

SEQ ID NO: 137769 - RNA, 64 nt, Homo Sapiens; identical to SEQ ID NO: 120917

SEQ ID NO: 137770 - RNA, 64 nt, Homo Sapiens; identical to SEQ ID NO: 120918

SEQ ID NO: 137771 - RNA, 64 nt, Homo Sapiens; identical to SEQ ID NO: 120919

SEQ ID NO: 137772 - RNA, 64 nt, Homo Sapiens; identical to SEQ ID NO: 120920

SEQ ID NO: 137773 - RNA, 64 nt, Homo Sapiens; identical to SEQ ID NO: 120921

SEQ ID NO: 137774 - RNA, 64 nt, Homo Sapiens; identical to SEQ ID NO: 120922

SEQ ID NO: 137775 - RNA, 64 nt, Homo Sapiens; identical to SEQ ID NO: 120923

SEQ ID NO: 137776 - RNA, 64 nt, Homo Sapiens; identical to SEQ ID NO: 120924

SEQ ID NO: 137777 - RNA, 64 nt, Homo Sapiens; identical to SEQ ID NO: 120925

SEQ ID NO: 137778 - RNA, 60 nt, Homo Sapiens
uguaggaacuaucuaacuggcauuuguguuucuugcgaguauuuugaagaaacaggccgu

SEQ ID NO: 137779 - RNA, 60 nt, Homo Sapiens
ccuggcacacaccugucuguuccagccaaaucuugcgacuccccaagccuccugggagga

SEQ ID NO: 137780 - RNA, 60 nt, Homo Sapiens
uuuuccucuggccuuuaacuauauguuauuucuugcgagguuuuaaaugaacugauugau

SEQ ID NO: 137781 - RNA, 60 nt, Homo Sapiens
guuuacugagaaugaugguugguuuuuuguucuugcgauaagugagaauaugcgguguuu

SEQ ID NO: 137782 - RNA, 60 nt, Homo Sapiens
gccccauagcagaagucccgagucaguggcucuugcgaauaugucuuuuauucaaagcug

SEQ ID NO: 137783 - RNA, 60 nt, Homo Sapiens
uguuguaguuacaguaaauaaaagaaugugucuugcgagccccgcuacaauucugcagaa

SEQ ID NO: 137784 - RNA, 60 nt, Homo Sapiens
cagccugccugguuuauggggacuuaaacaucuugcgaggugcaaaggaagcaguagagu

SEQ ID NO: 137785 - RNA, 60 nt, Homo Sapiens
agugagaauaugcaguguuugguuuuuuguucuugcgauaguuuacugagaaugaugauu

SEQ ID NO: 137786 - RNA, 60 nt, Homo Sapiens
agcgagguucccugaucccuuugccugggaucuugcgaaaaggaacagaaguuccaacua

SEQ ID NO: 137787 - RNA, 60 nt, Homo Sapiens
cucgcagccuccggaagcugugugggcauuucuugcgagcacgcccuaagcgcacauuca

SEQ ID NO: 137788 - RNA, 60 nt, Homo Sapiens
acggugacuuuuuuuccaaucccuacccccucuugcgaagguccccgaugucgcuggggc

SEQ ID NO: 137789 - RNA, 60 nt, Homo Sapiens
uuguauauaucguguucgacaaguacagucucuugcgauuuuccucaguccuuugaagag

SEQ ID NO: 137790 - RNA, 60 nt, Homo Sapiens
ccaagcucccugccccaaaugaauuccauaucuugcgaaugaguauauuuccgcacuuca

SEQ ID NO: 137791 - RNA, 60 nt, Homo Sapiens
cggcccgcuccagauccccagucagggucuucuugcgacccgccccagcgccggagcacg

SEQ ID NO: 137792 - RNA, 60 nt, Homo Sapiens
uaagagggaucauucauguacucccccaccucuugcgagaguaccgaugcagcucucuuu

SEQ ID NO: 137793 - RNA, 60 nt, Homo Sapiens
aaagaaaaacaaggaaggggaaaagaaaacucuugcgauuugggaggguucaguguugag

SEQ ID NO: 137794 - RNA, 60 nt, Homo Sapiens
cugaagugcuaucuucucuggcaugagggcucuugcgagagaacuucgagccagaaaggg

SEQ ID NO: 137795 - RNA, 60 nt, Homo Sapiens
cccgggcagcuggaaaguccauucagccuaucuugcgaggugcucucuccuaaggcucuc

SEQ ID NO: 137796 - RNA, 60 nt, Homo Sapiens
ucuauuugaacuguuuuauuuuccugugagucuugcgagguggaaguaaugauuaaauac

SEQ ID NO: 137797 - RNA, 60 nt, Homo Sapiens
uaggcccuccucccagucacuuagaaacagucuugcgaggaauuccuuagguucucaggg

SEQ ID NO: 137798 - RNA, 60 nt, Homo Sapiens
ccuccuccuccuccuccucugguagagcacucuugcgaugcugacacugccaaccuccag

SEQ ID NO: 137799 - RNA, 60 nt, Homo Sapiens
aauucugcauuguucggugucagucccuagucuugcgauggggacucuaccuuccagauu

SEQ ID NO: 137800 - RNA, 60 nt, Homo Sapiens
gccaggccccggccccgucugggaagcucaucuugcgaagcugagggagcucagggcaaa

SEQ ID NO: 137801 - RNA, 60 nt, Homo Sapiens
aucagacaccagucaagcagccucaggucaucuugcgacuccacugagcagccuuuccug

SEQ ID NO: 137802 - RNA, 60 nt, Homo Sapiens
aacuacagaaauuuaaaaaugccauaacaaucuugcgagacuaacuuuaaaauauacuuu

SEQ ID NO: 137803 - RNA, 60 nt, Homo Sapiens
guugaauacgucuuauuuuuacugaauuuuucuugcgaauuucaauaugagucucaauaa

SEQ ID NO: 137804 - RNA, 60 nt, Homo Sapiens
cuucuguucacggcggauucuuuguuuuaaucuugcgaugugcuuugcuuguugcugggc

SEQ ID NO: 137805 - RNA, 64 nt, Homo Sapiens
uuugagacacuagcaccuaggaagcgaauaaaguuuuacugauucuguuaauggcgaaagaaug

SEQ ID NO: 137806 - RNA, 64 nt, Homo Sapiens
uaaaaacaaaacaaaaaaaaaggacccgguuucuuuuacugauucuuagaucacugcagcuucu

SEQ ID NO: 137807 - RNA, 64 nt, Homo Sapiens
gaacaggcaucccuguugccccugccugcccagauuuacugaccccauuugucgacauggcccc

SEQ ID NO: 137808 - RNA, 64 nt, Homo Sapiens
cugcagacucuuccagauuuuucugcccaaggccuuuacugagcucaggacuccagcuaaauca

SEQ ID NO: 137809 - RNA, 64 nt, Homo Sapiens
gagaugcuuucuaauauaagacugauguguugauuuuacugauuguacuguacaucuauuaaag

SEQ ID NO: 137810 - RNA, 64 nt, Homo Sapiens
ugaauauucguauuguuaacuaaaugauuuauauuuuacugauuuaauauuacaguguaagaau

SEQ ID NO: 137811 - RNA, 64 nt, Homo Sapiens
uguacaggguggcugugguccuagaaguucaguuuuuacugaggaaauauuuccauuaacagca

SEQ ID NO: 137812 - RNA, 64 nt, Homo Sapiens
agacauuacuauagcauagauugucaaauguaaauuuacugagcguguuuuauaaaaaacucac

SEQ ID NO: 137813 - RNA, 64 nt, Homo Sapiens
accuaccaucugcauugagcagaaagacuuuuguuuuacugaagacaaaagauguuuuuauuuu

SEQ ID NO: 137814 - RNA, 64 nt, Homo Sapiens
gaagaccagauaaugaaacugaaaagcaaacaauuuuacugaaucugucuacccuucauucaug

SEQ ID NO: 137815 - RNA, 64 nt, Homo Sapiens
ugccccggucuagucccauuugaaacaguucugcuuuacugagacccuaggccggucuccuugc

SEQ ID NO: 137816 - RNA, 64 nt, Homo Sapiens
caacuuguacugcgccugaauagucaugugauaauuuacugaagaaaucuaguguacuuuaaau

SEQ ID NO: 137817 - RNA, 64 nt, Homo Sapiens
gaauauauuuaauuauauucuuuguccaguucaguuuacugaaggaaaaggucuguucucuagu

SEQ ID NO: 137818 - RNA, 64 nt, Homo Sapiens
cuauuagacugauaauuucucuaaaagugccauuuuuacugauguuguauauuuuaugccauga

SEQ ID NO: 137819 - RNA, 64 nt, Homo Sapiens
ucuguuguauauuuuucauguucauuugaacccauuuacugaucgcauaaaaugguuuacugug

SEQ ID NO: 137820 - RNA, 64 nt, Homo Sapiens
ucacucaaaagcuaaagcaaggcacguugacuguuuuacugacaugcagugagccaccgcggca

SEQ ID NO: 137821 - RNA, 64 nt, Homo Sapiens
ucuguucuagugaguggguccucacaggacacaguuuacugaucaggcucccagcugaauuuca

SEQ ID NO: 137822 - RNA, 64 nt, Homo Sapiens
aucuacccugugccagcccuuuguuuaccgaacguuuacugagcuuguuuauuuuuuaauucuu

SEQ ID NO: 137823 - RNA, 64 nt, Homo Sapiens
gcuucagggguuaacaguaggauucuuguuuuaauuuacugaugcuggagcuagaagcacuugu

SEQ ID NO: 137824 - RNA, 64 nt, Homo Sapiens
uuucaucuaaguaaagcucaguucuuuaucacaauuuacugaccaaauaccuagcaccaguucc

SEQ ID NO: 137825 - RNA, 64 nt, Homo Sapiens
ucuuaucaauuaccuaaaucucaacgaaaaacaauuuacugaagccgacuccccuccccaucuc

SEQ ID NO: 137826 - RNA, 64 nt, Homo Sapiens
caugaccaaucauaugguaugggaccgucuuucuuuuacugacaauggugguggccuggugaug

SEQ ID NO: 137827 - RNA, 64 nt, Homo Sapiens
aagaugacacguggugauuguguagcgguuucccuuuacugaauaaaguguuuucagguaucuu

SEQ ID NO: 137828 - RNA, 64 nt, Homo Sapiens
aaaagaaauugacaaagaaauauuucaucuggccuuuacugacuccuguuaaaugcaguuuuaa

SEQ ID NO: 137829 - RNA, 64 nt, Homo Sapiens
uuaagugccugacacaguagguauucaauaaaaauuuacugaauuaaaggauuaaauuagguga

SEQ ID NO: 137830 - RNA, 64 nt, Homo Sapiens
uauuuuauaucucaauaucuuuaauauaaaucuuuuuacugagagaucauuauagaaacauguu

SEQ ID NO: 137831 - RNA, 64 nt, Homo Sapiens
cuuuucacauaugauguguuuggaacccaaauuuuuuacugauuuuauuguguuguugguaacu

SEQ ID NO: 137832 - RNA, 64 nt, Homo Sapiens
ccauuuauaaaguacugagagaaugauauuggauuuugcugaacaggccuaucuugaacuuugg

SEQ ID NO: 137833 - RNA, 64 nt, Homo Sapiens
uuauuuuugacagaauacucuuuucaaaauggcauuugcugauuucauaaaccuuucacgucug

SEQ ID NO: 137834 - RNA, 64 nt, Homo Sapiens
ccuacuuuauaggcugagucgcuuucagugggaauuugcugacuucuuuauuucagagaugugg

SEQ ID NO: 137835 - RNA, 64 nt, Homo Sapiens
cccagcugaggggagcauggugcucggcagauacuuugcugauugguaugcagguggccugggc

SEQ ID NO: 137836 - RNA, 64 nt, Homo Sapiens
aauaagcuuuaacuuaauuugggggauuaacacuuuugcugagggagaaaaagaaaacauacau

SEQ ID NO: 137837 - RNA, 64 nt, Homo Sapiens
ucuuauugugaggaaucuguuaaaaguuuaaagcuuugcugaaaacugaauucauucucaggaa

SEQ ID NO: 137838 - RNA, 64 nt, Homo Sapiens
uacagacacaggcuguuuaccugaauguuuuuaauuugcugacuguucugucuagaggauacaa

SEQ ID NO: 137839 - RNA, 64 nt, Homo Sapiens
acacauuagcuggaucuuagacauauuagaggccuuugcugauguguuccauuacuacgcaaac

SEQ ID NO: 137840 - RNA, 64 nt, Homo Sapiens
uuugauggaaggguccauacauuuuuuuuuuuuuuuugcugauguugcuaucuagauguuucuc

SEQ ID NO: 137841 - RNA, 64 nt, Homo Sapiens
aggcgugagccacugcaccuggccuguaacaugauuugcugaaauuuuuaaaaaucuuaaauaa

SEQ ID NO: 137842 - RNA, 64 nt, Homo Sapiens
aguuagucuuaauuaucuauauaggagaaaucaguuugcugaaaaaagauuuuuguguuugaau

SEQ ID NO: 137843 - RNA, 64 nt, Homo Sapiens
cucaacuugucaugaguguauuccaccugccaguuuugcugacucucuccauuucucuuucccc

SEQ ID NO: 137844 - RNA, 64 nt, Homo Sapiens
aauauaaggaucagugcuuuguucugcagcagaguuugcugauaaaugucuguuggauucuuuu

SEQ ID NO: 137845 - RNA, 64 nt, Homo Sapiens
uuuaauuagcaguagauggugcuacuggcuuucauuugcugacuugauuauucccuuucucuua

SEQ ID NO: 137846 - RNA, 64 nt, Homo Sapiens
ugaauuguuuuucuuucucaauuguuuuggugaauuugcugaauucacuuuaggauauauucac

SEQ ID NO: 137847 - RNA, 64 nt, Homo Sapiens
aacaauuaaagugggaugauuuuucauugaaaguuuugcugauuuccugguuaaaauggaugau

SEQ ID NO: 137848 - RNA, 64 nt, Homo Sapiens
ccuaugagcccauaaggguucucaucuguagcuguuugcugacuaugaauucuuaacaagaaga

SEQ ID NO: 137849 - RNA, 64 nt, Homo Sapiens
uuaagauguagguuauagauagaaagcaguauguuuugcugacaauucaauuggugauuugggu

SEQ ID NO: 137850 - RNA, 64 nt, Homo Sapiens
auuuaugaccugaaauaauaccaacaguuguauguuugcugauuuuggguuuuuuuuuuaguug

SEQ ID NO: 137851 - RNA, 64 nt, Homo Sapiens
ucagcacauucgggaccaauuuagcgucaagacauuugcugaacuaagcaguuauggugaugac

SEQ ID NO: 137852 - RNA, 64 nt, Homo Sapiens
acaggccauucgacgccuucuccaaggggucugauuugcugagacaccagcuucaccuucuuaa

SEQ ID NO: 137853 - RNA, 64 nt, Homo Sapiens
auguacguuacaugauuuuccuacacucuguaauuuugcugaggugcaauuuggaacucugcaa

SEQ ID NO: 137854 - RNA, 64 nt, Homo Sapiens
gagaugcugggacauagaaccacuguggccacacuuugcugaaaugacugagcauugcucagau

SEQ ID NO: 137855 - RNA, 64 nt, Homo Sapiens
ugauuugcgaauugacuuucuauuuucugaccuguuugcugaagacaacugguuugauaguuac

SEQ ID NO: 137856 - RNA, 64 nt, Homo Sapiens
auuuuacuuuuuugauauaaaaucaagauauuucuuugcugaaguauuuaaaucuuauccuugu

SEQ ID NO: 137857 - RNA, 64 nt, Homo Sapiens
uuuuguagaauucauuucggcagcucacuaggauuuugcugaacauuaaaaagugugauagcga

SEQ ID NO: 137858 - RNA, 64 nt, Homo Sapiens
aucagccggccuauaaaucuguaaauauauuguguuugcugacaugugagcaaaugcuaauaca

SEQ ID NO: 137859 - RNA, 64 nt, Homo Sapiens
acuuuuuauaaugugaugauugcagagacaguauuuugcugaauugaaggguaaaaucuuucuu

SEQ ID NO: 137860 - RNA, 64 nt, Homo Sapiens
cuucaaagagcuuaguuugcgucacuuagcaagguuugcugauguauccaaauggcauucacgu

SEQ ID NO: 137861 - RNA, 64 nt, Homo Sapiens
ccuuccaaggguucaauauaauugaguccuccucuuugcugaucuucuauucuagucuuuuuuu

SEQ ID NO: 137862 - RNA, 64 nt, Homo Sapiens
ugaccguauauauuauauucuccugaaccgcaaauuugcugaagcagacaaagcuuguacaaau

SEQ ID NO: 137863 - RNA, 64 nt, Homo Sapiens
cugcagaauggaaugcagcuacagaaggaagucauuugcugaguaaggcaaaauagagguggaa

SEQ ID NO: 137864 - RNA, 64 nt, Homo Sapiens
uauuucuaaacuguugaauacccacaaaaugugguuugcugacccacuauggggaagcaguugc

SEQ ID NO: 137865 - RNA, 64 nt, Homo Sapiens
uuguuaucuucauucaauuugaaaauaauuguguuuugcugaacuucccuuuccucagugaugu

SEQ ID NO: 137866 - RNA, 64 nt, Homo Sapiens
agcauucagaugcacacccugagagcccuucagguuugcugaaauaguuuggggaaaggaggag

SEQ ID NO: 137867 - RNA, 64 nt, Homo Sapiens
ucacagcagccgcccacagacuugagcuccgcuuuuugcugagagggcggcggagucccugagc

SEQ ID NO: 137868 - RNA, 64 nt, Homo Sapiens
cuaaucuuauucauuuucucaacuaauuuuuauuuuugcugagauucuagcuuaucuacuucca

SEQ ID NO: 137869 - RNA, 64 nt, Homo Sapiens
agcuacuauaugucaagugcaaauucaacaaacauuugcugaauaauuuguuuaaaaaguaaua

SEQ ID NO: 137870 - RNA, 64 nt, Homo Sapiens
auuauaacugccuuuaauuaacauaauauuaacuuuugcugagguuuaugagauuuucucaccc

SEQ ID NO: 137871 - RNA, 64 nt, Homo Sapiens
agucuuuacugacaggagcagcagcuaucugucuuuugcugaucuacaaauaaaugaauugaga

SEQ ID NO: 137872 - RNA, 64 nt, Homo Sapiens
gggcuucugagcugaugcaggccccaaggaccccuuugcugaccucugccaggacccacacagc

SEQ ID NO: 137873 - RNA, 64 nt, Homo Sapiens
guuggugggcaccaauauuccaagggcagcucucuuugcugaaugagggccuucucgugaggua

SEQ ID NO: 137874 - RNA, 64 nt, Homo Sapiens
cuuuuaauggugggaauuuacaguagaagcauccuuugcugaguuauacauuccuuuaucaauc

SEQ ID NO: 137875 - RNA, 64 nt, Homo Sapiens
acagcaggauuaugaauuaucaaaggaaaaaguauuugcugaggugaaaaaaucugauguuuga

SEQ ID NO: 137876 - RNA, 64 nt, Homo Sapiens
uaagugcagaguucauuuuugccccugaaaaguuuuugcugaguuugcugaagaaauuguauuu

SEQ ID NO: 137877 - RNA, 64 nt, Homo Sapiens
aguucauuuuugccccugaaaaguuuuugcugaguuugcugaagaaauuguauuucaaccacau

SEQ ID NO: 137878 - RNA, 64 nt, Homo Sapiens
ccaggccuggcacgucaaagaggcuccagaaauguuugcugagugagugaugaaucagcaauuu

SEQ ID NO: 137879 - RNA, 64 nt, Homo Sapiens
gucuguguuucuuuuugccagcuauugacuaaucuuugcugaagcugagcuagaauucuggugu

SEQ ID NO: 137880 - RNA, 64 nt, Homo Sapiens
uuucagaaagaaagacccuucaguuuugaugcauuuugcugaacacuuggguagugagugggau

SEQ ID NO: 137881 - RNA, 64 nt, Homo Sapiens
ugcuuuaucuuugguaacuuuuacuugaaugggauuugcugaauuaaugacuauugaauuuaaa

SEQ ID NO: 137882 - RNA, 64 nt, Homo Sapiens
gggauauuuccaguaccuacuuuuuuuuuuuuuuuuugcugaauccaaagauauauaaauaaaa

SEQ ID NO: 137883 - RNA, 64 nt, Homo Sapiens
aaaugacuuaugggggauggugagcugugacugcuuugcugaccauuuuggaugucauuguaaa

SEQ ID NO: 137884 - RNA, 64 nt, Homo Sapiens
gacagguggggagcagcugacaggcauuagggucuuugcugacaucuacuaaccuugaagaguu

SEQ ID NO: 137885 - RNA, 64 nt, Homo Sapiens
uaaggaaggagggauuuaaaccuuuuaaaaaacuuuugcugacuuauauuacuguaaagauuug

SEQ ID NO: 137886 - RNA, 64 nt, Homo Sapiens
ucaguguggagagcaaaaaagcugacuguggugauuugcugagugcuguggcccacaggcaggg

SEQ ID NO: 137887 - RNA, 64 nt, Homo Sapiens
aauacacuuuucccucacuacgacugcuucuuuauuugcugauaaaucuuaaaacaacuaagua

SEQ ID NO: 137888 - RNA, 64 nt, Homo Sapiens
cuccagcgucugccauaggaaugugagagggguguuugcugagcgcuccgggcacggccagagg

SEQ ID NO: 137889 - RNA, 64 nt, Homo Sapiens
agcaaugugaacucucagcgcugguccugguggguuugcugaccaugacugggcaagccguucu

SEQ ID NO: 137890 - RNA, 64 nt, Homo Sapiens
cuccugggucccggccaccuguccauauuccacauuugcugacugugcucccugcacuccacuc

SEQ ID NO: 137891 - RNA, 64 nt, Homo Sapiens
guaaauaaacaucuaugccuuuucucagaaaugauuugcugaacuauguccauauuuuacagcu

SEQ ID NO: 137892 - RNA, 64 nt, Homo Sapiens
aagacacauguauacaaggcacuauuguacacacuuugcugaauauuuugucaguuguauuuac

SEQ ID NO: 137893 - RNA, 64 nt, Homo Sapiens
ccccagccuacuuccccgaugccagacaauagccuuugcugacauugugugauaccggcccccc

SEQ ID NO: 137894 - RNA, 64 nt, Homo Sapiens
gauuuagacggggaugaaguccaccccaaagugcuuugcugaagagucaggcuggaaucuuggg

SEQ ID NO: 137895 - RNA, 64 nt, Homo Sapiens
aguuuugauguuauuuuuuuacauugaauacagauuugcugaaccuuguuuguuuauuuugguu

SEQ ID NO: 137896 - RNA, 64 nt, Homo Sapiens
uccauuuuaugucuacuuuuccagauucaugaaauuugcugauguuuuccaucacuucuuuguc

SEQ ID NO: 137897 - RNA, 64 nt, Homo Sapiens; identical to SEQ ID NO: 88257

SEQ ID NO: 137898 - RNA, 64 nt, Homo Sapiens; identical to SEQ ID NO: 88258

SEQ ID NO: 137899 - RNA, 64 nt, Homo Sapiens; identical to SEQ ID NO: 88259

SEQ ID NO: 137900 - RNA, 64 nt, Homo Sapiens; identical to SEQ ID NO: 88260

SEQ ID NO: 137901 - RNA, 64 nt, Homo Sapiens; identical to SEQ ID NO: 88261

SEQ ID NO: 137902 - RNA, 64 nt, Homo Sapiens; identical to SEQ ID NO: 88262

SEQ ID NO: 137903 - RNA, 64 nt, Homo Sapiens; identical to SEQ ID NO: 88263

SEQ ID NO: 137904 - RNA, 64 nt, Homo Sapiens; identical to SEQ ID NO: 88264

SEQ ID NO: 137905 - RNA, 64 nt, Homo Sapiens; identical to SEQ ID NO: 88265

SEQ ID NO: 137906 - RNA, 64 nt, Homo Sapiens; identical to SEQ ID NO: 88266

SEQ ID NO: 137907 - RNA, 64 nt, Homo Sapiens; identical to SEQ ID NO: 88267

SEQ ID NO: 137908 - RNA, 64 nt, Homo Sapiens; identical to SEQ ID NO: 88268

SEQ ID NO: 137909 - RNA, 64 nt, Homo Sapiens; identical to SEQ ID NO: 88269

SEQ ID NO: 137910 - RNA, 64 nt, Homo Sapiens; identical to SEQ ID NO: 88270

SEQ ID NO: 137911 - RNA, 64 nt, Homo Sapiens; identical to SEQ ID NO: 88271

SEQ ID NO: 137912 - RNA, 64 nt, Homo Sapiens; identical to SEQ ID NO: 88269

SEQ ID NO: 137913 - RNA, 64 nt, Homo Sapiens; identical to SEQ ID NO: 88273

SEQ ID NO: 137914 - RNA, 64 nt, Homo Sapiens; identical to SEQ ID NO: 88274

SEQ ID NO: 137915 - RNA, 64 nt, Homo Sapiens; identical to SEQ ID NO: 88275

SEQ ID NO: 137916 - RNA, 64 nt, Homo Sapiens; identical to SEQ ID NO: 88276

SEQ ID NO: 137917 - RNA, 64 nt, Homo Sapiens; identical to SEQ ID NO: 88277

SEQ ID NO: 137918 - RNA, 64 nt, Homo Sapiens; identical to SEQ ID NO: 88278

SEQ ID NO: 137919 - RNA, 64 nt, Homo Sapiens; identical to SEQ ID NO: 88279

SEQ ID NO: 137920 - RNA, 64 nt, Homo Sapiens; identical to SEQ ID NO: 88280

SEQ ID NO: 137921 - RNA, 64 nt, Homo Sapiens; identical to SEQ ID NO: 88281

SEQ ID NO: 137922 - RNA, 64 nt, Homo Sapiens; identical to SEQ ID NO: 88282

SEQ ID NO: 137923 - RNA, 64 nt, Homo Sapiens; identical to SEQ ID NO: 88283

SEQ ID NO: 137924 - RNA, 64 nt, Homo Sapiens; identical to SEQ ID NO: 88284

SEQ ID NO: 137925 - RNA, 64 nt, Homo Sapiens; identical to SEQ ID NO: 88285

SEQ ID NO: 137926 - RNA, 64 nt, Homo Sapiens; identical to SEQ ID NO: 88286

SEQ ID NO: 137927 - RNA, 64 nt, Homo Sapiens; identical to SEQ ID NO: 88287

SEQ ID NO: 137928 - RNA, 64 nt, Homo Sapiens; identical to SEQ ID NO: 88288

SEQ ID NO: 137929 - RNA, 64 nt, Homo Sapiens; identical to SEQ ID NO: 88289

SEQ ID NO: 137930 - RNA, 64 nt, Homo Sapiens; identical to SEQ ID NO: 88290

SEQ ID NO: 137931 - RNA, 64 nt, Homo Sapiens; identical to SEQ ID NO: 88291

SEQ ID NO: 137932 - RNA, 64 nt, Homo Sapiens; identical to SEQ ID NO: 88292

SEQ ID NO: 137933 - RNA, 64 nt, Homo Sapiens; identical to SEQ ID NO: 88293

SEQ ID NO: 137934 - RNA, 64 nt, Homo Sapiens; identical to SEQ ID NO: 88294

SEQ ID NO: 137935 - RNA, 64 nt, Homo Sapiens; identical to SEQ ID NO: 88295

SEQ ID NO: 137936 - RNA, 64 nt, Homo Sapiens; identical to SEQ ID NO: 88296

SEQ ID NO: 137937 - RNA, 64 nt, Homo Sapiens; identical to SEQ ID NO: 88297

SEQ ID NO: 137938 - RNA, 64 nt, Homo Sapiens; identical to SEQ ID NO: 88298

SEQ ID NO: 137939 - RNA, 64 nt, Homo Sapiens; identical to SEQ ID NO: 88299

SEQ ID NO: 137940 - RNA, 64 nt, Homo Sapiens; identical to SEQ ID NO: 88300

SEQ ID NO: 137941 - RNA, 64 nt, Homo Sapiens; identical to SEQ ID NO: 88298

SEQ ID NO: 137942 - RNA, 64 nt, Homo Sapiens; identical to SEQ ID NO: 88302

SEQ ID NO: 137943 - RNA, 64 nt, Homo Sapiens; identical to SEQ ID NO: 88300

SEQ ID NO: 137944 - RNA, 64 nt, Homo Sapiens; identical to SEQ ID NO: 88304

SEQ ID NO: 137945 - RNA, 64 nt, Homo Sapiens; identical to SEQ ID NO: 88305

SEQ ID NO: 137946 - RNA, 64 nt, Homo Sapiens; identical to SEQ ID NO: 88306

SEQ ID NO: 137947 - RNA, 64 nt, Homo Sapiens; identical to SEQ ID NO: 88307

SEQ ID NO: 137948 - RNA, 64 nt, Homo Sapiens; identical to SEQ ID NO: 88299

SEQ ID NO: 137949 - RNA, 64 nt, Homo Sapiens; identical to SEQ ID NO: 88309

SEQ ID NO: 137950 - RNA, 64 nt, Homo Sapiens; identical to SEQ ID NO: 88310

SEQ ID NO: 137951 - RNA, 64 nt, Homo Sapiens; identical to SEQ ID NO: 88311

SEQ ID NO: 137952 - RNA, 64 nt, Homo Sapiens; identical to SEQ ID NO: 88312

SEQ ID NO: 137953 - RNA, 64 nt, Homo Sapiens; identical to SEQ ID NO: 88313

SEQ ID NO: 137954 - RNA, 64 nt, Homo Sapiens; identical to SEQ ID NO: 88314

SEQ ID NO: 137955 - RNA, 64 nt, Homo Sapiens; identical to SEQ ID NO: 88315

SEQ ID NO: 137956 - RNA, 64 nt, Homo Sapiens; identical to SEQ ID NO: 88316

SEQ ID NO: 137957 - RNA, 64 nt, Homo Sapiens; identical to SEQ ID NO: 88317

SEQ ID NO: 137958 - RNA, 64 nt, Homo Sapiens; identical to SEQ ID NO: 88318

SEQ ID NO: 137959 - RNA, 64 nt, Homo Sapiens; identical to SEQ ID NO: 88319

SEQ ID NO: 137960 - RNA, 64 nt, Homo Sapiens; identical to SEQ ID NO: 88320

SEQ ID NO: 137961 - RNA, 64 nt, Homo Sapiens; identical to SEQ ID NO: 88321

SEQ ID NO: 137962 - RNA, 64 nt, Homo Sapiens; identical to SEQ ID NO: 88322

SEQ ID NO: 137963 - RNA, 64 nt, Homo Sapiens; identical to SEQ ID NO: 88323

SEQ ID NO: 137964 - RNA, 64 nt, Homo Sapiens; identical to SEQ ID NO: 88324

SEQ ID NO: 137965 - RNA, 64 nt, Homo Sapiens; identical to SEQ ID NO: 88325

SEQ ID NO: 137966 - RNA, 64 nt, Homo Sapiens; identical to SEQ ID NO: 88326

SEQ ID NO: 137967 - RNA, 64 nt, Homo Sapiens; identical to SEQ ID NO: 88327

SEQ ID NO: 137968 - RNA, 64 nt, Homo Sapiens; identical to SEQ ID NO: 88328

SEQ ID NO: 137969 - RNA, 64 nt, Homo Sapiens; identical to SEQ ID NO: 88329

SEQ ID NO: 137970 - RNA, 64 nt, Homo Sapiens; identical to SEQ ID NO: 88330

SEQ ID NO: 137971 - RNA, 64 nt, Homo Sapiens
ugacucugagaauaacacauagugaagaucugugggcuuuuaaaauuguucacagccaauuuaa

SEQ ID NO: 137972 - RNA, 64 nt, Homo Sapiens
auauuuuaauuaggggaguagauuauuguccaaaggcuuuuauuuagagaaacggguaauuaaa

SEQ ID NO: 137973 - RNA, 64 nt, Homo Sapiens
augcuccgccuacuucagucuaccaauuaccuuaggcuuuuauaaaguuuuuccaacucuucac

SEQ ID NO: 137974 - RNA, 64 nt, Homo Sapiens
cauggcaccucuuuauaaugcuugaaacuaccuaggcuuuuaugugaggaauggaagaauggac

SEQ ID NO: 137975 - RNA, 64 nt, Homo Sapiens
cuucuccccagaggaacuuagggauuucaccccuggcuuuuaaaaaaaacgaaauaccgacaag

SEQ ID NO: 137976 - RNA, 64 nt, Homo Sapiens
uuuugaugccauauuuucaguguuacacuuuuauggcuuuuaauuuucgauuugacagauguaa

SEQ ID NO: 137977 - RNA, 64 nt, Homo Sapiens
gcugcagugccagaggggccucuggagcaggccuggcuuuuaaauggggggcugaauuccagcu

SEQ ID NO: 137978 - RNA, 64 nt, Homo Sapiens
gaauacauuucuuguaaaaccuggcuuguugcuuggcuuuuaaagaugguguauguuuguaaaa

SEQ ID NO: 137979 - RNA, 64 nt, Homo Sapiens
acaaguaguucaugaaagaauguugauuauuugaggcuuuuaaaauggauggguuuucuuguuu

SEQ ID NO: 137980 - RNA, 64 nt, Homo Sapiens
cuccuagaucuucaacgcagcaugggggacacaaggcuuuuauggcagcauuagagccaucguu

SEQ ID NO: 137981 - RNA, 64 nt, Homo Sapiens
ugaugaaucaacuucuacagguauauacggaucuggcuuuuaaucuggcaguuucuucagcugu

SEQ ID NO: 137982 - RNA, 64 nt, Homo Sapiens
gugacaggcaaagaggaauuguugggaccagacuggcuuuuauaaauaauguccuugauacuga

SEQ ID NO: 137983 - RNA, 64 nt, Homo Sapiens
agaaagaccuuauaaauguaagacaugugggaaaggcuuuuauucucccacgucauuucaaaga

SEQ ID NO: 137984 - RNA, 64 nt, Homo Sapiens
agaaagaccuuauaaauguaagauaugugggaaaggcuuuuauucugccaagucauuucaaaua

SEQ ID NO: 137985 - RNA, 64 nt, Homo Sapiens
caccucuucccaacccuuacaagcaagggugcuaggggcucagcuauacgaccauucucccuga

SEQ ID NO: 137986 - RNA, 64 nt, Homo Sapiens
ucuguggcccugcaccuuaugggaagccauuaagggggcucaucuaggaauucugguuacagcc

SEQ ID NO: 137987 - RNA, 64 nt, Homo Sapiens
guagcucuucacagcugaacucagucuauggguuggggcucagauaacucugugcauuuaagcu

SEQ ID NO: 137988 - RNA, 64 nt, Homo Sapiens
gcaaguuaaaauguaaaagaugugauuuaucuggggggcucagguaugguggggaaguggauuc

SEQ ID NO: 137989 - RNA, 64 nt, Homo Sapiens
guuuacuggggugggguggcgagaugggcuugagggggcucagagcauaaggcuucagggccca

SEQ ID NO: 137990 - RNA, 64 nt, Homo Sapiens
uucaggaagggggagcacugagaagcacagcacaggggcucagccugggauccggugauggucu

SEQ ID NO: 137991 - RNA, 64 nt, Homo Sapiens
cuacauauggcaggccgaucggagagcagccgauggggcucagacugauguuagagaggccugg

SEQ ID NO: 137992 - RNA, 64 nt, Homo Sapiens
uuuuccuggcuuugggagcaaccugucaugggcuggggcucagacccauucuucucuacccaga

SEQ ID NO: 137993 - RNA, 64 nt, Homo Sapiens
aaggggccccucgagccuuccucuggguuacugaggggcucaggaccuagccugcuccucugcu

SEQ ID NO: 137994 - RNA, 64 nt, Homo Sapiens
ccugccccccauggcucugugcugcucacuuuagggggcucaauucuccacucugcucaguccc

SEQ ID NO: 137995 - RNA, 64 nt, Homo Sapiens
agcguugugucaugccuguccacaggggauucguggggcucacuucaucagaguuugaagccca

SEQ ID NO: 137996 - RNA, 64 nt, Homo Sapiens
uuuccagcuacugugcccuugggcagcugcgucuggggcucaaccccccaauccuguuccccuc

SEQ ID NO: 137997 - RNA, 64 nt, Homo Sapiens
aaaaugucuuuccuuuuaugcugcgcccagucuuggggcucaaagauuugcccaaaccucauug

SEQ ID NO: 137998 - RNA, 64 nt, Homo Sapiens
cgccuccagugugcaugagcgugucugaagauggggggcucagggggcacguuugcguuuggac

SEQ ID NO: 137999 - RNA, 64 nt, Homo Sapiens
cggggcugcagguuguugagggcugugacuccguggggcucagccaggcuccagcagggucaga

SEQ ID NO: 138000 - RNA, 64 nt, Homo Sapiens
gggacucggggcggccaguaccaccgccugaggcggggcucagcagcguugcauguacgggccu

SEQ ID NO: 138001 - RNA, 64 nt, Homo Sapiens
cccuccaccccucccuucauaggccaggggggagggggcucagcgucccuggggggcaggggcc

SEQ ID NO: 138002 - RNA, 64 nt, Homo Sapiens
cucccccugggccgaggccuacaccccuguccccggggcucagcacaacacuugaggccaaagg

SEQ ID NO: 138003 - RNA, 64 nt, Homo Sapiens
acaacgcugcugccugcuuugugcaggguccuccggggcucagcccugaguuggcaucaccugc

SEQ ID NO: 138004 - RNA, 64 nt, Homo Sapiens
gcccugaguuggcaucaccugcgcagggcccucuggggcucagcccugagcuagugucaccugc

SEQ ID NO: 138005 - RNA, 64 nt, Homo Sapiens
gcccugagcuggcgucaccugugcagggcccucuggggcucagcccugagcuggccucaccugg

SEQ ID NO: 138006 - RNA, 64 nt, Homo Sapiens
cgcugggccgcccacuccugucagucauuccccuggggcucaaguuggcccuggcuaaugucuc

SEQ ID NO: 138007 - RNA, 64 nt, Homo Sapiens
gguccuaacccuuuaggcagacuugagcugggcuggggcucaggauugaaaaagggcagggggc

SEQ ID NO: 138008 - RNA, 64 nt, Homo Sapiens
ugggcccaggcugagugugacccuggguggggaaggggcucacacucccacccugacccccgac

SEQ ID NO: 138009 - RNA, 64 nt, Homo Sapiens
ugcuucagggaaugugucccugaagccgugccagggggcucagccagggccaggguccccuugg

SEQ ID NO: 138010 - RNA, 64 nt, Homo Sapiens
gccauggaagcuacuccaaggagcugcaggccggggggcucaguuagccugagacaugaugcaa

SEQ ID NO: 138011 - RNA, 64 nt, Homo Sapiens
ugcccagcaguguuggugcccagagaugacaagggccagggagccuggcccgggugugagaauu

SEQ ID NO: 138012 - RNA, 64 nt, Homo Sapiens
cagccuugugggggagggcaaggcucuccucccagccagggacgccaggacauagcugcuccug

SEQ ID NO: 138013 - RNA, 64 nt, Homo Sapiens
gcagaccuccugggagacccacgaaggguuuuuagccagggaaaacugagccccaggaaaaccu

SEQ ID NO: 138014 - RNA, 64 nt, Homo Sapiens
gcuuucauucagggcaacaaaugauacaaauggugccagggaguggcaaggccauggggguagg

SEQ ID NO: 138015 - RNA, 64 nt, Homo Sapiens
gggugaagcagguaucagaggugggaguugacaggccagggagaccugcccagaaguggaugau

SEQ ID NO: 138016 - RNA, 59 nt, Homo Sapiens
ugcugccagaaugaaguaggcaccauaaggccagggagcgggacagcaaagagaucuag

SEQ ID NO: 138017 - RNA, 64 nt, Homo Sapiens
augucacagaugaggcugccccugccccccccccgccagggagguuucaugagcucaugucuau

SEQ ID NO: 138018 - RNA, 64 nt, Homo Sapiens
cccaaccccgguggguacuggcugccugcccugggccagggaauggcuccuuauaccaaagaug

SEQ ID NO: 138019 - RNA, 64 nt, Homo Sapiens
ccccacccagaccugccugucucccacccuuucugccagggauggcaguggcugugaaggagua

SEQ ID NO: 138020 - RNA, 64 nt, Homo Sapiens
ggggacacuguggcagcaggagggacucugucuggccagggaggagccccaguggugagaagac

SEQ ID NO: 138021 - RNA, 64 nt, Homo Sapiens
gggauggguacacuuacugcaguguugggguuuugccagggaaguaaaaggaguugagagaaag

SEQ ID NO: 138022 - RNA, 64 nt, Homo Sapiens
aaauagaggguaugaccugggguugcuggccagagccagggaggagccuuaagaagugaaaucu

SEQ ID NO: 138023 - RNA, 64 nt, Homo Sapiens
ccacaggcccggccauaugaagggaaggagaggggccagggaggagugcagggagccagcugga

SEQ ID NO: 138024 - RNA, 64 nt, Homo Sapiens
uagcagguagcucucuagggaagacgugaaggaagccagggagggagaaggugaaaugugagca

SEQ ID NO: 138025 - RNA, 64 nt, Homo Sapiens
gauucgaagauccuagaccagggagacacugugagccagggauacaacaaaauacuagguaagu

SEQ ID NO: 138026 - RNA, 64 nt, Homo Sapiens
gacaugacugcugaccuaaagaucccuggcauuggccagggauccuguggaaccucuucuaguu

SEQ ID NO: 138027 - RNA, 64 nt, Homo Sapiens
caacaauggggacagaagucccacccagagcugggccagggacugggaggacacgcuccacuga

SEQ ID NO: 138028 - RNA, 64 nt, Homo Sapiens
acacgcuccacugaccacccccacccagagcugggccagggaggacacggacacgcucugcuga

SEQ ID NO: 138029 - RNA, 64 nt, Homo Sapiens
gaccugagcugcugugaaagccccugcacaaucagccagggagaacugggcggguuuaguggcc

SEQ ID NO: 138030 - RNA, 64 nt, Homo Sapiens
gcugcaggccaaggccaaaauugggcuaguccuggccagggaaaucagaagcucuucuugggug

SEQ ID NO: 138031 - RNA, 64 nt, Homo Sapiens
gcugcccuccccucacaguuccugcaccucagcagccagggaagcagggcccagaggagaccca

SEQ ID NO: 138032 - RNA, 64 nt, Homo Sapiens
ccgggagguaauugggggugaggaagaugugcgggccagggaauguguuccacagagagggaca

SEQ ID NO: 138033 - RNA, 64 nt, Homo Sapiens
ggacagaggaaaacagccaccucuggcaccagaugccagggaagccaggacccccgcaccugcc

SEQ ID NO: 138034 - RNA, 64 nt, Homo Sapiens
ggucccaggacucaacugggacccugagggcucagccagggaggccugccauagggaggggagg

SEQ ID NO: 138035 - RNA, 64 nt, Homo Sapiens
ugagaaguuauauugggcagcaagucugucuucagccagggacuaaguaggugaugccagcccu

SEQ ID NO: 138036 - RNA, 64 nt, Homo Sapiens
gcaguuugcacagcagaggggcaagggagagcuggccagggacauccuauguaucagguuaaga

SEQ ID NO: 138037 - RNA, 64 nt, Homo Sapiens
cccagaacaagaagaccccgccuccauggcagcagccagggaccacuuuccugagcugucgcug

SEQ ID NO: 138038 - RNA, 64 nt, Homo Sapiens
agccccaggguuggggggugagacaccauccugagccagggaacugaccauaauccuagccccg

SEQ ID NO: 138039 - RNA, 64 nt, Homo Sapiens
caggugugccugugcuccugucccucaacugagggccagggaccaaacucugguacgaaucuca

SEQ ID NO: 138040 - RNA, 64 nt, Homo Sapiens
uugacauuuccauuacacacagcacugcugcggugccagggaccuagcgcaggacuuuugguaa

SEQ ID NO: 138041 - RNA, 64 nt, Homo Sapiens
ucucuccaccgccucaguguagggaaggguccaggccagggaaggagcacccucuaguggaggc

SEQ ID NO: 138042 - RNA, 64 nt, Homo Sapiens
gugcagccuggaaccuccagggcaggagucaggagccagggacuaaccuccagucacugcgccc

SEQ ID NO: 138043 - RNA, 64 nt, Homo Sapiens
agggacccgacuugcagacgugcuguaggcacccgccagggagcugcuggggccuccuuguugg

SEQ ID NO: 138044 - RNA, 64 nt, Homo Sapiens
uggggagggggggcggaaaccaagccagcccacagccagggaagagggacucacuggagggcac

SEQ ID NO: 138045 - RNA, 64 nt, Homo Sapiens
cuucaaacuuuccaacggaaaacuaaugagaacugccagggaaugggacacuucgggaaugcug

SEQ ID NO: 138046 - RNA, 64 nt, Homo Sapiens
ggccacaucacuucccacugcagccagggacauagccagggagggcucugaucagcgcaggggc

SEQ ID NO: 138047 - RNA, 64 nt, Homo Sapiens
uagccagggaggggccacaucagcgcaggggccagccagggacaccacuuucuguggcucugau

SEQ ID NO: 138048 - RNA, 64 nt, Homo Sapiens
augggcugcagcagaggcacugggggcagcgggggccagggaaguccccgaguuuccccagaca

SEQ ID NO: 138049 - RNA, 64 nt, Homo Sapiens
gguuugagauggacacacugguguggauuaaccugccagggagacagagcucacaauaaaaaug

SEQ ID NO: 138050 - RNA, 64 nt, Homo Sapiens
ccuugucgccuucacuucuacaggaggggaaggggccagggaggggauucucccuuuaucauca

SEQ ID NO: 138051 - RNA, 64 nt, Homo Sapiens
gguauaggggaguccagaggugaugccugccucagccagggagggcuuccuggaggagaaggag

SEQ ID NO: 138052 - RNA, 64 nt, Homo Sapiens
ugcguuuuaggcacagcaaauggcacauacaagggccagggagcaagagagaggacagguccuc

SEQ ID NO: 138053 - RNA, 64 nt, Homo Sapiens
gucuugccagacgacucugaggaggagaagugaggccagggacacaugggugaagucuagaugg

SEQ ID NO: 138054 - RNA, 64 nt, Homo Sapiens
gaacccugggcagggcucugggcugguggcccaggccagggaggagggcaccucauggaccagg

SEQ ID NO: 138055 - RNA, 64 nt, Homo Sapiens
cucucgaccuugaucucuagcuaugaauggaccagccagggaaacaauucccuguuccuucagg

SEQ ID NO: 138056 - RNA, 64 nt, Homo Sapiens
augcuuggcacuuuccauagagucucuacuguaugccagggaucgagggaaccaacauuugcua

SEQ ID NO: 138057 - RNA, 64 nt, Homo Sapiens
uaggugcacggugcaaggcccugggagggcacuggccagggaaggugguauagauggcccucag

SEQ ID NO: 138058 - RNA, 64 nt, Homo Sapiens
caaguccacugcccggaagucuugucagcccuaagccagggaagccuggagcguggccuggcgg

SEQ ID NO: 138059 - RNA, 64 nt, Homo Sapiens
aauuacugcuugguacgcagagcaccgaggccgagccagggaugaagcugaaauggaauaucug

SEQ ID NO: 138060 - RNA, 64 nt, Homo Sapiens
cgauucuuuggaaguucagcagaugaaagcccaggccagggaggagaaggcuagaaagcaggug

SEQ ID NO: 138061 - RNA, 64 nt, Homo Sapiens
gguacccacccgcuguucuccaugcaaacaaagcgccagggaaaugacccacagggaucgcagc

SEQ ID NO: 138062 - RNA, 64 nt, Homo Sapiens
gaaaugacccacagggaucgcagcugcagggagggccagggagguugggggugggagugaaugc

SEQ ID NO: 138063 - RNA, 64 nt, Homo Sapiens
gccauggagacuccaccuggauccccuguaggaggccagggaggggaacucagcaguucaggag

SEQ ID NO: 138064 - RNA, 64 nt, Homo Sapiens
accaggugcgggggcagagggugacuuaccaagagccagggagggcagcccaggcccaagugac

SEQ ID NO: 138065 - RNA, 64 nt, Homo Sapiens
ggagaguacauugaaggccuggaauuagcuuggggccagggaagggacugggaggggagagaag

SEQ ID NO: 138066 - RNA, 64 nt, Homo Sapiens
uggggggggauguggaucagguuuacuagcaccugccagggaggccaucuggggcuccuucucc

SEQ ID NO: 138067 - RNA, 64 nt, Homo Sapiens
uaagaaacuuccuguacauaaauucaagaaaggagaugaguaugauguaugugccauuuguuug

SEQ ID NO: 138068 - RNA, 64 nt, Homo Sapiens
aggagaugaguaugauguaugugccauuuguuuggaugaguaugaagauggagacaaacucaga

SEQ ID NO: 138069 - RNA, 64 nt, Homo Sapiens; identical to SEQ ID NO: 72083

SEQ ID NO: 138070 - RNA, 64 nt, Homo Sapiens; identical to SEQ ID NO: 72084

SEQ ID NO: 138071 - RNA, 64 nt, Homo Sapiens; identical to SEQ ID NO: 72085

SEQ ID NO: 138072 - RNA, 64 nt, Homo Sapiens; identical to SEQ ID NO: 72086

SEQ ID NO: 138073 - RNA, 64 nt, Homo Sapiens; identical to SEQ ID NO: 72087

SEQ ID NO: 138074 - RNA, 64 nt, Homo Sapiens; identical to SEQ ID NO: 72088

SEQ ID NO: 138075 - RNA, 64 nt, Homo Sapiens; identical to SEQ ID NO: 72089

SEQ ID NO: 138076 - RNA, 64 nt, Homo Sapiens; identical to SEQ ID NO: 72090

SEQ ID NO: 138077 - RNA, 64 nt, Homo Sapiens; identical to SEQ ID NO: 72091

SEQ ID NO: 138078 - RNA, 64 nt, Homo Sapiens; identical to SEQ ID NO: 72092

SEQ ID NO: 138079 - RNA, 64 nt, Homo Sapiens; identical to SEQ ID NO: 72093

SEQ ID NO: 138080 - RNA, 64 nt, Homo Sapiens; identical to SEQ ID NO: 72094

SEQ ID NO: 138081 - RNA, 64 nt, Homo Sapiens; identical to SEQ ID NO: 72095

SEQ ID NO: 138082 - RNA, 64 nt, Homo Sapiens; identical to SEQ ID NO: 72096

SEQ ID NO: 138083 - RNA, 64 nt, Homo Sapiens; identical to SEQ ID NO: 72097

SEQ ID NO: 138084 - RNA, 64 nt, Homo Sapiens; identical to SEQ ID NO: 72098

SEQ ID NO: 138085 - RNA, 64 nt, Homo Sapiens; identical to SEQ ID NO: 72099

SEQ ID NO: 138086 - RNA, 64 nt, Homo Sapiens; identical to SEQ ID NO: 72100

SEQ ID NO: 138087 - RNA, 64 nt, Homo Sapiens; identical to SEQ ID NO: 72101

SEQ ID NO: 138088 - RNA, 64 nt, Homo Sapiens; identical to SEQ ID NO: 72102

SEQ ID NO: 138089 - RNA, 64 nt, Homo Sapiens; identical to SEQ ID NO: 72103

SEQ ID NO: 138090 - RNA, 64 nt, Homo Sapiens; identical to SEQ ID NO: 72104

SEQ ID NO: 138091 - RNA, 64 nt, Homo Sapiens; identical to SEQ ID NO: 72105

SEQ ID NO: 138092 - RNA, 64 nt, Homo Sapiens; identical to SEQ ID NO: 72106

SEQ ID NO: 138093 - RNA, 64 nt, Homo Sapiens; identical to SEQ ID NO: 72107

SEQ ID NO: 138094 - RNA, 64 nt, Homo Sapiens; identical to SEQ ID NO: 72108

SEQ ID NO: 138095 - RNA, 64 nt, Homo Sapiens; identical to SEQ ID NO: 72109

SEQ ID NO: 138096 - RNA, 64 nt, Homo Sapiens
ugcagugagcugagaucgcaccacugcacuccagccugguuacagagcaagacucugucucaaa

SEQ ID NO: 138097 - RNA, 64 nt, Homo Sapiens
aaauagggacucugaagaugucgaaaucuuuauuccugguuaggaaggugggccgcuacccuuc

SEQ ID NO: 138098 - RNA, 64 nt, Homo Sapiens
aaucauggagggaaaacauuguuaccucggaucuccugguuacccagcacauaguaguacugga

SEQ ID NO: 138099 - RNA, 64 nt, Homo Sapiens
guuaaccagaggggcuuccuuuguauguuacaugccugguuacaugggccuggacagcaugucc

SEQ ID NO: 138100 - RNA, 64 nt, Homo Sapiens
aauucuguuaugcaauuuauucuugaugcucaggccugguuaagcugaggcuuaccuuuaauaa

SEQ ID NO: 138101 - RNA, 64 nt, Homo Sapiens
uaggcgugaauguaaaugccuuaauauugaagguccugguuagaagcaugauacaagacaucua

SEQ ID NO: 138102 - RNA, 64 nt, Homo Sapiens
ucgcaacucuaagauuuuuuuaaaccacaaaaacccugguuagccaucucaugcucagccuuau

SEQ ID NO: 138103 - RNA, 64 nt, Homo Sapiens
cuguugagcccaucaauaaaacuauugcaccuguccugguuagcaagaaacugaacgucacaga

SEQ ID NO: 138104 - RNA, 64 nt, Homo Sapiens
gcaggugguccuagacagcagucuugccuuuauuccugguuaggaacaaacuggucuccaggcu

SEQ ID NO: 138105 - RNA, 64 nt, Homo Sapiens
gcugcccgggugucuuuuuuucggacccugguguccugguuacucagguguguggaggccgugg

SEQ ID NO: 138106 - RNA, 64 nt, Homo Sapiens
cucgggcacccaggaaagccucccuucuccucugccugguuagacucccaggccucgccagggc

SEQ ID NO: 138107 - RNA, 64 nt, Homo Sapiens
gguaaguacacacacccacauggccucacaagccccugguuacuccuacacauaccgccacugc

SEQ ID NO: 138108 - RNA, 64 nt, Homo Sapiens
agaaucaggauaaaaauaagaaguucuucagggaccugguuauuuaaaacagagauuccucaga

SEQ ID NO: 138109 - RNA, 64 nt, Homo Sapiens
gaagguuaaagcaaauguuuuuagacugcauuuuccugguuaaacuuuuuagagaagagggcau

SEQ ID NO: 138110 - RNA, 64 nt, Homo Sapiens
ugacagucagcuguggggaacacucaccccuagcccugguuagcacccuguguccuccaccaug

SEQ ID NO: 138111 - RNA, 64 nt, Homo Sapiens
aacugcauuaaaguccuuacaguuuuaacagauuccugguuaggagauuaagagcagaaauuga

SEQ ID NO: 138112 - RNA, 64 nt, Homo Sapiens
ucuuccguugucagcuucuccuucuuucuccaggccugguuaacccuugccuuccuuccuccca

SEQ ID NO: 138113 - RNA, 64 nt, Homo Sapiens
auuaaugucagugacuaaaauucaauuccuguaaccugguuaguuauauuguacaauguuaaac

SEQ ID NO: 138114 - RNA, 64 nt, Homo Sapiens
acucuuuugcugugcacauaaugauaggauagauccugguuaccuauguuccuaacaaaaugag

SEQ ID NO: 138115 - RNA, 64 nt, Homo Sapiens
gugcaauuuggagauuuuuugauucuuauaucucccugguuacaacuccccacaccuaagacca

SEQ ID NO: 138116 - RNA, 64 nt, Homo Sapiens
guguccuguaaaauacagacuuuauaaguagccgccugguuacuugaaaugaaucuuguuuuuu

SEQ ID NO: 138117 - RNA, 64 nt, Homo Sapiens
gcaguuucuuggugauuugggaagcaggagaguuccugguuaugagagaaccaaauagccugag

SEQ ID NO: 138118 - RNA, 64 nt, Homo Sapiens
gcuuuccaucacagcuccccccccucuugacuuuccugguuauauguuaagugcaguagggcuu

SEQ ID NO: 138119 - RNA, 64 nt, Homo Sapiens
ggguaggacacccagauuuuggcagauaucuuggccugguuaugucagagacuuuagcauuggg

SEQ ID NO: 138120 - RNA, 64 nt, Homo Sapiens
cauagagaguagccuuuaaucugaacuaguuggaccugguuaauucacuuccuuaaagacucuu

SEQ ID NO: 138121 - RNA, 64 nt, Homo Sapiens
ugaauaaucaguggcaauuuuuggcagugaugcuccugguuaacuaauugucacuugguucugu

SEQ ID NO: 138122 - RNA, 64 nt, Homo Sapiens
guacauuugaaugccagaauuucuaaauaaauccccugguuaggaaauuuuaaaagucaaagcu

SEQ ID NO: 138123 - RNA, 64 nt, Homo Sapiens
auuaaaguuacacacuaguauguuggucuggugaccugguuacauuuuauuauacacauuauug

SEQ ID NO: 138124 - RNA, 64 nt, Homo Sapiens
ggguccauguggcaaguagggccacagggcagcaccugguuacaacuugcugguggguuuuaug

SEQ ID NO: 138125 - RNA, 64 nt, Homo Sapiens
uucacauguuacuucauuuuguuaggcacagugaccugguuauuggucauuaaauauaucauau

SEQ ID NO: 138126 - RNA, 64 nt, Homo Sapiens
uucaucauugcuuugaauuguuauuucccauauuccugguuauuuuuuugagagaagcaucuuu

SEQ ID NO: 138127 - RNA, 64 nt, Homo Sapiens
uacaaaugugacccgugauauuauuuggccaucuccugguuauacaaaaucacugcaguagaug

SEQ ID NO: 138128 - RNA, 64 nt, Homo Sapiens
uugaaaguguaauuccccucaaugaccuacuagcccugguuauugcuguuccccaucugguacu

SEQ ID NO: 138129 - RNA, 64 nt, Homo Sapiens
agccgacuucuuugguguucacggaccccuuucaccugguuaugccguggagucgagcuggccg

SEQ ID NO: 138130 - RNA, 64 nt, Homo Sapiens
uguuuucugaguuuuuuggguucuuuaucuuuuuccugguuaauuuggcaucagcauuaccucu

SEQ ID NO: 138131 - RNA, 64 nt, Homo Sapiens
uuagcccuaacucucaucugacgccuacuucugcccugguuaauaggucccagaaaugaccaga

SEQ ID NO: 138132 - RNA, 64 nt, Homo Sapiens
gacagcuucgagaaccagagguuaucuccccugcccugguuacaccagggaauggucccauaca

SEQ ID NO: 138133 - RNA, 64 nt, Homo Sapiens
cugcugcaaaaaagaaguaugucaguuauaauaaccugguuaucuaaccuguuccauuccaugg

SEQ ID NO: 138134 - RNA, 64 nt, Homo Sapiens
ucugcacucuuuaaaccuguuuaaggcucuucauccugguuagcaaaaggugugaauguaaugu

SEQ ID NO: 138135 - RNA, 64 nt, Homo Sapiens
uugcauggcaaagacccagucaaaaugauuuaccccugguuaaguuucugaagacuuuguacau

SEQ ID NO: 138136 - RNA, 64 nt, Homo Sapiens
uucugguaauaauucuugcauuuuuuccccauaaccugguuaaaauaaauacgccauuggcaau

SEQ ID NO: 138137 - RNA, 64 nt, Homo Sapiens
uuucaugcuuuuuaucaguguccucgcuguccuuccugguuagacacuuggcuuucaucaugaa

SEQ ID NO: 138138 - RNA, 64 nt, Homo Sapiens
agcuuucuccugagcuccagucccugcuggauucccugguuaauucagcuugagcugaaaagcu

SEQ ID NO: 138139 - RNA, 64 nt, Homo Sapiens
ugcccaaccaaguauguuccuccugaauuccucuccugguuacuucaucacaaucuacauaggc

SEQ ID NO: 138140 - RNA, 64 nt, Homo Sapiens
aaggacagguaguugagaugaaacacuucaaaacccugguuauagauguacuguuuggauguag

SEQ ID NO: 138141 - RNA, 64 nt, Homo Sapiens
guucccaagagaguguaaagcauuuaaacauuuuccugguuaaggcguuuagaguugggauaua

SEQ ID NO: 138142 - RNA, 64 nt, Homo Sapiens
agaaaauuaauguucugacacccacauuuccuauccugguuagaugauugaaaaguaaacaaaa

SEQ ID NO: 138143 - RNA, 64 nt, Homo Sapiens
gaaucaccaauauuuaaaauguagcauuugcauuccugguuaaagagacacacacagcacuuca

SEQ ID NO: 138144 - RNA, 64 nt, Homo Sapiens
ggugcucccccugcaggaaagccacauccacgucccugguuaaauuucagagcuaaagugacaa

SEQ ID NO: 138145 - RNA, 64 nt, Homo Sapiens
ggcauuccuaagauucuucacaaauaucccauucccugguuacuccuguagauguugugauaug

SEQ ID NO: 138146 - RNA, 64 nt, Homo Sapiens
aucaguugacacuuugaguaugacauuuuaaaagccugguuaugaauagcauauaaaugguucu

SEQ ID NO: 138147 - RNA, 64 nt, Homo Sapiens
aggucuaggguucuguauauagggaacagauacaccugguuagauuccuaauaauggcaugggu

SEQ ID NO: 138148 - RNA, 64 nt, Homo Sapiens
ugcagcuacagcugcuucauucccugcauuagugccugguuacuggguaccuccugaguggcug

SEQ ID NO: 138149 - RNA, 64 nt, Homo Sapiens
ucuguuguaggguugccagaugcaauacaagauuccugguuaaauuugaauuucaguaaacaau

SEQ ID NO: 138150 - RNA, 64 nt, Homo Sapiens
cgccaucaaacuuaugggcagggauaacagugugccugguuaauauuaauauucccauuuuauu

SEQ ID NO: 138151 - RNA, 64 nt, Homo Sapiens
cagaaugauuuuccaacuagcaaauauaaguaugccugguuaagauaucuucccuuuguagaaa

SEQ ID NO: 138152 - RNA, 64 nt, Homo Sapiens
cacccagauuuauacuuagagucagacgaagucgccugguuaaagaugcucugcgucaauuaag

SEQ ID NO: 138153 - RNA, 64 nt, Homo Sapiens
cucagagcugggacuacaggcgugcaccaccacgccugguuaauuguuuuuuuuuaauuuaucu

SEQ ID NO: 138154 - RNA, 64 nt, Homo Sapiens
ugguucucuucagagaauauuaguggauguuccgccugguuagccugguuauguggaagauucu

SEQ ID NO: 138155 - RNA, 64 nt, Homo Sapiens
gguuuguuugucauuaaagacagucuucauuccuccugguuauuucacauuauaaagggaagga

SEQ ID NO: 138156 - RNA, 61 nt, Homo Sapiens
uuauuaccugauuugaugaaaugugaaccugccugguuaauucagaauacuaucugauuga

SEQ ID NO: 138157 - RNA, 64 nt, Homo Sapiens
aagaaaacucaccaaucauccuauccacagugaaccugguuacgggaaggaaggcaggcccuuc

SEQ ID NO: 138158 - RNA, 64 nt, Homo Sapiens
auggaugauuuuucauugaauuuccuggugugauccugguuaaaaaaaaaaaauacaccuucag

SEQ ID NO: 138159 - RNA, 64 nt, Homo Sapiens
auguauguugccagcuaguguacuugcuuuguguccugguuacugaccagaacccaaguacugg

SEQ ID NO: 138160 - RNA, 64 nt, Homo Sapiens
cagauauuaaagcugcuuuuuuauuauagaauaaccugguuaaacgugcauuaaaauggaguuc

SEQ ID NO: 138161 - RNA, 64 nt, Homo Sapiens
uuggacaucacaugugaaugcaugauaugaagagccugguuacaguuucuacuguucucugcaa

SEQ ID NO: 138162 - RNA, 64 nt, Homo Sapiens
auguuaccaugguacuccuaaagcauaugccucaccugguuaaaaaagaacaaacauguuuuug

SEQ ID NO: 138163 - RNA, 64 nt, Homo Sapiens
cccagguccccagugcgcccccuaguggccauagccugguuaaaguuccccagugccuccuugu

SEQ ID NO: 138164 - RNA, 64 nt, Homo Sapiens
aaaagagaggaacccaguugaauaggauccaaucccugguuagccucuacacaauaauagggag

SEQ ID NO: 138165 - RNA, 64 nt, Homo Sapiens
uacugucuuaaagcucauacggcuuggugcuugaccugguuaaacugaaaauaauaguagcucu

SEQ ID NO: 138166 - RNA, 64 nt, Homo Sapiens
aaggcaagauccccaacucuaaguuugagaccagccugguuagcuggggauugcgugaagccac

SEQ ID NO: 138167 - RNA, 64 nt, Homo Sapiens
uguuuuaugcuguaaucuagcuuuaacgccauugccugguuacuccaguuuuagaagagagaga

SEQ ID NO: 138168 - RNA, 64 nt, Homo Sapiens
uuuuacacacccuaggaaacgugcuucauuccccccugguuaauaguuugguugccagaaaaau

SEQ ID NO: 138169 - RNA, 64 nt, Homo Sapiens
auauacuugugucugugcugauuuauauuaaaccccugguuaguggucuuucuaugcugguugu

SEQ ID NO: 138170 - RNA, 64 nt, Homo Sapiens
aaaauaacuaugaaauuaccacuguuaauguaaaccugguuauuagaaaaaaguucaucacgug

SEQ ID NO: 138171 - RNA, 64 nt, Homo Sapiens
accugcuuagacuuuuaugugacuuguauggucuccugguuaaagggaauggugucagaauauu

SEQ ID NO: 138172 - RNA, 64 nt, Homo Sapiens
acugagagguauacaugaggcuaguguuugcauuccugguuauauguaaugugauaaauuagcu

SEQ ID NO: 138173 - RNA, 64 nt, Homo Sapiens
uuucucaaaggccauuuccauggucuuucaggucccugguuacuaggugccuuccacaaucuca

SEQ ID NO: 138174 - RNA, 64 nt, Homo Sapiens
gagaaaugucuuauguaaauagaaaaacaauuaaccugguuaaagaggagucuaugccauuuua

SEQ ID NO: 138175 - RNA, 64 nt, Homo Sapiens
auacuguggguccauacacaucugaacuuaucuaccugguuaugcauuuuuaaaaacuauucuu

SEQ ID NO: 138176 - RNA, 64 nt, Homo Sapiens
uuucuauaaaauaagaacauaaacgccuguauauccugguuaagagcgcccgagaagaagaaug

SEQ ID NO: 138177 - RNA, 64 nt, Homo Sapiens
agugauuuugaccaaugccuuuccagcaccuuccccugguuaugacagggagcucccaggccag

SEQ ID NO: 138178 - RNA, 64 nt, Homo Sapiens
ucuucuuuccuccaaccucuuaccuuagaugcauccugguuaucuggaagcaugggaaagaagg

SEQ ID NO: 138179 - RNA, 64 nt, Homo Sapiens
ugccauuuaaacugccagaaaucuuugccaagguccugguuaaaaaaauuggaaacgguuuucu

SEQ ID NO: 138180 - RNA, 64 nt, Homo Sapiens
uaaugcuaaucacuguaccauggacuuuaaaucuccugguuaaacaagguagaauuuaauuuuc

SEQ ID NO: 138181 - RNA, 64 nt, Homo Sapiens
ggagaucuggcugugagucagaggacuagcagccccugguuaagcaagaaaaguggaucucagg

SEQ ID NO: 138182 - RNA, 64 nt, Homo Sapiens
accugacgcuaaaacuaaaaaaagaaaacagaaaccugguuauaaguauugaaaagacaggaga

SEQ ID NO: 138183 - RNA, 64 nt, Homo Sapiens
aacaaguuuuacugaucaguucaagaacagucacccugguuaauacagcaggguuaaucuauua

SEQ ID NO: 138184 - RNA, 64 nt, Homo Sapiens
ccauauaauaacacaaacugagagguuaaaacuaccugguuaucagagaaaugggguuagccau

SEQ ID NO: 138185 - RNA, 64 nt, Homo Sapiens
aauccuggcugucgaggcuuugaagcauguguuaccugguuaagcuuguuuucucuugcuuuag

SEQ ID NO: 138186 - RNA, 64 nt, Homo Sapiens
gcuaauaggagucugacccgagggccugcugcuuccugguuaaguaucuuuugagauucuagaa

SEQ ID NO: 138187 - RNA, 55 nt, Homo Sapiens
auggcguuggaaagaaaugaaaaacccugguuaaucaaagauguuccagagugcc

SEQ ID NO: 138188 - RNA, 64 nt, Homo Sapiens
caggagucugaguuuacagagccaacuugcagcaccugguuaugccuccuuucaucucaaagcc

SEQ ID NO: 138189 - RNA, 64 nt, Homo Sapiens
auggccacgcaccuucucucaggccuucgggcccccugguuaaacugcaccaaggguguuuccu

SEQ ID NO: 138190 - RNA, 64 nt, Homo Sapiens
uaugaaauacucauauguuuaauagcacauaacaccugguuauauuugcuuuauacccgggcca

SEQ ID NO: 138191 - RNA, 64 nt, Homo Sapiens
ugaaugaaagaaaaggagcaugagugauauccaaccugguuaaagcuuccuaacuaaaaauaca

SEQ ID NO: 138192 - RNA, 64 nt, Homo Sapiens
acagauguggacugagugcuaguucacacaauucccugguuagccuuuucaauggagaagagac

SEQ ID NO: 138193 - RNA, 64 nt, Homo Sapiens
accgaaucugacuuuggugagaucauagaugccaccugguuagcuaaauaagaggggcgacguu

SEQ ID NO: 138194 - RNA, 64 nt, Homo Sapiens
gcugaggaccccaagauagggaggcagugggugcccugguuaggcccagcaggagcugaugccg

SEQ ID NO: 138195 - RNA, 64 nt, Homo Sapiens
gcugcuuuuaagauagagaacccaaaguuuuguaccugguuauuuuucacuuaaguuuguagac

SEQ ID NO: 138196 - RNA, 64 nt, Homo Sapiens
cacuaaaguaggugguucguguguguucucauuaccugguuaugauagauaugcacaucaaagc

SEQ ID NO: 138197 - RNA, 64 nt, Homo Sapiens
aaacaugucuuauuacuaaagaaagugauuuacuccugguuaguacauucucagaggauucuga

SEQ ID NO: 138198 - RNA, 64 nt, Homo Sapiens
ucaccaacgaaggcuaggagauggaaucacuauuccugguuaucaguauucuuguuguuuacgc

SEQ ID NO: 138199 - RNA, 64 nt, Homo Sapiens
guucagacauuccauggugaaguaaucuccagggccugguuauuuaaaacucugccagcccugc

SEQ ID NO: 138200 - RNA, 64 nt, Homo Sapiens
uuggucaucuaaagcugucagcgccauauauaagccugguuaaaucccgugaaaccaguauuug

SEQ ID NO: 138201 - RNA, 64 nt, Homo Sapiens
cugcgagacuugagucuaccaugcuuuccuagugccugguuacuucguggagcuacugcccaug

SEQ ID NO: 138202 - RNA, 64 nt, Homo Sapiens
gcugagcucugugcucagugccccuaagccuggcccugguuauuuggcaggcagcccccugugc

SEQ ID NO: 138203 - RNA, 64 nt, Homo Sapiens
acugucugggguuucugauauggggauuucagccccugguuaaucagucuugucccuacaaguc

SEQ ID NO: 138204 - RNA, 64 nt, Homo Sapiens
guaucgucuuugauaauauucaacauuuucaugaccugguuauagccuuugcugguguuuuuaa

SEQ ID NO: 138205 - RNA, 64 nt, Homo Sapiens
cuuuugugaagguucccccgcugagaucuuuccuccugguuacugugaagccuguugguuugcu

SEQ ID NO: 138206 - RNA, 64 nt, Homo Sapiens
aauauuaagguuggaauuacgugcuaugcuauuuccugguuaugcaucacucuaggaucaugaa

SEQ ID NO: 138207 - RNA, 64 nt, Homo Sapiens
cuaucccagugaccagccacggccgacugcauuuccugguuacuaaguuuuguucauucaugag

SEQ ID NO: 138208 - RNA, 64 nt, Homo Sapiens
agaaaugauggugcucugcaucagugguucagagccugguuauacauauagaucacucagggag

SEQ ID NO: 138209 - RNA, 54 nt, Homo Sapiens
aguggaaacagacugucugacuucccugguuacucauguccucaaagacgacuc

SEQ ID NO: 138210 - RNA, 64 nt, Homo Sapiens
ggacggaaggucaguugccaugguuaccgaggacccugguuacucuggugcuguccuguuuuac

SEQ ID NO: 138211 - RNA, 64 nt, Homo Sapiens
aggcccagcccugacuuccacucuggcucagcaaccugguuauuuauguggggccgugcaggca

SEQ ID NO: 138212 - RNA, 64 nt, Homo Sapiens
gcccuuguuuuguuuuauggcuagucuuaucuggccugguuauuuccuugcggggaggagaggg

SEQ ID NO: 138213 - RNA, 64 nt, Homo Sapiens
aguggguacagcccaguggaggaggggguacaguccugguuagguggggacagaggauuucugc

SEQ ID NO: 138214 - RNA, 64 nt, Homo Sapiens
uuccauguagacuuaccuuuccucauagagcuauccugguuaauaacaggccaagauucuccca

SEQ ID NO: 138215 - RNA, 64 nt, Homo Sapiens
acagucagaaauuugagaaggauuuuaggugacaccugguuauggcaucuuggccuacaggaca

SEQ ID NO: 138216 - RNA, 64 nt, Homo Sapiens
gcccagggggaagaugccaaggcaagcauagucgccugguuacgcguguucacacacacacaau

SEQ ID NO: 138217 - RNA, 64 nt, Homo Sapiens
uuguuauucucggacugugauggaggaauugggaccugguuaugacagaagcuugugggguaca

SEQ ID NO: 138218 - RNA, 64 nt, Homo Sapiens
accucuauacaggacuuagaaguaguauguuauuccugguuaagcaggcauugcuuugcccugg

SEQ ID NO: 138219 - RNA, 64 nt, Homo Sapiens
aauacaauauuccagccaaccaguuaauucucuuccugguuacauucauugggucuauuugccu

SEQ ID NO: 138220 - RNA, 64 nt, Homo Sapiens
guccugaccacgcaggcccuggggacucaagaccccugguuacccccacucaucuguccucucu

SEQ ID NO: 138221 - RNA, 64 nt, Homo Sapiens
gcccuaguuuggcgccugcugcuccuugguuuugccugguuagacuuucagugacagauguugg

SEQ ID NO: 138222 - RNA, 64 nt, Homo Sapiens
gggcucccccaggggcugucccggaggcggugggccugguuaaauaaggcaggguuuauaugca

SEQ ID NO: 138223 - RNA, 64 nt, Homo Sapiens
cuucuguugcucucugugucugagagcaaagugaccugguuaaacaaaccagaaucccucuaca

SEQ ID NO: 138224 - RNA, 64 nt, Homo Sapiens
ugucaugguuuggaauguucauuaucgccaagaaccugguuagaggcauaaagaccuuuuuuca

SEQ ID NO: 138225 - RNA, 64 nt, Homo Sapiens
aaagucuuuuguauuggguccugcaagaagaaauccugguuaaaguguuuccaagucagcuuuc

SEQ ID NO: 138226 - RNA, 64 nt, Homo Sapiens
uuggaaaugcaggaacuuauuaaccugaaugugaccugguuaccgauuuuguuaccagcagugc

SEQ ID NO: 138227 - RNA, 64 nt, Homo Sapiens
uucucacgggcaguagcugucaacaucccauugcccugguuauaccacccccuucagugcccac

SEQ ID NO: 138228 - RNA, 64 nt, Homo Sapiens
gcacuuuggacaggucuugcuuuugccuacagccccugguuaggcccauuaucguggggcaucc

SEQ ID NO: 138229 - RNA, 64 nt, Homo Sapiens
guaacguggagaucuuuguagccugagcaagucaccugguuauuagaaauuagcuuugauggaa

SEQ ID NO: 138230 - RNA, 64 nt, Homo Sapiens
aacaaaaaaggaaaaauguaagagacuuccauguccugguuauuaaauuuuaaaaguucuucca

SEQ ID NO: 138231 - RNA, 64 nt, Homo Sapiens
auuuauagcaggaucuugcuugccucauuuguuuccugguuauguucuuaggauucugacuaag

SEQ ID NO: 138232 - RNA, 64 nt, Homo Sapiens
aaaggacacgugggggugccuagaggacgggcuuccugguuaggugggacccaugcccccuccu

SEQ ID NO: 138233 - RNA, 64 nt, Homo Sapiens
uuguggacagucacaacaauucuuugauauuuaaccugguuaauuggggaguauucccaaugua

SEQ ID NO: 138234 - RNA, 64 nt, Homo Sapiens
cccagaaacaucucuucucaggaaaggaucuuccccugguuacuuagcaagaccacaguguaga

SEQ ID NO: 138235 - RNA, 64 nt, Homo Sapiens
guuguuuacagacuaacaaauguguuggcaaaucccugguuagaugcacuuccugguguugaga

SEQ ID NO: 138236 - RNA, 64 nt, Homo Sapiens
gaguuaaaaaauaaaaaagugcauucugugauccccugguuacuaauuugacucacaguuugaa

SEQ ID NO: 138237 - RNA, 64 nt, Homo Sapiens
gauguggcccuggcugccggguggucggugggacccugguuauuggcugucggugggaccuacg

SEQ ID NO: 138238 - RNA, 64 nt, Homo Sapiens
cuggcccugagacucugugagggggcuggagcagccugguuauuuccuaucuguaccaaagagg

SEQ ID NO: 138239 - RNA, 64 nt, Homo Sapiens
auguccaaagcauugacuguugugucauuagcugccugguuacauuagcucccuggcuucuugu

SEQ ID NO: 138240 - RNA, 64 nt, Homo Sapiens
ugucgugggccaaccucguucugccuccagcuuuccugguuagcgcaacgcggcuccacgacca

SEQ ID NO: 138241 - RNA, 64 nt, Homo Sapiens
uacaguguauguauaaagcagaaugccugccuuuccugguuauuuuuuguaccauauuguaaau

SEQ ID NO: 138242 - RNA, 64 nt, Homo Sapiens
ucccugcccuggcccucuuucuucugucacuaacccugguuaucauuuuacaggcuuguaacug

SEQ ID NO: 138243 - RNA, 64 nt, Homo Sapiens
aauaauaaauccagauuuccggauaagaauauugccugguuaaaauucugcauugcuuaaagac

SEQ ID NO: 138244 - RNA, 64 nt, Homo Sapiens
uuuuuacaggggugccccucccaacaguucccuuccugguuaauuaaacccucagacuggugcu

SEQ ID NO: 138245 - RNA, 64 nt, Homo Sapiens
cagugcaccuguagggaaccaacuagacuucucuccugguuaguccagcucuuuacucuaaacc

SEQ ID NO: 138246 - RNA, 64 nt, Homo Sapiens
ucucuuguuuccgaggugcugcuuuugcaggugaccugguuacuuagcuaggauuggugauuug

SEQ ID NO: 138247 - RNA, 64 nt, Homo Sapiens
cuuggggcagagaguaucuagaccuuaaaagggaccugguuagucccaggcugcuguucucagg

SEQ ID NO: 138248 - RNA, 64 nt, Homo Sapiens
gaaaaugggaagguauaggaaacugcgaucacguccugguuaugaccgccucaacacaguucuc

SEQ ID NO: 138249 - RNA, 64 nt, Homo Sapiens
aaagaccuauaugaugcgguuuggauucaaguauccugguuagcaagaccacucccaccucagg

SEQ ID NO: 138250 - RNA, 64 nt, Homo Sapiens
ucuucagcagggacauuacaaucaaacaccaauuccugguuaaugaagggagagugugggcuua

SEQ ID NO: 138251 - RNA, 64 nt, Homo Sapiens
cuaauguggugaaucacugaaagucucagaaagaccugguuaguguauguucucauuuaccaca

SEQ ID NO: 138252 - RNA, 64 nt, Homo Sapiens
aagggcacuauauuuuugggaggagccauagauuccugguuauccuauuuuuaaacaaaaugua

SEQ ID NO: 138253 - RNA, 64 nt, Homo Sapiens
aguuuuuacaacagauuugcagcucauuccuuacccugguuaggucacuacuuuugcagauuuu

SEQ ID NO: 138254 - RNA, 64 nt, Homo Sapiens
caggaagcugcuguuccggccgcugagauuguugccugguuaccgcgcagcccugacucccagg

SEQ ID NO: 138255 - RNA, 64 nt, Homo Sapiens
agagcuggaccaguggugccgaugccaucuguguccugguuagcaggcaagaaagagauaccaa

SEQ ID NO: 138256 - RNA, 64 nt, Homo Sapiens
ggcugguuuuuucucuuuucuuucuagcgcauggccugguuagauucuuuuuuauacucaauca

SEQ ID NO: 138257 - RNA, 64 nt, Homo Sapiens
uccucaccaagcuucccacgcuuaaaccacaggaccugguuaacgaaucccgggugcuccacug

SEQ ID NO: 138258 - RNA, 64 nt, Homo Sapiens
cagcuucucuugucuucuucugguuauaguuacuccugguuaugaagccaaauuguguuugcuu

SEQ ID NO: 138259 - RNA, 64 nt, Homo Sapiens
gaagcugagcgccuguggccguauugauguugaaccugguuaggucagcuccagggaaauggag

SEQ ID NO: 138260 - RNA, 64 nt, Homo Sapiens
cccuugucugacugcuugguucuggcugggagcuccugguuaccccucccugcccccauguuuu

SEQ ID NO: 138261 - RNA, 64 nt, Homo Sapiens
uuuuggauuaaaccuguuucgggacggggggucuccugguuacaccucaggcgugugcggggcg

SEQ ID NO: 138262 - RNA, 64 nt, Homo Sapiens
ccaaauugaaaguaaauauuccagaaguugauagccugguuaaaaguuagauccucuauuacca

SEQ ID NO: 138263 - RNA, 64 nt, Homo Sapiens
caguugcuauaauucuagacucuaaaucuucucuccugguuacagugaccauuugaacauuggu

SEQ ID NO: 138264 - RNA, 64 nt, Homo Sapiens
cuuaucagcuacauccucuguaacgugguucaucccugguuaaaaagcaaacaaacacaggcug

SEQ ID NO: 138265 - RNA, 64 nt, Homo Sapiens
aguuucaaaauauugugguuuaguaaaguugauaccugguuauaaauauuaugccuuuauuuuu

SEQ ID NO: 138266 - RNA, 64 nt, Homo Sapiens
agggguuguguagguuguucacugcaggaaguccccugguuaagaaggcaagugggguuuaaac

SEQ ID NO: 138267 - RNA, 64 nt, Homo Sapiens
gugugggacauaucuggcaagauuuuguggcacuccugguuacagauacuggggcagcaaauaa

SEQ ID NO: 138268 - RNA, 64 nt, Homo Sapiens
cacugagggcucuggacgggguggucccuccagcccugguuagguccagcugaggcccacccag

SEQ ID NO: 138269 - RNA, 64 nt, Homo Sapiens
uggauaccugcccugacaugcuccuccccugcagccugguuaggccccauucccggcuucccuc

SEQ ID NO: 138270 - RNA, 64 nt, Homo Sapiens
uuuuuauuuuuauuuuuugucaugcaccaccacaccugguuaauggaguagcugggacuacaga

SEQ ID NO: 138271 - RNA, 64 nt, Homo Sapiens
auggugaaacccugucuguagaguuugagaccaaccugguuaacgguggaucacuugaggccag

SEQ ID NO: 138272 - RNA, 64 nt, Homo Sapiens
ggauuuauuuauuuauuuuggccaccgcacccagccugguuauuugcugggauuacaggcauga

SEQ ID NO: 138273 - RNA, 64 nt, Homo Sapiens
gugaggcuggcgauuacauagaacaccuaccuccccugguuauucacuguguccgccaugguca

SEQ ID NO: 138274 - RNA, 64 nt, Homo Sapiens
gauuuguauaaaauguacucaaacaugaaagaagccugguuacuaguuacguucauuucagguu

SEQ ID NO: 138275 - RNA, 64 nt, Homo Sapiens
uuccauuauugcuuauuaguagguaugaaauugcccugguuacauuuuaauuaugcuccuuggc

SEQ ID NO: 138276 - RNA, 64 nt, Homo Sapiens
cugugugucuccuacauuaaggcauugagacuguccugguuaggucaucacacaaccauuccug

SEQ ID NO: 138277 - RNA, 64 nt, Homo Sapiens
acacccaggguuacugaggacuuaugcugccugaccugguuagauguacauggagguaucuccc

SEQ ID NO: 138278 - RNA, 64 nt, Homo Sapiens
cacuaugcauauuugaaauaggagaauccuuauuccugguuaaucucuuaacaggcagaacaug

SEQ ID NO: 138279 - RNA, 64 nt, Homo Sapiens
aaaaccaaugagcauuacuuuaaacacuagacauccugguuaucagcaagaguuugaaauaugu

SEQ ID NO: 138280 - RNA, 64 nt, Homo Sapiens
ccauccugggcccccacucuagacccccccaccaccugguuaagucucgagugaauccaguggc

SEQ ID NO: 138281 - RNA, 64 nt, Homo Sapiens
ggggcgucccagcuguguuuuuugaugucuccucccugguuaagaguagcuuggagaggacccu

SEQ ID NO: 138282 - RNA, 64 nt, Homo Sapiens
gggcuggcuagccagaggaguuggcuguaucaccccugguuauuuuagggcaacaacccaguug

SEQ ID NO: 138283 - RNA, 64 nt, Homo Sapiens
ggacagugcuagugggaaaauaauuuucaaacuaccugguuaaccaaaauacaaaagcagcuga

SEQ ID NO: 138284 - RNA, 64 nt, Homo Sapiens
uuuuuuaagucaucugggggugaauucaugguauccugguuauuacauguuuacuacuuaaaca

SEQ ID NO: 138285 - RNA, 64 nt, Homo Sapiens
uuucuaccuacuccgaguguaaggggccguucagccugguuaguggacagcucaccaaccccug

SEQ ID NO: 138286 - RNA, 64 nt, Homo Sapiens; identical to SEQ ID NO: 44260

SEQ ID NO: 138287 - RNA, 64 nt, Homo Sapiens; identical to SEQ ID NO: 44261

SEQ ID NO: 138288 - RNA, 64 nt, Homo Sapiens; identical to SEQ ID NO: 44262

SEQ ID NO: 138289 - RNA, 64 nt, Homo Sapiens; identical to SEQ ID NO: 44263

SEQ ID NO: 138290 - RNA, 64 nt, Homo Sapiens; identical to SEQ ID NO: 44264

SEQ ID NO: 138291 - RNA, 64 nt, Homo Sapiens; identical to SEQ ID NO: 44265

SEQ ID NO: 138292 - RNA, 64 nt, Homo Sapiens; identical to SEQ ID NO: 44266

SEQ ID NO: 138293 - RNA, 64 nt, Homo Sapiens; identical to SEQ ID NO: 44267

SEQ ID NO: 138294 - RNA, 64 nt, Homo Sapiens; identical to SEQ ID NO: 44268

SEQ ID NO: 138295 - RNA, 64 nt, Homo Sapiens; identical to SEQ ID NO: 44269

SEQ ID NO: 138296 - RNA, 64 nt, Homo Sapiens; identical to SEQ ID NO: 44270

SEQ ID NO: 138297 - RNA, 64 nt, Homo Sapiens; identical to SEQ ID NO: 44271

SEQ ID NO: 138298 - RNA, 64 nt, Homo Sapiens; identical to SEQ ID NO: 44272

SEQ ID NO: 138299 - RNA, 64 nt, Homo Sapiens; identical to SEQ ID NO: 44273

SEQ ID NO: 138300 - RNA, 64 nt, Homo Sapiens; identical to SEQ ID NO: 44274

SEQ ID NO: 138301 - RNA, 64 nt, Homo Sapiens; identical to SEQ ID NO: 44275

SEQ ID NO: 138302 - RNA, 64 nt, Homo Sapiens; identical to SEQ ID NO: 44276

SEQ ID NO: 138303 - RNA, 64 nt, Homo Sapiens; identical to SEQ ID NO: 44277

SEQ ID NO: 138304 - RNA, 60 nt, Homo Sapiens; identical to SEQ ID NO: 44278

SEQ ID NO: 138305 - RNA, 64 nt, Homo Sapiens; identical to SEQ ID NO: 44279

SEQ ID NO: 138306 - RNA, 64 nt, Homo Sapiens; identical to SEQ ID NO: 44280

SEQ ID NO: 138307 - RNA, 64 nt, Homo Sapiens; identical to SEQ ID NO: 44281

SEQ ID NO: 138308 - RNA, 64 nt, Homo Sapiens; identical to SEQ ID NO: 44282

SEQ ID NO: 138309 - RNA, 64 nt, Homo Sapiens; identical to SEQ ID NO: 44283

SEQ ID NO: 138310 - RNA, 64 nt, Homo Sapiens; identical to SEQ ID NO: 44284

SEQ ID NO: 138311 - RNA, 64 nt, Homo Sapiens; identical to SEQ ID NO: 44285

SEQ ID NO: 138312 - RNA, 64 nt, Homo Sapiens; identical to SEQ ID NO: 44286

SEQ ID NO: 138313 - RNA, 64 nt, Homo Sapiens; identical to SEQ ID NO: 44287

SEQ ID NO: 138314 - RNA, 64 nt, Homo Sapiens; identical to SEQ ID NO: 44288

SEQ ID NO: 138315 - RNA, 64 nt, Homo Sapiens; identical to SEQ ID NO: 44289

SEQ ID NO: 138316 - RNA, 64 nt, Homo Sapiens; identical to SEQ ID NO: 44290

SEQ ID NO: 138317 - RNA, 64 nt, Homo Sapiens; identical to SEQ ID NO: 44291

SEQ ID NO: 138318 - RNA, 64 nt, Homo Sapiens; identical to SEQ ID NO: 44292

SEQ ID NO: 138319 - RNA, 64 nt, Homo Sapiens; identical to SEQ ID NO: 44293

SEQ ID NO: 138320 - RNA, 64 nt, Homo Sapiens; identical to SEQ ID NO: 44294

SEQ ID NO: 138321 - RNA, 64 nt, Homo Sapiens; identical to SEQ ID NO: 44295

SEQ ID NO: 138322 - RNA, 64 nt, Homo Sapiens; identical to SEQ ID NO: 44296

SEQ ID NO: 138323 - RNA, 64 nt, Homo Sapiens; identical to SEQ ID NO: 44297

SEQ ID NO: 138324 - RNA, 64 nt, Homo Sapiens; identical to SEQ ID NO: 44298

SEQ ID NO: 138325 - RNA, 64 nt, Homo Sapiens; identical to SEQ ID NO: 44299

SEQ ID NO: 138326 - RNA, 64 nt, Homo Sapiens; identical to SEQ ID NO: 44300

SEQ ID NO: 138327 - RNA, 64 nt, Homo Sapiens; identical to SEQ ID NO: 44301

SEQ ID NO: 138328 - RNA, 54 nt, Homo Sapiens; identical to SEQ ID NO: 44302

SEQ ID NO: 138329 - RNA, 64 nt, Homo Sapiens; identical to SEQ ID NO: 44303

SEQ ID NO: 138330 - RNA, 64 nt, Homo Sapiens; identical to SEQ ID NO: 44304

SEQ ID NO: 138331 - RNA, 64 nt, Homo Sapiens; identical to SEQ ID NO: 44305

SEQ ID NO: 138332 - RNA, 64 nt, Homo Sapiens; identical to SEQ ID NO: 44306

SEQ ID NO: 138333 - RNA, 64 nt, Homo Sapiens; identical to SEQ ID NO: 44307

SEQ ID NO: 138334 - RNA, 64 nt, Homo Sapiens; identical to SEQ ID NO: 44308

SEQ ID NO: 138335 - RNA, 64 nt, Homo Sapiens; identical to SEQ ID NO: 44309

SEQ ID NO: 138336 - RNA, 64 nt, Homo Sapiens; identical to SEQ ID NO: 44310

SEQ ID NO: 138337 - RNA, 64 nt, Homo Sapiens
uuugaaagaggagggacaaucagcgccuggcccaguguaauauugggauuacaggugugagcca

SEQ ID NO: 138338 - RNA, 64 nt, Homo Sapiens
ccacagguugguauauuuaggaauauauuaaaauguguaauauaucuuagugggcauuauggaa

SEQ ID NO: 138339 - RNA, 64 nt, Homo Sapiens
cuccguuuauuauaaacuguaugcucacaacuuaguguaauauaccagcuuguaugcaauggau

SEQ ID NO: 138340 - RNA, 64 nt, Homo Sapiens
caaaacucacaagugcucaucuguuguagauuuaguguaauaagacuuagauugugcuccuucg

SEQ ID NO: 138341 - RNA, 64 nt, Homo Sapiens
uaauagacauuuuuucuuauuggucagaauuauuguguaauaaacccccgccguugguuguugg

SEQ ID NO: 138342 - RNA, 64 nt, Homo Sapiens
uuugggaaagaauccucaaaccaucauaauacagguguaauaggaagaguuggaaaauuuguaa

SEQ ID NO: 138343 - RNA, 64 nt, Homo Sapiens
cuugugaacucgauagagcaaggaaaccagaaagguguaauauuuauagguugguaaaauagau

SEQ ID NO: 138344 - RNA, 64 nt, Homo Sapiens
ugaaucuauaauaaugguacuucuacuggggagaguguaauauuuuggacugcuguuuuccauu

SEQ ID NO: 138345 - RNA, 60 nt, Homo Sapiens
guauuauauuuggcuucuauuuuuauuauuuuggaucaccauucucccuaucccuucuug

SEQ ID NO: 138346 - RNA, 60 nt, Homo Sapiens
cagagacugcuacaaaauuguauauaguuuuuggaucaaauagcaugaggggagaggaaa

SEQ ID NO: 138347 - RNA, 60 nt, Homo Sapiens
aaauaaagguuacaguuuuguaacguacuguuggaucaacggggaugggguaaaaguggu

SEQ ID NO: 138348 - RNA, 60 nt, Homo Sapiens
uucuuuuucauagggguggaaccuggaacuuuggaucaauuugacuagagacccaagaaa

SEQ ID NO: 138349 - RNA, 60 nt, Homo Sapiens
gucuuuagaucuacacagaaaugacccuccuuggaucaguuuucuuuccagucuaaucau

SEQ ID NO: 138350 - RNA, 60 nt, Homo Sapiens
ugucacagguaucugccagcauucaagguuuuggaucauuucaugaggaucuuuccuuug

SEQ ID NO: 138351 - RNA, 60 nt, Homo Sapiens
uccaaagaaugaaaaccaguaauaaacauuuuggaucaccauggcuuuuuccuuugcuug

SEQ ID NO: 138352 - RNA, 60 nt, Homo Sapiens
auuuacacaagagauggcuuguagggugaauuggaucaccaaagugaaauucagucuuaa

SEQ ID NO: 138353 - RNA, 60 nt, Homo Sapiens
cuacucuuuugaaguguuuuagucuaguuauuggaucagugaaaaacauuaguauacguu

SEQ ID NO: 138354 - RNA, 60 nt, Homo Sapiens
auacguuuuuaaauaggcuaauuuuucaacuuggaucauuaggcuuacguacuacuuguu

SEQ ID NO: 138355 - RNA, 64 nt, Homo Sapiens; identical to SEQ ID NO: 58312

SEQ ID NO: 138356 - RNA, 64 nt, Homo Sapiens; identical to SEQ ID NO: 58313

SEQ ID NO: 138357 - RNA, 64 nt, Homo Sapiens; identical to SEQ ID NO: 58314

SEQ ID NO: 138358 - RNA, 64 nt, Homo Sapiens; identical to SEQ ID NO: 58315

SEQ ID NO: 138359 - RNA, 64 nt, Homo Sapiens; identical to SEQ ID NO: 58316

SEQ ID NO: 138360 - RNA, 64 nt, Homo Sapiens; identical to SEQ ID NO: 58317

SEQ ID NO: 138361 - RNA, 64 nt, Homo Sapiens; identical to SEQ ID NO: 58318

SEQ ID NO: 138362 - RNA, 64 nt, Homo Sapiens; identical to SEQ ID NO: 58319

SEQ ID NO: 138363 - RNA, 64 nt, Homo Sapiens; identical to SEQ ID NO: 58320

SEQ ID NO: 138364 - RNA, 64 nt, Homo Sapiens; identical to SEQ ID NO: 58321

SEQ ID NO: 138365 - RNA, 64 nt, Homo Sapiens; identical to SEQ ID NO: 58322

SEQ ID NO: 138366 - RNA, 64 nt, Homo Sapiens; identical to SEQ ID NO: 58323

SEQ ID NO: 138367 - RNA, 64 nt, Homo Sapiens; identical to SEQ ID NO: 58324

SEQ ID NO: 138368 - RNA, 64 nt, Homo Sapiens; identical to SEQ ID NO: 58325

SEQ ID NO: 138369 - RNA, 64 nt, Homo Sapiens; identical to SEQ ID NO: 58326

SEQ ID NO: 138370 - RNA, 64 nt, Homo Sapiens; identical to SEQ ID NO: 58327

SEQ ID NO: 138371 - RNA, 64 nt, Homo Sapiens; identical to SEQ ID NO: 58328

SEQ ID NO: 138372 - RNA, 64 nt, Homo Sapiens; identical to SEQ ID NO: 58329

SEQ ID NO: 138373 - RNA, 64 nt, Homo Sapiens; identical to SEQ ID NO: 58330

SEQ ID NO: 138374 - RNA, 64 nt, Homo Sapiens; identical to SEQ ID NO: 58331

SEQ ID NO: 138375 - RNA, 64 nt, Homo Sapiens; identical to SEQ ID NO: 58332

SEQ ID NO: 138376 - RNA, 64 nt, Homo Sapiens; identical to SEQ ID NO: 58333

SEQ ID NO: 138377 - RNA, 64 nt, Homo Sapiens; identical to SEQ ID NO: 58334

SEQ ID NO: 138378 - RNA, 64 nt, Homo Sapiens; identical to SEQ ID NO: 58335

SEQ ID NO: 138379 - RNA, 64 nt, Homo Sapiens; identical to SEQ ID NO: 58336

SEQ ID NO: 138380 - RNA, 64 nt, Homo Sapiens; identical to SEQ ID NO: 58337

SEQ ID NO: 138381 - RNA, 64 nt, Homo Sapiens; identical to SEQ ID NO: 58338

SEQ ID NO: 138382 - RNA, 64 nt, Homo Sapiens; identical to SEQ ID NO: 58339

SEQ ID NO: 138383 - RNA, 64 nt, Homo Sapiens; identical to SEQ ID NO: 58340

SEQ ID NO: 138384 - RNA, 64 nt, Homo Sapiens; identical to SEQ ID NO: 58341

SEQ ID NO: 138385 - RNA, 64 nt, Homo Sapiens; identical to SEQ ID NO: 58342

SEQ ID NO: 138386 - RNA, 64 nt, Homo Sapiens; identical to SEQ ID NO: 58343

SEQ ID NO: 138387 - RNA, 64 nt, Homo Sapiens; identical to SEQ ID NO: 58344

SEQ ID NO: 138388 - RNA, 64 nt, Homo Sapiens; identical to SEQ ID NO: 58345

SEQ ID NO: 138389 - RNA, 64 nt, Homo Sapiens; identical to SEQ ID NO: 58346

SEQ ID NO: 138390 - RNA, 64 nt, Homo Sapiens; identical to SEQ ID NO: 58347

SEQ ID NO: 138391 - RNA, 64 nt, Homo Sapiens; identical to SEQ ID NO: 58348

SEQ ID NO: 138392 - RNA, 64 nt, Homo Sapiens; identical to SEQ ID NO: 58349

SEQ ID NO: 138393 - RNA, 64 nt, Homo Sapiens; identical to SEQ ID NO: 58350

SEQ ID NO: 138394 - RNA, 64 nt, Homo Sapiens; identical to SEQ ID NO: 58351

SEQ ID NO: 138395 - RNA, 64 nt, Homo Sapiens; identical to SEQ ID NO: 58352

SEQ ID NO: 138396 - RNA, 64 nt, Homo Sapiens; identical to SEQ ID NO: 58353

SEQ ID NO: 138397 - RNA, 64 nt, Homo Sapiens; identical to SEQ ID NO: 58354

SEQ ID NO: 138398 - RNA, 64 nt, Homo Sapiens; identical to SEQ ID NO: 58355

SEQ ID NO: 138399 - RNA, 64 nt, Homo Sapiens; identical to SEQ ID NO: 58356

SEQ ID NO: 138400 - RNA, 64 nt, Homo Sapiens; identical to SEQ ID NO: 58357

SEQ ID NO: 138401 - RNA, 64 nt, Homo Sapiens; identical to SEQ ID NO: 58358

SEQ ID NO: 138402 - RNA, 64 nt, Homo Sapiens; identical to SEQ ID NO: 58359

SEQ ID NO: 138403 - RNA, 64 nt, Homo Sapiens; identical to SEQ ID NO: 58360

SEQ ID NO: 138404 - RNA, 64 nt, Homo Sapiens; identical to SEQ ID NO: 58361

SEQ ID NO: 138405 - RNA, 64 nt, Homo Sapiens; identical to SEQ ID NO: 58362

SEQ ID NO: 138406 - RNA, 64 nt, Homo Sapiens; identical to SEQ ID NO: 58363

SEQ ID NO: 138407 - RNA, 64 nt, Homo Sapiens; identical to SEQ ID NO: 58364

SEQ ID NO: 138408 - RNA, 64 nt, Homo Sapiens; identical to SEQ ID NO: 58365

SEQ ID NO: 138409 - RNA, 64 nt, Homo Sapiens; identical to SEQ ID NO: 58366

SEQ ID NO: 138410 - RNA, 64 nt, Homo Sapiens; identical to SEQ ID NO: 58367

SEQ ID NO: 138411 - RNA, 64 nt, Homo Sapiens; identical to SEQ ID NO: 58368

SEQ ID NO: 138412 - RNA, 64 nt, Homo Sapiens; identical to SEQ ID NO: 58369

SEQ ID NO: 138413 - RNA, 64 nt, Homo Sapiens; identical to SEQ ID NO: 58370

SEQ ID NO: 138414 - RNA, 64 nt, Homo Sapiens; identical to SEQ ID NO: 58371

SEQ ID NO: 138415 - RNA, 64 nt, Homo Sapiens; identical to SEQ ID NO: 58372

SEQ ID NO: 138416 - RNA, 64 nt, Homo Sapiens; identical to SEQ ID NO: 58373

SEQ ID NO: 138417 - RNA, 64 nt, Homo Sapiens; identical to SEQ ID NO: 58374

SEQ ID NO: 138418 - RNA, 64 nt, Homo Sapiens; identical to SEQ ID NO: 58375

SEQ ID NO: 138419 - RNA, 64 nt, Homo Sapiens; identical to SEQ ID NO: 58376

SEQ ID NO: 138420 - RNA, 64 nt, Homo Sapiens; identical to SEQ ID NO: 58377

SEQ ID NO: 138421 - RNA, 64 nt, Homo Sapiens; identical to SEQ ID NO: 58378

SEQ ID NO: 138422 - RNA, 64 nt, Homo Sapiens; identical to SEQ ID NO: 58379

SEQ ID NO: 138423 - RNA, 64 nt, Homo Sapiens; identical to SEQ ID NO: 58380

SEQ ID NO: 138424 - RNA, 64 nt, Homo Sapiens; identical to SEQ ID NO: 58381

SEQ ID NO: 138425 - RNA, 64 nt, Homo Sapiens; identical to SEQ ID NO: 58382

SEQ ID NO: 138426 - RNA, 64 nt, Homo Sapiens; identical to SEQ ID NO: 58383

SEQ ID NO: 138427 - RNA, 64 nt, Homo Sapiens; identical to SEQ ID NO: 58384

SEQ ID NO: 138428 - RNA, 64 nt, Homo Sapiens; identical to SEQ ID NO: 58385

SEQ ID NO: 138429 - RNA, 64 nt, Homo Sapiens; identical to SEQ ID NO: 58386

SEQ ID NO: 138430 - RNA, 64 nt, Homo Sapiens; identical to SEQ ID NO: 58387

SEQ ID NO: 138431 - RNA, 64 nt, Homo Sapiens; identical to SEQ ID NO: 58388

SEQ ID NO: 138432 - RNA, 64 nt, Homo Sapiens; identical to SEQ ID NO: 58389

SEQ ID NO: 138433 - RNA, 64 nt, Homo Sapiens; identical to SEQ ID NO: 58390

SEQ ID NO: 138434 - RNA, 64 nt, Homo Sapiens; identical to SEQ ID NO: 58391

SEQ ID NO: 138435 - RNA, 64 nt, Homo Sapiens; identical to SEQ ID NO: 58392

SEQ ID NO: 138436 - RNA, 64 nt, Homo Sapiens; identical to SEQ ID NO: 58393

SEQ ID NO: 138437 - RNA, 64 nt, Homo Sapiens; identical to SEQ ID NO: 58394

SEQ ID NO: 138438 - RNA, 64 nt, Homo Sapiens; identical to SEQ ID NO: 58395

SEQ ID NO: 138439 - RNA, 64 nt, Homo Sapiens; identical to SEQ ID NO: 58396

SEQ ID NO: 138440 - RNA, 64 nt, Homo Sapiens; identical to SEQ ID NO: 58397

SEQ ID NO: 138441 - RNA, 64 nt, Homo Sapiens; identical to SEQ ID NO: 58398

SEQ ID NO: 138442 - RNA, 64 nt, Homo Sapiens; identical to SEQ ID NO: 58399

SEQ ID NO: 138443 - RNA, 64 nt, Homo Sapiens; identical to SEQ ID NO: 58400

SEQ ID NO: 138444 - RNA, 64 nt, Homo Sapiens; identical to SEQ ID NO: 58401

SEQ ID NO: 138445 - RNA, 64 nt, Homo Sapiens; identical to SEQ ID NO: 58402

SEQ ID NO: 138446 - RNA, 64 nt, Homo Sapiens; identical to SEQ ID NO: 58403

SEQ ID NO: 138447 - RNA, 64 nt, Homo Sapiens; identical to SEQ ID NO: 58404

SEQ ID NO: 138448 - RNA, 64 nt, Homo Sapiens; identical to SEQ ID NO: 58405

SEQ ID NO: 138449 - RNA, 64 nt, Homo Sapiens; identical to SEQ ID NO: 58406

SEQ ID NO: 138450 - RNA, 64 nt, Homo Sapiens; identical to SEQ ID NO: 58407

SEQ ID NO: 138451 - RNA, 64 nt, Homo Sapiens; identical to SEQ ID NO: 58408

SEQ ID NO: 138452 - RNA, 64 nt, Homo Sapiens; identical to SEQ ID NO: 58409

SEQ ID NO: 138453 - RNA, 64 nt, Homo Sapiens; identical to SEQ ID NO: 58410

SEQ ID NO: 138454 - RNA, 64 nt, Homo Sapiens; identical to SEQ ID NO: 58411

SEQ ID NO: 138455 - RNA, 64 nt, Homo Sapiens; identical to SEQ ID NO: 58412

SEQ ID NO: 138456 - RNA, 64 nt, Homo Sapiens; identical to SEQ ID NO: 58413

SEQ ID NO: 138457 - RNA, 64 nt, Homo Sapiens; identical to SEQ ID NO: 58414

SEQ ID NO: 138458 - RNA, 64 nt, Homo Sapiens; identical to SEQ ID NO: 58415

SEQ ID NO: 138459 - RNA, 64 nt, Homo Sapiens; identical to SEQ ID NO: 58416

SEQ ID NO: 138460 - RNA, 64 nt, Homo Sapiens; identical to SEQ ID NO: 58417

SEQ ID NO: 138461 - RNA, 64 nt, Homo Sapiens; identical to SEQ ID NO: 58418

SEQ ID NO: 138462 - RNA, 64 nt, Homo Sapiens; identical to SEQ ID NO: 58419

SEQ ID NO: 138463 - RNA, 64 nt, Homo Sapiens; identical to SEQ ID NO: 58420

SEQ ID NO: 138464 - RNA, 64 nt, Homo Sapiens; identical to SEQ ID NO: 58421

SEQ ID NO: 138465 - RNA, 64 nt, Homo Sapiens; identical to SEQ ID NO: 58422

SEQ ID NO: 138466 - RNA, 64 nt, Homo Sapiens; identical to SEQ ID NO: 58423

SEQ ID NO: 138467 - RNA, 64 nt, Homo Sapiens; identical to SEQ ID NO: 58424

SEQ ID NO: 138468 - RNA, 64 nt, Homo Sapiens; identical to SEQ ID NO: 58425

SEQ ID NO: 138469 - RNA, 64 nt, Homo Sapiens; identical to SEQ ID NO: 58426

SEQ ID NO: 138470 - RNA, 64 nt, Homo Sapiens; identical to SEQ ID NO: 58427

SEQ ID NO: 138471 - RNA, 64 nt, Homo Sapiens; identical to SEQ ID NO: 58428

SEQ ID NO: 138472 - RNA, 64 nt, Homo Sapiens; identical to SEQ ID NO: 58429

SEQ ID NO: 138473 - RNA, 64 nt, Homo Sapiens; identical to SEQ ID NO: 58430

SEQ ID NO: 138474 - RNA, 64 nt, Homo Sapiens; identical to SEQ ID NO: 58431

SEQ ID NO: 138475 - RNA, 64 nt, Homo Sapiens; identical to SEQ ID NO: 58432

SEQ ID NO: 138476 - RNA, 64 nt, Homo Sapiens; identical to SEQ ID NO: 58433

SEQ ID NO: 138477 - RNA, 64 nt, Homo Sapiens; identical to SEQ ID NO: 58434

SEQ ID NO: 138478 - RNA, 64 nt, Homo Sapiens; identical to SEQ ID NO: 58435

SEQ ID NO: 138479 - RNA, 50 nt, Homo Sapiens; identical to SEQ ID NO: 58436

SEQ ID NO: 138480 - RNA, 64 nt, Homo Sapiens; identical to SEQ ID NO: 58437

SEQ ID NO: 138481 - RNA, 64 nt, Homo Sapiens; identical to SEQ ID NO: 58438

SEQ ID NO: 138482 - RNA, 64 nt, Homo Sapiens; identical to SEQ ID NO: 58439

SEQ ID NO: 138483 - RNA, 64 nt, Homo Sapiens; identical to SEQ ID NO: 58440

SEQ ID NO: 138484 - RNA, 64 nt, Homo Sapiens; identical to SEQ ID NO: 58441

SEQ ID NO: 138485 - RNA, 64 nt, Homo Sapiens; identical to SEQ ID NO: 58442

SEQ ID NO: 138486 - RNA, 64 nt, Homo Sapiens; identical to SEQ ID NO: 58443

SEQ ID NO: 138487 - RNA, 64 nt, Homo Sapiens; identical to SEQ ID NO: 58444

SEQ ID NO: 138488 - RNA, 64 nt, Homo Sapiens; identical to SEQ ID NO: 58445

SEQ ID NO: 138489 - RNA, 64 nt, Homo Sapiens; identical to SEQ ID NO: 58446

SEQ ID NO: 138490 - RNA, 64 nt, Homo Sapiens; identical to SEQ ID NO: 58447

SEQ ID NO: 138491 - RNA, 64 nt, Homo Sapiens; identical to SEQ ID NO: 58448

SEQ ID NO: 138492 - RNA, 64 nt, Homo Sapiens; identical to SEQ ID NO: 58449

SEQ ID NO: 138493 - RNA, 64 nt, Homo Sapiens; identical to SEQ ID NO: 58450

SEQ ID NO: 138494 - RNA, 64 nt, Homo Sapiens; identical to SEQ ID NO: 58451

SEQ ID NO: 138495 - RNA, 64 nt, Homo Sapiens; identical to SEQ ID NO: 58452

SEQ ID NO: 138496 - RNA, 64 nt, Homo Sapiens; identical to SEQ ID NO: 58453

SEQ ID NO: 138497 - RNA, 64 nt, Homo Sapiens; identical to SEQ ID NO: 58454

SEQ ID NO: 138498 - RNA, 64 nt, Homo Sapiens; identical to SEQ ID NO: 58455

SEQ ID NO: 138499 - RNA, 64 nt, Homo Sapiens; identical to SEQ ID NO: 58456

SEQ ID NO: 138500 - RNA, 64 nt, Homo Sapiens; identical to SEQ ID NO: 58457

SEQ ID NO: 138501 - RNA, 64 nt, Homo Sapiens; identical to SEQ ID NO: 58458

SEQ ID NO: 138502 - RNA, 64 nt, Homo Sapiens; identical to SEQ ID NO: 58459

SEQ ID NO: 138503 - RNA, 64 nt, Homo Sapiens; identical to SEQ ID NO: 58460

SEQ ID NO: 138504 - RNA, 64 nt, Homo Sapiens; identical to SEQ ID NO: 58461

SEQ ID NO: 138505 - RNA, 64 nt, Homo Sapiens; identical to SEQ ID NO: 58462

SEQ ID NO: 138506 - RNA, 64 nt, Homo Sapiens; identical to SEQ ID NO: 58463

SEQ ID NO: 138507 - RNA, 64 nt, Homo Sapiens; identical to SEQ ID NO: 58464

SEQ ID NO: 138508 - RNA, 64 nt, Homo Sapiens; identical to SEQ ID NO: 58465

SEQ ID NO: 138509 - RNA, 64 nt, Homo Sapiens; identical to SEQ ID NO: 58466

SEQ ID NO: 138510 - RNA, 64 nt, Homo Sapiens; identical to SEQ ID NO: 58467

SEQ ID NO: 138511 - RNA, 64 nt, Homo Sapiens
aaagacaacaggcaguaguggcuccucccagcccugggcccaagaggaggcggcugcgggucgu

SEQ ID NO: 138512 - RNA, 64 nt, Homo Sapiens
ggauugucaccccaagucuuccagcugguggaucugggcccagcaaagacuguucuccucccga

SEQ ID NO: 138513 - RNA, 64 nt, Homo Sapiens
uauagcccucacacucuuggccuugauuuuccucugggcccaaauagcagcuggauaugggguu

SEQ ID NO: 138514 - RNA, 64 nt, Homo Sapiens
ggcuuuagcagcuggauaugagugguacacuccuugggcccaagcccaagagagccuuggauuc

SEQ ID NO: 138515 - RNA, 64 nt, Homo Sapiens
uucuuugucucucuucaaccugacuuugucucccugggcccagaacauucucccugggcccaaa

SEQ ID NO: 138516 - RNA, 64 nt, Homo Sapiens
ugacuuugucucccugggccauccacauucucccugggcccaaaccaccuauugguuccccaaa

SEQ ID NO: 138517 - RNA, 64 nt, Homo Sapiens
cagcccugcugcucagagugaagggcugaggcccugggcccaguugugaggaguguacaccugc

SEQ ID NO: 138518 - RNA, 64 nt, Homo Sapiens
cagcccugcugcacauggcacaaggcugaaucccugggcccaguaugaaugggccuacaccugc

SEQ ID NO: 138519 - RNA, 64 nt, Homo Sapiens
auuuccacaucuuggugaaggacugacuguggggugggcccaggccaggaagaaauggagcgau

SEQ ID NO: 138520 - RNA, 64 nt, Homo Sapiens
ugcuucugggggguuggggaacuggccuggagccugggcccacccgucugaucuugaugggggc

SEQ ID NO: 138521 - RNA, 64 nt, Homo Sapiens
caccuguguuccucaaucacacugaagccacagcugggcccaccgaggugcuauccugcccagg

SEQ ID NO: 138522 - RNA, 64 nt, Homo Sapiens
ugcauggugacagucucccccaaacauggccugcugggcccaagugaggagugccagcucaagu

SEQ ID NO: 138523 - RNA, 64 nt, Homo Sapiens
uccccgcgaguuccugugguggggaaucuguguaugggcccaguaugugaauaacccuuccuac

SEQ ID NO: 138524 - RNA, 58 nt, Homo Sapiens
aggcaagccugggccuucuguggaguuaugggcccacccagggacagaaaggggauag

SEQ ID NO: 138525 - RNA, 64 nt, Homo Sapiens
agugccucuggagcccaggcaugccaagggguaaugggcccagcccuguguuccagaggaccug

SEQ ID NO: 138526 - RNA, 64 nt, Homo Sapiens
uccuuguaucaugccacgguaggagcuguccuggugggcccaggcugacuaugcuuucucuccu

SEQ ID NO: 138527 - RNA, 64 nt, Homo Sapiens
caggggcccugaccccaggccacacagacggacaugggcccacaugggagggugagcaggagca

SEQ ID NO: 138528 - RNA, 64 nt, Homo Sapiens
uuaugucagggaaaccuaaacugaggucagcacuugggcccacugacagugacugacuggggga

SEQ ID NO: 138529 - RNA, 64 nt, Homo Sapiens
ucaugccucgcgguggccuccacgcuggccccucugggcccagccaccagcccggcuccugccu

SEQ ID NO: 138530 - RNA, 64 nt, Homo Sapiens
ucccgucuccaaacagccuccgcgucugcgcccgugggcccagcuccgggcccagcucuuugcu

SEQ ID NO: 138531 - RNA, 64 nt, Homo Sapiens
gacaccagccaggcucuguggccccagcccccuuugggcccagggcccgucucucucccaugga

SEQ ID NO: 138532 - RNA, 64 nt, Homo Sapiens
ccugucuguagagggcccugcugcacagggcagcugggcccaacagcccgccugccaguccuag

SEQ ID NO: 138533 - RNA, 64 nt, Homo Sapiens
ugggcccugcuucucugcuccccugggugaugggugggcccagaagguggcagucccacaccuu

SEQ ID NO: 138534 - RNA, 64 nt, Homo Sapiens
acagccucccaagcccaggcuuuggcacucagaaugggcccagugggggcugggcaggcccauu

SEQ ID NO: 138535 - RNA, 64 nt, Homo Sapiens
gaaggucggccugggaugugucauagggaauggcugggcccacgaccaggacugcccucggugc

SEQ ID NO: 138536 - RNA, 64 nt, Homo Sapiens
cauccaguuuuccucuuuuaccucucaaugggcaugggcccaaccgcuguucuacagaaccuac

SEQ ID NO: 138537 - RNA, 64 nt, Homo Sapiens
gaauucagaagagcuugcagcuuugcaagagagaugggcccaaggcacccgggcguccugagca

SEQ ID NO: 138538 - RNA, 64 nt, Homo Sapiens
ggggcucccuucugugcagaccgccagggaggucugggcccagcacuggccugaccugcagugg

SEQ ID NO: 138539 - RNA, 64 nt, Homo Sapiens
cuuccagcccagaguccucaaguccagggcaccuugggcccagcgcaggcagaauccgaggugg

SEQ ID NO: 138540 - RNA, 64 nt, Homo Sapiens
ggcaggggcuccccgccgccgaggcugccugcccugggcccaccucugcaugcugcucaugggg

SEQ ID NO: 138541 - RNA, 64 nt, Homo Sapiens
uugcgucucccugugaugggcccuuaggccuggcugggcccauuacauaucccugugguggcuc

SEQ ID NO: 138542 - RNA, 64 nt, Homo Sapiens
aaaucucacagccuucucaugcugccggcucaucugggcccauagagugggcuuugccaguugc

SEQ ID NO: 138543 - RNA, 64 nt, Homo Sapiens
ggccaaccagcaaaauccugauaacaagacucugugggcccaacucuccugaauuaaaggagcc

SEQ ID NO: 138544 - RNA, 64 nt, Homo Sapiens
ucucucagcugucaauggcuuggagaacaucucaugggcccaagucaucaaauaaccuguuccu

SEQ ID NO: 138545 - RNA, 64 nt, Homo Sapiens
gggaagggggaagcugagaaugccuggagaccagugggcccagggugggucuuggggcuggguc

SEQ ID NO: 138546 - RNA, 64 nt, Homo Sapiens
aggccucgcgcagccuagcucugagucggcgccgugggcccagcguggccccuaccagccugac

SEQ ID NO: 138547 - RNA, 64 nt, Homo Sapiens
acagaugccccagagcuguuacugagggaccaacugggcccaagucccuggcucccaugaccau

SEQ ID NO: 138548 - RNA, 64 nt, Homo Sapiens
ucuggucccuugcagcuagugcccaucacaggguugggcccagacaugcagcccaugcccaccu

SEQ ID NO: 138549 - RNA, 64 nt, Homo Sapiens
cucucccuagacucuccuaggguucaggagcugcugggcccagaggugacauuugacuuuuuuc

SEQ ID NO: 138550 - RNA, 64 nt, Homo Sapiens
ggacagggaguuguaacagagcagugccagagcaugggcccaggucccaggggagagguugggg

SEQ ID NO: 138551 - RNA, 64 nt, Homo Sapiens
ggcuggccagaguucaggaaaggggaccccagacugggcccagacagucaaagccagaacugag

SEQ ID NO: 138552 - RNA, 64 nt, Homo Sapiens
guguggcgguccccauggugcccuugaaguggagugggcccagauggagcccaaggggccacug

SEQ ID NO: 138553 - RNA, 64 nt, Homo Sapiens
accucucagcccucccaggaaacacacagagcucugggcccaucccagcccuggccuguggccu

SEQ ID NO: 138554 - RNA, 64 nt, Homo Sapiens
gcuguucugcccucauacccuuaaagggccagccugggcccaguggacacagguaaggcaccau

SEQ ID NO: 138555 - RNA, 64 nt, Homo Sapiens
cugugaacuucccuacccuacccccacaacacaagcaccccagaccucaccuccaucccccucu

SEQ ID NO: 138556 - RNA, 64 nt, Homo Sapiens
uaguuuuuucaucuguaaaacagggauaauaacagcaccccauagaguugugacgaggauugag

SEQ ID NO: 138557 - RNA, 64 nt, Homo Sapiens
ugggcugcuagacuaccccuacccaugcaggcaugcaccccagacaguuguaugcacaaaggag

SEQ ID NO: 138558 - RNA, 64 nt, Homo Sapiens
ccugcccuuucuccccugcaucuucacaguucaagcaccccaaaacccuuggcuguauuuccca

SEQ ID NO: 138559 - RNA, 64 nt, Homo Sapiens
uuaguggggcaggggcagggcggcugcucacagagcaccccaguuccucaccagcuacucuggc

SEQ ID NO: 138560 - RNA, 64 nt, Homo Sapiens
uguguugagaccauugacaacugcucguguacaggcaccccacagccccagagcauggggcaca

SEQ ID NO: 138561 - RNA, 64 nt, Homo Sapiens
ggcagagguugcagugagccgagauugcgccacugcaccccagccuggacaacagagugagacu

SEQ ID NO: 138562 - RNA, 64 nt, Homo Sapiens
aguguacacucccccggugacagggugcucacuggcaccccaucuuccugugaauaacucaaau

SEQ ID NO: 138563 - RNA, 64 nt, Homo Sapiens
gguccaacucuugcuguccuuucuuaccaccugugcaccccacuuggagcagugggaggaaauc

SEQ ID NO: 138564 - RNA, 64 nt, Homo Sapiens
aguuguugggguaaaucccacauggcagaguaaggcaccccacagaaauuaacuuggagagccu

SEQ ID NO: 138565 - RNA, 64 nt, Homo Sapiens
auugagauguguuuuuaauggcaaaguuacagaugcaccccaacacuccccugaccucaccuuu

SEQ ID NO: 138566 - RNA, 64 nt, Homo Sapiens
aguagugcccacuugaggcugggcagacaccugugcaccccauggugauucaggggcuccccgg

SEQ ID NO: 138567 - RNA, 64 nt, Homo Sapiens
ccccacuccucggcaguuucaacuggucccacacgcaccccaggcguggcuucuccagccauug

SEQ ID NO: 138568 - RNA, 64 nt, Homo Sapiens
ugcaccugaauccucuaacucccagcuccagccagcaccccaucuuccacagugcugcuaauau

SEQ ID NO: 138569 - RNA, 64 nt, Homo Sapiens
cauggcagggacaaugccggcagccugagcccaggcaccccagugcccgcugggcccagccugg

SEQ ID NO: 138570 - RNA, 64 nt, Homo Sapiens
cagcacagccccgcccguggagggucccuuuuacgcaccccaaggcccacaccuaagcuuccau

SEQ ID NO: 138571 - RNA, 64 nt, Homo Sapiens
ucagaccucggugggcauucugaugaacaaaucugcaccccacuugacccgaguaacuuucugc

SEQ ID NO: 138572 - RNA, 64 nt, Homo Sapiens
cagccacuccuagccuuggcaccaucccagcacugcaccccaggccuugacacuccccuugcaa

SEQ ID NO: 138573 - RNA, 55 nt, Homo Sapiens
agugcgauggggccacguagggugggcaccccaugggacucaguggcucacauuu

SEQ ID NO: 138574 - RNA, 64 nt, Homo Sapiens
cuggaguuggcccugagcucuauccaccaagccagcaccccaccaucccuuugcaggggaguca

SEQ ID NO: 138575 - RNA, 64 nt, Homo Sapiens
auccucccugaguccccacacagggccucacucugcaccccaccagggucccgcucacaccagg

SEQ ID NO: 138576 - RNA, 64 nt, Homo Sapiens
ucccuggccaccuugggcagagcugggucaugcagcaccccauccuuacccggugcccucuccu

SEQ ID NO: 138577 - RNA, 64 nt, Homo Sapiens
gguggcagagcuugggggccugcgggaggggacggcaccccagucaaagcugacugugccccgc

SEQ ID NO: 138578 - RNA, 64 nt, Homo Sapiens
cacaggcuguggcugcucccaggaagaaaucccagcaccccagcuacguuucucuuugaugacc

SEQ ID NO: 138579 - RNA, 64 nt, Homo Sapiens
cugggcaacagagcgagacugagauugcaccauugcaccccagcggcggagguuucagugagcc

SEQ ID NO: 138580 - RNA, 64 nt, Homo Sapiens
cuacuugcugggcugagucccacccaacgcccaggcaccccagugaggaagcuacagguagguc

SEQ ID NO: 138581 - RNA, 64 nt, Homo Sapiens
ccagaacuaaaccagggagcugucugaaaucauagcaccccauccggguggcggggagaucaac

SEQ ID NO: 138582 - RNA, 64 nt, Homo Sapiens
cgguggagaaagggcccaugucaagccuuguucugcaccccaagcauuggugguaggacugggu

SEQ ID NO: 138583 - RNA, 64 nt, Homo Sapiens
cccacacucacauguacgaauuuucucucucagggcaccccagccccugacagauggguccccu

SEQ ID NO: 138584 - RNA, 64 nt, Homo Sapiens
ugcccugacagaugggucccaggguggggguggggcaccccagccuacucugcucccuaguccc

SEQ ID NO: 138585 - RNA, 64 nt, Homo Sapiens; identical to SEQ ID NO: 51595

SEQ ID NO: 138586 - RNA, 64 nt, Homo Sapiens; identical to SEQ ID NO: 51596

SEQ ID NO: 138587 - RNA, 64 nt, Homo Sapiens; identical to SEQ ID NO: 51597

SEQ ID NO: 138588 - RNA, 64 nt, Homo Sapiens; identical to SEQ ID NO: 51598

SEQ ID NO: 138589 - RNA, 64 nt, Homo Sapiens; identical to SEQ ID NO: 51599

SEQ ID NO: 138590 - RNA, 64 nt, Homo Sapiens; identical to SEQ ID NO: 51600

SEQ ID NO: 138591 - RNA, 64 nt, Homo Sapiens; identical to SEQ ID NO: 51601

SEQ ID NO: 138592 - RNA, 64 nt, Homo Sapiens; identical to SEQ ID NO: 51602

SEQ ID NO: 138593 - RNA, 64 nt, Homo Sapiens; identical to SEQ ID NO: 51603

SEQ ID NO: 138594 - RNA, 64 nt, Homo Sapiens; identical to SEQ ID NO: 51604

SEQ ID NO: 138595 - RNA, 64 nt, Homo Sapiens; identical to SEQ ID NO: 51605

SEQ ID NO: 138596 - RNA, 64 nt, Homo Sapiens; identical to SEQ ID NO: 51606

SEQ ID NO: 138597 - RNA, 64 nt, Homo Sapiens; identical to SEQ ID NO: 51607

SEQ ID NO: 138598 - RNA, 64 nt, Homo Sapiens; identical to SEQ ID NO: 51608

SEQ ID NO: 138599 - RNA, 64 nt, Homo Sapiens; identical to SEQ ID NO: 51609

SEQ ID NO: 138600 - RNA, 64 nt, Homo Sapiens; identical to SEQ ID NO: 51610

SEQ ID NO: 138601 - RNA, 64 nt, Homo Sapiens; identical to SEQ ID NO: 51611

SEQ ID NO: 138602 - RNA, 64 nt, Homo Sapiens; identical to SEQ ID NO: 51612

SEQ ID NO: 138603 - RNA, 64 nt, Homo Sapiens; identical to SEQ ID NO: 51613

SEQ ID NO: 138604 - RNA, 64 nt, Homo Sapiens; identical to SEQ ID NO: 51614

SEQ ID NO: 138605 - RNA, 64 nt, Homo Sapiens; identical to SEQ ID NO: 51615

SEQ ID NO: 138606 - RNA, 64 nt, Homo Sapiens; identical to SEQ ID NO: 51616

SEQ ID NO: 138607 - RNA, 64 nt, Homo Sapiens; identical to SEQ ID NO: 51617

SEQ ID NO: 138608 - RNA, 64 nt, Homo Sapiens; identical to SEQ ID NO: 51618

SEQ ID NO: 138609 - RNA, 64 nt, Homo Sapiens; identical to SEQ ID NO: 51619

SEQ ID NO: 138610 - RNA, 64 nt, Homo Sapiens; identical to SEQ ID NO: 51620

SEQ ID NO: 138611 - RNA, 64 nt, Homo Sapiens; identical to SEQ ID NO: 105615

SEQ ID NO: 138612 - RNA, 64 nt, Homo Sapiens; identical to SEQ ID NO: 105616

SEQ ID NO: 138613 - RNA, 64 nt, Homo Sapiens; identical to SEQ ID NO: 105617

SEQ ID NO: 138614 - RNA, 64 nt, Homo Sapiens; identical to SEQ ID NO: 105618

SEQ ID NO: 138615 - RNA, 64 nt, Homo Sapiens; identical to SEQ ID NO: 105619

SEQ ID NO: 138616 - RNA, 64 nt, Homo Sapiens; identical to SEQ ID NO: 105620

SEQ ID NO: 138617 - RNA, 64 nt, Homo Sapiens; identical to SEQ ID NO: 105621

SEQ ID NO: 138618 - RNA, 64 nt, Homo Sapiens; identical to SEQ ID NO: 105622

SEQ ID NO: 138619 - RNA, 64 nt, Homo Sapiens; identical to SEQ ID NO: 105623

SEQ ID NO: 138620 - RNA, 64 nt, Homo Sapiens; identical to SEQ ID NO: 105624

SEQ ID NO: 138621 - RNA, 64 nt, Homo Sapiens
auguaaacuaaucuaaagauguugguuuccaaugcacaaauaucaauuaugucacaaaugaaua

SEQ ID NO: 138622 - RNA, 64 nt, Homo Sapiens
cauuaaccaaggcuguguccuuguuuaaagcuggcacaaauaagccgauucugggacaauaaag

SEQ ID NO: 138623 - RNA, 64 nt, Homo Sapiens
ucaggagaguaaaaauucauauaaagugcaauugcacaaauacaagccaagcuagaaggaagca

SEQ ID NO: 138624 - RNA, 64 nt, Homo Sapiens
aguagguauacaaaagacuaguuuguuauuaauccacaaauaugcuaaauguuagcaagaugau

SEQ ID NO: 138625 - RNA, 64 nt, Homo Sapiens
uuaucagguuaaacuuucaccuagcuuuuuuccccacaaauaaaugaacuuuuucucaucaaaa

SEQ ID NO: 138626 - RNA, 64 nt, Homo Sapiens
guguaauaucaucaguccaagccuaguacuuuaccacaaauacaaucgauauauauauucuugu

SEQ ID NO: 138627 - RNA, 64 nt, Homo Sapiens
uauggggacaucaaaacuucauacucaucucaggcacaaauauagcagggccaaaacuagagug

SEQ ID NO: 138628 - RNA, 64 nt, Homo Sapiens
uguuuauggacaaaaauuuaugaauacuuugaaccacaaauaaguacucuuguaagaaaaacac

SEQ ID NO: 138629 - RNA, 64 nt, Homo Sapiens
augaaacauuaacucuaacugugacaaagaagaccacaaauaguuaucuuuuaauuacagaaga

SEQ ID NO: 138630 - RNA, 64 nt, Homo Sapiens
uuacaagagaagaaagugaaagcaaaugggguuucacaaauaguuguaaauauagugaagcaau

SEQ ID NO: 138631 - RNA, 64 nt, Homo Sapiens
ucuguuaauaguaccuaaaauugcaacuucuaaacacaaauaaaaagaaaauauuuauaggagg

SEQ ID NO: 138632 - RNA, 64 nt, Homo Sapiens
aacccaagaaauguaauaaauauuuguaauuuuacacaaauauuuaagaggaaagaguauuaag

SEQ ID NO: 138633 - RNA, 64 nt, Homo Sapiens
aaguguggaagcacuacuuuuuuuaaauagaaaucacaaauagcagcacaaauagaaaaccuau

SEQ ID NO: 138634 - RNA, 64 nt, Homo Sapiens
aaaccuauuuuuaaauagaaaauuggugacagagcacaaauagaucaccauauaaaaggaaaaa

SEQ ID NO: 138635 - RNA, 64 nt, Homo Sapiens
caucuuaggaucccaucagcgccucagcugcugucacaaauaccaauuuguuuucaaugccugu

SEQ ID NO: 138636 - RNA, 64 nt, Homo Sapiens
aguagcaauucuaggugguauacacauccaagcucacaaauaggcucucaucuucccccacaga

SEQ ID NO: 138637 - RNA, 64 nt, Homo Sapiens
caggcuggagucucuacuuuguauucuugugaggcacaaauauaggcuagaauccaggccccac

SEQ ID NO: 138638 - RNA, 64 nt, Homo Sapiens
ugugaggcacaaauauaggcuagaauccaggccccacaaauauaggcuagaauccggaauguuu

SEQ ID NO: 138639 - RNA, 64 nt, Homo Sapiens
uuaaagcguaaaaggagacccaagagcguccccucacaaauaaauuacugagccacagauaaua

SEQ ID NO: 138640 - RNA, 64 nt, Homo Sapiens
caugccagcucauuacagcaguggagccauguggcacaaauacuguucuguuucaaacuugcau

SEQ ID NO: 138641 - RNA, 64 nt, Homo Sapiens
ucucuuaacaauucaagcaguagacaaaguugcucacaaauacagaaaacaucuuuuugucuac

SEQ ID NO: 138642 - RNA, 64 nt, Homo Sapiens
uaguuucucugacaggcaguuuuuaacuguuuuccacaaauaaaaauaauaugucaugggauua

SEQ ID NO: 138643 - RNA, 64 nt, Homo Sapiens
auggccagcacaugagggcucaccaaguguaagccacaaauacacaucagcuauagcacaaaua

SEQ ID NO: 138644 - RNA, 64 nt, Homo Sapiens
ccaaguguaagccacaaauacacaucagcuauagcacaaauauacuuguguuacaagaaaggaa

SEQ ID NO: 138645 - RNA, 64 nt, Homo Sapiens
cuaacugcacugaaaccauuucuaaccacaacccuuggcccaaggacuugguacaggaagggag

SEQ ID NO: 138646 - RNA, 64 nt, Homo Sapiens
gaagggacagugcaucuguucauccauccugcacuuggcccacguugaacuccauggugccuga

SEQ ID NO: 138647 - RNA, 64 nt, Homo Sapiens
guuuuccucuguuuuggucucuugggcaacauuuuuggcccaaguuugggcaacauuuggccca

SEQ ID NO: 138648 - RNA, 64 nt, Homo Sapiens
ugggcaacauuuuuggcccaaguuugggcaacauuuggcccaaguuugggcauuuuggcaguag

SEQ ID NO: 138649 - RNA, 64 nt, Homo Sapiens
uugggccaguccauuuuuggcaggguagcucagguuggcccagugugagcccucuugcgucuuc

SEQ ID NO: 138650 - RNA, 64 nt, Homo Sapiens
ucauuacuuucucccuuucuuucagugcugcuguuuggcccagcugagugugacuugggaagcu

SEQ ID NO: 138651 - RNA, 64 nt, Homo Sapiens; identical to SEQ ID NO: 125569

SEQ ID NO: 138652 - RNA, 64 nt, Homo Sapiens; identical to SEQ ID NO: 125570

SEQ ID NO: 138653 - RNA, 64 nt, Homo Sapiens; identical to SEQ ID NO: 125571

SEQ ID NO: 138654 - RNA, 64 nt, Homo Sapiens; identical to SEQ ID NO: 125572

SEQ ID NO: 138655 - RNA, 64 nt, Homo Sapiens; identical to SEQ ID NO: 125573

SEQ ID NO: 138656 - RNA, 64 nt, Homo Sapiens; identical to SEQ ID NO: 125574

SEQ ID NO: 138657 - RNA, 64 nt, Homo Sapiens; identical to SEQ ID NO: 125575

SEQ ID NO: 138658 - RNA, 64 nt, Homo Sapiens; identical to SEQ ID NO: 125576

SEQ ID NO: 138659 - RNA, 64 nt, Homo Sapiens; identical to SEQ ID NO: 125577

SEQ ID NO: 138660 - RNA, 64 nt, Homo Sapiens; identical to SEQ ID NO: 125578

SEQ ID NO: 138661 - RNA, 64 nt, Homo Sapiens; identical to SEQ ID NO: 125579

SEQ ID NO: 138662 - RNA, 64 nt, Homo Sapiens; identical to SEQ ID NO: 125580

SEQ ID NO: 138663 - RNA, 64 nt, Homo Sapiens; identical to SEQ ID NO: 125581

SEQ ID NO: 138664 - RNA, 64 nt, Homo Sapiens; identical to SEQ ID NO: 125582

SEQ ID NO: 138665 - RNA, 64 nt, Homo Sapiens; identical to SEQ ID NO: 125583

SEQ ID NO: 138666 - RNA, 64 nt, Homo Sapiens; identical to SEQ ID NO: 125584

SEQ ID NO: 138667 - RNA, 64 nt, Homo Sapiens; identical to SEQ ID NO: 125585

SEQ ID NO: 138668 - RNA, 64 nt, Homo Sapiens; identical to SEQ ID NO: 125586

SEQ ID NO: 138669 - RNA, 64 nt, Homo Sapiens; identical to SEQ ID NO: 125587

SEQ ID NO: 138670 - RNA, 64 nt, Homo Sapiens; identical to SEQ ID NO: 125588

SEQ ID NO: 138671 - RNA, 64 nt, Homo Sapiens; identical to SEQ ID NO: 125589

SEQ ID NO: 138672 - RNA, 64 nt, Homo Sapiens; identical to SEQ ID NO: 125590

SEQ ID NO: 138673 - RNA, 64 nt, Homo Sapiens; identical to SEQ ID NO: 125591

SEQ ID NO: 138674 - RNA, 64 nt, Homo Sapiens; identical to SEQ ID NO: 125592

SEQ ID NO: 138675 - RNA, 64 nt, Homo Sapiens; identical to SEQ ID NO: 125593

SEQ ID NO: 138676 - RNA, 64 nt, Homo Sapiens; identical to SEQ ID NO: 125594

SEQ ID NO: 138677 - RNA, 64 nt, Homo Sapiens; identical to SEQ ID NO: 125595

SEQ ID NO: 138678 - RNA, 64 nt, Homo Sapiens; identical to SEQ ID NO: 125596

SEQ ID NO: 138679 - RNA, 64 nt, Homo Sapiens; identical to SEQ ID NO: 125597

SEQ ID NO: 138680 - RNA, 64 nt, Homo Sapiens; identical to SEQ ID NO: 125598

SEQ ID NO: 138681 - RNA, 64 nt, Homo Sapiens; identical to SEQ ID NO: 125599

SEQ ID NO: 138682 - RNA, 64 nt, Homo Sapiens; identical to SEQ ID NO: 125600

SEQ ID NO: 138683 - RNA, 64 nt, Homo Sapiens; identical to SEQ ID NO: 125601

SEQ ID NO: 138684 - RNA, 64 nt, Homo Sapiens; identical to SEQ ID NO: 125602

SEQ ID NO: 138685 - RNA, 64 nt, Homo Sapiens; identical to SEQ ID NO: 125603

SEQ ID NO: 138686 - RNA, 64 nt, Homo Sapiens; identical to SEQ ID NO: 125604

SEQ ID NO: 138687 - RNA, 64 nt, Homo Sapiens; identical to SEQ ID NO: 125605

SEQ ID NO: 138688 - RNA, 64 nt, Homo Sapiens; identical to SEQ ID NO: 125606

SEQ ID NO: 138689 - RNA, 64 nt, Homo Sapiens; identical to SEQ ID NO: 125607

SEQ ID NO: 138690 - RNA, 64 nt, Homo Sapiens; identical to SEQ ID NO: 125608

SEQ ID NO: 138691 - RNA, 64 nt, Homo Sapiens; identical to SEQ ID NO: 125609

SEQ ID NO: 138692 - RNA, 64 nt, Homo Sapiens; identical to SEQ ID NO: 125610

SEQ ID NO: 138693 - RNA, 64 nt, Homo Sapiens; identical to SEQ ID NO: 125611

SEQ ID NO: 138694 - RNA, 64 nt, Homo Sapiens; identical to SEQ ID NO: 125612

SEQ ID NO: 138695 - RNA, 64 nt, Homo Sapiens; identical to SEQ ID NO: 125613

SEQ ID NO: 138696 - RNA, 64 nt, Homo Sapiens; identical to SEQ ID NO: 125614

SEQ ID NO: 138697 - RNA, 64 nt, Homo Sapiens; identical to SEQ ID NO: 125615

SEQ ID NO: 138698 - RNA, 64 nt, Homo Sapiens; identical to SEQ ID NO: 125616

SEQ ID NO: 138699 - RNA, 64 nt, Homo Sapiens; identical to SEQ ID NO: 125617

SEQ ID NO: 138700 - RNA, 64 nt, Homo Sapiens; identical to SEQ ID NO: 125618

SEQ ID NO: 138701 - RNA, 64 nt, Homo Sapiens; identical to SEQ ID NO: 125619

SEQ ID NO: 138702 - RNA, 64 nt, Homo Sapiens; identical to SEQ ID NO: 125620

SEQ ID NO: 138703 - RNA, 64 nt, Homo Sapiens; identical to SEQ ID NO: 125621

SEQ ID NO: 138704 - RNA, 64 nt, Homo Sapiens; identical to SEQ ID NO: 125622

SEQ ID NO: 138705 - RNA, 64 nt, Homo Sapiens; identical to SEQ ID NO: 125623

SEQ ID NO: 138706 - RNA, 64 nt, Homo Sapiens; identical to SEQ ID NO: 125624

SEQ ID NO: 138707 - RNA, 64 nt, Homo Sapiens; identical to SEQ ID NO: 125625

SEQ ID NO: 138708 - RNA, 64 nt, Homo Sapiens; identical to SEQ ID NO: 125626

SEQ ID NO: 138709 - RNA, 64 nt, Homo Sapiens; identical to SEQ ID NO: 125627

SEQ ID NO: 138710 - RNA, 64 nt, Homo Sapiens; identical to SEQ ID NO: 125628

SEQ ID NO: 138711 - RNA, 64 nt, Homo Sapiens; identical to SEQ ID NO: 125629

SEQ ID NO: 138712 - RNA, 64 nt, Homo Sapiens; identical to SEQ ID NO: 125630

SEQ ID NO: 138713 - RNA, 64 nt, Homo Sapiens; identical to SEQ ID NO: 125631

SEQ ID NO: 138714 - RNA, 64 nt, Homo Sapiens; identical to SEQ ID NO: 125632

SEQ ID NO: 138715 - RNA, 64 nt, Homo Sapiens; identical to SEQ ID NO: 125633

SEQ ID NO: 138716 - RNA, 64 nt, Homo Sapiens; identical to SEQ ID NO: 125634

SEQ ID NO: 138717 - RNA, 64 nt, Homo Sapiens; identical to SEQ ID NO: 125635

SEQ ID NO: 138718 - RNA, 64 nt, Homo Sapiens; identical to SEQ ID NO: 125636

SEQ ID NO: 138719 - RNA, 64 nt, Homo Sapiens; identical to SEQ ID NO: 125637

SEQ ID NO: 138720 - RNA, 64 nt, Homo Sapiens; identical to SEQ ID NO: 125638

SEQ ID NO: 138721 - RNA, 64 nt, Homo Sapiens; identical to SEQ ID NO: 125639

SEQ ID NO: 138722 - RNA, 64 nt, Homo Sapiens; identical to SEQ ID NO: 125640

SEQ ID NO: 138723 - RNA, 64 nt, Homo Sapiens; identical to SEQ ID NO: 125641

SEQ ID NO: 138724 - RNA, 64 nt, Homo Sapiens; identical to SEQ ID NO: 125642

SEQ ID NO: 138725 - RNA, 64 nt, Homo Sapiens
cucccaggccucagaugcaggggcccagaacaccugcucucaccugagccccaggugaaggggc

SEQ ID NO: 138726 - RNA, 64 nt, Homo Sapiens
accugagccccaggugaaggggcccgggaacaccugcucucaccugagccccaggugaaggggc

SEQ ID NO: 138727 - RNA, 64 nt, Homo Sapiens
accugagccccaggugaaggggcccgggaacaccugcucucaccugaaccccaggugaaggggc

SEQ ID NO: 138728 - RNA, 64 nt, Homo Sapiens
caccugaaccccaggugaaggggcccggaacaccugcucucaccugagccccaggugaaggggc

SEQ ID NO: 138729 - RNA, 64 nt, Homo Sapiens
caccugagccccaggugaaggggcccggaacaccugcucucaccugagccccaggugaaggggc

SEQ ID NO: 138730 - RNA, 64 nt, Homo Sapiens; identical to SEQ ID NO: 138726

SEQ ID NO: 138731 - RNA, 64 nt, Homo Sapiens; identical to SEQ ID NO: 138727

SEQ ID NO: 138732 - RNA, 64 nt, Homo Sapiens
caccugaaccccaggugaaggggcccagaacaccugcucucaccugagccccaggugaaggggc

SEQ ID NO: 138733 - RNA, 64 nt, Homo Sapiens; identical to SEQ ID NO: 138729

SEQ ID NO: 138734 - RNA, 64 nt, Homo Sapiens
accugagccccaggugaaggggcccgggaacaccugcucucaccugagccccuggugaaggggc

SEQ ID NO: 138735 - RNA, 64 nt, Homo Sapiens
caccugagccccuggugaaggggcccggaacacuugcucucaccugagccccaggugaaggggc

SEQ ID NO: 138736 - RNA, 64 nt, Homo Sapiens
caccugagccccaggugaaggggcccggaacaccugcucucaccugagcccccggugaaggggc

SEQ ID NO: 138737 - RNA, 64 nt, Homo Sapiens
caccugagcccccggugaaggggcccggaacacuugcucucaccugagccccaggugaaggggc

SEQ ID NO: 138738 - RNA, 64 nt, Homo Sapiens
aagcuacucaagucugggagaugcugcucugagcugcucucaguacucuccucaucauggcagu

SEQ ID NO: 138739 - RNA, 64 nt, Homo Sapiens
uucauuuggucacccucaguccagccagugggcuugcucucauuuggccuguucucaggggugg

SEQ ID NO: 138740 - RNA, 64 nt, Homo Sapiens
cugcucagugacauggcccacuccccuucccaccugcucucauaugcucucacuggggacccuc

SEQ ID NO: 138741 - RNA, 64 nt, Homo Sapiens
ggggacccuccuccccuucccccuuugccaucucugcucucacuccucccuggggcucccaauc

SEQ ID NO: 138742 - RNA, 64 nt, Homo Sapiens
agcaccuuggucauggauuaaggcccaggaaggaugcucucauaccaggaaggaugcucucaua

SEQ ID NO: 138743 - RNA, 64 nt, Homo Sapiens
aggcccaggaaggaugcucugggcccaggaaggaugcucucauaggccuuuucuggcaagagaa

SEQ ID NO: 138744 - RNA, 64 nt, Homo Sapiens
ucucugaagggcuccaccauuccucuagcaaccaugcucucaaagcucagagggaggaaaagga

SEQ ID NO: 138745 - RNA, 64 nt, Homo Sapiens
ucagaaguaaccacuguuaacauguuggcuuaucugcucucagguguuucugugccuguacaua

SEQ ID NO: 138746 - RNA, 64 nt, Homo Sapiens
aacaucugauuugggguuaaaggacauucugauuugcucucagaagacuuggcuuuuuacuuag

SEQ ID NO: 138747 - RNA, 64 nt, Homo Sapiens
gaacauggugauggaggguucuggaaguggccuuugcucucagggcuucuuugaaccgcgacua

SEQ ID NO: 138748 - RNA, 64 nt, Homo Sapiens
caagaggugguagguuggaguaagaugcuacagaugcucucaagucaggaauagaaacugauga

SEQ ID NO: 138749 - RNA, 64 nt, Homo Sapiens
cuuacauuuguacagcaugaugaccuuuacaaagugcucucaaugcauuuacccauucguuaua

SEQ ID NO: 138750 - RNA, 64 nt, Homo Sapiens
ccacuggacagucauuguggauagagcagccugcugcucucaggaccagagaagggaaaugacu

SEQ ID NO: 138751 - RNA, 64 nt, Homo Sapiens
aacccaggcuucuaaauuucuaggccaguacuacugcucucaaaagagauuaacugggauuaag

SEQ ID NO: 138752 - RNA, 64 nt, Homo Sapiens
cagguuuuucccuccauauucaacaaaaacgaagugcucucaguuuucugugauuguacaaaaa

SEQ ID NO: 138753 - RNA, 59 nt, Homo Sapiens
cucccuucucucccucaauaccgugcgggugcucucaccgcuccgacacugacuacuga

SEQ ID NO: 138754 - RNA, 64 nt, Homo Sapiens
uaaaccuuuuguuugauuucagcccauguucuugacaaugcagagcaauucugagcagucacaa

SEQ ID NO: 138755 - RNA, 64 nt, Homo Sapiens
gcugagcaaacccgcuuuuguuuccuucccagaaacaaugcaaaacaacagguggagauagucu

SEQ ID NO: 138756 - RNA, 64 nt, Homo Sapiens
uaugucuauuuauucaauaugaucuuugcgaauuacaaugcauauuuagccuguggucuugcca

SEQ ID NO: 138757 - RNA, 64 nt, Homo Sapiens
cuuaaaaugacucaauaaaauaaaucuuaaagacacaaugcacauuaaaaugauacaagucaaa

SEQ ID NO: 138758 - RNA, 64 nt, Homo Sapiens
gcugcccgaucgccagcccgaggacuuaccauccacaaugcaccacggaagaggccguucuaug

SEQ ID NO: 138759 - RNA, 64 nt, Homo Sapiens
aaccagugcugaaagguuuugaauccuuuacccaacaaugcaaaaauagagccaaugguuauaa

SEQ ID NO: 138760 - RNA, 64 nt, Homo Sapiens
cagccucaugcaaguuuagacuuuauggcauuuuacaaugcacaauauucacugacccaaaacu

SEQ ID NO: 138761 - RNA, 64 nt, Homo Sapiens
auucucaauuguguuacugaugacucuguuccuaacaaugcaguaccguugaaaggcauagaau

SEQ ID NO: 138762 - RNA, 64 nt, Homo Sapiens
ugccuucugagccauuugacguagaggaaaagccugcaagcacauuuuguggaaagaggaguug

SEQ ID NO: 138763 - RNA, 64 nt, Homo Sapiens
aaucaaucaacccaacaccacaagcuugguugggugcaagcagagggugagcaggggcugcccc

SEQ ID NO: 138764 - RNA, 64 nt, Homo Sapiens
acagaauguuauccuuacguugacuucucagggcugcaagcagcuaccugccuuucacggcugc

SEQ ID NO: 138765 - RNA, 64 nt, Homo Sapiens
gaccucuugcuucugagaaauguuuacauucucgugcaagcagggguccagaucacugaauuca

SEQ ID NO: 138766 - RNA, 64 nt, Homo Sapiens
ucuagaggacaccuuuguauugaugccagcaaagggauggaaaguuucuuuuucuuuauagaua

SEQ ID NO: 138767 - RNA, 64 nt, Homo Sapiens
cacuccuacccuccagguaauuagaguggauuguggauggaaaguugaauuaauagaggccuua

SEQ ID NO: 138768 - RNA, 64 nt, Homo Sapiens
ccuuuuaugcuguacugaagcaagaggaaaacgaggauggaaaauuuuucccccuuucuagcuc

SEQ ID NO: 138769 - RNA, 64 nt, Homo Sapiens
aagaguaaguaucaugcguuauucaugcagauauggauggaaagguggauucuuggcucggaaa

SEQ ID NO: 138770 - RNA, 64 nt, Homo Sapiens
ugaccaccuacuuuguccagcauauauggaacauggauggaaacgaauacauacucuuuccaug

SEQ ID NO: 138771 - RNA, 64 nt, Homo Sapiens
auuaaauccagaguuccaggcaagauaaaaagugggauggaagagagagagagugaagugaaug

SEQ ID NO: 138772 - RNA, 64 nt, Homo Sapiens
acuuacaauaucucaaggaacagcaaugucaacaggauggaaaccagcccuaucugagucuucg

SEQ ID NO: 138773 - RNA, 64 nt, Homo Sapiens
auagccucaaaauagguuauucguuucuaaacuuggauggaauuagagaauacaaucaaacuuu

SEQ ID NO: 138774 - RNA, 64 nt, Homo Sapiens
ccuaucucauggaugugauaguggaaggaauuguggauggaagacaagcagaaaagcugaagac

SEQ ID NO: 138775 - RNA, 64 nt, Homo Sapiens
cuuuguacugcucucugggagccucccugcuugaggauggaaggaugaaauuugacgaauauau

SEQ ID NO: 138776 - RNA, 64 nt, Homo Sapiens
cauuuuauaaacagucuuauuaaaaacuuguacuggauggaaccuauguguuacaacaguaguu

SEQ ID NO: 138777 - RNA, 64 nt, Homo Sapiens
uuuauugaaugaaaaaugcaacaaaacuaaauaaggauggaacacauggacuucacuuucggca

SEQ ID NO: 138778 - RNA, 64 nt, Homo Sapiens
uagacagcaacaagauuuuaggcauuuaccuguuggauggaaggaauauaaaccaccgucguga

SEQ ID NO: 138779 - RNA, 64 nt, Homo Sapiens
aaaccagcucgucucagagguccaaaggcuucagggauggaaacucaagaccucauccagcucg

SEQ ID NO: 138780 - RNA, 64 nt, Homo Sapiens
accucauucggcaaauuagcgccuggagaggucaggauggaacuugucuucccagacccaccau

SEQ ID NO: 138781 - RNA, 64 nt, Homo Sapiens
aagggggcuuagaauuugugggguauucccaaaaggauggaaguuaagacucagagucucauua

SEQ ID NO: 138782 - RNA, 64 nt, Homo Sapiens
guuccuggaaucaaccaaaucauguuuuccucuuggauggaagugucaaaggcagaagggugug

SEQ ID NO: 138783 - RNA, 64 nt, Homo Sapiens; identical to SEQ ID NO: 47773

SEQ ID NO: 138784 - RNA, 64 nt, Homo Sapiens; identical to SEQ ID NO: 47774

SEQ ID NO: 138785 - RNA, 64 nt, Homo Sapiens; identical to SEQ ID NO: 47775

SEQ ID NO: 138786 - RNA, 64 nt, Homo Sapiens; identical to SEQ ID NO: 47776

SEQ ID NO: 138787 - RNA, 64 nt, Homo Sapiens; identical to SEQ ID NO: 47777

SEQ ID NO: 138788 - RNA, 64 nt, Homo Sapiens; identical to SEQ ID NO: 47778

SEQ ID NO: 138789 - RNA, 64 nt, Homo Sapiens; identical to SEQ ID NO: 47779

SEQ ID NO: 138790 - RNA, 64 nt, Homo Sapiens; identical to SEQ ID NO: 47780

SEQ ID NO: 138791 - RNA, 64 nt, Homo Sapiens; identical to SEQ ID NO: 47781

SEQ ID NO: 138792 - RNA, 64 nt, Homo Sapiens; identical to SEQ ID NO: 47782

SEQ ID NO: 138793 - RNA, 64 nt, Homo Sapiens; identical to SEQ ID NO: 47783

SEQ ID NO: 138794 - RNA, 64 nt, Homo Sapiens; identical to SEQ ID NO: 47784

SEQ ID NO: 138795 - RNA, 64 nt, Homo Sapiens
guguuuucucagaacagcugacaggggcggggcaggaaugcaaacugccgcccaaagagaaauc

SEQ ID NO: 138796 - RNA, 64 nt, Homo Sapiens
gaagagggcaguaccugggaaaggcuggcugaguggaaugcagggcuguggcacagacuucugg

SEQ ID NO: 138797 - RNA, 64 nt, Homo Sapiens
uccugagauuuggugccugugagcucugauuguaggaaugcaugugacagucccaguccuaugg

SEQ ID NO: 138798 - RNA, 64 nt, Homo Sapiens
gugacagucccaguccuaugguaaugacuuaggaggaaugcagauaaaaguaccuuguaagaua

SEQ ID NO: 138799 - RNA, 64 nt, Homo Sapiens
ucccgugccuuuagaggaaggagaggauugcugaggaaugcagggacgccuguuucuguccuca

SEQ ID NO: 138800 - RNA, 64 nt, Homo Sapiens
uuuugaaacggaguuuugcucugucacccaggcuggaaugcaauggcaccaucuuggcucacug

SEQ ID NO: 138801 - RNA, 64 nt, Homo Sapiens
ccaaguccuuuuauuuuaacgggggucucccuggggaaugcagggagcugucuacaguggaaua

SEQ ID NO: 138802 - RNA, 64 nt, Homo Sapiens
gguuucgacuaccagaaaggccggaggucaccaaggaaugcacaugccggcccauguucucucu

SEQ ID NO: 138803 - RNA, 64 nt, Homo Sapiens
ccaccuuccuaggucguucaaccagguuuugugaggaaugcauucaaaguggcuuuauaaaaga

SEQ ID NO: 138804 - RNA, 64 nt, Homo Sapiens
uaaccgcuuaaggcauugaagccauaugggauggggaaugcauuucuucaguguuucuccgaga

SEQ ID NO: 138805 - RNA, 64 nt, Homo Sapiens
uugccuuguaaguuccuggggaugcucccgugaaggaaugcacuaaacugccaugccccccugu

SEQ ID NO: 138806 - RNA, 64 nt, Homo Sapiens
ugcuaagcaaguaugacuuuguuuguggcaaucaggaaugcauuuugcagccaguuuuuacuga

SEQ ID NO: 138807 - RNA, 64 nt, Homo Sapiens
ucaggcucagcaaacugucagcagccccuggucuggaaugcaguauggggucugugaaagccac

SEQ ID NO: 138808 - RNA, 64 nt, Homo Sapiens
cacagcaccccuuuccgagcuguguccuggcugaggaaugcacucgaggugcaguuuggcaacc

SEQ ID NO: 138809 - RNA, 64 nt, Homo Sapiens
caaugccugggacuggagguugauaguuuaaguguguucuuaccgccuccuuuuuccuuuaauc

SEQ ID NO: 138810 - RNA, 64 nt, Homo Sapiens
cccaaaaugcaaccuugaaaggcacuacugacuuuguucuuauuggauacuccucuuauuauuu

SEQ ID NO: 138811 - RNA, 64 nt, Homo Sapiens
augcccugaaagaauaauagggauuauaccugucuguucuuaaagauuucaugguuggcucaga

SEQ ID NO: 138812 - RNA, 64 nt, Homo Sapiens
gugaaaauaugguauaaagguguuuucauuuuccuguucuuaccuauuauuguauagagcuauu

SEQ ID NO: 138813 - RNA, 64 nt, Homo Sapiens
ggauguucugacccugcuuccuacugaggugcuauguucuuagucuggcacuauaauguaagcu

SEQ ID NO: 138814 - RNA, 64 nt, Homo Sapiens
uugcaguuacacuaaaagguugucaagccauaauuguucuuaguacuucccuacauggaguaua

SEQ ID NO: 138815 - RNA, 64 nt, Homo Sapiens
uuugauauuucuucuauuuuucuuuugaaaccgguguucuuauugguuugccauccuuguucau

SEQ ID NO: 138816 - RNA, 64 nt, Homo Sapiens
gaauaaaauucuaugaaaaaagacacuagaaugcuguucuuaauuuuaauaguguuaagauagg

SEQ ID NO: 138817 - RNA, 64 nt, Homo Sapiens
aacauaccucaggucuauuuuaccuuacacugaauguucuuaauaugauuugguaccuaaagua

SEQ ID NO: 138818 - RNA, 64 nt, Homo Sapiens
auaagcaauuuauuuagcuuaaguuccaacuuacuguucuuauuauaaauugcaaagcaaccug

SEQ ID NO: 138819 - RNA, 64 nt, Homo Sapiens
gacauuuucuuuaugguuccaagugcaaaacagguguucuuaucuaaaacgucaauuagaaaau

SEQ ID NO: 138820 - RNA, 64 nt, Homo Sapiens
accucauuugcagauguccaaacuuaaauucaucuguucuuaaaaugcuacuuaaaacuuuggu

SEQ ID NO: 138821 - RNA, 64 nt, Homo Sapiens
cugaaaucuaaugcuuuguucuccuaaaacuggcuguucuuagcgcuauucgauguaauucuua

SEQ ID NO: 138822 - RNA, 64 nt, Homo Sapiens
cauauuggacuaaagucuguuuucagagauucauuguucuuaacaacguuugccaacucugaaa

SEQ ID NO: 138823 - RNA, 64 nt, Homo Sapiens
uaugguguguauguaaagaggacauggacuuggguguucuuauuacacuuuaccagcacccagg

SEQ ID NO: 138824 - RNA, 64 nt, Homo Sapiens
cgucauuuuuaaguccagugagcauugugguaguuguucuuagauugcaguuucuuauguuuug

SEQ ID NO: 138825 - RNA, 64 nt, Homo Sapiens
ucuuauguuuugaguuugaaguugauuuucagaauguucuuagaaaagaacugcauuuuuuucc

SEQ ID NO: 138826 - RNA, 64 nt, Homo Sapiens
ccuccuaaaugccccauauuugcugucagacgauuguucuuagaauuuauuuguguuuaaaugc

SEQ ID NO: 138827 - RNA, 64 nt, Homo Sapiens
cauaauuucuuaauuuucacuauuugcuaaaugcuguucuuacagucucucuuuuuuuaauagc

SEQ ID NO: 138828 - RNA, 64 nt, Homo Sapiens
uuaagauuauuagaaaacaugcccugaagagaguuguucuuagguuacacaugaaauccuaccg

SEQ ID NO: 138829 - RNA, 64 nt, Homo Sapiens
acugauaaaucugucugacugggcuacaauccauuguucuuaguccaauauggacacugccuua

SEQ ID NO: 138830 - RNA, 64 nt, Homo Sapiens
uuagauuucccuccacgaggucagcaaacuaucauguucuuauguaaacuuaggccaaggccag

SEQ ID NO: 138831 - RNA, 64 nt, Homo Sapiens
uuugcccacguauauuauguagucuauuugcaacuguucuuaaaaaaaugacauuaaaagaaua

SEQ ID NO: 138832 - RNA, 64 nt, Homo Sapiens
uagucgucuccucuuggccucagcagcucuucccuguucuuacugguugacauuuugaucacuc

SEQ ID NO: 138833 - RNA, 64 nt, Homo Sapiens
gcucaguaaauguuuguggaauaagugcauaaaauguucuuaaccuuugauucuacuuacagcc

SEQ ID NO: 138834 - RNA, 64 nt, Homo Sapiens
cucuuaccucuccuguagcgcuuaccugcuagaauguucuuaccgcugaauuuguagcauacag

SEQ ID NO: 138835 - RNA, 64 nt, Homo Sapiens
uccgccugcgagagccacagaggcgccagcugccuguucuuaccagccuaaggaugugccgugg

SEQ ID NO: 138836 - RNA, 64 nt, Homo Sapiens
cagugagacgagacgagcaaugggaaaccuuuucuguucuuaagaagugacuuuaauuuuauug

SEQ ID NO: 138837 - RNA, 64 nt, Homo Sapiens
agccugccaugagguaggauccuagggguuuggcuguucuuacuccacugcucagaaagcuucc

SEQ ID NO: 138838 - RNA, 64 nt, Homo Sapiens
gaguaucaacuuucauacugacgcgucuguaaucuguucuuaugcucauuuuguauuuuccuuu

SEQ ID NO: 138839 - RNA, 64 nt, Homo Sapiens
augagauaaaauaggagaaguuccuggcuuaaccuguucuuacauauuaaagaaaaguuacuua

SEQ ID NO: 138840 - RNA, 64 nt, Homo Sapiens
cauucuaucuuugcucaaauaaguccaucuauguuguucuuagguaaaacagcccauccucugc

SEQ ID NO: 138841 - RNA, 64 nt, Homo Sapiens
cuuuuucuuguaaaauugaucuguaaacacuuuuuguucuuaguucaccauuuuuguccuguau

SEQ ID NO: 138842 - RNA, 64 nt, Homo Sapiens
acaaacuccaagacauuucucuuuguguuuguuuuguucuuauugucuacuuuugaacucuucu

SEQ ID NO: 138843 - RNA, 64 nt, Homo Sapiens
uuuauuuuacucuauuuuaugcuagguuuuauauuguucuuaaauuuuuaauuuuauuuuggua

SEQ ID NO: 138844 - RNA, 64 nt, Homo Sapiens
aauaguugguuuccaaugcagaacuuuuaauuaugucacaaauguggaagaauucauuaauaag

SEQ ID NO: 138845 - RNA, 64 nt, Homo Sapiens
auagucuacaaauaugcuuuaauacaguuugcuagucacaaagaccuugguggacucuucuaag

SEQ ID NO: 138846 - RNA, 64 nt, Homo Sapiens
ugcauccuaauccuugguggauaggaaaggaguggucacaaacucugugagcuacuuaagguau

SEQ ID NO: 138847 - RNA, 64 nt, Homo Sapiens
auaaaauccauauuuuaagacaauaguucuucaugucacaaacacaaucuauucuacaugagga

SEQ ID NO: 138848 - RNA, 64 nt, Homo Sapiens
aggaaagaaauacuguuucugggacucucccacagucacaaagcuguuuucacuguggccccua

SEQ ID NO: 138849 - RNA, 64 nt, Homo Sapiens
uuucaguaaugcuacaaccacuaauauaaugauugucacaaagucauaguauagggaaacuuga

SEQ ID NO: 138850 - RNA, 64 nt, Homo Sapiens
acagcuugaaagacaggagaugacaaaguugucagucacaaaucucuuacaaaugugaagacug

SEQ ID NO: 138851 - RNA, 64 nt, Homo Sapiens
cauucauacuggagagaaacuucaacccuuguaagucacaaagcggcaacaccuuccaucacaa

SEQ ID NO: 138852 - RNA, 64 nt, Homo Sapiens
ugcugagaugggcgcucccgacacagcgcagacccaccaggaggaaagaggcccagcucucagc

SEQ ID NO: 138853 - RNA, 64 nt, Homo Sapiens
guuucaggggcauuugacauccccuccugguucucaccaggaaaacauccaaagcuuuggagga

SEQ ID NO: 138854 - RNA, 64 nt, Homo Sapiens
ccacagagcuggcucugcucccugagauccuguucaccaggacugucaugcagugggucgagcg

SEQ ID NO: 138855 - RNA, 64 nt, Homo Sapiens
caaggcaggcuguuccuugguuuaaccugcagggcaccaggaccccuugggucugggaaaaagc

SEQ ID NO: 138856 - RNA, 64 nt, Homo Sapiens
uccaccccagcucuggucugugcagacucauggccaccaggaggccugcagauccagccuuccu

SEQ ID NO: 138857 - RNA, 64 nt, Homo Sapiens
gacucaagugcaccugaucccugcgcaacagccacaccaggagaacaggcuguccuuggcggca

SEQ ID NO: 138858 - RNA, 64 nt, Homo Sapiens
cucugggggcaggggcuggcgcaggugcuucucacaccaggagccuuaauccacgucggagccg

SEQ ID NO: 138859 - RNA, 64 nt, Homo Sapiens
gccaggggcauacgcaguccucgccuugcacgcccaccaggagggcuggccaugggcacugggc

SEQ ID NO: 138860 - RNA, 64 nt, Homo Sapiens
caggaauagguucugucgggucuguugggggugacaccaggacaaccaggagagagggacaggu

SEQ ID NO: 138861 - RNA, 64 nt, Homo Sapiens
gagggacagguucuguugggucugucaggggugacaccaggagaaccaggagagagggacaggu

SEQ ID NO: 138862 - RNA, 64 nt, Homo Sapiens
gagggacagguucugucaggucugucgggggugacaccaggagaaagaggagacagggacaggu

SEQ ID NO: 138863 - RNA, 64 nt, Homo Sapiens
gagggacagguucuguugggucuaucaugggugacaccaggagaacgaggacacagggacaggu

SEQ ID NO: 138864 - RNA, 64 nt, Homo Sapiens
cagggacagguucugucaugucugucgggggugacaccaggacaaccaggacacagggacaggu

SEQ ID NO: 138865 - RNA, 64 nt, Homo Sapiens
cagggacagguucugucgggucugucaggggugacaccaggacaaccaggagagagggacaggu

SEQ ID NO: 138866 - RNA, 64 nt, Homo Sapiens
cugccuccuggucccugguuggagaggugcugggcaccaggacgguggggacgagggacacuga

SEQ ID NO: 138867 - RNA, 64 nt, Homo Sapiens
guuugaggaggugaucgaggacugguacaggaaccaccaggaggaagaccugacugaauuccuc

SEQ ID NO: 138868 - RNA, 64 nt, Homo Sapiens
ugugaacucaggaggggcaggugucagaacugggcaccaggacuggagcccccuccggagacca

SEQ ID NO: 138869 - RNA, 64 nt, Homo Sapiens
ugaaaccaaagauauauacacaggauccuauucucaccaggaaggggguccacccagcaaagag

SEQ ID NO: 138870 - RNA, 64 nt, Homo Sapiens
ugcuaggcgagugccaggacuccccaggccaggccaccaggauggcccuucccacuggagguca

SEQ ID NO: 138871 - RNA, 64 nt, Homo Sapiens
uuccccucugcccgaugacuggauaaggcuucaccaccaggagaagggugggucucaaguggga

SEQ ID NO: 138872 - RNA, 64 nt, Homo Sapiens
ggccaaguaaaccgagacacgcaggcaccacuaucaccaggagucucacagucagucagacgcu

SEQ ID NO: 138873 - RNA, 64 nt, Homo Sapiens
cagggcaagcugggaucgggccagugccuggacccaccaggaugauccccggaagggggcaaug

SEQ ID NO: 138874 - RNA, 64 nt, Homo Sapiens
ccagaagcucagggcccagcuacuauguaccaggcaccaggaaguccucaauccagucaacacc

SEQ ID NO: 138875 - RNA, 64 nt, Homo Sapiens
gaggaggacgguugacggcccugcuuggauccaccaccaggacgcugugcucggccauggcgcg

SEQ ID NO: 138876 - RNA, 64 nt, Homo Sapiens
gcaugcccuccugcaguugcuggauggauagggacaccaggaagaggacaaacugcauggacuc

SEQ ID NO: 138877 - RNA, 64 nt, Homo Sapiens
guggucccgccgcaccucugcaucuccugggcgucaccaggaaggcucugaagucccgggcugc

SEQ ID NO: 138878 - RNA, 64 nt, Homo Sapiens
agacugaagacucuggacucauugcugauuggaacaccaggaggagguuggauuucugccagug

SEQ ID NO: 138879 - RNA, 64 nt, Homo Sapiens
gugguuccucaguuucuccucugccagcuccccccaccaggacuggcgccuggaucuugcccag

SEQ ID NO: 138880 - RNA, 64 nt, Homo Sapiens
ccuggagccccuuccacccaucccacauggggagcaccaggagcuacugauguggccacccuau

SEQ ID NO: 138881 - RNA, 64 nt, Homo Sapiens
cccugauuugacccugugugggaaaugcugaaagcaccaggaggaagccgguucccgugagaua

SEQ ID NO: 138882 - RNA, 64 nt, Homo Sapiens
aaaauccgucucccauuuguuacagccucaccugcaccaggauagaaagcacgugauggaaucu

SEQ ID NO: 138883 - RNA, 64 nt, Homo Sapiens
auaugaaagccagggggcagugccaaacacgcggcaccaggagauggaggaugucaucaggcug

SEQ ID NO: 138884 - RNA, 64 nt, Homo Sapiens
uaugaagugagccuggacaacaacguggagccugcaccaggagcggccagggaggguucucccc

SEQ ID NO: 138885 - RNA, 64 nt, Homo Sapiens
guccacccgcccuguuggcagcccaccaggaagucaccaggacauuggccucuugguuggccag

SEQ ID NO: 138886 - RNA, 64 nt, Homo Sapiens
ucaccaggacaguccacccgugguuggccaggcccaccaggaagggugaggccacuuggccucu

SEQ ID NO: 138887 - RNA, 64 nt, Homo Sapiens
cccucgagguugcucugggauuccaggugguaagcaccaggacgucucccaccaccucaccagu

SEQ ID NO: 138888 - RNA, 64 nt, Homo Sapiens
ucucccaccaccucaccagucuuccacuaggguccaccaggaguuucaagaaauuacuggaagg

SEQ ID NO: 138889 - RNA, 64 nt, Homo Sapiens
ccaccaccucccucuaggauauauuaauaccagucaccaggagcaaccucaggucucccccuac

SEQ ID NO: 138890 - RNA, 64 nt, Homo Sapiens
ggacugcaaccucaggucucagauggcaccuggacaccaggaugaggagaugccucccuagccc

SEQ ID NO: 138891 - RNA, 64 nt, Homo Sapiens
auuuaugguaguaugaggggacauucgcuucucucaccaggaaccuucgcuucucucaccagga

SEQ ID NO: 138892 - RNA, 64 nt, Homo Sapiens
auucgcuucucucaccaggaaccuucgcuucucucaccaggaacggcugagccaggagaugcac

SEQ ID NO: 138893 - RNA, 62 nt, Homo Sapiens
aggcccgucucuccuguaggggcuuuagugagaccacagacccuggaccuaauugggcauug

SEQ ID NO: 138894 - RNA, 62 nt, Homo Sapiens
acagugauuuuucuuuucccuuuuuuucagagaccacagaccgaucccacuuacucuuuuuu

SEQ ID NO: 138895 - RNA, 62 nt, Homo Sapiens
gugaugucauaauuguacuaauccacauaaguaccacagagaaggguuugaacugugcuauu

SEQ ID NO: 138896 - RNA, 62 nt, Homo Sapiens
agcuacagcuucuuugcguuuaacuuuuucaaaccacagaccagaacugguugcauguuacu

SEQ ID NO: 138897 - RNA, 62 nt, Homo Sapiens
ugcuuuuuaaaggcuaaauauuguuugugggaaccacagaugguugggguugaacaguaagc

SEQ ID NO: 138898 - RNA, 62 nt, Homo Sapiens
cuacucaacucuguuucugaagcaggaaagccaccacagacaguacauaaaggaauaugugu

SEQ ID NO: 138899 - RNA, 62 nt, Homo Sapiens
auuugacuccuacagcagaaguucugagccugaccacagaugguguguaaucuaucaaacac

SEQ ID NO: 138900 - RNA, 62 nt, Homo Sapiens
cugcagcccacaggaguccagggaaggcggggaccacagaggcacagaguccagcacuuggc

SEQ ID NO: 138901 - RNA, 62 nt, Homo Sapiens
gggacuguucuuuuacaagacaggacccugggaccacagagggcaggaacuugcacaaaauc

SEQ ID NO: 138902 - RNA, 62 nt, Homo Sapiens
augcugcccgcuucucacccuaugugggugggaccacagacucacauccugaccuugcacaa

SEQ ID NO: 138903 - RNA, 62 nt, Homo Sapiens
uuaugcgaaauacccaagauucaugcuacuguaccacagauuuguuuucacagcaauaaauc

SEQ ID NO: 138904 - RNA, 62 nt, Homo Sapiens
aucaguuuuauuuuucucugauuuuuuuuaauaccacagaaucaccugagugucaauugaaa

SEQ ID NO: 138905 - RNA, 62 nt, Homo Sapiens
gugugagauuuuccuguuuguguacugcacacaccacagaauugagagaguccacacagugc

SEQ ID NO: 138906 - RNA, 62 nt, Homo Sapiens
gaaccugugaaugcauucagcaugggggugacaccacagagaacuggaaugaaaugugcaaa

SEQ ID NO: 138907 - RNA, 62 nt, Homo Sapiens
gugcaaagacucuccugcuugaaaauacugaaaccacagacauauauuaaaaaaaaaaaaga

SEQ ID NO: 138908 - RNA, 62 nt, Homo Sapiens
ggaggcugccaacacccagggcacacacccucaccacagacugaccccaccccaccaucuca

SEQ ID NO: 138909 - RNA, 64 nt, Homo Sapiens
caguggcucagcuaagugcucccccuagcucccaucucaggagaccaaaucucacagaaaaaua

SEQ ID NO: 138910 - RNA, 64 nt, Homo Sapiens
cgugggacaggcuuaggggaaagagcuuguccuaucucaggaacaaaauuauaggcugugggca

SEQ ID NO: 138911 - RNA, 64 nt, Homo Sapiens
gugacugcauugaggcgcucuauucuucuucaccucucaggaacugacuuuuauuuuuucuguc

SEQ ID NO: 138912 - RNA, 64 nt, Homo Sapiens
uuuccuugugacaagaaauuugcaagcuuuucaaucucaggaauacuggauucuauagccaaga

SEQ ID NO: 138913 - RNA, 64 nt, Homo Sapiens
aaaacaacuaggaugucuuggccauuacgccagcucucaggagaagguaaugauacagagauug

SEQ ID NO: 138914 - RNA, 64 nt, Homo Sapiens
cuuuuaccauacuugaguagauugugaacauuauucucaggacauuaagaugccaaugaaaagu

SEQ ID NO: 138915 - RNA, 64 nt, Homo Sapiens
augaguuucucuucccucaguggguuuagaaagaucucaggaaaccugggggaaaagccugggu

SEQ ID NO: 138916 - RNA, 64 nt, Homo Sapiens
gugaccagaguagacuuggguuucccucacuggcucucaggaguucucacagucggccacugga

SEQ ID NO: 138917 - RNA, 64 nt, Homo Sapiens
cacagcacuucaaagaagcugucuuggaagucugucucaggagcacccugucuucuuaauucuc

SEQ ID NO: 138918 - RNA, 64 nt, Homo Sapiens
augaaauacucaggguuaggaauccuagcacuugucucaggacucugaaaaggaacggcuuccu

SEQ ID NO: 138919 - RNA, 64 nt, Homo Sapiens
uacauaaaugugaaaaguuguugaucuugaaauaucucaggauagcacuuuuggcaaacucuua

SEQ ID NO: 138920 - RNA, 64 nt, Homo Sapiens
aggaucccaaacuguaaaagauugaaauaaucuuucucaggauuuuuuaaaugucuaagauuau

SEQ ID NO: 138921 - RNA, 64 nt, Homo Sapiens
gcaucccuucccacaugccugccacagcugcuguucucaggacaauguucuauuuuugacugua

SEQ ID NO: 138922 - RNA, 64 nt, Homo Sapiens
uugggcagugccccagggagagagcagcucccuuucucaggagcucccagacuaaaggauccag

SEQ ID NO: 138923 - RNA, 64 nt, Homo Sapiens
cagacagcccuccacuccagcucugagacccuuuucucaggaccucuguaggcagcagagagag

SEQ ID NO: 138924 - RNA, 64 nt, Homo Sapiens
gguucuucaugauccacacuuugggcuuaguauuucucaggaagagcuauggcccagaaacaac

SEQ ID NO: 138925 - RNA, 64 nt, Homo Sapiens
ucugucucaucaguucuucaccuaaauguucccuucucaggaauugcccuucuaucccagauua

SEQ ID NO: 138926 - RNA, 64 nt, Homo Sapiens
cacuggacacagugauucugcagcugaaagaacaucucaggaagagcugcugccuuccauuccu

SEQ ID NO: 138927 - RNA, 64 nt, Homo Sapiens
ugaauaaucaggggucaccggaaaacaggccacuucucaggaguagaacaagugccacaaaaau

SEQ ID NO: 138928 - RNA, 64 nt, Homo Sapiens
uuucaccauccaucacccacauacuuuuccccauucucaggacuaucccuccccccacauuuuc

SEQ ID NO: 138929 - RNA, 64 nt, Homo Sapiens
aaggagagagaaggcuaaaucaacuacugcaggaucucaggacuaacgugacguuccaguugcu

SEQ ID NO: 138930 - RNA, 64 nt, Homo Sapiens
gaaucaaagagaacuuccaguggccaagagcuucucucaggagagcagcggggagugguggugc

SEQ ID NO: 138931 - RNA, 64 nt, Homo Sapiens
ggucuaaacuucaagucucaaggaucaccacgcaucucaggauucaggcagucugcucucucuc

SEQ ID NO: 138932 - RNA, 64 nt, Homo Sapiens
accacgcaucucaggauuggggcagucugcucucucucaggaucuauggaccauuuaccuggca

SEQ ID NO: 138933 - RNA, 64 nt, Homo Sapiens
augaggcucccucccaaccugauccaaaagccagucucaggaguuuaccccugggaugggggau

SEQ ID NO: 138934 - RNA, 64 nt, Homo Sapiens
ccacgugcccuguggcaccccagcucacugggagucucaggagggauaaccggauuucugcucu

SEQ ID NO: 138935 - RNA, 64 nt, Homo Sapiens
uguggacuuaaccguugcaagacuugcgaggcaaucucaggagccucugcuucaugcccaagau

SEQ ID NO: 138936 - RNA, 64 nt, Homo Sapiens
uuccucagauugaaaagcuucuuacuaauuaccuucucaggauucaccacaucgcuagguggug

SEQ ID NO: 138937 - RNA, 64 nt, Homo Sapiens
acuccucugccgccuccccucaugccucaccgugucucaggagagaggggugcacguuucaugg

SEQ ID NO: 138938 - RNA, 64 nt, Homo Sapiens
aaaaaucauugacgucauagaauauucuucuuccucucaggagaagacggaagcuggaguugga

SEQ ID NO: 138939 - RNA, 64 nt, Homo Sapiens
ggcauaacagcacauucaucccuuugguuugggaucucaggaauacagucccaugcaaagauuc

SEQ ID NO: 138940 - RNA, 64 nt, Homo Sapiens
uuucucauggaguuucuuaucuuuuuugguuuauucucaggaguugcuuguacauucuugggca

SEQ ID NO: 138941 - RNA, 64 nt, Homo Sapiens; identical to SEQ ID NO: 42317

SEQ ID NO: 138942 - RNA, 64 nt, Homo Sapiens; identical to SEQ ID NO: 42318

SEQ ID NO: 138943 - RNA, 64 nt, Homo Sapiens; identical to SEQ ID NO: 42319

SEQ ID NO: 138944 - RNA, 64 nt, Homo Sapiens; identical to SEQ ID NO: 42320

SEQ ID NO: 138945 - RNA, 64 nt, Homo Sapiens; identical to SEQ ID NO: 42321

SEQ ID NO: 138946 - RNA, 64 nt, Homo Sapiens; identical to SEQ ID NO: 42322

SEQ ID NO: 138947 - RNA, 64 nt, Homo Sapiens; identical to SEQ ID NO: 42323

SEQ ID NO: 138948 - RNA, 64 nt, Homo Sapiens; identical to SEQ ID NO: 42324

SEQ ID NO: 138949 - RNA, 64 nt, Homo Sapiens; identical to SEQ ID NO: 42325

SEQ ID NO: 138950 - RNA, 64 nt, Homo Sapiens; identical to SEQ ID NO: 42326

SEQ ID NO: 138951 - RNA, 64 nt, Homo Sapiens; identical to SEQ ID NO: 42327

SEQ ID NO: 138952 - RNA, 64 nt, Homo Sapiens; identical to SEQ ID NO: 42328

SEQ ID NO: 138953 - RNA, 64 nt, Homo Sapiens; identical to SEQ ID NO: 42329

SEQ ID NO: 138954 - RNA, 64 nt, Homo Sapiens; identical to SEQ ID NO: 42330

SEQ ID NO: 138955 - RNA, 64 nt, Homo Sapiens; identical to SEQ ID NO: 42331

SEQ ID NO: 138956 - RNA, 64 nt, Homo Sapiens; identical to SEQ ID NO: 42332

SEQ ID NO: 138957 - RNA, 64 nt, Homo Sapiens
uucaacacugcuucaagguuucuuuuguauauaauucuuagaaugcucauuucuuuuaaauggu

SEQ ID NO: 138958 - RNA, 64 nt, Homo Sapiens
ugugugugggaaaucucuguagagcaccuuuucuuucuuagacuaaguaacccaguacaauagu

SEQ ID NO: 138959 - RNA, 64 nt, Homo Sapiens
accaaguggaagaaacgucuucuugccaagcucauucuuagaacuuacacaucuagaacagcuu

SEQ ID NO: 138960 - RNA, 64 nt, Homo Sapiens
aauguuucaucaaaugguuaaauggaccacugguuucuuagagaaauguuuuuaggcuuaauuc

SEQ ID NO: 138961 - RNA, 64 nt, Homo Sapiens
aaaauuuucaagguuauaguacuuauuucaacaauucuuagagaugcuagcuaguguugaagcu

SEQ ID NO: 138962 - RNA, 64 nt, Homo Sapiens
augccaagagaauagauacauuauggaccucuuguucuuagauaugggccucucagccuggcag

SEQ ID NO: 138963 - RNA, 64 nt, Homo Sapiens
gagcacuuuaacaaguugagcauuccauguuucauucuuagaaccuucuuuaauagagggucuu

SEQ ID NO: 138964 - RNA, 64 nt, Homo Sapiens
ucaagaaagcaugcgucuugucagcuacauuguuuucuuagauggauuucuccuguuaauccuc

SEQ ID NO: 138965 - RNA, 64 nt, Homo Sapiens
agacucuaugacaugcccucagaauaucagaaucuucuuagaaauaaacuaggaaaugcagaug

SEQ ID NO: 138966 - RNA, 64 nt, Homo Sapiens
gcuaaugaauguauaggagaccacauuguaauuguucuuagaugauggaguccaugcaguuucu

SEQ ID NO: 138967 - RNA, 64 nt, Homo Sapiens
uguaauuguucuuagaugauggaguccaugcaguuucuuagaaaucggucucagugcaugcugu

SEQ ID NO: 138968 - RNA, 64 nt, Homo Sapiens
ucgcauuuugccagcucagcuguaaaugaagguguucuuagaaucuuucaagcagcagucgaca

SEQ ID NO: 138969 - RNA, 64 nt, Homo Sapiens
accacaaaacauaaaaggaguguggauuuuuuuuuucuuagagaguuucacaagcuuuaaucca

SEQ ID NO: 138970 - RNA, 64 nt, Homo Sapiens
aucuaaacaucuuuguugauuuaggucccaucaauucuuagaaucuaagaaucuuuguuagaua

SEQ ID NO: 138971 - RNA, 64 nt, Homo Sapiens
aucuaagaaucuuuguuagaucaggucccaucaauucuuagaauacauuucacugaugcuucua

SEQ ID NO: 138972 - RNA, 64 nt, Homo Sapiens
cgcagugaaagggaggaacuccugcccugaaaaguucuuagaaagaugacuaauuuuaaaagaa

SEQ ID NO: 138973 - RNA, 64 nt, Homo Sapiens
aggucaguuguccuauguauugccccagccgggcuucuuagaggcuccaugaaaagcucacugc

SEQ ID NO: 138974 - RNA, 64 nt, Homo Sapiens
ucauuuuuaaguccagugagcauugugguaguuguucuuagauugcaguuucuuauguuuugag

SEQ ID NO: 138975 - RNA, 64 nt, Homo Sapiens
uuauguuuugaguuugaaguugauuuucagaauguucuuagaaaagaacugcauuuuuuuccuu

SEQ ID NO: 138976 - RNA, 64 nt, Homo Sapiens
uguauuuaaaaggguaauguggccuuggcauuucuucuuagaaaaaaacuaauuuuuggugcug

SEQ ID NO: 138977 - RNA, 64 nt, Homo Sapiens
uauucagcguacuugaauuuuucuuccucuccacuucuuagaggcauucaguuagcaaagaggu

SEQ ID NO: 138978 - RNA, 64 nt, Homo Sapiens
guucagcgcucagaacaaaagauugcgcuaaaauuucuuagauugugguaagucuuuuuucuua

SEQ ID NO: 138979 - RNA, 64 nt, Homo Sapiens
gcgcuaaaauuucuuagauugugguaagucuuuuuucuuagauuaauguuauuuuaggugcuuu

SEQ ID NO: 138980 - RNA, 64 nt, Homo Sapiens
aaaacaaaaucucaaaaguaucuucucuauaauauucuuagaguugagaggugauacccgauga

SEQ ID NO: 138981 - RNA, 64 nt, Homo Sapiens
agaauaaugcaacuucgaguuuaauguguauauguucuuagauuuuauuaacuuaauuugacuc

SEQ ID NO: 138982 - RNA, 64 nt, Homo Sapiens
agaugugucauuguguucaugccaguguuggcgguucuuagagcgcugggcaggggugggagug

SEQ ID NO: 138983 - RNA, 64 nt, Homo Sapiens
uauagauuuuuggucacuugaaaauaaccagguauucuuagagcagaaaaacaaaagacagcag

SEQ ID NO: 138984 - RNA, 64 nt, Homo Sapiens
aggcaagagcuuccuucuuuugucucacgaguuuuucuuagagcucuugccugagcuggcuucc

SEQ ID NO: 138985 - RNA, 64 nt, Homo Sapiens
cauuugagcaugcuguaauuaagaugagaucaguuucuuagaaaaagcuuuccugaaucccucu

SEQ ID NO: 138986 - RNA, 64 nt, Homo Sapiens
uuacaguggcuuccgugggaucgucaauuucuuguucuuagaguuucggguguuuuucuccagu

SEQ ID NO: 138987 - RNA, 64 nt, Homo Sapiens
augacugaaacucauuuaacuggguuaauuucauuucuuagacugaauauauuauuguuaagau

SEQ ID NO: 138988 - RNA, 64 nt, Homo Sapiens
aucguugucccuacaggaggaacaguggccuugcuucuuagacggucuucacuguguguuuuaa

SEQ ID NO: 138989 - RNA, 64 nt, Homo Sapiens
gugcuauaaaauuaacaguauuaaaugacuuauauucuuagaauacaucgagugucuuuucuua

SEQ ID NO: 138990 - RNA, 64 nt, Homo Sapiens
gaaguauuuauccaccuguuuuauuuucaugaaguucuuagacuagcugaauuugucuuuaaaa

SEQ ID NO: 138991 - RNA, 64 nt, Homo Sapiens
caugagccauugugccuagccuauuuugauuuuuuucuuagagucaaggucuugcucuguugcc

SEQ ID NO: 138992 - RNA, 64 nt, Homo Sapiens
uguuuuucugggccuuguuuggguucuucccuccugcccucaauguggaagguaucauccgugu

SEQ ID NO: 138993 - RNA, 64 nt, Homo Sapiens
augagagaacauuaaacuacgaaguagacacuauugcccucagacuuucaaaggcuaccuuuau

SEQ ID NO: 138994 - RNA, 64 nt, Homo Sapiens
cacaagcgggugacugacugucucauccuccgcaugcccucagcccccagauccuuaauguagu

SEQ ID NO: 138995 - RNA, 64 nt, Homo Sapiens
aagcaucauugaaauagcagcagagcccaggccuugcccucaugggagcaccauccugcccuag

SEQ ID NO: 138996 - RNA, 64 nt, Homo Sapiens
cagagaguaagaaagcccaacacucacaaaugugugcccucagcgcuuucuuuaucaaccugcu

SEQ ID NO: 138997 - RNA, 64 nt, Homo Sapiens
caugcaagugaaaggaggaggccuguaugugcgcugcccucagaauauguguguacacgcgcac

SEQ ID NO: 138998 - RNA, 64 nt, Homo Sapiens
ccacauauguguguacacgccacucaccauggucugcccucaccgacugcauccgaaaggcccc

SEQ ID NO: 138999 - RNA, 64 nt, Homo Sapiens
ggccuuugauugcucaccccugcuccccaggcccugcccucacuuuuaccaaagguucucccuc

SEQ ID NO: 139000 - RNA, 64 nt, Homo Sapiens
cuugcugaaguuaguaguacuguacuaagagcucugcccucaugugaauuccugcccuggcgcc

SEQ ID NO: 139001 - RNA, 64 nt, Homo Sapiens
caguagaaccuuuccagguucucuuagagccauaugcccucaucaucccaggggagaacuacau

SEQ ID NO: 139002 - RNA, 64 nt, Homo Sapiens
ugguguuacacauugaggcugucuuuaaggggccugcccucaucaucaacgucucagcccuuca

SEQ ID NO: 139003 - RNA, 64 nt, Homo Sapiens
ccuuccgguggagcugccucguuccuuugaacuaugcccucacccuucugcccucacuugauuu

SEQ ID NO: 139004 - RNA, 64 nt, Homo Sapiens
ugccucguuccuuugaacuaugcccucacccuucugcccucacuugauuugaaagggucguuaa

SEQ ID NO: 139005 - RNA, 64 nt, Homo Sapiens
aaggaggaguggcauuggcauccugacccagcucugcccucaagguggggauggaugggcaaag

SEQ ID NO: 139006 - RNA, 64 nt, Homo Sapiens
guuggggcuggucccagccugaggcuccagcugaugcccucagcucccagagagggggugcccc

SEQ ID NO: 139007 - RNA, 64 nt, Homo Sapiens
gccuugcuucucucagccuaggcagcccuuuggaugcccucacauucucaggaacaaaaccuga

SEQ ID NO: 139008 - RNA, 64 nt, Homo Sapiens
gagcucuuugcaguguaguggaaagaacacagucugcccucagacucaggcagggacagaccca

SEQ ID NO: 139009 - RNA, 64 nt, Homo Sapiens
cuccauuccaaaggccaucuuguggucaguuucaugcccucaccugauuuuuuuuuuuuuuuuu

SEQ ID NO: 139010 - RNA, 64 nt, Homo Sapiens
gggagaaacucacagcuccuccgggauacauaugugcccucagcagcagcucccaggugaaguu

SEQ ID NO: 139011 - RNA, 64 nt, Homo Sapiens
uucgaaugcacacucaaauaaaaaaccaaacagcugcccucauuagcggauuccguuccauuau

SEQ ID NO: 139012 - RNA, 64 nt, Homo Sapiens
aacuucauuucucuuccaacccauuguguuccucugcccucauucuuuaccuuuguuguaagaa

SEQ ID NO: 139013 - RNA, 64 nt, Homo Sapiens
gucuccucggccauccuguggggccccgaggccuugcccucacuucagugccugggugcucagg

SEQ ID NO: 139014 - RNA, 64 nt, Homo Sapiens
aaguaauaaaccguggguggugauagugacccagugcccucacugcccagccccgccuguccuc

SEQ ID NO: 139015 - RNA, 64 nt, Homo Sapiens
cacuacagcaaacaagcuacgauggucagucucuugcccucaaaccaggccagcuuucugcaug

SEQ ID NO: 139016 - RNA, 64 nt, Homo Sapiens
ccuggccaggugaugcucugcccacuccaugcucugcccucagagcagagaaacaaagucugga

SEQ ID NO: 139017 - RNA, 64 nt, Homo Sapiens
ccccgaccuuauuuauuacccccccuccaaccacugcccucagcggagcugucugcauccgcca

SEQ ID NO: 139018 - RNA, 64 nt, Homo Sapiens
agacacccuguuggccaugacugaccgguccuugugcccucaccagacccugcccggcuccucc

SEQ ID NO: 139019 - RNA, 64 nt, Homo Sapiens
ccuccccaaugcugacccuaggauuuuccuucccugcccucaccugcaaaugaguuaaagaaga

SEQ ID NO: 139020 - RNA, 64 nt, Homo Sapiens
ggggacacagugguaaucaagacagccccaacacugcccucauagagcucacaguccaauggag

SEQ ID NO: 139021 - RNA, 64 nt, Homo Sapiens
caagguagagguggcaggggccuggaugcccaccugcccucaggcuguccaucccacagcucag

SEQ ID NO: 139022 - RNA, 64 nt, Homo Sapiens
gcccacucugcccacacuucggagcugccugccuugcccucacuggaauccaggucccccaggu

SEQ ID NO: 139023 - RNA, 64 nt, Homo Sapiens
cuaagggccacucugguuaucugccaagguugcuugcccucaccccaaugcuccaacagccauu

SEQ ID NO: 139024 - RNA, 64 nt, Homo Sapiens
auaccuccucccguugggcugugacuuuuccuccugcccucagccucugaaacagaaaucuuug

SEQ ID NO: 139025 - RNA, 64 nt, Homo Sapiens
aggucguuaaaaauucaaauuuuaauuuaccugaugcccucaucuaagaaucuucccaaaaucc

SEQ ID NO: 139026 - RNA, 64 nt, Homo Sapiens
agugacagcagcuuaggugugguaccagggguugugcccucagcgugacagccucacagggucu

SEQ ID NO: 139027 - RNA, 64 nt, Homo Sapiens
cacugaugucuguccccaggccagggccuccagcugcccucagaucaucugaacuuccguuucc

SEQ ID NO: 139028 - RNA, 64 nt, Homo Sapiens
gacuggccaguccagcccagacaggcccugccccugcccucagugaagggugagggggucagac

SEQ ID NO: 139029 - RNA, 64 nt, Homo Sapiens; identical to SEQ ID NO: 58216

SEQ ID NO: 139030 - RNA, 64 nt, Homo Sapiens; identical to SEQ ID NO: 58217

SEQ ID NO: 139031 - RNA, 64 nt, Homo Sapiens; identical to SEQ ID NO: 58218

SEQ ID NO: 139032 - RNA, 64 nt, Homo Sapiens; identical to SEQ ID NO: 58219

SEQ ID NO: 139033 - RNA, 64 nt, Homo Sapiens; identical to SEQ ID NO: 58220

SEQ ID NO: 139034 - RNA, 64 nt, Homo Sapiens; identical to SEQ ID NO: 58221

SEQ ID NO: 139035 - RNA, 64 nt, Homo Sapiens; identical to SEQ ID NO: 58222

SEQ ID NO: 139036 - RNA, 64 nt, Homo Sapiens; identical to SEQ ID NO: 58223

SEQ ID NO: 139037 - RNA, 64 nt, Homo Sapiens; identical to SEQ ID NO: 58224

SEQ ID NO: 139038 - RNA, 64 nt, Homo Sapiens; identical to SEQ ID NO: 58225

SEQ ID NO: 139039 - RNA, 64 nt, Homo Sapiens; identical to SEQ ID NO: 58226

SEQ ID NO: 139040 - RNA, 64 nt, Homo Sapiens; identical to SEQ ID NO: 58227

SEQ ID NO: 139041 - RNA, 64 nt, Homo Sapiens; identical to SEQ ID NO: 58228

SEQ ID NO: 139042 - RNA, 64 nt, Homo Sapiens; identical to SEQ ID NO: 58229

SEQ ID NO: 139043 - RNA, 64 nt, Homo Sapiens; identical to SEQ ID NO: 58230

SEQ ID NO: 139044 - RNA, 64 nt, Homo Sapiens; identical to SEQ ID NO: 58231

SEQ ID NO: 139045 - RNA, 64 nt, Homo Sapiens; identical to SEQ ID NO: 58232

SEQ ID NO: 139046 - RNA, 64 nt, Homo Sapiens; identical to SEQ ID NO: 58233

SEQ ID NO: 139047 - RNA, 64 nt, Homo Sapiens; identical to SEQ ID NO: 58234

SEQ ID NO: 139048 - RNA, 64 nt, Homo Sapiens; identical to SEQ ID NO: 58235

SEQ ID NO: 139049 - RNA, 64 nt, Homo Sapiens; identical to SEQ ID NO: 58236

SEQ ID NO: 139050 - RNA, 64 nt, Homo Sapiens; identical to SEQ ID NO: 58237

SEQ ID NO: 139051 - RNA, 64 nt, Homo Sapiens; identical to SEQ ID NO: 58238

SEQ ID NO: 139052 - RNA, 64 nt, Homo Sapiens; identical to SEQ ID NO: 58239

SEQ ID NO: 139053 - RNA, 64 nt, Homo Sapiens; identical to SEQ ID NO: 58240

SEQ ID NO: 139054 - RNA, 64 nt, Homo Sapiens; identical to SEQ ID NO: 58241

SEQ ID NO: 139055 - RNA, 64 nt, Homo Sapiens; identical to SEQ ID NO: 58242

SEQ ID NO: 139056 - RNA, 64 nt, Homo Sapiens; identical to SEQ ID NO: 58243

SEQ ID NO: 139057 - RNA, 64 nt, Homo Sapiens; identical to SEQ ID NO: 58244

SEQ ID NO: 139058 - RNA, 64 nt, Homo Sapiens; identical to SEQ ID NO: 58245

SEQ ID NO: 139059 - RNA, 64 nt, Homo Sapiens; identical to SEQ ID NO: 58246

SEQ ID NO: 139060 - RNA, 64 nt, Homo Sapiens; identical to SEQ ID NO: 58247

SEQ ID NO: 139061 - RNA, 64 nt, Homo Sapiens; identical to SEQ ID NO: 58248

SEQ ID NO: 139062 - RNA, 64 nt, Homo Sapiens; identical to SEQ ID NO: 58249

SEQ ID NO: 139063 - RNA, 64 nt, Homo Sapiens; identical to SEQ ID NO: 58250

SEQ ID NO: 139064 - RNA, 64 nt, Homo Sapiens; identical to SEQ ID NO: 58251

SEQ ID NO: 139065 - RNA, 64 nt, Homo Sapiens; identical to SEQ ID NO: 58252

SEQ ID NO: 139066 - RNA, 64 nt, Homo Sapiens; identical to SEQ ID NO: 58253

SEQ ID NO: 139067 - RNA, 64 nt, Homo Sapiens; identical to SEQ ID NO: 58254

SEQ ID NO: 139068 - RNA, 64 nt, Homo Sapiens; identical to SEQ ID NO: 58255

SEQ ID NO: 139069 - RNA, 64 nt, Homo Sapiens; identical to SEQ ID NO: 58256

SEQ ID NO: 139070 - RNA, 64 nt, Homo Sapiens; identical to SEQ ID NO: 58257

SEQ ID NO: 139071 - RNA, 64 nt, Homo Sapiens; identical to SEQ ID NO: 58258

SEQ ID NO: 139072 - RNA, 64 nt, Homo Sapiens; identical to SEQ ID NO: 58259

SEQ ID NO: 139073 - RNA, 64 nt, Homo Sapiens; identical to SEQ ID NO: 58260

SEQ ID NO: 139074 - RNA, 64 nt, Homo Sapiens; identical to SEQ ID NO: 58261

SEQ ID NO: 139075 - RNA, 64 nt, Homo Sapiens; identical to SEQ ID NO: 58262

SEQ ID NO: 139076 - RNA, 64 nt, Homo Sapiens; identical to SEQ ID NO: 58263

SEQ ID NO: 139077 - RNA, 64 nt, Homo Sapiens; identical to SEQ ID NO: 58264

SEQ ID NO: 139078 - RNA, 64 nt, Homo Sapiens; identical to SEQ ID NO: 58265

SEQ ID NO: 139079 - RNA, 64 nt, Homo Sapiens; identical to SEQ ID NO: 58266

SEQ ID NO: 139080 - RNA, 64 nt, Homo Sapiens; identical to SEQ ID NO: 58267

SEQ ID NO: 139081 - RNA, 64 nt, Homo Sapiens; identical to SEQ ID NO: 58268

SEQ ID NO: 139082 - RNA, 60 nt, Homo Sapiens
uagucuggucauuuuguuuagaaauggccaggcacaaauuaauggcuauggcguuagguu

SEQ ID NO: 139083 - RNA, 60 nt, Homo Sapiens
accaaauauugguuaugaugguggccacauggcacaaaacgaugugaaacugacaauccu

SEQ ID NO: 139084 - RNA, 60 nt, Homo Sapiens
cucagcaauuuuuuucccucuugagacagaggcacaaagauauauuucucucacccuauu

SEQ ID NO: 139085 - RNA, 60 nt, Homo Sapiens
auuugacaguacaagucaaaaugaagccagggcacaaagaaaacuauuuucuucuucucc

SEQ ID NO: 139086 - RNA, 60 nt, Homo Sapiens
uuauaauuuuuuaaaugaaaggaggcagagggcacaaacccccaggcucugcucaggcug

SEQ ID NO: 139087 - RNA, 60 nt, Homo Sapiens
ggcccggccuuuggcagaggaauaacacguggcacaaaugcaaggagucccuccagccug

SEQ ID NO: 139088 - RNA, 60 nt, Homo Sapiens
gugagucugggauauucuuuagcuuaccugggcacaaacagaauuuuccauuuauuaagc

SEQ ID NO: 139089 - RNA, 60 nt, Homo Sapiens
gccaguuacuugggcuucaacagccaagcuggcacaaaagacagcuggcggaggcugcuc

SEQ ID NO: 139090 - RNA, 64 nt, Homo Sapiens
ggugaacacccaccgagacagcgccuucauauuccucagccagagccuggaguaugccaagaac

SEQ ID NO: 139091 - RNA, 64 nt, Homo Sapiens
ccuggcugccgcacgggaacucauggguguguuacucagccaccacccaccgcuggagccccag

SEQ ID NO: 139092 - RNA, 64 nt, Homo Sapiens
caaucuccugggccuuaaaggaugcggacucauccucagccagcgcccauguugugauacaggg

SEQ ID NO: 139093 - RNA, 64 nt, Homo Sapiens
ccucacugcagcugccagcacuuggucagucacucucagccauagcacuuuguucacuguccug

SEQ ID NO: 139094 - RNA, 64 nt, Homo Sapiens
ggaaccccaucuucagcccauuucucagaggccccucagccacuggucccagggcccuuccuug

SEQ ID NO: 139095 - RNA, 64 nt, Homo Sapiens
cugggggagccggacauggcggaggcgccguggacucagccaggcucucccgagggcugggcag

SEQ ID NO: 139096 - RNA, 64 nt, Homo Sapiens
agcgggugacugacuguuccauccuccgcaugcccucagccacaagauccuuaauguaguucuc

SEQ ID NO: 139097 - RNA, 64 nt, Homo Sapiens
gaguaagaaagcccaaaucucacaaaugugugcccucagccagaucuuuaucaaccugcucacu

SEQ ID NO: 139098 - RNA, 64 nt, Homo Sapiens
uguuacaagcuacagaauaucaguuuaagguggucucagccaauucccacuauaagucaaguug

SEQ ID NO: 139099 - RNA, 64 nt, Homo Sapiens
ccugagacuugguauaaaauuaaccauggcuucccucagccauuaauuauaccuucugaucaaa

SEQ ID NO: 139100 - RNA, 64 nt, Homo Sapiens
cuuggauacucacauuaggaguggcuuagaaggccucagccaugaagagugggauuaggcugaa

SEQ ID NO: 139101 - RNA, 64 nt, Homo Sapiens
uuugugaguccuucaagagcaagcuuacaucuuccucagccaucgaauguauuuuuuucuggac

SEQ ID NO: 139102 - RNA, 64 nt, Homo Sapiens
ugggaugugacaagaagcagaaggagccucccagcucagccacguggauucuucauugcaagug

SEQ ID NO: 139103 - RNA, 64 nt, Homo Sapiens
ucugaaccuucuucaaacaguaguacaagcuccccucagccagccugccugcccagcgaggccc

SEQ ID NO: 139104 - RNA, 64 nt, Homo Sapiens
ucucagcccgccccguguggccgcccggguguggcucagccauguccccuccccagguccuuca

SEQ ID NO: 139105 - RNA, 64 nt, Homo Sapiens
auguuuauguccccccuucucuuccugagugauucucagccaaguccagacagugcucggcggg

SEQ ID NO: 139106 - RNA, 64 nt, Homo Sapiens
gagccauugugggguccccaggaaagggcaagggcucagccacaucuuggggucugggaggccc

SEQ ID NO: 139107 - RNA, 64 nt, Homo Sapiens
cuugcccugcuggccacacucuggagaagcacuucucagccaaggcaccccugcccugggacug

SEQ ID NO: 139108 - RNA, 64 nt, Homo Sapiens
caacauggggugaaccucaguuugucccuccagccucagccaaguccaguauggccccaccaug

SEQ ID NO: 139109 - RNA, 64 nt, Homo Sapiens
gcagagccaaucacagaccccgcuaccacaccagcucagccacagacucugcauccccugcacc

SEQ ID NO: 139110 - RNA, 64 nt, Homo Sapiens
uucuccacggcagcgaccucucuucccaccaguccucagccaccaugccaguguggagagcgcc

SEQ ID NO: 139111 - RNA, 64 nt, Homo Sapiens
gcacacugcagggcugcuguggcccagucguccgcucagccaaggagucagauggcaaugggua

SEQ ID NO: 139112 - RNA, 64 nt, Homo Sapiens
ugagcuuucuagccuaaguguggagaaggauagccucagccacaaaacucugucaggcauugaa

SEQ ID NO: 139113 - RNA, 64 nt, Homo Sapiens
guggguccugggggaaauaccuuaacugcugagccucagccagcaguauuuuuuguuuuuguuc

SEQ ID NO: 139114 - RNA, 64 nt, Homo Sapiens
aucugccuaagauuaugauucuuguaguauccugcucagccaagacaaugucacucacccuccc

SEQ ID NO: 139115 - RNA, 64 nt, Homo Sapiens
cucuggcucagcggggcccacaagcgcccacgugcucagccaccgaacucugcugauggggacc

SEQ ID NO: 139116 - RNA, 52 nt, Homo Sapiens; identical to SEQ ID NO: 112167

SEQ ID NO: 139117 - RNA, 64 nt, Homo Sapiens
gugcugagccaccauuucagacugagucugcacccucagccacaugaacaaucuccccuaccuc

SEQ ID NO: 139118 - RNA, 64 nt, Homo Sapiens
acagcauuuucuuacacccccuccccagcgugcccucagccaagugcuuuggcccggugcuucc

SEQ ID NO: 139119 - RNA, 64 nt, Homo Sapiens
ugggugugcgcagagcugucugcugcucccucuccucagccagugucacucagccaaaucuguc

SEQ ID NO: 139120 - RNA, 64 nt, Homo Sapiens
ucugucugcugcucccucucacccugcagagucacucagccaaaucuuccuugccuuuagagug

SEQ ID NO: 139121 - RNA, 64 nt, Homo Sapiens
aaccaacauuguuuacauuccaggagacuuguagcucagccacacacgcaguaaugaccugugc

SEQ ID NO: 139122 - RNA, 64 nt, Homo Sapiens
ucgcauguaugaauaucuaguccuuucugugguucucagccaagacauaaaaacuaggacucag

SEQ ID NO: 139123 - RNA, 64 nt, Homo Sapiens
gagaacuacaaaaauacaaaaugcuuguccaggacucagccaugcacaccuugagcagcgccgg

SEQ ID NO: 139124 - RNA, 64 nt, Homo Sapiens
cccccagcaccuugcacauagcaaagagaagguccucagccauguaucuucagggucacucugg

SEQ ID NO: 139125 - RNA, 64 nt, Homo Sapiens
cagacaugagacauggcggagaucccugaagugacucagccagggcucucuggugccagcacgg

SEQ ID NO: 139126 - RNA, 64 nt, Homo Sapiens
gccccccaucccugaccucaugcucuccuccuuucucagccaugcuuugcaccccaugcagagg

SEQ ID NO: 139127 - RNA, 64 nt, Homo Sapiens
cucuucagccaaaugccccacagaggggaaguuccucagccagauccccuccucccguccaccc

SEQ ID NO: 139128 - RNA, 64 nt, Homo Sapiens
uugugaauauccagacuguuucagcccagcccaucucagccaacccuccuuagacugagcuguc

SEQ ID NO: 139129 - RNA, 64 nt, Homo Sapiens
uggagaugcccauggcaugggcacugcccacaggcucagccagaaccucuugguguacccgaua

SEQ ID NO: 139130 - RNA, 64 nt, Homo Sapiens
ccguguguaggcuuagccuccccuuacccuguuacucagccacggaggaaacgaucucccuauu

SEQ ID NO: 139131 - RNA, 64 nt, Homo Sapiens
cacgugggcauccacuccuugcgggcccaggagccucagccagcccagcggggggacggaggcg

SEQ ID NO: 139132 - RNA, 64 nt, Homo Sapiens
auaaucuccaaagaaagaauaagucuccaaggagcacaaaaaaaucauauguaccaaggauguu

SEQ ID NO: 139133 - RNA, 64 nt, Homo Sapiens
gaaauuaucuugagucuacacauuauuuuuaaaacacaaaaauuguucggcuggaacugaccca

SEQ ID NO: 139134 - RNA, 64 nt, Homo Sapiens
uauugaagcaacaaauauuucuaaauauuuuuuacacaaaaaugggcaggguaguaagcugaca

SEQ ID NO: 139135 - RNA, 64 nt, Homo Sapiens
uacagacaaucaaaacauugaugacuugcacagacacaaaaauaaggcuggcagagauuuaugu

SEQ ID NO: 139136 - RNA, 64 nt, Homo Sapiens
gcuuucuggguuguaggcccccacaagcuuggcucacaaaaagaauagacgaggcacuuuggaa

SEQ ID NO: 139137 - RNA, 64 nt, Homo Sapiens
cgagaaaucuuccaccaugcuaucaagaugccagcacaaaaauuaguauccuaaggacagggga

SEQ ID NO: 139138 - RNA, 64 nt, Homo Sapiens
aagcuaccuaugauccuggaaacacaaaacauaacacaaaaaagcaaggcacaacacaaaaacc

SEQ ID NO: 139139 - RNA, 64 nt, Homo Sapiens
aacacaaaacauaacacaaagcaucaaggcacaacacaaaaaccuaaagcaaaggaguacuaca

SEQ ID NO: 139140 - RNA, 64 nt, Homo Sapiens
aagggugaagauggucucucuucuaaauaaauuccacaaaaacaagaaucucucaauaaaauuu

SEQ ID NO: 139141 - RNA, 64 nt, Homo Sapiens
cucaggcacauuaaauuauuaugacauguauuugcacaaaaauuaugcauauuuuuaaugaaag

SEQ ID NO: 139142 - RNA, 64 nt, Homo Sapiens
ugcaacccccagcauaaaugggucugauuuuucacacaaaaaaucugcucaaagucauugccaa

SEQ ID NO: 139143 - RNA, 64 nt, Homo Sapiens
ugcuauuuuuauuggaacuuacagcucucuuggucacaaaaacaauuuuaaaugugccuauuuc

SEQ ID NO: 139144 - RNA, 64 nt, Homo Sapiens
gguuaagaaguccuaguugaacagcagcucauagcacaaaaaaagagggauggaccagacugcc

SEQ ID NO: 139145 - RNA, 64 nt, Homo Sapiens
gaugaaauguaauuucuaaagagcuauguacugccacaaaaaaaagauaccauuauauuuauau

SEQ ID NO: 139146 - RNA, 64 nt, Homo Sapiens
agccagugccuauugaguauaaaaaaagccacaucacaaaaaaaaguguggaaagccacaucac

SEQ ID NO: 139147 - RNA, 64 nt, Homo Sapiens
gccacaucacaaaaaaaagcguggaaagccacaucacaaaaaaauucuggacuucuacaauagu

SEQ ID NO: 139148 - RNA, 64 nt, Homo Sapiens
gaaauucauauaaugacuuaacuacagugaaauacacaaaaaauugucauuuuguugucacagc

SEQ ID NO: 139149 - RNA, 64 nt, Homo Sapiens
uauccugccauucgagugcugugaaggauuacaacacaaaaagucagaguuuguuuuucuauau

SEQ ID NO: 139150 - RNA, 64 nt, Homo Sapiens
gauacugugagccagagagaaaguaaaagcacuucacaaaaaaaugaaaauucuaaggacauac

SEQ ID NO: 139151 - RNA, 64 nt, Homo Sapiens
augagaguuuuuacagcucaucauucaaauaacgcacaaaaaacaaaagccgcuaugaccggcg

SEQ ID NO: 139152 - RNA, 64 nt, Homo Sapiens
gaauucugaaucaucuugaaaauaagauuccaaccacaaaaaaaauuuagccauuucuuuacua

SEQ ID NO: 139153 - RNA, 64 nt, Homo Sapiens
uucacaucauguauugugauguuucaaugugagacacaaaaacaauggcuugaaacuuguguau

SEQ ID NO: 139154 - RNA, 64 nt, Homo Sapiens
aauuguuaauacauagucccaaucuuuuucauugcacaaaaaucuaggguugacuugguaaaug

SEQ ID NO: 139155 - RNA, 64 nt, Homo Sapiens
cugggcgacagagcaggacucucucucaaaaaaacacaaaaaaacaaaaacaaaaaaccauaca

SEQ ID NO: 139156 - RNA, 64 nt, Homo Sapiens
caauggaauauaauggaauauucuugagacugaucacaaaaaaaaaaaccuuuuuaauauuucu

SEQ ID NO: 139157 - RNA, 64 nt, Homo Sapiens
acaaugcauccaaaaaaucuuuuuaaacagauuacacaaaaauuauuuccagaaaggcuaccau

SEQ ID NO: 139158 - RNA, 64 nt, Homo Sapiens
cuaaauauuacuuuacacaguaagaugugaaauucacaaaaaguaaaccaaacaaaacgaauga

SEQ ID NO: 139159 - RNA, 64 nt, Homo Sapiens
augcaaauguuuauuuugaagcaggcauugacaacacaaaaacuguguaguggucuugaugcug

SEQ ID NO: 139160 - RNA, 64 nt, Homo Sapiens
gguaauaaauauuucauuuuaaaagguguuaagucacaaaaagcgugacguuauguuaaaaaaa

SEQ ID NO: 139161 - RNA, 64 nt, Homo Sapiens
aguuauuaauggucauugaagcagcuuuccucaacacaaaaaaaacaaaacaaucuuaaguugg

SEQ ID NO: 139162 - RNA, 64 nt, Homo Sapiens
ugauauaaacaggaucuaagauuuuguguaaauucacaaaaaugguuuuaaagcuauaaaugga

SEQ ID NO: 139163 - RNA, 64 nt, Homo Sapiens
uaguuugaguguuaugaauaaaaacauaaauggccacaaaaaaguaccauacaaucuaguguca

SEQ ID NO: 139164 - RNA, 64 nt, Homo Sapiens
cugggaacgcucuuguugcuuggugcaacagaagcacaaaaaucaauaaacacugugauugcac

SEQ ID NO: 139165 - RNA, 64 nt, Homo Sapiens
gcuaaccaauuugagauucaugauuaauuauguacacaaaaauauuuuccuuguagaaaauagu

SEQ ID NO: 139166 - RNA, 64 nt, Homo Sapiens
agcaauuaaaucuaaaauaaaguaaauuacaugacacaaaaagggaaaauucaaggaauggaag

SEQ ID NO: 139167 - RNA, 64 nt, Homo Sapiens
aagagaguaaaaauuacgugcaucaucucaacuucacaaaaagcugacaacgucugaacccacu

SEQ ID NO: 139168 - RNA, 64 nt, Homo Sapiens
cauuuccuuggccaaacaaaaauagcuacaaauccacaaaaauuuacuauuccaguaaggcaga

SEQ ID NO: 139169 - RNA, 64 nt, Homo Sapiens
aguuugaaaaaaauacauaacuaauuuaauuuuacacaaaaauauuuaugcagauuuucagaau

SEQ ID NO: 139170 - RNA, 64 nt, Homo Sapiens
caggaggaaagaaacgauuuuaaaucauuaaaaacacaaaaacuaagugcgaacggaacagagu

SEQ ID NO: 139171 - RNA, 64 nt, Homo Sapiens
gucccucccagcuuuagguuaugaagauuuuacucacaaaaaaaaucaacaaaaaucacgaaac

SEQ ID NO: 139172 - RNA, 64 nt, Homo Sapiens
agaaggggagcagauaucuucagaugggaaaaaucacaaaaauguauuacguugaguuugcaac

SEQ ID NO: 139173 - RNA, 64 nt, Homo Sapiens
auauucuugaaaauugcucucaauaaauggucagcacaaaaaagagcccuggucagucaagucc

SEQ ID NO: 139174 - RNA, 64 nt, Homo Sapiens
ugcuaaaauagauacaaacucaauuuugcauagaaagguguauuuugaauaguucccauguugu

SEQ ID NO: 139175 - RNA, 64 nt, Homo Sapiens
aaauauuuaacuagagcaugauauuuuaaauguuaagguguaacauauguuaaauaaaacuguu

SEQ ID NO: 139176 - RNA, 64 nt, Homo Sapiens
uuaucugauaucaagucaaaaucaguuugaaaagaagguguaucauauuuuauauugucacuag

SEQ ID NO: 139177 - RNA, 64 nt, Homo Sapiens
uaaaauauuuauauuucuaaauccgagguauuucaagguguaguauccuauuucaaaggagaua

SEQ ID NO: 139178 - RNA, 64 nt, Homo Sapiens; identical to SEQ ID NO: 83525

SEQ ID NO: 139179 - RNA, 64 nt, Homo Sapiens; identical to SEQ ID NO: 83526

SEQ ID NO: 139180 - RNA, 64 nt, Homo Sapiens; identical to SEQ ID NO: 83527

SEQ ID NO: 139181 - RNA, 64 nt, Homo Sapiens; identical to SEQ ID NO: 83528

SEQ ID NO: 139182 - RNA, 64 nt, Homo Sapiens; identical to SEQ ID NO: 83529

SEQ ID NO: 139183 - RNA, 64 nt, Homo Sapiens; identical to SEQ ID NO: 83530

SEQ ID NO: 139184 - RNA, 64 nt, Homo Sapiens; identical to SEQ ID NO: 83531

SEQ ID NO: 139185 - RNA, 64 nt, Homo Sapiens; identical to SEQ ID NO: 83532

SEQ ID NO: 139186 - RNA, 64 nt, Homo Sapiens; identical to SEQ ID NO: 83533

SEQ ID NO: 139187 - RNA, 64 nt, Homo Sapiens; identical to SEQ ID NO: 83534

SEQ ID NO: 139188 - RNA, 64 nt, Homo Sapiens; identical to SEQ ID NO: 83535

SEQ ID NO: 139189 - RNA, 64 nt, Homo Sapiens; identical to SEQ ID NO: 83536

SEQ ID NO: 139190 - RNA, 64 nt, Homo Sapiens; identical to SEQ ID NO: 83537

SEQ ID NO: 139191 - RNA, 64 nt, Homo Sapiens; identical to SEQ ID NO: 83538

SEQ ID NO: 139192 - RNA, 64 nt, Homo Sapiens; identical to SEQ ID NO: 83539

SEQ ID NO: 139193 - RNA, 64 nt, Homo Sapiens; identical to SEQ ID NO: 83540

SEQ ID NO: 139194 - RNA, 64 nt, Homo Sapiens; identical to SEQ ID NO: 83541

SEQ ID NO: 139195 - RNA, 64 nt, Homo Sapiens; identical to SEQ ID NO: 83542

SEQ ID NO: 139196 - RNA, 64 nt, Homo Sapiens; identical to SEQ ID NO: 83543

SEQ ID NO: 139197 - RNA, 64 nt, Homo Sapiens; identical to SEQ ID NO: 83544

SEQ ID NO: 139198 - RNA, 64 nt, Homo Sapiens; identical to SEQ ID NO: 83545

SEQ ID NO: 139199 - RNA, 64 nt, Homo Sapiens; identical to SEQ ID NO: 83546

SEQ ID NO: 139200 - RNA, 64 nt, Homo Sapiens; identical to SEQ ID NO: 83547

SEQ ID NO: 139201 - RNA, 64 nt, Homo Sapiens; identical to SEQ ID NO: 83548

SEQ ID NO: 139202 - RNA, 64 nt, Homo Sapiens; identical to SEQ ID NO: 83549

SEQ ID NO: 139203 - RNA, 64 nt, Homo Sapiens; identical to SEQ ID NO: 83550

SEQ ID NO: 139204 - RNA, 64 nt, Homo Sapiens; identical to SEQ ID NO: 83551

SEQ ID NO: 139205 - RNA, 64 nt, Homo Sapiens; identical to SEQ ID NO: 83552

SEQ ID NO: 139206 - RNA, 64 nt, Homo Sapiens; identical to SEQ ID NO: 83553

SEQ ID NO: 139207 - RNA, 64 nt, Homo Sapiens; identical to SEQ ID NO: 83554

SEQ ID NO: 139208 - RNA, 64 nt, Homo Sapiens; identical to SEQ ID NO: 83555

SEQ ID NO: 139209 - RNA, 64 nt, Homo Sapiens; identical to SEQ ID NO: 83556

SEQ ID NO: 139210 - RNA, 64 nt, Homo Sapiens; identical to SEQ ID NO: 83557

SEQ ID NO: 139211 - RNA, 64 nt, Homo Sapiens; identical to SEQ ID NO: 83558

SEQ ID NO: 139212 - RNA, 64 nt, Homo Sapiens; identical to SEQ ID NO: 83559

SEQ ID NO: 139213 - RNA, 64 nt, Homo Sapiens; identical to SEQ ID NO: 83560

SEQ ID NO: 139214 - RNA, 64 nt, Homo Sapiens; identical to SEQ ID NO: 83561

SEQ ID NO: 139215 - RNA, 64 nt, Homo Sapiens
ggaaacuugauuugagauuuuuaugccugugacuuccuuggaaaucaaauguaaaguuuaauug

SEQ ID NO: 139216 - RNA, 64 nt, Homo Sapiens
cugcauaguucccaugcacgcugggcaaugagaauccuuggaaacauuggugaugcuaucaguu

SEQ ID NO: 139217 - RNA, 64 nt, Homo Sapiens
gcuaucuuuuaagaagagaugauguugaaccugcuccuuggaccucugaaggaauagaacgguc

SEQ ID NO: 139218 - RNA, 64 nt, Homo Sapiens
uuugauuuuacagaaaaggaaaugacacuugagauccuuggaaugaacacagcuucuaaagugu

SEQ ID NO: 139219 - RNA, 64 nt, Homo Sapiens
aggggucaugagguccaucagucuucuggagcccuccuuggagcuggagagcaccucagagacc

SEQ ID NO: 139220 - RNA, 64 nt, Homo Sapiens
ccacgcuccccugacacugaagaggauccacaacuccuuggagaaacacccucacgucuguugc

SEQ ID NO: 139221 - RNA, 64 nt, Homo Sapiens
gauucagcacgaguagauggacgcuggagcaaucuccuuggaagaagcgaggaccuggagauaa

SEQ ID NO: 139222 - RNA, 64 nt, Homo Sapiens
uggaucauuggauucaaaucucacuggaucccaauccuuggagcagguuuggauuggagagggc

SEQ ID NO: 139223 - RNA, 64 nt, Homo Sapiens
cuucucagccaaguggcggucuuggauccuuugguccuuggaugaaugauacucaucaaguaug

SEQ ID NO: 139224 - RNA, 64 nt, Homo Sapiens
ccaaguucucacccuguccacucuccaacuuucuuccuuggaggacaaaagcaaggggcauuuc

SEQ ID NO: 139225 - RNA, 64 nt, Homo Sapiens
agaccacucucuugugggacgagggaaccagccauccuuggaaaaggggugggagggguggagg

SEQ ID NO: 139226 - RNA, 64 nt, Homo Sapiens
ucacccacuuguaagccagcgcuucuucucuccauccuuggaccuucacaaaugcccugagacg

SEQ ID NO: 139227 - RNA, 64 nt, Homo Sapiens
guuucccugguguagagcuuguguucuuggcccauccuuggagcuuuauaagugaccugagugg

SEQ ID NO: 139228 - RNA, 64 nt, Homo Sapiens
ccagacagucuuugaguaacaucuguucccaucuuccuuggaagcaggacacaccagcuccucc

SEQ ID NO: 139229 - RNA, 64 nt, Homo Sapiens
gggcagcccucuaccugggccccgggagccgugcuccuuggaacgcaaagggccgaggagcauc

SEQ ID NO: 139230 - RNA, 64 nt, Homo Sapiens; identical to SEQ ID NO: 52440

SEQ ID NO: 139231 - RNA, 64 nt, Homo Sapiens; identical to SEQ ID NO: 52441

SEQ ID NO: 139232 - RNA, 64 nt, Homo Sapiens; identical to SEQ ID NO: 52442

SEQ ID NO: 139233 - RNA, 50 nt, Homo Sapiens; identical to SEQ ID NO: 52443

SEQ ID NO: 139234 - RNA, 64 nt, Homo Sapiens; identical to SEQ ID NO: 52444

SEQ ID NO: 139235 - RNA, 64 nt, Homo Sapiens; identical to SEQ ID NO: 52445

SEQ ID NO: 139236 - RNA, 64 nt, Homo Sapiens; identical to SEQ ID NO: 52446

SEQ ID NO: 139237 - RNA, 64 nt, Homo Sapiens; identical to SEQ ID NO: 52447

SEQ ID NO: 139238 - RNA, 64 nt, Homo Sapiens; identical to SEQ ID NO: 52448

SEQ ID NO: 139239 - RNA, 64 nt, Homo Sapiens; identical to SEQ ID NO: 52449

SEQ ID NO: 139240 - RNA, 64 nt, Homo Sapiens; identical to SEQ ID NO: 52450

SEQ ID NO: 139241 - RNA, 64 nt, Homo Sapiens; identical to SEQ ID NO: 52451

SEQ ID NO: 139242 - RNA, 64 nt, Homo Sapiens; identical to SEQ ID NO: 52452

SEQ ID NO: 139243 - RNA, 64 nt, Homo Sapiens; identical to SEQ ID NO: 52453

SEQ ID NO: 139244 - RNA, 64 nt, Homo Sapiens; identical to SEQ ID NO: 52454

SEQ ID NO: 139245 - RNA, 64 nt, Homo Sapiens; identical to SEQ ID NO: 52455

SEQ ID NO: 139246 - RNA, 64 nt, Homo Sapiens; identical to SEQ ID NO: 52456

SEQ ID NO: 139247 - RNA, 64 nt, Homo Sapiens; identical to SEQ ID NO: 52457

SEQ ID NO: 139248 - RNA, 64 nt, Homo Sapiens; identical to SEQ ID NO: 52458

SEQ ID NO: 139249 - RNA, 64 nt, Homo Sapiens; identical to SEQ ID NO: 52459

SEQ ID NO: 139250 - RNA, 64 nt, Homo Sapiens; identical to SEQ ID NO: 52460

SEQ ID NO: 139251 - RNA, 64 nt, Homo Sapiens; identical to SEQ ID NO: 52461

SEQ ID NO: 139252 - RNA, 64 nt, Homo Sapiens; identical to SEQ ID NO: 52462

SEQ ID NO: 139253 - RNA, 64 nt, Homo Sapiens; identical to SEQ ID NO: 52463

SEQ ID NO: 139254 - RNA, 64 nt, Homo Sapiens; identical to SEQ ID NO: 52464

SEQ ID NO: 139255 - RNA, 64 nt, Homo Sapiens; identical to SEQ ID NO: 52465

SEQ ID NO: 139256 - RNA, 64 nt, Homo Sapiens; identical to SEQ ID NO: 52466

SEQ ID NO: 139257 - RNA, 64 nt, Homo Sapiens; identical to SEQ ID NO: 52467

SEQ ID NO: 139258 - RNA, 64 nt, Homo Sapiens; identical to SEQ ID NO: 52468

SEQ ID NO: 139259 - RNA, 64 nt, Homo Sapiens; identical to SEQ ID NO: 52469

SEQ ID NO: 139260 - RNA, 64 nt, Homo Sapiens; identical to SEQ ID NO: 52470

SEQ ID NO: 139261 - RNA, 64 nt, Homo Sapiens; identical to SEQ ID NO: 52471

SEQ ID NO: 139262 - RNA, 64 nt, Homo Sapiens; identical to SEQ ID NO: 52472

SEQ ID NO: 139263 - RNA, 64 nt, Homo Sapiens; identical to SEQ ID NO: 52473

SEQ ID NO: 139264 - RNA, 64 nt, Homo Sapiens; identical to SEQ ID NO: 52474

SEQ ID NO: 139265 - RNA, 64 nt, Homo Sapiens; identical to SEQ ID NO: 52475

SEQ ID NO: 139266 - RNA, 64 nt, Homo Sapiens; identical to SEQ ID NO: 52476

SEQ ID NO: 139267 - RNA, 64 nt, Homo Sapiens; identical to SEQ ID NO: 52477

SEQ ID NO: 139268 - RNA, 64 nt, Homo Sapiens; identical to SEQ ID NO: 52478

SEQ ID NO: 139269 - RNA, 64 nt, Homo Sapiens; identical to SEQ ID NO: 52479

SEQ ID NO: 139270 - RNA, 64 nt, Homo Sapiens; identical to SEQ ID NO: 52480

SEQ ID NO: 139271 - RNA, 64 nt, Homo Sapiens; identical to SEQ ID NO: 52481

SEQ ID NO: 139272 - RNA, 64 nt, Homo Sapiens; identical to SEQ ID NO: 52482

SEQ ID NO: 139273 - RNA, 64 nt, Homo Sapiens; identical to SEQ ID NO: 52483

SEQ ID NO: 139274 - RNA, 64 nt, Homo Sapiens; identical to SEQ ID NO: 52484

SEQ ID NO: 139275 - RNA, 64 nt, Homo Sapiens; identical to SEQ ID NO: 52485

SEQ ID NO: 139276 - RNA, 64 nt, Homo Sapiens; identical to SEQ ID NO: 52486

SEQ ID NO: 139277 - RNA, 64 nt, Homo Sapiens; identical to SEQ ID NO: 52487

SEQ ID NO: 139278 - RNA, 64 nt, Homo Sapiens; identical to SEQ ID NO: 52488

SEQ ID NO: 139279 - RNA, 64 nt, Homo Sapiens; identical to SEQ ID NO: 52489

SEQ ID NO: 139280 - RNA, 64 nt, Homo Sapiens; identical to SEQ ID NO: 52490

SEQ ID NO: 139281 - RNA, 64 nt, Homo Sapiens; identical to SEQ ID NO: 52491

SEQ ID NO: 139282 - RNA, 64 nt, Homo Sapiens; identical to SEQ ID NO: 52492

SEQ ID NO: 139283 - RNA, 64 nt, Homo Sapiens; identical to SEQ ID NO: 52493

SEQ ID NO: 139284 - RNA, 64 nt, Homo Sapiens; identical to SEQ ID NO: 52494

SEQ ID NO: 139285 - RNA, 64 nt, Homo Sapiens; identical to SEQ ID NO: 52495

SEQ ID NO: 139286 - RNA, 64 nt, Homo Sapiens; identical to SEQ ID NO: 52496

SEQ ID NO: 139287 - RNA, 64 nt, Homo Sapiens; identical to SEQ ID NO: 52497

SEQ ID NO: 139288 - RNA, 64 nt, Homo Sapiens; identical to SEQ ID NO: 52498

SEQ ID NO: 139289 - RNA, 64 nt, Homo Sapiens; identical to SEQ ID NO: 52499

SEQ ID NO: 139290 - RNA, 64 nt, Homo Sapiens; identical to SEQ ID NO: 52500

SEQ ID NO: 139291 - RNA, 64 nt, Homo Sapiens; identical to SEQ ID NO: 52501

SEQ ID NO: 139292 - RNA, 64 nt, Homo Sapiens; identical to SEQ ID NO: 52502

SEQ ID NO: 139293 - RNA, 64 nt, Homo Sapiens; identical to SEQ ID NO: 52503

SEQ ID NO: 139294 - RNA, 64 nt, Homo Sapiens; identical to SEQ ID NO: 52504

SEQ ID NO: 139295 - RNA, 64 nt, Homo Sapiens
gugccauuccaggauaacagcugcaaaugucacuugugaugaguugagucuccccuuaauuaga

SEQ ID NO: 139296 - RNA, 64 nt, Homo Sapiens
augagugagucuccccuuaaccuucccccugccuugugaugauguuugaaauccuguggugccc

SEQ ID NO: 139297 - RNA, 64 nt, Homo Sapiens
agggggauaaggagggaacauaucauaacugcacugugaugaagaagcuguuccccacagagga

SEQ ID NO: 139298 - RNA, 64 nt, Homo Sapiens
uuaacucuggaaaucaccugauguagaagaagacugugaugagcucgucuguggaacaucacaa

SEQ ID NO: 139299 - RNA, 64 nt, Homo Sapiens
ccucuuucauuucucaguauauauuucaagagcuugugaugaaaucuauaggaugguaaugaug

SEQ ID NO: 139300 - RNA, 64 nt, Homo Sapiens
gccuacauugagugcuuaaaaaaaaaaaaacaacugugaugaugugagcagaauggcaaguaag

SEQ ID NO: 139301 - RNA, 64 nt, Homo Sapiens
uuucuacauaauugugaccaauacauuuguauuuugugaugaaucuacauuuguuuguauucau

SEQ ID NO: 139302 - RNA, 64 nt, Homo Sapiens
aagaauuuuuugauaauuacugaguucagccuuuugugaugacuuauauuuuggacuuacauuu

SEQ ID NO: 139303 - RNA, 64 nt, Homo Sapiens
ugugcuaucgugcuguuccuacucaguaaacaggugugaugaguuaacaagaaauaacacuguu

SEQ ID NO: 139304 - RNA, 64 nt, Homo Sapiens
gaaucuucuguuaaaaggugauuuaaaacuugaaugugaugaauuguggcaaguuaacuucaag

SEQ ID NO: 139305 - RNA, 64 nt, Homo Sapiens
cuuugguuuaacaucacaguuaaaaugcuguuauugugaugaguugcacaauauuucuuaaaag

SEQ ID NO: 139306 - RNA, 64 nt, Homo Sapiens
cuaucuuuucucucugugaaugcaaaucuguuugugugaugaaauagaacuuaaagcugaaauc

SEQ ID NO: 139307 - RNA, 64 nt, Homo Sapiens
augaugugccagcuaaaauugaaaaggcuuccccugugaugaaauuuaggaauuuucucucuug

SEQ ID NO: 139308 - RNA, 64 nt, Homo Sapiens
caguauggauuugcuuuucuauuucuuucuugugugugaugaacugauuucauuuuagccaggu

SEQ ID NO: 139309 - RNA, 64 nt, Homo Sapiens
uauaccaacuauaaagcacuccauaucaauuuucugugaugauguuucaggauuuaaauuagua

SEQ ID NO: 139310 - RNA, 64 nt, Homo Sapiens
gguuaacuucuuuuagguacgaauuccuaucauuugugaugauuuacugcggguaugaguuguu

SEQ ID NO: 139311 - RNA, 64 nt, Homo Sapiens
ccuauuuccucucauguuuuaauugggccucuacugugaugauuuuugcacacauuaugauuaa

SEQ ID NO: 139312 - RNA, 64 nt, Homo Sapiens
augagacagaugccaucagaggggguguauuuacugugaugaagacuaauuuaguuauccauug

SEQ ID NO: 139313 - RNA, 64 nt, Homo Sapiens
acauuucauuaaaagauugcgaaaacaaguacuaugugaugaaaaaaaguucugaauucauaca

SEQ ID NO: 139314 - RNA, 64 nt, Homo Sapiens
ccuuuugcuuugccuugugggaaaugacucauacugugaugauauuccagaugucugccaacaa

SEQ ID NO: 139315 - RNA, 64 nt, Homo Sapiens
guguauauacuuuuggcaagucauacagcucaaaugugaugagauuucugauguuagagggaga

SEQ ID NO: 139316 - RNA, 64 nt, Homo Sapiens
aaagccuauacuuuggcagguuaugaacuuugaaugugaugaaaugacacguuuggcugcauuu

SEQ ID NO: 139317 - RNA, 64 nt, Homo Sapiens
accacugugauuuuuuaaaauuguuuuuucgccaugugaugaagccuuuggagaagagugaagu

SEQ ID NO: 139318 - RNA, 64 nt, Homo Sapiens
agcuuccauuacuucugaaauuguauuagauuuuugugaugaagcuugggcacauacuccaaga

SEQ ID NO: 139319 - RNA, 64 nt, Homo Sapiens
uagugcuggucagagagaccucauccugcucuuuugugaugaacauauucaugaaauguggaag

SEQ ID NO: 139320 - RNA, 64 nt, Homo Sapiens
uuuugccugcaggucaguuguaauaaaucuaggaugugaugaugacuuuguaauuugauuuucu

SEQ ID NO: 139321 - RNA, 64 nt, Homo Sapiens
ccugcaaacaugggguuggcugggcccagaagguugugaugaagaaaagugggccaguguggga

SEQ ID NO: 139322 - RNA, 64 nt, Homo Sapiens
cacuguaguaaauggcaauucuuugaccucaaccugugaugaggggaggaaacucaccugcugg

SEQ ID NO: 139323 - RNA, 64 nt, Homo Sapiens
guggcaaagcguuuacuucagagaaacucacaagugugaugauuauaggaggauucauacagga

SEQ ID NO: 139324 - RNA, 64 nt, Homo Sapiens
guggcaacaccuuuggucaaagaaaccuuacaaaugugaugaguuauuagaauucaaacuggag

SEQ ID NO: 139325 - RNA, 64 nt, Homo Sapiens
gaauuucuccauugaugaauucaugacaaugucaugugaugauagggagggaaugauauaauuu

SEQ ID NO: 139326 - RNA, 64 nt, Homo Sapiens
auagagugccacccaaggcaucacuguuggccggugugaugagugacacccucucuggcauuua

SEQ ID NO: 139327 - RNA, 63 nt, Homo Sapiens
uccugagaagcuucaaauucaggccaggagagaagucuuaagaaaagaccuccagcaguuaca

SEQ ID NO: 139328 - RNA, 63 nt, Homo Sapiens
cugacuauacuuaguuugaaauggugcaggcuuagucuuaagccuccaaaggccuggauuuga

SEQ ID NO: 139329 - RNA, 63 nt, Homo Sapiens
uuaacugccaaagcuaguuuuagagaaugagaaagucuuaagcaaaauacucccaggucucac

SEQ ID NO: 139330 - RNA, 63 nt, Homo Sapiens
ggaaagauacagggaacaaaaaucaauuuguacagucuuaauauuaaaagcagcuugacuaaa

SEQ ID NO: 139331 - RNA, 63 nt, Homo Sapiens
uggaucugucuagucaaucaacauagcagagacagucuuaaaccuaccauugaccugugugua

SEQ ID NO: 139332 - RNA, 63 nt, Homo Sapiens
gauuuccuugaagcaguuugaaaauuugaauugagucuuaacuuuaggaaaugagguuucaua

SEQ ID NO: 139333 - RNA, 63 nt, Homo Sapiens
acaaccaggugggaccaaaguuuaugugccuuuagucuuaauuuaccuugcauuguaauauuc

SEQ ID NO: 139334 - RNA, 63 nt, Homo Sapiens
ggugauucuuucuuuaccauuucuggggacuuuagucuuaauuagguaccuuauuaacaggaa

SEQ ID NO: 139335 - RNA, 63 nt, Homo Sapiens
ucaaaaaucugcauauaacuuuugauuccccaaagucuuaaguacuaguagccuguuauugac

SEQ ID NO: 139336 - RNA, 63 nt, Homo Sapiens
uauauugcaaaauuuaauauauuuguucacuugagucuuaagaguaggucaggccaaggcagg

SEQ ID NO: 139337 - RNA, 63 nt, Homo Sapiens
aaauuaguggaacuuaguucagggacauagaagagucuuaaugaauuaaaaucauucacuuga

SEQ ID NO: 139338 - RNA, 63 nt, Homo Sapiens
auaaaacaauggcugguucuagcccugagugacagucuuaaggcuagauccuucccauaguau

SEQ ID NO: 139339 - RNA, 63 nt, Homo Sapiens
acaguuuuauagcugguuccuuuuaggguaaagagucuuaagagaguuuuauugugucuaugg

SEQ ID NO: 139340 - RNA, 63 nt, Homo Sapiens
gcuuuauuagugaggagaaaacaauuccuuagaagucuuaaauauauuguacucuuuagaucu

SEQ ID NO: 139341 - RNA, 63 nt, Homo Sapiens
uucucuuuuaaagcugcaugaaugucauauaguagucuuaaguuguuuuuuguguaauucgug

SEQ ID NO: 139342 - RNA, 63 nt, Homo Sapiens
uuccuaccacuuugguuucaagugaaagugcuaagucuuaagucccuucgauguaugccauuu

SEQ ID NO: 139343 - RNA, 63 nt, Homo Sapiens
uucugccccauaagacuuucauauuuauaaaggagucuuaaugcuguugauuaaucuauuuuc

SEQ ID NO: 139344 - RNA, 63 nt, Homo Sapiens
uggcagccauucugccuuuguaaggcaagcaaaagucuuaacacuaaaauauacccaucagua

SEQ ID NO: 139345 - RNA, 63 nt, Homo Sapiens
guuuaucuuuucucugcugagggcaaaaaagaaagucuuaagaccuuucugacacauaauuug

SEQ ID NO: 139346 - RNA, 63 nt, Homo Sapiens
cugagauuucuaaagaugcuuuagccccuccuaagucuuaaugcuguucaacauccucccucc

SEQ ID NO: 139347 - RNA, 63 nt, Homo Sapiens
cuaaauuugugugaauaaucguuuuuaaugaauagucuuaaauuuaacgaguguuuuaaaaag

SEQ ID NO: 139348 - RNA, 63 nt, Homo Sapiens
guugagccuuuccuuucauaagcauaugaaacuagucuuaacuccuguuucacucacucaccc

SEQ ID NO: 139349 - RNA, 63 nt, Homo Sapiens
gccagcagaaaaacuccauaauucugauucugaagucuuaacuguuaaauguauguaagauug

SEQ ID NO: 139350 - RNA, 63 nt, Homo Sapiens
uccucacagcacgggagcagcugugaguuuaggagucuuaagaaauagguugaaaacaaucau

SEQ ID NO: 139351 - RNA, 63 nt, Homo Sapiens
ucaaaguauccaauauuuuauuucauuuaaaguagucuuaaaaaugguauuccauuagguucu

SEQ ID NO: 139352 - RNA, 63 nt, Homo Sapiens
uuucaccaggggugcucaccuuuauacucacugagucuuaacuccacagcucuucuuggcgua

SEQ ID NO: 139353 - RNA, 63 nt, Homo Sapiens
gaauaucagagguaagaggguacauccucugccagucuuaauagugauagaaaacccacacaa

SEQ ID NO: 139354 - RNA, 63 nt, Homo Sapiens
aaacucaggaggaccaauguugaccacggacaaagucuuaacaucuuuggauagcugucugag

SEQ ID NO: 139355 - RNA, 63 nt, Homo Sapiens
uaaauguacugugaagaauggaaaacagaagacagucuuaauaaaauuuucaacccuuaaucu

SEQ ID NO: 139356 - RNA, 63 nt, Homo Sapiens
ucugcuauuuacagagcauuaaacacaaugguaagucuuaaaguaguugagucacugagguuu

SEQ ID NO: 139357 - RNA, 63 nt, Homo Sapiens
uuacugaauaagauuugaguaaugaaagucuguagucuuaaaacucuaaaacaguuguacugc

SEQ ID NO: 139358 - RNA, 63 nt, Homo Sapiens
acgaauagguaauugauagaguuuaugggucuuagucuuaaggguaacagagugaauaccuuc

SEQ ID NO: 139359 - RNA, 63 nt, Homo Sapiens
aaaucauguuuagaaacuuuggaugaguuaagaagucuuaaguaugcaggcguuuacgugauu

SEQ ID NO: 139360 - RNA, 63 nt, Homo Sapiens
caugugguauuaauauaccuucaauuuauguugagucuuaaacauaauuaggagauauuuuuc

SEQ ID NO: 139361 - RNA, 63 nt, Homo Sapiens
uaguugaaauuuuuaauagaaucaaggcacaaaagucuuaaaaccauguggaaaaauuaggua

SEQ ID NO: 139362 - RNA, 63 nt, Homo Sapiens
caggcugucauagaguuauguguuagucucaggagucuuaacuuuugaaauauguuuuacuug

SEQ ID NO: 139363 - RNA, 63 nt, Homo Sapiens
uaggguuccacaucauucuaauguauaguuucaagucuuaauagacaaucugaauuccacuac

SEQ ID NO: 139364 - RNA, 63 nt, Homo Sapiens
ucaaaagggcaauguuuucuuuauauuucuuauagucuuaauuuuguuauccaugugcauaau

SEQ ID NO: 139365 - RNA, 63 nt, Homo Sapiens
uucauacaaccauuuucaaaugaaccuuagaaaagucuuaacauuuaagguauuuuaugcaca

SEQ ID NO: 139366 - RNA, 63 nt, Homo Sapiens
uuuuaacauuuauagugcuucauuauacacugaagucuuaacaaaaaggcaggauguuauuga

SEQ ID NO: 139367 - RNA, 63 nt, Homo Sapiens
ugagguuugccaaaugagaauuuaagauacuuuagucuuaaauguuuuugguggaggaagaag

SEQ ID NO: 139368 - RNA, 63 nt, Homo Sapiens
uuaaaugcuaaaaacaauugaacacugagccauagucuuaaauguuaacuuauuuauuuuuca

SEQ ID NO: 139369 - RNA, 63 nt, Homo Sapiens
cuuuucagcauuaacgcaaaaacagucccccaaagucuuaacuaaaaccaaucaugccuuccu

SEQ ID NO: 139370 - RNA, 63 nt, Homo Sapiens
auuuacuaaaauggucaacuaacuccucuucuuagucuuaauaagagagaguacugaaaaagc

SEQ ID NO: 139371 - RNA, 63 nt, Homo Sapiens
uuuucuaaaagaagacaauaaaucuguuauuccagucuuaaauuacagcauugcaggaaaaac

SEQ ID NO: 139372 - RNA, 63 nt, Homo Sapiens
uuuuucuuuuaaaaaacaucacaucuugaauaaagucuuaacauuuguuauaaugccugauac

SEQ ID NO: 139373 - RNA, 63 nt, Homo Sapiens
aacagguuuucuaauccagacuggaugugacccagucuuaauaagggcacugaaauguacuag

SEQ ID NO: 139374 - RNA, 63 nt, Homo Sapiens
gucaauauuauuuuugucuaccuuagacagugaagucuuaauuccccaggguaggucuguggc

SEQ ID NO: 139375 - RNA, 63 nt, Homo Sapiens
ugaccuggacgugaaggaaauuuaagauaccgaagucuuaaagugaagugaugcaugugugaa

SEQ ID NO: 139376 - RNA, 63 nt, Homo Sapiens
uuaaauauaugauuagccaguucuaaagccuuaagucuuaauauauuuuuugaauaauaacuu

SEQ ID NO: 139377 - RNA, 63 nt, Homo Sapiens
guuggcuauaaguacgucauucuuaguccagucagucuuaaaaacaucuuggguuacccacuc

SEQ ID NO: 139378 - RNA, 63 nt, Homo Sapiens
gccaguugcuguuuuuucaugcagugcccugggagucuuaaaagcagugcuuagcaacauugg

SEQ ID NO: 139379 - RNA, 63 nt, Homo Sapiens
uugacaaaagccggggucaaaaaaaguaguuuaagucuuaagacugaauaugcauuaaaguau

SEQ ID NO: 139380 - RNA, 63 nt, Homo Sapiens
cugcuauuucuuuucaguuuuuccaaagucaagagucuuaaccuuguacucagggaauuuuga

SEQ ID NO: 139381 - RNA, 63 nt, Homo Sapiens
ugugcgccugugagcgcccagcuucuguuucauagucuuaacagguggccauugucgugaaac

SEQ ID NO: 139382 - RNA, 63 nt, Homo Sapiens
ccugaaauuuuuuauaauauauguaauuugucuagucuuaaagacauuuggagcauggccaac

SEQ ID NO: 139383 - RNA, 63 nt, Homo Sapiens
aggucuagaaaagcauccugucuggcauuuuguagucuuaacuucuccccauuucccccaucu

SEQ ID NO: 139384 - RNA, 63 nt, Homo Sapiens
cacagaaaaggauguuuggcaauuugucuuuuaagucuuaaccuugcuaaugugaauacuggg

SEQ ID NO: 139385 - RNA, 63 nt, Homo Sapiens
gacagcacugaaccuauuccaaaaccagaguacagucuuaaguucacagaagggcguauuucg

SEQ ID NO: 139386 - RNA, 63 nt, Homo Sapiens
uaucaacuccuuaaaugugcuucugauucauauagucuuaaauauuuuaauggaguguuaaaa

SEQ ID NO: 139387 - RNA, 63 nt, Homo Sapiens
agaugaauggaugagagaagggacacagaaggcagucuuaagaaagauaauuucccugcaaaa

SEQ ID NO: 139388 - RNA, 63 nt, Homo Sapiens
gauaguuuauaaucaggcauaaaccuuugaaauagucuuaauguuauuguuggguagaagggg

SEQ ID NO: 139389 - RNA, 63 nt, Homo Sapiens
ccagaaaauaaguuuauagcuagaguaaauuuuagucuuaaagcaaaacauuuuagaaaaucu

SEQ ID NO: 139390 - RNA, 63 nt, Homo Sapiens
aucuauuggccacgaugaaauugcugaaaaguuagucuuaauuugaauauaggagaaaucagu

SEQ ID NO: 139391 - RNA, 63 nt, Homo Sapiens
aucuaagacucaguuguaguucauguagacuaaagucuuaaacuguauuaauugauuuaaaca

SEQ ID NO: 139392 - RNA, 63 nt, Homo Sapiens
cuggaaauuuuauuagcaauagcuauaagcuuaagucuuaauuaauugcucuuaaacuuuccu

SEQ ID NO: 139393 - RNA, 63 nt, Homo Sapiens
aaacauugaauuguaguaaaagguccugacuuuagucuuaauauaugacucaguaaguuggca

SEQ ID NO: 139394 - RNA, 63 nt, Homo Sapiens
agguucaugaucuacauugguuuuaccauaaugagucuuaaguagaaaaauguaagaauuugu

SEQ ID NO: 139395 - RNA, 63 nt, Homo Sapiens
gucaaugccagagacggaagccuuuuuccccaaagucuuaaaauaacuuauaucaucagcaua

SEQ ID NO: 139396 - RNA, 63 nt, Homo Sapiens
cauccaucagaaucuucuggagaauauggucagagucuuaaacaggcccagugcugaguucuu

SEQ ID NO: 139397 - RNA, 63 nt, Homo Sapiens
ucuuugcuuuaauaaaugagcaacccuggguauagucuuaaaauucugcacaauaaauuuuga

SEQ ID NO: 139398 - RNA, 63 nt, Homo Sapiens
guuauuaaauuuauuauuuaagaugguagcacuagucuuaaauuguauaaaauauccccuaac

SEQ ID NO: 139399 - RNA, 63 nt, Homo Sapiens
guuauuaaauuuauuauuaaagauaguagcacuagucuuaaauuugauauaacaucuccuaac

SEQ ID NO: 139400 - RNA, 63 nt, Homo Sapiens
gcauggcccuguuagagauggcguagaagugaaagucuuaaagggagcauuagagauccuuuu

SEQ ID NO: 139401 - RNA, 63 nt, Homo Sapiens
gauggucucgaucuccugaccuugaaucacaagagucuuaacagggaauguuucaggaaacaa

SEQ ID NO: 139402 - RNA, 63 nt, Homo Sapiens
uaaauaauuaaaauaucagacauguuuuggaaaagucuuaauuugagaacaccaaaggaaacu

SEQ ID NO: 139403 - RNA, 63 nt, Homo Sapiens
gaaauuaagccauuuaacauugaaaaacauaagagucuuaaaaaguauaauacccauuuaaug

SEQ ID NO: 139404 - RNA, 63 nt, Homo Sapiens
uaaaaguugucuaaacugucaagggggcauucuagucuuaacuacgguggugccuaucuacuu

SEQ ID NO: 139405 - RNA, 63 nt, Homo Sapiens
ugauguuuuucaacuuuuauaauuaguagcaccagucuuaauugugcacauauuucauaacca

SEQ ID NO: 139406 - RNA, 63 nt, Homo Sapiens
cuuuaugaugcuaugguuuguuaguagcccuucagucuuaauacuuuaaaaugaauagguagg

SEQ ID NO: 139407 - RNA, 63 nt, Homo Sapiens
auauuuaaguguuacuguggauuucugcauucgagucuuaaccuuagcuuuccaaccaaccaa

SEQ ID NO: 139408 - RNA, 63 nt, Homo Sapiens
aaaaaaaaaaacagaaaaagaacugaauuaggcagucuuaaaacuugucagacaauggcuaua

SEQ ID NO: 139409 - RNA, 63 nt, Homo Sapiens
auaaaggcauauuguucauguaucuuuuaaaugagucuuaaaaaguuuguguuuugucgacag

SEQ ID NO: 139410 - RNA, 63 nt, Homo Sapiens
gguuaccgucucaugugaaccuggagauucaccagucuuaacuuuugggucauuguguuuucu

SEQ ID NO: 139411 - RNA, 63 nt, Homo Sapiens
uuuccauuuuugucagucugagucaucaaaaagagucuuaauuuucuaaaacaaguuggcuag

SEQ ID NO: 139412 - RNA, 63 nt, Homo Sapiens
ccaugcaguuguuuaccaaaaauagaggaggagagucuuaacuuuugcucuuggauuuaaguc

SEQ ID NO: 139413 - RNA, 63 nt, Homo Sapiens
uaggcuuaauucauucaauugucaaguacacuuagucuuaauacacucagguuugaacagauu

SEQ ID NO: 139414 - RNA, 63 nt, Homo Sapiens
gcauauucuccuuucauccuggcuugccaacgcagucuuaauuccgccuuuuuuuuuucuaau

SEQ ID NO: 139415 - RNA, 63 nt, Homo Sapiens
uuuuaguuuuauguaaccauaucaauauuauuuagucuuaaacuaguuacguuauuaugcaau

SEQ ID NO: 139416 - RNA, 63 nt, Homo Sapiens
uuccagcauuucuucauuugauucucuuuuuuuagucuuaaaauaaugacuccuauucagaca

SEQ ID NO: 139417 - RNA, 63 nt, Homo Sapiens
gauuauguuuuuggauugucaaagaggaugcuuagucuuaaaauaaaaauaaauuuaaaaauc

SEQ ID NO: 139418 - RNA, 63 nt, Homo Sapiens
acacccuaguaaccucuugagauuaaauuacauagucuuaauauuucuguuccuccaugcaac

SEQ ID NO: 139419 - RNA, 63 nt, Homo Sapiens
cugucuauccccacgaaauuuaguuuuaucaguagucuuaaaguguugaucucaaacaaguac

SEQ ID NO: 139420 - RNA, 63 nt, Homo Sapiens
gaaauggaagauuuuuuuuuaacuuguucuagaagucuuaauaugggcuguugccaugaaggc

SEQ ID NO: 139421 - RNA, 63 nt, Homo Sapiens
uauucccacgauauucuguauagcacuaauuuuagucuuaaaaauuuauauauucagauacuc

SEQ ID NO: 139422 - RNA, 63 nt, Homo Sapiens
auagcguguauacuugaauaagacuuaauuuuaagucuuaaaaauaucuuuauuauagccuua

SEQ ID NO: 139423 - RNA, 63 nt, Homo Sapiens
auuucaaaauaaaagugguuauaacuucuugugagucuuaagugaucucucugaacuauuuuu

SEQ ID NO: 139424 - RNA, 63 nt, Homo Sapiens
ugguguuguucuaauuuuccaauccggaaauauagucuuaacccaugggaggcaaagaaagga

SEQ ID NO: 139425 - RNA, 63 nt, Homo Sapiens
cauccaccagagucuagaagcuuuaucacccucagucuuaauccaucaguccuggggcuuuuu

SEQ ID NO: 139426 - RNA, 63 nt, Homo Sapiens
aauuaaagauaacauuauaauggucuuguuuuaagucuuaaaauacagauuuuuuguuuaccu

SEQ ID NO: 139427 - RNA, 63 nt, Homo Sapiens
gaaguuucacuaaaaauguauuuucuuuuggacagucuuaagauagcaucauauauuaguuca

SEQ ID NO: 139428 - RNA, 63 nt, Homo Sapiens
uuggccagcaucuguuuaucccaaguccuuaggagucuuaacaagagguuucaguuuuuaaua

SEQ ID NO: 139429 - RNA, 63 nt, Homo Sapiens
cccuguagaaaccucguuauuaaccaguguuccagucuuaaaguagacaaaauauucagagcc

SEQ ID NO: 139430 - RNA, 63 nt, Homo Sapiens
uuuauuguuuuuaaaaugaaaggaauacuaauaagucuuaaaaguuccuucaugcauaagauu

SEQ ID NO: 139431 - RNA, 63 nt, Homo Sapiens
caggugugagccacccugcccagccgucaaaagagucuuaauauauauauccagauggcaugu

SEQ ID NO: 139432 - RNA, 63 nt, Homo Sapiens
ucuucucuccucauggacuuuuucugcaauugcagucuuaagcuucacucuccaccaccugga

SEQ ID NO: 139433 - RNA, 63 nt, Homo Sapiens
gccugaguugucaccauuaugucuuaagcuguuagucuuaaagauuauuguuaaaaaauucag

SEQ ID NO: 139434 - RNA, 63 nt, Homo Sapiens
guaagcuuaaacuacaacuugucacauaaaggaagucuuaaguggaguucacagaaugauaau

SEQ ID NO: 139435 - RNA, 63 nt, Homo Sapiens
uuuaacuagcugccuuuagauuuugauaaucacagucuuaaaauacuaggaaagaaguggaug

SEQ ID NO: 139436 - RNA, 63 nt, Homo Sapiens
uauucgugugaaaaagaauacaucauuucucacagucuuaaguugauauuuauagaaaugaau

SEQ ID NO: 139437 - RNA, 63 nt, Homo Sapiens
uuuucugaugaauaguguucaguaaaaugaagcagucuuaagagugacuaauaauuucaaagu

SEQ ID NO: 139438 - RNA, 63 nt, Homo Sapiens
uuucuguuugaagaaaauagagggagaaacagaagucuuaagucuguggcacacugugucuuc

SEQ ID NO: 139439 - RNA, 63 nt, Homo Sapiens
cccaaaggcucuuuucagagucacuuuuucaucagucuuaaaagaaagagcguaaauguaaag

SEQ ID NO: 139440 - RNA, 63 nt, Homo Sapiens
aaggcucuuuucagagccacuuuuuaaggaagcagucuuaacaacgagaacucuuauauuggc

SEQ ID NO: 139441 - RNA, 63 nt, Homo Sapiens
guguacauguaguugaauuuuugaacuagggcaagucuuaaauuccaguacuugagcugacca

SEQ ID NO: 139442 - RNA, 63 nt, Homo Sapiens
aaaauuacauauuuuauaauaaauauuauuauuagucuuaacuaccauuuuuaaagugcacaa

SEQ ID NO: 139443 - RNA, 63 nt, Homo Sapiens
uaccugugcuucaguuuccuccuaccuuuugcaagucuuaacugcuggaucugcugcuuccug

SEQ ID NO: 139444 - RNA, 63 nt, Homo Sapiens
agaaacuguuacugucccaauucugcucauggaagucuuaaacguuuucacagacaauaacug

SEQ ID NO: 139445 - RNA, 63 nt, Homo Sapiens
ccacaccacuauuccagcgauuugaccguuccaagucuuaauguugugaaccccugaagauuu

SEQ ID NO: 139446 - RNA, 63 nt, Homo Sapiens
gggcugauaguccaaccagggcucuggggcuugagucuuaauauauuccaggcacaagagaaa

SEQ ID NO: 139447 - RNA, 63 nt, Homo Sapiens
gauaaagacauaaaugggacuuugaagaugaauagucuuaaaaaaaaccuuauuuaugucuua

SEQ ID NO: 139448 - RNA, 63 nt, Homo Sapiens
augucugguuuuccaucuguauuuuaccuagacagucuuaaauugguaaaggaaacccaugca

SEQ ID NO: 139449 - RNA, 63 nt, Homo Sapiens
guauuuuaaauugaagccuuuuuaaauguaucaagucuuaauuuaauguuuaucuugauagac

SEQ ID NO: 139450 - RNA, 63 nt, Homo Sapiens
uacacauugcauuuugauaaaauccauaacuuuagucuuaauguuucuaugccaaacaggaac

SEQ ID NO: 139451 - RNA, 63 nt, Homo Sapiens
ucuccugcggccacaucaacggaugcaagucacagucuuaacacagccugugggagacaagca

SEQ ID NO: 139452 - RNA, 63 nt, Homo Sapiens
ugaaaaacauauaauuuacuucuuauaaauugaagucuuaaaugugaaaccaagaaauguaau

SEQ ID NO: 139453 - RNA, 63 nt, Homo Sapiens
uuagaaaguuaaaagaauguagaaaagauacucagucuuaauccuaugcaaaaaaaaaaauca

SEQ ID NO: 139454 - RNA, 63 nt, Homo Sapiens
acaggucuuugaucuggaaacuaagacuagagaagucuuaagagaugacugcucaggugagua

SEQ ID NO: 139455 - RNA, 63 nt, Homo Sapiens
guccuuguuguuucuugccugaacuccugccauagucuuaacuggucuccuugcuuccugucu

SEQ ID NO: 139456 - RNA, 63 nt, Homo Sapiens
cauaagguuauuauaauaaauuauauuaguaaaagucuuaacuggaaaaaagaaucuaaauca

SEQ ID NO: 139457 - RNA, 63 nt, Homo Sapiens
ugcaccuugaguugagagggcuacauguagaaaagucuuaaaauagagcuaaacaccacagug

SEQ ID NO: 139458 - RNA, 63 nt, Homo Sapiens
gucuuuuguacaaauaucuagaacuggccauguagucuuaacacauucuguuuccugcagugg

SEQ ID NO: 139459 - RNA, 63 nt, Homo Sapiens
cugugucaguaagucuuuaauuccucucucgaaagucuuaauuuccaacuuuucccuucucag

SEQ ID NO: 139460 - RNA, 63 nt, Homo Sapiens
aaucucuaagguuuguuucuugguggguuuuuaagucuuaaccauuaagugguaaugucauag

SEQ ID NO: 139461 - RNA, 63 nt, Homo Sapiens
uaccuucaguuuaaucuguguaaccaaaacugaagucuuaauuccucacagaaaaguuggaaa

SEQ ID NO: 139462 - RNA, 63 nt, Homo Sapiens
uugaaugcugcuuucugcuucuagaaauugggcagucuuaauggggcuaaggaaguaucagca

SEQ ID NO: 139463 - RNA, 63 nt, Homo Sapiens
gugugcauaaaaaacuaaauuuaguguuuauaaagucuuaaaucccuucuggaauugcuaaug

SEQ ID NO: 139464 - RNA, 63 nt, Homo Sapiens
aaauaugccuuuuugaagcagagagugagacucagucuuaaaacacugcacuccagucugggu

SEQ ID NO: 139465 - RNA, 63 nt, Homo Sapiens
uuauuauauuuuguuguuacucuguuuucuuauagucuuaauuuauugaauuauaccauuuac

SEQ ID NO: 139466 - RNA, 63 nt, Homo Sapiens
agugccagaccggaaccuauagcuacugcuagaagucuuaaaaaaaccaacagcagcacagga

SEQ ID NO: 139467 - RNA, 63 nt, Homo Sapiens
gguugaauuguguucccccaaaauauauggugaagucuuaacccccauccccgugaaugggac

SEQ ID NO: 139468 - RNA, 63 nt, Homo Sapiens
aagaaaauccuuuccucuugggaaaguaauacaagucuuaaguuccauuguagggugcgccuu

SEQ ID NO: 139469 - RNA, 63 nt, Homo Sapiens
cuguauccucccuggcagacacaacccaauaggagucuuaauuuauuucuuaaccuuugcuau

SEQ ID NO: 139470 - RNA, 63 nt, Homo Sapiens
gguguauggauaugugauuuugagauuaaaguuagucuuaaaauguaaauaaaaugugaaacg

SEQ ID NO: 139471 - RNA, 63 nt, Homo Sapiens
cauuauagaauuaucugugaguuguguagacacagucuuaauguuucugguuaugacagauaa

SEQ ID NO: 139472 - RNA, 63 nt, Homo Sapiens
ucgaauucuagacugaggaguagaguucauuggagucuuaaacucucugauaucacuuaaagc

SEQ ID NO: 139473 - RNA, 63 nt, Homo Sapiens
cucaggcuuuucguucauuaugguaccaaucucagucuuaaagcagguggccaugacuacccg

SEQ ID NO: 139474 - RNA, 63 nt, Homo Sapiens
uucauguguacaccucuuugguuaaaauuuuggagucuuaauucacaucuucagggcaccagu

SEQ ID NO: 139475 - RNA, 63 nt, Homo Sapiens
uuuccaacaugaaaauucucuuaauuccaugaaagucuuaaugauuggaaguucuuuguaauu

SEQ ID NO: 139476 - RNA, 63 nt, Homo Sapiens
auuagguugaggucuaccuaugccuuagaugauagucuuaaauauagucacaaguauuaauaa

SEQ ID NO: 139477 - RNA, 63 nt, Homo Sapiens
cugacauacuggauuuuuaaauuuggaugaagaagucuuaauaauagcaauaaaccuaacugg

SEQ ID NO: 139478 - RNA, 63 nt, Homo Sapiens
cugaaauacugaauuuuuaacuuuggaugaagaagucuuaauacuaguuagaguuagaccugu

SEQ ID NO: 139479 - RNA, 63 nt, Homo Sapiens
ucuguccaccuucaagucaaagauaauuuuuccagucuuaagccuuuguuaaaccccaauuau

SEQ ID NO: 139480 - RNA, 63 nt, Homo Sapiens
ucaaaaugaaaacaaagcaaaugaauacuggacagucuuaacaauuuuauaaguuauaaaaug

SEQ ID NO: 139481 - RNA, 63 nt, Homo Sapiens
gugagcauuugccugaauaaaaccuaaaagaguagucuuaacacauuacuaacuuuuucuaag

SEQ ID NO: 139482 - RNA, 63 nt, Homo Sapiens
cagauuaaucuuuuauccuuuccugaaguacaaagucuuaagagugucugaaauccaagacau

SEQ ID NO: 139483 - RNA, 63 nt, Homo Sapiens
aguuuuacuacuuuucauuuagaacagaguaugagucuuaaucugaagucuuuuucaugcccu

SEQ ID NO: 139484 - RNA, 63 nt, Homo Sapiens
gcuuuauuuugguguuguguuugaauuccccaaagucuuaauucguuuuuguuuucuuguacu

SEQ ID NO: 139485 - RNA, 63 nt, Homo Sapiens
uguacaguguauuuuauagacuauauuuagaacagucuuaaaaacaguccauugugaagugug

SEQ ID NO: 139486 - RNA, 63 nt, Homo Sapiens
uucagcauauguugcugcugaccaagcuucauuagucuuaaaugcauugggcuccgugccaca

SEQ ID NO: 139487 - RNA, 63 nt, Homo Sapiens
aaaauauucaggucuaucauaaaaaaaguuuacagucuuaagguuuuuuauaauuguuuucag

SEQ ID NO: 139488 - RNA, 63 nt, Homo Sapiens
aaggaaauuucccuaauguuaccugguuuggagagucuuaauuuuacaggcaugagcuaccac

SEQ ID NO: 139489 - RNA, 63 nt, Homo Sapiens
uaguuaaaaguuuguauuuuaagguaaucuguuagucuuaaaagagagauuggugauuuauau

SEQ ID NO: 139490 - RNA, 63 nt, Homo Sapiens
agacaaaccauaucacuccuauaaagcaaguccagucuuaaaacacacuuuuacaaauuuaau

SEQ ID NO: 139491 - RNA, 63 nt, Homo Sapiens
uauuucaaggaaucagugucuguccagaaaagaagucuuaagauggaaacugaccaccuacuu

SEQ ID NO: 139492 - RNA, 63 nt, Homo Sapiens
ccuuccauuuuuuagagacauauaaaugagggaagucuuaagaaaugaaucacggcaauuucu

SEQ ID NO: 139493 - RNA, 63 nt, Homo Sapiens
ucucuuucuggccaaagacuaaugcauauauugagucuuaaaacauauuuauauuuuuaaaua

SEQ ID NO: 139494 - RNA, 63 nt, Homo Sapiens
gaaucuagcauuuguuuucagagauucaagcauagucuuaaggguagaucagaaaugacaaau

SEQ ID NO: 139495 - RNA, 63 nt, Homo Sapiens
agaccgaacuguuguauaaauuuauuuacugcuagucuuaagaacugcuuucuuucguuuguu

SEQ ID NO: 139496 - RNA, 63 nt, Homo Sapiens
ugcuucugugaauuaaguugugguuucaucaugagucuuaauguucuuuguugauaagacaag

SEQ ID NO: 139497 - RNA, 63 nt, Homo Sapiens
uauauauauaucaguuugaucacacuauuuuagagucuuaaugccaagucagcagauuugcuu

SEQ ID NO: 139498 - RNA, 63 nt, Homo Sapiens
gguuuuguuaauucuuuucagaaucauugaagcagucuuaaagggucuuuugcagaugguaca

SEQ ID NO: 139499 - RNA, 63 nt, Homo Sapiens
agaggauaaugguucaccucugcguaaacugcaagucuuaagcagacaucuggaauagagcuu

SEQ ID NO: 139500 - RNA, 63 nt, Homo Sapiens
ucagggcuuuucuggggcugcucuuggaaaugaagucuuaaguacugaauaacuccccugggg

SEQ ID NO: 139501 - RNA, 63 nt, Homo Sapiens
uauauuaaugaggagaaaaguaugaaaacaagaagucuuaaguaaauauugaggucauuguuu

SEQ ID NO: 139502 - RNA, 63 nt, Homo Sapiens
gggcuugagaagguuacugagugaguuauugggagucuuaauaaaauaaacuagauauuaggu

SEQ ID NO: 139503 - RNA, 63 nt, Homo Sapiens
uuauauuacuauuuuccuuuuuguuguucacauagucuuaaggcaccuauacuuuuaaauuga

SEQ ID NO: 139504 - RNA, 63 nt, Homo Sapiens
uuagccaggaaagacaaauaauccaacgcugcuagucuuaaccccagaccagagagaacugca

SEQ ID NO: 139505 - RNA, 63 nt, Homo Sapiens
augcccggcccauaaguaccguuuuugagguucagucuuaaacauuugcuuuaagaaaacagu

SEQ ID NO: 139506 - RNA, 63 nt, Homo Sapiens
aaaaccaaucaugccuucccaacagucccccaaagucuuaacucauuucagcauuaacccaaa

SEQ ID NO: 139507 - RNA, 63 nt, Homo Sapiens
aacuuucauauuagcagauugcuccuucaaaacagucuuaauugcaaaggaaacuauugucuc

SEQ ID NO: 139508 - RNA, 63 nt, Homo Sapiens
gccaaaauucauuauaacccugcaugcaguggcagucuuaaguuauuucuuuuucgggguuuc

SEQ ID NO: 139509 - RNA, 63 nt, Homo Sapiens
uauaauguaaaguugacauucaucuucacuguuagucuuaaauaccauuuauauucuaguagc

SEQ ID NO: 139510 - RNA, 63 nt, Homo Sapiens
uucaggaguuuacaauugacauacacauuuccuagucuuaacuuguacucuuaugugucugau

SEQ ID NO: 139511 - RNA, 63 nt, Homo Sapiens
uuuucaauaaaauugagugauuguaacuuuuaaagucuuaaacuaggcagggcgaauacuacu

SEQ ID NO: 139512 - RNA, 63 nt, Homo Sapiens
cuuuuggguuugaaugaagguuccccccaaguuagucuuaaaugucuaaagugauuaucuuuu

SEQ ID NO: 139513 - RNA, 63 nt, Homo Sapiens
cacuucugcuuaaacucccaaaugccgcugugaagucuuaaaggcggggcugaggaacaggga

SEQ ID NO: 139514 - RNA, 63 nt, Homo Sapiens
uaaugugucuuguucuuuuuuauaaaaaguauuagucuuaacauguuuuauuuuuagaauagu

SEQ ID NO: 139515 - RNA, 63 nt, Homo Sapiens
caugucauagagaauaaagcugaugauuguaccagucuuaaauuauucaugauucaauaaaau

SEQ ID NO: 139516 - RNA, 63 nt, Homo Sapiens
uuuagaguuuccaaauuuagagcuucugcauacagucuuaaagccacagaggcuuguaaaaau

SEQ ID NO: 139517 - RNA, 63 nt, Homo Sapiens
ucauuucaggguaggagucaaugaagacaucuuagucuuaacaaguuacagauaaucucugac

SEQ ID NO: 139518 - RNA, 63 nt, Homo Sapiens
uauaaggugagguaacucagaacuuaauuuaaaagucuuaaauauucugauacaauucagcug

SEQ ID NO: 139519 - RNA, 63 nt, Homo Sapiens
aacaauuggcagaaccuguuugauuacugugacagucuuaaugauaccauaaaucaauauuag

SEQ ID NO: 139520 - RNA, 63 nt, Homo Sapiens
ucuuguuuuugcaucacuguucacauauuuuauagucuuaauaauuucgcugguucuuuguag

SEQ ID NO: 139521 - RNA, 63 nt, Homo Sapiens
cauuuuaucuuaaauaauuuaacccugacauucagucuuaacauccauuaucccuuugccuuu

SEQ ID NO: 139522 - RNA, 63 nt, Homo Sapiens
gagacacugcaaagucuuaguuaauauuuugaaagucuuaaaguuuuucguaacuuuugaauc

SEQ ID NO: 139523 - RNA, 63 nt, Homo Sapiens
uuauaauuguucaauauguuuauuacuggguggagucuuaaagccaucuaugggcuuuagacc

SEQ ID NO: 139524 - RNA, 63 nt, Homo Sapiens
aguuuuauugucaaauaaacguguucaguucaaagucuuaaccuuuguauuauuguuuguuuu

SEQ ID NO: 139525 - RNA, 63 nt, Homo Sapiens
agaugagaaguccuccccuuccuaacaagacugagucuuaacacugauauccccuggcucagu

SEQ ID NO: 139526 - RNA, 63 nt, Homo Sapiens
uaaaaggggagaagaacaaaagcaaaggccucaagucuuaaaaguuauuugcuucuuuuaauc

SEQ ID NO: 139527 - RNA, 63 nt, Homo Sapiens
uacuugcauccacuucaaauauuuaaagcuucuagucuuaacaaauggcugaagagaucaaga

SEQ ID NO: 139528 - RNA, 63 nt, Homo Sapiens
acagcuucuugcuuguaaaaaaguguaaaaaaaagucuuaacagccccaaaauuauaaacucu

SEQ ID NO: 139529 - RNA, 63 nt, Homo Sapiens
gaaggaagcaggagugauuagcaagagaauggaagucuuaauacugguucauucuccauuacu

SEQ ID NO: 139530 - RNA, 52 nt, Homo Sapiens
gcccucuccugcuucagucggaagucuuaauucccuucaggacgaggaguaa

SEQ ID NO: 139531 - RNA, 63 nt, Homo Sapiens
uaaggaaagacuugguguauagugugaugguuuagucuuaaggauuaagacauuuuugguacu

SEQ ID NO: 139532 - RNA, 63 nt, Homo Sapiens
gaaaaauggacauaugaauauuauuaaaaauugagucuuaaauuuaaaugggaagggaagaaa

SEQ ID NO: 139533 - RNA, 63 nt, Homo Sapiens
gaagguuauggguaccaggaagaaacaaacagaagucuuaagauuagaaugagaaccaaagag

SEQ ID NO: 139534 - RNA, 63 nt, Homo Sapiens
gauaagaugaccuguguaauaaucuuuguuaguagucuuaaagcugcugccauaguccuccaa

SEQ ID NO: 139535 - RNA, 63 nt, Homo Sapiens
acauuucacauacuguuacugaagaaagcaccaagucuuaauggaacaaagaccauagaauga

SEQ ID NO: 139536 - RNA, 63 nt, Homo Sapiens
uuuauugaugaauacaucucugaacguuccagaagucuuaagguuccaaagggauuuagcagu

SEQ ID NO: 139537 - RNA, 63 nt, Homo Sapiens
acacuauuaugaagcuacuagucauuccauaagagucuuaaaggacugcucuguguaacacug

SEQ ID NO: 139538 - RNA, 63 nt, Homo Sapiens
auucucauauccaugccuuuuuguccuguuuacagucuuaaaagagguaaaacagcaaauauu

SEQ ID NO: 139539 - RNA, 63 nt, Homo Sapiens
acaaguuguuuguauuuuauuuuuguuuauaccagucuuaaagauccagguucugaauaaaaa

SEQ ID NO: 139540 - RNA, 63 nt, Homo Sapiens
aguagacaccacuguacuuuuugauacgagggcagucuuaacuuguguuaaggccugugugua

SEQ ID NO: 139541 - RNA, 63 nt, Homo Sapiens
guauuggaguuuaaaaaaaaagccaaauuucacagucuuaauaacuuuuuuuaaaaaaaacua

SEQ ID NO: 139542 - RNA, 63 nt, Homo Sapiens
gguuuucaucaagccccgcccuuucucucucauagucuuaaugcgucuggaccacuggggaaa

SEQ ID NO: 139543 - RNA, 63 nt, Homo Sapiens
guaaauaauguucaggaaaaacgcagggaacagagucuuaaaguuaauggauauuuaauguga

SEQ ID NO: 139544 - RNA, 63 nt, Homo Sapiens
cagaaguaauuggccugagagcauucuugaccaagucuuaaaugcuagaaucugagaaggaau

SEQ ID NO: 139545 - RNA, 63 nt, Homo Sapiens
aguugggacaucagcugacuuacuuuaacuguuagucuuaaaucuuucucauacacugacugu

SEQ ID NO: 139546 - RNA, 63 nt, Homo Sapiens
uaauuauuauuaaaccaauguagaugugauuauagucuuaaacuaaauggacauuccagaaua

SEQ ID NO: 139547 - RNA, 63 nt, Homo Sapiens
uuuggggacauuauaaacuugggaugauuuucuagucuuaaggcaacuauaggccuuuuucuu

SEQ ID NO: 139548 - RNA, 63 nt, Homo Sapiens
accugccuguuaguacagagaggauuucuugggagucuuaauacucagauugaaaagcuuaug

SEQ ID NO: 139549 - RNA, 63 nt, Homo Sapiens
uucagagaaaacuucagagaagagcucaucaucagucuuaauaggcacuauuucugaacaaag

SEQ ID NO: 139550 - RNA, 63 nt, Homo Sapiens
uguguaagaaguuaaaacuuuuaaucuugaaguagucuuaaaaacugcucauuuacacucaaa

SEQ ID NO: 139551 - RNA, 63 nt, Homo Sapiens
aaaaaaaggaaucugaaaaaauuuagccaaauaagucuuaaccaaguuacacagaccacagug

SEQ ID NO: 139552 - RNA, 63 nt, Homo Sapiens
agggugaauuggaucaccauaaaagugaaauucagucuuaaguuguaaauaguguccauuagu

SEQ ID NO: 139553 - RNA, 63 nt, Homo Sapiens
uuacacuucuugacuucugacauuaauuuuugcagucuuaaaaucuguuauuaaggggcauag

SEQ ID NO: 139554 - RNA, 63 nt, Homo Sapiens
ccauuuggauuaaagauucacuuuaacacagaaagucuuaauaaaagguccuagucuuucugg

SEQ ID NO: 139555 - RNA, 63 nt, Homo Sapiens
gagaacugaaagggaaaacaaaauacuugacauagucuuaaguagaagaaggcaguuagagaa

SEQ ID NO: 139556 - RNA, 63 nt, Homo Sapiens
cacugguaaaauuguugaauauuucucucucccagucuuaaaagcccacaggcaagaauuaau

SEQ ID NO: 139557 - RNA, 63 nt, Homo Sapiens
caaaaauuuuauucaguguauuuucaguuguugagucuuaaugagggauacaggaggaaaaau

SEQ ID NO: 139558 - RNA, 63 nt, Homo Sapiens
uuugugaacaacguuucuauuuuaauaccugagagucuuaaaaguucucuguuuugaauauac

SEQ ID NO: 139559 - RNA, 63 nt, Homo Sapiens
uauuuuuuacuuaguaaccauuuacuguaauuuagucuuaaaauaaacuguggagcuuucaug

SEQ ID NO: 139560 - RNA, 63 nt, Homo Sapiens
uugaauugguggaaccacuaaaauucuguuaguagucuuaaaaucguaggcguuuauauuaua

SEQ ID NO: 139561 - RNA, 63 nt, Homo Sapiens
guacgcugcgugaacaugccucaccuuuaagagagucuuaaagguaaagacacgaaaacacuu

SEQ ID NO: 139562 - RNA, 63 nt, Homo Sapiens
acuaaaauuuuauauauuguaaccaguguuaaaagucuuaaaaaacaaugguauuaauugucc

SEQ ID NO: 139563 - RNA, 63 nt, Homo Sapiens
cuauaauuuuguguuuuuuuuuuuuaauugucuagucuuaaauuuguacaucuuguauaaaau

SEQ ID NO: 139564 - RNA, 63 nt, Homo Sapiens
aagcugggugggcugaagaggccuggaaacgagagucuuaauugaggagaugggagacucgaa

SEQ ID NO: 139565 - RNA, 63 nt, Homo Sapiens
uugaugggaugacugacacaggaaaucuguuaaagucuuaaaauggaaugagaauguuguuuu

SEQ ID NO: 139566 - RNA, 63 nt, Homo Sapiens
uacauaauucaaaagaacuacuugaugcaguauagucuuaaggguucugcauacauuuuagaa

SEQ ID NO: 139567 - RNA, 63 nt, Homo Sapiens
uuuguuuucuaaaguugauauaauuaguguuauagucuuaagaaaaugcauccucuagaaaaa

SEQ ID NO: 139568 - RNA, 63 nt, Homo Sapiens
ucaauggacaaaaauaaaauaugcugugcaugcagucuuaaauccauccccaagcaccuccuc

SEQ ID NO: 139569 - RNA, 63 nt, Homo Sapiens
guguuugcagcucaaaaauacuaugaagaucaaagucuuaaguuuuauuuccuaaaugccaua

SEQ ID NO: 139570 - RNA, 63 nt, Homo Sapiens
auuaguagugggauuuggcuaauugauaauagcagucuuaaacgcaaauugaauuggaauagg

SEQ ID NO: 139571 - RNA, 63 nt, Homo Sapiens
caaacauuuuauauaaaguuuaauagcaaugacagucuuaagcuggaauuucauucaaaggca

SEQ ID NO: 139572 - RNA, 63 nt, Homo Sapiens
cuucugguucccauaaaagaccugguucccauuagucuuaaguggagucucuggcuuaugacu

SEQ ID NO: 139573 - RNA, 63 nt, Homo Sapiens
aaucaaacaauggaggaaucacugaaagggcaaagucuuaaucaacuuaggcccuggcaauua

SEQ ID NO: 139574 - RNA, 63 nt, Homo Sapiens
aauaaagauuuauaacagaacugcagguguucaagucuuaaaagauugcuuuuguauuuaauu

SEQ ID NO: 139575 - RNA, 63 nt, Homo Sapiens
uucauugcuaagacuaacucaagauaauccuagagucuuaaagcauuucaggccaguguggug

SEQ ID NO: 139576 - RNA, 63 nt, Homo Sapiens
uuaggaauuacuuuauuauaaaaugcuccuagaagucuuaauuguguuuauuuuuuaaaaaaa

SEQ ID NO: 139577 - RNA, 63 nt, Homo Sapiens
acucuuccccucuucucacuacugcacuugacuagucuuaaaacaaagaaagaacgaaugaau

SEQ ID NO: 139578 - RNA, 63 nt, Homo Sapiens
gauaaaauauugauguuguauuuuacacucuuaagucuuaaccacagucagaauuaucuuaau

SEQ ID NO: 139579 - RNA, 63 nt, Homo Sapiens
cucucacggggcaagccugaaacuguauagccaagucuuaaacgccccacugcaucucaagug

SEQ ID NO: 139580 - RNA, 63 nt, Homo Sapiens
ucaaauuacuauaugaugauaauggcugaaguuagucuuaaacauacuuucaauauuauucug

SEQ ID NO: 139581 - RNA, 63 nt, Homo Sapiens
uuauuguuaugauuauacuuuauuucacacauaagucuuaauguaaguguuucagaaauguuu

SEQ ID NO: 139582 - RNA, 63 nt, Homo Sapiens
uuuauuuaauaauuauauuugguuaguauuuaaagucuuaacaguauuuuuaaauuuuucuug

SEQ ID NO: 139583 - RNA, 63 nt, Homo Sapiens
cuugguaccacagaauaucaauuucuauguugaagucuuaaccgcugagugugucucccuaaa

SEQ ID NO: 139584 - RNA, 63 nt, Homo Sapiens
ugucuguacauaucugucugucuuaaacagaacagucuuaaaaaguacacagacaugaacugu

SEQ ID NO: 139585 - RNA, 63 nt, Homo Sapiens
uuguuggaaauaauguaccccccauucaugguaagucuuaagcuguguuuuuguaugaaugag

SEQ ID NO: 139586 - RNA, 63 nt, Homo Sapiens
ucuaaaauuuuaaauaaaagugagguggucguaagucuuaacucuauuaggaauggcauauac

SEQ ID NO: 139587 - RNA, 63 nt, Homo Sapiens
cuuugagucuagagagauuuaauagguuggcauagucuuaagugagcaguguaauuacaaaca

SEQ ID NO: 139588 - RNA, 63 nt, Homo Sapiens
cuacauaaaagcuccaugugaaaagcuacuccuagucuuaacauuugcaguccuugugucacu

SEQ ID NO: 139589 - RNA, 63 nt, Homo Sapiens
uuaaaaaaggaaaaaaaaaagaaacuggguuccagucuuaauucauuuuccgugccagguuuu

SEQ ID NO: 139590 - RNA, 63 nt, Homo Sapiens
cuuuucuuugcaagcgaaccuguuugaagcccaagucuuaacuccuggucucguaagguucca

SEQ ID NO: 139591 - RNA, 63 nt, Homo Sapiens
acuuuuugcucuggucaguuacacacaaacggaagucuuaaaauuuugaauguaaaaguugca

SEQ ID NO: 139592 - RNA, 63 nt, Homo Sapiens
aggaaacuaaaagcuuucaccauucucaagaaaagucuuaacuuaugucugcaccagugaauc

SEQ ID NO: 139593 - RNA, 63 nt, Homo Sapiens
aaaguauuaauagaaauucucuaucagcuauucagucuuaauuucacuaguaguauaaugggu

SEQ ID NO: 139594 - RNA, 63 nt, Homo Sapiens
agucuggguuguugggaacagcacagaauuuggagucuuaagcucuaaauuagaggcccugac

SEQ ID NO: 139595 - RNA, 63 nt, Homo Sapiens
uucuuuucuuuuuuaaaguaaacuuguguauugagucuuaacuguauuucaguauuuuccagc

SEQ ID NO: 139596 - RNA, 63 nt, Homo Sapiens
gugcauuuccuccugccuuugcuuguucacugcagucuuaagaaagagguaaaaggcaagcaa

SEQ ID NO: 139597 - RNA, 63 nt, Homo Sapiens
aaggguuugccggcccuaacgugcucagggcugagucuuaaaggagcucaguucccauugcuu

SEQ ID NO: 139598 - RNA, 63 nt, Homo Sapiens
accauauucaggguacgaaccugcuccauuccuagucuuaauugugauauuuuuuagacugaa

SEQ ID NO: 139599 - RNA, 63 nt, Homo Sapiens
gggagagggcuuucuggggcgggcgccucgugcagucuuaacacgccuuucucaccacccugg

SEQ ID NO: 139600 - RNA, 63 nt, Homo Sapiens
auacaaaaugguauuguuuauucacacagugagagucuuaaagcauaauugaugcacaugaug

SEQ ID NO: 139601 - RNA, 63 nt, Homo Sapiens
uuucuaacucugauguaaauauucaagaaagccagucuuaacagauucgagcuauauuuaagu

SEQ ID NO: 139602 - RNA, 63 nt, Homo Sapiens
cacuuuuuuaauauauaugauaauucaauuuuaagucuuaagugcaccuuucuguacaaauac

SEQ ID NO: 139603 - RNA, 63 nt, Homo Sapiens
gucacuggccucuccccaggcccccaucaccagagucuuaagggcgguggagggaucaguugc

SEQ ID NO: 139604 - RNA, 63 nt, Homo Sapiens
uucaguaugaaaccaguuucagguguagaacucagucuuaaacuccguaguguagaagcccac

SEQ ID NO: 139605 - RNA, 63 nt, Homo Sapiens
acaguguaacuuacaguuucgggugaagauacaagucuuaaccuagaaugugggcuuuuucaa

SEQ ID NO: 139606 - RNA, 63 nt, Homo Sapiens
cuauaauguucauuuaguuguaaaggcacauaaagucuuaacuuauugauacuaaagaggagu

SEQ ID NO: 139607 - RNA, 63 nt, Homo Sapiens
uacauuuaacuuuggaauggcuuuguaauaaucagucuuaagaaaauguugacaagcucuggu

SEQ ID NO: 139608 - RNA, 63 nt, Homo Sapiens
gaaucuggugaauuuuagucaucccagcuuuuuagucuuaaccacaguucucacucucuuaaa

SEQ ID NO: 139609 - RNA, 63 nt, Homo Sapiens
uguucuguaaauuuuauuuuaaacuguuaccauagucuuaaguuguuuaugcuuuaucagacu

SEQ ID NO: 139610 - RNA, 63 nt, Homo Sapiens
uuuuguuuucuuucuauguuccaugcauaauacagucuuaagugaauuucucuuuuuuaauuu

SEQ ID NO: 139611 - RNA, 63 nt, Homo Sapiens
uacaaaggaaccaaaaugauaaugggagaauuuagucuuaaaaguuuagguugucagaguuua

SEQ ID NO: 139612 - RNA, 63 nt, Homo Sapiens
cuauguuuuuaaauuuuuuuuaaucuacaaauaagucuuaaacuacaagucaggguguuuggc

SEQ ID NO: 139613 - RNA, 63 nt, Homo Sapiens
aguuuugugcccuggcucuacgaacccaaugguagucuuaaaguaaaagugcuaauguguauu

SEQ ID NO: 139614 - RNA, 63 nt, Homo Sapiens
agacccaagucaucaugaaaaaggcccaaguacagucuuaaugcgauaaauccacuagcuaag

SEQ ID NO: 139615 - RNA, 63 nt, Homo Sapiens
ccagcuguccccacgccucugucuuuugggucaagucuuaaucccugcaccugaguugguccu

SEQ ID NO: 139616 - RNA, 63 nt, Homo Sapiens
aauuguucugugauugaggaccacugaaaaauaagucuuaauaaauguugguaugaaccuacu

SEQ ID NO: 139617 - RNA, 63 nt, Homo Sapiens
uucuucaaaaugugcauguuaaguauucaaaucagucuuaaauuuuuaaaaauauguaauuuu

SEQ ID NO: 139618 - RNA, 63 nt, Homo Sapiens
caggaacuauucuaaaagucauaaaagggucacagucuuaagcagagcuuaguuuucuucuca

SEQ ID NO: 139619 - RNA, 63 nt, Homo Sapiens
uuuuuuuacacauauuaacuuaauaaauguaugagucuuaaauaccucuuaguucucauuaaa

SEQ ID NO: 139620 - RNA, 63 nt, Homo Sapiens
gggucuuggugcccaagcuggucucaaacuccuagucuuaagcaaucuuccugcuuuggccuc

SEQ ID NO: 139621 - RNA, 63 nt, Homo Sapiens
gcagccccgccccccugccucacccacaaacuaagucuuaacaaaauccaaauuaccaacaaa

SEQ ID NO: 139622 - RNA, 63 nt, Homo Sapiens
acaccaaaacugagccauggaaagugcagcucaagucuuaaaggacggcagagccuccuucag

SEQ ID NO: 139623 - RNA, 63 nt, Homo Sapiens
acacggagccaccaacuggauuuuuaaugauaaagucuuaaaaccuucucuaauuucuucuuu

SEQ ID NO: 139624 - RNA, 63 nt, Homo Sapiens
uuuccccuucagaugucagugugcagauuccacagucuuaagcagauugaaaagagaccgaau

SEQ ID NO: 139625 - RNA, 63 nt, Homo Sapiens
auagguaguuuucuauaguaacuugauuaauuuagucuuaauccauuugaaacucucucuucc

SEQ ID NO: 139626 - RNA, 63 nt, Homo Sapiens
acuugcccucgugccugggggagagaggcagcaagucuuaacaaaccaacaucuuugcgaaaa

SEQ ID NO: 139627 - RNA, 63 nt, Homo Sapiens
uucuacuacuacauauuuagaguucacugguucagucuuaaaugccugcauggugccuuuuua

SEQ ID NO: 139628 - RNA, 63 nt, Homo Sapiens
cacuggaugaaaaucuaggauguaguuaaggccagucuuaaccuuucagguaguaauauucag

SEQ ID NO: 139629 - RNA, 63 nt, Homo Sapiens
uggggcuucauguguggccuuacccguuggaagagucuuaaacucacucacucacucaacaaa

SEQ ID NO: 139630 - RNA, 63 nt, Homo Sapiens
gaugccccuuccaaaccaucccugguuucuuuaagucuuaaguugggguguuucgccugcacc

SEQ ID NO: 139631 - RNA, 63 nt, Homo Sapiens
uaucuggcauuugggugaacguuuguauuugguagucuuaauguuuuggggggaacauuuuag

SEQ ID NO: 139632 - RNA, 63 nt, Homo Sapiens
uaccguauucgccguacuaaguugguuucuguuagucuuaacagucuguuuucuuuuaaaagc

SEQ ID NO: 139633 - RNA, 63 nt, Homo Sapiens
gacuuagcccauaggcacuugaguauauuuugaagucuuaaaacugucauaauuuaagcauuu

SEQ ID NO: 139634 - RNA, 63 nt, Homo Sapiens
ggaacuuggcauuuuccugacaaggagcuuuaaagucuuaaugcaccccgcaaccugggaucu

SEQ ID NO: 139635 - RNA, 63 nt, Homo Sapiens
acaaagugccaaagaaaguguguagaagcaugaagucuuaaggaccuuguaaaagacagugua

SEQ ID NO: 139636 - RNA, 63 nt, Homo Sapiens
acccuggccuccuagggucccuuuuucugaugaagucuuaauucccuaaaagcgccucuuugg

SEQ ID NO: 139637 - RNA, 63 nt, Homo Sapiens
guuaugagaaccagcgaaaucccccaugucaucagucuuaaaaaaaaaauuuuacaaauccac

SEQ ID NO: 139638 - RNA, 63 nt, Homo Sapiens
ggauuguaggcuguguagaaugaugaagaaauuagucuuaauacuccuguuagacaaacacau

SEQ ID NO: 139639 - RNA, 63 nt, Homo Sapiens
auuugugacauauguaucuaguuacauuuuuuaagucuuaaucggcucccacuucuugggagg

SEQ ID NO: 139640 - RNA, 63 nt, Homo Sapiens
ugguuuauacuuuuucuauucaucaggguaggaagucuuaaauccuuaggcauccaagaagua

SEQ ID NO: 139641 - RNA, 63 nt, Homo Sapiens
uggaucaccauuauauuuugaaagaagccaucaagucuuaaguuuuucauuucaacuugugaa

SEQ ID NO: 139642 - RNA, 63 nt, Homo Sapiens
aaugugugaaagaaccucacacaacauaauuggagucuuaaaauagaggaagaguaagcaaag

SEQ ID NO: 139643 - RNA, 63 nt, Homo Sapiens
gcuuauugcuucuguauuucuucucuacucccuagucuuaauguuuaaccuugaaugcuauua

SEQ ID NO: 139644 - RNA, 63 nt, Homo Sapiens
aauaaauacaaaaaaaucauuuuucuagagcagagucuuaaaaucagguggggguaggggaug

SEQ ID NO: 139645 - RNA, 63 nt, Homo Sapiens
cagauuacuccaggauaaucuccucaccucaugagucuuaacuuaauuacaucugcaaggccc

SEQ ID NO: 139646 - RNA, 63 nt, Homo Sapiens
ugaauuuuaguacuaguuuacacguauaaauacagucuuaaaccuuuaugucugagucugaaa

SEQ ID NO: 139647 - RNA, 63 nt, Homo Sapiens
uuucgccuuaguggugauuguuuaaacucucacagucuuaaaccgugccaaaguccuguuaug

SEQ ID NO: 139648 - RNA, 63 nt, Homo Sapiens
gucugcauuuucagguggggugauagaguucacagucuuaaaagucuccugagacaagcaucg

SEQ ID NO: 139649 - RNA, 63 nt, Homo Sapiens
cucuccgcuaaaguggacauauucuagaaauccagucuuaaauccucggcuccauuguggguu

SEQ ID NO: 139650 - RNA, 63 nt, Homo Sapiens
auauuucauugugaaagaagaagguaucaguccagucuuaaagguuacugaggcuucucccaa

SEQ ID NO: 139651 - RNA, 63 nt, Homo Sapiens
uauaugugggaggaggagggaagagacuagaagagucuuaaaugcccuugaacaucuccucca

SEQ ID NO: 139652 - RNA, 63 nt, Homo Sapiens
auuuuugcaauuuuuuaaauaugacucuuacauagucuuaagcgugaagugccuguguaauug

SEQ ID NO: 139653 - RNA, 63 nt, Homo Sapiens
ccagauuuacugaaaaugucacaauaaaaauccagucuuaauuauguaaaguugauauugacu

SEQ ID NO: 139654 - RNA, 64 nt, Homo Sapiens
cuccugagaagcuucaaauucaggccaggagagaagucuuaagaaaagaccuccagcaguuaca

SEQ ID NO: 139655 - RNA, 64 nt, Homo Sapiens
ucugacuauacuuaguuugaaauggugcaggcuuagucuuaagccuccaaaggccuggauuuga

SEQ ID NO: 139656 - RNA, 64 nt, Homo Sapiens
guuaacugccaaagcuaguuuuagagaaugagaaagucuuaagcaaaauacucccaggucucac

SEQ ID NO: 139657 - RNA, 64 nt, Homo Sapiens
aggaaagauacagggaacaaaaaucaauuuguacagucuuaauauuaaaagcagcuugacuaaa

SEQ ID NO: 139658 - RNA, 64 nt, Homo Sapiens
cuggaucugucuagucaaucaacauagcagagacagucuuaaaccuaccauugaccugugugua

SEQ ID NO: 139659 - RNA, 64 nt, Homo Sapiens
ugauuuccuugaagcaguuugaaaauuugaauugagucuuaacuuuaggaaaugagguuucaua

SEQ ID NO: 139660 - RNA, 64 nt, Homo Sapiens
gacaaccaggugggaccaaaguuuaugugccuuuagucuuaauuuaccuugcauuguaauauuc

SEQ ID NO: 139661 - RNA, 64 nt, Homo Sapiens
aggugauucuuucuuuaccauuucuggggacuuuagucuuaauuagguaccuuauuaacaggaa

SEQ ID NO: 139662 - RNA, 64 nt, Homo Sapiens
gucaaaaaucugcauauaacuuuugauuccccaaagucuuaaguacuaguagccuguuauugac

SEQ ID NO: 139663 - RNA, 64 nt, Homo Sapiens
guauauugcaaaauuuaauauauuuguucacuugagucuuaagaguaggucaggccaaggcagg

SEQ ID NO: 139664 - RNA, 64 nt, Homo Sapiens
caaauuaguggaacuuaguucagggacauagaagagucuuaaugaauuaaaaucauucacuuga

SEQ ID NO: 139665 - RNA, 64 nt, Homo Sapiens
gauaaaacaauggcugguucuagcccugagugacagucuuaaggcuagauccuucccauaguau

SEQ ID NO: 139666 - RNA, 64 nt, Homo Sapiens
gacaguuuuauagcugguuccuuuuaggguaaagagucuuaagagaguuuuauugugucuaugg

SEQ ID NO: 139667 - RNA, 64 nt, Homo Sapiens
ugcuuuauuagugaggagaaaacaauuccuuagaagucuuaaauauauuguacucuuuagaucu

SEQ ID NO: 139668 - RNA, 64 nt, Homo Sapiens
uucucuuuuaaagcugcauggaaugucauauaguagucuuaaguguguuuuuuguguaauucgu

SEQ ID NO: 139669 - RNA, 64 nt, Homo Sapiens
uuccuaccacuuugguuucauagugaaagugcuaagucuuaagugcccuucgauguaugccauu

SEQ ID NO: 139670 - RNA, 64 nt, Homo Sapiens
uucugccccauaagacuuuccauauuuauaaaggagucuuaaugccuguugauuaaucuauuuu

SEQ ID NO: 139671 - RNA, 64 nt, Homo Sapiens
uggcagccauucugccuuugauaaggcaagcaaaagucuuaacaccuaaaauauacccaucagu

SEQ ID NO: 139672 - RNA, 64 nt, Homo Sapiens
guuuaucuuuucucugcugaggggcaaaaaagaaagucuuaagauccuuucugacacauaauuu

SEQ ID NO: 139673 - RNA, 64 nt, Homo Sapiens
cugagauuucuaaagaugcucuuagccccuccuaagucuuaauggcuguucaacauccucccuc

SEQ ID NO: 139674 - RNA, 64 nt, Homo Sapiens
cuaaauuugugugaauaaucgguuuuuaaugaauagucuuaaauauuaacgaguguuuuaaaaa

SEQ ID NO: 139675 - RNA, 64 nt, Homo Sapiens
guugagccuuuccuuucauacagcauaugaaacuagucuuaacugccuguuucacucacucacc

SEQ ID NO: 139676 - RNA, 64 nt, Homo Sapiens
gccagcagaaaaacuccauagauucugauucugaagucuuaacuaguuaaauguauguaagauu

SEQ ID NO: 139677 - RNA, 64 nt, Homo Sapiens
uccucacagcacgggagcagucugugaguuuaggagucuuaagaaaauagguugaaaacaauca

SEQ ID NO: 139678 - RNA, 64 nt, Homo Sapiens
ucaaaguauccaauauuuuauuuucauuuaaaguagucuuaaaauaugguauuccauuagguuc

SEQ ID NO: 139679 - RNA, 64 nt, Homo Sapiens
uuucaccaggggugcucaccauuuauacucacugagucuuaacugccacagcucuucuuggcgu

SEQ ID NO: 139680 - RNA, 64 nt, Homo Sapiens
gaauaucagagguaagagggauacauccucugccagucuuaauaagugauagaaaacccacaca

SEQ ID NO: 139681 - RNA, 64 nt, Homo Sapiens
aaacucaggaggaccaaugugugaccacggacaaagucuuaacagucuuuggauagcugucuga

SEQ ID NO: 139682 - RNA, 64 nt, Homo Sapiens
uaaauguacugugaagaaugugaaaacagaagacagucuuaauagaaauuuucaacccuuaauc

SEQ ID NO: 139683 - RNA, 64 nt, Homo Sapiens
ucugcuauuuacagagcauuuaaacacaaugguaagucuuaaaguuaguugagucacugagguu

SEQ ID NO: 139684 - RNA, 64 nt, Homo Sapiens
uuuacugaauaagauuugaguaaugaaagucuguagucuuaaaacucuaaaacaguuguacugc

SEQ ID NO: 139685 - RNA, 64 nt, Homo Sapiens
cacgaauagguaauugauagaguuuaugggucuuagucuuaaggguaacagagugaauaccuuc

SEQ ID NO: 139686 - RNA, 64 nt, Homo Sapiens
caaaucauguuuagaaacuuuggaugaguuaagaagucuuaaguaugcaggcguuuacgugauu

SEQ ID NO: 139687 - RNA, 64 nt, Homo Sapiens
ccaugugguauuaauauaccuucaauuuauguugagucuuaaacauaauuaggagauauuuuuc

SEQ ID NO: 139688 - RNA, 64 nt, Homo Sapiens
cuaguugaaauuuuuaauagaaucaaggcacaaaagucuuaaaaccauguggaaaaauuaggua

SEQ ID NO: 139689 - RNA, 64 nt, Homo Sapiens
gcaggcugucauagaguuauguguuagucucaggagucuuaacuuuugaaauauguuuuacuug

SEQ ID NO: 139690 - RNA, 64 nt, Homo Sapiens
uuaggguuccacaucauucuaauguauaguuucaagucuuaauagacaaucugaauuccacuac

SEQ ID NO: 139691 - RNA, 64 nt, Homo Sapiens
uucaaaagggcaauguuuucuuuauauuucuuauagucuuaauuuuguuauccaugugcauaau

SEQ ID NO: 139692 - RNA, 64 nt, Homo Sapiens
uuucauacaaccauuuucaaaugaaccuuagaaaagucuuaacauuuaagguauuuuaugcaca

SEQ ID NO: 139693 - RNA, 64 nt, Homo Sapiens
uuuuaacauuuauagugcuuacauuauacacugaagucuuaacaaaaaaggcaggauguuauug

SEQ ID NO: 139694 - RNA, 64 nt, Homo Sapiens
ugagguuugccaaaugagaaguuuaagauacuuuagucuuaaauuguuuuugguggaggaagaa

SEQ ID NO: 139695 - RNA, 64 nt, Homo Sapiens
uuaaaugcuaaaaacaauugaaacacugagccauagucuuaaauuguuaacuuauuuauuuuuc

SEQ ID NO: 139696 - RNA, 64 nt, Homo Sapiens
cuuuucagcauuaacgcaaauaacagucccccaaagucuuaacucaaaaccaaucaugccuucc

SEQ ID NO: 139697 - RNA, 64 nt, Homo Sapiens
auuuacuaaaauggucaacucaacuccucuucuuagucuuaauagagagagaguacugaaaaag

SEQ ID NO: 139698 - RNA, 64 nt, Homo Sapiens
uuuucuaaaagaagacaauacaaucuguuauuccagucuuaaauuuacagcauugcaggaaaaa

SEQ ID NO: 139699 - RNA, 64 nt, Homo Sapiens
uuuuucuuuuaaaaaacauccacaucuugaauaaagucuuaacauuuuguuauaaugccugaua

SEQ ID NO: 139700 - RNA, 64 nt, Homo Sapiens
aacagguuuucuaauccagagcuggaugugacccagucuuaauaaagggcacugaaauguacua

SEQ ID NO: 139701 - RNA, 64 nt, Homo Sapiens
gucaauauuauuuuugucuacccuuagacagugaagucuuaauuaccccaggguaggucugugg

SEQ ID NO: 139702 - RNA, 64 nt, Homo Sapiens
ugaccuggacgugaaggaaaauuuaagauaccgaagucuuaaaguugaagugaugcauguguga

SEQ ID NO: 139703 - RNA, 64 nt, Homo Sapiens
uuaaauauaugauuagccaguuucuaaagccuuaagucuuaauauuauuuuuugaauaauaacu

SEQ ID NO: 139704 - RNA, 64 nt, Homo Sapiens
aguuggcuauaaguacgucauucuuaguccagucagucuuaaaaacaucuuggguuacccacuc

SEQ ID NO: 139705 - RNA, 64 nt, Homo Sapiens
ggccaguugcuguuuuuucaugcagugcccugggagucuuaaaagcagugcuuagcaacauugg

SEQ ID NO: 139706 - RNA, 64 nt, Homo Sapiens
auugacaaaagccggggucaaaaaaaguaguuuaagucuuaagacugaauaugcauuaaaguau

SEQ ID NO: 139707 - RNA, 64 nt, Homo Sapiens
ucugcuauuucuuuucaguuuuuccaaagucaagagucuuaaccuuguacucagggaauuuuga

SEQ ID NO: 139708 - RNA, 64 nt, Homo Sapiens
uugugcgccugugagcgcccagcuucuguuucauagucuuaacagguggccauugucgugaaac

SEQ ID NO: 139709 - RNA, 64 nt, Homo Sapiens
uccugaaauuuuuuauaauauauguaauuugucuagucuuaaagacauuuggagcauggccaac

SEQ ID NO: 139710 - RNA, 64 nt, Homo Sapiens
aaggucuagaaaagcauccugucuggcauuuuguagucuuaacuucuccccauuucccccaucu

SEQ ID NO: 139711 - RNA, 64 nt, Homo Sapiens
gcacagaaaaggauguuuggcaauuugucuuuuaagucuuaaccuugcuaaugugaauacuggg

SEQ ID NO: 139712 - RNA, 64 nt, Homo Sapiens
gacagcacugaaccuauuccgaaaaccagaguacagucuuaaguaucacagaagggcguauuuc

SEQ ID NO: 139713 - RNA, 64 nt, Homo Sapiens
uaucaacuccuuaaaugugcauucugauucauauagucuuaaauuauuuuaauggaguguuaaa

SEQ ID NO: 139714 - RNA, 64 nt, Homo Sapiens
agaugaauggaugagagaagaggacacagaaggcagucuuaagauaagauaauuucccugcaaa

SEQ ID NO: 139715 - RNA, 64 nt, Homo Sapiens
gauaguuuauaaucaggcaugaaaccuuugaaauagucuuaaugguuauuguuggguagaaggg

SEQ ID NO: 139716 - RNA, 64 nt, Homo Sapiens
ccagaaaauaaguuuauagcuuagaguaaauuuuagucuuaaagacaaaacauuuuagaaaauc

SEQ ID NO: 139717 - RNA, 64 nt, Homo Sapiens
aucuauuggccacgaugaaauuugcugaaaaguuagucuuaauuuugaauauaggagaaaucag

SEQ ID NO: 139718 - RNA, 64 nt, Homo Sapiens
aucuaagacucaguuguaguaucauguagacuaaagucuuaaacauguauuaauugauuuaaac

SEQ ID NO: 139719 - RNA, 64 nt, Homo Sapiens
cuggaaauuuuauuagcaauuagcuauaagcuuaagucuuaauuaaauugcucuuaaacuuucc

SEQ ID NO: 139720 - RNA, 64 nt, Homo Sapiens
aaacauugaauuguaguaaaaagguccugacuuuagucuuaauauuaugacucaguaaguuggc

SEQ ID NO: 139721 - RNA, 64 nt, Homo Sapiens
agguucaugaucuacauugguuuuuaccauaaugagucuuaagucagaaaaauguaagaauuug

SEQ ID NO: 139722 - RNA, 64 nt, Homo Sapiens
ggucaaugccagagacggaagccuuuuuccccaaagucuuaaaauaacuuauaucaucagcaua

SEQ ID NO: 139723 - RNA, 64 nt, Homo Sapiens
acauccaucagaaucuucuggagaauauggucagagucuuaaacaggcccagugcugaguucuu

SEQ ID NO: 139724 - RNA, 64 nt, Homo Sapiens
gucuuugcuuuaauaaaugagcaacccuggguauagucuuaaaauucugcacaauaaauuuuga

SEQ ID NO: 139725 - RNA, 64 nt, Homo Sapiens
uguuauuaaauuuauuauuuaagaugguagcacuagucuuaaauuguauaaaauauccccuaac

SEQ ID NO: 139726 - RNA, 64 nt, Homo Sapiens
uguuauuaaauuuauuauuaaagauaguagcacuagucuuaaauuugauauaacaucuccuaac

SEQ ID NO: 139727 - RNA, 64 nt, Homo Sapiens
ugcauggcccuguuagagauggcguagaagugaaagucuuaaagggagcauuagagauccuuuu

SEQ ID NO: 139728 - RNA, 64 nt, Homo Sapiens
ggauggucucgaucuccugaccuugaaucacaagagucuuaacagggaauguuucaggaaacaa

SEQ ID NO: 139729 - RNA, 64 nt, Homo Sapiens
auaaauaauuaaaauaucagacauguuuuggaaaagucuuaauuugagaacaccaaaggaaacu

SEQ ID NO: 139730 - RNA, 64 nt, Homo Sapiens
gaaauuaagccauuuaacaugugaaaaacauaagagucuuaaaagaguauaauacccauuuaau

SEQ ID NO: 139731 - RNA, 64 nt, Homo Sapiens
uaaaaguugucuaaacugucuaagggggcauucuagucuuaacuaacgguggugccuaucuacu

SEQ ID NO: 139732 - RNA, 64 nt, Homo Sapiens
ugauguuuuucaacuuuuauaaauuaguagcaccagucuuaauuagugcacauauuucauaacc

SEQ ID NO: 139733 - RNA, 64 nt, Homo Sapiens
cuuuaugaugcuaugguuugguuaguagcccuucagucuuaauaucuuuaaaaugaauagguag

SEQ ID NO: 139734 - RNA, 64 nt, Homo Sapiens
auauuuaaguguuacuguggaauuucugcauucgagucuuaaccauuagcuuuccaaccaacca

SEQ ID NO: 139735 - RNA, 64 nt, Homo Sapiens
aaaaaaaaaaacagaaaaagaaacugaauuaggcagucuuaaaaucuugucagacaauggcuau

SEQ ID NO: 139736 - RNA, 64 nt, Homo Sapiens
auaaaggcauauuguucaugguaucuuuuaaaugagucuuaaaaaaguuuguguuuugucgaca

SEQ ID NO: 139737 - RNA, 64 nt, Homo Sapiens
ggguuaccgucucaugugaaccuggagauucaccagucuuaacuuuugggucauuguguuuucu

SEQ ID NO: 139738 - RNA, 64 nt, Homo Sapiens
uuuuccauuuuugucagucugagucaucaaaaagagucuuaauuuucuaaaacaaguuggcuag

SEQ ID NO: 139739 - RNA, 64 nt, Homo Sapiens
accaugcaguuguuuaccaaaaauagaggaggagagucuuaacuuuugcucuuggauuuaaguc

SEQ ID NO: 139740 - RNA, 64 nt, Homo Sapiens
uuaggcuuaauucauucaauugucaaguacacuuagucuuaauacacucagguuugaacagauu

SEQ ID NO: 139741 - RNA, 64 nt, Homo Sapiens
ugcauauucuccuuucauccuggcuugccaacgcagucuuaauuccgccuuuuuuuuuucuaau

SEQ ID NO: 139742 - RNA, 64 nt, Homo Sapiens
uuuuuaguuuuauguaaccauaucaauauuauuuagucuuaaacuaguuacguuauuaugcaau

SEQ ID NO: 139743 - RNA, 64 nt, Homo Sapiens
uuuccagcauuucuucauuugauucucuuuuuuuagucuuaaaauaaugacuccuauucagaca

SEQ ID NO: 139744 - RNA, 64 nt, Homo Sapiens
ggauuauguuuuuggauugucaaagaggaugcuuagucuuaaaauaaaaauaaauuuaaaaauc

SEQ ID NO: 139745 - RNA, 64 nt, Homo Sapiens
cacacccuaguaaccucuugagauuaaauuacauagucuuaauauuucuguuccuccaugcaac

SEQ ID NO: 139746 - RNA, 64 nt, Homo Sapiens
acugucuauccccacgaaauuuaguuuuaucaguagucuuaaaguguugaucucaaacaaguac

SEQ ID NO: 139747 - RNA, 64 nt, Homo Sapiens
ggaaauggaagauuuuuuuuuaacuuguucuagaagucuuaauaugggcuguugccaugaaggc

SEQ ID NO: 139748 - RNA, 64 nt, Homo Sapiens
uauucccacgauauucuguacuagcacuaauuuuagucuuaaaaaauuuauauauucagauacu

SEQ ID NO: 139749 - RNA, 64 nt, Homo Sapiens
auagcguguauacuugaauaaagacuuaauuuuaagucuuaaaagauaucuuuauuauagccuu

SEQ ID NO: 139750 - RNA, 64 nt, Homo Sapiens
auuucaaaauaaaagugguuuauaacuucuugugagucuuaaguggaucucucugaacuauuuu

SEQ ID NO: 139751 - RNA, 64 nt, Homo Sapiens
ugguguuguucuaauuuuccaaauccggaaauauagucuuaaccccaugggaggcaaagaaagg

SEQ ID NO: 139752 - RNA, 64 nt, Homo Sapiens
cauccaccagagucuagaagucuuuaucacccucagucuuaaucccaucaguccuggggcuuuu

SEQ ID NO: 139753 - RNA, 64 nt, Homo Sapiens
aauuaaagauaacauuauaauuggucuuguuuuaagucuuaaaaauacagauuuuuuguuuacc

SEQ ID NO: 139754 - RNA, 64 nt, Homo Sapiens
gaaguuucacuaaaaauguaauuuucuuuuggacagucuuaagaauagcaucauauauuaguuc

SEQ ID NO: 139755 - RNA, 64 nt, Homo Sapiens
uuggccagcaucuguuuaucaccaaguccuuaggagucuuaacagagagguuucaguuuuuaau

SEQ ID NO: 139756 - RNA, 64 nt, Homo Sapiens
acccuguagaaaccucguuauuaaccaguguuccagucuuaaaguagacaaaauauucagagcc

SEQ ID NO: 139757 - RNA, 64 nt, Homo Sapiens
auuuauuguuuuuaaaaugaaaggaauacuaauaagucuuaaaaguuccuucaugcauaagauu

SEQ ID NO: 139758 - RNA, 64 nt, Homo Sapiens
acaggugugagccacccugcccagccgucaaaagagucuuaauauauauauccagauggcaugu

SEQ ID NO: 139759 - RNA, 64 nt, Homo Sapiens
uucuucucuccucauggacuuuuucugcaauugcagucuuaagcuucacucuccaccaccugga

SEQ ID NO: 139760 - RNA, 64 nt, Homo Sapiens
agccugaguugucaccauuaugucuuaagcuguuagucuuaaagauuauuguuaaaaaauucag

SEQ ID NO: 139761 - RNA, 64 nt, Homo Sapiens
aguaagcuuaaacuacaacuugucacauaaaggaagucuuaaguggaguucacagaaugauaau

SEQ ID NO: 139762 - RNA, 64 nt, Homo Sapiens
cuuuaacuagcugccuuuagauuuugauaaucacagucuuaaaauacuaggaaagaaguggaug

SEQ ID NO: 139763 - RNA, 64 nt, Homo Sapiens
auauucgugugaaaaagaauacaucauuucucacagucuuaaguugauauuuauagaaaugaau

SEQ ID NO: 139764 - RNA, 64 nt, Homo Sapiens
uuuuucugaugaauaguguucaguaaaaugaagcagucuuaagagugacuaauaauuucaaagu

SEQ ID NO: 139765 - RNA, 64 nt, Homo Sapiens
guuucuguuugaagaaaauagagggagaaacagaagucuuaagucuguggcacacugugucuuc

SEQ ID NO: 139766 - RNA, 64 nt, Homo Sapiens
cccaaaggcucuuuucagaggucacuuuuucaucagucuuaaaaagaaagagcguaaauguaaa

SEQ ID NO: 139767 - RNA, 64 nt, Homo Sapiens
aaggcucuuuucagagccaccuuuuuaaggaagcagucuuaacaaacgagaacucuuauauugg

SEQ ID NO: 139768 - RNA, 64 nt, Homo Sapiens
guguacauguaguugaauuuauugaacuagggcaagucuuaaaucuccaguacuugagcugacc

SEQ ID NO: 139769 - RNA, 64 nt, Homo Sapiens
aaaauuacauauuuuauaauaaaauauuauuauuagucuuaacuaaccauuuuuaaagugcaca

SEQ ID NO: 139770 - RNA, 64 nt, Homo Sapiens
uaccugugcuucaguuuccugccuaccuuuugcaagucuuaacuugcuggaucugcugcuuccu

SEQ ID NO: 139771 - RNA, 64 nt, Homo Sapiens
agaaacuguuacugucccaaguucugcucauggaagucuuaaaccguuuucacagacaauaacu

SEQ ID NO: 139772 - RNA, 64 nt, Homo Sapiens
ccacaccacuauuccagcgauuuugaccguuccaagucuuaauguuugugaaccccugaagauu

SEQ ID NO: 139773 - RNA, 64 nt, Homo Sapiens
gggcugauaguccaaccaggagcucuggggcuugagucuuaauaauauuccaggcacaagagaa

SEQ ID NO: 139774 - RNA, 64 nt, Homo Sapiens
gauaaagacauaaaugggacauuugaagaugaauagucuuaaaauaaaaccuuauuuaugucuu

SEQ ID NO: 139775 - RNA, 64 nt, Homo Sapiens
augucugguuuuccaucuguaauuuuaccuagacagucuuaaauaugguaaaggaaacccaugc

SEQ ID NO: 139776 - RNA, 64 nt, Homo Sapiens
guauuuuaaauugaagccuucuuuaaauguaucaagucuuaauuuuaauguuuaucuugauaga

SEQ ID NO: 139777 - RNA, 64 nt, Homo Sapiens
uacacauugcauuuugauaacaauccauaacuuuagucuuaaugauuucuaugccaaacaggaa

SEQ ID NO: 139778 - RNA, 64 nt, Homo Sapiens
cucuccugcggccacaucaacggaugcaagucacagucuuaacacagccugugggagacaagca

SEQ ID NO: 139779 - RNA, 64 nt, Homo Sapiens
uugaaaaacauauaauuuacuucuuauaaauugaagucuuaaaugugaaaccaagaaauguaau

SEQ ID NO: 139780 - RNA, 64 nt, Homo Sapiens
cuuagaaaguuaaaagaauguagaaaagauacucagucuuaauccuaugcaaaaaaaaaaauca

SEQ ID NO: 139781 - RNA, 64 nt, Homo Sapiens
uacaggucuuugaucuggaaacuaagacuagagaagucuuaagagaugacugcucaggugagua

SEQ ID NO: 139782 - RNA, 64 nt, Homo Sapiens
gguccuuguuguuucuugccugaacuccugccauagucuuaacuggucuccuugcuuccugucu

SEQ ID NO: 139783 - RNA, 64 nt, Homo Sapiens
ucauaagguuauuauaauaaauuauauuaguaaaagucuuaacuggaaaaaagaaucuaaauca

SEQ ID NO: 139784 - RNA, 64 nt, Homo Sapiens
cugcaccuugaguugagagggcuacauguagaaaagucuuaaaauagagcuaaacaccacagug

SEQ ID NO: 139785 - RNA, 64 nt, Homo Sapiens
gucuuuuguacaaauaucuaggaacuggccauguagucuuaacaucauucuguuuccugcagug

SEQ ID NO: 139786 - RNA, 64 nt, Homo Sapiens
cugugucaguaagucuuuaaguuccucucucgaaagucuuaauuauccaacuuuucccuucuca

SEQ ID NO: 139787 - RNA, 64 nt, Homo Sapiens
aaucucuaagguuuguuucugugguggguuuuuaagucuuaaccgauuaagugguaaugucaua

SEQ ID NO: 139788 - RNA, 64 nt, Homo Sapiens
uaccuucaguuuaaucugugauaaccaaaacugaagucuuaauuuccucacagaaaaguuggaa

SEQ ID NO: 139789 - RNA, 64 nt, Homo Sapiens
uugaaugcugcuuucugcuuacuagaaauugggcagucuuaaugugggcuaaggaaguaucagc

SEQ ID NO: 139790 - RNA, 64 nt, Homo Sapiens
gugugcauaaaaaacuaaauguuaguguuuauaaagucuuaaauacccuucuggaauugcuaau

SEQ ID NO: 139791 - RNA, 64 nt, Homo Sapiens
aaauaugccuuuuugaagcaugagagugagacucagucuuaaaaccacugcacuccagucuggg

SEQ ID NO: 139792 - RNA, 64 nt, Homo Sapiens
uuauuauauuuuguuguuaccucuguuuucuuauagucuuaauuuuauugaauuauaccauuua

SEQ ID NO: 139793 - RNA, 64 nt, Homo Sapiens
aagugccagaccggaaccuauagcuacugcuagaagucuuaaaaaaaccaacagcagcacagga

SEQ ID NO: 139794 - RNA, 64 nt, Homo Sapiens
ugguugaauuguguucccccaaaauauauggugaagucuuaacccccauccccgugaaugggac

SEQ ID NO: 139795 - RNA, 64 nt, Homo Sapiens
gaagaaaauccuuuccucuugggaaaguaauacaagucuuaaguuccauuguagggugcgccuu

SEQ ID NO: 139796 - RNA, 64 nt, Homo Sapiens
ccuguauccucccuggcagacacaacccaauaggagucuuaauuuauuucuuaaccuuugcuau

SEQ ID NO: 139797 - RNA, 64 nt, Homo Sapiens
agguguauggauaugugauuuugagauuaaaguuagucuuaaaauguaaauaaaaugugaaacg

SEQ ID NO: 139798 - RNA, 64 nt, Homo Sapiens
ucauuauagaauuaucugugaguuguguagacacagucuuaauguuucugguuaugacagauaa

SEQ ID NO: 139799 - RNA, 64 nt, Homo Sapiens
gucgaauucuagacugaggaguagaguucauuggagucuuaaacucucugauaucacuuaaagc

SEQ ID NO: 139800 - RNA, 64 nt, Homo Sapiens
cucaggcuuuucguucauuagugguaccaaucucagucuuaaaggcagguggccaugacuaccc

SEQ ID NO: 139801 - RNA, 64 nt, Homo Sapiens
uucauguguacaccucuuuguguuaaaauuuuggagucuuaauugcacaucuucagggcaccag

SEQ ID NO: 139802 - RNA, 64 nt, Homo Sapiens
uuuccaacaugaaaauucucuuuaauuccaugaaagucuuaaugcauuggaaguucuuuguaau

SEQ ID NO: 139803 - RNA, 64 nt, Homo Sapiens
auuagguugaggucuaccuaaugccuuagaugauagucuuaaauaauagucacaaguauuaaua

SEQ ID NO: 139804 - RNA, 64 nt, Homo Sapiens
cugacauacuggauuuuuaagauuuggaugaagaagucuuaauaaauagcaauaaaccuaacug

SEQ ID NO: 139805 - RNA, 64 nt, Homo Sapiens
cugaaauacugaauuuuuaaucuuuggaugaagaagucuuaauaccuaguuagaguuagaccug

SEQ ID NO: 139806 - RNA, 64 nt, Homo Sapiens
ucuguccaccuucaagucaauagauaauuuuuccagucuuaagcucuuuguuaaaccccaauua

SEQ ID NO: 139807 - RNA, 64 nt, Homo Sapiens
aucaaaaugaaaacaaagcaaaugaauacuggacagucuuaacaauuuuauaaguuauaaaaug

SEQ ID NO: 139808 - RNA, 64 nt, Homo Sapiens
agugagcauuugccugaauaaaaccuaaaagaguagucuuaacacauuacuaacuuuuucuaag

SEQ ID NO: 139809 - RNA, 64 nt, Homo Sapiens
ucagauuaaucuuuuauccuuuccugaaguacaaagucuuaagagugucugaaauccaagacau

SEQ ID NO: 139810 - RNA, 64 nt, Homo Sapiens
uaguuuuacuacuuuucauuuagaacagaguaugagucuuaaucugaagucuuuuucaugcccu

SEQ ID NO: 139811 - RNA, 64 nt, Homo Sapiens
gcuuuauuuugguguuguguuuugaauuccccaaagucuuaauuucguuuuuguuuucuuguac

SEQ ID NO: 139812 - RNA, 64 nt, Homo Sapiens
uguacaguguauuuuauagagcuauauuuagaacagucuuaaaacacaguccauugugaagugu

SEQ ID NO: 139813 - RNA, 64 nt, Homo Sapiens
uucagcauauguugcugcugaaccaagcuucauuagucuuaaauugcauugggcuccgugccac

SEQ ID NO: 139814 - RNA, 64 nt, Homo Sapiens
aaaauauucaggucuaucaugaaaaaaaguuuacagucuuaaggcuuuuuuauaauuguuuuca

SEQ ID NO: 139815 - RNA, 64 nt, Homo Sapiens
aaggaaauuucccuaauguucaccugguuuggagagucuuaauuauuacaggcaugagcuacca

SEQ ID NO: 139816 - RNA, 64 nt, Homo Sapiens
uaguuaaaaguuuguauuuuuaagguaaucuguuagucuuaaaaugagagauuggugauuuaua

SEQ ID NO: 139817 - RNA, 64 nt, Homo Sapiens
agacaaaccauaucacuccuuauaaagcaaguccagucuuaaaagcacacuuuuacaaauuuaa

SEQ ID NO: 139818 - RNA, 64 nt, Homo Sapiens
uauuucaaggaaucagugucuuguccagaaaagaagucuuaagaauggaaacugaccaccuacu

SEQ ID NO: 139819 - RNA, 64 nt, Homo Sapiens
ccuuccauuuuuuagagacauuauaaaugagggaagucuuaagaaaaugaaucacggcaauuuc

SEQ ID NO: 139820 - RNA, 64 nt, Homo Sapiens
ucucuuucuggccaaagacuaaaugcauauauugagucuuaaaaccauauuuauauuuuuaaau

SEQ ID NO: 139821 - RNA, 64 nt, Homo Sapiens
ugaaucuagcauuuguuuucagagauucaagcauagucuuaaggguagaucagaaaugacaaau

SEQ ID NO: 139822 - RNA, 64 nt, Homo Sapiens
cagaccgaacuguuguauaaauuuauuuacugcuagucuuaagaacugcuuucuuucguuuguu

SEQ ID NO: 139823 - RNA, 64 nt, Homo Sapiens
gugcuucugugaauuaaguugugguuucaucaugagucuuaauguucuuuguugauaagacaag

SEQ ID NO: 139824 - RNA, 64 nt, Homo Sapiens
auauauauauaucaguuugaucacacuauuuuagagucuuaaugccaagucagcagauuugcuu

SEQ ID NO: 139825 - RNA, 64 nt, Homo Sapiens
ggguuuuguuaauucuuuucagaaucauugaagcagucuuaaagggucuuuugcagaugguaca

SEQ ID NO: 139826 - RNA, 64 nt, Homo Sapiens
uagaggauaaugguucaccucugcguaaacugcaagucuuaagcagacaucuggaauagagcuu

SEQ ID NO: 139827 - RNA, 64 nt, Homo Sapiens
gucagggcuuuucuggggcugcucuuggaaaugaagucuuaaguacugaauaacuccccugggg

SEQ ID NO: 139828 - RNA, 64 nt, Homo Sapiens
uuauauuaaugaggagaaaaguaugaaaacaagaagucuuaaguaaauauugaggucauuguuu

SEQ ID NO: 139829 - RNA, 64 nt, Homo Sapiens
ggggcuugagaagguuacugagugaguuauugggagucuuaauaaaauaaacuagauauuaggu

SEQ ID NO: 139830 - RNA, 64 nt, Homo Sapiens
uuuauauuacuauuuuccuuuuuguuguucacauagucuuaaggcaccuauacuuuuaaauuga

SEQ ID NO: 139831 - RNA, 64 nt, Homo Sapiens
cuuagccaggaaagacaaauaauccaacgcugcuagucuuaaccccagaccagagagaacugca

SEQ ID NO: 139832 - RNA, 64 nt, Homo Sapiens
caugcccggcccauaaguaccguuuuugagguucagucuuaaacauuugcuuuaagaaaacagu

SEQ ID NO: 139833 - RNA, 64 nt, Homo Sapiens
caaaaccaaucaugccuucccaacagucccccaaagucuuaacucauuucagcauuaacccaaa

SEQ ID NO: 139834 - RNA, 64 nt, Homo Sapiens
aacuuucauauuagcagauucgcuccuucaaaacagucuuaauuugcaaaggaaacuauugucu

SEQ ID NO: 139835 - RNA, 64 nt, Homo Sapiens
gccaaaauucauuauaaccccugcaugcaguggcagucuuaaguguauuucuuuuucgggguuu

SEQ ID NO: 139836 - RNA, 64 nt, Homo Sapiens
uauaauguaaaguugacauuccaucuucacuguuagucuuaaaugaccauuuauauucuaguag

SEQ ID NO: 139837 - RNA, 64 nt, Homo Sapiens
uucaggaguuuacaauugacuauacacauuuccuagucuuaacuuuguacucuuaugugucuga

SEQ ID NO: 139838 - RNA, 64 nt, Homo Sapiens
uuuucaauaaaauugagugauuuguaacuuuuaaagucuuaaacauaggcagggcgaauacuac

SEQ ID NO: 139839 - RNA, 64 nt, Homo Sapiens
cuuuuggguuugaaugaagguuuccccccaaguuagucuuaaauugucuaaagugauuaucuuu

SEQ ID NO: 139840 - RNA, 64 nt, Homo Sapiens
cacuucugcuuaaacucccaaaaugccgcugugaagucuuaaagggcggggcugaggaacaggg

SEQ ID NO: 139841 - RNA, 64 nt, Homo Sapiens
uaaugugucuuguucuuuuuuuauaaaaaguauuagucuuaacaauguuuuauuuuuagaauag

SEQ ID NO: 139842 - RNA, 64 nt, Homo Sapiens
ccaugucauagagaauaaagcugaugauuguaccagucuuaaauuauucaugauucaauaaaau

SEQ ID NO: 139843 - RNA, 64 nt, Homo Sapiens
auuuagaguuuccaaauuuagagcuucugcauacagucuuaaagccacagaggcuuguaaaaau

SEQ ID NO: 139844 - RNA, 64 nt, Homo Sapiens
gucauuucaggguaggagucaaugaagacaucuuagucuuaacaaguuacagauaaucucugac

SEQ ID NO: 139845 - RNA, 64 nt, Homo Sapiens
uuauaaggugagguaacucagaacuuaauuuaaaagucuuaaauauucugauacaauucagcug

SEQ ID NO: 139846 - RNA, 64 nt, Homo Sapiens
aaacaauuggcagaaccuguuugauuacugugacagucuuaaugauaccauaaaucaauauuag

SEQ ID NO: 139847 - RNA, 64 nt, Homo Sapiens
ucuuguuuuugcaucacugugucacauauuuuauagucuuaauauauuucgcugguucuuugua

SEQ ID NO: 139848 - RNA, 64 nt, Homo Sapiens
cauuuuaucuuaaauaauuuuaacccugacauucagucuuaacaauccauuaucccuuugccuu

SEQ ID NO: 139849 - RNA, 64 nt, Homo Sapiens
gagacacugcaaagucuuagcuuaauauuuugaaagucuuaaagcuuuuucguaacuuuugaau

SEQ ID NO: 139850 - RNA, 64 nt, Homo Sapiens
uuauaauuguucaauauguucuauuacuggguggagucuuaaagcccaucuaugggcuuuagac

SEQ ID NO: 139851 - RNA, 64 nt, Homo Sapiens
aguuuuauugucaaauaaacuguguucaguucaaagucuuaaccuuuuguauuauuguuuguuu

SEQ ID NO: 139852 - RNA, 64 nt, Homo Sapiens
agaugagaaguccuccccuuuccuaacaagacugagucuuaacaccugauauccccuggcucag

SEQ ID NO: 139853 - RNA, 64 nt, Homo Sapiens
uaaaaggggagaagaacaaacagcaaaggccucaagucuuaaaauguuauuugcuucuuuuaau

SEQ ID NO: 139854 - RNA, 64 nt, Homo Sapiens
uacuugcauccacuucaaauaauuuaaagcuucuagucuuaacagaauggcugaagagaucaag

SEQ ID NO: 139855 - RNA, 64 nt, Homo Sapiens
acagcuucuugcuuguaaaauaaguguaaaaaaaagucuuaacaugccccaaaauuauaaacuc

SEQ ID NO: 139856 - RNA, 64 nt, Homo Sapiens
gaaggaagcaggagugauuaugcaagagaauggaagucuuaauaacugguucauucuccauuac

SEQ ID NO: 139857 - RNA, 52 nt, Homo Sapiens; identical to SEQ ID NO: 139530

SEQ ID NO: 139858 - RNA, 64 nt, Homo Sapiens
auaaggaaagacuugguguauagugugaugguuuagucuuaaggauuaagacauuuuugguacu

SEQ ID NO: 139859 - RNA, 64 nt, Homo Sapiens
agaaaaauggacauaugaauauuauuaaaaauugagucuuaaauuuaaaugggaagggaagaaa

SEQ ID NO: 139860 - RNA, 64 nt, Homo Sapiens
agaagguuauggguaccaggaagaaacaaacagaagucuuaagauuagaaugagaaccaaagag

SEQ ID NO: 139861 - RNA, 64 nt, Homo Sapiens
ggauaagaugaccuguguaauaaucuuuguuaguagucuuaaagcugcugccauaguccuccaa

SEQ ID NO: 139862 - RNA, 64 nt, Homo Sapiens
cacauuucacauacuguuacugaagaaagcaccaagucuuaauggaacaaagaccauagaauga

SEQ ID NO: 139863 - RNA, 64 nt, Homo Sapiens
uuuuauugaugaauacaucucugaacguuccagaagucuuaagguuccaaagggauuuagcagu

SEQ ID NO: 139864 - RNA, 64 nt, Homo Sapiens
gacacuauuaugaagcuacuagucauuccauaagagucuuaaaggacugcucuguguaacacug

SEQ ID NO: 139865 - RNA, 64 nt, Homo Sapiens
aauucucauauccaugccuuuuuguccuguuuacagucuuaaaagagguaaaacagcaaauauu

SEQ ID NO: 139866 - RNA, 64 nt, Homo Sapiens
aacaaguuguuuguauuuuauuuuuguuuauaccagucuuaaagauccagguucugaauaaaaa

SEQ ID NO: 139867 - RNA, 64 nt, Homo Sapiens
caguagacaccacuguacuuuuugauacgagggcagucuuaacuuguguuaaggccugugugua

SEQ ID NO: 139868 - RNA, 64 nt, Homo Sapiens
gguauuggaguuuaaaaaaaaagccaaauuucacagucuuaauaacuuuuuuuaaaaaaaacua

SEQ ID NO: 139869 - RNA, 64 nt, Homo Sapiens
agguuuucaucaagccccgcccuuucucucucauagucuuaaugcgucuggaccacuggggaaa

SEQ ID NO: 139870 - RNA, 64 nt, Homo Sapiens
uguaaauaauguucaggaaaaacgcagggaacagagucuuaaaguuaauggauauuuaauguga

SEQ ID NO: 139871 - RNA, 64 nt, Homo Sapiens
acagaaguaauuggccugagagcauucuugaccaagucuuaaaugcuagaaucugagaaggaau

SEQ ID NO: 139872 - RNA, 64 nt, Homo Sapiens
aguugggacaucagcugacuuuacuuuaacuguuagucuuaaauacuuucucauacacugacug

SEQ ID NO: 139873 - RNA, 64 nt, Homo Sapiens
uaauuauuauuaaaccaaugauagaugugauuauagucuuaaacguaaauggacauuccagaau

SEQ ID NO: 139874 - RNA, 64 nt, Homo Sapiens
uuuggggacauuauaaacuuugggaugauuuucuagucuuaaggccaacuauaggccuuuuucu

SEQ ID NO: 139875 - RNA, 64 nt, Homo Sapiens
accugccuguuaguacagaggaggauuucuugggagucuuaauaccucagauugaaaagcuuau

SEQ ID NO: 139876 - RNA, 64 nt, Homo Sapiens
uucagagaaaacuucagagagagagcucaucaucagucuuaauacggcacuauuucugaacaaa

SEQ ID NO: 139877 - RNA, 64 nt, Homo Sapiens
uguguaagaaguuaaaacuuauuaaucuugaaguagucuuaaaauacugcucauuuacacucaa

SEQ ID NO: 139878 - RNA, 64 nt, Homo Sapiens
aaaaaaaggaaucugaaaaagauuuagccaaauaagucuuaaccgaaguuacacagaccacagu

SEQ ID NO: 139879 - RNA, 64 nt, Homo Sapiens
agggugaauuggaucaccauuaaaagugaaauucagucuuaaguauguaaauaguguccauuag

SEQ ID NO: 139880 - RNA, 64 nt, Homo Sapiens
uuacacuucuugacuucugagcauuaauuuuugcagucuuaaaauucuguuauuaaggggcaua

SEQ ID NO: 139881 - RNA, 64 nt, Homo Sapiens
ccauuuggauuaaagauucagcuuuaacacagaaagucuuaauauaaagguccuagucuuucug

SEQ ID NO: 139882 - RNA, 64 nt, Homo Sapiens
ggagaacugaaagggaaaacaaaauacuugacauagucuuaaguagaagaaggcaguuagagaa

SEQ ID NO: 139883 - RNA, 64 nt, Homo Sapiens
ucacugguaaaauuguugaauauuucucucucccagucuuaaaagcccacaggcaagaauuaau

SEQ ID NO: 139884 - RNA, 64 nt, Homo Sapiens
ucaaaaauuuuauucaguguauuuucaguuguugagucuuaaugagggauacaggaggaaaaau

SEQ ID NO: 139885 - RNA, 64 nt, Homo Sapiens
uuugugaacaacguuucuaucuuuaauaccugagagucuuaaaauguucucuguuuugaauaua

SEQ ID NO: 139886 - RNA, 64 nt, Homo Sapiens
uauuuuuuacuuaguaaccaguuuacuguaauuuagucuuaaaauuaaacuguggagcuuucau

SEQ ID NO: 139887 - RNA, 64 nt, Homo Sapiens
uugaauugguggaaccacuaaaaauucuguuaguagucuuaaaaaucguaggcguuuauauuau

SEQ ID NO: 139888 - RNA, 64 nt, Homo Sapiens
uguacgcugcgugaacaugccucaccuuuaagagagucuuaaagguaaagacacgaaaacacuu

SEQ ID NO: 139889 - RNA, 64 nt, Homo Sapiens
aacuaaaauuuuauauauuguaaccaguguuaaaagucuuaaaaaacaaugguauuaauugucc

SEQ ID NO: 139890 - RNA, 64 nt, Homo Sapiens
gcuauaauuuuguguuuuuuuuuuuuaauugucuagucuuaaauuuguacaucuuguauaaaau

SEQ ID NO: 139891 - RNA, 64 nt, Homo Sapiens
gaagcugggugggcugaagaggccuggaaacgagagucuuaauugaggagaugggagacucgaa

SEQ ID NO: 139892 - RNA, 64 nt, Homo Sapiens
uuugaugggaugacugacacaggaaaucuguuaaagucuuaaaauggaaugagaauguuguuuu

SEQ ID NO: 139893 - RNA, 64 nt, Homo Sapiens
auacauaauucaaaagaacuacuugaugcaguauagucuuaaggguucugcauacauuuuagaa

SEQ ID NO: 139894 - RNA, 64 nt, Homo Sapiens
uuuguuuucuaaaguugauaauaauuaguguuauagucuuaagacaaaugcauccucuagaaaa

SEQ ID NO: 139895 - RNA, 64 nt, Homo Sapiens
ucaauggacaaaaauaaaaucaugcugugcaugcagucuuaaauuccauccccaagcaccuccu

SEQ ID NO: 139896 - RNA, 64 nt, Homo Sapiens
guguuugcagcucaaaaauaacuaugaagaucaaagucuuaaguuuuuauuuccuaaaugccau

SEQ ID NO: 139897 - RNA, 64 nt, Homo Sapiens
auuaguagugggauuuggcugaauugauaauagcagucuuaaacugcaaauugaauuggaauag

SEQ ID NO: 139898 - RNA, 64 nt, Homo Sapiens
caaacauuuuauauaaaguuauaauagcaaugacagucuuaagcguggaauuucauucaaaggc

SEQ ID NO: 139899 - RNA, 64 nt, Homo Sapiens
cuucugguucccauaaaagauccugguucccauuagucuuaaguaggagucucuggcuuaugac

SEQ ID NO: 139900 - RNA, 64 nt, Homo Sapiens
aaucaaacaauggaggaaucaacugaaagggcaaagucuuaauccaacuuaggcccuggcaauu

SEQ ID NO: 139901 - RNA, 64 nt, Homo Sapiens
aauaaagauuuauaacagaaucugcagguguucaagucuuaaaaugauugcuuuuguauuuaau

SEQ ID NO: 139902 - RNA, 64 nt, Homo Sapiens
uuucauugcuaagacuaacucaagauaauccuagagucuuaaagcauuucaggccaguguggug

SEQ ID NO: 139903 - RNA, 64 nt, Homo Sapiens
auuaggaauuacuuuauuauaaaaugcuccuagaagucuuaauuguguuuauuuuuuaaaaaaa

SEQ ID NO: 139904 - RNA, 64 nt, Homo Sapiens
uacucuuccccucuucucacuacugcacuugacuagucuuaaaacaaagaaagaacgaaugaau

SEQ ID NO: 139905 - RNA, 64 nt, Homo Sapiens
ugauaaaauauugauguuguauuuuacacucuuaagucuuaaccacagucagaauuaucuuaau

SEQ ID NO: 139906 - RNA, 64 nt, Homo Sapiens
cucucacggggcaagccugagaacuguauagccaagucuuaaacagccccacugcaucucaagu

SEQ ID NO: 139907 - RNA, 64 nt, Homo Sapiens
ucaaauuacuauaugaugaugaauggcugaaguuagucuuaaacaauacuuucaauauuauucu

SEQ ID NO: 139908 - RNA, 64 nt, Homo Sapiens
uuauuguuaugauuauacuuuuauuucacacauaagucuuaaugcuaaguguuucagaaauguu

SEQ ID NO: 139909 - RNA, 64 nt, Homo Sapiens
uuuauuuaauaauuauauuuggguuaguauuuaaagucuuaacauguauuuuuaaauuuuucuu

SEQ ID NO: 139910 - RNA, 64 nt, Homo Sapiens
cuugguaccacagaauaucaaauuucuauguugaagucuuaaccagcugagugugucucccuaa

SEQ ID NO: 139911 - RNA, 64 nt, Homo Sapiens
ugucuguacauaucugucuguucuuaaacagaacagucuuaaaauaguacacagacaugaacug

SEQ ID NO: 139912 - RNA, 64 nt, Homo Sapiens
uuguuggaaauaauguacccgcccauucaugguaagucuuaagcguguguuuuuguaugaauga

SEQ ID NO: 139913 - RNA, 64 nt, Homo Sapiens
ucuaaaauuuuaaauaaaagcugagguggucguaagucuuaacuucuauuaggaauggcauaua

SEQ ID NO: 139914 - RNA, 64 nt, Homo Sapiens
cuuugagucuagagagauuuaaauagguuggcauagucuuaaguugagcaguguaauuacaaac

SEQ ID NO: 139915 - RNA, 64 nt, Homo Sapiens
ucuacauaaaagcuccaugugaaaagcuacuccuagucuuaacauuugcaguccuugugucacu

SEQ ID NO: 139916 - RNA, 64 nt, Homo Sapiens
uuuaaaaaaggaaaaaaaaaagaaacuggguuccagucuuaauucauuuuccgugccagguuuu

SEQ ID NO: 139917 - RNA, 64 nt, Homo Sapiens
acuuuucuuugcaagcgaaccuguuugaagcccaagucuuaacuccuggucucguaagguucca

SEQ ID NO: 139918 - RNA, 64 nt, Homo Sapiens
acuuuuugcucuggucaguuaacacacaaacggaagucuuaaaaguuuugaauguaaaaguugc

SEQ ID NO: 139919 - RNA, 64 nt, Homo Sapiens
aggaaacuaaaagcuuucacccauucucaagaaaagucuuaacuuuaugucugcaccagugaau

SEQ ID NO: 139920 - RNA, 64 nt, Homo Sapiens
aaaaguauuaauagaaauucucuaucagcuauucagucuuaauuucacuaguaguauaaugggu

SEQ ID NO: 139921 - RNA, 64 nt, Homo Sapiens
gagucuggguuguugggaacagcacagaauuuggagucuuaagcucuaaauuagaggcccugac

SEQ ID NO: 139922 - RNA, 64 nt, Homo Sapiens
uuucuuuucuuuuuuaaaguaaacuuguguauugagucuuaacuguauuucaguauuuuccagc

SEQ ID NO: 139923 - RNA, 64 nt, Homo Sapiens
agugcauuuccuccugccuuugcuuguucacugcagucuuaagaaagagguaaaaggcaagcaa

SEQ ID NO: 139924 - RNA, 64 nt, Homo Sapiens
aaggguuugccggcccuaacugugcucagggcugagucuuaaagggagcucaguucccauugcu

SEQ ID NO: 139925 - RNA, 64 nt, Homo Sapiens
accauauucaggguacgaacacugcuccauuccuagucuuaauuugugauauuuuuuagacuga

SEQ ID NO: 139926 - RNA, 64 nt, Homo Sapiens
gggagagggcuuucuggggcggggcgccucgugcagucuuaacaccgccuuucucaccacccug

SEQ ID NO: 139927 - RNA, 64 nt, Homo Sapiens
auacaaaaugguauuguuuaguucacacagugagagucuuaaaggcauaauugaugcacaugau

SEQ ID NO: 139928 - RNA, 64 nt, Homo Sapiens
uuucuaacucugauguaaauuauucaagaaagccagucuuaacaugauucgagcuauauuuaag

SEQ ID NO: 139929 - RNA, 64 nt, Homo Sapiens
cacuuuuuuaauauauaugacuaauucaauuuuaagucuuaaguugcaccuuucuguacaaaua

SEQ ID NO: 139930 - RNA, 64 nt, Homo Sapiens
gucacuggccucuccccaggccccccaucaccagagucuuaaggugcgguggagggaucaguug

SEQ ID NO: 139931 - RNA, 64 nt, Homo Sapiens
uucaguaugaaaccaguuuccagguguagaacucagucuuaaacuuccguaguguagaagccca

SEQ ID NO: 139932 - RNA, 64 nt, Homo Sapiens
acaguguaacuuacaguuucagggugaagauacaagucuuaaccauagaaugugggcuuuuuca

SEQ ID NO: 139933 - RNA, 64 nt, Homo Sapiens
cuauaauguucauuuaguuguuaaaggcacauaaagucuuaacuuuauugauacuaaagaggag

SEQ ID NO: 139934 - RNA, 64 nt, Homo Sapiens
guacauuuaacuuuggaauggcuuuguaauaaucagucuuaagaaaauguugacaagcucuggu

SEQ ID NO: 139935 - RNA, 64 nt, Homo Sapiens
ggaaucuggugaauuuuagucaucccagcuuuuuagucuuaaccacaguucucacucucuuaaa

SEQ ID NO: 139936 - RNA, 64 nt, Homo Sapiens
cuguucuguaaauuuuauuuuaaacuguuaccauagucuuaaguuguuuaugcuuuaucagacu

SEQ ID NO: 139937 - RNA, 64 nt, Homo Sapiens
guuuuguuuucuuucuauguuccaugcauaauacagucuuaagugaauuucucuuuuuuaauuu

SEQ ID NO: 139938 - RNA, 64 nt, Homo Sapiens
uuacaaaggaaccaaaaugauaaugggagaauuuagucuuaaaaguuuagguugucagaguuua

SEQ ID NO: 139939 - RNA, 64 nt, Homo Sapiens
cuauguuuuuaaauuuuuuucuaaucuacaaauaagucuuaaacauacaagucaggguguuugg

SEQ ID NO: 139940 - RNA, 64 nt, Homo Sapiens
aguuuugugcccuggcucuaucgaacccaaugguagucuuaaaguuaaaagugcuaauguguau

SEQ ID NO: 139941 - RNA, 64 nt, Homo Sapiens
gagacccaagucaucaugaaaaaggcccaaguacagucuuaaugcgauaaauccacuagcuaag

SEQ ID NO: 139942 - RNA, 64 nt, Homo Sapiens
cccagcuguccccacgccucugucuuuugggucaagucuuaaucccugcaccugaguugguccu

SEQ ID NO: 139943 - RNA, 64 nt, Homo Sapiens
uaauuguucugugauugaggaccacugaaaaauaagucuuaauaaauguugguaugaaccuacu

SEQ ID NO: 139944 - RNA, 64 nt, Homo Sapiens
guucuucaaaaugugcauguuaaguauucaaaucagucuuaaauuuuuaaaaauauguaauuuu

SEQ ID NO: 139945 - RNA, 64 nt, Homo Sapiens
ucaggaacuauucuaaaagucauaaaagggucacagucuuaagcagagcuuaguuuucuucuca

SEQ ID NO: 139946 - RNA, 64 nt, Homo Sapiens
guuuuuuuacacauauuaacuuaauaaauguaugagucuuaaauaccucuuaguucucauuaaa

SEQ ID NO: 139947 - RNA, 64 nt, Homo Sapiens
ggggucuuggugcccaagcuggucucaaacuccuagucuuaagcaaucuuccugcuuuggccuc

SEQ ID NO: 139948 - RNA, 64 nt, Homo Sapiens
ugcagccccgccccccugccucacccacaaacuaagucuuaacaaaauccaaauuaccaacaaa

SEQ ID NO: 139949 - RNA, 64 nt, Homo Sapiens
acaccaaaacugagccaugggaaagugcagcucaagucuuaaagcgacggcagagccuccuuca

SEQ ID NO: 139950 - RNA, 64 nt, Homo Sapiens
acacggagccaccaacuggauuuuuuaaugauaaagucuuaaaacccuucucuaauuucuucuu

SEQ ID NO: 139951 - RNA, 64 nt, Homo Sapiens
uuuccccuucagaugucaguugugcagauuccacagucuuaagccagauugaaaagagaccgaa

SEQ ID NO: 139952 - RNA, 64 nt, Homo Sapiens
aauagguaguuuucuauaguaacuugauuaauuuagucuuaauccauuugaaacucucucuucc

SEQ ID NO: 139953 - RNA, 64 nt, Homo Sapiens
cacuugcccucgugccugggggagagaggcagcaagucuuaacaaaccaacaucuuugcgaaaa

SEQ ID NO: 139954 - RNA, 64 nt, Homo Sapiens
uuucuacuacuacauauuuagaguucacugguucagucuuaaaugccugcauggugccuuuuua

SEQ ID NO: 139955 - RNA, 64 nt, Homo Sapiens
cacuggaugaaaaucuaggaguguaguuaaggccagucuuaaccauuucagguaguaauauuca

SEQ ID NO: 139956 - RNA, 64 nt, Homo Sapiens
uggggcuucauguguggccuauacccguuggaagagucuuaaacuucacucacucacucaacaa

SEQ ID NO: 139957 - RNA, 64 nt, Homo Sapiens
gaugccccuuccaaaccauccccugguuucuuuaagucuuaagugugggguguuucgccugcac

SEQ ID NO: 139958 - RNA, 64 nt, Homo Sapiens
uaucuggcauuugggugaacgguuuguauuugguagucuuaaugauuuuggggggaacauuuua

SEQ ID NO: 139959 - RNA, 64 nt, Homo Sapiens
uuaccguauucgccguacuaaguugguuucuguuagucuuaacagucuguuuucuuuuaaaagc

SEQ ID NO: 139960 - RNA, 64 nt, Homo Sapiens
gacuuagcccauaggcacuuugaguauauuuugaagucuuaaaagcugucauaauuuaagcauu

SEQ ID NO: 139961 - RNA, 64 nt, Homo Sapiens
ggaacuuggcauuuuccugaucaaggagcuuuaaagucuuaauggcaccccgcaaccugggauc

SEQ ID NO: 139962 - RNA, 64 nt, Homo Sapiens
acaaagugccaaagaaagugauguagaagcaugaagucuuaagggaccuuguaaaagacagugu

SEQ ID NO: 139963 - RNA, 64 nt, Homo Sapiens
uacccuggccuccuagggucccuuuuucugaugaagucuuaauucccuaaaagcgccucuuugg

SEQ ID NO: 139964 - RNA, 64 nt, Homo Sapiens
gguuaugagaaccagcgaaaucccccaugucaucagucuuaaaaaaaaaauuuuacaaauccac

SEQ ID NO: 139965 - RNA, 64 nt, Homo Sapiens
ggauuguaggcuguguagaauugaugaagaaauuagucuuaauagcuccuguuagacaaacaca

SEQ ID NO: 139966 - RNA, 64 nt, Homo Sapiens
auuugugacauauguaucuagguuacauuuuuuaagucuuaaucaggcucccacuucuugggag

SEQ ID NO: 139967 - RNA, 64 nt, Homo Sapiens
uugguuuauacuuuuucuauucaucaggguaggaagucuuaaauccuuaggcauccaagaagua

SEQ ID NO: 139968 - RNA, 64 nt, Homo Sapiens
auggaucaccauuauauuuugaaagaagccaucaagucuuaaguuuuucauuucaacuugugaa

SEQ ID NO: 139969 - RNA, 64 nt, Homo Sapiens
aaaugugugaaagaaccucacacaacauaauuggagucuuaaaauagaggaagaguaagcaaag

SEQ ID NO: 139970 - RNA, 64 nt, Homo Sapiens
ugcuuauugcuucuguauuucuucucuacucccuagucuuaauguuuaaccuugaaugcuauua

SEQ ID NO: 139971 - RNA, 64 nt, Homo Sapiens
uaauaaauacaaaaaaaucauuuuucuagagcagagucuuaaaaucagguggggguaggggaug

SEQ ID NO: 139972 - RNA, 64 nt, Homo Sapiens
ccagauuacuccaggauaaucuccucaccucaugagucuuaacuuaauuacaucugcaaggccc

SEQ ID NO: 139973 - RNA, 64 nt, Homo Sapiens
cugaauuuuaguacuaguuuacacguauaaauacagucuuaaaccuuuaugucugagucugaaa

SEQ ID NO: 139974 - RNA, 64 nt, Homo Sapiens
uuuucgccuuaguggugauuguuuaaacucucacagucuuaaaccgugccaaaguccuguuaug

SEQ ID NO: 139975 - RNA, 64 nt, Homo Sapiens
gucugcauuuucaggugggggugauagaguucacagucuuaaaaugucuccugagacaagcauc

SEQ ID NO: 139976 - RNA, 64 nt, Homo Sapiens
cucuccgcuaaaguggacauuauucuagaaauccagucuuaaauuccucggcuccauugugggu

SEQ ID NO: 139977 - RNA, 64 nt, Homo Sapiens
auauuucauugugaaagaagaaagguaucaguccagucuuaaagaguuacugaggcuucuccca

SEQ ID NO: 139978 - RNA, 64 nt, Homo Sapiens
uauaugugggaggaggagggaaagagacuagaagagucuuaaauagcccuugaacaucuccucc

SEQ ID NO: 139979 - RNA, 64 nt, Homo Sapiens
auuuuugcaauuuuuuaaaugaugacucuuacauagucuuaagcugugaagugccuguguaauu

SEQ ID NO: 139980 - RNA, 64 nt, Homo Sapiens
ccagauuuacugaaaaugucuacaauaaaaauccagucuuaauuuauguaaaguugauauugac

SEQ ID NO: 139981 - RNA, 65 nt, Homo Sapiens
gcuccugagaagcuucaaauucaggccaggagagaagucuuaagaaaagaccuccagcaguuaca

SEQ ID NO: 139982 - RNA, 65 nt, Homo Sapiens
cucugacuauacuuaguuugaaauggugcaggcuuagucuuaagccuccaaaggccuggauuuga

SEQ ID NO: 139983 - RNA, 65 nt, Homo Sapiens
uguuaacugccaaagcuaguuuuagagaaugagaaagucuuaagcaaaauacucccaggucucac

SEQ ID NO: 139984 - RNA, 65 nt, Homo Sapiens
gaggaaagauacagggaacaaaaaucaauuuguacagucuuaauauuaaaagcagcuugacuaaa

SEQ ID NO: 139985 - RNA, 65 nt, Homo Sapiens
ccuggaucugucuagucaaucaacauagcagagacagucuuaaaccuaccauugaccugugugua

SEQ ID NO: 139986 - RNA, 65 nt, Homo Sapiens
uugauuuccuugaagcaguuugaaaauuugaauugagucuuaacuuuaggaaaugagguuucaua

SEQ ID NO: 139987 - RNA, 65 nt, Homo Sapiens
ugacaaccaggugggaccaaaguuuaugugccuuuagucuuaauuuaccuugcauuguaauauuc

SEQ ID NO: 139988 - RNA, 65 nt, Homo Sapiens
aaggugauucuuucuuuaccauuucuggggacuuuagucuuaauuagguaccuuauuaacaggaa

SEQ ID NO: 139989 - RNA, 65 nt, Homo Sapiens
agucaaaaaucugcauauaacuuuugauuccccaaagucuuaaguacuaguagccuguuauugac

SEQ ID NO: 139990 - RNA, 65 nt, Homo Sapiens
uguauauugcaaaauuuaauauauuuguucacuugagucuuaagaguaggucaggccaaggcagg

SEQ ID NO: 139991 - RNA, 65 nt, Homo Sapiens
ucaaauuaguggaacuuaguucagggacauagaagagucuuaaugaauuaaaaucauucacuuga

SEQ ID NO: 139992 - RNA, 65 nt, Homo Sapiens
ggauaaaacaauggcugguucuagcccugagugacagucuuaaggcuagauccuucccauaguau

SEQ ID NO: 139993 - RNA, 65 nt, Homo Sapiens
agacaguuuuauagcugguuccuuuuaggguaaagagucuuaagagaguuuuauugugucuaugg

SEQ ID NO: 139994 - RNA, 65 nt, Homo Sapiens
augcuuuauuagugaggagaaaacaauuccuuagaagucuuaaauauauuguacucuuuagaucu

SEQ ID NO: 139995 - RNA, 65 nt, Homo Sapiens
uucucuuuuaaagcugcaugugaaugucauauaguagucuuaaguaguguuuuuuguguaauucg

SEQ ID NO: 139996 - RNA, 65 nt, Homo Sapiens
uuccuaccacuuugguuucauuagugaaagugcuaagucuuaaguugcccuucgauguaugccau

SEQ ID NO: 139997 - RNA, 65 nt, Homo Sapiens
uucugccccauaagacuuucucauauuuauaaaggagucuuaauguccuguugauuaaucuauuu

SEQ ID NO: 139998 - RNA, 65 nt, Homo Sapiens
uggcagccauucugccuuuguauaaggcaagcaaaagucuuaacaaccuaaaauauacccaucag

SEQ ID NO: 139999 - RNA, 65 nt, Homo Sapiens
guuuaucuuuucucugcugauggggcaaaaaagaaagucuuaagauuccuuucugacacauaauu

SEQ ID NO: 140000 - RNA, 65 nt, Homo Sapiens
cugagauuucuaaagaugcuccuuagccccuccuaagucuuaaugggcuguucaacauccucccu

SEQ ID NO: 140001 - RNA, 65 nt, Homo Sapiens
cuaaauuugugugaauaaucagguuuuuaaugaauagucuuaaaucauuaacgaguguuuuaaaa

SEQ ID NO: 140002 - RNA, 65 nt, Homo Sapiens
guugagccuuuccuuucauaccagcauaugaaacuagucuuaacuggccuguuucacucacucac

SEQ ID NO: 140003 - RNA, 65 nt, Homo Sapiens
gccagcagaaaaacuccauaugauucugauucugaagucuuaacugaguuaaauguauguaagau

SEQ ID NO: 140004 - RNA, 65 nt, Homo Sapiens
uccucacagcacgggagcagaucugugaguuuaggagucuuaagauaaauagguugaaaacaauc

SEQ ID NO: 140005 - RNA, 65 nt, Homo Sapiens
ucaaaguauccaauauuuuacuuuucauuuaaaguagucuuaaaauuaugguauuccauuagguu

SEQ ID NO: 140006 - RNA, 65 nt, Homo Sapiens
uuucaccaggggugcucaccuauuuauacucacugagucuuaacuagccacagcucuucuuggcg

SEQ ID NO: 140007 - RNA, 65 nt, Homo Sapiens
gaauaucagagguaagagggaauacauccucugccagucuuaauacagugauagaaaacccacac

SEQ ID NO: 140008 - RNA, 65 nt, Homo Sapiens
aaacucaggaggaccaauguagugaccacggacaaagucuuaacaugucuuuggauagcugucug

SEQ ID NO: 140009 - RNA, 65 nt, Homo Sapiens
uaaauguacugugaagaaugcugaaaacagaagacagucuuaauaggaaauuuucaacccuuaau

SEQ ID NO: 140010 - RNA, 65 nt, Homo Sapiens
ucugcuauuuacagagcauuuuaaacacaaugguaagucuuaaagcuuaguugagucacugaggu

SEQ ID NO: 140011 - RNA, 65 nt, Homo Sapiens
auuuacugaauaagauuugaguaaugaaagucuguagucuuaaaacucuaaaacaguuguacugc

SEQ ID NO: 140012 - RNA, 65 nt, Homo Sapiens
ccacgaauagguaauugauagaguuuaugggucuuagucuuaaggguaacagagugaauaccuuc

SEQ ID NO: 140013 - RNA, 65 nt, Homo Sapiens
ucaaaucauguuuagaaacuuuggaugaguuaagaagucuuaaguaugcaggcguuuacgugauu

SEQ ID NO: 140014 - RNA, 65 nt, Homo Sapiens
cccaugugguauuaauauaccuucaauuuauguugagucuuaaacauaauuaggagauauuuuuc

SEQ ID NO: 140015 - RNA, 65 nt, Homo Sapiens
acuaguugaaauuuuuaauagaaucaaggcacaaaagucuuaaaaccauguggaaaaauuaggua

SEQ ID NO: 140016 - RNA, 65 nt, Homo Sapiens
ggcaggcugucauagaguuauguguuagucucaggagucuuaacuuuugaaauauguuuuacuug

SEQ ID NO: 140017 - RNA, 65 nt, Homo Sapiens
auuaggguuccacaucauucuaauguauaguuucaagucuuaauagacaaucugaauuccacuac

SEQ ID NO: 140018 - RNA, 65 nt, Homo Sapiens
guucaaaagggcaauguuuucuuuauauuucuuauagucuuaauuuuguuauccaugugcauaau

SEQ ID NO: 140019 - RNA, 65 nt, Homo Sapiens
uuuucauacaaccauuuucaaaugaaccuuagaaaagucuuaacauuuaagguauuuuaugcaca

SEQ ID NO: 140020 - RNA, 65 nt, Homo Sapiens
uuuuaacauuuauagugcuugacauuauacacugaagucuuaacauaaaaaggcaggauguuauu

SEQ ID NO: 140021 - RNA, 65 nt, Homo Sapiens
ugagguuugccaaaugagaaaguuuaagauacuuuagucuuaaauguguuuuugguggaggaaga

SEQ ID NO: 140022 - RNA, 65 nt, Homo Sapiens
uuaaaugcuaaaaacaauugcaaacacugagccauagucuuaaauuuguuaacuuauuuauuuuu

SEQ ID NO: 140023 - RNA, 65 nt, Homo Sapiens
cuuuucagcauuaacgcaaacuaacagucccccaaagucuuaacuucaaaaccaaucaugccuuc

SEQ ID NO: 140024 - RNA, 65 nt, Homo Sapiens
auuuacuaaaauggucaacugcaacuccucuucuuagucuuaauaagagagagaguacugaaaaa

SEQ ID NO: 140025 - RNA, 65 nt, Homo Sapiens
uuuucuaaaagaagacaauaacaaucuguuauuccagucuuaaauauuacagcauugcaggaaaa

SEQ ID NO: 140026 - RNA, 65 nt, Homo Sapiens
uuuuucuuuuaaaaaacaucacacaucuugaauaaagucuuaacaguuuuguuauaaugccugau

SEQ ID NO: 140027 - RNA, 65 nt, Homo Sapiens
aacagguuuucuaauccagaagcuggaugugacccagucuuaauaaaagggcacugaaauguacu

SEQ ID NO: 140028 - RNA, 65 nt, Homo Sapiens
gucaauauuauuuuugucuagcccuuagacagugaagucuuaauucaccccaggguaggucugug

SEQ ID NO: 140029 - RNA, 65 nt, Homo Sapiens
ugaccuggacgugaaggaaaaauuuaagauaccgaagucuuaaagcuugaagugaugcaugugug

SEQ ID NO: 140030 - RNA, 65 nt, Homo Sapiens
uuaaauauaugauuagccaguuuucuaaagccuuaagucuuaauaguuauuuuuugaauaauaac

SEQ ID NO: 140031 - RNA, 65 nt, Homo Sapiens
uaguuggcuauaaguacgucauucuuaguccagucagucuuaaaaacaucuuggguuacccacuc

SEQ ID NO: 140032 - RNA, 65 nt, Homo Sapiens
gggccaguugcuguuuuuucaugcagugcccugggagucuuaaaagcagugcuuagcaacauugg

SEQ ID NO: 140033 - RNA, 65 nt, Homo Sapiens
uauugacaaaagccggggucaaaaaaaguaguuuaagucuuaagacugaauaugcauuaaaguau

SEQ ID NO: 140034 - RNA, 65 nt, Homo Sapiens
uucugcuauuucuuuucaguuuuuccaaagucaagagucuuaaccuuguacucagggaauuuuga

SEQ ID NO: 140035 - RNA, 65 nt, Homo Sapiens
auugugcgccugugagcgcccagcuucuguuucauagucuuaacagguggccauugucgugaaac

SEQ ID NO: 140036 - RNA, 65 nt, Homo Sapiens
auccugaaauuuuuuauaauauauguaauuugucuagucuuaaagacauuuggagcauggccaac

SEQ ID NO: 140037 - RNA, 65 nt, Homo Sapiens
aaaggucuagaaaagcauccugucuggcauuuuguagucuuaacuucuccccauuucccccaucu

SEQ ID NO: 140038 - RNA, 65 nt, Homo Sapiens
agcacagaaaaggauguuuggcaauuugucuuuuaagucuuaaccuugcuaaugugaauacuggg

SEQ ID NO: 140039 - RNA, 65 nt, Homo Sapiens
gacagcacugaaccuauucccgaaaaccagaguacagucuuaagucaucacagaagggcguauuu

SEQ ID NO: 140040 - RNA, 65 nt, Homo Sapiens
uaucaacuccuuaaaugugcaauucugauucauauagucuuaaauuuauuuuaauggaguguuaa

SEQ ID NO: 140041 - RNA, 65 nt, Homo Sapiens
agaugaauggaugagagaagaaggacacagaaggcagucuuaagaguaagauaauuucccugcaa

SEQ ID NO: 140042 - RNA, 65 nt, Homo Sapiens
gauaguuuauaaucaggcauggaaaccuuugaaauagucuuaauguguuauuguuggguagaagg

SEQ ID NO: 140043 - RNA, 65 nt, Homo Sapiens
ccagaaaauaaguuuauagccuuagaguaaauuuuagucuuaaaguacaaaacauuuuagaaaau

SEQ ID NO: 140044 - RNA, 65 nt, Homo Sapiens
aucuauuggccacgaugaaaguuugcugaaaaguuagucuuaauuuuugaauauaggagaaauca

SEQ ID NO: 140045 - RNA, 65 nt, Homo Sapiens
aucuaagacucaguuguagucaucauguagacuaaagucuuaaacaauguauuaauugauuuaaa

SEQ ID NO: 140046 - RNA, 65 nt, Homo Sapiens
cuggaaauuuuauuagcaaucuagcuauaagcuuaagucuuaauuaaaauugcucuuaaacuuuc

SEQ ID NO: 140047 - RNA, 65 nt, Homo Sapiens
aaacauugaauuguaguaaacaagguccugacuuuagucuuaauacuuaugacucaguaaguugg

SEQ ID NO: 140048 - RNA, 65 nt, Homo Sapiens
agguucaugaucuacauuggguuuuuaccauaaugagucuuaaguacagaaaaauguaagaauuu

SEQ ID NO: 140049 - RNA, 65 nt, Homo Sapiens
aggucaaugccagagacggaagccuuuuuccccaaagucuuaaaauaacuuauaucaucagcaua

SEQ ID NO: 140050 - RNA, 65 nt, Homo Sapiens
aacauccaucagaaucuucuggagaauauggucagagucuuaaacaggcccagugcugaguucuu

SEQ ID NO: 140051 - RNA, 65 nt, Homo Sapiens
agucuuugcuuuaauaaaugagcaacccuggguauagucuuaaaauucugcacaauaaauuuuga

SEQ ID NO: 140052 - RNA, 65 nt, Homo Sapiens
uuguuauuaaauuuauuauuuaagaugguagcacuagucuuaaauuguauaaaauauccccuaac

SEQ ID NO: 140053 - RNA, 65 nt, Homo Sapiens
uuguuauuaaauuuauuauuaaagauaguagcacuagucuuaaauuugauauaacaucuccuaac

SEQ ID NO: 140054 - RNA, 65 nt, Homo Sapiens
cugcauggcccuguuagagauggcguagaagugaaagucuuaaagggagcauuagagauccuuuu

SEQ ID NO: 140055 - RNA, 65 nt, Homo Sapiens
aggauggucucgaucuccugaccuugaaucacaagagucuuaacagggaauguuucaggaaacaa

SEQ ID NO: 140056 - RNA, 65 nt, Homo Sapiens
aauaaauaauuaaaauaucagacauguuuuggaaaagucuuaauuugagaacaccaaaggaaacu

SEQ ID NO: 140057 - RNA, 65 nt, Homo Sapiens
gaaauuaagccauuuaacauugugaaaaacauaagagucuuaaaaggaguauaauacccauuuaa

SEQ ID NO: 140058 - RNA, 65 nt, Homo Sapiens
uaaaaguugucuaaacugucuuaagggggcauucuagucuuaacuuaacgguggugccuaucuac

SEQ ID NO: 140059 - RNA, 65 nt, Homo Sapiens
ugauguuuuucaacuuuuaucaaauuaguagcaccagucuuaauuaagugcacauauuucauaac

SEQ ID NO: 140060 - RNA, 65 nt, Homo Sapiens
cuuuaugaugcuaugguuuggguuaguagcccuucagucuuaauaaucuuuaaaaugaauaggua

SEQ ID NO: 140061 - RNA, 65 nt, Homo Sapiens
auauuuaaguguuacuguggaaauuucugcauucgagucuuaaccaauuagcuuuccaaccaacc

SEQ ID NO: 140062 - RNA, 65 nt, Homo Sapiens
aaaaaaaaaaacagaaaaaguaaacugaauuaggcagucuuaaaacucuugucagacaauggcua

SEQ ID NO: 140063 - RNA, 65 nt, Homo Sapiens
auaaaggcauauuguucaugaguaucuuuuaaaugagucuuaaaaaaaguuuguguuuugucgac

SEQ ID NO: 140064 - RNA, 65 nt, Homo Sapiens
uggguuaccgucucaugugaaccuggagauucaccagucuuaacuuuugggucauuguguuuucu

SEQ ID NO: 140065 - RNA, 65 nt, Homo Sapiens
guuuuccauuuuugucagucugagucaucaaaaagagucuuaauuuucuaaaacaaguuggcuag

SEQ ID NO: 140066 - RNA, 65 nt, Homo Sapiens
uaccaugcaguuguuuaccaaaaauagaggaggagagucuuaacuuuugcucuuggauuuaaguc

SEQ ID NO: 140067 - RNA, 65 nt, Homo Sapiens
uuuaggcuuaauucauucaauugucaaguacacuuagucuuaauacacucagguuugaacagauu

SEQ ID NO: 140068 - RNA, 65 nt, Homo Sapiens
uugcauauucuccuuucauccuggcuugccaacgcagucuuaauuccgccuuuuuuuuuucuaau

SEQ ID NO: 140069 - RNA, 65 nt, Homo Sapiens
uuuuuuaguuuuauguaaccauaucaauauuauuuagucuuaaacuaguuacguuauuaugcaau

SEQ ID NO: 140070 - RNA, 65 nt, Homo Sapiens
uuuuccagcauuucuucauuugauucucuuuuuuuagucuuaaaauaaugacuccuauucagaca

SEQ ID NO: 140071 - RNA, 65 nt, Homo Sapiens
aggauuauguuuuuggauugucaaagaggaugcuuagucuuaaaauaaaaauaaauuuaaaaauc

SEQ ID NO: 140072 - RNA, 65 nt, Homo Sapiens
gcacacccuaguaaccucuugagauuaaauuacauagucuuaauauuucuguuccuccaugcaac

SEQ ID NO: 140073 - RNA, 65 nt, Homo Sapiens
cacugucuauccccacgaaauuuaguuuuaucaguagucuuaaaguguugaucucaaacaaguac

SEQ ID NO: 140074 - RNA, 65 nt, Homo Sapiens
uggaaauggaagauuuuuuuuuaacuuguucuagaagucuuaauaugggcuguugccaugaaggc

SEQ ID NO: 140075 - RNA, 65 nt, Homo Sapiens
uauucccacgauauucuguaucuagcacuaauuuuagucuuaaaagaauuuauauauucagauac

SEQ ID NO: 140076 - RNA, 65 nt, Homo Sapiens
auagcguguauacuugaauauaagacuuaauuuuaagucuuaaaaugauaucuuuauuauagccu

SEQ ID NO: 140077 - RNA, 65 nt, Homo Sapiens
auuucaaaauaaaagugguuuuauaacuucuugugagucuuaagugggaucucucugaacuauuu

SEQ ID NO: 140078 - RNA, 65 nt, Homo Sapiens
ugguguuguucuaauuuuccgaaauccggaaauauagucuuaaccaccaugggaggcaaagaaag

SEQ ID NO: 140079 - RNA, 65 nt, Homo Sapiens
cauccaccagagucuagaaguucuuuaucacccucagucuuaauccccaucaguccuggggcuuu

SEQ ID NO: 140080 - RNA, 65 nt, Homo Sapiens
aauuaaagauaacauuauaacuuggucuuguuuuaagucuuaaaaaauacagauuuuuuguuuac

SEQ ID NO: 140081 - RNA, 65 nt, Homo Sapiens
gaaguuucacuaaaaauguacauuuucuuuuggacagucuuaagaaauagcaucauauauuaguu

SEQ ID NO: 140082 - RNA, 65 nt, Homo Sapiens
uuggccagcaucuguuuaucuaccaaguccuuaggagucuuaacaugagagguuucaguuuuuaa

SEQ ID NO: 140083 - RNA, 65 nt, Homo Sapiens
uacccuguagaaaccucguuauuaaccaguguuccagucuuaaaguagacaaaauauucagagcc

SEQ ID NO: 140084 - RNA, 65 nt, Homo Sapiens
uauuuauuguuuuuaaaaugaaaggaauacuaauaagucuuaaaaguuccuucaugcauaagauu

SEQ ID NO: 140085 - RNA, 65 nt, Homo Sapiens
uacaggugugagccacccugcccagccgucaaaagagucuuaauauauauauccagauggcaugu

SEQ ID NO: 140086 - RNA, 65 nt, Homo Sapiens
cuucuucucuccucauggacuuuuucugcaauugcagucuuaagcuucacucuccaccaccugga

SEQ ID NO: 140087 - RNA, 65 nt, Homo Sapiens
aagccugaguugucaccauuaugucuuaagcuguuagucuuaaagauuauuguuaaaaaauucag

SEQ ID NO: 140088 - RNA, 65 nt, Homo Sapiens
aaguaagcuuaaacuacaacuugucacauaaaggaagucuuaaguggaguucacagaaugauaau

SEQ ID NO: 140089 - RNA, 65 nt, Homo Sapiens
ucuuuaacuagcugccuuuagauuuugauaaucacagucuuaaaauacuaggaaagaaguggaug

SEQ ID NO: 140090 - RNA, 65 nt, Homo Sapiens
cauauucgugugaaaaagaauacaucauuucucacagucuuaaguugauauuuauagaaaugaau

SEQ ID NO: 140091 - RNA, 65 nt, Homo Sapiens
guuuuucugaugaauaguguucaguaaaaugaagcagucuuaagagugacuaauaauuucaaagu

SEQ ID NO: 140092 - RNA, 65 nt, Homo Sapiens
uguuucuguuugaagaaaauagagggagaaacagaagucuuaagucuguggcacacugugucuuc

SEQ ID NO: 140093 - RNA, 65 nt, Homo Sapiens
cccaaaggcucuuuucagagagucacuuuuucaucagucuuaaaagagaaagagcguaaauguaa

SEQ ID NO: 140094 - RNA, 65 nt, Homo Sapiens
aaggcucuuuucagagccacgcuuuuuaaggaagcagucuuaacaaaacgagaacucuuauauug

SEQ ID NO: 140095 - RNA, 65 nt, Homo Sapiens
guguacauguaguugaauuucauugaacuagggcaagucuuaaauucuccaguacuugagcugac

SEQ ID NO: 140096 - RNA, 65 nt, Homo Sapiens
aaaauuacauauuuuauaauaaaaauauuauuauuagucuuaacuuaaccauuuuuaaagugcac

SEQ ID NO: 140097 - RNA, 65 nt, Homo Sapiens
uaccugugcuucaguuuccuugccuaccuuuugcaagucuuaacuaugcuggaucugcugcuucc

SEQ ID NO: 140098 - RNA, 65 nt, Homo Sapiens
agaaacuguuacugucccaauguucugcucauggaagucuuaaacacguuuucacagacaauaac

SEQ ID NO: 140099 - RNA, 65 nt, Homo Sapiens
ccacaccacuauuccagcgauuuuugaccguuccaagucuuaaugcuuugugaaccccugaagau

SEQ ID NO: 140100 - RNA, 65 nt, Homo Sapiens
gggcugauaguccaaccaggaagcucuggggcuugagucuuaauacauauuccaggcacaagaga

SEQ ID NO: 140101 - RNA, 65 nt, Homo Sapiens
gauaaagacauaaaugggacuauuugaagaugaauagucuuaaaaauaaaaccuuauuuaugucu

SEQ ID NO: 140102 - RNA, 65 nt, Homo Sapiens
augucugguuuuccaucugucaauuuuaccuagacagucuuaaauuaugguaaaggaaacccaug

SEQ ID NO: 140103 - RNA, 65 nt, Homo Sapiens
guauuuuaaauugaagccuuacuuuaaauguaucaagucuuaauuuuuaauguuuaucuugauag

SEQ ID NO: 140104 - RNA, 65 nt, Homo Sapiens
uacacauugcauuuugauaaacaauccauaacuuuagucuuaaugcauuucuaugccaaacagga

SEQ ID NO: 140105 - RNA, 65 nt, Homo Sapiens
ccucuccugcggccacaucaacggaugcaagucacagucuuaacacagccugugggagacaagca

SEQ ID NO: 140106 - RNA, 65 nt, Homo Sapiens
auugaaaaacauauaauuuacuucuuauaaauugaagucuuaaaugugaaaccaagaaauguaau

SEQ ID NO: 140107 - RNA, 65 nt, Homo Sapiens
ccuuagaaaguuaaaagaauguagaaaagauacucagucuuaauccuaugcaaaaaaaaaaauca

SEQ ID NO: 140108 - RNA, 65 nt, Homo Sapiens
cuacaggucuuugaucuggaaacuaagacuagagaagucuuaagagaugacugcucaggugagua

SEQ ID NO: 140109 - RNA, 65 nt, Homo Sapiens
agguccuuguuguuucuugccugaacuccugccauagucuuaacuggucuccuugcuuccugucu

SEQ ID NO: 140110 - RNA, 65 nt, Homo Sapiens
cucauaagguuauuauaauaaauuauauuaguaaaagucuuaacuggaaaaaagaaucuaaauca

SEQ ID NO: 140111 - RNA, 65 nt, Homo Sapiens
gcugcaccuugaguugagagggcuacauguagaaaagucuuaaaauagagcuaaacaccacagug

SEQ ID NO: 140112 - RNA, 65 nt, Homo Sapiens
gucuuuuguacaaauaucuagggaacuggccauguagucuuaacaaucauucuguuuccugcagu

SEQ ID NO: 140113 - RNA, 65 nt, Homo Sapiens
cugugucaguaagucuuuaaaguuccucucucgaaagucuuaauucauccaacuuuucccuucuc

SEQ ID NO: 140114 - RNA, 65 nt, Homo Sapiens
aaucucuaagguuuguuucuagugguggguuuuuaagucuuaaccagauuaagugguaaugucau

SEQ ID NO: 140115 - RNA, 65 nt, Homo Sapiens
uaccuucaguuuaaucugugaauaaccaaaacugaagucuuaauuauccucacagaaaaguugga

SEQ ID NO: 140116 - RNA, 65 nt, Homo Sapiens
uugaaugcugcuuucugcuucacuagaaauugggcagucuuaaugcugggcuaaggaaguaucag

SEQ ID NO: 140117 - RNA, 65 nt, Homo Sapiens
gugugcauaaaaaacuaaauuguuaguguuuauaaagucuuaaauuacccuucuggaauugcuaa

SEQ ID NO: 140118 - RNA, 65 nt, Homo Sapiens
aaauaugccuuuuugaagcagugagagugagacucagucuuaaaaaccacugcacuccagucugg

SEQ ID NO: 140119 - RNA, 65 nt, Homo Sapiens
uuauuauauuuuguuguuacacucuguuuucuuauagucuuaauuauuauugaauuauaccauuu

SEQ ID NO: 140120 - RNA, 65 nt, Homo Sapiens
aaagugccagaccggaaccuauagcuacugcuagaagucuuaaaaaaaccaacagcagcacagga

SEQ ID NO: 140121 - RNA, 65 nt, Homo Sapiens
gugguugaauuguguucccccaaaauauauggugaagucuuaacccccauccccgugaaugggac

SEQ ID NO: 140122 - RNA, 65 nt, Homo Sapiens
ggaagaaaauccuuuccucuugggaaaguaauacaagucuuaaguuccauuguagggugcgccuu

SEQ ID NO: 140123 - RNA, 65 nt, Homo Sapiens
gccuguauccucccuggcagacacaacccaauaggagucuuaauuuauuucuuaaccuuugcuau

SEQ ID NO: 140124 - RNA, 65 nt, Homo Sapiens
uagguguauggauaugugauuuugagauuaaaguuagucuuaaaauguaaauaaaaugugaaacg

SEQ ID NO: 140125 - RNA, 65 nt, Homo Sapiens
uucauuauagaauuaucugugaguuguguagacacagucuuaauguuucugguuaugacagauaa

SEQ ID NO: 140126 - RNA, 65 nt, Homo Sapiens
ugucgaauucuagacugaggaguagaguucauuggagucuuaaacucucugauaucacuuaaagc

SEQ ID NO: 140127 - RNA, 65 nt, Homo Sapiens
cucaggcuuuucguucauuacgugguaccaaucucagucuuaaagagcagguggccaugacuacc

SEQ ID NO: 140128 - RNA, 65 nt, Homo Sapiens
uucauguguacaccucuuugguguuaaaauuuuggagucuuaauuggcacaucuucagggcacca

SEQ ID NO: 140129 - RNA, 65 nt, Homo Sapiens
uuuccaacaugaaaauucucuuuuaauuccaugaaagucuuaaugucauuggaaguucuuuguaa

SEQ ID NO: 140130 - RNA, 65 nt, Homo Sapiens
auuagguugaggucuaccuaaaugccuuagaugauagucuuaaauaaauagucacaaguauuaau

SEQ ID NO: 140131 - RNA, 65 nt, Homo Sapiens
cugacauacuggauuuuuaaggauuuggaugaagaagucuuaauauaauagcaauaaaccuaacu

SEQ ID NO: 140132 - RNA, 65 nt, Homo Sapiens
cugaaauacugaauuuuuaagucuuuggaugaagaagucuuaauagccuaguuagaguuagaccu

SEQ ID NO: 140133 - RNA, 65 nt, Homo Sapiens
ucuguccaccuucaagucaaauagauaauuuuuccagucuuaagccucuuuguuaaaccccaauu

SEQ ID NO: 140134 - RNA, 65 nt, Homo Sapiens
aaucaaaaugaaaacaaagcaaaugaauacuggacagucuuaacaauuuuauaaguuauaaaaug

SEQ ID NO: 140135 - RNA, 65 nt, Homo Sapiens
cagugagcauuugccugaauaaaaccuaaaagaguagucuuaacacauuacuaacuuuuucuaag

SEQ ID NO: 140136 - RNA, 65 nt, Homo Sapiens
uucagauuaaucuuuuauccuuuccugaaguacaaagucuuaagagugucugaaauccaagacau

SEQ ID NO: 140137 - RNA, 65 nt, Homo Sapiens
guaguuuuacuacuuuucauuuagaacagaguaugagucuuaaucugaagucuuuuucaugcccu

SEQ ID NO: 140138 - RNA, 65 nt, Homo Sapiens
gcuuuauuuugguguugugucuuugaauuccccaaagucuuaauuaucguuuuuguuuucuugua

SEQ ID NO: 140139 - RNA, 65 nt, Homo Sapiens
uguacaguguauuuuauagaugcuauauuuagaacagucuuaaaaccacaguccauugugaagug

SEQ ID NO: 140140 - RNA, 65 nt, Homo Sapiens
uucagcauauguugcugcugcaaccaagcuucauuagucuuaaaugugcauugggcuccgugcca

SEQ ID NO: 140141 - RNA, 65 nt, Homo Sapiens
aaaauauucaggucuaucauagaaaaaaaguuuacagucuuaaggacuuuuuuauaauuguuuuc

SEQ ID NO: 140142 - RNA, 65 nt, Homo Sapiens
aaggaaauuucccuaauguuacaccugguuuggagagucuuaauugauuacaggcaugagcuacc

SEQ ID NO: 140143 - RNA, 65 nt, Homo Sapiens
uaguuaaaaguuuguauuuuauaagguaaucuguuagucuuaaaacugagagauuggugauuuau

SEQ ID NO: 140144 - RNA, 65 nt, Homo Sapiens
agacaaaccauaucacuccuauauaaagcaaguccagucuuaaaaugcacacuuuuacaaauuua

SEQ ID NO: 140145 - RNA, 65 nt, Homo Sapiens
uauuucaaggaaucagugucuuuguccagaaaagaagucuuaagagauggaaacugaccaccuac

SEQ ID NO: 140146 - RNA, 65 nt, Homo Sapiens
ccuuccauuuuuuagagacacuuauaaaugagggaagucuuaagauaaaugaaucacggcaauuu

SEQ ID NO: 140147 - RNA, 65 nt, Homo Sapiens
ucucuuucuggccaaagacuuaaaugcauauauugagucuuaaaauccauauuuauauuuuuaaa

SEQ ID NO: 140148 - RNA, 65 nt, Homo Sapiens
augaaucuagcauuuguuuucagagauucaagcauagucuuaaggguagaucagaaaugacaaau

SEQ ID NO: 140149 - RNA, 65 nt, Homo Sapiens
acagaccgaacuguuguauaaauuuauuuacugcuagucuuaagaacugcuuucuuucguuuguu

SEQ ID NO: 140150 - RNA, 65 nt, Homo Sapiens
ggugcuucugugaauuaaguugugguuucaucaugagucuuaauguucuuuguugauaagacaag

SEQ ID NO: 140151 - RNA, 65 nt, Homo Sapiens
uauauauauauaucaguuugaucacacuauuuuagagucuuaaugccaagucagcagauuugcuu

SEQ ID NO: 140152 - RNA, 65 nt, Homo Sapiens
aggguuuuguuaauucuuuucagaaucauugaagcagucuuaaagggucuuuugcagaugguaca

SEQ ID NO: 140153 - RNA, 65 nt, Homo Sapiens
uuagaggauaaugguucaccucugcguaaacugcaagucuuaagcagacaucuggaauagagcuu

SEQ ID NO: 140154 - RNA, 65 nt, Homo Sapiens
ugucagggcuuuucuggggcugcucuuggaaaugaagucuuaaguacugaauaacuccccugggg

SEQ ID NO: 140155 - RNA, 65 nt, Homo Sapiens
uuuauauuaaugaggagaaaaguaugaaaacaagaagucuuaaguaaauauugaggucauuguuu

SEQ ID NO: 140156 - RNA, 65 nt, Homo Sapiens
aggggcuugagaagguuacugagugaguuauugggagucuuaauaaaauaaacuagauauuaggu

SEQ ID NO: 140157 - RNA, 65 nt, Homo Sapiens
uuuuauauuacuauuuuccuuuuuguuguucacauagucuuaaggcaccuauacuuuuaaauuga

SEQ ID NO: 140158 - RNA, 65 nt, Homo Sapiens
ucuuagccaggaaagacaaauaauccaacgcugcuagucuuaaccccagaccagagagaacugca

SEQ ID NO: 140159 - RNA, 65 nt, Homo Sapiens
ccaugcccggcccauaaguaccguuuuugagguucagucuuaaacauuugcuuuaagaaaacagu

SEQ ID NO: 140160 - RNA, 65 nt, Homo Sapiens
ucaaaaccaaucaugccuucccaacagucccccaaagucuuaacucauuucagcauuaacccaaa

SEQ ID NO: 140161 - RNA, 65 nt, Homo Sapiens
aacuuucauauuagcagauuucgcuccuucaaaacagucuuaauugugcaaaggaaacuauuguc

SEQ ID NO: 140162 - RNA, 65 nt, Homo Sapiens
gccaaaauucauuauaacccucugcaugcaguggcagucuuaaguuguauuucuuuuucgggguu

SEQ ID NO: 140163 - RNA, 65 nt, Homo Sapiens
uauaauguaaaguugacauugccaucuucacuguuagucuuaaauugaccauuuauauucuagua

SEQ ID NO: 140164 - RNA, 65 nt, Homo Sapiens
uucaggaguuuacaauugacauauacacauuuccuagucuuaacuguuguacucuuaugugucug

SEQ ID NO: 140165 - RNA, 65 nt, Homo Sapiens
uuuucaauaaaauugagugacuuuguaacuuuuaaagucuuaaacuauaggcagggcgaauacua

SEQ ID NO: 140166 - RNA, 65 nt, Homo Sapiens
cuuuuggguuugaaugaagguuuuccccccaaguuagucuuaaauaugucuaaagugauuaucuu

SEQ ID NO: 140167 - RNA, 65 nt, Homo Sapiens
cacuucugcuuaaacucccagaaaugccgcugugaagucuuaaagaggcggggcugaggaacagg

SEQ ID NO: 140168 - RNA, 65 nt, Homo Sapiens
uaaugugucuuguucuuuuuguuauaaaaaguauuagucuuaacagauguuuuauuuuuagaaua

SEQ ID NO: 140169 - RNA, 65 nt, Homo Sapiens
cccaugucauagagaauaaagcugaugauuguaccagucuuaaauuauucaugauucaauaaaau

SEQ ID NO: 140170 - RNA, 65 nt, Homo Sapiens
aauuuagaguuuccaaauuuagagcuucugcauacagucuuaaagccacagaggcuuguaaaaau

SEQ ID NO: 140171 - RNA, 65 nt, Homo Sapiens
ugucauuucaggguaggagucaaugaagacaucuuagucuuaacaaguuacagauaaucucugac

SEQ ID NO: 140172 - RNA, 65 nt, Homo Sapiens
uuuauaaggugagguaacucagaacuuaauuuaaaagucuuaaauauucugauacaauucagcug

SEQ ID NO: 140173 - RNA, 65 nt, Homo Sapiens
aaaacaauuggcagaaccuguuugauuacugugacagucuuaaugauaccauaaaucaauauuag

SEQ ID NO: 140174 - RNA, 65 nt, Homo Sapiens
ucuuguuuuugcaucacuguagucacauauuuuauagucuuaauauuauuucgcugguucuuugu

SEQ ID NO: 140175 - RNA, 65 nt, Homo Sapiens
cauuuuaucuuaaauaauuuuuaacccugacauucagucuuaacacauccauuaucccuuugccu

SEQ ID NO: 140176 - RNA, 65 nt, Homo Sapiens
gagacacugcaaagucuuagucuuaauauuuugaaagucuuaaagacuuuuucguaacuuuugaa

SEQ ID NO: 140177 - RNA, 65 nt, Homo Sapiens
uuauaauuguucaauauguuccuauuacuggguggagucuuaaagucccaucuaugggcuuuaga

SEQ ID NO: 140178 - RNA, 65 nt, Homo Sapiens
aguuuuauugucaaauaaacuuguguucaguucaaagucuuaaccuuuuuguauuauuguuuguu

SEQ ID NO: 140179 - RNA, 65 nt, Homo Sapiens
agaugagaaguccuccccuuguccuaacaagacugagucuuaacacccugauauccccuggcuca

SEQ ID NO: 140180 - RNA, 65 nt, Homo Sapiens
uaaaaggggagaagaacaaaucagcaaaggccucaagucuuaaaacuguuauuugcuucuuuuaa

SEQ ID NO: 140181 - RNA, 65 nt, Homo Sapiens
uacuugcauccacuucaaaugaauuuaaagcuucuagucuuaacaagaauggcugaagagaucaa

SEQ ID NO: 140182 - RNA, 65 nt, Homo Sapiens
acagcuucuugcuuguaaaacuaaguguaaaaaaaagucuuaacacugccccaaaauuauaaacu

SEQ ID NO: 140183 - RNA, 65 nt, Homo Sapiens
gaaggaagcaggagugauuacugcaagagaauggaagucuuaauaaacugguucauucuccauua

SEQ ID NO: 140184 - RNA, 52 nt, Homo Sapiens; identical to SEQ ID NO: 139530

SEQ ID NO: 140185 - RNA, 65 nt, Homo Sapiens
aauaaggaaagacuugguguauagugugaugguuuagucuuaaggauuaagacauuuuugguacu

SEQ ID NO: 140186 - RNA, 65 nt, Homo Sapiens
uagaaaaauggacauaugaauauuauuaaaaauugagucuuaaauuuaaaugggaagggaagaaa

SEQ ID NO: 140187 - RNA, 65 nt, Homo Sapiens
gagaagguuauggguaccaggaagaaacaaacagaagucuuaagauuagaaugagaaccaaagag

SEQ ID NO: 140188 - RNA, 65 nt, Homo Sapiens
uggauaagaugaccuguguaauaaucuuuguuaguagucuuaaagcugcugccauaguccuccaa

SEQ ID NO: 140189 - RNA, 65 nt, Homo Sapiens
ccacauuucacauacuguuacugaagaaagcaccaagucuuaauggaacaaagaccauagaauga

SEQ ID NO: 140190 - RNA, 65 nt, Homo Sapiens
uuuuuauugaugaauacaucucugaacguuccagaagucuuaagguuccaaagggauuuagcagu

SEQ ID NO: 140191 - RNA, 65 nt, Homo Sapiens
ugacacuauuaugaagcuacuagucauuccauaagagucuuaaaggacugcucuguguaacacug

SEQ ID NO: 140192 - RNA, 65 nt, Homo Sapiens
uaauucucauauccaugccuuuuuguccuguuuacagucuuaaaagagguaaaacagcaaauauu

SEQ ID NO: 140193 - RNA, 65 nt, Homo Sapiens
uaacaaguuguuuguauuuuauuuuuguuuauaccagucuuaaagauccagguucugaauaaaaa

SEQ ID NO: 140194 - RNA, 65 nt, Homo Sapiens
ccaguagacaccacuguacuuuuugauacgagggcagucuuaacuuguguuaaggccugugugua

SEQ ID NO: 140195 - RNA, 65 nt, Homo Sapiens
agguauuggaguuuaaaaaaaaagccaaauuucacagucuuaauaacuuuuuuuaaaaaaaacua

SEQ ID NO: 140196 - RNA, 65 nt, Homo Sapiens
aagguuuucaucaagccccgcccuuucucucucauagucuuaaugcgucuggaccacuggggaaa

SEQ ID NO: 140197 - RNA, 65 nt, Homo Sapiens
auguaaauaauguucaggaaaaacgcagggaacagagucuuaaaguuaauggauauuuaauguga

SEQ ID NO: 140198 - RNA, 65 nt, Homo Sapiens
uacagaaguaauuggccugagagcauucuugaccaagucuuaaaugcuagaaucugagaaggaau

SEQ ID NO: 140199 - RNA, 65 nt, Homo Sapiens
aguugggacaucagcugacuguuacuuuaacuguuagucuuaaauaacuuucucauacacugacu

SEQ ID NO: 140200 - RNA, 65 nt, Homo Sapiens
uaauuauuauuaaaccaauguauagaugugauuauagucuuaaacaguaaauggacauuccagaa

SEQ ID NO: 140201 - RNA, 65 nt, Homo Sapiens
uuuggggacauuauaaacuuuugggaugauuuucuagucuuaaggaccaacuauaggccuuuuuc

SEQ ID NO: 140202 - RNA, 65 nt, Homo Sapiens
accugccuguuaguacagagugaggauuucuugggagucuuaauauccucagauugaaaagcuua

SEQ ID NO: 140203 - RNA, 65 nt, Homo Sapiens
uucagagaaaacuucagagaagagagcucaucaucagucuuaauagcggcacuauuucugaacaa

SEQ ID NO: 140204 - RNA, 65 nt, Homo Sapiens
uguguaagaaguuaaaacuuaauuaaucuugaaguagucuuaaaaguacugcucauuuacacuca

SEQ ID NO: 140205 - RNA, 65 nt, Homo Sapiens
aaaaaaaggaaucugaaaaaugauuuagccaaauaagucuuaaccagaaguuacacagaccacag

SEQ ID NO: 140206 - RNA, 65 nt, Homo Sapiens
agggugaauuggaucaccauguaaaagugaaauucagucuuaaguaauguaaauaguguccauua

SEQ ID NO: 140207 - RNA, 65 nt, Homo Sapiens
uuacacuucuugacuucugaagcauuaauuuuugcagucuuaaaaguucuguuauuaaggggcau

SEQ ID NO: 140208 - RNA, 65 nt, Homo Sapiens
ccauuuggauuaaagauucaggcuuuaacacagaaagucuuaauaguaaagguccuagucuuucu

SEQ ID NO: 140209 - RNA, 65 nt, Homo Sapiens
gggagaacugaaagggaaaacaaaauacuugacauagucuuaaguagaagaaggcaguuagagaa

SEQ ID NO: 140210 - RNA, 65 nt, Homo Sapiens
uucacugguaaaauuguugaauauuucucucucccagucuuaaaagcccacaggcaagaauuaau

SEQ ID NO: 140211 - RNA, 65 nt, Homo Sapiens
uucaaaaauuuuauucaguguauuuucaguuguugagucuuaaugagggauacaggaggaaaaau

SEQ ID NO: 140212 - RNA, 65 nt, Homo Sapiens
uuugugaacaacguuucuauacuuuaauaccugagagucuuaaaaauguucucuguuuugaauau

SEQ ID NO: 140213 - RNA, 65 nt, Homo Sapiens
uauuuuuuacuuaguaaccauguuuacuguaauuuagucuuaaaauuuaaacuguggagcuuuca

SEQ ID NO: 140214 - RNA, 65 nt, Homo Sapiens
uugaauugguggaaccacuauaaaauucuguuaguagucuuaaaauaucguaggcguuuauauua

SEQ ID NO: 140215 - RNA, 65 nt, Homo Sapiens
uuguacgcugcgugaacaugccucaccuuuaagagagucuuaaagguaaagacacgaaaacacuu

SEQ ID NO: 140216 - RNA, 65 nt, Homo Sapiens
caacuaaaauuuuauauauuguaaccaguguuaaaagucuuaaaaaacaaugguauuaauugucc

SEQ ID NO: 140217 - RNA, 65 nt, Homo Sapiens
ggcuauaauuuuguguuuuuuuuuuuuaauugucuagucuuaaauuuguacaucuuguauaaaau

SEQ ID NO: 140218 - RNA, 65 nt, Homo Sapiens
agaagcugggugggcugaagaggccuggaaacgagagucuuaauugaggagaugggagacucgaa

SEQ ID NO: 140219 - RNA, 65 nt, Homo Sapiens
guuugaugggaugacugacacaggaaaucuguuaaagucuuaaaauggaaugagaauguuguuuu

SEQ ID NO: 140220 - RNA, 65 nt, Homo Sapiens
uauacauaauucaaaagaacuacuugaugcaguauagucuuaaggguucugcauacauuuuagaa

SEQ ID NO: 140221 - RNA, 65 nt, Homo Sapiens
uuuguuuucuaaaguugauaaauaauuaguguuauagucuuaagaucaaaugcauccucuagaaa

SEQ ID NO: 140222 - RNA, 65 nt, Homo Sapiens
ucaauggacaaaaauaaaauucaugcugugcaugcagucuuaaauauccauccccaagcaccucc

SEQ ID NO: 140223 - RNA, 65 nt, Homo Sapiens
guguuugcagcucaaaaauauacuaugaagaucaaagucuuaaguuuuuuauuuccuaaaugcca

SEQ ID NO: 140224 - RNA, 65 nt, Homo Sapiens
auuaguagugggauuuggcuggaauugauaauagcagucuuaaacuugcaaauugaauuggaaua

SEQ ID NO: 140225 - RNA, 65 nt, Homo Sapiens
caaacauuuuauauaaaguucauaauagcaaugacagucuuaagcaguggaauuucauucaaagg

SEQ ID NO: 140226 - RNA, 65 nt, Homo Sapiens
cuucugguucccauaaaagacuccugguucccauuagucuuaagugaggagucucuggcuuauga

SEQ ID NO: 140227 - RNA, 65 nt, Homo Sapiens
aaucaaacaauggaggaaucuaacugaaagggcaaagucuuaaucccaacuuaggcccuggcaau

SEQ ID NO: 140228 - RNA, 65 nt, Homo Sapiens
aauaaagauuuauaacagaauucugcagguguucaagucuuaaaauugauugcuuuuguauuuaa

SEQ ID NO: 140229 - RNA, 65 nt, Homo Sapiens
cuuucauugcuaagacuaacucaagauaauccuagagucuuaaagcauuucaggccaguguggug

SEQ ID NO: 140230 - RNA, 65 nt, Homo Sapiens
aauuaggaauuacuuuauuauaaaaugcuccuagaagucuuaauuguguuuauuuuuuaaaaaaa

SEQ ID NO: 140231 - RNA, 65 nt, Homo Sapiens
cuacucuuccccucuucucacuacugcacuugacuagucuuaaaacaaagaaagaacgaaugaau

SEQ ID NO: 140232 - RNA, 65 nt, Homo Sapiens
gugauaaaauauugauguuguauuuuacacucuuaagucuuaaccacagucagaauuaucuuaau

SEQ ID NO: 140233 - RNA, 65 nt, Homo Sapiens
cucucacggggcaagccugaugaacuguauagccaagucuuaaaccagccccacugcaucucaag

SEQ ID NO: 140234 - RNA, 65 nt, Homo Sapiens
ucaaauuacuauaugaugauugaauggcugaaguuagucuuaaacaaauacuuucaauauuauuc

SEQ ID NO: 140235 - RNA, 65 nt, Homo Sapiens
uuauuguuaugauuauacuuuuuauuucacacauaagucuuaaugccuaaguguuucagaaaugu

SEQ ID NO: 140236 - RNA, 65 nt, Homo Sapiens
uuuauuuaauaauuauauuuuggguuaguauuuaaagucuuaacauuguauuuuuaaauuuuucu

SEQ ID NO: 140237 - RNA, 65 nt, Homo Sapiens
cuugguaccacagaauaucaaaauuucuauguugaagucuuaaccgagcugagugugucucccua

SEQ ID NO: 140238 - RNA, 65 nt, Homo Sapiens
ugucuguacauaucugucugguucuuaaacagaacagucuuaaaauuaguacacagacaugaacu

SEQ ID NO: 140239 - RNA, 65 nt, Homo Sapiens
uuguuggaaauaauguacccagcccauucaugguaagucuuaagcaguguguuuuuguaugaaug

SEQ ID NO: 140240 - RNA, 65 nt, Homo Sapiens
ucuaaaauuuuaaauaaaagacugagguggucguaagucuuaacuuucuauuaggaauggcauau

SEQ ID NO: 140241 - RNA, 65 nt, Homo Sapiens
cuuugagucuagagagauuucaaauagguuggcauagucuuaaguuugagcaguguaauuacaaa

SEQ ID NO: 140242 - RNA, 65 nt, Homo Sapiens
cucuacauaaaagcuccaugugaaaagcuacuccuagucuuaacauuugcaguccuugugucacu

SEQ ID NO: 140243 - RNA, 65 nt, Homo Sapiens
uuuuaaaaaaggaaaaaaaaaagaaacuggguuccagucuuaauucauuuuccgugccagguuuu

SEQ ID NO: 140244 - RNA, 65 nt, Homo Sapiens
gacuuuucuuugcaagcgaaccuguuugaagcccaagucuuaacuccuggucucguaagguucca

SEQ ID NO: 140245 - RNA, 65 nt, Homo Sapiens
acuuuuugcucuggucaguucaacacacaaacggaagucuuaaaagguuuugaauguaaaaguug

SEQ ID NO: 140246 - RNA, 65 nt, Homo Sapiens
aggaaacuaaaagcuuucacuccauucucaagaaaagucuuaacuauuaugucugcaccagugaa

SEQ ID NO: 140247 - RNA, 65 nt, Homo Sapiens
caaaaguauuaauagaaauucucuaucagcuauucagucuuaauuucacuaguaguauaaugggu

SEQ ID NO: 140248 - RNA, 65 nt, Homo Sapiens
ugagucuggguuguugggaacagcacagaauuuggagucuuaagcucuaaauuagaggcccugac

SEQ ID NO: 140249 - RNA, 65 nt, Homo Sapiens
cuuucuuuucuuuuuuaaaguaaacuuguguauugagucuuaacuguauuucaguauuuuccagc

SEQ ID NO: 140250 - RNA, 65 nt, Homo Sapiens
uagugcauuuccuccugccuuugcuuguucacugcagucuuaagaaagagguaaaaggcaagcaa

SEQ ID NO: 140251 - RNA, 65 nt, Homo Sapiens
aaggguuugccggcccuaacuugugcucagggcugagucuuaaaggggagcucaguucccauugc

SEQ ID NO: 140252 - RNA, 65 nt, Homo Sapiens
accauauucaggguacgaacaacugcuccauuccuagucuuaauucugugauauuuuuuagacug

SEQ ID NO: 140253 - RNA, 65 nt, Homo Sapiens
gggagagggcuuucuggggcgggggcgccucgugcagucuuaacaaccgccuuucucaccacccu

SEQ ID NO: 140254 - RNA, 65 nt, Homo Sapiens
auacaaaaugguauuguuuauguucacacagugagagucuuaaagggcauaauugaugcacauga

SEQ ID NO: 140255 - RNA, 65 nt, Homo Sapiens
uuucuaacucugauguaaauguauucaagaaagccagucuuaacagugauucgagcuauauuuaa

SEQ ID NO: 140256 - RNA, 65 nt, Homo Sapiens
cacuuuuuuaauauauaugaacuaauucaauuuuaagucuuaagucugcaccuuucuguacaaau

SEQ ID NO: 140257 - RNA, 65 nt, Homo Sapiens
gucacuggccucuccccagggccccccaucaccagagucuuaaggcugcgguggagggaucaguu

SEQ ID NO: 140258 - RNA, 65 nt, Homo Sapiens
uucaguaugaaaccaguuucacagguguagaacucagucuuaaacguuccguaguguagaagccc

SEQ ID NO: 140259 - RNA, 65 nt, Homo Sapiens
acaguguaacuuacaguuucaagggugaagauacaagucuuaaccgauagaaugugggcuuuuuc

SEQ ID NO: 140260 - RNA, 65 nt, Homo Sapiens
cuauaauguucauuuaguugguuaaaggcacauaaagucuuaacucuuauugauacuaaagagga

SEQ ID NO: 140261 - RNA, 65 nt, Homo Sapiens
uguacauuuaacuuuggaauggcuuuguaauaaucagucuuaagaaaauguugacaagcucuggu

SEQ ID NO: 140262 - RNA, 65 nt, Homo Sapiens
aggaaucuggugaauuuuagucaucccagcuuuuuagucuuaaccacaguucucacucucuuaaa

SEQ ID NO: 140263 - RNA, 65 nt, Homo Sapiens
ccuguucuguaaauuuuauuuuaaacuguuaccauagucuuaaguuguuuaugcuuuaucagacu

SEQ ID NO: 140264 - RNA, 65 nt, Homo Sapiens
aguuuuguuuucuuucuauguuccaugcauaauacagucuuaagugaauuucucuuuuuuaauuu

SEQ ID NO: 140265 - RNA, 65 nt, Homo Sapiens
uuuacaaaggaaccaaaaugauaaugggagaauuuagucuuaaaaguuuagguugucagaguuua

SEQ ID NO: 140266 - RNA, 65 nt, Homo Sapiens
cuauguuuuuaaauuuuuuugcuaaucuacaaauaagucuuaaaccauacaagucaggguguuug

SEQ ID NO: 140267 - RNA, 65 nt, Homo Sapiens
aguuuugugcccuggcucuauucgaacccaaugguagucuuaaaguuuaaaagugcuaaugugua

SEQ ID NO: 140268 - RNA, 65 nt, Homo Sapiens
ugagacccaagucaucaugaaaaaggcccaaguacagucuuaaugcgauaaauccacuagcuaag

SEQ ID NO: 140269 - RNA, 65 nt, Homo Sapiens
acccagcuguccccacgccucugucuuuugggucaagucuuaaucccugcaccugaguugguccu

SEQ ID NO: 140270 - RNA, 65 nt, Homo Sapiens
uuaauuguucugugauugaggaccacugaaaaauaagucuuaauaaauguugguaugaaccuacu

SEQ ID NO: 140271 - RNA, 65 nt, Homo Sapiens
uguucuucaaaaugugcauguuaaguauucaaaucagucuuaaauuuuuaaaaauauguaauuuu

SEQ ID NO: 140272 - RNA, 65 nt, Homo Sapiens
uucaggaacuauucuaaaagucauaaaagggucacagucuuaagcagagcuuaguuuucuucuca

SEQ ID NO: 140273 - RNA, 65 nt, Homo Sapiens
uguuuuuuuacacauauuaacuuaauaaauguaugagucuuaaauaccucuuaguucucauuaaa

SEQ ID NO: 140274 - RNA, 65 nt, Homo Sapiens
uggggucuuggugcccaagcuggucucaaacuccuagucuuaagcaaucuuccugcuuuggccuc

SEQ ID NO: 140275 - RNA, 65 nt, Homo Sapiens
gugcagccccgccccccugccucacccacaaacuaagucuuaacaaaauccaaauuaccaacaaa

SEQ ID NO: 140276 - RNA, 65 nt, Homo Sapiens
acaccaaaacugagccauggagaaagugcagcucaagucuuaaagccgacggcagagccuccuuc

SEQ ID NO: 140277 - RNA, 65 nt, Homo Sapiens
acacggagccaccaacuggauuuuuuuaaugauaaagucuuaaaaucccuucucuaauuucuucu

SEQ ID NO: 140278 - RNA, 65 nt, Homo Sapiens
uuuccccuucagaugucaguaugugcagauuccacagucuuaagcucagauugaaaagagaccga

SEQ ID NO: 140279 - RNA, 65 nt, Homo Sapiens
uaauagguaguuuucuauaguaacuugauuaauuuagucuuaauccauuugaaacucucucuucc

SEQ ID NO: 140280 - RNA, 65 nt, Homo Sapiens
ucacuugcccucgugccugggggagagaggcagcaagucuuaacaaaccaacaucuuugcgaaaa

SEQ ID NO: 140281 - RNA, 65 nt, Homo Sapiens
uuuucuacuacuacauauuuagaguucacugguucagucuuaaaugccugcauggugccuuuuua

SEQ ID NO: 140282 - RNA, 65 nt, Homo Sapiens
cacuggaugaaaaucuaggaaguguaguuaaggccagucuuaaccaauuucagguaguaauauuc

SEQ ID NO: 140283 - RNA, 65 nt, Homo Sapiens
uggggcuucauguguggccuaauacccguuggaagagucuuaaaccuucacucacucacucaaca

SEQ ID NO: 140284 - RNA, 65 nt, Homo Sapiens
gaugccccuuccaaaccaucccccugguuucuuuaagucuuaaguugugggguguuucgccugca

SEQ ID NO: 140285 - RNA, 65 nt, Homo Sapiens
uaucuggcauuugggugaacagguuuguauuugguagucuuaaugaauuuuggggggaacauuuu

SEQ ID NO: 140286 - RNA, 65 nt, Homo Sapiens
auuaccguauucgccguacuaaguugguuucuguuagucuuaacagucuguuuucuuuuaaaagc

SEQ ID NO: 140287 - RNA, 65 nt, Homo Sapiens
gacuuagcccauaggcacuuuugaguauauuuugaagucuuaaaaugcugucauaauuuaagcau

SEQ ID NO: 140288 - RNA, 65 nt, Homo Sapiens
ggaacuuggcauuuuccugacucaaggagcuuuaaagucuuaaugugcaccccgcaaccugggau

SEQ ID NO: 140289 - RNA, 65 nt, Homo Sapiens
acaaagugccaaagaaaguguauguagaagcaugaagucuuaaggugaccuuguaaaagacagug

SEQ ID NO: 140290 - RNA, 65 nt, Homo Sapiens
uuacccuggccuccuagggucccuuuuucugaugaagucuuaauucccuaaaagcgccucuuugg

SEQ ID NO: 140291 - RNA, 65 nt, Homo Sapiens
ggguuaugagaaccagcgaaaucccccaugucaucagucuuaaaaaaaaaauuuuacaaauccac

SEQ ID NO: 140292 - RNA, 65 nt, Homo Sapiens
ggauuguaggcuguguagaaauugaugaagaaauuagucuuaauaggcuccuguuagacaaacac

SEQ ID NO: 140293 - RNA, 65 nt, Homo Sapiens
auuugugacauauguaucuaggguuacauuuuuuaagucuuaaucgaggcucccacuucuuggga

SEQ ID NO: 140294 - RNA, 65 nt, Homo Sapiens
cuugguuuauacuuuuucuauucaucaggguaggaagucuuaaauccuuaggcauccaagaagua

SEQ ID NO: 140295 - RNA, 65 nt, Homo Sapiens
gauggaucaccauuauauuuugaaagaagccaucaagucuuaaguuuuucauuucaacuugugaa

SEQ ID NO: 140296 - RNA, 65 nt, Homo Sapiens
gaaaugugugaaagaaccucacacaacauaauuggagucuuaaaauagaggaagaguaagcaaag

SEQ ID NO: 140297 - RNA, 65 nt, Homo Sapiens
augcuuauugcuucuguauuucuucucuacucccuagucuuaauguuuaaccuugaaugcuauua

SEQ ID NO: 140298 - RNA, 65 nt, Homo Sapiens
guaauaaauacaaaaaaaucauuuuucuagagcagagucuuaaaaucagguggggguaggggaug

SEQ ID NO: 140299 - RNA, 65 nt, Homo Sapiens
cccagauuacuccaggauaaucuccucaccucaugagucuuaacuuaauuacaucugcaaggccc

SEQ ID NO: 140300 - RNA, 65 nt, Homo Sapiens
ucugaauuuuaguacuaguuuacacguauaaauacagucuuaaaccuuuaugucugagucugaaa

SEQ ID NO: 140301 - RNA, 65 nt, Homo Sapiens
uuuuucgccuuaguggugauuguuuaaacucucacagucuuaaaccgugccaaaguccuguuaug

SEQ ID NO: 140302 - RNA, 65 nt, Homo Sapiens
gucugcauuuucagguggggcgugauagaguucacagucuuaaaagugucuccugagacaagcau

SEQ ID NO: 140303 - RNA, 65 nt, Homo Sapiens
cucuccgcuaaaguggacauuuauucuagaaauccagucuuaaauuuccucggcuccauuguggg

SEQ ID NO: 140304 - RNA, 65 nt, Homo Sapiens
auauuucauugugaaagaagaaaagguaucaguccagucuuaaagcaguuacugaggcuucuccc

SEQ ID NO: 140305 - RNA, 65 nt, Homo Sapiens
uauaugugggaggaggagggcaaagagacuagaagagucuuaaaucagcccuugaacaucuccuc

SEQ ID NO: 140306 - RNA, 65 nt, Homo Sapiens
auuuuugcaauuuuuuaaauugaugacucuuacauagucuuaagcaugugaagugccuguguaau

SEQ ID NO: 140307 - RNA, 65 nt, Homo Sapiens
ccagauuuacugaaaauguccuacaauaaaaauccagucuuaauuauauguaaaguugauauuga

SEQ ID NO: 140308 - RNA, 64 nt, Homo Sapiens
uugggaauaaauuaaaaacaguauuugggggagaaacgugcaauagcguaaugguggugucccu

SEQ ID NO: 140309 - RNA, 64 nt, Homo Sapiens
cuauucugcaguugcagagccagccccgcgugagaacgugcauaaugagugcacaccaucaugu

SEQ ID NO: 140310 - RNA, 64 nt, Homo Sapiens
aggaucacucacauauguacauguacccaccacaaacgugcaagcuccugcacacaugcaugca

SEQ ID NO: 140311 - RNA, 64 nt, Homo Sapiens
augcacacacacacgcacacguacauucacuacaaacgugcagccuccugcacacgugcacauu

SEQ ID NO: 140312 - RNA, 64 nt, Homo Sapiens
cugaauuugucuuuuaaaaugaguacauauauaggcaauaaauauauaugcucagaucaauaua

SEQ ID NO: 140313 - RNA, 64 nt, Homo Sapiens
acauucuugugauuucauaugcuguauucuucaagcaauaaaauugugauguguuuuauaaaug

SEQ ID NO: 140314 - RNA, 64 nt, Homo Sapiens
gaaacacuagagucauauaagaaauaaaaauugggcaauaaaauaaaaugauucaguguuucuu

SEQ ID NO: 140315 - RNA, 64 nt, Homo Sapiens
auacauuauuagacugaacugugaccugaaaugagcaauaaacucuguauuaauucacugaaau

SEQ ID NO: 140316 - RNA, 64 nt, Homo Sapiens
aauuuuuugucuucaugcuagcaauaaagacauugcaauaaaguggccaacuugcuccaguaau

SEQ ID NO: 140317 - RNA, 64 nt, Homo Sapiens
cauugcaauaaaguaauuuucuugcuccaguaaugcaauaaagaagaggggacagucuggccaa

SEQ ID NO: 140318 - RNA, 64 nt, Homo Sapiens
uggcaacagagcaagacuccgucucaaaaaaagggcaauaaaugcccucucugaauguuugaac

SEQ ID NO: 140319 - RNA, 64 nt, Homo Sapiens
aauuuauauuuucccucucuugccuuucuuauuugcaauaaaagguauugagccauuuuuuaaa

SEQ ID NO: 140320 - RNA, 64 nt, Homo Sapiens
ucaauaugaaggaaaugaaccacauagacuuuaugcaauaaauaacagugcaagugaguauaac

SEQ ID NO: 140321 - RNA, 64 nt, Homo Sapiens
ugauggugcauuuuauucuugaagugaaaucugugcaauaaaauaacagacugucugcaaaacu

SEQ ID NO: 140322 - RNA, 64 nt, Homo Sapiens
auuuuuaagaaaucgagauuaaagacuauuaagagcaauaaauucuguuguagaauaauaauaa

SEQ ID NO: 140323 - RNA, 64 nt, Homo Sapiens
uacuaugaaaugaaagaacuuaaguagauagaaagcaauaaaaaauuuuuuggcuucuuauuuc

SEQ ID NO: 140324 - RNA, 64 nt, Homo Sapiens
ucauaguacucuuuguagcacuaaagguggugaggcaauaaaaaacuugugaaguggaaauguu

SEQ ID NO: 140325 - RNA, 64 nt, Homo Sapiens
aaugggcugagcugccuguaggaauauaaggaaagcaauaaaugcaacuuaaauaauaaacagu

SEQ ID NO: 140326 - RNA, 64 nt, Homo Sapiens
uuugugagaguaguuuuccuuugcuacuugaauagcaauaaaagcguguuaacuuuuugauuga

SEQ ID NO: 140327 - RNA, 64 nt, Homo Sapiens
aguauugcaguugcugcuuuguacagagguuacugcaauaaaggaaguggauucauuaaaccua

SEQ ID NO: 140328 - RNA, 64 nt, Homo Sapiens
cacaugucaacuugauggauuaggggauauuugugcaauaaauauuauaauaaccucccaguuc

SEQ ID NO: 140329 - RNA, 64 nt, Homo Sapiens
cauacuaguacagauuuuguugaaaauguuaagugcaauaaaaaauaugucuuaauuuugaguu

SEQ ID NO: 140330 - RNA, 64 nt, Homo Sapiens
uagguuuucugcuagccaauauuaaaagagaccugcaauaaaaaaauuacccugaucugauaga

SEQ ID NO: 140331 - RNA, 64 nt, Homo Sapiens
gugaauacuggaagcugcagaucuuugcuaggacgcaauaaauuuauauacuuuuugagggguu

SEQ ID NO: 140332 - RNA, 64 nt, Homo Sapiens
auauucuguuucuuucguuaaauaaauuaaccuagcaauaaaaacagacuauuauuaucuuugu

SEQ ID NO: 140333 - RNA, 64 nt, Homo Sapiens
aaugaauaccacaaaagaugguuccagacaucaagcaauaaaaacaggucuaguuucgguaacu

SEQ ID NO: 140334 - RNA, 64 nt, Homo Sapiens
uaccuucaacaugugcucgcucugcaugauuagugcaauaaaacucccuuccuuaugcauacug

SEQ ID NO: 140335 - RNA, 64 nt, Homo Sapiens
uugaaaaaauauuguuuaaugcaaaugaaggaaugcaauaaagaguaaauauacuugaaaaugu

SEQ ID NO: 140336 - RNA, 64 nt, Homo Sapiens
caacucuaaaaucacagcugccaugcacccccucgcaauaaaaccucuuuccaccuuccccuau

SEQ ID NO: 140337 - RNA, 64 nt, Homo Sapiens
aaacuagaaaaaaaaaagguccaaugucacaaaagcaauaaaacagagagaaaauccacaaauu

SEQ ID NO: 140338 - RNA, 64 nt, Homo Sapiens
cuaagcccggccucgucucgccggaggagacgcugcaauaaagguugggagaaggcgcggaaag

SEQ ID NO: 140339 - RNA, 64 nt, Homo Sapiens
guguuacuuuuuuagacucccgucugcacaaaaugcaauaaaaauaauuuuauuauacccuuca

SEQ ID NO: 140340 - RNA, 64 nt, Homo Sapiens
uuugcuuuaugucacuuacacggucaccuggagccggcucaaguggcuaaagcauccuggggcc

SEQ ID NO: 140341 - RNA, 64 nt, Homo Sapiens
cugucgcccaggcuagaguggauuggcgugaucucggcucaaugcaaaucuccaggguucaauc

SEQ ID NO: 140342 - RNA, 64 nt, Homo Sapiens; identical to SEQ ID NO: 74579

SEQ ID NO: 140343 - RNA, 64 nt, Homo Sapiens; identical to SEQ ID NO: 74580

SEQ ID NO: 140344 - RNA, 64 nt, Homo Sapiens
auggacuuuuccaugggucaaauuuuuugugugagagauagagguacaugucuucugaugaugu

SEQ ID NO: 140345 - RNA, 64 nt, Homo Sapiens
ugaaucauagcgagccauuugcucuugccaaagugagauagauguacugaggagauaauugaaa

SEQ ID NO: 140346 - RNA, 64 nt, Homo Sapiens
uuggaagggaagggaggugggcagcagugggucagagauagaccuuuguucucuuauuucugag

SEQ ID NO: 140347 - RNA, 64 nt, Homo Sapiens
ucccacucuauucaaaguuaucucucugcucacugagauagauacauaucugauugccuccuuu

SEQ ID NO: 140348 - RNA, 64 nt, Homo Sapiens
auuacugaaaccaaaauauauuugcuucaucugccccuacuaaccaucccccugccugcugccu

SEQ ID NO: 140349 - RNA, 64 nt, Homo Sapiens
ccugcccugcgugcugguuccuucagaccccuaacccuacuaaccagcaggcucaucucaccuc

SEQ ID NO: 140350 - RNA, 63 nt, Homo Sapiens
cugugauuuuuagaagaacuguuguaaagccuuugagauuagacagacuagagcuacauuacu

SEQ ID NO: 140351 - RNA, 63 nt, Homo Sapiens
gauaaccuugugguuaaaagauaaggaaaaauaugagauuaugagaaauuaaauguauacuau

SEQ ID NO: 140352 - RNA, 63 nt, Homo Sapiens
guugguuagcagggaagacccagaguuguagauugagauuaggguguacuggcugaacugugg

SEQ ID NO: 140353 - RNA, 63 nt, Homo Sapiens
uggaaaacauacaauucuguguuccucaguaaaugagauuagcgucuaaugaguagcaccccu

SEQ ID NO: 140354 - RNA, 63 nt, Homo Sapiens
aagugauucuccugccucauccucccaagaagcugagauuacagaugaccaccaccacuccug

SEQ ID NO: 140355 - RNA, 63 nt, Homo Sapiens
aggugauccaccugccucagccucccaaagugcugagauuacaggcaugagccaccacgccca

SEQ ID NO: 140356 - RNA, 63 nt, Homo Sapiens
aggcgauucuccugccucagcuucccgaguaacugagauuacaggcacccaccaccaugccca

SEQ ID NO: 140357 - RNA, 63 nt, Homo Sapiens
aggugaucuaccugccucagccucccaaagugcugagauuacagacaugagccuccgcgccuu

SEQ ID NO: 140358 - RNA, 63 nt, Homo Sapiens
uccauauuuuucaaacaucagaacucuuucaauugagauuaaggcucugugguaagaaaaaau

SEQ ID NO: 140359 - RNA, 63 nt, Homo Sapiens
ccagagcauuaauuguaucaaucgggaaggcugugagauuaaugccugguuuccuuuguacua

SEQ ID NO: 140360 - RNA, 63 nt, Homo Sapiens
agaacccuuuuuaggcuuuaggguagaggcuccugagauuagggugcacccccaacuucauag

SEQ ID NO: 140361 - RNA, 63 nt, Homo Sapiens
agaacuccaaauagcccaaguuagauuagacaaugagauuaagaaggggaggggugcuggaga

SEQ ID NO: 140362 - RNA, 63 nt, Homo Sapiens
gaauccagaaucuuuuuucacuugccagcaaggugagauuauguucugcugaaaugguaguuu

SEQ ID NO: 140363 - RNA, 63 nt, Homo Sapiens
aguacaccacaccaugcccgccucccaaggagcugagauuacgaagugauucuccuaccucag

SEQ ID NO: 140364 - RNA, 63 nt, Homo Sapiens
gacuugagcagagggaacgaccugacuuacuugcacugugaucccccuugcuccgcccacugu

SEQ ID NO: 140365 - RNA, 63 nt, Homo Sapiens
acuuacuugcacugugaucccccuugcuccgcccacugugaccuugaaccccaugcacuguga

SEQ ID NO: 140366 - RNA, 63 nt, Homo Sapiens
cuugcuccgcccacugugaccuugaaccccaugcacugugaccuccccccuucucccccuucc

SEQ ID NO: 140367 - RNA, 63 nt, Homo Sapiens
augcacugugaccuccccccuucucccccuucccacugugauuggcacaucgacaagggcugu

SEQ ID NO: 140368 - RNA, 63 nt, Homo Sapiens
uaugugggugacccuguggaagugagaaggagucacugugaugcuuagcuguccuaaaugaug

SEQ ID NO: 140369 - RNA, 63 nt, Homo Sapiens
uggagugcugugagcuguccguggugcugaauucacugugacgucacuccugucucucuuugc

SEQ ID NO: 140370 - RNA, 63 nt, Homo Sapiens
agguuagccagagacagguuuucauuaucaggucacugugaaaucugguaaggcaguccugag

SEQ ID NO: 140371 - RNA, 63 nt, Homo Sapiens
agcucacugcaaacaacuggaauugagguugcacacugugauuuuuacaccgaaaagccaaaa

SEQ ID NO: 140372 - RNA, 63 nt, Homo Sapiens
ugugccucagaucauccaccugugugaguccaucacugugaaauugacuguguccaugugaug

SEQ ID NO: 140373 - RNA, 63 nt, Homo Sapiens
agauuucugagucguacuaugguuuugccuugucacugugaggcccuacuagguguaagcauu

SEQ ID NO: 140374 - RNA, 63 nt, Homo Sapiens
uuuugcauguguucugauaaaaaucaauucuagcacugugaagcuucagacaccuugaaaguc

SEQ ID NO: 140375 - RNA, 63 nt, Homo Sapiens
aaaucucuccaucugcauuaguauuuuaaggagcacugugagagaaaucacaaaguauuagag

SEQ ID NO: 140376 - RNA, 63 nt, Homo Sapiens
ggugccccugccuccagcagagcccccaccauucacugugacaucuuuccgugucacccugcc

SEQ ID NO: 140377 - RNA, 63 nt, Homo Sapiens
gccuggcggccauggggccugccgugccugccccacugugacccacaggccugggugguguac

SEQ ID NO: 140378 - RNA, 63 nt, Homo Sapiens
aauggaucccuacaggggggcacuggagaggugcacugugagaaggugcaguguccccggcug

SEQ ID NO: 140379 - RNA, 63 nt, Homo Sapiens
uguaucaccugcagauguggggcaggggugccucacugugagcgggaugacuguucacugcca

SEQ ID NO: 140380 - RNA, 63 nt, Homo Sapiens
cccaggcuggagugcagugacacaaucucagcucacugugaccuccgccuccuggguucaaga

SEQ ID NO: 140381 - RNA, 63 nt, Homo Sapiens
ucuuguguucuguagacugccaucauugaugaucacugugaaaauugaccaagugauguguuu

SEQ ID NO: 140382 - RNA, 63 nt, Homo Sapiens
uuacagaugucuuuuugucaauuuguaaaauaucacugugaaucccuguguacaauuuaaaau

SEQ ID NO: 140383 - RNA, 63 nt, Homo Sapiens
gcacagcgguuuccuucuuccuuggcucuuuuucacugugacuaccuaaggagcuguccaguu

SEQ ID NO: 140384 - RNA, 63 nt, Homo Sapiens
aggccuuugagcucuugucagccucccgggagccacugugaccaggacaguggguguguacug

SEQ ID NO: 140385 - RNA, 63 nt, Homo Sapiens
ccuucucagcaggcacaugucuccacaguccugcacugugauuauccuuuucuucagaccacu

SEQ ID NO: 140386 - RNA, 64 nt, Homo Sapiens
acuaaccuaccccaacucugcccuucucccauccaagagaaaccagcaaaaugauaaagaagcu

SEQ ID NO: 140387 - RNA, 64 nt, Homo Sapiens
gggcagcagucacuggggcucaagggcagugagcaagagaaaugucuaaagcugcuucucccaa

SEQ ID NO: 140388 - RNA, 64 nt, Homo Sapiens
ugauaagaagaauuccauugaaaggggaaaaaugaagagaaacaaguauaucugaaauguuuau

SEQ ID NO: 140389 - RNA, 64 nt, Homo Sapiens
uuugaaaauauaacaguuaaagauauuuuucuaaaagagaaaugauuuaaugaaucuugcuuuc

SEQ ID NO: 140390 - RNA, 64 nt, Homo Sapiens
gggcacuuuuuaacauugcugauguaguaugcuuaagagaaaugaccuaaauaaggaucaauug

SEQ ID NO: 140391 - RNA, 64 nt, Homo Sapiens
cuauuauuuuagaguucuaauacacucuaaauuaaagagaaaauugagaguaaaugacugucuu

SEQ ID NO: 140392 - RNA, 64 nt, Homo Sapiens
gucuuaucacucuuauuugacauuucguagguguaagagaaauggaaaugaaugguuucaacaa

SEQ ID NO: 140393 - RNA, 64 nt, Homo Sapiens
agaccuuccacuuaaggguaccaauucaauacaaaagagaaaagaagaaccucucagugcuuuu

SEQ ID NO: 140394 - RNA, 64 nt, Homo Sapiens
uggccugcucucacgugucuguguaagaucaugcaagagaaaucacagugccuucuacagaauu

SEQ ID NO: 140395 - RNA, 64 nt, Homo Sapiens
gaauuaauucagugaaggauuuuaagaaaagagaaagagaaaagucuauaaaaugaauaaaaug

SEQ ID NO: 140396 - RNA, 64 nt, Homo Sapiens
gaaaaggaauuaauucagugaaaauguuuaagaaaagagaaagaaaucucucuauaaaaugaau

SEQ ID NO: 140397 - RNA, 64 nt, Homo Sapiens
uuuagcuaguaacgugaucuauugcaauagaaugaagagaaacauaaauucauuguauguuaga

SEQ ID NO: 140398 - RNA, 64 nt, Homo Sapiens
acagcacuuucugauccaaaugguuucuuaacaaaagagaaagcaggaaauuucaguggcucuc

SEQ ID NO: 140399 - RNA, 64 nt, Homo Sapiens
acauuccacaaaugucaagcccuauaauucuauaaagagaaaugguuuuauuggagaaaucuug

SEQ ID NO: 140400 - RNA, 64 nt, Homo Sapiens
ggguguuggugauuguauuuuauuuuucuuauagaagagaaaauuauaaaaaauuuaaaacugc

SEQ ID NO: 140401 - RNA, 64 nt, Homo Sapiens
agaauacugcaauuuugugcuucaugcaauacuaaagagaaauaaauaguuuaagcuuuauuca

SEQ ID NO: 140402 - RNA, 64 nt, Homo Sapiens
cuucacagaauuauuguggguucaccaucuacagaagagaaauaaagucacuccuaguaucuau

SEQ ID NO: 140403 - RNA, 64 nt, Homo Sapiens
gcccacgaaaauuagucuagggcgcugcaggagaaagagaaaguauucacuguuagagagugua

SEQ ID NO: 140404 - RNA, 64 nt, Homo Sapiens
acugucauuuaaggcugugcuugugcuuuauacaaagagaaagagguggucuuaaggggaugcu

SEQ ID NO: 140405 - RNA, 64 nt, Homo Sapiens
cugaugcauuaauaaaagcagccaaauagggccaaagagaaaaauaacaggacucuguacugga

SEQ ID NO: 140406 - RNA, 64 nt, Homo Sapiens
gcuacaguuuuauagauugcuuguguugcuacccaagagaaaauaaauccagacuuggggguca

SEQ ID NO: 140407 - RNA, 64 nt, Homo Sapiens
gugguggcagccacaaauucgacaagccaguccuaagagaaaagcugcagccaccagugggaga

SEQ ID NO: 140408 - RNA, 64 nt, Homo Sapiens
gaggaagaagcaaaaguggaucuuacauggcagcaagagaaaauggcgggaggugaaaggcacu

SEQ ID NO: 140409 - RNA, 64 nt, Homo Sapiens
ggacaucuaauagucccuaagagaaaugaaagagaagagaaaugacuggggugagaagagauaa

SEQ ID NO: 140410 - RNA, 64 nt, Homo Sapiens
aaagagaagagaaaugggacgggugagaagagauaagagaaauguguagcgauucguuacacug

SEQ ID NO: 140411 - RNA, 64 nt, Homo Sapiens
ccgcuuuagucaauacuuuuugcaaagcauauuaaagagaaagcagauuggaaagaauuucaua

SEQ ID NO: 140412 - RNA, 64 nt, Homo Sapiens
auuuuaagaguagcaguauaauucuuaaaaaaagaagagaaagagacuugcauuuaaaugugac

SEQ ID NO: 140413 - RNA, 64 nt, Homo Sapiens
ugagaaggcuugugcccaaaugucuccaaagagaaagagaaacuugggcaacagagugagaccc

SEQ ID NO: 140414 - RNA, 64 nt, Homo Sapiens
gaaacuugagaaggcuugugagacccugucuccaaagagaaagaccagccugggcaacagagug

SEQ ID NO: 140415 - RNA, 64 nt, Homo Sapiens
uuaaagagacugguagcucaucauccuaccauaaaagagaaaaaaauucggaaagugaucagag

SEQ ID NO: 140416 - RNA, 64 nt, Homo Sapiens
gaaaaucuuaaaagagaacacaccaaaaaagugaaagagaaauugaaagggaaaaaagacaaaa

SEQ ID NO: 140417 - RNA, 64 nt, Homo Sapiens
gagauugaugacaagcaaguuacucaggaaucaaaagagaaaaaaguuucugaaaacaaugaaa

SEQ ID NO: 140418 - RNA, 64 nt, Homo Sapiens
gaaagaagcaaaugacuauucucugaagacaaccaagagaaaauugcaaaaagacaaguaugac

SEQ ID NO: 140419 - RNA, 64 nt, Homo Sapiens
aacuuagaaguguuucuaagagaacagaaguaauaagagaaacaguuacguguggaauucaaca

SEQ ID NO: 140420 - RNA, 64 nt, Homo Sapiens
uagagaauauucucauccucuacuuugacauuuaaagagaaauugguucuccuagcugcagcaa

SEQ ID NO: 140421 - RNA, 64 nt, Homo Sapiens
uccucaaguuuccaugugcgauaguccuagcaauaagagaaauuaucuugaaucccauuguccu

SEQ ID NO: 140422 - RNA, 64 nt, Homo Sapiens
uucaggaaauaaaacuacauacaguauuuaguaaaagagaaaguuaucaaaacaucucuaagau

SEQ ID NO: 140423 - RNA, 64 nt, Homo Sapiens
aagaaauucaugcauagcuugaagggaacuguaaaagagaaaaagauuuuuuuuuuuuaaguaa

SEQ ID NO: 140424 - RNA, 64 nt, Homo Sapiens
accucuuuccugaauauugagaggaauguuaaguaagagaaagagaccagggucucacacccug

SEQ ID NO: 140425 - RNA, 64 nt, Homo Sapiens
uguggaaaaguucuuuuuuuuuuccaacuagaggaagagaaacuaaaaacaugauuucucuaau

SEQ ID NO: 140426 - RNA, 64 nt, Homo Sapiens
agaucugaacauguauuuguaaacacauguuuugaagagaaaccugcauguuuguuaaaaaaac

SEQ ID NO: 140427 - RNA, 64 nt, Homo Sapiens
aaaugguuuucuuuuuguacgaugcugggggaaaaagagaaaaggguguugccuugccuugcau

SEQ ID NO: 140428 - RNA, 64 nt, Homo Sapiens
ucagucuuuucuaaucauaagauaauucacacugaagagaaacugcaaacguggaaagugugac

SEQ ID NO: 140429 - RNA, 64 nt, Homo Sapiens
aagcuugcaaccacacucaaucuauucuaaauauaagagaaaugauauuggugagaagccacaa

SEQ ID NO: 140430 - RNA, 63 nt, Homo Sapiens
cauuuuuuuccuccugguaguaaaugucagaguaagagaaacaaacuguuuagaauuaucaug

SEQ ID NO: 140431 - RNA, 64 nt, Homo Sapiens
aguaauuaaaaugugccuuuugaagauguuuucuaagagaaaggaaauacguugcagugaugug

SEQ ID NO: 140432 - RNA, 64 nt, Homo Sapiens
caacaacuucauuccuagccagggguagcucugaaagagaaaccaauauaaagugaaugccuuu

SEQ ID NO: 140433 - RNA, 64 nt, Homo Sapiens
uagcauuagcucucacaaaauggugggugaaacuaagagaaauggacuuaaguuugugaaggug

SEQ ID NO: 140434 - RNA, 64 nt, Homo Sapiens
gugacacuugugaaaaggcuauccuucccuuuuaaagagaaaauuauuucaccuuuguuuggaa

SEQ ID NO: 140435 - RNA, 52 nt, Homo Sapiens
agcacgcauggaaaaguuucuuaagagaaaugguggaaacaaggaaaacuga

SEQ ID NO: 140436 - RNA, 64 nt, Homo Sapiens
agaaaggcugcuuuagugccauaacuaggucuccaagagaaaauaauuuguucuuccugauaug

SEQ ID NO: 140437 - RNA, 64 nt, Homo Sapiens
uccucacuuauuaacucucucaguagcugucuccaagagaaaaaccuccaguucucccugauga

SEQ ID NO: 140438 - RNA, 64 nt, Homo Sapiens
ggggcugaaaaacugaauaaggaaacaacuuuauaagagaaacaguggucuucaaucuuuuaaa

SEQ ID NO: 140439 - RNA, 64 nt, Homo Sapiens
aaagaaaggaauacuuuuguuagaaugagaauuaaagagaaaacaaaagaaucuuggcaaaauu

SEQ ID NO: 140440 - RNA, 64 nt, Homo Sapiens
ucgcuguuuguuguuucauagauuuauuuaaaaaaagagaaagucuauagcuauaaaucuuuaa

SEQ ID NO: 140441 - RNA, 64 nt, Homo Sapiens
aaaaaaagagaaagucuauagcuauaaaucuuuaaagagaaauaugaauacaauuccccuaaac

SEQ ID NO: 140442 - RNA, 64 nt, Homo Sapiens
caacauuuucuuagaggagagagagaaauauuaaaagagaaaugaaacaauagaguauuuuggg

SEQ ID NO: 140443 - RNA, 64 nt, Homo Sapiens
gugcacuggcaaugcuauuuuagagucugcagagaagagaaagcauguugcuuaaacauccuuc

SEQ ID NO: 140444 - RNA, 64 nt, Homo Sapiens
uauauauauccacccccagcaauacauuaagagaaagagaaauaaauguccuuugauuuuuuuu

SEQ ID NO: 140445 - RNA, 64 nt, Homo Sapiens
gaaauauauauauauccaccuuuuuuaauacauuaagagaaagaacgugcaauguccuuugauu

SEQ ID NO: 140446 - RNA, 64 nt, Homo Sapiens
accugacuugcuaugaaaaaacucaucacacaagaagagaaacaguaaccucacuuugaaaauu

SEQ ID NO: 140447 - RNA, 64 nt, Homo Sapiens
aauguaaggaaagcuuaaauucuuguaucuuuaaaagagaaaaucuuauuuaacccuuuugugu

SEQ ID NO: 140448 - RNA, 64 nt, Homo Sapiens
ucuguuucacuguuugcuuucuccugucaugguuaagagaaaugugcaauucgauccucaauca

SEQ ID NO: 140449 - RNA, 64 nt, Homo Sapiens
cugaugaguacagaaaaaaaaagaaaaagaaaagaagagaaaaaauuaagaaaaaaaucaaaaa

SEQ ID NO: 140450 - RNA, 64 nt, Homo Sapiens
acugaaaaggggugggaguuggaaaucagaaagaaagagaaauauuucauuauguuaaugaaga

SEQ ID NO: 140451 - RNA, 64 nt, Homo Sapiens
agaaagagaaauauuucauuauguuaaugaagaaaagagaaaauugaagcauaaauguauuuuu

SEQ ID NO: 140452 - RNA, 64 nt, Homo Sapiens
ccaacaaaaaucagcagauggcaaaauaacaaaaaagagaaacgaauuauuuaaaguguggaaa

SEQ ID NO: 140453 - RNA, 64 nt, Homo Sapiens
acauggcguauuuuguauuuaacaaauggaagagaagagaaaggcucaccucccaaucacccca

SEQ ID NO: 140454 - RNA, 64 nt, Homo Sapiens
guaaagcuacagagguuaauuguggcaugcaaugaagagaaaaucauuuuaucagggcccaaca

SEQ ID NO: 140455 - RNA, 64 nt, Homo Sapiens
cucucaauaccaaccagggaaagcugcaggugucaagagaaauggagaggacaaagcaaguugg

SEQ ID NO: 140456 - RNA, 64 nt, Homo Sapiens
uuucuucccuucuacuaaaacaggagggaagagaaagagaaaacccuucggcagcauuccagaa

SEQ ID NO: 140457 - RNA, 64 nt, Homo Sapiens
gaaaacuuucuucccuucuaccagaacaggagggaagagaaagaacaugcccuucggcagcauu

SEQ ID NO: 140458 - RNA, 64 nt, Homo Sapiens
ggcagcagaggaacccaaagucugaauauuuagcaagagaaacauagucauaguaaagucucag

SEQ ID NO: 140459 - RNA, 64 nt, Homo Sapiens
caagcucaccucuuggagcuggcccaaaacagaaaagagaaacaacacaaagaugaccacaagg

SEQ ID NO: 140460 - RNA, 64 nt, Homo Sapiens
aggacaaaaaaucuaauugcaaaaauaaauggcaaagagaaaucgcaacauuaauugaagcauc

SEQ ID NO: 140461 - RNA, 64 nt, Homo Sapiens
uguguggguacuugcuaauaguuuguguguuuguaagagaaaaauacaacaugacaagcuguga

SEQ ID NO: 140462 - RNA, 64 nt, Homo Sapiens
aucaguuaagaaaucuacuugauuauguccacuuaagagaaauccuucagaaugcauccuuuga

SEQ ID NO: 140463 - RNA, 64 nt, Homo Sapiens
ucauaccuacuugaacaucagaggguccaucaugaagagaaagccuaugaguaugaugaauaug

SEQ ID NO: 140464 - RNA, 64 nt, Homo Sapiens
ucaugccuuauucagcaucacaaaaugcauaggaaagagaaaucguaugaauguaaugaguaug

SEQ ID NO: 140465 - RNA, 64 nt, Homo Sapiens
ggugaggauggaaggauggaaagagaaaguuaucaagagaaagaccgcuauauugugauuuggg

SEQ ID NO: 140466 - RNA, 64 nt, Homo Sapiens
uaucaagagaaagaggugaguauugugauuugggaagagaaagugaaaaugaaaaaguccgcua

SEQ ID NO: 140467 - RNA, 64 nt, Homo Sapiens
gaugugcauauacacacaauuuguggcaugucauaagagaaacagauagauguaguuccuuccc

SEQ ID NO: 140468 - RNA, 64 nt, Homo Sapiens
aguuguucuguucacugcuuaagauauugugcugaagagaaaacuaaugauuggaaugggcuau

SEQ ID NO: 140469 - RNA, 64 nt, Homo Sapiens
agugaaaguuuagcccacuguucuucuguagaggaagagaaaggucagggugauaaacagaaua

SEQ ID NO: 140470 - RNA, 64 nt, Homo Sapiens
aaagucucccucagaaaguaggcaguagaugaugaagagaaaaaaagaaugagaagcuugaaug

SEQ ID NO: 140471 - RNA, 64 nt, Homo Sapiens
aagagacagaaaucaggacuuuaaaaaaagagaaaagagaaagcugcauuuuuuuguuugcaua

SEQ ID NO: 140472 - RNA, 64 nt, Homo Sapiens
agaaagcaagagacagaaauuugcauauuaaaaaaagagaaaagucauuuuugcauuuuuuugu

SEQ ID NO: 140473 - RNA, 64 nt, Homo Sapiens
uccgugagagucaucucaaacacugcuuaaggaaaagagaaacacuaauggccaaguguacauu

SEQ ID NO: 140474 - RNA, 64 nt, Homo Sapiens
aguaauaacuguuagaauuagguaauggauaugaaagagaaaaugcuuucucaugcauagacaa

SEQ ID NO: 140475 - RNA, 64 nt, Homo Sapiens
gagccugcaguuauguacauuuuguccuuuccguaagagaaaaaugaggacuuuggaaauucag

SEQ ID NO: 140476 - RNA, 64 nt, Homo Sapiens
ccaguuguagucaaaaugcuacaauaaaacaaaaaagagaaagaaaaugaagagcauuugacuc

SEQ ID NO: 140477 - RNA, 64 nt, Homo Sapiens
cuacaccucagcagccucccccaugcaaaaaggaaagagaaaaauuaaguuagggcagucagua

SEQ ID NO: 140478 - RNA, 64 nt, Homo Sapiens
uuuaauaaaaaucuuugagcaagugaguuauggcaagagaaacucagccucuuucuguauaaac

SEQ ID NO: 140479 - RNA, 64 nt, Homo Sapiens
uccccccaucagacucuggacacccaggaaucaaaagagaaaggacuuuuuuggugacucaauc

SEQ ID NO: 140480 - RNA, 64 nt, Homo Sapiens
caaucuauucuacaugaggaggcugagaaaggggaagagaaaaacaaaccaaauggaugauguu

SEQ ID NO: 140481 - RNA, 64 nt, Homo Sapiens
augaaaccuacaguugacaagagaauguacagcuaagagaaaagcuuaagaggccacacuauuc

SEQ ID NO: 140482 - RNA, 64 nt, Homo Sapiens
uuuuccauagcuccucacuuuuuagcccuucugcaagagaaaaacccucauggguccacauggu

SEQ ID NO: 140483 - RNA, 64 nt, Homo Sapiens
cugugugaaagaaagaaaaagaaagaaagaaagaaagagaaaggaaauuauaaggucaaguuaa

SEQ ID NO: 140484 - RNA, 64 nt, Homo Sapiens
cagagguauaacugaauaagaaauuuuuuuaagcaagagaaagacaacuguucugcggguugga

SEQ ID NO: 140485 - RNA, 64 nt, Homo Sapiens
cacugcgcccggcccgagaaaauacaguuuuaaaaagagaaagcuuuauaaccucaccaaugaa

SEQ ID NO: 140486 - RNA, 64 nt, Homo Sapiens
gggaggcaaaaagcacuucuuacauggcggcagcaagagaaaaugagaaagaagcaaaagugga

SEQ ID NO: 140487 - RNA, 64 nt, Homo Sapiens
gggaggugaaaagcacuucguacauggugguggcaagagaaaaugaagaagaagcaaaagugga

SEQ ID NO: 140488 - RNA, 64 nt, Homo Sapiens
uuuuuuuuuuuuuuaauggcuuuaaagagaaaagaagagaaagaaaaccccucugucaugccuc

SEQ ID NO: 140489 - RNA, 64 nt, Homo Sapiens
aagagaaagauuuuuuuuuugucaugccucuuuaaagagaaaaggcuguuggucaaaccccucu

SEQ ID NO: 140490 - RNA, 64 nt, Homo Sapiens
aagauaaaauuugauacagguuuggugucauuauaagagaaaucauuauuaaaugaagcaaguu

SEQ ID NO: 140491 - RNA, 64 nt, Homo Sapiens
gagcagguagcccaaaauagagaaagauuagauaaagagaaaauaaguauccaucagagacagu

SEQ ID NO: 140492 - RNA, 64 nt, Homo Sapiens
guauccaucagagacaguaucucuaggcuugggcaagagaaaaguccacagugauaagcaacuc

SEQ ID NO: 140493 - RNA, 64 nt, Homo Sapiens
uguagccucagguuugaaucagucaccuagggguaagagaaaaaccacaacauaagaccugaaa

SEQ ID NO: 140494 - RNA, 64 nt, Homo Sapiens
gaaauuuuaggacuugaggacgugaacaacuugaaagagaaaauugauuccccuugaggaaaga

SEQ ID NO: 140495 - RNA, 64 nt, Homo Sapiens
acuagagccugugcuaaagagaaacccaaggaacaagagaaaaaagaguccuuugggauucuag

SEQ ID NO: 140496 - RNA, 64 nt, Homo Sapiens
aaaccaagauagauccauuuccuaauauuuaggcaagagaaaauuuugaaacccauuaggcaug

SEQ ID NO: 140497 - RNA, 64 nt, Homo Sapiens
gaauuuuuguuuaaaugagaauuauuaauaaauaaagagaaaaguugauauuauuguuauuauc

SEQ ID NO: 140498 - RNA, 64 nt, Homo Sapiens
cccaagccuggaacgcagagaaaaagaacaaaaaaagagaaaccgcuucuggcacuuagaaaac

SEQ ID NO: 140499 - RNA, 64 nt, Homo Sapiens
cuaaagggaaccugcaauaaucuugaaaaagaaaaagagaaaaauuuuaaaauccugcuauagg

SEQ ID NO: 140500 - RNA, 64 nt, Homo Sapiens
agaaaaauuuuaaaauccugcuauaggagaaaaaaagagaaaaaaauaaaaaucaaaaaaaaaa

SEQ ID NO: 140501 - RNA, 64 nt, Homo Sapiens
ucagaauaucaaagcgaaaacugauagaacuacaaagagaaauaaaauccauucucacggcagg

SEQ ID NO: 140502 - RNA, 64 nt, Homo Sapiens
uugauaaaacauaaagguacaguggucuaugaggaagagaaaagguaccugaggaugcagaagu

SEQ ID NO: 140503 - RNA, 64 nt, Homo Sapiens
ucuucuucuucuuuuuuuuuuuuuauaaaagcaaaagagaaauacauaaaaaaguguuuacccu

SEQ ID NO: 140504 - RNA, 64 nt, Homo Sapiens
gcaauacauuuuuuucucuuuccuugaaaauaaaaagagaaacaaguauuuugcuauauauaaa

SEQ ID NO: 140505 - RNA, 64 nt, Homo Sapiens
cgggaaaagcuggcccaggcgucuaaggagucaaaagagaaacagcuucaagcagaacguaaaa

SEQ ID NO: 140506 - RNA, 64 nt, Homo Sapiens
ccuucgagcaaaagcaaagauccaccgagagaagaagagaaagaaaagaaaaagaaaaagcaca

SEQ ID NO: 140507 - RNA, 64 nt, Homo Sapiens
cagucaggagcacagcaucccuuugaccagcuguaagagaaauguacuucaccaucauuucuga

SEQ ID NO: 140508 - RNA, 64 nt, Homo Sapiens
augcuacaucucagaaacuuugaguguaggaaggaagagaaaugaaagaaagagccugacagaa

SEQ ID NO: 140509 - RNA, 64 nt, Homo Sapiens
agcugcacuccaugagugcaugagcuugaccuuuaagagaaauggagcagacaguuaagagaaa

SEQ ID NO: 140510 - RNA, 64 nt, Homo Sapiens
agcuugaccuuuaagagaaacagagcagacaguuaagagaaaugaaaacugauuacaacugcua

SEQ ID NO: 140511 - RNA, 64 nt, Homo Sapiens
acuugcauaaccaaaauaaaacacuuguuucaugaagagaaagguauuuuagccuuagagccuu

SEQ ID NO: 140512 - RNA, 64 nt, Homo Sapiens
auggagaaugauuauuuaaaaagaaagcucuagaaagagaaauuuuacgugauagcauacaaag

SEQ ID NO: 140513 - RNA, 64 nt, Homo Sapiens
aagggauugauaaaaugcuggaaucuucuagaagaagagaaacaggagcaacauaaugcucaua

SEQ ID NO: 140514 - RNA, 64 nt, Homo Sapiens
ucagccuuucuaaguugauaaacauuuaaaaaggaagagaaacuuggauaauagacaaagugaa

SEQ ID NO: 140515 - RNA, 64 nt, Homo Sapiens
aaacuugccauauuuuacaacauuuggcaaaaacaagagaaaagaaaauucaaauaauuauaag

SEQ ID NO: 140516 - RNA, 64 nt, Homo Sapiens
agauaaaguagaaaaagaaauacacagucaaagaaagagaaaaaacucagcaguuugugccucc

SEQ ID NO: 140517 - RNA, 64 nt, Homo Sapiens
cucauucagaaaucauggauuaaaguuauaaauaaagagaaaaauuuuccuacucuaauucaac

SEQ ID NO: 140518 - RNA, 64 nt, Homo Sapiens
acgugucucagacugcaugugcagcugauguuggaagagaaagcuugggucucauuuagaacuu

SEQ ID NO: 140519 - RNA, 64 nt, Homo Sapiens
aaucauaaauguagacauauagagacuuuaaaauaagagaaagauuuuaaaaaacuaaaccaga

SEQ ID NO: 140520 - RNA, 64 nt, Homo Sapiens
aaaaccccuacacugauaucaguuuuauuucaugaagagaaaugcuggacccauguuuaaauac

SEQ ID NO: 140521 - RNA, 64 nt, Homo Sapiens
guuaugagaauaucaguugguauaaagagagagaaagagaaaaacauuucagcccuuagaugag

SEQ ID NO: 140522 - RNA, 64 nt, Homo Sapiens
aaccccugagaaaugaacauugguaggagcauuuaagagaaaacuugcuuauuugcuaaugccu

SEQ ID NO: 140523 - RNA, 64 nt, Homo Sapiens
uguuacuuucaaugugaggaaugaaugauaaauuaagagaaaaaaauaucaggaaggucaauau

SEQ ID NO: 140524 - RNA, 64 nt, Homo Sapiens
uauugacuaauaagggaauauguauggaagaaggaagagaaagccuuugucuagcauuuauuag

SEQ ID NO: 140525 - RNA, 64 nt, Homo Sapiens
ggaagagagaggaaaugagggugaaaguauguacaagagaaaacuagcuugggaugagaugugu

SEQ ID NO: 140526 - RNA, 64 nt, Homo Sapiens
gaauguuugaaaggcuauccgaucaaaccucacaaagagaaauacauccuuuacauucaguuaa

SEQ ID NO: 140527 - RNA, 64 nt, Homo Sapiens
agugcugcaagaauguauuuuguuuugcagcaguaagagaaacuaaaugagguuuuguuucacc

SEQ ID NO: 140528 - RNA, 64 nt, Homo Sapiens
ucacccaggaaguuuaaaaacaauuuccagagagaagagaaaacagggaaaagauucuuuauuc

SEQ ID NO: 140529 - RNA, 64 nt, Homo Sapiens
cugaugcuggcaaggagcgguacccaaagggaaaaagagaaaagugcaaagaagggagagaagg

SEQ ID NO: 140530 - RNA, 64 nt, Homo Sapiens
cugaaggggaugcuaaaggaccgccgccaugcccaagagaaagacccacaucccgccgccgccg

SEQ ID NO: 140531 - RNA, 64 nt, Homo Sapiens
aacaagauuuccauucccacuugucauacuaucaaagagaaagaaugacaauauccuuacacau

SEQ ID NO: 140532 - RNA, 64 nt, Homo Sapiens
cuuugacuuccacgugcccagggaaaaaaaaaaaaagagaaaccuuauguauagcuucuaaaag

SEQ ID NO: 140533 - RNA, 64 nt, Homo Sapiens
gcaguaacaguuuacagaagaagugccaaaucacaagagaaaaauuuuuuccggcuuaagccuu

SEQ ID NO: 140534 - RNA, 64 nt, Homo Sapiens
agaguuuauucugguuaacuauuuggguacucaaaagagaaaucauguuaaaagccuuaaucuc

SEQ ID NO: 140535 - RNA, 64 nt, Homo Sapiens
agcaacagauuuucagcguuagauacagguuuagaagagaaaagagacucaguuuuauugaggu

SEQ ID NO: 140536 - RNA, 64 nt, Homo Sapiens
gacagucacucuuuuuuuucccucggauacauuuaagagaaagauacgauuacuugcuauuggc

SEQ ID NO: 140537 - RNA, 64 nt, Homo Sapiens
ucuaaaagaauaugaucuucggggcggggguacaaagagaaaucuucuuuaauggcgggggcgg

SEQ ID NO: 140538 - RNA, 64 nt, Homo Sapiens
aaucacaaaaacaaacuuuuagaaaaaaaagaaaaagagaaaaacaaugcauggauuccuuuga

SEQ ID NO: 140539 - RNA, 62 nt, Homo Sapiens
uuguauuaguuguauguuucgaaaagugaagaguaagagaaaugacuuuugaauaauaaaaa

SEQ ID NO: 140540 - RNA, 64 nt, Homo Sapiens
caagauaaucccaaacuugaagauuugaacaacaaagagaaaggcauuuaaaggauuaaaacug

SEQ ID NO: 140541 - RNA, 64 nt, Homo Sapiens
cauaggccucuguucucauuaggcuccuuuuuuaaagagaaaagucggcugugcaucgcauucg

SEQ ID NO: 140542 - RNA, 64 nt, Homo Sapiens
ccuucugugcccaggcuaaaaggaaagaacaggaaagagaaaagguccugaaguuugcugguuc

SEQ ID NO: 140543 - RNA, 64 nt, Homo Sapiens
gugcugaugaaguccucuauaagcacaagccaaaaagagaaagagaaaaaaagguaauuauugu

SEQ ID NO: 140544 - RNA, 64 nt, Homo Sapiens
uaauucuuaaaucccagcacaagccaaaaagagaaagagaaaaaaagguaauuauuguagaacc

SEQ ID NO: 140545 - RNA, 64 nt, Homo Sapiens
auuuuccucauaucuuauuuaccuaggagcauguaagagaaagaagggagagaaaagguugcau

SEQ ID NO: 140546 - RNA, 64 nt, Homo Sapiens
aaacauaaugaaagaaacaaacuccaguauggagaagagaaaguuuaauuauuugguuccaucu

SEQ ID NO: 140547 - RNA, 64 nt, Homo Sapiens
uuuaugcuuuguauaauguuaauuagacaacuguaagagaaaaaacugauucacaauugaguua

SEQ ID NO: 140548 - RNA, 64 nt, Homo Sapiens
aggauuugcuaugcagacagaaaguagcuuuuggaagagaaauguugaacugaacuuaguuuuu

SEQ ID NO: 140549 - RNA, 64 nt, Homo Sapiens
gcggcagcagcagccgcagcagccaaagagaggcaagagaaagagaaagcgggcgguggagggg

SEQ ID NO: 140550 - RNA, 64 nt, Homo Sapiens
gcagcagccgcagcagccaaagagaggcaagagaaagagaaagcgggcgguggaggggucccgg

SEQ ID NO: 140551 - RNA, 64 nt, Homo Sapiens
accuugucaauagguucuugaaaacuuguacuucaagagaaaugauguauaacaaaaccauacu

SEQ ID NO: 140552 - RNA, 64 nt, Homo Sapiens
cuccauaccauuuggcucccaaauuuaaauaaacaagagaaaacgguguucaucuauuaaggac

SEQ ID NO: 140553 - RNA, 64 nt, Homo Sapiens
gaagacuugaaagaaaggggcaggagcucagaugaagagaaauccuaaguuaccuuucuagguc

SEQ ID NO: 140554 - RNA, 64 nt, Homo Sapiens
auugaaaaaagaaauucccuggaccagaugcugaaagagaaaagagggguugguaguuggcuau

SEQ ID NO: 140555 - RNA, 64 nt, Homo Sapiens
uaggcuugaaauaauugacuugucuaaaaggacaaagagaaaaaaaaaauaccucaugacugca

SEQ ID NO: 140556 - RNA, 64 nt, Homo Sapiens
agggaaguggagagcacaucccuguaaggcccauaagagaaagaggaguuuguuacauuuaauc

SEQ ID NO: 140557 - RNA, 64 nt, Homo Sapiens
ggaaaugagaacauuccaagucaaugucaccugaaagagaaaugaggaaaacuuugaggaacau

SEQ ID NO: 140558 - RNA, 64 nt, Homo Sapiens
agaaacaguuaaagugucuaaagagaagaaaaagaagagaaacuuuugucaauccuagccuucc

SEQ ID NO: 140559 - RNA, 64 nt, Homo Sapiens
gacaccggacaaaccauugucuuggggagcccagaagagaaagugggcaggguggggucauugg

SEQ ID NO: 140560 - RNA, 64 nt, Homo Sapiens
uggcugcuguguugggcauggauggagaaucagcaagagaaaugcuguauuaggacuaauaauc

SEQ ID NO: 140561 - RNA, 64 nt, Homo Sapiens
auacccugggguaaguggaguugggaaauacaagaagagaaagaccaguggggauuuguaagac

SEQ ID NO: 140562 - RNA, 64 nt, Homo Sapiens
auccuugcuaaguuuucauagaaaauaaggaacaaagagaaacuuguaauggucucugaaaagg

SEQ ID NO: 140563 - RNA, 64 nt, Homo Sapiens
gaggaaacaucuuaccaucuggucauucauacugaagagaaacuccauaaguaucaucucugug

SEQ ID NO: 140564 - RNA, 64 nt, Homo Sapiens
gggacauucaaacaaaggaggaggagucauagggaagagaaagaaauggaagcacagcuucuuu

SEQ ID NO: 140565 - RNA, 64 nt, Homo Sapiens
aagggaacaucuuaccaucuggccauucacacugaagagaaacuucauaagcauccucucuuug

SEQ ID NO: 140566 - RNA, 64 nt, Homo Sapiens
gggauauuuaaacaaaggaagaggaaauauagggaagagaaagaaaccacagcuucuuuuagac

SEQ ID NO: 140567 - RNA, 64 nt, Homo Sapiens
cuucagugaugccucugugugaaauauaaagaagaagagaaagcuucacacuacagagaaacuu

SEQ ID NO: 140568 - RNA, 64 nt, Homo Sapiens
uuuugaggacaaucuguaugauuaauucacucugaagagaaaccaauagcauucaguaacuccu

SEQ ID NO: 140569 - RNA, 64 nt, Homo Sapiens
uggcuuuguuccaccuggcuuuugcuugugaaagaagagaaaugauucagugauauuucuccca

SEQ ID NO: 140570 - RNA, 64 nt, Homo Sapiens
aaucauauuaaguacuuuggauucucuauguggaaagagaaaagcauuauuuauagauuaucug

SEQ ID NO: 140571 - RNA, 64 nt, Homo Sapiens
gagauccugaauguuaaguguauuuguuuuacaaaagagaaauugagccacugcaccuagccuc

SEQ ID NO: 140572 - RNA, 64 nt, Homo Sapiens
gcuguucuccuuucucuuucccccucucccaugcaagagaaagaucagauuucccauucagacg

SEQ ID NO: 140573 - RNA, 64 nt, Homo Sapiens
cuaaaaugaaugugaacaaccagaagugauuuggaagagaaaucagaagcaagaaggaaagcac

SEQ ID NO: 140574 - RNA, 64 nt, Homo Sapiens
uaagaaauugcugacggaauugcuuaagguugaaaagagaaauuuuuuauaauuucagaaaaac

SEQ ID NO: 140575 - RNA, 64 nt, Homo Sapiens
ccaauuuucuggggcuccucacauagcuacccaaaagagaaaaaaaauuaagacaagccuggca

SEQ ID NO: 140576 - RNA, 64 nt, Homo Sapiens
agaugugggcuuugauuuccaaguaauauaauggaagagaaaucucauacucccccacaguuug

SEQ ID NO: 140577 - RNA, 64 nt, Homo Sapiens
uuuauaaaauuagaaagcaacuuaucagcuacuuaagagaaauggcaaguuuugauaugaguau

SEQ ID NO: 140578 - RNA, 64 nt, Homo Sapiens
ucugggaucaguuauaauauauauuuuuuuuagaaagagaaaaugagcugagaguuuacaggca

SEQ ID NO: 140579 - RNA, 64 nt, Homo Sapiens
uacuuggggagagaucaguagcauuugaggaaguaagagaaaagaaucaugguaccucaggguu

SEQ ID NO: 140580 - RNA, 64 nt, Homo Sapiens
uuaucuuugcuuugugguucugaacucugaaaaaaagagaaacccacagaaagucuuaggauca

SEQ ID NO: 140581 - RNA, 64 nt, Homo Sapiens
aacaagccccacucagcucaauccuuguuuacagaagagaaacaccuaaaagggaaaaaacaau

SEQ ID NO: 140582 - RNA, 64 nt, Homo Sapiens
uucaggaccucaucauuaugauugucugauauuuaagagaaacaaaaugaaaauuuuaacugga

SEQ ID NO: 140583 - RNA, 64 nt, Homo Sapiens
acacgagagagacuguggccaacauaucaaaaacaagagaaaaguaccuguauuuaaaaauaga

SEQ ID NO: 140584 - RNA, 64 nt, Homo Sapiens
aauauucuuuguuuagagguacuuguuuuuuauuaagagaaaaaccaguguaacguuuauguga

SEQ ID NO: 140585 - RNA, 64 nt, Homo Sapiens
gcaagggcuccuccaggauugcaaaaaaaaaaggaagagaaaagaugaaccuuuaagcaaauaa

SEQ ID NO: 140586 - RNA, 64 nt, Homo Sapiens
aaaaggaacuuuuaaaaaaaaugauauauucacaaagagaaaaccagauuauguauaaucauau

SEQ ID NO: 140587 - RNA, 64 nt, Homo Sapiens
caguucaccuacagagguagcucaaaagugacacaagagaaaucaguguucuucuuucacacuu

SEQ ID NO: 140588 - RNA, 64 nt, Homo Sapiens
cugguauuugcaaugaucuguuuacaaaaagagaaagagaaaauagcuuauauaugacgguaua

SEQ ID NO: 140589 - RNA, 64 nt, Homo Sapiens
gaaaaucugguauuugcaaugguauauuuacaaaaagagaaagaaauuuuagcuuauauaugac

SEQ ID NO: 140590 - RNA, 64 nt, Homo Sapiens
uuagcuuauauaugacgguaaaccccaccacccuaagagaaauuugucccuuucccugccagca

SEQ ID NO: 140591 - RNA, 64 nt, Homo Sapiens
gaaaccuacucaagaaaagagaacacaagaacuuaagagaaaaaucugaacaacacuaacauga

SEQ ID NO: 140592 - RNA, 64 nt, Homo Sapiens
gaaaccuguuacagaaaagacucaaggagaacauaagagaaaagcugagaaaagaacauaagaa

SEQ ID NO: 140593 - RNA, 64 nt, Homo Sapiens
gaaaucuguugaagaaaggaacguaagcacaggaaagagaaaaaguacccuccgagaaagaaga

SEQ ID NO: 140594 - RNA, 64 nt, Homo Sapiens
gacaccuagaagaaggcaaaaacagaaacaucagaagagaaaacugaccaucaagcaggucaua

SEQ ID NO: 140595 - RNA, 64 nt, Homo Sapiens
uggccagauggggaaggucaccuccccaaaagacaagagaaauucucagugccacucaccccuc

SEQ ID NO: 140596 - RNA, 64 nt, Homo Sapiens
gaaugcaggccaguuacuuauccauucaguaagaaagagaaagggagauggccucagagucuuu

SEQ ID NO: 140597 - RNA, 64 nt, Homo Sapiens; identical to SEQ ID NO: 124497

SEQ ID NO: 140598 - RNA, 64 nt, Homo Sapiens; identical to SEQ ID NO: 124498

SEQ ID NO: 140599 - RNA, 64 nt, Homo Sapiens; identical to SEQ ID NO: 124499

SEQ ID NO: 140600 - RNA, 64 nt, Homo Sapiens; identical to SEQ ID NO: 124500

SEQ ID NO: 140601 - RNA, 64 nt, Homo Sapiens; identical to SEQ ID NO: 124501

SEQ ID NO: 140602 - RNA, 64 nt, Homo Sapiens; identical to SEQ ID NO: 124502

SEQ ID NO: 140603 - RNA, 64 nt, Homo Sapiens; identical to SEQ ID NO: 124503

SEQ ID NO: 140604 - RNA, 64 nt, Homo Sapiens; identical to SEQ ID NO: 124504

SEQ ID NO: 140605 - RNA, 64 nt, Homo Sapiens; identical to SEQ ID NO: 124505

SEQ ID NO: 140606 - RNA, 64 nt, Homo Sapiens; identical to SEQ ID NO: 124506

SEQ ID NO: 140607 - RNA, 64 nt, Homo Sapiens; identical to SEQ ID NO: 124507

SEQ ID NO: 140608 - RNA, 64 nt, Homo Sapiens; identical to SEQ ID NO: 124508

SEQ ID NO: 140609 - RNA, 64 nt, Homo Sapiens; identical to SEQ ID NO: 124509

SEQ ID NO: 140610 - RNA, 64 nt, Homo Sapiens; identical to SEQ ID NO: 124510

SEQ ID NO: 140611 - RNA, 64 nt, Homo Sapiens; identical to SEQ ID NO: 124511

SEQ ID NO: 140612 - RNA, 64 nt, Homo Sapiens; identical to SEQ ID NO: 124512

SEQ ID NO: 140613 - RNA, 64 nt, Homo Sapiens; identical to SEQ ID NO: 124513

SEQ ID NO: 140614 - RNA, 64 nt, Homo Sapiens; identical to SEQ ID NO: 124514

SEQ ID NO: 140615 - RNA, 64 nt, Homo Sapiens; identical to SEQ ID NO: 124515

SEQ ID NO: 140616 - RNA, 64 nt, Homo Sapiens; identical to SEQ ID NO: 124516

SEQ ID NO: 140617 - RNA, 64 nt, Homo Sapiens
uacauauaccauguaaacucucaaacucuauuuagcugugaaauaguggugugcaauuccuugu

SEQ ID NO: 140618 - RNA, 64 nt, Homo Sapiens
aauaacaauugacauuccuugagcaaaauauacugcugugaauuugcaaacaagaaaucugagc

SEQ ID NO: 140619 - RNA, 64 nt, Homo Sapiens
cagcaaguagcuacugguucacgugcaguuuggggcugugaaaccuaggcagaaggcggcuguc

SEQ ID NO: 140620 - RNA, 64 nt, Homo Sapiens
uuagugccaccaccuucugaacacaguggggagggcugugaaggcucaugugaccuggaucuga

SEQ ID NO: 140621 - RNA, 64 nt, Homo Sapiens
gaaauaaauuauuuauacaaaaugcauauaugaugcugugaacauuguuuccauagccuuuuau

SEQ ID NO: 140622 - RNA, 64 nt, Homo Sapiens
ugaguaauuuucggucacagccuugcauucaggggcugugaagcguucuggggggaccaccucu

SEQ ID NO: 140623 - RNA, 64 nt, Homo Sapiens
ucguucucugucuuuaaaaaauuguagagaaguggcugugaaagcuguagaagacaauuaauuu

SEQ ID NO: 140624 - RNA, 64 nt, Homo Sapiens
gaucacauuuguuguggugcgggucuuuagaccugcugugaaaguuaugcuuuguugccucuga

SEQ ID NO: 140625 - RNA, 64 nt, Homo Sapiens
ugaucacaguggcgagaggagaggaaaaacgaucgcugugaaaaugaggaggauugcuucuugu

SEQ ID NO: 140626 - RNA, 64 nt, Homo Sapiens
gagcuuguauauacuucacucacuuuucuuuauugcugugaauagucugugugcacaaugggca

SEQ ID NO: 140627 - RNA, 64 nt, Homo Sapiens
gugaaugugccaacacuaagcugucucgagccaagcugugaaaacccuagacgcacccgcaggg

SEQ ID NO: 140628 - RNA, 64 nt, Homo Sapiens
ugacuucccaaccuacagcauugacgccaacuuggcugugaaggaagaggaaaggaucuggccu

SEQ ID NO: 140629 - RNA, 64 nt, Homo Sapiens
uguuuaggauuuucuuuaagaguuccuggguuuagcugugaaacauguuauagguuaaggagac

SEQ ID NO: 140630 - RNA, 64 nt, Homo Sapiens
uuuaaggaauaaauaauauagaaucuuguuuaaggcugugaaguucuguacaacuucacagaug

SEQ ID NO: 140631 - RNA, 64 nt, Homo Sapiens
cgccccaccuugcagcuaaaugugauccugccuugcugugaaauuucuguaccuucaaccuggu

SEQ ID NO: 140632 - RNA, 64 nt, Homo Sapiens
gcacuccccacccugcucccuucccagagggauugcugugaaauuuuuuugguggcaaauaaag

SEQ ID NO: 140633 - RNA, 64 nt, Homo Sapiens
ugaaacuucucuauuggagugucuguuucuuuaagcugugaauacugaaauuaugccuugucuc

SEQ ID NO: 140634 - RNA, 64 nt, Homo Sapiens
auggucugagacuaaguaaaggaaauuuccuaaagcugugaaauuugaauuuugcuuuaaauaa

SEQ ID NO: 140635 - RNA, 64 nt, Homo Sapiens
cuucacucuuauuguccuucagcagugucugucagcugugaagggaugacauagccaauggaca

SEQ ID NO: 140636 - RNA, 64 nt, Homo Sapiens
ggagaacaguuucaucaggauauuuaggaugacugcugugaaauucacagaccucugcuuggag

SEQ ID NO: 140637 - RNA, 64 nt, Homo Sapiens
aagagggauaaaccuuuggaggggucaugaugcugcugugaagauaaaaguagaauauaaaagc

SEQ ID NO: 140638 - RNA, 64 nt, Homo Sapiens
gauuucguaguauauucagagcuuucuuuuaagagcugugaaugaaacuuuuucuaagcacuau

SEQ ID NO: 140639 - RNA, 64 nt, Homo Sapiens
cuggccgccacgcagaauaccucgaaccaggcgggcugugaaccagccccgcucaccugccagc

SEQ ID NO: 140640 - RNA, 64 nt, Homo Sapiens
auucccacuccccuuuggccucccuguacucugagcugugaauauuuuuaacccuguaaauacg

SEQ ID NO: 140641 - RNA, 64 nt, Homo Sapiens
gcacaugcacuacugaaauuuacacaaaaagaaagcugugaaauugaagucccaauuuaagagu

SEQ ID NO: 140642 - RNA, 64 nt, Homo Sapiens
uugugucuuaagaaaaauaaucuuagaacagauggcugugaaaauuacacccaugcacagaaca

SEQ ID NO: 140643 - RNA, 64 nt, Homo Sapiens
gugauugaaggagaggauugaggguggaaggugggcugugaagacuuuuugggggcauccugga

SEQ ID NO: 140644 - RNA, 64 nt, Homo Sapiens
cugcuguguugugugugcuagagagacuuacagggcugugaaagagugaccuuugucagugucc

SEQ ID NO: 140645 - RNA, 64 nt, Homo Sapiens
cuccugcagacaggagggccugagucccacaccagcugugaauugcugugaauggccuaggggc

SEQ ID NO: 140646 - RNA, 64 nt, Homo Sapiens
gccuaggggcugagucccaccagagccagacaaagcugugaaugccccgugcugaaugaaugua

SEQ ID NO: 140647 - RNA, 64 nt, Homo Sapiens; identical to SEQ ID NO: 91418

SEQ ID NO: 140648 - RNA, 64 nt, Homo Sapiens; identical to SEQ ID NO: 91419

SEQ ID NO: 140649 - RNA, 56 nt, Homo Sapiens; identical to SEQ ID NO: 91420

SEQ ID NO: 140650 - RNA, 64 nt, Homo Sapiens; identical to SEQ ID NO: 91421

SEQ ID NO: 140651 - RNA, 64 nt, Homo Sapiens; identical to SEQ ID NO: 91422

SEQ ID NO: 140652 - RNA, 64 nt, Homo Sapiens; identical to SEQ ID NO: 91423

SEQ ID NO: 140653 - RNA, 64 nt, Homo Sapiens; identical to SEQ ID NO: 91424

SEQ ID NO: 140654 - RNA, 64 nt, Homo Sapiens; identical to SEQ ID NO: 91425

SEQ ID NO: 140655 - RNA, 64 nt, Homo Sapiens; identical to SEQ ID NO: 91426

SEQ ID NO: 140656 - RNA, 64 nt, Homo Sapiens; identical to SEQ ID NO: 91427

SEQ ID NO: 140657 - RNA, 64 nt, Homo Sapiens; identical to SEQ ID NO: 91428

SEQ ID NO: 140658 - RNA, 64 nt, Homo Sapiens; identical to SEQ ID NO: 91429

SEQ ID NO: 140659 - RNA, 64 nt, Homo Sapiens; identical to SEQ ID NO: 91430

SEQ ID NO: 140660 - RNA, 64 nt, Homo Sapiens; identical to SEQ ID NO: 91431

SEQ ID NO: 140661 - RNA, 64 nt, Homo Sapiens; identical to SEQ ID NO: 91432

SEQ ID NO: 140662 - RNA, 64 nt, Homo Sapiens; identical to SEQ ID NO: 91433

SEQ ID NO: 140663 - RNA, 64 nt, Homo Sapiens; identical to SEQ ID NO: 91434

SEQ ID NO: 140664 - RNA, 64 nt, Homo Sapiens; identical to SEQ ID NO: 91435

SEQ ID NO: 140665 - RNA, 64 nt, Homo Sapiens; identical to SEQ ID NO: 91436

SEQ ID NO: 140666 - RNA, 64 nt, Homo Sapiens
cucagguguucucaccugguaaaauuguagaccucgaggcuaaguuucaaggagaucauauuca

SEQ ID NO: 140667 - RNA, 64 nt, Homo Sapiens
cccaagaagaagcagaagagaugagaugcaccaucgaggcuaccgaauuuaauacuuugaaguc

SEQ ID NO: 140668 - RNA, 64 nt, Homo Sapiens
ggaguuguggguugguaagcucccagguacuucccgaggcuauggugugagagcccccguccug

SEQ ID NO: 140669 - RNA, 64 nt, Homo Sapiens
auaaauucaagaagauacacuuggcaucguguaucgaggcuaaguuuuucaugcauuucccaga

SEQ ID NO: 140670 - RNA, 64 nt, Homo Sapiens
gugagcuaugauuacaccacugagcuugggagaucgaggcuacaggugaggcagaagcauugcu

SEQ ID NO: 140671 - RNA, 64 nt, Homo Sapiens
gcuaaggcaggaggaucacuugagccccggaggucgaggcuacagugagccaagagugcacuac

SEQ ID NO: 140672 - RNA, 64 nt, Homo Sapiens
uggcuccggccgguuguccuggcacacaaggaggcgaggcuaugcguucgaggccaaccuaggc

SEQ ID NO: 140673 - RNA, 64 nt, Homo Sapiens
aucuggauuaccaaaaucacucugcagcccugcccgaggcuaguaggcugcaacccuggucccc

SEQ ID NO: 140674 - RNA, 64 nt, Homo Sapiens
agugggggugggggaaagaucugugcagagaauccgaggcuaugcaucagcuccuuuacuaaag

SEQ ID NO: 140675 - RNA, 64 nt, Homo Sapiens
accucuagcccugguggcagaggucccucagcugcgaggcuaauugggugaccaccgauuccag

SEQ ID NO: 140676 - RNA, 64 nt, Homo Sapiens
uccugggauuacaggcaugauuuggccauguugccgaggcuaacuuuuuuuguagagacggggg

SEQ ID NO: 140677 - RNA, 64 nt, Homo Sapiens
aaguuccaaaaacaucugccgaguuagagggaugcgaggcuaacggccccagcgaguuucccag

SEQ ID NO: 140678 - RNA, 64 nt, Homo Sapiens
ggcauuuggaacaacaaaucggugggauucaugucgaggcuagacaaaacaggaagggggaaaa

SEQ ID NO: 140679 - RNA, 64 nt, Homo Sapiens
cuuuccgacugcccagaaaguggggguggaggaccgaggcuacagcuccacacgccccgguccc

SEQ ID NO: 140680 - RNA, 64 nt, Homo Sapiens
aucugagcaagcaggagauaugugugaucugccucgaggcuaugaguccaugugcauccugagc

SEQ ID NO: 140681 - RNA, 64 nt, Homo Sapiens
aucauauguuggccaggucucacugcagccugcccgaggcuaacuggcuagagccuccaggccc

SEQ ID NO: 140682 - RNA, 64 nt, Homo Sapiens
agggcgguaauggugcccaccuuucgaggcauugcgaggcuagaugguaacacacagaaagcuc

SEQ ID NO: 140683 - RNA, 64 nt, Homo Sapiens
cugccaugccuucggcaucagaggauggaguggucgaggcuaguggagucccagggaccgcugg

SEQ ID NO: 140684 - RNA, 64 nt, Homo Sapiens
acguggccggcgcucuccaguggacgagucggaccgaggcuagguuccccacagggccauacgc

SEQ ID NO: 140685 - RNA, 64 nt, Homo Sapiens
uuggggagaaacugaagccguguuuuuggccccccgaggcuaacccugauccauagugcuaccu

SEQ ID NO: 140686 - RNA, 64 nt, Homo Sapiens
uuccucuggaaccacauuuuucaucccucccguccgaggcuaguggggcauggcacaaauaagc

SEQ ID NO: 140687 - RNA, 64 nt, Homo Sapiens
aauuggaccuuuuugguaucaggucggcagccagcgaggcuauggcccacuaugcagaggccaa

SEQ ID NO: 140688 - RNA, 64 nt, Homo Sapiens
gacucacgccuguaaucccagcacuuugggagggcgaggcuagcagaucacuugagguuaggag

SEQ ID NO: 140689 - RNA, 64 nt, Homo Sapiens
ccccgagucugcguccauuagagcacaguccacccgaggcuagcaccgugucugugucugucuc

SEQ ID NO: 140690 - RNA, 64 nt, Homo Sapiens
gaggggacaggagacggcccgggaggagggccggcgaggcuagcagaagaugcuugggcuugga

SEQ ID NO: 140691 - RNA, 64 nt, Homo Sapiens
cauguccucgagggccguguuggggagggggugccgaggcuacgcagccccuggggagggucuu

SEQ ID NO: 140692 - RNA, 64 nt, Homo Sapiens
gugagcuaugaucacaccauugagcccuggaggucgaggcuacagucccagcuacuugggaggc

SEQ ID NO: 140693 - RNA, 64 nt, Homo Sapiens
gcagacccccaugagagaaguccugccuccuucccgaggcuacaugucauuuuauuuggagguu

SEQ ID NO: 140694 - RNA, 64 nt, Homo Sapiens
ugcagauaugacaggugccuuugaagggaaaugucgaggcuaccgguggccaggaaguuucagg

SEQ ID NO: 140695 - RNA, 64 nt, Homo Sapiens
gugagcaaagaucacgccacugagccuaugaggucgaggcuacagcugaggugggaggaucacu

SEQ ID NO: 140696 - RNA, 64 nt, Homo Sapiens
guaccugcugucuuuccaggcccuggccagcaggcgaggcuacacagguccucugagccggcgc

SEQ ID NO: 140697 - RNA, 64 nt, Homo Sapiens
uccguucagcugaacaggaggauggauacagccgcgaggcuaaaaaacggauuuccucuuccua

SEQ ID NO: 140698 - RNA, 64 nt, Homo Sapiens
uaacacaucuaugaugcugcucuccccccucuuacgaggcuacaggaauauacccagugugugu

SEQ ID NO: 140699 - RNA, 64 nt, Homo Sapiens
gauguagguuucauuucucaagggacaaagaucucgaggcuaacggcaucugcagaauaucauc

SEQ ID NO: 140700 - RNA, 64 nt, Homo Sapiens
guucuaauacaccgcagcuccggcugacgcugcgcgaggcuaaguuuauggaacacuuaccaca

SEQ ID NO: 140701 - RNA, 64 nt, Homo Sapiens
acaauccggcugggagcaugccucaucacggcggcgaggcuacgugcuggggccuccacaccug

SEQ ID NO: 140702 - RNA, 64 nt, Homo Sapiens
auaagucaucagggaaugcaaauugaaaccacagcgaggcuaugacuuacuuaucucaauggcu

SEQ ID NO: 140703 - RNA, 64 nt, Homo Sapiens
agugggaugagugaugcccccccgucugcuccugcgaggcuaugcugcaguauguugccaagag

SEQ ID NO: 140704 - RNA, 64 nt, Homo Sapiens
ugcuguacuauccugaggaauugcgagauauugcugaggggaaaaaaaaaugaccuuuucuuga

SEQ ID NO: 140705 - RNA, 64 nt, Homo Sapiens
aauucaguggcuuugagucaaggccgguucuaauugaggggacccagugugcuucaguguuaag

SEQ ID NO: 140706 - RNA, 64 nt, Homo Sapiens
aacagauucccuaaacuuucgaaugaggaaggagugaggggaagagcaugucugaguuggaugg

SEQ ID NO: 140707 - RNA, 64 nt, Homo Sapiens
gaagagagggcuggcugcccaccccugaaggauaugaggggaugugccccaggagagguaaugc

SEQ ID NO: 140708 - RNA, 64 nt, Homo Sapiens
gauaaucugaaggccagagaugcuuucaguccuuugaggggacaauacuauuaaucaaagugcu

SEQ ID NO: 140709 - RNA, 64 nt, Homo Sapiens
ucauuguuucucaugcaucaagguggggcaccucugaggggaguucauguuuaagagcauugac

SEQ ID NO: 140710 - RNA, 64 nt, Homo Sapiens
ccaggacaucgggcugcgugaaguccagugacccugaggggauuuuggccaaaggaaacagcca

SEQ ID NO: 140711 - RNA, 64 nt, Homo Sapiens
gaggggcagugacuuccagagucccauccgucagugaggggacugggcugcgggaugggugagg

SEQ ID NO: 140712 - RNA, 64 nt, Homo Sapiens
ucccuccuaaggaaaagggaguagcagauugaucugaggggaaagcacaggcugugcugucgag

SEQ ID NO: 140713 - RNA, 64 nt, Homo Sapiens
ugcccuugcuggguuuuccuuuucuuugggacugugaggggaaaugguuuuuagaggugagggu

SEQ ID NO: 140714 - RNA, 64 nt, Homo Sapiens
uucuggacacucaaacacaucauaauggauucacugaggggagacaaagggagccgagacccug

SEQ ID NO: 140715 - RNA, 64 nt, Homo Sapiens
acaaaggcaguucaguccacaggcauggaagcugugaggggacaggccugugcgugccauccag

SEQ ID NO: 140716 - RNA, 64 nt, Homo Sapiens
aauccagcugaugaguuacagccuguuaguaacaugaggggacauuuuggugagaaaugggacu

SEQ ID NO: 140717 - RNA, 64 nt, Homo Sapiens
aaccagcuaagaaaagauuuuaaucaaguugaauugaggggauuaauaugaaaacuuaugaccu

SEQ ID NO: 140718 - RNA, 64 nt, Homo Sapiens
cacccgguuucuccugauuauggcugcuguggggugaggggagggaggggcagccccgaggcag

SEQ ID NO: 140719 - RNA, 64 nt, Homo Sapiens
augucaucguccagaugagaaaucuuagcccaggugaggggaguaacuugcuugaggucacaca

SEQ ID NO: 140720 - RNA, 64 nt, Homo Sapiens
ggaagcgggcaugauuguagcgugucccgggcgcugaggggaaauuaggguaugaucucgguca

SEQ ID NO: 140721 - RNA, 64 nt, Homo Sapiens
cuacgccucaggcaugugguaugcggugagaggaugaggggagcaggcugggagcaaaugcccc

SEQ ID NO: 140722 - RNA, 64 nt, Homo Sapiens
cagaggcuuaagaugggauacauggccugugcagugaggggaccuggguccuuugcuucugaga

SEQ ID NO: 140723 - RNA, 64 nt, Homo Sapiens
caguggagaugagggaacggguagauggugugagugaggggaacuuuuagaguggaacugggca

SEQ ID NO: 140724 - RNA, 64 nt, Homo Sapiens
aaggcaucauuuaguugggcagcuacucuguaucaggugcuaaccacuuuacauacauuaauuu

SEQ ID NO: 140725 - RNA, 64 nt, Homo Sapiens
uuuuucuguuaaaaggggagauucucaagcuuccaggugcuaccauauggagccuaaggauaaa

SEQ ID NO: 140726 - RNA, 64 nt, Homo Sapiens
uguucuuuuugcaaagacuugaauacauuggcagaggugcuaaucacaucuucccuaaggcacc

SEQ ID NO: 140727 - RNA, 64 nt, Homo Sapiens
uugaauaaucauuguaaagcacuuuguauauauaaggugcuauauaagugugaaauaucauuca

SEQ ID NO: 140728 - RNA, 64 nt, Homo Sapiens
ggcagucucucucuuccucacagucccacugugcaggugcuauuguuacucuuacgaauauuuu

SEQ ID NO: 140729 - RNA, 64 nt, Homo Sapiens
uuuagaagcccaguaucagaacuugcuacguuucaggugcuagggacuuaaugaaaaacaggac

SEQ ID NO: 140730 - RNA, 64 nt, Homo Sapiens
caacuaggagcccagcuggguuucuugagugcaaaggugcuagaagagagaaaaacaauauaac

SEQ ID NO: 140731 - RNA, 64 nt, Homo Sapiens
uccuaagaggcacucacaaggacuuuaaccaguuaggugcuagaagagcuagucauggauaaca

SEQ ID NO: 140732 - RNA, 64 nt, Homo Sapiens
uaacaugggaggagagcguggugaauuuuucuaaaggugcuauuuuuuuuguggauggggacuu

SEQ ID NO: 140733 - RNA, 64 nt, Homo Sapiens
ucuaugugauggguggggugccauuuuauaccaaaggugcuacaggcaggguggaagcggcucc

SEQ ID NO: 140734 - RNA, 59 nt, Homo Sapiens
aauccaggugcuuuccagacccaggcuccucucccaagagcccuccucucccaagaaau

SEQ ID NO: 140735 - RNA, 59 nt, Homo Sapiens
aauccaggcuccucucccaacagcccuccucucccaagaagaacugauuggggcuucca

SEQ ID NO: 140736 - RNA, 59 nt, Homo Sapiens
uuuuuaagauuaaaaaugaauaccuuaaaucucccaaaagagauaaccaguaucugaag

SEQ ID NO: 140737 - RNA, 59 nt, Homo Sapiens
ccugaccgcaagugauccacacgccuuggucucccaaagugcugggauuacgguguuag

SEQ ID NO: 140738 - RNA, 59 nt, Homo Sapiens
acugcagccccacuucuguuucccuggagucucccaauggaucauucaggaguguccua

SEQ ID NO: 140739 - RNA, 59 nt, Homo Sapiens
aaggggaagagggugaccucagcggcuuuucucccaaaaaucggcugaaggcugguugu

SEQ ID NO: 140740 - RNA, 59 nt, Homo Sapiens
cugcucccuuuuguuuugugcaaucaucuucucccaagacuacccucagucuacacuca

SEQ ID NO: 140741 - RNA, 59 nt, Homo Sapiens
agugcucuuuccaccccaaacagcaggggucucccaacacuuugugcucuguuccuguc

SEQ ID NO: 140742 - RNA, 59 nt, Homo Sapiens
ugcagugggagagcuuugcuauaccugauucucccaauccagccccccaugugggagaa

SEQ ID NO: 140743 - RNA, 59 nt, Homo Sapiens
gaaaccaaaugcgccccuucgcucucuuuucucccaagccugcgccagccuccccgccc

SEQ ID NO: 140744 - RNA, 59 nt, Homo Sapiens
accuuagaguagggacacugucccaagucucucccaaauagacaguccacccagagcuc

SEQ ID NO: 140745 - RNA, 59 nt, Homo Sapiens
cucucccaaauaccuuagagacccagagcucucccaaguugaacagggugagacagucc

SEQ ID NO: 140746 - RNA, 59 nt, Homo Sapiens
aacguggaacaguaucacaaaagauuccaucucccaacgauuucagaacucugagcuca

SEQ ID NO: 140747 - RNA, 59 nt, Homo Sapiens
gaagaaagauaaggaggcucccacccaccucucccaagagcagacauuaaacaucuuug

SEQ ID NO: 140748 - RNA, 59 nt, Homo Sapiens
cauauuuuugauaggaaaaagccucuuuuucucccaacugggaaagaaacuacuuuaga

SEQ ID NO: 140749 - RNA, 59 nt, Homo Sapiens
uuuaaaaacaaauuggaagaaaaggggaaucucccaaaauaugcuuccagguggaggag

SEQ ID NO: 140750 - RNA, 59 nt, Homo Sapiens
acagcaagacugucagccucagcucguuuucucccaauucaaucugccaaaugugcugc

SEQ ID NO: 140751 - RNA, 59 nt, Homo Sapiens
gaagcguuggcagcaaagggucuccagccucucccaaaguaggagauuuuuauaaaccc

SEQ ID NO: 140752 - RNA, 59 nt, Homo Sapiens
cccugggccauaugugcuauggagaggacucucccaaacccccaauagcuagugacagc

SEQ ID NO: 140753 - RNA, 59 nt, Homo Sapiens
aagcuuccccuuaucguccccugugauuaucucccaaccccgugacaaagguagagcaa

SEQ ID NO: 140754 - RNA, 59 nt, Homo Sapiens
guuugucacugccguuuauuacauugacuucucccaagaugaaucuuccuuccaaaugu

SEQ ID NO: 140755 - RNA, 59 nt, Homo Sapiens
ugaagauaaucaaggccaguuacucaucaucucccaaccacuguuuccucaacugcccu

SEQ ID NO: 140756 - RNA, 64 nt, Homo Sapiens
cugcacacacaugucagggggacacaagacaccaagucccuagggccauggcuggaguggcugg

SEQ ID NO: 140757 - RNA, 64 nt, Homo Sapiens
ugcuauuaaauaccuuauugaugggacaucuaauagucccuaagagaaaugaaagagaagagaa

SEQ ID NO: 140758 - RNA, 64 nt, Homo Sapiens
cacugugcuuaguagugacuauugcaagucccuaagucccuauuguucaauuugauacaguaga

SEQ ID NO: 140759 - RNA, 64 nt, Homo Sapiens
ucccuauucacugugcuuagacaguagaauugcaagucccuaagaucauaauguucaauuugau

SEQ ID NO: 140760 - RNA, 64 nt, Homo Sapiens
cauguuucucccauaggcuggaguucucuuucuuagucccuaauuauaucauauauaaaagucu

SEQ ID NO: 140761 - RNA, 64 nt, Homo Sapiens
guauaugauuauaaugcuauguuuaguaaucuaaagucccuauaccuuggucccauuagcugag

SEQ ID NO: 140762 - RNA, 64 nt, Homo Sapiens
ugggggcuggacagggggaauaccccugaucuccagucccuagcuuagaacaccaugagauagu

SEQ ID NO: 140763 - RNA, 64 nt, Homo Sapiens
ccccuccccucuguuucugccccccuagcacgugagucccuacugcaaaaagccuggcuaccuc

SEQ ID NO: 140764 - RNA, 64 nt, Homo Sapiens; identical to SEQ ID NO: 118026

SEQ ID NO: 140765 - RNA, 64 nt, Homo Sapiens; identical to SEQ ID NO: 118027

SEQ ID NO: 140766 - RNA, 64 nt, Homo Sapiens; identical to SEQ ID NO: 118028

SEQ ID NO: 140767 - RNA, 64 nt, Homo Sapiens; identical to SEQ ID NO: 118029

SEQ ID NO: 140768 - RNA, 64 nt, Homo Sapiens; identical to SEQ ID NO: 118030

SEQ ID NO: 140769 - RNA, 64 nt, Homo Sapiens; identical to SEQ ID NO: 118031

SEQ ID NO: 140770 - RNA, 64 nt, Homo Sapiens; identical to SEQ ID NO: 118032

SEQ ID NO: 140771 - RNA, 64 nt, Homo Sapiens; identical to SEQ ID NO: 118033

SEQ ID NO: 140772 - RNA, 64 nt, Homo Sapiens; identical to SEQ ID NO: 118034

SEQ ID NO: 140773 - RNA, 64 nt, Homo Sapiens; identical to SEQ ID NO: 118035

SEQ ID NO: 140774 - RNA, 64 nt, Homo Sapiens; identical to SEQ ID NO: 118036

SEQ ID NO: 140775 - RNA, 64 nt, Homo Sapiens; identical to SEQ ID NO: 118037

SEQ ID NO: 140776 - RNA, 64 nt, Homo Sapiens; identical to SEQ ID NO: 118038

SEQ ID NO: 140777 - RNA, 64 nt, Homo Sapiens; identical to SEQ ID NO: 118039

SEQ ID NO: 140778 - RNA, 64 nt, Homo Sapiens; identical to SEQ ID NO: 118040

SEQ ID NO: 140779 - RNA, 64 nt, Homo Sapiens; identical to SEQ ID NO: 118041

SEQ ID NO: 140780 - RNA, 64 nt, Homo Sapiens; identical to SEQ ID NO: 118042

SEQ ID NO: 140781 - RNA, 64 nt, Homo Sapiens; identical to SEQ ID NO: 118043

SEQ ID NO: 140782 - RNA, 64 nt, Homo Sapiens; identical to SEQ ID NO: 118044

SEQ ID NO: 140783 - RNA, 64 nt, Homo Sapiens; identical to SEQ ID NO: 118045

SEQ ID NO: 140784 - RNA, 64 nt, Homo Sapiens; identical to SEQ ID NO: 118046

SEQ ID NO: 140785 - RNA, 64 nt, Homo Sapiens; identical to SEQ ID NO: 118047

SEQ ID NO: 140786 - RNA, 64 nt, Homo Sapiens; identical to SEQ ID NO: 118048

SEQ ID NO: 140787 - RNA, 64 nt, Homo Sapiens; identical to SEQ ID NO: 118049

SEQ ID NO: 140788 - RNA, 64 nt, Homo Sapiens; identical to SEQ ID NO: 118050

SEQ ID NO: 140789 - RNA, 64 nt, Homo Sapiens; identical to SEQ ID NO: 118051

SEQ ID NO: 140790 - RNA, 64 nt, Homo Sapiens; identical to SEQ ID NO: 118052

SEQ ID NO: 140791 - RNA, 64 nt, Homo Sapiens; identical to SEQ ID NO: 118053

SEQ ID NO: 140792 - RNA, 64 nt, Homo Sapiens; identical to SEQ ID NO: 118054

SEQ ID NO: 140793 - RNA, 64 nt, Homo Sapiens; identical to SEQ ID NO: 118055

SEQ ID NO: 140794 - RNA, 64 nt, Homo Sapiens; identical to SEQ ID NO: 118056

SEQ ID NO: 140795 - RNA, 64 nt, Homo Sapiens; identical to SEQ ID NO: 118057

SEQ ID NO: 140796 - RNA, 64 nt, Homo Sapiens; identical to SEQ ID NO: 118058

SEQ ID NO: 140797 - RNA, 64 nt, Homo Sapiens; identical to SEQ ID NO: 118059

SEQ ID NO: 140798 - RNA, 64 nt, Homo Sapiens; identical to SEQ ID NO: 118060

SEQ ID NO: 140799 - RNA, 64 nt, Homo Sapiens; identical to SEQ ID NO: 118061

SEQ ID NO: 140800 - RNA, 64 nt, Homo Sapiens; identical to SEQ ID NO: 118062

SEQ ID NO: 140801 - RNA, 64 nt, Homo Sapiens; identical to SEQ ID NO: 118063

SEQ ID NO: 140802 - RNA, 64 nt, Homo Sapiens; identical to SEQ ID NO: 118064

SEQ ID NO: 140803 - RNA, 64 nt, Homo Sapiens; identical to SEQ ID NO: 118065

SEQ ID NO: 140804 - RNA, 64 nt, Homo Sapiens; identical to SEQ ID NO: 118066

SEQ ID NO: 140805 - RNA, 64 nt, Homo Sapiens
uuuuaaaugguuauguaagcggaagcacgcuggugcuaaguauugaugauuuguuuggcauaua

SEQ ID NO: 140806 - RNA, 64 nt, Homo Sapiens
gcuuucuacaaauaauugccaaaugcaucuggaggcuaaguauuuggcauaugccauuucuggg

SEQ ID NO: 140807 - RNA, 64 nt, Homo Sapiens
gagaauucagagauucuggccuccagcugucaccacaccguaacggggccauguaacugugcag

SEQ ID NO: 140808 - RNA, 64 nt, Homo Sapiens
ugucuggcccugaauuugcauggcuugagaaggcacaccguaagacuaaguaggaaaaauccaa

SEQ ID NO: 140809 - RNA, 64 nt, Homo Sapiens
guuagcuagcuuccuacuuuucuugugauaaugaacaccguaaggaacuggcacuagguccaaa

SEQ ID NO: 140810 - RNA, 64 nt, Homo Sapiens
acccccgguuuuacaguuuuuuuguggacucugcacaccguaugggucaccucaccugcaaggc

SEQ ID NO: 140811 - RNA, 64 nt, Homo Sapiens
cguucacacacaugcacuaugcacguguguguacacaccguauauuauucaagagccauucggg

SEQ ID NO: 140812 - RNA, 64 nt, Homo Sapiens
acauauauuaaucuacuggcaaaaagacacacccacaccguagaggaaaaauaagaugacuggg

SEQ ID NO: 140813 - RNA, 64 nt, Homo Sapiens
ucauuuuuuaaugacuuucaacacucccaugaaaacaccguagucugcuuuuccugaaagguga

SEQ ID NO: 140814 - RNA, 64 nt, Homo Sapiens
ugugcauucuuagaagaguaagaacaaauaaaguacaccguaauauacauauaaauacauucau

SEQ ID NO: 140815 - RNA, 64 nt, Homo Sapiens
ugucuggaaggcaaaaagauaggaugacacagaaacaccguaagaccucucuaaaagacacagg

SEQ ID NO: 140816 - RNA, 64 nt, Homo Sapiens
uuaugaauuuguucauuguccuuuauguaauguaacaccguaauaauuuuaauaagaaacuaag

SEQ ID NO: 140817 - RNA, 64 nt, Homo Sapiens
uccucaguagcuggggcuuuaggugggcacugccacaccguacuaauuuuuguauuuuuuguag

SEQ ID NO: 140818 - RNA, 64 nt, Homo Sapiens
aauauggugagaucagacucuuuaaauaccugucacaccguaugcuuuagugaugccuccccuc

SEQ ID NO: 140819 - RNA, 64 nt, Homo Sapiens
uugcuguacacagaugcuacagacuuguacuaacacaccguaauuuggcauuuguuuaaccuca

SEQ ID NO: 140820 - RNA, 64 nt, Homo Sapiens
uguuugcuaacuggcuuuacgaggaggagaucacacaccguaugggggcuuuaagagugaaggu

SEQ ID NO: 140821 - RNA, 64 nt, Homo Sapiens
gcaugugguucaaagagaaguugaugguggugaaacaccguagggaauuaaugaaguaaaguug

SEQ ID NO: 140822 - RNA, 64 nt, Homo Sapiens
gcuaugcaaaaggcgcugauacuggaaggcuugaacaccguauguuaauagggguuaagugaca

SEQ ID NO: 140823 - RNA, 64 nt, Homo Sapiens
uuaucagaauuauuggccuaguaauccuucagaaacaccguaauucuaaauaaaccucuuccca

SEQ ID NO: 140824 - RNA, 64 nt, Homo Sapiens
acuccguaaacagcccagcucucccuugaaaaguacaccguaaccuuuccacacgauuuccuau

SEQ ID NO: 140825 - RNA, 64 nt, Homo Sapiens
ucacuuugucugucuuguucaccuggagccugacacaccguagguacugaguacaaauagcuug

SEQ ID NO: 140826 - RNA, 64 nt, Homo Sapiens
gacuuucucugaguugggcaaagaagaagcugacacaccguauguuguuagagucuuuuaucug

SEQ ID NO: 140827 - RNA, 64 nt, Homo Sapiens
uagggacagaggcaucuggagaaauggaguucucacaccguaucggggagcaaauuccagcucu

SEQ ID NO: 140828 - RNA, 64 nt, Homo Sapiens
ggguuaugaggaaguuuaaugucuuagcuucugaacaccguagcggccuggcucuggaagucac

SEQ ID NO: 140829 - RNA, 64 nt, Homo Sapiens
ucugcaauaugaauucaagaaaaccaauaaauccacaccguacaacuuuaagguuugcagagau

SEQ ID NO: 140830 - RNA, 64 nt, Homo Sapiens
acacucugugcccuguuugguguaaacagcacagacaccguaaccuuuguauaaaauauuggca

SEQ ID NO: 140831 - RNA, 64 nt, Homo Sapiens
gacguuacagggugaaacccucugaccccucgcgacaccguaggacuugacuuuuguuuagucu

SEQ ID NO: 140832 - RNA, 64 nt, Homo Sapiens; identical to SEQ ID NO: 72441

SEQ ID NO: 140833 - RNA, 64 nt, Homo Sapiens; identical to SEQ ID NO: 72442

SEQ ID NO: 140834 - RNA, 64 nt, Homo Sapiens; identical to SEQ ID NO: 72443

SEQ ID NO: 140835 - RNA, 64 nt, Homo Sapiens; identical to SEQ ID NO: 72444

SEQ ID NO: 140836 - RNA, 64 nt, Homo Sapiens; identical to SEQ ID NO: 72445

SEQ ID NO: 140837 - RNA, 64 nt, Homo Sapiens; identical to SEQ ID NO: 72446

SEQ ID NO: 140838 - RNA, 64 nt, Homo Sapiens; identical to SEQ ID NO: 72447

SEQ ID NO: 140839 - RNA, 64 nt, Homo Sapiens; identical to SEQ ID NO: 72448

SEQ ID NO: 140840 - RNA, 64 nt, Homo Sapiens; identical to SEQ ID NO: 72449

SEQ ID NO: 140841 - RNA, 64 nt, Homo Sapiens; identical to SEQ ID NO: 72450

SEQ ID NO: 140842 - RNA, 64 nt, Homo Sapiens; identical to SEQ ID NO: 72451

SEQ ID NO: 140843 - RNA, 64 nt, Homo Sapiens; identical to SEQ ID NO: 72452

SEQ ID NO: 140844 - RNA, 64 nt, Homo Sapiens; identical to SEQ ID NO: 72453

SEQ ID NO: 140845 - RNA, 64 nt, Homo Sapiens; identical to SEQ ID NO: 72454

SEQ ID NO: 140846 - RNA, 64 nt, Homo Sapiens; identical to SEQ ID NO: 72455

SEQ ID NO: 140847 - RNA, 64 nt, Homo Sapiens; identical to SEQ ID NO: 72456

SEQ ID NO: 140848 - RNA, 64 nt, Homo Sapiens; identical to SEQ ID NO: 72457

SEQ ID NO: 140849 - RNA, 64 nt, Homo Sapiens; identical to SEQ ID NO: 72458

SEQ ID NO: 140850 - RNA, 64 nt, Homo Sapiens; identical to SEQ ID NO: 72459

SEQ ID NO: 140851 - RNA, 64 nt, Homo Sapiens; identical to SEQ ID NO: 72460

SEQ ID NO: 140852 - RNA, 64 nt, Homo Sapiens; identical to SEQ ID NO: 72461

SEQ ID NO: 140853 - RNA, 64 nt, Homo Sapiens; identical to SEQ ID NO: 72462

SEQ ID NO: 140854 - RNA, 64 nt, Homo Sapiens; identical to SEQ ID NO: 72463

SEQ ID NO: 140855 - RNA, 64 nt, Homo Sapiens; identical to SEQ ID NO: 72464

SEQ ID NO: 140856 - RNA, 64 nt, Homo Sapiens; identical to SEQ ID NO: 72465

SEQ ID NO: 140857 - RNA, 64 nt, Homo Sapiens; identical to SEQ ID NO: 72466

SEQ ID NO: 140858 - RNA, 64 nt, Homo Sapiens; identical to SEQ ID NO: 72467

SEQ ID NO: 140859 - RNA, 64 nt, Homo Sapiens; identical to SEQ ID NO: 72468

SEQ ID NO: 140860 - RNA, 64 nt, Homo Sapiens; identical to SEQ ID NO: 72469

SEQ ID NO: 140861 - RNA, 64 nt, Homo Sapiens; identical to SEQ ID NO: 72470

SEQ ID NO: 140862 - RNA, 64 nt, Homo Sapiens; identical to SEQ ID NO: 72471

SEQ ID NO: 140863 - RNA, 64 nt, Homo Sapiens; identical to SEQ ID NO: 72472

SEQ ID NO: 140864 - RNA, 64 nt, Homo Sapiens; identical to SEQ ID NO: 72473

SEQ ID NO: 140865 - RNA, 64 nt, Homo Sapiens; identical to SEQ ID NO: 72474

SEQ ID NO: 140866 - RNA, 64 nt, Homo Sapiens; identical to SEQ ID NO: 72475

SEQ ID NO: 140867 - RNA, 64 nt, Homo Sapiens; identical to SEQ ID NO: 72476

SEQ ID NO: 140868 - RNA, 64 nt, Homo Sapiens; identical to SEQ ID NO: 72477

SEQ ID NO: 140869 - RNA, 64 nt, Homo Sapiens; identical to SEQ ID NO: 72478

SEQ ID NO: 140870 - RNA, 64 nt, Homo Sapiens; identical to SEQ ID NO: 72479

SEQ ID NO: 140871 - RNA, 64 nt, Homo Sapiens; identical to SEQ ID NO: 72480

SEQ ID NO: 140872 - RNA, 64 nt, Homo Sapiens; identical to SEQ ID NO: 72481

SEQ ID NO: 140873 - RNA, 64 nt, Homo Sapiens; identical to SEQ ID NO: 72482

SEQ ID NO: 140874 - RNA, 64 nt, Homo Sapiens; identical to SEQ ID NO: 72483

SEQ ID NO: 140875 - RNA, 64 nt, Homo Sapiens; identical to SEQ ID NO: 72484

SEQ ID NO: 140876 - RNA, 64 nt, Homo Sapiens; identical to SEQ ID NO: 72485

SEQ ID NO: 140877 - RNA, 64 nt, Homo Sapiens; identical to SEQ ID NO: 72486

SEQ ID NO: 140878 - RNA, 64 nt, Homo Sapiens; identical to SEQ ID NO: 72487

SEQ ID NO: 140879 - RNA, 64 nt, Homo Sapiens; identical to SEQ ID NO: 72488

SEQ ID NO: 140880 - RNA, 64 nt, Homo Sapiens; identical to SEQ ID NO: 72489

SEQ ID NO: 140881 - RNA, 64 nt, Homo Sapiens; identical to SEQ ID NO: 72490

SEQ ID NO: 140882 - RNA, 64 nt, Homo Sapiens; identical to SEQ ID NO: 72491

SEQ ID NO: 140883 - RNA, 64 nt, Homo Sapiens; identical to SEQ ID NO: 72492

SEQ ID NO: 140884 - RNA, 64 nt, Homo Sapiens; identical to SEQ ID NO: 72493

SEQ ID NO: 140885 - RNA, 64 nt, Homo Sapiens
gcggggugggggggugcaaaucugccagcagcucuuacguaaggcauguuuuauuggggagggc

SEQ ID NO: 140886 - RNA, 64 nt, Homo Sapiens
augacauuggggcccuucuuuugcugaaacugccuuacguaaugguuuuacuccuugaaagaga

SEQ ID NO: 140887 - RNA, 64 nt, Homo Sapiens
uuaaauagauccuuuaguuuauaugcuauucuccuuacguaacgcucacucacuuuuagguucu

SEQ ID NO: 140888 - RNA, 64 nt, Homo Sapiens
acggucuuugcaguauuacaacuuuaaccaacauuuacguaaguggagcuuuguauaauuggua

SEQ ID NO: 140889 - RNA, 64 nt, Homo Sapiens; identical to SEQ ID NO: 57499

SEQ ID NO: 140890 - RNA, 64 nt, Homo Sapiens; identical to SEQ ID NO: 57500

SEQ ID NO: 140891 - RNA, 64 nt, Homo Sapiens; identical to SEQ ID NO: 57501

SEQ ID NO: 140892 - RNA, 64 nt, Homo Sapiens; identical to SEQ ID NO: 57502

SEQ ID NO: 140893 - RNA, 64 nt, Homo Sapiens; identical to SEQ ID NO: 57503

SEQ ID NO: 140894 - RNA, 64 nt, Homo Sapiens; identical to SEQ ID NO: 57504

SEQ ID NO: 140895 - RNA, 64 nt, Homo Sapiens; identical to SEQ ID NO: 57505

SEQ ID NO: 140896 - RNA, 64 nt, Homo Sapiens; identical to SEQ ID NO: 57506

SEQ ID NO: 140897 - RNA, 64 nt, Homo Sapiens; identical to SEQ ID NO: 57507

SEQ ID NO: 140898 - RNA, 64 nt, Homo Sapiens; identical to SEQ ID NO: 57508

SEQ ID NO: 140899 - RNA, 64 nt, Homo Sapiens; identical to SEQ ID NO: 57509

SEQ ID NO: 140900 - RNA, 64 nt, Homo Sapiens; identical to SEQ ID NO: 57510

SEQ ID NO: 140901 - RNA, 64 nt, Homo Sapiens; identical to SEQ ID NO: 57511

SEQ ID NO: 140902 - RNA, 64 nt, Homo Sapiens; identical to SEQ ID NO: 57512

SEQ ID NO: 140903 - RNA, 64 nt, Homo Sapiens; identical to SEQ ID NO: 57513

SEQ ID NO: 140904 - RNA, 64 nt, Homo Sapiens; identical to SEQ ID NO: 57514

SEQ ID NO: 140905 - RNA, 64 nt, Homo Sapiens; identical to SEQ ID NO: 57515

SEQ ID NO: 140906 - RNA, 64 nt, Homo Sapiens; identical to SEQ ID NO: 57516

SEQ ID NO: 140907 - RNA, 64 nt, Homo Sapiens; identical to SEQ ID NO: 57517

SEQ ID NO: 140908 - RNA, 64 nt, Homo Sapiens; identical to SEQ ID NO: 57518

SEQ ID NO: 140909 - RNA, 64 nt, Homo Sapiens; identical to SEQ ID NO: 57519

SEQ ID NO: 140910 - RNA, 64 nt, Homo Sapiens; identical to SEQ ID NO: 57520

SEQ ID NO: 140911 - RNA, 64 nt, Homo Sapiens; identical to SEQ ID NO: 57521

SEQ ID NO: 140912 - RNA, 64 nt, Homo Sapiens; identical to SEQ ID NO: 57522

SEQ ID NO: 140913 - RNA, 64 nt, Homo Sapiens; identical to SEQ ID NO: 57523

SEQ ID NO: 140914 - RNA, 64 nt, Homo Sapiens; identical to SEQ ID NO: 57524

SEQ ID NO: 140915 - RNA, 64 nt, Homo Sapiens; identical to SEQ ID NO: 57525

SEQ ID NO: 140916 - RNA, 64 nt, Homo Sapiens; identical to SEQ ID NO: 57526

SEQ ID NO: 140917 - RNA, 64 nt, Homo Sapiens; identical to SEQ ID NO: 57527

SEQ ID NO: 140918 - RNA, 64 nt, Homo Sapiens; identical to SEQ ID NO: 57528

SEQ ID NO: 140919 - RNA, 64 nt, Homo Sapiens; identical to SEQ ID NO: 57529

SEQ ID NO: 140920 - RNA, 64 nt, Homo Sapiens; identical to SEQ ID NO: 57530

SEQ ID NO: 140921 - RNA, 64 nt, Homo Sapiens; identical to SEQ ID NO: 57531

SEQ ID NO: 140922 - RNA, 64 nt, Homo Sapiens; identical to SEQ ID NO: 57532

SEQ ID NO: 140923 - RNA, 64 nt, Homo Sapiens; identical to SEQ ID NO: 57533

SEQ ID NO: 140924 - RNA, 64 nt, Homo Sapiens; identical to SEQ ID NO: 57534

SEQ ID NO: 140925 - RNA, 64 nt, Homo Sapiens; identical to SEQ ID NO: 57535

SEQ ID NO: 140926 - RNA, 64 nt, Homo Sapiens; identical to SEQ ID NO: 57536

SEQ ID NO: 140927 - RNA, 64 nt, Homo Sapiens; identical to SEQ ID NO: 57537

SEQ ID NO: 140928 - RNA, 64 nt, Homo Sapiens; identical to SEQ ID NO: 57538

SEQ ID NO: 140929 - RNA, 64 nt, Homo Sapiens; identical to SEQ ID NO: 57539

SEQ ID NO: 140930 - RNA, 64 nt, Homo Sapiens; identical to SEQ ID NO: 57540

SEQ ID NO: 140931 - RNA, 64 nt, Homo Sapiens; identical to SEQ ID NO: 57541

SEQ ID NO: 140932 - RNA, 64 nt, Homo Sapiens; identical to SEQ ID NO: 57542

SEQ ID NO: 140933 - RNA, 64 nt, Homo Sapiens; identical to SEQ ID NO: 57543

SEQ ID NO: 140934 - RNA, 64 nt, Homo Sapiens; identical to SEQ ID NO: 57544

SEQ ID NO: 140935 - RNA, 64 nt, Homo Sapiens; identical to SEQ ID NO: 57545

SEQ ID NO: 140936 - RNA, 64 nt, Homo Sapiens; identical to SEQ ID NO: 57546

SEQ ID NO: 140937 - RNA, 64 nt, Homo Sapiens; identical to SEQ ID NO: 57547

SEQ ID NO: 140938 - RNA, 64 nt, Homo Sapiens; identical to SEQ ID NO: 57548

SEQ ID NO: 140939 - RNA, 64 nt, Homo Sapiens; identical to SEQ ID NO: 57549

SEQ ID NO: 140940 - RNA, 64 nt, Homo Sapiens; identical to SEQ ID NO: 57550

SEQ ID NO: 140941 - RNA, 64 nt, Homo Sapiens; identical to SEQ ID NO: 57551

SEQ ID NO: 140942 - RNA, 64 nt, Homo Sapiens; identical to SEQ ID NO: 57552

SEQ ID NO: 140943 - RNA, 64 nt, Homo Sapiens; identical to SEQ ID NO: 57553

SEQ ID NO: 140944 - RNA, 64 nt, Homo Sapiens; identical to SEQ ID NO: 57554

SEQ ID NO: 140945 - RNA, 64 nt, Homo Sapiens; identical to SEQ ID NO: 57555

SEQ ID NO: 140946 - RNA, 64 nt, Homo Sapiens; identical to SEQ ID NO: 57556

SEQ ID NO: 140947 - RNA, 64 nt, Homo Sapiens; identical to SEQ ID NO: 57557

SEQ ID NO: 140948 - RNA, 64 nt, Homo Sapiens; identical to SEQ ID NO: 57558

SEQ ID NO: 140949 - RNA, 64 nt, Homo Sapiens; identical to SEQ ID NO: 57559

SEQ ID NO: 140950 - RNA, 64 nt, Homo Sapiens; identical to SEQ ID NO: 57560

SEQ ID NO: 140951 - RNA, 64 nt, Homo Sapiens; identical to SEQ ID NO: 57561

SEQ ID NO: 140952 - RNA, 64 nt, Homo Sapiens; identical to SEQ ID NO: 57562

SEQ ID NO: 140953 - RNA, 64 nt, Homo Sapiens; identical to SEQ ID NO: 57563

SEQ ID NO: 140954 - RNA, 64 nt, Homo Sapiens; identical to SEQ ID NO: 57564

SEQ ID NO: 140955 - RNA, 64 nt, Homo Sapiens; identical to SEQ ID NO: 57565

SEQ ID NO: 140956 - RNA, 64 nt, Homo Sapiens; identical to SEQ ID NO: 57566

SEQ ID NO: 140957 - RNA, 64 nt, Homo Sapiens; identical to SEQ ID NO: 57567

SEQ ID NO: 140958 - RNA, 64 nt, Homo Sapiens; identical to SEQ ID NO: 57568

SEQ ID NO: 140959 - RNA, 64 nt, Homo Sapiens; identical to SEQ ID NO: 57569

SEQ ID NO: 140960 - RNA, 64 nt, Homo Sapiens; identical to SEQ ID NO: 57570

SEQ ID NO: 140961 - RNA, 64 nt, Homo Sapiens; identical to SEQ ID NO: 57571

SEQ ID NO: 140962 - RNA, 64 nt, Homo Sapiens; identical to SEQ ID NO: 57572

SEQ ID NO: 140963 - RNA, 64 nt, Homo Sapiens; identical to SEQ ID NO: 57573

SEQ ID NO: 140964 - RNA, 64 nt, Homo Sapiens; identical to SEQ ID NO: 57574

SEQ ID NO: 140965 - RNA, 64 nt, Homo Sapiens; identical to SEQ ID NO: 57575

SEQ ID NO: 140966 - RNA, 64 nt, Homo Sapiens; identical to SEQ ID NO: 57576

SEQ ID NO: 140967 - RNA, 64 nt, Homo Sapiens; identical to SEQ ID NO: 57577

SEQ ID NO: 140968 - RNA, 64 nt, Homo Sapiens
uugaaugaacugaggcaaauuuaaaaggcaauaauuuaaacauuaaccucauuccaaguuaaug

SEQ ID NO: 140969 - RNA, 64 nt, Homo Sapiens
gaauuaaauacuguauuaaaauaaguucgcugucuuuaaacaaauggagaugacuacuaaguca

SEQ ID NO: 140970 - RNA, 64 nt, Homo Sapiens
gauauaugcagacaaauuuuugacaaauucaccuuuuaaacacacuuaaccauuugugaagguu

SEQ ID NO: 140971 - RNA, 64 nt, Homo Sapiens
uuaaccauuugugaagguuuucuuuagcuuacauuuuaaacauacacaauaaacacuaauccuc

SEQ ID NO: 140972 - RNA, 64 nt, Homo Sapiens
uaauauuaguuucaagcuuuccuuacccuacaacuuuaaacaaaagcuuuaauuuuguuugcac

SEQ ID NO: 140973 - RNA, 64 nt, Homo Sapiens
acuaaauuauguagcuauuugacuguuaaguucuuuuaaacaacuguuuccuugggcuucaguu

SEQ ID NO: 140974 - RNA, 64 nt, Homo Sapiens
ugaggggauaggggaaguaagccaauaagaaccuuuuaaacaaaucguccugucacaaaaugcu

SEQ ID NO: 140975 - RNA, 64 nt, Homo Sapiens
aauggaaaauuucugaaaugcuggauuaucuauuuuuaaacaagcaguugacuuaaaacuuucu

SEQ ID NO: 140976 - RNA, 64 nt, Homo Sapiens
uuggauauuggaaugcagucguagcaaugugcacuuuaaacaauaaacuguuuuaauugcuugg

SEQ ID NO: 140977 - RNA, 64 nt, Homo Sapiens
ucagugcuuccacauucaccgcauugcuuggcucuuuaaacacaguugauugguaagaaauugg

SEQ ID NO: 140978 - RNA, 64 nt, Homo Sapiens
aacaaaaaaaaugaaugcacauaauuuaaacauauuuaaacaaaugaggagugccagcagugug

SEQ ID NO: 140979 - RNA, 64 nt, Homo Sapiens
uuuaaacaaaaacaaaaaaacagcagugugauaauuuaaacauauucaugcaaaugaggagugc

SEQ ID NO: 140980 - RNA, 64 nt, Homo Sapiens
cucaauuucuaauucaccauaaugcuaaaaaguuuuuaaacacuggauaucacagcaacauuga

SEQ ID NO: 140981 - RNA, 64 nt, Homo Sapiens
uguuuaucccaaccuuuuuguaccuccucucuuuuuuaaacaccccccugcccauccucccuuu

SEQ ID NO: 140982 - RNA, 64 nt, Homo Sapiens
cuuuuagugaaauugucauuagcauccgguagucuuuaaacauuucaugaaguugguuugcucc

SEQ ID NO: 140983 - RNA, 64 nt, Homo Sapiens
uuuacacagaucgguguuuggaguaacaucaauauuuaaacauuagaauaaguauauauuuuug

SEQ ID NO: 140984 - RNA, 64 nt, Homo Sapiens
aggcagaauaauucuuuuaguuauaaaagcuuacuuuaaacagguuuucuuccccaaaacagaa

SEQ ID NO: 140985 - RNA, 64 nt, Homo Sapiens
augguaagucuuaaagucuguugagucacugagguuuaaacacauagauauugacuauccuuag

SEQ ID NO: 140986 - RNA, 64 nt, Homo Sapiens
guuauaauugaccuugcauggugugaaauaaaaguuuaaacacugguguauuucagguguacuu

SEQ ID NO: 140987 - RNA, 64 nt, Homo Sapiens
ugcccuuucauagauauucgauuaauuuuuacauuuuaaacaaguugacuauuuccuuuagggg

SEQ ID NO: 140988 - RNA, 64 nt, Homo Sapiens
gauuaaauugaauguguaauaaaguuuuauuuuuuuuaaacaauagaaaugggcuguuuugccc

SEQ ID NO: 140989 - RNA, 64 nt, Homo Sapiens
caaacaaacaaacagaaguacuagucccaugugauuuaaacaaaacucccuguaggauuuuuuu

SEQ ID NO: 140990 - RNA, 64 nt, Homo Sapiens
gggcaacagcuggaucuccaagguggucuuuuguuuuaaacagguuaauuuaauugaccccccg

SEQ ID NO: 140991 - RNA, 64 nt, Homo Sapiens
uagaaagauaauauuucuccauugcaaccaaaacuuuaaacaaggagcagcauuacccuaaugg

SEQ ID NO: 140992 - RNA, 64 nt, Homo Sapiens
uuguugagcuccuauuugcccagagauggucauauuuaaacagaaguauacguuuuucaguuuc

SEQ ID NO: 140993 - RNA, 64 nt, Homo Sapiens
gaaauuccuacacauacguuugcguauauguuauuuuaaacaucuuuguggugagaauuuuuuc

SEQ ID NO: 140994 - RNA, 64 nt, Homo Sapiens
gggaaauuggauuuuuguaauaaucuuuugauguuuuaaacauugguucccuagucaccauagu

SEQ ID NO: 140995 - RNA, 64 nt, Homo Sapiens
uagucaccauaguuaccacuuguauuuuaagucauuuaaacaagccacgguggggcuuuuuucu

SEQ ID NO: 140996 - RNA, 64 nt, Homo Sapiens
gcucaguuucuauuuuacuauucaaguuguguacuuuaaacaaauauaaaaaucaaaaggcugc

SEQ ID NO: 140997 - RNA, 64 nt, Homo Sapiens
gcuuuuugcccuuagcacuaugcuugggggccauuuuaaacagugaaaucaaaaaaagaacaga

SEQ ID NO: 140998 - RNA, 64 nt, Homo Sapiens
auuuauauuacugucuuuucuauuaaucauuugauuuaaacaaugccaagucacucuuuuuuag

SEQ ID NO: 140999 - RNA, 64 nt, Homo Sapiens
uuauggugagguuuaaaggauaugaaacucuacauuuaaacaaguauuuuauauuuggguacag

SEQ ID NO: 141000 - RNA, 64 nt, Homo Sapiens
agaguugagcacuuccagucaauggacucagaccuuuaaacaggaaguaagaggucauuucugg

SEQ ID NO: 141001 - RNA, 64 nt, Homo Sapiens
caggagaccaucagccucucugcucugccaaagguuuaaacaccuguugucacacccaaaggga

SEQ ID NO: 141002 - RNA, 64 nt, Homo Sapiens
auuaaaagcuuaauguaaaugauaggaaaagcacuuuaaacauacaucuaagaggcuaaacucu

SEQ ID NO: 141003 - RNA, 64 nt, Homo Sapiens
ugcuuuauuauuguuuucuuguuaaagaaaauuuuuuaaacauuucauauuucccgaagcagaa

SEQ ID NO: 141004 - RNA, 64 nt, Homo Sapiens
auucuaguuaaauguagaaguaauaucaguuuuuuuuaaacauguagcucugaagugucacauu

SEQ ID NO: 141005 - RNA, 64 nt, Homo Sapiens
auaaaggaauaucuuuuuuugagcagcugccacuuuuaaacaacauuaaaauggaauaaagaaa

SEQ ID NO: 141006 - RNA, 64 nt, Homo Sapiens
aaauucuuuaaaauauuuuauauuuuuuucaccuuuuaaacaaagugaaucaguuucuuguuua

SEQ ID NO: 141007 - RNA, 64 nt, Homo Sapiens
cuugguccuuaaaaaauaugcucuccccucccuuuuuaaacaaauggcuuguucagucacuugu

SEQ ID NO: 141008 - RNA, 64 nt, Homo Sapiens
cuuguucagucacuuguuuguguuugaauugauuuuuaaacagcagguugugugugugugcagu

SEQ ID NO: 141009 - RNA, 64 nt, Homo Sapiens
uaauaccucaagauaaucugauuuauuagcuauuuuuaaacauuuuuaaucacaagcuguauua

SEQ ID NO: 141010 - RNA, 64 nt, Homo Sapiens
ugcccuuuauguacuacauucuuauuuucuaacuuuuaaacacuguauuggagguuuuuuuuua

SEQ ID NO: 141011 - RNA, 64 nt, Homo Sapiens
acuaucugugcguagaaguucuaguguuuucaauuuuaaacauauccaaguuugaauuccuaaa

SEQ ID NO: 141012 - RNA, 64 nt, Homo Sapiens
acauaucucuuaucuuacgaaaaaaugguagcauuuuaaacaaaauagaaaguugcaaggcaaa

SEQ ID NO: 141013 - RNA, 64 nt, Homo Sapiens
aguaguuucauuauuuggcacaauagcaguuuauuuuaaacaaacaauuugaaguuaaacauuu

SEQ ID NO: 141014 - RNA, 64 nt, Homo Sapiens
uuuuggcuacaacuugauugaaacaaguucaaaauuuaaacaaguucauacaaguuuuuaaaaa

SEQ ID NO: 141015 - RNA, 64 nt, Homo Sapiens
ccaaaggauaggacuuuaguucuuuaagcauuauuuuaaacacuauauugauacaaaaauaucu

SEQ ID NO: 141016 - RNA, 64 nt, Homo Sapiens
ucauuagacucuuuuaaugcuaauggcuaguacguuuaaacaaaacagcaguucucugcugcaa

SEQ ID NO: 141017 - RNA, 64 nt, Homo Sapiens
ugcccaagaaggcaagcaggccucccauacugcuuuuaaacagacccccuagaacaucccccuu

SEQ ID NO: 141018 - RNA, 64 nt, Homo Sapiens
caagauuuaauugaaaggacugcguguuuuucauuuuaaacacauauggauauuuguaccaggc

SEQ ID NO: 141019 - RNA, 64 nt, Homo Sapiens
cuguuaauuauaagaaacuccucaaaguaaguauuuuaaacagccagcuaaugucugguuauuu

SEQ ID NO: 141020 - RNA, 64 nt, Homo Sapiens
ugaaauuaaagcaacaauaagguggugguagauuuuuaaacaaaucuuuuugacuggacuuuug

SEQ ID NO: 141021 - RNA, 64 nt, Homo Sapiens
aguuugugugucuuaauuauuauuuguguuuuaauuuaaacaccuccucauguacauacccugg

SEQ ID NO: 141022 - RNA, 64 nt, Homo Sapiens
gcccccugccccccagccucuggcauuagaauuauuuaaacaaaaacuaggcgguugaaugaga

SEQ ID NO: 141023 - RNA, 64 nt, Homo Sapiens
uaauauacuauuguuugcagauaaaggccuuaacuuuaaacaucuuucaucuucugaaagcugc

SEQ ID NO: 141024 - RNA, 64 nt, Homo Sapiens
uagaugaaaauuguugaugccccuuucuuuuuacuuuaaacaaugugguagugggagaaugacu

SEQ ID NO: 141025 - RNA, 64 nt, Homo Sapiens
cuuguaucucacuguauuucucaugcuuuguucuuuuaaacaaauccuuuaaacugugucauuu

SEQ ID NO: 141026 - RNA, 64 nt, Homo Sapiens
uauccuucuuuuuuuauuuagauaauucuuuuaauuuaaacaaagguucacuauggaaccagac

SEQ ID NO: 141027 - RNA, 64 nt, Homo Sapiens
uagucuagugucugguuuucuagcaaacaguaaauuuaaacaaguaaacuauuaugguuuccau

SEQ ID NO: 141028 - RNA, 64 nt, Homo Sapiens
acccuugccucccccacccccuucuuuuuuuuuuuuuaaacaaaucaguuuguuuugguaccuu

SEQ ID NO: 141029 - RNA, 64 nt, Homo Sapiens
cugggcagcgcugcccauuuauuuauauguagauuuuaaacacugcuguugacaaguugguuug

SEQ ID NO: 141030 - RNA, 64 nt, Homo Sapiens
guuuucuccugcagugcuuuugaguuuuaauguuuuuaaacaaaaaaauguauuuauauucacc

SEQ ID NO: 141031 - RNA, 64 nt, Homo Sapiens
auggaaaucaaugaaaaagagaaauauccaaagguuuaaacaagccuuguggaaucugaagauu

SEQ ID NO: 141032 - RNA, 64 nt, Homo Sapiens
aaaccauaaaaaguguauuuccauacaguucucuuuuaaacaucaacauuguuuaauuaaaaua

SEQ ID NO: 141033 - RNA, 64 nt, Homo Sapiens
guuuaauuaaaauaccauacaaugaaaaguuuauuuuaaacauuaauuuuagacucucauucac

SEQ ID NO: 141034 - RNA, 64 nt, Homo Sapiens
uacugaaugacagacuauuacuacguuugccaguuuuaaacagcuuuauuuauguucauguccu

SEQ ID NO: 141035 - RNA, 64 nt, Homo Sapiens
cuuaagaugaauacaccugccuuuggaucaacuauuuaaacauuguaugcauuuugauuuuucc

SEQ ID NO: 141036 - RNA, 64 nt, Homo Sapiens
uaaacaaauggggacaaugcauccaaaaaaucuuuuuaaacagauuacacaaaaauuauuucca

SEQ ID NO: 141037 - RNA, 64 nt, Homo Sapiens
uuaggaguuacuuuauguauuguugaaagcaaauuuuaaacaugauguuuuagaaguguuucug

SEQ ID NO: 141038 - RNA, 64 nt, Homo Sapiens
ggacuauuuggugguuuaaaaaaagggucagacuuuuaaacacucugaccauagaaauguuuuu

SEQ ID NO: 141039 - RNA, 64 nt, Homo Sapiens
auagacauucaugucagaucccauaugggggauuuuuaaacauuucuuugaacuuugaggccug

SEQ ID NO: 141040 - RNA, 64 nt, Homo Sapiens
uuuuagcccaauuuucuugaugugguuuuuuuuuuuuaaacaaagauucuuuuacuuauuuuuu

SEQ ID NO: 141041 - RNA, 64 nt, Homo Sapiens
cauuugauuacagccaccaaggggaaugaggaauuuuaaacacaugcagcuagaacccuacagu

SEQ ID NO: 141042 - RNA, 64 nt, Homo Sapiens
uuucagauucuguugacauuuuaaggauuguuucuuuaaacaacccaaaaguuaaauauucuag

SEQ ID NO: 141043 - RNA, 64 nt, Homo Sapiens
guggcacaaacauaguuuuucuuuauuacaguaauuuaaacaauuuuaugcuuaugcaguuagu

SEQ ID NO: 141044 - RNA, 64 nt, Homo Sapiens
gcuggggagugggaggggggagaaaaggaauguauuuaaacaauuuccgaugcccaugaugagu

SEQ ID NO: 141045 - RNA, 64 nt, Homo Sapiens
aggaacugugaggcuuugucauuuagcauuagacuuuaaacaagaauuaaaaucaugugcugua

SEQ ID NO: 141046 - RNA, 64 nt, Homo Sapiens
acgaugggaucauucugaacauauuuuguuuguuuuuaaacaaauguuuucuguguauacaugg

SEQ ID NO: 141047 - RNA, 64 nt, Homo Sapiens
agagcuggaguggggcuggaaaguaguuuauggauuuaaacauuaccuggugauguuagaagac

SEQ ID NO: 141048 - RNA, 64 nt, Homo Sapiens
uuguuuagaauuugcuucccauuuugcaccagccuuuaaacacuuuucgugaagaaauuuugca

SEQ ID NO: 141049 - RNA, 64 nt, Homo Sapiens
uaaaacauuuuuagguuuuacagagauuuuaaccuuuaaacaacagaucuuuaaaaaacaggug

SEQ ID NO: 141050 - RNA, 64 nt, Homo Sapiens
ggcaacuucuaacuuugcuccaagccacucucuuuuuaaacagcaacaauuuaaagcuaugaag

SEQ ID NO: 141051 - RNA, 64 nt, Homo Sapiens
uggacucaaugacaaagaccgagucuucuuuuuuuuuaaacaaaaacaaaaaaagcaaccaggg

SEQ ID NO: 141052 - RNA, 64 nt, Homo Sapiens
uuaaacuuuaaauuuucugagcagcauuuugguauuuaaacauuucuuguaaaaagcugagaca

SEQ ID NO: 141053 - RNA, 64 nt, Homo Sapiens
cauaccaguguuuuaaaagguauuuuuauguguuuuuaaacacuuuuuuaaaugagccugacac

SEQ ID NO: 141054 - RNA, 64 nt, Homo Sapiens
ccauuguguuacugcuguuguuaauaaaauaaccuuuaaacaguaaaccuugaacugaaaauau

SEQ ID NO: 141055 - RNA, 64 nt, Homo Sapiens
aaacggaaggcauuugaugcuuaaaaaaucaccuuuuaaacaagcaucuauagacaauagacua

SEQ ID NO: 141056 - RNA, 64 nt, Homo Sapiens
guuucuauuaaacuagaaagcacggcuuagaauauuuaaacauuuuuuaauucuacuuauaauc

SEQ ID NO: 141057 - RNA, 64 nt, Homo Sapiens
cauucccagucauccuggugcagauuuagccauuuuuaaacagaaucuaauuaccuuaaacaag

SEQ ID NO: 141058 - RNA, 64 nt, Homo Sapiens
guauauguaaaaggugaaagugaaucagcaucauuuuaaacaaagcaccggaauuccuuuggga

SEQ ID NO: 141059 - RNA, 64 nt, Homo Sapiens
gagguaguuuugaauggcauaccucaagguauaauuuaaacagugauguuuacauaauuuuagc

SEQ ID NO: 141060 - RNA, 64 nt, Homo Sapiens
cagugguuauagacucuuucaguuguuucaacauuuuaaacaaauguuucaccaguacagugaa

SEQ ID NO: 141061 - RNA, 64 nt, Homo Sapiens
aaugaaucauuacuguguauaaaucaccucuuguuuuaaacaagaaaaucccaaucccaagucg

SEQ ID NO: 141062 - RNA, 64 nt, Homo Sapiens
auucuacuacucauuggauugccggggaugucccuuuaaacagacugcugccuucagcuaaaaa

SEQ ID NO: 141063 - RNA, 64 nt, Homo Sapiens
caguaucauuauucagacuucaaauugugaaucuuuuaaacaucuugauaauuuguuguugaga

SEQ ID NO: 141064 - RNA, 64 nt, Homo Sapiens
aaggguuaucuuagauguuucacaccggaagguuuuuaaacacuaaaauauauaauuuauaguu

SEQ ID NO: 141065 - RNA, 64 nt, Homo Sapiens
gccaguaugauuuauaaaugcaaucuccccuugauuuaaacacacagauacacacacacacaca

SEQ ID NO: 141066 - RNA, 64 nt, Homo Sapiens
gucacaauuucucuugauauuaagcuggguugucuuuaaacaacccuaaauacacgucuguuua

SEQ ID NO: 141067 - RNA, 64 nt, Homo Sapiens
acuaccuuugcaaaaacaaaauaccccaaagauauuuaaacaagguuauaauuuagcaucuucc

SEQ ID NO: 141068 - RNA, 64 nt, Homo Sapiens
auuuacccuacuuaucccucucuuuagaaugcuguuuaaacaccuuuagaaugcuuuaauccuu

SEQ ID NO: 141069 - RNA, 64 nt, Homo Sapiens
aaaacguuaaauaacuugggcaaugggcccaccuuuuaaacaagugauuuauuuucuuaagugc

SEQ ID NO: 141070 - RNA, 64 nt, Homo Sapiens
uggaguagcugagguuaaacaaacaaaaaaaaauuuuaaacaaagaaaggaaaaaaauugacaa

SEQ ID NO: 141071 - RNA, 64 nt, Homo Sapiens
aaaaauuauuaauagcucagguuaaaaacacccauuuaaacaaaaacaagagcauuuguaauag

SEQ ID NO: 141072 - RNA, 64 nt, Homo Sapiens
ggagguggagguugcagugaaagcaggagaaucguuuaaacacauccagcuacucaggaggcug

SEQ ID NO: 141073 - RNA, 64 nt, Homo Sapiens
agaccccaggagcuuggcuguauaauuggaguauuuuaaacacuuuucaguccgcacaagauga

SEQ ID NO: 141074 - RNA, 64 nt, Homo Sapiens
caaaauaacugacaauaaugaucagacuauaauauuuaaacaugguuuuguuuguuuacaaaua

SEQ ID NO: 141075 - RNA, 64 nt, Homo Sapiens
cuuaguaaauuaucuuucuaugacauugaaagacuuuaaacagccuauacugcaggauuucuga

SEQ ID NO: 141076 - RNA, 64 nt, Homo Sapiens
uuagguauaacagcacaauugguuuuccucuguuuuuaaacauccuuuaucaucuuucacuuuu

SEQ ID NO: 141077 - RNA, 64 nt, Homo Sapiens
ccuuguuuccagauaaguguuuucuugagcccauuuuaaacaaccauaacaaggguguacggcu

SEQ ID NO: 141078 - RNA, 64 nt, Homo Sapiens
uguuuuauuggaaaugcacgugguuucuuaggcuuuuaaacaaauacauggaaugguugaaaga

SEQ ID NO: 141079 - RNA, 64 nt, Homo Sapiens
guuuguuuuggcacuguuuuaaaaacucaaauauuuuaaacauuuguuaaguuggagcuugcac

SEQ ID NO: 141080 - RNA, 64 nt, Homo Sapiens
agagauauccauugaaaagggaugucuagagggauuuaaacagcuccuuuggcacgugccucuc

SEQ ID NO: 141081 - RNA, 64 nt, Homo Sapiens
cauguguaaauugacacaaucacuaaucugguaauuuaaacaauugagauagcaaaaguguuua

SEQ ID NO: 141082 - RNA, 64 nt, Homo Sapiens
ccagggaguaaaauuaccugaaaacguaagaaguuuuaaacagcuuuucacacaaauuagaugc

SEQ ID NO: 141083 - RNA, 64 nt, Homo Sapiens
aaugugagcuuuggauuacuggauuuuuuuuuuuuuuaaacacaccuggagaggacauuugaaa

SEQ ID NO: 141084 - RNA, 64 nt, Homo Sapiens
agaauuguguuacaaaggggagggaagauguccuuuuaaacaguauuuauuggaggugguaauu

SEQ ID NO: 141085 - RNA, 64 nt, Homo Sapiens
gaaaccacauuuuuaaaauucaacuuaguaacuguuuaaacaaaucuguuacugaaagaugaac

SEQ ID NO: 141086 - RNA, 64 nt, Homo Sapiens
uaaaccauugcauaaaugcuauaguguaaaaaaauuuaaacaaguguuaacuuuaaacaguucg

SEQ ID NO: 141087 - RNA, 64 nt, Homo Sapiens
gcuauaguguaaaaaaauuuaaacaaguguuaacuuuaaacaguucgcuacaaguaaaugauua

SEQ ID NO: 141088 - RNA, 64 nt, Homo Sapiens
ccucccagaguacugggauuacaggcucuuucuuuuuaaacauaaaaguuuuaaauugguauua

SEQ ID NO: 141089 - RNA, 64 nt, Homo Sapiens
auugaugcaauuugauauuuuuucauaaucuauauuuaaacaaaauuacaucauugcaucaucu

SEQ ID NO: 141090 - RNA, 64 nt, Homo Sapiens
aaauuaaauaucuauaaaguauauuuucacaaauuuuaaacaaaagauuguuuaaaauaucuug

SEQ ID NO: 141091 - RNA, 64 nt, Homo Sapiens
uuuuguauauaugugauauaugcuuuuauuuccguuuaaacauauauaauuuaauucaagagaa

SEQ ID NO: 141092 - RNA, 64 nt, Homo Sapiens
gucaaaugcuuucccuuuugugauuugucugucuuuuaaacacuaagccacauugaguuuugcu

SEQ ID NO: 141093 - RNA, 64 nt, Homo Sapiens
ucuucuuguuugcaucuuaguugacucauugcaguuuaaacauuaauaauuauuaugucugaug

SEQ ID NO: 141094 - RNA, 64 nt, Homo Sapiens
auauauuuuauuuaaauauauguuacauauuauauuuaaacauacauauuuaacauuuuuuaca

SEQ ID NO: 141095 - RNA, 64 nt, Homo Sapiens
aauaucagagauuuggguaaaagaauggguaauguuuaaacauguggaggcauguggagcuuua

SEQ ID NO: 141096 - RNA, 64 nt, Homo Sapiens
gagccugaauuuuguugcuguauuuaucuuuacuuuuaaacaguagaaauuacacccaaagagg

SEQ ID NO: 141097 - RNA, 64 nt, Homo Sapiens
gguugagauguaaaagguaucagagcaaaauaauuuuaaacaaaauccugaaauuucagauucc

SEQ ID NO: 141098 - RNA, 64 nt, Homo Sapiens
aagaauucacacaacuacuuaaucgucaaccacuuuuaaacauagggucuuaaagaauuuuuuu

SEQ ID NO: 141099 - RNA, 64 nt, Homo Sapiens
ucauuuuucuugaucguuguuauauaaauaagcuuuuaaacaaggacaaucuuauugucaacac

SEQ ID NO: 141100 - RNA, 64 nt, Homo Sapiens
uucuauagaauuaaugaucagagcaaguuuaauuuuuaaacauaaaggucuugguuacacaugu

SEQ ID NO: 141101 - RNA, 64 nt, Homo Sapiens
ugguuacacauguccaugcauuccaguuaacacauuuaaacauauagaaaauucacuucuucuu

SEQ ID NO: 141102 - RNA, 64 nt, Homo Sapiens
aaugcuauagaaauauuuggugguuuuuuuuuuuuuuaaacauccacaguuaagguugggccag

SEQ ID NO: 141103 - RNA, 64 nt, Homo Sapiens
uacugugaaaugaucacuuuguggcagggguacuuuuaaacauaaauguuucuacaaaaguagg

SEQ ID NO: 141104 - RNA, 64 nt, Homo Sapiens
aauguaucuuauuuuugauaauggcucuuaaaucuuuaaacacacacacaaaaucguucuuuac

SEQ ID NO: 141105 - RNA, 64 nt, Homo Sapiens
guguuguccuacagauguccaauuuauuugcauuuuuaaacauuagccuaugauaguaauuuaa

SEQ ID NO: 141106 - RNA, 64 nt, Homo Sapiens
uuacaauugcuuucauucgugaagccgaaacguuuuuaaacaugaauuacauaugaauuauuaa

SEQ ID NO: 141107 - RNA, 64 nt, Homo Sapiens
augcacaacuuuagaauuucuacaaauaaguucuuuuaaacagucuuuuuauuguggauuguga

SEQ ID NO: 141108 - RNA, 64 nt, Homo Sapiens
acaugcuuuagcagagauaacuuaucagggcuaguuuaaacaaauguguauaggaaaggauguu

SEQ ID NO: 141109 - RNA, 64 nt, Homo Sapiens
aaccacaaacagacaaacaauauauagcugugaguuuaaacaaacuuuguaaaaaagaaaaaug

SEQ ID NO: 141110 - RNA, 64 nt, Homo Sapiens
ucuuucugugccacacaaugaauuacaauggaaguuuaaacauuaaggacacuugauauuuuuu

SEQ ID NO: 141111 - RNA, 64 nt, Homo Sapiens; identical to SEQ ID NO: 84377

SEQ ID NO: 141112 - RNA, 64 nt, Homo Sapiens; identical to SEQ ID NO: 84378

SEQ ID NO: 141113 - RNA, 64 nt, Homo Sapiens; identical to SEQ ID NO: 84379

SEQ ID NO: 141114 - RNA, 64 nt, Homo Sapiens; identical to SEQ ID NO: 84380

SEQ ID NO: 141115 - RNA, 64 nt, Homo Sapiens; identical to SEQ ID NO: 84381

SEQ ID NO: 141116 - RNA, 64 nt, Homo Sapiens; identical to SEQ ID NO: 84382

SEQ ID NO: 141117 - RNA, 64 nt, Homo Sapiens; identical to SEQ ID NO: 84383

SEQ ID NO: 141118 - RNA, 64 nt, Homo Sapiens; identical to SEQ ID NO: 84384

SEQ ID NO: 141119 - RNA, 64 nt, Homo Sapiens; identical to SEQ ID NO: 84385

SEQ ID NO: 141120 - RNA, 64 nt, Homo Sapiens; identical to SEQ ID NO: 84386

SEQ ID NO: 141121 - RNA, 64 nt, Homo Sapiens; identical to SEQ ID NO: 84387

SEQ ID NO: 141122 - RNA, 64 nt, Homo Sapiens; identical to SEQ ID NO: 84388

SEQ ID NO: 141123 - RNA, 64 nt, Homo Sapiens; identical to SEQ ID NO: 84389

SEQ ID NO: 141124 - RNA, 64 nt, Homo Sapiens; identical to SEQ ID NO: 84390

SEQ ID NO: 141125 - RNA, 64 nt, Homo Sapiens; identical to SEQ ID NO: 84391

SEQ ID NO: 141126 - RNA, 64 nt, Homo Sapiens; identical to SEQ ID NO: 84392

SEQ ID NO: 141127 - RNA, 64 nt, Homo Sapiens; identical to SEQ ID NO: 84393

SEQ ID NO: 141128 - RNA, 64 nt, Homo Sapiens; identical to SEQ ID NO: 84394

SEQ ID NO: 141129 - RNA, 64 nt, Homo Sapiens; identical to SEQ ID NO: 84395

SEQ ID NO: 141130 - RNA, 64 nt, Homo Sapiens; identical to SEQ ID NO: 84396

SEQ ID NO: 141131 - RNA, 64 nt, Homo Sapiens; identical to SEQ ID NO: 84397

SEQ ID NO: 141132 - RNA, 64 nt, Homo Sapiens; identical to SEQ ID NO: 84398

SEQ ID NO: 141133 - RNA, 64 nt, Homo Sapiens; identical to SEQ ID NO: 84399

SEQ ID NO: 141134 - RNA, 64 nt, Homo Sapiens; identical to SEQ ID NO: 84400

SEQ ID NO: 141135 - RNA, 64 nt, Homo Sapiens; identical to SEQ ID NO: 84401

SEQ ID NO: 141136 - RNA, 64 nt, Homo Sapiens; identical to SEQ ID NO: 84402

SEQ ID NO: 141137 - RNA, 64 nt, Homo Sapiens; identical to SEQ ID NO: 84403

SEQ ID NO: 141138 - RNA, 64 nt, Homo Sapiens; identical to SEQ ID NO: 84404

SEQ ID NO: 141139 - RNA, 64 nt, Homo Sapiens; identical to SEQ ID NO: 84405

SEQ ID NO: 141140 - RNA, 64 nt, Homo Sapiens; identical to SEQ ID NO: 84406

SEQ ID NO: 141141 - RNA, 64 nt, Homo Sapiens; identical to SEQ ID NO: 84407

SEQ ID NO: 141142 - RNA, 64 nt, Homo Sapiens; identical to SEQ ID NO: 84408

SEQ ID NO: 141143 - RNA, 64 nt, Homo Sapiens; identical to SEQ ID NO: 84409

SEQ ID NO: 141144 - RNA, 64 nt, Homo Sapiens; identical to SEQ ID NO: 84410

SEQ ID NO: 141145 - RNA, 64 nt, Homo Sapiens; identical to SEQ ID NO: 84411

SEQ ID NO: 141146 - RNA, 64 nt, Homo Sapiens; identical to SEQ ID NO: 84412

SEQ ID NO: 141147 - RNA, 64 nt, Homo Sapiens; identical to SEQ ID NO: 84413

SEQ ID NO: 141148 - RNA, 64 nt, Homo Sapiens; identical to SEQ ID NO: 84414

SEQ ID NO: 141149 - RNA, 64 nt, Homo Sapiens; identical to SEQ ID NO: 84415

SEQ ID NO: 141150 - RNA, 64 nt, Homo Sapiens; identical to SEQ ID NO: 84416

SEQ ID NO: 141151 - RNA, 64 nt, Homo Sapiens; identical to SEQ ID NO: 84417

SEQ ID NO: 141152 - RNA, 64 nt, Homo Sapiens; identical to SEQ ID NO: 84418

SEQ ID NO: 141153 - RNA, 64 nt, Homo Sapiens; identical to SEQ ID NO: 84419

SEQ ID NO: 141154 - RNA, 64 nt, Homo Sapiens; identical to SEQ ID NO: 84420

SEQ ID NO: 141155 - RNA, 63 nt, Homo Sapiens
ggggagcagaagcacucauagcuuggaaguuggaauuaacaguggagacagccugaguaaaag

SEQ ID NO: 141156 - RNA, 63 nt, Homo Sapiens
cgcuggagcagcccagaggacucucuggacaggaauuaacaaaugaagagggagaugagacag

SEQ ID NO: 141157 - RNA, 63 nt, Homo Sapiens
guuuuuuuauugcuagcuaucauuaccaguuagaauuaacauuaauuacaauuaacaauaauu

SEQ ID NO: 141158 - RNA, 63 nt, Homo Sapiens
cuaucauuaccaguuagaauuaacauuaauuacaauuaacaauaauuuuagguauggaauguu

SEQ ID NO: 141159 - RNA, 63 nt, Homo Sapiens
cacaccaaaaaaagcuguuuauuuguaugauuaaauuaacacauccuuauuguauaaaugaau

SEQ ID NO: 141160 - RNA, 63 nt, Homo Sapiens
agacagaaggccugacuuugcagcaagaagaaaaauuaacaaaggccagucuuaaacgggugu

SEQ ID NO: 141161 - RNA, 63 nt, Homo Sapiens
caaaaagaggagauuaaccuaauagagauggucaauuaacaauccaaauccagccuuuggagg

SEQ ID NO: 141162 - RNA, 63 nt, Homo Sapiens
agaaucucagagaaaagcuguacuguaagucucaauuaacagcagcacucagagacacaaaaa

SEQ ID NO: 141163 - RNA, 63 nt, Homo Sapiens
ccaagucacauuauuuuaccaauggaauuauagaauuaacaguauuuuaaauuacguuuauaa

SEQ ID NO: 141164 - RNA, 63 nt, Homo Sapiens
auauacaauagucucauugaugacuguaaagugaauuaacauuuggugauuaugccuagcuuu

SEQ ID NO: 141165 - RNA, 63 nt, Homo Sapiens
ccccaaucauaauuaagccguauacacagauuaaauuaacagaagcauuucacauaaauguug

SEQ ID NO: 141166 - RNA, 63 nt, Homo Sapiens
guguuacuucacucaaagaacauaaguaacugcaauuaacauauaugaaauuuauuacucugc

SEQ ID NO: 141167 - RNA, 63 nt, Homo Sapiens
agguauauuuuguaaauuuaaaagaucauuuaaaauuaacaucuuaauaguauguuuaauuuu

SEQ ID NO: 141168 - RNA, 63 nt, Homo Sapiens
aggaaucacgagaaagguacguuccugugcagaaauuaacagcaacugcaugagcagcugaau

SEQ ID NO: 141169 - RNA, 63 nt, Homo Sapiens
guaagccuuagcagcaaacaucagccgugugauaauuaacaugcugauuuagaagucaucuuu

SEQ ID NO: 141170 - RNA, 63 nt, Homo Sapiens
acuuaauuugaacaaagugauauuuuauugguaaauuaacauguaaaauguugguuuguuuac

SEQ ID NO: 141171 - RNA, 63 nt, Homo Sapiens
accuaauagacaucuacagaacucuccaccccaaauuaacagaauauacauuuuuuucagcac

SEQ ID NO: 141172 - RNA, 63 nt, Homo Sapiens
aaaugcccacaagagaaagcaggaaagauccaaaauuaacacccuaacaucacaauuaaaaga

SEQ ID NO: 141173 - RNA, 63 nt, Homo Sapiens
agucaguacagcaggggaaaacauaugugaugcaauuaacaucugcauaauuucacuuaaaau

SEQ ID NO: 141174 - RNA, 63 nt, Homo Sapiens
cauauugguguuuucucaauuagucacugagaaaauuaacacuuuaggcaguggcuauuuaaa

SEQ ID NO: 141175 - RNA, 63 nt, Homo Sapiens
aaauuccuuaguacauauacuuggaucauguuaaauuaacaagaaagaugaauaacugcgcug

SEQ ID NO: 141176 - RNA, 64 nt, Homo Sapiens
aucccuggacucccugguccugaggaaggaauggagagagcaggauuggauaggagaaaguugg

SEQ ID NO: 141177 - RNA, 64 nt, Homo Sapiens
auucuguaauccucuugcccagaacuaaugcucaagagagcaagugacagagaggaccagggug

SEQ ID NO: 141178 - RNA, 64 nt, Homo Sapiens
gcacacacuggcucaagcagggggcuagggaagcagagagcagauaagggaugagaaggauggc

SEQ ID NO: 141179 - RNA, 64 nt, Homo Sapiens
gcaugcagugauggaagaagggaaccagggaagcagagagcagaugaggaaacuuuuagguggu

SEQ ID NO: 141180 - RNA, 64 nt, Homo Sapiens
gcauaugcugacccaugcagaggacagaggagguagagagcaggaggaggcugcaggcaguguc

SEQ ID NO: 141181 - RNA, 64 nt, Homo Sapiens
ccaaucagucccucaggaaagggaauugaauagcagagagcaaaugcaggaacaagugggcuug

SEQ ID NO: 141182 - RNA, 64 nt, Homo Sapiens
ccccccaaaaaaaagaaaaaccucaacugcagucagagagcaagaaggccaggacccuggggcc

SEQ ID NO: 141183 - RNA, 64 nt, Homo Sapiens
agcuaacuuuuuuuuccuaggcuugugacuaugaagagagcaaaguagaaaagucacaagauga

SEQ ID NO: 141184 - RNA, 64 nt, Homo Sapiens
caggugggugguuucacaucgaaagucaccaccgagagagcaccuuuauuugaucccuugaaca

SEQ ID NO: 141185 - RNA, 64 nt, Homo Sapiens
aggucuauagaaacaucaugcugcauugucaccuagagagcaaguaaacaccuuugcccuggcu

SEQ ID NO: 141186 - RNA, 64 nt, Homo Sapiens
ccaguugauuuuuuaauucacuuuucaggugggaagagagcaaaauauauuaaugcagucaucc

SEQ ID NO: 141187 - RNA, 64 nt, Homo Sapiens
ggcuggcucaggcaucgucucccgcaaugggcagagagagcagagacagguggaccaacagaca

SEQ ID NO: 141188 - RNA, 64 nt, Homo Sapiens
ccuggccuagccucucuguccuucccugagucacagagagcaagccaagacauccagggaaaga

SEQ ID NO: 141189 - RNA, 64 nt, Homo Sapiens
uucccuuggcucuggggccgggcuugcaacccagagagagcagcuucuugcugcaaaacugguu

SEQ ID NO: 141190 - RNA, 64 nt, Homo Sapiens
gcauccuggcaucugcgaucuucaccccauugggagagagcaggacagccccgaagguccugcc

SEQ ID NO: 141191 - RNA, 64 nt, Homo Sapiens
agcaaugacaucucaggggccagaggaacuguccagagagcaacucugagaucuaaggauguca

SEQ ID NO: 141192 - RNA, 64 nt, Homo Sapiens
gggccaacuugagggcccagagcaggaagcauucagagagcagcuuuaaacucagggacagagc

SEQ ID NO: 141193 - RNA, 64 nt, Homo Sapiens
gggucugggaagagguaagacucucugauaauucagagagcauuccuuuacuggguucuaaaug

SEQ ID NO: 141194 - RNA, 64 nt, Homo Sapiens
agugccuggccaggucggucgacuggcaaggacuagagagcagggccucuuggagacagaugau

SEQ ID NO: 141195 - RNA, 64 nt, Homo Sapiens
acuccgcaucaccucaccaaaggacgccugcaggagagagcagcccaaccugcucuguccccaa

SEQ ID NO: 141196 - RNA, 64 nt, Homo Sapiens
ucccuuucucaggagcuuggagacuaaaggauccagagagcagcucaagacccccauuuguccc

SEQ ID NO: 141197 - RNA, 64 nt, Homo Sapiens
gcccucucugggcccaccaccugcaucugcgacuagagagcacccggcccacguuggguucuca

SEQ ID NO: 141198 - RNA, 64 nt, Homo Sapiens
gcaacugacauacuugauggaggauugauucgguagagagcaguagaaaucuuguucuaacugu

SEQ ID NO: 141199 - RNA, 64 nt, Homo Sapiens
cuggggccuccgugucggggagagucagccuuggagagagcaccaggcagggcaggggaagcga

SEQ ID NO: 141200 - RNA, 64 nt, Homo Sapiens
guggucgcccucugcagccauagggcgcgggaggagagagcacugcccacuugccccacugugc

SEQ ID NO: 141201 - RNA, 64 nt, Homo Sapiens
gaagcuucaaaacauugauaaguagguuuaccagagagagcaaggucucaucuaguaccuuugg

SEQ ID NO: 141202 - RNA, 64 nt, Homo Sapiens
uuucuaugguacccuguguuuggccucgugcuguagagagcagacuaaauucuagaaaguacuu

SEQ ID NO: 141203 - RNA, 64 nt, Homo Sapiens
ugucuaauacaauaaaaacuagucuucgauucucagagagcauuugggccugucuaccuuuaga

SEQ ID NO: 141204 - RNA, 64 nt, Homo Sapiens
gcccagacaagcagcugggucuagcugcggugugagagagcaugggagagucgccgcagaugac

SEQ ID NO: 141205 - RNA, 64 nt, Homo Sapiens
gcccaggccugcuggcaucacaggccagguagcaagagagcagccuugucauccucccuugccc

SEQ ID NO: 141206 - RNA, 64 nt, Homo Sapiens
caggggcaucugucugucugcacguagguuccccagagagcaggagggccaggcagaauggcug

SEQ ID NO: 141207 - RNA, 64 nt, Homo Sapiens
ucaauguguacuucagacacguucaccuguagacagagagcagaggucagcaggcucaucugug

SEQ ID NO: 141208 - RNA, 64 nt, Homo Sapiens
agagcacaguagcccagccuuccaugugggagagagagagcaugcugggagcuauuuacaaaug

SEQ ID NO: 141209 - RNA, 64 nt, Homo Sapiens
caguauucaauuuauugcaguuauagaauuggucagagagcauuuucauagugugcucauuucu

SEQ ID NO: 141210 - RNA, 64 nt, Homo Sapiens
gaguuacuaaggccuucagugaacagaaaggagcagagagcaagauuagaucugagaagaugcu

SEQ ID NO: 141211 - RNA, 64 nt, Homo Sapiens
cugaguaaggggcuuuguugaaagaggggguuagagagagcaagacagcacuugagugcacugg

SEQ ID NO: 141212 - RNA, 64 nt, Homo Sapiens
cagcaggugcucagcaauaugcucugagcaggacagagagcaugcagccuccauccagguacug

SEQ ID NO: 141213 - RNA, 64 nt, Homo Sapiens
aguggauguugcagaaucucguuuugcaaggcucagagagcaaaguuagggacugauugugcag

SEQ ID NO: 141214 - RNA, 64 nt, Homo Sapiens
cugagaauagacuucaucaugugcuucagaagaaagagagcaugggcauguguuucaucgggaa

SEQ ID NO: 141215 - RNA, 64 nt, Homo Sapiens
cuuucuguagguugguuccuguauaccuugggccagagagcaaacauagguggccugagagagc

SEQ ID NO: 141216 - RNA, 64 nt, Homo Sapiens
uuccagcuucggaagccccugcagccuugccuccagagagcagaucuguacagaggcuguuugg

SEQ ID NO: 141217 - RNA, 64 nt, Homo Sapiens
cccugugguggcaggagguggcggggggugggggagagagcagggcagggggacaaguauucug

SEQ ID NO: 141218 - RNA, 64 nt, Homo Sapiens
gugaugaggagacugagcgucacaccuguaucccagagagcaaagggaaaaugaacguccagga

SEQ ID NO: 141219 - RNA, 64 nt, Homo Sapiens
gccaggggucuuggugcucccccgugacccacccagagagcaagccuccugcggcagaacagca

SEQ ID NO: 141220 - RNA, 64 nt, Homo Sapiens
ugaaaguuucaaaaacuuuggagagcacuacuugagagagcaguaauucuagucuucacgcuga

SEQ ID NO: 141221 - RNA, 64 nt, Homo Sapiens
acuugagagagcaguugaaauagucuucacgcugagagagcacuauauggguuuuaacaaauuc

SEQ ID NO: 141222 - RNA, 64 nt, Homo Sapiens
acccugagugugauucugggaucuguggacuugagcguccaaaaccucgucugggcaccucagc

SEQ ID NO: 141223 - RNA, 64 nt, Homo Sapiens
ggagucagguuuucuauuccccccaaaggccugugcguccaaguggggcccuggugucagaacu

SEQ ID NO: 141224 - RNA, 64 nt, Homo Sapiens
uggagauugcccuucccuaugcggggcgggggcugcguccaacccagaacaggagucaaccuug

SEQ ID NO: 141225 - RNA, 64 nt, Homo Sapiens
gcaagaagagacugauugaggauacugaagacuggcguccaaggacuggaacaacucagucucg

SEQ ID NO: 141226 - RNA, 64 nt, Homo Sapiens
ccggggcauggacagggccauguccuacccgcccgcguccaaccuuagugucuguccaucuguc

SEQ ID NO: 141227 - RNA, 64 nt, Homo Sapiens
ugauuuucauuguaaauauuugacuuuagugaaagcguccaauugacugcccucuuacuguuuu

SEQ ID NO: 141228 - RNA, 64 nt, Homo Sapiens
ccuggggacaaagcagcgucuggcucgaguggaagcguccaaaccugcuuuucccaucuccccc

SEQ ID NO: 141229 - RNA, 64 nt, Homo Sapiens
aguuuacuuccuaagccuuugagccggcccuuccgcguccaagacucacucggcggaaacccgc

SEQ ID NO: 141230 - RNA, 64 nt, Homo Sapiens
agaauguuauagcgagugcucuuuuccaccaccugcguccaaaauccuccgccuguuuuuuaaa

SEQ ID NO: 141231 - RNA, 64 nt, Homo Sapiens
ggugacccagacucguaaauccccggugcagcuggcguccaaagaggcccagacucguaaauga

SEQ ID NO: 141232 - RNA, 64 nt, Homo Sapiens
cucagaacguuccaggccuuggugagacacagcagcguccaaugcucacaggcuguccccacuc

SEQ ID NO: 141233 - RNA, 64 nt, Homo Sapiens
gcucccaugccacacagugagaacuguagccucugcguccaaggcacacaggguacuuucugga

SEQ ID NO: 141234 - RNA, 64 nt, Homo Sapiens
ugaagccuucuggaggagaaggugacguggcccagcguccaagggacagacucagcuccaggcu

SEQ ID NO: 141235 - RNA, 64 nt, Homo Sapiens
cugauuaguggaucacguagcuacuuucccugucgcguccaauucacuauuugcccagaagcuu

SEQ ID NO: 141236 - RNA, 64 nt, Homo Sapiens
gccugugacucuucccuggacugccacccaggcugcguccaacagagggugaugacccugcccu

SEQ ID NO: 141237 - RNA, 64 nt, Homo Sapiens
cacagagcugcuuccccacgagcagcaggcaacggcguccaaggagacuaggaugaguucuugg

SEQ ID NO: 141238 - RNA, 64 nt, Homo Sapiens
cuggggcccacccuucucacuuuagaggacuucagcguccaagaggcugugucucugccuuguc

SEQ ID NO: 141239 - RNA, 64 nt, Homo Sapiens
accugauucaggguuagcagcaaugaguaucacagcguccaacucaguagcuccaguguaugaa

SEQ ID NO: 141240 - RNA, 64 nt, Homo Sapiens
gccgcuguggugacggaagccaggaggcaggcgcgcguccaaauccagacguucuccgcgggug

SEQ ID NO: 141241 - RNA, 64 nt, Homo Sapiens
ucagaguuugcaaauaaaggccgccucgggcaccgcguccaaccggagagaaacgugacacugu

SEQ ID NO: 141242 - RNA, 64 nt, Homo Sapiens
agcugaagguggugaaauuuucauucagaagaaggcguccaaggagacugugauuuugauagcg

SEQ ID NO: 141243 - RNA, 64 nt, Homo Sapiens
ucuuuucggagaaauugaaauaagcucuuugcaggcguccaauccuagaaaccaauggucucca

SEQ ID NO: 141244 - RNA, 64 nt, Homo Sapiens
cacgcgugugcuccucuccuaauguggagugucugcguccaauagggugcaggaaagguucaca

SEQ ID NO: 141245 - RNA, 64 nt, Homo Sapiens
ccaugcucucugcgggucaggcugucaccacugugcguccaaggacgggggacacuuggaggcu

SEQ ID NO: 141246 - RNA, 64 nt, Homo Sapiens
aggcagagccaggaagcuaagccagggcccagcugcguccaacccagccccccaccucgggucc

SEQ ID NO: 141247 - RNA, 64 nt, Homo Sapiens
aaaaaaaaauagccgugcacucuugaccccgucagcguccaacguggaaaaggcguuaccucuu

SEQ ID NO: 141248 - RNA, 64 nt, Homo Sapiens; identical to SEQ ID NO: 51693

SEQ ID NO: 141249 - RNA, 64 nt, Homo Sapiens; identical to SEQ ID NO: 51694

SEQ ID NO: 141250 - RNA, 64 nt, Homo Sapiens; identical to SEQ ID NO: 51695

SEQ ID NO: 141251 - RNA, 64 nt, Homo Sapiens; identical to SEQ ID NO: 51696

SEQ ID NO: 141252 - RNA, 64 nt, Homo Sapiens; identical to SEQ ID NO: 51697

SEQ ID NO: 141253 - RNA, 64 nt, Homo Sapiens; identical to SEQ ID NO: 51698

SEQ ID NO: 141254 - RNA, 64 nt, Homo Sapiens; identical to SEQ ID NO: 51699

SEQ ID NO: 141255 - RNA, 64 nt, Homo Sapiens; identical to SEQ ID NO: 51700

SEQ ID NO: 141256 - RNA, 64 nt, Homo Sapiens; identical to SEQ ID NO: 51701

SEQ ID NO: 141257 - RNA, 64 nt, Homo Sapiens; identical to SEQ ID NO: 51702

SEQ ID NO: 141258 - RNA, 64 nt, Homo Sapiens; identical to SEQ ID NO: 51703

SEQ ID NO: 141259 - RNA, 64 nt, Homo Sapiens; identical to SEQ ID NO: 51704

SEQ ID NO: 141260 - RNA, 64 nt, Homo Sapiens; identical to SEQ ID NO: 51705

SEQ ID NO: 141261 - RNA, 64 nt, Homo Sapiens
gugccggcccuccuggugcucuauccacugcagggccagccacucgccaggaggccacgggcca

SEQ ID NO: 141262 - RNA, 64 nt, Homo Sapiens
aggaggccacgggccacgggaagaaccaagcggugccagccacgagacgucaccaagaaaacau

SEQ ID NO: 141263 - RNA, 64 nt, Homo Sapiens
gcccaggcagcuuugacugcugaagggagagccagccagccaggggcuccuggggggagcaggc

SEQ ID NO: 141264 - RNA, 64 nt, Homo Sapiens
cagggcccaggcagcuuugaaggcugaagggagagccagccagcucagggcuccuggggggagc

SEQ ID NO: 141265 - RNA, 64 nt, Homo Sapiens
aagcugcaaaagaaaggcagcccauuuuaccauugccagccaggccggggacacaggagccggu

SEQ ID NO: 141266 - RNA, 64 nt, Homo Sapiens
gcucaguguggggcguggcagggggguaaaugaagccagccaauguguuaaccugucucuguca

SEQ ID NO: 141267 - RNA, 64 nt, Homo Sapiens
guggauaaauuuuuuguaaucuuuauuuuugaaggccagccaguaaaauggcccaaugugccag

SEQ ID NO: 141268 - RNA, 64 nt, Homo Sapiens
uuuuugaaggccagccaguaaaauggcccaaugugccagccaggcuuauguggccuuguuuuca

SEQ ID NO: 141269 - RNA, 64 nt, Homo Sapiens
ugcagggccucuugcugcuugugcuguccagccagccagccagcaugcagccaccugcuuaacu

SEQ ID NO: 141270 - RNA, 64 nt, Homo Sapiens
cagcugcagggccucuugcuaacugugcuguccagccagccagcgaggaugcagccaccugcuu

SEQ ID NO: 141271 - RNA, 64 nt, Homo Sapiens
uaagccaaucggggaugcagucagcauccuccuggccagccacaugcaauaagcucucagacca

SEQ ID NO: 141272 - RNA, 64 nt, Homo Sapiens
aguucccuuccagcucccaccuuugugcaggcuggccagccaagcugugaaaugugcugcuccc

SEQ ID NO: 141273 - RNA, 64 nt, Homo Sapiens
ggccuuucuucccaccccaaguccaagaacaaaugccagccacguccuccgccacuuggagaga

SEQ ID NO: 141274 - RNA, 64 nt, Homo Sapiens
cugacuuggcccacugcuaagcggcagaggcagggccagccauccugucgcaagcccgugcugg

SEQ ID NO: 141275 - RNA, 64 nt, Homo Sapiens
uggcuucccuucucagccucauguccaccugccugccagccaggcuacaggugugacuuccuuc

SEQ ID NO: 141276 - RNA, 64 nt, Homo Sapiens
ccuaucaaccgcccccagugauaacaucugugaagccagccauuacucaauaaacugcaaacuu

SEQ ID NO: 141277 - RNA, 64 nt, Homo Sapiens
cccacauuccaaggugagauacauccggauagaugccagccaccaacuguuucuguuucaucug

SEQ ID NO: 141278 - RNA, 64 nt, Homo Sapiens
ccgagccaggaggacgugagcagcuccccgagcugccagccagccgcauggacguuucauccaa

SEQ ID NO: 141279 - RNA, 64 nt, Homo Sapiens
aggugauaaccacccucccauacuuccccaagcugccagccaggcccgccgucuuccaaagccu

SEQ ID NO: 141280 - RNA, 56 nt, Homo Sapiens
ccaccgagguccaaguaugauccugggccagccacaaggccucccugcauggauag

SEQ ID NO: 141281 - RNA, 64 nt, Homo Sapiens
ccaggagggagugcagagcaucagucacuagugcgccagccagggaugucugcacugagccagu

SEQ ID NO: 141282 - RNA, 64 nt, Homo Sapiens
cccucuggccugcuggcaaucuggagccaacaccgccagccaccggcuggccccuugggucaga

SEQ ID NO: 141283 - RNA, 64 nt, Homo Sapiens
cuaccagugcaggcuggccaugccuggccggccagccagccacucaucugcccgccugcccacc

SEQ ID NO: 141284 - RNA, 64 nt, Homo Sapiens
cacucuaccagugcaggcugcaccugccuggccggccagccagcuguccaucugcccgccugcc

SEQ ID NO: 141285 - RNA, 64 nt, Homo Sapiens
uuucccugugucuggcuagaucacccaacagccagccagccacauuggcucccaaggaacugga

SEQ ID NO: 141286 - RNA, 64 nt, Homo Sapiens
cacauuucccugugucuggcuggaucacccaacagccagccagcaacauuggcucccaaggaac

SEQ ID NO: 141287 - RNA, 64 nt, Homo Sapiens
uccggacccuucccuuagggcggugccgcggagggccagccagauuuguucuggguggaagcag

SEQ ID NO: 141288 - RNA, 64 nt, Homo Sapiens
gugcaacugcccaagcuccaaccuggccaagggagccagccagcgauuccacaauggaggggag

SEQ ID NO: 141289 - RNA, 64 nt, Homo Sapiens
cuucaagaucuaccggacugagauggcacccggggccagccagggugagugccugugcucugug

SEQ ID NO: 141290 - RNA, 64 nt, Homo Sapiens
cagugacucuggggcuaccuggcuccuaggcccagccagccagagaggacaguggagcccagac

SEQ ID NO: 141291 - RNA, 64 nt, Homo Sapiens
cugggaaauacauaaaagagucuaaggugacuaugccagccaacuuuccacauuugggggcuau

SEQ ID NO: 141292 - RNA, 64 nt, Homo Sapiens
gcaaagaaugcacucugcagugggccccucugaggccagccaagagacaaacugcuguggccag

SEQ ID NO: 141293 - RNA, 64 nt, Homo Sapiens
cauuguuaaucauccaucacgaacaaaauguaaagccagccauggauggccaagcaauuccucu

SEQ ID NO: 141294 - RNA, 64 nt, Homo Sapiens
agguaccccgauggccaagcggaggcauucuguggccagccaaaccuucugaggagaggcaaca

SEQ ID NO: 141295 - RNA, 64 nt, Homo Sapiens
cugcuggcucgccuggcaccaccacacggccacagccagccaucugcucugccaggguggcacc

SEQ ID NO: 141296 - RNA, 64 nt, Homo Sapiens
uggaggucauugggagugagcagauguggggguggccagccaggcuggccgcacuccaucacug

SEQ ID NO: 141297 - RNA, 64 nt, Homo Sapiens
cuuggccgccauccgggacgcuuccagaccaccugccagccaucacaaggggaacgcagaggcg

SEQ ID NO: 141298 - RNA, 64 nt, Homo Sapiens
agcccuagguggggccaggaggugccuuggagaagccagccagagcagagagggcugcugacuu

SEQ ID NO: 141299 - RNA, 64 nt, Homo Sapiens
cagaacuaggggcucagagccagagcuggcagccgccagccaaaaugaugccauugccugagcu

SEQ ID NO: 141300 - RNA, 50 nt, Homo Sapiens
uggugcaguaccugacaugagccagccacgcucaguggcugaacagcauu

SEQ ID NO: 141301 - RNA, 64 nt, Homo Sapiens
guucccuucucuucccugaaauauauuagcaccugccagccaggcccucauuuugcccagccag

SEQ ID NO: 141302 - RNA, 64 nt, Homo Sapiens
agcucccagguaccaaaaagcuuggccaacgcuugccagccagccagcugcagguggcaucugc

SEQ ID NO: 141303 - RNA, 64 nt, Homo Sapiens
cccagguaccaaaaagcuuggccaacgcuugccagccagccagcugcagguggcaucugccacg

SEQ ID NO: 141304 - RNA, 64 nt, Homo Sapiens
cuccucggaggagaagucaggcugacguuggagagccagccagacagucauuucuuucaggcca

SEQ ID NO: 141305 - RNA, 64 nt, Homo Sapiens
gccucuggggagccagucaugucgucauuugagagccagccacauugcacagagaaagccagcu

SEQ ID NO: 141306 - RNA, 64 nt, Homo Sapiens
ugacuuugcaccuccuuuuuuccccaaacacuuugccagccacugguggucccugcuuuucuga

SEQ ID NO: 141307 - RNA, 64 nt, Homo Sapiens
gccugggaaugaguguuacugcagcaucugggcugccagccacagggaagggccaagccccaug

SEQ ID NO: 141308 - RNA, 64 nt, Homo Sapiens
cuaccaccucgccuugacccugaagucagagcaggccagccaagcaggaagcacacuguuuacu

SEQ ID NO: 141309 - RNA, 64 nt, Homo Sapiens
ggcagaacugaagcccucucggccccuacccuaagccagccaccccucuucacagugggugagc

SEQ ID NO: 141310 - RNA, 64 nt, Homo Sapiens
cugcucuggguggugguggauagguggacagacggccagccagccagcuguggccgggggcccg

SEQ ID NO: 141311 - RNA, 64 nt, Homo Sapiens
ucuggguggugguggauagguggacagacggccagccagccagcuguggccgggggcccggcuc

SEQ ID NO: 141312 - RNA, 64 nt, Homo Sapiens
ccucuucgggcccugaauuuucuguucccugggggccagccagggcccuuugugccccucccag

SEQ ID NO: 141313 - RNA, 64 nt, Homo Sapiens
gcccuuucuuuucuccauggcugaugcugcuguggccagccagggcccuugagauccuuccagu

SEQ ID NO: 141314 - RNA, 64 nt, Homo Sapiens
cagccccuuucucaagcagagaccuggccccugggccagccagauggaagggccuaucuuagcc

SEQ ID NO: 141315 - RNA, 64 nt, Homo Sapiens
cuggagcuuaagccaaaccuguucugucccacuggccagccaucuuugcucacauggaaauuca

SEQ ID NO: 141316 - RNA, 64 nt, Homo Sapiens
auuaauuaaauagcuuuugugucuuacauugguagccagccagccaaggcucuguuuaugcuuu

SEQ ID NO: 141317 - RNA, 64 nt, Homo Sapiens
auuaaauagcuuuugugucuuacauugguagccagccagccaaggcucuguuuaugcuuuuggg

SEQ ID NO: 141318 - RNA, 64 nt, Homo Sapiens
aggacaggagacccuaaggccccgggagcccagugccagccagagguugugcaggcaaggagac

SEQ ID NO: 141319 - RNA, 64 nt, Homo Sapiens
aagcaacucaacagaugccaaugccaauuccaaggccagccacaacccugccaccuuggggaau

SEQ ID NO: 141320 - RNA, 64 nt, Homo Sapiens
uuggggaauccagccuggaggcauccccuaagcagccagccauggccuggguggaggcaccuga

SEQ ID NO: 141321 - RNA, 64 nt, Homo Sapiens
cuaauaugguaaaaagauaaagcaucaaagcaguauuucucauuccugccuccucaauaucuaa

SEQ ID NO: 141322 - RNA, 64 nt, Homo Sapiens
ugucaaguaaaaccaucagaccuacuguucuuguauuucucauuuaacuuuacuguuaagacau

SEQ ID NO: 141323 - RNA, 64 nt, Homo Sapiens
uuguggguacauuuuuguucuuuacuccuaaguuauuucucauagaacccagccuacucuagaa

SEQ ID NO: 141324 - RNA, 64 nt, Homo Sapiens
aaugaucugccauaacaugugguaacaauaguucauuucucauaacauauaugagguauacaaa

SEQ ID NO: 141325 - RNA, 64 nt, Homo Sapiens
gggagaguaagguacccccaagaggaaauuuagaauuucucauuguggaggcaccaggcucaaa

SEQ ID NO: 141326 - RNA, 64 nt, Homo Sapiens
ugucaucagccugguggggccuuuggguggaugcauuucucaauacuccgacacagaguuccug

SEQ ID NO: 141327 - RNA, 64 nt, Homo Sapiens
caguuggauccagaaaccagaauaucuaguugauauuucucauugaucuaguugauauuuaaac

SEQ ID NO: 141328 - RNA, 64 nt, Homo Sapiens
aauucccauuuuguggcuaaaauguucucuguuuauuucucaugaugucuuuuacauagcuaau

SEQ ID NO: 141329 - RNA, 64 nt, Homo Sapiens
accuucguccagagugcucugguuugcaccaugcauuucucagggguccgcauuucucaugcuu

SEQ ID NO: 141330 - RNA, 64 nt, Homo Sapiens
ucugguuugcaccaugcauuucucagggguccgcauuucucaugcuuuucuauaagaucuacac

SEQ ID NO: 141331 - RNA, 64 nt, Homo Sapiens
gggcaacuuuauuuucuaauacaauuaaacaauuauuucucagacuuggaaaaaaaauauaaua

SEQ ID NO: 141332 - RNA, 64 nt, Homo Sapiens
ggagcagggcgugguggcaccauuuuacucauuuauuucucagacaucucacucacagggggug

SEQ ID NO: 141333 - RNA, 64 nt, Homo Sapiens
cuuaugagcuugcuguauuuaaagcaacuguacaauuucucagcuauuuagagcacaguuuuuu

SEQ ID NO: 141334 - RNA, 64 nt, Homo Sapiens
agggccuauguuuauauauauagaauuuaugacgauuucucagcuguaacuguugaaauuauuu

SEQ ID NO: 141335 - RNA, 64 nt, Homo Sapiens
agaugcuguugugccuauaucaugaaguacauuaauuucucauguaaaaaaaauagcucuaaaa

SEQ ID NO: 141336 - RNA, 64 nt, Homo Sapiens
acacagcuuucccuucaaagagccauugagaaacauuucucaaacaggaaauccuucuuuuacu

SEQ ID NO: 141337 - RNA, 64 nt, Homo Sapiens
uuuugugaccaguuucugucugcauguaauuuggauuucucaaauacauucauuaguaauuuau

SEQ ID NO: 141338 - RNA, 64 nt, Homo Sapiens
cuaccuauaacaugaggaauauaacauugcagaaauuucucauaggggcaugccagugagcaau

SEQ ID NO: 141339 - RNA, 64 nt, Homo Sapiens
aagaaaaagacaguacauggugggaaagcugcacauuucucacaaggaaaaaaacauucuauau

SEQ ID NO: 141340 - RNA, 64 nt, Homo Sapiens
cgcuuccauggucuugcacuauaaacuggaauggauuucucaaugcgggaccagauuaugacua

SEQ ID NO: 141341 - RNA, 64 nt, Homo Sapiens
cccucuggaguucagaacuuaaguaucagugcaaauuucucaaccuuucuggguuagacaaaga

SEQ ID NO: 141342 - RNA, 64 nt, Homo Sapiens
aaaggugaauuucaacacauuuagugccucuuucauuucucaguauauauuucaagagcuugug

SEQ ID NO: 141343 - RNA, 64 nt, Homo Sapiens
aaaccaaauauugcaaauggucaauucgauuuuaauuucucaaaagauacucuguuauccagaa

SEQ ID NO: 141344 - RNA, 64 nt, Homo Sapiens
uguacacuuguauuauaauacuuguucuguauacauuucucaaaggauauguacauagcuguuu

SEQ ID NO: 141345 - RNA, 64 nt, Homo Sapiens
guaaguauuuuaaacagccugcuaaugucugguuauuucucaaauaguuuugcaauucaaaaca

SEQ ID NO: 141346 - RNA, 64 nt, Homo Sapiens
aguuauuucauucauaauccccaauuucauagagauuucucacaacugcucuaaaaaccaucuu

SEQ ID NO: 141347 - RNA, 64 nt, Homo Sapiens
uagaaacagguuccaacauuaaaacuggaaacuuauuucucauuugccucaacuuucucauccu

SEQ ID NO: 141348 - RNA, 64 nt, Homo Sapiens
auccuaagcagauaauuauucuaaaagcuaaaauauuucucaccauaaaucgaaauguucaaua

SEQ ID NO: 141349 - RNA, 64 nt, Homo Sapiens
aauuacuggcuuuaaaagaaaucuucuugcauuuauuucucaaguggaauauuuaaucuauuua

SEQ ID NO: 141350 - RNA, 64 nt, Homo Sapiens
uaagaagaugaauuugcacagauuucucugcauaauuucucaauaucuuuagcacaguauggug

SEQ ID NO: 141351 - RNA, 64 nt, Homo Sapiens
uauuaccuguauguuuuauaauggaucaugcauaauuucucaggagaauaaaaugagaauucau

SEQ ID NO: 141352 - RNA, 64 nt, Homo Sapiens
guauguuugauaugauauuacacacgugggcuuuauuucucacugcuuucuguuaccauacuuu

SEQ ID NO: 141353 - RNA, 64 nt, Homo Sapiens
ugcugaguuacacaguccugcuaaaggcuguaugauuucucaagucuguccuguaaauagggaa

SEQ ID NO: 141354 - RNA, 64 nt, Homo Sapiens
agucuuuaaacccuaaaucucucaauaccuuccuauuucucaaucugaugaaacccaauaaucu

SEQ ID NO: 141355 - RNA, 64 nt, Homo Sapiens
agucuuuaagcccuaaaucucucaauaccuuccuauuucucaaugcucugaugaaacccagucu

SEQ ID NO: 141356 - RNA, 64 nt, Homo Sapiens
auuccuuuuccuuccuucuacagccuccaaacaaauuucucaagucauccuuauuauuaaaaug

SEQ ID NO: 141357 - RNA, 64 nt, Homo Sapiens
uuuaugguccauaaaaacuuagauguucauuugaauuucucacaagugcagucauaaucuuaca

SEQ ID NO: 141358 - RNA, 64 nt, Homo Sapiens
caguaaaaguuuuuaguguuuacuuaaauuaguaauuucucacuuucugucugguuaaaauguc

SEQ ID NO: 141359 - RNA, 64 nt, Homo Sapiens
accucccuuuuacuuuucaaauucacaaaauuacauuucucauaaauuguauaguauuuaacuu

SEQ ID NO: 141360 - RNA, 64 nt, Homo Sapiens
gaggaaaaaagugaugacauggagagauuuccugauuucucagggggggaugaguggcuuccau

SEQ ID NO: 141361 - RNA, 64 nt, Homo Sapiens
uaguucagccuagcugaauugagccugcaucuaaauuucucaacaauuucuucauuaccuaagg

SEQ ID NO: 141362 - RNA, 64 nt, Homo Sapiens
uuuuucugugcuauauaugaaaaauaauugcaugauuucucauuccugagucauuucucagaga

SEQ ID NO: 141363 - RNA, 64 nt, Homo Sapiens
gaaaaauaauugcaugauuucucauuccugagucauuucucagagauuccuaggaaagcugccu

SEQ ID NO: 141364 - RNA, 64 nt, Homo Sapiens
cuaauuuaacaagaaugccuacaaaauaaaacaaauuucucaaagcagagggauuguaccuugu

SEQ ID NO: 141365 - RNA, 64 nt, Homo Sapiens
cauauguagaaagaaauauaagacccaaguaaauauuucucauaauauuagaaaauuacuuugg

SEQ ID NO: 141366 - RNA, 64 nt, Homo Sapiens
gugcauguuggcuucuuuggaccugcacuggaggauuucucagacacaugcaccagauucuggc

SEQ ID NO: 141367 - RNA, 64 nt, Homo Sapiens
acucccucucccuggugggccuggcaaugacagcauuucucacagaggcauucugguaaaugaa

SEQ ID NO: 141368 - RNA, 64 nt, Homo Sapiens
uaauguauuuugcugguaaggccuacauuagcauauuucucaugcuaacaguccuaccccucua

SEQ ID NO: 141369 - RNA, 64 nt, Homo Sapiens
aaacuucuaaaauucuuauacuuuuuuuauuuuaauuucucauuacaacauuaaagaaaaugga

SEQ ID NO: 141370 - RNA, 64 nt, Homo Sapiens
gcacagguccccagaugagaagucugcuacccucauuucucaucuuuuuacuaaacucagaggc

SEQ ID NO: 141371 - RNA, 64 nt, Homo Sapiens
cagaggcagugacagcagucagggacagacauacauuucucauaccuuccccacaucugagaga

SEQ ID NO: 141372 - RNA, 64 nt, Homo Sapiens
ucuauuauuuuagaaccuagcauuucucaguccuauuucucagucguauauacuugauguuggu

SEQ ID NO: 141373 - RNA, 64 nt, Homo Sapiens
ccuauuucucaguucuauuaacuugauguuggucauuucucagugugcuaaguguaccguauau

SEQ ID NO: 141374 - RNA, 64 nt, Homo Sapiens
ccagauccaugucuccacugggacaggaaaacccauuucucaacaagaugugggugacacaggg

SEQ ID NO: 141375 - RNA, 64 nt, Homo Sapiens
uuagauguugcuuuacauagaaccagaaaauggaauuucucagcuaaagcaugugugccuguuu

SEQ ID NO: 141376 - RNA, 64 nt, Homo Sapiens
uuauucauuuucucccuuuagcaauuuucauuuuauuucucauaauuugaacagagacaguucu

SEQ ID NO: 141377 - RNA, 64 nt, Homo Sapiens
cguuugauuaccaugcuggaauaagaagaguugcauuucucauuuuaaugagcauauggaaaga

SEQ ID NO: 141378 - RNA, 64 nt, Homo Sapiens
gaacagaauuucagucuugcagccaugagccucuauuucucauuccuaagccuuaccaugaguc

SEQ ID NO: 141379 - RNA, 64 nt, Homo Sapiens
uuagucauuuuuuuucuuuuagcauuugauaugcauuucucagauuccaccaucuuuuugugcu

SEQ ID NO: 141380 - RNA, 64 nt, Homo Sapiens
uaaacauugggaaccauucaccuaauuuggagacauuucucacugguugugacuacccccuuau

SEQ ID NO: 141381 - RNA, 64 nt, Homo Sapiens
gucauguugcaucuuggagcggcuccugagaguuauuucucaggaguaguauugccuuccauua

SEQ ID NO: 141382 - RNA, 64 nt, Homo Sapiens
cuucaggccaggaaaccgagcuccucuacuccaaauuucucauuccuuaagaucacaucaucua

SEQ ID NO: 141383 - RNA, 64 nt, Homo Sapiens
ugaaaggccaacagcaaguguuugugggacacaacacagauaauuuuuucuuaagucggccaag

SEQ ID NO: 141384 - RNA, 64 nt, Homo Sapiens
cuucucugugugcacacccaugcacacucaugcacacagauacauaggucuguauggcuguauu

SEQ ID NO: 141385 - RNA, 64 nt, Homo Sapiens
ucccugaaggcacacguacgcacacacgcacaugcacagauaugccgccugggcacacagauaa

SEQ ID NO: 141386 - RNA, 64 nt, Homo Sapiens
acacacgcacaugcacagauaugccgccugggcacacagauaagcugcccaaaugcacgcacac

SEQ ID NO: 141387 - RNA, 64 nt, Homo Sapiens
acacgugcagauaugguauccggacacacacgugcacagauaugcugccuggacacacagauaa

SEQ ID NO: 141388 - RNA, 64 nt, Homo Sapiens
ggacacacacgugcacagauaugcugccuggacacacagauaaugcugccuugacacacacaug

SEQ ID NO: 141389 - RNA, 64 nt, Homo Sapiens
ggauauugccuggacacacacacacacacgugugcacagauaugcugucuggacacgcacacac

SEQ ID NO: 141390 - RNA, 64 nt, Homo Sapiens
acgcagacaugcuguccggacacacacacgcaugcacagauaugcuguccggacacacacacgc

SEQ ID NO: 141391 - RNA, 64 nt, Homo Sapiens
acacacgcacgcagauaugcugccuggacacacacacagauaaugcugccucaacacucacaca

SEQ ID NO: 141392 - RNA, 64 nt, Homo Sapiens
acacgugcagauauugccuggacacacacaugugcacagauaugcugucuggacaugcacacac

SEQ ID NO: 141393 - RNA, 64 nt, Homo Sapiens
uaguucacauuuacuggugcauccuugauccucucacagauagaggucuuaaagguuggaucau

SEQ ID NO: 141394 - RNA, 64 nt, Homo Sapiens
uaauaacauuuuucaugaaucaugagaaaauuuccacagauacuucccuuagaaaauuugcuau

SEQ ID NO: 141395 - RNA, 64 nt, Homo Sapiens
ggaugugaaagcuguuugugaucaguaaagcuaccacagauauaaggguguuaugcugaauccu

SEQ ID NO: 141396 - RNA, 64 nt, Homo Sapiens
aucuugggauuuauuaaauuauguaagaagauagcacagauaucgggauauuauugugugaaaa

SEQ ID NO: 141397 - RNA, 64 nt, Homo Sapiens
cacgcacauagagauaugcacacacagaugcacacacagauauacacauggaugcacgcacaug

SEQ ID NO: 141398 - RNA, 64 nt, Homo Sapiens
ugcacagagauaugcacacaccgaugugcgcacacacagauaugcacacacauggaugagcaca

SEQ ID NO: 141399 - RNA, 64 nt, Homo Sapiens
cugaggaaugcagaaaaaccaggaggacaauucccacagauaauugucauuugagaaaggaugc

SEQ ID NO: 141400 - RNA, 64 nt, Homo Sapiens
ugaauuaauucauccaaauggccagggauuuguucacagauacuacggggcuagggcgagagag

SEQ ID NO: 141401 - RNA, 64 nt, Homo Sapiens
gaguguaaaagugcgcaaaaugggauauauggucauccucuaauguuacuggcuucaucuuccu

SEQ ID NO: 141402 - RNA, 64 nt, Homo Sapiens
uaggcauuuaaugaaacauucaucaacuaugguuauccucuaaagguuuggcuuuuuucugugu

SEQ ID NO: 141403 - RNA, 64 nt, Homo Sapiens
aaauagaacuaucugcauuaucuaugcagcaugggguuuuuauuauuuuuaccuaaagacgucu

SEQ ID NO: 141404 - RNA, 64 nt, Homo Sapiens
aaaaaagccugguuuuucucaauacgccuuuaaagguuuuuaaauuguuucauaucuggucaag

SEQ ID NO: 141405 - RNA, 64 nt, Homo Sapiens
aaugagguaaaugccguauauucccuacuggcaagguuuuuaaagggagaagagcagcuuagau

SEQ ID NO: 141406 - RNA, 64 nt, Homo Sapiens
uucuacaagaauucugguuuaaacuuuggcuguagguuuuuauuaauuuccaguuagcuggaag

SEQ ID NO: 141407 - RNA, 64 nt, Homo Sapiens
gaauagucuuaaaucuaaaugaguguuuuaaaaagguuuuuaauguuuguuuauugacauuaac

SEQ ID NO: 141408 - RNA, 64 nt, Homo Sapiens
aaagaaccuuucacuagcuauuaucauugcuacagguuuuuaaauuguaucuuucuaaucuguu

SEQ ID NO: 141409 - RNA, 64 nt, Homo Sapiens
ugugcuuauggaaaggacccuggagcagagggaugguuuuuaaacuauaaguuuuaauauuuug

SEQ ID NO: 141410 - RNA, 64 nt, Homo Sapiens
guaugagaaacacaguuugugguagcggccacaugguuuuuaaaccuggguuuuuauccacaaa

SEQ ID NO: 141411 - RNA, 64 nt, Homo Sapiens
cacaaagguagcggccacaucagcauccuaccuggguuuuuaucagcacuuucugcauuccaaa

SEQ ID NO: 141412 - RNA, 64 nt, Homo Sapiens
gcuccacuaaaaauaauuaugugagcuucucacagguuuuuaaacuggaggccaaaaagucaau

SEQ ID NO: 141413 - RNA, 64 nt, Homo Sapiens
uuuuuauuuuuuagaugguguucucauuuugggggguuuuuauuaauauguuuaaauauuuaau

SEQ ID NO: 141414 - RNA, 64 nt, Homo Sapiens
uacaaaaacauuuugccuauuucgcuaacaguuugguuuuuaauggcugugguauuugagugag

SEQ ID NO: 141415 - RNA, 64 nt, Homo Sapiens
ugcaacaauuucucuuguaaauggaaugguuugggguuuuuaaauaagcauuaacuaacaaccu

SEQ ID NO: 141416 - RNA, 64 nt, Homo Sapiens
ccuggcauccagagugacagaagaaaaugaugaugguuuuuauuguacuugaugcucacagagg

SEQ ID NO: 141417 - RNA, 64 nt, Homo Sapiens
uucauauccagccuaaaggugccauauuuguguugguuuuuauuucuuuagaaaauggggaucu

SEQ ID NO: 141418 - RNA, 64 nt, Homo Sapiens
ccucuaucaaucaguaguuaaaucaacggacacugguuuuuagauagcauccugcuuagagacc

SEQ ID NO: 141419 - RNA, 64 nt, Homo Sapiens
uuacuaaaauaaguucaaguuugacacagcuccagguuuuuaaacugacccccuagcaacguag

SEQ ID NO: 141420 - RNA, 64 nt, Homo Sapiens
uauugagggaaauguuuucauauuuuucaaaauagguuuuuauuguugaauguacaucuacccc

SEQ ID NO: 141421 - RNA, 64 nt, Homo Sapiens
ucugucuccucuucuuugucaucagccaaaacgugguuuuuaaagagagucaugcagguuagaa

SEQ ID NO: 141422 - RNA, 64 nt, Homo Sapiens
ccaacuucuuucaucaggaaaccuuauucaggaggguuuuuaaaaaguguuuaaaugucaaaug

SEQ ID NO: 141423 - RNA, 64 nt, Homo Sapiens
gcuaugauguuaguuuuccuuagcugauuuugaggguuuuuaaaaauaaagcaagguugacuaa

SEQ ID NO: 141424 - RNA, 64 nt, Homo Sapiens
auuuguuuucaauuucagugguagagaaauuagagguuuuuaaaaguucaagcuucaggcuuua

SEQ ID NO: 141425 - RNA, 64 nt, Homo Sapiens
auguuuccauugcuuuuauauugcauuuuuaggagguuuuuagauccuuauuuccacaaauauu

SEQ ID NO: 141426 - RNA, 64 nt, Homo Sapiens
auacaaaaaccaugaaguacaaugucacuuuuuugguuuuuauuaaaagcacuaauuaguuuaa

SEQ ID NO: 141427 - RNA, 64 nt, Homo Sapiens
aauauuuuuuauuuuuccccugauucugguuuuugguuuuuagacuuauuuauagaaaguacag

SEQ ID NO: 141428 - RNA, 64 nt, Homo Sapiens
uaaauuguuacuugccuuucaccuugggccagcagguuuuuaacaauaaggaaugaaucaacug

SEQ ID NO: 141429 - RNA, 64 nt, Homo Sapiens
uagcuaggcacuuuauuacuauuugaagucuugugguuuuuauaugcaguuagcuuaaauuaca

SEQ ID NO: 141430 - RNA, 64 nt, Homo Sapiens
uuugugauaacaaaauaacggugacuaagccucagguuuuuaauuccauuaucuauauaaaaua

SEQ ID NO: 141431 - RNA, 64 nt, Homo Sapiens
ccugugauuauguuggaauauaucacuuuaaaaugguuuuuacuguuguuuguuucauaaagca

SEQ ID NO: 141432 - RNA, 64 nt, Homo Sapiens
uugauuucccucugcagcacagcgucucuguaaagguuuuuaugcuuucaccagccaugucuua

SEQ ID NO: 141433 - RNA, 64 nt, Homo Sapiens
gagcaacugaugauuaaauguugcuuuuuaauaagguuuuuaacuugaaaauuugaaaauauuu

SEQ ID NO: 141434 - RNA, 64 nt, Homo Sapiens
aaccauauacugacugaaacauuuggacaguagcgguuuuuaaauauagugauauauuguguua

SEQ ID NO: 141435 - RNA, 64 nt, Homo Sapiens
agaguauauaucucuuuaaagggcaagggugggagguuuuuagaacccuuuccguuggggaugg

SEQ ID NO: 141436 - RNA, 64 nt, Homo Sapiens
aauuucuugauacucuuauaccaaaucacuuuuugguuuuuaaguaacuguaaguuuugugcuu

SEQ ID NO: 141437 - RNA, 64 nt, Homo Sapiens
uuuaauauuaggggaguagauauauuucccaugugguuuuuaugguuacuucuauuugaauuuc

SEQ ID NO: 141438 - RNA, 64 nt, Homo Sapiens
acauggauguuaaggcuguuagcguggauaaaaagguuuuuaaaaagugcuuggaugaaaggac

SEQ ID NO: 141439 - RNA, 64 nt, Homo Sapiens
uuuuuucuccccgacucaaaagaaagaaauuuuggguuuuuaauuauuuuuauuuugaauaaac

SEQ ID NO: 141440 - RNA, 64 nt, Homo Sapiens
cugcucaccguggagauaagggcuguuccuuggggguuuuuaucaggcacagaagguugucaug

SEQ ID NO: 141441 - RNA, 64 nt, Homo Sapiens
guaggugagcgugagccucuaggaaguggcuuuggguuuuuaaaugaggcccaggcaggugaag

SEQ ID NO: 141442 - RNA, 64 nt, Homo Sapiens
uaaauuaugcaaagguuaacuuguuaauaagaaugguuuuuacagucauucuguaauguaaaug

SEQ ID NO: 141443 - RNA, 64 nt, Homo Sapiens
uaccucugaaucuguccuacaaauauuuccgugagguuuuuaacgucuucaagaaagaagccaa

SEQ ID NO: 141444 - RNA, 64 nt, Homo Sapiens
ggaguugaguuuugguuugguccugcucaguuuugguuuuuaguuguccauccucacaguccua

SEQ ID NO: 141445 - RNA, 64 nt, Homo Sapiens
acaccagugaaggugucucuguuuuaaugaucaggguuuuuauuccaucuuuugcauuucuucu

SEQ ID NO: 141446 - RNA, 64 nt, Homo Sapiens
gaaauuuccaagccaaugguuucuuuuggguuuugguuuuuauguuuguuuuuugggguuugga

SEQ ID NO: 141447 - RNA, 64 nt, Homo Sapiens
gguuuuccuuuucuuugggacugugaggggaaaugguuuuuagaggugaggguugguccaugug

SEQ ID NO: 141448 - RNA, 64 nt, Homo Sapiens
guagggaccucagagguuuaccuagagaacaggugguuuuuaaggguuaucuuagauguuucac

SEQ ID NO: 141449 - RNA, 64 nt, Homo Sapiens
uuuuaaggguuaucuuagauguuucacaccggaagguuuuuaaacacuaaaauauauaauuuau

SEQ ID NO: 141450 - RNA, 64 nt, Homo Sapiens
uguguagaauggguguuugauugaccuuugugaagguuuuuaucucagcucuggauuacuucag

SEQ ID NO: 141451 - RNA, 54 nt, Homo Sapiens
uagaaggggaacaaaaaaaacugagguuuuuaugucuccacucaggagugguga

SEQ ID NO: 141452 - RNA, 64 nt, Homo Sapiens
cuuucuuaaaagacguuaaagugggaaaaaaggagguuuuuagaaacucaaaguuuugaaguca

SEQ ID NO: 141453 - RNA, 64 nt, Homo Sapiens
uuuuuaaugaauuucacagaaaugacauuucugugguuuuuaacuauugaaauauguuguuucu

SEQ ID NO: 141454 - RNA, 64 nt, Homo Sapiens
cuuugugacaggaaagcccuaaaugcauuuuggggguuuuuaauuauuguguauuauguuguuc

SEQ ID NO: 141455 - RNA, 64 nt, Homo Sapiens
ucucgggugcauuugagagagaucuguauuuaaugguuuuuauugagaggcggccucgugccau

SEQ ID NO: 141456 - RNA, 64 nt, Homo Sapiens
uauuuauauauauuuuuugaguaagaauguuuaagguuuuuauuuucuguucuuuaagaucccu

SEQ ID NO: 141457 - RNA, 64 nt, Homo Sapiens
auguauucuguucuuuaagaauauaaauuacugagguuuuuaacuaaaguaccgcuuaaaauug

SEQ ID NO: 141458 - RNA, 64 nt, Homo Sapiens
uuuuauuauacuuuguuaaauauucuguuuuugggguuuuuauguuugaauuguaaaugucaag

SEQ ID NO: 141459 - RNA, 64 nt, Homo Sapiens
uuuuuucugcaaauaaaucuuuguagcaguuucagguuuuuaauuccuucccuccuccaagcac

SEQ ID NO: 141460 - RNA, 64 nt, Homo Sapiens
aaauuuuauuuuguuuuuuugaccaaacguuguugguuuuuaaaaaagaacauguguccauuug

SEQ ID NO: 141461 - RNA, 64 nt, Homo Sapiens
uccuagcauaugcuguuuggagaauuuagcguuugguuuuuaccacacuugacaccuugagggu

SEQ ID NO: 141462 - RNA, 64 nt, Homo Sapiens
uugauuucacuauacucauuggaaagacacuguugguuuuuauucuuauucuaaggucaaaagu

SEQ ID NO: 141463 - RNA, 64 nt, Homo Sapiens
aguauaaauagaagggagaggacuuuuuuauagugguuuuuaagguuuuaagauugucaauucu

SEQ ID NO: 141464 - RNA, 64 nt, Homo Sapiens
cgccacagccacacuugaagaaacacagcucuuggguuuuuaguccugcuguguguugggaaga

SEQ ID NO: 141465 - RNA, 64 nt, Homo Sapiens
aaucacuguauuuuauagcuuuuuuuuucauguagguuuuuaguuaaaacaucuccugccuaaa

SEQ ID NO: 141466 - RNA, 64 nt, Homo Sapiens
uguuuuguuuuugcuauucuagucuuggauacaugguuuuuauuggcaaaaugaugguaaccua

SEQ ID NO: 141467 - RNA, 64 nt, Homo Sapiens
uagaucaugaguugaacaaaugcaaugaaacagugguuuuuacugacuugagacaucagucaaa

SEQ ID NO: 141468 - RNA, 64 nt, Homo Sapiens
uuuauuuuaaaauuauuuaauagcaaauggaagugguuuuuaauauuucuuacuuuaagcucuu

SEQ ID NO: 141469 - RNA, 64 nt, Homo Sapiens
caaaaaacaacccuugcacgaaugaauguggcaagguuuuuaaugagagaaacuuuacaagugu

SEQ ID NO: 141470 - RNA, 64 nt, Homo Sapiens
uuucuuuuaaaauuauuuauuagcaaauggaauugguuuuuaauauuucuuacuuuaaguucuu

SEQ ID NO: 141471 - RNA, 64 nt, Homo Sapiens
caacaaucacaccuugcaagaaugaaugugacaugguuuuuaaugagagaaaccuuacaagcac

SEQ ID NO: 141472 - RNA, 64 nt, Homo Sapiens
caaaaagcaaccuuugcacaaaugaauguggcaagguuuuuaaugagagaaaccuuacaagcau

SEQ ID NO: 141473 - RNA, 64 nt, Homo Sapiens
cuuaaaagagcuaacguucuuauuaaggcuuugugguuuuuagaguugcaucuaugaaccuggg

SEQ ID NO: 141474 - RNA, 64 nt, Homo Sapiens
uuucaauuaaaaagcacacuucuacaaaagauuugguuuuuaaauuaugguuacacauuucagu

SEQ ID NO: 141475 - RNA, 64 nt, Homo Sapiens
augaaguuguuuauuaaaaacauuuucaaaaaaagguuuuuauauucaauguuuuacagaauua

SEQ ID NO: 141476 - RNA, 64 nt, Homo Sapiens
uguaaaguauaagugccauuuuuauauaaaacaagguuuuuaauccucuuggaguauuuuuggc

SEQ ID NO: 141477 - RNA, 64 nt, Homo Sapiens
cuguuuuguuuugggugggagggugggaaauuuggguuuuuaaguccucuaaacacacuugggc

SEQ ID NO: 141478 - RNA, 64 nt, Homo Sapiens
cugacuaggucaauuuuuuuucugaacaaaagcagguuuuuauauguaaacagugagaaaagaa

SEQ ID NO: 141479 - RNA, 64 nt, Homo Sapiens
uuuggggggaaugacauguuuuuuuauuuuuguugguuuuuauugggacauuccguccugauga

SEQ ID NO: 141480 - RNA, 64 nt, Homo Sapiens
uuuauauacguuuauauaaaauuugcauuugggugguuuuuauuuuaucaauugcaaaaugcgu

SEQ ID NO: 141481 - RNA, 64 nt, Homo Sapiens
agaacguguauuuauuaauggauuagacacuggagguuuuuaacacuuaagacuuuaugggaga

SEQ ID NO: 141482 - RNA, 64 nt, Homo Sapiens
ucuucgaacagucuccuuucccuaaguacgaaaagguuuuuaagaacguuugccccuggcguuu

SEQ ID NO: 141483 - RNA, 64 nt, Homo Sapiens
agggggacuccagaucagaugggagccaugaaaugguuuuuaauccauagcuugaaggcaguga

SEQ ID NO: 141484 - RNA, 64 nt, Homo Sapiens
aauacuuccaaauugcccucgauauuuauauauugguuuuuaauguggaauugcaaagucauag

SEQ ID NO: 141485 - RNA, 64 nt, Homo Sapiens
guauucacaaaguuguguaaggguacaauuuagugguuuuuaguuuacaauucacuuauuuuaa

SEQ ID NO: 141486 - RNA, 64 nt, Homo Sapiens
guuguuuaguuuugguuuguauuauuuuucauuggguuuuuauuacauagccccaaagcaugag

SEQ ID NO: 141487 - RNA, 64 nt, Homo Sapiens
aaaaucaggucauuuaagaaacuaauguuuuuaagguuuuuaggauauauucucaguauuugga

SEQ ID NO: 141488 - RNA, 64 nt, Homo Sapiens
uauuauacuuagucaaauguauuuuggucaguuggguuuuuauguugucacugagaagauguuu

SEQ ID NO: 141489 - RNA, 64 nt, Homo Sapiens
ugaucaguuuucaugugggaaugggcuugcuguggguuuuuaauugguguaggggcuuagaggc

SEQ ID NO: 141490 - RNA, 65 nt, Homo Sapiens
augcuuuuuguaucacacaguauaugauggggcaugugccauagugcaggcuuggggagcuuuaa

SEQ ID NO: 141491 - RNA, 65 nt, Homo Sapiens
acaaaugguauuuugauagauacuggauuguguuugugccauauuugugccauucuuuuaagaac

SEQ ID NO: 141492 - RNA, 65 nt, Homo Sapiens
ggcagcugggccuccugggugccaguccaucucaagugccauauucugugaucacggauguuggc

SEQ ID NO: 141493 - RNA, 65 nt, Homo Sapiens
ggccgacagucuggaaaugaauccaucauacauuagugccauagaguuuaguaaccguccagcaa

SEQ ID NO: 141494 - RNA, 65 nt, Homo Sapiens
aaacaauuguaaugauauuauuuauugggcauuuugugccauacauggugaugagcaguuugcau

SEQ ID NO: 141495 - RNA, 65 nt, Homo Sapiens
cauaaagcuuccgugacuucuaaaccaucaggucggugccauaagagaugcucaaaaaagcaugg

SEQ ID NO: 141496 - RNA, 64 nt, Homo Sapiens
ucagaaagagcucuccagaagccaauauugagauguaauucagauuaggacacagugugugacg

SEQ ID NO: 141497 - RNA, 64 nt, Homo Sapiens
ccaguguuuuugcaggugaggaaacaggggcagaguaauucaggcacauguguucagaguucca

SEQ ID NO: 141498 - RNA, 64 nt, Homo Sapiens
cuuuaacugauccucaacuuuuacuaaacauaagguaauucauacuggagaaaagccauacaaa

SEQ ID NO: 141499 - RNA, 64 nt, Homo Sapiens
uucuugaaaaauuaguuuuugaaaagcaaaugauguaauucaacucaaauucaugcucuucauu

SEQ ID NO: 141500 - RNA, 64 nt, Homo Sapiens
auauuauuauaauaaacuuauuacugcuuguaggguaauucacaguuacuuacccuauucuugc

SEQ ID NO: 141501 - RNA, 64 nt, Homo Sapiens
gugacucuuuuucuacaacugccuugucaguuugguaauucacuuaugauuuucuaauguucuc

SEQ ID NO: 141502 - RNA, 64 nt, Homo Sapiens
agaacaguguggcaugaucacacucauuuaaaaaguaauucagaaaaagugaaccagaacaaau

SEQ ID NO: 141503 - RNA, 64 nt, Homo Sapiens
uguuaaaaaaaaucuagauuguagcugccaauuuguaauucauccucuuuucacuaggguauaa

SEQ ID NO: 141504 - RNA, 64 nt, Homo Sapiens
aaugcuucccauggaguuuuguauaucccuuauaguaauucauaaaaacauugccuucuguuuu

SEQ ID NO: 141505 - RNA, 64 nt, Homo Sapiens
ucuuuuguuagaaauuguuagagaauagagagugguaauucagauuuggucaacgauucuaguc

SEQ ID NO: 141506 - RNA, 64 nt, Homo Sapiens
aauugagcuugccaggcugucucauuccuaacauguaauucaugauuuagccacuaaauuucua

SEQ ID NO: 141507 - RNA, 64 nt, Homo Sapiens
agcuauagagagaaagauaaaugugcuuuuuauuguaauucaacgccaacugcuaauggaucga

SEQ ID NO: 141508 - RNA, 64 nt, Homo Sapiens
aaacuuuuacaaucugaaaggauacucuuaaaauguaauucauuucauauuuuguuauguguag

SEQ ID NO: 141509 - RNA, 64 nt, Homo Sapiens
cuuccccuccucccuguugcccauacucagcaucucggaugaaagggcucccuuguccucaggc

SEQ ID NO: 141510 - RNA, 64 nt, Homo Sapiens
cccuggccugaacugaggaguccgcugaggggucucggaugacaucuuuccucccccugcaacu

SEQ ID NO: 141511 - RNA, 64 nt, Homo Sapiens
uuucuuagugcuacuucuuuguacuggggacugcucggaugaucucugccaaaaagugggggcu

SEQ ID NO: 141512 - RNA, 64 nt, Homo Sapiens
ucugacccaugggagauuuggagcugucuacucuucggaugaggcccucauucccauucgggag

SEQ ID NO: 141513 - RNA, 64 nt, Homo Sapiens
uacauauuguuagggucagccauuuuuaaugaucucggaugaccaaaccagccuucggagcguu

SEQ ID NO: 141514 - RNA, 64 nt, Homo Sapiens
gcacacgcagacagacccucuguggccaacuccaucggaugaauuaaagaagccuagugguuug

SEQ ID NO: 141515 - RNA, 64 nt, Homo Sapiens
gguuggaaauguagcugcuuauucaacuucugccucggaugagagagucuuguuaaaaugaugg

SEQ ID NO: 141516 - RNA, 64 nt, Homo Sapiens
caccuguagugagauguacuguugaaauaauccaucggaugaccccccuuaauggauuguggca

SEQ ID NO: 141517 - RNA, 64 nt, Homo Sapiens
uucagacuguugaugacauugacauuucauggauucggaugaugcaaggagacacaugccaccc

SEQ ID NO: 141518 - RNA, 64 nt, Homo Sapiens
gcagaaaauaguguuuuguaaauggcacaauucuucggaugacucauucagaggcaucacaagu

SEQ ID NO: 141519 - RNA, 64 nt, Homo Sapiens
auacucagacgugugaccucucucucccaggaccucggaugaccaagugggacauucaaaaaac

SEQ ID NO: 141520 - RNA, 64 nt, Homo Sapiens
ugccggacuugagucugaguucauggagacucugucggaugaagaaguacuucugugucucacc

SEQ ID NO: 141521 - RNA, 64 nt, Homo Sapiens
gugucauuuggguguuuuggcaacucaggggccuucggaugaucuuaaaccuuuguguucagcc

SEQ ID NO: 141522 - RNA, 64 nt, Homo Sapiens
aguuuaaugcaagaguagguuuggugcacuuucuucggaugaaggggcagugccgagggucacc

SEQ ID NO: 141523 - RNA, 64 nt, Homo Sapiens
aagcccccaagacugcccagccaaagggaaaaacucggaugaaggaaagcugcucgugcucguu

SEQ ID NO: 141524 - RNA, 64 nt, Homo Sapiens
uauauuguucuaauguaaaauuguacugggcuggucggaugagcugaggccauugacuucucua

SEQ ID NO: 141525 - RNA, 64 nt, Homo Sapiens
uucaaacuguucuuuuuccuaauuaauguagcuuucggaugacauaaauccaguaucucugcuu

SEQ ID NO: 141526 - RNA, 64 nt, Homo Sapiens
ugacugacccagugcacacucaugugugacugucucggaugaagagggacuuaccuggggcugg

SEQ ID NO: 141527 - RNA, 64 nt, Homo Sapiens
uuggagaguuucaaagugaaccccgaacgaauguucggaugacucaguggugccucucaagaaa

SEQ ID NO: 141528 - RNA, 64 nt, Homo Sapiens
cugguuauugguccaccccccaucagccaagcguucggaugaguccacggagcaacuggaaaac

SEQ ID NO: 141529 - RNA, 64 nt, Homo Sapiens
cugacgugauugcuucagacauggaaugauccugucggaugacgucuuggauucaucucaucuc

SEQ ID NO: 141530 - RNA, 64 nt, Homo Sapiens
ggaagccugaagcaggcagggccgguggacuucgucggaugaagagugauccuccuuccuuccc

SEQ ID NO: 141531 - RNA, 64 nt, Homo Sapiens
ugagggaggagcaggucagggaccgaauccggcuucggaugagggagggaggaauuacacagcu

SEQ ID NO: 141532 - RNA, 64 nt, Homo Sapiens
cugacucaggucuccgccaugcacgcguggacucucggaugagcucagcagaaccgcacagcca

SEQ ID NO: 141533 - RNA, 64 nt, Homo Sapiens
gguugcagccggccugcugcaagggcaaccacccucggaugaugcuucccgcccuccugcagca

SEQ ID NO: 141534 - RNA, 64 nt, Homo Sapiens
agaugaugauguaauagugaauaaaccucauguuucggaugaagaggaagaagaaccuccuuuu

SEQ ID NO: 141535 - RNA, 64 nt, Homo Sapiens
auauuccaguauuugaagccuucucagaccucagucggaugaacuucaauuuuaauuuucuucu

SEQ ID NO: 141536 - RNA, 64 nt, Homo Sapiens
uugggcauuuuaguucuauagugaaccugcuauuucggaugacauuuacuuuuauaaccuuuug

SEQ ID NO: 141537 - RNA, 64 nt, Homo Sapiens
ccgggacgcugagggggaucugguucggcugcugucggaugaggacguagcgcucauggugcgg

SEQ ID NO: 141538 - RNA, 64 nt, Homo Sapiens
ugaggcgcagccuacgccauagcuggggagggacucggaugaacucccuuggccuggaccagug

SEQ ID NO: 141539 - RNA, 64 nt, Homo Sapiens
agccccaaacuggugcauaaugcaugguacaagaaauauuuauguauuuuuuggaauuuuguaa

SEQ ID NO: 141540 - RNA, 64 nt, Homo Sapiens
acaagaaauauuuauguauuuuuuggaauuuuguaauauuuaguaagaguauaugaaaggauug

SEQ ID NO: 141541 - RNA, 64 nt, Homo Sapiens
acuauuaugcguaaugcucagcuuuuuguaaagaaauauuuaauuguauuuuguguuuauacag

SEQ ID NO: 141542 - RNA, 64 nt, Homo Sapiens
acaaguuuguugagcuuuaaaauguauuugaaguaauauuuaaauaggcauuuaaaauuucaaa

SEQ ID NO: 141543 - RNA, 64 nt, Homo Sapiens
uguuuccuccuacaguggagcagcauucaaaucaaauauuuacauauugcuuaucacuuuuucu

SEQ ID NO: 141544 - RNA, 64 nt, Homo Sapiens
acagauauuuuauguuuuuuuaauuuucuccaagaauauuuauagaauuccaaagaaucagaau

SEQ ID NO: 141545 - RNA, 64 nt, Homo Sapiens
gguuuaaauuauuggacaauuuaaauuguggguaaauauuuaaaacuccugaacaauguuucug

SEQ ID NO: 141546 - RNA, 64 nt, Homo Sapiens
gucgcaacagaaucucuguggcccacaaggcuaaaauauuuacauucucacccauuacagaaaa

SEQ ID NO: 141547 - RNA, 64 nt, Homo Sapiens
uaccuuuguaacuaaagucugucuagucauuguaaauauuuaucugucaguuuugacagauugg

SEQ ID NO: 141548 - RNA, 64 nt, Homo Sapiens
agguauauauucaauuuuuuaccauuuuauggaaaauauuuaaaaucuguuuuuacaggguuuu

SEQ ID NO: 141549 - RNA, 64 nt, Homo Sapiens
uuuguagaaggguuauauuuuacuacuguggaaaaauauuuaagauaguuuugccagaacaguu

SEQ ID NO: 141550 - RNA, 64 nt, Homo Sapiens
uuuucaauuuugcaugcucgauuauucccuguacaauauuuaaaauuuauugcuugauacuuuu

SEQ ID NO: 141551 - RNA, 64 nt, Homo Sapiens
guauaaaaauagaagaauacaaacauauuuguuaaauauuuacauaugaaauuuaauauagcua

SEQ ID NO: 141552 - RNA, 64 nt, Homo Sapiens
ucuauuauuuucauauguuauguucugaauauuuaauauuuauuugaauuuucacucaugagua

SEQ ID NO: 141553 - RNA, 64 nt, Homo Sapiens
auuuauuucuauuauuuucaaugaguauguucugaauauuuaauaauuaauugaauuuucacuc

SEQ ID NO: 141554 - RNA, 64 nt, Homo Sapiens
aaaaucagauuaugggauaaaugcuuaaaaauguaauauuuacuauuuaaaaaaacagcauaaa

SEQ ID NO: 141555 - RNA, 64 nt, Homo Sapiens
aaucaaauaggaaaugaaugcugaaaaacucuuaaauauuuagccucugugagacaggccauaa

SEQ ID NO: 141556 - RNA, 64 nt, Homo Sapiens
uauccuaaauauaggauauauccuaaauauuuaaaauauuuagaaccuuuuggcucuuaagaua

SEQ ID NO: 141557 - RNA, 64 nt, Homo Sapiens
auauuuagauauccuaaauacuuaagauauccuaaauauuuaaaucugugaggaccuuuuggcu

SEQ ID NO: 141558 - RNA, 64 nt, Homo Sapiens
uacaguuucuaucaaaaauauucugguaguacugaauauuuacugagaguugaagauaguauau

SEQ ID NO: 141559 - RNA, 64 nt, Homo Sapiens
aguugaaguuauuaucaguuuuagaacuuagaaaaauauuuacuaucuuuucuuauuuguguga

SEQ ID NO: 141560 - RNA, 64 nt, Homo Sapiens
aaaaugcaugguucauuuuuuuaugacuauagguaauauuuaagauauccgaaaaaguaaacgu

SEQ ID NO: 141561 - RNA, 64 nt, Homo Sapiens
gagggccuacuguggaccagcauaaucauggcuaaauauuuaugugccaaggcacucacagaau

SEQ ID NO: 141562 - RNA, 64 nt, Homo Sapiens
uuagacauuaccaguaauuuugcauuauuaaaugaauauuuaaacaaacaaaaacagguaucag

SEQ ID NO: 141563 - RNA, 64 nt, Homo Sapiens
uuaaacuccuuauguuacuuuuuaauuauuuaauaauauuuauaauaugaaccaugucuauuaa

SEQ ID NO: 141564 - RNA, 64 nt, Homo Sapiens
auuuucaccuguuuuuaagcuuauaauuuuuuucaauauuuauuauuuagaaagaagcccaaua

SEQ ID NO: 141565 - RNA, 64 nt, Homo Sapiens
accucugauaccucaaccccuaccucucuuauagaauauuuauuccccuugagaaaccuuauug

SEQ ID NO: 141566 - RNA, 64 nt, Homo Sapiens
aucuugauuuuuuuuaaauguaaaaucuuuagacaauauuuaaacauuuucuaaaucugggauu

SEQ ID NO: 141567 - RNA, 64 nt, Homo Sapiens
agauuacuucuugauaaaaugaaaacacugcagaaauauuuaacuugucaguuacuuuuagaaa

SEQ ID NO: 141568 - RNA, 64 nt, Homo Sapiens
auucuuaauagauuauuaucuaaaugcucacuugaauauuuauggaacuauuaaauagaaaauu

SEQ ID NO: 141569 - RNA, 64 nt, Homo Sapiens
aaggcuauguacuuauuauuuuagcucuuucuguaauauuuacauuuuuuaccauauguacauu

SEQ ID NO: 141570 - RNA, 64 nt, Homo Sapiens
uguaguuucuuuguagagagauaauaaaaaucaaaauauuuaaugaaaauggacuuacuguuac

SEQ ID NO: 141571 - RNA, 64 nt, Homo Sapiens
acuccgacuuuuauagaagcuacuuuuaaaucagaauauuuaauuuuugauauucauauaauua

SEQ ID NO: 141572 - RNA, 64 nt, Homo Sapiens
ugaaauuuuuacuauuucuguuuccacaauuccaaauauuuaucuugguguauauauuguuacu

SEQ ID NO: 141573 - RNA, 64 nt, Homo Sapiens
uagguaaaacuaaaucauugauaaaugacaaggaaauauuuaauaaaaaggucagugacaauug

SEQ ID NO: 141574 - RNA, 64 nt, Homo Sapiens
gaugagugaaugaggaaauaaauagguacuaauaaauauuuauaaucagggagacauggguaau

SEQ ID NO: 141575 - RNA, 64 nt, Homo Sapiens
auauauuucaugaauacauuguacauauuauguuaauauuuacacaauuuaaaauauagaugug

SEQ ID NO: 141576 - RNA, 64 nt, Homo Sapiens
aaagagagucaugcagguuagaaauaaugucaaaaauauuuaggaauuuaauaaccuuuaaguc

SEQ ID NO: 141577 - RNA, 64 nt, Homo Sapiens
uugcaaauugcccacucgugauaagucaacagccaauauuuaaaacuuuguucguuacuggcuu

SEQ ID NO: 141578 - RNA, 64 nt, Homo Sapiens
auuucagugcaaauauauuuugaaguuacuuuuaaauauuuauuuaaaaccucuguuucuguaa

SEQ ID NO: 141579 - RNA, 64 nt, Homo Sapiens
uguaaugagaauagacuggaacaugugagggaaaaauauuuaaaaaaagauggcagucaucuag

SEQ ID NO: 141580 - RNA, 64 nt, Homo Sapiens
aggaucaggauugcaugaaagaagaaaauccuucaauauuuaaaauguuucuuacaauacccac

SEQ ID NO: 141581 - RNA, 64 nt, Homo Sapiens
ucuggguuggauguuagacuaaaggaaacccaggaauauuuaccugguguuacauuuaauauuu

SEQ ID NO: 141582 - RNA, 64 nt, Homo Sapiens
ggaaacccaggaauauuuaccugguguuacauuuaauauuuaauguaacuggucuagcaacauu

SEQ ID NO: 141583 - RNA, 64 nt, Homo Sapiens
gaagguguuuuucauucacuuuaauagaagggcaaauauuuauaagcuauuucuguaccaaagu

SEQ ID NO: 141584 - RNA, 64 nt, Homo Sapiens
guggaaacaaacauguaagcauaacuuauuuuaaaauauuuauuuauauaacuugguaaucaug

SEQ ID NO: 141585 - RNA, 64 nt, Homo Sapiens
uugauaugaugcuuaaauauugauuuuauuuuaaaauauuuauuauuuaauagcuuguuaccug

SEQ ID NO: 141586 - RNA, 64 nt, Homo Sapiens
cuguuagaaaaaaaaauuuuuucuuaacuauucaaauauuuauucuuugaagugagguacaugg

SEQ ID NO: 141587 - RNA, 64 nt, Homo Sapiens
aauuuuuccugcuucuaaaaacuuuucacauauuaauauuuagucccucagaaggaaaguccuu

SEQ ID NO: 141588 - RNA, 64 nt, Homo Sapiens
cuuguuuccagaauguuauucucagaauaaauguaauauuuauacaguuuagaaaguaucugga

SEQ ID NO: 141589 - RNA, 64 nt, Homo Sapiens
acuagaguuccuauuuucagauauuuagacuuugaauauuuagaccccucuccuuauuuuucua

SEQ ID NO: 141590 - RNA, 64 nt, Homo Sapiens
cuuugaauauuuagaacuagcuccuuauuuuucuaauauuuagaagcauuuugucauauccccu

SEQ ID NO: 141591 - RNA, 64 nt, Homo Sapiens
uuuuuuaaaguauuuucuagagcuauacuuuuaaaauauuuauuaauacuacauugucacugua

SEQ ID NO: 141592 - RNA, 64 nt, Homo Sapiens
uuguggaucuuugaaaagguugggaaccaagaaaaauauuuauuuuauuuggcaauaauggggg

SEQ ID NO: 141593 - RNA, 64 nt, Homo Sapiens
uacaaauaacaagacuaauauuucaaauugauaaaauauuuaggugacaauuuaugaauuugug

SEQ ID NO: 141594 - RNA, 64 nt, Homo Sapiens
ucuaugcuuuguugccucugaaagaaaaaacuuaaauauuuauucacagauugaagaagaaaag

SEQ ID NO: 141595 - RNA, 64 nt, Homo Sapiens
uaacaucaacagaacaacuugagaagaugagaggaauauuuaaaacgucuuugaaguuguggcu

SEQ ID NO: 141596 - RNA, 64 nt, Homo Sapiens
aaagcuuuauaaauuauauuuuucucuagaacaaaauauuuaguuucacauaagucaauagaug

SEQ ID NO: 141597 - RNA, 64 nt, Homo Sapiens
aguaaauacuccuuuccaacguugaauaaauaguaauauuuaucaaugcuuguuuuccaacuau

SEQ ID NO: 141598 - RNA, 64 nt, Homo Sapiens
cugggugucauguggaccagacuucugaauagagaauauuuauaacuuuuguaugagagagaau

SEQ ID NO: 141599 - RNA, 64 nt, Homo Sapiens
guuauugaaaaaaugucuuuucauggugaaugacaauauuuauguugccuuuagcuucuugaag

SEQ ID NO: 141600 - RNA, 64 nt, Homo Sapiens
gccugguuaauauuaauauucccauuuuauuaauaauauuuauguugggucaaguguuagguca

SEQ ID NO: 141601 - RNA, 64 nt, Homo Sapiens
ugacagacuauuugcuaauguauaaugugcagaaaauauuuaauaucaaaagaaaauugauauu

SEQ ID NO: 141602 - RNA, 64 nt, Homo Sapiens
cacacacguccucuccucccaggaaccucauucaaauauuuacccgggacacacaccccccccc

SEQ ID NO: 141603 - RNA, 64 nt, Homo Sapiens
gucugaauaguuauguguuucuuuuaucccuggaaauauuuauuaaacuuuauaguuuauccga

SEQ ID NO: 141604 - RNA, 64 nt, Homo Sapiens
uuuuggagauauguuucucucugaaauuacugugaauauuuaacaaacacuuacuugaucuaug

SEQ ID NO: 141605 - RNA, 64 nt, Homo Sapiens
uaagauugcaccuggcagugugccuuuuugcacaaauauuuacuuuugcacuuggagcugcuuu

SEQ ID NO: 141606 - RNA, 64 nt, Homo Sapiens
ggaaaauuaaaauuacuaauuaauuuuuagauucaauauuuauauggaguuuugaaaaauaaua

SEQ ID NO: 141607 - RNA, 64 nt, Homo Sapiens
ggcagagcacuuuauucuucuggugagcucccugaauauuuauuuuucugauuauaaauuuucu

SEQ ID NO: 141608 - RNA, 64 nt, Homo Sapiens
uacaguucugugaaaggacuuauuuuuuaacuguaauauuuauuaguuuuaaaauauuuguauc

SEQ ID NO: 141609 - RNA, 64 nt, Homo Sapiens
caguugaaugggguuaaagcuuucaauaucuuaaaauauuuauaaaacauuucacuguugcaaa

SEQ ID NO: 141610 - RNA, 64 nt, Homo Sapiens
uuuuuaugaaauaaagagguuacuauuucuaauaaauauuuauaagaaaaacuaaucuuaaaca

SEQ ID NO: 141611 - RNA, 64 nt, Homo Sapiens
guguuagaaaaccagccacauagccacucuuauuaauauuuauaacagauguaaauaauagcac

SEQ ID NO: 141612 - RNA, 64 nt, Homo Sapiens
aguggaaauaaaauuuguaauuuuaaauguugacaauauuuacacugguguuucauuaacuugg

SEQ ID NO: 141613 - RNA, 64 nt, Homo Sapiens
uagcaacuuuugugccagaauaagacuaauuacuaauauuuaugucuauaauuguuuuguaaug

SEQ ID NO: 141614 - RNA, 64 nt, Homo Sapiens
ccguuaaaacuguuuuuagaugaacuguguauaaaauauuuaugauacauuuuguuuugguaaa

SEQ ID NO: 141615 - RNA, 64 nt, Homo Sapiens
uauuuaauuuguucuacuagaauuacaguauuuuaauauuuaguuuuguuuuugcuaugaauau

SEQ ID NO: 141616 - RNA, 64 nt, Homo Sapiens
ugcaacuuacuagagugauguggcaaccaaggaaaauauuuagauuucuccauccuaaaaaaag

SEQ ID NO: 141617 - RNA, 64 nt, Homo Sapiens
aguggugcauuuuuaaguauggcuugcugaauuaaauauuuauguaaaaucaagucuugguugu

SEQ ID NO: 141618 - RNA, 64 nt, Homo Sapiens
gccagaaaaaucuuguacagacaauguguuaaguaauauuuaggauuauuguuauugaauccaa

SEQ ID NO: 141619 - RNA, 64 nt, Homo Sapiens
cauuuuaaagaaccacugugcagcaucuaagacaaauauuuaaacaguucucuuugucuauauu

SEQ ID NO: 141620 - RNA, 64 nt, Homo Sapiens
auuauguugaauguuaaauacuuauuuaucccaaaauauuuauuggggcucuaaaaugguuuca

SEQ ID NO: 141621 - RNA, 64 nt, Homo Sapiens
uuuuauauuuauuguugaaucuucuauuuauuuaaauauuuaaaccacuuaaaacauaucaggc

SEQ ID NO: 141622 - RNA, 64 nt, Homo Sapiens
caccucaauguagguacauuaaaacuguuggagaaauauuuaaauuucauaauguaauucaaug

SEQ ID NO: 141623 - RNA, 64 nt, Homo Sapiens
aguaccuggcuugaagccuauuucuuuuaaauuaaauauuuauuuguguugaguuuuuucuuuc

SEQ ID NO: 141624 - RNA, 64 nt, Homo Sapiens
ugucugcaguucucgaugaccgaaaguuaucaaaaauauuuaaaauauuuaaauugugaaccua

SEQ ID NO: 141625 - RNA, 64 nt, Homo Sapiens
uucucgaugaccgaaaguuaucaaaaauauuuaaaauauuuaaauugugaaccuauugauaaag

SEQ ID NO: 141626 - RNA, 64 nt, Homo Sapiens
uuaaaauauuuaaauugugaaccuauugauaaagaauauuuauaaaaacugaucuguaggccug

SEQ ID NO: 141627 - RNA, 64 nt, Homo Sapiens
uacaaauauguuuauguauuaaaucaccauccaaaauauuuaaggaauauauaaaaagauuuuu

SEQ ID NO: 141628 - RNA, 64 nt, Homo Sapiens
ccaagaagucacugcuuuuuagguguguugcaucaauauuuaaauaaaaucccagaaauguauu

SEQ ID NO: 141629 - RNA, 64 nt, Homo Sapiens
uuaggcaggaaugaucuuuucaaaucauuagcacaauauuuaaauaucuaaaaauuuaagagau

SEQ ID NO: 141630 - RNA, 64 nt, Homo Sapiens
aagaaauuauguuaaauagcccuguuuuaagaaaaauauuuaugaagcaucucaacuugaagau

SEQ ID NO: 141631 - RNA, 64 nt, Homo Sapiens
uuugccaaaauauuuuauuauaaaauaugaccaaaauauuuaaaaugcacaaugcuuuuaacuu

SEQ ID NO: 141632 - RNA, 64 nt, Homo Sapiens
auucaaacagcuuuaaacacuuccaaugagauaaaauauuuacuauuaugcuuauuagaacaaa

SEQ ID NO: 141633 - RNA, 64 nt, Homo Sapiens
agaaugggaauauuuuauacugacagaaaucaguaauauuuauauauuuauauuuuuaaaauau

SEQ ID NO: 141634 - RNA, 64 nt, Homo Sapiens
gaaaucaguaauauuuauauauuuauauuuuuaaaauauuuauuuauuuauuuauuuaaguuca

SEQ ID NO: 141635 - RNA, 64 nt, Homo Sapiens
aggagaaaaguaacuagaaaaauucaaauauuuaaauauuuaagacauuaguagauauaaacau

SEQ ID NO: 141636 - RNA, 64 nt, Homo Sapiens
uauuuaagaggagaaaaguaauaaacauaauucaaauauuuaaauaucuccuacauuaguagau

SEQ ID NO: 141637 - RNA, 64 nt, Homo Sapiens
ucuaaauuccagauuuuaagauuugggauuuucaaauauuuaaugacugcaagcuuuccugcca

SEQ ID NO: 141638 - RNA, 64 nt, Homo Sapiens
uauuuuuauaaauaaauguguguguaugaagguaaauauuuauauuacccacuggugguuugug

SEQ ID NO: 141639 - RNA, 64 nt, Homo Sapiens
ccuuccuugguagguagcuuggagugggaaauaaaauauuuagcgagaagauggggagggggug

SEQ ID NO: 141640 - RNA, 64 nt, Homo Sapiens
uaaaauugcaacuucuaaacacaaauaaaaagaaaauauuuauaggaggaaaugauuaauuuga

SEQ ID NO: 141641 - RNA, 64 nt, Homo Sapiens
caagaaauguaauaaauauuuguaauuuuacacaaauauuuaagaggaaagaguauuaagagca

SEQ ID NO: 141642 - RNA, 64 nt, Homo Sapiens
uuaacuuaugcaagggugugggagauguguacguaauauuuauuuguacguccuccuaggugau

SEQ ID NO: 141643 - RNA, 64 nt, Homo Sapiens
uguauuuauguacguccuccuauugcuccuaauuaauauuuauaagcgucguuaauuuauuucu

SEQ ID NO: 141644 - RNA, 64 nt, Homo Sapiens
aaaauugcacgcauauuagacauuaaaaaauauaaauauuuaugcuuuuuuuugguguguauuu

SEQ ID NO: 141645 - RNA, 64 nt, Homo Sapiens
agaaaugaauggaaggaaauuucaaguggauaacaauauuuauaaauuccuucaucagaacgac

SEQ ID NO: 141646 - RNA, 64 nt, Homo Sapiens
uuuacuaaacuaauagcauaugaaagcccucauaaauauuuauaauaugucauuuaaaauauuu

SEQ ID NO: 141647 - RNA, 64 nt, Homo Sapiens
uuagaauguauaugucauuuugaaucuggaguguaauauuuauaguaacaucaacucaguugua

SEQ ID NO: 141648 - RNA, 64 nt, Homo Sapiens
cccaagaaagugaaaacuaaaggucugcugauaaaauauuuaacccuuucucaagugugugaua

SEQ ID NO: 141649 - RNA, 64 nt, Homo Sapiens
uuaaucuuaauauuuuuacagacuuacauuguuuaauauuuauuaagcacauaccuauuuugua

SEQ ID NO: 141650 - RNA, 64 nt, Homo Sapiens
aagagaaacaggcagcagagaaagucucagucugaauauuuagcggaguaagauuagucauagu

SEQ ID NO: 141651 - RNA, 64 nt, Homo Sapiens
ugcuaaucaaaaaaaugaucuuuucucaaugcagaauauuuagaucucucaccccuuaaugcau

SEQ ID NO: 141652 - RNA, 64 nt, Homo Sapiens
uauguguucacauggucaaaugccaaagacuguaaauauuuauuugaugaaacgucauguguuu

SEQ ID NO: 141653 - RNA, 64 nt, Homo Sapiens
aagugacuauagaaugcaacauaaauauuuuguuaauauuuauuauuucauuaagguuccaguu

SEQ ID NO: 141654 - RNA, 64 nt, Homo Sapiens
cggacacuaauuuauauaggagugaaguuuuauaaauauuuaauauuuauuuuggauucaaauu

SEQ ID NO: 141655 - RNA, 64 nt, Homo Sapiens
uaauuuauauaggagugaaguuuuauaaauauuuaauauuuauuuuggauucaaauuguauuua

SEQ ID NO: 141656 - RNA, 64 nt, Homo Sapiens
aauguauuaagacaggacauauuguuggugagauaauauuuaauagguauaaaaugguaaaaua

SEQ ID NO: 141657 - RNA, 64 nt, Homo Sapiens
guuaggacacuauuuuaauuauuuuuaauuuauuaauauuuaaauaugugaagcugaguuaauu

SEQ ID NO: 141658 - RNA, 64 nt, Homo Sapiens
aaauaaauggcuaacuuauacauauuuuuaaagaaauauuuauauuguauuuauauaauguaua

SEQ ID NO: 141659 - RNA, 64 nt, Homo Sapiens
uuucaguuuuaucuaauaacuuacuuuuuaaaucaauauuuaucaacaaucuuuccuuguaugc

SEQ ID NO: 141660 - RNA, 64 nt, Homo Sapiens
gguuuaguuuacuucuguuccaccuuuugauugaaauauuuaguuguuaggcugaaagccucgg

SEQ ID NO: 141661 - RNA, 64 nt, Homo Sapiens
uugucuacauauaagguuuuuauuugaauuguaaaauauuuaaaaguaugaauaaaauauauuu

SEQ ID NO: 141662 - RNA, 64 nt, Homo Sapiens
acaguuuccccccaaaaaagagauuuauuuaugaaauauuuaaaguuucuaaugugguauuuua

SEQ ID NO: 141663 - RNA, 64 nt, Homo Sapiens
uauuuuaaauaaaguaucauaaauguaauaaguaaauauuuauuuaggaauacugugaacacug

SEQ ID NO: 141664 - RNA, 64 nt, Homo Sapiens
aaucuuuauacuauuuuacaguaaccacaaucuaaauauuuacauauacccaaaauuaacuuau

SEQ ID NO: 141665 - RNA, 64 nt, Homo Sapiens
uauaugcaaaguuuuucaaccaagugguuugucuaauauuuaaacauguacuggcacaauuugu

SEQ ID NO: 141666 - RNA, 64 nt, Homo Sapiens
uaaauuuuuguauagacauuccuuugguuggaagaauauuuauaggcaauacagucaaaguuuc

SEQ ID NO: 141667 - RNA, 64 nt, Homo Sapiens
agaaaauuuguaugaaauaauuuagucaucaugaaauauuuaguugucauauaaaaacccacug

SEQ ID NO: 141668 - RNA, 64 nt, Homo Sapiens
gcuuaacaaacaugaaguaugguguaauaggaauaauauuuauccaaaagauuuuuaaaaauag

SEQ ID NO: 141669 - RNA, 64 nt, Homo Sapiens
uauaugaaaaccaaucugagccuuguaucucuuaaauauuuauuuuuuuuaacgugugagaugu

SEQ ID NO: 141670 - RNA, 64 nt, Homo Sapiens
ucaugagcaguacagcuaauuacacauauuuccaaauauuuauuuaugaccugcagaaaauauu

SEQ ID NO: 141671 - RNA, 64 nt, Homo Sapiens
cauauuuccaaauauuuauuuaugaccugcagaaaauauuuacagugcccuaaaaugguguucu

SEQ ID NO: 141672 - RNA, 64 nt, Homo Sapiens
uuggcacacuuuuuuuagaaugggccagaugguaaauauuuaugcuucacgguccauacagucu

SEQ ID NO: 141673 - RNA, 64 nt, Homo Sapiens
uugaaaacuuauaaaccuaacagaaaagccacauaauauuuagugucauuaugcaauaaucaca

SEQ ID NO: 141674 - RNA, 64 nt, Homo Sapiens
auaguaauaaaguaguauuuauaggaauuuauaaaauauuuaugugauuuuuaucauguuuuaa

SEQ ID NO: 141675 - RNA, 64 nt, Homo Sapiens
guguacucuguucguugauuuguuuaaaaauaaaaauauuuauuaugaaagauguacaauucag

SEQ ID NO: 141676 - RNA, 64 nt, Homo Sapiens
gucagucuacuuuuuaguaaaucacuauucuuggaauauuuaugacuagcauuggaaaauacau

SEQ ID NO: 141677 - RNA, 64 nt, Homo Sapiens
uuucuuaguaaaaagaauaauucccccaaacaacaauauuuaaugaucuaaaaaagagaggaga

SEQ ID NO: 141678 - RNA, 64 nt, Homo Sapiens
uuuaggauaaugaagaguacauaauguccuacuuaauauuuauguuaauaggacuuaauucuua

SEQ ID NO: 141679 - RNA, 64 nt, Homo Sapiens
gaauaucuuuccuaguaaaaauaggauguguugaaauauuuauauguacuuugaucucuccaca

SEQ ID NO: 141680 - RNA, 64 nt, Homo Sapiens
uguacauuuauuaugucuuuuuuuaaagaauggaaauauuuauuucagaggccuuauuuuugga

SEQ ID NO: 141681 - RNA, 64 nt, Homo Sapiens
gcaugaacuguaaagcuguguguauuagguguaaaauauuuauaagauauauggacuggggaau

SEQ ID NO: 141682 - RNA, 64 nt, Homo Sapiens
aaaugcucauucuuuguagaguuucacuguuuguaauauuuaagaucuguaagcuaguauauuu

SEQ ID NO: 141683 - RNA, 64 nt, Homo Sapiens
uaaauauugcuuugaagaugaggcagaauaaguuaauauuuaauggcauagcaguuuuugaccc

SEQ ID NO: 141684 - RNA, 64 nt, Homo Sapiens
aacaugguaagccugguauuuuuuaaucaaacaaaauauuuaugaaauggguuuucucuuaauu

SEQ ID NO: 141685 - RNA, 64 nt, Homo Sapiens
ucuggauucaucauggcuuucuaauaccaauuguaauauuuacaauauucaccaaaacuuagaa

SEQ ID NO: 141686 - RNA, 64 nt, Homo Sapiens
uauagaaccacuuuuuguagauuaguauaagaaaaauauuuacccuguuuuggggcaaaugcua

SEQ ID NO: 141687 - RNA, 64 nt, Homo Sapiens
uggguauuuuauuauguguuuuguauaaaucccuaauauuuaaaaaaaaaaacaaaacaaaaaa

SEQ ID NO: 141688 - RNA, 64 nt, Homo Sapiens
uggacccauugaggauaacuauaaaauuacagaaaauauuuaaaugcaacuuauugcuauagaa

SEQ ID NO: 141689 - RNA, 64 nt, Homo Sapiens
ucuaggaacagauggcuucacugaaguuauuccaaauauuuaagaaauaauaccaggcuuuuau

SEQ ID NO: 141690 - RNA, 64 nt, Homo Sapiens
aaaaaaugcuacaaugacuuccuauuaaagguucaauauuuacacauucuuauugguugauauu

SEQ ID NO: 141691 - RNA, 64 nt, Homo Sapiens
aacacacccgagaaaucuuaaauagacacuuugcaauauuuaagaaccuaaugcuguuuaauuu

SEQ ID NO: 141692 - RNA, 64 nt, Homo Sapiens
uaggaaaauguucuggugauugucagggucuccuaauauuuaucucaauucuuuuauaagucua

SEQ ID NO: 141693 - RNA, 64 nt, Homo Sapiens
uggaggacucguacuuaggucuucccauuuguguaauauuuaccauacuuaaaaauucaagaug

SEQ ID NO: 141694 - RNA, 64 nt, Homo Sapiens
gaaucaugauucagauuguagggaagugggguauaauauuuaacgaccagccuaaauauucugg

SEQ ID NO: 141695 - RNA, 64 nt, Homo Sapiens
gcacaucacuguguauauauagaaccugcugucaaauauuuacacaggguuuuaauuuucucag

SEQ ID NO: 141696 - RNA, 64 nt, Homo Sapiens
uauacccauauucacaguggcaaauauaauggacaauauuuauugugauaccaaaauuuuguug

SEQ ID NO: 141697 - RNA, 64 nt, Homo Sapiens
uggaauuuauguuguuuaguaguaauauggugaaaauauuuaucaggggaauucuauucaucua

SEQ ID NO: 141698 - RNA, 64 nt, Homo Sapiens
uaucaagcacuuuguuaugcaaucacucauucaaaauauuuaaggauauguucccucacugaaa

SEQ ID NO: 141699 - RNA, 64 nt, Homo Sapiens
aucacucuuacuuuauauucuguaaaaacuguuaaauauuuaguggucuucacagcgcucauac

SEQ ID NO: 141700 - RNA, 64 nt, Homo Sapiens
aauauagaugugaauaucaauaaguagacugugaaauauuuauuuugcucuauaguagaauauu

SEQ ID NO: 141701 - RNA, 64 nt, Homo Sapiens
uagacugugaaauauuuauuuugcucuauaguagaauauuuaagauuuguuuuuguuagaugau

SEQ ID NO: 141702 - RNA, 64 nt, Homo Sapiens
uaaaguauuucuugucuguguguucauuuuacacaauauuuaaugauauuuaacuguauaaaaa

SEQ ID NO: 141703 - RNA, 64 nt, Homo Sapiens
aaaacaaguuuuauuccuuaucagauccacuuaaaauauuuagaacacuugucuugaauuuuuu

SEQ ID NO: 141704 - RNA, 64 nt, Homo Sapiens
cacuugucuugaauuuuuuucaaaguuguagcuaaauauuuauaguagacuuuugugauuuugc

SEQ ID NO: 141705 - RNA, 64 nt, Homo Sapiens
ucauauauauggcauaauuuugaauaucauggacaauauuuagaacccaaauuuuggagugcuu

SEQ ID NO: 141706 - RNA, 64 nt, Homo Sapiens
uguguuuacuaacacacuuaauguuuauauaccuaauauuuauuaugccauaucugaauuuauu

SEQ ID NO: 141707 - RNA, 64 nt, Homo Sapiens
uguguuuguaugguguuaugcaaccucuuuccugaauauuuaaaagacuaagcaauaaucuuaa

SEQ ID NO: 141708 - RNA, 64 nt, Homo Sapiens
gaagagaugaagcucugcaguuacaguacuugaaaauauuuaaguuuuucauggauuuguguuc

SEQ ID NO: 141709 - RNA, 64 nt, Homo Sapiens
uuuuuuccauuuugcucuuuaaacaggaacagcaaauauuuauaaauaaaugcacaaaagauau

SEQ ID NO: 141710 - RNA, 64 nt, Homo Sapiens
uuuuuuuuuacuguaaguauuuauaccuuucuauaauauuuagagggaauucuuacuuuuugcu

SEQ ID NO: 141711 - RNA, 64 nt, Homo Sapiens
uaaucuggaaaacaauguaaauucuccuaacugaaauauuuacuaaauaaaaauaaaaauaugu

SEQ ID NO: 141712 - RNA, 64 nt, Homo Sapiens
ucccacuuuuuacuguuuggaaacuccucuuugaaauauuuauugcuacauaacuauauauaau

SEQ ID NO: 141713 - RNA, 64 nt, Homo Sapiens
gaccaucucaaaagaugccaacguugucuuugauaauauuuaauauauuuuuuaaaaaacaauu

SEQ ID NO: 141714 - RNA, 64 nt, Homo Sapiens
ucgcugcuaaauuauucuucacuugagugaagcaaauauuuagcuuccaaauaaaguauauuuu

SEQ ID NO: 141715 - RNA, 64 nt, Homo Sapiens
ugggucucuauguuuuggaaguuggggguuuaauaauauuuaaugucuuuuuaggaucauaaac

SEQ ID NO: 141716 - RNA, 64 nt, Homo Sapiens
uuuuuuuuuuuuuuuuaaauccaguauuuaggauaauauuuaugcuuaguguaaacauucugug

SEQ ID NO: 141717 - RNA, 64 nt, Homo Sapiens
ugacaguguuuauugauuugaagucauauuaggaaauauuuagacaaugaaaauuaucaagaga

SEQ ID NO: 141718 - RNA, 64 nt, Homo Sapiens
aggacuagggcuuucucauggaguacaguauguuaauauuuaccuauauaacuaaucuguuaac

SEQ ID NO: 141719 - RNA, 64 nt, Homo Sapiens
cacuuuuaaucuguaauuuuaaaauacaagucugaauauuuauaguugauucuuaacugcauaa

SEQ ID NO: 141720 - RNA, 64 nt, Homo Sapiens
cccagggagcaugcuguuuugucaaucaauauaaaauauuuaugaggucucccccacccccagg

SEQ ID NO: 141721 - RNA, 64 nt, Homo Sapiens
ggguccccauuuuagugggaacaaguauuuaaacaauauuuagagcaaguguccucaugugaua

SEQ ID NO: 141722 - RNA, 64 nt, Homo Sapiens
ugaagacagaaauauguaugaggaugaucacugaaauauuuaugacagugcauaauuugcaaaa

SEQ ID NO: 141723 - RNA, 64 nt, Homo Sapiens
auguaagcacuauccagguauaagggcaaaaaccaauauuuauagauuuuucuuauguuagcac

SEQ ID NO: 141724 - RNA, 64 nt, Homo Sapiens
uuugugggugucgacuuccugaacuuuuguuugcaauauuuauuugagugugaaguguauguga

SEQ ID NO: 141725 - RNA, 64 nt, Homo Sapiens
caguucagugaacugguacaauguggucccucucaauauuuaaaaauauaauuuguaacagugc

SEQ ID NO: 141726 - RNA, 64 nt, Homo Sapiens
auaaaaugcagaacauuucuauccuauccuaccaaauauuuauccuucucuguccucuauucuc

SEQ ID NO: 141727 - RNA, 64 nt, Homo Sapiens
acgacauguuaauaaacaaaagcuguauuuauguaauauuuagaguuugauacucuaguaugua

SEQ ID NO: 141728 - RNA, 64 nt, Homo Sapiens
aaguuccuaauauaagugaaucauucauucaacaaauauuuaccaauucauauccauagauagu

SEQ ID NO: 141729 - RNA, 64 nt, Homo Sapiens
uuaagaggcaucuuacaaauauuuuauaaaaaagaauauuuauuuauuuauuugaaguuuuauu

SEQ ID NO: 141730 - RNA, 64 nt, Homo Sapiens
ugaaguuuuauuauuuuauauguuuaguguaaagaauauuuauuuucuaauuuuuucaacauau

SEQ ID NO: 141731 - RNA, 64 nt, Homo Sapiens
ucuucacuguuucaccaucuagcuugcuaagucaaauauuuaugaugauaaugagguacugaac

SEQ ID NO: 141732 - RNA, 64 nt, Homo Sapiens
uauugaccuauauucaugaaagcauauaaauuaaaauauuuaaaauuagauaugauucacacua

SEQ ID NO: 141733 - RNA, 64 nt, Homo Sapiens
uagagaaugauuuuaaaaggguucucuaucucuaaauauuuauuggacuguuauuucauuuaga

SEQ ID NO: 141734 - RNA, 64 nt, Homo Sapiens
agguuaaaacuguggaaaauuaaaagcacuguaaaauauuuaaacaaaaagcaauauaguugca

SEQ ID NO: 141735 - RNA, 64 nt, Homo Sapiens
ugaauugaauuccugaugggugaagaagaaaaaaaauauuuaaagguauucauuuugaguaggu

SEQ ID NO: 141736 - RNA, 64 nt, Homo Sapiens
ccuuauuuauuaaucucuuguuuuuguaaaacagaauauuuaauuauauuggccauucuguaug

SEQ ID NO: 141737 - RNA, 64 nt, Homo Sapiens
cauuuauagguagaauucugacauuagccugcuuaauauuuagauuaaaucuagcccaguauaa

SEQ ID NO: 141738 - RNA, 64 nt, Homo Sapiens
gcgguauugcucugugaauugccgaaagugcuaaaauauuuaguuccaauaaaagugguguagu

SEQ ID NO: 141739 - RNA, 64 nt, Homo Sapiens
auucaaaaguaauuaauaguuuuuuaaaauuaaaaauauuuaaaaacuauuaaaacaauagggc

SEQ ID NO: 141740 - RNA, 64 nt, Homo Sapiens
auaggacucgacuuggagaaaauacaaaaaugaaaauauuuauauaaauugagacucaaaguga

SEQ ID NO: 141741 - RNA, 64 nt, Homo Sapiens
gacauuccuuauacaugacagaagcuucaaauggaauauuuaccucgagggaaauauguacaaa

SEQ ID NO: 141742 - RNA, 64 nt, Homo Sapiens
uuuuaccaauauaugccuguagccugaguccgagaauauuuauaacuguccucacuuagaacaa

SEQ ID NO: 141743 - RNA, 64 nt, Homo Sapiens
aacuaccugaugccaggagcaucacaaaucucuuaauauuuauagugauuugugaucaaguuua

SEQ ID NO: 141744 - RNA, 64 nt, Homo Sapiens
uccgauuuggaaccuuagauugacuuguuuuaaaaauauuuaaugaguuuuugagcaaauuagg

SEQ ID NO: 141745 - RNA, 64 nt, Homo Sapiens
uuauucggaaauauauuccaauauuguaugucuuaauauuuaacaaaaguaggacauuauugcc

SEQ ID NO: 141746 - RNA, 64 nt, Homo Sapiens
uugugcuuaugugguguuugaaaaauauuuugacaauauuuaauaauggucuucaauuuaauuu

SEQ ID NO: 141747 - RNA, 64 nt, Homo Sapiens
agucaucauauguauaugucauaugacuuuauaaaauauuuaaugugacaaaaaguggaaagaa

SEQ ID NO: 141748 - RNA, 64 nt, Homo Sapiens
cuuuuacucuuugguuuuaucauuccauuuugcuaauauuuacuagcuuuauaaauuacaguaa

SEQ ID NO: 141749 - RNA, 64 nt, Homo Sapiens
cuuuuuacuuuuaugcauuuuaauaagauuuaaaaauauuuagauuaaagcccccuuuaaugag

SEQ ID NO: 141750 - RNA, 64 nt, Homo Sapiens
aaugucaaagcacauaucuuuaauaugcugaaugaauauuuauuuuuguauccauuaaaacagu

SEQ ID NO: 141751 - RNA, 64 nt, Homo Sapiens
aacccaaauuaucaaaccaugauauuuaauauuuaauauuuaaaucauuccuuccgaaaccccu

SEQ ID NO: 141752 - RNA, 64 nt, Homo Sapiens
auuuaaaaacccaaauuaucaaccccugauauuuaauauuuaaugaauucaucauuccuuccga

SEQ ID NO: 141753 - RNA, 64 nt, Homo Sapiens
uacuucaguugguuuuggaaucugccuuauaccuaauauuuauuuauucacacucauaagcauc

SEQ ID NO: 141754 - RNA, 64 nt, Homo Sapiens
ccuaauauuuauuuauucacacucauaagcaucaaauauuuaaugcccucagugggaaauuugu

SEQ ID NO: 141755 - RNA, 64 nt, Homo Sapiens
aagcccuccccaucccauguauuuaucucuauuuaauauuuaugucuauuuaagccucauauuu

SEQ ID NO: 141756 - RNA, 64 nt, Homo Sapiens
ggucucccacgugggagacaagaaaucccuguuuaauauuuaaacagcaguguuccccaucugg

SEQ ID NO: 141757 - RNA, 64 nt, Homo Sapiens
uaugauaaaggcuuaggacuucaaaaggugauuaaauauuuaaugaugugucauaugaguccuc

SEQ ID NO: 141758 - RNA, 64 nt, Homo Sapiens
aaguagauuuguaguuugucccauuuauuauuuuaauauuuauguuuaagugcuugguugaaaa

SEQ ID NO: 141759 - RNA, 64 nt, Homo Sapiens
gagauucaaaaaaaaaauauaagguuggguuagcaauauuuauagggcuuuuauuuuuuaaguu

SEQ ID NO: 141760 - RNA, 64 nt, Homo Sapiens
uuccucuggauagucaaaccuaauuuuauauaaaaauauuuaauuggcaauauuuauuauaauu

SEQ ID NO: 141761 - RNA, 64 nt, Homo Sapiens
auaauuuaauuuuauauaaaggaaagcauuuggcaauauuuauuagacuuggaacaaugcuaaa

SEQ ID NO: 141762 - RNA, 64 nt, Homo Sapiens
ucuaaaaugaaucaguuucuaaagugaaacaugcaauauuuaugcucugacugacuccugaauu

SEQ ID NO: 141763 - RNA, 64 nt, Homo Sapiens
cuuuuugucuacuucgcaagucucaaaacgugauaauauuuaagcccauuuguagaagaaaucu

SEQ ID NO: 141764 - RNA, 64 nt, Homo Sapiens
caugauauucaguacaacucugucauuucuuuguaauauuuaaaaaauauuaguaaaggaguga

SEQ ID NO: 141765 - RNA, 64 nt, Homo Sapiens
ccuguaaaguucugaccuugauaacaaagcuauaaauauuuaaguuugcuaauaugcguaagua

SEQ ID NO: 141766 - RNA, 64 nt, Homo Sapiens
aggaaguaugauuucaaggaucuuuauuuugcucaauauuuaauuauaaauaauuuucuuuuaa

SEQ ID NO: 141767 - RNA, 64 nt, Homo Sapiens
cuauuaaacugaguuuaacaucaauucuuauuugaauauuuauucuacuggaauauugguauag

SEQ ID NO: 141768 - RNA, 64 nt, Homo Sapiens
gauguggggagauguaauaauggaugcguaaaguaauauuuacaugcuuaaaauaagcaaaaau

SEQ ID NO: 141769 - RNA, 64 nt, Homo Sapiens
augaaaugagaacaaagagguuauuaaucaaugcaauauuuaaaaaauguguguguguauauua

SEQ ID NO: 141770 - RNA, 64 nt, Homo Sapiens
gacauuucagcgagacaaaguuuggugcucagacaauauuuaagagauccuugcuuuugcagaa

SEQ ID NO: 141771 - RNA, 64 nt, Homo Sapiens
uuggucagucagguagaagaagauucuugggcagaauauuuaaauauucugugacaaaaaguua

SEQ ID NO: 141772 - RNA, 64 nt, Homo Sapiens
gaguuuuauugaccccucuaauucucuuacccagaauauuuauccuucaccagcaacucugacu

SEQ ID NO: 141773 - RNA, 64 nt, Homo Sapiens
agaaucaauugucuauauggaauuuaggauaaagaauauuuacaauaaagaauauuuacaauaa

SEQ ID NO: 141774 - RNA, 64 nt, Homo Sapiens
auggaauuuaggauaaagaauauuuacaauaaagaauauuuacaauaaagaguuuauuauuauu

SEQ ID NO: 141775 - RNA, 64 nt, Homo Sapiens
uaagaauuaauuggcuauauggaauuuaggauagaauauuuacaauaaagaguauuuacaauaa

SEQ ID NO: 141776 - RNA, 64 nt, Homo Sapiens
acaacaacucauuuuuacagaguuugugaagcuaaauauuuaacauuguugauuucaguaagcu

SEQ ID NO: 141777 - RNA, 64 nt, Homo Sapiens
auauauggaguuucgaagaauaaaauaugagagcaauauuuaaauucucaggaauugacuuaua

SEQ ID NO: 141778 - RNA, 64 nt, Homo Sapiens
uucuuucuguaaccauaacaucucugugugcacaaauauuuauuuguagaaugauuucaugcua

SEQ ID NO: 141779 - RNA, 64 nt, Homo Sapiens
uuuuuuaaguauuuagguuucuagggaugacuaaaauauuuauugcagaccuugaccucguggg

SEQ ID NO: 141780 - RNA, 64 nt, Homo Sapiens
acuauaaacuuuauagaagucuuauguggcauacaauauuuauauauauguaagaauuuuauug

SEQ ID NO: 141781 - RNA, 64 nt, Homo Sapiens
aguucuguuaaaagcagagcucuauguauuauuaaauauuuacuugcaaauaacuagccauuau

SEQ ID NO: 141782 - RNA, 64 nt, Homo Sapiens
cagcuguauacauuuuugggcaacgguuaugcauaauauuuaccaggagaauuuuuuucuuaac

SEQ ID NO: 141783 - RNA, 64 nt, Homo Sapiens
caaauaccuuccaaugaaaccaagaauuucucaaaauauuuaaugucacauauuauaagaaguu

SEQ ID NO: 141784 - RNA, 64 nt, Homo Sapiens
gauuucuagauacuuuuugcugcuaguuuuauguaauauuuauugaacauuuugacaaauauuu

SEQ ID NO: 141785 - RNA, 64 nt, Homo Sapiens
uaguuuuauguaauauuuauugaacauuuugacaaauauuuauuuuuguaagccuaaaagugau

SEQ ID NO: 141786 - RNA, 64 nt, Homo Sapiens
gucuagauauagccccauuacuacaaaaugcuaaaauauuuaaugaaaauugaugguggccaca

SEQ ID NO: 141787 - RNA, 64 nt, Homo Sapiens
auuucauauacacagucuauacaaugaaauaaugaauauuuaucauauugauacaaacugugac

SEQ ID NO: 141788 - RNA, 64 nt, Homo Sapiens
aaucaagucuuuuaauaauucauuuuuucuucauaauauuuacucaaaguuaagcuuaaaaaua

SEQ ID NO: 141789 - RNA, 64 nt, Homo Sapiens
cgaaauguuagguaaucauuuagaaaggacagaaaauauuuaaaguggcucauagguaaugaau

SEQ ID NO: 141790 - RNA, 64 nt, Homo Sapiens
uauguauguaauaaaaaaagggucauuuaaagucaauauuuauugaauucaugucccuuacagu

SEQ ID NO: 141791 - RNA, 64 nt, Homo Sapiens
aaguggauauuccaggaauguuccuguguguuaaaauauuuaaauaauagauauugaaacccau

SEQ ID NO: 141792 - RNA, 64 nt, Homo Sapiens
ucuuugaaauaaucaguaaauaaaauguauugauaauauuuacauaaaaguucagacagcucug

SEQ ID NO: 141793 - RNA, 64 nt, Homo Sapiens
aauggaauuuuucauuugccuuagguuaaugaccaauauuuauaccuuuuaauauacucuugga

SEQ ID NO: 141794 - RNA, 64 nt, Homo Sapiens
aagaaaauacuuaaauguuaucuuuuugcucuaaaauauuuaugaccauugcaacaaaauacau

SEQ ID NO: 141795 - RNA, 64 nt, Homo Sapiens
guugaacaaaauaaauuggauuuuuguaaagaaaaauauuuaauauuagccuaagauauacuug

SEQ ID NO: 141796 - RNA, 64 nt, Homo Sapiens
acagauuuuagauacuuuuugcugcuaguuguguaauauuuauugaacauuuugacaaauauuu

SEQ ID NO: 141797 - RNA, 64 nt, Homo Sapiens
gcuaguuguguaauauuuauugaacauuuugacaaauauuuauuuuuguaagccuaaaaaugau

SEQ ID NO: 141798 - RNA, 64 nt, Homo Sapiens
gagugcaauagcacgaucuuggcucaccgcaaccucugccuaccggguucaagugauucuugug

SEQ ID NO: 141799 - RNA, 64 nt, Homo Sapiens
gagugcacuggcgugaucucggcucacugcaccuucugccuaccgaguucaagcgauucuugug

SEQ ID NO: 141800 - RNA, 64 nt, Homo Sapiens
cuggagacuggaccugccacauguuccaagucugucugccuaggucacugcugccacuucuccu

SEQ ID NO: 141801 - RNA, 64 nt, Homo Sapiens
auuuugccuuuugugcugacuugacagcuucacuucugccuaagaugcgccuccacugucaccu

SEQ ID NO: 141802 - RNA, 64 nt, Homo Sapiens
uccccaauuacccuuagaaaaugaucacaccaacucugccuacacacuuccagugauaguggcu

SEQ ID NO: 141803 - RNA, 64 nt, Homo Sapiens
cuuuguuagaaaguucuuucuuagguugcuaaaaucugccuaguaccccgcuacccuguucugu

SEQ ID NO: 141804 - RNA, 64 nt, Homo Sapiens
uccuccuucucuccccagagcccccuugagccccucugccuaugucccucugccuccuccccau

SEQ ID NO: 141805 - RNA, 64 nt, Homo Sapiens
guuuuguuuuccaaaucaagguaacuugcucccuucugccuacaggccuuggucuuggcuuguc

SEQ ID NO: 141806 - RNA, 64 nt, Homo Sapiens
agaaugcaggcugcuguagucucagguaaugaaggcacagcacagcaguacuccacauuguuuc

SEQ ID NO: 141807 - RNA, 64 nt, Homo Sapiens
gcaggcugcuguagucucagguaaugaaggcacagcacagcaguacuccacauuguuuccuauu

SEQ ID NO: 141808 - RNA, 64 nt, Homo Sapiens
gcuccccaccacagccccagcugccucagagcaggcacagcacaaggcaggcccagccccaugg

SEQ ID NO: 141809 - RNA, 64 nt, Homo Sapiens
agacccuugacugugacuggcaggcaggugaggggcacagcaccccuccccggcaucugccagc

SEQ ID NO: 141810 - RNA, 64 nt, Homo Sapiens
aacguugguaaaagggcagucacuucucugggcugcacagcagauucucccucuccuucccuga

SEQ ID NO: 141811 - RNA, 64 nt, Homo Sapiens
cacugcucguuguaaaugccuguaccaucuugaggcacagcagcuauaugauuccaguucugca

SEQ ID NO: 141812 - RNA, 64 nt, Homo Sapiens
auggccuguggcccgagggccaaccaccgagcaggcacagcacagcagugacucggugagggga

SEQ ID NO: 141813 - RNA, 64 nt, Homo Sapiens
cuguggcccgagggccaaccaccgagcaggcacagcacagcagugacucggugaggggaggaca

SEQ ID NO: 141814 - RNA, 64 nt, Homo Sapiens
agugauggcgaggacuucccagcggggagcugcagcacagcaacuugggagagagcuggggcag

SEQ ID NO: 141815 - RNA, 55 nt, Homo Sapiens
uggccgaggcaggacacugcugcaggcacagcagacggcuagggcuuggggguga

SEQ ID NO: 141816 - RNA, 64 nt, Homo Sapiens
gccaugugcagggcguccccgccuuccagucauugcacagcaaaucuacugcccaugccgggcg

SEQ ID NO: 141817 - RNA, 64 nt, Homo Sapiens
ggcugcacggugcacgcauuagaggccucccugggcacagcacagcaacugccaaucccgcuga

SEQ ID NO: 141818 - RNA, 64 nt, Homo Sapiens
ugccaaucccgcugaagaggugccuguucucagggcacagcaacauucagggaucacacaguuc

SEQ ID NO: 141819 - RNA, 64 nt, Homo Sapiens
ugcuggguggcccauccccccucaccaggggcaggcacagcacagggauccgacuugaauuuuc

SEQ ID NO: 141820 - RNA, 64 nt, Homo Sapiens
cugcccaggacggggccggccaggugggcgggcagcacagcaaggaggcuggcuggggccuauc

SEQ ID NO: 141821 - RNA, 64 nt, Homo Sapiens
gaccccagagccaggaaccucacacccggugggggcacagcacaagcaccucccaccaaccaac

SEQ ID NO: 141822 - RNA, 64 nt, Homo Sapiens
gaccccagaggcaggaaccucacacccggugggggcacagcacaagcaccucccaccaaccagc

SEQ ID NO: 141823 - RNA, 64 nt, Homo Sapiens
gaccccagagccaggaaccucacacccagugggggcacagcacaagcaccucccaccaaccagc

SEQ ID NO: 141824 - RNA, 64 nt, Homo Sapiens
uugguuuugcugagaucgaaaaagcaauuagguagcacagcacuguuggaaaggaaaaaagaaa

SEQ ID NO: 141825 - RNA, 64 nt, Homo Sapiens
gggggagagggacacuccucgagaauugacugaagcacagcaccguuugagagcccgcgugcug

SEQ ID NO: 141826 - RNA, 64 nt, Homo Sapiens
auuccacccgcccgcccugcugcagauacaugcggcacagcaggcacgugccuggagagaacag

SEQ ID NO: 141827 - RNA, 64 nt, Homo Sapiens
cagcaggcacgugccuggagagaacagcuccugagcacagcacccuuggagcccucaccccgcu

SEQ ID NO: 141828 - RNA, 64 nt, Homo Sapiens
ugaagccaugugggacaguucaugcuggggaccagcacagcaccacagcugcccagccuguuca

SEQ ID NO: 141829 - RNA, 64 nt, Homo Sapiens
uguggggugugggcaucuucccaggaguacccaugcacagcagcuugccuuaaugccagguggc

SEQ ID NO: 141830 - RNA, 64 nt, Homo Sapiens
aaguaauucguuagaugcuuagaaauugugcacagcacagcaucaaaguucuuuccugccagau

SEQ ID NO: 141831 - RNA, 64 nt, Homo Sapiens
gcaucaaguaauucguuagacagauagaaauugugcacagcacauuuccaaaguucuuuccugc

SEQ ID NO: 141832 - RNA, 64 nt, Homo Sapiens
acuugaauagcaauaaaagcguguuaacuuuuugauugaugaaagaaguacaaaaagccuuuag

SEQ ID NO: 141833 - RNA, 64 nt, Homo Sapiens
auuuuuuuaugccaaauuuuuuuuaguucuaaucauugaugauagcuuggaaauaaauaauuau

SEQ ID NO: 141834 - RNA, 64 nt, Homo Sapiens
ugggcccuaauaauccuaaaaagaauggagcugcauugaugaauuggcucaguauuuaaaggga

SEQ ID NO: 141835 - RNA, 64 nt, Homo Sapiens
agggagaaaugucaugagacguuggacaggcaggauugaugauagcaugaccauagcuuugcug

SEQ ID NO: 141836 - RNA, 64 nt, Homo Sapiens
aucuuugugcacaggcuguucuuuucaguuauaaauugaugaauaucacuaaugcuguuacuaa

SEQ ID NO: 141837 - RNA, 64 nt, Homo Sapiens
ucuggacagaaagaugcccgguugcccaguuccuauugaugagccccuggcggcuccccaccug

SEQ ID NO: 141838 - RNA, 64 nt, Homo Sapiens
accacuuccaaacuuuucagcguuggauaaaaugauugaugaggcaggcagaaggaauguaggu

SEQ ID NO: 141839 - RNA, 64 nt, Homo Sapiens
uuguguuugcuucauuuuuaaugaugacuucaagauugaugaugugauccaauaacuguggagg

SEQ ID NO: 141840 - RNA, 64 nt, Homo Sapiens
gcaauucugguauccucuaaauuuguaagcauucauaaaacaggaaaaaguaaacuaucauucg

SEQ ID NO: 141841 - RNA, 64 nt, Homo Sapiens
guuggugcucaaugcaguguagacauguuuucaaauaaaacaaaugauuguguacaacaaugag

SEQ ID NO: 141842 - RNA, 64 nt, Homo Sapiens
aagaugacugaaccuugcaguucugugaauuuuuauaaaacauacaaaaacuuuguauauacac

SEQ ID NO: 141843 - RNA, 64 nt, Homo Sapiens
acaaaaggugccuauucuuuuuuaaaaaaauaaaauaaaacauaaauauuacucuuccauauuc

SEQ ID NO: 141844 - RNA, 64 nt, Homo Sapiens
uuuugcuuccagcaaguauguuagacuagauauuauaaaacaacuagauccugaauaaaaucug

SEQ ID NO: 141845 - RNA, 64 nt, Homo Sapiens
ugauaaacauaaguaaauuuaaacuguuguuuguauaaaacaauuauaaugaaguguuuauaag

SEQ ID NO: 141846 - RNA, 64 nt, Homo Sapiens
cauucuggcugauuuuaagccauuuaaaauuuauauaaaacaaccuuccauaaaaauuugacag

SEQ ID NO: 141847 - RNA, 64 nt, Homo Sapiens
aaaauguaauuuuccagaaaaacaccuaaagaaaauaaaacauggacaugccuaguaaauucug

SEQ ID NO: 141848 - RNA, 64 nt, Homo Sapiens
gacugaugggucugcuccagcauucagucuguucauaaaacaugaaugguggaugcuacggaca

SEQ ID NO: 141849 - RNA, 64 nt, Homo Sapiens
uuaagaaauugguuuaagauaaaaguaccuuugaauaaaacaauaagaauaggggcaagacgac

SEQ ID NO: 141850 - RNA, 64 nt, Homo Sapiens
ucuuuagcacacuaggugguaugccuuuauuagcauaaaacaaaaaaaacuuuaacaggagcuu

SEQ ID NO: 141851 - RNA, 64 nt, Homo Sapiens
caaauuauucuuuuauauaacugaccagugcuuaauaaaacaagcagguacuuacaaauaauua

SEQ ID NO: 141852 - RNA, 64 nt, Homo Sapiens
uaaaacuaggcuacagguauuuuaaaagaacuaaauaaaacaaaauaaaacuaaugaaggguuu

SEQ ID NO: 141853 - RNA, 64 nt, Homo Sapiens
ugacaaaaccagccuugguggaugucuacacucaauaaaacauugcauguuuuacaguacucca

SEQ ID NO: 141854 - RNA, 64 nt, Homo Sapiens
auuuugaaugcauucaggaauuaguucuuuguaaauaaaacagguuucugagaauuuguuugaa

SEQ ID NO: 141855 - RNA, 64 nt, Homo Sapiens
auuugccuuucaauuuauacucauagucugagucauaaaacaucuuaaugcuuuuauagacuac

SEQ ID NO: 141856 - RNA, 64 nt, Homo Sapiens
gccagaaaugcccucccuagguccaggaccaaagauaaaacaaacacgaggaacauguagcguc

SEQ ID NO: 141857 - RNA, 64 nt, Homo Sapiens
gaauuaacuaauucuacuugaaaucaggaguuuuauaaaacaacauuuuuagacguggucaucu

SEQ ID NO: 141858 - RNA, 64 nt, Homo Sapiens
gcuuggauacauaugaaugaugcuuuccccucaaauaaaacaucugcauuauucugaaacucaa

SEQ ID NO: 141859 - RNA, 64 nt, Homo Sapiens
uuguaacuuccugugaauuuauaauaauuucaaaauaaaacaaguuaaaaaaaaacccacuaug

SEQ ID NO: 141860 - RNA, 64 nt, Homo Sapiens
aaauucaauacauacugcucucagauaaaacauuauaaaacauuauuacuugcaguucugaguu

SEQ ID NO: 141861 - RNA, 64 nt, Homo Sapiens
auaaaacauuaaauucaauaguucugaguuucagauaaaacauucaaccugcaaauuacuugca

SEQ ID NO: 141862 - RNA, 64 nt, Homo Sapiens
cuggccaguucauuucagcaaaaaagguuguuacauaaaacaccggccugagauuuuauuuuag

SEQ ID NO: 141863 - RNA, 64 nt, Homo Sapiens
guaaacauucuauuucucuaacagaguaauaauaauaaaacacaauagauaaauauguaucuac

SEQ ID NO: 141864 - RNA, 64 nt, Homo Sapiens
uuuuaauguuaaaguuuauagauuuuauuacaaaauaaaacauuaagguuucaaugggaaauuu

SEQ ID NO: 141865 - RNA, 64 nt, Homo Sapiens
uaccccuuagaaagucuucuuaaucuuuuaaacaauaaaacaaaaucccaaaguuauuaccaca

SEQ ID NO: 141866 - RNA, 64 nt, Homo Sapiens
ggacucuuugaaauguauguuauuaaugucgauaauaaaacauuaaaucuucagcaugaacaaa

SEQ ID NO: 141867 - RNA, 64 nt, Homo Sapiens
ucgaaauuaaccuugauuuauaacuauuuuuguaauaaaacaaugacagcuguaguaacuauga

SEQ ID NO: 141868 - RNA, 64 nt, Homo Sapiens
augggguuaaagcuuucaauaucuuaaaauauuuauaaaacauuucacuguugcaaaaucacuu

SEQ ID NO: 141869 - RNA, 64 nt, Homo Sapiens
gccaauauuuucuuauguuaacuuuugcugauguauaaaacagacuaugccuuauaauugaaau

SEQ ID NO: 141870 - RNA, 64 nt, Homo Sapiens
aauaaaauuauaaucugccugaaaaugaauaaaaauaaaacauuuugaaaugugugguugagau

SEQ ID NO: 141871 - RNA, 64 nt, Homo Sapiens
cucuaauguuuggcauccuugcaaacgucaugcaauaaaacaaaucaauaacuuuuuuucuuau

SEQ ID NO: 141872 - RNA, 64 nt, Homo Sapiens
uguuuuuuagauuauuaauagacuuuugcugguuauaaaacagaugcauaacuugaauucaaua

SEQ ID NO: 141873 - RNA, 64 nt, Homo Sapiens
gaugaggaaagggcuucaauagacauuucuggacauaaaacacaagcaaaucuucaaaaucagu

SEQ ID NO: 141874 - RNA, 64 nt, Homo Sapiens
ccauacuugagagaaaaacuagcucuuacaggauauaaaacagucuccagugucaagguaguuc

SEQ ID NO: 141875 - RNA, 64 nt, Homo Sapiens
auuuugcuuuaaaaaaauuucuaauuuuuuucacauaaaacaauuauccuaaagguuaauaguu

SEQ ID NO: 141876 - RNA, 64 nt, Homo Sapiens
auguugaugggacaagaagaauaguauuuauuuaauaaaacauauauuauauugaacuaugugu

SEQ ID NO: 141877 - RNA, 64 nt, Homo Sapiens
uuuauaugcaauucuucugguaaauagcaauagaauaaaacauauuucaauguuuguguauagg

SEQ ID NO: 141878 - RNA, 64 nt, Homo Sapiens
uucacuugaauauauggaauuuaguaugcauuuaauaaaacauaucacauacuauagaaagaua

SEQ ID NO: 141879 - RNA, 64 nt, Homo Sapiens
ucccuuaacugcauugcuaucagaaagcuaugaaauaaaacacguaucagagcaauuuugcuug

SEQ ID NO: 141880 - RNA, 64 nt, Homo Sapiens
acuuuggaauauugcauugaacucagcuauacacauaaaacauuuucuuugguaaaucaagauc

SEQ ID NO: 141881 - RNA, 64 nt, Homo Sapiens
guguuguauuugaaaguuuuacaguaaguuuaaaauaaaacauucugugacugacgguguuuuu

SEQ ID NO: 141882 - RNA, 64 nt, Homo Sapiens
cucaaauugcuuauaaaguuauagcuaacugcccauaaaacaaagcaauaaaaaaugcuuugag

SEQ ID NO: 141883 - RNA, 64 nt, Homo Sapiens
cacuuugcugaaauaggaaagucuguuuagcuuuauaaaacaaaucugcauucucauuggaaau

SEQ ID NO: 141884 - RNA, 64 nt, Homo Sapiens
uucucuaagcaucuuuagccgucaacuaaugaaaauaaaacauuauucaacugaacaacuaguu

SEQ ID NO: 141885 - RNA, 64 nt, Homo Sapiens
aaaaaagguaauccaguaaucgcacuugggugaaauaaaacaacacuuagguaaaugacauaga

SEQ ID NO: 141886 - RNA, 64 nt, Homo Sapiens
gccuuaacaaaguuguuuguccauuaaucagcaaauaaaacauguaaauuacauugccuuuugu

SEQ ID NO: 141887 - RNA, 64 nt, Homo Sapiens
uuugcauaaaauuaccaugauaacugaugaucacauaaaacagaaacugagaaacuuuuauaua

SEQ ID NO: 141888 - RNA, 64 nt, Homo Sapiens
uaacacugaucuucagauaguaggaaauuccuucauaaaacauguuugguugguucuuuuuuca

SEQ ID NO: 141889 - RNA, 64 nt, Homo Sapiens
gacaauggcagaggacuuuuguuuuaaaaaacagauaaaacaugaguauauauuuuccccuacg

SEQ ID NO: 141890 - RNA, 64 nt, Homo Sapiens
aauugauauuuuuucuggaacugaauucuuaaacauaaaacagauaaaaugcaucuuguuacua

SEQ ID NO: 141891 - RNA, 64 nt, Homo Sapiens
uaauuuugaaaagaaauagaaauuaagcuacuauauaaaacaauuguuuacguguacuuuuaac

SEQ ID NO: 141892 - RNA, 64 nt, Homo Sapiens
uuucuagccacuguuuuuuuuuucuuguuuccuuauaaaacagguaauaaccaaucauuuugug

SEQ ID NO: 141893 - RNA, 64 nt, Homo Sapiens
gaaauuuagcaauaguuaauauuaggugacauaaauaaaacaucccagacuagugaguuaagua

SEQ ID NO: 141894 - RNA, 64 nt, Homo Sapiens
uuuggaggaugggagagaacucauagcaguuaauauaaaacaucacgugaccggcaaauaaauc

SEQ ID NO: 141895 - RNA, 64 nt, Homo Sapiens
augugaaaaccaaaguggauugaauugacgcaauauaaaacaaacugcccccugagaaaacacu

SEQ ID NO: 141896 - RNA, 64 nt, Homo Sapiens
acuuuguuuauuuaaaguuuugccaauguacuuaauaaaacauguuuggacagcacaugaaguc

SEQ ID NO: 141897 - RNA, 64 nt, Homo Sapiens
acauugcagagggggagcuaucuauuaaaucuuuauaaaacauugaagaaagauaucuaucuaa

SEQ ID NO: 141898 - RNA, 64 nt, Homo Sapiens
uuccauaaggugucagcaacauuagaauuuccaaauaaaacaguagaacaguuuuaaaaaucua

SEQ ID NO: 141899 - RNA, 63 nt, Homo Sapiens
uaacaaaaucuauaacugugaaaacucuuaaugauaaaacauuggcugcaggcacaaguauag

SEQ ID NO: 141900 - RNA, 64 nt, Homo Sapiens
auguaacccauucaugaaaaucuuagaauuguauauaaaacaacuauugaauaccagggucaua

SEQ ID NO: 141901 - RNA, 64 nt, Homo Sapiens
gagaguaucuaugucuuucuaagucugaaauacuauaaaacacuugcuuauuuuucagccuuua

SEQ ID NO: 141902 - RNA, 64 nt, Homo Sapiens
acucuacagguagcuauugauauaauuaguuuuaauaaaacaugcugcaaccaugguauacaac

SEQ ID NO: 141903 - RNA, 64 nt, Homo Sapiens
uagcuucuggcuuuuaauuuugccagcuaaggacauaaaacaaaaauaaacaaacaaaaacaaa

SEQ ID NO: 141904 - RNA, 64 nt, Homo Sapiens
caaauuuuaaguauuaugaauaauuuuacuaagaauaaaacaucuuuauuuuaugaaguaaugu

SEQ ID NO: 141905 - RNA, 64 nt, Homo Sapiens
aguggcaacacuccuauugggauguuuacugaacauaaaacaaucuguauguauuuaaaauucu

SEQ ID NO: 141906 - RNA, 64 nt, Homo Sapiens
ucaggauuuaaauuaguacccaaauuucagcuacauaaaacauuggcauuucuuaagcuuuauc

SEQ ID NO: 141907 - RNA, 64 nt, Homo Sapiens
ccugcuuuuaguuauuauguuacaucuuaaugaaauaaaacauuaugauagguaaaaagaucua

SEQ ID NO: 141908 - RNA, 64 nt, Homo Sapiens
auaguuugccccuuuuggaaugaucucugaauauauaaaacacacacacaaagagcaauaguuu

SEQ ID NO: 141909 - RNA, 64 nt, Homo Sapiens
auaguuugccccuuuuggaacgaccccugaauauauaaaacacacacacaccccgcgcacucuc

SEQ ID NO: 141910 - RNA, 64 nt, Homo Sapiens
augguggaaguauaaauaagccuaugaacuuauaauaaaacaaacuguagguagaaaaaaugag

SEQ ID NO: 141911 - RNA, 64 nt, Homo Sapiens
gaaaaaauacuuguucagguaauucuaauucuuaauaaaacaaaugaguaucauacagguagag

SEQ ID NO: 141912 - RNA, 64 nt, Homo Sapiens
aaaaacucuugagaacuauacuaacgugaaaaggauaaaacauugcuauuuaaacaauuuuuuu

SEQ ID NO: 141913 - RNA, 64 nt, Homo Sapiens
ccaaauccugguugcagaguaaaaauuugcucuaauaaaacauaaaugaaagccaccuuuuguu

SEQ ID NO: 141914 - RNA, 64 nt, Homo Sapiens
gcuaauaaugguaaucacaucuuacuuuccaucuauaaaacaggaugagcuuaaauuacccaag

SEQ ID NO: 141915 - RNA, 64 nt, Homo Sapiens
aaaauucaaauaauuauaagauuuucuguaucauauaaaacauuuauugucauugaacacuggu

SEQ ID NO: 141916 - RNA, 64 nt, Homo Sapiens
gauuauuuagcuuuauaauucggacuaguaaacaauaaaacauuuuuauuguaauguuuacuag

SEQ ID NO: 141917 - RNA, 64 nt, Homo Sapiens
ugcagauugcuaaguagcuguaauuguaaucauaauaaaacaauugagaaaauaaaauauuucu

SEQ ID NO: 141918 - RNA, 64 nt, Homo Sapiens
cacagaguuaagauaguuuauuuucuuuuaauuaauaaaacagacacagccugcauuaauuugc

SEQ ID NO: 141919 - RNA, 64 nt, Homo Sapiens
agauuagaaaucaaaagauauguauauaaaauacauaaaacaaucuugugaaauuucuguacuu

SEQ ID NO: 141920 - RNA, 64 nt, Homo Sapiens
gcaaauggcaucacuguguuaagcuacuagcaaaauaaaacauaauuugcauguuauguuuaau

SEQ ID NO: 141921 - RNA, 64 nt, Homo Sapiens
ccagaaauguuuauggaaauauuaagaacauuuuauaaaacauacgaaaaagugauugugaagg

SEQ ID NO: 141922 - RNA, 64 nt, Homo Sapiens
agagccacauacuuuacaguaaaauuaaguguguauaaaacauuaauugcuaacaauuguuagc

SEQ ID NO: 141923 - RNA, 64 nt, Homo Sapiens
gacuccuuguucucuagaagggcuuuuuacuugaauaaaacaaugcaacuuagcaaaccaauuu

SEQ ID NO: 141924 - RNA, 64 nt, Homo Sapiens
agaaaagacaugcuccaaaaaaaaaacaaaacugauaaaacaguuuuucgaaacuuacuuuuaa

SEQ ID NO: 141925 - RNA, 64 nt, Homo Sapiens
gcaaaguuuacagacuuuugauauggaaaaccagauaaaacaauguuacaaaaggcaaauauaa

SEQ ID NO: 141926 - RNA, 64 nt, Homo Sapiens
uggaagugaaacuauuaaaagagaaaucgcauucauaaaacaauauuaguuugaaagauaucug

SEQ ID NO: 141927 - RNA, 64 nt, Homo Sapiens
ugguuggcugcauuuuuuaacuugguaaaacuuaauaaaacaggggacuuuuuagaaggaaaua

SEQ ID NO: 141928 - RNA, 64 nt, Homo Sapiens
uaagagagaagcuuuuaaaacaguacauuccugaauaaaacaacaauauuguaucuuaaucaag

SEQ ID NO: 141929 - RNA, 64 nt, Homo Sapiens
uaguagcugaguguuccugaguugccuaguagcaauaaaacaagugaauaggaaaauaauuaau

SEQ ID NO: 141930 - RNA, 64 nt, Homo Sapiens
uaggcuggaaaguuuuuuucaucacuaugauuuuauaaaacaauuuuuucuaugaaccuuuacu

SEQ ID NO: 141931 - RNA, 64 nt, Homo Sapiens
cuuauuuuaaguuccaaaggugaagucuuuaagaauaaaacauuaccaacuccugcuuuuauau

SEQ ID NO: 141932 - RNA, 64 nt, Homo Sapiens
cugguauuuugacauguuauaauacgcaaguaaaauaaaacaauaguuuacucagcucauguua

SEQ ID NO: 141933 - RNA, 64 nt, Homo Sapiens
aaaacauaaauuaaaacucaaaugccaggacaaaauaaaacaauauaccagauggagaggaugc

SEQ ID NO: 141934 - RNA, 64 nt, Homo Sapiens
cuuagugcauuagugucacauugauuaucauuuuauaaaacaugaagggauuauaggacugucu

SEQ ID NO: 141935 - RNA, 64 nt, Homo Sapiens
acaaugacacaaaaccacaagugaauagaauacaauaaaacaaaagaacuugcuuccaaaguaa

SEQ ID NO: 141936 - RNA, 64 nt, Homo Sapiens
aguucaagauccagcugaaaaagaagcuugugguauaaaacaauuuaauucaaggauaaaacag

SEQ ID NO: 141937 - RNA, 64 nt, Homo Sapiens
agaagcuugugguauaaaacuucuuaauucaaggauaaaacagaggggcauaaaaggcuaucua

SEQ ID NO: 141938 - RNA, 64 nt, Homo Sapiens
uugaaaaucccacaagccaaaaauuagauagucaauaaaacaucuucucuuuguaaguagauuc

SEQ ID NO: 141939 - RNA, 64 nt, Homo Sapiens
gaugucacuuugaggggcaggucgguaauuuaacauaaaacaggaugccuuugauuccuuagag

SEQ ID NO: 141940 - RNA, 64 nt, Homo Sapiens
uugccuggaaagauguuuucaaggaauuugaaccauaaaacacuaucugaugcacagaacaccu

SEQ ID NO: 141941 - RNA, 64 nt, Homo Sapiens
uaguguccagaauguucagacauucggaguguacauaaaacagaaaaaaucuucauguauuuuu

SEQ ID NO: 141942 - RNA, 64 nt, Homo Sapiens
agaaaaaagaaauugguuaugaauaaaagugacaauaaaacaugagauauaaaucaagcuuaaa

SEQ ID NO: 141943 - RNA, 64 nt, Homo Sapiens
cuuacguucugguugucauguuucccuguauuugauaaaacacauaauuuugagaaaaauaaag

SEQ ID NO: 141944 - RNA, 64 nt, Homo Sapiens
ccaauaaaaauaccaucugauggaaaaggggaauauaaaacaaacuucaaaacagaagggcaaa

SEQ ID NO: 141945 - RNA, 64 nt, Homo Sapiens
auuuugacaguuuaggcuucuacauucuuuugguauaaaacaauggaauacauucauaaguaca

SEQ ID NO: 141946 - RNA, 64 nt, Homo Sapiens
aucacauaugugcauagauacacaaucguauuacauaaaacacccuugaaaauauaugacuuug

SEQ ID NO: 141947 - RNA, 64 nt, Homo Sapiens
aguucacacugcagagcuagguuguccuauuggcauaaaacaaaccagcaacuuuucucaugug

SEQ ID NO: 141948 - RNA, 64 nt, Homo Sapiens
uuaaguuuuuaaaggugauucugugcaguaagguauaaaacagauauauaauaaauagccuagc

SEQ ID NO: 141949 - RNA, 64 nt, Homo Sapiens
cuaaaaaggaaaaaaaacaccaaaauaagauaaaauaaaacaaauuuaaacaccaaaauaagau

SEQ ID NO: 141950 - RNA, 64 nt, Homo Sapiens
aauaaaacaaauuuaaacaccaaaauaagauauaauaaaacauuuguuuuugcaaaauaaggcc

SEQ ID NO: 141951 - RNA, 64 nt, Homo Sapiens
uucuaaaagccccaacacaugacgccaucugaagacccgcaacggaguggggguggcggccgcc

SEQ ID NO: 141952 - RNA, 64 nt, Homo Sapiens
cccguuuguucucagauaaaaagcaguuuuauaaacccgcaaucugcuccagauucaagcagua

SEQ ID NO: 141953 - RNA, 64 nt, Homo Sapiens
ccauaaugcagacuuucccauuccuucucuuuccacccgcaacuguggggcuaagaauucuuaa

SEQ ID NO: 141954 - RNA, 64 nt, Homo Sapiens
cgggacauaguaugugacaauuguucagguuaguacccgcaaaaaauacaugcaaagcaauauc

SEQ ID NO: 141955 - RNA, 64 nt, Homo Sapiens
uugucauuggauugaauuuacuuuuuuguuucucacccgcaacuugagccaggacagcuggucc

SEQ ID NO: 141956 - RNA, 64 nt, Homo Sapiens
aguauuggaaaaauguauccaugcuuuaaaaccgacccgcaacaaccuucacucuccaggguac

SEQ ID NO: 141957 - RNA, 64 nt, Homo Sapiens
accauguuccuuuguauauguugggauuuacauaacccgcaacccacauuuccuguucauaagu

SEQ ID NO: 141958 - RNA, 64 nt, Homo Sapiens
ucugccacugucagggaccagccggccaacgcccacccgcaaaggugucuaaaaacuucagcuu

SEQ ID NO: 141959 - RNA, 64 nt, Homo Sapiens
cccaagugccuucccucaugccugggccggccugacccgcaaugggcagagggugggugggacc

SEQ ID NO: 141960 - RNA, 64 nt, Homo Sapiens
gaagggcaccacuuggaugagaucuggcauaugcacccgcaauaacacaaaggaccuuagauga

SEQ ID NO: 141961 - RNA, 64 nt, Homo Sapiens
cuaccagccuuguggccacgucugaaacccacccacccgcaagcgcucaaagcucagacucagg

SEQ ID NO: 141962 - RNA, 64 nt, Homo Sapiens
ggcccaggcgcgguugaccugccccugcuguaacacccgcaagaaggaugcaguccuuaccaag

SEQ ID NO: 141963 - RNA, 64 nt, Homo Sapiens
cucugaaggguucuugaagcuguaccgcucagaaacccgcaagguaaguugaagcccuuacugg

SEQ ID NO: 141964 - RNA, 64 nt, Homo Sapiens
caagccgccccuuguagaaacguauccaccuugcacccgcaaguugaaaucaacucucuucggu

SEQ ID NO: 141965 - RNA, 64 nt, Homo Sapiens
uggucaucugugcccgugacguggucuucuccguacccgcaacgcccucgugugagcccagccu

SEQ ID NO: 141966 - RNA, 50 nt, Homo Sapiens
uguaccuggugagcugcugaacccgcaaaugcugcugccccagcucuaca

SEQ ID NO: 141967 - RNA, 64 nt, Homo Sapiens
cccccuccugggaagugcccccucaccucagggcacccgcaaccugggcuccucccugagcgca

SEQ ID NO: 141968 - RNA, 64 nt, Homo Sapiens
uuccagcugcuucccuuuguccugugacccugggacccgcaaccaccugucacuaauacagcug

SEQ ID NO: 141969 - RNA, 64 nt, Homo Sapiens
gugccauuucuccuuuugccugccaguuuguccuacccgcaagcugguugauauggggcagagg

SEQ ID NO: 141970 - RNA, 64 nt, Homo Sapiens
cagggccuagagagccugguguugggucaugcugggaagggagcggcagcccagccaggccugg

SEQ ID NO: 141971 - RNA, 64 nt, Homo Sapiens
cagccaggcaccugcuccucuugcccuuccugggggaagggagcugccuucugucccuguaacu

SEQ ID NO: 141972 - RNA, 64 nt, Homo Sapiens
gccacuuagggcacugcuagcagggcuucaaccaggaagggaucaacccaggaagggaugauca

SEQ ID NO: 141973 - RNA, 64 nt, Homo Sapiens
cuagcagggcuucaaccaggaagggaucaacccaggaagggaugaucaggagaggcuucccuga

SEQ ID NO: 141974 - RNA, 64 nt, Homo Sapiens
ucccuaucuccuuuuagaccugggacggcaaaagggaagggaaggaaacuuagcagagugcuau

SEQ ID NO: 141975 - RNA, 64 nt, Homo Sapiens
uguuaucucuguagggcucaggaagcuggaaggaggaagggaggguaaguggccuggugagugg

SEQ ID NO: 141976 - RNA, 64 nt, Homo Sapiens
gggccagccuccccacuuacaaggcugcuuuccaggaagggaggucugguguaucucaugggag

SEQ ID NO: 141977 - RNA, 64 nt, Homo Sapiens
cuggcaggaccaagacugcggcuggggugggcagggaagggaagccgggggcugcugugaggga

SEQ ID NO: 141978 - RNA, 64 nt, Homo Sapiens
gggcuggagaccaggccaugggcccucacggagaggaagggaaggaaggagagggagggggagg

SEQ ID NO: 141979 - RNA, 64 nt, Homo Sapiens
agaccuuccagacuucggcugagcuuggagggugggaagggagccuucucaguccucucucccu

SEQ ID NO: 141980 - RNA, 64 nt, Homo Sapiens
uuuaaauuuaaaaucacuuuuuuaacgaauggggggaagggaucuaugagaaaggugguaucua

SEQ ID NO: 141981 - RNA, 64 nt, Homo Sapiens
ugaaucucacaaugcgucguagaugucgcguguuggaagggagcaggaggaaggacugauacug

SEQ ID NO: 141982 - RNA, 64 nt, Homo Sapiens
cacuggaggaagacggcaccguggggagauccugggaagggagggaguucuggcugagcccagg

SEQ ID NO: 141983 - RNA, 64 nt, Homo Sapiens
agacuaugugcuccgcugccacuggccaugcuuuggaagggacagauaggaagaaucagucuaa

SEQ ID NO: 141984 - RNA, 64 nt, Homo Sapiens
guuuauuugcaaaaaccauggggguggggggaagggaagggaugaaaaaaaaaaucaugggggu

SEQ ID NO: 141985 - RNA, 64 nt, Homo Sapiens
ggaugguuuauuugcaaaaaggggugggguggggggaagggaaguuaaaaaaaaaaaaaucaug

SEQ ID NO: 141986 - RNA, 64 nt, Homo Sapiens
gggggaacaguauggaaaagacuggaaggggaaaggaagggaagggagggagggucuguucuau

SEQ ID NO: 141987 - RNA, 64 nt, Homo Sapiens
aacaguauggaaaagacuggaaggggaaaggaagggaagggagggagggucuguucuaucuguu

SEQ ID NO: 141988 - RNA, 64 nt, Homo Sapiens
cucagcucugcccagggccagccagguucugcugggaagggaagggaauggggagaagggagaa

SEQ ID NO: 141989 - RNA, 64 nt, Homo Sapiens
cucugcccagggccagccagguucugcugggaagggaagggaauggggagaagggagaagcaag

SEQ ID NO: 141990 - RNA, 64 nt, Homo Sapiens
cuuuuccuuuuggaucauagcuuaacaaggcacaggaagggaagggaucuugacuaagauucau

SEQ ID NO: 141991 - RNA, 64 nt, Homo Sapiens
ccuuuuggaucauagcuuaacaaggcacaggaagggaagggaucuugacuaagauucaugagac

SEQ ID NO: 141992 - RNA, 64 nt, Homo Sapiens
cgcgggugaggugguggcccccugauuuacagagggaagggaagucacagagacccugcacagc

SEQ ID NO: 141993 - RNA, 64 nt, Homo Sapiens
gccaggcggcucucaggggcgcucucccggaacuggaagggaaacggaccugagucgggcagcc

SEQ ID NO: 141994 - RNA, 64 nt, Homo Sapiens
caggggacaagaggcaaguuggagugaugcagccggaagggaagggacaccaaggaucuccggc

SEQ ID NO: 141995 - RNA, 64 nt, Homo Sapiens
gacaagaggcaaguuggagugaugcagccggaagggaagggacaccaaggaucuccggccacca

SEQ ID NO: 141996 - RNA, 64 nt, Homo Sapiens
agcacacugaguuuguacaauuguguuaacugcuggaagggacagaugcacugauauauaugca

SEQ ID NO: 141997 - RNA, 64 nt, Homo Sapiens
gcacgaagccaccagucucccccagggagcaucaggaagggacauggaugugcuccugccacag

SEQ ID NO: 141998 - RNA, 64 nt, Homo Sapiens
ucagugcuagaauaaaguccuguagguuuauuuuggaagggacuguggccaggguaguucucag

SEQ ID NO: 141999 - RNA, 64 nt, Homo Sapiens
ggagucucaguaaucaagccaauggccuuugucaggaagggaaggggcucaacacagugaugga

SEQ ID NO: 142000 - RNA, 64 nt, Homo Sapiens
ucuauaggcagcuucuaagagcgaacuucacauaggaagggaucugagaacacguugccagggg

SEQ ID NO: 142001 - RNA, 64 nt, Homo Sapiens
ccaaacacucaguccacuguugagccccagugcuggaagggaggaaggccuuucuucuguguua

SEQ ID NO: 142002 - RNA, 64 nt, Homo Sapiens
agucuaggcugagggcaagagaagggacugguagggaagggacggggaggggccuuugucuagg

SEQ ID NO: 142003 - RNA, 64 nt, Homo Sapiens
gguagggaagggacgagucugggccuuugucuagggaagggacucugggacccagggaggggag

SEQ ID NO: 142004 - RNA, 64 nt, Homo Sapiens
cauugagcacagacuuuggaacagcugcaguuagggaagggagcugauuucuggugaggugacc

SEQ ID NO: 142005 - RNA, 64 nt, Homo Sapiens
cuuuuuuuuuucuuuuuuuugccuuaaaaaaauaggaagggaagacauuuauuuauuaauucau

SEQ ID NO: 142006 - RNA, 64 nt, Homo Sapiens
aacagcagggaagaggggcagaaucugugcccugggaagggagagggaagaugaagagauucua

SEQ ID NO: 142007 - RNA, 64 nt, Homo Sapiens
gccugaggccggcauaaggguuggcuacagagagggaagggaaagugggguuuccaccuggcuu

SEQ ID NO: 142008 - RNA, 64 nt, Homo Sapiens
gcccgcucccacagcuuccugagggcuaauucugggaagggagaguucuuugcugccccugucu

SEQ ID NO: 142009 - RNA, 64 nt, Homo Sapiens
ccccuggggacgccaaggaggugggccacacccaggaagggaaagcgggcagccccguuuuggg

SEQ ID NO: 142010 - RNA, 64 nt, Homo Sapiens
cccacaccacaccuguaggggaccugucugacugggaagggaguuccgagagggagggggcaau

SEQ ID NO: 142011 - RNA, 64 nt, Homo Sapiens
cuccacgaccaagccgagaaaggaccuaggguggggaagggagggucucuugauuccuaaccgc

SEQ ID NO: 142012 - RNA, 64 nt, Homo Sapiens
ggcuagaguauccaugcaaggugucuuguugcauggaagggauaguuuggcucccuuggaggcu

SEQ ID NO: 142013 - RNA, 64 nt, Homo Sapiens
caugauggaugauuauuauuuuaaggucuguuuaggaagggaaauggcuacuuggccagccauu

SEQ ID NO: 142014 - RNA, 64 nt, Homo Sapiens
uggagcuggcccagggcugucuggggcagagaaaggaagggaacgccaugagcacagggcaggg

SEQ ID NO: 142015 - RNA, 64 nt, Homo Sapiens
gugggggcccacuuuuuuguucuccucugccccuggaagggaauuauuugcuuaccuucccguu

SEQ ID NO: 142016 - RNA, 64 nt, Homo Sapiens
cugcaggcccuucacauuuucaagcuguaaaggaggaagggaguccgcagcugagcagguguca

SEQ ID NO: 142017 - RNA, 64 nt, Homo Sapiens
cgaggugugcuguuccuucccuccgucugccuugggaagggagaucucuccccugugcugggag

SEQ ID NO: 142018 - RNA, 64 nt, Homo Sapiens
aaucuuuuauguuucauuuaccugaggaagggaaggaagggaaugaugaguacauguggacuca

SEQ ID NO: 142019 - RNA, 64 nt, Homo Sapiens
gaagggaauaaucuuuuaugguggacucaccugaggaagggaaguugucuccugaugaguacau

SEQ ID NO: 142020 - RNA, 64 nt, Homo Sapiens
aaaaauguagcgacagcauuuugcuuucugaauuggaagggaaaccuguuacuaugguaacacu

SEQ ID NO: 142021 - RNA, 64 nt, Homo Sapiens
aaguaggccgcugaugauaugaacaggcuuggagggaagggagagacggguauuguugggaaag

SEQ ID NO: 142022 - RNA, 64 nt, Homo Sapiens
ccauaucuacaacacagccugagaaaagagaagaggaagggaggugggccuagaauacccugau

SEQ ID NO: 142023 - RNA, 64 nt, Homo Sapiens
agucaugccuugggccuagacaacauuuauaucuggaagggacaagaggaaggcucaaaggagu

SEQ ID NO: 142024 - RNA, 64 nt, Homo Sapiens
gacgguguccuguggagacccugccccuuggaagggaagggaagugggcgagggugcguggggc

SEQ ID NO: 142025 - RNA, 64 nt, Homo Sapiens
ggaaggacgguguccuguggggggccugccccuuggaagggaaguuuuuugggcgagggugcgu

SEQ ID NO: 142026 - RNA, 64 nt, Homo Sapiens
gaaugaggugggaggugucugguaaggucaugggggaagggagaugagagaggagauaggcaga

SEQ ID NO: 142027 - RNA, 64 nt, Homo Sapiens
agguggauugagcaggaucucaggguuaugucgaggaagggaagaaagaaacagaagucaggca

SEQ ID NO: 142028 - RNA, 64 nt, Homo Sapiens
aguauaaagcuuauuuguauuuuaauuuuuauuuggaagggagcuuuguuuccuugguacuaau

SEQ ID NO: 142029 - RNA, 64 nt, Homo Sapiens
ugacuuguucuaauucuagggcuuguuggccacgggaagggaaaucacugguucccaacuagau

SEQ ID NO: 142030 - RNA, 64 nt, Homo Sapiens
acagaaagcagacaaagaaaacauagggaagggaggaagggaaacugucugaggcucugagcgu

SEQ ID NO: 142031 - RNA, 64 nt, Homo Sapiens
aagggaaaacagaaagcagacugagcguacauagggaagggaggcagacggucugucugaggcu

SEQ ID NO: 142032 - RNA, 64 nt, Homo Sapiens
cggcagaauagagggcauccgagugcgaaacgggggaagggagcaucuggagggggcgcuggag

SEQ ID NO: 142033 - RNA, 64 nt, Homo Sapiens
aggagccugcagucacuggcggguuccaggacagggaagggagcggggcgccuggccagagccg

SEQ ID NO: 142034 - RNA, 64 nt, Homo Sapiens
aggugggggcuggggaaugaggggcugaggucccggaagggauuuuauuuuuuugaauuuuaau

SEQ ID NO: 142035 - RNA, 64 nt, Homo Sapiens
gggagcuguucacuuuaggauacgggggugguauggaagggagcguucacaccgccagccucgg

SEQ ID NO: 142036 - RNA, 64 nt, Homo Sapiens
ccagcugcgacguacugucacugaugagagacugggaagggaaaagcauauauauauagauaua

SEQ ID NO: 142037 - RNA, 64 nt, Homo Sapiens
agaaaagaaagcaagaacagaaaacgaagccacaggaagggaaguagacauuguaugcuuaugg

SEQ ID NO: 142038 - RNA, 64 nt, Homo Sapiens
agagaacuucaaagaaaaucccucccugugcuuuggaagggaagggaggugggcagcagugggu

SEQ ID NO: 142039 - RNA, 64 nt, Homo Sapiens
acuucaaagaaaaucccucccugugcuuuggaagggaagggaggugggcagcagugggucagag

SEQ ID NO: 142040 - RNA, 64 nt, Homo Sapiens
cccagaagcagcaguggcagcuugggaaaugugaggaagggaaggagggagagacgggagggag

SEQ ID NO: 142041 - RNA, 64 nt, Homo Sapiens
ucaggcuucccacccugugcggggcacacccccaggaagggacccuggacacggcucccacguc

SEQ ID NO: 142042 - RNA, 64 nt, Homo Sapiens
ggcagaaggaaggagggaagagaggggagaagaaggaagggaaguuuuccuuugggggaggcgg

SEQ ID NO: 142043 - RNA, 64 nt, Homo Sapiens
ggcaagcuggcugugaacuggcugggaggggaagggaagggagacgaggcuggggcugggggug

SEQ ID NO: 142044 - RNA, 64 nt, Homo Sapiens
ggagaggcaagcuggcugugggguggcugggaggggaagggaaguuucccgaggcuggggcugg

SEQ ID NO: 142045 - RNA, 64 nt, Homo Sapiens
agguggccguccaaagacagccaacggagcugccucgcagaaucagccagugggcagguggacg

SEQ ID NO: 142046 - RNA, 64 nt, Homo Sapiens
uguuauacuagguuugauuugaaacuggugcuugucgcagaacugucagagcaugaggagcgcu

SEQ ID NO: 142047 - RNA, 64 nt, Homo Sapiens
ggguccucaaggaacaaagaagauaaagcacaaaucgcagaacuugaauccaggcugcugcuca

SEQ ID NO: 142048 - RNA, 64 nt, Homo Sapiens
ccccacgugugcacgaguggagcaaggccaauucucgcagaaacgucuucgccaaucacagugc

SEQ ID NO: 142049 - RNA, 64 nt, Homo Sapiens
aguaagguggacugacuuuucuaagcguucccacucgcagaaaguguucucuugcccucuggac

SEQ ID NO: 142050 - RNA, 64 nt, Homo Sapiens
acacacaucaauggcaauaacuucuuccaacuccucgcagaagugggagaggccggcagccugc

SEQ ID NO: 142051 - RNA, 57 nt, Homo Sapiens
gacugggccaggaucuguaaucauccuucgcagaacaugaguuuaugggaaugccuu

SEQ ID NO: 142052 - RNA, 64 nt, Homo Sapiens
gcaaguccugaaagaauggaccaucaggaaguccucgcagaaguuuuuucuuuuuagucguucc

SEQ ID NO: 142053 - RNA, 64 nt, Homo Sapiens
caucuuccuccucucugugaccagggcaccagccucgcagaaggcugccacuugguguggcuca

SEQ ID NO: 142054 - RNA, 64 nt, Homo Sapiens
guuugugggcaaagggcugcuaauugggcagccaucgcagaauuggaucagaaugcuuugggau

SEQ ID NO: 142055 - RNA, 64 nt, Homo Sapiens
aaguucucacuuauaaaccuggggacccauugccucgcagaagacagggggcuggacuucaggc

SEQ ID NO: 142056 - RNA, 64 nt, Homo Sapiens
ccagucagguauguucugagugaacccacagcagucgcagaaugagcaccuggcaggguggguu

SEQ ID NO: 142057 - RNA, 64 nt, Homo Sapiens
caugcgacucccacacgacacuaaaucacuuuucucgcagaagcgagaaaaaaccuccgucugc

SEQ ID NO: 142058 - RNA, 64 nt, Homo Sapiens
aauuaaugagauucgcuccuacuugaggcugcagucgcagaaauacuugucacgccagaagcac

SEQ ID NO: 142059 - RNA, 64 nt, Homo Sapiens
guuuuccaggaugccaguggcaaaugucuuuucuucgcagaauugcauggaaccuggaccaagg

SEQ ID NO: 142060 - RNA, 64 nt, Homo Sapiens
uuuaaugcacaauuuuuugcagucagcuguucugucgcagaaugagggauguuugcaauuuccc

SEQ ID NO: 142061 - RNA, 64 nt, Homo Sapiens
gaguagacaacuuuaauaauccauauuuauacuaucgcagaaguaagcauuuggcaaacguuca

SEQ ID NO: 142062 - RNA, 64 nt, Homo Sapiens
ucgggacaaaacaaugacucaaggacagcacuucucgcagaaggucuggaagugcccagaaugg

SEQ ID NO: 142063 - RNA, 64 nt, Homo Sapiens
cugaaagcagggcagaaaagaugaauccuaccuuucgcagaaggcaugacuguucccacuuuua

SEQ ID NO: 142064 - RNA, 64 nt, Homo Sapiens
auacucaaaguggagcagggguugugggaaaaagucgcagaaagcccuugcaggaccuuuguag

SEQ ID NO: 142065 - RNA, 64 nt, Homo Sapiens
uaaauguguuaauuuuaguagaaucaggcacugcucgcagaaggaacacagauuguagagauua

SEQ ID NO: 142066 - RNA, 64 nt, Homo Sapiens
cucucggauggcaacauuaagcucauucuuggccucgcagaaaaucaccgcggcacacguucua

SEQ ID NO: 142067 - RNA, 64 nt, Homo Sapiens
gcugugauucuguuuuaagugaguuugagggcuuucgcagaaaugagcagcaaacauagaugga

SEQ ID NO: 142068 - RNA, 64 nt, Homo Sapiens
cucaaaaguuuguuuuauuaauuguacucaacccucgcagaacaguaaaacugaagauuauugu

SEQ ID NO: 142069 - RNA, 64 nt, Homo Sapiens
guguccccaaggaagugccacucugaauuauguuucgcagaaaaagcacagccagcuccgugcc

SEQ ID NO: 142070 - RNA, 64 nt, Homo Sapiens
gaggaaggcaaauacucagguucuguuccccucuucgcagaagucgauuuugcaagcuucaaga

SEQ ID NO: 142071 - RNA, 64 nt, Homo Sapiens
uuuaagcuuuuuaaacauaguauacaguacugauucgcagaauggugggugguagugguuaauu

SEQ ID NO: 142072 - RNA, 64 nt, Homo Sapiens
aaaacuccaaacccuucaguggaugaggacaaggucgcagaaaggcauucuguugacagaugaa

SEQ ID NO: 142073 - RNA, 64 nt, Homo Sapiens
aaaaccuugacauuucaaagacugccuugaaaggucgcagaaauugauuucuauuuuuaauuuc

SEQ ID NO: 142074 - RNA, 64 nt, Homo Sapiens
gggcgccgagugcccucuccuggacgaucgcgggucgcagaagcccaggccagcgagcccuaca

SEQ ID NO: 142075 - RNA, 64 nt, Homo Sapiens
aacauauauguggcuguggaugugggacacggacucgcagaauaggggaagaagagucucagac

SEQ ID NO: 142076 - RNA, 64 nt, Homo Sapiens
aaugcccuuacugauacaccgaucucuguuaaggucgcagaaucccuuaagccacuguuauucu

SEQ ID NO: 142077 - RNA, 64 nt, Homo Sapiens
uuuuuuuuuuuuuuuggccaaaucucgugguguuucgcagaaaaaaauccagaaaauuucaaau

SEQ ID NO: 142078 - RNA, 64 nt, Homo Sapiens; identical to SEQ ID NO: 61460

SEQ ID NO: 142079 - RNA, 64 nt, Homo Sapiens; identical to SEQ ID NO: 61461

SEQ ID NO: 142080 - RNA, 64 nt, Homo Sapiens; identical to SEQ ID NO: 61462

SEQ ID NO: 142081 - RNA, 64 nt, Homo Sapiens; identical to SEQ ID NO: 61463

SEQ ID NO: 142082 - RNA, 64 nt, Homo Sapiens; identical to SEQ ID NO: 61464

SEQ ID NO: 142083 - RNA, 64 nt, Homo Sapiens; identical to SEQ ID NO: 61465

SEQ ID NO: 142084 - RNA, 64 nt, Homo Sapiens; identical to SEQ ID NO: 61466

SEQ ID NO: 142085 - RNA, 64 nt, Homo Sapiens; identical to SEQ ID NO: 61467

SEQ ID NO: 142086 - RNA, 64 nt, Homo Sapiens; identical to SEQ ID NO: 61468

SEQ ID NO: 142087 - RNA, 64 nt, Homo Sapiens; identical to SEQ ID NO: 61469

SEQ ID NO: 142088 - RNA, 64 nt, Homo Sapiens; identical to SEQ ID NO: 61470

SEQ ID NO: 142089 - RNA, 64 nt, Homo Sapiens; identical to SEQ ID NO: 61471

SEQ ID NO: 142090 - RNA, 64 nt, Homo Sapiens; identical to SEQ ID NO: 61472

SEQ ID NO: 142091 - RNA, 64 nt, Homo Sapiens; identical to SEQ ID NO: 61473

SEQ ID NO: 142092 - RNA, 64 nt, Homo Sapiens; identical to SEQ ID NO: 61474

SEQ ID NO: 142093 - RNA, 64 nt, Homo Sapiens; identical to SEQ ID NO: 61475

SEQ ID NO: 142094 - RNA, 64 nt, Homo Sapiens; identical to SEQ ID NO: 61476

SEQ ID NO: 142095 - RNA, 64 nt, Homo Sapiens; identical to SEQ ID NO: 61477

SEQ ID NO: 142096 - RNA, 64 nt, Homo Sapiens; identical to SEQ ID NO: 61478

SEQ ID NO: 142097 - RNA, 64 nt, Homo Sapiens; identical to SEQ ID NO: 61479

SEQ ID NO: 142098 - RNA, 64 nt, Homo Sapiens; identical to SEQ ID NO: 61480

SEQ ID NO: 142099 - RNA, 64 nt, Homo Sapiens; identical to SEQ ID NO: 61481

SEQ ID NO: 142100 - RNA, 64 nt, Homo Sapiens; identical to SEQ ID NO: 61482

SEQ ID NO: 142101 - RNA, 64 nt, Homo Sapiens; identical to SEQ ID NO: 61483

SEQ ID NO: 142102 - RNA, 64 nt, Homo Sapiens; identical to SEQ ID NO: 61484

SEQ ID NO: 142103 - RNA, 64 nt, Homo Sapiens; identical to SEQ ID NO: 61485

SEQ ID NO: 142104 - RNA, 64 nt, Homo Sapiens; identical to SEQ ID NO: 61486

SEQ ID NO: 142105 - RNA, 64 nt, Homo Sapiens; identical to SEQ ID NO: 61487

SEQ ID NO: 142106 - RNA, 64 nt, Homo Sapiens; identical to SEQ ID NO: 61488

SEQ ID NO: 142107 - RNA, 64 nt, Homo Sapiens; identical to SEQ ID NO: 61489

SEQ ID NO: 142108 - RNA, 64 nt, Homo Sapiens; identical to SEQ ID NO: 61490

SEQ ID NO: 142109 - RNA, 64 nt, Homo Sapiens; identical to SEQ ID NO: 61491

SEQ ID NO: 142110 - RNA, 64 nt, Homo Sapiens; identical to SEQ ID NO: 61492

SEQ ID NO: 142111 - RNA, 64 nt, Homo Sapiens; identical to SEQ ID NO: 61493

SEQ ID NO: 142112 - RNA, 64 nt, Homo Sapiens; identical to SEQ ID NO: 61494

SEQ ID NO: 142113 - RNA, 64 nt, Homo Sapiens
aagccacgaggugcaguaagggugcuaauaugacauaugacaauucaaugcagguuuguuuuuu

SEQ ID NO: 142114 - RNA, 64 nt, Homo Sapiens
ugacaauaagccacgaggugguuuuuuggugcuaauaugacauaaucaaaaucaaugcagguuu

SEQ ID NO: 142115 - RNA, 64 nt, Homo Sapiens
aaguaaaauuguacaugugagaaaauauuuaaauauaugacaaaugagauagcucugcagauaa

SEQ ID NO: 142116 - RNA, 64 nt, Homo Sapiens
uuuauauuguaaaugcacuuauuuguagcuucauauaugacauguccacuccagugagauuaug

SEQ ID NO: 142117 - RNA, 64 nt, Homo Sapiens
uuucuaaauuaauuuguauaaaagguugugugaaauaugacagcgagucacuaaacuuucuuca

SEQ ID NO: 142118 - RNA, 64 nt, Homo Sapiens
cacuuuuuuagagacugcgguugagcaccuaacuauaugacaggcagucagucaucaaacauua

SEQ ID NO: 142119 - RNA, 64 nt, Homo Sapiens
cugggagaggcaaaacuaucguaugauugcaauuauaugacauucugaaaaggcuuucuauguu

SEQ ID NO: 142120 - RNA, 64 nt, Homo Sapiens
uucuguuuugaguuugaugcugcuuagaaauaaaauaugacaaggaaaucuaaagugaaaauuu

SEQ ID NO: 142121 - RNA, 64 nt, Homo Sapiens
auuugcugcugcugcugugcucuguaaauucugaauaugacauuuaaacucugugccuacuaaa

SEQ ID NO: 142122 - RNA, 64 nt, Homo Sapiens
auaggaacuacuugaaauaguaauuuguuaaaagauaugacaaaaugaaaaugcuuaaacuaca

SEQ ID NO: 142123 - RNA, 64 nt, Homo Sapiens
aguugagcaggcgccagggcugucaucaacauggauaugacauuucacaacagugacuaguuga

SEQ ID NO: 142124 - RNA, 64 nt, Homo Sapiens
gcaggaucaccuacuuacuguauucuacauuauuauaugacauaguauaaugagacaauaucaa

SEQ ID NO: 142125 - RNA, 64 nt, Homo Sapiens
uuuacuacuuaaacaugaauuauuauuuuuaaauauaugacaugcuguacugcuauucuauauu

SEQ ID NO: 142126 - RNA, 64 nt, Homo Sapiens
cucaaagugacagaauauguuucauucucugucaauaugacaagaucucgagucuuaucaaguu

SEQ ID NO: 142127 - RNA, 64 nt, Homo Sapiens
aaccauugugagaaacuagucaaaugaagggucuauaugacagcguucauaucguuuuucuuga

SEQ ID NO: 142128 - RNA, 64 nt, Homo Sapiens
gcgaguggauaauuccaacaguuacaguucguccugacuacaagcucggggaccugcuucacaa

SEQ ID NO: 142129 - RNA, 64 nt, Homo Sapiens
gauauuucagagagcuucuuaucuuuuuccacuuugacuacaaauuaacuugagcuucacuguc

SEQ ID NO: 142130 - RNA, 64 nt, Homo Sapiens
guaaguacagaacaguaaagugauaagcugcacaugacuacauacucauccguauucuuugugu

SEQ ID NO: 142131 - RNA, 64 nt, Homo Sapiens
augcaucaugcucauggggagaaauguuacugucugacuacaacuuugugcacauguacauaug

SEQ ID NO: 142132 - RNA, 64 nt, Homo Sapiens
ggauaaauaauuuguuugcuggucuguggucacgugacuacaauagacucugucauuuugauuu

SEQ ID NO: 142133 - RNA, 64 nt, Homo Sapiens
ugugacacuuaagauugauuugccauuucucaaaugacuacagcggcagggggugcauuauguc

SEQ ID NO: 142134 - RNA, 64 nt, Homo Sapiens
uucauucccuucagaaguauauagauacuuccggugacuacauaugaauguacuuucaauauua

SEQ ID NO: 142135 - RNA, 64 nt, Homo Sapiens
aaaauuugcuagugguuugaaaauaauaauguacugacuacauguaugcuguuauugucagugu

SEQ ID NO: 142136 - RNA, 64 nt, Homo Sapiens
uggaaaugccaaaaacucacuuuguaguuaaauuugacuacaaugaccucaauugacuacaaaa

SEQ ID NO: 142137 - RNA, 64 nt, Homo Sapiens
auuuguaguuaaauuugacuaauuugaccucaauugacuacaaacaaugcaaaauuuguaguua

SEQ ID NO: 142138 - RNA, 64 nt, Homo Sapiens; identical to SEQ ID NO: 50739

SEQ ID NO: 142139 - RNA, 64 nt, Homo Sapiens; identical to SEQ ID NO: 50740

SEQ ID NO: 142140 - RNA, 64 nt, Homo Sapiens; identical to SEQ ID NO: 50741

SEQ ID NO: 142141 - RNA, 64 nt, Homo Sapiens; identical to SEQ ID NO: 50742

SEQ ID NO: 142142 - RNA, 64 nt, Homo Sapiens; identical to SEQ ID NO: 50743

SEQ ID NO: 142143 - RNA, 64 nt, Homo Sapiens; identical to SEQ ID NO: 50744

SEQ ID NO: 142144 - RNA, 64 nt, Homo Sapiens; identical to SEQ ID NO: 50745

SEQ ID NO: 142145 - RNA, 64 nt, Homo Sapiens; identical to SEQ ID NO: 50746

SEQ ID NO: 142146 - RNA, 64 nt, Homo Sapiens; identical to SEQ ID NO: 50747

SEQ ID NO: 142147 - RNA, 64 nt, Homo Sapiens; identical to SEQ ID NO: 50748

SEQ ID NO: 142148 - RNA, 58 nt, Homo Sapiens
cccccauguggcugaagacacggccucuuccacccauucuagcuggcaggacacaucc

SEQ ID NO: 142149 - RNA, 58 nt, Homo Sapiens
cugcacugcagugauggcgcuuccuccguccacccaggcccaggccguuccccuuggc

SEQ ID NO: 142150 - RNA, 58 nt, Homo Sapiens
gcugccaugccacugccaggcuugggcauccacccaguccgcaccagcugcucugccc

SEQ ID NO: 142151 - RNA, 58 nt, Homo Sapiens
cccucugaagaacugggcauaauucgccuccacccacugucuucuuccucucaagcca

SEQ ID NO: 142152 - RNA, 58 nt, Homo Sapiens
uauguccacuuagucacccaccucugcuuccacccacaaaggucucucccuccaggga

SEQ ID NO: 142153 - RNA, 58 nt, Homo Sapiens
cauguaaaggcaggagaccuuugggguauccacccaguuaaccuggggcccuggcaga

SEQ ID NO: 142154 - RNA, 58 nt, Homo Sapiens
aggcaccuggggcuucucagggcuucuauccacccauggaccucacccuggcagggug

SEQ ID NO: 142155 - RNA, 58 nt, Homo Sapiens
ucggccucccaaagugcuggucaagcgauccacccacccuggucucgaacuccugacc

SEQ ID NO: 142156 - RNA, 58 nt, Homo Sapiens
caagcccacaucacaucucccaucugcuuccacccagcuuccguuggaaccacccaga

SEQ ID NO: 142157 - RNA, 58 nt, Homo Sapiens
ccuuugcugaagucuccccgcagcccucuccacccagaggucucccuauaccgagacc

SEQ ID NO: 142158 - RNA, 58 nt, Homo Sapiens
cagccuccuaggcucccugagguaccuuuccacccagacccuccuuccccaccccaua

SEQ ID NO: 142159 - RNA, 58 nt, Homo Sapiens
cuugauaaaucauggggaacagauguguuccacccaacaaaugugauaagugaucaug

SEQ ID NO: 142160 - RNA, 58 nt, Homo Sapiens
ggauggucucgaucucuugaccucaugauccacccaccucggucucccaaagugcugg

SEQ ID NO: 142161 - RNA, 58 nt, Homo Sapiens
ccagccccugggcagccggguacucccuuccacccaucgccuguaaacgcucuguaaa

SEQ ID NO: 142162 - RNA, 58 nt, Homo Sapiens
uaucugccuauuuucuugcugucccuccuccacccagguuuuuugcaaguacauuuuu

SEQ ID NO: 142163 - RNA, 58 nt, Homo Sapiens
gaugcagaaccagaaugagggggacaauuccacccacucgagggcugcccccucuucc

SEQ ID NO: 142164 - RNA, 58 nt, Homo Sapiens
ggauggucucgaucuccugaccucgugauccacccaccucggccucccaaagugcugg

SEQ ID NO: 142165 - RNA, 58 nt, Homo Sapiens
cucuaucccccaccgcuccaugcauuccuccacccacccucuccccgccccuguaucc

SEQ ID NO: 142166 - RNA, 58 nt, Homo Sapiens
ccucucccaaccucucuccccccaccccuccacccaccguaccucccaccccuguauc

SEQ ID NO: 142167 - RNA, 58 nt, Homo Sapiens
aguggcaugaucucagcucacugcaaccuccacccacuggguucaagcgauucuucug

SEQ ID NO: 142168 - RNA, 58 nt, Homo Sapiens
acaggacuauucuagcauaccugcuucguccacccaggcaggguuugggguggucucu

SEQ ID NO: 142169 - RNA, 58 nt, Homo Sapiens
accuccuccaacaaaggaguccccacccuccacccacuaccagccguaucuagcauau

SEQ ID NO: 142170 - RNA, 58 nt, Homo Sapiens
uuaguuaggagcuacuuccagccaugccuccacccaccugugauuuuuaucaguaaug

SEQ ID NO: 142171 - RNA, 58 nt, Homo Sapiens
guccuccuuuaauuguuugcccaaaucuuccacccaucuuuuuucuucccucauuuuc

SEQ ID NO: 142172 - RNA, 58 nt, Homo Sapiens
gacaaaaggaguaauuauuugguauagauccacccaucccaaccuuucucuccucagu

SEQ ID NO: 142173 - RNA, 58 nt, Homo Sapiens
agaacagcgugagcugguggccucaccuuccacccaugguaagguccuagcaucuucc

SEQ ID NO: 142174 - RNA, 58 nt, Homo Sapiens
acucacuacaaccuugugcugccuugucuccacccaugcugagcauaaaaccauggca

SEQ ID NO: 142175 - RNA, 58 nt, Homo Sapiens
uuggguggaugccugguggcagcugcgguccacccaggagccccgaggccuucucuga

SEQ ID NO: 142176 - RNA, 58 nt, Homo Sapiens
cuggucucaaacucuugaccucaggugauccacccaccucagccucccaaagugcugg

SEQ ID NO: 142177 - RNA, 58 nt, Homo Sapiens
aacuaauucuggugcucaggcugggcucuccacccaaguuaggccugcucuggccuaa

SEQ ID NO: 142178 - RNA, 58 nt, Homo Sapiens
aggcagucucccuuccugaccauucuucuccacccagucacagauaagggaauaaccu

SEQ ID NO: 142179 - RNA, 58 nt, Homo Sapiens
uccuuggcagagaugacagggagccaaguccacccauggaucauggagcuaagaagca

SEQ ID NO: 142180 - RNA, 58 nt, Homo Sapiens
ucggccucccaaagugcuggccucgugauccacccaacggauggucucgaucuccuga

SEQ ID NO: 142181 - RNA, 58 nt, Homo Sapiens
aguguccuggggagaaggaaaacccagcuccacccagcgccucgggcacuccacuacc

SEQ ID NO: 142182 - RNA, 58 nt, Homo Sapiens
ccuucuccccacagccucuguucucaccuccacccauacaccggagagacuacugacc

SEQ ID NO: 142183 - RNA, 58 nt, Homo Sapiens
ucggucuccccaaagugcugccuugugauccacccaccggauggucucaaucuccuga

SEQ ID NO: 142184 - RNA, 58 nt, Homo Sapiens
uuggccucccaaauuguucgucaaaugauccacccacccugaucuuaaacucuugacc

SEQ ID NO: 142185 - RNA, 58 nt, Homo Sapiens
uccaccucccaaagugcuagucaagugauccacccauccuggucucgaacuccugggc

SEQ ID NO: 142186 - RNA, 58 nt, Homo Sapiens
ucagccucucaaagugcuggucaggugauccacccacccuggucucaaacuccugccc

SEQ ID NO: 142187 - RNA, 58 nt, Homo Sapiens
ccuggggacagccccaccuccgggucccuccacccacaucccccugguccuaccccug

SEQ ID NO: 142188 - RNA, 58 nt, Homo Sapiens
gggagagcgcugggggcccaucccccuguccacccaguguccacuggccuguccuuca

SEQ ID NO: 142189 - RNA, 58 nt, Homo Sapiens
uccgcaucuguguguaucauuaaccucuuccacccaaguucugucuauuguaccgacu

SEQ ID NO: 142190 - RNA, 58 nt, Homo Sapiens
acgcgcuugguuugcagaugggacggaauccacccacacggcccucucgaacacaaug

SEQ ID NO: 142191 - RNA, 58 nt, Homo Sapiens
aaccuaauacagccccuuuugugggaaauccacccagcaugcugcugcccugaucuca

SEQ ID NO: 142192 - RNA, 58 nt, Homo Sapiens
gucucacuuuaggucucauuccaaugacuccacccauauaaacuucaggccagaaccc

SEQ ID NO: 142193 - RNA, 64 nt, Homo Sapiens
uccagaaccaucaccuuugggaaccugcugugagagugcugagguaccagaagugugagaacga

SEQ ID NO: 142194 - RNA, 64 nt, Homo Sapiens
gggcaccucccuggccacacgccuguucccagcaagugcugaaacucacuagaccgucugccug

SEQ ID NO: 142195 - RNA, 64 nt, Homo Sapiens
uagaacuuuuccuaacacagguaucuaggaaguaagugcugaguugauuuucuagguucuuacg

SEQ ID NO: 142196 - RNA, 64 nt, Homo Sapiens
gaccucaggucauccuccugccucggccucccaaagugcugagacuacaggugugagccaccgu

SEQ ID NO: 142197 - RNA, 64 nt, Homo Sapiens
gucugagaggggagaugcauaugggaguggaagaagugcugaggggaccgugagggggcucuug

SEQ ID NO: 142198 - RNA, 64 nt, Homo Sapiens
aggagcccagauuugggccuagaggccaggccccagugcugacggacccuguccuggagggggc

SEQ ID NO: 142199 - RNA, 64 nt, Homo Sapiens
acaaggaggugagaaguggugguaaaaggagcggagugcugaagcagagagcagauuuaauaua

SEQ ID NO: 142200 - RNA, 64 nt, Homo Sapiens
ggaaauggauguuucauuuguaugaguuuggagcagugcugaaggccaaagccgccuacugguu

SEQ ID NO: 142201 - RNA, 64 nt, Homo Sapiens
acccaaucuucccaauacuuuucccauuugucccagugcugacaucuugggguccugauacuca

SEQ ID NO: 142202 - RNA, 64 nt, Homo Sapiens
acuaaaaugaacaugcuauuacccacuuauguucagugcugaaauuguauaaacauuuauguug

SEQ ID NO: 142203 - RNA, 64 nt, Homo Sapiens
uauggacucucuaaggaagggucaccccagcaugagugcugagauugcaaacucuugugaaggg

SEQ ID NO: 142204 - RNA, 64 nt, Homo Sapiens
agauacugaugcauugaccuagcccucuccucauagugcugaaaagguagaccuugaauacagg

SEQ ID NO: 142205 - RNA, 64 nt, Homo Sapiens
cugaccuugugauccacucgccucagccucucgaagugcugagauuacacacgugagcaacugu

SEQ ID NO: 142206 - RNA, 64 nt, Homo Sapiens
aaggaaagaaaacaucuuuaaggggaggaaccagagugcugaaggaauggaaguccaucugcgu

SEQ ID NO: 142207 - RNA, 64 nt, Homo Sapiens
ugggucugggugugaauuccaccuucccuccugcagugcugagaggcagcgaggacggagagga

SEQ ID NO: 142208 - RNA, 64 nt, Homo Sapiens
ugaccucaucguccaccugccucggccuccccaaagugcugagauuaggcguuagccaccgcgc

SEQ ID NO: 142209 - RNA, 64 nt, Homo Sapiens
ccucaucacuguggggaucacaacuggcuuucagagugcugaccuccagcagcuugucuggcgu

SEQ ID NO: 142210 - RNA, 64 nt, Homo Sapiens
ccaccuuccugcugagguggaggcugggacugcgagugcugacgugggacugcgaugcggcgug

SEQ ID NO: 142211 - RNA, 64 nt, Homo Sapiens
uuacaggcauaagccagugcccucugccucccaaagugcugagagaccucaggugauccaccug

SEQ ID NO: 142212 - RNA, 64 nt, Homo Sapiens
gcacuggcacauuacagugguuuuagaaaugaguagugcugaugauucaaacagaagugccuca

SEQ ID NO: 142213 - RNA, 64 nt, Homo Sapiens
gaacguccccgagaaccacacgagcgugcugcucagugcugacugcagaaugaaauagaagcaa

SEQ ID NO: 142214 - RNA, 64 nt, Homo Sapiens
ucuuuuauuucugaaacacucaaacaccuuacaaagugcugaguagguaauagugacccaacuu

SEQ ID NO: 142215 - RNA, 64 nt, Homo Sapiens
acguggaccgggagaaugagcagagccagaggucagugcugaaggaaaguacgucacaucauac

SEQ ID NO: 142216 - RNA, 64 nt, Homo Sapiens
ucuucugcagcaguacuauccgaacugaagaaccagugcugaggcgcgcgcucucccagaaaca

SEQ ID NO: 142217 - RNA, 64 nt, Homo Sapiens
gagugagaaggaauucagggagagcaaaggagccagugcugagaugcugcuguguugguugagg

SEQ ID NO: 142218 - RNA, 64 nt, Homo Sapiens
gcuuccagagugugcacuuccagcccacccgggcagugcugagagggaggaggagaacaaggau

SEQ ID NO: 142219 - RNA, 64 nt, Homo Sapiens
gggagggguuauagcuucaggcucuguucaaggcagugcugagaauguuuuaauaucuuuaugg

SEQ ID NO: 142220 - RNA, 64 nt, Homo Sapiens
uauuucaagucucucacccuguccugcucacugcagugcugaugaaaaagcaguaaugaaaccu

SEQ ID NO: 142221 - RNA, 64 nt, Homo Sapiens
uaagguaaagaguugcauguaaaauagucuguagaugaauaaugcuccucaucucuaagggaga

SEQ ID NO: 142222 - RNA, 64 nt, Homo Sapiens
ucuuuuuaccagagagagaaccaucucaucagagaugaauaauaggucacugucauauuuugaa

SEQ ID NO: 142223 - RNA, 64 nt, Homo Sapiens
cucaguauauguauaauaucucuaggucauaaacaugaauaauacagcccucccaugaagaauu

SEQ ID NO: 142224 - RNA, 64 nt, Homo Sapiens
acaaaagccaagguguaugcgaauaaauaaauaaaugaauaaagcagaagggcacaaaaugaau

SEQ ID NO: 142225 - RNA, 64 nt, Homo Sapiens
aaauaaaugaauaaagacaaagggcacaaaaugaaugaauaaauaguccugguucauucccaga

SEQ ID NO: 142226 - RNA, 64 nt, Homo Sapiens
uuuaaucaauuaguaauggcacagugaaguuuuaaugaauaaagaaaaaaaaaucacaaauaaa

SEQ ID NO: 142227 - RNA, 64 nt, Homo Sapiens
aaggcaaacauaggucugggauacuucaauuguuaugaauaagacagauaauugguuuuugccu

SEQ ID NO: 142228 - RNA, 64 nt, Homo Sapiens
aaugagaaauauuuugugacucucaguuaccugcaugaauaaauugauuucugcacuaucuuuu

SEQ ID NO: 142229 - RNA, 64 nt, Homo Sapiens
gagaucagcccuauguaaguauguuugauauuccaugaauaauuucagguuuguucuuccuauc

SEQ ID NO: 142230 - RNA, 64 nt, Homo Sapiens
auuauaccuggaugauucaggagaguguauaugaaugaauaaagcauccaaguauauaugaaug

SEQ ID NO: 142231 - RNA, 64 nt, Homo Sapiens
uauaugaaugaauaaagcauccaaguauauaugaaugaauaaaguauguaaguaucaccagaaa

SEQ ID NO: 142232 - RNA, 64 nt, Homo Sapiens
aguaauuuugugauuugucuauauuguugcauuuaugaauaaaucauuuaucugcugcugagua

SEQ ID NO: 142233 - RNA, 64 nt, Homo Sapiens
uuuugaugauggacauuaauaguucuaggcuauuaugaauaaaguuuccaugaacaucuaugua

SEQ ID NO: 142234 - RNA, 64 nt, Homo Sapiens
ugaaaaaucauaaucugacuaauuuugggacugaaugaauaaguacaagagguuggauuuucua

SEQ ID NO: 142235 - RNA, 64 nt, Homo Sapiens
uuuuagguuaggcaaauucacaaauacggaauccaugaauaacgaggaucaacuguacuuaacu

SEQ ID NO: 142236 - RNA, 64 nt, Homo Sapiens
cuuaccauguaccagaauuuuacuaggcacaaccaugaauaaaaauacaauucucuugcaccau

SEQ ID NO: 142237 - RNA, 64 nt, Homo Sapiens
acaucaccacacccaaaccaucugaaaauauauuaugaauaaauauucuccauuauuaaugugu

SEQ ID NO: 142238 - RNA, 64 nt, Homo Sapiens
guuauucuccauuauuaaugguuauauucaguauaugaauaaguucuagagugcuccaggaaaa

SEQ ID NO: 142239 - RNA, 64 nt, Homo Sapiens
uuggcugagaaugguaccuuaucuaugaauaauaaugaauaauugggcacccaaaguucugguu

SEQ ID NO: 142240 - RNA, 64 nt, Homo Sapiens
augaauaauuuuggcugagaaguucugguuaucuaugaauaauagaaugauuaggggcacccaa

SEQ ID NO: 142241 - RNA, 64 nt, Homo Sapiens
uauagagguaacuauguuguuuuuucaucauaucaugaauaaaauaaauauaauggaaaacaga

SEQ ID NO: 142242 - RNA, 64 nt, Homo Sapiens
uggagaaagcucauuguauuuacuuggaguuuccaugaauaagaaagccaacacuugauagcac

SEQ ID NO: 142243 - RNA, 64 nt, Homo Sapiens
ggcuggcacauuguuggcacucaacaaugguugaaugaauaaaacaauaaaugaaugaauaacu

SEQ ID NO: 142244 - RNA, 64 nt, Homo Sapiens
ucaacaaugguugaaugaauaaaacaauaaaugaaugaauaacuaagauauagaaacucucauu

SEQ ID NO: 142245 - RNA, 64 nt, Homo Sapiens
auaaugagcucaauucaaagcaaucaccacuggcaugaauaaguacugcaugaaaagggaguau

SEQ ID NO: 142246 - RNA, 64 nt, Homo Sapiens
uguucaaagcaggggagaagaauuauucaauuucaugaauaacucuuguuugcacuccagaaaa

SEQ ID NO: 142247 - RNA, 64 nt, Homo Sapiens
ucugcuagugguauauguugcuuaauauuugguaaugaauaaauacauagugcuggucucacag

SEQ ID NO: 142248 - RNA, 64 nt, Homo Sapiens
guuuucagugauaugaaaagucuacauacaauagaugaauaaauuucaguuuuuaaaagaucga

SEQ ID NO: 142249 - RNA, 64 nt, Homo Sapiens
gccauuugauuuauguuuccaauaacagccaaaaaugaauaacauuaacugguauucaaaaaug

SEQ ID NO: 142250 - RNA, 64 nt, Homo Sapiens
gccaaaaaugaauaacagccacugguauucaaaaaugaauaacacuuugaaagcaguaauauua

SEQ ID NO: 142251 - RNA, 64 nt, Homo Sapiens
acuaauuauccugcuguucuuuaauuaaugcuuaaugaauaauauggcacuguaaaauagcuuc

SEQ ID NO: 142252 - RNA, 64 nt, Homo Sapiens
cagcagcucaaauuaaaccuuugugcauuggguuaugaauaaucuuuucuuccaaagauggcaa

SEQ ID NO: 142253 - RNA, 64 nt, Homo Sapiens
augcuauaauuauaguauccguuuuacuguaacuaugaauaauuucuaaauaaaaugguuuaga

SEQ ID NO: 142254 - RNA, 64 nt, Homo Sapiens
uugaaauaacucugaaagauaaucaaaaucuuauaugaauaauugugcauguaguagcuaaacu

SEQ ID NO: 142255 - RNA, 64 nt, Homo Sapiens
gacacaccauuauauuuaauucuaguuucucucaaugaauaauuguauuuuuguaggaaaugua

SEQ ID NO: 142256 - RNA, 64 nt, Homo Sapiens
auggaucuuugguuuguuuccagguuugguuauuaugaauaaaguugcugugaauacuuacgug

SEQ ID NO: 142257 - RNA, 64 nt, Homo Sapiens
ucaggaaaugaauauaaaauagguucacaguuaaaugaauaagcuuuuguuuauuugugggugg

SEQ ID NO: 142258 - RNA, 64 nt, Homo Sapiens
ugcccaaggauacuuaaucaggauuaaauuuucuaugaauaauugaaaaacaaaacacucacug

SEQ ID NO: 142259 - RNA, 64 nt, Homo Sapiens
guagccuaaacuuaauauuugcacacuuuuuuaaaugaauaauguuggcaaaaacagccuucua

SEQ ID NO: 142260 - RNA, 64 nt, Homo Sapiens
ugaaggucugguguauaugucaaaggaaaaauugaugaauaaaauuagugguuugagugucuag

SEQ ID NO: 142261 - RNA, 64 nt, Homo Sapiens
cuuuuuuguuuuuaaaauuguaaaauacauuaaaaugaauaacauuuagauauauugguucaaa

SEQ ID NO: 142262 - RNA, 64 nt, Homo Sapiens
aguuuggcaaaaugaugguaaaagaaaaaugaggaugaauaacaaauguccuuuuguucauaca

SEQ ID NO: 142263 - RNA, 64 nt, Homo Sapiens
ugacacuuagaggggagagaugaaagccaaacaaaugaauaaacauaaaugauaccaucagugc

SEQ ID NO: 142264 - RNA, 64 nt, Homo Sapiens
aaauaaggaaaaggagagaaaaaagaaauugguuaugaauaaaagugacaauaaaacaugagau

SEQ ID NO: 142265 - RNA, 64 nt, Homo Sapiens
aacuaaaggaaaucuugaggucauauacugaaauaugaauaaauuaaaauaaugaauucagauc

SEQ ID NO: 142266 - RNA, 64 nt, Homo Sapiens
agaaaaccagcaugguuugacaccacaugggaacaugaauaaaucugucucaugauuugaaaag

SEQ ID NO: 142267 - RNA, 64 nt, Homo Sapiens
gaguuuccuauagaagaaccaaaacauuacuguaaugaauaacugguauugcaggaauuuuuca

SEQ ID NO: 142268 - RNA, 64 nt, Homo Sapiens
auauuccgucaaaaauaguuaauauuucaaauucaugaauaagaauuuauuugaagugauuuca

SEQ ID NO: 142269 - RNA, 64 nt, Homo Sapiens
uccagccugggcgacagagcgagagucugucucaaaagaaaaaaaaaagcaccgccuccaaaug

SEQ ID NO: 142270 - RNA, 64 nt, Homo Sapiens
ccagccugagcaacagagugagacccugucucuuaaagaaaaaaaaagucagacugcugggacu

SEQ ID NO: 142271 - RNA, 64 nt, Homo Sapiens
aaagacauaggacuuaacuggaaaaugaaaaaaaaaagaaaaagaaaaaacuaaacaaaaaauc

SEQ ID NO: 142272 - RNA, 64 nt, Homo Sapiens
auaggacuuaacuggaaaaugaaaaaaaaaagaaaaagaaaaaacuaaacaaaaaaucccucua

SEQ ID NO: 142273 - RNA, 64 nt, Homo Sapiens
cccagagaagcccccuacauccccccgggaaaaaaaagaaaacuagacagaaacucaucuauau

SEQ ID NO: 142274 - RNA, 64 nt, Homo Sapiens
ggccaccauauuuagaacuaguuaccuuauuaaaaaagaaaaaacagucuguuggcuucucagu

SEQ ID NO: 142275 - RNA, 64 nt, Homo Sapiens
aauuuaaagacaucuauuaucugcuuugugcuuaaaagaaaaauucaaccuuuuuuuuuuuuuu

SEQ ID NO: 142276 - RNA, 64 nt, Homo Sapiens
cucugugaaaucgucugauggucuguguggaagaaaagaaaaaucugucugccgccuauuuccc

SEQ ID NO: 142277 - RNA, 64 nt, Homo Sapiens
aguguuuuuguccuaauguugcuacucccauggcaaagaaaaaaaaaagaaugaaaaaaagaaa

SEQ ID NO: 142278 - RNA, 64 nt, Homo Sapiens
acucccauggcaaagaaaaaaaaaagaaugaaaaaaagaaaaaaauuuggaaaaaaaaaucagg

SEQ ID NO: 142279 - RNA, 64 nt, Homo Sapiens
cucuaguaugguguauuuaaauaauaaaaacuuaaaagaaaaaauauuuaaugguguuuggguu

SEQ ID NO: 142280 - RNA, 64 nt, Homo Sapiens
aauuauucaaaugccuagaaauccauaguuuggaaaagaaaaaucaugucaucuucuauuugua

SEQ ID NO: 142281 - RNA, 64 nt, Homo Sapiens
aaauggaaauugucggucauauuucuagaacuuuaaagaaaaaagaauguuauauuaguuuucu

SEQ ID NO: 142282 - RNA, 64 nt, Homo Sapiens
ugcugauagaaggaguugaaaucugaugacaaaaaaagaaaaauuacuuuuuguuuguuuauaa

SEQ ID NO: 142283 - RNA, 64 nt, Homo Sapiens
agauuuguuguuuuuguaagaaaugagaugcaggaaagaaaaccaaaucccauuccugcacccc

SEQ ID NO: 142284 - RNA, 64 nt, Homo Sapiens
acuagggaagauaauauuaaggaagacaaugugaaaagaaaaaugagccuggcaagaauguguu

SEQ ID NO: 142285 - RNA, 64 nt, Homo Sapiens
ugggugacagagcaagugagacccugucucaaaaaaagaaaaagaaaaagaaaaaauauuuucc

SEQ ID NO: 142286 - RNA, 64 nt, Homo Sapiens
acagagcaagugagacccugucucaaaaaaagaaaaagaaaaagaaaaaauauuuucccuauua

SEQ ID NO: 142287 - RNA, 64 nt, Homo Sapiens
caagugagacccugucucaaaaaaagaaaaagaaaaagaaaaaauauuuucccuauuagagaag

SEQ ID NO: 142288 - RNA, 64 nt, Homo Sapiens
agucucugcucaaaaaaaaaacaauucucggcccaaagaaaacaaucagaagaauucacugauu

SEQ ID NO: 142289 - RNA, 64 nt, Homo Sapiens
uccagccaggcuucauuuaugcacuugugcugcaaaagaaaagucuagguuuuaaggcugugcc

SEQ ID NO: 142290 - RNA, 64 nt, Homo Sapiens
auuucuuuuuaggcucugagacuaaaugagaggaaaagaaaagaaaaaaaaaaugauugucuaa

SEQ ID NO: 142291 - RNA, 64 nt, Homo Sapiens
uuuuuaggcucugagacuaaaugagaggaaaagaaaagaaaaaaaaaaugauugucuaaccaau

SEQ ID NO: 142292 - RNA, 64 nt, Homo Sapiens
uagcaacaaaauauuuauucuacuguaaaugacaaaagaaaaagaaaaauugagccuugggacg

SEQ ID NO: 142293 - RNA, 64 nt, Homo Sapiens
caaaauauuuauucuacuguaaaugacaaaagaaaaagaaaaauugagccuugggacgugccca

SEQ ID NO: 142294 - RNA, 64 nt, Homo Sapiens
aaaaauguagaaugauuuuugcuauuucuaguagaaagaaaaugucuguuuuccaaagauaaug

SEQ ID NO: 142295 - RNA, 64 nt, Homo Sapiens
aguaggaaggaaaaaauaagagauagcagaggaaaaagaaaaacauuuccucuuauaacuucug

SEQ ID NO: 142296 - RNA, 64 nt, Homo Sapiens
ucugacccacugcuaacuguagcaacaaaauuuaaaagaaaaaaaacauacuuuaucuggcuau

SEQ ID NO: 142297 - RNA, 64 nt, Homo Sapiens
aaaaacagaaaguguauucaaauuuuaucaguuuaaagaaaauaaagcugugauaaauacugua

SEQ ID NO: 142298 - RNA, 64 nt, Homo Sapiens
uaacagagcaagacuccaucucaaaaaaagaaagaaagaaaaaagaaaguacaaguuuauaaag

SEQ ID NO: 142299 - RNA, 64 nt, Homo Sapiens
uuccuugaaaauguaauuuuccagaaaaacaccuaaagaaaauaaaacauggacaugccuagua

SEQ ID NO: 142300 - RNA, 64 nt, Homo Sapiens
uaaauucauacucagacaaaaaaaggaauucuggaaagaaaaccauucuggacacugucauaac

SEQ ID NO: 142301 - RNA, 64 nt, Homo Sapiens
gugggggaggguaagaaaagcaguuugcacuuaaaaagaaaaaaaaaaaacggguggugugucu

SEQ ID NO: 142302 - RNA, 64 nt, Homo Sapiens
uugaguucuaauaauccauguucaguuuguagggaaagaaaaaauaauuuuuccuucuacccac

SEQ ID NO: 142303 - RNA, 64 nt, Homo Sapiens
aaagaacaguaaauuuuuagagaaacaacaaaacaaagaaaaagagcuuugagucuguaggggc

SEQ ID NO: 142304 - RNA, 64 nt, Homo Sapiens
agaaacuagucccagauuuguggcauuucaguuaaaagaaaaaaaaaaaacccugggcugaagu

SEQ ID NO: 142305 - RNA, 64 nt, Homo Sapiens
cgacaucuuucuaagauucuucucucauucauuaaaagaaaacguucagggauacaaaugggcu

SEQ ID NO: 142306 - RNA, 64 nt, Homo Sapiens
auagcuugguuuuauuugucuaguuaauguuuaaaaagaaaaaauaaauguucuuuauacagcc

SEQ ID NO: 142307 - RNA, 64 nt, Homo Sapiens
aggaaaagguuuuuagcucaaagcuuuaaaaaaaaaagaaaaaaguugguuuaacaaaaaaaaa

SEQ ID NO: 142308 - RNA, 64 nt, Homo Sapiens
auuaguuuaccugagcacuuuaguucugggggugaaagaaaaaugcuuacagcuaggaaagcuc

SEQ ID NO: 142309 - RNA, 64 nt, Homo Sapiens
ugcaaugcagugcuuuuagauuguuuguaugaguaaagaaaagguuguuugaaaccuuuguaac

SEQ ID NO: 142310 - RNA, 64 nt, Homo Sapiens
ucuacuaauuucagaccucuaaaaagagaaaagaaaagaaaauuaaaacacuucuacuagggcc

SEQ ID NO: 142311 - RNA, 64 nt, Homo Sapiens
aaauuucuacuaauuucagagggccaaaaagagaaaagaaaagaaagcuaaaacacuucuacua

SEQ ID NO: 142312 - RNA, 64 nt, Homo Sapiens
uauuuuacaaaaauuacuuccugugucuguagcuaaagaaaaauaauuauacauggcuacuuua

SEQ ID NO: 142313 - RNA, 64 nt, Homo Sapiens
aucuucuccuaguuguguguggccaaaccaaaauaaagaaaagcauuuaaccauuagcaucuuu

SEQ ID NO: 142314 - RNA, 64 nt, Homo Sapiens
cuauaaccugaaaauguuuccucugugacaccaaaaagaaaaguaagaauucagaacuacuuuc

SEQ ID NO: 142315 - RNA, 64 nt, Homo Sapiens
agaauucagaacuacuuuccuuuuccuaaaaaaaaaagaaaaaagaauuuagcaaauuaaguua

SEQ ID NO: 142316 - RNA, 64 nt, Homo Sapiens
cuuggggauaaguuuagugauguacaacugaccgaaagaaaaccuguggagaaacuaaaaaugu

SEQ ID NO: 142317 - RNA, 64 nt, Homo Sapiens
aggggugcuuuuggaagcaguuagugggaugaagaaagaaaagcugacaacaucuaagacaaua

SEQ ID NO: 142318 - RNA, 64 nt, Homo Sapiens
uuuucuacaauuugcaugagugccagcuucaaggaaagaaaauucaugaaucuuuauuuuucac

SEQ ID NO: 142319 - RNA, 64 nt, Homo Sapiens
acaugaaucuuuauuuuucaacaggggugugcacaaagaaaaugaaucugacaggaagaagcgc

SEQ ID NO: 142320 - RNA, 64 nt, Homo Sapiens
aauuauuugugggcaaaugugacaaaauuaagaaaaagaaaaaaacuguguuugguauuuuucu

SEQ ID NO: 142321 - RNA, 64 nt, Homo Sapiens
guuuaaaagcaucaaauaaguuuucugucuaaauaaagaaaaaauuacuuuuaaagaguugguc

SEQ ID NO: 142322 - RNA, 64 nt, Homo Sapiens
gggugggggugggggugguaagagguuuuagggaaaagaaaaugccugaucauuuucuuuagga

SEQ ID NO: 142323 - RNA, 64 nt, Homo Sapiens
aggcagaaagaggaggaagacccaaaaaaaagaaaaagaaaaggugcagucagagagcaagccc

SEQ ID NO: 142324 - RNA, 64 nt, Homo Sapiens
aaaaggaggcagaaagaggaaagccccccaaaaaaaagaaaaagcucaacugcagucagagagc

SEQ ID NO: 142325 - RNA, 64 nt, Homo Sapiens
agaagacauauaaauuaaauccaaaaaaagagaaaaagaaaaauauuugucacauguaucaccc

SEQ ID NO: 142326 - RNA, 64 nt, Homo Sapiens
cgaauauuuaaggugacagaaauauuuucaacauaaagaaaagaaaaugaagaaaaguaauuag

SEQ ID NO: 142327 - RNA, 64 nt, Homo Sapiens
gaagaaaaguaauuagaauaagggagagagaagaaaagaaaaauaagaagagagggaggaagaa

SEQ ID NO: 142328 - RNA, 64 nt, Homo Sapiens
auauugguuacugggaaaagauuuuacuuuauucaaagaaaaaugagaggaaugucaaaaauac

SEQ ID NO: 142329 - RNA, 64 nt, Homo Sapiens
uggguagacaauuucuugcagaaaggaacauuugaaagaaaaugcauuaaaggaaugaaacaau

SEQ ID NO: 142330 - RNA, 64 nt, Homo Sapiens
aaaaugcuaaugaagccaucuauuaaggauccaaaaagaaaaacccuaacagaauugaguuuuc

SEQ ID NO: 142331 - RNA, 64 nt, Homo Sapiens
aagcuggagcugguggcuuaucaaaaaaaaaaagaaagaaaagaaacaagagcaaaacuccagc

SEQ ID NO: 142332 - RNA, 64 nt, Homo Sapiens
ggaggcugggcgcaguggcucgcugcucuaaagaaaagaaaacuaagccaaaaggauuuaaaac

SEQ ID NO: 142333 - RNA, 64 nt, Homo Sapiens
aaacuggaggcugggcgcagaaaaccgcugcucuaaagaaaagaacuugaagccaaaaggauuu

SEQ ID NO: 142334 - RNA, 64 nt, Homo Sapiens
ucgaauugaaaugugugagguuuugcuuaagcaaaaagaaaaccuuaaagauagcucaugaaac

SEQ ID NO: 142335 - RNA, 64 nt, Homo Sapiens
aaacccaaccaaucugcaaugaucuuacuacuacaaagaaaaaauacuuuuuuucuaauuuacu

SEQ ID NO: 142336 - RNA, 64 nt, Homo Sapiens
uaugguguaauuuaaacucuugauuugcagaaagaaagaaaaacaaacugcaaaucagaaagaa

SEQ ID NO: 142337 - RNA, 64 nt, Homo Sapiens
auuacauaucaguuguccuuuuuuucauaucuguaaagaaaaaaucucagcuuugccuucuugc

SEQ ID NO: 142338 - RNA, 64 nt, Homo Sapiens
uuuuauuugcacuacugaguauuuuuauauuugaaaagaaaaugauggauagucuucuuggauu

SEQ ID NO: 142339 - RNA, 64 nt, Homo Sapiens
uacagaauggaaaauaauauaaguaauggaagguaaagaaaaauuaaauugcagagaaaccugu

SEQ ID NO: 142340 - RNA, 64 nt, Homo Sapiens
acagaucguggucagcagaccagaagcccauaguaaagaaaauguaaaauagcaugcauucucc

SEQ ID NO: 142341 - RNA, 64 nt, Homo Sapiens
acauuuggccuuaaaauagcgggaaggggagaagaaagaaaaacugggagaaagggaaaaguca

SEQ ID NO: 142342 - RNA, 64 nt, Homo Sapiens
agauaauuuuuaggacuugaugcuccaaaagaggaaagaaaaaacuccucccaccacacacaca

SEQ ID NO: 142343 - RNA, 64 nt, Homo Sapiens
uuaaggucuccccuuuuucucaccaagguauuccaaagaaaauaauauucuuaaaauuuuuucc

SEQ ID NO: 142344 - RNA, 64 nt, Homo Sapiens
aucucuguuguggugggcauagguggcaccaucuaaagaaaagaggucuuguuuuuuguuuaaa

SEQ ID NO: 142345 - RNA, 64 nt, Homo Sapiens
cuucacugcuggaaaaauccacuggcucccaagaaaagaaaauggucugaagccucuguugugg

SEQ ID NO: 142346 - RNA, 64 nt, Homo Sapiens
acacagacugacaugaaaccugggugcuacaguaaaagaaaacaaaaguccaguuugugucucu

SEQ ID NO: 142347 - RNA, 64 nt, Homo Sapiens
cagaugcauuacugcuaucuuaguuuaaagggggaaagaaaagggaagaagaaaggaaaagaga

SEQ ID NO: 142348 - RNA, 64 nt, Homo Sapiens
ugaccuguacaagugaugcagaaaggaggguuucaaagaaaaaggauuuuguuuaaaauacuuu

SEQ ID NO: 142349 - RNA, 64 nt, Homo Sapiens
cagcagaaugagccaggaguagcaggagaugggcaaagaaaacuggggugcacucagcucucac

SEQ ID NO: 142350 - RNA, 64 nt, Homo Sapiens
ugaaagacacagauacccaguaugcuuaacgugaaaagaaaauguguucuguuuuguaaaggaa

SEQ ID NO: 142351 - RNA, 64 nt, Homo Sapiens
gaagauuaaccauuuuuuugucuuagaauaucaaaaagaaaaagaaaaagguguucuagcuguu

SEQ ID NO: 142352 - RNA, 64 nt, Homo Sapiens
uaaccauuuuuuugucuuagaauaucaaaaagaaaaagaaaaagguguucuagcuguuugcauc

SEQ ID NO: 142353 - RNA, 64 nt, Homo Sapiens
acucuuuuacuuugguuccuguugugcucuuguaaaagaaaaauauaauuuccugaagaauaaa

SEQ ID NO: 142354 - RNA, 64 nt, Homo Sapiens
uuauaauguaccuggaaaauaaaccucuugagaaaaagaaaaguucauacugauuauuggaaaa

SEQ ID NO: 142355 - RNA, 64 nt, Homo Sapiens
uuugucuuaaaauauuaguggcuuacauuuuaaaaaagaaaaaucaccagcaugaacuugcacc

SEQ ID NO: 142356 - RNA, 64 nt, Homo Sapiens
aaguguugcuagagaaaauuagggaaaaggugaaaaagaaaaaaugguaguaauugagcagaaa

SEQ ID NO: 142357 - RNA, 64 nt, Homo Sapiens
gauuuaucuaaguagaacugaauuggcuaggaaaaaagaaaaacugcauguuaaucauuuuccu

SEQ ID NO: 142358 - RNA, 64 nt, Homo Sapiens
acaugacucauugaguaguaaugauucagaagaaaaagaaaaaggagacuuuauuggucaauau

SEQ ID NO: 142359 - RNA, 64 nt, Homo Sapiens
gagcaauuuaaacucccaguuguuuauuuucacaaaagaaaauaaaauugcaguugcaagaccu

SEQ ID NO: 142360 - RNA, 64 nt, Homo Sapiens
cagcccaggcaacaagagugaaacccugucucaaaaagaaaaaaaaaguugaccuugagaauuu

SEQ ID NO: 142361 - RNA, 64 nt, Homo Sapiens
cuccagaacugugaaaaauaaauuuguuauuuaaaaagaaaaaaaaaaaaacaaaaaccugagu

SEQ ID NO: 142362 - RNA, 64 nt, Homo Sapiens
aaaaaaaaaaaaaaaaaaaaaaaaggaaaaaaaaaaagaaaaagaaaacgugugcauuuuguau

SEQ ID NO: 142363 - RNA, 64 nt, Homo Sapiens
aaaaaaaaaaaaaaaaaaggaaaaaaaaaaagaaaaagaaaacgugugcauuuuguauaauggc

SEQ ID NO: 142364 - RNA, 64 nt, Homo Sapiens
acaaaaguuuuaccacagucugcacuugcagaagaaagaaaaaaauucaaaccacauguuuauu

SEQ ID NO: 142365 - RNA, 64 nt, Homo Sapiens
uuuauuaauggcauguaauauucugagcacgggcaaagaaaacacacaaaagauuauguauugg

SEQ ID NO: 142366 - RNA, 64 nt, Homo Sapiens
gauugaaaaaagagaaaggggcaagaaauucauuaaagaaaaaccacagauacugaaacauuug

SEQ ID NO: 142367 - RNA, 64 nt, Homo Sapiens
cuucucccugaaaaagagaaaaaaaaaaggaaaaaaagaaaagaaaagugaaaagaaaaacucu

SEQ ID NO: 142368 - RNA, 64 nt, Homo Sapiens
cccugaaaaagagaaaaaaaaaaggaaaaaaagaaaagaaaagugaaaagaaaaacucuuauug

SEQ ID NO: 142369 - RNA, 64 nt, Homo Sapiens
gaaaaaaaaaaggaaaaaaagaaaagaaaagugaaaagaaaaacucuuauuggccuaaguucua

SEQ ID NO: 142370 - RNA, 64 nt, Homo Sapiens
auaugaaugguuuuaugucauuuuuuuaauuaaaaaagaaaaauucauauaaucguguuuaaaa

SEQ ID NO: 142371 - RNA, 64 nt, Homo Sapiens
aaaacaguauaaacauuaauuuacuuuguguucaaaagaaaauuccaacugcuguuggggaagg

SEQ ID NO: 142372 - RNA, 64 nt, Homo Sapiens
gaaaauuccaacugcuguuggggaaggacacagaaaagaaaaauaaccacccaagaaaaacaaa

SEQ ID NO: 142373 - RNA, 64 nt, Homo Sapiens
uauacauagaauuugugaauuacuuucugacuacaaagaaaagcagaugccaaaauacucuucu

SEQ ID NO: 142374 - RNA, 64 nt, Homo Sapiens
cucuuuguuuacuuagcuuucucuuaguuguaagaaagaaaaagacgucuugcaugaaaauagu

SEQ ID NO: 142375 - RNA, 64 nt, Homo Sapiens
cucucaauucuuuuauauucuaacaauaaauaaaaaagaaaagauuacugacugugcauuguac

SEQ ID NO: 142376 - RNA, 64 nt, Homo Sapiens
uuuauaguuuaugguuaucaggaagcucuguaagaaagaaaaggucagccucccaggcaaacca

SEQ ID NO: 142377 - RNA, 64 nt, Homo Sapiens
gacuauuaaacuacguauaguguugcugaaauagaaagaaaacagcauuggaauuggauucaug

SEQ ID NO: 142378 - RNA, 64 nt, Homo Sapiens
uaccaaguaagacucaaaauugcaaauauaaacaaaagaaaaauccaacugaaaauaacacuaa

SEQ ID NO: 142379 - RNA, 64 nt, Homo Sapiens
cauaguuaauucucauuaacacuuacauuuccauaaagaaaacucaaguauuaauaaaagagac

SEQ ID NO: 142380 - RNA, 64 nt, Homo Sapiens
uagcuuguauauguaguaguuugaugaauaauuuaaagaaaaacaccuaaaauuugaaaaauga

SEQ ID NO: 142381 - RNA, 64 nt, Homo Sapiens
auuuccaaaauguuuggaaacaguauaauuugacaaagaaaaaugauacuucucuuuuuuugcu

SEQ ID NO: 142382 - RNA, 64 nt, Homo Sapiens
uuucauugauuaaucuccuggaagauugguuuaaaaagaaaaguguaaugcaagaauuuaaaga

SEQ ID NO: 142383 - RNA, 64 nt, Homo Sapiens
aauaaguagcaacuauacuuuccaaugacuaaagaaagaaaaucucaguauauucguucucaug

SEQ ID NO: 142384 - RNA, 64 nt, Homo Sapiens
uauaauagcuguggaugagcacaggagagagaggaaagaaaagaacagucgaaaugagcaacuc

SEQ ID NO: 142385 - RNA, 64 nt, Homo Sapiens
uuucuuuuuucuagaaaacacuuuccuggauaaaaaagaaaacauuccagaugcaugauccagc

SEQ ID NO: 142386 - RNA, 64 nt, Homo Sapiens
ugacauuuaauaacuuugcuggaaaaucuguaaaaaagaaaaacaaguuugcuagugacuaagc

SEQ ID NO: 142387 - RNA, 64 nt, Homo Sapiens
aagacagacuguagaugcauuuuuucccaaauauaaagaaaacuuucacacuuaagauucaaaa

SEQ ID NO: 142388 - RNA, 64 nt, Homo Sapiens
ucuuuucuagcuucaacagaaagaguuaaaggcuaaagaaaacacaaugcacacaaggauugag

SEQ ID NO: 142389 - RNA, 64 nt, Homo Sapiens
aaaaaaaaggagcugugccccaguuuuuuaaaaaaaagaaaaaaagccacugcaagcucugaau

SEQ ID NO: 142390 - RNA, 64 nt, Homo Sapiens
caugucuucaacaucugagugaauagcuauuauuaaagaaaagccaaaaaagaauaaaaaguuu

SEQ ID NO: 142391 - RNA, 64 nt, Homo Sapiens
aaaaaagguacuuagaggucagaucuugucucuuaaagaaaaaacccaccugggcaacauagua

SEQ ID NO: 142392 - RNA, 64 nt, Homo Sapiens
aaaaacgaaugaaaauaacuaguuaaagaaaggaaaagaaaacaauuuaauaugcuuauaaccu

SEQ ID NO: 142393 - RNA, 64 nt, Homo Sapiens
aaaaaagccagccaagcuuuuuugaauuaucagcaaagaaaaaauugcuugccaaaguacagaa

SEQ ID NO: 142394 - RNA, 64 nt, Homo Sapiens
gaaaaauggucauuuuuaaaguuuaauuuccuagaaagaaaauggguagauaagaauuaaaagg

SEQ ID NO: 142395 - RNA, 61 nt, Homo Sapiens
uccugccauuguaacaucauauuccuucccuaaagaaaaagauacauugcagcacaacuga

SEQ ID NO: 142396 - RNA, 64 nt, Homo Sapiens
uuucaucugauuuaguuagcauauacagaauuuuaaagaaaacauuuccuagaaauucuuaaau

SEQ ID NO: 142397 - RNA, 64 nt, Homo Sapiens
auuacuuagaaacuccauuucuccacuaaacuauaaagaaaauauuuuagauuuauuuuucuua

SEQ ID NO: 142398 - RNA, 64 nt, Homo Sapiens
aauacauaaaaaagggacaaguguuugcaaaaaaaaagaaaauaacaaauucuaaaagauaagu

SEQ ID NO: 142399 - RNA, 64 nt, Homo Sapiens
aacaaacaaacaaaaacugucccccuugaucccuaaagaaaacacauuucuguaacccuccuag

SEQ ID NO: 142400 - RNA, 64 nt, Homo Sapiens
ucaauuuucuggguaugcacgaaaaaaaaaaagaaaagaaaacuaugaugcaaaaaaagaaaaa

SEQ ID NO: 142401 - RNA, 64 nt, Homo Sapiens
aaacuucaauuuucuggguaaaaaagaaaaaaaaaaagaaaagaauguuaugaugcaaaaaaag

SEQ ID NO: 142402 - RNA, 64 nt, Homo Sapiens
aaaaagaaaagaaaacuucaaugcaaaaaaagaaaaagaaaaaagauuuuuaucaaauguuaug

SEQ ID NO: 142403 - RNA, 64 nt, Homo Sapiens
aaaaaaaaaaagaaaagaaaguuaugaugcaaaaaaagaaaaagacaaaagauuuuuaucaaau

SEQ ID NO: 142404 - RNA, 64 nt, Homo Sapiens
aaguguucagggcauaacaacaaaggaagaaaagaaagaaaaacacaauaaagaaaaaaaaaua

SEQ ID NO: 142405 - RNA, 64 nt, Homo Sapiens
aaauacaaaggaagaaaagagugagaguaacaauaaagaaaaaauucagaaagcaguagugaga

SEQ ID NO: 142406 - RNA, 64 nt, Homo Sapiens
uuucagaagagcagaaguaaaaaaaagauagaaaaaagaaaaaggacuggagaagaaaaaaaag

SEQ ID NO: 142407 - RNA, 64 nt, Homo Sapiens
gauagaaaaaagaaaaaguucuggagaagaaaaaaaagaaaaaaauuacaggaaauuagaucga

SEQ ID NO: 142408 - RNA, 64 nt, Homo Sapiens
gaauacccaggugugguaguaaaaagaaaaagaaaaagaaaaaaggucuguacuaaaaaaaaaa

SEQ ID NO: 142409 - RNA, 64 nt, Homo Sapiens
aaaaaagaauacccagguguaaaaaaaaaaagaaaaagaaaaagaaacccggucuguacuaaaa

SEQ ID NO: 142410 - RNA, 64 nt, Homo Sapiens
aaaaagaaaaaagaauaccccuaaaaaaaaaaaaaaagaaaaagguggugaaacccggucugua

SEQ ID NO: 142411 - RNA, 64 nt, Homo Sapiens
agaaugauauggugucaacuguuagccagacaauaaagaaaagcagacaucugcaucuuuguaa

SEQ ID NO: 142412 - RNA, 64 nt, Homo Sapiens
cugaaaaauacauuucuauucaagaaaccaacccaaagaaaauuguauuacugggagaugcuac

SEQ ID NO: 142413 - RNA, 64 nt, Homo Sapiens
auucucuauuuuuccaugggucagaaagaaaaagaaagaaaaccauuucuugagcauguauugg

SEQ ID NO: 142414 - RNA, 64 nt, Homo Sapiens
aaagaaaaccauucucuauucauguauuggucagaaagaaaaagcagauauuugauuucuugag

SEQ ID NO: 142415 - RNA, 64 nt, Homo Sapiens
uuaucccaguuaccuacaucacuuacucauccuaaaagaaaacagaagcgauuucaguagaauc

SEQ ID NO: 142416 - RNA, 64 nt, Homo Sapiens
cuuguuuauguauuaaaaaaugaaaugaguucuuaaagaaaagacaauccgaaagaauagacug

SEQ ID NO: 142417 - RNA, 64 nt, Homo Sapiens
aaagccagacaaacccaaguuuauuuuuaaagaaaaagaaaacacuuguaguuuuacuguacau

SEQ ID NO: 142418 - RNA, 64 nt, Homo Sapiens
aaaacaaaagccagacaaacguacauuuauuuuuaaagaaaaagcuuuugcuuguaguuuuacu

SEQ ID NO: 142419 - RNA, 64 nt, Homo Sapiens
ccuuuugaagcuauuaaaccgaagaguauacaugaaagaaaauuaagcuucaauauuggauacu

SEQ ID NO: 142420 - RNA, 64 nt, Homo Sapiens
ggcgcuuugucuccuacaauaauguguccauugaaaagaaaauaggugauugcugcuauucugg

SEQ ID NO: 142421 - RNA, 64 nt, Homo Sapiens
gcauccuaaccauuccauccaaugcuuuaauuugaaagaaaaaugcuauuuuuucucaguuuuu

SEQ ID NO: 142422 - RNA, 64 nt, Homo Sapiens
guguauuuuaagaugaaauaguauuuucugguaaaaagaaaaaugguggcaauuuauuuuaaga

SEQ ID NO: 142423 - RNA, 64 nt, Homo Sapiens
gcauuuuagagaaaacuaaaaccuuccucaucuaaaagaaaaagaaaaaauuuuuaggaaacuc

SEQ ID NO: 142424 - RNA, 64 nt, Homo Sapiens
uucaccauugcccgccugaagaccccaacucgccaaagaaaagaagucucucugggauggagag

SEQ ID NO: 142425 - RNA, 64 nt, Homo Sapiens
uaaugccuuucugaagaaccgagaaaaaggcaaaaaagaaaaagggaaaaggaaauaaaagaaa

SEQ ID NO: 142426 - RNA, 64 nt, Homo Sapiens
agcucggugacuccguccacacuuuuguuuugcaaaagaaaagcgcgugacugcaaagaaaaag

SEQ ID NO: 142427 - RNA, 64 nt, Homo Sapiens
acuuuuguuuugcaaaagaauacagcgugacugcaaagaaaaaguuucuccagcagccucgucu

SEQ ID NO: 142428 - RNA, 64 nt, Homo Sapiens
gagcaacagaauccuuccaggaccguucacauacaaagaaaaguagugguauuuugguaugugc

SEQ ID NO: 142429 - RNA, 64 nt, Homo Sapiens
aaaaaaagguuuuauaaugucagagacuaguauuaaagaaaacugaaagaaccugagagaauag

SEQ ID NO: 142430 - RNA, 64 nt, Homo Sapiens
cuagacuacuguuguccagggucaauuugaguguaaagaaaauguagacaaggaauugcccaau

SEQ ID NO: 142431 - RNA, 64 nt, Homo Sapiens
uaaaaguucuugagaccuaaauuucuucacaaaaaaagaaaagaucuuaagucauacauuuuaa

SEQ ID NO: 142432 - RNA, 64 nt, Homo Sapiens
ucagggcuggggccaagaggaaaaacagggaaaaaaagaaaaaaaaaagaaaaaggaaaaggaa

SEQ ID NO: 142433 - RNA, 64 nt, Homo Sapiens
gccaagaggaaaaacagggaaaaaaagaaaaaaaaaagaaaaaggaaaaggaagcggugugugg

SEQ ID NO: 142434 - RNA, 64 nt, Homo Sapiens
guaaaguuuaauugaaagaauguaaagcaaccaaaaagaaaaaaaaaaagaaagaaagaggaaa

SEQ ID NO: 142435 - RNA, 64 nt, Homo Sapiens
acugcaaacuauuuaaagaaauauguauucuguaaaagaaaaaaaaaaugcggccuuuucauga

SEQ ID NO: 142436 - RNA, 64 nt, Homo Sapiens
acuggugguuuuccgcauucuuuguacacccaugaaagaaaacuuuuaugcaaggucuugcauu

SEQ ID NO: 142437 - RNA, 64 nt, Homo Sapiens
cuuaacucuuucuugucaggaguauauaaaaaagaaagaaaacaaaacucgcccuacaggaaga

SEQ ID NO: 142438 - RNA, 64 nt, Homo Sapiens
aauacguuugacccauuuugaauaaggaaauugaaaagaaaaauuuaaaaggagaaaaaaaugc

SEQ ID NO: 142439 - RNA, 64 nt, Homo Sapiens
ccuuaaugggucuugucuaucuucauuagucuucaaagaaaaaccauuugcuaccaaaguaaau

SEQ ID NO: 142440 - RNA, 64 nt, Homo Sapiens
ugaaaaagcacauuuuagauacugaaauugaaggaaagaaaaugcaucuucaaacauuuuuugg

SEQ ID NO: 142441 - RNA, 64 nt, Homo Sapiens
uauuuaguucacuauuauauaguggguuauauuaaaagaaaagaagaaaaauaucuaauuucuc

SEQ ID NO: 142442 - RNA, 64 nt, Homo Sapiens
ucauuaaaaaccuuuuuuuuuuaaaaaaaaaaaaaaagaaaaucucauuagugaacuuaucuuu

SEQ ID NO: 142443 - RNA, 64 nt, Homo Sapiens
auucuuccugauucaaagacugucaaauaggaaaaaagaaaacaguaaaugaacaaaaacauca

SEQ ID NO: 142444 - RNA, 64 nt, Homo Sapiens
uaacagacaaggucaaaaaauagaugcaggcugaaaagaaaaggaagugggcuaagaugggaaa

SEQ ID NO: 142445 - RNA, 64 nt, Homo Sapiens
caguuuggguaaaggaugagcagacaagucaacuaaagaaaaaagaaaagcaaggaggaggguu

SEQ ID NO: 142446 - RNA, 64 nt, Homo Sapiens
gguaaaggaugagcagacaagucaacuaaagaaaaaagaaaagcaaggaggaggguugagcaau

SEQ ID NO: 142447 - RNA, 56 nt, Homo Sapiens
uuauucuuuuauacaguugagguacuaaagaaaauugacauuccaucugucuuuau

SEQ ID NO: 142448 - RNA, 64 nt, Homo Sapiens
uguccuuaaggguucuguaguguuaucaaagcaaaaagaaaaugcugcauaaaaauaccaaacu

SEQ ID NO: 142449 - RNA, 64 nt, Homo Sapiens
ggaaaagguuaaacuggauuuuuuuuuuuaaaaaaaagaaaaaaaaagaagaaaaguauaccag

SEQ ID NO: 142450 - RNA, 64 nt, Homo Sapiens
caaacugcccuuuguccucaaagaaauuguugaaaaagaaaacuuuuuaaagagauuuuuugca

SEQ ID NO: 142451 - RNA, 64 nt, Homo Sapiens
gacauacauuccaagcuuuucaacucuaggagaaaaagaaaaucauguuuuccuguauuguaaa

SEQ ID NO: 142452 - RNA, 64 nt, Homo Sapiens
guuuauugcuguuuugucuuucuuuuuucuaaaaaaagaaaaaaaagaaaaaaaggaaaagaag

SEQ ID NO: 142453 - RNA, 64 nt, Homo Sapiens
uguuuugucuuucuuuuuucuaaaaaaagaaaaaaaagaaaaaaaggaaaagaagaacaaagaa

SEQ ID NO: 142454 - RNA, 64 nt, Homo Sapiens
gccggacagcgaacuggaggggggagaaauuuucaaagaaaaacgagggaaaugggaggggugc

SEQ ID NO: 142455 - RNA, 64 nt, Homo Sapiens
aagaaacagcauggagaaaacccgguacgcucaaaaagaaaaaggaaaaaaaaaaaucccauca

SEQ ID NO: 142456 - RNA, 64 nt, Homo Sapiens
ugaccaugauaauucaguuuauauucaccacaugaaagaaaaauggguaacagaagaacccuua

SEQ ID NO: 142457 - RNA, 64 nt, Homo Sapiens
aaaguaauguugaccaucccccucucagcugaauaaagaaaaauuuaguucaauuuauugcaau

SEQ ID NO: 142458 - RNA, 64 nt, Homo Sapiens
aaagcuagguauuuaucaacugcagauguuauugaaagaaaauaaaauucagucucaagaguaa

SEQ ID NO: 142459 - RNA, 64 nt, Homo Sapiens
gcaacccucuuucaaacuguauuuagcauuucuaaaagaaaaaaauuuuugucuuguuaagaaa

SEQ ID NO: 142460 - RNA, 64 nt, Homo Sapiens
cacacacaaagcaaaaacucucuaaaugaaaaagaaagaaaacccuccacuuuaucccacgaua

SEQ ID NO: 142461 - RNA, 64 nt, Homo Sapiens
ugaaacacaauuuaguccucuuuuaaaaaaaggaaaagaaaaugauucucauuguuacaugauu

SEQ ID NO: 142462 - RNA, 64 nt, Homo Sapiens
aagaguuuguuacucuauuguauuuaaaaaaaaaaaagaaaaaaaucuuuggaaacuugccccu

SEQ ID NO: 142463 - RNA, 64 nt, Homo Sapiens
guguauuuuacuguuuucugaaaaaaaaaaagaaaaagaaaaaaagucuuguuuguaaaaaaaa

SEQ ID NO: 142464 - RNA, 64 nt, Homo Sapiens
aaaaaaguguauuuuacuguaaaaaaaaaaaaaaaaagaaaaaguaagcuagucuuguuuguaa

SEQ ID NO: 142465 - RNA, 64 nt, Homo Sapiens
aacaugguucaaauuauaucuguuucaaaaaagaaaagaaaagacuggugacagagugagacuc

SEQ ID NO: 142466 - RNA, 64 nt, Homo Sapiens
aaagaaacaugguucaaauugacucuguuucaaaaaagaaaagaccagccuggugacagaguga

SEQ ID NO: 142467 - RNA, 64 nt, Homo Sapiens
auaaagggauugugaaaagaaaaaaaaaaaaagaaaagaaaaaggagccagacucugucucaaa

SEQ ID NO: 142468 - RNA, 64 nt, Homo Sapiens
aaaagauaaagggauugugaucaaaaaaaaaaaaaaagaaaagaugacagagccagacucuguc

SEQ ID NO: 142469 - RNA, 64 nt, Homo Sapiens
uuuguguauauuucugaugcugcaccccugcuggaaagaaaaggcagguggggaaaggggggcu

SEQ ID NO: 142470 - RNA, 64 nt, Homo Sapiens
caauuguucacaucccaucugaguuucuauuucuaaagaaaaaauuuaugaaugacuuucuaca

SEQ ID NO: 142471 - RNA, 64 nt, Homo Sapiens
aggaagauaccugcacuaaugggaggaaauauguaaagaaaaacagagccuguugugggaggua

SEQ ID NO: 142472 - RNA, 64 nt, Homo Sapiens
agaagccuuauuugugauuuuuaccucacacuaaaaagaaaacccuuaauauugaauauacugu

SEQ ID NO: 142473 - RNA, 64 nt, Homo Sapiens
agaccauuuaaaaacucagauccuacauaaugaaaaagaaaaacgaauuuuggugggcaucuaa

SEQ ID NO: 142474 - RNA, 64 nt, Homo Sapiens
aaauguuguuuaaaaaauguguucauacauuugaaaagaaaaaauuccuggcuaucuuaaacaa

SEQ ID NO: 142475 - RNA, 64 nt, Homo Sapiens
uagauuuuacauaucuuugccaaaaaaaaaaaaaaaagaaaaaugcuuagucuaaagacuguag

SEQ ID NO: 142476 - RNA, 64 nt, Homo Sapiens
aacacucccauccacucauaagcauuuuucauuuaaagaaaaguuuuccgauuaggcuuugguc

SEQ ID NO: 142477 - RNA, 64 nt, Homo Sapiens
aacaacuuaauauauuuuggcaaaaaauauugugaaagaaaaaagaaaaaagaggaaaaaaagg

SEQ ID NO: 142478 - RNA, 64 nt, Homo Sapiens
gaggaaaaaaaggcaaaaaauguuuacaaagcaaaaagaaaaaauacauuugguucaugugcau

SEQ ID NO: 142479 - RNA, 64 nt, Homo Sapiens
guuuuauuauccuuacuuuucucugucucaaaaaaaagaaaaaagccuggagagcagagcaaga

SEQ ID NO: 142480 - RNA, 64 nt, Homo Sapiens
uaaauugugacaguaauguuuauuaugguaauacaaagaaaaguuuguuuuuaaaggaaacauc

SEQ ID NO: 142481 - RNA, 64 nt, Homo Sapiens
gaaaaagaagaaucuugcugggaauugguuauuaaaagaaaaagaaauuucuauucaggcuacu

SEQ ID NO: 142482 - RNA, 64 nt, Homo Sapiens
uugaaaauuucuauucaggcaugcaguuuuaccaaaagaaaaauaucauaacuuuaauucaaga

SEQ ID NO: 142483 - RNA, 64 nt, Homo Sapiens
cagaaauauauccagcuaacaaaaaaagaaaaaaaaagaaaaaacugugacaaaaaaaaaaaaa

SEQ ID NO: 142484 - RNA, 64 nt, Homo Sapiens
aaagaaaaaacagaaauauaaaaaaaaaaaaaaaaaagaaaaaaaaacaguguucugugacaaa

SEQ ID NO: 142485 - RNA, 64 nt, Homo Sapiens
agagagagagaauauuggagaaaaaaaagaugacaaagaaaaacuugaaaauguuuauuuaaaa

SEQ ID NO: 142486 - RNA, 64 nt, Homo Sapiens
uuccacaaugaaagaauguaccaaucaaccaaacaaagaaaaaaacaggaacccaccaaaccaa

SEQ ID NO: 142487 - RNA, 64 nt, Homo Sapiens
aguacacauucagaaucugggagugcauuuugaaaaagaaaaaauaugaacuuugguucuucau

SEQ ID NO: 142488 - RNA, 64 nt, Homo Sapiens
ccucacuuuuccuuuauaguaguacguuaaagaaaaagaaaaaacaagaagcucaaagaaaaga

SEQ ID NO: 142489 - RNA, 64 nt, Homo Sapiens
aaaaaaccucacuuuuccuuaaaagaaguacguuaaagaaaaaguuugaccaagaagcucaaag

SEQ ID NO: 142490 - RNA, 64 nt, Homo Sapiens
aguacguuaaagaaaaagaaugaccaagaagcucaaagaaaagagcauguaccuugaaauuauu

SEQ ID NO: 142491 - RNA, 64 nt, Homo Sapiens
cucuguacaaaggagaaaaauguugcuccuagugaaagaaaaauccuuuuaaagauaguuuugc

SEQ ID NO: 142492 - RNA, 64 nt, Homo Sapiens
gcaacuuuuuuugccuuggugacuuuugaaaaaaaaagaaaagaaaaagcagcauccuuauauu

SEQ ID NO: 142493 - RNA, 64 nt, Homo Sapiens
uuuuuuugccuuggugacuuuugaaaaaaaaagaaaagaaaaagcagcauccuuauauuucuuu

SEQ ID NO: 142494 - RNA, 64 nt, Homo Sapiens
cuaauguauaaugugcagaaaauauuuaauaucaaaagaaaauugauauuuuuauacaaguaau

SEQ ID NO: 142495 - RNA, 64 nt, Homo Sapiens
gcuaaccauuuauauaaaacuuaaaaacaagagaaaagaaaaaucaauuagaucuaaacaguua

SEQ ID NO: 142496 - RNA, 64 nt, Homo Sapiens
agccagaacuuucuuucacgguuacuguuccugaaaagaaaaagccaccuagcccuaucaagcc

SEQ ID NO: 142497 - RNA, 64 nt, Homo Sapiens
uuaauuucaaaauuuaaagccaugcuaaaauuaaaaagaaaauauuaaauuacacaauuacacu

SEQ ID NO: 142498 - RNA, 64 nt, Homo Sapiens
uaaaaaugaaauauuucaaagacugaauauuuucaaagaaaaugaauaauucauugcccuugug

SEQ ID NO: 142499 - RNA, 64 nt, Homo Sapiens
guauuuccuucugcuucaaaagaacaaaauugggaaagaaaacucacuugagucuugaucaaac

SEQ ID NO: 142500 - RNA, 64 nt, Homo Sapiens
uuucaucuccugcuugucugacugcaaguuuuuuaaagaaaagaggaacuggagaaacgacuuc

SEQ ID NO: 142501 - RNA, 64 nt, Homo Sapiens
uuuggaaggcuuuccacaaacuaaccuuggaugaaaagaaaaaauuccucuguaaguacugugg

SEQ ID NO: 142502 - RNA, 64 nt, Homo Sapiens
agaaguauauuuuagaaauuuguuaaugagaguaaaagaaaauaaauguguauagcucaguuug

SEQ ID NO: 142503 - RNA, 64 nt, Homo Sapiens
auccaguaguaaaauauguaaccauugucccaguaaagaaaaauaacaaaaguuguaaaaugua

SEQ ID NO: 142504 - RNA, 64 nt, Homo Sapiens
agguuaaacaugguuagaaacaacugaaagcauaaaagaaaaaucuaggccgggugcaguggcu

SEQ ID NO: 142505 - RNA, 64 nt, Homo Sapiens
uguugugacaaccacaagcacuuuuuuuuuuuuuaaagaaaaaaagguagugaauuuuuaauca

SEQ ID NO: 142506 - RNA, 64 nt, Homo Sapiens
agaagauuuuuguccaugcuugauuuuuuuuuuuaaagaaaaacuuucauggguuagcauuacc

SEQ ID NO: 142507 - RNA, 64 nt, Homo Sapiens
auaaauggauacacauucaaaauacuuuuaaaaaaaagaaaauguuaccaguuuuuuuaucuga

SEQ ID NO: 142508 - RNA, 64 nt, Homo Sapiens
aauuugcaucccucguuuaaaugcaauuuuuuaaaaagaaaauuaaagagaauuuagaugagag

SEQ ID NO: 142509 - RNA, 64 nt, Homo Sapiens
gccuucuugacugugaagagugccagcuacacuaaaagaaaauguaaggaugaucagagacuuu

SEQ ID NO: 142510 - RNA, 64 nt, Homo Sapiens
gguacuuacccuucuacaaaaaaagaaaacaaccaaagaaaauuacuuugaacauuaauguuga

SEQ ID NO: 142511 - RNA, 64 nt, Homo Sapiens
accaaagaaaauugguacuuacauuaauguugaaaaagaaaacaccuggcuacaauuacuuuga

SEQ ID NO: 142512 - RNA, 64 nt, Homo Sapiens
uguaacagaguugagguugucaaaauugaccucaaaagaaaaugagaggacaaguguaauaaau

SEQ ID NO: 142513 - RNA, 64 nt, Homo Sapiens
gaagggguagggauuuggcucuugauauuccuacaaagaaaaaaaaauauuugcucaauaugau

SEQ ID NO: 142514 - RNA, 64 nt, Homo Sapiens
aacacaaaagcuauagauaucguaaauuauagaaaaagaaaagaguugaaucaacaaugugaua

SEQ ID NO: 142515 - RNA, 64 nt, Homo Sapiens
auguugcuaagauuguguugcaaagauuauuacaaaagaaaaauaauucauuggaagaaaucac

SEQ ID NO: 142516 - RNA, 64 nt, Homo Sapiens
caaaagcauuuaauguuuugucugugggaggaguaaagaaaaucuuuuuguauuugugaacuca

SEQ ID NO: 142517 - RNA, 64 nt, Homo Sapiens
uuugaaagauuuauaucuaaccucacagcucuucaaagaaaacccaucaaaucugaaauaguca

SEQ ID NO: 142518 - RNA, 64 nt, Homo Sapiens
auucuuucuuggauugguuuccacauggagggaaaaagaaaacauuccuuaagaaugaaaccga

SEQ ID NO: 142519 - RNA, 64 nt, Homo Sapiens
aaaaguuuuaagaggggucauauaucaaaccaaaaaagaaaaaaaaaagccagugccuauugag

SEQ ID NO: 142520 - RNA, 64 nt, Homo Sapiens
aagauuuugauaugaccaccaucugauagguacaaaagaaaaccgccaccaacaauuuagucau

SEQ ID NO: 142521 - RNA, 64 nt, Homo Sapiens
cauuuuauauuacuacucaacuuguaacaaugaaaaagaaaaagguuggcaaucaaagcaugca

SEQ ID NO: 142522 - RNA, 64 nt, Homo Sapiens
aagaacguugcaaauuuguuaaaaaaaaacagaaaaagaaaaaaaauuaggcagucuuaaaaaa

SEQ ID NO: 142523 - RNA, 64 nt, Homo Sapiens
aaauagauguagaguguuuugcauacauguauuuaaagaaaaaauugugaagcagcuauacgug

SEQ ID NO: 142524 - RNA, 64 nt, Homo Sapiens
aaaauaacaaaaacaacccuaaagcagaagcaaaaaagaaaaacguccucagaagccuauuuuu

SEQ ID NO: 142525 - RNA, 64 nt, Homo Sapiens
uuuaauuauauaaauagcaagucaauugaaauuuaaagaaaaguacaaaaugacucuuuuuccu

SEQ ID NO: 142526 - RNA, 64 nt, Homo Sapiens
uuauuuaauugauaugcuguugaaacuguauuguaaagaaaacagaaacaaauggaaaguccua

SEQ ID NO: 142527 - RNA, 64 nt, Homo Sapiens
gcaaauuauuuuuuuuuauucugcuaaaugaaagaaagaaaaaaaguggccaaacuuauuuaug

SEQ ID NO: 142528 - RNA, 64 nt, Homo Sapiens
aucccuuguucucaguggugaaaaaagaaaagaaaaagaaaaaacccuucccccugcaaaaaga

SEQ ID NO: 142529 - RNA, 64 nt, Homo Sapiens
aaaaaaaucccuuguucucaaaaagaaaaaaagaaaagaaaaagucccugcccuucccccugca

SEQ ID NO: 142530 - RNA, 64 nt, Homo Sapiens
aaaagaaaaaaaucccuugucugcaaaaagaaaaaaagaaaagauauacucccugcccuucccc

SEQ ID NO: 142531 - RNA, 64 nt, Homo Sapiens
agaaaagaaaaagaaaaaaaccuucccccugcaaaaagaaaaaaguagacgauauacucccugc

SEQ ID NO: 142532 - RNA, 64 nt, Homo Sapiens
aguaaaauauuuugcuuguaacucuggcaauuuaaaagaaaaucuuaaccaguucacuuauugu

SEQ ID NO: 142533 - RNA, 64 nt, Homo Sapiens
aaauguuguauuaaauagaugucuucaaucguggaaagaaaauuccuaaaggacaggagaaaag

SEQ ID NO: 142534 - RNA, 64 nt, Homo Sapiens
aaaguuugcacuaauugaggcccccaaaaaauagaaagaaaaaacaagaccccauccuccaccc

SEQ ID NO: 142535 - RNA, 64 nt, Homo Sapiens
gugcuggguggagaauggaguggcauagaauuccaaagaaaauggcucaacaacagucuuugag

SEQ ID NO: 142536 - RNA, 64 nt, Homo Sapiens
cuaaagcugguuuaauguuuuggccaaugcaccuaaagaaaaacaaacucguuuuuuacaaagc

SEQ ID NO: 142537 - RNA, 64 nt, Homo Sapiens
caacuuaccaggcaccaaaagaaguaaaagcaaaaaagaaaaccuuucuucaccaaaucuuggu

SEQ ID NO: 142538 - RNA, 64 nt, Homo Sapiens
aaccccgcaaacaagaauuaagaugaucccaauaaaagaaaaauugcucaggaaacugaaccuu

SEQ ID NO: 142539 - RNA, 64 nt, Homo Sapiens
gacaguuggagccaaugccucauaguguaaacugaaagaaaaauaguugcuuuuuaaaauguca

SEQ ID NO: 142540 - RNA, 64 nt, Homo Sapiens
agauaacgcaggagagagagagagaaagaaugagaaagaaaaggaaugcaagagaaggagaugu

SEQ ID NO: 142541 - RNA, 64 nt, Homo Sapiens
uuuuuaacaaauguuuucauuuacaggaaauugcaaagaaaauucucaagugauagucuuuuuu

SEQ ID NO: 142542 - RNA, 59 nt, Homo Sapiens
ugucaaagccagacuucuaaggaguagugaaagaaaacccugaaauaaucgaacaggaa

SEQ ID NO: 142543 - RNA, 64 nt, Homo Sapiens
uaaugauuuauacaaugacuccaaaggcaaucccaaagaaaagauguaaagaauguuuugagca

SEQ ID NO: 142544 - RNA, 64 nt, Homo Sapiens
cagcuugggcaacagagcaagacuccaucucaaaaaagaaaaaagaaaagaaauagaauuauca

SEQ ID NO: 142545 - RNA, 64 nt, Homo Sapiens
ggcaacagagcaagacuccaucucaaaaaagaaaaaagaaaagaaauagaauuaucaagcuuuu

SEQ ID NO: 142546 - RNA, 64 nt, Homo Sapiens
aggcaauguagugagacccugucucuaauuuaaaaaagaaaaagaaaaaaacauucccaguggc

SEQ ID NO: 142547 - RNA, 64 nt, Homo Sapiens
uguagugagacccugucucuaauuuaaaaaagaaaaagaaaaaaacauucccaguggcagccug

SEQ ID NO: 142548 - RNA, 64 nt, Homo Sapiens
aaagcuugcuguacaaaggcaacagcaacuuaaaaaagaaaaucuggacaauagauguggacuc

SEQ ID NO: 142549 - RNA, 64 nt, Homo Sapiens
uuugauaugacugaauugcaaucuauauuuuuaaaaagaaaaaucaaaauacauuaggguuuac

SEQ ID NO: 142550 - RNA, 64 nt, Homo Sapiens
gacucuugugaaguuuucuuaaauuguucacuuuaaagaaaaugacguaccaacaaugauuugg

SEQ ID NO: 142551 - RNA, 64 nt, Homo Sapiens
augugaaacugcugucuuuuauauuaaaguaauuaaagaaaauguauugugauugaaauuauuu

SEQ ID NO: 142552 - RNA, 64 nt, Homo Sapiens
guugaauuguucuuaaggcaucauaucuagaagcaaagaaaaaagaaaaauaacaauuuaaguu

SEQ ID NO: 142553 - RNA, 64 nt, Homo Sapiens
uguucuuaaggcaucauaucuagaagcaaagaaaaaagaaaaauaacaauuuaaguuguguaaa

SEQ ID NO: 142554 - RNA, 64 nt, Homo Sapiens
guuacuuauauuaauaauauucagaaaaaaaaaaaaagaaaaggaaaaagaaaaauauauauuc

SEQ ID NO: 142555 - RNA, 64 nt, Homo Sapiens
acucugucucagaaaaaaaaaaaaagaaaaggaaaaagaaaaauauauauucuauauuuuuuua

SEQ ID NO: 142556 - RNA, 64 nt, Homo Sapiens
aaacuuaagaugugcaaggagauuuaaugauuucaaagaaaauaaugguucuuuguuuuuaaug

SEQ ID NO: 142557 - RNA, 64 nt, Homo Sapiens
uguggauucaaguuacugaagugaauaccaauaaaaagaaaacccuaggccauguuaauugguu

SEQ ID NO: 142558 - RNA, 64 nt, Homo Sapiens
uugucguuuuaacaucuccacgucccuagcauaaaaagaaaaagaaaaaaauuuaaacugcuuu

SEQ ID NO: 142559 - RNA, 64 nt, Homo Sapiens
uuuuaacaucuccacgucccuagcauaaaaagaaaaagaaaaaaauuuaaacugcuuuuucgga

SEQ ID NO: 142560 - RNA, 64 nt, Homo Sapiens
gagucacaggacccugcccaccugaguucccaauaaagaaaaaccuccccuucugaggcugcuu

SEQ ID NO: 142561 - RNA, 64 nt, Homo Sapiens
gagcaggcuuuuggaagaaccuguuugaugcaaaaaagaaaaugaaaaacaaaacaaaaaaucc

SEQ ID NO: 142562 - RNA, 64 nt, Homo Sapiens
augaguggaauuuacauuuuagauacuauaggggaaagaaaagucucaaaaagaaguauugcau

SEQ ID NO: 142563 - RNA, 64 nt, Homo Sapiens
gaauaagaaauagccaacuaguuaaaauguaugaaaagaaaacuuuccccugcuguauuuguug

SEQ ID NO: 142564 - RNA, 64 nt, Homo Sapiens
auaagcccagcauuaccugauaccaaaaccaggcaaagaaaacagaagaagaggaaggaaaacu

SEQ ID NO: 142565 - RNA, 64 nt, Homo Sapiens
caaccaguguaauucagcacauuaauaaaguaaaaaagaaaaccauaugaucauuucaacgaug

SEQ ID NO: 142566 - RNA, 64 nt, Homo Sapiens
uaguagggggacuaaggaacccuucggaucuaugaaagaaaauaaacguguucuuacaaaugaa

SEQ ID NO: 142567 - RNA, 64 nt, Homo Sapiens
cuugaacauuuaugaugucauucucucucccugcaaagaaaaauguuuggauagacuccaugcc

SEQ ID NO: 142568 - RNA, 64 nt, Homo Sapiens
acagcaggaugcuaauggaaaaagacuaacuugaaaagaaaaccuaguuaaaaaaaaauucccu

SEQ ID NO: 142569 - RNA, 64 nt, Homo Sapiens
uuccacauaggaaaaugccaauagaaagaugacaaaagaaaauuaauugucaaaauuguuuacc

SEQ ID NO: 142570 - RNA, 64 nt, Homo Sapiens
uccauuuaucaucuguuacaaaauaugauauaauaaagaaaaacuuucagcuuccuugauuuag

SEQ ID NO: 142571 - RNA, 64 nt, Homo Sapiens
gugugcuguccaaauuuuuugcaccuuuggaaugaaagaaaaguauggaucuguguucugacug

SEQ ID NO: 142572 - RNA, 64 nt, Homo Sapiens
cuugcugcuuuuuguccaggaugcacugaauucaaaagaaaaauacucaagcacuucuagaauc

SEQ ID NO: 142573 - RNA, 64 nt, Homo Sapiens
uaguaauuauuugauggauacugauuuuuuuuaaaaagaaaacuuaauugugugcccauaaaca

SEQ ID NO: 142574 - RNA, 64 nt, Homo Sapiens
uugguaaugcgaauguauagaagggauguuuugaaaagaaaaaauagaaaguagcacuugaugc

SEQ ID NO: 142575 - RNA, 64 nt, Homo Sapiens
cugagaaaugaaacuugguagcauaauaaauuuaaaagaaaaggaaugaaaaaagaaaagaaaa

SEQ ID NO: 142576 - RNA, 64 nt, Homo Sapiens
auaauaaauuuaaaagaaaauaaaugaaaaaagaaaagaaaagccaaagucucaauccuuauuu

SEQ ID NO: 142577 - RNA, 64 nt, Homo Sapiens
aaagcauaauaaauuuaaaauauuuuaaaugaaaaaagaaaagaggggacaaagucucaauccu

SEQ ID NO: 142578 - RNA, 64 nt, Homo Sapiens
ugaugauuagauuagguuaguugccuucuuuuaaaaagaaaaaccauggauaaaaacuaagcgc

SEQ ID NO: 142579 - RNA, 64 nt, Homo Sapiens
ccgacagcuguaaaauguucaucucuaaaccauaaaagaaaacaugagauugaaauuuuuuaug

SEQ ID NO: 142580 - RNA, 64 nt, Homo Sapiens
gagguuuuaggauuuucaugauuuuaaaaaagaaaaagaaaauuuugaauaagaguuggcuuaa

SEQ ID NO: 142581 - RNA, 64 nt, Homo Sapiens
aaaauugagguuuuaggauugcuuaaauuuuaaaaaagaaaaaggaaaaguugaauaagaguug

SEQ ID NO: 142582 - RNA, 64 nt, Homo Sapiens
uuucuucuuugucuguuaagauagcagcugucccaaagaaaauaggaccuugguuuucuucuag

SEQ ID NO: 142583 - RNA, 64 nt, Homo Sapiens
aaaggcauucuaguaaaucggaccccaucucaaaaaagaaaaaaccugcugagcaacagaguga

SEQ ID NO: 142584 - RNA, 55 nt, Homo Sapiens
aacuugcuacuacaugaaauaccacaaagaaaaucagucucaggcguggggauga

SEQ ID NO: 142585 - RNA, 64 nt, Homo Sapiens
aaggaaaaggcucuuuauuagaaaaaaagggaaaaaagaaaagcuaagaaaagaaaaaagaaaa

SEQ ID NO: 142586 - RNA, 64 nt, Homo Sapiens
agggaaaaaagaaaagcaaggaaaagaaaaaagaaaagaaaaaacgacuuaauguauguuguaa

SEQ ID NO: 142587 - RNA, 64 nt, Homo Sapiens
aaaaaagggaaaaaagaaaauguaagaaaagaaaaaagaaaagaauucacgacuuaauguaugu

SEQ ID NO: 142588 - RNA, 64 nt, Homo Sapiens
gaaaagaaaaaaagggaaaauguauguuguaagaaaagaaaaaaacaucugauucacgacuuaa

SEQ ID NO: 142589 - RNA, 64 nt, Homo Sapiens
uuguuguuuuaauggaauguacuuccaacuagacaaagaaaaaagcuguguauguauucaagag

SEQ ID NO: 142590 - RNA, 64 nt, Homo Sapiens
acuuguuuauucaguuauuaaucauugauuaaaaaaagaaaaccacuauuuucaucauaauuuc

SEQ ID NO: 142591 - RNA, 64 nt, Homo Sapiens
auuguuacuaucuccuuugacacuuuagaucaucaaagaaaaccaucacgacauuguaaaaucu

SEQ ID NO: 142592 - RNA, 64 nt, Homo Sapiens
acaaaaaauacaccacacugguagauguugugaaaaagaaaaaaaagugcuucucuuguguccu

SEQ ID NO: 142593 - RNA, 64 nt, Homo Sapiens
acuaaauccugcccuuuuuguguaguuggggaauaaagaaaagcggaaaaccugguagugaaug

SEQ ID NO: 142594 - RNA, 64 nt, Homo Sapiens
cuauaaaagugcacauacgcugacugaaaauuugaaagaaaagcguugccuuuuucuuacagaa

SEQ ID NO: 142595 - RNA, 64 nt, Homo Sapiens
guucaucacgugacuguuaaguuuagcugacauuaaagaaaaaaugaacaaaacuguguuuuga

SEQ ID NO: 142596 - RNA, 64 nt, Homo Sapiens
auggugagucccggcccucucaaaagguuuaggaaaagaaaacaacacaucaaacaggccuaua

SEQ ID NO: 142597 - RNA, 64 nt, Homo Sapiens
aaaagccucucuguccuaugaaugccaaaaagaaaaagaaaaaaaagauugaccaaaccaucca

SEQ ID NO: 142598 - RNA, 64 nt, Homo Sapiens
aaaaaaaaaagccucucugucauccaaaugccaaaaagaaaaaggaagagaagauugaccaaac

SEQ ID NO: 142599 - RNA, 64 nt, Homo Sapiens
gaaagcauuguuuuaauugaucucaaaaaaaagaaaagaaaaaaggugacagagcaagacuccg

SEQ ID NO: 142600 - RNA, 64 nt, Homo Sapiens
aaaaagaaagcauuguuuuacuccgucucaaaaaaaagaaaagagcccgggugacagagcaaga

SEQ ID NO: 142601 - RNA, 64 nt, Homo Sapiens
aaauugcaguauuuaaagcuuaagcuuucaggaaaaagaaaauaagaauucagugugugcauga

SEQ ID NO: 142602 - RNA, 64 nt, Homo Sapiens
aucaguuuagcuuuguguuguaugcuaguuuaaaaaagaaaauauguaauauaauguaaaaaaa

SEQ ID NO: 142603 - RNA, 64 nt, Homo Sapiens
cagacgaagaguuuaaagagaaaagggaaaaaagaaagaaaaaguaagcagggcuggcuucgcc

SEQ ID NO: 142604 - RNA, 64 nt, Homo Sapiens
agucaguggagggcgagugguuucggaaaaaaaaaaagaaaaaaagaaaaaaaaagaaaaaaaa

SEQ ID NO: 142605 - RNA, 64 nt, Homo Sapiens
gagggcgagugguuucggaaaaaaaaaaagaaaaaaagaaaaaaaaagaaaaaaaaaagauuuu

SEQ ID NO: 142606 - RNA, 64 nt, Homo Sapiens
gguuucggaaaaaaaaaaagaaaaaaagaaaaaaaaagaaaaaaaaaagauuuuuuucuucucu

SEQ ID NO: 142607 - RNA, 64 nt, Homo Sapiens
uucaaggccacaaaaacaauguuugggggaaaaaaaagaaaaaaucaugccagcuaaucauguc

SEQ ID NO: 142608 - RNA, 64 nt, Homo Sapiens
ggacagaaacaagguuuuaaagcauugccaaaaaaaagaaaacagaaagaaaaaauguaucauc

SEQ ID NO: 142609 - RNA, 64 nt, Homo Sapiens
agguuuuaaagcauugccaaaaaaaagaaaacagaaagaaaaaauguaucaucuaaaggacuag

SEQ ID NO: 142610 - RNA, 64 nt, Homo Sapiens
aauuuuuaaaaauagcuuucguuuugaguucuggaaagaaaacugucaaaaucaguauauacua

SEQ ID NO: 142611 - RNA, 64 nt, Homo Sapiens
uuguguguauauuugggauaucuauugaagaaaaaaagaaaaccccuuaaagauaauguacaug

SEQ ID NO: 142612 - RNA, 64 nt, Homo Sapiens
augucuuuaaaucagauaccaaauauuuuuuaggaaagaaaaauguuauuacugucauuagguu

SEQ ID NO: 142613 - RNA, 64 nt, Homo Sapiens
caguguuucugggggagguuauggagggaagaaaaaagaaaaaucgauagugagugacugauug

SEQ ID NO: 142614 - RNA, 64 nt, Homo Sapiens
uaaauaccauuaaacugugaucaguuaaaauuuaaaagaaaaaucagcacaaaagggcgcuaaa

SEQ ID NO: 142615 - RNA, 64 nt, Homo Sapiens
guggaguaucccauucugaugaguacagaaaaaaaaagaaaaagaaaagaagagaaaaaauuaa

SEQ ID NO: 142616 - RNA, 64 nt, Homo Sapiens
uaucccauucugaugaguacagaaaaaaaaagaaaaagaaaagaagagaaaaaauuaagaaaaa

SEQ ID NO: 142617 - RNA, 64 nt, Homo Sapiens
cgcaagcccggggagagauuuauaaaaguaaacaaaagaaaaccuuccagcaacaaauuaaaaa

SEQ ID NO: 142618 - RNA, 64 nt, Homo Sapiens
uuaaccguccuuccccuagcaaauuuaaaaacagaaagaaaauguuguaccaguuaccauuccg

SEQ ID NO: 142619 - RNA, 64 nt, Homo Sapiens
gccaaaugucacuaaaggguuuaguuuuaaggagaaagaaaaggaaaaaaaaaaaaaacaaaaa

SEQ ID NO: 142620 - RNA, 64 nt, Homo Sapiens
aaugguguaaaggcugucuuuuuuuuuuuuuuuuaaagaaaaguuauuaccauguauuuuguga

SEQ ID NO: 142621 - RNA, 64 nt, Homo Sapiens
acuacaagucuugaguuaagaaggaaagaggaaaaaagaaaaaacaccaauacccagauuuaaa

SEQ ID NO: 142622 - RNA, 64 nt, Homo Sapiens
aaaaguaaaauacuucugacuguuaaaacuauauaaagaaaaucucauuugucuaauugcaauu

SEQ ID NO: 142623 - RNA, 64 nt, Homo Sapiens
uauaaagaaaaucucauuugucuaauugcaauuaaaagaaaaauguuaaaauauuaaaaugaaa

SEQ ID NO: 142624 - RNA, 64 nt, Homo Sapiens
ccaacuguuuagcugaaguucauauuauuuaaguaaagaaaauauuucaguuuuauaacagacu

SEQ ID NO: 142625 - RNA, 64 nt, Homo Sapiens
cuggggaguucuugaguuccucauuuguugguaaaaagaaaaagaaugugaaaaugucucuuuu

SEQ ID NO: 142626 - RNA, 64 nt, Homo Sapiens
uucuguucuuguuuauccagcguaggaagaaggaaaagaaaaucuuugcuccucugccccauuc

SEQ ID NO: 142627 - RNA, 64 nt, Homo Sapiens
uguauugcauuuuugggggaagcaaauugacuuuaaagaaaaaaguuguggcaaaagaugcuaa

SEQ ID NO: 142628 - RNA, 64 nt, Homo Sapiens
uauuuuuucauuagggccauaucuccaaaaaaagaaagaaaaaauacaaaaaacaaaaacaaaa

SEQ ID NO: 142629 - RNA, 64 nt, Homo Sapiens
uguauuucaagauaauguaguuuaaaaaaaaaaaaaagaaaaaaacuugauguaaauuccuccu

SEQ ID NO: 142630 - RNA, 64 nt, Homo Sapiens
gaaaugauuuagauuaaacaugccagcucuuuuuaaagaaaauauuuuuccuuucauuuuuaga

SEQ ID NO: 142631 - RNA, 64 nt, Homo Sapiens
acugcaacagacucauugaaaucuccuagagucaaaagaaaaccauagaucacaaaacugggac

SEQ ID NO: 142632 - RNA, 64 nt, Homo Sapiens
auuuuccccacaagagaaauuuuaagugugcuuuaaagaaaaauggaaguaaaugcaaauuacu

SEQ ID NO: 142633 - RNA, 64 nt, Homo Sapiens
uaagagauuauugaguucuugaaauaagucuucaaaagaaaacacaccgaaauaguuaauauuu

SEQ ID NO: 142634 - RNA, 64 nt, Homo Sapiens
aaaacuccugaaauccuagauaaugcucuaguugaaagaaaaggaaagcuaauggaaauaaagc

SEQ ID NO: 142635 - RNA, 64 nt, Homo Sapiens
uaaguuuggaaguacuaaaauucauuguacauucaaagaaaaugaaacauuuuagacaaaaagu

SEQ ID NO: 142636 - RNA, 64 nt, Homo Sapiens
gcgaugcccagucaaucacaaaaaaagaauaaagaaagaaaagugagacuccaacucaaaaaaa

SEQ ID NO: 142637 - RNA, 64 nt, Homo Sapiens
gcgaagcggccgggcacggugcaugcaaccugcaaaagaaaaaugcacagaggaauauuggcug

SEQ ID NO: 142638 - RNA, 64 nt, Homo Sapiens
aagauuuggagucauuguggaauagcguuuuaaaaaagaaaaacgaacaguuuagucccaagag

SEQ ID NO: 142639 - RNA, 64 nt, Homo Sapiens
uguggaaaagagucuuagaggaguuuguucauauaaagaaaagcgaugcauuuuacauaauuau

SEQ ID NO: 142640 - RNA, 64 nt, Homo Sapiens
auaguuggaaaauaagacaucuaaagguaaaagaaaagaaaaaaaaaugaugcuguuuucucug

SEQ ID NO: 142641 - RNA, 64 nt, Homo Sapiens
aaaaaauaguuggaaaauaacucugcuaaagguaaaagaaaagacucuaaaaugaugcuguuuu

SEQ ID NO: 142642 - RNA, 64 nt, Homo Sapiens
aaacuagacaccaaguaauacacaggaagcuaucaaagaaaaguccuucaggaagauccuuuuc

SEQ ID NO: 142643 - RNA, 64 nt, Homo Sapiens
auuuucaaauugcagacuucccaugaccugagguaaagaaaauagaaauucacuucauuguacc

SEQ ID NO: 142644 - RNA, 64 nt, Homo Sapiens
aaagugauugaugauaguucuguuauuaagagcaaaagaaaaauaagagugagaaagaauaaau

SEQ ID NO: 142645 - RNA, 64 nt, Homo Sapiens
acacauuuuauaauagaauaucaaaacuaaccuaaaagaaaauguaguaggggcuuauugucuc

SEQ ID NO: 142646 - RNA, 64 nt, Homo Sapiens
acugcaccauguuaguaauaaacagaucugccuuaaagaaaagaaaauuuuagaaagaaauauu

SEQ ID NO: 142647 - RNA, 64 nt, Homo Sapiens
accauguuaguaauaaacagaucugccuuaaagaaaagaaaauuuuagaaagaaauauuguugc

SEQ ID NO: 142648 - RNA, 64 nt, Homo Sapiens
uuuagcauugcaugugaauaagaaaauaauguuuaaagaaaaaaaaaaaaaagcaaaccuccaa

SEQ ID NO: 142649 - RNA, 64 nt, Homo Sapiens
gaaaauagacuaacuacuggagaaacaaagagagaaagaaaacccaguguuuccauaggggcac

SEQ ID NO: 142650 - RNA, 64 nt, Homo Sapiens
cucacuauaguauaagaaucuauuuuggagaaaaaaagaaaauaugagggucucgaagcaugau

SEQ ID NO: 142651 - RNA, 64 nt, Homo Sapiens
agaaucaaaacaaaagcaaaaaaaaaaagcaaaaaaagaaaagagaaaaaaagaaaaaaugcaa

SEQ ID NO: 142652 - RNA, 64 nt, Homo Sapiens
gcaaaaaaaaaaagcaaaaaaagaaaagagaaaaaaagaaaaaaugcaaauggaauaauuuucu

SEQ ID NO: 142653 - RNA, 64 nt, Homo Sapiens
cacacaccacuuaauggggaaauaguuaauuguuaaagaaaacuucuuguagccucacauuccc

SEQ ID NO: 142654 - RNA, 64 nt, Homo Sapiens
uguauuuuucuuuuucuauaauaccuuuaacugcaaagaaaaggcaguuucaaauauaagaaau

SEQ ID NO: 142655 - RNA, 64 nt, Homo Sapiens
uccagccugggugauagagcaagacugucucaaaaaagaaaaaaaagaaaaaauuuuaauuuaa

SEQ ID NO: 142656 - RNA, 64 nt, Homo Sapiens
ggugauagagcaagacugucucaaaaaagaaaaaaaagaaaaaauuuuaauuuaauccuucugu

SEQ ID NO: 142657 - RNA, 64 nt, Homo Sapiens
ugaaauuguaaaaccugucaaugauacagucccuaaagaaaaaaaaucauugcuuugaagcagu

SEQ ID NO: 142658 - RNA, 64 nt, Homo Sapiens
guaugauguguugugauagcuaacauuuuaaauaaaagaaaaaauaucuugaagauuuuuguca

SEQ ID NO: 142659 - RNA, 64 nt, Homo Sapiens
cuggcaacagagcaagagucugucucaaaaaaaaaaagaaaaaaagaaaaaaagaaaaaagaaa

SEQ ID NO: 142660 - RNA, 64 nt, Homo Sapiens
agagcaagagucugucucaaaaaaaaaaagaaaaaaagaaaaaaagaaaaaagaaaaaucucau

SEQ ID NO: 142661 - RNA, 64 nt, Homo Sapiens
agucugucucaaaaaaaaaaagaaaaaaagaaaaaaagaaaaaagaaaaaucucauuauuucaa

SEQ ID NO: 142662 - RNA, 64 nt, Homo Sapiens
cucaaaaaaaaaaagaaaaaaagaaaaaaagaaaaaagaaaaaucucauuauuucaaaaugaua

SEQ ID NO: 142663 - RNA, 64 nt, Homo Sapiens
cugggccacagugcaagacuccaucucaaaaaaaaaagaaaagaaaaagccuguuuaaugcaca

SEQ ID NO: 142664 - RNA, 64 nt, Homo Sapiens
ccacagugcaagacuccaucucaaaaaaaaaagaaaagaaaaagccuguuuaaugcacaggugu

SEQ ID NO: 142665 - RNA, 64 nt, Homo Sapiens
uaagaaagaaaggaaagaaggagaugaauagaagaaagaaaauggaaagaaggaaaaaaggagg

SEQ ID NO: 142666 - RNA, 64 nt, Homo Sapiens
uuaauaguacaucauguaagauggcaacuguauuaaagaaaaauccggaaaacaaauguuugau

SEQ ID NO: 142667 - RNA, 64 nt, Homo Sapiens
cuuaaaacuggagugacaggagacauaagaaaggaaagaaaagaaaaacuugaauauagguggg

SEQ ID NO: 142668 - RNA, 64 nt, Homo Sapiens
ugaugaaguugcaaauggcaaguacagccgcaagaaagaaaaaacacacauuuaauuccuauua

SEQ ID NO: 142669 - RNA, 64 nt, Homo Sapiens
acuauaaauacaaaucuguacuguagaugcagaaaaagaaaaaacaugcauaaaagggucaaac

SEQ ID NO: 142670 - RNA, 64 nt, Homo Sapiens
aaagaauuaccaagagaagguaucccagcuuuaaaaagaaaaaauuuuuccuuccucuguaaga

SEQ ID NO: 142671 - RNA, 64 nt, Homo Sapiens
augacuaauacgaccuauuaugcagcagguggucaaagaaaagcauugacaauuaagugcuucu

SEQ ID NO: 142672 - RNA, 64 nt, Homo Sapiens
aauuaaaugcaugcuuuaaauucagcaacccuuuaaagaaaaagaccuuuuuucaggggaagca

SEQ ID NO: 142673 - RNA, 64 nt, Homo Sapiens
auucuguuuccugcaguggguaauaauaaaaaaaaaagaaaaucaaaaugcuauuggcagggaa

SEQ ID NO: 142674 - RNA, 64 nt, Homo Sapiens
aagaacucuugacuauuuagucagccaaggagggaaagaaaaggcccacagaguagugaaucuc

SEQ ID NO: 142675 - RNA, 64 nt, Homo Sapiens
cuacuuauagaaaaggagaauccuauuuggacauaaagaaaaucaaauuauccuaguuaccaag

SEQ ID NO: 142676 - RNA, 64 nt, Homo Sapiens
aaucauagggccaaguucaacaaaaaagaaaagaaaagaaaagaacaagagcaaaacuccgucu

SEQ ID NO: 142677 - RNA, 64 nt, Homo Sapiens
aaagaaaucauagggccaagcgucucaaaaaagaaaagaaaagagggcaacaagagcaaaacuc

SEQ ID NO: 142678 - RNA, 64 nt, Homo Sapiens
aaagaaaagaaaucauagggaacuccgucucaaaaaagaaaagaagccugggcaacaagagcaa

SEQ ID NO: 142679 - RNA, 64 nt, Homo Sapiens
uuuuuucaaaaaugcuguuacucugcugaauguaaaagaaaauugaaauucuucaugaacauaa

SEQ ID NO: 142680 - RNA, 64 nt, Homo Sapiens
caaaguagaaacuacuaauuugugaaaucaucaaaaagaaaaauuauuagacuucuaaauaagg

SEQ ID NO: 142681 - RNA, 64 nt, Homo Sapiens
auaguuaaugguuucaaauacuuaaaauaaugaaaaagaaaagugacuauuuuaucaaauuugc

SEQ ID NO: 142682 - RNA, 64 nt, Homo Sapiens
cugugagaaaacccugugauuucuacauaucuugaaagaaaagucauugcucguuucucaugca

SEQ ID NO: 142683 - RNA, 64 nt, Homo Sapiens
auuccuuaccuauaaaaacauuucuacuuaauuuaaagaaaagauagagcuguagccacguagu

SEQ ID NO: 142684 - RNA, 64 nt, Homo Sapiens
ccgggugaggugguguguacaaaaaaaaaagaaaaaagaaaaaggaccucccgucucucucgga

SEQ ID NO: 142685 - RNA, 64 nt, Homo Sapiens
gaaaaagccgggugagguggucucggaaaaaaaaaaagaaaaaaacauggugaccucccgucuc

SEQ ID NO: 142686 - RNA, 64 nt, Homo Sapiens
uuguccauguaaagcuuaaaaaaaucauuuuuucaaagaaaaauuuauuaaugggccaaugcaa

SEQ ID NO: 142687 - RNA, 64 nt, Homo Sapiens
cuaaacauuuaaacaaaaauuaaaaucaaaucaaaaagaaaaaaaaacagaaaaauaaaugauu

SEQ ID NO: 142688 - RNA, 64 nt, Homo Sapiens
aaggaagacuaaacagaaacuuuaaguaaagaaaaaagaaaaaauuucuaaaaggaaaaauaau

SEQ ID NO: 142689 - RNA, 64 nt, Homo Sapiens
gaaaaaaaaggaagacuaaaaaauaauuuuaaguaaagaaaaaaggugaacuuucuaaaaggaa

SEQ ID NO: 142690 - RNA, 64 nt, Homo Sapiens
gaaaccugguuauaaccugagaaaagacaggagaaaagaaaacacuggacguuugugcaguauu

SEQ ID NO: 142691 - RNA, 64 nt, Homo Sapiens
guauucacagauuuaauaccaauugaaauguuuuaaagaaaaaauuggcuuuagauuuaaagua

SEQ ID NO: 142692 - RNA, 64 nt, Homo Sapiens
aaaauuaaauuaaaaaaaaaucacagaaaaagaaaaagaaaauauuucaauacaagccauaggc

SEQ ID NO: 142693 - RNA, 64 nt, Homo Sapiens
aaaauaaaaauuaaauuaaaauaggcucacagaaaaagaaaaagcuaaaguuucaauacaagcc

SEQ ID NO: 142694 - RNA, 64 nt, Homo Sapiens
acuaggaccaccaggagcacucuggaccacaggcaaagaaaaccgcugccaguauccagcagua

SEQ ID NO: 142695 - RNA, 64 nt, Homo Sapiens
auuaagacauaaaauucuuucuuuuuuuuuuuuuaaagaaaagcauguccuaguucaauguuga

SEQ ID NO: 142696 - RNA, 64 nt, Homo Sapiens
uuuguaguagcguuuuuuaacaaaaacaaaaagaaaagaaaauuauagcuaaguacacaauaag

SEQ ID NO: 142697 - RNA, 64 nt, Homo Sapiens
aaauuuuuguaguagcguuuauaagcaaaaacaaaaagaaaagauaucuauagcuaaguacaca

SEQ ID NO: 142698 - RNA, 64 nt, Homo Sapiens
ugucucagaucccagauucuaugaucccugcuuaaaagaaaauguucacugcauguagguugau

SEQ ID NO: 142699 - RNA, 64 nt, Homo Sapiens
cagaagauaagccauguuucuguauuguacauguaaagaaaaauaaaacuguuuaugauacuug

SEQ ID NO: 142700 - RNA, 64 nt, Homo Sapiens
aaaauauaauuaccuguaagguuaucugguuuuaaaagaaaaaaaaaaagccuacaaacucagu

SEQ ID NO: 142701 - RNA, 64 nt, Homo Sapiens
ggcaacaagagugaaacuccaucuccaaaaaaaaaaagaaaaaguaacaaaaggaaauuauuug

SEQ ID NO: 142702 - RNA, 64 nt, Homo Sapiens
guucaacuuuguggauuauuuuuccucugaaggaaaagaaaaggcuuaaugguuaggauuuuua

SEQ ID NO: 142703 - RNA, 64 nt, Homo Sapiens
cuaguuuugaauuuacaccaagaacuucucaauaaaagaaaaucaugaaugcuccacaauuuca

SEQ ID NO: 142704 - RNA, 64 nt, Homo Sapiens
auguuuucuuuaaguguuuaugguaaacucuuuuaaagaaaauuuaauauguuauagcugaauc

SEQ ID NO: 142705 - RNA, 64 nt, Homo Sapiens
gcaugacauacuuuugcuuucaguaguuucauguaaagaaaaaaacuugaaaauaguaauaccu

SEQ ID NO: 142706 - RNA, 64 nt, Homo Sapiens
aaucuaaaauaaaaaucgaaauaauuuuuuuaaaaaagaaaaagacaauaguauuacccauggg

SEQ ID NO: 142707 - RNA, 64 nt, Homo Sapiens
ggaaugcauuuguuuccaugagugaaaagaggaaaaagaaaauggcugugcugcauugcaggaa

SEQ ID NO: 142708 - RNA, 64 nt, Homo Sapiens
auuuaugagaauuuuggacaauuggaaagguagaaaagaaaagccaagaucauacuaaggacug

SEQ ID NO: 142709 - RNA, 64 nt, Homo Sapiens
auaggaaacauuuuaguaugagcuucagugucacaaagaaaaccagaucucucucucuuuuuuu

SEQ ID NO: 142710 - RNA, 64 nt, Homo Sapiens
ucauauuuuaauuuaaauuggauucaaccacaauaaagaaaaugagaaaagcuuucaacugugu

SEQ ID NO: 142711 - RNA, 64 nt, Homo Sapiens
uuagguauaaaaccuacugcaacuuagaaaaaggaaagaaaaaagaaaacuuuuccaacugcug

SEQ ID NO: 142712 - RNA, 64 nt, Homo Sapiens
uaaaaccuacugcaacuuagaaaaaggaaagaaaaaagaaaacuuuuccaacugcugcauuaag

SEQ ID NO: 142713 - RNA, 64 nt, Homo Sapiens
gaugacacaucauuuugacauuaucaauaggagaaaagaaaacuaacccuucuucugauuguuu

SEQ ID NO: 142714 - RNA, 64 nt, Homo Sapiens
ucauuuaagugcuguuuguucuuaaaaugcauuuaaagaaaaauuacccauauugacuuucaca

SEQ ID NO: 142715 - RNA, 64 nt, Homo Sapiens
aggaauaauauugugaaaaugaaucuguuaugauaaagaaaaaauaaaguggaaacuuuuagag

SEQ ID NO: 142716 - RNA, 64 nt, Homo Sapiens
uaguagaaaaggaaacuaguagggccaaaaaaaaaaagaaaaagaaaaagaaaaaagaaaaaaa

SEQ ID NO: 142717 - RNA, 64 nt, Homo Sapiens
aaaaggaaacuaguagggccaaaaaaaaaaagaaaaagaaaaagaaaaaagaaaaaaaaagaaa

SEQ ID NO: 142718 - RNA, 64 nt, Homo Sapiens
aaacuaguagggccaaaaaaaaaaagaaaaagaaaaagaaaaaagaaaaaaaaagaaaaaacug

SEQ ID NO: 142719 - RNA, 64 nt, Homo Sapiens
uagggccaaaaaaaaaaagaaaaagaaaaagaaaaaagaaaaaaaaagaaaaaacugggaccua

SEQ ID NO: 142720 - RNA, 64 nt, Homo Sapiens
aaaaaaaagaaaaagaaaaagaaaaaagaaaaaaaaagaaaaaacugggaccuaaguauaaaua

SEQ ID NO: 142721 - RNA, 64 nt, Homo Sapiens
cuacuuaaaacuuugguuguuuuccuguaauauaaaagaaaaaguuaauuuaucaauugauuga

SEQ ID NO: 142722 - RNA, 64 nt, Homo Sapiens
auuucuugcaauuugaagguacgaguagagguuuaaagaaaaaucaguuuuuguucuuaaaaau

SEQ ID NO: 142723 - RNA, 64 nt, Homo Sapiens
agaauaacaacugcugggaauauccgugccaggaaaagaaaaauuucuggcaaauauuuuguca

SEQ ID NO: 142724 - RNA, 64 nt, Homo Sapiens
uaauugaacccauccacucugggcagguaagagaaaagaaaaagauaaggaaagaagagagaag

SEQ ID NO: 142725 - RNA, 64 nt, Homo Sapiens
aucacuacagaccaaaacagaagaagaagaaaaaaaagaaaaagaaaucuaagcaacaugguaa

SEQ ID NO: 142726 - RNA, 64 nt, Homo Sapiens
gaauaaugggagaaugugcggguuaucauuuuucaaagaaaauuauucucaucucaaugccaaa

SEQ ID NO: 142727 - RNA, 64 nt, Homo Sapiens
acugauuugugaugucaauaggauggcaccuuggaaagaaaaaugaagaacaacuuuaucaagg

SEQ ID NO: 142728 - RNA, 64 nt, Homo Sapiens
aaaaaguuuuuuaccuuacauuaucuccacuccaaaagaaaaaaauaggguggagaaggaggag

SEQ ID NO: 142729 - RNA, 64 nt, Homo Sapiens
uuucuuuuguuuuuuacacaguaaguaaaaacaaaaagaaaaccaaagauauucucuauguuuu

SEQ ID NO: 142730 - RNA, 64 nt, Homo Sapiens
acacuuucugcuuuacagaaugaacacuggaggaaaagaaaauguauuuucgaagaggagcaac

SEQ ID NO: 142731 - RNA, 64 nt, Homo Sapiens
aaccauaaauaucgugucauuaaaauggaccagaaaagaaaagaagugaguacauuaaguaaaa

SEQ ID NO: 142732 - RNA, 64 nt, Homo Sapiens
aaaagaaagaaagagggaaaaaaaaaauagaaaaaaagaaaaaagaccaucucuguaggaucgu

SEQ ID NO: 142733 - RNA, 64 nt, Homo Sapiens
gcaugaaacuaggcuucuguuuucuaucccccuuaaagaaaauuuuuuuuaaaguaguuccuau

SEQ ID NO: 142734 - RNA, 64 nt, Homo Sapiens
acagcaucucacuauguugcuuaaaaaaaaaagaaaagaaaaagaauuagguuugaauugcuuu

SEQ ID NO: 142735 - RNA, 64 nt, Homo Sapiens
aaaagacagcaucucacuaugcuuuuuaaaaaaaaaagaaaagaggaagaauuagguuugaauu

SEQ ID NO: 142736 - RNA, 64 nt, Homo Sapiens
uacauguauauauuuguccucaaaaaaaagaaagaaagaaaaggcaacgggcgagacucugucu

SEQ ID NO: 142737 - RNA, 64 nt, Homo Sapiens
guauguucacuugaacucugauuuacauacuuauaaagaaaacuuuuguagugcuaugaaauuu

SEQ ID NO: 142738 - RNA, 64 nt, Homo Sapiens
agaagccccuucacucuacauuaaaaaaaacuaaaaagaaaaaaaauuuuuuuaagacucuguc

SEQ ID NO: 142739 - RNA, 64 nt, Homo Sapiens
aggcaugaaaucaguuuaacaagaaaaaaaaaaaaaagaaaacuauccaugugggcuuccugga

SEQ ID NO: 142740 - RNA, 64 nt, Homo Sapiens
aaaaaaaagaaaacuaggcaugugggcuuccuggaaagaaaaaaccucaucugucagaaaucca

SEQ ID NO: 142741 - RNA, 64 nt, Homo Sapiens
caucaucaauaaaacuguuaaacaaauguaaauaaaagaaaacaucaauaccaaauacaguaaa

SEQ ID NO: 142742 - RNA, 64 nt, Homo Sapiens
cuagcagauuuacuccuuuucuuucacauuaaaaaaagaaaaagcugccugagggcuugcauag

SEQ ID NO: 142743 - RNA, 64 nt, Homo Sapiens
gaaagccauccaaauuugaaguaaccagauagcaaaagaaaaggcaucuaaaaaugaaagguga

SEQ ID NO: 142744 - RNA, 64 nt, Homo Sapiens
guuuuaguugauguuaccugaaggaaaaauuaguaaagaaaaaaauuauucucuuguaaaagaa

SEQ ID NO: 142745 - RNA, 64 nt, Homo Sapiens
aaaaauuaguaaagaaaaaaauuauucucuuguaaaagaaaagguuuguaguauaauauuaaug

SEQ ID NO: 142746 - RNA, 64 nt, Homo Sapiens
auuaagaguguguuuacaacauuaucuugcagauaaagaaaaaauuguguaaucuuuuaaaaau

SEQ ID NO: 142747 - RNA, 64 nt, Homo Sapiens
aauuguacaguguauauuccaugacaucagaaugaaagaaaaaauaaaacugauaauaucugua

SEQ ID NO: 142748 - RNA, 64 nt, Homo Sapiens
aagaaaucauucagaucaucaugcuacacucucaaaagaaaauuuuuuauuccugggggggauc

SEQ ID NO: 142749 - RNA, 64 nt, Homo Sapiens
ugcagggugauuucuuauuauaguuuuaguuuaaaaagaaaaaauuguaacuuuacaguuaaac

SEQ ID NO: 142750 - RNA, 64 nt, Homo Sapiens
aguauuuuguccuuuuguguuuuucauuuaagggaaagaaaauguucuaaaaacuucucaacug

SEQ ID NO: 142751 - RNA, 64 nt, Homo Sapiens
aaucauagucaccugacuaaggaaauauauacaaaaagaaaauugcaaaacuauuauauguaag

SEQ ID NO: 142752 - RNA, 64 nt, Homo Sapiens
acauuuccauucauggauauuugucaacagauuuaaagaaaaccacaguuauuaauuaaagaaa

SEQ ID NO: 142753 - RNA, 64 nt, Homo Sapiens
ucaacagauuuaaagaaaaccacaguuauuaauuaaagaaaauuaauuauguguaguuauaaac

SEQ ID NO: 142754 - RNA, 64 nt, Homo Sapiens
uguagucaaaaugcuacaauaaaacaaaaaagagaaagaaaaugaagagcauuugacucccgca

SEQ ID NO: 142755 - RNA, 64 nt, Homo Sapiens
ugacaaaagccuuuaguuguguuucuugaacuauaaagaaaacaaauuuuggcagucuuuaagu

SEQ ID NO: 142756 - RNA, 64 nt, Homo Sapiens
ucucuguucaucccuuccuauaaccucuagguaaaaagaaaagaaaaaaagaaauuucgagaua

SEQ ID NO: 142757 - RNA, 64 nt, Homo Sapiens
guucaucccuuccuauaaccucuagguaaaaagaaaagaaaaaaagaaauuucgagauauuuuc

SEQ ID NO: 142758 - RNA, 64 nt, Homo Sapiens
cuacuuucaaguaaauauagcauuccuuuggcaaaaagaaaaaaaaaguaaaagaaaagaaaaa

SEQ ID NO: 142759 - RNA, 64 nt, Homo Sapiens
auagcauuccuuuggcaaaaagaaaaaaaaaguaaaagaaaagaaaaaaaauguauuaccaccc

SEQ ID NO: 142760 - RNA, 64 nt, Homo Sapiens
auuccuuuggcaaaaagaaaaaaaaaguaaaagaaaagaaaaaaaauguauuaccacccgauga

SEQ ID NO: 142761 - RNA, 64 nt, Homo Sapiens
ggauuccuuuuggaucaaucagaaaggaaacacgaaagaaaagucaggaagguagagagagaaa

SEQ ID NO: 142762 - RNA, 64 nt, Homo Sapiens
uuugcugagcaaccaguguguuucaggaugauacaaagaaaaauauagaauagaaauaagugca

SEQ ID NO: 142763 - RNA, 64 nt, Homo Sapiens
ucuggaugagaaaauuuucaauucuggccaugagaaagaaaaaaaaauaaacagccuucuuuuu

SEQ ID NO: 142764 - RNA, 64 nt, Homo Sapiens
cugggugacaagagugaaacuccaucucaaaaaaaaagaaaagaagguccagcuuuuggauuca

SEQ ID NO: 142765 - RNA, 64 nt, Homo Sapiens
cccgggugacaaagcaagacccugucucagaaaaaaagaaaauucaaggccaguuaagacaaaa

SEQ ID NO: 142766 - RNA, 64 nt, Homo Sapiens
guauggaaucaacaccaccgagcucugugggaaaaaagaaaaaccugcucccuucgcucugcug

SEQ ID NO: 142767 - RNA, 64 nt, Homo Sapiens
caacauguaucugucuacuuucucuuguuuaaaaaaagaaaaaaaaacuuaaaaaaaugggguu

SEQ ID NO: 142768 - RNA, 64 nt, Homo Sapiens
cuccagccugggugacagagcgagacuguguuucaaagaaaaaaaaaaacaagcagccuuuugc

SEQ ID NO: 142769 - RNA, 64 nt, Homo Sapiens
uccauguacucagauaaacaugaagaaaauaagcaaagaaaaauggagacugggaaagcaaagc

SEQ ID NO: 142770 - RNA, 64 nt, Homo Sapiens
ggaaaaaaacaguuugaacaaaaaaaaaggaaaaaaagaaaaaacuuaaaaaaagaaaaaauga

SEQ ID NO: 142771 - RNA, 64 nt, Homo Sapiens
ugaaaaaaaaaggaaaaaaauugaaaucuuaaaaaaagaaaaaauuuccaguguguaacccagu

SEQ ID NO: 142772 - RNA, 64 nt, Homo Sapiens
caauuagucacucaacauaacacaaguuuccagaaaagaaaauaacacaaaacugccaacuuug

SEQ ID NO: 142773 - RNA, 64 nt, Homo Sapiens
acauggucuuguuuuuacuagcacauuuuuaaaaaaagaaaaaaucauuuauguuagcauuaau

SEQ ID NO: 142774 - RNA, 64 nt, Homo Sapiens
gaaacaaaaaggaacuucuuauaaaagggaaaaaaaagaaaaaacaugacuguugccugcaaaa

SEQ ID NO: 142775 - RNA, 64 nt, Homo Sapiens
uguuuuaucuaauacuguaaagguguuuaaaaagaaagaaaaguaauuuuugaaagacuauugc

SEQ ID NO: 142776 - RNA, 64 nt, Homo Sapiens
accaacagaauuuuaacucuguuuugcaaaagaaaaagaaaagaugaaggagaaggaggguagu

SEQ ID NO: 142777 - RNA, 64 nt, Homo Sapiens
aaaagaaccaacagaauuuugguaguguuuugcaaaagaaaaagagaugcugaaggagaaggag

SEQ ID NO: 142778 - RNA, 64 nt, Homo Sapiens
aauuuuguaugucaauaacuucauuaaaaggaaaaaagaaaaaaauuucuaaguuaaaucauuu

SEQ ID NO: 142779 - RNA, 64 nt, Homo Sapiens
augauuguuuuagaaguuaaaacccacugcugaaaaagaaaaaaaaauuuacagaauauuauau

SEQ ID NO: 142780 - RNA, 64 nt, Homo Sapiens
augagagaacuauuguuuggacugucuugagagaaaagaaaaauuucacuaauacuuacuguua

SEQ ID NO: 142781 - RNA, 64 nt, Homo Sapiens
aauccuacuuauaaacuacuucuuggaaaauuuuaaagaaaaauuuauuugucaaguaauauga

SEQ ID NO: 142782 - RNA, 64 nt, Homo Sapiens
aggaaaaaaauuuuuuuucaauaaccuucaggaaaaagaaaaucuuaccaugguuucuacaaaa

SEQ ID NO: 142783 - RNA, 64 nt, Homo Sapiens
ggcuggguuuacuauugcaccuuacuguauagaaaaagaaaaaaauuacaggcugcauucuugc

SEQ ID NO: 142784 - RNA, 64 nt, Homo Sapiens
cucuguuguaaaaacaguuuguuuaauuaaaaaaaaagaaaaaaucuucuguacaucuuacugg

SEQ ID NO: 142785 - RNA, 64 nt, Homo Sapiens
cccaugaaauggcuugauguauucuagacuacugaaagaaaaccacuucaaagauuuuguugaa

SEQ ID NO: 142786 - RNA, 64 nt, Homo Sapiens
aaaugcaagagggaaggugauugguagugaguuaaaagaaaaagagaggaaaagagaguaguuu

SEQ ID NO: 142787 - RNA, 64 nt, Homo Sapiens
uuccuuucacuggccacaguuguuugaugcauuaaaagaaaauaaaaaaaagaaaaaagagaaa

SEQ ID NO: 142788 - RNA, 64 nt, Homo Sapiens
cacaguuguuugaugcauuaaaagaaaauaaaaaaaagaaaaaagagaaaagaaaaaaaaagaa

SEQ ID NO: 142789 - RNA, 64 nt, Homo Sapiens
gcauuaaaagaaaauaaaaaaaagaaaaaagagaaaagaaaaaaaaagaaaaaaguuguaggcg

SEQ ID NO: 142790 - RNA, 64 nt, Homo Sapiens
aaaauaaaaaaaagaaaaaagagaaaagaaaaaaaaagaaaaaaguuguaggcgaaucauuugu

SEQ ID NO: 142791 - RNA, 64 nt, Homo Sapiens
uuguguucagcaaaaugugauguuuuuuucuuuuaaagaaaaaaagugaaaauauauagugcca

SEQ ID NO: 142792 - RNA, 64 nt, Homo Sapiens
cgguuugacuacuuuguucuuugguuaagauccaaaagaaaacagaaaacaauuccacgaggcc

SEQ ID NO: 142793 - RNA, 64 nt, Homo Sapiens
uugaaggugugaugguagaaauaggaaaacaacaaaagaaaaacaauaacaaaaaaagaaagug

SEQ ID NO: 142794 - RNA, 64 nt, Homo Sapiens
aauaaauaaauagaaagagagagagaggaaaaaaaaagaaaagaacacuucuuuauuugaggga

SEQ ID NO: 142795 - RNA, 64 nt, Homo Sapiens
caaauauuuugccucauuauucuuguuuuaaaagaaagaaaacaggccgggcacaguggcucau

SEQ ID NO: 142796 - RNA, 64 nt, Homo Sapiens
gggugacagagggagacucugucucgaaagaaagaaagaaaaaaaggaaggaaggagaaggaag

SEQ ID NO: 142797 - RNA, 64 nt, Homo Sapiens
guaccugaucaggaucugggagaauuugaaaaaaaaagaaaaacuagaaaaauaaacaaaauua

SEQ ID NO: 142798 - RNA, 64 nt, Homo Sapiens
aaaaaagaaaaacuagaaaaauaaacaaaauuaaaaagaaaaaaaaauaccugagacugaguaa

SEQ ID NO: 142799 - RNA, 64 nt, Homo Sapiens
aauaccugaguggaguauucaaaaacuugcuuagaaagaaaacucuaggaacagauggcuucac

SEQ ID NO: 142800 - RNA, 64 nt, Homo Sapiens
ccuggaagacagagugagaccccaucucaggaaaaaagaaaaaaaaaaagaugucauucagcag

SEQ ID NO: 142801 - RNA, 64 nt, Homo Sapiens
guuaaaucuaagaccucaaacuaugaaacagcuaaaagaaaacaucggggaaucucuccaggac

SEQ ID NO: 142802 - RNA, 64 nt, Homo Sapiens
caaagaagaagaaaaacaccaaaaccacaagggaaaagaaaaacccaguuucuuaggaaacgca

SEQ ID NO: 142803 - RNA, 64 nt, Homo Sapiens
cagauuauuuggauaaguccuuuuuaagaaaaaaaaagaaaaugaaaaacaacacaaaaaaaau

SEQ ID NO: 142804 - RNA, 64 nt, Homo Sapiens
acauguuagaauaguuuaccauaauuaccaaggaaaagaaaaguaaaauuaccuuagaagaaaa

SEQ ID NO: 142805 - RNA, 64 nt, Homo Sapiens
aauuuuuuaaacguguucucgggaaguuagggcuaaagaaaauuuugauaaaacaauuuuccca

SEQ ID NO: 142806 - RNA, 64 nt, Homo Sapiens
ucaucuacgauucaacuaaucgaaggauuaaacuaaagaaaaaacuaagaagaacaaugaaccu

SEQ ID NO: 142807 - RNA, 64 nt, Homo Sapiens
aguggucccuuuugaauuucaugagccucucaaaaaagaaaaacuuaaaaaaaaaaaaaaaaaa

SEQ ID NO: 142808 - RNA, 64 nt, Homo Sapiens
ccccgcaaaaaaaaaaaagaaagaaagaaagagaaaagaaaagaaaagcaaccacagccagccu

SEQ ID NO: 142809 - RNA, 64 nt, Homo Sapiens
caaaaaaaaaaaagaaagaaagaaagagaaaagaaaagaaaagcaaccacagccagccuuaggg

SEQ ID NO: 142810 - RNA, 64 nt, Homo Sapiens
agacugaucauuccucuggguuaucugcaucucaaaagaaaaugcuuacccacaggaacuguua

SEQ ID NO: 142811 - RNA, 64 nt, Homo Sapiens
gugucccugaugcugcuggaggcugcuguggcacaaagaaaagcugcuaaaucuauagccaacc

SEQ ID NO: 142812 - RNA, 64 nt, Homo Sapiens
aaauguuuuuuucuuuuuucuuuuuuuuugcaauaaagaaaacaaauuaaucauaaacaucuuu

SEQ ID NO: 142813 - RNA, 64 nt, Homo Sapiens
aacuggacuuuaagaacuggaaagagguuuuacaaaagaaaaacuuucagauucaucucucauu

SEQ ID NO: 142814 - RNA, 64 nt, Homo Sapiens
aaacuguauuuuucucuuaguauugcuaaugaguaaagaaaagucucauaagguagccaaauga

SEQ ID NO: 142815 - RNA, 64 nt, Homo Sapiens
uuccccuuccauucccaacucucucucucuuuuuaaagaaaaaugcuaagggcagcccugccug

SEQ ID NO: 142816 - RNA, 64 nt, Homo Sapiens
agagacaauuuaaggccugcacucuuauuucacuaaagaaaaacuaaugucagcacauguugcu

SEQ ID NO: 142817 - RNA, 64 nt, Homo Sapiens
augggguaaauacccgauagcugucuuuuuggugaaagaaaaggugcauuucaagaacuugggg

SEQ ID NO: 142818 - RNA, 64 nt, Homo Sapiens
ccagccugagcaacagagcgacucugucuccaaaaaagaaaaaaaguaccccauguucagcccc

SEQ ID NO: 142819 - RNA, 64 nt, Homo Sapiens
uaaaauuauaucacaaauauauaugcuuccagacaaagaaaaguuuguuaguccugauuuucua

SEQ ID NO: 142820 - RNA, 64 nt, Homo Sapiens
aggucuaaaggaaaguagcauauugcuuggcagaaaagaaaauaauaauggccagaaaauauug

SEQ ID NO: 142821 - RNA, 64 nt, Homo Sapiens
ggauaucuuuuuuauauuuucuuuuagguuuguaaaagaaaaagccagagcuucauucuccugg

SEQ ID NO: 142822 - RNA, 64 nt, Homo Sapiens
acccacauuuuaauuuagcagcaaaaagaaaagaaaagaaaaccaauggcaugauuuuuuuuau

SEQ ID NO: 142823 - RNA, 64 nt, Homo Sapiens
aaaccacccacauuuuaauuuuuaugcaaaaagaaaagaaaagaacauuaauggcaugauuuuu

SEQ ID NO: 142824 - RNA, 64 nt, Homo Sapiens
aaagaaaaccacccacauuuuuuuuuuuaugcaaaaagaaaagauccacacauuaauggcauga

SEQ ID NO: 142825 - RNA, 64 nt, Homo Sapiens
uuacauaauuuggcuagagcgacagagaaaagaaaaagaaaacacacuacaguccagccugggu

SEQ ID NO: 142826 - RNA, 64 nt, Homo Sapiens
aaaacauuacauaauuuggccugggugacagagaaaagaaaaaguuguuccacuacaguccagc

SEQ ID NO: 142827 - RNA, 64 nt, Homo Sapiens
uauuuuuucuuuucauugucuuuuuauuuauuagaaagaaaauagccucuagcauuuuaaauua

SEQ ID NO: 142828 - RNA, 64 nt, Homo Sapiens
auuucauuuauaaaugaacaccauguauuuuggaaaagaaaauggucugccuugaauauugcuu

SEQ ID NO: 142829 - RNA, 64 nt, Homo Sapiens
ggcauaaaucuuuauugcagagaaaaaaaaaagaaaagaaaaaaguacuguuuguauaaaaaau

SEQ ID NO: 142830 - RNA, 64 nt, Homo Sapiens
aaaaaggcauaaaucuuuauaaaauagaaaaaaaaaagaaaagauguuuguacuguuuguauaa

SEQ ID NO: 142831 - RNA, 64 nt, Homo Sapiens
auauuuucuaaguaaguuuauuuugaaauauaggaaagaaaauggaucuuuugcaauaccucaa

SEQ ID NO: 142832 - RNA, 64 nt, Homo Sapiens
aacugacauuauauauaaccaagguuauauucugaaagaaaaauuagaauagguuacuacaaaa

SEQ ID NO: 142833 - RNA, 64 nt, Homo Sapiens
aaaauaaugugcuuaagaagcucugggaucaguaaaagaaaaaacuccuuaucuuuugcagucu

SEQ ID NO: 142834 - RNA, 64 nt, Homo Sapiens
aaagcacgucuuggcucagcaaaaaaaaaaaguaaaagaaaaaugcaagacccugucucuaaag

SEQ ID NO: 142835 - RNA, 64 nt, Homo Sapiens
aaaaaguaaaagaaaaauaaaagacccugucucuaaagaaaaaaaccagccugggcaacauagc

SEQ ID NO: 142836 - RNA, 64 nt, Homo Sapiens
aggaagaagcagcuuugcugaaaaaaaaaaagaaaaagaaaaaggggcuuuuuuuuccucucaa

SEQ ID NO: 142837 - RNA, 64 nt, Homo Sapiens
aaaaagaggaagaagcagcuucucaaaaaaaaaaaaagaaaaaguccagugggcuuuuuuuucc

SEQ ID NO: 142838 - RNA, 64 nt, Homo Sapiens
ggagaaaaccucuuagcaaauguuucagagcagaaaagaaaaaggcacaaagcaaccgccaaau

SEQ ID NO: 142839 - RNA, 64 nt, Homo Sapiens
caaaauccuagcuugggauuaacuuuuuggaacaaaagaaaacaaggaagggagaagguggcau

SEQ ID NO: 142840 - RNA, 64 nt, Homo Sapiens
aaacaaacccuaacuaacuugaaguccacauuaaaaagaaaacaaagaaaauuuaaauaaaggg

SEQ ID NO: 142841 - RNA, 64 nt, Homo Sapiens
uaaauaaaggggaaguccacgaauuuguacacugaaagaaaauuauuuuuguagccaguuuugu

SEQ ID NO: 142842 - RNA, 64 nt, Homo Sapiens
gcauuaauuuuguguguuuagaguucuguugucaaaagaaaacuaaugaauaaauuaguuuguc

SEQ ID NO: 142843 - RNA, 64 nt, Homo Sapiens
uugcgcaaaaauuguuaaauccuuugucuuuauuaaagaaaaauuugaguaacauuaaguuuga

SEQ ID NO: 142844 - RNA, 64 nt, Homo Sapiens
aagacucauuuguguggaugcgugaccaugggaaaaagaaaaaaaaaaagauccauuuuuuagg

SEQ ID NO: 142845 - RNA, 64 nt, Homo Sapiens
ucacauuggaugacaccauguucuuccucuuugaaaagaaaaggggaaugugucccacuaguga

SEQ ID NO: 142846 - RNA, 64 nt, Homo Sapiens
augcaugaauauaaaucuauauuauuugcuaaaaaaagaaaaaacauuuguguuuuaguuucuu

SEQ ID NO: 142847 - RNA, 64 nt, Homo Sapiens
cccguuaggguuuaaaaccauauugaucaacuagaaagaaaaauaugaaaagagaaaaauauuu

SEQ ID NO: 142848 - RNA, 64 nt, Homo Sapiens
ucugauacuuuugaaacagaugugaaaaacagaaaaagaaaaaauugucugaaauguuuauuuu

SEQ ID NO: 142849 - RNA, 64 nt, Homo Sapiens
gcucugaguuuucagcaccaguagauuuguauuaaaagaaaaaaaaauggggccuuagcuucug

SEQ ID NO: 142850 - RNA, 64 nt, Homo Sapiens
acaaauagccaucugcuaucagcaucauuauguaaaagaaaauauauuuuagccccuaaaauua

SEQ ID NO: 142851 - RNA, 64 nt, Homo Sapiens
ugggggacuggacgcugcuauugauucauuaaaaaaagaaaagaaaaauacaccaaggcuccau

SEQ ID NO: 142852 - RNA, 64 nt, Homo Sapiens
gacuggacgcugcuauugauucauuaaaaaaagaaaagaaaaauacaccaaggcuccauguucc

SEQ ID NO: 142853 - RNA, 64 nt, Homo Sapiens
gggagagacugaauuguuaguaggucuaaacaucaaagaaaacauuuuuauuaguuacuuaugg

SEQ ID NO: 142854 - RNA, 64 nt, Homo Sapiens
ucuggucauuugucuaaauaggaauggaaaauuaaaagaaaagcaacaauccaaucuuuuuucu

SEQ ID NO: 142855 - RNA, 64 nt, Homo Sapiens
auaugcuauauacagcuuaacucacagaacuguaaaagaaaauuauaaaauaauucaacauguc

SEQ ID NO: 142856 - RNA, 64 nt, Homo Sapiens
gcaugguauuaaacuaucauagaaguagacagaaaaagaaaaaaggacucauggcauuauuaau

SEQ ID NO: 142857 - RNA, 64 nt, Homo Sapiens
acuuuuuaaaaaguaacuuuuuuaauaauauaagaaagaaaaaugcccuuucacacugaaucuu

SEQ ID NO: 142858 - RNA, 64 nt, Homo Sapiens
auauggcaagagcccaacucuacuaaaaauacaaaaagaaaagaaaacagccaagcuugguggu

SEQ ID NO: 142859 - RNA, 64 nt, Homo Sapiens
gcaagagcccaacucuacuaaaaauacaaaaagaaaagaaaacagccaagcuuggugguaugug

SEQ ID NO: 142860 - RNA, 64 nt, Homo Sapiens
uccaaccugagugacagagcaacacucugucuuaaaagaaaaaaaaaaaagagagagauaguaa

SEQ ID NO: 142861 - RNA, 64 nt, Homo Sapiens
aguaaucucuugggcaaaagguaucaaauaauugaaagaaaaguuuaaacacauuuccgagagg

SEQ ID NO: 142862 - RNA, 64 nt, Homo Sapiens
gaccaaaccaugcacauaaagcuuguaguuuaaaaaagaaaagcaaaaaaauaauuaugccuga

SEQ ID NO: 142863 - RNA, 64 nt, Homo Sapiens
uuuaccuggaaauuccaugaccaauacaugugcaaaagaaaaugauggguugaauuuacugauu

SEQ ID NO: 142864 - RNA, 64 nt, Homo Sapiens
uaaauuuuugcuaaggauguauuuugauuauugaaaagaaaauuucuauuuaaacuguaaauau

SEQ ID NO: 142865 - RNA, 64 nt, Homo Sapiens
gaaaucaagucugucaaguacaauaacauuuuuaaaagaaaauggaucccacuguuccucuuug

SEQ ID NO: 142866 - RNA, 64 nt, Homo Sapiens
gauguaaaaaccauucuuagcccucucaaaagaaaaagaaaaaacugggugacagagcaagacu

SEQ ID NO: 142867 - RNA, 64 nt, Homo Sapiens
aaaaaagauguaaaaaccauaagacucccucucaaaagaaaaaguccagccugggugacagagc

SEQ ID NO: 142868 - RNA, 64 nt, Homo Sapiens
aaaacuuuccaaauuccaacgaaaugugugggaaaaagaaaacauggaaaacaccccaaccccg

SEQ ID NO: 142869 - RNA, 64 nt, Homo Sapiens
aaaaaccccgugcucgccccgaggaaacgcaaaaaaagaaaaggccucaggcuucucuuacgaa

SEQ ID NO: 142870 - RNA, 64 nt, Homo Sapiens
gccaaccuuagaaaagacaaucaaauugcaaaauaaagaaaaauuuuuuuacuguaaguaugga

SEQ ID NO: 142871 - RNA, 64 nt, Homo Sapiens
uggggaucauagccgauagacauaguuucucuaaaaagaaaacuaaaacugcuauuaucagcau

SEQ ID NO: 142872 - RNA, 64 nt, Homo Sapiens
aggaaagaagaauaaagaagcaagaggaaagaaaaaagaaaagaagaggugguuuuugaaagag

SEQ ID NO: 142873 - RNA, 64 nt, Homo Sapiens
gaaaagaaggaaagaagaaugaaagagcaagaggaaagaaaaaaaguuccaagaggugguuuuu

SEQ ID NO: 142874 - RNA, 64 nt, Homo Sapiens
aauucccaucucuauacuucuccuuuggacauggaaagaaaaguuauugcuggugcaaagauag

SEQ ID NO: 142875 - RNA, 64 nt, Homo Sapiens
gcuauuuguuaaaauauuugccuuuuuaaguaaaaaagaaaaaucagaacagggcuauuugaag

SEQ ID NO: 142876 - RNA, 64 nt, Homo Sapiens
acagaguaauguuuuuuuucuuauuuucccaaagaaagaaaagggggaaaauauauuuguaugu

SEQ ID NO: 142877 - RNA, 64 nt, Homo Sapiens
cagguuuaaacuggacuuagcuugaguuaaaggcaaagaaaaucuaaaaacauaaauguuauau

SEQ ID NO: 142878 - RNA, 64 nt, Homo Sapiens
ucuucccuuuagugauuucaguaguuuauauuggaaagaaaaacaauuacaacaugugcccuua

SEQ ID NO: 142879 - RNA, 64 nt, Homo Sapiens
cauuugaucuauagcaaugugauuuuauuuuuaaaaagaaaagcaguguguuuucuuuuuuugu

SEQ ID NO: 142880 - RNA, 64 nt, Homo Sapiens
gcgacagugcaagacucugucuccaaaaaaaaaaaaagaaaaaagaaaaucccccuucaucccc

SEQ ID NO: 142881 - RNA, 64 nt, Homo Sapiens
ugcaagacucugucuccaaaaaaaaaaaaagaaaaaagaaaaucccccuucaucccccaggacu

SEQ ID NO: 142882 - RNA, 64 nt, Homo Sapiens
caaaauaccccaacacaggcgggggagagacgaaaaagaaaaggaaagagcaagauagacaaaa

SEQ ID NO: 142883 - RNA, 64 nt, Homo Sapiens
aaagagcaagauagacaaaagccaaucagcuuaaaaagaaaaacaaggaaggggaaaagaaaac

SEQ ID NO: 142884 - RNA, 64 nt, Homo Sapiens
ccaaucagcuuaaaaagaaaaacaaggaaggggaaaagaaaacucuugcgauuugggaggguuc

SEQ ID NO: 142885 - RNA, 64 nt, Homo Sapiens
auacuaccuaaagggaaccugcaauaaucuugaaaaagaaaaagagaaaaauuuuaaaauccug

SEQ ID NO: 142886 - RNA, 64 nt, Homo Sapiens
cugucuugaauucucuguuuaugcaaugugcucgaaagaaaaaaauguuaaaaauauaucuaua

SEQ ID NO: 142887 - RNA, 64 nt, Homo Sapiens
cuacuauaaaaauauuugcauauauaaguuugacaaagaaaagaaaaucaauguuaaaccauua

SEQ ID NO: 142888 - RNA, 64 nt, Homo Sapiens
auaaaaauauuugcauauauaaguuugacaaagaaaagaaaaucaauguuaaaccauuaaaucu

SEQ ID NO: 142889 - RNA, 64 nt, Homo Sapiens
acaaagauuauauaugacaaucaguauugcaaugaaagaaaaacuaaaaacagaaaugauauuc

SEQ ID NO: 142890 - RNA, 64 nt, Homo Sapiens
uacacugcacauguacaaagaaugucuucagaucaaagaaaauuuaucucuuuuuauaaacuua

SEQ ID NO: 142891 - RNA, 64 nt, Homo Sapiens
ggagcaugaucuaaguacauagcacaugugaauaaaagaaaagcugacaguauauucugguuuc

SEQ ID NO: 142892 - RNA, 64 nt, Homo Sapiens
uuuuaaagcugcucauuucauuuuguccaaccaaaaagaaaagggagauaacuaaugagcuucu

SEQ ID NO: 142893 - RNA, 64 nt, Homo Sapiens
guauuauuuugcuacuuaccguguuauucuguggaaagaaaaaccuguaaaguguuuaauaaau

SEQ ID NO: 142894 - RNA, 64 nt, Homo Sapiens
gucaacauuuaugaaauauugccugacuauuuaaaaagaaaaaaguagcucuccauuaucaccu

SEQ ID NO: 142895 - RNA, 64 nt, Homo Sapiens
uaaacagacaguauuguaaucccaucaaaagaugaaagaaaaacaaaaacaaaaaccaacaaca

SEQ ID NO: 142896 - RNA, 64 nt, Homo Sapiens
ucaaagacuacaucagagauucaaauagguuuuuaaagaaaagcuaagcaagagagccaaauuu

SEQ ID NO: 142897 - RNA, 64 nt, Homo Sapiens
uaucuuuuaacauuuugggggacuuuccaguugaaaagaaaacaugcuaugucauuuuuaucca

SEQ ID NO: 142898 - RNA, 64 nt, Homo Sapiens
aaagaaccaucaucuuguggcacaaaaaaagaagaaagaaaagaaaacuucaagguuuugugag

SEQ ID NO: 142899 - RNA, 64 nt, Homo Sapiens
accaucaucuuguggcacaaaaaaagaagaaagaaaagaaaacuucaagguuuugugagaagca

SEQ ID NO: 142900 - RNA, 64 nt, Homo Sapiens
uuccuuugcuccaauaagcuuugcaaucaaggccaaagaaaaugaucugcuuccccuggaaaaa

SEQ ID NO: 142901 - RNA, 64 nt, Homo Sapiens
gagcaaaagcaaagauccaccgagagaagaagagaaagaaaagaaaaagaaaaagcacaaaaaa

SEQ ID NO: 142902 - RNA, 64 nt, Homo Sapiens
aaagcaaagauccaccgagagaagaagagaaagaaaagaaaaagaaaaagcacaaaaaaagauc

SEQ ID NO: 142903 - RNA, 64 nt, Homo Sapiens
aagauccaccgagagaagaagagaaagaaaagaaaaagaaaaagcacaaaaaaagaucucgaac

SEQ ID NO: 142904 - RNA, 64 nt, Homo Sapiens
gaauuucucuuuacuucucuaccugacagaaaaaaaagaaaaauauuuuuuuucuuuguaaugc

SEQ ID NO: 142905 - RNA, 64 nt, Homo Sapiens
guuuuguuuuguuuuuuggggcuacaauuuuuaaaaagaaaaaaaauguguuuuguuguuuugu

SEQ ID NO: 142906 - RNA, 64 nt, Homo Sapiens
caaauacaacaagcaaacaacucaaaaggcuuggaaagaaaaaagcugacuaauagaccucagc

SEQ ID NO: 142907 - RNA, 64 nt, Homo Sapiens
auggaaaaaaauuacaaggcuauuuuuucuauaaaaagaaaaaaucacucuccccaaaauauua

SEQ ID NO: 142908 - RNA, 64 nt, Homo Sapiens
ugagcaaagaugguaaaaagaaauucgaaaacauaaagaaaagacuucuauacauuaguucgag

SEQ ID NO: 142909 - RNA, 64 nt, Homo Sapiens
aaggauaaaaaaacccaaacauacuuauuuuaaaaaagaaaaaaaacacaaauaagcagaaaac

SEQ ID NO: 142910 - RNA, 64 nt, Homo Sapiens
caaauaagcagaaaacauacaauauauucaaagaaaagaaaacauuaauaauaaaauauugugc

SEQ ID NO: 142911 - RNA, 64 nt, Homo Sapiens
aaacacaaauaagcagaaaaugugcaauauauucaaagaaaagauuuuuuuaauaauaaaauau

SEQ ID NO: 142912 - RNA, 64 nt, Homo Sapiens
acuaguguccaauuucauuuaccagaguuauuuuaaagaaaaacgacuuugcuaacuuacuagu

SEQ ID NO: 142913 - RNA, 64 nt, Homo Sapiens
uaaacuuuauguauuaguguuauuuaggauauugaaagaaaaaauaugacucccauugucccuu

SEQ ID NO: 142914 - RNA, 64 nt, Homo Sapiens
aaagucuagcgaaaaaacucuuuaauaagguuaaaaagaaaaaauuuuuaggaccaaucucauu

SEQ ID NO: 142915 - RNA, 64 nt, Homo Sapiens
auaauuuuucuuuucuguuuaaagccaaaaaaagaaagaaaaaagaugagguccuucuggacua

SEQ ID NO: 142916 - RNA, 64 nt, Homo Sapiens
ggcagaagcccuggauucaaaagaaaaaagaaagaaagaaaaaacucugucucaaaaaaaaaaa

SEQ ID NO: 142917 - RNA, 64 nt, Homo Sapiens
gaaagaaagaaaaaaggcagucucaaaaaaaaaaaaagaaaaaaggugacagagcgaaccucug

SEQ ID NO: 142918 - RNA, 64 nt, Homo Sapiens
aaaauagcaacucuggugagaagcacuaaacagaaaagaaaaaaccuauaagaauuaaggggua

SEQ ID NO: 142919 - RNA, 64 nt, Homo Sapiens
aaugccaugaaacauuugaaaaaauuuuucacuuaaagaaaaaauaaaacuguuuuacaguauc

SEQ ID NO: 142920 - RNA, 64 nt, Homo Sapiens
uaugaauggucaaaaugaauaucuucuuagaaagaaagaaaaaggcaaagcacucagcucaauu

SEQ ID NO: 142921 - RNA, 64 nt, Homo Sapiens
uguuuacuuacccauuaguaauaacuuguuuguaaaagaaaauugaggaucccuaugacucaaa

SEQ ID NO: 142922 - RNA, 64 nt, Homo Sapiens
gagcuuaaggcaaaaggccuuuuuuucuaaucaaaaagaaaauuauuuuauuuuuuaaucuaau

SEQ ID NO: 142923 - RNA, 64 nt, Homo Sapiens
aagaaagcauagacauauuuaaaaaaaaagaaaaaaagaaaaaauuuaagaaaguacuugacua

SEQ ID NO: 142924 - RNA, 64 nt, Homo Sapiens
agaaaaaaaagaaagcauagcuugacuaaaaaaaaaagaaaaaaauuguuucuuuaagaaagua

SEQ ID NO: 142925 - RNA, 64 nt, Homo Sapiens
gagaaaaacaaagagauuucaaagagagaaaggaaaagaaaaagaugaauacaaagauaaguga

SEQ ID NO: 142926 - RNA, 64 nt, Homo Sapiens
aaaauauauauauauauauauaauguucuauagaaaagaaaaaaugcuguugaucuuuuaucaa

SEQ ID NO: 142927 - RNA, 64 nt, Homo Sapiens
gacauucugaaugugucaggcauacucugaugggaaagaaaauguugacuucauuguuggacuu

SEQ ID NO: 142928 - RNA, 64 nt, Homo Sapiens
uuggauuuuaaagguauuaaucaugaaugauuuuaaagaaaaauuucugacuugagaaucuuuu

SEQ ID NO: 142929 - RNA, 64 nt, Homo Sapiens
cccaaugaggaacaauuggaugauguguguuuuaaaagaaaaaacaaagcaaccccaaaagagu

SEQ ID NO: 142930 - RNA, 64 nt, Homo Sapiens
aagcacgugaccuuaugaggucaaaaaagaaaaaaaagaaaaaaaacaaaagcgaaacucuguc

SEQ ID NO: 142931 - RNA, 64 nt, Homo Sapiens
aagaaaaaaaagcacgugacaacucugucucaaaaaagaaaaaaagccugggcaacaaaagcga

SEQ ID NO: 142932 - RNA, 64 nt, Homo Sapiens
cugcauaggaaaacugagauaacguguuccuagaaaagaaaauguccuuguccugguugaaggu

SEQ ID NO: 142933 - RNA, 64 nt, Homo Sapiens
ucagcgucauuuguucccugagaguucaguuaaaaaagaaaaaaucauaaaacauuuucuugag

SEQ ID NO: 142934 - RNA, 64 nt, Homo Sapiens
caguauuauuuuugcauguuuuuaaaacuuuuuaaaagaaaacuaaagaaacauuuaaugacgg

SEQ ID NO: 142935 - RNA, 64 nt, Homo Sapiens
aaggaccucaaagcaccugauuucuuaucacaaaaaagaaaaugcaacguuaauaauucuggau

SEQ ID NO: 142936 - RNA, 64 nt, Homo Sapiens
cuuaaaaugaucauuaggacuuuaccuuuuugaaaaagaaaacaugugucuuucuuuuuggaca

SEQ ID NO: 142937 - RNA, 64 nt, Homo Sapiens
uuaguuugcuuaccuuaagaauugcccaaaaaugaaagaaaauaugagcuuuucaguuaaacau

SEQ ID NO: 142938 - RNA, 64 nt, Homo Sapiens
cgcugcacuccagccugggagacugcaucucaaaaaagaaaaauaaacgaaguaaaagauauuu

SEQ ID NO: 142939 - RNA, 64 nt, Homo Sapiens
auugugucacugcacucuagccugggcgacagaaaaagaaaauuuagguggggaaaaaaaucag

SEQ ID NO: 142940 - RNA, 64 nt, Homo Sapiens
uuaauuuggaauagagaaaccaguauauuuuaaaaaagaaaaauauucuuuguagcaacuguaa

SEQ ID NO: 142941 - RNA, 64 nt, Homo Sapiens
acuacauuaguauuagugacaucagguggauauaaaagaaaacccuuggaaagagaacugccuu

SEQ ID NO: 142942 - RNA, 64 nt, Homo Sapiens
agccugggcaacauagggagacccccaucuuuacaaagaaaaaaaaaaggggaaaagaaaaucu

SEQ ID NO: 142943 - RNA, 64 nt, Homo Sapiens
gacccccaucuuuacaaagaaaaaaaaaaggggaaaagaaaaucuuuuaaaucuuuggauuuga

SEQ ID NO: 142944 - RNA, 64 nt, Homo Sapiens
uaagccauuauuugccauuuuggguacuuuauacaaagaaaauucagcccuacccugcauaauu

SEQ ID NO: 142945 - RNA, 64 nt, Homo Sapiens
aauaugccagaugugugugaguuggaaaucaaaaaaagaaaaauaaaauaugcaaagaauucac

SEQ ID NO: 142946 - RNA, 64 nt, Homo Sapiens
acuucagcuuuccaaaagcuaguaaacauguuucaaagaaaaauaaggucaggagaaaaagaau

SEQ ID NO: 142947 - RNA, 64 nt, Homo Sapiens
uugacuuggaagccaauuugguccuuuaauaaguaaagaaaauaauauguuuaaaaauguaaau

SEQ ID NO: 142948 - RNA, 64 nt, Homo Sapiens
ugggugacacagcgagacuucaucucaaaaaaaaaaagaaaagaaaagcaauuguacuucacua

SEQ ID NO: 142949 - RNA, 64 nt, Homo Sapiens
gacacagcgagacuucaucucaaaaaaaaaaagaaaagaaaagcaauuguacuucacuaugcca

SEQ ID NO: 142950 - RNA, 64 nt, Homo Sapiens
cacauugcauguaguugagccacauuuuuuaaaaaaagaaaauggaugaccauuaauugacuag

SEQ ID NO: 142951 - RNA, 64 nt, Homo Sapiens
caugaggucagcaguugagaccagccaaaaggaaaaagaaaauuaugagaguuacuuaaaggua

SEQ ID NO: 142952 - RNA, 64 nt, Homo Sapiens
ggggaaacgacccuguggcugugagaaagugaaaaaagaaaaaaaaaaaggcauuggcauuuuc

SEQ ID NO: 142953 - RNA, 64 nt, Homo Sapiens
uguauuaggacagaauuaaugaugcuuaaagagaaaagaaaaaaagagagaagaaaaaggagag

SEQ ID NO: 142954 - RNA, 64 nt, Homo Sapiens
agccaggugugguggcaaguaaaaaaaaaaaagaaaagaaaauugagacuccaucgcaaaaaaa

SEQ ID NO: 142955 - RNA, 64 nt, Homo Sapiens
aaauuagccaggugugguggaaaaaaaaaaaaaaaaagaaaagaagagugagacuccaucgcaa

SEQ ID NO: 142956 - RNA, 64 nt, Homo Sapiens
cuugaaagaacacuucuaagugguuucuuuuuuaaaagaaaaaacaacaaaaaucuucaaagac

SEQ ID NO: 142957 - RNA, 64 nt, Homo Sapiens
auuacauccuuuacauucaguauaauacuuuuaaaaagaaaauuugugccagcugaauuuaaaa

SEQ ID NO: 142958 - RNA, 64 nt, Homo Sapiens
agugggaauuaagaaagccuuguuuacggcauggaaagaaaaucacauaugacauuuuaugagc

SEQ ID NO: 142959 - RNA, 64 nt, Homo Sapiens
gaaaaaagauuauuguaaauauauucuuguauucaaagaaaaagccacugaaaacauuuuuguc

SEQ ID NO: 142960 - RNA, 64 nt, Homo Sapiens
aaccugccgauuaacaagaccagaacaaaugagaaaagaaaaaacauaacuaaaacauugaaaa

SEQ ID NO: 142961 - RNA, 64 nt, Homo Sapiens
aagaaaagcaaucucgcaguuguuauugauggaaaaagaaaaagaagaggcauuccagccccua

SEQ ID NO: 142962 - RNA, 64 nt, Homo Sapiens
aaaaaaggaaagaaagaaacaacaaaaaaaacaaaaagaaaaaacaaccagugaggcugcccug

SEQ ID NO: 142963 - RNA, 64 nt, Homo Sapiens
caauauaccacuuccuaaauauccaucuuuggugaaagaaaauagugugguaagaguacccaug

SEQ ID NO: 142964 - RNA, 64 nt, Homo Sapiens
agcuuacaaauauucuguuaagggguaguuuuauaaagaaaaaugauauauaguuauguugucu

SEQ ID NO: 142965 - RNA, 64 nt, Homo Sapiens
acauaaagacuugagaagggaauuguuuaagggaaaagaaaagaguaauaauuuuuuuuaaaac

SEQ ID NO: 142966 - RNA, 64 nt, Homo Sapiens
uaauuauguaaaaaacaaaacuacaacaacaaaaaaagaaaaaaguuaaaaaagaaaaaaacac

SEQ ID NO: 142967 - RNA, 64 nt, Homo Sapiens
aaaacuacaacaacaaaaaaagaaaaaaguuaaaaaagaaaaaaacaccaaaaaacaaaaacaa

SEQ ID NO: 142968 - RNA, 64 nt, Homo Sapiens
uaaagucuuaaaauggaaugagaauguuguuuuaaaagaaaauagcaaaacaacaaaaaagcaa

SEQ ID NO: 142969 - RNA, 64 nt, Homo Sapiens
accucuugcaugaaaauagucucuuaguuauaagaaagaaaaagcccuuuguuuacuuagcuuu

SEQ ID NO: 142970 - RNA, 64 nt, Homo Sapiens
agauacuaaaagucucuucuuacuuucugacuacaaagaaaaacuauacauagaauuugccagu

SEQ ID NO: 142971 - RNA, 64 nt, Homo Sapiens
acuaaucuuggcauccuaucccaaaugaacucuuaaagaaaaaaaaacagugggguuuaguacu

SEQ ID NO: 142972 - RNA, 64 nt, Homo Sapiens
uaacuuaaaauauuuuagcaaaaaaaaaaaagaaaaagaaaauuaaacuuauuuugcuuuaaaa

SEQ ID NO: 142973 - RNA, 64 nt, Homo Sapiens
aaaauuuaacuuaaaauauuuuaaaaaaaaaaaaaaagaaaaagccuuuuaaacuuauuuugcu

SEQ ID NO: 142974 - RNA, 64 nt, Homo Sapiens
ggacuccaguauuuguggccguauuuugugggacaaagaaaaaauuaaguuaacuguaauuacu

SEQ ID NO: 142975 - RNA, 64 nt, Homo Sapiens
cacucccaguccccagcccuacauuuuguuguaaaaagaaaaacccuaguuuuuaguaaucugu

SEQ ID NO: 142976 - RNA, 64 nt, Homo Sapiens
aaaaacaaccaagcgcauccuuuuuuuuuuaaaaaaagaaaaugccccccuaaaauuugugggu

SEQ ID NO: 142977 - RNA, 64 nt, Homo Sapiens
ugauaauacuuucgugauuuaacaauaaaguacuaaagaaaaugacuuaaagguucacuuguaa

SEQ ID NO: 142978 - RNA, 64 nt, Homo Sapiens
caaguuagaagcauaccauuuacuuuaggacauuaaagaaaacuaaauaaaaacuauaaaaaug

SEQ ID NO: 142979 - RNA, 64 nt, Homo Sapiens
uagccagacgugguggcauggucucuacuaaaaaaaagaaaaaugaccaaaauggugaaacccu

SEQ ID NO: 142980 - RNA, 64 nt, Homo Sapiens
ccaguguuucucaucccauuuaaaaugaaauuguaaagaaaauauuaguuuaaugugcucuuug

SEQ ID NO: 142981 - RNA, 64 nt, Homo Sapiens
gaugaacuuggaagcaagagcagaagaggcuaucaaagaaaagaaagaaaagguguagcacuuu

SEQ ID NO: 142982 - RNA, 64 nt, Homo Sapiens
uguagcacuuucagaagaggaguuuacuuguggaaaagaaaaggaacaacaaucagccauaaca

SEQ ID NO: 142983 - RNA, 64 nt, Homo Sapiens
uagcacaaaacuuaagacuuuucucccuuaugaaaaagaaaagauauucaguguucuuccucuu

SEQ ID NO: 142984 - RNA, 64 nt, Homo Sapiens
uguaaauucuauugagcaaaaaccauuuuaaaggaaagaaaauauugauuauacaggcuaugaa

SEQ ID NO: 142985 - RNA, 64 nt, Homo Sapiens
uuuugaaauggcuguuuuuuuauuuuaugauauuaaagaaaaucagcucacuuguccaugaaaa

SEQ ID NO: 142986 - RNA, 64 nt, Homo Sapiens
aaguuacguuaaaaaccaaauuauuuucugcaaaaaagaaaaaacgaagugacaguuuacaaaa

SEQ ID NO: 142987 - RNA, 64 nt, Homo Sapiens
ucuauuuucaugcaaauauuaaaugaucagaacaaaagaaaauuuaugacuagaaguauguaag

SEQ ID NO: 142988 - RNA, 64 nt, Homo Sapiens
uaaaucaaagaugacuucuuuagcagucaauggcaaagaaaaagagguaaggcuuauuuuugau

SEQ ID NO: 142989 - RNA, 64 nt, Homo Sapiens
augauuaauauuuuugucuaaaaaacccuuauuaaaagaaaaacucaaagcuacacuuuugagu

SEQ ID NO: 142990 - RNA, 64 nt, Homo Sapiens
uaagguggcaaccuuauuuuacaccccauuaccaaaagaaaagguuuuucucuuaaaaaaaaua

SEQ ID NO: 142991 - RNA, 64 nt, Homo Sapiens
gacugcacaguugugaaaaaggaagagaaucauuaaagaaaaagaaaaaagauuuuaagaccgu

SEQ ID NO: 142992 - RNA, 64 nt, Homo Sapiens
acaguugugaaaaaggaagagaaucauuaaagaaaaagaaaaaagauuuuaagaccguugaaau

SEQ ID NO: 142993 - RNA, 64 nt, Homo Sapiens
uucaaaucuagacacuaaaugugugugaauguacaaagaaaacaaaccauugcuuaugcuguua

SEQ ID NO: 142994 - RNA, 64 nt, Homo Sapiens
agauuaauaauccaacuuuaauaguauacauuuaaaagaaaaaaaacaaaagcccuggaaguug

SEQ ID NO: 142995 - RNA, 64 nt, Homo Sapiens
cccagggcuugucuggaucagcaccaacgauuuuaaagaaaaaaggaagaguuucuuagaugag

SEQ ID NO: 142996 - RNA, 64 nt, Homo Sapiens
auacuguuaaaaugugcuuacuccuuucccuacaaaagaaaagcgauguuagacauagccauau

SEQ ID NO: 142997 - RNA, 64 nt, Homo Sapiens
aauugaaauguugagagagagugaacugcuaaaaaaagaaaaauucuaguuuccagccauugaa

SEQ ID NO: 142998 - RNA, 64 nt, Homo Sapiens
gguguauccuaucugccccauuauagggccaggaaaagaaaaucagggaccucaggguguggca

SEQ ID NO: 142999 - RNA, 64 nt, Homo Sapiens
gacuuuguugcacuuuuaguguucuaagcaaaggaaagaaaacuguaguaggacaaugaaaauu

SEQ ID NO: 143000 - RNA, 64 nt, Homo Sapiens
cuuuucccauauaauccaacaucugccguuugcaaaagaaaaauuccaggaacuacaagaugcc

SEQ ID NO: 143001 - RNA, 64 nt, Homo Sapiens
auguucacucccacuuauguaagacagagagauuaaagaaaaaugagagagagagagagaggag

SEQ ID NO: 143002 - RNA, 64 nt, Homo Sapiens
aggggcuuaggggauuggaacugggguuuggcugaaagaaaaaaaaaaaaauguaacugaugaa

SEQ ID NO: 143003 - RNA, 64 nt, Homo Sapiens
caaggcccaggacacuugucagaaggaugcaaaaaaagaaaaaaguacauccacccucuuaauc

SEQ ID NO: 143004 - RNA, 64 nt, Homo Sapiens
ggguuuuguuucuguuguuguucaaaugcaaaaaaaagaaaaaaaaagaaaaaaaaaggugacu

SEQ ID NO: 143005 - RNA, 64 nt, Homo Sapiens
ucuguuguuguucaaaugcaaaaaaaagaaaaaaaaagaaaaaaaaaggugacucacauuguua

SEQ ID NO: 143006 - RNA, 64 nt, Homo Sapiens
aauuucgaaagaaauaauuggcaagauaaugagaaaagaaaaaagucaugguaggugagguggu

SEQ ID NO: 143007 - RNA, 64 nt, Homo Sapiens
uuuuguagccaagcagaguuguagagggggauaaaaagaaaagaaauuggauguauuuacagcu

SEQ ID NO: 143008 - RNA, 64 nt, Homo Sapiens
aaaauccaaaagagagaagaaaaaaaaaaagaaaaaagaaaaaaccaaaaaaaaaaaaaaaaaa

SEQ ID NO: 143009 - RNA, 64 nt, Homo Sapiens
gaaaaaaaaaauccaaaagaaaaaaaaaaaaaaaaaagaaaaaauuaaaagccaaaaaaaaaaa

SEQ ID NO: 143010 - RNA, 64 nt, Homo Sapiens
cugucucaaaaaaaaaaaaaaaaaaaaagaaagaaaagaaaacuaacuuccucucaaaaaaaaa

SEQ ID NO: 143011 - RNA, 64 nt, Homo Sapiens
aaacucugucucaaaaaaaaaaaaaaaaaaaaagaaagaaaagaagcaaaacuuccucucaaaa

SEQ ID NO: 143012 - RNA, 64 nt, Homo Sapiens
gcgauuuuauagcuggagaugauuaaaaagggagaaagaaaacuggggggguucucccccuccu

SEQ ID NO: 143013 - RNA, 64 nt, Homo Sapiens
gggggguucucccccuccugacucagaaauggacaaagaaaacguguguguuggcaaaagagcu

SEQ ID NO: 143014 - RNA, 64 nt, Homo Sapiens
gugaaaggugauggguuuuauucguugggcuuuaaaagaaaagguuuggcagaacuaaaaacaa

SEQ ID NO: 143015 - RNA, 64 nt, Homo Sapiens
aucaaacuaaauguccaucagugguagaaaggauaaagaaaaugugguggcagggagugguggc

SEQ ID NO: 143016 - RNA, 64 nt, Homo Sapiens
gcaaccaagcgagacucugccuuaaaaaaaaaaaaaagaaaauguggcacauauacaccaugga

SEQ ID NO: 143017 - RNA, 64 nt, Homo Sapiens
uacacaugugccccugaaccuaaaaaaaaaguuaaaagaaaaacguuuggauuauuuucccucu

SEQ ID NO: 143018 - RNA, 64 nt, Homo Sapiens
ccagccugggugacagagcgagacuccguaucagaaagaaaaagaggaacugaaugaaaucuca

SEQ ID NO: 143019 - RNA, 64 nt, Homo Sapiens
gagccugggcaacauagugagaccccaucucuacaaagaaaaaaaaauuagcuggacaugguaa

SEQ ID NO: 143020 - RNA, 64 nt, Homo Sapiens
gcccaacuugggaguggggaaauugcuuaaaaaaaaagaaaaagaaaaaaaaaaagauuauucu

SEQ ID NO: 143021 - RNA, 64 nt, Homo Sapiens
cuugggaguggggaaauugcuuaaaaaaaaagaaaaagaaaaaaaaaaagauuauucuaaauaa

SEQ ID NO: 143022 - RNA, 64 nt, Homo Sapiens
cugugaauguagaagugggggggaggggggagaaaaagaaaacucuggcguuagaggauauaga

SEQ ID NO: 143023 - RNA, 64 nt, Homo Sapiens
aaaccaaaauuuaaaugaucagaauuggcagcacaaagaaaacgcccucuccugacuuguauug

SEQ ID NO: 143024 - RNA, 64 nt, Homo Sapiens
uguuuuuuugcagcuugcugauauuuuauauaaaaaagaaaagcaaagcaaaagagaagcugau

SEQ ID NO: 143025 - RNA, 64 nt, Homo Sapiens
gcugauagucuugaauauuuuauuuuuuuaaugaaaagaaaaaacaagaaaguuauguuucaua

SEQ ID NO: 143026 - RNA, 64 nt, Homo Sapiens
accuuccuuauauuuuuuuccucaacaguuuuaaaaagaaaaaaaggucuauuuuuuuuucucc

SEQ ID NO: 143027 - RNA, 64 nt, Homo Sapiens
auuugauggccuuuugaugaaugucuuccacaguaaagaaaacuuaguggcuuaauuuaggaaa

SEQ ID NO: 143028 - RNA, 64 nt, Homo Sapiens
aaugcauauuuuugcacaguggagcuuacacuuaaaagaaaacaaagccccaugggcugccuug

SEQ ID NO: 143029 - RNA, 64 nt, Homo Sapiens
uuuaaagaguuggaggaauuggggauugaguuguaaagaaaacuuacagaagaggcaacaauuu

SEQ ID NO: 143030 - RNA, 64 nt, Homo Sapiens
ucauauuuaaagccaaauguaaauagaggucuguaaagaaaaauaauugccauagaaaguauaa

SEQ ID NO: 143031 - RNA, 64 nt, Homo Sapiens
uuuggacuuuguaauuauuuuuuuagcaguaauuaaagaaaaaaguccucugugaggaauauuc

SEQ ID NO: 143032 - RNA, 64 nt, Homo Sapiens
gaguauuuuuguacagauuugcuuucucuuacaaaaagaaaaaaaaaauccuguuguauuaaca

SEQ ID NO: 143033 - RNA, 64 nt, Homo Sapiens
cuauugaaauaaaauaaaauauaaaaagaaagagaaagaaaagaaaauaguuccaauuuaucau

SEQ ID NO: 143034 - RNA, 64 nt, Homo Sapiens
gaaauaaaauaaaauauaaaaagaaagagaaagaaaagaaaauaguuccaauuuaucaugccaa

SEQ ID NO: 143035 - RNA, 64 nt, Homo Sapiens
ggcucgccgugagccaggucuaaaguuugaagaaaaagaaaaaucuuaaaaaaaaaaaaaaaaa

SEQ ID NO: 143036 - RNA, 64 nt, Homo Sapiens
aaaagaaaaaucuuaaaaaaaaaaaaaaaaaaaaaaagaaaaaaagaaaaacaggaaaaaggac

SEQ ID NO: 143037 - RNA, 64 nt, Homo Sapiens
aaucuuaaaaaaaaaaaaaaaaaaaaaaagaaaaaaagaaaaacaggaaaaaggacuuuuuuuu

SEQ ID NO: 143038 - RNA, 64 nt, Homo Sapiens
ucugcuagucuuggcaaacaauacagaauguuuaaaagaaaaaccccccagucugacauauuuc

SEQ ID NO: 143039 - RNA, 64 nt, Homo Sapiens
aaugaauuagaagagaucccgugcacaauguuuaaaagaaaaacuucuaugugaauauaagcuu

SEQ ID NO: 143040 - RNA, 64 nt, Homo Sapiens
aaagucuuugguaaauggcacagcuuuaaaagaaaaagaaaaaaguuuucccuugaggaaacaa

SEQ ID NO: 143041 - RNA, 64 nt, Homo Sapiens
aaaaaaaaagucuuugguaaaaacaacagcuuuaaaagaaaaaggauaaaguuuucccuugagg

SEQ ID NO: 143042 - RNA, 64 nt, Homo Sapiens
acagaaagagaaauaggaggcaagaagaaggaagaaagaaaaagaaaaaaagaaaaagaaaaag

SEQ ID NO: 143043 - RNA, 64 nt, Homo Sapiens
caagaagaaggaagaaagaacuuaaaaaaaagaaaaagaaaaagucaaaucucuugcuuucuuu

SEQ ID NO: 143044 - RNA, 64 nt, Homo Sapiens
aaaaagcaagaagaaggaaguucuuucuuaaaaaaaagaaaaagcaagauucaaaucucuugcu

SEQ ID NO: 143045 - RNA, 64 nt, Homo Sapiens
augcgaaaagauccuguuuugaacuaaaauguggaaagaaaagauuuuuguucuaagaugcaug

SEQ ID NO: 143046 - RNA, 64 nt, Homo Sapiens
uuguauauacuuugccacuguaaaaacagaaaacaaagaaaagcucacauccccgaugcuaaau

SEQ ID NO: 143047 - RNA, 64 nt, Homo Sapiens
uugccuuuuucuaggaacugauggauacaaagauaaagaaaaugcaugucggcguucuuggcca

SEQ ID NO: 143048 - RNA, 64 nt, Homo Sapiens
uuuauguugcaggguauugcugcagauccuuggaaaagaaaauguggagcaucauguccacccc

SEQ ID NO: 143049 - RNA, 64 nt, Homo Sapiens
aaucccuuucuuguaaacuuaaaaaaagaaaaaaaaagaaaaaauagaaacuuugcuaguuaaa

SEQ ID NO: 143050 - RNA, 64 nt, Homo Sapiens
aaagaaaaaaaaucccuuucgcuaguuaaaaaaaaaagaaaaaagaaaguauaauagaaacuuu

SEQ ID NO: 143051 - RNA, 64 nt, Homo Sapiens
gagcugcagaguauuuauaauauguuuaaaaguuaaagaaaaaacaaaguuauuaaauuaauua

SEQ ID NO: 143052 - RNA, 64 nt, Homo Sapiens
uuuuauaaagagacucaaagcuaaugauagcuuaaaagaaaaguuaaugccuucucauuggaaa

SEQ ID NO: 143053 - RNA, 64 nt, Homo Sapiens
auggaguauaugccugaaaagguuuuggauucagaaagaaaaaggaugguuaguuuaaucagug

SEQ ID NO: 143054 - RNA, 64 nt, Homo Sapiens
aacauuuuaacuuaaugguacuuaaaauaauuuaaaagaaaaauguuaacuuagacauucuuau

SEQ ID NO: 143055 - RNA, 64 nt, Homo Sapiens
uacaacuacaucccauuuuauauuuccaauuguuaaagaaaaauauuucaagaacaaaucuucu

SEQ ID NO: 143056 - RNA, 64 nt, Homo Sapiens
aaaaauacugaauuaguaauuuuaaaagucucacaaagaaaaucccaggccuagauggcugcau

SEQ ID NO: 143057 - RNA, 64 nt, Homo Sapiens
guuuguucaacaucuaaaaaucaaauaagcuaauaaagaaaagagguuuauacugcaaaagaag

SEQ ID NO: 143058 - RNA, 64 nt, Homo Sapiens
aaacugcuuuguguauuguauauuuuuuuaagaaaaagaaaagccuuauuugacuuaugcuugu

SEQ ID NO: 143059 - RNA, 64 nt, Homo Sapiens
acaggugaaucuagagccuacuuuuauuuugguuaaagaaaaagaaaauaucaauaauucaauu

SEQ ID NO: 143060 - RNA, 64 nt, Homo Sapiens
gaaucuagagccuacuuuuauuuugguuaaagaaaaagaaaauaucaauaauucaauuuugugu

SEQ ID NO: 143061 - RNA, 64 nt, Homo Sapiens
aaacaaagaaacaaaaguuuuuuccccauuuuaaaaagaaaagcuuucuuuuauguuuuacagu

SEQ ID NO: 143062 - RNA, 64 nt, Homo Sapiens
acauuuaaauaauguguguaaucuacguuauuggaaagaaaauggcaauaaauauugugguuuu

SEQ ID NO: 143063 - RNA, 64 nt, Homo Sapiens
ugcacuuugcuuuaauauaauaaacaagaaaaauaaagaaaagauauguauugugcaaugugua

SEQ ID NO: 143064 - RNA, 64 nt, Homo Sapiens
auguauuuuauguuauauauaccugagauuuauuaaagaaaaaagaaaggacuccugaaaaaaa

SEQ ID NO: 143065 - RNA, 64 nt, Homo Sapiens
gaugcuacauugugugaauuauaugccuuaccauaaagaaaauucuuuugaauaauugcuuaua

SEQ ID NO: 143066 - RNA, 64 nt, Homo Sapiens
aacuuaguucuaccuugauuacaugaagucaggaaaagaaaagagaggugggucugaaauucau

SEQ ID NO: 143067 - RNA, 64 nt, Homo Sapiens
aguuacacugagaaugaauauuacagaaaaugaaaaagaaaauggaguaauagggaaagaagag

SEQ ID NO: 143068 - RNA, 64 nt, Homo Sapiens
agaaauguaccuguuggcagcaaaaaaaaaaaaaaaagaaaaaagacagagcgagacuccgccu

SEQ ID NO: 143069 - RNA, 64 nt, Homo Sapiens
ucuuuuacuguguuuaauguucuugcacaaagaaaaagaaaauuaaggucuucugacacacuua

SEQ ID NO: 143070 - RNA, 64 nt, Homo Sapiens
aaaauuucuuuuacuguguucacuuaucuugcacaaagaaaaaguuugaaaaggucuucugaca

SEQ ID NO: 143071 - RNA, 64 nt, Homo Sapiens
aagauauccagaaaggagccacagcugacgccaaaaagaaaagaaaaaagauauauauauauau

SEQ ID NO: 143072 - RNA, 64 nt, Homo Sapiens
auccagaaaggagccacagcugacgccaaaaagaaaagaaaaaagauauauauauauauauaua

SEQ ID NO: 143073 - RNA, 64 nt, Homo Sapiens
ugggcaacaagagcaaaacuccgucucaaaauaaaaagaaaagaaaagaauggacaguguuugc

SEQ ID NO: 143074 - RNA, 64 nt, Homo Sapiens
aacaagagcaaaacuccgucucaaaauaaaaagaaaagaaaagaauggacaguguuugcagaga

SEQ ID NO: 143075 - RNA, 64 nt, Homo Sapiens
caaagacucuuguccucuugucccuccugagaaaaaagaaaacgaaaagugggguuuuuuucug

SEQ ID NO: 143076 - RNA, 64 nt, Homo Sapiens
uuuuaauuguaacauuuuuagaaaaagaacaaaaaaagaaaaaaaaaagaaagaaacacagcaa

SEQ ID NO: 143077 - RNA, 64 nt, Homo Sapiens
ggaagggaccuugcagggaccucucccuccaaaaaaagaaaaaaagaaaaagaaagaaaaaaua

SEQ ID NO: 143078 - RNA, 64 nt, Homo Sapiens
ccuugcagggaccucucccuccaaaaaaagaaaaaaagaaaaagaaagaaaaaauaaaugagga

SEQ ID NO: 143079 - RNA, 64 nt, Homo Sapiens
accucucccuccaaaaaaagaaaaaaagaaaaagaaagaaaaaauaaaugaggaaacguguugc

SEQ ID NO: 143080 - RNA, 64 nt, Homo Sapiens
auaaacaaacuaauaaaaagcaaaaaaaaaaaaaaaagaaaagaaaaaacacugcauuugggca

SEQ ID NO: 143081 - RNA, 64 nt, Homo Sapiens
caaacuaauaaaaagcaaaaaaaaaaaaaaaagaaaagaaaaaacacugcauuugggcaccauc

SEQ ID NO: 143082 - RNA, 64 nt, Homo Sapiens
ucucaaaaaaaaaaaaaaaaaaaaggaaagaaagaaagaaaagaaaagaaaauccuuuuugcuu

SEQ ID NO: 143083 - RNA, 64 nt, Homo Sapiens
aaaaaaaaaaaaaaaaaaaggaaagaaagaaagaaaagaaaagaaaauccuuuuugcuuuaacu

SEQ ID NO: 143084 - RNA, 64 nt, Homo Sapiens
aaaaaaaaaaaaaaggaaagaaagaaagaaaagaaaagaaaauccuuuuugcuuuaacuugccu

SEQ ID NO: 143085 - RNA, 64 nt, Homo Sapiens
ggaaggaaaaagaaagagaaagagagagagagagaaagaaaaagaaagaaaaguaagaaagaaa

SEQ ID NO: 143086 - RNA, 64 nt, Homo Sapiens
agaaagagaaagagagagagagagaaagaaaaagaaagaaaaguaagaaagaaaaaagaaaaag

SEQ ID NO: 143087 - RNA, 64 nt, Homo Sapiens
gagagagagagaaagaaaaagaaagaaaaguaagaaagaaaaaagaaaaagaaagaaaaguaag

SEQ ID NO: 143088 - RNA, 64 nt, Homo Sapiens
agagaaagaaaaagaaagaaaaguaagaaagaaaaaagaaaaagaaagaaaaguaagaaagaaa

SEQ ID NO: 143089 - RNA, 64 nt, Homo Sapiens
aaagaaagaaaaguaagaaagaaaaaagaaaaagaaagaaaaguaagaaagaaaaaaagaaaaa

SEQ ID NO: 143090 - RNA, 64 nt, Homo Sapiens
uuaggcagcaagaauuggagaacucacacugcgaaaagaaaaccuuggguggcagugauuugaa

SEQ ID NO: 143091 - RNA, 64 nt, Homo Sapiens
gagacuccaucuuaaaaaaaaaaaaaaaaaaaagaaagaaaagaaaauggaguucugagagcua

SEQ ID NO: 143092 - RNA, 64 nt, Homo Sapiens
uccaucuuaaaaaaaaaaaaaaaaaaaagaaagaaaagaaaauggaguucugagagcuaggaaa

SEQ ID NO: 143093 - RNA, 64 nt, Homo Sapiens
uccagucuggcaacagagcaagacuccaucucaaaaagaaaagaaaagaagacucugaccugua

SEQ ID NO: 143094 - RNA, 64 nt, Homo Sapiens
ucuggcaacagagcaagacuccaucucaaaaagaaaagaaaagaagacucugaccuguacucuu

SEQ ID NO: 143095 - RNA, 64 nt, Homo Sapiens
agacagauuuauaguugaagccuacgagauguauaaagaaaagcuguuaccaaucuuacugaaa

SEQ ID NO: 143096 - RNA, 64 nt, Homo Sapiens
auucuaauaccaaaaccugacaggcacaaugaaaaaagaaaacuucaggcugguacuccugacg

SEQ ID NO: 143097 - RNA, 64 nt, Homo Sapiens
aucaacguaaaugcccaucagcaguagaccagauaaagaaaauuugguacauauacaccaugga

SEQ ID NO: 143098 - RNA, 64 nt, Homo Sapiens
uuuuaaaugaaaaggugaaaguucucaacuuaaaaaagaaaagaaaaaaaucauauacugaggu

SEQ ID NO: 143099 - RNA, 64 nt, Homo Sapiens
aaugaaaaggugaaaguucucaacuuaaaaaagaaaagaaaaaaaucauauacugagguugcua

SEQ ID NO: 143100 - RNA, 64 nt, Homo Sapiens
uuuuugucgauucuuauucuucuacauauuauggaaagaaaauaaaaaaaagaaacaaaccacc

SEQ ID NO: 143101 - RNA, 64 nt, Homo Sapiens
aaaaaaaagaaacaaaccacaaaaaguaaaaagaaaagaaaaaacugccaggggcgggcaaaaa

SEQ ID NO: 143102 - RNA, 64 nt, Homo Sapiens
aaaaaaaaaaaaagaaacaaaaaaaaaaaaguaaaaagaaaagagagcucugccaggggcgggc

SEQ ID NO: 143103 - RNA, 64 nt, Homo Sapiens
gggcaugcgcuuguuggcaaucucuccucaaaggaaagaaaacacuccccgggacuccagaauu

SEQ ID NO: 143104 - RNA, 64 nt, Homo Sapiens
agacaaauuacccagaaaccugucucaagaaagaaaagaaaaagugggcgacacagcgagaccc

SEQ ID NO: 143105 - RNA, 64 nt, Homo Sapiens
aaaagagacaaauuacccaggacccugucucaagaaagaaaagacagccugggcgacacagcga

SEQ ID NO: 143106 - RNA, 64 nt, Homo Sapiens
cacagaagagauuuaaaaaaaaaaagcaacaaaaaaagaaaacaaacacaaacagaagaggaaa

SEQ ID NO: 143107 - RNA, 64 nt, Homo Sapiens
aucaaaaaagcgacaaaaaacugcaaggaacaaaaaagaaaaaaaaacgucuguggagcuucug

SEQ ID NO: 143108 - RNA, 64 nt, Homo Sapiens
uuuuggcagguuauguuuacagacaaaaaaaaaaaaagaaaauaaaaaaaaaaaacacaaaaaa

SEQ ID NO: 143109 - RNA, 64 nt, Homo Sapiens
aaucucaucacuugaagccaaaaaaaaaaaaagaaaagaaaaaaaaagaaaaaaaaaagacaaa

SEQ ID NO: 143110 - RNA, 64 nt, Homo Sapiens
aaaaaaaucucaucacuugaacaaaaaaaaaaaaaaagaaaagaauggaaaagaaaaaaaaaag

SEQ ID NO: 143111 - RNA, 64 nt, Homo Sapiens
aaaagacaaaaaaaaaaaaauucaacgaaauggaaaagaaaaaauuccccauugcuguaaauau

SEQ ID NO: 143112 - RNA, 64 nt, Homo Sapiens
ucuacauauuaaaacuuguguaucucaaagaaaaaaagaaaauugggcaacaagagcaaaacuc

SEQ ID NO: 143113 - RNA, 64 nt, Homo Sapiens
agaaaauuucuacauauuaacaaaacucuaucucaaagaaaaaauccagccugggcaacaagag

SEQ ID NO: 143114 - RNA, 64 nt, Homo Sapiens
gaggaugaauaacaaguuugcuuuuguucauacaaaagaaaaaugaugauauaucuggaauguc

SEQ ID NO: 143115 - RNA, 64 nt, Homo Sapiens
ccagaaaaaguuggugccccaaaaaaagaaaagaaaagaaaaagagcaacacucugucucaaaa

SEQ ID NO: 143116 - RNA, 64 nt, Homo Sapiens
aaaagccagaaaaaguuggucaaaaaaaaaaagaaaagaaaagaagcagagcaacacucugucu

SEQ ID NO: 143117 - RNA, 64 nt, Homo Sapiens
aaagaaaaagccagaaaaagugucucaaaaaaaaaaagaaaagaugggcagcagagcaacacuc

SEQ ID NO: 143118 - RNA, 64 nt, Homo Sapiens
aaacugaucaaaagcauaauugaaaguucugaaaaaagaaaaauaauaauauguagaaaaaugu

SEQ ID NO: 143119 - RNA, 64 nt, Homo Sapiens
aauaauauuaauauuacuugaaauagacuaagauaaagaaaaggggucuguaugaugugcaguu

SEQ ID NO: 143120 - RNA, 64 nt, Homo Sapiens
cugcgaguaauaaauuaguuaaaacugcaaauagaaagaaaacaccaaaaauaaagaaaagagc

SEQ ID NO: 143121 - RNA, 64 nt, Homo Sapiens
uuaaaacugcaaauagaaagaaaacaccaaaaauaaagaaaagagcaaaaguggccaaaaaaug

SEQ ID NO: 143122 - RNA, 64 nt, Homo Sapiens
caaaaaaaaaaaaaaaaaaaaaaaaaacagaaagaaagaaaaagaaaacugcagauaacccuau

SEQ ID NO: 143123 - RNA, 64 nt, Homo Sapiens
aaaaaaaaaaaaaaaaaaaaacagaaagaaagaaaaagaaaacugcagauaacccuauacauua

SEQ ID NO: 143124 - RNA, 64 nt, Homo Sapiens
uuguacucagcuguguucaugugguggucuguggaaagaaaagaagacucauuuggaaaugaag

SEQ ID NO: 143125 - RNA, 64 nt, Homo Sapiens
caagacacgcacagucaaccauuuuccgagaaaaaaagaaaauuccccacuuggaaagaaagag

SEQ ID NO: 143126 - RNA, 64 nt, Homo Sapiens
ggccacugcagaugacucuccuuugaaaugagaaaaagaaaagaaagcaagaacagaaaacgaa

SEQ ID NO: 143127 - RNA, 64 nt, Homo Sapiens
uaguggaaucuacuuucauuguuaacacugagcuaaagaaaaaaagccguguguuuuaugaaug

SEQ ID NO: 143128 - RNA, 64 nt, Homo Sapiens
agccugggcaacauagcgagaccucaucuccaaaaaagaaaacaaaaaacaaaaaaaggaauga

SEQ ID NO: 143129 - RNA, 64 nt, Homo Sapiens
gaguccaucuguuuguccaucugcugaaaugagaaaagaaaaauuuaugcacugauuuaaaaca

SEQ ID NO: 143130 - RNA, 64 nt, Homo Sapiens
aaauuuaugcacugauuuaaaacaaaccaaaaaaaaagaaaaaaacaaaaaaaaaaaucccucc

SEQ ID NO: 143131 - RNA, 64 nt, Homo Sapiens
agcacacccgugguugugaaaauaguauagcaaaaaagaaaaauccccgguuauugauguacua

SEQ ID NO: 143132 - RNA, 64 nt, Homo Sapiens
uuuuuuaaaccagaauaaacuagaaagaaaagaaaaagaaaaucuaaccaggacuauguagaag

SEQ ID NO: 143133 - RNA, 64 nt, Homo Sapiens
aaaaucuuuuuuaaaccagauagaaguagaaagaaaagaaaaaguuaauuuaaccaggacuaug

SEQ ID NO: 143134 - RNA, 64 nt, Homo Sapiens
aaaagaaaaucuuuuuuaaacuauguagaaguagaaagaaaagauuguauuaauuuaaccagga

SEQ ID NO: 143135 - RNA, 64 nt, Homo Sapiens
agaaaaaaucccugcccuccauccuguguuuaaaaaagaaaaaaaaauaagaauuuuaauaaaa

SEQ ID NO: 143136 - RNA, 64 nt, Homo Sapiens
cuguaggcagggagcccucuuucucaaauauggaaaagaaaaccuuauuuuauugugcaaacau

SEQ ID NO: 143137 - RNA, 64 nt, Homo Sapiens
uuccgggcauuuugcaucagaaaaagaaaaaaaaaaagaaaaaggguauuuuuguuuguaaguu

SEQ ID NO: 143138 - RNA, 64 nt, Homo Sapiens
aaaaagaaaaaguuccgggcuguuuguaaguuaaaaagaaaaaaguuuauuauuacgguauuuu

SEQ ID NO: 143139 - RNA, 64 nt, Homo Sapiens
gauuuaaaaaaaaaaaaaaaaaaaaaaaaaagaaaaagaaaaacuauuaacuuuaacuuauuaa

SEQ ID NO: 143140 - RNA, 64 nt, Homo Sapiens
aaaaacgauuuaaaaaaaaauauuaaaaaaaaaaaaagaaaaaguauuuguauuaacuuuaacu

SEQ ID NO: 143141 - RNA, 64 nt, Homo Sapiens
gggagagaugaguggguuagaaaauagaagcuauaaagaaaagacguuauuuuucucuuuaaaa

SEQ ID NO: 143142 - RNA, 64 nt, Homo Sapiens
cauugaaagcucuauggauucuaagagggugaacaaagaaaagaggguccaggggagggaaaag

SEQ ID NO: 143143 - RNA, 64 nt, Homo Sapiens
ucguuguuguuguuuuucugucccgucgauaaggaaagaaaauggcuuccagaaccauaaaaua

SEQ ID NO: 143144 - RNA, 64 nt, Homo Sapiens
auuacaaagcagggguuuagguguauuaccuuguaaagaaaaaaugagugccaagucagaaagu

SEQ ID NO: 143145 - RNA, 64 nt, Homo Sapiens
aauuucuacaguagucuuucgugucuugaaggcaaaagaaaaaaccacguuucuuuguugagcu

SEQ ID NO: 143146 - RNA, 64 nt, Homo Sapiens
aaaaaccacguuucuuuguuaaaaaaaaaagaaaaaagaaaaaaacaagcuaagagagcuugca

SEQ ID NO: 143147 - RNA, 64 nt, Homo Sapiens
gaaaaaaaaaaaccacguuugcuugcaaaaaaaaaaagaaaaaaugaaugcacaagcuaagaga

SEQ ID NO: 143148 - RNA, 64 nt, Homo Sapiens
aacuccuuuauuaaaaacaauuuauauaggauugaaagaaaauuaaguuuuuaauugcuauugu

SEQ ID NO: 143149 - RNA, 64 nt, Homo Sapiens
cguuucuguaacagagagaaagcucuucagugugaaagaaaacauauauuccuguuucuaaauc

SEQ ID NO: 143150 - RNA, 64 nt, Homo Sapiens
aguaacuacagagaggacguuucccuguuuagggaaagaaaaaacaucuucagaucauaggucc

SEQ ID NO: 143151 - RNA, 64 nt, Homo Sapiens
uguucucacagcaccguuccgacagggaccagugaaagaaaagagacaaaguuagaacgugcug

SEQ ID NO: 143152 - RNA, 64 nt, Homo Sapiens
guagauguaguugcuuaguagcauuuuggaaaaaaaagaaaaaaagguuugguuugguuuugug

SEQ ID NO: 143153 - RNA, 64 nt, Homo Sapiens
aaacuccgucucaaaaaaaaaaaaaaaaaaaaagaaagaaaagaguaacagaaagauagggauu

SEQ ID NO: 143154 - RNA, 64 nt, Homo Sapiens
uugaauuucucaaauguuugucagcuuaaaacauaaagaaaacccaaaaucuccauauauagga

SEQ ID NO: 143155 - RNA, 64 nt, Homo Sapiens
uaacaguuugauuucugucaccacagggaccaagaaagaaaauauuuguuuccuuuaagaaaaa

SEQ ID NO: 143156 - RNA, 64 nt, Homo Sapiens
cuuuacaagauaagacugaaacuguuuauauacuaaagaaaaaguauaauuguaaagcuuguua

SEQ ID NO: 143157 - RNA, 64 nt, Homo Sapiens
gaauaauggagcauuguuuuaaaccccaagcagaaaagaaaauguacaucuuggcuucuggccc

SEQ ID NO: 143158 - RNA, 64 nt, Homo Sapiens
uugucugccuuuauuuccaucuaagcgaaauaaaaaagaaaaggagacacucuuugcauuuugu

SEQ ID NO: 143159 - RNA, 64 nt, Homo Sapiens
gggugggugggaaaucagccacacaagaggcaagaaagaaaacauucugacuggaaguucuauc

SEQ ID NO: 143160 - RNA, 64 nt, Homo Sapiens
gccaaaauauauuaaaaaaacaauauuuauaauuaaagaaaauuaccuuuuuuuuacggaauuc

SEQ ID NO: 143161 - RNA, 64 nt, Homo Sapiens
auagcagauaucauguaggaaagagaggauaaacaaagaaaaaagaaaaaaaaauaagcucaua

SEQ ID NO: 143162 - RNA, 64 nt, Homo Sapiens
auaucauguaggaaagagaggauaaacaaagaaaaaagaaaaaaaaauaagcucauacccaaau

SEQ ID NO: 143163 - RNA, 64 nt, Homo Sapiens
guuuagauucuugauaaagauggaaauggaagagaaagaaaauuauauauguauauacuaaaga

SEQ ID NO: 143164 - RNA, 64 nt, Homo Sapiens
uugauuucuuaaugaugacuucaaaaauuaauaaaaagaaaagaaaaaaaugauuucuggccgg

SEQ ID NO: 143165 - RNA, 64 nt, Homo Sapiens
uucuuaaugaugacuucaaaaauuaauaaaaagaaaagaaaaaaaugauuucuggccgggcgug

SEQ ID NO: 143166 - RNA, 64 nt, Homo Sapiens
ugccucaucgauaccccauuuagcuccagaaagcaaagaaaacucgaguaacacuuguuugaaa

SEQ ID NO: 143167 - RNA, 64 nt, Homo Sapiens
aauuuuguguugauucagcuaaauuaugaaaaauaaagaaaaacuccuuugauaagcauggcuu

SEQ ID NO: 143168 - RNA, 64 nt, Homo Sapiens
gaagcccaaacuagugagaguuuuguaaaaagaaaaagaaaaaaauuucucuuuccagcugcug

SEQ ID NO: 143169 - RNA, 64 nt, Homo Sapiens
aaaaaagaagcccaaacuagcugcuguuuuguaaaaagaaaaagaccuacauuucucuuuccag

SEQ ID NO: 143170 - RNA, 64 nt, Homo Sapiens
gaucugcggaaguaaccacaaaauauuaucgaaaaaagaaaagaauucuaaugaccagccguga

SEQ ID NO: 143171 - RNA, 64 nt, Homo Sapiens
ucuguuuuuuaaccuuuuguuccgccauuuaaaaaaagaaaaaaaaaaagcuuauguuucuugu

SEQ ID NO: 143172 - RNA, 64 nt, Homo Sapiens
uauacuauguauauagaagaacauguauauugagaaagaaaacauacuuauauagaggaauuua

SEQ ID NO: 143173 - RNA, 64 nt, Homo Sapiens
uuggaauuucuuugaauucuguuaguaaugcccaaaagaaaagucucaagcagucccccuaucc

SEQ ID NO: 143174 - RNA, 64 nt, Homo Sapiens
cuauguugguucacauguacaucuacuuuauaugaaagaaaaaacaguugucugccuguaaaau

SEQ ID NO: 143175 - RNA, 64 nt, Homo Sapiens
agauaaucugauugcuguuguuuuguuuguuuggaaagaaaaaaaaugucuggcuucuucuacu

SEQ ID NO: 143176 - RNA, 64 nt, Homo Sapiens
uuugaacauuuacaaaaugucacacuuuuucuuaaaagaaaaauauuuugggguuugaauaaaa

SEQ ID NO: 143177 - RNA, 64 nt, Homo Sapiens
gcaugacccuccaaguagaccuguggcuuaaaauaaagaaaaugcagcaaaaagaaugcuauag

SEQ ID NO: 143178 - RNA, 64 nt, Homo Sapiens
agccaacauuuaaaauuuauguuuuaugucaauaaaagaaaauauacuuuauugugacuucaac

SEQ ID NO: 143179 - RNA, 64 nt, Homo Sapiens
uuuuguuaacuugauaauucuucaucuaccuuaaaaagaaaaaaauuacacauagucauucuug

SEQ ID NO: 143180 - RNA, 64 nt, Homo Sapiens
aaauggguugccaacauaagcuggcugagaaauaaaagaaaacaagacaguuguucauaaaguu

SEQ ID NO: 143181 - RNA, 64 nt, Homo Sapiens
guguaucaucaauaaaauuguauguuaaugcuggaaagaaaaaaagaagaaagaaagaaaccau

SEQ ID NO: 143182 - RNA, 64 nt, Homo Sapiens
uaaaauggguauugauuuuuaggacgguuuugaaaaagaaaaguguugggaaugaagcaaguga

SEQ ID NO: 143183 - RNA, 64 nt, Homo Sapiens
agcaaaucaauaacucuaaauucugggcugauauaaagaaaaaaacaauauuggauuuggauuu

SEQ ID NO: 143184 - RNA, 64 nt, Homo Sapiens
uuugaguugcaaaaaguuuauaaaugcaaagcaaaaagaaaacauuuauuuucugagucugcag

SEQ ID NO: 143185 - RNA, 64 nt, Homo Sapiens
uuggacgagaaaacaauaacgauaaaagacagugaaagaaaauaacgauaaaagacagugaaag

SEQ ID NO: 143186 - RNA, 64 nt, Homo Sapiens
agacagugaaagaaaauaacgauaaaagacagugaaagaaaauaacaauaaaagacaaggaaaa

SEQ ID NO: 143187 - RNA, 64 nt, Homo Sapiens
aaugagaaaaaaguaagaaaauaaaaaagagaaaaaagaaaaaaaaaaaauauacuugcuaucu

SEQ ID NO: 143188 - RNA, 64 nt, Homo Sapiens
guuuuuagaaaugcguacaagugaccucuagaaaaaagaaaaguugauauaucaguguuugaga

SEQ ID NO: 143189 - RNA, 64 nt, Homo Sapiens
guauauagcugugaguuuaaagagacuuuguaaaaaagaaaaaugccagccugaacuauauuua

SEQ ID NO: 143190 - RNA, 64 nt, Homo Sapiens
auucaaguaugacaauauacggaauuguguuuuuaaagaaaagcuuguaauauauauaaggacu

SEQ ID NO: 143191 - RNA, 64 nt, Homo Sapiens
ggguuugggcuuugcuuuagaaaaaaaaaaaaaaaaagaaaacuuuaagaauuccaaaaaaaaa

SEQ ID NO: 143192 - RNA, 64 nt, Homo Sapiens
uuguuuuugacuaugggaguuuacuugaauuguuaaagaaaacauuauucauguacaauuuugg

SEQ ID NO: 143193 - RNA, 64 nt, Homo Sapiens
cauaaaauauugagcugaugucccuuagaaugggaaagaaaaauaaaguaagaaagaaaaggac

SEQ ID NO: 143194 - RNA, 64 nt, Homo Sapiens
acucccuuagaaugggaaagaaaaaaaaaguaagaaagaaaagggagacuccaucucaaaaaaa

SEQ ID NO: 143195 - RNA, 64 nt, Homo Sapiens
aauuauuaaauguuucucacuucauuuucuuaaaaaagaaaaaauuuuccucaaguuacuuucc

SEQ ID NO: 143196 - RNA, 64 nt, Homo Sapiens
agccaugauguacccuccgacuuaagcaucgaaaaaagaaaaaaucaaggucaguucaggaaag

SEQ ID NO: 143197 - RNA, 64 nt, Homo Sapiens
auuuaauguugaacaaaauaauacuuguuuuuguaaagaaaaauuuuaaaaauuagccuaagau

SEQ ID NO: 143198 - RNA, 64 nt, Homo Sapiens
aaaccaaaaguuauuaaaauuaaagauagaguaaaaagaaaacagaauguaagguauaucauuc

SEQ ID NO: 143199 - RNA, 64 nt, Homo Sapiens
auuaaaaaagcuaauauuugaauaaagggugaggaaagaaaaauaaauauuuuuuuccuaaagg

SEQ ID NO: 143200 - RNA, 64 nt, Homo Sapiens
agagucagcuacugagagcuauuuuagucacagaaaagaaaagcagaacauuaaaucuguuucc

SEQ ID NO: 143201 - RNA, 64 nt, Homo Sapiens
ggggcaaggagccccgcggcaagaaaagaaggaaaaagaaaaaaucuucuuucccauuuuaaaa

SEQ ID NO: 143202 - RNA, 64 nt, Homo Sapiens
aggaaaaagaaaaaaggggcuuucccauuuuaaaaaagaaaagacuucuacccucccccucuuc

SEQ ID NO: 143203 - RNA, 64 nt, Homo Sapiens
ggaucccaaucugagaaaaggagauccuaauaugaaagaaaaauccagggcaaauggaaaacag

SEQ ID NO: 143204 - RNA, 64 nt, Homo Sapiens
augaugacauuaggcuucuauugugauggccaagaaagaaaauguaacaaugucuucuugaaau

SEQ ID NO: 143205 - RNA, 64 nt, Homo Sapiens
acugcucagcaauguaaaagagacaaauaaggagaaagaaaaucuccaaaccaggaauguuuuu

SEQ ID NO: 143206 - RNA, 64 nt, Homo Sapiens
ugauauaucaguguuugggagugaccucuagaaaaaagaaaacuguuuuuagaaauacauaaaa

SEQ ID NO: 143207 - RNA, 64 nt, Homo Sapiens
gaggggguggggagguaaauuccucugacuugccaaagaaaaagaagggaaccacaguggauau

SEQ ID NO: 143208 - RNA, 64 nt, Homo Sapiens
gcauuccugaauaauuuccaaauguuuuuaauccaaagaaaaagguuuaaagcuuauuucccuu

SEQ ID NO: 143209 - RNA, 62 nt, Homo Sapiens
aaagugucuguacagcagccauccaaguugccccuacuuaguggcuugcccucugccugccu

SEQ ID NO: 143210 - RNA, 62 nt, Homo Sapiens
acacaaguauaagacuuuuuguauuacugcucccuacuuaacauacuugaauucucaaauuu

SEQ ID NO: 143211 - RNA, 62 nt, Homo Sapiens
acuggauguugacuguuaacuagaagcucuguccuacuuacagcacuuuggaucaucaaaaa

SEQ ID NO: 143212 - RNA, 62 nt, Homo Sapiens
uauuuuccuguuacuacuguauaaagcuuaaaccuacuuaaacaacuacaagcuuuaagguu

SEQ ID NO: 143213 - RNA, 62 nt, Homo Sapiens
acucucucauuuggagggaucaugugaguuggccuacuuacaaguagugaaaguucccuuuu

SEQ ID NO: 143214 - RNA, 62 nt, Homo Sapiens
gcuuccuuauggcuuugcuucccacugggauuccuacuuaggugucugcccucaggggucca

SEQ ID NO: 143215 - RNA, 62 nt, Homo Sapiens
ucucacaccagccucauuuccaacuccgacuuccuacuuagaauguggcaguggcuuuguga

SEQ ID NO: 143216 - RNA, 62 nt, Homo Sapiens
ccucugcaagcuucuugcugaucagaguuccuccuacuuacaacccagggugugaacauguu

SEQ ID NO: 143217 - RNA, 62 nt, Homo Sapiens
gugagacaaacaguuguaaagaugaguuuccaccuacuuauaccagagugcuaagaggaaau

SEQ ID NO: 143218 - RNA, 62 nt, Homo Sapiens
augauccuugagucuccucuggaaccccguucccuacuuagcugaaugccugaggacgugug

SEQ ID NO: 143219 - RNA, 62 nt, Homo Sapiens
uuuauaaagguucucuagucaggguuuucaagccuacuuaccauaagacugcucaguuucca

SEQ ID NO: 143220 - RNA, 62 nt, Homo Sapiens
ugauuucauaaggaaaaccauuccagaugguuccuacuuaaaugccguuuccacaguaaccu

SEQ ID NO: 143221 - RNA, 62 nt, Homo Sapiens
agcugccucauugcaagggccuagaccgcugcccuacuuaaccuccaaggaaugggcuugug

SEQ ID NO: 143222 - RNA, 62 nt, Homo Sapiens
auuuccuuuaaauauauacuuuuuguucauuaccuacuuaauaaguaaaauuucaaaauuga

SEQ ID NO: 143223 - RNA, 62 nt, Homo Sapiens
agauauguugcuuuuuacuuacugauaacaaaccuacuuaagaauuuacauucgauaguguu

SEQ ID NO: 143224 - RNA, 62 nt, Homo Sapiens
uucaaguuaaaaaggcugaucuaugacuggcuccuacuuacaacacacaaugcacacaacuc

SEQ ID NO: 143225 - RNA, 62 nt, Homo Sapiens
guaauucaggacuccaaccaaacagauaccccccuacuuaaugccgaaaguaaaaacacaaa

SEQ ID NO: 143226 - RNA, 62 nt, Homo Sapiens
auagaacaugguuuuggcuagaaaaaaaagaaccuacuuaagaaaaaagaaaaaagagggag

SEQ ID NO: 143227 - RNA, 62 nt, Homo Sapiens
uugugacuuuguuucucaggaaaaaaaauauuccuacuuaaauuuuaagucuauaauucaau

SEQ ID NO: 143228 - RNA, 62 nt, Homo Sapiens
acacauuucaaaguugcccuauggaaaugaauccuacuuagugacaagucaucaaauguuug

SEQ ID NO: 143229 - RNA, 62 nt, Homo Sapiens
cuggccacugauuccuuugagucucacaaaacccuacuuaggucaucagggcaggaguucuc

SEQ ID NO: 143230 - RNA, 62 nt, Homo Sapiens
caugaaaaagugcucaugacauauugagaagaccuacuuacaaaguggcauauauugcaauu

SEQ ID NO: 143231 - RNA, 62 nt, Homo Sapiens
accuucaacuuugcuguaaaccuuuugguuuuccuacuuacucuucuucuguggaguuaucc

SEQ ID NO: 143232 - RNA, 62 nt, Homo Sapiens
caaaaaauucuuaccguaauauuauaucuugcccuacuuauuuacaaaauaauauguuucug

SEQ ID NO: 143233 - RNA, 62 nt, Homo Sapiens
cugagcugagggaacacugaguggacagucggccuacuuacuuguuuuggauccaaggaccu

SEQ ID NO: 143234 - RNA, 55 nt, Homo Sapiens
caagauaagcacgcauuuuuaauuaccuacuuaauguguuacaucuucugcauaa

SEQ ID NO: 143235 - RNA, 62 nt, Homo Sapiens
uauaaacagcucacuacacuuguuggaauuugccuacuuacccaaauguauauaaaauucuc

SEQ ID NO: 143236 - RNA, 62 nt, Homo Sapiens
agugucauauguaaaauggaauagaaucccugccuacuuaaguaacuguuggacaaaugaua

SEQ ID NO: 143237 - RNA, 62 nt, Homo Sapiens
aagcuucauucucuucagugucuucuagaugcccuacuuaaagagaacauuuucuuaugucu

SEQ ID NO: 143238 - RNA, 62 nt, Homo Sapiens
gauauucuagaaaaugucacuuuccuuagucuccuacuuagauuacuuuuuauaaaguuuuu

SEQ ID NO: 143239 - RNA, 62 nt, Homo Sapiens
auggugcucaacacuuguuaauuuauugagcaccuacuuauucuuucaucauucauucaugu

SEQ ID NO: 143240 - RNA, 62 nt, Homo Sapiens
cagucaauuaagaguaaguuacaguaguggacccuacuuauuuaaaauuugauuguuaagau

SEQ ID NO: 143241 - RNA, 62 nt, Homo Sapiens
ucuaccucugccguuuuccugcaauuccgcuuccuacuuaggcaguucagagagaacaauuc

SEQ ID NO: 143242 - RNA, 62 nt, Homo Sapiens
auucauaauuauuuuacauuuaaauuacuguuccuacuuaaguggugagcuugguaaccauu

SEQ ID NO: 143243 - RNA, 62 nt, Homo Sapiens
ugucaauaacugugcauggucugagauuuuacccuacuuauaagcuaacaaguuagccuguu

SEQ ID NO: 143244 - RNA, 62 nt, Homo Sapiens
acugacggguuaacagaaaugcuuugguaauaccuacuuaguuaauuggaggaaguaguaaa

SEQ ID NO: 143245 - RNA, 62 nt, Homo Sapiens
cgcgagaugacauauauagauaaaaaguauagccuacuuaaacacagaaguuuuuauuuuau

SEQ ID NO: 143246 - RNA, 62 nt, Homo Sapiens
aucuaaaauuuguuauucaaaagaaguuauggccuacuuagauauaaaucaauuguuuugca

SEQ ID NO: 143247 - RNA, 62 nt, Homo Sapiens
gauauuuuugggagugacaaacauucucucauccuacuuagccuaccuagauuucucaugac

SEQ ID NO: 143248 - RNA, 62 nt, Homo Sapiens
gcaucuccaggcaaugaguuuuucaaagaaugccuacuuaguaguaagaugaagcucaggau

SEQ ID NO: 143249 - RNA, 62 nt, Homo Sapiens
gcuucaaucacugucauuauucuaauccuacuccuacuuaaauuuuaaguuaugagguuuau

SEQ ID NO: 143250 - RNA, 62 nt, Homo Sapiens
aucuccuaauaacguuuugcuuuagauguuuuccuacuuaguagcuaaaauggucagucuuu

SEQ ID NO: 143251 - RNA, 62 nt, Homo Sapiens
agugcuguguaacccccaguaaacuuaucacgccuacuuaaggagauacugaacauuuugca

SEQ ID NO: 143252 - RNA, 62 nt, Homo Sapiens
cucaggacuugauacccucuggaguuuuguuuccuacuuaaguuauguucaaauuuuaguug

SEQ ID NO: 143253 - RNA, 62 nt, Homo Sapiens
augaaugcaaaucagaaccaaugaucccuuggccuacuuaguuaaaaccaguucauacaucc

SEQ ID NO: 143254 - RNA, 62 nt, Homo Sapiens
uuugugaguuuccaguugauuuguagcaaaugccuacuuaguucuuuguggauuguucuaga

SEQ ID NO: 143255 - RNA, 62 nt, Homo Sapiens
agcacuuacuucguguccgacucuucugagcaccuacuuacaugcauuacugcaugcacuuc

SEQ ID NO: 143256 - RNA, 62 nt, Homo Sapiens
cugcagcucccuggcuucuguggggccccucaccuacuuacccaggugggucccggcucugu

SEQ ID NO: 143257 - RNA, 62 nt, Homo Sapiens
aacuuaagaauuuuuauaccaucuacaucuauccuacuuaugcagaaaaauaggcaauaaga

SEQ ID NO: 143258 - RNA, 62 nt, Homo Sapiens
gaauuuugcaguaacugguauucuuggguuuuccuacuuaauacacaguaauucagaacuug

SEQ ID NO: 143259 - RNA, 62 nt, Homo Sapiens
cccaaauauagaucuuauuucugcucauuuccccuacuuauuaaaaucacaccaaacacuua

SEQ ID NO: 143260 - RNA, 62 nt, Homo Sapiens
uacugcguuuacaguucuuuauuugcgaaaauccuacuuagugcauaaacaguuacuugggg

SEQ ID NO: 143261 - RNA, 62 nt, Homo Sapiens
agcugaaacguggguaaggagugaagcaucaaccuacuuagauuaauuggacgggagacaga

SEQ ID NO: 143262 - RNA, 62 nt, Homo Sapiens
uaauuuaucguguuaggagaagaacgaugauaccuacuuaacaccucagcaucugcgucgug

SEQ ID NO: 143263 - RNA, 62 nt, Homo Sapiens
auuuuuuuaaaagccaccuggguugacaccuuccuacuuauccacuagaugucaucagaggu

SEQ ID NO: 143264 - RNA, 62 nt, Homo Sapiens
gugguguaaucaaacccgaugcuuucagaugaccuacuuacaucuucaauguggauaagaua

SEQ ID NO: 143265 - RNA, 62 nt, Homo Sapiens
acgguaccaauccuaggaacuguauacuaguuccuacuuagaacaaaaguaucaaguuugca

SEQ ID NO: 143266 - RNA, 62 nt, Homo Sapiens
auguuagaauaagacuaccauucuaaauaucaccuacuuaugaauaacauguaauaauuuuu

SEQ ID NO: 143267 - RNA, 62 nt, Homo Sapiens
uauuaaugcuaucaucucgaccaagcucaaagccuacuuauuagaaacaaugaaguucacaa

SEQ ID NO: 143268 - RNA, 62 nt, Homo Sapiens
ccgcauuuccaguuguauuagccaauagauuuccuacuuauuuaagcuauuugagcuccggg

SEQ ID NO: 143269 - RNA, 62 nt, Homo Sapiens
auuugcaucaguauaauauauuauuuuuaugcccuacuuaauaauucuaucuuugauaaauu

SEQ ID NO: 143270 - RNA, 62 nt, Homo Sapiens
gaaaaggagaaaauaauuaacauaaagaaaauccuacuuauaguuaccaaguccuauuugga

SEQ ID NO: 143271 - RNA, 62 nt, Homo Sapiens
uggaagagaaaugucuauuagaagaucagacuccuacuuaacgacaaauaaacuauuuugua

SEQ ID NO: 143272 - RNA, 62 nt, Homo Sapiens
ugaagucgcugcauaugugacugucaugagauccuacuuaguaugauccuggcuagaaugau

SEQ ID NO: 143273 - RNA, 62 nt, Homo Sapiens
ucagauccuagcucaucaucagugaaguccagccuacuuacuuguaacuauuaaccuuucua

SEQ ID NO: 143274 - RNA, 62 nt, Homo Sapiens
guaucuucucagcccugcuacugucugcugcuccuacuuagaaguugcaggcaauauccugu

SEQ ID NO: 143275 - RNA, 62 nt, Homo Sapiens
aaguagaaauggugagauugaguccuaguuuuccuacuuauaucuguuuugagcuuauuuag

SEQ ID NO: 143276 - RNA, 62 nt, Homo Sapiens
uauuucaugugcuauagacaccacugcacccaccuacuuagaucucccaauacaggcaugaa

SEQ ID NO: 143277 - RNA, 62 nt, Homo Sapiens
gaguggaaaccaggagguuaugcuuugggaagccuacuuaugaagaaaauuuaguuguuagu

SEQ ID NO: 143278 - RNA, 62 nt, Homo Sapiens
aaaaaaaggguagcacuuauaauauuuuuaugccuacuuagggaaaacaagaaggaaaugaa

SEQ ID NO: 143279 - RNA, 62 nt, Homo Sapiens
aaaauuuuaggauaaugaagaguacauaauguccuacuuaauauuuauguuaauaggacuua

SEQ ID NO: 143280 - RNA, 62 nt, Homo Sapiens
ggcugccccagaggacaguggguggagugguaccuacuuauuaaaugucucagaccccucuc

SEQ ID NO: 143281 - RNA, 62 nt, Homo Sapiens
aacuacuuuuuuauaauuguaagaaaaauaauccuacuuauauaugaucuuggaaaauuuua

SEQ ID NO: 143282 - RNA, 62 nt, Homo Sapiens
uuuacucuaaucaaggcaggagaugcagcaguccuacuuauugccauguggacuugugggaa

SEQ ID NO: 143283 - RNA, 62 nt, Homo Sapiens
cagagaaaaaaaucguauugaauggccauuucccuacuuauaagaugucucaaucugaauuu

SEQ ID NO: 143284 - RNA, 62 nt, Homo Sapiens
gcccugcaaauguuuacagaaaugaaauucuuccuacuuauauaagaaaucucacacugaga

SEQ ID NO: 143285 - RNA, 62 nt, Homo Sapiens
uguguguguguguguccacacuggccagccucccuacuuaccaagguucuccacugcuuacc

SEQ ID NO: 143286 - RNA, 62 nt, Homo Sapiens
ugucauucgcucauguaagaaaaguucaagugccuacuuaugcuuaaaccaggugaaagagc

SEQ ID NO: 143287 - RNA, 62 nt, Homo Sapiens
cuaugguguguacuuuuuguuaauaucaggcgccuacuuaacagaugaauuauugaucuucc

SEQ ID NO: 143288 - RNA, 62 nt, Homo Sapiens
aguucgauauuuuacuuuagaaccuggaaucuccuacuuaauauaugaccaugacuuugaaa

SEQ ID NO: 143289 - RNA, 62 nt, Homo Sapiens
auuuuuaggagaaaguaaguugcuuugcaccgccuacuuaauucuuuuccauauauugugau

SEQ ID NO: 143290 - RNA, 62 nt, Homo Sapiens
uaucuaugauugaguguccguguaaauaaauuccuacuuagacuuaccacuuugugugugcu

SEQ ID NO: 143291 - RNA, 62 nt, Homo Sapiens
gccaccauacaguggccucaaagcaaccauggccuacuuaaaaaccaaaccaaaaauaaaga

SEQ ID NO: 143292 - RNA, 62 nt, Homo Sapiens
cccuggcagaggggaugccaaggguaguugugccuacuuaucgagcaugccauuuugagggg

SEQ ID NO: 143293 - RNA, 62 nt, Homo Sapiens
ucagauucaccuccauuaacucggggauuccaccuacuuauuuacucuuccaaaagccugca

SEQ ID NO: 143294 - RNA, 62 nt, Homo Sapiens
ccucaaugcacaugauugauaacaccauuuacccuacuuaucuuucuuuagaaugcuguuua

SEQ ID NO: 143295 - RNA, 62 nt, Homo Sapiens
ucuuaaagauggacagccuggaaaucuuccuuccuacuuaugguuaacgggugaugaagcaa

SEQ ID NO: 143296 - RNA, 62 nt, Homo Sapiens
uacugccccacuuuaauauauguaagcaacuuccuacuuauacacgacguguuccuaaaaca

SEQ ID NO: 143297 - RNA, 62 nt, Homo Sapiens
aagguguggugcuggaacaucgaugaaggagcccuacuuacugagcuuaguuauggacuuuu

SEQ ID NO: 143298 - RNA, 62 nt, Homo Sapiens
uuuaaugaggaauaauaugcauguagaaaagaccuacuuaaagucuucauuuauauucuuuc

SEQ ID NO: 143299 - RNA, 62 nt, Homo Sapiens
uuacuuaaacguacuuucaggagugagcaaguccuacuuauaaaccuauauuaacuuuauuu

SEQ ID NO: 143300 - RNA, 62 nt, Homo Sapiens
aucacuacaagaaaacugagagcacagcauccccuacuuacuguaagagaaaugcagucagg

SEQ ID NO: 143301 - RNA, 62 nt, Homo Sapiens
auuuuccacucuaucuuugucauguauuuuuuccuacuuaggguugcucauuugcccuuuuc

SEQ ID NO: 143302 - RNA, 62 nt, Homo Sapiens
uugcucauaaagccuuuucuggagacacuacuccuacuuaucgugaaaaacuguguuggggg

SEQ ID NO: 143303 - RNA, 62 nt, Homo Sapiens
uccaaaauaccuguauccaacuucacuuaacuccuacuuagcuuucagaggcauucccagcc

SEQ ID NO: 143304 - RNA, 62 nt, Homo Sapiens
gaucugaguucuucaguuccagggguaccccaccuacuuaggugaaauguggcaguccucuc

SEQ ID NO: 143305 - RNA, 62 nt, Homo Sapiens
ugaugugauuuauuaauauauuauugaaacuuccuacuuauuucaauguaucuacaggcuug

SEQ ID NO: 143306 - RNA, 62 nt, Homo Sapiens
uuagggaacuucaaauagugcguagacuuuucccuacuuaccauuggguucaauugauguag

SEQ ID NO: 143307 - RNA, 50 nt, Homo Sapiens
gugcauugaaacugcugugaccuacuuacaccaugucuguagcuauuuuc

SEQ ID NO: 143308 - RNA, 62 nt, Homo Sapiens
ucuguggcagcaaagaaaagcuuaauuuucccccuacuuaguagguuaaaugaaccccuggg

SEQ ID NO: 143309 - RNA, 62 nt, Homo Sapiens
ugugaggaacaggccucaggcccuugccacgaccuacuuaggcuacaauuuccuuuaaggca

SEQ ID NO: 143310 - RNA, 62 nt, Homo Sapiens
guuaaaugcaguuuuaaauuuauaucguaacaccuacuuaagugccugacacaguagguauu

SEQ ID NO: 143311 - RNA, 62 nt, Homo Sapiens
gaagaugaacacuugaggacuucagcuucucaccuacuuaguacaguugggaaccauacacu

SEQ ID NO: 143312 - RNA, 62 nt, Homo Sapiens
ggcacaacuaaaugcuuuauaaaaaaaauuagccuacuuaaaacuccaucucaaaacaaaac

SEQ ID NO: 143313 - RNA, 62 nt, Homo Sapiens
auuguuuauucucaauuuacuuauccaauaauccuacuuacucauacauacauuucauuuaa

SEQ ID NO: 143314 - RNA, 62 nt, Homo Sapiens
uacuaccugcgacuuucuuuuucaugugcccaccuacuuaccuggacagagcagcuuggcuu

SEQ ID NO: 143315 - RNA, 62 nt, Homo Sapiens
uggggaccccggcuggggcacugcauucagccccuacuuacccuguccagcggccucuuugg

SEQ ID NO: 143316 - RNA, 62 nt, Homo Sapiens
gagggugccaucgagggcuccggaucccuuauccuacuuagcaguguuggucucuggggcug

SEQ ID NO: 143317 - RNA, 62 nt, Homo Sapiens
uucaaggaaggaagugggaacaagguuggaugccuacuuaugagcuugaccaucacagcuau

SEQ ID NO: 143318 - RNA, 62 nt, Homo Sapiens
cggccaccacugcagccgggggcuggccuucuccuacuuagggaagaaaaagcaaguguuca

SEQ ID NO: 143319 - RNA, 62 nt, Homo Sapiens
ucugauaaaccugucuaagcaugaguguugugccuacuuaauggaaaugcuuuucugaaagu

SEQ ID NO: 143320 - RNA, 62 nt, Homo Sapiens
agaagauuaauuaauuuccuauccuaaucccuccuacuuauacuuccccaaaaaacaagcuu

SEQ ID NO: 143321 - RNA, 62 nt, Homo Sapiens
gaggucagcccguuacccccauaacugauuuaccuacuuaccauacugggagguagaagaga

SEQ ID NO: 143322 - RNA, 62 nt, Homo Sapiens
aagaaaaauauuguauuuuuagaauguuuaguccuacuuaguuuguuuuccaguaggggauu

SEQ ID NO: 143323 - RNA, 62 nt, Homo Sapiens
guugaccaagcugcuuaaaggcucucuagaacccuacuuacaugauccuaaccuuuuagccu

SEQ ID NO: 143324 - RNA, 62 nt, Homo Sapiens
uuguucacuuuacuugccugugucucagcggaccuacuuaagccauaauccccaccgcuucc

SEQ ID NO: 143325 - RNA, 62 nt, Homo Sapiens
uccuuagcaaagagacccugcugccucuuuccccuacuuagcgguccugcugggagcucccc

SEQ ID NO: 143326 - RNA, 62 nt, Homo Sapiens
aaaaugccuuuuacucaggggccuggacacguccuacuuaagcccccaggacugcugcugga

SEQ ID NO: 143327 - RNA, 62 nt, Homo Sapiens
uggauucugcagacugaaacgaguaaagcuugccuacuuaauacacucaaguguggggaguc

SEQ ID NO: 143328 - RNA, 62 nt, Homo Sapiens
ccuuaaauaaguuuagauuuaaugcacguuauccuacuuaaucuugauucuuuuagcaaauc

SEQ ID NO: 143329 - RNA, 62 nt, Homo Sapiens
cucuccaccucucacccacucucuccuaauccccuacuuaaguagggcuugccccacuucag

SEQ ID NO: 143330 - RNA, 62 nt, Homo Sapiens
uaacacaucacaucuaagaauaaaggcugccuccuacuuaauugcuauauaacaauugucca

SEQ ID NO: 143331 - RNA, 62 nt, Homo Sapiens
gauauaccuuguauauuuaccaccgaauaauuccuacuuacuguuguccuaguuucuggaau

SEQ ID NO: 143332 - RNA, 62 nt, Homo Sapiens
uuaugcaugagaacuaaauagauuuuuagauuccuacuuaaacaaaaacuuuccaugacagu

SEQ ID NO: 143333 - RNA, 62 nt, Homo Sapiens
cagaaugagcccaccuggcuuugaaucugggcccuacuuaacuuaucagcuaugugguuuug

SEQ ID NO: 143334 - RNA, 62 nt, Homo Sapiens
gcugccagccuucuguccugggcaaacuacucccuacuuaagggaauaggccaggcuccauc

SEQ ID NO: 143335 - RNA, 62 nt, Homo Sapiens
cuccuuguuugcacauuauuauggaacacuuuccuacuuaggcaguuacucuuccauguuua

SEQ ID NO: 143336 - RNA, 62 nt, Homo Sapiens
aagcagcaccugugggccauacuaaaagauccccuacuuacguucugguugucauguuuccc

SEQ ID NO: 143337 - RNA, 62 nt, Homo Sapiens
gaauucuuccuagauagucgcccacuccaccuccuacuuaaccugagacucauuauuuagcu

SEQ ID NO: 143338 - RNA, 62 nt, Homo Sapiens
ugguaccuaugaaccuagaacuugaagugacuccuacuuaucacguaaauuuuuaugucuga

SEQ ID NO: 143339 - RNA, 62 nt, Homo Sapiens
gagaauguacuuauauuuuguuuugcuauuaaccuacuuacgggguuagggauuugcggggg

SEQ ID NO: 143340 - RNA, 62 nt, Homo Sapiens
caaugcggaugcccaacugucuagggucuccaccuacuuauauauccuucaaaagaaccaca

SEQ ID NO: 143341 - RNA, 62 nt, Homo Sapiens
cccagucauucuagagggaucugcccugucucccuacuuagaaccaguccacgccgggucgc

SEQ ID NO: 143342 - RNA, 62 nt, Homo Sapiens
uguuuuuaguuacacacacacacacacacacaccuacuuaaauggaaucuaaacauuuuuag

SEQ ID NO: 143343 - RNA, 62 nt, Homo Sapiens
uccauuuuaauugauaugaggguguuaaaguaccuacuuaauggguugauuacuaucaaaau

SEQ ID NO: 143344 - RNA, 62 nt, Homo Sapiens
uccaccuaccgcuuaccugaaaugcaggaucaccuacuuacuguauucuacauuauuauaug

SEQ ID NO: 143345 - RNA, 62 nt, Homo Sapiens
ccacauaagagaugcauuuuugguaacuaagaccuacuuaugucaucgagcucuaucaacac

SEQ ID NO: 143346 - RNA, 62 nt, Homo Sapiens
ccguaaggggaaaugaaggcaagacgauauaaccuacuuacuagggagacauuuuagucagu

SEQ ID NO: 143347 - RNA, 62 nt, Homo Sapiens
uaguugaaauaucaaggagggaaaacuagaguccuacuuacaggaaauuauauaccgugacu

SEQ ID NO: 143348 - RNA, 64 nt, Homo Sapiens
ugacccuagccacacugaaaugagagacucccugacugcucagagaggcuaaacuguugaugaa

SEQ ID NO: 143349 - RNA, 64 nt, Homo Sapiens
uucauuuaacucauuugaugacugcucuagauaaacugcucaaguacacaucacuacacuaaac

SEQ ID NO: 143350 - RNA, 64 nt, Homo Sapiens
uagaaauaaaucaucugguuauaacaauuuugauacugcucauuuucacucuaccugcaugagu

SEQ ID NO: 143351 - RNA, 64 nt, Homo Sapiens
uuuggauguuuguagauaacuuaguuuuauaaacacugcucauugcacuguuuuagaagcuuac

SEQ ID NO: 143352 - RNA, 64 nt, Homo Sapiens
agaccccugcccucuaguugaaugaggcucuaacacugcucaggcaauuuggccgggauggacu

SEQ ID NO: 143353 - RNA, 64 nt, Homo Sapiens
gauuaaauggguucacuuccccaauacauauuguacugcucaguugugucuacacaggauaaac

SEQ ID NO: 143354 - RNA, 64 nt, Homo Sapiens
uucugaucacucugauacuucuucacuacugcucacugcucacucaugggaaagaaaauucugg

SEQ ID NO: 143355 - RNA, 64 nt, Homo Sapiens
gcucacuuucugaucacucuauucuggcuucacuacugcucacucaggagucaugggaaagaaa

SEQ ID NO: 143356 - RNA, 64 nt, Homo Sapiens
gucauugccaaggucugauugucauuuacauccuacugcucaaaggaaugcuaagcuuguggga

SEQ ID NO: 143357 - RNA, 64 nt, Homo Sapiens
uuccaggaucagcuuccuccuuaaaaagcagcccacugcucaguaaggccacuggcaguaggau

SEQ ID NO: 143358 - RNA, 64 nt, Homo Sapiens
ucuccucugcagccagauucacuggcugaugcucacugcucacugucuauccccacgaaauuua

SEQ ID NO: 143359 - RNA, 64 nt, Homo Sapiens
cucaauuugugucuguuuacagcucucucuccucacugcucacagcaagggguucuguaucagu

SEQ ID NO: 143360 - RNA, 64 nt, Homo Sapiens
gagugagccugguguucuugccuucuuggaaauuacugcucaccugguaucuguacguuaaugu

SEQ ID NO: 143361 - RNA, 64 nt, Homo Sapiens
ccaugcuguugggcaaagcaacucuuuuucaaccacugcucaucaguuucuguagagacaaaaa

SEQ ID NO: 143362 - RNA, 64 nt, Homo Sapiens
uuacuuuuugcauggaauacuacucacuugacuuacugcucauuaaguuuuuauauagccugaa

SEQ ID NO: 143363 - RNA, 64 nt, Homo Sapiens
aagacuaaaaguugaccuguaaaacuucgugaaaacugcucauaacauuuuuuaaaugucgagu

SEQ ID NO: 143364 - RNA, 64 nt, Homo Sapiens
acucccuaaaaacacaccaucugacacagcggggacugcucagcgcaccauuuggaggguuuug

SEQ ID NO: 143365 - RNA, 64 nt, Homo Sapiens
gcgggccauugcaagggugccauccccuacucccacugcucagccaccugccccccgcccuccc

SEQ ID NO: 143366 - RNA, 64 nt, Homo Sapiens
aguggccagcauucugccugcagacccugagcacugagucaacaagguuugugaugaugucugu

SEQ ID NO: 143367 - RNA, 64 nt, Homo Sapiens
gaaggcaagagcuguuuccuuuccauuucuacaaugagucaauugcagaugaugcuauaacacu

SEQ ID NO: 143368 - RNA, 64 nt, Homo Sapiens
acaccucuuucauuuauaaagccauguggaacugugagucaauuaguuuccugaggccuccccc

SEQ ID NO: 143369 - RNA, 64 nt, Homo Sapiens
aaucagcaggcugggcaccccucucaucuagcacugagucaagcguccgauucugaggucucuu

SEQ ID NO: 143370 - RNA, 64 nt, Homo Sapiens
gugcgugcguguguguucacguguucucgugcgggcgcgugaguggucuucaaacgaggguccc

SEQ ID NO: 143371 - RNA, 64 nt, Homo Sapiens
cugugcaguaaucgagauugggagaauuugggcagcgcgugagaagugcuaagcuacuuguuuu

SEQ ID NO: 143372 - RNA, 64 nt, Homo Sapiens
agucugaacuaaggccugagcuguggauaccauggcgcgugaguuagauguggucccugcccuc

SEQ ID NO: 143373 - RNA, 64 nt, Homo Sapiens
agucccacugcuucuaaaggcccuugcugggccugcgcgugagggacagcugcgggugcccaag

SEQ ID NO: 143374 - RNA, 64 nt, Homo Sapiens
cggcugccugcguccauggucuaguggcagccgggcgcgugaggagcggcaggccuugaggcug

SEQ ID NO: 143375 - RNA, 64 nt, Homo Sapiens
gcaucagcagggaccccggcggacgugggcgggcgcgcgugagcucgggcugcccggccgggcg

SEQ ID NO: 143376 - RNA, 64 nt, Homo Sapiens
cuauaaccuagguaaagcauaaucugucagagaagcgcgugagaaauuugaaaugaaggcauuu

SEQ ID NO: 143377 - RNA, 64 nt, Homo Sapiens
cugugcuugcuccuaagcaaaagggaaaaggagcgcgcgugauagaagaaaagcacugggagaa

SEQ ID NO: 143378 - RNA, 64 nt, Homo Sapiens
cagagcuuuaaagaagugggacucagccauguuggcgcgugauugacauuacagcacagaaaac

SEQ ID NO: 143379 - RNA, 64 nt, Homo Sapiens
aggacagagugugugcgugcgugugggugugugcgcgcgugagcacacacgcguguguuggggg

SEQ ID NO: 143380 - RNA, 64 nt, Homo Sapiens
uaaauauauuauauauggaugugugugugugcgugcgcgugagugugugagcgcuucugcagcc

SEQ ID NO: 143381 - RNA, 64 nt, Homo Sapiens
caaugcugggugguuuuccccucuucacacggacgcgcgugacacaagaagccuguuugguggu

SEQ ID NO: 143382 - RNA, 64 nt, Homo Sapiens
ccccggcccuccaaauccaagggaccucgggacugcgcgugaggcuggacucggccuggaccag

SEQ ID NO: 143383 - RNA, 64 nt, Homo Sapiens
cccuccgcggcgggcccugcccacaccuccuggggcgcgugaggcccguggggccggggcuucu

SEQ ID NO: 143384 - RNA, 63 nt, Homo Sapiens
ccucccaaagcagccugaccugcgugggagaggcguagcgaggucggaggggaaagggagauc

SEQ ID NO: 143385 - RNA, 63 nt, Homo Sapiens
cucuaaaauucuguucccaagaugcaguccuagcguagcgaacguuccuggaguggggugaag

SEQ ID NO: 143386 - RNA, 63 nt, Homo Sapiens
ugucacauggggcagggaagagacauguggggccguagcgaggccagccccaaggaugaagca

SEQ ID NO: 143387 - RNA, 63 nt, Homo Sapiens
uagugagacuagacauaguauuaagaacuaugacguagcgagucaaauacauuccuuuuagag

SEQ ID NO: 143388 - RNA, 64 nt, Homo Sapiens
uggcugacuucgggcuggcgcgucucaugguggacgagaagacucagccugagggccugcggag

SEQ ID NO: 143389 - RNA, 64 nt, Homo Sapiens
uccccaucaccgugcgcuguugcgaucuggaccccgagaagaggccauccuuugugaagcugga

SEQ ID NO: 143390 - RNA, 64 nt, Homo Sapiens
gagauguggaaggcaccuucgcuggcagcuucugcgagaagagacagaaucucuggacggagcu

SEQ ID NO: 143391 - RNA, 64 nt, Homo Sapiens
agcgcucaugucuuuuuugcugucuacuugcucccgagaagaggcuuccugacccuggcaccug

SEQ ID NO: 143392 - RNA, 64 nt, Homo Sapiens; identical to SEQ ID NO: 94932

SEQ ID NO: 143393 - RNA, 64 nt, Homo Sapiens; identical to SEQ ID NO: 94933

SEQ ID NO: 143394 - RNA, 64 nt, Homo Sapiens; identical to SEQ ID NO: 94934

SEQ ID NO: 143395 - RNA, 64 nt, Homo Sapiens; identical to SEQ ID NO: 94935

SEQ ID NO: 143396 - RNA, 64 nt, Homo Sapiens; identical to SEQ ID NO: 94936

SEQ ID NO: 143397 - RNA, 64 nt, Homo Sapiens; identical to SEQ ID NO: 94937

SEQ ID NO: 143398 - RNA, 64 nt, Homo Sapiens; identical to SEQ ID NO: 94938

SEQ ID NO: 143399 - RNA, 64 nt, Homo Sapiens; identical to SEQ ID NO: 94939

SEQ ID NO: 143400 - RNA, 64 nt, Homo Sapiens; identical to SEQ ID NO: 94940

SEQ ID NO: 143401 - RNA, 64 nt, Homo Sapiens; identical to SEQ ID NO: 94941

SEQ ID NO: 143402 - RNA, 64 nt, Homo Sapiens; identical to SEQ ID NO: 94942

SEQ ID NO: 143403 - RNA, 64 nt, Homo Sapiens; identical to SEQ ID NO: 94943

SEQ ID NO: 143404 - RNA, 64 nt, Homo Sapiens
ggaggauggcuugaagccaguaguucaagaccagccugggcaacauaguaagaccccaucucua

SEQ ID NO: 143405 - RNA, 64 nt, Homo Sapiens
ugcagugagcugugauugugccacuguuuuccagccugggcaauacagugagacccugucucaa

SEQ ID NO: 143406 - RNA, 64 nt, Homo Sapiens
ggagaauugcuugaguccaggaguuugagaugcgccugggcaacauagaaaccugugucuacaa

SEQ ID NO: 143407 - RNA, 64 nt, Homo Sapiens
ugcagugagcugagaucgcaccauuacacuccagccugggcaacagagccagacucugucucaa

SEQ ID NO: 143408 - RNA, 64 nt, Homo Sapiens
cccaugggaauccuguccugccucgaaggagcagccugggcagccaucacaccacgaggacagg

SEQ ID NO: 143409 - RNA, 64 nt, Homo Sapiens
cccuguccaaggaccuucccucuucuccccaguuccugggcaaucacuucaccuuggacaaagg

SEQ ID NO: 143410 - RNA, 64 nt, Homo Sapiens
ggggaagcccagccgugggcaaguccgccaugacccugggcacaugggcagccggccuggcuug

SEQ ID NO: 143411 - RNA, 64 nt, Homo Sapiens
uucuccgaggcaugugucucgccgccuggcccagccugggcacgcccgugaggagcuucccgca

SEQ ID NO: 143412 - RNA, 64 nt, Homo Sapiens
gccacauguuacauguacaguagaugcugggaugccugggcaugucuuuacacugacuucagga

SEQ ID NO: 143413 - RNA, 64 nt, Homo Sapiens
agguggcuuuggugguuggucuucuaaaggaaguccugggcagggcgcgugaggagucccacug

SEQ ID NO: 143414 - RNA, 64 nt, Homo Sapiens
agagcgagacccugucucaaccauugcacucuagccugggcagcugcagugagccaagauggca

SEQ ID NO: 143415 - RNA, 64 nt, Homo Sapiens
guggcaaaaccgcguguuuagaguucaagacuagccugggcaauggcagauggcuugaguccag

SEQ ID NO: 143416 - RNA, 64 nt, Homo Sapiens
aaagccagacucugucucaaugagaucacuccaaccugggcaaugugugaagguuucagugaac

SEQ ID NO: 143417 - RNA, 64 nt, Homo Sapiens
cuccucauguuucccaccugguuguuuuccuuugccugggcauuuuggcgggggugcugggccu

SEQ ID NO: 143418 - RNA, 64 nt, Homo Sapiens
agagugagacccugucucaacacuggcacuccagccugggcaacgcaguaagccaagaucacac

SEQ ID NO: 143419 - RNA, 64 nt, Homo Sapiens
gugguguauaccuguaguccaaugaacaaaauuaccugggcauagaccccaucucuauuuaaaa

SEQ ID NO: 143420 - RNA, 64 nt, Homo Sapiens
auagugagaccccaucucuagaguuugagacuagccugggcaacagcuaagcauuuuuuaaauu

SEQ ID NO: 143421 - RNA, 64 nt, Homo Sapiens
aguguuauuaaaaaauuacaaaggccuagaccagccugggcaacauggugaaaccccaucucua

SEQ ID NO: 143422 - RNA, 64 nt, Homo Sapiens
ugcagugaaucaugaucaugccacuguacuccagccugggcaacagagaccaucuuaaaaaaaa

SEQ ID NO: 143423 - RNA, 64 nt, Homo Sapiens
ugcagugagcagagaucgcaccacugcacuccagccugggcaagagugagacugugucucaaaa

SEQ ID NO: 143424 - RNA, 64 nt, Homo Sapiens
ggaggaucacuuagguccaggaguucgagacuagccugggcaacauagugagacaccggaucua

SEQ ID NO: 143425 - RNA, 64 nt, Homo Sapiens
ugcagugagccgugauugcaccacugcacuccagccugggcaacagagcaagacccugucuugg

SEQ ID NO: 143426 - RNA, 64 nt, Homo Sapiens
agccuguggccucugcgccuccugccacugaggcccugggcagaugcugcagcccgcccccuuc

SEQ ID NO: 143427 - RNA, 64 nt, Homo Sapiens
gcugugggccagggaauccagcggcgucuggccuccugggcacugcuugccuggccucgugcuu

SEQ ID NO: 143428 - RNA, 64 nt, Homo Sapiens
gugauggauugacccuccauaauucacgucucguccugggcauuugaaaagaacuuaaggccac

SEQ ID NO: 143429 - RNA, 64 nt, Homo Sapiens
cgggacgggccggcgggcaccgcuaccaaauacgccugggcagcccaguggcucucaacccaug

SEQ ID NO: 143430 - RNA, 64 nt, Homo Sapiens
uggucacuccccagagaagcaugcaggaguuucuccugggcagcaaccugugagucucuucugc

SEQ ID NO: 143431 - RNA, 64 nt, Homo Sapiens
guguugucucuccccaaauuuuccucuccucuuaccugggcagaggacagcuggaccccugaac

SEQ ID NO: 143432 - RNA, 64 nt, Homo Sapiens
agagugagacuccaucucaaccauugcacuccagccugggcaacugcaguaagcugagauccca

SEQ ID NO: 143433 - RNA, 64 nt, Homo Sapiens
uccccagcgaggggguugggcaagggauguucuaccugggcaugccuugugaugggcagugaga

SEQ ID NO: 143434 - RNA, 64 nt, Homo Sapiens
cuguuuacagcuggcaaacaucccagagaggcagccugggcaguaugccccugaguucuuuugg

SEQ ID NO: 143435 - RNA, 64 nt, Homo Sapiens
ggaggauuuucccggccgcaacccauaggcagucccugggcaagugaggaagggagaaggcaga

SEQ ID NO: 143436 - RNA, 64 nt, Homo Sapiens
cacuggccaggccguuguaucacagcagaugcuuccugggcagcccaggaacuagagccccaac

SEQ ID NO: 143437 - RNA, 64 nt, Homo Sapiens
acguacgcacacacgcacaugcacagauaugccgccugggcacacagauaagcugcccaaaugc

SEQ ID NO: 143438 - RNA, 64 nt, Homo Sapiens
ggauacacacgcacgcacacaugcagauaugcugccugggcacacacuuccggacacacaugca

SEQ ID NO: 143439 - RNA, 64 nt, Homo Sapiens
ggcaguucgcuugggcccaagaguucgagaccagccugggcaacauggugaaacccuaucuccg

SEQ ID NO: 143440 - RNA, 64 nt, Homo Sapiens
ugagccgaggucaugccacugcacuccagccuggccugggcaacagagcaagacccugucucaa

SEQ ID NO: 143441 - RNA, 64 nt, Homo Sapiens
gaggaugauggauggucgggauugaggcuguugaccugggcaguagcuccucccauggccagug

SEQ ID NO: 143442 - RNA, 64 nt, Homo Sapiens
ugagaaaccugcccugaacucaccgccuccccugccugggcacucccuccucccugcgcccaca

SEQ ID NO: 143443 - RNA, 64 nt, Homo Sapiens
agccccaugggccgucacaaaggcuugaucacugccugggcaguggcacaaccaucccccaugu

SEQ ID NO: 143444 - RNA, 64 nt, Homo Sapiens
agcuaugguugaguaacuaaaggucuggcaagacccugggcacacagggagcugccuagcaucu

SEQ ID NO: 143445 - RNA, 64 nt, Homo Sapiens
uaucucuccagguggcccuaugcacccagguagcccugggcauggagcaccuguccaacaaccg

SEQ ID NO: 143446 - RNA, 64 nt, Homo Sapiens
agcaagccgugaggagggagcccgcucaggauggccugggcaggggaggacaucucuagaggga

SEQ ID NO: 143447 - RNA, 64 nt, Homo Sapiens
ugcauugagcugagaucaugcuagugcgcuccagccugggcaacagagcgagacuucaucucag

SEQ ID NO: 143448 - RNA, 64 nt, Homo Sapiens
uggagugagcugagaucgcgccaccgcacuccagccugggcaacagagcgagacuccaucucaa

SEQ ID NO: 143449 - RNA, 64 nt, Homo Sapiens
agagugagauccugacucaaccacugcauucuagccugggcaacugcaaugagcuaugauuuca

SEQ ID NO: 143450 - RNA, 64 nt, Homo Sapiens
auagcgagacugcaucucuaggguucaagacuagccugggcaacggaggauugcuugaggccga

SEQ ID NO: 143451 - RNA, 64 nt, Homo Sapiens
agagugagacccuauuucaaccacugcacuccagccugggcaacugcagugagcacagaucaca

SEQ ID NO: 143452 - RNA, 64 nt, Homo Sapiens
auggcuaaaccccaucucuagaguucaagaccagccugggcaacgguggauugcuuaagcccag

SEQ ID NO: 143453 - RNA, 64 nt, Homo Sapiens
agaguaagacaaaaaaauauucacugcacucuagccugggcaacugcagugagccaaggucacg

SEQ ID NO: 143454 - RNA, 64 nt, Homo Sapiens
auggugaaacccuguuucuagaauucaagaccagccugggcaacgguagauuacuugagcccag

SEQ ID NO: 143455 - RNA, 64 nt, Homo Sapiens
ggaggauugcuugaagcuaggaguuugagaccagccugggcaacaggguaagguccugucucua

SEQ ID NO: 143456 - RNA, 64 nt, Homo Sapiens
cugcagugagcugugaugugcccuuaugcuauagccugggcaagagcgugagacccugucucaa

SEQ ID NO: 143457 - RNA, 64 nt, Homo Sapiens
ggcggaucacuugaggccaggaauuugaaaccagccugggcaaaacccugucucuacuaaaaau

SEQ ID NO: 143458 - RNA, 64 nt, Homo Sapiens
ugggcagaugggcacaggugcuggugaugccucuccugggcaaaacgccccauuuguggcacuu

SEQ ID NO: 143459 - RNA, 64 nt, Homo Sapiens
gagaugcagugggugcgggguaugaggcaggcacccugggcagacucuguggcgcggggcaucc

SEQ ID NO: 143460 - RNA, 59 nt, Homo Sapiens
gagacucuguggcgcggggcggcgggcgcccugggcagauggacgaggaccagcuguga

SEQ ID NO: 143461 - RNA, 64 nt, Homo Sapiens
gccggacguccuacucaggccacccugccaggccccugggcaucugagcaccucggcuucggag

SEQ ID NO: 143462 - RNA, 64 nt, Homo Sapiens
acagcgccgcccgggcagacggagaggcuggaggccugggcagacugagcggagcgguggagag

SEQ ID NO: 143463 - RNA, 64 nt, Homo Sapiens
agagaaagacccugucucaaccagugcacucuagccugggcaacgcuagagugagccgugauca

SEQ ID NO: 143464 - RNA, 64 nt, Homo Sapiens
agagcgagaucccaucacuagaguucgagaccacccugggcaacggaggaucgcuugaggccag

SEQ ID NO: 143465 - RNA, 64 nt, Homo Sapiens
guggcgaaauccccgucuuugaguucgagaccagccugggcaacggagaaucgcuugagcucag

SEQ ID NO: 143466 - RNA, 64 nt, Homo Sapiens
auagcaaaaccuagucccuagaguuuaaggccagccugggcaacaaggaucaccuugaggccag

SEQ ID NO: 143467 - RNA, 64 nt, Homo Sapiens
cgccuucugaacccgucucagcagguccacagcaccugggcagaggucagagaccaggggaggc

SEQ ID NO: 143468 - RNA, 64 nt, Homo Sapiens
cucacagcgggacuacacaguugcuggcuuugcuccugggcaaggaggagcaggccagagccuc

SEQ ID NO: 143469 - RNA, 64 nt, Homo Sapiens
ugcagugagccgagaucgcaccauugcacuccugccugggcaacaagagugaaacuccaucucc

SEQ ID NO: 143470 - RNA, 64 nt, Homo Sapiens
ggcagauuauuugagcucaggaguuugagaccauccugggcaacauggcgaaacccuaucucua

SEQ ID NO: 143471 - RNA, 64 nt, Homo Sapiens
gggcgagacucugucucaaaucauugcacuccagccugggcaacugcagugagcugagaucaca

SEQ ID NO: 143472 - RNA, 64 nt, Homo Sapiens
uuuuuuaagacucugucuuaucuuaaaaaaagagccugggcaauggcaagaguuuuuuuaagac

SEQ ID NO: 143473 - RNA, 64 nt, Homo Sapiens
aguuuuuuuaagacucuuaaccacugcacuccagccugggcaagugcagcgagccaagaucgug

SEQ ID NO: 143474 - RNA, 64 nt, Homo Sapiens
agagugagacccugucucugccacugcacuccagccugggcaacugcagugggcugugaucaca

SEQ ID NO: 143475 - RNA, 64 nt, Homo Sapiens
auagugagacuccugucucugaguucaagaccagccugggcaacggaggaucacuugagcccag

SEQ ID NO: 143476 - RNA, 64 nt, Homo Sapiens
gcucacagccucuugcacccgccucaggugugugccugggcaccucccggagcuuggaggggca

SEQ ID NO: 143477 - RNA, 64 nt, Homo Sapiens
gguuagugguagagguggugagaagacaucagauccugggcacauucuuuucuucugcuucccu

SEQ ID NO: 143478 - RNA, 64 nt, Homo Sapiens
caacagucaugacccugauaguuucccauaacaaccugggcauuccuugggacucaggagcugc

SEQ ID NO: 143479 - RNA, 64 nt, Homo Sapiens
agugagccaucaucauggcaucauugcauuccagccugggcaacagagcaagaccucgucucaa

SEQ ID NO: 143480 - RNA, 64 nt, Homo Sapiens
ggaacccaggcugggccugguggugaagagcaguccugggcacaggcugugagccagggugcug

SEQ ID NO: 143481 - RNA, 64 nt, Homo Sapiens
cuugcagccguaugcugcacaagcguguacacccccugggcagccucaaaaccccgcuuacagc

SEQ ID NO: 143482 - RNA, 64 nt, Homo Sapiens
ggggcagccgcagggaggcacggcguuggcggggccugggcacacguggccgagggggccuuga

SEQ ID NO: 143483 - RNA, 64 nt, Homo Sapiens
ugccaccgggaaggaauggccgauuucggcaaagccugggcaggccucccccucuuguugccuu

SEQ ID NO: 143484 - RNA, 64 nt, Homo Sapiens
agagcgagaccaucucuuaaacacugcacuccagccugggcaacuguagugagccgagaucaug

SEQ ID NO: 143485 - RNA, 64 nt, Homo Sapiens
cccccaggccccauccgggauuccaguuucgcacccugggcagacuuagguguuucagcauaga

SEQ ID NO: 143486 - RNA, 64 nt, Homo Sapiens
uagguguuucagcauagauuccaugggggcaccuccugggcacuggagccgugucacuccuggg

SEQ ID NO: 143487 - RNA, 64 nt, Homo Sapiens
uugggguacacaggauacugggcccccucggccuccugggcaacccagugcagauggagcccaa

SEQ ID NO: 143488 - RNA, 64 nt, Homo Sapiens
gacaacgaggaggugguggcugccgcaucuuugaccugggcagcgugacccggccacguccccc

SEQ ID NO: 143489 - RNA, 64 nt, Homo Sapiens
cccuugagcaguguacagccugcucaacaaccgcccugggcaggccgcuccugagcugcugucu

SEQ ID NO: 143490 - RNA, 64 nt, Homo Sapiens
agcugggggugagaggcuggugguugccucccguccugggcaggcugcagccucaugccauguc

SEQ ID NO: 143491 - RNA, 64 nt, Homo Sapiens
agagcaagauccugucuuuaccacugcacuccagccugggcaacugcagucagucaugauggca

SEQ ID NO: 143492 - RNA, 64 nt, Homo Sapiens
auagcaagacacaucccuacgaguuugagaccagccugggcagcggagcaucucuugaggccag

SEQ ID NO: 143493 - RNA, 64 nt, Homo Sapiens
agagcaagacucugccucaaccacugcacuccagccugggcaacugcagugagcugagaucaug

SEQ ID NO: 143494 - RNA, 64 nt, Homo Sapiens
guggcaggugcuuauaauccacaugcaaaaauuaccugggcaugugaaaccccaucucuacuaa

SEQ ID NO: 143495 - RNA, 64 nt, Homo Sapiens
cccugcuuugcauugcugcucaccuggcccauucccugggcauuagcccauagacggcacaggc

SEQ ID NO: 143496 - RNA, 64 nt, Homo Sapiens
ugucuccuagcagccuacacagagcauaguccagccugggcauugggggccccagguacugugg

SEQ ID NO: 143497 - RNA, 64 nt, Homo Sapiens
aaagcaagaccuugucucaaccacuacacuccagccugggcaacuguagugagccaagaucgug

SEQ ID NO: 143498 - RNA, 64 nt, Homo Sapiens
augacgaaaccccgucucuagaguucgagagcagccugggcaacggcagaucacuugagcccag

SEQ ID NO: 143499 - RNA, 64 nt, Homo Sapiens
ccuaagccccugucccucgcucccagaggccuugccugggcaaccccuaccccaccacacccca

SEQ ID NO: 143500 - RNA, 64 nt, Homo Sapiens
gccacgccuaccacagguggaauugugcugguuuccugggcauuuguccuaagcuguauuugug

SEQ ID NO: 143501 - RNA, 64 nt, Homo Sapiens
gccuggacggcuggaugggccugggcugggugggccugggcagcugggugggccugggcagcug

SEQ ID NO: 143502 - RNA, 64 nt, Homo Sapiens
gccugggcugggugggccugggcagcugggugggccugggcagcugggugggccugagcuaggg

SEQ ID NO: 143503 - RNA, 64 nt, Homo Sapiens
ggaaagauggggaaggguguggaguggggaggagccugggcagccugcugggugggccacacuc

SEQ ID NO: 143504 - RNA, 64 nt, Homo Sapiens
ugugccucucaugcugccuccucugcccauggguccugggcacccaggccugcccugccugcug

SEQ ID NO: 143505 - RNA, 64 nt, Homo Sapiens
accccuguuccccucagcuuucccuccucgcuggccugggcacccuccugggagcaggccuucc

SEQ ID NO: 143506 - RNA, 64 nt, Homo Sapiens
ucaggcuuggggcuggggcaggcuugggcucaauccugggcacccaggggcagcccaccccuaa

SEQ ID NO: 143507 - RNA, 61 nt, Homo Sapiens
ggcagaggcagggucgcugaguccuccagguccugggcagccuucauauuugccauugugu

SEQ ID NO: 143508 - RNA, 64 nt, Homo Sapiens
uauccagcugggccagccucgugcugggcucugcccugggcagacaggcagagggccagagcag

SEQ ID NO: 143509 - RNA, 64 nt, Homo Sapiens
ggaggaaugcuugagcccaagaguuuuagaccagccugggcaacacaguaagacccuguuucua

SEQ ID NO: 143510 - RNA, 64 nt, Homo Sapiens
gacagauggcuugagcucaggaguucgugaccagccugggcaacccugucucuacaaaaaauac

SEQ ID NO: 143511 - RNA, 64 nt, Homo Sapiens
ggaggacugcuugagcccaggaguuugagaccagccugggcaauguagcaagaccccaucucua

SEQ ID NO: 143512 - RNA, 64 nt, Homo Sapiens
caugucccuccacuguuccuaucagcagguggccccugggcaucagaacagccugcccugggca

SEQ ID NO: 143513 - RNA, 64 nt, Homo Sapiens
cagcagguggccccugggcaucagaacagccugcccugggcaccagguggcagacacacucaga

SEQ ID NO: 143514 - RNA, 64 nt, Homo Sapiens
aagacuccagcaggugagcugaagaagggccagaccugggcagacauccuucucugcuugaccu

SEQ ID NO: 143515 - RNA, 64 nt, Homo Sapiens
ucucuaccucccagguggaaucccugcuguguccccugggcauuaccccuuggccaaccacauc

SEQ ID NO: 143516 - RNA, 64 nt, Homo Sapiens
ugggaggaucacuugaguccagguucaagacuagccugggcaacauggcaagacccugucccua

SEQ ID NO: 143517 - RNA, 64 nt, Homo Sapiens
ugcagugaacugagaucacgacacugcacuccagccugggcaacaguaaaaccuggucuccaaa

SEQ ID NO: 143518 - RNA, 64 nt, Homo Sapiens
aaaagcgaaacucugucucaccacugcauuccagccugggcaacuuacaguagccgagaucgcg

SEQ ID NO: 143519 - RNA, 64 nt, Homo Sapiens
aagagcgaaacucugucucaccauugcacuccagccugggcaacugcagugagcugagaucgca

SEQ ID NO: 143520 - RNA, 64 nt, Homo Sapiens
aggcaucguacuaguugggcgagaccuaaaauucccugggcacagguugcaccugggugugagc

SEQ ID NO: 143521 - RNA, 64 nt, Homo Sapiens
agcaaagcuauagagacaggugcauucagaacauccugggcaccagucaugagucuuacugugu

SEQ ID NO: 143522 - RNA, 64 nt, Homo Sapiens
cacguagacaagggcagcuaccugggcagugcuaccugggcacauucaguggcagugcuguacc

SEQ ID NO: 143523 - RNA, 64 nt, Homo Sapiens
gcuaccugggcacacacguaggcagugcuguaccccugggcagucauguuaagggcauuucagu

SEQ ID NO: 143524 - RNA, 64 nt, Homo Sapiens
agugagacccugucucaaaaccacugugcucccaccugggcaacugcagugagccaagauugca

SEQ ID NO: 143525 - RNA, 64 nt, Homo Sapiens
auggcgaaacuccauuucuagaguucaagaccagccugggcaacggcagaucacugaagcucag

SEQ ID NO: 143526 - RNA, 64 nt, Homo Sapiens
gaaggaucgcugcagcccaggaguucgagacuagccugggcaacauagcgagaccucgucucua

SEQ ID NO: 143527 - RNA, 64 nt, Homo Sapiens
ggaggauugcuugagcccaggaguuugagaccagccugggcaacacagcgagaccuugucucuu

SEQ ID NO: 143528 - RNA, 64 nt, Homo Sapiens
cccuucccuguuccuuucuugcacgcgcucccugccugggcacaccaaacugguugaaacacag

SEQ ID NO: 143529 - RNA, 64 nt, Homo Sapiens
uguucugcacugugggcuggcucucugccccaacccugggcacuggccccuggcugggccauuu

SEQ ID NO: 143530 - RNA, 64 nt, Homo Sapiens
cugucuccccuggucucacugucccugggcaggcccugggcaccuggcggggggucagcagcau

SEQ ID NO: 143531 - RNA, 64 nt, Homo Sapiens
cccugggcacccugucucccgucagcagcaugucccugggcaggggggugcaggguggcggggg

SEQ ID NO: 143532 - RNA, 64 nt, Homo Sapiens
auagaaagaccucuucccuagaguucaagagcagccugggcaaugguggauugcuugagcccag

SEQ ID NO: 143533 - RNA, 64 nt, Homo Sapiens
gaauucaggaaacugcuagaccaggacucucaucccugggcacaccaggccugaaacucccuuu

SEQ ID NO: 143534 - RNA, 64 nt, Homo Sapiens
agagacccugucucaaccacucauugcacuccagccugggcaacugcaaugagcuauaauugca

SEQ ID NO: 143535 - RNA, 64 nt, Homo Sapiens
guaguaaaaccucaucuauaccaccacccuccagccugggcaacucacacaaggaauauaaaaa

SEQ ID NO: 143536 - RNA, 64 nt, Homo Sapiens
gggacccccucaccauccaggccugccgcccccgccugggcacccucagcaagugcccagugga

SEQ ID NO: 143537 - RNA, 64 nt, Homo Sapiens
cagagcuacugagacuuggaccaagggcccagacccugggcaaagagccuuccuuucuccugcc

SEQ ID NO: 143538 - RNA, 64 nt, Homo Sapiens
ugcagugagucaagaucacgccauugcacuccagccugggcaacaagagcgaaacuccaucuca

SEQ ID NO: 143539 - RNA, 64 nt, Homo Sapiens
ggaggauuacuugaaacccacaguuugagaccagccugggcaacauagugagacccugucucua

SEQ ID NO: 143540 - RNA, 64 nt, Homo Sapiens
aggcggggaggauccauugagcccagcaguccaaccugggcaaaauagugagagacccuguauc

SEQ ID NO: 143541 - RNA, 64 nt, Homo Sapiens
ugcagugagcugagauugugccacugcacuccagccugggcaacaaagcaagacucugucucaa

SEQ ID NO: 143542 - RNA, 64 nt, Homo Sapiens
ugcagugagccaagaucaugucacugcauuccagccugggcaacagaggaagacuccgucucaa

SEQ ID NO: 143543 - RNA, 64 nt, Homo Sapiens
gacccuguaggauggggucaggggcccaggaaggccugggcagaccccuggcagugcucccgga

SEQ ID NO: 143544 - RNA, 64 nt, Homo Sapiens
aucccagcucccuccccucuggguucugggggggccugggcagggaagacugggggagagcagu

SEQ ID NO: 143545 - RNA, 64 nt, Homo Sapiens
guuacacccucccaugcagucaugccacccccauccugggcacaugcccuugauugugccagcc

SEQ ID NO: 143546 - RNA, 64 nt, Homo Sapiens
agagcgagacuccgucucaaccauugcaccccagccugggcaacuucagugagccgagauugca

SEQ ID NO: 143547 - RNA, 64 nt, Homo Sapiens
agaccagccccaaggccagaccaaggcauguaggccugggcagguggcucggggccacuggcgg

SEQ ID NO: 143548 - RNA, 64 nt, Homo Sapiens
gagaagagggugaaggagcuggggcaggccccauccugggcauuggagaugaugaaaccgagca

SEQ ID NO: 143549 - RNA, 64 nt, Homo Sapiens
cgggccucuagcuucagccagggcggguacacacccugggcacaggguccucagcccccgggaa

SEQ ID NO: 143550 - RNA, 64 nt, Homo Sapiens
acaagggaggggaaacuccaucaggaagugcuccccugggcagaggcgcccacugggugcugug

SEQ ID NO: 143551 - RNA, 64 nt, Homo Sapiens
ugucgugagcuaugauuaugccacugcuuuccagccugggcaacauaguaagaccccaucucuu

SEQ ID NO: 143552 - RNA, 64 nt, Homo Sapiens
ugcagugagccaugaucgagccacugcacuccagccugggcaacagaugaagacccuauuucag

SEQ ID NO: 143553 - RNA, 64 nt, Homo Sapiens
ggaggauugcuugaagccaggaguuugggaccagccugggcaacauagggggaucccaucucua

SEQ ID NO: 143554 - RNA, 64 nt, Homo Sapiens
ugcagugagcuaugauuguaccacugcacuccagccugggcaacagagcaagaccuugucucaa

SEQ ID NO: 143555 - RNA, 64 nt, Homo Sapiens
cuguagaagagauagcuauuaaaauaaucaguagccugggcauaguggcucacaccuguaaucc

SEQ ID NO: 143556 - RNA, 64 nt, Homo Sapiens
ggaggacugcuugaguccagaaguuuaagaccagccugggcaacacggggagacccugucucua

SEQ ID NO: 143557 - RNA, 64 nt, Homo Sapiens
gcauggguacacgcgcguuuccagugcacaucugccugggcaggacacgguuuccucuugcugg

SEQ ID NO: 143558 - RNA, 64 nt, Homo Sapiens
uugcaaugagcaagauugugccacugcacuccagccugggcaacagagcaagacucugucucaa

SEQ ID NO: 143559 - RNA, 64 nt, Homo Sapiens
acggcucccacuaaggccugcccaccaccgcccgccugggcagccaugaauguagcgccccagg

SEQ ID NO: 143560 - RNA, 64 nt, Homo Sapiens
gccccagcccgccaugccacaaggugggggaggcccugggcaggauguucacucuauuuauugg

SEQ ID NO: 143561 - RNA, 64 nt, Homo Sapiens
ggaggaucacuuaaggccaggaguucgagaccagccugggcaacagcaagaccucaucucuaca

SEQ ID NO: 143562 - RNA, 64 nt, Homo Sapiens
ggcaggaggaucacucgagcucaagaauucaagaccugggcaagagagagagacuuugucucua

SEQ ID NO: 143563 - RNA, 64 nt, Homo Sapiens
aagagcaaaacaaccucuguccacugcacuccagccugggcagcugcggugagccaagaucgcg

SEQ ID NO: 143564 - RNA, 64 nt, Homo Sapiens
cauaaaucgacacaugccaaugguucuaccacccccugggcauacccuaauauuugcaggagcg

SEQ ID NO: 143565 - RNA, 64 nt, Homo Sapiens
auggugaaaccaugucucuagaauuugaggccugccugggcaaaggcaaauugcuugaccucag

SEQ ID NO: 143566 - RNA, 64 nt, Homo Sapiens
gaggggcagcuucugagguugagggcuuuaguuuccugggcaggucuacccugugaagggaaau

SEQ ID NO: 143567 - RNA, 64 nt, Homo Sapiens
gcucuggugggagagggagagccagggagggaacccugggcaggaccaggggcugguggcccag

SEQ ID NO: 143568 - RNA, 64 nt, Homo Sapiens
acagcaagauccugucuaaaucacugcacuccagccugggcaacugaagagagcuaugacugca

SEQ ID NO: 143569 - RNA, 64 nt, Homo Sapiens
auagcaagacccccaccaucgaguuugagaccagccugggcaacggaggacugcuuaagcucag

SEQ ID NO: 143570 - RNA, 64 nt, Homo Sapiens
acugaaagggacccggagcuguugucccuuccauccugggcaaaauuuccccguucaacucccu

SEQ ID NO: 143571 - RNA, 64 nt, Homo Sapiens
cacuucuguucuuggacagaacauccacccugugccugggcagcgugguggccuagcauugcuu

SEQ ID NO: 143572 - RNA, 64 nt, Homo Sapiens
guaguaagacccccaucgcugaguucaagaccagccugggcaauggaggaucaguugagcccca

SEQ ID NO: 143573 - RNA, 64 nt, Homo Sapiens
acagcgagacuccgucucaaccacugcacuccagccugggcaacugcagugaaccaagaucaug

SEQ ID NO: 143574 - RNA, 64 nt, Homo Sapiens
agagcaacacucugucucaaccacugcacuccagccugggcagcugcagugagccgagauugcg

SEQ ID NO: 143575 - RNA, 64 nt, Homo Sapiens
agagggagcccccgucucaaccacugcacuccagccugggcaacugcauugagccaugauugca

SEQ ID NO: 143576 - RNA, 64 nt, Homo Sapiens
auggugagaccccaucucuagaguucaagaccagccugggcaacgggggauugauugaggccag

SEQ ID NO: 143577 - RNA, 64 nt, Homo Sapiens
agagugagacucuguuucuaccacugcacuccagccugggcaacugcagugagccgagaucguc

SEQ ID NO: 143578 - RNA, 64 nt, Homo Sapiens
auggugaaaccccaucucuagaguucaagaccagccugggcaagguggguggaucacaagucag

SEQ ID NO: 143579 - RNA, 64 nt, Homo Sapiens
aggaacgaaacucguucucaccauuacacuccagccugggcaccuucuauuaauggagaucauu

SEQ ID NO: 143580 - RNA, 64 nt, Homo Sapiens
aagaacaaaacuccaucuaaccacugcacuccagccugggcaacuguggugagccaagaucaug

SEQ ID NO: 143581 - RNA, 64 nt, Homo Sapiens
auagggagauccugucucuaaguugugaggucaaccugggcaaugaggaucacuugagaccagg

SEQ ID NO: 143582 - RNA, 64 nt, Homo Sapiens
augaugagaccccaucucuagaguuccagaucaaccugggcaacgaaggauugcuugaggccag

SEQ ID NO: 143583 - RNA, 64 nt, Homo Sapiens
ucggccuggucccagcaggugcugccucuuacucccugggcacccaucugugcucuuccaggau

SEQ ID NO: 143584 - RNA, 64 nt, Homo Sapiens
caucgccacgucuggcuaaucaaguagcugggagccugggcaugauccuccugccucagccucc

SEQ ID NO: 143585 - RNA, 64 nt, Homo Sapiens
uuuuuuguuguuguggugguuuuuuaacacaaagccugggcaacagagcaaaacucugucucaa

SEQ ID NO: 143586 - RNA, 64 nt, Homo Sapiens
cccugcucgugcugcccagaggcugaucugcaaaccugggcaguauuccacacugaagcucagu

SEQ ID NO: 143587 - RNA, 64 nt, Homo Sapiens
ggaggaucccuuuagcccaggaguuaaagaccagccugggcaacauagggagacccugucuuuu

SEQ ID NO: 143588 - RNA, 64 nt, Homo Sapiens
cugaggugggaggaucccaggaguucaaauccugccugggcaacauagcaagacccugucucuu

SEQ ID NO: 143589 - RNA, 64 nt, Homo Sapiens
uuggcaggacaagugggagccagugcucucccucccugggcagaccagaccucucucccuccua

SEQ ID NO: 143590 - RNA, 54 nt, Homo Sapiens
cggcauuuugacacauguccucgaccugggcacuuugaguccacagaaaucuga

SEQ ID NO: 143591 - RNA, 64 nt, Homo Sapiens
auggugaaacccaguuucuagagcuugagaccagccugggcaacgguggaucacuugagcucag

SEQ ID NO: 143592 - RNA, 64 nt, Homo Sapiens
guggcucacuccuguaaucuuuacaaaaaagaagccugggcacuaaauguuucuaguagcugca

SEQ ID NO: 143593 - RNA, 64 nt, Homo Sapiens
ucgugucuccuccugaccccgccugguggcuuagccugggcaggucccucuccugagaggggag

SEQ ID NO: 143594 - RNA, 64 nt, Homo Sapiens
aguguggaggugccgaggugaguguauaucucugccugggcaagcuguucauuccuuugugcag

SEQ ID NO: 143595 - RNA, 64 nt, Homo Sapiens
aggguugggcccugcuuuccgcuuucccaagcguccugggcaggcccuccguccagccagcaag

SEQ ID NO: 143596 - RNA, 64 nt, Homo Sapiens
gccugggucgcacccccuccucagaaaucacaagccugggcaugguaaaugcacuagcgcgagg

SEQ ID NO: 143597 - RNA, 64 nt, Homo Sapiens
aggcagggugcagguggggcuagggcaucccgggccugggcaucacguccaggugggcccagcc

SEQ ID NO: 143598 - RNA, 64 nt, Homo Sapiens
agagugagacucugucucaaccacugcacuccagccugggcaacugcagugagcugagaucacg

SEQ ID NO: 143599 - RNA, 64 nt, Homo Sapiens
agagcgagacucagucucaaccacugcacuccagccugggcaacagcagugagcugaagucccg

SEQ ID NO: 143600 - RNA, 64 nt, Homo Sapiens
acgccccaggggaccagccaggccuggaaugcccccugggcaggacccugggcaggaccagagg

SEQ ID NO: 143601 - RNA, 64 nt, Homo Sapiens
accagccaggccuggaaugcccccugggcaggacccugggcaggaccagaggcccacauggaug

SEQ ID NO: 143602 - RNA, 64 nt, Homo Sapiens
gccaagcugcuguuccuaugacaggcccacucaaccugggcagaccgagaggcccgugcacuuu

SEQ ID NO: 143603 - RNA, 64 nt, Homo Sapiens
gggaggcuggaagcauauuccccaagagcacugcccugggcaucaucucccuccugcgaggagc

SEQ ID NO: 143604 - RNA, 64 nt, Homo Sapiens
uagcucagauggcagaugagaguguagucaagggccugggcacaggagggagagcugcagagug

SEQ ID NO: 143605 - RNA, 64 nt, Homo Sapiens
cacauccccaucuguuaggccuuggugaggaggcccugggcaaagaagggucuuucgcaaagcg

SEQ ID NO: 143606 - RNA, 64 nt, Homo Sapiens
ccagccaaaacccucccagacgucuccucuccugccugggcaaaguccagcuuggcaccccguc

SEQ ID NO: 143607 - RNA, 64 nt, Homo Sapiens
ugcagugagcugagauugcgccauugcacuccagccugggcaacaagagcaaaauucugccuca

SEQ ID NO: 143608 - RNA, 64 nt, Homo Sapiens
accuccgggacugaccuucggcaucugccuggagccugggcagcuggcuggggccggggcugcc

SEQ ID NO: 143609 - RNA, 64 nt, Homo Sapiens
gaagcuuuggaagcagcaagccacaaggcccagcccugggcaagaccacgguguggggggugcc

SEQ ID NO: 143610 - RNA, 64 nt, Homo Sapiens
cugcaggcaggcagaccacgaggcggagggucucccugggcaccgaaagaacuuggacuucuaa

SEQ ID NO: 143611 - RNA, 64 nt, Homo Sapiens
cuugacgaggagcaaaccccgucugcgguucucgccugggcaguuccuuuuggcuggggucuga

SEQ ID NO: 143612 - RNA, 64 nt, Homo Sapiens
cccaccccugggagggaugacauccccaguccagccugggcaaccuccuccaccucucccauuc

SEQ ID NO: 143613 - RNA, 64 nt, Homo Sapiens
agagccagacuccgucucuaccacugcacuccagccugggcaacuguagugagcugagaucgug

SEQ ID NO: 143614 - RNA, 64 nt, Homo Sapiens
auggugaaacccugucucuagaguucgggaccagccugggcaacggcagaucaccugagaucag

SEQ ID NO: 143615 - RNA, 64 nt, Homo Sapiens
gaaggggagggaaauugcugagcaucucccgaguccugggcaggcaaaaaagaaaaggaagcug

SEQ ID NO: 143616 - RNA, 64 nt, Homo Sapiens
agagcaagacuccaucucaaccauugcacuccagccugggcaacugcagugagccgagaucacg

SEQ ID NO: 143617 - RNA, 64 nt, Homo Sapiens
ccgaacccugcgcucgcaccgagaccgggcacugccugggcaaagcuuccaccugggcuacacg

SEQ ID NO: 143618 - RNA, 64 nt, Homo Sapiens
gacagcuuccaccugggcuacucugggaguuuguccugggcacaaugcucccaucauugggcac

SEQ ID NO: 143619 - RNA, 64 nt, Homo Sapiens
guggucaugugagucugggauauucuuuagcuuaccugggcacaaacagaauuuuccauuuauu

SEQ ID NO: 143620 - RNA, 64 nt, Homo Sapiens
cacagccuucuaaauucccaaauccuagacugcuccugggcauuagcaaggcagagccuuuuua

SEQ ID NO: 143621 - RNA, 64 nt, Homo Sapiens
aagagugaaauucugucucaccauugcacuccagccugggcaacugcagugagccaagaucuug

SEQ ID NO: 143622 - RNA, 64 nt, Homo Sapiens
agugaaacuccaucucaaaaccacugcacuccagccugggcaacugcaaugagccgagaucaca

SEQ ID NO: 143623 - RNA, 64 nt, Homo Sapiens; identical to SEQ ID NO: 23628

SEQ ID NO: 143624 - RNA, 64 nt, Homo Sapiens; identical to SEQ ID NO: 23629

SEQ ID NO: 143625 - RNA, 64 nt, Homo Sapiens; identical to SEQ ID NO: 23630

SEQ ID NO: 143626 - RNA, 64 nt, Homo Sapiens; identical to SEQ ID NO: 23631

SEQ ID NO: 143627 - RNA, 64 nt, Homo Sapiens; identical to SEQ ID NO: 23632

SEQ ID NO: 143628 - RNA, 64 nt, Homo Sapiens; identical to SEQ ID NO: 23633

SEQ ID NO: 143629 - RNA, 64 nt, Homo Sapiens; identical to SEQ ID NO: 23634

SEQ ID NO: 143630 - RNA, 64 nt, Homo Sapiens; identical to SEQ ID NO: 23635

SEQ ID NO: 143631 - RNA, 64 nt, Homo Sapiens; identical to SEQ ID NO: 23636

SEQ ID NO: 143632 - RNA, 64 nt, Homo Sapiens; identical to SEQ ID NO: 23637

SEQ ID NO: 143633 - RNA, 64 nt, Homo Sapiens; identical to SEQ ID NO: 23638

SEQ ID NO: 143634 - RNA, 64 nt, Homo Sapiens; identical to SEQ ID NO: 23639

SEQ ID NO: 143635 - RNA, 64 nt, Homo Sapiens; identical to SEQ ID NO: 73772

SEQ ID NO: 143636 - RNA, 64 nt, Homo Sapiens; identical to SEQ ID NO: 73773

SEQ ID NO: 143637 - RNA, 64 nt, Homo Sapiens; identical to SEQ ID NO: 73774

SEQ ID NO: 143638 - RNA, 64 nt, Homo Sapiens; identical to SEQ ID NO: 73775

SEQ ID NO: 143639 - RNA, 64 nt, Homo Sapiens; identical to SEQ ID NO: 73776

SEQ ID NO: 143640 - RNA, 64 nt, Homo Sapiens; identical to SEQ ID NO: 73777

SEQ ID NO: 143641 - RNA, 64 nt, Homo Sapiens; identical to SEQ ID NO: 73778

SEQ ID NO: 143642 - RNA, 64 nt, Homo Sapiens; identical to SEQ ID NO: 73779

SEQ ID NO: 143643 - RNA, 64 nt, Homo Sapiens; identical to SEQ ID NO: 73780

SEQ ID NO: 143644 - RNA, 64 nt, Homo Sapiens; identical to SEQ ID NO: 73781

SEQ ID NO: 143645 - RNA, 64 nt, Homo Sapiens; identical to SEQ ID NO: 73782

SEQ ID NO: 143646 - RNA, 64 nt, Homo Sapiens; identical to SEQ ID NO: 73783

SEQ ID NO: 143647 - RNA, 64 nt, Homo Sapiens; identical to SEQ ID NO: 73784

SEQ ID NO: 143648 - RNA, 64 nt, Homo Sapiens; identical to SEQ ID NO: 73785

SEQ ID NO: 143649 - RNA, 64 nt, Homo Sapiens; identical to SEQ ID NO: 73786

SEQ ID NO: 143650 - RNA, 64 nt, Homo Sapiens; identical to SEQ ID NO: 73787

SEQ ID NO: 143651 - RNA, 64 nt, Homo Sapiens; identical to SEQ ID NO: 73788

SEQ ID NO: 143652 - RNA, 64 nt, Homo Sapiens; identical to SEQ ID NO: 73789

SEQ ID NO: 143653 - RNA, 64 nt, Homo Sapiens; identical to SEQ ID NO: 73790

SEQ ID NO: 143654 - RNA, 64 nt, Homo Sapiens; identical to SEQ ID NO: 73791

SEQ ID NO: 143655 - RNA, 64 nt, Homo Sapiens; identical to SEQ ID NO: 73792

SEQ ID NO: 143656 - RNA, 64 nt, Homo Sapiens; identical to SEQ ID NO: 73793

SEQ ID NO: 143657 - RNA, 64 nt, Homo Sapiens; identical to SEQ ID NO: 73794

SEQ ID NO: 143658 - RNA, 64 nt, Homo Sapiens; identical to SEQ ID NO: 73795

SEQ ID NO: 143659 - RNA, 64 nt, Homo Sapiens; identical to SEQ ID NO: 73796

SEQ ID NO: 143660 - RNA, 64 nt, Homo Sapiens; identical to SEQ ID NO: 73797

SEQ ID NO: 143661 - RNA, 64 nt, Homo Sapiens; identical to SEQ ID NO: 73798

SEQ ID NO: 143662 - RNA, 64 nt, Homo Sapiens; identical to SEQ ID NO: 73799

SEQ ID NO: 143663 - RNA, 64 nt, Homo Sapiens; identical to SEQ ID NO: 73800

SEQ ID NO: 143664 - RNA, 64 nt, Homo Sapiens; identical to SEQ ID NO: 73801

SEQ ID NO: 143665 - RNA, 64 nt, Homo Sapiens; identical to SEQ ID NO: 73802

SEQ ID NO: 143666 - RNA, 64 nt, Homo Sapiens; identical to SEQ ID NO: 73803

SEQ ID NO: 143667 - RNA, 64 nt, Homo Sapiens; identical to SEQ ID NO: 73804

SEQ ID NO: 143668 - RNA, 64 nt, Homo Sapiens; identical to SEQ ID NO: 73805

SEQ ID NO: 143669 - RNA, 64 nt, Homo Sapiens; identical to SEQ ID NO: 73806

SEQ ID NO: 143670 - RNA, 64 nt, Homo Sapiens; identical to SEQ ID NO: 73807

SEQ ID NO: 143671 - RNA, 64 nt, Homo Sapiens; identical to SEQ ID NO: 73808

SEQ ID NO: 143672 - RNA, 64 nt, Homo Sapiens; identical to SEQ ID NO: 73809

SEQ ID NO: 143673 - RNA, 64 nt, Homo Sapiens; identical to SEQ ID NO: 73810

SEQ ID NO: 143674 - RNA, 64 nt, Homo Sapiens; identical to SEQ ID NO: 73811

SEQ ID NO: 143675 - RNA, 64 nt, Homo Sapiens; identical to SEQ ID NO: 73812

SEQ ID NO: 143676 - RNA, 64 nt, Homo Sapiens; identical to SEQ ID NO: 73813

SEQ ID NO: 143677 - RNA, 64 nt, Homo Sapiens; identical to SEQ ID NO: 73814

SEQ ID NO: 143678 - RNA, 64 nt, Homo Sapiens; identical to SEQ ID NO: 73815

SEQ ID NO: 143679 - RNA, 64 nt, Homo Sapiens; identical to SEQ ID NO: 73816

SEQ ID NO: 143680 - RNA, 64 nt, Homo Sapiens; identical to SEQ ID NO: 73817

SEQ ID NO: 143681 - RNA, 64 nt, Homo Sapiens; identical to SEQ ID NO: 73818

SEQ ID NO: 143682 - RNA, 64 nt, Homo Sapiens; identical to SEQ ID NO: 73819

SEQ ID NO: 143683 - RNA, 64 nt, Homo Sapiens; identical to SEQ ID NO: 73820

SEQ ID NO: 143684 - RNA, 64 nt, Homo Sapiens; identical to SEQ ID NO: 73821

SEQ ID NO: 143685 - RNA, 64 nt, Homo Sapiens; identical to SEQ ID NO: 73822

SEQ ID NO: 143686 - RNA, 64 nt, Homo Sapiens; identical to SEQ ID NO: 73823

SEQ ID NO: 143687 - RNA, 64 nt, Homo Sapiens; identical to SEQ ID NO: 73824

SEQ ID NO: 143688 - RNA, 64 nt, Homo Sapiens; identical to SEQ ID NO: 73825

SEQ ID NO: 143689 - RNA, 64 nt, Homo Sapiens; identical to SEQ ID NO: 73826

SEQ ID NO: 143690 - RNA, 64 nt, Homo Sapiens; identical to SEQ ID NO: 73827

SEQ ID NO: 143691 - RNA, 64 nt, Homo Sapiens; identical to SEQ ID NO: 73828

SEQ ID NO: 143692 - RNA, 64 nt, Homo Sapiens; identical to SEQ ID NO: 73829

SEQ ID NO: 143693 - RNA, 64 nt, Homo Sapiens; identical to SEQ ID NO: 73830

SEQ ID NO: 143694 - RNA, 64 nt, Homo Sapiens
uguggguagcaaaaacaauucuaaaaauuugcaagucaaguaagugacuuuuagaaacaaaauu

SEQ ID NO: 143695 - RNA, 64 nt, Homo Sapiens
ggcaaugcaaagauucacauaacucaucauuuuagucaaguagacuaaguguguaugauaauga

SEQ ID NO: 143696 - RNA, 64 nt, Homo Sapiens
aauguuuucuacuuucguugauaauaaaggagaugggccauacaacauuguuuucuagagcaag

SEQ ID NO: 143697 - RNA, 64 nt, Homo Sapiens
uuuacucuaucaaaugaucuuuagcuauguuuuagggccauacacuuuaccugaggguaugucu

SEQ ID NO: 143698 - RNA, 62 nt, Homo Sapiens
guuuuggaugggaagggaagauaaaaauccaguuggcugagggguccccuaguuaggcccag

SEQ ID NO: 143699 - RNA, 62 nt, Homo Sapiens
aggggccaggccaagggccguccucuggcuauuuggcugagaccuccugggacagggcuggg

SEQ ID NO: 143700 - RNA, 62 nt, Homo Sapiens
uugccucuuuguccuggccuucuugcaguggcuuggcugacaaaauacaggggugcauacca

SEQ ID NO: 143701 - RNA, 62 nt, Homo Sapiens
uacaggggugcauaccaucugauugccugcccuuggcugaaagaaagcaguguguaauuuug

SEQ ID NO: 143702 - RNA, 62 nt, Homo Sapiens
uagaacaucuggucucgcugguuagugccucguuggcugaggacuaggugugcauuucuccu

SEQ ID NO: 143703 - RNA, 62 nt, Homo Sapiens
aaaaccaauucauuauuuguccagaaggaagcuuggcugagcuggccuuuuaacauaggaau

SEQ ID NO: 143704 - RNA, 62 nt, Homo Sapiens
cgcgcguucaaagcacuuuucgcucccuuguguuggcugacaaaggcuaaaaauaacuggug

SEQ ID NO: 143705 - RNA, 62 nt, Homo Sapiens
agacggacuugcuugccucuuugguggaucuguuggcugaaacucccguguuggguagaaau

SEQ ID NO: 143706 - RNA, 62 nt, Homo Sapiens
auugaggaugcaaacauuccauggcaccuauauuggcugauaauaucaggaagggcuuuggg

SEQ ID NO: 143707 - RNA, 62 nt, Homo Sapiens
gaagauaaucauagguugugcugaaguucaacuuggcugaguuuauauaagaauugcuaaag

SEQ ID NO: 143708 - RNA, 62 nt, Homo Sapiens
cugcugucucagaggccuuggucaggaugaaguuggcugacacagcuuagcuugguuuugcu

SEQ ID NO: 143709 - RNA, 60 nt, Homo Sapiens
gauaaaaacugauuaaaccuuuguggcugugguuggcugacauggggucuguguuucacu

SEQ ID NO: 143710 - RNA, 62 nt, Homo Sapiens
ccacacccaggaccacugucagccccaucugcuuggcugaccccaggaucccgcagggcaac

SEQ ID NO: 143711 - RNA, 62 nt, Homo Sapiens
gggcuaccugcccagccccugauggccugccuuuggcugagauggcaggacaagugggagca

SEQ ID NO: 143712 - RNA, 64 nt, Homo Sapiens
cugcucccuguguucccacccuccaguguuggcacaggcccaccccuggcuccaccagagccag

SEQ ID NO: 143713 - RNA, 64 nt, Homo Sapiens
gggccucggcaccuggcccuggcagcacagcucucaggcccagcccugggcgaccuccuuggcc

SEQ ID NO: 143714 - RNA, 64 nt, Homo Sapiens
cccuaacugcccccugccugcuccggcacugccccaggcccagcuccuggcccuaggucccucc

SEQ ID NO: 143715 - RNA, 64 nt, Homo Sapiens
cagggugugggggcagcugugccaaucuaccucacaggcccacccccugccgggcaugccgugg

SEQ ID NO: 143716 - RNA, 64 nt, Homo Sapiens
acacccuggugcccugcaccagacaggccguggucaggcccaggccaccggccggguucugcca

SEQ ID NO: 143717 - RNA, 64 nt, Homo Sapiens
uaggcccuuccaccagcuggggagcuagagggagcaggcccaagggcagagcagaggcugaggc

SEQ ID NO: 143718 - RNA, 64 nt, Homo Sapiens
cucccuucuucaguaagcaaggagccccgccccucaggcccagccucuggcaagagguggugga

SEQ ID NO: 143719 - RNA, 64 nt, Homo Sapiens
ugugccggguaguagaggaggauaagggcaaaaccaggcccaggccagugccuggcuuggucug

SEQ ID NO: 143720 - RNA, 64 nt, Homo Sapiens
aaggauauucccuuggcuaugguccugccaggugcaggcccaggcccaugaccccaccuuuacu

SEQ ID NO: 143721 - RNA, 64 nt, Homo Sapiens
auucccuuggcuaugguccugccaggugcaggcccaggcccaugaccccaccuuuacuaagcac

SEQ ID NO: 143722 - RNA, 64 nt, Homo Sapiens
cugagugguauuuucuuuagcaggcacgagccaccaggcccagccucccaaaguguugagauga

SEQ ID NO: 143723 - RNA, 64 nt, Homo Sapiens
acuguccauguuccagggcagagaccucugcagacaggcccaucagguuguucuaguuuuuagu

SEQ ID NO: 143724 - RNA, 64 nt, Homo Sapiens
cacuuugcucuaauucuuucggauccuacaaacccaggcccacuaauccaagagaaguuuguga

SEQ ID NO: 143725 - RNA, 64 nt, Homo Sapiens
ccacuuugucguguuuguuuuuuuuagcccagcacaggcccaggagggcuaucagaaggucucc

SEQ ID NO: 143726 - RNA, 64 nt, Homo Sapiens
aggccaccccccucuucaggcugcugcaggaggccaggcccaggccagagaccccaggcagccu

SEQ ID NO: 143727 - RNA, 64 nt, Homo Sapiens
cucacugcuggagcggggaaaccgcagcucagcccaggcccagcuggggagaaggcgcuaccug

SEQ ID NO: 143728 - RNA, 64 nt, Homo Sapiens
ugacugcgucucggcucuggccaugagcucugcccaggcccacaagccccuccccugggcucuc

SEQ ID NO: 143729 - RNA, 64 nt, Homo Sapiens
cagggaaagugggagguggugcuggugcucucuccaggcccaccaugcugggagaggcggccag

SEQ ID NO: 143730 - RNA, 64 nt, Homo Sapiens
ugaggagcugugagaagcagccagccagcgccuccaggcccagcuucccagagcucccucugcc

SEQ ID NO: 143731 - RNA, 64 nt, Homo Sapiens
cuccagaggaagacuccugagcgccacccuucuucaggcccaggucuugccccaccuggcugag

SEQ ID NO: 143732 - RNA, 64 nt, Homo Sapiens
guggcugcugcuuccugcuagcuugggagacagccaggcccaggaggugcucauggggugcggu

SEQ ID NO: 143733 - RNA, 64 nt, Homo Sapiens
ccauccccucccucauccuccccgugacagccggcaggcccagccgggucugaaccugagcccu

SEQ ID NO: 143734 - RNA, 64 nt, Homo Sapiens
ugucagcaucaggaaggccuuugcuucuugcacccaggcccagcugagacaggccccugagucc

SEQ ID NO: 143735 - RNA, 64 nt, Homo Sapiens
cagcucccugaggaccaccuccuacacuauugaccaggcccagaaggaaccagccaugaggugc

SEQ ID NO: 143736 - RNA, 64 nt, Homo Sapiens
agggacuugccuuccccacccacucugcugccagcaggcccagggaucccugaccugcaccagg

SEQ ID NO: 143737 - RNA, 64 nt, Homo Sapiens
auaaacgaagcacuuuauucuguacagauuugggcaggcccaaggugcccgagugaucugagga

SEQ ID NO: 143738 - RNA, 64 nt, Homo Sapiens
ggucagagacggcagaaaacagagccugccuaaccaggcccagccaguugguggggccaggcca

SEQ ID NO: 143739 - RNA, 64 nt, Homo Sapiens
uuugacucagaggcugggagcauagcagaggggccaggcccaggcagagcugacgggaggcccc

SEQ ID NO: 143740 - RNA, 64 nt, Homo Sapiens
ccuggcuucccugauggucucucccuccuggccucaggcccauuccugaggaagggccuuggcg

SEQ ID NO: 143741 - RNA, 64 nt, Homo Sapiens
ccagggcagccaguggcucuagcucagggaaagccaggcccaccugcccuauccccucccuugc

SEQ ID NO: 143742 - RNA, 64 nt, Homo Sapiens
cucucuggcucagcccgggagggggcacuguggucaggcccagcaccauggcaccuuugagaga

SEQ ID NO: 143743 - RNA, 64 nt, Homo Sapiens
ucucgugcccuuagaggggagggaaagggauggucaggcccaguuuggcccugcgcccugugca

SEQ ID NO: 143744 - RNA, 64 nt, Homo Sapiens
cagacagauccccuaggccuaucugagacccauacaggcccacaccugagcuccugucugccug

SEQ ID NO: 143745 - RNA, 64 nt, Homo Sapiens
accaaaacuuggcagcugugccagaaaccaaagccaggcccagauguagggggagggcacgaga

SEQ ID NO: 143746 - RNA, 64 nt, Homo Sapiens
gggcuucccaguaaggcccacucuuggccugccccaggcccagaugcccaggcccaggggcagg

SEQ ID NO: 143747 - RNA, 64 nt, Homo Sapiens
ggcaggcucuuggccugcccgagaccuugcugcccaggcccaggacuggccucuguccuuggca

SEQ ID NO: 143748 - RNA, 64 nt, Homo Sapiens
ugagacaggcaacgccaggucaaguccugcugcccaggcccaggugucugcuggguucuuuucu

SEQ ID NO: 143749 - RNA, 64 nt, Homo Sapiens
gacugucugugugcccuguggggguccgugugagcaggcccaccuggcuccagacccgccccca

SEQ ID NO: 143750 - RNA, 64 nt, Homo Sapiens
uggagacauccacacccauucccagguguccuuccaggcccauuguccacgucuucaagggggc

SEQ ID NO: 143751 - RNA, 64 nt, Homo Sapiens
cacacggucccucaggucagccgucuagaaacaccaggcccagaacaagugacuguagggggga

SEQ ID NO: 143752 - RNA, 64 nt, Homo Sapiens
ugacaagcguggggcuggugagagcagcagcugucaggcccagcguuuucaugaauagaaaaca

SEQ ID NO: 143753 - RNA, 64 nt, Homo Sapiens
uccugcccggcguaggcccuaaaguaggccucgccaggcccaccaaaguggcccaaagcguccc

SEQ ID NO: 143754 - RNA, 64 nt, Homo Sapiens
ucccgccucccggcggccuucgcagcagccuuuccaggcccagcccccucaccuugccucaccu

SEQ ID NO: 143755 - RNA, 64 nt, Homo Sapiens
acuuccucaagucggccuccugugguggccucuccaggcccagauugaggcccagcuuuucccu

SEQ ID NO: 143756 - RNA, 64 nt, Homo Sapiens
ggguggaaucuguccccaccgcuuuucuuccucccaggcccagucccugacuaguggccaaggu

SEQ ID NO: 143757 - RNA, 64 nt, Homo Sapiens
agacccugaagagccuggguagcagcagcugacccaggcccaaggagcacccgccagaggcugc

SEQ ID NO: 143758 - RNA, 64 nt, Homo Sapiens
ccaacuuuuugaugucccuguagggcuggccagucaggcccagccaaagcccccuccucagucu

SEQ ID NO: 143759 - RNA, 64 nt, Homo Sapiens
uccucagucuccacagacccacaugugagcagcccaggcccaucggugcuccucagagguaggu

SEQ ID NO: 143760 - RNA, 64 nt, Homo Sapiens
cacucugcccgugucacacggugcgauccaggcccaggcccacaagacagagggccacggcugc

SEQ ID NO: 143761 - RNA, 64 nt, Homo Sapiens
cccacacacucugcccguguggcugcgugcgauccaggcccaggcuuuguagacagagggccac

SEQ ID NO: 143762 - RNA, 64 nt, Homo Sapiens
gccuuggucuccccccugggcacacgugcucacucaggcccagcaaugaccucugcucauuuuu

SEQ ID NO: 143763 - RNA, 64 nt, Homo Sapiens
auggguagugucuacacguccccgggcucaggcucaggcccagcccugggcugaccugagagga

SEQ ID NO: 143764 - RNA, 64 nt, Homo Sapiens
ucagccagggagaacugggcggguuuaguggccccaggcccacuccucaugcagcagugugcug

SEQ ID NO: 143765 - RNA, 64 nt, Homo Sapiens
gagcuccgaagcggucaaagugagcugagcaggacaggcccagccuuucuccacugccacgucc

SEQ ID NO: 143766 - RNA, 64 nt, Homo Sapiens
agacccagguccuugugcucaguccugcgcaaaccaggcccagacccugcaagcauuuguugau

SEQ ID NO: 143767 - RNA, 64 nt, Homo Sapiens
gcccagacccugcaagcauuuguugaugcccuugcaggcccacugggagaaagaugccucaggc

SEQ ID NO: 143768 - RNA, 64 nt, Homo Sapiens
ggcaagucugggcccugggguagggagggagacucaggcccacacuuggguauuuucuaauuuc

SEQ ID NO: 143769 - RNA, 64 nt, Homo Sapiens
guggcaccugguucuccgaugccugggcuggugucaggcccaggacuguagugcugggagcagu

SEQ ID NO: 143770 - RNA, 64 nt, Homo Sapiens
gcacagcguggaggucagcggcucccagcucugccaggcccauucccagcugcugcaguacgug

SEQ ID NO: 143771 - RNA, 64 nt, Homo Sapiens
cguccugcccaccuucuuaagaggcgagauggagcaggcccaucugccucugcccuuucuagcc

SEQ ID NO: 143772 - RNA, 64 nt, Homo Sapiens
ugggccugggcuuccacagugugaagacacugugcaggcccaggcaggcccagccucugcccca

SEQ ID NO: 143773 - RNA, 64 nt, Homo Sapiens
cuuccacagugugaagacacugugcaggcccaggcaggcccagccucugccccacccaucagug

SEQ ID NO: 143774 - RNA, 64 nt, Homo Sapiens
cucaaggcaaggagggcgcuggccaccuuugucccaggcccagcccugccugggcuggcuguga

SEQ ID NO: 143775 - RNA, 64 nt, Homo Sapiens
acuguggcuggacugccgcgaaaggcugauugugcaggcccagccuuccuguuccaguucaccu

SEQ ID NO: 143776 - RNA, 64 nt, Homo Sapiens
uggccuccuccuugcuuggaggccagggcuaccccaggcccaugacggcagagcaggugggcaa

SEQ ID NO: 143777 - RNA, 64 nt, Homo Sapiens
uucuggaauagacaguuccuucaacccaguuccccaggcccagcggcuccuucccguggcugcu

SEQ ID NO: 143778 - RNA, 64 nt, Homo Sapiens
cucacaacugcuuguucaggauccaggggugugccaggcccaccgaccagaugcuccuguaaac

SEQ ID NO: 143779 - RNA, 64 nt, Homo Sapiens
uccaggcccugcuccucagauagcucuggcuuugcaggcccagccccagcccuucuucuagugg

SEQ ID NO: 143780 - RNA, 64 nt, Homo Sapiens
agguauggagacacccuggcccccugcccaggcucaggcccaugggggcuaugugcacuccaga

SEQ ID NO: 143781 - RNA, 64 nt, Homo Sapiens
cugacccuacauuacauaggccuggcucaucccucaggcccaccggugugucaccugcccacca

SEQ ID NO: 143782 - RNA, 64 nt, Homo Sapiens
caggcagagccgagaguucgccccaacccuuccccaggcccagugugaaaaacagacucacaag

SEQ ID NO: 143783 - RNA, 64 nt, Homo Sapiens
aguccugccagcagccgcaaagagccgaggcugccaggcccauuuaugucccucaugucucuag

SEQ ID NO: 143784 - RNA, 64 nt, Homo Sapiens
agcccccagggugggauuucucaggcugccagggcaggcccaggccucaggaagaaggggaggc

SEQ ID NO: 143785 - RNA, 64 nt, Homo Sapiens
cccagcugggccucucuggccuauuccuaccuuccaggcccacugcacuccugucugggaggcc

SEQ ID NO: 143786 - RNA, 64 nt, Homo Sapiens
acagguggaucccauggcauccccauggaggaaccaggcccaucugggcagcagcaucugguug

SEQ ID NO: 143787 - RNA, 64 nt, Homo Sapiens
ugcagaagcuuagcauaugcccuuguguucggaucaggcccacagggcugcucaaagaguagag

SEQ ID NO: 143788 - RNA, 64 nt, Homo Sapiens
ggacuggggugacucacgggccggcuuggguacacaggcccagagugcacuccccggccugcau

SEQ ID NO: 143789 - RNA, 64 nt, Homo Sapiens
cuccacucuccucgucuaggggcgccuccuugcgcaggcccagcgggcaguggucuccccccuu

SEQ ID NO: 143790 - RNA, 57 nt, Homo Sapiens
acauucucggggggcccuagcugagcgcaggcccaggccccacuugcuuccugcggg

SEQ ID NO: 143791 - RNA, 64 nt, Homo Sapiens
aggccccacuugcuuccugcgggugggaaagcugcaggcccaggccuugcuucccuaucaggcu

SEQ ID NO: 143792 - RNA, 64 nt, Homo Sapiens
ccagugugcggggagccucugccugagugugcaccaggcccauguuuauugaccacagucugag

SEQ ID NO: 143793 - RNA, 64 nt, Homo Sapiens
cggggcccugauguggaguagacagugcgcaccucaggcccacacacggccccgcccuggggcc

SEQ ID NO: 143794 - RNA, 64 nt, Homo Sapiens
cacccgguaccucccgagaggugcuaccgggccccaggcccagcggcagauaccguuaagcgcu

SEQ ID NO: 143795 - RNA, 64 nt, Homo Sapiens
ggggccaccgcagagccgagagcuaaaggaagggcaggcccacaaugccgcgggcagcagcugg

SEQ ID NO: 143796 - RNA, 64 nt, Homo Sapiens
accccauccucagugcccaaugcuguggccccaccaggcccagagccugguuggccauucucau

SEQ ID NO: 143797 - RNA, 64 nt, Homo Sapiens
ucgacccgggccaggaggcccggggcgcugagcucaggcccagaacuggcugauuucagggaua

SEQ ID NO: 143798 - RNA, 64 nt, Homo Sapiens
gcauggcugcaggguggaccagcugccuggcauucaggcccagaugccugcagggcuggggcuc

SEQ ID NO: 143799 - RNA, 64 nt, Homo Sapiens
aggaguccuugcagaccugcugccucccccacgacaggcccaaagauggacccccccuggccuu

SEQ ID NO: 143800 - RNA, 64 nt, Homo Sapiens
gcagguguccuggcagggggacaggagacuguaacaggcccagguccuugugcagcccgugaau

SEQ ID NO: 143801 - RNA, 64 nt, Homo Sapiens
ugaccacggcugcuggaccccuucccuguucaggcaggcccagccccucucagaaccugcugcc

SEQ ID NO: 143802 - RNA, 64 nt, Homo Sapiens
ugcucaggaccccccgcacugucccaaucccacucaggcccaccuccagcuggccucacuccgc

SEQ ID NO: 143803 - RNA, 64 nt, Homo Sapiens
ccugcucaggagcccccacugucccagucccacucaggcccaucucuggcuggccucacugcgc

SEQ ID NO: 143804 - RNA, 64 nt, Homo Sapiens
ccugauaaaguuaguagcugcccucaucagaaaccaggcccaggcaguggggacacauccagag

SEQ ID NO: 143805 - RNA, 64 nt, Homo Sapiens
gugggguggaugggcccaaaccggcacuccccgccaggcccagggccuccccggcagcaagacc

SEQ ID NO: 143806 - RNA, 64 nt, Homo Sapiens
caggaggucccaccccagaccccauagcaucccacaggcccaggcaggaacacgcagacauaug

SEQ ID NO: 143807 - RNA, 64 nt, Homo Sapiens
gaccgagccccucucccugucagcagugcugugucaggcccaggaccugcauuuauuuauugag

SEQ ID NO: 143808 - RNA, 64 nt, Homo Sapiens
ggcacauugaacaggaggaccugaccugggaccccaggcccaggggccuggagaccacccagcc

SEQ ID NO: 143809 - RNA, 64 nt, Homo Sapiens
uugcccacaccugccucugaguggggaggagacucaggcccacaccccgcgggcagugacguga

SEQ ID NO: 143810 - RNA, 64 nt, Homo Sapiens
cccuccguccuggcagggcacugggguuuccacacaggcccaugcucaugggagucagggagcc

SEQ ID NO: 143811 - RNA, 64 nt, Homo Sapiens
ugggugggcaguggccaagcugcuguuccuaugacaggcccacucaaccugggcagaccgagag

SEQ ID NO: 143812 - RNA, 64 nt, Homo Sapiens
uuuuuuuuuuuuuugauggaagaccaaggguugccaggcccacuguaacugccgagcugccugc

SEQ ID NO: 143813 - RNA, 62 nt, Homo Sapiens
uucccucacccccagaaacaaguggucagguuuccccugaccuaccugccucacuccugucc

SEQ ID NO: 143814 - RNA, 62 nt, Homo Sapiens
aagguccauuucuucccagggaggucaaggcuuccccugagucacaggcucagacuaaauca

SEQ ID NO: 143815 - RNA, 62 nt, Homo Sapiens
uuugcuauaacuaagcaaccucagaggaugcuuccccugagggguuguugugcugaggccag

SEQ ID NO: 143816 - RNA, 62 nt, Homo Sapiens
cugagcugagcccaguaucccacugacagguauccccugaaauggggcuuggaggaccgagc

SEQ ID NO: 143817 - RNA, 62 nt, Homo Sapiens
uccccuggcucaguccuaaccuuccccugagguccccugauaucccccacugucccgguccu

SEQ ID NO: 143818 - RNA, 62 nt, Homo Sapiens
uccccugauauccccuggcuucccgguccucuuccccugaggcuggccaccuucccccacug

SEQ ID NO: 143819 - RNA, 62 nt, Homo Sapiens
ccugccccggcauugcaucuucccuagauagguccccugagggcugagugggagggcggccc

SEQ ID NO: 143820 - RNA, 62 nt, Homo Sapiens
aaggucaaauggggucaucugcuccuuuuccauccccugacauaccuuaaccucugaacucu

SEQ ID NO: 143821 - RNA, 62 nt, Homo Sapiens
cugugagagcuauccacucuccugccugcauauccccugagaguuauaggaagugcccacug

SEQ ID NO: 143822 - RNA, 62 nt, Homo Sapiens
caucggcuggcuuugggacuauuccaccuccuuccccugagcccagaucugcccccaccauc

SEQ ID NO: 143823 - RNA, 62 nt, Homo Sapiens
acuaccugggucucauuccacaacaccagaaauccccugagcacugguugcuuguccauggc

SEQ ID NO: 143824 - RNA, 62 nt, Homo Sapiens
cuuuccccacauugguaagagcagagguucauuccccugaccuugggaauucaaauuguccu

SEQ ID NO: 143825 - RNA, 64 nt, Homo Sapiens
gacuguuuucauuucuguuuuuagcagagacaugcaacaacaacacacacgcacacacgcacac

SEQ ID NO: 143826 - RNA, 64 nt, Homo Sapiens
uguuuucauuucuguuuuuagcagagacaugcaacaacaacacacacgcacacacgcacacaca

SEQ ID NO: 143827 - RNA, 64 nt, Homo Sapiens
aaguuuugaaaugcugcacuuacauuuaaaaaaacaacaacaacauuuuuucaacaauuucaac

SEQ ID NO: 143828 - RNA, 64 nt, Homo Sapiens
uuuugaaaugcugcacuuacauuuaaaaaaacaacaacaacauuuuuucaacaauuucaacaau

SEQ ID NO: 143829 - RNA, 64 nt, Homo Sapiens
augaugcuaauggagaugaugguaaugauaaagacaacaacaaugauuaucaaguuccuguaca

SEQ ID NO: 143830 - RNA, 64 nt, Homo Sapiens
uaaccaaaggguuugcuaacucugcuucaacauccaacaacacaaaacuauaugauuuuuaaaa

SEQ ID NO: 143831 - RNA, 64 nt, Homo Sapiens
acuuaggaggcccauagaaacauucucguuuaaacaacaacaacaaaauaaauuuaucagcacu

SEQ ID NO: 143832 - RNA, 64 nt, Homo Sapiens
uaggaggcccauagaaacauucucguuuaaacaacaacaacaaaauaaauuuaucagcacuaga

SEQ ID NO: 143833 - RNA, 64 nt, Homo Sapiens
cagcccuaagucuccuucuuuauuauuaggaaaacaacaacaacaacaaacaaaaaaauggcgu

SEQ ID NO: 143834 - RNA, 64 nt, Homo Sapiens
cccuaagucuccuucuuuauuauuaggaaaacaacaacaacaacaaacaaaaaaauggcgucau

SEQ ID NO: 143835 - RNA, 64 nt, Homo Sapiens
uaagucuccuucuuuauuauuaggaaaacaacaacaacaacaaacaaaaaaauggcgucaugaa

SEQ ID NO: 143836 - RNA, 64 nt, Homo Sapiens
aaacuaagcgauugggaaaacaguuaaaaaacaacaacaacaaacugggucagaaugaucuacu

SEQ ID NO: 143837 - RNA, 64 nt, Homo Sapiens
aaaaaacuaagcgauugggaacucaguuaaaaaacaacaacaacguucugggucagaaugaucu

SEQ ID NO: 143838 - RNA, 64 nt, Homo Sapiens
aacaauaaauccuaaguguauuaaaaaacaacaacaacaacaauauugcagaaguagcuuauca

SEQ ID NO: 143839 - RNA, 64 nt, Homo Sapiens
aauaacaauaaauccuaaguucauuaaaaaacaacaacaacaacaaaauugcagaaguagcuua

SEQ ID NO: 143840 - RNA, 64 nt, Homo Sapiens
aacaauaacaauaaauccuauuaucauuaaaaaacaacaacaacguuaaaauugcagaaguagc

SEQ ID NO: 143841 - RNA, 64 nt, Homo Sapiens
aaauaaaucaagaaggcauaaaugcugugaacaacaacaacaaaguuccaaaucccaucaacaa

SEQ ID NO: 143842 - RNA, 64 nt, Homo Sapiens
aaaaaauaaaucaagaaggccaaaaugcugugaacaacaacaacaguguuccaaaucccaucaa

SEQ ID NO: 143843 - RNA, 64 nt, Homo Sapiens
aacaaaaugaaacuaaucugaugauugaaaacaacaacaacaaaugaaguaauaguuucagugg

SEQ ID NO: 143844 - RNA, 64 nt, Homo Sapiens
aaaaacaaaaugaaacuaauuggaugauugaaaacaacaacaacuggugaaguaauaguuucag

SEQ ID NO: 143845 - RNA, 57 nt, Homo Sapiens
acaccucugucaauguaagaaaaacaacaacaacaaaaaagagcuuauaugugguaa

SEQ ID NO: 143846 - RNA, 54 nt, Homo Sapiens
aaaacaccucugucaauguaaaaacaacaacaacaaagagcuuauaugugguaa

SEQ ID NO: 143847 - RNA, 64 nt, Homo Sapiens
ucgcagguguucaugauuucuuuuauucuuugcacaacaacaacaacaacaaauucacggaauc

SEQ ID NO: 143848 - RNA, 64 nt, Homo Sapiens
cagguguucaugauuucuuuuauucuuugcacaacaacaacaacaacaaauucacggaaucuuu

SEQ ID NO: 143849 - RNA, 64 nt, Homo Sapiens
guguucaugauuucuuuuauucuuugcacaacaacaacaacaacaaauucacggaaucuuuuaa

SEQ ID NO: 143850 - RNA, 64 nt, Homo Sapiens
uucaugauuucuuuuauucuuugcacaacaacaacaacaacaaauucacggaaucuuuuaagug

SEQ ID NO: 143851 - RNA, 64 nt, Homo Sapiens
cagccugggcgacagagugagacuccaucucaaacaacaacaacaacaacaacaacaacaacaa

SEQ ID NO: 143852 - RNA, 64 nt, Homo Sapiens
ccugggcgacagagugagacuccaucucaaacaacaacaacaacaacaacaacaacaacaaacc

SEQ ID NO: 143853 - RNA, 64 nt, Homo Sapiens
gggcgacagagugagacuccaucucaaacaacaacaacaacaacaacaacaacaacaaaccaca

SEQ ID NO: 143854 - RNA, 64 nt, Homo Sapiens
cgacagagugagacuccaucucaaacaacaacaacaacaacaacaacaacaacaaaccacaaaa

SEQ ID NO: 143855 - RNA, 64 nt, Homo Sapiens
cagagugagacuccaucucaaacaacaacaacaacaacaacaacaacaacaaaccacaaaauua

SEQ ID NO: 143856 - RNA, 64 nt, Homo Sapiens
agugagacuccaucucaaacaacaacaacaacaacaacaacaacaacaaaccacaaaauuauuu

SEQ ID NO: 143857 - RNA, 64 nt, Homo Sapiens
gagacuccaucucaaacaacaacaacaacaacaacaacaacaacaaaccacaaaauuauuugag

SEQ ID NO: 143858 - RNA, 64 nt, Homo Sapiens
acuccaucucaaacaacaacaacaacaacaacaacaacaacaaaccacaaaauuauuugaguac

SEQ ID NO: 143859 - RNA, 64 nt, Homo Sapiens
auuauaaagguagaaaauaaacaaaaacaaacaacaacaacaaaucucaaaaaaaacccaaaaa

SEQ ID NO: 143860 - RNA, 64 nt, Homo Sapiens
aaaauuauaaagguagaaaaaaaacaaaaacaaacaacaacaacgcaucucaaaaaaaacccaa

SEQ ID NO: 143861 - RNA, 64 nt, Homo Sapiens
gugcaauacaggcugaaccuaaccaacaccaacucaacaacaaacucuccacaacaacaaugaa

SEQ ID NO: 143862 - RNA, 64 nt, Homo Sapiens
gaaaaccaacaccaacucaaaaugccacucuccacaacaacaauucugcuauuuccaaucaguc

SEQ ID NO: 143863 - RNA, 64 nt, Homo Sapiens
ccaaccaaggacggaaaaugcuuaaaaaauaauacaacaacaacaaaaaauacauuauaacaac

SEQ ID NO: 143864 - RNA, 64 nt, Homo Sapiens
accaaggacggaaaaugcuuaaaaaauaauacaacaacaacaaaaaauacauuauaacaacuau

SEQ ID NO: 143865 - RNA, 64 nt, Homo Sapiens
uguguuccuaacaggaauuuucauuguucuauaacaacaacaacaaaagcgauuauuauuuuag

SEQ ID NO: 143866 - RNA, 64 nt, Homo Sapiens
guuccuaacaggaauuuucauuguucuauaacaacaacaacaaaagcgauuauuauuuuagagc

SEQ ID NO: 143867 - RNA, 64 nt, Homo Sapiens
uggaaagaauggaggaagcacuucaaguagccaucaacaacaacagaggauuugucucacccau

SEQ ID NO: 143868 - RNA, 64 nt, Homo Sapiens
aaagaauggaggaagcacuucaaguagccaucaacaacaacagaggauuugucucacccaugcu

SEQ ID NO: 143869 - RNA, 64 nt, Homo Sapiens
aacaacaaugguuuacaugauacaacaagaacaacaacaacaauacaaaacaaaacaacaacaa

SEQ ID NO: 143870 - RNA, 64 nt, Homo Sapiens
aauaacaacaaugguuuacacaauacaacaagaacaacaacaacaaaacaaaacaaaacaacaa

SEQ ID NO: 143871 - RNA, 64 nt, Homo Sapiens
acaacaagaacaacaacaacaaaacaaaacaaaacaacaacaauuacuuuacacucucuguaca

SEQ ID NO: 143872 - RNA, 64 nt, Homo Sapiens
aagaugauaccaaaacaaggaaaagcaacaacagcaacaacacguuugaauguguagaagagga

SEQ ID NO: 143873 - RNA, 64 nt, Homo Sapiens
aacaacacgaagaugauaccagaagaggaaaaagcaacaacagcgaaaguuuguuugaaugugu

SEQ ID NO: 143874 - RNA, 64 nt, Homo Sapiens
aguccauucauauuuuuuaacauucugaaaacaacaacaacaaaguuacggguuacaacugguu

SEQ ID NO: 143875 - RNA, 64 nt, Homo Sapiens
aaaaguccauucauauuuuuguucauucugaaaacaacaacaacucaguuacggguuacaacug

SEQ ID NO: 143876 - RNA, 64 nt, Homo Sapiens
aaacccugaaagaacuggcaauagggaacaacaacaacaacaaauuguuuccauguauauggaa

SEQ ID NO: 143877 - RNA, 64 nt, Homo Sapiens
aaaaaacccugaaagaacuggaaauagggaacaacaacaacaacuuuuuguuuccauguauaug

SEQ ID NO: 143878 - RNA, 64 nt, Homo Sapiens
aacaaaaaacccugaaagaaauggaaauagggaacaacaacaacgcauuuuuguuuccauguau

SEQ ID NO: 143879 - RNA, 64 nt, Homo Sapiens
auacgucaacaccuaugaaaagaagcggggaaaacaacaacaaggacaacaacaaaaaaccagu

SEQ ID NO: 143880 - RNA, 64 nt, Homo Sapiens
cuaugaaaagaagcggggaaaacaacaacaaggacaacaacaaaaaaccagugaaauucuacaa

SEQ ID NO: 143881 - RNA, 64 nt, Homo Sapiens
cagaaggauaaacuggcuugaacaacaacaacaacaacaacaaagcaaaaauuaaaacaacaac

SEQ ID NO: 143882 - RNA, 64 nt, Homo Sapiens
aaacagaaggauaaacuggcaacaacaacaacaacaacaacaacuuggcaaaaauuaaaacaac

SEQ ID NO: 143883 - RNA, 64 nt, Homo Sapiens
aacaaacagaaggauaaacuaacaacaacaacaacaacaacaacuucuuggcaaaaauuaaaac

SEQ ID NO: 143884 - RNA, 64 nt, Homo Sapiens
aacaacaaacagaaggauaaaacaacaacaacaacaacaacaacagcuucuuggcaaaaauuaa

SEQ ID NO: 143885 - RNA, 64 nt, Homo Sapiens
aacaacaacaaacagaaggauaaaacaacaacaacaacaacaaccucagcuucuuggcaaaaau

SEQ ID NO: 143886 - RNA, 64 nt, Homo Sapiens
aacaacaacaacaaacagaaaauuaaaacaacaacaacaacaacuuucucagcuucuuggcaaa

SEQ ID NO: 143887 - RNA, 64 nt, Homo Sapiens
aacaacaacaacaacaaacaaaaaauuaaaacaacaacaacaacguuuuucucagcuucuuggc

SEQ ID NO: 143888 - RNA, 64 nt, Homo Sapiens
aacaacaacaacaacaacaaggcaaaaauuaaaacaacaacaacauuguuuuucucagcuucuu

SEQ ID NO: 143889 - RNA, 64 nt, Homo Sapiens
ccugggcaacagagagagaccuugucucaaaaaacaacaacaacaaaaagucaaagucauaaua

SEQ ID NO: 143890 - RNA, 64 nt, Homo Sapiens
gggcaacagagagagaccuugucucaaaaaacaacaacaacaaaaagucaaagucauaauaagc

SEQ ID NO: 143891 - RNA, 64 nt, Homo Sapiens
uucacagaaacuaaacuccacccuugggacuccacaacaacaacaacaacaaaauuuaauuuaa

SEQ ID NO: 143892 - RNA, 64 nt, Homo Sapiens
acagaaacuaaacuccacccuugggacuccacaacaacaacaacaacaaaauuuaauuuaauuu

SEQ ID NO: 143893 - RNA, 64 nt, Homo Sapiens
gaaacuaaacuccacccuugggacuccacaacaacaacaacaacaaaauuuaauuuaauuuaaa

SEQ ID NO: 143894 - RNA, 64 nt, Homo Sapiens
acuaaacuccacccuugggacuccacaacaacaacaacaacaaaauuuaauuuaauuuaaaaau

SEQ ID NO: 143895 - RNA, 64 nt, Homo Sapiens
auaacauguuugccuguuaauaauuuccaaacaacaacaacaaauauauagcuuuucccaaugc

SEQ ID NO: 143896 - RNA, 64 nt, Homo Sapiens
aaaauaacauguuugccuguugcuaauuuccaaacaacaacaacuguuauauagcuuuucccaa

SEQ ID NO: 143897 - RNA, 64 nt, Homo Sapiens
gacaguaaaacguuaaaguacuggauuaagaaaacaacaacaggcugggcgcaguggcucacac

SEQ ID NO: 143898 - RNA, 64 nt, Homo Sapiens
cugucucaaaaaauaauaauaauaauaaauaaaacaacaacaaaaugcaucagagagccaaaac

SEQ ID NO: 143899 - RNA, 64 nt, Homo Sapiens
aaaaaggaauaaaauauccuugaucuauccucaacaacaacagacauugcuguucucuguaucg

SEQ ID NO: 143900 - RNA, 64 nt, Homo Sapiens
agaaaaaaggaauaaaauauucgugaucuauccucaacaacaacacccauugcuguucucugua

SEQ ID NO: 143901 - RNA, 64 nt, Homo Sapiens
caaaccugacaagagaaaaaaaacaaaacaacaacaacaacacauaaauuuuuuaaaaagacaa

SEQ ID NO: 143902 - RNA, 64 nt, Homo Sapiens
acacaaaccugacaagagaacaaaaacaaaacaacaacaacaaccccuaaauuuuuuaaaaaga

SEQ ID NO: 143903 - RNA, 64 nt, Homo Sapiens
aacacacaaaccugacaagaagacaaaaacaaaacaacaacaacgcucccuaaauuuuuuaaaa

SEQ ID NO: 143904 - RNA, 64 nt, Homo Sapiens
aaacaaguccaaacugauauaaaacaaaaaacaacaacaacaaaagugcacugaacuucaaaac

SEQ ID NO: 143905 - RNA, 64 nt, Homo Sapiens
aaaaaacaaguccaaacugaaacaaaacaaaaaacaacaacaacaaaagugcacugaacuucaa

SEQ ID NO: 143906 - RNA, 64 nt, Homo Sapiens
acaaucugcucugaccuucuuagcccaagaagaacaacaacaaaucaucauugugacuuccugg

SEQ ID NO: 143907 - RNA, 60 nt, Homo Sapiens
gaggaagauagaguggugacacaagcagaccaacaacacuacauuguugaguggcacuga

SEQ ID NO: 143908 - RNA, 64 nt, Homo Sapiens
uauuggacuucuugaaaauaaaaguuacaaaauccaacaacaacaacaacaaaacaauguucuu

SEQ ID NO: 143909 - RNA, 64 nt, Homo Sapiens
uggacuucuugaaaauaaaaguuacaaaauccaacaacaacaacaacaaaacaauguucuuggu

SEQ ID NO: 143910 - RNA, 64 nt, Homo Sapiens
acuucuugaaaauaaaaguuacaaaauccaacaacaacaacaacaaaacaauguucuugguuuu

SEQ ID NO: 143911 - RNA, 64 nt, Homo Sapiens
ucuugaaaauaaaaguuacaaaauccaacaacaacaacaacaaaacaauguucuugguuuuaau

SEQ ID NO: 143912 - RNA, 64 nt, Homo Sapiens
cuacuagaagucucccugaguccuaaacaaacaacaacaacaaaaguugucaauuggauuuucu

SEQ ID NO: 143913 - RNA, 64 nt, Homo Sapiens
aaacuacuagaagucucccuucuuccuaaacaaacaacaacaacgaaaguugucaauuggauuu

SEQ ID NO: 143914 - RNA, 64 nt, Homo Sapiens
aagguugaaaauaugcagguuauacauguuaaaacaacaacaacacuauccuauaaacuagaaa

SEQ ID NO: 143915 - RNA, 64 nt, Homo Sapiens
guugaaaauaugcagguuauacauguuaaaacaacaacaacacuauccuauaaacuagaaagac

SEQ ID NO: 143916 - RNA, 64 nt, Homo Sapiens
aucaucuucuaagagcugaucaagaaauuuaaaacaacaacaacaacaaaaaguuacgggguuc

SEQ ID NO: 143917 - RNA, 64 nt, Homo Sapiens
aucuucuaagagcugaucaagaaauuuaaaacaacaacaacaacaaaaaguuacgggguucauc

SEQ ID NO: 143918 - RNA, 64 nt, Homo Sapiens
uucuaagagcugaucaagaaauuuaaaacaacaacaacaacaaaaaguuacgggguucaucucc

SEQ ID NO: 143919 - RNA, 64 nt, Homo Sapiens
caagcaaacgggcuaggaggaaagauuaaaaaaacaacaacaacaacuuauuuaguuuggggag

SEQ ID NO: 143920 - RNA, 64 nt, Homo Sapiens
gcaaacgggcuaggaggaaagauuaaaaaaacaacaacaacaacuuauuuaguuuggggagggg

SEQ ID NO: 143921 - RNA, 64 nt, Homo Sapiens
uuucucaggcaaaauggauuauuuggcauagcaacaacaacacauccagucaugugugcauuua

SEQ ID NO: 143922 - RNA, 64 nt, Homo Sapiens
acauuucucaggcaaaaugguuaauuuggcauagcaacaacaacaaauccagucaugugugcau

SEQ ID NO: 143923 - RNA, 64 nt, Homo Sapiens
aagcuuccccaacuaaagcccuccgucacaacaacaacaacaaagccugggugacaaagugaga

SEQ ID NO: 143924 - RNA, 64 nt, Homo Sapiens
aaaaagcuuccccaacuaaaagacuccgucacaacaacaacaacccagccugggugacaaagug

SEQ ID NO: 143925 - RNA, 64 nt, Homo Sapiens
aacaaaaagcuuccccaacugugagacuccgucacaacaacaacacuccagccugggugacaaa

SEQ ID NO: 143926 - RNA, 64 nt, Homo Sapiens
aaugccagguguggugggguaccagcuugggcaacaacaacaaacuugagcccagggguuugag

SEQ ID NO: 143927 - RNA, 64 nt, Homo Sapiens
aaaaaugccagguguggugggagaccagcuugggcaacaacaacuugcuugagcccagggguuu

SEQ ID NO: 143928 - RNA, 64 nt, Homo Sapiens
aauaaagaugugaaaacucgaauaauaacaacaacaacaacaauaugaugaugauaauaauaau

SEQ ID NO: 143929 - RNA, 64 nt, Homo Sapiens
aauaauaaagaugugaaaacaauaauaauaacaacaacaacaacaugaugaugaugauaauaau

SEQ ID NO: 143930 - RNA, 64 nt, Homo Sapiens
aacaauaauaaagaugugaaaauaauaauaauaacaacaacaacaugaugaugaugaugauaau

SEQ ID NO: 143931 - RNA, 64 nt, Homo Sapiens
ggaagccacaccucuacaugucuaaaacaaaaaacaacaacaacagauaccccacucgccacua

SEQ ID NO: 143932 - RNA, 64 nt, Homo Sapiens
agccacaccucuacaugucuaaaacaaaaaacaacaacaacagauaccccacucgccacuaugc

SEQ ID NO: 143933 - RNA, 64 nt, Homo Sapiens
acuccagccugggcaacagagcgagacucugucucaacaacaacaacaaaaaguccugaacaug

SEQ ID NO: 143934 - RNA, 64 nt, Homo Sapiens
ccagccugggcaacagagcgagacucugucucaacaacaacaacaaaaaguccugaacaugauu

SEQ ID NO: 143935 - RNA, 64 nt, Homo Sapiens
gccugggcaacagagcgagacucugucucaacaacaacaacaaaaaguccugaacaugauugug

SEQ ID NO: 143936 - RNA, 64 nt, Homo Sapiens
gcucuauuuuuuuuuuuuuuuuuuuuaagaaaaacaacaacaacaaaaaaagacaaugaaaaaa

SEQ ID NO: 143937 - RNA, 64 nt, Homo Sapiens
cuauuuuuuuuuuuuuuuuuuuuaagaaaaacaacaacaacaaaaaaagacaaugaaaaaaaaa

SEQ ID NO: 143938 - RNA, 64 nt, Homo Sapiens
ugaugagacaacacacacacacacaaaacaacagcaacaacaacagaacaacaacaaagcaugc

SEQ ID NO: 143939 - RNA, 64 nt, Homo Sapiens
ugagacaacacacacacacacaaaacaacagcaacaacaacagaacaacaacaaagcaugcuca

SEQ ID NO: 143940 - RNA, 64 nt, Homo Sapiens
acacacacacaaaacaacagcaacaacaacagaacaacaacaaagcaugcucaguauugagaca

SEQ ID NO: 143941 - RNA, 64 nt, Homo Sapiens
acuguuucucguguaauauccuucuaaugcuuagcaacaacaacaaaaaauugcucucucagau

SEQ ID NO: 143942 - RNA, 64 nt, Homo Sapiens
guuucucguguaauauccuucuaaugcuuagcaacaacaacaaaaaauugcucucucagaucca

SEQ ID NO: 143943 - RNA, 64 nt, Homo Sapiens
gcuucuuagacggucuucacuguguguuuuaaaacaacaacaacaacaacaacaacaacauaaa

SEQ ID NO: 143944 - RNA, 64 nt, Homo Sapiens
ucuuagacggucuucacuguguguuuuaaaacaacaacaacaacaacaacaacaacauaaaacu

SEQ ID NO: 143945 - RNA, 64 nt, Homo Sapiens
uagacggucuucacuguguguuuuaaaacaacaacaacaacaacaacaacaacauaaaacucuu

SEQ ID NO: 143946 - RNA, 64 nt, Homo Sapiens
acggucuucacuguguguuuuaaaacaacaacaacaacaacaacaacaacauaaaacucuuuug

SEQ ID NO: 143947 - RNA, 64 nt, Homo Sapiens
gucuucacuguguguuuuaaaacaacaacaacaacaacaacaacaacauaaaacucuuuugacc

SEQ ID NO: 143948 - RNA, 64 nt, Homo Sapiens
uucacuguguguuuuaaaacaacaacaacaacaacaacaacaacauaaaacucuuuugaccugu

SEQ ID NO: 143949 - RNA, 64 nt, Homo Sapiens
acuguguguuuuaaaacaacaacaacaacaacaacaacaacauaaaacucuuuugaccuguaac

SEQ ID NO: 143950 - RNA, 64 nt, Homo Sapiens
auaacuccuccauugaaauaacuccuccccaccccaacaacaacauucccagcagaccaacucc

SEQ ID NO: 143951 - RNA, 64 nt, Homo Sapiens
acuccuccauugaaauaacuccuccccaccccaacaacaacauucccagcagaccaacucccac

SEQ ID NO: 143952 - RNA, 64 nt, Homo Sapiens
gagaugguacaguuuuauuguacaggugcuaaaacaacaacaacaaaaaagaaaauggaaaaaa

SEQ ID NO: 143953 - RNA, 64 nt, Homo Sapiens
augguacaguuuuauuguacaggugcuaaaacaacaacaacaaaaaagaaaauggaaaaaaaaa

SEQ ID NO: 143954 - RNA, 64 nt, Homo Sapiens
guccaacaaggaauucacaccucugccuccuuugcaacaacaacauuuacacaguugguaagug

SEQ ID NO: 143955 - RNA, 64 nt, Homo Sapiens
caacaaggaauucacaccucugccuccuuugcaacaacaacauuuacacaguugguaagugggu

SEQ ID NO: 143956 - RNA, 64 nt, Homo Sapiens
ccacugugguugagcuuuauguuuacagucucagcaacaacacuuaugcauccaaacacucaca

SEQ ID NO: 143957 - RNA, 64 nt, Homo Sapiens
ucuaauucauuuucucuuuaguguuaguagacuccaacaacagaaguggcaucuguguauucau

SEQ ID NO: 143958 - RNA, 64 nt, Homo Sapiens
agggcagcaggagcagcagcagcagcagcagcagcaacaacaacaacuacugugccuugggcug

SEQ ID NO: 143959 - RNA, 64 nt, Homo Sapiens
gcagcaggagcagcagcagcagcagcagcagcaacaacaacaacuacugugccuugggcugcua

SEQ ID NO: 143960 - RNA, 64 nt, Homo Sapiens
auaagaagaagauaaaaacaaaauauuuuggaguguuuuccaacuuaaaguaugaagacauacu

SEQ ID NO: 143961 - RNA, 64 nt, Homo Sapiens
auaaaguacuguguuuaaaaaaauguuaugcaauguuuuccaaacugauaaaguuuguaaagug

SEQ ID NO: 143962 - RNA, 64 nt, Homo Sapiens
cccucauaugguuuuuggccaagugacuaaaacaguuuuccacaacuguaaacaaacugcuaag

SEQ ID NO: 143963 - RNA, 64 nt, Homo Sapiens
ugcuugauuaugucagcaacacccaacacugucuguuuuccauuuguugguuuuaaucauaaaa

SEQ ID NO: 143964 - RNA, 64 nt, Homo Sapiens
caaaggggcguggagaccuuaaugaacaguggcuguuuuccaccucuuuggaugugaacgcggg

SEQ ID NO: 143965 - RNA, 54 nt, Homo Sapiens
ucuugcacaagcaaguuuguuccgguuuuccaguuccuuugcuaggcacuuuga

SEQ ID NO: 143966 - RNA, 64 nt, Homo Sapiens
agggcggccgccacccucgcguagcuuuccugugguuuuccaggacuguccgguacagcccggg

SEQ ID NO: 143967 - RNA, 64 nt, Homo Sapiens
gucucacuguuggccagggcuuuguggcguggguguuuuccagucugccuggagcagcgagaag

SEQ ID NO: 143968 - RNA, 64 nt, Homo Sapiens
uaugaaggugcuugagaaaagagaugauguugaaguuuuccaauauucuguugaaguuuuccaa

SEQ ID NO: 143969 - RNA, 64 nt, Homo Sapiens
agaugauguugaaguuuuccaauauucuguugaaguuuuccaauauuaaguauuagcuuaggga

SEQ ID NO: 143970 - RNA, 64 nt, Homo Sapiens
uuuaaacuaguaacagcaggguucuuucuuuccuguuuuccauuuuuaccgacagccgucuuuu

SEQ ID NO: 143971 - RNA, 64 nt, Homo Sapiens
aagacauuuauauaugugaggauucauugagagaguuuuccauaaacucugagaauuuucuuca

SEQ ID NO: 143972 - RNA, 64 nt, Homo Sapiens
uauuaaaaucacacauggcuagcugaaaugccguguuuuccauugguuuacugcuuuaccacug

SEQ ID NO: 143973 - RNA, 64 nt, Homo Sapiens
agugagaaaaucauugcacuaauuaauaaugccaguuuuccaagaacuuugcuugguaauuuaa

SEQ ID NO: 143974 - RNA, 64 nt, Homo Sapiens
aggaauuugaguucucucuauuuuguucgguuuuguuuuccaucacaccuuuuuuuucuaguuu

SEQ ID NO: 143975 - RNA, 64 nt, Homo Sapiens
ugaaacuuuuagcuccaugaaagagguggguucuguuuuccaggcugaaaaugcaacauuagca

SEQ ID NO: 143976 - RNA, 64 nt, Homo Sapiens
uucuacuggggagaguguaauauuuuggacugcuguuuuccauuaaugaggagagcaacaggcc

SEQ ID NO: 143977 - RNA, 64 nt, Homo Sapiens
uuauuuggcuacacuaaagaaugcaguauauuuaguuuuccauuugcaugauguuugugugcua

SEQ ID NO: 143978 - RNA, 64 nt, Homo Sapiens
aaauguuuguugaaugaaugcaugucuucuaaaaguuuuccaacacaaauuagcagugguuucu

SEQ ID NO: 143979 - RNA, 64 nt, Homo Sapiens
caccccuaauuaauaugugagagacaacagcuggguuuuccaucccuaacacauuuauuucauu

SEQ ID NO: 143980 - RNA, 64 nt, Homo Sapiens
aauccaacugagcauugaaaggcagcuguucuguguuuuccagguugagagcaguggggugcuu

SEQ ID NO: 143981 - RNA, 64 nt, Homo Sapiens
aucccagaaggcaaacuguguccgauacugcaacguuuuccaaagauucagggcaagcuaaaaa

SEQ ID NO: 143982 - RNA, 64 nt, Homo Sapiens
guuuuuuguuuuuuuuuuuugacacuguccaaagguuuuccauccuguccuggaaucagaguug

SEQ ID NO: 143983 - RNA, 64 nt, Homo Sapiens
agggguagugauacaagucucauagccagagaugguuuuccacuccuucuagauauucccaaaa

SEQ ID NO: 143984 - RNA, 64 nt, Homo Sapiens
augauauuuaugaguaauuuuuccccagcacuugguuuuccaacgggggaagaccuagaacccu

SEQ ID NO: 143985 - RNA, 64 nt, Homo Sapiens
ggcagugccaguuucuagccuguacauauucagaguuuuccauuaggaagaaacaucuagaagu

SEQ ID NO: 143986 - RNA, 64 nt, Homo Sapiens
guaugcgcacaguuccugugggacugggccgugaguuuuccauuggaaagaaguucaguggucc

SEQ ID NO: 143987 - RNA, 64 nt, Homo Sapiens
uuacugaugcacuuuaguuuuuggucuguuaccuguuuuccagaaauuuguggccuuuuaggcg

SEQ ID NO: 143988 - RNA, 64 nt, Homo Sapiens
cagaaaaucuacuccccuguaggggaaaagacuuguuuuccagaucauuagucauggcagaagg

SEQ ID NO: 143989 - RNA, 64 nt, Homo Sapiens
ucuaugugaguccuugugcuuugugugcauaucuguuuuccaggcugugugugcauguuggucu

SEQ ID NO: 143990 - RNA, 64 nt, Homo Sapiens
uugcccucuccuauccucuugccauaugaauagcguuuuccaugaaauaggaaaauauuacuug

SEQ ID NO: 143991 - RNA, 64 nt, Homo Sapiens
acaagggaagaaucuacuuuuuagaaaucgcuuuguuuuccaagcaguaaguacuacauacagu

SEQ ID NO: 143992 - RNA, 64 nt, Homo Sapiens
aggggauuagaauguuuaguguuuuuuguuuuuuguuuuccaguugaaaaguuuuccaguuuuu

SEQ ID NO: 143993 - RNA, 64 nt, Homo Sapiens
uuuuguuuuuuguuuuuuguugacuuucugaaaaguuuuccaguuacugacuuguuaccacugc

SEQ ID NO: 143994 - RNA, 64 nt, Homo Sapiens
acuuuaaucaaucauuuugagccuccaccaucauguuuuccaucuauuugaacuugccuuguag

SEQ ID NO: 143995 - RNA, 64 nt, Homo Sapiens
ucuuaugaauauuaucagcacaagagauugcacuguuuuccaauuuuucaguuguguguaauac

SEQ ID NO: 143996 - RNA, 64 nt, Homo Sapiens
uauguacacaaaaauauuuuccuuguagaaaauaguuuuccagacacuuagccuucugaagugc

SEQ ID NO: 143997 - RNA, 64 nt, Homo Sapiens
uagcuagagaaauguaagguaaaaggcucacuuuguuuuccaguggguccagagucuucucuau

SEQ ID NO: 143998 - RNA, 64 nt, Homo Sapiens
gugggugggccagguguuccugagcaguuuuccaguuuuccaccguuugugguuuaggaaugcc

SEQ ID NO: 143999 - RNA, 64 nt, Homo Sapiens
uuuccaccgugggugggccaggaaugccugagcaguuuuccaguaugguauuguuugugguuua

SEQ ID NO: 144000 - RNA, 64 nt, Homo Sapiens
guuuaugauugagguaaaacgugaacuucuguauguuuuccacauugaacuuacaguaaaaguu

SEQ ID NO: 144001 - RNA, 64 nt, Homo Sapiens
ggauaaaggacacccuaggucccaaagcaggaguguuuuccaugggaccuaggccccaguuugu

SEQ ID NO: 144002 - RNA, 64 nt, Homo Sapiens
gagggaaugauauaauuuucggauaauagucacaguuuuccaggcaaaauaacauuucuaccca

SEQ ID NO: 144003 - RNA, 64 nt, Homo Sapiens
ugacccucuuuccuugcaucuuuuggaaaucaguguuuuccaugauguuauugacuauagcaga

SEQ ID NO: 144004 - RNA, 64 nt, Homo Sapiens
uccagauugcgccagcauuagcucuaguuuucuaguuuuccauuugccuggcccacuccugaga

SEQ ID NO: 144005 - RNA, 64 nt, Homo Sapiens
ucuucuauggcucucuuuuuugagugauuuuaagguuuuccaaaugauguucuuccaacucagu

SEQ ID NO: 144006 - RNA, 64 nt, Homo Sapiens
uccacggaaagguuuggccugaagaaaguggcagguuuuccagggaaacugcauuguaaaaaga

SEQ ID NO: 144007 - RNA, 64 nt, Homo Sapiens
cuguuuuauacagguuuguuuacugugaauguuuguuuuccaagugagaaaugggcuguauuga

SEQ ID NO: 144008 - RNA, 64 nt, Homo Sapiens
cuugggagccucgccuuacaacuaauuccugccuuucguccaguaccaagucccccguugcuuc

SEQ ID NO: 144009 - RNA, 64 nt, Homo Sapiens
gugacuuuccgguugcccuggaucucagaauauauucguccacccccucggcaccccauuaccc

SEQ ID NO: 144010 - RNA, 64 nt, Homo Sapiens
uagagagagccguagcccuuuguaaaggcuuucguucguccaaacaacacuugauccaaccaaa

SEQ ID NO: 144011 - RNA, 64 nt, Homo Sapiens
aggcaguaccugccugacccuucaaggccugaccuucguccagagugcucugguuugcaccaug

SEQ ID NO: 144012 - RNA, 64 nt, Homo Sapiens
ggauagugugagcuucauuuuguacacgugugacuucguccaguuacaaacccaauaaacucug

SEQ ID NO: 144013 - RNA, 64 nt, Homo Sapiens
uauugaaauaggcagcacucugaaagacagaagcuucguccagccacucuucagcacauuccuu

SEQ ID NO: 144014 - RNA, 64 nt, Homo Sapiens
ucaaaaaugcaucaagucuccgcccccgggcccuuucguccacauaucuugacaggcgccgccu

SEQ ID NO: 144015 - RNA, 64 nt, Homo Sapiens
uuucucacauugcuguauuucaacucgaacugcuuucguccaugcaggggaagaccaaaguuug

SEQ ID NO: 144016 - RNA, 64 nt, Homo Sapiens
ccucucucuacucucaggcaugucuuuuguccuuuucguccaucuauuucugucugucgcucac

SEQ ID NO: 144017 - RNA, 64 nt, Homo Sapiens
auagcauuucaacauuuuucaaaaucaggagauuuucguccauuuaaaaaauguauaggugcag

SEQ ID NO: 144018 - RNA, 64 nt, Homo Sapiens
ucuucauguauuuuuuuucuauucuaacaaauuuuucguccaccaucuuaacagagaucaagug

SEQ ID NO: 144019 - RNA, 64 nt, Homo Sapiens
uucccagauaauugggucuuaaagaagacugaccuucguccauuucugucagcaggaagcaguu

SEQ ID NO: 144020 - RNA, 64 nt, Homo Sapiens
aagagaugggcauaauaccaagaguaagaucagauucguccacauuacagguuaaugacuccag

SEQ ID NO: 144021 - RNA, 64 nt, Homo Sapiens
uauuagugaagccccuccuuuaugcaaaaugugauucguccaguuuucugcaaaauaaacgcaa

SEQ ID NO: 144022 - RNA, 64 nt, Homo Sapiens
ggaaauacagagagaaccucuuccacuuuuacuuuucguccaaauaaaaugcaugguguaccag

SEQ ID NO: 144023 - RNA, 64 nt, Homo Sapiens
uaucuuaauagcaauuuuaggagaaaaugacucuuucguccagaagagcucugcagaaccaggg

SEQ ID NO: 144024 - RNA, 64 nt, Homo Sapiens
cuguguuagucuaggcuuagguuacugcuuuauauucguccaaaggcucugggcugauucagag

SEQ ID NO: 144025 - RNA, 64 nt, Homo Sapiens
uaaaacaacuguaauguacuucuuuguuuucuuuuucguccaacauuaguaauuuauuuuugau

SEQ ID NO: 144026 - RNA, 64 nt, Homo Sapiens
agcaccaggcugaaaaaacacaguguaugaagcauucguccagcagccaggaaugaguuacaaa

SEQ ID NO: 144027 - RNA, 64 nt, Homo Sapiens
uguugacaaaugacagaucugucaauagcuugucuucguccaucucgcggcagguucucuuuga

SEQ ID NO: 144028 - RNA, 64 nt, Homo Sapiens
cucuguuuauagaaauggaagaauggcaaaacaguucguccaucaggaagcuuaggacccgugg

SEQ ID NO: 144029 - RNA, 64 nt, Homo Sapiens
auaaaauguuuaaguuauuaucaagccucuccuuuucguccauauugccuuuaggcuugagucc

SEQ ID NO: 144030 - RNA, 64 nt, Homo Sapiens
auucugcaggacaggacuauucuagcauaccugcuucguccacccaggcaggguuugggguggu

SEQ ID NO: 144031 - RNA, 64 nt, Homo Sapiens
caugagcauuguggaauauccuuuccuaggcacauucguccacuaagggaacagccucagaaac

SEQ ID NO: 144032 - RNA, 64 nt, Homo Sapiens
acccucugcagccuuggugccagaaauaggagguuucguccagcguggcaacugaaaugcauuu

SEQ ID NO: 144033 - RNA, 64 nt, Homo Sapiens
ccaugugcaaagucaacaguuaaagaguuccaaguucguccagcccuggaacuauacagauagg

SEQ ID NO: 144034 - RNA, 64 nt, Homo Sapiens
auuuuccgugucuuuggggauuauuucuaaucuguucguccagguaaaaacuuguuuuuuguag

SEQ ID NO: 144035 - RNA, 64 nt, Homo Sapiens
aauccacaccaccuuucccaauuacguuagagacuucguccacguuuacccuucaguagucaag

SEQ ID NO: 144036 - RNA, 64 nt, Homo Sapiens
cucucucugaacugugaucucuccaugucugaauuucguccagcaaagaacaaugagugugaug

SEQ ID NO: 144037 - RNA, 64 nt, Homo Sapiens
aggcgggauuggauggaguccaccgagggcguuguucguccaucguucuuuucauggugucuga

SEQ ID NO: 144038 - RNA, 64 nt, Homo Sapiens
gucaagggcccgcccacugacccagccguaccuauucguccacggugccccguagcagcagguc

SEQ ID NO: 144039 - RNA, 64 nt, Homo Sapiens
gcacuuggaaguuacaucugugaaguuucugucauucguccagaucuguguguguagcaugugc

SEQ ID NO: 144040 - RNA, 64 nt, Homo Sapiens
guucuuuauuuuugucugcuaucuccucuuaagcuucguccaggcggguucguguacucucugu

SEQ ID NO: 144041 - RNA, 64 nt, Homo Sapiens
cgccaccaucuaccagugggcaaggacuaagcuguucguccacacgaccagcacaagcuuugcc

SEQ ID NO: 144042 - RNA, 64 nt, Homo Sapiens
aguccccucccagcuccgcucacagggcucucauuucguccauccccuugucgcagauccuggc

SEQ ID NO: 144043 - RNA, 64 nt, Homo Sapiens
agcagcuuuguacacgaagaccauccauccucccuucguccaccacucuacucccuccacccuc

SEQ ID NO: 144044 - RNA, 64 nt, Homo Sapiens
auugcagaaagugaaagaggaaaucauugaagccuucguccaggagcugaggaagcgggguucu

SEQ ID NO: 144045 - RNA, 64 nt, Homo Sapiens
ugcugcugucaccucucccacgggaccuggggcuuucguccacagcuuccuguccccaucuguc

SEQ ID NO: 144046 - RNA, 64 nt, Homo Sapiens
cagaggugggcaagaacuggacuucggcgagagguucguccaugcagggagggcggcaggcucc

SEQ ID NO: 144047 - RNA, 64 nt, Homo Sapiens
uguaucuaucuuacgagaacaaucaucaugcagauucguccacaggggaucugucaguuugggu

SEQ ID NO: 144048 - RNA, 64 nt, Homo Sapiens
ccauucaagucaccugaggcaaagugucugcaucuucguccagcgacccuuugcuuuucggcuc

SEQ ID NO: 144049 - RNA, 64 nt, Homo Sapiens
gacugguuaggaucugaggugagucccaggauguuucguccaccagggcccagauucugggagg

SEQ ID NO: 144050 - RNA, 64 nt, Homo Sapiens
ugcaggggccagggaagcccagcgcucggugcccuucguccaggguuaaaaucggccugugggg

SEQ ID NO: 144051 - RNA, 64 nt, Homo Sapiens
ugcuuuuuucugaaauacaccuguaaggucggucuucguccauccucaguguagaaacccacgu

SEQ ID NO: 144052 - RNA, 64 nt, Homo Sapiens
ucuuccuuugucuaaugugggauuccugacucccuucguccaaggcaccggugugugugugucu

SEQ ID NO: 144053 - RNA, 64 nt, Homo Sapiens
cuuuaccucaggagccaggagcagacagcaauacuucguccacaccugggaucgcgcagggccc

SEQ ID NO: 144054 - RNA, 64 nt, Homo Sapiens
uaaagaaguggugccggguaggaaccacgguuccuucguccauuaguuggaaaaaguaacagac

SEQ ID NO: 144055 - RNA, 64 nt, Homo Sapiens
gaagaggaggacaaaaagggggaggagaagguucuucguccaaaggaggaaggagaagaaguag

SEQ ID NO: 144056 - RNA, 64 nt, Homo Sapiens; identical to SEQ ID NO: 50725

SEQ ID NO: 144057 - RNA, 64 nt, Homo Sapiens; identical to SEQ ID NO: 50726

SEQ ID NO: 144058 - RNA, 64 nt, Homo Sapiens; identical to SEQ ID NO: 50727

SEQ ID NO: 144059 - RNA, 64 nt, Homo Sapiens; identical to SEQ ID NO: 50728

SEQ ID NO: 144060 - RNA, 64 nt, Homo Sapiens; identical to SEQ ID NO: 50729

SEQ ID NO: 144061 - RNA, 64 nt, Homo Sapiens; identical to SEQ ID NO: 50730

SEQ ID NO: 144062 - RNA, 64 nt, Homo Sapiens; identical to SEQ ID NO: 50731

SEQ ID NO: 144063 - RNA, 64 nt, Homo Sapiens; identical to SEQ ID NO: 50732

SEQ ID NO: 144064 - RNA, 64 nt, Homo Sapiens; identical to SEQ ID NO: 50733

SEQ ID NO: 144065 - RNA, 64 nt, Homo Sapiens; identical to SEQ ID NO: 50734

SEQ ID NO: 144066 - RNA, 51 nt, Homo Sapiens; identical to SEQ ID NO: 50735

SEQ ID NO: 144067 - RNA, 64 nt, Homo Sapiens; identical to SEQ ID NO: 50736

SEQ ID NO: 144068 - RNA, 64 nt, Homo Sapiens; identical to SEQ ID NO: 50737

SEQ ID NO: 144069 - RNA, 64 nt, Homo Sapiens; identical to SEQ ID NO: 50738

SEQ ID NO: 144070 - RNA, 64 nt, Homo Sapiens
cagggaccggugcugcaggaucaaacauucgugagcuggggacuagggcuggggacagagggug

SEQ ID NO: 144071 - RNA, 64 nt, Homo Sapiens
gagggugucaaacauucgugggggccccgccagggcuggggacaagaauguguguguguggcag

SEQ ID NO: 144072 - RNA, 64 nt, Homo Sapiens
ucacauccucaggcaggaacagccauauggugaggcuggggagucuauccucuugcucaugacc

SEQ ID NO: 144073 - RNA, 64 nt, Homo Sapiens
gcaaccacugguuugcaaccguugcuauccucuugcuggggauaggagguagcaaggccacugg

SEQ ID NO: 144074 - RNA, 64 nt, Homo Sapiens
ggcugcugugugaauguugagggccgcccuguaggcuggggaugugggaagcaugaucuggcag

SEQ ID NO: 144075 - RNA, 64 nt, Homo Sapiens
ggaagugacuaaccccggguucugacgcagugcugcuggggaagaagaggggccucagagaagc

SEQ ID NO: 144076 - RNA, 64 nt, Homo Sapiens
uggccuuccucugccugcaagugagcagggaugggcuggggaguugcuugugccaccaagacgu

SEQ ID NO: 144077 - RNA, 64 nt, Homo Sapiens
uggagcggggaaaccgcagcucagcccaggcccagcuggggagaaggcgcuaccugcgugggac

SEQ ID NO: 144078 - RNA, 64 nt, Homo Sapiens
ccucagaaucauggugggaguaaaguuccacauggcuggggaggaaaagugguuuaauuggacu

SEQ ID NO: 144079 - RNA, 64 nt, Homo Sapiens
ccucagaaucauggcgggaguacaguuccacauggcuggggaggaaaagagguuuacuuggacu

SEQ ID NO: 144080 - RNA, 64 nt, Homo Sapiens
ugaccuuaugaggcccauggcacuggggcagggagcuggggacauuuuaaucaucaauaaacga

SEQ ID NO: 144081 - RNA, 64 nt, Homo Sapiens
gaagaaggcuucuggucaggacccccaccccaaggcuggggacuccaggcuccugcuuuacugu

SEQ ID NO: 144082 - RNA, 64 nt, Homo Sapiens
acagaggggaggaggaggaccaccaguuucucaggcuggggagcaggggagguguuuuugccau

SEQ ID NO: 144083 - RNA, 64 nt, Homo Sapiens
ggugcaggcgggaagagugggauagggugggggagcuggggaagccuugugucuguggacuaga

SEQ ID NO: 144084 - RNA, 64 nt, Homo Sapiens
ggaguuuugcccaacgcaguaggccaugcucagugcuggggacaugccagcugcuauggggcuu

SEQ ID NO: 144085 - RNA, 64 nt, Homo Sapiens
aggaggcccacucacaagccccuccugcaccugugcuggggaguagagcagugcuuccagaguu

SEQ ID NO: 144086 - RNA, 64 nt, Homo Sapiens
agaauccaaacggccucaagcaaagggaggacuugcuggggaccaaauuauuucuggguugauu

SEQ ID NO: 144087 - RNA, 64 nt, Homo Sapiens
agaguccugaacgguuugaugccacuccagcccggcuggggaagucucacugagcagcccgagg

SEQ ID NO: 144088 - RNA, 64 nt, Homo Sapiens
gguuuaguuauaagugaagcaugguugaauaccagcuggggagacacuagggaagggagcuuug

SEQ ID NO: 144089 - RNA, 64 nt, Homo Sapiens
ucauaaaccagcugcgguaacagacaagccuuuggcuggggaguuuuaagccucgguaacugcu

SEQ ID NO: 144090 - RNA, 64 nt, Homo Sapiens
augugugguuguggcaugugaccuugggguuccugcuggggaccucuuugugcugcuccuugcc

SEQ ID NO: 144091 - RNA, 64 nt, Homo Sapiens
gccugugaggaccgagaggagcugggcgagcugggcuggggagagagcugggcgagcugggcga

SEQ ID NO: 144092 - RNA, 64 nt, Homo Sapiens
cugggugcaggugccaggcucaggcagccugcaggcuggggaccugaacuuggugcucuaaguc

SEQ ID NO: 144093 - RNA, 64 nt, Homo Sapiens
gguuuugguuuugggguuuugagggcuuuuuguggcuggggaugcugcgaacgcaaaagugaau

SEQ ID NO: 144094 - RNA, 64 nt, Homo Sapiens
acugcucgccagucucugugagccuaggcccugagcuggggagguggggaagauucgggcaugu

SEQ ID NO: 144095 - RNA, 64 nt, Homo Sapiens
ccucagcugaagccuggccuaguugcugagaggggcuggggagauggggcgggagggccagacu

SEQ ID NO: 144096 - RNA, 64 nt, Homo Sapiens
uagcaaggcauuguggaaagaggggaccaggguggcuggggaagaggccgaugcauaaagucag

SEQ ID NO: 144097 - RNA, 64 nt, Homo Sapiens
agaaaacuaagacaggaugauacagguuugaggggcuggggagugggaggggggagaaaaggaa

SEQ ID NO: 144098 - RNA, 64 nt, Homo Sapiens
augucggugcacagcugaaauugaugugggcugagcuggggaaccuauggaaacaaggguguca

SEQ ID NO: 144099 - RNA, 64 nt, Homo Sapiens
acaugggugugugugugacuggagaggguuugcugcuggggaggggugugggaugcuccuggau

SEQ ID NO: 144100 - RNA, 64 nt, Homo Sapiens
uaccaaagacacagcugggucuggaccccacggggcuggggagggccaugugcaauauuuggag

SEQ ID NO: 144101 - RNA, 64 nt, Homo Sapiens
auauuuggaggguuuucuggagggcagcaggaaggcuggggaauuccccauguacaguauuuau

SEQ ID NO: 144102 - RNA, 64 nt, Homo Sapiens
cagcaagcaugcuggugggaucugggcuuuucuugcuggggaggcucccccucaugaccuaaac

SEQ ID NO: 144103 - RNA, 64 nt, Homo Sapiens
aacaauccccgagggcugcuacucugggccgguggcuggggaagccccacgauugaccagccac

SEQ ID NO: 144104 - RNA, 64 nt, Homo Sapiens
auuuguuacuucguauguguuuugccuuguggaagcuggggaggaguucccaggcuggggaugc

SEQ ID NO: 144105 - RNA, 64 nt, Homo Sapiens
cuuugccuuguggaagcugguccacaguucccaggcuggggaugauggugacggcaacaagaac

SEQ ID NO: 144106 - RNA, 64 nt, Homo Sapiens
gcaaccauagccacaccacacuguggguugccaggcuggggaggugcccccuuucccaggguau

SEQ ID NO: 144107 - RNA, 64 nt, Homo Sapiens
agguacaguaggcccugucccaaaggucuaccgagcuggggaggccugucuccuccccaccucc

SEQ ID NO: 144108 - RNA, 64 nt, Homo Sapiens
ccuuuuucagggaacugggaacuuaggggacugagcuggggagggaggcaggugggugguaaga

SEQ ID NO: 144109 - RNA, 64 nt, Homo Sapiens
aacagguuugccuacguuggugcaagugugcauggcuggggacuucucacuuccccuugcaccc

SEQ ID NO: 144110 - RNA, 64 nt, Homo Sapiens
auggagacagguagacagaccuccaggucccuaagcuggggacagagaagguucugagcugucc

SEQ ID NO: 144111 - RNA, 64 nt, Homo Sapiens
cccuauaguuucaccacuccucauacuccuuuuggcuggggaguagagccccuuuaacccugau

SEQ ID NO: 144112 - RNA, 64 nt, Homo Sapiens
aggacugugugagaggggcgagccuuaccuuggggcuggggaagaauguguguaagugaggguc

SEQ ID NO: 144113 - RNA, 64 nt, Homo Sapiens
ccgggcagaagaugccgcagggcuucuuugcagagcuggggaagaucacagccauuugagaaau

SEQ ID NO: 144114 - RNA, 64 nt, Homo Sapiens
caauccacccagacccgcguccagggaagugggagcuggggagcaagggccugcccuggggcuc

SEQ ID NO: 144115 - RNA, 64 nt, Homo Sapiens
uuuuuuuuuuuaaacagggugggaugguaggauugcuggggauucagaucacuccuggaggcug

SEQ ID NO: 144116 - RNA, 64 nt, Homo Sapiens
guaggauugcuggggauuuugaucacuccuggaggcuggggauguucucaaugcuuaggagaca

SEQ ID NO: 144117 - RNA, 64 nt, Homo Sapiens
ugucuagagugugggcuggcuguugugcuggaaagcuggggacagguugaugguaauaaacugc

SEQ ID NO: 144118 - RNA, 64 nt, Homo Sapiens
acauugcaucccaaagagcuucucaguggaggaggcuggggaaggcaugagggggcucagaggc

SEQ ID NO: 144119 - RNA, 64 nt, Homo Sapiens
uuggggaggaauuugguauugaggcccugcccaugcuggggacucuuccagugccacauggagu

SEQ ID NO: 144120 - RNA, 64 nt, Homo Sapiens
gaaguccuuccagugccacaucuguggagaaggugcuggggagggcuggcaggaccaugccauc

SEQ ID NO: 144121 - RNA, 64 nt, Homo Sapiens
aaagccagugcccagggaugggcaucuccagggagcuggggauuagugccaggcagcccugcca

SEQ ID NO: 144122 - RNA, 64 nt, Homo Sapiens
ucugccugggccaacucugcauggagaggccagggcuggggacaguccgcacucugccacccuc

SEQ ID NO: 144123 - RNA, 64 nt, Homo Sapiens
cuagcacggcucagccuccugcuauccccugacugcuggggacccucgccuucccuccucucac

SEQ ID NO: 144124 - RNA, 64 nt, Homo Sapiens
ggagagcacggaaccgcacgcacgucaggcaccggcuggggaucuguggggcagcggcgggcgc

SEQ ID NO: 144125 - RNA, 64 nt, Homo Sapiens
cuucccugcucacacccacacuggcugcugauuggcuggggaggcccccgcccuuuucucccuu

SEQ ID NO: 144126 - RNA, 64 nt, Homo Sapiens
uccccucugccauccccuuggggccggucccucugcuggggaugcaccaaugaaccccacagga

SEQ ID NO: 144127 - RNA, 64 nt, Homo Sapiens
uuccugcggguggccagccugucuguguggcugggcuggggaggccacgucugguaucugaaug

SEQ ID NO: 144128 - RNA, 64 nt, Homo Sapiens
cuggaaggcugccaagcccaaaguugugcagagcgcuggggacuccagacuccccacagcagca

SEQ ID NO: 144129 - RNA, 64 nt, Homo Sapiens
gucuuggguuuaaaacugcagcucuucccagcuggcuggggacuuuuugccaugaggguaacca

SEQ ID NO: 144130 - RNA, 64 nt, Homo Sapiens
aucccugggccuggggccaccagccucccccaaugcuggggagccaggaugccaggggccuggc

SEQ ID NO: 144131 - RNA, 64 nt, Homo Sapiens
uccuggacacccuguccuuccccuggagcccggugcuggggaccccccuggcauggggaccaca

SEQ ID NO: 144132 - RNA, 64 nt, Homo Sapiens
gugccaggccaugcuugcugugggcaucccuggugcuggggacuggcugcuggcccauccugcc

SEQ ID NO: 144133 - RNA, 64 nt, Homo Sapiens
ccgaggccaccgccccccccccuccgacaccucggcuggggaaaccuccucuucucucauccuu

SEQ ID NO: 144134 - RNA, 64 nt, Homo Sapiens
ucacccuggagggcacuggguaggagccucaccugcuggggaccccacacugaaucucaccugc

SEQ ID NO: 144135 - RNA, 64 nt, Homo Sapiens
ucuccuggggacuuugccuacggaagccuggccugcuggggauggcuuccaggagcguccccug

SEQ ID NO: 144136 - RNA, 64 nt, Homo Sapiens
ucacccuggagggcccugggacugaaucucaccugcuggggaccgcucccagagaccuugccac

SEQ ID NO: 144137 - RNA, 64 nt, Homo Sapiens
uuggcugcuggaggcugcacuggggaccucaccugcuggggacccuguuggggaccucaccugc

SEQ ID NO: 144138 - RNA, 64 nt, Homo Sapiens
ucaccugcuggggaccuugguggggaccucaccugcuggggacccugcuggggaccucgccugu

SEQ ID NO: 144139 - RNA, 64 nt, Homo Sapiens
ucgccuguuggggaccucacuagggaccucgccugcuggggaccccuccagaagacuugccugc

SEQ ID NO: 144140 - RNA, 64 nt, Homo Sapiens
gugccuacuggggaccuugcccuugccagcuggggcuggggaugggagccuccccugcugggga

SEQ ID NO: 144141 - RNA, 64 nt, Homo Sapiens
uugccagcuggggcuggggacaggagccuccccugcuggggacccacuugccgggcuucacugc

SEQ ID NO: 144142 - RNA, 64 nt, Homo Sapiens
caccccauucauccccguauaaaaguggggagccgcuggggagcgcuuuuuucucucguaauag

SEQ ID NO: 144143 - RNA, 64 nt, Homo Sapiens
ggcugccuguuuuacucaccucaaggcuagagcugcuggggaggcccaagccacggcccggggu

SEQ ID NO: 144144 - RNA, 64 nt, Homo Sapiens
ggcuccuggaauccaggccagcccaacagcccuggcuggggaggugucagggcagcuggggaga

SEQ ID NO: 144145 - RNA, 64 nt, Homo Sapiens
gcccaacagcccuggcuggggaggugucagggcagcuggggagaggugggcucugcuuuucaga

SEQ ID NO: 144146 - RNA, 64 nt, Homo Sapiens
agcccugcaguuucauagucccagccuuccuggugcuggggagggaggacugugaauggcuguu

SEQ ID NO: 144147 - RNA, 64 nt, Homo Sapiens
cuaacaugugagcucauuaaccaacagacccuaugcuggggacuggguguggccugcaaaggaa

SEQ ID NO: 144148 - RNA, 64 nt, Homo Sapiens
uggaaccauggugcaguaguagagcccacuguaugcuggggaaaagguacagcuuuggcccuca

SEQ ID NO: 144149 - RNA, 64 nt, Homo Sapiens
gggaggcuccccugcccuccccaacugugcaggugcuggggaguuuuguggaucucuuggcaag

SEQ ID NO: 144150 - RNA, 64 nt, Homo Sapiens
aagcggggggacgccugucaagggaaaggucacagcuggggaggcccagcuucgguaugccuuc

SEQ ID NO: 144151 - RNA, 64 nt, Homo Sapiens
agggacccacacaagcccccaagccacccugccugcuggggaggaucaccagccagagcacagg

SEQ ID NO: 144152 - RNA, 64 nt, Homo Sapiens
ucugucugcuccuaaugggggcccaaagcucagggcuggggagccugggguccccacuugaauc

SEQ ID NO: 144153 - RNA, 64 nt, Homo Sapiens
gugcagcuggggucccaggcagcgcugccugggggcuggggaggggaggcccagaggagggcug

SEQ ID NO: 144154 - RNA, 64 nt, Homo Sapiens
ggugagggccuuccagagaucagggugcuccagcgcuggggaguugccacuugaagccuggacu

SEQ ID NO: 144155 - RNA, 64 nt, Homo Sapiens
aggaaagucuggggagccacaauggagagagugagcuggggaacaucagcaccguggucugaug

SEQ ID NO: 144156 - RNA, 64 nt, Homo Sapiens
augggacuuagaggguuucuguacacugcagcagugugcaaacuccauuccaguccucugcacu

SEQ ID NO: 144157 - RNA, 64 nt, Homo Sapiens
augggcagaaaagaaagugcauauuuccauauugugugcaaaggccucuccccagauaccuccu

SEQ ID NO: 144158 - RNA, 64 nt, Homo Sapiens
accagccucuaggcuagcggcugcauucguggucugugcaaacacuucgugguucuauauauca

SEQ ID NO: 144159 - RNA, 64 nt, Homo Sapiens
caaacacuucgugguucuauauaucagcagcaagugugcaaaauaaaggaccuguuaacucaga

SEQ ID NO: 144160 - RNA, 64 nt, Homo Sapiens
ccuugccuguguaauuuuaaaaaauuaauagagcugugcaaacccuguuauuuuuguaaaaaaa

SEQ ID NO: 144161 - RNA, 64 nt, Homo Sapiens
aucaaguucacauguuccaaugugaacuuuuaugugugcaaaggaggcaaauuaaaagcagcuu

SEQ ID NO: 144162 - RNA, 64 nt, Homo Sapiens
gaacauuguaacuacaccaaacuauagggauaguugugcaaagugaaacccaauggcuaccuag

SEQ ID NO: 144163 - RNA, 64 nt, Homo Sapiens
cuguauuccaaggccugugaaccucauuuguccaugugcaaacgccgacucugagcugcuagga

SEQ ID NO: 144164 - RNA, 64 nt, Homo Sapiens
uaccacauucuguccccaaagaugggagagguucugugcaaaaccuuuuucuaagcuguuucuu

SEQ ID NO: 144165 - RNA, 64 nt, Homo Sapiens
gucacugggcugauuugaccuccgacucauugguugugcaaaugccaugugcagccuuuccuga

SEQ ID NO: 144166 - RNA, 64 nt, Homo Sapiens
uccacaccaagaggguguugugaugaggugccggugugcaaagggaacuuuaguuuuuccacug

SEQ ID NO: 144167 - RNA, 64 nt, Homo Sapiens
caggcuugugcuuuauacccaguuggucuuacuuugugcaaaaguugggcuaacauuuaggaga

SEQ ID NO: 144168 - RNA, 64 nt, Homo Sapiens
guguaagcuuagauuuucugcaagauccaaaugcugugcaaacagcugggacucauucacauuu

SEQ ID NO: 144169 - RNA, 64 nt, Homo Sapiens
uggacauaauaguucacuuaacaguggacgaguaugugcaaacaucuccuucaggugaucacac

SEQ ID NO: 144170 - RNA, 64 nt, Homo Sapiens
auuauauauaaauauauuuaccuucuaaauuucaugugcaaauaucaaaguaaaucugcaaauu

SEQ ID NO: 144171 - RNA, 64 nt, Homo Sapiens
cauuuuuguuacaaaccugugcauugugaggaacugugcaaagauugcuuuagcuauuaauggg

SEQ ID NO: 144172 - RNA, 64 nt, Homo Sapiens
guaguaccacguguagcauuuauuuugaucaaacugugcaaacacuugacucaaaguagaucgu

SEQ ID NO: 144173 - RNA, 64 nt, Homo Sapiens
ggacaaccagaaguacacauuuacaauagauagaugugcaaaagaccuuuuuguagccaaacaa

SEQ ID NO: 144174 - RNA, 64 nt, Homo Sapiens
cauauauuuaaacuuacagauggaaauugcccaaugugcaaauuguuaaguaccacacuuuaca

SEQ ID NO: 144175 - RNA, 64 nt, Homo Sapiens
ggaaaacagagcgucuuuuucagaaauacauuuuugugcaaaaugucuguacuuugggaaguca

SEQ ID NO: 144176 - RNA, 64 nt, Homo Sapiens
caaaagcaacacuccugaguguguguaugauuucugugcaaaaaguuaggaagugugaaguuuu

SEQ ID NO: 144177 - RNA, 64 nt, Homo Sapiens
acuauagucaaauguacuguaaagugaaaagggaugugcaaaaaaauaaaaaaaaacaacaaaa

SEQ ID NO: 144178 - RNA, 64 nt, Homo Sapiens
ucaaacaggaugcucauagcuuaauaauaaaagcugugcaaaggccaugaaugaaugaauuuuc

SEQ ID NO: 144179 - RNA, 64 nt, Homo Sapiens
ggagacugaaacucaaacaacccugggcaaguaaugugcaaaagauggcaggguggggauuuga

SEQ ID NO: 144180 - RNA, 64 nt, Homo Sapiens
aggacuccucugcagggagcgccaucugugugcgugugcaaauaugacucaauucacguaaaga

SEQ ID NO: 144181 - RNA, 64 nt, Homo Sapiens
guuuugcauaguugcacuacaagaagaauguaguugugcaaaucuaugcaaaacugaugguggc

SEQ ID NO: 144182 - RNA, 64 nt, Homo Sapiens
uugcagguuugcauccagcugugugauauucugcugugcaaauccaugcaaaacugacuguggu

SEQ ID NO: 144183 - RNA, 64 nt, Homo Sapiens
uuuguauaauucuguguuauauuacaugugaugcugugcaaaacuugcauauagcauauguguc

SEQ ID NO: 144184 - RNA, 64 nt, Homo Sapiens
gauaugggcaccacgaaauaugaaauuccauauaugugcaaacagugauuuaaaauuuucaaaa

SEQ ID NO: 144185 - RNA, 64 nt, Homo Sapiens
caguaauucaacuuaaaauaucuguagaaauguuugugcaaauuagcuuguuuuuuaaaacaau

SEQ ID NO: 144186 - RNA, 64 nt, Homo Sapiens
gugaaauauuauuuuauuaucuuuagucagacucugugcaaauugaggguaauaugccucugcc

SEQ ID NO: 144187 - RNA, 64 nt, Homo Sapiens
acaggcaagacaacaaagcccuacagagccuaaaugugcaaauuaaaacuauuuuauaaacaaa

SEQ ID NO: 144188 - RNA, 64 nt, Homo Sapiens
ggggcagggaugagacaauauugugcccugggucugugcaaacguugggaccagaauccacuau

SEQ ID NO: 144189 - RNA, 64 nt, Homo Sapiens
aaucuucuccuuauucaccggggaggcugugucuugugcaaacaagucauagaaacuugauggg

SEQ ID NO: 144190 - RNA, 64 nt, Homo Sapiens
ugggaagcgcacccugucguucagugacgucauucuucuccaggcuggcccgcccccucugacu

SEQ ID NO: 144191 - RNA, 64 nt, Homo Sapiens
aucugcgcuuuccagauaagcccaaagacagcaacuucuccacucaugacaaaucaacugugac

SEQ ID NO: 144192 - RNA, 64 nt, Homo Sapiens
gacccuuagaucacaucacuucuuccacuccacccuucuccaggcuuuaacccaagacccugcc

SEQ ID NO: 144193 - RNA, 64 nt, Homo Sapiens
ccucuugccuuugagucuuuccuaggagccccugcuucuccagggagaggcaugcaggcagggu

SEQ ID NO: 144194 - RNA, 64 nt, Homo Sapiens
uccucauccuucaaggagcauuaaagauaccgugcuucuccacaagacucccuucccuuguuuu

SEQ ID NO: 144195 - RNA, 64 nt, Homo Sapiens
ggcuugauaaauucaaucaccaccagggagaguccuucuccacacauauuuaugccacuaccuc

SEQ ID NO: 144196 - RNA, 64 nt, Homo Sapiens
ggucccacguuuguuaucucugccuaaauguuagcuucuccauccucaccacaugaugaccugc

SEQ ID NO: 144197 - RNA, 64 nt, Homo Sapiens
cuuugacccccagacuuugcuccaucuauuauugcuucuccauccuggauccuugacauuuguc

SEQ ID NO: 144198 - RNA, 64 nt, Homo Sapiens
ucuguccccaggaccuaugcucccugcucacccccuucuccaaagcccaagcgucccgcugcuc

SEQ ID NO: 144199 - RNA, 64 nt, Homo Sapiens
aaugggcaaggagucucuagcaugcagcccaggccuucuccauaccccucuccccagcaucaug

SEQ ID NO: 144200 - RNA, 64 nt, Homo Sapiens
ccacagccaggcccugggcccaagccccuugucccuucuccacugccccucuuuccagacagua

SEQ ID NO: 144201 - RNA, 64 nt, Homo Sapiens
cuggacaaggcagucaucacauaagaacagcuaccuucuccacuugguggcacaagagguaggg

SEQ ID NO: 144202 - RNA, 64 nt, Homo Sapiens
aauaagaagcacgugguaaaggauguuugcucagcuucuccaacauccuugucuuuuuaugaca

SEQ ID NO: 144203 - RNA, 64 nt, Homo Sapiens
cuaccacaaugcagugccuucauucaagucagcucuucuccauccuuuuuguuccccuuugcuu

SEQ ID NO: 144204 - RNA, 64 nt, Homo Sapiens
gauuuuuuaaaguuaauuuguuuccugggauucacuucuccaggguagaaaucuggaaaguuca

SEQ ID NO: 144205 - RNA, 64 nt, Homo Sapiens
ccccugugguuucuguuggaacgaaacucauguucuucuccaguccuucugauucguaaggguu

SEQ ID NO: 144206 - RNA, 64 nt, Homo Sapiens
uucuguuuaaucugaucacgcccacaucccuccacuucuccaaccauuuucuucucgugugugg

SEQ ID NO: 144207 - RNA, 64 nt, Homo Sapiens
acugugcaauagagauacaggggaucagagcagacuucuccacuggaaucauuguuuacacaug

SEQ ID NO: 144208 - RNA, 64 nt, Homo Sapiens
aguguuuaaguacaaucuuuuuauucauuccuuccuucuccaauaguaguagaaaugaaugcau

SEQ ID NO: 144209 - RNA, 64 nt, Homo Sapiens
aguccuagaaacaucucauccuaaaagagcauaucuucuccagaccauccagggcaaggacaga

SEQ ID NO: 144210 - RNA, 64 nt, Homo Sapiens
uucacuggcuuccccagccacuugagucucuccucuucuccaucugaugcccgagggcugggcc

SEQ ID NO: 144211 - RNA, 64 nt, Homo Sapiens
aaaaacaauaaucccaaagucucccauuaccccccuucuccacuguuaacuguaaacagucaca

SEQ ID NO: 144212 - RNA, 64 nt, Homo Sapiens
guagcaaaauaagcacccccccccauucaagccccuucuccacuauguuagccaggucugcccu

SEQ ID NO: 144213 - RNA, 64 nt, Homo Sapiens
gcagcgaccuccgucucaagcaguccucagccaccuucuccacguggagagcgccucuucccac

SEQ ID NO: 144214 - RNA, 64 nt, Homo Sapiens
cauugaacuggucccacacgcgcugccuccguggcuucuccagccauuuccacagaagcccauc

SEQ ID NO: 144215 - RNA, 64 nt, Homo Sapiens
gacuaaccuccuccucuggcccuuccagaggccgcuucuccagugucccagcucaggcucucug

SEQ ID NO: 144216 - RNA, 64 nt, Homo Sapiens
auucugcagaguggugaaguucacuuccccaacucuucuccaagucuagcuuuccuuuccuucu

SEQ ID NO: 144217 - RNA, 64 nt, Homo Sapiens
uuaacucaggaugccaaguggcccucagauuacacuucuccagauagcugaaugagucugcuuu

SEQ ID NO: 144218 - RNA, 64 nt, Homo Sapiens
ggcacacguggccuccgugguauggaccugguggcuucuccaucccacuguggccucuguggua

SEQ ID NO: 144219 - RNA, 64 nt, Homo Sapiens
ucccacuguggccucugugguauggaccugguggcuucuccauccuacccaagguaacaguguc

SEQ ID NO: 144220 - RNA, 64 nt, Homo Sapiens
ccucucuuggauccgccucgggaggggaucugcccuucuccacuggugggaagucuugagcgga

SEQ ID NO: 144221 - RNA, 64 nt, Homo Sapiens
acugucuucucacccuucccguccaucaccugaccuucuccaggaucgugcguggucucugauc

SEQ ID NO: 144222 - RNA, 64 nt, Homo Sapiens
ggcuuuggggaagaacuucacucugaugcagcugcuucuccaauagugucagugacacaguuuc

SEQ ID NO: 144223 - RNA, 64 nt, Homo Sapiens
ucacagacuuuaaucuacaccugagcaacgccugcuucuccauagauaagaaauccuagguccu

SEQ ID NO: 144224 - RNA, 64 nt, Homo Sapiens
cagaaccagaaugacuggacaaucuuuuucauagcuucuccaucacauucaagcugguuuaugu

SEQ ID NO: 144225 - RNA, 64 nt, Homo Sapiens
gcaauuucaggggagucaaaaaccuugcaacuuccuucuccacuaacccaggacuaaaaaugga

SEQ ID NO: 144226 - RNA, 64 nt, Homo Sapiens
ccccugcccugaggcugugagcagcuagugguggcuucuccagccuuuuucagggaacugggaa

SEQ ID NO: 144227 - RNA, 64 nt, Homo Sapiens
gccugcugcucucaggaccagagaagggaaaugacuucuccaggcagaggcagaucugagucua

SEQ ID NO: 144228 - RNA, 64 nt, Homo Sapiens
caguauuuugcuagugcauuucaaggaauggaaucuucuccaguaugaaauuaccagauauaaa

SEQ ID NO: 144229 - RNA, 64 nt, Homo Sapiens
caguagcuuuggggaaagggaggaagauauggcacuucuccaaccccggaaaacauugcuuuug

SEQ ID NO: 144230 - RNA, 64 nt, Homo Sapiens
gaguguuggcuucucaauaguugcuuaaagcccccuucuccaugaaguugaggagaguucuuuu

SEQ ID NO: 144231 - RNA, 64 nt, Homo Sapiens
gcucuggagugugcauuucagcugcucucaggcgcuucuccaauauguccuuguggucuuugcu

SEQ ID NO: 144232 - RNA, 64 nt, Homo Sapiens
guuuuuuguugucuccaaucagggggguauuaagcuucuccaguuuucuaaggaacccugagug

SEQ ID NO: 144233 - RNA, 64 nt, Homo Sapiens
ucuccgugugugcaguagugggaugauguagauucuucuccaucuaaaccuccagcagucccua

SEQ ID NO: 144234 - RNA, 64 nt, Homo Sapiens
cuggaccuugaacuggguacuuguggacacagcucuucuccaggcuguaucccaugagccucag

SEQ ID NO: 144235 - RNA, 64 nt, Homo Sapiens
gcgugagccacugcaccgggccacagagaaaguacuucuccacccugcucuccgaccagacacc

SEQ ID NO: 144236 - RNA, 64 nt, Homo Sapiens
gggacacagucuggugcccagaugauggaagggccuucuccacaaugaguuuccagcuaagccu

SEQ ID NO: 144237 - RNA, 64 nt, Homo Sapiens
accuccuccuccaguucugacgagaggaaaaaggcuucuccacaaugcuguguaacacacucac

SEQ ID NO: 144238 - RNA, 64 nt, Homo Sapiens
agauauuugcuuccuaagaacaaagaaaaagccccuucuccaccugcauaacuggcguguagca

SEQ ID NO: 144239 - RNA, 64 nt, Homo Sapiens
cugcugucucuaauuuggccacugaagcuauuuucuucuccaaaagugagucgguggcuucugg

SEQ ID NO: 144240 - RNA, 64 nt, Homo Sapiens
gaaugaugagugauucuugguuaacaaguagauucuucuccaaacagagauaaaugcuguuaau

SEQ ID NO: 144241 - RNA, 64 nt, Homo Sapiens
gucuuaguucugucacccaugaucagccaguuaccuucuccauucauccgguguaaaaaaaaga

SEQ ID NO: 144242 - RNA, 64 nt, Homo Sapiens
caggcugaaggcacacgcucaaugccccacgugccuucuccaggaggaacgaagcaggguuuga

SEQ ID NO: 144243 - RNA, 64 nt, Homo Sapiens
ccacccccaccccgaguccugagcucacuuucgccuucuccauccccugccgugggggccacag

SEQ ID NO: 144244 - RNA, 64 nt, Homo Sapiens
cucccucugcugucaccuugcucagccaucccgucuucuccaacaccaccucuccagaggccaa

SEQ ID NO: 144245 - RNA, 64 nt, Homo Sapiens
agaacaggagcucuuaacuacaguggcugaauagcuucuccaaaggcucccuguguucucaccg

SEQ ID NO: 144246 - RNA, 64 nt, Homo Sapiens
uuuaggaacugagaaagaaacucuucuuccucagcuucuccauguugcaagucaacauuauuuu

SEQ ID NO: 144247 - RNA, 64 nt, Homo Sapiens
aauuucuccauucuguuuaugcuaugaaaaguuacuucuccauugugccacccuuuauaauaca

SEQ ID NO: 144248 - RNA, 64 nt, Homo Sapiens
agccucgguuuuucagcaaaacgcggccaguccccuucuccacugcugccucccagcagagggc

SEQ ID NO: 144249 - RNA, 64 nt, Homo Sapiens
aucuuaacaauauuuuguaaaaugaugcuucccccuucuccauggucuagucaauuuuguacaa

SEQ ID NO: 144250 - RNA, 64 nt, Homo Sapiens
uugggaggcucccacuucuugaaauuguauuugccuucuccacuucuccuuauccccccaaaug

SEQ ID NO: 144251 - RNA, 64 nt, Homo Sapiens
cggauggcccccacccaguccaguugcagcuggacuucuccaccugcugaggacacucaguguc

SEQ ID NO: 144252 - RNA, 64 nt, Homo Sapiens
uguuccauugaaucuguauggcuagaauauccuacuucuccagccuagagguacuuuccacuug

SEQ ID NO: 144253 - RNA, 64 nt, Homo Sapiens
ugcggucuagggaaugagacaggaccuaggauaucuucuccaggaugucaacugaccuaaaauu

SEQ ID NO: 144254 - RNA, 64 nt, Homo Sapiens
gaggagcagguaaaugggagagcauccugccugccuucuccacucccuuccccacuuucacuag

SEQ ID NO: 144255 - RNA, 64 nt, Homo Sapiens
gucaacucuuggggcacuccuuuacccccauugccuucuccauuugugucccaccccucacccc

SEQ ID NO: 144256 - RNA, 64 nt, Homo Sapiens
guagccaaggugggcugagcccuggcaggaugacccugcgaaggggcccugguccuuccaggcc

SEQ ID NO: 144257 - RNA, 53 nt, Homo Sapiens
ggaagaaaauggaaaugugaguuccugcgaacgcugaaucuaggugggacgcu

SEQ ID NO: 144258 - RNA, 64 nt, Homo Sapiens
uagucucuaucuucauguuauuaucacuuaaaaaccugcgaaagcugucaacuuuugugguugu

SEQ ID NO: 144259 - RNA, 64 nt, Homo Sapiens
aucuuugaccuagaagagauucuuuuuggaccaaccugcgaaauugguaguuaggucuauggaa

SEQ ID NO: 144260 - RNA, 64 nt, Homo Sapiens
ggcagaggccuccguggugaagcuguggaccugcccugcgaauccagucguggugaaaccgguc

SEQ ID NO: 144261 - RNA, 64 nt, Homo Sapiens
uguguuuauaauaaaugaggagacccucuauuuaccugcgaacuuuuauuuuaauguauuuuuu

SEQ ID NO: 144262 - RNA, 64 nt, Homo Sapiens
cuugagauuuagugucugugggaagcagagguucccugcgaagaaaugaggcuggacagauggc

SEQ ID NO: 144263 - RNA, 64 nt, Homo Sapiens
cugggcacugcugugggacaagaccaagagagguccugcgaagggcagggucacccacggacag

SEQ ID NO: 144264 - RNA, 64 nt, Homo Sapiens
ugaacggggugaguuguuucggggggagggggagccugcgaauugucauugugggagaaggggu

SEQ ID NO: 144265 - RNA, 64 nt, Homo Sapiens
caaaccugugagucucuucuuuccaaaguucgugccugcgaaccgugcgccagacucuuccggu

SEQ ID NO: 144266 - RNA, 64 nt, Homo Sapiens
aucacacacguauacacaacauuacugaaagaacccugcgaaucaaaacaacccccacacagac

SEQ ID NO: 144267 - RNA, 64 nt, Homo Sapiens
aauacacccagacacaccagcaacacucaauuuaccugcgaagcagagguguucagaauuuagg

SEQ ID NO: 144268 - RNA, 64 nt, Homo Sapiens
gccacugcacuccagccuggccaugaugauugcaccugcgaauagagcucgaggcuguaaugug

SEQ ID NO: 144269 - RNA, 64 nt, Homo Sapiens
ccagcguucuucaggagaugugacuagccgccugccugcgaaacgaccccuggguuguugcagg

SEQ ID NO: 144270 - RNA, 64 nt, Homo Sapiens
agagguucuguagaauccaacuuccccaggggagccugcgaaggacgccaacuggaaagguccc

SEQ ID NO: 144271 - RNA, 64 nt, Homo Sapiens
gacggacucccuccccuggcggggaaauuaccuuccugcgaagaaaggugacauccccgccaca

SEQ ID NO: 144272 - RNA, 64 nt, Homo Sapiens
ccagaguccaggguggagcggugacaggcaggaaccugcgaagugcucccaggaaggggguggc

SEQ ID NO: 144273 - RNA, 64 nt, Homo Sapiens
caaaagugaaugagggcuuucaagcgcaggagagccugcgaacgggagagagagggauagaaaa

SEQ ID NO: 144274 - RNA, 64 nt, Homo Sapiens
uaccaugagaaauaucagagacuacaagggauacccugcgaaagcuccucugucaguuucagca

SEQ ID NO: 144275 - RNA, 64 nt, Homo Sapiens
gauugcuuuccaguuuaaugaaagcuuaaaugucccugcgaacccacaaucucugccagcagaa

SEQ ID NO: 144276 - RNA, 64 nt, Homo Sapiens
cccccaaaccagauacggacagccuaggccuaguccugcgaaaacuugugcccucccuguccuu

SEQ ID NO: 144277 - RNA, 64 nt, Homo Sapiens
cgaguuugguuuuagcuggggauugugcuggcauccugcgaagcuccucccagccggucucucu

SEQ ID NO: 144278 - RNA, 64 nt, Homo Sapiens
gauacugugaaaucacuaauggaguggggaucggccugcgaaagggguugcugagggaacgguu

SEQ ID NO: 144279 - RNA, 64 nt, Homo Sapiens
agaucuuccuccagcggcgcccuggacggcugcuccugcgaacagcccauggcaucuucugcuc

SEQ ID NO: 144280 - RNA, 64 nt, Homo Sapiens
uacugacagcagaggucuuggugggcugcacgugccugcgaagaugugguggacaaggaggcuc

SEQ ID NO: 144281 - RNA, 64 nt, Homo Sapiens
uuaaugauccacaaguguauaaaccaauuuuuuuccugcgaaguauuacuacaaagacaacccc

SEQ ID NO: 144282 - RNA, 64 nt, Homo Sapiens
uggagcaucgagguaggaggugccuccccagugaccugcgaaagucccucaugugccaugggcc

SEQ ID NO: 144283 - RNA, 64 nt, Homo Sapiens
aaaugagacaaugacauaaaugcagggacuuuucccugcgaaacagagggagugaggagaggau

SEQ ID NO: 144284 - RNA, 64 nt, Homo Sapiens
aggccagagccacagcugggagaccugcacugucccugcgaaauacuaagaacaccuagggugu

SEQ ID NO: 144285 - RNA, 64 nt, Homo Sapiens
gaucugcaguggcuguuugauagucaccccuccuccugcgaaguaccuuccaguaacauacuuc

SEQ ID NO: 144286 - RNA, 64 nt, Homo Sapiens
ggcucucaggggccagugagauagacagugcugcccugcgaaguaaccucauggucauggacag

SEQ ID NO: 144287 - RNA, 64 nt, Homo Sapiens
aaaggcauuauguaucugucuaugccacauagccccugcgaagauugagaugcaacagagaacg

SEQ ID NO: 144288 - RNA, 64 nt, Homo Sapiens
caucugcuuuccaggcugcuaggagcccucgauaccugcgaauacagaggcuauuuggggucgg

SEQ ID NO: 144289 - RNA, 64 nt, Homo Sapiens
cguguaaaaauucagugaagcaaguagaauuaaaccugcgaaucaaacaaagaugcucuguaga

SEQ ID NO: 144290 - RNA, 64 nt, Homo Sapiens
aucagacgccacccagcccuagccuagcgcccucccugcgaagcgcccgugccgugugacucga

SEQ ID NO: 144291 - RNA, 64 nt, Homo Sapiens
augaucgcccgauaaagacgguggacaccccagaccugcgaagguagggggcucugggcggccc

SEQ ID NO: 144292 - RNA, 64 nt, Homo Sapiens
gggcgaucaaguccagagccaaccacguggugucccugcgaauggcgggccaccaaguucugga

SEQ ID NO: 144293 - RNA, 64 nt, Homo Sapiens
uucuccuaagaacuagguuucucauaccucucuuccugcgaauuaaauguauucugugaaacua

SEQ ID NO: 144294 - RNA, 64 nt, Homo Sapiens
cucauucauucauggagccaagggugggguuucaccugcgaacaucagacugacuugcuggcgu

SEQ ID NO: 144295 - RNA, 64 nt, Homo Sapiens
aagcaaaccaaguugcaccuggcuucugcacacuccugcgaaagucggugaacauucacuccac

SEQ ID NO: 144296 - RNA, 64 nt, Homo Sapiens
cacaucgacauacccagggcaagcaacagcagacccugcgaaugggacuucagauacguuaagc

SEQ ID NO: 144297 - RNA, 64 nt, Homo Sapiens
ugcuuucucaggaaccuuucaagcggccagaaccccugcgaaucacacaugaccuuugcgggaa

SEQ ID NO: 144298 - RNA, 64 nt, Homo Sapiens
acacaugaccuuugcgggaaaagcggccagaaccccugcgaaucuacuuucucaggaaccuuuc

SEQ ID NO: 144299 - RNA, 64 nt, Homo Sapiens
acccuaauucucaaaagcaaucuuuguaaaaugaccugcgaauuguguucuuugauauuacagu

SEQ ID NO: 144300 - RNA, 64 nt, Homo Sapiens
acaucaaauaccagcaccccucugccaaagaauuaucuagaagcgggaccccaauucauucuua

SEQ ID NO: 144301 - RNA, 64 nt, Homo Sapiens
uuugagugcuuggcuuuccagagaacccagagcaaucuagaaucuuagaaagaaacuaacaaaa

SEQ ID NO: 144302 - RNA, 64 nt, Homo Sapiens
auggaggguaaauauuaaagugcguauuauguacaucuagaauccaugugacuugcagccuacc

SEQ ID NO: 144303 - RNA, 64 nt, Homo Sapiens
ucaccaaauuguaaccuggauguuauagcccagcaucuagaaauccuaugaaacguauuagcac

SEQ ID NO: 144304 - RNA, 64 nt, Homo Sapiens
cuuggaaguacauuauauugaaaaaaaaaaaaaaaucuagaauuugacgagugaaacugucucc

SEQ ID NO: 144305 - RNA, 64 nt, Homo Sapiens
agccgggcauggucgcucaucuuuacucuauuaaaucuagaauucuguaacaaaaguacuuucu

SEQ ID NO: 144306 - RNA, 64 nt, Homo Sapiens
gauuuaaagcauacaggaggagauauuauaagaaaucuagaaauugauguguaggcauuguauu

SEQ ID NO: 144307 - RNA, 64 nt, Homo Sapiens
ggcuggaaaccagaagcugguguuuccagagaacaucuagaaguguaugguuucaacgcaguua

SEQ ID NO: 144308 - RNA, 64 nt, Homo Sapiens
ggaauagccauauaaauuauuguucuaucaguauaucuagaaagacucugugguguucuguuca

SEQ ID NO: 144309 - RNA, 64 nt, Homo Sapiens
aaaacagcuaaaucccaaagugguuaaccuuuauaucuagaacccagagaaaaaccuuugauuu

SEQ ID NO: 144310 - RNA, 64 nt, Homo Sapiens
aauauuucaguauugagcuuugcauuuaugauuuaucuagaaauuuaccucaaaagcagaauuu

SEQ ID NO: 144311 - RNA, 64 nt, Homo Sapiens
agucauaauguuuauucaaaguauuuuaucuuuuaucuagaauccacauauguauguccaauuu

SEQ ID NO: 144312 - RNA, 64 nt, Homo Sapiens; identical to SEQ ID NO: 144310

SEQ ID NO: 144313 - RNA, 64 nt, Homo Sapiens; identical to SEQ ID NO: 144311

SEQ ID NO: 144314 - RNA, 64 nt, Homo Sapiens
uccccaaggcgggucccaagcguggucacauuuccccaucaaaaaaaaucuggauucacagaac

SEQ ID NO: 144315 - RNA, 64 nt, Homo Sapiens
aaaugcugugaacaacaacaacaguguuccaaaucccaucaacacuuuguagcuuugaaauacg

SEQ ID NO: 144316 - RNA, 64 nt, Homo Sapiens
aauaauggagaguauacuguagauuacauguuuacccaucaaaucugacuuaaaagguuaaaug

SEQ ID NO: 144317 - RNA, 64 nt, Homo Sapiens
guuguaaaauguguuaaauccuguucauugaacucccaucaacucuuauaaaauucaugcugau

SEQ ID NO: 144318 - RNA, 64 nt, Homo Sapiens
cuuagaauaucuaaacaucuguuagauauuaggucccaucaauuuagaauaucuaagaaucuuu

SEQ ID NO: 144319 - RNA, 64 nt, Homo Sapiens
cuuagaauaucuaagaaucuugcuucuaucaggucccaucaauuucuuaaugacauuucacuga

SEQ ID NO: 144320 - RNA, 64 nt, Homo Sapiens
acugcccaagguaauuuauagauucaaugccauccccaucaagcuaccaaugacuuucuucaca

SEQ ID NO: 144321 - RNA, 64 nt, Homo Sapiens
aaugaacucaaacaaauuuacaggaacaaacaaccccaucaaaaagucggcaaaggacaugaac

SEQ ID NO: 144322 - RNA, 64 nt, Homo Sapiens; identical to SEQ ID NO: 44480

SEQ ID NO: 144323 - RNA, 64 nt, Homo Sapiens; identical to SEQ ID NO: 44481

SEQ ID NO: 144324 - RNA, 64 nt, Homo Sapiens; identical to SEQ ID NO: 44482

SEQ ID NO: 144325 - RNA, 64 nt, Homo Sapiens; identical to SEQ ID NO: 44483

SEQ ID NO: 144326 - RNA, 64 nt, Homo Sapiens; identical to SEQ ID NO: 44484

SEQ ID NO: 144327 - RNA, 64 nt, Homo Sapiens; identical to SEQ ID NO: 44485

SEQ ID NO: 144328 - RNA, 64 nt, Homo Sapiens; identical to SEQ ID NO: 44486

SEQ ID NO: 144329 - RNA, 64 nt, Homo Sapiens; identical to SEQ ID NO: 44487

SEQ ID NO: 144330 - RNA, 64 nt, Homo Sapiens; identical to SEQ ID NO: 44488

SEQ ID NO: 144331 - RNA, 64 nt, Homo Sapiens; identical to SEQ ID NO: 44489

SEQ ID NO: 144332 - RNA, 64 nt, Homo Sapiens; identical to SEQ ID NO: 44490

SEQ ID NO: 144333 - RNA, 64 nt, Homo Sapiens; identical to SEQ ID NO: 44491

SEQ ID NO: 144334 - RNA, 64 nt, Homo Sapiens; identical to SEQ ID NO: 44492

SEQ ID NO: 144335 - RNA, 64 nt, Homo Sapiens; identical to SEQ ID NO: 44493

SEQ ID NO: 144336 - RNA, 64 nt, Homo Sapiens; identical to SEQ ID NO: 44494

SEQ ID NO: 144337 - RNA, 64 nt, Homo Sapiens; identical to SEQ ID NO: 44495

SEQ ID NO: 144338 - RNA, 64 nt, Homo Sapiens; identical to SEQ ID NO: 44496

SEQ ID NO: 144339 - RNA, 64 nt, Homo Sapiens; identical to SEQ ID NO: 44497

SEQ ID NO: 144340 - RNA, 64 nt, Homo Sapiens; identical to SEQ ID NO: 44498

SEQ ID NO: 144341 - RNA, 64 nt, Homo Sapiens; identical to SEQ ID NO: 44499

SEQ ID NO: 144342 - RNA, 64 nt, Homo Sapiens
gauauguaugaauuuuuacagguucguuuuugaauugugagaggcaguucauuagcaaagaugu

SEQ ID NO: 144343 - RNA, 64 nt, Homo Sapiens
auguaauuuauauauuccuagaauuuaaguuacuuugugagauuugggccugucccucaaugcc

SEQ ID NO: 144344 - RNA, 64 nt, Homo Sapiens
gucuuaugagugacaaucguuaguuugaggaauuuugugagacaguugucaaauuguugcuagc

SEQ ID NO: 144345 - RNA, 64 nt, Homo Sapiens
ucugguuucagaauuaaaagaauucagaguuaccuugugagauaaauguucuuugcuucauauu

SEQ ID NO: 144346 - RNA, 64 nt, Homo Sapiens
gguccagcuuuauuuacaggcauauaaaaugaaauugugagauguuuugcaagcuucuuuuuac

SEQ ID NO: 144347 - RNA, 64 nt, Homo Sapiens
cagcuguuugguuuuucguuuuucauuguuauuauugugagaaugcuguuauugggguugugug

SEQ ID NO: 144348 - RNA, 64 nt, Homo Sapiens
ugugucagauuaugccuugcacuugggaaagcucuugugagacucucccaaggugcuguauuuu

SEQ ID NO: 144349 - RNA, 64 nt, Homo Sapiens
agaaacuggcugcucauuguuagaaagugaugcuuugugagacuauugucuuggggccaaaaau

SEQ ID NO: 144350 - RNA, 64 nt, Homo Sapiens
aaaaaaagaagaaagaaaagaaaacuucaagguuuugugagaagcaaugggucugugacucaaa

SEQ ID NO: 144351 - RNA, 64 nt, Homo Sapiens
agggcaaaguucgaccucuguuaaguggagggauuugugagauaaaaauucaaaauguuggccu

SEQ ID NO: 144352 - RNA, 64 nt, Homo Sapiens
aagauugccccagcuaaaaguggacaaguccgcuuugugagaugaauacuuccugagaaacuug

SEQ ID NO: 144353 - RNA, 64 nt, Homo Sapiens
cucaaauauccuugauuuuggauguucaguauguuugugagagagguuucugggaagacucucu

SEQ ID NO: 144354 - RNA, 64 nt, Homo Sapiens
gccugaggaccaggagccaccacccacugggguguugugagagauacacuuugguaggcugagg

SEQ ID NO: 144355 - RNA, 64 nt, Homo Sapiens
cccaagaacuuugggagugugugucuguuuugguuugugagaaaguagcugccccucauucugg

SEQ ID NO: 144356 - RNA, 64 nt, Homo Sapiens
agagucucgcucugucgcccaggcuggaaugcaguugugagaucucggcucacugcaagcuccg

SEQ ID NO: 144357 - RNA, 64 nt, Homo Sapiens
ucuuuuuaauucuccccacccuugagaauguacuuugugagauccaccccugcccgcaaaacau

SEQ ID NO: 144358 - RNA, 64 nt, Homo Sapiens
gcucccagaagccaagaguguuuaaaugugacacuugugagaaggcauuugccaaaccaagcca

SEQ ID NO: 144359 - RNA, 64 nt, Homo Sapiens
ucuguacaggggagcggccguuccauugcacgcuuugugagaaagccuucaaccagaagagugc

SEQ ID NO: 144360 - RNA, 64 nt, Homo Sapiens
ccuuuuauaucacuaaaauaagaucauguuuuaauugugagaaacagggccgagcacaguggcu

SEQ ID NO: 144361 - RNA, 64 nt, Homo Sapiens
ugagacuccaucucaaaaaaaaaaaaaaaaaaaauugugagaaacagaaauacuuaaaaugagg

SEQ ID NO: 144362 - RNA, 64 nt, Homo Sapiens
agacaccuaguuugaaaaauguuauucuguuuuuuugugagaacuuaguaaacaagaaaauacu

SEQ ID NO: 144363 - RNA, 64 nt, Homo Sapiens
guuucagcuucaguccuccuugggagacggggcauugugagaauguaacuuaaagccuggcuuu

SEQ ID NO: 144364 - RNA, 64 nt, Homo Sapiens
ccgggcaacguggugaaaccugaggucaggaguucaagaccagcgcugaggcgggcagaucgcu

SEQ ID NO: 144365 - RNA, 64 nt, Homo Sapiens
cuggccaacauggcgaaaccugaggucaggaguucaagaccagcgccgagucagguggaucacc

SEQ ID NO: 144366 - RNA, 64 nt, Homo Sapiens
ggagcugagggagggccacacacuggcaagauuucaagaccacucucugcacugaagagguaaa

SEQ ID NO: 144367 - RNA, 64 nt, Homo Sapiens
uguuggccuuacugacacaccuuugcuccauguucaagaccagaaguagcugggauuuguuugc

SEQ ID NO: 144368 - RNA, 64 nt, Homo Sapiens
uauacugucugucugaggcaaggaaucuuagaaacaagaccacuggcccaaaguaacugguggu

SEQ ID NO: 144369 - RNA, 64 nt, Homo Sapiens
gacagaugucagugggcugcgaugcauuugaucucaagaccaaauucuaauguaugaagaaugg

SEQ ID NO: 144370 - RNA, 64 nt, Homo Sapiens
caggcuuucccaggccuggggucaccuggggugacaagaccagagaaagauuccaguuguauuu

SEQ ID NO: 144371 - RNA, 64 nt, Homo Sapiens
uaauuuuaugcuucagagaucucuuucucugggucaagaccaugaugucuauuaaaugucucuc

SEQ ID NO: 144372 - RNA, 64 nt, Homo Sapiens
cuggccaacauggugaaaccugaggucaggaguucaagaccaaugcugagguggguguaucacu

SEQ ID NO: 144373 - RNA, 64 nt, Homo Sapiens
cugggcaaaguagggagaccugagccuagaaguucaagaccagcgccacuguaggaggaucaau

SEQ ID NO: 144374 - RNA, 64 nt, Homo Sapiens
uugggaaacauggcaaaaccugagcucaggaguucaagaccagcgcugaggcagguggaucacu

SEQ ID NO: 144375 - RNA, 64 nt, Homo Sapiens
gucuccugguacuggacuauguggccucacccaucaagaccacuuucccugcuacuccaugcug

SEQ ID NO: 144376 - RNA, 64 nt, Homo Sapiens
gccagaugugcccccacuucuucuacccucagugcaagaccaguaggguggucuaggacugggc

SEQ ID NO: 144377 - RNA, 64 nt, Homo Sapiens
acccacuggggcauauaaaacccaguugagcucccaagaccaggcugcuguauccuuucggcuu

SEQ ID NO: 144378 - RNA, 64 nt, Homo Sapiens
acccacuggggcauauaaaacccaguugagcucccaagaccaggcugcuguguccuuucggcuu

SEQ ID NO: 144379 - RNA, 64 nt, Homo Sapiens
aggccaaggccaagcccugcaagcucaacgccuccaagaccagcuccuccaccccuuccagacc

SEQ ID NO: 144380 - RNA, 64 nt, Homo Sapiens
acccaccacgggcccugccaguggacaccaaagucaagaccagcggccugagccucgggacuca

SEQ ID NO: 144381 - RNA, 64 nt, Homo Sapiens
aggccaaggcaggcagaucaugaggucaagagaucaagaccauccuggccaacauggugaaacc

SEQ ID NO: 144382 - RNA, 64 nt, Homo Sapiens
gccgaggcagguggaucauuugagcucaggaauucaagaccagccuggguaauauggcaagagc

SEQ ID NO: 144383 - RNA, 64 nt, Homo Sapiens
gccgucccaaauacaguuuccgucgccuugacgacaagaccaccaacguguccuuguacccugg

SEQ ID NO: 144384 - RNA, 64 nt, Homo Sapiens
accaaggcgggcggaucacuuaaagucaggaguccaagaccagacucgccaacauggugaaacc

SEQ ID NO: 144385 - RNA, 64 nt, Homo Sapiens
uccaaggcgggcggaucacuugaggucaggaguucaagaccagcuuggccaaggugauaaaacc

SEQ ID NO: 144386 - RNA, 64 nt, Homo Sapiens
gcugaggcgggcagaucacuugaggccaggaguucaagaccagcccaaccaacauggugaaacc

SEQ ID NO: 144387 - RNA, 64 nt, Homo Sapiens
cuggcaaacauggugaaaccugaggccaggaguucaagaccagcgcuaaggcagcuggaucacu

SEQ ID NO: 144388 - RNA, 64 nt, Homo Sapiens
caaggcaacauagugaggccugaaacuaggaguucaagaccagcgccaaggugagaggauaacu

SEQ ID NO: 144389 - RNA, 64 nt, Homo Sapiens
cuggcuaacacggugaaacccgagguagggagaucaagaccaucaggccgaggugggcggauca

SEQ ID NO: 144390 - RNA, 64 nt, Homo Sapiens
cuggccaaccuggugaaaugugaggucaggaguucaagaccagccccgaggcggguggaucagc

SEQ ID NO: 144391 - RNA, 64 nt, Homo Sapiens
cuggccaacauggugaaaccugaggucaggaguucaagaccagcgcacugagaggccgaucacu

SEQ ID NO: 144392 - RNA, 64 nt, Homo Sapiens
cuggccaacaugaugagaccugaggccaggaguucaagaccagcgccaagguggguggaucacu

SEQ ID NO: 144393 - RNA, 64 nt, Homo Sapiens
cugggcaacauggcaagaccugagccugggaguucaagaccagcgcugaagugggaggaucgcu

SEQ ID NO: 144394 - RNA, 64 nt, Homo Sapiens
cccagcaaaaguggucggcuuuuggccucuguggcaagaccacgcuccaaacugcugucucuaa

SEQ ID NO: 144395 - RNA, 64 nt, Homo Sapiens
cugggcaacauagugaaaccggagcucgggaguucaagaccagcgccgaggugggaggaucacu

SEQ ID NO: 144396 - RNA, 64 nt, Homo Sapiens
cuugcagccaggugcaguggcugacguugucagucaagaccagcccuagcgacuggacuacugc

SEQ ID NO: 144397 - RNA, 64 nt, Homo Sapiens
cugggcaauguaguaagaccugagccccagaguucaagaccagcgccaaggugggaggaucagu

SEQ ID NO: 144398 - RNA, 64 nt, Homo Sapiens
cuggccaacauggugaaaccugaggucaggaguucaagaccagcgcugaggcaggcggaucacc

SEQ ID NO: 144399 - RNA, 64 nt, Homo Sapiens
gccucagugagggaucagggcagcaaacaagggccaagaccaucugagccagccccacaucuag

SEQ ID NO: 144400 - RNA, 64 nt, Homo Sapiens
gucgaggcaggcggaucacuugaggucaggaguucaagaccagccuggccaauauggugaaacc

SEQ ID NO: 144401 - RNA, 64 nt, Homo Sapiens
cugcucauugucaguguagcguccacaaugaccuagagugcauccucucaagagcuccgugccu

SEQ ID NO: 144402 - RNA, 64 nt, Homo Sapiens
aguggacucuccacugauggagggucacugcucaagagugcaggaacugccccuccccucauug

SEQ ID NO: 144403 - RNA, 64 nt, Homo Sapiens
uggaggaugucaucuuuucauagaugcuggaacuagagugcacuuguuagaugcuaaagguuug

SEQ ID NO: 144404 - RNA, 64 nt, Homo Sapiens
ugggacaggguuguaacucagccuuccaaagggaagagugcagggggacggggccaugauaugg

SEQ ID NO: 144405 - RNA, 64 nt, Homo Sapiens
agaacaguauuuuacaaaagguguagcuuuuauaagagugcagaaaagggaaggauguguuuuu

SEQ ID NO: 144406 - RNA, 64 nt, Homo Sapiens
uaugugucuccccuccccuccacaaaaaggagaaagagugcauuaaaauguuuaguuggguuuu

SEQ ID NO: 144407 - RNA, 64 nt, Homo Sapiens
cucacagugacuuucucagaacaucaggcagaggagagugcagcuuugggggaugauggaggug

SEQ ID NO: 144408 - RNA, 64 nt, Homo Sapiens
ggucugagacagcagccacuccuucuccuugcuuagagugcagguccuuccauaccccagcaua

SEQ ID NO: 144409 - RNA, 64 nt, Homo Sapiens
ggugcaaucucagcucacugcugucucccaggcuagagugcaguuuuugagacagauucucacu

SEQ ID NO: 144410 - RNA, 64 nt, Homo Sapiens
ugagacugauauuuaaacuauauccuccaaaaggagagugcaucaaagaucugugacucugaaa

SEQ ID NO: 144411 - RNA, 64 nt, Homo Sapiens
ggugugaucucggcucacugcugucaccuaggcuagagugcaguguuugagauggagucucacu

SEQ ID NO: 144412 - RNA, 64 nt, Homo Sapiens
cgauggaauaacagauuugccggcaaucacugaaagagugcaaauaucggguccuugugacuuc

SEQ ID NO: 144413 - RNA, 64 nt, Homo Sapiens
aauuucuguaggaagaaucaaaucaccgauuuaaagagugcaauauauaauaaucauuuuuaaa

SEQ ID NO: 144414 - RNA, 64 nt, Homo Sapiens
gggcucugggggaaugcugggaaaaugggcaagcagagugcacagcccucguucugccagcugg

SEQ ID NO: 144415 - RNA, 64 nt, Homo Sapiens
gcccgacuggaggaacagcagcucugggaggcacagagugcaggucucaggggcagaagacaug

SEQ ID NO: 144416 - RNA, 58 nt, Homo Sapiens
aacacucaacagaauuauagauucuaaucugagugaguuacugagcuuugguccacua

SEQ ID NO: 144417 - RNA, 64 nt, Homo Sapiens
uguuuguaucccuacccaucuccuggcagcccuacugagugaaauugggauacauuuggcuguc

SEQ ID NO: 144418 - RNA, 64 nt, Homo Sapiens
uucauccuuaguauugaguauuucauauuucuaccugagugaagacaucaacguuauccuucuu

SEQ ID NO: 144419 - RNA, 64 nt, Homo Sapiens
auaagaaaugaucuuuacguaagaaaauugagaccugagugaagccuggcaacaaaaaguaaug

SEQ ID NO: 144420 - RNA, 64 nt, Homo Sapiens
ucgcaagcgcacuagcauguaucccggaacauuccugagugaaucucucuaccuucuggccccc

SEQ ID NO: 144421 - RNA, 64 nt, Homo Sapiens
aggaggagcuggaaaccuggcaccgcgcaggacccugagugagggaaccuccccacaccucccu

SEQ ID NO: 144422 - RNA, 64 nt, Homo Sapiens
auguaggagcugcaguucuuguggaagacacuugcugagugaaggaaaugaaucuuugacugaa

SEQ ID NO: 144423 - RNA, 64 nt, Homo Sapiens
uuuacaucuauguguauguugacuuuuuaaaauucugagugauccaggguaugaccuagggaau

SEQ ID NO: 144424 - RNA, 64 nt, Homo Sapiens
caaguuauuuucuccuucuucuaggaaaucccuucugagugaugucacaucuuggcaggggugg

SEQ ID NO: 144425 - RNA, 64 nt, Homo Sapiens
ggaagaggaagagugcaaaacauugaagagagagcugagugagcugaagagugaggauaugagu

SEQ ID NO: 144426 - RNA, 64 nt, Homo Sapiens
ggcugagaccgaccacgguuagcauagaguggcgcugagugaguuggugcuacacggacuucgg

SEQ ID NO: 144427 - RNA, 64 nt, Homo Sapiens
ggcugacagcgauccgggcuagcuccaugcggcacugagugaguugacguugcgcuguccgagg

SEQ ID NO: 144428 - RNA, 64 nt, Homo Sapiens
ccugaagaccaagcccccucaggcuccuagggugcugagugaagcugcccuugggagcacagac

SEQ ID NO: 144429 - RNA, 64 nt, Homo Sapiens
uguucgcuuguagggugcugguguguccaccuuccugagugaugauguccguguacgucagcgu

SEQ ID NO: 144430 - RNA, 64 nt, Homo Sapiens
ugggaguauuuuggugacaaccuacuuugcuuggcugagugaaggaaugauauucauauauuca

SEQ ID NO: 144431 - RNA, 64 nt, Homo Sapiens
uuuaguuagugcuuuuuauauaccaggcaugaugcugagugacacucuuguguauauuuccaaa

SEQ ID NO: 144432 - RNA, 64 nt, Homo Sapiens
gagcgagacuccaucucuuucacugcacuccagccugagugacaugcaaugagccaugauuucc

SEQ ID NO: 144433 - RNA, 64 nt, Homo Sapiens
gcuuuccucaaaaagcagaagucaggcggagcugcugagugacacacccaguccaugcuccagg

SEQ ID NO: 144434 - RNA, 64 nt, Homo Sapiens
cuuuuuuuuccucugaugugaauccagccucagacugagugaacuguaauaauuaugaauucau

SEQ ID NO: 144435 - RNA, 64 nt, Homo Sapiens
ugcauaucucauuagauaugcaauauaaauuuaucugagugaacaaagugcuaaauaaauagau

SEQ ID NO: 144436 - RNA, 64 nt, Homo Sapiens
guuauggggagccugagguuagugagugagauggcugagugaggccugggggaugcugggagug

SEQ ID NO: 144437 - RNA, 64 nt, Homo Sapiens
gaggggacccccauccugggggaggggaaguguccugagugaagcccagaacgugcaggucugc

SEQ ID NO: 144438 - RNA, 64 nt, Homo Sapiens
caaauacagaaaugacccaugccucucuuagauccugagugagacaauucaaggauguuuaucg

SEQ ID NO: 144439 - RNA, 64 nt, Homo Sapiens
aagucaggaagcccuguggcguuaugucuguuuucugagugauggcagauggccaagcagauag

SEQ ID NO: 144440 - RNA, 64 nt, Homo Sapiens
agggugucacccacugcaucgggccgggguguggcugagugaccccaggacagcagaggcugag

SEQ ID NO: 144441 - RNA, 64 nt, Homo Sapiens
ggggugugcccggcagacacccgagccaguguggcugagugaccgaccucgggaaggcgcuggg

SEQ ID NO: 144442 - RNA, 64 nt, Homo Sapiens
uguuucugcuuucaguuucuuggcuugguagccucugagugaaucugaugcucugcugaauaau

SEQ ID NO: 144443 - RNA, 64 nt, Homo Sapiens
agcccugcuccuuuaguuuccugacaccuguguccugagugagccgcaggaguucuuagcuccu

SEQ ID NO: 144444 - RNA, 64 nt, Homo Sapiens
gccuggcacgucaaagaggcuccagaaauguuugcugagugagugaugaaucagcaauuucuga

SEQ ID NO: 144445 - RNA, 64 nt, Homo Sapiens
agugagccaggaaagcagcaaaggaaagagaaaccugagugacgacgugguggaggaacagggc

SEQ ID NO: 144446 - RNA, 64 nt, Homo Sapiens
ugcagccucgaacuccugggcucaagcaauccuccugagugaucccauuucuuaaucaguguag

SEQ ID NO: 144447 - RNA, 64 nt, Homo Sapiens
gaggaggugaacuguuuccacauucaagauuaaacugagugaaucugcauuuucuggguucugg

SEQ ID NO: 144448 - RNA, 64 nt, Homo Sapiens
gaaugaacuaaaauaaacaagaacaaaagaauaguauaauuauaucaguaacaagaagacucaa

SEQ ID NO: 144449 - RNA, 64 nt, Homo Sapiens
aucuuccauugacauuaauaaaacuuagaaacaguauaauuaguauaacauuuacucugaauuu

SEQ ID NO: 144450 - RNA, 64 nt, Homo Sapiens
uauuugauucacuaguggaagauaguguucugcuuauaauuaaacugaauguagaguaucucug

SEQ ID NO: 144451 - RNA, 64 nt, Homo Sapiens
ucagugggcaucuacuaggugacagccacugugcuauaauuagagacuuuuuacuauaagcauc

SEQ ID NO: 144452 - RNA, 64 nt, Homo Sapiens
ccuuuuuaauauuggggaaaaauuauaaugauaguauaauuaucagcagauauagacauuauca

SEQ ID NO: 144453 - RNA, 64 nt, Homo Sapiens
uuuaaaaaaacaaacagaugacuaaagcauuugcuauaauuauugucuuggacuaagucuuugu

SEQ ID NO: 144454 - RNA, 64 nt, Homo Sapiens
auuauuauugacaugaggaaauuguuauuauaauuauaauuauuaaccaggauuuuuuuuaauu

SEQ ID NO: 144455 - RNA, 64 nt, Homo Sapiens
auuauuauuauuauugacauuuaauuauuguuauuauaauuauaacagagaaccaggauuuuuu

SEQ ID NO: 144456 - RNA, 64 nt, Homo Sapiens
caugaagggaaucauaggaaaaauguacugaucauauaauuaacauuauguacuguauauauca

SEQ ID NO: 144457 - RNA, 64 nt, Homo Sapiens
uuuaaaauucuguuuauaguuuuugauaugcauauauaauuauguguauaucuaaauacaaaug

SEQ ID NO: 144458 - RNA, 64 nt, Homo Sapiens
uuauccccucccccaccgccauuauuauaauuauuauaauuauuccuuuauuauuauuguuaua

SEQ ID NO: 144459 - RNA, 64 nt, Homo Sapiens
auaauuauuuuauccccuccauuguuauaauuauuauaauuauuuauuaaucuccuuuauuauu

SEQ ID NO: 144460 - RNA, 64 nt, Homo Sapiens
auaauuauuauaauuauuuuuuuauuauuauuguuauaauuauuggacauuuuuauuaaucucc

SEQ ID NO: 144461 - RNA, 64 nt, Homo Sapiens
uaccaauuucaauuuccugguuuugacauuauaguauaauuauguaagauggaaccauugggga

SEQ ID NO: 144462 - RNA, 64 nt, Homo Sapiens
cagauuauuaaagagguucauguuaaaaggcauuuauaauuauuuuuaauuaucuaaguuuuaa

SEQ ID NO: 144463 - RNA, 64 nt, Homo Sapiens
augauauuuucuucuauaauauuuuuauggcuuuuauaauuacaaauuucacaauacaguucca

SEQ ID NO: 144464 - RNA, 64 nt, Homo Sapiens
uuacaaagguauacauaauugcucccuuuaaccauauaauuaaaaaauuuuaugaaauuccaau

SEQ ID NO: 144465 - RNA, 64 nt, Homo Sapiens
uagcauaaaaguuaagguugcauaaagcuuugaauauaauuauguguaauuauaaacaaaaaua

SEQ ID NO: 144466 - RNA, 64 nt, Homo Sapiens
guguaauuauaaacaaaaauugguacuaaacauuuauaauuacuaauaguguuugucaucaggu

SEQ ID NO: 144467 - RNA, 64 nt, Homo Sapiens
aagaaaaaaaaaaauaaaacugauguaaugaauauauaauuacaacaaaagaggucuaacacua

SEQ ID NO: 144468 - RNA, 64 nt, Homo Sapiens
agaguauauuuuguugaaugcuauggaauauuaauauaauuaauucuaaaauaucaccuaaaau

SEQ ID NO: 144469 - RNA, 64 nt, Homo Sapiens
uagaacuguacuauaagaaaacauuuccccuauguauaauuauaugaaugugauguuuauugcu

SEQ ID NO: 144470 - RNA, 64 nt, Homo Sapiens
uugguuucuguaaauguugcaggguuuuaaacuuuauaauuacuuuaauauuuuugauaacuag

SEQ ID NO: 144471 - RNA, 64 nt, Homo Sapiens
cccauugugcucuuaauggauuggagcauccugguauaauuaccgcacaagauggaaagagcga

SEQ ID NO: 144472 - RNA, 64 nt, Homo Sapiens
agcaacagcaagcagcagcccaaaguuuaauuaauauaauuaaacucucuuugcauuaaaauuu

SEQ ID NO: 144473 - RNA, 64 nt, Homo Sapiens
auauguauuuaugucuuuuguacaaugcacaauuuauaauuacauagaauuuacaacuuauaau

SEQ ID NO: 144474 - RNA, 64 nt, Homo Sapiens
augcacaauuuauaauuacauagaauuuacaacuuauaauuacaaccauagcugaccuuuguag

SEQ ID NO: 144475 - RNA, 64 nt, Homo Sapiens
agcaaacaaaugcauaagcaagacugagcagcauuauaauuaauuuucaggguuuugaggcuga

SEQ ID NO: 144476 - RNA, 64 nt, Homo Sapiens
acuguuuuauuuuuuauauuuuuaaaauuuaaaguauaauuaguuuuuauaauuuucaucagau

SEQ ID NO: 144477 - RNA, 64 nt, Homo Sapiens
uaggaacgacucuaauuaauaggcuuucuguguauauaauuaaauuuagcugcugcaaccauug

SEQ ID NO: 144478 - RNA, 64 nt, Homo Sapiens
gcacuuaauggaaagguaaauggucagauaaaaauauaauuaccuguaagguuaucugguuuua

SEQ ID NO: 144479 - RNA, 64 nt, Homo Sapiens
uccaugagaaugguuacucaauauuaagauagaauauaauuaacagaaaacaagaugcugccau

SEQ ID NO: 144480 - RNA, 64 nt, Homo Sapiens
uuuggcuuuuucagccacugacuucacuaaccacuauaauuauuaacuacgaauuacaaauauc

SEQ ID NO: 144481 - RNA, 64 nt, Homo Sapiens
uguacuguugaucacauguauaagguuugacugcuauaauuauuauauuaaguaugugugauac

SEQ ID NO: 144482 - RNA, 64 nt, Homo Sapiens
uuuguaaggauauacugaguuuucaaaaaccauauauaauuaaaggaaaaacauuucucuuuag

SEQ ID NO: 144483 - RNA, 64 nt, Homo Sapiens
gcguucuagaugucauccuaaaaaacacuucauauauaauuaaucacuauuuuguauaauuaca

SEQ ID NO: 144484 - RNA, 64 nt, Homo Sapiens
aaaaacacuucauauauaauuaaucacuauuuuguauaauuacauauugcugcuuguguguuuu

SEQ ID NO: 144485 - RNA, 64 nt, Homo Sapiens
aaaguuccuuuugcaugaaacaauuaugcaaacuuauaauuauuagugcugaaaaagaguuuau

SEQ ID NO: 144486 - RNA, 64 nt, Homo Sapiens
caacugguuuaucuacaaucucaaauccuaaguguauaauuaugugcaauguucaauaccucau

SEQ ID NO: 144487 - RNA, 62 nt, Homo Sapiens
auggguuuggaaaaucaucaagaucaauaaacuauauaauuauuauuguaaaaaguccaagc

SEQ ID NO: 144488 - RNA, 64 nt, Homo Sapiens
uaauuauuguaaaaaguccauauguacuuaaaucuauaauuauuauuuuaaauguuauuaaaau

SEQ ID NO: 144489 - RNA, 64 nt, Homo Sapiens
acgcuuaaaugaucaaauuagaaaaaccaauuccuauaauuaauaugcagaacuuuuauagaau

SEQ ID NO: 144490 - RNA, 64 nt, Homo Sapiens
acgauggugaugauaauuuuaguauuacugucauuauaauuauuauuauauucauucuacagau

SEQ ID NO: 144491 - RNA, 64 nt, Homo Sapiens
uucaucuuugaaauacaucuaaaacugauacuaauauaauuaagcuuugauuugcuagauugac

SEQ ID NO: 144492 - RNA, 64 nt, Homo Sapiens
uuuuuuccauauuuuugaaaggaaguaauuuuaguauaauuagaaaaauuuuuuuugaaugugu

SEQ ID NO: 144493 - RNA, 64 nt, Homo Sapiens
caaguaaugccaaaaaccaaacucauuggaaugauauaauuauaugaauggauuaccuguagug

SEQ ID NO: 144494 - RNA, 64 nt, Homo Sapiens
cuucaaaauauuugacaucuuuuuaauccuucccuauaauuauacccccuggauaaagaguuaa

SEQ ID NO: 144495 - RNA, 64 nt, Homo Sapiens
uuaaaaugguucuagcacaaauuuggcagauauguauaauuauacauaaaccuuuucuuccugg

SEQ ID NO: 144496 - RNA, 64 nt, Homo Sapiens
agcaaaauucagagcaacuggugauuaaauagguuauaauuauaaccucugcagggguucuucu

SEQ ID NO: 144497 - RNA, 64 nt, Homo Sapiens
uaagaauaaucuaguuauauuuuuugaaaucacauauaauuagacuuuauaauauauauacuuu

SEQ ID NO: 144498 - RNA, 64 nt, Homo Sapiens
uaauuagacuuuauaauauauauacuuuuucauauauaauuagaucuuucuuuguaauuucaua

SEQ ID NO: 144499 - RNA, 64 nt, Homo Sapiens
ggaagacuguguguagaaucaagguuuuaguuauuauaauuaaauaauuuaaaguaaaauucag

SEQ ID NO: 144500 - RNA, 64 nt, Homo Sapiens
ugaagcugcauguuuguauuaaauaaaacguauguauaauuaaguguguguuuugcuuuucuuu

SEQ ID NO: 144501 - RNA, 64 nt, Homo Sapiens
uaacuguucuucauacuuaguauaauuaaguaguuauaauuaaaucagauucuuggugaaacac

SEQ ID NO: 144502 - RNA, 64 nt, Homo Sapiens
uaguuauaauuaaauaacugucuuggugaaacacuauaauuaaguuaguauuagggcaucagau

SEQ ID NO: 144503 - RNA, 64 nt, Homo Sapiens
cagauauaccuagaguauaccugugguuugguuuuauaauuaaucagcucguuacuucagccca

SEQ ID NO: 144504 - RNA, 64 nt, Homo Sapiens
ugaaaagggaugaugugguuuuuugccagguguuuauaauuaauccuuuaauauuaugguuauu

SEQ ID NO: 144505 - RNA, 64 nt, Homo Sapiens
cagagcgcguauggaguggaguaagacaucacaaucccauuauucgcccaguuugagaauuggu

SEQ ID NO: 144506 - RNA, 64 nt, Homo Sapiens; identical to SEQ ID NO: 144505

SEQ ID NO: 144507 - RNA, 64 nt, Homo Sapiens
agcaggaauggcaguaauaacuuuugacuccugcucccauuaggccccuuuuaauuuguuuuuc

SEQ ID NO: 144508 - RNA, 64 nt, Homo Sapiens
uauauguaaguaguuguaguaagccccacucuuuucccauuagaucccauccacucugacaccu

SEQ ID NO: 144509 - RNA, 64 nt, Homo Sapiens
uuuuaaacaacuguuuccuugggcuucaguuauuuaaaguaaauuuagguguaauauagaaaac

SEQ ID NO: 144510 - RNA, 64 nt, Homo Sapiens
auuuacaauguaguauguuuucaaugaaaaaccauaaaguaacauccaaguguuucaugguuug

SEQ ID NO: 144511 - RNA, 64 nt, Homo Sapiens
auggauuauggaagucuaguuucuagauugaauuuaaaguaaguccuaauaugagucauguuau

SEQ ID NO: 144512 - RNA, 64 nt, Homo Sapiens
cucuuauuuuagcaaauauuagcacucuaauuuuuaaaguaaaugguguacuuugcaagaaaua

SEQ ID NO: 144513 - RNA, 64 nt, Homo Sapiens
accacaccauguuucugucuaaauguaagcuuguuaaaguaagcccaacccaauuacaggggau

SEQ ID NO: 144514 - RNA, 64 nt, Homo Sapiens
gaaaucucucauugccgguaagaaggcaggaauauaaaguaauugauaauauguguacagacug

SEQ ID NO: 144515 - RNA, 64 nt, Homo Sapiens
gcgauuguaugaauauuuaaaaugccuggaacacuaaaguaaaguaaugauauuucaaguguuu

SEQ ID NO: 144516 - RNA, 64 nt, Homo Sapiens
uguaugaauauuuaaaaugccuggaacacuaaaguaaaguaaugauauuucaaguguuuuugug

SEQ ID NO: 144517 - RNA, 64 nt, Homo Sapiens
cuuucaaaguaaacagugaugacacagcauuugcuaaaguaacaucuguagguuuugguuucca

SEQ ID NO: 144518 - RNA, 64 nt, Homo Sapiens
aagguggcaggaaauaauauuggaaauaacauuuuaaaguaaaaauuuuaaaguuuaaagaaga

SEQ ID NO: 144519 - RNA, 64 nt, Homo Sapiens
uacuguauggaaaguuacaaucuucauuuuaaaguaaaguaauaagauacacuuccgcaagaua

SEQ ID NO: 144520 - RNA, 64 nt, Homo Sapiens
uaauauacuguauggaaaguagauaucuucauuuuaaaguaaagacagaagauacacuuccgca

SEQ ID NO: 144521 - RNA, 64 nt, Homo Sapiens
uuccuuuccuggugcuaacuaaguaaucagaagcuaaaguaaagaaguaaaaauaaaaauaaaa

SEQ ID NO: 144522 - RNA, 64 nt, Homo Sapiens
auaaaaauaaaaaaguaaucaauaauaauaauaauaaaguaaaaugagacuccaucucaaaaau

SEQ ID NO: 144523 - RNA, 64 nt, Homo Sapiens
aaagagugagaaaacauaaauugagaaagggugauaaaguaauagauaacuuuuaguuuaauaa

SEQ ID NO: 144524 - RNA, 64 nt, Homo Sapiens
gcaaaugucaaguuaaaauguauuguguuguuuguaaaguaagaaguuacuggccaggagcggc

SEQ ID NO: 144525 - RNA, 64 nt, Homo Sapiens
uaguuuaucauuuacuguguaaagaccuuagacauaaaguaaaaacauucuauuucauauuaug

SEQ ID NO: 144526 - RNA, 64 nt, Homo Sapiens
aaaaguaauaugguggcuuuacugaaaauguguauaaaguaauuaaaugauuauuuagaugaug

SEQ ID NO: 144527 - RNA, 64 nt, Homo Sapiens
gcuuacauguuuugaaaaucuaauuauccaggcuuaaaguaauagguuuauuaaaauaagcaga

SEQ ID NO: 144528 - RNA, 64 nt, Homo Sapiens
cauauauagggaaauuaacauuacuuuugucugcuaaaguaaacucgguuuuaaaaaagaaaca

SEQ ID NO: 144529 - RNA, 64 nt, Homo Sapiens
auuuugaccacuauuuucaauuauuaaauuuugauaaaguaaauuuugggugaguuuuauagau

SEQ ID NO: 144530 - RNA, 55 nt, Homo Sapiens
cuaaauaccuugaaaaucaaaacaguaaaguaauuauuucuuacaguaucgauaa

SEQ ID NO: 144531 - RNA, 64 nt, Homo Sapiens
cuuugaggcuuuuguuauaccaaggaauacuauauaaaguaaugagacugguuuaaaguaacau

SEQ ID NO: 144532 - RNA, 64 nt, Homo Sapiens
ccaaggaauacuauauaaaguaaugagacugguuuaaaguaacaugccagaacuuacgcaucca

SEQ ID NO: 144533 - RNA, 64 nt, Homo Sapiens
uagugaugguggccacgugccucguugcuauuuuuaaaguaauauucagaugugguuuuaaauu

SEQ ID NO: 144534 - RNA, 64 nt, Homo Sapiens
caucuguaaauauuaugugugugauaguauucaauaaaguaaaaucaaauugucuuuggguugu

SEQ ID NO: 144535 - RNA, 64 nt, Homo Sapiens
uccaguagcagaaucaucuuccacaacaaggaauuaaaguaauuaaagugcaaguucaaugauc

SEQ ID NO: 144536 - RNA, 64 nt, Homo Sapiens
uaaauaaguauuugugagauuugcuauuuuuuaauaaaguaauuguuuuaaauuaaucucuguu

SEQ ID NO: 144537 - RNA, 64 nt, Homo Sapiens
uaacauuuuggggagccaccugaagguugauguauaaaguaaggauuagagaaagaggucguug

SEQ ID NO: 144538 - RNA, 64 nt, Homo Sapiens
cugaaaaagacauuaccauagugcuuuacauuuuuaaaguaauguuacaaggucuggaauccau

SEQ ID NO: 144539 - RNA, 64 nt, Homo Sapiens
uucauuguacauguuuucuguuuaaaucauuguauaaaguaauugcaggucagaauuauaccac

SEQ ID NO: 144540 - RNA, 64 nt, Homo Sapiens
ucagugacuuacuugcacuuuuugcacauagauauaaaguaaaauuauguuauuaauuugguuu

SEQ ID NO: 144541 - RNA, 64 nt, Homo Sapiens
aaaaaacugggaccuaaguauaaauaucucauccuaaaguaaacaauaaguuuauaguuaacga

SEQ ID NO: 144542 - RNA, 64 nt, Homo Sapiens
uacagauuuaaaugcauguuaccauagaaacuauuaaaguaacuagaacugucaaauaacaaaa

SEQ ID NO: 144543 - RNA, 64 nt, Homo Sapiens
uuauuucuuuaaacaugauuuuugaaaguaccauuaaaguaaauauuuguuauggauuagucuu

SEQ ID NO: 144544 - RNA, 64 nt, Homo Sapiens
uccaguucuuacugauugagaacaguagcuaaauuaaaguaauaauguuuacuuuuuaggacag

SEQ ID NO: 144545 - RNA, 64 nt, Homo Sapiens
caaaccuaucuugguuaacaagaggguaacaaaguaaaguaaaaugcaaauaaguugaguuugu

SEQ ID NO: 144546 - RNA, 64 nt, Homo Sapiens
gcauaucgcuuauaucauuuggacuuuuuagaaguaaaguaaaauguagccaggguuaaaaacu

SEQ ID NO: 144547 - RNA, 64 nt, Homo Sapiens
auuucacuugcauuaagucuuuauuauauuaugauaaaguaaaaaauuaacuaaugucuuuuau

SEQ ID NO: 144548 - RNA, 64 nt, Homo Sapiens
aguccuuauuucugcauuucauuuagcagcaaauuaaaguaaccuaaagccaaaccugcuuuuc

SEQ ID NO: 144549 - RNA, 64 nt, Homo Sapiens
auuaucgcuaaguguacuugccuuuguuuuaaaguaaaguaaacuuguuuugagggagaaaauc

SEQ ID NO: 144550 - RNA, 64 nt, Homo Sapiens
uaaacauuaucgcuaaguguaaaucccuuuguuuuaaaguaaagaaaacuuguuuugagggaga

SEQ ID NO: 144551 - RNA, 64 nt, Homo Sapiens
guuucaaaguugaaagauuaauuuugggaaauuuuaaaguaaaacuuuuucugcuuucauuuua

SEQ ID NO: 144552 - RNA, 64 nt, Homo Sapiens
augauuaaagaauaacuaaaguauuaguguauuuuaaaguaauaggagggaaguagauaagaau

SEQ ID NO: 144553 - RNA, 64 nt, Homo Sapiens
aacaauugucucuauugucacacaugguuauauuuaaaguaauuucugaacuguguaauguguc

SEQ ID NO: 144554 - RNA, 64 nt, Homo Sapiens
gcuuuuuguguggcgcuauaagugacuaugguuguaaaguaauaaaauugauguuaacaugccc

SEQ ID NO: 144555 - RNA, 64 nt, Homo Sapiens
gaaaaugcagucugguguauucaguaauauauaguaaaguaauaaugauaaaauaucuuuucau

SEQ ID NO: 144556 - RNA, 64 nt, Homo Sapiens
uaucuuuucauauauuagaauguguacuuuuauauaaaguaauucuggauuugacauucucauu

SEQ ID NO: 144557 - RNA, 64 nt, Homo Sapiens
cccauuacuguaucgggaauguuccugcugcuaauaaaguaaggcaauugugucugguaugcuu

SEQ ID NO: 144558 - RNA, 64 nt, Homo Sapiens
uuguaugcuuacaaaagcugaaaagucauuuuuuuaaaguaauaguuuugcugaaucuccuagu

SEQ ID NO: 144559 - RNA, 64 nt, Homo Sapiens
gaaaaccugcaauuguuucuuuguuuuucuaaaauaaaguaauuauggcacaaauuguaaaccu

SEQ ID NO: 144560 - RNA, 64 nt, Homo Sapiens
guuugguauguuuauuguagaaaacucuuuuuuuuaaaguaacaucuuuccaaagcaaugucua

SEQ ID NO: 144561 - RNA, 64 nt, Homo Sapiens
aaugcauguaaauugcucagcagcgugccuagcauaaaguaauuacucaaaccauaauguaaag

SEQ ID NO: 144562 - RNA, 64 nt, Homo Sapiens
ugccuagcauaaaguaauuacucaaaccauaauguaaaguaaaaagauaaccauacuauacaua

SEQ ID NO: 144563 - RNA, 64 nt, Homo Sapiens
gguuaucaugggaaaguauuaugcagaguauuucuaaaguaauucuaauuucaauuauaguguc

SEQ ID NO: 144564 - RNA, 64 nt, Homo Sapiens
aacucaagggcacauagaaaauggcccagggggcuaaaguaaacauuuuacagagaaagaaauu

SEQ ID NO: 144565 - RNA, 64 nt, Homo Sapiens
cuguaaccugauucauccugggauguaaaccauucgaagucagcuaauuggacuuuuauggcuc

SEQ ID NO: 144566 - RNA, 64 nt, Homo Sapiens
accugaaccaaggcgucucuuuaaguggggcgcccgaagucauuuuggacggccaccugauuuu

SEQ ID NO: 144567 - RNA, 64 nt, Homo Sapiens
uugcauuuacuaccucagagcucagaagaaacuccgaagucagcauuugcuuuacucuuucuuu

SEQ ID NO: 144568 - RNA, 64 nt, Homo Sapiens
ccuuccccuacucucuucucaucuucguauaugacgaagucagaaaacucaucaucaggcgacg

SEQ ID NO: 144569 - RNA, 64 nt, Homo Sapiens
acuuauauuucuuuguaaucaagacuugagauaucgaagucaguuauuggucuccagagugcag

SEQ ID NO: 144570 - RNA, 64 nt, Homo Sapiens
gugcuggaauuuuccaaaacagagacgcauggcccgaagucaaaccguacucagaacguccagg

SEQ ID NO: 144571 - RNA, 64 nt, Homo Sapiens
augcaccauccaugagaagaggccauggaaugcacgaagucacacuuugguugccauauggaau

SEQ ID NO: 144572 - RNA, 64 nt, Homo Sapiens
uugacuguaaaaguaccccauggugggcggacaccgaagucaacagugguccuacaaagguaga

SEQ ID NO: 144573 - RNA, 64 nt, Homo Sapiens
ccgugaguuaaugaaaacugauucaaccaaauggcgaagucagagacuaucgggggccauggag

SEQ ID NO: 144574 - RNA, 64 nt, Homo Sapiens
guugagcccugccugggcugaaggacugucuucacgaagucaguccugaggaaaaauauugggg

SEQ ID NO: 144575 - RNA, 64 nt, Homo Sapiens
ucucacugccaucaaacuguaaaagauuaaacugcgaagucaagcucaacagauuauuuuggaa

SEQ ID NO: 144576 - RNA, 64 nt, Homo Sapiens
uguuucuaacauuuaaauaagaaaaaaaucaaaucgaagucagccugcuggaaaagugaucaca

SEQ ID NO: 144577 - RNA, 64 nt, Homo Sapiens
cucaagcuucaauuuauuuauauuaguucuuuuacgaagucaucucguccccuuucuuugcaaa

SEQ ID NO: 144578 - RNA, 64 nt, Homo Sapiens
gccacugaaaauacagaaccauuauaccaaagagcgaagucaguagcuauugucacugcagugc

SEQ ID NO: 144579 - RNA, 64 nt, Homo Sapiens
agaaggcagagccugugucccagggggacccacacgaagucaccagcccauagguccagggagg

SEQ ID NO: 144580 - RNA, 64 nt, Homo Sapiens
caucccaccaggagcagcgccugugcagaaugaacgaagucacauaggcuccuuaauuuuuuuu

SEQ ID NO: 144581 - RNA, 64 nt, Homo Sapiens
gcucuuuccaccaugcugccaggucuuucaucuccgaagucaauaccccaggagucuaaaaucc

SEQ ID NO: 144582 - RNA, 64 nt, Homo Sapiens
auccuacauggcuaaaagaagcagaagcaaguuucgaagucacagucaaggaaaucaauaccua

SEQ ID NO: 144583 - RNA, 64 nt, Homo Sapiens
uucagggcucuuggcguguugggauggaguaaaccgaagucaaucacugccagcaggacagaca

SEQ ID NO: 144584 - RNA, 51 nt, Homo Sapiens
uggcagggacuugcgguuaaucgaagucacugagaccauuugcaagaggcu

SEQ ID NO: 144585 - RNA, 64 nt, Homo Sapiens
cugcagaaaauaaauauuuacucaagaauuacuccgaagucaguacuaaccucuccccuccugg

SEQ ID NO: 144586 - RNA, 64 nt, Homo Sapiens
cugcucuacuacuaacaaacuugagcaguaaacccgaagucagcacagucacuguuuguuuacc

SEQ ID NO: 144587 - RNA, 64 nt, Homo Sapiens
ugaguaucccuguaggucacgaugugaauggcaccgaagucagaaaaccaaaugaccgcacugu

SEQ ID NO: 144588 - RNA, 64 nt, Homo Sapiens
cagccauucccaugagcagcagcaugccagcuaccgaagucaccgggugcuagugaguacugac

SEQ ID NO: 144589 - RNA, 64 nt, Homo Sapiens
agugcagcuguggguggaggcuggggugucugcacgaagucaggccagcguccuccuccacagc

SEQ ID NO: 144590 - RNA, 64 nt, Homo Sapiens
agacacuagacaguaaguaugacauggugguggucgaagucagccuucuuuuccuuauagaaug

SEQ ID NO: 144591 - RNA, 64 nt, Homo Sapiens
cggaguacuugaagaaggccccagucuuguguuccgaagucaguaaaaugacaagcauugcauc

SEQ ID NO: 144592 - RNA, 64 nt, Homo Sapiens
gcagcggaugauggaacugauggauucuguuuuccgaagucacuggcugggaggaccgggaugc

SEQ ID NO: 144593 - RNA, 64 nt, Homo Sapiens
ccaguacuuuauagauucaacucuaaguugcaagcgaagucaaaacugaugaaaauuuauuuag

SEQ ID NO: 144594 - RNA, 64 nt, Homo Sapiens
aggugacauuucucuggucauuuauuugagaguucgaagucaaagucgaggggcaccggcuuug

SEQ ID NO: 144595 - RNA, 64 nt, Homo Sapiens
aaaaaaacacaaaaacuguaauauucccaauuuucgaagucagugggguaaaaguguauuuuga

SEQ ID NO: 144596 - RNA, 64 nt, Homo Sapiens
cccagcccuuugggaggccgaggugggcagaucacgaagucaguaguuugagaccagccuggcc

SEQ ID NO: 144597 - RNA, 64 nt, Homo Sapiens
uauucuuggcucuucuuucuuuauuccacauccacgaagucaaguuaguggccgaagguuagug

SEQ ID NO: 144598 - RNA, 64 nt, Homo Sapiens
agaucgagaccauccuggcuaggcgggcagaucacgaagucaggcccagcacuuugggaggcug

SEQ ID NO: 144599 - RNA, 64 nt, Homo Sapiens
gccacauccucuugcugaugacagagaagacagccgaagucaaacaucucuuggggcuccccug

SEQ ID NO: 144600 - RNA, 64 nt, Homo Sapiens
cuuggccaagcagaugacaacacauucaagaccucgaagucauuccuuggggccuugcauggga

SEQ ID NO: 144601 - RNA, 64 nt, Homo Sapiens
agaucaagaccaucuggcuaaggugggcagaucacgaagucaggccuagcacuuugggaggccg

SEQ ID NO: 144602 - RNA, 64 nt, Homo Sapiens
ucccagccccagagucacuggggggggcccagcacgaagucacacugcaugaacagcuucaccu

SEQ ID NO: 144603 - RNA, 64 nt, Homo Sapiens
uuuccugaccuaagaauuuaguuuuguaauuaaucgaagucacacacauuacacauaaauauau

SEQ ID NO: 144604 - RNA, 64 nt, Homo Sapiens
aaaacaaaaugaaacauuugucuuuauauuggaccgaagucauucuauucacuguauuucauuu

SEQ ID NO: 144605 - RNA, 61 nt, Homo Sapiens
uuuuacagugguggaaaugagcacaaagacacgaagucaugggccuggggcccagggccag

SEQ ID NO: 144606 - RNA, 64 nt, Homo Sapiens
ccuagugcuccauaguuuggcauuugcacgguuucgaagucauuaaacugguuagacgugucuc

SEQ ID NO: 144607 - RNA, 64 nt, Homo Sapiens
aacaagcaaugauggcgauguccgaaaccaaguccgaagucaaccugcagaugccucuaaggag

SEQ ID NO: 144608 - RNA, 64 nt, Homo Sapiens
uggaagugugugugacgcccauugagcuguuacccgaagucagauuaaaaaucagggaguguuu

SEQ ID NO: 144609 - RNA, 64 nt, Homo Sapiens
ucaaggacccggaugugaauggcaugcugaaacucgaagucauggccaccuccagggacaaaga

SEQ ID NO: 144610 - RNA, 64 nt, Homo Sapiens
cgcugcccaucggccugaggaagggcugccuucccgaagucagccugcacagucucugauaaug

SEQ ID NO: 144611 - RNA, 64 nt, Homo Sapiens
cauuuggaccucaguaugagguaguguuaaaaggcgaagucauuucuucaggaaguaaaccucu

SEQ ID NO: 144612 - RNA, 64 nt, Homo Sapiens
aaccaaacagcucagggacccuacgcucugugcacgaagucaaggggucccugacaaagaagag

SEQ ID NO: 144613 - RNA, 64 nt, Homo Sapiens
ccgacgaaggcggccacggacggacgccagcacacgaagucacgugcaagugccuuugauucgu

SEQ ID NO: 144614 - RNA, 64 nt, Homo Sapiens
caacuuauaagacuagugauuaaaaggacuuuaacgaagucaaacuagagaacaccucuauuuu

SEQ ID NO: 144615 - RNA, 64 nt, Homo Sapiens
gcugucgcacagccucuggggugcuuggucucugcgaagucaaaggccugacagcucuguggcc

SEQ ID NO: 144616 - RNA, 64 nt, Homo Sapiens
cuggccaacguggugaaaccugaggucaggaguucgaagucagcgcugagacaggcagaucacu

SEQ ID NO: 144617 - RNA, 64 nt, Homo Sapiens
cucuugcucccaccccacccggggcccuccugcccgaagucauaaccaaggaggggggcuuggg

SEQ ID NO: 144618 - RNA, 64 nt, Homo Sapiens
ucagcacaugcgcacacgcacacucggacucacacgaagucacacgcacacaugcacgcacaca

SEQ ID NO: 144619 - RNA, 64 nt, Homo Sapiens
cugcuacuuaacccugaaaacuggccaccaaaugcgaagucaauugaaaaauuaggguacacag

SEQ ID NO: 144620 - RNA, 64 nt, Homo Sapiens
caucacaaucccauuauucacccaguuugagaauugguguaagagauucggcugcagcuggccg

SEQ ID NO: 144621 - RNA, 54 nt, Homo Sapiens
caucacaaucccauuauucagaauugguguaagacagcuggccgcccaguuuga

SEQ ID NO: 144622 - RNA, 64 nt, Homo Sapiens
uuaaauaguugaugcaauuuuuaacguuaauugauauaaaaaaaaaaacaacaaaauuaggcuu

SEQ ID NO: 144623 - RNA, 64 nt, Homo Sapiens
caaguuagucaaguaugucucaacacuagcaugauauaaaaagggacacugcagcugaaugaaa

SEQ ID NO: 144624 - RNA, 64 nt, Homo Sapiens
ucaaggaaggguuauauugcauucucacgugaaauauaaaaagcaagucuugcccaauaaaaac

SEQ ID NO: 144625 - RNA, 64 nt, Homo Sapiens
aaccaguguuuuuaccuuucacuugaaaaagaaguauaaaaacaacuguauugaguugaggcug

SEQ ID NO: 144626 - RNA, 64 nt, Homo Sapiens
auaaagaauauugacaugaguauaccaguuuauauauaaaaauguuuuuaaacuugacaaucau

SEQ ID NO: 144627 - RNA, 64 nt, Homo Sapiens
uucaaaacuaguguauucacuuacccuaguucauuauaaaaaauaucuaggcauuguggauaua

SEQ ID NO: 144628 - RNA, 64 nt, Homo Sapiens
agcuaaaacauaaucacaaagcuuuaucguguuguauaaaaaaauuaacaauauaauggcaaua

SEQ ID NO: 144629 - RNA, 64 nt, Homo Sapiens
auaauugcuuuauuuggaaaguaacuucuuaccauauaaaaacggaucuuaaaccuaugauuca

SEQ ID NO: 144630 - RNA, 64 nt, Homo Sapiens
gauacauuucccucuuaggcuacacucauaguaguauaaaaagaaaccagagagugauuucauu

SEQ ID NO: 144631 - RNA, 64 nt, Homo Sapiens
auucaaguucaacuguuucuuucaucaaaccuacuauaaaaaacuucuacaucacuggcugcuc

SEQ ID NO: 144632 - RNA, 64 nt, Homo Sapiens
uaaauaauaccauaauacaucaagaauugcuaaauauaaaaacaauaaagcacauuuuaaggaa

SEQ ID NO: 144633 - RNA, 64 nt, Homo Sapiens
uauaaauaucgaguagcucuaaaugaccggugcuuauaaaaaguaaaccaaaucaguucucaaa

SEQ ID NO: 144634 - RNA, 64 nt, Homo Sapiens
augagagacuggcagcuauucaggaaaugauauuuauaaaaaauuuuccuagcucauugcuagu

SEQ ID NO: 144635 - RNA, 64 nt, Homo Sapiens
ggagcaaaagaaaauacucuauuguguuuauauguauaaaaauauuugaauacugagauugauu

SEQ ID NO: 144636 - RNA, 64 nt, Homo Sapiens
cagauaguauauauauauuugaaaaguuuagacuuauaaaaaggcuuacauauaagcuaaugua

SEQ ID NO: 144637 - RNA, 64 nt, Homo Sapiens
uguguguguguucuguguguaacaaaaccaauaguauaaaaaugaauccagauagccuggauuu

SEQ ID NO: 144638 - RNA, 64 nt, Homo Sapiens
cauccccuaucuacuuaaucacaaaaauaaaaacuauaaaaaccauaguagcugcccuauaguu

SEQ ID NO: 144639 - RNA, 64 nt, Homo Sapiens
uagccauccacacccaggcauagccuggauacaguauaaaaauagauaauuaaaaagaugguug

SEQ ID NO: 144640 - RNA, 64 nt, Homo Sapiens
ccagccugggcaacaaagugagacuccaucucuauauaaaaacaaaaaccacgaaagcacacac

SEQ ID NO: 144641 - RNA, 64 nt, Homo Sapiens
aucgaguagaauuuggccucaggucaauaaaugauauaaaaacauguguucuauuuauguauau

SEQ ID NO: 144642 - RNA, 64 nt, Homo Sapiens
ugccugaacauugggcgguuuucuuaauuugaaguauaaaaauuauaaagaguaauuccaaagg

SEQ ID NO: 144643 - RNA, 64 nt, Homo Sapiens
uaauggaauaauuauuaaugaaagauuuuugaaauauaaaaaauaaauuaggcccaauccaaga

SEQ ID NO: 144644 - RNA, 64 nt, Homo Sapiens
caagagaaaacuaugucaguaacauguugcuuuguauaaaaaucuuauuuauaaaugugaagcu

SEQ ID NO: 144645 - RNA, 64 nt, Homo Sapiens
aauaaaaccaagaggugauuacguaucaaacuaauauaaaaagaauuaaguuggacuaacauuc

SEQ ID NO: 144646 - RNA, 64 nt, Homo Sapiens
uuauagugauauuaaucuuuaaugaaauaggaguuauaaaaaaugauaaaucugaaaaauccau

SEQ ID NO: 144647 - RNA, 64 nt, Homo Sapiens
uguugacugacuuauuuaaaaguguuaaauacuuuauaaaaaauugccuauguuucuacaauga

SEQ ID NO: 144648 - RNA, 64 nt, Homo Sapiens
aaaggauagcauuuuuauacuuauuuaaguuguauauaaaaauaugaguugaaacgagugcgau

SEQ ID NO: 144649 - RNA, 64 nt, Homo Sapiens
ggauuaaaucuaaaggaaaguuuaccacaauuuuuauaaaaagaacauuuuauguuauguguau

SEQ ID NO: 144650 - RNA, 64 nt, Homo Sapiens
auaaaugcucaugauagaaauuuaaaaauucaauuauaaaaauacaggguugcagauguuuagu

SEQ ID NO: 144651 - RNA, 64 nt, Homo Sapiens
uauagaguuggcuugcauuuuaggggccauuuuguauaaaaagugcauaugauuaaaauuagac

SEQ ID NO: 144652 - RNA, 64 nt, Homo Sapiens
ugaauaagggaaagauuaauuuuggcuggaccaauauaaaaaauuguauuugaagaauugauac

SEQ ID NO: 144653 - RNA, 64 nt, Homo Sapiens
cuuauuuuugcuccuuacagcaagauuaguagguuauaaaaauuuaaauuuaaacaaaauuauu

SEQ ID NO: 144654 - RNA, 64 nt, Homo Sapiens
uuuuuguuugccuuucaggcaucauauuagcuuuuauaaaaaauggucuugcugcugaaauugu

SEQ ID NO: 144655 - RNA, 64 nt, Homo Sapiens
uauauuuuuuaaacaaugugagaguacuggacgauauaaaaauaugacucucucaucugucuaa

SEQ ID NO: 144656 - RNA, 64 nt, Homo Sapiens
aaaaaaucugcugugcacaacugaaucuacuuuuuauaaaaaaaauuuauaauuggaugugcuc

SEQ ID NO: 144657 - RNA, 64 nt, Homo Sapiens
aaaauaauuuuagaaaguuuauguguuagaaaauuauaaaaaauaaaauucauuuucuaacacc

SEQ ID NO: 144658 - RNA, 64 nt, Homo Sapiens
uucuccaacaaaaauacuugcccucuaucccgcuuauaaaaaaacugagugucuauguuaacuu

SEQ ID NO: 144659 - RNA, 64 nt, Homo Sapiens
uguuugauauuucuuaauguuuugaaaaacuuuuuauaaaaaauacuucacuuugggccaaaca

SEQ ID NO: 144660 - RNA, 64 nt, Homo Sapiens
cuugaaaaauauagacaauccaaaagcuuuuauuuauaaaaagguuuuuuucuaacacaauaac

SEQ ID NO: 144661 - RNA, 64 nt, Homo Sapiens
aauuuccauguaaguuaccacuucuugauaaaaauauaaaaaauauuuaaaugccuggaacuga

SEQ ID NO: 144662 - RNA, 64 nt, Homo Sapiens
agaaaccuugcacugauuuuuagaacuuaaaguauauaaaaaaacacguugugcacauguaccc

SEQ ID NO: 144663 - RNA, 64 nt, Homo Sapiens
uucacuauaagaacagaaaauuuagaauuuuuuuuauaaaaaccuuuaaaucuuucagugaugu

SEQ ID NO: 144664 - RNA, 64 nt, Homo Sapiens
uauguacuuuuaccugaaaauuaaaaccaauauuuauaaaaaguguauaugcaguaugauacca

SEQ ID NO: 144665 - RNA, 64 nt, Homo Sapiens
aauaaauuuuaaugagcacuacaaauuuagaauauauaaaaauaucaguaaccuaugaauucau

SEQ ID NO: 144666 - RNA, 64 nt, Homo Sapiens
uuucucauaggggcaugccagugagcaauuacuuuauaaaaauauuuuccuugguguuaaguau

SEQ ID NO: 144667 - RNA, 64 nt, Homo Sapiens
cugcuccuuauugccauacccacgaacuguuaaauauaaaaaaauucaaaguauuugacaucuu

SEQ ID NO: 144668 - RNA, 64 nt, Homo Sapiens
ugccaaacauguuggcaucaauuuuauacagggauauaaaaaaguauauguggauaaauuuuuu

SEQ ID NO: 144669 - RNA, 64 nt, Homo Sapiens
uauauguggauaaauuuuuuguaaucuuuagggauauaaaaaaguguauguggauaaauuuuuu

SEQ ID NO: 144670 - RNA, 64 nt, Homo Sapiens
acagagcaagaccaccaucuccaaaaauuauauauauaaaaauaauuaauauuauagaagagaa

SEQ ID NO: 144671 - RNA, 64 nt, Homo Sapiens
gagaauauacacaacucagagaugcaauggauaauauaaaaagaguaccugagauguauuuuuu

SEQ ID NO: 144672 - RNA, 64 nt, Homo Sapiens
aucauucagaaaacuuuauagugugaauucagacuauaaaaaaccuauaaauuaauguaauacu

SEQ ID NO: 144673 - RNA, 64 nt, Homo Sapiens
uaugcaaaugacuuuauuuuuauuuuguuguuuuuauaaaaaguaauuuauuuuuacagaaaaa

SEQ ID NO: 144674 - RNA, 64 nt, Homo Sapiens
cuaauuuauuuuuacagaaagaagaacauuucaguauaaaaaacauuuucuaaacacuuuacua

SEQ ID NO: 144675 - RNA, 64 nt, Homo Sapiens
ccuuaaaucuauguucauuuacuccuuaaauuuauauaaaaauauguaacaaaacuauacuugu

SEQ ID NO: 144676 - RNA, 64 nt, Homo Sapiens
auauaugcucaaccagaaaaguaauaucuauuauuauaaaaauauuuucuggcacugguuguaa

SEQ ID NO: 144677 - RNA, 64 nt, Homo Sapiens
uggaagauuaaaaacucaaacaucaguccaaggauauaaaaaaaucauauuccggggaucauca

SEQ ID NO: 144678 - RNA, 64 nt, Homo Sapiens
ugcuaaagauaggauaaaaguaaggaauaguucauauaaaaauaaaauuucuauuucuuuugcu

SEQ ID NO: 144679 - RNA, 64 nt, Homo Sapiens
agucuugcuuauuuuguugcgaaggccaguggaauauaaaaaucaauggcauuaaugaggagca

SEQ ID NO: 144680 - RNA, 64 nt, Homo Sapiens
gauugaaaagacuaaugagaagauaacaugacaauauaaaaagacagaaacucaaaaaguauau

SEQ ID NO: 144681 - RNA, 64 nt, Homo Sapiens
caguaacaccagugaaaccccacacugucgggcuuauaaaaaucugugccaucauggugauuuu

SEQ ID NO: 144682 - RNA, 64 nt, Homo Sapiens
caaaaagaaaucuuuacuuuccuuguuuuaucauuauaaaaauaaaguauuuugcuaguaugga

SEQ ID NO: 144683 - RNA, 64 nt, Homo Sapiens
ucucagauguuaaaauaaaugguuuggugcuuuuuauaaaaagauaaucucagugcuuuccucc

SEQ ID NO: 144684 - RNA, 64 nt, Homo Sapiens
aguaaaaugucuuuccaaauuauuucuuaauuauuauaaaaauauuaagacaauagcacuuaaa

SEQ ID NO: 144685 - RNA, 64 nt, Homo Sapiens
uuauuucuuuuacuuuuuuuaguaaguuaauguauauaaaaauggcuucggacaaaauaucucu

SEQ ID NO: 144686 - RNA, 64 nt, Homo Sapiens
aagguacuuuuuaaagcuuguacaugaaccuuuguauaaaaaacaccagugcucuuucguugua

SEQ ID NO: 144687 - RNA, 64 nt, Homo Sapiens
ccugucagcagcaguucugugaaugcaucuuagguauaaaaaugcaauacagauuuuuauauuu

SEQ ID NO: 144688 - RNA, 64 nt, Homo Sapiens
agacaaaugaaauaauaaagagauuuucaugguuuauaaaaaucuuuuuugauaugauaauaau

SEQ ID NO: 144689 - RNA, 64 nt, Homo Sapiens
auuuuuaaagacaaagcauucuaaaugaacucaauauaaaaacauucauuuggaauguacauac

SEQ ID NO: 144690 - RNA, 64 nt, Homo Sapiens
aauaauuuagucaucaugaaauauuuaguugucauauaaaaacccacuguuugagaaugaugcu

SEQ ID NO: 144691 - RNA, 64 nt, Homo Sapiens
uugucgacguaaacauuuaaaguguuauauuuuuuauaaaaauguuuauuuuuaaugauaugag

SEQ ID NO: 144692 - RNA, 64 nt, Homo Sapiens
accagccugggcaaaacccugucucuacuaaaaauauaaaaauuagccaggcaugauggcacau

SEQ ID NO: 144693 - RNA, 64 nt, Homo Sapiens
ggccaacauggcaaaaccccgucucuaugaaaaauauaaaaauuagcugggcaugguggcaggc

SEQ ID NO: 144694 - RNA, 64 nt, Homo Sapiens
uuaaaauuauuuagccuccauuauuacaaaaaauuauaaaaauaaguuuucagucagucaggau

SEQ ID NO: 144695 - RNA, 64 nt, Homo Sapiens
cuaauaauuaucaggacuuuuuucaggaguggguuauaaaaacauucaaguuggucugacagua

SEQ ID NO: 144696 - RNA, 64 nt, Homo Sapiens
uugugaauaacucaaggguuuagaauguaaauuguauaaaaagucucauuaaaaaauuuagcaa

SEQ ID NO: 144697 - RNA, 64 nt, Homo Sapiens
ucugcuuuuguauaauacaacuacuuuaaaacaguauaaaaauugaccauuuuuauuuuagugc

SEQ ID NO: 144698 - RNA, 64 nt, Homo Sapiens
uaaugaauucaucagcuagacacauuauuugccuuauaaaaaucgaaauucuguucuaacuuuc

SEQ ID NO: 144699 - RNA, 64 nt, Homo Sapiens
uuuuuuacaauuguaauuaucaguccauccuuguuauaaaaaauugauuuggaaauaugaaaau

SEQ ID NO: 144700 - RNA, 64 nt, Homo Sapiens
acuuuuauugcgguuugacuaaaucacuuuuaccuauaaaaacccauucagaucuuaagagaug

SEQ ID NO: 144701 - RNA, 52 nt, Homo Sapiens
guguauugcuguguaauauuaguauaaaaaguagaauuuugguuuuguguag

SEQ ID NO: 144702 - RNA, 57 nt, Homo Sapiens
agaugaaugccagacugugaaggaaaauauaaaaaaaaagucgacugcuaugcucaa

SEQ ID NO: 144703 - RNA, 64 nt, Homo Sapiens
aaagaaaaucuuauauaguacauuuuacaaaaauuauaaaaaaugaauuaguacuggcgaggac

SEQ ID NO: 144704 - RNA, 64 nt, Homo Sapiens
caaauuuuuggaacaaagauccccccaacacaccuauaaaaacccaacaauauggagaauaacc

SEQ ID NO: 144705 - RNA, 64 nt, Homo Sapiens
ugaaaauauaugauggcucgaaaaguagauugaguauaaaaacuaguucccaaaagauugcuga

SEQ ID NO: 144706 - RNA, 64 nt, Homo Sapiens
uaaugcuguuaaacaggaguagauuugguuuuuguauaaaaaaaaauacuugcaguauaaauga

SEQ ID NO: 144707 - RNA, 64 nt, Homo Sapiens
gguagcuacagaugauauaguuagcaugugcuuuuauaaaaaguauuacaguggacgugaucuu

SEQ ID NO: 144708 - RNA, 64 nt, Homo Sapiens
gugugaugaaugaaucacauuacuuuguaccauuuauaaaaauucuguauuuuaaaauguaaua

SEQ ID NO: 144709 - RNA, 64 nt, Homo Sapiens
uuaaugaauuaggauaacaaauaaaauccaaucauauaaaaacuucuagguaauugauuuaagu

SEQ ID NO: 144710 - RNA, 64 nt, Homo Sapiens
guuauuaugggauuggaagaucugcuauacagucuauaaaaauucaaaaagccguugacaaggc

SEQ ID NO: 144711 - RNA, 64 nt, Homo Sapiens
aagggaagaaaggaggcagcagaaacggacagcuuauaaaaauaugcaaaagaaaaaacauuuu

SEQ ID NO: 144712 - RNA, 64 nt, Homo Sapiens
auaaagauggcacuuucccguuuuauuccaguuuuauaaaaaguggagacagacugauguguau

SEQ ID NO: 144713 - RNA, 64 nt, Homo Sapiens
uucugcaacaucuuaagauccacaaaugaagggauauaaaaauaaugucauagguaagaaacac

SEQ ID NO: 144714 - RNA, 64 nt, Homo Sapiens
uggaggcuaucaacaaagaaugggcuugaaacauuauaaaaauugacaaugauuuauuaaauau

SEQ ID NO: 144715 - RNA, 64 nt, Homo Sapiens
agaaaaaaaaaagaaaagaaguuuguacuguuuguauaaaaaauuuguuguuaugugcaauacu

SEQ ID NO: 144716 - RNA, 64 nt, Homo Sapiens
cucauuuuuuaaaaaaaguugaaucuauauaagcuauaaaaauaucccacaaugcacaaauuaa

SEQ ID NO: 144717 - RNA, 64 nt, Homo Sapiens
auuagucuuaacauaaugugauuuuuagaauaguuauaaaaaguuauauguucaaagauguuuu

SEQ ID NO: 144718 - RNA, 64 nt, Homo Sapiens
ccuuuguucauauuucuuccauuacaagggcuuuuauaaaaaacauucauaagaaguguugaac

SEQ ID NO: 144719 - RNA, 64 nt, Homo Sapiens
guaauauuauuguuaugcuugagguauuggugcauauaaaaacaagagcuuuauauauuaaaga

SEQ ID NO: 144720 - RNA, 64 nt, Homo Sapiens
ugggcauuuuguaacauuccgcauauugacccuauauaaaaaagugaaaaauauaaguaauuug

SEQ ID NO: 144721 - RNA, 64 nt, Homo Sapiens
aaaaaaagcuccuguaauuuuucuuuuuagacuuuauaaaaaaacuguuacuuuugugcuuuua

SEQ ID NO: 144722 - RNA, 64 nt, Homo Sapiens
acucaaugugacuguugauuguuaauucacauaauauaaaaauuggugucugcgcacauuuuaa

SEQ ID NO: 144723 - RNA, 64 nt, Homo Sapiens
uguaagcguuagcggcauuaugcauagauauauguauaaaaauucauauguauguauuuauaaa

SEQ ID NO: 144724 - RNA, 64 nt, Homo Sapiens
uuggaagucuuuucaccaaaucaagucagggugauauaaaaacauccugcugggccuuuuuuca

SEQ ID NO: 144725 - RNA, 64 nt, Homo Sapiens
ucucauaggaauuaaauguaaagauuuuaacaaguauaaaaaauaaauuuuuauaauaauugaa

SEQ ID NO: 144726 - RNA, 64 nt, Homo Sapiens
aaaaaauggaaaaaaauuacuauuauauuuuuucuauaaaaagacauggucacucuccccaaaa

SEQ ID NO: 144727 - RNA, 64 nt, Homo Sapiens
uauaaccaguauuuuacuucgugaauaaguagaauauaaaaaaauuuagacuccaguguguuca

SEQ ID NO: 144728 - RNA, 64 nt, Homo Sapiens
cuggugugcaauuaauuggauacguguauaucaguauaaaaacaugcagguaaauauauauacu

SEQ ID NO: 144729 - RNA, 64 nt, Homo Sapiens
gguuucaauguaucuacaggauuuuaacuuuuaauauaaaaaggucaaucuggauuugucuuuc

SEQ ID NO: 144730 - RNA, 64 nt, Homo Sapiens
gcaauagaaauuaagcauaagggagcggggggucuauaaaaacacaccagaaacaucuuuucag

SEQ ID NO: 144731 - RNA, 64 nt, Homo Sapiens
gagagaugugacugucuacaguucuauuuguauauauaaaaagaagacugaaagucuuuugaca

SEQ ID NO: 144732 - RNA, 64 nt, Homo Sapiens
aauauauaguaauguaacauauucaguauuaauguauaaaaagcacucuaauuauauaauucag

SEQ ID NO: 144733 - RNA, 64 nt, Homo Sapiens
uuuuuuuuacaagacuaguucuaaauuaacagcuuauaaaaaauuugucuaaauuuaauaauua

SEQ ID NO: 144734 - RNA, 64 nt, Homo Sapiens
ugucagcaaaaaaaaacuuaauuucuaguaaaucuauaaaaauggguaagucccuaaauuacaa

SEQ ID NO: 144735 - RNA, 64 nt, Homo Sapiens
ggccgacauggugaaacgcugucucuacuaaaaauauaaaaaauuagccgggugcaguggcgug

SEQ ID NO: 144736 - RNA, 64 nt, Homo Sapiens
gcuaacaugccaacaaaaagccauguaaguauuguauaaaaagauucacauuguuaauuuagcc

SEQ ID NO: 144737 - RNA, 64 nt, Homo Sapiens
gucuuuuaucauugcaggauuguacauacuacuuuauaaaaauucucaccuuugauuuuaaauc

SEQ ID NO: 144738 - RNA, 64 nt, Homo Sapiens
gaaugauuggggggaaaaacuggugaaaaagaaauauaaaaaggacccuaaaaagaauucugca

SEQ ID NO: 144739 - RNA, 64 nt, Homo Sapiens
gauaacuuuaaggaugugcaguguucuuuacuuauauaaaaaaaauucaagugaauuuauuugu

SEQ ID NO: 144740 - RNA, 64 nt, Homo Sapiens
caaagaaauguguuacaaaguuucuugucuuaguuauaaaaauuccuagaucugauaaaaaaau

SEQ ID NO: 144741 - RNA, 64 nt, Homo Sapiens
acccacaaagaaacaaagcaaauguucuaaauucuauaaaaacccauggcaacaucagcuuucu

SEQ ID NO: 144742 - RNA, 64 nt, Homo Sapiens
auauauuugucauaugcuccauagagaauacacauauaaaaacaggagcucaacuaaaaguggc

SEQ ID NO: 144743 - RNA, 64 nt, Homo Sapiens
uaugaaucacucacacucacuauguauguauauauauaaaaaacauauuugggauccucuuuuc

SEQ ID NO: 144744 - RNA, 64 nt, Homo Sapiens
acaaaaaaaaaaaaaucuagcgaaacuccauuucuauaaaaaaugaccagccugggcaacaugg

SEQ ID NO: 144745 - RNA, 64 nt, Homo Sapiens
uauauauaaacacacauauagauaauccuaauuauauaaaaauauuuuaauaguuugaaaugau

SEQ ID NO: 144746 - RNA, 64 nt, Homo Sapiens
guuuuuuuaaguuauuuuaauuuuugcugcuuuauauaaaaaugucugcagagaggaagauaug

SEQ ID NO: 144747 - RNA, 64 nt, Homo Sapiens
auuugcagaaggaaaccauuucugguuauuuggcuauaaaaagucagcauaaaauaugauccaa

SEQ ID NO: 144748 - RNA, 64 nt, Homo Sapiens
uaauguucugaugggaacguaacacuuauuuuuauauaaaaagagacugaguaaacaaacauua

SEQ ID NO: 144749 - RNA, 64 nt, Homo Sapiens
gggaaguaauuuuauaaaguuacacaaagguaguuauaaaaaaagcccaguuugucuuucagaa

SEQ ID NO: 144750 - RNA, 64 nt, Homo Sapiens
caauaugguuuacauuuugcucacuuuugacuuauauaaaaauagaauaauacuauaugucgug

SEQ ID NO: 144751 - RNA, 57 nt, Homo Sapiens
ccuuauuaaaaguuuauuaaacaauaauauaaaaauuuuaaaccuacuugauauucc

SEQ ID NO: 144752 - RNA, 64 nt, Homo Sapiens
ggagaaauaaucauauucguaauuucaaaaguuguauaaaaauauuuucuauuguaguucaaau

SEQ ID NO: 144753 - RNA, 64 nt, Homo Sapiens
uugagaugguagaaacauguucauauacuguauauauaaaaaucuguacauuuauaaaaacaga

SEQ ID NO: 144754 - RNA, 64 nt, Homo Sapiens
gaucauauacuguauauauaucaagcuguacauuuauaaaaacaacuacaagaaggaucuuuuu

SEQ ID NO: 144755 - RNA, 64 nt, Homo Sapiens
ccaugagaauuauuacuuuaaaaacaaaacaaaauauaaaaaacuguguuugaguaaacugaua

SEQ ID NO: 144756 - RNA, 64 nt, Homo Sapiens
ugguugaaauuucagacaaagcaaacccagcagguauaaaaaguaguauaaauacaaaucugua

SEQ ID NO: 144757 - RNA, 64 nt, Homo Sapiens
uacaaguuucugaauauuuuaaaucuuaacaucauauaaaaagcagcagaggugagaacucaga

SEQ ID NO: 144758 - RNA, 64 nt, Homo Sapiens
uccccgaauucuauuuuuguccuugcagacagaauauaaaaacuccugggcuuaaggccuaagg

SEQ ID NO: 144759 - RNA, 64 nt, Homo Sapiens
aaugcaaaccaaagcaacuuaguaaaauaauagguauaaaaaguuauucuguaagucuguuggu

SEQ ID NO: 144760 - RNA, 64 nt, Homo Sapiens
gaguagauauuugauauaccacucugauaacucauauaaaaauaucaucauaaaaagcuuaauu

SEQ ID NO: 144761 - RNA, 64 nt, Homo Sapiens
ggaauaccucuuuauacgucuacauauuuuaguauauaaaaauagauaaugcucuuggacacau

SEQ ID NO: 144762 - RNA, 64 nt, Homo Sapiens
uaaauaaaaucuauucuguguuuauguagggugguauaaaaaagaggucuucauuuagacaugu

SEQ ID NO: 144763 - RNA, 64 nt, Homo Sapiens
uuuucauugcugguacaaugacucaguauuucuuuauaaaaaucuguuguucugaaaaucaaca

SEQ ID NO: 144764 - RNA, 64 nt, Homo Sapiens
guguaacacuauggcauugcuucuauagccaaaguauaaaaauuucuggaauacugacauguaa

SEQ ID NO: 144765 - RNA, 64 nt, Homo Sapiens
aaaauuuuaaaacuaugaugacuaaagaccagaauauaaaaagcauauacaaaaauaaaaucca

SEQ ID NO: 144766 - RNA, 64 nt, Homo Sapiens
acuuuuauacaagaaauaauuaucaacgaagaacuauaaaaauauauuaaguaaggaaaacaag

SEQ ID NO: 144767 - RNA, 64 nt, Homo Sapiens
cuuuauugcuaaaaauacuauuaaaaagaaauuauauaaaaauaauuugaagcuccauuauuuu

SEQ ID NO: 144768 - RNA, 64 nt, Homo Sapiens
caaaauaaaugaaaaggacugacucugccucuauuauaaaaaaagccuggacaacauauagcaa

SEQ ID NO: 144769 - RNA, 64 nt, Homo Sapiens
ccuguaucuugaaagccuuauaaaauacaaaugcuauaaaaauuauguauuugcccuaaauccu

SEQ ID NO: 144770 - RNA, 64 nt, Homo Sapiens
aaaaaccuuaccgguaguaauauauucauuucuuuauaaaaaacaacuaaugguugaaaauaca

SEQ ID NO: 144771 - RNA, 64 nt, Homo Sapiens
ccaauuauuuuccuacagcccacauuucugaauguauaaaaauauucagauuucucuuuuuaac

SEQ ID NO: 144772 - RNA, 64 nt, Homo Sapiens
aaaaugcuaaauuauaucugugccuaaauuaguauauaaaaacaauucaguggcggggggguuu

SEQ ID NO: 144773 - RNA, 64 nt, Homo Sapiens
cauaguaauccugccaaaugagccaauuuuucuuuauaaaaauuuuuguugugaaacacugcaa

SEQ ID NO: 144774 - RNA, 64 nt, Homo Sapiens
guguuugaccaaaguaggucuccauauauauuucuauaaaaaaaccccugguucuauuaaaaua

SEQ ID NO: 144775 - RNA, 64 nt, Homo Sapiens
aaaauuauaggauuuuuuuuuuaguaaaaaccuguauaaaaaccuuauaggauuuuuuucuuuu

SEQ ID NO: 144776 - RNA, 64 nt, Homo Sapiens
aaaauuauaggauuuuuucuuuaguaaaaaccuauauaaaaaccuuauaggauuuuuuucuuuu

SEQ ID NO: 144777 - RNA, 64 nt, Homo Sapiens
aaaauuauaggauuuuuucuugaguaaaaaccuauauaaaaaccggggguaauagagccacugg

SEQ ID NO: 144778 - RNA, 64 nt, Homo Sapiens
gugugauuuuuuucacauuuaagcaggaaugcaauauaaaaaugugaaucucuuaauucucagc

SEQ ID NO: 144779 - RNA, 64 nt, Homo Sapiens
uguuuucuauaugaacuuagucauuaauguucuuuauaaaaagugaaauaagauggaaaaauaa

SEQ ID NO: 144780 - RNA, 64 nt, Homo Sapiens
uguucucucaagauccuuaaaaccucuuggaaauuauaaaaauauuggcaagaaaagaagaaua

SEQ ID NO: 144781 - RNA, 64 nt, Homo Sapiens
uuggagacuuaacagcauuugucuguguuugaacuauaaaaagcaccggaucuuuuccaucuaa

SEQ ID NO: 144782 - RNA, 64 nt, Homo Sapiens
auuuuaagaaaagauaaacaccauuuuauuuauuuauaaaaacaaaauuaguuucaaauauuuu

SEQ ID NO: 144783 - RNA, 64 nt, Homo Sapiens
cuuuuuuauucaugauaaaaccuuauaggaauaguauaaaaaaucccuguggaaagcuacuagu

SEQ ID NO: 144784 - RNA, 64 nt, Homo Sapiens
aaucauaguaauaauauugaucauguuugcugacuauaaaaauagaaggaaaagcuuuuaaguc

SEQ ID NO: 144785 - RNA, 64 nt, Homo Sapiens
aagauguuaaaacagugaaaagaccccaucucuauauaaaaaaaccgaccugggcagcauagcg

SEQ ID NO: 144786 - RNA, 64 nt, Homo Sapiens
ccuaaaaacaaaacaaacacaaaaaaaaguuguuuauaaaaaccuaaacuaaagugugcuuuau

SEQ ID NO: 144787 - RNA, 64 nt, Homo Sapiens
aguuguuuauaaaaaccccuacuaaagugugcuuuauaaaaaaaguuauaaagaaagauuguaa

SEQ ID NO: 144788 - RNA, 64 nt, Homo Sapiens
agcugggugugguggcaggagucucuacuaaaaauauaaaaauuggccaacauggugaaacccc

SEQ ID NO: 144789 - RNA, 64 nt, Homo Sapiens
guaaaacuacuacuuuguuuacaauuaaguauauuauaaaaauuuauggaacauuuaauuuagu

SEQ ID NO: 144790 - RNA, 64 nt, Homo Sapiens
gaccugaucaacaucauaggaaacagguaaaauguauaaaaauaauuagggaaagguaauauaa

SEQ ID NO: 144791 - RNA, 64 nt, Homo Sapiens
gguaaaauguauaaaaauaguuagggaaagguaauauaaaaacaaguuuuaguguuuuucagua

SEQ ID NO: 144792 - RNA, 64 nt, Homo Sapiens
agugaaacccugucuguauggaauuuacacaaauuauaaaaauuagucgggugucauugugcau

SEQ ID NO: 144793 - RNA, 64 nt, Homo Sapiens
cuggccugggcagcauagcgagaccccaucucuauauaaaaaaaaagauguuaaaacagugaaa

SEQ ID NO: 144794 - RNA, 64 nt, Homo Sapiens
agaaggaaaagcaugaagucucauguuugcugacuauaaaaauaaaucauaguaauaauauuau

SEQ ID NO: 144795 - RNA, 64 nt, Homo Sapiens
caacuuuaacaggagucaucaauucauccauaaauauaaaaagggaaaaaaacuuaaggcagua

SEQ ID NO: 144796 - RNA, 64 nt, Homo Sapiens
ugggggagauuuaaucaguuuuuuuaaugccugcuauaaaaauuugaaauauuagaauggccga

SEQ ID NO: 144797 - RNA, 64 nt, Homo Sapiens
uauauaaccuucucaaugaguuaccauucuuuuuuauaaaaaaaauuguuccuugaaaugcuaa

SEQ ID NO: 144798 - RNA, 64 nt, Homo Sapiens
aagguuaaucggaguaucugaaaggaauuguuuuuauaaaaacauugaaguauuaguuacuugc

SEQ ID NO: 144799 - RNA, 64 nt, Homo Sapiens; identical to SEQ ID NO: 144797

SEQ ID NO: 144800 - RNA, 64 nt, Homo Sapiens; identical to SEQ ID NO: 144798

SEQ ID NO: 144801 - RNA, 64 nt, Homo Sapiens
gucuccagggagagaggguggucgucugugcauuccagguuacugcacuugucugaugugacgu

SEQ ID NO: 144802 - RNA, 64 nt, Homo Sapiens
cccaggucuucuuaaaacaaagucaucagcuuugccagguuacauacuuuauuuaaaaguauag

SEQ ID NO: 144803 - RNA, 64 nt, Homo Sapiens; identical to SEQ ID NO: 114759

SEQ ID NO: 144804 - RNA, 64 nt, Homo Sapiens; identical to SEQ ID NO: 114760

SEQ ID NO: 144805 - RNA, 64 nt, Homo Sapiens; identical to SEQ ID NO: 114761

SEQ ID NO: 144806 - RNA, 64 nt, Homo Sapiens; identical to SEQ ID NO: 114762

SEQ ID NO: 144807 - RNA, 64 nt, Homo Sapiens; identical to SEQ ID NO: 114763

SEQ ID NO: 144808 - RNA, 64 nt, Homo Sapiens; identical to SEQ ID NO: 114764

SEQ ID NO: 144809 - RNA, 64 nt, Homo Sapiens; identical to SEQ ID NO: 114765

SEQ ID NO: 144810 - RNA, 64 nt, Homo Sapiens; identical to SEQ ID NO: 114766

SEQ ID NO: 144811 - RNA, 64 nt, Homo Sapiens; identical to SEQ ID NO: 114767

SEQ ID NO: 144812 - RNA, 64 nt, Homo Sapiens; identical to SEQ ID NO: 114768

SEQ ID NO: 144813 - RNA, 64 nt, Homo Sapiens; identical to SEQ ID NO: 114769

SEQ ID NO: 144814 - RNA, 64 nt, Homo Sapiens; identical to SEQ ID NO: 114770

SEQ ID NO: 144815 - RNA, 64 nt, Homo Sapiens; identical to SEQ ID NO: 114771

SEQ ID NO: 144816 - RNA, 64 nt, Homo Sapiens; identical to SEQ ID NO: 114772

SEQ ID NO: 144817 - RNA, 64 nt, Homo Sapiens; identical to SEQ ID NO: 114773

SEQ ID NO: 144818 - RNA, 64 nt, Homo Sapiens; identical to SEQ ID NO: 114774

SEQ ID NO: 144819 - RNA, 64 nt, Homo Sapiens; identical to SEQ ID NO: 114775

SEQ ID NO: 144820 - RNA, 64 nt, Homo Sapiens; identical to SEQ ID NO: 114776

SEQ ID NO: 144821 - RNA, 64 nt, Homo Sapiens; identical to SEQ ID NO: 114777

SEQ ID NO: 144822 - RNA, 64 nt, Homo Sapiens; identical to SEQ ID NO: 114778

SEQ ID NO: 144823 - RNA, 64 nt, Homo Sapiens; identical to SEQ ID NO: 114779

SEQ ID NO: 144824 - RNA, 64 nt, Homo Sapiens; identical to SEQ ID NO: 114780

SEQ ID NO: 144825 - RNA, 64 nt, Homo Sapiens; identical to SEQ ID NO: 114781

SEQ ID NO: 144826 - RNA, 64 nt, Homo Sapiens; identical to SEQ ID NO: 114782

SEQ ID NO: 144827 - RNA, 64 nt, Homo Sapiens; identical to SEQ ID NO: 114783

SEQ ID NO: 144828 - RNA, 64 nt, Homo Sapiens; identical to SEQ ID NO: 114784

SEQ ID NO: 144829 - RNA, 64 nt, Homo Sapiens; identical to SEQ ID NO: 114785

SEQ ID NO: 144830 - RNA, 64 nt, Homo Sapiens; identical to SEQ ID NO: 114786

SEQ ID NO: 144831 - RNA, 64 nt, Homo Sapiens; identical to SEQ ID NO: 114787

SEQ ID NO: 144832 - RNA, 64 nt, Homo Sapiens; identical to SEQ ID NO: 114788

SEQ ID NO: 144833 - RNA, 64 nt, Homo Sapiens; identical to SEQ ID NO: 114789

SEQ ID NO: 144834 - RNA, 64 nt, Homo Sapiens; identical to SEQ ID NO: 114790

SEQ ID NO: 144835 - RNA, 64 nt, Homo Sapiens; identical to SEQ ID NO: 114791

SEQ ID NO: 144836 - RNA, 64 nt, Homo Sapiens; identical to SEQ ID NO: 114792

SEQ ID NO: 144837 - RNA, 64 nt, Homo Sapiens; identical to SEQ ID NO: 114793

SEQ ID NO: 144838 - RNA, 64 nt, Homo Sapiens; identical to SEQ ID NO: 114794

SEQ ID NO: 144839 - RNA, 64 nt, Homo Sapiens; identical to SEQ ID NO: 114795

SEQ ID NO: 144840 - RNA, 64 nt, Homo Sapiens; identical to SEQ ID NO: 114796

SEQ ID NO: 144841 - RNA, 64 nt, Homo Sapiens; identical to SEQ ID NO: 114797

SEQ ID NO: 144842 - RNA, 64 nt, Homo Sapiens; identical to SEQ ID NO: 114798

SEQ ID NO: 144843 - RNA, 64 nt, Homo Sapiens; identical to SEQ ID NO: 114799

SEQ ID NO: 144844 - RNA, 64 nt, Homo Sapiens; identical to SEQ ID NO: 114800

SEQ ID NO: 144845 - RNA, 64 nt, Homo Sapiens; identical to SEQ ID NO: 114801

SEQ ID NO: 144846 - RNA, 64 nt, Homo Sapiens; identical to SEQ ID NO: 114802

SEQ ID NO: 144847 - RNA, 64 nt, Homo Sapiens; identical to SEQ ID NO: 114803

SEQ ID NO: 144848 - RNA, 64 nt, Homo Sapiens; identical to SEQ ID NO: 114804

SEQ ID NO: 144849 - RNA, 64 nt, Homo Sapiens; identical to SEQ ID NO: 114805

SEQ ID NO: 144850 - RNA, 64 nt, Homo Sapiens; identical to SEQ ID NO: 114806

SEQ ID NO: 144851 - RNA, 64 nt, Homo Sapiens; identical to SEQ ID NO: 114807

SEQ ID NO: 144852 - RNA, 64 nt, Homo Sapiens
ucucagccuuaugagcuugcguuuuuuaaagcaacuguacaauuuucccauuauuuagagcaca

SEQ ID NO: 144853 - RNA, 64 nt, Homo Sapiens
uccagcauugagaauuugccauguuucaccucagcuguacaaacuuccuacuuuaaagugugaa

SEQ ID NO: 144854 - RNA, 64 nt, Homo Sapiens
uggccugaaugacuguuggaugaaauauuugucccuguacaaagcugggacuauuccaguagag

SEQ ID NO: 144855 - RNA, 64 nt, Homo Sapiens
uuccagguaaaugaaauuucgguagugaggcucacuguacaauuguuaaauuguagcauugcca

SEQ ID NO: 144856 - RNA, 64 nt, Homo Sapiens
uugauucccaucuggcauauuucuguacaacuuucuguacaauaaaaguuuucuauguaaaaaa

SEQ ID NO: 144857 - RNA, 64 nt, Homo Sapiens
uucuguacaauauugauucccuauguaaaaaauucuguacaacuugguacagauguaaaguuuu

SEQ ID NO: 144858 - RNA, 64 nt, Homo Sapiens
aauuuuguuaugcacuacuaggguuuuuuuucaucuguacaagauuguuuuuuucuauguuugu

SEQ ID NO: 144859 - RNA, 64 nt, Homo Sapiens
uaagauggccugggcagaguugcuaaagaaaugucuguacaaaaagaaaguuguguaaugguga

SEQ ID NO: 144860 - RNA, 64 nt, Homo Sapiens
aaaauaccccugacccaucaucuaaaguguuaugcuguacaauuugucccauacuucccagcuc

SEQ ID NO: 144861 - RNA, 64 nt, Homo Sapiens
gaaugaaguucugaaaauggacuuaaguuugggucuguacaaagcagcaggaaaauaauacaaa

SEQ ID NO: 144862 - RNA, 64 nt, Homo Sapiens; identical to SEQ ID NO: 97809

SEQ ID NO: 144863 - RNA, 64 nt, Homo Sapiens; identical to SEQ ID NO: 97810

SEQ ID NO: 144864 - RNA, 64 nt, Homo Sapiens; identical to SEQ ID NO: 97811

SEQ ID NO: 144865 - RNA, 64 nt, Homo Sapiens; identical to SEQ ID NO: 97812

SEQ ID NO: 144866 - RNA, 64 nt, Homo Sapiens; identical to SEQ ID NO: 97813

SEQ ID NO: 144867 - RNA, 64 nt, Homo Sapiens; identical to SEQ ID NO: 97814

SEQ ID NO: 144868 - RNA, 64 nt, Homo Sapiens
ugcaaaaugaccuggugacauggcaagucaguggggacaggaaggaccacucccuaaguaaucc

SEQ ID NO: 144869 - RNA, 64 nt, Homo Sapiens
cauaguaauuacccacagaaggaggaaguggaagggacaggagcacauagguagaugccaaguu

SEQ ID NO: 144870 - RNA, 64 nt, Homo Sapiens
caccuccauccuucggaaggcaagcuaccuggagggacaggaccaguccugcuguccacaccca

SEQ ID NO: 144871 - RNA, 64 nt, Homo Sapiens
aaauugcaccacagcuccccccacagaccuccagggacaggagcccugugcccacagcuuccgc

SEQ ID NO: 144872 - RNA, 64 nt, Homo Sapiens
agugcucaaucuucaugagaggacaguuggcuggggacaggagaaucuccuaugccccuggaca

SEQ ID NO: 144873 - RNA, 64 nt, Homo Sapiens
guuggcuggggacaggagaaucuccuaugccccuggacaggacagcuauagaacuugggggcua

SEQ ID NO: 144874 - RNA, 64 nt, Homo Sapiens
caaaacagggauguuuguuuuuguuuuggaaacuggacaggaguuguauguauguuuuguuguu

SEQ ID NO: 144875 - RNA, 64 nt, Homo Sapiens
ugugcuaaagggcacagcaauauaaacuuacuggggacaggauggucuccaacgaacagaaaac

SEQ ID NO: 144876 - RNA, 64 nt, Homo Sapiens
uuccagauccuaauuggaaaugaaaaucucuaagggacaggauucauaaaaucaaggagacugc

SEQ ID NO: 144877 - RNA, 64 nt, Homo Sapiens
gaauguaaaaauaaauaucggcggcuggauuccaggacaggagucugucuccgcggaagucagg

SEQ ID NO: 144878 - RNA, 64 nt, Homo Sapiens
gcuugaggccaagagguggauugggaggccaaggggacaggacuauuccuguaaucccagcacu

SEQ ID NO: 144879 - RNA, 64 nt, Homo Sapiens
ggcucauggggacuccacucucugaagggugcugggacaggacacccccucagcuaacaacagu

SEQ ID NO: 144880 - RNA, 64 nt, Homo Sapiens
guuacagauuuuggauuuuuaucugaaaugcuugggacaggaguagacaggcuaagcguuucuu

SEQ ID NO: 144881 - RNA, 64 nt, Homo Sapiens
accacgugcuccacuccagcggggaggagauauaggacaggaaaagcaguauuaucugcggugg

SEQ ID NO: 144882 - RNA, 64 nt, Homo Sapiens
acagacaacucuuucuuuaaaugucuccaggacaggacaggacuuucacaccagacagccccuc

SEQ ID NO: 144883 - RNA, 64 nt, Homo Sapiens
ggacuacagacaacucuuuccccucaugucuccaggacaggacauuuccuucacaccagacagc

SEQ ID NO: 144884 - RNA, 64 nt, Homo Sapiens
acagaucgaccaagcugccguucccuauucugcaggacaggacuauucuagcauaccugcuucg

SEQ ID NO: 144885 - RNA, 64 nt, Homo Sapiens
cccuucccaagacuagcugcucaggguggugcagggacaggaccagacccugcgccuauuuccu

SEQ ID NO: 144886 - RNA, 64 nt, Homo Sapiens
cccccuccccugagaagcccgccuucucccucguggacaggagucagccaguugguugcugugg

SEQ ID NO: 144887 - RNA, 64 nt, Homo Sapiens
cagcagggagcacuuggcuccuggcagagggagaggacaggaggaggagccuuccccaggagga

SEQ ID NO: 144888 - RNA, 64 nt, Homo Sapiens
ugcgcccucagaacgugugggaaggagggggcguggacaggacacgggaccuugccaggccugg

SEQ ID NO: 144889 - RNA, 64 nt, Homo Sapiens
caggacacgggaccuugccaggccuggugucugaggacaggagccugggagaggcggguggagc

SEQ ID NO: 144890 - RNA, 64 nt, Homo Sapiens
cccuugagucuggggcacccuucagcugcccuggggacaggaaggacaggagcuaagcaggguc

SEQ ID NO: 144891 - RNA, 64 nt, Homo Sapiens
cuggggcacccuucagcugcccuggggacaggaaggacaggagcuaagcaggguccaagccugg

SEQ ID NO: 144892 - RNA, 64 nt, Homo Sapiens
gggguaggaggagaggaggcuaugcuuagguguuggacaggauacagacucccagugguacuac

SEQ ID NO: 144893 - RNA, 64 nt, Homo Sapiens
gguggauauuuguugauggaaucugaggcaagcuggacaggagaagagaagagagaaccugaag

SEQ ID NO: 144894 - RNA, 64 nt, Homo Sapiens
ggccccaaucuugcccacuguugugcagcuucgaggacaggaaaguucugggcuggggccaccu

SEQ ID NO: 144895 - RNA, 64 nt, Homo Sapiens
cugguccuucccugauggccugcaucacacucaaggacaggagcggcccuacuuccaggaugga

SEQ ID NO: 144896 - RNA, 64 nt, Homo Sapiens
uaacuguauuaccugcuuugucuugaauucugcaggacaggaaagacaggaacugcauaaaggu

SEQ ID NO: 144897 - RNA, 64 nt, Homo Sapiens
ugcauaaagguucuugaauucucuuuaaaucauaggacaggaacagaguagcggagucacugac

SEQ ID NO: 144898 - RNA, 64 nt, Homo Sapiens
caaugcccucguaucaauaagaccgggguaagggggacaggauacuugucacauauuugaagaa

SEQ ID NO: 144899 - RNA, 64 nt, Homo Sapiens
acccugaagccccuccuccuucccccacagauggggacaggaggugauggggugcucagaaccc

SEQ ID NO: 144900 - RNA, 64 nt, Homo Sapiens
gucccucgcagggucccagggccgggagcugggcggacaggaccggagucaccgucuacugcca

SEQ ID NO: 144901 - RNA, 64 nt, Homo Sapiens
guggcggcugcugacuguggggggacaugcggugggacaggagcacggagaggagggcucccag

SEQ ID NO: 144902 - RNA, 64 nt, Homo Sapiens
ggagccauggcucagaggugauucgggcagccagggacaggagccacccuccccaggcccaacu

SEQ ID NO: 144903 - RNA, 64 nt, Homo Sapiens
gagagagugggaggcagagugugauggggaggagggacaggaagacccuuuuaaugaugagggu

SEQ ID NO: 144904 - RNA, 64 nt, Homo Sapiens
ggcucugagaagaggccaaagggaccacagauuuggacaggaaggccaccacuuugcaucaccu

SEQ ID NO: 144905 - RNA, 64 nt, Homo Sapiens
uggaccgcuucagccugggcucccuccaugccaaggacaggacucacugguauagucaucgcuc

SEQ ID NO: 144906 - RNA, 64 nt, Homo Sapiens
agcuucgggcccagcuucacccagcguggcccuaggacaggagguccccgccgccucacugcag

SEQ ID NO: 144907 - RNA, 64 nt, Homo Sapiens
ugggugcaacucccucccauuuuugggggggggcggacaggagaauaucgacauacauauauau

SEQ ID NO: 144908 - RNA, 64 nt, Homo Sapiens
auucaauccuacuuuucgaacaccaaaaaugaugcgcaucaauguauuuuaucuuauuuucuca

SEQ ID NO: 144909 - RNA, 64 nt, Homo Sapiens
aauagaaugaaacugugugaaggauaagauuguucgcaucaagauccaaaucuugauuucauau

SEQ ID NO: 144910 - RNA, 64 nt, Homo Sapiens
uugauucucagagcaauaaauucguggagaauuacgcaucaaaucugaguuuuuugggaauauc

SEQ ID NO: 144911 - RNA, 64 nt, Homo Sapiens
guggagguccgaggggaugacccugggagacauacgcaucaacuugaguuaagugaccuaauuc

SEQ ID NO: 144912 - RNA, 64 nt, Homo Sapiens
aucaugccuuccaaauuguggguggcucugugggcgcaucaauaaaagccguccuugauuuuau

SEQ ID NO: 144913 - RNA, 64 nt, Homo Sapiens
aaagaacugucucuaccagggucaagagcaugaacgcaucaauagaaagaacucggggaaacau

SEQ ID NO: 144914 - RNA, 64 nt, Homo Sapiens
cgcagaccuaaacugauccuugcuugggcggcaucgcaucaacggaagucccacguguccggug

SEQ ID NO: 144915 - RNA, 64 nt, Homo Sapiens
gagggaaauuuucagcuacauacaccuuaugaaucgcaucaauacagauaauucacacaagagg

SEQ ID NO: 144916 - RNA, 64 nt, Homo Sapiens
uuuggcacuuacaaaguuuuugguaauuauuucacgcaucaaccuaacuuuuaugagaaaaaaa

SEQ ID NO: 144917 - RNA, 64 nt, Homo Sapiens
ccaccguggaggcagggggcaagaaacucaagaacgcaucaagagcaccagcccugggccaggg

SEQ ID NO: 144918 - RNA, 64 nt, Homo Sapiens
uuuggcaggaucggcuuccuugggcugcuggugucgcaucaagauugggaugaagaggguagag

SEQ ID NO: 144919 - RNA, 64 nt, Homo Sapiens
cugggccuggauugcagacagugccgcugcugaucgcaucaaaaacaaagucaaaggccaucuc

SEQ ID NO: 144920 - RNA, 64 nt, Homo Sapiens
guguggucccaacaggaggacaauucaugaacuucgcaucaaaagacaauucuuuauacaacag

SEQ ID NO: 144921 - RNA, 64 nt, Homo Sapiens
gcugagcgccuccuaguugccaggcacuggagggcgcaucaaagaagaguccuacccaggaggg

SEQ ID NO: 144922 - RNA, 64 nt, Homo Sapiens
ggaaacuaagacaccugaacccuccagggccucccgcaucaaggucagcaugaggacagaccac

SEQ ID NO: 144923 - RNA, 64 nt, Homo Sapiens
uuuguuuucuucauucauuuguuaaggaaccuagcgcaucaaauacccauguguccaauagcaa

SEQ ID NO: 144924 - RNA, 64 nt, Homo Sapiens
agcaaucugugacaaagucucauuuuuugccggacgcaucaagauuaaacuugccugguuugua

SEQ ID NO: 144925 - RNA, 64 nt, Homo Sapiens
cuggggggcggggcuggaggggaaggaguguccacgcaucaauaaagauuuaacgaacugaacg

SEQ ID NO: 144926 - RNA, 64 nt, Homo Sapiens
uucagcuguccacacgggcuggcgacacacuuaccgcaucaaucuguguucagguccaggguua

SEQ ID NO: 144927 - RNA, 64 nt, Homo Sapiens
gauacaucuuugaugaaguccucagagcucaauacgcaucaaaagacagaagcuuuauccaggu

SEQ ID NO: 144928 - RNA, 64 nt, Homo Sapiens
aauaauuuugaaggccucacugugcuuuacuccacgcaucaauaccaagcccaguucucugggu

SEQ ID NO: 144929 - RNA, 64 nt, Homo Sapiens
agacuggucuggccugcuggccugggcgucagggcgcaucaauaaaguacuuggaccaguuuug

SEQ ID NO: 144930 - RNA, 64 nt, Homo Sapiens
ccagaaggccgcagaggcugagcaggaaaugcagcgcaucaaggccacagcgauucgcacggag

SEQ ID NO: 144931 - RNA, 64 nt, Homo Sapiens
ucaacaacuacuaccaggacaggacuuucugcugcgcaucaacucggcuaccagccccaccugg

SEQ ID NO: 144932 - RNA, 64 nt, Homo Sapiens
auggcauccucaggggcgugagaaacgccugauccgcaucaagagucugggaucaacuccugga

SEQ ID NO: 144933 - RNA, 64 nt, Homo Sapiens
cggauuguuuauauguuuaagaaauuaguuuucacgcaucaaacuauccuaauuuaaaagcugu

SEQ ID NO: 144934 - RNA, 63 nt, Homo Sapiens
cuuuuuccuuccccuggacuguccucugacccuuuggcucauccuagauugcaguguguccug

SEQ ID NO: 144935 - RNA, 63 nt, Homo Sapiens
augcagauggagaagugguguuggcagcaagcuuuggcucauguggauuugguuuaaguggug

SEQ ID NO: 144936 - RNA, 63 nt, Homo Sapiens
cugucacccaggcuagagugcgguggugugaucuuggcucacugcaaccucccccuccugggu

SEQ ID NO: 144937 - RNA, 63 nt, Homo Sapiens
cuguugcucaggcuggagugcaguggugcaaucuuggcucacugcaaccuacaccucccgggu

SEQ ID NO: 144938 - RNA, 63 nt, Homo Sapiens
cugucacccaggcuggaaugcaguggugugaucuuggcucacugcaaccuccacuucccgggu

SEQ ID NO: 144939 - RNA, 63 nt, Homo Sapiens
gagacuggguaauugauaaagaaaaagguuuguuuggcucacaauuuugcuggcuagaagguu

SEQ ID NO: 144940 - RNA, 63 nt, Homo Sapiens
ccaucguccaggcuggagugcgcuggcuugaucuuggcucacugcagccucaauguccccagg

SEQ ID NO: 144941 - RNA, 63 nt, Homo Sapiens
uuguugccagggcuggagugcaauggcgugaucuuggcucacugcaaccuccgccucccgggu

SEQ ID NO: 144942 - RNA, 63 nt, Homo Sapiens
ugguggaggcaaagggcagaauuucugaccccuuuggcucagcugcccuuccccacaaauaaa

SEQ ID NO: 144943 - RNA, 63 nt, Homo Sapiens
cugccacccaggcuggaguacaguggcaugaucuuggcucacugcaacgucugccuccugggu

SEQ ID NO: 144944 - RNA, 63 nt, Homo Sapiens
cuguugcccaggcuggagugcaguggugccaucuuggcucacuccaagcucccccucccgugu

SEQ ID NO: 144945 - RNA, 63 nt, Homo Sapiens
aaaaaaucuuuuuauaaaaugaacuuuuaacacuuggcucaaaccucuaggucauacugccaa

SEQ ID NO: 144946 - RNA, 63 nt, Homo Sapiens
caggggaaacugcuguggauuugagaggcaaaguuggcucagcugugugcccaguuccuccug

SEQ ID NO: 144947 - RNA, 63 nt, Homo Sapiens
uuguguuuuuauuggagguggggugucacuauguuggcucagcugauuucaaauuccugaccu

SEQ ID NO: 144948 - RNA, 63 nt, Homo Sapiens
ucugucaccaggcuggagugcaguggugcgaucuuggcucauggcaaccucugccucccaggu

SEQ ID NO: 144949 - RNA, 63 nt, Homo Sapiens
uguuacuuuccuaaggagucuagcauccuuagauuggcucaacccacugaccuacugaauauc

SEQ ID NO: 144950 - RNA, 63 nt, Homo Sapiens
cagaaaucuggaagucaucucaccaucuacccauuggcucaaguguauguaagugaaaagcau

SEQ ID NO: 144951 - RNA, 63 nt, Homo Sapiens
gcaaccuccgccuccugggucaacgguacgaucuuggcucagucucucgcccaggcuggagug

SEQ ID NO: 144952 - RNA, 63 nt, Homo Sapiens
auagccuugaccucucaggccaauggugcaaucuuggcucacucugucucccaggcuggagug

SEQ ID NO: 144953 - RNA, 63 nt, Homo Sapiens
gcaaccuccgccucuugggucaguggugugaucuuggcucacucugucgcccaggcuggagug

SEQ ID NO: 144954 - RNA, 63 nt, Homo Sapiens
ggguuucuagggcugugacggccucguuucugguuggcucagcaagagguacaggcggugucc

SEQ ID NO: 144955 - RNA, 63 nt, Homo Sapiens
caggagagagggaaggcugcaugagucuugcuuuuggcucauauuccugcagggaggggugcc

SEQ ID NO: 144956 - RNA, 63 nt, Homo Sapiens
uaauuuuuuuuuuuuuuuuuaacauuguccugguuggcucauucuuuuuggcucuggcuuuua

SEQ ID NO: 144957 - RNA, 63 nt, Homo Sapiens
guaaccuccaccucccaggcggcucacuugaucuuggcucacugagugcaguggugugaucuu

SEQ ID NO: 144958 - RNA, 63 nt, Homo Sapiens
ugaucuuggcucacuguaaccaguggugugaucuuggcucacucugucacccaggcuggagug

SEQ ID NO: 144959 - RNA, 63 nt, Homo Sapiens
uggaacagggcuggggcuggaggcugucaguccuuggcucacccccucccagguaccuagcag

SEQ ID NO: 144960 - RNA, 63 nt, Homo Sapiens
cuguguugaaacccagaaccguucaccuggucuuuggcucacucagcuggguguacugagccu

SEQ ID NO: 144961 - RNA, 63 nt, Homo Sapiens
uguguucaucaaauacuccuagacucugggcucuuggcucagaaacugcauggccuuggagag

SEQ ID NO: 144962 - RNA, 63 nt, Homo Sapiens
agccagcauuggugaauauuauguauuuuucaguuggcucauccucagcaaguggagguuuca

SEQ ID NO: 144963 - RNA, 63 nt, Homo Sapiens
gcaaccuccgccucccgggucaauggcaccgucuuggcucacuuguugcccaggcugggaggg

SEQ ID NO: 144964 - RNA, 63 nt, Homo Sapiens
auugcuuuguaguaaccccugcuugguuaaaaauuggcucacuaccaucaaaucucugucucu

SEQ ID NO: 144965 - RNA, 63 nt, Homo Sapiens
ccuguaaucccagcacuuugucagcuggguguuuuggcucaggaaucagcuauaugaagaauc

SEQ ID NO: 144966 - RNA, 63 nt, Homo Sapiens
gcaacuugggccucccaggucaguggugcaaucuuggcucacucugucacccaggcuggagug

SEQ ID NO: 144967 - RNA, 63 nt, Homo Sapiens
ugaaaaauccguauccucugcuucuggugaacauuggcucagggguuagcaucuuagcaguau

SEQ ID NO: 144968 - RNA, 63 nt, Homo Sapiens
ccagagcgacuuugaucaccaucaccaacaacauuggcucaauagcaagaaugugugcccuua

SEQ ID NO: 144969 - RNA, 63 nt, Homo Sapiens
uuguugcccaggcuggagugcaacggcaugauuuuggcucacugcagccucugccucccaggc

SEQ ID NO: 144970 - RNA, 63 nt, Homo Sapiens
cuguugcccaggcuggagugcaguggcgugaucuuggcucacuacaaccuccaccuuccaggc

SEQ ID NO: 144971 - RNA, 63 nt, Homo Sapiens
uuaaucuuagucugaaaucaaaauauagauuaauuggcucagcuuuaauaccuuucuaggagg

SEQ ID NO: 144972 - RNA, 63 nt, Homo Sapiens
cagucacuggaugcacaaaaucacuguguaacauuggcucacuuggugagcauaggguugacu

SEQ ID NO: 144973 - RNA, 63 nt, Homo Sapiens
uugccugcuggugacaagcagagcgccugugauuuggcucaagacuccuauaugaugcaggug

SEQ ID NO: 144974 - RNA, 63 nt, Homo Sapiens
cuuaagccugauuuuccugaugcuuauuguaacuuggcucauugccugcagguaaagaauaac

SEQ ID NO: 144975 - RNA, 63 nt, Homo Sapiens
gcaaccuccaccuccugggucaguggcacagucuuggcucacucuguugugcaggcuggagug

SEQ ID NO: 144976 - RNA, 63 nt, Homo Sapiens
gcaaccuccaccucccgggucaguggcacgaucuuggcucacucuguugugcaggcuguagug

SEQ ID NO: 144977 - RNA, 63 nt, Homo Sapiens
gcaaccuccgccucccaggucaguggcgcaaucuuggcucacuucuguugccaggcuggagug

SEQ ID NO: 144978 - RNA, 64 nt, Homo Sapiens
uaaauacccuauguuauguagcaaagcugauagucuaugucaauuuugccaucuucugcucuca

SEQ ID NO: 144979 - RNA, 64 nt, Homo Sapiens
auuuuuguaaaugagguuuaguuuauucauaaugcuaugucacuuccaugguccccaauucaua

SEQ ID NO: 144980 - RNA, 64 nt, Homo Sapiens; identical to SEQ ID NO: 52440

SEQ ID NO: 144981 - RNA, 64 nt, Homo Sapiens; identical to SEQ ID NO: 52441

SEQ ID NO: 144982 - RNA, 64 nt, Homo Sapiens; identical to SEQ ID NO: 52442

SEQ ID NO: 144983 - RNA, 50 nt, Homo Sapiens; identical to SEQ ID NO: 52443

SEQ ID NO: 144984 - RNA, 64 nt, Homo Sapiens; identical to SEQ ID NO: 52444

SEQ ID NO: 144985 - RNA, 64 nt, Homo Sapiens; identical to SEQ ID NO: 52445

SEQ ID NO: 144986 - RNA, 64 nt, Homo Sapiens; identical to SEQ ID NO: 52446

SEQ ID NO: 144987 - RNA, 64 nt, Homo Sapiens; identical to SEQ ID NO: 52447

SEQ ID NO: 144988 - RNA, 64 nt, Homo Sapiens; identical to SEQ ID NO: 52448

SEQ ID NO: 144989 - RNA, 64 nt, Homo Sapiens; identical to SEQ ID NO: 52449

SEQ ID NO: 144990 - RNA, 64 nt, Homo Sapiens; identical to SEQ ID NO: 52450

SEQ ID NO: 144991 - RNA, 64 nt, Homo Sapiens; identical to SEQ ID NO: 52451

SEQ ID NO: 144992 - RNA, 64 nt, Homo Sapiens; identical to SEQ ID NO: 52452

SEQ ID NO: 144993 - RNA, 64 nt, Homo Sapiens; identical to SEQ ID NO: 52453

SEQ ID NO: 144994 - RNA, 64 nt, Homo Sapiens; identical to SEQ ID NO: 52454

SEQ ID NO: 144995 - RNA, 64 nt, Homo Sapiens; identical to SEQ ID NO: 52455

SEQ ID NO: 144996 - RNA, 64 nt, Homo Sapiens; identical to SEQ ID NO: 52456

SEQ ID NO: 144997 - RNA, 64 nt, Homo Sapiens; identical to SEQ ID NO: 52457

SEQ ID NO: 144998 - RNA, 64 nt, Homo Sapiens; identical to SEQ ID NO: 52458

SEQ ID NO: 144999 - RNA, 64 nt, Homo Sapiens; identical to SEQ ID NO: 52459

SEQ ID NO: 145000 - RNA, 64 nt, Homo Sapiens; identical to SEQ ID NO: 52460

SEQ ID NO: 145001 - RNA, 64 nt, Homo Sapiens; identical to SEQ ID NO: 52461

SEQ ID NO: 145002 - RNA, 64 nt, Homo Sapiens; identical to SEQ ID NO: 52462

SEQ ID NO: 145003 - RNA, 64 nt, Homo Sapiens; identical to SEQ ID NO: 52463

SEQ ID NO: 145004 - RNA, 64 nt, Homo Sapiens; identical to SEQ ID NO: 52464

SEQ ID NO: 145005 - RNA, 64 nt, Homo Sapiens; identical to SEQ ID NO: 52465

SEQ ID NO: 145006 - RNA, 64 nt, Homo Sapiens; identical to SEQ ID NO: 52466

SEQ ID NO: 145007 - RNA, 64 nt, Homo Sapiens; identical to SEQ ID NO: 52467

SEQ ID NO: 145008 - RNA, 64 nt, Homo Sapiens; identical to SEQ ID NO: 52468

SEQ ID NO: 145009 - RNA, 64 nt, Homo Sapiens; identical to SEQ ID NO: 52469

SEQ ID NO: 145010 - RNA, 64 nt, Homo Sapiens; identical to SEQ ID NO: 52470

SEQ ID NO: 145011 - RNA, 64 nt, Homo Sapiens; identical to SEQ ID NO: 52471

SEQ ID NO: 145012 - RNA, 64 nt, Homo Sapiens; identical to SEQ ID NO: 52472

SEQ ID NO: 145013 - RNA, 64 nt, Homo Sapiens; identical to SEQ ID NO: 52473

SEQ ID NO: 145014 - RNA, 64 nt, Homo Sapiens; identical to SEQ ID NO: 52474

SEQ ID NO: 145015 - RNA, 64 nt, Homo Sapiens; identical to SEQ ID NO: 52475

SEQ ID NO: 145016 - RNA, 64 nt, Homo Sapiens; identical to SEQ ID NO: 52476

SEQ ID NO: 145017 - RNA, 64 nt, Homo Sapiens; identical to SEQ ID NO: 52477

SEQ ID NO: 145018 - RNA, 64 nt, Homo Sapiens; identical to SEQ ID NO: 52478

SEQ ID NO: 145019 - RNA, 64 nt, Homo Sapiens; identical to SEQ ID NO: 52479

SEQ ID NO: 145020 - RNA, 64 nt, Homo Sapiens; identical to SEQ ID NO: 52480

SEQ ID NO: 145021 - RNA, 64 nt, Homo Sapiens; identical to SEQ ID NO: 52481

SEQ ID NO: 145022 - RNA, 64 nt, Homo Sapiens; identical to SEQ ID NO: 52482

SEQ ID NO: 145023 - RNA, 64 nt, Homo Sapiens; identical to SEQ ID NO: 52483

SEQ ID NO: 145024 - RNA, 64 nt, Homo Sapiens; identical to SEQ ID NO: 52484

SEQ ID NO: 145025 - RNA, 64 nt, Homo Sapiens; identical to SEQ ID NO: 52485

SEQ ID NO: 145026 - RNA, 64 nt, Homo Sapiens; identical to SEQ ID NO: 52486

SEQ ID NO: 145027 - RNA, 64 nt, Homo Sapiens; identical to SEQ ID NO: 52487

SEQ ID NO: 145028 - RNA, 64 nt, Homo Sapiens; identical to SEQ ID NO: 52488

SEQ ID NO: 145029 - RNA, 64 nt, Homo Sapiens; identical to SEQ ID NO: 52489

SEQ ID NO: 145030 - RNA, 64 nt, Homo Sapiens; identical to SEQ ID NO: 52490

SEQ ID NO: 145031 - RNA, 64 nt, Homo Sapiens; identical to SEQ ID NO: 52491

SEQ ID NO: 145032 - RNA, 64 nt, Homo Sapiens; identical to SEQ ID NO: 52492

SEQ ID NO: 145033 - RNA, 64 nt, Homo Sapiens; identical to SEQ ID NO: 52493

SEQ ID NO: 145034 - RNA, 64 nt, Homo Sapiens; identical to SEQ ID NO: 52494

SEQ ID NO: 145035 - RNA, 64 nt, Homo Sapiens; identical to SEQ ID NO: 52495

SEQ ID NO: 145036 - RNA, 64 nt, Homo Sapiens; identical to SEQ ID NO: 52496

SEQ ID NO: 145037 - RNA, 64 nt, Homo Sapiens; identical to SEQ ID NO: 52497

SEQ ID NO: 145038 - RNA, 64 nt, Homo Sapiens; identical to SEQ ID NO: 52498

SEQ ID NO: 145039 - RNA, 64 nt, Homo Sapiens; identical to SEQ ID NO: 52499

SEQ ID NO: 145040 - RNA, 64 nt, Homo Sapiens; identical to SEQ ID NO: 52500

SEQ ID NO: 145041 - RNA, 64 nt, Homo Sapiens; identical to SEQ ID NO: 52501

SEQ ID NO: 145042 - RNA, 64 nt, Homo Sapiens; identical to SEQ ID NO: 52502

SEQ ID NO: 145043 - RNA, 64 nt, Homo Sapiens; identical to SEQ ID NO: 52503

SEQ ID NO: 145044 - RNA, 64 nt, Homo Sapiens; identical to SEQ ID NO: 52504

SEQ ID NO: 145045 - RNA, 64 nt, Homo Sapiens; identical to SEQ ID NO: 53719

SEQ ID NO: 145046 - RNA, 64 nt, Homo Sapiens; identical to SEQ ID NO: 53720

SEQ ID NO: 145047 - RNA, 64 nt, Homo Sapiens; identical to SEQ ID NO: 53721

SEQ ID NO: 145048 - RNA, 64 nt, Homo Sapiens; identical to SEQ ID NO: 53722

SEQ ID NO: 145049 - RNA, 64 nt, Homo Sapiens; identical to SEQ ID NO: 53723

SEQ ID NO: 145050 - RNA, 64 nt, Homo Sapiens; identical to SEQ ID NO: 53724

SEQ ID NO: 145051 - RNA, 64 nt, Homo Sapiens; identical to SEQ ID NO: 53725

SEQ ID NO: 145052 - RNA, 64 nt, Homo Sapiens; identical to SEQ ID NO: 53726

SEQ ID NO: 145053 - RNA, 64 nt, Homo Sapiens; identical to SEQ ID NO: 53727

SEQ ID NO: 145054 - RNA, 64 nt, Homo Sapiens; identical to SEQ ID NO: 53728

SEQ ID NO: 145055 - RNA, 64 nt, Homo Sapiens; identical to SEQ ID NO: 53729

SEQ ID NO: 145056 - RNA, 64 nt, Homo Sapiens; identical to SEQ ID NO: 53730

SEQ ID NO: 145057 - RNA, 64 nt, Homo Sapiens; identical to SEQ ID NO: 53731

SEQ ID NO: 145058 - RNA, 64 nt, Homo Sapiens; identical to SEQ ID NO: 53732

SEQ ID NO: 145059 - RNA, 64 nt, Homo Sapiens; identical to SEQ ID NO: 53733

SEQ ID NO: 145060 - RNA, 64 nt, Homo Sapiens; identical to SEQ ID NO: 53734

SEQ ID NO: 145061 - RNA, 64 nt, Homo Sapiens; identical to SEQ ID NO: 53735

SEQ ID NO: 145062 - RNA, 64 nt, Homo Sapiens; identical to SEQ ID NO: 53736

SEQ ID NO: 145063 - RNA, 64 nt, Homo Sapiens; identical to SEQ ID NO: 53737

SEQ ID NO: 145064 - RNA, 64 nt, Homo Sapiens; identical to SEQ ID NO: 53738

SEQ ID NO: 145065 - RNA, 64 nt, Homo Sapiens; identical to SEQ ID NO: 53739

SEQ ID NO: 145066 - RNA, 64 nt, Homo Sapiens; identical to SEQ ID NO: 53740

SEQ ID NO: 145067 - RNA, 64 nt, Homo Sapiens; identical to SEQ ID NO: 53741

SEQ ID NO: 145068 - RNA, 64 nt, Homo Sapiens; identical to SEQ ID NO: 53742

SEQ ID NO: 145069 - RNA, 64 nt, Homo Sapiens; identical to SEQ ID NO: 53743

SEQ ID NO: 145070 - RNA, 64 nt, Homo Sapiens; identical to SEQ ID NO: 53744

SEQ ID NO: 145071 - RNA, 64 nt, Homo Sapiens; identical to SEQ ID NO: 53745

SEQ ID NO: 145072 - RNA, 64 nt, Homo Sapiens; identical to SEQ ID NO: 53746

SEQ ID NO: 145073 - RNA, 64 nt, Homo Sapiens; identical to SEQ ID NO: 53747

SEQ ID NO: 145074 - RNA, 64 nt, Homo Sapiens; identical to SEQ ID NO: 53748

SEQ ID NO: 145075 - RNA, 64 nt, Homo Sapiens; identical to SEQ ID NO: 53749

SEQ ID NO: 145076 - RNA, 64 nt, Homo Sapiens; identical to SEQ ID NO: 53750

SEQ ID NO: 145077 - RNA, 64 nt, Homo Sapiens; identical to SEQ ID NO: 53751

SEQ ID NO: 145078 - RNA, 64 nt, Homo Sapiens; identical to SEQ ID NO: 53752

SEQ ID NO: 145079 - RNA, 64 nt, Homo Sapiens; identical to SEQ ID NO: 53753

SEQ ID NO: 145080 - RNA, 64 nt, Homo Sapiens; identical to SEQ ID NO: 53754

SEQ ID NO: 145081 - RNA, 64 nt, Homo Sapiens; identical to SEQ ID NO: 53755

SEQ ID NO: 145082 - RNA, 64 nt, Homo Sapiens; identical to SEQ ID NO: 53756

SEQ ID NO: 145083 - RNA, 64 nt, Homo Sapiens; identical to SEQ ID NO: 53757

SEQ ID NO: 145084 - RNA, 64 nt, Homo Sapiens; identical to SEQ ID NO: 53758

SEQ ID NO: 145085 - RNA, 64 nt, Homo Sapiens; identical to SEQ ID NO: 53759

SEQ ID NO: 145086 - RNA, 64 nt, Homo Sapiens; identical to SEQ ID NO: 53760

SEQ ID NO: 145087 - RNA, 64 nt, Homo Sapiens; identical to SEQ ID NO: 53761

SEQ ID NO: 145088 - RNA, 64 nt, Homo Sapiens; identical to SEQ ID NO: 53762

SEQ ID NO: 145089 - RNA, 64 nt, Homo Sapiens; identical to SEQ ID NO: 53763

SEQ ID NO: 145090 - RNA, 64 nt, Homo Sapiens; identical to SEQ ID NO: 53764

SEQ ID NO: 145091 - RNA, 64 nt, Homo Sapiens
aacuaaccuaccccaacucugcccuucucccauccaagagaaaccagcaaaaugauaaagaagc

SEQ ID NO: 145092 - RNA, 64 nt, Homo Sapiens
cgggcagcagucacuggggcucaagggcagugagcaagagaaaugucuaaagcugcuucuccca

SEQ ID NO: 145093 - RNA, 64 nt, Homo Sapiens
ugugguagccacuccaggauccugauuggggugccaagagaaacagcaggauguugaauugauc

SEQ ID NO: 145094 - RNA, 64 nt, Homo Sapiens
uauaaaauucugucuuucauuuccaaccauuuuucaagagaagcugcuacuaucuugagacuuc

SEQ ID NO: 145095 - RNA, 64 nt, Homo Sapiens
ccucagggcugcauucagcuuaccagcuaccuagcaagagaaggaauuauuugacaugccuaaa

SEQ ID NO: 145096 - RNA, 64 nt, Homo Sapiens
gcccacgugaagaguuugguagaaauagccuugucaagagaacuagcaagccccugacauuuuu

SEQ ID NO: 145097 - RNA, 64 nt, Homo Sapiens
ucugaaucuuaggaagaagguaaaagaaaggaggcaagagaauaguuaugaugaauauguguua

SEQ ID NO: 145098 - RNA, 64 nt, Homo Sapiens
uucauguuauaugcacauugccaagaauuacugucaagagaaaugauaaguaaaagucauuuau

SEQ ID NO: 145099 - RNA, 64 nt, Homo Sapiens
guuugaacccgggaggcagauugagaggcugaggcaagagaauuaugccuguagucccagcuac

SEQ ID NO: 145100 - RNA, 64 nt, Homo Sapiens
aaauugcugaaagaucuuucugacucacuuaucccaagagaaugaacacacacuguucugaaag

SEQ ID NO: 145101 - RNA, 64 nt, Homo Sapiens
uagaaaggcugcuuuagugcgauaacuaggucuccaagagaaaaaaauuuguucuuccugauau

SEQ ID NO: 145102 - RNA, 64 nt, Homo Sapiens
auccucacuuauuaacucucacaguagcugucuccaagagaaaaaccuccaguucucccugaug

SEQ ID NO: 145103 - RNA, 64 nt, Homo Sapiens
uaaucuuacggauaauccacgugagauuuccacacaagagaaaagcacacgcauagugaaaugu

SEQ ID NO: 145104 - RNA, 64 nt, Homo Sapiens
aaaccucaagacuaucagugugaccuccccauaacaagagaaccccauauauaguuugagacuu

SEQ ID NO: 145105 - RNA, 64 nt, Homo Sapiens
ggacuucucuuccaguuucuaaaaaaagaauuaccaagagaagguaucccagcuuuaaaaagaa

SEQ ID NO: 145106 - RNA, 64 nt, Homo Sapiens
gcuuacaggcauggacaugccuuucuuccuuggccaagagaagggguuucuuuuuucuuucuuc

SEQ ID NO: 145107 - RNA, 64 nt, Homo Sapiens
ugggaggcaaaaagcacuucuuacauggcggcagcaagagaaaaugagaaagaagcaaaagugg

SEQ ID NO: 145108 - RNA, 64 nt, Homo Sapiens
cgggaggugaaaagcacuucguacauggugguggcaagagaaaaugaagaagaagcaaaagugg

SEQ ID NO: 145109 - RNA, 64 nt, Homo Sapiens
ugccuauaaguagcaggccuuugugccucagugucaagagaaaucaagagaugcuaaaagcuuu

SEQ ID NO: 145110 - RNA, 64 nt, Homo Sapiens
gcgccuguaguuccagcuacucgggaggcugaggcaagagaauggcaugaacccgguaggggag

SEQ ID NO: 145111 - RNA, 64 nt, Homo Sapiens
aacuagagccugugcuaaagggaaacccaaggaacaagagaaaagagaguccuuugggauucua

SEQ ID NO: 145112 - RNA, 64 nt, Homo Sapiens
uaaaccaagauagauccauugccuaauauuuaggcaagagaaaauuuugaaacccauuaggcau

SEQ ID NO: 145113 - RNA, 64 nt, Homo Sapiens
gaaguuaugaaugaagauaacauucacccauaaccaagagaacucagguagcugcaucaccagg

SEQ ID NO: 145114 - RNA, 64 nt, Homo Sapiens
uauuauauaacauguaaaguugauuuucuugugacaagagaacuucuuuuuuuaacaagaggac

SEQ ID NO: 145115 - RNA, 64 nt, Homo Sapiens
cucuucagcuguaaauaacaggauacagaauuaacaagagaaaaugucuaacuuuuuaagaaaa

SEQ ID NO: 145116 - RNA, 64 nt, Homo Sapiens
cacaaaaugacacucuucuaaaacuaaaugggcacaagagaauuuuccugggaaaguucacauc

SEQ ID NO: 145117 - RNA, 64 nt, Homo Sapiens
aaccuugucaauagguucuugaaaacuuguacuucaagagaaaugauguauaacaaaaccauac

SEQ ID NO: 145118 - RNA, 64 nt, Homo Sapiens
ucuccauaccauuuggcucccaaauuuaaauaaacaagagaaaacgguguucaucuauuaagga

SEQ ID NO: 145119 - RNA, 64 nt, Homo Sapiens
acuugaacccaggaggcagaucaggaggcugaggcaagagaaucacgccugaagucccagcuac

SEQ ID NO: 145120 - RNA, 64 nt, Homo Sapiens
ccaaucagcuucaucaaaacuuauuuuucagcaucaagagaaaacuaguaccaauuuucccuuu

SEQ ID NO: 145121 - RNA, 64 nt, Homo Sapiens
cauugagcuuuuucuuucauuagugguggcaggacaagagaaggggugggagugugguggggcg

SEQ ID NO: 145122 - RNA, 64 nt, Homo Sapiens
aguguacacacaggggccacauuuuauuuaaguucaagagaaaagguuuuuuaaauuuuauuuu

SEQ ID NO: 145123 - RNA, 64 nt, Homo Sapiens
ggguaagguaaagugcgauaguucaaguggaaagcaagagaaugaccagugaccuugcuuccuu

SEQ ID NO: 145124 - RNA, 64 nt, Homo Sapiens
guuggucauuaggugaauauuacucauuuucccucaagagaagcucauaagugugugugggugu

SEQ ID NO: 145125 - RNA, 64 nt, Homo Sapiens
cagggucuucugcuccagucaccccggccucuugcaagagaaaguccagggacuggcaagaaga

SEQ ID NO: 145126 - RNA, 64 nt, Homo Sapiens
cugagaaacuguugagucaggcuagaggacuggacaagagaagaggcauugagagcccccuugg

SEQ ID NO: 145127 - RNA, 64 nt, Homo Sapiens
ccauaaacgggucuuaugacauggcuuucuacaccaacucuaauucauuuuucaacucaaggca

SEQ ID NO: 145128 - RNA, 64 nt, Homo Sapiens
aauugacccuaucaacuggauugaagaacccuuucaacucuaaaaauaagggugguggacuauc

SEQ ID NO: 145129 - RNA, 64 nt, Homo Sapiens
agaaauugcaucacacuaauuacaaaauacaaguucuggaaaaaauauuuuucuucauuuuaaa

SEQ ID NO: 145130 - RNA, 64 nt, Homo Sapiens
guuaacuuuuacacaguucugaguacuguuaauaucuggaaaguaucuugagauaucaguggaa

SEQ ID NO: 145131 - RNA, 64 nt, Homo Sapiens
caugauuuauauauggcauauuuauauuguauauucuggaaaaaaaauauauauauauauuuaa

SEQ ID NO: 145132 - RNA, 64 nt, Homo Sapiens
uuugagaauuauuccuuuccuagacuaauuaaaaucuggaaaucuguuuuguauaugaucuaau

SEQ ID NO: 145133 - RNA, 64 nt, Homo Sapiens
aaacugaguaaauuggaaacauuuucuuucuuuuucuggaaauuuuguccauuuuaaaaaccaa

SEQ ID NO: 145134 - RNA, 64 nt, Homo Sapiens
uucuacauucauugccaucaagucgucagcuuguucuggaaacucuuuaugcuuugacaucgag

SEQ ID NO: 145135 - RNA, 64 nt, Homo Sapiens
agcuccuagagaagaacaauccucauggagaaacucuggaaaccuugacaauggcaacagugug

SEQ ID NO: 145136 - RNA, 64 nt, Homo Sapiens
uaccaccaaucccgaucggccaagacaccugugaucuggaaauccuuauuagcuccccgcucca

SEQ ID NO: 145137 - RNA, 64 nt, Homo Sapiens
cacgaccaaucccgaucggcugacuccacggggaucuggaaaucgcccaggaaagaacuucagc

SEQ ID NO: 145138 - RNA, 64 nt, Homo Sapiens
gaagaaacaccccagcacagacuugugauuuuuaucuggaaaagagagccgucaucagugucuc

SEQ ID NO: 145139 - RNA, 64 nt, Homo Sapiens
gaguccaugaagggggugugagggggaggguauuucuggaaaguggaccagcaugugcaaaaau

SEQ ID NO: 145140 - RNA, 64 nt, Homo Sapiens
ggacuccaguugccucagguugguucugcugugcucuggaaaguaacugcagccaccagguaug

SEQ ID NO: 145141 - RNA, 64 nt, Homo Sapiens
uguaucgcaaagcuauaugugaaacaaccuauggucuggaaauuagccuuuuaauacuaaguau

SEQ ID NO: 145142 - RNA, 64 nt, Homo Sapiens
cuuuggucccacagccuugcauuagucaaggaagucuggaaaagaauuugguauugcacaggug

SEQ ID NO: 145143 - RNA, 64 nt, Homo Sapiens
aaggaagaagccugagauuugauccuugacaauuucuggaaagcacuggucagucacacugucc

SEQ ID NO: 145144 - RNA, 64 nt, Homo Sapiens
cuaagaugauauuucagaagaguuggcugccuucucuggaaacaaggaaaacccaauaauuccg

SEQ ID NO: 145145 - RNA, 64 nt, Homo Sapiens
aaugagggacuggaaccagggagaccgagcgcuuucuggaaaagaggaguuucgagguagaguu

SEQ ID NO: 145146 - RNA, 64 nt, Homo Sapiens
aagaggcuggugcuguggccagggugagagcugcucuggaaaaugugacccagauccucacaac

SEQ ID NO: 145147 - RNA, 64 nt, Homo Sapiens
uuuucaugacaauguaauuuguguaacuguugaaucuggaaauugaucagcauuaaagggcaca

SEQ ID NO: 145148 - RNA, 64 nt, Homo Sapiens
ugauacagcucuggcuuucugagcacacuacggaucuggaaaauacuggaaaaugugauacuua

SEQ ID NO: 145149 - RNA, 64 nt, Homo Sapiens
aauucagaauucuuaggcaaccuucauaccuuuaucuggaaaaugccuucucuccagacaauaa

SEQ ID NO: 145150 - RNA, 64 nt, Homo Sapiens
agcaggaauuuauacauuggguaccagagcuaaaucuggaaaacacauuuggaaugagcuucca

SEQ ID NO: 145151 - RNA, 64 nt, Homo Sapiens
cauauuuuucuaaguuuccccccuaguuucacuuucuggaaagugaacaguuuuuuaaauccua

SEQ ID NO: 145152 - RNA, 64 nt, Homo Sapiens
uuaauaguuuuagaguuaagaguaguugucauauucuggaaaauuuguuuuaucuaauacugua

SEQ ID NO: 145153 - RNA, 64 nt, Homo Sapiens
ccuauuuuuuggggaaaaaguaacaguaaugagaucuggaaacaguuuuauuugaaugugugca

SEQ ID NO: 145154 - RNA, 64 nt, Homo Sapiens
augggagauauuacaauaaaguugccagugauguucuggaaauacccuugcauacaaguuucua

SEQ ID NO: 145155 - RNA, 64 nt, Homo Sapiens
ucuacaacuaauaggacacauucuacauaaguucucuggaaauacaaaauuuguaauguguugc

SEQ ID NO: 145156 - RNA, 64 nt, Homo Sapiens
ucccuacagccuagggcagacaauaguauagaagucuggaaaaaaacaaaaacagaauuugaga

SEQ ID NO: 145157 - RNA, 64 nt, Homo Sapiens
aucacgauuugcaggauucccuucugggcuucauucuggaaacuuuuguuagggcugcuuuucu

SEQ ID NO: 145158 - RNA, 64 nt, Homo Sapiens
uggcagggaguggggauugguccuacuuucuuucucuggaaaggaaagccuccaagacuccaug

SEQ ID NO: 145159 - RNA, 64 nt, Homo Sapiens
auccaucccuuauuaaaacucuuaguaaauuaagucuggaaagaaacacccuaaucuagauaaa

SEQ ID NO: 145160 - RNA, 64 nt, Homo Sapiens
aaaaaaaaaggcuuuggcuuugggaucacagaaaucuggaaaaaguugagcaacauggggcuag

SEQ ID NO: 145161 - RNA, 64 nt, Homo Sapiens
ggauuugcuucuuacccuguuuaaaacuaaaaucucuggaaaauccugccuggcugauucuucc

SEQ ID NO: 145162 - RNA, 64 nt, Homo Sapiens
cgugugaaggaagcguucuuggugcuacacacagucuggaaaagcagccugggcuucacuggca

SEQ ID NO: 145163 - RNA, 64 nt, Homo Sapiens
uucucuguguggauagacuccccagcguuuuuccucuggaaaugcccacagggcuugccgcgug

SEQ ID NO: 145164 - RNA, 64 nt, Homo Sapiens
cauggggcacugacagagaaaugaaauaguuuuaucuggaaaauuccagagcuauuauuuacuc

SEQ ID NO: 145165 - RNA, 64 nt, Homo Sapiens
agaggccaugaagaagugcuuccguggccgacagucuggaaaugaauccaucauacauuagugc

SEQ ID NO: 145166 - RNA, 64 nt, Homo Sapiens
ugggauuugcaaauaaaggccccuuuggggauagucuggaaagucaagagaaagaaagaacguu

SEQ ID NO: 145167 - RNA, 64 nt, Homo Sapiens
cuugcucccaggagggcuuugcuauugggagcaaucuggaaaaaugccugcugcugccaaguua

SEQ ID NO: 145168 - RNA, 64 nt, Homo Sapiens
uucuuuggggcagagaagagaaauaaugugaaauucuggaaauugcaagauggguuuuuaagga

SEQ ID NO: 145169 - RNA, 64 nt, Homo Sapiens
uauuccugugcccauauuuugcuuagauauacaaucuggaaaaaaguugcagaacaagcaauug

SEQ ID NO: 145170 - RNA, 64 nt, Homo Sapiens
cugggguaguuggugagcagcucuguucacagucucuggaaaagucuaguuggccagcgucuug

SEQ ID NO: 145171 - RNA, 64 nt, Homo Sapiens
cagauaacuaaggugaagaaggacaggaugggguucuggaaaucgaacccugcagggcccuuau

SEQ ID NO: 145172 - RNA, 64 nt, Homo Sapiens
gccaguuuuccucccccgccggcuucugcagaauucuggaaaaucucaaauuguagucucuguc

SEQ ID NO: 145173 - RNA, 64 nt, Homo Sapiens
uucuuugucaacauuaguaagucccuuuuugguuucuggaaagaggcuucagugauuccucugu

SEQ ID NO: 145174 - RNA, 64 nt, Homo Sapiens
gcuugaaaucuugcuguacuguuguuguuguuuuucuggaaacucgauaaggaaagaaaauguc

SEQ ID NO: 145175 - RNA, 64 nt, Homo Sapiens
accagaguuaagcucucggcgccagcagguugucucuggaaacggcugggcgcaucccaagaca

SEQ ID NO: 145176 - RNA, 64 nt, Homo Sapiens
gagagaauacuguaauaauaucaaaagcacuuuuucuggaaacacauuuauggcuuuuauaaug

SEQ ID NO: 145177 - RNA, 64 nt, Homo Sapiens
auauugucauagugguuuuuauuccugcuuuguuucuggaaaggaaauccugaauuacuuaagu

SEQ ID NO: 145178 - RNA, 64 nt, Homo Sapiens
acaguguugugcaccaggaaacugggcacuucccucuggaaaucacaacaguaucuuaaguuua

SEQ ID NO: 145179 - RNA, 64 nt, Homo Sapiens
ugauucagccagcauggauagcucuggucccaccucuggaaaucgagcucuuuaaaaauaaauu

SEQ ID NO: 145180 - RNA, 64 nt, Homo Sapiens
aaccagaaggaggcugggcaggaaaagaaccaggccuggaaaagcaaaggugggaagagagccu

SEQ ID NO: 145181 - RNA, 64 nt, Homo Sapiens
aaccaggccuggaaaagaacaggugggaagagagccuggaaaagccucuucugucauuguucaa

SEQ ID NO: 145182 - RNA, 64 nt, Homo Sapiens
ucacacuucuuugucauugugguucugagaaaagccuggaaaaauuaaucuucacacaucucug

SEQ ID NO: 145183 - RNA, 64 nt, Homo Sapiens
uaugucacaugcgggaacugaaugucagaaguauccuggaaacaguuuuauaauuucucauauc

SEQ ID NO: 145184 - RNA, 64 nt, Homo Sapiens
ucuacaguaauuaauaugcaacauucccuaauuaccuggaaaguaaauggccucaggcaauuuc

SEQ ID NO: 145185 - RNA, 64 nt, Homo Sapiens
aagggaaaguggauuuaaaauaugacacagggggccuggaaagacaagccgccugguggauucc

SEQ ID NO: 145186 - RNA, 64 nt, Homo Sapiens
aaugaacaugagaaaauuuauacuguagagaaacccuggaaaugugaagaacguggcaaaguuc

SEQ ID NO: 145187 - RNA, 64 nt, Homo Sapiens
uacuguauauauauaauuccuacugaagaaauccccuggaaaugcaaaaaauguggcaggauuu

SEQ ID NO: 145188 - RNA, 64 nt, Homo Sapiens
uacauuguggcuuagcaaauaaauuuaugcuauuccuggaaaaaauagacacaagaaagauggc

SEQ ID NO: 145189 - RNA, 64 nt, Homo Sapiens
uagcuuguccaaauugagauugugacuauugagcccuggaaauguugauuacaauugagauuca

SEQ ID NO: 145190 - RNA, 64 nt, Homo Sapiens
aguguaaaucuugcaacauaucauuggaagacuuccuggaaaucccuauaauucagagcauacg

SEQ ID NO: 145191 - RNA, 64 nt, Homo Sapiens
gccugguaacccagugccuaaauuugcucaaagcccuggaaaauaucaucuuuaugauuagaac

SEQ ID NO: 145192 - RNA, 64 nt, Homo Sapiens
caacuuugcuucuuuaugaacauaaccuagugaaccuggaaauauuaguaacauauuuuucucc

SEQ ID NO: 145193 - RNA, 64 nt, Homo Sapiens
auacaggaaacauauuaagauuuuuuuuuggcauccuggaaaugaggcuagagaguugauuuuu

SEQ ID NO: 145194 - RNA, 64 nt, Homo Sapiens
cuuuaaagauuucagacuuuauuuaaaaaugcauccuggaaaucagucugaguucuggugggga

SEQ ID NO: 145195 - RNA, 64 nt, Homo Sapiens
aaauauuggaauguuauuauuacagaauauuuacccuggaaagaaauuauguuaguauagaaac

SEQ ID NO: 145196 - RNA, 64 nt, Homo Sapiens
uuccagaagaagagaagcugguuuguuucaagaaccuggaaaaaauuuguuuguuuguuugucu

SEQ ID NO: 145197 - RNA, 64 nt, Homo Sapiens
guaguagcucucuguagcaucuguuaaccuacuuccuggaaaaaauuguccuuuuucuuucuag

SEQ ID NO: 145198 - RNA, 64 nt, Homo Sapiens
aagauuuguaaaaucaccgguuguagacuuuacaccuggaaaaaucucuaauuuuuuggaauuu

SEQ ID NO: 145199 - RNA, 64 nt, Homo Sapiens
cccggcccacgcgugcugcagcagauguggggagccuggaaacaacacccggcccacgcgugcu

SEQ ID NO: 145200 - RNA, 64 nt, Homo Sapiens; identical to SEQ ID NO: 145199

SEQ ID NO: 145201 - RNA, 64 nt, Homo Sapiens
cccggcccacgcgugcugcaugugacguggggagccuggaaacaugcgaggcagaguuaagacc

SEQ ID NO: 145202 - RNA, 64 nt, Homo Sapiens
aauuagaguaaaaaucaguguaaauccaaaguaaccuggaaaaacuagaaaaagaagagcaaau

SEQ ID NO: 145203 - RNA, 64 nt, Homo Sapiens
ggcccacacauacagcccagcuccaagacagggcccuggaaagaauuuucuuuaagcagcugcu

SEQ ID NO: 145204 - RNA, 64 nt, Homo Sapiens
augaagcccuuggugaugaggacauagcaucugcccuggaaaucguuauuccaacauaauauua

SEQ ID NO: 145205 - RNA, 64 nt, Homo Sapiens
gccccaagagaauaccaagacaagcaggcuguucccuggaaaaaaucuaaugcaaggagggcua

SEQ ID NO: 145206 - RNA, 64 nt, Homo Sapiens
cagcagaauccagaguuggauuguaguuuaccuuccuggaaagcucauuaucucuguuugaauu

SEQ ID NO: 145207 - RNA, 64 nt, Homo Sapiens
auaucaaguaacaauaugauuuaaagcuuuggugccuggaaacagaauaugaauggauuaaaug

SEQ ID NO: 145208 - RNA, 64 nt, Homo Sapiens
cugcaggaacuaggcacaaguucucugggguuccccuggaaaggccgucgcuguggggguuuuu

SEQ ID NO: 145209 - RNA, 64 nt, Homo Sapiens
uuuguuugcauaggaauucaugaaggcgacccaaccuggaaaaagaacuauucacuuuggccau

SEQ ID NO: 145210 - RNA, 64 nt, Homo Sapiens
gauauuaauaccagaccaaagacauuuucuguuuccuggaaaaaaaaaaugaaucauguuaggc

SEQ ID NO: 145211 - RNA, 64 nt, Homo Sapiens
caucuuucuucaucuuucccucgggagcccaugcccuggaaaucgagcgaggggcagauucuag

SEQ ID NO: 145212 - RNA, 64 nt, Homo Sapiens
ucuggucugagugugacuuguccaucuuccaaucccuggaaaagcugcaccuccuuucccucuc

SEQ ID NO: 145213 - RNA, 64 nt, Homo Sapiens
gugugauuagaacacugaucccauuuggcuucggccuggaaauagugucauguuagcugaguca

SEQ ID NO: 145214 - RNA, 64 nt, Homo Sapiens
ccacgauggcugcugaauucgccucagggacaggccuggaaaggggccaggggaaacugggggg

SEQ ID NO: 145215 - RNA, 64 nt, Homo Sapiens
ugcauuuugcagaaacuuuuggguuagggcagggccuggaaaugcacuuagggaucucccagcu

SEQ ID NO: 145216 - RNA, 64 nt, Homo Sapiens
gcaugaauaaaacacucauccucugacaucccuuccuggaaacaaaggguuucgacugguccag

SEQ ID NO: 145217 - RNA, 64 nt, Homo Sapiens
ggucccaguccaucuccuggaggcggacagauggccuggaaaccucuggcuaaucgggccaucc

SEQ ID NO: 145218 - RNA, 64 nt, Homo Sapiens
aagagacagcgacccaaagccgaaggacagguggccuggaaagaucccgcccaggucugggagc

SEQ ID NO: 145219 - RNA, 64 nt, Homo Sapiens
guagaauuaagaccugaggaagaccucuugagcuccuggaaauauuuggugacaugauucauac

SEQ ID NO: 145220 - RNA, 61 nt, Homo Sapiens
acaacuggguaugcaucagggaaagucuucaccuggaaaucgcuauaaagccagugacuga

SEQ ID NO: 145221 - RNA, 64 nt, Homo Sapiens
gcauuggcauuauuuucaaugcuccucaauacuaccuggaaaaaacaaacaagcacucagccca

SEQ ID NO: 145222 - RNA, 64 nt, Homo Sapiens
gccagaguuggcuaugccuugagaucaggaccaaccuggaaaauccuacagacuaccaccuuuc

SEQ ID NO: 145223 - RNA, 64 nt, Homo Sapiens
ucucaaauguaugucucuuacguaacauacucuaagaaugaaacugucaccacagguaaauccu

SEQ ID NO: 145224 - RNA, 64 nt, Homo Sapiens
gucauuacaugucaaauucaauuuuucugccuuaagaaugaauguccuucauaaaauauuggau

SEQ ID NO: 145225 - RNA, 64 nt, Homo Sapiens
ugaaggggaugauccuaauggaauucacuuauugagaaugaaaguaggcaauaacaguaauagg

SEQ ID NO: 145226 - RNA, 64 nt, Homo Sapiens
cuuuucaaauauaaaacuauauguuuauguuuuaagaaugaacaaaagcucugcuguauuuuaa

SEQ ID NO: 145227 - RNA, 64 nt, Homo Sapiens
cuaauauaggaacaagacucaauauuaauugucuagaaugaaaguuauugccuuucccuauaua

SEQ ID NO: 145228 - RNA, 64 nt, Homo Sapiens
gaaacauuuagcuaguaacgguuagaauugcaauagaaugaagauacuaauaaauucauuguau

SEQ ID NO: 145229 - RNA, 64 nt, Homo Sapiens
uugcaaauauuuguaaguaaacaugaguacuauaagaaugaauugucaauucaaguacaaaacu

SEQ ID NO: 145230 - RNA, 64 nt, Homo Sapiens
agaaguagagaagaaagacuaaagugacacaaagagaaugaagcacccaggagguacacauacu

SEQ ID NO: 145231 - RNA, 64 nt, Homo Sapiens
gaaaaacugaauuuuuuuuuuuuaaaaugugcaaagaaugaaguucuaaacauucuaaucaaau

SEQ ID NO: 145232 - RNA, 64 nt, Homo Sapiens
gugcuuauuucuaaacauucccugucauuuuuauagaaugaaaugcgugagccacugugccuga

SEQ ID NO: 145233 - RNA, 64 nt, Homo Sapiens
cugguuggaaacuaaagguugcccgggucugcagagaaugaaaagcaguuuuuauaaaaagaaa

SEQ ID NO: 145234 - RNA, 64 nt, Homo Sapiens
ggcacaugcuuuuauccguguaacaucccagagaagaaugaaaauuuagagcguguugcuguug

SEQ ID NO: 145235 - RNA, 64 nt, Homo Sapiens
ggaaauaacacauacccuaaucuuuugauaguauagaaugaaggugaaaagguaauacaagacu

SEQ ID NO: 145236 - RNA, 64 nt, Homo Sapiens
auucuuuguaggcgccaucauauuggugaagaaaagaaugaaugggaaagccaagaacagccuu

SEQ ID NO: 145237 - RNA, 64 nt, Homo Sapiens
aagcaacaaggaagagagacacucauuauuuuagagaaugaauguguuucaucugccuaggccu

SEQ ID NO: 145238 - RNA, 64 nt, Homo Sapiens
acagaaaaaaaaaagagagaguccugccagaaagagaaugaaugcccucucacacagacgugac

SEQ ID NO: 145239 - RNA, 64 nt, Homo Sapiens
uuggaaaaaggaaaaaaaaagcgggccaaccccgagaaugaagagacauggagugacuaucggg

SEQ ID NO: 145240 - RNA, 64 nt, Homo Sapiens
acuauaaccaguuguugagggguauacuagaagcagaaugaaaccacauuuuuugguuugauaa

SEQ ID NO: 145241 - RNA, 64 nt, Homo Sapiens
uaucgguauuuuaacugaauuuacccauugacuaagaaugaaccagauuugguggugguuuugu

SEQ ID NO: 145242 - RNA, 64 nt, Homo Sapiens
gacugaaacaaugagaaagauuuuuaauuuuccuagaaugaaguccucaauuuaauuguguggg

SEQ ID NO: 145243 - RNA, 64 nt, Homo Sapiens
agauguuuguguggguuuuguuaccccagcgagcagaaugaagaacucugaugccccagcacag

SEQ ID NO: 145244 - RNA, 64 nt, Homo Sapiens
aggagcugucaaauggacacuuaauuaugacaugagaaugaagaaauuauuuuggaaaaaaaaa

SEQ ID NO: 145245 - RNA, 64 nt, Homo Sapiens
auugcaaccaguuugguaaugcaaacagcagaauagaaugaaaucucaguaaugaauuaaagca

SEQ ID NO: 145246 - RNA, 64 nt, Homo Sapiens
augccuuauuugaaacugggcuuaaacugcaaaaagaaugaaguuggauuuaggaagcuguuag

SEQ ID NO: 145247 - RNA, 64 nt, Homo Sapiens
cugaaugcaaucauuaacuugguugcuaauuacaagaaugaaaauuauaauggaaaaggacaaa

SEQ ID NO: 145248 - RNA, 64 nt, Homo Sapiens
ucagcaacuucuagcauauaguuuucuugguggcagaaugaaaauucccauaaauaaaaguaca

SEQ ID NO: 145249 - RNA, 64 nt, Homo Sapiens
gaaguauaaaguaacccauaagagcaauucugggagaaugaaagaaugacgacaccuagcucua

SEQ ID NO: 145250 - RNA, 64 nt, Homo Sapiens
caaggaggguguaaguuuaggggacaaagaagaaagaaugaauaauacgagcagacauucucug

SEQ ID NO: 145251 - RNA, 64 nt, Homo Sapiens
cgagcagacauucucuguagaagguaauggucugagaaugaaaagguguuugauggacauguug

SEQ ID NO: 145252 - RNA, 64 nt, Homo Sapiens
acuuauacugacuuucaucugggaagacaaaacaagaaugaaacacuaagacauaugcauuuau

SEQ ID NO: 145253 - RNA, 64 nt, Homo Sapiens
aucccccaaaaugcauuuagaaauauuuucuaagagaaugaauucacauuguauuuuugucuuc

SEQ ID NO: 145254 - RNA, 64 nt, Homo Sapiens
uguaccuauaaagcauaaggacaagcauugcuucagaaugaauuaaauguaaauuaaaauuucc

SEQ ID NO: 145255 - RNA, 64 nt, Homo Sapiens
ggauaaagguuuugguauuugcccacuucuagauagaaugaaugaaaacaacacaagcguuuua

SEQ ID NO: 145256 - RNA, 64 nt, Homo Sapiens
gauccucuguucuggaagcuuugaaauuuaucagagaaugaagucauucaguacaucugauaaa

SEQ ID NO: 145257 - RNA, 64 nt, Homo Sapiens
augguuggaaaacugaggaaugaaaguaguagucagaaugaauuuugguucuuuaaaauauauc

SEQ ID NO: 145258 - RNA, 64 nt, Homo Sapiens
auguaucccuucucuuuugggggaucgugauuucagaaugaauuaccuuuucugugaggaggag

SEQ ID NO: 145259 - RNA, 64 nt, Homo Sapiens
aaaacaggaauuugguuuucugucuucccaggagagaaugaagcaacuaacccuuccuuguauc

SEQ ID NO: 145260 - RNA, 64 nt, Homo Sapiens
uuauauguaagcuuuuaagcguggcguuuuucuaagaaugaaaaaaaaauccaggauccaaaau

SEQ ID NO: 145261 - RNA, 64 nt, Homo Sapiens
ccugcuagcacuagcguggacacuagcguggucuagaaugaaggguagaaugaaggccugcuag

SEQ ID NO: 145262 - RNA, 64 nt, Homo Sapiens
ccugcuagcacuagcgugguuguuaagcuugaguagaaugaagguuaauucccuggauuuaucc

SEQ ID NO: 145263 - RNA, 64 nt, Homo Sapiens
agaaagcaccaagucuuaauggaacaaagaccauagaaugaauuauuuuaucuccucccaugau

SEQ ID NO: 145264 - RNA, 64 nt, Homo Sapiens
ccagucugaauagaucuuguaaauauuugugaauagaaugaauaccuuucaugccacugcagcc

SEQ ID NO: 145265 - RNA, 64 nt, Homo Sapiens
aaugucccuggaacacgcauacaggcucuagucaagaaugaauuagagugaaggaaagcugugu

SEQ ID NO: 145266 - RNA, 64 nt, Homo Sapiens
uuccaguccaaagcuuuauuugccaaguuuucuuagaaugaauuuuaccaauuuaugaauucuu

SEQ ID NO: 145267 - RNA, 64 nt, Homo Sapiens
uuaccaauuuaugaauucuuugccaaguuuucuuagaaugaauuuuccaguccaaagcuuuauu

SEQ ID NO: 145268 - RNA, 64 nt, Homo Sapiens
agagugaaggaaagcuguguacaggcucuagucaagaaugaauuaaugucccuggaacaggcau

SEQ ID NO: 145269 - RNA, 64 nt, Homo Sapiens
uuaccaauguaugaguucuuugccaaguuuucuuagaaugaauuuuccaggccaaagcguuauu

SEQ ID NO: 145270 - RNA, 64 nt, Homo Sapiens
agagugaaggaaagcuguguacaggcucuagucaagaaugaauuaaugucucugaaacaggcau

SEQ ID NO: 145271 - RNA, 64 nt, Homo Sapiens
uucuuugguuguuuuauauaaauacuuacuaagaagaaugaaaacacgccuagaauguauuuua

SEQ ID NO: 145272 - RNA, 64 nt, Homo Sapiens
uuucauuaauauuaaaauuggucacuucaaacucagaaugaaauggucagacccuugaagaaac

SEQ ID NO: 145273 - RNA, 64 nt, Homo Sapiens
uagugguuuuuaaagaguuagggacuuguccacaagaaugaaaguuuuggcaauucuuccacgu

SEQ ID NO: 145274 - RNA, 64 nt, Homo Sapiens
caguugcauugauucagugcagagagaaagagagagaaugaaugugggcagaggugagagagag

SEQ ID NO: 145275 - RNA, 64 nt, Homo Sapiens
ugggaacacgucauugauagaaugaguuacacugagaaugaauauuacagaaaaugaaaaagaa

SEQ ID NO: 145276 - RNA, 64 nt, Homo Sapiens
uguuuuuuugaggucggaaaacagauggaaauacagaaugaauauaggauuucuucugggaaau

SEQ ID NO: 145277 - RNA, 64 nt, Homo Sapiens
guugagcugauauauguuaagcagauauucaaucagaaugaacagguuccggugguuauuuugc

SEQ ID NO: 145278 - RNA, 64 nt, Homo Sapiens
auaaacaaaauuacagacugucugaaauugaagaagaaugaacuaauaauagcauucauaacca

SEQ ID NO: 145279 - RNA, 64 nt, Homo Sapiens
aucauggguccugaugguuuuaaccaugccagccagaaugaagccaaggcaagagaaguggcuu

SEQ ID NO: 145280 - RNA, 64 nt, Homo Sapiens
uuuguaauugaaagaaaaagggaaaauaugcuacagaaugaaaguaggaagugguucuccuacu

SEQ ID NO: 145281 - RNA, 64 nt, Homo Sapiens
guaauaacucuuccugcuauucagaauaaguaggagaaugaaaacugcagcauaucagacagca

SEQ ID NO: 145282 - RNA, 64 nt, Homo Sapiens
cauguaauaaacuauucuuugaaacuuguuggguagaaugaaaauuaaagccauaaugguagaa

SEQ ID NO: 145283 - RNA, 64 nt, Homo Sapiens
agcuuuaaaaauagccuuaacuccccacgaccccagaaugaaacaaguuuuaaaaacuuucucg

SEQ ID NO: 145284 - RNA, 64 nt, Homo Sapiens
gacuuugauuccugcgccuucagagaaagagaauagaaugaaaugacuccugagggcuagagga

SEQ ID NO: 145285 - RNA, 64 nt, Homo Sapiens
gagcaauuuggagaauguauagacucucagguauagaaugaacugcaaaaugugaaaagacaca

SEQ ID NO: 145286 - RNA, 64 nt, Homo Sapiens
caagguuuuuuugauguuacacagcuaaaguaucagaaugaaagaaccgguauugacuggauug

SEQ ID NO: 145287 - RNA, 64 nt, Homo Sapiens
gguuuccaugccugcugggaauaggcugagcaugcaaugacaugagggccaaggcuugugggaa

SEQ ID NO: 145288 - RNA, 64 nt, Homo Sapiens
aauccgagaccuguuuugcguagcuaauuaccagcaaugacaaacucccaggcucugaggccca

SEQ ID NO: 145289 - RNA, 64 nt, Homo Sapiens
ugaauuuaauuuuauaaauagccaagaauauuugcaaugacacacauccuucaggaggaucuua

SEQ ID NO: 145290 - RNA, 64 nt, Homo Sapiens
gcuugagcguuacuuccuccucuacagggaagaacaaugacacacuaacguuuaauaguccggg

SEQ ID NO: 145291 - RNA, 64 nt, Homo Sapiens
uuccccuuaccuuagccacucaacaacacaaugacaaugacaucuuaaaauaagcuauaaucag

SEQ ID NO: 145292 - RNA, 64 nt, Homo Sapiens
gacaucuuccccuuaccuuaaaucagcaacaacacaaugacaauacaaauuuaaaauaagcuau

SEQ ID NO: 145293 - RNA, 64 nt, Homo Sapiens
uccuggcuccacccuccagcauguucucacccaacaaugacaguugaguggagugggaagggaa

SEQ ID NO: 145294 - RNA, 64 nt, Homo Sapiens
aauuacaaaagggaaauuccaagaaugcauaacacaaugacaacauggugagaaaagugcagua

SEQ ID NO: 145295 - RNA, 64 nt, Homo Sapiens
ucaccaggaucacccuuaccuguuccucauuccccaaugacaccuucuuuauuucccaauagca

SEQ ID NO: 145296 - RNA, 64 nt, Homo Sapiens
aaagauuaucagauuuguccucuuuaauuauuggcaaugacaccauuuagcccaucgguugcca

SEQ ID NO: 145297 - RNA, 64 nt, Homo Sapiens
ggucguaaauuauuucuacuuauccaguaaauaacaaugacaaaauaaacaccaaugacagaaa

SEQ ID NO: 145298 - RNA, 64 nt, Homo Sapiens
cuuauccaguaaauaacaaugacaaaauaaacaccaaugacagaaaaauuucuacuuuacuguc

SEQ ID NO: 145299 - RNA, 63 nt, Homo Sapiens
gcagaaaccccugauaaacugaaaaaaugaggaagaagcaaaacacuucuuacauuguggcaa

SEQ ID NO: 145300 - RNA, 63 nt, Homo Sapiens
guggaaaccccugauaagccgagaaaaugaggaagaagcaaaacacuucuuacauggcagcaa

SEQ ID NO: 145301 - RNA, 63 nt, Homo Sapiens
guuuaaagaaauggucugcauaaccugaaugaaagaagcaaaugacuauucucugaagacaac

SEQ ID NO: 145302 - RNA, 63 nt, Homo Sapiens
augcugugguggaugagguuggaguucgaaagaagaagcaagcgcuggccuggccuugaaaga

SEQ ID NO: 145303 - RNA, 63 nt, Homo Sapiens
aauaggaauccggcagaagaccuucauuaauuaagaagcaaacaaaaagagagcaacccaacc

SEQ ID NO: 145304 - RNA, 63 nt, Homo Sapiens
uccaaacaaugugaauuuaaaaggucacacaaaagaagcaaucgggcuccgccaccacaaaau

SEQ ID NO: 145305 - RNA, 63 nt, Homo Sapiens
aagaaaaacaaaauaacaaacuauuuuuaaagcagaagcaaaaaauucacaguccucagaagc

SEQ ID NO: 145306 - RNA, 63 nt, Homo Sapiens
aucaguugguuugcuaccaccacuuaugaaaguagaagcaagaggaugauaugugggcaaaau

SEQ ID NO: 145307 - RNA, 63 nt, Homo Sapiens
uucuuacauggcggcagcaagagaaaaugagaaagaagcaaaaguggaaaccccuaauaaacc

SEQ ID NO: 145308 - RNA, 63 nt, Homo Sapiens
uucguacauggugguggcaagagaaaaugaagaagaagcaaaaguggaaaccccugauaaacc

SEQ ID NO: 145309 - RNA, 63 nt, Homo Sapiens
ggacagaccagacguuucauuuucaagaguuucagaagcaacauugacuguucuugacuaaau

SEQ ID NO: 145310 - RNA, 63 nt, Homo Sapiens
ccacuaaaagaggagaugguuucuuggcaggagagaagcaaggggacuuuuucauuccuguuu

SEQ ID NO: 145311 - RNA, 63 nt, Homo Sapiens
ucccagauauaggcugaacaaaauuuauaagguagaagcaauuaucaucuuugaaggacacuc

SEQ ID NO: 145312 - RNA, 63 nt, Homo Sapiens
auugucugcccuguuaaacuuaagugugaaugcagaagcaaauuuuuaaaaaauguaauugaa

SEQ ID NO: 145313 - RNA, 63 nt, Homo Sapiens
uaccugccagcacuucugcaagcugaaauuuacagaagcaaauucaccagaagggaaacaucu

SEQ ID NO: 145314 - RNA, 63 nt, Homo Sapiens
gcauggcaugcacguauguaaguaaucuggggaagaagcaaagaucuguuucauucuuagccu

SEQ ID NO: 145315 - RNA, 63 nt, Homo Sapiens
ggaaaacauauauauguuagcaucaaagggggcagaagcaaagaagauacagaucugcacuga

SEQ ID NO: 145316 - RNA, 63 nt, Homo Sapiens
auaaaggcuucauccacgaaccauccagcgcacagaagcaagugcaaaaaugacacaagcaca

SEQ ID NO: 145317 - RNA, 63 nt, Homo Sapiens
agccagggugugccaggagacugcuggccuuggagaagcaaaacaggugagccacucacccuc

SEQ ID NO: 145318 - RNA, 63 nt, Homo Sapiens
ucaaguccuucccauacucauguccugcugguuagaagcaaguucccuuccccucugccccag

SEQ ID NO: 145319 - RNA, 63 nt, Homo Sapiens
ugccuggaacaaagaacugcaccuaagcagaccagaagcaaaaugucuucuucacggccugag

SEQ ID NO: 145320 - RNA, 63 nt, Homo Sapiens
cagccuccagccauacagaacaaaugagaaauuagaagcaauuccaagaacgugugauggugu

SEQ ID NO: 145321 - RNA, 64 nt, Homo Sapiens
uacaucaagccagcuucauucacucacuuuacuuagaacagagauauaagggccugggaugcau

SEQ ID NO: 145322 - RNA, 64 nt, Homo Sapiens
agugagacacaagaucucucuuuuaccaaaguugagaacagagcugguggauuaauuaauaguc

SEQ ID NO: 145323 - RNA, 64 nt, Homo Sapiens
aggcaacuuaaauaacuccugagcaguuggcacuagaacagaauacuuggaaugacaccaaagu

SEQ ID NO: 145324 - RNA, 64 nt, Homo Sapiens
ugcaaagaucaugauuaacugucaagacacugguagaacagaacaagcaaaagauuaagaguuc

SEQ ID NO: 145325 - RNA, 64 nt, Homo Sapiens
ugggauuucagugaggccuuuugaucuguccaggagaacagaagggaaaaaaagauacuugaaa

SEQ ID NO: 145326 - RNA, 64 nt, Homo Sapiens
aacuaaaggccgaaagaaucucuugcugcugcaaagaacagauuuuauauuucuuccucuaauc

SEQ ID NO: 145327 - RNA, 64 nt, Homo Sapiens
uuauuuuauccugaaguaagugugcccggccaaaagaacagaaaggauuacaggugugagccac

SEQ ID NO: 145328 - RNA, 64 nt, Homo Sapiens
aaaauccugccaucuuggauacccagcagggaccagaacagaugcgcugguguguuugccagag

SEQ ID NO: 145329 - RNA, 64 nt, Homo Sapiens
cuugaaauaugcacuuagcacuuuaaacauauucagaacagaugccuuuuguaacuuacugugg

SEQ ID NO: 145330 - RNA, 64 nt, Homo Sapiens
uuacccuuucaccuaccucagcagucaccuggaaagaacagagaccagggaagccugugcagau

SEQ ID NO: 145331 - RNA, 62 nt, Homo Sapiens
ugcaaauguguuauauacaaaauaaaauaugcacagaacagaaauaaaauuuuuauuuauuc

SEQ ID NO: 145332 - RNA, 64 nt, Homo Sapiens
cuguccuucacuguaagagccaauugugacuuaaagaacagaauguuuuuugaucaguguagcu

SEQ ID NO: 145333 - RNA, 64 nt, Homo Sapiens
uggcuuucaaugaguuccuauguggauuuuuaaaagaacagaacaguaaugaaauauuugaagu

SEQ ID NO: 145334 - RNA, 64 nt, Homo Sapiens
uaaaagcuauaugcagaguuuuguauaaaacaauagaacagaaauuugggacauuuuucuagga

SEQ ID NO: 145335 - RNA, 64 nt, Homo Sapiens
ucucugugcaauaacuuguguaagagucuggcuuagaacagaccaucucacaccuccuuagcug

SEQ ID NO: 145336 - RNA, 64 nt, Homo Sapiens
auuauacagagauggaauggccguaucuuggugcagaacagauaagcugucugagucuaaagca

SEQ ID NO: 145337 - RNA, 64 nt, Homo Sapiens
cauuuaaaauggaaaagagagaaauccccccuucagaacagaggugaccagaaacagggacaaa

SEQ ID NO: 145338 - RNA, 64 nt, Homo Sapiens
gaccaaauugcuucuaggagccccugcacaguuuagaacagaggcuucuuugcagagccuuuua

SEQ ID NO: 145339 - RNA, 64 nt, Homo Sapiens
aggggaaagcaagagaggacuuuaauucuuccugagaacagaaguaaaauuccaugauuuugua

SEQ ID NO: 145340 - RNA, 64 nt, Homo Sapiens
gcacuaaaaaaauuuuuuuuuuucuagucacuuuagaacagauggguaaaaacacuauuaccug

SEQ ID NO: 145341 - RNA, 64 nt, Homo Sapiens
gaccuuacuucauuucaaaugaauuuauuacuccagaacagaaaagaauaauuauugcauagua

SEQ ID NO: 145342 - RNA, 64 nt, Homo Sapiens
ucuuucaggggaaaguagauucgguuuuugccacagaacagagacaaauugacucuucaaaccc

SEQ ID NO: 145343 - RNA, 64 nt, Homo Sapiens
agagaauucagcagcucaacaguaaugaaagugaagaacagaguccauuuuccuuccuggggcc

SEQ ID NO: 145344 - RNA, 64 nt, Homo Sapiens
uugccagucucuccagugugggcaccagccggccagaacagaugcgagcaguccaugacucugg

SEQ ID NO: 145345 - RNA, 64 nt, Homo Sapiens
gcuagguguggcugggggccaggagagcaggaacagaacagagaaaugcccuuggaagaagugg

SEQ ID NO: 145346 - RNA, 64 nt, Homo Sapiens
acacuauuuuacuuuuuuaaaaucauaaaacggcagaacagauuugguuaguuuagaagaaaag

SEQ ID NO: 145347 - RNA, 64 nt, Homo Sapiens
uacagguuauauguggcauagcauaaccacaguaagaacagaacagauauucagcagaaaacuu

SEQ ID NO: 145348 - RNA, 64 nt, Homo Sapiens
guuauauguggcauagcauaaccacaguaagaacagaacagauauucagcagaaaacuuuuuau

SEQ ID NO: 145349 - RNA, 64 nt, Homo Sapiens
ggcagaaguguggcaaaugcaucaggaaccgguuagaacagaacagagaaacccugacugucua

SEQ ID NO: 145350 - RNA, 64 nt, Homo Sapiens
aaguguggcaaaugcaucaggaaccgguuagaacagaacagagaaacccugacugucuacagau

SEQ ID NO: 145351 - RNA, 64 nt, Homo Sapiens
cguuggaagcuuaacuuuugcauuuccgguugagagaacagauuuccugauuggaaauagaaga

SEQ ID NO: 145352 - RNA, 64 nt, Homo Sapiens
gaggaaguuggccaauuacacgguugcuauuccaagaacagaaggugcuaacugcuuuuugucu

SEQ ID NO: 145353 - RNA, 64 nt, Homo Sapiens
ugguacugguaccaaaacagagauauagaucaauagaacagaacagagcccucagaaauaaugc

SEQ ID NO: 145354 - RNA, 64 nt, Homo Sapiens
cugguaccaaaacagagauauagaucaauagaacagaacagagcccucagaaauaaugccacau

SEQ ID NO: 145355 - RNA, 64 nt, Homo Sapiens
ugagauuugacaaaaaaaaacugugaaaacuaggagaacagagacuuuauuccuguaaauauuu

SEQ ID NO: 145356 - RNA, 64 nt, Homo Sapiens
gaggaaaugugucucccucccaccacugugcaggagaacagacagucuccugugggcuuuuuac

SEQ ID NO: 145357 - RNA, 64 nt, Homo Sapiens
gccaaaacccuuacucacaugaggauggaggaacagaacagaggacuugggaaaagucucaacu

SEQ ID NO: 145358 - RNA, 64 nt, Homo Sapiens
uauguacuuagaauagguuuugaaugggagagguagaacagagagagaauuaagaagggaucug

SEQ ID NO: 145359 - RNA, 64 nt, Homo Sapiens
uuccaggggggugaguucaugccucuccuguauuuuccagcaagugggguauguguggugguuu

SEQ ID NO: 145360 - RNA, 64 nt, Homo Sapiens
guagagcagaagggagggcuugggacuccugucuuuccagcaugcccuggggugcaguggucag

SEQ ID NO: 145361 - RNA, 64 nt, Homo Sapiens
cacagcuaagagauaagaagaucuuucuccuuucuuccagcacaccagaacgauaugucugucc

SEQ ID NO: 145362 - RNA, 64 nt, Homo Sapiens
aauacccuauccccgcacuugugcagugcaacaauuccagcaaaccccuguguuguuacaggcu

SEQ ID NO: 145363 - RNA, 64 nt, Homo Sapiens
ugaguuguguguggcagcagacuguagaaaaauauuccagcacuauaauccguagaacagagag

SEQ ID NO: 145364 - RNA, 64 nt, Homo Sapiens
cuaacugugcucugcuccagauggcaucugaauguuccagcagccaauuuaaggccugucugua

SEQ ID NO: 145365 - RNA, 64 nt, Homo Sapiens
cugaaaccuaaauauguuauucugaaaucuauuauuccagcaguagauuauuagauuccagcaa

SEQ ID NO: 145366 - RNA, 64 nt, Homo Sapiens
cugaaaucuauuauuccagcggcagauuauuagauuccagcaaugugugucagucaucuucaaa

SEQ ID NO: 145367 - RNA, 64 nt, Homo Sapiens
aacagcugggguuccaggcaugguuuaggcccuguuccagcaauaagaaccaaucugcuguaca

SEQ ID NO: 145368 - RNA, 64 nt, Homo Sapiens
gggacagugucuucguuugauuacugccaguuauuuccagcaugcuaaaucccuacccacguuc

SEQ ID NO: 145369 - RNA, 64 nt, Homo Sapiens
cuucagggugggguggucucugauagguagcauuuuccagcacuuugcaaggaauguuuuguag

SEQ ID NO: 145370 - RNA, 64 nt, Homo Sapiens
uugcucacagcugugcucugagugccuagcggaguuccagcaaacaaaauggacucaagagaga

SEQ ID NO: 145371 - RNA, 64 nt, Homo Sapiens
uccuucccuccguggcguagggagcacuguuucuuuccagcaagccuguucagguuuggccagg

SEQ ID NO: 145372 - RNA, 64 nt, Homo Sapiens
acaccuucuugcagagugauuuugaccaaugccuuuccagcaccuuccccugguuaugacaggg

SEQ ID NO: 145373 - RNA, 64 nt, Homo Sapiens
gcaggaaaacaaacaaaagucuguagaaauauuauuccagcauaacacacacaaaaaaaaauac

SEQ ID NO: 145374 - RNA, 64 nt, Homo Sapiens
gcccucuacccagaacauccuggcccagagaagcuuccagcacaccucccuacagccgggggug

SEQ ID NO: 145375 - RNA, 64 nt, Homo Sapiens
uguuguuguuuuacucaccuugggaacagagcauuuccagcauugucuuggaacucccuggcau

SEQ ID NO: 145376 - RNA, 64 nt, Homo Sapiens
gcuggggcccagcuggggggcaccugccggcugguuccagcagcgaggugcugcuuuucugccc

SEQ ID NO: 145377 - RNA, 64 nt, Homo Sapiens
aacuguuagugacugguuuccuguuagauaaggguuccagcagccuggggcaguaugucucagc

SEQ ID NO: 145378 - RNA, 64 nt, Homo Sapiens
guggaaguaaagacuuuggagcuagagaagccuuuuccagcaaugauuauugacuucaccacac

SEQ ID NO: 145379 - RNA, 64 nt, Homo Sapiens
guggcccagugcgugaggucagucaacagccaaauuccagcagcaaaauacauuuucaucaaua

SEQ ID NO: 145380 - RNA, 64 nt, Homo Sapiens
agaagucaccacggaagguuguuuaagaugcagauuccagcauccccuccucagagaucaauuu

SEQ ID NO: 145381 - RNA, 64 nt, Homo Sapiens
uuuccacuuuaggccaauuuuucucucuuagaucuuccagcagccccagggguaggaagcuccu

SEQ ID NO: 145382 - RNA, 64 nt, Homo Sapiens
acgggcacgugcccuucaccccauuccacccuuguuccagcaagacugggauggguacaacuga

SEQ ID NO: 145383 - RNA, 64 nt, Homo Sapiens
gugcuuuuucccugggcuuauuguaccgcauucuuuccagcauuaaaucuuuucuccucucccg

SEQ ID NO: 145384 - RNA, 64 nt, Homo Sapiens
cagagaucccagccccuauguuccauuuuccaaauuccagcacacauuuagccuguagauuuau

SEQ ID NO: 145385 - RNA, 64 nt, Homo Sapiens
gucuaggcagucgucugccacaucacuggagguauuccagcagaugugaagguagugagugccc

SEQ ID NO: 145386 - RNA, 64 nt, Homo Sapiens
ugaaacucuucaauguuugacuauacaaagggcauuccagcagccaauuggguucauuuaugcc

SEQ ID NO: 145387 - RNA, 64 nt, Homo Sapiens
cuuuuggauggaagauaagauagggaagauuaaguuccagcauuucugacuuguuauuuugagu

SEQ ID NO: 145388 - RNA, 64 nt, Homo Sapiens
aggcaaucaaugauagguuuauaaucuuagauuauuccagcaaaguguggauugcauuguuagg

SEQ ID NO: 145389 - RNA, 64 nt, Homo Sapiens
aggcaucuugaaucccaucuauaagaacacaaucuuccagcauacguuugcuuuuucagaaacu

SEQ ID NO: 145390 - RNA, 64 nt, Homo Sapiens
auggguccugacucaaaaccgagacauacacacuuuccagcaaguaaaaucaaaaucugagucu

SEQ ID NO: 145391 - RNA, 64 nt, Homo Sapiens
ugaaggugggucacagguaucugugacgcugacuuuccagcacggaacgugucucucuccaagu

SEQ ID NO: 145392 - RNA, 64 nt, Homo Sapiens
uuucucauuugauuuugcuugugcagaaaauaguuuccagcacauggauugaucugagagagaa

SEQ ID NO: 145393 - RNA, 64 nt, Homo Sapiens
ccaaacggaagaauagccagcggagcauggacuguuccagcacgggccagauggccagcugucg

SEQ ID NO: 145394 - RNA, 64 nt, Homo Sapiens
cucacucagcacgcucacuaacccagcaugccacuuccagcaggcaugcaguccuggcccagcu

SEQ ID NO: 145395 - RNA, 64 nt, Homo Sapiens
cuuggguucuugcaagagcgcguggggacaguucuuccagcaggcacugguuuuguugccccag

SEQ ID NO: 145396 - RNA, 64 nt, Homo Sapiens
gcucaaccuccucaucgccauguucaacuacaccuuccagcaggugcaggagcacacggaccag

SEQ ID NO: 145397 - RNA, 64 nt, Homo Sapiens
cuaccugaaggagaacuaccuccagaaccgacaguuccagcaaaagcagcggcccgagcagaag

SEQ ID NO: 145398 - RNA, 64 nt, Homo Sapiens
uuaaguugucuuuguagaaaaugaagagccuuucuuccagcaaaaaucccugcuguaugcaaua

SEQ ID NO: 145399 - RNA, 64 nt, Homo Sapiens
ggaucuagggcagacacacaaccuccuccuccucuuccagcaaggaacgcaccgaaaagucaca

SEQ ID NO: 145400 - RNA, 64 nt, Homo Sapiens
aaccguuuuucaagaaaacuggaaaucuggauuuucagcgaacaugccugauuuuaaaagguug

SEQ ID NO: 145401 - RNA, 64 nt, Homo Sapiens
ccccaguugaaaucuuugcaaaggucgguucuauucagcgaacagcacuauagcaaaagaagau

SEQ ID NO: 145402 - RNA, 64 nt, Homo Sapiens
caacugccuugggugaaaaucagaagcaagcaacucagcgaaaaacucagaagguuuggguaca

SEQ ID NO: 145403 - RNA, 64 nt, Homo Sapiens
ccuuuacaauuuccuaugggugucagaaguacucucagcgaaaacugauggcuaaaacaguauc

SEQ ID NO: 145404 - RNA, 64 nt, Homo Sapiens
acaaaaucaucuuugugaaguucacuucacgcuuucagcgaauggagcaagaggaggccguuga

SEQ ID NO: 145405 - RNA, 64 nt, Homo Sapiens
cccuuucuugccaguacauccaaguuuaaaauuaucagcgaaaugguccauguuuuuccaauua

SEQ ID NO: 145406 - RNA, 64 nt, Homo Sapiens
gcauuuaaagggacucaaggugccugccacuuccucagcgaagaagucuguguuccuccccguc

SEQ ID NO: 145407 - RNA, 64 nt, Homo Sapiens
gggccaagcaccuagccucgcucuuggcagguacucagcgaaugaaugcuguauauguugggug

SEQ ID NO: 145408 - RNA, 64 nt, Homo Sapiens
cuauacuaagacuuggaaauuauucucuccagugucagcgaauccagaaggguaucagauuaaa

SEQ ID NO: 145409 - RNA, 64 nt, Homo Sapiens
agugggguggcuguucucuguccucagaauguuuucagcgaaagcaggauaacagcuugcaccc

SEQ ID NO: 145410 - RNA, 64 nt, Homo Sapiens
acuaggcccccuuuuuaaaagucucucuuccuccucagcgaaccaaaaagaacacacauuuaga

SEQ ID NO: 145411 - RNA, 64 nt, Homo Sapiens
ugaaaugugcgcuaaacgggucuccccaaagccuucagcgaacgucauaagcucuguuuccccc

SEQ ID NO: 145412 - RNA, 64 nt, Homo Sapiens
ccauuuccuaccccugccauuucccaccccugcuucagcgaaagggacucucuaacagggcagu

SEQ ID NO: 145413 - RNA, 64 nt, Homo Sapiens
guauauagagugguuucagauuguaaauagcgcgucagcgaacuugucuaaaucauauauuuuu

SEQ ID NO: 145414 - RNA, 64 nt, Homo Sapiens
caucugcagugcuuaaguacuuagcaaaaucuauucagcgaaaccacaccacuuaguuucuccc

SEQ ID NO: 145415 - RNA, 64 nt, Homo Sapiens
auauuuuuacuauucuuggaaaccccaaaugcaaucagcgaaacagacacuuacuuauuauuaa

SEQ ID NO: 145416 - RNA, 64 nt, Homo Sapiens
aaaugaaacccaaaacucucguaaagaaaauaagucagcgaaaacuguuccuuuauguaaacau

SEQ ID NO: 145417 - RNA, 64 nt, Homo Sapiens
cuugcugggaaccgcugagcccuaggacagagacucagcgaaccagcauacccagcucggaccu

SEQ ID NO: 145418 - RNA, 64 nt, Homo Sapiens
uuaaaaaagacaagaaacuaugcaaacugucgauucagcgaaacccacagaauauagcacguug

SEQ ID NO: 145419 - RNA, 64 nt, Homo Sapiens
gcugugcucuuuucugacuaacccugggggacuuucagcgaagaguaguggcuugaugcaggga

SEQ ID NO: 145420 - RNA, 64 nt, Homo Sapiens
caaauggucugacuucuuuagcccucugaggcagucagcgaagguuguaggugacacaugcucu

SEQ ID NO: 145421 - RNA, 64 nt, Homo Sapiens
gaaaaggaggcucagcacugucucaggcuggaggucagcgaaccucgugggcuguaggaaagca

SEQ ID NO: 145422 - RNA, 64 nt, Homo Sapiens
uuacucugagcucccaguucgugguuuccuguuuucagcgaaauacugaacgcaucugggcuuc

SEQ ID NO: 145423 - RNA, 64 nt, Homo Sapiens
ggcaaguuuuuuucuucaccuucaauaugagaauucagcgaacuugaaagaaaaaucaucugug

SEQ ID NO: 145424 - RNA, 64 nt, Homo Sapiens
ugguuccugcuguuuauucucuggucaugccuuuucagcgaaagccugucuccucacccacccc

SEQ ID NO: 145425 - RNA, 64 nt, Homo Sapiens
ucaguguauuuaguguaauugucccuucuauuuuucagcgaagggcuggcuucuguagccaccu

SEQ ID NO: 145426 - RNA, 64 nt, Homo Sapiens
aggagaagugaaagacuuccagguggacagccuuucagcgaaguuacaagcugacauucaacca

SEQ ID NO: 145427 - RNA, 64 nt, Homo Sapiens
gggccccgugaggagggcgggcaggccugggccaucagcgaacuggggguggcugcucuuccug

SEQ ID NO: 145428 - RNA, 64 nt, Homo Sapiens
cgggaggaaagauuucgauugggcgugaggcugaucagcgaagacagcugugccccucccccag

SEQ ID NO: 145429 - RNA, 64 nt, Homo Sapiens
ucugcuaaccccuuacauucgcucugagguggcuucagcgaaagccacacacuugcacacccca

SEQ ID NO: 145430 - RNA, 64 nt, Homo Sapiens
ccucagccuuaaacuuuuguuccuacucccacccucagcgaacugggcagcacggggaggguuu

SEQ ID NO: 145431 - RNA, 64 nt, Homo Sapiens
cucaagacaagccaggcauguaaucugcauucauucagcgaauggguaagucuguuguucugau

SEQ ID NO: 145432 - RNA, 64 nt, Homo Sapiens
cucaugggaagcaggaccuaguggcugggcggauucagcgaagugcugggaaggggugaagugu

SEQ ID NO: 145433 - RNA, 64 nt, Homo Sapiens
guccaguucaggcuucuagacauuuuacucaugcucagcgaaggcugguuccugguccccuggg

SEQ ID NO: 145434 - RNA, 64 nt, Homo Sapiens
ugccuuuuuguccuguccucagcucuccguguggucagcgaaaccauuguuuucuguuaggacu

SEQ ID NO: 145435 - RNA, 64 nt, Homo Sapiens
uuguggguggggagcaagggaagagagaaacucuucagcgaauccuucuaguacuaguugagag

SEQ ID NO: 145436 - RNA, 64 nt, Homo Sapiens
gagaggagcuuucagaaaaauuucaaagaacuuuucagcgaagguacaacacccacguuguuua

SEQ ID NO: 145437 - RNA, 64 nt, Homo Sapiens
gaaggcuggcacaaggagaaaaaaaaagcaagcaucagcgaauaguauagugucucaggguccg

SEQ ID NO: 145438 - RNA, 52 nt, Homo Sapiens; identical to SEQ ID NO: 119717

SEQ ID NO: 145439 - RNA, 64 nt, Homo Sapiens; identical to SEQ ID NO: 119718

SEQ ID NO: 145440 - RNA, 64 nt, Homo Sapiens; identical to SEQ ID NO: 119719

SEQ ID NO: 145441 - RNA, 64 nt, Homo Sapiens; identical to SEQ ID NO: 119720

SEQ ID NO: 145442 - RNA, 64 nt, Homo Sapiens; identical to SEQ ID NO: 119721

SEQ ID NO: 145443 - RNA, 64 nt, Homo Sapiens; identical to SEQ ID NO: 119722

SEQ ID NO: 145444 - RNA, 64 nt, Homo Sapiens; identical to SEQ ID NO: 119723

SEQ ID NO: 145445 - RNA, 64 nt, Homo Sapiens; identical to SEQ ID NO: 119724

SEQ ID NO: 145446 - RNA, 64 nt, Homo Sapiens
guggguaaccagugccuucccuguaacgguaaugcugcagaacugcaaccuuuuguaccuuucu

SEQ ID NO: 145447 - RNA, 64 nt, Homo Sapiens
cuguuagcuggcagggucaggcuuagcuccuugacugcagaagaccaagaaccuguuccccaag

SEQ ID NO: 145448 - RNA, 64 nt, Homo Sapiens
aggcucccucugccacgguccagaaagcugcugacugcagaacuucugcaggaagccacuaugc

SEQ ID NO: 145449 - RNA, 64 nt, Homo Sapiens
caagagccacuuguagcuggcaguuaggauccugcugcagaaaagucagacuuggcaucuaucu

SEQ ID NO: 145450 - RNA, 64 nt, Homo Sapiens
aagaaagaauauaauaugacaaaacacuuuacuacugcagaaggaaaaaaacugaguaugaaga

SEQ ID NO: 145451 - RNA, 64 nt, Homo Sapiens
ucuucaguaugauguucuccgugauccuugcucccugcagaacuacaucgaaaccagggagaaa

SEQ ID NO: 145452 - RNA, 64 nt, Homo Sapiens
uuuuuuugucguguaagaaggaugcuggucagagcugcagaaaauaugaggcaauuaaaagucu

SEQ ID NO: 145453 - RNA, 64 nt, Homo Sapiens
guuagaaauauauuggcagccaagacucugaacucugcagaaacauuuguuucacccagacuuc

SEQ ID NO: 145454 - RNA, 64 nt, Homo Sapiens
cgauuuuuacugagaagagauaugccuguuguuacugcagaaccugaaccguaaguaggaugac

SEQ ID NO: 145455 - RNA, 64 nt, Homo Sapiens
uuaagcauaaaaagaaagggaaaaagcagaaacacugcagaagacacaaacaaacaaagaagag

SEQ ID NO: 145456 - RNA, 64 nt, Homo Sapiens
uuaggagaaaaugacucuuucguccagaagagcucugcagaaccagggcucccguuuaucuugu

SEQ ID NO: 145457 - RNA, 64 nt, Homo Sapiens
ugcuauauaauucagcaaguaccaacuuguguagcugcagaauaaccaaguggcuauccaguca

SEQ ID NO: 145458 - RNA, 64 nt, Homo Sapiens
gcacuugacugcugggcauguccugcuugauguucugcagaaugccuguggucugugauaccca

SEQ ID NO: 145459 - RNA, 64 nt, Homo Sapiens
aagccagugcacaugguauucguuuccauugccacugcagaaugaugcaugucaucuaugcaag

SEQ ID NO: 145460 - RNA, 64 nt, Homo Sapiens
guucugguucccaaagucauugauauucagacaucugcagaaaugccuuuuagagauagguucu

SEQ ID NO: 145461 - RNA, 64 nt, Homo Sapiens
cagugugauuguaacaaaaauuauuugauuucugcugcagaaggcaauggcuaauuagaaugug

SEQ ID NO: 145462 - RNA, 64 nt, Homo Sapiens
uuacugagcuguuguuacccuuuuuuccaugaaucugcagaaaaaagggauaucuuuuuuauau

SEQ ID NO: 145463 - RNA, 64 nt, Homo Sapiens
uauugguccagcuugcucuuuuguuugauuuuagcugcagaacgaagggucuagggagagaccc

SEQ ID NO: 145464 - RNA, 64 nt, Homo Sapiens
gcauauauaucgcuuaaucuagccacguuccuuacugcagaauacagguggaaaaacaucugaa

SEQ ID NO: 145465 - RNA, 64 nt, Homo Sapiens
aaugucguaggugauagaaaacucgccuacuccacugcagaacuugcagaaugcgugguguuaa

SEQ ID NO: 145466 - RNA, 64 nt, Homo Sapiens
agucagagauaauugccuauacuaagaaucuauacugcagaauauaguguaucaaaaacuuuuu

SEQ ID NO: 145467 - RNA, 64 nt, Homo Sapiens
ugcagaaaagaaacauguuaaaaucauggcacaccugcagaauuucagaugacaguguggucag

SEQ ID NO: 145468 - RNA, 64 nt, Homo Sapiens
gauguaccaugaacuaacaauucuuugaaaggaccugcagaagcauuuuuaauaccucauucug

SEQ ID NO: 145469 - RNA, 64 nt, Homo Sapiens
gaaacucaugucauguuuaucccauuugcauuaucugcagaagaauuauguuaagagucuuuaa

SEQ ID NO: 145470 - RNA, 64 nt, Homo Sapiens
uccuuaugaugauugugugcucuugaaaaagcaacugcagaaauuaaaggacuggggaggcgug

SEQ ID NO: 145471 - RNA, 64 nt, Homo Sapiens
ccccaucucucagaugcacgggaacaagcagcaccugcagaaggacuucuuccuguacaacgcc

SEQ ID NO: 145472 - RNA, 64 nt, Homo Sapiens
agcgagugcuccugcuuaccuugcucuaggcugucugcagaagcaccugccgguggcacucagc

SEQ ID NO: 145473 - RNA, 64 nt, Homo Sapiens
ugggguaagaaagggcacauucauaugaaacaaucugcagaaagaggucacguggaggguacgu

SEQ ID NO: 145474 - RNA, 64 nt, Homo Sapiens
gagcuggagcucauggguuuagcuguuggccacgcugcagaaauuugugacaguguacaguggc

SEQ ID NO: 145475 - RNA, 64 nt, Homo Sapiens
acaccuggucuuuucuagaaaucccugcuuggagcugcagaaggguugccuucuguaggucgga

SEQ ID NO: 145476 - RNA, 64 nt, Homo Sapiens
ccagguaagccuucuaugcauccacaccaaaauccugcagaauguaaguaagcucugcuuuaua

SEQ ID NO: 145477 - RNA, 64 nt, Homo Sapiens
ggcgccaugcugcagacuccagugggccugguuucugcagaauguccaugguggccgcugcaga

SEQ ID NO: 145478 - RNA, 64 nt, Homo Sapiens
ggagcaggucuggagguuuguggaacccaguccccugcagaaucuguaaaaccuaauaaaucau

SEQ ID NO: 145479 - RNA, 64 nt, Homo Sapiens
ggaugcucaaggcccugcccugcaccaguugguccugcagaacugcugcugcagaacgcacagg

SEQ ID NO: 145480 - RNA, 64 nt, Homo Sapiens
cacaggugcaccaguuggucuggagcugcugcugcugcagaacgcuucuucccugcagacaugg

SEQ ID NO: 145481 - RNA, 64 nt, Homo Sapiens
cuggcgggcucuggucaccacucgacacugccaccugcagaagcccacagacaucuuacacuug

SEQ ID NO: 145482 - RNA, 64 nt, Homo Sapiens
gccucugcguggugccaugaggggaccugcagcacugcagaaauccuggacuguguggcugaag

SEQ ID NO: 145483 - RNA, 58 nt, Homo Sapiens
ucuuuuuuuuuuucugaaaaaaggaaaaagcacacagcacacaauuucaagccauuuu

SEQ ID NO: 145484 - RNA, 58 nt, Homo Sapiens
uuuuuucugaaaaaaggaaaaagcacacagcacacaauuucaagccauuuucagauca

SEQ ID NO: 145485 - RNA, 58 nt, Homo Sapiens
agagaaucagacuggccugaggugaaggagcacacagcccugagggcuuggaacccug

SEQ ID NO: 145486 - RNA, 58 nt, Homo Sapiens
ucugugcuuaaccagaauccagcaagucagcacacaagugauuuuauuguuauuuugu

SEQ ID NO: 145487 - RNA, 58 nt, Homo Sapiens
ggcucaagcagcagagguaagagagcagagcacacacuauggcggggcuagggaagca

SEQ ID NO: 145488 - RNA, 58 nt, Homo Sapiens
gcugcccgucuugggaucacgggcgaacagcacacaagugcugcuccaagccugugag

SEQ ID NO: 145489 - RNA, 58 nt, Homo Sapiens
uguccagccacugcccuuuaacaugcccagcacacaugggaggccuguggcccugugu

SEQ ID NO: 145490 - RNA, 58 nt, Homo Sapiens
ugaacccugcuugauguaaaauggaaauagcacacaggcagauggcccuggguuugga

SEQ ID NO: 145491 - RNA, 58 nt, Homo Sapiens
aggaacccagggccagcuggaaguguggagcacacaugcuguggagcacacaugcugu

SEQ ID NO: 145492 - RNA, 58 nt, Homo Sapiens
cuggaaguguggagcacacaugcuguggagcacacaugcuguggagauugcagugugu

SEQ ID NO: 145493 - RNA, 58 nt, Homo Sapiens
cacacacacacacgaacacacacacacgagcacacacagccucaaaacacagcacaca

SEQ ID NO: 145494 - RNA, 58 nt, Homo Sapiens
cacacgagcacacacacacacaaaacacagcacacacaucaaagcccacguaaagccu

SEQ ID NO: 145495 - RNA, 58 nt, Homo Sapiens
agggacuuuuguuuacucuauuugcucaagcacacaaauuuucuccucuugguuuuca

SEQ ID NO: 145496 - RNA, 58 nt, Homo Sapiens
ugcagugcacacaaagaaauaugugcacagcacacacgcugggaggagucuccaagcc

SEQ ID NO: 145497 - RNA, 58 nt, Homo Sapiens
auuccaucagcccugaaggaguguccugagcacacaagagcuuggucacaacacaacu

SEQ ID NO: 145498 - RNA, 58 nt, Homo Sapiens
cacacacacacacacacacaaauuuaaaagcacacacaaauccugacaugcucccucc

SEQ ID NO: 145499 - RNA, 58 nt, Homo Sapiens
gugaauggcagacuuuucauucucaggaagcacacacuccuguauucucaugauuuuc

SEQ ID NO: 145500 - RNA, 58 nt, Homo Sapiens
uugcuauaaacuguuacuuuuuaucaccagcacacagagaguaggaucuuguuuuguu

SEQ ID NO: 145501 - RNA, 58 nt, Homo Sapiens
gauaauuagcugauauucaugguuguuuagcacacaguucaggaccuuugagaucaug

SEQ ID NO: 145502 - RNA, 58 nt, Homo Sapiens
uccuuuguuacacacucaagaauuugucagcacacaauuaauugcagccauaguaccu

SEQ ID NO: 145503 - RNA, 58 nt, Homo Sapiens
agggccugcucuuuccauuguggaucacagcacacacauacauacacccuccaccucc

SEQ ID NO: 145504 - RNA, 58 nt, Homo Sapiens
gccccuuagcagggugagcuguuaaaacagcacacaucucucauccccucuuccuuua

SEQ ID NO: 145505 - RNA, 58 nt, Homo Sapiens
uucauuuuuuggcacuaggucauuaaguagcacacagucugaaugcccuuuucuggag

SEQ ID NO: 145506 - RNA, 58 nt, Homo Sapiens
caagcuggcuguguacaggaaaauuggaagcacacaguggacugugccucuuaaagau

SEQ ID NO: 145507 - RNA, 58 nt, Homo Sapiens
auuuuauccaaugcaaacaagguaaacaagcacacacaauauauauauauauauauau

SEQ ID NO: 145508 - RNA, 58 nt, Homo Sapiens
cgcacacacacuugcauucaucuauguaagcacacauguuccucuacgacccgaccuc

SEQ ID NO: 145509 - RNA, 58 nt, Homo Sapiens
ggcaaaaacuguacuguguuucgcauuaagcacacacaucuggcccugacuucuggag

SEQ ID NO: 145510 - RNA, 58 nt, Homo Sapiens
aaggugccucauagcauagccagcauucagcacacacaaaccuacugcccacauuugg

SEQ ID NO: 145511 - RNA, 58 nt, Homo Sapiens
agugcacagagcacacugcagaccacacagcacacacacacaugcacacaggugcaca

SEQ ID NO: 145512 - RNA, 58 nt, Homo Sapiens
ugcacugaccacaccuguaugaccacauagcacacaugcgcuugcacacaugcacaca

SEQ ID NO: 145513 - RNA, 58 nt, Homo Sapiens
aacuguguguuuccaacaucaugguagcagcacacacuuccaaagcucagccagggac

SEQ ID NO: 145514 - RNA, 58 nt, Homo Sapiens
aauaugugaaauauuaugaucugaacuuagcacacaugaagcaacauuucuuugcuac

SEQ ID NO: 145515 - RNA, 64 nt, Homo Sapiens
ucccagcacuuugggaggccgaggugggcagaucacuugagaucaggaccagccuggucaagau

SEQ ID NO: 145516 - RNA, 64 nt, Homo Sapiens
gacuggaaaaauaggccuacuaaagaugaaucacacuugagauguuucuuacucacucugcaca

SEQ ID NO: 145517 - RNA, 64 nt, Homo Sapiens
ugucgguuguuccuaauggcuuauuuuacaagagacuugagaaaaaauucacuugaugcucuuu

SEQ ID NO: 145518 - RNA, 64 nt, Homo Sapiens
gcuugugcccaaagcuugaaaaagagaaagagaaacuugagaagcagagugagacccugucucc

SEQ ID NO: 145519 - RNA, 64 nt, Homo Sapiens
uuuuuuccuuaauaucagaagguguuuauaaaacacuugagaaccauaugagaggguauaggga

SEQ ID NO: 145520 - RNA, 64 nt, Homo Sapiens
ucccgguuuuuuccucuuguccugcugauaagugacuugagaguaauuugagcucguauuuacc

SEQ ID NO: 145521 - RNA, 64 nt, Homo Sapiens
uggcuaaguaauagaggaccauuuugguuuuuguacuugagaauauuuuuggugaauuacuuug

SEQ ID NO: 145522 - RNA, 64 nt, Homo Sapiens
aaaauucccuucuguuucuuacaugggaucaaauacuugagauuaguacuucagaguacuggcc

SEQ ID NO: 145523 - RNA, 64 nt, Homo Sapiens
agggaugggguggagaauggagggagcaucguccacuugagauccuucugcccaucugagauug

SEQ ID NO: 145524 - RNA, 64 nt, Homo Sapiens
gcaguuucuaggaaauguuuaaugauuaaucuucacuugagaaaggcucuuguuuuguaaacca

SEQ ID NO: 145525 - RNA, 64 nt, Homo Sapiens
cuuaaauauuguacuacuguacucuuaaauggagacuugagaugcagucauucuuugauaguca

SEQ ID NO: 145526 - RNA, 64 nt, Homo Sapiens
uagaaauaacaucagauauauuauuuauuguugaacuugagagaaaauaaaaauguacuuugga

SEQ ID NO: 145527 - RNA, 64 nt, Homo Sapiens
aguugaauaaaagugcacacuuaccuguacacugacuugagaccuggguggaggcagccagggc

SEQ ID NO: 145528 - RNA, 64 nt, Homo Sapiens
uaugaaggcuuuuggucuccuuuuuugucccccaacuugagauguucgugcccccccuuccccc

SEQ ID NO: 145529 - RNA, 64 nt, Homo Sapiens
acaguuugauccauugcuuuuauggccaggaaggacuugagaaguucauuguaucacauagaaa

SEQ ID NO: 145530 - RNA, 64 nt, Homo Sapiens
uuuuggccuaugauaauaccauacacugucagaaacuugagaucgccauaacuuuauuuguuag

SEQ ID NO: 145531 - RNA, 64 nt, Homo Sapiens
uugcagggacccgggucuguuggggaaaaugcucacuugagauuuggaagauucuguuuuccug

SEQ ID NO: 145532 - RNA, 64 nt, Homo Sapiens
cagagcucgccaccuucuggcuuccacaguugaaacuugagaaguccucugggaccagaugugc

SEQ ID NO: 145533 - RNA, 64 nt, Homo Sapiens
ggcaggccccuucccucucuuuccccagacaccuacuugagacucaccaauuucuggccuguuc

SEQ ID NO: 145534 - RNA, 64 nt, Homo Sapiens
cuggccuguucaggagccucagauaaguauuuguacuugagaccaccucacacaaucuguaugg

SEQ ID NO: 145535 - RNA, 64 nt, Homo Sapiens
uguggucuucaggaaaacuaggauacuuuccuugacuugagacucuuuuuuuccccuagauuaa

SEQ ID NO: 145536 - RNA, 64 nt, Homo Sapiens
acagaaucaaccauuucaugauucuggauucuagacuugagaccauuuacaguauugggcagca

SEQ ID NO: 145537 - RNA, 64 nt, Homo Sapiens
gaucucuguucuuucauacuacauuugaacagggcaaaaugaacuaacugccauguaggcuaag

SEQ ID NO: 145538 - RNA, 64 nt, Homo Sapiens
accuuucuggcuuuuaagccaauauaaugggcugcaaaaugaagacaccagaguguaugcauac

SEQ ID NO: 145539 - RNA, 64 nt, Homo Sapiens
guaacaaaucauuauuaucuauuuuuaaaagcuucaaaaugaugggauaugaucauagauuuua

SEQ ID NO: 145540 - RNA, 64 nt, Homo Sapiens
cuaugaucacaucacuguacuccagccugggugacaaaaugagacauugucucuaaaauacaua

SEQ ID NO: 145541 - RNA, 64 nt, Homo Sapiens
aaacugaguugaauagagaagugugacccugugacaaaaugauacugugagaaauggggcauuu

SEQ ID NO: 145542 - RNA, 64 nt, Homo Sapiens
ccuagaaacucacccgugcauauguugaccuuugcaaaaugaccuggugacauggcaagucagu

SEQ ID NO: 145543 - RNA, 64 nt, Homo Sapiens
cccugucucaaaaaaaaaaauccagcuugggcaacaaaaugagacuaugauuuuaccacugcac

SEQ ID NO: 145544 - RNA, 64 nt, Homo Sapiens
gaauaaauaaauaaaugaauuucccagaagggcacaaaaugaauauucaaauaguccugguuca

SEQ ID NO: 145545 - RNA, 64 nt, Homo Sapiens
uuuuuuucuuuuuuaauguuaugauaauguacuucaaaaugauggaaaucucaacaguaugagu

SEQ ID NO: 145546 - RNA, 64 nt, Homo Sapiens
gugcuugaaugagaaaagccuccuggugcaucuucaaaaugaguccuaaagaacauacugagua

SEQ ID NO: 145547 - RNA, 64 nt, Homo Sapiens
auucgcuccuaagggaggcucugaggggaugcaacaaaaugauccuuaugauguccaacaagga

SEQ ID NO: 145548 - RNA, 64 nt, Homo Sapiens
cacauacacgguauucccaagagugguggcagcucaaaaugauauguuugaguagacgaacagc

SEQ ID NO: 145549 - RNA, 64 nt, Homo Sapiens
auuuacaauggaaggacaaggcuuucugcauuuucaaaaugauacccagcagggcugcuagcuu

SEQ ID NO: 145550 - RNA, 64 nt, Homo Sapiens
uguaaauucucuggugcaagucagcuucuaugaccaaaaugagugguagaaaucuauucacaau

SEQ ID NO: 145551 - RNA, 64 nt, Homo Sapiens
aguggauugcaaauaauugaugcucuaaaauuugcaaaaugagguaagcaaaaauggcuaagau

SEQ ID NO: 145552 - RNA, 64 nt, Homo Sapiens
cuguuggacuuagaggcuucuucuuuuuucacaucaaaaugaugauccugucauucucuggcuc

SEQ ID NO: 145553 - RNA, 64 nt, Homo Sapiens
gaaacagucaaaugguuugccacaugcaaacaaacaaaaugaauaguuuuuguaguaaaggcgu

SEQ ID NO: 145554 - RNA, 64 nt, Homo Sapiens
cuuucuaaaucaaaccagguugagggcagcuuugcaaaaugagauaaaaggcuucacuuuugac

SEQ ID NO: 145555 - RNA, 64 nt, Homo Sapiens
gcuagugcuugggaucguacaaaucuuccauaagcaaaaugacauucacgagaacaaacuuugu

SEQ ID NO: 145556 - RNA, 64 nt, Homo Sapiens
cuaaaccucacauauauuuuuucuuccccaauaacaaaaugauuauagccuauuuaaaauuauc

SEQ ID NO: 145557 - RNA, 64 nt, Homo Sapiens
guaaucaaucuaaauaauagacuuuuuuuacaggcaaaaugaaagaggaggaagucuggguuuu

SEQ ID NO: 145558 - RNA, 64 nt, Homo Sapiens
gaaugaggagugaggcuuuuuauuagaaaaauuacaaaaugagucccggaaggucaguaagugc

SEQ ID NO: 145559 - RNA, 64 nt, Homo Sapiens
agacaauagaauugucuuuacaauaaaggacuuccaaaaugacagaugagaaacuguauauuaa

SEQ ID NO: 145560 - RNA, 64 nt, Homo Sapiens
aaagucaaaaaguguaaaauggaaaauaagagaucaaaaugaauauagcauaggaauaaagauu

SEQ ID NO: 145561 - RNA, 64 nt, Homo Sapiens
auacuacuuuauaccauuugaaggcugagauucccaaaaugagaguaaagccaaccuuuuuuuu

SEQ ID NO: 145562 - RNA, 64 nt, Homo Sapiens
auuaucaagaguuucauguggguagaaauuucuacaaaaugaauuugaaaaagccaaaguguac

SEQ ID NO: 145563 - RNA, 64 nt, Homo Sapiens
ugguuugcuuaaaauuaacuuauuuuguagaagacaaaaugaauugcacuucacuuaaugugug

SEQ ID NO: 145564 - RNA, 64 nt, Homo Sapiens
ucacauuuaaucacaucccccuucuagagugcuucaaaaugauguagucccucaacuuggcuaa

SEQ ID NO: 145565 - RNA, 64 nt, Homo Sapiens
augcuuaucagccccuucagugguguuauucuaacaaaaugaauacauuacaaauuauuaaguu

SEQ ID NO: 145566 - RNA, 64 nt, Homo Sapiens
uuacuagcacugacacacugauuuugaaauguuucaaaaugaguagauaugauuagauccuuua

SEQ ID NO: 145567 - RNA, 64 nt, Homo Sapiens
uaauauguaaucaugugucaaaucauuucuuuuacaaaaugauugcugucagucccacauacag

SEQ ID NO: 145568 - RNA, 64 nt, Homo Sapiens
uuggguuuaaaaagugcuuuagacauauauuuugcaaaaugagcauuuucaaaugauaaacucu

SEQ ID NO: 145569 - RNA, 64 nt, Homo Sapiens
acacgcccgacucucuccaucuuuccagaacuaccaaaaugaagcagaaucuuuaaagaggagc

SEQ ID NO: 145570 - RNA, 64 nt, Homo Sapiens
uucaaucuuaacaaaagugauuuagaaaugauuucaaaaugauagugccuauaaaggaaacacg

SEQ ID NO: 145571 - RNA, 64 nt, Homo Sapiens
uggagucuucuagucccaagggauugggagaugacaaaaugaauuuuuuuuuucuuuuuugaga

SEQ ID NO: 145572 - RNA, 64 nt, Homo Sapiens
gggauuacaggcaugaaccacugugcccagcugacaaaaugaguucuuaaacuuuuuuuuuuuu

SEQ ID NO: 145573 - RNA, 64 nt, Homo Sapiens
gaacuuuauaaaagacacuugcaauauacugugucaaaaugauaauuuuguuauguuagccucu

SEQ ID NO: 145574 - RNA, 64 nt, Homo Sapiens
gccaugcuagccuaggccucuauuuccuugucuccaaaaugagaauaauaaaauuuaggucagg

SEQ ID NO: 145575 - RNA, 64 nt, Homo Sapiens
aagaaaaaaagaaaaaagaaaaaucucauuauuucaaaaugauagacauauaccaaaaacaagu

SEQ ID NO: 145576 - RNA, 64 nt, Homo Sapiens
gacuuccuuauuucugaacaguacugguuacuuucaaaaugaauuuuuauugagauuuuccauu

SEQ ID NO: 145577 - RNA, 64 nt, Homo Sapiens
ucuuaaacuuuuuuuuuuuucugugcccagcugacaaaaugagugggauuacaggcaugaacca

SEQ ID NO: 145578 - RNA, 64 nt, Homo Sapiens
uuuuuuuucuuuuuugagauggauugggagaugacaaaaugaauuggagucuucuagucccaag

SEQ ID NO: 145579 - RNA, 64 nt, Homo Sapiens
gauuuacuagacgaaaaccauaccucucuucaaucaaaaugaaaacaaagcaaaugaauacugg

SEQ ID NO: 145580 - RNA, 64 nt, Homo Sapiens
uuguagucauuuuaaaguacacaaagggcacaaucaaaaugagaugcacucauuuaaaucugca

SEQ ID NO: 145581 - RNA, 64 nt, Homo Sapiens
cagauuuugauaacuguuuauauguguugaaaaccaaaaugacaucuuuuuaaagcuuauccau

SEQ ID NO: 145582 - RNA, 64 nt, Homo Sapiens
auaaaacaccucacaccucacucuuuauagugcacaaaaugaaugaggucugggcuagguagaa

SEQ ID NO: 145583 - RNA, 64 nt, Homo Sapiens
gaacauuguucucuauccucgcaucucugccuuucaaaaugaagcugggaccuugaacaaguca

SEQ ID NO: 145584 - RNA, 64 nt, Homo Sapiens
aauugaaugagaugaagaaaggcgaggguuguuccaaaaugagucuugagcauuuauaaaccag

SEQ ID NO: 145585 - RNA, 64 nt, Homo Sapiens
agcgaagccuuaacuuuaaaguaaauuguuguuucaaaaugaacucuaugacaauaugacacuu

SEQ ID NO: 145586 - RNA, 64 nt, Homo Sapiens
uuugauagaaauguuggcauuuaucuauucuauucaaaaugaccagugacaguaucuuuuuucc

SEQ ID NO: 145587 - RNA, 64 nt, Homo Sapiens
uuauagggcaguuuggugcauaauuaauucaguccaaaaugaaaucagcccccuacugagaagu

SEQ ID NO: 145588 - RNA, 64 nt, Homo Sapiens
acuugaccaaaaaaccacauacauuauuacaaaacaaaaugaacacucuauuuggaucagaacu

SEQ ID NO: 145589 - RNA, 64 nt, Homo Sapiens
cauuuuguuaaggggguaggucuggacuagaaaacaaaaugaggccguuguaauaaugaauugu

SEQ ID NO: 145590 - RNA, 64 nt, Homo Sapiens
uuccaccucuguccacucccauuaccagcguaggcaaaaugagcuauguccacuaaguacucca

SEQ ID NO: 145591 - RNA, 64 nt, Homo Sapiens
cacccagcuagagcacuguaugcuccucucgucucaaaaugaccugucucagcugcugcaagac

SEQ ID NO: 145592 - RNA, 64 nt, Homo Sapiens
caguuaaaaggucaguaugagauaccaugagacacaaaaugagaacagaauuuuggcugaucua

SEQ ID NO: 145593 - RNA, 64 nt, Homo Sapiens
ccuaaagaacauacugaguauccuggugcaucuucaaaaugagugugcuugaaugagaaaaggc

SEQ ID NO: 145594 - RNA, 64 nt, Homo Sapiens
gaaaucucaacaguaugaguaugauaauguacuucaaaaugauguuuuuuucuuuuuuaauguu

SEQ ID NO: 145595 - RNA, 64 nt, Homo Sapiens
ccauuccauucuagaaauuucauuuuuccaguuccaaaaugauuagggacgucaguguuuaugc

SEQ ID NO: 145596 - RNA, 64 nt, Homo Sapiens
uccuuugcuuugauuagacauuuuucuuuauuuucaaaaugauuuuaaccaauuauaauagcuu

SEQ ID NO: 145597 - RNA, 64 nt, Homo Sapiens
gugaauauucuuucuaaaaacgugaaacccaugacaaaaugaauuaauauauuuagaagagcca

SEQ ID NO: 145598 - RNA, 64 nt, Homo Sapiens
aaaagagccugcuuuuuuccuaaauuaugagaaucaaaaugauauaaauaaauacauugauugg

SEQ ID NO: 145599 - RNA, 64 nt, Homo Sapiens
acaucgagagagauaaauggaaaguaugaauggucaaaaugaauaucuucuuagaaagaaagaa

SEQ ID NO: 145600 - RNA, 64 nt, Homo Sapiens
uauagauuaguuuaaauguguccauuaauguaaucaaaaugaaaagguuucauuccuucagagc

SEQ ID NO: 145601 - RNA, 64 nt, Homo Sapiens
accggauuucaaauaaccaguaaccaaaacuauucaaaaugaaaauucugccaugacauacacu

SEQ ID NO: 145602 - RNA, 64 nt, Homo Sapiens
ggacuaguuaaggauuaacuuggaagauaaugcacaaaaugaagaaaaaagagaaggagaauac

SEQ ID NO: 145603 - RNA, 64 nt, Homo Sapiens
cuccuucaagguuuucaaaaacaguacuucuugucaaaaugauuagaagacugcagcagacuac

SEQ ID NO: 145604 - RNA, 64 nt, Homo Sapiens
aaccagaaggccauuugguggaggauauuuaaaccaaaaugaaaguauuacuugaaugcaucca

SEQ ID NO: 145605 - RNA, 64 nt, Homo Sapiens
aaagccuuuuuacuugugggaauugcagcauccccaaaaugaauaaauguuuauauaaauacca

SEQ ID NO: 145606 - RNA, 64 nt, Homo Sapiens
ccagaggcugggugacauguguuggcagccucuucaaaaugagcccuguccugccuaaggcuga

SEQ ID NO: 145607 - RNA, 64 nt, Homo Sapiens
cguuccuucaaagcaaaugucuuccuggauuauucaaaaugauguauguugaagccuuuguaaa

SEQ ID NO: 145608 - RNA, 64 nt, Homo Sapiens
uuuuuauuuuaggaggguuuuauaauagaaaaaccaaaaugauaagcccgccuuuagaguuaaa

SEQ ID NO: 145609 - RNA, 64 nt, Homo Sapiens
gaaggccgaagagcaaggcuugagguuuaggguucaaaaugaugaguguuucguucuaaaucua

SEQ ID NO: 145610 - RNA, 64 nt, Homo Sapiens
uuuuucuucucuaaaacauuaguuuaauuuucuucaaaaugaaaauacugcuuuguaauuacaa

SEQ ID NO: 145611 - RNA, 64 nt, Homo Sapiens
uuuucuucaaaaugaaaauacugcuuuguaauuacaaaaugagacacaccuaucuugauauuuu

SEQ ID NO: 145612 - RNA, 64 nt, Homo Sapiens
aagacuuugguauggauuaagcgcuguccaguaacaaaaugaaaucucaaaacagagcucagcu

SEQ ID NO: 145613 - RNA, 64 nt, Homo Sapiens
acuguguuuuaugauuuuaccucaaaucagaaaacaaaaugaugugcuuuggucaguuaauaaa

SEQ ID NO: 145614 - RNA, 64 nt, Homo Sapiens
gguguuccuccaaagaauaggguaaaggagagcugggagggagcccucuccguugggugacucu

SEQ ID NO: 145615 - RNA, 64 nt, Homo Sapiens
cagggugcccuggaacacugguaguucuggggcugggagggagaggggcuccggcuuucucuga

SEQ ID NO: 145616 - RNA, 64 nt, Homo Sapiens
ucugugguuccugguugguggcuaaugaagugaggggagggagggaugucaccccaaaaguagg

SEQ ID NO: 145617 - RNA, 64 nt, Homo Sapiens
ugguuccugguugguggcuaaugaagugaggggagggagggaugucaccccaaaaguaggcccu

SEQ ID NO: 145618 - RNA, 64 nt, Homo Sapiens
agccccagacauacuguguugagagauacuuagagggagggaguagguuuugaagagguugaug

SEQ ID NO: 145619 - RNA, 64 nt, Homo Sapiens
gagggaguagguuuugaagagguugauggugguggggagggaaggccuccugaauugaguuuga

SEQ ID NO: 145620 - RNA, 64 nt, Homo Sapiens
gaaaaaagauccaccagaggacaucuuggggagggggagggagcugggggggagggaaaugacu

SEQ ID NO: 145621 - RNA, 64 nt, Homo Sapiens
agaggacaucuuggggagggggagggagcugggggggagggaaaugacuaaugaagcuaauuaa

SEQ ID NO: 145622 - RNA, 64 nt, Homo Sapiens
ugaccagugcucuguggggcagaggagcugaccagggagggagguacccaugagcagaggguag

SEQ ID NO: 145623 - RNA, 64 nt, Homo Sapiens
uauauauuauuuuuugguucucucucguuuuuuagggagggaagaaaguaccaaguugcauuga

SEQ ID NO: 145624 - RNA, 50 nt, Homo Sapiens
ugaaaaggauggaagcaugagggagggagggaggagggagaaaaacagaa

SEQ ID NO: 145625 - RNA, 54 nt, Homo Sapiens
ugaaaaggauggaagcaugagggagggagggaggagggagaaaaacagaaucca

SEQ ID NO: 145626 - RNA, 64 nt, Homo Sapiens
caucucaccagagcaacagcccaguccugaggaugggagggacgugacuuagccuugggauucc

SEQ ID NO: 145627 - RNA, 64 nt, Homo Sapiens
gaaggucagggugccgcugggggagcagggagcggggagggaggaagaggggaaugcacaucuu

SEQ ID NO: 145628 - RNA, 64 nt, Homo Sapiens
gguuugggccggggaguuccccauucguucuccggggagggagggacuuuacaccuaccccuca

SEQ ID NO: 145629 - RNA, 64 nt, Homo Sapiens
ugggccggggaguuccccauucguucuccggggagggagggacuuuacaccuaccccucaccgg

SEQ ID NO: 145630 - RNA, 64 nt, Homo Sapiens
cugggcacaccuugcugaggccccaguagggguggggagggagggagaggccgccacccccgcc

SEQ ID NO: 145631 - RNA, 64 nt, Homo Sapiens
gcacaccuugcugaggccccaguagggguggggagggagggagaggccgccacccccgccggug

SEQ ID NO: 145632 - RNA, 64 nt, Homo Sapiens
ucuuggggagaugggcagucgcacagcugccacagggagggagggggucaaggggccccgaugu

SEQ ID NO: 145633 - RNA, 64 nt, Homo Sapiens
auggcccgcagggucaagggucccagccagggcagggagggaccuggacauccugcccaccgug

SEQ ID NO: 145634 - RNA, 64 nt, Homo Sapiens
gggagugaagagccugcccugggagggagagagagggagggagagcuguuggauucugagggug

SEQ ID NO: 145635 - RNA, 64 nt, Homo Sapiens
gagagggagggagagggaguggauucugaggguggggagggagauguugcaaacgacugcuguu

SEQ ID NO: 145636 - RNA, 64 nt, Homo Sapiens
gcugacccaccaaggucucaaggcacauggcugggggagggacuggggacaaaccagggguacc

SEQ ID NO: 145637 - RNA, 64 nt, Homo Sapiens
ugaggccucccuugaguagggucccacccaggaagggagggagcgagucucuggcucagcugug

SEQ ID NO: 145638 - RNA, 64 nt, Homo Sapiens
uggugaggaagaggaagggaccccauucuccagagggagggaggaaucuggauucucuccucuu

SEQ ID NO: 145639 - RNA, 64 nt, Homo Sapiens
cuggaauggagaaucuggaugguauuuguauggggggagggaggaagcaguugguagaaggaau

SEQ ID NO: 145640 - RNA, 64 nt, Homo Sapiens
uaagaguagggucagaguuaagcuugaauugauggggagggaggcauaggauuucucuuaauuc

SEQ ID NO: 145641 - RNA, 64 nt, Homo Sapiens
gauuugaguccaagcauacaggcucaagaugaaugggagggagauuugccaccacgcaacucag

SEQ ID NO: 145642 - RNA, 64 nt, Homo Sapiens
gggcgcggggcgcggcgggacccaggcuacgagcgggagggaggcgggagucgggggaagacgc

SEQ ID NO: 145643 - RNA, 64 nt, Homo Sapiens
gacaccagcgcuggcuucccgggcccgcgggccggggagggaagccucggggcugcggggugag

SEQ ID NO: 145644 - RNA, 64 nt, Homo Sapiens
cucaaagaagcauuugcugaggauggagaggcaggggagggaggcgggaggccgucacuggagu

SEQ ID NO: 145645 - RNA, 64 nt, Homo Sapiens
ugugaugccccucucccgauuucccaggggcucugggagggacccuucuaagaagauugggcag

SEQ ID NO: 145646 - RNA, 64 nt, Homo Sapiens
gacaugacuuauguguguguguguuuuugggguggggagggagggagagaagagggggcuaaau

SEQ ID NO: 145647 - RNA, 64 nt, Homo Sapiens
ugacuuauguguguguguguuuuugggguggggagggagggagagaagagggggcuaaauuuga

SEQ ID NO: 145648 - RNA, 64 nt, Homo Sapiens
ugaggagcgucuccgcccggcagccacccaguccgggagggaggugggggggucagucccccgu

SEQ ID NO: 145649 - RNA, 64 nt, Homo Sapiens
gaggagccccucugccccgccagccaccccguccgggagggaggugggggggucagccccccgc

SEQ ID NO: 145650 - RNA, 64 nt, Homo Sapiens
gggucagccccccgcccggccagccgccccguccgggagggaggugggggaucagccccccgcc

SEQ ID NO: 145651 - RNA, 64 nt, Homo Sapiens
gggucagccccccgcccggccagccgcccgguccgggagggaggugggggggucagccccccgc

SEQ ID NO: 145652 - RNA, 64 nt, Homo Sapiens
cucccuugccccuuuccugggcccagaaguuggggggagggagggaaaggauuuuuacauuuuu

SEQ ID NO: 145653 - RNA, 64 nt, Homo Sapiens
cuugccccuuuccugggcccagaaguuggggggagggagggaaaggauuuuuacauuuuuuaaa

SEQ ID NO: 145654 - RNA, 64 nt, Homo Sapiens
ugcuggugugagcagccagagggagggaugcucagggagggauagauggugggguggaugguca

SEQ ID NO: 145655 - RNA, 64 nt, Homo Sapiens
cucagggagggauaugcugggggguggauggucagggagggaugcaaauggcuguggggauggu

SEQ ID NO: 145656 - RNA, 64 nt, Homo Sapiens
gacuuauuuuuucucuccuaugccaccccagguggggagggagggagguuucagacuccaguuu

SEQ ID NO: 145657 - RNA, 64 nt, Homo Sapiens
uauuuuuucucuccuaugccaccccagguggggagggagggagguuucagacuccaguuucucc

SEQ ID NO: 145658 - RNA, 64 nt, Homo Sapiens
uuucaggacuuuuauuucccccuggaugguuguugggagggagggaaaguguuuucugaauggc

SEQ ID NO: 145659 - RNA, 64 nt, Homo Sapiens
aggacuuuuauuucccccuggaugguuguugggagggagggaaaguguuuucugaauggcuauu

SEQ ID NO: 145660 - RNA, 64 nt, Homo Sapiens
acccaugaaaacugagaugaggaccuugguacuagggagggagggaaggacgugggaauguuuu

SEQ ID NO: 145661 - RNA, 64 nt, Homo Sapiens
augaaaacugagaugaggaccuugguacuagggagggagggaaggacgugggaauguuuucuua

SEQ ID NO: 145662 - RNA, 64 nt, Homo Sapiens
ccaagaaauuggaauugaaaacaggaggugacuagggagggauuaggaaauuagaggucuugac

SEQ ID NO: 145663 - RNA, 64 nt, Homo Sapiens
agggaaguaguccuuggcaugggagggauuauuugggagggaaauuuguuuguuucuuuguguu

SEQ ID NO: 145664 - RNA, 64 nt, Homo Sapiens
auuugggagggaaaagggaauguuucuuuguguugggagggauuuugccuagcucuuuuuuguu

SEQ ID NO: 145665 - RNA, 64 nt, Homo Sapiens
acauggacagggccuuccacucagggcuuagggagggagggaggagguggggcuguuaccuucc

SEQ ID NO: 145666 - RNA, 64 nt, Homo Sapiens
gaggacauggacagggccuuuuccucagggcuuagggagggaggucacagguggggcuguuacc

SEQ ID NO: 145667 - RNA, 64 nt, Homo Sapiens
cugggcaucagggaucacauaguagggugggauggggagggaggcuuuucucucugucuuuagg

SEQ ID NO: 145668 - RNA, 64 nt, Homo Sapiens
cgaguuaucaagaugggagguagcuuccuaaggggggagggaacuuguguugcuuccuauuggc

SEQ ID NO: 145669 - RNA, 64 nt, Homo Sapiens
ccuguguguuuguggggagauguucucugugggagggagggaguuucuucaguuaacaacuuug

SEQ ID NO: 145670 - RNA, 64 nt, Homo Sapiens
gaguccuguguguuuguggguuuguguucucugugggagggaggcuuguucuucaguuaacaac

SEQ ID NO: 145671 - RNA, 64 nt, Homo Sapiens
uuuuacuuuugcgggggggaggggggaggaguuggggagggagggaaugugggaggaauuaaga

SEQ ID NO: 145672 - RNA, 64 nt, Homo Sapiens
acuuuugcgggggggaggggggaggaguuggggagggagggaaugugggaggaauuaagacaaa

SEQ ID NO: 145673 - RNA, 64 nt, Homo Sapiens
cuucucuuagauucuuaauucaugaggagggugggggagggagguggagggagggaaggguuuc

SEQ ID NO: 145674 - RNA, 64 nt, Homo Sapiens
uuaauucaugaggagggugggggagggagguggagggagggaaggguuucucuauuaaaaugca

SEQ ID NO: 145675 - RNA, 64 nt, Homo Sapiens
gaugcuggcagaucucaaggccaucaauuauugggggagggagggacaaacacucccaaucauc

SEQ ID NO: 145676 - RNA, 64 nt, Homo Sapiens
cuggcagaucucaaggccaucaauuauugggggagggagggacaaacacucccaaucauccacc

SEQ ID NO: 145677 - RNA, 64 nt, Homo Sapiens
uuaaaugcuucccuggacugcggggaggggcggggggagggagggauuucuuaucccguuuguu

SEQ ID NO: 145678 - RNA, 64 nt, Homo Sapiens
augcuucccuggacugcggggaggggcggggggagggagggauuucuuaucccguuuguuacau

SEQ ID NO: 145679 - RNA, 64 nt, Homo Sapiens
cagaggacagcuuccccauccccauugccuucuggggagggacaucagcacagagagcggcuuc

SEQ ID NO: 145680 - RNA, 64 nt, Homo Sapiens
cagaggacggcuuccccauccccauugccuucuggggagggacauuagcacagaggauggcuuc

SEQ ID NO: 145681 - RNA, 64 nt, Homo Sapiens
gaacuugcugauucuguagcguuuuuuggggggagggagggaguaaugucuuguuuuaauuugu

SEQ ID NO: 145682 - RNA, 64 nt, Homo Sapiens
gagugaacuugcugauucuguuguguuuuuuggggggagggagggcaaaaugucuuguuuuaau

SEQ ID NO: 145683 - RNA, 64 nt, Homo Sapiens
ccgccccccucuaggagagcuggcucugcagugggggagggaugcagggacauuuacugaagga

SEQ ID NO: 145684 - RNA, 64 nt, Homo Sapiens
ggaggguggggccgugguccccucagccuccauggggagggaagaagggggagcucuuuuuuua

SEQ ID NO: 145685 - RNA, 64 nt, Homo Sapiens
cugguggggucacccucccuguccucccgccugugggagggagggagggcuggcucaggcaucg

SEQ ID NO: 145686 - RNA, 64 nt, Homo Sapiens
uggggucacccucccuguccucccgccugugggagggagggagggcuggcucaggcaucgucuc

SEQ ID NO: 145687 - RNA, 64 nt, Homo Sapiens
ccucugagucacugaaugucaccaggagaggugggggagggaaagugggccaguggggaggggg

SEQ ID NO: 145688 - RNA, 51 nt, Homo Sapiens
agaaugagauucaccaguaaggggagggaggggcccuggaggccacauccu

SEQ ID NO: 145689 - RNA, 64 nt, Homo Sapiens
acuuggggguuucacugcucucccccaugauggagggagggagccccccaaccucagugaggag

SEQ ID NO: 145690 - RNA, 64 nt, Homo Sapiens
cagagauggaugccacuuacgggcagaggggggagggagggauaaguuugucugggccacacug

SEQ ID NO: 145691 - RNA, 64 nt, Homo Sapiens
gauacagagauggaugccacacuggggcagaggggggagggagguuucaguuugucugggccac

SEQ ID NO: 145692 - RNA, 64 nt, Homo Sapiens
gagaagagcucugcacuuccaaaagggugggggagggagggaaacaaacaaacaaacaaacaaa

SEQ ID NO: 145693 - RNA, 64 nt, Homo Sapiens
gaaagagaagagcucugcaccaaaaaaagggugggggagggaggaaaacaaacaaacaaacaaa

SEQ ID NO: 145694 - RNA, 64 nt, Homo Sapiens
accuucccagggagaaacccgugggggagggaaagggagggaugucccaugaguugggggucgg

SEQ ID NO: 145695 - RNA, 64 nt, Homo Sapiens
gggagggaugaccuucccagugggggucgggugggggagggaaauuuauuuuuuucccaugagu

SEQ ID NO: 145696 - RNA, 64 nt, Homo Sapiens
guggacaguaucuggaaguuucuccucugcccaggggagggaguuguucccuugaggugccucc

SEQ ID NO: 145697 - RNA, 64 nt, Homo Sapiens
caacccccacccucccuccuagggagcccccucugggagggaacgcuucaggacggggcgucag

SEQ ID NO: 145698 - RNA, 64 nt, Homo Sapiens
gaauggcccgagggaggagggagggagggagggagggagggagauacauauaaacacuggaggg

SEQ ID NO: 145699 - RNA, 64 nt, Homo Sapiens
gagagaauggcccgagggagaggggagggagggagggagggaggcccuuacauauaaacacugg

SEQ ID NO: 145700 - RNA, 64 nt, Homo Sapiens
gagggagagaauggcccgagcuggaggggagggagggagggaggaguacccuuacauauaaaca

SEQ ID NO: 145701 - RNA, 63 nt, Homo Sapiens
gagggagggagagaauggccacacuggaggggagggagggaggaccaguacccuuacauauaa

SEQ ID NO: 145702 - RNA, 59 nt, Homo Sapiens
gagggagggagggagagaauacacuggaggggagggaggaccaguacccuuacauauaa

SEQ ID NO: 145703 - RNA, 64 nt, Homo Sapiens
cacuggagagcuuuuugcaauaugcuggggaaaggggagggagggaaugaaagugccaaagaaa

SEQ ID NO: 145704 - RNA, 64 nt, Homo Sapiens
ggagagcuuuuugcaauaugcuggggaaaggggagggagggaaugaaagugccaaagaaaacau

SEQ ID NO: 145705 - RNA, 64 nt, Homo Sapiens
ccuugacauccccagaaucucggucuuugggguggggagggagggaggagggagguggaguugg

SEQ ID NO: 145706 - RNA, 64 nt, Homo Sapiens
gacauccccagaaucucggucuuugggguggggagggagggaggagggagguggaguugggaug

SEQ ID NO: 145707 - RNA, 64 nt, Homo Sapiens
aaguacgacuaauguuggagcuuuuuuugauagcgggagggaggccaucccauuggagucucuu

SEQ ID NO: 145708 - RNA, 64 nt, Homo Sapiens
auccuggaugcuggauggagcuucagggaugagagggagggagaugugcuuugacauucuagca

SEQ ID NO: 145709 - RNA, 64 nt, Homo Sapiens
aaagaaauauauauaaccuuguuauuguauuugggggagggauacugggauaauuuuuauuuuc

SEQ ID NO: 145710 - RNA, 64 nt, Homo Sapiens
uugaauuguaguucccauaauccccacauguugugggagggacccagugggagguaauuaaauc

SEQ ID NO: 145711 - RNA, 64 nt, Homo Sapiens
auacuugguauaagguaguagauuguuggggguggggagggagggaucuaggauacagggcagg

SEQ ID NO: 145712 - RNA, 64 nt, Homo Sapiens
uugguauaagguaguagauuguuggggguggggagggagggaucuaggauacagggcagggaua

SEQ ID NO: 145713 - RNA, 64 nt, Homo Sapiens
aucccccagcccuggcuccuagguccucccaacugggagggaguccuccgugccucacuuagag

SEQ ID NO: 145714 - RNA, 64 nt, Homo Sapiens
aagcuuugagccuccugccccugcuuucugcccagggagggagaaggaagagggggagcugguu

SEQ ID NO: 145715 - RNA, 64 nt, Homo Sapiens
uguccuucccuggccuucucuuggcucaaaggcugggagggagggaaggagagaagaguuccag

SEQ ID NO: 145716 - RNA, 64 nt, Homo Sapiens
cuucccuggccuucucuuggcucaaaggcugggagggagggaaggagagaagaguuccaggcaa

SEQ ID NO: 145717 - RNA, 64 nt, Homo Sapiens
gcgguggacaauaaacaucuuuguucugggcucagggagggaggaccacggggagcaaaccagc

SEQ ID NO: 145718 - RNA, 64 nt, Homo Sapiens
uaacgggugccugcugcggcgaggaggugagagugggagggaggggugggcacuggagcaugca

SEQ ID NO: 145719 - RNA, 64 nt, Homo Sapiens
cugccucucacaccuccagguucucuaaguucuggggagggagcgccccaccugcugaggucgg

SEQ ID NO: 145720 - RNA, 64 nt, Homo Sapiens
cccagucacugacccugggagaccccuucugugugggagggagcgggggcuggcuagcgggccc

SEQ ID NO: 145721 - RNA, 64 nt, Homo Sapiens
uauguggaagguaagauucacagaggaguguguagggagggauggaguuuggugggcuuaaggu

SEQ ID NO: 145722 - RNA, 64 nt, Homo Sapiens
uaagugccuaccuacucgcugagagccuacaaaugggagggacccucaaacagaaggcaguaau

SEQ ID NO: 145723 - RNA, 64 nt, Homo Sapiens
gaucugacaaauacugcccacuccuugguacugggggagggagaaacaccacuucuacacaacc

SEQ ID NO: 145724 - RNA, 64 nt, Homo Sapiens
agaaaggggcagggaggggagacauucugcuugagggagggaauccaugaucguaagggagaau

SEQ ID NO: 145725 - RNA, 64 nt, Homo Sapiens
guuuaucacugcuuaacuucugggguggcagggagggagggaggacuauaugaugaggagaaac

SEQ ID NO: 145726 - RNA, 64 nt, Homo Sapiens
gaggguuuaucacugcuuaaaaacugggguggcagggagggagggaugacuauaugaugaggag

SEQ ID NO: 145727 - RNA, 64 nt, Homo Sapiens
accagccucggugcucugccccaugcugggaggagggagggagggacaggugccuggagccccc

SEQ ID NO: 145728 - RNA, 64 nt, Homo Sapiens
gccucggugcucugccccaugcugggaggagggagggagggacaggugccuggagcccccggaa

SEQ ID NO: 145729 - RNA, 64 nt, Homo Sapiens
cccugacugucagggagggccagggaggcagagcgggagggagucucaggaggaggcugcccug

SEQ ID NO: 145730 - RNA, 64 nt, Homo Sapiens
ggugcugguagcugaggggacgggcaagugagaggggagggagggaaguccugggaggauccug

SEQ ID NO: 145731 - RNA, 64 nt, Homo Sapiens
cugguagcugaggggacgggcaagugagaggggagggagggaaguccugggaggauccugagcu

SEQ ID NO: 145732 - RNA, 64 nt, Homo Sapiens
cgcauguagggccauccugggauggggcaccacagggagggagggagaaaagagguggguaggg

SEQ ID NO: 145733 - RNA, 64 nt, Homo Sapiens
uguagggccauccugggauggggcaccacagggagggagggagaaaagagguggguaggguuac

SEQ ID NO: 145734 - RNA, 64 nt, Homo Sapiens
guguggcugaguguauucugcgcguguguguggagggagggagggaggggagcauggugucucc

SEQ ID NO: 145735 - RNA, 64 nt, Homo Sapiens
ggcugaguguauucugcgcguguguguggagggagggagggaggggagcauggugucucccgcu

SEQ ID NO: 145736 - RNA, 64 nt, Homo Sapiens
cugggguuuauuuaaacuguucugugugggucuggggagggagagcaccuuaauauuauugggg

SEQ ID NO: 145737 - RNA, 64 nt, Homo Sapiens
ugcccugcucuggggaugcacggcggcagggugggggagggagguuccucgcaggucucagccc

SEQ ID NO: 145738 - RNA, 64 nt, Homo Sapiens
acccagcagcagguuaccaagggcugucuggaaagggagggacaaaaggacccagaaguagaag

SEQ ID NO: 145739 - RNA, 64 nt, Homo Sapiens
uugguacuuuauaguaauaaaucugaccagcagagggagggaucaggcagcaguguuuagagca

SEQ ID NO: 145740 - RNA, 64 nt, Homo Sapiens
gaaggcuggcaccucuuccaagcggggagggcaggggagggacgcaagaggcgccauagacccu

SEQ ID NO: 145741 - RNA, 64 nt, Homo Sapiens
gaggucccugaggugaagagagguucaggauggugggagggacuuugcuggaaaagguguggga

SEQ ID NO: 145742 - RNA, 64 nt, Homo Sapiens
aggaauacuagcccuuuuuauggugugugugggagggagggagggggcauuuaauauauaccac

SEQ ID NO: 145743 - RNA, 64 nt, Homo Sapiens
gaggaggaauacuagcccuuccacuggugugugugggagggaggacuugggcauuuaauauaua

SEQ ID NO: 145744 - RNA, 64 nt, Homo Sapiens
aagugugaagggcacagcuggagggaagcagggagggagggagcgccaggacugaggaggagug

SEQ ID NO: 145745 - RNA, 64 nt, Homo Sapiens
gagcaagugugaagggcacaaguggagggaagcagggagggaggucuggccaggacugaggagg

SEQ ID NO: 145746 - RNA, 64 nt, Homo Sapiens
gcuuuccugugcugacagcggagaggaccugguggggagggagguuggccuggcaguggcuuca

SEQ ID NO: 145747 - RNA, 64 nt, Homo Sapiens
cauccagcuugggcuuucccgcuugcagggguuggggagggagaggcucuggaaggaugggcca

SEQ ID NO: 145748 - RNA, 64 nt, Homo Sapiens
cugguccugcaccugcccucgugcuugucugggugggagggagccucuugccuucuaagcuacu

SEQ ID NO: 145749 - RNA, 64 nt, Homo Sapiens
aagcgccgguuuaugucugucgagcuguggugaugggagggagggugcuggggugacaaagccc

SEQ ID NO: 145750 - RNA, 64 nt, Homo Sapiens
gcuggggugcagggcuccggauguggagcgcauggggagggaagagaggcugaacaaaggacgc

SEQ ID NO: 145751 - RNA, 64 nt, Homo Sapiens
gcgccuuuuccugcagcucuccuggacuggacuggggagggaaacucggcugcuaggccccucg

SEQ ID NO: 145752 - RNA, 64 nt, Homo Sapiens
uaagaagaccccgcagucaacagugaugcagggcgggagggagagggcgcccacacuggcccug

SEQ ID NO: 145753 - RNA, 64 nt, Homo Sapiens
agacuuuauauaaauguuuaaaacauagggguaagggagggagggagaauuuuuguauagaaug

SEQ ID NO: 145754 - RNA, 64 nt, Homo Sapiens
uuuauauaaauguuuaaaacauagggguaagggagggagggagaauuuuuguauagaaugaaac

SEQ ID NO: 145755 - RNA, 64 nt, Homo Sapiens
aguugcagggccuccgcagcuggacagagagugggggagggagggacagacagaaggccaaggc

SEQ ID NO: 145756 - RNA, 64 nt, Homo Sapiens
gcagggccuccgcagcuggacagagagugggggagggagggacagacagaaggccaaggcccga

SEQ ID NO: 145757 - RNA, 64 nt, Homo Sapiens
uugggguggggaagggaagggcgggcaaggaguggggagggagucuggggugggagggaggcau

SEQ ID NO: 145758 - RNA, 64 nt, Homo Sapiens
agggcgggcaaggaguggggagggagucuggggugggagggaggcaucugcaugggucuucuuu

SEQ ID NO: 145759 - RNA, 64 nt, Homo Sapiens
ugcccuaaguccugugagaagaugucagggacuagggagggagggagggaaggcagagaaaaau

SEQ ID NO: 145760 - RNA, 64 nt, Homo Sapiens
cuaaguccugugagaagaugucagggacuagggagggagggagggaaggcagagaaaaauuacu

SEQ ID NO: 145761 - RNA, 64 nt, Homo Sapiens
guccugugagaagaugucagggacuagggagggagggagggaaggcagagaaaaauuacuuagc

SEQ ID NO: 145762 - RNA, 64 nt, Homo Sapiens
aaauggggcuaugccuggcugagggagagggagggggagggagaagacgaugccgacuggaagg

SEQ ID NO: 145763 - RNA, 64 nt, Homo Sapiens
gggagggggagggagaaaaugaugccgacuggaagggagggagauggggcugugggcagcagac

SEQ ID NO: 145764 - RNA, 64 nt, Homo Sapiens
agggcagaggcugcgguuugcugagauugcuguggggagggaggucaaauuccuuaaaauauaa

SEQ ID NO: 145765 - RNA, 64 nt, Homo Sapiens
ucccuaccauccuuguuuagagcagcuuuguuuggggagggaagcgguucucaauaaauuacug

SEQ ID NO: 145766 - RNA, 64 nt, Homo Sapiens
uuuaagucuagccucugcgugguagacagguauggggagggagaaugcuuuuccccucccagua

SEQ ID NO: 145767 - RNA, 64 nt, Homo Sapiens
gaaugaguagucaggaacuggucacuuugaaugugggagggaagauauucacgacaagguuuuc

SEQ ID NO: 145768 - RNA, 64 nt, Homo Sapiens
auucuucugcaguuaaugggguagaggagggcaugggagggagggagagguggggagggagaca

SEQ ID NO: 145769 - RNA, 64 nt, Homo Sapiens
uucugcaguuaaugggguagaggagggcaugggagggagggagagguggggagggagacagaga

SEQ ID NO: 145770 - RNA, 64 nt, Homo Sapiens
ggguagaggagggcaugggagggagggagagguggggagggagacagagacagaaacagagaga

SEQ ID NO: 145771 - RNA, 64 nt, Homo Sapiens
cggagggccaggcaacaggcuagcaaggcccacagggagggagcagaauggagagggcaucuca

SEQ ID NO: 145772 - RNA, 64 nt, Homo Sapiens
cuguaagaaaucagagggagaaagggagagaagggggagggagacaacccaaacguuggagggu

SEQ ID NO: 145773 - RNA, 64 nt, Homo Sapiens
gggggaugauggagagcuguccaaccaagagagcgggagggagggaaggagggagggagagaga

SEQ ID NO: 145774 - RNA, 64 nt, Homo Sapiens
gaugauggagagcuguccaaccaagagagcgggagggagggaaggagggagggagagagauaga

SEQ ID NO: 145775 - RNA, 64 nt, Homo Sapiens
cuguccaaccaagagagcgggagggagggaaggagggagggagagagauagagagagagagaga

SEQ ID NO: 145776 - RNA, 64 nt, Homo Sapiens
ggucuccuaacucgauuggacuggauccuucccugggagggagaggccugcacuuuggagauuu

SEQ ID NO: 145777 - RNA, 64 nt, Homo Sapiens
ccgcggcagguacucucccugccaccuccuccuugggagggaggccgugaccguguccugagug

SEQ ID NO: 145778 - RNA, 64 nt, Homo Sapiens
ccaccgccucucacacuccggucccgguccccucgggagggacuugcuuuccuggaccgggaga

SEQ ID NO: 145779 - RNA, 64 nt, Homo Sapiens
gagggcaggggccccuguggguucugggcuccaggggagggagcuggggaggccaggguauaag

SEQ ID NO: 145780 - RNA, 64 nt, Homo Sapiens
aaguuaacugaugauugugggguuugucauaucugggagggaagaugggugcugggagaggguu

SEQ ID NO: 145781 - RNA, 64 nt, Homo Sapiens
cuuugggguugagggagaugggagcuagggggaggggagggagaugucuuguuguggggacuug

SEQ ID NO: 145782 - RNA, 64 nt, Homo Sapiens
accucuuuaucucaaucuauuuauuuggcauccugggagggauuuccaauaguaauuuauguga

SEQ ID NO: 145783 - RNA, 64 nt, Homo Sapiens
ccuugccccuugugagcuggauagacuugggauggggagggagggaguuuugucugucucccuc

SEQ ID NO: 145784 - RNA, 64 nt, Homo Sapiens
gccccuugugagcuggauagacuugggauggggagggagggaguuuugucugucucccuccccu

SEQ ID NO: 145785 - RNA, 64 nt, Homo Sapiens
agggagcaggcaggucccaauagagggagggagggggagggaggacuauuuuaauacucagcac

SEQ ID NO: 145786 - RNA, 64 nt, Homo Sapiens
gggagggaggagggagcagguacucagcacuagagggagggagggcuuuuauagacuauuuuaa

SEQ ID NO: 145787 - RNA, 64 nt, Homo Sapiens
ucagaggugaaugcacagugaagggugauuuguggggagggagcauuuuugguggucuuggggg

SEQ ID NO: 145788 - RNA, 64 nt, Homo Sapiens
agggagcauuuuugguggucuugggggaggggaggggagggaagggcugguguugauuuuccuc

SEQ ID NO: 145789 - RNA, 64 nt, Homo Sapiens
cccccaagcagagcggguaaagugcaauggguaagggagggaaggggaauggaagagaaaagac

SEQ ID NO: 145790 - RNA, 64 nt, Homo Sapiens
ggagggaaggggaauggaagagaaaagacagggugggagggaggagggagugcuguguuuuagu

SEQ ID NO: 145791 - RNA, 64 nt, Homo Sapiens
agaacugggccugaccuaccgcccggggucugucgggagggaaguggucuucggugcuucccgg

SEQ ID NO: 145792 - RNA, 64 nt, Homo Sapiens
ccucagggccacuagugauggcauuccaucccuugggagggagucuguuuuaguauuuggauuu

SEQ ID NO: 145793 - RNA, 64 nt, Homo Sapiens
cucuucccaaaacugugccuguccccagcuucuggggagggacacagcuuccccuucccaggaa

SEQ ID NO: 145794 - RNA, 64 nt, Homo Sapiens
ucuccucuucuagcccaugcccuuccccgguggagggagggagcagggagcccucacucuccac

SEQ ID NO: 145795 - RNA, 64 nt, Homo Sapiens
gaggagcgucuacgcccgggcagcugccccguccgggagggaggugggggggucagccccccgc

SEQ ID NO: 145796 - RNA, 64 nt, Homo Sapiens
gggucagccccccgcccggccagccgccccguccgggagggaggugggggggaucagccccccg

SEQ ID NO: 145797 - RNA, 64 nt, Homo Sapiens
ggaucagccccccgcccggccagccgccccguccgggagggagguggggggcgccucugcccgg

SEQ ID NO: 145798 - RNA, 64 nt, Homo Sapiens
cccgggcaguacuggggaccuucccugggggacggggagggaggaggcagcgacuccuuggaca

SEQ ID NO: 145799 - RNA, 64 nt, Homo Sapiens
gagcuggauccagagcuggaggggguggguccgggggagggaguggcucggaaggggcccccac

SEQ ID NO: 145800 - RNA, 64 nt, Homo Sapiens
ccugccaucauguuuacagaggacaguauuuguggggagggauuuggggcucagagugggguag

SEQ ID NO: 145801 - RNA, 64 nt, Homo Sapiens
aauggcaguaugguagagggauaaauagggggcggggagggauagucauggauccaagaagucc

SEQ ID NO: 145802 - RNA, 64 nt, Homo Sapiens
ggaauccaagaacaggaagccaagagagugagcagggagggauugggggugggggaggccucaa

SEQ ID NO: 145803 - RNA, 64 nt, Homo Sapiens
ccuucagccugugacuguugcugacuccaggggugggagggauggggagacuccccucuugcug

SEQ ID NO: 145804 - RNA, 64 nt, Homo Sapiens
guggggggcaggggucggggggagugggaaaugcgggagggaggaaagggagggaugggucuag

SEQ ID NO: 145805 - RNA, 64 nt, Homo Sapiens
ggucuagggagugggaaauguuuuuuggggaaaagggagggauguuuuuuuuuuuccugggaau

SEQ ID NO: 145806 - RNA, 64 nt, Homo Sapiens
ggcugagauugcagcccaugacugccuaaggugugggagggacuuccccaugaggggccaagac

SEQ ID NO: 145807 - RNA, 55 nt, Homo Sapiens
gggacuugugggucugauccgcugcgggagggagaugggggcgucuagagacuga

SEQ ID NO: 145808 - RNA, 64 nt, Homo Sapiens
cgugccuccccaccccucccagcagcugcgcugggggagggaagguuccggcaaagacagagcc

SEQ ID NO: 145809 - RNA, 64 nt, Homo Sapiens
gggauaaauaaaggcaaagaggagcccggggguugggagggacagaggagugagauagaacuug

SEQ ID NO: 145810 - RNA, 64 nt, Homo Sapiens
uuuuuugagacagggucucacaggcagcuggcaugggagggacugcaccugagugguugggaca

SEQ ID NO: 145811 - RNA, 64 nt, Homo Sapiens
ucaaauaagaggagagaaaagggcauguuaucaugggagggaagauaguggcucucagcccuug

SEQ ID NO: 145812 - RNA, 64 nt, Homo Sapiens
auuauuuuagcuauuuauuuuuaggagugacugggggagggaaguaauguuuggugucuguuuc

SEQ ID NO: 145813 - RNA, 64 nt, Homo Sapiens
caguuuugugggaaauauucguagggagagggaagggagggaaagggaggggggugggaggggu

SEQ ID NO: 145814 - RNA, 64 nt, Homo Sapiens
cugcuguggguuuaacuccuugugauaguaauaggggagggaggggguuaauuuacccacagaa

SEQ ID NO: 145815 - RNA, 64 nt, Homo Sapiens
caggcuuggaggguuaauuuuugggaugugggcagggagggaaggaagcuagacccaaucuccu

SEQ ID NO: 145816 - RNA, 64 nt, Homo Sapiens
gguagggacagaagcuagacgaggacugguguaagggagggaggaauggggccacauagcagca

SEQ ID NO: 145817 - RNA, 64 nt, Homo Sapiens
gaaaucacauccgccccaacgguccgaggguggugggagggauaauugggguagaaaaggagag

SEQ ID NO: 145818 - RNA, 64 nt, Homo Sapiens
ugagagucacagacacugaggucccacggggcaggggagggaaucucagcccgccagcugaggg

SEQ ID NO: 145819 - RNA, 64 nt, Homo Sapiens
gggaggggagaaagggagauuauuauuugggggagggagggaugguuuuuggcuauuacuggug

SEQ ID NO: 145820 - RNA, 64 nt, Homo Sapiens
gauggggaggggagaaaggggguguauuauuugggggagggagguguaguuuuuggcuauuacu

SEQ ID NO: 145821 - RNA, 64 nt, Homo Sapiens
acgcgaggggaaaggccugugaaggugcuggaaagggagggaggggaagaaaaacaggccgagu

SEQ ID NO: 145822 - RNA, 64 nt, Homo Sapiens
gacaagaugcaacuaggaagaagauggauggaaagggagggaaaggaugacggggggugggaac

SEQ ID NO: 145823 - RNA, 64 nt, Homo Sapiens
agugcccaagcgcuuggccuggaugaaugagagagggagggaacugaaggggagggaggaaaau

SEQ ID NO: 145824 - RNA, 64 nt, Homo Sapiens
aaaauggaugaaugagagagucuacacccugaaggggagggagggugaauccuccaggcccuuc

SEQ ID NO: 145825 - RNA, 64 nt, Homo Sapiens
cuccaggggugcaguggggugggugaggacgggugggagggacagggagggaccaauaaaucau

SEQ ID NO: 145826 - RNA, 64 nt, Homo Sapiens
gcaguggggugggugaggacgggugggagggacagggagggaccaauaaaucauaaugaagaaa

SEQ ID NO: 145827 - RNA, 64 nt, Homo Sapiens
cucugucucaugcucccaggcugcacagcaggcagggagggaggcaaggcaggggaguggggcc

SEQ ID NO: 145828 - RNA, 64 nt, Homo Sapiens
guuccagggaggaggugcucgguugacaccaucagggagggagggugggcacugcugggcugag

SEQ ID NO: 145829 - RNA, 64 nt, Homo Sapiens
gggaaucacacugggcugaccuggcauugggagagggagggaggaaggaagggagggaggggcu

SEQ ID NO: 145830 - RNA, 64 nt, Homo Sapiens
ugaccuggcauugggagagggagggaggaaggaagggagggaggggcuggaagauacugaagga

SEQ ID NO: 145831 - RNA, 64 nt, Homo Sapiens
ggggccuguccagagggucuucagaagccccccugggagggaggggaggaugagcacgcccagc

SEQ ID NO: 145832 - RNA, 64 nt, Homo Sapiens
cuaguuugugaggcuguggccccgagcuggcggagggagggaagaggagggagugacgggaggg

SEQ ID NO: 145833 - RNA, 64 nt, Homo Sapiens
caccugaggagacuuuggggacagggcaggggcagggagggaaacugaggaaaucuuccauucc

SEQ ID NO: 145834 - RNA, 64 nt, Homo Sapiens
agaugggcggguuugugcuaugugcaggguggaagggagggaaguugacaggucagaagaucag

SEQ ID NO: 145835 - RNA, 64 nt, Homo Sapiens
gaccucaagauuccacucugugcccgccucugccgggagggagggaggcacacagguggagcug

SEQ ID NO: 145836 - RNA, 64 nt, Homo Sapiens
ucaagauuccacucugugcccgccucugccgggagggagggaggcacacagguggagcugaccc

SEQ ID NO: 145837 - RNA, 63 nt, Homo Sapiens
acgggaccccucugcccugaccccacggggccggggagggaggggaccccccuccaccccccu

SEQ ID NO: 145838 - RNA, 64 nt, Homo Sapiens
auuuauugaucaaucucucugcgggguggggugggggagggacgggagcugguugggguggcuu

SEQ ID NO: 145839 - RNA, 64 nt, Homo Sapiens
gcuuccuccuaaaucaagcacaaugggggagggagggagggaaacuuugcugaguuccggggug

SEQ ID NO: 145840 - RNA, 64 nt, Homo Sapiens
gaaagcuuccuccuaaaucaggugcaaugggggagggagggaggucaccuuugcugaguuccgg

SEQ ID NO: 145841 - RNA, 64 nt, Homo Sapiens
gagggaaagcuuccuccuaaccggggugcaaugggggagggagguggcucaccuuugcugaguu

SEQ ID NO: 145842 - RNA, 64 nt, Homo Sapiens
auggcgguggguuuuuguaucagagcaggagggagggagggacguuccaggcccaucccuggcc

SEQ ID NO: 145843 - RNA, 64 nt, Homo Sapiens
gacgauggcgguggguuuuuggcccagagcaggagggagggaggcuccuuccaggcccaucccu

SEQ ID NO: 145844 - RNA, 64 nt, Homo Sapiens
agccaaauugggcggccaccucaggcacagggaggggagggaucccccaccuaccucagcuggg

SEQ ID NO: 145845 - RNA, 64 nt, Homo Sapiens
auuuuauaaugaaccaaaaagucacagcaggggagggagggacagguuucucauaccccacaag

SEQ ID NO: 145846 - RNA, 64 nt, Homo Sapiens
gacaauuuuauaaugaaccacaaggucacagcaggggagggaggccuagguuucucauacccca

SEQ ID NO: 145847 - RNA, 64 nt, Homo Sapiens
gggaaguuaagggggucaccaaaguggugguagggggagggagguggguuucuaagcucugggc

SEQ ID NO: 145848 - RNA, 64 nt, Homo Sapiens
gagacccagagggcagcgucgagccagugggggagggagggacaucucaacaaacaaacaaaaa

SEQ ID NO: 145849 - RNA, 64 nt, Homo Sapiens
gacagagacccagagggcagaaaagagccagugggggagggaggcccgucucaacaaacaaaca

SEQ ID NO: 145850 - RNA, 64 nt, Homo Sapiens
gcaggguggagggcaaggcuccucccuagagggagggagggagggaggucugcaggaccucaca

SEQ ID NO: 145851 - RNA, 64 nt, Homo Sapiens
gagggcaggguggagggcaacacaccucccuagagggagggaggaguugaggucugcaggaccu

SEQ ID NO: 145852 - RNA, 64 nt, Homo Sapiens
gccaaaaagaaaagggagaguggcagaagagggagggagggagguagcacauccuccaguuaca

SEQ ID NO: 145853 - RNA, 64 nt, Homo Sapiens
gagggccaaaaagaaaaggguacauggcagaagagggagggaggcucauagcacauccuccagu

SEQ ID NO: 145854 - RNA, 64 nt, Homo Sapiens
caggagguacaccagcuggacaaauugcagggaggggagggagcgagggccaacccggccccuc

SEQ ID NO: 145855 - RNA, 64 nt, Homo Sapiens
gaagaauucaggggaugugggaaguggggaggcggggagggaucuugacucuugucuccuuugu

SEQ ID NO: 145856 - RNA, 64 nt, Homo Sapiens
uuuaaaaauuccuuuagucuguaaaacuccuagagggagggagguaacugaauucacuucuuuu

SEQ ID NO: 145857 - RNA, 64 nt, Homo Sapiens
cugcaguuucauagucccagccuuccuggugcuggggagggaggacugugaauggcuguucucc

SEQ ID NO: 145858 - RNA, 64 nt, Homo Sapiens
augugaaacacauuagcaaugcuuuacauggguggggagggaaagaacagcuuuuuugggacaa

SEQ ID NO: 145859 - RNA, 64 nt, Homo Sapiens
cguucaggagaggagccuuacccuuaucaggcaugggagggacaaaguuccagagaugugucag

SEQ ID NO: 145860 - RNA, 64 nt, Homo Sapiens
ucaaauaaagcuuuauuuugugaaugaucuguaggggagggaguuggacauggucccgggcauc

SEQ ID NO: 145861 - RNA, 64 nt, Homo Sapiens
guuuguccucuuugccccacgccgggucccuuaggggagggagaaggggaaggaggcccaguga

SEQ ID NO: 145862 - RNA, 64 nt, Homo Sapiens
guggaggguuugacgggccugcggcgggaggggagggagggagagagggggcccacccuuaaag

SEQ ID NO: 145863 - RNA, 64 nt, Homo Sapiens
gagaguggaggguuugacggaaaggcggcgggaggggagggagggggggagggggcccacccuu

SEQ ID NO: 145864 - RNA, 64 nt, Homo Sapiens
uggcaguuucaaaucgcccagggugggggagggagggagggaguuuaugucacuuuagaaucaa

SEQ ID NO: 145865 - RNA, 64 nt, Homo Sapiens
gaguuggcaguuucaaaucgucaagggugggggagggagggaggauucuuaugucacuuuagaa

SEQ ID NO: 145866 - RNA, 64 nt, Homo Sapiens
gagggaguuggcaguuucaaagaaucaagggugggggagggaggcaccauucuuaugucacuuu

SEQ ID NO: 145867 - RNA, 64 nt, Homo Sapiens
gcagggagugauguggccgggccaaggacaggcagggagggaggccaggccucgcuugcaccgc

SEQ ID NO: 145868 - RNA, 64 nt, Homo Sapiens
ucaggaccguggcuccagaacuccugugccaggcgggagggaagggcggcacuggagagauggg

SEQ ID NO: 145869 - RNA, 64 nt, Homo Sapiens
ucuagaauaacacccuucuaggggaggcgggugggggagggagggaucauaaccccuucugugc

SEQ ID NO: 145870 - RNA, 64 nt, Homo Sapiens
gaauaacacccuucuaggggaggcgggugggggagggagggaucauaaccccuucugugccuug

SEQ ID NO: 145871 - RNA, 64 nt, Homo Sapiens
gaggcagcagaguuggggcacagucugagagcaggggagggaaggcgaguggagaaacgcccuc

SEQ ID NO: 145872 - RNA, 64 nt, Homo Sapiens
uagaagaaggugccccuuccuggaaacuuccauagggagggagcugugaugaagcugagcagag

SEQ ID NO: 145873 - RNA, 64 nt, Homo Sapiens
gggagggcugaauuguuuugugaguugguggggagggagggaggagccccauguuuuguuuuuc

SEQ ID NO: 145874 - RNA, 64 nt, Homo Sapiens
gagggggagggcugaauuguuuucugaguugguggggagggaggugggagccccauguuuuguu

SEQ ID NO: 145875 - RNA, 64 nt, Homo Sapiens
gucccaccacguucucagggugggcagucagggagggagggagucaacucagccaacccaggug

SEQ ID NO: 145876 - RNA, 64 nt, Homo Sapiens
gagugucccaccacguucucggugugggcagucagggagggaggccuccaacucagccaaccca

SEQ ID NO: 145877 - RNA, 64 nt, Homo Sapiens
ggcaggguccccaauguccguguucuccagucuggggagggagagaguguugacaacccaaagc

SEQ ID NO: 145878 - RNA, 64 nt, Homo Sapiens
cggaugaacugaggcgcagcggaccagugagcuggggagggacuccucucccaucccuuggccu

SEQ ID NO: 145879 - RNA, 64 nt, Homo Sapiens
gucgcugugaucagaguggguguaggcagggacggggagggacuccagagcuggcagugugagc

SEQ ID NO: 145880 - RNA, 64 nt, Homo Sapiens
aauauauauauauaaaucuaggggggaauuaaaagggagggauaugggaugauggggaaagggu

SEQ ID NO: 145881 - RNA, 64 nt, Homo Sapiens
auacacaccaucaccuuugaaagugcuuguuugggggagggaaggacauacggguaacuagaac

SEQ ID NO: 145882 - RNA, 64 nt, Homo Sapiens
acccagccugugccccacaaggaucucucuaaaugggagggauugaggcuacuuuucugccaag

SEQ ID NO: 145883 - RNA, 64 nt, Homo Sapiens
acaagcggcccccgccuccagaccccaugggagugggagggaugggccacaccucagugccaaa

SEQ ID NO: 145884 - RNA, 64 nt, Homo Sapiens
cauucaucuacagacuccaaguuuccuuuuccgugggagggaggcugacaugcugcagucggaa

SEQ ID NO: 145885 - RNA, 64 nt, Homo Sapiens
ggugggaggaaugggaagcaggaugggagggaaggggagggaaaugggagggagggcuggggau

SEQ ID NO: 145886 - RNA, 64 nt, Homo Sapiens
gggagggaaaggugggaggaggcuggggauggaugggagggaagggaggaagagugggagggag

SEQ ID NO: 145887 - RNA, 64 nt, Homo Sapiens
gcuggggauggaugggaggguggggaggaagagugggagggaggcugauggcugggaagggagu

SEQ ID NO: 145888 - RNA, 64 nt, Homo Sapiens
agggggaggaaaggggcgaggggccagggugggagggagggacacugggucucacuccugagug

SEQ ID NO: 145889 - RNA, 64 nt, Homo Sapiens
gacaagggggaggaaaggggaguggggccagggugggagggagggccacugggucucacuccug

SEQ ID NO: 145890 - RNA, 64 nt, Homo Sapiens
gaccaaagggugcagugaugggcuggguggcgggcccagggaaaugggguggggaugggcuggg

SEQ ID NO: 145891 - RNA, 64 nt, Homo Sapiens
cucccuccagaauuuccuccagaugggggcagugcccagggagggguuauuugucuucccugcc

SEQ ID NO: 145892 - RNA, 64 nt, Homo Sapiens
gugccuuggggugcagaaucuguacugggaccuucccagggaaguggaaggcguuucugagucu

SEQ ID NO: 145893 - RNA, 64 nt, Homo Sapiens
gugggcuggggggggggcagcagaagcguaugaucccagggaggccccggcucuucacagcagg

SEQ ID NO: 145894 - RNA, 64 nt, Homo Sapiens
ucuaaagcuuggggcuccagaaaucacucguguccccagggacucaccagcagccccccuaaaa

SEQ ID NO: 145895 - RNA, 64 nt, Homo Sapiens
cauccuagggcagguagcacgucccagagauggucccagggagcuuggcuuccuggucgccucu

SEQ ID NO: 145896 - RNA, 64 nt, Homo Sapiens
agagcucucaauuuuuuauuacuccuuccccaaacccagggaaaauguggaauucccuacccug

SEQ ID NO: 145897 - RNA, 64 nt, Homo Sapiens
gaccccuggcccaagcucccagggaccuaccccucccagggaccugcccagcucuaccccuccc

SEQ ID NO: 145898 - RNA, 64 nt, Homo Sapiens
uaccccucccagggaccgacccagcucuaccccucccagggaccgccacuggccaugcugcugc

SEQ ID NO: 145899 - RNA, 64 nt, Homo Sapiens
acugggaaccuuaucucuuggugauaauauaauucccagggaggguucuuagugauacugaccu

SEQ ID NO: 145900 - RNA, 64 nt, Homo Sapiens
augugcucuccacacccaggcuggcagcucugcacccagggacccagcugccucaacucugucu

SEQ ID NO: 145901 - RNA, 64 nt, Homo Sapiens
uauauacauuauucuauguggcccucacugaugccccagggaaguaugcauuagccuucccauu

SEQ ID NO: 145902 - RNA, 64 nt, Homo Sapiens
uugagagguuuggggccuuguuccccagaggguccccagggacucugcaguguccuuggcaaau

SEQ ID NO: 145903 - RNA, 64 nt, Homo Sapiens
cccgagauagccaccuggaaacacuaggugccugcccagggaggaacggaggaggacucgcgcu

SEQ ID NO: 145904 - RNA, 64 nt, Homo Sapiens
gaacggaggaggacucgcgcuacaagaggccacucccagggacccagggaggcgauggccaccc

SEQ ID NO: 145905 - RNA, 64 nt, Homo Sapiens
gaggacucgcgcuacaagaggccacucccagggacccagggaggcgauggccaccccagaggcc

SEQ ID NO: 145906 - RNA, 64 nt, Homo Sapiens
gaccuggggcuugagcugaggaugggacgaugugcccagggagggacccaccagagcacaagag

SEQ ID NO: 145907 - RNA, 64 nt, Homo Sapiens
cagagcacaagagaagguggcuaccugggggugucccagggacucugucagugccuucagccca

SEQ ID NO: 145908 - RNA, 62 nt, Homo Sapiens
ccaggccccgguggcgguaacugccccaaggccccagggacagaggccaaggacugacuuug

SEQ ID NO: 145909 - RNA, 64 nt, Homo Sapiens
cuucugcuggaggaggggaagcugggcccaaaggcccagggaggcagcgugggcucugccaaug

SEQ ID NO: 145910 - RNA, 64 nt, Homo Sapiens
caaccuuagccccucagaacagggagucccaggacccagggagaguguggggacaggacagccu

SEQ ID NO: 145911 - RNA, 64 nt, Homo Sapiens
uccuggggugggaggcacaggggcaaagcaauaccccagggaaagugggagguggugcuggugc

SEQ ID NO: 145912 - RNA, 64 nt, Homo Sapiens
uuaaaacagacauuccacagucagccaggccagccccagggagccauccccuuggcagcugccg

SEQ ID NO: 145913 - RNA, 64 nt, Homo Sapiens
caccucccucagccucccgccuccucaccagccacccagggagucacagccuggugccgaggcu

SEQ ID NO: 145914 - RNA, 64 nt, Homo Sapiens
gagaaccaugccaugcugaaugaggggcaggagucccagggaaauguccuccaagacuccuuaa

SEQ ID NO: 145915 - RNA, 64 nt, Homo Sapiens
cuuguugccuggugaaccugguggcugcaaggaacccagggaccagcccuggauuuuggagccu

SEQ ID NO: 145916 - RNA, 64 nt, Homo Sapiens
cccagcgugcaacagccacggcucucuuggagcacccagggacacgccugcgucccaccguggg

SEQ ID NO: 145917 - RNA, 64 nt, Homo Sapiens
uagaaaccagucuccauguguagauuaagcuguccccagggaagcagagugcaagagcagaaga

SEQ ID NO: 145918 - RNA, 64 nt, Homo Sapiens
ugcaccucccaugauguccuggcuuuguggcaaccccagggaggugcagcaguuucacuccuuc

SEQ ID NO: 145919 - RNA, 64 nt, Homo Sapiens
ucacuguguggaguggggcaggcaggggcuggaccccagggacuugccuuccccacccacucug

SEQ ID NO: 145920 - RNA, 64 nt, Homo Sapiens
acuugccuuccccacccacucugcugccagcaggcccagggaucccugaccugcaccagguggc

SEQ ID NO: 145921 - RNA, 64 nt, Homo Sapiens
aaauuuaugggacaggaaaugcaggaugggacuccccagggaacgcagggugaagggaacaaag

SEQ ID NO: 145922 - RNA, 64 nt, Homo Sapiens
caaccucagcgucaugccagaaugcacagggcagcccagggagaucacaccuuuggcaaagucc

SEQ ID NO: 145923 - RNA, 64 nt, Homo Sapiens
ggggguggggguaggugggcugcaguguagguuucccagggaagccggcucagugcuggaaugu

SEQ ID NO: 145924 - RNA, 64 nt, Homo Sapiens
accucggcuuuuaauuuaaauaggguuuuauuaucccagggacuugaaauacugccauucuagg

SEQ ID NO: 145925 - RNA, 64 nt, Homo Sapiens
gaauggaggacugggaggagucugagaaaguggccccagggagauguucaugaaauaaggcauc

SEQ ID NO: 145926 - RNA, 64 nt, Homo Sapiens
gugguuuucacuucuucgucuucucagcauucagcccagggaauguuagauuuuggcacccguu

SEQ ID NO: 145927 - RNA, 64 nt, Homo Sapiens
gcccgugaagacuuuggccuucccagacucccaccccagggauuauccuucauuauccacccca

SEQ ID NO: 145928 - RNA, 64 nt, Homo Sapiens
cccaccccacuucugcaacccuguggacugaugccccagggauuccaucgcuggcccccaccuc

SEQ ID NO: 145929 - RNA, 64 nt, Homo Sapiens
ggcugugucccugcugggguggucaggaccaggacccagggagagaaggcaggaguugggggca

SEQ ID NO: 145930 - RNA, 64 nt, Homo Sapiens
gugagcuggugccugcuuugcagaguggccacggcccagggaggaggcugggcugagccaaagc

SEQ ID NO: 145931 - RNA, 64 nt, Homo Sapiens
uacgugguaacaagguugucauuuauuuaaacaccccagggaguccuuucuauguggcauauuu

SEQ ID NO: 145932 - RNA, 64 nt, Homo Sapiens
cagacggcagacacaccugugggccugggcuuggcccagggaaagaggacggcgugggcagccu

SEQ ID NO: 145933 - RNA, 64 nt, Homo Sapiens
ugggaagaccacgggaccuccccccagcagcugccccagggacaacagccgguguccuggaaag

SEQ ID NO: 145934 - RNA, 64 nt, Homo Sapiens
ucaguuuucccauauguaaaugagccaggguucccccagggaacccagggaggccaacugacuc

SEQ ID NO: 145935 - RNA, 64 nt, Homo Sapiens
cagccagacccgugcccaaucggugguugucccucccagggauggagagggagcccuguguucc

SEQ ID NO: 145936 - RNA, 64 nt, Homo Sapiens
auggggagggaguggcccagacuuguggguggggcccagggaggcccugccugaagcucuggaa

SEQ ID NO: 145937 - RNA, 64 nt, Homo Sapiens
acaaaaacacguaggggcagggacgguccccacccccagggacacaaccccuggucuuggacca

SEQ ID NO: 145938 - RNA, 64 nt, Homo Sapiens
gaaaggagucccaggccugucccuagggacaaggcccagggaagaguguauuuggggagcaggg

SEQ ID NO: 145939 - RNA, 64 nt, Homo Sapiens
cuggaugcgcugggagccccaacaugugcacccucccagggacauggguuugcaggaaggccug

SEQ ID NO: 145940 - RNA, 64 nt, Homo Sapiens
uagggggguacgggugaaagacuuauugcccaaacccagggagucuccucaauuucuuggccuc

SEQ ID NO: 145941 - RNA, 64 nt, Homo Sapiens
gaaggacacagugcguggagccccccauguggcacccagggacuuuaucuucccacugugguaa

SEQ ID NO: 145942 - RNA, 64 nt, Homo Sapiens
auucuucaaagcccccuccugacuggguagaaaccccagggaugggggugcaggacccuaagua

SEQ ID NO: 145943 - RNA, 64 nt, Homo Sapiens
ccagcgaaugacgucuguggacacucauuuagugcccagggaguagcagccuuaaggaugcuag

SEQ ID NO: 145944 - RNA, 64 nt, Homo Sapiens
uucuggagguuccuuucuguguggccgggagagacccagggagguaaaguuuucuuuuauuugg

SEQ ID NO: 145945 - RNA, 64 nt, Homo Sapiens
gaggguguguaccccaaggcgaggugcuggcggccccagggaagccauccgggauagggcagag

SEQ ID NO: 145946 - RNA, 64 nt, Homo Sapiens
ccccucuaugucugagaggccucuggagaugucacccagggagcugucugggggacaagggggu

SEQ ID NO: 145947 - RNA, 64 nt, Homo Sapiens
gccaaagcugaccucugaguggccaacugcagcucccagggacuccgagaccuccgguccgaga

SEQ ID NO: 145948 - RNA, 64 nt, Homo Sapiens
ggggucccugagagugcccccacccaucucaugccccagggaccgccacugcccaccgccucca

SEQ ID NO: 145949 - RNA, 64 nt, Homo Sapiens
uucuauuuaaguggcuucugaggauaucuucucccccagggaucacucuguaaggaccuggggc

SEQ ID NO: 145950 - RNA, 64 nt, Homo Sapiens
gugcucagguaaguggggccccaugagcuuucuacccagggacuccagggcagccuggccacug

SEQ ID NO: 145951 - RNA, 64 nt, Homo Sapiens
augguccccagcagugccugguucugagcaaacucccagggaagaaaacggcccugucuccaug

SEQ ID NO: 145952 - RNA, 64 nt, Homo Sapiens
guugaagcucuucagaggagcuggaacugucuaccccagggacacacccauuucguugcuaccc

SEQ ID NO: 145953 - RNA, 64 nt, Homo Sapiens
gguauagaggugucauaggcggaaggcuggagugcccagggagaucuacucccagggaccugcu

SEQ ID NO: 145954 - RNA, 64 nt, Homo Sapiens
ugcuggaaggcuggagugccgcucugucucuacucccagggaccaccaggcuuugcagcccugg

SEQ ID NO: 145955 - RNA, 64 nt, Homo Sapiens
ggccccagccacggcugcagagccugggcucagccccagggagggcagggagagcaaggggcaa

SEQ ID NO: 145956 - RNA, 64 nt, Homo Sapiens
uagaggaagggagguuugagccagacaggccuuucccagggaagccuccucccaggugcuugcc

SEQ ID NO: 145957 - RNA, 64 nt, Homo Sapiens
ccugggguaccuagucaccaggaucuccaggacucccagggagcagagucuucucaucuuuuca

SEQ ID NO: 145958 - RNA, 64 nt, Homo Sapiens
gcuggcaucuguagcucgguggcuugacauucuccccagggacuucccgguuccuaguucuuug

SEQ ID NO: 145959 - RNA, 64 nt, Homo Sapiens
aaggcagaagccacaagaggccuugagugccacccccagggaagaacauaaaggguugcacaau

SEQ ID NO: 145960 - RNA, 64 nt, Homo Sapiens
cucaauccaccccugacccaucugucagcuuuuucccagggagccguuucagggguucugggca

SEQ ID NO: 145961 - RNA, 64 nt, Homo Sapiens
agccaaaugcaguuccaaauaguggacauaaucucccagggaaaucugggcucgaggccuacaa

SEQ ID NO: 145962 - RNA, 64 nt, Homo Sapiens
aguuccuggugugggccagcugguguuggguggccccagggagucacacagucuguacccggcc

SEQ ID NO: 145963 - RNA, 64 nt, Homo Sapiens
ugccuaggggagcugggccaggcacuagccuuugcccagggaggugggccucaggcugcccagg

SEQ ID NO: 145964 - RNA, 64 nt, Homo Sapiens
cuauccugucuguccccaccccagcuguccccugcccagggagcuggcauaaaagcacgaggcc

SEQ ID NO: 145965 - RNA, 64 nt, Homo Sapiens
gggauuccugagugucagugacuugggauucccacccagggacucaagccagccacccccuucu

SEQ ID NO: 145966 - RNA, 64 nt, Homo Sapiens
ucuuucaucgucauggaaacuuguaucccauuugcccagggaacugccacuccugguugccaug

SEQ ID NO: 145967 - RNA, 64 nt, Homo Sapiens
cacggaccaaagggagucugccagggccccucuccccagggaagcagcagccucgccccuggca

SEQ ID NO: 145968 - RNA, 64 nt, Homo Sapiens
gcuccuuugggcuucagcugccaguguccugagccccagggagagggggcuggugggugccuag

SEQ ID NO: 145969 - RNA, 64 nt, Homo Sapiens
cguggcacgggccccccgcccccgagaucuggagcccagggacuuucuuccuggcagaucugug

SEQ ID NO: 145970 - RNA, 64 nt, Homo Sapiens
ggggcacagugugaaacccgcacccuagccaggccccagggagccuccgcugggcccagacagc

SEQ ID NO: 145971 - RNA, 64 nt, Homo Sapiens
cugggucggcuucugucccugucacacccccaaccccagggaggggcugucauagucccagagg

SEQ ID NO: 145972 - RNA, 64 nt, Homo Sapiens
aauaccuauuucugacugagucucccagcccagacccagggacccuuggccccaagcucagcuc

SEQ ID NO: 145973 - RNA, 64 nt, Homo Sapiens
ugcacuccccgugcgguacaggggcacuucguaacccagggaaagggcggggggcauauuugca

SEQ ID NO: 145974 - RNA, 64 nt, Homo Sapiens
caagcgcgcucggugcgggcaggcucgcauugcacccagggagcuggaguugagcuguuccccu

SEQ ID NO: 145975 - RNA, 64 nt, Homo Sapiens
gcucugacccuggaaugggguugguuuggacacccccagggaucugagcccugacccuuuguga

SEQ ID NO: 145976 - RNA, 64 nt, Homo Sapiens
gcaggagccauccgccccccucagccccuuccuccccagggagcaaagccauaaggggcagggg

SEQ ID NO: 145977 - RNA, 64 nt, Homo Sapiens
uggccauugccagaagccugaccaucucccggaccccagggaggcccugagcuguccagacccc

SEQ ID NO: 145978 - RNA, 64 nt, Homo Sapiens
ccgucaccggcccggcccauuuuucgggacuugccccagggaagcccucugugccagaaauggg

SEQ ID NO: 145979 - RNA, 64 nt, Homo Sapiens
ccacuccauuccuccgccccgugucuuaacuccccccagggaugaaugaaacugcaaaccucgu

SEQ ID NO: 145980 - RNA, 64 nt, Homo Sapiens
ccucgagucgcccugcccaggccacaccaguccucccagggagucaaaggcccaacccccagag

SEQ ID NO: 145981 - RNA, 64 nt, Homo Sapiens
acaugggggucacugcugccgcugugacucagggcccagggaucguggugggggguggauggcg

SEQ ID NO: 145982 - RNA, 64 nt, Homo Sapiens
caugggcagagcuggggagcggggucagggaggccccagggaccgauggagggcugggcgccau

SEQ ID NO: 145983 - RNA, 64 nt, Homo Sapiens
cuaagaggagggugcaacgauuagggcuggagaacccagggaaggcaggaagcugcuaccaccc

SEQ ID NO: 145984 - RNA, 64 nt, Homo Sapiens
gcggcaggcuccacuucggcggaugggcucuuaccccagggaggggccugucuggggacaugua

SEQ ID NO: 145985 - RNA, 64 nt, Homo Sapiens
ucaagggauuucccugucucagagcagccuuugccccagggaaaugggcucugggcuggcugcc

SEQ ID NO: 145986 - RNA, 64 nt, Homo Sapiens
caggcagcccucccagugcccaagggccaccaaccccagggaaacagggccagcacagaggggc

SEQ ID NO: 145987 - RNA, 64 nt, Homo Sapiens
ugucccuggggcagacacuagaagcccauggaagcccagggagacgaaagcucaggggagcaca

SEQ ID NO: 145988 - RNA, 64 nt, Homo Sapiens
cugggugggguggguguugagugggcugaggccucccagggaaguuugauuuaauccuuuggcu

SEQ ID NO: 145989 - RNA, 64 nt, Homo Sapiens
uggaguagacagccuggccucgaggugcacucgccccagggagaaaggaugcugccaggugacc

SEQ ID NO: 145990 - RNA, 64 nt, Homo Sapiens
accugcuggcguuggcuguggaccacugcuggaucccagggagacuuggggcagcccccagaag

SEQ ID NO: 145991 - RNA, 64 nt, Homo Sapiens
ggaaucuagaggaauacgugugauucaccuccagcccagggaaucaguccccuccgggaugacc

SEQ ID NO: 145992 - RNA, 64 nt, Homo Sapiens
aggcgccgcugagacccuucaggcuucuauccuucccagggagggagucccuuccccuucagag

SEQ ID NO: 145993 - RNA, 64 nt, Homo Sapiens
ggggggaacccaaggcacagcaaccccaaaugugcccagggaggccccaccgugugggcugccc

SEQ ID NO: 145994 - RNA, 64 nt, Homo Sapiens
ccccaucauuucacccucacuugggaguaaggcccccagggacaaccaaaggacuugaucugag

SEQ ID NO: 145995 - RNA, 64 nt, Homo Sapiens
gcuggauaugcccaccccugccaaaagcccugaccccagggaaggaggcugcucacccagccuu

SEQ ID NO: 145996 - RNA, 64 nt, Homo Sapiens
aaagggacugggaaguaaagggaaaccauauggccccagggaauggacccuuggagacucccau

SEQ ID NO: 145997 - RNA, 64 nt, Homo Sapiens
ccuggagcccccaggagcuggaugcggccacaagcccagggacaagacagaggcagacuggagu

SEQ ID NO: 145998 - RNA, 64 nt, Homo Sapiens
ccuggaguccccaggagcuggaugcugccccaagcccagggaugacagaggcagagacugaagu

SEQ ID NO: 145999 - RNA, 64 nt, Homo Sapiens; identical to SEQ ID NO: 96836

SEQ ID NO: 146000 - RNA, 64 nt, Homo Sapiens; identical to SEQ ID NO: 96837

SEQ ID NO: 146001 - RNA, 64 nt, Homo Sapiens; identical to SEQ ID NO: 96838

SEQ ID NO: 146002 - RNA, 64 nt, Homo Sapiens; identical to SEQ ID NO: 96839

SEQ ID NO: 146003 - RNA, 64 nt, Homo Sapiens; identical to SEQ ID NO: 96840

SEQ ID NO: 146004 - RNA, 64 nt, Homo Sapiens; identical to SEQ ID NO: 96841

SEQ ID NO: 146005 - RNA, 64 nt, Homo Sapiens; identical to SEQ ID NO: 96842

SEQ ID NO: 146006 - RNA, 64 nt, Homo Sapiens; identical to SEQ ID NO: 96843

SEQ ID NO: 146007 - RNA, 64 nt, Homo Sapiens; identical to SEQ ID NO: 96844

SEQ ID NO: 146008 - RNA, 64 nt, Homo Sapiens; identical to SEQ ID NO: 96845

SEQ ID NO: 146009 - RNA, 64 nt, Homo Sapiens; identical to SEQ ID NO: 96846

SEQ ID NO: 146010 - RNA, 64 nt, Homo Sapiens; identical to SEQ ID NO: 96847

SEQ ID NO: 146011 - RNA, 64 nt, Homo Sapiens; identical to SEQ ID NO: 96848

SEQ ID NO: 146012 - RNA, 64 nt, Homo Sapiens; identical to SEQ ID NO: 96849

SEQ ID NO: 146013 - RNA, 64 nt, Homo Sapiens; identical to SEQ ID NO: 96850

SEQ ID NO: 146014 - RNA, 64 nt, Homo Sapiens; identical to SEQ ID NO: 96851

SEQ ID NO: 146015 - RNA, 64 nt, Homo Sapiens; identical to SEQ ID NO: 96852

SEQ ID NO: 146016 - RNA, 64 nt, Homo Sapiens; identical to SEQ ID NO: 96853

SEQ ID NO: 146017 - RNA, 64 nt, Homo Sapiens; identical to SEQ ID NO: 96854

SEQ ID NO: 146018 - RNA, 64 nt, Homo Sapiens; identical to SEQ ID NO: 96855

SEQ ID NO: 146019 - RNA, 64 nt, Homo Sapiens; identical to SEQ ID NO: 96856

SEQ ID NO: 146020 - RNA, 64 nt, Homo Sapiens; identical to SEQ ID NO: 96857

SEQ ID NO: 146021 - RNA, 64 nt, Homo Sapiens; identical to SEQ ID NO: 96858

SEQ ID NO: 146022 - RNA, 64 nt, Homo Sapiens; identical to SEQ ID NO: 96859

SEQ ID NO: 146023 - RNA, 64 nt, Homo Sapiens; identical to SEQ ID NO: 96860

SEQ ID NO: 146024 - RNA, 64 nt, Homo Sapiens; identical to SEQ ID NO: 96861

SEQ ID NO: 146025 - RNA, 64 nt, Homo Sapiens; identical to SEQ ID NO: 96862

SEQ ID NO: 146026 - RNA, 64 nt, Homo Sapiens; identical to SEQ ID NO: 96863

SEQ ID NO: 146027 - RNA, 64 nt, Homo Sapiens; identical to SEQ ID NO: 96864

SEQ ID NO: 146028 - RNA, 64 nt, Homo Sapiens; identical to SEQ ID NO: 96865

SEQ ID NO: 146029 - RNA, 64 nt, Homo Sapiens; identical to SEQ ID NO: 96866

SEQ ID NO: 146030 - RNA, 64 nt, Homo Sapiens; identical to SEQ ID NO: 96867

SEQ ID NO: 146031 - RNA, 64 nt, Homo Sapiens; identical to SEQ ID NO: 96868

SEQ ID NO: 146032 - RNA, 64 nt, Homo Sapiens; identical to SEQ ID NO: 96869

SEQ ID NO: 146033 - RNA, 64 nt, Homo Sapiens; identical to SEQ ID NO: 96870

SEQ ID NO: 146034 - RNA, 64 nt, Homo Sapiens; identical to SEQ ID NO: 96871

SEQ ID NO: 146035 - RNA, 64 nt, Homo Sapiens; identical to SEQ ID NO: 96872

SEQ ID NO: 146036 - RNA, 64 nt, Homo Sapiens; identical to SEQ ID NO: 96873

SEQ ID NO: 146037 - RNA, 64 nt, Homo Sapiens; identical to SEQ ID NO: 96874

SEQ ID NO: 146038 - RNA, 64 nt, Homo Sapiens; identical to SEQ ID NO: 96875

SEQ ID NO: 146039 - RNA, 62 nt, Homo Sapiens
uggcuuggucuggaugggacacugucagaguuuggccacagccuguccuuuacuucauccac

SEQ ID NO: 146040 - RNA, 62 nt, Homo Sapiens
gagaggggaagucuuggcagggaaaucccuuuuggccacacaguuuacaaacccaguaucau

SEQ ID NO: 146041 - RNA, 62 nt, Homo Sapiens
uucccuuuccaaaaaggcuacuccccuguuuguggccacaccguguaggguugugagcaaag

SEQ ID NO: 146042 - RNA, 62 nt, Homo Sapiens
uuggugcuugugcacgggacucauugucauuauggccacagucccaggaaggaguuugaggu

SEQ ID NO: 146043 - RNA, 62 nt, Homo Sapiens
cagguuuucccuaagaagauggaggugcccgcuggccacagccugcagcaagcagggcuuca

SEQ ID NO: 146044 - RNA, 62 nt, Homo Sapiens
gcuaucuggaggcuuugcagccccagcucccguggccacacacgcacugggcugccgucugu

SEQ ID NO: 146045 - RNA, 62 nt, Homo Sapiens
gggcugguggggaaggagcguuccagcuguucuggccacacuggugggucauuugagaggag

SEQ ID NO: 146046 - RNA, 62 nt, Homo Sapiens
caucacuuucuccuccuccucugaagccuuccuggccacaggcccauugacagaugagaggu

SEQ ID NO: 146047 - RNA, 62 nt, Homo Sapiens
cuuuuucuauccuguuuucaccccgggcucccuggccacaaggacacaaugccucacucagg

SEQ ID NO: 146048 - RNA, 62 nt, Homo Sapiens
aaugccauaaugccuguugggaccccagacucuggccacaaagauggcucuuguucagucaa

SEQ ID NO: 146049 - RNA, 62 nt, Homo Sapiens
gagccaaugcucaccagccccagagucagagcuggccacaggcuggcagccuccaggggcuu

SEQ ID NO: 146050 - RNA, 62 nt, Homo Sapiens
uaagccauguggcagggaccgucuugcccugcuggccacacucuggagaagcacuucucagc

SEQ ID NO: 146051 - RNA, 61 nt, Homo Sapiens; identical to SEQ ID NO: 110929

SEQ ID NO: 146052 - RNA, 62 nt, Homo Sapiens
gccucucagugcccuccagccccgcgaccauguggccacaauccacgcuucuccggaucgcg

SEQ ID NO: 146053 - RNA, 62 nt, Homo Sapiens
aacaaagaugcgaguugaagcugcacucucuguggccacaggaguggccacaaggcugcuuu

SEQ ID NO: 146054 - RNA, 62 nt, Homo Sapiens
gcugcuuucugcacucucugguuggucagcaguggccacaagaaguuagcuuugguagcucu

SEQ ID NO: 146055 - RNA, 62 nt, Homo Sapiens
ccagcaacuugaacuucaccugcaaagcucuguggccacauuuucagccaaagggaaauaug

SEQ ID NO: 146056 - RNA, 62 nt, Homo Sapiens
cauccuggcuggagaauguggagaacuaaagguggccacaaauucuuugacacucaaguccc

SEQ ID NO: 146057 - RNA, 62 nt, Homo Sapiens
ggaaggucaauauaugccuaacauuucuaaacuggccacauaaccuuagauuuuuaaaggaa

SEQ ID NO: 146058 - RNA, 62 nt, Homo Sapiens
uuccuacaugaucuuuaccuguuguuagacuguggccacagccaguaaaucaggccagagug

SEQ ID NO: 146059 - RNA, 62 nt, Homo Sapiens
cacuggaaggaagagccaucguggucuuugucuggccacaggccaggcugcugggcauccuc

SEQ ID NO: 146060 - RNA, 62 nt, Homo Sapiens
ccaucaccccucccaggccagccucuguaaguuggccacacuuggggagugaguguggguau

SEQ ID NO: 146061 - RNA, 62 nt, Homo Sapiens
ccucucuuuggaaaguuuagccuggaagcaguuggccacacuguguggagggcaccucucug

SEQ ID NO: 146062 - RNA, 62 nt, Homo Sapiens
gccugcgucccugcacacugcgaggacugccuuggccacaggcccacucccuacgacacgug

SEQ ID NO: 146063 - RNA, 62 nt, Homo Sapiens
ucaggcacccagguuccuacugucuugccauguggccacaguuagcaacaaaggaggcugua

SEQ ID NO: 146064 - RNA, 62 nt, Homo Sapiens
cucuuggaucagucacuguggccaugcauguuuggccacaugauuaauccagucugggucau

SEQ ID NO: 146065 - RNA, 62 nt, Homo Sapiens
acagaugugcuguugguccaggugucccagucuggccacagcccugccuccgcccucaccua

SEQ ID NO: 146066 - RNA, 62 nt, Homo Sapiens
agggggugggagcagagccucggugagggucuuggccacagggcagugccuuccugaacgug

SEQ ID NO: 146067 - RNA, 62 nt, Homo Sapiens
ugcagagcacugcagcucccagugagagcuaguggccacagcuugaaggcuggaggagucag

SEQ ID NO: 146068 - RNA, 62 nt, Homo Sapiens
caccccauuccuggacuccuucuccucuggacuggccacaccaccccuccccagucaccagu

SEQ ID NO: 146069 - RNA, 62 nt, Homo Sapiens
gcuauggccaagcguucccuagucacuguggguggccacagguggcauuacagggaugaggg

SEQ ID NO: 146070 - RNA, 62 nt, Homo Sapiens
cucgcgggcugggaaggauuuccacucccgaguggccacagggugagggucccaguguuccc

SEQ ID NO: 146071 - RNA, 62 nt, Homo Sapiens
gggcucacauucccaaggguacuugguauaucuggccacacuauguccagcuucucuugaaa

SEQ ID NO: 146072 - RNA, 62 nt, Homo Sapiens
aaggccacucaggauguccucaaagcggaugcuggccacagauggcccgggccuuauccagu

SEQ ID NO: 146073 - RNA, 62 nt, Homo Sapiens
cagcucaccuguggguuuucccuuugagccuuuggccacauccaccucgaggggacccuggc

SEQ ID NO: 146074 - RNA, 62 nt, Homo Sapiens
cagcuagccuacgcggggauggccgucaguucuggccacaggacccgagucugggcuugggu

SEQ ID NO: 146075 - RNA, 62 nt, Homo Sapiens
aguccccuacuggcugcagaacaaggaaguccuggccacagguggagaagggcugcuacuua

SEQ ID NO: 146076 - RNA, 62 nt, Homo Sapiens
ugaugcguuuuuggugggcuuacugugggccauggccacaccgaggcagggaaugaagaagg

SEQ ID NO: 146077 - RNA, 62 nt, Homo Sapiens
ccccccagccaaguggcagacgcugguuuugguggccacaggggguggcccgugcgacagag

SEQ ID NO: 146078 - RNA, 62 nt, Homo Sapiens
agguaguaccuuugaagaugcuguugaccaccuggccacagccagucaggggccugguggug

SEQ ID NO: 146079 - RNA, 62 nt, Homo Sapiens
uugcccugcuucucucaggguucugaauccuuuggccacauugauaauguuggaaagaaagg

SEQ ID NO: 146080 - RNA, 62 nt, Homo Sapiens
gagcugcuuucuggggaacagccgugagcgucuggccacauguuggacugcacagagcagcu

SEQ ID NO: 146081 - RNA, 64 nt, Homo Sapiens
aggggugucccaugacacuauuucauauucuacagaaguaaaucagguuucaccaacugaaaug

SEQ ID NO: 146082 - RNA, 64 nt, Homo Sapiens
agaaggaauuaccuuugacaauauuuuucgguaagaaguaaaaccucuggagaccuaucuuuaa

SEQ ID NO: 146083 - RNA, 64 nt, Homo Sapiens
aguugauauacauagucauuuuuccucuaugguagaaguaaaaaaaaaaaaaaaggacauagca

SEQ ID NO: 146084 - RNA, 64 nt, Homo Sapiens
cuauaugacagauguauuuuaaaaguuucaucuugaaguaaaaguacaacagcuugaaguguug

SEQ ID NO: 146085 - RNA, 64 nt, Homo Sapiens
cuuuguugguaaaagugacauguuaaggggcuaugaaguaaauaugcugcaguuaauuaugcua

SEQ ID NO: 146086 - RNA, 64 nt, Homo Sapiens
ugcugcaguuaauugugcuauguuaaggggcuaugaaguaaauacuuuguugguaaaagugaca

SEQ ID NO: 146087 - RNA, 64 nt, Homo Sapiens
uacaacagcuugaaguguugaaaaguuucaacuugaaguaaaagcuguaugacagauguauuuu

SEQ ID NO: 146088 - RNA, 64 nt, Homo Sapiens
uuuaacuuuuuaacuaaaguuacuuugaaaaagagaaguaaaaggaauagugaaguuuugaaaa

SEQ ID NO: 146089 - RNA, 64 nt, Homo Sapiens
auuaaaauauccuauuuaauuauauaauaucuuugaaguaaauuagaucucuugggaucagaau

SEQ ID NO: 146090 - RNA, 64 nt, Homo Sapiens
uuacuuguugcaacccgagguccacuuuguugcugaaguaaacgacaaauaaucucuagagagg

SEQ ID NO: 146091 - RNA, 64 nt, Homo Sapiens
aggaccagaugcccauagaagcacaguacagacugaaguaaacccaaacuuggcuggggcucag

SEQ ID NO: 146092 - RNA, 64 nt, Homo Sapiens
uuccuaaagauuugaauuuuuuguucccauggaagaaguaaagaagaggucacuagauguugca

SEQ ID NO: 146093 - RNA, 64 nt, Homo Sapiens
uuuggaggaaaaucaauaucaagagcuuugccgggaaguaaagcgauuaugcagaagaaaauag

SEQ ID NO: 146094 - RNA, 64 nt, Homo Sapiens
aaguauaauuucuguaguaaacccuucaagacaagaaguaaaagucaguuuguuuauuuuguuc

SEQ ID NO: 146095 - RNA, 64 nt, Homo Sapiens
ccgggauuuuacuacuaaaauuggacauuuaagcgaaguaaaagaggccgggugcgguggcuca

SEQ ID NO: 146096 - RNA, 64 nt, Homo Sapiens
cugggagacugcaucucaaaaaagaaaaauaaacgaaguaaaagauauuuaucagagcuguuac

SEQ ID NO: 146097 - RNA, 64 nt, Homo Sapiens
acugaguggugcuuuaucugaauaggccuggaucgaaguaaaauagaaaugggacuggcuuucc

SEQ ID NO: 146098 - RNA, 64 nt, Homo Sapiens
gaaguaaaauagaaaugggacuggcuuuccacaggaaguaaacugcuucagagcccacaguccc

SEQ ID NO: 146099 - RNA, 64 nt, Homo Sapiens
cagccacuuugcucagagaauuggaacccacgcagaaguaaacuuuguugaucacacuguugcc

SEQ ID NO: 146100 - RNA, 60 nt, Homo Sapiens
gggccaggauaaacccugacccagaauagcgaaguaaaacgguuucugccaucuggauga

SEQ ID NO: 146101 - RNA, 64 nt, Homo Sapiens
uccccaguuaguuuuuauauccuccucuccauucgaaguaaagaacacaauuuuuuucauucuu

SEQ ID NO: 146102 - RNA, 64 nt, Homo Sapiens
auuuugaaaguucucuuuuucaucuuucucuucugaaguaaacucuguuuaacucuucauguuc

SEQ ID NO: 146103 - RNA, 64 nt, Homo Sapiens
uuuuuaaagcuacuuuuacuaccacacccggcuggaaguaaacaugggauuacaggcgcgagcc

SEQ ID NO: 146104 - RNA, 64 nt, Homo Sapiens
uuuuuuuuuuuuuuugguuuaguauguuacugaggaaguaaacuucacuuuuuucccccuucaa

SEQ ID NO: 146105 - RNA, 64 nt, Homo Sapiens
uauuugaaguuucuuaguaaaucuggaacuucaggaaguaaaaucauguguguauacaacugua

SEQ ID NO: 146106 - RNA, 64 nt, Homo Sapiens
aaugaaagauauguuaauuaauuuuaaauguuaagaaguaaaauaugcuuccacucauguaacu

SEQ ID NO: 146107 - RNA, 64 nt, Homo Sapiens
ucauacuaaaagcaauguuuaaaucaaacuaaagauuaaaaauuaaaauucguuuuugcaauaa

SEQ ID NO: 146108 - RNA, 64 nt, Homo Sapiens
accuuugaaaugcaccaaaugaauugaguuuguaauuaaaaaaauuuuuuucccuuucagucau

SEQ ID NO: 146109 - RNA, 64 nt, Homo Sapiens
aaaaacaagugaaaaggucaagauacaaauguguauuaaaaaaaaaaaagccuauuaauagggu

SEQ ID NO: 146110 - RNA, 64 nt, Homo Sapiens
aaacuugacuugcuaucucagcaagauaaauuauauuaaaaaaauaagaauccugcaguguuua

SEQ ID NO: 146111 - RNA, 64 nt, Homo Sapiens
acaagauggcaauaaauacuaugggauuguuuguauuaaaaaauuuacauugcuucuuacuauu

SEQ ID NO: 146112 - RNA, 64 nt, Homo Sapiens
gauauagggaaagaaugaagugccuuucaaguacauuaaaaaucaguuaagaguuuacaggaaa

SEQ ID NO: 146113 - RNA, 64 nt, Homo Sapiens
uuuucuaggauugucuuuuaacauagaaugaugaauuaaaaaagaucaccacuuauuaaaacac

SEQ ID NO: 146114 - RNA, 64 nt, Homo Sapiens
aaaagacugucauucauacccaaacgacuaagaaauuaaaaaaauuuugcaugcuuaaggauuc

SEQ ID NO: 146115 - RNA, 64 nt, Homo Sapiens
uggacagaaaauuauaaauucauuacugauuuuuauuaaaaaccaaugauaguauuccauuuaa

SEQ ID NO: 146116 - RNA, 58 nt, Homo Sapiens
auguaauacuuguggaacuucuaacugaauuaaaaauuaguuccguagucuaagauaa

SEQ ID NO: 146117 - RNA, 64 nt, Homo Sapiens
aaaaaaaacccaccuauuuguuuaaauucauauuauuaaaaaaccucacccuguuuguggcuau

SEQ ID NO: 146118 - RNA, 64 nt, Homo Sapiens
gcacuuuuaggaaacugauuuuccucuuauagguauuaaaaauaacaaaagcacuagacugagu

SEQ ID NO: 146119 - RNA, 64 nt, Homo Sapiens
uugaauuuuacuaacaauaagacaaaaauaugagauuaaaaaugaacgccacauuuuuuaaaua

SEQ ID NO: 146120 - RNA, 64 nt, Homo Sapiens
gauuaucaaagaauaucaggaagaaaaguuuaaaauuaaaaaguguguuauagcaguuucauuc

SEQ ID NO: 146121 - RNA, 64 nt, Homo Sapiens
auaaaagucuuccucuugccauuucaugguauucauuaaaaagcuaacuuaguaaaguagaaua

SEQ ID NO: 146122 - RNA, 64 nt, Homo Sapiens
aaaucuaaagaugaauaguccaguggauauuucaauuaaaaaaauguaucuguuauuuaaagcc

SEQ ID NO: 146123 - RNA, 64 nt, Homo Sapiens
uguuggacuuuuaaauacaugagucguaauuuauauuaaaaaguagugaugggaauggguuuga

SEQ ID NO: 146124 - RNA, 64 nt, Homo Sapiens
uaauucagguucucuuaauuuccuuuuuuaaaauauuaaaaauuuaccagcuucccagcaacuu

SEQ ID NO: 146125 - RNA, 64 nt, Homo Sapiens
acuauaaauccaggaggcaaugagguuuuuuucaauuaaaaauuuugcaaaugagcagaauaaa

SEQ ID NO: 146126 - RNA, 64 nt, Homo Sapiens
uucugcuguguaauucuugcuuucuauaaugaccauuaaaaaaaauaggugaagugcaagcuag

SEQ ID NO: 146127 - RNA, 64 nt, Homo Sapiens
uugggugaucuuaagugccuagauuugguuauaaauuaaaaaggacugaaauccugaagaggag

SEQ ID NO: 146128 - RNA, 64 nt, Homo Sapiens
uaaaauauguacccauuuuuuaauguauuucacaauuaaaaaacaacaauguucuuacagguca

SEQ ID NO: 146129 - RNA, 64 nt, Homo Sapiens
aaaaaaagauacauaugccuuuaacaguguucugauuaaaaacagaacaaauggugccugaaua

SEQ ID NO: 146130 - RNA, 64 nt, Homo Sapiens
aaaaaaagcacuguuguguuagcuuuguggggggauuaaaaaaagcauaguacauaguuggaaa

SEQ ID NO: 146131 - RNA, 64 nt, Homo Sapiens
auucauauucuuucuauaccacugucauuaauauauuaaaaagauguauguguuagacuaucga

SEQ ID NO: 146132 - RNA, 64 nt, Homo Sapiens
acggaugugcaugugcagauucccuuuugcagguauuaaaaauaauuaaaaauaguccugccug

SEQ ID NO: 146133 - RNA, 64 nt, Homo Sapiens
augugcagauucccuuuugcagguauuaaaaauaauuaaaaauaguccugccugagguugcagu

SEQ ID NO: 146134 - RNA, 64 nt, Homo Sapiens
gauguagaguagggcaaaucuguguguguaugucauuaaaaaaauucuaccaucuuucuuuauc

SEQ ID NO: 146135 - RNA, 64 nt, Homo Sapiens
aauauuuuguagauuacauauugauuuuucaaaaauuaaaaauguauuucaaacuauucuuacu

SEQ ID NO: 146136 - RNA, 64 nt, Homo Sapiens
uucuggagagaugguaugcagcauacaaaaauauauuaaaaauauaaacaauguucaggagagu

SEQ ID NO: 146137 - RNA, 64 nt, Homo Sapiens
ucaugaacaaaaugaaguuaacuuaguguuuagcauuaaaaauaaaaguuguaccuugacccua

SEQ ID NO: 146138 - RNA, 64 nt, Homo Sapiens
caggcauagccuggauacaguauaaaaauagauaauuaaaaagaugguugccaagcaaggaaaa

SEQ ID NO: 146139 - RNA, 64 nt, Homo Sapiens
ucugauguugccuuaauauucugcuauugcagcaauuaaaaauugucuucauguacauuuggaa

SEQ ID NO: 146140 - RNA, 64 nt, Homo Sapiens
acauuuugugacaugcauacagauagcauguguuauuaaaaagaguugccuauugaaaugauca

SEQ ID NO: 146141 - RNA, 64 nt, Homo Sapiens
ucuggagaaauuaagcuuauagacagcauguguuauuaaaaagaguuaccuauugaaaugauag

SEQ ID NO: 146142 - RNA, 64 nt, Homo Sapiens
aagacagauggaugaucugugaacauaaguguuuauuaaaaauggcaauuaaauauaaauuacu

SEQ ID NO: 146143 - RNA, 64 nt, Homo Sapiens
cauuuugauaaucauuugcuuccaguguuuaaaaauuaaaaaaagaauggggagaagguuauga

SEQ ID NO: 146144 - RNA, 64 nt, Homo Sapiens
gagaaucaaggcaguaguuugguauuuggugcuuauuaaaaaugugguuuguuuugaacuggaa

SEQ ID NO: 146145 - RNA, 64 nt, Homo Sapiens
auaaaugugaagcuuuuugaugccaucaaaacuuauuaaaaaauaggauuuacuuuuuucuaau

SEQ ID NO: 146146 - RNA, 63 nt, Homo Sapiens
aaaaccauguccauuuaaaauaaagauuaaaaacauuaaaaauacugucaauauacaaaacuu

SEQ ID NO: 146147 - RNA, 64 nt, Homo Sapiens
uuaaaaauaaaaccauguccacaaaacuuuaaagauuaaaaacauuuuaaaggacugucaauau

SEQ ID NO: 146148 - RNA, 64 nt, Homo Sapiens
aaaaaaagcguuuaccagcuucagcccugucuguauuaaaaaacauuuaauuuuuuucaaaguc

SEQ ID NO: 146149 - RNA, 64 nt, Homo Sapiens
uauauuuuccugagagacugauggcccaaaauuuauuaaaaagcgaaaacaagacugaaauaug

SEQ ID NO: 146150 - RNA, 64 nt, Homo Sapiens
aauuguaucucauuacuuauguuugauauaccaaauuaaaaaaaauuuauauguagccuuuacu

SEQ ID NO: 146151 - RNA, 64 nt, Homo Sapiens
uucauguaauuuuauuuuaauugugguuuggaauauuaaaaaacuacaacauagcagaucuguu

SEQ ID NO: 146152 - RNA, 64 nt, Homo Sapiens
ucuacaacauagcagaucugaucucaaauaggcuauuaaaaaagguuuggcguagcagaguuaa

SEQ ID NO: 146153 - RNA, 64 nt, Homo Sapiens
auaaaagauuuucuauaaaaaauugcccuuaaaaauuaaaaagauaaaaggaaacuguauaagc

SEQ ID NO: 146154 - RNA, 64 nt, Homo Sapiens
aagugauacaaauauuuauauucuuguuaaacuuauuaaaaaaucccaaaagaaaugauaugua

SEQ ID NO: 146155 - RNA, 64 nt, Homo Sapiens
cuuuuuaagaaaauaacuaugguugaaucauuuuauuaaaaauauuccaggguaaaaauaauaa

SEQ ID NO: 146156 - RNA, 64 nt, Homo Sapiens
aacuagaagugugcuuugaucacaagcaaacuuuauuaaaaaaaagagcacagaaggucaucau

SEQ ID NO: 146157 - RNA, 64 nt, Homo Sapiens
cugcuguuuuauaagaagaccccuuuguacaagcauuaaaaaaaaauaugugguugcucuuuau

SEQ ID NO: 146158 - RNA, 64 nt, Homo Sapiens
uguaaaauuaauaauuugcauuuugaggaaaaaaauuaaaaauaugccaaccaauagaugagaa

SEQ ID NO: 146159 - RNA, 64 nt, Homo Sapiens
acguauuccuuuguaguguguugaauuuguuaaaauuaaaaacagcugcugauaugacacaccu

SEQ ID NO: 146160 - RNA, 64 nt, Homo Sapiens
gguaaauugcucaauguaauucauugugauugucauuaaaaagucagucugaugguucuguucu

SEQ ID NO: 146161 - RNA, 64 nt, Homo Sapiens
aaauuguaucaggacccaugcuuucuagcucaucauuaaaaagguagaggaugugaucuaauuu

SEQ ID NO: 146162 - RNA, 64 nt, Homo Sapiens
aaauuaccuaggugugguggaauuaaaaaaugaaauuaaaaauaucaucucuacaaaaaguaaa

SEQ ID NO: 146163 - RNA, 64 nt, Homo Sapiens
gaaauuaaaaauaaaauuacuacaaaaaguaaaaauuaaaaaauacauagcaaaaucucaucuc

SEQ ID NO: 146164 - RNA, 64 nt, Homo Sapiens
cugcauucugagcuggacauaaguuugaauuuguauuaaaaagcucuucucauuguuuguuugu

SEQ ID NO: 146165 - RNA, 64 nt, Homo Sapiens
auguaaugugccuagcacacaggguauuaggauaauuaaaaauaagaguuauguuuauuuuuga

SEQ ID NO: 146166 - RNA, 64 nt, Homo Sapiens
auggaaaucaaauuauuaugcucucuucuccaauauuaaaaaaacuguuacggccuccuuuuau

SEQ ID NO: 146167 - RNA, 64 nt, Homo Sapiens
gauagaauuuuagcuccugauugacuacuucauuauuaaaaauuaaugaaacuugguuaagauu

SEQ ID NO: 146168 - RNA, 64 nt, Homo Sapiens
caaaaauuagccgggagugggaaaccccaccucuauuaaaaauaaccauccucgccaacaaggu

SEQ ID NO: 146169 - RNA, 64 nt, Homo Sapiens
auuaugugucuguguuauacuaugugucuguauuauuaaaaaaauuuaacauauuuauaauuac

SEQ ID NO: 146170 - RNA, 64 nt, Homo Sapiens
uuucauuuauuuuguaccucacaugauuuuccauauuaaaaaauauauuccauguuacaaauug

SEQ ID NO: 146171 - RNA, 64 nt, Homo Sapiens
ccacauaaauauuuuuccccgaauucuaauauggauuaaaaacuauggucaaguuacaacaacu

SEQ ID NO: 146172 - RNA, 64 nt, Homo Sapiens
aaauccaucuuucuuuauuuuucuguauagaauuauuaaaaaaacuggucccaucaucugaaga

SEQ ID NO: 146173 - RNA, 64 nt, Homo Sapiens
ucucguuagaguauuugauggguuuaagucuuucauuaaaaaugugguucauuguggccuaucu

SEQ ID NO: 146174 - RNA, 64 nt, Homo Sapiens
uggcaggcuguggucuccucugcaaagcauuuuaauuaaaaaccucaauaaagauggcccugcc

SEQ ID NO: 146175 - RNA, 64 nt, Homo Sapiens
gugaacauaauaucuaaugauguggagcaaguacauuaaaaacaggaaggaagagaucugugau

SEQ ID NO: 146176 - RNA, 64 nt, Homo Sapiens
caaaaaaaaaaaaaaaaaaaauccauauccauucauuaaaaaaaugagauauaaagcaacaacu

SEQ ID NO: 146177 - RNA, 64 nt, Homo Sapiens
gcugugaagcuuauagcauuuuuaaaguauggcuauuaaaaacacuaaguugauucuggaaugc

SEQ ID NO: 146178 - RNA, 64 nt, Homo Sapiens
uauuuguaaagcuaauaugcuccucaauguaauuauuaaaaauucucaagucacagcuaaacuu

SEQ ID NO: 146179 - RNA, 64 nt, Homo Sapiens
aacuuacuaauucugauuuuaguguagccccuaaauuaaaaauggcuuccauaugccacucugu

SEQ ID NO: 146180 - RNA, 64 nt, Homo Sapiens
cuccuuggaucauuauauugagugguuuuuauacauuaaaaaauguaugcagaguuuuuuuccc

SEQ ID NO: 146181 - RNA, 64 nt, Homo Sapiens
augcuuuggaaacauauguccuagaaaacauaaaauuaaaaaaaaacacuauaguguaguuuuu

SEQ ID NO: 146182 - RNA, 64 nt, Homo Sapiens
aauuuuguucagaguuucauccuaauccagauguauuaaaaauauauaaaaguguaaguuaaag

SEQ ID NO: 146183 - RNA, 64 nt, Homo Sapiens
uuuaauuuuauuuguaugaauuuuccaggauuucauuaaaaauuauuauuguauuuuuuaccuu

SEQ ID NO: 146184 - RNA, 64 nt, Homo Sapiens
ucugcaucuuauaaugguaaagggaccagaaaacauuaaaaaguuuuggcccuauugaauuuuc

SEQ ID NO: 146185 - RNA, 64 nt, Homo Sapiens
aagccugccgccaaaauaaaagagauuuguuuucauuaaaaaaucaaacuggccauuugacuuc

SEQ ID NO: 146186 - RNA, 64 nt, Homo Sapiens
ucugugcaauaauuuuaaaaaaaaauaaauaaaaauuaaaaaaagaccucuguuauuguuuaaa

SEQ ID NO: 146187 - RNA, 64 nt, Homo Sapiens
ucucauguuguuuucuuuauaaccaaacuccaguauuaaaaaucgaagcuuaaauauguaaugu

SEQ ID NO: 146188 - RNA, 64 nt, Homo Sapiens
aucuucugauguuuuguagccauagagaagauacauuaaaaaaaacaacuuuuuuuuuaauuac

SEQ ID NO: 146189 - RNA, 64 nt, Homo Sapiens
acaaaaagaacaaaaaaaucuuuacaaaguguguauuaaaaaaauugcaagugaagguuuacaa

SEQ ID NO: 146190 - RNA, 64 nt, Homo Sapiens
uaaaacugcguuaaaggcucccuaaaaaagauauauuaaaaauaauaaaauaaauauauauaaa

SEQ ID NO: 146191 - RNA, 64 nt, Homo Sapiens
uuaacuguacugaauagguuccccaauccaucguauuaaaaaacaauuaacugcccucugaaau

SEQ ID NO: 146192 - RNA, 64 nt, Homo Sapiens
cauaguaagugcgaagacugagccagauuggccaauuaaaaacgaaaaccugacuagguucugu

SEQ ID NO: 146193 - RNA, 64 nt, Homo Sapiens
gaugugcccuuuuauaaggaaacuucugauguuuauuaaaaaaacuggccuuuugauagaggua

SEQ ID NO: 146194 - RNA, 64 nt, Homo Sapiens
aaaauaguacacacauauauauaacaaauaauauauuaaaaaacccauccaucaacuaaaacau

SEQ ID NO: 146195 - RNA, 64 nt, Homo Sapiens
aaucauuaauuucaaaauuuaaagccaugcuaaaauuaaaaagaaaauauuaaauuacacaauu

SEQ ID NO: 146196 - RNA, 64 nt, Homo Sapiens
auuuuuacaguugcagagaauuguuucugggcucauuaaaaaaaguaguauugcagacauugcu

SEQ ID NO: 146197 - RNA, 64 nt, Homo Sapiens
uuuuaucuaguucucacacuuccuuuugaaagcuauuaaaaaucuauggcagaaaaauggucaa

SEQ ID NO: 146198 - RNA, 64 nt, Homo Sapiens
agccuucauagacuuuuccaauccuuaguuaaauauuaaaaacugaguauuguaguuauuugcu

SEQ ID NO: 146199 - RNA, 64 nt, Homo Sapiens
cucuuauaaucaugguaucuuucacagaauaaaaauuaaaaauaaugccagggugcaagugacc

SEQ ID NO: 146200 - RNA, 64 nt, Homo Sapiens
cacauagguagaaagaguuugaguuuuacuguggauuaaaaagccuucccuaaaaagagagcau

SEQ ID NO: 146201 - RNA, 64 nt, Homo Sapiens
ucuauuccaaugggcauuuauuuuuuauccugucauuaaaaaaaaaagacuguuauccugcuac

SEQ ID NO: 146202 - RNA, 64 nt, Homo Sapiens
uuuugaaacaguacugugcaauccgauggaucuaauuaaaaaaaaggcaauauuuuuauauuaa

SEQ ID NO: 146203 - RNA, 64 nt, Homo Sapiens
guaaauuuuucaugagaauuggaauaaaugcuggauuaaaaaguguguaguaacucauuucaag

SEQ ID NO: 146204 - RNA, 64 nt, Homo Sapiens
uuuacauagguguaguaacuuuugggguucaaacauuaaaaaaaaaaaauguauuuauuuuauc

SEQ ID NO: 146205 - RNA, 64 nt, Homo Sapiens
aaugauuuuuuuaaaagucaauccucuuguuuuuauuaaaaacaagaaugcuuuugcauggacu

SEQ ID NO: 146206 - RNA, 64 nt, Homo Sapiens
uugguuuggcacuagcagcaucaguccugauaauauuaaaaacaaagcuuuauuucacauuuuu

SEQ ID NO: 146207 - RNA, 58 nt, Homo Sapiens
caaccacuacaaccgugugauguaugccauuaaaaaaauuguuuuuuuaauuuucuau

SEQ ID NO: 146208 - RNA, 64 nt, Homo Sapiens
uauccuggguaugcauuauuuuaaauguuguaucauuaaaaaccucagaaugaugaaaaauaug

SEQ ID NO: 146209 - RNA, 64 nt, Homo Sapiens
uacuaaaugugaucuccuguggauuaccacaugcauuaaaaaauuuuucaagcugggccuagug

SEQ ID NO: 146210 - RNA, 64 nt, Homo Sapiens
accauccuggccaacauggugaaacccugucucuauuaaaaauacaaaaauuagcugggcgugg

SEQ ID NO: 146211 - RNA, 64 nt, Homo Sapiens
ggaaguuuccuugagccuaaaauaaaaagaaaaaauuaaaaagaaucaguuuuuuuaauuaaaa

SEQ ID NO: 146212 - RNA, 64 nt, Homo Sapiens
aaaaagaaaaaauuaaaaagaaucaguuuuuuuaauuaaaaaaauagaaagcuguuaggcuccu

SEQ ID NO: 146213 - RNA, 64 nt, Homo Sapiens
ccugaauucuugggggccggcggggagcuuuuacauuaaaaaucuacuaacgccuacuuuuuaa

SEQ ID NO: 146214 - RNA, 64 nt, Homo Sapiens
uaguagguuaauauuguucagaagauuuuuacaaauuaaaaacugauuuccaaauauguucaac

SEQ ID NO: 146215 - RNA, 64 nt, Homo Sapiens
gaaccgacuuuuuaguuuggguccuacuguuguuauuaaaaacagaacaaaaacaaaacacaca

SEQ ID NO: 146216 - RNA, 64 nt, Homo Sapiens
gcuaauuuuuccuaguuaacauauuuuguacaauauuaaaaaaaugcacagaaaccauuggggg

SEQ ID NO: 146217 - RNA, 64 nt, Homo Sapiens
auaaacuaaaacccaugauuauuuucagaaauauauuaaaaauaagacagucuugauauuauac

SEQ ID NO: 146218 - RNA, 64 nt, Homo Sapiens
cauuaucagacagucuugaucagaacuggaaaguauuaaaaaagaugcaugacaggaauguugg

SEQ ID NO: 146219 - RNA, 64 nt, Homo Sapiens
uguaaugcuuauguauaaaccuguauacauuuuuauuaaaaaaaccaccaaaacagugccccac

SEQ ID NO: 146220 - RNA, 64 nt, Homo Sapiens
cuccaagccuuccaccaaaaauagcucuaaacucauuaaaaaaauuuaacucagugguuaucua

SEQ ID NO: 146221 - RNA, 64 nt, Homo Sapiens
uauagaaccauaucaacacuuuuaaauuaaaaaaauuaaaaauuagaauuaaaaauuuuaaaaa

SEQ ID NO: 146222 - RNA, 64 nt, Homo Sapiens
uuaaaaauuuauagaaccauuuuuaaaaauuuaaauuaaaaaaaaaauuuuaaagaauuaaaaa

SEQ ID NO: 146223 - RNA, 64 nt, Homo Sapiens
uuaaaaauuuaaauuaaaaauuaaauuuuaaagaauuaaaaauuaacaggacaauuuaaaaauu

SEQ ID NO: 146224 - RNA, 64 nt, Homo Sapiens
uaaaagguuaaacacuguauuagauaaaacucuaauuaaaaauuuuacaaauguugacugaaga

SEQ ID NO: 146225 - RNA, 64 nt, Homo Sapiens
aaucaaagaaagaaggccacaguccaaauuugucauuaaaaaaaauauuuaacaaucuccaugu

SEQ ID NO: 146226 - RNA, 64 nt, Homo Sapiens
aauguggaguuggagggcuaagaggaccauaccuauuaaaaaaaaaggaucagagaccauuaaa

SEQ ID NO: 146227 - RNA, 64 nt, Homo Sapiens
aucagagaccauuaaaagagggcguauggcacucauuaaaaaggaaaccugcaggcauaucauu

SEQ ID NO: 146228 - RNA, 63 nt, Homo Sapiens
aauucauguguaauuauucaauuuuuaauaaaaaauuaaaaaguguuuagcuguguuucuuuc

SEQ ID NO: 146229 - RNA, 64 nt, Homo Sapiens
uauugccuggaaaaggaauauaaaguguguaacuauuaaaaauaaaguggaaaauuauguauuu

SEQ ID NO: 146230 - RNA, 64 nt, Homo Sapiens
uuuuuuuuuuuuaaauaaugauuuggcaaucagaauuaaaaaguuuuuauaccugccuuaaaua

SEQ ID NO: 146231 - RNA, 64 nt, Homo Sapiens
uauuugucauguuaaaaaguacucaguaaaggaaauuaaaaaugcugcugccacgucgcaaacc

SEQ ID NO: 146232 - RNA, 64 nt, Homo Sapiens
ucauacauuugcgggccauugcagaauucagaauauuaaaaaguucuaugagucaaucuuuuug

SEQ ID NO: 146233 - RNA, 64 nt, Homo Sapiens
gaaaaccacuuguuuauucauaauuucaucauugauuaaaaaaauucauugacuauuuucauca

SEQ ID NO: 146234 - RNA, 64 nt, Homo Sapiens
gcaccaaagcaucggcaaaaaaaugaaaauuaggauuaaaaauucauauucacuaauuuaacau

SEQ ID NO: 146235 - RNA, 64 nt, Homo Sapiens
acgacauuguaaaaucucacuuacuaugaaguauauuaaaaaucggugcuuaauugcaauaaaa

SEQ ID NO: 146236 - RNA, 64 nt, Homo Sapiens
ggugucuggauacuucccugggggaauucauuuuauuaaaaauuauucagucaagacucccuuu

SEQ ID NO: 146237 - RNA, 64 nt, Homo Sapiens
aguuuuuuucacaucauuauugccggugauuauuauuaaaaauuuuucccccugcccccguuac

SEQ ID NO: 146238 - RNA, 64 nt, Homo Sapiens
aaaaacuguuucuguaaggauuguuuacaaguucauuaaaaacuauuuugaaaugggagcuuuu

SEQ ID NO: 146239 - RNA, 64 nt, Homo Sapiens
aagcauauuugucacagaaaauaauguucuugguauuaaaaaaauaggacucugcauuaacucu

SEQ ID NO: 146240 - RNA, 64 nt, Homo Sapiens
guuaacuuugaauuuauauauuuagauuuaaaggauuaaaaaaaaggaaagcucuugacaguug

SEQ ID NO: 146241 - RNA, 64 nt, Homo Sapiens
aauugucacugaucguauuucuacuuguuaaauaauuaaaaaucaucuuaaaauucauacuuug

SEQ ID NO: 146242 - RNA, 64 nt, Homo Sapiens
uauccuuagaaagagaaguguacauugauuuccaauuaaaaauuugcuggcauuaaaaauaagc

SEQ ID NO: 146243 - RNA, 64 nt, Homo Sapiens
guguacauugauuuccaauuaaaaauuugcuggcauuaaaaauaagcacacuuacauaagcccc

SEQ ID NO: 146244 - RNA, 64 nt, Homo Sapiens
auggagaauguuuucucucauauuucuauaaucuauuaaaaaaauaaaacuauugaaaaauuaa

SEQ ID NO: 146245 - RNA, 64 nt, Homo Sapiens
uaguuaugaaaucuuagccaccauucaagggcuaauuaaaaaaaaaaacacuuauagccuuaaa

SEQ ID NO: 146246 - RNA, 64 nt, Homo Sapiens
aaucaguggaaauaaaugauaugaucucagagugauuaaaaaaagauuuaaaaaacaagaaugc

SEQ ID NO: 146247 - RNA, 64 nt, Homo Sapiens
aaaccaugaauuacgaagcagucugaugcauuucauuaaaaaaaauguuuguuuguagauguuu

SEQ ID NO: 146248 - RNA, 64 nt, Homo Sapiens
acuuuuuuguuugauaacuuaagggggguaaaguauuaaaaauagugauugaaucauaagauau

SEQ ID NO: 146249 - RNA, 64 nt, Homo Sapiens
aauuucucagaauugugauuauaauguuuguaugauuaaaaauacuuuacugcaguuaaaucau

SEQ ID NO: 146250 - RNA, 64 nt, Homo Sapiens
uaaauaaauguuguguccguaaauuuuaugguuuauuaaaaaauuucuuuucauuugaauauuu

SEQ ID NO: 146251 - RNA, 64 nt, Homo Sapiens
cuguguucuuuacacacuacauuucuugcugccaauuaaaaaacgucucagaagcugucauaga

SEQ ID NO: 146252 - RNA, 64 nt, Homo Sapiens
aaaacagaaauagagcucuaacaacaaaaaaaaaauuaaaaaaaaaacaaacaacaaaaaacaa

SEQ ID NO: 146253 - RNA, 64 nt, Homo Sapiens
aucaccaaagaaguccugcuagguuuucuccaauauuaaaaaauagcaaucuuaaggcucuuua

SEQ ID NO: 146254 - RNA, 64 nt, Homo Sapiens
agauugaaaaguuuugagaaaaaaaguacaagcuauuaaaaaucaaaaagcuuugccaauagcu

SEQ ID NO: 146255 - RNA, 64 nt, Homo Sapiens
aaaagcuuugccaauagcuaaugcuuaagaaggaauuaaaaaaacuaguuuaacacuugagcaa

SEQ ID NO: 146256 - RNA, 64 nt, Homo Sapiens
cagagaacuuucccauucuguugcugaauaaaugauuaaaaaaucauagaaaacaaucaaauau

SEQ ID NO: 146257 - RNA, 64 nt, Homo Sapiens
accacauguguuucugucucuauccuagugggccauuaaaaacuucucaauuuaguuuguuauu

SEQ ID NO: 146258 - RNA, 64 nt, Homo Sapiens
ucauuuucacuaagaguuuaaaagcuauuguauuauuaaaaagucuuuacaaugcuuguuucaa

SEQ ID NO: 146259 - RNA, 64 nt, Homo Sapiens
acagaaaaaaaagcuaagaaaacugagaacuaacauuaaaaaaauuaaauuuagaauaagaaug

SEQ ID NO: 146260 - RNA, 64 nt, Homo Sapiens
ccaucgcuucucagccuuuuggcuaagauuaaguauuaaaaaaaaaccaggcucugccaggcgc

SEQ ID NO: 146261 - RNA, 64 nt, Homo Sapiens
ugggcaacauagcgagaccccaucucuacaaaagauuaaaaauuagcugcguguaguagcauau

SEQ ID NO: 146262 - RNA, 64 nt, Homo Sapiens
gaccagacuuugugaaugguucagauauuuuuucauuaaaaaacaagguauggcagauggacuu

SEQ ID NO: 146263 - RNA, 64 nt, Homo Sapiens
guccaugucuaauaaguaaaaacugauagaauacauuaaaaagucacugguuuaucauagaaaa

SEQ ID NO: 146264 - RNA, 64 nt, Homo Sapiens
uugcaauguauauucuaaauaaagucaucuaacuauuaaaaaaaaaacacccuuccuaacccuu

SEQ ID NO: 146265 - RNA, 64 nt, Homo Sapiens
gcaggagcccuaaaugucagcacaaauuuuaaugauuaaaaagugcuugauuucaugacugaug

SEQ ID NO: 146266 - RNA, 64 nt, Homo Sapiens
aaaccacagaucaugacuuucaagacuaaagauaauuaaaaagauuuaaaauuaugugugauca

SEQ ID NO: 146267 - RNA, 64 nt, Homo Sapiens
aaaccugaugaaacagaugaaaaaacaaaaguaaauuaaaaacaaaacaaaaaaaaaaacaaaa

SEQ ID NO: 146268 - RNA, 64 nt, Homo Sapiens
aaacaaaaaaaaaaacaaaaccagaaaaauagaaauuaaaaacauuuuaagguuucugaguuaa

SEQ ID NO: 146269 - RNA, 64 nt, Homo Sapiens
aggauaaacacuaauaagaguuggagaaacagggauuaaaaauauucagagcaaagcuaucaac

SEQ ID NO: 146270 - RNA, 64 nt, Homo Sapiens
gauggaucuucucugaacuccccaggcuuuaaaaauuaaaaaugagaaucuguugugagaaaug

SEQ ID NO: 146271 - RNA, 64 nt, Homo Sapiens
cagauaagacauaaauaguuaucugaauuuuaaaauuaaaaaggaaagcaggauuuucuccugu

SEQ ID NO: 146272 - RNA, 64 nt, Homo Sapiens
guuaaauguauauuuugguuuguaguaugaaauaauuaaaaauuuuuuaaaagaaauguagucu

SEQ ID NO: 146273 - RNA, 64 nt, Homo Sapiens
uuauuaguaaaauaaaauuuauuaguuaaaauauauuaaaaauaaauacucuugauuuaugaua

SEQ ID NO: 146274 - RNA, 64 nt, Homo Sapiens
aaaaauuucuaauggauuuauaaguggaaagcugauuaaaaaacucaauggcugccaaaaccau

SEQ ID NO: 146275 - RNA, 64 nt, Homo Sapiens
aaacauacagacacucaaauccuccaaacaaacaauuaaaaaaacuaauuagcuuaucaacucc

SEQ ID NO: 146276 - RNA, 64 nt, Homo Sapiens
ugugguacauacacaccaggcagugacagacuggauuaaaaaaauucguugcagcacugcccau

SEQ ID NO: 146277 - RNA, 64 nt, Homo Sapiens
gggcaaaggacaugaacagagaaaaaaccaccccauuaaaaaguuaauuuaaacaaauuuagaa

SEQ ID NO: 146278 - RNA, 64 nt, Homo Sapiens
gugguuaagcugugucuacacugguugggaauaaauuaaaaacaguauuugggggagaaacgug

SEQ ID NO: 146279 - RNA, 64 nt, Homo Sapiens
uuaacaaaguaauauuuuuguauugcauuuuucuauuaaaaaauuaacaguuaauguuucaguc

SEQ ID NO: 146280 - RNA, 64 nt, Homo Sapiens
aacaauuugauaauacuuaauagaaaucuguucaauuaaaaaugcuuaguuuauacaaagauac

SEQ ID NO: 146281 - RNA, 64 nt, Homo Sapiens
uauguugcguacauggcaaauccugcaaauauagauuaaaaauuaaauuagcccauugaaaucc

SEQ ID NO: 146282 - RNA, 64 nt, Homo Sapiens
agagaggcacugugauauacuugggacccuuuaaauuaaaaagugaagauagucaccagggcca

SEQ ID NO: 146283 - RNA, 64 nt, Homo Sapiens
ggucuuccaagaaaugagcuauuuuauugaugccauuaaaaagcaaguugcgaugguuuuguau

SEQ ID NO: 146284 - RNA, 64 nt, Homo Sapiens
guagcuuccuacucaacuauuuauaaucucauuaauuaaaaaguuauaauuuuagauaaaaauu

SEQ ID NO: 146285 - RNA, 64 nt, Homo Sapiens
agacagcauguuauuuuaacaaucaaguauacauauuaaaaauugugagcaaucucaaaugaag

SEQ ID NO: 146286 - RNA, 64 nt, Homo Sapiens
ucauccuuaaauuuugaagcaagugagagacuuuauuaaaaauacauauauaucuauauaaaca

SEQ ID NO: 146287 - RNA, 64 nt, Homo Sapiens
uacauguuacuuugagaugcuagguauuuguggaauuaaaaagaaucaggcucuuuuguacuuu

SEQ ID NO: 146288 - RNA, 64 nt, Homo Sapiens
gaacaaaguaguaaaauaaaaaaaaauuuaaaaaauuaaaaaauaaaaaaaagaggucacuaaa

SEQ ID NO: 146289 - RNA, 64 nt, Homo Sapiens
uagagaccaaucauauaucugaaaagaaauacccauuaaaaauucugccuccuguuuauugaga

SEQ ID NO: 146290 - RNA, 64 nt, Homo Sapiens
caaauaauuggaauauauugcaggcauuaagcucauuaaaaacaaacuggcuugcagaaggguc

SEQ ID NO: 146291 - RNA, 64 nt, Homo Sapiens
ugaaauguuaccuuuuaacagacuguuuuuaaaaauuaaaaauguauguauagguuuugaaauu

SEQ ID NO: 146292 - RNA, 64 nt, Homo Sapiens
aguauugccaaugcuguuuugucaacuagauaugauuaaaaauaaaaagauuguuuguuucuau

SEQ ID NO: 146293 - RNA, 64 nt, Homo Sapiens
uguguuccaaaggcauuaaagaaaaauuacauuuauuaaaaaagauguauuuaaauuuuauuau

SEQ ID NO: 146294 - RNA, 64 nt, Homo Sapiens
uuagcaauagaauguaaauuuugacaucuggcucauuaaaaaauaauaacaguggcucuaccuu

SEQ ID NO: 146295 - RNA, 64 nt, Homo Sapiens
accauuuauaauaauaauagcuaucuuaaugugaauuaaaaaccaaaauuggauuaaauuccac

SEQ ID NO: 146296 - RNA, 64 nt, Homo Sapiens
uuguacguauauaauucaaauaacuugauuagucauuaaaaaucuauuuguuggcugggccacg

SEQ ID NO: 146297 - RNA, 64 nt, Homo Sapiens
uuucauuguaucacauagaagauagauugcauuuauuaaaaaugauaaaaacuugcaguucuau

SEQ ID NO: 146298 - RNA, 64 nt, Homo Sapiens
uaacuauugccagauuuagcauucuucuucagaaauuaaaaacauugaccuuauaagaaaaaug

SEQ ID NO: 146299 - RNA, 64 nt, Homo Sapiens
gagaaaagagaaagcaagaguuuuuuguuugcauauuaaaaaaaugucauuuucauuuuugcau

SEQ ID NO: 146300 - RNA, 64 nt, Homo Sapiens
gagauaaauggucaaugagaaguagguuaccaagauuaaaaaguuguuauucuuucuuuugaug

SEQ ID NO: 146301 - RNA, 64 nt, Homo Sapiens
uacuucauagagccugccuuucuuaugaagaccuauuaaaaaaagaauucaauagcuuguaaug

SEQ ID NO: 146302 - RNA, 64 nt, Homo Sapiens
uacuuucugcaugguauuucagugucugucauacauuaaaaauacuugucacuguuuuaagauc

SEQ ID NO: 146303 - RNA, 64 nt, Homo Sapiens
acuuacuuggaaaaugaugcuguuagguccugguauuaaaaaucuagaaaagacuuguugguuu

SEQ ID NO: 146304 - RNA, 64 nt, Homo Sapiens
guagcacaaucuauaauuuuaaugcaaacaguacauuaaaaacuucacaauuuaauaauuuauc

SEQ ID NO: 146305 - RNA, 64 nt, Homo Sapiens
ucucaaacuuacuugacaacuucaagagcaaaguauuaaaaauugcuaaacugcucucugauua

SEQ ID NO: 146306 - RNA, 64 nt, Homo Sapiens
ccauggauuuaacuuaugaacaauuacuuuuuauauuaaaaagaugaacacuaaaacuaugaaa

SEQ ID NO: 146307 - RNA, 64 nt, Homo Sapiens
aaaacgccauagcacagcugcguuaacuuuugagauuaaaaaaaaaaaccacucucuugaauca

SEQ ID NO: 146308 - RNA, 64 nt, Homo Sapiens
uuaagaggccagguuacccaguauguugcuugcuauuaaaaaggaaguugauugcauuacuucu

SEQ ID NO: 146309 - RNA, 64 nt, Homo Sapiens
agcaaaucauuugcacucuauguagaauaaaagcauuaaaaagauagccuaugguaguaauuua

SEQ ID NO: 146310 - RNA, 64 nt, Homo Sapiens
uuuuuuugcuauaaggcuuuaguccuuugcaaauauuaaaaaaucacaugguuguuugcuguac

SEQ ID NO: 146311 - RNA, 64 nt, Homo Sapiens
aaauuaauaaaaguaaaaaauacugaaaaucuguauuaaaaauaauuagguugaaaaugccccu

SEQ ID NO: 146312 - RNA, 64 nt, Homo Sapiens
gcauaggguaaaaaccugauuauuaauuuuaaugauuaaaaagagcugccacacacacauuuug

SEQ ID NO: 146313 - RNA, 64 nt, Homo Sapiens
guuaugggauaaaaaagguuuuaaaaguuaugggauuaaaaaaagccacuaaauuaaaaaaaaa

SEQ ID NO: 146314 - RNA, 64 nt, Homo Sapiens
aauuaaaaguuaugggauuaaagcuggccacuaaauuaaaaaaaugaagaucacugucaucuaa

SEQ ID NO: 146315 - RNA, 64 nt, Homo Sapiens
auuuuacuguuuguuuuuauuaucuuaagugcuaauuaaaaaaaaaauaaaauuuuaaaaaaac

SEQ ID NO: 146316 - RNA, 64 nt, Homo Sapiens
gcauuuuguaccaguggaacuuuuuauacuggagauuaaaaaaaaaauggaaauuuuuguggcu

SEQ ID NO: 146317 - RNA, 64 nt, Homo Sapiens
gauugauagaaagaaaguugcuuuucuuuugagaauuaaaaacuuuggcuugauuucuuuuuuc

SEQ ID NO: 146318 - RNA, 64 nt, Homo Sapiens
cuaaaacgcuaauauugauuuuccugauagcuguauuaaaaauagcaaagcaucggacugaacc

SEQ ID NO: 146319 - RNA, 64 nt, Homo Sapiens
caccaaugaauacaaauguuuaaauaaaauauugauuaaaaaaacauuaaaagugcaucaugac

SEQ ID NO: 146320 - RNA, 64 nt, Homo Sapiens
gccggcccacugugcacugcuugugagaaaauggauuaaaaacuauucuuacauuuguuuugcc

SEQ ID NO: 146321 - RNA, 64 nt, Homo Sapiens
cuaaacucucuaguuagauaucugacuugggaguauuaaaaauugggucuaugacauauugucc

SEQ ID NO: 146322 - RNA, 64 nt, Homo Sapiens
gaaaucugcuuuuaauuuaugacaaaguugcagaauuaaaaaaaugaaaaagauguacguugua

SEQ ID NO: 146323 - RNA, 64 nt, Homo Sapiens
aauaaaaacauaaaaaauuacuaugcugccaaagauuaaaaauaucggaggaccacaaucaguu

SEQ ID NO: 146324 - RNA, 64 nt, Homo Sapiens
auuauaucauggacauacauggucagacuuuuggauuaaaaaguaauuuuuauuuuuuaauaug

SEQ ID NO: 146325 - RNA, 64 nt, Homo Sapiens
gaagcugucuugaauuagagaccugcuacuauuuauuaaaaauggaucuuacuaaaugcauuuu

SEQ ID NO: 146326 - RNA, 64 nt, Homo Sapiens
uaaaggauauuauuguuugauuucaauaaaugacauuaaaaaucaguuucuguuaugauugcca

SEQ ID NO: 146327 - RNA, 64 nt, Homo Sapiens
aaaaaaguuuucuuauaguauuuauaggaagccaauuaaaaaaacucucauuugccgacuuauu

SEQ ID NO: 146328 - RNA, 64 nt, Homo Sapiens
gaggucgacaugagauaccuggcuguaaauccuaauuaaaaauagaaagacauagggaagaaug

SEQ ID NO: 146329 - RNA, 64 nt, Homo Sapiens
acugcuuuugauucacauuaagcugcuuucagaaauuaaaaaaacacuuuuuaaagggugcauu

SEQ ID NO: 146330 - RNA, 64 nt, Homo Sapiens
uuuuaagaguuuaaaaaucuuaugagugagaaauauuaaaaaaaucuuauuuucaccucuuuag

SEQ ID NO: 146331 - RNA, 64 nt, Homo Sapiens
aucaacuuaauguuuaagacuuuagaugucuuguauuaaaaauuacacaaaaaaaguaaaacuu

SEQ ID NO: 146332 - RNA, 64 nt, Homo Sapiens
cuacuucuaacgggaagaagaaacacuacggucgauuaaaaaaauuauuuuguuacuucgaagu

SEQ ID NO: 146333 - RNA, 64 nt, Homo Sapiens
uuguaauauauucaugaggcuggaaguaagaagaauuaaaaauuuguccuaauuacaaugagaa

SEQ ID NO: 146334 - RNA, 64 nt, Homo Sapiens
acgaaaguuuuuuuaaagaacagaaacuuuuccaauuaaaaaaaaaaagcagacuucugguuca

SEQ ID NO: 146335 - RNA, 64 nt, Homo Sapiens
agguauucuuuuugguuuaauuuuugccaauguaauuaaaaaaugguaugucauuuuuaaaauu

SEQ ID NO: 146336 - RNA, 64 nt, Homo Sapiens
aauuaugcagaguuauuuuccuauaucucacaguauuaaaaauaaauaauuaaaaauuaagaau

SEQ ID NO: 146337 - RNA, 64 nt, Homo Sapiens
auuuuccuauaucucacaguauuaaaaauaaauaauuaaaaauuaagaauaaauaaacgaguug

SEQ ID NO: 146338 - RNA, 64 nt, Homo Sapiens
cuauugugaucuaaagcagaaaagaaauuuauuuauuaaaaauuuuacaaaaaaacaaaaaaga

SEQ ID NO: 146339 - RNA, 64 nt, Homo Sapiens
acacaaaugacugggcuaaaaaaaaagacaguuuauuaaaaaugacaaaaaacaaacaaucaaa

SEQ ID NO: 146340 - RNA, 64 nt, Homo Sapiens
ugucagaacuggagaaaaugaaacagugauuucuauuaaaaaggaagugcuauuuguuuccuaa

SEQ ID NO: 146341 - RNA, 64 nt, Homo Sapiens
aaaauaaaagauauugagguaaacuuuuuuuuaaauuaaaaaggucuuuguaucuggggaaaaa

SEQ ID NO: 146342 - RNA, 64 nt, Homo Sapiens
ucuauucacuuuaacuuauaaugcuacaaggaauauuaaaaaaauuuucuguugcacuuguaaa

SEQ ID NO: 146343 - RNA, 64 nt, Homo Sapiens
uuguauuuaacucuuuucaaugcuugucauguaaauuaaaaaccguucgauacagcguauuuau

SEQ ID NO: 146344 - RNA, 64 nt, Homo Sapiens
uuaugauuaaugugaaacuguucacuacuuguuaauuaaaaaagcaauaucuuaaaguguccga

SEQ ID NO: 146345 - RNA, 64 nt, Homo Sapiens
auuuuccagcaguccaaagauuaacauguucauaauuaaaaagugcuucugcuguuuuuuauuu

SEQ ID NO: 146346 - RNA, 64 nt, Homo Sapiens
gaaaaauaugguuuccagagcaucuuaguugauuauuaaaaaagaugaggcuuucuuacauaua

SEQ ID NO: 146347 - RNA, 64 nt, Homo Sapiens
aaaagaugaggcuuucuuacaaagcaucuuguauauuaaaaaucugaaucuugcucucuuaaag

SEQ ID NO: 146348 - RNA, 64 nt, Homo Sapiens
aagaauuucauucauaaugcuuaaacugugugaaauuaaaaacagccugauuucauauuguauu

SEQ ID NO: 146349 - RNA, 64 nt, Homo Sapiens
auuagcacaucccuuuacuugaaugucaucuacaauuaaaaaaauacaggggaauuaugugugu

SEQ ID NO: 146350 - RNA, 64 nt, Homo Sapiens
gucuggauuuuuugaguauuuaggaaagagagcuauuaaaaacuggggauuucucaaugugacu

SEQ ID NO: 146351 - RNA, 64 nt, Homo Sapiens
aauuuccugauuuaauguagacuuugacuuuuuuauuaaaaaccuuuguauuaaagcaaguuau

SEQ ID NO: 146352 - RNA, 64 nt, Homo Sapiens
aagcuaguuagugaauggaaaauaaguguggaguauuaaaaauguucuuugguugguaaggccu

SEQ ID NO: 146353 - RNA, 64 nt, Homo Sapiens
aauuuuccaguuucaaguaccuauucaaaauuuuauuaaaaaccagcaaauuaauuuuaaucuc

SEQ ID NO: 146354 - RNA, 64 nt, Homo Sapiens
cuuaagaacauacuaauggcauauauuuguuacaauuaaaaaauaaauuuacuacuuaauccua

SEQ ID NO: 146355 - RNA, 64 nt, Homo Sapiens
aaacaaaacauauuggccuuaaaaacucuuaaugauuaaaaaacaaaaccaucaccuuuuguac

SEQ ID NO: 146356 - RNA, 64 nt, Homo Sapiens
aaaugccaagaaacauuauuacuggauuucuuuaauuaaaaaaauuuucacaaguuuuugagac

SEQ ID NO: 146357 - RNA, 64 nt, Homo Sapiens
gaacaagguugaggagaaaugaauaagaugauccauuaaaaacuaacagguuguggcuccuguu

SEQ ID NO: 146358 - RNA, 64 nt, Homo Sapiens
cuugagaacuauaaagugaagaaaaggauaaaacauuaaaaacuaaacaauuuuuuucuaacgu

SEQ ID NO: 146359 - RNA, 64 nt, Homo Sapiens
ugugggggagagaucagugaacaaagcaagacaaauuaaaaauagacuugcauaaccaaaauaa

SEQ ID NO: 146360 - RNA, 64 nt, Homo Sapiens
cuaaaaaauaaagacacacagcaagucuaucaacauuaaaaauaaugauacacagauagauaaa

SEQ ID NO: 146361 - RNA, 64 nt, Homo Sapiens
uagccaggcaugguggcacaaucucuacaaaaaaauuaaaaaaugggcaacaugacaagacccc

SEQ ID NO: 146362 - RNA, 64 nt, Homo Sapiens
gauucuucugcagagcacuggauacauuaaaaaaauuaaaaacuucaacuuauuccauuaaaua

SEQ ID NO: 146363 - RNA, 64 nt, Homo Sapiens
uuaaaaacugauucuucugccauuaaauagauacauuaaaaaaaaaucuaugaucaacuuauuc

SEQ ID NO: 146364 - RNA, 64 nt, Homo Sapiens
uauuugaaauuucauuauaaccaagaaaaaauauauuaaaaagaguaauauuauuauugucauc

SEQ ID NO: 146365 - RNA, 64 nt, Homo Sapiens
ugggggaauccauauauauccccaauguggcuguauuaaaaauucuccuaccuuccucaauauu

SEQ ID NO: 146366 - RNA, 64 nt, Homo Sapiens
gaguuccauuaauaaacagauuuauuaaaaacugauuaaaaaguaggcuaaacuggauuagcaa

SEQ ID NO: 146367 - RNA, 64 nt, Homo Sapiens
gauuaaaaagugaguuccauuggauuagcaauuuauuaaaaacugaacugauuugaggcuaaac

SEQ ID NO: 146368 - RNA, 64 nt, Homo Sapiens
aagacgucuucaauaugccaauaaauauguauugauuaaaaacauggcacacaguaggcacuca

SEQ ID NO: 146369 - RNA, 64 nt, Homo Sapiens
aaaauuugagagugguagaaguguugugucuugcauuaaaaaaauauaacucuggccuaugauu

SEQ ID NO: 146370 - RNA, 64 nt, Homo Sapiens
auuuuuuuuuuccuuuuuuacuuugcuuuuuuugauuaaaaagauuuuuccucuuucgaaugug

SEQ ID NO: 146371 - RNA, 64 nt, Homo Sapiens
guguguaaguaaaguguuauaagccgaaaacaguauuaaaaaaacacaaaacuguguuuacuga

SEQ ID NO: 146372 - RNA, 64 nt, Homo Sapiens
uuuuuuuugaaaaaaacaagaaauauucuuccugauuaaaaaaauguggacaaaaagccaaaau

SEQ ID NO: 146373 - RNA, 64 nt, Homo Sapiens
uccagagaagcauaaaaguauauuucauguuuacauuaaaaauuuuuuuaaucgguucuucaaa

SEQ ID NO: 146374 - RNA, 64 nt, Homo Sapiens
uuucaguguuaacaaauguguugaacauuuuaauauuaaaaauaggccuugaaauaagaaaaua

SEQ ID NO: 146375 - RNA, 64 nt, Homo Sapiens
uaauugugcugaaaucuauuuccuuuuauaauagauuaaaaauuuuauauuuuuauaaguaaac

SEQ ID NO: 146376 - RNA, 64 nt, Homo Sapiens
aaaaucccucauaauaaccuaauagggcauugcuauuaaaaaugcuaaaauaaaaauucagcuu

SEQ ID NO: 146377 - RNA, 64 nt, Homo Sapiens
cucuuuauguuggccccaggccaguacuaagcaaauuaaaaagaccgacaugggcuuccucccu

SEQ ID NO: 146378 - RNA, 64 nt, Homo Sapiens
uguuagacaacagugaggcauaucauguguuuuuauuaaaaaugauaaagauguguuucuucuc

SEQ ID NO: 146379 - RNA, 64 nt, Homo Sapiens
caggauagaccuagcaaggagauaagaauagaucauuaaaaaauaaauauaaauggauuggaua

SEQ ID NO: 146380 - RNA, 64 nt, Homo Sapiens
aacuccauaguacuaauuuugaugaauucuuaaaauuaaaaaaaugcuuacuccuuagaguuca

SEQ ID NO: 146381 - RNA, 64 nt, Homo Sapiens
uuggcauuauuuuccucauccaaauacaauuugcauuaaaaagaaacuaauaaaucaaguguuc

SEQ ID NO: 146382 - RNA, 64 nt, Homo Sapiens
ugaauugccugaccucguuaaaugcacuuuaugaauuaaaaaacuuauuugaagcugucugaag

SEQ ID NO: 146383 - RNA, 64 nt, Homo Sapiens
aaagguucuauucauaaucauuaaaagacaaguuauuaaaaagguucggucauuggaauuuaua

SEQ ID NO: 146384 - RNA, 64 nt, Homo Sapiens
uacuucaagaaauuauuuuaaucagcuuaauuggauuaaaaaaguaaaauucgaagugauuauu

SEQ ID NO: 146385 - RNA, 64 nt, Homo Sapiens
cuacucacuacaauaaaacuugccuuucaagaaaauuaaaaauacaaaaguaauuauucuuggg

SEQ ID NO: 146386 - RNA, 64 nt, Homo Sapiens
uaaaaugauuaauaguucagcucaugcauucuaaauuaaaaagugagcuuaaacaaaugccacu

SEQ ID NO: 146387 - RNA, 64 nt, Homo Sapiens
uuuaguuuugucacaguuaacugugucaaagagaauuaaaaaaaaaaacuucagauuuuguuua

SEQ ID NO: 146388 - RNA, 64 nt, Homo Sapiens
uucaauguguuaagaguuuaauuuuuuuguuaucauuaaaaaagacaggauuauaaagagauau

SEQ ID NO: 146389 - RNA, 64 nt, Homo Sapiens
uaaauagaaggaaauaaauguaaaaaugcugcaaauuaaaaaccucaaagaagggaaauaauug

SEQ ID NO: 146390 - RNA, 64 nt, Homo Sapiens
ucgcaaauucauaaagcuuuccauaaauauauuuauuaaaaaccaauaggaggagcacuucgag

SEQ ID NO: 146391 - RNA, 64 nt, Homo Sapiens
uuuuuuguguggagucuaugaccacacccagcuaauuaaaaaaaugggacuauaggugcaugcc

SEQ ID NO: 146392 - RNA, 64 nt, Homo Sapiens
cauguuuuuaaaaauuagccgguaaauccugguaauuaaaaacggacaaagaguaguuuuauca

SEQ ID NO: 146393 - RNA, 64 nt, Homo Sapiens
aaacagugcucaugucauaauuaagaaaaaaauaauuaaaaaagguuaauuuuaaacacauuuu

SEQ ID NO: 146394 - RNA, 64 nt, Homo Sapiens
accuguuaauuuuaaacacagggggggggaagaaauuaaaaaaccauaaauacauuuucuaagg

SEQ ID NO: 146395 - RNA, 64 nt, Homo Sapiens
uuuuuuacuuuuuuuuaugaucaaggaaaagaucauuaaaaaaaaacacaaagaaguuuuucuu

SEQ ID NO: 146396 - RNA, 64 nt, Homo Sapiens
ugucuucuuaaaaucaaauguaaaucaauuacagauuaaaaaaaaaagccuguauuuaacucau

SEQ ID NO: 146397 - RNA, 64 nt, Homo Sapiens
ucuacauugaaacagaaaauaccugggaaugaagauuaaaaauguagcugcuguuauuugcuug

SEQ ID NO: 146398 - RNA, 64 nt, Homo Sapiens
guaaguuaacuaugaaagcuuucuuauuuuuauuauuaaaaauguaacaauuuaacccacagga

SEQ ID NO: 146399 - RNA, 64 nt, Homo Sapiens
cgcgggcugcgucggucccggacuuuucuaauuuauuaaaaacauggccuuggcaguuauuuuu

SEQ ID NO: 146400 - RNA, 64 nt, Homo Sapiens
aaaaaaaaaaugucuuaaccaaccgaaaagaaaaauuaaaaaaggauuuguauuaaaucuuauu

SEQ ID NO: 146401 - RNA, 64 nt, Homo Sapiens
aagaaucucugucaccucaguuugaguccaacucauuaaaaaaguguccaggcaccauguuuuc

SEQ ID NO: 146402 - RNA, 64 nt, Homo Sapiens
aagacaguauuuaucguagcauaaaaauauauauauuaaaaaaaaugagauuauauauauauau

SEQ ID NO: 146403 - RNA, 64 nt, Homo Sapiens
gugcuguguuuucuaacacauuuuucuguuuuuaauuaaaaaaaaaaaaaaaagguuuucaguu

SEQ ID NO: 146404 - RNA, 64 nt, Homo Sapiens
aucccccucugcgagaaacacccaagaaugaucaauuaaaaaaaaaauaauauaauaauaauuc

SEQ ID NO: 146405 - RNA, 64 nt, Homo Sapiens
gcguugguguugugagcggcccaugaaaagccaaauuaaaaaucaaggauucagucaaacuaag

SEQ ID NO: 146406 - RNA, 64 nt, Homo Sapiens
acauggcuuuaagaaccacacugaugccuugauaauuaaaaagaauacaagcauuccauguaca

SEQ ID NO: 146407 - RNA, 64 nt, Homo Sapiens
acuuuguguuuagcuaccuuuuuauauuuaaaaaauuaaaaaugaaaauuacguucuuacaagc

SEQ ID NO: 146408 - RNA, 64 nt, Homo Sapiens
uuggcuugcuguuuacucccuucuguaguuuuuaauuaaaaacuuuaaagauaagucuacauua

SEQ ID NO: 146409 - RNA, 64 nt, Homo Sapiens
ucaacucucuuaugguauuauaucucuguaugccauuaaaaaacagcuuguucuagaaucaugu

SEQ ID NO: 146410 - RNA, 64 nt, Homo Sapiens
auuaugucuuauuuuauuauuucuaaauaaaaaaauuaaaaauugaaaacaaauucuuggaaga

SEQ ID NO: 146411 - RNA, 64 nt, Homo Sapiens
uacaaaaaagaaaaaaugaaacuuaaauuuaagaauuaaaaaaacuauaaauuaaaaauuuuuu

SEQ ID NO: 146412 - RNA, 64 nt, Homo Sapiens
uuuuacuuaaauuuaagaaugaaaaccccuauaaauuaaaaauuaggcuuuccaguuuuuacca

SEQ ID NO: 146413 - RNA, 64 nt, Homo Sapiens
acuguuauacaugagacuauuuuaaggaagaaagauuaaaaacaauggcuuaagauaaaguauu

SEQ ID NO: 146414 - RNA, 64 nt, Homo Sapiens
aaaaaagacuaugaccaaaaccuauucaggcaagauuaaaaaaaaaagacaaguggacuugggc

SEQ ID NO: 146415 - RNA, 64 nt, Homo Sapiens
cauauuucccaaucauugucaaaaugacuuugggauuaaaaaagcaaccucuuuuuugugcuuu

SEQ ID NO: 146416 - RNA, 64 nt, Homo Sapiens
aaccucuuuuuugugcuuuacuguauguacaaagauuaaaaaucuaaagaaaauguauuacauu

SEQ ID NO: 146417 - RNA, 64 nt, Homo Sapiens
gguuucuagagguaaccuguuucuuaguucugggauuaaaaauuacaucagagaaugacuguuc

SEQ ID NO: 146418 - RNA, 64 nt, Homo Sapiens
aaaaaaaaucugaaucuuguagauucugcuuuaaauuaaaaaaagccuucucaugauggaagac

SEQ ID NO: 146419 - RNA, 64 nt, Homo Sapiens
aauaaacgaugcuauuuuaaugagcucaugacucauuaaaaaaugcuuuaugaagcuuuagaaa

SEQ ID NO: 146420 - RNA, 64 nt, Homo Sapiens
uacaaaugauagaaucuuuaguaaaauuuacguuauuaaaaaauuaaacaucauucuuaucaau

SEQ ID NO: 146421 - RNA, 64 nt, Homo Sapiens
cagaccaauaaugaguuccaaaauuuaaucacuaauuaaaaaucuaucaaacaaaacucuggac

SEQ ID NO: 146422 - RNA, 64 nt, Homo Sapiens
acucaaacaaaucaacaaugagaaaaacaaccccauuaaaaacugggcaaaggccaugaauaga

SEQ ID NO: 146423 - RNA, 64 nt, Homo Sapiens
accugucugaauggguauuaucagaauggguauuauuaaaaaaucaaaacauagaugcuaguga

SEQ ID NO: 146424 - RNA, 64 nt, Homo Sapiens
ccacggccugaggccaggccucaaggggucacuuauuaaaaaguuggagccaccacgcccuucc

SEQ ID NO: 146425 - RNA, 64 nt, Homo Sapiens
aaauucuccacuuuuuuuuuuucuagcuugggggauuaaaaaaaccagaagccuguggguuucu

SEQ ID NO: 146426 - RNA, 64 nt, Homo Sapiens
cucuauucuucaccccccaguuauauauauauauauuaaaaagugcaaagcagaacuuauaaaa

SEQ ID NO: 146427 - RNA, 64 nt, Homo Sapiens
caaagagcaaagcagaacuuaaaaaaacuuaaaaauuaaaaacauaaaucucugccaaaaaaaa

SEQ ID NO: 146428 - RNA, 64 nt, Homo Sapiens
uaccaugggaaaaaagcuugaguuaauuuucagaauuaaaaacaaauugucucuugucuccuuc

SEQ ID NO: 146429 - RNA, 64 nt, Homo Sapiens
auagagccauggacugucauuacacaaacuauucauuaaaaaccggguguuucaugggaaaauc

SEQ ID NO: 146430 - RNA, 64 nt, Homo Sapiens
cccacccuuuuucauuucccaaaauuuuuuuuuaauuaaaaaaagaaccugucucuuaaaaaaa

SEQ ID NO: 146431 - RNA, 64 nt, Homo Sapiens
acacagucuuuuuaaaacuacaaaaaaaaauugaauuaaaaauaagaacagagaugagauuuga

SEQ ID NO: 146432 - RNA, 64 nt, Homo Sapiens
caaaccuuuauaugcaugugggcaaaaaaguggaauuaaaaaguugccaucuucccugcgauca

SEQ ID NO: 146433 - RNA, 64 nt, Homo Sapiens
ucuuuaacauaaagguuugauaaagaacuuagggauuaaaaaaaagauggaguuuucuaacgug

SEQ ID NO: 146434 - RNA, 64 nt, Homo Sapiens
guuuucuaacgugaggaugaagucuacacuucagauuaaaaaggguuauguuguauccugcugu

SEQ ID NO: 146435 - RNA, 64 nt, Homo Sapiens
ggguaacaugguaaauuuuaagaaaauuuaaaaaauuaaaaaacugucucuaaagaaaaacuau

SEQ ID NO: 146436 - RNA, 64 nt, Homo Sapiens
aaaguauaaaguauuuuaaguaaagguacuacaaauuaaaaauugcauuugaugcauuauaacu

SEQ ID NO: 146437 - RNA, 64 nt, Homo Sapiens
agccuaugauaguaauuuaauguagaaugaagauauuaaaaacagaagcaaauuauuugaagcu

SEQ ID NO: 146438 - RNA, 64 nt, Homo Sapiens
aucaguuauuucucuugugcacagagaaaaaugcauuaaaaaugacuaaaaaaaauaaaaaauu

SEQ ID NO: 146439 - RNA, 64 nt, Homo Sapiens
aaaaugcauuaaaaaugacuaaaaaaaauaaaaaauuaaaaaauggauaaaucuuuucuuuuug

SEQ ID NO: 146440 - RNA, 64 nt, Homo Sapiens
uacuauggcaacuuaaguguaucugcagcucuacauuaaaaaggagaaagagaaauaaccuguc

SEQ ID NO: 146441 - RNA, 64 nt, Homo Sapiens
agaauauguaccuuuuugaugcuauauuacugcgauuaaaaaguucuugcagguaauguuuaug

SEQ ID NO: 146442 - RNA, 64 nt, Homo Sapiens
ucucacuguggugugauuggcuaaacaaucucgcauuaaaaauucaaauguaaauugaauucac

SEQ ID NO: 146443 - RNA, 64 nt, Homo Sapiens
gggcagggggugaauuuuacuuucaucucaaguuauuaaaaacccacaacugaaguaaauuuua

SEQ ID NO: 146444 - RNA, 64 nt, Homo Sapiens
aucaccaguggaacuaaacaugaaaucacuguccauuaaaaaaaaacaaaaacaccaaaucauu

SEQ ID NO: 146445 - RNA, 64 nt, Homo Sapiens
aucaucucacaugcauuuuagguauguugcaugcauuaaaaaaacucggggacaacaucugaag

SEQ ID NO: 146446 - RNA, 64 nt, Homo Sapiens
aaaaaucugccacuuauccacaaaaaaauuaaaaauuaaaaaaagugaugcagcuaccaugauu

SEQ ID NO: 146447 - RNA, 64 nt, Homo Sapiens
aaaaaaaaaaaaucugccaccaugauucaaaaaaauuaaaaauuagcuuuugugaugcagcuac

SEQ ID NO: 146448 - RNA, 64 nt, Homo Sapiens
guaaaguaccaugcuuagaauguuguaugaaugcauuaaaaauuucaguacuuuuccaaugcac

SEQ ID NO: 146449 - RNA, 64 nt, Homo Sapiens
cuaugcuuguguaagugaaauaucuuguggaaauauuaaaaagcuauaguuuaauugagauauu

SEQ ID NO: 146450 - RNA, 64 nt, Homo Sapiens
aaaagugguccacuugaagcuguagcccuaucauauuaaaaacagaguuuagcugacuuuuccc

SEQ ID NO: 146451 - RNA, 64 nt, Homo Sapiens
uuuuaaaaauuuccccuuuauauuugauuaacacauuaaaaauuuauuucucuuugcaagugac

SEQ ID NO: 146452 - RNA, 64 nt, Homo Sapiens
ugaacaagaaaauacuaaaacuaauaguuuuuugauuaaaaauguugaacucaucuuuuuauga

SEQ ID NO: 146453 - RNA, 64 nt, Homo Sapiens
cagcaaucauucauacugcucaaauuaagugaccauuaaaaacaguagaaauuugacagcauua

SEQ ID NO: 146454 - RNA, 64 nt, Homo Sapiens
uuggccuggguauuucaaaguauggaugcaacuuauuaaaaauguugcacuuguuaccucuuaa

SEQ ID NO: 146455 - RNA, 64 nt, Homo Sapiens
cauggagugaagugcaauauuauaaauauuauagauuaaaaaaaaaauagccgugcacucuuga

SEQ ID NO: 146456 - RNA, 64 nt, Homo Sapiens
ugccucauucauccauuuuucuuaaaagcuggaaauuaaaaaaaaaaaagagagagagaggcuu

SEQ ID NO: 146457 - RNA, 64 nt, Homo Sapiens
gggaggagagaggcuuucgguggacacguuugacauuaaaaaaaaaaaaaaaaaaaaaaaaaaa

SEQ ID NO: 146458 - RNA, 64 nt, Homo Sapiens
acuuguuauucaguuacuaaauuugaggugaauaauuaaaaagaaaaggacauuaggagaguga

SEQ ID NO: 146459 - RNA, 64 nt, Homo Sapiens
uauguauggauauaauauaaaaugaauucauauaauuaaaaagaauuugguuaauaagaauuug

SEQ ID NO: 146460 - RNA, 64 nt, Homo Sapiens
gagcaaugcauuguauucagaaaaccugugucacauuaaaaaauuucaucuaggcuaggugcag

SEQ ID NO: 146461 - RNA, 64 nt, Homo Sapiens
gcacuccagccuggacgacagagcaagacccuguauuaaaaaaaaaauucauccugcacaggga

SEQ ID NO: 146462 - RNA, 64 nt, Homo Sapiens
ccagccuggccaacaugaugaaacccuugucucuauuaaaaacacaaaaauuagccagaugugg

SEQ ID NO: 146463 - RNA, 64 nt, Homo Sapiens
auggaugaaucuggcucguuuuaaaaucacguuuucugacgaauccuuugccccuucaccuuua

SEQ ID NO: 146464 - RNA, 64 nt, Homo Sapiens
auaaugugauauuaguaaguaaaggucuuaaaagucugacgacuggaauagauauaaaguccug

SEQ ID NO: 146465 - RNA, 64 nt, Homo Sapiens
uuuucauaucucaugaaugguaaucugguuucuaucugacgaguuuuuguagugaaaauagaua

SEQ ID NO: 146466 - RNA, 64 nt, Homo Sapiens
uugacucucaguuucauauuagaugccuucagaaucugacgagaucauugggaagcuuaucuac

SEQ ID NO: 146467 - RNA, 64 nt, Homo Sapiens
cgacucucagauccacgcccagggauucaggaguucugacgacagcuggcagcaguagcaggac

SEQ ID NO: 146468 - RNA, 64 nt, Homo Sapiens
ucaugggaaucgaaccuagggauagugcuccacuucugacgauggagugaagacacuuggcaga

SEQ ID NO: 146469 - RNA, 64 nt, Homo Sapiens
ugcuuccuagaaaccuaaauaagaucuauuaauuucugacgagagguguucuucuagaauuaau

SEQ ID NO: 146470 - RNA, 64 nt, Homo Sapiens
ggucuccaugcuuuugcuguugcaacuucccacuucugacgaaauugauuuuggggacacacau

SEQ ID NO: 146471 - RNA, 64 nt, Homo Sapiens
uaagauacaaugaagccauuaggguccucaaagcucugacgaucguccuccucccucaucucaa

SEQ ID NO: 146472 - RNA, 64 nt, Homo Sapiens
gacaccaggcaagaaaagcgcagagaaaucggugucugacgauuuuggaaaugagaacaaucuc

SEQ ID NO: 146473 - RNA, 64 nt, Homo Sapiens
auuuucuaaguugggucaucgugucggcugguugucugacgagcaucguuacaaacaccaugau

SEQ ID NO: 146474 - RNA, 64 nt, Homo Sapiens
ucagagugaaggaagguugugcugguaagacaucucugacgaagagccauggaugcuuuccaca

SEQ ID NO: 146475 - RNA, 64 nt, Homo Sapiens
ggcuuuuccaccuccagcaaagacccacccacgcucugacgagaugagcagggggccugccacc

SEQ ID NO: 146476 - RNA, 64 nt, Homo Sapiens
agagaggaaggagauuccacacagggguggaguuucugacgaagguccuaagggaguguuugug

SEQ ID NO: 146477 - RNA, 64 nt, Homo Sapiens
uggugcacuaauuagugaauauauaggaaaauuaucugacgaguaucugaaggcauuuucagcu

SEQ ID NO: 146478 - RNA, 64 nt, Homo Sapiens
gggacgcaguucucggacgcaaggaacaggcguuucugacgagcggcuaggcugggagacgacg

SEQ ID NO: 146479 - RNA, 64 nt, Homo Sapiens
cuucuauuuauagcuauugguaguuccccuaaauucugacgauagaaauuuuuauuugcuguuu

SEQ ID NO: 146480 - RNA, 64 nt, Homo Sapiens
ugauaauaaauuuuuucucucuugagaguggauuucugacgaauaccccaucucuucuuuuaac

SEQ ID NO: 146481 - RNA, 64 nt, Homo Sapiens
ugaaaguccagcucccaagucuggcucggugggaucugacgaccaaggagggcagggcuacauc

SEQ ID NO: 146482 - RNA, 64 nt, Homo Sapiens
ucaccagcgucaccaaccaugcuggcucuccgugucugacgaccugaccccaacaccgcagcug

SEQ ID NO: 146483 - RNA, 64 nt, Homo Sapiens
gucuccaagccaaguucaggcucacugaccuggcucugacgaggaccccaggccacucugagaa

SEQ ID NO: 146484 - RNA, 64 nt, Homo Sapiens
uggcgaugucucccuccagguuccaagcccugcgucugacgaugcugcagcgccuggagcagcu

SEQ ID NO: 146485 - RNA, 64 nt, Homo Sapiens
agucaaaaaucuagaauuucuuuaauuuugcuucucugacgaguugugaagcaaaauaccugaa

SEQ ID NO: 146486 - RNA, 64 nt, Homo Sapiens
auuucccuguauauuauguuuucuugugcauuaaucugacgauaucauuaaaaauuucuuguau

SEQ ID NO: 146487 - RNA, 64 nt, Homo Sapiens
gcguuaagaaacagaugcugcugcaucccagggcucugacgaagacgagguccacaaacuguuu

SEQ ID NO: 146488 - RNA, 64 nt, Homo Sapiens
ugccgacuaacuggccaccaccaaaucgagacccucugacgacuauaccaucccauagcuccug

SEQ ID NO: 146489 - RNA, 64 nt, Homo Sapiens
aagccgauccacauccugacuuaagagaucugauucugacgaacugccuggaggaggggaauau

SEQ ID NO: 146490 - RNA, 64 nt, Homo Sapiens
caguggagaguuccugacaggcauuuagcauggcucugacgagguuucagccagugcuguuacu

SEQ ID NO: 146491 - RNA, 64 nt, Homo Sapiens
cugacguggaauccacagaguagauuacgacagcucugacgauuccgggccucucaaagucugg

SEQ ID NO: 146492 - RNA, 64 nt, Homo Sapiens
gggacuacagaccauuaguacccaagugaagucuucugacgauccagaauuccuaagguggcuc

SEQ ID NO: 146493 - RNA, 51 nt, Homo Sapiens
ugaaaacaaucuuccaguaguucugacgauacuuggagccugguccacgug

SEQ ID NO: 146494 - RNA, 64 nt, Homo Sapiens
acuuacauuuguguuaugcuccugucugauucuuucugacgauccuugcaacacccugauugcu

SEQ ID NO: 146495 - RNA, 64 nt, Homo Sapiens
ccgugagccugccuuuguacccaucguucugaauucugacgacacagcacccccagccccacga

SEQ ID NO: 146496 - RNA, 64 nt, Homo Sapiens; identical to SEQ ID NO: 146495

SEQ ID NO: 146497 - RNA, 64 nt, Homo Sapiens; identical to SEQ ID NO: 146495

SEQ ID NO: 146498 - RNA, 64 nt, Homo Sapiens
guagacuggaggguagcauugaguagguuugguuucugacgaaauccuuguaaaugauuugagu

SEQ ID NO: 146499 - RNA, 64 nt, Homo Sapiens
augaugccaaaauccucaauccaucacuuuugugucugacgagacuuuggcaccaaaggccuag

SEQ ID NO: 146500 - RNA, 64 nt, Homo Sapiens
acucuugaacacaaguuccuuuuauggaaaauacucugacgaguaaauugcuucuucuucaaga

SEQ ID NO: 146501 - RNA, 64 nt, Homo Sapiens
ccucaugacccagccucacagacccucucaggccucugacgagugagcgggugaagugccacug

SEQ ID NO: 146502 - RNA, 64 nt, Homo Sapiens
agcuauaggaaacccaguaccaccccuggucuguucugacgagacaucguucauaaggcacagc

SEQ ID NO: 146503 - RNA, 64 nt, Homo Sapiens
ccaucaccugcaacuuaaaucacugauuacucucucugacgaguggguuacacugaucuuguuc

SEQ ID NO: 146504 - RNA, 64 nt, Homo Sapiens
uccucuggugugguaaauugaccuaaaggugaccucugacgauuuccugaaauaaauaugcaau

SEQ ID NO: 146505 - RNA, 64 nt, Homo Sapiens
aucacugggcucccuaucccguguggaacaagugucugacgauucuguuugccccaccuucacc

SEQ ID NO: 146506 - RNA, 64 nt, Homo Sapiens
aaagacuuacugccuacaagcuuaauuccuauucucugacgaaucucuggaggaaacuuucuuu

SEQ ID NO: 146507 - RNA, 64 nt, Homo Sapiens
auuguguuuuguuauaucuucuuaauaaaaagacucugacgaugacaaauuuuacuggauuuau

SEQ ID NO: 146508 - RNA, 64 nt, Homo Sapiens
guccauagauauaaagccaucaaaugugcauuuuucugacgaguuaaggcauucuguauaaaug

SEQ ID NO: 146509 - RNA, 64 nt, Homo Sapiens
guggcuugaacacauuacagugagcaguuaaccucuaggauaaugacucuuugugagauucuuc

SEQ ID NO: 146510 - RNA, 64 nt, Homo Sapiens
cuguguuugagugugaaguuuuauuaauacuucccuaggauaucugacuaugauugaauuuuau

SEQ ID NO: 146511 - RNA, 64 nt, Homo Sapiens
cucuggccacaauccuccccaccagucucacccacuaggauaggaacugggccuugugugcugg

SEQ ID NO: 146512 - RNA, 64 nt, Homo Sapiens
ucacccagcaaggcacaggcuccuguauuugagacuaggauagcuucaucuugagccugagccu

SEQ ID NO: 146513 - RNA, 64 nt, Homo Sapiens
auuaugaccucaaaaaaaaaaagccaacuuugagcuaggauaaaaauuggguaaaggacauuug

SEQ ID NO: 146514 - RNA, 64 nt, Homo Sapiens
ccauguauauuuuccgcuuugacuuuaacgcuuucuaggauaggguaagcacccuuaauucagg

SEQ ID NO: 146515 - RNA, 64 nt, Homo Sapiens
aaccucuuuaaaaaaauuuuuaaagaacuauggcuaugaccaaagcuucuauuuugccaaaaag

SEQ ID NO: 146516 - RNA, 64 nt, Homo Sapiens
gaaaccugacaccuagauuuauuuggaaauauucuaugaccacuuuacagaugaggaaacaggc

SEQ ID NO: 146517 - RNA, 64 nt, Homo Sapiens
uuuuaaguguauuaugaaggcaguuuucaaaggauaugaccaguugggguaauucaaauuaaaa

SEQ ID NO: 146518 - RNA, 64 nt, Homo Sapiens
guaaugguggauucauuuacauuguuuacacuucuaugaccaggccuuaagggaaggucaguuu

SEQ ID NO: 146519 - RNA, 64 nt, Homo Sapiens
cuucauagcauacuccuucccccucaggugauacuaugaccaugaguagcaucagccagaacau

SEQ ID NO: 146520 - RNA, 64 nt, Homo Sapiens
acauagcaauuuucuguggcacugagaaaccauguaugaccacaauaaaaauccauuuugugaa

SEQ ID NO: 146521 - RNA, 64 nt, Homo Sapiens
cggacaugcuuuucugccacuccauauuaaaacauaugaccauugagucccugcuaagugcgag

SEQ ID NO: 146522 - RNA, 64 nt, Homo Sapiens
uucuuacaaaacaaauuccacaaagaacacccuauaugaccacagcugcagaucaguucuuagc

SEQ ID NO: 146523 - RNA, 64 nt, Homo Sapiens
ccuuuacauagaaaacagcauucuuuuugccaaauaugaccaaauuacuuuuauuuauaauuuu

SEQ ID NO: 146524 - RNA, 64 nt, Homo Sapiens
guuuugauucugggcugaguuauuacaguuaugguaugaccagugagagggauuuguguccuuu

SEQ ID NO: 146525 - RNA, 64 nt, Homo Sapiens
aaguguuuacuaugugcaacgguauugaaguucuuaugaccacagaucaucaguacuguugucu

SEQ ID NO: 146526 - RNA, 64 nt, Homo Sapiens
uuuuuugacuguugggcuuugggaagauguuauuuaugaccaauaucugccaguaacgcuguuu

SEQ ID NO: 146527 - RNA, 64 nt, Homo Sapiens
guucauggcggcucuucucgaacgcccuggcugguaugaccacaguuaggaagucuuguccuag

SEQ ID NO: 146528 - RNA, 64 nt, Homo Sapiens
acaauugucuacagaucacacugguuuauaccuauaugaccauugggcauggcucuggacucag

SEQ ID NO: 146529 - RNA, 64 nt, Homo Sapiens
ucacuguacgccagcccgggaggcugcagugaccuaugaccacacacuugagcacaggaguuug

SEQ ID NO: 146530 - RNA, 64 nt, Homo Sapiens
ccaauaaaaagggcauuuaacaccuguuggagacuaugaccaaguuaacuagcaaaagccuugg

SEQ ID NO: 146531 - RNA, 64 nt, Homo Sapiens
aaucaaaaagggaaugcauuggcuagaucgaugauaugaccagagaaauugaggaugccccugg

SEQ ID NO: 146532 - RNA, 64 nt, Homo Sapiens
gagugcauuuaaauaaaaacuugagcuucugcccuaugaccacucucccuucgccccagcuagc

SEQ ID NO: 146533 - RNA, 64 nt, Homo Sapiens
cccucuuucaccggguguuuuucuaggacaugaauaugaccacaacuacacugugcuaggcgca

SEQ ID NO: 146534 - RNA, 64 nt, Homo Sapiens
uucagguauaacaguguuguaagaaagaauauaauaugaccauccacuuuacuacugcagaagg

SEQ ID NO: 146535 - RNA, 64 nt, Homo Sapiens
cugagcagagauuugguuuucucaguguucucacuaugaccacuguagaaaaacauaugcaaau

SEQ ID NO: 146536 - RNA, 64 nt, Homo Sapiens
uauaaauuggaguuaggaauuucaugaaccucacuaugaccaaaauuaauuuuuugauucaguu

SEQ ID NO: 146537 - RNA, 64 nt, Homo Sapiens
ccauuuaauauguucugaaaacauuacucaccuguaugaccagguugccaguguacuggucuag

SEQ ID NO: 146538 - RNA, 64 nt, Homo Sapiens
uuuguuuagucucgcuaaaguuauauuugucuguuaugaccacagaguuauauguguguguauc

SEQ ID NO: 146539 - RNA, 64 nt, Homo Sapiens
aaaacugaugaagcaaaaccaugaauucuggauauaugaccaauuuuugaaagauuuauauaug

SEQ ID NO: 146540 - RNA, 64 nt, Homo Sapiens
gccacacuaaaaacuauuuguagaaaguguagucuaugaccacuggcaagagaccucuaccuag

SEQ ID NO: 146541 - RNA, 64 nt, Homo Sapiens
uuucuugacauggaaauaccgucuugucuguacauaugaccaugaaaacuuguugguuauccau

SEQ ID NO: 146542 - RNA, 64 nt, Homo Sapiens
uuuaauacacuuuuuugaguugccuucauccaaguaugaccacuugcuuugagcagaguuggag

SEQ ID NO: 146543 - RNA, 64 nt, Homo Sapiens
guagccauugcuuuaaaaugugguuucuaauauguaugaccaauuaguucuuaacuuuuuuuua

SEQ ID NO: 146544 - RNA, 64 nt, Homo Sapiens
aaaugugcuucugaaauauaggaauuagcuagaauaugaccauugacagaaugucaaauaaaaa

SEQ ID NO: 146545 - RNA, 64 nt, Homo Sapiens
gggagaucccagccugggcauauggaaacacggcuaugaccaaaugagggugaguggaggggua

SEQ ID NO: 146546 - RNA, 64 nt, Homo Sapiens
aaaaagggaauguauguuuuaagaugcucuacauuaugaccaauuauaauauaauuuagcuuga

SEQ ID NO: 146547 - RNA, 64 nt, Homo Sapiens
auuuuaaguaggaaagucacauguuuugaaaugauaugaccaaaugcagccaaccaagaugcaa

SEQ ID NO: 146548 - RNA, 64 nt, Homo Sapiens
aaccuuuguuuugggcucaaucaucuucuagccuuaugaccaggauucuaccacuugcacuuac

SEQ ID NO: 146549 - RNA, 64 nt, Homo Sapiens
gagcuuuaaaaacagaaaaaaaaccccauauacuuaugaccaucuuaaaucaagaaaauugcau

SEQ ID NO: 146550 - RNA, 64 nt, Homo Sapiens
ugguauuuucauuuuucucaagcucuccaauaaauaugaccaccaagaugcagaacucuuucag

SEQ ID NO: 146551 - RNA, 64 nt, Homo Sapiens
ucacccccuuauuuaaaugugugcuaugacccacuaugaccacagcaucugcauuuucuaaaaa

SEQ ID NO: 146552 - RNA, 64 nt, Homo Sapiens
caucuguuuuuaugaauuuuggggguaaauaauuuaugaccauuuuuggcaguucacuccauua

SEQ ID NO: 146553 - RNA, 64 nt, Homo Sapiens
augaguuguaaauucucuggcacaauucagcuucuaugaccaaagagggugguagaaaucuauu

SEQ ID NO: 146554 - RNA, 64 nt, Homo Sapiens
aaccaaauaaagcccaucauuaucuuucuuuuuuuaugaccaaccaaacuaaaaucuaauauuu

SEQ ID NO: 146555 - RNA, 64 nt, Homo Sapiens
aauguaugucauaaacauguguuuaaaaauuguguaugaccauucucuguuguuacuagauuua

SEQ ID NO: 146556 - RNA, 64 nt, Homo Sapiens
uugcuugccuacaguucccuaagaaacaaauuccuaugaccaaauuuucauuuaaaacaagaca

SEQ ID NO: 146557 - RNA, 64 nt, Homo Sapiens
uuguacaaaugaaucuguguuuaguuauuuuucuuaugaccacauagacuacugaaaugucauu

SEQ ID NO: 146558 - RNA, 64 nt, Homo Sapiens
agcacauuugugaagagguucaaacugucccccuuaugaccaaccauggagcacuccauagucu

SEQ ID NO: 146559 - RNA, 64 nt, Homo Sapiens
aauguaacauagauaacaauauaaauaaaagugguaugaccagugcuuguuuuuccuugugugu

SEQ ID NO: 146560 - RNA, 64 nt, Homo Sapiens
aaccaagagaaaaauuuuuaugcuaggaugccuuuaugaccacuuaauuuuuuaaucuuaguuu

SEQ ID NO: 146561 - RNA, 64 nt, Homo Sapiens
gcuggcaagaagaggaaaaauaacacagaggaguuaugaccaguguuguaaggaucuggccuag

SEQ ID NO: 146562 - RNA, 64 nt, Homo Sapiens
acugacugaaggaacagaaagugagacagacagauaugaccaaauuuauacaaaccauguacca

SEQ ID NO: 146563 - RNA, 64 nt, Homo Sapiens
uuuuaucacagugccauuuggugcuggagcaugguaugaccagacgugcuuucauguacuucca

SEQ ID NO: 146564 - RNA, 64 nt, Homo Sapiens
uuucaacacuuuuuacugcaaaccaagauuuugauaugaccaccaucugauagguacaaaagaa

SEQ ID NO: 146565 - RNA, 64 nt, Homo Sapiens
uuuccaucaaaucaauguaguaccacauaucgcauaugaccaucccauagauugaagaaauuua

SEQ ID NO: 146566 - RNA, 64 nt, Homo Sapiens
cagccuaucuuugugugacaugugagcauaaaauuaugaccaugguauauuccuauuggaaaca

SEQ ID NO: 146567 - RNA, 64 nt, Homo Sapiens
acuguucuuacuguaacuacuuccugauuaggaauaugaccauuugacuguucaaugauuauuu

SEQ ID NO: 146568 - RNA, 64 nt, Homo Sapiens
uauuuuauuuuugccaaaauauuuuauuauaaaauaugaccaaaauauuuaaaaugcacaaugc

SEQ ID NO: 146569 - RNA, 64 nt, Homo Sapiens
cugcaucauagcuaugccuguauggagucuaacauaugaccaauaccaacccauaauccagcug

SEQ ID NO: 146570 - RNA, 64 nt, Homo Sapiens
uuuauuccgaaggagcuacgucuuaggugaaaguuaugaccaaccagauuaaacucuacccaca

SEQ ID NO: 146571 - RNA, 64 nt, Homo Sapiens
agaaaaauaaucuggucuugaauaaaucagcauuuaugaccagagucugaacaaggcaccugua

SEQ ID NO: 146572 - RNA, 64 nt, Homo Sapiens
ugauuaauuucuuuucacacagcacuagccaguauaugaccauguuuaaugucuacuuuuagag

SEQ ID NO: 146573 - RNA, 64 nt, Homo Sapiens
uccugccucauuaauucaaggaaacucauuaagguaugaccaaaugcuugaacucuuuuucugu

SEQ ID NO: 146574 - RNA, 64 nt, Homo Sapiens
aaauauggcuccaugaagguaccugauacacaauuaugaccagauuucucauuagcaugaauga

SEQ ID NO: 146575 - RNA, 64 nt, Homo Sapiens
uaucccauuuugguaauuauucauacauagcacauaugaccaugauguucagggcuuuauagaa

SEQ ID NO: 146576 - RNA, 64 nt, Homo Sapiens
cacaggcacacuaugacuucugcucccaaauacauaugaccauauguaaauaccaccuugcauu

SEQ ID NO: 146577 - RNA, 64 nt, Homo Sapiens
aaagcuucuuaucaaaagaacuggaauuuccugauaugaccaagaauacagggagggacuuucu

SEQ ID NO: 146578 - RNA, 64 nt, Homo Sapiens
guucuauuuuucagugauucgaaaggaaauuuuguaugaccacuuguaaaaaugccaaauuugg

SEQ ID NO: 146579 - RNA, 64 nt, Homo Sapiens
agcaauauguuuauaagaagauuucaguucaguguaugaccaaaaaaaggaauuuaugcuguac

SEQ ID NO: 146580 - RNA, 64 nt, Homo Sapiens
guauaauaauuauggguaugaaaaugacucuucauaugaccacauaugugaaaguauauauaug

SEQ ID NO: 146581 - RNA, 64 nt, Homo Sapiens
ugucuccauuuuauagauuaguuucuuucuaaauuaugaccaaaaauauuuugcuauuucuuuc

SEQ ID NO: 146582 - RNA, 64 nt, Homo Sapiens
augucauuugguuguaaccuauuuauuuuaauuuuaugaccaacucuuuaaguauuuugugaau

SEQ ID NO: 146583 - RNA, 64 nt, Homo Sapiens
ucuaauauucuggcugcuuuuuggaaacuuauuuuaugaccacaccuaguuauucagacaaaau

SEQ ID NO: 146584 - RNA, 64 nt, Homo Sapiens
cuagagagggcccugagcacgcaaucacaccgcuuaugaccaucagugccuggggaugaccuau

SEQ ID NO: 146585 - RNA, 64 nt, Homo Sapiens
aauuuuaucggcauuaauuuguauuucuuaauauuaugaccaagauauuuucaauuuauauauu

SEQ ID NO: 146586 - RNA, 64 nt, Homo Sapiens
uauguuaaauaaaaaaucaguaucauggaaaagauaugaccauaauuuagucuccucaagugaa

SEQ ID NO: 146587 - RNA, 64 nt, Homo Sapiens
aucaucgauccucucugugguguuaauuuuuuuauaugaccaguagaaaaauuuuaauauucuc

SEQ ID NO: 146588 - RNA, 64 nt, Homo Sapiens
gaaucagcugcucuacaggauuuguugaagguacuaugaccaaauucucuaguucuauaguuua

SEQ ID NO: 146589 - RNA, 64 nt, Homo Sapiens
agccuuggaaccagccccauagaaagaagccauauaugaccagacauuggaaugccuuggaaau

SEQ ID NO: 146590 - RNA, 64 nt, Homo Sapiens
auaaauaugaaaccucauauaauacucauauguuuaugaccaaauaacaccugguuauauauga

SEQ ID NO: 146591 - RNA, 64 nt, Homo Sapiens
cauaguaucuauuauauuuggguuuaccugguuuuaugaccaggccuuuugaaugggguagggg

SEQ ID NO: 146592 - RNA, 64 nt, Homo Sapiens
uacacaguucucaggaggcugugguuucuuagaauaugaccaugagccauuucacagaaaaacc

SEQ ID NO: 146593 - RNA, 64 nt, Homo Sapiens
cugucauuucaaagacucucaccccugcuauaacuaugaccaugcugauaaacugauuuaucua

SEQ ID NO: 146594 - RNA, 64 nt, Homo Sapiens
ccuugucuauuccugucuguauaaaguguuucauuaugaccagaucucugauuguauggucacu

SEQ ID NO: 146595 - RNA, 64 nt, Homo Sapiens
aacaaaucugaaaauaugucaaauuacguguuuuuaugaccauguaauguuuuaaaggcaccua

SEQ ID NO: 146596 - RNA, 64 nt, Homo Sapiens
aaaagcaaauacuuccuaacggcaguaaugugacuaugaccaugauauauuauauaugugacag

SEQ ID NO: 146597 - RNA, 64 nt, Homo Sapiens
uucauuuuucucucccucuuuuucucuguauauuuaugaccagagcaaaaauguaaaaaacaaa

SEQ ID NO: 146598 - RNA, 64 nt, Homo Sapiens
acacgauuuaaaucuuuucaacucauguuucugcuaugaccauguaugaucugccauuucaaag

SEQ ID NO: 146599 - RNA, 64 nt, Homo Sapiens
guucugugcauaacaggauccaaugucuuccucuuaugaccagagaauucugcuaguccaguag

SEQ ID NO: 146600 - RNA, 64 nt, Homo Sapiens
uaauguuuuaaaggcaccuaaaauuacguguuuuuaugaccaugaacaaaucugaaaauauguc

SEQ ID NO: 146601 - RNA, 64 nt, Homo Sapiens
ggcuugaaacauauuggauuggaaauuuuaaaauuaugaccaagcaaugugcacauuaaaauau

SEQ ID NO: 146602 - RNA, 64 nt, Homo Sapiens
uguuaagaggaacugaucucguucauucauuucuuaugaccacuuauuuccuuguguguaaaau

SEQ ID NO: 146603 - RNA, 64 nt, Homo Sapiens
uuauuaaccuuaugaaucaguaauuuaaaucacuuaugaccaagcuaaaauuacuugauguaag

SEQ ID NO: 146604 - RNA, 64 nt, Homo Sapiens
uagaugauuucagacuugacccuaauugaccauauaugaccaggaaacacuucugaguuuacag

SEQ ID NO: 146605 - RNA, 64 nt, Homo Sapiens
uuuccagucggagagcgaggagaagguugucaccuaugaccacauugggcccaacgucugcaug

SEQ ID NO: 146606 - RNA, 64 nt, Homo Sapiens
cuaaauauucugggggaagucacauuuuuaacuuuaugaccagcuaugcuuauguacuuacuua

SEQ ID NO: 146607 - RNA, 64 nt, Homo Sapiens
gccuugcaacucaaaguguggcacaaacacaauguaugaccagagaggcauccuucucugaugu

SEQ ID NO: 146608 - RNA, 64 nt, Homo Sapiens
ggccccugccaggugugggccccccacgccguccuaugaccaaacagacuucacacaguauucu

SEQ ID NO: 146609 - RNA, 64 nt, Homo Sapiens
uuuuacuuuagaaccuggaaucuccuacuuaauauaugaccaugacuuugaaaggcaaaagagg

SEQ ID NO: 146610 - RNA, 64 nt, Homo Sapiens
agggaagccccauccucucccaggaccaggaguuuaugaccaggcgagcacaaauggcuaaaag

SEQ ID NO: 146611 - RNA, 64 nt, Homo Sapiens
acuuggaaggcugccuuaaaguauaucucuuaucuaugaccaaauaucugggguacuuuuagaa

SEQ ID NO: 146612 - RNA, 64 nt, Homo Sapiens
caucauuggaaucuuaucaccagauaggcaaguuuaugaccaaacaagagaguacuggcuuuau

SEQ ID NO: 146613 - RNA, 64 nt, Homo Sapiens
gauaugauagacuccuauuuuucuuguuuuauauuaugaccacacacaucucugcuggaaaguc

SEQ ID NO: 146614 - RNA, 64 nt, Homo Sapiens
ggaaugaacuugccagccuucaggcucguucagcuaugaccaucugugcggucaggguacacuc

SEQ ID NO: 146615 - RNA, 64 nt, Homo Sapiens
cacauuaugauauuguccuuuuaugaaacugucauaugaccagaauucuucuguaauucugccc

SEQ ID NO: 146616 - RNA, 64 nt, Homo Sapiens
cugagaaagaagcuguacguuuucuuuauguuuuuaugaccaaagcaguuucuugucaauacac

SEQ ID NO: 146617 - RNA, 64 nt, Homo Sapiens
ucaaguugguguugcccaaacaugacuugaucccuaugaccaagccacacaaccagagggugca

SEQ ID NO: 146618 - RNA, 64 nt, Homo Sapiens
aauugaaagacgucaucacugggcauuggucacauaugaccaguuuuuuuuuuggcuggggugg

SEQ ID NO: 146619 - RNA, 64 nt, Homo Sapiens
ucaccaaggaaauaaacagggccauguuugcuuguaugaccaaguuggguucugagaggguuuu

SEQ ID NO: 146620 - RNA, 64 nt, Homo Sapiens
uuuuggauaaugaagucagcagaggaaaaaaaaauaugaccaucucaaaagaugccaacguugu

SEQ ID NO: 146621 - RNA, 64 nt, Homo Sapiens
cauguacuuggguguuucccuccauccuuucugauaugaccaaaaaucaaguuguuuuguuuuu

SEQ ID NO: 146622 - RNA, 64 nt, Homo Sapiens
ggaaucccgaauggccccaauucuugccucauccuaugaccaggcuuuuagaggaccuucccua

SEQ ID NO: 146623 - RNA, 64 nt, Homo Sapiens
aguuagauguuuguucaccauggggaccauuacauaugaccauacaaugcacugaauugacagg

SEQ ID NO: 146624 - RNA, 64 nt, Homo Sapiens
uguuaauacagaaaagagacauuucagcugugauuaugaccauuguuucauauuccaauuaaaa

SEQ ID NO: 146625 - RNA, 64 nt, Homo Sapiens
cuguguggaaaccuaacuguccaggagguaaguuuaugaccaguaacaugaguuuuauauuaaa

SEQ ID NO: 146626 - RNA, 64 nt, Homo Sapiens
cuauguuuugaaacuguaucccacaaguugccgguaugaccaucuuauuuguaaugagucugug

SEQ ID NO: 146627 - RNA, 64 nt, Homo Sapiens
uagaucgaaaugucaauauacuaccuaucugguuuaugaccacuggguaaaucuuuuaauaaaa

SEQ ID NO: 146628 - RNA, 64 nt, Homo Sapiens
uguguagugugcccucauauacgugucagucauuuaugaccaacuccaaauuguguauggauuc

SEQ ID NO: 146629 - RNA, 64 nt, Homo Sapiens
uaauuuuguuuuuauuuaauggaguuguuucuauuaugaccauuauuuugaucuauuuuccuau

SEQ ID NO: 146630 - RNA, 64 nt, Homo Sapiens
uaaagguuaugcugcuuguucucuucaccuauuguaugaccaaaguguucaaaacauugagaca

SEQ ID NO: 146631 - RNA, 64 nt, Homo Sapiens
cccuaauugcuguccugauguuccuguccaccuauaugaccaauuccccugccuccccuccuuu

SEQ ID NO: 146632 - RNA, 64 nt, Homo Sapiens
aacuugcuuuggcuuuauugcuaagucuuauaauuaugaccauugagaguuuuauuuuaaaaag

SEQ ID NO: 146633 - RNA, 64 nt, Homo Sapiens
cccaauaacuguuauuagaguuaagaauuuccaguaugaccacauuggcaagacaacuauaugg

SEQ ID NO: 146634 - RNA, 64 nt, Homo Sapiens
uuuuuucauuuaccaagauuaggauuuaugaccuuaugaccaguagagccucaugaggguuucu

SEQ ID NO: 146635 - RNA, 64 nt, Homo Sapiens
uaaccucagaauucauaauuuauucugaucaugauaugaccauuuuuuugcuaucuuuuuuuau

SEQ ID NO: 146636 - RNA, 64 nt, Homo Sapiens
acaaguuuucaaauaggugaagacagcauagaauuaugaccaggguggcucaacccacaaauca

SEQ ID NO: 146637 - RNA, 64 nt, Homo Sapiens
acuuguuauaacuuagaggauaggucugaaaacuuaugaccaauguucuuuguaauuuaaugaa

SEQ ID NO: 146638 - RNA, 64 nt, Homo Sapiens
agcucugaugaaugagauuagugcccuuauaaauuaugaccaaaagagcucuucacuccuccua

SEQ ID NO: 146639 - RNA, 64 nt, Homo Sapiens
auuaugauguuccucagagaagugaggugggaaauaugaccaggucaggcaguuggaggggcuu

SEQ ID NO: 146640 - RNA, 64 nt, Homo Sapiens
cuguaucaagauaaaggaauucaaauagcauauauaugaccaugucugaaaugucaguucucua

SEQ ID NO: 146641 - RNA, 64 nt, Homo Sapiens
ugaccaauggcuuuuaaggaaggacuaagugacuuaugaccagaacaagggagcagccugaguc

SEQ ID NO: 146642 - RNA, 64 nt, Homo Sapiens
gucuuaugcuuauggacauuguauauuuguauuuuaugaccaaguagaccaagucagaaagauc

SEQ ID NO: 146643 - RNA, 64 nt, Homo Sapiens
aucauggaauuugcuagaacacugugguuggcaguaugaccagaucacuuggcucucuagaucc

SEQ ID NO: 146644 - RNA, 64 nt, Homo Sapiens
acagucacuagguuguaguuacaacaaucaugcuuaugaccaauauuguaaguagcacauugca

SEQ ID NO: 146645 - RNA, 64 nt, Homo Sapiens
gaaaaaggaaaaauguagacuuuaauuaggaucauaugaccauucugaugguuuggaaaauaac

SEQ ID NO: 146646 - RNA, 64 nt, Homo Sapiens
uaaaacaaagcaauucuugaaccuuaauguaagauaugaccaguucuauuugauuuuuuaaaaa

SEQ ID NO: 146647 - RNA, 64 nt, Homo Sapiens
gcagcaauugcugacauauuaaaugacucuugccuaugaccaaggccauuugaugccaggggag

SEQ ID NO: 146648 - RNA, 64 nt, Homo Sapiens
gauaaugccccaaggacaagcccaggacaagugguaugaccaguaaauaucucaucugccggcc

SEQ ID NO: 146649 - RNA, 64 nt, Homo Sapiens
ggggccggaguaucuauuucgagggcauaaaauguaugaccacuacuauaaauaagauagguuu

SEQ ID NO: 146650 - RNA, 64 nt, Homo Sapiens
uguuccccaagacauucuagguuugcaagaaaaauaugaccacacuccagcugggaucacaugu

SEQ ID NO: 146651 - RNA, 64 nt, Homo Sapiens
ggccgagagcugagcaagaauuuggaauggaaguuaugaccaagggaauuaugcuguucauuua

SEQ ID NO: 146652 - RNA, 64 nt, Homo Sapiens
gcaacaaccucucaccaucuccaucagcacagccuaugaccauuggggugugggguguucccgg

SEQ ID NO: 146653 - RNA, 64 nt, Homo Sapiens
uauucaaagaaaagcuaaagcaaaaacacuggcauaugaccaugcaagacugucagugccaaca

SEQ ID NO: 146654 - RNA, 64 nt, Homo Sapiens
agcaccguccgaauccccgcaggacccauggagcuaugaccacaccaggccauucaaauggcuc

SEQ ID NO: 146655 - RNA, 64 nt, Homo Sapiens
uaaguaacuuaaguuuugugcagaucccagguucuaugaccaaagugucagcucuguacagggu

SEQ ID NO: 146656 - RNA, 64 nt, Homo Sapiens
gugucuggccgcauucccccgaauugcaagauauuaugaccaguaucccucccugccucuccua

SEQ ID NO: 146657 - RNA, 64 nt, Homo Sapiens
agccaggacaaagcuggcagaacggaaucgcaaguaugaccagagacccgccugguggugaagg

SEQ ID NO: 146658 - RNA, 64 nt, Homo Sapiens
uugccacaucccaagauguaaaacggcaguaauuuaugaccacguauggaagaaauucuucaaa

SEQ ID NO: 146659 - RNA, 64 nt, Homo Sapiens
ucagggacuugaaugcacuuccacaaauagaaaauaugaccagauguccuuauggggaugggug

SEQ ID NO: 146660 - RNA, 64 nt, Homo Sapiens
auggcuuaagauaaaguauuaaaaaaaaaaagacuaugaccaaacccuauucaggcaagauuaa

SEQ ID NO: 146661 - RNA, 64 nt, Homo Sapiens
ugucaaagaggauguaauaaauuguaguaauaaauaugaccacaagccauaaaugacugcagga

SEQ ID NO: 146662 - RNA, 64 nt, Homo Sapiens
ugucagcaaggguguaauauaccauagugauaaauaugaccaaaagccauaaaugacugugaga

SEQ ID NO: 146663 - RNA, 64 nt, Homo Sapiens
ugucagcaaguguguaauauaccauagugauaaauaugaccaaaagccauaaaugacugugaga

SEQ ID NO: 146664 - RNA, 64 nt, Homo Sapiens
gaauuccauugaagaaaaccuauuuuuguaugaauaugaccaguuucaagcagagcccaaaaug

SEQ ID NO: 146665 - RNA, 64 nt, Homo Sapiens
aagcacucggagaauugugcaggugucauuuaucuaugaccaauaggaagagcaaccaguuacu

SEQ ID NO: 146666 - RNA, 64 nt, Homo Sapiens
cuucuuuaauaaauauuuauuucccauacacccuuaugaccauuuccagagacugaauuguguu

SEQ ID NO: 146667 - RNA, 64 nt, Homo Sapiens
ugaaucuuguaggguucuguuuggguuaaguuuguaugaccaaauuugagcuuucuaggucaca

SEQ ID NO: 146668 - RNA, 64 nt, Homo Sapiens
cagcccggccuacgcccaguacccaccggccaccuaugaccaguacccauacgccgccucgccu

SEQ ID NO: 146669 - RNA, 64 nt, Homo Sapiens
agcuaaguuguuauuucuuuccauacguauauuuuaugaccauguguguguauacuuuauuuac

SEQ ID NO: 146670 - RNA, 64 nt, Homo Sapiens
ugcauuuaacaaaacuccuccaugggguauguaguaugaccaacuggucugucaaaacugcaac

SEQ ID NO: 146671 - RNA, 64 nt, Homo Sapiens
agcaggcuuccugcuccauggcugugguaugagcuaugaccaagcaugcccccgugaccugccu

SEQ ID NO: 146672 - RNA, 64 nt, Homo Sapiens
gagaacucucucccuggucuugagagcuuggccuuaugaccaguuuccuguuugucuugugucu

SEQ ID NO: 146673 - RNA, 64 nt, Homo Sapiens
caacacuacgaagaguauuuggauugcgugacccuaugaccaaaacuauuccauugaccuuaau

SEQ ID NO: 146674 - RNA, 64 nt, Homo Sapiens
cuccugaaguuuuggcagcgucuugaaagccuaauaugaccaucuguugcucaacaauacuguu

SEQ ID NO: 146675 - RNA, 64 nt, Homo Sapiens
auuccuuaaaccugaacucaguaccugcgaguguuaugaccagguaauucucaccauuccugug

SEQ ID NO: 146676 - RNA, 64 nt, Homo Sapiens
ugcuacucgaccagucgccacagcccugaucccuuaugaccaacuucaagucugaguucaaaac

SEQ ID NO: 146677 - RNA, 64 nt, Homo Sapiens
aagaagaagccauucccaacguugcucaucaaauuaugaccauaaauuuccaggaucagacuaa

SEQ ID NO: 146678 - RNA, 64 nt, Homo Sapiens
cuggucguacugcagucagcacccguaacccggcuaugaccagggaucuguaagcccuguggcu

SEQ ID NO: 146679 - RNA, 64 nt, Homo Sapiens
gggccaucggacuggagacccccaaggcaaagcuuaugaccaaugaggaggguggcucuguuuc

SEQ ID NO: 146680 - RNA, 64 nt, Homo Sapiens
cagaggcaaugacaugaguuuguuuucucauuaauaugaccaguuugggucuauguugguucac

SEQ ID NO: 146681 - RNA, 64 nt, Homo Sapiens
uucaggaaagcagcaguuuucuuuuaauuuuuccuaugaccauaaaauuagacauaccucucaa

SEQ ID NO: 146682 - RNA, 64 nt, Homo Sapiens
ccaaauuuauaguuaguuuagguaaacuuuuuauuaugaccauuagaaacuauuuugaaugcuu

SEQ ID NO: 146683 - RNA, 64 nt, Homo Sapiens
aauaugcuggguuaucaaauucuguucacugaguuaugaccagauaaauaauagauaugcacau

SEQ ID NO: 146684 - RNA, 64 nt, Homo Sapiens
uuuacucuuucuaacuuucuguuucaaaaaauuauaugaccauaugcuuuuuguacuuggaagu

SEQ ID NO: 146685 - RNA, 64 nt, Homo Sapiens
ggcuauggccugugcgauccuuagagaagauggauaugaccaguaggagagacaguuggauucu

SEQ ID NO: 146686 - RNA, 64 nt, Homo Sapiens
ucauggucagagaugagaauuugacgccuagaacuaugaccaccaauuggucauagaacagcau

SEQ ID NO: 146687 - RNA, 64 nt, Homo Sapiens
ccaaauuuauaguuaguuuagguaaacuuuuuauuaugaccauuagaaacuauuuugaauguuu

SEQ ID NO: 146688 - RNA, 64 nt, Homo Sapiens; identical to SEQ ID NO: 104783

SEQ ID NO: 146689 - RNA, 64 nt, Homo Sapiens; identical to SEQ ID NO: 104784

SEQ ID NO: 146690 - RNA, 64 nt, Homo Sapiens; identical to SEQ ID NO: 104785

SEQ ID NO: 146691 - RNA, 64 nt, Homo Sapiens; identical to SEQ ID NO: 104786

SEQ ID NO: 146692 - RNA, 64 nt, Homo Sapiens; identical to SEQ ID NO: 104787

SEQ ID NO: 146693 - RNA, 64 nt, Homo Sapiens; identical to SEQ ID NO: 104788

SEQ ID NO: 146694 - RNA, 64 nt, Homo Sapiens; identical to SEQ ID NO: 104789

SEQ ID NO: 146695 - RNA, 64 nt, Homo Sapiens; identical to SEQ ID NO: 104790

SEQ ID NO: 146696 - RNA, 64 nt, Homo Sapiens; identical to SEQ ID NO: 104791

SEQ ID NO: 146697 - RNA, 64 nt, Homo Sapiens; identical to SEQ ID NO: 104792

SEQ ID NO: 146698 - RNA, 64 nt, Homo Sapiens; identical to SEQ ID NO: 104793

SEQ ID NO: 146699 - RNA, 64 nt, Homo Sapiens; identical to SEQ ID NO: 104794

SEQ ID NO: 146700 - RNA, 64 nt, Homo Sapiens; identical to SEQ ID NO: 104795

SEQ ID NO: 146701 - RNA, 64 nt, Homo Sapiens; identical to SEQ ID NO: 104796

SEQ ID NO: 146702 - RNA, 64 nt, Homo Sapiens; identical to SEQ ID NO: 104797

SEQ ID NO: 146703 - RNA, 64 nt, Homo Sapiens; identical to SEQ ID NO: 104798

SEQ ID NO: 146704 - RNA, 64 nt, Homo Sapiens; identical to SEQ ID NO: 104799

SEQ ID NO: 146705 - RNA, 64 nt, Homo Sapiens; identical to SEQ ID NO: 104800

SEQ ID NO: 146706 - RNA, 64 nt, Homo Sapiens; identical to SEQ ID NO: 104801

SEQ ID NO: 146707 - RNA, 64 nt, Homo Sapiens; identical to SEQ ID NO: 104802

SEQ ID NO: 146708 - RNA, 64 nt, Homo Sapiens; identical to SEQ ID NO: 104803

SEQ ID NO: 146709 - RNA, 64 nt, Homo Sapiens; identical to SEQ ID NO: 104804

SEQ ID NO: 146710 - RNA, 64 nt, Homo Sapiens; identical to SEQ ID NO: 104805

SEQ ID NO: 146711 - RNA, 64 nt, Homo Sapiens; identical to SEQ ID NO: 104806

SEQ ID NO: 146712 - RNA, 64 nt, Homo Sapiens; identical to SEQ ID NO: 104807

SEQ ID NO: 146713 - RNA, 64 nt, Homo Sapiens; identical to SEQ ID NO: 104808

SEQ ID NO: 146714 - RNA, 64 nt, Homo Sapiens; identical to SEQ ID NO: 104809

SEQ ID NO: 146715 - RNA, 64 nt, Homo Sapiens; identical to SEQ ID NO: 104810

SEQ ID NO: 146716 - RNA, 64 nt, Homo Sapiens; identical to SEQ ID NO: 104811

SEQ ID NO: 146717 - RNA, 64 nt, Homo Sapiens; identical to SEQ ID NO: 104812

SEQ ID NO: 146718 - RNA, 64 nt, Homo Sapiens; identical to SEQ ID NO: 104813

SEQ ID NO: 146719 - RNA, 64 nt, Homo Sapiens; identical to SEQ ID NO: 104814

SEQ ID NO: 146720 - RNA, 64 nt, Homo Sapiens; identical to SEQ ID NO: 104815

SEQ ID NO: 146721 - RNA, 64 nt, Homo Sapiens; identical to SEQ ID NO: 104816

SEQ ID NO: 146722 - RNA, 64 nt, Homo Sapiens; identical to SEQ ID NO: 104817

SEQ ID NO: 146723 - RNA, 64 nt, Homo Sapiens; identical to SEQ ID NO: 104818

SEQ ID NO: 146724 - RNA, 64 nt, Homo Sapiens; identical to SEQ ID NO: 104819

SEQ ID NO: 146725 - RNA, 64 nt, Homo Sapiens; identical to SEQ ID NO: 104820

SEQ ID NO: 146726 - RNA, 64 nt, Homo Sapiens; identical to SEQ ID NO: 104821

SEQ ID NO: 146727 - RNA, 64 nt, Homo Sapiens; identical to SEQ ID NO: 104822

SEQ ID NO: 146728 - RNA, 64 nt, Homo Sapiens; identical to SEQ ID NO: 104823

SEQ ID NO: 146729 - RNA, 64 nt, Homo Sapiens; identical to SEQ ID NO: 104824

SEQ ID NO: 146730 - RNA, 64 nt, Homo Sapiens; identical to SEQ ID NO: 104825

SEQ ID NO: 146731 - RNA, 64 nt, Homo Sapiens; identical to SEQ ID NO: 104826

SEQ ID NO: 146732 - RNA, 64 nt, Homo Sapiens; identical to SEQ ID NO: 104827

SEQ ID NO: 146733 - RNA, 64 nt, Homo Sapiens; identical to SEQ ID NO: 104828

SEQ ID NO: 146734 - RNA, 64 nt, Homo Sapiens; identical to SEQ ID NO: 104829

SEQ ID NO: 146735 - RNA, 64 nt, Homo Sapiens; identical to SEQ ID NO: 104830

SEQ ID NO: 146736 - RNA, 64 nt, Homo Sapiens; identical to SEQ ID NO: 104831

SEQ ID NO: 146737 - RNA, 64 nt, Homo Sapiens; identical to SEQ ID NO: 104832

SEQ ID NO: 146738 - RNA, 64 nt, Homo Sapiens; identical to SEQ ID NO: 104833

SEQ ID NO: 146739 - RNA, 64 nt, Homo Sapiens; identical to SEQ ID NO: 104834

SEQ ID NO: 146740 - RNA, 64 nt, Homo Sapiens; identical to SEQ ID NO: 104835

SEQ ID NO: 146741 - RNA, 64 nt, Homo Sapiens; identical to SEQ ID NO: 104836

SEQ ID NO: 146742 - RNA, 64 nt, Homo Sapiens; identical to SEQ ID NO: 104837

SEQ ID NO: 146743 - RNA, 64 nt, Homo Sapiens; identical to SEQ ID NO: 104838

SEQ ID NO: 146744 - RNA, 64 nt, Homo Sapiens; identical to SEQ ID NO: 104839

SEQ ID NO: 146745 - RNA, 64 nt, Homo Sapiens; identical to SEQ ID NO: 104840

SEQ ID NO: 146746 - RNA, 64 nt, Homo Sapiens; identical to SEQ ID NO: 104841

SEQ ID NO: 146747 - RNA, 64 nt, Homo Sapiens; identical to SEQ ID NO: 104842

SEQ ID NO: 146748 - RNA, 64 nt, Homo Sapiens; identical to SEQ ID NO: 104843

SEQ ID NO: 146749 - RNA, 64 nt, Homo Sapiens; identical to SEQ ID NO: 104844

SEQ ID NO: 146750 - RNA, 64 nt, Homo Sapiens; identical to SEQ ID NO: 104845

SEQ ID NO: 146751 - RNA, 64 nt, Homo Sapiens; identical to SEQ ID NO: 104846

SEQ ID NO: 146752 - RNA, 64 nt, Homo Sapiens; identical to SEQ ID NO: 104847

SEQ ID NO: 146753 - RNA, 64 nt, Homo Sapiens; identical to SEQ ID NO: 104848

SEQ ID NO: 146754 - RNA, 64 nt, Homo Sapiens; identical to SEQ ID NO: 104849

SEQ ID NO: 146755 - RNA, 64 nt, Homo Sapiens; identical to SEQ ID NO: 104850

SEQ ID NO: 146756 - RNA, 64 nt, Homo Sapiens; identical to SEQ ID NO: 104851

SEQ ID NO: 146757 - RNA, 64 nt, Homo Sapiens; identical to SEQ ID NO: 104852

SEQ ID NO: 146758 - RNA, 64 nt, Homo Sapiens; identical to SEQ ID NO: 104853

SEQ ID NO: 146759 - RNA, 64 nt, Homo Sapiens; identical to SEQ ID NO: 104854

SEQ ID NO: 146760 - RNA, 64 nt, Homo Sapiens; identical to SEQ ID NO: 104855

SEQ ID NO: 146761 - RNA, 64 nt, Homo Sapiens; identical to SEQ ID NO: 104856

SEQ ID NO: 146762 - RNA, 64 nt, Homo Sapiens; identical to SEQ ID NO: 104857

SEQ ID NO: 146763 - RNA, 64 nt, Homo Sapiens; identical to SEQ ID NO: 104858

SEQ ID NO: 146764 - RNA, 64 nt, Homo Sapiens; identical to SEQ ID NO: 104859

SEQ ID NO: 146765 - RNA, 64 nt, Homo Sapiens; identical to SEQ ID NO: 104860

SEQ ID NO: 146766 - RNA, 64 nt, Homo Sapiens; identical to SEQ ID NO: 104861

SEQ ID NO: 146767 - RNA, 64 nt, Homo Sapiens; identical to SEQ ID NO: 104862

SEQ ID NO: 146768 - RNA, 64 nt, Homo Sapiens; identical to SEQ ID NO: 104863

SEQ ID NO: 146769 - RNA, 64 nt, Homo Sapiens; identical to SEQ ID NO: 104864

SEQ ID NO: 146770 - RNA, 64 nt, Homo Sapiens; identical to SEQ ID NO: 104865

SEQ ID NO: 146771 - RNA, 64 nt, Homo Sapiens; identical to SEQ ID NO: 104866

SEQ ID NO: 146772 - RNA, 64 nt, Homo Sapiens; identical to SEQ ID NO: 104867

SEQ ID NO: 146773 - RNA, 64 nt, Homo Sapiens; identical to SEQ ID NO: 104868

SEQ ID NO: 146774 - RNA, 64 nt, Homo Sapiens; identical to SEQ ID NO: 104869

SEQ ID NO: 146775 - RNA, 64 nt, Homo Sapiens; identical to SEQ ID NO: 104870

SEQ ID NO: 146776 - RNA, 64 nt, Homo Sapiens; identical to SEQ ID NO: 104871

SEQ ID NO: 146777 - RNA, 64 nt, Homo Sapiens; identical to SEQ ID NO: 104872

SEQ ID NO: 146778 - RNA, 64 nt, Homo Sapiens; identical to SEQ ID NO: 104873

SEQ ID NO: 146779 - RNA, 64 nt, Homo Sapiens; identical to SEQ ID NO: 104874

SEQ ID NO: 146780 - RNA, 64 nt, Homo Sapiens; identical to SEQ ID NO: 104875

SEQ ID NO: 146781 - RNA, 64 nt, Homo Sapiens; identical to SEQ ID NO: 104876

SEQ ID NO: 146782 - RNA, 64 nt, Homo Sapiens; identical to SEQ ID NO: 104877

SEQ ID NO: 146783 - RNA, 61 nt, Homo Sapiens; identical to SEQ ID NO: 104878

SEQ ID NO: 146784 - RNA, 64 nt, Homo Sapiens; identical to SEQ ID NO: 104879

SEQ ID NO: 146785 - RNA, 64 nt, Homo Sapiens
ugccauaggcagugcuguggacaguagaggcugccaaaggcaagggcuggucuucaggauggag

SEQ ID NO: 146786 - RNA, 64 nt, Homo Sapiens
ccccuccccacugugcuuuugaugccuuuggagucaaaggcagguggggucaccugaugagcua

SEQ ID NO: 146787 - RNA, 64 nt, Homo Sapiens
gcucuggcccuggcccacauugcacauggaaacccaaaggcauauaucugcguaugugugguac

SEQ ID NO: 146788 - RNA, 64 nt, Homo Sapiens
ucgucguaugaacugugcauagucuccagagcuucaaaggcaacacaagcucgcaacucuaaga

SEQ ID NO: 146789 - RNA, 64 nt, Homo Sapiens
augcuagcaucuggugaggggaaccugggaaauccaaaggcauguuauuuggcucacaguucug

SEQ ID NO: 146790 - RNA, 64 nt, Homo Sapiens
uuauguauauaauuaguuuauuuuacaacugggccaaaggcacauuucuuuuugaugucuuuua

SEQ ID NO: 146791 - RNA, 64 nt, Homo Sapiens
uauucaacagucccuguguguccuucugaguuuucaaaggcaagaaaucuggauuugccuugug

SEQ ID NO: 146792 - RNA, 64 nt, Homo Sapiens
guucauuucuuccauuaacuauacugcuggacuucaaaggcaaauaugaaaguaacaguuauug

SEQ ID NO: 146793 - RNA, 64 nt, Homo Sapiens
uggaauauauuuuaauaaaauaucaaaaagauaucaaaggcacaguguguguaagaugucuucc

SEQ ID NO: 146794 - RNA, 64 nt, Homo Sapiens
ugacuagaaucgacaaauuguugacccagguagucaaaggcaguuuuaucuggugggaaauugc

SEQ ID NO: 146795 - RNA, 64 nt, Homo Sapiens
ccuuuuugcuaaaacacuuauuacccuucugcagcaaaggcauuaaaagcgcuaagcauauauu

SEQ ID NO: 146796 - RNA, 64 nt, Homo Sapiens
auucaggaaacauggcacugcuuuuuucucuaagcaaaggcaaauauccucauaauucuaagcu

SEQ ID NO: 146797 - RNA, 64 nt, Homo Sapiens
gcuggugauagucaucucauccuacucaauuuuucaaaggcagaaaccaacccuggagcaauug

SEQ ID NO: 146798 - RNA, 64 nt, Homo Sapiens
guucagauucuuugccccaguucuaaucuagugacaaaggcauagaauucuccucccacaggaa

SEQ ID NO: 146799 - RNA, 64 nt, Homo Sapiens
caaaacuuagccucacuccacuuugugaugugagcaaaggcaacgacgggucaaaggcaaaggc

SEQ ID NO: 146800 - RNA, 64 nt, Homo Sapiens
ggccuuugugaugugagcaagguucaggacgggucaaaggcaaaagaagggccucacagugaug

SEQ ID NO: 146801 - RNA, 64 nt, Homo Sapiens
uuaccaugccagauggacaccagcuucuuugugacaaaggcaugaaugauuugacaguguccaa

SEQ ID NO: 146802 - RNA, 64 nt, Homo Sapiens
ucaacacuaacguugaguaccgguagcuugugaucaaaggcauauacuuccuuaugagauuucu

SEQ ID NO: 146803 - RNA, 64 nt, Homo Sapiens
ucaguaagcaaggucuuuguaagaaaagaucuaucaaaggcagauuucucuuuagguacaauag

SEQ ID NO: 146804 - RNA, 64 nt, Homo Sapiens
agauuguugauggcuuuaacaaacaccaaucucucaaaggcagcuuauacaagacuugauggac

SEQ ID NO: 146805 - RNA, 64 nt, Homo Sapiens
ccaaagccugucccaggacucacccuccacaaagcaaaggcagucccgggagaaaagacggaug

SEQ ID NO: 146806 - RNA, 64 nt, Homo Sapiens
aggaugccuuagcaugugacuccugaagggaaggcaaaggcagaggaauuuggcugcuucuacg

SEQ ID NO: 146807 - RNA, 64 nt, Homo Sapiens
aaauacaaauuccuaccauuucauguauucugaacaaaggcaaaauguggcauauuuaccaaug

SEQ ID NO: 146808 - RNA, 64 nt, Homo Sapiens
uggcauauuuaccaaugucaaguuguacuuccaccaaaggcauguuguauagaguaauaacaac

SEQ ID NO: 146809 - RNA, 64 nt, Homo Sapiens
aggacacaaaauucacauccuauuuucccuauaacaaaggcaauuccuuccuuggcucaaacaa

SEQ ID NO: 146810 - RNA, 64 nt, Homo Sapiens
uaaaaauucaauuucuugucgguugaaguuuuugcaaaggcauuucuucaccuugcuuuaagua

SEQ ID NO: 146811 - RNA, 64 nt, Homo Sapiens
ggagauuucuaaacauugugguacaauaacaacucaaaggcacauuguuuuuguguguagaaac

SEQ ID NO: 146812 - RNA, 64 nt, Homo Sapiens
auagcaaugacagucuuaagaguggaauuucauucaaaggcauacuggacaauggaggcgaaag

SEQ ID NO: 146813 - RNA, 64 nt, Homo Sapiens
gggagcaugcuucccugcagcugaccgggucacacaaaggcaugcuggaguacccagccuauca

SEQ ID NO: 146814 - RNA, 64 nt, Homo Sapiens
gcuggaguacccagccuaucaggugccccucuuccaaaggcagcgugccgagccagcaagagga

SEQ ID NO: 146815 - RNA, 64 nt, Homo Sapiens
cacgcuaccaaaucucaaaauauccuaagacuaacaaaggcagcugugucugagcccaacccuu

SEQ ID NO: 146816 - RNA, 64 nt, Homo Sapiens
acggccggagccaggcccaagacacagcagaggucaaaggcaguggagagccuuggccaguuca

SEQ ID NO: 146817 - RNA, 64 nt, Homo Sapiens
acuggagcccucugcucacuggcacuuccugacucaaaggcacuaacagugcucaugugccuuc

SEQ ID NO: 146818 - RNA, 64 nt, Homo Sapiens
cuuuuuggcuuucagugcuguuuagaaacaguggcaaaggcaggguggugcugccugcaagcug

SEQ ID NO: 146819 - RNA, 64 nt, Homo Sapiens
auuucuauauuuugucuuuuuuuaguucagacagcaaaggcauguacuacuauaaaauacaaag

SEQ ID NO: 146820 - RNA, 64 nt, Homo Sapiens
guuucaaaucaaauuaucuaagaaaacaagaaaacaaaggcagcagacuauugguacacauuau

SEQ ID NO: 146821 - RNA, 64 nt, Homo Sapiens
ggacacuccuuucuaauugcaaauuuucagcucucaaaggcaaaugugaugggaucacaugagc

SEQ ID NO: 146822 - RNA, 64 nt, Homo Sapiens
auaggggcuggcacaggagcauauuauuuaacagcaaaggcauccacgucuugucccccgcugc

SEQ ID NO: 146823 - RNA, 64 nt, Homo Sapiens
gugcacgcagaggacguuuguggaagcaaggacucaaaggcaaggucagagaugcugugcuucu

SEQ ID NO: 146824 - RNA, 64 nt, Homo Sapiens
agaacagccacuuucagacuaaaagaagaaacaacaaaggcaggagaaaaacccagacgccagg

SEQ ID NO: 146825 - RNA, 64 nt, Homo Sapiens
acgucggcuagcuucaggguuuaugaagcaaaggcaaaggcaacacaccaacaugggagggagu

SEQ ID NO: 146826 - RNA, 64 nt, Homo Sapiens
ggcaacacgucggcuagcuugggaguuuaugaagcaaaggcaaacagaaaacaccaacauggga

SEQ ID NO: 146827 - RNA, 64 nt, Homo Sapiens
uaauugcuagcaaaucccccccuucuugaucuuucaaaggcagccccuuuuguccauuaacacc

SEQ ID NO: 146828 - RNA, 64 nt, Homo Sapiens
aagccuggcuaccuccccccccaucuagucacaccaaaggcaaacccaggggccaagcaguucu

SEQ ID NO: 146829 - RNA, 64 nt, Homo Sapiens
gaccccuccaccgacuccuuuucuugggacuuaccaaaggcacgcugaggugcauuguccugcu

SEQ ID NO: 146830 - RNA, 64 nt, Homo Sapiens
aaguaucucacaaauaggaauaacucucagcauuacaaaagaguuuuuuaguuuucaguuuaag

SEQ ID NO: 146831 - RNA, 64 nt, Homo Sapiens
uguaguucagcuuuucaauguguaauccuaacaaacaaaagaaauacacagauguaauuaaaau

SEQ ID NO: 146832 - RNA, 64 nt, Homo Sapiens
cauguaauauucugagcacgggcaaagaaaacacacaaaagauuauguauuggcauuuauuuau

SEQ ID NO: 146833 - RNA, 64 nt, Homo Sapiens
cccauuauuccucaccuacccucaaaguagguauacaaaagacuaguuuguuauuaauccacaa

SEQ ID NO: 146834 - RNA, 64 nt, Homo Sapiens
uugccuuacacugguucaugguaugucauauaucacaaaagaaaucuacccuucccuucaagga

SEQ ID NO: 146835 - RNA, 64 nt, Homo Sapiens
cuacaggaggaacuuucugaggagcaguuccccaacaaaagaaggaucugaucuuagcaauuuu

SEQ ID NO: 146836 - RNA, 64 nt, Homo Sapiens
ugacuauuuucguucauuacuugauuaagauuuuacaaaagaggagcacuuccaaaauucuuau

SEQ ID NO: 146837 - RNA, 64 nt, Homo Sapiens
aagaggagcacuuccaaaauucuuauuuuuccuaacaaaagaugaaagcagggaauuucuaucu

SEQ ID NO: 146838 - RNA, 64 nt, Homo Sapiens
aaaauaaaacugauguaaugaauauauaauuacaacaaaagaggucuaacacuauaguagaaaa

SEQ ID NO: 146839 - RNA, 64 nt, Homo Sapiens
ccaacugaaguggcauguuauguuuuuggcaugaacaaaagaaacaagagagaaaaaaaucaaa

SEQ ID NO: 146840 - RNA, 64 nt, Homo Sapiens
ugaagaacuauuauauugaguacggauuuagcuaacaaaagauauuauuggcaauaccuaguga

SEQ ID NO: 146841 - RNA, 64 nt, Homo Sapiens
ugugacuagauaucaaucagguacuuacccuucuacaaaagaagaaaacaaccaaagaaaauug

SEQ ID NO: 146842 - RNA, 64 nt, Homo Sapiens
auuaguagaaaauacauuauuuuacagugauagaacaaaagaggauuuuaugguacuaaugaaa

SEQ ID NO: 146843 - RNA, 64 nt, Homo Sapiens
aguuagaauuacagcuacugcaaagcagaguauuacaaaagagaacauucuauagguuaauuuu

SEQ ID NO: 146844 - RNA, 64 nt, Homo Sapiens
aauauguugcuaagauugugcaccaaagauuauuacaaaagaaacagaauucauuggaagaaau

SEQ ID NO: 146845 - RNA, 64 nt, Homo Sapiens
agacaagacaagcacuuauuuuuauuuucagaagacaaaagaaccaagaugccaacuggcugcg

SEQ ID NO: 146846 - RNA, 64 nt, Homo Sapiens
ugaguaauggugaaaauuguugucuuuggaaagcacaaaagaaaccuggaaaggcaguucggcu

SEQ ID NO: 146847 - RNA, 64 nt, Homo Sapiens
aaaagcacuuaccagccgaacguggaacaguaucacaaaagauuccaucucccaacgauuucag

SEQ ID NO: 146848 - RNA, 64 nt, Homo Sapiens
uuagauauguccagagauggaaacucacuccccuacaaaagauggagcuuaauggagaaauugc

SEQ ID NO: 146849 - RNA, 64 nt, Homo Sapiens
auguaaugacuacguaacuugcuaugggcaguugacaaaagaaauuuaaaaaaguccaaaagca

SEQ ID NO: 146850 - RNA, 64 nt, Homo Sapiens
gguuaggugcauagauuuuuucaauagagaagauacaaaagagucauauugauagaggaauagg

SEQ ID NO: 146851 - RNA, 64 nt, Homo Sapiens
guaggagagccaaaccucauaagggaaauggcaaacaaaagacucuguguuuugguucaaagac

SEQ ID NO: 146852 - RNA, 64 nt, Homo Sapiens
aucaaaguggcagaacugccaucauuagucagccacaaaagacaaaaggaaggccaaaguaucc

SEQ ID NO: 146853 - RNA, 64 nt, Homo Sapiens
aaauaaucauugaugaaguaugucaguuacaagcacaaaagaauauaacugcuuuuauaaaucu

SEQ ID NO: 146854 - RNA, 64 nt, Homo Sapiens
aucagcuuuuuaauguagguuaccacuuauaagcacaaaagaaacauguauaagaaaccagauu

SEQ ID NO: 146855 - RNA, 64 nt, Homo Sapiens
gcaaacuggacuuuaagaacuggaaagagguuuuacaaaagaaaaacuuucagauucaucucuc

SEQ ID NO: 146856 - RNA, 64 nt, Homo Sapiens
aaaagaaugaaagggaaagugaaaaauuaaggggacaaaagaugggaugugaaaagaagaauuc

SEQ ID NO: 146857 - RNA, 64 nt, Homo Sapiens
ucacauggacgcacugagaauaaggguuugaucuacaaaagagcuccauuuuauuuuguacgag

SEQ ID NO: 146858 - RNA, 64 nt, Homo Sapiens
uuguuuaaagauuuuauuuagcaauugaaaugcuacaaaagacuuaucuucaaaaaaaucagca

SEQ ID NO: 146859 - RNA, 64 nt, Homo Sapiens
ggaggagaaggagaagaagaagaagaagaagaccacaaaagacaugacuauccaacuuuuuaug

SEQ ID NO: 146860 - RNA, 64 nt, Homo Sapiens
ggccaacauggcaaaaccccgucucuacaaaaauacaaaagaaauuagccagacaugauggcgg

SEQ ID NO: 146861 - RNA, 64 nt, Homo Sapiens
auggguguaauuuuccuaauacagguauguaacaacaaaagaaguugccugcaugccgguccaa

SEQ ID NO: 146862 - RNA, 64 nt, Homo Sapiens
uucuuuaaacuguuucaacgccaauauguauucuacaaaagagaaugguuuuaggcuccagugu

SEQ ID NO: 146863 - RNA, 64 nt, Homo Sapiens
aagagaaacaaguauuuugcuauauauaaagacaacaaaagaaaucuccuaacaaaagaacuaa

SEQ ID NO: 146864 - RNA, 64 nt, Homo Sapiens
ugcuauauauaaagacaacaaaagaaaucuccuaacaaaagaacuaagaggcccagcccucaga

SEQ ID NO: 146865 - RNA, 64 nt, Homo Sapiens
uugcugagaauuaagaaaugauacaguuaaugcaacaaaagauggaaaauaauauuucagucaa

SEQ ID NO: 146866 - RNA, 64 nt, Homo Sapiens
ccagucuucagauucucugguaaguuaauaacccacaaaagauucaggaagaggaucuauuuua

SEQ ID NO: 146867 - RNA, 64 nt, Homo Sapiens
uuuauguccaccauuaucucuguuugauauucuuacaaaagaugcugccagugagaaauuuucc

SEQ ID NO: 146868 - RNA, 64 nt, Homo Sapiens
agcauacuguuaaaaugugcuaucuccuuucccuacaaaagaaacacgauguuagacauagcca

SEQ ID NO: 146869 - RNA, 64 nt, Homo Sapiens
uaagcaauguucuuuauguagccaaugcuacgaaacaaaagaggugaaagagacccuuuuuuau

SEQ ID NO: 146870 - RNA, 64 nt, Homo Sapiens
aauaaauucauaaaaaagacucauaucuuugcaaacaaaagaagggcagauacugggcuucuac

SEQ ID NO: 146871 - RNA, 64 nt, Homo Sapiens
caaacauugucuguacagguacuuacugcuuuuuacaaaagaaaucauuuaguuacugggcaua

SEQ ID NO: 146872 - RNA, 64 nt, Homo Sapiens
aaagauaaaccagccucaauuuuaguuccucaucacaaaagaacuuuuuuucuccccucccaaa

SEQ ID NO: 146873 - RNA, 64 nt, Homo Sapiens
gucuucccuguacguauuggagaggcugaaaagcacaaaagauaggguggggauuaucuugggg

SEQ ID NO: 146874 - RNA, 64 nt, Homo Sapiens
aguuuauaggguuggguuuuaaauuguguaaaggacaaaagaccaauugcgugcaaugaaccug

SEQ ID NO: 146875 - RNA, 64 nt, Homo Sapiens
aaaaccaacuccaccaaaaagccagguaacauuaacaaaagaauucccuguaucaucuggaucu

SEQ ID NO: 146876 - RNA, 64 nt, Homo Sapiens
uuuuuaaaggucuuguugcaguaggagaaagagcacaaaagaggucugggaacuucucugcugc

SEQ ID NO: 146877 - RNA, 64 nt, Homo Sapiens
caaaagcuuuuuaaaauuuaauguggcuguaaugacaaaagauauuuugaauacauuuguauuu

SEQ ID NO: 146878 - RNA, 64 nt, Homo Sapiens
aaagcaaguacaaguuccaaacgugaucucuguuacaaaagaaaacucuguaacacuaaucaau

SEQ ID NO: 146879 - RNA, 64 nt, Homo Sapiens
caaguuuaaagagcuauauuuuaagaaagaugccuaaauagaaguauaacuacauagagauaaa

SEQ ID NO: 146880 - RNA, 64 nt, Homo Sapiens
acccaagguuuuucagugaguauaaaacccucuauaaauagauuaaccugagauuacagauacu

SEQ ID NO: 146881 - RNA, 64 nt, Homo Sapiens
ucugcccuccaacaucuuuuguguauacaaaaacuaaauagacuugaguaaugcacucuugcaa

SEQ ID NO: 146882 - RNA, 64 nt, Homo Sapiens
auauauuauuuuuugcacauauauuuuaaaauuauaaauagauauguuuuugagcuggcuguau

SEQ ID NO: 146883 - RNA, 64 nt, Homo Sapiens
uaucagaaaaaggcuuucuuucauaagacuauuuuaaauagaaauuauuucaacaauuaaagua

SEQ ID NO: 146884 - RNA, 64 nt, Homo Sapiens
uggacaaagcucuguauggaagacugaacaacuguaaauagaugauauccaaacuuaauuuggc

SEQ ID NO: 146885 - RNA, 64 nt, Homo Sapiens
gcagaaugaauuaauggaaauuuugaaugagggauaaauagaaaggaaaguauauauguuagag

SEQ ID NO: 146886 - RNA, 64 nt, Homo Sapiens
cuaugcuuccaccaauaaacugucucguuuauuuuaaauagaauugaaguagacccuagaaaau

SEQ ID NO: 146887 - RNA, 64 nt, Homo Sapiens
auuuuuauuuauguagcuuuaauagauauuucuauaaauagauauuuaaauuauggaacugcua

SEQ ID NO: 146888 - RNA, 64 nt, Homo Sapiens
uuucuauaaauagauaauuuaauuauggaacugcuaaauagauaaauuugauuugaauauuuua

SEQ ID NO: 146889 - RNA, 64 nt, Homo Sapiens
ggccucucauaguuuucucucucuuuaaagagaauaaauagagggccaggugugguggcucacg

SEQ ID NO: 146890 - RNA, 64 nt, Homo Sapiens
aaaaaaaaaaaaaaaaaaaaagagagagagagaauaaauagaaaagaauguggcugggaauugu

SEQ ID NO: 146891 - RNA, 64 nt, Homo Sapiens
gcgaacuucaagagaaguugaaaagcuagugaccuaaauagaaaaaccaggguuggcuuuauuu

SEQ ID NO: 146892 - RNA, 64 nt, Homo Sapiens
cuuauugaauauacauucuuagauuagauugaauuaaauagaaaaauuaaauuucuaauugagc

SEQ ID NO: 146893 - RNA, 64 nt, Homo Sapiens
uguuucuucugaauaaucuaaaacuuauuaagguuaaauagaauauauaaaaugugugagacaa

SEQ ID NO: 146894 - RNA, 64 nt, Homo Sapiens
aagaaaagauauaauuucuuuuguaauaucauucuaaauagauuggaaaagagucuuagagauu

SEQ ID NO: 146895 - RNA, 64 nt, Homo Sapiens
uagcagauagucuuugcucuaaaugauaucugaguaaauagacuugaggaauccucuaccacag

SEQ ID NO: 146896 - RNA, 64 nt, Homo Sapiens
uuuuuuuagauguuugauacauuuuaaguauuuuuaaauagaugaaaauucuaaaugauuuucc

SEQ ID NO: 146897 - RNA, 64 nt, Homo Sapiens
uucgguuuguaucuuccauaagaacuugagaucuuaaauagaaucugaaucaaaucaugauucu

SEQ ID NO: 146898 - RNA, 64 nt, Homo Sapiens
cagagguuuuacagcaguuuguuauuuguguugcuaaauagaugauaguauuuuggcuuuugaa

SEQ ID NO: 146899 - RNA, 64 nt, Homo Sapiens
uucuaaguuuauggugaacuuuuaacucaauguguaaauagaucuggagaauauucagcauaau

SEQ ID NO: 146900 - RNA, 64 nt, Homo Sapiens
ugaguacuuuaguguuuguauauguuuuuucuuuuaaauagaacuuguuuuuauaauugauuua

SEQ ID NO: 146901 - RNA, 64 nt, Homo Sapiens
caagcuauuauuaacaacuuuguuaaaguauuuguaaauagaaggacacuuguaagucaaucag

SEQ ID NO: 146902 - RNA, 64 nt, Homo Sapiens
ugcuaauaccgugugcgucaggaccuaauaacuuuaaauagacacucuaagaaaaggcuauaug

SEQ ID NO: 146903 - RNA, 64 nt, Homo Sapiens
aauaauauuauaaaauacaggauuuaaaccuuucuaaauagauccugaaacugucucucacauu

SEQ ID NO: 146904 - RNA, 64 nt, Homo Sapiens
cccagcuacuugggagguggaggugggaggauuauaaauagagacuuuccuuaagacuuuaaaa

SEQ ID NO: 146905 - RNA, 64 nt, Homo Sapiens
cuuuaguuugauagguucauuccuuacguaacguuaaauagaucuuagguucuauaugcuauuc

SEQ ID NO: 146906 - RNA, 64 nt, Homo Sapiens
uuaagccaauucuaguaagauauuucuuauuugguaaauagauugguaaaacuuaaaaguuuac

SEQ ID NO: 146907 - RNA, 64 nt, Homo Sapiens
caauuuguaauauuuugcaacccuaggauuuuuuuaaauagaugcugcuugcuauguuuucaaa

SEQ ID NO: 146908 - RNA, 64 nt, Homo Sapiens
ugacuguauuauuugauuucggauugaaugaauguaaauagaaauuaaaugcaaauuugaauga

SEQ ID NO: 146909 - RNA, 64 nt, Homo Sapiens
guuauaauuuuuuucuuaaacuggcccccggguguaaauagauucccgucuccucuucccuucc

SEQ ID NO: 146910 - RNA, 64 nt, Homo Sapiens
cagcccagcccgucuccucuuccugugucccuuguaaauagaaccuccuccagacccccucccc

SEQ ID NO: 146911 - RNA, 64 nt, Homo Sapiens
aaaaauauaaauaugcauauauauauauaaauuauaaauagauuccccacgcagugugguggca

SEQ ID NO: 146912 - RNA, 64 nt, Homo Sapiens
gaugaguggaugaguggaucgauggauguauugauaaauagauagaaccagucaucugaagcaa

SEQ ID NO: 146913 - RNA, 64 nt, Homo Sapiens
uuaagcuucauuauaaaauauguauuuauguauguaaauagauuguugcaucaacaaaguuaau

SEQ ID NO: 146914 - RNA, 64 nt, Homo Sapiens
gccuuucugcugccuuggguucacaaucagugaguaaauagacaagcaaacuuuccugggcaaa

SEQ ID NO: 146915 - RNA, 64 nt, Homo Sapiens
gcugagggggaagauuuagaagccuugcacucacuaaauagauuaaacagagcaggcuuguuug

SEQ ID NO: 146916 - RNA, 64 nt, Homo Sapiens
agguguuuuacacucacauucccuuuuugccccuuaaauagaaagugcagguaaagguuuauac

SEQ ID NO: 146917 - RNA, 58 nt, Homo Sapiens
uucgagaaauuaaaucuuaaaaucuguguaaauagaaaacuugaaccauuaguaauaa

SEQ ID NO: 146918 - RNA, 64 nt, Homo Sapiens
uuaauauaaaguuugaagcuucauccaccaaaguuaaauagagcuauuuaaaaaugcacuuuau

SEQ ID NO: 146919 - RNA, 63 nt, Homo Sapiens
auuuucaaaacgaaguucuuacuuuuaaagagaauuaccuauauucuccugauacugauuacc

SEQ ID NO: 146920 - RNA, 63 nt, Homo Sapiens
ugauuugaccaauuuaucaaauaugucauuuuaauuaccuagcuggaaguuagagacaugaaa

SEQ ID NO: 146921 - RNA, 63 nt, Homo Sapiens
caguuagacaauccaugguuuaaugcacaugaaauuaccuauauuuuauacuguuucaaugua

SEQ ID NO: 146922 - RNA, 63 nt, Homo Sapiens
ucuaagaccauuucauucugaaacuucuuaucaauuaccuaaaucucaacgaaaaacaauuua

SEQ ID NO: 146923 - RNA, 63 nt, Homo Sapiens
gaaaacauuuguucccuguuguggccacuuauuauuaccuaaagugaaguuggucagggacau

SEQ ID NO: 146924 - RNA, 63 nt, Homo Sapiens
ucuaguuggccuuugguugauugaacacuugcaauuaccuagauagggucaaagacauucuau

SEQ ID NO: 146925 - RNA, 63 nt, Homo Sapiens
uagaugcacugcucaccugcagacauagacaguauuaccuaggaaaauuacauaguauuaccu

SEQ ID NO: 146926 - RNA, 63 nt, Homo Sapiens
cauagacaguauuaccuaggaaaauuacauaguauuaccuagauccacacgcaguaugaagau

SEQ ID NO: 146927 - RNA, 63 nt, Homo Sapiens
aagauuuguaaaaguaaaaucaaacauugaacaauuaccuauaaaaaucucaaauaacaagua

SEQ ID NO: 146928 - RNA, 63 nt, Homo Sapiens
caaugccuuuuaaaagaaagacucaaacucaguauuaccuacuucgacuuguauuuauuaaau

SEQ ID NO: 146929 - RNA, 64 nt, Homo Sapiens
agugucaaugcagcccccauuguggucacaggaaguagaggaggccacguucuuacuaguuucc

SEQ ID NO: 146930 - RNA, 64 nt, Homo Sapiens
gcgacagugagacucugucucaguccaugaagauguagaggagaaacuggaacucucgagcguu

SEQ ID NO: 146931 - RNA, 64 nt, Homo Sapiens
gauuugcaguuacuugggcaagcaagcacacuuuguagaggaggucuaguuugcacugccuugg

SEQ ID NO: 146932 - RNA, 64 nt, Homo Sapiens
aagugugugguuaagccaguguggggaaaaaaaaguagaggaaaugucauccgcuugcugugcu

SEQ ID NO: 146933 - RNA, 64 nt, Homo Sapiens
caguguacuguuaaaccaauuucucuugguccuaguagaggaugugcugacaccaaugaggcac

SEQ ID NO: 146934 - RNA, 64 nt, Homo Sapiens
agaauucaucugguuaucacaucuaaaugucucaguagaggaguagcgauagauuuauauaaau

SEQ ID NO: 146935 - RNA, 64 nt, Homo Sapiens
gcuuaaccuaggcuaugugacagugaagcaaaauguugccaacugaaagcuuuguaaaaccaga

SEQ ID NO: 146936 - RNA, 64 nt, Homo Sapiens
gaguuugggaaaugcuggcucaggaugggguuugguugccaaaauuuguguggggagguggggg

SEQ ID NO: 146937 - RNA, 64 nt, Homo Sapiens
aaucuaggaaauuaguuguauaguauucugaucaguugccaaaguucuauagcgagacauagaa

SEQ ID NO: 146938 - RNA, 64 nt, Homo Sapiens
gaggaaauaagguuagaagcgcgugagcuggucaguugccaaagauuucaucacuaguaugugu

SEQ ID NO: 146939 - RNA, 64 nt, Homo Sapiens
uggacauugugcaauaaagucagcauagcugaaaguugccaaacuuugcuuuuguuuagcuuca

SEQ ID NO: 146940 - RNA, 64 nt, Homo Sapiens
uuaaugauuauucuuuuuauccuuccuaguggcaguugccaaugaguaguauguggcauauaca

SEQ ID NO: 146941 - RNA, 64 nt, Homo Sapiens
uauuuaaaagggcuuuccugugcauggaacugugguugccaagguaugugaguuuuccuuuugg

SEQ ID NO: 146942 - RNA, 64 nt, Homo Sapiens
ucaccuuaaagucgucaguaagcugggcuggacuguugccaacaaggggaaaguuuaaaauccc

SEQ ID NO: 146943 - RNA, 64 nt, Homo Sapiens
uucacaaucagcgccuugugguaagauaaugcuguaacuagaauaugccugccucuuuaauuug

SEQ ID NO: 146944 - RNA, 64 nt, Homo Sapiens
cacucaaauugccaaccaggaauguucaacaccauaacuagagaggccacucagagcuaaccaa

SEQ ID NO: 146945 - RNA, 64 nt, Homo Sapiens
agggcccauuuccuccccucucuaccugcagugaguuccagaccugcccguccccucaccagcg

SEQ ID NO: 146946 - RNA, 64 nt, Homo Sapiens
ccccucaccagcgccuccccacccuguugguacuguuccagaaaaacuguuacucccccucacc

SEQ ID NO: 146947 - RNA, 64 nt, Homo Sapiens
cuggagucaugcugcccacaagauacauuguuggguuccagagggcuuaucaaaaguuugugga

SEQ ID NO: 146948 - RNA, 64 nt, Homo Sapiens
agauucaggccguuuggcacguaaccuuuagguuguuccagaaagcugggaggagagucuaacu

SEQ ID NO: 146949 - RNA, 64 nt, Homo Sapiens
ccuaccaugggcacccaugugcuggcacagaacaguuccagaucuagacuggagagguccacag

SEQ ID NO: 146950 - RNA, 64 nt, Homo Sapiens
gcauuauauauucuaguuagaucagcucugguagguuccagagaacagucaauguuggaaggau

SEQ ID NO: 146951 - RNA, 64 nt, Homo Sapiens
ugguucaacuguugacagaggacacaaauacguuguuccagagcucagccuucucacucuaaaa

SEQ ID NO: 146952 - RNA, 64 nt, Homo Sapiens
ccacacuguaggcagcagugacuaagcacuggcaguuccagaacauuuacccagguauauguua

SEQ ID NO: 146953 - RNA, 64 nt, Homo Sapiens
auuauaaguuacuguucuaagaaaaguaaauacaguuccagauggguuauugcagauuaacaga

SEQ ID NO: 146954 - RNA, 64 nt, Homo Sapiens
caagggcuggguuugccucugaugaguacaaucaguuccagaagacuggguaagucucuugcua

SEQ ID NO: 146955 - RNA, 64 nt, Homo Sapiens
uauuuuagacugacugaacgaaacccagaggcugguuccagagcucugucccugagaacacauc

SEQ ID NO: 146956 - RNA, 64 nt, Homo Sapiens
gccuggcuaacauggcaauaacuucagcccaggaguuccagacugaggccaaggcagggggauu

SEQ ID NO: 146957 - RNA, 64 nt, Homo Sapiens
cauuagaaggcaggauuaauaagguagaggauguguuccagaaaaucagaggagccggcaggcg

SEQ ID NO: 146958 - RNA, 64 nt, Homo Sapiens
uggaaucaaacaguccugaaagagguuccagaaaguuccagauuuguguguguguguguguguc

SEQ ID NO: 146959 - RNA, 64 nt, Homo Sapiens
guuccagauuuggaaucaaaugugugugucagagguuccagaaaugugugugugugugugugug

SEQ ID NO: 146960 - RNA, 64 nt, Homo Sapiens
ccgccccuggggaaauagccucacgggguuggcuguuccagacucagguuccagaacagcccuc

SEQ ID NO: 146961 - RNA, 64 nt, Homo Sapiens
aauagccucacgggguuggcuguuccagacucagguuccagaacagcccucggccuccgaggcu

SEQ ID NO: 146962 - RNA, 64 nt, Homo Sapiens
ggguggggcuuagaauggggugggccaagccaggguuccagacacaagaagugggauucaggaa

SEQ ID NO: 146963 - RNA, 64 nt, Homo Sapiens
gaguggaucuggagucugaaagcagggggguuggguuccagacaagguguggaguggagggguc

SEQ ID NO: 146964 - RNA, 64 nt, Homo Sapiens
uuguguuugugcugcccacaggacagugggaguuacaguucauaucaggaugacccuacauacc

SEQ ID NO: 146965 - RNA, 64 nt, Homo Sapiens
caaucuuaauauguagguucauuuaaauuuuaagacaguucagugcauauauaguagaagccuu

SEQ ID NO: 146966 - RNA, 64 nt, Homo Sapiens
gaaaugaacuucaguaagcuuucaauuuugauacacaguucauuauucauaacuugaggcagua

SEQ ID NO: 146967 - RNA, 64 nt, Homo Sapiens
guuuccaggugggcaugguuuauuucccaguuuaacaguucagaauaggggcauuuauuuuauc

SEQ ID NO: 146968 - RNA, 64 nt, Homo Sapiens
uuccaaguucucacugcuggaaagagcuagaagcacaguucaaaguucuggcuucuggacucug

SEQ ID NO: 146969 - RNA, 64 nt, Homo Sapiens
gaaguggcccauaacuugaaggaaaaguuuaaagacaguucaauuuaaucaucagaaugcauuc

SEQ ID NO: 146970 - RNA, 64 nt, Homo Sapiens
uaagcacggagaaguguugcccauauguugggcaacaguucaaaaucauguguuuaaacaaauc

SEQ ID NO: 146971 - RNA, 64 nt, Homo Sapiens
ugaagcacaaggauuaaguuaaugacaaaaauaaacaguucaagaagacaauguugcaauguug

SEQ ID NO: 146972 - RNA, 64 nt, Homo Sapiens
ugcuggugcaccucgcccaacucauucuuacugcacaguucacuuuauuuaacaauuuucaugu

SEQ ID NO: 146973 - RNA, 64 nt, Homo Sapiens
ugucccgucaccaggcucuugcuucacugcagauacaguucacucugaaagcugguugaaggag

SEQ ID NO: 146974 - RNA, 64 nt, Homo Sapiens
guaggaaagcaauucuguacgggccuuaagaaggacaguucauuuuuaacauuuggguggagag

SEQ ID NO: 146975 - RNA, 64 nt, Homo Sapiens
gacuaggaaaagcacuacaugauuuugccagggaacaguucacuauagucaauucugugccuag

SEQ ID NO: 146976 - RNA, 64 nt, Homo Sapiens
gcuccccccauccugggcugggcugccuucuucuacaguucaauauggggcagacuagggaaac

SEQ ID NO: 146977 - RNA, 64 nt, Homo Sapiens
uccucccagaauauuuagaaauguagaagggauaacaguucacagccagguaaaauuuaacugg

SEQ ID NO: 146978 - RNA, 64 nt, Homo Sapiens
ccuggucucgggaggcuucugucauugcucacacacaguucagauuuccaccucuuuauagaca

SEQ ID NO: 146979 - RNA, 64 nt, Homo Sapiens
guuuauauaaauuggcaacaacuuauaccgucugacaguucaaaaucucuuucagcugcgcucu

SEQ ID NO: 146980 - RNA, 64 nt, Homo Sapiens
accucugaguguugaaggggcaacccaaggcaucacaguucacagguaaccauguuguguucuu

SEQ ID NO: 146981 - RNA, 64 nt, Homo Sapiens
uuuaaauuauuuauauuacugaauuggcaaaauuacaguucacacugcagagcuagguuguccu

SEQ ID NO: 146982 - RNA, 64 nt, Homo Sapiens; identical to SEQ ID NO: 113583

SEQ ID NO: 146983 - RNA, 64 nt, Homo Sapiens; identical to SEQ ID NO: 113584

SEQ ID NO: 146984 - RNA, 64 nt, Homo Sapiens; identical to SEQ ID NO: 113585

SEQ ID NO: 146985 - RNA, 64 nt, Homo Sapiens; identical to SEQ ID NO: 113586

SEQ ID NO: 146986 - RNA, 64 nt, Homo Sapiens; identical to SEQ ID NO: 113587

SEQ ID NO: 146987 - RNA, 64 nt, Homo Sapiens; identical to SEQ ID NO: 113588

SEQ ID NO: 146988 - RNA, 64 nt, Homo Sapiens; identical to SEQ ID NO: 113589

SEQ ID NO: 146989 - RNA, 64 nt, Homo Sapiens; identical to SEQ ID NO: 113590

SEQ ID NO: 146990 - RNA, 64 nt, Homo Sapiens; identical to SEQ ID NO: 113591

SEQ ID NO: 146991 - RNA, 64 nt, Homo Sapiens; identical to SEQ ID NO: 113592

SEQ ID NO: 146992 - RNA, 64 nt, Homo Sapiens; identical to SEQ ID NO: 113593

SEQ ID NO: 146993 - RNA, 64 nt, Homo Sapiens; identical to SEQ ID NO: 113594

SEQ ID NO: 146994 - RNA, 64 nt, Homo Sapiens; identical to SEQ ID NO: 113595

SEQ ID NO: 146995 - RNA, 64 nt, Homo Sapiens; identical to SEQ ID NO: 113596

SEQ ID NO: 146996 - RNA, 64 nt, Homo Sapiens; identical to SEQ ID NO: 113597

SEQ ID NO: 146997 - RNA, 64 nt, Homo Sapiens; identical to SEQ ID NO: 113598

SEQ ID NO: 146998 - RNA, 64 nt, Homo Sapiens; identical to SEQ ID NO: 113599

SEQ ID NO: 146999 - RNA, 64 nt, Homo Sapiens; identical to SEQ ID NO: 113600

SEQ ID NO: 147000 - RNA, 64 nt, Homo Sapiens; identical to SEQ ID NO: 113601

SEQ ID NO: 147001 - RNA, 64 nt, Homo Sapiens; identical to SEQ ID NO: 113602

SEQ ID NO: 147002 - RNA, 64 nt, Homo Sapiens; identical to SEQ ID NO: 113603

SEQ ID NO: 147003 - RNA, 64 nt, Homo Sapiens; identical to SEQ ID NO: 113604

SEQ ID NO: 147004 - RNA, 64 nt, Homo Sapiens; identical to SEQ ID NO: 113605

SEQ ID NO: 147005 - RNA, 64 nt, Homo Sapiens; identical to SEQ ID NO: 113606

SEQ ID NO: 147006 - RNA, 64 nt, Homo Sapiens; identical to SEQ ID NO: 113607

SEQ ID NO: 147007 - RNA, 64 nt, Homo Sapiens; identical to SEQ ID NO: 113608

SEQ ID NO: 147008 - RNA, 64 nt, Homo Sapiens; identical to SEQ ID NO: 113609

SEQ ID NO: 147009 - RNA, 64 nt, Homo Sapiens; identical to SEQ ID NO: 113610

SEQ ID NO: 147010 - RNA, 64 nt, Homo Sapiens; identical to SEQ ID NO: 113611

SEQ ID NO: 147011 - RNA, 64 nt, Homo Sapiens; identical to SEQ ID NO: 113612

SEQ ID NO: 147012 - RNA, 64 nt, Homo Sapiens; identical to SEQ ID NO: 113613

SEQ ID NO: 147013 - RNA, 64 nt, Homo Sapiens; identical to SEQ ID NO: 113614

SEQ ID NO: 147014 - RNA, 64 nt, Homo Sapiens; identical to SEQ ID NO: 113615

SEQ ID NO: 147015 - RNA, 64 nt, Homo Sapiens; identical to SEQ ID NO: 113616

SEQ ID NO: 147016 - RNA, 64 nt, Homo Sapiens; identical to SEQ ID NO: 113617

SEQ ID NO: 147017 - RNA, 64 nt, Homo Sapiens; identical to SEQ ID NO: 113618

SEQ ID NO: 147018 - RNA, 64 nt, Homo Sapiens; identical to SEQ ID NO: 113619

SEQ ID NO: 147019 - RNA, 64 nt, Homo Sapiens; identical to SEQ ID NO: 113620

SEQ ID NO: 147020 - RNA, 64 nt, Homo Sapiens; identical to SEQ ID NO: 113621

SEQ ID NO: 147021 - RNA, 64 nt, Homo Sapiens; identical to SEQ ID NO: 113622

SEQ ID NO: 147022 - RNA, 64 nt, Homo Sapiens; identical to SEQ ID NO: 113623

SEQ ID NO: 147023 - RNA, 64 nt, Homo Sapiens; identical to SEQ ID NO: 113624

SEQ ID NO: 147024 - RNA, 64 nt, Homo Sapiens; identical to SEQ ID NO: 113625

SEQ ID NO: 147025 - RNA, 64 nt, Homo Sapiens; identical to SEQ ID NO: 113626

SEQ ID NO: 147026 - RNA, 64 nt, Homo Sapiens; identical to SEQ ID NO: 113627

SEQ ID NO: 147027 - RNA, 64 nt, Homo Sapiens; identical to SEQ ID NO: 113628

SEQ ID NO: 147028 - RNA, 64 nt, Homo Sapiens; identical to SEQ ID NO: 113629

SEQ ID NO: 147029 - RNA, 64 nt, Homo Sapiens; identical to SEQ ID NO: 113630

SEQ ID NO: 147030 - RNA, 64 nt, Homo Sapiens; identical to SEQ ID NO: 113631

SEQ ID NO: 147031 - RNA, 64 nt, Homo Sapiens; identical to SEQ ID NO: 113632

SEQ ID NO: 147032 - RNA, 64 nt, Homo Sapiens; identical to SEQ ID NO: 113633

SEQ ID NO: 147033 - RNA, 64 nt, Homo Sapiens; identical to SEQ ID NO: 113634

SEQ ID NO: 147034 - RNA, 64 nt, Homo Sapiens; identical to SEQ ID NO: 113635

SEQ ID NO: 147035 - RNA, 64 nt, Homo Sapiens; identical to SEQ ID NO: 113636

SEQ ID NO: 147036 - RNA, 64 nt, Homo Sapiens; identical to SEQ ID NO: 113637

SEQ ID NO: 147037 - RNA, 64 nt, Homo Sapiens; identical to SEQ ID NO: 113638

SEQ ID NO: 147038 - RNA, 64 nt, Homo Sapiens
aacucaaggcuuguugugaagccuaaaaauauucacaaauaagcuuuuaaacuggugucuuugg

SEQ ID NO: 147039 - RNA, 64 nt, Homo Sapiens
ugaauuuagauaucuuuauuccauuuauuaugguacaaauaacugauguuuuaaccagaguaau

SEQ ID NO: 147040 - RNA, 64 nt, Homo Sapiens
uuuagguggggguggcagguguauuucuuuuuuaacaaauaaaaggcauuuaaguaaaacuaaa

SEQ ID NO: 147041 - RNA, 64 nt, Homo Sapiens
aacuucuuacuccauaccuuguucgauauggaggacaaauaauuggauugucugauaagucugc

SEQ ID NO: 147042 - RNA, 64 nt, Homo Sapiens
uuacaaauuccuuucagaguuuuacuaagaucacacaaauaacagcuuucuuauucagugaaaa

SEQ ID NO: 147043 - RNA, 64 nt, Homo Sapiens
uuuuguggcaaaauauucuucuuugauaguguaaacaaauaauaaagcaaucuagguccuuuag

SEQ ID NO: 147044 - RNA, 64 nt, Homo Sapiens
ggaaaccguguaaauaccugcauugucuguaaugacaaauaaguuacuaagauguucacugugg

SEQ ID NO: 147045 - RNA, 64 nt, Homo Sapiens
gacaagugagacaaaaagcauuccuaaggcacccacaaauaaauaggaucaaauucuacaacuu

SEQ ID NO: 147046 - RNA, 64 nt, Homo Sapiens
guguuuuguuugaaugugcaauaguuuauaggccacaaauaagcuuucuuguaagcucucuucc

SEQ ID NO: 147047 - RNA, 64 nt, Homo Sapiens
gaauaguuuacuauuucauucaagcauguuuaaaacaaauaauuuccuuucaccaguuuuucuu

SEQ ID NO: 147048 - RNA, 64 nt, Homo Sapiens
cuaggcuacagguauagcugaagaacuaaauaaaacaaauaaaaacuaaugaaggguuuuuuaa

SEQ ID NO: 147049 - RNA, 64 nt, Homo Sapiens
uuggggagaugggaaucuuuugaaaaccaaugcgacaaauaaaguuuuaaaaaauuaaaauuuc

SEQ ID NO: 147050 - RNA, 64 nt, Homo Sapiens
uuagaacauagaguggcauggccgugcuggaaugacaaauaacuggcgugcuuuuuuuuugugu

SEQ ID NO: 147051 - RNA, 64 nt, Homo Sapiens
aaggcuaacuccugaucguuucuguagaaagaugacaaauaaagaaaaaguuauaauuauuaau

SEQ ID NO: 147052 - RNA, 64 nt, Homo Sapiens
acuugaauauguuuguagagcauaauaacccaaaacaaauaauuuauauaauuauuucauguua

SEQ ID NO: 147053 - RNA, 64 nt, Homo Sapiens
uuggccgggcacgguggcucauaaauaagcuuaaacaaauaacuuguggcugaugguguugaag

SEQ ID NO: 147054 - RNA, 64 nt, Homo Sapiens
guaaaguauuauuuauuugaaucuacaaaaaacaacaaauaauuuuuaaauauaaggauuuucc

SEQ ID NO: 147055 - RNA, 64 nt, Homo Sapiens
ggguacccaguuaaauuuucauuucagauaaacaacaaauaauuuuuuaguauaaguacauuau

SEQ ID NO: 147056 - RNA, 64 nt, Homo Sapiens
aacaaacaaacagccacaaaaggccuuuaggaagacaaauaaauuaauggccaguuguuuagga

SEQ ID NO: 147057 - RNA, 64 nt, Homo Sapiens
uacaugccagauuucuauucugcugauugcuuauacaaauaaccaggagagguuuccuucagau

SEQ ID NO: 147058 - RNA, 64 nt, Homo Sapiens
aauaaauaaauaaaagcauacuauaguuguaaaaacaaauaauuuuaauaguauauucaguggc

SEQ ID NO: 147059 - RNA, 64 nt, Homo Sapiens
gaagaaaacagacaaaagacauguaacaacagaaacaaauaaaccacuuacuguaaaauuucag

SEQ ID NO: 147060 - RNA, 64 nt, Homo Sapiens
auauguugaauuuucguauuuauucauauauuuaacaaauaaaaugaaggaauauauuuaauua

SEQ ID NO: 147061 - RNA, 64 nt, Homo Sapiens
cauauaccuguuuucaguccaauauaaauucuggacaaauaaguauuuuauugggauacagaaa

SEQ ID NO: 147062 - RNA, 64 nt, Homo Sapiens
uauagauauauauguccacccuguauaucuauauacaaauaauauacuuugguacaaauaaaaa

SEQ ID NO: 147063 - RNA, 64 nt, Homo Sapiens
acuguauaucuauauacaaaaguuuuacuuugguacaaauaaaaagaauuaggcaguuggugau

SEQ ID NO: 147064 - RNA, 64 nt, Homo Sapiens
cacaacgauuauaguaacuauaagauacaauaaaacaaauaaauaugaaaguagauucaugaaa

SEQ ID NO: 147065 - RNA, 64 nt, Homo Sapiens
ucaauugacauuccuuugaauacgcuaauaagugacaaauaagauuaauaagauuuuucaaaau

SEQ ID NO: 147066 - RNA, 64 nt, Homo Sapiens
caaucuaugcuguucuguccugcccuaucaaaauacaaauaaauacuauaaaauaaaucuucac

SEQ ID NO: 147067 - RNA, 64 nt, Homo Sapiens
caauuaaguacacuuuauugaaguuuaugucugaacaaauaagucagaucacaggggccuuaca

SEQ ID NO: 147068 - RNA, 64 nt, Homo Sapiens
gaaauaaaaaacauguuaauguucauuugcagaaacaaauaacuuagguacauggauacaucaa

SEQ ID NO: 147069 - RNA, 64 nt, Homo Sapiens
guucuuguacccagagugauaaauaauaauuggaacaaauaaagacagguucuaaauuuaaaac

SEQ ID NO: 147070 - RNA, 64 nt, Homo Sapiens
auuggaacaaauaaagguucguucuaaauuuaaaacaaauaauaguauuuuagacccaacacag

SEQ ID NO: 147071 - RNA, 64 nt, Homo Sapiens
agcaaagcuucagugcuuuuuuggcugaaucacaacaaauaacuaaugugacaagagaauuggu

SEQ ID NO: 147072 - RNA, 64 nt, Homo Sapiens
uaacacauaucauauaggacccuuuguaaaauauacaaauaaucggaaauauaaaucauauggu

SEQ ID NO: 147073 - RNA, 64 nt, Homo Sapiens
uuuuauuagauagauaccuaugcauugcacauacacaaauaaacucauaucuaagauagaguua

SEQ ID NO: 147074 - RNA, 64 nt, Homo Sapiens
gacuuucuauuuucauauuucauauuacaaauggacaaauaacguguaucaucuuuuuuuuucu

SEQ ID NO: 147075 - RNA, 64 nt, Homo Sapiens
cauaacugaaagaagagcaggucccaguacacuuacaaauaaaaaaaauacaacagggggaugu

SEQ ID NO: 147076 - RNA, 64 nt, Homo Sapiens
acaaacuaaaacaaaacagaccaccaaaaacuagacaaauaaaguacaaaaacaaaccuaccaa

SEQ ID NO: 147077 - RNA, 64 nt, Homo Sapiens
uacaugugaauucuacugcuuuaagagaaauaaaacaaauaagccuagggaaauauuagagucu

SEQ ID NO: 147078 - RNA, 64 nt, Homo Sapiens
auuaaaggugccagaucaaaauaguaauaaaucaacaaauaauuuuugauugacugguggaauu

SEQ ID NO: 147079 - RNA, 64 nt, Homo Sapiens
auacaguauaacaguuauuuaaaauaaaaauaauacaaauaaaagcagaucaaaaauauuagaa

SEQ ID NO: 147080 - RNA, 64 nt, Homo Sapiens
uagccucauucauuuuuuaauccaugauggcuguacaaauaauugcuguauugaaaaauauaaa

SEQ ID NO: 147081 - RNA, 64 nt, Homo Sapiens
uucuauucugauuuuaaaaaaaaaucuugaauccacaaauaaagaaaguguaaaaucauuuuuu

SEQ ID NO: 147082 - RNA, 53 nt, Homo Sapiens
aucuguaguguuuuuacugcauuacaaauaacagcuuugauggaguugauuag

SEQ ID NO: 147083 - RNA, 64 nt, Homo Sapiens
cugccuuuuacaggugaaacaauuaaaauuaaaaacaaauaaucgacugucucaaaaaaauuaa

SEQ ID NO: 147084 - RNA, 64 nt, Homo Sapiens
cugccuuuggccgggugcggcugcaacccgcuuaacaaauaaucguggggggucugguagaaca

SEQ ID NO: 147085 - RNA, 64 nt, Homo Sapiens
acuugaguggauggauacccggauuguuuguaacacaaauaaauaaauaacuaagaguauaauu

SEQ ID NO: 147086 - RNA, 64 nt, Homo Sapiens
aagaguauaauuggauuguuaauagcuuaauuguacaaauaacuaccgggugaguauagucaau

SEQ ID NO: 147087 - RNA, 64 nt, Homo Sapiens
uaaggggaaguuuuauuagcguuaugcacacauuacaaauaauacuguaacaaaaguguacuau

SEQ ID NO: 147088 - RNA, 64 nt, Homo Sapiens
ucacaggucucuuggccucauccugacuuagagauacaaucacgcacucgcccagucuucaguc

SEQ ID NO: 147089 - RNA, 64 nt, Homo Sapiens
auuuuggucccuuccagcuuccacaaauauuuauuacaaucagucccagucaguacaaggaggc

SEQ ID NO: 147090 - RNA, 64 nt, Homo Sapiens
gccacugcuacaucucccagcugugaauuacugcuacaaucaaggugucagaaccaguccugcc

SEQ ID NO: 147091 - RNA, 64 nt, Homo Sapiens
ccagcagggugggcaacuccagagccaguguuuguacaaucagaggucugccauugcaaugcag

SEQ ID NO: 147092 - RNA, 51 nt, Homo Sapiens
guccuaacgagaagagauaauuacaaucaggcuaccagaggaagccuuugg

SEQ ID NO: 147093 - RNA, 64 nt, Homo Sapiens
gaggaagccuuugguccuaacgagaagagauaauuacaaucaggcuaccaaaggaagcacuaac

SEQ ID NO: 147094 - RNA, 64 nt, Homo Sapiens
aaacaugaauucauaaauucaggaagcacaauauauaccaaacauauauuuaaauaaaauccag

SEQ ID NO: 147095 - RNA, 64 nt, Homo Sapiens
ccaggccuagacucaagguauuguaaaugacaagauaccaaauacaagauuuuaaaagcaacca

SEQ ID NO: 147096 - RNA, 64 nt, Homo Sapiens
uaauaacuuugaacuuaaauauacuuaacaacauauaccaaaaauauaugaggcaaauuuuagc

SEQ ID NO: 147097 - RNA, 64 nt, Homo Sapiens
aaaugaaauggacaaauuccuaggaagacacagaauaccaaaucugacuccacaagaaauagau

SEQ ID NO: 147098 - RNA, 64 nt, Homo Sapiens
aaaaaaagaaaaaaaaagaagaaaaguauaccagauaccaaaagcuagcuuucuuauguuuucc

SEQ ID NO: 147099 - RNA, 64 nt, Homo Sapiens
gaugcaguauccuguacuagcuuauaauauucccauaccaaagucauggggaaacaaacauuau

SEQ ID NO: 147100 - RNA, 64 nt, Homo Sapiens
gaaguuuugauguuagaauaauugcuuuuggaaaauaccaaaugaacguacaguacaacauuuc

SEQ ID NO: 147101 - RNA, 64 nt, Homo Sapiens
uugguuugcaucuuuuuuccauauuguuaauuuuauaccaaaauguuaaauauuuguauuacuu

SEQ ID NO: 147102 - RNA, 64 nt, Homo Sapiens
uguuugcuuauuccacauuaauuuacuuuucucuauaccaaaucacccauggaauaguuauuga

SEQ ID NO: 147103 - RNA, 64 nt, Homo Sapiens
uuuuucacugauucuauaagcccagcauuaccugauaccaaaaccaggcaaagaaaacagaaga

SEQ ID NO: 147104 - RNA, 64 nt, Homo Sapiens
auguaucauuuuuauuugaaaagugaaauugaaaauaccaaaaguucauaauguauaccuagaa

SEQ ID NO: 147105 - RNA, 64 nt, Homo Sapiens
aacgacaacaacgcccucuuaaucagcaaaauccauaccaaaacuuuuuuuccccuccuauuuu

SEQ ID NO: 147106 - RNA, 64 nt, Homo Sapiens
uguuacuauuguguuauucaugucuuuaaaucagauaccaaauauuuuuuaggaaagaaaaaug

SEQ ID NO: 147107 - RNA, 64 nt, Homo Sapiens
gucugugggggauugguuccaguuaccccuauagauaccaaaaucugcagaugcucaagucccu

SEQ ID NO: 147108 - RNA, 64 nt, Homo Sapiens
aucauucauaaaucagauaauagcuuucuuagacauaccaaaccaguucauuuuauguuuuaua

SEQ ID NO: 147109 - RNA, 64 nt, Homo Sapiens
uuuaaaguuguuugaaauccgcucccccaaucugauaccaaaugccuaaauuuuauuauuuguu

SEQ ID NO: 147110 - RNA, 64 nt, Homo Sapiens
aaguuucuaagugauuaaugaaaaaugugaaguuauaccaaauaaaauaaaauuucuauauacc

SEQ ID NO: 147111 - RNA, 64 nt, Homo Sapiens
ugugaaguuauaccaaauaaaauaaaauuucuauauaccaaaaacuacugugcugcauuaagaa

SEQ ID NO: 147112 - RNA, 64 nt, Homo Sapiens
aaaaggaaauaaaaugcacauaucuaaugcagugauaccaaaaacagcauuguacuggaagugc

SEQ ID NO: 147113 - RNA, 64 nt, Homo Sapiens
caggcaaaaacauuacaagaccaggauuacccuaauaccaaagcucccaaaucauuuugugagg

SEQ ID NO: 147114 - RNA, 64 nt, Homo Sapiens
ugaaagaggccaucauagcugacaaauacugcuaauaccaaaaguagauuaagaaaaaacagaa

SEQ ID NO: 147115 - RNA, 64 nt, Homo Sapiens
uccaguuaaauuggagcacugaacguucagaugcauaccaaauuaugcauggguccuaaucaca

SEQ ID NO: 147116 - RNA, 64 nt, Homo Sapiens
cuucagcuugaaagcuuuuuuuuaaaaggaaaagauaccaaaugccugcugcuaccacccuuuu

SEQ ID NO: 147117 - RNA, 64 nt, Homo Sapiens
uucaaugaucauguguuuuguccuccuaaacaguauaccaaaguuuguuuuuauaguugaggau

SEQ ID NO: 147118 - RNA, 64 nt, Homo Sapiens
cuuuugaauaauuuccagauggauuucuguagccauaccaaagccaggguguuuucauucaugc

SEQ ID NO: 147119 - RNA, 64 nt, Homo Sapiens
aaacagaagaaauuaaucuuuuaguuaguugaacauaccaaagcagaggacuggaaucuguuug

SEQ ID NO: 147120 - RNA, 64 nt, Homo Sapiens
cuugaauaguaggauuuuaaagggcauugauagcauaccaaacaaaaggcaaaauaaagugacc

SEQ ID NO: 147121 - RNA, 64 nt, Homo Sapiens
ugccaauagcaaaugaaguuaugggugacuugaaauaccaaaaccugaggagugggcaauggug

SEQ ID NO: 147122 - RNA, 64 nt, Homo Sapiens
aucuccaggaaaaaaaaaaaaaaacccaauuuggauaccaaauuaaucaacuaauuugagcuau

SEQ ID NO: 147123 - RNA, 60 nt, Homo Sapiens
cauccuauugcaaagguuccaacuguauauauucccaauagcaacguagcuucuaccaug

SEQ ID NO: 147124 - RNA, 60 nt, Homo Sapiens
auugaaauguagcaauaaugucuuuugaauauucccaagcccaugaguccuugaaaauau

SEQ ID NO: 147125 - RNA, 60 nt, Homo Sapiens
uuacgcauccaauguggguugucacuuguuauucccaaguacuauuauuccauacuacua

SEQ ID NO: 147126 - RNA, 60 nt, Homo Sapiens
gcaaggugcagugcuagaauauggugguugauucccaaacagagcaguuaacuuuacucu

SEQ ID NO: 147127 - RNA, 60 nt, Homo Sapiens
uucauuuguagauacugaaccugucauagaauucccaaauauuuaaauaugcuaacauca

SEQ ID NO: 147128 - RNA, 60 nt, Homo Sapiens
aacuguacuuuauacaauucguuguuucccauucccaacaucuguauaccccuucaagca

SEQ ID NO: 147129 - RNA, 60 nt, Homo Sapiens
uacuuaacacagauguuuuucgcccugcauauucccaacaagugguacauaaauuuaucu

SEQ ID NO: 147130 - RNA, 60 nt, Homo Sapiens
guuauggucaaucccaaaagucaccacuccauucccaacuagacauuaccaaagugaccu

SEQ ID NO: 147131 - RNA, 60 nt, Homo Sapiens
gcuucucauccccagucccaaugcacauccauucccaagaaaugcuuugucuucagccuc

SEQ ID NO: 147132 - RNA, 64 nt, Homo Sapiens
agaggcgcugggaagauggcuggugaggagcuuaacagaggaaccucaagaagauucugaaaau

SEQ ID NO: 147133 - RNA, 64 nt, Homo Sapiens
cgcgagaggcaucccuggcgcugucucccacuggacagaggaggcuggccauggggcccagggg

SEQ ID NO: 147134 - RNA, 64 nt, Homo Sapiens
uaacagaaggcaaaggccaggauuggggacagggacagaggagggaacucacacaugcucccag

SEQ ID NO: 147135 - RNA, 64 nt, Homo Sapiens
caaaugguccagcagucguuggccacuuuuucuaacagaggaaacauuccccggcuccacccua

SEQ ID NO: 147136 - RNA, 64 nt, Homo Sapiens
acuccgucucacaaaaaaaacuccagccugggugacagaggaaggcuaaaauugugccacugca

SEQ ID NO: 147137 - RNA, 64 nt, Homo Sapiens
gugguggccacaggagcugaucuccugcgaucccacagaggacuuugccuuggauuacuaagca

SEQ ID NO: 147138 - RNA, 64 nt, Homo Sapiens
aggagcaagcuggcgccgacgaggaagcucaggcacagaggacguagcagaggagccggacaca

SEQ ID NO: 147139 - RNA, 64 nt, Homo Sapiens
cucaggugaguacaaagagucagaggagccggacacagaggaagcccaugcugccacagguuag

SEQ ID NO: 147140 - RNA, 64 nt, Homo Sapiens
gccacaaaagaaaagacuuguaauauuuuuauauacagaggaaaucuguaacagguauuuuguu

SEQ ID NO: 147141 - RNA, 64 nt, Homo Sapiens
uaacagguauuuuguuucuuuuaaagcaagcaacacagaggaauuuauaccucaaacuaucugg

SEQ ID NO: 147142 - RNA, 64 nt, Homo Sapiens
gcuuccccaucgccuucugguucuggggagggacacagaggacaagagcggcuuccccauugcc

SEQ ID NO: 147143 - RNA, 64 nt, Homo Sapiens
gcuuccccaucgccuucugguucuggggagggacacagaggacgaggauggcuuccccauugcc

SEQ ID NO: 147144 - RNA, 64 nt, Homo Sapiens
gcuuccccauugccuucuggcagcugcaguuagcacagaggaugucagccugugaacugccagg

SEQ ID NO: 147145 - RNA, 64 nt, Homo Sapiens
uugaccugggggcaaacuuuccucuugaaugggaacagaggaggcauuauauauucuaguuaga

SEQ ID NO: 147146 - RNA, 64 nt, Homo Sapiens
aucuucagaaaagcagaauuugguucaacuguugacagaggacacaaauacguuguuccagagc

SEQ ID NO: 147147 - RNA, 64 nt, Homo Sapiens
uccagaauguaaggaucaucuacagaggagacugacagaggaauuggaagucaaagccgucggu

SEQ ID NO: 147148 - RNA, 64 nt, Homo Sapiens
cugacagaggaauuccagaacaaagccgucgguuacagaggagaguaaaaccugggcuggaagu

SEQ ID NO: 147149 - RNA, 64 nt, Homo Sapiens
accagacauuaugggccugguaaauauuaacaucacagaggaagcaaacugucccaaauccuga

SEQ ID NO: 147150 - RNA, 64 nt, Homo Sapiens
aaccagucuucugaaggucaaaggaucuuccaaaacagaggaccguaucaugugcuuggcacuc

SEQ ID NO: 147151 - RNA, 64 nt, Homo Sapiens
gcagccuucuccauaucuccgguaccuuccauacacagaggagugugcuccgccaugguguccc

SEQ ID NO: 147152 - RNA, 64 nt, Homo Sapiens
gggcuggcucccccuccccaacugccccacggagacagaggaaagaguuuuuccucccagugag

SEQ ID NO: 147153 - RNA, 64 nt, Homo Sapiens
uuuucuggaauuucaaaccagccauccucaaacgacagaggagcgguuaaacggugcccauccu

SEQ ID NO: 147154 - RNA, 64 nt, Homo Sapiens
cagcccccagcugcauggaagaugaagccaccccacagaggauggccccacagaccccacagag

SEQ ID NO: 147155 - RNA, 64 nt, Homo Sapiens
aagccaccccacagaggauggccccacagaccccacagaggaugaugcugaugacuuggagcag

SEQ ID NO: 147156 - RNA, 64 nt, Homo Sapiens
gccuccugagggaggggcagggaagaucugggggacagaggaaguggucagaggaagccagcag

SEQ ID NO: 147157 - RNA, 64 nt, Homo Sapiens
uucccccacacccagaucacagacaauaauuaacacagaggacucaagccuguuccggugaugu

SEQ ID NO: 147158 - RNA, 64 nt, Homo Sapiens
ggggaggaaagagcuuccagggggcgaacgcagcacagaggaagaggccugcuccacuugucug

SEQ ID NO: 147159 - RNA, 64 nt, Homo Sapiens
cugcuccacuugucugggaaccugggcaggaggcacagaggaagccaaggccuggagcugcagg

SEQ ID NO: 147160 - RNA, 64 nt, Homo Sapiens
cagagaagguuuggguguccaaaagccagguuccacagaggacauuucucugaggacaagagaa

SEQ ID NO: 147161 - RNA, 64 nt, Homo Sapiens
ucggcauuuguuucuuucuccuuucauauuuuaaacagaggauagggguuauugguguaaggua

SEQ ID NO: 147162 - RNA, 64 nt, Homo Sapiens
cagagagggagagagagacaagagagggagagaaacagaggagagagagagagacagaggaggc

SEQ ID NO: 147163 - RNA, 64 nt, Homo Sapiens
cagagagggagagaaacagaaugaggagagagagacagaggagguggggagaggggagagagau

SEQ ID NO: 147164 - RNA, 64 nt, Homo Sapiens
ugugucucccuccaaggcccgugcaggagaacagacagaggaaagugggcuuuuuaccaccacu

SEQ ID NO: 147165 - RNA, 64 nt, Homo Sapiens
cccugcagaaaguuccaucaugcuccgagcucagacagaggaagcauccugcccggaaugccag

SEQ ID NO: 147166 - RNA, 64 nt, Homo Sapiens
cauguacucauugucagauguucccucugagagcacagaggaggcaaaagcuucugugggaugu

SEQ ID NO: 147167 - RNA, 64 nt, Homo Sapiens
gcuucugugggaugugcuagucggcuaaagcuucacagaggagguggcaauugaaaaugagucc

SEQ ID NO: 147168 - RNA, 64 nt, Homo Sapiens
gagaugaccuauauaaaucagagcaugcauauauacuucacaaaguguguaugaguuucuaugu

SEQ ID NO: 147169 - RNA, 64 nt, Homo Sapiens
acuauuugcauaagacaaaacuuacuucauuaauacuucacaauugguccuugaauaaaauugu

SEQ ID NO: 147170 - RNA, 64 nt, Homo Sapiens
ugcagaccagaaugaguucaacucauucugugcaacuucacaggggguuuauuagaaugcucag

SEQ ID NO: 147171 - RNA, 64 nt, Homo Sapiens
uucugaauuauggcagaaaggaaaaauaaaacauacuucacauuagaacacagaaucauuuaca

SEQ ID NO: 147172 - RNA, 64 nt, Homo Sapiens
uaugacaaaaccgaaaaagcucacuuagggucugacuucacagcgaccugcaacgggguggcau

SEQ ID NO: 147173 - RNA, 64 nt, Homo Sapiens
uacucugcaaagggcaaauugucaggaccaaauaacuucacagcuaugcucaguuccacagaau

SEQ ID NO: 147174 - RNA, 64 nt, Homo Sapiens
gcaaguuuuuucuggucugaaaacaagguguacaacuucacaaagcagacaauguguuuggaag

SEQ ID NO: 147175 - RNA, 64 nt, Homo Sapiens
uggaaucuuguuuaaggcuggauggcucuguacaacuucacagaacaaugacauggcaacaaag

SEQ ID NO: 147176 - RNA, 64 nt, Homo Sapiens
guauauugggucuuuguacauuauguuugcuaaaacuucacaauggaaccaaaauguauaaaug

SEQ ID NO: 147177 - RNA, 64 nt, Homo Sapiens
gcaaacgccuuuuauucuauauguuuauguagguacuucacauuguuuaaucuucucgauguag

SEQ ID NO: 147178 - RNA, 64 nt, Homo Sapiens
auugacuuauuuuauuggacucuuaccgcauaccacuucacacuuguuuuauuuucuuuaguuu

SEQ ID NO: 147179 - RNA, 64 nt, Homo Sapiens
guagcuuuuuagacuguuggucaaagaacauucuacuucacaguaauagcucuaucagccacag

SEQ ID NO: 147180 - RNA, 64 nt, Homo Sapiens
gaagagugugaaaugaaaauauugccuugccauuucugaacaaaagaaaacugaauuguaaaga

SEQ ID NO: 147181 - RNA, 64 nt, Homo Sapiens
caagcaauuuagacuuaaguggugcuuugugguaucugaacaauucauaacauguaaauaaugu

SEQ ID NO: 147182 - RNA, 64 nt, Homo Sapiens
ccaccaugccaaagcuaugugauuuacugaagcuucugaacauguagagaugucauagccugaa

SEQ ID NO: 147183 - RNA, 64 nt, Homo Sapiens
aucugcagacauuuuugguuggaugauucgcuuaucugaacagcaagcagugggucucaacugg

SEQ ID NO: 147184 - RNA, 64 nt, Homo Sapiens
ugucuccauuuuucaaguguguuucccuuucuauucugaacaacgagcuuaaacucuaauagcu

SEQ ID NO: 147185 - RNA, 64 nt, Homo Sapiens
ccuuguaaaguuccauuguauaacuuuauuuuggucugaacaaauaugugacugaauguaagau

SEQ ID NO: 147186 - RNA, 64 nt, Homo Sapiens
cacaguggagagguuaaucugaggguuuaggaggucugaacacaggccuugcccuaagcuaccu

SEQ ID NO: 147187 - RNA, 64 nt, Homo Sapiens
acaaaaguugccagaguuggccgccugcacccacucugaacauguuaggcauuuccucuuuucc

SEQ ID NO: 147188 - RNA, 64 nt, Homo Sapiens
uuuccuaaauggaaaaugggaaggagauacugucucugaacaaaaauagcuggaaaaacacaua

SEQ ID NO: 147189 - RNA, 64 nt, Homo Sapiens
uucuuaccaaugacuucgcuuuguuccucgugccucugaacagacugcugagauacccaaucaa

SEQ ID NO: 147190 - RNA, 64 nt, Homo Sapiens
acccacaaagcaucaaaagacucacucacaaacuucugaacacaaacuccauggaugaaagcug

SEQ ID NO: 147191 - RNA, 64 nt, Homo Sapiens
guauaugcuuguaaaaauugauucuguguguuccucugaacaaagcggagaaaaugaugauacc

SEQ ID NO: 147192 - RNA, 64 nt, Homo Sapiens
gaggguaggcccuuaggaaauuuauuuaggaaagucugaacacguuaucacuugguuuucugga

SEQ ID NO: 147193 - RNA, 64 nt, Homo Sapiens
aguauaugcuuagcuguaagugacaaguauuuuuucugaacagaaguuuacuuagaaauaccau

SEQ ID NO: 147194 - RNA, 64 nt, Homo Sapiens
gaauaacugauauaucuuuauuacaaacugaaagagagaagauuaucaaacaaaugaaacaagu

SEQ ID NO: 147195 - RNA, 64 nt, Homo Sapiens
aguaaaggaagaaagaagguaucuggaaagaaauagagaagaacuaguaaaaacgguugaaaag

SEQ ID NO: 147196 - RNA, 64 nt, Homo Sapiens
agucuguggcccagacaggaaacugacaaagagaagagaagacacaaggucaagucuggcuguc

SEQ ID NO: 147197 - RNA, 64 nt, Homo Sapiens
agacaagucuguggcccagacugucaacugacaaagagaagagagagcccaaggucaagucugg

SEQ ID NO: 147198 - RNA, 64 nt, Homo Sapiens
ugaagagggggagguacgguccuguuccccacacagagaagagagcaugaaggaugcuucaugc

SEQ ID NO: 147199 - RNA, 64 nt, Homo Sapiens
agaaaaaugaagaaaaguaaaggaagaaagggagagagaagaaagaaauaaaaagaagagaggg

SEQ ID NO: 147200 - RNA, 64 nt, Homo Sapiens
cuguaguauuugcugugggcaggauccacaguuaagagaagaccaagacuucacuaaaaugacc

SEQ ID NO: 147201 - RNA, 64 nt, Homo Sapiens
cuaucacagugcacauaaggauguuccagcucccagagaagacuuccagcagaaaccagauugg

SEQ ID NO: 147202 - RNA, 64 nt, Homo Sapiens
uuuauauuaugaaauauguaggaaugggcuccagagagaagacaccuauuuaaucuuaagugua

SEQ ID NO: 147203 - RNA, 64 nt, Homo Sapiens
aaagcuuacacuggugacaucauuaaacuuuucuagagaagacaguuuguacaucguuuuuuuc

SEQ ID NO: 147204 - RNA, 64 nt, Homo Sapiens
auaacaaaaauggaagcaaacggaauucaucaucagagaagaaacuuucacuuuuucuuuuuua

SEQ ID NO: 147205 - RNA, 64 nt, Homo Sapiens
ccagaucugaccuguuuauuuuagagauucuuucagagaagaaaauauuuuugaccaguuccuu

SEQ ID NO: 147206 - RNA, 64 nt, Homo Sapiens
ccacuuacccaagcuuuagaaaugaacauugaugagagaagaugguuuauuucacuuuucauua

SEQ ID NO: 147207 - RNA, 64 nt, Homo Sapiens
gacuguaugugacaauuaccaaugaagcagaaguagagaagaaauacuaaagugacacaaagag

SEQ ID NO: 147208 - RNA, 64 nt, Homo Sapiens
ggcucugaaagaaaggagggcauaaacauagcccagagaagagacugacaaaaaguccagaacc

SEQ ID NO: 147209 - RNA, 64 nt, Homo Sapiens
cuuauauuuacaucuaguaugaauacagacuauuagagaagaucuuguacagauagggauuaag

SEQ ID NO: 147210 - RNA, 64 nt, Homo Sapiens
ugaggagccugucuuuuaauuaccaggaugaggaagagaagaaauaaagcuuuugggcacugug

SEQ ID NO: 147211 - RNA, 64 nt, Homo Sapiens
uuuuggacuuaacaacauacaagauagguagcccagagaagaaggagcaccugcuucaugaagg

SEQ ID NO: 147212 - RNA, 64 nt, Homo Sapiens
ggacaaauuugguugugaaggagauucuuggcagagagaagaggggagccaucacugcuuggaa

SEQ ID NO: 147213 - RNA, 64 nt, Homo Sapiens
gaagauccaaguugcauuaucauuugaauuggaaagagaagaguaaaagagugucauauuccag

SEQ ID NO: 147214 - RNA, 64 nt, Homo Sapiens
uaaagcaagaaaaucugaaguacugugguaauauagagaagaauuuggacuuuguuaaauauuu

SEQ ID NO: 147215 - RNA, 64 nt, Homo Sapiens
gaggaaguguucacuuuuuuguuaaauguagaagagagaagaaauuuuuuuaaacaugauucua

SEQ ID NO: 147216 - RNA, 64 nt, Homo Sapiens
cauuaaaaaaaaucuucugauuuuuaauuaccauagagaagauaacuagaagggcacaacuuuu

SEQ ID NO: 147217 - RNA, 64 nt, Homo Sapiens
cuuguauuugcagcuagaggugagucaaauguuaagagaagaaacuacgauccaucucccuuug

SEQ ID NO: 147218 - RNA, 64 nt, Homo Sapiens
ccccggagcuccucgcucuggcaggauggaagacagagaagaccggguccaggagaacugagac

SEQ ID NO: 147219 - RNA, 64 nt, Homo Sapiens
aaugauuugguuaaagucacagaaacugaagaccagagaagagagucuuucaauuuacagauca

SEQ ID NO: 147220 - RNA, 64 nt, Homo Sapiens
auaaagaaggcuaauauauaaaaaaaaaaaaaggagagaagaaagagacccugucucaaaaaaa

SEQ ID NO: 147221 - RNA, 64 nt, Homo Sapiens
uggagagcagcaauuggagcgugcacccagcugaagagaagaaagcaggguccucuguaugagu

SEQ ID NO: 147222 - RNA, 64 nt, Homo Sapiens
caagucuuacauagaaaaaagacugaaauguauaagagaagaaccaaaagguuagucuucaaua

SEQ ID NO: 147223 - RNA, 64 nt, Homo Sapiens
uuacagccauuucuaaaauggcagcuucaguucuagagaagaaagaacaacaucagcaguaaag

SEQ ID NO: 147224 - RNA, 64 nt, Homo Sapiens
ucaugcagcaauuaugagaggcuaggucauccaaagagaagacccuaucaauguagguugcaaa

SEQ ID NO: 147225 - RNA, 64 nt, Homo Sapiens
aaaugguacuguccacagugcacugcugcaaugaagagaagaggcagcagacacaaauaaaggu

SEQ ID NO: 147226 - RNA, 64 nt, Homo Sapiens
ucagcugaagauuuuauauaggacuuuaaaaagaagagaagagaaagaagaaacaaugcauuuc

SEQ ID NO: 147227 - RNA, 64 nt, Homo Sapiens
ggugggagauuuagacaccugaaacugggcguggagagaagagccguugcuguuuguuuuuugg

SEQ ID NO: 147228 - RNA, 64 nt, Homo Sapiens
uccugagaccacgggcaaagcucuucauuuugagagagaagaaaaacuguuuggaaccacacca

SEQ ID NO: 147229 - RNA, 64 nt, Homo Sapiens
guuaaaauuuaaaaaugcauuuuuaacaugucagagagaagagaugaacaccaaauuuaaagau

SEQ ID NO: 147230 - RNA, 64 nt, Homo Sapiens
ccauaaaauaaacaccuccccuaagaacuccaugagagaagaugaagacaaauuguccgaagug

SEQ ID NO: 147231 - RNA, 64 nt, Homo Sapiens
ccuguuaauuuauaauguauuuuaauaauaucaaagagaagaugauauguauuuaagauguaca

SEQ ID NO: 147232 - RNA, 64 nt, Homo Sapiens
accucaaguaauaggcauuuguaguuuuguauacagagaagaaauuuugggcguaagaccaaau

SEQ ID NO: 147233 - RNA, 64 nt, Homo Sapiens
ggcccuuaauccaauaugacugguguuccuuauaagagaagauagggcgggcaugguggcucac

SEQ ID NO: 147234 - RNA, 64 nt, Homo Sapiens
acucugucucaaaaaaaaaaaaaaaaaggaagaaagagaagauagagacacaggggagaaugcc

SEQ ID NO: 147235 - RNA, 64 nt, Homo Sapiens
ggagccauacucugauaugacagaugagaaagggagagaagacuuuucucuggcagacuaucag

SEQ ID NO: 147236 - RNA, 64 nt, Homo Sapiens
aaauauguuucucaagcaaccugcaucuuuuaugagagaagaaagagugagagaagaauugccu

SEQ ID NO: 147237 - RNA, 64 nt, Homo Sapiens
gcaaccugcaucuuuuaugagagaagaaagagugagagaagaauugccucuggacuaucaucaa

SEQ ID NO: 147238 - RNA, 64 nt, Homo Sapiens
uugagugaagcagcacgcgacuauauuuauaagaagagaagaucaaacaagcuccaucccuuuu

SEQ ID NO: 147239 - RNA, 64 nt, Homo Sapiens
aguccaaagagugugugggcccguuuguuuagguagagaagacaucagauccuuacuugccgag

SEQ ID NO: 147240 - RNA, 64 nt, Homo Sapiens
cuugugccagguggcaccaguugguuccagagagagagaagaugugcagaauucuuuugguucu

SEQ ID NO: 147241 - RNA, 64 nt, Homo Sapiens
ccaagcuuguuucccugcugugugguacccuggcagagaagagaguuaccuuggcguguguccc

SEQ ID NO: 147242 - RNA, 64 nt, Homo Sapiens
gaagcacucugcuggcgggaguaggaaacagaaaagagaagaaaggguuccagggacuguaccu

SEQ ID NO: 147243 - RNA, 64 nt, Homo Sapiens
cgggaugcaaggagcugccuggguugacuggguuagagaagaaccugaaacagucuugagccug

SEQ ID NO: 147244 - RNA, 64 nt, Homo Sapiens
ccgaaccuuaagacgccagaugaauucacugugaagagaagaacucaggagacagaggcuuuuu

SEQ ID NO: 147245 - RNA, 64 nt, Homo Sapiens
auggaaagcagcacacuccgccagugacagaaguagagaagagagugauccguguaucuucucc

SEQ ID NO: 147246 - RNA, 64 nt, Homo Sapiens
ucccuuaccagucccacccuaguauuuuggauucagagaagagccaugaaaucuuuggugauaa

SEQ ID NO: 147247 - RNA, 64 nt, Homo Sapiens
gggaaguagggcagugcaugaguuaaccugcaauagagaagaaaaaaaacugccuacaggccau

SEQ ID NO: 147248 - RNA, 64 nt, Homo Sapiens
aacugccuacaggccauaguucaaaaaaaaaaaaagagaagaaaggugacagaacaagacuguc

SEQ ID NO: 147249 - RNA, 64 nt, Homo Sapiens
gggggaggggucccggauuugcucugugacuuuaagagaagaagcccacugcaguuccuuccgu

SEQ ID NO: 147250 - RNA, 64 nt, Homo Sapiens
aagggaggccauaucuacaaacccugaugagaaaagagaagaggucaugccuugggccuagaau

SEQ ID NO: 147251 - RNA, 64 nt, Homo Sapiens
uuuuguuuuaacuauugucaggagauugggcuaaagagaagacgacgagaguaaggaaauaaag

SEQ ID NO: 147252 - RNA, 64 nt, Homo Sapiens
cacacaaaugcuaaggcagaauuuugagggugggagagaagaaaagggaaagaagcugaaaaug

SEQ ID NO: 147253 - RNA, 64 nt, Homo Sapiens
uauggcucagggaucugugucccuguuuccccucagagaagagcaauguugugacugauuauaa

SEQ ID NO: 147254 - RNA, 64 nt, Homo Sapiens
uuguugcaaaagguguauuagcuuaauggagaacagagaagaucacuagugagauuuacaugau

SEQ ID NO: 147255 - RNA, 64 nt, Homo Sapiens
aagaauguagaccagcuuaugaaagugguugcauagagaagagucuagcacuguuaaucuagaa

SEQ ID NO: 147256 - RNA, 64 nt, Homo Sapiens
auuggggcuggaguguuccgucacucagcagcaaagagaagagccgugggccauggggaggacu

SEQ ID NO: 147257 - RNA, 64 nt, Homo Sapiens
gaaaagaaucacagucauauauugaauggcguuuagagaagauaucaauuaaagagaggagaga

SEQ ID NO: 147258 - RNA, 64 nt, Homo Sapiens
gaccacuggagaccuagaaaguuaaaccaucuaaagagaagaaagaaagaucaacucaccugca

SEQ ID NO: 147259 - RNA, 64 nt, Homo Sapiens
ccugggcgaaagagcgacucugucuccaaaaaaaagagaagaggagaggacacagagacacaca

SEQ ID NO: 147260 - RNA, 64 nt, Homo Sapiens
aaaaaagagaagaggagaggacacagagacacacagagaagaaagccauguggcggcagaggca

SEQ ID NO: 147261 - RNA, 64 nt, Homo Sapiens
ccucucccagggcggaaacagcauuugccuucugagagaagagacuagcaaaaagcugcagaga

SEQ ID NO: 147262 - RNA, 64 nt, Homo Sapiens
caagggugguuaagugacacauagaacuuuucuaagagaagacagacaaguugacaggcaugcc

SEQ ID NO: 147263 - RNA, 64 nt, Homo Sapiens
ugcuucucuuucuaaaaaaaaaaaaaaaaaagaaagagaagaaagaagugauuccuacccccua

SEQ ID NO: 147264 - RNA, 64 nt, Homo Sapiens
acuuucuuagcucaagagagaggcugagaaaugcagagaagaauaagacauaaaauagcuccga

SEQ ID NO: 147265 - RNA, 64 nt, Homo Sapiens
cuuaaauguguaagucacccccaccaaaaacaaaagagaagaaaaagaauagaaagaauuaucc

SEQ ID NO: 147266 - RNA, 64 nt, Homo Sapiens
uucuacucauucaaagcacauuguagauauucagagagaagaacaaauggcuggcuuggcaaau

SEQ ID NO: 147267 - RNA, 64 nt, Homo Sapiens
cuggggcucuccgugguguucuggacccagccccuggagacaccauucacuuuuacugcuuugu

SEQ ID NO: 147268 - RNA, 64 nt, Homo Sapiens
ccauggcuggucaugagagcaaaccguaguccccuggagacagcgacuccagagaaccucuugg

SEQ ID NO: 147269 - RNA, 64 nt, Homo Sapiens
ccacucaacacacguccucaccagucaccccaaauggagacacucgcagaccugcaguucucag

SEQ ID NO: 147270 - RNA, 64 nt, Homo Sapiens
ccaaaccagcacccuccuuugugcucugagagguuggagacaucugguccaccccauugccccu

SEQ ID NO: 147271 - RNA, 64 nt, Homo Sapiens
gcccugucgguuuauucacucuguuuucccuccuuggagacaggaguugcaguuuuuuccuagu

SEQ ID NO: 147272 - RNA, 64 nt, Homo Sapiens
gaggcaggcacugccaaaacguugcagugucugcuggagacauugguuuucccaucucaggugu

SEQ ID NO: 147273 - RNA, 64 nt, Homo Sapiens
cuggaggucccaaguagcucuaugccugcaaucauggagacacaggcagacagauaagcuucau

SEQ ID NO: 147274 - RNA, 64 nt, Homo Sapiens
ugucugccugggaacacucaguagggagacacuuuggagacaggaggugaugaaccuuuuuaug

SEQ ID NO: 147275 - RNA, 64 nt, Homo Sapiens
agcaguccuguggugcaguuccugaaaggacguguggagacagcgugagguggacagcccagac

SEQ ID NO: 147276 - RNA, 64 nt, Homo Sapiens
ggggcccugcuggggggauggagacaccaccuaguggagacauuuaggccauggaggaaaugag

SEQ ID NO: 147277 - RNA, 64 nt, Homo Sapiens
ucauaucaauucauaugccauuaacaaucuaucuuggagacauucugcaccuugcuuuuuuccc

SEQ ID NO: 147278 - RNA, 64 nt, Homo Sapiens
guuucaccauguuggccagguuuuguauuuuuacuggagacaggcaccaccacacccagcuauu

SEQ ID NO: 147279 - RNA, 64 nt, Homo Sapiens
gaaaaagugaaggcuggguuuuuccccucuaaucuggagacaagcugcugcucucguacuaacu

SEQ ID NO: 147280 - RNA, 64 nt, Homo Sapiens
caugaaugacaaugagauaacauacagaugucaguggagacaaaguuguggguuccuccuccca

SEQ ID NO: 147281 - RNA, 64 nt, Homo Sapiens
gagggaguaagucguaggagcauggaggaguggguggagacaaggaaauucccaacucgguucu

SEQ ID NO: 147282 - RNA, 64 nt, Homo Sapiens
gccuuugagccccacccuuguguuuguguugucguggagacaaguagucugugccugaagucug

SEQ ID NO: 147283 - RNA, 64 nt, Homo Sapiens
ccacccccaguugaauaauggcacaguccagaaauggagacauccauacaaggugugaauuuga

SEQ ID NO: 147284 - RNA, 64 nt, Homo Sapiens
ggcaagcauuaguggcuucaccacuggaucuucauggagacaugucaucagcuuuuccucuuug

SEQ ID NO: 147285 - RNA, 64 nt, Homo Sapiens
uauugggucuuucauaaauaacaugagugguuucuggagacauuuaagauugucagcaaacuug

SEQ ID NO: 147286 - RNA, 64 nt, Homo Sapiens
ugccuucucuccagacaauaagacaguucacaucuggagacaucagccuuugguaccuaauucu

SEQ ID NO: 147287 - RNA, 64 nt, Homo Sapiens
guguuuuuuuucuucugcuaugugacuugcaucguggagacagggcauuugaguuuauaucucu

SEQ ID NO: 147288 - RNA, 64 nt, Homo Sapiens
agaauuuuacuguguuucuuuugguuccauuguuuggagacauuccugggcacaguuugguccg

SEQ ID NO: 147289 - RNA, 64 nt, Homo Sapiens
aguucucauccuccauccuucuguacuuguaaaguggagacagcgaucauccagagccucaguu

SEQ ID NO: 147290 - RNA, 64 nt, Homo Sapiens
accacaggaaugggccaaggaggacccaaggggauggagacagguggcagaaagaaaaaucaag

SEQ ID NO: 147291 - RNA, 64 nt, Homo Sapiens
gaauuuuaugauugguuuauaugguauugcaguguggagacaugugagguagcuacgugauuaa

SEQ ID NO: 147292 - RNA, 64 nt, Homo Sapiens
gaguuuuauugagguagcuaacgguguugcaauguggagacaugugaggcagccacuugauuga

SEQ ID NO: 147293 - RNA, 64 nt, Homo Sapiens
uuuagcaggcccccccaccuuuuuuuuuuguuuuuggagacagagucuugcuuuguugccaggc

SEQ ID NO: 147294 - RNA, 64 nt, Homo Sapiens
gccaccgugccuggccaggccccuucucuuuuaauggagacagggucuugcacuaucacccagg

SEQ ID NO: 147295 - RNA, 64 nt, Homo Sapiens
gugacucaaaaauugagcccuggccaggaaaauguggagacaguucuucuccuccacugcucac

SEQ ID NO: 147296 - RNA, 64 nt, Homo Sapiens
ccaggaacccagacuggacuucagucucccuccauggagacaaaggcuucccagagccaccaaa

SEQ ID NO: 147297 - RNA, 64 nt, Homo Sapiens
ucccuugugaaugucccuuagggaggcaccagauuggagacagaugugcuaucuccuaacagag

SEQ ID NO: 147298 - RNA, 64 nt, Homo Sapiens
cuuugaaccacagcuuuauuaugguccuuuacacuggagacagacacagagacacuguucagaa

SEQ ID NO: 147299 - RNA, 64 nt, Homo Sapiens
ccauaauguucuuuuuuauguaaaaagaagaacuuggagacauuaacaugaaaaagucuuuuau

SEQ ID NO: 147300 - RNA, 64 nt, Homo Sapiens
guaccauacugacccaggcugggggcagguguguuggagacaggcuggucaaagaggugacaau

SEQ ID NO: 147301 - RNA, 64 nt, Homo Sapiens
ccucaccuucucuggcccuuaggaucuccccauuuggagacagagccauuuggauauuuucccc

SEQ ID NO: 147302 - RNA, 64 nt, Homo Sapiens
aagaggcaucgcauggacguucucuggucuguaguggagacaagcaguuaaccuagcaccaucc

SEQ ID NO: 147303 - RNA, 64 nt, Homo Sapiens
cauuaccagcagggagcagacuuaccuccgaagauggagacaggugacugagagcugcaggccu

SEQ ID NO: 147304 - RNA, 64 nt, Homo Sapiens
caggacuaauggauacuguaccuuucuugauuuuuggagacaccguagaaagggaaaccccaac

SEQ ID NO: 147305 - RNA, 64 nt, Homo Sapiens
uuuuuggcuuaucacagcacgacugaguauagacuggagacagguguccacguuacugaggauu

SEQ ID NO: 147306 - RNA, 64 nt, Homo Sapiens
gagggaaguguggacauggaauaaaaagccauuuuggagacaguggaccugguuugaacaaaac

SEQ ID NO: 147307 - RNA, 64 nt, Homo Sapiens
accacuggggggccuguuuagugugaauaaguccuggagacagggagaacgggaugauacaaga

SEQ ID NO: 147308 - RNA, 64 nt, Homo Sapiens
guccuggaggaggagaggaccccucccaaaggacuggagacaaaacccucugcuuccuuggguc

SEQ ID NO: 147309 - RNA, 64 nt, Homo Sapiens
agaaugggcaagaaggaucaggucagccacucccuggagacacagccuucuggcugggacugac

SEQ ID NO: 147310 - RNA, 64 nt, Homo Sapiens
agagagcagaagaguagcuaggcagaugcagagauggagacaugagacucagugcagugggcag

SEQ ID NO: 147311 - RNA, 64 nt, Homo Sapiens
ugccucacauuucccacuugagguugaggcguacuggagacaacaccucagaccaucugaaccc

SEQ ID NO: 147312 - RNA, 64 nt, Homo Sapiens
uuuuuuggcauuccaccuccuagggauauaauucuggagacauggaguguuacugaucauaaaa

SEQ ID NO: 147313 - RNA, 64 nt, Homo Sapiens
ggccugugcuuuucagauaguauacucuccuguuuggagacagaggaagaaccaggucagucug

SEQ ID NO: 147314 - RNA, 64 nt, Homo Sapiens
uucaggucaugccaaaagcucucugguuguaaccuggagacauguggaggggaauggcgauggg

SEQ ID NO: 147315 - RNA, 64 nt, Homo Sapiens
ccaccaacccaaagacagcugguggguuuccccuuggagacaauccugcguuugccugggccgg

SEQ ID NO: 147316 - RNA, 64 nt, Homo Sapiens
aaauucacuuucugccguuuuaaauggagacagauggagacacccuuucuuuuguaaauaucua

SEQ ID NO: 147317 - RNA, 64 nt, Homo Sapiens
uggagacaccaaauucacuuuaaauaucuauaaauggagacagauugcucaugacuuucuuuug

SEQ ID NO: 147318 - RNA, 64 nt, Homo Sapiens
cacggaccagggaggccaaggcccccggaaggcguggagacaccgcggcagccuggauccaggg

SEQ ID NO: 147319 - RNA, 64 nt, Homo Sapiens
uuugaaagcagcucccuaagaugacagguuccucuggagacauugcggauccaaagacccagga

SEQ ID NO: 147320 - RNA, 64 nt, Homo Sapiens; identical to SEQ ID NO: 88665

SEQ ID NO: 147321 - RNA, 64 nt, Homo Sapiens; identical to SEQ ID NO: 88666

SEQ ID NO: 147322 - RNA, 64 nt, Homo Sapiens; identical to SEQ ID NO: 88667

SEQ ID NO: 147323 - RNA, 64 nt, Homo Sapiens; identical to SEQ ID NO: 88668

SEQ ID NO: 147324 - RNA, 64 nt, Homo Sapiens; identical to SEQ ID NO: 88669

SEQ ID NO: 147325 - RNA, 64 nt, Homo Sapiens; identical to SEQ ID NO: 88670

SEQ ID NO: 147326 - RNA, 64 nt, Homo Sapiens; identical to SEQ ID NO: 88671

SEQ ID NO: 147327 - RNA, 64 nt, Homo Sapiens; identical to SEQ ID NO: 88672

SEQ ID NO: 147328 - RNA, 64 nt, Homo Sapiens; identical to SEQ ID NO: 88673

SEQ ID NO: 147329 - RNA, 64 nt, Homo Sapiens; identical to SEQ ID NO: 88674

SEQ ID NO: 147330 - RNA, 64 nt, Homo Sapiens; identical to SEQ ID NO: 88675

SEQ ID NO: 147331 - RNA, 64 nt, Homo Sapiens; identical to SEQ ID NO: 88676

SEQ ID NO: 147332 - RNA, 64 nt, Homo Sapiens; identical to SEQ ID NO: 88677

SEQ ID NO: 147333 - RNA, 64 nt, Homo Sapiens; identical to SEQ ID NO: 88678

SEQ ID NO: 147334 - RNA, 64 nt, Homo Sapiens; identical to SEQ ID NO: 88679

SEQ ID NO: 147335 - RNA, 64 nt, Homo Sapiens; identical to SEQ ID NO: 88680

SEQ ID NO: 147336 - RNA, 64 nt, Homo Sapiens; identical to SEQ ID NO: 88681

SEQ ID NO: 147337 - RNA, 64 nt, Homo Sapiens; identical to SEQ ID NO: 88682

SEQ ID NO: 147338 - RNA, 64 nt, Homo Sapiens; identical to SEQ ID NO: 88683

SEQ ID NO: 147339 - RNA, 64 nt, Homo Sapiens; identical to SEQ ID NO: 88684

SEQ ID NO: 147340 - RNA, 64 nt, Homo Sapiens; identical to SEQ ID NO: 88685

SEQ ID NO: 147341 - RNA, 64 nt, Homo Sapiens; identical to SEQ ID NO: 88686

SEQ ID NO: 147342 - RNA, 64 nt, Homo Sapiens; identical to SEQ ID NO: 88687

SEQ ID NO: 147343 - RNA, 64 nt, Homo Sapiens; identical to SEQ ID NO: 88688

SEQ ID NO: 147344 - RNA, 64 nt, Homo Sapiens; identical to SEQ ID NO: 88689

SEQ ID NO: 147345 - RNA, 64 nt, Homo Sapiens; identical to SEQ ID NO: 88690

SEQ ID NO: 147346 - RNA, 64 nt, Homo Sapiens; identical to SEQ ID NO: 88691

SEQ ID NO: 147347 - RNA, 50 nt, Homo Sapiens; identical to SEQ ID NO: 88692

SEQ ID NO: 147348 - RNA, 64 nt, Homo Sapiens; identical to SEQ ID NO: 88693

SEQ ID NO: 147349 - RNA, 64 nt, Homo Sapiens; identical to SEQ ID NO: 88694

SEQ ID NO: 147350 - RNA, 64 nt, Homo Sapiens; identical to SEQ ID NO: 88695

SEQ ID NO: 147351 - RNA, 64 nt, Homo Sapiens; identical to SEQ ID NO: 88696

SEQ ID NO: 147352 - RNA, 64 nt, Homo Sapiens; identical to SEQ ID NO: 88697

SEQ ID NO: 147353 - RNA, 64 nt, Homo Sapiens; identical to SEQ ID NO: 88698

SEQ ID NO: 147354 - RNA, 64 nt, Homo Sapiens; identical to SEQ ID NO: 88699

SEQ ID NO: 147355 - RNA, 64 nt, Homo Sapiens; identical to SEQ ID NO: 88700

SEQ ID NO: 147356 - RNA, 64 nt, Homo Sapiens; identical to SEQ ID NO: 88701

SEQ ID NO: 147357 - RNA, 64 nt, Homo Sapiens; identical to SEQ ID NO: 88702

SEQ ID NO: 147358 - RNA, 64 nt, Homo Sapiens; identical to SEQ ID NO: 88703

SEQ ID NO: 147359 - RNA, 64 nt, Homo Sapiens; identical to SEQ ID NO: 88704

SEQ ID NO: 147360 - RNA, 64 nt, Homo Sapiens; identical to SEQ ID NO: 88705

SEQ ID NO: 147361 - RNA, 64 nt, Homo Sapiens; identical to SEQ ID NO: 88706

SEQ ID NO: 147362 - RNA, 64 nt, Homo Sapiens; identical to SEQ ID NO: 88707

SEQ ID NO: 147363 - RNA, 64 nt, Homo Sapiens; identical to SEQ ID NO: 88708

SEQ ID NO: 147364 - RNA, 64 nt, Homo Sapiens; identical to SEQ ID NO: 88709

SEQ ID NO: 147365 - RNA, 64 nt, Homo Sapiens; identical to SEQ ID NO: 88710

SEQ ID NO: 147366 - RNA, 64 nt, Homo Sapiens; identical to SEQ ID NO: 88711

SEQ ID NO: 147367 - RNA, 64 nt, Homo Sapiens; identical to SEQ ID NO: 88712

SEQ ID NO: 147368 - RNA, 64 nt, Homo Sapiens; identical to SEQ ID NO: 88713

SEQ ID NO: 147369 - RNA, 64 nt, Homo Sapiens; identical to SEQ ID NO: 88714

SEQ ID NO: 147370 - RNA, 64 nt, Homo Sapiens; identical to SEQ ID NO: 88715

SEQ ID NO: 147371 - RNA, 64 nt, Homo Sapiens; identical to SEQ ID NO: 88716

SEQ ID NO: 147372 - RNA, 64 nt, Homo Sapiens; identical to SEQ ID NO: 88717

SEQ ID NO: 147373 - RNA, 64 nt, Homo Sapiens; identical to SEQ ID NO: 88718

SEQ ID NO: 147374 - RNA, 64 nt, Homo Sapiens; identical to SEQ ID NO: 88719

SEQ ID NO: 147375 - RNA, 64 nt, Homo Sapiens; identical to SEQ ID NO: 88720

SEQ ID NO: 147376 - RNA, 64 nt, Homo Sapiens; identical to SEQ ID NO: 88721

SEQ ID NO: 147377 - RNA, 64 nt, Homo Sapiens; identical to SEQ ID NO: 88722

SEQ ID NO: 147378 - RNA, 64 nt, Homo Sapiens; identical to SEQ ID NO: 88723

SEQ ID NO: 147379 - RNA, 64 nt, Homo Sapiens; identical to SEQ ID NO: 88724

SEQ ID NO: 147380 - RNA, 64 nt, Homo Sapiens; identical to SEQ ID NO: 88725

SEQ ID NO: 147381 - RNA, 64 nt, Homo Sapiens; identical to SEQ ID NO: 88726

SEQ ID NO: 147382 - RNA, 64 nt, Homo Sapiens; identical to SEQ ID NO: 88727

SEQ ID NO: 147383 - RNA, 64 nt, Homo Sapiens; identical to SEQ ID NO: 88728

SEQ ID NO: 147384 - RNA, 64 nt, Homo Sapiens; identical to SEQ ID NO: 88729

SEQ ID NO: 147385 - RNA, 64 nt, Homo Sapiens; identical to SEQ ID NO: 88730

SEQ ID NO: 147386 - RNA, 64 nt, Homo Sapiens; identical to SEQ ID NO: 88731

SEQ ID NO: 147387 - RNA, 64 nt, Homo Sapiens; identical to SEQ ID NO: 88732

SEQ ID NO: 147388 - RNA, 64 nt, Homo Sapiens; identical to SEQ ID NO: 88733

SEQ ID NO: 147389 - RNA, 64 nt, Homo Sapiens; identical to SEQ ID NO: 88734

SEQ ID NO: 147390 - RNA, 64 nt, Homo Sapiens; identical to SEQ ID NO: 88735

SEQ ID NO: 147391 - RNA, 64 nt, Homo Sapiens; identical to SEQ ID NO: 88736

SEQ ID NO: 147392 - RNA, 64 nt, Homo Sapiens; identical to SEQ ID NO: 88737

SEQ ID NO: 147393 - RNA, 64 nt, Homo Sapiens; identical to SEQ ID NO: 88738

SEQ ID NO: 147394 - RNA, 64 nt, Homo Sapiens; identical to SEQ ID NO: 88739

SEQ ID NO: 147395 - RNA, 64 nt, Homo Sapiens; identical to SEQ ID NO: 88740

SEQ ID NO: 147396 - RNA, 64 nt, Homo Sapiens; identical to SEQ ID NO: 88741

SEQ ID NO: 147397 - RNA, 64 nt, Homo Sapiens; identical to SEQ ID NO: 88742

SEQ ID NO: 147398 - RNA, 64 nt, Homo Sapiens; identical to SEQ ID NO: 88743

SEQ ID NO: 147399 - RNA, 64 nt, Homo Sapiens; identical to SEQ ID NO: 88744

SEQ ID NO: 147400 - RNA, 64 nt, Homo Sapiens; identical to SEQ ID NO: 88745

SEQ ID NO: 147401 - RNA, 64 nt, Homo Sapiens; identical to SEQ ID NO: 88746

SEQ ID NO: 147402 - RNA, 64 nt, Homo Sapiens; identical to SEQ ID NO: 88747

SEQ ID NO: 147403 - RNA, 64 nt, Homo Sapiens; identical to SEQ ID NO: 88748

SEQ ID NO: 147404 - RNA, 64 nt, Homo Sapiens; identical to SEQ ID NO: 88749

SEQ ID NO: 147405 - RNA, 64 nt, Homo Sapiens; identical to SEQ ID NO: 88750

SEQ ID NO: 147406 - RNA, 64 nt, Homo Sapiens; identical to SEQ ID NO: 88751

SEQ ID NO: 147407 - RNA, 64 nt, Homo Sapiens; identical to SEQ ID NO: 88752

SEQ ID NO: 147408 - RNA, 64 nt, Homo Sapiens; identical to SEQ ID NO: 88753

SEQ ID NO: 147409 - RNA, 64 nt, Homo Sapiens; identical to SEQ ID NO: 88754

SEQ ID NO: 147410 - RNA, 64 nt, Homo Sapiens; identical to SEQ ID NO: 88755

SEQ ID NO: 147411 - RNA, 64 nt, Homo Sapiens; identical to SEQ ID NO: 88756

SEQ ID NO: 147412 - RNA, 64 nt, Homo Sapiens; identical to SEQ ID NO: 88757

SEQ ID NO: 147413 - RNA, 64 nt, Homo Sapiens; identical to SEQ ID NO: 88758

SEQ ID NO: 147414 - RNA, 64 nt, Homo Sapiens; identical to SEQ ID NO: 88759

SEQ ID NO: 147415 - RNA, 64 nt, Homo Sapiens; identical to SEQ ID NO: 88760

SEQ ID NO: 147416 - RNA, 64 nt, Homo Sapiens; identical to SEQ ID NO: 88761

SEQ ID NO: 147417 - RNA, 64 nt, Homo Sapiens; identical to SEQ ID NO: 88762

SEQ ID NO: 147418 - RNA, 64 nt, Homo Sapiens; identical to SEQ ID NO: 88763

SEQ ID NO: 147419 - RNA, 64 nt, Homo Sapiens; identical to SEQ ID NO: 88764

SEQ ID NO: 147420 - RNA, 64 nt, Homo Sapiens; identical to SEQ ID NO: 88765

SEQ ID NO: 147421 - RNA, 64 nt, Homo Sapiens
guacauggaaaaccccuaaaauggaaugaccaggcucuaugaauaccaggcucuaugaauguac

SEQ ID NO: 147422 - RNA, 64 nt, Homo Sapiens
guacauggaaugaccaggcucgcugcugaccaggcucuaugaaucauacgcaacaaggacuccu

SEQ ID NO: 147423 - RNA, 64 nt, Homo Sapiens
guaaauggauaugauuuccuaucaguuuauauuucucuaugauuugaguucaguguuuaaggau

SEQ ID NO: 147424 - RNA, 64 nt, Homo Sapiens
gauagugcuuuacucuuucuguuuuuaaagggcacucuaugaauugauuuauugucuaagaaaa

SEQ ID NO: 147425 - RNA, 64 nt, Homo Sapiens
uucgauaucuaaaaggacucacaguggagaaaaacucuaugaguguaagcaaugugggaaaguc

SEQ ID NO: 147426 - RNA, 64 nt, Homo Sapiens
ucaaaugcauggaagcacucacacuuggcagaaacucuaugaauguaagcaguaugggaaagcc

SEQ ID NO: 147427 - RNA, 64 nt, Homo Sapiens
guaaaccauguggugaaggcgaaaaagaaauaaacucuaugaauucaaaaaaaauaaaaaaaaa

SEQ ID NO: 147428 - RNA, 64 nt, Homo Sapiens
gcaagcagugugggaaagcgcuggagagaagaaacucuaugaauaagucaugaaagaacucaca

SEQ ID NO: 147429 - RNA, 64 nt, Homo Sapiens
uuaauuuuuguuuuugcuccagucaauuccugauuauccacaggucaacccacauuuuuucauu

SEQ ID NO: 147430 - RNA, 64 nt, Homo Sapiens
uuauaucuccacaaacacaaauuauauauauacauauccacacacauacauuacauauaucugu

SEQ ID NO: 147431 - RNA, 64 nt, Homo Sapiens
caagugagaaucagcuauugauaauggccagagauauccacagcuuggaggagcccagagaccg

SEQ ID NO: 147432 - RNA, 64 nt, Homo Sapiens
aggugggaaaauucuuugauauuugaugucauuguauccacauuuguuguaagacauauugcau

SEQ ID NO: 147433 - RNA, 64 nt, Homo Sapiens
gucccuucugucucuuccacaccaaaauuuuccuuauccacaaugguacauuguugugucccaa

SEQ ID NO: 147434 - RNA, 64 nt, Homo Sapiens
agacaggcaagaggauuggagccugccucggcgguauccacagaccaugacugcauuuguuccu

SEQ ID NO: 147435 - RNA, 64 nt, Homo Sapiens
auaauugugaccaauacauuuguauuuugugaugaaucuacauuuguuuguauucauguucaug

SEQ ID NO: 147436 - RNA, 64 nt, Homo Sapiens
cauuuuagcaaauuaugguuauauguuuuaauuuaaucuacagaauguuuuauaguaaaauucu

SEQ ID NO: 147437 - RNA, 64 nt, Homo Sapiens
uuuguuuucugucuagcuccauaugguaucagagaaucuacaagaagaacagguucacagaagg

SEQ ID NO: 147438 - RNA, 64 nt, Homo Sapiens
gagauagacucaaaacaguuauuuuuuuacaauuaaucuacaaagggaauuaauauuguugacu

SEQ ID NO: 147439 - RNA, 64 nt, Homo Sapiens
agaagugcaauguauuuuucuccugugaaaccugaaucuacaaguuuuccugccaagccacuca

SEQ ID NO: 147440 - RNA, 64 nt, Homo Sapiens
uacccauuuuacauuuucuuauuuuaacuacaguaaucuacauaaauauaccucagaaaucauu

SEQ ID NO: 147441 - RNA, 64 nt, Homo Sapiens
ccucugugacugcuucgccccuguuguauacaggaaucuacaucgagguggaaucuacaucccu

SEQ ID NO: 147442 - RNA, 64 nt, Homo Sapiens
ccucuguuguauacaggaaucaaucaagagguggaaucuacaucgcagcaguuugacacacuuu

SEQ ID NO: 147443 - RNA, 64 nt, Homo Sapiens
aauaacuauguaaauagaaacagauaccagaauaaaucuacagcuagacccuuagucaauaguu

SEQ ID NO: 147444 - RNA, 64 nt, Homo Sapiens
aucaggaaggaacuuuucaagaaauguaauuauaaaucuacaucaaacagaauuuuaaggaaaa

SEQ ID NO: 147445 - RNA, 64 nt, Homo Sapiens; identical to SEQ ID NO: 147443

SEQ ID NO: 147446 - RNA, 64 nt, Homo Sapiens; identical to SEQ ID NO: 147444

SEQ ID NO: 147447 - RNA, 64 nt, Homo Sapiens
uauuacaauuuaguuuucaguaaucaaaaagauuucuaugaauucuaaaaaauauuuuuuucua

SEQ ID NO: 147448 - RNA, 64 nt, Homo Sapiens
aaaagauuucuaugaauucuaaaaaauauuuuuuucuaugaaauuacuagugcccagcuguaga

SEQ ID NO: 147449 - RNA, 64 nt, Homo Sapiens
uauaggcucgguguguguaaaucccccucuuuaaucuaugaaucgggcagucagcucuccaucc

SEQ ID NO: 147450 - RNA, 64 nt, Homo Sapiens
cucugcagggcaaggggaccgacaaacccucugaucuaugaagucucugcaggacagacagaca

SEQ ID NO: 147451 - RNA, 64 nt, Homo Sapiens
cuguacaaugcugauaauaaaaugcuucauaaaaucuaugaauauuggaggauauauuuuggag

SEQ ID NO: 147452 - RNA, 64 nt, Homo Sapiens
aacagagaagucucagaaaaaaaaaaaggaagacucuaugaagaagccaucuggaggaaauaaa

SEQ ID NO: 147453 - RNA, 64 nt, Homo Sapiens
uacauggaaaaccccuaaaauggaaugaccaggcucuaugaaugccaggcucuaugaauguaca

SEQ ID NO: 147454 - RNA, 64 nt, Homo Sapiens
uacauggaaugaccaggcucgcugcugaccaggcucuaugaaugauacgcaacaaggacuccuc

SEQ ID NO: 147455 - RNA, 64 nt, Homo Sapiens
uuuuccacauugaaacacuuugcagacacaaauaucuaugaaaagaugcuuugucagccacugu

SEQ ID NO: 147456 - RNA, 64 nt, Homo Sapiens
uaaaaaauaagagacuauuuguuuucuuuuaauuucuaugaauaaaagaaauuuuuaaaaacuu

SEQ ID NO: 147457 - RNA, 64 nt, Homo Sapiens
ugaugggcucaaacuagcuguuaauacaugauucucuaugaaaugucauucaauuuacuuguuu

SEQ ID NO: 147458 - RNA, 64 nt, Homo Sapiens
cagggcuuuaaaacauuuuuucuccuaaaaccagucuaugaacuagucccguguguccuaaaaa

SEQ ID NO: 147459 - RNA, 64 nt, Homo Sapiens
gauucuuuuuuauuaggcauuauuuaugaccuuuucuaugaaaagauaaggacauuaaaaugua

SEQ ID NO: 147460 - RNA, 64 nt, Homo Sapiens
uaaguuagucauauguuauuuuauuaauuguacuucuaugaaauaauaugcagucuauuuuuaa

SEQ ID NO: 147461 - RNA, 64 nt, Homo Sapiens
uaaaccauguggugaaggcuaaaaagaaauaaacucuaugaaugcaaaaaaaauaaaaaaaaag

SEQ ID NO: 147462 - RNA, 64 nt, Homo Sapiens
caagcagugugggaaagcguuggagagaagaaacucuaugaaugagucaugaaagaacucacac

SEQ ID NO: 147463 - RNA, 64 nt, Homo Sapiens; identical to SEQ ID NO: 44407

SEQ ID NO: 147464 - RNA, 64 nt, Homo Sapiens; identical to SEQ ID NO: 44408

SEQ ID NO: 147465 - RNA, 64 nt, Homo Sapiens; identical to SEQ ID NO: 44409

SEQ ID NO: 147466 - RNA, 64 nt, Homo Sapiens; identical to SEQ ID NO: 44410

SEQ ID NO: 147467 - RNA, 64 nt, Homo Sapiens; identical to SEQ ID NO: 44411

SEQ ID NO: 147468 - RNA, 64 nt, Homo Sapiens; identical to SEQ ID NO: 44412

SEQ ID NO: 147469 - RNA, 64 nt, Homo Sapiens; identical to SEQ ID NO: 44413

SEQ ID NO: 147470 - RNA, 64 nt, Homo Sapiens; identical to SEQ ID NO: 44414

SEQ ID NO: 147471 - RNA, 64 nt, Homo Sapiens; identical to SEQ ID NO: 44415

SEQ ID NO: 147472 - RNA, 64 nt, Homo Sapiens; identical to SEQ ID NO: 44416

SEQ ID NO: 147473 - RNA, 64 nt, Homo Sapiens
auaaccgaaggaaagaccguucaccagacuuggcuccucuaaacauuugcuguucaaacauguu

SEQ ID NO: 147474 - RNA, 64 nt, Homo Sapiens
gcucugucaugauggcgguugugcaauucugguauccucuaaauuuguaagcauucauaaaaca

SEQ ID NO: 147475 - RNA, 64 nt, Homo Sapiens
cucuaucauauacuuauuccaaacaaaaccaguguccucuaaguacagggauguagauaaguug

SEQ ID NO: 147476 - RNA, 64 nt, Homo Sapiens
uaucuagucuguggaguuuggggguuuagaacauuccucuaagcgagggguuaggauuuggaca

SEQ ID NO: 147477 - RNA, 64 nt, Homo Sapiens
aguguaaaagugcgcaaaacgggauauauggucauccucuaauguuacuggcuucaucuuccuu

SEQ ID NO: 147478 - RNA, 64 nt, Homo Sapiens
aggcauuuaaugaaacauugaucaacuaugguuauccucuaaauguuuggcuuuuuucuguguc

SEQ ID NO: 147479 - RNA, 64 nt, Homo Sapiens
cccaagucccccacccccauccugcuccagcguuuccucuaacagggaccagcucuccgcuuug

SEQ ID NO: 147480 - RNA, 64 nt, Homo Sapiens
cagggaccagcucuccgcuuugcccccacgggguuccucuaaccagaaccagcuuccuagccuc

SEQ ID NO: 147481 - RNA, 64 nt, Homo Sapiens
uaaauauuuagagguauuuauauucccucuauuuuccucuaagggaggcuguucauugauccac

SEQ ID NO: 147482 - RNA, 64 nt, Homo Sapiens
uggacuugcuugcaaagguguugggguuggccguuccucuaaucuauguggcaaaaggucagcc

SEQ ID NO: 147483 - RNA, 64 nt, Homo Sapiens
gaaaaccacccacaagcucaacugugacccaagcagaaucuacaaaccccagacaagguugaag

SEQ ID NO: 147484 - RNA, 64 nt, Homo Sapiens
acggcuggggagaucaggcccagccccauaaaggagaaucuacgcugguccucaggacguguua

SEQ ID NO: 147485 - RNA, 64 nt, Homo Sapiens
agccuuucuauauuaaaggcucaggaugucacggagaaucuaucuaaucccacuguauuaagag

SEQ ID NO: 147486 - RNA, 64 nt, Homo Sapiens
ucagcaauguugugugaaauauacuaaacaucaaagaaucuauguuggagcacaagauucuaaa

SEQ ID NO: 147487 - RNA, 64 nt, Homo Sapiens
auuuuuuucuaugaaauuacuagugcccagcuguagaaucuaccuuagguagaugaucccuaga

SEQ ID NO: 147488 - RNA, 64 nt, Homo Sapiens
aggaauagaucugacuuuaauaaaaacauggcucagaaucuacaggucaaauuaauuugaacag

SEQ ID NO: 147489 - RNA, 64 nt, Homo Sapiens
uucgguagaacugagugaccuguggaacugcuuuagaaucuaaccugcugucuucgugcucugu

SEQ ID NO: 147490 - RNA, 64 nt, Homo Sapiens
uaauuagccuauagggcucccuacccuuccauuaagaaucuaccaagcauuagcaaggcugaaa

SEQ ID NO: 147491 - RNA, 64 nt, Homo Sapiens
cucuucagauuccuaaguagcacaagacuuuaucagaaucuauaggcauaccaaccuggaucac

SEQ ID NO: 147492 - RNA, 64 nt, Homo Sapiens
aaggguuaugcaaaucucaggguguugccucuaaagaaucuaaagaauagacaugcuuugggcu

SEQ ID NO: 147493 - RNA, 64 nt, Homo Sapiens
gcgggacccagucaaaccccauucaggucaugguagaaucuacuccuugguagucacuugucau

SEQ ID NO: 147494 - RNA, 64 nt, Homo Sapiens
aaccagacauuuccaguugguuuuguaaguuuugagaaucuagauacuggguuuuauuuuuuga

SEQ ID NO: 147495 - RNA, 64 nt, Homo Sapiens
uuugcauguacccacccaaaaugauuauuuuuguagaaucuaaguuaaacuuacuauuuauaau

SEQ ID NO: 147496 - RNA, 64 nt, Homo Sapiens
uucaggcuaccuuuuauacuaaaccuugaaaacuagaaucuaaugucuaccccaaaaaaguagu

SEQ ID NO: 147497 - RNA, 64 nt, Homo Sapiens
uacugaagggcuaguggcaccaucugggagaggcagaaucuauaagcuauaaaggaggacuuuc

SEQ ID NO: 147498 - RNA, 64 nt, Homo Sapiens
gagagccuccucucuggugguaaauaacagauuuagaaucuaguuuuuucaauugaaaaguaau

SEQ ID NO: 147499 - RNA, 64 nt, Homo Sapiens
cuauuuauugacuguccugauccaggccuggcucagaaucuaaccccuuugaauacccucacuu

SEQ ID NO: 147500 - RNA, 64 nt, Homo Sapiens
gaccuggcuccucggaucugccacucuagcucccagaaucuacaucaucugggaaucauauacu

SEQ ID NO: 147501 - RNA, 64 nt, Homo Sapiens
ucugccucugaauggacuuccguaacuggaacguagaaucuacgaggagaguccauagaucagc

SEQ ID NO: 147502 - RNA, 64 nt, Homo Sapiens
cccuccgauguguguuucuaaugagguccuggggagaaucuaaguaccucugauagaggucaga

SEQ ID NO: 147503 - RNA, 64 nt, Homo Sapiens
uuauuaacugaccuguuuuggggacauauucuuuagaaucuauugggagggagggcugugcaua

SEQ ID NO: 147504 - RNA, 64 nt, Homo Sapiens
ucaucccugacuccaguguccauuguuugagccaagaaucuaagggaugguauuacaucagcuc

SEQ ID NO: 147505 - RNA, 64 nt, Homo Sapiens
uaggugcuuuuaacuggggugccuuaucuugaaaagaaucuagaauuuuaaagcugacuuuguu

SEQ ID NO: 147506 - RNA, 64 nt, Homo Sapiens
accaaccaagcuaggaacauuggugaaccaucagagaaucuagagcuccuaugagcuuggagca

SEQ ID NO: 147507 - RNA, 64 nt, Homo Sapiens
caggaaugcagauagaacacaggagaagucaugcagaaucuaagagggggccaaggggauggac

SEQ ID NO: 147508 - RNA, 64 nt, Homo Sapiens
aaaaaugcacuuguuccuuagcaagccgaguuccagaaucuauuugaggaauuaugacuacuau

SEQ ID NO: 147509 - RNA, 64 nt, Homo Sapiens
guguuugauaucuguuucagacuuugcacugaagagaaucuaggaaauugcugugacuccagau

SEQ ID NO: 147510 - RNA, 64 nt, Homo Sapiens
cuacucaggcuaugggccucuuuuuuacaaauacagaaucuauucaguugauguaaccaccuca

SEQ ID NO: 147511 - RNA, 64 nt, Homo Sapiens
cugcuuacauucuuguuuaauuuaggaaaauacuagaaucuacuuggaaguagaagguaaggag

SEQ ID NO: 147512 - RNA, 64 nt, Homo Sapiens
ucugaugaauaugaaaggaaaacaugccucccacagaaucuauucagcccgaguucugaauuaa

SEQ ID NO: 147513 - RNA, 64 nt, Homo Sapiens
ccaacgugccuaauuaauuauggaaaaauaauucagaaucuaaacaccacugaaaacuuauaaa

SEQ ID NO: 147514 - RNA, 64 nt, Homo Sapiens
gucggauuaaugaacugcggaacaagagguugugagaaucuaagauggaaccuuucuuucuuuc

SEQ ID NO: 147515 - RNA, 53 nt, Homo Sapiens
aagacagugaccuggagugaaacagaaucuacauaaccuaagcccauauacuc

SEQ ID NO: 147516 - RNA, 64 nt, Homo Sapiens
uaaaugagauuacagcauaaugaagaagaaaacuagaaucuaacagguaugacacauucaguua

SEQ ID NO: 147517 - RNA, 64 nt, Homo Sapiens
uagacaaugauguuacuaaaugcuucaaagcugaagaaucuaaaugucgucuuugacucaagua

SEQ ID NO: 147518 - RNA, 64 nt, Homo Sapiens
acuuuguguccucacucugaugucuccuuccuucagaaucuaccaccccucccccaggcuggga

SEQ ID NO: 147519 - RNA, 64 nt, Homo Sapiens
gaaaagagaauuacuuauauucaucuauuuucucagaaucuauucaguacccuauggaguacau

SEQ ID NO: 147520 - RNA, 64 nt, Homo Sapiens
agguugauggaaggaauauuuuuauuaaccaaauagaaucuauuuacaaaaaugguucacguau

SEQ ID NO: 147521 - RNA, 64 nt, Homo Sapiens
cucuuuugacuuuuuauugguacaacuguagggaagaaucuacaaccuggagcauuucagguuu

SEQ ID NO: 147522 - RNA, 64 nt, Homo Sapiens
ucuuagugaucaguggucaguaaucuucaaagucagaaucuaucaccuugguaaauuauauaaa

SEQ ID NO: 147523 - RNA, 64 nt, Homo Sapiens
gacuuaaaguuaugcuggcagauucgccaagagaagaaucuaacaaacggcaaagaacuuacug

SEQ ID NO: 147524 - RNA, 64 nt, Homo Sapiens
cgcaaccuacucaucugacaaagggcuaauaaccagaaucuacaaugaacucaaacaaauuuac

SEQ ID NO: 147525 - RNA, 64 nt, Homo Sapiens
agaauuauacuugaaaauacaguuggugcacuggagaaucuauuauuuaaaaccacucuguuca

SEQ ID NO: 147526 - RNA, 64 nt, Homo Sapiens
cgccgugaccuauucacccuccacuucccgucucagaaucuaaacguggucaccuucgaguaga

SEQ ID NO: 147527 - RNA, 64 nt, Homo Sapiens
uugauugcucucuuuugucuuggucgcugcuucuagaaucuaugcaggggauagcagugagguc

SEQ ID NO: 147528 - RNA, 64 nt, Homo Sapiens
gacugaaucuaaugcuuccaguuaauuuugucacagaaucuaugcauugcacagacugacugua

SEQ ID NO: 147529 - RNA, 61 nt, Homo Sapiens
gccaguggcuugaggcuacaauaaggacuccagaaucuaaacaggguaugaaacccaguga

SEQ ID NO: 147530 - RNA, 64 nt, Homo Sapiens
gcuggcaauugggaaccgcagauuauagaggaggagaaucuacucuguagaccauauagaaaaa

SEQ ID NO: 147531 - RNA, 64 nt, Homo Sapiens
uuuuaaagguguagcaccuuuaagcauuuaaaagagaaucuaaugaccccucuaagcaaacuac

SEQ ID NO: 147532 - RNA, 64 nt, Homo Sapiens
gcugcugcugaucugacagguucgcacuucuaugagaaucuaaucauaccaguucaccauaugg

SEQ ID NO: 147533 - RNA, 64 nt, Homo Sapiens
cucaguaaaauaacuuauggugcuguagggcagcagaaucuauugcuuagaguuuuggcaccaa

SEQ ID NO: 147534 - RNA, 64 nt, Homo Sapiens
aggcacagaugaggccgcccccuuggaagcaguuagaaucuaccccugcacgcguccuccucua

SEQ ID NO: 147535 - RNA, 64 nt, Homo Sapiens
gaacaaaugaaccagcaguaaguuucuaaaaaucagaaucuagauagaaguucugcaauaugaa

SEQ ID NO: 147536 - RNA, 64 nt, Homo Sapiens
auuuccaccauuguagagaauuuccuuccuacugagaaucuaccucuauucccccugcccuagc

SEQ ID NO: 147537 - RNA, 64 nt, Homo Sapiens
ccucauuccgugucagugaucagcaguagacugaagaaucuaccuuagauuugcuccauacuau

SEQ ID NO: 147538 - RNA, 64 nt, Homo Sapiens
ccacugauuaauauuuaaugagggaagguaggggagaaucuagccauuuuauaaugccagaaau

SEQ ID NO: 147539 - RNA, 64 nt, Homo Sapiens
uuggaauccuauuuaguuaauacuuuagcaucuuagaaucuaggcuugagaauuguucaggugu

SEQ ID NO: 147540 - RNA, 64 nt, Homo Sapiens
uucuccuacuguucuguaaacuuauuaaugggugagaaucuaauuuuacucaucuugauggcuu

SEQ ID NO: 147541 - RNA, 64 nt, Homo Sapiens
aagcucaguuuuuucaggcucauccuguucuuccagaaucuaucccuuuucuuacacugaagag

SEQ ID NO: 147542 - RNA, 64 nt, Homo Sapiens
agaugguuucuagagaugguuucuacuggcugccagaaucuagagcaaagccauccccgcuccu

SEQ ID NO: 147543 - RNA, 64 nt, Homo Sapiens
acauguuggugugaagacugggacgacacuggguagaaucuaguuuuuaauuauuauuaauaua

SEQ ID NO: 147544 - RNA, 64 nt, Homo Sapiens
caagcccaaauuuaauuugcaaccaucagaauucagaaucuauagugaccagugaucaaggcua

SEQ ID NO: 147545 - RNA, 64 nt, Homo Sapiens
aguuuaugguagaaagauggcuccucauccucccagaaucuacccucuccucguuucucucuua

SEQ ID NO: 147546 - RNA, 64 nt, Homo Sapiens
cuuccaccaauaaaccaucgcguuuauuuuaaauagaaucuauguagacccuagaaaauugucu

SEQ ID NO: 147547 - RNA, 61 nt, Homo Sapiens
cugaaaacauugacucuagaauugggcuuggagaaucuauuaucccuuccauuuuguuuaa

SEQ ID NO: 147548 - RNA, 64 nt, Homo Sapiens
auauauugucauauguuuucagaccuugucuuagagaaucuaaaacuugucaucuaaacuuaug

SEQ ID NO: 147549 - RNA, 64 nt, Homo Sapiens
cuuguauuugauagacaaaagacauguugaaauuagaaucuauuuaaagucagcacucaacuug

SEQ ID NO: 147550 - RNA, 64 nt, Homo Sapiens
acauuaaauguaguagaugcucacuugcuaaauaagaaucuaugauguuugcaacgaauccagc

SEQ ID NO: 147551 - RNA, 64 nt, Homo Sapiens
auguaauuguuuucaacacuuuucucuaaauaccagaaucuagucaacucacucaggcaucuuc

SEQ ID NO: 147552 - RNA, 64 nt, Homo Sapiens
aacaauuugaaaaguaauacaaucuuugggaaacagaaucuaguaguuauaucugaaauaguca

SEQ ID NO: 147553 - RNA, 64 nt, Homo Sapiens
caaaggauacuguaacacuuuccagccccuucucagaaucuaccggaguguugaugcuuucguc

SEQ ID NO: 147554 - RNA, 64 nt, Homo Sapiens
caagcaggaauuauauugaauuaaacaucaaaucagaaucuagcacuaggguuuuauaaguuga

SEQ ID NO: 147555 - RNA, 64 nt, Homo Sapiens
uuuagagauauguucacuuguaaauaaaaagguuagaaucuaaggacaaagaaugauccaaaaa

SEQ ID NO: 147556 - RNA, 64 nt, Homo Sapiens
ugaaauaguauagauuaaaaacacucaguagaaaagaaucuaaaauuaaaugaauuuguuuugc

SEQ ID NO: 147557 - RNA, 64 nt, Homo Sapiens
cuuuucucugugcuucaauuaauaaaaaauggaaagaaucuaauagagugguacagcacuguua

SEQ ID NO: 147558 - RNA, 64 nt, Homo Sapiens
aagaaugagauacugauguccacaguucauuggcagaaucuaaccccuucuguuaucuuuuuua

SEQ ID NO: 147559 - RNA, 64 nt, Homo Sapiens
gucuuaauuugagaacaccaaaggaaacuaccccagaaucuaauguaguucgcuauuaauaaca

SEQ ID NO: 147560 - RNA, 64 nt, Homo Sapiens
aaacagccuucaacaaguauuugugaagugacugagaaucuagcacuucuccacuuguagcugc

SEQ ID NO: 147561 - RNA, 64 nt, Homo Sapiens
uccuuuccagucauuucaauuuuuuauuucuuuaagaaucuauuuguuucuggaauugugcuua

SEQ ID NO: 147562 - RNA, 64 nt, Homo Sapiens
uuaauuguuucagguggaaacauuauaugcuaguagaaucuaguuauugcuguaauguguuaag

SEQ ID NO: 147563 - RNA, 64 nt, Homo Sapiens
uggcccugucuugacccugaacuugcaaggccauagaaucuagauucccagcauugugggugcu

SEQ ID NO: 147564 - RNA, 64 nt, Homo Sapiens
uguaaaaaagaaauaacuaauaucagggaaguggagaaucuaagagaaccaguguuacuguuug

SEQ ID NO: 147565 - RNA, 64 nt, Homo Sapiens
aucuaguacugaaauuacuaugaaaauguauaaaagaaucuauaauaucacagcucacaguuuc

SEQ ID NO: 147566 - RNA, 64 nt, Homo Sapiens
aguaaacaaacauccugucuccugaaacuuacuaagaaucuaccuguuuuaugcaccuucuuua

SEQ ID NO: 147567 - RNA, 64 nt, Homo Sapiens
uucuucuaagugggccuuuagccagcuuucauuaagaaucuaaggcacccugaaauggacuaag

SEQ ID NO: 147568 - RNA, 64 nt, Homo Sapiens
gucgcccugggauagauccaauaucuuugcgggaagaaucuagaagugacggaaagcagcacgc

SEQ ID NO: 147569 - RNA, 64 nt, Homo Sapiens
auuuguuauucaaauuaaauguuauggccuacuuagaaucuaaaaucaauuguuuugcaaagaa

SEQ ID NO: 147570 - RNA, 64 nt, Homo Sapiens
aaagaccuaaauaugaagacaaaacuuuuaaaugagaaucuauaagguuauuuucaugauuuug

SEQ ID NO: 147571 - RNA, 64 nt, Homo Sapiens
ccaaaacagauuuuagacuuaccuugaacggauaagaaucuauaguucacugacacaguaaaau

SEQ ID NO: 147572 - RNA, 64 nt, Homo Sapiens
aaauguaugugaggcguauguggcaaaauguuacagaaucuaacugguggacauggcuguucau

SEQ ID NO: 147573 - RNA, 64 nt, Homo Sapiens; identical to SEQ ID NO: 147572

SEQ ID NO: 147574 - RNA, 64 nt, Homo Sapiens
uguuacagcuacuauaaauauacauauaaauuauagaaucuacuuuaauuuauuuugugaacac

SEQ ID NO: 147575 - RNA, 64 nt, Homo Sapiens
gcugauaaggaccauccaaaauucaaggaaauucagaaucuaauuaaggcgagugcuccagagu

SEQ ID NO: 147576 - RNA, 64 nt, Homo Sapiens
cuauagaaagaagucaaaagaugaggccccuucuagaaucuaggauaacaagaguguugacagu

SEQ ID NO: 147577 - RNA, 64 nt, Homo Sapiens
aauucuuggggaaguguguuuauuauuuauagaaagaaucuauaaggugcaguauuuuuuaaau

SEQ ID NO: 147578 - RNA, 64 nt, Homo Sapiens
gccacuacugaucuaacaagugugcacuccuaugagaaucuaauaugugcaguucccaauggag

SEQ ID NO: 147579 - RNA, 64 nt, Homo Sapiens
gugcucagggcuugguacaaaguaaagcauacaaagaaucuagugaugugcuuaacguaagguu

SEQ ID NO: 147580 - RNA, 64 nt, Homo Sapiens
uuggacuucuguuguauucuuggugacaacacucagaaucuaaaucugugugauuguaaucaca

SEQ ID NO: 147581 - RNA, 64 nt, Homo Sapiens
aaguuagccauucucuauugcuaccaggaucaccagaaucuaauuucugagcccuuccucuuga

SEQ ID NO: 147582 - RNA, 64 nt, Homo Sapiens
gaaccaagaugcucauuuuccugugagcaagauaagaaucuauaauucaguuuuggagcaaguc

SEQ ID NO: 147583 - RNA, 64 nt, Homo Sapiens
auucucucccuggcugacagaggcuugaugacccagaaucuaggauauguaaaaugggaaaguu

SEQ ID NO: 147584 - RNA, 64 nt, Homo Sapiens
uguuuguuuuccucauuucuuccuucuagaacacagaaucuaaagggguauuagccagccucgc

SEQ ID NO: 147585 - RNA, 64 nt, Homo Sapiens
auauuucauugcuaguuaaaaaauaaaaccuuugagaaucuaagauguacauuuuuaccuuuua

SEQ ID NO: 147586 - RNA, 64 nt, Homo Sapiens
guucuuuggacacucaggccuaacuaguuaucaaagaaucuauuuuagaaaccuugaguuuccu

SEQ ID NO: 147587 - RNA, 64 nt, Homo Sapiens
uaaaaggcagaaaggucaucacaacuuuagugucagaaucuauagugguggcaaaguuaggaua

SEQ ID NO: 147588 - RNA, 64 nt, Homo Sapiens
gccuguuggugguguucuugucuuaacccuagauagaaucuaaugaacucagaggcuuagcucg

SEQ ID NO: 147589 - RNA, 64 nt, Homo Sapiens
aauaugaacuguauuuuaaauuuguuaggucugaagaaucuaaaacuguuaauuuaacccuuaa

SEQ ID NO: 147590 - RNA, 61 nt, Homo Sapiens
aaacagaaaagacagacuagcuacaucaaacagaaucuauuuccagagagucuugcugcug

SEQ ID NO: 147591 - RNA, 64 nt, Homo Sapiens
guagauacuucuuaacuggaaauucuuucuuuucagaaucuagguggugaauuuuuuuuaagug

SEQ ID NO: 147592 - RNA, 64 nt, Homo Sapiens
uuaauggacuuauucucaggguccuacucuaagaagaaucuaauaggaugcugguuguguauua

SEQ ID NO: 147593 - RNA, 64 nt, Homo Sapiens
caugacuguccuucagucacaauuccagaauaaaagaaucuacuuuguguauuaauguuuuaug

SEQ ID NO: 147594 - RNA, 64 nt, Homo Sapiens
aucuuauuauaaagaacuauuuguaguaacuaucagaaucuacauucuaaaacagaaauuguau

SEQ ID NO: 147595 - RNA, 64 nt, Homo Sapiens
gugagauuagucauaucacuaauauacuaacaacagaaucuaaucuucauuuaaggcacuguag

SEQ ID NO: 147596 - RNA, 64 nt, Homo Sapiens
ccuuuguuuucugucuagcuccauaugguaucagagaaucuacaagaagaacagguucacagaa

SEQ ID NO: 147597 - RNA, 64 nt, Homo Sapiens
caaacgauauucugauuuugcacauuauuauagaagaaucuauaauccuugauauguuucuaac

SEQ ID NO: 147598 - RNA, 64 nt, Homo Sapiens
ucagguucuucucacagguaaaucuuucagccacagaaucuaacuggugagcuucagaaccaau

SEQ ID NO: 147599 - RNA, 64 nt, Homo Sapiens
ugcaaacucugcaucugaugaagguccaauauccagaaucuacaaggaacuuaaacaauucaac

SEQ ID NO: 147600 - RNA, 64 nt, Homo Sapiens
uuaaaagcaguccaguaaaagguuaacuguauaaagaaucuaugacuuuuugagggaaguguga

SEQ ID NO: 147601 - RNA, 64 nt, Homo Sapiens
uacauauaauauguaugagauuuaauugugggugagaaucuaugaccuguucugcagugagaga

SEQ ID NO: 147602 - RNA, 64 nt, Homo Sapiens
cucuucucuccagucccguugcucuaaauaauucagaaucuauugaaaagcucugcugcucuua

SEQ ID NO: 147603 - RNA, 64 nt, Homo Sapiens
aucacucucaguaauauagaucaacaguagaccaagaaucuaacggugcauguguuugguaucu

SEQ ID NO: 147604 - RNA, 64 nt, Homo Sapiens
gauguguuuagaaccucuugauuucuuucugcuuagaaucuaaauaaaucuaauaguacuugua

SEQ ID NO: 147605 - RNA, 64 nt, Homo Sapiens
gaauuuagcauuuugaaaaugucacuggucucaaagaaucuacgaauggauugaaagagugaaa

SEQ ID NO: 147606 - RNA, 64 nt, Homo Sapiens
uaacccugacaaauuuuaauaaugauauugcugaagaaucuacuugggccuuuuuccaguaagg

SEQ ID NO: 147607 - RNA, 64 nt, Homo Sapiens
aaauuaguuguauuuugugcugaucaguugccaaagaaucuaggcgagacauagaauaguauuc

SEQ ID NO: 147608 - RNA, 64 nt, Homo Sapiens
acgcuuuauuuuuagacugauugaaaaacacuccagaaucuaguuggcaaauauuuuaaaauau

SEQ ID NO: 147609 - RNA, 64 nt, Homo Sapiens
ggaaggauguguuuuuuucucucacuauaguauaagaaucuauuuuggagaaaaaaagaaaaua

SEQ ID NO: 147610 - RNA, 64 nt, Homo Sapiens
cccuguuguguggacuuugagcacacuuuacacaagaaucuagaaaaucagaucgcgauuaaga

SEQ ID NO: 147611 - RNA, 64 nt, Homo Sapiens
gggaauauggauaagcauaguaacaaaacccaccagaaucuaagcaguuuucacccccucagaa

SEQ ID NO: 147612 - RNA, 64 nt, Homo Sapiens
uuaaccagcauuuuucaacccugggaaaauuugcagaaucuaaguugauuguaaugauuuugag

SEQ ID NO: 147613 - RNA, 64 nt, Homo Sapiens
accauacugcuuucaaaagucuuuucucaucaguagaaucuauuuuggucacuucuagucaaug

SEQ ID NO: 147614 - RNA, 64 nt, Homo Sapiens
uaaauuauauuaguaaaagucuuaacuggaaaaaagaaucuaaaucagaauagugaucaauuug

SEQ ID NO: 147615 - RNA, 64 nt, Homo Sapiens
gaaauucuauuugagccacccuuccgcacuggggagaaucuaugcaagccucgucaacaccacu

SEQ ID NO: 147616 - RNA, 64 nt, Homo Sapiens
agagaauucauaaccacaccuuccuuucugcaugagaaucuaggugguaauauggcaagccuug

SEQ ID NO: 147617 - RNA, 64 nt, Homo Sapiens
aucgggacuauuagcaauggcaaagcccccagacagaaucuagccccaccuuuccagauaccca

SEQ ID NO: 147618 - RNA, 64 nt, Homo Sapiens
acauaccacaaaaauacaucuucuguccuucuugagaaucuaaaaaauaaaucaaucuaugcug

SEQ ID NO: 147619 - RNA, 64 nt, Homo Sapiens
acuaaaaauuuuuacaaaaccugagaggucacaaagaaucuaucugguugcugauguuuauaaa

SEQ ID NO: 147620 - RNA, 64 nt, Homo Sapiens
gcugcuaaagcacauuaaaagaagacacaguuuuagaaucuacuucaaacuaaugagaggacaa

SEQ ID NO: 147621 - RNA, 64 nt, Homo Sapiens
aaaucaggcaagugcuuaaauauggauacauuucagaaucuaagacaacguguaugcaaauugu

SEQ ID NO: 147622 - RNA, 64 nt, Homo Sapiens
ugagaccaugccacuagcuugucucucuccugcaagaaucuacccugauggaauucauauaucu

SEQ ID NO: 147623 - RNA, 64 nt, Homo Sapiens
ccucucuaggggaagcccaccaccuggguuugcaagaaucuaaaauugcucaacaagaacgauu

SEQ ID NO: 147624 - RNA, 64 nt, Homo Sapiens
aaaaaaauaaaaauaaaaauaaaacacuuuaauuagaaucuauuuuuaccuauuuucuaaauuu

SEQ ID NO: 147625 - RNA, 64 nt, Homo Sapiens
gggaguagagggagagggcagguggaacuggggcagaaucuagucaugcccuaaagcuaguccu

SEQ ID NO: 147626 - RNA, 64 nt, Homo Sapiens
gagggauuuuaaaguaaagauguauuuauucugaagaaucuaaaagauaacagauuauuugcuu

SEQ ID NO: 147627 - RNA, 64 nt, Homo Sapiens
aaguucaguccagucaagaauuuuuguauuugagagaaucuacuaauaaguaaucuaaaaaucc

SEQ ID NO: 147628 - RNA, 64 nt, Homo Sapiens
gggauggaaguuuuugcuacucaauccaucugccagaaucuaguuauauauauauugugaaaga

SEQ ID NO: 147629 - RNA, 64 nt, Homo Sapiens
auacuuugguuggcagcauuauuacauuguuuaaagaaucuacuggagucugcagauagaaagc

SEQ ID NO: 147630 - RNA, 64 nt, Homo Sapiens
cauuuuacagguguaucugauaaggaaagaauggagaaucuagaacaaacuacucuauuuuaaa

SEQ ID NO: 147631 - RNA, 64 nt, Homo Sapiens
ugcuuaugcaguuuuucagaagcugcauccuccaagaaucuaucaauauagaaacacgaacuuu

SEQ ID NO: 147632 - RNA, 64 nt, Homo Sapiens
cugcaucgcagcccaccgugguaacuguaaauccagaaucuaucgagaguauuuuuuucuucgu

SEQ ID NO: 147633 - RNA, 64 nt, Homo Sapiens
acuguguuguucaugguggcuuuuuggacaauaaagaaucuaaaauggguggggaggguggaag

SEQ ID NO: 147634 - RNA, 64 nt, Homo Sapiens
gaucuccacagggccaggguugcuacuugcacccagaaucuagugauuuuagucagauccaugg

SEQ ID NO: 147635 - RNA, 64 nt, Homo Sapiens
ccacugccuucuagccguccuccaccuugcagaaagaaucuagccuuuggucucucucucucuc

SEQ ID NO: 147636 - RNA, 64 nt, Homo Sapiens
aucauuccucaagucuuacugauuuuuaucagcuagaaucuaucuccuuauuucuaccucuauu

SEQ ID NO: 147637 - RNA, 64 nt, Homo Sapiens
caauuaaggcaucaucaguccuaccugagcaacaagaaucuaaacuuuauuccaagucagaaac

SEQ ID NO: 147638 - RNA, 64 nt, Homo Sapiens
gagaccagugggcgccauuuaaaagaacaggaugagaaucuaagauauauuauuaauaaaugua

SEQ ID NO: 147639 - RNA, 64 nt, Homo Sapiens
uuugcacaguauuauuuuacagaaaaggaaucagagaaucuacaacauagggccccagaacaac

SEQ ID NO: 147640 - RNA, 64 nt, Homo Sapiens
uacaggcaugagccacugugcccagcugggauauagaaucuaagaguugauuguggaaaacacg

SEQ ID NO: 147641 - RNA, 64 nt, Homo Sapiens
ccuuagcuugcccuccugccggagguuggagggaagaaucuagggcucccuccuucccugucug

SEQ ID NO: 147642 - RNA, 64 nt, Homo Sapiens
uacauauguaugagaagacuuuuaauugugggugagaaucuaugaccuguucugcagugagaga

SEQ ID NO: 147643 - RNA, 64 nt, Homo Sapiens
gcagaagagaucuuuuaaaacaaaaaagaaaccuagaaucuaauuguagacccaguuuugaaac

SEQ ID NO: 147644 - RNA, 64 nt, Homo Sapiens
cagucuugccuuacacaaaggggaucauaaaguuagaaucuauuuucuauguacuaguacugug

SEQ ID NO: 147645 - RNA, 64 nt, Homo Sapiens
uuuuaagcaaauggguaauaguagaaaauagguuagaaucuauggcuugauuaaaaauauguua

SEQ ID NO: 147646 - RNA, 64 nt, Homo Sapiens
uuguaucugaucccugcuuggaguuuuaguuuaaagaaucuauauguagcaaggaaaaggugcu

SEQ ID NO: 147647 - RNA, 64 nt, Homo Sapiens
gcauuaacagaaugcuuuaaaaacuucuaagacaagaaucuauagcauuaguauacacuggcac

SEQ ID NO: 147648 - RNA, 61 nt, Homo Sapiens
ucaucuucccagcaucuugacaguuuccagaagaaucuaugggauuuuccccccacugguc

SEQ ID NO: 147649 - RNA, 64 nt, Homo Sapiens
cucuuagguguacucuuuauaagcugguaaaccaagaaucuagggaguggccaaacuaaauaua

SEQ ID NO: 147650 - RNA, 64 nt, Homo Sapiens
aauaaagggcaacucugacuuucuagaauauuuaagaaucuaaaggcaggcucguuuuaccuca

SEQ ID NO: 147651 - RNA, 64 nt, Homo Sapiens
cuuuucucuauggucuacaguaaaugucuacuaaagaaucuagagcuaauucuuuugcuuucug

SEQ ID NO: 147652 - RNA, 64 nt, Homo Sapiens
cgaaucaaccuuucuaccuuggcauggacucuggagaaucuaugacaaagaauuuguacuuaau

SEQ ID NO: 147653 - RNA, 64 nt, Homo Sapiens
aggacugagggagccagaggcuuggugucaugccagaaucuacccaagagccagcacugcuggc

SEQ ID NO: 147654 - RNA, 64 nt, Homo Sapiens
cuggucuuaaagucauaaauuuguacagccuuauagaaucuaaguugaccuuuucagccauaua

SEQ ID NO: 147655 - RNA, 64 nt, Homo Sapiens
uaagcuauaaaaauacucaucaaugcacaaauuaagaaucuauaucuaguauaaaacguuccca

SEQ ID NO: 147656 - RNA, 58 nt, Homo Sapiens
uucaucugagaacuucugaucaauaucaagaaucuagucagaaagaaaccuuuuguag

SEQ ID NO: 147657 - RNA, 64 nt, Homo Sapiens
aaaaaaaacaaaaaacuguuauucuuuaacaaagagaaucuaaaccauccccggaagggugcuu

SEQ ID NO: 147658 - RNA, 64 nt, Homo Sapiens
cagcaaaguuaaccugacacucagguagcuacacagaaucuacaagacuuuuucuuggacgaau

SEQ ID NO: 147659 - RNA, 64 nt, Homo Sapiens
caacucauauccacguuaucuagcaaaguacauaagaaucuaucacuaaguaauguauccuuca

SEQ ID NO: 147660 - RNA, 64 nt, Homo Sapiens
ugcauuagaaaaaaaagagauauauacaccacaaagaaucuaauaagaaauuuauuauggagau

SEQ ID NO: 147661 - RNA, 64 nt, Homo Sapiens
ugucugaaauguuuauuuugcaaaacagugcaauagaaucuaguuaugccuucaucacuguuga

SEQ ID NO: 147662 - RNA, 64 nt, Homo Sapiens
gccacuuugcucgcaggggugaggggaaggauagagaaucuauuuuuaauaaauaacauucuag

SEQ ID NO: 147663 - RNA, 64 nt, Homo Sapiens
cuuaagaauuuugagagggugaggaggguuguucagaaucuaaauuacagauagaugauuguuu

SEQ ID NO: 147664 - RNA, 64 nt, Homo Sapiens
ugggaaucagaacucuuuaugcaacuugguuaauagaaucuacuaucuggaagauaaaugaagg

SEQ ID NO: 147665 - RNA, 64 nt, Homo Sapiens
aucaacagcaaucugaagacucugacuaacaugcagaaucuacccaauaccacacugcccccau

SEQ ID NO: 147666 - RNA, 64 nt, Homo Sapiens
ccagccuuuuaacaacaucuuuugggguacaauuagaaucuaaguguuugcagccauauguguc

SEQ ID NO: 147667 - RNA, 64 nt, Homo Sapiens
auauacucauguaacaagccugcacauguaccccagaaucuaaaauaaaaauaaaaagaaaaac

SEQ ID NO: 147668 - RNA, 64 nt, Homo Sapiens
ccguuaaaaaaucaaacaaaaggaccccaaauuaagaaucuaggaagcucagaaacgaaaucua

SEQ ID NO: 147669 - RNA, 64 nt, Homo Sapiens
ccccuacauuaaagcuuugcugcuugaugucagcagaaucuaaacaaccugaaagagaaaaggc

SEQ ID NO: 147670 - RNA, 64 nt, Homo Sapiens
agaucuaauacuaguuuggauaucuuuaggguuuagaaucuaaccucaagaauaagaaauacaa

SEQ ID NO: 147671 - RNA, 64 nt, Homo Sapiens
gaaacaaccccucauccaaaucauggguuaguuaagaaucuaacuggggcaauuaagaugaauu

SEQ ID NO: 147672 - RNA, 64 nt, Homo Sapiens
accuggauuucagcuuugcaugauccucaguaugagaaucuaucuguucugugcuggacuucua

SEQ ID NO: 147673 - RNA, 64 nt, Homo Sapiens
uccacacccagcuaaaguuagaggagauacauauagaaucuauuuuagauuauuguuaacuauu

SEQ ID NO: 147674 - RNA, 64 nt, Homo Sapiens
uucuguucuagcuggcuacugcuucacuggauugagaaucuaucuaucuccuugcacacauggg

SEQ ID NO: 147675 - RNA, 64 nt, Homo Sapiens
ugcgggaagacggaucccaccucccuuucuuagcagaaucuaaauuacagccagaccucuggcu

SEQ ID NO: 147676 - RNA, 64 nt, Homo Sapiens
acccacccugcaccccucgcccuccccccaccacagaaucuaagaccuuucagcuucgagccag

SEQ ID NO: 147677 - RNA, 64 nt, Homo Sapiens
uugcuucuuugaugugauaguuuugagaugggugagaaucuaauagaucugugguugaauuugc

SEQ ID NO: 147678 - RNA, 64 nt, Homo Sapiens
ugacucugucccuggagugacaaugauuuacaaaagaaucuacuugguugugcucuuuucuggc

SEQ ID NO: 147679 - RNA, 64 nt, Homo Sapiens
aauguucacaagguaccccaagugaaugccauuuagaaucuagagcaaugaugacccacuaaag

SEQ ID NO: 147680 - RNA, 64 nt, Homo Sapiens
ccuagaaauaccauuugacccaucugauuccucaagaaucuagaccuucauaaagaaugccacc

SEQ ID NO: 147681 - RNA, 64 nt, Homo Sapiens
gcuugaugaccugagguguaaugcgcuccuuaugagaaucuaaugcaugcaagggaucuaggcu

SEQ ID NO: 147682 - RNA, 64 nt, Homo Sapiens
uguccaaguucuccucucccuggucaugcuuccuagaaucuacucugccacugucagauagccu

SEQ ID NO: 147683 - RNA, 64 nt, Homo Sapiens
aaggggaugacugucucaaaugugcccuaguuacagaaucuauuguggucacacagagguagca

SEQ ID NO: 147684 - RNA, 64 nt, Homo Sapiens
cuuucuuguauacauuuuucgugcauguggagaaagaaucuagaggaacuuuauuccaaaagua

SEQ ID NO: 147685 - RNA, 64 nt, Homo Sapiens
ugagaauauagaaagucuuuaauuaaaccugaugagaaucuacuugguguauagaugagaaugc

SEQ ID NO: 147686 - RNA, 64 nt, Homo Sapiens
uuccagauugaggauuuagugcugcuuugugcucagaaucuacauuauuuuuuagguuaacuga

SEQ ID NO: 147687 - RNA, 64 nt, Homo Sapiens
ggucauuaggguguauuucccagguuuccaauugagaaucuaaaccaagagaagugagacaaac

SEQ ID NO: 147688 - RNA, 64 nt, Homo Sapiens
auuuggcacaagucagagauaauugccuauacuaagaaucuauacugcagaauauaguguauca

SEQ ID NO: 147689 - RNA, 64 nt, Homo Sapiens
gaaauccacauucuuacacaagaaagaccauauuagaaucuaaggaaaacaugcauauucacau

SEQ ID NO: 147690 - RNA, 64 nt, Homo Sapiens
auuuuccucccuuucucuguaccucuaagaagaaagaaucuaacugaaaauaccaaaaaaaaaa

SEQ ID NO: 147691 - RNA, 64 nt, Homo Sapiens
ucuguugauuuuuaaaacuuugaucauuaucuaaagaaucuaauauguuguuuucugacuaggc

SEQ ID NO: 147692 - RNA, 64 nt, Homo Sapiens
aagcuuuaauaaucuuccccuuugaccaauugacagaaucuaauuguugaaauacauuuuuucu

SEQ ID NO: 147693 - RNA, 64 nt, Homo Sapiens
gcgugggacaguaaaggaucacacguaaaguagaagaaucuaguuaauaaaguuuugaaaaguu

SEQ ID NO: 147694 - RNA, 64 nt, Homo Sapiens
aucuagggugacauuccuugaaguaaaucccaggagaaucuaggccaaagagaugagccaaggu

SEQ ID NO: 147695 - RNA, 64 nt, Homo Sapiens
gcccuuuuuuccuuuguccaaaaugauucuaaauagaaucuaauaaaccaauguagcauuauuu

SEQ ID NO: 147696 - RNA, 64 nt, Homo Sapiens
uauaaucugaaaggggcagauuaaaaaaaaaaaaagaaucuaaaccuuacauguguaaagguuu

SEQ ID NO: 147697 - RNA, 64 nt, Homo Sapiens
ccccggaaacucacaggggcccucuucccagaaaagaaucuauucuaucacuucagaaucagga

SEQ ID NO: 147698 - RNA, 64 nt, Homo Sapiens
cauucucugggcaaaauaauauuaaauggauuaaagaaucuaaaaccagugggaaaacugucug

SEQ ID NO: 147699 - RNA, 64 nt, Homo Sapiens
cuauagcagggaugauuuauaacuacuaccuaggagaaucuaagcucauuuuccuucugaaaga

SEQ ID NO: 147700 - RNA, 64 nt, Homo Sapiens
uuccaagcacauuuacugaaaaaguaucugaacaagaaucuauaaucucuggcaacagagaggc

SEQ ID NO: 147701 - RNA, 64 nt, Homo Sapiens
acuaggcauaaccuuacauaaaugcaggucuuucagaaucuagaauggguugugcaagcauuaa

SEQ ID NO: 147702 - RNA, 64 nt, Homo Sapiens
agcuuguaauagcaaaauuguaaauuacaagggaagaaucuacuuuuuagaaaucgcuuuguuu

SEQ ID NO: 147703 - RNA, 64 nt, Homo Sapiens
uuauuuugcauuuggcuaauggauaguugugguaagaaucuagugaauaguugcaguguuuaua

SEQ ID NO: 147704 - RNA, 64 nt, Homo Sapiens
ugaaauuauaguaaaauuuccuuaguaaaaguacagaaucuauucuauucaaauugguuucauu

SEQ ID NO: 147705 - RNA, 64 nt, Homo Sapiens
uuaauuccuuauuucuucauaguaaaucuaaauaagaaucuauuacuugaaucauuucugaaua

SEQ ID NO: 147706 - RNA, 64 nt, Homo Sapiens
ggccuuuuacaggguauuaaauuuuuauuagaaaagaaucuauuguuugugucuuuguagcagu

SEQ ID NO: 147707 - RNA, 64 nt, Homo Sapiens
uagucuaaugcugacaacuuacagccaagauuacagaaucuauagucugguccaucaaauuaca

SEQ ID NO: 147708 - RNA, 64 nt, Homo Sapiens
ucuuaaaauauccacaauauuccuugagugagucagaaucuauagccgguuagugaugguuuca

SEQ ID NO: 147709 - RNA, 64 nt, Homo Sapiens
aauuugggcagcuaaugaaugucaugaaagcuguagaaucuacaucaccauccauugcuuuaau

SEQ ID NO: 147710 - RNA, 64 nt, Homo Sapiens
agagcagugaaggugagguacuugcugccacagcagaaucuaaagaaagcauugaguccugggg

SEQ ID NO: 147711 - RNA, 64 nt, Homo Sapiens
augggggucucucuucagacucuucucguuucugagaaucuagucuacuguugguugagcuucu

SEQ ID NO: 147712 - RNA, 64 nt, Homo Sapiens
ucauauuuuauauuccuaauaacagugaugacugagaaucuauuugaguuuccagcuggcagaa

SEQ ID NO: 147713 - RNA, 64 nt, Homo Sapiens
aggguauaguaucacuccugaguuccacugcucuagaaucuaaccagaaauagaaaccuaguuu

SEQ ID NO: 147714 - RNA, 64 nt, Homo Sapiens
gaagcuccuuuagauugggauagauuccaaauaaagaaucuagaaauaggagaagauuuaauua

SEQ ID NO: 147715 - RNA, 64 nt, Homo Sapiens
uugaaaacuugucuuagaaugcgaaucuguguuaagaaucuagucuuuguaauagaaguuuccc

SEQ ID NO: 147716 - RNA, 64 nt, Homo Sapiens
aacauuaaaaugcuggggcaaugcaugguuggugagaaucuaauuuaucucaggaaaggaaaau

SEQ ID NO: 147717 - RNA, 64 nt, Homo Sapiens
agauguguaaacagguauuugucuggcguucucaagaaucuagaaauuuggccuuaagaacugu

SEQ ID NO: 147718 - RNA, 64 nt, Homo Sapiens
guggaggcuggcagguuuuucugcaagaugguccagaaucuaaaaugucccauuaaucugguca

SEQ ID NO: 147719 - RNA, 64 nt, Homo Sapiens
uagagcuauucugcacaguuaacuacugaucuuuagaaucuaaaauuguauaugaacuuauucu

SEQ ID NO: 147720 - RNA, 64 nt, Homo Sapiens
ccauuccuaaagauuugggguuuucuaaaacuaaagaaucuaggaaccuugccugcgaccaauc

SEQ ID NO: 147721 - RNA, 64 nt, Homo Sapiens
cugaggcugggcuauugcuucucccuugcuucaaagaaucuagcagcgggggauaggauuuugc

SEQ ID NO: 147722 - RNA, 64 nt, Homo Sapiens
cucucucuuuuuuuuuuuuuuacuuaaucuagcuagaaucuauuucuguugauuacaacuuaac

SEQ ID NO: 147723 - RNA, 64 nt, Homo Sapiens
cuucugggacugcugugaggcagaggaaugauggagaaucuaguguagcagccuccaggcagga

SEQ ID NO: 147724 - RNA, 64 nt, Homo Sapiens
gugacaauagggcuaaauguuuaaagaaaucaaaagaaucuauuagauuuuagaaaaacauuua

SEQ ID NO: 147725 - RNA, 64 nt, Homo Sapiens
uugccagggccuguggaggucuaggccgccuggcagaaucuagcaccguccgaauccccgcagg

SEQ ID NO: 147726 - RNA, 64 nt, Homo Sapiens
uaaggcgccgcggggagggcacagaguauagugaagaaucuauuucuuguacauacuguaacau

SEQ ID NO: 147727 - RNA, 64 nt, Homo Sapiens
cgugucauuuaaagaaaaguacuuuaacaacugaagaaucuauguggcuucgguuacauauugg

SEQ ID NO: 147728 - RNA, 64 nt, Homo Sapiens
gcuguauuguuguccacugcgauaguggccaaggagaaucuaggguaagagagaggccaguugu

SEQ ID NO: 147729 - RNA, 64 nt, Homo Sapiens
cuuacaaugccuuccuacaguccuuugaugcugcagaaucuacuccaccucuuuuagagaauua

SEQ ID NO: 147730 - RNA, 64 nt, Homo Sapiens
cauuuuagacuuuuuuuuauaggaagguuuaaggagaaucuaagcuggccuuugguguugaaau

SEQ ID NO: 147731 - RNA, 64 nt, Homo Sapiens
ccagaacaaggaagucacuuuucaguggauccaaagaaucuacuccuuaaaccuggagaagaac

SEQ ID NO: 147732 - RNA, 64 nt, Homo Sapiens
aucauauucaaaaaaggcagcauucaaauuauauagaaucuaguuuuuaaaaucagcacagauc

SEQ ID NO: 147733 - RNA, 64 nt, Homo Sapiens
ucaaguauuuugaaggaagcgugaauaagauggcagaaucuaaaaagaguuucuuagguucuau

SEQ ID NO: 147734 - RNA, 64 nt, Homo Sapiens
uccucaggaaaugguccuuuagccauauauuuucagaaucuauaugacaaguguagcaaaagcc

SEQ ID NO: 147735 - RNA, 64 nt, Homo Sapiens
cgcaaccuacucaucugacaaagggcuaauauccagaaucuacaaugaacucaaacaaauuuac

SEQ ID NO: 147736 - RNA, 64 nt, Homo Sapiens
uauaaugagggacaugacaaaaucuguguccacuagaaucuaagcuccaugcaggaacauuguu

SEQ ID NO: 147737 - RNA, 64 nt, Homo Sapiens
gcaggagauguaagcagaugaguuauuuuuuaagagaaucuaaucuaauuguuuuuauaaaaau

SEQ ID NO: 147738 - RNA, 64 nt, Homo Sapiens
uguuuacaaacugcaucugacaaagaucuaauccagaaucuauaaagaacucaaacaaaucaac

SEQ ID NO: 147739 - RNA, 64 nt, Homo Sapiens
guagcgcuuucucagauuucauaugacgcgucacagaaucuaggauauauauacagauauauau

SEQ ID NO: 147740 - RNA, 64 nt, Homo Sapiens
ucccaacugccaugugauuaaggggacuaacagcagaaucuaccuccauuucugugugugucaa

SEQ ID NO: 147741 - RNA, 64 nt, Homo Sapiens
ugcuguuggaccuguguggcugucuugaacauaaagaaucuaucguuuuuguaucugaauuugc

SEQ ID NO: 147742 - RNA, 64 nt, Homo Sapiens
ccugggcaacuucacauccgcacuuuggagagacagaaucuaguacagagaacagggcuugggc

SEQ ID NO: 147743 - RNA, 64 nt, Homo Sapiens
acuugguaauuauacugcauucacagaucacucuagaaucuaauacuguucugggguagcagag

SEQ ID NO: 147744 - RNA, 64 nt, Homo Sapiens
gaaugugcaaccuaauuguaaccgggccaagugaagaaucuaauuuauagaugugagccagcac

SEQ ID NO: 147745 - RNA, 64 nt, Homo Sapiens
cuggacagaaaucuuacaaaucauuagacaucagagaaucuauacuuugcuucacguucacacg

SEQ ID NO: 147746 - RNA, 64 nt, Homo Sapiens
augaauaaagaucuaacaaguugcaaaucauuggagaaucuauacuucaguaacgcuacaacca

SEQ ID NO: 147747 - RNA, 64 nt, Homo Sapiens
cacacacacuuauuaauuacuacuucaucucaaaagaaucuacuucaaggaagaacaagauaua

SEQ ID NO: 147748 - RNA, 64 nt, Homo Sapiens
uagauguuuaugugcuuuuuguauccuaacuuuuagaaucuaaauaaaaucagagguaauguau

SEQ ID NO: 147749 - RNA, 64 nt, Homo Sapiens
cuauggaagaacuagaaucucacucacaguaauaagaaucuaggaggaauuccaaaccgaagca

SEQ ID NO: 147750 - RNA, 64 nt, Homo Sapiens
cagugccacgagggaggaggggaccugcaaagcuagaaucuagggcacuguuuccuccccaucc

SEQ ID NO: 147751 - RNA, 64 nt, Homo Sapiens
aaagaacagccugagccaaggccuagugguaguaagaaucuagcaagaauugaggaagaauggu

SEQ ID NO: 147752 - RNA, 64 nt, Homo Sapiens
agaccuacugagugagaaucuugaggguggaaucagaaucuauuuugaaaaggcauccccaaau

SEQ ID NO: 147753 - RNA, 64 nt, Homo Sapiens
acauccgguuguguccugugggagggucagaggcagaaucuacuuacagugguguaauuaaagu

SEQ ID NO: 147754 - RNA, 64 nt, Homo Sapiens
ggaucuuuggcuggaaaacuacauuuuuuguuacagaaucuauucauauuuuuaaguauuauuc

SEQ ID NO: 147755 - RNA, 64 nt, Homo Sapiens
uuuaacaagaucugcaggggccauccaguucaugagaaucuauagcagaauccuaggcuccacc

SEQ ID NO: 147756 - RNA, 64 nt, Homo Sapiens
gauuuguacaaugugaaauaaccagugaauaaagagaaucuaaguguauuuguuguagaaaugg

SEQ ID NO: 147757 - RNA, 64 nt, Homo Sapiens
uccgcccucaagcccauacuuaaacuuccaguuaagaaucuaggacugggauuggaucacuucu

SEQ ID NO: 147758 - RNA, 64 nt, Homo Sapiens
aacuuggucaaacuaguuagcaaauuagaacuucagaaucuaaugauaguuuaggguuucuaaa

SEQ ID NO: 147759 - RNA, 64 nt, Homo Sapiens
cacaccccugugugauaugugaugcccucggcaaagaaucuacuggaauagauuccgaggagca

SEQ ID NO: 147760 - RNA, 64 nt, Homo Sapiens
agaauaaaugccaagagggaucuucacauuucccagaaucuagacaggauuucauuuugcccug

SEQ ID NO: 147761 - RNA, 64 nt, Homo Sapiens
uaagaguuuaauauaugagguacuuugaauucaaagaaucuauugugccucuccuauugacccu

SEQ ID NO: 147762 - RNA, 64 nt, Homo Sapiens
cuuggcuggcucuccggaguagagaaaugaauaaagaaucuacuuuuuuuuuuuaagaaaaaaa

SEQ ID NO: 147763 - RNA, 64 nt, Homo Sapiens
gcacucgucuacuguuuuaauauuugauauucagagaaucuaaacagugucuaucuguauauau

SEQ ID NO: 147764 - RNA, 64 nt, Homo Sapiens
cgcauguaugcaugcacaaacccucgccuucaggagaaucuacaacagacuucuggccuaggac

SEQ ID NO: 147765 - RNA, 64 nt, Homo Sapiens
guucuuuuuuuaaauuguagauuuauuuaguuucagaaucuaaguuuaugaauggcaugaauca

SEQ ID NO: 147766 - RNA, 64 nt, Homo Sapiens
aacagaaugaguugguuuauggggaaaagagaagagaaucuaaaaaauaaacaaaucccuaaca

SEQ ID NO: 147767 - RNA, 64 nt, Homo Sapiens
uccucacaguucuggagccuggaagucugagaucagaaucuagcaagguuaggucuuggugacg

SEQ ID NO: 147768 - RNA, 64 nt, Homo Sapiens
cagugugacuuugccacuucacccaucaagagguagaaucuauuucuucaaccccugcaacuga

SEQ ID NO: 147769 - RNA, 64 nt, Homo Sapiens
agugcacacaccacaguguaaauuaugccuuaucagaaucuaaaugaaaauagcgaacauuuaa

SEQ ID NO: 147770 - RNA, 64 nt, Homo Sapiens
gaaauuaagauuuuaagcuugaaauuauacaagcagaaucuaauuuaauuuugauugacugaag

SEQ ID NO: 147771 - RNA, 64 nt, Homo Sapiens
augacauugaaguuguuggagcgaauuuauuccaagaaucuacaaaagaggggaagauauggga

SEQ ID NO: 147772 - RNA, 64 nt, Homo Sapiens
uuauccuuccuuuuaauagucuguuuuauaguauagaaucuacucuuuuaucagagguaggauu

SEQ ID NO: 147773 - RNA, 64 nt, Homo Sapiens
cagaauauucaaauuauagacuauaaaguguuuaagaaucuacaaacuacaaacuggaauccaa

SEQ ID NO: 147774 - RNA, 64 nt, Homo Sapiens
ccaccccaaccucuguucccugcuccgcauacugagaaucuagguguuuaucugauuuuuuuau

SEQ ID NO: 147775 - RNA, 64 nt, Homo Sapiens
cuccccucuguccuauuggagagggggcucugagagaaucuagcaaggaagcaguugccuuccg

SEQ ID NO: 147776 - RNA, 64 nt, Homo Sapiens
cuagaguaaaaccaaguugggccaaguguccugcagaaucuaaaaugaaguuuaaucagcgugc

SEQ ID NO: 147777 - RNA, 64 nt, Homo Sapiens
uacacuuucucaaugaaugaacaaauuagucuguagaaucuagccaccuguuuagccuagucau

SEQ ID NO: 147778 - RNA, 64 nt, Homo Sapiens
cccagauccaagcagccugaggcaaugaugaaugagaaucuaccuaguaauugacaugugccag

SEQ ID NO: 147779 - RNA, 64 nt, Homo Sapiens
gaacauaauucuuuuguugcuguuuguuuaagaagcaccuuaguuuguuuaagaagcaccuuau

SEQ ID NO: 147780 - RNA, 64 nt, Homo Sapiens
guuuguuuaagaagcaccuuaguuuguuuaagaagcaccuuauauaguauaauauauauuuuuu

SEQ ID NO: 147781 - RNA, 64 nt, Homo Sapiens
acagccuggcagcucgugccauugcagugcagaagggcaguaucggcaaccuccugggcuuccu

SEQ ID NO: 147782 - RNA, 64 nt, Homo Sapiens
gguacgucugagcccaagaguucaagaucagccugggcaguauagcaagaccccaucuccauuu

SEQ ID NO: 147783 - RNA, 64 nt, Homo Sapiens
ucccagugggaggcgcgagccaugauguggaguggggcaguagaaggucggaggcuugggaccg

SEQ ID NO: 147784 - RNA, 64 nt, Homo Sapiens
gguuggaagaugcaaaguuuauaccugaugaucagggcaguaggcauaauucagcaacaaacaa

SEQ ID NO: 147785 - RNA, 64 nt, Homo Sapiens
aagaccugucgucaaacuuaaaagguuuugcagagggcaguaucaaaagaaagugguuuucuuc

SEQ ID NO: 147786 - RNA, 64 nt, Homo Sapiens
aauaugaagaaaaauacacagccaccucuguccagggcaguaagaagggcugcaaggaagggga

SEQ ID NO: 147787 - RNA, 64 nt, Homo Sapiens
gagauuccuuaaaccuuccuaauuuccugcuccagggcaguaaacacaaauauuucuucaaggg

SEQ ID NO: 147788 - RNA, 64 nt, Homo Sapiens
ugcuuuaugcuggacccaguaagaugaggaagucgggcaguacacaggaagaggagccaggccc

SEQ ID NO: 147789 - RNA, 64 nt, Homo Sapiens
gccaggggugccgcuaaacauccuauaaugcacagggcaguaccccacaacgaaaaauaaucug

SEQ ID NO: 147790 - RNA, 64 nt, Homo Sapiens
ccaacaggagaggaggccuccugggguuuccccagggcaguaggucaaacgaccucaucacagu

SEQ ID NO: 147791 - RNA, 64 nt, Homo Sapiens
gacagaauucucccagcguuaacacaaaauccaugggcaguaugauggcagguccucuguugca

SEQ ID NO: 147792 - RNA, 64 nt, Homo Sapiens
uuucccuggguggagcaggacucccaccuaaacggggcaguacuccucccugggggcgggacuc

SEQ ID NO: 147793 - RNA, 64 nt, Homo Sapiens
uaaaacaaccaguuaaagccacagauggcuuucagggcaguagcagcagaggccaguggacucu

SEQ ID NO: 147794 - RNA, 64 nt, Homo Sapiens
ucucaucgggggugcgcacaccaucguuacugucgggcaguaacugccgcuugccuugccgcag

SEQ ID NO: 147795 - RNA, 64 nt, Homo Sapiens
gagacgucggacuucacgguaagggccccacccugggcaguauauccugagcuucaugguggag

SEQ ID NO: 147796 - RNA, 64 nt, Homo Sapiens
ugggaaaggacccacccaucgaaugcagggaagagggcaguaccucuggaaggcuggcugagug

SEQ ID NO: 147797 - RNA, 64 nt, Homo Sapiens
uuuuuaugaacuauaaaugauuuuguguauaucagggcaguauugggugggugggaguagaaaa

SEQ ID NO: 147798 - RNA, 64 nt, Homo Sapiens
cacacaguuugcugagugaaagaugcccugcaaagggcaguaacucaugucuuuccccaaauga

SEQ ID NO: 147799 - RNA, 64 nt, Homo Sapiens
ccccgccuuuaguucuccacaaggaagcugggcugggcaguaucaaacuaagagcucucaaguc

SEQ ID NO: 147800 - RNA, 64 nt, Homo Sapiens
ucaaaucgguccccugucgaguucggcucugggugggcaguaggaccaccagugugggguucug

SEQ ID NO: 147801 - RNA, 64 nt, Homo Sapiens
uauuugugcaggucaugcacacaguuuugauaaagggcaguaacaaguauuggggccuauuuuu

SEQ ID NO: 147802 - RNA, 64 nt, Homo Sapiens
aucuaccauuaaaacaacaaauggcuugcagacagggcaguaaugguuuauccuaaauuacuca

SEQ ID NO: 147803 - RNA, 64 nt, Homo Sapiens
gccuaccuagaaucugccugaaagggcuggagaggggcaguauugggggacugugcuagcuuua

SEQ ID NO: 147804 - RNA, 64 nt, Homo Sapiens
uggcagccuugugaugucauacagagaagucacagggcaguaccugagggucuguagguugcac

SEQ ID NO: 147805 - RNA, 64 nt, Homo Sapiens
cagacacacaguaaauaauggcugaccagcaugagggcaguacugucagaaauuucuuugagcu

SEQ ID NO: 147806 - RNA, 54 nt, Homo Sapiens
guaguuguggaggauugugagucugggcaguaaauccacagccaacaaacauag

SEQ ID NO: 147807 - RNA, 64 nt, Homo Sapiens
ugauggggauggcauugaaucuauaaauuaccuugggcaguauggccauuuucacgauauugau

SEQ ID NO: 147808 - RNA, 64 nt, Homo Sapiens
gcauuaacuaaaaaaguuuauuuuccuuuugucugggcaguagugaaaauaacuacucacaaca

SEQ ID NO: 147809 - RNA, 64 nt, Homo Sapiens
uuaagagcagggacuguucuuauuuucagaaaaagggcaguauagaauaaauaugaaauugaac

SEQ ID NO: 147810 - RNA, 64 nt, Homo Sapiens
gagcacuuacccgaccccaaggcagcuaaaacgagggcaguagaugccauauagacgagauaaa

SEQ ID NO: 147811 - RNA, 64 nt, Homo Sapiens
aguuacuuuugagaguuuucucuuaagaauaguagggcaguaaccuuuauucaaauuuuaagua

SEQ ID NO: 147812 - RNA, 64 nt, Homo Sapiens
auuggguccugggucuuucagcuuugcccugguagggcaguaacagccaccaucuuugcagguu

SEQ ID NO: 147813 - RNA, 64 nt, Homo Sapiens
acaaaauagcuggcgagugccagcauuaugcuuugggcaguauuauaauaugcuuugauugaug

SEQ ID NO: 147814 - RNA, 64 nt, Homo Sapiens
agcgcugcggugucaccucugcuccauuggggacgggcaguacagggcgugcuagaggugucac

SEQ ID NO: 147815 - RNA, 64 nt, Homo Sapiens
auugugagaggcaguucauuagcaaagauguacugggcaguaacuaaacacacaugcaaacaug

SEQ ID NO: 147816 - RNA, 64 nt, Homo Sapiens
gaaauguagccaaauuggaguccauucuucuuuagggcaguauaugaaauccuagcagauguaa

SEQ ID NO: 147817 - RNA, 64 nt, Homo Sapiens
uggcacuucccagggccuggcaguauggucugaugggcaguaugguccaauaggcagcauccuc

SEQ ID NO: 147818 - RNA, 64 nt, Homo Sapiens
cuaagggcucacaaccaaagugauccgccaagcagggcaguaucuggguuacagccacagcagg

SEQ ID NO: 147819 - RNA, 64 nt, Homo Sapiens
ccuaagcuucugagaaucauguggcaagugugaugggcaguaaaauaccagagaagauguuuag

SEQ ID NO: 147820 - RNA, 64 nt, Homo Sapiens
guugcugagcuucucuccaaagucuaaaaugguggggcaguagggaccugugagaggcccaaug

SEQ ID NO: 147821 - RNA, 64 nt, Homo Sapiens
ugagaguuccagauuguucuguccaguuuccaaagggcaguaaaguuuucgugccgguuuucag

SEQ ID NO: 147822 - RNA, 64 nt, Homo Sapiens
aacaauuuguucuuuuguuguuuuugccaguuuagggcaguagcugcuuuugucauaaauaucu

SEQ ID NO: 147823 - RNA, 64 nt, Homo Sapiens
ucauuucaaauguuuugguuauucaugaucacuugggcaguauaagaaaauguagcuucugaau

SEQ ID NO: 147824 - RNA, 64 nt, Homo Sapiens
gcugugcaacccagcugcaaggggcaucucauuugggcaguacuuguuggcaccagcccgggca

SEQ ID NO: 147825 - RNA, 64 nt, Homo Sapiens
acaaagugucuuaaaaguuuaaauguauuuugaugggcaguaaaacugauucuuuucuauuuau

SEQ ID NO: 147826 - RNA, 64 nt, Homo Sapiens
ccuucauuaguguagauaguggcuucagccaugggggcaguagcucucuccuguaccauucugu

SEQ ID NO: 147827 - RNA, 64 nt, Homo Sapiens
uuuaaguccagacuuggcacgaugcagaaagguagggcaguaugagauacaggcugguauagag

SEQ ID NO: 147828 - RNA, 64 nt, Homo Sapiens
ccuguguggcccuguucccaaagggacguucugugggcaguagccaggggaggaggaccagguc

SEQ ID NO: 147829 - RNA, 64 nt, Homo Sapiens
cucagugaauuguuauuguuugcaaaaaugcacugggcaguaacauuuugugauaaauccuaua

SEQ ID NO: 147830 - RNA, 64 nt, Homo Sapiens
gaauacuuggaauucuaauuguuuugugugccaggggcaguaaugucccugccucuucucccaa

SEQ ID NO: 147831 - RNA, 64 nt, Homo Sapiens
auacuguuuuaaagugaagguaguauacuagaaagggcaguauaauguuaaacuuuaucuuaau

SEQ ID NO: 147832 - RNA, 64 nt, Homo Sapiens
aucaguucuauaauguaaaaguuuggcucaauuagggcaguaucuuuuuuccaaaguuuucuau

SEQ ID NO: 147833 - RNA, 64 nt, Homo Sapiens
augugauguccagcacccuagucagucuauuccugggcaguaguaccucaucuugauucagacu

SEQ ID NO: 147834 - RNA, 64 nt, Homo Sapiens
uguauuuuucauccaucuuuucugaagugucuuugggcaguauguaguuauuuauuacaaaauu

SEQ ID NO: 147835 - RNA, 64 nt, Homo Sapiens
gaugauggauggucgggauugaggcuguugaccugggcaguagcuccucccauggccagugguc

SEQ ID NO: 147836 - RNA, 64 nt, Homo Sapiens
caauaggcauuugauuuugccuugauuccuugcugggcaguauccauguuaccuagagcaggca

SEQ ID NO: 147837 - RNA, 64 nt, Homo Sapiens
gagugugguugagguuugagguccuggucgagcagggcaguacuggaccaggucuacgucagca

SEQ ID NO: 147838 - RNA, 64 nt, Homo Sapiens
cucccucucuuuuuccucuguagagaaaugugaggggcaguacauuuacugugcuuuucacacc

SEQ ID NO: 147839 - RNA, 64 nt, Homo Sapiens
agaaaaaugcauguauuuaccucuucaaccaaaagggcaguaaagaauagggauaauauauuuu

SEQ ID NO: 147840 - RNA, 64 nt, Homo Sapiens
acuguuuaugcugugauuucacucugucuaucaugggcaguauuagaaaacacacugguuuuca

SEQ ID NO: 147841 - RNA, 64 nt, Homo Sapiens
acaccauguucuuucccacccuaacaacaacaaagggcaguaaauuaaaguacucuuuguaagg

SEQ ID NO: 147842 - RNA, 64 nt, Homo Sapiens
gucuuagccuguagacaugcugcuaguaucagaggggcaguagagcuuggacagaaagaaaaga

SEQ ID NO: 147843 - RNA, 64 nt, Homo Sapiens
cucuucccacuuccucguccucgugagaaccugugggcaguauucaagcccugaugacaaaacc

SEQ ID NO: 147844 - RNA, 58 nt, Homo Sapiens
ucuauccaacuuaaaaaggcagguuuccgggcaguaauuucguggggagagagcguag

SEQ ID NO: 147845 - RNA, 64 nt, Homo Sapiens
uuccugaugucuucuuagcuggaaugaauacuuugggcaguaucaaacugaaagcaagucaugg

SEQ ID NO: 147846 - RNA, 64 nt, Homo Sapiens
auuacaaauggaucugaaauugcauauuuuaugggggcaguauuagauaaacuucuguaaccua

SEQ ID NO: 147847 - RNA, 64 nt, Homo Sapiens
augugacagagcccaaagcaccuaccaccaggaugggcaguaaugggagcucacagcaacaccc

SEQ ID NO: 147848 - RNA, 64 nt, Homo Sapiens
cuagaccccugccacuaacaggcuaggagacuuugggcaguaaugggaggcacugaggguuugc

SEQ ID NO: 147849 - RNA, 64 nt, Homo Sapiens
aaccguucuagaaagccacuaacgcauucacucggggcaguauugccucauucguaccaugcca

SEQ ID NO: 147850 - RNA, 64 nt, Homo Sapiens
uucugauggugugcaugugauacugaaaguccuggggcaguaucuuauccuuaggcccuagaga

SEQ ID NO: 147851 - RNA, 64 nt, Homo Sapiens
ggaagaaaugcuagccuggaagauccucuagccugggcaguagacuuaaaguaggaucaaaucu

SEQ ID NO: 147852 - RNA, 64 nt, Homo Sapiens
cucccugaggugaacguuguuggguugcuagcaagggcaguagcuuaaauacuuuuguugccua

SEQ ID NO: 147853 - RNA, 64 nt, Homo Sapiens
gggugggugccugucaccuugaggugaccaucuagggcaguaccugcugggcuuaggacagcgc

SEQ ID NO: 147854 - RNA, 64 nt, Homo Sapiens
ugaugaagagaaaaaaaaguugagaagcuugaaugggcaguagacuguacaacucaaucaagaa

SEQ ID NO: 147855 - RNA, 64 nt, Homo Sapiens
cuccauugggcacaguccagcccucccugccugagggcaguaccggaaucuacaagccaaaagu

SEQ ID NO: 147856 - RNA, 64 nt, Homo Sapiens
ugcacacgcggcgcugucagcccaaggccgggaagggcaguaacgggucggcccgcagauggca

SEQ ID NO: 147857 - RNA, 64 nt, Homo Sapiens
ucaacaaggaauagagggaggggggauucuacgggggcaguagcugggcuuuggguauaaagga

SEQ ID NO: 147858 - RNA, 64 nt, Homo Sapiens
guuaagaugcgugggcaggggcuguguaaguuaagggcaguaacaaguggcgcagccaggccaa

SEQ ID NO: 147859 - RNA, 64 nt, Homo Sapiens
aggugaaggccugcgcacugaacuguaaggcagugggcaguacaggguaacuggaggcggggcc

SEQ ID NO: 147860 - RNA, 64 nt, Homo Sapiens
cuuuggaaagaaugugaaaugugugccagacaccgggcaguacaauugucauauuguaacaugc

SEQ ID NO: 147861 - RNA, 64 nt, Homo Sapiens
uuugucuuguauauguauguauauuggguccucugggcaguagaggcaaagcucaccucccaug

SEQ ID NO: 147862 - RNA, 64 nt, Homo Sapiens
cucuuuucuuugcaagauauaucacagcugcuuugggcaguagcugaagccgaaguaugaacag

SEQ ID NO: 147863 - RNA, 64 nt, Homo Sapiens
agggugagagaggggagggaggggaauaaggugugggcaguagagggaaucugucagucucaug

SEQ ID NO: 147864 - RNA, 64 nt, Homo Sapiens
ugguuuccuguuagauaaggguuccagcagccuggggcaguaugucucagcuggaauggaaaga

SEQ ID NO: 147865 - RNA, 64 nt, Homo Sapiens
cguacacuaggggguccuacagcuacguggccgugggcaguacugggggcgaccuggaccugcu

SEQ ID NO: 147866 - RNA, 64 nt, Homo Sapiens
uuugcugugcaaugacuggaaggccgcccggcaugggcaguagagaccccuggccucugagcac

SEQ ID NO: 147867 - RNA, 64 nt, Homo Sapiens
cugaagauaacagugcacaauuuuuaucucugaagggcaguagcaacaugguauuggcuuaucg

SEQ ID NO: 147868 - RNA, 64 nt, Homo Sapiens
cuauggccccaggguugaaaaguuaugagggucagggcaguaucucucugccuauuuauugggg

SEQ ID NO: 147869 - RNA, 64 nt, Homo Sapiens
aggaguuggagagcacaguugccccguugugugagggcaguaguaggcaucuggaaugcuccag

SEQ ID NO: 147870 - RNA, 64 nt, Homo Sapiens
aacaccucaccuugaaacuguagcaguguguucugggcaguaucuguaauguaugaaauagagu

SEQ ID NO: 147871 - RNA, 64 nt, Homo Sapiens
ggauggcaucagaauugucuggaaguuuugucuugggcaguaugggcugggccaaaugaaauga

SEQ ID NO: 147872 - RNA, 64 nt, Homo Sapiens
aaacuuacucucuuuuuuccgaggaggagguagggggcaguaaaguaaggagcggggcacgggg

SEQ ID NO: 147873 - RNA, 64 nt, Homo Sapiens
cagggucaggguggucaagguauuuccaguagaugggcaguaaauuucaaaugacauuggucuu

SEQ ID NO: 147874 - RNA, 64 nt, Homo Sapiens
cuaagguguggcugucuuggaaacucauuaguuugggcaguauaaacgaguauuuguauuuauu

SEQ ID NO: 147875 - RNA, 64 nt, Homo Sapiens
aagaaaucugucuccacagcgugcuaggcguggugggcaguauaaagcccgugugccaggcacu

SEQ ID NO: 147876 - RNA, 64 nt, Homo Sapiens
uauccccaguccccuccuagugggggauuggggugggcaguaccccuccucuguaacuucuuuc

SEQ ID NO: 147877 - RNA, 64 nt, Homo Sapiens
uacguaauugcuaaaauuauuuaauuaaaaaauugggcaguagguaacuggcauuccucucuuu

SEQ ID NO: 147878 - RNA, 64 nt, Homo Sapiens
ggacaccaguagguagugucaagccagagauucggggcaguagauaaauguucauuuuacugau

SEQ ID NO: 147879 - RNA, 64 nt, Homo Sapiens
guaaugacagugauauaaugccuggaaccugguugggcaguaggggagggagguagaaggaaaa

SEQ ID NO: 147880 - RNA, 64 nt, Homo Sapiens
cuggaggauccggaaagaguuuccgaagagugaagggcaguacaguggcuucaagaguccuuac

SEQ ID NO: 147881 - RNA, 64 nt, Homo Sapiens
aaugcccccuuacagcagaacaacaacccugugagggcaguauuacucuuaccgucaugucuug

SEQ ID NO: 147882 - RNA, 64 nt, Homo Sapiens
uguggugagguggguuuucugguuauauucucacgggcaguagccaccaacaucccauugcccu

SEQ ID NO: 147883 - RNA, 64 nt, Homo Sapiens
ugaucuugguaguaucccugaucuguccagcagggggcaguaaguugccuuggugcugccccag

SEQ ID NO: 147884 - RNA, 64 nt, Homo Sapiens
uuuacuuucucagguauguuaagagguggccuuugggcaguagauccucucagcacagagaauc

SEQ ID NO: 147885 - RNA, 64 nt, Homo Sapiens
ucuaacaaggacgccuuccacaguaauccauuaagggcaguaccaauagcagcaugacauuuag

SEQ ID NO: 147886 - RNA, 64 nt, Homo Sapiens
ccccagcuccacgccuguugcgccuacacaguaggggcaguagcggagacuauggggagcccac

SEQ ID NO: 147887 - RNA, 64 nt, Homo Sapiens
acacuuugcacacgauaaaggcaggaagcucagggggcaguagcuuuuucaagaaaagagaaau

SEQ ID NO: 147888 - RNA, 64 nt, Homo Sapiens
cagcuuuuucccagggagccguuucagggguucugggcaguaggcugggccuggccucagaacc

SEQ ID NO: 147889 - RNA, 64 nt, Homo Sapiens
cacccccuaaaauucucacccucagcuauuuugugggcaguauucaggaagagcuacuucaaac

SEQ ID NO: 147890 - RNA, 64 nt, Homo Sapiens
ucucgccccaauagccucacggcacaguacucuugggcaguaacuggacaccuuuuauuugaag

SEQ ID NO: 147891 - RNA, 64 nt, Homo Sapiens
ccauaaucccuacguguugugggagggacccagugggcaguaauuuaaucaugguggugguuac

SEQ ID NO: 147892 - RNA, 64 nt, Homo Sapiens
gccuaaugcugcagucagaagcaaugccuggcuggggcaguaggggaaauuccacccaauuuug

SEQ ID NO: 147893 - RNA, 64 nt, Homo Sapiens
uucauuucauuuaauucuuccacagaaccaguuugggcaguaggaacucaggcuucuggucugc

SEQ ID NO: 147894 - RNA, 64 nt, Homo Sapiens
uugucuuaagauauauuuuuguuuuacauguuuugggcaguauuaggugaauuuuuacaauuca

SEQ ID NO: 147895 - RNA, 64 nt, Homo Sapiens
gcuguuuggaggaaggugucugucugggaggauggggcaguaaaugagguuggcagaguggcag

SEQ ID NO: 147896 - RNA, 64 nt, Homo Sapiens
uggcagaggugaggggauaaguuagaauguaaaagggcaguaauuaggggugagggaaaggaga

SEQ ID NO: 147897 - RNA, 64 nt, Homo Sapiens
cuggcuccgaguuccccuccugggauuugcaggagggcaguacugaaccugcauucuucuccuu

SEQ ID NO: 147898 - RNA, 64 nt, Homo Sapiens
ugucccgggcugaggagcucuuaaggcaaagguggggcaguacgugcccagcggaaggaggcaa

SEQ ID NO: 147899 - RNA, 64 nt, Homo Sapiens
aaucugcauuuuaacuagucgcggggauuguggggggcaguagcuggcuguuucguggcauuuc

SEQ ID NO: 147900 - RNA, 64 nt, Homo Sapiens
ccucucuccacggaaaggucacaguggacagcccgggcaguaggaugcagccccagaggcuggu

SEQ ID NO: 147901 - RNA, 64 nt, Homo Sapiens
cagcuaccagcagagacucuauagcugucucuuagggcaguauuuuggggaaguggggcuugaa

SEQ ID NO: 147902 - RNA, 64 nt, Homo Sapiens
aucuucaaggugaccaugccccaccggggugcuggggcaguagucauggcagacucccggccug

SEQ ID NO: 147903 - RNA, 64 nt, Homo Sapiens
gcaggaggcauggggcaggguggcccaccccagugggcaguagccuggccuuuuucugugugag

SEQ ID NO: 147904 - RNA, 64 nt, Homo Sapiens
cccccacacaaaaccuucagcagaagacauuagggggcaguaggggacugugcugcaguaucac

SEQ ID NO: 147905 - RNA, 64 nt, Homo Sapiens
uccaaucagucccacucccuccugagguccccaagggcaguauucagagagguuuccugcguuu

SEQ ID NO: 147906 - RNA, 64 nt, Homo Sapiens
accccgcaccagcccugcccccaccugcccucccgggcaguacuggggaccuucccugggggac

SEQ ID NO: 147907 - RNA, 64 nt, Homo Sapiens
uugcacgggccuugccaaggcccaggagggacuugggcaguauguucauguggucauauguuuu

SEQ ID NO: 147908 - RNA, 64 nt, Homo Sapiens
auguuuugugggaggcagcauggcaccguggaaagggcaguagacguggagccggcaccucugg

SEQ ID NO: 147909 - RNA, 64 nt, Homo Sapiens
ugggcagaaacugcaggcacugaucccagaggaggggcaguagcgcuguuacgacaucccugug

SEQ ID NO: 147910 - RNA, 64 nt, Homo Sapiens
gaagguggaggcacacuccuccugaaaaaggggcgggcaguaggagggcuagaggcccuaagac

SEQ ID NO: 147911 - RNA, 64 nt, Homo Sapiens
agaaacaaaaucauggaucaggcuagguuuauuugggcaguauugugaccuuagguuuauuaaa

SEQ ID NO: 147912 - RNA, 64 nt, Homo Sapiens
ugauggacuggggagcacaggcagcacgcaggcggggcaguaugggccugggcaccagcauuug

SEQ ID NO: 147913 - RNA, 64 nt, Homo Sapiens
uuucugucaagacuauucaauuggaguuugcuaagggcaguauuuguggcaucguuuuguuuau

SEQ ID NO: 147914 - RNA, 64 nt, Homo Sapiens
caggucccaccgacacucaccuucggugccgcgugggcaguacgucacagagagcaggcagggg

SEQ ID NO: 147915 - RNA, 64 nt, Homo Sapiens
cuucaucuaauuuuagcaagguaacaguugcccagggcaguaccugaauuaacuguccauuuca

SEQ ID NO: 147916 - RNA, 64 nt, Homo Sapiens
aguccauaccagcugcgauuguuccucuuauuuggggcaguaccucuuggagccaagcucuuag

SEQ ID NO: 147917 - RNA, 64 nt, Homo Sapiens
cugcagauccugccccaagaagcugggguggugggggcaguaauuccugccccccucucugccc

SEQ ID NO: 147918 - RNA, 64 nt, Homo Sapiens
gcauacauuccuugagugacuaugaaugacugccgggcaguaacuucugggcugugguuguaaa

SEQ ID NO: 147919 - RNA, 64 nt, Homo Sapiens
gccucugcuacagccggcucuggggagggcgugggggcaguaaagcuacugaccagggcagagc

SEQ ID NO: 147920 - RNA, 64 nt, Homo Sapiens
gagcccugggagguguuugaaaacuuuauccugugggcaguagguucucccagagcccaaguaa

SEQ ID NO: 147921 - RNA, 64 nt, Homo Sapiens
gauuggguugggggaagauacccaaguccagugagggcaguaggggggccaaagguccagaccc

SEQ ID NO: 147922 - RNA, 64 nt, Homo Sapiens
gucagucuccaucucaaagaacugcccucagccugggcaguagaccgugaggcaaaaucgugcc

SEQ ID NO: 147923 - RNA, 64 nt, Homo Sapiens
cugaccacccaaauaugacugugaauuguggaaagggcaguagaucucuaauguggagguggga

SEQ ID NO: 147924 - RNA, 64 nt, Homo Sapiens
ugcucgugcugcccagaggcugaucugcaaaccugggcaguauuccacacugaagcucaguuug

SEQ ID NO: 147925 - RNA, 64 nt, Homo Sapiens
ggaagccccaaggugaccugcccacccauucucagggcaguauguaucguuugcaugcccucau

SEQ ID NO: 147926 - RNA, 64 nt, Homo Sapiens
agguggggcugccacugccccugagccggagccagggcaguauguccccuccucccaauagagg

SEQ ID NO: 147927 - RNA, 64 nt, Homo Sapiens
ucugcccacagcagacucugucccauggcucuccgggcaguagagugugugagugcagacugga

SEQ ID NO: 147928 - RNA, 64 nt, Homo Sapiens
ggguggguggggagggaugcugcauuucucagcugggcaguaaucaauuuaaugguccuuuaaa

SEQ ID NO: 147929 - RNA, 64 nt, Homo Sapiens
uccccaacucccucguuaauuguguguugcaggggggcaguaacgcugcccgagccaggaacug

SEQ ID NO: 147930 - RNA, 64 nt, Homo Sapiens
gugagaucuuuucucuacaaauaagaauuugccugggcaguauauguggugacaguuggugcua

SEQ ID NO: 147931 - RNA, 64 nt, Homo Sapiens
acuuggagcgguacccggacuggcaggccuggcagggcaguaccggguggggagcaggccuacc

SEQ ID NO: 147932 - RNA, 64 nt, Homo Sapiens
uuacuuaauaauauuauuaaauaauaauaggucugggcaguauuguuuuuaaccugacucaucc

SEQ ID NO: 147933 - RNA, 64 nt, Homo Sapiens
ggacugaugacacgagcugccauggcgggaggaggggcaguaguuauugauauggugagcccca

SEQ ID NO: 147934 - RNA, 64 nt, Homo Sapiens
auuacauguuugguaccaagaaaggaaccugucagggcaguacaaugugacuuugaaaauauau

SEQ ID NO: 147935 - RNA, 64 nt, Homo Sapiens
gguaccaaugcagaacucccagcguagugcagcagggcaguagccacucagaaguccagagucu

SEQ ID NO: 147936 - RNA, 64 nt, Homo Sapiens
ggaugaaugcuggaccgagauaagcccaugugauguccaccaguguaaccuucgcugguaaaaa

SEQ ID NO: 147937 - RNA, 64 nt, Homo Sapiens
cccuuuacaaaagaaugaacgcaucucgaacaaaguccaccaauuucucauuucuuuugaaaug

SEQ ID NO: 147938 - RNA, 64 nt, Homo Sapiens
cuggagucucauuaaaugccugauugugaaccauguccaccaguaucuggggugggcacguggu

SEQ ID NO: 147939 - RNA, 64 nt, Homo Sapiens
ccgcccccaggcugccugugucuucaccuguccuguccaccagcgccaacagccguggggaagc

SEQ ID NO: 147940 - RNA, 64 nt, Homo Sapiens
ccuucuagagccgggcugggaauggggacacgguguccaccauccccagcugguggcccugugc

SEQ ID NO: 147941 - RNA, 64 nt, Homo Sapiens
caggcccuuggcugcaggcaacacuuuagcuuggguccaccaugcagaacaccaauauuaacac

SEQ ID NO: 147942 - RNA, 64 nt, Homo Sapiens
cagcgacaacagcaccagaguccccaguucuuagccaguugagcucaaaucucaaccugagcca

SEQ ID NO: 147943 - RNA, 64 nt, Homo Sapiens
gcuccgaguuugggccaguuucccagauuuuggaccaguugaaaaaauggcaaacaucaccagc

SEQ ID NO: 147944 - RNA, 64 nt, Homo Sapiens
ucccaagaccaggacccacuauccuuucggcuucccaguugagcgcauauaaaaucucugcugu

SEQ ID NO: 147945 - RNA, 64 nt, Homo Sapiens
ucccaagaccaggacccacuguccuuucggcuucccaguugagcggccugcccuucucugcugu

SEQ ID NO: 147946 - RNA, 64 nt, Homo Sapiens
ccgcuuccucuuuuucuugcaaguuuuaaauuuccaaccuuaagugaauuuguggaccaaauuu

SEQ ID NO: 147947 - RNA, 64 nt, Homo Sapiens
aggaaucuaaauauuuauagugagauugugaaagcaaccuuaaaguuuugaagaagacugauga

SEQ ID NO: 147948 - RNA, 64 nt, Homo Sapiens
uauguuauauguuguucuuacaaaccauacugaaagaguccauuguuuaaaaaucuuaauguau

SEQ ID NO: 147949 - RNA, 64 nt, Homo Sapiens
uuauacuugaugauaacacuauuugaugagucuuagaguccagacacaaagagacaaagcuuug

SEQ ID NO: 147950 - RNA, 64 nt, Homo Sapiens
aaacauacauucgugccuggagacccugcaggccagaguccaaauauuuaacaaucagaagggg

SEQ ID NO: 147951 - RNA, 64 nt, Homo Sapiens
uauuuugccugaacaccccaacacucuugguuuuagaguccaagaguaaguugugcagagacau

SEQ ID NO: 147952 - RNA, 64 nt, Homo Sapiens
ccugccugccugccagccagccacucucuugcugagaguccaggcaaaaccaagcugcuugagc

SEQ ID NO: 147953 - RNA, 64 nt, Homo Sapiens
ccuccugccuggccuuucccgggaaaccauagacagaguccacuaggcaacuggugcagggacu

SEQ ID NO: 147954 - RNA, 64 nt, Homo Sapiens
agggccacagagaacucaaacacugaaggaaggaagaguccagaguaccucauucuucccuuau

SEQ ID NO: 147955 - RNA, 64 nt, Homo Sapiens
acaggccagaaagugaauccagaaugauggaagaagaguccagaggagcucuagagugggagaa

SEQ ID NO: 147956 - RNA, 64 nt, Homo Sapiens
gaagcccucccagguguuaacauuccaagacucuagaguccaagguuuaaagagucuagauuca

SEQ ID NO: 147957 - RNA, 64 nt, Homo Sapiens
uuugcugcauucugccucucuaggaccaugguuaagaguccaagaauccacauuucuaaaaucu

SEQ ID NO: 147958 - RNA, 64 nt, Homo Sapiens
cgggucaucagcaagaaaugaauuggaggcaggaagaguccaagccugaauaauaacaccccac

SEQ ID NO: 147959 - RNA, 64 nt, Homo Sapiens
ucucaacccugcuguucagacuugauaagaucucagaguccacaggaaagaagucacuguugca

SEQ ID NO: 147960 - RNA, 64 nt, Homo Sapiens
ccuguuauuguccccuaaugauaggauauucccugcugccuaccuggagauucaguaggaucuu

SEQ ID NO: 147961 - RNA, 64 nt, Homo Sapiens
gccuucaccucuguugcugaggaaaugguagaaugcugccuaucaccuccagcacaaucccagu

SEQ ID NO: 147962 - RNA, 64 nt, Homo Sapiens
gacucccgggccuugugugccgugucucauuguggcugccuauggaccgggacccccccaccca

SEQ ID NO: 147963 - RNA, 64 nt, Homo Sapiens
cagugccauucuuucacaaccccaggagccuccagcugccuaacgacagaggagucaggcccgc

SEQ ID NO: 147964 - RNA, 64 nt, Homo Sapiens
aggaggacaucuuggauguaagaaaagacagcagcaucaagaggaagaagcaggaaaagcaaga

SEQ ID NO: 147965 - RNA, 64 nt, Homo Sapiens
gaaaggucucagaugaaagaagaagaaaaggcgacaucaagaaggaacaucagaaaaagcaaga

SEQ ID NO: 147966 - RNA, 64 nt, Homo Sapiens
uuggaaaucugacuucuugcagaaggaguaggcacaucaagauauucaggggugccccaagagu

SEQ ID NO: 147967 - RNA, 64 nt, Homo Sapiens
aucuuauuacuguuacucaaaaacauugacucugcaucaagaaagaaacaagaaagcaauaaaa

SEQ ID NO: 147968 - RNA, 64 nt, Homo Sapiens
ugccggaccagcccugaugcuuuggcaaaggccucaucaagaagacugcuuccaguuccugccc

SEQ ID NO: 147969 - RNA, 64 nt, Homo Sapiens
acagacgugcaggcagcccgauggaccuugugcucaucaagaauugaacagcaacuauuauguc

SEQ ID NO: 147970 - RNA, 64 nt, Homo Sapiens
ggcauccucaggggcguguaaaacgccugauccgcaucaagaaucugggaucaacuccuggaag

SEQ ID NO: 147971 - RNA, 64 nt, Homo Sapiens
cuggccgcaggagucuauauguuuucguaaucuucaucaagaaguuuuuaaaaggcaagcaaaa

SEQ ID NO: 147972 - RNA, 64 nt, Homo Sapiens
acucugucuggugagcucugcuuuuucagugcaccaucaagagaugcagccccguggacaugaa

SEQ ID NO: 147973 - RNA, 64 nt, Homo Sapiens; identical to SEQ ID NO: 111411

SEQ ID NO: 147974 - RNA, 64 nt, Homo Sapiens; identical to SEQ ID NO: 111412

SEQ ID NO: 147975 - RNA, 64 nt, Homo Sapiens; identical to SEQ ID NO: 111413

SEQ ID NO: 147976 - RNA, 64 nt, Homo Sapiens; identical to SEQ ID NO: 111414

SEQ ID NO: 147977 - RNA, 64 nt, Homo Sapiens; identical to SEQ ID NO: 111415

SEQ ID NO: 147978 - RNA, 64 nt, Homo Sapiens; identical to SEQ ID NO: 111416

SEQ ID NO: 147979 - RNA, 64 nt, Homo Sapiens; identical to SEQ ID NO: 111417

SEQ ID NO: 147980 - RNA, 64 nt, Homo Sapiens; identical to SEQ ID NO: 111418

SEQ ID NO: 147981 - RNA, 64 nt, Homo Sapiens; identical to SEQ ID NO: 111419

SEQ ID NO: 147982 - RNA, 64 nt, Homo Sapiens; identical to SEQ ID NO: 111420

SEQ ID NO: 147983 - RNA, 64 nt, Homo Sapiens; identical to SEQ ID NO: 111421

SEQ ID NO: 147984 - RNA, 64 nt, Homo Sapiens; identical to SEQ ID NO: 111422

SEQ ID NO: 147985 - RNA, 64 nt, Homo Sapiens; identical to SEQ ID NO: 111423

SEQ ID NO: 147986 - RNA, 64 nt, Homo Sapiens; identical to SEQ ID NO: 111424

SEQ ID NO: 147987 - RNA, 64 nt, Homo Sapiens; identical to SEQ ID NO: 111425

SEQ ID NO: 147988 - RNA, 64 nt, Homo Sapiens; identical to SEQ ID NO: 111426

SEQ ID NO: 147989 - RNA, 64 nt, Homo Sapiens; identical to SEQ ID NO: 111427

SEQ ID NO: 147990 - RNA, 64 nt, Homo Sapiens; identical to SEQ ID NO: 111428

SEQ ID NO: 147991 - RNA, 64 nt, Homo Sapiens; identical to SEQ ID NO: 111429

SEQ ID NO: 147992 - RNA, 64 nt, Homo Sapiens; identical to SEQ ID NO: 111430

SEQ ID NO: 147993 - RNA, 64 nt, Homo Sapiens; identical to SEQ ID NO: 111431

SEQ ID NO: 147994 - RNA, 64 nt, Homo Sapiens; identical to SEQ ID NO: 111432

SEQ ID NO: 147995 - RNA, 64 nt, Homo Sapiens; identical to SEQ ID NO: 111433

SEQ ID NO: 147996 - RNA, 64 nt, Homo Sapiens; identical to SEQ ID NO: 111434

SEQ ID NO: 147997 - RNA, 58 nt, Homo Sapiens; identical to SEQ ID NO: 111435

SEQ ID NO: 147998 - RNA, 64 nt, Homo Sapiens; identical to SEQ ID NO: 111436

SEQ ID NO: 147999 - RNA, 64 nt, Homo Sapiens; identical to SEQ ID NO: 111437

SEQ ID NO: 148000 - RNA, 64 nt, Homo Sapiens; identical to SEQ ID NO: 111438

SEQ ID NO: 148001 - RNA, 64 nt, Homo Sapiens; identical to SEQ ID NO: 111439

SEQ ID NO: 148002 - RNA, 64 nt, Homo Sapiens; identical to SEQ ID NO: 111440

SEQ ID NO: 148003 - RNA, 64 nt, Homo Sapiens; identical to SEQ ID NO: 111441

SEQ ID NO: 148004 - RNA, 64 nt, Homo Sapiens; identical to SEQ ID NO: 111442

SEQ ID NO: 148005 - RNA, 64 nt, Homo Sapiens; identical to SEQ ID NO: 111443

SEQ ID NO: 148006 - RNA, 64 nt, Homo Sapiens; identical to SEQ ID NO: 111444

SEQ ID NO: 148007 - RNA, 64 nt, Homo Sapiens; identical to SEQ ID NO: 111445

SEQ ID NO: 148008 - RNA, 64 nt, Homo Sapiens; identical to SEQ ID NO: 111446

SEQ ID NO: 148009 - RNA, 64 nt, Homo Sapiens; identical to SEQ ID NO: 111447

SEQ ID NO: 148010 - RNA, 64 nt, Homo Sapiens; identical to SEQ ID NO: 111448

SEQ ID NO: 148011 - RNA, 64 nt, Homo Sapiens; identical to SEQ ID NO: 111449

SEQ ID NO: 148012 - RNA, 64 nt, Homo Sapiens; identical to SEQ ID NO: 111450

SEQ ID NO: 148013 - RNA, 64 nt, Homo Sapiens; identical to SEQ ID NO: 111451

SEQ ID NO: 148014 - RNA, 64 nt, Homo Sapiens; identical to SEQ ID NO: 111452

SEQ ID NO: 148015 - RNA, 64 nt, Homo Sapiens; identical to SEQ ID NO: 111453

SEQ ID NO: 148016 - RNA, 64 nt, Homo Sapiens; identical to SEQ ID NO: 111454

SEQ ID NO: 148017 - RNA, 64 nt, Homo Sapiens; identical to SEQ ID NO: 111455

SEQ ID NO: 148018 - RNA, 64 nt, Homo Sapiens; identical to SEQ ID NO: 111456

SEQ ID NO: 148019 - RNA, 64 nt, Homo Sapiens; identical to SEQ ID NO: 111457

SEQ ID NO: 148020 - RNA, 64 nt, Homo Sapiens; identical to SEQ ID NO: 111458

SEQ ID NO: 148021 - RNA, 64 nt, Homo Sapiens; identical to SEQ ID NO: 111459

SEQ ID NO: 148022 - RNA, 52 nt, Homo Sapiens; identical to SEQ ID NO: 111460

SEQ ID NO: 148023 - RNA, 64 nt, Homo Sapiens; identical to SEQ ID NO: 111461

SEQ ID NO: 148024 - RNA, 64 nt, Homo Sapiens; identical to SEQ ID NO: 111462

SEQ ID NO: 148025 - RNA, 64 nt, Homo Sapiens; identical to SEQ ID NO: 111463

SEQ ID NO: 148026 - RNA, 64 nt, Homo Sapiens; identical to SEQ ID NO: 111464

SEQ ID NO: 148027 - RNA, 64 nt, Homo Sapiens; identical to SEQ ID NO: 111465

SEQ ID NO: 148028 - RNA, 64 nt, Homo Sapiens; identical to SEQ ID NO: 111466

SEQ ID NO: 148029 - RNA, 64 nt, Homo Sapiens; identical to SEQ ID NO: 111467

SEQ ID NO: 148030 - RNA, 62 nt, Homo Sapiens
acuuuuagauuggauuguuugcuauugcucugugugaggauacauaaucuuucaguaaacug

SEQ ID NO: 148031 - RNA, 62 nt, Homo Sapiens
uggauacaguuugcuuguaauauuuuuaauaaugugaggaguacaguguuuucuaauucauu

SEQ ID NO: 148032 - RNA, 62 nt, Homo Sapiens
gagaagaacaaugucaaaugucacagggguguugugaggacuuggggucaauaccaccuacc

SEQ ID NO: 148033 - RNA, 62 nt, Homo Sapiens
cacuaaaccuuuccgugccucaccacgcggccugugaggagcagagcaccacucugcugccc

SEQ ID NO: 148034 - RNA, 62 nt, Homo Sapiens
uaucgggaagauuucuaaauuguguauauauaugugaggaugaaaaacccauguggugauga

SEQ ID NO: 148035 - RNA, 62 nt, Homo Sapiens
cccaucugucuaaagauagauuuggaagauccugugaggagcggguugguuccuuuccaacg

SEQ ID NO: 148036 - RNA, 62 nt, Homo Sapiens
uuuuggcucuuaagauauccgguuaaagcuucugugaggacccauauucuuaugauuacuug

SEQ ID NO: 148037 - RNA, 62 nt, Homo Sapiens
aaaguaaaacauguuuaauuuuuuuauguucuugugaggaaacuguuaagucccuuccguaa

SEQ ID NO: 148038 - RNA, 62 nt, Homo Sapiens
uugggaagagguuucuguaaccccugcccuggugugaggaggaaauggcucuggccuggcug

SEQ ID NO: 148039 - RNA, 62 nt, Homo Sapiens
aaaaccauuuuucuaauucuaacaaguuagaaugugaggaaggaaugaacaugaguguuuag

SEQ ID NO: 148040 - RNA, 62 nt, Homo Sapiens
aguaucuugagauucaccuggaaggcaaaugaugugaggauuucaagacgagggaaauauga

SEQ ID NO: 148041 - RNA, 62 nt, Homo Sapiens
uagauguuugcuaacuucaaaccuuguagagaugugaggauugaagaaucauacuuugaccu

SEQ ID NO: 148042 - RNA, 62 nt, Homo Sapiens
gggaaggcaguguggucccuacccugugugaaugugaggauguagacauccaucagugcaac

SEQ ID NO: 148043 - RNA, 62 nt, Homo Sapiens
auuuaucugggagaaaacuguggugcacagcuugugaggagggcaagguugugacguucgag

SEQ ID NO: 148044 - RNA, 62 nt, Homo Sapiens
uuugacucagugacaaucauuauuacaggguuugugaggaccauuuccagaauuuuagacau

SEQ ID NO: 148045 - RNA, 62 nt, Homo Sapiens
uuguaagucagcauaaaaauuauaaguuuuuaugugaggacucaaagaggguugauuaaauc

SEQ ID NO: 148046 - RNA, 62 nt, Homo Sapiens
uccucagcgacauuucugaugugcugcucuuaugugaggaccagugcuuucucucuuugcac

SEQ ID NO: 148047 - RNA, 62 nt, Homo Sapiens
uggcacgggcuccucagagcgugguagccgacugugaggaaaagcagagggaaugugaaaga

SEQ ID NO: 148048 - RNA, 62 nt, Homo Sapiens
gggcccccacaggggaugguaggggccugggcugugaggacacuuccugucuaacuugggga

SEQ ID NO: 148049 - RNA, 62 nt, Homo Sapiens
gagacuugcaguuagacucauuuuuaauuuccugugaggauaauguaggaaccgaucugcua

SEQ ID NO: 148050 - RNA, 62 nt, Homo Sapiens
gguugucucucuucgguggcaccccagauaccugugaggacugauaucccaaguuggaaggg

SEQ ID NO: 148051 - RNA, 62 nt, Homo Sapiens
gagaggagaaaugagaagaacuggggagagccugugaggaccggcgagcugggcgagcuggg

SEQ ID NO: 148052 - RNA, 62 nt, Homo Sapiens
gggguggugggaagaauugguuugcgaugggcugugaggaugagggccuacaacgaggggcc

SEQ ID NO: 148053 - RNA, 62 nt, Homo Sapiens
uuaaugcaggaagaacaugacaaccaagcaaaugugaggagucuggugaccuggggcaacuu

SEQ ID NO: 148054 - RNA, 62 nt, Homo Sapiens
uccgcuauagaauggaguguccagaaauagacugugaggaaggaugggccuugcugaagugu

SEQ ID NO: 148055 - RNA, 62 nt, Homo Sapiens
ucucagacaaaggcaaggccgaucagcuguggugugaggacucuuccccauuguuuccaucu

SEQ ID NO: 148056 - RNA, 62 nt, Homo Sapiens
ugcagacccaaacccacguguggacaggcgggugugaggagugaccguggccgcuggcuggc

SEQ ID NO: 148057 - RNA, 62 nt, Homo Sapiens
gaacuccaagauguuccauaaguguuuuuacuugugaggaaugagaagccauccauggaaau

SEQ ID NO: 148058 - RNA, 62 nt, Homo Sapiens
cuuccuucuguagccauuaacugcugaauccaugugaggaagacaggcuucccuuccuuccc

SEQ ID NO: 148059 - RNA, 62 nt, Homo Sapiens
ggggggcaaugauaccuaccucacagggguguugugaggauuaaaugugaggaggauagugg

SEQ ID NO: 148060 - RNA, 62 nt, Homo Sapiens
accuaccucacagggguguugugaggauuaaaugugaggaggauaguggcagaugagugaug

SEQ ID NO: 148061 - RNA, 62 nt, Homo Sapiens
gccgucucccugcuugacucggucuucaagguugugaggaaauguacaucaugaugacugau

SEQ ID NO: 148062 - RNA, 62 nt, Homo Sapiens
cugcacguccucagcagaguucugugaguggcugugaggaugggggacggcgacagcgcggc

SEQ ID NO: 148063 - RNA, 62 nt, Homo Sapiens
gguucugcagcuugaguccugugaaaauggggugugaggaguaaccagccaaaugcacuuuu

SEQ ID NO: 148064 - RNA, 62 nt, Homo Sapiens
ggagcuuucuggaaguacuuuaggcaucacauugugaggaaguuuagaauagccagggucug

SEQ ID NO: 148065 - RNA, 64 nt, Homo Sapiens
uugcuccaguaaugcaauaaccaagaggggacagucuggccaaccuuuuuguuuaauaccuucc

SEQ ID NO: 148066 - RNA, 64 nt, Homo Sapiens
aaugaggcccucccaacacuguccuuaccacugaucuggccaagggccuggauagacugccugc

SEQ ID NO: 148067 - RNA, 64 nt, Homo Sapiens
ugccucuucuuuaacugggauucuccagcagagcucuggccagcgguccaucuugggcauuagg

SEQ ID NO: 148068 - RNA, 64 nt, Homo Sapiens
ccccccuuuuuucccccaagauugcuaggcaaggucuggccagguuuauccugcuuucuuuggg

SEQ ID NO: 148069 - RNA, 64 nt, Homo Sapiens
auggugaaaccccaucucuagaguucgagauuagucuggccaacggcggaucaccugaggucag

SEQ ID NO: 148070 - RNA, 64 nt, Homo Sapiens
auuuccuucuguaucacuccuauaggauuuucuuucuggccaaggagugcuacuucagaagccu

SEQ ID NO: 148071 - RNA, 64 nt, Homo Sapiens
augcuccccaucgccugcuugcucuccagccgagucuggccaauuugccauggggaggcugcag

SEQ ID NO: 148072 - RNA, 64 nt, Homo Sapiens
uugcuuccuuuuuugaccagcaggaaacagcaggucuggccagauucucacuugcccaucaauc

SEQ ID NO: 148073 - RNA, 64 nt, Homo Sapiens
gagcaagggcugagggaagccaucaccuaacaccucuggccacccaggaccaggucuguguggg

SEQ ID NO: 148074 - RNA, 64 nt, Homo Sapiens
gcucuaaaguacugacuuuucagcaaauuuccuuucuggccaagcccucugaguuugaaauucu

SEQ ID NO: 148075 - RNA, 64 nt, Homo Sapiens
uuaaguuuguauuuuaaaaaguacacauucagaaucuggccaaucauuuugaaaaagaaaaaaa

SEQ ID NO: 148076 - RNA, 64 nt, Homo Sapiens
ggugcguguuucauucagauguuuuccuuuuggaucuggccauuuaucugaggaagucuaggua

SEQ ID NO: 148077 - RNA, 64 nt, Homo Sapiens
aauggcucucuaggugggcucucccacccagaacucuggccaaagggucucacuggccccaagu

SEQ ID NO: 148078 - RNA, 64 nt, Homo Sapiens
aguaguggcugagcucuguggagagcacauguccucuggccaggucaggaggccagccugccau

SEQ ID NO: 148079 - RNA, 64 nt, Homo Sapiens
uugcugugccugacggaugggcuguagaauggggucuggccaccuggccugcugggaaacagca

SEQ ID NO: 148080 - RNA, 64 nt, Homo Sapiens
cagggagcagcccugugucgggggcuggaauaguucuggccagaccccguuccccuuccucuau

SEQ ID NO: 148081 - RNA, 64 nt, Homo Sapiens
caggugggggcagcaggagggcagagggcagagcucuggccacuucugcccacuucauuagggu

SEQ ID NO: 148082 - RNA, 64 nt, Homo Sapiens
ugucuuuugggagaguacuuuucuccacgagcccucuggccacugugggagggaaggacaaggg

SEQ ID NO: 148083 - RNA, 64 nt, Homo Sapiens
gggaagcgggcagcucuagcgcugccuugggcccucuggccagagugguuggagaacccagggg

SEQ ID NO: 148084 - RNA, 64 nt, Homo Sapiens
gguccuccuggaagccccucgcacuugcuggccuucuggccagagggcggugugacuggucaug

SEQ ID NO: 148085 - RNA, 64 nt, Homo Sapiens
ggaacucagagauucucaucaggguuacugacucucuggccaugaggccuguggggagcacugg

SEQ ID NO: 148086 - RNA, 64 nt, Homo Sapiens
gguuuuccugaugggugagucauccuuccaaccuucuggccagaauaucaguaucucacagucc

SEQ ID NO: 148087 - RNA, 64 nt, Homo Sapiens
guggacgcgcugccucaacacuuguccagacaccucuggccagguuggacccgcacacuuacuu

SEQ ID NO: 148088 - RNA, 64 nt, Homo Sapiens
gacaaagcugcagagcacauuccaugccagacgcucuggccaggaagcugaggccgggcuugag

SEQ ID NO: 148089 - RNA, 64 nt, Homo Sapiens
cccuagggccuucugggccagaggcaccaucccuucuggccauccaucaaguccaucaaggccc

SEQ ID NO: 148090 - RNA, 64 nt, Homo Sapiens
cccgaagagacuccuggcguccuuccuacucugcucuggccaguggugccaggugccacccagg

SEQ ID NO: 148091 - RNA, 64 nt, Homo Sapiens
ugugagcagcccagagcccucucuauccacuuggucuggccagccaggcccuuccucaccaggg

SEQ ID NO: 148092 - RNA, 64 nt, Homo Sapiens
ccaggcccuuccucaccagggucugaggggcagcucuggccagugcucaccagggccagcaggg

SEQ ID NO: 148093 - RNA, 64 nt, Homo Sapiens
gccagcugugcucagcuggcgguggagggcucccucuggccagugugggcauacguggugggag

SEQ ID NO: 148094 - RNA, 64 nt, Homo Sapiens
ccccaggcacagagcugccucagcaccccugaggucuggccaggggggaacaggagcagggcca

SEQ ID NO: 148095 - RNA, 64 nt, Homo Sapiens
gaagcagcagcauccuggggcauuccagaacccaucuggccagauggagcaguagcagaagccu

SEQ ID NO: 148096 - RNA, 64 nt, Homo Sapiens
ggugaggccugcacagauguccccugugcccagaucuggccaugcugaaaacaguggcguggcu

SEQ ID NO: 148097 - RNA, 64 nt, Homo Sapiens
agcagagagccaagcaucuucccugggaagucuuucuggccaagucuggccagccuggcccugc

SEQ ID NO: 148098 - RNA, 64 nt, Homo Sapiens
caagcaucuucccugggaagucuuucuggccaagucuggccagccuggcccugcaggucuccca

SEQ ID NO: 148099 - RNA, 64 nt, Homo Sapiens
gccuggacggggcuuuugucugaugcucugggauucuggccagacccaccccagggcacauguc

SEQ ID NO: 148100 - RNA, 64 nt, Homo Sapiens
caggcaccuuggcaucugugcagagacggcccagucuggccaaauccucuuccucuccccugcu

SEQ ID NO: 148101 - RNA, 64 nt, Homo Sapiens
aggcccagcagcaccugcacccacuuccagcugcucuggccaaaaucuccgcucggccaggccc

SEQ ID NO: 148102 - RNA, 64 nt, Homo Sapiens
ccguagccuccucccaggcaccugucugcaucccucuggccagugcaugcugagcacgugaccu

SEQ ID NO: 148103 - RNA, 64 nt, Homo Sapiens
ucucuguggucuccauccugacucuugaacuuacccacaauaagaauaaauucugccucaucuu

SEQ ID NO: 148104 - RNA, 64 nt, Homo Sapiens
gauuuauuuuucccauaguguaucaguuguuaugccacaauaacaacaauaauaauguucuuaa

SEQ ID NO: 148105 - RNA, 64 nt, Homo Sapiens
gcaauuuucuguggcacugagaaaccauguaugaccacaauaaaaauccauuuugugaaaggau

SEQ ID NO: 148106 - RNA, 64 nt, Homo Sapiens
agagagggcaggggagcccacaucuggggcuggcccacaauaccugcucccccgacccccucca

SEQ ID NO: 148107 - RNA, 64 nt, Homo Sapiens
uugcgugcagggaugcuugcugauggaugaaagaccacaauaaaacaagauuagcagcaaaaca

SEQ ID NO: 148108 - RNA, 64 nt, Homo Sapiens
ccauuugaaaaaaaucucaaaacacagauuaaaaccacaauaggcuguaguauuuuuuauuuug

SEQ ID NO: 148109 - RNA, 64 nt, Homo Sapiens
uuucuaaugacuugauuuucuauuuucucccuacccacaauacaguuaucuuuuuuauuguguu

SEQ ID NO: 148110 - RNA, 64 nt, Homo Sapiens
aaccuuggcagacgggagucccugccccgcgggaccacaauaaauacguaugccaugcauaccu

SEQ ID NO: 148111 - RNA, 64 nt, Homo Sapiens
ccuuuccugaaagcagaggcacagaaggcacucaccacaauaaauuucauuugcagucgacugu

SEQ ID NO: 148112 - RNA, 64 nt, Homo Sapiens
gacagggcagggacagggacuggacucucccgggccacaauaggagggcugggcccuguagugc

SEQ ID NO: 148113 - RNA, 64 nt, Homo Sapiens
accauuuaagugugugcuaauccccuuuccccucccacaauaagcuugggaaucugcaagaacc

SEQ ID NO: 148114 - RNA, 64 nt, Homo Sapiens
gcaugaucuggauuaaaugcauguuagauauuaaccacaauaagaggaaaauaugguguuugga

SEQ ID NO: 148115 - RNA, 64 nt, Homo Sapiens
cagcccuuacuaagccgagaugggagucauauucccacaauaagucuccaccuggucuuccaga

SEQ ID NO: 148116 - RNA, 64 nt, Homo Sapiens
aacaccucccuauucuguuacaagcuucaggugaccacaauagccuacuuuuuuuuuuuuuccu

SEQ ID NO: 148117 - RNA, 64 nt, Homo Sapiens
aagcauaacuucuaaaggaaaugguuaccacaagccacaauaaaccauugcucuugcauguuac

SEQ ID NO: 148118 - RNA, 64 nt, Homo Sapiens
aaaaaaccuagcaucuuacauuuucugugucauaccacaauaaaaagcuguacauuuggugcac

SEQ ID NO: 148119 - RNA, 64 nt, Homo Sapiens
uguauuuuucccaauccccuaaaaaacuaaaguaccacaauagcaucauagcuuaaauacauug

SEQ ID NO: 148120 - RNA, 64 nt, Homo Sapiens
uugcuaaaauaaagaggagaaagucgcacauuuuccacaauacaaauauuuucauaucaagaua

SEQ ID NO: 148121 - RNA, 64 nt, Homo Sapiens
ccugugcuauauuuguuuuaggucuuuaauauuuccacaauaauaacugcaacuuuuaugaaau

SEQ ID NO: 148122 - RNA, 64 nt, Homo Sapiens
aaacaaugguuugaaacaacuacuggaauauuguccacaauaagcuggaaguuuguuguaguau

SEQ ID NO: 148123 - RNA, 64 nt, Homo Sapiens
gugcaccugauuuuuggucuaaaaggaauuauugccacaauauauuuuauuuauucuuuagauu

SEQ ID NO: 148124 - RNA, 64 nt, Homo Sapiens
gguagauccuauuacacuucuguuuauauuaaauccacaauauuuuauuacauuuuuaacuugu

SEQ ID NO: 148125 - RNA, 64 nt, Homo Sapiens
gacuccgaugugaauuuguugugaauuuguugugccacaauagcaguucuggaaugaagcuagg

SEQ ID NO: 148126 - RNA, 64 nt, Homo Sapiens
ccaugaagguguacacaucuaaacuuaaggaaaaccacaauaaaacuucauccuaauaaggaua

SEQ ID NO: 148127 - RNA, 64 nt, Homo Sapiens
aucuuuuaguucucuuuaacucuucuguccugaaccacaauaauuaagugagcaugcuacuaag

SEQ ID NO: 148128 - RNA, 64 nt, Homo Sapiens
agacaguguuuucugggauaugaccaggcauccuccacaauagcaccccuucauccucugagug

SEQ ID NO: 148129 - RNA, 64 nt, Homo Sapiens
aggcccucuuggauggacuugaugaccuugaccaccacaauaccuccauuccuaggugucauca

SEQ ID NO: 148130 - RNA, 64 nt, Homo Sapiens
uuuuuaauacucaguguucuggauuuaauuaaggccacaauaccugaagugccuucugaaucaa

SEQ ID NO: 148131 - RNA, 64 nt, Homo Sapiens
ucccaacucauaaauugcuuauccaucaagucuuccacaauaauagugacccagagcuauaauc

SEQ ID NO: 148132 - RNA, 64 nt, Homo Sapiens
gguugugauuuauauuuuaaagcuuggugcuaaaccacaauauguauagcauauggagugccug

SEQ ID NO: 148133 - RNA, 64 nt, Homo Sapiens
gguaauauacuauuauauaauucauuugugauauccacaauaauaugacuggcaagaauuggug

SEQ ID NO: 148134 - RNA, 64 nt, Homo Sapiens
uaaacacuuuauuuuugaguaauaaaaauauguaccacaauaaauuauuguuaauuaacaugua

SEQ ID NO: 148135 - RNA, 64 nt, Homo Sapiens
aagaaaccacguuaggggaaaugaaaaaagcaagccacaauaccaugauuccuuccauuuucaa

SEQ ID NO: 148136 - RNA, 64 nt, Homo Sapiens
auuuugggguuauguuuaaaaaaacauuauugucccacaauauuaccuuaagauuuuucuuuuc

SEQ ID NO: 148137 - RNA, 64 nt, Homo Sapiens
uguaccaccacacacggaauucagauuuugcacaccacaauaaacagagaaaaaucgucaguug

SEQ ID NO: 148138 - RNA, 64 nt, Homo Sapiens
ucuucuuccucagggacuaccauuugugcccagaccacaauauuuaggcccuucagcagagacc

SEQ ID NO: 148139 - RNA, 64 nt, Homo Sapiens
uagagagauagaaaagguagaaacacuuaguggcccacaauauacguuagcagcaucaguccac

SEQ ID NO: 148140 - RNA, 64 nt, Homo Sapiens
uguauguuuuauauuuuauugcuugugcagagggccacaauaagagacucugcacaaccagauu

SEQ ID NO: 148141 - RNA, 64 nt, Homo Sapiens
ugcaaaaaauaaaaagucuguuauguauauuuuaccacaauaaaaaugguuaaaagguuuuaug

SEQ ID NO: 148142 - RNA, 64 nt, Homo Sapiens
acauauaaaagauuauaaaucuuaagcauaauagccacaauagguuuuuucuuuagcuauuuua

SEQ ID NO: 148143 - RNA, 64 nt, Homo Sapiens
ugcuggugcagagcugaagauuuuggaggguccuccacaauaaggucaaugccagagacggaag

SEQ ID NO: 148144 - RNA, 64 nt, Homo Sapiens
augcaauguaaaacauguauuagacauucaggcuccacaauaaauuuuaaugagcacuacaaau

SEQ ID NO: 148145 - RNA, 64 nt, Homo Sapiens
cagaaaacaacuuggcauuucagauuuuaccuauccacaauagugaauuaccauuaauuacaua

SEQ ID NO: 148146 - RNA, 64 nt, Homo Sapiens
aagauuuuuacuggaaaaaaaaagaaaagauuucccacaauaaaaaaauguuuuaaauaaaaau

SEQ ID NO: 148147 - RNA, 64 nt, Homo Sapiens
ccaaguacaacucuucaucaacaaaaaaaaaaauccacaauauuaaacaauagggggagauuag

SEQ ID NO: 148148 - RNA, 64 nt, Homo Sapiens
auaguagagugaggugagggucguggcuaaaaccccacaauaacuuuacauuccuagcuuuaca

SEQ ID NO: 148149 - RNA, 64 nt, Homo Sapiens
uuuuugcugauugcuaagggaaauaacaguauuuccacaauaggguucaaauuccugcaaaauu

SEQ ID NO: 148150 - RNA, 64 nt, Homo Sapiens
aaaaauuagacauuuugccaaguuaguuuucuuaccacaauacccucuuggcuuuuuuuuuuuu

SEQ ID NO: 148151 - RNA, 64 nt, Homo Sapiens
aaaugguaaauauugcaaaaguuaaacaaggguaccacaauaucauuuauaauugaugucaaua

SEQ ID NO: 148152 - RNA, 64 nt, Homo Sapiens
aagagcaaaucaauucuagucauauauuaaacauccacaauaaccaagauauuuuuaucccaag

SEQ ID NO: 148153 - RNA, 64 nt, Homo Sapiens
cuggcaccaguggaaacacauacugaagcugccaccacaauagcuugugagguuuuauccagcu

SEQ ID NO: 148154 - RNA, 64 nt, Homo Sapiens
uaaacccaugaguuuaugcccugggcuccuuagcccacaauaguguaauaaaagugccccgggc

SEQ ID NO: 148155 - RNA, 64 nt, Homo Sapiens
gaagaaguauucaauuuauaaaucuaucuaaaagccacaauaugggguuggggacaggucugcc

SEQ ID NO: 148156 - RNA, 64 nt, Homo Sapiens
cagggauuaaugcugccacacguuuucaauauugccacaauaccaggggguagcagauuccauu

SEQ ID NO: 148157 - RNA, 64 nt, Homo Sapiens
auuaauaauagaaaauucauuuauuuuaaaacaaccacaauaaccauauauacauucagaacuu

SEQ ID NO: 148158 - RNA, 64 nt, Homo Sapiens
ccuguacccagcugugucuuuuucaccuccagugccacaauaaaugcuggccacaccagccccc

SEQ ID NO: 148159 - RNA, 64 nt, Homo Sapiens
caagagccccagccaguuuacuccagguagauuuccacaauaugcaaaguggugguggggucaa

SEQ ID NO: 148160 - RNA, 64 nt, Homo Sapiens
ucucuccuuugcuuuccuugaagucagcuuuggaccacaauaauuucacuguagaugauaugcu

SEQ ID NO: 148161 - RNA, 64 nt, Homo Sapiens
gaaagcuuuaaaaguuuuauauccagauauacaaccacaauaaagcaaaauaaccuacuaucaa

SEQ ID NO: 148162 - RNA, 64 nt, Homo Sapiens
caugaaggcuuaauguuaaguuuccuuuaaugauccacaauaaucccuuugaucacguuaaucu

SEQ ID NO: 148163 - RNA, 64 nt, Homo Sapiens
ucuaacaagguauaucuaguaggggagaaagccaccacaauaaauauauuuguuaauaguuuuu

SEQ ID NO: 148164 - RNA, 64 nt, Homo Sapiens
augccauugaugguugaaauauacauagaaacuuccacaauaaaaggaaguuaauaccuaugua

SEQ ID NO: 148165 - RNA, 64 nt, Homo Sapiens
uugaagcaguaagggggaaguuuauuuauuuuuaccacaauagugccaccacgccagggcuuua

SEQ ID NO: 148166 - RNA, 64 nt, Homo Sapiens
uuuuuauuaaaaaaauccuauaauguaccuuguuccacaauaauuccuaauugcaagccaaauu

SEQ ID NO: 148167 - RNA, 64 nt, Homo Sapiens
gccccugcuggccgccgcgucccccgagauugacccacaauaaagcacaggccuuaccgcggcg

SEQ ID NO: 148168 - RNA, 64 nt, Homo Sapiens
aguuauaacucagccuuuaggaacaccggagaacccacaauaauagaaaucuuuucguguuccc

SEQ ID NO: 148169 - RNA, 64 nt, Homo Sapiens
aucgcuccaauaaacauauauugugaaaaugcauccacaauaaauggaauuccuuccugcaaaa

SEQ ID NO: 148170 - RNA, 64 nt, Homo Sapiens
aaaucgggugaagugugcacucuuugccguuucaccacaauaaucaguauuucuuuuucucaca

SEQ ID NO: 148171 - RNA, 64 nt, Homo Sapiens
ucauuuuuuucaacaauggagacauagauuugacccacaauaacuucucccccucucuuuuuac

SEQ ID NO: 148172 - RNA, 64 nt, Homo Sapiens
acacuuuaaaauggaaaauuuauauguauuuuuaccacaauaaacaaaaaacccuaaaaaaacu

SEQ ID NO: 148173 - RNA, 64 nt, Homo Sapiens
aagcauuucauauuuuaauuuaaauuggauucaaccacaauaaagaaaaugagaaaagcuuuca

SEQ ID NO: 148174 - RNA, 64 nt, Homo Sapiens
guuuacuuguaaaauuuuaguuguucaucuguggccacaauaaaaccuuaacugucauguuuug

SEQ ID NO: 148175 - RNA, 64 nt, Homo Sapiens
augugauuggaucgugugguaggucccgaccuccccacaauaaaaucgugccugccgccccuuc

SEQ ID NO: 148176 - RNA, 64 nt, Homo Sapiens
gaugcucuccgaccuuccugggccgggccccuccccacaauaaauuuggugucagaacuuuggg

SEQ ID NO: 148177 - RNA, 64 nt, Homo Sapiens
cuguggcauucauauuucauauucauauuucaaaccacaauauccagcaaaaugucuccugagc

SEQ ID NO: 148178 - RNA, 64 nt, Homo Sapiens
ucacuggauugucugggaugacuugggcucauauccacaauacuugguauaagguaguagauug

SEQ ID NO: 148179 - RNA, 64 nt, Homo Sapiens
aaaagcgaagcagacaaaaagaaccuuaccucccccacaauacaacauugggcugcugaaccca

SEQ ID NO: 148180 - RNA, 64 nt, Homo Sapiens
uaugguuuuuuauucauaaggaacauuuaauauuccacaauauacucucauguuaguacaugca

SEQ ID NO: 148181 - RNA, 64 nt, Homo Sapiens
gcauauaaauauuaugccauguuuguuauacgugccacaauauaccagguuaugugguguaaag

SEQ ID NO: 148182 - RNA, 64 nt, Homo Sapiens
ccagagggucagaacuggaccacaugggggcuggccacaauagcaggaggcagcucccuccugg

SEQ ID NO: 148183 - RNA, 64 nt, Homo Sapiens
gaaucuaaaaggaaaccguuugguucuggaaaagccacaauauuacugaggaaagggaacaugc

SEQ ID NO: 148184 - RNA, 64 nt, Homo Sapiens
gagguuauguguguauguuguaguuuuauugcagccacaauaauuuuaccaaaguuuucacaua

SEQ ID NO: 148185 - RNA, 64 nt, Homo Sapiens
uccugcccuuccucaguuuaauccuucuaguuucccacaauauaaaacuguacuucacugucag

SEQ ID NO: 148186 - RNA, 64 nt, Homo Sapiens
ggauaauuaaauaaugugccaaauuuaaguuguaccacaauauucaaaucauagucuuauggaa

SEQ ID NO: 148187 - RNA, 64 nt, Homo Sapiens
ucuguccaaaugaaaaagguauuucuaacaacaaccacaauaacaauaacaacuuagugcuuag

SEQ ID NO: 148188 - RNA, 64 nt, Homo Sapiens
uagaagggaaaacugcauggcagauacgugacugccacaauaugcaucgaagacaaacuuacua

SEQ ID NO: 148189 - RNA, 64 nt, Homo Sapiens
uucugcaugauccaggagcacauaccacaaacuaccacaauaaaaaagcuguuuuugcuaauug

SEQ ID NO: 148190 - RNA, 64 nt, Homo Sapiens
agggccccuagaaaccaccuggguucagccucucccacaauaagaguucuugcccuucauaccc

SEQ ID NO: 148191 - RNA, 64 nt, Homo Sapiens
uucaaaagugagguagucauccagguucccccucccacaauauuuuuguaucauaaaauuuaga

SEQ ID NO: 148192 - RNA, 64 nt, Homo Sapiens
ccagccaggccaucucacguguacauaaucagagccacaauaaauucuauuucacaccccuugu

SEQ ID NO: 148193 - RNA, 64 nt, Homo Sapiens
uaaauaaccucauguuuauuccuaaucuaaauugccacaauauuuuuaauguaugguuacacug

SEQ ID NO: 148194 - RNA, 64 nt, Homo Sapiens
gauuuucccauuaacaauuuuuuuugugugugggccacaauauuccaguugaucuggcaaugac

SEQ ID NO: 148195 - RNA, 64 nt, Homo Sapiens
guugagaaaacaccaagcuguacccuucuccuguccacaauaaaaaaaaaccuucaagucuacu

SEQ ID NO: 148196 - RNA, 64 nt, Homo Sapiens
aauggguuccaaaauggcccgcccagaguaacacccacaauauacuaguauggggcuagaugaa

SEQ ID NO: 148197 - RNA, 64 nt, Homo Sapiens
auacccaacaaaguggcugcgguuauaaggagucccacaauagagagcaauauugagguuggcc

SEQ ID NO: 148198 - RNA, 64 nt, Homo Sapiens
uaagauucaucagagcccacccuauucuaaggaaccacaauaacuuacucuggccccaguguua

SEQ ID NO: 148199 - RNA, 64 nt, Homo Sapiens
guuaaacauucuuauuucucauauuuaaaggauaccacaauaagcugcuguguguggaauugcu

SEQ ID NO: 148200 - RNA, 64 nt, Homo Sapiens
uggcucuuguagcuuaguaaugagucauagcuacccacaauaaccuaauaaaaacucaaguuca

SEQ ID NO: 148201 - RNA, 64 nt, Homo Sapiens
ggcugagcucuuaucuugcagugcccuucugagcccacaauaaaccucugcauguucugcucuu

SEQ ID NO: 148202 - RNA, 64 nt, Homo Sapiens
caccucuguggaugauguugaugaagcucacuggccacaauaccugucaacuacccaccugggg

SEQ ID NO: 148203 - RNA, 64 nt, Homo Sapiens
caauauguggugauaaugaagauguuuccaaauuccacaauaagcuuccugaagaagagaaaug

SEQ ID NO: 148204 - RNA, 64 nt, Homo Sapiens
aaaaccaaaaacuacuguguuugauacauaugauccacaauauaguucuuuaugaauauuaccu

SEQ ID NO: 148205 - RNA, 64 nt, Homo Sapiens
uagccauuuuggaaggggaacugaccacuaccucccacaauaccuuaucuacacacuuucgggu

SEQ ID NO: 148206 - RNA, 64 nt, Homo Sapiens
caauauuucucugaguagcuauuuccauguuauuccacaauaugcuuuagaguuaagccuuugu

SEQ ID NO: 148207 - RNA, 64 nt, Homo Sapiens
uccugggaccuuuuguacuuaaugaaucaacaaaccacaauacugucauuugggcuuucuguug

SEQ ID NO: 148208 - RNA, 64 nt, Homo Sapiens
aauuacuaaaaagcuugguauguaaaauuauucuccacaauauuaccaugcaaguuaucucuga

SEQ ID NO: 148209 - RNA, 64 nt, Homo Sapiens
uagccuuuuguuguuguugucauaggcaguguacccacaauagacuuguggagcaggacuaccc

SEQ ID NO: 148210 - RNA, 64 nt, Homo Sapiens
cagagauggagcaaaccaguaaaguucaaaacagccacaauaauugccaagggaguauuuucac

SEQ ID NO: 148211 - RNA, 64 nt, Homo Sapiens
gugucuaucaacauguuucuuuacuacaaacaagccacaauaaaauguugagggguugaauguu

SEQ ID NO: 148212 - RNA, 64 nt, Homo Sapiens
ccugugaagauguaugaaugguaucuuuuauaauccacaauacauuucugguaagauggaauca

SEQ ID NO: 148213 - RNA, 64 nt, Homo Sapiens
aaucuauggcaagcaacuaaaguauuauggaaauccacaauaacagcugcucuuuaggaugggg

SEQ ID NO: 148214 - RNA, 64 nt, Homo Sapiens
auacaaacgaagaguuuaaguagggguucaugacccacaauagguaauuuuaaucaaauucuca

SEQ ID NO: 148215 - RNA, 64 nt, Homo Sapiens
ggagaauaaugauagaugauggugacuauucuugccacaauauuguaucuuaauuuuuacuugc

SEQ ID NO: 148216 - RNA, 64 nt, Homo Sapiens
agcaacacuuccuaaucaaaguuacaaagcaaaaccacaauaucauccuuuugguagaaaucag

SEQ ID NO: 148217 - RNA, 64 nt, Homo Sapiens
caauccuaauugugguccuguuucaucaccucguccacaauaguaucucaccuuuggggcugcg

SEQ ID NO: 148218 - RNA, 64 nt, Homo Sapiens
aaagcagaaaaccaggaaaauuuucuuaaaauauccacaauauuccuugagugagucagaaucu

SEQ ID NO: 148219 - RNA, 64 nt, Homo Sapiens
cuugauuuuucuuuacauucucaauauuuugaugccacaauaaacuugacugauaacagcucug

SEQ ID NO: 148220 - RNA, 64 nt, Homo Sapiens
caacaugggaaaaugccuuacaguuagaaaucagccacaauaaaauugaaaauauuguaacuuu

SEQ ID NO: 148221 - RNA, 64 nt, Homo Sapiens
ugacggcuggguguuucagugcucucgacaguauccacaauagcgacuggcacuggugguuuuu

SEQ ID NO: 148222 - RNA, 64 nt, Homo Sapiens
aauggacccaacucagcucucucuaagcccugauccacaauaaaaaugcugaccggugcuuauc

SEQ ID NO: 148223 - RNA, 64 nt, Homo Sapiens
cacauuuguacaauucauugauucucuuuuccuuccacaauaaaaugguauacaagaacaggag

SEQ ID NO: 148224 - RNA, 64 nt, Homo Sapiens
uuaguucugacauguauauauugcuucaguagagccacaauauguaucuuugcuguaaagugca

SEQ ID NO: 148225 - RNA, 64 nt, Homo Sapiens
acagacauugcuuucaaauguuagcugcugaaauccacaauaaacgucauuuaaaaaaaaaaaa

SEQ ID NO: 148226 - RNA, 64 nt, Homo Sapiens
gaaaucuuuauauuuaucgauuguaaacugaggaccacaauaaacccugguuccugucuguuau

SEQ ID NO: 148227 - RNA, 64 nt, Homo Sapiens
caucaucguuuggcccucucacuuuguucagcugccacaauagaguuccaguucuguaagucuc

SEQ ID NO: 148228 - RNA, 64 nt, Homo Sapiens
ccucccaaagugcugggauuauaggcacaagacaccacaauaauuauugccuguaugucaauua

SEQ ID NO: 148229 - RNA, 64 nt, Homo Sapiens
caguuuuugcuggauggguuauuuguacugaaauccacaauaauuaaugugugacaacuuggaa

SEQ ID NO: 148230 - RNA, 64 nt, Homo Sapiens
agggcucacgugggaaccccccucccacccaccgccacaauaaagaucgcccccaccuccaccc

SEQ ID NO: 148231 - RNA, 64 nt, Homo Sapiens
uccaauguccugaaacaugaacccaaaaagagacccacaauaaacucgugacuuguccccucau

SEQ ID NO: 148232 - RNA, 64 nt, Homo Sapiens
uauuuaagagguggggucccaggugggaacccccccacaauaaagucugucaauguuuggagag

SEQ ID NO: 148233 - RNA, 64 nt, Homo Sapiens
ccgacucccggggcccucagacaccccgauccucccacaauaaaggcuucucaauccgcacucu

SEQ ID NO: 148234 - RNA, 64 nt, Homo Sapiens
aguaugcaaacuuuaaucgcacaucuucuguauuccacaauaguacuuacucuugagaagcaua

SEQ ID NO: 148235 - RNA, 64 nt, Homo Sapiens
ugugagaaagccuucagcccucucucauugguuaccacaauauuuacaugaggaaaauaccaca

SEQ ID NO: 148236 - RNA, 64 nt, Homo Sapiens
cucucaacaaaugugugguaaagcuguuuguucuccacaauaggguaaucaaccuuuacuuccc

SEQ ID NO: 148237 - RNA, 64 nt, Homo Sapiens
gugaauauugcaauaaagcauccacuccagaucaccacaauaauaccucagagauauugcaggc

SEQ ID NO: 148238 - RNA, 64 nt, Homo Sapiens
cucaucaacauggcugcuugacugcagcuccuggccacaauagcuggcuguuggcugaacgcug

SEQ ID NO: 148239 - RNA, 64 nt, Homo Sapiens
cugacagagaacgcuacuaauacuugauuucuuuccacaauaaaaaucuuuuugagaauuuguu

SEQ ID NO: 148240 - RNA, 64 nt, Homo Sapiens
aaccugaaaaccaacuccgcugccagaaauacacccacaauaaaccucaccaccccugucccgc

SEQ ID NO: 148241 - RNA, 64 nt, Homo Sapiens
agaaacacucccagggacucauccccuauucccuccacaauaacacgucccacccuguccccag

SEQ ID NO: 148242 - RNA, 64 nt, Homo Sapiens
ggcuucucaauccgcacucuacaccccgauccucccacaauaaaucccgacuccuggagcccug

SEQ ID NO: 148243 - RNA, 64 nt, Homo Sapiens
ggcuucucaauccgcacucuacaccccgauccucccacaauaaaccgucucccggggcccuagg

SEQ ID NO: 148244 - RNA, 64 nt, Homo Sapiens
aaaaggcagaaaaggccgggucagggaaagagaaccacaauagaggagacagaacaacagaguc

SEQ ID NO: 148245 - RNA, 64 nt, Homo Sapiens
cgcuguuucuccuugagcuucgcccagcuccccuccacaauaaaguucuccgagggcugagccc

SEQ ID NO: 148246 - RNA, 64 nt, Homo Sapiens
gcaaauauugcuauaaaguguggguugcagcccaccacaauaaaaccucaaagauauuguggau

SEQ ID NO: 148247 - RNA, 64 nt, Homo Sapiens
guaauaacagaauuggaaccaugccacucuugagccacaauaccugucaccagccuguuguuuu

SEQ ID NO: 148248 - RNA, 64 nt, Homo Sapiens
cuacaucauuaaccaguaaggacuuuuuaauuaaccacaauaccacuaucacaccuaauaauag

SEQ ID NO: 148249 - RNA, 64 nt, Homo Sapiens
ccaccaaguucaccagguucaccagacacggccuccacaauagccacacccacaccugagcugu

SEQ ID NO: 148250 - RNA, 64 nt, Homo Sapiens
cuuagugcuuggcucagacauggaugucccuuccccacaauagggggucugugauggggaaggg

SEQ ID NO: 148251 - RNA, 64 nt, Homo Sapiens
ucaaacuucucccuguagaccguaaggaugaauuccacaauaggauccuuuuuaaaaucgauuu

SEQ ID NO: 148252 - RNA, 64 nt, Homo Sapiens
uuaguaguuaacuuccuauuaaaacuccaaaauuccacaauauucuuguauucuuucacuugaa

SEQ ID NO: 148253 - RNA, 64 nt, Homo Sapiens
caaaaacuaaacacacacacaaacccccagaaacccacaauauguacacgcuaaggaaaaacua

SEQ ID NO: 148254 - RNA, 64 nt, Homo Sapiens
ucuagcccaucuuacuccagguuugauacucuuuccacaauacugagcugccucagaauccuca

SEQ ID NO: 148255 - RNA, 64 nt, Homo Sapiens
ugcaaucauaugguugacuuuugaauggaaaaccccacaauauuaagaaaagcauucaugugac

SEQ ID NO: 148256 - RNA, 64 nt, Homo Sapiens
aauuuaauuuauauagaguaccuauuauuauaugccacaauagagcucuaugagaaacaguguc

SEQ ID NO: 148257 - RNA, 64 nt, Homo Sapiens
gggagggauuuugacuaguugaauuauuaagccaccacaauaaagcagauuuuuaaauaagaaa

SEQ ID NO: 148258 - RNA, 64 nt, Homo Sapiens
ggggcuuaaugguuuccuggugauucuuaccaauccacaauaaacauggcccauuggcauaucu

SEQ ID NO: 148259 - RNA, 64 nt, Homo Sapiens
ccacugguaucugggggacuuaauuaccuaagagccacaauaagaagcccacagagguggaacu

SEQ ID NO: 148260 - RNA, 64 nt, Homo Sapiens
caugaucugaagcagcucugccuacccccuggccccacaauaaaagcccucucacccgaggauc

SEQ ID NO: 148261 - RNA, 64 nt, Homo Sapiens
auucuccagaaaauaaguccuccuguauuauccuccacaauaaaccacuuaccuggagcugcuc

SEQ ID NO: 148262 - RNA, 64 nt, Homo Sapiens
gcaggagcccucuugaaauuuccccaucugaaauccacaauacuuacuccuggucugauuauuu

SEQ ID NO: 148263 - RNA, 64 nt, Homo Sapiens
cauacuauguguuugcaguaaaccauucacagguccacaauauuaggggaagugagauuuaaaa

SEQ ID NO: 148264 - RNA, 64 nt, Homo Sapiens
cccaauguuugccuauccacgggccccccaagucccacaauagcguguggggacgggggaguca

SEQ ID NO: 148265 - RNA, 63 nt, Homo Sapiens; identical to SEQ ID NO: 23714

SEQ ID NO: 148266 - RNA, 64 nt, Homo Sapiens; identical to SEQ ID NO: 23715

SEQ ID NO: 148267 - RNA, 64 nt, Homo Sapiens; identical to SEQ ID NO: 23716

SEQ ID NO: 148268 - RNA, 64 nt, Homo Sapiens; identical to SEQ ID NO: 23717

SEQ ID NO: 148269 - RNA, 64 nt, Homo Sapiens; identical to SEQ ID NO: 23718

SEQ ID NO: 148270 - RNA, 64 nt, Homo Sapiens; identical to SEQ ID NO: 23719

SEQ ID NO: 148271 - RNA, 64 nt, Homo Sapiens; identical to SEQ ID NO: 23720

SEQ ID NO: 148272 - RNA, 64 nt, Homo Sapiens; identical to SEQ ID NO: 23721

SEQ ID NO: 148273 - RNA, 64 nt, Homo Sapiens; identical to SEQ ID NO: 23722

SEQ ID NO: 148274 - RNA, 64 nt, Homo Sapiens; identical to SEQ ID NO: 23723

SEQ ID NO: 148275 - RNA, 64 nt, Homo Sapiens; identical to SEQ ID NO: 23724

SEQ ID NO: 148276 - RNA, 64 nt, Homo Sapiens; identical to SEQ ID NO: 23725

SEQ ID NO: 148277 - RNA, 64 nt, Homo Sapiens; identical to SEQ ID NO: 23726

SEQ ID NO: 148278 - RNA, 64 nt, Homo Sapiens; identical to SEQ ID NO: 23727

SEQ ID NO: 148279 - RNA, 64 nt, Homo Sapiens; identical to SEQ ID NO: 23728

SEQ ID NO: 148280 - RNA, 64 nt, Homo Sapiens; identical to SEQ ID NO: 23729

SEQ ID NO: 148281 - RNA, 64 nt, Homo Sapiens
guuccauuuaacauuccaacgacauuaguaugaaauuuacuacaccaaagaaaugccaauaugu

SEQ ID NO: 148282 - RNA, 64 nt, Homo Sapiens
acucaggauuauaaggcugguacagcaacaaauaauuuacuaucaauaaaauauuggcaaacaa

SEQ ID NO: 148283 - RNA, 64 nt, Homo Sapiens
augagaacaguaugggggaaauaucgugagacuuauuuacuaccaacccuuuuaaaaccaucag

SEQ ID NO: 148284 - RNA, 64 nt, Homo Sapiens
uucuaaaguuuauugauacuuaagggacaggugaauuuacuacuacaauugcauacccauauuu

SEQ ID NO: 148285 - RNA, 64 nt, Homo Sapiens
gcuuuguaacaauugcauacacauuuuauaaaccauuuacuauggaguaacauaaaauaaaagu

SEQ ID NO: 148286 - RNA, 64 nt, Homo Sapiens
augauuaagacuuacauuuuaacuucccacauauauuuacuaagguauaucuauuaaaaauuuc

SEQ ID NO: 148287 - RNA, 64 nt, Homo Sapiens
cagaugaauucagugugagguuugcuaucauaauauuuacuaugaaaugaauaucugcauggga

SEQ ID NO: 148288 - RNA, 64 nt, Homo Sapiens
aauuuuuaaaauucagaauguaaaaauuggguaaauuuacuacugaggggagugcacuuauuua

SEQ ID NO: 148289 - RNA, 64 nt, Homo Sapiens
auuuuugauguuuauauauaaacucuauauccuaauuuacuaauacucaucagaugucagccuu

SEQ ID NO: 148290 - RNA, 64 nt, Homo Sapiens
auuguuguaaaaugaggaauaaagguaaugccucauuuacuaguugauacuaaugacuacaaaa

SEQ ID NO: 148291 - RNA, 64 nt, Homo Sapiens
uguauuuccuuguguguaaauuuuccaugugaugauuuacuaguuugcuagcaaggcugagcac

SEQ ID NO: 148292 - RNA, 55 nt, Homo Sapiens; identical to SEQ ID NO: 118903

SEQ ID NO: 148293 - RNA, 64 nt, Homo Sapiens
gcuauucguggugggggugggggggaacccuaugauuuacuaugcagaugaagaggguaggaac

SEQ ID NO: 148294 - RNA, 64 nt, Homo Sapiens
cguguuuccagcaguuggcagguugugcaaauguauuuacuaugcccuggagggcacuguguuu

SEQ ID NO: 148295 - RNA, 64 nt, Homo Sapiens
cuauaugugaauaucccuguucccuacacagggaauuuacuacccucuaucucacuggcugcau

SEQ ID NO: 148296 - RNA, 64 nt, Homo Sapiens; identical to SEQ ID NO: 65415

SEQ ID NO: 148297 - RNA, 64 nt, Homo Sapiens; identical to SEQ ID NO: 65416

SEQ ID NO: 148298 - RNA, 64 nt, Homo Sapiens; identical to SEQ ID NO: 65417

SEQ ID NO: 148299 - RNA, 64 nt, Homo Sapiens; identical to SEQ ID NO: 65418

SEQ ID NO: 148300 - RNA, 64 nt, Homo Sapiens; identical to SEQ ID NO: 61352

SEQ ID NO: 148301 - RNA, 64 nt, Homo Sapiens; identical to SEQ ID NO: 61353

SEQ ID NO: 148302 - RNA, 64 nt, Homo Sapiens; identical to SEQ ID NO: 65421

SEQ ID NO: 148303 - RNA, 64 nt, Homo Sapiens; identical to SEQ ID NO: 65422

SEQ ID NO: 148304 - RNA, 64 nt, Homo Sapiens; identical to SEQ ID NO: 65423

SEQ ID NO: 148305 - RNA, 64 nt, Homo Sapiens; identical to SEQ ID NO: 65424

SEQ ID NO: 148306 - RNA, 64 nt, Homo Sapiens; identical to SEQ ID NO: 65425

SEQ ID NO: 148307 - RNA, 64 nt, Homo Sapiens; identical to SEQ ID NO: 65426

SEQ ID NO: 148308 - RNA, 64 nt, Homo Sapiens; identical to SEQ ID NO: 61354

SEQ ID NO: 148309 - RNA, 64 nt, Homo Sapiens; identical to SEQ ID NO: 61355

SEQ ID NO: 148310 - RNA, 64 nt, Homo Sapiens; identical to SEQ ID NO: 65429

SEQ ID NO: 148311 - RNA, 64 nt, Homo Sapiens; identical to SEQ ID NO: 65430

SEQ ID NO: 148312 - RNA, 64 nt, Homo Sapiens; identical to SEQ ID NO: 65431

SEQ ID NO: 148313 - RNA, 64 nt, Homo Sapiens; identical to SEQ ID NO: 65432

SEQ ID NO: 148314 - RNA, 64 nt, Homo Sapiens; identical to SEQ ID NO: 65433

SEQ ID NO: 148315 - RNA, 64 nt, Homo Sapiens; identical to SEQ ID NO: 65434

SEQ ID NO: 148316 - RNA, 64 nt, Homo Sapiens; identical to SEQ ID NO: 65435

SEQ ID NO: 148317 - RNA, 64 nt, Homo Sapiens; identical to SEQ ID NO: 65436

SEQ ID NO: 148318 - RNA, 64 nt, Homo Sapiens; identical to SEQ ID NO: 65437

SEQ ID NO: 148319 - RNA, 64 nt, Homo Sapiens; identical to SEQ ID NO: 65438

SEQ ID NO: 148320 - RNA, 64 nt, Homo Sapiens; identical to SEQ ID NO: 65439

SEQ ID NO: 148321 - RNA, 64 nt, Homo Sapiens; identical to SEQ ID NO: 65440

SEQ ID NO: 148322 - RNA, 64 nt, Homo Sapiens; identical to SEQ ID NO: 61356

SEQ ID NO: 148323 - RNA, 64 nt, Homo Sapiens; identical to SEQ ID NO: 61357

SEQ ID NO: 148324 - RNA, 64 nt, Homo Sapiens; identical to SEQ ID NO: 65443

SEQ ID NO: 148325 - RNA, 64 nt, Homo Sapiens; identical to SEQ ID NO: 65444

SEQ ID NO: 148326 - RNA, 64 nt, Homo Sapiens; identical to SEQ ID NO: 65445

SEQ ID NO: 148327 - RNA, 64 nt, Homo Sapiens; identical to SEQ ID NO: 65446

SEQ ID NO: 148328 - RNA, 64 nt, Homo Sapiens; identical to SEQ ID NO: 65447

SEQ ID NO: 148329 - RNA, 64 nt, Homo Sapiens; identical to SEQ ID NO: 65448

SEQ ID NO: 148330 - RNA, 64 nt, Homo Sapiens; identical to SEQ ID NO: 65449

SEQ ID NO: 148331 - RNA, 64 nt, Homo Sapiens; identical to SEQ ID NO: 65450

SEQ ID NO: 148332 - RNA, 64 nt, Homo Sapiens; identical to SEQ ID NO: 65451

SEQ ID NO: 148333 - RNA, 64 nt, Homo Sapiens; identical to SEQ ID NO: 65452

SEQ ID NO: 148334 - RNA, 64 nt, Homo Sapiens; identical to SEQ ID NO: 65453

SEQ ID NO: 148335 - RNA, 64 nt, Homo Sapiens; identical to SEQ ID NO: 65454

SEQ ID NO: 148336 - RNA, 64 nt, Homo Sapiens; identical to SEQ ID NO: 65455

SEQ ID NO: 148337 - RNA, 64 nt, Homo Sapiens; identical to SEQ ID NO: 65456

SEQ ID NO: 148338 - RNA, 64 nt, Homo Sapiens; identical to SEQ ID NO: 65457

SEQ ID NO: 148339 - RNA, 64 nt, Homo Sapiens; identical to SEQ ID NO: 65458

SEQ ID NO: 148340 - RNA, 64 nt, Homo Sapiens; identical to SEQ ID NO: 65459

SEQ ID NO: 148341 - RNA, 64 nt, Homo Sapiens; identical to SEQ ID NO: 65460

SEQ ID NO: 148342 - RNA, 64 nt, Homo Sapiens; identical to SEQ ID NO: 65461

SEQ ID NO: 148343 - RNA, 64 nt, Homo Sapiens; identical to SEQ ID NO: 65462

SEQ ID NO: 148344 - RNA, 64 nt, Homo Sapiens; identical to SEQ ID NO: 65463

SEQ ID NO: 148345 - RNA, 64 nt, Homo Sapiens; identical to SEQ ID NO: 65464

SEQ ID NO: 148346 - RNA, 64 nt, Homo Sapiens; identical to SEQ ID NO: 61358

SEQ ID NO: 148347 - RNA, 64 nt, Homo Sapiens; identical to SEQ ID NO: 61359

SEQ ID NO: 148348 - RNA, 64 nt, Homo Sapiens; identical to SEQ ID NO: 65467

SEQ ID NO: 148349 - RNA, 64 nt, Homo Sapiens; identical to SEQ ID NO: 65468

SEQ ID NO: 148350 - RNA, 64 nt, Homo Sapiens; identical to SEQ ID NO: 65469

SEQ ID NO: 148351 - RNA, 64 nt, Homo Sapiens; identical to SEQ ID NO: 65470

SEQ ID NO: 148352 - RNA, 64 nt, Homo Sapiens; identical to SEQ ID NO: 65471

SEQ ID NO: 148353 - RNA, 64 nt, Homo Sapiens; identical to SEQ ID NO: 65472

SEQ ID NO: 148354 - RNA, 64 nt, Homo Sapiens; identical to SEQ ID NO: 65473

SEQ ID NO: 148355 - RNA, 64 nt, Homo Sapiens; identical to SEQ ID NO: 65474

SEQ ID NO: 148356 - RNA, 64 nt, Homo Sapiens; identical to SEQ ID NO: 65475

SEQ ID NO: 148357 - RNA, 64 nt, Homo Sapiens; identical to SEQ ID NO: 65476

SEQ ID NO: 148358 - RNA, 64 nt, Homo Sapiens; identical to SEQ ID NO: 65477

SEQ ID NO: 148359 - RNA, 64 nt, Homo Sapiens; identical to SEQ ID NO: 65478

SEQ ID NO: 148360 - RNA, 64 nt, Homo Sapiens; identical to SEQ ID NO: 65479

SEQ ID NO: 148361 - RNA, 64 nt, Homo Sapiens; identical to SEQ ID NO: 65480

SEQ ID NO: 148362 - RNA, 64 nt, Homo Sapiens; identical to SEQ ID NO: 65481

SEQ ID NO: 148363 - RNA, 64 nt, Homo Sapiens; identical to SEQ ID NO: 65482

SEQ ID NO: 148364 - RNA, 64 nt, Homo Sapiens; identical to SEQ ID NO: 65483

SEQ ID NO: 148365 - RNA, 64 nt, Homo Sapiens; identical to SEQ ID NO: 65484

SEQ ID NO: 148366 - RNA, 64 nt, Homo Sapiens; identical to SEQ ID NO: 65485

SEQ ID NO: 148367 - RNA, 64 nt, Homo Sapiens; identical to SEQ ID NO: 65486

SEQ ID NO: 148368 - RNA, 64 nt, Homo Sapiens; identical to SEQ ID NO: 65487

SEQ ID NO: 148369 - RNA, 64 nt, Homo Sapiens; identical to SEQ ID NO: 65488

SEQ ID NO: 148370 - RNA, 64 nt, Homo Sapiens; identical to SEQ ID NO: 65489

SEQ ID NO: 148371 - RNA, 64 nt, Homo Sapiens; identical to SEQ ID NO: 65490

SEQ ID NO: 148372 - RNA, 64 nt, Homo Sapiens; identical to SEQ ID NO: 65491

SEQ ID NO: 148373 - RNA, 64 nt, Homo Sapiens; identical to SEQ ID NO: 65492

SEQ ID NO: 148374 - RNA, 64 nt, Homo Sapiens; identical to SEQ ID NO: 65493

SEQ ID NO: 148375 - RNA, 64 nt, Homo Sapiens; identical to SEQ ID NO: 65494

SEQ ID NO: 148376 - RNA, 64 nt, Homo Sapiens; identical to SEQ ID NO: 65495

SEQ ID NO: 148377 - RNA, 64 nt, Homo Sapiens; identical to SEQ ID NO: 65496

SEQ ID NO: 148378 - RNA, 64 nt, Homo Sapiens; identical to SEQ ID NO: 65497

SEQ ID NO: 148379 - RNA, 64 nt, Homo Sapiens; identical to SEQ ID NO: 65498

SEQ ID NO: 148380 - RNA, 64 nt, Homo Sapiens; identical to SEQ ID NO: 65499

SEQ ID NO: 148381 - RNA, 64 nt, Homo Sapiens; identical to SEQ ID NO: 65500

SEQ ID NO: 148382 - RNA, 64 nt, Homo Sapiens; identical to SEQ ID NO: 65501

SEQ ID NO: 148383 - RNA, 64 nt, Homo Sapiens; identical to SEQ ID NO: 65502

SEQ ID NO: 148384 - RNA, 64 nt, Homo Sapiens; identical to SEQ ID NO: 65503

SEQ ID NO: 148385 - RNA, 64 nt, Homo Sapiens; identical to SEQ ID NO: 65504

SEQ ID NO: 148386 - RNA, 64 nt, Homo Sapiens; identical to SEQ ID NO: 65505

SEQ ID NO: 148387 - RNA, 64 nt, Homo Sapiens; identical to SEQ ID NO: 65506

SEQ ID NO: 148388 - RNA, 64 nt, Homo Sapiens; identical to SEQ ID NO: 65507

SEQ ID NO: 148389 - RNA, 64 nt, Homo Sapiens; identical to SEQ ID NO: 65508

SEQ ID NO: 148390 - RNA, 64 nt, Homo Sapiens; identical to SEQ ID NO: 61360

SEQ ID NO: 148391 - RNA, 64 nt, Homo Sapiens; identical to SEQ ID NO: 61361

SEQ ID NO: 148392 - RNA, 64 nt, Homo Sapiens; identical to SEQ ID NO: 65511

SEQ ID NO: 148393 - RNA, 64 nt, Homo Sapiens; identical to SEQ ID NO: 65512

SEQ ID NO: 148394 - RNA, 64 nt, Homo Sapiens; identical to SEQ ID NO: 65513

SEQ ID NO: 148395 - RNA, 64 nt, Homo Sapiens; identical to SEQ ID NO: 65514

SEQ ID NO: 148396 - RNA, 64 nt, Homo Sapiens; identical to SEQ ID NO: 65515

SEQ ID NO: 148397 - RNA, 64 nt, Homo Sapiens; identical to SEQ ID NO: 65516

SEQ ID NO: 148398 - RNA, 64 nt, Homo Sapiens; identical to SEQ ID NO: 65517

SEQ ID NO: 148399 - RNA, 64 nt, Homo Sapiens; identical to SEQ ID NO: 65518

SEQ ID NO: 148400 - RNA, 64 nt, Homo Sapiens; identical to SEQ ID NO: 65519

SEQ ID NO: 148401 - RNA, 64 nt, Homo Sapiens; identical to SEQ ID NO: 65520

SEQ ID NO: 148402 - RNA, 64 nt, Homo Sapiens; identical to SEQ ID NO: 65521

SEQ ID NO: 148403 - RNA, 64 nt, Homo Sapiens; identical to SEQ ID NO: 65522

SEQ ID NO: 148404 - RNA, 64 nt, Homo Sapiens; identical to SEQ ID NO: 65523

SEQ ID NO: 148405 - RNA, 64 nt, Homo Sapiens; identical to SEQ ID NO: 65524

SEQ ID NO: 148406 - RNA, 64 nt, Homo Sapiens; identical to SEQ ID NO: 65525

SEQ ID NO: 148407 - RNA, 64 nt, Homo Sapiens; identical to SEQ ID NO: 65526

SEQ ID NO: 148408 - RNA, 64 nt, Homo Sapiens; identical to SEQ ID NO: 65527

SEQ ID NO: 148409 - RNA, 64 nt, Homo Sapiens; identical to SEQ ID NO: 65528

SEQ ID NO: 148410 - RNA, 64 nt, Homo Sapiens; identical to SEQ ID NO: 61362

SEQ ID NO: 148411 - RNA, 64 nt, Homo Sapiens; identical to SEQ ID NO: 61363

SEQ ID NO: 148412 - RNA, 64 nt, Homo Sapiens; identical to SEQ ID NO: 61364

SEQ ID NO: 148413 - RNA, 64 nt, Homo Sapiens; identical to SEQ ID NO: 61365

SEQ ID NO: 148414 - RNA, 64 nt, Homo Sapiens; identical to SEQ ID NO: 65533

SEQ ID NO: 148415 - RNA, 64 nt, Homo Sapiens; identical to SEQ ID NO: 65534

SEQ ID NO: 148416 - RNA, 64 nt, Homo Sapiens; identical to SEQ ID NO: 65535

SEQ ID NO: 148417 - RNA, 64 nt, Homo Sapiens; identical to SEQ ID NO: 65536

SEQ ID NO: 148418 - RNA, 64 nt, Homo Sapiens; identical to SEQ ID NO: 65537

SEQ ID NO: 148419 - RNA, 64 nt, Homo Sapiens; identical to SEQ ID NO: 65538

SEQ ID NO: 148420 - RNA, 64 nt, Homo Sapiens; identical to SEQ ID NO: 65539

SEQ ID NO: 148421 - RNA, 64 nt, Homo Sapiens; identical to SEQ ID NO: 65540

SEQ ID NO: 148422 - RNA, 64 nt, Homo Sapiens; identical to SEQ ID NO: 65541

SEQ ID NO: 148423 - RNA, 64 nt, Homo Sapiens; identical to SEQ ID NO: 65542

SEQ ID NO: 148424 - RNA, 64 nt, Homo Sapiens; identical to SEQ ID NO: 65543

SEQ ID NO: 148425 - RNA, 64 nt, Homo Sapiens; identical to SEQ ID NO: 65544

SEQ ID NO: 148426 - RNA, 64 nt, Homo Sapiens; identical to SEQ ID NO: 65545

SEQ ID NO: 148427 - RNA, 64 nt, Homo Sapiens; identical to SEQ ID NO: 65546

SEQ ID NO: 148428 - RNA, 64 nt, Homo Sapiens; identical to SEQ ID NO: 65547

SEQ ID NO: 148429 - RNA, 64 nt, Homo Sapiens; identical to SEQ ID NO: 61366

SEQ ID NO: 148430 - RNA, 64 nt, Homo Sapiens; identical to SEQ ID NO: 61367

SEQ ID NO: 148431 - RNA, 64 nt, Homo Sapiens; identical to SEQ ID NO: 65550

SEQ ID NO: 148432 - RNA, 64 nt, Homo Sapiens; identical to SEQ ID NO: 65551

SEQ ID NO: 148433 - RNA, 64 nt, Homo Sapiens; identical to SEQ ID NO: 61368

SEQ ID NO: 148434 - RNA, 56 nt, Homo Sapiens; identical to SEQ ID NO: 61369

SEQ ID NO: 148435 - RNA, 64 nt, Homo Sapiens; identical to SEQ ID NO: 65554

SEQ ID NO: 148436 - RNA, 64 nt, Homo Sapiens; identical to SEQ ID NO: 65555

SEQ ID NO: 148437 - RNA, 64 nt, Homo Sapiens; identical to SEQ ID NO: 65556

SEQ ID NO: 148438 - RNA, 64 nt, Homo Sapiens; identical to SEQ ID NO: 65557

SEQ ID NO: 148439 - RNA, 64 nt, Homo Sapiens; identical to SEQ ID NO: 65558

SEQ ID NO: 148440 - RNA, 64 nt, Homo Sapiens; identical to SEQ ID NO: 65559

SEQ ID NO: 148441 - RNA, 64 nt, Homo Sapiens; identical to SEQ ID NO: 65560

SEQ ID NO: 148442 - RNA, 64 nt, Homo Sapiens; identical to SEQ ID NO: 65561

SEQ ID NO: 148443 - RNA, 64 nt, Homo Sapiens; identical to SEQ ID NO: 65562

SEQ ID NO: 148444 - RNA, 64 nt, Homo Sapiens; identical to SEQ ID NO: 65563

SEQ ID NO: 148445 - RNA, 64 nt, Homo Sapiens; identical to SEQ ID NO: 65564

SEQ ID NO: 148446 - RNA, 64 nt, Homo Sapiens; identical to SEQ ID NO: 65565

SEQ ID NO: 148447 - RNA, 64 nt, Homo Sapiens; identical to SEQ ID NO: 65566

SEQ ID NO: 148448 - RNA, 64 nt, Homo Sapiens; identical to SEQ ID NO: 65567

SEQ ID NO: 148449 - RNA, 64 nt, Homo Sapiens; identical to SEQ ID NO: 65568

SEQ ID NO: 148450 - RNA, 64 nt, Homo Sapiens; identical to SEQ ID NO: 65569

SEQ ID NO: 148451 - RNA, 64 nt, Homo Sapiens; identical to SEQ ID NO: 65570

SEQ ID NO: 148452 - RNA, 64 nt, Homo Sapiens; identical to SEQ ID NO: 65571

SEQ ID NO: 148453 - RNA, 64 nt, Homo Sapiens; identical to SEQ ID NO: 65572

SEQ ID NO: 148454 - RNA, 64 nt, Homo Sapiens; identical to SEQ ID NO: 65573

SEQ ID NO: 148455 - RNA, 64 nt, Homo Sapiens; identical to SEQ ID NO: 61370

SEQ ID NO: 148456 - RNA, 64 nt, Homo Sapiens; identical to SEQ ID NO: 61371

SEQ ID NO: 148457 - RNA, 64 nt, Homo Sapiens; identical to SEQ ID NO: 65576

SEQ ID NO: 148458 - RNA, 64 nt, Homo Sapiens; identical to SEQ ID NO: 65577

SEQ ID NO: 148459 - RNA, 64 nt, Homo Sapiens; identical to SEQ ID NO: 65578

SEQ ID NO: 148460 - RNA, 64 nt, Homo Sapiens; identical to SEQ ID NO: 65579

SEQ ID NO: 148461 - RNA, 64 nt, Homo Sapiens; identical to SEQ ID NO: 65580

SEQ ID NO: 148462 - RNA, 64 nt, Homo Sapiens; identical to SEQ ID NO: 65581

SEQ ID NO: 148463 - RNA, 64 nt, Homo Sapiens; identical to SEQ ID NO: 65582

SEQ ID NO: 148464 - RNA, 64 nt, Homo Sapiens; identical to SEQ ID NO: 65583

SEQ ID NO: 148465 - RNA, 64 nt, Homo Sapiens; identical to SEQ ID NO: 65584

SEQ ID NO: 148466 - RNA, 64 nt, Homo Sapiens; identical to SEQ ID NO: 65585

SEQ ID NO: 148467 - RNA, 64 nt, Homo Sapiens; identical to SEQ ID NO: 65586

SEQ ID NO: 148468 - RNA, 64 nt, Homo Sapiens; identical to SEQ ID NO: 65587

SEQ ID NO: 148469 - RNA, 64 nt, Homo Sapiens; identical to SEQ ID NO: 65588

SEQ ID NO: 148470 - RNA, 64 nt, Homo Sapiens; identical to SEQ ID NO: 65589

SEQ ID NO: 148471 - RNA, 64 nt, Homo Sapiens; identical to SEQ ID NO: 65590

SEQ ID NO: 148472 - RNA, 64 nt, Homo Sapiens; identical to SEQ ID NO: 65591

SEQ ID NO: 148473 - RNA, 64 nt, Homo Sapiens; identical to SEQ ID NO: 65592

SEQ ID NO: 148474 - RNA, 64 nt, Homo Sapiens; identical to SEQ ID NO: 65593

SEQ ID NO: 148475 - RNA, 64 nt, Homo Sapiens; identical to SEQ ID NO: 65594

SEQ ID NO: 148476 - RNA, 64 nt, Homo Sapiens; identical to SEQ ID NO: 65595

SEQ ID NO: 148477 - RNA, 64 nt, Homo Sapiens; identical to SEQ ID NO: 65596

SEQ ID NO: 148478 - RNA, 64 nt, Homo Sapiens; identical to SEQ ID NO: 65597

SEQ ID NO: 148479 - RNA, 64 nt, Homo Sapiens; identical to SEQ ID NO: 65598

SEQ ID NO: 148480 - RNA, 64 nt, Homo Sapiens; identical to SEQ ID NO: 65599

SEQ ID NO: 148481 - RNA, 64 nt, Homo Sapiens; identical to SEQ ID NO: 65600

SEQ ID NO: 148482 - RNA, 64 nt, Homo Sapiens; identical to SEQ ID NO: 65601

SEQ ID NO: 148483 - RNA, 64 nt, Homo Sapiens; identical to SEQ ID NO: 65602

SEQ ID NO: 148484 - RNA, 64 nt, Homo Sapiens; identical to SEQ ID NO: 65603

SEQ ID NO: 148485 - RNA, 64 nt, Homo Sapiens; identical to SEQ ID NO: 65604

SEQ ID NO: 148486 - RNA, 64 nt, Homo Sapiens; identical to SEQ ID NO: 65605

SEQ ID NO: 148487 - RNA, 64 nt, Homo Sapiens; identical to SEQ ID NO: 65606

SEQ ID NO: 148488 - RNA, 64 nt, Homo Sapiens; identical to SEQ ID NO: 65607

SEQ ID NO: 148489 - RNA, 64 nt, Homo Sapiens; identical to SEQ ID NO: 65608

SEQ ID NO: 148490 - RNA, 64 nt, Homo Sapiens; identical to SEQ ID NO: 65609

SEQ ID NO: 148491 - RNA, 64 nt, Homo Sapiens; identical to SEQ ID NO: 65610

SEQ ID NO: 148492 - RNA, 64 nt, Homo Sapiens; identical to SEQ ID NO: 65611

SEQ ID NO: 148493 - RNA, 64 nt, Homo Sapiens; identical to SEQ ID NO: 61372

SEQ ID NO: 148494 - RNA, 64 nt, Homo Sapiens; identical to SEQ ID NO: 61373

SEQ ID NO: 148495 - RNA, 64 nt, Homo Sapiens; identical to SEQ ID NO: 65614

SEQ ID NO: 148496 - RNA, 64 nt, Homo Sapiens; identical to SEQ ID NO: 65615

SEQ ID NO: 148497 - RNA, 64 nt, Homo Sapiens; identical to SEQ ID NO: 65616

SEQ ID NO: 148498 - RNA, 64 nt, Homo Sapiens; identical to SEQ ID NO: 61374

SEQ ID NO: 148499 - RNA, 64 nt, Homo Sapiens; identical to SEQ ID NO: 61375

SEQ ID NO: 148500 - RNA, 64 nt, Homo Sapiens; identical to SEQ ID NO: 65619

SEQ ID NO: 148501 - RNA, 64 nt, Homo Sapiens; identical to SEQ ID NO: 65620

SEQ ID NO: 148502 - RNA, 64 nt, Homo Sapiens; identical to SEQ ID NO: 65621

SEQ ID NO: 148503 - RNA, 64 nt, Homo Sapiens; identical to SEQ ID NO: 65622

SEQ ID NO: 148504 - RNA, 64 nt, Homo Sapiens; identical to SEQ ID NO: 65623

SEQ ID NO: 148505 - RNA, 64 nt, Homo Sapiens; identical to SEQ ID NO: 65624

SEQ ID NO: 148506 - RNA, 64 nt, Homo Sapiens; identical to SEQ ID NO: 65625

SEQ ID NO: 148507 - RNA, 64 nt, Homo Sapiens; identical to SEQ ID NO: 65626

SEQ ID NO: 148508 - RNA, 64 nt, Homo Sapiens; identical to SEQ ID NO: 65627

SEQ ID NO: 148509 - RNA, 64 nt, Homo Sapiens; identical to SEQ ID NO: 65628

SEQ ID NO: 148510 - RNA, 64 nt, Homo Sapiens; identical to SEQ ID NO: 65629

SEQ ID NO: 148511 - RNA, 64 nt, Homo Sapiens; identical to SEQ ID NO: 65630

SEQ ID NO: 148512 - RNA, 64 nt, Homo Sapiens; identical to SEQ ID NO: 65631

SEQ ID NO: 148513 - RNA, 64 nt, Homo Sapiens; identical to SEQ ID NO: 65632

SEQ ID NO: 148514 - RNA, 64 nt, Homo Sapiens; identical to SEQ ID NO: 65633

SEQ ID NO: 148515 - RNA, 64 nt, Homo Sapiens; identical to SEQ ID NO: 65634

SEQ ID NO: 148516 - RNA, 64 nt, Homo Sapiens; identical to SEQ ID NO: 65635

SEQ ID NO: 148517 - RNA, 64 nt, Homo Sapiens; identical to SEQ ID NO: 65636

SEQ ID NO: 148518 - RNA, 64 nt, Homo Sapiens; identical to SEQ ID NO: 65637

SEQ ID NO: 148519 - RNA, 64 nt, Homo Sapiens; identical to SEQ ID NO: 65638

SEQ ID NO: 148520 - RNA, 64 nt, Homo Sapiens; identical to SEQ ID NO: 65639

SEQ ID NO: 148521 - RNA, 64 nt, Homo Sapiens; identical to SEQ ID NO: 65640

SEQ ID NO: 148522 - RNA, 64 nt, Homo Sapiens; identical to SEQ ID NO: 65641

SEQ ID NO: 148523 - RNA, 64 nt, Homo Sapiens; identical to SEQ ID NO: 65642

SEQ ID NO: 148524 - RNA, 64 nt, Homo Sapiens; identical to SEQ ID NO: 65643

SEQ ID NO: 148525 - RNA, 64 nt, Homo Sapiens; identical to SEQ ID NO: 65644

SEQ ID NO: 148526 - RNA, 60 nt, Homo Sapiens; identical to SEQ ID NO: 65087

SEQ ID NO: 148527 - RNA, 64 nt, Homo Sapiens; identical to SEQ ID NO: 65646

SEQ ID NO: 148528 - RNA, 64 nt, Homo Sapiens; identical to SEQ ID NO: 65647

SEQ ID NO: 148529 - RNA, 64 nt, Homo Sapiens; identical to SEQ ID NO: 65648

SEQ ID NO: 148530 - RNA, 64 nt, Homo Sapiens; identical to SEQ ID NO: 65649

SEQ ID NO: 148531 - RNA, 64 nt, Homo Sapiens; identical to SEQ ID NO: 65650

SEQ ID NO: 148532 - RNA, 64 nt, Homo Sapiens; identical to SEQ ID NO: 65651

SEQ ID NO: 148533 - RNA, 51 nt, Homo Sapiens; identical to SEQ ID NO: 65094

SEQ ID NO: 148534 - RNA, 64 nt, Homo Sapiens; identical to SEQ ID NO: 65653

SEQ ID NO: 148535 - RNA, 64 nt, Homo Sapiens; identical to SEQ ID NO: 65654

SEQ ID NO: 148536 - RNA, 64 nt, Homo Sapiens; identical to SEQ ID NO: 65655

SEQ ID NO: 148537 - RNA, 64 nt, Homo Sapiens; identical to SEQ ID NO: 65656

SEQ ID NO: 148538 - RNA, 64 nt, Homo Sapiens; identical to SEQ ID NO: 65657

SEQ ID NO: 148539 - RNA, 64 nt, Homo Sapiens; identical to SEQ ID NO: 65658

SEQ ID NO: 148540 - RNA, 64 nt, Homo Sapiens; identical to SEQ ID NO: 65659

SEQ ID NO: 148541 - RNA, 64 nt, Homo Sapiens; identical to SEQ ID NO: 65660

SEQ ID NO: 148542 - RNA, 64 nt, Homo Sapiens; identical to SEQ ID NO: 65661

SEQ ID NO: 148543 - RNA, 64 nt, Homo Sapiens; identical to SEQ ID NO: 65662

SEQ ID NO: 148544 - RNA, 64 nt, Homo Sapiens; identical to SEQ ID NO: 65663

SEQ ID NO: 148545 - RNA, 64 nt, Homo Sapiens; identical to SEQ ID NO: 65664

SEQ ID NO: 148546 - RNA, 64 nt, Homo Sapiens; identical to SEQ ID NO: 65665

SEQ ID NO: 148547 - RNA, 64 nt, Homo Sapiens; identical to SEQ ID NO: 65666

SEQ ID NO: 148548 - RNA, 64 nt, Homo Sapiens; identical to SEQ ID NO: 65667

SEQ ID NO: 148549 - RNA, 64 nt, Homo Sapiens; identical to SEQ ID NO: 65668

SEQ ID NO: 148550 - RNA, 64 nt, Homo Sapiens; identical to SEQ ID NO: 65669

SEQ ID NO: 148551 - RNA, 64 nt, Homo Sapiens; identical to SEQ ID NO: 65670

SEQ ID NO: 148552 - RNA, 64 nt, Homo Sapiens; identical to SEQ ID NO: 65671

SEQ ID NO: 148553 - RNA, 64 nt, Homo Sapiens; identical to SEQ ID NO: 65672

SEQ ID NO: 148554 - RNA, 64 nt, Homo Sapiens; identical to SEQ ID NO: 65673

SEQ ID NO: 148555 - RNA, 64 nt, Homo Sapiens; identical to SEQ ID NO: 65674

SEQ ID NO: 148556 - RNA, 64 nt, Homo Sapiens; identical to SEQ ID NO: 65675

SEQ ID NO: 148557 - RNA, 64 nt, Homo Sapiens; identical to SEQ ID NO: 65676

SEQ ID NO: 148558 - RNA, 64 nt, Homo Sapiens; identical to SEQ ID NO: 65677

SEQ ID NO: 148559 - RNA, 64 nt, Homo Sapiens; identical to SEQ ID NO: 65678

SEQ ID NO: 148560 - RNA, 64 nt, Homo Sapiens; identical to SEQ ID NO: 65679

SEQ ID NO: 148561 - RNA, 64 nt, Homo Sapiens; identical to SEQ ID NO: 65680

SEQ ID NO: 148562 - RNA, 64 nt, Homo Sapiens; identical to SEQ ID NO: 65681

SEQ ID NO: 148563 - RNA, 64 nt, Homo Sapiens; identical to SEQ ID NO: 65682

SEQ ID NO: 148564 - RNA, 64 nt, Homo Sapiens; identical to SEQ ID NO: 65683

SEQ ID NO: 148565 - RNA, 64 nt, Homo Sapiens; identical to SEQ ID NO: 65684

SEQ ID NO: 148566 - RNA, 64 nt, Homo Sapiens; identical to SEQ ID NO: 65685

SEQ ID NO: 148567 - RNA, 64 nt, Homo Sapiens; identical to SEQ ID NO: 65686

SEQ ID NO: 148568 - RNA, 64 nt, Homo Sapiens; identical to SEQ ID NO: 65687

SEQ ID NO: 148569 - RNA, 64 nt, Homo Sapiens; identical to SEQ ID NO: 65688

SEQ ID NO: 148570 - RNA, 64 nt, Homo Sapiens; identical to SEQ ID NO: 65689

SEQ ID NO: 148571 - RNA, 64 nt, Homo Sapiens; identical to SEQ ID NO: 65690

SEQ ID NO: 148572 - RNA, 64 nt, Homo Sapiens; identical to SEQ ID NO: 65691

SEQ ID NO: 148573 - RNA, 64 nt, Homo Sapiens; identical to SEQ ID NO: 65692

SEQ ID NO: 148574 - RNA, 64 nt, Homo Sapiens; identical to SEQ ID NO: 65693

SEQ ID NO: 148575 - RNA, 62 nt, Homo Sapiens; identical to SEQ ID NO: 69653

SEQ ID NO: 148576 - RNA, 62 nt, Homo Sapiens; identical to SEQ ID NO: 69654

SEQ ID NO: 148577 - RNA, 62 nt, Homo Sapiens; identical to SEQ ID NO: 69655

SEQ ID NO: 148578 - RNA, 62 nt, Homo Sapiens; identical to SEQ ID NO: 69656

SEQ ID NO: 148579 - RNA, 62 nt, Homo Sapiens; identical to SEQ ID NO: 69657

SEQ ID NO: 148580 - RNA, 62 nt, Homo Sapiens; identical to SEQ ID NO: 69658

SEQ ID NO: 148581 - RNA, 62 nt, Homo Sapiens; identical to SEQ ID NO: 69659

SEQ ID NO: 148582 - RNA, 62 nt, Homo Sapiens; identical to SEQ ID NO: 69660

SEQ ID NO: 148583 - RNA, 62 nt, Homo Sapiens; identical to SEQ ID NO: 69661

SEQ ID NO: 148584 - RNA, 62 nt, Homo Sapiens; identical to SEQ ID NO: 69662

SEQ ID NO: 148585 - RNA, 62 nt, Homo Sapiens; identical to SEQ ID NO: 69663

SEQ ID NO: 148586 - RNA, 62 nt, Homo Sapiens; identical to SEQ ID NO: 69664

SEQ ID NO: 148587 - RNA, 62 nt, Homo Sapiens; identical to SEQ ID NO: 69665

SEQ ID NO: 148588 - RNA, 52 nt, Homo Sapiens; identical to SEQ ID NO: 69143

SEQ ID NO: 148589 - RNA, 62 nt, Homo Sapiens; identical to SEQ ID NO: 69667

SEQ ID NO: 148590 - RNA, 62 nt, Homo Sapiens; identical to SEQ ID NO: 69668

SEQ ID NO: 148591 - RNA, 62 nt, Homo Sapiens; identical to SEQ ID NO: 69669

SEQ ID NO: 148592 - RNA, 62 nt, Homo Sapiens; identical to SEQ ID NO: 69670

SEQ ID NO: 148593 - RNA, 62 nt, Homo Sapiens; identical to SEQ ID NO: 69671

SEQ ID NO: 148594 - RNA, 62 nt, Homo Sapiens; identical to SEQ ID NO: 69672

SEQ ID NO: 148595 - RNA, 62 nt, Homo Sapiens; identical to SEQ ID NO: 69673

SEQ ID NO: 148596 - RNA, 62 nt, Homo Sapiens; identical to SEQ ID NO: 69674

SEQ ID NO: 148597 - RNA, 62 nt, Homo Sapiens; identical to SEQ ID NO: 69675

SEQ ID NO: 148598 - RNA, 62 nt, Homo Sapiens; identical to SEQ ID NO: 69676

SEQ ID NO: 148599 - RNA, 62 nt, Homo Sapiens; identical to SEQ ID NO: 69677

SEQ ID NO: 148600 - RNA, 62 nt, Homo Sapiens; identical to SEQ ID NO: 69678

SEQ ID NO: 148601 - RNA, 62 nt, Homo Sapiens; identical to SEQ ID NO: 69679

SEQ ID NO: 148602 - RNA, 62 nt, Homo Sapiens; identical to SEQ ID NO: 69680

SEQ ID NO: 148603 - RNA, 62 nt, Homo Sapiens; identical to SEQ ID NO: 69681

SEQ ID NO: 148604 - RNA, 62 nt, Homo Sapiens; identical to SEQ ID NO: 69682

SEQ ID NO: 148605 - RNA, 62 nt, Homo Sapiens; identical to SEQ ID NO: 69683

SEQ ID NO: 148606 - RNA, 62 nt, Homo Sapiens; identical to SEQ ID NO: 69684

SEQ ID NO: 148607 - RNA, 62 nt, Homo Sapiens; identical to SEQ ID NO: 69685

SEQ ID NO: 148608 - RNA, 62 nt, Homo Sapiens; identical to SEQ ID NO: 69686

SEQ ID NO: 148609 - RNA, 62 nt, Homo Sapiens; identical to SEQ ID NO: 69687

SEQ ID NO: 148610 - RNA, 62 nt, Homo Sapiens; identical to SEQ ID NO: 69688

SEQ ID NO: 148611 - RNA, 62 nt, Homo Sapiens; identical to SEQ ID NO: 69689

SEQ ID NO: 148612 - RNA, 62 nt, Homo Sapiens; identical to SEQ ID NO: 69690

SEQ ID NO: 148613 - RNA, 62 nt, Homo Sapiens; identical to SEQ ID NO: 69691

SEQ ID NO: 148614 - RNA, 62 nt, Homo Sapiens; identical to SEQ ID NO: 69692

SEQ ID NO: 148615 - RNA, 57 nt, Homo Sapiens; identical to SEQ ID NO: 69170

SEQ ID NO: 148616 - RNA, 62 nt, Homo Sapiens; identical to SEQ ID NO: 69694

SEQ ID NO: 148617 - RNA, 62 nt, Homo Sapiens; identical to SEQ ID NO: 69695

SEQ ID NO: 148618 - RNA, 62 nt, Homo Sapiens; identical to SEQ ID NO: 69696

SEQ ID NO: 148619 - RNA, 62 nt, Homo Sapiens; identical to SEQ ID NO: 69697

SEQ ID NO: 148620 - RNA, 62 nt, Homo Sapiens; identical to SEQ ID NO: 69698

SEQ ID NO: 148621 - RNA, 62 nt, Homo Sapiens; identical to SEQ ID NO: 69699

SEQ ID NO: 148622 - RNA, 62 nt, Homo Sapiens; identical to SEQ ID NO: 69700

SEQ ID NO: 148623 - RNA, 62 nt, Homo Sapiens; identical to SEQ ID NO: 69701

SEQ ID NO: 148624 - RNA, 62 nt, Homo Sapiens; identical to SEQ ID NO: 69702

SEQ ID NO: 148625 - RNA, 62 nt, Homo Sapiens; identical to SEQ ID NO: 69703

SEQ ID NO: 148626 - RNA, 62 nt, Homo Sapiens; identical to SEQ ID NO: 69704

SEQ ID NO: 148627 - RNA, 62 nt, Homo Sapiens; identical to SEQ ID NO: 69705

SEQ ID NO: 148628 - RNA, 62 nt, Homo Sapiens; identical to SEQ ID NO: 69706

SEQ ID NO: 148629 - RNA, 62 nt, Homo Sapiens; identical to SEQ ID NO: 69707

SEQ ID NO: 148630 - RNA, 62 nt, Homo Sapiens; identical to SEQ ID NO: 69708

SEQ ID NO: 148631 - RNA, 62 nt, Homo Sapiens; identical to SEQ ID NO: 69709

SEQ ID NO: 148632 - RNA, 61 nt, Homo Sapiens; identical to SEQ ID NO: 69187

SEQ ID NO: 148633 - RNA, 62 nt, Homo Sapiens; identical to SEQ ID NO: 69711

SEQ ID NO: 148634 - RNA, 62 nt, Homo Sapiens; identical to SEQ ID NO: 69712

SEQ ID NO: 148635 - RNA, 62 nt, Homo Sapiens; identical to SEQ ID NO: 69713

SEQ ID NO: 148636 - RNA, 62 nt, Homo Sapiens; identical to SEQ ID NO: 69714

SEQ ID NO: 148637 - RNA, 62 nt, Homo Sapiens; identical to SEQ ID NO: 69715

SEQ ID NO: 148638 - RNA, 62 nt, Homo Sapiens; identical to SEQ ID NO: 69716

SEQ ID NO: 148639 - RNA, 62 nt, Homo Sapiens; identical to SEQ ID NO: 69717

SEQ ID NO: 148640 - RNA, 62 nt, Homo Sapiens; identical to SEQ ID NO: 69718

SEQ ID NO: 148641 - RNA, 62 nt, Homo Sapiens; identical to SEQ ID NO: 69719

SEQ ID NO: 148642 - RNA, 62 nt, Homo Sapiens; identical to SEQ ID NO: 69720

SEQ ID NO: 148643 - RNA, 62 nt, Homo Sapiens; identical to SEQ ID NO: 69721

SEQ ID NO: 148644 - RNA, 62 nt, Homo Sapiens; identical to SEQ ID NO: 69722

SEQ ID NO: 148645 - RNA, 62 nt, Homo Sapiens; identical to SEQ ID NO: 69723

SEQ ID NO: 148646 - RNA, 62 nt, Homo Sapiens; identical to SEQ ID NO: 69724

SEQ ID NO: 148647 - RNA, 62 nt, Homo Sapiens; identical to SEQ ID NO: 69725

SEQ ID NO: 148648 - RNA, 62 nt, Homo Sapiens; identical to SEQ ID NO: 69726

SEQ ID NO: 148649 - RNA, 62 nt, Homo Sapiens; identical to SEQ ID NO: 69727

SEQ ID NO: 148650 - RNA, 62 nt, Homo Sapiens; identical to SEQ ID NO: 69728

SEQ ID NO: 148651 - RNA, 62 nt, Homo Sapiens; identical to SEQ ID NO: 69729

SEQ ID NO: 148652 - RNA, 62 nt, Homo Sapiens; identical to SEQ ID NO: 69730

SEQ ID NO: 148653 - RNA, 62 nt, Homo Sapiens; identical to SEQ ID NO: 69731

SEQ ID NO: 148654 - RNA, 62 nt, Homo Sapiens; identical to SEQ ID NO: 69732

SEQ ID NO: 148655 - RNA, 62 nt, Homo Sapiens; identical to SEQ ID NO: 69733

SEQ ID NO: 148656 - RNA, 62 nt, Homo Sapiens; identical to SEQ ID NO: 69734

SEQ ID NO: 148657 - RNA, 62 nt, Homo Sapiens; identical to SEQ ID NO: 69735

SEQ ID NO: 148658 - RNA, 62 nt, Homo Sapiens; identical to SEQ ID NO: 69736

SEQ ID NO: 148659 - RNA, 62 nt, Homo Sapiens; identical to SEQ ID NO: 69737

SEQ ID NO: 148660 - RNA, 62 nt, Homo Sapiens; identical to SEQ ID NO: 69738

SEQ ID NO: 148661 - RNA, 62 nt, Homo Sapiens; identical to SEQ ID NO: 69739

SEQ ID NO: 148662 - RNA, 62 nt, Homo Sapiens; identical to SEQ ID NO: 69740

SEQ ID NO: 148663 - RNA, 62 nt, Homo Sapiens; identical to SEQ ID NO: 69741

SEQ ID NO: 148664 - RNA, 62 nt, Homo Sapiens; identical to SEQ ID NO: 69742

SEQ ID NO: 148665 - RNA, 62 nt, Homo Sapiens; identical to SEQ ID NO: 69743

SEQ ID NO: 148666 - RNA, 62 nt, Homo Sapiens; identical to SEQ ID NO: 69744

SEQ ID NO: 148667 - RNA, 62 nt, Homo Sapiens; identical to SEQ ID NO: 69745

SEQ ID NO: 148668 - RNA, 62 nt, Homo Sapiens; identical to SEQ ID NO: 69746

SEQ ID NO: 148669 - RNA, 62 nt, Homo Sapiens; identical to SEQ ID NO: 69747

SEQ ID NO: 148670 - RNA, 62 nt, Homo Sapiens; identical to SEQ ID NO: 69748

SEQ ID NO: 148671 - RNA, 62 nt, Homo Sapiens; identical to SEQ ID NO: 69749

SEQ ID NO: 148672 - RNA, 62 nt, Homo Sapiens; identical to SEQ ID NO: 69750

SEQ ID NO: 148673 - RNA, 62 nt, Homo Sapiens; identical to SEQ ID NO: 69751

SEQ ID NO: 148674 - RNA, 62 nt, Homo Sapiens; identical to SEQ ID NO: 69752

SEQ ID NO: 148675 - RNA, 62 nt, Homo Sapiens; identical to SEQ ID NO: 69753

SEQ ID NO: 148676 - RNA, 62 nt, Homo Sapiens; identical to SEQ ID NO: 69754

SEQ ID NO: 148677 - RNA, 62 nt, Homo Sapiens; identical to SEQ ID NO: 69755

SEQ ID NO: 148678 - RNA, 62 nt, Homo Sapiens; identical to SEQ ID NO: 69756

SEQ ID NO: 148679 - RNA, 62 nt, Homo Sapiens; identical to SEQ ID NO: 69757

SEQ ID NO: 148680 - RNA, 62 nt, Homo Sapiens; identical to SEQ ID NO: 69758

SEQ ID NO: 148681 - RNA, 62 nt, Homo Sapiens; identical to SEQ ID NO: 69759

SEQ ID NO: 148682 - RNA, 62 nt, Homo Sapiens; identical to SEQ ID NO: 69760

SEQ ID NO: 148683 - RNA, 62 nt, Homo Sapiens; identical to SEQ ID NO: 69761

SEQ ID NO: 148684 - RNA, 62 nt, Homo Sapiens; identical to SEQ ID NO: 69762

SEQ ID NO: 148685 - RNA, 62 nt, Homo Sapiens; identical to SEQ ID NO: 69763

SEQ ID NO: 148686 - RNA, 62 nt, Homo Sapiens; identical to SEQ ID NO: 69764

SEQ ID NO: 148687 - RNA, 62 nt, Homo Sapiens; identical to SEQ ID NO: 69765

SEQ ID NO: 148688 - RNA, 62 nt, Homo Sapiens; identical to SEQ ID NO: 69766

SEQ ID NO: 148689 - RNA, 62 nt, Homo Sapiens; identical to SEQ ID NO: 69767

SEQ ID NO: 148690 - RNA, 62 nt, Homo Sapiens; identical to SEQ ID NO: 69768

SEQ ID NO: 148691 - RNA, 62 nt, Homo Sapiens; identical to SEQ ID NO: 69769

SEQ ID NO: 148692 - RNA, 62 nt, Homo Sapiens; identical to SEQ ID NO: 69770

SEQ ID NO: 148693 - RNA, 62 nt, Homo Sapiens; identical to SEQ ID NO: 69771

SEQ ID NO: 148694 - RNA, 62 nt, Homo Sapiens; identical to SEQ ID NO: 69772

SEQ ID NO: 148695 - RNA, 62 nt, Homo Sapiens; identical to SEQ ID NO: 69773

SEQ ID NO: 148696 - RNA, 62 nt, Homo Sapiens; identical to SEQ ID NO: 69774

SEQ ID NO: 148697 - RNA, 62 nt, Homo Sapiens; identical to SEQ ID NO: 69775

SEQ ID NO: 148698 - RNA, 62 nt, Homo Sapiens; identical to SEQ ID NO: 69776

SEQ ID NO: 148699 - RNA, 62 nt, Homo Sapiens; identical to SEQ ID NO: 69777

SEQ ID NO: 148700 - RNA, 62 nt, Homo Sapiens; identical to SEQ ID NO: 69778

SEQ ID NO: 148701 - RNA, 62 nt, Homo Sapiens; identical to SEQ ID NO: 69779

SEQ ID NO: 148702 - RNA, 62 nt, Homo Sapiens; identical to SEQ ID NO: 69780

SEQ ID NO: 148703 - RNA, 62 nt, Homo Sapiens; identical to SEQ ID NO: 69781

SEQ ID NO: 148704 - RNA, 62 nt, Homo Sapiens; identical to SEQ ID NO: 69782

SEQ ID NO: 148705 - RNA, 62 nt, Homo Sapiens; identical to SEQ ID NO: 69783

SEQ ID NO: 148706 - RNA, 62 nt, Homo Sapiens; identical to SEQ ID NO: 69784

SEQ ID NO: 148707 - RNA, 62 nt, Homo Sapiens; identical to SEQ ID NO: 69785

SEQ ID NO: 148708 - RNA, 62 nt, Homo Sapiens; identical to SEQ ID NO: 69786

SEQ ID NO: 148709 - RNA, 62 nt, Homo Sapiens; identical to SEQ ID NO: 69787

SEQ ID NO: 148710 - RNA, 62 nt, Homo Sapiens; identical to SEQ ID NO: 69788

SEQ ID NO: 148711 - RNA, 62 nt, Homo Sapiens; identical to SEQ ID NO: 69789

SEQ ID NO: 148712 - RNA, 62 nt, Homo Sapiens; identical to SEQ ID NO: 69790

SEQ ID NO: 148713 - RNA, 62 nt, Homo Sapiens; identical to SEQ ID NO: 69791

SEQ ID NO: 148714 - RNA, 62 nt, Homo Sapiens; identical to SEQ ID NO: 69792

SEQ ID NO: 148715 - RNA, 62 nt, Homo Sapiens; identical to SEQ ID NO: 69793

SEQ ID NO: 148716 - RNA, 62 nt, Homo Sapiens; identical to SEQ ID NO: 69794

SEQ ID NO: 148717 - RNA, 59 nt, Homo Sapiens; identical to SEQ ID NO: 69272

SEQ ID NO: 148718 - RNA, 62 nt, Homo Sapiens; identical to SEQ ID NO: 69796

SEQ ID NO: 148719 - RNA, 62 nt, Homo Sapiens; identical to SEQ ID NO: 69797

SEQ ID NO: 148720 - RNA, 62 nt, Homo Sapiens; identical to SEQ ID NO: 69798

SEQ ID NO: 148721 - RNA, 62 nt, Homo Sapiens; identical to SEQ ID NO: 69799

SEQ ID NO: 148722 - RNA, 62 nt, Homo Sapiens; identical to SEQ ID NO: 69800

SEQ ID NO: 148723 - RNA, 62 nt, Homo Sapiens; identical to SEQ ID NO: 69801

SEQ ID NO: 148724 - RNA, 62 nt, Homo Sapiens; identical to SEQ ID NO: 69802

SEQ ID NO: 148725 - RNA, 62 nt, Homo Sapiens; identical to SEQ ID NO: 69803

SEQ ID NO: 148726 - RNA, 62 nt, Homo Sapiens; identical to SEQ ID NO: 69804

SEQ ID NO: 148727 - RNA, 62 nt, Homo Sapiens; identical to SEQ ID NO: 69805

SEQ ID NO: 148728 - RNA, 62 nt, Homo Sapiens; identical to SEQ ID NO: 69806

SEQ ID NO: 148729 - RNA, 62 nt, Homo Sapiens; identical to SEQ ID NO: 69807

SEQ ID NO: 148730 - RNA, 62 nt, Homo Sapiens; identical to SEQ ID NO: 69808

SEQ ID NO: 148731 - RNA, 62 nt, Homo Sapiens; identical to SEQ ID NO: 69809

SEQ ID NO: 148732 - RNA, 62 nt, Homo Sapiens; identical to SEQ ID NO: 69810

SEQ ID NO: 148733 - RNA, 62 nt, Homo Sapiens; identical to SEQ ID NO: 69811

SEQ ID NO: 148734 - RNA, 62 nt, Homo Sapiens; identical to SEQ ID NO: 69812

SEQ ID NO: 148735 - RNA, 62 nt, Homo Sapiens; identical to SEQ ID NO: 69813

SEQ ID NO: 148736 - RNA, 62 nt, Homo Sapiens; identical to SEQ ID NO: 69814

SEQ ID NO: 148737 - RNA, 62 nt, Homo Sapiens; identical to SEQ ID NO: 69815

SEQ ID NO: 148738 - RNA, 62 nt, Homo Sapiens; identical to SEQ ID NO: 69816

SEQ ID NO: 148739 - RNA, 62 nt, Homo Sapiens; identical to SEQ ID NO: 69817

SEQ ID NO: 148740 - RNA, 62 nt, Homo Sapiens; identical to SEQ ID NO: 69818

SEQ ID NO: 148741 - RNA, 62 nt, Homo Sapiens; identical to SEQ ID NO: 69819

SEQ ID NO: 148742 - RNA, 62 nt, Homo Sapiens; identical to SEQ ID NO: 69820

SEQ ID NO: 148743 - RNA, 62 nt, Homo Sapiens; identical to SEQ ID NO: 69821

SEQ ID NO: 148744 - RNA, 62 nt, Homo Sapiens; identical to SEQ ID NO: 69822

SEQ ID NO: 148745 - RNA, 62 nt, Homo Sapiens; identical to SEQ ID NO: 69823

SEQ ID NO: 148746 - RNA, 62 nt, Homo Sapiens; identical to SEQ ID NO: 69824

SEQ ID NO: 148747 - RNA, 62 nt, Homo Sapiens; identical to SEQ ID NO: 69825

SEQ ID NO: 148748 - RNA, 62 nt, Homo Sapiens; identical to SEQ ID NO: 69826

SEQ ID NO: 148749 - RNA, 62 nt, Homo Sapiens; identical to SEQ ID NO: 69827

SEQ ID NO: 148750 - RNA, 62 nt, Homo Sapiens; identical to SEQ ID NO: 69828

SEQ ID NO: 148751 - RNA, 62 nt, Homo Sapiens; identical to SEQ ID NO: 69829

SEQ ID NO: 148752 - RNA, 62 nt, Homo Sapiens; identical to SEQ ID NO: 69830

SEQ ID NO: 148753 - RNA, 62 nt, Homo Sapiens; identical to SEQ ID NO: 69831

SEQ ID NO: 148754 - RNA, 62 nt, Homo Sapiens; identical to SEQ ID NO: 69832

SEQ ID NO: 148755 - RNA, 62 nt, Homo Sapiens; identical to SEQ ID NO: 69833

SEQ ID NO: 148756 - RNA, 62 nt, Homo Sapiens; identical to SEQ ID NO: 69834

SEQ ID NO: 148757 - RNA, 62 nt, Homo Sapiens; identical to SEQ ID NO: 69835

SEQ ID NO: 148758 - RNA, 62 nt, Homo Sapiens; identical to SEQ ID NO: 69836

SEQ ID NO: 148759 - RNA, 62 nt, Homo Sapiens; identical to SEQ ID NO: 69837

SEQ ID NO: 148760 - RNA, 62 nt, Homo Sapiens; identical to SEQ ID NO: 69838

SEQ ID NO: 148761 - RNA, 62 nt, Homo Sapiens; identical to SEQ ID NO: 69839

SEQ ID NO: 148762 - RNA, 62 nt, Homo Sapiens; identical to SEQ ID NO: 69840

SEQ ID NO: 148763 - RNA, 62 nt, Homo Sapiens; identical to SEQ ID NO: 69841

SEQ ID NO: 148764 - RNA, 62 nt, Homo Sapiens; identical to SEQ ID NO: 69842

SEQ ID NO: 148765 - RNA, 62 nt, Homo Sapiens; identical to SEQ ID NO: 69843

SEQ ID NO: 148766 - RNA, 62 nt, Homo Sapiens; identical to SEQ ID NO: 69844

SEQ ID NO: 148767 - RNA, 62 nt, Homo Sapiens; identical to SEQ ID NO: 69845

SEQ ID NO: 148768 - RNA, 62 nt, Homo Sapiens; identical to SEQ ID NO: 69846

SEQ ID NO: 148769 - RNA, 62 nt, Homo Sapiens; identical to SEQ ID NO: 69847

SEQ ID NO: 148770 - RNA, 62 nt, Homo Sapiens; identical to SEQ ID NO: 69848

SEQ ID NO: 148771 - RNA, 62 nt, Homo Sapiens; identical to SEQ ID NO: 69849

SEQ ID NO: 148772 - RNA, 62 nt, Homo Sapiens; identical to SEQ ID NO: 69850

SEQ ID NO: 148773 - RNA, 62 nt, Homo Sapiens; identical to SEQ ID NO: 69851

SEQ ID NO: 148774 - RNA, 62 nt, Homo Sapiens; identical to SEQ ID NO: 69852

SEQ ID NO: 148775 - RNA, 62 nt, Homo Sapiens; identical to SEQ ID NO: 69853

SEQ ID NO: 148776 - RNA, 62 nt, Homo Sapiens; identical to SEQ ID NO: 69854

SEQ ID NO: 148777 - RNA, 62 nt, Homo Sapiens; identical to SEQ ID NO: 69855

SEQ ID NO: 148778 - RNA, 62 nt, Homo Sapiens; identical to SEQ ID NO: 69856

SEQ ID NO: 148779 - RNA, 62 nt, Homo Sapiens; identical to SEQ ID NO: 69857

SEQ ID NO: 148780 - RNA, 62 nt, Homo Sapiens; identical to SEQ ID NO: 69858

SEQ ID NO: 148781 - RNA, 62 nt, Homo Sapiens; identical to SEQ ID NO: 69859

SEQ ID NO: 148782 - RNA, 62 nt, Homo Sapiens; identical to SEQ ID NO: 69860

SEQ ID NO: 148783 - RNA, 62 nt, Homo Sapiens; identical to SEQ ID NO: 69861

SEQ ID NO: 148784 - RNA, 62 nt, Homo Sapiens; identical to SEQ ID NO: 69862

SEQ ID NO: 148785 - RNA, 62 nt, Homo Sapiens; identical to SEQ ID NO: 69863

SEQ ID NO: 148786 - RNA, 62 nt, Homo Sapiens; identical to SEQ ID NO: 69864

SEQ ID NO: 148787 - RNA, 62 nt, Homo Sapiens; identical to SEQ ID NO: 69865

SEQ ID NO: 148788 - RNA, 62 nt, Homo Sapiens; identical to SEQ ID NO: 69866

SEQ ID NO: 148789 - RNA, 62 nt, Homo Sapiens; identical to SEQ ID NO: 69867

SEQ ID NO: 148790 - RNA, 62 nt, Homo Sapiens; identical to SEQ ID NO: 69868

SEQ ID NO: 148791 - RNA, 62 nt, Homo Sapiens; identical to SEQ ID NO: 69869

SEQ ID NO: 148792 - RNA, 62 nt, Homo Sapiens; identical to SEQ ID NO: 69870

SEQ ID NO: 148793 - RNA, 62 nt, Homo Sapiens; identical to SEQ ID NO: 69871

SEQ ID NO: 148794 - RNA, 62 nt, Homo Sapiens; identical to SEQ ID NO: 69872

SEQ ID NO: 148795 - RNA, 62 nt, Homo Sapiens; identical to SEQ ID NO: 69873

SEQ ID NO: 148796 - RNA, 54 nt, Homo Sapiens; identical to SEQ ID NO: 69351

SEQ ID NO: 148797 - RNA, 62 nt, Homo Sapiens; identical to SEQ ID NO: 69875

SEQ ID NO: 148798 - RNA, 62 nt, Homo Sapiens; identical to SEQ ID NO: 69876

SEQ ID NO: 148799 - RNA, 62 nt, Homo Sapiens; identical to SEQ ID NO: 69877

SEQ ID NO: 148800 - RNA, 62 nt, Homo Sapiens; identical to SEQ ID NO: 69878

SEQ ID NO: 148801 - RNA, 62 nt, Homo Sapiens; identical to SEQ ID NO: 69879

SEQ ID NO: 148802 - RNA, 62 nt, Homo Sapiens; identical to SEQ ID NO: 69880

SEQ ID NO: 148803 - RNA, 62 nt, Homo Sapiens; identical to SEQ ID NO: 69881

SEQ ID NO: 148804 - RNA, 62 nt, Homo Sapiens; identical to SEQ ID NO: 69882

SEQ ID NO: 148805 - RNA, 62 nt, Homo Sapiens; identical to SEQ ID NO: 69883

SEQ ID NO: 148806 - RNA, 62 nt, Homo Sapiens; identical to SEQ ID NO: 69884

SEQ ID NO: 148807 - RNA, 62 nt, Homo Sapiens; identical to SEQ ID NO: 69885

SEQ ID NO: 148808 - RNA, 62 nt, Homo Sapiens; identical to SEQ ID NO: 69886

SEQ ID NO: 148809 - RNA, 62 nt, Homo Sapiens; identical to SEQ ID NO: 69887

SEQ ID NO: 148810 - RNA, 62 nt, Homo Sapiens; identical to SEQ ID NO: 69888

SEQ ID NO: 148811 - RNA, 62 nt, Homo Sapiens; identical to SEQ ID NO: 69889

SEQ ID NO: 148812 - RNA, 62 nt, Homo Sapiens; identical to SEQ ID NO: 69890

SEQ ID NO: 148813 - RNA, 62 nt, Homo Sapiens; identical to SEQ ID NO: 69891

SEQ ID NO: 148814 - RNA, 62 nt, Homo Sapiens; identical to SEQ ID NO: 69892

SEQ ID NO: 148815 - RNA, 62 nt, Homo Sapiens; identical to SEQ ID NO: 69893

SEQ ID NO: 148816 - RNA, 62 nt, Homo Sapiens; identical to SEQ ID NO: 69894

SEQ ID NO: 148817 - RNA, 62 nt, Homo Sapiens; identical to SEQ ID NO: 69895

SEQ ID NO: 148818 - RNA, 62 nt, Homo Sapiens; identical to SEQ ID NO: 69896

SEQ ID NO: 148819 - RNA, 62 nt, Homo Sapiens; identical to SEQ ID NO: 69897

SEQ ID NO: 148820 - RNA, 54 nt, Homo Sapiens; identical to SEQ ID NO: 69375

SEQ ID NO: 148821 - RNA, 62 nt, Homo Sapiens; identical to SEQ ID NO: 69899

SEQ ID NO: 148822 - RNA, 62 nt, Homo Sapiens; identical to SEQ ID NO: 69900

SEQ ID NO: 148823 - RNA, 62 nt, Homo Sapiens; identical to SEQ ID NO: 69901

SEQ ID NO: 148824 - RNA, 62 nt, Homo Sapiens; identical to SEQ ID NO: 69902

SEQ ID NO: 148825 - RNA, 62 nt, Homo Sapiens; identical to SEQ ID NO: 69903

SEQ ID NO: 148826 - RNA, 62 nt, Homo Sapiens; identical to SEQ ID NO: 69904

SEQ ID NO: 148827 - RNA, 62 nt, Homo Sapiens; identical to SEQ ID NO: 69905

SEQ ID NO: 148828 - RNA, 62 nt, Homo Sapiens; identical to SEQ ID NO: 69906

SEQ ID NO: 148829 - RNA, 62 nt, Homo Sapiens; identical to SEQ ID NO: 69907

SEQ ID NO: 148830 - RNA, 62 nt, Homo Sapiens; identical to SEQ ID NO: 69908

SEQ ID NO: 148831 - RNA, 62 nt, Homo Sapiens; identical to SEQ ID NO: 69909

SEQ ID NO: 148832 - RNA, 62 nt, Homo Sapiens; identical to SEQ ID NO: 69910

SEQ ID NO: 148833 - RNA, 62 nt, Homo Sapiens; identical to SEQ ID NO: 69911

SEQ ID NO: 148834 - RNA, 62 nt, Homo Sapiens; identical to SEQ ID NO: 69912

SEQ ID NO: 148835 - RNA, 62 nt, Homo Sapiens; identical to SEQ ID NO: 69913

SEQ ID NO: 148836 - RNA, 62 nt, Homo Sapiens; identical to SEQ ID NO: 69914

SEQ ID NO: 148837 - RNA, 58 nt, Homo Sapiens; identical to SEQ ID NO: 69392

SEQ ID NO: 148838 - RNA, 62 nt, Homo Sapiens; identical to SEQ ID NO: 69916

SEQ ID NO: 148839 - RNA, 62 nt, Homo Sapiens; identical to SEQ ID NO: 69917

SEQ ID NO: 148840 - RNA, 62 nt, Homo Sapiens; identical to SEQ ID NO: 69918

SEQ ID NO: 148841 - RNA, 62 nt, Homo Sapiens; identical to SEQ ID NO: 69919

SEQ ID NO: 148842 - RNA, 62 nt, Homo Sapiens; identical to SEQ ID NO: 69920

SEQ ID NO: 148843 - RNA, 62 nt, Homo Sapiens; identical to SEQ ID NO: 69921

SEQ ID NO: 148844 - RNA, 62 nt, Homo Sapiens; identical to SEQ ID NO: 69922

SEQ ID NO: 148845 - RNA, 62 nt, Homo Sapiens; identical to SEQ ID NO: 69923

SEQ ID NO: 148846 - RNA, 62 nt, Homo Sapiens; identical to SEQ ID NO: 69924

SEQ ID NO: 148847 - RNA, 62 nt, Homo Sapiens; identical to SEQ ID NO: 69925

SEQ ID NO: 148848 - RNA, 62 nt, Homo Sapiens; identical to SEQ ID NO: 69926

SEQ ID NO: 148849 - RNA, 62 nt, Homo Sapiens; identical to SEQ ID NO: 69927

SEQ ID NO: 148850 - RNA, 62 nt, Homo Sapiens; identical to SEQ ID NO: 69928

SEQ ID NO: 148851 - RNA, 62 nt, Homo Sapiens; identical to SEQ ID NO: 69929

SEQ ID NO: 148852 - RNA, 62 nt, Homo Sapiens; identical to SEQ ID NO: 69930

SEQ ID NO: 148853 - RNA, 62 nt, Homo Sapiens; identical to SEQ ID NO: 69931

SEQ ID NO: 148854 - RNA, 62 nt, Homo Sapiens; identical to SEQ ID NO: 69932

SEQ ID NO: 148855 - RNA, 62 nt, Homo Sapiens; identical to SEQ ID NO: 69933

SEQ ID NO: 148856 - RNA, 62 nt, Homo Sapiens; identical to SEQ ID NO: 69934

SEQ ID NO: 148857 - RNA, 62 nt, Homo Sapiens; identical to SEQ ID NO: 69935

SEQ ID NO: 148858 - RNA, 62 nt, Homo Sapiens; identical to SEQ ID NO: 69936

SEQ ID NO: 148859 - RNA, 62 nt, Homo Sapiens; identical to SEQ ID NO: 69937

SEQ ID NO: 148860 - RNA, 62 nt, Homo Sapiens; identical to SEQ ID NO: 69938

SEQ ID NO: 148861 - RNA, 62 nt, Homo Sapiens; identical to SEQ ID NO: 69939

SEQ ID NO: 148862 - RNA, 62 nt, Homo Sapiens; identical to SEQ ID NO: 69940

SEQ ID NO: 148863 - RNA, 62 nt, Homo Sapiens; identical to SEQ ID NO: 69941

SEQ ID NO: 148864 - RNA, 60 nt, Homo Sapiens; identical to SEQ ID NO: 69419

SEQ ID NO: 148865 - RNA, 62 nt, Homo Sapiens; identical to SEQ ID NO: 69943

SEQ ID NO: 148866 - RNA, 62 nt, Homo Sapiens; identical to SEQ ID NO: 69944

SEQ ID NO: 148867 - RNA, 62 nt, Homo Sapiens; identical to SEQ ID NO: 69945

SEQ ID NO: 148868 - RNA, 62 nt, Homo Sapiens; identical to SEQ ID NO: 69946

SEQ ID NO: 148869 - RNA, 62 nt, Homo Sapiens; identical to SEQ ID NO: 69947

SEQ ID NO: 148870 - RNA, 62 nt, Homo Sapiens; identical to SEQ ID NO: 69948

SEQ ID NO: 148871 - RNA, 62 nt, Homo Sapiens; identical to SEQ ID NO: 69949

SEQ ID NO: 148872 - RNA, 62 nt, Homo Sapiens; identical to SEQ ID NO: 69950

SEQ ID NO: 148873 - RNA, 62 nt, Homo Sapiens; identical to SEQ ID NO: 69951

SEQ ID NO: 148874 - RNA, 62 nt, Homo Sapiens; identical to SEQ ID NO: 69952

SEQ ID NO: 148875 - RNA, 62 nt, Homo Sapiens; identical to SEQ ID NO: 69953

SEQ ID NO: 148876 - RNA, 62 nt, Homo Sapiens; identical to SEQ ID NO: 69954

SEQ ID NO: 148877 - RNA, 62 nt, Homo Sapiens; identical to SEQ ID NO: 69955

SEQ ID NO: 148878 - RNA, 62 nt, Homo Sapiens; identical to SEQ ID NO: 69956

SEQ ID NO: 148879 - RNA, 62 nt, Homo Sapiens; identical to SEQ ID NO: 69957

SEQ ID NO: 148880 - RNA, 62 nt, Homo Sapiens; identical to SEQ ID NO: 69958

SEQ ID NO: 148881 - RNA, 62 nt, Homo Sapiens; identical to SEQ ID NO: 69959

SEQ ID NO: 148882 - RNA, 62 nt, Homo Sapiens; identical to SEQ ID NO: 69960

SEQ ID NO: 148883 - RNA, 62 nt, Homo Sapiens; identical to SEQ ID NO: 69961

SEQ ID NO: 148884 - RNA, 62 nt, Homo Sapiens; identical to SEQ ID NO: 69962

SEQ ID NO: 148885 - RNA, 62 nt, Homo Sapiens; identical to SEQ ID NO: 69963

SEQ ID NO: 148886 - RNA, 62 nt, Homo Sapiens; identical to SEQ ID NO: 69964

SEQ ID NO: 148887 - RNA, 62 nt, Homo Sapiens; identical to SEQ ID NO: 69965

SEQ ID NO: 148888 - RNA, 62 nt, Homo Sapiens; identical to SEQ ID NO: 69966

SEQ ID NO: 148889 - RNA, 59 nt, Homo Sapiens; identical to SEQ ID NO: 69444

SEQ ID NO: 148890 - RNA, 62 nt, Homo Sapiens; identical to SEQ ID NO: 69968

SEQ ID NO: 148891 - RNA, 62 nt, Homo Sapiens; identical to SEQ ID NO: 69969

SEQ ID NO: 148892 - RNA, 62 nt, Homo Sapiens; identical to SEQ ID NO: 69970

SEQ ID NO: 148893 - RNA, 62 nt, Homo Sapiens; identical to SEQ ID NO: 69971

SEQ ID NO: 148894 - RNA, 52 nt, Homo Sapiens; identical to SEQ ID NO: 69449

SEQ ID NO: 148895 - RNA, 62 nt, Homo Sapiens; identical to SEQ ID NO: 69973

SEQ ID NO: 148896 - RNA, 62 nt, Homo Sapiens; identical to SEQ ID NO: 69974

SEQ ID NO: 148897 - RNA, 62 nt, Homo Sapiens; identical to SEQ ID NO: 69975

SEQ ID NO: 148898 - RNA, 62 nt, Homo Sapiens; identical to SEQ ID NO: 69976

SEQ ID NO: 148899 - RNA, 62 nt, Homo Sapiens; identical to SEQ ID NO: 69977

SEQ ID NO: 148900 - RNA, 62 nt, Homo Sapiens; identical to SEQ ID NO: 69978

SEQ ID NO: 148901 - RNA, 62 nt, Homo Sapiens; identical to SEQ ID NO: 69979

SEQ ID NO: 148902 - RNA, 62 nt, Homo Sapiens; identical to SEQ ID NO: 69980

SEQ ID NO: 148903 - RNA, 62 nt, Homo Sapiens; identical to SEQ ID NO: 69981

SEQ ID NO: 148904 - RNA, 62 nt, Homo Sapiens; identical to SEQ ID NO: 69982

SEQ ID NO: 148905 - RNA, 62 nt, Homo Sapiens; identical to SEQ ID NO: 69983

SEQ ID NO: 148906 - RNA, 62 nt, Homo Sapiens; identical to SEQ ID NO: 69984

SEQ ID NO: 148907 - RNA, 62 nt, Homo Sapiens; identical to SEQ ID NO: 69985

SEQ ID NO: 148908 - RNA, 62 nt, Homo Sapiens; identical to SEQ ID NO: 69986

SEQ ID NO: 148909 - RNA, 62 nt, Homo Sapiens; identical to SEQ ID NO: 69987

SEQ ID NO: 148910 - RNA, 62 nt, Homo Sapiens; identical to SEQ ID NO: 69988

SEQ ID NO: 148911 - RNA, 62 nt, Homo Sapiens; identical to SEQ ID NO: 69989

SEQ ID NO: 148912 - RNA, 62 nt, Homo Sapiens; identical to SEQ ID NO: 69990

SEQ ID NO: 148913 - RNA, 62 nt, Homo Sapiens; identical to SEQ ID NO: 69991

SEQ ID NO: 148914 - RNA, 62 nt, Homo Sapiens; identical to SEQ ID NO: 69992

SEQ ID NO: 148915 - RNA, 62 nt, Homo Sapiens; identical to SEQ ID NO: 69993

SEQ ID NO: 148916 - RNA, 62 nt, Homo Sapiens; identical to SEQ ID NO: 69994

SEQ ID NO: 148917 - RNA, 62 nt, Homo Sapiens; identical to SEQ ID NO: 69995

SEQ ID NO: 148918 - RNA, 62 nt, Homo Sapiens; identical to SEQ ID NO: 69996

SEQ ID NO: 148919 - RNA, 62 nt, Homo Sapiens; identical to SEQ ID NO: 69997

SEQ ID NO: 148920 - RNA, 62 nt, Homo Sapiens; identical to SEQ ID NO: 69998

SEQ ID NO: 148921 - RNA, 62 nt, Homo Sapiens; identical to SEQ ID NO: 69999

SEQ ID NO: 148922 - RNA, 62 nt, Homo Sapiens; identical to SEQ ID NO: 70000

SEQ ID NO: 148923 - RNA, 62 nt, Homo Sapiens; identical to SEQ ID NO: 70001

SEQ ID NO: 148924 - RNA, 62 nt, Homo Sapiens; identical to SEQ ID NO: 70002

SEQ ID NO: 148925 - RNA, 62 nt, Homo Sapiens; identical to SEQ ID NO: 70003

SEQ ID NO: 148926 - RNA, 62 nt, Homo Sapiens; identical to SEQ ID NO: 70004

SEQ ID NO: 148927 - RNA, 62 nt, Homo Sapiens; identical to SEQ ID NO: 70005

SEQ ID NO: 148928 - RNA, 61 nt, Homo Sapiens; identical to SEQ ID NO: 70006

SEQ ID NO: 148929 - RNA, 62 nt, Homo Sapiens; identical to SEQ ID NO: 70007

SEQ ID NO: 148930 - RNA, 62 nt, Homo Sapiens; identical to SEQ ID NO: 70008

SEQ ID NO: 148931 - RNA, 62 nt, Homo Sapiens; identical to SEQ ID NO: 70009

SEQ ID NO: 148932 - RNA, 62 nt, Homo Sapiens; identical to SEQ ID NO: 70010

SEQ ID NO: 148933 - RNA, 62 nt, Homo Sapiens; identical to SEQ ID NO: 70011

SEQ ID NO: 148934 - RNA, 62 nt, Homo Sapiens; identical to SEQ ID NO: 70012

SEQ ID NO: 148935 - RNA, 62 nt, Homo Sapiens; identical to SEQ ID NO: 70013

SEQ ID NO: 148936 - RNA, 62 nt, Homo Sapiens; identical to SEQ ID NO: 70014

SEQ ID NO: 148937 - RNA, 62 nt, Homo Sapiens; identical to SEQ ID NO: 70015

SEQ ID NO: 148938 - RNA, 62 nt, Homo Sapiens; identical to SEQ ID NO: 70016

SEQ ID NO: 148939 - RNA, 62 nt, Homo Sapiens; identical to SEQ ID NO: 70017

SEQ ID NO: 148940 - RNA, 62 nt, Homo Sapiens; identical to SEQ ID NO: 70018

SEQ ID NO: 148941 - RNA, 62 nt, Homo Sapiens; identical to SEQ ID NO: 70019

SEQ ID NO: 148942 - RNA, 62 nt, Homo Sapiens; identical to SEQ ID NO: 70020

SEQ ID NO: 148943 - RNA, 62 nt, Homo Sapiens; identical to SEQ ID NO: 70021

SEQ ID NO: 148944 - RNA, 62 nt, Homo Sapiens; identical to SEQ ID NO: 70022

SEQ ID NO: 148945 - RNA, 62 nt, Homo Sapiens; identical to SEQ ID NO: 70023

SEQ ID NO: 148946 - RNA, 62 nt, Homo Sapiens; identical to SEQ ID NO: 70024

SEQ ID NO: 148947 - RNA, 62 nt, Homo Sapiens; identical to SEQ ID NO: 70025

SEQ ID NO: 148948 - RNA, 62 nt, Homo Sapiens; identical to SEQ ID NO: 70026

SEQ ID NO: 148949 - RNA, 62 nt, Homo Sapiens; identical to SEQ ID NO: 70027

SEQ ID NO: 148950 - RNA, 62 nt, Homo Sapiens; identical to SEQ ID NO: 70028

SEQ ID NO: 148951 - RNA, 62 nt, Homo Sapiens; identical to SEQ ID NO: 70029

SEQ ID NO: 148952 - RNA, 62 nt, Homo Sapiens; identical to SEQ ID NO: 70030

SEQ ID NO: 148953 - RNA, 62 nt, Homo Sapiens; identical to SEQ ID NO: 70031

SEQ ID NO: 148954 - RNA, 62 nt, Homo Sapiens; identical to SEQ ID NO: 70032

SEQ ID NO: 148955 - RNA, 62 nt, Homo Sapiens; identical to SEQ ID NO: 70033

SEQ ID NO: 148956 - RNA, 62 nt, Homo Sapiens; identical to SEQ ID NO: 70034

SEQ ID NO: 148957 - RNA, 62 nt, Homo Sapiens; identical to SEQ ID NO: 70035

SEQ ID NO: 148958 - RNA, 62 nt, Homo Sapiens; identical to SEQ ID NO: 70036

SEQ ID NO: 148959 - RNA, 62 nt, Homo Sapiens; identical to SEQ ID NO: 70037

SEQ ID NO: 148960 - RNA, 62 nt, Homo Sapiens; identical to SEQ ID NO: 70038

SEQ ID NO: 148961 - RNA, 62 nt, Homo Sapiens; identical to SEQ ID NO: 70039

SEQ ID NO: 148962 - RNA, 62 nt, Homo Sapiens; identical to SEQ ID NO: 70040

SEQ ID NO: 148963 - RNA, 62 nt, Homo Sapiens; identical to SEQ ID NO: 70041

SEQ ID NO: 148964 - RNA, 62 nt, Homo Sapiens; identical to SEQ ID NO: 70042

SEQ ID NO: 148965 - RNA, 62 nt, Homo Sapiens; identical to SEQ ID NO: 70043

SEQ ID NO: 148966 - RNA, 62 nt, Homo Sapiens; identical to SEQ ID NO: 70044

SEQ ID NO: 148967 - RNA, 62 nt, Homo Sapiens; identical to SEQ ID NO: 70045

SEQ ID NO: 148968 - RNA, 62 nt, Homo Sapiens; identical to SEQ ID NO: 70046

SEQ ID NO: 148969 - RNA, 62 nt, Homo Sapiens; identical to SEQ ID NO: 70047

SEQ ID NO: 148970 - RNA, 62 nt, Homo Sapiens; identical to SEQ ID NO: 70048

SEQ ID NO: 148971 - RNA, 62 nt, Homo Sapiens; identical to SEQ ID NO: 70049

SEQ ID NO: 148972 - RNA, 62 nt, Homo Sapiens; identical to SEQ ID NO: 70050

SEQ ID NO: 148973 - RNA, 62 nt, Homo Sapiens; identical to SEQ ID NO: 70051

SEQ ID NO: 148974 - RNA, 62 nt, Homo Sapiens; identical to SEQ ID NO: 70052

SEQ ID NO: 148975 - RNA, 62 nt, Homo Sapiens; identical to SEQ ID NO: 70053

SEQ ID NO: 148976 - RNA, 62 nt, Homo Sapiens; identical to SEQ ID NO: 70054

SEQ ID NO: 148977 - RNA, 62 nt, Homo Sapiens; identical to SEQ ID NO: 70055

SEQ ID NO: 148978 - RNA, 62 nt, Homo Sapiens; identical to SEQ ID NO: 70056

SEQ ID NO: 148979 - RNA, 62 nt, Homo Sapiens; identical to SEQ ID NO: 70057

SEQ ID NO: 148980 - RNA, 62 nt, Homo Sapiens; identical to SEQ ID NO: 70058

SEQ ID NO: 148981 - RNA, 62 nt, Homo Sapiens; identical to SEQ ID NO: 70059

SEQ ID NO: 148982 - RNA, 62 nt, Homo Sapiens; identical to SEQ ID NO: 70060

SEQ ID NO: 148983 - RNA, 62 nt, Homo Sapiens; identical to SEQ ID NO: 70061

SEQ ID NO: 148984 - RNA, 62 nt, Homo Sapiens; identical to SEQ ID NO: 70062

SEQ ID NO: 148985 - RNA, 62 nt, Homo Sapiens; identical to SEQ ID NO: 70063

SEQ ID NO: 148986 - RNA, 60 nt, Homo Sapiens; identical to SEQ ID NO: 69541

SEQ ID NO: 148987 - RNA, 62 nt, Homo Sapiens; identical to SEQ ID NO: 70065

SEQ ID NO: 148988 - RNA, 62 nt, Homo Sapiens; identical to SEQ ID NO: 70066

SEQ ID NO: 148989 - RNA, 62 nt, Homo Sapiens; identical to SEQ ID NO: 70067

SEQ ID NO: 148990 - RNA, 62 nt, Homo Sapiens; identical to SEQ ID NO: 70068

SEQ ID NO: 148991 - RNA, 62 nt, Homo Sapiens; identical to SEQ ID NO: 70069

SEQ ID NO: 148992 - RNA, 62 nt, Homo Sapiens; identical to SEQ ID NO: 70070

SEQ ID NO: 148993 - RNA, 62 nt, Homo Sapiens; identical to SEQ ID NO: 70071

SEQ ID NO: 148994 - RNA, 62 nt, Homo Sapiens; identical to SEQ ID NO: 70072

SEQ ID NO: 148995 - RNA, 62 nt, Homo Sapiens; identical to SEQ ID NO: 70073

SEQ ID NO: 148996 - RNA, 62 nt, Homo Sapiens; identical to SEQ ID NO: 70074

SEQ ID NO: 148997 - RNA, 62 nt, Homo Sapiens; identical to SEQ ID NO: 70075

SEQ ID NO: 148998 - RNA, 62 nt, Homo Sapiens; identical to SEQ ID NO: 70076

SEQ ID NO: 148999 - RNA, 62 nt, Homo Sapiens; identical to SEQ ID NO: 70077

SEQ ID NO: 149000 - RNA, 62 nt, Homo Sapiens; identical to SEQ ID NO: 70078

SEQ ID NO: 149001 - RNA, 62 nt, Homo Sapiens; identical to SEQ ID NO: 70079

SEQ ID NO: 149002 - RNA, 62 nt, Homo Sapiens; identical to SEQ ID NO: 70080

SEQ ID NO: 149003 - RNA, 62 nt, Homo Sapiens; identical to SEQ ID NO: 70081

SEQ ID NO: 149004 - RNA, 62 nt, Homo Sapiens; identical to SEQ ID NO: 70082

SEQ ID NO: 149005 - RNA, 62 nt, Homo Sapiens; identical to SEQ ID NO: 70083

SEQ ID NO: 149006 - RNA, 62 nt, Homo Sapiens; identical to SEQ ID NO: 70084

SEQ ID NO: 149007 - RNA, 62 nt, Homo Sapiens; identical to SEQ ID NO: 70085

SEQ ID NO: 149008 - RNA, 62 nt, Homo Sapiens; identical to SEQ ID NO: 70086

SEQ ID NO: 149009 - RNA, 62 nt, Homo Sapiens; identical to SEQ ID NO: 70087

SEQ ID NO: 149010 - RNA, 62 nt, Homo Sapiens; identical to SEQ ID NO: 70088

SEQ ID NO: 149011 - RNA, 62 nt, Homo Sapiens; identical to SEQ ID NO: 70089

SEQ ID NO: 149012 - RNA, 62 nt, Homo Sapiens; identical to SEQ ID NO: 70090

SEQ ID NO: 149013 - RNA, 62 nt, Homo Sapiens; identical to SEQ ID NO: 70091

SEQ ID NO: 149014 - RNA, 62 nt, Homo Sapiens; identical to SEQ ID NO: 70092

SEQ ID NO: 149015 - RNA, 60 nt, Homo Sapiens; identical to SEQ ID NO: 69570

SEQ ID NO: 149016 - RNA, 62 nt, Homo Sapiens; identical to SEQ ID NO: 70094

SEQ ID NO: 149017 - RNA, 62 nt, Homo Sapiens; identical to SEQ ID NO: 70095

SEQ ID NO: 149018 - RNA, 62 nt, Homo Sapiens; identical to SEQ ID NO: 70096

SEQ ID NO: 149019 - RNA, 62 nt, Homo Sapiens; identical to SEQ ID NO: 70097

SEQ ID NO: 149020 - RNA, 62 nt, Homo Sapiens; identical to SEQ ID NO: 70098

SEQ ID NO: 149021 - RNA, 62 nt, Homo Sapiens; identical to SEQ ID NO: 70099

SEQ ID NO: 149022 - RNA, 62 nt, Homo Sapiens; identical to SEQ ID NO: 70100

SEQ ID NO: 149023 - RNA, 62 nt, Homo Sapiens; identical to SEQ ID NO: 70101

SEQ ID NO: 149024 - RNA, 62 nt, Homo Sapiens; identical to SEQ ID NO: 70102

SEQ ID NO: 149025 - RNA, 62 nt, Homo Sapiens; identical to SEQ ID NO: 70103

SEQ ID NO: 149026 - RNA, 62 nt, Homo Sapiens; identical to SEQ ID NO: 70104

SEQ ID NO: 149027 - RNA, 62 nt, Homo Sapiens; identical to SEQ ID NO: 70105

SEQ ID NO: 149028 - RNA, 62 nt, Homo Sapiens; identical to SEQ ID NO: 70106

SEQ ID NO: 149029 - RNA, 62 nt, Homo Sapiens; identical to SEQ ID NO: 70107

SEQ ID NO: 149030 - RNA, 62 nt, Homo Sapiens; identical to SEQ ID NO: 70108

SEQ ID NO: 149031 - RNA, 62 nt, Homo Sapiens; identical to SEQ ID NO: 70109

SEQ ID NO: 149032 - RNA, 62 nt, Homo Sapiens; identical to SEQ ID NO: 70110

SEQ ID NO: 149033 - RNA, 62 nt, Homo Sapiens; identical to SEQ ID NO: 70111

SEQ ID NO: 149034 - RNA, 62 nt, Homo Sapiens; identical to SEQ ID NO: 70112

SEQ ID NO: 149035 - RNA, 62 nt, Homo Sapiens; identical to SEQ ID NO: 70113

SEQ ID NO: 149036 - RNA, 62 nt, Homo Sapiens; identical to SEQ ID NO: 70114

SEQ ID NO: 149037 - RNA, 62 nt, Homo Sapiens; identical to SEQ ID NO: 70115

SEQ ID NO: 149038 - RNA, 62 nt, Homo Sapiens; identical to SEQ ID NO: 70116

SEQ ID NO: 149039 - RNA, 62 nt, Homo Sapiens; identical to SEQ ID NO: 70117

SEQ ID NO: 149040 - RNA, 62 nt, Homo Sapiens; identical to SEQ ID NO: 70118

SEQ ID NO: 149041 - RNA, 62 nt, Homo Sapiens; identical to SEQ ID NO: 70119

SEQ ID NO: 149042 - RNA, 62 nt, Homo Sapiens; identical to SEQ ID NO: 70120

SEQ ID NO: 149043 - RNA, 62 nt, Homo Sapiens; identical to SEQ ID NO: 70121

SEQ ID NO: 149044 - RNA, 62 nt, Homo Sapiens; identical to SEQ ID NO: 70122

SEQ ID NO: 149045 - RNA, 62 nt, Homo Sapiens; identical to SEQ ID NO: 70123

SEQ ID NO: 149046 - RNA, 62 nt, Homo Sapiens; identical to SEQ ID NO: 70124

SEQ ID NO: 149047 - RNA, 62 nt, Homo Sapiens; identical to SEQ ID NO: 70125

SEQ ID NO: 149048 - RNA, 62 nt, Homo Sapiens; identical to SEQ ID NO: 70126

SEQ ID NO: 149049 - RNA, 62 nt, Homo Sapiens; identical to SEQ ID NO: 70127

SEQ ID NO: 149050 - RNA, 62 nt, Homo Sapiens; identical to SEQ ID NO: 70128

SEQ ID NO: 149051 - RNA, 62 nt, Homo Sapiens; identical to SEQ ID NO: 70129

SEQ ID NO: 149052 - RNA, 62 nt, Homo Sapiens; identical to SEQ ID NO: 70130

SEQ ID NO: 149053 - RNA, 62 nt, Homo Sapiens; identical to SEQ ID NO: 70131

SEQ ID NO: 149054 - RNA, 62 nt, Homo Sapiens; identical to SEQ ID NO: 70132

SEQ ID NO: 149055 - RNA, 62 nt, Homo Sapiens; identical to SEQ ID NO: 70133

SEQ ID NO: 149056 - RNA, 62 nt, Homo Sapiens; identical to SEQ ID NO: 70134

SEQ ID NO: 149057 - RNA, 62 nt, Homo Sapiens; identical to SEQ ID NO: 70135

SEQ ID NO: 149058 - RNA, 62 nt, Homo Sapiens; identical to SEQ ID NO: 70136

SEQ ID NO: 149059 - RNA, 62 nt, Homo Sapiens; identical to SEQ ID NO: 70137

SEQ ID NO: 149060 - RNA, 62 nt, Homo Sapiens; identical to SEQ ID NO: 70138

SEQ ID NO: 149061 - RNA, 62 nt, Homo Sapiens; identical to SEQ ID NO: 70139

SEQ ID NO: 149062 - RNA, 62 nt, Homo Sapiens; identical to SEQ ID NO: 70140

SEQ ID NO: 149063 - RNA, 62 nt, Homo Sapiens; identical to SEQ ID NO: 70141

SEQ ID NO: 149064 - RNA, 62 nt, Homo Sapiens; identical to SEQ ID NO: 70142

SEQ ID NO: 149065 - RNA, 62 nt, Homo Sapiens; identical to SEQ ID NO: 70143

SEQ ID NO: 149066 - RNA, 62 nt, Homo Sapiens; identical to SEQ ID NO: 70144

SEQ ID NO: 149067 - RNA, 62 nt, Homo Sapiens; identical to SEQ ID NO: 70145

SEQ ID NO: 149068 - RNA, 62 nt, Homo Sapiens; identical to SEQ ID NO: 70146

SEQ ID NO: 149069 - RNA, 62 nt, Homo Sapiens; identical to SEQ ID NO: 70147

SEQ ID NO: 149070 - RNA, 62 nt, Homo Sapiens; identical to SEQ ID NO: 70148

SEQ ID NO: 149071 - RNA, 62 nt, Homo Sapiens; identical to SEQ ID NO: 70149

SEQ ID NO: 149072 - RNA, 62 nt, Homo Sapiens; identical to SEQ ID NO: 70150

SEQ ID NO: 149073 - RNA, 62 nt, Homo Sapiens; identical to SEQ ID NO: 70151

SEQ ID NO: 149074 - RNA, 62 nt, Homo Sapiens; identical to SEQ ID NO: 70152

SEQ ID NO: 149075 - RNA, 62 nt, Homo Sapiens; identical to SEQ ID NO: 70153

SEQ ID NO: 149076 - RNA, 62 nt, Homo Sapiens; identical to SEQ ID NO: 70154

SEQ ID NO: 149077 - RNA, 62 nt, Homo Sapiens; identical to SEQ ID NO: 70155

SEQ ID NO: 149078 - RNA, 62 nt, Homo Sapiens; identical to SEQ ID NO: 70156

SEQ ID NO: 149079 - RNA, 62 nt, Homo Sapiens; identical to SEQ ID NO: 70157

SEQ ID NO: 149080 - RNA, 62 nt, Homo Sapiens; identical to SEQ ID NO: 70158

SEQ ID NO: 149081 - RNA, 62 nt, Homo Sapiens; identical to SEQ ID NO: 70159

SEQ ID NO: 149082 - RNA, 62 nt, Homo Sapiens; identical to SEQ ID NO: 70160

SEQ ID NO: 149083 - RNA, 62 nt, Homo Sapiens; identical to SEQ ID NO: 70161

SEQ ID NO: 149084 - RNA, 62 nt, Homo Sapiens; identical to SEQ ID NO: 70162

SEQ ID NO: 149085 - RNA, 62 nt, Homo Sapiens; identical to SEQ ID NO: 70163

SEQ ID NO: 149086 - RNA, 62 nt, Homo Sapiens; identical to SEQ ID NO: 70164

SEQ ID NO: 149087 - RNA, 62 nt, Homo Sapiens; identical to SEQ ID NO: 70165

SEQ ID NO: 149088 - RNA, 62 nt, Homo Sapiens; identical to SEQ ID NO: 70166

SEQ ID NO: 149089 - RNA, 62 nt, Homo Sapiens; identical to SEQ ID NO: 70167

SEQ ID NO: 149090 - RNA, 62 nt, Homo Sapiens; identical to SEQ ID NO: 70168

SEQ ID NO: 149091 - RNA, 62 nt, Homo Sapiens; identical to SEQ ID NO: 70169

SEQ ID NO: 149092 - RNA, 62 nt, Homo Sapiens; identical to SEQ ID NO: 70170

SEQ ID NO: 149093 - RNA, 62 nt, Homo Sapiens; identical to SEQ ID NO: 70171

SEQ ID NO: 149094 - RNA, 62 nt, Homo Sapiens; identical to SEQ ID NO: 70172

SEQ ID NO: 149095 - RNA, 62 nt, Homo Sapiens; identical to SEQ ID NO: 70173

SEQ ID NO: 149096 - RNA, 62 nt, Homo Sapiens; identical to SEQ ID NO: 70174

SEQ ID NO: 149097 - RNA, 62 nt, Homo Sapiens; identical to SEQ ID NO: 70175

SEQ ID NO: 149098 - RNA, 63 nt, Homo Sapiens; identical to SEQ ID NO: 70176

SEQ ID NO: 149099 - RNA, 63 nt, Homo Sapiens; identical to SEQ ID NO: 70177

SEQ ID NO: 149100 - RNA, 63 nt, Homo Sapiens; identical to SEQ ID NO: 70178

SEQ ID NO: 149101 - RNA, 63 nt, Homo Sapiens; identical to SEQ ID NO: 70179

SEQ ID NO: 149102 - RNA, 63 nt, Homo Sapiens; identical to SEQ ID NO: 70180

SEQ ID NO: 149103 - RNA, 63 nt, Homo Sapiens; identical to SEQ ID NO: 70181

SEQ ID NO: 149104 - RNA, 63 nt, Homo Sapiens; identical to SEQ ID NO: 70182

SEQ ID NO: 149105 - RNA, 63 nt, Homo Sapiens; identical to SEQ ID NO: 70183

SEQ ID NO: 149106 - RNA, 63 nt, Homo Sapiens; identical to SEQ ID NO: 70184

SEQ ID NO: 149107 - RNA, 63 nt, Homo Sapiens; identical to SEQ ID NO: 70185

SEQ ID NO: 149108 - RNA, 63 nt, Homo Sapiens; identical to SEQ ID NO: 70186

SEQ ID NO: 149109 - RNA, 63 nt, Homo Sapiens; identical to SEQ ID NO: 70187

SEQ ID NO: 149110 - RNA, 63 nt, Homo Sapiens; identical to SEQ ID NO: 70188

SEQ ID NO: 149111 - RNA, 52 nt, Homo Sapiens; identical to SEQ ID NO: 69143

SEQ ID NO: 149112 - RNA, 63 nt, Homo Sapiens; identical to SEQ ID NO: 70190

SEQ ID NO: 149113 - RNA, 63 nt, Homo Sapiens; identical to SEQ ID NO: 70191

SEQ ID NO: 149114 - RNA, 63 nt, Homo Sapiens; identical to SEQ ID NO: 70192

SEQ ID NO: 149115 - RNA, 63 nt, Homo Sapiens; identical to SEQ ID NO: 70193

SEQ ID NO: 149116 - RNA, 63 nt, Homo Sapiens; identical to SEQ ID NO: 70194

SEQ ID NO: 149117 - RNA, 63 nt, Homo Sapiens; identical to SEQ ID NO: 70195

SEQ ID NO: 149118 - RNA, 63 nt, Homo Sapiens; identical to SEQ ID NO: 70196

SEQ ID NO: 149119 - RNA, 63 nt, Homo Sapiens; identical to SEQ ID NO: 70197

SEQ ID NO: 149120 - RNA, 63 nt, Homo Sapiens; identical to SEQ ID NO: 70198

SEQ ID NO: 149121 - RNA, 63 nt, Homo Sapiens; identical to SEQ ID NO: 70199

SEQ ID NO: 149122 - RNA, 63 nt, Homo Sapiens; identical to SEQ ID NO: 70200

SEQ ID NO: 149123 - RNA, 63 nt, Homo Sapiens; identical to SEQ ID NO: 70201

SEQ ID NO: 149124 - RNA, 63 nt, Homo Sapiens; identical to SEQ ID NO: 70202

SEQ ID NO: 149125 - RNA, 63 nt, Homo Sapiens; identical to SEQ ID NO: 70203

SEQ ID NO: 149126 - RNA, 63 nt, Homo Sapiens; identical to SEQ ID NO: 70204

SEQ ID NO: 149127 - RNA, 63 nt, Homo Sapiens; identical to SEQ ID NO: 70205

SEQ ID NO: 149128 - RNA, 63 nt, Homo Sapiens; identical to SEQ ID NO: 70206

SEQ ID NO: 149129 - RNA, 63 nt, Homo Sapiens; identical to SEQ ID NO: 70207

SEQ ID NO: 149130 - RNA, 63 nt, Homo Sapiens; identical to SEQ ID NO: 70208

SEQ ID NO: 149131 - RNA, 63 nt, Homo Sapiens; identical to SEQ ID NO: 70209

SEQ ID NO: 149132 - RNA, 63 nt, Homo Sapiens; identical to SEQ ID NO: 70210

SEQ ID NO: 149133 - RNA, 63 nt, Homo Sapiens; identical to SEQ ID NO: 70211

SEQ ID NO: 149134 - RNA, 63 nt, Homo Sapiens; identical to SEQ ID NO: 70212

SEQ ID NO: 149135 - RNA, 63 nt, Homo Sapiens; identical to SEQ ID NO: 70213

SEQ ID NO: 149136 - RNA, 63 nt, Homo Sapiens; identical to SEQ ID NO: 70214

SEQ ID NO: 149137 - RNA, 63 nt, Homo Sapiens; identical to SEQ ID NO: 70215

SEQ ID NO: 149138 - RNA, 57 nt, Homo Sapiens; identical to SEQ ID NO: 69170

SEQ ID NO: 149139 - RNA, 63 nt, Homo Sapiens; identical to SEQ ID NO: 70217

SEQ ID NO: 149140 - RNA, 63 nt, Homo Sapiens; identical to SEQ ID NO: 70218

SEQ ID NO: 149141 - RNA, 63 nt, Homo Sapiens; identical to SEQ ID NO: 70219

SEQ ID NO: 149142 - RNA, 63 nt, Homo Sapiens; identical to SEQ ID NO: 70220

SEQ ID NO: 149143 - RNA, 63 nt, Homo Sapiens; identical to SEQ ID NO: 70221

SEQ ID NO: 149144 - RNA, 63 nt, Homo Sapiens; identical to SEQ ID NO: 70222

SEQ ID NO: 149145 - RNA, 63 nt, Homo Sapiens; identical to SEQ ID NO: 70223

SEQ ID NO: 149146 - RNA, 63 nt, Homo Sapiens; identical to SEQ ID NO: 70224

SEQ ID NO: 149147 - RNA, 63 nt, Homo Sapiens; identical to SEQ ID NO: 70225

SEQ ID NO: 149148 - RNA, 63 nt, Homo Sapiens; identical to SEQ ID NO: 70226

SEQ ID NO: 149149 - RNA, 63 nt, Homo Sapiens; identical to SEQ ID NO: 70227

SEQ ID NO: 149150 - RNA, 63 nt, Homo Sapiens; identical to SEQ ID NO: 70228

SEQ ID NO: 149151 - RNA, 63 nt, Homo Sapiens; identical to SEQ ID NO: 70229

SEQ ID NO: 149152 - RNA, 63 nt, Homo Sapiens; identical to SEQ ID NO: 70230

SEQ ID NO: 149153 - RNA, 63 nt, Homo Sapiens; identical to SEQ ID NO: 70231

SEQ ID NO: 149154 - RNA, 63 nt, Homo Sapiens; identical to SEQ ID NO: 70232

SEQ ID NO: 149155 - RNA, 61 nt, Homo Sapiens; identical to SEQ ID NO: 69187

SEQ ID NO: 149156 - RNA, 63 nt, Homo Sapiens; identical to SEQ ID NO: 70234

SEQ ID NO: 149157 - RNA, 63 nt, Homo Sapiens; identical to SEQ ID NO: 70235

SEQ ID NO: 149158 - RNA, 63 nt, Homo Sapiens; identical to SEQ ID NO: 70236

SEQ ID NO: 149159 - RNA, 63 nt, Homo Sapiens; identical to SEQ ID NO: 70237

SEQ ID NO: 149160 - RNA, 63 nt, Homo Sapiens; identical to SEQ ID NO: 70238

SEQ ID NO: 149161 - RNA, 63 nt, Homo Sapiens; identical to SEQ ID NO: 70239

SEQ ID NO: 149162 - RNA, 63 nt, Homo Sapiens; identical to SEQ ID NO: 70240

SEQ ID NO: 149163 - RNA, 63 nt, Homo Sapiens; identical to SEQ ID NO: 70241

SEQ ID NO: 149164 - RNA, 63 nt, Homo Sapiens; identical to SEQ ID NO: 70242

SEQ ID NO: 149165 - RNA, 63 nt, Homo Sapiens; identical to SEQ ID NO: 70243

SEQ ID NO: 149166 - RNA, 63 nt, Homo Sapiens; identical to SEQ ID NO: 70244

SEQ ID NO: 149167 - RNA, 63 nt, Homo Sapiens; identical to SEQ ID NO: 70245

SEQ ID NO: 149168 - RNA, 63 nt, Homo Sapiens; identical to SEQ ID NO: 70246

SEQ ID NO: 149169 - RNA, 63 nt, Homo Sapiens; identical to SEQ ID NO: 70247

SEQ ID NO: 149170 - RNA, 63 nt, Homo Sapiens; identical to SEQ ID NO: 70248

SEQ ID NO: 149171 - RNA, 63 nt, Homo Sapiens; identical to SEQ ID NO: 70249

SEQ ID NO: 149172 - RNA, 63 nt, Homo Sapiens; identical to SEQ ID NO: 70250

SEQ ID NO: 149173 - RNA, 63 nt, Homo Sapiens; identical to SEQ ID NO: 70251

SEQ ID NO: 149174 - RNA, 63 nt, Homo Sapiens; identical to SEQ ID NO: 70252

SEQ ID NO: 149175 - RNA, 63 nt, Homo Sapiens; identical to SEQ ID NO: 70253

SEQ ID NO: 149176 - RNA, 63 nt, Homo Sapiens; identical to SEQ ID NO: 70254

SEQ ID NO: 149177 - RNA, 63 nt, Homo Sapiens; identical to SEQ ID NO: 70255

SEQ ID NO: 149178 - RNA, 63 nt, Homo Sapiens; identical to SEQ ID NO: 70256

SEQ ID NO: 149179 - RNA, 63 nt, Homo Sapiens; identical to SEQ ID NO: 70257

SEQ ID NO: 149180 - RNA, 63 nt, Homo Sapiens; identical to SEQ ID NO: 70258

SEQ ID NO: 149181 - RNA, 63 nt, Homo Sapiens; identical to SEQ ID NO: 70259

SEQ ID NO: 149182 - RNA, 63 nt, Homo Sapiens; identical to SEQ ID NO: 70260

SEQ ID NO: 149183 - RNA, 63 nt, Homo Sapiens; identical to SEQ ID NO: 70261

SEQ ID NO: 149184 - RNA, 63 nt, Homo Sapiens; identical to SEQ ID NO: 70262

SEQ ID NO: 149185 - RNA, 63 nt, Homo Sapiens; identical to SEQ ID NO: 70263

SEQ ID NO: 149186 - RNA, 63 nt, Homo Sapiens; identical to SEQ ID NO: 70264

SEQ ID NO: 149187 - RNA, 63 nt, Homo Sapiens; identical to SEQ ID NO: 70265

SEQ ID NO: 149188 - RNA, 63 nt, Homo Sapiens; identical to SEQ ID NO: 70266

SEQ ID NO: 149189 - RNA, 63 nt, Homo Sapiens; identical to SEQ ID NO: 70267

SEQ ID NO: 149190 - RNA, 63 nt, Homo Sapiens; identical to SEQ ID NO: 70268

SEQ ID NO: 149191 - RNA, 63 nt, Homo Sapiens; identical to SEQ ID NO: 70269

SEQ ID NO: 149192 - RNA, 63 nt, Homo Sapiens; identical to SEQ ID NO: 70270

SEQ ID NO: 149193 - RNA, 63 nt, Homo Sapiens; identical to SEQ ID NO: 70271

SEQ ID NO: 149194 - RNA, 63 nt, Homo Sapiens; identical to SEQ ID NO: 70272

SEQ ID NO: 149195 - RNA, 63 nt, Homo Sapiens; identical to SEQ ID NO: 70273

SEQ ID NO: 149196 - RNA, 63 nt, Homo Sapiens; identical to SEQ ID NO: 70274

SEQ ID NO: 149197 - RNA, 63 nt, Homo Sapiens; identical to SEQ ID NO: 70275

SEQ ID NO: 149198 - RNA, 63 nt, Homo Sapiens; identical to SEQ ID NO: 70276

SEQ ID NO: 149199 - RNA, 63 nt, Homo Sapiens; identical to SEQ ID NO: 70277

SEQ ID NO: 149200 - RNA, 63 nt, Homo Sapiens; identical to SEQ ID NO: 70278

SEQ ID NO: 149201 - RNA, 63 nt, Homo Sapiens; identical to SEQ ID NO: 70279

SEQ ID NO: 149202 - RNA, 63 nt, Homo Sapiens; identical to SEQ ID NO: 70280

SEQ ID NO: 149203 - RNA, 63 nt, Homo Sapiens; identical to SEQ ID NO: 70281

SEQ ID NO: 149204 - RNA, 63 nt, Homo Sapiens; identical to SEQ ID NO: 70282

SEQ ID NO: 149205 - RNA, 63 nt, Homo Sapiens; identical to SEQ ID NO: 70283

SEQ ID NO: 149206 - RNA, 63 nt, Homo Sapiens; identical to SEQ ID NO: 70284

SEQ ID NO: 149207 - RNA, 63 nt, Homo Sapiens; identical to SEQ ID NO: 70285

SEQ ID NO: 149208 - RNA, 63 nt, Homo Sapiens; identical to SEQ ID NO: 70286

SEQ ID NO: 149209 - RNA, 63 nt, Homo Sapiens; identical to SEQ ID NO: 70287

SEQ ID NO: 149210 - RNA, 63 nt, Homo Sapiens; identical to SEQ ID NO: 70288

SEQ ID NO: 149211 - RNA, 63 nt, Homo Sapiens; identical to SEQ ID NO: 70289

SEQ ID NO: 149212 - RNA, 63 nt, Homo Sapiens; identical to SEQ ID NO: 70290

SEQ ID NO: 149213 - RNA, 63 nt, Homo Sapiens; identical to SEQ ID NO: 70291

SEQ ID NO: 149214 - RNA, 63 nt, Homo Sapiens; identical to SEQ ID NO: 70292

SEQ ID NO: 149215 - RNA, 63 nt, Homo Sapiens; identical to SEQ ID NO: 70293

SEQ ID NO: 149216 - RNA, 63 nt, Homo Sapiens; identical to SEQ ID NO: 70294

SEQ ID NO: 149217 - RNA, 63 nt, Homo Sapiens; identical to SEQ ID NO: 70295

SEQ ID NO: 149218 - RNA, 63 nt, Homo Sapiens; identical to SEQ ID NO: 70296

SEQ ID NO: 149219 - RNA, 63 nt, Homo Sapiens; identical to SEQ ID NO: 70297

SEQ ID NO: 149220 - RNA, 63 nt, Homo Sapiens; identical to SEQ ID NO: 70298

SEQ ID NO: 149221 - RNA, 63 nt, Homo Sapiens; identical to SEQ ID NO: 70299

SEQ ID NO: 149222 - RNA, 63 nt, Homo Sapiens; identical to SEQ ID NO: 70300

SEQ ID NO: 149223 - RNA, 63 nt, Homo Sapiens; identical to SEQ ID NO: 70301

SEQ ID NO: 149224 - RNA, 63 nt, Homo Sapiens; identical to SEQ ID NO: 70302

SEQ ID NO: 149225 - RNA, 63 nt, Homo Sapiens; identical to SEQ ID NO: 70303

SEQ ID NO: 149226 - RNA, 63 nt, Homo Sapiens; identical to SEQ ID NO: 70304

SEQ ID NO: 149227 - RNA, 63 nt, Homo Sapiens; identical to SEQ ID NO: 70305

SEQ ID NO: 149228 - RNA, 63 nt, Homo Sapiens; identical to SEQ ID NO: 70306

SEQ ID NO: 149229 - RNA, 63 nt, Homo Sapiens; identical to SEQ ID NO: 70307

SEQ ID NO: 149230 - RNA, 63 nt, Homo Sapiens; identical to SEQ ID NO: 70308

SEQ ID NO: 149231 - RNA, 63 nt, Homo Sapiens; identical to SEQ ID NO: 70309

SEQ ID NO: 149232 - RNA, 63 nt, Homo Sapiens; identical to SEQ ID NO: 70310

SEQ ID NO: 149233 - RNA, 63 nt, Homo Sapiens; identical to SEQ ID NO: 70311

SEQ ID NO: 149234 - RNA, 63 nt, Homo Sapiens; identical to SEQ ID NO: 70312

SEQ ID NO: 149235 - RNA, 63 nt, Homo Sapiens; identical to SEQ ID NO: 70313

SEQ ID NO: 149236 - RNA, 63 nt, Homo Sapiens; identical to SEQ ID NO: 70314

SEQ ID NO: 149237 - RNA, 63 nt, Homo Sapiens; identical to SEQ ID NO: 70315

SEQ ID NO: 149238 - RNA, 63 nt, Homo Sapiens; identical to SEQ ID NO: 70316

SEQ ID NO: 149239 - RNA, 63 nt, Homo Sapiens; identical to SEQ ID NO: 70317

SEQ ID NO: 149240 - RNA, 59 nt, Homo Sapiens; identical to SEQ ID NO: 69272

SEQ ID NO: 149241 - RNA, 63 nt, Homo Sapiens; identical to SEQ ID NO: 70319

SEQ ID NO: 149242 - RNA, 63 nt, Homo Sapiens; identical to SEQ ID NO: 70320

SEQ ID NO: 149243 - RNA, 63 nt, Homo Sapiens; identical to SEQ ID NO: 70321

SEQ ID NO: 149244 - RNA, 63 nt, Homo Sapiens; identical to SEQ ID NO: 70322

SEQ ID NO: 149245 - RNA, 63 nt, Homo Sapiens; identical to SEQ ID NO: 70323

SEQ ID NO: 149246 - RNA, 63 nt, Homo Sapiens; identical to SEQ ID NO: 70324

SEQ ID NO: 149247 - RNA, 63 nt, Homo Sapiens; identical to SEQ ID NO: 70325

SEQ ID NO: 149248 - RNA, 63 nt, Homo Sapiens; identical to SEQ ID NO: 70326

SEQ ID NO: 149249 - RNA, 63 nt, Homo Sapiens; identical to SEQ ID NO: 70327

SEQ ID NO: 149250 - RNA, 63 nt, Homo Sapiens; identical to SEQ ID NO: 70328

SEQ ID NO: 149251 - RNA, 63 nt, Homo Sapiens; identical to SEQ ID NO: 70329

SEQ ID NO: 149252 - RNA, 63 nt, Homo Sapiens; identical to SEQ ID NO: 70330

SEQ ID NO: 149253 - RNA, 63 nt, Homo Sapiens; identical to SEQ ID NO: 70331

SEQ ID NO: 149254 - RNA, 63 nt, Homo Sapiens; identical to SEQ ID NO: 70332

SEQ ID NO: 149255 - RNA, 63 nt, Homo Sapiens; identical to SEQ ID NO: 70333

SEQ ID NO: 149256 - RNA, 63 nt, Homo Sapiens; identical to SEQ ID NO: 70334

SEQ ID NO: 149257 - RNA, 63 nt, Homo Sapiens; identical to SEQ ID NO: 70335

SEQ ID NO: 149258 - RNA, 63 nt, Homo Sapiens; identical to SEQ ID NO: 70336

SEQ ID NO: 149259 - RNA, 63 nt, Homo Sapiens; identical to SEQ ID NO: 70337

SEQ ID NO: 149260 - RNA, 63 nt, Homo Sapiens; identical to SEQ ID NO: 70338

SEQ ID NO: 149261 - RNA, 63 nt, Homo Sapiens; identical to SEQ ID NO: 70339

SEQ ID NO: 149262 - RNA, 63 nt, Homo Sapiens; identical to SEQ ID NO: 70340

SEQ ID NO: 149263 - RNA, 63 nt, Homo Sapiens; identical to SEQ ID NO: 70341

SEQ ID NO: 149264 - RNA, 63 nt, Homo Sapiens; identical to SEQ ID NO: 70342

SEQ ID NO: 149265 - RNA, 63 nt, Homo Sapiens; identical to SEQ ID NO: 70343

SEQ ID NO: 149266 - RNA, 63 nt, Homo Sapiens; identical to SEQ ID NO: 70344

SEQ ID NO: 149267 - RNA, 63 nt, Homo Sapiens; identical to SEQ ID NO: 70345

SEQ ID NO: 149268 - RNA, 63 nt, Homo Sapiens; identical to SEQ ID NO: 70346

SEQ ID NO: 149269 - RNA, 63 nt, Homo Sapiens; identical to SEQ ID NO: 70347

SEQ ID NO: 149270 - RNA, 63 nt, Homo Sapiens; identical to SEQ ID NO: 70348

SEQ ID NO: 149271 - RNA, 63 nt, Homo Sapiens; identical to SEQ ID NO: 70349

SEQ ID NO: 149272 - RNA, 63 nt, Homo Sapiens; identical to SEQ ID NO: 70350

SEQ ID NO: 149273 - RNA, 63 nt, Homo Sapiens; identical to SEQ ID NO: 70351

SEQ ID NO: 149274 - RNA, 63 nt, Homo Sapiens; identical to SEQ ID NO: 70352

SEQ ID NO: 149275 - RNA, 63 nt, Homo Sapiens; identical to SEQ ID NO: 70353

SEQ ID NO: 149276 - RNA, 63 nt, Homo Sapiens; identical to SEQ ID NO: 70354

SEQ ID NO: 149277 - RNA, 63 nt, Homo Sapiens; identical to SEQ ID NO: 70355

SEQ ID NO: 149278 - RNA, 63 nt, Homo Sapiens; identical to SEQ ID NO: 70356

SEQ ID NO: 149279 - RNA, 63 nt, Homo Sapiens; identical to SEQ ID NO: 70357

SEQ ID NO: 149280 - RNA, 63 nt, Homo Sapiens; identical to SEQ ID NO: 70358

SEQ ID NO: 149281 - RNA, 63 nt, Homo Sapiens; identical to SEQ ID NO: 70359

SEQ ID NO: 149282 - RNA, 63 nt, Homo Sapiens; identical to SEQ ID NO: 70360

SEQ ID NO: 149283 - RNA, 63 nt, Homo Sapiens; identical to SEQ ID NO: 70361

SEQ ID NO: 149284 - RNA, 63 nt, Homo Sapiens; identical to SEQ ID NO: 70362

SEQ ID NO: 149285 - RNA, 63 nt, Homo Sapiens; identical to SEQ ID NO: 70363

SEQ ID NO: 149286 - RNA, 63 nt, Homo Sapiens; identical to SEQ ID NO: 70364

SEQ ID NO: 149287 - RNA, 63 nt, Homo Sapiens; identical to SEQ ID NO: 70365

SEQ ID NO: 149288 - RNA, 63 nt, Homo Sapiens; identical to SEQ ID NO: 70366

SEQ ID NO: 149289 - RNA, 63 nt, Homo Sapiens; identical to SEQ ID NO: 70367

SEQ ID NO: 149290 - RNA, 63 nt, Homo Sapiens; identical to SEQ ID NO: 70368

SEQ ID NO: 149291 - RNA, 63 nt, Homo Sapiens; identical to SEQ ID NO: 70369

SEQ ID NO: 149292 - RNA, 63 nt, Homo Sapiens; identical to SEQ ID NO: 70370

SEQ ID NO: 149293 - RNA, 63 nt, Homo Sapiens; identical to SEQ ID NO: 70371

SEQ ID NO: 149294 - RNA, 63 nt, Homo Sapiens; identical to SEQ ID NO: 70372

SEQ ID NO: 149295 - RNA, 63 nt, Homo Sapiens; identical to SEQ ID NO: 70373

SEQ ID NO: 149296 - RNA, 63 nt, Homo Sapiens; identical to SEQ ID NO: 70374

SEQ ID NO: 149297 - RNA, 63 nt, Homo Sapiens; identical to SEQ ID NO: 70375

SEQ ID NO: 149298 - RNA, 63 nt, Homo Sapiens; identical to SEQ ID NO: 70376

SEQ ID NO: 149299 - RNA, 63 nt, Homo Sapiens; identical to SEQ ID NO: 70377

SEQ ID NO: 149300 - RNA, 63 nt, Homo Sapiens; identical to SEQ ID NO: 70378

SEQ ID NO: 149301 - RNA, 63 nt, Homo Sapiens; identical to SEQ ID NO: 70379

SEQ ID NO: 149302 - RNA, 63 nt, Homo Sapiens; identical to SEQ ID NO: 70380

SEQ ID NO: 149303 - RNA, 63 nt, Homo Sapiens; identical to SEQ ID NO: 70381

SEQ ID NO: 149304 - RNA, 63 nt, Homo Sapiens; identical to SEQ ID NO: 70382

SEQ ID NO: 149305 - RNA, 63 nt, Homo Sapiens; identical to SEQ ID NO: 70383

SEQ ID NO: 149306 - RNA, 63 nt, Homo Sapiens; identical to SEQ ID NO: 70384

SEQ ID NO: 149307 - RNA, 63 nt, Homo Sapiens; identical to SEQ ID NO: 70385

SEQ ID NO: 149308 - RNA, 63 nt, Homo Sapiens; identical to SEQ ID NO: 70386

SEQ ID NO: 149309 - RNA, 63 nt, Homo Sapiens; identical to SEQ ID NO: 70387

SEQ ID NO: 149310 - RNA, 63 nt, Homo Sapiens; identical to SEQ ID NO: 70388

SEQ ID NO: 149311 - RNA, 63 nt, Homo Sapiens; identical to SEQ ID NO: 70389

SEQ ID NO: 149312 - RNA, 63 nt, Homo Sapiens; identical to SEQ ID NO: 70390

SEQ ID NO: 149313 - RNA, 63 nt, Homo Sapiens; identical to SEQ ID NO: 70391

SEQ ID NO: 149314 - RNA, 63 nt, Homo Sapiens; identical to SEQ ID NO: 70392

SEQ ID NO: 149315 - RNA, 63 nt, Homo Sapiens; identical to SEQ ID NO: 70393

SEQ ID NO: 149316 - RNA, 63 nt, Homo Sapiens; identical to SEQ ID NO: 70394

SEQ ID NO: 149317 - RNA, 63 nt, Homo Sapiens; identical to SEQ ID NO: 70395

SEQ ID NO: 149318 - RNA, 63 nt, Homo Sapiens; identical to SEQ ID NO: 70396

SEQ ID NO: 149319 - RNA, 54 nt, Homo Sapiens; identical to SEQ ID NO: 69351

SEQ ID NO: 149320 - RNA, 63 nt, Homo Sapiens; identical to SEQ ID NO: 70398

SEQ ID NO: 149321 - RNA, 63 nt, Homo Sapiens; identical to SEQ ID NO: 70399

SEQ ID NO: 149322 - RNA, 63 nt, Homo Sapiens; identical to SEQ ID NO: 70400

SEQ ID NO: 149323 - RNA, 63 nt, Homo Sapiens; identical to SEQ ID NO: 70401

SEQ ID NO: 149324 - RNA, 63 nt, Homo Sapiens; identical to SEQ ID NO: 70402

SEQ ID NO: 149325 - RNA, 63 nt, Homo Sapiens; identical to SEQ ID NO: 70403

SEQ ID NO: 149326 - RNA, 63 nt, Homo Sapiens; identical to SEQ ID NO: 70404

SEQ ID NO: 149327 - RNA, 63 nt, Homo Sapiens; identical to SEQ ID NO: 70405

SEQ ID NO: 149328 - RNA, 63 nt, Homo Sapiens; identical to SEQ ID NO: 70406

SEQ ID NO: 149329 - RNA, 63 nt, Homo Sapiens; identical to SEQ ID NO: 70407

SEQ ID NO: 149330 - RNA, 63 nt, Homo Sapiens; identical to SEQ ID NO: 70408

SEQ ID NO: 149331 - RNA, 63 nt, Homo Sapiens; identical to SEQ ID NO: 70409

SEQ ID NO: 149332 - RNA, 63 nt, Homo Sapiens; identical to SEQ ID NO: 70410

SEQ ID NO: 149333 - RNA, 63 nt, Homo Sapiens; identical to SEQ ID NO: 70411

SEQ ID NO: 149334 - RNA, 63 nt, Homo Sapiens; identical to SEQ ID NO: 70412

SEQ ID NO: 149335 - RNA, 63 nt, Homo Sapiens; identical to SEQ ID NO: 70413

SEQ ID NO: 149336 - RNA, 63 nt, Homo Sapiens; identical to SEQ ID NO: 70414

SEQ ID NO: 149337 - RNA, 63 nt, Homo Sapiens; identical to SEQ ID NO: 70415

SEQ ID NO: 149338 - RNA, 63 nt, Homo Sapiens; identical to SEQ ID NO: 70416

SEQ ID NO: 149339 - RNA, 63 nt, Homo Sapiens; identical to SEQ ID NO: 70417

SEQ ID NO: 149340 - RNA, 63 nt, Homo Sapiens; identical to SEQ ID NO: 70418

SEQ ID NO: 149341 - RNA, 63 nt, Homo Sapiens; identical to SEQ ID NO: 70419

SEQ ID NO: 149342 - RNA, 63 nt, Homo Sapiens; identical to SEQ ID NO: 70420

SEQ ID NO: 149343 - RNA, 54 nt, Homo Sapiens; identical to SEQ ID NO: 69375

SEQ ID NO: 149344 - RNA, 63 nt, Homo Sapiens; identical to SEQ ID NO: 70422

SEQ ID NO: 149345 - RNA, 63 nt, Homo Sapiens; identical to SEQ ID NO: 70423

SEQ ID NO: 149346 - RNA, 63 nt, Homo Sapiens; identical to SEQ ID NO: 70424

SEQ ID NO: 149347 - RNA, 63 nt, Homo Sapiens; identical to SEQ ID NO: 70425

SEQ ID NO: 149348 - RNA, 63 nt, Homo Sapiens; identical to SEQ ID NO: 70426

SEQ ID NO: 149349 - RNA, 63 nt, Homo Sapiens; identical to SEQ ID NO: 70427

SEQ ID NO: 149350 - RNA, 63 nt, Homo Sapiens; identical to SEQ ID NO: 70428

SEQ ID NO: 149351 - RNA, 63 nt, Homo Sapiens; identical to SEQ ID NO: 70429

SEQ ID NO: 149352 - RNA, 63 nt, Homo Sapiens; identical to SEQ ID NO: 70430

SEQ ID NO: 149353 - RNA, 63 nt, Homo Sapiens; identical to SEQ ID NO: 70431

SEQ ID NO: 149354 - RNA, 63 nt, Homo Sapiens; identical to SEQ ID NO: 70432

SEQ ID NO: 149355 - RNA, 63 nt, Homo Sapiens; identical to SEQ ID NO: 70433

SEQ ID NO: 149356 - RNA, 62 nt, Homo Sapiens; identical to SEQ ID NO: 69911

SEQ ID NO: 149357 - RNA, 63 nt, Homo Sapiens; identical to SEQ ID NO: 70435

SEQ ID NO: 149358 - RNA, 63 nt, Homo Sapiens; identical to SEQ ID NO: 70436

SEQ ID NO: 149359 - RNA, 63 nt, Homo Sapiens; identical to SEQ ID NO: 70437

SEQ ID NO: 149360 - RNA, 58 nt, Homo Sapiens; identical to SEQ ID NO: 69392

SEQ ID NO: 149361 - RNA, 63 nt, Homo Sapiens; identical to SEQ ID NO: 70439

SEQ ID NO: 149362 - RNA, 63 nt, Homo Sapiens; identical to SEQ ID NO: 70440

SEQ ID NO: 149363 - RNA, 63 nt, Homo Sapiens; identical to SEQ ID NO: 70441

SEQ ID NO: 149364 - RNA, 63 nt, Homo Sapiens; identical to SEQ ID NO: 70442

SEQ ID NO: 149365 - RNA, 63 nt, Homo Sapiens; identical to SEQ ID NO: 70443

SEQ ID NO: 149366 - RNA, 63 nt, Homo Sapiens; identical to SEQ ID NO: 70444

SEQ ID NO: 149367 - RNA, 63 nt, Homo Sapiens; identical to SEQ ID NO: 70445

SEQ ID NO: 149368 - RNA, 63 nt, Homo Sapiens; identical to SEQ ID NO: 70446

SEQ ID NO: 149369 - RNA, 63 nt, Homo Sapiens; identical to SEQ ID NO: 70447

SEQ ID NO: 149370 - RNA, 63 nt, Homo Sapiens; identical to SEQ ID NO: 70448

SEQ ID NO: 149371 - RNA, 63 nt, Homo Sapiens; identical to SEQ ID NO: 70449

SEQ ID NO: 149372 - RNA, 63 nt, Homo Sapiens; identical to SEQ ID NO: 70450

SEQ ID NO: 149373 - RNA, 63 nt, Homo Sapiens; identical to SEQ ID NO: 70451

SEQ ID NO: 149374 - RNA, 63 nt, Homo Sapiens; identical to SEQ ID NO: 70452

SEQ ID NO: 149375 - RNA, 63 nt, Homo Sapiens; identical to SEQ ID NO: 70453

SEQ ID NO: 149376 - RNA, 63 nt, Homo Sapiens; identical to SEQ ID NO: 70454

SEQ ID NO: 149377 - RNA, 63 nt, Homo Sapiens; identical to SEQ ID NO: 70455

SEQ ID NO: 149378 - RNA, 63 nt, Homo Sapiens; identical to SEQ ID NO: 70456

SEQ ID NO: 149379 - RNA, 63 nt, Homo Sapiens; identical to SEQ ID NO: 70457

SEQ ID NO: 149380 - RNA, 63 nt, Homo Sapiens; identical to SEQ ID NO: 70458

SEQ ID NO: 149381 - RNA, 63 nt, Homo Sapiens; identical to SEQ ID NO: 70459

SEQ ID NO: 149382 - RNA, 63 nt, Homo Sapiens; identical to SEQ ID NO: 70460

SEQ ID NO: 149383 - RNA, 63 nt, Homo Sapiens; identical to SEQ ID NO: 70461

SEQ ID NO: 149384 - RNA, 63 nt, Homo Sapiens; identical to SEQ ID NO: 70462

SEQ ID NO: 149385 - RNA, 63 nt, Homo Sapiens; identical to SEQ ID NO: 70463

SEQ ID NO: 149386 - RNA, 63 nt, Homo Sapiens; identical to SEQ ID NO: 70464

SEQ ID NO: 149387 - RNA, 60 nt, Homo Sapiens; identical to SEQ ID NO: 69419

SEQ ID NO: 149388 - RNA, 63 nt, Homo Sapiens; identical to SEQ ID NO: 70466

SEQ ID NO: 149389 - RNA, 63 nt, Homo Sapiens; identical to SEQ ID NO: 70467

SEQ ID NO: 149390 - RNA, 63 nt, Homo Sapiens; identical to SEQ ID NO: 70468

SEQ ID NO: 149391 - RNA, 63 nt, Homo Sapiens; identical to SEQ ID NO: 70469

SEQ ID NO: 149392 - RNA, 63 nt, Homo Sapiens; identical to SEQ ID NO: 70470

SEQ ID NO: 149393 - RNA, 63 nt, Homo Sapiens; identical to SEQ ID NO: 70471

SEQ ID NO: 149394 - RNA, 63 nt, Homo Sapiens; identical to SEQ ID NO: 70472

SEQ ID NO: 149395 - RNA, 63 nt, Homo Sapiens; identical to SEQ ID NO: 70473

SEQ ID NO: 149396 - RNA, 63 nt, Homo Sapiens; identical to SEQ ID NO: 70474

SEQ ID NO: 149397 - RNA, 63 nt, Homo Sapiens; identical to SEQ ID NO: 70475

SEQ ID NO: 149398 - RNA, 63 nt, Homo Sapiens; identical to SEQ ID NO: 70476

SEQ ID NO: 149399 - RNA, 63 nt, Homo Sapiens; identical to SEQ ID NO: 70477

SEQ ID NO: 149400 - RNA, 63 nt, Homo Sapiens; identical to SEQ ID NO: 70478

SEQ ID NO: 149401 - RNA, 63 nt, Homo Sapiens; identical to SEQ ID NO: 70479

SEQ ID NO: 149402 - RNA, 63 nt, Homo Sapiens; identical to SEQ ID NO: 70480

SEQ ID NO: 149403 - RNA, 63 nt, Homo Sapiens; identical to SEQ ID NO: 70481

SEQ ID NO: 149404 - RNA, 63 nt, Homo Sapiens; identical to SEQ ID NO: 70482

SEQ ID NO: 149405 - RNA, 63 nt, Homo Sapiens; identical to SEQ ID NO: 70483

SEQ ID NO: 149406 - RNA, 63 nt, Homo Sapiens; identical to SEQ ID NO: 70484

SEQ ID NO: 149407 - RNA, 63 nt, Homo Sapiens; identical to SEQ ID NO: 70485

SEQ ID NO: 149408 - RNA, 63 nt, Homo Sapiens; identical to SEQ ID NO: 70486

SEQ ID NO: 149409 - RNA, 63 nt, Homo Sapiens; identical to SEQ ID NO: 70487

SEQ ID NO: 149410 - RNA, 63 nt, Homo Sapiens; identical to SEQ ID NO: 70488

SEQ ID NO: 149411 - RNA, 63 nt, Homo Sapiens; identical to SEQ ID NO: 70489

SEQ ID NO: 149412 - RNA, 59 nt, Homo Sapiens; identical to SEQ ID NO: 69444

SEQ ID NO: 149413 - RNA, 63 nt, Homo Sapiens; identical to SEQ ID NO: 70491

SEQ ID NO: 149414 - RNA, 63 nt, Homo Sapiens; identical to SEQ ID NO: 70492

SEQ ID NO: 149415 - RNA, 63 nt, Homo Sapiens; identical to SEQ ID NO: 70493

SEQ ID NO: 149416 - RNA, 63 nt, Homo Sapiens; identical to SEQ ID NO: 70494

SEQ ID NO: 149417 - RNA, 52 nt, Homo Sapiens; identical to SEQ ID NO: 69449

SEQ ID NO: 149418 - RNA, 63 nt, Homo Sapiens; identical to SEQ ID NO: 70496

SEQ ID NO: 149419 - RNA, 63 nt, Homo Sapiens; identical to SEQ ID NO: 70497

SEQ ID NO: 149420 - RNA, 63 nt, Homo Sapiens; identical to SEQ ID NO: 70498

SEQ ID NO: 149421 - RNA, 63 nt, Homo Sapiens; identical to SEQ ID NO: 70499

SEQ ID NO: 149422 - RNA, 63 nt, Homo Sapiens; identical to SEQ ID NO: 70500

SEQ ID NO: 149423 - RNA, 63 nt, Homo Sapiens; identical to SEQ ID NO: 70501

SEQ ID NO: 149424 - RNA, 63 nt, Homo Sapiens; identical to SEQ ID NO: 70502

SEQ ID NO: 149425 - RNA, 63 nt, Homo Sapiens; identical to SEQ ID NO: 70503

SEQ ID NO: 149426 - RNA, 63 nt, Homo Sapiens; identical to SEQ ID NO: 70504

SEQ ID NO: 149427 - RNA, 63 nt, Homo Sapiens; identical to SEQ ID NO: 70505

SEQ ID NO: 149428 - RNA, 63 nt, Homo Sapiens; identical to SEQ ID NO: 70506

SEQ ID NO: 149429 - RNA, 63 nt, Homo Sapiens; identical to SEQ ID NO: 70507

SEQ ID NO: 149430 - RNA, 63 nt, Homo Sapiens; identical to SEQ ID NO: 70508

SEQ ID NO: 149431 - RNA, 63 nt, Homo Sapiens; identical to SEQ ID NO: 70509

SEQ ID NO: 149432 - RNA, 63 nt, Homo Sapiens; identical to SEQ ID NO: 70510

SEQ ID NO: 149433 - RNA, 63 nt, Homo Sapiens; identical to SEQ ID NO: 70511

SEQ ID NO: 149434 - RNA, 63 nt, Homo Sapiens; identical to SEQ ID NO: 70512

SEQ ID NO: 149435 - RNA, 63 nt, Homo Sapiens; identical to SEQ ID NO: 70513

SEQ ID NO: 149436 - RNA, 63 nt, Homo Sapiens; identical to SEQ ID NO: 70514

SEQ ID NO: 149437 - RNA, 63 nt, Homo Sapiens; identical to SEQ ID NO: 70515

SEQ ID NO: 149438 - RNA, 63 nt, Homo Sapiens; identical to SEQ ID NO: 70516

SEQ ID NO: 149439 - RNA, 63 nt, Homo Sapiens; identical to SEQ ID NO: 70517

SEQ ID NO: 149440 - RNA, 63 nt, Homo Sapiens; identical to SEQ ID NO: 70518

SEQ ID NO: 149441 - RNA, 63 nt, Homo Sapiens; identical to SEQ ID NO: 70519

SEQ ID NO: 149442 - RNA, 63 nt, Homo Sapiens; identical to SEQ ID NO: 70520

SEQ ID NO: 149443 - RNA, 63 nt, Homo Sapiens; identical to SEQ ID NO: 70521

SEQ ID NO: 149444 - RNA, 63 nt, Homo Sapiens; identical to SEQ ID NO: 70522

SEQ ID NO: 149445 - RNA, 63 nt, Homo Sapiens; identical to SEQ ID NO: 70523

SEQ ID NO: 149446 - RNA, 63 nt, Homo Sapiens; identical to SEQ ID NO: 70524

SEQ ID NO: 149447 - RNA, 63 nt, Homo Sapiens; identical to SEQ ID NO: 70525

SEQ ID NO: 149448 - RNA, 63 nt, Homo Sapiens; identical to SEQ ID NO: 70526

SEQ ID NO: 149449 - RNA, 63 nt, Homo Sapiens; identical to SEQ ID NO: 70527

SEQ ID NO: 149450 - RNA, 63 nt, Homo Sapiens; identical to SEQ ID NO: 70528

SEQ ID NO: 149451 - RNA, 62 nt, Homo Sapiens; identical to SEQ ID NO: 70529

SEQ ID NO: 149452 - RNA, 63 nt, Homo Sapiens; identical to SEQ ID NO: 70530

SEQ ID NO: 149453 - RNA, 63 nt, Homo Sapiens; identical to SEQ ID NO: 70531

SEQ ID NO: 149454 - RNA, 63 nt, Homo Sapiens; identical to SEQ ID NO: 70532

SEQ ID NO: 149455 - RNA, 63 nt, Homo Sapiens; identical to SEQ ID NO: 70533

SEQ ID NO: 149456 - RNA, 63 nt, Homo Sapiens; identical to SEQ ID NO: 70534

SEQ ID NO: 149457 - RNA, 63 nt, Homo Sapiens; identical to SEQ ID NO: 70535

SEQ ID NO: 149458 - RNA, 63 nt, Homo Sapiens; identical to SEQ ID NO: 70536

SEQ ID NO: 149459 - RNA, 63 nt, Homo Sapiens; identical to SEQ ID NO: 70537

SEQ ID NO: 149460 - RNA, 63 nt, Homo Sapiens; identical to SEQ ID NO: 70538

SEQ ID NO: 149461 - RNA, 63 nt, Homo Sapiens; identical to SEQ ID NO: 70539

SEQ ID NO: 149462 - RNA, 63 nt, Homo Sapiens; identical to SEQ ID NO: 70540

SEQ ID NO: 149463 - RNA, 63 nt, Homo Sapiens; identical to SEQ ID NO: 70541

SEQ ID NO: 149464 - RNA, 63 nt, Homo Sapiens; identical to SEQ ID NO: 70542

SEQ ID NO: 149465 - RNA, 63 nt, Homo Sapiens; identical to SEQ ID NO: 70543

SEQ ID NO: 149466 - RNA, 63 nt, Homo Sapiens; identical to SEQ ID NO: 70544

SEQ ID NO: 149467 - RNA, 63 nt, Homo Sapiens; identical to SEQ ID NO: 70545

SEQ ID NO: 149468 - RNA, 63 nt, Homo Sapiens; identical to SEQ ID NO: 70546

SEQ ID NO: 149469 - RNA, 63 nt, Homo Sapiens; identical to SEQ ID NO: 70547

SEQ ID NO: 149470 - RNA, 63 nt, Homo Sapiens; identical to SEQ ID NO: 70548

SEQ ID NO: 149471 - RNA, 63 nt, Homo Sapiens; identical to SEQ ID NO: 70549

SEQ ID NO: 149472 - RNA, 63 nt, Homo Sapiens; identical to SEQ ID NO: 70550

SEQ ID NO: 149473 - RNA, 63 nt, Homo Sapiens; identical to SEQ ID NO: 70551

SEQ ID NO: 149474 - RNA, 63 nt, Homo Sapiens; identical to SEQ ID NO: 70552

SEQ ID NO: 149475 - RNA, 63 nt, Homo Sapiens; identical to SEQ ID NO: 70553

SEQ ID NO: 149476 - RNA, 63 nt, Homo Sapiens; identical to SEQ ID NO: 70554

SEQ ID NO: 149477 - RNA, 63 nt, Homo Sapiens; identical to SEQ ID NO: 70555

SEQ ID NO: 149478 - RNA, 63 nt, Homo Sapiens; identical to SEQ ID NO: 70556

SEQ ID NO: 149479 - RNA, 63 nt, Homo Sapiens; identical to SEQ ID NO: 70557

SEQ ID NO: 149480 - RNA, 63 nt, Homo Sapiens; identical to SEQ ID NO: 70558

SEQ ID NO: 149481 - RNA, 63 nt, Homo Sapiens; identical to SEQ ID NO: 70559

SEQ ID NO: 149482 - RNA, 63 nt, Homo Sapiens; identical to SEQ ID NO: 70560

SEQ ID NO: 149483 - RNA, 63 nt, Homo Sapiens; identical to SEQ ID NO: 70561

SEQ ID NO: 149484 - RNA, 63 nt, Homo Sapiens; identical to SEQ ID NO: 70562

SEQ ID NO: 149485 - RNA, 63 nt, Homo Sapiens; identical to SEQ ID NO: 70563

SEQ ID NO: 149486 - RNA, 63 nt, Homo Sapiens; identical to SEQ ID NO: 70564

SEQ ID NO: 149487 - RNA, 63 nt, Homo Sapiens; identical to SEQ ID NO: 70565

SEQ ID NO: 149488 - RNA, 63 nt, Homo Sapiens; identical to SEQ ID NO: 70566

SEQ ID NO: 149489 - RNA, 63 nt, Homo Sapiens; identical to SEQ ID NO: 70567

SEQ ID NO: 149490 - RNA, 63 nt, Homo Sapiens; identical to SEQ ID NO: 70568

SEQ ID NO: 149491 - RNA, 63 nt, Homo Sapiens; identical to SEQ ID NO: 70569

SEQ ID NO: 149492 - RNA, 63 nt, Homo Sapiens; identical to SEQ ID NO: 70570

SEQ ID NO: 149493 - RNA, 63 nt, Homo Sapiens; identical to SEQ ID NO: 70571

SEQ ID NO: 149494 - RNA, 63 nt, Homo Sapiens; identical to SEQ ID NO: 70572

SEQ ID NO: 149495 - RNA, 63 nt, Homo Sapiens; identical to SEQ ID NO: 70573

SEQ ID NO: 149496 - RNA, 63 nt, Homo Sapiens; identical to SEQ ID NO: 70574

SEQ ID NO: 149497 - RNA, 63 nt, Homo Sapiens; identical to SEQ ID NO: 70575

SEQ ID NO: 149498 - RNA, 63 nt, Homo Sapiens; identical to SEQ ID NO: 70576

SEQ ID NO: 149499 - RNA, 63 nt, Homo Sapiens; identical to SEQ ID NO: 70577

SEQ ID NO: 149500 - RNA, 63 nt, Homo Sapiens; identical to SEQ ID NO: 70578

SEQ ID NO: 149501 - RNA, 63 nt, Homo Sapiens; identical to SEQ ID NO: 70579

SEQ ID NO: 149502 - RNA, 63 nt, Homo Sapiens; identical to SEQ ID NO: 70580

SEQ ID NO: 149503 - RNA, 63 nt, Homo Sapiens; identical to SEQ ID NO: 70581

SEQ ID NO: 149504 - RNA, 63 nt, Homo Sapiens; identical to SEQ ID NO: 70582

SEQ ID NO: 149505 - RNA, 63 nt, Homo Sapiens; identical to SEQ ID NO: 70583

SEQ ID NO: 149506 - RNA, 63 nt, Homo Sapiens; identical to SEQ ID NO: 70584

SEQ ID NO: 149507 - RNA, 63 nt, Homo Sapiens; identical to SEQ ID NO: 70585

SEQ ID NO: 149508 - RNA, 63 nt, Homo Sapiens; identical to SEQ ID NO: 70586

SEQ ID NO: 149509 - RNA, 60 nt, Homo Sapiens; identical to SEQ ID NO: 69541

SEQ ID NO: 149510 - RNA, 63 nt, Homo Sapiens; identical to SEQ ID NO: 70588

SEQ ID NO: 149511 - RNA, 63 nt, Homo Sapiens; identical to SEQ ID NO: 70589

SEQ ID NO: 149512 - RNA, 63 nt, Homo Sapiens; identical to SEQ ID NO: 70590

SEQ ID NO: 149513 - RNA, 63 nt, Homo Sapiens; identical to SEQ ID NO: 70591

SEQ ID NO: 149514 - RNA, 63 nt, Homo Sapiens; identical to SEQ ID NO: 70592

SEQ ID NO: 149515 - RNA, 63 nt, Homo Sapiens; identical to SEQ ID NO: 70593

SEQ ID NO: 149516 - RNA, 63 nt, Homo Sapiens; identical to SEQ ID NO: 70594

SEQ ID NO: 149517 - RNA, 63 nt, Homo Sapiens; identical to SEQ ID NO: 70595

SEQ ID NO: 149518 - RNA, 63 nt, Homo Sapiens; identical to SEQ ID NO: 70596

SEQ ID NO: 149519 - RNA, 63 nt, Homo Sapiens; identical to SEQ ID NO: 70597

SEQ ID NO: 149520 - RNA, 63 nt, Homo Sapiens; identical to SEQ ID NO: 70598

SEQ ID NO: 149521 - RNA, 63 nt, Homo Sapiens; identical to SEQ ID NO: 70599

SEQ ID NO: 149522 - RNA, 63 nt, Homo Sapiens; identical to SEQ ID NO: 70600

SEQ ID NO: 149523 - RNA, 63 nt, Homo Sapiens; identical to SEQ ID NO: 70601

SEQ ID NO: 149524 - RNA, 63 nt, Homo Sapiens; identical to SEQ ID NO: 70602

SEQ ID NO: 149525 - RNA, 63 nt, Homo Sapiens; identical to SEQ ID NO: 70603

SEQ ID NO: 149526 - RNA, 63 nt, Homo Sapiens; identical to SEQ ID NO: 70604

SEQ ID NO: 149527 - RNA, 63 nt, Homo Sapiens; identical to SEQ ID NO: 70605

SEQ ID NO: 149528 - RNA, 63 nt, Homo Sapiens; identical to SEQ ID NO: 70606

SEQ ID NO: 149529 - RNA, 63 nt, Homo Sapiens; identical to SEQ ID NO: 70607

SEQ ID NO: 149530 - RNA, 63 nt, Homo Sapiens; identical to SEQ ID NO: 70608

SEQ ID NO: 149531 - RNA, 63 nt, Homo Sapiens; identical to SEQ ID NO: 70609

SEQ ID NO: 149532 - RNA, 63 nt, Homo Sapiens; identical to SEQ ID NO: 70610

SEQ ID NO: 149533 - RNA, 63 nt, Homo Sapiens; identical to SEQ ID NO: 70611

SEQ ID NO: 149534 - RNA, 63 nt, Homo Sapiens; identical to SEQ ID NO: 70612

SEQ ID NO: 149535 - RNA, 63 nt, Homo Sapiens; identical to SEQ ID NO: 70613

SEQ ID NO: 149536 - RNA, 63 nt, Homo Sapiens; identical to SEQ ID NO: 70614

SEQ ID NO: 149537 - RNA, 63 nt, Homo Sapiens; identical to SEQ ID NO: 70615

SEQ ID NO: 149538 - RNA, 60 nt, Homo Sapiens; identical to SEQ ID NO: 69570

SEQ ID NO: 149539 - RNA, 63 nt, Homo Sapiens; identical to SEQ ID NO: 70617

SEQ ID NO: 149540 - RNA, 63 nt, Homo Sapiens; identical to SEQ ID NO: 70618

SEQ ID NO: 149541 - RNA, 63 nt, Homo Sapiens; identical to SEQ ID NO: 70619

SEQ ID NO: 149542 - RNA, 63 nt, Homo Sapiens; identical to SEQ ID NO: 70620

SEQ ID NO: 149543 - RNA, 63 nt, Homo Sapiens; identical to SEQ ID NO: 70621

SEQ ID NO: 149544 - RNA, 63 nt, Homo Sapiens; identical to SEQ ID NO: 70622

SEQ ID NO: 149545 - RNA, 62 nt, Homo Sapiens; identical to SEQ ID NO: 70100

SEQ ID NO: 149546 - RNA, 63 nt, Homo Sapiens; identical to SEQ ID NO: 70624

SEQ ID NO: 149547 - RNA, 63 nt, Homo Sapiens; identical to SEQ ID NO: 70625

SEQ ID NO: 149548 - RNA, 63 nt, Homo Sapiens; identical to SEQ ID NO: 70626

SEQ ID NO: 149549 - RNA, 63 nt, Homo Sapiens; identical to SEQ ID NO: 70627

SEQ ID NO: 149550 - RNA, 63 nt, Homo Sapiens; identical to SEQ ID NO: 70628

SEQ ID NO: 149551 - RNA, 63 nt, Homo Sapiens; identical to SEQ ID NO: 70629

SEQ ID NO: 149552 - RNA, 63 nt, Homo Sapiens; identical to SEQ ID NO: 70630

SEQ ID NO: 149553 - RNA, 63 nt, Homo Sapiens; identical to SEQ ID NO: 70631

SEQ ID NO: 149554 - RNA, 63 nt, Homo Sapiens; identical to SEQ ID NO: 70632

SEQ ID NO: 149555 - RNA, 63 nt, Homo Sapiens; identical to SEQ ID NO: 70633

SEQ ID NO: 149556 - RNA, 63 nt, Homo Sapiens; identical to SEQ ID NO: 70634

SEQ ID NO: 149557 - RNA, 63 nt, Homo Sapiens; identical to SEQ ID NO: 70635

SEQ ID NO: 149558 - RNA, 63 nt, Homo Sapiens; identical to SEQ ID NO: 70636

SEQ ID NO: 149559 - RNA, 63 nt, Homo Sapiens; identical to SEQ ID NO: 70637

SEQ ID NO: 149560 - RNA, 63 nt, Homo Sapiens; identical to SEQ ID NO: 70638

SEQ ID NO: 149561 - RNA, 63 nt, Homo Sapiens; identical to SEQ ID NO: 70639

SEQ ID NO: 149562 - RNA, 63 nt, Homo Sapiens; identical to SEQ ID NO: 70640

SEQ ID NO: 149563 - RNA, 63 nt, Homo Sapiens; identical to SEQ ID NO: 70641

SEQ ID NO: 149564 - RNA, 63 nt, Homo Sapiens; identical to SEQ ID NO: 70642

SEQ ID NO: 149565 - RNA, 63 nt, Homo Sapiens; identical to SEQ ID NO: 70643

SEQ ID NO: 149566 - RNA, 63 nt, Homo Sapiens; identical to SEQ ID NO: 70644

SEQ ID NO: 149567 - RNA, 63 nt, Homo Sapiens; identical to SEQ ID NO: 70645

SEQ ID NO: 149568 - RNA, 63 nt, Homo Sapiens; identical to SEQ ID NO: 70646

SEQ ID NO: 149569 - RNA, 63 nt, Homo Sapiens; identical to SEQ ID NO: 70647

SEQ ID NO: 149570 - RNA, 63 nt, Homo Sapiens; identical to SEQ ID NO: 70648

SEQ ID NO: 149571 - RNA, 63 nt, Homo Sapiens; identical to SEQ ID NO: 70649

SEQ ID NO: 149572 - RNA, 63 nt, Homo Sapiens; identical to SEQ ID NO: 70650

SEQ ID NO: 149573 - RNA, 63 nt, Homo Sapiens; identical to SEQ ID NO: 70651

SEQ ID NO: 149574 - RNA, 63 nt, Homo Sapiens; identical to SEQ ID NO: 70652

SEQ ID NO: 149575 - RNA, 63 nt, Homo Sapiens; identical to SEQ ID NO: 70653

SEQ ID NO: 149576 - RNA, 63 nt, Homo Sapiens; identical to SEQ ID NO: 70654

SEQ ID NO: 149577 - RNA, 63 nt, Homo Sapiens; identical to SEQ ID NO: 70655

SEQ ID NO: 149578 - RNA, 63 nt, Homo Sapiens; identical to SEQ ID NO: 70656

SEQ ID NO: 149579 - RNA, 63 nt, Homo Sapiens; identical to SEQ ID NO: 70657

SEQ ID NO: 149580 - RNA, 63 nt, Homo Sapiens; identical to SEQ ID NO: 70658

SEQ ID NO: 149581 - RNA, 63 nt, Homo Sapiens; identical to SEQ ID NO: 70659

SEQ ID NO: 149582 - RNA, 63 nt, Homo Sapiens; identical to SEQ ID NO: 70660

SEQ ID NO: 149583 - RNA, 63 nt, Homo Sapiens; identical to SEQ ID NO: 70661

SEQ ID NO: 149584 - RNA, 63 nt, Homo Sapiens; identical to SEQ ID NO: 70662

SEQ ID NO: 149585 - RNA, 63 nt, Homo Sapiens; identical to SEQ ID NO: 70663

SEQ ID NO: 149586 - RNA, 63 nt, Homo Sapiens; identical to SEQ ID NO: 70664

SEQ ID NO: 149587 - RNA, 63 nt, Homo Sapiens; identical to SEQ ID NO: 70665

SEQ ID NO: 149588 - RNA, 63 nt, Homo Sapiens; identical to SEQ ID NO: 70666

SEQ ID NO: 149589 - RNA, 63 nt, Homo Sapiens; identical to SEQ ID NO: 70667

SEQ ID NO: 149590 - RNA, 63 nt, Homo Sapiens; identical to SEQ ID NO: 70668

SEQ ID NO: 149591 - RNA, 63 nt, Homo Sapiens; identical to SEQ ID NO: 70669

SEQ ID NO: 149592 - RNA, 63 nt, Homo Sapiens; identical to SEQ ID NO: 70670

SEQ ID NO: 149593 - RNA, 63 nt, Homo Sapiens; identical to SEQ ID NO: 70671

SEQ ID NO: 149594 - RNA, 63 nt, Homo Sapiens; identical to SEQ ID NO: 70672

SEQ ID NO: 149595 - RNA, 63 nt, Homo Sapiens; identical to SEQ ID NO: 70673

SEQ ID NO: 149596 - RNA, 63 nt, Homo Sapiens; identical to SEQ ID NO: 70674

SEQ ID NO: 149597 - RNA, 63 nt, Homo Sapiens; identical to SEQ ID NO: 70675

SEQ ID NO: 149598 - RNA, 63 nt, Homo Sapiens; identical to SEQ ID NO: 70676

SEQ ID NO: 149599 - RNA, 63 nt, Homo Sapiens; identical to SEQ ID NO: 70677

SEQ ID NO: 149600 - RNA, 63 nt, Homo Sapiens; identical to SEQ ID NO: 70678

SEQ ID NO: 149601 - RNA, 63 nt, Homo Sapiens; identical to SEQ ID NO: 70679

SEQ ID NO: 149602 - RNA, 63 nt, Homo Sapiens; identical to SEQ ID NO: 70680

SEQ ID NO: 149603 - RNA, 63 nt, Homo Sapiens; identical to SEQ ID NO: 70681

SEQ ID NO: 149604 - RNA, 63 nt, Homo Sapiens; identical to SEQ ID NO: 70682

SEQ ID NO: 149605 - RNA, 63 nt, Homo Sapiens; identical to SEQ ID NO: 70683

SEQ ID NO: 149606 - RNA, 63 nt, Homo Sapiens; identical to SEQ ID NO: 70684

SEQ ID NO: 149607 - RNA, 63 nt, Homo Sapiens; identical to SEQ ID NO: 70685

SEQ ID NO: 149608 - RNA, 63 nt, Homo Sapiens; identical to SEQ ID NO: 70686

SEQ ID NO: 149609 - RNA, 63 nt, Homo Sapiens; identical to SEQ ID NO: 70687

SEQ ID NO: 149610 - RNA, 63 nt, Homo Sapiens; identical to SEQ ID NO: 70688

SEQ ID NO: 149611 - RNA, 63 nt, Homo Sapiens; identical to SEQ ID NO: 70689

SEQ ID NO: 149612 - RNA, 63 nt, Homo Sapiens; identical to SEQ ID NO: 70690

SEQ ID NO: 149613 - RNA, 63 nt, Homo Sapiens; identical to SEQ ID NO: 70691

SEQ ID NO: 149614 - RNA, 63 nt, Homo Sapiens; identical to SEQ ID NO: 70692

SEQ ID NO: 149615 - RNA, 63 nt, Homo Sapiens; identical to SEQ ID NO: 70693

SEQ ID NO: 149616 - RNA, 63 nt, Homo Sapiens; identical to SEQ ID NO: 70694

SEQ ID NO: 149617 - RNA, 63 nt, Homo Sapiens; identical to SEQ ID NO: 70695

SEQ ID NO: 149618 - RNA, 63 nt, Homo Sapiens; identical to SEQ ID NO: 70696

SEQ ID NO: 149619 - RNA, 63 nt, Homo Sapiens; identical to SEQ ID NO: 70697

SEQ ID NO: 149620 - RNA, 63 nt, Homo Sapiens; identical to SEQ ID NO: 70698

SEQ ID NO: 149621 - RNA, 62 nt, Homo Sapiens
ggcaacugucacgugugcuagaagguucgaugccucuggaaugcaugugauacucaucucca

SEQ ID NO: 149622 - RNA, 62 nt, Homo Sapiens
cucaccuggcagccguccaguacugcuggcuuccucuggaggcccagccacaggcugggguu

SEQ ID NO: 149623 - RNA, 62 nt, Homo Sapiens
ccucccagguucgcgccauucaccugccucagccucuggaguagcugagacuacaggcgccc

SEQ ID NO: 149624 - RNA, 62 nt, Homo Sapiens
caggacacagggauggauaccaccuacccucgccucuggaauggccuacccaacccgagaag

SEQ ID NO: 149625 - RNA, 62 nt, Homo Sapiens
uucucucugcaggaggagagaacgcugccucuccucuggauuggucucaggcucucuguugg

SEQ ID NO: 149626 - RNA, 62 nt, Homo Sapiens
ggucucacuggaccaucaggacugcugccgccccucuggagagagcagcuuuuuauuugucu

SEQ ID NO: 149627 - RNA, 62 nt, Homo Sapiens
gguacggcggcccugcaucagccugcggguggccucuggauccuccguggaccgaaccgucc

SEQ ID NO: 149628 - RNA, 62 nt, Homo Sapiens
gcugugacagaggugccuguucugacuuagaaccucuggaggaggaggggggugccuugguc

SEQ ID NO: 149629 - RNA, 62 nt, Homo Sapiens
aagaaaccaaagucugccgcccaccucgcuccccucuggaaucuuccccaagggccaaaccc

SEQ ID NO: 149630 - RNA, 62 nt, Homo Sapiens
caucuccugacccucccacucccaucuccuuaccucuggaaccccccaggcccuacaaugcu

SEQ ID NO: 149631 - RNA, 62 nt, Homo Sapiens
uggaaacacacuggaaccucaugauaauugacccucuggaucaccagauuaguuuaauuuaa

SEQ ID NO: 149632 - RNA, 62 nt, Homo Sapiens
ccccagcugaucagugccaggagagaccagagccucuggaggcuacccaggggaccacacca

SEQ ID NO: 149633 - RNA, 62 nt, Homo Sapiens
agcucuggcccugcaccuacucucacuggccaccucuggaggcucugccuuucccaagggcc

SEQ ID NO: 149634 - RNA, 62 nt, Homo Sapiens
gaggggcaguguuagagcagggcuggucauacccucuggaguucagaggaagagguaggacc

SEQ ID NO: 149635 - RNA, 62 nt, Homo Sapiens
accugcuccgcccccuucccuggagggagcacccucuggacagacagaaccaucugaggcuc

SEQ ID NO: 149636 - RNA, 62 nt, Homo Sapiens
auggaauaaagggcuuagggacuucccugaggccucuggacccaucugucuuccugagggca

SEQ ID NO: 149637 - RNA, 62 nt, Homo Sapiens
guauccaugcucuguggccaggugccugccacccucuggaacucacaaaagcuggcuuuuau

SEQ ID NO: 149638 - RNA, 53 nt, Homo Sapiens
uacagacgcaggcuugcugagggccucuggacacaggcuggaccagaugcugu

SEQ ID NO: 149639 - RNA, 62 nt, Homo Sapiens
aacccuguuucaaauccacugccaauucagcuccucuggaguggagcuuucugauuucuugg

SEQ ID NO: 149640 - RNA, 62 nt, Homo Sapiens
aggugugcagccugagagacgggaagaggaggccucuggaccugcuggucugcacugacagc

SEQ ID NO: 149641 - RNA, 62 nt, Homo Sapiens
agcgaccccaccugccauuaccuucagggccuccucuggaagagaacccauucucagagugc

SEQ ID NO: 149642 - RNA, 62 nt, Homo Sapiens
agguuugggggcucagaugggacaagaagccgccucuggacuaucuccccagaccagcagcc

SEQ ID NO: 149643 - RNA, 62 nt, Homo Sapiens
ugugagccaggacauucuuccagcaagguuggccucuggauggugaacgggcugugcaaaaa

SEQ ID NO: 149644 - RNA, 62 nt, Homo Sapiens
gccggacuuagggcuucaagaggcgggcgugcccucuggaguccccuaccaugacugaaggc

SEQ ID NO: 149645 - RNA, 62 nt, Homo Sapiens
agaggcaggcauagaggcuucuccgccagccuccucuggacggcaggcucacugccaggcca

SEQ ID NO: 149646 - RNA, 62 nt, Homo Sapiens
ccuugccacaucugugucucuggaacccaggaccucuggaccucagguuccuaagacuucag

SEQ ID NO: 149647 - RNA, 62 nt, Homo Sapiens
ccuuugacaauauuuuucgguaagaaguaaaaccucuggagaccuaucuuuaagaucucuaa

SEQ ID NO: 149648 - RNA, 62 nt, Homo Sapiens
accaucgccccacuggucuagccaucaugacaccucuggaggugucaagcuccugaaacaag

SEQ ID NO: 149649 - RNA, 62 nt, Homo Sapiens
aguugccaagguagagagcugcccgcuccugcccucuggaugacauaggggacaucaacaag

SEQ ID NO: 149650 - RNA, 62 nt, Homo Sapiens
ucuagugagguaguauugaagccucggcuuucccucuggagccugggacccuguuuacaguu

SEQ ID NO: 149651 - RNA, 62 nt, Homo Sapiens
aacagcaggauguugaauugaucaucagaugcccucuggaaugguuagcauccaaggugaca

SEQ ID NO: 149652 - RNA, 62 nt, Homo Sapiens
uaaggcuagauccuucccauaguaucaucuguccucuggaaugacucuccugucccuaaagg

SEQ ID NO: 149653 - RNA, 62 nt, Homo Sapiens
aaagggguuaagagagagaucaccuagaaaucccucuggacacuuguggguucuuuaggguu

SEQ ID NO: 149654 - RNA, 62 nt, Homo Sapiens
cuuucuuggugucuguccuuugcccccugugcccucuggauucucugggucuauguaggccc

SEQ ID NO: 149655 - RNA, 62 nt, Homo Sapiens
agacgagacugagguuaaacaucagaaaaaaaccucuggaaugaccuuccucauuccaggag

SEQ ID NO: 149656 - RNA, 62 nt, Homo Sapiens
uuaagcagcgccagugacagucagggaaggugccucuggaugcugugaagagucuacagaga

SEQ ID NO: 149657 - RNA, 62 nt, Homo Sapiens
cuugacugcuuucuucccccacuuucauguccccucuggauuguccaguguaaugcauggca

SEQ ID NO: 149658 - RNA, 62 nt, Homo Sapiens
uaugauugcuguuagccaugucuauuguuuuuccucuggauucuuuucuuauaacuuggaau

SEQ ID NO: 149659 - RNA, 62 nt, Homo Sapiens
uuccuguuguucauacuuuucgcauggagccgccucuggagccuucuacugagcccagcgcc

SEQ ID NO: 149660 - RNA, 62 nt, Homo Sapiens
cagagggaacaaggugggagccccugagcaucccucuggacucccucccugggccuccauca

SEQ ID NO: 149661 - RNA, 62 nt, Homo Sapiens
uugagaccacuggaggcacaccaccaaggggcccucuggaacgcggacaucaagggcggaca

SEQ ID NO: 149662 - RNA, 62 nt, Homo Sapiens
cucauaggguugugaggcaacacaucuugugcccucuggaagggauauggucauuuacaaga

SEQ ID NO: 149663 - RNA, 62 nt, Homo Sapiens
ucugguucucaggagucugcacacacccaaagccucuggacugaaggcacuggaaucacucc

SEQ ID NO: 149664 - RNA, 62 nt, Homo Sapiens
gggcagaagaaagaaauaaacuacccauuuggccucuggaggcagaaggcaaaggaaccacc

SEQ ID NO: 149665 - RNA, 62 nt, Homo Sapiens
gagaagucacacagacaaucuaaaaaagucuuccucuggaaagcuuuccuagaauuuaaaaa

SEQ ID NO: 149666 - RNA, 62 nt, Homo Sapiens
gagaggcuccacccacuacaaagcagaggccuccucuggagucaucuccuucccuccucaag

SEQ ID NO: 149667 - RNA, 62 nt, Homo Sapiens
gaaacaugugaguaagugagcugugagcagucccucuggaaagcauaggcucuuuuugcugc

SEQ ID NO: 149668 - RNA, 62 nt, Homo Sapiens
agugguuccugcaguguagacuccauucuugcccucuggagaaugauggacaggucccccuc

SEQ ID NO: 149669 - RNA, 62 nt, Homo Sapiens
aaggaucauacagguguuauacaccauccaucccucuggacaggccccuuuccccauucuca

SEQ ID NO: 149670 - RNA, 56 nt, Homo Sapiens
ucuugggggguguuggggaggaacucccucuggaauggccuguccgggggcacuga

SEQ ID NO: 149671 - RNA, 62 nt, Homo Sapiens
aaccagcacuugcccccuuguucuccucaaggccucuggagccaccuggucugccccuagau

SEQ ID NO: 149672 - RNA, 62 nt, Homo Sapiens
ccucauuuucuccauggggacaaggcaggaaaccucuggagaggggguugguggauauuggg

SEQ ID NO: 149673 - RNA, 62 nt, Homo Sapiens
cugaguuacaaccaccaauaggcugaauucucccucuggaaaaauugugaucuaggcugcug

SEQ ID NO: 149674 - RNA, 62 nt, Homo Sapiens
uuacacuguucugggguuugucccaucacccaccucuggagccuucucacuuuggggacugu

SEQ ID NO: 149675 - RNA, 62 nt, Homo Sapiens
gcaccagaggcugcagaaggcuuccagagaguccucuggaugcuuggaccucugcucugagg

SEQ ID NO: 149676 - RNA, 62 nt, Homo Sapiens
uuccucuugaauguacaugaauguccccaagaccucuggaguccaacacucucccagcuccc

SEQ ID NO: 149677 - RNA, 62 nt, Homo Sapiens
aggugggcacuggauuaguuugcccugcccacccucuggagaucaagacccuuuuggguuuc

SEQ ID NO: 149678 - RNA, 62 nt, Homo Sapiens
cuaaacccugucuggauuucacccgcucucugccucuggaggccuuugcaucugggccuggc

SEQ ID NO: 149679 - RNA, 62 nt, Homo Sapiens
gcccugauucuacuccaguccugggggccuggccucuggagaagccaagaauggggccuggg

SEQ ID NO: 149680 - RNA, 62 nt, Homo Sapiens
agguccuuucuccaucccacccacuuaucuguccucuggauccuuucccggagauggggugg

SEQ ID NO: 149681 - RNA, 62 nt, Homo Sapiens
ugggauuaaacagauacccaccugcaugcccuccucuggaaccccccacuucuucccuccag

SEQ ID NO: 149682 - RNA, 62 nt, Homo Sapiens
caccuugagaagggggagcuacuccagaauggccucuggacuagggccugguacccaggccc

SEQ ID NO: 149683 - RNA, 62 nt, Homo Sapiens
gaacuguuugcaguuguaugucaggcgugaauccucuggaagcugaugacccucugcgguug

SEQ ID NO: 149684 - RNA, 62 nt, Homo Sapiens
cagccugacaccaaggacagagauggacacugccucuggagcgaggacuagaggugaagagg

SEQ ID NO: 149685 - RNA, 62 nt, Homo Sapiens
gcauuccccauccaucacuccuugcuagguagccucuggaaagcugcagaugcuacugacug

SEQ ID NO: 149686 - RNA, 62 nt, Homo Sapiens
cugaacuuggguugguugugcugcugucucuuccucuggagacagggagaguaagacaugcu

SEQ ID NO: 149687 - RNA, 62 nt, Homo Sapiens
cuguggucagucauuugaaagccaucauguggccucuggacaucuucauucuuucucacuuu

SEQ ID NO: 149688 - RNA, 62 nt, Homo Sapiens
ccaccuuggaccucagugacggggcccagccuccucuggacucuguguggacuucaucucaa

SEQ ID NO: 149689 - RNA, 62 nt, Homo Sapiens
uuuuucaucuuuuccuccacuuuuuccuccucccucuggacuuuaacaccagccugggcuug

SEQ ID NO: 149690 - RNA, 62 nt, Homo Sapiens
uaagcguucccacucgcagacuguucucuugcccucuggaccaggccccugugaucccaguu

SEQ ID NO: 149691 - RNA, 62 nt, Homo Sapiens
aaaguaggcaggaccaugggcuccuuuuucucccucuggaucacacagaaacucuuuuuggg

SEQ ID NO: 149692 - RNA, 62 nt, Homo Sapiens
cugagccuugcccgugcauaccccugcccacuccucuggagagaucagacagccccuaccua

SEQ ID NO: 149693 - RNA, 62 nt, Homo Sapiens
uauagugacuuuugggcuaggucaacucugggccucuggagcgggggcguuggggagccaaa

SEQ ID NO: 149694 - RNA, 62 nt, Homo Sapiens
gacaggauggaccuggucagggaugcacagggccucuggagguguggcuugcugccugggag

SEQ ID NO: 149695 - RNA, 62 nt, Homo Sapiens
aaggagguaccucacaggugggugugaggcccccucuggaguuucuggccauucacuuaccc

SEQ ID NO: 149696 - RNA, 62 nt, Homo Sapiens
cccauccuuugcuuccucaagcucccugccaaccucuggauacaucaaugggaaggaaacca

SEQ ID NO: 149697 - RNA, 60 nt, Homo Sapiens
cgaggugcccuugcaggugaccgggcgccgccucuggaagaacguguacgacgagcuggg

SEQ ID NO: 149698 - RNA, 62 nt, Homo Sapiens
uccaguccugaguuugcuacuuacuucuguggccucuggaaccuuauccaaccucuuggugc

SEQ ID NO: 149699 - RNA, 62 nt, Homo Sapiens
cucugaggaguucccuggggacaacugagcagccucuggagaggggccauuaauaaagcuca

SEQ ID NO: 149700 - RNA, 62 nt, Homo Sapiens
cacaccgccgcugcagcuugggccccauccgcccucuggaccuguguagggccucacugcug

SEQ ID NO: 149701 - RNA, 62 nt, Homo Sapiens
uuuuuuagacuggaaaaaagccagucuaaaggccucuggauacugggcuccccagaacugcu

SEQ ID NO: 149702 - RNA, 62 nt, Homo Sapiens
uaggaagggggcagggacgugaccuugacuuaccucuggaaagggucccagccuagacugcu

SEQ ID NO: 149703 - RNA, 62 nt, Homo Sapiens
ccgggcaagcacuaccaggcugugggucugcaccucuggaagguaacucagccccgucuggc

SEQ ID NO: 149704 - RNA, 62 nt, Homo Sapiens
aggguuagaagagacuuuuuacuuauuagaauccucuggauguaaucucuuugguaccuaua

SEQ ID NO: 149705 - RNA, 62 nt, Homo Sapiens
uaagacauaacaguaacacgauaacauuuuuuccucuggacaaguaagagcaaaucuguaug

SEQ ID NO: 149706 - RNA, 62 nt, Homo Sapiens
ccuugcgcagagcuuacuuuuuuugucugcucccucuggaagggauguucaguuuagaacca

SEQ ID NO: 149707 - RNA, 62 nt, Homo Sapiens
uggagagaagggcgugccacucuuagcagcagccucuggacuggaagcccucuuggaaaagu

SEQ ID NO: 149708 - RNA, 62 nt, Homo Sapiens
aguggcauggcuuauaauccuguaacuuucuuccucuggaucgacugaaaaucuccacuaca

SEQ ID NO: 149709 - RNA, 62 nt, Homo Sapiens
cccuuuggaggcaucagguucuggaagggggcccucuggauuuccugccucaacuggggcug

SEQ ID NO: 149710 - RNA, 62 nt, Homo Sapiens
aagaugaacgucaccaaugggaaugguauauuccucuggaaauuuuccccuaaguccuaaca

SEQ ID NO: 149711 - RNA, 62 nt, Homo Sapiens
auagccaagaccaggagaagggugguucaaauccucuggaacccugagcacaggccgaugga

SEQ ID NO: 149712 - RNA, 62 nt, Homo Sapiens
uuuuaaagggacauuuuccugcugcucaguaaccucuggaguugcaauacaagcuaauucua

SEQ ID NO: 149713 - RNA, 62 nt, Homo Sapiens
uucauguuaugccuguugcacaauccaaauucccucuggaguguuuaugugaacauuccuau

SEQ ID NO: 149714 - RNA, 62 nt, Homo Sapiens
gagaggaaggaaggauuggaucagccuggcagccucuggacaccaccuggacgguggccccc

SEQ ID NO: 149715 - RNA, 62 nt, Homo Sapiens
caguggaccaagaugcagcaccccaugggugaccucuggagggaagccagguggccugugcu

SEQ ID NO: 149716 - RNA, 62 nt, Homo Sapiens
gccaaauauauuuccugauaacauuauguggcccucuggauccagccaugccugaggucuac

SEQ ID NO: 149717 - RNA, 62 nt, Homo Sapiens
accugguucccugccucuguauucagguguggccucuggaaccugacuccguuaggacgaac

SEQ ID NO: 149718 - RNA, 62 nt, Homo Sapiens
gagacacgcgaccauguuggggcucuuggacuccucuggaugacccguccccaaaguugaca

SEQ ID NO: 149719 - RNA, 62 nt, Homo Sapiens
ugcagagaggaggacguguacuccaggcgaggccucuggaccuguguuccugugccaaaguc

SEQ ID NO: 149720 - RNA, 62 nt, Homo Sapiens
cuuugccacucgccggagcaucaaugccgcugccucuggaggagcccuuggauuuucuccau

SEQ ID NO: 149721 - RNA, 62 nt, Homo Sapiens
gucaucaagaugcacagcauggaacacaagcuccucuggauccugcagcuggugacauggaa

SEQ ID NO: 149722 - RNA, 62 nt, Homo Sapiens
uugugcucugcccacaaacaggcgucccuuucccucuggauaacaguaagugcccaguaacu

SEQ ID NO: 149723 - RNA, 62 nt, Homo Sapiens
agaagcauuugugguaguaaaggaaaaccaacccucuggaaaauacauuuugagaaucucaa

SEQ ID NO: 149724 - RNA, 62 nt, Homo Sapiens
guggccuauggagagacaggccuuucucucagccucuggaagccaccugcucuuuugcucua

SEQ ID NO: 149725 - RNA, 62 nt, Homo Sapiens
uccucuccaagcccuccucugaaccagcuaucccucuggaaugcagcugaccaaacaaauuc

SEQ ID NO: 149726 - RNA, 62 nt, Homo Sapiens
guugaguauggguuagaaauuuaaaacaguauccucuggauaaucaguuuacaauaauguuc

SEQ ID NO: 149727 - RNA, 62 nt, Homo Sapiens
uuggcagaccacuuuucggugaaaauguggcuccucuggagcaacgugagccuggaagagga

SEQ ID NO: 149728 - RNA, 62 nt, Homo Sapiens
cuaccacaugcaaacauacaaacugaagauuuccucuggaaggauaugaaccugaagauuaa

SEQ ID NO: 149729 - RNA, 62 nt, Homo Sapiens
ucaucugaggugagaccaccacagugcauguaccucuggaugguggguucccuuggucagca

SEQ ID NO: 149730 - RNA, 62 nt, Homo Sapiens
ugcagggcacccuugagaagcccaagacugcaccucuggaggucugaacaugcuacauccug

SEQ ID NO: 149731 - RNA, 62 nt, Homo Sapiens
gcagaggacucacucagcucguauuucuugguccucuggagaagugggucugugucacacag

SEQ ID NO: 149732 - RNA, 62 nt, Homo Sapiens
agguggcuccacgaugccuuauuguggcucccccucuggaggugcuccuucgggguccugag

SEQ ID NO: 149733 - RNA, 62 nt, Homo Sapiens
ccaggccccaacacagccccggcccagcagugccucuggagcccugaugccaagggguaaug

SEQ ID NO: 149734 - RNA, 62 nt, Homo Sapiens
gugcagucaucaauggucagaagagccucauuccucuggaacacaaugaaccaccugauuac

SEQ ID NO: 149735 - RNA, 62 nt, Homo Sapiens
agccucauauggugauaugcuacuggaagccaccucuggaaagaagacccccuccagaagca

SEQ ID NO: 149736 - RNA, 62 nt, Homo Sapiens
agcugggcaugggucauggcgucuccccauguccucuggaacgcccuuugccagacagcucu

SEQ ID NO: 149737 - RNA, 62 nt, Homo Sapiens
cagcgcccagggucccucugccucugggcccgccucuggagcccgccagccugaccucacac

SEQ ID NO: 149738 - RNA, 62 nt, Homo Sapiens
cucugugguugugaaggcaaucauucagaucaccucuggaauucuggccauuggugcguguu

SEQ ID NO: 149739 - RNA, 62 nt, Homo Sapiens
gacagaucugaauguucaguaaguuagauuuuccucuggagaaauaugaaccauuaugauuc

SEQ ID NO: 149740 - RNA, 62 nt, Homo Sapiens
gauucgagggguuccuuccacuucuggggccaccucuggaucccguucagaaaaccacuuua

SEQ ID NO: 149741 - RNA, 62 nt, Homo Sapiens
ggguaaacgaaggcauaauaagccauggcugaccucuggagcaccaggugccaggacuuguc

SEQ ID NO: 149742 - RNA, 62 nt, Homo Sapiens
gugauaaaauuuuuuaaaaguuuugaaggaaaccucuggauaaauggacaaggccuaauuuu

SEQ ID NO: 149743 - RNA, 62 nt, Homo Sapiens
acauuaagaugagcccuaauauguaagauuuuccucuggaauggaugugagaaauguaaauu

SEQ ID NO: 149744 - RNA, 62 nt, Homo Sapiens
auuuaacgauucaggcuuugaauuacucugucccucuggaccgaaucucuuuaacugcugga

SEQ ID NO: 149745 - RNA, 61 nt, Homo Sapiens
agccucagcuucugaagugacaugaaaagagccucuggaugcauuuccauuucucuccuua

SEQ ID NO: 149746 - RNA, 62 nt, Homo Sapiens
uccuaacuugcuaagaugcuagguaguacgacccucuggauuuggaaggcaaauaaaacucu

SEQ ID NO: 149747 - RNA, 62 nt, Homo Sapiens
gagaacuaaauuguuucuaaauguagauggucccucuggaaaagcaguuuucagcaggggug

SEQ ID NO: 149748 - RNA, 62 nt, Homo Sapiens
ugcugcuuuugugccucccccacuuuccaucaccucuggagucccgucuggacgucccuucc

SEQ ID NO: 149749 - RNA, 62 nt, Homo Sapiens
uaugcagaaaaaaaagugcugcaguuuagauaccucuggaauuuuuccacagugucacaggu

SEQ ID NO: 149750 - RNA, 62 nt, Homo Sapiens
ucaucuguaucuuaaauggccccaggcaucugccucuggaaaacuauugagccuugcaugua

SEQ ID NO: 149751 - RNA, 62 nt, Homo Sapiens
cuugcaaaaugaucccagcucugauuagcagcccucuggaguucagaacuuaaguaucagug

SEQ ID NO: 149752 - RNA, 62 nt, Homo Sapiens
cccggcacguggugggccacuuucgggcguggccucuggagccgucugugauuuauuuggug

SEQ ID NO: 149753 - RNA, 62 nt, Homo Sapiens
gugacgucucccugcugggaccaucucuguggccucuggagauguggagacagaggugucug

SEQ ID NO: 149754 - RNA, 62 nt, Homo Sapiens
ccuggcccaauuccucagacuucccucugcacccucuggaacagcucagcuaccacuucccc

SEQ ID NO: 149755 - RNA, 62 nt, Homo Sapiens
gaccgaaucagggacuagaggccccacccccgccucuggaugggacaaucaccuacugagga

SEQ ID NO: 149756 - RNA, 62 nt, Homo Sapiens
acuuaauauuucaaguaaucgcguguccuugcccucuggacagagguggcccuuugauuugu

SEQ ID NO: 149757 - RNA, 62 nt, Homo Sapiens
cucuaaaugugaauuuugauuucuaagacaguccucuggaucauuaaauaugcuuuagaauu

SEQ ID NO: 149758 - RNA, 62 nt, Homo Sapiens
uuaucacuaaauugcuugugcgcauccuuggcccucuggacagaguucugcaaaaggugguc

SEQ ID NO: 149759 - RNA, 62 nt, Homo Sapiens
caccaucuguugaguuguaaauuguagcuguuccucuggauuuagguaugcuccguauagug

SEQ ID NO: 149760 - RNA, 62 nt, Homo Sapiens
aaaagaacugacuuuugauauuuucucagugaccucuggaauagaauuuuagcagaugguac

SEQ ID NO: 149761 - RNA, 62 nt, Homo Sapiens
ugcuagccauuuccaguguccuggauccugcgccucuggacggccgaaugggcauggcugcg

SEQ ID NO: 149762 - RNA, 62 nt, Homo Sapiens
gauccuucuccugaaguucagccacccugaggccucuggaaagcaaagggcuccucuccagu

SEQ ID NO: 149763 - RNA, 62 nt, Homo Sapiens
gaauccugcuaaaggagcaaagccuuguauuaccucuggaagacaacaaaaacaauuggcaa

SEQ ID NO: 149764 - RNA, 62 nt, Homo Sapiens
ugcagauaugaagagcauuuuaagaggugcagccucuggaaguggaucaaacuagaacucau

SEQ ID NO: 149765 - RNA, 62 nt, Homo Sapiens
ucugcuucuaaccacugaggcucucuaaucuuccucuggaguuuuagugaaaggauuuauug

SEQ ID NO: 149766 - RNA, 62 nt, Homo Sapiens
guucuuccaagagccucugcucacauuguuggccucuggauucuggcccuucuucauuggcu

SEQ ID NO: 149767 - RNA, 62 nt, Homo Sapiens
aauacuuguguauauuuaaagacccaauugcuccucuggagcuuguacuuucaagaaugauu

SEQ ID NO: 149768 - RNA, 62 nt, Homo Sapiens
guccccaggcucagauuguccuuccaccuuagccucuggagcagcugggacuacaggugugc

SEQ ID NO: 149769 - RNA, 62 nt, Homo Sapiens
uuuguagaaaagguuuccucuagaacugaauuccucuggaauugagugauggacuucacaac

SEQ ID NO: 149770 - RNA, 62 nt, Homo Sapiens
uugcuauguugaaguaauaggguuuuuuuuaaccucuggaugucucgucugugguugaguuu

SEQ ID NO: 149771 - RNA, 62 nt, Homo Sapiens
gcagugcgaguagugaccccagcauaccuuguccucuggaccuccugucuucucugcuucug

SEQ ID NO: 149772 - RNA, 62 nt, Homo Sapiens
cucaccuuucugugacuuguucggaauuaacuccucuggauggaaacuuccaucuuacuugg

SEQ ID NO: 149773 - RNA, 62 nt, Homo Sapiens
cucuccuuguuuggaacaaaggagcguccauuccucuggaguuugccugagauccuuccuga

SEQ ID NO: 149774 - RNA, 62 nt, Homo Sapiens
aggcuuucaugauuuggcaucaauagguauauccucuggaaaguauucuugagggacaaugc

SEQ ID NO: 149775 - RNA, 62 nt, Homo Sapiens
gagguaggcauaguacaguaugagacagcuggccucuggacauaggcacccugaagaacagg

SEQ ID NO: 149776 - RNA, 62 nt, Homo Sapiens
uaaauguuccgggaucauguuucuaucaaaagccucuggaaauuuuauucaagauugugcuc

SEQ ID NO: 149777 - RNA, 62 nt, Homo Sapiens
gaacaacuggcaggacuguugaaaaguauuugccucuggaaagaaggaaaaacuaagagaau

SEQ ID NO: 149778 - RNA, 62 nt, Homo Sapiens
ccgccuagaucagagacucaaacccacauagcccucuggagacaugggcaucgaagaaguac

SEQ ID NO: 149779 - RNA, 62 nt, Homo Sapiens
caagaaccaggggccugaggauaccucagacgccucuggaucagcagcaggugccugugaac

SEQ ID NO: 149780 - RNA, 62 nt, Homo Sapiens
aaaaaaaaugaaaugaagagcugugauuugguccucuggaaauuuagaauguaauauguaaa

SEQ ID NO: 149781 - RNA, 62 nt, Homo Sapiens
auuuuaggggaggaagagccgagauacuguccccucuggagguggccguguuuugccagcau

SEQ ID NO: 149782 - RNA, 62 nt, Homo Sapiens
cucugcuuuugauugccuauagcuugcuuuucccucuggacaauguguaaaaaccacgucug

SEQ ID NO: 149783 - RNA, 62 nt, Homo Sapiens
ggaaggggcaggacucaucaugccaggcaggcccucuggaagccaaacacccugcugcuggc

SEQ ID NO: 149784 - RNA, 62 nt, Homo Sapiens
ccuuucuccuuuucuuuccucaaggcauuggcccucuggacuauucaucucagaugugagca

SEQ ID NO: 149785 - RNA, 62 nt, Homo Sapiens
cagcugaccugacaggucaugagguugugggaccucuggaucagcugccagcucugccuuga

SEQ ID NO: 149786 - RNA, 62 nt, Homo Sapiens
aucuuggcaauaaugucaacaccagaaagccuccucuggagaaucuuacagagugauuguag

SEQ ID NO: 149787 - RNA, 62 nt, Homo Sapiens
uucuguggaugccagcuuuggaaucagagccgccucuggaauaccugugcuuccagaguuag

SEQ ID NO: 149788 - RNA, 62 nt, Homo Sapiens
caaaaaggcagaggaaaggcaaauucuucucuccucuggagcugagacacucuucuucuucu

SEQ ID NO: 149789 - RNA, 62 nt, Homo Sapiens
uuuccugccaaaaugagugaggcgcuuggugcccucuggacuuucccacuucccaacauggg

SEQ ID NO: 149790 - RNA, 62 nt, Homo Sapiens
ucugaaucucuguaagguuuauuuaucuucacccucuggagagaagauguuuuaccaaagcc

SEQ ID NO: 149791 - RNA, 62 nt, Homo Sapiens
auuuccuaucauuuuauuaucaccaugcaaugccucuggaauaaaacauacaggagucuguc

SEQ ID NO: 149792 - RNA, 62 nt, Homo Sapiens
ucugguuccauuuuuccucuguucacaaacuaccucuggacaguuguguuguuuuuuguuca

SEQ ID NO: 149793 - RNA, 62 nt, Homo Sapiens
gagacuugcuuacaguggaugccacuucuaggccucuggaccgcagaugcccuccucccucc

SEQ ID NO: 149794 - RNA, 62 nt, Homo Sapiens
uguuuuuaaaaguaacuuggguugcauucuucccucuggacuagaguagaaaugcaggggaa

SEQ ID NO: 149795 - RNA, 62 nt, Homo Sapiens
uuccuccuccccacuuguccgcugggugguacccucuggagggguguggcuccuucccaucg

SEQ ID NO: 149796 - RNA, 62 nt, Homo Sapiens
acucugcaggccugcuccaccacagcccuaauccucuggacgcuuguguagggccuggggug

SEQ ID NO: 149797 - RNA, 62 nt, Homo Sapiens
agucuucugggagccauuguggccagggacggccucuggacugccaggcuggguuggggacc

SEQ ID NO: 149798 - RNA, 62 nt, Homo Sapiens
gauucagggcccccucagcugucuccucccucccucuggaaaggaggguggggcucaggggc

SEQ ID NO: 149799 - RNA, 62 nt, Homo Sapiens
ugggcccggaucuccaggcccuggggagggagccucuggacggacaguggggacauuguggg

SEQ ID NO: 149800 - RNA, 62 nt, Homo Sapiens
gauuuuagacagggcaaaaggaagaacaggggccucuggaggcccuugguuauuuaaaucuu

SEQ ID NO: 149801 - RNA, 62 nt, Homo Sapiens
cucgagugccaccaguaccuccgcaccccgggccucuggacuucuuggaugagcucacccug

SEQ ID NO: 149802 - RNA, 62 nt, Homo Sapiens
aagcucucucgacagcaaaugguuuccccucaccucuggaauuaaagaaggaacuccaaagu

SEQ ID NO: 149803 - RNA, 62 nt, Homo Sapiens
ucuguuuacuaacucaaauaaagcaauuguucccucuggagggguccaggugcccccgcccc

SEQ ID NO: 149804 - RNA, 62 nt, Homo Sapiens
aucauuuucucaucauuaauuaugcacuuuguccucuggaccauuuuaaucuaaaauugcuc

SEQ ID NO: 149805 - RNA, 62 nt, Homo Sapiens
ugccuucucucccacgaauucugucccuguauccucuggauguaaaaagcaaggagagaccc

SEQ ID NO: 149806 - RNA, 62 nt, Homo Sapiens
aauacaaaaccacuucagagaccaggguaucuccucuggaaggaucuaagagaagguaagac

SEQ ID NO: 149807 - RNA, 62 nt, Homo Sapiens
gcugcuccuguuugucugauguggcaaaaggcccucuggagggcugguggccacgagguuaa

SEQ ID NO: 149808 - RNA, 62 nt, Homo Sapiens
uacgugugaucuuugaaaaccuuggcuuuagcccucuggaaucagagcuuacccaccauagu

SEQ ID NO: 149809 - RNA, 62 nt, Homo Sapiens
auaccuucacggccgcugcucaaaaacccacaccucuggaaggcauggagcagauugaaaug

SEQ ID NO: 149810 - RNA, 62 nt, Homo Sapiens
cauauaaaguuccuggcuuuugccagagagucccucuggaacaaugaguaaucaacaaaauc

SEQ ID NO: 149811 - RNA, 62 nt, Homo Sapiens
ucugauacaguaaauauauguaacagccacacccucuggaaacugggaguagagagacacac

SEQ ID NO: 149812 - RNA, 62 nt, Homo Sapiens
cuucugcaaccagucccagaccugcugacuucccucuggauuucuuguuuccuauucuucaa

SEQ ID NO: 149813 - RNA, 62 nt, Homo Sapiens
caucuuuagcuuugacuuugcuucucuccuggccucuggaaggagugcuacuaaaacauuuu

SEQ ID NO: 149814 - RNA, 62 nt, Homo Sapiens
gcagaccacaucgcacagacgggcaagggguuccucuggauuggccugacuuugggggguua

SEQ ID NO: 149815 - RNA, 62 nt, Homo Sapiens
gcccugcccugacuggggcuuccuuugcugggccucuggauguucucuugucgggacaggug

SEQ ID NO: 149816 - RNA, 62 nt, Homo Sapiens
ggccacuaagcagaggagggcccuggagaggcccucuggaguucacagccauacaccuguag

SEQ ID NO: 149817 - RNA, 62 nt, Homo Sapiens
uagucuuaguaaaacuuauuugaaguguauggccucuggaguuagucauaaaagaaacacaa

SEQ ID NO: 149818 - RNA, 62 nt, Homo Sapiens
ucaacuacucauuugccaaguuauacauuaugccucuggauccagaguguguggccucaaua

SEQ ID NO: 149819 - RNA, 62 nt, Homo Sapiens
gaugugaucuuauugcauguaacuugagccagccucuggaucccuccguuuccccucaguca

SEQ ID NO: 149820 - RNA, 62 nt, Homo Sapiens
uagaaaaccagagagucccagaucauugaauuccucuggaaugauugauagugaaaccauua

SEQ ID NO: 149821 - RNA, 62 nt, Homo Sapiens
ccaggggcuggccgguuguuaaugauggugggccucuggaguaugcauguaggucucuuaac

SEQ ID NO: 149822 - RNA, 62 nt, Homo Sapiens
ugagucuaccuaauauguuaaggacaaggaaaccucuggacagugguauauuggggaauuuu

SEQ ID NO: 149823 - RNA, 62 nt, Homo Sapiens
uuccuacaggggcuccucugugggugaggggcccucuggaauggcaucccaugagcuugugg

SEQ ID NO: 149824 - RNA, 62 nt, Homo Sapiens
guuuauuuaaugauguaauuuauuguugcguuccucuggaagcugugacuggaauaaacccc

SEQ ID NO: 149825 - RNA, 62 nt, Homo Sapiens
cgccuccugcuagcaagaacagaguccacccuccucuggauauuggggagggacggaaguga

SEQ ID NO: 149826 - RNA, 62 nt, Homo Sapiens
gagccagggccacucagcugccccuguccccaccucuggagaauccacccccaccagauucc

SEQ ID NO: 149827 - RNA, 62 nt, Homo Sapiens
ccagggccugcaugggggcaccgggcuccaugccucuggaggccucuggcccucgguggcug

SEQ ID NO: 149828 - RNA, 62 nt, Homo Sapiens
acaaagacagggauaaauugcuuacauuucaaccucuggagauugagguaacuuuuuguguc

SEQ ID NO: 149829 - RNA, 62 nt, Homo Sapiens
uccuucugcugcccugggguuggggccucaccccucuggagggccggaggcaggagguggaa

SEQ ID NO: 149830 - RNA, 62 nt, Homo Sapiens
acugauuccaauauuauuacuuauaacacugaccucuggaaaauauuuuguucacaagaaau

SEQ ID NO: 149831 - RNA, 62 nt, Homo Sapiens
gcaucuguacuccugugcaauugaaucugcacccucuggaggccugcauaggcacacacacc

SEQ ID NO: 149832 - RNA, 62 nt, Homo Sapiens
gagauacuugaccuugcauggaaaacaaaaguccucuggauuuuuucuaagcuuuucauuaa

SEQ ID NO: 149833 - RNA, 62 nt, Homo Sapiens
cugcuguggccucacuucccgggaaggggugcccucuggauccucgccugggcccaggcucu

SEQ ID NO: 149834 - RNA, 62 nt, Homo Sapiens
acuuugcaguaaauugcaggcuuccuuuguuaccucuggauuaggcagccguuaaccuccug

SEQ ID NO: 149835 - RNA, 62 nt, Homo Sapiens
gggcuggcuggugcccuauuaccccaggugucccucuggaagaaccccuugggcuaggucug

SEQ ID NO: 149836 - RNA, 62 nt, Homo Sapiens
gaugugagaaggcaccaccugucaaguggcguccucuggacaccauguuuucagagugcagg

SEQ ID NO: 149837 - RNA, 62 nt, Homo Sapiens
cgccauucugcagaguauuuaacuugaaaccgccucuggagccaguguuaccugacuuauga

SEQ ID NO: 149838 - RNA, 62 nt, Homo Sapiens
uccugcguguucucagaggacggcgagaaaugccucuggagcuggaacccagcuuacauuuu

SEQ ID NO: 149839 - RNA, 62 nt, Homo Sapiens
cugccugcuggcucucccccagccccacauccccucuggaagagaauguaaaauaaaccugg

SEQ ID NO: 149840 - RNA, 62 nt, Homo Sapiens
gaggcuggccugccccauuccccaagggggcuccucuggagugguggggaggauuaggcugc

SEQ ID NO: 149841 - RNA, 62 nt, Homo Sapiens
gaaguccaagauuaagggaucaacaaauuaggccucuggaucauacauggcauuuucuagcu

SEQ ID NO: 149842 - RNA, 62 nt, Homo Sapiens
gauuuggaagauuuguuucuuuuaucucucuuccucuggauguaguuuuuuuuuguuuuuuu

SEQ ID NO: 149843 - RNA, 62 nt, Homo Sapiens
acuaugcauugaacauucugaaucauucuaagccucuggagagacuguaaugauccauucau

SEQ ID NO: 149844 - RNA, 62 nt, Homo Sapiens
guccugcuugggguucauaggaauugguaaggccucuggacuggccugucuggccccugaga

SEQ ID NO: 149845 - RNA, 62 nt, Homo Sapiens
gccagugaccuuugaccucgggagcugagcagccucuggacauuuacugguucuugcaaaug

SEQ ID NO: 149846 - RNA, 62 nt, Homo Sapiens
cagaaccccuucuuuuccaagguauggaacccccucuggauaugcccaccaccgacgaugug

SEQ ID NO: 149847 - RNA, 62 nt, Homo Sapiens
gcccugggcucuggcagaugguuccacaagugccucuggagggccucccacccuggucccag

SEQ ID NO: 149848 - RNA, 62 nt, Homo Sapiens
cuuuguuucuucuguacccggaccucccugggccucuggaaguugcacgacacagggcuggu

SEQ ID NO: 149849 - RNA, 62 nt, Homo Sapiens
gcacacagcacccacaaccaucucccaugauuccucuggacuuuuaaggacuugacuuccuu

SEQ ID NO: 149850 - RNA, 62 nt, Homo Sapiens
uccagaaaaccaaguguccgcaacacccaggcccucuggacaccagcuuccucauucugcua

SEQ ID NO: 149851 - RNA, 62 nt, Homo Sapiens
gcuugacucuacucccagcgagcaagcagugcccucuggacacuccaccuggccccuucucc

SEQ ID NO: 149852 - RNA, 62 nt, Homo Sapiens
ugaggcgggagcaugcccucuccgcccaacagccucuggaggaacugcugcagcucucggcu

SEQ ID NO: 149853 - RNA, 62 nt, Homo Sapiens
augaaacuugccccuucacugaucuggacucaccucuggagccuauggcuuuaagcaagcac

SEQ ID NO: 149854 - RNA, 62 nt, Homo Sapiens
caccugcugaacuucauuucuguaucaccugaccucuggaugccaaaacguuuauucugcuu

SEQ ID NO: 149855 - RNA, 62 nt, Homo Sapiens
aaacccuaaaggagaaggaagcagaauauaacccucuggagagcucaagacaguaggaaccu

SEQ ID NO: 149856 - RNA, 62 nt, Homo Sapiens
ccuggccaccaccuugggcauggccacucugcccucuggaccugucuuucaucgggagaaac

SEQ ID NO: 149857 - RNA, 62 nt, Homo Sapiens
ggugcagcgcucagguggauccugggaagcagccucuggaugcugaguggagggagccacug

SEQ ID NO: 149858 - RNA, 62 nt, Homo Sapiens
cuuguacuuuauuuuucugauagaaaugguuuccucuggaucguuuuaugcgguucuuacag

SEQ ID NO: 149859 - RNA, 62 nt, Homo Sapiens
ccguuuggcacagcuuuggccacagccaggccccucuggaauuguccuuauuaaaccaguuu

SEQ ID NO: 149860 - RNA, 62 nt, Homo Sapiens
ccugugaugcucugccaacuacaaaugcugcuccucuggagggcgggucccccgugcugugg

SEQ ID NO: 149861 - RNA, 62 nt, Homo Sapiens
uagacuccacgagggcagggccucuccugucgccucuggacacaaguggcgacagccugcug

SEQ ID NO: 149862 - RNA, 62 nt, Homo Sapiens
acuauggucuuacaagcaguccagcuacagagccucuggaacacuucagauucccaaagaag

SEQ ID NO: 149863 - RNA, 62 nt, Homo Sapiens
ugcagcaaguuuuuaugcaagugaauuuuggaccucuggaugauugguuuuuuaagugccgg

SEQ ID NO: 149864 - RNA, 62 nt, Homo Sapiens
uccccugccuaucuguuuguucaauucugaguccucuggacucauuauuguauagagcugcu

SEQ ID NO: 149865 - RNA, 62 nt, Homo Sapiens
uuuggcucuucuuuguuuugagcucucaggucccucuggaacagugcaggaaaccugaaccc

SEQ ID NO: 149866 - RNA, 62 nt, Homo Sapiens
ugacccuuugcaagucuuuaacagggcucgagccucuggaaccugucugugaaagucagaac

SEQ ID NO: 149867 - RNA, 62 nt, Homo Sapiens
acaaauucuuagucuauaauaacuggucagcuccucuggacauauauugaugcugaaagagg

SEQ ID NO: 149868 - RNA, 62 nt, Homo Sapiens
caucccccguucugggcaagagccucagccuuccucuggaaggcuggcuuccuuaccagaaa

SEQ ID NO: 149869 - RNA, 62 nt, Homo Sapiens
guggguggggcccugcaccgccauuucuccugccucuggaaggggcagcuggggcugccauc

SEQ ID NO: 149870 - RNA, 62 nt, Homo Sapiens
auuaaaauauauugccauucguucuacucuuuccucuggagcaagaauguacaauggccaga

SEQ ID NO: 149871 - RNA, 62 nt, Homo Sapiens
ucccuacagacagccagucuccacuugccuccccucuggauguaucuggucagggaaguggg

SEQ ID NO: 149872 - RNA, 62 nt, Homo Sapiens
gagaggcagggaaaaugguuaagcagcccggcccucuggaguccccaugggggcgguagcug

SEQ ID NO: 149873 - RNA, 62 nt, Homo Sapiens
aucucugugcaggaaccaagauggggcugaagccucuggaggcaguugguugggggcgggca

SEQ ID NO: 149874 - RNA, 62 nt, Homo Sapiens
ccuuguuaccugcccaaacuugugacugcaucccucuggagucuacccagagacagagaaug

SEQ ID NO: 149875 - RNA, 62 nt, Homo Sapiens
cuuccaccagccuuaugcaucuaaguguagcuccucuggagauggagagcucuuucaucgua

SEQ ID NO: 149876 - RNA, 62 nt, Homo Sapiens
cuguaauuuaaggaaagaaaacuucaguucugccucuggauaccaagaugcccauugcucag

SEQ ID NO: 149877 - RNA, 62 nt, Homo Sapiens
uuuuucuuuuggccuuugggcacagagucugaccucuggaccacucuaacuggagaaggaac

SEQ ID NO: 149878 - RNA, 62 nt, Homo Sapiens
aggugccaggaaucccuugggucagcuccuauccucuggacggggagcaucaugggaaaaag

SEQ ID NO: 149879 - RNA, 62 nt, Homo Sapiens
gcccaacaucccuugacuuuaccugaaguccaccucuggagacuccagugucaucuuugucc

SEQ ID NO: 149880 - RNA, 62 nt, Homo Sapiens
acauaaaaaacaaaauauggacugguuuuuauccucuggacauaacaauuucuacugcuuac

SEQ ID NO: 149881 - RNA, 62 nt, Homo Sapiens
cacuuggacuucaaaaauagccucaacuguuuccucuggagccuucuacccccauuaucuua

SEQ ID NO: 149882 - RNA, 62 nt, Homo Sapiens
ucuugcacguaucuguuuucugguucuguucuccucuggagauggugacucacugaguacca

SEQ ID NO: 149883 - RNA, 62 nt, Homo Sapiens
uuguauaugcauagucauguaauuuguagauuccucuggauuguuuauuucuuaaaucuagu

SEQ ID NO: 149884 - RNA, 62 nt, Homo Sapiens
cuacauggggaugcuggacgagccccucaaccccucuggaugcugugacaucccagaagccc

SEQ ID NO: 149885 - RNA, 62 nt, Homo Sapiens
cuguauuucuugaauuagaaauccuaaaggauccucuggaagcaugugcaauaagaacauag

SEQ ID NO: 149886 - RNA, 62 nt, Homo Sapiens
guagaggagcuaacuguuugaggaauagcuucccucuggacucugucaccuugaaugaacuc

SEQ ID NO: 149887 - RNA, 62 nt, Homo Sapiens
uaauuaccuuaaacaagcaguuugugccaaguccucuggaucagccccuuuugaaacucagu

SEQ ID NO: 149888 - RNA, 62 nt, Homo Sapiens
cccacacuuguggggacuuaagcugggccgcuccucuggaaggcucugauucagcuggggcu

SEQ ID NO: 149889 - RNA, 62 nt, Homo Sapiens
aaaguaguggcuauuuuuguuuucuuuauuccccucuggacucucuccuugcuuuugacaaa

SEQ ID NO: 149890 - RNA, 62 nt, Homo Sapiens
cagguaggcuaauugguaguuguucauuucagccucuggauggcuggcugccuuaaacacaa

SEQ ID NO: 149891 - RNA, 62 nt, Homo Sapiens
acaagcaaugcuguucuguaaauuuauugaaaccucuggaacauuucaccuuuagagaugga

SEQ ID NO: 149892 - RNA, 62 nt, Homo Sapiens
gucagccaccuuguacuaagcugaaacaugucccucuggagcuuccaccuggccagggagga

SEQ ID NO: 149893 - RNA, 62 nt, Homo Sapiens
gaggcagacagucucccagagcugagggcuugccucuggagaccccagccccagagggcuuu

SEQ ID NO: 149894 - RNA, 62 nt, Homo Sapiens
agccccucucugaagagacuguccuugggccuccucuggaagcagcacccccagaggacagg

SEQ ID NO: 149895 - RNA, 62 nt, Homo Sapiens
ccccuuacuccccgccaaaacccacaucccagccucuggauccuggggaagguuccaguccc

SEQ ID NO: 149896 - RNA, 62 nt, Homo Sapiens
cggcaugggcuaagucacucugcccuucggagccucuggaagcuuagggcacauugguucca

SEQ ID NO: 149897 - RNA, 62 nt, Homo Sapiens
uacucuuaggugccagucugguaacugaacucccucuggaggcaggcuugagggaggauucc

SEQ ID NO: 149898 - RNA, 51 nt, Homo Sapiens
ugaaucagagacgcaucugacccucuggagaacacugccucccgcuggccc

SEQ ID NO: 149899 - RNA, 62 nt, Homo Sapiens
gagccgagggcgagacaggaguauucucuuggccucuggacacccucccguuccuccaaggc

SEQ ID NO: 149900 - RNA, 62 nt, Homo Sapiens
uuaugagagaagaaagagugagagaagaauugccucuggacuaucaucaauauguuguaccu

SEQ ID NO: 149901 - RNA, 62 nt, Homo Sapiens
auuuugcauaaaauuggauucccaccaucccaccucuggauacacacucaagccgacuuaug

SEQ ID NO: 149902 - RNA, 62 nt, Homo Sapiens
uugugauuuuaguauaaauuauuacuucauauccucuggaguauugugaccccuuguaauuu

SEQ ID NO: 149903 - RNA, 62 nt, Homo Sapiens
cagggggaggccuggaaggauuggguccccauccucuggaacgguucuucuaguucgaggcc

SEQ ID NO: 149904 - RNA, 62 nt, Homo Sapiens
aauguguuaaauaucuguauggacuggagccaccucuggaaucaccaucucucaagccccaa

SEQ ID NO: 149905 - RNA, 62 nt, Homo Sapiens
ccuaaccccuuccagaucacauccuuagagguccucuggagcgcagcccagagacuuuguag

SEQ ID NO: 149906 - RNA, 62 nt, Homo Sapiens
uagaagggaccauaagaggaucuuccucuuagccucuggaucggguccuugggccuggccag

SEQ ID NO: 149907 - RNA, 57 nt, Homo Sapiens
cuccgagccugcccccagagcugccggccucuggaggugaagaccaaucucuucuag

SEQ ID NO: 149908 - RNA, 62 nt, Homo Sapiens
ucugcugugaauuuguauuccuuggccuggggccucuggaagggauggaaacuuucuaccug

SEQ ID NO: 149909 - RNA, 62 nt, Homo Sapiens
ucccaucuguuucacugucuaaggagcagggaccucuggaauacuuuacuguuccucuggga

SEQ ID NO: 149910 - RNA, 62 nt, Homo Sapiens
cucagccagaaguaccauuacccuccuggggaccucuggagcccccuccacgcaaacacccu

SEQ ID NO: 149911 - RNA, 62 nt, Homo Sapiens
ccuaauggcaggcaaagggaaaaggaugccauccucuggaaucuucugugaaagcaaauacu

SEQ ID NO: 149912 - RNA, 62 nt, Homo Sapiens
uuugcagccaaggugcuaaacccccaaaucuuccucuggagcuggucauaggcucacucuuu

SEQ ID NO: 149913 - RNA, 62 nt, Homo Sapiens
cugaggcggcugcuugaaccaucagguggaagccucuggaaccagagaacugaagugcagcc

SEQ ID NO: 149914 - RNA, 62 nt, Homo Sapiens
agaccuggggugggggcugagugggcuggaggccucuggagaggcuuccuuuggagguggga

SEQ ID NO: 149915 - RNA, 62 nt, Homo Sapiens
gggacacuggcccugggaacgcauggacuuggccucuggaguggccugcugaggggagggga

SEQ ID NO: 149916 - RNA, 62 nt, Homo Sapiens
cagcacagugcuccuccauaacaagcaacaccccucuggagcugcagcauauuagauucuag

SEQ ID NO: 149917 - RNA, 62 nt, Homo Sapiens
ggcggaaguaaaucuggaaguaaaagccuguaccucuggauugcaguucucugccccuugcc

SEQ ID NO: 149918 - RNA, 62 nt, Homo Sapiens
ucgcugggagcaucaccgccaggggacagcgcccucuggagcccgcagcgcccgcgccuccg

SEQ ID NO: 149919 - RNA, 62 nt, Homo Sapiens
cuguccucguguccaccuggaauaaaaccaagccucuggaaugaggacaaagaaaacugcac

SEQ ID NO: 149920 - RNA, 62 nt, Homo Sapiens
cagacucacauccugaccuugcacaaacagccccucuggacacagccccauguacacggccu

SEQ ID NO: 149921 - RNA, 62 nt, Homo Sapiens
ccaagcaaggauagggaaggggaaugguugagccucuggagaucauuguaaccaauccugcc

SEQ ID NO: 149922 - RNA, 62 nt, Homo Sapiens
ugucaaccagagaacagcuccccuagacauggccucuggaaaaaggaaaucuuugguggcca

SEQ ID NO: 149923 - RNA, 62 nt, Homo Sapiens
gccauuacuaauagaaacacagccuuuccaauccucuggaacauauucugucuggguuuuua

SEQ ID NO: 149924 - RNA, 62 nt, Homo Sapiens
agguaaucaggccccucccagggcuucuuuccccucuggagugccuccggccuccccaucca

SEQ ID NO: 149925 - RNA, 62 nt, Homo Sapiens
gaggcuaacccugauccauagugcuaccugcaccucuggauucuggauucacagaccaaguc

SEQ ID NO: 149926 - RNA, 62 nt, Homo Sapiens
cggccaaaaugcugcuucgagugcacacggugccucuggaugcccgggauggcaaugaggug

SEQ ID NO: 149927 - RNA, 62 nt, Homo Sapiens
ggcucccaguggucacugugcccaucccucagccucuggauucucuucauggccagguggcu

SEQ ID NO: 149928 - RNA, 62 nt, Homo Sapiens
ggacaaggggcucagggcugcugccuuccuguccucuggagagaacccagccaggcgcggug

SEQ ID NO: 149929 - RNA, 62 nt, Homo Sapiens
cucuuucuuuaaaaagaaagaggguugaaaauccucuggacgaacagaagucacuuuggcug

SEQ ID NO: 149930 - RNA, 62 nt, Homo Sapiens
ggaccuagggaggcauggucugcccucugcauccucuggagccagccgagcaggaggccuag

SEQ ID NO: 149931 - RNA, 62 nt, Homo Sapiens
gguugaagacaaggaaagcucugcuguggcugccucuggacugacacccucccuaaugaguc

SEQ ID NO: 149932 - RNA, 62 nt, Homo Sapiens
gccacaggcacccccagcuguccugcugggaaccucuggagagccucugucuccugccacaa

SEQ ID NO: 149933 - RNA, 62 nt, Homo Sapiens
acucuacaguauacuugugacacuucaugaagccucuggaaaagcaauaaugucaccacaca

SEQ ID NO: 149934 - RNA, 62 nt, Homo Sapiens
cacauuuuuaucuagaugaacgaggcuaguuuccucuggaacauaagcucaucccucccguc

SEQ ID NO: 149935 - RNA, 62 nt, Homo Sapiens
guagacuguauauguuuaauacugcaguuccuccucuggaauucugugguguuauaguggua

SEQ ID NO: 149936 - RNA, 62 nt, Homo Sapiens
uugacugggggguggggauguucagaucuguuccucuggagcacugauccuuccccaccauc

SEQ ID NO: 149937 - RNA, 62 nt, Homo Sapiens
aauuuccuccuagcccuucccgaugccugugcccucuggaaaaggauaugacaguccagcau

SEQ ID NO: 149938 - RNA, 62 nt, Homo Sapiens
accuggugaguaggggaccuuuugagcgugugccucuggaggauuucgaagagcacccacug

SEQ ID NO: 149939 - RNA, 62 nt, Homo Sapiens
uucuuauguaugcaagcuccgucauguuuucuccucuggaaccauguugcauuuaacugaau

SEQ ID NO: 149940 - RNA, 62 nt, Homo Sapiens
gggacuccuucucccucccucccaucccgaggccucuggaauauccaccccacuucugcaaa

SEQ ID NO: 149941 - RNA, 62 nt, Homo Sapiens
gugugcugucuuuagggccccacucagcccgcccucuggagccaggacccaagugugaacaa

SEQ ID NO: 149942 - RNA, 62 nt, Homo Sapiens
uacauuaaggauggugggggcuucauuagagaccucuggaaagaguuuucuaagcucagggu

SEQ ID NO: 149943 - RNA, 62 nt, Homo Sapiens
ggaucucaggaccuugguggacacuguguacaccucuggauucauugucucucacagaugug

SEQ ID NO: 149944 - RNA, 62 nt, Homo Sapiens
cugccuccuugcugaggggccccugugagaggccucuggaugggcaugggaagaugggcucc

SEQ ID NO: 149945 - RNA, 62 nt, Homo Sapiens
cucacacuuugccucuaaggagcuagaguaguccucuggauuaaggugauaaauaacuugag

SEQ ID NO: 149946 - RNA, 62 nt, Homo Sapiens
guggaggugagggagagcuggcacaagcccucccucuggauccuccacuccuggggauuaug

SEQ ID NO: 149947 - RNA, 62 nt, Homo Sapiens
uucuccuacccgauuccccaacaccacuagugccucuggauuuagagauauauauccuaggg

SEQ ID NO: 149948 - RNA, 62 nt, Homo Sapiens
aagacaaauauucacacaaaaaugaaguguguccucuggagggucagauauacaauuucuuu

SEQ ID NO: 149949 - RNA, 62 nt, Homo Sapiens
cagagcauccgaccucuuggagcaaguuucugccucuggaaagggggcgggcccuuuucaca

SEQ ID NO: 149950 - RNA, 62 nt, Homo Sapiens
aguuggauaagccaauccucacuccccagccuccucuggauagggaugaagaccccacuggg

SEQ ID NO: 149951 - RNA, 62 nt, Homo Sapiens
ugaagcagagaggcacgugccugucucauucgccucuggaucugcugcauccaggacugugc

SEQ ID NO: 149952 - RNA, 62 nt, Homo Sapiens
acuggcugugaaaagucaggcacuaccacccaccucuggaaggccuaggguggaggucacug

SEQ ID NO: 149953 - RNA, 62 nt, Homo Sapiens
aucuggcugagcaacugaauaaaugcuggcuaccucuggaucaaauucaauggacaaaaaua

SEQ ID NO: 149954 - RNA, 62 nt, Homo Sapiens
acuugacuguaauuuaacauguguaacauccuccucuggauaugucauuuccuuauaaguuu

SEQ ID NO: 149955 - RNA, 62 nt, Homo Sapiens
gagucagaaugagggaauaauuuggaauugggccucuggacaaaagggagucaaggguuggc

SEQ ID NO: 149956 - RNA, 62 nt, Homo Sapiens
ggauauauugguugguucauucuucccgccucccucuggaaucugaccuguacuuauuuuuc

SEQ ID NO: 149957 - RNA, 62 nt, Homo Sapiens
acucugcccuccugucacccguaucugggucuccucuggagccagggaaguccuugguugau

SEQ ID NO: 149958 - RNA, 62 nt, Homo Sapiens
acaaacuaccaauuucucgugugcccauguccccucuggaagcacugagcccaccagccaca

SEQ ID NO: 149959 - RNA, 62 nt, Homo Sapiens
cuccugcccagcugcucuugucagcccucuggccucuggaugagguugaguucuccacaaca

SEQ ID NO: 149960 - RNA, 62 nt, Homo Sapiens
gagcaccuuucuuccgucuguucacucugcggccucuggaaucccagcucuucucucucaga

SEQ ID NO: 149961 - RNA, 62 nt, Homo Sapiens
cuggaaccuggaccccagccuuggugggggagccucuggaaugcauggggcggguccuagcu

SEQ ID NO: 149962 - RNA, 62 nt, Homo Sapiens
ucuggaaagcucaaccugcaggaguuccaccaccucuggaacaagauuaaggccuggcaggu

SEQ ID NO: 149963 - RNA, 62 nt, Homo Sapiens
aaguggaauuggcagcuucuagaauauguacaccucuggacaaaauguuccucaaucuuaag

SEQ ID NO: 149964 - RNA, 62 nt, Homo Sapiens; identical to SEQ ID NO: 70529

SEQ ID NO: 149965 - RNA, 62 nt, Homo Sapiens
uagaaaugcagaccugugggcucuaccacaggccucuggaaucagaaucuucaggguggggc

SEQ ID NO: 149966 - RNA, 62 nt, Homo Sapiens
accuaggcuuacaggccauccugagccaggggccucuggaaauucucuuccugaugguccuu

SEQ ID NO: 149967 - RNA, 62 nt, Homo Sapiens
cccccaccaauuuauacaucuccauuuucugaccucuggacuaacugguugcucagcaaggu

SEQ ID NO: 149968 - RNA, 62 nt, Homo Sapiens
ugggggcauuuugcuggggggagaugaggcagccucuggaauggcucagggauucagcccuc

SEQ ID NO: 149969 - RNA, 62 nt, Homo Sapiens
agaagauaagcuacuaauagaaaauguuuuuaccucuggauaugaaauaagugcccugugua

SEQ ID NO: 149970 - RNA, 62 nt, Homo Sapiens
gccuccggacucuggcacgcuccagcagcccuccucuggaagcugcguccccucacccccug

SEQ ID NO: 149971 - RNA, 62 nt, Homo Sapiens
guagaugcuugcucuugggaggaugucuuucuccucuggagacaaccuaccuucuuuccaga

SEQ ID NO: 149972 - RNA, 62 nt, Homo Sapiens
aagacuccgagaguuauaacccauguaaagauccucuggaaagcugacugagacaauucugu

SEQ ID NO: 149973 - RNA, 62 nt, Homo Sapiens
cacuuuuuucccccuucaaauaguaaacuuuuccucuggagugaaauuaaccugcuauuaaa

SEQ ID NO: 149974 - RNA, 62 nt, Homo Sapiens
ugcugauuuuauggacugaggccuggaaccuuccucuggaaguucucgaugugcacugugau

SEQ ID NO: 149975 - RNA, 62 nt, Homo Sapiens
uacacuagugugagccuucauuaaaacugucaccucuggaaaaagcgucuccaauaugacua

SEQ ID NO: 149976 - RNA, 62 nt, Homo Sapiens
acagacacugcacagaccuuucacaguccuguccucuggaucgugauauauuagggacacuu

SEQ ID NO: 149977 - RNA, 62 nt, Homo Sapiens
cggggcaucucccucugauucucaacuucuuuccucuggagacuuagguuuugcuugggaaa

SEQ ID NO: 149978 - RNA, 62 nt, Homo Sapiens
gcacugaauaaagcacgugcguugagggguccccucuggaauggaagggcuuggccagcgcu

SEQ ID NO: 149979 - RNA, 62 nt, Homo Sapiens
ucauuuaguuaaagcacaugugcugcuguuggccucuggagugaaggugaauugagcagguc

SEQ ID NO: 149980 - RNA, 62 nt, Homo Sapiens
accaagcccuccccuaaugcguguccucucucccucuggaggcaugccagauagcauucagg

SEQ ID NO: 149981 - RNA, 62 nt, Homo Sapiens
ucugcucagaagcagaacaaugcacugugucaccucuggaucuuuggugugagugcagauau

SEQ ID NO: 149982 - RNA, 62 nt, Homo Sapiens
agaggccgggggagcagacagggccggugcucccucuggaagcuugggugaccggggcccug

SEQ ID NO: 149983 - RNA, 62 nt, Homo Sapiens
gaccucggccagcuggacccacaugagggccaccucuggaaccuucuucgaggcccuggcca

SEQ ID NO: 149984 - RNA, 62 nt, Homo Sapiens
gugguugccacauuucaucagacagacaccucccucuggagaugcaguugagugacaaccuu

SEQ ID NO: 149985 - RNA, 62 nt, Homo Sapiens
ugcugccgcccuugaaccuggcugagcucaguccucuggaggaagccguccagucccuagaa

SEQ ID NO: 149986 - RNA, 62 nt, Homo Sapiens
ggcugcuuggggagacucuuccgugcguucuuccucuggauagaaccaccaccuccugggcg

SEQ ID NO: 149987 - RNA, 62 nt, Homo Sapiens
uucucuguguggauagacuccccagcguuuuuccucuggaaaugcccacagggcuugccgcg

SEQ ID NO: 149988 - RNA, 62 nt, Homo Sapiens
caggaagggcugggcagaggaggcuggggccaccucuggaggguguccugcuguuccuguug

SEQ ID NO: 149989 - RNA, 62 nt, Homo Sapiens
cacuccccacaguuuuaggaucuaaaugauugccucuggaacuauucuucuagacuauccca

SEQ ID NO: 149990 - RNA, 62 nt, Homo Sapiens
agaacagcagcacugagcucccacccgcagagccucuggacggccuuggcaacagcaaaauc

SEQ ID NO: 149991 - RNA, 62 nt, Homo Sapiens
gaaaucugaagaccucgagcagaugaugccaaccucuggagcaauguugcuuaggaugugug

SEQ ID NO: 149992 - RNA, 62 nt, Homo Sapiens
gccucaccuucaacugucugucuuagaauuccccucuggagggcuauggccucccuaugcuu

SEQ ID NO: 149993 - RNA, 62 nt, Homo Sapiens
cccagagccccaggugccuggccuggccuagaccucuggaauugagauuaaacaauuuggag

SEQ ID NO: 149994 - RNA, 62 nt, Homo Sapiens
gacaccucucucaggagcuucugagucagacgccucuggagcgagcccuaugucaggcacuc

SEQ ID NO: 149995 - RNA, 62 nt, Homo Sapiens
cugaggucagucucccaagccuggcauguggcccucuggaucuggguuccaucucugucucc

SEQ ID NO: 149996 - RNA, 62 nt, Homo Sapiens
ucacagggugagggccaccuccacacccacccccucuggagaaggccuggaagagcugagac

SEQ ID NO: 149997 - RNA, 62 nt, Homo Sapiens
cuuguuuugguuuucagcugauaggaucuaugccucuggaccagcugaacuuacuggugcag

SEQ ID NO: 149998 - RNA, 62 nt, Homo Sapiens
gucugagcuaagcuggcacccaucccagggcuccucuggagcuaauccuuuaagcaaaaugu

SEQ ID NO: 149999 - RNA, 62 nt, Homo Sapiens
cucuuuguuucccuccacccacccuuccauauccucuggagcaggagacaaugugggugccc

SEQ ID NO: 150000 - RNA, 62 nt, Homo Sapiens
ggaguccaugugugaaauggcaucuaccauuuccucuggauuaaaacuacggacuggggaca

SEQ ID NO: 150001 - RNA, 62 nt, Homo Sapiens
ucucuugggaacgcuggagagcuugugcacagccucuggaaggaaaggcagcgcugacuucg

SEQ ID NO: 150002 - RNA, 62 nt, Homo Sapiens
uauuuaucaauauaauugggaacccauguuguccucuggacaggacucagccauccauuaag

SEQ ID NO: 150003 - RNA, 62 nt, Homo Sapiens
uguucacucugagaucuguucuccucccaccuccucuggauucucacaucccaccauggugg

SEQ ID NO: 150004 - RNA, 62 nt, Homo Sapiens
augacuauggacagaaggcccagucugacuucccucuggagaagaucucauaagaaagaauc

SEQ ID NO: 150005 - RNA, 62 nt, Homo Sapiens
gcucaaauccaguccccuucucaggccccacaccucuggacauuccagggacuggggcaaac

SEQ ID NO: 150006 - RNA, 62 nt, Homo Sapiens
caaccucuuucuaauacccugagaccacucauccucuggaauaguggggggcuauagccuca

SEQ ID NO: 150007 - RNA, 62 nt, Homo Sapiens
ggacagggaaguugaguuaggagcucauggaaccucuggaaaccaguacauguuuaaaagaa

SEQ ID NO: 150008 - RNA, 62 nt, Homo Sapiens
ugccuucucaucaggugcacuuuccuuugaguccucuggagcuuucucucuugauucuuggu

SEQ ID NO: 150009 - RNA, 62 nt, Homo Sapiens
cucaaaccuuuuuagggcguugcacgguucugccucuggacaucucugugggcuucucuugg

SEQ ID NO: 150010 - RNA, 62 nt, Homo Sapiens
ugccuuuggccacaugugcuacucagcugcugccucuggaggacccugcagucuucauccuc

SEQ ID NO: 150011 - RNA, 62 nt, Homo Sapiens
uugugucuccuucggccccuccucccucuuuuccucuggaugcacucugaugauaccauggu

SEQ ID NO: 150012 - RNA, 62 nt, Homo Sapiens
acaggaucaagccuugcuugagauuggccuuaccucuggacuuuuuuuguuauaugagcuaa

SEQ ID NO: 150013 - RNA, 62 nt, Homo Sapiens
cggauaccucuggcccccaccccauuacuguaccucuggagucacuacugugggucgccacu

SEQ ID NO: 150014 - RNA, 62 nt, Homo Sapiens
gugggagacggcuuuguccuggggacacuuucccucuggaaucucaagacgacguggcacac

SEQ ID NO: 150015 - RNA, 62 nt, Homo Sapiens
gagccggucccccccugaggcacccggauucaccucuggaccacccugauauugcuucuccu

SEQ ID NO: 150016 - RNA, 62 nt, Homo Sapiens
ggcccccgggaccugcugcagugccagaggggccucuggagcaggccuggcuuuuaaauggg

SEQ ID NO: 150017 - RNA, 62 nt, Homo Sapiens
aaaugaugaguucuaguaaacucugauuuuugccucuggauaguagaucucgagcguuuauc

SEQ ID NO: 150018 - RNA, 62 nt, Homo Sapiens
uucccuccccacccuucauggcuugccuccugccucuggauuuuagguguugauuucuggau

SEQ ID NO: 150019 - RNA, 62 nt, Homo Sapiens
cugggugcaaagaacggcuuggcuuggcuccuccucuggagguuaaaauuuauagucauucu

SEQ ID NO: 150020 - RNA, 62 nt, Homo Sapiens
ugaaacaagucuagucuucugguuuucuagccccucuggauucccuuuugacucuuccgugc

SEQ ID NO: 150021 - RNA, 62 nt, Homo Sapiens
acccaucagcccuugcaagucccccacucaggccucuggaagguccagggaugggcucugau

SEQ ID NO: 150022 - RNA, 62 nt, Homo Sapiens
cucucuacccagcccaucuugccuccauggugccucuggaggccucugggccuccucuaaca

SEQ ID NO: 150023 - RNA, 62 nt, Homo Sapiens
cucgugacagccucugacucaccacgaugacgccucuggaccucggugaugccuuccgacac

SEQ ID NO: 150024 - RNA, 62 nt, Homo Sapiens
gccacuguggacgcccuggggcuuggcacccaccucuggagaaacucggggccaccuccacu

SEQ ID NO: 150025 - RNA, 62 nt, Homo Sapiens
cagaccagccuggccaaugccuauggguggccccucuggagugcucacuaacaagggugagu

SEQ ID NO: 150026 - RNA, 62 nt, Homo Sapiens
gcuuugccucaccuuucuccagcagccgggacccucuggagagcuuguuuucccuccaagaa

SEQ ID NO: 150027 - RNA, 62 nt, Homo Sapiens
cccucucccuucccugcugccuugcagugaccccucuggaacucaggacucgauuuuaagga

SEQ ID NO: 150028 - RNA, 62 nt, Homo Sapiens
uguccacagcuccuguggggguggaggagacuccucuggagaagggugagaagguggaggcu

SEQ ID NO: 150029 - RNA, 62 nt, Homo Sapiens
cccuaccuccagcuuccuccagccucaaaccgccucuggaucuagcuguccuucuccgagug

SEQ ID NO: 150030 - RNA, 62 nt, Homo Sapiens
ugcaggguggauuguuacagcuucgcuggaaaccucuggaggucaucucggcuguuccugag

SEQ ID NO: 150031 - RNA, 62 nt, Homo Sapiens
gccaaagcgaucggugcucccagaucccgcagccucuggagagagcugacggcagaugaaau

SEQ ID NO: 150032 - RNA, 62 nt, Homo Sapiens
cucugccuucacaugugagacgguggacuuuuccucuggacaaaaugacagcauccuggcga

SEQ ID NO: 150033 - RNA, 62 nt, Homo Sapiens
ggaggccgggcccgggcaccugagggcuucucccucuggacacugcgggccagguguacaua

SEQ ID NO: 150034 - RNA, 62 nt, Homo Sapiens
augagauuguaggugauauuaaaugguuuuuuccucuggaagagauucaagggaaaggcacu

SEQ ID NO: 150035 - RNA, 62 nt, Homo Sapiens
ccaggacucugggguuuuaccuccaaaggaggccucuggaacacccccuuccagggccucug

SEQ ID NO: 150036 - RNA, 62 nt, Homo Sapiens
ugccaauccauccuucccccucuguaaagucuccucuggaaaucccaugagaucaggcgcca

SEQ ID NO: 150037 - RNA, 62 nt, Homo Sapiens
ggaugguucuucauaggagaaagucuuuaaucccucuggacuugauuuuauuuuuuacacuu

SEQ ID NO: 150038 - RNA, 62 nt, Homo Sapiens
ccugggaaccuggcugcagccuguggucccacccucuggaggaccaucacuaccugcaccug

SEQ ID NO: 150039 - RNA, 62 nt, Homo Sapiens
accucccgcugcguuuccuaucggccgcuuucccucuggaccggugagggcagcccucaggg

SEQ ID NO: 150040 - RNA, 62 nt, Homo Sapiens
cugccagagauggggguugaagaaagaagaagccucuggacaugugcugcaacacugaagac

SEQ ID NO: 150041 - RNA, 62 nt, Homo Sapiens
acuaacaaguucucagacuuaucccuugaccaccucuggaccacagugucucugaacuguuc

SEQ ID NO: 150042 - RNA, 62 nt, Homo Sapiens
gucaaaccugccagauaucaaauauuuaauuuccucuggauaauaauuuaauuuuauauaaa

SEQ ID NO: 150043 - RNA, 62 nt, Homo Sapiens
ggccacacccaccccauuccgucaccaguucuccucuggacucccccugccaccccucccca

SEQ ID NO: 150044 - RNA, 62 nt, Homo Sapiens
gugggaauuaaggaagugacaguugcacuuggccucuggauuaguagggguugugggugacc

SEQ ID NO: 150045 - RNA, 62 nt, Homo Sapiens
cagguggugggaguaccagcgagcccucuccuccucuggagugccaguccacauccccugca

SEQ ID NO: 150046 - RNA, 62 nt, Homo Sapiens
augcaagucuuugccauggcgagugacaugggccucuggagaucugaaaugcagacagcugu

SEQ ID NO: 150047 - RNA, 62 nt, Homo Sapiens
ugauaagggccaaaggagcauaccugaacuugccucuggagaugugugacaaaauucagauc

SEQ ID NO: 150048 - RNA, 62 nt, Homo Sapiens
gcucuguggggagagauacagaccccuuuacuccucuggaggucucaggccagcuucucugu

SEQ ID NO: 150049 - RNA, 62 nt, Homo Sapiens
gugcccaagucaggguccagggcccugccccaccucuggacaggccuucuuguaagaggcca

SEQ ID NO: 150050 - RNA, 62 nt, Homo Sapiens
ugugcugcacugcuucagccccucccuucucaccucuggagccugcaaggcuggggucugcc

SEQ ID NO: 150051 - RNA, 62 nt, Homo Sapiens
ggccacuuggccaaagcgcccccugcugccucccucuggaguauggucaggucccauguugu

SEQ ID NO: 150052 - RNA, 62 nt, Homo Sapiens
ccugucuucauuguuucagguauuucuuuaccccucuggauuccccacgggcuggaucgaga

SEQ ID NO: 150053 - RNA, 62 nt, Homo Sapiens
guucuccucuucucucacgggcggcucgcccgccucuggaucagcuggccuccgaagagccg

SEQ ID NO: 150054 - RNA, 62 nt, Homo Sapiens
aacagauaccccacucgccacuaugcccaaacccucuggaugcugaaaaaugccacuuucgg

SEQ ID NO: 150055 - RNA, 62 nt, Homo Sapiens
uauguaaugcuuccaaucuuugacucucugacccucuggaaacucucacccauaaacaguaa

SEQ ID NO: 150056 - RNA, 62 nt, Homo Sapiens
uugugagaauugugcuuucauaugaacuauugccucuggacggauagcgcauauauuugcag

SEQ ID NO: 150057 - RNA, 62 nt, Homo Sapiens
uugaggaagugaacauuucgaagaaacagaauccucuggaacaauacuggcucugucugagu

SEQ ID NO: 150058 - RNA, 62 nt, Homo Sapiens
agccgccaagguugaccucagcuucggagccaccucuggaugaacugcccccagcccccgcc

SEQ ID NO: 150059 - RNA, 62 nt, Homo Sapiens
uccacccuuuugccuggcuccuggcaccuguaccucuggacucuccuaucgggggauuaaaa

SEQ ID NO: 150060 - RNA, 62 nt, Homo Sapiens
ucccaagaccuccccccucgucaccagccaucccucuggaccaggcagagggcggaccgggu

SEQ ID NO: 150061 - RNA, 62 nt, Homo Sapiens
auaaaaauaaaaauaaauauuggcgggggaacccucuggaaucaauaaaggcuuccuuaacc

SEQ ID NO: 150062 - RNA, 62 nt, Homo Sapiens
gcuccacgugcuuacugaggacaucagguccaccucuggaccccuuggcaggccacagaggg

SEQ ID NO: 150063 - RNA, 62 nt, Homo Sapiens
aaaaaagaaagcacaacaccuuucccaugccuccucuggagccuucgccuggggagacagaa

SEQ ID NO: 150064 - RNA, 62 nt, Homo Sapiens
cauccuggguucaagugauucuccugccucagccucuggaggagcugguaucacaggcgucc

SEQ ID NO: 150065 - RNA, 62 nt, Homo Sapiens
cccagucugcuugucucccuuucccuugcaggccucuggagccucgugccuggcccggacau

SEQ ID NO: 150066 - RNA, 62 nt, Homo Sapiens
agagaggaaaaccaugacaggcaaaugcauuuccucuggaguuugagacccugacaaacaac

SEQ ID NO: 150067 - RNA, 62 nt, Homo Sapiens
cuccagaagggguucugggccuaguuguccucccucuggagccccguccuguggucugccuc

SEQ ID NO: 150068 - RNA, 62 nt, Homo Sapiens
gcaacauuuaacuucucgcacaugguucccguccucuggagcucugucuugucggggagaug

SEQ ID NO: 150069 - RNA, 62 nt, Homo Sapiens
ccccaaggcagguggccuccacggcugcugcuccucuggacuauccggcccccacagcucuc

SEQ ID NO: 150070 - RNA, 62 nt, Homo Sapiens
ugugcguucugcauagaauuguggccccauagccucuggaacccccuaggucugggugggca

SEQ ID NO: 150071 - RNA, 62 nt, Homo Sapiens
agagcgcuguggagccccuccaccauguugacccucuggaggcagcugucugcagggaacgc

SEQ ID NO: 150072 - RNA, 62 nt, Homo Sapiens
uacuuggcucugccccaugggccuccaagccaccucuggaaaccucuccccgccaccccagg

SEQ ID NO: 150073 - RNA, 62 nt, Homo Sapiens
acucaggauucucacgacuccugguuugaaagccucuggaaaguucccauuuucgcuuuccu

SEQ ID NO: 150074 - RNA, 62 nt, Homo Sapiens
guggugaaccugaagcaugcgacuaaccagucccucuggaugaaucuaaguagaacugcauu

SEQ ID NO: 150075 - RNA, 62 nt, Homo Sapiens
ugugguucccagggaugggcagggggaggcccccucuggaaaagggggccaaugggggccuc

SEQ ID NO: 150076 - RNA, 62 nt, Homo Sapiens
acugcuuuuugaauugagaaguggugaaagaaccucuggauauugaaacacaagaaaagaga

SEQ ID NO: 150077 - RNA, 62 nt, Homo Sapiens
uggccuugcccgguccccuuaucacccacaacccucuggaagacccgcagacccuuaaaaaa

SEQ ID NO: 150078 - RNA, 62 nt, Homo Sapiens
cguaaccuaugucagacacuugccaggcagauccucuggacagggcagggguagcuagcgug

SEQ ID NO: 150079 - RNA, 62 nt, Homo Sapiens
aggucuggaggggccauggggccggagaagggccucuggagcagcggggagagcacggggua

SEQ ID NO: 150080 - RNA, 62 nt, Homo Sapiens
aggucucuguugacuggcugccugcccgcagaccucuggauuucccuguccuuuucauagcu

SEQ ID NO: 150081 - RNA, 62 nt, Homo Sapiens
agcugggacuacagacaugccuuccaccucagccucuggaguacucccagacucaagugauc

SEQ ID NO: 150082 - RNA, 62 nt, Homo Sapiens
gccaccaagauaucugagcaggcucgugggacccucuggacagccacagcaggugggggcag

SEQ ID NO: 150083 - RNA, 62 nt, Homo Sapiens
guccccagagacccacgcccagcccaccuccaccucuggaggcaccaggcagccaggccauc

SEQ ID NO: 150084 - RNA, 62 nt, Homo Sapiens
uugcaguggcugaaggaugcgaagaccuggucccucuggaggaggaacgaagauuuccugaa

SEQ ID NO: 150085 - RNA, 62 nt, Homo Sapiens
gauggguguccccuggugccagguggggagggccucuggacagcagccccccacgcuucugg

SEQ ID NO: 150086 - RNA, 62 nt, Homo Sapiens
cuggccaaugaaauaucuccaaugggcuccauccucuggauuuuucaaccagaguuccaacc

SEQ ID NO: 150087 - RNA, 62 nt, Homo Sapiens
cuaagacuccgccccugaggugcccugacuccccucuggacaucccgcccuggaccuccagc

SEQ ID NO: 150088 - RNA, 60 nt, Homo Sapiens
agacaauggaugcaaacagccacccccagaccucuggaggcugagauccgccuggaguga

SEQ ID NO: 150089 - RNA, 50 nt, Homo Sapiens
agauuugaaagccaggauggccucuggagcagcagccccuccccagauaa

SEQ ID NO: 150090 - RNA, 62 nt, Homo Sapiens
cccaggaggcuggugccaggcccacauucucuccucuggaccgcccucaucacccugacacc

SEQ ID NO: 150091 - RNA, 62 nt, Homo Sapiens
ucccaccaggcuauuaaaggcccaccccuccaccucuggaggggguagcugggcccaggcaa

SEQ ID NO: 150092 - RNA, 62 nt, Homo Sapiens
agaugaggguuccuaaaccuuaaaccucucugccucuggaggagggugggguauucuggcag

SEQ ID NO: 150093 - RNA, 62 nt, Homo Sapiens
ucacagaagcagcuaaaccaaggacugagcacccucuggauucugaaucucaagaugggggc

SEQ ID NO: 150094 - RNA, 62 nt, Homo Sapiens
gcuauguauuagccgaugucuuuaguguugagccucuggauucuggggucugggccaguggc

SEQ ID NO: 150095 - RNA, 62 nt, Homo Sapiens
acacuucccacugauccauggggccuuuaagcccucuggaagcuuccauuaaagaugauuau

SEQ ID NO: 150096 - RNA, 62 nt, Homo Sapiens
ugccaaguggagcugucauuuaauuugaugcaccucuggauucagaugaaacauuaaauugu

SEQ ID NO: 150097 - RNA, 62 nt, Homo Sapiens
ugcagagucgccuuaguccagaaccugacaggccucuggagccaggcgacuucuugggaaac

SEQ ID NO: 150098 - RNA, 62 nt, Homo Sapiens
ggcaggcucccucugggcaucccuggaugcagccucuggacacaugccuccuuuaaaguguc

SEQ ID NO: 150099 - RNA, 62 nt, Homo Sapiens
gucgugcuuccauggcuugcuacggagagagaccucuggauccacacuggggcugcgucugg

SEQ ID NO: 150100 - RNA, 62 nt, Homo Sapiens
ggcuagaguccucacucccaacucccuccucaccucuggacuauaaagaugcaaggaccagg

SEQ ID NO: 150101 - RNA, 62 nt, Homo Sapiens
guagggucuauggcgagggaccaugaccuucaccucuggagaccugcuguggaaggaauugg

SEQ ID NO: 150102 - RNA, 62 nt, Homo Sapiens
cuucuggacuggccagcccaccugccugccucccucuggagccacgccgagggccccgggac

SEQ ID NO: 150103 - RNA, 62 nt, Homo Sapiens
accuucuucaaccggaaauggcuggccgcugcccucuggagaauccuuucagaugaucaugg

SEQ ID NO: 150104 - RNA, 62 nt, Homo Sapiens
cuccuaagcaccucucaggagggccuucucagccucuggacucccaccauuucuccucaccu

SEQ ID NO: 150105 - RNA, 62 nt, Homo Sapiens
uugauuuuuguguaucugaguaaaugcuuugcccucuggaacugcucguuguggacuguaau

SEQ ID NO: 150106 - RNA, 62 nt, Homo Sapiens
cacagcuguugcgucaggcacgagucccacccccucuggagguuccgugucagaaacaguac

SEQ ID NO: 150107 - RNA, 62 nt, Homo Sapiens
ugggauuugggaggacacaggcugggccgcggccucuggagcugaacacccaaaugccccac

SEQ ID NO: 150108 - RNA, 62 nt, Homo Sapiens
cuauggauuugguuucuuccccaagugugaaaccucuggaucucaugacuugggagcuaagc

SEQ ID NO: 150109 - RNA, 62 nt, Homo Sapiens
uguccagaagcuuuaccaucgugcuguguaugccucuggaugguuuuaaggguugcucacug

SEQ ID NO: 150110 - RNA, 62 nt, Homo Sapiens
gcaacgaaggcaaugcugcuaccagccagaagccucuggaaggguggacuccguggggcucc

SEQ ID NO: 150111 - RNA, 62 nt, Homo Sapiens
aacuccugggcuugagcaagucuuccccucagccucuggaguagcugggccuacagugugug

SEQ ID NO: 150112 - RNA, 62 nt, Homo Sapiens
gcccuggcugcuccaaaaccaaaaagcuggguccucuggaggaggggcgagcuguggagcag

SEQ ID NO: 150113 - RNA, 62 nt, Homo Sapiens
acggaugcucaagguuccugggcagaccagcaccucuggaggacaauggacaaaaugucucu

SEQ ID NO: 150114 - RNA, 62 nt, Homo Sapiens
uuugccauaaggaaagcgggucaauagggcugccucuggauagcauuacuucaaagcugggu

SEQ ID NO: 150115 - RNA, 62 nt, Homo Sapiens
gauggauuguguccuaggaagacuuuucuuuuccucuggauuuuuguuccuccuguacaaga

SEQ ID NO: 150116 - RNA, 62 nt, Homo Sapiens
uucuuggaugucccaguugaaucagaaggggaccucuggaguacacaccucucuccugggcg

SEQ ID NO: 150117 - RNA, 62 nt, Homo Sapiens
uauucucucucagccacagugagcaaauucauccucuggaaaugagaagcacuuggcuggcu

SEQ ID NO: 150118 - RNA, 62 nt, Homo Sapiens
gucaguguggcguaggcagucucaggagggggccucuggaccagugccccuugcuggccgcc

SEQ ID NO: 150119 - RNA, 62 nt, Homo Sapiens
cugcaggccagaugguugcuacgccugacuccccucuggaaaguucacuccagucccacccc

SEQ ID NO: 150120 - RNA, 62 nt, Homo Sapiens
cccagccaggggcuuggaaagccccugcccucccucuggacccagggagccggcaggaggug

SEQ ID NO: 150121 - RNA, 62 nt, Homo Sapiens
cugaccaauuacuucauuuugcaggguucuccccucuggagugagacugcgaggaucuccag

SEQ ID NO: 150122 - RNA, 62 nt, Homo Sapiens
ugugcuccucacaaaguuucgcugcugugggcccucuggaauugucacgccaggaggcugug

SEQ ID NO: 150123 - RNA, 62 nt, Homo Sapiens
caauggguuguugcugccaugagcauguacaaccucuggagcuagaagcuccucaggaaagc

SEQ ID NO: 150124 - RNA, 62 nt, Homo Sapiens
uuccuccucccaaggcauucucccagcucuagccucuggacuggaaagcacaagacuggccc

SEQ ID NO: 150125 - RNA, 62 nt, Homo Sapiens
caaaugcuuuuccaacccaugagugcuaagagccucuggaagggagggcuucaggcccgaag

SEQ ID NO: 150126 - RNA, 62 nt, Homo Sapiens
cccaaacccauuuuagagacagaagaaacuacccucuggagauaaaauaaaaagaugaagcu

SEQ ID NO: 150127 - RNA, 62 nt, Homo Sapiens
uuuaacucuagaaauucucaguaugggguuucccucuggaaaaagaaaaucugaagacauua

SEQ ID NO: 150128 - RNA, 62 nt, Homo Sapiens
agaggaacauuccauuuauuuguaguggauuuccucuggagggcauguacccacacuaaaua

SEQ ID NO: 150129 - RNA, 62 nt, Homo Sapiens
cauuuuugaaagcagcucccgaaugacagguuccucuggagaaagcggauccaaagacccag

SEQ ID NO: 150130 - RNA, 62 nt, Homo Sapiens
ucacaguguugugcaccaggacugggcacuucccucuggaaaacaacaguaucuuaaguuua

SEQ ID NO: 150131 - RNA, 62 nt, Homo Sapiens
ucugauucagccagcauggagcucuggucccaccucuggaaagagcucuuuaaaaauaaauu

SEQ ID NO: 150132 - RNA, 62 nt, Homo Sapiens
ucuuagccagaggaauaaacaaccucaaauuaccucuggaucgaacuuuaaaaagaaaugua

SEQ ID NO: 150133 - RNA, 62 nt, Homo Sapiens
ccuagaguuuaaaguuuuaaacugguugaaugccucuggagaaaggcaauaaguaaauaugu

SEQ ID NO: 150134 - RNA, 62 nt, Homo Sapiens
aagauaauauauucaaaaaaauuaauguaauuccucuggauauacauaauaccuucuuagcc

SEQ ID NO: 150135 - RNA, 62 nt, Homo Sapiens
ccaucuuguuccagccucugcuagcaaaggggccucuggagaaaugagaaugauaaauuauc

SEQ ID NO: 150136 - RNA, 62 nt, Homo Sapiens
aguccucuguauccucaugauaugucauguagccucuggaaaugagagagaugacauaacca

SEQ ID NO: 150137 - RNA, 64 nt, Homo Sapiens
cucuugcucuuguuaaagauuuguuugaauauagaagaugcaugauuucuggguuuuuuuuuuu

SEQ ID NO: 150138 - RNA, 64 nt, Homo Sapiens
gggauuacaggcauaagccacugcgcccagccagaagaugcaugauuucuuaggaucauaugcu

SEQ ID NO: 150139 - RNA, 64 nt, Homo Sapiens
gccagaucaacaguuagauuucaggauucugucaaagaugcagucucucccuucaccuccagga

SEQ ID NO: 150140 - RNA, 64 nt, Homo Sapiens
ugcugugacaagguaaggaaucaauuuuuuuuggaagaugcaauggucguacauuuccuguuga

SEQ ID NO: 150141 - RNA, 64 nt, Homo Sapiens
uaugcucuuguuuuuucccucuaauagcuauggaaagaugcauagaaagaguauaauguuuuaa

SEQ ID NO: 150142 - RNA, 64 nt, Homo Sapiens
uucacaugaaaaaaaucaauuuauuugaaaaggcaagaugcaggagagaggaagccuugcaaac

SEQ ID NO: 150143 - RNA, 64 nt, Homo Sapiens
aaaaggaauccgugacccacagagcuagacagauaagaugcauaguugaccagucauaaaaggc

SEQ ID NO: 150144 - RNA, 64 nt, Homo Sapiens
agcaagauggguuccuuggagaagcugauuugccaagaugcacaucgcuauuaacagccagagu

SEQ ID NO: 150145 - RNA, 64 nt, Homo Sapiens
auuuggugcuuuguuuuccuucauauaaugcccgaagaugcagcucugaggucauuauugaggu

SEQ ID NO: 150146 - RNA, 64 nt, Homo Sapiens
auauacuuuucucauuuuuaaagugcauuacuuaaagaugcaguuggaaaaaacccagagagca

SEQ ID NO: 150147 - RNA, 64 nt, Homo Sapiens
ccgaucgccagcuccguggcugcuccuggguuugaagaugcagguugccagccucugcugcucc

SEQ ID NO: 150148 - RNA, 64 nt, Homo Sapiens
aggaggaaguuagugcuuacugggucuucuguggaagaugcagaagaaagagaaugcccacaag

SEQ ID NO: 150149 - RNA, 64 nt, Homo Sapiens; identical to SEQ ID NO: 119606

SEQ ID NO: 150150 - RNA, 64 nt, Homo Sapiens; identical to SEQ ID NO: 119607

SEQ ID NO: 150151 - RNA, 64 nt, Homo Sapiens; identical to SEQ ID NO: 119608

SEQ ID NO: 150152 - RNA, 64 nt, Homo Sapiens; identical to SEQ ID NO: 119609

SEQ ID NO: 150153 - RNA, 64 nt, Homo Sapiens; identical to SEQ ID NO: 119610

SEQ ID NO: 150154 - RNA, 64 nt, Homo Sapiens; identical to SEQ ID NO: 119611

SEQ ID NO: 150155 - RNA, 64 nt, Homo Sapiens; identical to SEQ ID NO: 119612

SEQ ID NO: 150156 - RNA, 64 nt, Homo Sapiens; identical to SEQ ID NO: 119613

SEQ ID NO: 150157 - RNA, 64 nt, Homo Sapiens; identical to SEQ ID NO: 119614

SEQ ID NO: 150158 - RNA, 64 nt, Homo Sapiens; identical to SEQ ID NO: 119615

SEQ ID NO: 150159 - RNA, 64 nt, Homo Sapiens; identical to SEQ ID NO: 119616

SEQ ID NO: 150160 - RNA, 64 nt, Homo Sapiens; identical to SEQ ID NO: 119617

SEQ ID NO: 150161 - RNA, 64 nt, Homo Sapiens; identical to SEQ ID NO: 119618

SEQ ID NO: 150162 - RNA, 64 nt, Homo Sapiens; identical to SEQ ID NO: 119619

SEQ ID NO: 150163 - RNA, 64 nt, Homo Sapiens; identical to SEQ ID NO: 119620

SEQ ID NO: 150164 - RNA, 64 nt, Homo Sapiens; identical to SEQ ID NO: 119621

SEQ ID NO: 150165 - RNA, 64 nt, Homo Sapiens; identical to SEQ ID NO: 119622

SEQ ID NO: 150166 - RNA, 64 nt, Homo Sapiens; identical to SEQ ID NO: 119623

SEQ ID NO: 150167 - RNA, 64 nt, Homo Sapiens; identical to SEQ ID NO: 119624

SEQ ID NO: 150168 - RNA, 64 nt, Homo Sapiens; identical to SEQ ID NO: 119625

SEQ ID NO: 150169 - RNA, 64 nt, Homo Sapiens; identical to SEQ ID NO: 119626

SEQ ID NO: 150170 - RNA, 64 nt, Homo Sapiens; identical to SEQ ID NO: 119627

SEQ ID NO: 150171 - RNA, 64 nt, Homo Sapiens; identical to SEQ ID NO: 119628

SEQ ID NO: 150172 - RNA, 64 nt, Homo Sapiens; identical to SEQ ID NO: 119629

SEQ ID NO: 150173 - RNA, 64 nt, Homo Sapiens; identical to SEQ ID NO: 119630

SEQ ID NO: 150174 - RNA, 64 nt, Homo Sapiens; identical to SEQ ID NO: 119631

SEQ ID NO: 150175 - RNA, 64 nt, Homo Sapiens
ugcuggggcuucagcccgccacgccaagcuggugcagcggcagagcuggcccagggcggccucu

SEQ ID NO: 150176 - RNA, 64 nt, Homo Sapiens
cucaucgccuucaucaucuaucaggccagaugaccagcggcaacacgggggccaccuugucauc

SEQ ID NO: 150177 - RNA, 64 nt, Homo Sapiens; identical to SEQ ID NO: 117299

SEQ ID NO: 150178 - RNA, 64 nt, Homo Sapiens; identical to SEQ ID NO: 117300

SEQ ID NO: 150179 - RNA, 64 nt, Homo Sapiens; identical to SEQ ID NO: 117301

SEQ ID NO: 150180 - RNA, 64 nt, Homo Sapiens; identical to SEQ ID NO: 117302

SEQ ID NO: 150181 - RNA, 64 nt, Homo Sapiens; identical to SEQ ID NO: 117303

SEQ ID NO: 150182 - RNA, 64 nt, Homo Sapiens; identical to SEQ ID NO: 117304

SEQ ID NO: 150183 - RNA, 64 nt, Homo Sapiens; identical to SEQ ID NO: 117305

SEQ ID NO: 150184 - RNA, 64 nt, Homo Sapiens; identical to SEQ ID NO: 117306

SEQ ID NO: 150185 - RNA, 64 nt, Homo Sapiens; identical to SEQ ID NO: 117307

SEQ ID NO: 150186 - RNA, 64 nt, Homo Sapiens; identical to SEQ ID NO: 117308

SEQ ID NO: 150187 - RNA, 64 nt, Homo Sapiens; identical to SEQ ID NO: 117309

SEQ ID NO: 150188 - RNA, 64 nt, Homo Sapiens; identical to SEQ ID NO: 117310

SEQ ID NO: 150189 - RNA, 64 nt, Homo Sapiens; identical to SEQ ID NO: 117311

SEQ ID NO: 150190 - RNA, 64 nt, Homo Sapiens; identical to SEQ ID NO: 117312

SEQ ID NO: 150191 - RNA, 64 nt, Homo Sapiens; identical to SEQ ID NO: 117313

SEQ ID NO: 150192 - RNA, 64 nt, Homo Sapiens; identical to SEQ ID NO: 117314

SEQ ID NO: 150193 - RNA, 64 nt, Homo Sapiens; identical to SEQ ID NO: 117315

SEQ ID NO: 150194 - RNA, 64 nt, Homo Sapiens; identical to SEQ ID NO: 117316

SEQ ID NO: 150195 - RNA, 64 nt, Homo Sapiens; identical to SEQ ID NO: 117317

SEQ ID NO: 150196 - RNA, 64 nt, Homo Sapiens; identical to SEQ ID NO: 117318

SEQ ID NO: 150197 - RNA, 64 nt, Homo Sapiens; identical to SEQ ID NO: 117319

SEQ ID NO: 150198 - RNA, 64 nt, Homo Sapiens; identical to SEQ ID NO: 117320

SEQ ID NO: 150199 - RNA, 64 nt, Homo Sapiens; identical to SEQ ID NO: 117321

SEQ ID NO: 150200 - RNA, 64 nt, Homo Sapiens; identical to SEQ ID NO: 117322

SEQ ID NO: 150201 - RNA, 64 nt, Homo Sapiens; identical to SEQ ID NO: 117323

SEQ ID NO: 150202 - RNA, 64 nt, Homo Sapiens; identical to SEQ ID NO: 117324

SEQ ID NO: 150203 - RNA, 64 nt, Homo Sapiens; identical to SEQ ID NO: 117325

SEQ ID NO: 150204 - RNA, 64 nt, Homo Sapiens; identical to SEQ ID NO: 117326

SEQ ID NO: 150205 - RNA, 64 nt, Homo Sapiens; identical to SEQ ID NO: 117327

SEQ ID NO: 150206 - RNA, 64 nt, Homo Sapiens; identical to SEQ ID NO: 117328

SEQ ID NO: 150207 - RNA, 64 nt, Homo Sapiens
ccucugccucccaggcucaagcaauccucccacuucagucuaaguagcugggacuacaggcacg

SEQ ID NO: 150208 - RNA, 64 nt, Homo Sapiens
gggauaacugagggaagagaagugacaauuccacucagucuauuagaggucuggauauaaggua

SEQ ID NO: 150209 - RNA, 64 nt, Homo Sapiens
ugacucuaucaggagcuuuuuacauccuuaguuuucagucuacuguucacucuaaaagcugaac

SEQ ID NO: 150210 - RNA, 64 nt, Homo Sapiens
gucccaguaaaaguaaagauuauguauuaucugaucagucuaugaacuguccagaagugugggc

SEQ ID NO: 150211 - RNA, 64 nt, Homo Sapiens
gaccacacucuaguuguuuuaguaacacuguaugucagucuacauggaagucagucuaccguau

SEQ ID NO: 150212 - RNA, 64 nt, Homo Sapiens
guauaguaacacuguauguccagucagcuggaagucagucuaccgucacaagcuucaguaaggc

SEQ ID NO: 150213 - RNA, 64 nt, Homo Sapiens
ucucguauuugcuuugcuguucccucuuugcaguucagucuaagccauuggugaaauggcccuu

SEQ ID NO: 150214 - RNA, 64 nt, Homo Sapiens
acccggcucuccuggcccugccuucuuagaggguucagucuaggcuucucuuuggacacauggg

SEQ ID NO: 150215 - RNA, 64 nt, Homo Sapiens
uggggccaacaucuccaagacaaaguuuuucagaaaagaggaaaaaaagaauuuaaaaaaggau

SEQ ID NO: 150216 - RNA, 64 nt, Homo Sapiens
uauacgcuggaaauugacuccccuuucccuucccaaagaggauaggaccucccaggaugcuucc

SEQ ID NO: 150217 - RNA, 64 nt, Homo Sapiens
cuaaacaaacaggccucucaaagcacagggacacaaagaggaauaggagcauccuuaccuccaa

SEQ ID NO: 150218 - RNA, 64 nt, Homo Sapiens
caacacauauuuuuauauuaacccugucuuaaaaaaagaggauuagccugggugacagagcaag

SEQ ID NO: 150219 - RNA, 64 nt, Homo Sapiens
ugucaggaaucaagccacugauaagauuccucuuaaagaggaaaacaugauuucagaagaugac

SEQ ID NO: 150220 - RNA, 64 nt, Homo Sapiens
agaauauuuuguguguuccucuggauugcaaaagaaagaggagaauuauuuuuuggcuccaaaa

SEQ ID NO: 150221 - RNA, 64 nt, Homo Sapiens
uuuauuuagaugguugguguauauuugguaaaauaaagaggacggucaacuuaacugauaaauu

SEQ ID NO: 150222 - RNA, 64 nt, Homo Sapiens
uagaacuagcaggguggacauuaccaagcacccaaaagaggauuucccuucccuccaccucucc

SEQ ID NO: 150223 - RNA, 64 nt, Homo Sapiens
aaagggcaaauugaaagucaaggagaaaaagcgcaaagaggagaaugaagauccagaaaggaaa

SEQ ID NO: 150224 - RNA, 64 nt, Homo Sapiens
gggcuucggcgccaugcugagauuuggaaagaagaaagaggauaaggguggaaaggcugagcag

SEQ ID NO: 150225 - RNA, 64 nt, Homo Sapiens
uguucacuuuuuuaauacacguagaagagagaagaaagaggaagaaacaugauucuaguuaaau

SEQ ID NO: 150226 - RNA, 64 nt, Homo Sapiens
gugcauuuuugcuauuuaaauugaguagaggccuaaagaggacuaagaguaauguaaacuauua

SEQ ID NO: 150227 - RNA, 64 nt, Homo Sapiens
ugggaggcuugguagcaaaguaacauuuuuuggaaaagaggacagaaaaauugaacuacagcuu

SEQ ID NO: 150228 - RNA, 64 nt, Homo Sapiens
ccagagugagcaaggauuauguuuuuggauugucaaagaggaugcuuagucuuaaaauaaaaau

SEQ ID NO: 150229 - RNA, 64 nt, Homo Sapiens
aaaacaaaacucauuagaauugucaaaucgcauaaaagaggaaauuuuguucucaguggaaccc

SEQ ID NO: 150230 - RNA, 64 nt, Homo Sapiens
gugggagauugggacagcugguugagugauugugaaagaggaauaggggaugugugaccuguuu

SEQ ID NO: 150231 - RNA, 64 nt, Homo Sapiens
gcccuucccacuggaggucacauucaggaagaugaaagaggagguuuggggucugccaccaucc

SEQ ID NO: 150232 - RNA, 64 nt, Homo Sapiens
ggacuggaaccagggagaccgagcgcuuucuggaaaagaggaguuucgagguagaguuugaagg

SEQ ID NO: 150233 - RNA, 64 nt, Homo Sapiens
uccgcaugggacuuguccaaaaaaacucuaaucaaaagaggaaaauuuuggaauaugccaggaa

SEQ ID NO: 150234 - RNA, 64 nt, Homo Sapiens
aauaccuacccuagaguacauaaaaauuauauuaaaagaggaaguagcaguaugcauaauuuua

SEQ ID NO: 150235 - RNA, 64 nt, Homo Sapiens
uuguuccuguccauucacccagccaaauuguguuaaagaggaaagccccacaaacuaaaacagc

SEQ ID NO: 150236 - RNA, 64 nt, Homo Sapiens
uugguuuauauucugguugucuuuuucuuuuuguaaagaggaaacaauguacagaaaaacaaua

SEQ ID NO: 150237 - RNA, 64 nt, Homo Sapiens
uccagcugcucagcugcagaucaaacacgaacucaaagaggacaacagaccacacugcaggaag

SEQ ID NO: 150238 - RNA, 64 nt, Homo Sapiens
aggagcgccuccggcagaagucagugaugugaagaaagaggaggacagaucaucuuucguaaga

SEQ ID NO: 150239 - RNA, 64 nt, Homo Sapiens
acaccaguaauggcacucuuccuaggacgggacuaaagaggacgccguccuuaaaaccugacgu

SEQ ID NO: 150240 - RNA, 64 nt, Homo Sapiens
uauuucccacaggaguccauuggguucagcuuugaaagaggaauagaaucgaggcuccuuugac

SEQ ID NO: 150241 - RNA, 64 nt, Homo Sapiens
ggucuaugucgagagcuggccaaagagccuuuccaaagaggagcgaugggccccuggccccgcc

SEQ ID NO: 150242 - RNA, 64 nt, Homo Sapiens
caugaggagggaaaagagugccuaagcgggggugaaagaggacguguuacccacugccaugcac

SEQ ID NO: 150243 - RNA, 64 nt, Homo Sapiens
aauaaaaccuuuucuccccuaaacuuuaaaaaaaaaagaggagacauauuuuuucaggaaaaac

SEQ ID NO: 150244 - RNA, 64 nt, Homo Sapiens
agaaaaauguacaaaaagauggaaaggccaaaaaaaagaggaaaaagaccacagaaaagagaaa

SEQ ID NO: 150245 - RNA, 64 nt, Homo Sapiens
gcuuuaugcccaugaugucauuucaggcucaaccaaagaggaucaaacaggaauuccaucuugg

SEQ ID NO: 150246 - RNA, 64 nt, Homo Sapiens
cagcugagaacagauuugacucacagacauuaccaaagaggagcuugugaauccaggaaaagcu

SEQ ID NO: 150247 - RNA, 64 nt, Homo Sapiens
aaagcucaagaggaaaagcuaaaaauugcucaaaaaagaggagaaaauauauaaacaaacaaac

SEQ ID NO: 150248 - RNA, 64 nt, Homo Sapiens
agacaguaagaguuuacaagaauauucauacaacaaagaggauugauucccgcaugguuuuuau

SEQ ID NO: 150249 - RNA, 64 nt, Homo Sapiens; identical to SEQ ID NO: 130383

SEQ ID NO: 150250 - RNA, 64 nt, Homo Sapiens; identical to SEQ ID NO: 130384

SEQ ID NO: 150251 - RNA, 64 nt, Homo Sapiens; identical to SEQ ID NO: 130385

SEQ ID NO: 150252 - RNA, 64 nt, Homo Sapiens; identical to SEQ ID NO: 130386

SEQ ID NO: 150253 - RNA, 64 nt, Homo Sapiens; identical to SEQ ID NO: 130387

SEQ ID NO: 150254 - RNA, 64 nt, Homo Sapiens; identical to SEQ ID NO: 130388

SEQ ID NO: 150255 - RNA, 64 nt, Homo Sapiens; identical to SEQ ID NO: 130389

SEQ ID NO: 150256 - RNA, 64 nt, Homo Sapiens; identical to SEQ ID NO: 130390

SEQ ID NO: 150257 - RNA, 64 nt, Homo Sapiens; identical to SEQ ID NO: 130391

SEQ ID NO: 150258 - RNA, 64 nt, Homo Sapiens; identical to SEQ ID NO: 130392

SEQ ID NO: 150259 - RNA, 64 nt, Homo Sapiens; identical to SEQ ID NO: 130393

SEQ ID NO: 150260 - RNA, 64 nt, Homo Sapiens; identical to SEQ ID NO: 130394

SEQ ID NO: 150261 - RNA, 64 nt, Homo Sapiens; identical to SEQ ID NO: 130395

SEQ ID NO: 150262 - RNA, 64 nt, Homo Sapiens; identical to SEQ ID NO: 130396

SEQ ID NO: 150263 - RNA, 64 nt, Homo Sapiens
cauauuauuuuauaaaauguuuucuguauggcaauaaacugaaaacauggaucaacccuucuuu

SEQ ID NO: 150264 - RNA, 64 nt, Homo Sapiens
aacugaaaacauggaucaacccuucuuuugaaaauaaacugagucaauuuagccuuuuaaaaau

SEQ ID NO: 150265 - RNA, 64 nt, Homo Sapiens
gguugcugguuaguuugguagggcccugugcuucuaaacugagucagacagggucaugggaagg

SEQ ID NO: 150266 - RNA, 64 nt, Homo Sapiens
cacuuuuagcagcagacuuuuguuguaaauuugcuaaacugauucucuuaaccgucaacaucag

SEQ ID NO: 150267 - RNA, 64 nt, Homo Sapiens
cuccauuuguugacagacaaagccaacaauacucuaaacugaggccugcaagucauuucauuug

SEQ ID NO: 150268 - RNA, 64 nt, Homo Sapiens
caaugcugacaguuggagccaaugccucauaguguaaacugaaagaaaaauaguugcuuuuuaa

SEQ ID NO: 150269 - RNA, 64 nt, Homo Sapiens
ugauauauugcuguuaucaaucauuucuagauuauaaacugacuaaacuuacaucagggaaaaa

SEQ ID NO: 150270 - RNA, 64 nt, Homo Sapiens
acaguggagggaagucuuccuuccugaaggaaaauaaacugacacuuauuaacuaagauaauuu

SEQ ID NO: 150271 - RNA, 64 nt, Homo Sapiens
ggcugaccuacucuggagcacggugucuuccuucuaaacugagugacuguaguacuaucugugc

SEQ ID NO: 150272 - RNA, 64 nt, Homo Sapiens
ugagaaaagggcuacagugcauuucuugguaacuuaaacugagucuugaaguuauaaugaucca

SEQ ID NO: 150273 - RNA, 64 nt, Homo Sapiens
agucucaguauggcuauuaauacauuuuucuuaauaaacugaaguuuuaaaaugccugaggaaa

SEQ ID NO: 150274 - RNA, 64 nt, Homo Sapiens
uaaagaaguggaaugaggagcucuaauauucacauaaacugaaaugaucucaccugucgcguag

SEQ ID NO: 150275 - RNA, 64 nt, Homo Sapiens
aggaugcuaaaauaaaagucaguaagaagcuauguaaacugacaggugggagagcuuuuaguua

SEQ ID NO: 150276 - RNA, 64 nt, Homo Sapiens
uugcaauauuuuugcaaaaacaaaccuacaaaaauaaacugaaccuguuuugguauauuguaca

SEQ ID NO: 150277 - RNA, 64 nt, Homo Sapiens
ugaguucugaaaggagccagcagaguuguucucuuaaacugauaagccaagccauuucugucuc

SEQ ID NO: 150278 - RNA, 64 nt, Homo Sapiens
ggcuggggcuugcccuuagauguuguguugucacuaaacugaaaacuuuuguuccuuuguuaac

SEQ ID NO: 150279 - RNA, 64 nt, Homo Sapiens
uguuucuauuugagaaggacacuuuuucaucaucuaaacugauucgcauaggugguuagaaugg

SEQ ID NO: 150280 - RNA, 64 nt, Homo Sapiens
aauugcccugcccaagucacugucuuuuaacuuuuaaacugaauauuaaaauguaucugucuuu

SEQ ID NO: 150281 - RNA, 64 nt, Homo Sapiens
uuuucuauuuugacuguuuuauagaucucuuuccuaaacugacauucugagaaauucugaacac

SEQ ID NO: 150282 - RNA, 64 nt, Homo Sapiens
aaggaaacuguugguaaaucuccagauuaggauuuaaacugauaagucucuggcuaggucuggg

SEQ ID NO: 150283 - RNA, 64 nt, Homo Sapiens
uuguauuucauuuuauugucaaauaauuaaagcuuaaacugaauuucacauaauuacacacgug

SEQ ID NO: 150284 - RNA, 64 nt, Homo Sapiens
ugaauguuuguuucagugccaaguaacucuuaccuaaacugagcaugccuuuauuuucagggau

SEQ ID NO: 150285 - RNA, 64 nt, Homo Sapiens
acuuucuuuugacagggggguaaguuuugcaucauaaacugagauguggauaaaugaacaauug

SEQ ID NO: 150286 - RNA, 64 nt, Homo Sapiens
gguuucacaggcauuugcuuugaaaggccugcauuaaacugaauuauuuaaaaugcauuuuuau

SEQ ID NO: 150287 - RNA, 64 nt, Homo Sapiens
acauugucauguuuuauuaauuaaaaucgguauuuaaacugaagacuuuuuuuugauuggcauu

SEQ ID NO: 150288 - RNA, 64 nt, Homo Sapiens
guagaaugauaauugugguacuagguaaugacaguaaacugacugcuuccaguuaccagguugu

SEQ ID NO: 150289 - RNA, 64 nt, Homo Sapiens
gcuuaucuucacagauguggucacccuggcgauguaaacugagauaaaauaguucuguugaauu

SEQ ID NO: 150290 - RNA, 64 nt, Homo Sapiens
caaauccguuauaacaugucuuuuugcaccaagauaaacugauaaauugugcaugauaucacau

SEQ ID NO: 150291 - RNA, 64 nt, Homo Sapiens
uuauggauauaaauaugacugcuauguaauuuaauaaacugauuaaagguuugggauguauauu

SEQ ID NO: 150292 - RNA, 64 nt, Homo Sapiens
agcagaaaacagaggccacacuugaugauguguuuaaacugaguccugacauuaauuaucuauc

SEQ ID NO: 150293 - RNA, 64 nt, Homo Sapiens
aauguugauguuugaagccaaaaagccaaaugcuuaaacugaucaaugacuguagcuuuuuaga

SEQ ID NO: 150294 - RNA, 64 nt, Homo Sapiens
uuuaaaaucccuuuugcuaccccaucugguuuuauaaacugaguuucuuagcauucguuaaaau

SEQ ID NO: 150295 - RNA, 64 nt, Homo Sapiens; identical to SEQ ID NO: 100778

SEQ ID NO: 150296 - RNA, 64 nt, Homo Sapiens; identical to SEQ ID NO: 100779

SEQ ID NO: 150297 - RNA, 64 nt, Homo Sapiens; identical to SEQ ID NO: 100780

SEQ ID NO: 150298 - RNA, 64 nt, Homo Sapiens; identical to SEQ ID NO: 100781

SEQ ID NO: 150299 - RNA, 64 nt, Homo Sapiens; identical to SEQ ID NO: 100782

SEQ ID NO: 150300 - RNA, 64 nt, Homo Sapiens; identical to SEQ ID NO: 100783

SEQ ID NO: 150301 - RNA, 64 nt, Homo Sapiens; identical to SEQ ID NO: 100784

SEQ ID NO: 150302 - RNA, 64 nt, Homo Sapiens; identical to SEQ ID NO: 100785

SEQ ID NO: 150303 - RNA, 64 nt, Homo Sapiens; identical to SEQ ID NO: 100786

SEQ ID NO: 150304 - RNA, 64 nt, Homo Sapiens; identical to SEQ ID NO: 100787

SEQ ID NO: 150305 - RNA, 64 nt, Homo Sapiens; identical to SEQ ID NO: 100788

SEQ ID NO: 150306 - RNA, 64 nt, Homo Sapiens; identical to SEQ ID NO: 100789

SEQ ID NO: 150307 - RNA, 64 nt, Homo Sapiens; identical to SEQ ID NO: 100790

SEQ ID NO: 150308 - RNA, 63 nt, Homo Sapiens
uguuuuucugggccuuguuugguucuucccuccugcccucaauuggaagguaucauccgugug

SEQ ID NO: 150309 - RNA, 63 nt, Homo Sapiens
augagagaacauuaaacuacaaguagacacuauugcccucagauuucaaaggcuaccuuuaug

SEQ ID NO: 150310 - RNA, 63 nt, Homo Sapiens
cacaagcgggugacugacugcucauccuccgcaugcccucagccccagauccuuaauguaguu

SEQ ID NO: 150311 - RNA, 63 nt, Homo Sapiens
aagcaucauugaaauagcagagagcccaggccuugcccucauggagcaccauccugcccuagc

SEQ ID NO: 150312 - RNA, 63 nt, Homo Sapiens
cagagaguaagaaagcccaaacucacaaaugugugcccucagccuuucuuuaucaaccugcuc

SEQ ID NO: 150313 - RNA, 63 nt, Homo Sapiens
caugcaagugaaaggaggagccuguaugugcgcugcccucagauauguguguacacgcgcacg

SEQ ID NO: 150314 - RNA, 63 nt, Homo Sapiens
ccacauauguguguacacgcacucaccauggucugcccucaccacugcauccgaaaggccccc

SEQ ID NO: 150315 - RNA, 63 nt, Homo Sapiens
gccuuugauugcucaccccugcuccccaggcccugcccucacuuuuaccaaagguucucccuc

SEQ ID NO: 150316 - RNA, 63 nt, Homo Sapiens
uugcugaaguuaguaguacuguacuaagagcucugcccucaugugaauuccugcccuggcgcc

SEQ ID NO: 150317 - RNA, 63 nt, Homo Sapiens
aguagaaccuuuccagguucucuuagagccauaugcccucaucaucccaggggagaacuacau

SEQ ID NO: 150318 - RNA, 63 nt, Homo Sapiens
gguguuacacauugaggcugucuuuaaggggccugcccucaucaucaacgucucagcccuuca

SEQ ID NO: 150319 - RNA, 63 nt, Homo Sapiens
cuuccgguggagcugccucguuccuuugaacuaugcccucacccuucugcccucacuugauuu

SEQ ID NO: 150320 - RNA, 63 nt, Homo Sapiens
gccucguuccuuugaacuaugcccucacccuucugcccucacuugauuugaaagggucguuaa

SEQ ID NO: 150321 - RNA, 63 nt, Homo Sapiens
aggaggaguggcauuggcauccugacccagcucugcccucaagguggggauggaugggcaaag

SEQ ID NO: 150322 - RNA, 63 nt, Homo Sapiens
uuggggcuggucccagccugaggcuccagcugaugcccucagcucccagagagggggugcccc

SEQ ID NO: 150323 - RNA, 63 nt, Homo Sapiens
gccuugcuucucucagccuagcagcccuuuggaugcccucacaucucaggaacaaaaccugag

SEQ ID NO: 150324 - RNA, 63 nt, Homo Sapiens
gagcucuuugcaguguagugaaagaacacagucugcccucagaucaggcagggacagacccag

SEQ ID NO: 150325 - RNA, 63 nt, Homo Sapiens
uccauuccaaaggccaucuuguggucaguuucaugcccucaccugauuuuuuuuuuuuuuuuu

SEQ ID NO: 150326 - RNA, 63 nt, Homo Sapiens
ggagaaacucacagcuccuccgggauacauaugugcccucagcagcagcucccaggugaaguu

SEQ ID NO: 150327 - RNA, 63 nt, Homo Sapiens
ucgaaugcacacucaaauaaaaaaccaaacagcugcccucauuagcggauuccguuccauuau

SEQ ID NO: 150328 - RNA, 63 nt, Homo Sapiens
acuucauuucucuuccaacccauuguguuccucugcccucauucuuuaccuuuguuguaagaa

SEQ ID NO: 150329 - RNA, 63 nt, Homo Sapiens
ucuccucggccauccuguggggccccgaggccuugcccucacuucagugccugggugcucagg

SEQ ID NO: 150330 - RNA, 63 nt, Homo Sapiens
aguaauaaaccguggguggugauagugacccagugcccucacugcccagccccgccuguccuc

SEQ ID NO: 150331 - RNA, 63 nt, Homo Sapiens
cacuacagcaaacaagcuacauggucagucucuugcccucaaacaggccagcuuucugcaugg

SEQ ID NO: 150332 - RNA, 63 nt, Homo Sapiens
ccuggccaggugaugcucugccacuccaugcucugcccucagacagagaaacaaagucuggac

SEQ ID NO: 150333 - RNA, 63 nt, Homo Sapiens
ccccgaccuuauuuauuaccccccuccaaccacugcccucagcgagcugucugcauccgccac

SEQ ID NO: 150334 - RNA, 63 nt, Homo Sapiens
agacacccuguuggccaugaugaccgguccuugugcccucaccgacccugcccggcuccuccc

SEQ ID NO: 150335 - RNA, 63 nt, Homo Sapiens
cuccccaaugcugacccuaggauuuuccuucccugcccucaccugcaaaugaguuaaagaaga

SEQ ID NO: 150336 - RNA, 63 nt, Homo Sapiens
gggacacagugguaaucaagacagccccaacacugcccucauagagcucacaguccaauggag

SEQ ID NO: 150337 - RNA, 63 nt, Homo Sapiens
caagguagagguggcaggggcuggaugcccaccugcccucagguguccaucccacagcucagc

SEQ ID NO: 150338 - RNA, 63 nt, Homo Sapiens
gcccacucugcccacacuucgagcugccugccuugcccucacugaauccaggucccccaggug

SEQ ID NO: 150339 - RNA, 63 nt, Homo Sapiens
uaagggccacucugguuaucugccaagguugcuugcccucaccccaaugcuccaacagccauu

SEQ ID NO: 150340 - RNA, 63 nt, Homo Sapiens
uaccuccucccguugggcugugacuuuuccuccugcccucagccucugaaacagaaaucuuug

SEQ ID NO: 150341 - RNA, 63 nt, Homo Sapiens
aggucguuaaaaauucaaauuuaauuuaccugaugcccucaucaagaaucuucccaaaauccu

SEQ ID NO: 150342 - RNA, 63 nt, Homo Sapiens
agugacagcagcuuagguguguaccagggguugugcccucagcugacagccucacagggucug

SEQ ID NO: 150343 - RNA, 63 nt, Homo Sapiens
cacugaugucuguccccaggcagggccuccagcugcccucagacaucugaacuuccguuuccc

SEQ ID NO: 150344 - RNA, 63 nt, Homo Sapiens
gacuggccaguccagcccagcaggcccugccccugcccucaguaagggugagggggucagaca

SEQ ID NO: 150345 - RNA, 64 nt, Homo Sapiens
uagcauuguaauggccaaauauauguaauauacacaaacucaauauuacaguguuaacugccau

SEQ ID NO: 150346 - RNA, 64 nt, Homo Sapiens
uguugcaguuguuuguaaugauuauuuaugcugccaaacucauugaagauuugaauaacuagac

SEQ ID NO: 150347 - RNA, 64 nt, Homo Sapiens
ccaucugaugccaguguugagcaccacucaaacucaaacucagucuggagguggccauuaauug

SEQ ID NO: 150348 - RNA, 61 nt, Homo Sapiens
cucaguccaucugaugccaguuggcaccacucaaacucaaacaccuggagguggccauuaa

SEQ ID NO: 150349 - RNA, 64 nt, Homo Sapiens
gagaaauaaagcucagauggaagagauaaacgaccaaacucaguucgaccaaacucaguucaaa

SEQ ID NO: 150350 - RNA, 64 nt, Homo Sapiens
gauggaagagauaaacgaccaaacucaguucgaccaaacucaguucaaaccauuucagccaaac

SEQ ID NO: 150351 - RNA, 64 nt, Homo Sapiens
cccaaggcagaagaccuaucugcauuugagcccucaaacucaccuugcagagcgccaagucccg

SEQ ID NO: 150352 - RNA, 64 nt, Homo Sapiens
ggacgggguuuugccauguuagcuaggcuggucucaaacucacaccugggauuacaggcaugag

SEQ ID NO: 150353 - RNA, 64 nt, Homo Sapiens
agcaggccuuuugcguuuacguuuuccauuuuuaaacuaguaacucuuuuguucuuucuuuccu

SEQ ID NO: 150354 - RNA, 64 nt, Homo Sapiens
ugacaauaaaugaccaccaagaaugugaauuaugaacuaguaugucaaugugguuuaaagggau

SEQ ID NO: 150355 - RNA, 64 nt, Homo Sapiens
uuaaacaaggugaaacaagaauuacuacaggaaaaacuaguaguagaaggagguacauggucaa

SEQ ID NO: 150356 - RNA, 64 nt, Homo Sapiens
aaggucuaaauuauucaugaugggugaccauacgaacuaguaaacuacuauucuuagcagugcu

SEQ ID NO: 150357 - RNA, 64 nt, Homo Sapiens
agauuuccucuggaaugucuaaauaaaaacguugccccauuaacauuuguauguaaauguacag

SEQ ID NO: 150358 - RNA, 64 nt, Homo Sapiens
uacagaauaggaccuauccaaccugucaacaaacccccauuaugggaguacuugcuauaaagcc

SEQ ID NO: 150359 - RNA, 64 nt, Homo Sapiens
aauugcuugaaauucacauggcagcccugcugguccccauuaacugaaaagugguuuucuuaau

SEQ ID NO: 150360 - RNA, 63 nt, Homo Sapiens
aauacaaagcacuacauucuucuaucaacaucaccccauuaagaugcaccccagguucgcuga

SEQ ID NO: 150361 - RNA, 64 nt, Homo Sapiens
aaacacugccccuuaaguccuggaucagaaaccuccccauuaacauucuugaaucacccaaccc

SEQ ID NO: 150362 - RNA, 64 nt, Homo Sapiens
aacagauacucccauaauaacucgaucauugaggccccauuauugagaccccuguuagccagcc

SEQ ID NO: 150363 - RNA, 64 nt, Homo Sapiens
uuaaauaggaaaaacaguauuuauuuuuauuuggccccauuauuuauuuuauuuuugguuugua

SEQ ID NO: 150364 - RNA, 64 nt, Homo Sapiens
uuauuuuugguuuguauuaugccaccacaucuggccccauuauuugcugggauuacaaauguga

SEQ ID NO: 150365 - RNA, 64 nt, Homo Sapiens
ucgaaaccuguccauaaaguaauuuugugaaagaaggagcaagagaacauuccucugcagcacu

SEQ ID NO: 150366 - RNA, 64 nt, Homo Sapiens
acauaaagguauuuagaauauauuaaaucguuagaggagcaacaggagaugagaguuccagauu

SEQ ID NO: 150367 - RNA, 64 nt, Homo Sapiens
aauguugcaggauacauagccccaaagauggucuaggagcaaucuaagcuguguuacuccaaag

SEQ ID NO: 150368 - RNA, 64 nt, Homo Sapiens
aggagggaggaugcugugugagagccaugcugucaggagcaagcuugcugcuccugugcugccc

SEQ ID NO: 150369 - RNA, 64 nt, Homo Sapiens
uuuguauuugugaccucagcgacagaggccaugaaggagcaaguucuggugguggggggcaggg

SEQ ID NO: 150370 - RNA, 64 nt, Homo Sapiens
acuggggucuuuugcgaaagccuugggagccuggaggagcaaaggugaaugaagauccagccgg

SEQ ID NO: 150371 - RNA, 64 nt, Homo Sapiens
ggagguucaaguauggaggguaggagugcaacccaggagcaacgcucaagguggccgagaugca

SEQ ID NO: 150372 - RNA, 64 nt, Homo Sapiens
aaggccccugauggagcuauuucuuccuaguaucaggagcaauugagaccccucaggaguuucc

SEQ ID NO: 150373 - RNA, 64 nt, Homo Sapiens
aaagcuuuaaaaacaagauugcaucauaacccccaggagcaaagcaaccuggaggcugcauauc

SEQ ID NO: 150374 - RNA, 64 nt, Homo Sapiens
guuuuguugguuauguggaaaucacaaacuccagaggagcaaagggguuuuucaaugucuuuug

SEQ ID NO: 150375 - RNA, 64 nt, Homo Sapiens
uggggguuggaagcaaaaaaauggggaaaaguuaaggagcaaaaugggcugggagacagggaca

SEQ ID NO: 150376 - RNA, 64 nt, Homo Sapiens
aggcugccugccugugggcugucgugguugcagaaggagcaauuucuuggcccagggccaggca

SEQ ID NO: 150377 - RNA, 64 nt, Homo Sapiens
gggucccuggccuuguccaucauugagggccaauaggagcaauguguccuugaagagagugagg

SEQ ID NO: 150378 - RNA, 64 nt, Homo Sapiens
ucuucaggcuccuuuuuuaucaugucuguauuucaggagcaaacauauccuuuuuauaaaaauu

SEQ ID NO: 150379 - RNA, 64 nt, Homo Sapiens; identical to SEQ ID NO: 53335

SEQ ID NO: 150380 - RNA, 64 nt, Homo Sapiens; identical to SEQ ID NO: 53336

SEQ ID NO: 150381 - RNA, 64 nt, Homo Sapiens; identical to SEQ ID NO: 53337

SEQ ID NO: 150382 - RNA, 64 nt, Homo Sapiens; identical to SEQ ID NO: 53338

SEQ ID NO: 150383 - RNA, 64 nt, Homo Sapiens; identical to SEQ ID NO: 53339

SEQ ID NO: 150384 - RNA, 64 nt, Homo Sapiens; identical to SEQ ID NO: 53340

SEQ ID NO: 150385 - RNA, 64 nt, Homo Sapiens; identical to SEQ ID NO: 53341

SEQ ID NO: 150386 - RNA, 64 nt, Homo Sapiens; identical to SEQ ID NO: 53342

SEQ ID NO: 150387 - RNA, 51 nt, Homo Sapiens; identical to SEQ ID NO: 53343

SEQ ID NO: 150388 - RNA, 64 nt, Homo Sapiens; identical to SEQ ID NO: 53344

SEQ ID NO: 150389 - RNA, 64 nt, Homo Sapiens; identical to SEQ ID NO: 53345

SEQ ID NO: 150390 - RNA, 64 nt, Homo Sapiens; identical to SEQ ID NO: 53346

SEQ ID NO: 150391 - RNA, 64 nt, Homo Sapiens; identical to SEQ ID NO: 53347

SEQ ID NO: 150392 - RNA, 64 nt, Homo Sapiens; identical to SEQ ID NO: 53348

SEQ ID NO: 150393 - RNA, 64 nt, Homo Sapiens; identical to SEQ ID NO: 53349

SEQ ID NO: 150394 - RNA, 64 nt, Homo Sapiens; identical to SEQ ID NO: 53350

SEQ ID NO: 150395 - RNA, 64 nt, Homo Sapiens; identical to SEQ ID NO: 53351

SEQ ID NO: 150396 - RNA, 64 nt, Homo Sapiens; identical to SEQ ID NO: 53352

SEQ ID NO: 150397 - RNA, 64 nt, Homo Sapiens; identical to SEQ ID NO: 53353

SEQ ID NO: 150398 - RNA, 64 nt, Homo Sapiens; identical to SEQ ID NO: 53354

SEQ ID NO: 150399 - RNA, 64 nt, Homo Sapiens; identical to SEQ ID NO: 53355

SEQ ID NO: 150400 - RNA, 64 nt, Homo Sapiens; identical to SEQ ID NO: 53356

SEQ ID NO: 150401 - RNA, 64 nt, Homo Sapiens; identical to SEQ ID NO: 53357

SEQ ID NO: 150402 - RNA, 64 nt, Homo Sapiens; identical to SEQ ID NO: 53358

SEQ ID NO: 150403 - RNA, 64 nt, Homo Sapiens; identical to SEQ ID NO: 53359

SEQ ID NO: 150404 - RNA, 64 nt, Homo Sapiens; identical to SEQ ID NO: 53360

SEQ ID NO: 150405 - RNA, 64 nt, Homo Sapiens; identical to SEQ ID NO: 53361

SEQ ID NO: 150406 - RNA, 64 nt, Homo Sapiens; identical to SEQ ID NO: 53362

SEQ ID NO: 150407 - RNA, 64 nt, Homo Sapiens; identical to SEQ ID NO: 53363

SEQ ID NO: 150408 - RNA, 64 nt, Homo Sapiens; identical to SEQ ID NO: 53364

SEQ ID NO: 150409 - RNA, 64 nt, Homo Sapiens; identical to SEQ ID NO: 53365

SEQ ID NO: 150410 - RNA, 64 nt, Homo Sapiens; identical to SEQ ID NO: 53366

SEQ ID NO: 150411 - RNA, 64 nt, Homo Sapiens; identical to SEQ ID NO: 53367

SEQ ID NO: 150412 - RNA, 64 nt, Homo Sapiens; identical to SEQ ID NO: 53368

SEQ ID NO: 150413 - RNA, 64 nt, Homo Sapiens; identical to SEQ ID NO: 53369

SEQ ID NO: 150414 - RNA, 64 nt, Homo Sapiens; identical to SEQ ID NO: 53370

SEQ ID NO: 150415 - RNA, 64 nt, Homo Sapiens; identical to SEQ ID NO: 53371

SEQ ID NO: 150416 - RNA, 64 nt, Homo Sapiens; identical to SEQ ID NO: 53372

SEQ ID NO: 150417 - RNA, 64 nt, Homo Sapiens; identical to SEQ ID NO: 128083

SEQ ID NO: 150418 - RNA, 64 nt, Homo Sapiens; identical to SEQ ID NO: 128084

SEQ ID NO: 150419 - RNA, 64 nt, Homo Sapiens; identical to SEQ ID NO: 128085

SEQ ID NO: 150420 - RNA, 64 nt, Homo Sapiens; identical to SEQ ID NO: 128086

SEQ ID NO: 150421 - RNA, 64 nt, Homo Sapiens; identical to SEQ ID NO: 128087

SEQ ID NO: 150422 - RNA, 64 nt, Homo Sapiens; identical to SEQ ID NO: 128088

SEQ ID NO: 150423 - RNA, 64 nt, Homo Sapiens; identical to SEQ ID NO: 128089

SEQ ID NO: 150424 - RNA, 64 nt, Homo Sapiens; identical to SEQ ID NO: 128090

SEQ ID NO: 150425 - RNA, 64 nt, Homo Sapiens; identical to SEQ ID NO: 128091

SEQ ID NO: 150426 - RNA, 64 nt, Homo Sapiens; identical to SEQ ID NO: 128092

SEQ ID NO: 150427 - RNA, 64 nt, Homo Sapiens; identical to SEQ ID NO: 128093

SEQ ID NO: 150428 - RNA, 64 nt, Homo Sapiens; identical to SEQ ID NO: 128094

SEQ ID NO: 150429 - RNA, 64 nt, Homo Sapiens; identical to SEQ ID NO: 128095

SEQ ID NO: 150430 - RNA, 64 nt, Homo Sapiens; identical to SEQ ID NO: 128096

SEQ ID NO: 150431 - RNA, 64 nt, Homo Sapiens; identical to SEQ ID NO: 128097

SEQ ID NO: 150432 - RNA, 64 nt, Homo Sapiens; identical to SEQ ID NO: 128098

SEQ ID NO: 150433 - RNA, 64 nt, Homo Sapiens; identical to SEQ ID NO: 128099

SEQ ID NO: 150434 - RNA, 64 nt, Homo Sapiens; identical to SEQ ID NO: 128100

SEQ ID NO: 150435 - RNA, 64 nt, Homo Sapiens; identical to SEQ ID NO: 128101

SEQ ID NO: 150436 - RNA, 64 nt, Homo Sapiens; identical to SEQ ID NO: 128102

SEQ ID NO: 150437 - RNA, 64 nt, Homo Sapiens; identical to SEQ ID NO: 128103

SEQ ID NO: 150438 - RNA, 64 nt, Homo Sapiens; identical to SEQ ID NO: 128104

SEQ ID NO: 150439 - RNA, 64 nt, Homo Sapiens; identical to SEQ ID NO: 128105

SEQ ID NO: 150440 - RNA, 64 nt, Homo Sapiens; identical to SEQ ID NO: 128106

SEQ ID NO: 150441 - RNA, 64 nt, Homo Sapiens; identical to SEQ ID NO: 128107

SEQ ID NO: 150442 - RNA, 64 nt, Homo Sapiens; identical to SEQ ID NO: 128108

SEQ ID NO: 150443 - RNA, 64 nt, Homo Sapiens; identical to SEQ ID NO: 128109

SEQ ID NO: 150444 - RNA, 64 nt, Homo Sapiens; identical to SEQ ID NO: 128110

SEQ ID NO: 150445 - RNA, 64 nt, Homo Sapiens; identical to SEQ ID NO: 128111

SEQ ID NO: 150446 - RNA, 64 nt, Homo Sapiens; identical to SEQ ID NO: 128112

SEQ ID NO: 150447 - RNA, 64 nt, Homo Sapiens; identical to SEQ ID NO: 128113

SEQ ID NO: 150448 - RNA, 64 nt, Homo Sapiens; identical to SEQ ID NO: 128114

SEQ ID NO: 150449 - RNA, 64 nt, Homo Sapiens; identical to SEQ ID NO: 128115

SEQ ID NO: 150450 - RNA, 64 nt, Homo Sapiens; identical to SEQ ID NO: 128116

SEQ ID NO: 150451 - RNA, 64 nt, Homo Sapiens; identical to SEQ ID NO: 128117

SEQ ID NO: 150452 - RNA, 64 nt, Homo Sapiens; identical to SEQ ID NO: 128118

SEQ ID NO: 150453 - RNA, 64 nt, Homo Sapiens; identical to SEQ ID NO: 128119

SEQ ID NO: 150454 - RNA, 64 nt, Homo Sapiens; identical to SEQ ID NO: 128120

SEQ ID NO: 150455 - RNA, 64 nt, Homo Sapiens; identical to SEQ ID NO: 128121

SEQ ID NO: 150456 - RNA, 64 nt, Homo Sapiens; identical to SEQ ID NO: 106770

SEQ ID NO: 150457 - RNA, 64 nt, Homo Sapiens; identical to SEQ ID NO: 106771

SEQ ID NO: 150458 - RNA, 64 nt, Homo Sapiens; identical to SEQ ID NO: 106772

SEQ ID NO: 150459 - RNA, 64 nt, Homo Sapiens; identical to SEQ ID NO: 106773

SEQ ID NO: 150460 - RNA, 64 nt, Homo Sapiens; identical to SEQ ID NO: 106774

SEQ ID NO: 150461 - RNA, 64 nt, Homo Sapiens; identical to SEQ ID NO: 106775

SEQ ID NO: 150462 - RNA, 64 nt, Homo Sapiens; identical to SEQ ID NO: 106776

SEQ ID NO: 150463 - RNA, 64 nt, Homo Sapiens; identical to SEQ ID NO: 106777

SEQ ID NO: 150464 - RNA, 64 nt, Homo Sapiens; identical to SEQ ID NO: 106778

SEQ ID NO: 150465 - RNA, 64 nt, Homo Sapiens; identical to SEQ ID NO: 106779

SEQ ID NO: 150466 - RNA, 64 nt, Homo Sapiens; identical to SEQ ID NO: 106780

SEQ ID NO: 150467 - RNA, 64 nt, Homo Sapiens; identical to SEQ ID NO: 106781

SEQ ID NO: 150468 - RNA, 64 nt, Homo Sapiens; identical to SEQ ID NO: 106782

SEQ ID NO: 150469 - RNA, 64 nt, Homo Sapiens; identical to SEQ ID NO: 106783

SEQ ID NO: 150470 - RNA, 64 nt, Homo Sapiens; identical to SEQ ID NO: 106784

SEQ ID NO: 150471 - RNA, 64 nt, Homo Sapiens; identical to SEQ ID NO: 106785

SEQ ID NO: 150472 - RNA, 64 nt, Homo Sapiens; identical to SEQ ID NO: 106786

SEQ ID NO: 150473 - RNA, 64 nt, Homo Sapiens; identical to SEQ ID NO: 106787

SEQ ID NO: 150474 - RNA, 64 nt, Homo Sapiens; identical to SEQ ID NO: 106788

SEQ ID NO: 150475 - RNA, 64 nt, Homo Sapiens; identical to SEQ ID NO: 106789

SEQ ID NO: 150476 - RNA, 64 nt, Homo Sapiens; identical to SEQ ID NO: 106790

SEQ ID NO: 150477 - RNA, 64 nt, Homo Sapiens; identical to SEQ ID NO: 106791

SEQ ID NO: 150478 - RNA, 64 nt, Homo Sapiens; identical to SEQ ID NO: 106792

SEQ ID NO: 150479 - RNA, 64 nt, Homo Sapiens; identical to SEQ ID NO: 106793

SEQ ID NO: 150480 - RNA, 64 nt, Homo Sapiens; identical to SEQ ID NO: 106794

SEQ ID NO: 150481 - RNA, 64 nt, Homo Sapiens; identical to SEQ ID NO: 106795

SEQ ID NO: 150482 - RNA, 64 nt, Homo Sapiens; identical to SEQ ID NO: 106796

SEQ ID NO: 150483 - RNA, 64 nt, Homo Sapiens; identical to SEQ ID NO: 106797

SEQ ID NO: 150484 - RNA, 64 nt, Homo Sapiens; identical to SEQ ID NO: 106798

SEQ ID NO: 150485 - RNA, 64 nt, Homo Sapiens; identical to SEQ ID NO: 106799

SEQ ID NO: 150486 - RNA, 64 nt, Homo Sapiens; identical to SEQ ID NO: 106800

SEQ ID NO: 150487 - RNA, 64 nt, Homo Sapiens; identical to SEQ ID NO: 106801

SEQ ID NO: 150488 - RNA, 64 nt, Homo Sapiens; identical to SEQ ID NO: 106802

SEQ ID NO: 150489 - RNA, 64 nt, Homo Sapiens; identical to SEQ ID NO: 106803

SEQ ID NO: 150490 - RNA, 64 nt, Homo Sapiens; identical to SEQ ID NO: 106804

SEQ ID NO: 150491 - RNA, 64 nt, Homo Sapiens; identical to SEQ ID NO: 106805

SEQ ID NO: 150492 - RNA, 64 nt, Homo Sapiens; identical to SEQ ID NO: 106806

SEQ ID NO: 150493 - RNA, 64 nt, Homo Sapiens; identical to SEQ ID NO: 106807

SEQ ID NO: 150494 - RNA, 64 nt, Homo Sapiens; identical to SEQ ID NO: 106808

SEQ ID NO: 150495 - RNA, 64 nt, Homo Sapiens; identical to SEQ ID NO: 106809

SEQ ID NO: 150496 - RNA, 64 nt, Homo Sapiens; identical to SEQ ID NO: 106810

SEQ ID NO: 150497 - RNA, 64 nt, Homo Sapiens; identical to SEQ ID NO: 106811

SEQ ID NO: 150498 - RNA, 64 nt, Homo Sapiens; identical to SEQ ID NO: 106812

SEQ ID NO: 150499 - RNA, 64 nt, Homo Sapiens; identical to SEQ ID NO: 106813

SEQ ID NO: 150500 - RNA, 64 nt, Homo Sapiens; identical to SEQ ID NO: 106814

SEQ ID NO: 150501 - RNA, 64 nt, Homo Sapiens; identical to SEQ ID NO: 106815

SEQ ID NO: 150502 - RNA, 64 nt, Homo Sapiens; identical to SEQ ID NO: 106816

SEQ ID NO: 150503 - RNA, 64 nt, Homo Sapiens; identical to SEQ ID NO: 106817

SEQ ID NO: 150504 - RNA, 64 nt, Homo Sapiens; identical to SEQ ID NO: 106818

SEQ ID NO: 150505 - RNA, 64 nt, Homo Sapiens; identical to SEQ ID NO: 106819

SEQ ID NO: 150506 - RNA, 64 nt, Homo Sapiens; identical to SEQ ID NO: 106820

SEQ ID NO: 150507 - RNA, 64 nt, Homo Sapiens; identical to SEQ ID NO: 106821

SEQ ID NO: 150508 - RNA, 64 nt, Homo Sapiens; identical to SEQ ID NO: 106822

SEQ ID NO: 150509 - RNA, 64 nt, Homo Sapiens; identical to SEQ ID NO: 106823

SEQ ID NO: 150510 - RNA, 64 nt, Homo Sapiens; identical to SEQ ID NO: 106824

SEQ ID NO: 150511 - RNA, 64 nt, Homo Sapiens; identical to SEQ ID NO: 106825

SEQ ID NO: 150512 - RNA, 64 nt, Homo Sapiens; identical to SEQ ID NO: 106826

SEQ ID NO: 150513 - RNA, 64 nt, Homo Sapiens; identical to SEQ ID NO: 106827

SEQ ID NO: 150514 - RNA, 64 nt, Homo Sapiens; identical to SEQ ID NO: 106828

SEQ ID NO: 150515 - RNA, 64 nt, Homo Sapiens; identical to SEQ ID NO: 106829

SEQ ID NO: 150516 - RNA, 64 nt, Homo Sapiens; identical to SEQ ID NO: 106830

SEQ ID NO: 150517 - RNA, 64 nt, Homo Sapiens; identical to SEQ ID NO: 106831

SEQ ID NO: 150518 - RNA, 64 nt, Homo Sapiens; identical to SEQ ID NO: 106832

SEQ ID NO: 150519 - RNA, 64 nt, Homo Sapiens; identical to SEQ ID NO: 106833

SEQ ID NO: 150520 - RNA, 64 nt, Homo Sapiens; identical to SEQ ID NO: 106834

SEQ ID NO: 150521 - RNA, 64 nt, Homo Sapiens; identical to SEQ ID NO: 106835

SEQ ID NO: 150522 - RNA, 64 nt, Homo Sapiens; identical to SEQ ID NO: 106836

SEQ ID NO: 150523 - RNA, 64 nt, Homo Sapiens; identical to SEQ ID NO: 106837

SEQ ID NO: 150524 - RNA, 64 nt, Homo Sapiens; identical to SEQ ID NO: 106838

SEQ ID NO: 150525 - RNA, 64 nt, Homo Sapiens; identical to SEQ ID NO: 106839

SEQ ID NO: 150526 - RNA, 64 nt, Homo Sapiens; identical to SEQ ID NO: 106840

SEQ ID NO: 150527 - RNA, 64 nt, Homo Sapiens; identical to SEQ ID NO: 106841

SEQ ID NO: 150528 - RNA, 64 nt, Homo Sapiens; identical to SEQ ID NO: 106842

SEQ ID NO: 150529 - RNA, 64 nt, Homo Sapiens; identical to SEQ ID NO: 106843

SEQ ID NO: 150530 - RNA, 64 nt, Homo Sapiens; identical to SEQ ID NO: 106844

SEQ ID NO: 150531 - RNA, 64 nt, Homo Sapiens; identical to SEQ ID NO: 106845

SEQ ID NO: 150532 - RNA, 64 nt, Homo Sapiens; identical to SEQ ID NO: 106846

SEQ ID NO: 150533 - RNA, 64 nt, Homo Sapiens; identical to SEQ ID NO: 106847

SEQ ID NO: 150534 - RNA, 64 nt, Homo Sapiens; identical to SEQ ID NO: 106848

SEQ ID NO: 150535 - RNA, 64 nt, Homo Sapiens; identical to SEQ ID NO: 106849

SEQ ID NO: 150536 - RNA, 64 nt, Homo Sapiens; identical to SEQ ID NO: 106850

SEQ ID NO: 150537 - RNA, 64 nt, Homo Sapiens; identical to SEQ ID NO: 106851

SEQ ID NO: 150538 - RNA, 64 nt, Homo Sapiens; identical to SEQ ID NO: 106852

SEQ ID NO: 150539 - RNA, 64 nt, Homo Sapiens; identical to SEQ ID NO: 106853

SEQ ID NO: 150540 - RNA, 64 nt, Homo Sapiens; identical to SEQ ID NO: 106854

SEQ ID NO: 150541 - RNA, 64 nt, Homo Sapiens; identical to SEQ ID NO: 106855

SEQ ID NO: 150542 - RNA, 64 nt, Homo Sapiens; identical to SEQ ID NO: 106856

SEQ ID NO: 150543 - RNA, 64 nt, Homo Sapiens; identical to SEQ ID NO: 106857

SEQ ID NO: 150544 - RNA, 64 nt, Homo Sapiens; identical to SEQ ID NO: 106858

SEQ ID NO: 150545 - RNA, 64 nt, Homo Sapiens; identical to SEQ ID NO: 106859

SEQ ID NO: 150546 - RNA, 64 nt, Homo Sapiens; identical to SEQ ID NO: 106860

SEQ ID NO: 150547 - RNA, 64 nt, Homo Sapiens; identical to SEQ ID NO: 106861

SEQ ID NO: 150548 - RNA, 64 nt, Homo Sapiens; identical to SEQ ID NO: 106862

SEQ ID NO: 150549 - RNA, 64 nt, Homo Sapiens; identical to SEQ ID NO: 106863

SEQ ID NO: 150550 - RNA, 64 nt, Homo Sapiens; identical to SEQ ID NO: 106864

SEQ ID NO: 150551 - RNA, 64 nt, Homo Sapiens; identical to SEQ ID NO: 106865

SEQ ID NO: 150552 - RNA, 64 nt, Homo Sapiens; identical to SEQ ID NO: 106866

SEQ ID NO: 150553 - RNA, 64 nt, Homo Sapiens; identical to SEQ ID NO: 106867

SEQ ID NO: 150554 - RNA, 64 nt, Homo Sapiens; identical to SEQ ID NO: 106868

SEQ ID NO: 150555 - RNA, 54 nt, Homo Sapiens; identical to SEQ ID NO: 106869

SEQ ID NO: 150556 - RNA, 64 nt, Homo Sapiens; identical to SEQ ID NO: 106870

SEQ ID NO: 150557 - RNA, 64 nt, Homo Sapiens; identical to SEQ ID NO: 106871

SEQ ID NO: 150558 - RNA, 64 nt, Homo Sapiens; identical to SEQ ID NO: 106872

SEQ ID NO: 150559 - RNA, 64 nt, Homo Sapiens; identical to SEQ ID NO: 106873

SEQ ID NO: 150560 - RNA, 60 nt, Homo Sapiens; identical to SEQ ID NO: 106874

SEQ ID NO: 150561 - RNA, 64 nt, Homo Sapiens; identical to SEQ ID NO: 106875

SEQ ID NO: 150562 - RNA, 64 nt, Homo Sapiens; identical to SEQ ID NO: 106876

SEQ ID NO: 150563 - RNA, 64 nt, Homo Sapiens; identical to SEQ ID NO: 106877

SEQ ID NO: 150564 - RNA, 64 nt, Homo Sapiens; identical to SEQ ID NO: 106878

SEQ ID NO: 150565 - RNA, 64 nt, Homo Sapiens; identical to SEQ ID NO: 106879

SEQ ID NO: 150566 - RNA, 64 nt, Homo Sapiens; identical to SEQ ID NO: 106880

SEQ ID NO: 150567 - RNA, 64 nt, Homo Sapiens; identical to SEQ ID NO: 106881

SEQ ID NO: 150568 - RNA, 64 nt, Homo Sapiens; identical to SEQ ID NO: 106882

SEQ ID NO: 150569 - RNA, 64 nt, Homo Sapiens; identical to SEQ ID NO: 106883

SEQ ID NO: 150570 - RNA, 64 nt, Homo Sapiens; identical to SEQ ID NO: 106884

SEQ ID NO: 150571 - RNA, 64 nt, Homo Sapiens; identical to SEQ ID NO: 106885

SEQ ID NO: 150572 - RNA, 64 nt, Homo Sapiens; identical to SEQ ID NO: 106886

SEQ ID NO: 150573 - RNA, 64 nt, Homo Sapiens; identical to SEQ ID NO: 106887

SEQ ID NO: 150574 - RNA, 64 nt, Homo Sapiens; identical to SEQ ID NO: 106888

SEQ ID NO: 150575 - RNA, 64 nt, Homo Sapiens; identical to SEQ ID NO: 106889

SEQ ID NO: 150576 - RNA, 64 nt, Homo Sapiens; identical to SEQ ID NO: 106890

SEQ ID NO: 150577 - RNA, 64 nt, Homo Sapiens; identical to SEQ ID NO: 106891

SEQ ID NO: 150578 - RNA, 64 nt, Homo Sapiens; identical to SEQ ID NO: 106892

SEQ ID NO: 150579 - RNA, 64 nt, Homo Sapiens; identical to SEQ ID NO: 106893

SEQ ID NO: 150580 - RNA, 64 nt, Homo Sapiens; identical to SEQ ID NO: 106894

SEQ ID NO: 150581 - RNA, 64 nt, Homo Sapiens; identical to SEQ ID NO: 106895

SEQ ID NO: 150582 - RNA, 64 nt, Homo Sapiens; identical to SEQ ID NO: 106896

SEQ ID NO: 150583 - RNA, 64 nt, Homo Sapiens; identical to SEQ ID NO: 106897

SEQ ID NO: 150584 - RNA, 64 nt, Homo Sapiens; identical to SEQ ID NO: 106898

SEQ ID NO: 150585 - RNA, 64 nt, Homo Sapiens; identical to SEQ ID NO: 106899

SEQ ID NO: 150586 - RNA, 64 nt, Homo Sapiens; identical to SEQ ID NO: 106900

SEQ ID NO: 150587 - RNA, 64 nt, Homo Sapiens; identical to SEQ ID NO: 106901

SEQ ID NO: 150588 - RNA, 64 nt, Homo Sapiens; identical to SEQ ID NO: 106902

SEQ ID NO: 150589 - RNA, 64 nt, Homo Sapiens; identical to SEQ ID NO: 106903

SEQ ID NO: 150590 - RNA, 64 nt, Homo Sapiens; identical to SEQ ID NO: 106904

SEQ ID NO: 150591 - RNA, 64 nt, Homo Sapiens; identical to SEQ ID NO: 106905

SEQ ID NO: 150592 - RNA, 64 nt, Homo Sapiens; identical to SEQ ID NO: 106906

SEQ ID NO: 150593 - RNA, 64 nt, Homo Sapiens; identical to SEQ ID NO: 106907

SEQ ID NO: 150594 - RNA, 64 nt, Homo Sapiens; identical to SEQ ID NO: 106908

SEQ ID NO: 150595 - RNA, 64 nt, Homo Sapiens; identical to SEQ ID NO: 106909

SEQ ID NO: 150596 - RNA, 64 nt, Homo Sapiens; identical to SEQ ID NO: 106910

SEQ ID NO: 150597 - RNA, 64 nt, Homo Sapiens; identical to SEQ ID NO: 106911

SEQ ID NO: 150598 - RNA, 64 nt, Homo Sapiens; identical to SEQ ID NO: 106912

SEQ ID NO: 150599 - RNA, 64 nt, Homo Sapiens; identical to SEQ ID NO: 106913

SEQ ID NO: 150600 - RNA, 64 nt, Homo Sapiens; identical to SEQ ID NO: 106914

SEQ ID NO: 150601 - RNA, 64 nt, Homo Sapiens; identical to SEQ ID NO: 106915

SEQ ID NO: 150602 - RNA, 64 nt, Homo Sapiens; identical to SEQ ID NO: 106916

SEQ ID NO: 150603 - RNA, 64 nt, Homo Sapiens; identical to SEQ ID NO: 106917

SEQ ID NO: 150604 - RNA, 64 nt, Homo Sapiens; identical to SEQ ID NO: 106918

SEQ ID NO: 150605 - RNA, 64 nt, Homo Sapiens; identical to SEQ ID NO: 106919

SEQ ID NO: 150606 - RNA, 64 nt, Homo Sapiens; identical to SEQ ID NO: 106920

SEQ ID NO: 150607 - RNA, 64 nt, Homo Sapiens; identical to SEQ ID NO: 106921

SEQ ID NO: 150608 - RNA, 64 nt, Homo Sapiens; identical to SEQ ID NO: 106922

SEQ ID NO: 150609 - RNA, 64 nt, Homo Sapiens; identical to SEQ ID NO: 106923

SEQ ID NO: 150610 - RNA, 64 nt, Homo Sapiens; identical to SEQ ID NO: 106924

SEQ ID NO: 150611 - RNA, 64 nt, Homo Sapiens; identical to SEQ ID NO: 106925

SEQ ID NO: 150612 - RNA, 64 nt, Homo Sapiens; identical to SEQ ID NO: 106926

SEQ ID NO: 150613 - RNA, 64 nt, Homo Sapiens; identical to SEQ ID NO: 106927

SEQ ID NO: 150614 - RNA, 64 nt, Homo Sapiens; identical to SEQ ID NO: 106928

SEQ ID NO: 150615 - RNA, 64 nt, Homo Sapiens; identical to SEQ ID NO: 106929

SEQ ID NO: 150616 - RNA, 64 nt, Homo Sapiens; identical to SEQ ID NO: 106930

SEQ ID NO: 150617 - RNA, 64 nt, Homo Sapiens; identical to SEQ ID NO: 106931

SEQ ID NO: 150618 - RNA, 64 nt, Homo Sapiens; identical to SEQ ID NO: 106932

SEQ ID NO: 150619 - RNA, 64 nt, Homo Sapiens; identical to SEQ ID NO: 106933

SEQ ID NO: 150620 - RNA, 64 nt, Homo Sapiens; identical to SEQ ID NO: 106934

SEQ ID NO: 150621 - RNA, 64 nt, Homo Sapiens; identical to SEQ ID NO: 106935

SEQ ID NO: 150622 - RNA, 64 nt, Homo Sapiens; identical to SEQ ID NO: 106936

SEQ ID NO: 150623 - RNA, 64 nt, Homo Sapiens; identical to SEQ ID NO: 106937

SEQ ID NO: 150624 - RNA, 64 nt, Homo Sapiens; identical to SEQ ID NO: 106938

SEQ ID NO: 150625 - RNA, 64 nt, Homo Sapiens; identical to SEQ ID NO: 106939

SEQ ID NO: 150626 - RNA, 64 nt, Homo Sapiens; identical to SEQ ID NO: 106940

SEQ ID NO: 150627 - RNA, 64 nt, Homo Sapiens
aacacuggcacacacaaaaaaguaguuuuaagcuuguuugcacaguucuuuuuuuccauuggaa

SEQ ID NO: 150628 - RNA, 64 nt, Homo Sapiens
aguuuauuuauaaccuguuauaagugcuauauucuguuugcaguuaggaaaugcagaauucaaa

SEQ ID NO: 150629 - RNA, 64 nt, Homo Sapiens
cagaugcacuaaaacaaagaaaugguaaaugaauuguuugcauuuaaaaaaaaaaacucuuaag

SEQ ID NO: 150630 - RNA, 64 nt, Homo Sapiens
aaaacuguacuaaaucugaaucauguuuugagcuuguuugcaguacuuuuaaacauuauucacu

SEQ ID NO: 150631 - RNA, 64 nt, Homo Sapiens
uccccagcuacuucuuauaccacuauucuuuuaauguuugcauaaucauaagcaccucaacacu

SEQ ID NO: 150632 - RNA, 64 nt, Homo Sapiens
ccuuaaaaagcugccaugguggucaaauggcauguguuugcacaaaaaugaccgauguguuuaa

SEQ ID NO: 150633 - RNA, 64 nt, Homo Sapiens
ugggcuagugagaguuggugcaaauucuuguguguguuugcauaggaaggugagaugaccaucu

SEQ ID NO: 150634 - RNA, 64 nt, Homo Sapiens
ugcagucuaugaugagaaacuguucaccauuaaauguuugcaucaaaaauugagauaaacauuu

SEQ ID NO: 150635 - RNA, 64 nt, Homo Sapiens
guacaaauaauacagcugugcaucucuuucuagguguuugcaauacuccugggauuuuguuucc

SEQ ID NO: 150636 - RNA, 64 nt, Homo Sapiens
caaugugcuaauaugcaaauaggcagacaccagcuguuugcaaacaaaauguuccaagcacuuu

SEQ ID NO: 150637 - RNA, 64 nt, Homo Sapiens
gcuuuuuguagagagggucagggcuuggaggugguguuugcacuuagucauuuuccuaacuuca

SEQ ID NO: 150638 - RNA, 64 nt, Homo Sapiens
auacuuuugaaguguauuuuaucuuuauauaguuuguuugcaagaguauuuuccuaauaacuuc

SEQ ID NO: 150639 - RNA, 64 nt, Homo Sapiens
cuaaaauagauauuaagcugcuguuguaaaguauuguuugcagcucuuuccaauaucuagagac

SEQ ID NO: 150640 - RNA, 64 nt, Homo Sapiens
cacacaagaaaucuggcuuguucggcucacauauuguuugcagauucaggaggcauuggugaug

SEQ ID NO: 150641 - RNA, 64 nt, Homo Sapiens
aacaauuuagaaaaaaacaauaccuguuaugcccuguuugcaaaauucuuacaaaguauuuuuu

SEQ ID NO: 150642 - RNA, 64 nt, Homo Sapiens
auauuccauauuugccugauuuuacuauucgguguguuugcauagauguugcuacuuggugggu

SEQ ID NO: 150643 - RNA, 64 nt, Homo Sapiens
cggcgugcaaugguaauuauaaauuggugaugcuuguuugcaaauugcccacucgugauaaguc

SEQ ID NO: 150644 - RNA, 64 nt, Homo Sapiens
auaccagagaagauguuuaguagcaauuaaaggcuguuugcaccuuuaaggaccagcugggcug

SEQ ID NO: 150645 - RNA, 64 nt, Homo Sapiens
auuauguuuuuacaaaauaaugacauaugucacauguuugcauguuuguuugcuuguugaauuu

SEQ ID NO: 150646 - RNA, 64 nt, Homo Sapiens
cuauaaaaucugaauugaugggugguuuauuucauguuugcauagcacauauuuguuguaauac

SEQ ID NO: 150647 - RNA, 64 nt, Homo Sapiens
uuuuaagaaguacauuuuuagcagcucgccauuguguuugcauuaacagaauguacacauuaua

SEQ ID NO: 150648 - RNA, 64 nt, Homo Sapiens
uucuauuuggggggcagggaagcagcucuuuaaguguuugcauucaauuuucggagaaaagaac

SEQ ID NO: 150649 - RNA, 64 nt, Homo Sapiens
cuuguuaauuuuuuuuuugguacauuauucaucguguuugcauuuggcaaagucuuggcagugg

SEQ ID NO: 150650 - RNA, 64 nt, Homo Sapiens
acauuguuaucaauucaucaguaaggucagaugcuguuugcacaccuccagcaauagggugcuc

SEQ ID NO: 150651 - RNA, 64 nt, Homo Sapiens
uccacaacagcccuaugaggguggcucccuuuguuguuugcauuuuaaggaacugggagugagg

SEQ ID NO: 150652 - RNA, 64 nt, Homo Sapiens
gcaaugcccguaaugcuuagauuuguguagaggguguuugcagaccugcucuucuaccauuuga

SEQ ID NO: 150653 - RNA, 64 nt, Homo Sapiens
uuuuccaugaaguuugaacucccacugaguuugcuguuugcaauaccuacaaugcuggcuuucu

SEQ ID NO: 150654 - RNA, 64 nt, Homo Sapiens
acacccaagagcgagcaaacugggcucugcuauuuguuugcagacggaacaggcuuuuuugcuu

SEQ ID NO: 150655 - RNA, 64 nt, Homo Sapiens
cacauuugugcccggcguuuuguuuacuuccaucuguuugcagaaagcauuugggccagugcac

SEQ ID NO: 150656 - RNA, 64 nt, Homo Sapiens
uuucuaguugaaaauaaagugaccaaaaguuacauguuugcaccaguuuauuuguugagagugu

SEQ ID NO: 150657 - RNA, 64 nt, Homo Sapiens
ggggaggcaucaguguccuuccgucaaaacagauuguuugcaaaugcucagauagaaugacagu

SEQ ID NO: 150658 - RNA, 64 nt, Homo Sapiens
cuuguuagaucaaccuccaacugcacaaacaauauguuugcaaauagacacuucccugcauuaa

SEQ ID NO: 150659 - RNA, 64 nt, Homo Sapiens
guagaaaaagauucucaucagaauuauauuagucuguuugcaaaaugggaggaaaacucaguaa

SEQ ID NO: 150660 - RNA, 64 nt, Homo Sapiens
guaagggcacaaacuucacuuagggcaucgcagauguuugcagaaugguuggccuaaugauuau

SEQ ID NO: 150661 - RNA, 64 nt, Homo Sapiens
cuuaguggugcccacaguuggagcccaggggccauguuugcaaacugauucaugugcauggcug

SEQ ID NO: 150662 - RNA, 64 nt, Homo Sapiens
guuuaucuuuaaaaacaacugcuucaguauaccauguuugcauaauacgaagggcucuuuugaa

SEQ ID NO: 150663 - RNA, 64 nt, Homo Sapiens
cugcucaguuguuuuauguauuuugguuuucucuuguuugcaguugaauuauguaucccuucuc

SEQ ID NO: 150664 - RNA, 64 nt, Homo Sapiens
ccaaauccagccuuuggaggucucagagaaaagcuguuugcaauagucucaauuaacagcagaa

SEQ ID NO: 150665 - RNA, 64 nt, Homo Sapiens
ucccaauguugucauuuuuaauguuuccccucacuguuugcagcuuaucuuuauuuuaaaaugu

SEQ ID NO: 150666 - RNA, 64 nt, Homo Sapiens
gcuucacuaaacauugaaaucauuccugcaauucuguuugcaguguaacauuauaacuaaaaug

SEQ ID NO: 150667 - RNA, 64 nt, Homo Sapiens
uguaacagaugcagaacuguagccuggcugucucuguuugcacacucuuaccuagagcauucaa

SEQ ID NO: 150668 - RNA, 64 nt, Homo Sapiens
ugccgccccccucaucuccacccucccccauaucuguuugcauuaggaguuccacgaccauggu

SEQ ID NO: 150669 - RNA, 64 nt, Homo Sapiens
aguaagauuggaacccagacuugcaguccagcgcuguuugcauuaaaagggugggugagucagg

SEQ ID NO: 150670 - RNA, 64 nt, Homo Sapiens
caggcauaaaaucacuuucucaauuauugcuugcuguuugcaacguagaaccagggccggguau

SEQ ID NO: 150671 - RNA, 64 nt, Homo Sapiens
caugcaaaacugcagcugaauguguguguguguguguuugcagaugugugugugugugugugug

SEQ ID NO: 150672 - RNA, 64 nt, Homo Sapiens
ucuaguauguuuaggguucuguguucagauauuuuguuugcacacuacuuuuuaggaaacuuau

SEQ ID NO: 150673 - RNA, 64 nt, Homo Sapiens
uguguguggggguguguguguguguguguguguauguuugcauauuauagcucucuuuaagaca

SEQ ID NO: 150674 - RNA, 64 nt, Homo Sapiens
gauucacauacgugccacuguuugaaaucuggucuguuugcauuucuguuaugacagagagaug

SEQ ID NO: 150675 - RNA, 64 nt, Homo Sapiens
gucuguuugcauuucuguuaugacagagagaugauguuugcauuucuguuaugacagagagaug

SEQ ID NO: 150676 - RNA, 64 nt, Homo Sapiens
auugcuucucauucucaucagacucuccuuguuuuguuugcauauuuaauuuuaaauuaaacca

SEQ ID NO: 150677 - RNA, 64 nt, Homo Sapiens
uacaagacaauguucucuaagaacugagccuagauguuugcaguauugaacccauaaaugauaa

SEQ ID NO: 150678 - RNA, 64 nt, Homo Sapiens
guacagaacugugucaugugaauaaucauuaaaauguuugcagcuuccaaaauguaugcucaac

SEQ ID NO: 150679 - RNA, 64 nt, Homo Sapiens
ucaaaaauaaagauguauuacaaagucuuaaguguguuugcagcaaaugccauacuaugaagau

SEQ ID NO: 150680 - RNA, 64 nt, Homo Sapiens
uuaaaaguacccuuuugugugaauugacuaccguuguuugcaaacccgaaaauaaaagacguuc

SEQ ID NO: 150681 - RNA, 64 nt, Homo Sapiens
acaugcacacacacacgcuuucuuaugcaaucuauguuugcacuugugcuuucaguuagccuuc

SEQ ID NO: 150682 - RNA, 64 nt, Homo Sapiens
aaaagucaaccagaaaacuguuaugccuuuuauuuguuugcaaggaugucuuuguaauguguuu

SEQ ID NO: 150683 - RNA, 64 nt, Homo Sapiens
guuaugcucuuaaugcuuaaaagaaggcuagcauuguuugcacaaaaaguuggugauucccacc

SEQ ID NO: 150684 - RNA, 64 nt, Homo Sapiens
ugagagcagcauggggccuggcauccaucccugcuguuugcaucccuuaccccagggccagaca

SEQ ID NO: 150685 - RNA, 64 nt, Homo Sapiens
ccuuucucagagcgacauaucacgcauuugucuuuguuugcaaaggguuggugcaaccucagua

SEQ ID NO: 150686 - RNA, 64 nt, Homo Sapiens
gaaguguguugcucuuucaaguucuaucacuuuuuguuugcaaaguucaaagcuguauuguuug

SEQ ID NO: 150687 - RNA, 64 nt, Homo Sapiens
uguucucauagugacuccugcauauuuugauuaauguuugcaugguuaauauuucuucauuuua

SEQ ID NO: 150688 - RNA, 64 nt, Homo Sapiens
gcugggcaguugaggaaagguucucuccacagaauguuugcagacugcccaucucuucuccacc

SEQ ID NO: 150689 - RNA, 64 nt, Homo Sapiens
caagaccauucuuuccaaccugaagcuggggcgauguuugcaguaucaaaggucuuccugcacu

SEQ ID NO: 150690 - RNA, 64 nt, Homo Sapiens
agguuuuuuucuuucugugcucuguagaucucauuguuugcacuuguaauuucccagaguugaa

SEQ ID NO: 150691 - RNA, 64 nt, Homo Sapiens
cucucuuauuugcucuaguguacuaguccaguaguguuugcauguggaugucuguggaugacag

SEQ ID NO: 150692 - RNA, 64 nt, Homo Sapiens
ggcugcaguuucaacagcuagauauccuggauauuguuugcaccauccauugucccuguaccag

SEQ ID NO: 150693 - RNA, 64 nt, Homo Sapiens
uuuaaaaucagccagcuccaugcccaaaccuuccuguuugcagaacuuuuuaaugucuuuucuu

SEQ ID NO: 150694 - RNA, 64 nt, Homo Sapiens
aaauaaaauggcaccgagcauguaaacugucuaguguuugcauugcuuguguccaggugugacu

SEQ ID NO: 150695 - RNA, 64 nt, Homo Sapiens
acguucauuucaggagcuucaccccucagccuucuguuugcagaugacuggacaugccuggaag

SEQ ID NO: 150696 - RNA, 64 nt, Homo Sapiens
uuuaugguauaguugaacccaguggcagauuguacacugcuagcacugcuagcacacaguagca

SEQ ID NO: 150697 - RNA, 64 nt, Homo Sapiens
uaguugaacccaguggcagauuguacacugcuagcacugcuagcacacaguagcaaagcaaaca

SEQ ID NO: 150698 - RNA, 64 nt, Homo Sapiens
caggccagcuggagaagcuuccagaagggcccugcacugcuacccucuauuucccacucagggc

SEQ ID NO: 150699 - RNA, 64 nt, Homo Sapiens
cuaaagcuuaucuguaauucaccuccuuuuccaccacugcuaccuuaugugagcccucauugcc

SEQ ID NO: 150700 - RNA, 64 nt, Homo Sapiens; identical to SEQ ID NO: 98228

SEQ ID NO: 150701 - RNA, 64 nt, Homo Sapiens; identical to SEQ ID NO: 98229

SEQ ID NO: 150702 - RNA, 64 nt, Homo Sapiens; identical to SEQ ID NO: 98230

SEQ ID NO: 150703 - RNA, 64 nt, Homo Sapiens; identical to SEQ ID NO: 98231

SEQ ID NO: 150704 - RNA, 64 nt, Homo Sapiens; identical to SEQ ID NO: 98232

SEQ ID NO: 150705 - RNA, 64 nt, Homo Sapiens; identical to SEQ ID NO: 98233

SEQ ID NO: 150706 - RNA, 64 nt, Homo Sapiens; identical to SEQ ID NO: 98234

SEQ ID NO: 150707 - RNA, 64 nt, Homo Sapiens; identical to SEQ ID NO: 98235

SEQ ID NO: 150708 - RNA, 64 nt, Homo Sapiens; identical to SEQ ID NO: 98236

SEQ ID NO: 150709 - RNA, 64 nt, Homo Sapiens; identical to SEQ ID NO: 98237

SEQ ID NO: 150710 - RNA, 64 nt, Homo Sapiens; identical to SEQ ID NO: 98238

SEQ ID NO: 150711 - RNA, 64 nt, Homo Sapiens; identical to SEQ ID NO: 98239

SEQ ID NO: 150712 - RNA, 64 nt, Homo Sapiens; identical to SEQ ID NO: 98240

SEQ ID NO: 150713 - RNA, 64 nt, Homo Sapiens; identical to SEQ ID NO: 98241

SEQ ID NO: 150714 - RNA, 64 nt, Homo Sapiens; identical to SEQ ID NO: 98242

SEQ ID NO: 150715 - RNA, 64 nt, Homo Sapiens; identical to SEQ ID NO: 98243

SEQ ID NO: 150716 - RNA, 64 nt, Homo Sapiens; identical to SEQ ID NO: 98244

SEQ ID NO: 150717 - RNA, 64 nt, Homo Sapiens; identical to SEQ ID NO: 98245

SEQ ID NO: 150718 - RNA, 64 nt, Homo Sapiens; identical to SEQ ID NO: 98246

SEQ ID NO: 150719 - RNA, 64 nt, Homo Sapiens; identical to SEQ ID NO: 98247

SEQ ID NO: 150720 - RNA, 64 nt, Homo Sapiens; identical to SEQ ID NO: 98248

SEQ ID NO: 150721 - RNA, 64 nt, Homo Sapiens; identical to SEQ ID NO: 98249

SEQ ID NO: 150722 - RNA, 64 nt, Homo Sapiens; identical to SEQ ID NO: 98250

SEQ ID NO: 150723 - RNA, 64 nt, Homo Sapiens; identical to SEQ ID NO: 98251

SEQ ID NO: 150724 - RNA, 64 nt, Homo Sapiens; identical to SEQ ID NO: 98252

SEQ ID NO: 150725 - RNA, 64 nt, Homo Sapiens; identical to SEQ ID NO: 98253

SEQ ID NO: 150726 - RNA, 64 nt, Homo Sapiens; identical to SEQ ID NO: 98254

SEQ ID NO: 150727 - RNA, 64 nt, Homo Sapiens; identical to SEQ ID NO: 98255

SEQ ID NO: 150728 - RNA, 64 nt, Homo Sapiens; identical to SEQ ID NO: 98256

SEQ ID NO: 150729 - RNA, 64 nt, Homo Sapiens; identical to SEQ ID NO: 98257

SEQ ID NO: 150730 - RNA, 64 nt, Homo Sapiens; identical to SEQ ID NO: 98258

SEQ ID NO: 150731 - RNA, 64 nt, Homo Sapiens; identical to SEQ ID NO: 98259

SEQ ID NO: 150732 - RNA, 64 nt, Homo Sapiens; identical to SEQ ID NO: 98260

SEQ ID NO: 150733 - RNA, 64 nt, Homo Sapiens; identical to SEQ ID NO: 98261

SEQ ID NO: 150734 - RNA, 64 nt, Homo Sapiens; identical to SEQ ID NO: 98262

SEQ ID NO: 150735 - RNA, 64 nt, Homo Sapiens; identical to SEQ ID NO: 98263

SEQ ID NO: 150736 - RNA, 64 nt, Homo Sapiens; identical to SEQ ID NO: 98264

SEQ ID NO: 150737 - RNA, 64 nt, Homo Sapiens
ucagccaauccgauugccuuuuauuuuuacuuagcuuagcuauggcuuauuuaugugaaaaggg

SEQ ID NO: 150738 - RNA, 64 nt, Homo Sapiens
auaccaccuaauccuucugguaagcaccuuggugcuuagcuagacuaccuguaggaucaggguc

SEQ ID NO: 150739 - RNA, 64 nt, Homo Sapiens
aggaacaauauuggguguuugggagccagaaagcuuuguugacagaucagaaauaagauugacu

SEQ ID NO: 150740 - RNA, 64 nt, Homo Sapiens
uauaacccugguuuugugauaaaacugcuuagauuuuguugaugacauuagauuaguaguugca

SEQ ID NO: 150741 - RNA, 64 nt, Homo Sapiens
aaaauaaaccagggugauuuauguuuuuuuuuccuuuguugaaaaaaugcugaauuauugaacc

SEQ ID NO: 150742 - RNA, 64 nt, Homo Sapiens
cacguaaccuccaugugugggugauagagcaucuuuuguugacuacuugcuuuuuacgcacauu

SEQ ID NO: 150743 - RNA, 64 nt, Homo Sapiens
gcaaaauguugaagaaaaaacaggacuguaaagauuuguugacaucaaguuauucaaauuugua

SEQ ID NO: 150744 - RNA, 64 nt, Homo Sapiens
augguuucaaguuauucaaauuacaguaacuaauuuuguugaaauucagucuuguagugugugc

SEQ ID NO: 150745 - RNA, 64 nt, Homo Sapiens
cuuuguucuguuauauuguugguuguucauaguuuuuguugaagcucuagcuuaagaagaaacu

SEQ ID NO: 150746 - RNA, 64 nt, Homo Sapiens
cuacuucauuuuaauuguauauuauucaagcaccuuuguugaagcucaaaaaaaaugaugccuc

SEQ ID NO: 150747 - RNA, 64 nt, Homo Sapiens
uggggcccagcacagcagccugcaagggccccuguuuguugaugcagcuuuuguugaacaaaaa

SEQ ID NO: 150748 - RNA, 64 nt, Homo Sapiens
cagccugcaagggccccuguuuguugaugcagcuuuuguugaacaaaaaucgugcucuuuccug

SEQ ID NO: 150749 - RNA, 64 nt, Homo Sapiens
aaaauaaaauauaaaggguuuuaugcacagacuuuuuguugaccaauucaggccugcugcugag

SEQ ID NO: 150750 - RNA, 64 nt, Homo Sapiens
gcuucauucucacccuguaugcccuuuuggagcuuuuguugaggggucacuuaccaguuucugu

SEQ ID NO: 150751 - RNA, 64 nt, Homo Sapiens
ucugccugugggucugaggaaaacuucucugguguuuguugacuaacacuuguaugguccugua

SEQ ID NO: 150752 - RNA, 64 nt, Homo Sapiens
gucggcgacaagguugugcgagcccaccuggcucuuuguugacagaacccagagcccccacccc

SEQ ID NO: 150753 - RNA, 64 nt, Homo Sapiens
acauuaaugcuauacuagacaguaguaauuaccauuuguugaacuauauuuuugagguggucuu

SEQ ID NO: 150754 - RNA, 64 nt, Homo Sapiens
ugaauuauuuugauguaggcugauauaaaguacuuuuguugaagucuuuuucucuaaugucacc

SEQ ID NO: 150755 - RNA, 64 nt, Homo Sapiens
uuuugcaggacccugaucuuuguugagccuaauauuuguugagaucugagaaucacauuugguu

SEQ ID NO: 150756 - RNA, 64 nt, Homo Sapiens
cuaauauuuguugagauuuuagaaucacauuugguuuguugagcgaacgcuucugcuuaaucug

SEQ ID NO: 150757 - RNA, 64 nt, Homo Sapiens
uagaguauuuuugcagcauuugugaucauaacucuuuguugaacagaauggauaaaaauuauuu

SEQ ID NO: 150758 - RNA, 64 nt, Homo Sapiens
ccuguaaagaagaagaagaaguucauuuuuagauuuuguugaguugagguaaaucuacagcaua

SEQ ID NO: 150759 - RNA, 64 nt, Homo Sapiens
uucugcuuuguucucagugauguauaugcaacauuuuguugaaagccacgauggacuuacaagc

SEQ ID NO: 150760 - RNA, 64 nt, Homo Sapiens
auugaagacauuauugugugggauugugcugauuuuuguugauaacacaaaaaacacuauguuu

SEQ ID NO: 150761 - RNA, 64 nt, Homo Sapiens
uugcauagaagaauaguagguuugaauuuugguauuuguugagauaauauucauaagguauauu

SEQ ID NO: 150762 - RNA, 64 nt, Homo Sapiens
aagugacuguccccguaaaaucauucagaaucuguuuguugaucccuggcauugccaguuuucu

SEQ ID NO: 150763 - RNA, 64 nt, Homo Sapiens
aauuuggugcuauguguauaucuugagcuuuuaauuuguugaauuuucuaaacgcuuacaacuu

SEQ ID NO: 150764 - RNA, 64 nt, Homo Sapiens
agcaucuuuaugaaacaggcacaguacccuuugguuuguugacuguuuugauuuuauuucuuug

SEQ ID NO: 150765 - RNA, 64 nt, Homo Sapiens
ucaucaaagaucaccagggcguugaugcucaucauuuguugaugaaauucugcggcaaacauuu

SEQ ID NO: 150766 - RNA, 64 nt, Homo Sapiens
cucaucauuuguugaugucauucugcggcaaacauuuguugaugggguaggugaugguagaaaa

SEQ ID NO: 150767 - RNA, 64 nt, Homo Sapiens
guuuagaauugagcaaagaucuugggaagcuaauuuuguugaauauuggguaucauuuuuguuu

SEQ ID NO: 150768 - RNA, 64 nt, Homo Sapiens
aaaaacgacaauugaagagaauauauauauaggcuuuguugauggcacagcaacucauuuauau

SEQ ID NO: 150769 - RNA, 64 nt, Homo Sapiens
gaauaaauguuagcucuucugcggacacucagcauuuguugauuucaaagaguaucuggccaug

SEQ ID NO: 150770 - RNA, 64 nt, Homo Sapiens
cucgugcuguuaagagauuucaacaacaaaagcauuuguugacaucuuuuugagacuguuuuug

SEQ ID NO: 150771 - RNA, 64 nt, Homo Sapiens
uuuaggcccuuugacuaaguugauauggaaauauuuuguugaaaaacuguacagagcagcuuua

SEQ ID NO: 150772 - RNA, 64 nt, Homo Sapiens
uucauuucauuacagaauuguuuauaaaaguucauuuguugaaaaauaaggauccuuuuuaaua

SEQ ID NO: 150773 - RNA, 64 nt, Homo Sapiens
acuuauugauuaagaccuugcaaaucaauaucuauuuguugagcugugauuccaccucuugcac

SEQ ID NO: 150774 - RNA, 64 nt, Homo Sapiens
gaauuaaugaauuaagaguguauauucauauauauuuguugaguugucucaugggugcuccaua

SEQ ID NO: 150775 - RNA, 64 nt, Homo Sapiens
acucccccauuuuugguuuguuucuuuuuaaauauuuguugaguacuuacguguuuaucuaaca

SEQ ID NO: 150776 - RNA, 64 nt, Homo Sapiens
ucuuggcacuggaaggguaguucuggaaagcuacuuuguugagagucucauucuucccuggagu

SEQ ID NO: 150777 - RNA, 64 nt, Homo Sapiens
agcugaaaugugaauucuguaaauauuuauaugcuuuguugacuuguuaucuucaagagauguu

SEQ ID NO: 150778 - RNA, 64 nt, Homo Sapiens
uguuuuaacacauauugguuuauuucuuguauuuuuuguugagccauuuuucacucugauuuuu

SEQ ID NO: 150779 - RNA, 64 nt, Homo Sapiens
uuagucucagugaagacuaugccauauuaaauuuuuuguugacaugagcuuaaaauacaagacu

SEQ ID NO: 150780 - RNA, 64 nt, Homo Sapiens
uucugaaugcuucuaaguaaaaaguugcagcuguuuuguugacaguaauugcaaaaaaaaaaaa

SEQ ID NO: 150781 - RNA, 64 nt, Homo Sapiens
cuccugccugcuugccaaaauuccuauuuugauuuuuguugaguccugcauuuagucugccuug

SEQ ID NO: 150782 - RNA, 64 nt, Homo Sapiens
auuugaggcuuuuaaaacaaauggguuuucuuguuuuguugauuuuugagugacuguaguaugg

SEQ ID NO: 150783 - RNA, 64 nt, Homo Sapiens
ccagugugaauauucuagcuaccaaacauuguuuuuuguugaaaaacugacuuucuguugucua

SEQ ID NO: 150784 - RNA, 64 nt, Homo Sapiens
cccugagaggaguguuuauuucugaguaaggggcuuuguugaaagaggggguuagagagagcaa

SEQ ID NO: 150785 - RNA, 64 nt, Homo Sapiens
aucuuuacugcaaguguaaucacuucucgugacauuuguugauaugucccaaucucugcucucu

SEQ ID NO: 150786 - RNA, 64 nt, Homo Sapiens
auuaagcuguguucacucuauugaguccuggcuuuuuguugauugauaacaagaacuuagcuag

SEQ ID NO: 150787 - RNA, 64 nt, Homo Sapiens
ugggaccagaaaccaaguaauguauaauguggcuuuuguugaguuaaauaagaugcuauauaau

SEQ ID NO: 150788 - RNA, 64 nt, Homo Sapiens
ggcuuuguaccuuguaccuuuuuuagccuuggcuuuuguugaacuagaacccucagcacauacu

SEQ ID NO: 150789 - RNA, 64 nt, Homo Sapiens
uuaagaaacaaaagugcauaguuuagauuuuuuuuuuguugaauauguuuguucuuggacuuua

SEQ ID NO: 150790 - RNA, 64 nt, Homo Sapiens
gcgugggcuuuuucucccuuuguuuaaaaugucauuuguugagcaagaguuguauaguauuauc

SEQ ID NO: 150791 - RNA, 64 nt, Homo Sapiens
aaggaaaauauuuucccagcuagaaaaguauacucauucucauuuaaacucucucauuuggagg

SEQ ID NO: 150792 - RNA, 64 nt, Homo Sapiens
uccuuccuuauccuuguagccaauaaaacauugacauucucacguuuuauagaugagguaaaaa

SEQ ID NO: 150793 - RNA, 64 nt, Homo Sapiens
ucccagugcauuuuaaaaacagcacuggcuggggcauucucauucucugauggagccaucaaug

SEQ ID NO: 150794 - RNA, 64 nt, Homo Sapiens
aguaguuucauauccuguagacauccucuuaggacauucucaaauuucaaaauaaaaaauauuc

SEQ ID NO: 150795 - RNA, 64 nt, Homo Sapiens
uggaauguaaaccacaguauuuuggagugcagaacauucucaauuaagugauaaguccaaauga

SEQ ID NO: 150796 - RNA, 64 nt, Homo Sapiens
aguguauaccagaggguuaguuggggaaaaacuucauucucaggaaaagacuugaaugauuaug

SEQ ID NO: 150797 - RNA, 64 nt, Homo Sapiens
ucgccuugcugcugcuuuaauggccuagaaaucgcauucucaccguucaucagucccaacaaga

SEQ ID NO: 150798 - RNA, 64 nt, Homo Sapiens
ggcagggcagagggggaucuacugaaauugcuggcauucucaaacacauaccauucucaauccc

SEQ ID NO: 150799 - RNA, 64 nt, Homo Sapiens
cccacugaaauugcuggcauagagauccacauaccauucucaaucugaggaucacuccaagaaa

SEQ ID NO: 150800 - RNA, 64 nt, Homo Sapiens
agcuuagacucuaucaugggcccccaugaagcuccauucucaauacugaauaauuauuacuucc

SEQ ID NO: 150801 - RNA, 64 nt, Homo Sapiens
uugacauuuccuggaguugguuuuguccuugauucauucucaugucauucugcacacagucucu

SEQ ID NO: 150802 - RNA, 64 nt, Homo Sapiens
uggccugucauauaaaacauaggauugacagauacauucucagccccauguauugggcuuaguc

SEQ ID NO: 150803 - RNA, 64 nt, Homo Sapiens
agauaacuucauaaccagaauaagagaaucaagccauucucaaggacuaauacuguugguggca

SEQ ID NO: 150804 - RNA, 64 nt, Homo Sapiens
ccuguagguuuccauugcuccaucaagcaacccucauucucaugcagagcagcugaaaucuugc

SEQ ID NO: 150805 - RNA, 64 nt, Homo Sapiens
aaagccaaaaaucuuucucuauucuuccacaaaccauucucaaucuucuucuuggcuuccucuu

SEQ ID NO: 150806 - RNA, 64 nt, Homo Sapiens
cauugccaucuucugggagcuugcaagaaauguacauucucaggauccacuccagaccuauuga

SEQ ID NO: 150807 - RNA, 64 nt, Homo Sapiens
aaauauauuuuuaaaagcuuuguaaaaauuaugucauucucagaauuguugucuucaaagcauu

SEQ ID NO: 150808 - RNA, 64 nt, Homo Sapiens
cuauaacaagaaaagaaaugcagucacucacugccauucucacaagcagacuccaguauuggca

SEQ ID NO: 150809 - RNA, 64 nt, Homo Sapiens
agacuccaguauuggcacagccuuuccauccacccauucucagcuucacccuugccaguaaaaa

SEQ ID NO: 150810 - RNA, 64 nt, Homo Sapiens
auguacauauauauucucacauucugaaaaauaacauucucagaauccacagaaaauauacuua

SEQ ID NO: 150811 - RNA, 64 nt, Homo Sapiens
uggauuaaugcaaaagggguaauaaagacugcaacauucucaggaccaaauuaaacugcuaaaa

SEQ ID NO: 150812 - RNA, 64 nt, Homo Sapiens
auaaacaugcuugucuccauguccacagcauucacauucucaggaugggagaucuugaguugca

SEQ ID NO: 150813 - RNA, 64 nt, Homo Sapiens
aaugggagaucuugaguugcgagggcaaaggacccauucucagugaaaaaaaaaagagugacca

SEQ ID NO: 150814 - RNA, 64 nt, Homo Sapiens
gcguuugaaugugaauuagguauccuguuagcuccauucucaggcuaugagauugggugcagug

SEQ ID NO: 150815 - RNA, 64 nt, Homo Sapiens
gauguuuuuugcuuguaguacuuuuucucaccuucauucucaguuuugcuuccucugaggacau

SEQ ID NO: 150816 - RNA, 64 nt, Homo Sapiens
aaacauuauucucacugcaauguuuguaaugagccauucucaaucagagauuuuauauauauuu

SEQ ID NO: 150817 - RNA, 64 nt, Homo Sapiens
acucaucugccuagggagggaugagaaagcugcccauucucaaggucaccuuccugaaagauga

SEQ ID NO: 150818 - RNA, 64 nt, Homo Sapiens
aaaauaaugggcgcuuuggagaagaguguggagucauucucauugaauuauaaaagccagcagg

SEQ ID NO: 150819 - RNA, 64 nt, Homo Sapiens
cuguuuaugcuuuuggggggcauauauuggguuccauucucaccuauccacacaacauauccgu

SEQ ID NO: 150820 - RNA, 64 nt, Homo Sapiens
uauggaaaaaaaucauauugccuucucuuaaaaagguacauauacaggagaguagacuaggauu

SEQ ID NO: 150821 - RNA, 64 nt, Homo Sapiens
cugccgcuucucaaauccccgugaacguagaugagguacauacagaccaugugucaggaaaauu

SEQ ID NO: 150822 - RNA, 64 nt, Homo Sapiens; identical to SEQ ID NO: 80933

SEQ ID NO: 150823 - RNA, 64 nt, Homo Sapiens; identical to SEQ ID NO: 80934

SEQ ID NO: 150824 - RNA, 64 nt, Homo Sapiens; identical to SEQ ID NO: 80935

SEQ ID NO: 150825 - RNA, 64 nt, Homo Sapiens; identical to SEQ ID NO: 80936

SEQ ID NO: 150826 - RNA, 64 nt, Homo Sapiens; identical to SEQ ID NO: 80937

SEQ ID NO: 150827 - RNA, 64 nt, Homo Sapiens; identical to SEQ ID NO: 80938

SEQ ID NO: 150828 - RNA, 64 nt, Homo Sapiens; identical to SEQ ID NO: 80939

SEQ ID NO: 150829 - RNA, 64 nt, Homo Sapiens; identical to SEQ ID NO: 80940

SEQ ID NO: 150830 - RNA, 64 nt, Homo Sapiens; identical to SEQ ID NO: 80941

SEQ ID NO: 150831 - RNA, 64 nt, Homo Sapiens; identical to SEQ ID NO: 80942

SEQ ID NO: 150832 - RNA, 64 nt, Homo Sapiens; identical to SEQ ID NO: 80943

SEQ ID NO: 150833 - RNA, 64 nt, Homo Sapiens; identical to SEQ ID NO: 80944

SEQ ID NO: 150834 - RNA, 64 nt, Homo Sapiens; identical to SEQ ID NO: 80945

SEQ ID NO: 150835 - RNA, 64 nt, Homo Sapiens; identical to SEQ ID NO: 80946

SEQ ID NO: 150836 - RNA, 64 nt, Homo Sapiens; identical to SEQ ID NO: 80947

SEQ ID NO: 150837 - RNA, 64 nt, Homo Sapiens; identical to SEQ ID NO: 80948

SEQ ID NO: 150838 - RNA, 64 nt, Homo Sapiens; identical to SEQ ID NO: 80949

SEQ ID NO: 150839 - RNA, 64 nt, Homo Sapiens; identical to SEQ ID NO: 80950

SEQ ID NO: 150840 - RNA, 64 nt, Homo Sapiens; identical to SEQ ID NO: 80951

SEQ ID NO: 150841 - RNA, 64 nt, Homo Sapiens; identical to SEQ ID NO: 80952

SEQ ID NO: 150842 - RNA, 64 nt, Homo Sapiens; identical to SEQ ID NO: 80953

SEQ ID NO: 150843 - RNA, 64 nt, Homo Sapiens; identical to SEQ ID NO: 80954

SEQ ID NO: 150844 - RNA, 63 nt, Homo Sapiens; identical to SEQ ID NO: 80955

SEQ ID NO: 150845 - RNA, 64 nt, Homo Sapiens; identical to SEQ ID NO: 80956

SEQ ID NO: 150846 - RNA, 64 nt, Homo Sapiens; identical to SEQ ID NO: 80957

SEQ ID NO: 150847 - RNA, 64 nt, Homo Sapiens; identical to SEQ ID NO: 80958

SEQ ID NO: 150848 - RNA, 64 nt, Homo Sapiens; identical to SEQ ID NO: 80959

SEQ ID NO: 150849 - RNA, 64 nt, Homo Sapiens; identical to SEQ ID NO: 80960

SEQ ID NO: 150850 - RNA, 64 nt, Homo Sapiens; identical to SEQ ID NO: 80961

SEQ ID NO: 150851 - RNA, 64 nt, Homo Sapiens; identical to SEQ ID NO: 80962

SEQ ID NO: 150852 - RNA, 64 nt, Homo Sapiens; identical to SEQ ID NO: 80963

SEQ ID NO: 150853 - RNA, 64 nt, Homo Sapiens; identical to SEQ ID NO: 80964

SEQ ID NO: 150854 - RNA, 64 nt, Homo Sapiens; identical to SEQ ID NO: 80965

SEQ ID NO: 150855 - RNA, 64 nt, Homo Sapiens; identical to SEQ ID NO: 80966

SEQ ID NO: 150856 - RNA, 64 nt, Homo Sapiens; identical to SEQ ID NO: 80967

SEQ ID NO: 150857 - RNA, 64 nt, Homo Sapiens; identical to SEQ ID NO: 80968

SEQ ID NO: 150858 - RNA, 64 nt, Homo Sapiens; identical to SEQ ID NO: 80969

SEQ ID NO: 150859 - RNA, 64 nt, Homo Sapiens; identical to SEQ ID NO: 80970

SEQ ID NO: 150860 - RNA, 64 nt, Homo Sapiens; identical to SEQ ID NO: 80971

SEQ ID NO: 150861 - RNA, 64 nt, Homo Sapiens; identical to SEQ ID NO: 80972

SEQ ID NO: 150862 - RNA, 64 nt, Homo Sapiens; identical to SEQ ID NO: 80973

SEQ ID NO: 150863 - RNA, 64 nt, Homo Sapiens; identical to SEQ ID NO: 80974

SEQ ID NO: 150864 - RNA, 64 nt, Homo Sapiens; identical to SEQ ID NO: 80975

SEQ ID NO: 150865 - RNA, 64 nt, Homo Sapiens; identical to SEQ ID NO: 80976

SEQ ID NO: 150866 - RNA, 64 nt, Homo Sapiens; identical to SEQ ID NO: 80977

SEQ ID NO: 150867 - RNA, 64 nt, Homo Sapiens; identical to SEQ ID NO: 80978

SEQ ID NO: 150868 - RNA, 64 nt, Homo Sapiens; identical to SEQ ID NO: 80979

SEQ ID NO: 150869 - RNA, 64 nt, Homo Sapiens; identical to SEQ ID NO: 80980

SEQ ID NO: 150870 - RNA, 64 nt, Homo Sapiens; identical to SEQ ID NO: 80981

SEQ ID NO: 150871 - RNA, 64 nt, Homo Sapiens; identical to SEQ ID NO: 80982

SEQ ID NO: 150872 - RNA, 64 nt, Homo Sapiens; identical to SEQ ID NO: 80983

SEQ ID NO: 150873 - RNA, 64 nt, Homo Sapiens; identical to SEQ ID NO: 80984

SEQ ID NO: 150874 - RNA, 64 nt, Homo Sapiens; identical to SEQ ID NO: 80985

SEQ ID NO: 150875 - RNA, 64 nt, Homo Sapiens; identical to SEQ ID NO: 80986

SEQ ID NO: 150876 - RNA, 64 nt, Homo Sapiens; identical to SEQ ID NO: 80987

SEQ ID NO: 150877 - RNA, 64 nt, Homo Sapiens; identical to SEQ ID NO: 80988

SEQ ID NO: 150878 - RNA, 64 nt, Homo Sapiens; identical to SEQ ID NO: 80989

SEQ ID NO: 150879 - RNA, 64 nt, Homo Sapiens; identical to SEQ ID NO: 80990

SEQ ID NO: 150880 - RNA, 64 nt, Homo Sapiens; identical to SEQ ID NO: 80991

SEQ ID NO: 150881 - RNA, 64 nt, Homo Sapiens; identical to SEQ ID NO: 80992

SEQ ID NO: 150882 - RNA, 64 nt, Homo Sapiens; identical to SEQ ID NO: 80993

SEQ ID NO: 150883 - RNA, 64 nt, Homo Sapiens; identical to SEQ ID NO: 80994

SEQ ID NO: 150884 - RNA, 64 nt, Homo Sapiens; identical to SEQ ID NO: 80995

SEQ ID NO: 150885 - RNA, 64 nt, Homo Sapiens; identical to SEQ ID NO: 80996

SEQ ID NO: 150886 - RNA, 64 nt, Homo Sapiens; identical to SEQ ID NO: 80997

SEQ ID NO: 150887 - RNA, 64 nt, Homo Sapiens; identical to SEQ ID NO: 80998

SEQ ID NO: 150888 - RNA, 64 nt, Homo Sapiens; identical to SEQ ID NO: 80999

SEQ ID NO: 150889 - RNA, 64 nt, Homo Sapiens; identical to SEQ ID NO: 81000

SEQ ID NO: 150890 - RNA, 64 nt, Homo Sapiens; identical to SEQ ID NO: 81001

SEQ ID NO: 150891 - RNA, 64 nt, Homo Sapiens; identical to SEQ ID NO: 81002

SEQ ID NO: 150892 - RNA, 64 nt, Homo Sapiens; identical to SEQ ID NO: 81003

SEQ ID NO: 150893 - RNA, 64 nt, Homo Sapiens; identical to SEQ ID NO: 81004

SEQ ID NO: 150894 - RNA, 64 nt, Homo Sapiens; identical to SEQ ID NO: 81005

SEQ ID NO: 150895 - RNA, 64 nt, Homo Sapiens; identical to SEQ ID NO: 81006

SEQ ID NO: 150896 - RNA, 64 nt, Homo Sapiens; identical to SEQ ID NO: 81007

SEQ ID NO: 150897 - RNA, 64 nt, Homo Sapiens; identical to SEQ ID NO: 81008

SEQ ID NO: 150898 - RNA, 64 nt, Homo Sapiens; identical to SEQ ID NO: 81009

SEQ ID NO: 150899 - RNA, 64 nt, Homo Sapiens; identical to SEQ ID NO: 81010

SEQ ID NO: 150900 - RNA, 64 nt, Homo Sapiens; identical to SEQ ID NO: 81011

SEQ ID NO: 150901 - RNA, 64 nt, Homo Sapiens; identical to SEQ ID NO: 81012

SEQ ID NO: 150902 - RNA, 64 nt, Homo Sapiens; identical to SEQ ID NO: 81013

SEQ ID NO: 150903 - RNA, 64 nt, Homo Sapiens; identical to SEQ ID NO: 81014

SEQ ID NO: 150904 - RNA, 64 nt, Homo Sapiens; identical to SEQ ID NO: 81015

SEQ ID NO: 150905 - RNA, 64 nt, Homo Sapiens; identical to SEQ ID NO: 81016

SEQ ID NO: 150906 - RNA, 64 nt, Homo Sapiens; identical to SEQ ID NO: 81017

SEQ ID NO: 150907 - RNA, 64 nt, Homo Sapiens; identical to SEQ ID NO: 81018

SEQ ID NO: 150908 - RNA, 64 nt, Homo Sapiens; identical to SEQ ID NO: 81019

SEQ ID NO: 150909 - RNA, 64 nt, Homo Sapiens; identical to SEQ ID NO: 81020

SEQ ID NO: 150910 - RNA, 64 nt, Homo Sapiens; identical to SEQ ID NO: 81021

SEQ ID NO: 150911 - RNA, 64 nt, Homo Sapiens; identical to SEQ ID NO: 81022

SEQ ID NO: 150912 - RNA, 64 nt, Homo Sapiens; identical to SEQ ID NO: 81023

SEQ ID NO: 150913 - RNA, 64 nt, Homo Sapiens; identical to SEQ ID NO: 81024

SEQ ID NO: 150914 - RNA, 64 nt, Homo Sapiens; identical to SEQ ID NO: 81025

SEQ ID NO: 150915 - RNA, 64 nt, Homo Sapiens; identical to SEQ ID NO: 81026

SEQ ID NO: 150916 - RNA, 64 nt, Homo Sapiens; identical to SEQ ID NO: 81027

SEQ ID NO: 150917 - RNA, 64 nt, Homo Sapiens; identical to SEQ ID NO: 81028

SEQ ID NO: 150918 - RNA, 64 nt, Homo Sapiens; identical to SEQ ID NO: 81029

SEQ ID NO: 150919 - RNA, 64 nt, Homo Sapiens; identical to SEQ ID NO: 81030

SEQ ID NO: 150920 - RNA, 64 nt, Homo Sapiens; identical to SEQ ID NO: 81031

SEQ ID NO: 150921 - RNA, 64 nt, Homo Sapiens; identical to SEQ ID NO: 81032

SEQ ID NO: 150922 - RNA, 64 nt, Homo Sapiens; identical to SEQ ID NO: 81033

SEQ ID NO: 150923 - RNA, 64 nt, Homo Sapiens; identical to SEQ ID NO: 81034

SEQ ID NO: 150924 - RNA, 64 nt, Homo Sapiens; identical to SEQ ID NO: 81035

SEQ ID NO: 150925 - RNA, 64 nt, Homo Sapiens; identical to SEQ ID NO: 81036

SEQ ID NO: 150926 - RNA, 64 nt, Homo Sapiens; identical to SEQ ID NO: 81037

SEQ ID NO: 150927 - RNA, 64 nt, Homo Sapiens; identical to SEQ ID NO: 81038

SEQ ID NO: 150928 - RNA, 64 nt, Homo Sapiens; identical to SEQ ID NO: 81039

SEQ ID NO: 150929 - RNA, 64 nt, Homo Sapiens; identical to SEQ ID NO: 81040

SEQ ID NO: 150930 - RNA, 64 nt, Homo Sapiens; identical to SEQ ID NO: 81041

SEQ ID NO: 150931 - RNA, 64 nt, Homo Sapiens; identical to SEQ ID NO: 81042

SEQ ID NO: 150932 - RNA, 61 nt, Homo Sapiens
acuuuuugaauuguugcaguguuggagaugccauuuucaccuuuuuaaaaagaugcauuuu

SEQ ID NO: 150933 - RNA, 61 nt, Homo Sapiens
cgccucauucccacccccaacaaagcacuaucauuuucauuuggaauggguauuuucuguu

SEQ ID NO: 150934 - RNA, 61 nt, Homo Sapiens
accagguuucauuuugggccugcugugucuucauuuucauuuauuuucuugaggaaaauau

SEQ ID NO: 150935 - RNA, 61 nt, Homo Sapiens
ggaagauuuaugaacagaaauauauuucagacauuuucacuugcuucauuguuacauguaa

SEQ ID NO: 150936 - RNA, 61 nt, Homo Sapiens
aaucccacugcauagaaauaacaagcguuaacauuuucauauuuuuuucuuucagucauuu

SEQ ID NO: 150937 - RNA, 61 nt, Homo Sapiens
uaagccugucucuauuguuggaauuucaggucauuuucauaaauauuguugcaauaaauau

SEQ ID NO: 150938 - RNA, 61 nt, Homo Sapiens
gcaaaacaaauggguauucuuuucauacaaccauuuucaaaugaaccuuagaaaagucuua

SEQ ID NO: 150939 - RNA, 61 nt, Homo Sapiens
auugauccauuuauuuuaauggcugccuuuucauuuucaucuuuucuugcugcuacccauc

SEQ ID NO: 150940 - RNA, 61 nt, Homo Sapiens
gaugcauaauuuucuuauuauucuaagccugcauuuucacuauugaaacucagaacuauau

SEQ ID NO: 150941 - RNA, 61 nt, Homo Sapiens
uuccaugcauacucgggcauaucacucauuccauuuucaugcuaccuaucaugcuguaugu

SEQ ID NO: 150942 - RNA, 61 nt, Homo Sapiens
cucaaauuccuguuuccaacaggcaacaaagcauuuucaaaagauaaagcaaaagauaauu

SEQ ID NO: 150943 - RNA, 61 nt, Homo Sapiens
ugcaaauugaagcaacaguucauuaaucucucauuuucaucugaacucuaagaaaaucaac

SEQ ID NO: 150944 - RNA, 61 nt, Homo Sapiens
gaguuauuuaugaauuagaggcuauagcucacauuuucaauccucuauuucuuuuuuuaaa

SEQ ID NO: 150945 - RNA, 61 nt, Homo Sapiens
acugugaucuuaaaaguuaccaaaccaaagucauuuucaguuugaggcaaccaaaccuuuc

SEQ ID NO: 150946 - RNA, 61 nt, Homo Sapiens
acagacaaacuugauuucuucuagaagauaacauuuucaauacugucccacuucucaucuu

SEQ ID NO: 150947 - RNA, 61 nt, Homo Sapiens
uucugcaacugaaauuacauauugcaggagacauuuucauaucaucaaugugacauuuaca

SEQ ID NO: 150948 - RNA, 61 nt, Homo Sapiens
uuauuuuuuaaaguagguuugccaauaaaaucauuuucaaccacuacauuuuguuaauacu

SEQ ID NO: 150949 - RNA, 61 nt, Homo Sapiens
uacuuagcuuuugcuuucuuaagaaagauaacauuuucaaaccuuucacagcaaguguuag

SEQ ID NO: 150950 - RNA, 61 nt, Homo Sapiens
uuauaucuuuguaauuuuccugcuacuuuaucauuuucaagauguccucuaggaauuuuuu

SEQ ID NO: 150951 - RNA, 61 nt, Homo Sapiens
ugagacuagacuuuacaacugucuuugauggcauuuucagaacaauaaaugucacaauccc

SEQ ID NO: 150952 - RNA, 61 nt, Homo Sapiens
uccgcuggaacuaaaggauaacugcagugcucauuuucaggccucagaauaagugcacucu

SEQ ID NO: 150953 - RNA, 61 nt, Homo Sapiens
uaaauaaggguaauucauuuuuuauuaaagucauuuucacguuaaguuccuauuuuuguau

SEQ ID NO: 150954 - RNA, 61 nt, Homo Sapiens
ugguuguucuuaccagccacaaaguaaacuucauuuucaggcaguguuucugggggagguu

SEQ ID NO: 150955 - RNA, 61 nt, Homo Sapiens
ggaaggcaaaugaagugaaaaaaaaaaaugccauuuucaauccuuccuuucuccccuuugu

SEQ ID NO: 150956 - RNA, 61 nt, Homo Sapiens
cuuuugcuuacaguguuguccccaaaugggucauuuucaaggauuacucauuugaaaacac

SEQ ID NO: 150957 - RNA, 61 nt, Homo Sapiens
agugugggguggggauggauuaugaugaaaucauuuucaaucuuaaaauauaauacaacaa

SEQ ID NO: 150958 - RNA, 61 nt, Homo Sapiens
cuuauaacuguaauauauagauucagaaauacauuuucauuauccaaaaucagcuucaaca

SEQ ID NO: 150959 - RNA, 61 nt, Homo Sapiens
uggcagaggcuacuacaaaaagcaaccuuuucauuuucacuaagaguuuaaaagcuauugu

SEQ ID NO: 150960 - RNA, 61 nt, Homo Sapiens
cauggaucauuacauuuuucaagcugcaguucauuuucaugcuaaaauauauacuacagga

SEQ ID NO: 150961 - RNA, 61 nt, Homo Sapiens
ugaauuguauagauauaugauuauuuggcaacauuuucaucgauuuuaguuuuguuucucu

SEQ ID NO: 150962 - RNA, 61 nt, Homo Sapiens
aauauaaggauguauuauugcaaaauauuaacauuuucauagaaagaugaaauaaaguauu

SEQ ID NO: 150963 - RNA, 61 nt, Homo Sapiens
uuggcagcaaaaaguucucaugacaaauaaucauuuucaucuaaaacuuauuaaauucgug

SEQ ID NO: 150964 - RNA, 61 nt, Homo Sapiens
cacuuagucauuuucuccuuuuuuuaagaaccauuuucaucugauuuuuaaacucacgaua

SEQ ID NO: 150965 - RNA, 61 nt, Homo Sapiens
ccuuuuacagcguauuacuuagugaacauuacauuuucagaauagauccuaauauuuuauu

SEQ ID NO: 150966 - RNA, 61 nt, Homo Sapiens
aacucugcugaggucacuuaaaggauaugaacauuuucaaguuugacaagagaagaauuug

SEQ ID NO: 150967 - RNA, 61 nt, Homo Sapiens
guuauuucaaagguucuuugaauuuaguuaccauuuucaguaaggauuuuuauuuuguuau

SEQ ID NO: 150968 - RNA, 61 nt, Homo Sapiens
ggagccuaguugaagugcuauguucacuuuucauuuucaaaaaggccagcauuaggaaacu

SEQ ID NO: 150969 - RNA, 61 nt, Homo Sapiens
gguuuauggugggcaauauuacauaaauaaucauuuucaguuagagaaauaaauggaauau

SEQ ID NO: 150970 - RNA, 61 nt, Homo Sapiens
uuuguguuauuuuugcuugaaacaacgcacacauuuucaacaaccaaaaaaugacaauuuc

SEQ ID NO: 150971 - RNA, 61 nt, Homo Sapiens
ugagaaaacuuuauuugucaaagucagaaaacauuuucaucuuauugagagauauguuuuu

SEQ ID NO: 150972 - RNA, 61 nt, Homo Sapiens
ucaucugaugcaauuugcucuuauaaagagacauuuucauagguucagaguaacucaccuc

SEQ ID NO: 150973 - RNA, 61 nt, Homo Sapiens
augcaucagagagccaaaacauucaguauugcauuuucacauaggugaugaaaugacuuug

SEQ ID NO: 150974 - RNA, 61 nt, Homo Sapiens
uuuuuuguuacauuguuacaaguguuaaugacauuuucauuaauggaugaaaacuucaggg

SEQ ID NO: 150975 - RNA, 61 nt, Homo Sapiens
aaugguaagcauuguuaauuucuguaaugaacauuuucaauuaaauuuaucuuguuugugu

SEQ ID NO: 150976 - RNA, 61 nt, Homo Sapiens
cucuaaauauuuaaaaacaguucuucucaaacauuuucauucagauagcuuucugaaaguu

SEQ ID NO: 150977 - RNA, 61 nt, Homo Sapiens
aauguaaaauguuauauaugcaucaguacagcauuuucaacauauuggcaacauauuuuaa

SEQ ID NO: 150978 - RNA, 61 nt, Homo Sapiens
uuugaaaccacauuuuuauuguuugauguuucauuuucagacuuuuuaaugucagucauua

SEQ ID NO: 150979 - RNA, 61 nt, Homo Sapiens
uugcauuauuaauuugaauagaaaauaaucacauuuucaacccauuuauacaaauuguuaa

SEQ ID NO: 150980 - RNA, 61 nt, Homo Sapiens
agcuuacaaaaacuaagugggagcuucuggacauuuucaaguuuaauaucauacuaagugu

SEQ ID NO: 150981 - RNA, 61 nt, Homo Sapiens
uauaggccaaauccugccaguuuuaaauguccauuuucauuucuguauuuuccccauauua

SEQ ID NO: 150982 - RNA, 60 nt, Homo Sapiens
uguugggcagaggcccaauaauaaaaaauucauuuucauucuguccaacagaaaagcuga

SEQ ID NO: 150983 - RNA, 61 nt, Homo Sapiens
uguuuguuuuccuuuuauuuggcuuugcaaccauuuucauuggccagacauagcaucuugu

SEQ ID NO: 150984 - RNA, 61 nt, Homo Sapiens
uacucauuuaaaguauuuuagugccauuuugcauuuucauccuggaaugaguugaaaaaau

SEQ ID NO: 150985 - RNA, 61 nt, Homo Sapiens
agaauaaagagaagauuugaauuuucaguuucauuuucaaaaacuauuuaccaaaacaaau

SEQ ID NO: 150986 - RNA, 61 nt, Homo Sapiens
uucuuuacuaaggauacuauucaaaaauuaacauuuucaucucaguaaguuuuuagaacau

SEQ ID NO: 150987 - RNA, 61 nt, Homo Sapiens
uuuggccuuuccuguuuuuaaaaaucaguuucauuuucauauuucauagaucagcuauugg

SEQ ID NO: 150988 - RNA, 61 nt, Homo Sapiens
aaauuauacuaaagugagaugcauuuuuucucauuuucagcaagacuccucuaagcauuua

SEQ ID NO: 150989 - RNA, 61 nt, Homo Sapiens
cgguccagaaugugacggauucgacucuauucauuuucaaauaaagccaugagccguggaa

SEQ ID NO: 150990 - RNA, 61 nt, Homo Sapiens
gcuacuacgaagaaaaucuuauuuuucugaacauuuucaugaauccaggggacuugaaaau

SEQ ID NO: 150991 - RNA, 61 nt, Homo Sapiens
cccuggaagacuugaucaccuuuuucugugucauuuucagucaaagagggccucucuuaca

SEQ ID NO: 150992 - RNA, 61 nt, Homo Sapiens
uagagcuuaauuucuugagaaauucaacagucauuuucaccagcauaauuuuaucuuaagg

SEQ ID NO: 150993 - RNA, 61 nt, Homo Sapiens
uuaaagcaggaaaaccugaaugugaugugcacauuuucaucccacauggacaauguaugug

SEQ ID NO: 150994 - RNA, 61 nt, Homo Sapiens
uucacucugugguaagcugaggaauaugucacauuuucagucaaagaaccaugauuaaaaa

SEQ ID NO: 150995 - RNA, 61 nt, Homo Sapiens
uaccauucuauagucaugaaccccuucagugcauuuucauuuuuuuauuaacagcaacuaa

SEQ ID NO: 150996 - RNA, 61 nt, Homo Sapiens
ucugcagaaccauagcuuccagagugcccaucauuuucaggaguauuuccagaaacauuug

SEQ ID NO: 150997 - RNA, 61 nt, Homo Sapiens
uguuacagaugugaacuuuauuuguacauuccauuuucaauugucugucuguccggucuug

SEQ ID NO: 150998 - RNA, 61 nt, Homo Sapiens
ugaggccaucucugagcaguggacucaaaagcauuuucaggcaugucagagaagggaggac

SEQ ID NO: 150999 - RNA, 61 nt, Homo Sapiens
uggaggaacuguuacauguucgguacuaagucauuuucaggggauugaaagacuauugcug

SEQ ID NO: 151000 - RNA, 61 nt, Homo Sapiens
gagcuuuuaaugaagcagagagcuaguacuucauuuucacuggauacauuuucagcaucau

SEQ ID NO: 151001 - RNA, 61 nt, Homo Sapiens
cagagagcuaguacuucauuuucacuggauacauuuucagcaucaugaguugucacagccu

SEQ ID NO: 151002 - RNA, 61 nt, Homo Sapiens
ccacaguugaccacagguaauuucuauuuaacauuuucagaugaugaauuauuucugaaau

SEQ ID NO: 151003 - RNA, 61 nt, Homo Sapiens
uuuauauucuguaacaugaaaauuuuuuauccauuuucaucuaauguguguacuucauaau

SEQ ID NO: 151004 - RNA, 61 nt, Homo Sapiens
uggccauguauccguaaguacuugcugucuucauuuucauguugcaugguucauaacauug

SEQ ID NO: 151005 - RNA, 61 nt, Homo Sapiens
uuuggcaucauguuguuuuaugcuuauaaagcauuuucauaugaacagaaaguuuauauuu

SEQ ID NO: 151006 - RNA, 61 nt, Homo Sapiens
auuuuaaaaugggggauaauuuugcuuuguccauuuucaucuauugguuaaguugcuugcu

SEQ ID NO: 151007 - RNA, 61 nt, Homo Sapiens
gcauuguuauugccauauuuuguuuuggagacauuuucaguauuuuuuaaaauguagaguu

SEQ ID NO: 151008 - RNA, 61 nt, Homo Sapiens
uaaggucuuuucuuaaaaaaaaaauccaccucauuuucaguuaacaugugccauuaaauag

SEQ ID NO: 151009 - RNA, 61 nt, Homo Sapiens
cauguuuacaaagaacuguuuuguauauagacauuuucaggcacgugcuuugcaccaaccc

SEQ ID NO: 151010 - RNA, 61 nt, Homo Sapiens
uaguuuggcaaagcauugaaguacaaagguacauuuucaauuaaaaagcacacuucuacaa

SEQ ID NO: 151011 - RNA, 61 nt, Homo Sapiens
uuuuacauuuuaaacccuauuguccuuuaugcauuuucaaugaaauggaaugaaggcuaau

SEQ ID NO: 151012 - RNA, 61 nt, Homo Sapiens
aaaagcugaucaauuuuucuuccuagcuucccauuuucaaaugggacaucacucauauccc

SEQ ID NO: 151013 - RNA, 61 nt, Homo Sapiens
aauuucaagucccuaauuuacucuaaccaagcauuuucagucuuacaaagaaaucuagugc

SEQ ID NO: 151014 - RNA, 61 nt, Homo Sapiens
gcuuugccaagcuugugagagcugguugcuacauuuucaggauuuuuacaaguugguaaac

SEQ ID NO: 151015 - RNA, 61 nt, Homo Sapiens
cucaaaucauuuaagaaggaguucugacauucauuuucauuguuuuacuuuugucuuccuc

SEQ ID NO: 151016 - RNA, 61 nt, Homo Sapiens
auuuccuggcauugauuuaucaggcagcauccauuuucagacuuagugauuucauguuuaa

SEQ ID NO: 151017 - RNA, 61 nt, Homo Sapiens
ucuguacgcaucugcggguuuacauauuuggcauuuucagucuuuugucaacaauuuugug

SEQ ID NO: 151018 - RNA, 61 nt, Homo Sapiens
gcugauaagaaugaauauagaugcuggccagcauuuucauucauuuuaaggaaaguagcaa

SEQ ID NO: 151019 - RNA, 61 nt, Homo Sapiens
auauaacacuuuccagccuauagcagaagcacauuuucagacugcaauauagagacugugu

SEQ ID NO: 151020 - RNA, 61 nt, Homo Sapiens
ucaaguuugguuuuugaauagacagagguuucauuuucaucucauuagggcuuuuuuguac

SEQ ID NO: 151021 - RNA, 61 nt, Homo Sapiens
ucucacccaguucagguguauagggaauuuucauuuucauuauuucaaggaauagaguuuu

SEQ ID NO: 151022 - RNA, 64 nt, Homo Sapiens; identical to SEQ ID NO: 134304

SEQ ID NO: 151023 - RNA, 64 nt, Homo Sapiens; identical to SEQ ID NO: 134305

SEQ ID NO: 151024 - RNA, 64 nt, Homo Sapiens; identical to SEQ ID NO: 134306

SEQ ID NO: 151025 - RNA, 64 nt, Homo Sapiens; identical to SEQ ID NO: 134307

SEQ ID NO: 151026 - RNA, 64 nt, Homo Sapiens; identical to SEQ ID NO: 134308

SEQ ID NO: 151027 - RNA, 64 nt, Homo Sapiens; identical to SEQ ID NO: 134309

SEQ ID NO: 151028 - RNA, 64 nt, Homo Sapiens; identical to SEQ ID NO: 134310

SEQ ID NO: 151029 - RNA, 64 nt, Homo Sapiens; identical to SEQ ID NO: 134311

SEQ ID NO: 151030 - RNA, 64 nt, Homo Sapiens; identical to SEQ ID NO: 134312

SEQ ID NO: 151031 - RNA, 64 nt, Homo Sapiens; identical to SEQ ID NO: 134313

SEQ ID NO: 151032 - RNA, 64 nt, Homo Sapiens; identical to SEQ ID NO: 134314

SEQ ID NO: 151033 - RNA, 64 nt, Homo Sapiens; identical to SEQ ID NO: 134315

SEQ ID NO: 151034 - RNA, 64 nt, Homo Sapiens; identical to SEQ ID NO: 134316

SEQ ID NO: 151035 - RNA, 64 nt, Homo Sapiens; identical to SEQ ID NO: 134317

SEQ ID NO: 151036 - RNA, 64 nt, Homo Sapiens; identical to SEQ ID NO: 134318

SEQ ID NO: 151037 - RNA, 64 nt, Homo Sapiens; identical to SEQ ID NO: 134319

SEQ ID NO: 151038 - RNA, 64 nt, Homo Sapiens; identical to SEQ ID NO: 134320

SEQ ID NO: 151039 - RNA, 64 nt, Homo Sapiens; identical to SEQ ID NO: 134321

SEQ ID NO: 151040 - RNA, 64 nt, Homo Sapiens; identical to SEQ ID NO: 134322

SEQ ID NO: 151041 - RNA, 64 nt, Homo Sapiens; identical to SEQ ID NO: 134323

SEQ ID NO: 151042 - RNA, 64 nt, Homo Sapiens; identical to SEQ ID NO: 134324

SEQ ID NO: 151043 - RNA, 64 nt, Homo Sapiens; identical to SEQ ID NO: 134325

SEQ ID NO: 151044 - RNA, 64 nt, Homo Sapiens; identical to SEQ ID NO: 134326

SEQ ID NO: 151045 - RNA, 64 nt, Homo Sapiens; identical to SEQ ID NO: 134327

SEQ ID NO: 151046 - RNA, 64 nt, Homo Sapiens; identical to SEQ ID NO: 134328

SEQ ID NO: 151047 - RNA, 64 nt, Homo Sapiens; identical to SEQ ID NO: 134329

SEQ ID NO: 151048 - RNA, 64 nt, Homo Sapiens; identical to SEQ ID NO: 134330

SEQ ID NO: 151049 - RNA, 64 nt, Homo Sapiens; identical to SEQ ID NO: 134331

SEQ ID NO: 151050 - RNA, 64 nt, Homo Sapiens; identical to SEQ ID NO: 134332

SEQ ID NO: 151051 - RNA, 64 nt, Homo Sapiens; identical to SEQ ID NO: 134333

SEQ ID NO: 151052 - RNA, 64 nt, Homo Sapiens; identical to SEQ ID NO: 134334

SEQ ID NO: 151053 - RNA, 64 nt, Homo Sapiens; identical to SEQ ID NO: 134335

SEQ ID NO: 151054 - RNA, 64 nt, Homo Sapiens; identical to SEQ ID NO: 134336

SEQ ID NO: 151055 - RNA, 64 nt, Homo Sapiens; identical to SEQ ID NO: 134337

SEQ ID NO: 151056 - RNA, 64 nt, Homo Sapiens; identical to SEQ ID NO: 134338

SEQ ID NO: 151057 - RNA, 64 nt, Homo Sapiens; identical to SEQ ID NO: 134339

SEQ ID NO: 151058 - RNA, 64 nt, Homo Sapiens; identical to SEQ ID NO: 134340

SEQ ID NO: 151059 - RNA, 64 nt, Homo Sapiens; identical to SEQ ID NO: 134341

SEQ ID NO: 151060 - RNA, 64 nt, Homo Sapiens; identical to SEQ ID NO: 134342

SEQ ID NO: 151061 - RNA, 64 nt, Homo Sapiens; identical to SEQ ID NO: 134343

SEQ ID NO: 151062 - RNA, 64 nt, Homo Sapiens; identical to SEQ ID NO: 134344

SEQ ID NO: 151063 - RNA, 64 nt, Homo Sapiens; identical to SEQ ID NO: 134345

SEQ ID NO: 151064 - RNA, 64 nt, Homo Sapiens; identical to SEQ ID NO: 134346

SEQ ID NO: 151065 - RNA, 64 nt, Homo Sapiens; identical to SEQ ID NO: 134347

SEQ ID NO: 151066 - RNA, 64 nt, Homo Sapiens; identical to SEQ ID NO: 134348

SEQ ID NO: 151067 - RNA, 64 nt, Homo Sapiens; identical to SEQ ID NO: 134349

SEQ ID NO: 151068 - RNA, 64 nt, Homo Sapiens; identical to SEQ ID NO: 134350

SEQ ID NO: 151069 - RNA, 64 nt, Homo Sapiens; identical to SEQ ID NO: 134351

SEQ ID NO: 151070 - RNA, 64 nt, Homo Sapiens; identical to SEQ ID NO: 134352

SEQ ID NO: 151071 - RNA, 64 nt, Homo Sapiens; identical to SEQ ID NO: 134353

SEQ ID NO: 151072 - RNA, 64 nt, Homo Sapiens; identical to SEQ ID NO: 134354

SEQ ID NO: 151073 - RNA, 64 nt, Homo Sapiens; identical to SEQ ID NO: 134355

SEQ ID NO: 151074 - RNA, 64 nt, Homo Sapiens; identical to SEQ ID NO: 134356

SEQ ID NO: 151075 - RNA, 64 nt, Homo Sapiens; identical to SEQ ID NO: 134357

SEQ ID NO: 151076 - RNA, 64 nt, Homo Sapiens; identical to SEQ ID NO: 134358

SEQ ID NO: 151077 - RNA, 64 nt, Homo Sapiens; identical to SEQ ID NO: 134359

SEQ ID NO: 151078 - RNA, 64 nt, Homo Sapiens; identical to SEQ ID NO: 134360

SEQ ID NO: 151079 - RNA, 64 nt, Homo Sapiens; identical to SEQ ID NO: 134361

SEQ ID NO: 151080 - RNA, 64 nt, Homo Sapiens; identical to SEQ ID NO: 134362

SEQ ID NO: 151081 - RNA, 64 nt, Homo Sapiens; identical to SEQ ID NO: 134363

SEQ ID NO: 151082 - RNA, 64 nt, Homo Sapiens; identical to SEQ ID NO: 134364

SEQ ID NO: 151083 - RNA, 64 nt, Homo Sapiens; identical to SEQ ID NO: 134365

SEQ ID NO: 151084 - RNA, 64 nt, Homo Sapiens; identical to SEQ ID NO: 134366

SEQ ID NO: 151085 - RNA, 64 nt, Homo Sapiens; identical to SEQ ID NO: 134367

SEQ ID NO: 151086 - RNA, 64 nt, Homo Sapiens; identical to SEQ ID NO: 134368

SEQ ID NO: 151087 - RNA, 64 nt, Homo Sapiens; identical to SEQ ID NO: 134369

SEQ ID NO: 151088 - RNA, 64 nt, Homo Sapiens; identical to SEQ ID NO: 134370

SEQ ID NO: 151089 - RNA, 64 nt, Homo Sapiens; identical to SEQ ID NO: 134371

SEQ ID NO: 151090 - RNA, 64 nt, Homo Sapiens; identical to SEQ ID NO: 134372

SEQ ID NO: 151091 - RNA, 64 nt, Homo Sapiens; identical to SEQ ID NO: 134373

SEQ ID NO: 151092 - RNA, 64 nt, Homo Sapiens; identical to SEQ ID NO: 134374

SEQ ID NO: 151093 - RNA, 64 nt, Homo Sapiens; identical to SEQ ID NO: 134375

SEQ ID NO: 151094 - RNA, 64 nt, Homo Sapiens; identical to SEQ ID NO: 134376

SEQ ID NO: 151095 - RNA, 64 nt, Homo Sapiens; identical to SEQ ID NO: 134377

SEQ ID NO: 151096 - RNA, 64 nt, Homo Sapiens; identical to SEQ ID NO: 134378

SEQ ID NO: 151097 - RNA, 64 nt, Homo Sapiens; identical to SEQ ID NO: 134379

SEQ ID NO: 151098 - RNA, 64 nt, Homo Sapiens; identical to SEQ ID NO: 134380

SEQ ID NO: 151099 - RNA, 64 nt, Homo Sapiens; identical to SEQ ID NO: 134381

SEQ ID NO: 151100 - RNA, 64 nt, Homo Sapiens; identical to SEQ ID NO: 134382

SEQ ID NO: 151101 - RNA, 64 nt, Homo Sapiens; identical to SEQ ID NO: 134383

SEQ ID NO: 151102 - RNA, 64 nt, Homo Sapiens; identical to SEQ ID NO: 134384

SEQ ID NO: 151103 - RNA, 64 nt, Homo Sapiens; identical to SEQ ID NO: 134385

SEQ ID NO: 151104 - RNA, 64 nt, Homo Sapiens; identical to SEQ ID NO: 134386

SEQ ID NO: 151105 - RNA, 64 nt, Homo Sapiens; identical to SEQ ID NO: 134387

SEQ ID NO: 151106 - RNA, 64 nt, Homo Sapiens; identical to SEQ ID NO: 134388

SEQ ID NO: 151107 - RNA, 64 nt, Homo Sapiens; identical to SEQ ID NO: 134389

SEQ ID NO: 151108 - RNA, 64 nt, Homo Sapiens; identical to SEQ ID NO: 134390

SEQ ID NO: 151109 - RNA, 64 nt, Homo Sapiens; identical to SEQ ID NO: 134391

SEQ ID NO: 151110 - RNA, 64 nt, Homo Sapiens; identical to SEQ ID NO: 134392

SEQ ID NO: 151111 - RNA, 64 nt, Homo Sapiens; identical to SEQ ID NO: 134393

SEQ ID NO: 151112 - RNA, 64 nt, Homo Sapiens; identical to SEQ ID NO: 134394

SEQ ID NO: 151113 - RNA, 64 nt, Homo Sapiens; identical to SEQ ID NO: 134395

SEQ ID NO: 151114 - RNA, 64 nt, Homo Sapiens; identical to SEQ ID NO: 134396

SEQ ID NO: 151115 - RNA, 64 nt, Homo Sapiens; identical to SEQ ID NO: 134397

SEQ ID NO: 151116 - RNA, 64 nt, Homo Sapiens; identical to SEQ ID NO: 134398

SEQ ID NO: 151117 - RNA, 64 nt, Homo Sapiens; identical to SEQ ID NO: 134399

SEQ ID NO: 151118 - RNA, 64 nt, Homo Sapiens; identical to SEQ ID NO: 134400

SEQ ID NO: 151119 - RNA, 64 nt, Homo Sapiens; identical to SEQ ID NO: 134401

SEQ ID NO: 151120 - RNA, 64 nt, Homo Sapiens; identical to SEQ ID NO: 134402

SEQ ID NO: 151121 - RNA, 64 nt, Homo Sapiens; identical to SEQ ID NO: 134403

SEQ ID NO: 151122 - RNA, 64 nt, Homo Sapiens; identical to SEQ ID NO: 134404

SEQ ID NO: 151123 - RNA, 64 nt, Homo Sapiens; identical to SEQ ID NO: 134405

SEQ ID NO: 151124 - RNA, 64 nt, Homo Sapiens; identical to SEQ ID NO: 134406

SEQ ID NO: 151125 - RNA, 64 nt, Homo Sapiens; identical to SEQ ID NO: 134407

SEQ ID NO: 151126 - RNA, 64 nt, Homo Sapiens; identical to SEQ ID NO: 134408

SEQ ID NO: 151127 - RNA, 64 nt, Homo Sapiens; identical to SEQ ID NO: 134409

SEQ ID NO: 151128 - RNA, 64 nt, Homo Sapiens; identical to SEQ ID NO: 134410

SEQ ID NO: 151129 - RNA, 64 nt, Homo Sapiens; identical to SEQ ID NO: 134411

SEQ ID NO: 151130 - RNA, 64 nt, Homo Sapiens; identical to SEQ ID NO: 134412

SEQ ID NO: 151131 - RNA, 64 nt, Homo Sapiens; identical to SEQ ID NO: 134413

SEQ ID NO: 151132 - RNA, 64 nt, Homo Sapiens; identical to SEQ ID NO: 134414

SEQ ID NO: 151133 - RNA, 64 nt, Homo Sapiens; identical to SEQ ID NO: 134415

SEQ ID NO: 151134 - RNA, 64 nt, Homo Sapiens; identical to SEQ ID NO: 134416

SEQ ID NO: 151135 - RNA, 64 nt, Homo Sapiens; identical to SEQ ID NO: 134417

SEQ ID NO: 151136 - RNA, 64 nt, Homo Sapiens; identical to SEQ ID NO: 134418

SEQ ID NO: 151137 - RNA, 64 nt, Homo Sapiens; identical to SEQ ID NO: 134419

SEQ ID NO: 151138 - RNA, 64 nt, Homo Sapiens; identical to SEQ ID NO: 134420

SEQ ID NO: 151139 - RNA, 64 nt, Homo Sapiens; identical to SEQ ID NO: 134421

SEQ ID NO: 151140 - RNA, 64 nt, Homo Sapiens; identical to SEQ ID NO: 134422

SEQ ID NO: 151141 - RNA, 64 nt, Homo Sapiens; identical to SEQ ID NO: 134423

SEQ ID NO: 151142 - RNA, 64 nt, Homo Sapiens; identical to SEQ ID NO: 134424

SEQ ID NO: 151143 - RNA, 64 nt, Homo Sapiens; identical to SEQ ID NO: 134425

SEQ ID NO: 151144 - RNA, 64 nt, Homo Sapiens; identical to SEQ ID NO: 134426

SEQ ID NO: 151145 - RNA, 64 nt, Homo Sapiens; identical to SEQ ID NO: 134427

SEQ ID NO: 151146 - RNA, 64 nt, Homo Sapiens; identical to SEQ ID NO: 134428

SEQ ID NO: 151147 - RNA, 64 nt, Homo Sapiens; identical to SEQ ID NO: 134429

SEQ ID NO: 151148 - RNA, 64 nt, Homo Sapiens; identical to SEQ ID NO: 134430

SEQ ID NO: 151149 - RNA, 64 nt, Homo Sapiens; identical to SEQ ID NO: 134431

SEQ ID NO: 151150 - RNA, 64 nt, Homo Sapiens; identical to SEQ ID NO: 134432

SEQ ID NO: 151151 - RNA, 64 nt, Homo Sapiens; identical to SEQ ID NO: 134433

SEQ ID NO: 151152 - RNA, 64 nt, Homo Sapiens; identical to SEQ ID NO: 134434

SEQ ID NO: 151153 - RNA, 64 nt, Homo Sapiens; identical to SEQ ID NO: 134435

SEQ ID NO: 151154 - RNA, 64 nt, Homo Sapiens; identical to SEQ ID NO: 134436

SEQ ID NO: 151155 - RNA, 64 nt, Homo Sapiens; identical to SEQ ID NO: 134437

SEQ ID NO: 151156 - RNA, 64 nt, Homo Sapiens; identical to SEQ ID NO: 134438

SEQ ID NO: 151157 - RNA, 64 nt, Homo Sapiens; identical to SEQ ID NO: 134439

SEQ ID NO: 151158 - RNA, 64 nt, Homo Sapiens; identical to SEQ ID NO: 134440

SEQ ID NO: 151159 - RNA, 64 nt, Homo Sapiens; identical to SEQ ID NO: 134441

SEQ ID NO: 151160 - RNA, 64 nt, Homo Sapiens; identical to SEQ ID NO: 134442

SEQ ID NO: 151161 - RNA, 64 nt, Homo Sapiens; identical to SEQ ID NO: 134443

SEQ ID NO: 151162 - RNA, 64 nt, Homo Sapiens; identical to SEQ ID NO: 134444

SEQ ID NO: 151163 - RNA, 64 nt, Homo Sapiens; identical to SEQ ID NO: 134445

SEQ ID NO: 151164 - RNA, 64 nt, Homo Sapiens; identical to SEQ ID NO: 134446

SEQ ID NO: 151165 - RNA, 64 nt, Homo Sapiens; identical to SEQ ID NO: 134447

SEQ ID NO: 151166 - RNA, 64 nt, Homo Sapiens; identical to SEQ ID NO: 134448

SEQ ID NO: 151167 - RNA, 64 nt, Homo Sapiens; identical to SEQ ID NO: 134449

SEQ ID NO: 151168 - RNA, 64 nt, Homo Sapiens; identical to SEQ ID NO: 134450

SEQ ID NO: 151169 - RNA, 64 nt, Homo Sapiens; identical to SEQ ID NO: 134451

SEQ ID NO: 151170 - RNA, 64 nt, Homo Sapiens; identical to SEQ ID NO: 134452

SEQ ID NO: 151171 - RNA, 64 nt, Homo Sapiens; identical to SEQ ID NO: 134453

SEQ ID NO: 151172 - RNA, 64 nt, Homo Sapiens; identical to SEQ ID NO: 134454

SEQ ID NO: 151173 - RNA, 64 nt, Homo Sapiens; identical to SEQ ID NO: 134455

SEQ ID NO: 151174 - RNA, 64 nt, Homo Sapiens; identical to SEQ ID NO: 134456

SEQ ID NO: 151175 - RNA, 64 nt, Homo Sapiens; identical to SEQ ID NO: 134457

SEQ ID NO: 151176 - RNA, 64 nt, Homo Sapiens
agccuggcaacagagcaagacuccgucucaaaaaaagggcaauaaaugcccucucugaauguuu

SEQ ID NO: 151177 - RNA, 64 nt, Homo Sapiens
ccaagaaaaggcauggagacagcgaacuagaagaaagggcaagaaggaaauagccaccgucuac

SEQ ID NO: 151178 - RNA, 64 nt, Homo Sapiens
gaggaguucuuuaaugggugccagggaaugggggaagggcaaguaaaauguaaaaccucucuug

SEQ ID NO: 151179 - RNA, 64 nt, Homo Sapiens
agugacccuguggaggguucagacauggccaaccaagggcaaggagagggucucugagggcaag

SEQ ID NO: 151180 - RNA, 64 nt, Homo Sapiens
uaaagaggcaaagggucacagaaguguucagaagaagggcaaagauaagaacaauauuagcugu

SEQ ID NO: 151181 - RNA, 64 nt, Homo Sapiens
gaaauaaguaaacaaauacaagagguucauauaaaagggcaaaugaaaaccuuuccuacaguuc

SEQ ID NO: 151182 - RNA, 64 nt, Homo Sapiens
cuuuccaggccggaugccauaguggaacauccagaagggcaacugucuacugucugcuuauuua

SEQ ID NO: 151183 - RNA, 64 nt, Homo Sapiens
cugauauuuauauacuuaauagauugaguucuguaagggcaaaaacggauugaaaugaacauag

SEQ ID NO: 151184 - RNA, 64 nt, Homo Sapiens
ugugucagaugcccuaguuagaugauuuuugggaaagggcaaaauauggaaaggguuugagaua

SEQ ID NO: 151185 - RNA, 64 nt, Homo Sapiens
aauucauuugaaccaguuuuugaugaauauaagaaagggcaaaaaaucugaauaagacaauaug

SEQ ID NO: 151186 - RNA, 64 nt, Homo Sapiens
cugccaaacacauuuacccuuuggccccacuuugaagggcaagaaauggcgucugcucuggugg

SEQ ID NO: 151187 - RNA, 64 nt, Homo Sapiens
guauauuaaaacacuuuuuuaaaggacaguugaaaagggcaagaggaaaccagggcaguucuag

SEQ ID NO: 151188 - RNA, 64 nt, Homo Sapiens
ugguuauuauuacauggugguggugguuuuauuauaugcaaaaucucugucuauuaugagauac

SEQ ID NO: 151189 - RNA, 64 nt, Homo Sapiens
caagcacaguaauguguguuuuguucagcauuauuaugcaaaaauucacuaguugagaugguuu

SEQ ID NO: 151190 - RNA, 64 nt, Homo Sapiens
uuuuaaucuguguuucugcauuuuaaaagccuuauaugcaaaccagaaagccuuuguaaggugg

SEQ ID NO: 151191 - RNA, 64 nt, Homo Sapiens
uuuuguacaguguuaaggccguuaaaaacugcauuaugcaaaaacggaguuggagcuggguauu

SEQ ID NO: 151192 - RNA, 64 nt, Homo Sapiens
ucuaagcccaaacaugacuuauucuguguaacauuaugcaaacuuuucggaagauaucauaauc

SEQ ID NO: 151193 - RNA, 64 nt, Homo Sapiens
caccuauguguaacuuccccauaguuuggauaguuaugcaaaugguacuugugaaaacaguaaa

SEQ ID NO: 151194 - RNA, 64 nt, Homo Sapiens
uucaaguuuaaaaaaucgucuuacauguguacaauaugcaaauuaguuuuagauuagagagugc

SEQ ID NO: 151195 - RNA, 64 nt, Homo Sapiens
aguguuuggauuguaauuauaaaugguucuuugauaugcaaauuaauauuuucaguugauuuua

SEQ ID NO: 151196 - RNA, 64 nt, Homo Sapiens
cagagaaaaaguuucuaaaguuacuacuggugucuaugcaaauuggauuccauagaaguuuuag

SEQ ID NO: 151197 - RNA, 64 nt, Homo Sapiens
uugaugaaacugcugguuuaaaaauauuuacugauaugcaaaugucaugcaaaacuccacuuuc

SEQ ID NO: 151198 - RNA, 64 nt, Homo Sapiens
uuauucaaccaagcuucuauucaaauguaaaucauaugcaaauacaaaaaugaguaugaggaaa

SEQ ID NO: 151199 - RNA, 64 nt, Homo Sapiens
ugaguaugaggaaaucaaauaugccugcaaacuauaugcaaaaaugaaauuacuauacauugaa

SEQ ID NO: 151200 - RNA, 64 nt, Homo Sapiens
uauauaaagucuucuccaguaauuaagaaauacauaugcaaauucuuuugugauugaguaaaag

SEQ ID NO: 151201 - RNA, 64 nt, Homo Sapiens
aaggcaauggcaguccuacauuuaagaauagagcuaugcaaacucuguuaaaaacuaugaggaa

SEQ ID NO: 151202 - RNA, 64 nt, Homo Sapiens
uauauaucauuagauuccugugaaauuuuaaauauaugcaaauaguuuauuaccuuuucccuca

SEQ ID NO: 151203 - RNA, 64 nt, Homo Sapiens
cuguuucuacuacaauguuaauuaccuuuucacauaugcaaaaugugauuaauguauuuuauaa

SEQ ID NO: 151204 - RNA, 64 nt, Homo Sapiens
ucuucauaucaucacaacauauucaugugguuucuaugcaaaguauucgaauuuugucuuuaaa

SEQ ID NO: 151205 - RNA, 64 nt, Homo Sapiens
uacuaacaaauuauacuguuaaagguguuauaucuaugcaaaccaagauguauuauaccaguga

SEQ ID NO: 151206 - RNA, 64 nt, Homo Sapiens
uguguauuuaccauuguguauuugauuuccuguguaugcaaaugagaccuguugugcuguguau

SEQ ID NO: 151207 - RNA, 64 nt, Homo Sapiens
guauuucucugucaguucccagaagcagcuggacuaugcaaaaauaaaaauuauuuuccauugc

SEQ ID NO: 151208 - RNA, 64 nt, Homo Sapiens
augaaaccagcauuuaguaccagcauaugguucauaugcaaauaauacuuuccccaaaaucuuu

SEQ ID NO: 151209 - RNA, 64 nt, Homo Sapiens
ugguuuuguuucauuuugcucuguuuuaaauccauaugcaaauaaaacugcuucucucuuacac

SEQ ID NO: 151210 - RNA, 64 nt, Homo Sapiens
uuaacaagcaguaacacugcguuuuuacauaaauuaugcaaaggaaauguuguuaauaagaaug

SEQ ID NO: 151211 - RNA, 64 nt, Homo Sapiens
uauaaauuugaguaugcuugagaccuuaugugaguaugcaaauagaagaguccccgauguuugu

SEQ ID NO: 151212 - RNA, 64 nt, Homo Sapiens
ugcuagcuugauuuuaaaaauuauaauguuuguauaugcaaaacugauucuuguauauuagcaa

SEQ ID NO: 151213 - RNA, 64 nt, Homo Sapiens
gaaaagaaaagaaaaccaccggcaugauuuuuuuuaugcaaaaacgcugcuuccacacauuaau

SEQ ID NO: 151214 - RNA, 64 nt, Homo Sapiens
guauuguggguuuuguagguuagauucauaucauuaugcaaauaucucuuaggaaguuaauaag

SEQ ID NO: 151215 - RNA, 64 nt, Homo Sapiens
uuugucuauauauauuugugaaccuuuaaaaugguaugcaaaaucaauuauauuuccaaaaaug

SEQ ID NO: 151216 - RNA, 64 nt, Homo Sapiens
gugugugaauauguguuacaccuaggaugggcauuaugcaaaagcacaaagauuauauaugaca

SEQ ID NO: 151217 - RNA, 64 nt, Homo Sapiens
guuuucugucaaaguuccuuuugcaugaaacaauuaugcaaacuuauaauuauuagugcugaaa

SEQ ID NO: 151218 - RNA, 64 nt, Homo Sapiens
aguugccuauauuugcuauucaaaauuuuguaaauaugcaaaucagcuuuauagguuuauuaca

SEQ ID NO: 151219 - RNA, 64 nt, Homo Sapiens
uuuucccucuuauuuuuguauuguggucauuuccuaugcaaauaauggagcaaacagcuguaua

SEQ ID NO: 151220 - RNA, 64 nt, Homo Sapiens
aaaugcugcaaagggaagcaugccauccagucuuuaugcaaaugucagagauggagcaaaccag

SEQ ID NO: 151221 - RNA, 64 nt, Homo Sapiens
ugaacuagcuucuuuguucauagcagggaugauuuaugcaaauuaccuaggagaaucuaagcua

SEQ ID NO: 151222 - RNA, 64 nt, Homo Sapiens
ccccaucaucugcacacccgcuagucccugcaaauaugcaaacccaaaccuccugccugacucg

SEQ ID NO: 151223 - RNA, 64 nt, Homo Sapiens
uccugccugacucgcuagucguucuauauucacauaugcaaaccugcucaugaggggcugcgga

SEQ ID NO: 151224 - RNA, 64 nt, Homo Sapiens
acuaagcauuaaauauuggccgggugcgguggcuuaugcaaaauggcucccagcauuuugggag

SEQ ID NO: 151225 - RNA, 64 nt, Homo Sapiens
aguaaaaguaaaauauuuaauccauaauuaagucuaugcaaauaucagagaauuuaugguagaa

SEQ ID NO: 151226 - RNA, 64 nt, Homo Sapiens
uauguacauauacauguauaugcauguguauauauaugcaaauacaugucuauauaauuauaaa

SEQ ID NO: 151227 - RNA, 64 nt, Homo Sapiens
uaaaucaaaguucccucuaucuugugcugcucuuuaugcaaaggaaugcuccuacuuuaaguac

SEQ ID NO: 151228 - RNA, 64 nt, Homo Sapiens
cacaucucacuucugcuuccucaucucagcccacucugaaaaugugcagcacccucacugguuc

SEQ ID NO: 151229 - RNA, 64 nt, Homo Sapiens
cccccaacgcaaggaggaugcccaauuguugcccucugaaaaugcacaguucuccuggcccuag

SEQ ID NO: 151230 - RNA, 64 nt, Homo Sapiens
gccagcuauuucauuaggcaccucccagugcccuucugaaaaguagccacuauucucaguuaca

SEQ ID NO: 151231 - RNA, 64 nt, Homo Sapiens
auauuccagauuacacuguagccccauggaaaggucugaaaauagaaaagaguccaguacccag

SEQ ID NO: 151232 - RNA, 64 nt, Homo Sapiens
gguagccuuaaaaaccuucuaaaaugcuuuugauucugaaaauugggggaaaaaacuuuuaauc

SEQ ID NO: 151233 - RNA, 64 nt, Homo Sapiens
gccugaggugcaugggaaauauaguuagcuauacucugaaaauacauuauguuuuuuuucuuua

SEQ ID NO: 151234 - RNA, 64 nt, Homo Sapiens
auguugguguuuuagaaguagauacaggcacugcucugaaaaccuggcuagccaaggauauucu

SEQ ID NO: 151235 - RNA, 64 nt, Homo Sapiens
aaaggccccacugauaagguaacauuugagcaagucugaaaaaggcaaggggaucuuuggggcu

SEQ ID NO: 151236 - RNA, 64 nt, Homo Sapiens
aggcugcaucaaugcaagccuggaaaccagcaggucugaaaaagugccuuccaagucaguccuu

SEQ ID NO: 151237 - RNA, 64 nt, Homo Sapiens
gaaagauuucuauguauuaaaaaugcuacuaauaucugaaaaguuauaaacuccuuaugugagg

SEQ ID NO: 151238 - RNA, 64 nt, Homo Sapiens
uaucagccaccaaaauaguuaaauaaagaagugcucugaaaaaauugcuaacaauaauguuugg

SEQ ID NO: 151239 - RNA, 64 nt, Homo Sapiens
gcugccgccgcgccgaggagucucuuggccucaaucugaaaacuagauacaaucacgucacagg

SEQ ID NO: 151240 - RNA, 64 nt, Homo Sapiens
aaauagcguuucacauaaaaagcauagcagcagcucugaaaagacacuucacaguaaauauguc

SEQ ID NO: 151241 - RNA, 64 nt, Homo Sapiens
gcaaguuacucaggaaucaaaagagaaaaaaguuucugaaaacaaugaaaccauaaaagauaau

SEQ ID NO: 151242 - RNA, 64 nt, Homo Sapiens
uuugaggugucugcugucgcuaccacugugcacaucugaaaacucacaaccaagaaaauccauu

SEQ ID NO: 151243 - RNA, 64 nt, Homo Sapiens
guucuagauauguacuucaugguuaaauucuaaaucugaaaaugcuagugggagauaucaagaa

SEQ ID NO: 151244 - RNA, 64 nt, Homo Sapiens
guuucaccguuugucuucuuuucugaaaaaaugaucugaaaaaaugcaucagcaaggcauugac

SEQ ID NO: 151245 - RNA, 64 nt, Homo Sapiens
ugaucugaaaaaaguuucacgcaaggcauugacuucugaaaaaagcauguugcgcuuugcauca

SEQ ID NO: 151246 - RNA, 64 nt, Homo Sapiens
auuaagauaucucugcuuuguuuugaaaugccagucugaaaauauacuuacuuaaauugacacu

SEQ ID NO: 151247 - RNA, 64 nt, Homo Sapiens
uaaaacaaagaacaaauaacguuuucaagaaacaucugaaaagaguuaaagaucacaccacaau

SEQ ID NO: 151248 - RNA, 64 nt, Homo Sapiens
uuuuaaccagcccacccagcgugccauguguacuucugaaaauaugcgugguuuauagacuggg

SEQ ID NO: 151249 - RNA, 64 nt, Homo Sapiens
uagcucugacucuugucuuuugaacacaucagccucugaaaaggcaguuaaaucaaacauuggu

SEQ ID NO: 151250 - RNA, 64 nt, Homo Sapiens
aguuggacuucaagaaauuugaauuuagaguauaucugaaaagcacaaucuguugauagaccug

SEQ ID NO: 151251 - RNA, 64 nt, Homo Sapiens
ccaaagggaaauuucaguagggcaccugccaucuucugaaaacuuuuuagagcauagaagaagc

SEQ ID NO: 151252 - RNA, 64 nt, Homo Sapiens
auugucuguuaaauuuauuaugcccaaaucaaccucugaaaaaagguuuuuccaggaagauuua

SEQ ID NO: 151253 - RNA, 64 nt, Homo Sapiens
guagacucuauaguacccucucuauucacuagcuucugaaaagggaggaguauuuuuaguuuga

SEQ ID NO: 151254 - RNA, 64 nt, Homo Sapiens
uauaaaagaaucuauaaucucacagcucacaguuucugaaaauggugauauaauccauuuauau

SEQ ID NO: 151255 - RNA, 64 nt, Homo Sapiens
uguguggugguaugacagcaaguuauaacugugaucugaaaauggcuagaauuaugaucuuuga

SEQ ID NO: 151256 - RNA, 64 nt, Homo Sapiens
guugaaguaccaaguaaccuacaagccuccuaguucugaaaaguuggaagggcaucaugaccuc

SEQ ID NO: 151257 - RNA, 64 nt, Homo Sapiens
uuuuucuucgacaaaaaaauaauaaaacguuucuucugaaaagcugaacguuucuguauaagcg

SEQ ID NO: 151258 - RNA, 64 nt, Homo Sapiens
uauaguuuaaaagcacaucuauguucacugccacucugaaaaagggaauuauuucucagucuuu

SEQ ID NO: 151259 - RNA, 64 nt, Homo Sapiens
agaaacccaagguuggagggugggaugaguacccucugaaaaagggaauuugcuggugaaaaga

SEQ ID NO: 151260 - RNA, 64 nt, Homo Sapiens
auggaaccaugccuucauaagucucgaaaaggaaucugaaaacaggggugacagaagagaccuu

SEQ ID NO: 151261 - RNA, 64 nt, Homo Sapiens
guauguauuuuuacauuagauuguucccccucccucugaaaaaaaagguguuuucuaguuuaag

SEQ ID NO: 151262 - RNA, 64 nt, Homo Sapiens
cuguuugggggcauacuuuucagcgacagaccuaucugaaaaguguuuuccuaauacaggaaua

SEQ ID NO: 151263 - RNA, 64 nt, Homo Sapiens
gugggcugauaaacuuguaaauuucaaucaccuuucugaaaagaauuucuguagcaugacaggg

SEQ ID NO: 151264 - RNA, 64 nt, Homo Sapiens
aaugcuaauguaaucauuuauuaaaaaaauaacaucugaaaagagcaaauaguuucaaaugagu

SEQ ID NO: 151265 - RNA, 64 nt, Homo Sapiens
uuuuuuucuagcuauaacaaggguaucugcugccucugaaaauagaacuguucauuuccaccaa

SEQ ID NO: 151266 - RNA, 64 nt, Homo Sapiens
cauaguaacagaaucuuuaugaaauaugaccuuuucugaaaauacauacuuuuacauuucuacu

SEQ ID NO: 151267 - RNA, 64 nt, Homo Sapiens
agauaaaaauaaaagcagaauguauaucaucccaucugaaaaacacuaauuauugacaugugca

SEQ ID NO: 151268 - RNA, 64 nt, Homo Sapiens
acugaaaugaaaucccauuggauuguacuucucuucugaaaagugugcuuuuugacccuacugg

SEQ ID NO: 151269 - RNA, 64 nt, Homo Sapiens
ugcuguuugcauuacagaacugcagcuuuucuacucugaaaaggccugggagcagaauggcugg

SEQ ID NO: 151270 - RNA, 64 nt, Homo Sapiens
cuuuugcaauaaaaaaaaaucauuuaaaaaguuuucugaaaaaauucaggugguuuauuaauua

SEQ ID NO: 151271 - RNA, 64 nt, Homo Sapiens
aaagaccauuauugcuaccagcaaaacaguuauuucugaaaauuuagugaaugguaagacuagu

SEQ ID NO: 151272 - RNA, 64 nt, Homo Sapiens
cuuucuauguuguaugauuguaagugaaaaccaaucugaaaagggaacccuaaaugcuuauugu

SEQ ID NO: 151273 - RNA, 64 nt, Homo Sapiens
aaucuauccuguacgugugaaaaauaacagauuaucugaaaaaaccauuuaaaaguuauaaauc

SEQ ID NO: 151274 - RNA, 64 nt, Homo Sapiens
accuuauauaaagguauaagagaccaugacaaugucugaaaauggaauagauaaugaugccuuu

SEQ ID NO: 151275 - RNA, 64 nt, Homo Sapiens
uauuuccauuauaguauuuauuguauuuuuauguucugaaaauuacccauggaacaauaugcuu

SEQ ID NO: 151276 - RNA, 64 nt, Homo Sapiens
uccuuccagggccccagcuagaggaaacugaaguucugaaaaucuuuauccccguuuuauaaaa

SEQ ID NO: 151277 - RNA, 64 nt, Homo Sapiens
aaaagcuuaggaccagaagaugacuuucagucucucugaaaauguuugucacgucuucugagaa

SEQ ID NO: 151278 - RNA, 64 nt, Homo Sapiens
gaaaaaauuaaaauguaaaaucaaaaaauuaaguucugaaaauuuuuuaaguguuagcaauagu

SEQ ID NO: 151279 - RNA, 64 nt, Homo Sapiens
aucaagauaacuaguaaaauauuuuugucccauuucugaaaauuagcagaaucaugagucuucu

SEQ ID NO: 151280 - RNA, 64 nt, Homo Sapiens
ucccuauuacaggauauguugcaguccccaucuuucugaaaauaacccuuaacguauccaacag

SEQ ID NO: 151281 - RNA, 64 nt, Homo Sapiens
aacaaguguuuuaaaagaugaguuuuuccuacauucugaaaagcaaacaugaaaaacugaacac

SEQ ID NO: 151282 - RNA, 64 nt, Homo Sapiens
cauuguaauaaguguagcaaaaucuccuuagauaucugaaaagucauacuggauggaaucugua

SEQ ID NO: 151283 - RNA, 64 nt, Homo Sapiens
uucugcuugcugauuuuuucccacagcaugugauucugaaaauguaacuacaauauugacauaa

SEQ ID NO: 151284 - RNA, 64 nt, Homo Sapiens
auuuuuuccccuuuagguucagcuugucugguucucugaaaauauauuuucaaugugaauccaa

SEQ ID NO: 151285 - RNA, 64 nt, Homo Sapiens
uguaguuucuuaauuuaaguccacaagauauguuucugaaaaccuuauuaagcucauugccaac

SEQ ID NO: 151286 - RNA, 64 nt, Homo Sapiens
uauauaacuguuguugauaacaaaguggguacuuucugaaaauucuuuuaaguggacucucuga

SEQ ID NO: 151287 - RNA, 64 nt, Homo Sapiens
agagacugcuugacaaaggaauaugugguccaucucugaaaacauucauacacaacguaaucaa

SEQ ID NO: 151288 - RNA, 64 nt, Homo Sapiens
agcauugaauauaagccaaauaacauuuugcauaucugaaaagauugacaacaacccaaugaaa

SEQ ID NO: 151289 - RNA, 64 nt, Homo Sapiens
cuguaucugagcacaucaagaaccauuuuccucuucugaaaauuuguuuuuuucuaauggaaug

SEQ ID NO: 151290 - RNA, 64 nt, Homo Sapiens
cccaaccccaaaaccuucauaauguacaucguugucugaaaaaaugugcacauuuggaagcuaa

SEQ ID NO: 151291 - RNA, 64 nt, Homo Sapiens
auuuuaugguucucaaucccucucuagacauucaucugaaaauccucuauuuuuguuuucauuu

SEQ ID NO: 151292 - RNA, 64 nt, Homo Sapiens
auacaaauuuuuuuacaaguauuuacauacuguaucugaaaacagacuuuaaagucacaagauu

SEQ ID NO: 151293 - RNA, 64 nt, Homo Sapiens
acaagauuauaaauguacauauauauucucacauucugaaaaauaacauucucagaauccacag

SEQ ID NO: 151294 - RNA, 64 nt, Homo Sapiens
gaguugggcuuaauguugacaguugcaugguuggucugaaaauaccauguguccucugaucuaa

SEQ ID NO: 151295 - RNA, 64 nt, Homo Sapiens
ucuuugacuguaaauuuaggucauaauacuuaucucugaaaaugacuuuagauucuuauugaau

SEQ ID NO: 151296 - RNA, 64 nt, Homo Sapiens
agcucucugccaagguuuuaaccuccgcgacgauucugaaaauguuuaagccauuuaagggugg

SEQ ID NO: 151297 - RNA, 64 nt, Homo Sapiens
aagaaagcaaggauacuaaggaucgucugagaaaucugaaaaaaugucaaaaaagaagagaaaa

SEQ ID NO: 151298 - RNA, 64 nt, Homo Sapiens
gcccaggggugcacuguuggaagauuugcugcagucugaaaacugauuuaauuauuuguaauaa

SEQ ID NO: 151299 - RNA, 64 nt, Homo Sapiens
acuaauuuaaauuugcuuuucuuucccuuucuucucugaaaaaaauucuuaaccccauggacuc

SEQ ID NO: 151300 - RNA, 64 nt, Homo Sapiens
augauauuuguacuucauuugaaaaaucaaaccuucugaaaauuucaguuuuuuuaugguacuc

SEQ ID NO: 151301 - RNA, 64 nt, Homo Sapiens
ggucuuacuaccugauaucaucauaugacuguucucugaaaaaaagggcuuuguccaguuaucu

SEQ ID NO: 151302 - RNA, 64 nt, Homo Sapiens
uacuguuuuagaauguauuacuaauuucaucauuucugaaaaugaggcagggagaucuuaauac

SEQ ID NO: 151303 - RNA, 64 nt, Homo Sapiens
uguaaggggccaauucuaagauauauguuggaccucugaaaaguaucaugggccguggaacaga

SEQ ID NO: 151304 - RNA, 64 nt, Homo Sapiens
cuugacauuguaaaaauauaaaaaugauauuuugucugaaaagaaggcacaaaagaacaccuga

SEQ ID NO: 151305 - RNA, 64 nt, Homo Sapiens
ccacaaauuuaugaaacauuaugugggauagccuucugaaaaaguccagaguagaaaacuauga

SEQ ID NO: 151306 - RNA, 64 nt, Homo Sapiens
cagacagcugcauuguaagaguucugucaugcagucugaaaagggaagaaacaggauggcuuuc

SEQ ID NO: 151307 - RNA, 64 nt, Homo Sapiens
gauuguuguauuauuagauuacugauuuuucuuuucugaaaauacauuugaguuuuaaucacau

SEQ ID NO: 151308 - RNA, 64 nt, Homo Sapiens
uuaaauaauugugaagccagauaugcaauguguaucugaaaagcaaggaauuugcagccguuuu

SEQ ID NO: 151309 - RNA, 64 nt, Homo Sapiens
cuucugauucuaauguggaaauuguuguauuuaaucugaaaaugacuuuaccuacaacaguucc

SEQ ID NO: 151310 - RNA, 64 nt, Homo Sapiens
uuguauuaagacuuuaaaauguaagcauuguaauucugaaaauacacauuuuaagaagaaacua

SEQ ID NO: 151311 - RNA, 64 nt, Homo Sapiens
cauuucccucccucucuuccucuuuuucucacuaucugaaaauaggauacauauuucaguucuu

SEQ ID NO: 151312 - RNA, 64 nt, Homo Sapiens
accauuagcccauuucccccguaaaaauuuaauuucugaaaagcaccauaaaaugucagcaaau

SEQ ID NO: 151313 - RNA, 64 nt, Homo Sapiens
ggaaccacucaagaguaucaauacaauuuagaucucugaaaauuaucagaaauauuuuuaaaaa

SEQ ID NO: 151314 - RNA, 64 nt, Homo Sapiens
aacuuauaaugaagcuacaauaggggagaacauuucugaaaaaggcaguagggaugggguuagg

SEQ ID NO: 151315 - RNA, 64 nt, Homo Sapiens
uccuuuucucuuuuuuuuuuacucaagaaaaugcucugaaaaauguggcaaaaguccuucuguu

SEQ ID NO: 151316 - RNA, 64 nt, Homo Sapiens
cacuuuuaccuugaaguucauuagcuuguccgcaucugaaaauuuuacucauaauccuuagaag

SEQ ID NO: 151317 - RNA, 64 nt, Homo Sapiens; identical to SEQ ID NO: 151188

SEQ ID NO: 151318 - RNA, 64 nt, Homo Sapiens; identical to SEQ ID NO: 151189

SEQ ID NO: 151319 - RNA, 64 nt, Homo Sapiens; identical to SEQ ID NO: 151190

SEQ ID NO: 151320 - RNA, 64 nt, Homo Sapiens; identical to SEQ ID NO: 151191

SEQ ID NO: 151321 - RNA, 64 nt, Homo Sapiens; identical to SEQ ID NO: 151192

SEQ ID NO: 151322 - RNA, 64 nt, Homo Sapiens; identical to SEQ ID NO: 151193

SEQ ID NO: 151323 - RNA, 64 nt, Homo Sapiens; identical to SEQ ID NO: 151194

SEQ ID NO: 151324 - RNA, 64 nt, Homo Sapiens; identical to SEQ ID NO: 151195

SEQ ID NO: 151325 - RNA, 64 nt, Homo Sapiens; identical to SEQ ID NO: 151196

SEQ ID NO: 151326 - RNA, 64 nt, Homo Sapiens; identical to SEQ ID NO: 151197

SEQ ID NO: 151327 - RNA, 64 nt, Homo Sapiens; identical to SEQ ID NO: 151198

SEQ ID NO: 151328 - RNA, 64 nt, Homo Sapiens; identical to SEQ ID NO: 151199

SEQ ID NO: 151329 - RNA, 64 nt, Homo Sapiens; identical to SEQ ID NO: 151200

SEQ ID NO: 151330 - RNA, 64 nt, Homo Sapiens; identical to SEQ ID NO: 151201

SEQ ID NO: 151331 - RNA, 64 nt, Homo Sapiens; identical to SEQ ID NO: 151202

SEQ ID NO: 151332 - RNA, 64 nt, Homo Sapiens; identical to SEQ ID NO: 151203

SEQ ID NO: 151333 - RNA, 64 nt, Homo Sapiens; identical to SEQ ID NO: 151204

SEQ ID NO: 151334 - RNA, 64 nt, Homo Sapiens; identical to SEQ ID NO: 151205

SEQ ID NO: 151335 - RNA, 64 nt, Homo Sapiens; identical to SEQ ID NO: 151206

SEQ ID NO: 151336 - RNA, 64 nt, Homo Sapiens; identical to SEQ ID NO: 151207

SEQ ID NO: 151337 - RNA, 64 nt, Homo Sapiens; identical to SEQ ID NO: 151208

SEQ ID NO: 151338 - RNA, 64 nt, Homo Sapiens; identical to SEQ ID NO: 151209

SEQ ID NO: 151339 - RNA, 64 nt, Homo Sapiens; identical to SEQ ID NO: 151210

SEQ ID NO: 151340 - RNA, 64 nt, Homo Sapiens; identical to SEQ ID NO: 151211

SEQ ID NO: 151341 - RNA, 64 nt, Homo Sapiens; identical to SEQ ID NO: 151212

SEQ ID NO: 151342 - RNA, 64 nt, Homo Sapiens; identical to SEQ ID NO: 151213

SEQ ID NO: 151343 - RNA, 64 nt, Homo Sapiens; identical to SEQ ID NO: 151214

SEQ ID NO: 151344 - RNA, 64 nt, Homo Sapiens; identical to SEQ ID NO: 151215

SEQ ID NO: 151345 - RNA, 64 nt, Homo Sapiens; identical to SEQ ID NO: 151216

SEQ ID NO: 151346 - RNA, 64 nt, Homo Sapiens; identical to SEQ ID NO: 151217

SEQ ID NO: 151347 - RNA, 64 nt, Homo Sapiens; identical to SEQ ID NO: 151218

SEQ ID NO: 151348 - RNA, 64 nt, Homo Sapiens; identical to SEQ ID NO: 151219

SEQ ID NO: 151349 - RNA, 64 nt, Homo Sapiens; identical to SEQ ID NO: 151220

SEQ ID NO: 151350 - RNA, 64 nt, Homo Sapiens; identical to SEQ ID NO: 151221

SEQ ID NO: 151351 - RNA, 64 nt, Homo Sapiens; identical to SEQ ID NO: 151222

SEQ ID NO: 151352 - RNA, 64 nt, Homo Sapiens; identical to SEQ ID NO: 151223

SEQ ID NO: 151353 - RNA, 64 nt, Homo Sapiens; identical to SEQ ID NO: 151224

SEQ ID NO: 151354 - RNA, 64 nt, Homo Sapiens; identical to SEQ ID NO: 151225

SEQ ID NO: 151355 - RNA, 64 nt, Homo Sapiens; identical to SEQ ID NO: 151226

SEQ ID NO: 151356 - RNA, 64 nt, Homo Sapiens; identical to SEQ ID NO: 151227

SEQ ID NO: 151357 - RNA, 64 nt, Homo Sapiens; identical to SEQ ID NO: 151228

SEQ ID NO: 151358 - RNA, 64 nt, Homo Sapiens; identical to SEQ ID NO: 151229

SEQ ID NO: 151359 - RNA, 64 nt, Homo Sapiens; identical to SEQ ID NO: 151230

SEQ ID NO: 151360 - RNA, 64 nt, Homo Sapiens; identical to SEQ ID NO: 151231

SEQ ID NO: 151361 - RNA, 64 nt, Homo Sapiens; identical to SEQ ID NO: 151232

SEQ ID NO: 151362 - RNA, 64 nt, Homo Sapiens; identical to SEQ ID NO: 151233

SEQ ID NO: 151363 - RNA, 64 nt, Homo Sapiens; identical to SEQ ID NO: 151234

SEQ ID NO: 151364 - RNA, 64 nt, Homo Sapiens; identical to SEQ ID NO: 151235

SEQ ID NO: 151365 - RNA, 64 nt, Homo Sapiens; identical to SEQ ID NO: 151236

SEQ ID NO: 151366 - RNA, 64 nt, Homo Sapiens; identical to SEQ ID NO: 151237

SEQ ID NO: 151367 - RNA, 64 nt, Homo Sapiens; identical to SEQ ID NO: 151238

SEQ ID NO: 151368 - RNA, 64 nt, Homo Sapiens; identical to SEQ ID NO: 151239

SEQ ID NO: 151369 - RNA, 64 nt, Homo Sapiens; identical to SEQ ID NO: 151240

SEQ ID NO: 151370 - RNA, 64 nt, Homo Sapiens; identical to SEQ ID NO: 151241

SEQ ID NO: 151371 - RNA, 64 nt, Homo Sapiens; identical to SEQ ID NO: 151242

SEQ ID NO: 151372 - RNA, 64 nt, Homo Sapiens; identical to SEQ ID NO: 151243

SEQ ID NO: 151373 - RNA, 64 nt, Homo Sapiens; identical to SEQ ID NO: 151244

SEQ ID NO: 151374 - RNA, 64 nt, Homo Sapiens; identical to SEQ ID NO: 151245

SEQ ID NO: 151375 - RNA, 64 nt, Homo Sapiens; identical to SEQ ID NO: 151246

SEQ ID NO: 151376 - RNA, 64 nt, Homo Sapiens; identical to SEQ ID NO: 151247

SEQ ID NO: 151377 - RNA, 64 nt, Homo Sapiens; identical to SEQ ID NO: 151248

SEQ ID NO: 151378 - RNA, 64 nt, Homo Sapiens; identical to SEQ ID NO: 151249

SEQ ID NO: 151379 - RNA, 64 nt, Homo Sapiens; identical to SEQ ID NO: 151250

SEQ ID NO: 151380 - RNA, 64 nt, Homo Sapiens; identical to SEQ ID NO: 151251

SEQ ID NO: 151381 - RNA, 64 nt, Homo Sapiens; identical to SEQ ID NO: 151252

SEQ ID NO: 151382 - RNA, 64 nt, Homo Sapiens; identical to SEQ ID NO: 151253

SEQ ID NO: 151383 - RNA, 64 nt, Homo Sapiens; identical to SEQ ID NO: 151254

SEQ ID NO: 151384 - RNA, 64 nt, Homo Sapiens; identical to SEQ ID NO: 151255

SEQ ID NO: 151385 - RNA, 64 nt, Homo Sapiens; identical to SEQ ID NO: 151256

SEQ ID NO: 151386 - RNA, 64 nt, Homo Sapiens; identical to SEQ ID NO: 151257

SEQ ID NO: 151387 - RNA, 64 nt, Homo Sapiens; identical to SEQ ID NO: 151258

SEQ ID NO: 151388 - RNA, 64 nt, Homo Sapiens; identical to SEQ ID NO: 151259

SEQ ID NO: 151389 - RNA, 64 nt, Homo Sapiens; identical to SEQ ID NO: 151260

SEQ ID NO: 151390 - RNA, 64 nt, Homo Sapiens; identical to SEQ ID NO: 151261

SEQ ID NO: 151391 - RNA, 64 nt, Homo Sapiens; identical to SEQ ID NO: 151262

SEQ ID NO: 151392 - RNA, 64 nt, Homo Sapiens; identical to SEQ ID NO: 151263

SEQ ID NO: 151393 - RNA, 64 nt, Homo Sapiens; identical to SEQ ID NO: 151264

SEQ ID NO: 151394 - RNA, 64 nt, Homo Sapiens; identical to SEQ ID NO: 151265

SEQ ID NO: 151395 - RNA, 64 nt, Homo Sapiens; identical to SEQ ID NO: 151266

SEQ ID NO: 151396 - RNA, 64 nt, Homo Sapiens; identical to SEQ ID NO: 151267

SEQ ID NO: 151397 - RNA, 64 nt, Homo Sapiens; identical to SEQ ID NO: 151268

SEQ ID NO: 151398 - RNA, 64 nt, Homo Sapiens; identical to SEQ ID NO: 151269

SEQ ID NO: 151399 - RNA, 64 nt, Homo Sapiens; identical to SEQ ID NO: 151270

SEQ ID NO: 151400 - RNA, 64 nt, Homo Sapiens; identical to SEQ ID NO: 151271

SEQ ID NO: 151401 - RNA, 64 nt, Homo Sapiens; identical to SEQ ID NO: 151272

SEQ ID NO: 151402 - RNA, 64 nt, Homo Sapiens; identical to SEQ ID NO: 151273

SEQ ID NO: 151403 - RNA, 64 nt, Homo Sapiens; identical to SEQ ID NO: 151274

SEQ ID NO: 151404 - RNA, 64 nt, Homo Sapiens; identical to SEQ ID NO: 151275

SEQ ID NO: 151405 - RNA, 64 nt, Homo Sapiens; identical to SEQ ID NO: 151276

SEQ ID NO: 151406 - RNA, 64 nt, Homo Sapiens; identical to SEQ ID NO: 151277

SEQ ID NO: 151407 - RNA, 64 nt, Homo Sapiens; identical to SEQ ID NO: 151278

SEQ ID NO: 151408 - RNA, 64 nt, Homo Sapiens; identical to SEQ ID NO: 151279

SEQ ID NO: 151409 - RNA, 64 nt, Homo Sapiens; identical to SEQ ID NO: 151280

SEQ ID NO: 151410 - RNA, 64 nt, Homo Sapiens; identical to SEQ ID NO: 151281

SEQ ID NO: 151411 - RNA, 64 nt, Homo Sapiens; identical to SEQ ID NO: 151282

SEQ ID NO: 151412 - RNA, 64 nt, Homo Sapiens; identical to SEQ ID NO: 151283

SEQ ID NO: 151413 - RNA, 64 nt, Homo Sapiens; identical to SEQ ID NO: 151284

SEQ ID NO: 151414 - RNA, 64 nt, Homo Sapiens; identical to SEQ ID NO: 151285

SEQ ID NO: 151415 - RNA, 64 nt, Homo Sapiens; identical to SEQ ID NO: 151286

SEQ ID NO: 151416 - RNA, 64 nt, Homo Sapiens; identical to SEQ ID NO: 151287

SEQ ID NO: 151417 - RNA, 64 nt, Homo Sapiens; identical to SEQ ID NO: 151288

SEQ ID NO: 151418 - RNA, 64 nt, Homo Sapiens; identical to SEQ ID NO: 151289

SEQ ID NO: 151419 - RNA, 64 nt, Homo Sapiens; identical to SEQ ID NO: 151290

SEQ ID NO: 151420 - RNA, 64 nt, Homo Sapiens; identical to SEQ ID NO: 151291

SEQ ID NO: 151421 - RNA, 64 nt, Homo Sapiens; identical to SEQ ID NO: 151292

SEQ ID NO: 151422 - RNA, 64 nt, Homo Sapiens; identical to SEQ ID NO: 151293

SEQ ID NO: 151423 - RNA, 64 nt, Homo Sapiens; identical to SEQ ID NO: 151294

SEQ ID NO: 151424 - RNA, 64 nt, Homo Sapiens; identical to SEQ ID NO: 151295

SEQ ID NO: 151425 - RNA, 64 nt, Homo Sapiens; identical to SEQ ID NO: 151296

SEQ ID NO: 151426 - RNA, 64 nt, Homo Sapiens; identical to SEQ ID NO: 151297

SEQ ID NO: 151427 - RNA, 64 nt, Homo Sapiens; identical to SEQ ID NO: 151298

SEQ ID NO: 151428 - RNA, 64 nt, Homo Sapiens; identical to SEQ ID NO: 151299

SEQ ID NO: 151429 - RNA, 64 nt, Homo Sapiens; identical to SEQ ID NO: 151300

SEQ ID NO: 151430 - RNA, 64 nt, Homo Sapiens; identical to SEQ ID NO: 151301

SEQ ID NO: 151431 - RNA, 64 nt, Homo Sapiens; identical to SEQ ID NO: 151302

SEQ ID NO: 151432 - RNA, 64 nt, Homo Sapiens; identical to SEQ ID NO: 151303

SEQ ID NO: 151433 - RNA, 64 nt, Homo Sapiens; identical to SEQ ID NO: 151304

SEQ ID NO: 151434 - RNA, 64 nt, Homo Sapiens; identical to SEQ ID NO: 151305

SEQ ID NO: 151435 - RNA, 64 nt, Homo Sapiens; identical to SEQ ID NO: 151306

SEQ ID NO: 151436 - RNA, 64 nt, Homo Sapiens; identical to SEQ ID NO: 151307

SEQ ID NO: 151437 - RNA, 64 nt, Homo Sapiens; identical to SEQ ID NO: 151308

SEQ ID NO: 151438 - RNA, 64 nt, Homo Sapiens; identical to SEQ ID NO: 151309

SEQ ID NO: 151439 - RNA, 64 nt, Homo Sapiens; identical to SEQ ID NO: 151310

SEQ ID NO: 151440 - RNA, 64 nt, Homo Sapiens; identical to SEQ ID NO: 151311

SEQ ID NO: 151441 - RNA, 64 nt, Homo Sapiens; identical to SEQ ID NO: 151312

SEQ ID NO: 151442 - RNA, 64 nt, Homo Sapiens; identical to SEQ ID NO: 151313

SEQ ID NO: 151443 - RNA, 64 nt, Homo Sapiens; identical to SEQ ID NO: 151314

SEQ ID NO: 151444 - RNA, 64 nt, Homo Sapiens; identical to SEQ ID NO: 151315

SEQ ID NO: 151445 - RNA, 64 nt, Homo Sapiens; identical to SEQ ID NO: 151316

SEQ ID NO: 151446 - RNA, 64 nt, Homo Sapiens
uugcauucugcucugcuauguagacucugugugccucuucuacauuuugucuggagaaaucacu

SEQ ID NO: 151447 - RNA, 64 nt, Homo Sapiens
acagccaccuugaccuugggacuuuugccuuucgcucuucuaucauucugaaauucaguuaguu

SEQ ID NO: 151448 - RNA, 64 nt, Homo Sapiens
cagcucugaauggagaaacucucuaggccauccccucuucuaccuccugcaacccacccauccu

SEQ ID NO: 151449 - RNA, 64 nt, Homo Sapiens
uccagauuuccguguacccacucuguuucaggagcucuucuagguaaagcugagaucacaggaa

SEQ ID NO: 151450 - RNA, 64 nt, Homo Sapiens
ccuuggccugaaucugguugccacugccuccucccucuucuaagcuagagucccuggcuucugg

SEQ ID NO: 151451 - RNA, 64 nt, Homo Sapiens
cuuccucaccaguguuguuuucagcaaaguuggccucuucuacagagaaaggcagggccacucc

SEQ ID NO: 151452 - RNA, 64 nt, Homo Sapiens
gaucauauuccugaaaagaaauuuaaaucugaagcucuucuauccacccuuacgucagaugccu

SEQ ID NO: 151453 - RNA, 64 nt, Homo Sapiens
ucuacacagguugucgaaauaauaauuccacagccucuucuaacaaugccuacaaugugaauuc

SEQ ID NO: 151454 - RNA, 64 nt, Homo Sapiens
aaugaagaugaagagcuauuuuguccuauugugacucuucuaaaauucucuagacaaaaucaaa

SEQ ID NO: 151455 - RNA, 64 nt, Homo Sapiens
uggaccccagcauuuaagugcaacagcacuuuuccucuucuagacuugccagggaugggcagcc

SEQ ID NO: 151456 - RNA, 64 nt, Homo Sapiens
cuccaucuaaagcagaaaacuccacaacuaagaucucuucuaacauuuaaggaauagagccuaa

SEQ ID NO: 151457 - RNA, 64 nt, Homo Sapiens
ccugaggaccacacuggcugcaacccaaacucgacucuucuacuuacacuugcucagcauuuuu

SEQ ID NO: 151458 - RNA, 64 nt, Homo Sapiens
gaacuaccuauccuuacauuucaccuacuaaugucucuucuaacaucuuagagguccauggaga

SEQ ID NO: 151459 - RNA, 64 nt, Homo Sapiens
uaucugguucuauaugaaugcuauuuuuucccuucucuucuaacaugaaauauauuuucucuuu

SEQ ID NO: 151460 - RNA, 64 nt, Homo Sapiens
ugugaaaagagggugcagagcuucuguauuuuuacucuucuagacaggucuuacagcaaaaaga

SEQ ID NO: 151461 - RNA, 64 nt, Homo Sapiens
aagggaagaacacgggguaaugguuuuacaaacgcucuucuaacaccuuuuggcuucaaagucc

SEQ ID NO: 151462 - RNA, 64 nt, Homo Sapiens
ccccugaaauccugaguuuauagaaaucauauaucucuucuaacuaagauuucuugaaggauuu

SEQ ID NO: 151463 - RNA, 64 nt, Homo Sapiens
gcgugugcagcacggggcgacacuuccggacacgcucuucuaaagcgaggagggccggggagga

SEQ ID NO: 151464 - RNA, 64 nt, Homo Sapiens
gauaugaaaaucucuuaacauccaucagaauccacucuucuaggugaaaaaguuaaugcagcuc

SEQ ID NO: 151465 - RNA, 64 nt, Homo Sapiens
caguuacuacauaucuaguauuagcacucacugacucuucuaugggggaauuaauuacucuuug

SEQ ID NO: 151466 - RNA, 64 nt, Homo Sapiens
caaauggaaacauaucauucuggaggugcacuuacucuucuacaauguggccggaucauuuguc

SEQ ID NO: 151467 - RNA, 64 nt, Homo Sapiens
ucggauaucauaacaccaaugucaggauaaauaucucuucuaaagacgauauuuaccuuuuaca

SEQ ID NO: 151468 - RNA, 64 nt, Homo Sapiens
uaaagcugagaucacaggaauucuguuucaggagcucuucuagguccagauuuucguguaccca

SEQ ID NO: 151469 - RNA, 64 nt, Homo Sapiens
uccugcaacccacccauccucucuaggccauccccucuucuacccagcucugaauggagaaacu

SEQ ID NO: 151470 - RNA, 64 nt, Homo Sapiens
uuuaagaccuccagacucuaacuuuauagaucaucucuucuagagugugcauggauguguguug

SEQ ID NO: 151471 - RNA, 64 nt, Homo Sapiens
gcugcacagagccccacaccuucacuuacaccuccucuucuagaauugcuuugcucuauuuuug

SEQ ID NO: 151472 - RNA, 64 nt, Homo Sapiens
uuauauuauuguuuucuacugcuaugugucacacuuugccaaacaggauguggaaaaugaauaa

SEQ ID NO: 151473 - RNA, 64 nt, Homo Sapiens
cuauauguaugguuguuacuaugggaaaucuuguuuugccaauuuucuuugaaaauucuggcag

SEQ ID NO: 151474 - RNA, 64 nt, Homo Sapiens
aauaaacaggauaacuguacauuuuucacuuguuuuugccaaugggagguagacacaauaaaau

SEQ ID NO: 151475 - RNA, 64 nt, Homo Sapiens
ugugcuaccaguacuaagaggggaagacuggcaauuugccaagcacuuggggauuauuauaaca

SEQ ID NO: 151476 - RNA, 64 nt, Homo Sapiens
uaauuauuauuucuuugaguagcucagacuugguuuugccaaaacucuugguaauuuuugaaga

SEQ ID NO: 151477 - RNA, 64 nt, Homo Sapiens
uauuugagagguuaguuuuuuuccuacacuuuuuuuugccaacugacuuaacaacauugcuguc

SEQ ID NO: 151478 - RNA, 64 nt, Homo Sapiens
auccugggccuucuugcuguuguuguggccuuuuuuugccaacuucaaugguccuagucagcau

SEQ ID NO: 151479 - RNA, 64 nt, Homo Sapiens
uugggaggcccuuuacauagaaaacagcauucuuuuugccaaauaugaccaaauuacuuuuauu

SEQ ID NO: 151480 - RNA, 64 nt, Homo Sapiens
ucagugguguuguauuuuuucaaaauaaaaaagguuugccaagcauaugaaagcauuuuuauca

SEQ ID NO: 151481 - RNA, 64 nt, Homo Sapiens
uguaauuuuugcauaauaaaauccucuuauugaauuugccaauugugaugcucaaauccauugc

SEQ ID NO: 151482 - RNA, 64 nt, Homo Sapiens
gagaaguucaaaaacuuggggucuuaaauugagguuugccaaauaagaaguuuaagauacuuua

SEQ ID NO: 151483 - RNA, 64 nt, Homo Sapiens
ucuacacaugccuuuuuugccggaacacugaagcuuugccaacuaagggaauaagacacuugua

SEQ ID NO: 151484 - RNA, 64 nt, Homo Sapiens
cugcaaucuugggggugguuuuauuuauuucuuuuuugccaaauagaguguggauucauuucag

SEQ ID NO: 151485 - RNA, 64 nt, Homo Sapiens
ugaguagggcaauggaaauaccaaaccuucugacuuugccaaaaagcauacaagcaaccugguc

SEQ ID NO: 151486 - RNA, 64 nt, Homo Sapiens
gcccauggaagacacuuggugaugaagggaagccuuugccaaugucuuucugccccuccaagcu

SEQ ID NO: 151487 - RNA, 64 nt, Homo Sapiens
uacucuaaaaugacauccaagauccucucaccauuuugccaagagagugauauugggaaaguga

SEQ ID NO: 151488 - RNA, 64 nt, Homo Sapiens
uacuuuuuuauuuaaaaaaagaauaucugcaaucuuugccaagguuaucacuguuuaaagcuuu

SEQ ID NO: 151489 - RNA, 64 nt, Homo Sapiens
ucuauuugucuucuccuucaccuuuccagcuacuuuugccaaauuuuguccuuuucugcaacaa

SEQ ID NO: 151490 - RNA, 64 nt, Homo Sapiens
cagguucacagcagcuuugggcuuccaucaaaccuuugccaacugauaucuaugaaaaccagug

SEQ ID NO: 151491 - RNA, 64 nt, Homo Sapiens
caggcucuuauugccauuuaaacugccagaaaucuuugccaagguccugguuaaaaaaauugga

SEQ ID NO: 151492 - RNA, 64 nt, Homo Sapiens
uagguaacacuuuaaauacuuuuuuacucaaagauuugccaagaacacagcuuauuagugaaag

SEQ ID NO: 151493 - RNA, 64 nt, Homo Sapiens
uuuugggagaacaauaaaacaaaguuacuuuaaauuugccaauaaucagagagcacaaagauua

SEQ ID NO: 151494 - RNA, 64 nt, Homo Sapiens
aauugguuucucauaacuugaaugcucaguuucauuugccaauauaacaaccuaugguugaagg

SEQ ID NO: 151495 - RNA, 61 nt, Homo Sapiens
uuccauuucucuagaauguuuuuuuaagcucuuugccaauaccaugaauuccuuuguuuaa

SEQ ID NO: 151496 - RNA, 64 nt, Homo Sapiens
uugguuuuaugcauugaugguuuuuuuuuucuuuuuugccaaauugacugucacgcggcagcuu

SEQ ID NO: 151497 - RNA, 64 nt, Homo Sapiens
ggaacccuccuccugucaauggggguguaguauuuuugccaaaauaucauguucaauuucagua

SEQ ID NO: 151498 - RNA, 64 nt, Homo Sapiens
guucuuuucccguaucaauucauuccuucaucucuuugccaaguuguuuuccuuucagggccug

SEQ ID NO: 151499 - RNA, 64 nt, Homo Sapiens
guuaugauuuugaaggcuguggguucagggagucuuugccaauccuguuggcccuaaacuauca

SEQ ID NO: 151500 - RNA, 64 nt, Homo Sapiens
uauguucagucucucaagauuuguauccagaggauuugccaaugcucuagcaacaugaucuuaa

SEQ ID NO: 151501 - RNA, 64 nt, Homo Sapiens
ugacguguauauugcucagcccagaaaaauaauauuugccaauagagggaacucaaaauaguua

SEQ ID NO: 151502 - RNA, 64 nt, Homo Sapiens
uaaaacuuucaauggagauagggcuagaaauacuuuugccaaauagcauucuuauucacuuuau

SEQ ID NO: 151503 - RNA, 64 nt, Homo Sapiens
uaaaugcagucaucuuaauacuagucuauacauuuuugccaaauggcgcaaauauaccuccauu

SEQ ID NO: 151504 - RNA, 64 nt, Homo Sapiens
uuucuuagaaugaauuuuacaggccaaagcguuauuugccaagugagaaagaaaugccaauucc

SEQ ID NO: 151505 - RNA, 64 nt, Homo Sapiens
gaauaacagauuugccggcaagcagcaauacgauuuugccaaugaaaugugagauuaacaggag

SEQ ID NO: 151506 - RNA, 64 nt, Homo Sapiens
accccucaccacccccacuggugagacaguuuacuuugccaacuugccauguuuuugccaaaac

SEQ ID NO: 151507 - RNA, 64 nt, Homo Sapiens
ggugagacaguuuacuuugccaacuugccauguuuuugccaaaaccaagauuuugaaggaaaug

SEQ ID NO: 151508 - RNA, 64 nt, Homo Sapiens
aaaaaaaaaaaaaaaaagcaccaauuuugucucauuugccaaaaaaagcccaauacuuagaguc

SEQ ID NO: 151509 - RNA, 64 nt, Homo Sapiens
uuguuagcugcgugcgugcugaugaaaauucauauuugccaacuuggcuuuggaaaaaucucau

SEQ ID NO: 151510 - RNA, 64 nt, Homo Sapiens
ugccuagcauacaucaguauuuauuaccugugucuuugccaagcgaaagaaacuucagucccca

SEQ ID NO: 151511 - RNA, 64 nt, Homo Sapiens
uacgucaaagcccuuuaagaauaucaucugggauuuugccaauaauccauacuuagaauuuggc

SEQ ID NO: 151512 - RNA, 64 nt, Homo Sapiens
gggauaugcagaacuugggauguguguauauauaaauauauaauauauauaaauauauauaaua

SEQ ID NO: 151513 - RNA, 64 nt, Homo Sapiens
gcagaacuugggauguguguauauauaaauauauaauauauauaaauauauauaauacugacuu

SEQ ID NO: 151514 - RNA, 64 nt, Homo Sapiens
ggauguguguauauauaaauauauaauauauauaaauauauauaauacugacuuaaaaaaucaa

SEQ ID NO: 151515 - RNA, 64 nt, Homo Sapiens
cacaaguccugaauuucccauucuuacuuacuaaaauauauauagaaauauauacgaacaaaac

SEQ ID NO: 151516 - RNA, 64 nt, Homo Sapiens
auuucccauucuuacuuacuaaaauauauauagaaauauauacgaacaaaacacacgcgcgcac

SEQ ID NO: 151517 - RNA, 64 nt, Homo Sapiens
uugucuuuuaaaaugaguacauauauaggcaauaaauauauaugcucagaucaauauacuuguu

SEQ ID NO: 151518 - RNA, 64 nt, Homo Sapiens
uacuuaccuaguccauccauacucauauuauucaaauauauaggugguacuuuugaaacaauua

SEQ ID NO: 151519 - RNA, 64 nt, Homo Sapiens
gaaaaccagcaaacuaaaacuucugggcagcaaaaauauauaaaugcuucagaugucaaauacc

SEQ ID NO: 151520 - RNA, 64 nt, Homo Sapiens
aaucucccuuucuucuucaguuccuuccuuguucaauauauacccuucucuaaacugugcgggu

SEQ ID NO: 151521 - RNA, 64 nt, Homo Sapiens
acuuucucacaaaagauuuuaagauaacauuucuaauauauaugcaccaauauauaugccuuua

SEQ ID NO: 151522 - RNA, 64 nt, Homo Sapiens
gauuuuaagauaacauuucuaauauauaugcaccaauauauaugccuuuaauaauuauaccauc

SEQ ID NO: 151523 - RNA, 64 nt, Homo Sapiens
acauguauuugguaugcauguguaucuauauaaaaauauauaagagggacuuuaugggauagua

SEQ ID NO: 151524 - RNA, 64 nt, Homo Sapiens
uauguagagucuagauuuauauacugcaauguaaaauauauauauauuuaccuuuuuuaaagac

SEQ ID NO: 151525 - RNA, 64 nt, Homo Sapiens
ucucagguuacuguauaacuguuauaauauauuuaauauauaaaauuaagacuuuugcuuccag

SEQ ID NO: 151526 - RNA, 64 nt, Homo Sapiens
uggaaaaacaugaauucauaaauucaggaagcacaauauauaccaaacauauauuuaaauaaaa

SEQ ID NO: 151527 - RNA, 64 nt, Homo Sapiens
guauacuugguguagacuuugucuugcuucuauaaauauauaguaaaauccaacucugcuuuug

SEQ ID NO: 151528 - RNA, 64 nt, Homo Sapiens
uauauauauauauauauaaucacuguuuauaaaaaauauauauagaccccaaacuggcauuuaa

SEQ ID NO: 151529 - RNA, 64 nt, Homo Sapiens
uaauaaaggcaggcaacuuuuuguauuauagacaaauauauaaaguaacaauauaauuuugcuu

SEQ ID NO: 151530 - RNA, 64 nt, Homo Sapiens
gcaugguuuguaauaaaauccuuaaguguaaagaaauauauaauagauuguuucauaucuauuc

SEQ ID NO: 151531 - RNA, 64 nt, Homo Sapiens
uguuucuaaaauuacuuguucaguuucuaucaaaaauauauauuuaguacugaauauuuacuua

SEQ ID NO: 151532 - RNA, 64 nt, Homo Sapiens
gugacaauauuaagguacauuuguacuuuugaguaauauauaaagauucuacuuuuaggguuau

SEQ ID NO: 151533 - RNA, 64 nt, Homo Sapiens
uguauguauauacagaugugauguauauaauuugaauauauacagaaucuacaaauaucuuuau

SEQ ID NO: 151534 - RNA, 64 nt, Homo Sapiens
gauauauaaucccuauauauauagacacacauauaauauauauaauauauauauauauaucugu

SEQ ID NO: 151535 - RNA, 64 nt, Homo Sapiens
uauauauaucuguauagacacacacagaaagaugaauauauauauguggauauauauacacaca

SEQ ID NO: 151536 - RNA, 64 nt, Homo Sapiens
guacaauuuaagaauugguguguauuaacauuuuaauauauaauucuucaauauuuugacauaa

SEQ ID NO: 151537 - RNA, 64 nt, Homo Sapiens
aacuguuaaggcccucuaauuaauauuuccuuuaaauauauacugauuuuguucauuaccuacu

SEQ ID NO: 151538 - RNA, 64 nt, Homo Sapiens
auauagauauggaaaugacuauaaauauauauauaauauauaaaauauauacauauauauauau

SEQ ID NO: 151539 - RNA, 64 nt, Homo Sapiens
uaauauauaaaauauagauauauauauauauauaaauauauauagugcuagguguauauauaca

SEQ ID NO: 151540 - RNA, 64 nt, Homo Sapiens
uagaaagauguauauagaugaaagaaacagagauaauauauauaugaaagguuuaucuaagaag

SEQ ID NO: 151541 - RNA, 64 nt, Homo Sapiens
ugcaucuauguacagagccuguuacaagcuacagaauauauacauaagguggucucagccaauu

SEQ ID NO: 151542 - RNA, 64 nt, Homo Sapiens
uuguuuucacuguaucacauaauaaaauauauacaauauauacaauucaacuacacuauauaua

SEQ ID NO: 151543 - RNA, 64 nt, Homo Sapiens
auauauacauuguuuucacucuauauauaaauaaaauauauacaguugcuacuauucaacuaca

SEQ ID NO: 151544 - RNA, 64 nt, Homo Sapiens
aggucuguaaauguguacauacaugucuuauauaaauauauaauauauaaauauggugucugug

SEQ ID NO: 151545 - RNA, 64 nt, Homo Sapiens
uaaauguguacauacaugucuuauauaaauauauaauauauaaauauggugucuguguacauau

SEQ ID NO: 151546 - RNA, 64 nt, Homo Sapiens
augccuaauaaauacauugacuauauauaaaaugaauauauacauacacauguaugccuguaua

SEQ ID NO: 151547 - RNA, 64 nt, Homo Sapiens
uguguuuuuuaguguugucacuuguuuauagauaaauauauaaauaaccuguuuggauccuggu

SEQ ID NO: 151548 - RNA, 64 nt, Homo Sapiens
uaauuguuagcuguuuugaaauuauauauauauaaauauauauaaauauauaaauauaugccag

SEQ ID NO: 151549 - RNA, 64 nt, Homo Sapiens
cuguuuugaaauuauauauauauaaauauauauaaauauauaaauauaugccagucuuggcuga

SEQ ID NO: 151550 - RNA, 64 nt, Homo Sapiens
uaaaacauuccccucuguccauauguaauauauaaauauauauacacauaugacuauacgggac

SEQ ID NO: 151551 - RNA, 64 nt, Homo Sapiens
uauauauauaaaacauucccuacgggacauauguaauauauaaaucacucuacacauaugacua

SEQ ID NO: 151552 - RNA, 64 nt, Homo Sapiens
cacacaaauuggugacagaagaacacuaaagaauaauauauaagccaaccccuuacacuacacu

SEQ ID NO: 151553 - RNA, 64 nt, Homo Sapiens
ucucacaaguucagcaucaccagacucugcugaaaauauauagcugugcccauaaagaucgauu

SEQ ID NO: 151554 - RNA, 64 nt, Homo Sapiens
auuaauaaaaccugugcuuguguuggcaguuuaaaauauauauauuuuuguuuuuguuuuuugc

SEQ ID NO: 151555 - RNA, 64 nt, Homo Sapiens
uagccugauaaacaacuucuugcauguuugggcaaauauauauaauaguuauuuuauccugugg

SEQ ID NO: 151556 - RNA, 64 nt, Homo Sapiens
gggugguccccagucucugucagccguagcuaugaauauauauauuaccuggaauuuuugcuua

SEQ ID NO: 151557 - RNA, 64 nt, Homo Sapiens
uguauuuuauauuaauguuucaaaucagcuaggaaauauauaauuuaugaccuggauauauaag

SEQ ID NO: 151558 - RNA, 64 nt, Homo Sapiens
uuucaaccagcauuuuacuauuaaaauauauauaaauauauauuuuaaacuaguaaugggccaa

SEQ ID NO: 151559 - RNA, 64 nt, Homo Sapiens
aauauauauuuuucaaccagaaugggccaauuaaaauauauauauaugcaauuuuuaaacuagu

SEQ ID NO: 151560 - RNA, 64 nt, Homo Sapiens
uuuuauuggaaaauucuaauuuaacaucugaaaaaauauauauugucucuacugauaugucuua

SEQ ID NO: 151561 - RNA, 64 nt, Homo Sapiens
uuaucucacugcucauguacaaauagguuauuggaauauauaagucuugggcaggaguuguuga

SEQ ID NO: 151562 - RNA, 64 nt, Homo Sapiens
uguguauguguguauacacagaauacauguuguaaauauauaucuggcacuucuuuugucuuag

SEQ ID NO: 151563 - RNA, 64 nt, Homo Sapiens
aauauauuuuuuuaaguuucaauauauagauauaaauauauaugugggcauugauacauauaua

SEQ ID NO: 151564 - RNA, 64 nt, Homo Sapiens
uauaaauauauaugaauauauugauacauauauaaauauauagagcccacguguuuuaugggca

SEQ ID NO: 151565 - RNA, 64 nt, Homo Sapiens
ccaauguauuccaagcuaagauauauauauguauaauauauauuuaaauuuuagguauaaauaa

SEQ ID NO: 151566 - RNA, 64 nt, Homo Sapiens
uguauaauauauauuccaauuuuagguauaaauaaauauauauagcaugaaguauugcuuaaau

SEQ ID NO: 151567 - RNA, 64 nt, Homo Sapiens
aucuucugggugguuugauaguguuuuuaaaaguaauauauaauguggggugaaaugggaguag

SEQ ID NO: 151568 - RNA, 64 nt, Homo Sapiens
ucccucagcugauaaugguaguugaucuguuguaaauauauacauauaugcauauuugcacuuc

SEQ ID NO: 151569 - RNA, 64 nt, Homo Sapiens
guguuucauuacuugaauguaguuaucuauugaaaauauauauuauauacauagacauauauau

SEQ ID NO: 151570 - RNA, 64 nt, Homo Sapiens
gggggacuggugauauguugaucuuuuucaaaaaaauauauauaugacaaaaaaaaaaaaaaag

SEQ ID NO: 151571 - RNA, 64 nt, Homo Sapiens
caccacuaguuuuaauauaguacaaugaaaaaauaauauauauauauauaguacaaugguccag

SEQ ID NO: 151572 - RNA, 64 nt, Homo Sapiens
uauuagacaacaacaaaaggaacaacuaaccugaaauauauaauaacuuugaacuuaaauauac

SEQ ID NO: 151573 - RNA, 64 nt, Homo Sapiens
uagcaaaaauuaaaauucuuaagaaaacuucacuaauauauagucauaaugugguauauucaua

SEQ ID NO: 151574 - RNA, 64 nt, Homo Sapiens
guagccuuuuaacagcaagucuuccuguagucacaauauauacugugauuuuaaaccaaauugu

SEQ ID NO: 151575 - RNA, 64 nt, Homo Sapiens
cauggauauauaaaguuucuuauauauauauauaaauauauauacauauagauagguagauaua

SEQ ID NO: 151576 - RNA, 64 nt, Homo Sapiens
uaacauccuaaguuaacauaugauuggucuaaaaaauauauagacuacaccucuuaaaaaacau

SEQ ID NO: 151577 - RNA, 64 nt, Homo Sapiens
cauuuauuuaaagagaaaagaguguuguuggugaaauauauaaacaugcugugugccacaggcc

SEQ ID NO: 151578 - RNA, 64 nt, Homo Sapiens
aaagccacuggaaugaaaacuccuaagaaggauaaauauauaaauaaaaaauuuaauuuguccu

SEQ ID NO: 151579 - RNA, 64 nt, Homo Sapiens
gacuauacaagaauuaauuuuaguccuuguaaacaauauauacagauuugugaugcaguguuug

SEQ ID NO: 151580 - RNA, 64 nt, Homo Sapiens
aaccuaaaaaagauauauuaauauauauaaaauaaauauauauauuguaaauauauaaauauau

SEQ ID NO: 151581 - RNA, 64 nt, Homo Sapiens
uauauaaaauaaauauauauguuguaaauauauaaauauauauagugaaggaauauauggcaga

SEQ ID NO: 151582 - RNA, 64 nt, Homo Sapiens
uauauauauauauaaaauaaauggcagaguuguaaauauauaaaaaccaaaggugaaggaauau

SEQ ID NO: 151583 - RNA, 64 nt, Homo Sapiens
cuuugcagaagcucuaggccauaugacucccuaaaauauauacauccagcauguauuguuccaa

SEQ ID NO: 151584 - RNA, 64 nt, Homo Sapiens
caggaaccauuuaucaucaaguuaauaccuauaaaauauauagcauuuccaaauuauaaacuau

SEQ ID NO: 151585 - RNA, 64 nt, Homo Sapiens
aacuuuaugauccaauuauaauaagagguuuuaaaauauauaaaauuauugauacucuuucuaa

SEQ ID NO: 151586 - RNA, 64 nt, Homo Sapiens
aauaaauugcuguuuauuuuuuaguuaauacuaaaauauauagcaaaaagaaccccacuuauuc

SEQ ID NO: 151587 - RNA, 64 nt, Homo Sapiens
cagaugaaacugaauaucauuguaauaaucucauaauauauauuuguaacuuuguagcuaucuu

SEQ ID NO: 151588 - RNA, 64 nt, Homo Sapiens
augcaguuuucauggacauagaaaauucaaauagaauauauaauauugaauuuaagauuugggg

SEQ ID NO: 151589 - RNA, 64 nt, Homo Sapiens
auauauauacauauauauauauauauaaacaugaaauauauauauauggcuccuuugugcccca

SEQ ID NO: 151590 - RNA, 64 nt, Homo Sapiens
uuuugguaauaguggcagguauuuauuccuucugaauauauaccccauuauaggaauaacuguu

SEQ ID NO: 151591 - RNA, 64 nt, Homo Sapiens
uaaauuugcuaguggauuuugucuaaugugcagaaauauauaugucuaaugugcagaaauauau

SEQ ID NO: 151592 - RNA, 64 nt, Homo Sapiens
uaaugugcagaaauauauaugucuaaugugcagaaauauauauguguguauguguguauauaua

SEQ ID NO: 151593 - RNA, 64 nt, Homo Sapiens
aaaaaagaaaaaaaaaaauaaaacugauguaaugaauauauaauuacaacaaaagaggucuaac

SEQ ID NO: 151594 - RNA, 64 nt, Homo Sapiens
ccacaauaaauuuuaaugagcacuacaaauuuagaauauauaaaaauaucaguaaccuaugaau

SEQ ID NO: 151595 - RNA, 64 nt, Homo Sapiens
acuguacuauuucaaagcuucuaaauaaauauaaaauauauauauuauauuauauaauuuuccu

SEQ ID NO: 151596 - RNA, 64 nt, Homo Sapiens
uuacacaugaauauaaaaucuauaauucuauaugaauauauagagauauagaaacaucugaacu

SEQ ID NO: 151597 - RNA, 64 nt, Homo Sapiens
uuugcccaaaauaacucauuuuguauuaucugaaaauauauaauuucuggucauguguauguua

SEQ ID NO: 151598 - RNA, 64 nt, Homo Sapiens
guguuuucucuggcacagaguagaucuuuugggaaauauauaugaaaguggauuaaguuugacu

SEQ ID NO: 151599 - RNA, 64 nt, Homo Sapiens
gguguaagaguugaugaaugacuuuagcugugugaauauauaauagucaaacugcaaacauuuu

SEQ ID NO: 151600 - RNA, 64 nt, Homo Sapiens
uucaaaauaauuagcuauauuuuuauauaauaugaauauauacauaaaaauuguuucuauaaau

SEQ ID NO: 151601 - RNA, 64 nt, Homo Sapiens
uuuaagaagcgaacaaaaaguaauguauaucuguaauauauaaucaaaugauucauuuuucugu

SEQ ID NO: 151602 - RNA, 64 nt, Homo Sapiens
ggaaauagcagugaauuuuagucauuaacuucaaaauauauauauauauauaauuuaaaggaaa

SEQ ID NO: 151603 - RNA, 64 nt, Homo Sapiens
aaaauuggcggguaaaaaucacaaaaugcagucgaauauauauaugaaaacuugcauuagguga

SEQ ID NO: 151604 - RNA, 64 nt, Homo Sapiens
aaccuucuuaacaaaacuucuuaaaacuggaaaaaauauauauuauguaucuauguaucauauu

SEQ ID NO: 151605 - RNA, 64 nt, Homo Sapiens
aauauaugauuuuuaugucaaucaagacaaaugaaauauauauguauguguauauauauacaug

SEQ ID NO: 151606 - RNA, 64 nt, Homo Sapiens
auauguauguguauauauauacauguauguaugaaauauauauaugugcguguguguguguaua

SEQ ID NO: 151607 - RNA, 64 nt, Homo Sapiens
gggacaucaaaacuucaauaucaucucaggcacaaauauauaugggccaaaacuagagugauac

SEQ ID NO: 151608 - RNA, 64 nt, Homo Sapiens
acaucucuccauuuagauaaucccuaccuucaaaaauauauauagcuugcuucaaacuaagguu

SEQ ID NO: 151609 - RNA, 64 nt, Homo Sapiens
guuauauauuuaugagaaacuuguaaauauauauaauauauaaaauauuuguaugcuguauaua

SEQ ID NO: 151610 - RNA, 64 nt, Homo Sapiens
auauauaaaguuauauauuucuguauauauuguaaauauauauaacaugaacaauauuuguaug

SEQ ID NO: 151611 - RNA, 64 nt, Homo Sapiens
uuauauuuguauguaaauuaaauauauauuuugaaauauauagaauuauuugaaaaucauucua

SEQ ID NO: 151612 - RNA, 64 nt, Homo Sapiens
uugaaauauauagauuauauugaaaaucauucuaaauauauauuaauauuuucuguagauuauu

SEQ ID NO: 151613 - RNA, 64 nt, Homo Sapiens
cuaaaauuuauggcacaaaaauacauuauaauguaauauauaaauaaauuauaauguauaaucu

SEQ ID NO: 151614 - RNA, 64 nt, Homo Sapiens
uuucaauguauuuuuuauuucauuucaugcaaaaaauauauauaacucagggguucuuaaccua

SEQ ID NO: 151615 - RNA, 64 nt, Homo Sapiens
auauauuuagcauugcugagauauauuuauauauaauauauauuaacguauguauuuauauauu

SEQ ID NO: 151616 - RNA, 64 nt, Homo Sapiens
uauauauaagguggccacgcagcauuuaugguagaauauauaauaucauaauuugaagaaggcc

SEQ ID NO: 151617 - RNA, 64 nt, Homo Sapiens
gacauccucgaggcccuagccauuuaguuauaaaaauauauagccaauuugaauauaaauuuau

SEQ ID NO: 151618 - RNA, 64 nt, Homo Sapiens
uuagauagaugaagaagcuaaauucugguagcuaaauauauauuuauuuuauuaggaguaccau

SEQ ID NO: 151619 - RNA, 64 nt, Homo Sapiens
gaauuuuguauuguuuuacuuuuuuuuuuauuucaauauauacaguuugaugaugugcuugaaa

SEQ ID NO: 151620 - RNA, 64 nt, Homo Sapiens
uauacaguuugaugaugugcuugaaauuggugcaaauauauacacacccuuguaagugcaaagu

SEQ ID NO: 151621 - RNA, 64 nt, Homo Sapiens
uguacuaaauacagcagaaaaucuacucuuuagcaauauauaacacaguauaugcuuuuuuaua

SEQ ID NO: 151622 - RNA, 64 nt, Homo Sapiens
uuuuacauaaaaguugugcucuuaauaaacauguaauauauaauuuaucaauugguuuaugugu

SEQ ID NO: 151623 - RNA, 64 nt, Homo Sapiens
ugcuugaguguguucgcguguguggguggauauaaauauauauaaauauauauaaauaaauaua

SEQ ID NO: 151624 - RNA, 64 nt, Homo Sapiens
uguucgcguguguggguggauauaaauauauauaaauauauauaaauaaauauauauauccucu

SEQ ID NO: 151625 - RNA, 64 nt, Homo Sapiens
gguggauauaaauauauauaaauauauauaaauaaauauauauauccucuguauaaaaugaggu

SEQ ID NO: 151626 - RNA, 64 nt, Homo Sapiens
aguacacuuguagccaaaacuggaagacaaaaccaauauauaauuuggcugcugauuggcuuac

SEQ ID NO: 151627 - RNA, 64 nt, Homo Sapiens
cuccuuuccccuucuggucccugcgcuuugguauaauauauauacuucuccauacacagaccuc

SEQ ID NO: 151628 - RNA, 64 nt, Homo Sapiens
uguauauauauaguacauguguguguguguguguaauauauauaaaauauauauauauaugugu

SEQ ID NO: 151629 - RNA, 64 nt, Homo Sapiens
uauaugugugugugugugugggaaggaaaaaaaaaauauauauaucuaucacuccuuuaccuag

SEQ ID NO: 151630 - RNA, 64 nt, Homo Sapiens
auacacagacaggauaguuuuaaauuugguaauaaauauauauacaaaagugguuuuuguuuau

SEQ ID NO: 151631 - RNA, 64 nt, Homo Sapiens
uuuugggugucugaggccccaacuuccacuggucaauauauagaaaauuugauaacaaaucauc

SEQ ID NO: 151632 - RNA, 64 nt, Homo Sapiens
guuuaaaagauauuucagucgccauaagaaagucaauauauauuagacccuuuaauaagugagu

SEQ ID NO: 151633 - RNA, 64 nt, Homo Sapiens
auauuaugguaauagcagaaguguauagcuuucuaauauauauaucugugaaauuaacaugcuu

SEQ ID NO: 151634 - RNA, 64 nt, Homo Sapiens
cacaauuuuaauauuuuaaucuuuuucuuuugaaaauauauauucauacuugaaauagguggag

SEQ ID NO: 151635 - RNA, 64 nt, Homo Sapiens
uuuuguuucuuagggaaaacgaaauggcauggggaauauauaugcaggcaauuugaggaaagaa

SEQ ID NO: 151636 - RNA, 64 nt, Homo Sapiens
guuaaauauacacgggacugagaaaauauauauaaauauauauuaaaacugaauguacugauuu

SEQ ID NO: 151637 - RNA, 64 nt, Homo Sapiens
aauauauauuguuaaauauaguacugauuuagaaaauauauauaaaacaaguuaaaaacugaau

SEQ ID NO: 151638 - RNA, 64 nt, Homo Sapiens
guuaaaggagaccuguagcacaauagaggaguuaaauauauauucagcauuagcaauaugguuc

SEQ ID NO: 151639 - RNA, 64 nt, Homo Sapiens
uuuguccaagaaaaaaaaaacaguuuuuuauaaaaauauauauuaaucauuaaaguuggaugau

SEQ ID NO: 151640 - RNA, 64 nt, Homo Sapiens
gauuuauaaauuggaaaucaccagguuacuugccaauauauagucauauugcugccauuguacu

SEQ ID NO: 151641 - RNA, 64 nt, Homo Sapiens
auagucauauugcugccauuguacuuaauuucuaaauauauaaaauccacauuuaaaaauuaua

SEQ ID NO: 151642 - RNA, 64 nt, Homo Sapiens
gaaagauauauuuuaaguggugcacuaauuagugaauauauaggaaaauuaucugacgaguauc

SEQ ID NO: 151643 - RNA, 64 nt, Homo Sapiens
cugaaggcauuuucagcucuagcaauuuauuuauaauauauaaguucauauauuuuuuaaucca

SEQ ID NO: 151644 - RNA, 64 nt, Homo Sapiens
augcaauggaauauagauauguauauacacauauaauauauaugcuaaaguauaaagaguaaua

SEQ ID NO: 151645 - RNA, 64 nt, Homo Sapiens
guucucaugucaaagacuacuccuugccccauugaauauauagugguagcagguguacaaauug

SEQ ID NO: 151646 - RNA, 64 nt, Homo Sapiens
guaaaauaucuaaagcaugaaucuaagagcacgcaauauauaauuuuaaagaaaauauucuauu

SEQ ID NO: 151647 - RNA, 64 nt, Homo Sapiens
aacacuaucggauuauuuauauuacucaagagacaauauauaugaauucuuaugaaagugcuug

SEQ ID NO: 151648 - RNA, 64 nt, Homo Sapiens
aacauguauauaaaagaaugaaauugaaaaauaaaauauauaaacauaaauaaauuagguagug

SEQ ID NO: 151649 - RNA, 64 nt, Homo Sapiens
caagcacaacuugaagcugagcaaagcuucagaaaauauauauguuccuguuaacaagcuggca

SEQ ID NO: 151650 - RNA, 64 nt, Homo Sapiens
ugaccaagcaccaugaucccgagaauuugacucaaauauauacuggagaguaauuuaugcuuug

SEQ ID NO: 151651 - RNA, 64 nt, Homo Sapiens
uauauauauauauauccauauaauauauauauaaaauauauauauagacuguacauauuauaua

SEQ ID NO: 151652 - RNA, 64 nt, Homo Sapiens
uaaaauauauauauauauauuacauauuauauauaauauauauaaaaguuuuauagcuagacug

SEQ ID NO: 151653 - RNA, 64 nt, Homo Sapiens
uuauuguaaccuuucaaccuugccauguaauugaaauauauagauaaaaugcuuuuguauuuac

SEQ ID NO: 151654 - RNA, 64 nt, Homo Sapiens
uauugaaaaucaaaggaggcgaguaagacaaaaaaauauauauagcacucuagccugggcaaca

SEQ ID NO: 151655 - RNA, 64 nt, Homo Sapiens
acuggcuuauuuucuuuuaauauauaaauauauaaauauauauauuuccaguguagcagaucuc

SEQ ID NO: 151656 - RNA, 64 nt, Homo Sapiens
uauauauaacuggcuuauuucagaucucuauauaaauauauaaauuuauauguuuccaguguag

SEQ ID NO: 151657 - RNA, 64 nt, Homo Sapiens
uacguguguacuuauuauaucuauacauauacauaauauauacaaugcccagguuacauuuaaa

SEQ ID NO: 151658 - RNA, 64 nt, Homo Sapiens
uacugaaaaugugauguucuaagacuuccacugcaauauauaaaccaguaagauuugauguuua

SEQ ID NO: 151659 - RNA, 64 nt, Homo Sapiens
uaaauaauuugucuuaaguaauugcaaaggugggaauauauacuauaucaguauuuagaaauaa

SEQ ID NO: 151660 - RNA, 64 nt, Homo Sapiens
uacauacguaaaaucauaaacacaaaugaucucuaauauauacuucccuauacaauuguuaaug

SEQ ID NO: 151661 - RNA, 64 nt, Homo Sapiens
cugggcaacauaccaagacccccgucucuuuaaaaauauauauauuuuaaauauacuuaaauau

SEQ ID NO: 151662 - RNA, 64 nt, Homo Sapiens
cucuuuaaaaauauauauauuuuaaauauacuuaaauauauauuucuaauaucuuuaaauauau

SEQ ID NO: 151663 - RNA, 64 nt, Homo Sapiens
aaauauacuuaaauauauauuucuaauaucuuuaaauauauauauauauuuuaaagaccaauuu

SEQ ID NO: 151664 - RNA, 64 nt, Homo Sapiens
aaauuaugacugaaagguuuauuaaaaugauuguaauauauagaaaguaucuguguuuaagaag

SEQ ID NO: 151665 - RNA, 64 nt, Homo Sapiens
gagugauuucauuuugggaaacagguuucaaaugaauauauauacauggguaaaauuacucugu

SEQ ID NO: 151666 - RNA, 64 nt, Homo Sapiens
aucugguaaauuguagaacaauugcauguguuuaaauauauauacaaacauaucacacauuaaa

SEQ ID NO: 151667 - RNA, 64 nt, Homo Sapiens
uguuuaaauauauauacaaacauaucacacauuaaauauauauauauuuaaaucaugcuuuguu

SEQ ID NO: 151668 - RNA, 64 nt, Homo Sapiens
caaaggaauuauaucauuauguuccuaaggaguaaauauauauuugaccuguaaguguguguau

SEQ ID NO: 151669 - RNA, 64 nt, Homo Sapiens
cuguagguggagcaaguaauaagccaugcugugcaauauauacauaaagcuucugcuucucaug

SEQ ID NO: 151670 - RNA, 64 nt, Homo Sapiens
auauuugaauugaaacaauagaaauuuuucucauaauauauaccuaugugaaaccaacuuaucu

SEQ ID NO: 151671 - RNA, 64 nt, Homo Sapiens
acugcuguguuauuuacacuguuuuguauuguacaauauauaugcucagcacugcccccuucuc

SEQ ID NO: 151672 - RNA, 64 nt, Homo Sapiens
uguuuuauucucaaguggagaacuucucccacauaauauauauauauauauauauuuuaauuua

SEQ ID NO: 151673 - RNA, 64 nt, Homo Sapiens
uuuguuuuauauaggucccaaauuauaauugucaaauauauauuuuaaauuaauaaaaguuguc

SEQ ID NO: 151674 - RNA, 64 nt, Homo Sapiens
uguuuuaauaucagguggauuuuuguuucuaagcaauauauacauaaaaucaaccaacauaucu

SEQ ID NO: 151675 - RNA, 64 nt, Homo Sapiens
uauaauacacacacacacacuaaaugggggcuucaauauauauaaaauguaaauuguaauaaug

SEQ ID NO: 151676 - RNA, 64 nt, Homo Sapiens
guaaaaucccacuuucaugcuuuaagugacuagaaauauauacacugaugaacuaccacaaagu

SEQ ID NO: 151677 - RNA, 64 nt, Homo Sapiens
ucauuagauuccuguggugguuuaaauauaugcaaauauauauauaccuuuucccucaugaaau

SEQ ID NO: 151678 - RNA, 64 nt, Homo Sapiens
uuaucauuuuagccagcaggaaggacuuacuuguaauauauaauggaauuaauauucacuucug

SEQ ID NO: 151679 - RNA, 64 nt, Homo Sapiens
gaaaaaugucacuauaucuuaguacauugcuuaaaauauauaguauacacaguggcaaaacaaa

SEQ ID NO: 151680 - RNA, 64 nt, Homo Sapiens
guaaagaagggauauuaagaaaaacugaagaugaaauauauauuacugcacuuuguuuagaaaa

SEQ ID NO: 151681 - RNA, 64 nt, Homo Sapiens
uuuuauauauauauauauauuaaaauacauauggaauauauauagaauauauauauuauauaua

SEQ ID NO: 151682 - RNA, 64 nt, Homo Sapiens
uuauauauauaaaauacauauauaauauauauggaauauauauaauuauauauauuuuuauaua

SEQ ID NO: 151683 - RNA, 64 nt, Homo Sapiens
gaauauauauauuauauauaauuuuuauauauauaauauauaugggaauauguauauuauauau

SEQ ID NO: 151684 - RNA, 64 nt, Homo Sapiens
gaauauguauauuauauauaacccuuccauauauaauauauaugaagggaaaccuaaaacaaau

SEQ ID NO: 151685 - RNA, 64 nt, Homo Sapiens
ucuccaaacccuugcugccaguuccucuuugauaaauauauaguuaauucgaaauaaaauccau

SEQ ID NO: 151686 - RNA, 64 nt, Homo Sapiens
uauauguuuuauacauaaauaaaacauuucaucuaauauauauaugugugugugaguauaugug

SEQ ID NO: 151687 - RNA, 64 nt, Homo Sapiens
ccagaacuugagccuuguguauagauuuuaaaagaauauauauaucagccgggcgcgguggcuc

SEQ ID NO: 151688 - RNA, 64 nt, Homo Sapiens
gaaaaguauuuuucuuguauauuauuaaguaaugaauauauaagaacuguacucuucucagcuu

SEQ ID NO: 151689 - RNA, 64 nt, Homo Sapiens
aggauuuaaggaggugaagucgggucaaaaauaaaauauauauacauauauacauugcuuagaa

SEQ ID NO: 151690 - RNA, 64 nt, Homo Sapiens
ucuaauuccacaggucaucagaugccugcuugauaauauauaaacaauaaaaacaacuuucacu

SEQ ID NO: 151691 - RNA, 64 nt, Homo Sapiens
gccuuaacuucuggccaaguuuguuuuuuauauaaauauauauacauauauacauauuauguau

SEQ ID NO: 151692 - RNA, 64 nt, Homo Sapiens
ugcuggguugaaaaauguuuugaaagccuuuuaaaauauauaucuuuauaaaguaauauucagg

SEQ ID NO: 151693 - RNA, 64 nt, Homo Sapiens
cacugcagcugcuuuccauuuuuauauauauauaaauauauauaaauauauacuuuuuaaaaau

SEQ ID NO: 151694 - RNA, 64 nt, Homo Sapiens
gcuuuccauuuuuauauauauauaaauauauauaaauauauacuuuuuaaaaauaauuuauaaa

SEQ ID NO: 151695 - RNA, 64 nt, Homo Sapiens
cugacccacacaaagguucuggagauuacuggagaauauauauaaauauauauauguacguaua

SEQ ID NO: 151696 - RNA, 64 nt, Homo Sapiens
caaagguucuggagauuacuggagaauauauauaaauauauauauguacguauauauguaaaua

SEQ ID NO: 151697 - RNA, 64 nt, Homo Sapiens
cguauauauguaaauacacauauacguauauauaaauauauauauacauauguguguguauaua

SEQ ID NO: 151698 - RNA, 64 nt, Homo Sapiens
aauuuaauucugcaagaaaaaguuuauucagaaaaauauauauuaaaaugauauuuucuaagua

SEQ ID NO: 151699 - RNA, 64 nt, Homo Sapiens
cacacacaaugauugcaagagggcugcagauaguaauauauaaauuuuucuagcauucacccuu

SEQ ID NO: 151700 - RNA, 64 nt, Homo Sapiens
ggauauagagauaaguugucuuacaaacacuaagaauauauacaaccaaagagcucaucuuagc

SEQ ID NO: 151701 - RNA, 64 nt, Homo Sapiens
guuuccuaaauaaaugaggaguagcauaguuuaaaauauauauaucuuauaacuuucuacaaca

SEQ ID NO: 151702 - RNA, 64 nt, Homo Sapiens
uguauauguauaucaaaacauguaguacacccuaaauauauauaauuuuuauuugucaaauaua

SEQ ID NO: 151703 - RNA, 64 nt, Homo Sapiens
ggauauucauuuauacugauuuuuacuuaaacauaauauauaauuacagugcaaguuuuuucac

SEQ ID NO: 151704 - RNA, 64 nt, Homo Sapiens
accagugguaaaucaugacuuugaacacacacauaauauauauaucauugcugcauuuuguacu

SEQ ID NO: 151705 - RNA, 64 nt, Homo Sapiens
uauaugcucuccucuuucaguaauauauauauaaaauauauauauuauauauauauuauauaua

SEQ ID NO: 151706 - RNA, 64 nt, Homo Sapiens
uaaaauauauauauauaugcuauauuauauauauaauauauauaauaauauaauauauuauaua

SEQ ID NO: 151707 - RNA, 64 nt, Homo Sapiens
auaauauauuauauauauauuauauuauauauauaauauauaauauauaauauauguguauaua

SEQ ID NO: 151708 - RNA, 64 nt, Homo Sapiens
gagcaauaguuugccccuuuuggaaugaucucugaauauauaaaacacacacacaaagagcaau

SEQ ID NO: 151709 - RNA, 64 nt, Homo Sapiens
gagcaauaguuugccccuuuuggaacgaccccugaauauauaaaacacacacacaccccgcgca

SEQ ID NO: 151710 - RNA, 64 nt, Homo Sapiens
ucugacagguagucaugaaaaucaaaugaugcaaaauauauacaagcacuuuguaaauuguaaa

SEQ ID NO: 151711 - RNA, 64 nt, Homo Sapiens
guaugagaaucuaucuguucugugcuggacuucuaauauauagaacugugagauaaugggucac

SEQ ID NO: 151712 - RNA, 64 nt, Homo Sapiens
gguuuuuaaaugcuggaggauuccaaucaauauaaauauauauauauauauacacacacauaua

SEQ ID NO: 151713 - RNA, 64 nt, Homo Sapiens
acacugggguuaagucucugguauuuaggcuggcaauauauauauuaaccauauuuuaaaagua

SEQ ID NO: 151714 - RNA, 64 nt, Homo Sapiens
guuuaugucucagaugcuaacgugugaaaauauaaauauauauaauauauaaaguaaccagucu

SEQ ID NO: 151715 - RNA, 64 nt, Homo Sapiens
ucagaugcuaacgugugaaaauauaaauauauauaauauauaaaguaaccagucuuccuguauu

SEQ ID NO: 151716 - RNA, 64 nt, Homo Sapiens
auauuucauguaaacauuguacauuuauuauuguaauauauacuauuaugcagcuuauuuuacc

SEQ ID NO: 151717 - RNA, 64 nt, Homo Sapiens
gcauuuuccuugcaaggacaacuucuaccguaugaauauauauuauauuuauguauuauauuuu

SEQ ID NO: 151718 - RNA, 64 nt, Homo Sapiens
uguugcauuuuuuuccaugcuguuuuaacuuguaaauauauauguauacauauggaagauauua

SEQ ID NO: 151719 - RNA, 64 nt, Homo Sapiens
aguugauauggccaaagggagagaggccuuuuaaaauauauauauauauacacauauauaugua

SEQ ID NO: 151720 - RNA, 64 nt, Homo Sapiens
gcuaaccaguuaaaaguacuguacacccaugcucaauauauaguccuggaaauagcaauugaaa

SEQ ID NO: 151721 - RNA, 64 nt, Homo Sapiens
uauauuauauauauucuuagaguccaucuuaagaaauauauauagccugggugacaaaagcaaa

SEQ ID NO: 151722 - RNA, 64 nt, Homo Sapiens
gacccaaaaugucuucugcuacaauccuacuagcaauauauaaggcaacacagucaagaauuau

SEQ ID NO: 151723 - RNA, 64 nt, Homo Sapiens
aaaugcuuuuuuuuccguuuccaaagaaaucugaaauauauaguccacauggggagaaccccaa

SEQ ID NO: 151724 - RNA, 64 nt, Homo Sapiens
uugaaacaagaaauauuaauuuuacuguuuugguaauauauauauucuauuuuuuuuccugguu

SEQ ID NO: 151725 - RNA, 64 nt, Homo Sapiens
uccacauaucuaacaguaucuuacuggaaagaaaaauauauacauuuauaagcaugaaacuauu

SEQ ID NO: 151726 - RNA, 64 nt, Homo Sapiens
acuaugugacuuagugcacagaaauucccaguuaaauauauacaacaggcuggaagucuuuugu

SEQ ID NO: 151727 - RNA, 64 nt, Homo Sapiens
uauauauauucuuacaugaguguacaguuaaaaaaauauauauacccucauguacuauaaauug

SEQ ID NO: 151728 - RNA, 64 nt, Homo Sapiens
acugauuaaauuauuguauauuuuuuagguguuaaauauauacagaaggacuuugaucgugaau

SEQ ID NO: 151729 - RNA, 64 nt, Homo Sapiens
uuauacugcagggcaucuugugaauauguauguaaauauauacagaauaauacacacaguugug

SEQ ID NO: 151730 - RNA, 64 nt, Homo Sapiens
aaacuccgucucaaaaaagaugaaaauaaaauaaaauauauauuuacaggccuacaacuuuugc

SEQ ID NO: 151731 - RNA, 64 nt, Homo Sapiens
uaccaaaaaaaaaaaaaaaaaaaaaaaaaaaaaaaauauauauauauauauacacacacacaca

SEQ ID NO: 151732 - RNA, 64 nt, Homo Sapiens
uuccccucccaguaauaaaaaaaaaaaaaaaaaaaauauauauauauauauauauauauauaua

SEQ ID NO: 151733 - RNA, 64 nt, Homo Sapiens
ccuaccauguacccauaaaaucauguaucccauaaauauauacacauaccuguaucaaaauauc

SEQ ID NO: 151734 - RNA, 64 nt, Homo Sapiens
aacaauugaguuuacuaaugaaacuuguaaaaaaaauauauauaucuguuuuuccaaaagguua

SEQ ID NO: 151735 - RNA, 64 nt, Homo Sapiens
gguugacaugauacauguacccucuugaagauuuaauauauaaucacuaaaacagaaguacuua

SEQ ID NO: 151736 - RNA, 64 nt, Homo Sapiens
agcuaaaaacaguauuucguauacugauuuugaaaauauauauacuuuacuguuuugugaggua

SEQ ID NO: 151737 - RNA, 64 nt, Homo Sapiens
auauauaucuauaucauauuuaauauauaucuacaauauauauuuacauguguacauauaugua

SEQ ID NO: 151738 - RNA, 64 nt, Homo Sapiens
uacaauauauauuauauauaguacauauauguauaauauauaucugggugcgugguauacaugu

SEQ ID NO: 151739 - RNA, 64 nt, Homo Sapiens
uuaagguugcacacaguacagaaagauuuuuacuaauauauauugaacacaagggauauaaaau

SEQ ID NO: 151740 - RNA, 64 nt, Homo Sapiens
agauaucuaucgcuauagaagaaaaauauauauaaauauauaauuuuguuuuguuuuguuuuua

SEQ ID NO: 151741 - RNA, 64 nt, Homo Sapiens
aauauauaauagauaucuauuuuguuuuuagaaaaauauauauaaguuguugguuuuguuuugu

SEQ ID NO: 151742 - RNA, 64 nt, Homo Sapiens
caagaacuucagaaaucugcaacauaauuuuauaaauauauaaauacauguauguaugucaaaa

SEQ ID NO: 151743 - RNA, 64 nt, Homo Sapiens
uuuaaaauguuaaagaaaaacauuucuauauugaaauauauauaauuuauaaugaaaauuauag

SEQ ID NO: 151744 - RNA, 64 nt, Homo Sapiens
cugugacacacacacaaaaggaauuuaauaguauaauauauauauaaauaaauauauauacaga

SEQ ID NO: 151745 - RNA, 64 nt, Homo Sapiens
aaaggaauuuaauaguauaauauauauauaaauaaauauauauacagauauauuuaucauggua

SEQ ID NO: 151746 - RNA, 64 nt, Homo Sapiens
uuucauauuucaaauuagauucccuaggagguauaauauauauuucuugaguaauaaugugguu

SEQ ID NO: 151747 - RNA, 64 nt, Homo Sapiens
uaaugcuaauauuuccaucaaaauuugccuguggaauauauacaguucuuaauuuuaaacuguc

SEQ ID NO: 151748 - RNA, 64 nt, Homo Sapiens
uauuauaggccagcuacaaguguauauaacaucuaauauauauauauugacuugguaagucuac

SEQ ID NO: 151749 - RNA, 64 nt, Homo Sapiens
uuacaggccaaaugaacuaauguauauaacaucuaauauauauauauugacuugguaagucuac

SEQ ID NO: 151750 - RNA, 64 nt, Homo Sapiens
guuagauuccaacuuccuccaaagucagaguuaaaauauauauauucccuaaaugguauggcca

SEQ ID NO: 151751 - RNA, 64 nt, Homo Sapiens
uaaaauauuuuuuucuuuuuaugcuauuuuaaaaaauauauauacccuauaguauaugauuaua

SEQ ID NO: 151752 - RNA, 64 nt, Homo Sapiens
uguauuacacauuauuaugaaaagugaaucucauaauauauauagacagcugauauuuguuuug

SEQ ID NO: 151753 - RNA, 64 nt, Homo Sapiens
uaggaauuuuuuuuuauuuuuuaaguauuuuauuaauauauauacguugaugccuccaggaaac

SEQ ID NO: 151754 - RNA, 64 nt, Homo Sapiens
uguuuagcuugacaugaaauaauuuauauuuggaaauauauauuuaagaauuauauauauaaaa

SEQ ID NO: 151755 - RNA, 64 nt, Homo Sapiens
uuggaaauauauauuuaagaauuauauauauaaaaauauauauguauaagaguuauguauuuga

SEQ ID NO: 151756 - RNA, 64 nt, Homo Sapiens
aauauauauguauaagaguuauguauuugaaaaaaauauauaaaagaauauacaucacaauaua

SEQ ID NO: 151757 - RNA, 64 nt, Homo Sapiens
ucacauuuuuagugaacuucuucuaugaauauauaauauauacuauaccuacauuaaaaucauu

SEQ ID NO: 151758 - RNA, 64 nt, Homo Sapiens
auauacuucacauuuuuaguaaucauuuucuaugaauauauaauuguaaucauaccuacauuaa

SEQ ID NO: 151759 - RNA, 64 nt, Homo Sapiens
ucaagauugauguaucaaaacuucugacacaguaaauauauauaacuauuugacuuuuuaaaau

SEQ ID NO: 151760 - RNA, 64 nt, Homo Sapiens
uaauauggauacacaugugucauuucugauauuaaauauauaaaaagagacaaggaaguaggaa

SEQ ID NO: 151761 - RNA, 64 nt, Homo Sapiens
uauacacacccugugagaacuacgaaucuucuuaaauauauauagaauaauuguaaauauaugu

SEQ ID NO: 151762 - RNA, 64 nt, Homo Sapiens
aauacuuucaagagaaaacuguguauacacaugaaauauauauauauauauauauauauauaug

SEQ ID NO: 151763 - RNA, 64 nt, Homo Sapiens
aaauauauauauauauauauauauauauauguauaauauauaaagacuggcacccugccucucu

SEQ ID NO: 151764 - RNA, 64 nt, Homo Sapiens
auugugcacuuuauuucuauuaugauuacauuguaauauauaaugaaauaauuauacaacucac

SEQ ID NO: 151765 - RNA, 64 nt, Homo Sapiens
gcaguagggaagagacgauguaaaaauaauaaacaauauauaccuuccuagagugugaaugcau

SEQ ID NO: 151766 - RNA, 64 nt, Homo Sapiens
uauauauauaaaauaacuuauuuuuuuuauacauaauauauauaccacuugauguaaacaaaac

SEQ ID NO: 151767 - RNA, 64 nt, Homo Sapiens
uauacauauauauauauauaggauaauauauacaaauauauauagaaccauaaguagaaucaca

SEQ ID NO: 151768 - RNA, 64 nt, Homo Sapiens
aauauauauauauacauauauagaaucacaggauaauauauacacgcagcagaggaaccauaag

SEQ ID NO: 151769 - RNA, 64 nt, Homo Sapiens
auacuuuguggaccaauuauugauauauauuauaaauauauauaaagaauauauauauauauau

SEQ ID NO: 151770 - RNA, 64 nt, Homo Sapiens
caauuauugauauauauuauaaauauauauaaagaauauauauauauauauauauauaaaguau

SEQ ID NO: 151771 - RNA, 64 nt, Homo Sapiens
cuugucucuuuggucuuuuauauaaaccacgagaaauauauaggaauuuggaaauucagaaacu

SEQ ID NO: 151772 - RNA, 64 nt, Homo Sapiens
ucuaucauauuuuaccuacauguagaugugcuaaaauauauagaacuuuugcuuuuguguuaaa

SEQ ID NO: 151773 - RNA, 64 nt, Homo Sapiens
uauaugucaaaagguaggaaguaaaaaauauauaaauauauauaaauagugauauccucaaggu

SEQ ID NO: 151774 - RNA, 64 nt, Homo Sapiens
uauauauauauaugucaaaacucaagguguaaaaaauauauaaaacaauuggaauagugauauc

SEQ ID NO: 151775 - RNA, 64 nt, Homo Sapiens
ucucauuugagauuuaagaauguuaauuaauaaaaauauauaaaguauguauucaaaacaagug

SEQ ID NO: 151776 - RNA, 64 nt, Homo Sapiens
uauuuuaucuaguuaccuuuaauguucuuaagcaaauauauaccaaaaaaagaaauauuuuuaa

SEQ ID NO: 151777 - RNA, 64 nt, Homo Sapiens
caguugguuucucuaccucuaucaaauaaaagaaaauauauaccuuagucucuugcuaguugaa

SEQ ID NO: 151778 - RNA, 64 nt, Homo Sapiens
aagauuuucaaauuauuuagcuuuuuuaauauauaauauauaucucucuguuauuuuugugugu

SEQ ID NO: 151779 - RNA, 64 nt, Homo Sapiens
auauaucaagauuuucaaauugugugucuuuuuuaauauauaauucccacuucucuguuauuuu

SEQ ID NO: 151780 - RNA, 64 nt, Homo Sapiens
aagucuaugcaaauaucagagaauuuaugguagaaauauauaagguacugacacuucagauaua

SEQ ID NO: 151781 - RNA, 64 nt, Homo Sapiens
gcccagccuguagcauauuuuaauaggagaauacaauauauaauaguagcaggguuaaguaagg

SEQ ID NO: 151782 - RNA, 64 nt, Homo Sapiens
acauccuauagaaacucacaaauaaugcauaagaaauauauauauaauauauguauguauguau

SEQ ID NO: 151783 - RNA, 64 nt, Homo Sapiens
aacauagcaagaccccaucucuuaaaaaaaaagaaauauauagacauauaucugcauugaaaac

SEQ ID NO: 151784 - RNA, 64 nt, Homo Sapiens
uauuggcuugcacuuugugaguauucuauguaaaaauauauauguauauaaaauauauauugca

SEQ ID NO: 151785 - RNA, 64 nt, Homo Sapiens
ugaguauucuauguaaaaauauauauguauauaaaauauauauugcauaggacagacuuaggag

SEQ ID NO: 151786 - RNA, 64 nt, Homo Sapiens
auuaugugugcauguguguauaagugcacacagaaauauauauacauauguagacuauauacau

SEQ ID NO: 151787 - RNA, 64 nt, Homo Sapiens
uuaagagaaauggcaaguuuugauaugaguauacaauauauaaaaauauauauagugcuauaua

SEQ ID NO: 151788 - RNA, 64 nt, Homo Sapiens
uggcaaguuuugauaugaguauacaauauauaaaaauauauauagugcuauauauauaaauauu

SEQ ID NO: 151789 - RNA, 64 nt, Homo Sapiens
uguguuuuuuuuuuuuucuuuuuccauaggaaagaauauauaaauuuguaaauccuaauucaaa

SEQ ID NO: 151790 - RNA, 64 nt, Homo Sapiens
cgugugagggggcuauguguuuuuuaauuuuuuaaauauauauuuuggugcugugugugguaag

SEQ ID NO: 151791 - RNA, 64 nt, Homo Sapiens
ucuaccauaugugauggaaauauaaauauauauaaauauauauccaaccacaaaagaaauuaua

SEQ ID NO: 151792 - RNA, 64 nt, Homo Sapiens
aauauauaucucuaccauauagaaauuauauauaaauauauauauugggacguccaaccacaaa

SEQ ID NO: 151793 - RNA, 64 nt, Homo Sapiens
auugagaaauaauucugauaagaaaugaaaacuaaauauauauauuguugaccucuuucucugu

SEQ ID NO: 151794 - RNA, 64 nt, Homo Sapiens
uauauacacacacacacacaauuuggggaaugcaaauauauauacuccaaauuguaguuuuuaa

SEQ ID NO: 151795 - RNA, 64 nt, Homo Sapiens
acaggugcuuucaauaguuuuaaaauuauuuuuaaauauauauuuuagcuuuuuaauaaacaaa

SEQ ID NO: 151796 - RNA, 64 nt, Homo Sapiens
uugcacuucaguauuuucacggauaugaauguaaaauauauaaauauauaaaccugcggcuuua

SEQ ID NO: 151797 - RNA, 64 nt, Homo Sapiens
caguauuuucacggauaugaauguaaaauauauaaauauauaaaccugcggcuuuaacaacugu

SEQ ID NO: 151798 - RNA, 64 nt, Homo Sapiens
uaauguauauagcaugauacuauuuuuguuuaaaaauauauaaaauauauaaaugcauaaaaaa

SEQ ID NO: 151799 - RNA, 64 nt, Homo Sapiens
uagcaugauacuauuuuuguuuaaaaauauauaaaauauauaaaugcauaaaaaaauccuggaa

SEQ ID NO: 151800 - RNA, 64 nt, Homo Sapiens
auguuacuuuaaaauuacauucuauauauauauaaauauauauaaauauauauuaaaauaccag

SEQ ID NO: 151801 - RNA, 64 nt, Homo Sapiens
aaaauuacauucuauauauauauaaauauauauaaauauauauuaaaauaccaguuuuuuuucu

SEQ ID NO: 151802 - RNA, 64 nt, Homo Sapiens
guauguuuacucuuauuuucauauaucaucagaaaauauauauucuacgguaacuagaucuaau

SEQ ID NO: 151803 - RNA, 64 nt, Homo Sapiens
aucagaaaauauauauuguacgguaacuagaucuaauauauaucgggaugguuuucugacccua

SEQ ID NO: 151804 - RNA, 64 nt, Homo Sapiens
uauauauuuuauauauacuuauguauguauauauaauauauauagaaaucuggauauauaugua

SEQ ID NO: 151805 - RNA, 64 nt, Homo Sapiens
uauugcuuacaaaaaguaugauuauuuuuaaagaaauauauaugguauguauccucaagaccua

SEQ ID NO: 151806 - RNA, 64 nt, Homo Sapiens
cuuauuuuucuauuuuuuguauuaccuuuuuaaaaauauauaccaguucaaguccuuuuaggaa

SEQ ID NO: 151807 - RNA, 64 nt, Homo Sapiens
uacaaaucuucauuuucauacauaguacaauguaaauauauaacuuuguuaacacuuuuguuag

SEQ ID NO: 151808 - RNA, 64 nt, Homo Sapiens
uaacuaaucacuuucccaucuuuuguuagauuugaauauauacauucuaugaucauugcuuuuu

SEQ ID NO: 151809 - RNA, 64 nt, Homo Sapiens
uuucuuucagagaguuaaguuauuuuauauauauaauauauauauaaaauauauaauauacaau

SEQ ID NO: 151810 - RNA, 64 nt, Homo Sapiens
guuaaguuauuuuauauauauaauauauauauaaaauauauaauauacaauauaaauauauagu

SEQ ID NO: 151811 - RNA, 64 nt, Homo Sapiens
uaauauauauauaaaauauauaauauacaauauaaauauauaguguguguguaugcgugugugu

SEQ ID NO: 151812 - RNA, 64 nt, Homo Sapiens
cagguaaaaaaauaaaauaguuaaaaaguaaagcaauauauacaaagcuuuuucuuuuuccuuu

SEQ ID NO: 151813 - RNA, 64 nt, Homo Sapiens
aagcaauuuggcuggcaucucaaagagaaaauuaaauauauaugccuaccuugcaguagugaag

SEQ ID NO: 151814 - RNA, 64 nt, Homo Sapiens
uccucuuuuugagagcaaaguaguuauccaauggugagacgagacccugacgcucauagaggcc

SEQ ID NO: 151815 - RNA, 64 nt, Homo Sapiens
gauuauuucaggguggggccugaugucugaaguuugagacgagguggcuccugagcugacugac

SEQ ID NO: 151816 - RNA, 64 nt, Homo Sapiens
caugucgaccaaaaggaaugacauauaaauuaaaugagacgagagagaaaaagaaaaauagaag

SEQ ID NO: 151817 - RNA, 64 nt, Homo Sapiens
gcugagcagggugagccucggcuuguggguccccugagacgaagcaagacacacuucuaggcug

SEQ ID NO: 151818 - RNA, 64 nt, Homo Sapiens
auuacugacaaguagaaucaaaggugcagcugacugagacgacaugcauguaagauccacaaaa

SEQ ID NO: 151819 - RNA, 64 nt, Homo Sapiens
ugagaucugaguauaaagaucccauaaaacuuuuugagacgaggaccuuucauuggcgcauuac

SEQ ID NO: 151820 - RNA, 64 nt, Homo Sapiens
ugaagcaauagaauucuaacauaaggccaagaaaugagacgaauguuugggguuuauguuuuuu

SEQ ID NO: 151821 - RNA, 64 nt, Homo Sapiens
uuuuucucaguuuauaaauacguagcacucagguugagacgacuuggauuuuauucuuagaaau

SEQ ID NO: 151822 - RNA, 64 nt, Homo Sapiens
caugaauuggauugaggcuugaggggaaauggugugagacgaaugggcucuggacauaugccug

SEQ ID NO: 151823 - RNA, 64 nt, Homo Sapiens
cuccaaguaguaaucccagaaacuaggagcucuuugagacgagacaggacacuguuuguugugg

SEQ ID NO: 151824 - RNA, 64 nt, Homo Sapiens
uauagagaacagguggcccauaugugcaagucagugagacgaaggacccaucugccuaucgaaa

SEQ ID NO: 151825 - RNA, 64 nt, Homo Sapiens
gcuggauuugggagcucugcuugccgacuggcugugagacgaggcaggggcucugcuuccucag

SEQ ID NO: 151826 - RNA, 64 nt, Homo Sapiens
gaggagagcuauguuuugugcuuuaguuccucugugagacgaaaguuuuguauauauuuuggaa

SEQ ID NO: 151827 - RNA, 64 nt, Homo Sapiens
aagacccugggaagagaugauugggggcgcuucuugagacgaaaucaaagccaaggguggcguu

SEQ ID NO: 151828 - RNA, 58 nt, Homo Sapiens
aucauuaaacguaucuuugucuuuaaaaugagacgaaauguaucguucaauaagguga

SEQ ID NO: 151829 - RNA, 64 nt, Homo Sapiens
uucagauuaggagauauuuuauaguuuccuguccugagacgaaaccugcgaggaagccuaugga

SEQ ID NO: 151830 - RNA, 64 nt, Homo Sapiens
ggcuaccgcggguaugcgagugccagauauuggcugagacgagccagcuuagacuaauugguac

SEQ ID NO: 151831 - RNA, 64 nt, Homo Sapiens
guuggagaugcagccuucaccauggauccuggauugagacgaaugccauuggaaccuguuaaau

SEQ ID NO: 151832 - RNA, 64 nt, Homo Sapiens
ugaguccacacggauagauuuuuccuuguaaccuugagacgagaauuccaaggagugucaccau

SEQ ID NO: 151833 - RNA, 64 nt, Homo Sapiens
ucacucugucaccagguugguuuuuauaucuuuaugagacgaucauuuuuauuuuauuuuuaau

SEQ ID NO: 151834 - RNA, 64 nt, Homo Sapiens
gauuuguggaggaugagaaagaugaagaagacaaugagacgagaacacuucuaaggcgagccac

SEQ ID NO: 151835 - RNA, 64 nt, Homo Sapiens
acugccuuggugaaggcaagggaggguucaacucugagacgagagggcuguugggggcccucag

SEQ ID NO: 151836 - RNA, 64 nt, Homo Sapiens
aguuaucuucuacauucuagaaauguagucuggcugagacgaugauacaucaucggguauuaga

SEQ ID NO: 151837 - RNA, 64 nt, Homo Sapiens
ucgcgccacugcacuccagcgguggaggcugcagugagacgagaaauugcgugaacccgggccc

SEQ ID NO: 151838 - RNA, 64 nt, Homo Sapiens
ucuuaauauucuaugugcuauuucaccagauuucugagacgaugcaacaagcucaugacugaaa

SEQ ID NO: 151839 - RNA, 64 nt, Homo Sapiens
ccacugcgccacgcucgcccacggaggaggacagugagacgaugcucgaugaugcggcccugca

SEQ ID NO: 151840 - RNA, 64 nt, Homo Sapiens
gggagguggagcuugcagugagcagagcuugcagugagacgagcuugugccacugcacuccagc

SEQ ID NO: 151841 - RNA, 64 nt, Homo Sapiens
ugcuuauacugauagugaaaaacuuggaugugugugagacgaguuaccgccuucuucauuggau

SEQ ID NO: 151842 - RNA, 64 nt, Homo Sapiens
ucuuaaugauauuuaaguaguuuuuuuuuuuuuuugagacgaaguuuugcucuuguugcccagg

SEQ ID NO: 151843 - RNA, 64 nt, Homo Sapiens
caagugccugauuaauugagguggcaacauaguuugagacgagggcagagaacaggaagauaca

SEQ ID NO: 151844 - RNA, 64 nt, Homo Sapiens
gagagaagccuccgcuccuuaggauuuguuucuaugagacgagaagaauuugaugaguauuuuc

SEQ ID NO: 151845 - RNA, 64 nt, Homo Sapiens
uuggagacugggauuagagcaagagaacaucccuugagacgaauguuuaaaccggccccacaug

SEQ ID NO: 151846 - RNA, 64 nt, Homo Sapiens
aaaagggaaaggaaaaaaugcacuggaugagcggugagacgaacagugugccucucuggccgcc

SEQ ID NO: 151847 - RNA, 64 nt, Homo Sapiens
gucucuuugacuguaagacagggcucuguaucagugagacgaugagaaaagucccaggcuaaug

SEQ ID NO: 151848 - RNA, 64 nt, Homo Sapiens
guucagugaauagaaagguauccaaggugaagccugagacgaauggcuuucccaggcuaccuuc

SEQ ID NO: 151849 - RNA, 64 nt, Homo Sapiens
caggaagagcuaaaacauggaggaauggcagaucugagacgaucggccacagguucauauccag

SEQ ID NO: 151850 - RNA, 64 nt, Homo Sapiens
cuuacuugaugauuuuuaacuuuuuauuucuaaaugagacgaaaugcugauguauccuuucauu

SEQ ID NO: 151851 - RNA, 64 nt, Homo Sapiens
gcugaggcaggcggaucacuugaggucagcaguuugagacgagccuggccaacauggugaaacc

SEQ ID NO: 151852 - RNA, 64 nt, Homo Sapiens
gaaauuaacagcagggaaaugccaucuuauuaccugagacgaccagcacugggaguuagguacg

SEQ ID NO: 151853 - RNA, 64 nt, Homo Sapiens
ugggguuuccacugugugucucuucgguuugccaugagacgaugcugagcuucccacaucccgu

SEQ ID NO: 151854 - RNA, 64 nt, Homo Sapiens
cuggccaacauggugaaaccugaggucagaaauuugagacgagcgcugaggcggguggaucacu

SEQ ID NO: 151855 - RNA, 64 nt, Homo Sapiens
cucccugacagccgagacugcuaccacugggcacugagacgaagacgacucuggaagcuucccu

SEQ ID NO: 151856 - RNA, 64 nt, Homo Sapiens
cggguucccaaggcccuggucugagauugggcucugagacgagacccugggggcuucuggcucc

SEQ ID NO: 151857 - RNA, 64 nt, Homo Sapiens
auauauucacaaugguaauaagguaggaggaaucugagacgauugcauugucuaaacaguggaa

SEQ ID NO: 151858 - RNA, 64 nt, Homo Sapiens
uggaagucucguuaagaucaucuggagccccugcugagacgauuccugccgccugcuggggaag

SEQ ID NO: 151859 - RNA, 64 nt, Homo Sapiens
uuagguuaugaugcgccuccuucugugcgaccaaugagacgacuucagcaucuuuuuaaaauaa

SEQ ID NO: 151860 - RNA, 64 nt, Homo Sapiens
agcuguagaucuguucuuagaucucuugaauuagugagacgacaguucccuuaggcaguuugug

SEQ ID NO: 151861 - RNA, 64 nt, Homo Sapiens
uugugccacugcacucuagcggcggagguugcagugagacgagaagaaucgcuugaacccagga

SEQ ID NO: 151862 - RNA, 64 nt, Homo Sapiens
acaacuuuuaaaaauuguuuuaauauuuugaaucugagacgaauaagauaaaucaccuguguga

SEQ ID NO: 151863 - RNA, 64 nt, Homo Sapiens
cucauuuucauuuccauuaaccaucucucucugaugagacgaauuccccaacgguugccuggca

SEQ ID NO: 151864 - RNA, 64 nt, Homo Sapiens
acaacacauguccauucagcccucugaauggaucugagacgaagaccuuuuuaaagauaugucu

SEQ ID NO: 151865 - RNA, 64 nt, Homo Sapiens
ccaagucuuaacuccuggucucguaagguuccacugagacgagaugucugagaacaaccaaaga

SEQ ID NO: 151866 - RNA, 51 nt, Homo Sapiens
cuugauuggaagagaaugccaugagacgagacccaggugucuuuaacguag

SEQ ID NO: 151867 - RNA, 64 nt, Homo Sapiens
ggcgggcagcauaagagaaugugaagcccuucagugagacgagacgagcaaugggaaaccuuuu

SEQ ID NO: 151868 - RNA, 64 nt, Homo Sapiens
cuaccaauaaaccaaacugcauguggcacgcugcugagacgacagcagcccgcagaugguggcc

SEQ ID NO: 151869 - RNA, 64 nt, Homo Sapiens
agggcucuggucccgucacucaggcaggcugcccugagacgaggugugaucuccaccuugaagc

SEQ ID NO: 151870 - RNA, 64 nt, Homo Sapiens
ucucacugucacccaggcuguuuguuuuuguuuuugagacgaggggggagcaugguuuuuuugu

SEQ ID NO: 151871 - RNA, 64 nt, Homo Sapiens
gugcuguagcuucccuugcagcugcuguuuauucugagacgacucgaauacaucugcuuuccag

SEQ ID NO: 151872 - RNA, 64 nt, Homo Sapiens
agaugagggaaguuuuagucuuggcggguggaaaugagacgaagccacaguuaucacacuccag

SEQ ID NO: 151873 - RNA, 64 nt, Homo Sapiens
ugguguuucagaugggcaguguuauggcuacgugauauuugaagggaaggauaaguguugcuuu

SEQ ID NO: 151874 - RNA, 64 nt, Homo Sapiens
aaguagcauaaaucaguauuuaaccuaaaauuacauauuugaaacagaagauauuauguuaugc

SEQ ID NO: 151875 - RNA, 64 nt, Homo Sapiens
gcaauuaaucacuaaugaauuaugcgaaagcaacauauuugauaaccguugcaguaaaucauga

SEQ ID NO: 151876 - RNA, 64 nt, Homo Sapiens
cuauacuuuggggaucauuugccuaccauggcauauauuugaaauugcuuuggacaaguuuucu

SEQ ID NO: 151877 - RNA, 64 nt, Homo Sapiens
gugauaggccugucuucugggcaauauuucuaaaauauuugagugacauugauguuuaagugac

SEQ ID NO: 151878 - RNA, 64 nt, Homo Sapiens
cauucauuaaacuacuuuggaagcgucaguggauauauuugaaagugguaauccugaaucucuu

SEQ ID NO: 151879 - RNA, 64 nt, Homo Sapiens
caaaauuaagcaugaaaaaaauguuuccauugccauauuugauucacuaguggaagauaguguu

SEQ ID NO: 151880 - RNA, 64 nt, Homo Sapiens
uacguguuuuggaaaauagaguaauuuaaaaaauauauuugaaaugaaaaucuccaacacauua

SEQ ID NO: 151881 - RNA, 64 nt, Homo Sapiens
cauaacgugcgugaauuaacagcuucucuauuugauauuugaaauucuucuguaagccugucug

SEQ ID NO: 151882 - RNA, 64 nt, Homo Sapiens
auuuugugauuuuauugcuuauaacagagaacucauauuugacauauuuuuuucauugaugugu

SEQ ID NO: 151883 - RNA, 64 nt, Homo Sapiens
aguuuacaaucuaagaguuacuuuuauuucagagauauuugauucuuaauuuaaauuuaauaaa

SEQ ID NO: 151884 - RNA, 64 nt, Homo Sapiens
uauaacuuccacuuaauuuagauuucagaaaacaauauuugaugcauacuguacaccagauuuu

SEQ ID NO: 151885 - RNA, 64 nt, Homo Sapiens
gugugcaugugugcaugacuugguuuuuguuuucauauuugagucuaagauuuccuuggguauc

SEQ ID NO: 151886 - RNA, 64 nt, Homo Sapiens
guuuguguagguauuugaggauauaauuuaguagauauuugacagugaccaguuugccaugugg

SEQ ID NO: 151887 - RNA, 64 nt, Homo Sapiens
caguucauaccagcuugcuauuaguccaaauuuaauauuugacaauuauuuuugacuaugaaca

SEQ ID NO: 151888 - RNA, 64 nt, Homo Sapiens
cacacauucacauauaaauuuauaaacgugaaauauauuugacaaugcauauauguguauaugu

SEQ ID NO: 151889 - RNA, 64 nt, Homo Sapiens
gaccucaauggaauaaauuuuacucucccuauuaauauuugaagcuuaauguacuacuuacugg

SEQ ID NO: 151890 - RNA, 64 nt, Homo Sapiens
uagaguauuuuggacaaaugguugaccuuuuguaauauuugauuaaggaggccuauucuuuuca

SEQ ID NO: 151891 - RNA, 64 nt, Homo Sapiens
ugcacauuuuugugauuuuuaaauuucuggcauaauauuugaagugaacaugaauauuuggaca

SEQ ID NO: 151892 - RNA, 64 nt, Homo Sapiens
auaggggauuuuuuugauguaagguguaggucagauauuugagauguccaaugguaggaauuuc

SEQ ID NO: 151893 - RNA, 64 nt, Homo Sapiens
aguaggauauuggcauuugucagauagaaugucaauauuugagcugauaaugagcagccccucc

SEQ ID NO: 151894 - RNA, 64 nt, Homo Sapiens
uaguauacauugucuugauggauuauguauggauauauuugaaacauguacuacagcuauauuu

SEQ ID NO: 151895 - RNA, 64 nt, Homo Sapiens
auguauggauauauuugaaacauguacuacagcuauauuugauuguaaucuacaccaaugaaaa

SEQ ID NO: 151896 - RNA, 64 nt, Homo Sapiens
acuuaaaacuuuuaaaacuuuauauuugaugcaaauauuugaucaguucuuuauuggguggaau

SEQ ID NO: 151897 - RNA, 64 nt, Homo Sapiens
caaauauuugaucacuuaaauauuggguggaauuauauuugaugcauuuaaauacaaaguucuu

SEQ ID NO: 151898 - RNA, 64 nt, Homo Sapiens
ucauuugaauauauucaguaguguuauugcagugauauuugaacugagauuuauaaccacuuga

SEQ ID NO: 151899 - RNA, 64 nt, Homo Sapiens
ggaaaagaacucucugguauaguugauuuuuaauauauuugauuuuauuuauaacccucaagcc

SEQ ID NO: 151900 - RNA, 64 nt, Homo Sapiens
aaauauaguuucuggcacuauauaccuuuucaauauauuugaacuuaauaucuauuuguauucu

SEQ ID NO: 151901 - RNA, 64 nt, Homo Sapiens
ugaguuucuaucacuaauuuaacccacaaaaaagauauuugaucauuuguuaacuucuaccucc

SEQ ID NO: 151902 - RNA, 64 nt, Homo Sapiens
agaagaaacuuuaucuuuuaauuaugugcucuuaauauuugaagaugagaguuaauaccugaga

SEQ ID NO: 151903 - RNA, 64 nt, Homo Sapiens
ccuuuguaagcuguggaacccaaacuguauggggauauuugauguuuucagaaagaggaagaaa

SEQ ID NO: 151904 - RNA, 64 nt, Homo Sapiens
ugauucuuguuagaggguuuuuguucuggaagccauauuugauaguauacuuugucuucacugg

SEQ ID NO: 151905 - RNA, 64 nt, Homo Sapiens
gccaguaaauaaaagugcuaugacuugagcuaagauauuugacuccaaugccuguacugugucu

SEQ ID NO: 151906 - RNA, 64 nt, Homo Sapiens
ccaggagaucuggggguugcaccagggaaucgccauauuugaccagcauguuuuaaaagcucuu

SEQ ID NO: 151907 - RNA, 64 nt, Homo Sapiens
cacgccugcccuagaaacaguuuuuuaauaggagauauuugagaggcauugagguaggagacuc

SEQ ID NO: 151908 - RNA, 64 nt, Homo Sapiens
cagcaguggagaguguuccuguugaaucuugcacauauuugaauguguaagcauuguauacauu

SEQ ID NO: 151909 - RNA, 64 nt, Homo Sapiens
ggagaaguagcugugaacauugucuggauaccagauauuugaaucuuucuuacuauugguaaua

SEQ ID NO: 151910 - RNA, 64 nt, Homo Sapiens
uaaaaacauauauuaauagaaagcauuucuggaaauauuugauucuagauuuaaagggacuugu

SEQ ID NO: 151911 - RNA, 64 nt, Homo Sapiens
cucagagacaguaucaugagauggcuuuaacugaauauuugaucauauuauuugguagucuagu

SEQ ID NO: 151912 - RNA, 64 nt, Homo Sapiens
aaaaucccuuguucuuuuggauaucauccaagaaauauuugaguuguuuuuccuaaaaaguacu

SEQ ID NO: 151913 - RNA, 64 nt, Homo Sapiens
auuggucuuucuuggacguguuauuuaaaaaacuauauuugaacauuaucuguuaauguagauu

SEQ ID NO: 151914 - RNA, 64 nt, Homo Sapiens
ucucuacauguuuuuuucuuuccguugcugaaaaauauuugaaacuuguggucucugaagcucg

SEQ ID NO: 151915 - RNA, 64 nt, Homo Sapiens
uuaguauuaaugcguuggcccacguagcaaaaagauauuugauuaucuuaaaaauuguuaaaua

SEQ ID NO: 151916 - RNA, 64 nt, Homo Sapiens
ucaguauuguaacagcaacuugucaaaccuaagcauauuugaauaugaucucccauaauuugaa

SEQ ID NO: 151917 - RNA, 64 nt, Homo Sapiens
uauugaauucucuuagcuuguguguguuucuuuaauauuugaacucaagugggauuagaagacu

SEQ ID NO: 151918 - RNA, 64 nt, Homo Sapiens
uuagaagacuaucaaaauacauguauguuucaggauauuugaccugucauuaaaaaaaacaaac

SEQ ID NO: 151919 - RNA, 64 nt, Homo Sapiens
uguuuuuauaggagauguauaaaaaaaaaaaaagauauuugaagggauaauuuagaaacaaacc

SEQ ID NO: 151920 - RNA, 64 nt, Homo Sapiens
gaauaggagaaaacaauauauggauuuugugauuauauuugagucuuuauucucuccuguauau

SEQ ID NO: 151921 - RNA, 64 nt, Homo Sapiens
guguuugucuagcauguuuguuuaauccuuugaaauauuugaaacaucaauuucuauuuucuga

SEQ ID NO: 151922 - RNA, 64 nt, Homo Sapiens
gaauuauaucauuauguuccuaaggaguaaauauauauuugaccuguaaguguguguauguaua

SEQ ID NO: 151923 - RNA, 64 nt, Homo Sapiens
gaccaaacacuggcguaaguucaauuuacacagaauauuugaauugaaacaauagaaauuuuuc

SEQ ID NO: 151924 - RNA, 64 nt, Homo Sapiens
aaaaauugguugaaacuaugaucuacuaucuuggauauuugaaacugauuuuuuaagaauuagu

SEQ ID NO: 151925 - RNA, 64 nt, Homo Sapiens
ugguguucugagccauaguuuuuuagcgagagucauauuugagaaaacuaugacuguaugauua

SEQ ID NO: 151926 - RNA, 64 nt, Homo Sapiens
aggaaaaaaaaaaaaggaugugucauuggucaugauauuugaaaaggggaggaggccgaaguug

SEQ ID NO: 151927 - RNA, 64 nt, Homo Sapiens
gccgaaguuguucccauuuauccaguauuggaaaauauuugacccccuuggcugaauucuuuug

SEQ ID NO: 151928 - RNA, 64 nt, Homo Sapiens
caggauuagagcauguaaagguacaucuagauucauauuugaaucuuaaacuguauuuuucucu

SEQ ID NO: 151929 - RNA, 64 nt, Homo Sapiens
gcuucucugccaaaagcaaugucuuucuugguugauauuugaguuuuaaaagggucaaaucuuu

SEQ ID NO: 151930 - RNA, 64 nt, Homo Sapiens
uuaaaucaaauagaugauucuauaugccaaaaauauauuugaugauucucauuguaaaaauaau

SEQ ID NO: 151931 - RNA, 64 nt, Homo Sapiens
ugguugaauaauuaauaauuuuggcugaaugaguauauuugaauaagaggcuuauuuuguucuu

SEQ ID NO: 151932 - RNA, 64 nt, Homo Sapiens
uuuauuuggacaguaauacuagcaaaguugguagauauuugauucuucauuuuuuguuuuuuuc

SEQ ID NO: 151933 - RNA, 64 nt, Homo Sapiens
auuuguaaauugugaugucauugagacuauauuuauauuugacuuggcaacauuaacauguccu

SEQ ID NO: 151934 - RNA, 64 nt, Homo Sapiens
auaaaccuuaaaugaaaaaaaugaucuauugcagauauuugauguaguuuucuuuuuuaaauua

SEQ ID NO: 151935 - RNA, 64 nt, Homo Sapiens
auccagugcuuccacagagauuagccuguagcuuauauuugacauucuucacugucuguuguuu

SEQ ID NO: 151936 - RNA, 64 nt, Homo Sapiens
ugguugggagaaucacagcuuuacaaggguguuuauauuugauuuguguuuauauuugaggcag

SEQ ID NO: 151937 - RNA, 64 nt, Homo Sapiens
gcuuuacaaggguguuuauauuugauuuguguuuauauuugaggcagguauuguaauauaaagg

SEQ ID NO: 151938 - RNA, 64 nt, Homo Sapiens
uguguucaaaaauacauaggcuuuauauagaguaauauuugagcugaaaaagcugaauacaagu

SEQ ID NO: 151939 - RNA, 64 nt, Homo Sapiens
uuaggagaguguuuaaauaauuucuccuaacuaaauauuugauuauaugcuuugaccuacuaac

SEQ ID NO: 151940 - RNA, 64 nt, Homo Sapiens
aacugucaggcuuuuauuuaugaauuuguacuguauauuugaguuuuuaaaagauuuuguuuug

SEQ ID NO: 151941 - RNA, 64 nt, Homo Sapiens
auuggccuucauuucucgauauugaagagauccaauauuugaaggcucauaucugccggcagca

SEQ ID NO: 151942 - RNA, 64 nt, Homo Sapiens
ucugcuauuaugccuucuuuaauuauacuucaaaauauuugacauaauuuuaauccuucccuau

SEQ ID NO: 151943 - RNA, 64 nt, Homo Sapiens
uuugagaucugaugagaauguguguaaaaucuagauauuugaaguuuuaauuauuacaaaucua

SEQ ID NO: 151944 - RNA, 64 nt, Homo Sapiens
uacuguauuuauaauuuauuuaaugcuuaaaacaauauuugaacuuuaacuuguuuagaaaaac

SEQ ID NO: 151945 - RNA, 64 nt, Homo Sapiens
uuaaaagcacuuuauuuaaacuuuagggcaacauauauuugaauuuaaaguauauuucaguuuu

SEQ ID NO: 151946 - RNA, 64 nt, Homo Sapiens
acaauauccuuacacauuugauauuugaaucacaauauuugauguacagucauuuugacaaucg

SEQ ID NO: 151947 - RNA, 64 nt, Homo Sapiens
cacaauauuugaugacaauacauuuugacaaucgauauuugaaucaacuuugauaugguacagu

SEQ ID NO: 151948 - RNA, 64 nt, Homo Sapiens
augagacugaucauuccgcucagggcugugcugaauauuugauauauguccaccauuaucucau

SEQ ID NO: 151949 - RNA, 64 nt, Homo Sapiens
caggcugguaauucggguaauuuuagcuagcaacauauuugaauuaugugcuugcuuauuaguu

SEQ ID NO: 151950 - RNA, 64 nt, Homo Sapiens
aaucuagaaaaugcauucauucuucgaaauguuaauauuugauacaguucauccccaacccuag

SEQ ID NO: 151951 - RNA, 64 nt, Homo Sapiens
guuuccaaaauucagauucucuuguggccaaaagauauuugaccuuuucaucucuuuaaccaaa

SEQ ID NO: 151952 - RNA, 64 nt, Homo Sapiens
gugccuuguuuuauccauuuuauaaauagaguagauauuugauauaccacucugauaacucaua

SEQ ID NO: 151953 - RNA, 64 nt, Homo Sapiens
cucaauuuuacaaaauuacuaauugcucuagugcauauuugaacuacaagcaacuuuuuaggaa

SEQ ID NO: 151954 - RNA, 64 nt, Homo Sapiens
guauauaaaaaugagaugauaguguugucuauaaauauuugaagauuauggaaugugaaauauc

SEQ ID NO: 151955 - RNA, 64 nt, Homo Sapiens
guuaacuuuuggaugauaggaugaaugagcaaacauauuugaaauaugaagggcauguauaugu

SEQ ID NO: 151956 - RNA, 64 nt, Homo Sapiens
uuuuuauuuaucucuagaaguuugaaauucaguaauauuugacauauuugaaauuacugucaua

SEQ ID NO: 151957 - RNA, 64 nt, Homo Sapiens
uucaguaauauuugacauuuuugaaauuacugucauauuugaaauuguaauuuuucaguaguau

SEQ ID NO: 151958 - RNA, 64 nt, Homo Sapiens
uaguaguuuauccauucaccugagaguaguauacauauuugaugagaugaaaguuguuuauauu

SEQ ID NO: 151959 - RNA, 64 nt, Homo Sapiens
guaguauacauauuugaugugaugaaaguuguuuauauuugagauaccaccauguaucuaacca

SEQ ID NO: 151960 - RNA, 64 nt, Homo Sapiens
gcuuuuucuuaauaaguauaggugaaaaugaugaauauuugagucucaugaaggcaugaaaugu

SEQ ID NO: 151961 - RNA, 64 nt, Homo Sapiens
uuugauaagccaaaaaugugcagcacaguaaaauauauuugaaacagcauuagaauauauuguu

SEQ ID NO: 151962 - RNA, 64 nt, Homo Sapiens
ucaucugucucuuuguaaaugugacugccaaauaauauuugaaguuauguuucuacauaguaag

SEQ ID NO: 151963 - RNA, 64 nt, Homo Sapiens
cauacauauuaccauacugaagggaaauggauuuauauuugaauuugauauuugaauauuugaa

SEQ ID NO: 151964 - RNA, 64 nt, Homo Sapiens
auacugaagggaaauggauuuauauuugaauuugauauuugaauauuugaaguucucuauuuau

SEQ ID NO: 151965 - RNA, 64 nt, Homo Sapiens
gggaaauggauuuauauuugaauuugauauuugaauauuugaaguucucuauuuauauuucauu

SEQ ID NO: 151966 - RNA, 64 nt, Homo Sapiens
cauuauucccauccauuguaaaguuccuuaagucauauuugacugggcgugcagaauaacuucu

SEQ ID NO: 151967 - RNA, 64 nt, Homo Sapiens
uuuccaggugcaugugaaucccgaaggacugaugauauuugaauguuuauuaaauuauuaucau

SEQ ID NO: 151968 - RNA, 64 nt, Homo Sapiens
aguuaagcuuaaaaauaaguuuuaucuuaaaaucauauuugaagacaguaagacaguaaacuau

SEQ ID NO: 151969 - RNA, 64 nt, Homo Sapiens
aagcccuugucuaaaauaaaaggcauuauuggaaauauuugaaaacuagaaaaugauggauaaa

SEQ ID NO: 151970 - RNA, 64 nt, Homo Sapiens
ucauuaguuguuaauuuuuuauuuauuauuuuaaauauuugaccuaagaauuaaauuauuagua

SEQ ID NO: 151971 - RNA, 64 nt, Homo Sapiens
uauuuaauacacuucuaauuuuuagagcaauucuauauuugaguaagguaauuuuuuuuagcaa

SEQ ID NO: 151972 - RNA, 64 nt, Homo Sapiens
auauuuaacauuuuccaauuuauuauaaaauguuauauuugaggauuuuugcuguugcuguuuu

SEQ ID NO: 151973 - RNA, 64 nt, Homo Sapiens
guauguuguuugaaaaacuucaagacuugugaauauauuugaauacuuguugccuuaguacuau

SEQ ID NO: 151974 - RNA, 64 nt, Homo Sapiens; identical to SEQ ID NO: 151966

SEQ ID NO: 151975 - RNA, 64 nt, Homo Sapiens
uuuccaggugcaugugaaucccgaaggacugaugauauuugaauguuuauuaaauuauuaucac

SEQ ID NO: 151976 - RNA, 62 nt, Homo Sapiens
aucacugaccuggugguggggcugugaccugggcagcucaagacuggugccccuugcugauc

SEQ ID NO: 151977 - RNA, 62 nt, Homo Sapiens
cuaauuagaccccuccccuugugucaacuccggcagcucaagacccccgagcaacauuugua

SEQ ID NO: 151978 - RNA, 62 nt, Homo Sapiens
gcaggugaccccauccccagccaugcucuccugcagcucaggucaccugguguucagacacc

SEQ ID NO: 151979 - RNA, 62 nt, Homo Sapiens
gagacccuaaguuaaggggcaggucuuucugugcagcucagggccuggucccaguagguauc

SEQ ID NO: 151980 - RNA, 62 nt, Homo Sapiens
aggauucuauccuuuccaauaccgggacuggggcagcucacuauaugcaggcacucaugcuu

SEQ ID NO: 151981 - RNA, 62 nt, Homo Sapiens
ggcugggggugaggagucccccuuaaucugcagcagcucacacuagcccaucuucaaugacc

SEQ ID NO: 151982 - RNA, 62 nt, Homo Sapiens
cauagccucuguccucaggacggaacuugggugcagcucagugggucggaagagaaggcggu

SEQ ID NO: 151983 - RNA, 62 nt, Homo Sapiens
gucugucuuugagaugcccaggccagcagaaagcagcucagaaguauuguugcucauggugu

SEQ ID NO: 151984 - RNA, 62 nt, Homo Sapiens
gggcaaacccuggcucggagcccagggcagaggcagcucagaguggaggcucuaggcagguu

SEQ ID NO: 151985 - RNA, 62 nt, Homo Sapiens
caucagcacaggggucccugccccacccuccggcagcucagggaguguuuuccugugaggcc

SEQ ID NO: 151986 - RNA, 62 nt, Homo Sapiens
gagacccaagugaagaucugcgcugcaucccugcagcucaaccgcgcccgcaggguggagau

SEQ ID NO: 151987 - RNA, 62 nt, Homo Sapiens
gaacuggagaaggaguuccacuucacuaccaagcagcucacgcccaacgcggugcgcaccaa

SEQ ID NO: 151988 - RNA, 62 nt, Homo Sapiens
aaagagaaaagaggcucagaaaaguuuagagagcagcucagugucacacugggagcugggca

SEQ ID NO: 151989 - RNA, 62 nt, Homo Sapiens
uugaggagaagagacuuacccaggcucacacagcagcucagccuguuccaggcgcuggucag

SEQ ID NO: 151990 - RNA, 62 nt, Homo Sapiens
gccgucauggaaaugaugagucagaagauucagcagcucacagcccugggggcagcucaggc

SEQ ID NO: 151991 - RNA, 62 nt, Homo Sapiens
gucagaagauucagcagcucacagcccugggggcagcucaggcuacugcuaaggccugagag

SEQ ID NO: 151992 - RNA, 62 nt, Homo Sapiens
gccccacggacagucagccugccggccucccugcagcucacggggcagaaccagcacaucug

SEQ ID NO: 151993 - RNA, 62 nt, Homo Sapiens
cacuuuauuccuaaaacgugucuuauuuuuaugcagcucauuuuuucuuuaaaggagaaaac

SEQ ID NO: 151994 - RNA, 62 nt, Homo Sapiens
ccggcuggccuggccccucagggucccugguggcagcucaccucucccuuggauuguccccg

SEQ ID NO: 151995 - RNA, 62 nt, Homo Sapiens
gcucagggccuggcucagguggggucacucuggcagcucagagagggugggagugggcccaa

SEQ ID NO: 151996 - RNA, 62 nt, Homo Sapiens
ugcaagaaguacugccaauacugccaaccagagcagcucacucgagaucuuuguguccagag

SEQ ID NO: 151997 - RNA, 62 nt, Homo Sapiens
uucugccuuggccucccaaagugcugaauuaagcagcucaccauccacacggcugaccucau

SEQ ID NO: 151998 - RNA, 62 nt, Homo Sapiens
gacuuacaugagugaaaggguugccucaucaagcagcucaguguaaauggggaggcuaggcu

SEQ ID NO: 151999 - RNA, 62 nt, Homo Sapiens
uucaucaaauggagugguuuaaaacugaucaagcagcucauaauaaugaauuccugcucugu

SEQ ID NO: 152000 - RNA, 62 nt, Homo Sapiens
gugguccugaagacuccggccaagaggcacaagcagcucaagaacaagcuggagaagaacga

SEQ ID NO: 152001 - RNA, 62 nt, Homo Sapiens
aguccacucccuuccuggcugugucaccccgagcagcucauccaccauggaggucauuggcc

SEQ ID NO: 152002 - RNA, 62 nt, Homo Sapiens
gaauacauggaaaagagcaagcaucugcaggagcagcucaaugaacucaagacagaaaucga

SEQ ID NO: 152003 - RNA, 62 nt, Homo Sapiens
ucuggcaauuccaucugguuuugagaaacuuagcagcucacagagcacagagauccugccuu

SEQ ID NO: 152004 - RNA, 62 nt, Homo Sapiens
ccacacugccggacccuaggcuguucagggaggcagcucauuuccaccccggccccaggaca

SEQ ID NO: 152005 - RNA, 62 nt, Homo Sapiens
cucccccugccucccugccuguguccgcuuuugcagcucaaugcagccaugacaaggaaaga

SEQ ID NO: 152006 - RNA, 64 nt, Homo Sapiens
cuuaauuuuaaggaauuucaaugaaccaaaagauaacugucaauuuauuuggauggauggaugg

SEQ ID NO: 152007 - RNA, 64 nt, Homo Sapiens
agaggcaaggcagaaauggaugaugaacaucaaaaacugucagaggacaggucugugccaggua

SEQ ID NO: 152008 - RNA, 64 nt, Homo Sapiens
uaaaaacauacaucuuuacaucuaccugugguauaacugucaggcacucuucucaacuugacag

SEQ ID NO: 152009 - RNA, 64 nt, Homo Sapiens
ugaaggacucuucuagaagcagaccauggacaacaacugucaucauucugcucuugauagucaa

SEQ ID NO: 152010 - RNA, 64 nt, Homo Sapiens
uucuaaaucugggauuuaaauaccaacaguccuaaacugucauuagaggacuuucugugauuca

SEQ ID NO: 152011 - RNA, 64 nt, Homo Sapiens
augaugaauggcccuuucaauuucuagaaucuggaacugucaccuauaaagaaauacuauaaua

SEQ ID NO: 152012 - RNA, 64 nt, Homo Sapiens
aaacuuggauaaaugggucaagcaguuuagagcaaacugucacucauauuauuguuuuuaaaaa

SEQ ID NO: 152013 - RNA, 64 nt, Homo Sapiens
auccugaaauccaaaauugcccuguuucuaacacaacugucauacucagacauagcccagguag

SEQ ID NO: 152014 - RNA, 64 nt, Homo Sapiens
uuacaucuaaaagaucucugguuggauggaaaucaacugucagaauuaccucagguaaguggua

SEQ ID NO: 152015 - RNA, 64 nt, Homo Sapiens
gaaacgauuccggauggcauuggaaaacuaaagaaacugucaaucuugaagguggaucagaaua

SEQ ID NO: 152016 - RNA, 64 nt, Homo Sapiens
cacaacuuggcuacacauagacucugcaaggcuaaacugucauuuguaauuggagaagaaggaa

SEQ ID NO: 152017 - RNA, 64 nt, Homo Sapiens
uuagcuacugaauccuggggcaaaaggacauggaaacugucacggccagccagcgagcucuagg

SEQ ID NO: 152018 - RNA, 64 nt, Homo Sapiens
aagguuuaugguauaaaugaagguggaaaauaggaacugucaagcuaaagcuuuuuuuaaaaaa

SEQ ID NO: 152019 - RNA, 64 nt, Homo Sapiens
ucuauugaaaauggauauaguucagucauuucuuaacugucacaaacauuuauaauaauauaau

SEQ ID NO: 152020 - RNA, 64 nt, Homo Sapiens
guuuaacccaaauaucugaaugauuaaaccagaaaacugucaucauagcucuuugcaagugccu

SEQ ID NO: 152021 - RNA, 64 nt, Homo Sapiens
cuuggguucuuguuauagaaugacuuugugaucaaacugucagguguaguccugauguuauaag

SEQ ID NO: 152022 - RNA, 64 nt, Homo Sapiens
guuucuuccaaaagucacaaaaccuuuuguugucaacugucacuuagaaugaggucugcuucag

SEQ ID NO: 152023 - RNA, 64 nt, Homo Sapiens
ucuuuuuccuuaaaacauauuauccagugcaaucaacugucauuuauauauauaaauauaugua

SEQ ID NO: 152024 - RNA, 64 nt, Homo Sapiens
aucuuugcagcagaaggucaccaucuuugcaccaaacugucaccauccaucuacccaacuguca

SEQ ID NO: 152025 - RNA, 64 nt, Homo Sapiens
aucuuugcaccaaacugucaccauccaucuacccaacugucacccuagguccccagcucuaauu

SEQ ID NO: 152026 - RNA, 64 nt, Homo Sapiens
uuuauugagaugggaaaaauuguuaccaaaaaacaacugucaguauuuuuaauuugaucagaac

SEQ ID NO: 152027 - RNA, 64 nt, Homo Sapiens
cauguuugauuuuagcguuuggaacgggucccggaacugucagaagcguggcccgaggggcugu

SEQ ID NO: 152028 - RNA, 64 nt, Homo Sapiens
uugcacuggucgguauaugggauaccuuaauuguaacugucagucuuaauuuucaaccuuucug

SEQ ID NO: 152029 - RNA, 64 nt, Homo Sapiens
uauuugagauggaaauaagaucauuuaauucuuaaacugucauuugcuuaauuuuuuuaaauug

SEQ ID NO: 152030 - RNA, 64 nt, Homo Sapiens
guuguugcccagagccauggggguggauguuauuaacugucauuauuuuagaaacagucuuugu

SEQ ID NO: 152031 - RNA, 64 nt, Homo Sapiens
aacaacuugaagaaaggagcaaaaagacccagccaacugucauugggaagcugugaaaacccuc

SEQ ID NO: 152032 - RNA, 64 nt, Homo Sapiens
uaugaagcugcuggggaagcguuggggugaagaaaacugucaaagugaaguaauugcagaagca

SEQ ID NO: 152033 - RNA, 61 nt, Homo Sapiens
cgccuaggacagggucaaucgaggaaugccagaugugcacgguuuuuggcaaaguaggggg

SEQ ID NO: 152034 - RNA, 61 nt, Homo Sapiens
gccaucgaucgcagauuucuguagaaacacggaugugcaugugcagauucccuuuugcagg

SEQ ID NO: 152035 - RNA, 61 nt, Homo Sapiens
ugagaaaacuagaggacugaaucaaguagcugaugugcaguaacacauauucauaaaaaaa

SEQ ID NO: 152036 - RNA, 61 nt, Homo Sapiens
gggcauaaaagcaaaucaacucuaccugcaagaugugcagauucccucagcugacuggugu

SEQ ID NO: 152037 - RNA, 61 nt, Homo Sapiens
guguguguguguggugugucuguuuguguaugaugugcaguaguggugggugguggggugg

SEQ ID NO: 152038 - RNA, 61 nt, Homo Sapiens
aaguuuuuaugcaauaagccuuggaccucuggaugugcagcuuuuaagugccgggugaauu

SEQ ID NO: 152039 - RNA, 61 nt, Homo Sapiens
auguccucugcuugcccggcugcagagcagagaugugcagcccucuggucagcugguccag

SEQ ID NO: 152040 - RNA, 61 nt, Homo Sapiens
ccuggcugacaggaagaauuucugagagcuggaugugcaugcccuguggacgaagguacag

SEQ ID NO: 152041 - RNA, 61 nt, Homo Sapiens
ugagagaaggcuugauguguauaaaagacgugaugugcaccaccucgaucucgguguuuca

SEQ ID NO: 152042 - RNA, 61 nt, Homo Sapiens
ggcugugaggugaccccagacacugcagaacgaugugcacccucugcguuuuggauguccu

SEQ ID NO: 152043 - RNA, 61 nt, Homo Sapiens
uccccgaggugcagcugccguggcugugcccgaugugcaccacuccccaaggugccugaga

SEQ ID NO: 152044 - RNA, 61 nt, Homo Sapiens
ucccagaggugcagcugcccuggccgugcccgaugugcaccacuccccaaggugccugaaa

SEQ ID NO: 152045 - RNA, 61 nt, Homo Sapiens
ucccggaagugcagcucccguggcugugcccgaugugcaccacucccgaaggugcccgaga

SEQ ID NO: 152046 - RNA, 61 nt, Homo Sapiens
ucccagaagugcagcuuccauggccgugcccgaugugcaccacucccgaaggugcccgaga

SEQ ID NO: 152047 - RNA, 64 nt, Homo Sapiens
ucacgccauugcacuccagcggcggaguuugcagugagccgagaagaaucgcuugaaccuggga

SEQ ID NO: 152048 - RNA, 64 nt, Homo Sapiens
ucacaucacugcacuccagcggcggagguuacagugagccgagaagaaucgcuugaacccggga

SEQ ID NO: 152049 - RNA, 64 nt, Homo Sapiens
ucacgccacugcacuccagcggcagaggucauggugagccgagaagaaucacuugaacccggga

SEQ ID NO: 152050 - RNA, 64 nt, Homo Sapiens
ucaugccauugcacuccagcggcggagguugcagugagccgagaagaaucgcuugaaccuggga

SEQ ID NO: 152051 - RNA, 64 nt, Homo Sapiens
ucgcaccacugcacuccagcggcggagacugcagugagccgagaagaauugccugaacccgcga

SEQ ID NO: 152052 - RNA, 64 nt, Homo Sapiens
ucgcgccacuauacuccagcggcagagauugcacugagccgagaagaauugcuugagccuggga

SEQ ID NO: 152053 - RNA, 64 nt, Homo Sapiens
ucgcgccacugcacuccagcggaagagcuugcagugagccgagaagaauggggugaacccggga

SEQ ID NO: 152054 - RNA, 64 nt, Homo Sapiens
ucgcuccacugcacuccagcggcggagguugcagugagccgagaagaaucucuugaacccagga

SEQ ID NO: 152055 - RNA, 64 nt, Homo Sapiens
agggaucuugaguuguuuuaauuuuuuuuuucugcaucugaaucugcaugauuuccaaacccug

SEQ ID NO: 152056 - RNA, 64 nt, Homo Sapiens
gcaucugaaucugcaugauuuccaaacccuguaccaucugaauuuugcauuuuagcacuugcac

SEQ ID NO: 152057 - RNA, 64 nt, Homo Sapiens
aaacuuaugugauguucugguaacauugcuguuacaucugaaauagaauuaaacuugucaauuu

SEQ ID NO: 152058 - RNA, 64 nt, Homo Sapiens
auucauguuuuccuuuuguauguaagaugggagacaucugaaaucuuugacagauugauaacuu

SEQ ID NO: 152059 - RNA, 64 nt, Homo Sapiens
acaaaauguuuuugucuacccaauaucuuggacacaucugaaauuccguuuguauaaaugauag

SEQ ID NO: 152060 - RNA, 64 nt, Homo Sapiens
accuagaacaaguuuaacugguccuggaaaagagcaucugaaaaaaaauaucaaaacauaugaa

SEQ ID NO: 152061 - RNA, 64 nt, Homo Sapiens
aaacauuucacuagugauugaauucuacuuuugccaucugaauugacuugaaugucuuaaaaca

SEQ ID NO: 152062 - RNA, 64 nt, Homo Sapiens
guuuuguaucuucugaucucguacccugagacuucaucugaaugugcucugccgccuucuuauc

SEQ ID NO: 152063 - RNA, 64 nt, Homo Sapiens
cagccaccaaaauauauuucacucaaggcuuguacaucugaaguuugcucuucaaggaauggga

SEQ ID NO: 152064 - RNA, 64 nt, Homo Sapiens
caucaaaacaaaaguuacaacacguaucucuuuucaucugaaaacuaauaccuggaaaaggaua

SEQ ID NO: 152065 - RNA, 64 nt, Homo Sapiens
ugugaaaccaagaaauguaaucaagcaguaaaaacaucugaauguagaccaugaucucaaguuc

SEQ ID NO: 152066 - RNA, 64 nt, Homo Sapiens
acaaaauuauguuaauaaauauucccacauaauacaucugaaugguuaaaaauacuggaagagu

SEQ ID NO: 152067 - RNA, 64 nt, Homo Sapiens
cuuuuccacugaaauagaggauaauuaauugacacaucugaaauccccaaucaaucaaucaaga

SEQ ID NO: 152068 - RNA, 64 nt, Homo Sapiens
aaaaaucauuacucuuuuucucaguaaaucauaucaucugaaauauuacaaauuucaaauuucu

SEQ ID NO: 152069 - RNA, 64 nt, Homo Sapiens
agcagagcuguguuauauuuaccuuauuuggaugcaucugaaccaguaugaccuuuuuaaauca

SEQ ID NO: 152070 - RNA, 64 nt, Homo Sapiens
ccaagcgaagucugugagcaggcucgugcugaaacaucugaaugucuuguuauaaguagagaug

SEQ ID NO: 152071 - RNA, 64 nt, Homo Sapiens
ugcaaccuggccuuugguguucaaacccuuaagacaucugaagcucccugaaacgggcuucagg

SEQ ID NO: 152072 - RNA, 64 nt, Homo Sapiens
uacuaacuuugugguuccaggccaaaccccagaucaucugaaacauucugccaccccucacaca

SEQ ID NO: 152073 - RNA, 64 nt, Homo Sapiens
uuacaggcacuaaaguuaguaaagaaaaguuuaccaucugaaaaagcuggauuuucuuuaagag

SEQ ID NO: 152074 - RNA, 64 nt, Homo Sapiens
acuuacuugcauaccaaguugauacuugaauaaccaucugaaagugguacuugaucauuuuuac

SEQ ID NO: 152075 - RNA, 64 nt, Homo Sapiens
ucaaguucuuaaaauuucaaggugucauuaccagcaucugaauuuagcuucucuuuuuuauucu

SEQ ID NO: 152076 - RNA, 64 nt, Homo Sapiens
uucacaaaacuucuugcuuccacuuuuguuucaccaucugaaaagcagauaauagcuuuuggug

SEQ ID NO: 152077 - RNA, 64 nt, Homo Sapiens
aucgucagaggagggugaggagaagacccagacucaucugaagggaaggaucuuugauggagga

SEQ ID NO: 152078 - RNA, 64 nt, Homo Sapiens
aucuuugauggaggaagaagugaagaccuagacucaucugaagggaaggaucuucacaagagga

SEQ ID NO: 152079 - RNA, 64 nt, Homo Sapiens
uuucucaaauuaucuucccuucucuuggggacaacaucugaaggguauguugcaugcauuuuua

SEQ ID NO: 152080 - RNA, 64 nt, Homo Sapiens
ucuggaccauccuggcuggaaacuuggcuguagacaucugaagagggugcaccuuuucucuuua

SEQ ID NO: 152081 - RNA, 64 nt, Homo Sapiens
cucaaaccauaccugguggggcccaagaaaaccaacuaaggacuuggauuucuuacuaccuaac

SEQ ID NO: 152082 - RNA, 64 nt, Homo Sapiens
gugggguuuuccuccaaggggcauaugacaguggacuaaggacuagcucccccugggaccucca

SEQ ID NO: 152083 - RNA, 64 nt, Homo Sapiens
ccuggaaacuaccagugggcaauaaauaaauaaaacuaaggaacuuauggacaucgauaugaaa

SEQ ID NO: 152084 - RNA, 64 nt, Homo Sapiens
auuaaacuccuacugcuuccuacagugauaugguacuaaggagaaaauuuugaggucuuuuaca

SEQ ID NO: 152085 - RNA, 64 nt, Homo Sapiens
augguauagugaaaagacauugacuugagaugauacuaaggaagcuuuggcucacucucacuug

SEQ ID NO: 152086 - RNA, 64 nt, Homo Sapiens
ucuuuaaacacuaaagcaaaaucaaaugagcaaaacuaaggaugaaauguaauauucaucagaa

SEQ ID NO: 152087 - RNA, 64 nt, Homo Sapiens
acagagcauacucuacaguguauucuaaaauaagacuaaggaagcuguuuauauucugauauga

SEQ ID NO: 152088 - RNA, 64 nt, Homo Sapiens
ugaaacuaccaucaagauguauaaaguaaaaauaacuaaggaguggaacaguguauauggcaua

SEQ ID NO: 152089 - RNA, 64 nt, Homo Sapiens
agaggcugccagauguuucugauguuguaucugaacuaaggaccucacaccuggcagcuucaug

SEQ ID NO: 152090 - RNA, 64 nt, Homo Sapiens
ccacugagggaauccuccaccuagcccaaauggcacuaaggaggcgccuuccagccuucccugg

SEQ ID NO: 152091 - RNA, 64 nt, Homo Sapiens
caaaaagguaaaugcuaucaagaguagaacuuuguagcuguagauuaguuauguuuaaaacgcc

SEQ ID NO: 152092 - RNA, 64 nt, Homo Sapiens
agccuaauucauuaucuguaugaaguuauaaaaguagcuguagauggcuaggaauuaugucauu

SEQ ID NO: 152093 - RNA, 64 nt, Homo Sapiens
cauuuguuuacauauuggcuguuuuauuggagcauagcuguacccaccuguuuucauaaauaac

SEQ ID NO: 152094 - RNA, 64 nt, Homo Sapiens
ccauucuaauaauuucugaugguauuaguuuucauagcuguaguuuuauugaauuuaagagauu

SEQ ID NO: 152095 - RNA, 64 nt, Homo Sapiens
auggaauauuuuuaaaugaaugccuaucuguagauagcuguaaagagaacucagcaccaagggc

SEQ ID NO: 152096 - RNA, 64 nt, Homo Sapiens
acuuggugggcgggguggggguaggaccuuccuuuagcuguaaguauucuuucaaugaauguca

SEQ ID NO: 152097 - RNA, 64 nt, Homo Sapiens
uucuuccagaguagguuuuuuuugguuauauuucagugaaaauuucacaauccacuuaaagaag

SEQ ID NO: 152098 - RNA, 64 nt, Homo Sapiens
auagacuguuaucuuguuggacuuugccuguguaagugaaaaauaacugguaauugcagaaucc

SEQ ID NO: 152099 - RNA, 64 nt, Homo Sapiens
auuccuuuuuguauaggcuaagaaacagguuaucagugaaaaguuaauuauggcuuuggcacua

SEQ ID NO: 152100 - RNA, 64 nt, Homo Sapiens
uucuuuaauuccuacaagguacucgaaaaccuuaagugaaaaagauuucuaucuuuuuaucuua

SEQ ID NO: 152101 - RNA, 64 nt, Homo Sapiens
ggaaggguuuugugcaaugagaauacccagguggagugaaaauuguuuuacuugaaauuuugca

SEQ ID NO: 152102 - RNA, 64 nt, Homo Sapiens
aucugaaauacacucagguguuggauaucccuuaagugaaaagauaauauucuuagcaaucaau

SEQ ID NO: 152103 - RNA, 64 nt, Homo Sapiens
aaaaggaguugcaauagccaaguauagagagaauagugaaaaauuaaucuugcccuuucaagcc

SEQ ID NO: 152104 - RNA, 64 nt, Homo Sapiens
guaguggugguagagagaaauuaauaacaaaaagagugaaaauauuuuaauuagcaguagaugg

SEQ ID NO: 152105 - RNA, 64 nt, Homo Sapiens
auuauguacuugaaaguaaacagauuguucuauaagugaaaagcaaauagaugagaauauggua

SEQ ID NO: 152106 - RNA, 64 nt, Homo Sapiens
ugaacuauguuuuuuuucaguuaauuaauuccugagugaaaaaguaagccaguuauugggagag

SEQ ID NO: 152107 - RNA, 64 nt, Homo Sapiens
aucaacaguuaauuugagccccuuguauauuaucagugaaaaggaaggcuuccugcuuuuuuac

SEQ ID NO: 152108 - RNA, 64 nt, Homo Sapiens
uucugucaagauuuucacugauuaucuuucugauagugaaaagguuaccacuaauaccaguaaa

SEQ ID NO: 152109 - RNA, 64 nt, Homo Sapiens
auuaaccuggauuggucucaaaaacauaaugcucagugaaaauagcaaguuguagaaaguuaua

SEQ ID NO: 152110 - RNA, 64 nt, Homo Sapiens
ggcauauuuagguuuuuuguagaagaaagauacaagugaaaauuaggaguggauuggagaaauu

SEQ ID NO: 152111 - RNA, 64 nt, Homo Sapiens
cgaguacagcuaauuggauaaucucaaacccuuuagugaaaauaucuuaaaugcauugagaaua

SEQ ID NO: 152112 - RNA, 64 nt, Homo Sapiens
uguuguguuuuugccuaaauacuaguaacauaucagugaaaaacccuaauuuuuuuucucuuca

SEQ ID NO: 152113 - RNA, 64 nt, Homo Sapiens
gugugaucugaucaacacucugguuaccuuggucagugaaaagaugcuacuauauugcuuuugu

SEQ ID NO: 152114 - RNA, 64 nt, Homo Sapiens
acacaagaaaugugugucugcugucauaacuuacagugaaaaagcccaauaauacagaacaaga

SEQ ID NO: 152115 - RNA, 64 nt, Homo Sapiens
gagauucagcucuaguuugcaccuugauuuccccagugaaaagggagaagagccaaaguauugu

SEQ ID NO: 152116 - RNA, 64 nt, Homo Sapiens
acagaccucccccggacagccuugaaggugaggaagugaaaacuuuuccuugcaucaucuuccu

SEQ ID NO: 152117 - RNA, 64 nt, Homo Sapiens
ccaugucauggaguguaggauugacuuuuuuuucagugaaaacaugcugcauuaucuguccagu

SEQ ID NO: 152118 - RNA, 64 nt, Homo Sapiens
ccucugucauggagccugucuuauauuuccacagagugaaaaaucaugggaaaagagauaggcu

SEQ ID NO: 152119 - RNA, 64 nt, Homo Sapiens
uugucucuuuacaaccaauuguguguauauguacagugaaaauguugugcuuacauguauggau

SEQ ID NO: 152120 - RNA, 64 nt, Homo Sapiens
uguuauaucuaugcaaaccuagauguauuauaccagugaaaaggcugccauaauccuuuggaaa

SEQ ID NO: 152121 - RNA, 64 nt, Homo Sapiens
agaauauacaugaagaauagaaacagaaaaaaagagugaaaaagaauaugguuaauuucaugua

SEQ ID NO: 152122 - RNA, 64 nt, Homo Sapiens
ggacauuuuuaauagugccauugugauucugucuagugaaaaugaugauugaguggguauaccu

SEQ ID NO: 152123 - RNA, 64 nt, Homo Sapiens
uuggacucaaaaggagguauaagacaaaagcugcagugaaaauuugaaugcaguucuuggcaca

SEQ ID NO: 152124 - RNA, 63 nt, Homo Sapiens
aaaacaugggaauuuuucucauauaaauaaaauuagugaaaaguucugagugaaaacuaccua

SEQ ID NO: 152125 - RNA, 64 nt, Homo Sapiens
accuaauauaaauaaaauuagaauugauauucugagugaaaacuuauaucuaaaccugaaaaau

SEQ ID NO: 152126 - RNA, 64 nt, Homo Sapiens
cuugugugcaccugauuuggccaauaggaucaacagugaaaagacagaagaggcaauaccagca

SEQ ID NO: 152127 - RNA, 64 nt, Homo Sapiens
ucuguuuucugccacaaaaaugugaauaguucagagugaaaaccuuuugugaugguugaugucu

SEQ ID NO: 152128 - RNA, 64 nt, Homo Sapiens
aagguauuugcuuguugaaaaaaaaaacuggcaaagugaaaagauacagucaaaaaucuagaau

SEQ ID NO: 152129 - RNA, 64 nt, Homo Sapiens
aauauuuuuuaaguuugggggaagagaaacuugcagugaaaaggaguuuuuucauuccugaaag

SEQ ID NO: 152130 - RNA, 64 nt, Homo Sapiens
aaucugaaaaggcuuucuauaaugcuuauuguuaagugaaaaccaaagacauauaggaacccua

SEQ ID NO: 152131 - RNA, 64 nt, Homo Sapiens
uugcuuagaaauaaaauauguuuaagaaaucuaaagugaaaauuacugaggagaaaauugucaa

SEQ ID NO: 152132 - RNA, 64 nt, Homo Sapiens
aucuuuugagauuaaagugacugucauuuagaacagugaaaaguaggaaaaaaugcuuaaaauc

SEQ ID NO: 152133 - RNA, 64 nt, Homo Sapiens
uccuguuuagacuuuggugguaagauuuuuaaauagugaaaaccguugucaucaauugcuuuac

SEQ ID NO: 152134 - RNA, 64 nt, Homo Sapiens
uccauaucagcaacauacguguuuuuugacagaaagugaaaacaaauuccguaaaacuguuagu

SEQ ID NO: 152135 - RNA, 64 nt, Homo Sapiens
cauaggacuuuuaaaaggcuugugcuaucuuuccagugaaaacugaaagugcauuauuauggaa

SEQ ID NO: 152136 - RNA, 64 nt, Homo Sapiens
uuuaaaaaggaagagaaacuuggauaauagacaaagugaaaacaaugcuuuccuaaaaugauag

SEQ ID NO: 152137 - RNA, 64 nt, Homo Sapiens
aaacaacuagcaaaaagaauuagaaaaagaaaaaagugaaaagggaaagagaaaaaagauaaag

SEQ ID NO: 152138 - RNA, 64 nt, Homo Sapiens
uagcuaauaacaugugaaaaccuccaauuuuuuaagugaaaauauuguuugcuuaccccuucag

SEQ ID NO: 152139 - RNA, 64 nt, Homo Sapiens
uuguaguaugauagguuauuuuacacuuuuuggaagugaaaacuuaccagugccuuaaacucug

SEQ ID NO: 152140 - RNA, 64 nt, Homo Sapiens
acuucaaauguuauucaauaaguuaauucucagaagugaaaaagcuggcauuugcugcauuuca

SEQ ID NO: 152141 - RNA, 64 nt, Homo Sapiens
uuauugaauauaauggccucaaauagcuauaaauagugaaaauuuuaccuauugcuguaaauaa

SEQ ID NO: 152142 - RNA, 64 nt, Homo Sapiens
aaaugauuuuuauuuuuccuuugguauuugcuacagugaaaagaaguuuggaaaguagauacau

SEQ ID NO: 152143 - RNA, 64 nt, Homo Sapiens
gaauuuaggcauuaccucagggaaaagccuugacagugaaaagaaacuacuuaaucgcuaauag

SEQ ID NO: 152144 - RNA, 64 nt, Homo Sapiens
agaguaacuccccagcauuuaaggagagaagggaagugaaaagucccaauuccauccuucccug

SEQ ID NO: 152145 - RNA, 64 nt, Homo Sapiens
cugcaggaggugcauccuccucccucugaggccuagugaaaaagcuagccuaaggggccugcug

SEQ ID NO: 152146 - RNA, 64 nt, Homo Sapiens
aaaaaaaaacuagaaagcuaaacuauuugauccaagugaaaaaagaucuuuuucugucuaucaa

SEQ ID NO: 152147 - RNA, 64 nt, Homo Sapiens
aaccaaguccaggaaauuacuucuuaacugcccaagugaaaagcuggggaaaacaagcuguguc

SEQ ID NO: 152148 - RNA, 64 nt, Homo Sapiens
caugcuacaaugaggcagcaagugaaaacacuagagugaaaacauucauaaacacagaguguag

SEQ ID NO: 152149 - RNA, 64 nt, Homo Sapiens
cuagagugaaaacacaugcuaacacagaguguagagugaaaacagcucaggcuauucauucaua

SEQ ID NO: 152150 - RNA, 61 nt, Homo Sapiens
auauaaaggcgacugaauagauggaugagggagugaaaacuuugcauagaauccucacgca

SEQ ID NO: 152151 - RNA, 64 nt, Homo Sapiens
uuaacuuacaaaaagucacaaaaacuuacaugagagugaaaauuuguuaugacuguuuugagag

SEQ ID NO: 152152 - RNA, 64 nt, Homo Sapiens
gugggucccucauaggcuaggccccggagaagcaagugaaaaggcugcacuuacccucaaucca

SEQ ID NO: 152153 - RNA, 64 nt, Homo Sapiens
guguccagauaaacccaccucuucuucuccagauagugaaaaagccugaacaaccaguaugugu

SEQ ID NO: 152154 - RNA, 64 nt, Homo Sapiens
acaaauggugccauaguuauuuuucucaaaauuuagugaaaaucccucccauguagacauguug

SEQ ID NO: 152155 - RNA, 64 nt, Homo Sapiens
uuuggaaaacuuaccaguuuuuagauguagauguagugaaaaacuucaagaaugaagcagagca

SEQ ID NO: 152156 - RNA, 64 nt, Homo Sapiens
guuaaaacagacaacugguauaucuuuuccaaaaagugaaaaauuuuuaaagcaaguuguugcu

SEQ ID NO: 152157 - RNA, 64 nt, Homo Sapiens
aggaagaagauggccuugaccugugggcugcugcagugaaaagcaagaggaucuccagcugguu

SEQ ID NO: 152158 - RNA, 64 nt, Homo Sapiens
uagcagucagugacauggggcagccuaguaaggaagugaaaacucggauaccucauuugaaacu

SEQ ID NO: 152159 - RNA, 64 nt, Homo Sapiens
uuagaugaguacggauaccugcuuguuuugcaguagugaaaagcuuaauguucccaauagucaa

SEQ ID NO: 152160 - RNA, 64 nt, Homo Sapiens
augcauuguuuuguuuaaguaaauucugccuacaagugaaaaggucggugcgcucuucugugca

SEQ ID NO: 152161 - RNA, 64 nt, Homo Sapiens
ugcuccgaacacuuaaaaaauacuaagacgugauagugaaaauagcuuugaaaagaaacuacau

SEQ ID NO: 152162 - RNA, 64 nt, Homo Sapiens
uagcuauuuugcuuaaauuucuacaguauguaaaagugaaaaaaugaugaagacgggugcaccu

SEQ ID NO: 152163 - RNA, 64 nt, Homo Sapiens
gacugguuuuguuuuuauauauauaaaaaaaaaaagugaaaacaccaaugugugaaaugccuua

SEQ ID NO: 152164 - RNA, 64 nt, Homo Sapiens
aacccauauaaauaugcucagcugauuuugaaaaagugaaaaagcaauucaauggaggaagaau

SEQ ID NO: 152165 - RNA, 64 nt, Homo Sapiens
augacuuacuuaucucaauggcuaaagaaaaaauagugaaaauaccaaauacugaugaggauac

SEQ ID NO: 152166 - RNA, 64 nt, Homo Sapiens
uuagacuuaggaaaaaaggcagaguaacauuacuuaaaaaaaaaaggauauguuuacauuuaau

SEQ ID NO: 152167 - RNA, 64 nt, Homo Sapiens
auccacucacuccaacaaagaacacuuagaaugauaaaaaaaaaaaaaaaaaaccugacaaaag

SEQ ID NO: 152168 - RNA, 64 nt, Homo Sapiens
uguuuaaauauaaacagaaguguaccuuuuauaauaaaaaaaagaaguugaguaaaaaaaaaaa

SEQ ID NO: 152169 - RNA, 64 nt, Homo Sapiens
aguguaccuuuuauaauaaaaaaaagaaguugaguaaaaaaaaaaaacacacaaaccuguuagu

SEQ ID NO: 152170 - RNA, 64 nt, Homo Sapiens
aaauaguugaugcaauuuuuaacguuaauugauauaaaaaaaaaaacaacaaaauuaggcuugu

SEQ ID NO: 152171 - RNA, 64 nt, Homo Sapiens
aaacaagugaaaaggucaagauacaaauguguauuaaaaaaaaaaaagccuauuaauaggguuu

SEQ ID NO: 152172 - RNA, 64 nt, Homo Sapiens
acuugacuugcuaucucagcaagauaaauuauauuaaaaaaauaagaauccugcaguguuuaag

SEQ ID NO: 152173 - RNA, 64 nt, Homo Sapiens
aagauuuuuacauuuugaagaaggggagcaaaucuaaaaaaaauucaguugaacuucugagagu

SEQ ID NO: 152174 - RNA, 64 nt, Homo Sapiens
auauuuaauaugugcccagauuauucuaaaaucuuaaaaaaagaugcauauagugaaauuuuuu

SEQ ID NO: 152175 - RNA, 64 nt, Homo Sapiens
agcccuaaaggagucuggcuuuuacuaucuuucuuaaaaaaaaaaaaaagucaaaaaaauucaa

SEQ ID NO: 152176 - RNA, 64 nt, Homo Sapiens
uguaaaauauugaaauuuucuuucaagcaaaguguaaaaaaauauauugagccuguaaauugcu

SEQ ID NO: 152177 - RNA, 64 nt, Homo Sapiens
uacauuguaaaauaaaguugagcuuaguuuuuuuuaaaaaaaaaaacaaagcaacaaauuaacu

SEQ ID NO: 152178 - RNA, 64 nt, Homo Sapiens
uuagcgaacuuguauacuuauuuucuguucagauuaaaaaaaaaaaaaaaaaacucagauaucc

SEQ ID NO: 152179 - RNA, 64 nt, Homo Sapiens
cuuucauucccacaaaaccaguauuacuuuuuuuuaaaaaaagaaagaaauuggaaaucugugc

SEQ ID NO: 152180 - RNA, 64 nt, Homo Sapiens
uacuucauuuuacaauacauauucccuuuuaacuuaaaaaaauuguaaaugugggagaaaaaac

SEQ ID NO: 152181 - RNA, 64 nt, Homo Sapiens
uaauuuacaaugucccugauauugagcuaacucuuaaaaaaaccaaacaaaacucguaucugag

SEQ ID NO: 152182 - RNA, 64 nt, Homo Sapiens
gaccuaagacagggaggggucagagugauggugauaaaaaaaaaaaaucaucagcaauaagcug

SEQ ID NO: 152183 - RNA, 64 nt, Homo Sapiens
ggcuguuuucacaaaugacuuguaaugucgugauuaaaaaaauuccuauauucuucugcaaauc

SEQ ID NO: 152184 - RNA, 64 nt, Homo Sapiens
gaaagcccugagcuuucugcuaucaaagagguuuuaaaaaaaucccauuuaaaaaaaaucccuu

SEQ ID NO: 152185 - RNA, 64 nt, Homo Sapiens
ucugcuaucaaagagguuuuaaaaaaaucccauuuaaaaaaaaucccuuaccucggugccuucc

SEQ ID NO: 152186 - RNA, 64 nt, Homo Sapiens
uucucgcacuaaccaccagaagacuugaaaaucuuaaaaaaaaaaaacaaaaaaacaagaaaag

SEQ ID NO: 152187 - RNA, 64 nt, Homo Sapiens
uauaacuuuuuuaaauaaagguaguauuuaccauuaaaaaaauuuuagcuaaugcuuuuuaucc

SEQ ID NO: 152188 - RNA, 64 nt, Homo Sapiens
gcagcuuggguaacagauugagaaccugucucauuaaaaaaaaaaaaaaaaaaaaagccguuag

SEQ ID NO: 152189 - RNA, 64 nt, Homo Sapiens
ggccaacauggugaaacccugucucuacugaaaauaaaaaaaacuagcugggcaugguggcaga

SEQ ID NO: 152190 - RNA, 64 nt, Homo Sapiens
cuaaaacauaaucacaaagcuuuaucguguuguauaaaaaaauuaacaauauaauggcaauagg

SEQ ID NO: 152191 - RNA, 64 nt, Homo Sapiens
caacauguaauuauuuaauaaaacuuuggaacauuaaaaaaauaaauuggaggcuuaaggauua

SEQ ID NO: 152192 - RNA, 64 nt, Homo Sapiens
ugaauauauuuugucuacaaaguguauuuggauuuaaaaaaauuaauuaggucuuucaguuggu

SEQ ID NO: 152193 - RNA, 64 nt, Homo Sapiens
aauggaaauaagcaaaauauaauguuuuaagaaguaaaaaaaucaauauaauuuaauuaauagc

SEQ ID NO: 152194 - RNA, 64 nt, Homo Sapiens
gaacuaaugucucauaugauguauuuacuuauuuuaaaaaaaagaauaggaaugagaugucccu

SEQ ID NO: 152195 - RNA, 64 nt, Homo Sapiens
auguucuuauauuuauguauauuuguuaaaacuguaaaaaaauuucacagauuuuuuuccaaua

SEQ ID NO: 152196 - RNA, 64 nt, Homo Sapiens
aacacacacagaaugggcugguuucuuucaaguuuaaaaaaagcccccuucuccaugcacaagu

SEQ ID NO: 152197 - RNA, 64 nt, Homo Sapiens
cacuccagccuaggagacaaaacgagacuucauuuaaaaaaaauaaaaauaaaaauaaaaauaa

SEQ ID NO: 152198 - RNA, 64 nt, Homo Sapiens
aauguauuuauuuuuuuacuuggacaugaaacuuuaaaaaaauucacagauuauauuuauaacc

SEQ ID NO: 152199 - RNA, 64 nt, Homo Sapiens
accugacuagagcaggugauguauuuuuauacaguaaaaaaaaaaaaccuuguaaauucuagaa

SEQ ID NO: 152200 - RNA, 64 nt, Homo Sapiens
ggauucauaaucacaaauauagagaauuccuauuuaaaaaaauagaaaaauagugaagacuaca

SEQ ID NO: 152201 - RNA, 64 nt, Homo Sapiens
gucuaagcauacguauacaauaaaacuaugcuauuaaaaaaaaagaagguaacugauaaaccaa

SEQ ID NO: 152202 - RNA, 64 nt, Homo Sapiens
aaaagccaggccgagcgugucauauggaacauguuaaaaaaaaaccuaacauuuagcccugccc

SEQ ID NO: 152203 - RNA, 64 nt, Homo Sapiens
acaaaaaaauuagccaggcgaaccccgucucuacuaaaaaaaaucauccuggcgaacacgguga

SEQ ID NO: 152204 - RNA, 64 nt, Homo Sapiens
aaaagaaauugacucaguacauagaacaaauauuuaaaaaaacaacuuuaaggcuuguaaauac

SEQ ID NO: 152205 - RNA, 64 nt, Homo Sapiens
aaagugcuacccugagaaaacuccaagaauuguuuaaaaaaaaaaaaugcuguggaccacagaa

SEQ ID NO: 152206 - RNA, 64 nt, Homo Sapiens
uuuagcaaaaaaaaaaaaagcaaggacucauacuuaaaaaaauguuuaaucuuuucuuuuuaaa

SEQ ID NO: 152207 - RNA, 64 nt, Homo Sapiens
aaaucccugguuuaaaaccaagguuuuuugagauuaaaaaaaaacugauugccuuguuauuacu

SEQ ID NO: 152208 - RNA, 64 nt, Homo Sapiens
aaaaaaacaaaaaacaacacugggcacuuuuagauaaaaaaaaacuggcagccuuaagcccacc

SEQ ID NO: 152209 - RNA, 64 nt, Homo Sapiens
gcauaaaaugcuuaaaaaugguagugacuauauuuaaaaaaacacauaaaagcaaguacauaua

SEQ ID NO: 152210 - RNA, 64 nt, Homo Sapiens
aguacguauuuagauaaucagcaauuccuuuauuuaaaaaaaaagaaagcacugaguugagcaa

SEQ ID NO: 152211 - RNA, 64 nt, Homo Sapiens
guucccuaaggcagcuuuauuauuuuccacauauuaaaaaaauacauuucauugaguuuggaug

SEQ ID NO: 152212 - RNA, 64 nt, Homo Sapiens
aagaguuuaaguggcuaaaggucaugaaaagcacuaaaaaaaaaacaaggccuaucauguccuu

SEQ ID NO: 152213 - RNA, 64 nt, Homo Sapiens
gaguaugaagaaaaacacuuuucaaauguucuauuaaaaaaacuguuaacuacacuucuugaua

SEQ ID NO: 152214 - RNA, 64 nt, Homo Sapiens
augcuuccuuuggauagacuaguuuauuguuuuuuaaaaaaaccacauucaagaggagacuugg

SEQ ID NO: 152215 - RNA, 64 nt, Homo Sapiens
cuuagcucaaagauaugauuucuuugugaaaaauuaaaaaaaaaaacuauuugccuucuggagc

SEQ ID NO: 152216 - RNA, 64 nt, Homo Sapiens
aaaucuuagucccuguuaucaaaaguagauuuuuuaaaaaaaaauucugucacaagucuuauug

SEQ ID NO: 152217 - RNA, 64 nt, Homo Sapiens
aaaaaaagauuuuggagacuuaguaaacuuucuuuaaaaaaaaauaagugccuugcauuacaca

SEQ ID NO: 152218 - RNA, 64 nt, Homo Sapiens
aaaagauaagugcuuguucuguugggcuuaguaauaaaaaaaaguacugcaugccacgcacugu

SEQ ID NO: 152219 - RNA, 64 nt, Homo Sapiens
aaucaucaaagacagaaaaugcaaaugccagaauuaaaaaaaaauucauuuaagaggcaauaag

SEQ ID NO: 152220 - RNA, 64 nt, Homo Sapiens
uccucccuucccccuuuccuaaauagcuuuaguuuaaaaaaaaauccccuuuuuucuaaauuug

SEQ ID NO: 152221 - RNA, 64 nt, Homo Sapiens
uguagaguagggcaaaucuguguguguaugucauuaaaaaaauucuaccaucuuucuuuaucau

SEQ ID NO: 152222 - RNA, 64 nt, Homo Sapiens
ccuuuuucugugggaaucacaagaguuuauccacuaaaaaaagauauguaaaaaagauacuuuc

SEQ ID NO: 152223 - RNA, 64 nt, Homo Sapiens
ccuucccuaccaucaaaagcauaccugcucuaauuaaaaaaaaaaaaaaaaaaaauucaaguuc

SEQ ID NO: 152224 - RNA, 64 nt, Homo Sapiens
cacuggugguguccuucuuacaaaacuuuugaaauaaaaaaaaaacucaaaucuucacugucug

SEQ ID NO: 152225 - RNA, 64 nt, Homo Sapiens
auaagcaaauguuucagcccaaugucaacccaguuaaaaaaaaaauuaaugcuguguaaaaugg

SEQ ID NO: 152226 - RNA, 64 nt, Homo Sapiens
ccuguacaaugacaacccuggaaguugcuuuuuuuaaaaaaauaauaaauuucuuaaaucaacu

SEQ ID NO: 152227 - RNA, 64 nt, Homo Sapiens
uugcggagaaaucaaguuuaaaauuccuucugauuaaaaaaauauaguggaauacaauugucug

SEQ ID NO: 152228 - RNA, 64 nt, Homo Sapiens
uuuaccuuguaaaauuuuguacagcauaaauaaguaaaaaaaucacuguuuuucucaacuuuuu

SEQ ID NO: 152229 - RNA, 64 nt, Homo Sapiens
caaaaucuuguaguuuuuaaucuuaaacacugaauaaaaaaacuuuccccuaaauuggaaugau

SEQ ID NO: 152230 - RNA, 64 nt, Homo Sapiens
cccuccucaauuuuguauuuuuaaaaguacaugguaaaaaaaaaaauucacaacaguauauaag

SEQ ID NO: 152231 - RNA, 64 nt, Homo Sapiens
uuuugauaaucauuugcuuccaguguuuaaaaauuaaaaaaagaauggggagaagguuaugaga

SEQ ID NO: 152232 - RNA, 64 nt, Homo Sapiens
uauaugagacuugccagucaaaugcuauuugguuuaaaaaaauuauugcaaucucaaguuaaug

SEQ ID NO: 152233 - RNA, 64 nt, Homo Sapiens
ggaacgaaaaugaaagcuacucauagcgggggccuaaaaaaaaaaagcuucacaguacccaaac

SEQ ID NO: 152234 - RNA, 64 nt, Homo Sapiens
ugauacuuugacaguguuuuuagaccuguguuacuaaaaaaaagaugaauguccugaaaagggu

SEQ ID NO: 152235 - RNA, 64 nt, Homo Sapiens
cacuccagcuugggcaacagggcgagaccuuguuuaaaaaaaaaauucaauauugggguuggaa

SEQ ID NO: 152236 - RNA, 64 nt, Homo Sapiens
auuaggaguguuucauuugauaugugaaugcucauaaaaaaaugucaaggaaugaagaacaaca

SEQ ID NO: 152237 - RNA, 64 nt, Homo Sapiens
uucuauuuuuuucucccauuuggauccuuugagguaaaaaaacauaaugucuucagccucauaa

SEQ ID NO: 152238 - RNA, 64 nt, Homo Sapiens
aaugucuucagccucauaauaaaggaaaguuaauuaaaaaaaaaaagcaaagagccauuuuguc

SEQ ID NO: 152239 - RNA, 64 nt, Homo Sapiens
ggaugacuagacagcaaaaaaggaaaaguuaaacuaaaaaaaaaaaggccgccgugaccuauuc

SEQ ID NO: 152240 - RNA, 64 nt, Homo Sapiens
uucauuauaaucucaaaggagaaaaaaaaccuuguaaaaaaagcaaaaaugacaacagaaaaac

SEQ ID NO: 152241 - RNA, 64 nt, Homo Sapiens
auauuuuuagcagaacaggaggguuuuguaaaaauaaaaaaaaauuaugaaauaaaaaaaagau

SEQ ID NO: 152242 - RNA, 64 nt, Homo Sapiens
auggguuuuguaaaaauaaauuuuuguuaugaaauaaaaaaaagaaguacagacguacuuuaaa

SEQ ID NO: 152243 - RNA, 64 nt, Homo Sapiens
uuguaucucauuacuuauacuugauauaccaaauuaaaaaaaaauuauauguagccuuuacugu

SEQ ID NO: 152244 - RNA, 64 nt, Homo Sapiens
agucaccaaauagugugaaauaagucucauagguuaaaaaaaaaccauaauguacugauuucag

SEQ ID NO: 152245 - RNA, 64 nt, Homo Sapiens
uaaaguacacauuguaagcucuuuauugaaaaaauaaaaaaaauuucauacacccauuuugucc

SEQ ID NO: 152246 - RNA, 64 nt, Homo Sapiens
aaacauacauuggggaaaggcgcucuucagguuguaaaaaaaaaucuaugccuuggauacacac

SEQ ID NO: 152247 - RNA, 64 nt, Homo Sapiens
aaaacuuugccagccauuuacauuuuuuaaaaacuaaaaaaaaaaacacaaucucauugaggag

SEQ ID NO: 152248 - RNA, 64 nt, Homo Sapiens
agagaaagaauuuuaagaguaaaugugacauucuuaaaaaaagaaauucuuaagacuugcauuu

SEQ ID NO: 152249 - RNA, 64 nt, Homo Sapiens
cauuguuugagcugucccauauucuguuuuagguuaaaaaaaggucaucuucagcuugugcaca

SEQ ID NO: 152250 - RNA, 64 nt, Homo Sapiens
aaccaaaacugugcagagucuaauauaaagauguuaaaaaaaaacugauaugauuuaaaacaug

SEQ ID NO: 152251 - RNA, 64 nt, Homo Sapiens
auggcguauuaugugaacuaaacuacaggcacaguaaaaaaaauaauuguaccacuccuugaag

SEQ ID NO: 152252 - RNA, 64 nt, Homo Sapiens
aaaaagcugaaacgaguaauaaucauuuggggaguaaaaaaaugcauuuuaagaaaaaggugaa

SEQ ID NO: 152253 - RNA, 64 nt, Homo Sapiens
gguuuuagaaaugaucuuaggucuuuagguucauuaaaaaaacaguacucaucugcugugaaaa

SEQ ID NO: 152254 - RNA, 64 nt, Homo Sapiens
ugacgcuugcuuaggagauuauagaaugauguuuuaaaaaaauuuaaaguuccuuaagcaucug

SEQ ID NO: 152255 - RNA, 64 nt, Homo Sapiens
uuuauaaauuacuaucuguuucccaaagcacuuuuaaaaaaauuaguaaugauacuguguguuu

SEQ ID NO: 152256 - RNA, 64 nt, Homo Sapiens
aaaaaaaaaaaaaaaaaaaauuccucuccaauuguaaaaaaaaauguguugccuuagcacuucu

SEQ ID NO: 152257 - RNA, 64 nt, Homo Sapiens
caguaaaguuuaaaaaauacuucuauuuaaaaaauaaaaaaauauguauuauuuucuauagcuc

SEQ ID NO: 152258 - RNA, 64 nt, Homo Sapiens
accucuauguguagauauuauaaaagguaggaguuaaaaaaaaaauuuauauauuugaaaggua

SEQ ID NO: 152259 - RNA, 64 nt, Homo Sapiens
acuucacagugagucgcuuuacuuguuuauguauuaaaaaaaccaaugaguucuuaaagaaaag

SEQ ID NO: 152260 - RNA, 64 nt, Homo Sapiens
aaaaaggaaguaaaaauuuugaucacugagaauuuaaaaaaauaccaaaaggaaucagaauaag

SEQ ID NO: 152261 - RNA, 64 nt, Homo Sapiens
uaauaauaauuugaaucauggguuuauuucuuuguaaaaaaaaauagugcagugauccuuuaca

SEQ ID NO: 152262 - RNA, 64 nt, Homo Sapiens
cuguuacuauauagugauaauaucuccuaaaguguaaaaaaaauacuuccguuauuggauaugg

SEQ ID NO: 152263 - RNA, 64 nt, Homo Sapiens
aaaccucaguacugcaucacuaauagauauugauuaaaaaaaaaaguaucuuugcuaaucuuac

SEQ ID NO: 152264 - RNA, 64 nt, Homo Sapiens
ucuuuucagauaaaaucugcaaagcuuucauauuuaaaaaaaagcauaauucuuauccuaagag

SEQ ID NO: 152265 - RNA, 64 nt, Homo Sapiens
ucugcuacucagauccacugcauuagcagaacuauaaaaaaaaaauucucaaaacaucacauca

SEQ ID NO: 152266 - RNA, 64 nt, Homo Sapiens
auccaucuuucuuuauuuuccuguauagaauuauuaaaaaaaaaggucccaucaucugaagauu

SEQ ID NO: 152267 - RNA, 64 nt, Homo Sapiens
aaaagacgaacuauuggaggaaaaauaaaaaaaauaaaaaaaaauaucacacaaagagaccaau

SEQ ID NO: 152268 - RNA, 64 nt, Homo Sapiens
aaaaaaaaaaaaagacgaacgagaccaauaaaaauaaaaaaaauguaggucauuaucacacaaa

SEQ ID NO: 152269 - RNA, 64 nt, Homo Sapiens
gcuugucacauugcaaaaccuagcuuaagagcauuaaaaaaaaaaacuuaaguagauaggagcu

SEQ ID NO: 152270 - RNA, 64 nt, Homo Sapiens
agaagauagagguuguuuucguuucuuuucuuuuuaaaaaaaaaaaaauuuauuugaccgacau

SEQ ID NO: 152271 - RNA, 64 nt, Homo Sapiens
caaagucuucuuugaauaucagggacugagucaauaaaaaaaauaguagaaagguggcuuuuac

SEQ ID NO: 152272 - RNA, 64 nt, Homo Sapiens
aguaugcagguagcaaagauguaauaaauuugcuuaaaaaaagaaauuaaaguuuuauuuagaa

SEQ ID NO: 152273 - RNA, 64 nt, Homo Sapiens
gcuuuggaaacauauguccuagaaaacauaaaauuaaaaaaaaacacuauaguguaguuuuugg

SEQ ID NO: 152274 - RNA, 64 nt, Homo Sapiens
auuauaugcuaaagaauaaaacuccaguuagauuuaaaaaaaucccauuuacaagcauugcacc

SEQ ID NO: 152275 - RNA, 64 nt, Homo Sapiens
uaaaauagaaaagaacaagugaauuguugcuauuuaaaaaaauuuuacaauucuuacuaaggag

SEQ ID NO: 152276 - RNA, 64 nt, Homo Sapiens
uaauaaauuugacucauuaaaaaccuuuuuuuuuuaaaaaaaaaaaaaaagaaaaucucauuag

SEQ ID NO: 152277 - RNA, 64 nt, Homo Sapiens
ugugaauuuauaauaauuucaaaauaaaacaaguuaaaaaaaaacccacuaugcuauaaguuag

SEQ ID NO: 152278 - RNA, 64 nt, Homo Sapiens
aauuuuauaaaauccaccuccuccaaaaaagcaauaaaaaaaaaacaaacuauaauaagcuuuu

SEQ ID NO: 152279 - RNA, 64 nt, Homo Sapiens
gcacuccagccaggugacauagcgagauccugucuaaaaaaauaaaaaauaaauaauggaacac

SEQ ID NO: 152280 - RNA, 64 nt, Homo Sapiens
gcaaguccuaggaaguagguuaaaacuaauucuuuaaaaaaaaaaaaaaguugagccugaauua

SEQ ID NO: 152281 - RNA, 64 nt, Homo Sapiens
uguguguaugugcgugugauuaccagagaacuacuaaaaaaaccaacugcuuuuuaaauccuau

SEQ ID NO: 152282 - RNA, 64 nt, Homo Sapiens
uugccauuguggaagaaauuauuugguacauuaauaaaaaaaguugguaaaacaugguuuuaua

SEQ ID NO: 152283 - RNA, 64 nt, Homo Sapiens
uuaaacauggugugguauucuaaagccuuuuuuuuaaaaaaagagaucuuuuugagagaaacaa

SEQ ID NO: 152284 - RNA, 64 nt, Homo Sapiens
guucccugucucuugaaaaaugcccauuugccuuuaaaaaaaaaaguuacagaaauacuauaac

SEQ ID NO: 152285 - RNA, 64 nt, Homo Sapiens
ugcaauauuccuuugggccucugcuucucucaccuaaaaaaagagaauuagauuauauuggugg

SEQ ID NO: 152286 - RNA, 64 nt, Homo Sapiens
gaaagaacuaugucugaaauauaaaaaauaaaaauaaaaaaacaacuaugaauaugcacaaggg

SEQ ID NO: 152287 - RNA, 64 nt, Homo Sapiens
aaaauguuuauugcuguuuugucuuucuuuuuucuaaaaaaagaaaaaaaagaaaaaaaggaaa

SEQ ID NO: 152288 - RNA, 64 nt, Homo Sapiens
uuuagaucauuacaguuuaaguuuucugaccaauuaaaaaaacauagagaacaaaagcauauuu

SEQ ID NO: 152289 - RNA, 64 nt, Homo Sapiens
uuuugcucuuguauggcaaaauaauuagugaguuuaaaaaaaaucuauaguuuccaauaaacaa

SEQ ID NO: 152290 - RNA, 64 nt, Homo Sapiens
ggauaugcuagaaaaggcauuuugggguuauguuuaaaaaaacauuauugucccacaauauuac

SEQ ID NO: 152291 - RNA, 64 nt, Homo Sapiens
ccaaauuagccagacaugguggcaugcgcuuguuuaaaaaaacaaauaaauaaauaaucgacuc

SEQ ID NO: 152292 - RNA, 64 nt, Homo Sapiens
aaaagaaaaugugaaacacaguuacaugauuuuuuaaaaaaaggacuuuuuuuucauucucauu

SEQ ID NO: 152293 - RNA, 64 nt, Homo Sapiens
aaagaaaaaaaagaguuuguacuugccccuuauuuaaaaaaaaacuccacacugaucuuuggaa

SEQ ID NO: 152294 - RNA, 64 nt, Homo Sapiens
gaagaaacugauaccacaccuguuuuguaacacauaaaaaaaugaugucaaguaaaaaaaagau

SEQ ID NO: 152295 - RNA, 64 nt, Homo Sapiens
auuguuuuguaacacauaaauuguugaugucaaguaaaaaaaagguguuuauacugcaccuugg

SEQ ID NO: 152296 - RNA, 64 nt, Homo Sapiens
uuuuuuuuaaauaauaauuguaggccagauaaguuaaaaaaaauuugugucagucaccacaaag

SEQ ID NO: 152297 - RNA, 64 nt, Homo Sapiens
uguuuuagacugccuuguucguucuucguauuuuuaaaaaaauuaccucuucccuucaauaucu

SEQ ID NO: 152298 - RNA, 64 nt, Homo Sapiens
auuauuagguccuuaccaguuaaaauacguacauuaaaaaaaaaguuguagcagugaauauagu

SEQ ID NO: 152299 - RNA, 64 nt, Homo Sapiens
aaaaaaaaaagaaaaagaaagcuagucuuguuuguaaaaaaaaacuauagagaauuugcuauaa

SEQ ID NO: 152300 - RNA, 64 nt, Homo Sapiens
aaaacaaaaacaagcagcuuauuauuguuauaacuaaaaaaaaacaaacagcaauaacaauauu

SEQ ID NO: 152301 - RNA, 64 nt, Homo Sapiens
gguuuucaaaugucaaauacacuaucauaguugcuaaaaaaaauaaggacaaagucuagaaacc

SEQ ID NO: 152302 - RNA, 64 nt, Homo Sapiens
uagcuuuggaaaaaaaacuauauauuaacgauacuaaaaaaaaaugcuuuuugugcaacugcuu

SEQ ID NO: 152303 - RNA, 64 nt, Homo Sapiens
acauuucacucaguugcacugaaugauuaaaauuuaaaaaaaaaccucaguucaaaccuuuagg

SEQ ID NO: 152304 - RNA, 64 nt, Homo Sapiens
aaaaaaaaaaaaaaaaaaaagucacgcaagacuuuaaaaaaaaauguauaaagggcagucugug

SEQ ID NO: 152305 - RNA, 64 nt, Homo Sapiens
aaggcagaaaacccaccauguuauuuaauuuguuuaaaaaaaaaacaaugacaaauaugccagu

SEQ ID NO: 152306 - RNA, 64 nt, Homo Sapiens
uucaguauccucauuaacaucacuuuuuuuagguuaaaaaaaacuuaugguuaccuaaaauugc

SEQ ID NO: 152307 - RNA, 64 nt, Homo Sapiens
cuuaaauggcuaaguuuacuuggagggaauaacuuaaaaaaauagaaaagcucccucaguuuuu

SEQ ID NO: 152308 - RNA, 64 nt, Homo Sapiens
aucauguuugaauuguuuucacuuucaaggacuuuaaaaaaauauuuucucugagaguuuuaau

SEQ ID NO: 152309 - RNA, 64 nt, Homo Sapiens
cccauuaaaaacaaaacaucaaaaaagaaaacuuuaaaaaaacuuuucuuuuuuuuuuuuuuua

SEQ ID NO: 152310 - RNA, 64 nt, Homo Sapiens
aaacuuuaaaaaaacucccauuuuuuuuuuuuuuuaaaaaaagagccguuuguccuuaacuuuc

SEQ ID NO: 152311 - RNA, 64 nt, Homo Sapiens
ucccauaaaacaguagaaacaagauuagcuuuuuuaaaaaaacauuuuuauuuucuuggcacua

SEQ ID NO: 152312 - RNA, 64 nt, Homo Sapiens
uuaaaucauguguauacaauaaacuguuaaaauuuaaaaaaaauuacuuuauuaagauugccaa

SEQ ID NO: 152313 - RNA, 64 nt, Homo Sapiens
cuccaacaaaaauacuuguucucuaucccgcuuauaaaaaaauugagugucuauguuaacuucc

SEQ ID NO: 152314 - RNA, 64 nt, Homo Sapiens
augggaagauuuuuauuuauaauauuuucuuauuuaaaaaaagcguacaaauaacaagacuaau

SEQ ID NO: 152315 - RNA, 64 nt, Homo Sapiens
ugugcaauaauuuuaaaaugaaauaaauaaaaauuaaaaaaaucccucuguuauuguuuaaaaa

SEQ ID NO: 152316 - RNA, 64 nt, Homo Sapiens
aaauaaaaauuaaaaaaaucccucuguuauuguuuaaaaaaaauagguccacaucugugguuga

SEQ ID NO: 152317 - RNA, 64 nt, Homo Sapiens
cuucugauguuuuguagccauagagaagauacauuaaaaaaaauaacuuuuuuuuuaauuacca

SEQ ID NO: 152318 - RNA, 64 nt, Homo Sapiens
aaagaugacaaagaaaaacaugaaaauguuuauuuaaaaaaaaagccuucuuuuggacaaaccu

SEQ ID NO: 152319 - RNA, 64 nt, Homo Sapiens
aaauguggaggaaaguagaaaugauuccuuucuuuaaaaaaaaaagccaucaauauucagcaaa

SEQ ID NO: 152320 - RNA, 64 nt, Homo Sapiens
uguauuuucuaauuuuuauuucuaaagaaaaaaauaaaaaaagucuuuuuaaaaaguuauauuu

SEQ ID NO: 152321 - RNA, 64 nt, Homo Sapiens
aaaccuugcacugauuuugugaacuuaaaguauauaaaaaaaagcguugugcacauguacccua

SEQ ID NO: 152322 - RNA, 64 nt, Homo Sapiens
ugugcccuuuuauaaggaaacuucugauguuuauuaaaaaaacuggccuuuugauagagguaac

SEQ ID NO: 152323 - RNA, 64 nt, Homo Sapiens
uuuuacaguugcagagaauuguuucugggcucauuaaaaaaaguaguauugcagacauugcugc

SEQ ID NO: 152324 - RNA, 64 nt, Homo Sapiens
ccuuaaauuuuaucaauaacagaauuauuguauuuaaaaaaaaacuaauacuuaucuuuaaaau

SEQ ID NO: 152325 - RNA, 64 nt, Homo Sapiens
cuccagccuggugacagagcaagacuccggcucuuaaaaaaaaaaaaaaaaaaaaaaaaagaga

SEQ ID NO: 152326 - RNA, 64 nt, Homo Sapiens
uagaagaacggaucaugugccaacuguaguuuuuuaaaaaaaacgcuccuuuguaggguuuuaa

SEQ ID NO: 152327 - RNA, 64 nt, Homo Sapiens
agccaccacaccuggccuuucugcaacauuuuuuuaaaaaaaucuaauaaaucuuagauuuuua

SEQ ID NO: 152328 - RNA, 64 nt, Homo Sapiens
gcuccuuauugccauacccacgaacuguuaaauauaaaaaaauucaaaguauuugacaucuuaa

SEQ ID NO: 152329 - RNA, 64 nt, Homo Sapiens
agggugcaagugaccaaggccuuaucuugaaaguuaaaaaaaaaaaguaaagaaaucacaguaa

SEQ ID NO: 152330 - RNA, 64 nt, Homo Sapiens
uauuccaaugggcauuuauuuuuuauccugucauuaaaaaaaaaagacuguuauccugcuacac

SEQ ID NO: 152331 - RNA, 64 nt, Homo Sapiens
uugaaacaguacugugcaauccgauggaucuaauuaaaaaaaaggcaauauuuuuauauuaaag

SEQ ID NO: 152332 - RNA, 64 nt, Homo Sapiens
ugugauagagacaucucuaaaguauuuugaauuuuaaaaaaagauggcagauuuucugcauuua

SEQ ID NO: 152333 - RNA, 64 nt, Homo Sapiens
ugugcacauucuaauuaauuaaacuucuuccgucuaaaaaaagugggggaaauguauagcuagu

SEQ ID NO: 152334 - RNA, 64 nt, Homo Sapiens
aaaaggcagaaacauaccuuugacuauaagaaauuaaaaaaaaaacaccaaaauaauauuuuuc

SEQ ID NO: 152335 - RNA, 64 nt, Homo Sapiens
cuagcauuauuuugccaccuuuauauuguauuuauaaaaaaaaaaguacuaucaaucaaucaua

SEQ ID NO: 152336 - RNA, 64 nt, Homo Sapiens
uauccagaagauuaaaaugccuacauugagugcuuaaaaaaaaaaaaacaacugugaugaugug

SEQ ID NO: 152337 - RNA, 64 nt, Homo Sapiens
guuuaacauuuauaauugcaaaauaaaccaacuauaaaaaaagaaacuaagagagaauugguac

SEQ ID NO: 152338 - RNA, 64 nt, Homo Sapiens
auauuaauaaauggauacacauucaaaauacuuuuaaaaaaaagaaaauguuaccaguuuuuuu

SEQ ID NO: 152339 - RNA, 64 nt, Homo Sapiens
uaaaaagacauuacaggcuuaaauuccauuuuauuaaaaaaaaaaaauugccuguaaucccagc

SEQ ID NO: 152340 - RNA, 64 nt, Homo Sapiens
cuuugagccccucucauucccacuuauaaugaaauaaaaaaaaaaauuggauaagaugggacag

SEQ ID NO: 152341 - RNA, 64 nt, Homo Sapiens
ucuuaaagccuguaauuucucccauucuaccauuuaaaaaaaaauuggcuaacugcaugacaug

SEQ ID NO: 152342 - RNA, 64 nt, Homo Sapiens
cuacauuugaaauuauuucauacaaaauuuccuguaaaaaaauaccaguaccuauuuuuacucu

SEQ ID NO: 152343 - RNA, 64 nt, Homo Sapiens
uaaaaaauacauagaauacuacccaaguaaguucuaaaaaaaagacuuaaauuaauuuuuguaa

SEQ ID NO: 152344 - RNA, 64 nt, Homo Sapiens
gauucucuaacagaccucuuaacuuugugcuuuuuaaaaaaaguguacuuuucuugauacuguu

SEQ ID NO: 152345 - RNA, 64 nt, Homo Sapiens
auucagaugagacugagccacaaaccaacacuuuuaaaaaaauaaguuuuuucauuuaauaauu

SEQ ID NO: 152346 - RNA, 64 nt, Homo Sapiens
uuugaucuuuuaauguaacucccaugaugucaauuaaaaaaaguaguguuugccugguacauca

SEQ ID NO: 152347 - RNA, 64 nt, Homo Sapiens
uucaguuucuucauuuuuaauuauuuaaaauauuuaaaaaaauuuauauaaaucaaaguacaca

SEQ ID NO: 152348 - RNA, 64 nt, Homo Sapiens
gauaucauagaaguaaaaaauuauauguggaagcuaaaaaaauuuaaacauugcauguuauuac

SEQ ID NO: 152349 - RNA, 62 nt, Homo Sapiens
aaagaaaagaaaaauaaaaaugucauccaagccauaaaaaaauauuggaucugaaaauaaag

SEQ ID NO: 152350 - RNA, 64 nt, Homo Sapiens
aaaaaaaaaaaauacaacuccuuaaaguauaauuuaaaaaaagcugugcacauguacccuaaaa

SEQ ID NO: 152351 - RNA, 64 nt, Homo Sapiens
ucauuuuuuuggauuccuuugaaaauauccugacuaaaaaaaauuucuuucuuauaacugcaga

SEQ ID NO: 152352 - RNA, 64 nt, Homo Sapiens
ggcaaccaaggaaaauauuuauauuucuccauccuaaaaaaaguucagacauuuuuuccugugg

SEQ ID NO: 152353 - RNA, 64 nt, Homo Sapiens
aaaaaucugccuaugcaugugcaucuauauucuguaaaaaaaaaauauuaaguacagugauaaa

SEQ ID NO: 152354 - RNA, 64 nt, Homo Sapiens
ggaauaauuauaucuaucuuuaucuuuuaaguuuuaaaaaaacuuucuuaauucggcaauggaa

SEQ ID NO: 152355 - RNA, 64 nt, Homo Sapiens
aaaaaacagaaaaagaaaaagaauuaggcagucuuaaaaaaaaaucagacaauggcuauaaacu

SEQ ID NO: 152356 - RNA, 64 nt, Homo Sapiens
uauauauacauaucuuuugaugugauguuacuuguaaaaaaaagcaugugaagaugugaucauu

SEQ ID NO: 152357 - RNA, 64 nt, Homo Sapiens
acaauaaaguaaaaaccgcaguuucugaaggcuuuaaaaaaaaucagaaacucuuagguggaau

SEQ ID NO: 152358 - RNA, 64 nt, Homo Sapiens
uauacagauuccuguuguguacacaaaaaaauaauaaaaaaauaauucuuuuguuauuaaaaaa

SEQ ID NO: 152359 - RNA, 64 nt, Homo Sapiens
caaaaaaauaauaaaaaaauuauucuuuuguuauuaaaaaaacauagucaauauggggcauuaa

SEQ ID NO: 152360 - RNA, 64 nt, Homo Sapiens
auacuuuacuuggauauucacuguguguugaauuuaaaaaaaaaaaacaauguauauuauguuc

SEQ ID NO: 152361 - RNA, 64 nt, Homo Sapiens
caauguauauuauguuccugauuaaccuuuuuuuuaaaaaaaaagaagaugaaaucauuccuaa

SEQ ID NO: 152362 - RNA, 64 nt, Homo Sapiens
uauauguuacccugaaaagagaauaagacuuacuuaaaaaaaugaauuaugaccuguuaggcug

SEQ ID NO: 152363 - RNA, 64 nt, Homo Sapiens
cacaucucuguaaacaaccuuuuuuaaguaauuuuaaaaaaaauaaacacucugcuuacuacuu

SEQ ID NO: 152364 - RNA, 64 nt, Homo Sapiens
auccuuuuuuaaaaguaaauguacaggaugccaguaaaaaaaaaaaauggcuucagaauuaaaa

SEQ ID NO: 152365 - RNA, 64 nt, Homo Sapiens
agugccugauaagcuucaaagcugcuuuauucaauaaaaaaaagaaaugaaaaagauauaugaa

SEQ ID NO: 152366 - RNA, 64 nt, Homo Sapiens
uauauguauauauaugcacauauauauauguauuuaaaaaaaucaaaacaaaaaaaaacucauu

SEQ ID NO: 152367 - RNA, 64 nt, Homo Sapiens
uuaauaaaguauaagugauguuuuauaugauuuuuaaaaaaaauucucaagugcaauguguuuu

SEQ ID NO: 152368 - RNA, 64 nt, Homo Sapiens
cucaucaaaagugugugaauuuuaaaacaaauucuaaaaaaacuauagugcuaaauugguaacu

SEQ ID NO: 152369 - RNA, 64 nt, Homo Sapiens
aaugcaguagaaaguagugguaauaauuccuuuuuaaaaaaauuucgguagucauauaguaaca

SEQ ID NO: 152370 - RNA, 64 nt, Homo Sapiens
gagacagacugaauauaucuaaaauuuccagcaauaaaaaaaaaagcauuuaacuugcaccaag

SEQ ID NO: 152371 - RNA, 64 nt, Homo Sapiens
auuuagaccccucucaguuaagaaaugcuuagauuaaaaaaaaaaaauuacguaggauuaauac

SEQ ID NO: 152372 - RNA, 64 nt, Homo Sapiens
uaguucucaauugaugacaguguuugaaucaucauaaaaaaaauaccugcuuuucaucuggaca

SEQ ID NO: 152373 - RNA, 64 nt, Homo Sapiens
cuucaggcuuuuagcucuccucaaaguuugagguuaaaaaaauguuaaaagaugugaguuaaag

SEQ ID NO: 152374 - RNA, 64 nt, Homo Sapiens
uccaaggugcagugcacugugaaucuuuuauuuuuaaaaaaauuuguaggugcuuuuauguaua

SEQ ID NO: 152375 - RNA, 64 nt, Homo Sapiens
ucagaauauuaagaaaaugaaguaacugauuuucuaaaaaaaaaaaaaaaaaaaauuucuacau

SEQ ID NO: 152376 - RNA, 64 nt, Homo Sapiens
acugucugugaaauaauguaagaagcuuuucacuuaaaaaaaaugcauuacuuucacuuaacac

SEQ ID NO: 152377 - RNA, 64 nt, Homo Sapiens
cuguacuuuuaccaguuucuuugucccaccaacuuaaaaaaaaaaaguacaauucauuguuuug

SEQ ID NO: 152378 - RNA, 64 nt, Homo Sapiens
augcuauauaucuuuuguaagacauuuccuuuuuuaaaaaaauuuuugcaaauaacugaucuca

SEQ ID NO: 152379 - RNA, 64 nt, Homo Sapiens
uauaaauaauuuuucacauuguauuguugcuauauaaaaaaaauaauagaauugguuggguuuc

SEQ ID NO: 152380 - RNA, 64 nt, Homo Sapiens
uucagugugaauaguguuuaaguugaaaauauuguaaaaaaauuauauuuuuucaaaaauauuu

SEQ ID NO: 152381 - RNA, 64 nt, Homo Sapiens
uauuguaaaaaaauuauauuuuuucaaaaauauuuaaaaaaauaaauaauaguagaacugagca

SEQ ID NO: 152382 - RNA, 64 nt, Homo Sapiens
caccuuucgcuguuuguuguuucauagauuuauuuaaaaaaagagaaagucuauagcuauaaau

SEQ ID NO: 152383 - RNA, 64 nt, Homo Sapiens
ggcauuaauauaaaagagguaggagucuguuauuuaaaaaaagcauuaaauuuaaaaaaaaacu

SEQ ID NO: 152384 - RNA, 64 nt, Homo Sapiens
guaggagucuguuauuuaaaaaaagcauuaaauuuaaaaaaaaacugucuugucuacuuuuagc

SEQ ID NO: 152385 - RNA, 64 nt, Homo Sapiens
guuuugucaaacuucccacugcaaugccuuuauuuaaaaaaauugucuacuuaucuaaauauuc

SEQ ID NO: 152386 - RNA, 64 nt, Homo Sapiens
aauaaaacuguuaaaucauggccugauaucaucuuaaaaaaaaaucucagaaucugaaauaagc

SEQ ID NO: 152387 - RNA, 64 nt, Homo Sapiens
aggaauagggaacuaauuuaugaaacagccaucuuaaaaaaaaaaaaaguaaacugcaaaagua

SEQ ID NO: 152388 - RNA, 64 nt, Homo Sapiens
aaagaaaaaauuaaaaagaaucaguuuuuuuaauuaaaaaaauagaaagcuguuaggcuccuaa

SEQ ID NO: 152389 - RNA, 64 nt, Homo Sapiens
uugaaguaguuuuuucauguuuaauuuguauuuguaaaaaaacaaaaagcaaaaaaauucccaa

SEQ ID NO: 152390 - RNA, 64 nt, Homo Sapiens
cuauuuaucuuugauuucagucuuggcaauuguuuaaaaaaaaaaucuagauuuguuuuauuag

SEQ ID NO: 152391 - RNA, 64 nt, Homo Sapiens
aucccucaaaaaguuaccaccacaucagaaaaaauaaaaaaaaaauaguaaaguaggcagagcu

SEQ ID NO: 152392 - RNA, 64 nt, Homo Sapiens
aauuuaguuguaacauagaaaaugaaaaaacaguuaaaaaaagugaaguaguugcaaaguguuu

SEQ ID NO: 152393 - RNA, 64 nt, Homo Sapiens
uucgcaugaaaaugacagauaacacuguaguuccuaaaaaaaaaauuaaaugcauaagcauaag

SEQ ID NO: 152394 - RNA, 64 nt, Homo Sapiens
ucucaauguaucagcuuuuuagaucugagaagauuaaaaaaaaauuugcagugguuucagaggc

SEQ ID NO: 152395 - RNA, 64 nt, Homo Sapiens
aauauuuuaaagauauaaauagacugaaagaaccuaaaaaaaaauugauuuagucagaauuccu

SEQ ID NO: 152396 - RNA, 64 nt, Homo Sapiens
auagacacgguucacuaaaucagguuuuuuccuuuaaaaaaauuuuuuucuaaguuuuggaaag

SEQ ID NO: 152397 - RNA, 64 nt, Homo Sapiens
aaccaguuuuuacaacuacuuuuguauuuauuuuuaaaaaaauauaauguuuuauauuuauauu

SEQ ID NO: 152398 - RNA, 64 nt, Homo Sapiens
aaaauguacaugugauguuaucuguacauuaaauuaaaaaaacaaauuuuacaguauauccugu

SEQ ID NO: 152399 - RNA, 64 nt, Homo Sapiens
aaacuuagagcacaauaaucacaacucuaaaaaauaaaaaaaaaucgugucauugugauauuug

SEQ ID NO: 152400 - RNA, 64 nt, Homo Sapiens
agaccaguaacuuuguuuuuucuaguguuaggaauaaaaaaaaauuugaugagcaaaaucuacu

SEQ ID NO: 152401 - RNA, 64 nt, Homo Sapiens
uaaugcuuauguauaaacauguauacauuuuuauuaaaaaaaugaccaaaacagugccccaccu

SEQ ID NO: 152402 - RNA, 64 nt, Homo Sapiens
ccaagccuuccaccaaaacaagcucuaaacucauuaaaaaaacuuaacucagugguuaucuaau

SEQ ID NO: 152403 - RNA, 64 nt, Homo Sapiens
uagcugcaggucuuugguccaagauauauaaauuuaaaaaaacaagaaaacuauaaaauacuua

SEQ ID NO: 152404 - RNA, 64 nt, Homo Sapiens
uauguucagaacuucaucugugagguauuauauuuaaaaaaaacacuuuuauuauuaaauguau

SEQ ID NO: 152405 - RNA, 64 nt, Homo Sapiens
gccuaucaguauuaugggcaagaaaacaaagcauuaaaaaaaaauuaaaaacaauacaaguuuu

SEQ ID NO: 152406 - RNA, 64 nt, Homo Sapiens
uuguggcagaauuaaauuucucaguacuuugcuuuaaaaaaauuaggaaucuuggauugggaau

SEQ ID NO: 152407 - RNA, 64 nt, Homo Sapiens
cgagcuacaaagaaagaaugaaaauguucuaagauaaaaaaacuaagaaaacaccgacagcugu

SEQ ID NO: 152408 - RNA, 64 nt, Homo Sapiens
ucaaagaaagaaggccacguuccaaauuugucauuaaaaaaaaaauuuaacaaucuccauguag

SEQ ID NO: 152409 - RNA, 64 nt, Homo Sapiens
caauaauuuggaaaaacccauucacuugaaaaacuaaaaaaaaauuuauguauuaauauaugca

SEQ ID NO: 152410 - RNA, 64 nt, Homo Sapiens
aaaaaaaaaaacaaggggaaagauaaagcaaaaguaaaaaaaaauuuggaaagaaguucauuga

SEQ ID NO: 152411 - RNA, 64 nt, Homo Sapiens
cagaagcaggaaaaccaauuaguauuuuauaauuuaaaaaaauagccacacaugguuuauuuga

SEQ ID NO: 152412 - RNA, 64 nt, Homo Sapiens
gacucuugucuaauauucgucccuuuuuuuaauuuaaaaaaaaucauaaagaaccucucuaugu

SEQ ID NO: 152413 - RNA, 64 nt, Homo Sapiens
ugugaaauuaacaugcuuguuauuaagaaucuuuuaaaaaaaucguauuucuaauuauauaaaa

SEQ ID NO: 152414 - RNA, 64 nt, Homo Sapiens
uguggaguuggagggcuaacaggaccauaccuauuaaaaaaaaaggaucagagaccauuaaaag

SEQ ID NO: 152415 - RNA, 64 nt, Homo Sapiens
gauuuuacauaaugccuacuuggggaugaucacuuaaaaaaacauuguuccaauuggcauacuc

SEQ ID NO: 152416 - RNA, 64 nt, Homo Sapiens
aaaccacuuguuuauucaguauuucaucauugauuaaaaaaagacauugacuauuuucaucaua

SEQ ID NO: 152417 - RNA, 64 nt, Homo Sapiens
aaaauuaauaagacauggaugagacccccaucucuaaaaaaaaaaccagacuggccaacacagc

SEQ ID NO: 152418 - RNA, 64 nt, Homo Sapiens
aucaacuguucuuacucuagccaucacuaauuguuaaaaaaagacuggccaucugaauacuccc

SEQ ID NO: 152419 - RNA, 64 nt, Homo Sapiens
uaacuaguacuaaucauuguccuuuuuaucaucuuaaaaaaagauuauguccauuggauacuuu

SEQ ID NO: 152420 - RNA, 64 nt, Homo Sapiens
uuugaccauuuuuauguccaaaauugaccugcaguaaaaaaaccauauuuuuuggucgggggaa

SEQ ID NO: 152421 - RNA, 64 nt, Homo Sapiens
guaauuauuccaacacccaucugccaugcgauguuaaaaaaaaaaaaaaggaagaaaaauaaca

SEQ ID NO: 152422 - RNA, 64 nt, Homo Sapiens
ccuuuauuccaagagguauuuauuuuuucacuuguaaaaaaauaauguuuccacguaaagaacu

SEQ ID NO: 152423 - RNA, 58 nt, Homo Sapiens
aggagaaacacaggaaaugaaaaauuuuuaaaaaaagaaggaaaaauguuuuaaauac

SEQ ID NO: 152424 - RNA, 64 nt, Homo Sapiens
uauauuagguagaauacacauacaaucaaaauuuuaaaaaaaaaagcuaaauaacuuaaaaaaa

SEQ ID NO: 152425 - RNA, 64 nt, Homo Sapiens
caaucaaaauuuuaaaaaaaaaagcuaaauaacuuaaaaaaaaacugaggcguacaacggagca

SEQ ID NO: 152426 - RNA, 64 nt, Homo Sapiens
cccagaggaacuuagggauuucaccccuggcuuuuaaaaaaaacgaaauaccgacaagccacaa

SEQ ID NO: 152427 - RNA, 64 nt, Homo Sapiens
aaaauuaagaaaaaaaucaaaaaaggaagaaaacuaaaaaaaaaaaaaaucaaaucaccuugug

SEQ ID NO: 152428 - RNA, 64 nt, Homo Sapiens
gguucuuuuuaauguuuauacuuagauuuucuuuuaaaaaaauuaaaauaaaacaaaaaaaaau

SEQ ID NO: 152429 - RNA, 64 nt, Homo Sapiens
ggcugauguugguauuggguguaggaacaugauuuaaaaaaaaacucuugccucugcuuucccc

SEQ ID NO: 152430 - RNA, 64 nt, Homo Sapiens
agagagagagauguaauuuaaagagccuugauuuuaaaaaaaaaaaaaaaagauuuugacauaa

SEQ ID NO: 152431 - RNA, 64 nt, Homo Sapiens
uuuugacauaaaagagccuuaucuaaaauauagcuaaaaaaagagggggggauguuaaauguua

SEQ ID NO: 152432 - RNA, 64 nt, Homo Sapiens
auggcuaacuaguguguuuucucugaauaggcauuaaaaaaaauguuacugggacacuuuuaaa

SEQ ID NO: 152433 - RNA, 64 nt, Homo Sapiens
caacuuccagaaaauguuuaccaauaagaacccuuaaaaaaaaacaauuuaauaaauaguaaau

SEQ ID NO: 152434 - RNA, 64 nt, Homo Sapiens
ggagaauguuuucucucaaauuucuauaaucuauuaaaaaaaauaaacuauugaaaaauuaaua

SEQ ID NO: 152435 - RNA, 64 nt, Homo Sapiens
guuaugaaaucuuagccacaauucaagggcuaauuaaaaaaauaaacacuuauagccuuaaacc

SEQ ID NO: 152436 - RNA, 64 nt, Homo Sapiens
guacuuuuauuucauguaaaaaacuuucuccuguuaaaaaaauuccccccugagcucuaguuuu

SEQ ID NO: 152437 - RNA, 64 nt, Homo Sapiens
ucaguggaaauaaaugaucagaucucagagugauuaaaaaaaaauuuaaaaaacaagaaugcau

SEQ ID NO: 152438 - RNA, 64 nt, Homo Sapiens
accaugaauuacgaagcacccugaugcauuucauuaaaaaaaaaguuuguuuguagauguuugu

SEQ ID NO: 152439 - RNA, 64 nt, Homo Sapiens
aucugguaucaacccacauuuucguuucacaaauuaaaaaaaaaccauugaaaauaguacuuuc

SEQ ID NO: 152440 - RNA, 64 nt, Homo Sapiens
uuuuauaaguagggagaaauucuuuaaagugcuuuaaaaaaaagauuuguggguuuugaaugca

SEQ ID NO: 152441 - RNA, 64 nt, Homo Sapiens
uugaacuuaaaaauaacagacugaacuuaaaaguuaaaaaaaagcacuuccugcgcauguaccc

SEQ ID NO: 152442 - RNA, 64 nt, Homo Sapiens
auuguucagccauaaagaaaaaaacauccuuuuuuaaaaaaagaucuguacacaauuccuccua

SEQ ID NO: 152443 - RNA, 64 nt, Homo Sapiens
aaaucauuuagaugcacuuuaaagacauuguuuuuaaaaaaaaaaagucagcauaugaggaauu

SEQ ID NO: 152444 - RNA, 64 nt, Homo Sapiens
augcuucaugaauuucuccuacugcagaaaccuuuaaaaaaaaauaccuuugaacuuucauagc

SEQ ID NO: 152445 - RNA, 64 nt, Homo Sapiens
cugacuauucccauuugucaaauuaaacuguaccuaaaaaaacuuguuuacuuuuuauauuaag

SEQ ID NO: 152446 - RNA, 64 nt, Homo Sapiens
aucccuaaaaacucucuauauuucacuucaaaaauaaaaaaaaacuauaaguauguacauacag

SEQ ID NO: 152447 - RNA, 64 nt, Homo Sapiens
aaaaaaaacaaaaaaaaaccggguuuauuuuauguaaaaaaaaaccaguggacgggugugcuaa

SEQ ID NO: 152448 - RNA, 64 nt, Homo Sapiens
aaagucccaauuaagaaccuagcgaaauucugucuaaaaaaacaacuccagccuggacaacaag

SEQ ID NO: 152449 - RNA, 64 nt, Homo Sapiens
uaugcacuauagaagggaauaaggacaaauuguguaaaaaaaccccccuucucugaaaugggua

SEQ ID NO: 152450 - RNA, 64 nt, Homo Sapiens
caaguagcugaugugcaguucaaacacauauucauaaaaaaaauagcaacuucccuggggaagc

SEQ ID NO: 152451 - RNA, 64 nt, Homo Sapiens
augccuaugcaacuucaaauuuuacaaaauggauuaaaaaaaaacucaagguuccauaguaucu

SEQ ID NO: 152452 - RNA, 64 nt, Homo Sapiens
aaguuaucguagccagccugauuugaauuuuuuuuaaaaaaagaguggcuugauguugauacac

SEQ ID NO: 152453 - RNA, 64 nt, Homo Sapiens
aaaaccgacaaaguuacgagaguuagaaaaacuuuaaaaaaaaauacugauucuggaacaaaac

SEQ ID NO: 152454 - RNA, 64 nt, Homo Sapiens
acacuuucugcucauaucaucucuccucuucuuuuaaaaaaagauuguugccuuuccaagugac

SEQ ID NO: 152455 - RNA, 64 nt, Homo Sapiens
aaaaaaaaaaaaaaaaaggcuucaugcaguaggauaaaaaaaaagaaugccagaaauuugucag

SEQ ID NO: 152456 - RNA, 64 nt, Homo Sapiens
guuuuucaaaugucaccaaucauuaauaguauuuuaaaaaaauugagaaacacagcauacuguu

SEQ ID NO: 152457 - RNA, 64 nt, Homo Sapiens
aagcuuugccaauagcuaaagcuuaagaaggaauuaaaaaaaaaaguuuaacacuugagcaaau

SEQ ID NO: 152458 - RNA, 64 nt, Homo Sapiens
uugauucaauuuuaugguaaagugauacugaggguaaaaaaaaaagaaaaaaggaaaaguagau

SEQ ID NO: 152459 - RNA, 64 nt, Homo Sapiens
uguauugugauuuucaauuuguuagguuuuaacuuaaaaaaaauaugaauguuaguuagaaaau

SEQ ID NO: 152460 - RNA, 64 nt, Homo Sapiens
uuacuuuuuauuaugaguuaauauaguuuagcaguaaaaaaaaaaaaaaaaaccacaccuaaaa

SEQ ID NO: 152461 - RNA, 64 nt, Homo Sapiens
aauaaauuuuaaucucuguuaaucuuaccugcuuuaaaaaaaaguucuuguguguucguaucuu

SEQ ID NO: 152462 - RNA, 64 nt, Homo Sapiens
cuugguaauacagagauggacaaucguacugggguaaaaaaacccugcugaagagaggacagug

SEQ ID NO: 152463 - RNA, 64 nt, Homo Sapiens
aaucagcagugaaucaucuugcagcuaugcaauuuaaaaaaaauacagauuaccaauuucaagu

SEQ ID NO: 152464 - RNA, 64 nt, Homo Sapiens
gcuaaauuugcauauaccaucuaaaauccuuuuuuaaaaaaauuuaauguaauaaagauucaug

SEQ ID NO: 152465 - RNA, 64 nt, Homo Sapiens
guaaacauugcagguuuaaacauaaaggagucuuuaaaaaaaaaucauuuacguuggaauuuua

SEQ ID NO: 152466 - RNA, 64 nt, Homo Sapiens
guucaaaguuugcuuaguuacaacaaagcaccuuuaaaaaaaauacauuuuaaaaaaacauucc

SEQ ID NO: 152467 - RNA, 64 nt, Homo Sapiens
guuacaacaaagcaccuuuaaaaaaaauacauuuuaaaaaaacauuccaagccaauuggaagac

SEQ ID NO: 152468 - RNA, 64 nt, Homo Sapiens
uccuaaguauaaaugguugucuguuuuuguaacuuaaaaaaaaaaaaaaaaguuuggccgggug

SEQ ID NO: 152469 - RNA, 64 nt, Homo Sapiens
cacuccggccugaugacagagcgagauuccgucuuaaaaaaaaaaaaaaaaaaguuuguuuuua

SEQ ID NO: 152470 - RNA, 64 nt, Homo Sapiens
ccgucuuaaaaaaaaaaaaaaaaaaguuuguuuuuaaaaaaaucuaaauaaaauaacuuugccc

SEQ ID NO: 152471 - RNA, 64 nt, Homo Sapiens
uuauccaaaagauuuuuaaaaauagggcuguguuuaaaaaaaaaaaacaaaacaagaaaagcag

SEQ ID NO: 152472 - RNA, 64 nt, Homo Sapiens
uggaguuaauuuguuuuacaggaauuuuguuuuuuaaaaaaauaggaucauucugaacuuugga

SEQ ID NO: 152473 - RNA, 64 nt, Homo Sapiens
aucacugccucauucuuauuuauauauaacccuuuaaaaaaaaauuacacugaucuaaaggaca

SEQ ID NO: 152474 - RNA, 64 nt, Homo Sapiens
aaauuagacuccaccuuaagaagcacugauaaauuaaaaaaaaaaagcuauuuugaagauuuuu

SEQ ID NO: 152475 - RNA, 64 nt, Homo Sapiens
uaaacagaagagcacccugaacaguuacacuuaauaaaaaaaauccuauauaaaaaucauuggc

SEQ ID NO: 152476 - RNA, 64 nt, Homo Sapiens
gcauugcaaaugcuuuagaagauuuuugucugaauaaaaaaaaauuguuacguaaaguuaaaau

SEQ ID NO: 152477 - RNA, 64 nt, Homo Sapiens
aaagcauauuuguuacguaauaucuugaaaguuguaaaaaaauuugucaguacagcuauaauag

SEQ ID NO: 152478 - RNA, 64 nt, Homo Sapiens
uaagugcguguguagaguuauaacguuuuuccuuuaaaaaaauugaucaugguguaauaagaca

SEQ ID NO: 152479 - RNA, 64 nt, Homo Sapiens
ugccuuugagacaguuucuuuggaggaaggauuguaaaaaaaaauuaauaacauuaccuuacug

SEQ ID NO: 152480 - RNA, 64 nt, Homo Sapiens
ugaaauuaacauccaguggacaucaagcauacaauaaaaaaaaccuuggaauugucucuaaaug

SEQ ID NO: 152481 - RNA, 64 nt, Homo Sapiens
agaaaaucauucuguuuccugcagggaauaauaauaaaaaaaaauuagauggaaaaugcuauug

SEQ ID NO: 152482 - RNA, 64 nt, Homo Sapiens
gauuaugaugcagaauauugaaauuaggcuuuuuuaaaaaaauagggaaauaauuguguacaua

SEQ ID NO: 152483 - RNA, 64 nt, Homo Sapiens
guuuugcauggaaccuggacuggauccauuuuuuuaaaaaaaugcuaagaauacagaaccaaau

SEQ ID NO: 152484 - RNA, 64 nt, Homo Sapiens
uauauucucacacauuucuucuucccucuugugguaaaaaaaauacuacuguaaaagauuuuug

SEQ ID NO: 152485 - RNA, 64 nt, Homo Sapiens
aaucauccaacuucuuugcaggaaaguaaaaaaguaaaaaaauacuuuugaagaauuuauauuu

SEQ ID NO: 152486 - RNA, 64 nt, Homo Sapiens
uuccaaauauuuguggguccgaacauuuuuaauuuaaaaaaaauagcucaaagcaauuaagugg

SEQ ID NO: 152487 - RNA, 64 nt, Homo Sapiens
cuagauuauaacaaacugcuuguaauucaucuguuaaaaaaaaugguauaaguagcugccaauu

SEQ ID NO: 152488 - RNA, 64 nt, Homo Sapiens
cuacuaacaccaccacaaauuucaaaagaaauuuuaaaaaaaucucucuggaucuuauuugcaa

SEQ ID NO: 152489 - RNA, 64 nt, Homo Sapiens
acauacagacacucaaauucuccaaacaaacaauuaaaaaaaaaaauuagcuuaucaacucccc

SEQ ID NO: 152490 - RNA, 64 nt, Homo Sapiens
gaauaaauugugaagaacugauauggugugugauuaaaaaaaauuaaaaaaaugcauugaaacc

SEQ ID NO: 152491 - RNA, 64 nt, Homo Sapiens
cauugaaaccauauggugugucuuuugaauugaauaaaaaaauggaaaaguuaacuuguuaaau

SEQ ID NO: 152492 - RNA, 64 nt, Homo Sapiens
uacugguauuuauuugguuauaugaagagaacaguaaaaaaaauccucuaucucuguacuccua

SEQ ID NO: 152493 - RNA, 64 nt, Homo Sapiens
aucacaucaguauaggccauaaaacaauuaucuuuaaaaaaaaaucaaguaaguguggguagca

SEQ ID NO: 152494 - RNA, 64 nt, Homo Sapiens
auacaaaucagaauaguacucuccaauauuugguuaaaaaaacucugagguaauauuaugguaa

SEQ ID NO: 152495 - RNA, 64 nt, Homo Sapiens
ucuaguauagcacuacauucuaccuaaauuuucuuaaaaaaaaauucauacccuacuuuuucug

SEQ ID NO: 152496 - RNA, 64 nt, Homo Sapiens
uacaaaaaaaaagcaccaugcagaauuaucuuauuaaaaaaaaauaagccgagagcugucuuug

SEQ ID NO: 152497 - RNA, 64 nt, Homo Sapiens
agauuauauuaaaauuuaaagucuaugggcugguuaaaaaaaacuguauaugcuuauauauuaa

SEQ ID NO: 152498 - RNA, 64 nt, Homo Sapiens
aauuuaaugcccuaacucucacacaugaauuucuuaaaaaaaucagauaauacaaucuacuuac

SEQ ID NO: 152499 - RNA, 64 nt, Homo Sapiens
aaaaaaaaaaaaaaaaaaaaaacagcuccaccgguaaaaaaaaacuccacaacuccuuggcuua

SEQ ID NO: 152500 - RNA, 64 nt, Homo Sapiens
gggugauucugaggcacugaccuccauucucuuuuaaaaaaaggugcuuggccuccaguagcug

SEQ ID NO: 152501 - RNA, 64 nt, Homo Sapiens
aagguacacguuguccuuuuguuuucccagccuauaaaaaaagggagcuuuguuaauuuucaau

SEQ ID NO: 152502 - RNA, 64 nt, Homo Sapiens
aauugcucuaucagcugacuuuucaggguauccuuaaaaaaaaacacacacgaaaaacaaaagu

SEQ ID NO: 152503 - RNA, 64 nt, Homo Sapiens
cagcaaauuuauaucaccaucuuagaaugguauauaaaaaaauugaacuguuuaugauaccaaa

SEQ ID NO: 152504 - RNA, 64 nt, Homo Sapiens
gacagcuaaucucucuagggacuauuuggugguuuaaaaaaagggucagacuuuuaaacacucu

SEQ ID NO: 152505 - RNA, 64 nt, Homo Sapiens
ucugcguugugugaaauguccaucuuaguuuuguuaaaaaaaaaaaaaaaaaaaggaaacagcc

SEQ ID NO: 152506 - RNA, 64 nt, Homo Sapiens
auauaauaagcucuugugccuuguaugcacuauuuaaaaaaaguuuuuuuuauuugaguccagu

SEQ ID NO: 152507 - RNA, 64 nt, Homo Sapiens
ccagaccggaaccuauagcuacugcuagaagucuuaaaaaaaccaacagcagcacaggauguau

SEQ ID NO: 152508 - RNA, 64 nt, Homo Sapiens
auuucuuguaauggcaccucaaauuuuauacucuuaaaaaaaaacaauaauuugugaauuacca

SEQ ID NO: 152509 - RNA, 64 nt, Homo Sapiens
acuuuuuaaguccugagugcuuacagguaguuguuaaaaaaauuuuaaggccaggcaugguggc

SEQ ID NO: 152510 - RNA, 64 nt, Homo Sapiens
aaggcaaggcacaacaaaaaaauauccugggcaauaaaaaaaauauuuuaaaccagcuuuggag

SEQ ID NO: 152511 - RNA, 64 nt, Homo Sapiens
guucccgugauugcaguaaaaauauuuacuauucuaaaaaaaugagaauugaagacuuagccag

SEQ ID NO: 152512 - RNA, 64 nt, Homo Sapiens
agugagcuaugauugcaccacuguacuccugccuuaaaaaaaaaaaaaaaaucccaauagucca

SEQ ID NO: 152513 - RNA, 64 nt, Homo Sapiens
uaccccccaacuuuuuuagagacagccugucucuuaaaaaaaaaauuaauuugguagugagagc

SEQ ID NO: 152514 - RNA, 64 nt, Homo Sapiens
ugugaaaaugcucaaaguuuuggcgagagugauauaaaaaaacugacuguggcugaaagaauug

SEQ ID NO: 152515 - RNA, 64 nt, Homo Sapiens
uuugccuauggugugaaauccuuuguuauuuuucuaaaaaaauaaaauuuaaaaagaaagaaaa

SEQ ID NO: 152516 - RNA, 64 nt, Homo Sapiens
ucaguguguaggagugaagacaggaucccgugcuuaaaaaaauaaaaaauaaaaaaauaaaaaa

SEQ ID NO: 152517 - RNA, 64 nt, Homo Sapiens
gaagacaggaucccgugcuuaaaaaaauaaaaaauaaaaaaauaaaaaaaaaauaagacuuuaa

SEQ ID NO: 152518 - RNA, 64 nt, Homo Sapiens
gaucccgugcuuaaaaaaauaaaaaauaaaaaaauaaaaaaaaaauaagacuuuaacugcaguu

SEQ ID NO: 152519 - RNA, 64 nt, Homo Sapiens
aaaccccauuuuccuaaagaacaaaguaguaaaauaaaaaaaaauuuaaaaaauuaaaaaauaa

SEQ ID NO: 152520 - RNA, 64 nt, Homo Sapiens
aguaaaauaaaaaaaaauuuaaaaaauuaaaaaauaaaaaaaagaggucacuaaaagaccaaga

SEQ ID NO: 152521 - RNA, 64 nt, Homo Sapiens
aacuaacuaacuaacugugucccuaauuuuucuauaaaaaaacaggcuauguguaaauguagaa

SEQ ID NO: 152522 - RNA, 64 nt, Homo Sapiens
uuucggcaucgacacggacguccaaaaaaagauuuaaaaaaagagccuccguccaaaagauucc

SEQ ID NO: 152523 - RNA, 64 nt, Homo Sapiens
aaccucacuuuuaacucucuuuuugccacaccuguaaaaaaaaaugcuuucuuuguaauaagua

SEQ ID NO: 152524 - RNA, 64 nt, Homo Sapiens
aagucugugacaaaacgguguccgugaauauauuuaaaaaaaaauuucaagaucuuucugguaa

SEQ ID NO: 152525 - RNA, 64 nt, Homo Sapiens
ugcuugauauugugaaaaggccuuauacuaagguuaaaaaaauauauuucuuggauuuauagua

SEQ ID NO: 152526 - RNA, 64 nt, Homo Sapiens
aagcaacaaaagaaaaugcauaugucugcauguuuaaaaaaaaaugugcuauccagauuuuuua

SEQ ID NO: 152527 - RNA, 64 nt, Homo Sapiens
aaaauguauguggaauucuguuuuuauaacuuaguaaaaaaaaacuuuggugaugggguuuuuu

SEQ ID NO: 152528 - RNA, 64 nt, Homo Sapiens
aaaaaaaaaaaaaaaaaagagaauuuacuuuucuuaaaaaaaaagaaaggacugugagcaagau

SEQ ID NO: 152529 - RNA, 64 nt, Homo Sapiens
aaacaaaaauauuuuuccccaacauuuuauuuuuuaaaaaaaagcaauuuucucccauugugcg

SEQ ID NO: 152530 - RNA, 64 nt, Homo Sapiens
uaaaaagaaaaaaagaagccuuaagacucugucuuaaaaaaaacaaagagccugggcaauuuuu

SEQ ID NO: 152531 - RNA, 64 nt, Homo Sapiens
gccugggcaauuuuuuuaaguuuuuuaagacucuuaaaaaaagaacuccagccugggcaagagu

SEQ ID NO: 152532 - RNA, 64 nt, Homo Sapiens
ucuauauauacuguaaaauuucagaauauuuuuuuaaaaaaaauauuacuuauauaaaaacagu

SEQ ID NO: 152533 - RNA, 64 nt, Homo Sapiens
acauuugauuacuuauauaaaaaggaguuucauuuaaaaaaauacauauccuccucuagccugu

SEQ ID NO: 152534 - RNA, 64 nt, Homo Sapiens
aaauguguauugauuucuaauugaaguaccagcauaaaaaaaugaaaugacuacuuugaaauag

SEQ ID NO: 152535 - RNA, 64 nt, Homo Sapiens
aaaaaaaaaaaaaaaaagggugccuuagcuugguuaaaaaaaaaauccuugaaauuucugguag

SEQ ID NO: 152536 - RNA, 64 nt, Homo Sapiens
cagaaagaaaaauauuucugaguauauaucucuuuaaaaaaaaagggugggagguuuuuagaag

SEQ ID NO: 152537 - RNA, 64 nt, Homo Sapiens
uugguuauuaaugaaguugguguaucugcucuaauaaaaaaaaguaauguacaguuuucacaac

SEQ ID NO: 152538 - RNA, 64 nt, Homo Sapiens
auaauaaaauauuuaaucuugaaagcugguuuuuuaaaaaaauaccuauagcuccuuacgcugg

SEQ ID NO: 152539 - RNA, 64 nt, Homo Sapiens
cccuauucuuggaaaauacaauacuuugauuaaguaaaaaaaaucagucaaucagauaagaagu

SEQ ID NO: 152540 - RNA, 64 nt, Homo Sapiens
aauagagguauauugccaaaccagaaaguaauguuaaaaaaaaagcuugaaauaucuuguuaug

SEQ ID NO: 152541 - RNA, 64 nt, Homo Sapiens
uaacugcuuaaaaguaaaguuaaaaaauaaaaguuaaaaaaauuuuuauuuuuagcccauuguu

SEQ ID NO: 152542 - RNA, 64 nt, Homo Sapiens
auccagccucauaaaguagauaaauuagcuuuucuaaaaaaaaacuagcuauuucuaaauauuu

SEQ ID NO: 152543 - RNA, 64 nt, Homo Sapiens
caugaaaacuugcuguacauagaaaucuauuuauuaaaaaaagauuaaauauauacugacuccu

SEQ ID NO: 152544 - RNA, 64 nt, Homo Sapiens
uaagugaagauggaaggcugggcuuaaucuuguuuaaaaaaaugauuuaaucccuucaauuugg

SEQ ID NO: 152545 - RNA, 64 nt, Homo Sapiens
uuuaaguauauccuuuaaaguauuuuccucugcuuaaaaaaaaugucauugguaaauaguaguc

SEQ ID NO: 152546 - RNA, 64 nt, Homo Sapiens
guuacauuaguuuuaaaauaauaguuucuuuuuuuaaaaaaaugaaaaucauuuucuuguuuaa

SEQ ID NO: 152547 - RNA, 64 nt, Homo Sapiens
cagaggaaaggaggcugccagugugugccaucgguaaaaaaaaugaaacaggcccaccccugaa

SEQ ID NO: 152548 - RNA, 64 nt, Homo Sapiens
gaaaagagaaagcaagagacuuuuguuugcauauuaaaaaaagaucauuuucauuuuugcauuu

SEQ ID NO: 152549 - RNA, 64 nt, Homo Sapiens
ucuuucugauguuguguuguguagcgaaugaaguuaaaaaaaugucaaccaguucgugacuguu

SEQ ID NO: 152550 - RNA, 64 nt, Homo Sapiens
cuucauagagccugccuuauuuaugaagaccuauuaaaaaaauaauucaauagcuuguaauguc

SEQ ID NO: 152551 - RNA, 64 nt, Homo Sapiens
guaacugaaauauaaucagaaacauuaaagccuguaaaaaaaaauugcugcguuuuugguaaag

SEQ ID NO: 152552 - RNA, 64 nt, Homo Sapiens
auauaacagaagccauccugaaaugaaacuagucuaaaaaaauucauuguucuacuuaguugca

SEQ ID NO: 152553 - RNA, 64 nt, Homo Sapiens
auugcuucuguuuauuaaaauugaccugcaaaguuaaaaaaaaauuaaaguugagaacagguau

SEQ ID NO: 152554 - RNA, 64 nt, Homo Sapiens
uauuuuaaaguguuccagacccaaaaaggaaaaauaaaaaaaaaggaauauuuguacccaacag

SEQ ID NO: 152555 - RNA, 64 nt, Homo Sapiens
aaauuucaucacuguugaugugguucuuuuguguuaaaaaaaaaaagugcaacuaucaaaacua

SEQ ID NO: 152556 - RNA, 64 nt, Homo Sapiens
auaugaaauucugugaaaaaaaacccuuugaucuuaaaaaaaaaaaaaccaccccccccuucug

SEQ ID NO: 152557 - RNA, 64 nt, Homo Sapiens
aguuuacccuaacgcuucuuuaaaagaaaguagguaaaaaaagaaaaggguagauaaucuuucg

SEQ ID NO: 152558 - RNA, 64 nt, Homo Sapiens
uuuaugcgauaacuccuuuuuguuacaauuuuuuuaaaaaaagcuauuuuuguuaauguaaagu

SEQ ID NO: 152559 - RNA, 59 nt, Homo Sapiens
agaugaaugccagacugugaaggaaaauauaaaaaaaaagucgacugcuaugcucaaaa

SEQ ID NO: 152560 - RNA, 64 nt, Homo Sapiens
uauaaaaaaaaagucgacugcuaugcucaaaaaguaaaaaaagcucaacaguuaaaaucuaaug

SEQ ID NO: 152561 - RNA, 64 nt, Homo Sapiens
uccaaggcagguguuguuaaucuaucauagcacuuaaaaaaaaaaaaaaaaagagaccaaaaau

SEQ ID NO: 152562 - RNA, 64 nt, Homo Sapiens
guguuuuuuucuggaacuacuucaagugagaaaauaaaaaaaaauggugacaaagcuguacaga

SEQ ID NO: 152563 - RNA, 64 nt, Homo Sapiens
augaugcgugcuacuugcuauuaugagagaagcuuaaaaaaaaaaaggaagauauuucugaaag

SEQ ID NO: 152564 - RNA, 64 nt, Homo Sapiens
auauuucugaaagaccagcucuaaguaggccaauuaaaaaaaucuaauuccucaaauuugugug

SEQ ID NO: 152565 - RNA, 64 nt, Homo Sapiens
uuuaccaacauguaucugucuacuuucucuuguuuaaaaaaagaaaaaaaaacuuaaaaaaaug

SEQ ID NO: 152566 - RNA, 64 nt, Homo Sapiens
uacuuucucuuguuuaaaaaaagaaaaaaaaacuuaaaaaaaugggguuauagaaggucagcaa

SEQ ID NO: 152567 - RNA, 64 nt, Homo Sapiens
uguuuuuuuuuuuuuaaucaaaaaacaauuuuuuuaaaaaaaaagcuuugaaaauggaugguuu

SEQ ID NO: 152568 - RNA, 64 nt, Homo Sapiens
ggaugguuuggguauuaaaaagaaaaaaaaaacuuaaaaaaaaaaagacacuaacggccaguga

SEQ ID NO: 152569 - RNA, 64 nt, Homo Sapiens
aaaaaugaaaaaaaaaggaaccaguuugaaaucuuaaaaaaagaagccuuuuccaguguguaac

SEQ ID NO: 152570 - RNA, 64 nt, Homo Sapiens
auaugaaaucucuguagccuugauuucuaaaaguuaaaaaaaaucagccauuuuauaagcacuc

SEQ ID NO: 152571 - RNA, 64 nt, Homo Sapiens
ggaaaagaggaagacuggacauuuuuuuuuuaaauaaaaaaaaaacacaacaauaguuuaagaa

SEQ ID NO: 152572 - RNA, 64 nt, Homo Sapiens
cuuggugauucuuucaagugagaaaaccgcuuuuuaaaaaaacaaggccaauuuguuggccacc

SEQ ID NO: 152573 - RNA, 64 nt, Homo Sapiens
ucacuuguauaaaaauggucguaagugucuuuuuuaaaaaaaauuaaacuauugccauacuuca

SEQ ID NO: 152574 - RNA, 64 nt, Homo Sapiens
aaaaaacauggucuuguuuuuuaaugcacauuuuuaaaaaaagaucuauucauuuauguuagca

SEQ ID NO: 152575 - RNA, 64 nt, Homo Sapiens
aacuguuguagaaauucuuacugguccuguuuucuaaaaaaaaaucauuuaaaaaaaaagaauu

SEQ ID NO: 152576 - RNA, 64 nt, Homo Sapiens
gaauucugguccuguuuucuacaggaucaucauuuaaaaaaaaauauggaaguaaaggcauucc

SEQ ID NO: 152577 - RNA, 64 nt, Homo Sapiens
cacaauuuacuucccaaaaagcagcaacuuguuuuaaaaaaauggcacuuagauggauauaaau

SEQ ID NO: 152578 - RNA, 64 nt, Homo Sapiens
aacgccauagcacagcugucuuaacuuuugagauuaaaaaaaaaaaccacucucuugaaucacg

SEQ ID NO: 152579 - RNA, 64 nt, Homo Sapiens
aaacugcuccuucuuuuggagcuaugaaugucuguaaaaaaaaaucacucuuauaaauagugcu

SEQ ID NO: 152580 - RNA, 64 nt, Homo Sapiens
aaguuacauaucacuaugacgugaguagaagaacuaaaaaaagaacauucauuuguauucagau

SEQ ID NO: 152581 - RNA, 64 nt, Homo Sapiens
agugguucaguucauuccccuuuaagugugauuuuaaaaaaaugacuuuuuugcccaugugucu

SEQ ID NO: 152582 - RNA, 64 nt, Homo Sapiens
gaaaaaacucuguuguaaaauuacuggguuuaauuaaaaaaaaacucauugucuucuguacauc

SEQ ID NO: 152583 - RNA, 64 nt, Homo Sapiens
uaugggauaaaaaagguuauaaaaguuaugggauuaaaaaaagucacuaaauuaaaaaaaaauu

SEQ ID NO: 152584 - RNA, 64 nt, Homo Sapiens
uuaaaaguuaugggauuaaagcuggccacuaaauuaaaaaaaaaaagaucacugucaucuaaaa

SEQ ID NO: 152585 - RNA, 64 nt, Homo Sapiens
aaaaaaggagacuuuuuuugaagaagaaaagauuuaaaaaaaaacucaacuuuaaaaaaaaaaa

SEQ ID NO: 152586 - RNA, 64 nt, Homo Sapiens
aaaagaagaaaagauuuaaauuuuaccucaacuuuaaaaaaaaaagguuuccauacacugaagc

SEQ ID NO: 152587 - RNA, 64 nt, Homo Sapiens
uuugugguuuuuuaauauaguauaaaaauccuuuuaaaaaaacaacaaucugugugccucucug

SEQ ID NO: 152588 - RNA, 64 nt, Homo Sapiens
cucaagugcuucaaugaugcagcauuucuugcacuaaaaaaaaaaaaaaaaaaaaaacuagaaa

SEQ ID NO: 152589 - RNA, 64 nt, Homo Sapiens
aaaaaaagaauuucaaaaaaaaaaguuguuugcuuaaaaaaaauuucaugugagggaaaaaaaa

SEQ ID NO: 152590 - RNA, 64 nt, Homo Sapiens
uuuuauuauguguuuuguauaaaucccuaauauuuaaaaaaaaaaacaaaacaaaaaaagguua

SEQ ID NO: 152591 - RNA, 64 nt, Homo Sapiens
uuuacuguuuguuuuuauuaucuuaagugcuaauuaaaaaaaaaauaaaauuuuaaaaaaaccu

SEQ ID NO: 152592 - RNA, 64 nt, Homo Sapiens
aucuuaagugcuaauuaaaaaaaaaauaaaauuuuaaaaaaaccuguaguuucauuaccuuuuu

SEQ ID NO: 152593 - RNA, 64 nt, Homo Sapiens
auuuuguaccaguggaacuuuuuauacuggagauuaaaaaaaaaauggaaauuuuuguggcuug

SEQ ID NO: 152594 - RNA, 64 nt, Homo Sapiens
uuuuugaggccaguacaaccuugauaacaaaaccuaaaaaaaaaacaacaaaaaaacccauaaa

SEQ ID NO: 152595 - RNA, 64 nt, Homo Sapiens
auguuuauuagggcaaucaaaagauuuauuauuuuaaaaaaaucaguguggacuuccauuccuc

SEQ ID NO: 152596 - RNA, 64 nt, Homo Sapiens
aagugacauuauagugauuaaauucuucccccuuuaaaaaaacaguuagugguuuucacuauuu

SEQ ID NO: 152597 - RNA, 64 nt, Homo Sapiens
aauguuuauaauguguauauagaauuguucacuguaaaaaaaauggccaaaauguguuuuuuuu

SEQ ID NO: 152598 - RNA, 64 nt, Homo Sapiens
auauacccccaccccacaaagauuuucuucagguuaaaaaaaaaguuuaaaaaaaagauuuuaa

SEQ ID NO: 152599 - RNA, 64 nt, Homo Sapiens
ccacaaagauuuucuucagguuaaaaaaaaaguuuaaaaaaaagauuuuaaaauaaagcauuua

SEQ ID NO: 152600 - RNA, 64 nt, Homo Sapiens
aaaaccaaaaugacaucuuuuuaaagcuuauccauaaaaaaaaauagaugucuuuuauagugga

SEQ ID NO: 152601 - RNA, 64 nt, Homo Sapiens
uauacuuuaaauaauuuaacuacccuuaauuacuuaaaaaaaaaaaaaagcuuuaugauuuuca

SEQ ID NO: 152602 - RNA, 64 nt, Homo Sapiens
aucauauuguguauaacuuggaaauggugcuguuuaaaaaaauuguguauuuauacaguaacag

SEQ ID NO: 152603 - RNA, 64 nt, Homo Sapiens
aaguauaagucaaucuauggucagugucuuugguuaaaaaaaaaaaaaaacacaggcaguucuu

SEQ ID NO: 152604 - RNA, 64 nt, Homo Sapiens
uaaauugcccaucaauaaguaaaaacuuuugcaauaaaaaaaaaacauuuaaaaaguuuucuga

SEQ ID NO: 152605 - RNA, 64 nt, Homo Sapiens
aaaagauaaugauuuauugcucacugauuugcuuuaaaaaaaauaaagguuuuuguccuuuccu

SEQ ID NO: 152606 - RNA, 64 nt, Homo Sapiens
acuguuuguuuaaagcaugcuagauucucucauuuaaaaaaaaugcuggucagacuuuuuuugu

SEQ ID NO: 152607 - RNA, 64 nt, Homo Sapiens
aaaaacuaaacuacuuguuguaaaauaagugacauaaaaaaaaaucccugucaagguuaguaaa

SEQ ID NO: 152608 - RNA, 64 nt, Homo Sapiens
uauuuuaaccuacagucaccaauuggucauuuuuuaaaaaaauauuaagaauugcaguggagca

SEQ ID NO: 152609 - RNA, 64 nt, Homo Sapiens
gauugaagauuuuaaauaaauaugauguacuuuguaaaaaaauuucccaaggguucuggcaccu

SEQ ID NO: 152610 - RNA, 64 nt, Homo Sapiens
cauaauaguuaggauaguuuaucuaaacuuuuuuuaaaaaaaauauuuguggcuagaaauuuua

SEQ ID NO: 152611 - RNA, 64 nt, Homo Sapiens
aaaaguuuucuuauaguauuuauaggaagccaauuaaaaaaaaacucauuugccgacuuauuuu

SEQ ID NO: 152612 - RNA, 64 nt, Homo Sapiens
aaaacaaaaacaaaacaaaaauggaggacgccaguaaaaaaacacuaccuauguaaauguuuga

SEQ ID NO: 152613 - RNA, 64 nt, Homo Sapiens
aacaaaaaacuguugucuaauaacaaagagaaucuaaaaaaaaaccggaagggugcuuauucuu

SEQ ID NO: 152614 - RNA, 64 nt, Homo Sapiens
guuuauauuuuauauacacaguuauaaacacuacuaaaaaaacauagcuucaggaauacugcuc

SEQ ID NO: 152615 - RNA, 64 nt, Homo Sapiens
gaaacacuaaauaguguaauauuucuuuugcuuuuaaaaaaauuccugguagcaaaucaagaua

SEQ ID NO: 152616 - RNA, 64 nt, Homo Sapiens
caagaauaaauaaaacaaacuuaaucuucaucuuuaaaaaaaagaaaaaagaaaccaaaaugag

SEQ ID NO: 152617 - RNA, 64 nt, Homo Sapiens
ugcuuuugauucacauuaagcugcuuucagaaauuaaaaaaacacuuuuuaaagggugcauuga

SEQ ID NO: 152618 - RNA, 64 nt, Homo Sapiens
uaaugaauuccaauuauaccuuacaucagcaaguuaaaaaaaguacuuuaaaauaaagcaaagg

SEQ ID NO: 152619 - RNA, 64 nt, Homo Sapiens
uuaagaguuuaaaaaucuuaugagugagaaauauuaaaaaaaucuuauuuucaccucuuuagaa

SEQ ID NO: 152620 - RNA, 64 nt, Homo Sapiens
caaaggaaaacacgugguuuuuaaagccauuagguaaaaaaaguucucaauaaaggcauuacaa

SEQ ID NO: 152621 - RNA, 64 nt, Homo Sapiens
agauggacuuuucugauaaaucuuggcagacaucuaaaaaaaaaaccauauuuuucacaagaaa

SEQ ID NO: 152622 - RNA, 64 nt, Homo Sapiens
aaaucucugccauuuuagauacugugaaacaaacuaaaaaaaaaaaagcuuuuguuuuguauuu

SEQ ID NO: 152623 - RNA, 64 nt, Homo Sapiens
ggccuacaagaacaaaacuccaucucaaaauaaauaaaaaaauaaauaaaaauaaaaauagacu

SEQ ID NO: 152624 - RNA, 64 nt, Homo Sapiens
cucucucuagggcagcagagagcuuuuugcacuuuaaaaaaaaaaagaaagaaagaaaggucgg

SEQ ID NO: 152625 - RNA, 64 nt, Homo Sapiens
uuuauauauauauaauauaaaaucacuuggugauuaaaaaaauaacugcuccauaaauaaaacu

SEQ ID NO: 152626 - RNA, 64 nt, Homo Sapiens
auauuguauuaaucucauggaugguucucaaagguaaaaaaagagagagaaagagagagagcua

SEQ ID NO: 152627 - RNA, 64 nt, Homo Sapiens
uugaaaccuacagaaccgacaaaaauuagggugcuaaaaaaaugacagugaaaucucaucguaa

SEQ ID NO: 152628 - RNA, 64 nt, Homo Sapiens
uuaagcaguuugaaggcauacuuuugcauagaaauaaaaaaaauacugauuuggggcaaugagg

SEQ ID NO: 152629 - RNA, 64 nt, Homo Sapiens
guucacugaacaccaagaccagaauggauuuuuuuaaaaaaauagauguuccuuuugugaagca

SEQ ID NO: 152630 - RNA, 64 nt, Homo Sapiens
gaaaguuuuuuuaaagaacagaaacuuuuccaauuaaaaaaaaaaagcagacuucugguucaag

SEQ ID NO: 152631 - RNA, 64 nt, Homo Sapiens
ugauaugaaaaacuuugucuugucauuauaauaauaaaaaaaugaacauuuauuauggaauuuc

SEQ ID NO: 152632 - RNA, 64 nt, Homo Sapiens
uuuugaaaaugucucuguaauauuuuaucuucuuuaaaaaaaagggggggaaauaccaaagugu

SEQ ID NO: 152633 - RNA, 64 nt, Homo Sapiens
gauguaacaugaagccauuccagaaaugguaacuuaaaaaaaaaaagacuacaugucuaggaaa

SEQ ID NO: 152634 - RNA, 64 nt, Homo Sapiens
gagucuagaacuuacugcaaaaacaagacaaaacuaaaaaaauacaacugagaagggugaagag

SEQ ID NO: 152635 - RNA, 64 nt, Homo Sapiens
uacaugucagagacauuuauaaaaagugaaaggauaaaaaaaaaaaaaaacaacuaauaccggg

SEQ ID NO: 152636 - RNA, 64 nt, Homo Sapiens
uuuagauagcuuagcuuguuuggacaaaucaaguuaaaaaaauuccauccugucuuuuacacaa

SEQ ID NO: 152637 - RNA, 64 nt, Homo Sapiens
agccgggugcgguggcacacgucucuacuaaaaauaaaaaaauuccaacauggugugagacccc

SEQ ID NO: 152638 - RNA, 64 nt, Homo Sapiens
cauuuuuauaucgaagaaaagauugauuuuuaucuaaaaaaauuuaagacaaggucacugugcu

SEQ ID NO: 152639 - RNA, 64 nt, Homo Sapiens
cagcuagauugcaguuuaauuauucugaauauacuaaaaaaaucaaacccacugccauauuagu

SEQ ID NO: 152640 - RNA, 64 nt, Homo Sapiens
gcuggacauuuguuuucaguaacagcuguuagguuaaaaaaauagauguuuuuaaaacaauauu

SEQ ID NO: 152641 - RNA, 64 nt, Homo Sapiens
ucauggugaggcuuaacaauaucauggcuaagcuuaaaaaaaacaggagugaacauuuggguaa

SEQ ID NO: 152642 - RNA, 64 nt, Homo Sapiens
aauaaauugcaugcugcuuuaaaacauaaaaaguuaaaaaaaauguugccguugccaagaacug

SEQ ID NO: 152643 - RNA, 64 nt, Homo Sapiens
uugucuuugagauucaauguucugugguaaccuauaaaaaaaguacaugagucacagcuuuugu

SEQ ID NO: 152644 - RNA, 64 nt, Homo Sapiens
uauucacuuuaacuuauaaugcuacaaggaauauuaaaaaaaucuucuguugcacuuguaaaau

SEQ ID NO: 152645 - RNA, 64 nt, Homo Sapiens
aaaaaaaugacauacgugacucagauugguuucuuaaaaaaaaacgcaaaccauugguugggag

SEQ ID NO: 152646 - RNA, 64 nt, Homo Sapiens
aauauacuauugcacuaaggaaccaaaauuacuguaaaaaaauaccuuaaaucucuuguauggc

SEQ ID NO: 152647 - RNA, 64 nt, Homo Sapiens
aaaaagcuccuguaauuugccuuuuuagacuuuauaaaaaaaaaguuacuuuugugcuuuuauu

SEQ ID NO: 152648 - RNA, 64 nt, Homo Sapiens
aguuauuuuauuuauugaguaaaucgguauuuguuaaaaaaaucaaucaacuccaucacuucuu

SEQ ID NO: 152649 - RNA, 64 nt, Homo Sapiens
ggaagggaagcuuuuuuuuuauuaauucaugccuuaaaaaaauacuuugcaaugacauuuauuu

SEQ ID NO: 152650 - RNA, 64 nt, Homo Sapiens
aaaucucaguuauguuuuuacuuuauguacaguguaaaaaaaaaccugugaaugccaaaguaaa

SEQ ID NO: 152651 - RNA, 64 nt, Homo Sapiens
aaagaauaaaaauacuucuaaaaaaauuaaaauguaaaaaaauuaaauuaaguucugaaaauug

SEQ ID NO: 152652 - RNA, 64 nt, Homo Sapiens
aucuccagacucaaguugcugaacuaaaaaggauuaaaaaaaaauuucuuucucauuuuauguu

SEQ ID NO: 152653 - RNA, 64 nt, Homo Sapiens
ucauugcuuuguauuguaguugcaaacuacacuuuaaaaaaaacgccuacuaaccgugccaucu

SEQ ID NO: 152654 - RNA, 64 nt, Homo Sapiens
ucuuaacaacagcuucuugcauaaacucuaaguguaaaaaaaaguuccuuccugccccaaaauu

SEQ ID NO: 152655 - RNA, 64 nt, Homo Sapiens
aacuagauugacuauuuauaauugccucuugaauuaaaaaaaaaagccuaacauuggugcaaag

SEQ ID NO: 152656 - RNA, 64 nt, Homo Sapiens
ugauuuccauauuuuauuuugcaaaaaacaaaauuaaaaaaaaucuggaaagggggggaaaaaa

SEQ ID NO: 152657 - RNA, 64 nt, Homo Sapiens
aucccaaguaaaaauuucuuuaaauacauguauuuaaaaaaacaacugcaguucauccgcacug

SEQ ID NO: 152658 - RNA, 64 nt, Homo Sapiens
ugcaaaaaaauucuuauggcugucgauguuuuuuuaaaaaaaaauagagauguagcgauguaag

SEQ ID NO: 152659 - RNA, 64 nt, Homo Sapiens
uagcacaucccuuuacuuacaugucaucuacaauuaaaaaaaaucaggggaauuauguguguga

SEQ ID NO: 152660 - RNA, 64 nt, Homo Sapiens
guuguuuuuguucuuuguguuuuagggugaaacuuaaaaaaaaaauucugcccccaccuagauc

SEQ ID NO: 152661 - RNA, 64 nt, Homo Sapiens
uaauguccucuugcugucuacaguagcugcuaccuaaaaaaagauguuuuauuuugccaguugg

SEQ ID NO: 152662 - RNA, 64 nt, Homo Sapiens
uugaauguauuugacuuaguucuuauuuuaaggcuaaaaaaacuuugucauauuuaagucggca

SEQ ID NO: 152663 - RNA, 64 nt, Homo Sapiens
agcuaugcccauuuauucccaaauauuaagcccuuaaaaaaauaaaaccucugaaccaaaaucu

SEQ ID NO: 152664 - RNA, 64 nt, Homo Sapiens
guaacugacucuuaaguguuaaauaauguagaaguaaaaaaauuuuuuuuaaaggcuuaauuug

SEQ ID NO: 152665 - RNA, 64 nt, Homo Sapiens
ccugugcugaaauuugggggaaguuuagguccuuuaaaaaaacauauuaaucauugacuacauc

SEQ ID NO: 152666 - RNA, 64 nt, Homo Sapiens
ccaugugcaccuugggguuuuguaaugacagugcuaaaaaaaaaaagcauuuuuuuuuuaugau

SEQ ID NO: 152667 - RNA, 64 nt, Homo Sapiens
auuaacguuauuuguaauuuaguuuguagcucauuaaaaaaaugugccuaguuuuauaguucau

SEQ ID NO: 152668 - RNA, 64 nt, Homo Sapiens
gaagauaaaaaauauuguuaagugugcaaguuauuaaaaaaaaaaaauugggccaggcacggug

SEQ ID NO: 152669 - RNA, 64 nt, Homo Sapiens
ucauauaaugacuuuuuuuuaagagucucuuuuuuaaaaaaacuuaauucucuaaaaccgaaau

SEQ ID NO: 152670 - RNA, 64 nt, Homo Sapiens
uugcauguuuuucagaugcuuucaaaucuuuuuuuaaaaaaauaguguaaaauauuuuaauaag

SEQ ID NO: 152671 - RNA, 64 nt, Homo Sapiens
caucaaauaaaaauggaaaaaaugaucauggcuuuaaaaaaaaaacaaaaacacacacacauga

SEQ ID NO: 152672 - RNA, 64 nt, Homo Sapiens
auguacaguguucuguuuaauacucauccuuguauaaaaaaaauaguugagccagcagacauug

SEQ ID NO: 152673 - RNA, 64 nt, Homo Sapiens
acauugccuauuucaguggcacgucaucuaguuuuaaaaaaauaaaacauuuuaaauggacaga

SEQ ID NO: 152674 - RNA, 64 nt, Homo Sapiens
uugcugacaaacuuaucccaaaacuuuaguggcuuaaaaaaaccugcccccaacuguuagucaa

SEQ ID NO: 152675 - RNA, 64 nt, Homo Sapiens
gcugggaugauggagaaagcucgaggugaaguuuuaaaaaaaaaguuguggaaaggaaaguucc

SEQ ID NO: 152676 - RNA, 64 nt, Homo Sapiens
gaaagaauuaucuggcacauuagguauuggaguuuaaaaaaaaagccaaauuucacagucuuaa

SEQ ID NO: 152677 - RNA, 64 nt, Homo Sapiens
aaaagccaaauuucacagucuuaauaacuuuuuuuaaaaaaaacuaaaaggcgcuucaugucca

SEQ ID NO: 152678 - RNA, 64 nt, Homo Sapiens
cacguauauuauguagucuauuugcaacuguucuuaaaaaaaugacauuaaaagaauaguuuau

SEQ ID NO: 152679 - RNA, 64 nt, Homo Sapiens
ugugugaagggguagaauuugugcgguaaagacuuaaaaaaaaaaguagggagauuaaaaaaaa

SEQ ID NO: 152680 - RNA, 64 nt, Homo Sapiens
ugcgguaaagacuuaaaaaaaaaaguagggagauuaaaaaaaaagaaagaaaaugcuuccuuau

SEQ ID NO: 152681 - RNA, 64 nt, Homo Sapiens
acugaauuuauuuuaaaaaauaauaauaaaaauuuaaaaaaauuaaaaauaaaaaaaaccacag

SEQ ID NO: 152682 - RNA, 64 nt, Homo Sapiens
aaaaauaauaauaaaaauuuaaaaaaauuaaaaauaaaaaaaaccacagaaaacaacuuuacau

SEQ ID NO: 152683 - RNA, 64 nt, Homo Sapiens
uuaaaacauuugaaugaacuuaaugccaacaguuuaaaaaaaaauuagauuuauuuaaaguucu

SEQ ID NO: 152684 - RNA, 64 nt, Homo Sapiens
cccaugcaaaccugagugagguaauuuaucaccauaaaaaaaaaucagauucauuuuucuugau

SEQ ID NO: 152685 - RNA, 64 nt, Homo Sapiens
aauacugucugugagaaaccgucuuaaauuauuuuaaaaaaauagcuugguacaagcuuaugcu

SEQ ID NO: 152686 - RNA, 64 nt, Homo Sapiens
ugcacugaacuucaaaacaauuguaaucuuacuguaaaaaaaaguccaucauguuccuaaauuu

SEQ ID NO: 152687 - RNA, 64 nt, Homo Sapiens
aaacgggcuagucccuauguggucacauuguuaauaaaaaaaaaacuuuaaagaauugugauca

SEQ ID NO: 152688 - RNA, 64 nt, Homo Sapiens
caaacugaaauucuauauacaagaaaaaaaaggauaaaaaaaccaaaacauacuuauuuuaaaa

SEQ ID NO: 152689 - RNA, 64 nt, Homo Sapiens
uuucuuuuuccaauuugguuacuugguuucuaauuaaaaaaaaaaaccauuuaaccguauguaa

SEQ ID NO: 152690 - RNA, 64 nt, Homo Sapiens
uuggaaaaugcaauacauuuaccaggcuauauguuaaaaaaaaaaaggauaugcaugauucuua

SEQ ID NO: 152691 - RNA, 64 nt, Homo Sapiens
uacaaaaauuagccgggcguaaccccaucucuacuaaaaaaaaacagccuggccaacacgguga

SEQ ID NO: 152692 - RNA, 64 nt, Homo Sapiens
aauuggugcugauaaauauugugagacucugucuuaaaaaaaaaacuccagccugggugaagaa

SEQ ID NO: 152693 - RNA, 64 nt, Homo Sapiens
aaaaaaauuagucgggcgugaaccccaucucuacuaaaaaaaaacagccuggccaacaugguga

SEQ ID NO: 152694 - RNA, 64 nt, Homo Sapiens
aaaaaaaauucauuuucuuuaugcuguuuucuuuuaaaaaaaaaaagaaaaucuuaagugauug

SEQ ID NO: 152695 - RNA, 64 nt, Homo Sapiens
aaaaaaagaggaagaaaauccuaauaagcaaguguaaaaaaaaacuuuggaacgagaugcuaua

SEQ ID NO: 152696 - RNA, 64 nt, Homo Sapiens
auuggcaagacaacuauauggacaauuuauuguuuaaaaaaaaaaaugcagugacuuauacuaa

SEQ ID NO: 152697 - RNA, 64 nt, Homo Sapiens
aaaaaaacaacaacaauaaauggcccaggacauguaaaaaaaaaaccauuuaguaaaauguagc

SEQ ID NO: 152698 - RNA, 64 nt, Homo Sapiens
uaaccaguauuuuacuucaagaauaaguagaauauaaaaaaauauagacuccaguguguucagu

SEQ ID NO: 152699 - RNA, 64 nt, Homo Sapiens
uguauaaaacuggaagugugugguuucuuuccuuuaaaaaaauuucaaaugcaauacuuugggu

SEQ ID NO: 152700 - RNA, 64 nt, Homo Sapiens
uucagcugugcuaaacaguaaaaaaaagaaagaauaaaaaaaccccaaaucaugggcucacuuu

SEQ ID NO: 152701 - RNA, 64 nt, Homo Sapiens
aagaauaaaaaaaccuucagucaugggcucacuuuaaaaaaagaaaucugggaaagacaccaaa

SEQ ID NO: 152702 - RNA, 64 nt, Homo Sapiens
cuagucaccaggaggaucccgcauuuuuagucauuaaaaaaaauuagguugacuaucuaaauag

SEQ ID NO: 152703 - RNA, 64 nt, Homo Sapiens
gauucccuaauucgaauuuauguaauucuacaucuaaaaaaaccauuuaauuccaaaaauacuc

SEQ ID NO: 152704 - RNA, 64 nt, Homo Sapiens
aaaaaaacaaaacaaaacaaacuaaugcuuuguuuaaaaaaacgcuaauagccaaauagauaac

SEQ ID NO: 152705 - RNA, 64 nt, Homo Sapiens
aaagcaaagcuuucugccaguagauuuauuuuuuuaaaaaaaaaaagacacacuuguacgaaug

SEQ ID NO: 152706 - RNA, 64 nt, Homo Sapiens
aaaaucuagugcuccugcuguuuaaagaacauguuaaaaaaaaauuuuuuaaucuucacagugu

SEQ ID NO: 152707 - RNA, 64 nt, Homo Sapiens
aaaaaaaaaaaaaaaguaaauaauaccuuuucuuuaaaaaaaaauuugcuucauuuggggaaaa

SEQ ID NO: 152708 - RNA, 64 nt, Homo Sapiens
uuagcuaggcauguugccacauaaaaaauaaaaauaaaaaaaacuagaccucaucucuacaaaa

SEQ ID NO: 152709 - RNA, 64 nt, Homo Sapiens
aaaaagccugggcaugauggaauguuaagaaauuuaaaaaaaaauuuagagguugcuaacugac

SEQ ID NO: 152710 - RNA, 64 nt, Homo Sapiens
uuuaaaaacugaucaaguuaaaaaauuuaaaaaauaaaaaaaguauauaaaauaaaaacuuaaa

SEQ ID NO: 152711 - RNA, 64 nt, Homo Sapiens
uuaaaaaauaaaaaaaguuuauaaaauaaaaacuuaaaaaaaauacuuuuacuuuguagauaau

SEQ ID NO: 152712 - RNA, 64 nt, Homo Sapiens
aaaaaaaaaaaaucaagacugcugcuauuacugcuaaaaaaaaaaaguaacaagagugauucuu

SEQ ID NO: 152713 - RNA, 64 nt, Homo Sapiens
guguaaguaaaguguuaugggccgaaaacaguauuaaaaaaagucaaaacuguguuuacugaaa

SEQ ID NO: 152714 - RNA, 64 nt, Homo Sapiens
uuuuuugaaaaaaacaaggcauauucuuccugauuaaaaaaauuuggacaaaaagccaaaauaa

SEQ ID NO: 152715 - RNA, 64 nt, Homo Sapiens
aacacaaaaagaugagucccuuugucucaaaacuuaaaaaaacauaaaaaugugacuuucuugu

SEQ ID NO: 152716 - RNA, 64 nt, Homo Sapiens
acuacaguauagcgcugguaaugugaaguucauuuaaaaaaauaauuugaaagaauacaaaaau

SEQ ID NO: 152717 - RNA, 64 nt, Homo Sapiens
ggcagcaaaggguaguuuuccuacaaaaaaacuuuaaaaaaaauacacaaaaaauaaaaaaccc

SEQ ID NO: 152718 - RNA, 64 nt, Homo Sapiens
guuguguggugggaaugugauuaaaacauuauauuaaaaaaaaauucuugaaauaaucuaaagu

SEQ ID NO: 152719 - RNA, 64 nt, Homo Sapiens
ccuuuuuaaagcauuaauggguggugggacuuuuuaaaaaaaugguacuugaaguugagccuuu

SEQ ID NO: 152720 - RNA, 64 nt, Homo Sapiens
caaucuucuccccugacaccacucaaguacuuccuaaaaaaaccuccaaacuagggcuuucaug

SEQ ID NO: 152721 - RNA, 64 nt, Homo Sapiens
aaaagauacaaagaaauaugcuucauugugggguuaaaaaaaaaccagugugguagacuuaagg

SEQ ID NO: 152722 - RNA, 64 nt, Homo Sapiens
agugaacuuaaagcaaagaccucuuaguaaaaaauaaaaaaaaauaaaaaauaaaaauaaaaaa

SEQ ID NO: 152723 - RNA, 64 nt, Homo Sapiens
uuaguaaaaaauaaaaaaaaauaaaaaauaaaaauaaaaaaaguuaaauuuauuuauagaaauu

SEQ ID NO: 152724 - RNA, 64 nt, Homo Sapiens
uuaaguggcuaugcaagcaaaagcauagauagguuaaaaaaaaggaucagcuggcugggcaggg

SEQ ID NO: 152725 - RNA, 64 nt, Homo Sapiens
auggggagggagaaugcuuuuccccucccaguaauaaaaaaaaaaaaaaaaaaaauauauauau

SEQ ID NO: 152726 - RNA, 64 nt, Homo Sapiens
aaauauguguuguaugucuuuuuugcuuuuuuuuuaaaaaaaagaauaacuuuuuuugccucuu

SEQ ID NO: 152727 - RNA, 64 nt, Homo Sapiens
agugguguuuugaagaggguauuuuauuguuuuuuaaaaaaagguucuuaaacauuauuugaaa

SEQ ID NO: 152728 - RNA, 64 nt, Homo Sapiens
aagaauuacuagguugccauguggcucacuuauuuaaaaaaaaaaaaaaaaaacucacccguuu

SEQ ID NO: 152729 - RNA, 64 nt, Homo Sapiens
gguugcauauggcaaugaaguguuuguuuuauauuaaaaaaaaccuguuauguacaguugaaau

SEQ ID NO: 152730 - RNA, 64 nt, Homo Sapiens
uaacuuuaaggaugugcaagguucuuuacuuauauaaaaaaagaucaagugaauuuauuugugu

SEQ ID NO: 152731 - RNA, 64 nt, Homo Sapiens
uucuugucuuaguuauaaaacugccuagaucugauaaaaaaauuguaaaugaagaucaguauuu

SEQ ID NO: 152732 - RNA, 64 nt, Homo Sapiens
augauagugcauuuuggugguccuguaaacuaaauaaaaaaaaaaaccuguacuuacagauucu

SEQ ID NO: 152733 - RNA, 64 nt, Homo Sapiens
cuccauaguacuaauuuuguugaauucuuaaaauuaaaaaaaaacuuacuccuuagaguucaga

SEQ ID NO: 152734 - RNA, 64 nt, Homo Sapiens
guauugugguuuaugcgaacgaauaaucauucauuaaaaaaaaucuuuucugguuuuaguuugg

SEQ ID NO: 152735 - RNA, 64 nt, Homo Sapiens
aacaaaaaaaaaaacccuccuuaguuuucuugguuaaaaaaaaaugucuuucaccaacucccuu

SEQ ID NO: 152736 - RNA, 64 nt, Homo Sapiens
ugcuaucaaauaugauaaaagguuuuguaaccaauaaaaaaagcuaauuuuguauaugggcuua

SEQ ID NO: 152737 - RNA, 64 nt, Homo Sapiens
uugcuuucagcuuucaggaguuggugauguuuuuuaaaaaaaucgcaaaagucuaaaauaccca

SEQ ID NO: 152738 - RNA, 64 nt, Homo Sapiens
aaaaaacuacuucaucuaccuaaacagauaaguuuaaaaaaaaacaagaaacuugguuauugaa

SEQ ID NO: 152739 - RNA, 64 nt, Homo Sapiens
aaugcacuuguaaacagaauauuuaaacauaugauaaaaaaagaaguaaauuaaauuucacccu

SEQ ID NO: 152740 - RNA, 64 nt, Homo Sapiens
aaaaaagcuuggacaugguuauaggacuuguauuuaaaaaaaaagaaaauuaguacuaacagcu

SEQ ID NO: 152741 - RNA, 64 nt, Homo Sapiens
guuugcuaaucugauaguuaaaaaacaaaaaauuuaaaaaaaagaaaaguaaaaaaaacaaaaa

SEQ ID NO: 152742 - RNA, 64 nt, Homo Sapiens
aaaaaaaaaacaaaaaauuucaucaauuuaaaaguaaaaaaaacaucuuaaugccacgguucac

SEQ ID NO: 152743 - RNA, 64 nt, Homo Sapiens
aaauauuuuuuuccuauggaacugaauuuguucuuaaaaaaauaacauuccacaucuguuucaa

SEQ ID NO: 152744 - RNA, 64 nt, Homo Sapiens
aauuggacagcuacuucuggcaaugcucagcgcuuaaaaaaacauuguggcaauuaaguggucc

SEQ ID NO: 152745 - RNA, 64 nt, Homo Sapiens
gaaaaaaagaggaaagaaggaaaaaaaaaagaauuaaaaaaaaaaaaaagaaaaacagaagaug

SEQ ID NO: 152746 - RNA, 64 nt, Homo Sapiens
cagaagaugaccuugauggaaaaaaaauauuuuuuaaaaaaaagauauacuguggaagggggga

SEQ ID NO: 152747 - RNA, 64 nt, Homo Sapiens
uaugugacauuugcccuagccuaagaguagcagguaaaaaaaaguuucuuucaucuuuugccuu

SEQ ID NO: 152748 - RNA, 64 nt, Homo Sapiens
auccuucuuggcaaaaguagcuuuugaacugauauaaaaaaaaaugcugaguaacagaaaagua

SEQ ID NO: 152749 - RNA, 64 nt, Homo Sapiens
cuguaauuuauacgguguacuauauaaugggauuuaaaaaaagugcuaucuuuucuauuucaag

SEQ ID NO: 152750 - RNA, 64 nt, Homo Sapiens
caaacaguuuuguaacucuuugcuuuuuaaaucuuaaaaaaaaaaaaguugcugaaguacugua

SEQ ID NO: 152751 - RNA, 64 nt, Homo Sapiens
caguugcauuaacuauuucaaaaauuacugccuuuaaaaaaaacaaccucaagcuauauuugua

SEQ ID NO: 152752 - RNA, 64 nt, Homo Sapiens
aaacagaugauguauuucuccauugaaaacacaauaaaaaaaaaacagcacaaucucacaguug

SEQ ID NO: 152753 - RNA, 64 nt, Homo Sapiens
ccuaagggacauguuuugauaaaguaguaaaaauuaaaaaaaaaaaacuuuacuaagaugacau

SEQ ID NO: 152754 - RNA, 64 nt, Homo Sapiens
gcaguuacaugcauacuucaaaaguauuuuccuguaaaaaaaaaaaaguuauauagguuuuguu

SEQ ID NO: 152755 - RNA, 64 nt, Homo Sapiens
aaaacaaaauaaggaauccucaaaaaauaaaaaauaaaaaaauagagagagccagaccuugucu

SEQ ID NO: 152756 - RNA, 64 nt, Homo Sapiens
guuuaccgcuguagugugaacugcgguauuuuuuuaaaaaaaaacuuuaaaaaaaaaaaagaau

SEQ ID NO: 152757 - RNA, 64 nt, Homo Sapiens
aaagaaucugcgguauuuuuaguaguaccuucuuuaaaaaaaaaacuuguuaacuucuuacagc

SEQ ID NO: 152758 - RNA, 64 nt, Homo Sapiens
uuuuguguggagucuauguucacacccagcuaauuaaaaaaauuggacuauaggugcaugccac

SEQ ID NO: 152759 - RNA, 64 nt, Homo Sapiens
aaaaauuagccagacgugguaacccugucucuacuaaaaaaaagcagccugaccaaaaugguga

SEQ ID NO: 152760 - RNA, 64 nt, Homo Sapiens
auacauugaauaaggcuguucuguguugcucauuuaaaaaaaguaggaguuauaugucugcuau

SEQ ID NO: 152761 - RNA, 64 nt, Homo Sapiens
caaaaaacuguuggauuauuaugaaaaauuaauuuaaaaaaauggguuauuuuauuuuaaaaaa

SEQ ID NO: 152762 - RNA, 64 nt, Homo Sapiens
aaaaauuaauuuaaaaaaauugguuauuuuauuuuaaaaaaauguuuguaacuuuacacuuuuu

SEQ ID NO: 152763 - RNA, 64 nt, Homo Sapiens
aaaguaaggggugagcaguuaaugagagaaaagcuaaaaaaaaaaaaaauaacaacaaaaaaaa

SEQ ID NO: 152764 - RNA, 64 nt, Homo Sapiens
aacaacaaaaaaaaaaugagaugugacaucuuuuuaaaaaaaaugcuaaaguuccccaguucau

SEQ ID NO: 152765 - RNA, 64 nt, Homo Sapiens
uuuuuuucaaauuucuucaugcuccuuuggcuuuuaaaaaaaauuucauuaggggcuuaagcua

SEQ ID NO: 152766 - RNA, 64 nt, Homo Sapiens
uucuagucuccauaacccccgaaauccuuaccuuuaaaaaaagcuuuugcuuugcuuuggauaa

SEQ ID NO: 152767 - RNA, 64 nt, Homo Sapiens
uuuuauuuugcaaccauucucuuuuucaguccauuaaaaaaacaaacgaaggugacucacuuug

SEQ ID NO: 152768 - RNA, 64 nt, Homo Sapiens
gggggagggaaugggagagauaccuuugcaaaguuaaaaaaaagacucuuuccuccuugccacu

SEQ ID NO: 152769 - RNA, 64 nt, Homo Sapiens
auuguguguauguguguugggguacauacaaggguaaaaaaaaaaaaauacguuuacaguauug

SEQ ID NO: 152770 - RNA, 64 nt, Homo Sapiens
aaaaauucugguugaagauaacauuuacuuuaaguaaaaaaaaacuuuagaaacuaacaaagcc

SEQ ID NO: 152771 - RNA, 64 nt, Homo Sapiens
cgcuaggcugcauagcauuauaaccugggaacguuaaaaaaaauacagacauucuugauucuua

SEQ ID NO: 152772 - RNA, 64 nt, Homo Sapiens
auacuuucagaauuguauuucaguuuugaagauuuaaaaaaaaugugaaaauaaauauauauua

SEQ ID NO: 152773 - RNA, 64 nt, Homo Sapiens
cuuguaagaugagaacugcuuuuuacacauuuaauaaaaaaaggucucugaauuaucugauguc

SEQ ID NO: 152774 - RNA, 64 nt, Homo Sapiens
caagaacagaaaacaagaagucauaccuuuuucuuaaaaaaaaaaaaaaaguuuuugcuucaag

SEQ ID NO: 152775 - RNA, 64 nt, Homo Sapiens
uuuuacuuuuuuuuaugaucaaggaaaagaucauuaaaaaaaaacacaaagaaguuuuucuuug

SEQ ID NO: 152776 - RNA, 64 nt, Homo Sapiens
ucuucuuaaaaucaaauguaaaucaauuacagauuaaaaaaaaaagccuguauuuaacucauau

SEQ ID NO: 152777 - RNA, 64 nt, Homo Sapiens
uuauuuuaugagccccaguuuucugggcuuaguuuaaaaaaaaaaucaagucuaaacauugcau

SEQ ID NO: 152778 - RNA, 64 nt, Homo Sapiens
aagcuuuuguucuuggauaaaaagucauacacuuuaaaaaaaaaaaaaacuuuuuccaggaaaa

SEQ ID NO: 152779 - RNA, 64 nt, Homo Sapiens
aaaagacugucaaaugaacuuuuacagaaugcauuaaaaaaaaaaaaaaacuccugugucgguc

SEQ ID NO: 152780 - RNA, 64 nt, Homo Sapiens
ugauucaguaucuuagaguuuacaguuuguguuuuaaaaaaacugaagguuuuuuuuuuaagug

SEQ ID NO: 152781 - RNA, 64 nt, Homo Sapiens
aaaaucauaugaucauuuuccuuuuuaguucucuuaaaaaaaaaacaaauucauuugucagccu

SEQ ID NO: 152782 - RNA, 64 nt, Homo Sapiens
agucuaugaagagucuguuuaggaauugauggcuuaaaaaaaaaauucuacaguggauagaauu

SEQ ID NO: 152783 - RNA, 64 nt, Homo Sapiens
uaaucuuuuuugaaauaaacuguguauccugguuuaaaaaaaugacuguuacauuaagugcauc

SEQ ID NO: 152784 - RNA, 64 nt, Homo Sapiens
gauaaagacuacagaaggaaagagcuagucuagauaaaaaaagagaagaaguaaggaaaaggag

SEQ ID NO: 152785 - RNA, 64 nt, Homo Sapiens
gaagaaaagaagcgaauaagacaucagaaucgauuaaaaaaaguauaauggagcaaguggccaa

SEQ ID NO: 152786 - RNA, 64 nt, Homo Sapiens
acgagugauagaaguagcaaagaaguucuggagauaaaaaaaauaugaugaaaagaguaguuca

SEQ ID NO: 152787 - RNA, 64 nt, Homo Sapiens
caauacaugcaguaguacaucauuuuagcaacucuaaaaaaaaaaaaaauacaaauaaaaagga

SEQ ID NO: 152788 - RNA, 64 nt, Homo Sapiens
gaaaguaauaaaaacuuaaauucuuuguaccaguuaaaaaaaauguauaaaauuuacaucugug

SEQ ID NO: 152789 - RNA, 64 nt, Homo Sapiens
caacucugcuuuaaaacaaaaccaaacaaaacuuuaaaaaaaaaugugugauccagcuuucucu

SEQ ID NO: 152790 - RNA, 64 nt, Homo Sapiens
uuugagaaaaaaaaauguuuacucuuccaucauuuaaaaaaaauguaaaagacaaaaaaaaaau

SEQ ID NO: 152791 - RNA, 64 nt, Homo Sapiens
gagcaugguucucaggaaaaccaguuccccaguuuaaaaaaaaaaaaaaaaauuccuuguaguu

SEQ ID NO: 152792 - RNA, 64 nt, Homo Sapiens
uuucccucuaauaggaaacaguauaaauuuuaauuaaaaaaaaaaggcaaacuaaaauuucuug

SEQ ID NO: 152793 - RNA, 64 nt, Homo Sapiens
uagccaaugcaaaucuguuuuaaaacaaauaguuuaaaaaaagaacaaguuuuuaagggcuuua

SEQ ID NO: 152794 - RNA, 64 nt, Homo Sapiens
ucugucuuuaaaguguuuacaaaaaaaaauuauauaaaaaaaaagucuagugucgacugguguu

SEQ ID NO: 152795 - RNA, 64 nt, Homo Sapiens
auauuaaaauacaaaaaaaaacuuauaaaauguuuaaaaaaauguucaaagcuugggagaaaag

SEQ ID NO: 152796 - RNA, 64 nt, Homo Sapiens
gugcgggaagaagcagaagcaaaaaaaauaaaaauaaaaaaauaaauaaaaauaaaaaaaauaa

SEQ ID NO: 152797 - RNA, 64 nt, Homo Sapiens
gcaaaaaaaauaaaaauaaaaaaauaaauaaaaauaaaaaaaauaaaaaaggaaaaaaaaaaaa

SEQ ID NO: 152798 - RNA, 64 nt, Homo Sapiens
cgcucuguauaguuacaacuuuguaauaauuguauaaaaaaaauaaaaaaacuuuuuuuaaucg

SEQ ID NO: 152799 - RNA, 55 nt, Homo Sapiens
aaaaaaacaaaaaaaacuuuuucuuuaaaaaaaaccggcucucuccucauccuag

SEQ ID NO: 152800 - RNA, 64 nt, Homo Sapiens
aaucagagaaaagcccaccuuuuugucuuuaaaauaaaaaaaaauuauaaugguuacaucugcu

SEQ ID NO: 152801 - RNA, 64 nt, Homo Sapiens
aauguauuguggcuuccaguuuaauucaguuuuuuaaaaaaacauauacuauuuuuuuccuuuu

SEQ ID NO: 152802 - RNA, 64 nt, Homo Sapiens
aaaaaaacuucauuggcuugggggagaugaacuuuaaaaaaaaagcuaucaguuuuuuggggca

SEQ ID NO: 152803 - RNA, 64 nt, Homo Sapiens
caucugucuucuugcuauguguaaacagugguaauaaaaaaaucaaaaagagagaaagaaagga

SEQ ID NO: 152804 - RNA, 64 nt, Homo Sapiens
cuuugauuugcacuguuauagacaaaucugacuuuaaaaaaaauacuugaaaaugggaagcgau

SEQ ID NO: 152805 - RNA, 64 nt, Homo Sapiens
auuuguccgcguugcaaacuuaggaggaagggguuaaaaaaaaaaucagggcccuagaaagugc

SEQ ID NO: 152806 - RNA, 64 nt, Homo Sapiens
auuaaauguccgucaguguccaugaugccucaguuaaaaaaaaaauaccucacuauuaaacugc

SEQ ID NO: 152807 - RNA, 64 nt, Homo Sapiens
acuccagccugggcaaccaagcgagacucugccuuaaaaaaaaaaaaaagaaaauguggcacau

SEQ ID NO: 152808 - RNA, 64 nt, Homo Sapiens
cuauauagcaagccuacacaugugccccugaaccuaaaaaaaaaguuaaaagaaaaacguuugg

SEQ ID NO: 152809 - RNA, 64 nt, Homo Sapiens
ugaaauuuugugagacuuuuccugcacuggacaguaaaaaaauaauaaaagacaaaaacaaauu

SEQ ID NO: 152810 - RNA, 64 nt, Homo Sapiens
acaguaaaaaaauaauaaaagacaaaaacaaauuuaaaaaaaaauuuaagccacaaaaaaaggc

SEQ ID NO: 152811 - RNA, 64 nt, Homo Sapiens
gcuguguuuucuaacacauuuuucuguuuuuaauuaaaaaaaaaaaaaaaagguuuucaguugc

SEQ ID NO: 152812 - RNA, 64 nt, Homo Sapiens
cccccucugcgagaaacacccaagaaugaucaauuaaaaaaaaaauaauauaauaauaauucuu

SEQ ID NO: 152813 - RNA, 64 nt, Homo Sapiens
caguauuaaguucuuagucauugauuuuuguguuuaaaaaaaaauaggaaagagggaaacugca

SEQ ID NO: 152814 - RNA, 64 nt, Homo Sapiens
ucgggcuuuaauuugcuaaagcugugcacauauguaaaaaaaaaaaaaaaaagauuauuuuagg

SEQ ID NO: 152815 - RNA, 64 nt, Homo Sapiens
guaaaagcugaaaaaaucccuuuguuucuauuuauaaaaaaagugcuuuucuauauguacccuu

SEQ ID NO: 152816 - RNA, 64 nt, Homo Sapiens
aagaugauaaagcauuugaaugguacaguagauguaaaaaaaauucaguuuaaaagaacauuug

SEQ ID NO: 152817 - RNA, 64 nt, Homo Sapiens
uucuucuuucccuaccuuuuuuuucuuuuuuucuuaaaaaaauauuuuguguuauuaacagaaa

SEQ ID NO: 152818 - RNA, 64 nt, Homo Sapiens
acugcuuccuugaaacauuuuugugcuauuguuuuaaaaaaauaauuaaaaaacaguuggcguu

SEQ ID NO: 152819 - RNA, 64 nt, Homo Sapiens
cuuggaaaagagaaaaacaauggaguuacuuauuuaaaaaaaaagaaagaaaguuaucucuucc

SEQ ID NO: 152820 - RNA, 64 nt, Homo Sapiens
cgaaguuuuguuuacugaugcagcacaagagauguaaaaaaaaaaaaaaaaaaaaaaaaaaaaa

SEQ ID NO: 152821 - RNA, 64 nt, Homo Sapiens
caauuauuuuccuuuuuguuccccccaaccccauuaaaaaaauuuuuuuuugauuuuuguuuuu

SEQ ID NO: 152822 - RNA, 64 nt, Homo Sapiens
gaggagagaaauaauaacuaaaaaauauacccuuuaaaaaaaccuauauuucucugucuaaaaa

SEQ ID NO: 152823 - RNA, 64 nt, Homo Sapiens
cuugggagauuuggaugauuugagaagagugacuuaaaaaaaaugcuucugugcucuaagauau

SEQ ID NO: 152824 - RNA, 64 nt, Homo Sapiens
cuaaucauuuccuggguuccacuuacucuugauuuaaaaaaaaaaaaacaacaaaagaguuugu

SEQ ID NO: 152825 - RNA, 64 nt, Homo Sapiens
uaauuuuugaauuuuaaaacuaaucuauuuuauuuaaaaaaaaucaaguacuuuggaagugaau

SEQ ID NO: 152826 - RNA, 64 nt, Homo Sapiens
caagccagcuggcuuaugcugguucucagcuguuuaaaaaaaaaaaaaaaaaggaauagaaaca

SEQ ID NO: 152827 - RNA, 64 nt, Homo Sapiens
gugaucugggaacuuuuugcuguacaaaucuguuuaaaaaaaaaaaaaaguaacucauugaauu

SEQ ID NO: 152828 - RNA, 64 nt, Homo Sapiens
cacgaugcaagcccauuguguuuccgggcuuuuuuaaaaaaaaaauuguagcacugggcguggu

SEQ ID NO: 152829 - RNA, 64 nt, Homo Sapiens
ggccaacauggugaaaccccgucucuacuaaagauaaaaaaauuagcugaguguguuggugggu

SEQ ID NO: 152830 - RNA, 64 nt, Homo Sapiens
aacaaagcaagacucugucucaaaaaaauaaaaauaaaaaaaaaaucuuaguuccauggaauuu

SEQ ID NO: 152831 - RNA, 64 nt, Homo Sapiens
uccucaggcuuugcgauuuaaggaggagcugccuuaaaaaaaaauaaaggccuuauuuugcaau

SEQ ID NO: 152832 - RNA, 64 nt, Homo Sapiens
uuuuuaaaaaagacagcaaacuuuuuuuuuuauuuaaaaaaagauauauuaacaguuuuagaag

SEQ ID NO: 152833 - RNA, 64 nt, Homo Sapiens
ugcgagcuaauauggcaaaaaugaaaaaaaaauuuaaaaaaauguauuccuuuucggcagccga

SEQ ID NO: 152834 - RNA, 64 nt, Homo Sapiens
acaacgcuguuuucuaguccgcugaacuacugaauaaaaaaaaauuuaggggacaauugagaug

SEQ ID NO: 152835 - RNA, 64 nt, Homo Sapiens
ucuuaagaguugaucuguuuuacagagcacuuauuaaaaaaaaauagguccucacacaauuccu

SEQ ID NO: 152836 - RNA, 64 nt, Homo Sapiens
gacauauaagguugauuaaaaauuuucaaaaaguuaaaaaaaaauuuguguuuuuuuaaauaaa

SEQ ID NO: 152837 - RNA, 64 nt, Homo Sapiens
aguuacagaaugcuguguacaaaauugaaaaaaauaaaaaaaaauuaaaaaaaaaaaagaagga

SEQ ID NO: 152838 - RNA, 64 nt, Homo Sapiens
aaagaaggaaaaauugaaaacacagacuagugcuuaaaaaaaaaucuugauucuguucgcaaag

SEQ ID NO: 152839 - RNA, 64 nt, Homo Sapiens
uacaauaaugcaccauauccugucauuguuucuuuaaaaaaaaauguuugcaaguuaaaggguu

SEQ ID NO: 152840 - RNA, 64 nt, Homo Sapiens
aagauauauacuagaaguaagaaaguauuaguucuaaaaaaaaaaaugugguugucagaacccu

SEQ ID NO: 152841 - RNA, 64 nt, Homo Sapiens
aaauaaauaguacuuaguguguugaacuacauaguaaaaaaauaauacaaaacaguucuagggg

SEQ ID NO: 152842 - RNA, 64 nt, Homo Sapiens
auuaacuaaaccaagaugcuuuaaagcauugcguuaaaaaaaaacaucaugccacgcauuguuu

SEQ ID NO: 152843 - RNA, 64 nt, Homo Sapiens
cuacaaauuguguuuugcuaaaaaaaaaaaaauuuaaaaaaaaucauuguaguugacuuuuuaa

SEQ ID NO: 152844 - RNA, 64 nt, Homo Sapiens
aaaaauuuaaaaaaaaucuauguaguugacuuuuuaaaaaaaaaaucccgauggaauauagcau

SEQ ID NO: 152845 - RNA, 64 nt, Homo Sapiens
gcauuacuauuucuaaucccaacccacuucaaaauaaaaaaacauuaaaaccaaucauaaguag

SEQ ID NO: 152846 - RNA, 64 nt, Homo Sapiens
aaaaccuaauguuuuuaucuuuaagagacucuuuuaaaaaaaaauguucaggggcucccuguuu

SEQ ID NO: 152847 - RNA, 64 nt, Homo Sapiens
uaaaauuauuuugaauuauuguacuugcucuuuguaaaaaaaaacaugaucuugaacagcuccu

SEQ ID NO: 152848 - RNA, 64 nt, Homo Sapiens
caaaugaagagaaaaagaaaugugaggucuacuuuaaaaaaauuugauacuuaaauaaagaaag

SEQ ID NO: 152849 - RNA, 64 nt, Homo Sapiens
gcaaaaagacgucaggccacuuuuuuuaaugcuuuaaaaaaaugugaacacuggauaaccuaau

SEQ ID NO: 152850 - RNA, 64 nt, Homo Sapiens
cuguuauaaugguguauaugaaauuggaagucauuaaaaaaagaagugcuuuagaaaaaaguua

SEQ ID NO: 152851 - RNA, 64 nt, Homo Sapiens
acaaaaaaaaaaaagccaaguauaaaacuuaguuuaaaaaaaagcagaguuaucagacauuauu

SEQ ID NO: 152852 - RNA, 64 nt, Homo Sapiens
agaaaaaaaaagaaaaaaaagaaacuuugcuaguuaaaaaaaaaaaagggaagaaaguauaaua

SEQ ID NO: 152853 - RNA, 64 nt, Homo Sapiens
guaugcuguuuuauaauaaauuagcaauauacuuuaaaaaaaauccaguuucuccuauaacaug

SEQ ID NO: 152854 - RNA, 64 nt, Homo Sapiens
acuguacuuggcaugcgcaauaaagcagcacauguaaaaaaaaaauacacagugcaaggacuuu

SEQ ID NO: 152855 - RNA, 64 nt, Homo Sapiens
aaugcacauggaggggauguaguugcauuuuugcuaaaaaaaaaaaaaaaccuuuaaaaauugu

SEQ ID NO: 152856 - RNA, 64 nt, Homo Sapiens
caggccaagaaaugaucauaccccuugccaaagguaaaaaaaaaaaaaaaaaaaugaguugaaa

SEQ ID NO: 152857 - RNA, 64 nt, Homo Sapiens
uaauauuauguaaaggccuggaaauuacuguugcuaaaaaaagucauguaguuucauguagugu

SEQ ID NO: 152858 - RNA, 64 nt, Homo Sapiens
ucauccuuacaauccugucccaugguauuuaacauaaaaaaaaauaaaacuguuaacagauucu

SEQ ID NO: 152859 - RNA, 64 nt, Homo Sapiens
agucauuauguucugagugugugguauguucccuuaaaaaaaaaugacacuuggaagaaaaaug

SEQ ID NO: 152860 - RNA, 64 nt, Homo Sapiens
guguauuuuauauaaaaaucccauuucuugaagauaaaaaaauuguuauucaaauuguuaugca

SEQ ID NO: 152861 - RNA, 64 nt, Homo Sapiens
aaaugucuuuuaagaaacauucuuuuccacuuguuaaaaaaauuaaauauauuuuaaagcacuu

SEQ ID NO: 152862 - RNA, 64 nt, Homo Sapiens
augcuguauuuggguauuuuucuccucuaccuucuaaaaaaaaauaccauaagaagaaucagaa

SEQ ID NO: 152863 - RNA, 64 nt, Homo Sapiens
uauucucuuaacaaauuuuaaaagguagugaucuuaaaaaaaaaucacuggauaacuaggaaau

SEQ ID NO: 152864 - RNA, 64 nt, Homo Sapiens
ggugucaugucacuaaguuuaaugcugcuguuuuuaaaaaaaaaaaaaaguuuuuuuaaaaagc

SEQ ID NO: 152865 - RNA, 64 nt, Homo Sapiens
uuuaugcaaccuuuuuuccuugaauuaacagcaauaaaaaaaugaaaaacagcuuaagaauugu

SEQ ID NO: 152866 - RNA, 64 nt, Homo Sapiens
auuaaauauacauguguauauucaauuguggcuuuaaaaaaauaacccaguggcaaagaauuuu

SEQ ID NO: 152867 - RNA, 64 nt, Homo Sapiens
gaugguagggagagagagccggaacagcaauggauaaaaaaacaguuuucauaaacacuagaga

SEQ ID NO: 152868 - RNA, 64 nt, Homo Sapiens
aaaguaauuucacuucauaggcuaggauuucuuuuaaaaaaauuuuucaaacucauuuuucauu

SEQ ID NO: 152869 - RNA, 64 nt, Homo Sapiens
ucuggaaaugcagaauggcgacacugcacaaauauaaaaaaaguuggugagugguugaccaaga

SEQ ID NO: 152870 - RNA, 64 nt, Homo Sapiens
cgaagagcuaaaaaauacgugacucacucauguuuaaaaaaaauuuuaagagcaguuacagugu

SEQ ID NO: 152871 - RNA, 64 nt, Homo Sapiens
aauauuuuuaaaauguucuugugaauuccaaaucuaaaaaaagaaggaacggaagaaaccuauu

SEQ ID NO: 152872 - RNA, 64 nt, Homo Sapiens
cccaaaaggagaagaacaucggggacaagggcucuaaaaaaagcguauaugcacuuuccaaauu

SEQ ID NO: 152873 - RNA, 64 nt, Homo Sapiens
caugcaucucagcguuuuuuuucgaaagcugcuuuaaaaaaauauuuaaugcugugguugauau

SEQ ID NO: 152874 - RNA, 64 nt, Homo Sapiens
aucaaugguggggaacuauaacauccuggggcauuaaaaaaaaaggaauauggggguuaucugu

SEQ ID NO: 152875 - RNA, 64 nt, Homo Sapiens
aaaaaaggaaaaaaaagacccuguaauauuuuuguaaaaaaaaauuccaauuuugcuuauacug

SEQ ID NO: 152876 - RNA, 64 nt, Homo Sapiens
auuuucgguuucucggguucguuuaaaccuuccauaaaaaaacaaaagaaaucuugaggacuuu

SEQ ID NO: 152877 - RNA, 64 nt, Homo Sapiens
uuuaaauauuucuuucucuaacccaucagcacaauaaaaaaaagucacugguucaacaacaggg

SEQ ID NO: 152878 - RNA, 64 nt, Homo Sapiens
aauaaaaaaaagucacugguucaacaacaggguuuaaaaaaaaugucuucagcuuuaauucaaa

SEQ ID NO: 152879 - RNA, 64 nt, Homo Sapiens
cccaggagcuguuuuacugucuacuuuucaggauuaaaaaaaaaaucaaaacuuaaaaaaaaaa

SEQ ID NO: 152880 - RNA, 64 nt, Homo Sapiens
ucuacuuuucaggauuaaaaaaaaaaucaaaacuuaaaaaaaaaaaaguuuaaaaagcaaaaug

SEQ ID NO: 152881 - RNA, 64 nt, Homo Sapiens
caacugaaauguuaaggaagaagauagauccaauuaaaaaaaauuaaaaccaauuuaaaaaaaa

SEQ ID NO: 152882 - RNA, 64 nt, Homo Sapiens
agauagauccaauuaaaaaaaauuaaaaccaauuuaaaaaaaaaaagaacacaggagauuccag

SEQ ID NO: 152883 - RNA, 64 nt, Homo Sapiens
acucagaauacagacaaguagaaagauucucgcuuaaaaaaaauguauuuauuuuauggcaagu

SEQ ID NO: 152884 - RNA, 64 nt, Homo Sapiens
auggaaucauauaguauguaaccuguuuugagcuuaaaaaaaaaguauacaugacuuuaaugag

SEQ ID NO: 152885 - RNA, 64 nt, Homo Sapiens
ggaccacaggcugcaccauaagacccacucacaauaaaaaaauaaaaggccgagccgggcaugg

SEQ ID NO: 152886 - RNA, 64 nt, Homo Sapiens
aggccgagccgggcaugguugcucacucccguaauaaaaaaauaaaagaacaggcugagccggg

SEQ ID NO: 152887 - RNA, 64 nt, Homo Sapiens
ugugcacaugguacccuaaaacuuaaaguauaauuaaaaaaaaaaauuagagguuuuucuucgg

SEQ ID NO: 152888 - RNA, 64 nt, Homo Sapiens
uccagccagguugacagaaugagacccugucucuuaaaaaaaaaaaaaaaaauccuggugaugc

SEQ ID NO: 152889 - RNA, 64 nt, Homo Sapiens
aauuuuggaaccaaaacaguaucuuuuuuuaagcuaaaaaaaaaguuuuaaauggugucuuucu

SEQ ID NO: 152890 - RNA, 64 nt, Homo Sapiens
gcggggaauauauacaagacuuuauuuagucaaguaaaaaaaaaucacuaauguuuaacugaag

SEQ ID NO: 152891 - RNA, 64 nt, Homo Sapiens
uugaacauugaaaaguuacaguagucagcucugauaaaaaaaugaugcaguagggugaggguag

SEQ ID NO: 152892 - RNA, 64 nt, Homo Sapiens
cugacuguuuuuguaugguccaugaucuagaauuuaaaaaaauuuuaaaggguugaaaaaagug

SEQ ID NO: 152893 - RNA, 64 nt, Homo Sapiens
caacacccacaccugugucugacaaaaguguuuuuaaaaaaaagggauauuaaaaaaaaaaaaa

SEQ ID NO: 152894 - RNA, 64 nt, Homo Sapiens
aaaagacaaaaguguuuuuaaagaaaggggauauuaaaaaaaaaaguauacuagcuugucuuuu

SEQ ID NO: 152895 - RNA, 64 nt, Homo Sapiens
aaaaaaaaaaaagacaaaacgugauaaaaaacuguaaaaaaaaacgacagaguccauguuggag

SEQ ID NO: 152896 - RNA, 64 nt, Homo Sapiens
aaaggaaaaaaaaaaaagacacacagaagagauuuaaaaaaaaaaagcaacaaaaaaagaaaac

SEQ ID NO: 152897 - RNA, 64 nt, Homo Sapiens
aaauuccaacagaagccacauaguuuucuuucuuuaaaaaaaaagucuggacauugcaucgccc

SEQ ID NO: 152898 - RNA, 64 nt, Homo Sapiens
gaaaaagaaauaaacucuaucaucucaaaaaaaauaaaaaaaaacuggcaacagagugagacuc

SEQ ID NO: 152899 - RNA, 64 nt, Homo Sapiens
auacagcagaaaaaccuuauuaccuuucucuucauaaaaaaaucaagcauuugguuguuuccag

SEQ ID NO: 152900 - RNA, 64 nt, Homo Sapiens
cuauuuaauuuuuuaauuuauuuuuuuuuuuuuuuaaaaaaaaaugguucuucucguuuuccuu

SEQ ID NO: 152901 - RNA, 64 nt, Homo Sapiens
aaaaaaaguuuuaaaaauacuggaagccauuuguuaaaaaaaaaaugaaacucgagcaggucuc

SEQ ID NO: 152902 - RNA, 64 nt, Homo Sapiens
auuauaaauuuaauuacugucaucagagaguacuuaaaaaaaguucugcucacaucuuacucaa

SEQ ID NO: 152903 - RNA, 64 nt, Homo Sapiens
uaaacuggagagaaacuacaaaucuuacuaaacauaaaaaaacuaagcauuuaacuggucccua

SEQ ID NO: 152904 - RNA, 64 nt, Homo Sapiens
auuagauucuuaaagugugguaguuguucuuuguuaaaaaaaaagugagaagauuaaaucagaa

SEQ ID NO: 152905 - RNA, 64 nt, Homo Sapiens
cauacuggagggaacuccugacucuuacuaaacauaaaaaaauuaagccuuuuaccaguccuca

SEQ ID NO: 152906 - RNA, 64 nt, Homo Sapiens
aaaauagaccaggugcucugcguguuucuuaauuuaaaaaaaaaccaugagccaccaugaccaa

SEQ ID NO: 152907 - RNA, 64 nt, Homo Sapiens
caaaugacuuaauucuguauugagacuuuucauuuaaaaaaaguuugguucaguaauaaauaug

SEQ ID NO: 152908 - RNA, 64 nt, Homo Sapiens
aauuacaaaaaauuagccggaaccccgucucuacuaaaaaaaaacauccuggcuaacguggaga

SEQ ID NO: 152909 - RNA, 64 nt, Homo Sapiens
aguuauggccgggcgcggugauccugucucuauuuaaaaaaagaaaccugggcaauauagggag

SEQ ID NO: 152910 - RNA, 64 nt, Homo Sapiens
ccuuuaaguucaaggaagaaaauuugcuuucacuuaaaaaaaaaauuccuuuacuuucuuaaca

SEQ ID NO: 152911 - RNA, 64 nt, Homo Sapiens
aaauaaaugaaaaggacugucucugccucuauuauaaaaaaacacuggacaacauauagcaaga

SEQ ID NO: 152912 - RNA, 64 nt, Homo Sapiens
ccaaccuugggcaacauagcaagaccccauuucuuaaaaaaaaaaaaaaaaaauuuaaacuuag

SEQ ID NO: 152913 - RNA, 64 nt, Homo Sapiens
ccugggcaauaaaguaacucuugacucaaaaaaauaaaaaaaauuguagugguagccauguguu

SEQ ID NO: 152914 - RNA, 64 nt, Homo Sapiens
uuuaagucugacacauuucuauuuuauucuaacauaaaaaaacuuccauuauauauuuacuaag

SEQ ID NO: 152915 - RNA, 64 nt, Homo Sapiens
ggcuuaguucaaacauaaggaaacaguguuugauuaaaaaaaacacaucuaguaagacguaagg

SEQ ID NO: 152916 - RNA, 64 nt, Homo Sapiens
auauagagacuucuaaaucauaaucauccuuuuuuaaaaaaaagaauuuuaaaaaagauggauu

SEQ ID NO: 152917 - RNA, 64 nt, Homo Sapiens
gcugagauguuuaguagcugauaaagaaaccuuuuaaaaaaauaauauaaaugaaugaaauaua

SEQ ID NO: 152918 - RNA, 64 nt, Homo Sapiens
caauagcuuucaauuguucuuucuggaagacuuuuaaaaaaauauaaauaugcauauauauaua

SEQ ID NO: 152919 - RNA, 64 nt, Homo Sapiens
cugccuucaagaaacaaugaccugauucugucuuuaaaaaaaaaaaucucagaauucuuuuuuu

SEQ ID NO: 152920 - RNA, 64 nt, Homo Sapiens
uuggggggaaagaauagauauggggaaauaaacuuaaaaaaaaaucaggaauuuaaaaaaacga

SEQ ID NO: 152921 - RNA, 64 nt, Homo Sapiens
auggggaaauaaacuuaaaaaaaaaucaggaauuuaaaaaaacgagcaauuugaagagaaucuu

SEQ ID NO: 152922 - RNA, 64 nt, Homo Sapiens
agaaauagaauggugcucuuaucuuucuugacuuuaaaaaaauuauuaaaaacaaaaaaaaaau

SEQ ID NO: 152923 - RNA, 64 nt, Homo Sapiens
aauucaguuucaaucaaguuuacauuauguugcuuaaaaaaauagaaauuauucuuuaucuugc

SEQ ID NO: 152924 - RNA, 64 nt, Homo Sapiens
cacccuuuuucauuucccaaaauuuuuuuuuaauuaaaaaaaccaccugucucuuaaaaaaaaa

SEQ ID NO: 152925 - RNA, 64 nt, Homo Sapiens
aauuuuuuuuuaauuaaaaaaagaaccugucucuuaaaaaaaaaccauccugggugauggagcg

SEQ ID NO: 152926 - RNA, 64 nt, Homo Sapiens
aaaaaauuuugugagugacuagggaagucuuacuuaaaaaaaaauccuccauugcuguuguugc

SEQ ID NO: 152927 - RNA, 64 nt, Homo Sapiens
ccuccgguuuccacuacuguaaagaauauaaaguuaaaaaaaaguauauaaggaggaaaacggg

SEQ ID NO: 152928 - RNA, 62 nt, Homo Sapiens
cauuuuuuucaagcagggagaaaaaaaauaaaaauaaaaaaaccccucaaaaaaauaaaaau

SEQ ID NO: 152929 - RNA, 64 nt, Homo Sapiens
aaaaauaaaaaaacauuuuucaaaaaaauaaaaauaaaaaaaauaauaaacugugcaauccccu

SEQ ID NO: 152930 - RNA, 64 nt, Homo Sapiens
ugauuuccacgggguccguuuguucuuaaaaaaauaaaaaaaacuuuguuggauuucuuguuug

SEQ ID NO: 152931 - RNA, 64 nt, Homo Sapiens
aaaaaaacugauuuccacggcuuguuuguguucuuaaaaaaauacucaguucuuuguuggauuu

SEQ ID NO: 152932 - RNA, 64 nt, Homo Sapiens
aaaaaaagcaaccaaccccaaaagaaaaacgauuuaaaaaaaaauauuaaaaaaaaaaaaagaa

SEQ ID NO: 152933 - RNA, 64 nt, Homo Sapiens
aaaagaaaaagaaaaacgauuaacuuuaacuuauuaaaaaaaaauccccuuuuuauauuuguau

SEQ ID NO: 152934 - RNA, 64 nt, Homo Sapiens
agaagcuauaaagaaaagagguuauuuuucucuuuaaaaaaaauaaccugcccuuguuuuaauc

SEQ ID NO: 152935 - RNA, 64 nt, Homo Sapiens
agucagguguggcggugcgugucucuacuaaacauaaaaaaauuggccaacauggcgaaacccc

SEQ ID NO: 152936 - RNA, 64 nt, Homo Sapiens
ccuuaguuguuaucaucuuuguuuggacuucacuuaaaaaaaugccagucugcagacguguuuu

SEQ ID NO: 152937 - RNA, 64 nt, Homo Sapiens
aagugacaauaaaacaugagauauaaaucaagcuuaaaaaaaaaaagcagcaccugugggccau

SEQ ID NO: 152938 - RNA, 64 nt, Homo Sapiens
cucacaagccaguggaagggauuccugauuuuacuaaaaaaaaaaaaaaaaaagagagggcggg

SEQ ID NO: 152939 - RNA, 64 nt, Homo Sapiens
cuagcuauagaaauccaauuaagacucacuuggguaaaaaaaaauaaaaaaauaaacaaaauaa

SEQ ID NO: 152940 - RNA, 64 nt, Homo Sapiens
aaauccaauuaagacucacuuggguaaaaaaaaauaaaaaaauaaacaaaauaaacugcucacu

SEQ ID NO: 152941 - RNA, 64 nt, Homo Sapiens
uaauaaacuuuaguuguacacugaagucuuuucauaaaaaaaaugaucauuuaugaauaacaau

SEQ ID NO: 152942 - RNA, 64 nt, Homo Sapiens
uucuuagcaaugaaauugcuauauuuuucauaucuaaaaaaaaauaaaaagcugaauguuacua

SEQ ID NO: 152943 - RNA, 64 nt, Homo Sapiens
gcagauuuccauuuuuuguauuugauagauccuuuaaaaaaaaguugauuacaauugagggaag

SEQ ID NO: 152944 - RNA, 64 nt, Homo Sapiens
ccuagugcugauucacagcuggauaauuauccaauaaaaaaaaacuguuaaacaacucuuuaaa

SEQ ID NO: 152945 - RNA, 64 nt, Homo Sapiens
aaauauuuuugaucuaaacaauauuguuaaucaguaaaaaaaaaucgaagauuuuuuaaaaaua

SEQ ID NO: 152946 - RNA, 64 nt, Homo Sapiens
aaacuacaaaauccuuuuaaggaguuagauguauuaaaaaaacgaacuuuuacuugugggggug

SEQ ID NO: 152947 - RNA, 64 nt, Homo Sapiens
cuacccugucuguuggucagacucaaaugagaguuaaaaaaaaaaaaaaaaaucuguaugccug

SEQ ID NO: 152948 - RNA, 64 nt, Homo Sapiens
gagauaaaggauuugguuucccugccaugaguauuaaaaaaauuuaaguuuucccaagcuugca

SEQ ID NO: 152949 - RNA, 64 nt, Homo Sapiens
gggugcaaagauguucauucuuuuaaaaaauguuuaaaaaaaaaaaaaaacugccuuucuuccc

SEQ ID NO: 152950 - RNA, 64 nt, Homo Sapiens
agaauuuuuuucguuauuuuuacaucuaacaaaguaaaaaaauuaaaaagaggguaagaaacga

SEQ ID NO: 152951 - RNA, 64 nt, Homo Sapiens
cgagagggauaaaaaauuaaaagaaaacaaacuuuaaaaaaaagugggaaaauauaaacgaggg

SEQ ID NO: 152952 - RNA, 64 nt, Homo Sapiens
aacaaaauauaagaggaacauaacaaguaaauuuuaaaaaaaagacaaaaaaagagaaaaaaca

SEQ ID NO: 152953 - RNA, 64 nt, Homo Sapiens
aaaauuccugggcauuugaucauuaaagaugauuuaaaaaaaagcaaaaaaauuauuaaaaaua

SEQ ID NO: 152954 - RNA, 64 nt, Homo Sapiens
ccgagcagcaaaaggggagaguaauuauuuuauuuaaaaaaauaagggauggguugggggcggg

SEQ ID NO: 152955 - RNA, 64 nt, Homo Sapiens
aaaaacaaaaaaaaucaaaacaaacaguuuuauuuaaaaaaacagggauaaaauagcuguuuca

SEQ ID NO: 152956 - RNA, 64 nt, Homo Sapiens
aaaaaguacaaaaaaaucuuaaauaucugaguuuuaaaaaaagauuguaaauuguauaauuuuu

SEQ ID NO: 152957 - RNA, 64 nt, Homo Sapiens
agcuggaaaauuacuuaaaacaggaaagugucaauaaaaaaacuugagcaacaccaacauauuu

SEQ ID NO: 152958 - RNA, 64 nt, Homo Sapiens
gcugcugaauuugugccccuggauuggaagcaaauaaaaaaaaaaaacaacacauaaacuaaac

SEQ ID NO: 152959 - RNA, 64 nt, Homo Sapiens
uuuaccaagaggaaagcuuuuacuguguugaagcuaaaaaaauaauggcucuuugacaaaacuu

SEQ ID NO: 152960 - RNA, 64 nt, Homo Sapiens
auccaguagaaaauguuaggauaugugugcuauauaaaaaaaaaaaaagacuuguuaaguuuua

SEQ ID NO: 152961 - RNA, 64 nt, Homo Sapiens
auuuagagcaaucccacaugcuuuucacaaacauuaaaaaaaaaaaccuuucagggucuuucau

SEQ ID NO: 152962 - RNA, 64 nt, Homo Sapiens
uuccuuuuguccacuuauauaguuauuuucucuuuaaaaaaaaauuuuuuuuaauguauuagag

SEQ ID NO: 152963 - RNA, 64 nt, Homo Sapiens
ccaugugcauggaaaagauguucaugguacauuguaaaaaaauaaaauuaaaauuaaaaaaagu

SEQ ID NO: 152964 - RNA, 64 nt, Homo Sapiens
uucaugguacauuguaaaaaaauaaaauuaaaauuaaaaaaaguuugcagaaccgcauauacag

SEQ ID NO: 152965 - RNA, 64 nt, Homo Sapiens
auuauaaauguaguuaguuugauacuccuuagaauaaaaaaaugaaacaguaacaacuuuuaug

SEQ ID NO: 152966 - RNA, 64 nt, Homo Sapiens
agaauaaaaaaaugaaacaguaacaacuuuuauguaaaaaaauuuuacauaagaguuagcaucu

SEQ ID NO: 152967 - RNA, 64 nt, Homo Sapiens
uguaaauuaucaagcuucaaaaagcuuuuuuuuuuaaaaaaaaacaugcauauucuaaaaauga

SEQ ID NO: 152968 - RNA, 64 nt, Homo Sapiens
aucugcacaguuugguuuuugcacaaaagucauuuaaaaaaaucugaguaauugucaaauauua

SEQ ID NO: 152969 - RNA, 64 nt, Homo Sapiens
caccaguggaacuaaacaguaaaucacuguccauuaaaaaaaaucaaaaacaccaaaucauuug

SEQ ID NO: 152970 - RNA, 64 nt, Homo Sapiens
acaaauagcugacccgggugucaaaacauaaaaauaaaaaaaauccacagagcaagacuccguc

SEQ ID NO: 152971 - RNA, 64 nt, Homo Sapiens
gauguuaaaacagugaaauuaccccaucucuauauaaaaaaaaagaccugggcagcauagcgag

SEQ ID NO: 152972 - RNA, 64 nt, Homo Sapiens
uucugugacacauucaaaaagaauguacuguauuuaaaaaaaccugacauugaaguuguuggag

SEQ ID NO: 152973 - RNA, 64 nt, Homo Sapiens
caucucacaugcauuuuauauauguugcaugcauuaaaaaaaaucggggacaacaucugaaggg

SEQ ID NO: 152974 - RNA, 64 nt, Homo Sapiens
uggauuuuuguguaugucugauuuauguauguaauaaaaaaagugucauuuaaagucaauauuu

SEQ ID NO: 152975 - RNA, 64 nt, Homo Sapiens
uaaagcagcucuuaugggcugcuuacaucucccuuaaaaaaaucguucagauggugauucugaa

SEQ ID NO: 152976 - RNA, 64 nt, Homo Sapiens
uuuuuuuuuuuuuuauaaaagggaaaguguauuauaaaaaaagaaauuuuuuuucacuucugaa

SEQ ID NO: 152977 - RNA, 64 nt, Homo Sapiens
aucacuucacuuauauuaagacaaaaggaacuuuuaaaaaaaaagauauauucacaaagagaaa

SEQ ID NO: 152978 - RNA, 64 nt, Homo Sapiens
aaaaagccaagauuucauugaccaaacauuuguguaaaaaaaaaaucacuaguguggcuaaaua

SEQ ID NO: 152979 - RNA, 64 nt, Homo Sapiens
aaaaaagauuuccaaaaugcugccaccguaaacauaaaaaaaaauucuuuucauagucguauuu

SEQ ID NO: 152980 - RNA, 64 nt, Homo Sapiens
uguucccauaggugcagcaaaaaauguuuuuguuuaaaaaaaacgccuuaacucuguauuaaaa

SEQ ID NO: 152981 - RNA, 64 nt, Homo Sapiens
guuuuuguuuaaaaaaaacuccuuaacucuguauuaaaaaaaauugugaaauauaagccugcgg

SEQ ID NO: 152982 - RNA, 64 nt, Homo Sapiens
acucgcugacauaaucucccauuuuuuaguuggauaaaaaaaaauuugaccucauuaguuguua

SEQ ID NO: 152983 - RNA, 64 nt, Homo Sapiens
acauugaaacaucaaacuuaacgccuuaggauuuuaaaaaaauuaaaauaguuugccuuagguc

SEQ ID NO: 152984 - RNA, 64 nt, Homo Sapiens
auuggaagcacaagugcaugaaacaaagcagcuuuaaaaaaauauaacuauuucacaugaguca

SEQ ID NO: 152985 - RNA, 64 nt, Homo Sapiens
ggauauuucaaucuuuuaaauuuaaucuuuuuuuuaaaaaaacuaguagguauuaaucuuauug

SEQ ID NO: 152986 - RNA, 64 nt, Homo Sapiens
uggagugaagugcaauauuauaaauauuauagauuaaaaaaaaaauagccgugcacucuugacc

SEQ ID NO: 152987 - RNA, 64 nt, Homo Sapiens
ccucauucauccauuuuucuuaaaagcuggaaauuaaaaaaaaaaaagagagagagaggcuuua

SEQ ID NO: 152988 - RNA, 64 nt, Homo Sapiens
gaggagagaggcuuucgguggacacguuugacauuaaaaaaaaaaaaaaaaaaaaaaaaaaacu

SEQ ID NO: 152989 - RNA, 64 nt, Homo Sapiens
ggacaacaucugaaggguauguugcaugcauuuuuaaaaaaaucaucucauaugcauuguauag

SEQ ID NO: 152990 - RNA, 64 nt, Homo Sapiens
acuccagccuggacgacagagcaagacccuguauuaaaaaaaaaauucauccugcacagggaaa

SEQ ID NO: 152991 - RNA, 64 nt, Homo Sapiens
ggccugggcagcauagcgagaccccaucucuauauaaaaaaaaagauguuaaaacagugaaauu

SEQ ID NO: 152992 - RNA, 64 nt, Homo Sapiens
gauccgcagauucaugcagcauuccauauuuuuuuaaaaaaagguuacacugugcaccgacgug

SEQ ID NO: 152993 - RNA, 64 nt, Homo Sapiens
cucauucaaacuucuguccaugucccuccacuguuccuaucagcagguggccccugggcaucag

SEQ ID NO: 152994 - RNA, 64 nt, Homo Sapiens
ccugucuaccuccucucacccugccacagauucuuccuaucacacagggaugccaguuguauuu

SEQ ID NO: 152995 - RNA, 64 nt, Homo Sapiens
aacaucuauuuuugauguccccugcagaaacucauccuaucagacaucaauuuugcauugagaa

SEQ ID NO: 152996 - RNA, 64 nt, Homo Sapiens
uauugacauguauggacaucaguagagucuaucuuccuaucagcuaugagcuucgccauaacca

SEQ ID NO: 152997 - RNA, 64 nt, Homo Sapiens
ucuucuaucuaauccuuaaagcuaaaaggaauagguaggagaccuggagcuuugcagccaaggu

SEQ ID NO: 152998 - RNA, 64 nt, Homo Sapiens
augcacaguuugcuauuugcgcuggccaaagucaguaggagagggagaccaagcuuguuucccu

SEQ ID NO: 152999 - RNA, 64 nt, Homo Sapiens
cagauggcaccuguggccagcacuuuggucacaaguaggagacauggaccacaccuccgugguu

SEQ ID NO: 153000 - RNA, 64 nt, Homo Sapiens
caaaaccugaugcaaaaaacagaaaaggggugauguaggagauggucagguugguaggagaagc

SEQ ID NO: 153001 - RNA, 64 nt, Homo Sapiens
cagaaaaggggugauguaggagauggucagguugguaggagaagcuauaaggaaagacgcaauu

SEQ ID NO: 153002 - RNA, 64 nt, Homo Sapiens
gaaaaguucuguuuuguuggauuaguuguuucaaguaggagacauucccauuauuucuuaugag

SEQ ID NO: 153003 - RNA, 64 nt, Homo Sapiens
gggagaccuuuuuauuuuguuauaucacagcuaaguaggagaaaaccauauuauuaaauaccua

SEQ ID NO: 153004 - RNA, 64 nt, Homo Sapiens
cggucugcuuuggaugauuucacagcuccgagcuguaggagagugugguacuggcaauaagaua

SEQ ID NO: 153005 - RNA, 64 nt, Homo Sapiens
cgacagcacacacaguggaugaucgaagaggccaguaggagacacagcacuuugguuuugcuga

SEQ ID NO: 153006 - RNA, 64 nt, Homo Sapiens
cucucaugcuguaaauaauggaagguugagaaccguaggagaggagaucacaguagugccuaau

SEQ ID NO: 153007 - RNA, 64 nt, Homo Sapiens
uaaccuuaguguguuacacaccaugauaaugucaguaggagacucacagagaauccaaaccaau

SEQ ID NO: 153008 - RNA, 64 nt, Homo Sapiens
cuugaaugauggauaaggggguacacagaccaagucccuauaaacaaggaccuuccaguccagg

SEQ ID NO: 153009 - RNA, 64 nt, Homo Sapiens
aacccuccucagggugguugaguuccagccaugcucccuauaaaugucauguggcuuaccucuc

SEQ ID NO: 153010 - RNA, 64 nt, Homo Sapiens
cagcuggagagaucugugugacuguucuguauauucccuauaggagucauucuuugaaggugac

SEQ ID NO: 153011 - RNA, 64 nt, Homo Sapiens
auugaugaugugaaaaccuauggcuucuuuggacucccuauaugugcuauguuaccugcuaggc

SEQ ID NO: 153012 - RNA, 64 nt, Homo Sapiens
aauauuaauugucuagaauguugcuuauugccuuucccuauauaacuuaaugacuggaaaaaac

SEQ ID NO: 153013 - RNA, 64 nt, Homo Sapiens
ucuugaaucuacaaauaucuauauagauauauaaucccuauauauauagacacacauauaauau

SEQ ID NO: 153014 - RNA, 64 nt, Homo Sapiens
accugccaacaugguugacaaucuuuguuguccaucccuauacacucugauugccccaauaaaa

SEQ ID NO: 153015 - RNA, 64 nt, Homo Sapiens
aguggaauuuucugucauggauaaugugcuugagucccuauaaucuauagacaugugauagcaa

SEQ ID NO: 153016 - RNA, 64 nt, Homo Sapiens
ccucuaggcccggggguggguccucacccuaaacucccuauagccacucucuucaccgcccucu

SEQ ID NO: 153017 - RNA, 64 nt, Homo Sapiens
agucauuccaaguccuauggccuggaaauuguauucccuauaauauacaaauuuuccuguaaua

SEQ ID NO: 153018 - RNA, 64 nt, Homo Sapiens
gccuggccuccagcccgagucgucauccccggagucccuauacagagguccugccauggaaccu

SEQ ID NO: 153019 - RNA, 64 nt, Homo Sapiens
uuauaucuauauugcaaaauguaguucuuauauaucccuauauauggguuuuggggauuuucuu

SEQ ID NO: 153020 - RNA, 62 nt, Homo Sapiens
uugaaucucaugccuguuaaugaaauaaaagugaucccuauauugguuuguauuuaauuguu

SEQ ID NO: 153021 - RNA, 64 nt, Homo Sapiens
augaucuguaauaaaauaguguucaugucuguagucccuauagagacugugcacauuuccucua

SEQ ID NO: 153022 - RNA, 64 nt, Homo Sapiens
gagaaauuguggacaugguagaaagcugcuuugcucccuauauuuuaaguagauguaaugacua

SEQ ID NO: 153023 - RNA, 64 nt, Homo Sapiens
agauguucaaaauucggccaucuaauuugaucacucccuauaacauuguuuuuccacauugccu

SEQ ID NO: 153024 - RNA, 64 nt, Homo Sapiens
ggguauaauuuuacacaguauuacaagagccuauucccuauaaagaaauaaguuaaaaggcagc

SEQ ID NO: 153025 - RNA, 64 nt, Homo Sapiens
ucacacugaacucaggauggccugguguuguucuucccuauacuaaaacugcaucgauccccag

SEQ ID NO: 153026 - RNA, 64 nt, Homo Sapiens
uuuaaagguuagacacuuucagagaucaaggugcucccuauacucccuuguuccaucagaagcu

SEQ ID NO: 153027 - RNA, 64 nt, Homo Sapiens
cucucugcuaaccuuccaccuuaugcacacacuuucccuauauuuuaagauaagucugcuagga

SEQ ID NO: 153028 - RNA, 64 nt, Homo Sapiens
cccuguucuuucccagacaucccuuacuauccauucccuauacagaugcccucuagauuaggug

SEQ ID NO: 153029 - RNA, 64 nt, Homo Sapiens
gcacuucagagaaauuaaaaaauacagaaaaagcucccuauaauuacuguagaacacuauuuuu

SEQ ID NO: 153030 - RNA, 64 nt, Homo Sapiens
cccucaaccaccuauucauuaugaccaugaaguuucccuauaaagaagaaggauccugggcuug

SEQ ID NO: 153031 - RNA, 64 nt, Homo Sapiens
cauauuaauauuccaaucauagacuagaaagcuuucccuauagauuuuuacaugauuuugaaau

SEQ ID NO: 153032 - RNA, 64 nt, Homo Sapiens
cuagacaaaacugagccuguucucagaaaugcugucccuauacaugagaaaugaauaagcuuuc

SEQ ID NO: 153033 - RNA, 64 nt, Homo Sapiens
gaagucuccccgcagcccucuccacccagaggucucccuauaccgagacccaccauccuuccau

SEQ ID NO: 153034 - RNA, 64 nt, Homo Sapiens
uuaucaaaagaagaaaaaacugaagguacuuuacucccuauagagaaaccauugccaucauugu

SEQ ID NO: 153035 - RNA, 64 nt, Homo Sapiens
cuaaacauuaccauuuauguggcagaaguucuguucccuauaaucugcaaugcugaaguaucuc

SEQ ID NO: 153036 - RNA, 64 nt, Homo Sapiens
agagcaucauaggucuccuugugcuaccuuuuacucccuauaaauagaaauccaaguauacuuu

SEQ ID NO: 153037 - RNA, 64 nt, Homo Sapiens
uuaaaauguguauauauauaaaaauaaacuuuauucccuauaacuuuguuuaacacuaucugcc

SEQ ID NO: 153038 - RNA, 64 nt, Homo Sapiens
caucucuuuuagguacgcaacaaguuaagguacuucccuauaucaagucuuaggaaagacuacu

SEQ ID NO: 153039 - RNA, 64 nt, Homo Sapiens
cuuaaccuacucgaaaccgguguucugacaagggucccuauaacuugggagcccuuuguaucaa

SEQ ID NO: 153040 - RNA, 64 nt, Homo Sapiens
ggaaaugauuggaauagaaucauugacuuuaauuucccuauacacuuugggucuucauuugaug

SEQ ID NO: 153041 - RNA, 64 nt, Homo Sapiens
uggcucauuuuacugucuuccuuuugauugccuaucccuauaaguuuucccucuggacacucug

SEQ ID NO: 153042 - RNA, 64 nt, Homo Sapiens
aguaaagccuuuuucugcccgccuugcugacuucucccuauaaacuagccauagauuccuuuca

SEQ ID NO: 153043 - RNA, 64 nt, Homo Sapiens
ucauagaggaccaccuuuuggaucauaaauucuuucccuauaacauuccuucucugccucucua

SEQ ID NO: 153044 - RNA, 64 nt, Homo Sapiens
ucauuagagcagaggcuauuuuucugcauucuugucccuauaacagggaugcuuaauuuuuuuu

SEQ ID NO: 153045 - RNA, 64 nt, Homo Sapiens
ugaagagaacuagggaaguacauaucuucagauaucccuauauaguucucuaccuucaguuuua

SEQ ID NO: 153046 - RNA, 64 nt, Homo Sapiens
cuauggagagcagcaaguugaucuuaguuaagucucccuauaugagggauaaguuccugauuuu

SEQ ID NO: 153047 - RNA, 64 nt, Homo Sapiens
aaaugaaauugaagaauucauucaaaugcucuuuucccuauaaccucuuuucucaccaaaaagg

SEQ ID NO: 153048 - RNA, 64 nt, Homo Sapiens
augaaauguuuuccuggaacuuucugggauaugcucccuauaaagggacuaguauuuucuaaug

SEQ ID NO: 153049 - RNA, 64 nt, Homo Sapiens
auuguuaaugcacaaaugauugucuuuuagugcuucccuauacauaauaucauuauaauguuuu

SEQ ID NO: 153050 - RNA, 64 nt, Homo Sapiens
cccaucauaaagucaaaaaagaaauggggcugcaucccuauaaaccuaaggagcuccucagcuu

SEQ ID NO: 153051 - RNA, 64 nt, Homo Sapiens
uagugugaauuuauauccagguccuuggcugugaucccuauacaaaagaaugucuacugcucuu

SEQ ID NO: 153052 - RNA, 64 nt, Homo Sapiens
acccgcucggacuuacugccugaccuuggaaucgucccuauaucagggccugagugaccuccuu

SEQ ID NO: 153053 - RNA, 64 nt, Homo Sapiens
cuccuuggcuuuaugacuuaaaccaacuacaacuucccuauagcuucuaagcaguuucaucagc

SEQ ID NO: 153054 - RNA, 64 nt, Homo Sapiens
ucuauugccuuauaugcaaauuugaacuuguuccucccuauaguaccuucuugaaaaggaagca

SEQ ID NO: 153055 - RNA, 64 nt, Homo Sapiens
cucuucauuguuuucuuuucauaucauauucuguucccuauaacaaauucuuacuuuccauucc

SEQ ID NO: 153056 - RNA, 64 nt, Homo Sapiens
uagcccugcgcacguaggacugaauucagugauaucccuauacacugccauuuaguggauaggu

SEQ ID NO: 153057 - RNA, 64 nt, Homo Sapiens
ccuuuuaccguggcaaccgucaagcuauucucugucccuauaccaggugucaucaaauuuuuuu

SEQ ID NO: 153058 - RNA, 64 nt, Homo Sapiens
gagagaguuugaaagaaauuuucagauguucuguucccuauagagggccuauuccaggaucuaa

SEQ ID NO: 153059 - RNA, 64 nt, Homo Sapiens
aaaaauauaaaaauuaguugcgugugguggcacaucccuauagucccagcuacuugggaggcug

SEQ ID NO: 153060 - RNA, 64 nt, Homo Sapiens
aacugugccuggugagagacuuuggcccccucccucccuauaaggcuguggaaccugaggaagu

SEQ ID NO: 153061 - RNA, 64 nt, Homo Sapiens
uuaaacucccucucuuaaauaaugauguuuugagucccuauaguuuggcccacagucucccaga

SEQ ID NO: 153062 - RNA, 64 nt, Homo Sapiens
aaauuagauuugaagaggauuucaauaaucuuauucccuauauuaaucaggaaaaaaauuuuuu

SEQ ID NO: 153063 - RNA, 64 nt, Homo Sapiens
ggcagauacacuugugacugucacacaggaaacuucccuauacuagucgcgaucaaggacucuc

SEQ ID NO: 153064 - RNA, 64 nt, Homo Sapiens
ccucccaugaaaaauggcuuauaucgccuuccucucccuauaucuugugcagagugggauguaa

SEQ ID NO: 153065 - RNA, 64 nt, Homo Sapiens
cugaauguaaaacacuccuagccaguuguugcauucccuauauuuauuuacuuccaauauuuua

SEQ ID NO: 153066 - RNA, 64 nt, Homo Sapiens
cuuuucucuuuuguuuuagugccccccgcccccaucccuauaauaucuguaacuacuccuaaaa

SEQ ID NO: 153067 - RNA, 64 nt, Homo Sapiens
aguugaauuuugauaucuacccauuuuucugucaucccuauaguucacuuuguauuaaauuggg

SEQ ID NO: 153068 - RNA, 64 nt, Homo Sapiens
ugcaaaaucccuauggagccugucaccacuccccucccuauauacccccaccccacaaagauuu

SEQ ID NO: 153069 - RNA, 64 nt, Homo Sapiens
uugcuccguggacacucggaggccugcguucuguucccuauaaauggaagcgugcucugagccu

SEQ ID NO: 153070 - RNA, 64 nt, Homo Sapiens
aaguggauaaaagauauaccucuuuaauaacacaucccuauagagaugaagaaaauguguguga

SEQ ID NO: 153071 - RNA, 64 nt, Homo Sapiens
ucuuuuugaaaauauagguaguaugcaucagaauucccuauagagaaauggguuuuaaacuuug

SEQ ID NO: 153072 - RNA, 64 nt, Homo Sapiens
uaaacaaugcaaaaucuaaaauugucaaauaucuucccuauaucaaaauauauuuuuucuuuuc

SEQ ID NO: 153073 - RNA, 64 nt, Homo Sapiens
ccccacaucaagggagagauaucuugaauuguaaucccuauaaugugcccccaccuaaaauauc

SEQ ID NO: 153074 - RNA, 64 nt, Homo Sapiens
gcuuggagcugagcaaaucaugcaaaccgccaccucccuauacugaaaccuacugcccaggcac

SEQ ID NO: 153075 - RNA, 64 nt, Homo Sapiens
gccuuuguuuguaaaccaaaaaguaauaaaugaaucccuauauuuccauuauaguauuuauugu

SEQ ID NO: 153076 - RNA, 64 nt, Homo Sapiens
ugguguggaaauggcugaagaguuugcucuuguaucccuauaguccaagguuucucaaucugca

SEQ ID NO: 153077 - RNA, 64 nt, Homo Sapiens
ccugaggaaauggaaugaaccacucccugcccauucccuauaagaauaucccaagacccaggca

SEQ ID NO: 153078 - RNA, 64 nt, Homo Sapiens
ccauaacaauucccccauccuucagugaacuaagucccuauaauaaaggcugaggcugcaucug

SEQ ID NO: 153079 - RNA, 64 nt, Homo Sapiens
uuuugaauuacuagagcuuuggucaguauuuccuucccuauaugucacagagggcaccacugag

SEQ ID NO: 153080 - RNA, 64 nt, Homo Sapiens
ugcagcuguaucucacacuauuugugaacuuacuucccuauauuuuagcuuuagaaaauaacag

SEQ ID NO: 153081 - RNA, 64 nt, Homo Sapiens
uuucugucuuccagguucuaccagggcuugaggcucccuauacuggcugcucuugcucucccuc

SEQ ID NO: 153082 - RNA, 64 nt, Homo Sapiens
uuuguaccacuuuugagagccauacaaguaucuuucccuauauaauguuuucuuguuuaucaca

SEQ ID NO: 153083 - RNA, 64 nt, Homo Sapiens
uaugucaguuagcuaaaacuucagaauacauuucucccuauaaagaguuauaaaugaugguuua

SEQ ID NO: 153084 - RNA, 64 nt, Homo Sapiens
uaaccgugaaaacuugagaggcacucugcccucuucccuauaaaaucacacagcgugauuuuac

SEQ ID NO: 153085 - RNA, 64 nt, Homo Sapiens
ucaagacuagccugggcaacauggcaagacccugucccuauaaaaaauacaaaaauuagccagg

SEQ ID NO: 153086 - RNA, 64 nt, Homo Sapiens
aaaggcaauaggacacaaaacucaaacaauauuuucccuauaaccccuaacucuccuuccuugg

SEQ ID NO: 153087 - RNA, 64 nt, Homo Sapiens
aaauccaucugcuuuuauacuuccuauuuauaugucccuauacaagucccuuccuccaggaccu

SEQ ID NO: 153088 - RNA, 64 nt, Homo Sapiens
uucaccacuccucucccuuguuuuggcuggggagucccuauaguuuaacccugauucauacucc

SEQ ID NO: 153089 - RNA, 64 nt, Homo Sapiens
ugauguauuugugacacccuucauguccccucucucccuauaaaguauaagauuuuggacuugu

SEQ ID NO: 153090 - RNA, 64 nt, Homo Sapiens
uuucuaagauaacugauacuaauacuuguuuucuucccuauaacauaaaaaacuucacuguuaa

SEQ ID NO: 153091 - RNA, 64 nt, Homo Sapiens
uaaucacacugcgguaggucauucuuuugccacaucccuauagaccacuggguuuggcaaaacu

SEQ ID NO: 153092 - RNA, 64 nt, Homo Sapiens
cagucuuuaaaggauuacaaucuauguguuuguuucccuauaugcaagggauucuuuuccuagu

SEQ ID NO: 153093 - RNA, 64 nt, Homo Sapiens
uuaauuacaauuggauuucauucuugaauugcuuucccuauagaacauuuaaguaucccgaauu

SEQ ID NO: 153094 - RNA, 64 nt, Homo Sapiens
auucacaaggucaaaguucugguccacaaacccuucccuauagaaguucaauggcugcgaaaga

SEQ ID NO: 153095 - RNA, 64 nt, Homo Sapiens
uuuucagcuaacuugcuucugcacagacccccuuucccuauaagggcacacauucacugguccc

SEQ ID NO: 153096 - RNA, 64 nt, Homo Sapiens
uuaggguucuucuuauccucagggacaugagcauucccuauagauuacugaccuguccuccuuc

SEQ ID NO: 153097 - RNA, 64 nt, Homo Sapiens
uauacuucaaaauauuugacuuaauuuuaauccuucccuauaauaguucccccuggauaaagag

SEQ ID NO: 153098 - RNA, 64 nt, Homo Sapiens
gugcccugcccacccuuauccaguauuuuuuuccucccuauacaaucccaagacccaucaauau

SEQ ID NO: 153099 - RNA, 64 nt, Homo Sapiens
aauugagauguuuucagcaguaauuugcucuaggucccuauacuugagacauagaaagcuuaaa

SEQ ID NO: 153100 - RNA, 64 nt, Homo Sapiens
auaugauuauaaugcuauuuuuaguaaucuaaagucccuauaguuuggucccauuagcugaggu

SEQ ID NO: 153101 - RNA, 64 nt, Homo Sapiens
guaagaaagcaacagguaagauaggcuuucucucucccuauaccaaguaauuuauaccuacaca

SEQ ID NO: 153102 - RNA, 64 nt, Homo Sapiens
ccucaggcuccuggguggccgcacugagggucccucccuauacucccugaggguaaggacugag

SEQ ID NO: 153103 - RNA, 64 nt, Homo Sapiens
auagagcuggcagcugagaaaaucagucagaaagucccuauaggaauauucuuuugaccugauu

SEQ ID NO: 153104 - RNA, 64 nt, Homo Sapiens
aaacuuacuccgcguccugcucuucucaacucuuucccuauaggcuaggucagucccugcagac

SEQ ID NO: 153105 - RNA, 64 nt, Homo Sapiens
ugguggcuucugaauuugguauuugaacuaggagucccuauagaggggcugcuuuaugggaagu

SEQ ID NO: 153106 - RNA, 64 nt, Homo Sapiens
gaagccauuagcagaccuuugggccagggcagccucccuauaauuuucuucaucucuugcuaau

SEQ ID NO: 153107 - RNA, 64 nt, Homo Sapiens
auacaauauucuuccacauuauauuaugagcauuucccuauaaugcuuuuuaaauugucacuau

SEQ ID NO: 153108 - RNA, 64 nt, Homo Sapiens
gaccaaggaguuugugguaccacggagaagcaggucccuauauugugcagagggggcuggggcg

SEQ ID NO: 153109 - RNA, 64 nt, Homo Sapiens
uuuuuuuuuuuuuuuaacugacauugugaaauucucccuauagcuuuugccauucaagcaacau

SEQ ID NO: 153110 - RNA, 64 nt, Homo Sapiens
cuuuguccuccccauagagcuggggugggguggaucccuauaccuggggcaggcagccccaaag

SEQ ID NO: 153111 - RNA, 64 nt, Homo Sapiens
uugcacuuacacaagacuuuccccauacucugucucccuauaaugcuggagcggcuacuaaaaa

SEQ ID NO: 153112 - RNA, 64 nt, Homo Sapiens
agguggauggcugauuuuaauagcagaacucuucucccuauacaaaucacuuuauuguaaacac

SEQ ID NO: 153113 - RNA, 64 nt, Homo Sapiens
aagaggacacuucaucuuacgggcucaaguuagaucccuauagaaaaacauuugacuccaguga

SEQ ID NO: 153114 - RNA, 64 nt, Homo Sapiens
gaaugagucgaacuagaccaaucauucugaaaugucccuauaaaaaguaaauuuuagccaacuc

SEQ ID NO: 153115 - RNA, 64 nt, Homo Sapiens
caccccuggaaccagcaaguuggcccccgcccccucccuauaugccucaccgucucggggguug

SEQ ID NO: 153116 - RNA, 64 nt, Homo Sapiens
aauguguccugucuaaaaaugauucucuaaacuuucccuauacuuaggcauagucuucuuucuu

SEQ ID NO: 153117 - RNA, 64 nt, Homo Sapiens
cacgggucaggagggcaacgccugaagucagaccucccuauaggucaacagggacaaccugggg

SEQ ID NO: 153118 - RNA, 64 nt, Homo Sapiens
gcccaggagaagcugucccaggagggcuguuaacucccuauagagccaggagacaggauagggg

SEQ ID NO: 153119 - RNA, 64 nt, Homo Sapiens
ugguaaguguggaaaagccuuuagaucauaugaaucccuauacaugugagaaaucuuacagaag

SEQ ID NO: 153120 - RNA, 64 nt, Homo Sapiens
ggaaacugaaggaaggauacugacaucacuggugucccuauaagguuggguucgaucccuaauc

SEQ ID NO: 153121 - RNA, 64 nt, Homo Sapiens
cccagcaacucagggggcugggugugguggugcaucccuauacuaaaaacacaaaaauuagcca

SEQ ID NO: 153122 - RNA, 64 nt, Homo Sapiens
cugaagaagaacaugauccugucauggggguuaaucccuauaucauguucagcagcgcggcaga

SEQ ID NO: 153123 - RNA, 64 nt, Homo Sapiens
caugaagcuuaccgacuagugguggaaaaauauaucccuauacucuagucucaagagauacagu

SEQ ID NO: 153124 - RNA, 64 nt, Homo Sapiens
augugaauauguggaaauaaucacaaguucagaaucccuauacauggaccuuuuauugaaaaua

SEQ ID NO: 153125 - RNA, 64 nt, Homo Sapiens
ucacuuggacauuggucacucgauaaucaggauuucccuauaagaauauugaauuuccuuuggc

SEQ ID NO: 153126 - RNA, 64 nt, Homo Sapiens
uaguagaugcucaguguauacuuuuuacuuccacucccuauauaguuggagacauaucuaaauc

SEQ ID NO: 153127 - RNA, 64 nt, Homo Sapiens
aggaguggugaugucugaugcucaauuacuauuuucccuauaagaguuucagcaugagcuuaau

SEQ ID NO: 153128 - RNA, 64 nt, Homo Sapiens
uauaaucauugucaacccuuugaugagugauauuucccuauaccuauguacccagauagauaua

SEQ ID NO: 153129 - RNA, 64 nt, Homo Sapiens
uaugcuguaggauggaacagguuauugcugaagcucccuauaauccugaaaugaagagaauucc

SEQ ID NO: 153130 - RNA, 64 nt, Homo Sapiens
caaacccccacuccauuguauuuggagacuggccucccuauaaaugugguagcuucuuuuauua

SEQ ID NO: 153131 - RNA, 64 nt, Homo Sapiens
ccuacacuuugggaggccaaggugugguggcucaucccuauaauaaaccuuaaaugucuggccg

SEQ ID NO: 153132 - RNA, 64 nt, Homo Sapiens
aacagcccagcacagguauucaggccccaccccuucccuauaggccuucuaggaauggaggagc

SEQ ID NO: 153133 - RNA, 64 nt, Homo Sapiens
ucucccuccuucuuacacacgcauuugccaccacucccuauacuaacaaacaucaagucagcaa

SEQ ID NO: 153134 - RNA, 65 nt, Homo Sapiens; identical to SEQ ID NO: 46699

SEQ ID NO: 153135 - RNA, 65 nt, Homo Sapiens; identical to SEQ ID NO: 46700

SEQ ID NO: 153136 - RNA, 65 nt, Homo Sapiens; identical to SEQ ID NO: 46729

SEQ ID NO: 153137 - RNA, 65 nt, Homo Sapiens; identical to SEQ ID NO: 46730

SEQ ID NO: 153138 - RNA, 65 nt, Homo Sapiens; identical to SEQ ID NO: 46736

SEQ ID NO: 153139 - RNA, 65 nt, Homo Sapiens; identical to SEQ ID NO: 46737

SEQ ID NO: 153140 - RNA, 65 nt, Homo Sapiens; identical to SEQ ID NO: 46784

SEQ ID NO: 153141 - RNA, 65 nt, Homo Sapiens; identical to SEQ ID NO: 46785

SEQ ID NO: 153142 - RNA, 65 nt, Homo Sapiens; identical to SEQ ID NO: 46787

SEQ ID NO: 153143 - RNA, 65 nt, Homo Sapiens; identical to SEQ ID NO: 46788

SEQ ID NO: 153144 - RNA, 65 nt, Homo Sapiens; identical to SEQ ID NO: 46800

SEQ ID NO: 153145 - RNA, 65 nt, Homo Sapiens; identical to SEQ ID NO: 46801

SEQ ID NO: 153146 - RNA, 65 nt, Homo Sapiens; identical to SEQ ID NO: 46823

SEQ ID NO: 153147 - RNA, 65 nt, Homo Sapiens; identical to SEQ ID NO: 46824

SEQ ID NO: 153148 - RNA, 65 nt, Homo Sapiens; identical to SEQ ID NO: 46864

SEQ ID NO: 153149 - RNA, 65 nt, Homo Sapiens; identical to SEQ ID NO: 46865

SEQ ID NO: 153150 - RNA, 64 nt, Homo Sapiens
agcagaugguacuucaacagugaggucauggugacucagugaucuaugcaaccugacaaaccac

SEQ ID NO: 153151 - RNA, 64 nt, Homo Sapiens
ucucauuauacaaagagaacaagcaagaaucuuucucagugaaaagaagauuggaaugcuucca

SEQ ID NO: 153152 - RNA, 64 nt, Homo Sapiens
uaaauuagauuuggcaucucuuuucucaaaggcccucagugagaugagccuggcccugaagcgu

SEQ ID NO: 153153 - RNA, 64 nt, Homo Sapiens
ucaaagccuggccuaauugugugcugguccccuccucagugacauuccuacuguccucagaggc

SEQ ID NO: 153154 - RNA, 64 nt, Homo Sapiens
agugucuucuauuuucauuaaaaagggcuuuacccucagugaaauggcuaaaucuagagcugcu

SEQ ID NO: 153155 - RNA, 64 nt, Homo Sapiens
accucuuucccugggaccagugaauucaugaugccucagugaccuagcagcagaaggugcuccu

SEQ ID NO: 153156 - RNA, 64 nt, Homo Sapiens
cugccucuucuggccuggugucuccucaugcccccucagugaggaucuucauguaccugcucuu

SEQ ID NO: 153157 - RNA, 64 nt, Homo Sapiens
gauccagugcugagcaagcaauguacaccagagccucagugagcccaucugcacaguggggagc

SEQ ID NO: 153158 - RNA, 64 nt, Homo Sapiens
ugugaagaugcguugggcugcaaguaacagaaaucucagugaacaguggccuggcgugguggcu

SEQ ID NO: 153159 - RNA, 64 nt, Homo Sapiens
gaugaucauugcuagaacugagagaccagccuggcucagugaacuucagggcguuccguucauu

SEQ ID NO: 153160 - RNA, 64 nt, Homo Sapiens
agaagaaccuccuuuuuaucaucaucccuuuaaacucagugaacccaaaccuauuuuuuucaau

SEQ ID NO: 153161 - RNA, 64 nt, Homo Sapiens
agcaaugagugaacgggcacuugcucagaaaagacucagugagaaugcauuugaucuugaagcc

SEQ ID NO: 153162 - RNA, 52 nt, Homo Sapiens
uugcugccacuuccaacugaagcucagugaccugggugggcaguggccaagc

SEQ ID NO: 153163 - RNA, 64 nt, Homo Sapiens
ugacauggccuugaggagauucagggcaccuuuccucagugagcuuugauaugguccaaaaaca

SEQ ID NO: 153164 - RNA, 64 nt, Homo Sapiens
ucacugaacacacgaauaacuuggauagcaaauccugagacaauggaaaaccauuaacuuuacu

SEQ ID NO: 153165 - RNA, 64 nt, Homo Sapiens
uuuugccaaauauccagauaaccaguuuucacaucugagacauuacaaaguaucugccucaauu

SEQ ID NO: 153166 - RNA, 64 nt, Homo Sapiens
guccugaccuucugugauguggaaacccuaggcucugagacacacucucuggugucugagacag

SEQ ID NO: 153167 - RNA, 64 nt, Homo Sapiens
gaaacccuaggcucugagacacacucucuggugucugagacagaaccaaagcaauaacguugug

SEQ ID NO: 153168 - RNA, 63 nt, Homo Sapiens
cuuggaaauaccagacauagcaauaacaacauucugagacacagaggugccagugauggacug

SEQ ID NO: 153169 - RNA, 64 nt, Homo Sapiens
aaugaugagucuucccuuucaacuguuguuaaaucugagacauccugacucucgagcugggaag

SEQ ID NO: 153170 - RNA, 64 nt, Homo Sapiens
agagcaacugaggagcucugcgagagugugcccucugagacagcccuguccgccccgcccaggu

SEQ ID NO: 153171 - RNA, 64 nt, Homo Sapiens
gggcggccagugcagugaugccuggcgcuuccagcugagacaggaguccggacagaggugggca

SEQ ID NO: 153172 - RNA, 64 nt, Homo Sapiens
ggccugcuuccaggccucuuugcugucagcccuucugagacaggaccuggcuucaggacugugg

SEQ ID NO: 153173 - RNA, 64 nt, Homo Sapiens
uugucuucccaguguugguuugaacccugugagccugagacagagagggccaggcaccaaccac

SEQ ID NO: 153174 - RNA, 64 nt, Homo Sapiens
ucuccagccuccaccugccugucugauccaagagcugagacacggccacccagcaccagucacu

SEQ ID NO: 153175 - RNA, 64 nt, Homo Sapiens
gucuugugaguugugcagggugaagaccgcuucccugagacaggggcaguggugcugauggaau

SEQ ID NO: 153176 - RNA, 64 nt, Homo Sapiens
cccgugacucagacuugccaagacaaugccgagccugagacaaauuggaccacauccuaaccug

SEQ ID NO: 153177 - RNA, 64 nt, Homo Sapiens
gccgagccugagacaaacccgaccacauccuaaccugagacaauauaauaagugggaguccuug

SEQ ID NO: 153178 - RNA, 64 nt, Homo Sapiens
ugcaggcaccgcuggguucugacucuggaccaugcugagacaucccucaucuagucuugaccuc

SEQ ID NO: 153179 - RNA, 64 nt, Homo Sapiens
caccuuugcagggaauaccucguuagagaauggccugagacagugcguugcaacuuuuuaauuc

SEQ ID NO: 153180 - RNA, 64 nt, Homo Sapiens
agaaucacuugaacccuggaagcuacucaggaggcugagacaggugguaugugccuguagucuc

SEQ ID NO: 153181 - RNA, 64 nt, Homo Sapiens
ucuuugccuucacuucccugcuagagacuuguuucugagacagucaggaccucaagcagacuuc

SEQ ID NO: 153182 - RNA, 64 nt, Homo Sapiens
ugaaggaacagcuccugaaaccagucucccugggcugagacaaccugggcucuucuuaggaaau

SEQ ID NO: 153183 - RNA, 64 nt, Homo Sapiens
gaucaccaggucaagcaccuaggccuggcuucuccugagacagaggacucagaaguggccuuuc

SEQ ID NO: 153184 - RNA, 64 nt, Homo Sapiens
ggaggguacgccaggcgagcccagggcacagaugcugagacagccucuccuucucagugcaggg

SEQ ID NO: 153185 - RNA, 64 nt, Homo Sapiens
uucaccccugccaggcaagcccagggcauagaugcugagacagccucucccucucagugcaggg

SEQ ID NO: 153186 - RNA, 64 nt, Homo Sapiens
auaacugcuguauucaugaaucuugagaguguuccugagacagaauuaauggucauuugggaaa

SEQ ID NO: 153187 - RNA, 64 nt, Homo Sapiens
guucuguuuucuaaaggagcagaaggacaggucucugagacaggaucguugucccuacaggagg

SEQ ID NO: 153188 - RNA, 64 nt, Homo Sapiens
uuacuaggcacacaggugaugcugacucgauggccugagacacaccccuugagaagaagcugcu

SEQ ID NO: 153189 - RNA, 64 nt, Homo Sapiens
acaauggacaacucaccaucaguccucugcucaccugagacaaaugcaugucugauugcuuccu

SEQ ID NO: 153190 - RNA, 64 nt, Homo Sapiens
augcaagagcugcaggccggugaggccacuuagccugagacauguguucccuaucuccacuccc

SEQ ID NO: 153191 - RNA, 64 nt, Homo Sapiens
cagaucacuugaggucaggaagcacuuugggaggcugagacagguggcucacgccuguaauccc

SEQ ID NO: 153192 - RNA, 64 nt, Homo Sapiens
gauuuaguaauuuugaggcaaaaaaaccaaaacuuuauaccaauuaaucuuuaaacuaucagga

SEQ ID NO: 153193 - RNA, 64 nt, Homo Sapiens
augugcauguuauugguagcaaaaauuacuuuuauuauaccauuucuuucaaaauauuuucaug

SEQ ID NO: 153194 - RNA, 64 nt, Homo Sapiens
aguggaucagcuggguuuugaauuuuuuuuaagauuauaccaacgauugacuuucuugaugggu

SEQ ID NO: 153195 - RNA, 64 nt, Homo Sapiens
acuccccccugaaguugacuucuauuuuuuaauuuuauaccaccaccaggugggguauuugguu

SEQ ID NO: 153196 - RNA, 64 nt, Homo Sapiens
gggaaaacucuucauuaaaguccacgggucucacuuauaccaaaccuuuugcuguuuggauguu

SEQ ID NO: 153197 - RNA, 64 nt, Homo Sapiens
gaccugaggcagaugaaauuugggaucgcaccuuuuauaccagagccuaggccugugagguaac

SEQ ID NO: 153198 - RNA, 64 nt, Homo Sapiens
auguggugcaagaagagaucuuaggucucuucuuuuauaccaagcucaucuuuuauaccaagcu

SEQ ID NO: 153199 - RNA, 64 nt, Homo Sapiens
ucuuaggucucuucuuuuauaccaagcucaucuuuuauaccaagcugugcaggugacuaugccu

SEQ ID NO: 153200 - RNA, 64 nt, Homo Sapiens
auuuaguaaaaaguuuuaguagucauauaaaagguuauaccacuagagaagucuauguucguaa

SEQ ID NO: 153201 - RNA, 64 nt, Homo Sapiens
auuauauaucagagaaagauuucaugaagugcuuuuauaccacuaacugauuaauagugagcau

SEQ ID NO: 153202 - RNA, 64 nt, Homo Sapiens
uguuuuuugacuacuuuuuauaacuuaagaauuuuuauaccaucuacaucuauccuacuuaugc

SEQ ID NO: 153203 - RNA, 64 nt, Homo Sapiens
auauacaaguauguuugaguuccaaucuuacauuuuauaccaaguucaaaacacuuucagauag

SEQ ID NO: 153204 - RNA, 64 nt, Homo Sapiens
aaagagaauguauuuccuuuucugauuuauaccauuauaccagccguucccauagauuugaaga

SEQ ID NO: 153205 - RNA, 64 nt, Homo Sapiens
auaccagcaaagagaauguauuugaagaucugauuuauaccauuagaugacucguucccauaga

SEQ ID NO: 153206 - RNA, 64 nt, Homo Sapiens
uuucuauucuugguggcuucgauauuugcagguauuauaccauuccccuuuuugccuuacaagu

SEQ ID NO: 153207 - RNA, 64 nt, Homo Sapiens
gaaaagguguuauaucuauguuggaaaagauguauuauaccaguaacaagccugccauaauccu

SEQ ID NO: 153208 - RNA, 64 nt, Homo Sapiens
gaaauacauugugccuuucucuagaugugauacguuauaccaaaaucuuuguagugugcagagc

SEQ ID NO: 153209 - RNA, 64 nt, Homo Sapiens
uggccagguuuuccucaggcuccaacaacugugcuuauaccaagcagauccucauccuccauau

SEQ ID NO: 153210 - RNA, 64 nt, Homo Sapiens
uuuggagacuggcugagaugugaucaguauuuuuuuauaccaguuuugucugucuuuuuuccuc

SEQ ID NO: 153211 - RNA, 64 nt, Homo Sapiens
ugcuucugcagcccgcagauuuccugcccauauauuauaccagucagccugucgggucucuuuc

SEQ ID NO: 153212 - RNA, 64 nt, Homo Sapiens
uaaauguaucuaugucucgacuuuucugaugaaguuauaccagaaaaguuaauuauuugauggg

SEQ ID NO: 153213 - RNA, 64 nt, Homo Sapiens
gcaguguuagcagggguggcaguccuuguguuuguuauaccaauaaaugcuuuagcugcaacua

SEQ ID NO: 153214 - RNA, 64 nt, Homo Sapiens
ccagcugucauaggaagaucaagguuagguguuuuagguacauucuagaucagggcuggugaag

SEQ ID NO: 153215 - RNA, 64 nt, Homo Sapiens
uguucuuuucaaaaauucagucgauuuugaacuuuagguacaugcccaagaucugugucacugg

SEQ ID NO: 153216 - RNA, 64 nt, Homo Sapiens
agccaggcuagugaucacaccccuguaacugccaagagcucagguuggcauauuauuguacuau

SEQ ID NO: 153217 - RNA, 64 nt, Homo Sapiens
cuauacaaaaccaauaugcacagucaauaauggaagagcucacuccauauucuuacaggccuuc

SEQ ID NO: 153218 - RNA, 64 nt, Homo Sapiens
cugggcuccuggcuagaugcaagcaagguggacaagagcucaggacuccagcccacugccacug

SEQ ID NO: 153219 - RNA, 64 nt, Homo Sapiens
auagaaacauguucauugcacacacccaaggagaagagcucaagcgcuuggaagaggaugcuuu

SEQ ID NO: 153220 - RNA, 64 nt, Homo Sapiens
uauaaaugugauguaugugggaaaauuuuccaucagagcucagcccuuacuagacaucagagaa

SEQ ID NO: 153221 - RNA, 64 nt, Homo Sapiens
uacaaauguaaagaaugugaaaagucuuucagucagagcucaagucuuagucgacauaaaagaa

SEQ ID NO: 153222 - RNA, 64 nt, Homo Sapiens
gcaaagagaaccuauuauuugccaguuuuuaagcagagcucaaucuaugccagcucucuggcau

SEQ ID NO: 153223 - RNA, 64 nt, Homo Sapiens
ugagauccuaagcucucaaaauagcauauucccuagagcucaagaaagcugguccaggagguug

SEQ ID NO: 153224 - RNA, 64 nt, Homo Sapiens
gugagugagccccuaagcuugaugcccccaaaucagagcucacaggaaagugugggcagccaca

SEQ ID NO: 153225 - RNA, 64 nt, Homo Sapiens
ccacugcucagagcaguaauaggcuaagauguugagagcucagauggccacuuuacuacuccua

SEQ ID NO: 153226 - RNA, 64 nt, Homo Sapiens
caaaccagguguccuuggcauuguguccacccagagagcucacuguuuucuuuucuuuuucuuu

SEQ ID NO: 153227 - RNA, 64 nt, Homo Sapiens
gggauuacagguguuagccacugcgcccggcccuagagcucacuguuuucuaguuaguccaucu

SEQ ID NO: 153228 - RNA, 64 nt, Homo Sapiens
guucagacagguccaaguuccaccucagggguuaagagcucagaaagagcucaccccagguucu

SEQ ID NO: 153229 - RNA, 64 nt, Homo Sapiens
ccagguucucaccucaggggggucccauggguuaagagcucacccuccucacucuagagggguu

SEQ ID NO: 153230 - RNA, 64 nt, Homo Sapiens
gccugucuaaauuguugccaucagagccauguggagagcucauguugagacaagagugguggga

SEQ ID NO: 153231 - RNA, 64 nt, Homo Sapiens
auacuagcugcuguuucaagcagaguguuagcuuagagcucaaaagaaaacaugacugaaaguc

SEQ ID NO: 153232 - RNA, 64 nt, Homo Sapiens
cccguuaccucgagcugacucuagaggggaaggcagagcucaggagggugggugggagcugcag

SEQ ID NO: 153233 - RNA, 64 nt, Homo Sapiens
guccucggguugggcuuggcccucucugccugagagagcucagcacacacacagcucagaccca

SEQ ID NO: 153234 - RNA, 64 nt, Homo Sapiens
gccuggaggcaguggcugagccagaaaguaacacagagcucaugcuuggagagagagagucuug

SEQ ID NO: 153235 - RNA, 64 nt, Homo Sapiens
ggggccuguguucuggguguuuuaaagcagacccagagcucaugggagagauguguacauaggu

SEQ ID NO: 153236 - RNA, 64 nt, Homo Sapiens
ugcuggucccguccccugcaacccucccggcuggagagcucaggcgacugagggccucugggcc

SEQ ID NO: 153237 - RNA, 64 nt, Homo Sapiens
auuaaaacuaaccgugaccacuacuccaaacaaaacacaauaugccuaggggcacggaugaacg

SEQ ID NO: 153238 - RNA, 64 nt, Homo Sapiens
uucuaauguaguuagaaguuucauugucugauggacacaauaugcccuuccgguucuauucaaa

SEQ ID NO: 153239 - RNA, 64 nt, Homo Sapiens
auuugauaaugcuuuuccaaagugaaaauaagauacacaauaaucauugcucugugugauuaca

SEQ ID NO: 153240 - RNA, 64 nt, Homo Sapiens
auuuaauuguauuuuguguuuauacagguauuucacacaauaauuuguucuuaaugcagccacu

SEQ ID NO: 153241 - RNA, 64 nt, Homo Sapiens
auuaaaucuuaauagauuuaaugcaauuuuacagacacaauaccuucaugaauuucaaaauuca

SEQ ID NO: 153242 - RNA, 64 nt, Homo Sapiens
acacuugugcacugaaagcuaacagggagagguuacacaauauuuuacaguuucuuaaacauaa

SEQ ID NO: 153243 - RNA, 64 nt, Homo Sapiens
guuuuuucuuucccauguauaaacuauuuauaucacacaauauaguuuuuucuguaauguaaau

SEQ ID NO: 153244 - RNA, 64 nt, Homo Sapiens
guauuauagacaaaagaauacgagagcuuggacuacacaauacauuucacaguggcuggacuac

SEQ ID NO: 153245 - RNA, 64 nt, Homo Sapiens
cauaggguauuugauacaaucauuaauggaucauacacaauagguuuuuaaaaauuaauaacuu

SEQ ID NO: 153246 - RNA, 64 nt, Homo Sapiens
uuuacaugaucugauacaaccauuaaugaaucauacacaauagguuuuuuaaaauuaauauuaa

SEQ ID NO: 153247 - RNA, 64 nt, Homo Sapiens; identical to SEQ ID NO: 145127

SEQ ID NO: 153248 - RNA, 64 nt, Homo Sapiens; identical to SEQ ID NO: 145128

SEQ ID NO: 153249 - RNA, 64 nt, Homo Sapiens; identical to SEQ ID NO: 138011

SEQ ID NO: 153250 - RNA, 64 nt, Homo Sapiens; identical to SEQ ID NO: 138012

SEQ ID NO: 153251 - RNA, 64 nt, Homo Sapiens; identical to SEQ ID NO: 138013

SEQ ID NO: 153252 - RNA, 64 nt, Homo Sapiens; identical to SEQ ID NO: 138014

SEQ ID NO: 153253 - RNA, 64 nt, Homo Sapiens; identical to SEQ ID NO: 138015

SEQ ID NO: 153254 - RNA, 59 nt, Homo Sapiens; identical to SEQ ID NO: 138016

SEQ ID NO: 153255 - RNA, 64 nt, Homo Sapiens; identical to SEQ ID NO: 138017

SEQ ID NO: 153256 - RNA, 64 nt, Homo Sapiens; identical to SEQ ID NO: 138018

SEQ ID NO: 153257 - RNA, 64 nt, Homo Sapiens; identical to SEQ ID NO: 138019

SEQ ID NO: 153258 - RNA, 64 nt, Homo Sapiens; identical to SEQ ID NO: 138020

SEQ ID NO: 153259 - RNA, 64 nt, Homo Sapiens; identical to SEQ ID NO: 138021

SEQ ID NO: 153260 - RNA, 64 nt, Homo Sapiens; identical to SEQ ID NO: 138022

SEQ ID NO: 153261 - RNA, 64 nt, Homo Sapiens; identical to SEQ ID NO: 138023

SEQ ID NO: 153262 - RNA, 64 nt, Homo Sapiens; identical to SEQ ID NO: 138024

SEQ ID NO: 153263 - RNA, 64 nt, Homo Sapiens; identical to SEQ ID NO: 138025

SEQ ID NO: 153264 - RNA, 64 nt, Homo Sapiens; identical to SEQ ID NO: 138026

SEQ ID NO: 153265 - RNA, 64 nt, Homo Sapiens; identical to SEQ ID NO: 138027

SEQ ID NO: 153266 - RNA, 64 nt, Homo Sapiens; identical to SEQ ID NO: 138028

SEQ ID NO: 153267 - RNA, 64 nt, Homo Sapiens; identical to SEQ ID NO: 138029

SEQ ID NO: 153268 - RNA, 64 nt, Homo Sapiens; identical to SEQ ID NO: 138030

SEQ ID NO: 153269 - RNA, 64 nt, Homo Sapiens; identical to SEQ ID NO: 138031

SEQ ID NO: 153270 - RNA, 64 nt, Homo Sapiens; identical to SEQ ID NO: 138032

SEQ ID NO: 153271 - RNA, 64 nt, Homo Sapiens; identical to SEQ ID NO: 138033

SEQ ID NO: 153272 - RNA, 64 nt, Homo Sapiens; identical to SEQ ID NO: 138034

SEQ ID NO: 153273 - RNA, 64 nt, Homo Sapiens; identical to SEQ ID NO: 138035

SEQ ID NO: 153274 - RNA, 64 nt, Homo Sapiens; identical to SEQ ID NO: 138036

SEQ ID NO: 153275 - RNA, 64 nt, Homo Sapiens; identical to SEQ ID NO: 138037

SEQ ID NO: 153276 - RNA, 64 nt, Homo Sapiens; identical to SEQ ID NO: 138038

SEQ ID NO: 153277 - RNA, 64 nt, Homo Sapiens; identical to SEQ ID NO: 138039

SEQ ID NO: 153278 - RNA, 64 nt, Homo Sapiens; identical to SEQ ID NO: 138040

SEQ ID NO: 153279 - RNA, 64 nt, Homo Sapiens; identical to SEQ ID NO: 138041

SEQ ID NO: 153280 - RNA, 64 nt, Homo Sapiens; identical to SEQ ID NO: 138042

SEQ ID NO: 153281 - RNA, 64 nt, Homo Sapiens; identical to SEQ ID NO: 138043

SEQ ID NO: 153282 - RNA, 64 nt, Homo Sapiens; identical to SEQ ID NO: 138044

SEQ ID NO: 153283 - RNA, 64 nt, Homo Sapiens; identical to SEQ ID NO: 138045

SEQ ID NO: 153284 - RNA, 64 nt, Homo Sapiens; identical to SEQ ID NO: 138046

SEQ ID NO: 153285 - RNA, 64 nt, Homo Sapiens; identical to SEQ ID NO: 138047

SEQ ID NO: 153286 - RNA, 64 nt, Homo Sapiens; identical to SEQ ID NO: 138048

SEQ ID NO: 153287 - RNA, 64 nt, Homo Sapiens; identical to SEQ ID NO: 138049

SEQ ID NO: 153288 - RNA, 64 nt, Homo Sapiens; identical to SEQ ID NO: 138050

SEQ ID NO: 153289 - RNA, 64 nt, Homo Sapiens; identical to SEQ ID NO: 138051

SEQ ID NO: 153290 - RNA, 64 nt, Homo Sapiens; identical to SEQ ID NO: 138052

SEQ ID NO: 153291 - RNA, 64 nt, Homo Sapiens; identical to SEQ ID NO: 138053

SEQ ID NO: 153292 - RNA, 64 nt, Homo Sapiens; identical to SEQ ID NO: 138054

SEQ ID NO: 153293 - RNA, 64 nt, Homo Sapiens; identical to SEQ ID NO: 138055

SEQ ID NO: 153294 - RNA, 64 nt, Homo Sapiens; identical to SEQ ID NO: 138056

SEQ ID NO: 153295 - RNA, 64 nt, Homo Sapiens; identical to SEQ ID NO: 138057

SEQ ID NO: 153296 - RNA, 64 nt, Homo Sapiens; identical to SEQ ID NO: 138058

SEQ ID NO: 153297 - RNA, 64 nt, Homo Sapiens; identical to SEQ ID NO: 138059

SEQ ID NO: 153298 - RNA, 64 nt, Homo Sapiens; identical to SEQ ID NO: 138060

SEQ ID NO: 153299 - RNA, 64 nt, Homo Sapiens; identical to SEQ ID NO: 138061

SEQ ID NO: 153300 - RNA, 64 nt, Homo Sapiens; identical to SEQ ID NO: 138062

SEQ ID NO: 153301 - RNA, 64 nt, Homo Sapiens; identical to SEQ ID NO: 138063

SEQ ID NO: 153302 - RNA, 64 nt, Homo Sapiens; identical to SEQ ID NO: 138064

SEQ ID NO: 153303 - RNA, 64 nt, Homo Sapiens; identical to SEQ ID NO: 138065

SEQ ID NO: 153304 - RNA, 64 nt, Homo Sapiens; identical to SEQ ID NO: 138066

SEQ ID NO: 153305 - RNA, 64 nt, Homo Sapiens
uggaacacagaugggcugcuugggaaagaaacuuucaccugagcuucaccugaggucagacugc

SEQ ID NO: 153306 - RNA, 64 nt, Homo Sapiens
ugggcugcuugggaaagaaacuuucaccugagcuucaccugaggucagacugcaguuucagaaa

SEQ ID NO: 153307 - RNA, 53 nt, Homo Sapiens
uggucccucagugugccuaauucucaccugaaggcagagggaugaaaugccaa

SEQ ID NO: 153308 - RNA, 64 nt, Homo Sapiens
uauuauauuguuuuauaaauggagguacaggauaucaccugaauuauuaaugaaugcccaggaa

SEQ ID NO: 153309 - RNA, 64 nt, Homo Sapiens
ucaggaguucgagaccacccccgagguggccagaucaccugaggaaucccagcacuuugggagg

SEQ ID NO: 153310 - RNA, 64 nt, Homo Sapiens
uuagaaguuugagaccagcccccaggugggcggaucaccugaggaaucccagcacuuugggagg

SEQ ID NO: 153311 - RNA, 64 nt, Homo Sapiens
aggccucagaugcaggggcccagaacaccugcucucaccugagccccaggugaaggggcccggg

SEQ ID NO: 153312 - RNA, 64 nt, Homo Sapiens
agccccaggugaaggggcccgggaacaccugcucucaccugagccccaggugaaggggcccggg

SEQ ID NO: 153313 - RNA, 64 nt, Homo Sapiens
agccccaggugaaggggcccgggaacaccugcucucaccugaaccccaggugaaggggcccgga

SEQ ID NO: 153314 - RNA, 64 nt, Homo Sapiens
gaaccccaggugaaggggcccggaacaccugcucucaccugagccccaggugaaggggcccgga

SEQ ID NO: 153315 - RNA, 64 nt, Homo Sapiens
gagccccaggugaaggggcccggaacaccugcucucaccugagccccaggugaaggggcccggg

SEQ ID NO: 153316 - RNA, 64 nt, Homo Sapiens; identical to SEQ ID NO: 153312

SEQ ID NO: 153317 - RNA, 64 nt, Homo Sapiens
agccccaggugaaggggcccgggaacaccugcucucaccugaaccccaggugaaggggcccaga

SEQ ID NO: 153318 - RNA, 64 nt, Homo Sapiens
gaaccccaggugaaggggcccagaacaccugcucucaccugagccccaggugaaggggcccgga

SEQ ID NO: 153319 - RNA, 64 nt, Homo Sapiens; identical to SEQ ID NO: 153315

SEQ ID NO: 153320 - RNA, 64 nt, Homo Sapiens
agccccaggugaaggggcccgggaacaccugcucucaccugagccccuggugaaggggcccgga

SEQ ID NO: 153321 - RNA, 64 nt, Homo Sapiens
gagccccuggugaaggggcccggaacacuugcucucaccugagccccaggugaaggggcccgga

SEQ ID NO: 153322 - RNA, 64 nt, Homo Sapiens
gagccccaggugaaggggcccggaacaccugcucucaccugagcccccggugaaggggcccgga

SEQ ID NO: 153323 - RNA, 64 nt, Homo Sapiens
gagcccccggugaaggggcccggaacacuugcucucaccugagccccaggugaaggggcccgga

SEQ ID NO: 153324 - RNA, 64 nt, Homo Sapiens
gagccccaggugaaggggcccggaacaccuccucucaccugagccccaggugaaggggcccgga

SEQ ID NO: 153325 - RNA, 64 nt, Homo Sapiens
gagccccaggugaaggggcccggaacaccuccugucaccugagccccaggugaaggggcccggg

SEQ ID NO: 153326 - RNA, 64 nt, Homo Sapiens
cugagccccaggugaaggggcccgggaacaccucucaccugaacccgggggucccaucccagga

SEQ ID NO: 153327 - RNA, 64 nt, Homo Sapiens
ugaggagcuguuuuguuguugaggggcauuacugucaccugacuaguuuguucucuuugcaaga

SEQ ID NO: 153328 - RNA, 64 nt, Homo Sapiens
aaugugugaagacauacuuagucaaagaguccauucaccugagauuuggagaagaaaugaaggu

SEQ ID NO: 153329 - RNA, 64 nt, Homo Sapiens
ucccucugacaucaccuugugggguauuuuggugucaccugaagggggcuuccaggcccuggau

SEQ ID NO: 153330 - RNA, 64 nt, Homo Sapiens
uuucaguguuucuaccuguggcagagccgagccgucaccugauucucuguggauccacagccug

SEQ ID NO: 153331 - RNA, 64 nt, Homo Sapiens
ucaggaguucaagacuagcccaggggcggguggaucaccugaggaaucccagcacuuugggagg

SEQ ID NO: 153332 - RNA, 64 nt, Homo Sapiens
cccagaggcagagguugcagcugagacaggagaaucaccugaacaaucccagcuacucaggagg

SEQ ID NO: 153333 - RNA, 64 nt, Homo Sapiens
ucaggaguucaagaccagcccugaggugguaggaucaccugaggaaucccagcacuuugagagg

SEQ ID NO: 153334 - RNA, 64 nt, Homo Sapiens
aucccagcacuuuggggggccaaggcaggcuggaucaccugaggacaggaguucgagaccaguc

SEQ ID NO: 153335 - RNA, 64 nt, Homo Sapiens
ucacacacuuugggaggccaagcgggggugcagaucaccugaggucaggaguuugagaccagcc

SEQ ID NO: 153336 - RNA, 64 nt, Homo Sapiens
aaucccagcacuuugggaggccaaggcugguggaucaccugaggucaggaguucgagaccagcc

SEQ ID NO: 153337 - RNA, 64 nt, Homo Sapiens
aaucccagcacuuugggaggcuuaggcggcuggaucaccugaggucaggaguucaagaccagcc

SEQ ID NO: 153338 - RNA, 64 nt, Homo Sapiens
aaucucagcacuuugggaggcugagauggguggaucaccugagguugggaguucgagaccagcc

SEQ ID NO: 153339 - RNA, 64 nt, Homo Sapiens
cuggaaacguaacuaaacagcgaaccauguagcuucaccugacucagugcugggggccucuacc

SEQ ID NO: 153340 - RNA, 64 nt, Homo Sapiens
aaucccagcacuuugggaggccgaggcaggcggaucaccugaaaucaggaguucaagaucagcc

SEQ ID NO: 153341 - RNA, 64 nt, Homo Sapiens
accugaguuucgucuccugucucucuggcugaugucaccugaauaaagccuucuucccuggcaa

SEQ ID NO: 153342 - RNA, 64 nt, Homo Sapiens
ugggggucaaggcaggaggauugugaggccaccaucaccugacccaccuaccucauaggggagg

SEQ ID NO: 153343 - RNA, 64 nt, Homo Sapiens
uucuccaggacugucuucucucucugaucguccaucaccugaccuuccgucucaucgugcgugg

SEQ ID NO: 153344 - RNA, 64 nt, Homo Sapiens
cugggaggucgaggcugcagcugaggcgggagaaucaccugagcagucccaacuaccugggagg

SEQ ID NO: 153345 - RNA, 64 nt, Homo Sapiens
ucaggaguucaagaucagcccugaggcgggaugaucaccugaggaaucccagcacugugagagg

SEQ ID NO: 153346 - RNA, 64 nt, Homo Sapiens
ccaauaggugcacccucugaggucagacaccauuucaccugagaccccuucccugggagccagu

SEQ ID NO: 153347 - RNA, 51 nt, Homo Sapiens
caagagcaggaagagguugcgucaccugaacggaagaaaaugagggcuuga

SEQ ID NO: 153348 - RNA, 64 nt, Homo Sapiens
cugguaggcugaggcugcagaagcugagauagggucaccugagcuguagucccaccuacucgag

SEQ ID NO: 153349 - RNA, 64 nt, Homo Sapiens
ucaggaguucaagaccagcccuaaggugggcggaucaccugaugaaucccagcacuuugggagg

SEQ ID NO: 153350 - RNA, 64 nt, Homo Sapiens
uaaucccagacuuugggaggccgaggcaggcggaucaccugaggugaggaguuugagaacagcc

SEQ ID NO: 153351 - RNA, 64 nt, Homo Sapiens
aaucccagcacucugggaggcugagguggguggaucaccugaggucaggaguucaagaccagcc

SEQ ID NO: 153352 - RNA, 64 nt, Homo Sapiens
acucucuccugggguuugucuaucuuuguuucucucaccugagagaaacgcagguguuccagag

SEQ ID NO: 153353 - RNA, 64 nt, Homo Sapiens
ccugguguccucgcuccacccacccacgcugcugucaccugaggggaaucugcuucuuaggagu

SEQ ID NO: 153354 - RNA, 64 nt, Homo Sapiens
aaucccagcacuuugggaggcugaggcugggggaucaccugaggucaggaguucgagaucagcc

SEQ ID NO: 153355 - RNA, 64 nt, Homo Sapiens
uuuguuuguuuuuguuuuuggugggagguuuauuucaccugaauauaauuccuaacugaugcac

SEQ ID NO: 153356 - RNA, 64 nt, Homo Sapiens
ucaggagagaccagccuggcccaaggcaagcagaucaccugaagaaucccaguacuuugggagg

SEQ ID NO: 153357 - RNA, 64 nt, Homo Sapiens
ucgggaguucgagaccagcccugaggcagguggaucaccugaggaaucccagcacuuugggagg

SEQ ID NO: 153358 - RNA, 64 nt, Homo Sapiens
uggggcaagaucccccagcccgacuagacccaccucaccugaagggggugagacccuuguuggc

SEQ ID NO: 153359 - RNA, 64 nt, Homo Sapiens
aauccuagcacauugggaggccaaggcaggcacaucaccugaguucaggaguucaagaccagcc

SEQ ID NO: 153360 - RNA, 64 nt, Homo Sapiens; identical to SEQ ID NO: 127122

SEQ ID NO: 153361 - RNA, 64 nt, Homo Sapiens; identical to SEQ ID NO: 127123

SEQ ID NO: 153362 - RNA, 64 nt, Homo Sapiens; identical to SEQ ID NO: 127124

SEQ ID NO: 153363 - RNA, 64 nt, Homo Sapiens; identical to SEQ ID NO: 127125

SEQ ID NO: 153364 - RNA, 64 nt, Homo Sapiens; identical to SEQ ID NO: 127126

SEQ ID NO: 153365 - RNA, 64 nt, Homo Sapiens; identical to SEQ ID NO: 127127

SEQ ID NO: 153366 - RNA, 64 nt, Homo Sapiens; identical to SEQ ID NO: 127128

SEQ ID NO: 153367 - RNA, 64 nt, Homo Sapiens; identical to SEQ ID NO: 127129

SEQ ID NO: 153368 - RNA, 64 nt, Homo Sapiens; identical to SEQ ID NO: 127130

SEQ ID NO: 153369 - RNA, 64 nt, Homo Sapiens; identical to SEQ ID NO: 127131

SEQ ID NO: 153370 - RNA, 64 nt, Homo Sapiens; identical to SEQ ID NO: 127132

SEQ ID NO: 153371 - RNA, 64 nt, Homo Sapiens; identical to SEQ ID NO: 127133

SEQ ID NO: 153372 - RNA, 64 nt, Homo Sapiens; identical to SEQ ID NO: 127134

SEQ ID NO: 153373 - RNA, 64 nt, Homo Sapiens; identical to SEQ ID NO: 127135

SEQ ID NO: 153374 - RNA, 64 nt, Homo Sapiens; identical to SEQ ID NO: 127136

SEQ ID NO: 153375 - RNA, 64 nt, Homo Sapiens; identical to SEQ ID NO: 127137

SEQ ID NO: 153376 - RNA, 64 nt, Homo Sapiens; identical to SEQ ID NO: 127138

SEQ ID NO: 153377 - RNA, 64 nt, Homo Sapiens; identical to SEQ ID NO: 127139

SEQ ID NO: 153378 - RNA, 64 nt, Homo Sapiens; identical to SEQ ID NO: 127140

SEQ ID NO: 153379 - RNA, 64 nt, Homo Sapiens; identical to SEQ ID NO: 127141

SEQ ID NO: 153380 - RNA, 64 nt, Homo Sapiens; identical to SEQ ID NO: 127142

SEQ ID NO: 153381 - RNA, 64 nt, Homo Sapiens; identical to SEQ ID NO: 127143

SEQ ID NO: 153382 - RNA, 64 nt, Homo Sapiens; identical to SEQ ID NO: 127144

SEQ ID NO: 153383 - RNA, 64 nt, Homo Sapiens; identical to SEQ ID NO: 127145

SEQ ID NO: 153384 - RNA, 64 nt, Homo Sapiens; identical to SEQ ID NO: 127146

SEQ ID NO: 153385 - RNA, 64 nt, Homo Sapiens; identical to SEQ ID NO: 127147

SEQ ID NO: 153386 - RNA, 64 nt, Homo Sapiens; identical to SEQ ID NO: 127148

SEQ ID NO: 153387 - RNA, 64 nt, Homo Sapiens; identical to SEQ ID NO: 127149

SEQ ID NO: 153388 - RNA, 64 nt, Homo Sapiens; identical to SEQ ID NO: 127150

SEQ ID NO: 153389 - RNA, 64 nt, Homo Sapiens; identical to SEQ ID NO: 127151

SEQ ID NO: 153390 - RNA, 64 nt, Homo Sapiens; identical to SEQ ID NO: 127152

SEQ ID NO: 153391 - RNA, 64 nt, Homo Sapiens; identical to SEQ ID NO: 127153

SEQ ID NO: 153392 - RNA, 64 nt, Homo Sapiens; identical to SEQ ID NO: 127154

SEQ ID NO: 153393 - RNA, 64 nt, Homo Sapiens; identical to SEQ ID NO: 127155

SEQ ID NO: 153394 - RNA, 64 nt, Homo Sapiens; identical to SEQ ID NO: 127156

SEQ ID NO: 153395 - RNA, 64 nt, Homo Sapiens; identical to SEQ ID NO: 127157

SEQ ID NO: 153396 - RNA, 64 nt, Homo Sapiens; identical to SEQ ID NO: 127158

SEQ ID NO: 153397 - RNA, 64 nt, Homo Sapiens; identical to SEQ ID NO: 127159

SEQ ID NO: 153398 - RNA, 64 nt, Homo Sapiens; identical to SEQ ID NO: 127160

SEQ ID NO: 153399 - RNA, 64 nt, Homo Sapiens; identical to SEQ ID NO: 127161

SEQ ID NO: 153400 - RNA, 64 nt, Homo Sapiens; identical to SEQ ID NO: 127162

SEQ ID NO: 153401 - RNA, 64 nt, Homo Sapiens; identical to SEQ ID NO: 127163

SEQ ID NO: 153402 - RNA, 64 nt, Homo Sapiens; identical to SEQ ID NO: 127164

SEQ ID NO: 153403 - RNA, 64 nt, Homo Sapiens; identical to SEQ ID NO: 127165

SEQ ID NO: 153404 - RNA, 64 nt, Homo Sapiens; identical to SEQ ID NO: 127166

SEQ ID NO: 153405 - RNA, 64 nt, Homo Sapiens; identical to SEQ ID NO: 127167

SEQ ID NO: 153406 - RNA, 64 nt, Homo Sapiens; identical to SEQ ID NO: 127168

SEQ ID NO: 153407 - RNA, 64 nt, Homo Sapiens; identical to SEQ ID NO: 127169

SEQ ID NO: 153408 - RNA, 64 nt, Homo Sapiens; identical to SEQ ID NO: 127170

SEQ ID NO: 153409 - RNA, 64 nt, Homo Sapiens; identical to SEQ ID NO: 127171

SEQ ID NO: 153410 - RNA, 64 nt, Homo Sapiens; identical to SEQ ID NO: 127172

SEQ ID NO: 153411 - RNA, 64 nt, Homo Sapiens; identical to SEQ ID NO: 127173

SEQ ID NO: 153412 - RNA, 64 nt, Homo Sapiens; identical to SEQ ID NO: 127174

SEQ ID NO: 153413 - RNA, 64 nt, Homo Sapiens; identical to SEQ ID NO: 127175

SEQ ID NO: 153414 - RNA, 64 nt, Homo Sapiens; identical to SEQ ID NO: 127176

SEQ ID NO: 153415 - RNA, 64 nt, Homo Sapiens; identical to SEQ ID NO: 127177

SEQ ID NO: 153416 - RNA, 64 nt, Homo Sapiens; identical to SEQ ID NO: 127178

SEQ ID NO: 153417 - RNA, 64 nt, Homo Sapiens; identical to SEQ ID NO: 127179

SEQ ID NO: 153418 - RNA, 64 nt, Homo Sapiens; identical to SEQ ID NO: 127180

SEQ ID NO: 153419 - RNA, 64 nt, Homo Sapiens; identical to SEQ ID NO: 127181

SEQ ID NO: 153420 - RNA, 64 nt, Homo Sapiens; identical to SEQ ID NO: 127182

SEQ ID NO: 153421 - RNA, 64 nt, Homo Sapiens; identical to SEQ ID NO: 127183

SEQ ID NO: 153422 - RNA, 64 nt, Homo Sapiens; identical to SEQ ID NO: 127184

SEQ ID NO: 153423 - RNA, 64 nt, Homo Sapiens; identical to SEQ ID NO: 127185

SEQ ID NO: 153424 - RNA, 64 nt, Homo Sapiens; identical to SEQ ID NO: 127186

SEQ ID NO: 153425 - RNA, 64 nt, Homo Sapiens; identical to SEQ ID NO: 127187

SEQ ID NO: 153426 - RNA, 64 nt, Homo Sapiens; identical to SEQ ID NO: 127188

SEQ ID NO: 153427 - RNA, 64 nt, Homo Sapiens; identical to SEQ ID NO: 127189

SEQ ID NO: 153428 - RNA, 64 nt, Homo Sapiens; identical to SEQ ID NO: 127190

SEQ ID NO: 153429 - RNA, 64 nt, Homo Sapiens; identical to SEQ ID NO: 127191

SEQ ID NO: 153430 - RNA, 64 nt, Homo Sapiens; identical to SEQ ID NO: 127192

SEQ ID NO: 153431 - RNA, 64 nt, Homo Sapiens; identical to SEQ ID NO: 127193

SEQ ID NO: 153432 - RNA, 64 nt, Homo Sapiens; identical to SEQ ID NO: 127194

SEQ ID NO: 153433 - RNA, 64 nt, Homo Sapiens; identical to SEQ ID NO: 127195

SEQ ID NO: 153434 - RNA, 64 nt, Homo Sapiens; identical to SEQ ID NO: 127196

SEQ ID NO: 153435 - RNA, 64 nt, Homo Sapiens; identical to SEQ ID NO: 127197

SEQ ID NO: 153436 - RNA, 64 nt, Homo Sapiens; identical to SEQ ID NO: 127198

SEQ ID NO: 153437 - RNA, 64 nt, Homo Sapiens; identical to SEQ ID NO: 127199

SEQ ID NO: 153438 - RNA, 64 nt, Homo Sapiens; identical to SEQ ID NO: 127200

SEQ ID NO: 153439 - RNA, 64 nt, Homo Sapiens; identical to SEQ ID NO: 127201

SEQ ID NO: 153440 - RNA, 64 nt, Homo Sapiens; identical to SEQ ID NO: 127202

SEQ ID NO: 153441 - RNA, 64 nt, Homo Sapiens; identical to SEQ ID NO: 127203

SEQ ID NO: 153442 - RNA, 64 nt, Homo Sapiens; identical to SEQ ID NO: 127204

SEQ ID NO: 153443 - RNA, 64 nt, Homo Sapiens; identical to SEQ ID NO: 127205

SEQ ID NO: 153444 - RNA, 64 nt, Homo Sapiens; identical to SEQ ID NO: 127206

SEQ ID NO: 153445 - RNA, 64 nt, Homo Sapiens; identical to SEQ ID NO: 127207

SEQ ID NO: 153446 - RNA, 64 nt, Homo Sapiens; identical to SEQ ID NO: 127208

SEQ ID NO: 153447 - RNA, 64 nt, Homo Sapiens; identical to SEQ ID NO: 127209

SEQ ID NO: 153448 - RNA, 64 nt, Homo Sapiens; identical to SEQ ID NO: 127210

SEQ ID NO: 153449 - RNA, 64 nt, Homo Sapiens; identical to SEQ ID NO: 127211

SEQ ID NO: 153450 - RNA, 64 nt, Homo Sapiens; identical to SEQ ID NO: 127212

SEQ ID NO: 153451 - RNA, 64 nt, Homo Sapiens; identical to SEQ ID NO: 127213

SEQ ID NO: 153452 - RNA, 64 nt, Homo Sapiens; identical to SEQ ID NO: 127214

SEQ ID NO: 153453 - RNA, 64 nt, Homo Sapiens; identical to SEQ ID NO: 127215

SEQ ID NO: 153454 - RNA, 64 nt, Homo Sapiens; identical to SEQ ID NO: 127216

SEQ ID NO: 153455 - RNA, 64 nt, Homo Sapiens; identical to SEQ ID NO: 127217

SEQ ID NO: 153456 - RNA, 64 nt, Homo Sapiens; identical to SEQ ID NO: 127218

SEQ ID NO: 153457 - RNA, 64 nt, Homo Sapiens; identical to SEQ ID NO: 127219

SEQ ID NO: 153458 - RNA, 64 nt, Homo Sapiens; identical to SEQ ID NO: 127220

SEQ ID NO: 153459 - RNA, 64 nt, Homo Sapiens; identical to SEQ ID NO: 127221

SEQ ID NO: 153460 - RNA, 64 nt, Homo Sapiens; identical to SEQ ID NO: 127222

SEQ ID NO: 153461 - RNA, 64 nt, Homo Sapiens; identical to SEQ ID NO: 127223

SEQ ID NO: 153462 - RNA, 64 nt, Homo Sapiens; identical to SEQ ID NO: 127224

SEQ ID NO: 153463 - RNA, 64 nt, Homo Sapiens; identical to SEQ ID NO: 127225

SEQ ID NO: 153464 - RNA, 64 nt, Homo Sapiens; identical to SEQ ID NO: 127226

SEQ ID NO: 153465 - RNA, 64 nt, Homo Sapiens; identical to SEQ ID NO: 127227

SEQ ID NO: 153466 - RNA, 64 nt, Homo Sapiens; identical to SEQ ID NO: 127228

SEQ ID NO: 153467 - RNA, 64 nt, Homo Sapiens; identical to SEQ ID NO: 127229

SEQ ID NO: 153468 - RNA, 64 nt, Homo Sapiens; identical to SEQ ID NO: 127230

SEQ ID NO: 153469 - RNA, 64 nt, Homo Sapiens; identical to SEQ ID NO: 127231

SEQ ID NO: 153470 - RNA, 64 nt, Homo Sapiens; identical to SEQ ID NO: 127232

SEQ ID NO: 153471 - RNA, 64 nt, Homo Sapiens; identical to SEQ ID NO: 127233

SEQ ID NO: 153472 - RNA, 64 nt, Homo Sapiens; identical to SEQ ID NO: 127234

SEQ ID NO: 153473 - RNA, 64 nt, Homo Sapiens; identical to SEQ ID NO: 127235

SEQ ID NO: 153474 - RNA, 64 nt, Homo Sapiens; identical to SEQ ID NO: 127236

SEQ ID NO: 153475 - RNA, 64 nt, Homo Sapiens; identical to SEQ ID NO: 127237

SEQ ID NO: 153476 - RNA, 64 nt, Homo Sapiens; identical to SEQ ID NO: 127238

SEQ ID NO: 153477 - RNA, 64 nt, Homo Sapiens; identical to SEQ ID NO: 127239

SEQ ID NO: 153478 - RNA, 64 nt, Homo Sapiens; identical to SEQ ID NO: 127240

SEQ ID NO: 153479 - RNA, 64 nt, Homo Sapiens; identical to SEQ ID NO: 127241

SEQ ID NO: 153480 - RNA, 64 nt, Homo Sapiens; identical to SEQ ID NO: 127242

SEQ ID NO: 153481 - RNA, 64 nt, Homo Sapiens; identical to SEQ ID NO: 127243

SEQ ID NO: 153482 - RNA, 64 nt, Homo Sapiens; identical to SEQ ID NO: 127244

SEQ ID NO: 153483 - RNA, 64 nt, Homo Sapiens; identical to SEQ ID NO: 127245

SEQ ID NO: 153484 - RNA, 64 nt, Homo Sapiens; identical to SEQ ID NO: 127246

SEQ ID NO: 153485 - RNA, 64 nt, Homo Sapiens; identical to SEQ ID NO: 127247

SEQ ID NO: 153486 - RNA, 64 nt, Homo Sapiens; identical to SEQ ID NO: 127248

SEQ ID NO: 153487 - RNA, 64 nt, Homo Sapiens; identical to SEQ ID NO: 127249

SEQ ID NO: 153488 - RNA, 64 nt, Homo Sapiens; identical to SEQ ID NO: 127250

SEQ ID NO: 153489 - RNA, 64 nt, Homo Sapiens; identical to SEQ ID NO: 127251

SEQ ID NO: 153490 - RNA, 64 nt, Homo Sapiens; identical to SEQ ID NO: 127252

SEQ ID NO: 153491 - RNA, 64 nt, Homo Sapiens; identical to SEQ ID NO: 127253

SEQ ID NO: 153492 - RNA, 64 nt, Homo Sapiens; identical to SEQ ID NO: 127254

SEQ ID NO: 153493 - RNA, 64 nt, Homo Sapiens; identical to SEQ ID NO: 127255

SEQ ID NO: 153494 - RNA, 64 nt, Homo Sapiens; identical to SEQ ID NO: 127256

SEQ ID NO: 153495 - RNA, 64 nt, Homo Sapiens; identical to SEQ ID NO: 127257

SEQ ID NO: 153496 - RNA, 64 nt, Homo Sapiens; identical to SEQ ID NO: 127258

SEQ ID NO: 153497 - RNA, 64 nt, Homo Sapiens; identical to SEQ ID NO: 127259

SEQ ID NO: 153498 - RNA, 64 nt, Homo Sapiens; identical to SEQ ID NO: 127260

SEQ ID NO: 153499 - RNA, 64 nt, Homo Sapiens; identical to SEQ ID NO: 127261

SEQ ID NO: 153500 - RNA, 64 nt, Homo Sapiens; identical to SEQ ID NO: 127262

SEQ ID NO: 153501 - RNA, 64 nt, Homo Sapiens; identical to SEQ ID NO: 127263

SEQ ID NO: 153502 - RNA, 64 nt, Homo Sapiens; identical to SEQ ID NO: 127264

SEQ ID NO: 153503 - RNA, 64 nt, Homo Sapiens; identical to SEQ ID NO: 127265

SEQ ID NO: 153504 - RNA, 64 nt, Homo Sapiens; identical to SEQ ID NO: 127266

SEQ ID NO: 153505 - RNA, 64 nt, Homo Sapiens; identical to SEQ ID NO: 127267

SEQ ID NO: 153506 - RNA, 64 nt, Homo Sapiens; identical to SEQ ID NO: 127268

SEQ ID NO: 153507 - RNA, 64 nt, Homo Sapiens; identical to SEQ ID NO: 127269

SEQ ID NO: 153508 - RNA, 64 nt, Homo Sapiens; identical to SEQ ID NO: 127270

SEQ ID NO: 153509 - RNA, 64 nt, Homo Sapiens; identical to SEQ ID NO: 127271

SEQ ID NO: 153510 - RNA, 64 nt, Homo Sapiens; identical to SEQ ID NO: 127272

SEQ ID NO: 153511 - RNA, 64 nt, Homo Sapiens; identical to SEQ ID NO: 127273

SEQ ID NO: 153512 - RNA, 64 nt, Homo Sapiens; identical to SEQ ID NO: 127274

SEQ ID NO: 153513 - RNA, 64 nt, Homo Sapiens; identical to SEQ ID NO: 127275

SEQ ID NO: 153514 - RNA, 64 nt, Homo Sapiens; identical to SEQ ID NO: 127276

SEQ ID NO: 153515 - RNA, 64 nt, Homo Sapiens; identical to SEQ ID NO: 127277

SEQ ID NO: 153516 - RNA, 64 nt, Homo Sapiens; identical to SEQ ID NO: 127278

SEQ ID NO: 153517 - RNA, 64 nt, Homo Sapiens; identical to SEQ ID NO: 127279

SEQ ID NO: 153518 - RNA, 64 nt, Homo Sapiens; identical to SEQ ID NO: 127280

SEQ ID NO: 153519 - RNA, 64 nt, Homo Sapiens; identical to SEQ ID NO: 127281

SEQ ID NO: 153520 - RNA, 64 nt, Homo Sapiens; identical to SEQ ID NO: 127282

SEQ ID NO: 153521 - RNA, 64 nt, Homo Sapiens; identical to SEQ ID NO: 127283

SEQ ID NO: 153522 - RNA, 64 nt, Homo Sapiens; identical to SEQ ID NO: 127284

SEQ ID NO: 153523 - RNA, 64 nt, Homo Sapiens; identical to SEQ ID NO: 127285

SEQ ID NO: 153524 - RNA, 64 nt, Homo Sapiens; identical to SEQ ID NO: 127286

SEQ ID NO: 153525 - RNA, 64 nt, Homo Sapiens; identical to SEQ ID NO: 127287

SEQ ID NO: 153526 - RNA, 64 nt, Homo Sapiens; identical to SEQ ID NO: 127288

SEQ ID NO: 153527 - RNA, 64 nt, Homo Sapiens; identical to SEQ ID NO: 127289

SEQ ID NO: 153528 - RNA, 64 nt, Homo Sapiens; identical to SEQ ID NO: 127290

SEQ ID NO: 153529 - RNA, 64 nt, Homo Sapiens; identical to SEQ ID NO: 127291

SEQ ID NO: 153530 - RNA, 64 nt, Homo Sapiens; identical to SEQ ID NO: 127292

SEQ ID NO: 153531 - RNA, 64 nt, Homo Sapiens; identical to SEQ ID NO: 127293

SEQ ID NO: 153532 - RNA, 64 nt, Homo Sapiens; identical to SEQ ID NO: 127294

SEQ ID NO: 153533 - RNA, 64 nt, Homo Sapiens; identical to SEQ ID NO: 127295

SEQ ID NO: 153534 - RNA, 64 nt, Homo Sapiens; identical to SEQ ID NO: 127296

SEQ ID NO: 153535 - RNA, 64 nt, Homo Sapiens; identical to SEQ ID NO: 127297

SEQ ID NO: 153536 - RNA, 64 nt, Homo Sapiens; identical to SEQ ID NO: 127298

SEQ ID NO: 153537 - RNA, 64 nt, Homo Sapiens; identical to SEQ ID NO: 127299

SEQ ID NO: 153538 - RNA, 64 nt, Homo Sapiens; identical to SEQ ID NO: 127300

SEQ ID NO: 153539 - RNA, 64 nt, Homo Sapiens; identical to SEQ ID NO: 127301

SEQ ID NO: 153540 - RNA, 64 nt, Homo Sapiens; identical to SEQ ID NO: 127302

SEQ ID NO: 153541 - RNA, 64 nt, Homo Sapiens; identical to SEQ ID NO: 127303

SEQ ID NO: 153542 - RNA, 64 nt, Homo Sapiens; identical to SEQ ID NO: 127304

SEQ ID NO: 153543 - RNA, 64 nt, Homo Sapiens; identical to SEQ ID NO: 127305

SEQ ID NO: 153544 - RNA, 64 nt, Homo Sapiens; identical to SEQ ID NO: 127306

SEQ ID NO: 153545 - RNA, 64 nt, Homo Sapiens; identical to SEQ ID NO: 127307

SEQ ID NO: 153546 - RNA, 64 nt, Homo Sapiens; identical to SEQ ID NO: 127308

SEQ ID NO: 153547 - RNA, 64 nt, Homo Sapiens; identical to SEQ ID NO: 127309

SEQ ID NO: 153548 - RNA, 64 nt, Homo Sapiens; identical to SEQ ID NO: 127310

SEQ ID NO: 153549 - RNA, 64 nt, Homo Sapiens; identical to SEQ ID NO: 127311

SEQ ID NO: 153550 - RNA, 64 nt, Homo Sapiens; identical to SEQ ID NO: 127312

SEQ ID NO: 153551 - RNA, 64 nt, Homo Sapiens; identical to SEQ ID NO: 127313

SEQ ID NO: 153552 - RNA, 64 nt, Homo Sapiens; identical to SEQ ID NO: 127314

SEQ ID NO: 153553 - RNA, 64 nt, Homo Sapiens; identical to SEQ ID NO: 127315

SEQ ID NO: 153554 - RNA, 64 nt, Homo Sapiens; identical to SEQ ID NO: 127316

SEQ ID NO: 153555 - RNA, 64 nt, Homo Sapiens; identical to SEQ ID NO: 127317

SEQ ID NO: 153556 - RNA, 64 nt, Homo Sapiens; identical to SEQ ID NO: 127318

SEQ ID NO: 153557 - RNA, 64 nt, Homo Sapiens; identical to SEQ ID NO: 127319

SEQ ID NO: 153558 - RNA, 64 nt, Homo Sapiens; identical to SEQ ID NO: 127320

SEQ ID NO: 153559 - RNA, 64 nt, Homo Sapiens; identical to SEQ ID NO: 127321

SEQ ID NO: 153560 - RNA, 64 nt, Homo Sapiens; identical to SEQ ID NO: 127322

SEQ ID NO: 153561 - RNA, 64 nt, Homo Sapiens; identical to SEQ ID NO: 127323

SEQ ID NO: 153562 - RNA, 64 nt, Homo Sapiens; identical to SEQ ID NO: 127324

SEQ ID NO: 153563 - RNA, 64 nt, Homo Sapiens; identical to SEQ ID NO: 127325

SEQ ID NO: 153564 - RNA, 64 nt, Homo Sapiens; identical to SEQ ID NO: 127326

SEQ ID NO: 153565 - RNA, 64 nt, Homo Sapiens; identical to SEQ ID NO: 127327

SEQ ID NO: 153566 - RNA, 63 nt, Homo Sapiens; identical to SEQ ID NO: 127328

SEQ ID NO: 153567 - RNA, 64 nt, Homo Sapiens; identical to SEQ ID NO: 127329

SEQ ID NO: 153568 - RNA, 64 nt, Homo Sapiens; identical to SEQ ID NO: 127330

SEQ ID NO: 153569 - RNA, 64 nt, Homo Sapiens; identical to SEQ ID NO: 127331

SEQ ID NO: 153570 - RNA, 64 nt, Homo Sapiens; identical to SEQ ID NO: 127332

SEQ ID NO: 153571 - RNA, 64 nt, Homo Sapiens; identical to SEQ ID NO: 127333

SEQ ID NO: 153572 - RNA, 64 nt, Homo Sapiens; identical to SEQ ID NO: 127334

SEQ ID NO: 153573 - RNA, 64 nt, Homo Sapiens; identical to SEQ ID NO: 127335

SEQ ID NO: 153574 - RNA, 64 nt, Homo Sapiens; identical to SEQ ID NO: 127336

SEQ ID NO: 153575 - RNA, 64 nt, Homo Sapiens; identical to SEQ ID NO: 127337

SEQ ID NO: 153576 - RNA, 64 nt, Homo Sapiens; identical to SEQ ID NO: 127338

SEQ ID NO: 153577 - RNA, 64 nt, Homo Sapiens; identical to SEQ ID NO: 127339

SEQ ID NO: 153578 - RNA, 64 nt, Homo Sapiens; identical to SEQ ID NO: 127340

SEQ ID NO: 153579 - RNA, 64 nt, Homo Sapiens; identical to SEQ ID NO: 127341

SEQ ID NO: 153580 - RNA, 64 nt, Homo Sapiens; identical to SEQ ID NO: 127342

SEQ ID NO: 153581 - RNA, 64 nt, Homo Sapiens; identical to SEQ ID NO: 127343

SEQ ID NO: 153582 - RNA, 64 nt, Homo Sapiens; identical to SEQ ID NO: 127344

SEQ ID NO: 153583 - RNA, 64 nt, Homo Sapiens; identical to SEQ ID NO: 127345

SEQ ID NO: 153584 - RNA, 64 nt, Homo Sapiens; identical to SEQ ID NO: 127346

SEQ ID NO: 153585 - RNA, 64 nt, Homo Sapiens; identical to SEQ ID NO: 127347

SEQ ID NO: 153586 - RNA, 64 nt, Homo Sapiens; identical to SEQ ID NO: 127348

SEQ ID NO: 153587 - RNA, 64 nt, Homo Sapiens; identical to SEQ ID NO: 127349

SEQ ID NO: 153588 - RNA, 64 nt, Homo Sapiens; identical to SEQ ID NO: 127350

SEQ ID NO: 153589 - RNA, 64 nt, Homo Sapiens; identical to SEQ ID NO: 127351

SEQ ID NO: 153590 - RNA, 64 nt, Homo Sapiens; identical to SEQ ID NO: 127352

SEQ ID NO: 153591 - RNA, 64 nt, Homo Sapiens; identical to SEQ ID NO: 127353

SEQ ID NO: 153592 - RNA, 64 nt, Homo Sapiens; identical to SEQ ID NO: 127354

SEQ ID NO: 153593 - RNA, 64 nt, Homo Sapiens; identical to SEQ ID NO: 127355

SEQ ID NO: 153594 - RNA, 64 nt, Homo Sapiens; identical to SEQ ID NO: 127356

SEQ ID NO: 153595 - RNA, 64 nt, Homo Sapiens; identical to SEQ ID NO: 127357

SEQ ID NO: 153596 - RNA, 64 nt, Homo Sapiens; identical to SEQ ID NO: 127358

SEQ ID NO: 153597 - RNA, 64 nt, Homo Sapiens; identical to SEQ ID NO: 127359

SEQ ID NO: 153598 - RNA, 64 nt, Homo Sapiens; identical to SEQ ID NO: 127360

SEQ ID NO: 153599 - RNA, 64 nt, Homo Sapiens; identical to SEQ ID NO: 127361

SEQ ID NO: 153600 - RNA, 64 nt, Homo Sapiens; identical to SEQ ID NO: 127362

SEQ ID NO: 153601 - RNA, 64 nt, Homo Sapiens; identical to SEQ ID NO: 127363

SEQ ID NO: 153602 - RNA, 64 nt, Homo Sapiens; identical to SEQ ID NO: 127364

SEQ ID NO: 153603 - RNA, 64 nt, Homo Sapiens; identical to SEQ ID NO: 127365

SEQ ID NO: 153604 - RNA, 64 nt, Homo Sapiens; identical to SEQ ID NO: 127366

SEQ ID NO: 153605 - RNA, 64 nt, Homo Sapiens; identical to SEQ ID NO: 127367

SEQ ID NO: 153606 - RNA, 64 nt, Homo Sapiens; identical to SEQ ID NO: 127368

SEQ ID NO: 153607 - RNA, 64 nt, Homo Sapiens; identical to SEQ ID NO: 127369

SEQ ID NO: 153608 - RNA, 64 nt, Homo Sapiens; identical to SEQ ID NO: 127370

SEQ ID NO: 153609 - RNA, 64 nt, Homo Sapiens
gucaucuuuuuguuauaagugaccuuugucuggaaugucugaaaaguaguuaaugcuuuuuggu

SEQ ID NO: 153610 - RNA, 64 nt, Homo Sapiens
uacauaauauuguccuuagauuuugaucaauucuaugucugacuuugaaauuccauuuacaaug

SEQ ID NO: 153611 - RNA, 64 nt, Homo Sapiens
uacgucugugacuuaucuacuaugcaugaaaugaaugucugagaauagaugucucaaaaauccu

SEQ ID NO: 153612 - RNA, 64 nt, Homo Sapiens
cagagaaccaaaccgcaaaccugaaaagcaguucaugucugaaaugccaccccagguuuuucau

SEQ ID NO: 153613 - RNA, 64 nt, Homo Sapiens
ggaauuggcaaaugaggugauuucaaauugugcaaugucugaauuuuaaaaaaagcaaaucuau

SEQ ID NO: 153614 - RNA, 64 nt, Homo Sapiens
uuuuccuacaguuccugcccauauauuuguuuggaugucugaucauuauagaucuauauaugua

SEQ ID NO: 153615 - RNA, 64 nt, Homo Sapiens
aaauaagugaguggagugaggaagugcucaauaaaugucugaacacaccaugccuggcccuuaa

SEQ ID NO: 153616 - RNA, 64 nt, Homo Sapiens
gacacuuuucacccuuguacauuacuuacgaaauaugucugaguuauaucuguauaauguugag

SEQ ID NO: 153617 - RNA, 64 nt, Homo Sapiens
ugcuccuggcacagaauuccaccggugcaaggagaugucugaauacugcagcacucugugccgc

SEQ ID NO: 153618 - RNA, 64 nt, Homo Sapiens
cacuuuagugauugcuuuuauuacauuaguuaagaugucugagagaccaucuccuaucuuuuau

SEQ ID NO: 153619 - RNA, 64 nt, Homo Sapiens
ucagugccuauggguuguuacauaggcacuugggaugucugagauaauaguacuauuaacaacc

SEQ ID NO: 153620 - RNA, 64 nt, Homo Sapiens
ucagugccuauggguugucagugguaugcaugggaugucugaaagauuuacuacuuaugcguaa

SEQ ID NO: 153621 - RNA, 64 nt, Homo Sapiens
ucagugccucuggguuguuaucagccuguuugggaugucugagaugaaagaaucauuugcauua

SEQ ID NO: 153622 - RNA, 64 nt, Homo Sapiens
cucuggaaugcuuuaguuuccuuuuccccucaagaugucugagucagcuaggaugcuguuuacc

SEQ ID NO: 153623 - RNA, 64 nt, Homo Sapiens
gagaacaauaguagucucaagaauggaaaccugaaugucugagggaaugggcugguagacuuuu

SEQ ID NO: 153624 - RNA, 64 nt, Homo Sapiens
auuucgaagcaaucuagacuguugugaugaguguaugucugaaccuguaauucuuaaaagacuu

SEQ ID NO: 153625 - RNA, 64 nt, Homo Sapiens
cauaguauugaaucucaggaaaaacuauucuuucaugucugauucugagauuucuaauuguguu

SEQ ID NO: 153626 - RNA, 64 nt, Homo Sapiens
gucuuuagcuauggugacuaacucccuuggcuguaugucugacagacugaaaauacuccugagu

SEQ ID NO: 153627 - RNA, 64 nt, Homo Sapiens
ucaaggaacucaguuuaauuaaauaaauaaggccaugucugacuugccuauauuaaagguauac

SEQ ID NO: 153628 - RNA, 64 nt, Homo Sapiens
aaaaacaucuagccauauccauaaacuauaucaucaccaagagauguuuauuagggcaaucaaa

SEQ ID NO: 153629 - RNA, 64 nt, Homo Sapiens
gggaugagaggaguuguggcuuugugucugcuggcaccaagagggcugagggugagguguggaa

SEQ ID NO: 153630 - RNA, 64 nt, Homo Sapiens
agucugcuucaugccaaggcugggcuuugggucccaccaagaugaguucucuguaagacugugg

SEQ ID NO: 153631 - RNA, 64 nt, Homo Sapiens
gcccacucuccuccaagacuguguugucuuuucucaccaagaguauuaacacuacuaagucuuu

SEQ ID NO: 153632 - RNA, 64 nt, Homo Sapiens
ggagaccaguuucuggggagcuuccaagagcacccaccaagacacagcaggacaggccagggga

SEQ ID NO: 153633 - RNA, 64 nt, Homo Sapiens
agacccacccacucgggcugcaaaaggugaaaagcaccaagagguuuucagauggaagugagag

SEQ ID NO: 153634 - RNA, 64 nt, Homo Sapiens
caggaagccugugaaaaacgugauuccugggccccaccaagacccaccaaaaccaucucugggg

SEQ ID NO: 153635 - RNA, 64 nt, Homo Sapiens
ccaccugccccaauaagaucugcucugucugcgacaccaagauccagcuggggacuccccugag

SEQ ID NO: 153636 - RNA, 64 nt, Homo Sapiens
gccuuuuccaguggccauccccccuucccugugccaccaagacaccacccaucgaaaccagcca

SEQ ID NO: 153637 - RNA, 64 nt, Homo Sapiens
auaaaccccacugucucucuaucucuuuagcugucaccaagaaaggccugcagccuaccugacc

SEQ ID NO: 153638 - RNA, 64 nt, Homo Sapiens
uagcaaguucccaaaggcaaagcucccucuguuaccuuuccaucguuuggugacuugaggcugg

SEQ ID NO: 153639 - RNA, 64 nt, Homo Sapiens
uccccagcuucugccccaaugccucccacuguccccuuuccacugccaacuggaguccagguuc

SEQ ID NO: 153640 - RNA, 64 nt, Homo Sapiens
gcaaauggauccuccugugagagugacgucaccuccuuuccagagccauuagugagccuggcuu

SEQ ID NO: 153641 - RNA, 64 nt, Homo Sapiens
gaugagcguccuuuaaaccacugugccuucucacccuuuccaucuucaguuugaaugacuccca

SEQ ID NO: 153642 - RNA, 64 nt, Homo Sapiens
gcugagggagaaaaagaaaacauacauuaugaagccuuuccaaaauuaggugcuugguaaucac

SEQ ID NO: 153643 - RNA, 64 nt, Homo Sapiens
aagagucaaugauucuguucgacuaaauagcuguccuuuccaacacauugcuacuuuuuuaaau

SEQ ID NO: 153644 - RNA, 64 nt, Homo Sapiens
gauuuuuuuguuuugaucauggccucuacaugcaccuuuccagaguggucucuucucaggcccu

SEQ ID NO: 153645 - RNA, 64 nt, Homo Sapiens
uccagaguggucucuucucaggcccuuuuuagucccuuuccaaagcugcccccaccacccugcu

SEQ ID NO: 153646 - RNA, 64 nt, Homo Sapiens
augacuuagaaccauccuugacccuuaggcccaaccuuuccacagagaaaucaccucucuuccu

SEQ ID NO: 153647 - RNA, 64 nt, Homo Sapiens
ccauuugucagaaauguauuuggcuuuuuaaacuccuuuccacaaaaguuuaagucuaaugacc

SEQ ID NO: 153648 - RNA, 64 nt, Homo Sapiens
cauuucuaaguagauuuuuucaccacacccagccccuuuccaaccugggauuacaggcaugagc

SEQ ID NO: 153649 - RNA, 64 nt, Homo Sapiens
uuccuuuuuuuuuuuuuuuuuaucaguaaauacuccuuuccaacguugaauaaauaguaauauu

SEQ ID NO: 153650 - RNA, 64 nt, Homo Sapiens
aaaagagagggagguauggacugggggccagaguccuuuccaaggcuucuccaauucugcccaa

SEQ ID NO: 153651 - RNA, 64 nt, Homo Sapiens
guaaccauuugcacuggaguucuaugcucucgcaccuuuccaaaguuaacagauuuugggguug

SEQ ID NO: 153652 - RNA, 64 nt, Homo Sapiens
uuuuuuccaagagugugaaggaaaauggggcauuccuuuccacucuggcauaguucaugagcuu

SEQ ID NO: 153653 - RNA, 64 nt, Homo Sapiens
aguccaaucuccaaugagaacaugagcaaauagaccuuuccagguugaaagugaaacauacugg

SEQ ID NO: 153654 - RNA, 64 nt, Homo Sapiens
cgucccgggccugccuuucccauccuuugguucuccuuuccagucuggguucacacccugaaaa

SEQ ID NO: 153655 - RNA, 64 nt, Homo Sapiens
uugaaaguaucgugaccauguggcccaccagcagccuuuccaaaggggaacuccagagacauuu

SEQ ID NO: 153656 - RNA, 64 nt, Homo Sapiens
uguauguuucuucuuucuuuuaagcagacccauaccuuuccagggucaaaguacagaauagaau

SEQ ID NO: 153657 - RNA, 64 nt, Homo Sapiens
aucauuagagcuuaaauugucagaucguucauugccuuuccaggguuauuuaguaaaguuuguu

SEQ ID NO: 153658 - RNA, 64 nt, Homo Sapiens
agggugggcaauucccaacucaucccugagaagcccuuuccaguccugagccuggauuuucacu

SEQ ID NO: 153659 - RNA, 64 nt, Homo Sapiens
ccaaaccaccuguuuccccuuggaccugguuccaccuuuccauuagcagagggagcacauuuug

SEQ ID NO: 153660 - RNA, 64 nt, Homo Sapiens
cagacaccuucuugcagagugauuuugaccaaugccuuuccagcaccuuccccugguuaugaca

SEQ ID NO: 153661 - RNA, 64 nt, Homo Sapiens
ucucuucaggacaaaugguuuguccuuaugguccccuuuccacuaggauuuucucauccucauc

SEQ ID NO: 153662 - RNA, 64 nt, Homo Sapiens
aagccaaaaauggcaacaauuuacagaaaucccaccuuuccaugcuuaagacaaaaaugucuua

SEQ ID NO: 153663 - RNA, 64 nt, Homo Sapiens
auuaagaccaggguuuacacacuuaggcaauaguccuuuccaaaccaugacaaaaacuacaagu

SEQ ID NO: 153664 - RNA, 64 nt, Homo Sapiens
uaacaggagggaggggaagagcaaagcauucaucccuuuccauaagucagaugauauagcacua

SEQ ID NO: 153665 - RNA, 64 nt, Homo Sapiens
uuuucuauuccagaagacagcuuccuucuuucauccuuuccaauaacaguggagcuggagcuaa

SEQ ID NO: 153666 - RNA, 64 nt, Homo Sapiens
accguuggugccuagaggacuacuugucugccuuccuuuccaaguaguauugaaauggccaguu

SEQ ID NO: 153667 - RNA, 64 nt, Homo Sapiens
auaguugcccacucccucucucuuugcuuuauggccuuuccauccuccagugcauacuucucaa

SEQ ID NO: 153668 - RNA, 64 nt, Homo Sapiens
cccuuccuuccuuuuccucccuccuucccuucucccuuuccaacuuccucccucccuuccuucc

SEQ ID NO: 153669 - RNA, 64 nt, Homo Sapiens
cccuuccuuccuuuuccucccucccucccuucuuccuuuccaaccccauccuuccauucuuccc

SEQ ID NO: 153670 - RNA, 64 nt, Homo Sapiens
ccauuguaucaauuuuuugaaucuuuuuuguuuuccuuuccacucauuguuaaaggugcuuacg

SEQ ID NO: 153671 - RNA, 64 nt, Homo Sapiens
gcacuugaaguucaacuuaaaaauaagugcuguaccuuuccacuuugaaugugaacugauccag

SEQ ID NO: 153672 - RNA, 64 nt, Homo Sapiens
guccccguccccagccuaccaaagaguauucacaccuuuccaucccugacucuauggguuacug

SEQ ID NO: 153673 - RNA, 64 nt, Homo Sapiens
ucuuuucagcuggggaggggaagaggugcuggcuccuuuccagacaugcuuauguauaaguaaa

SEQ ID NO: 153674 - RNA, 58 nt, Homo Sapiens
caggcggugggaugcuuguagcuccucacagcaggauuccugcccacuguuuuuucuc

SEQ ID NO: 153675 - RNA, 58 nt, Homo Sapiens
caauaugcccuuccgguucuauucaaaccagcaggaucugucggugcuuagagauggc

SEQ ID NO: 153676 - RNA, 58 nt, Homo Sapiens
cccauucauucacccaacuuccuucauucagcaggagguccuauuacccucuccagcu

SEQ ID NO: 153677 - RNA, 58 nt, Homo Sapiens
cugcauccaacaugggagcagagacuggcagcaggaggggggaacauggugagaagug

SEQ ID NO: 153678 - RNA, 58 nt, Homo Sapiens
gucgugccauucacaaagucagaaaauacagcaggaagagacagcuuuuagaggggca

SEQ ID NO: 153679 - RNA, 58 nt, Homo Sapiens
gauggaaugacuucugcaacuguagucccagcaggaacugugaagaccagcugcccug

SEQ ID NO: 153680 - RNA, 58 nt, Homo Sapiens
gguuggguaggugugggguuccagaggacagcaggacacucucgcauacuuugccaaa

SEQ ID NO: 153681 - RNA, 58 nt, Homo Sapiens
ccagacucugugcacuucagaccagcagcagcaggagggcucccgagggccuuaugag

SEQ ID NO: 153682 - RNA, 58 nt, Homo Sapiens
cugccuggggccugggucaagggccagucagcaggaggcugccggaacaacagcggcu

SEQ ID NO: 153683 - RNA, 58 nt, Homo Sapiens
cuuggagagucggccagacggcggggggcagcaggaacuuugccucauaccccaccaa

SEQ ID NO: 153684 - RNA, 58 nt, Homo Sapiens
gaauaagcaaauccaugaacuuuugucucagcaggauaugugugugcacacucaugag

SEQ ID NO: 153685 - RNA, 58 nt, Homo Sapiens
acuuagggauaaggaagaauggacuccccagcaggaauagauaauauuucuccaauug

SEQ ID NO: 153686 - RNA, 58 nt, Homo Sapiens
gggggcccuugggugccagagugagacacagcaggacccuuccccaaauacuaggcuc

SEQ ID NO: 153687 - RNA, 58 nt, Homo Sapiens
uaggcucagagcaaccuccagccuucuccagcaggaucugcucccuguguccuuggac

SEQ ID NO: 153688 - RNA, 58 nt, Homo Sapiens
cuuuuuuuccccaaggcacuuuaaaaaucagcaggacaacccugaggcaaacuggaag

SEQ ID NO: 153689 - RNA, 58 nt, Homo Sapiens
caugauuuguucauuucugagucacaaacagcaggauaccucacagguaagccauacc

SEQ ID NO: 153690 - RNA, 58 nt, Homo Sapiens
aagacaacccguuggagcccgugggggacagcaggaucgccucugcaaggcacucagg

SEQ ID NO: 153691 - RNA, 58 nt, Homo Sapiens
uggcccuucugccugggcagcuguggagcagcaggaccgcagcuuccuccacagccgg

SEQ ID NO: 153692 - RNA, 58 nt, Homo Sapiens
uagagaggcguuagugggcagguggccacagcaggacugaggacaggcccccauuauc

SEQ ID NO: 153693 - RNA, 58 nt, Homo Sapiens
ccaggaccaccucguccucguggcggggcagcaggagcgguagaaagggguccgaugu

SEQ ID NO: 153694 - RNA, 58 nt, Homo Sapiens
cugcuggcaucaguaccugguguugggacagcaggauaggguucuaaaggugguuuuc

SEQ ID NO: 153695 - RNA, 58 nt, Homo Sapiens
ccaggaaucccuuccucccauguccuggcagcaggaccccaggcuacauauggaaggu

SEQ ID NO: 153696 - RNA, 58 nt, Homo Sapiens
gagugucuuuguguaucaccguguuccucagcaggaaugcuggucucuguguguuugu

SEQ ID NO: 153697 - RNA, 58 nt, Homo Sapiens
cacuggccuggcaccaccugucuccugacagcaggaacuguugaaaagcuccuugggu

SEQ ID NO: 153698 - RNA, 58 nt, Homo Sapiens
ugucauguauaacugagacacacaaacacagcaggagaaaucuaaaccguugugccuu

SEQ ID NO: 153699 - RNA, 58 nt, Homo Sapiens
augauuaguauagcuuucuccagcauggcagcaggaaguaacuacagggccucuuuua

SEQ ID NO: 153700 - RNA, 58 nt, Homo Sapiens
aagagaguucuggaugucuggcucaaagcagcaggacugugggaaagagccuaacauc

SEQ ID NO: 153701 - RNA, 58 nt, Homo Sapiens
ucccaaggccccacuuucaagaaucagacagcaggaagccauagaugcuggcuggguu

SEQ ID NO: 153702 - RNA, 58 nt, Homo Sapiens
aacaaagcacuuuuggacaaugcuaucccagcaggaaaaaaaaggauaauauaacugu

SEQ ID NO: 153703 - RNA, 58 nt, Homo Sapiens
uuugaucccuagauaagaacaugcaaaucagcaggaacuggucauacaggguaagcac

SEQ ID NO: 153704 - RNA, 58 nt, Homo Sapiens
gccuucucaggacuccuggguggcacagcagcaggaccuugucaugggacugaugcug

SEQ ID NO: 153705 - RNA, 58 nt, Homo Sapiens
agcaagggugacuccuggcaggugggggcagcaggagggcagagggcagagcucuggc

SEQ ID NO: 153706 - RNA, 58 nt, Homo Sapiens
ggcugucguguauauagcuguccacggccagcaggaugacaggagcucccagcuuuug

SEQ ID NO: 153707 - RNA, 58 nt, Homo Sapiens
gaagggcgcagcguccccucagucugggcagcaggaaggcgccggacccgguaggggc

SEQ ID NO: 153708 - RNA, 58 nt, Homo Sapiens
gaaaugagaaagcuggaauccugguccccagcaggagagccuaguccucccccagccc

SEQ ID NO: 153709 - RNA, 58 nt, Homo Sapiens
cugccagauccacucacucugcugccuccagcaggacccaaggccacuuucaacucuu

SEQ ID NO: 153710 - RNA, 58 nt, Homo Sapiens
ugagagaaaggaggugguauggaagacucagcaggaacaagguaggcuucaaagagcc

SEQ ID NO: 153711 - RNA, 58 nt, Homo Sapiens
gggccccugcugggcccagccaccaggacagcaggaaccagggccuacuccucuuaug

SEQ ID NO: 153712 - RNA, 58 nt, Homo Sapiens
gcuccuacuccucacaucuggaggauuccagcaggagggguuuuggaggggaccugcu

SEQ ID NO: 153713 - RNA, 58 nt, Homo Sapiens
auccagccauagauggcugcugggugugcagcaggagaaggaggauggucagccuugg

SEQ ID NO: 153714 - RNA, 58 nt, Homo Sapiens
gaggugaagagggcggagagggaagggacagcaggagugucuauauugcacugagaga

SEQ ID NO: 153715 - RNA, 58 nt, Homo Sapiens
gccucacugccccucuugcaaccucaaucagcaggacacaguagagagaccaggagcc

SEQ ID NO: 153716 - RNA, 58 nt, Homo Sapiens
ggagcuuccaagagcacccaccaagacacagcaggacaggccaggggagggcaucugg

SEQ ID NO: 153717 - RNA, 58 nt, Homo Sapiens
cacuugacucucuguaaaauggaccaaucagcaggauguggguggggcgagacaagag

SEQ ID NO: 153718 - RNA, 58 nt, Homo Sapiens
gagacggucuugccucucagagcagcugcagcaggaggccagcaguggcugcugggga

SEQ ID NO: 153719 - RNA, 58 nt, Homo Sapiens
agguuuuccucuguuggccuuguugucacagcaggaaugcugcgugggacaagggcug

SEQ ID NO: 153720 - RNA, 58 nt, Homo Sapiens
gugaaguaguaaacugggggagcagcagcagcaggaugucucuauggugcugaggaag

SEQ ID NO: 153721 - RNA, 58 nt, Homo Sapiens
aggcccuggguugccgugcucccaccuucagcaggauguccuuaccccccagccccug

SEQ ID NO: 153722 - RNA, 58 nt, Homo Sapiens
aggaggggugguagccguucccaccucgcagcaggacccccagugcagaggcucacag

SEQ ID NO: 153723 - RNA, 58 nt, Homo Sapiens
ugagggggucugaccaggaggccaccuacagcaggaagugaggcugccauguuuccuu

SEQ ID NO: 153724 - RNA, 58 nt, Homo Sapiens
aagggagccagccuccagugucucguuccagcaggaccuggcguccacaagcaauacc

SEQ ID NO: 153725 - RNA, 58 nt, Homo Sapiens
aggcauuccagucugccccaggugggaacagcaggaaacgagcuauagggcaucaggu

SEQ ID NO: 153726 - RNA, 58 nt, Homo Sapiens
ugaagcccacagaugcgcacgcaaugaccagcaggaaccggaagcccugggucacccc

SEQ ID NO: 153727 - RNA, 58 nt, Homo Sapiens
cccuccccucucuuagagacugugccuucagcaggacucuuaauaucugcugcaacuu

SEQ ID NO: 153728 - RNA, 58 nt, Homo Sapiens
caugcagaggugguagaaaggcuggacucagcaggaacaccaaaucccggaccaggca

SEQ ID NO: 153729 - RNA, 58 nt, Homo Sapiens
gcagggcucagcagcacccggugaacagcagcaggaggagccgcuagagcagcugcuc

SEQ ID NO: 153730 - RNA, 58 nt, Homo Sapiens
aauucugcaucccuaauucucacugccucagcaggagcuucagcuugaggggagcucc

SEQ ID NO: 153731 - RNA, 58 nt, Homo Sapiens
uuguaguuguaugcuugauuaaguggagcagcaggacuaauuauuaaguuugacuugg

SEQ ID NO: 153732 - RNA, 58 nt, Homo Sapiens
cuaaaauaucugccaucaucuaauaggacagcaggaacgcugcuuuugagcuucaagg

SEQ ID NO: 153733 - RNA, 58 nt, Homo Sapiens
ugugcauguggguagagaucuugggaagcagcaggaaagacaccaucuuggaauaccu

SEQ ID NO: 153734 - RNA, 64 nt, Homo Sapiens
uuuucuacuuuggcaacucacgucacacacauauuacacacaugugcgcauuacacacacacaa

SEQ ID NO: 153735 - RNA, 64 nt, Homo Sapiens
ucacgucacacacauauuacacacaugugcgcauuacacacacacaauacacauacaugcauau

SEQ ID NO: 153736 - RNA, 64 nt, Homo Sapiens
cacaacuuguuucuuaguucauauaaucucgggauacacacacacacacacauauauauacaca

SEQ ID NO: 153737 - RNA, 64 nt, Homo Sapiens
aaucucgggauacacacacacacacacauauauauacacacacauacguauacacacacauaca

SEQ ID NO: 153738 - RNA, 64 nt, Homo Sapiens
cacacacacacauauauauacacacacauacguauacacacacauacauauauauaaauauacc

SEQ ID NO: 153739 - RNA, 64 nt, Homo Sapiens
ucaaagacuaucugcagcuaguguguuucuucuuuacacacauauacacacagacaucagaaaa

SEQ ID NO: 153740 - RNA, 64 nt, Homo Sapiens
ucugcagcuaguguguuucuucuuuacacacauauacacacagacaucagaaaauucuguugag

SEQ ID NO: 153741 - RNA, 64 nt, Homo Sapiens
gcaacuugaauuaagaccaaacagaacaugagaauacacacacacacacacauauacacacaca

SEQ ID NO: 153742 - RNA, 64 nt, Homo Sapiens
acagaacaugagaauacacacacacacacacauauacacacacacacacuucacacauacacac

SEQ ID NO: 153743 - RNA, 64 nt, Homo Sapiens
agagaaucauauauaguccagucuucauuuuacauacacacacauauuuuacacacacacacau

SEQ ID NO: 153744 - RNA, 64 nt, Homo Sapiens
guccagucuucauuuuacauacacacacauauuuuacacacacacacauuuuacacacacacac

SEQ ID NO: 153745 - RNA, 64 nt, Homo Sapiens
cauacacacacauauuuuacacacacacacauuuuacacacacacacacacacacacacauaug

SEQ ID NO: 153746 - RNA, 64 nt, Homo Sapiens
cacacacacacaccugaggcaccacacacacacauacacacacaguacacacgcagacacagac

SEQ ID NO: 153747 - RNA, 64 nt, Homo Sapiens
cuccaauccauccaugcauaucgggggcaaagcauacacacacaagcuuuccugaacuggaacg

SEQ ID NO: 153748 - RNA, 64 nt, Homo Sapiens
cacacacacacacguauaucuauauauauauauauacacacacaugauauacacacacauuaua

SEQ ID NO: 153749 - RNA, 64 nt, Homo Sapiens
uuauauauauauauauauaugaaaaaauaugauauacacacacacuggcagcucuuaaaacuaa

SEQ ID NO: 153750 - RNA, 64 nt, Homo Sapiens
gacucaaauguaugcaguacuauucagaaugauauacacacauauguguauauguauuuacaua

SEQ ID NO: 153751 - RNA, 64 nt, Homo Sapiens
agcagaucaugcuauugugacauuugcagagauauacacacacuuuuuguacagaagaggcuug

SEQ ID NO: 153752 - RNA, 64 nt, Homo Sapiens
auuccugggauuauuauacugagauauauauauauacacacacacacacauauguguauauaug

SEQ ID NO: 153753 - RNA, 64 nt, Homo Sapiens
uguguauauauguauauauauaugugaguauauauacacacacacacacacacacacauauaua

SEQ ID NO: 153754 - RNA, 64 nt, Homo Sapiens
uacacacacacacacacacacacauauauauauauacacacacgcacacauauauguugcugca

SEQ ID NO: 153755 - RNA, 64 nt, Homo Sapiens
cuccauguucuucuaaaacauauacauauauacauacacacauacacauauucuucaggucucu

SEQ ID NO: 153756 - RNA, 64 nt, Homo Sapiens
gagaccuagguucuuacacauaugcacacacgcauacacacaugcacgcacacacacauacaca

SEQ ID NO: 153757 - RNA, 64 nt, Homo Sapiens
cacacacgcauacacacaugcacgcacacacacauacacacaugcacgcacgcacgcaugcaca

SEQ ID NO: 153758 - RNA, 64 nt, Homo Sapiens
ccucagaguacucuuucuuacacacacacauauguacacacacaauaacaugugcccgaacaua

SEQ ID NO: 153759 - RNA, 64 nt, Homo Sapiens
cauauguacacacacaccuccaugugcccgaacauacacacacaaaccugugacuguugaauaa

SEQ ID NO: 153760 - RNA, 64 nt, Homo Sapiens
cacacacacacagagacacaaacacacacacacauacacacacaguugcaguucagacaaaugu

SEQ ID NO: 153761 - RNA, 64 nt, Homo Sapiens
acagugguauaaacuuuuuauuuagaacauggacuacacacaauuggcuccggggcauccugga

SEQ ID NO: 153762 - RNA, 64 nt, Homo Sapiens
cacagacccacacacauacacacacacacacauauacacacacuaaccucuguacacacacaca

SEQ ID NO: 153763 - RNA, 64 nt, Homo Sapiens
cacacacacacacauauacacuuauaaaccucuguacacacacacucgcagaagaaaguucuca

SEQ ID NO: 153764 - RNA, 64 nt, Homo Sapiens
cagcuacggauauaaugaaaccauuauguaacuauacacacauauucuguaucguguguaguua

SEQ ID NO: 153765 - RNA, 64 nt, Homo Sapiens
cagacacacacacacacacauguguauguguguauacacacacaacauguuguaaauauauauc

SEQ ID NO: 153766 - RNA, 64 nt, Homo Sapiens
uauguuucuguguuccucuuaguauauauauauauacacacauaacauacauauguguguguau

SEQ ID NO: 153767 - RNA, 64 nt, Homo Sapiens
uacauauguguguguauaguuauauguauauauauacacacacagugauauacauauauacaua

SEQ ID NO: 153768 - RNA, 64 nt, Homo Sapiens
cacauauauauauauauauauauauauauauauauacacacacaucucaaaaguuaaaauuaua

SEQ ID NO: 153769 - RNA, 64 nt, Homo Sapiens
gaauuuuuuaaagguauucauggugacucaggaauacacacauacacacacacacacacacaca

SEQ ID NO: 153770 - RNA, 64 nt, Homo Sapiens
uaaagguauucauggugacucaggaauacacacauacacacacacacacacacacacacacaca

SEQ ID NO: 153771 - RNA, 64 nt, Homo Sapiens
uacacacacacacacacacacacacacacacacauacacacauauaauuugaaagaggugagua

SEQ ID NO: 153772 - RNA, 64 nt, Homo Sapiens
cacacuccuucucuaagauucacacacacacacauacacacacaucauuacucuuacacacaca

SEQ ID NO: 153773 - RNA, 64 nt, Homo Sapiens
cacacacacacacauacacacagaucauuacucuuacacacacacucgagugcauugagacuuc

SEQ ID NO: 153774 - RNA, 64 nt, Homo Sapiens
uucacuuaaaguuguuuuaaaaauuacaaacacauacacacaucuccauaauggacuagaauau

SEQ ID NO: 153775 - RNA, 64 nt, Homo Sapiens
cacagaaugcacauuucacagcacauacacacauuacacacacaccauguauacaccuguaugu

SEQ ID NO: 153776 - RNA, 64 nt, Homo Sapiens
acacacacacacagaaugcaccuguaugugcacauacacacauuaaauguuugccauguauaca

SEQ ID NO: 153777 - RNA, 64 nt, Homo Sapiens
aauguguguauacauuugggaaauagcauacauguacacacaaaguauguaccugugguauacc

SEQ ID NO: 153778 - RNA, 64 nt, Homo Sapiens
ggggccuucccucccaggucugugucugauagcauacacacacacauauauauacacacacaca

SEQ ID NO: 153779 - RNA, 64 nt, Homo Sapiens
ucugugucugauagcauacacacacacauauauauacacacacacacacacacacacacacaca

SEQ ID NO: 153780 - RNA, 64 nt, Homo Sapiens
cacacacacacacacacacacacacacacauacauacacacacacauauauauacacacacaca

SEQ ID NO: 153781 - RNA, 64 nt, Homo Sapiens
cacacacacacauacauacacacacacauauauauacacacacacacacacacacacacacaca

SEQ ID NO: 153782 - RNA, 64 nt, Homo Sapiens
augauaguauuuuuaugcacucuucucccacacauacacacacgugcauguaucugagcugcuc

SEQ ID NO: 153783 - RNA, 64 nt, Homo Sapiens
agaagaccuauaccccggugccccugugucccacuacacacagaaaacccugugagauggccag

SEQ ID NO: 153784 - RNA, 64 nt, Homo Sapiens
cggaccaaaauacuuacacccacacacacacacauacacacacacauauuuagguauacacaca

SEQ ID NO: 153785 - RNA, 64 nt, Homo Sapiens
cacacacacacauacacacauacauauuuagguauacacacacaugcagaaaccauuaagcagu

SEQ ID NO: 153786 - RNA, 64 nt, Homo Sapiens
cauauaauuuuuuuuuuuuuuacauauauauacauacacacauacauacauauauauauauaua

SEQ ID NO: 153787 - RNA, 64 nt, Homo Sapiens
cacacacacacacacacacacuuuauuccauauauacacacacaaaaaagcagggaaucucaaa

SEQ ID NO: 153788 - RNA, 64 nt, Homo Sapiens
cgagagacagaaggaaagagaugauacauacacauacacacacaacguauacauauguguauau

SEQ ID NO: 153789 - RNA, 64 nt, Homo Sapiens
uauauauauggauggauguauguggcuagauauauacacacacaaaaagagagagaaguaccac

SEQ ID NO: 153790 - RNA, 64 nt, Homo Sapiens
aauuucuuaaaaaaaucaauuaauacaaucuacuuacacacauggaccugaaaugacucauaga

SEQ ID NO: 153791 - RNA, 64 nt, Homo Sapiens
uuuagaaauaaauuaaaaauuaauaugcuccaccuacacacaaucuccaaauccaauucagagg

SEQ ID NO: 153792 - RNA, 64 nt, Homo Sapiens
cacacauacuuaaaucuugcuguguguguauauauacacacacauguauguguaugugugugug

SEQ ID NO: 153793 - RNA, 64 nt, Homo Sapiens
cacacacaugcacacauaccauauauauauauaauacacacacauaauguaaaugggggcuuca

SEQ ID NO: 153794 - RNA, 64 nt, Homo Sapiens
cacacacacacacacacacacacacacgcacauauacacacacauauauauauauauacacaca

SEQ ID NO: 153795 - RNA, 64 nt, Homo Sapiens
cacacgcacauauacacacauauauauauauauauacacacacaaaaggcuccauauauauaua

SEQ ID NO: 153796 - RNA, 64 nt, Homo Sapiens
cuauaucuauauguguguauacauauauaauauauacacacagauacaaguguacacacacaca

SEQ ID NO: 153797 - RNA, 64 nt, Homo Sapiens
auacauauauaauauauacacacagauacaaguguacacacacacaccacacaccacacacacc

SEQ ID NO: 153798 - RNA, 64 nt, Homo Sapiens
uuauggaaacccauugacauuccaaaacaauauauacacacacacauaaaucagccaaaaucag

SEQ ID NO: 153799 - RNA, 64 nt, Homo Sapiens
gcaauaagagucuggauuuuaaaaaacacaugcauacacacaauuaagagcucaugucuuagca

SEQ ID NO: 153800 - RNA, 64 nt, Homo Sapiens
cacacacacacacacacagucacacacaugcacauacacacacauaccccuuuaaacacacaca

SEQ ID NO: 153801 - RNA, 64 nt, Homo Sapiens
uauuuccuugagauaaacaaucuguggcuacauauacacacacggugugugcauuuauguaugc

SEQ ID NO: 153802 - RNA, 64 nt, Homo Sapiens
caacccccuauaccuggaagguguguguguguaauacacacacaaaaaaauuuauauauacauu

SEQ ID NO: 153803 - RNA, 64 nt, Homo Sapiens
uaauuugaaaacugauuggcuacauacauauguauacacacacaaacauacaugcaugcacaca

SEQ ID NO: 153804 - RNA, 64 nt, Homo Sapiens
cacacacacacacauaucacacacacacaacacauacacacacagccuggagaaggccuuuuac

SEQ ID NO: 153805 - RNA, 64 nt, Homo Sapiens
caacacauacacacacacacuggagaaggccuuuuacacacacaccaaggggcccuuccuggcc

SEQ ID NO: 153806 - RNA, 64 nt, Homo Sapiens
uugguuugacgcccuguuuucacacgcgugcgcauacacacauucacaggcacacccaccagua

SEQ ID NO: 153807 - RNA, 64 nt, Homo Sapiens
cccacaggcacacccaccagggcaggggggcagguacacacacacaaccugggagcaucuggca

SEQ ID NO: 153808 - RNA, 64 nt, Homo Sapiens
augaaugcgaauuuucagauuugauuuuauucucuacacacaccucuucuuuucuugguauuuc

SEQ ID NO: 153809 - RNA, 64 nt, Homo Sapiens
caaacguguacacaagugugagcuccuacacgcauacacacacacacguguacaugcaccaaag

SEQ ID NO: 153810 - RNA, 64 nt, Homo Sapiens
ugaacagcguaaguuccuacacacggacgugugauacacacaugcauguacagguaagcacaca

SEQ ID NO: 153811 - RNA, 64 nt, Homo Sapiens
gugcacacaucguacacaugugagcucccacacguacacacagaugcacauggacacaccccaa

SEQ ID NO: 153812 - RNA, 64 nt, Homo Sapiens
gcacauggacacaccccaaacacgcacaggcuccuacacacaugcacacacguguacaccacaa

SEQ ID NO: 153813 - RNA, 64 nt, Homo Sapiens
cacaaacacaugcgcaggcuccugcaggcgugaauacacacaugcacacacauauacacacaug

SEQ ID NO: 153814 - RNA, 64 nt, Homo Sapiens
ccugcaggcgugaauacacacaugcacacacauauacacacaugugccacaaacaagugcacac

SEQ ID NO: 153815 - RNA, 64 nt, Homo Sapiens
cacacacacucugacugucucacucacacucacauacacacacauuuaauguacaucacacaca

SEQ ID NO: 153816 - RNA, 64 nt, Homo Sapiens
cagagucuuuauugcagaagcacauacacacacauacacacacauuacaggcgugagacagaca

SEQ ID NO: 153817 - RNA, 64 nt, Homo Sapiens
uacacacacacagagucuuugagacagacacacauacacacacaagugcuaggauuacaggcgu

SEQ ID NO: 153818 - RNA, 64 nt, Homo Sapiens
aagauaaagauagaaaucugagguugagaacuuuuacacacacuucuaaaauuuguccuugucu

SEQ ID NO: 153819 - RNA, 64 nt, Homo Sapiens
agucagugcccauguguauguguguauauguuuauacacacaggcacguguauaugaggaugua

SEQ ID NO: 153820 - RNA, 64 nt, Homo Sapiens
gacacacaagcagacacacaaguuuuuauaccuguacacacacaaaauauuacucugccuguca

SEQ ID NO: 153821 - RNA, 64 nt, Homo Sapiens
cacacacacacacacacacauaucacccccucccuacacacacauagggagccuccccucccug

SEQ ID NO: 153822 - RNA, 64 nt, Homo Sapiens
caggcccaugccaaggccucuaaagggacaccccuacacacaccaacacagaccccuagggauu

SEQ ID NO: 153823 - RNA, 64 nt, Homo Sapiens
cgcucgugcacaggcacgcagaugcgcucacacguacacacacacaaaugcacgcccacuugca

SEQ ID NO: 153824 - RNA, 64 nt, Homo Sapiens
caugcacacucacgcucacacaugcugucacgcauacacacacgcacauacuccugcacauguu

SEQ ID NO: 153825 - RNA, 64 nt, Homo Sapiens
uuucaccacaugugcacaugcacgugugugcacguacacacacauacacacacacgcgugcaca

SEQ ID NO: 153826 - RNA, 64 nt, Homo Sapiens
ugugcacaugcacgugugugcacguacacacacauacacacacacgcgugcacacaccagagcc

SEQ ID NO: 153827 - RNA, 64 nt, Homo Sapiens
auuauucuggauguagauugagcuuauuaaauguuacacacaaaguauucaugcauggugaauc

SEQ ID NO: 153828 - RNA, 64 nt, Homo Sapiens
aaaagacaaagggugagaguuagcguccuguagauacacacagagacuaggccguauauuaacu

SEQ ID NO: 153829 - RNA, 64 nt, Homo Sapiens
cacacacacacacacacacacacauauauacauauacacacacacacacacacacacacacaca

SEQ ID NO: 153830 - RNA, 64 nt, Homo Sapiens
cacacacacacacacacauauauauauauauauauacacacacaguauauauauauauauauua

SEQ ID NO: 153831 - RNA, 64 nt, Homo Sapiens
cuccuucuccaucucacccucccucucucacacauacacacacaaacacauacacacaacacua

SEQ ID NO: 153832 - RNA, 64 nt, Homo Sapiens
cccucccucucucacacauacacacacaaacacauacacacaacacuaagugccuagacuuuaa

SEQ ID NO: 153833 - RNA, 64 nt, Homo Sapiens
gauauuguguacaccaugcccauguauauacaaguacacacagauguacacacagauguacaca

SEQ ID NO: 153834 - RNA, 64 nt, Homo Sapiens
accaugcccauguauauacaaguacacacagauguacacacagauguacacaugcuccagcccc

SEQ ID NO: 153835 - RNA, 64 nt, Homo Sapiens
uguguauauauguacauacagcuacagauccagauacacacacuguauauaaagcgcauguaga

SEQ ID NO: 153836 - RNA, 64 nt, Homo Sapiens
ugcacagguucucaaccacgugugcuugugaugauacacacacaguguugacguuucccagaug

SEQ ID NO: 153837 - RNA, 64 nt, Homo Sapiens
uguguguguguguguguauauguguuuauagagauacacacacauauauauguguguauauaua

SEQ ID NO: 153838 - RNA, 64 nt, Homo Sapiens
uauauguguguauauauauacacauacauauauauacacacacgcauuugcacagacacacaca

SEQ ID NO: 153839 - RNA, 64 nt, Homo Sapiens
gugauucucaaucucuuugaauuuuacuuacauuuacacacacacgcacacacauauguauaua

SEQ ID NO: 153840 - RNA, 64 nt, Homo Sapiens
uucucaaccucuuugaauuuuacuuauaauuacauacacacacacacugcuacuuauauaaaug

SEQ ID NO: 153841 - RNA, 64 nt, Homo Sapiens
cacacacagacacacacacacccuugaguacacauacacacacacacacacacacacacagaga

SEQ ID NO: 153842 - RNA, 64 nt, Homo Sapiens
cacacacagagacccuugagacuguugaaauuuauacacacacaggaccuuuuuucggagaagc

SEQ ID NO: 153843 - RNA, 64 nt, Homo Sapiens
cagacacacacacacgaaaccacauacacacacauacacacacaucugcccacacacacacaaa

SEQ ID NO: 153844 - RNA, 64 nt, Homo Sapiens
uacacacacacagacacacacacacacaaacacauacacacacauaaaagaaauucugcccaca

SEQ ID NO: 153845 - RNA, 64 nt, Homo Sapiens
uuucucucugcaaaccuuuaguuuucugaugaucuacacacacacauacacacacacacacaca

SEQ ID NO: 153846 - RNA, 64 nt, Homo Sapiens
aaccuuuaguuuucugaugaucuacacacacacauacacacacacacacacacacgugcacaca

SEQ ID NO: 153847 - RNA, 64 nt, Homo Sapiens
accaauaguauaaaaauguguccagauagccuggauuuaacaaacccauccccuaucuacuuaa

SEQ ID NO: 153848 - RNA, 64 nt, Homo Sapiens
uuagaaggcuugauagaaagguuuggaaaacuuuauuuaacaguguaaugaaguuuaaaugcuu

SEQ ID NO: 153849 - RNA, 64 nt, Homo Sapiens
auaauucauugugguaagaaugauugaaaugcagauuuaacaaucuuauaaucuauugaaugcc

SEQ ID NO: 153850 - RNA, 64 nt, Homo Sapiens
gugaagaaaguauuuaaauccaacuuuugaacagauuuaacaaacaugaggaacuuuuuuauuu

SEQ ID NO: 153851 - RNA, 64 nt, Homo Sapiens
cugaccugguaagcugccacacaauuagagaaucauuuaacaucuagaaaaugaauuguucacu

SEQ ID NO: 153852 - RNA, 64 nt, Homo Sapiens
gccacaccugaagcacuugguuuuuggcacucuuauuuaacaauuucuaugacccgugucuuca

SEQ ID NO: 153853 - RNA, 64 nt, Homo Sapiens
uaaugauacagagauuggccagaauggcagauaaauuuaacaggagaaggaagaagagacguua

SEQ ID NO: 153854 - RNA, 64 nt, Homo Sapiens
gcuuucuuuuuagcaagagguuauaacaaaauacauuuaacauuauuauuuuaggucauaaagg

SEQ ID NO: 153855 - RNA, 64 nt, Homo Sapiens
ugggaaaacaggacagcucacccaguuaaaugauauuuaacaccuuuuuuuauugcuuucauuu

SEQ ID NO: 153856 - RNA, 64 nt, Homo Sapiens
uaccaucuucaaaguacaaacugucacaucauagauuuaacauuguauuugcagcuagagguua

SEQ ID NO: 153857 - RNA, 64 nt, Homo Sapiens
caaaggauuggauuacuuuuucuauucuaauuaaauuuaacaaugacaguauuauauguacaua

SEQ ID NO: 153858 - RNA, 64 nt, Homo Sapiens
auagagcacagcgcccuacuagagacagaagcugauuuaacagcgacccugggcuugucugggc

SEQ ID NO: 153859 - RNA, 64 nt, Homo Sapiens
ccugacaugcucccuccaaugacaaacugagucaauuuaacaaugauauuuuggagauaaacaa

SEQ ID NO: 153860 - RNA, 64 nt, Homo Sapiens
uauaugugacagaaaucuaaaauauuaaucaagaauuuaacagagaaaguuuuauuuaaauauu

SEQ ID NO: 153861 - RNA, 64 nt, Homo Sapiens
agguauucguugaggugccucccaagguuuauuuauuuaacaacuuaaaguuucaacaacaaac

SEQ ID NO: 153862 - RNA, 64 nt, Homo Sapiens
guauuccuuuaaaauauuguuuuccuacaggccuauuuaacaagauguuucauuuuacuguaua

SEQ ID NO: 153863 - RNA, 64 nt, Homo Sapiens
augucucacuuuacuuucaaguaauauuggugcuauuuaacauuuuacaguaaauguuacuucu

SEQ ID NO: 153864 - RNA, 64 nt, Homo Sapiens
uucagagaggagaauacaacaucuuaguccagacauuuaacauacugcauuucaaguacaugug

SEQ ID NO: 153865 - RNA, 64 nt, Homo Sapiens
ccaaaccaugacaaaaacuacaaguuuauuuauaauuuaacaacucagcugaaaauauaacggg

SEQ ID NO: 153866 - RNA, 64 nt, Homo Sapiens
aaucugagcaaaagguauauguaaaugagguaaaauuuaacaaugagaaagagcaauugauaaa

SEQ ID NO: 153867 - RNA, 64 nt, Homo Sapiens
aaucugauacacauaaauaggcaaauaagguaacauuuaacaauuaaagagagcaauugauaag

SEQ ID NO: 153868 - RNA, 64 nt, Homo Sapiens
cguaugucaucucagggagcuuaaaaugggcuugauuuaacauuguuuuuguguuauuuuugcu

SEQ ID NO: 153869 - RNA, 64 nt, Homo Sapiens
ucucagaacauuuagccugcaguugggcaaaaccauuuaacacaaagccuauuuuauaaugaag

SEQ ID NO: 153870 - RNA, 64 nt, Homo Sapiens
uucacauuuaguuuauguuuuauagaauuuauucauuuaacauaaaaguucagguaugacaaag

SEQ ID NO: 153871 - RNA, 64 nt, Homo Sapiens
aaguaaaauugaaauuucuucuauuuuauuuuuuauuuaacaugacuguuuuaaaaguuccucu

SEQ ID NO: 153872 - RNA, 64 nt, Homo Sapiens
aguuaacucuacuuacuguuuuaacauacauuugauuuaacaaauuguucagcauaacacuucu

SEQ ID NO: 153873 - RNA, 64 nt, Homo Sapiens
uucuguuugauuauauuuccuacacaaacuucuuauuuaacaggauagccuacuaaauuaaaug

SEQ ID NO: 153874 - RNA, 64 nt, Homo Sapiens
gagcccagugacucaauaggccuuucaaggaguuauuuaacaauuuaucccccagaauccuuca

SEQ ID NO: 153875 - RNA, 64 nt, Homo Sapiens
ccauguaacuuuucugacuucuaucuccuuuaaaauuuaacauugcauguaauaaaacaagggc

SEQ ID NO: 153876 - RNA, 64 nt, Homo Sapiens
uucaacugucuguguaucauaaugugaauaaaguauuuaacauggguggauauaguuuguaaac

SEQ ID NO: 153877 - RNA, 64 nt, Homo Sapiens
gguucacagaaaguuuccuaugggacuuaauuggauuuaacauaaaagagcuaagccaucaagc

SEQ ID NO: 153878 - RNA, 64 nt, Homo Sapiens
cauaaaagccacugcuuuuaacaucccauuguacauuuaacacauaaaugguguuaacauccca

SEQ ID NO: 153879 - RNA, 64 nt, Homo Sapiens
uuaacacauaaaugguguuaacaucccauuguacauuuaacacauaaauggccauugucuuugu

SEQ ID NO: 153880 - RNA, 64 nt, Homo Sapiens
caagaaguguauauuuucaaacaauuuuuuaaugauuuaacaauuuuuguaaaucauuuucagg

SEQ ID NO: 153881 - RNA, 64 nt, Homo Sapiens
acaaggccuaauuugcaguaacuauugcuguuuuauuuaacaaugccuuguugcuuuguaugca

SEQ ID NO: 153882 - RNA, 64 nt, Homo Sapiens
auuaaguggauuuuuguauaaguuuauuguuguuauuuaacaguuucuguucaggaaaucuugu

SEQ ID NO: 153883 - RNA, 64 nt, Homo Sapiens
acaauugaaugccugaagaaacuacugucuguuuauuuaacacaggaaucauugcugcuaaaua

SEQ ID NO: 153884 - RNA, 64 nt, Homo Sapiens
cauuucaaaugaauauuauuaaugguuaauuacuauuuaacacacauuguaauuuaacaugguu

SEQ ID NO: 153885 - RNA, 64 nt, Homo Sapiens
guuaaugguuaauuacuauuugcuuuucauuguaauuuaacaugaagguauauagcuuauuugu

SEQ ID NO: 153886 - RNA, 64 nt, Homo Sapiens
aucuaguucauugaaucauucaguuaccugagagauuuaacauuaauccuaccucaaaauuuaa

SEQ ID NO: 153887 - RNA, 64 nt, Homo Sapiens
uaccugagagauuuaacauuaauccuaccucaaaauuuaacagugaaccccugaaguauuuuuu

SEQ ID NO: 153888 - RNA, 64 nt, Homo Sapiens
agaauauuuguuguugcaauuuucacauaagaaaauuuaacaguugugucauguuguuucuguc

SEQ ID NO: 153889 - RNA, 64 nt, Homo Sapiens
aaauauauguuacauauuauauuuaaacauacauauuuaacauuuuuuacauaucuaucaauau

SEQ ID NO: 153890 - RNA, 64 nt, Homo Sapiens
uucaccauauugcaugugcuauauagccuuuuaaauuuaacacuauuuucagucgcauugaugc

SEQ ID NO: 153891 - RNA, 64 nt, Homo Sapiens
uguaacacuuugacaauacuaaacucucauaagcauuuaacacuucagauguuuaacauuucug

SEQ ID NO: 153892 - RNA, 64 nt, Homo Sapiens
cauuaaauguauuuugcaaagccuaaaguuauauauuuaacaguuuuuauauguuguauauuug

SEQ ID NO: 153893 - RNA, 64 nt, Homo Sapiens
aguuuuuauauguuguauauuuguagaaaauccuauuuaacaauuaacguggcagucccggccg

SEQ ID NO: 153894 - RNA, 64 nt, Homo Sapiens
uacuuaauuguauuaaggucuuuaaaauguauguauuuaacaaauguggauaugaugacguuuc

SEQ ID NO: 153895 - RNA, 64 nt, Homo Sapiens
aauacaggaagcauggcaggggccugccccauguauuuaacaguaaacauugggauccuccaaa

SEQ ID NO: 153896 - RNA, 64 nt, Homo Sapiens
uuuccaauuuuagaaaaucaagcagguuagagaaaauagagaugaauuaggggacacugucuua

SEQ ID NO: 153897 - RNA, 64 nt, Homo Sapiens
ugaauaauaguaugaguaaugcuuaagggaguuuaauagagaaggaaagcuuuggcaguguuuu

SEQ ID NO: 153898 - RNA, 64 nt, Homo Sapiens
acuuacuauaaccacaucauaagaauucuggaaaaauagagaacaaaaggaaaagauuguuacc

SEQ ID NO: 153899 - RNA, 64 nt, Homo Sapiens
aaauaccuuuuuaaaaauuauuuuauuauuuuuuaauagagacuauguugccuaggcuggucuu

SEQ ID NO: 153900 - RNA, 64 nt, Homo Sapiens
uuagaaaugagaccacacacgacugauggaacagaauagagaaucuggcacaaaaacacacgua

SEQ ID NO: 153901 - RNA, 64 nt, Homo Sapiens
ggguuucaccauguuggccaauuuuuguauuuuuaauagagacgcccaccaccacgccuggcua

SEQ ID NO: 153902 - RNA, 64 nt, Homo Sapiens
uguucgaagacacauuuguaaauuuucaagcagcaauagagaaaaaaauucaugcaucucaaca

SEQ ID NO: 153903 - RNA, 64 nt, Homo Sapiens
ggacuuaaaacaaaccuugugcucuuuucaagaaaauagagaucuuaugucaaguucuacauca

SEQ ID NO: 153904 - RNA, 64 nt, Homo Sapiens
ugccacucuguuaauuucuuguuccagacauuuuaauagagauugcuugagccauguuguuuga

SEQ ID NO: 153905 - RNA, 64 nt, Homo Sapiens
auguuguuggcucaacuguuuuuuuuuuuucccuaauagagauggaguaucgcuauguugcuca

SEQ ID NO: 153906 - RNA, 64 nt, Homo Sapiens
uauaaaaguguguucuuaacugaucucuuugagaaauagagaaaaugugugugauuuacuuuuc

SEQ ID NO: 153907 - RNA, 64 nt, Homo Sapiens
aggcuaugccuguaauuuuuauauaaauauagaaaauagagaaaaugaagcaugaauuauuuuc

SEQ ID NO: 153908 - RNA, 64 nt, Homo Sapiens
uucaauaagcuauuuuuuuucuuuucuuauuuuaaauagagagagagucuugcuauguuuccca

SEQ ID NO: 153909 - RNA, 64 nt, Homo Sapiens
gcccagcgcugcggccccgggaagggccacugcgaauagagaggaagcuggaaaaguuccuggg

SEQ ID NO: 153910 - RNA, 64 nt, Homo Sapiens
ccuaccaccaugcccagcuaauuuuuguauuuuuaauagagaugggguuucaccauguuggcca

SEQ ID NO: 153911 - RNA, 64 nt, Homo Sapiens
aaaaaaaaaaaaaaaaagaauauauugacggaagaauagagaggaggcuugaaggaaccagcaa

SEQ ID NO: 153912 - RNA, 64 nt, Homo Sapiens
uauaugguucugucacuacuaacuaucuugauuuucacugaaaugauguuuuuuuuaaugguau

SEQ ID NO: 153913 - RNA, 64 nt, Homo Sapiens
gucccuuuuagcuucugauuaaugcgucugcugaucacugaagucuccauuuguuacgugagag

SEQ ID NO: 153914 - RNA, 64 nt, Homo Sapiens
ggggcauguaugcaaaccucgauuccaacauuucucacugaaagguauauacucauguccccca

SEQ ID NO: 153915 - RNA, 64 nt, Homo Sapiens
aagccaucagggaaaaaacaucaugguacauuuaucacugaauuaccugguguguuucuuggga

SEQ ID NO: 153916 - RNA, 64 nt, Homo Sapiens
uccuaaauguuuuaauuguaccauaguguuuugcucacugaagaagcuucuuauggaccuugca

SEQ ID NO: 153917 - RNA, 64 nt, Homo Sapiens
auuaguugauuuuuucauuuuguuagagguauuuucacugaacaaggucaauugguuaccucag

SEQ ID NO: 153918 - RNA, 64 nt, Homo Sapiens
uuggcuuucucuuucugacuagucccaucgacguucacugaacaacucacccuccacagcacuc

SEQ ID NO: 153919 - RNA, 64 nt, Homo Sapiens
uucugagggcagagucuuagaauggaccugccuuucacugaauuuuuguuuuuuucuuacugaa

SEQ ID NO: 153920 - RNA, 64 nt, Homo Sapiens
cucccccuuacuagauauuuaaguagcuguacacucacugaaugacugaaauugaagaugagga

SEQ ID NO: 153921 - RNA, 64 nt, Homo Sapiens
ugaagaugaggaaaguagcucagugccuguguacucacugaaauccuguuuugaguauggaagc

SEQ ID NO: 153922 - RNA, 64 nt, Homo Sapiens
aggcccuguuugcaauucaccuacaggcacacagucacugaagcagacucccgaguagcuggga

SEQ ID NO: 153923 - RNA, 64 nt, Homo Sapiens
gucuggcuaaugcucuugugccuguuaccuguucucacugaaaaguaccaagugcuggugccag

SEQ ID NO: 153924 - RNA, 64 nt, Homo Sapiens
aagucauacaugcuuaagcuaacaaaaacuaaucucacugaauagacauguaccaagcuaaaua

SEQ ID NO: 153925 - RNA, 64 nt, Homo Sapiens
uugguuuuuccauaauuuacuuaaccaauccuugucacugaacauuaaggcugcuuucacacug

SEQ ID NO: 153926 - RNA, 64 nt, Homo Sapiens
cauccaugcacagccacuaucauacccuuuauucucacugaaaggcagaacucagaaccuguua

SEQ ID NO: 153927 - RNA, 64 nt, Homo Sapiens
agugaggggcccuuugcauagcucuccuucccccucacugaagcuggguagccuauugggguug

SEQ ID NO: 153928 - RNA, 64 nt, Homo Sapiens
agugaaauaaaaugaaaacaaccagugaaauauuucacugaaacaaauuacauguuucacugaa

SEQ ID NO: 153929 - RNA, 64 nt, Homo Sapiens
cagugaaauauuucacugaauaaaauuacauguuucacugaaacuuuauugagaauaaauuuuc

SEQ ID NO: 153930 - RNA, 64 nt, Homo Sapiens
agcugaggggauguggggccccaaacucauuaauucacugaagacacaggucccacagggagcg

SEQ ID NO: 153931 - RNA, 64 nt, Homo Sapiens
accagucugcaacccugcucuaugcugacccuugucacugaacccugaucuagacuuauaugaa

SEQ ID NO: 153932 - RNA, 64 nt, Homo Sapiens
cucauaaaggugccacucaguuuuagccaugucuucacugaaauugcaaaaguacuuuuaggga

SEQ ID NO: 153933 - RNA, 64 nt, Homo Sapiens
ugagagguaggacuggauuaaaugaccacugaacucacugaauccagaucauucauaucaucaa

SEQ ID NO: 153934 - RNA, 64 nt, Homo Sapiens
uaauagcucaaaauugucccgagguuuugaaaaaccaguuaauuaucuccacaaaugccauugg

SEQ ID NO: 153935 - RNA, 64 nt, Homo Sapiens
augaaagguugcagugcuucaauuauuugucaccccaguuaaacacuuugauuacuuuggucuc

SEQ ID NO: 153936 - RNA, 64 nt, Homo Sapiens
gaaagcucugccucuggcuuuccggucauggguuccaguuaauucaugccucccauggaccuau

SEQ ID NO: 153937 - RNA, 64 nt, Homo Sapiens
uuuggaaaaguggauuucauucauuucugauuguccaguuaagugaucaccaaaggacugagaa

SEQ ID NO: 153938 - RNA, 64 nt, Homo Sapiens
ugugguuuugaaguuuguacuuucucugugggugccaguuaaauauuggagagcaaggaaugug

SEQ ID NO: 153939 - RNA, 64 nt, Homo Sapiens
aagacccugucucagaaaaaaagaaaauucaaggccaguuaagacaaaaugcuaugacuuugaa

SEQ ID NO: 153940 - RNA, 64 nt, Homo Sapiens
agccuguuuggaugauggaugccauuccuuuugcccaguuaaauguucaccaaucauuuuaacu

SEQ ID NO: 153941 - RNA, 64 nt, Homo Sapiens
guggaauguauccuuuuuuagguuucccugcuuuccaguuaauuuuuaaaaugguagcgcuuug

SEQ ID NO: 153942 - RNA, 64 nt, Homo Sapiens
cuguugaaaaacuaccugggaggagugaguuccuccaguuaaauguggcuguagauguuggagg

SEQ ID NO: 153943 - RNA, 64 nt, Homo Sapiens
uguaauuggggaacauuaaaacaguaacugacauccaguuaaagccacgaucgucagcaauucu

SEQ ID NO: 153944 - RNA, 64 nt, Homo Sapiens
uuccuuagaaauuggaugagaccaagguuagaugccaguuaaaauuugcuuacagcauauggua

SEQ ID NO: 153945 - RNA, 64 nt, Homo Sapiens
agcauuagaagaggugguuguauaggaagcacugccaguuaaagcucuauugcuuggugucauu

SEQ ID NO: 153946 - RNA, 64 nt, Homo Sapiens
gccagcaauuggcugggguccaggaaacaaagcaaaagcacaauaugugaaugugcugauugug

SEQ ID NO: 153947 - RNA, 64 nt, Homo Sapiens
aaauuuauguuggcgauagccaagaccacaagcaaaagcacauacuggaaaugaugaguuagaa

SEQ ID NO: 153948 - RNA, 64 nt, Homo Sapiens
uggguccuuuauucauuucuaggauuuuggaaggaaagcacaacgagcacaaacaacuuuguug

SEQ ID NO: 153949 - RNA, 64 nt, Homo Sapiens
aaagagagggugucuucauauauaaaaggugaaaaaagcacacaauuauauuugcaaacuucuu

SEQ ID NO: 153950 - RNA, 64 nt, Homo Sapiens
gacacaaagaggaaucuaaacauccuuaccuccaaaagcacagguggcacccagagaaaaggag

SEQ ID NO: 153951 - RNA, 64 nt, Homo Sapiens
uuaaggaacaagaauugcuaggcuccuucuccauaaagcacauuaaacguauuucacuaacucu

SEQ ID NO: 153952 - RNA, 64 nt, Homo Sapiens
ugaagcagugucgccgucccucugccuugcacaaaaagcacaagcauuccuuagcagcucaggc

SEQ ID NO: 153953 - RNA, 64 nt, Homo Sapiens
ggccccaaagcccagcccggcugaccaacauucaaaagcacaaacccuggggacucugcuuggc

SEQ ID NO: 153954 - RNA, 64 nt, Homo Sapiens
aauugacagaaaaauacaggaagcacaauaauugaaagcacaauauauauauauauauaauuca

SEQ ID NO: 153955 - RNA, 64 nt, Homo Sapiens
aauugaaagcacaauaauuguauauauauaauucaaagcacaauuacacacacacacauauaua

SEQ ID NO: 153956 - RNA, 64 nt, Homo Sapiens
uauuaaugcagucaucccuuauauauggauguggaaagcacauaugguagacuuuuauuaaaac

SEQ ID NO: 153957 - RNA, 64 nt, Homo Sapiens
gccuuuuuuuuuuaauuauucaaagcaucguuuuaaagcacauggaagaugaugcugcuuuuua

SEQ ID NO: 153958 - RNA, 64 nt, Homo Sapiens
uaaaauuaggcuacauucuugcuuuugcccaucuaaagcacaaugucuuuccuacaacauuuua

SEQ ID NO: 153959 - RNA, 64 nt, Homo Sapiens
aaauagugagguaguaguuacaaaggaaauuucuaaagcacaagaagauacuuuaagagaaaua

SEQ ID NO: 153960 - RNA, 64 nt, Homo Sapiens
uauuaaaacaaacagauccaugauaagccuaaaaaaagcacaauaguaaauggccucuaguaga

SEQ ID NO: 153961 - RNA, 64 nt, Homo Sapiens
uucagcaauggcuacaugacaccuuuaauagugcaaagcacaguuuaaaagcaggacauucccu

SEQ ID NO: 153962 - RNA, 64 nt, Homo Sapiens
caugcacacacacagaacccugcaacagaagacaaaagcacaggguuuauguuauuaaucugaa

SEQ ID NO: 153963 - RNA, 64 nt, Homo Sapiens
ggacaaaguuaauucaaaaaaccuuaauuccaggaaagcacagaacugaagaacugcagccaag

SEQ ID NO: 153964 - RNA, 64 nt, Homo Sapiens
uucauaauaacgagaagaauauauauuuauuuauaaagcacauauuacaauggaguaaccgaca

SEQ ID NO: 153965 - RNA, 64 nt, Homo Sapiens
auggauguggaugugauaggcuaggggcaugagaaaagcacauauugaccaagcaccaugaucc

SEQ ID NO: 153966 - RNA, 64 nt, Homo Sapiens
aaaaacaaauccugguuuuuaaucuacugcugcuaaagcacauuacaagaagacacaguuuuag

SEQ ID NO: 153967 - RNA, 64 nt, Homo Sapiens
aaaaucccccauaaaauaaagauuuugggguacuaaagcacaaaugauguaugcgaacauaugu

SEQ ID NO: 153968 - RNA, 64 nt, Homo Sapiens
guuguuguuuucauuucuguuauaaguaaaacuaaaagcacagaauggugggaaaggggcuaua

SEQ ID NO: 153969 - RNA, 64 nt, Homo Sapiens
gauauacaaaucucccuguaggaaaugugaaagaaaagcacaacaaaacuaggguuuuuuguuc

SEQ ID NO: 153970 - RNA, 64 nt, Homo Sapiens
auguguagauauaacuuaaauauggagcuuucaaaaagcacaaauaggcuggacaugguggcuc

SEQ ID NO: 153971 - RNA, 64 nt, Homo Sapiens
aaagggcaaaauucuagagagugguaaaucucagaaagcacaagcauaaaaugcagcucugggg

SEQ ID NO: 153972 - RNA, 64 nt, Homo Sapiens
gcuggaggcugggcgccugcauugggagccugugaaagcacaaaacccacuucugcugaaaugc

SEQ ID NO: 153973 - RNA, 64 nt, Homo Sapiens
cucaccaucaaugagccuggucuuuguuaggaucaaagcacaagccuccacuuuugugcauuua

SEQ ID NO: 153974 - RNA, 64 nt, Homo Sapiens
gugcagccaggagggcucuugggauuuccuuuccaaagcacaaaaauacugggacccaagaaga

SEQ ID NO: 153975 - RNA, 64 nt, Homo Sapiens
aagagggcuaagauacguuuucugucuugagcugaaagcacagucuacucuccuucguuuuguc

SEQ ID NO: 153976 - RNA, 64 nt, Homo Sapiens
ugacucuaagaaguauguagaaucauugagaaauaaagcacauugggaguaagcuugggacuug

SEQ ID NO: 153977 - RNA, 64 nt, Homo Sapiens
aaaccaguuauaggacacaguguuaucuucuaucaaagcacauaccaauauguugaaagcguuu

SEQ ID NO: 153978 - RNA, 64 nt, Homo Sapiens
guggcaaacaaaacccgagcacccaggagucuccaaagcacagagcagggacagaccagaccag

SEQ ID NO: 153979 - RNA, 64 nt, Homo Sapiens
ggcagggacagaccagaccaaagagaaaauacugaaagcacaggggaggugcccuauaaaccag

SEQ ID NO: 153980 - RNA, 64 nt, Homo Sapiens
cauccugugacagaaguugccuaugcuccuccucaaagcacaaugccucuaccuuacgagagag

SEQ ID NO: 153981 - RNA, 64 nt, Homo Sapiens
cuaacaaacauguuuacuauagccacucuuggaaaaagcacaacgagcugcauauugcauuguu

SEQ ID NO: 153982 - RNA, 64 nt, Homo Sapiens
aaaauguaguggaaaaugaccaaauauuaauauaaaagcacaacguauuaaauuauagcauuug

SEQ ID NO: 153983 - RNA, 64 nt, Homo Sapiens
gucauggcugguuuuguuucuagaaauccuugucaaagcacaaaaaagaaaaaaaaaagagcua

SEQ ID NO: 153984 - RNA, 64 nt, Homo Sapiens
cugacugucaagcauccccuguccccaaguuccaaaagcacagacucaaagggaaaccccccag

SEQ ID NO: 153985 - RNA, 64 nt, Homo Sapiens
ccccaucugacaagaaagccuggagcgaggaaggaaagcacagcgaacccaauggguaacgugg

SEQ ID NO: 153986 - RNA, 64 nt, Homo Sapiens
gggcuauauauacuggaaguugaagguuaaaggaaaagcacaagaaacuuuggaagcacuuuuu

SEQ ID NO: 153987 - RNA, 64 nt, Homo Sapiens
caggucuuugccauaacuuuaugaagugcuacagaaagcacaaagaauugauucauguucauca

SEQ ID NO: 153988 - RNA, 64 nt, Homo Sapiens
gauguggguaagaugaaaaagcccagacuucuguaaagcacacagcugguuucuuuucuguggg

SEQ ID NO: 153989 - RNA, 64 nt, Homo Sapiens
cuguaccccaggggcgccggucucucuucccugcaaagcacaaccucccucucuuccccacccu

SEQ ID NO: 153990 - RNA, 64 nt, Homo Sapiens
ccggccugagugggggauauugacacccccagcuaaagcacaagcaccuuagucaccccuccuc

SEQ ID NO: 153991 - RNA, 64 nt, Homo Sapiens
uccuggccugccaccccaccccagcguuuaccccaaagcacaaugcccuggucacuuggcaagc

SEQ ID NO: 153992 - RNA, 64 nt, Homo Sapiens
aagcugaggacagggugugagcgccacaucucugaaagcacaggagacacugugcuauaaaucc

SEQ ID NO: 153993 - RNA, 64 nt, Homo Sapiens
ggccugaaggaggugagagaagaccucugugaggaaagcacacagucaccuucucggcaacuaa

SEQ ID NO: 153994 - RNA, 64 nt, Homo Sapiens
ccaguuucuugggaaaauucaaggugaugcugccaaagcacaaggagugaccagagcaaguaug

SEQ ID NO: 153995 - RNA, 64 nt, Homo Sapiens
gucaaacaagguuaugccaagaucacuuacuuucaaagcacacauuuuuagaguuucuuuuuuu

SEQ ID NO: 153996 - RNA, 64 nt, Homo Sapiens
aauguaaucuacuuugaacuuguguaaugaaugaaaagcacauaaacggaucaugucuguacau

SEQ ID NO: 153997 - RNA, 64 nt, Homo Sapiens
guauugagucucuugaaaauaggauuuuuaccugaaagcacaauaguaacugaucuuuugucua

SEQ ID NO: 153998 - RNA, 64 nt, Homo Sapiens; identical to SEQ ID NO: 125533

SEQ ID NO: 153999 - RNA, 64 nt, Homo Sapiens; identical to SEQ ID NO: 125534

SEQ ID NO: 154000 - RNA, 64 nt, Homo Sapiens; identical to SEQ ID NO: 125535

SEQ ID NO: 154001 - RNA, 64 nt, Homo Sapiens; identical to SEQ ID NO: 125536

SEQ ID NO: 154002 - RNA, 64 nt, Homo Sapiens; identical to SEQ ID NO: 125537

SEQ ID NO: 154003 - RNA, 64 nt, Homo Sapiens; identical to SEQ ID NO: 125538

SEQ ID NO: 154004 - RNA, 64 nt, Homo Sapiens; identical to SEQ ID NO: 125539

SEQ ID NO: 154005 - RNA, 64 nt, Homo Sapiens; identical to SEQ ID NO: 125540

SEQ ID NO: 154006 - RNA, 64 nt, Homo Sapiens; identical to SEQ ID NO: 125541

SEQ ID NO: 154007 - RNA, 64 nt, Homo Sapiens; identical to SEQ ID NO: 125542

SEQ ID NO: 154008 - RNA, 64 nt, Homo Sapiens; identical to SEQ ID NO: 125543

SEQ ID NO: 154009 - RNA, 64 nt, Homo Sapiens; identical to SEQ ID NO: 125544

SEQ ID NO: 154010 - RNA, 64 nt, Homo Sapiens; identical to SEQ ID NO: 125545

SEQ ID NO: 154011 - RNA, 64 nt, Homo Sapiens; identical to SEQ ID NO: 125546

SEQ ID NO: 154012 - RNA, 64 nt, Homo Sapiens; identical to SEQ ID NO: 125547

SEQ ID NO: 154013 - RNA, 64 nt, Homo Sapiens; identical to SEQ ID NO: 125548

SEQ ID NO: 154014 - RNA, 64 nt, Homo Sapiens; identical to SEQ ID NO: 125549

SEQ ID NO: 154015 - RNA, 64 nt, Homo Sapiens; identical to SEQ ID NO: 125550

SEQ ID NO: 154016 - RNA, 64 nt, Homo Sapiens; identical to SEQ ID NO: 125551

SEQ ID NO: 154017 - RNA, 64 nt, Homo Sapiens; identical to SEQ ID NO: 125552

SEQ ID NO: 154018 - RNA, 64 nt, Homo Sapiens; identical to SEQ ID NO: 125553

SEQ ID NO: 154019 - RNA, 64 nt, Homo Sapiens; identical to SEQ ID NO: 125554

SEQ ID NO: 154020 - RNA, 64 nt, Homo Sapiens; identical to SEQ ID NO: 125555

SEQ ID NO: 154021 - RNA, 64 nt, Homo Sapiens; identical to SEQ ID NO: 125556

SEQ ID NO: 154022 - RNA, 64 nt, Homo Sapiens; identical to SEQ ID NO: 125557

SEQ ID NO: 154023 - RNA, 64 nt, Homo Sapiens; identical to SEQ ID NO: 125558

SEQ ID NO: 154024 - RNA, 64 nt, Homo Sapiens; identical to SEQ ID NO: 125559

SEQ ID NO: 154025 - RNA, 64 nt, Homo Sapiens; identical to SEQ ID NO: 125560

SEQ ID NO: 154026 - RNA, 64 nt, Homo Sapiens; identical to SEQ ID NO: 125561

SEQ ID NO: 154027 - RNA, 64 nt, Homo Sapiens; identical to SEQ ID NO: 125562

SEQ ID NO: 154028 - RNA, 64 nt, Homo Sapiens; identical to SEQ ID NO: 125563

SEQ ID NO: 154029 - RNA, 64 nt, Homo Sapiens; identical to SEQ ID NO: 125564

SEQ ID NO: 154030 - RNA, 64 nt, Homo Sapiens; identical to SEQ ID NO: 125565

SEQ ID NO: 154031 - RNA, 64 nt, Homo Sapiens; identical to SEQ ID NO: 125566

SEQ ID NO: 154032 - RNA, 64 nt, Homo Sapiens; identical to SEQ ID NO: 125567

SEQ ID NO: 154033 - RNA, 64 nt, Homo Sapiens; identical to SEQ ID NO: 125568

SEQ ID NO: 154034 - RNA, 64 nt, Homo Sapiens; identical to SEQ ID NO: 81753

SEQ ID NO: 154035 - RNA, 64 nt, Homo Sapiens; identical to SEQ ID NO: 81754

SEQ ID NO: 154036 - RNA, 64 nt, Homo Sapiens; identical to SEQ ID NO: 81755

SEQ ID NO: 154037 - RNA, 64 nt, Homo Sapiens; identical to SEQ ID NO: 81756

SEQ ID NO: 154038 - RNA, 64 nt, Homo Sapiens; identical to SEQ ID NO: 81757

SEQ ID NO: 154039 - RNA, 64 nt, Homo Sapiens; identical to SEQ ID NO: 81758

SEQ ID NO: 154040 - RNA, 64 nt, Homo Sapiens; identical to SEQ ID NO: 81759

SEQ ID NO: 154041 - RNA, 64 nt, Homo Sapiens; identical to SEQ ID NO: 81760

SEQ ID NO: 154042 - RNA, 61 nt, Homo Sapiens; identical to SEQ ID NO: 81761

SEQ ID NO: 154043 - RNA, 64 nt, Homo Sapiens; identical to SEQ ID NO: 81762

SEQ ID NO: 154044 - RNA, 64 nt, Homo Sapiens; identical to SEQ ID NO: 81763

SEQ ID NO: 154045 - RNA, 64 nt, Homo Sapiens; identical to SEQ ID NO: 81764

SEQ ID NO: 154046 - RNA, 64 nt, Homo Sapiens; identical to SEQ ID NO: 81765

SEQ ID NO: 154047 - RNA, 64 nt, Homo Sapiens; identical to SEQ ID NO: 81766

SEQ ID NO: 154048 - RNA, 64 nt, Homo Sapiens; identical to SEQ ID NO: 81767

SEQ ID NO: 154049 - RNA, 64 nt, Homo Sapiens; identical to SEQ ID NO: 81768

SEQ ID NO: 154050 - RNA, 64 nt, Homo Sapiens; identical to SEQ ID NO: 81769

SEQ ID NO: 154051 - RNA, 56 nt, Homo Sapiens; identical to SEQ ID NO: 81770

SEQ ID NO: 154052 - RNA, 64 nt, Homo Sapiens; identical to SEQ ID NO: 81771

SEQ ID NO: 154053 - RNA, 64 nt, Homo Sapiens; identical to SEQ ID NO: 81772

SEQ ID NO: 154054 - RNA, 64 nt, Homo Sapiens; identical to SEQ ID NO: 81773

SEQ ID NO: 154055 - RNA, 64 nt, Homo Sapiens; identical to SEQ ID NO: 81774

SEQ ID NO: 154056 - RNA, 64 nt, Homo Sapiens; identical to SEQ ID NO: 81775

SEQ ID NO: 154057 - RNA, 64 nt, Homo Sapiens; identical to SEQ ID NO: 81776

SEQ ID NO: 154058 - RNA, 64 nt, Homo Sapiens; identical to SEQ ID NO: 81777

SEQ ID NO: 154059 - RNA, 64 nt, Homo Sapiens; identical to SEQ ID NO: 81778

SEQ ID NO: 154060 - RNA, 64 nt, Homo Sapiens; identical to SEQ ID NO: 81779

SEQ ID NO: 154061 - RNA, 64 nt, Homo Sapiens; identical to SEQ ID NO: 81780

SEQ ID NO: 154062 - RNA, 64 nt, Homo Sapiens; identical to SEQ ID NO: 81781

SEQ ID NO: 154063 - RNA, 64 nt, Homo Sapiens; identical to SEQ ID NO: 81782

SEQ ID NO: 154064 - RNA, 64 nt, Homo Sapiens; identical to SEQ ID NO: 81783

SEQ ID NO: 154065 - RNA, 64 nt, Homo Sapiens; identical to SEQ ID NO: 81784

SEQ ID NO: 154066 - RNA, 64 nt, Homo Sapiens; identical to SEQ ID NO: 81785

SEQ ID NO: 154067 - RNA, 64 nt, Homo Sapiens; identical to SEQ ID NO: 81786

SEQ ID NO: 154068 - RNA, 64 nt, Homo Sapiens; identical to SEQ ID NO: 81787

SEQ ID NO: 154069 - RNA, 64 nt, Homo Sapiens; identical to SEQ ID NO: 81788

SEQ ID NO: 154070 - RNA, 64 nt, Homo Sapiens; identical to SEQ ID NO: 81789

SEQ ID NO: 154071 - RNA, 64 nt, Homo Sapiens; identical to SEQ ID NO: 81790

SEQ ID NO: 154072 - RNA, 64 nt, Homo Sapiens; identical to SEQ ID NO: 81791

SEQ ID NO: 154073 - RNA, 64 nt, Homo Sapiens; identical to SEQ ID NO: 81792

SEQ ID NO: 154074 - RNA, 64 nt, Homo Sapiens; identical to SEQ ID NO: 81793

SEQ ID NO: 154075 - RNA, 64 nt, Homo Sapiens; identical to SEQ ID NO: 81794

SEQ ID NO: 154076 - RNA, 64 nt, Homo Sapiens; identical to SEQ ID NO: 81795

SEQ ID NO: 154077 - RNA, 64 nt, Homo Sapiens; identical to SEQ ID NO: 81796

SEQ ID NO: 154078 - RNA, 64 nt, Homo Sapiens; identical to SEQ ID NO: 81797

SEQ ID NO: 154079 - RNA, 64 nt, Homo Sapiens; identical to SEQ ID NO: 81798

SEQ ID NO: 154080 - RNA, 64 nt, Homo Sapiens; identical to SEQ ID NO: 81799

SEQ ID NO: 154081 - RNA, 64 nt, Homo Sapiens; identical to SEQ ID NO: 81800

SEQ ID NO: 154082 - RNA, 64 nt, Homo Sapiens; identical to SEQ ID NO: 81801

SEQ ID NO: 154083 - RNA, 64 nt, Homo Sapiens; identical to SEQ ID NO: 81802

SEQ ID NO: 154084 - RNA, 64 nt, Homo Sapiens
acccugcgaaggggcccugguccuuccaggcccccaccacuaggacucugaggcucuuucuggg

SEQ ID NO: 154085 - RNA, 64 nt, Homo Sapiens
cugcugcaccacaagcacccagaacggaagcaggcaccacuaacuuaugaaaaggaggaggaac

SEQ ID NO: 154086 - RNA, 64 nt, Homo Sapiens
cccacuccagcuccuucgcuuaagccagcacucacaccacuaacaugcccuguucagcuacucc

SEQ ID NO: 154087 - RNA, 64 nt, Homo Sapiens
uguuaccuuaggagcugaacauucaauucaguuacaccacuaugacuaaaaacaguuuggaucu

SEQ ID NO: 154088 - RNA, 64 nt, Homo Sapiens
gaguggugccaggugcaaguuaggcuaaagaagccaccacuauuccucucucuugcccauugug

SEQ ID NO: 154089 - RNA, 64 nt, Homo Sapiens
uggggacauuaauaguccaaggcauucccucccccaccacuauucauaaaguauuaaccaacug

SEQ ID NO: 154090 - RNA, 64 nt, Homo Sapiens
uccaguuggcagaugacuugaucuccgacauuuucaccacuauuggcucagugacugucgccuu

SEQ ID NO: 154091 - RNA, 64 nt, Homo Sapiens
gcuguuugccaccucaaaacuuuaugaacuucaccaccacuagugucuguccauggaguuagag

SEQ ID NO: 154092 - RNA, 64 nt, Homo Sapiens
aaagcugcugcuuggcuggaugggaagaacccagcaccacuaauuccgagcacgcuguagggua

SEQ ID NO: 154093 - RNA, 64 nt, Homo Sapiens
cccagcuaauuuuuuuauuuggauuacaggcacccaccacuauggucagucuccugaguagcug

SEQ ID NO: 154094 - RNA, 64 nt, Homo Sapiens
uuacccagguugauauugaccaaccccuacggaacaccacuacuaacaacccugagcccagggc

SEQ ID NO: 154095 - RNA, 64 nt, Homo Sapiens
gcaaggaauucuuaacuaggguuuaguccuuguucaccacuaagguguuucacccauugucugu

SEQ ID NO: 154096 - RNA, 64 nt, Homo Sapiens
caacaauagauuuuauauguaaauuagagaauuccaccacuaagccaaaauaugcguaugagua

SEQ ID NO: 154097 - RNA, 64 nt, Homo Sapiens
gaaacaucugagcaaacaaaucagcagugggggacaccacuaaaaaaaacaaauaauaaaauau

SEQ ID NO: 154098 - RNA, 64 nt, Homo Sapiens
uuacuggaugaaaugaaauuugaggcccagcaagcaccacuaaaagcuuaaugaugcuucuguu

SEQ ID NO: 154099 - RNA, 64 nt, Homo Sapiens
ucacuucuguaguaugguuuccaccuaucucuaacaccacuauuaagguacaccaguguuaagg

SEQ ID NO: 154100 - RNA, 64 nt, Homo Sapiens
gggucaguagcucuccacaugaagaccugucacucaccacuaugcaggagagggagguggucau

SEQ ID NO: 154101 - RNA, 64 nt, Homo Sapiens
aguaucccacaccagaguggcaugcauagccucccaccacuaucauauauccccugcccucaca

SEQ ID NO: 154102 - RNA, 64 nt, Homo Sapiens
cuccagccugggcaacagaggugagucgagauugcaccacuacacccaggcggcagagguugca

SEQ ID NO: 154103 - RNA, 64 nt, Homo Sapiens
gacuuucaguccuaauuugaggggaaauuacugucaccacuaguuuuaauauaguacaaugaaa

SEQ ID NO: 154104 - RNA, 64 nt, Homo Sapiens
cagagugugcagacugaugggacaucaaauuugccaccacuagagcugagagucugaaagacag

SEQ ID NO: 154105 - RNA, 64 nt, Homo Sapiens
aacacuuaguucauuggcuuuaguauuugcucuucaccacuacaagcccacuccccuuuacuuc

SEQ ID NO: 154106 - RNA, 64 nt, Homo Sapiens
agaauuguucccaacccaguccauggcuucuagccaccacuacagggcuguuucauguacuucu

SEQ ID NO: 154107 - RNA, 64 nt, Homo Sapiens
ucagugcugccuauuaguaguuaauucugucacucaccacuacaucacuugagacaaaucuaug

SEQ ID NO: 154108 - RNA, 51 nt, Homo Sapiens
ucuaccaugacaccaacugaucaccacuaacucagagccuccuccaggcca

SEQ ID NO: 154109 - RNA, 64 nt, Homo Sapiens
uaauugggagauaaugaaacguuagugguggugucaccacuacuaucagaguuuggauacuagu

SEQ ID NO: 154110 - RNA, 64 nt, Homo Sapiens
ggcauguucauucuucacuuucuucaaaauggaucaccacuaagccgagaagagcaaaucagag

SEQ ID NO: 154111 - RNA, 64 nt, Homo Sapiens
acagaugacccguuuacacguaauuaguuuugcucaccacuaguggccauugauaguucucaug

SEQ ID NO: 154112 - RNA, 64 nt, Homo Sapiens
caacaggaaggaauaaauucacacuguaucuugacaccacuaagaggcacuucugguaacauug

SEQ ID NO: 154113 - RNA, 64 nt, Homo Sapiens
agaucgcaguuugccuggugaaagagagaagaggcaccacuaaagggacaacauccuuaaguca

SEQ ID NO: 154114 - RNA, 64 nt, Homo Sapiens
uggacaguugcacauguuuucaagcugaaaaugucaccacuaccucacgaucaucuuacgauau

SEQ ID NO: 154115 - RNA, 64 nt, Homo Sapiens
caacugcagcaggugccaccaccaccacaaaagacaccacuacccuuguaacuacugcuucuac

SEQ ID NO: 154116 - RNA, 64 nt, Homo Sapiens
uuuaagagcagauuuuagauuaauaauguuuuaucaccacuaauuugcccacaacaaacucagu

SEQ ID NO: 154117 - RNA, 64 nt, Homo Sapiens
uuuuguuuugauuuuuaaccauaguuuuggggaucaccacuauaaucgucaaaauaaugucaaa

SEQ ID NO: 154118 - RNA, 64 nt, Homo Sapiens
gcaggaaaugcuggcauagagcagcacuaaaugacaccacuaaagaaacgaucagacagaucug

SEQ ID NO: 154119 - RNA, 64 nt, Homo Sapiens; identical to SEQ ID NO: 154118

SEQ ID NO: 154120 - RNA, 64 nt, Homo Sapiens
uuaaucuacagaauguuuuauaguaaaauucuagcaccacuagaauaaucacauagcauguaca

SEQ ID NO: 154121 - RNA, 64 nt, Homo Sapiens
gagauugacuuccuaagcuacuuaagacaacuugcaccacuaagaaaaaaauguagaaccauuu

SEQ ID NO: 154122 - RNA, 64 nt, Homo Sapiens
aucagucaauaaaaauuacaguaauuauuagacccaccacuaggucaucuuauuugaugcauca

SEQ ID NO: 154123 - RNA, 64 nt, Homo Sapiens
gggaugcagaugggugcuaucagagccucucccacaccacuauaguguaauaauguuauuauua

SEQ ID NO: 154124 - RNA, 64 nt, Homo Sapiens
cacuccauuuuuuuucuauuuuuauccucuucaccaccacuacccuuuuguuuuuugauggggu

SEQ ID NO: 154125 - RNA, 64 nt, Homo Sapiens
cccaggaguucgaggcugcagugagcuaugaucucaccacuacacuccagccugggugacagca

SEQ ID NO: 154126 - RNA, 64 nt, Homo Sapiens
accugaaaacaaacaaacaaacccuaaaacucagcaccacuaccauuuccagaagcuuuuuuaa

SEQ ID NO: 154127 - RNA, 64 nt, Homo Sapiens
uagaguccugccaauacagcuguugcauuuuccccaccacuagccccacuuaaacuacuacuac

SEQ ID NO: 154128 - RNA, 64 nt, Homo Sapiens
ggaggaugcauuauccuguauucuccuccaacaucaccacuagcguaaaagcaaaaagcuuuua

SEQ ID NO: 154129 - RNA, 64 nt, Homo Sapiens
guuuuuuaaguuccauauuuuguugugaaauacccaccacuaaaaagccuuugccagguguaac

SEQ ID NO: 154130 - RNA, 64 nt, Homo Sapiens
ccagcgaauuuaugcuacaaaagucuuaaugccacaccacuauugaagauuuuuugaccguucc

SEQ ID NO: 154131 - RNA, 64 nt, Homo Sapiens
guuuucuacuguaaucugaaccuguuccucuccccaccacuacuaaaugaaucaaagacccauu

SEQ ID NO: 154132 - RNA, 64 nt, Homo Sapiens
ccugggaggcgaagauugcagugagcugaaaucacaccacuacacuccagccaaagcaacaaga

SEQ ID NO: 154133 - RNA, 64 nt, Homo Sapiens
uaacuuugagguucuauauagucagagacuaugacaccacuaagguucagaauaaaguuuaggc

SEQ ID NO: 154134 - RNA, 64 nt, Homo Sapiens
cuacaacauucacuaccucuacuacugguuaaagcaccacuacaauguccauuuuaauggccug

SEQ ID NO: 154135 - RNA, 57 nt, Homo Sapiens
aacgccaguugcuuaaauaauaugcagcaccacuagcuugugcugguuuuuagauuu

SEQ ID NO: 154136 - RNA, 64 nt, Homo Sapiens
aagagagauuucugugucuuucucaucuauaauccaccacuaccaagucugugguucuucucau

SEQ ID NO: 154137 - RNA, 64 nt, Homo Sapiens
cuccagccuaggcaacagagaugagccgagaucacaccacuacacccuggaggcagagguugca

SEQ ID NO: 154138 - RNA, 64 nt, Homo Sapiens
aaaaaaaaaaaaaauccccagggagccugacagacaccacuauuuaauuaacaugucuaggagu

SEQ ID NO: 154139 - RNA, 64 nt, Homo Sapiens
accaggaguggccaaguaaaucagacgcugcaggcaccacuauccagcagcaccucacagucag

SEQ ID NO: 154140 - RNA, 64 nt, Homo Sapiens
uggauauuucacaggcaucuaacagcccauuagacaccacuagccaguuuguccaacucuuucc

SEQ ID NO: 154141 - RNA, 64 nt, Homo Sapiens
gcccuggcauaucaccccgcacuguggggccaggcaccacuagccuggcucaaauauuccccag

SEQ ID NO: 154142 - RNA, 64 nt, Homo Sapiens
cucagccucccgaguagcugggauuacaagcacccaccacuacacucagcuaauuuuuuguauu

SEQ ID NO: 154143 - RNA, 64 nt, Homo Sapiens
aaaaaaaaagaauuaauaagcgccacaccaacaccaccacuacaaccgccaccaccaccaacac

SEQ ID NO: 154144 - RNA, 64 nt, Homo Sapiens
gcacuguccgugucauaugaucggcuagcaucagcaccacuauauuagaguaguguugaaauac

SEQ ID NO: 154145 - RNA, 64 nt, Homo Sapiens
cugcgagagaagcuaaacgucagccuggacuuaccaccacuaaaauaggagcgcaaagaagcua

SEQ ID NO: 154146 - RNA, 64 nt, Homo Sapiens
caccccacgugggacuuccagaccucuguccuuacaccacuagcacaucccucugcccauccga

SEQ ID NO: 154147 - RNA, 64 nt, Homo Sapiens
uguguacauauguauuauaugucugaaaagaaaacaccacuaauaauauuuguuucaguauuuu

SEQ ID NO: 154148 - RNA, 64 nt, Homo Sapiens
aauuaucauucauugauaauacuacuacuguuagcaccacuacuaaaauaaaugcuuaaccaac

SEQ ID NO: 154149 - RNA, 64 nt, Homo Sapiens
ggcuucuuugauuuucuuuccuuuagaaaaaauucaccacuauauuauucaacucccuaggauc

SEQ ID NO: 154150 - RNA, 64 nt, Homo Sapiens
uuuuuaaaaauggaagguaauuagaaguuuuuugcaccacuaaugauuuuauguaucacuaaca

SEQ ID NO: 154151 - RNA, 64 nt, Homo Sapiens
cucagccucccaaguagcugggacuacaggugugcaccacuacuccuggauauuuuuuuguguu

SEQ ID NO: 154152 - RNA, 64 nt, Homo Sapiens
caggcgccacgcuggcgguucgugagugucgaggcaccacuaaauauagcugucugccguccac

SEQ ID NO: 154153 - RNA, 64 nt, Homo Sapiens
ccugucaggcucggagaggucaggagaccgaccccaccacuaacuuuggagaaaauguggguuu

SEQ ID NO: 154154 - RNA, 64 nt, Homo Sapiens
auaucuuguaucuaggugucuacaucaauagccucaccacuaauaaucacaucacuguaucuuu

SEQ ID NO: 154155 - RNA, 64 nt, Homo Sapiens
ccuggcuaauuuuguauuuuggacuacaggugugcaccacuaugcucagucuuccggguagcug

SEQ ID NO: 154156 - RNA, 64 nt, Homo Sapiens
uacuuccugaucaaacaucaaaaauuuauaugaacaccacuagaaaacaagacagacuccacuc

SEQ ID NO: 154157 - RNA, 64 nt, Homo Sapiens
gcagucgguacagaacaguucagaaagauuugugcaccacuacuuauaguucugugaauuuuaa

SEQ ID NO: 154158 - RNA, 64 nt, Homo Sapiens
uggggaacaagcuugcguccuugcaguuugaggucaccacuauuuggcugcagguuucaucaua

SEQ ID NO: 154159 - RNA, 64 nt, Homo Sapiens
uuaaaccacuucccauuacugaccauuaaaagcucaccacuagaguuccugaaacaggugaaac

SEQ ID NO: 154160 - RNA, 64 nt, Homo Sapiens
ucucaucucaaauccuauggccuucuggaagauccaccacuauccaaaggaaaaaguagauuaa

SEQ ID NO: 154161 - RNA, 64 nt, Homo Sapiens
ucuauuuuucagauguugacuugaguaaauauaucaccacuauugcuggagucaugacacuaag

SEQ ID NO: 154162 - RNA, 64 nt, Homo Sapiens
acccaggaagcgggguugcagugagccaaagguacaccacuacacuccagccugggcaacagag

SEQ ID NO: 154163 - RNA, 64 nt, Homo Sapiens
guuaaacagccuauuccugaacuauaacaccugccaccacuauaaaaugucuucaaggcuucag

SEQ ID NO: 154164 - RNA, 64 nt, Homo Sapiens
cuccagccugggcgagacgggugagcuaagaucacaccacuacacccaggaggcagagguugca

SEQ ID NO: 154165 - RNA, 63 nt, Homo Sapiens
gucccagauagcaucauauuagacaugaauucucaccacuaaaaagaaaaauaucgagucuaa

SEQ ID NO: 154166 - RNA, 64 nt, Homo Sapiens
auuauaggugcaaggcaccccauccacacauuugcaccacuacuccaagauaguauuuuucuuu

SEQ ID NO: 154167 - RNA, 50 nt, Homo Sapiens
cuccacagcagaagauuuagcaccacuaucuccguuccaucugggcuuau

SEQ ID NO: 154168 - RNA, 64 nt, Homo Sapiens
cacgcagcugaggcgcaugugguggccuucuucccaccacuaccccaguacaccgugagguaga

SEQ ID NO: 154169 - RNA, 64 nt, Homo Sapiens
cauguggcauuuggauggccagagugcccugaagcaccacuaccaaccuugccucccccuccuc

SEQ ID NO: 154170 - RNA, 64 nt, Homo Sapiens
ccagacggcggcucacccuagguguguggcccgccaccacuaaugcgaaguccacgcucauccu

SEQ ID NO: 154171 - RNA, 64 nt, Homo Sapiens
uauagggcguuuggcccugugacuauggcucuggcaccacuaggguccuggcccucuucuuauu

SEQ ID NO: 154172 - RNA, 64 nt, Homo Sapiens
auauuuauugcuacauaacuauauauaauuuucccaccacuaauaccacacuuuauauucaguu

SEQ ID NO: 154173 - RNA, 64 nt, Homo Sapiens
guauuggagaguacaauaauguaaauccuaaaagcaccacuauuuuagcauaauaaaagaaagu

SEQ ID NO: 154174 - RNA, 64 nt, Homo Sapiens
gaggccagagagcagccacugcuacugcuaaugccaccacuaccccugccaucacugccccaca

SEQ ID NO: 154175 - RNA, 64 nt, Homo Sapiens
cucucgacuuuaggaggaauauccuucccaacaucaccacuacuuaccucaagucgugcauuua

SEQ ID NO: 154176 - RNA, 64 nt, Homo Sapiens
gugacgaccaccgccccaccaccuccugggaccacaccacuaccgcccccaaccacagcagaga

SEQ ID NO: 154177 - RNA, 64 nt, Homo Sapiens
uaauuccagacucacgcuuuacuuguucaaccaucaccacuaucugguuuuaguaaauucacaa

SEQ ID NO: 154178 - RNA, 64 nt, Homo Sapiens
uuuguuuuaugaauugauuugauuucccaaaccacaccacuaaauaaaaauacgucauuuuaaa

SEQ ID NO: 154179 - RNA, 64 nt, Homo Sapiens
agcguccucuucagcgucuuuuccuagagcuggucaccacuaggcugucacuauaaauuccuug

SEQ ID NO: 154180 - RNA, 64 nt, Homo Sapiens
ucucugugcagaaguguuggcugggugcucuccccaccacuacccuuguaaacuuccaggaaga

SEQ ID NO: 154181 - RNA, 64 nt, Homo Sapiens
uuacauacacaguuuucucuccacacauaaauaacaccacuaaaguuguuuuguaagguuccaa

SEQ ID NO: 154182 - RNA, 64 nt, Homo Sapiens
aauauugcccaaugacuaguccucauccauguagcaccacuaauucuuccaugccuggaagaaa

SEQ ID NO: 154183 - RNA, 64 nt, Homo Sapiens
agaacagauaaaugcgaaggaaaccauguauauucaccacuaggacagguuaaaaagaccauug

SEQ ID NO: 154184 - RNA, 64 nt, Homo Sapiens
cagcuaagggcagaggcugugccuagggcuauaccaccacuagcaucuguauuugagacuguuu

SEQ ID NO: 154185 - RNA, 64 nt, Homo Sapiens
ucuggaagagucugugcgcccauggauggcugagcaccacuacgacuuaguccgggauaagggc

SEQ ID NO: 154186 - RNA, 64 nt, Homo Sapiens
cagaggaggucuaacgaccagaguauugcccugccaccacuaucucuagucucccuagcuuggu

SEQ ID NO: 154187 - RNA, 64 nt, Homo Sapiens
uugcugugaauauuucuccuacccgauuccccaacaccacuagugccucuggauuuagagauau

SEQ ID NO: 154188 - RNA, 64 nt, Homo Sapiens
acccuagagaagacuuucauuuuugccuuuaccucaccacuauucuaacgucugucagcuaucc

SEQ ID NO: 154189 - RNA, 64 nt, Homo Sapiens
acaagcaggccgcucucccagacuuaaaauguaucaccacuaaccugugagggggacccaaucu

SEQ ID NO: 154190 - RNA, 64 nt, Homo Sapiens
uucuguuaaucauuaggugucuguuuagauaauacaccacuacaauggcacaucagcacgauuu

SEQ ID NO: 154191 - RNA, 64 nt, Homo Sapiens
uaaaagaauuaaaaaucuaaggcagaaaaugaaacaccacuaggcauuguuuuuauuuuacaaa

SEQ ID NO: 154192 - RNA, 64 nt, Homo Sapiens
ccugucucucugugugggggcugucacuaaacugcaccacuauaaggaucuaagacuggauucc

SEQ ID NO: 154193 - RNA, 64 nt, Homo Sapiens
ccgcucaccuagaguuguuacugugggcuucuaccaccacuaagcaguguuuccagcguuucag

SEQ ID NO: 154194 - RNA, 64 nt, Homo Sapiens
cuacacccgugucaccuacuacuuggacuggauccaccacuauguccccaagaagcccugagcc

SEQ ID NO: 154195 - RNA, 64 nt, Homo Sapiens
ucacaguuuuuuacugugaugaaaucuuguuaaccaccacuagggaaucuccagaugaacuauu

SEQ ID NO: 154196 - RNA, 64 nt, Homo Sapiens
gcgggggugcccccaauggugcagcugcagcagucaccacuagggggugauggagaggaagggg

SEQ ID NO: 154197 - RNA, 64 nt, Homo Sapiens
cuucccugugccuccucccucccucuccgacucacaccacuagccucaggggucugagcuccag

SEQ ID NO: 154198 - RNA, 64 nt, Homo Sapiens
cucagccucccaaguagcugggaccacaggcaugcaccacuacgcaugacuaauuuuuuaaaua

SEQ ID NO: 154199 - RNA, 64 nt, Homo Sapiens
aaagcucuucagaaucuugugggccauccagccccaccacuagaaaguuuggauuacucaggca

SEQ ID NO: 154200 - RNA, 64 nt, Homo Sapiens
gcugaaugaccugugucuuggagaaccuggaggccaccacuaaaggccuucugcacggcccaag

SEQ ID NO: 154201 - RNA, 64 nt, Homo Sapiens
uugcacaaaaauuuaagucugaugugugcuuuaacaccacuauguugauuugcauaguccaaug

SEQ ID NO: 154202 - RNA, 64 nt, Homo Sapiens
agauagaaguucuaacaacucagguuauaucagacaccacuagucacuguaacacuggagagcc

SEQ ID NO: 154203 - RNA, 64 nt, Homo Sapiens
uuaauuuugcgauacacugcugucagaugaggaacaccacuaucagguuuuguugcuuguacag

SEQ ID NO: 154204 - RNA, 64 nt, Homo Sapiens
augauuuuuuaaggagcugguugggucaacuugacaccacuaagauuuuuuuuaaacuuaaauu

SEQ ID NO: 154205 - RNA, 64 nt, Homo Sapiens
agacacugucugaaagaugacaugaguaguaauucaccacuaucugaaccaagcaaggaucaau

SEQ ID NO: 154206 - RNA, 64 nt, Homo Sapiens
aucaaggaccucagccuuauauaaucauuguccccaccacuaccauggacuggacaccuucacu

SEQ ID NO: 154207 - RNA, 64 nt, Homo Sapiens
uugggaggauacagaggagaugccacuucucacucaccacuaccagccagccucagaaggcccc

SEQ ID NO: 154208 - RNA, 59 nt, Homo Sapiens
acaagcacagucgggccgcgggggugagacaccacuacuugcugguacggguggaauga

SEQ ID NO: 154209 - RNA, 64 nt, Homo Sapiens
agcucccuggccucccugcccucccugaaccccccaccacuacccccuuucaccagaugccacc

SEQ ID NO: 154210 - RNA, 64 nt, Homo Sapiens
ggcugcuggaguccuggaacaccccacgccgccccaccacuauaggaagcucugucgugccccu

SEQ ID NO: 154211 - RNA, 64 nt, Homo Sapiens
gcuaaccauucaucugguugaaaagcaaaguguucaccacuaaaccagccaaccacacuauuca

SEQ ID NO: 154212 - RNA, 64 nt, Homo Sapiens
uggugcuggaugcuuguucuacccuccuccaggacaccacuaggcccuucuguuaccacccccc

SEQ ID NO: 154213 - RNA, 64 nt, Homo Sapiens
aaagcugcuucauuuuugaaagaugauggagacccaccacuacuauaugaugaauagcacuaau

SEQ ID NO: 154214 - RNA, 64 nt, Homo Sapiens
uuuuucauagucauugugguuuagauccaauucccaccacuaaaaaaccaacaaugugauuuau

SEQ ID NO: 154215 - RNA, 64 nt, Homo Sapiens
agacaucuauugaagagaaucaaauucuugccuacaccacuagaggacagaauagcacguaaaa

SEQ ID NO: 154216 - RNA, 64 nt, Homo Sapiens
acauccggaguccuggagccgggugucccaguggcaccacuaggugccugcugccuccacagug

SEQ ID NO: 154217 - RNA, 64 nt, Homo Sapiens
cucagccucccgaguagcugggccuaaaggugcccaccacuauacccggcuaauuuuuguauuu

SEQ ID NO: 154218 - RNA, 64 nt, Homo Sapiens
ggccuccuugggaacguguaggccacggcucugccaccacuagguaccugcugagggcgcuggc

SEQ ID NO: 154219 - RNA, 64 nt, Homo Sapiens
uucuggacucugccccaaucggguccagagaccacaccacuaaccauccccaacuccauggggu

SEQ ID NO: 154220 - RNA, 64 nt, Homo Sapiens
caagaguaugaggcugcagugagcccaugagccccaccacuacacuccagccuggaagacacca

SEQ ID NO: 154221 - RNA, 61 nt, Homo Sapiens
agcugccugccauccugcagucuacuucuuccaccacuacgccucccgcagcauuccauga

SEQ ID NO: 154222 - RNA, 64 nt, Homo Sapiens
ucaguguaagaauuaaagaaccuugccaagccuccaccacuaggacccacuugguaacaggcau

SEQ ID NO: 154223 - RNA, 64 nt, Homo Sapiens
accucagacgcuugggcaggugggcuucuccccccaccacuaacuuuaccagagucugggaugg

SEQ ID NO: 154224 - RNA, 64 nt, Homo Sapiens
caauauauccauguaacaaaaacagcccagacuucaccacuacgauucaggugaugguuacaug

SEQ ID NO: 154225 - RNA, 64 nt, Homo Sapiens
agaauacaggaaaaucccuucucggucuuacccccaccacuaaggaugagugaggacuuggguc

SEQ ID NO: 154226 - RNA, 64 nt, Homo Sapiens
uggagaguuggacauguuuucaagcugaaaaugucaccacuaucauucagucacguuaccauau

SEQ ID NO: 154227 - RNA, 64 nt, Homo Sapiens
cucuuaaacgaucaagaacaacacaauagcaguacaccacuaggucucaguaggauacuccaua

SEQ ID NO: 154228 - RNA, 64 nt, Homo Sapiens
uuuuagcccuuuuuguugggcacugcacccggcucaccacuagucugggauuacaggcgugagc

SEQ ID NO: 154229 - RNA, 64 nt, Homo Sapiens
uccaugguuguucauuuagguuauguuaucaccccaccacuaccaaaauacugaguuguuaugu

SEQ ID NO: 154230 - RNA, 64 nt, Homo Sapiens
ccaccaccuccaccaccaccaccaccaccaccaccaccacuaccaccaccacccaacuggggcu

SEQ ID NO: 154231 - RNA, 64 nt, Homo Sapiens
aagcccagagagguuaagaaauuugcuaggaucacaccacuaauaagcaacagagccaggauuc

SEQ ID NO: 154232 - RNA, 64 nt, Homo Sapiens
gagcugcagaugagggagcccguacacucccugccaccacuagguuguaagccuguagcuggcu

SEQ ID NO: 154233 - RNA, 64 nt, Homo Sapiens
aaucccagaggugggauccuagaaggacuaucaacaccacuaggucuggaggguucuaaguggg

SEQ ID NO: 154234 - RNA, 64 nt, Homo Sapiens
ccucccccagaagcucacaaucguaucaaaaagucaccacuaacgcugcacaaaaugcauuuuu

SEQ ID NO: 154235 - RNA, 64 nt, Homo Sapiens
accacuuuagacaggaccgaguggaacucacagccaccacuacccucuuugggagaugacauga

SEQ ID NO: 154236 - RNA, 64 nt, Homo Sapiens
ugauguguacagaguuggacauaucuucacaaaacaccacuauuaagucauuguaagugcacug

SEQ ID NO: 154237 - RNA, 64 nt, Homo Sapiens
ggcuccccuccuguggggaggccaccuuuuaaggcaccacuagcagucaggauaugguggcauc

SEQ ID NO: 154238 - RNA, 62 nt, Homo Sapiens
uaauauacuuucaguauugaaacucacgacggcaccacuaggccagaggcguggcugcccca

SEQ ID NO: 154239 - RNA, 64 nt, Homo Sapiens
ccacccugcccgugggcauacgcagcuccacccucaccacuagccuccuucugggggucaggga

SEQ ID NO: 154240 - RNA, 62 nt, Homo Sapiens
gggagacaugcuguaggggacaccaagaagcccaccacuaggcagccgagaacaacagcuag

SEQ ID NO: 154241 - RNA, 64 nt, Homo Sapiens
guaagcugguuuacagauguuguguugcagcugucaccacuacaauaauaaaagugccuuagca

SEQ ID NO: 154242 - RNA, 64 nt, Homo Sapiens
uggacagccguuuucagagccuccagcauuugcacaccacuacucacccucucugcugcuggca

SEQ ID NO: 154243 - RNA, 64 nt, Homo Sapiens
uuuaugcuaaaucuggccaaagaugagcauuguccaccacuaaaaugccucugccacuuugaau

SEQ ID NO: 154244 - RNA, 64 nt, Homo Sapiens
uggaucucccccugcccauugccugcuugaggggcaccacuacuccagcccagaaggaaagggg

SEQ ID NO: 154245 - RNA, 64 nt, Homo Sapiens
gcucgggugaugggugcaccaaaaucucacaaaucaccacuaaauaauguacucauguaaccaa

SEQ ID NO: 154246 - RNA, 64 nt, Homo Sapiens
ugaucucagcccugcaacuugacccagguagggccaccacuacgccuucacuugucacccaagc

SEQ ID NO: 154247 - RNA, 64 nt, Homo Sapiens
aaaaaagcugcuccccaagcgcugagaagaaaaucaccacuauuaauuccagugagaagcucug

SEQ ID NO: 154248 - RNA, 64 nt, Homo Sapiens
uggagauuucgacguguuuucaagcugaaaaugucaccacuaucucacgaucauguuaccauau

SEQ ID NO: 154249 - RNA, 64 nt, Homo Sapiens
ucucuugugcuaaauuuggccaaagaugauuguccaccacuaaaaaugccucucccacuuggaa

SEQ ID NO: 154250 - RNA, 64 nt, Homo Sapiens
gcccauaaaaacauaaauggccuuauugaugcuuucagcagaauuucaucuagaaguggcagca

SEQ ID NO: 154251 - RNA, 64 nt, Homo Sapiens
acagaugauguggaaggagcucaaacagacgacuucagcagacucaucucuggagggucguuua

SEQ ID NO: 154252 - RNA, 64 nt, Homo Sapiens
gcgccguccaggccgagcgcagacuguuuaggacucagcagacccagcaagaggcaucugcccu

SEQ ID NO: 154253 - RNA, 64 nt, Homo Sapiens
ccccagccaccuccccagcaagcaaccugaaaucucagcagaugcccaccauuucucuagaucg

SEQ ID NO: 154254 - RNA, 64 nt, Homo Sapiens
uccuucccgcuacagaaucgcucaucggcgaggcucagcagaaagacccugaaggcaggcugca

SEQ ID NO: 154255 - RNA, 64 nt, Homo Sapiens
auuaagaaauaaagcaugauauuucuauaauccuucagcagaauaggguccuagaauuuuucug

SEQ ID NO: 154256 - RNA, 64 nt, Homo Sapiens
aaaggccagccaagcuugggaaagauuaugcacaucagcagagggguacuuagaggucgcacuu

SEQ ID NO: 154257 - RNA, 64 nt, Homo Sapiens
cugucuuaauuuguggaugaggcucagcaugggcucagcagaugcccaguuguugacugugaca

SEQ ID NO: 154258 - RNA, 64 nt, Homo Sapiens
ugugcuccuucugaaggcucugaaaaucaaggugucagcagagcccaaaauggaugucccugaa

SEQ ID NO: 154259 - RNA, 64 nt, Homo Sapiens
gagucucuguacacagccccguguggccaucgugucagcagagauggagucauacacgaagggc

SEQ ID NO: 154260 - RNA, 64 nt, Homo Sapiens
gagucucuguacacagccccauauggccaucgugucagcagagauggagucauacgcgaaggcc

SEQ ID NO: 154261 - RNA, 64 nt, Homo Sapiens
cuccaagccccacgaacccuucugugguaucaugucagcagagucgcggggagguaaugaauug

SEQ ID NO: 154262 - RNA, 64 nt, Homo Sapiens
cuuuccagcuaucagcacuuucagcaucggcucuucagcagauccaaacccccucagcaacuug

SEQ ID NO: 154263 - RNA, 64 nt, Homo Sapiens
gccugagacaucaggggagagccugcagcugaguucagcagaaaggaggaauccuggcccucag

SEQ ID NO: 154264 - RNA, 64 nt, Homo Sapiens
agaacaaauuguggaucaugguauaugcaggcuaucagcagaaggaucagacaauaaaaugagu

SEQ ID NO: 154265 - RNA, 64 nt, Homo Sapiens
ugaguuagugcaaaccauuuaguaaaaauaacuaucagcagaguuguuccagauuaaaaauagu

SEQ ID NO: 154266 - RNA, 64 nt, Homo Sapiens
cuagacaguaaguauagcagggugguggucgaagucagcagacauuuccuuauagaauggacau

SEQ ID NO: 154267 - RNA, 64 nt, Homo Sapiens
ucacaggauuaaaugugcaguggaaaugccugguucagcagaugucagaucccagcuucugcag

SEQ ID NO: 154268 - RNA, 64 nt, Homo Sapiens
aguugcugaaguagggucugagagaacccuggcaucagcagacccagggugcuucugucuccug

SEQ ID NO: 154269 - RNA, 64 nt, Homo Sapiens
uguccacaaugguacugaauuugcaucugcacagucagcagagauaacaaguguugaacugacc

SEQ ID NO: 154270 - RNA, 64 nt, Homo Sapiens
gcuuuagcuagaagaauuucaaggaaaagaauucucagcagagcucaagauuguagaaacucag

SEQ ID NO: 154271 - RNA, 64 nt, Homo Sapiens
aagaauucucagcagagcucaagauuguagaaacucagcagaagcugguaaaaacauggggagc

SEQ ID NO: 154272 - RNA, 64 nt, Homo Sapiens
ggaugacuccgcacugccccucaacagggaugacucagcagagaugacucagcacugucccuua

SEQ ID NO: 154273 - RNA, 64 nt, Homo Sapiens
ggaugacucagcauugccccucaacagggaugacucagcagacucagcagggaugacucagcac

SEQ ID NO: 154274 - RNA, 64 nt, Homo Sapiens
cgccccucagcaaggaugacucagcagggaugauucagcagagauaacucggggaugacucuga

SEQ ID NO: 154275 - RNA, 64 nt, Homo Sapiens
gcacagcaggcuacaggguuagaguacagucccuucagcagagguaccccagggcagcaggcuc

SEQ ID NO: 154276 - RNA, 64 nt, Homo Sapiens
cagcugguggcuuugcccucccaaggcugcccccucagcagaggugucccccaggucucagccc

SEQ ID NO: 154277 - RNA, 64 nt, Homo Sapiens
guagaccaccagcuccccuccccaucuccuugagucagcagacuguccaaugugcucagccagg

SEQ ID NO: 154278 - RNA, 64 nt, Homo Sapiens
ccccugaauagcuccuucggccccaucuccauccucagcagaugacacugauuggccucacggg

SEQ ID NO: 154279 - RNA, 64 nt, Homo Sapiens
agccagccagucuugccuagagggccccucccucugccccaagcacccagcuccuuuugucccc

SEQ ID NO: 154280 - RNA, 64 nt, Homo Sapiens
ccccaaccccgcggugcucuugggccccaugcucugccccaagcgaacaagucacagcugcagc

SEQ ID NO: 154281 - RNA, 64 nt, Homo Sapiens
aguggaguagagcccaaucugagcuugaccagugugccccaagggcagcugcagugguugggag

SEQ ID NO: 154282 - RNA, 64 nt, Homo Sapiens
caccugcaggcaagguaccccaacagaaaaacccugccccaaugaauacaggcugaaccuggcc

SEQ ID NO: 154283 - RNA, 64 nt, Homo Sapiens
ggaucuggaacacagguguuguuccccacucccuugccccaaaauaacaacauggccagugccu

SEQ ID NO: 154284 - RNA, 64 nt, Homo Sapiens
cuggucucaguaaaacacugccuugugccucauaugccccaaugcuagggaacagagcuggauu

SEQ ID NO: 154285 - RNA, 64 nt, Homo Sapiens
ccccugcaccuccaccugccccagccccugccucugccccaaguggggccagcugcccucacuu

SEQ ID NO: 154286 - RNA, 64 nt, Homo Sapiens
gguugggguuucugccacuuccgggucuaggcccugccccaaauccagccaguccugccccagc

SEQ ID NO: 154287 - RNA, 64 nt, Homo Sapiens
cuuaacaguugaauuauggagggaaauucccuuuugccccaagcauuucuauauuuaaagcaau

SEQ ID NO: 154288 - RNA, 64 nt, Homo Sapiens
agcaucccuaaucugaacaguuaaaacccccaaaugccccaaaauccaaaccuuccugaacgcu

SEQ ID NO: 154289 - RNA, 64 nt, Homo Sapiens
aaagcauagauuccccaaagcuaaggcaagaauaugccccaacuggccaaaugcagagaugagg

SEQ ID NO: 154290 - RNA, 64 nt, Homo Sapiens
ccugcggugacaccacccagugccugggggcuacugccccaacucuacuccugcugccugugug

SEQ ID NO: 154291 - RNA, 64 nt, Homo Sapiens
ugcaagauuuuccacaagauacugaaggagaaggugccccaaaauuuuaagguauaucauuaua

SEQ ID NO: 154292 - RNA, 64 nt, Homo Sapiens
ccuggaagcuguguccuugcagugggaacgugacugccccaacuucaccaggaauguuaaaguc

SEQ ID NO: 154293 - RNA, 64 nt, Homo Sapiens
acugggucaugcgauccccaauccuagacuccuaugccccaaccucccagcauccagauccugg

SEQ ID NO: 154294 - RNA, 64 nt, Homo Sapiens
auugggucaugggaucccagauccuagacuccuaugccccaaccucccaguacccagauccugg

SEQ ID NO: 154295 - RNA, 64 nt, Homo Sapiens
aggggcucccagccugcacuugcaggaguggugaugccccaagucugcgaauccagggugcacg

SEQ ID NO: 154296 - RNA, 64 nt, Homo Sapiens
uuccaaagcaggugcugcauggcucaccaucauaugccccaaacaacugaaaguuggcgguuau

SEQ ID NO: 154297 - RNA, 64 nt, Homo Sapiens
ccaaaugugcccagggagggcccaccgugugggcugccccaaccgggcaggucaaucuucccac

SEQ ID NO: 154298 - RNA, 64 nt, Homo Sapiens
accaaggcuuucccaucuuggcccccccauucuaugccccaacccugucuuggccggccccacu

SEQ ID NO: 154299 - RNA, 64 nt, Homo Sapiens
acagucgugccauucacaaagucagaaaauacagcaggaagagacagcuuuuagaggggcagag

SEQ ID NO: 154300 - RNA, 64 nt, Homo Sapiens
aaugcacacaacagaaccauaggcaacaccaacacaggaagaaauagaagucaccuauugaaaa

SEQ ID NO: 154301 - RNA, 64 nt, Homo Sapiens
ucuaagaagagacuguccaagcaaguuaggcuugcaggaagauaugacccagcugagaagcccu

SEQ ID NO: 154302 - RNA, 64 nt, Homo Sapiens
ucuagugggauggaguugggguauagaaauuaaccaggaagauguuuccaccaagccugcugug

SEQ ID NO: 154303 - RNA, 64 nt, Homo Sapiens
cugagacauuucgccugagauucuguccaaugagcaggaagauugcaauguggugaagcugagu

SEQ ID NO: 154304 - RNA, 64 nt, Homo Sapiens
uggagcgaugacugacugugggaggugguggugccaggaagaaagguuggggagcaggccagau

SEQ ID NO: 154305 - RNA, 64 nt, Homo Sapiens
aaagcuguccuaggccaaccgcuccuauaaggggcaggaagagccaggaagaugaacugugagg

SEQ ID NO: 154306 - RNA, 64 nt, Homo Sapiens
aacugugagggcuccuauaacucaucugcgccaccaggaagauguguuacccaagggugccuca

SEQ ID NO: 154307 - RNA, 64 nt, Homo Sapiens
guagaucauuuuuaucccgccagggagugugaugcaggaagaccacaugcgcuccuggcuuuua

SEQ ID NO: 154308 - RNA, 64 nt, Homo Sapiens
ugcaagcuccaguagcuccgcgugucucauuugccaggaagauggguucccacguagcaaaucg

SEQ ID NO: 154309 - RNA, 64 nt, Homo Sapiens
ccccaucugugugugaauuccuuuagacuaagggcaggaagacuuccagcuuucucuuuguucu

SEQ ID NO: 154310 - RNA, 64 nt, Homo Sapiens
caguggcaagggacggagaggucccaacaggagucaggaagagguuugauuauaaccaagaaaa

SEQ ID NO: 154311 - RNA, 64 nt, Homo Sapiens
gugccuguaauuccagcuacucgggaggcugaggcaggaagaaucacuugaacccaggaggcgg

SEQ ID NO: 154312 - RNA, 64 nt, Homo Sapiens
gggugcugguuugagggccgagugccugugcugucaggaagaggguggcgcaggccccgggggg

SEQ ID NO: 154313 - RNA, 64 nt, Homo Sapiens
cagcaagagcaaggcaugggucuggcagcuggcccaggaagagccauccuggugccugcauacc

SEQ ID NO: 154314 - RNA, 54 nt, Homo Sapiens
guaguccuagccuccuauaaggcccaggaagagggcagaggggccagaaggacu

SEQ ID NO: 154315 - RNA, 64 nt, Homo Sapiens
uagugccagccccucacacgccuucauccugaaacaggaagaggacggcaccaaguugggggug

SEQ ID NO: 154316 - RNA, 64 nt, Homo Sapiens
caggagggcuaauuagaaauagcucaggcuuuuccaggaagauccagcuucaaagcuuaaaaag

SEQ ID NO: 154317 - RNA, 64 nt, Homo Sapiens
uaugcuuugaaugcaaaagaagaccugcauuuggcaggaagauguaguaaauaugugaagaaaa

SEQ ID NO: 154318 - RNA, 64 nt, Homo Sapiens
aaaucugggcauugagcaaggagauaaccacaaccaggaagaacccccgugaaugcuuaccugu

SEQ ID NO: 154319 - RNA, 64 nt, Homo Sapiens
gugcuugucaucugccacuuuucgaggcgguuuccaggaagaguacaaugcaguagccagcacg

SEQ ID NO: 154320 - RNA, 64 nt, Homo Sapiens
ccgccuggaggagauccgcaucuggggaccccuccaggaagaugcugacauccaggucagcagg

SEQ ID NO: 154321 - RNA, 64 nt, Homo Sapiens
ccugugcauggacucugcccucagggugccuguccaggaagagcuguguggccuggcaagcaag

SEQ ID NO: 154322 - RNA, 64 nt, Homo Sapiens
ggaaaaggaagggcagagugaguggguugcaagacaggaagaaacacaguaggcgcccaggaca

SEQ ID NO: 154323 - RNA, 64 nt, Homo Sapiens
uccccccuccaucccagccccauggccaggguggcaggaagacauccuugcgggguuggggcug

SEQ ID NO: 154324 - RNA, 64 nt, Homo Sapiens
cuggccuacagcuugucuguuucucaagcagaggcaggaagagcuagucuuagcauuuauauuu

SEQ ID NO: 154325 - RNA, 64 nt, Homo Sapiens
agaguccacuugucccgggcuuccaccuggcugacaggaagaauuucugagagcuggaugugca

SEQ ID NO: 154326 - RNA, 64 nt, Homo Sapiens
uuccauguaacaaucuggaaggaaacuucacggacaggaagacugcuggagaagagaagcgugu

SEQ ID NO: 154327 - RNA, 64 nt, Homo Sapiens
aaugccuugggaccuggagugcugggcuugugcacaggaagagcaccagccgcugagucaggau

SEQ ID NO: 154328 - RNA, 64 nt, Homo Sapiens
ggguaacacgaagaagacccggcccuuagggcaucaggaagacuagcuccccugccccggagga

SEQ ID NO: 154329 - RNA, 64 nt, Homo Sapiens
cuggaaugauucuagaaccaaaauaaaguuggggcaggaagagggggcuuccagggagcccugc

SEQ ID NO: 154330 - RNA, 64 nt, Homo Sapiens
gggcugcagaagauuuagauucaacacaaagacacaggaagaaucauggaagauuagagguuug

SEQ ID NO: 154331 - RNA, 64 nt, Homo Sapiens
uuuaacacuaaaauuccacuacugaacccagagucaggaagagauaacagaagaggagggaccu

SEQ ID NO: 154332 - RNA, 64 nt, Homo Sapiens
auggcuaacaaaaacuaaaggggaagugaggaaacaggaagaaguauggugggggcugggguag

SEQ ID NO: 154333 - RNA, 64 nt, Homo Sapiens
uaguuuucuucaggugucaauggcguuagacucccaggaagacuagcccugcccacagggccac

SEQ ID NO: 154334 - RNA, 64 nt, Homo Sapiens
uguacugcugaguguuccuuaagggugcccaggacaggaagacggguuuuggucaauacuugac

SEQ ID NO: 154335 - RNA, 64 nt, Homo Sapiens
ugaaaaaucacguggauucaugaugacuguacaacaggaagacucagcacaaaccuggucauuu

SEQ ID NO: 154336 - RNA, 64 nt, Homo Sapiens
uugcuggagcaagaggagaggccugaaccaagagcaggaagaggagaaaaugagggcuugaguc

SEQ ID NO: 154337 - RNA, 64 nt, Homo Sapiens
uugcugagauuguuggaacagccugaacgaagagcaggaagaggagaaaaugagggcuugaguc

SEQ ID NO: 154338 - RNA, 64 nt, Homo Sapiens
uugcucagguuguuggagcaaccugaaccaagagcaggaagaggagaaaaugagggcuugaguc

SEQ ID NO: 154339 - RNA, 64 nt, Homo Sapiens
aaguucuggauauaauaaauugauuuagauggcacaggaagagcagaugggagauagauaccaa

SEQ ID NO: 154340 - RNA, 64 nt, Homo Sapiens
gaucuacuuuacaccccacagcaucagcugagagcaggaagagcacacaugcuacaaugaggca

SEQ ID NO: 154341 - RNA, 64 nt, Homo Sapiens
gagagcugagaguauucgcucgacugagcacauucaggaagaucagggcaggcgugugggaggu

SEQ ID NO: 154342 - RNA, 64 nt, Homo Sapiens
cacguaugguucuuucugugggucuguggcacagcaggaagagcccggugccgccagcaccuug

SEQ ID NO: 154343 - RNA, 64 nt, Homo Sapiens
caggccuucaagggcaaggacagucagagggcaacaggaagauggcccaaguagguuauuugua

SEQ ID NO: 154344 - RNA, 64 nt, Homo Sapiens
auggccuugacuuuuuaaaugcugcagugaaaagcaggaagaaguccagcugguucugugggcu

SEQ ID NO: 154345 - RNA, 64 nt, Homo Sapiens
uccuuccugggaagaagaagucacgcuggcauaucaggaagaugcaucuucgagcccaaaggag

SEQ ID NO: 154346 - RNA, 55 nt, Homo Sapiens
uccuuccuggggaagaagaacaccucaggaagauggcccaaaagagucacaguga

SEQ ID NO: 154347 - RNA, 64 nt, Homo Sapiens
cccuguggucaccgugucugcccacagccaaggucaggaagaggcaaugugcaaucccccugcc

SEQ ID NO: 154348 - RNA, 64 nt, Homo Sapiens
gaaaugcuacacgacaaccuugaaccccgaaacucaggaagagugaagcgauggcugaccagau

SEQ ID NO: 154349 - RNA, 64 nt, Homo Sapiens
agcagaaaagaagggcugggacuacgguagggggcaggaagagguacccaguuuuguuucugaa

SEQ ID NO: 154350 - RNA, 64 nt, Homo Sapiens
cuccauguggcuccugcuucgcaggcagacuuuccaggaagaggguaaagcccuuuggcucuug

SEQ ID NO: 154351 - RNA, 64 nt, Homo Sapiens
aggccgcggaggagccggaugcugagccgggaggcaggaagaagacggaggagccgggcgacag

SEQ ID NO: 154352 - RNA, 64 nt, Homo Sapiens
gcagguggaggcggaacgaggauggagccaucugcaggaagagcauaaagaagaugcuggaagu

SEQ ID NO: 154353 - RNA, 64 nt, Homo Sapiens
gagccuaggaguucgagaccuugggaagcugaggcaggaagauuacuccuguaacccugggacu

SEQ ID NO: 154354 - RNA, 64 nt, Homo Sapiens
ggaaucugccuggaacaaagacaucuggaagaaacaggaagauuauuucugaggacaggagcuc

SEQ ID NO: 154355 - RNA, 64 nt, Homo Sapiens
aucaguaacauuauccuuagcuaccuaaguaaaacaggaagaaaagguguccauaugucuuuac

SEQ ID NO: 154356 - RNA, 64 nt, Homo Sapiens
uucugucaaucauggacgcaaugugacuuuagugcaggaagaacucagaggcccggacucuccu

SEQ ID NO: 154357 - RNA, 64 nt, Homo Sapiens
gacuuguuuauaauucugcacuuuagaagaaaaacaguguuaaucuguaguugaaagaaagcuu

SEQ ID NO: 154358 - RNA, 64 nt, Homo Sapiens
aggccgguucuaauugaggggacccagugugcuucaguguuaagaguggggcaaugaagaguga

SEQ ID NO: 154359 - RNA, 64 nt, Homo Sapiens
aacaaacaaaaaaauuugcagaauaaagccaugacaguguuaaacuuuugugcaacuguguuuu

SEQ ID NO: 154360 - RNA, 64 nt, Homo Sapiens
guuccucaaaagucggaacaggugcuuuuggaagcaguguuagugaugaagaaagaaaagcagg

SEQ ID NO: 154361 - RNA, 64 nt, Homo Sapiens
cucacccuguucuuugaagccuuugcaccagcuucaguguuaagaagaggguaacauggguuac

SEQ ID NO: 154362 - RNA, 64 nt, Homo Sapiens
aggguaacauggguuaccuugugccauccuuguacaguguuaaguuuaaucuguguuucugcaa

SEQ ID NO: 154363 - RNA, 64 nt, Homo Sapiens
gccuaaaaacugugugguucgcaaaaauuuuguacaguguuaagauuguuaaaaacugcauuau

SEQ ID NO: 154364 - RNA, 64 nt, Homo Sapiens
uauuauuugaauggaaagacuauuaaaaaauguacaguguuaggagaaccaaguuuuucuauga

SEQ ID NO: 154365 - RNA, 64 nt, Homo Sapiens
aaaacagaugcccauuuguuugucuguaaaucuucaguguuaaauuaugauaacuuuuaaaaag

SEQ ID NO: 154366 - RNA, 64 nt, Homo Sapiens
ugauauuuuaauuuauuuuuuuuaaaucacuguacaguguuauuccccacccuuuuuuuuuggu

SEQ ID NO: 154367 - RNA, 64 nt, Homo Sapiens
uaaaaauuaaucugagcacaaaagcagaacuauccaguguuaucuuggugaaggcaagucucug

SEQ ID NO: 154368 - RNA, 64 nt, Homo Sapiens
uccauaugccucccuaugcagugaagggcccuagcaguguuaacaaauugcugagaucccacgg

SEQ ID NO: 154369 - RNA, 64 nt, Homo Sapiens
aaaacaagauacauacauaguauaacacaccucacaguguuaagauuuauauugugaaaugaga

SEQ ID NO: 154370 - RNA, 64 nt, Homo Sapiens
ugugaguggaaggaguucugagaacgucauggaccaguguuaaagaagguuucucuuuugcaau

SEQ ID NO: 154371 - RNA, 64 nt, Homo Sapiens
uaaacauuuucaaugugcauauuaaucuaaaagucaguguuauuugcaaaggccuaaacugaga

SEQ ID NO: 154372 - RNA, 64 nt, Homo Sapiens
uggaacccucacugaaaguccagaaugucuaagccaguguuagauuuuguaaacaaguggaaca

SEQ ID NO: 154373 - RNA, 64 nt, Homo Sapiens
cuaagccaguguuagauuuuguaaacaaguggaacaguguuaaauuucuaugauguuggagcca

SEQ ID NO: 154374 - RNA, 64 nt, Homo Sapiens
uguuucagcagaguauuauuguauucuugggagucaguguuaugugacaaagaguaaguaagca

SEQ ID NO: 154375 - RNA, 64 nt, Homo Sapiens
ccucuguuuaucucgcauguucuccagaauuaaucaguguuaguuuauaguucuucuccauguu

SEQ ID NO: 154376 - RNA, 64 nt, Homo Sapiens
aauaaaguuauucuacuagucuauguagaaggcucaguguuagauuauucauuucuguaaauuc

SEQ ID NO: 154377 - RNA, 64 nt, Homo Sapiens
cauuucuguaaauuccuauggagaauaagcagcacaguguuauuagaaucugggaagagaaaug

SEQ ID NO: 154378 - RNA, 64 nt, Homo Sapiens
agagcccaguaagaacugcuggcaaggagggaaacaguguuaccugccauucugagccuugaag

SEQ ID NO: 154379 - RNA, 64 nt, Homo Sapiens
ugugaugaauacuguauuuuagcagugaaugauucaguguuaaacgcuggacucucagucucug

SEQ ID NO: 154380 - RNA, 64 nt, Homo Sapiens
gaagggccugccacagccuccccagcucugaaaccaguguuaggaggaacccuuacaguaggag

SEQ ID NO: 154381 - RNA, 64 nt, Homo Sapiens
aauaccagcauccauguuacugacagaaauuaagcaguguuaaguuaacauuuauagugaggau

SEQ ID NO: 154382 - RNA, 64 nt, Homo Sapiens
acaaaagggcaucaccaucccugaauccccuucacaguguuaaccggcacccaauucagcaggg

SEQ ID NO: 154383 - RNA, 64 nt, Homo Sapiens
cuguaagguguuagccuuaacagggccaguguuacaguguuaccuggagaaaagcaccuggcuc

SEQ ID NO: 154384 - RNA, 64 nt, Homo Sapiens
guguuacccuguaagguguuccuggcuccagggccaguguuacaaguuuucauggagaaaagca

SEQ ID NO: 154385 - RNA, 64 nt, Homo Sapiens
ucuaaauccuugauccucugcagugacaaugaaucaguguuaauaaagugguauuacagacauu

SEQ ID NO: 154386 - RNA, 64 nt, Homo Sapiens
gugaacacuuagcauccugucccuucccuuuggacaguguuacaacuccuucauuuuuccuucu

SEQ ID NO: 154387 - RNA, 64 nt, Homo Sapiens
acaccagaacuuuagccaaaguuguaucacaaaucaguguuaaauaaaaggaaguuuaaugucc

SEQ ID NO: 154388 - RNA, 64 nt, Homo Sapiens
augccaagguagggaaugugcauuuaaauucaggcaguguuaaucuauuuacaacucaguuuua

SEQ ID NO: 154389 - RNA, 64 nt, Homo Sapiens
agaaaggacacagcguaauguguuauaccaaacccaguguuaggucgaggguucaugcagucag

SEQ ID NO: 154390 - RNA, 64 nt, Homo Sapiens
ccaaacccaguguuaggagaaggguucaugcagucaguguuauacaaugaguuauggagacucg

SEQ ID NO: 154391 - RNA, 64 nt, Homo Sapiens
gcuuugugcucccugcuccugaggcagucaggcugaugcucaguuguuuggaacccuccccaaa

SEQ ID NO: 154392 - RNA, 64 nt, Homo Sapiens
gagggauaugcuggugugaggauggucagggagggaugcucagggcuguggggaugguggggug

SEQ ID NO: 154393 - RNA, 64 nt, Homo Sapiens
uaaagcuuuuaaguauagacuaccuuagcaugaagaugcucaugccuaagaaugaaaauuguug

SEQ ID NO: 154394 - RNA, 64 nt, Homo Sapiens
ucccacuuuacauaaaaacccaucaggacagaaugaugcucaauauuuuaaaauucuaaaaaua

SEQ ID NO: 154395 - RNA, 64 nt, Homo Sapiens
uucugcaagggggcagucuccccagcucccugaugaugcucacccccgcccccccaccucaggu

SEQ ID NO: 154396 - RNA, 64 nt, Homo Sapiens
ggaggaaaggcagguaggaaggaguaaggauggagaugcucagaaucaagagcauggcggagua

SEQ ID NO: 154397 - RNA, 64 nt, Homo Sapiens
cagaagggacuguggucgcucugcaaccugacgcgaugcucagacccagcgucaggugggagua

SEQ ID NO: 154398 - RNA, 64 nt, Homo Sapiens
cacagaagggacugcagucgcugcaaccugacacgaugcucagacccaaagucagaugggagua

SEQ ID NO: 154399 - RNA, 64 nt, Homo Sapiens
caagaauagggcuguggccgcugcaaccugacaggaugcucagacccaaagucaggugggagua

SEQ ID NO: 154400 - RNA, 64 nt, Homo Sapiens
gccgaccuguggccucuugcaacagcuagacacagaugcucacaauccacuguuggagaugcuc

SEQ ID NO: 154401 - RNA, 64 nt, Homo Sapiens
agcuagacacagaugcucaccauccacuguuggagaugcucaaccucaggucuaccuggacacu

SEQ ID NO: 154402 - RNA, 64 nt, Homo Sapiens
ucccuuguauaaaauggcauugguaaaaucugaggaugcucaagguuccaggauccuccacuga

SEQ ID NO: 154403 - RNA, 64 nt, Homo Sapiens
augccauaucuucaaccaguucaguauacuuuuggaugcucaaaacaaaacaucauucuauaag

SEQ ID NO: 154404 - RNA, 64 nt, Homo Sapiens
cugccucccacccacugacucagggacccaaugucccgaggaaugagcccaaguagccucuggc

SEQ ID NO: 154405 - RNA, 64 nt, Homo Sapiens
ugugaccagugguuucugcuaucagggagaaagucccgaggaaaaggggcccagagcaaagggc

SEQ ID NO: 154406 - RNA, 64 nt, Homo Sapiens
ccugcuguauuucuuguaacgugucaucugcaggagugaguaggccaauggccaaggauuccgu

SEQ ID NO: 154407 - RNA, 64 nt, Homo Sapiens
cucgauauuaaaaucauccuugaaaauguugaaaagugaguaacuagcuuuaaguuugugcaag

SEQ ID NO: 154408 - RNA, 64 nt, Homo Sapiens
auauuucuaucccugccagcacagugcuggacauagugaguacugaacaccuaagaggcacuca

SEQ ID NO: 154409 - RNA, 64 nt, Homo Sapiens
gcacuagucagccgccugcauagacuuucuaaacagugaguaaauaccauggaaugucagaaau

SEQ ID NO: 154410 - RNA, 64 nt, Homo Sapiens
aaaagcuguuucaaguuuauuuuccagggauguaagugaguaauugagagaucccaucuguugg

SEQ ID NO: 154411 - RNA, 64 nt, Homo Sapiens
uuccuugugcaauggagggaggaaauucaccuagagugaguacuacauacuuacugccuuuugu

SEQ ID NO: 154412 - RNA, 64 nt, Homo Sapiens
auccuuuuccuggugugcuuauuaucccuuuugcagugaguacaguuuauuaaguugucagccc

SEQ ID NO: 154413 - RNA, 64 nt, Homo Sapiens
guaccucccuguguaacucaccuucccccaugacagugaguaagagacacucacaggcuaugag

SEQ ID NO: 154414 - RNA, 64 nt, Homo Sapiens
aaauuucuugaaauaucacuucucccugaucugcagugaguauaaauucacuugucaccucagu

SEQ ID NO: 154415 - RNA, 64 nt, Homo Sapiens
uaggaaaugguauacuauuuugcuauuuguacugagugaguacauuggcauaaauauagaaauu

SEQ ID NO: 154416 - RNA, 64 nt, Homo Sapiens
ucccuuuugccaguugacaaaaugcccagugauuagugaguauuaggaauuuguacuuuuucau

SEQ ID NO: 154417 - RNA, 64 nt, Homo Sapiens
gauuuuuggauauuucaaaagguggcccacaaugagugaguagucauucacuugauauuggcaa

SEQ ID NO: 154418 - RNA, 64 nt, Homo Sapiens
uagacagccuuucugcugccggcaaaucacaaucagugaguaaacaaaccagcaaacuuuccug

SEQ ID NO: 154419 - RNA, 64 nt, Homo Sapiens
ucacgcagcaacguuuuuaaauguuaaucaaacaagugaguagcuuuacauuaaacucccuuuc

SEQ ID NO: 154420 - RNA, 64 nt, Homo Sapiens
agcaauugcccuguaacuuauagaaauguaaaaguacucugaaacuuuacugacaagaauggaa

SEQ ID NO: 154421 - RNA, 64 nt, Homo Sapiens
ccaggccguuccccuuggcugggcaaggucuccuuacucugagccagacaccguuugucccccg

SEQ ID NO: 154422 - RNA, 64 nt, Homo Sapiens
uuuguuguuuggggggaggguuuuuccuuugacauacucugaaugaucaauacaauaacaaacc

SEQ ID NO: 154423 - RNA, 64 nt, Homo Sapiens
uuucaggaaccgucaaaggauauuuuaggacuuguacucugaauugcugguagcuuaaaauuuu

SEQ ID NO: 154424 - RNA, 64 nt, Homo Sapiens
uucugucuaguaucagagaagugggcuguagcguuacucugauuuuuuuacacccuguagaauu

SEQ ID NO: 154425 - RNA, 64 nt, Homo Sapiens
caauccucuauuucuuuuuuuaaauauaacuuucuacucugaugagagaaugugguuuuaaucu

SEQ ID NO: 154426 - RNA, 64 nt, Homo Sapiens
ugcgccaucacaacuagcugguggucaguuuuguuacucugagagcuguucacuucucugaauu

SEQ ID NO: 154427 - RNA, 64 nt, Homo Sapiens
gucuaauauuucagauucuuucuuuucgacuuuauacucugaguuauuacuuacuguaaguggu

SEQ ID NO: 154428 - RNA, 64 nt, Homo Sapiens
caacagcuuauaccauggaaugaggacaaggugauacucugagcuguggacugaacuggcagac

SEQ ID NO: 154429 - RNA, 64 nt, Homo Sapiens
uuuauacucuguuuuugcagaaaacaaagaggcauacucugauuuuuuuuuuuuuuuuugguag

SEQ ID NO: 154430 - RNA, 64 nt, Homo Sapiens
cauaguuaguuuaggaaaucuaagucauuagagauacucugaagcuuuauuuuccaugagcuac

SEQ ID NO: 154431 - RNA, 64 nt, Homo Sapiens
ucuucauuugucaccaucuuuucccaugcacgcauacucugaacauccuugugugggcccaucc

SEQ ID NO: 154432 - RNA, 64 nt, Homo Sapiens
agacuguguaugcaacccccaauagacccccuuuuacucugaucuggagaauguaucuggcuuc

SEQ ID NO: 154433 - RNA, 64 nt, Homo Sapiens
ccuuugccacauuauacaaaaggguguaggauaugaggguuaggcucucuuagaaugagagugg

SEQ ID NO: 154434 - RNA, 64 nt, Homo Sapiens
ccugcuuccuaaagccucaacauuugaacaugcagaggguuaauauacugaguaccagcauguc

SEQ ID NO: 154435 - RNA, 64 nt, Homo Sapiens
ucauuaaaauaaauuuucacuguauuugagaugggaggguuaaggcucagggauuuuauuucag

SEQ ID NO: 154436 - RNA, 64 nt, Homo Sapiens
guguaauaauaacaacuacuuugucgguugcucugaggguuaaaugaaaauaaaaagaaaaugu

SEQ ID NO: 154437 - RNA, 64 nt, Homo Sapiens; identical to SEQ ID NO: 154420

SEQ ID NO: 154438 - RNA, 64 nt, Homo Sapiens; identical to SEQ ID NO: 154421

SEQ ID NO: 154439 - RNA, 64 nt, Homo Sapiens; identical to SEQ ID NO: 154422

SEQ ID NO: 154440 - RNA, 64 nt, Homo Sapiens; identical to SEQ ID NO: 154423

SEQ ID NO: 154441 - RNA, 64 nt, Homo Sapiens; identical to SEQ ID NO: 154424

SEQ ID NO: 154442 - RNA, 64 nt, Homo Sapiens; identical to SEQ ID NO: 154425

SEQ ID NO: 154443 - RNA, 64 nt, Homo Sapiens; identical to SEQ ID NO: 154426

SEQ ID NO: 154444 - RNA, 64 nt, Homo Sapiens; identical to SEQ ID NO: 154427

SEQ ID NO: 154445 - RNA, 64 nt, Homo Sapiens; identical to SEQ ID NO: 154428

SEQ ID NO: 154446 - RNA, 64 nt, Homo Sapiens; identical to SEQ ID NO: 154429

SEQ ID NO: 154447 - RNA, 64 nt, Homo Sapiens; identical to SEQ ID NO: 154430

SEQ ID NO: 154448 - RNA, 64 nt, Homo Sapiens; identical to SEQ ID NO: 154431

SEQ ID NO: 154449 - RNA, 64 nt, Homo Sapiens; identical to SEQ ID NO: 154432

SEQ ID NO: 154450 - RNA, 64 nt, Homo Sapiens; identical to SEQ ID NO: 154433

SEQ ID NO: 154451 - RNA, 64 nt, Homo Sapiens; identical to SEQ ID NO: 154434

SEQ ID NO: 154452 - RNA, 64 nt, Homo Sapiens; identical to SEQ ID NO: 154435

SEQ ID NO: 154453 - RNA, 64 nt, Homo Sapiens; identical to SEQ ID NO: 154436

SEQ ID NO: 154454 - RNA, 64 nt, Homo Sapiens; identical to SEQ ID NO: 154420

SEQ ID NO: 154455 - RNA, 64 nt, Homo Sapiens; identical to SEQ ID NO: 154421

SEQ ID NO: 154456 - RNA, 64 nt, Homo Sapiens; identical to SEQ ID NO: 154422

SEQ ID NO: 154457 - RNA, 64 nt, Homo Sapiens; identical to SEQ ID NO: 154423

SEQ ID NO: 154458 - RNA, 64 nt, Homo Sapiens; identical to SEQ ID NO: 154424

SEQ ID NO: 154459 - RNA, 64 nt, Homo Sapiens; identical to SEQ ID NO: 154425

SEQ ID NO: 154460 - RNA, 64 nt, Homo Sapiens; identical to SEQ ID NO: 154426

SEQ ID NO: 154461 - RNA, 64 nt, Homo Sapiens; identical to SEQ ID NO: 154427

SEQ ID NO: 154462 - RNA, 64 nt, Homo Sapiens; identical to SEQ ID NO: 154428

SEQ ID NO: 154463 - RNA, 64 nt, Homo Sapiens; identical to SEQ ID NO: 154429

SEQ ID NO: 154464 - RNA, 64 nt, Homo Sapiens; identical to SEQ ID NO: 154430

SEQ ID NO: 154465 - RNA, 64 nt, Homo Sapiens; identical to SEQ ID NO: 154431

SEQ ID NO: 154466 - RNA, 64 nt, Homo Sapiens; identical to SEQ ID NO: 154432

SEQ ID NO: 154467 - RNA, 64 nt, Homo Sapiens; identical to SEQ ID NO: 154433

SEQ ID NO: 154468 - RNA, 64 nt, Homo Sapiens; identical to SEQ ID NO: 154434

SEQ ID NO: 154469 - RNA, 64 nt, Homo Sapiens; identical to SEQ ID NO: 154435

SEQ ID NO: 154470 - RNA, 64 nt, Homo Sapiens; identical to SEQ ID NO: 154436

SEQ ID NO: 154471 - RNA, 64 nt, Homo Sapiens; identical to SEQ ID NO: 154420

SEQ ID NO: 154472 - RNA, 64 nt, Homo Sapiens; identical to SEQ ID NO: 154421

SEQ ID NO: 154473 - RNA, 64 nt, Homo Sapiens; identical to SEQ ID NO: 154422

SEQ ID NO: 154474 - RNA, 64 nt, Homo Sapiens; identical to SEQ ID NO: 154423

SEQ ID NO: 154475 - RNA, 64 nt, Homo Sapiens; identical to SEQ ID NO: 154424

SEQ ID NO: 154476 - RNA, 64 nt, Homo Sapiens; identical to SEQ ID NO: 154425

SEQ ID NO: 154477 - RNA, 64 nt, Homo Sapiens; identical to SEQ ID NO: 154426

SEQ ID NO: 154478 - RNA, 64 nt, Homo Sapiens; identical to SEQ ID NO: 154427

SEQ ID NO: 154479 - RNA, 64 nt, Homo Sapiens; identical to SEQ ID NO: 154428

SEQ ID NO: 154480 - RNA, 64 nt, Homo Sapiens; identical to SEQ ID NO: 154429

SEQ ID NO: 154481 - RNA, 64 nt, Homo Sapiens; identical to SEQ ID NO: 154430

SEQ ID NO: 154482 - RNA, 64 nt, Homo Sapiens; identical to SEQ ID NO: 154431

SEQ ID NO: 154483 - RNA, 64 nt, Homo Sapiens; identical to SEQ ID NO: 154432

SEQ ID NO: 154484 - RNA, 64 nt, Homo Sapiens; identical to SEQ ID NO: 154433

SEQ ID NO: 154485 - RNA, 64 nt, Homo Sapiens; identical to SEQ ID NO: 154434

SEQ ID NO: 154486 - RNA, 64 nt, Homo Sapiens; identical to SEQ ID NO: 154435

SEQ ID NO: 154487 - RNA, 64 nt, Homo Sapiens; identical to SEQ ID NO: 154436

SEQ ID NO: 154488 - RNA, 64 nt, Homo Sapiens; identical to SEQ ID NO: 154420

SEQ ID NO: 154489 - RNA, 64 nt, Homo Sapiens; identical to SEQ ID NO: 154421

SEQ ID NO: 154490 - RNA, 64 nt, Homo Sapiens; identical to SEQ ID NO: 154422

SEQ ID NO: 154491 - RNA, 64 nt, Homo Sapiens; identical to SEQ ID NO: 154423

SEQ ID NO: 154492 - RNA, 64 nt, Homo Sapiens; identical to SEQ ID NO: 154424

SEQ ID NO: 154493 - RNA, 64 nt, Homo Sapiens; identical to SEQ ID NO: 154425

SEQ ID NO: 154494 - RNA, 64 nt, Homo Sapiens; identical to SEQ ID NO: 154426

SEQ ID NO: 154495 - RNA, 64 nt, Homo Sapiens; identical to SEQ ID NO: 154427

SEQ ID NO: 154496 - RNA, 64 nt, Homo Sapiens; identical to SEQ ID NO: 154428

SEQ ID NO: 154497 - RNA, 64 nt, Homo Sapiens; identical to SEQ ID NO: 154429

SEQ ID NO: 154498 - RNA, 64 nt, Homo Sapiens; identical to SEQ ID NO: 154430

SEQ ID NO: 154499 - RNA, 64 nt, Homo Sapiens; identical to SEQ ID NO: 154431

SEQ ID NO: 154500 - RNA, 64 nt, Homo Sapiens; identical to SEQ ID NO: 154432

SEQ ID NO: 154501 - RNA, 64 nt, Homo Sapiens; identical to SEQ ID NO: 154433

SEQ ID NO: 154502 - RNA, 64 nt, Homo Sapiens; identical to SEQ ID NO: 154434

SEQ ID NO: 154503 - RNA, 64 nt, Homo Sapiens; identical to SEQ ID NO: 154435

SEQ ID NO: 154504 - RNA, 64 nt, Homo Sapiens; identical to SEQ ID NO: 154436

SEQ ID NO: 154505 - RNA, 64 nt, Homo Sapiens; identical to SEQ ID NO: 154420

SEQ ID NO: 154506 - RNA, 64 nt, Homo Sapiens; identical to SEQ ID NO: 154421

SEQ ID NO: 154507 - RNA, 64 nt, Homo Sapiens; identical to SEQ ID NO: 154422

SEQ ID NO: 154508 - RNA, 64 nt, Homo Sapiens; identical to SEQ ID NO: 154423

SEQ ID NO: 154509 - RNA, 64 nt, Homo Sapiens; identical to SEQ ID NO: 154424

SEQ ID NO: 154510 - RNA, 64 nt, Homo Sapiens; identical to SEQ ID NO: 154425

SEQ ID NO: 154511 - RNA, 64 nt, Homo Sapiens; identical to SEQ ID NO: 154426

SEQ ID NO: 154512 - RNA, 64 nt, Homo Sapiens; identical to SEQ ID NO: 154427

SEQ ID NO: 154513 - RNA, 64 nt, Homo Sapiens; identical to SEQ ID NO: 154428

SEQ ID NO: 154514 - RNA, 64 nt, Homo Sapiens; identical to SEQ ID NO: 154429

SEQ ID NO: 154515 - RNA, 64 nt, Homo Sapiens; identical to SEQ ID NO: 154430

SEQ ID NO: 154516 - RNA, 64 nt, Homo Sapiens; identical to SEQ ID NO: 154431

SEQ ID NO: 154517 - RNA, 64 nt, Homo Sapiens; identical to SEQ ID NO: 154432

SEQ ID NO: 154518 - RNA, 64 nt, Homo Sapiens; identical to SEQ ID NO: 154433

SEQ ID NO: 154519 - RNA, 64 nt, Homo Sapiens; identical to SEQ ID NO: 154434

SEQ ID NO: 154520 - RNA, 64 nt, Homo Sapiens; identical to SEQ ID NO: 154435

SEQ ID NO: 154521 - RNA, 64 nt, Homo Sapiens; identical to SEQ ID NO: 154436

SEQ ID NO: 154522 - RNA, 64 nt, Homo Sapiens
ccaaaaccuuaacuaugacuaagaaauuaaagaagaaaaccagcaaacuaaaacuucugggcag

SEQ ID NO: 154523 - RNA, 64 nt, Homo Sapiens
aacuuugauauucagggagguaggaaagguaacagaaaaccagcauauuuaaucaaagcaagaa

SEQ ID NO: 154524 - RNA, 64 nt, Homo Sapiens
aggauuauaaaacucccaaaguaccaguuuuccagaaaaccacauuuuacaguuuaugaugauu

SEQ ID NO: 154525 - RNA, 64 nt, Homo Sapiens
gcuuauaugagaaacauguuuaggcaacuagucagaaaaccagcuauggccuuacagaaaggga

SEQ ID NO: 154526 - RNA, 64 nt, Homo Sapiens
cacuuuccgccucucuugcaucccaugcuucgaggaaaaccaaagaauaccaugaucgaugaug

SEQ ID NO: 154527 - RNA, 64 nt, Homo Sapiens
guuuccacccacagacccuuccaaauacuggagagaaaaccaaccaacgagcaacaaucggaaa

SEQ ID NO: 154528 - RNA, 64 nt, Homo Sapiens
cauuucacugagaaagcccccagaggaggcagcagaaaaccaaacccuggaggggggccugggg

SEQ ID NO: 154529 - RNA, 64 nt, Homo Sapiens
cacagcugaccggcucgguggagcgucguaacaggaaaaccaccuguuauugcuacaggcuacu

SEQ ID NO: 154530 - RNA, 64 nt, Homo Sapiens
guaaguuucccuuuauuuuucagagaaaaagccagaaaaccaaggaggauuuaauuagaaagcc

SEQ ID NO: 154531 - RNA, 64 nt, Homo Sapiens
gcaacagacucauugaagaauccuagagucaaaagaaaaccacugaucacaaaacugggacauc

SEQ ID NO: 154532 - RNA, 64 nt, Homo Sapiens
ucacagauacuuuuguacccauuuugcacuagaggaaaaccaugaagcaguugcucaaauguug

SEQ ID NO: 154533 - RNA, 64 nt, Homo Sapiens
uuucagagcaauauucuucugcauuauaguaagagaaaaccauuuuuaaucuuaguuaaaauua

SEQ ID NO: 154534 - RNA, 64 nt, Homo Sapiens
aauaaagcagaagcaaccuuuuucccucuucccagaaaaccagucuguguuuacagacagaaga

SEQ ID NO: 154535 - RNA, 64 nt, Homo Sapiens
ggaacugacaauaugcaggagcaguaaacuggcagaaaaccaggaaucagagaaagaaaauaua

SEQ ID NO: 154536 - RNA, 64 nt, Homo Sapiens
aguacguuuuagucauauuacaccuccaaagaaugaaaaccagucuugaauaaacauuuuggau

SEQ ID NO: 154537 - RNA, 64 nt, Homo Sapiens
cccacaugcuaauaugggugaguaucuaagguuagaaaaccacgaaaaauaaauuaugacauuu

SEQ ID NO: 154538 - RNA, 64 nt, Homo Sapiens
acaauauaugcaauuuucauugaacuuaaagagugaaaaccauguaaacuauugaaacuauugu

SEQ ID NO: 154539 - RNA, 64 nt, Homo Sapiens
aguguuaaugcaaaguuuacagacuuuugauauggaaaaccagauaaaacaauguuacaaaagg

SEQ ID NO: 154540 - RNA, 64 nt, Homo Sapiens
gggaugaguggcuuccaugguccuucuuauuggugaaaaccaggaguguguuauacacuuugcu

SEQ ID NO: 154541 - RNA, 64 nt, Homo Sapiens
auaugguggugcugggcuuuauuccaacucuagagaaaaccaauucaaguucuugauuuuuaaa

SEQ ID NO: 154542 - RNA, 64 nt, Homo Sapiens
gauugugguguggggcggguauuuaaaaaaugccgaaaaccagcugacguuucuuaaaaaaaaa

SEQ ID NO: 154543 - RNA, 64 nt, Homo Sapiens
uaccaacugaaaggacacgauuauugauucuauagaaaaccauuuauauuuaaagaaagaaaua

SEQ ID NO: 154544 - RNA, 64 nt, Homo Sapiens
guucaauuuuuuaucuuguuuaaaauuagaguaugaaaaccaguuuaagcaucuuuguuuuaca

SEQ ID NO: 154545 - RNA, 64 nt, Homo Sapiens
gauccucuccuguuucucucauaaaauaccuguggaaaaccagguaugaagucauacauuuuug

SEQ ID NO: 154546 - RNA, 64 nt, Homo Sapiens
aaugacaagccaggucuuacagcugggcucuucagaaaaccagguuucuacauccaaagacugc

SEQ ID NO: 154547 - RNA, 64 nt, Homo Sapiens
aacacugcggaaggcggcaggguccucugccuaggaaaaccagagaccuuuguucacuuguuga

SEQ ID NO: 154548 - RNA, 64 nt, Homo Sapiens
uuuuaucuuuuacauggcccagaugagagaucaugaaaaccaaaaacaauacagaaggagagau

SEQ ID NO: 154549 - RNA, 64 nt, Homo Sapiens
aaccacuuuuaauaauguguguuuggaugguaucgaaaaccagaguuuaaaaauuguucauguu

SEQ ID NO: 154550 - RNA, 64 nt, Homo Sapiens
cuuggguuggcaauagaaggugacauggaauggagaaaaccaagauuccagauggggauaguaa

SEQ ID NO: 154551 - RNA, 64 nt, Homo Sapiens
gugcuucagaugcacugccugcgggugccagucugaaaaccagaccgcacagaggccuggggcu

SEQ ID NO: 154552 - RNA, 64 nt, Homo Sapiens
aucuagcauccuuagauuggauuuuuuccacugaccuacugaaugaccacagugagaaccacug

SEQ ID NO: 154553 - RNA, 64 nt, Homo Sapiens
gacgggcccccuacggagauggagcagggccauuccuacugaaggcaagugagccaagaaccua

SEQ ID NO: 154554 - RNA, 64 nt, Homo Sapiens
uuuugauguugaacuucccaaacagacaacugcaccuacugaugggaaacagacaugagcccuc

SEQ ID NO: 154555 - RNA, 64 nt, Homo Sapiens
acauauucuuguuguauuugaauguggucucuuuccuacugagcauuaccugggcuauugggga

SEQ ID NO: 154556 - RNA, 64 nt, Homo Sapiens
aaugcaauuugaaaacuacaggcuuaggacucugugccaaaaaucucuauuuuaaaugaaaaua

SEQ ID NO: 154557 - RNA, 64 nt, Homo Sapiens
augauucaagaaaugugauguagauuuuugagaaugccaaaaaucagguuucagaaaagcuaca

SEQ ID NO: 154558 - RNA, 64 nt, Homo Sapiens
aauuagaauuguuggcaugaugacauuucauuugugccaaaaauauuaaaaaugccuuuuuugg

SEQ ID NO: 154559 - RNA, 64 nt, Homo Sapiens
auguaauaaaugguuaacuuucaaaugaugcugcugccaaaauuauauuaauagugaguuucag

SEQ ID NO: 154560 - RNA, 64 nt, Homo Sapiens
cucgggguugggccucuauauggagugaccaaaaugccaaaauuguccaucugccucugaguag

SEQ ID NO: 154561 - RNA, 64 nt, Homo Sapiens
aguagggcaauggaaauaccaaaccuucugacuuugccaaaaagcauacaagcaaccuggucau

SEQ ID NO: 154562 - RNA, 64 nt, Homo Sapiens
guaauuuccaaacuucuguugauaaucugcuuugugccaaaacauaauucuguauuucuacuaa

SEQ ID NO: 154563 - RNA, 64 nt, Homo Sapiens
uucagcucuuauuuuaauggguucugaagauaaaugccaaaaauuugcagucuguuuuuuaggu

SEQ ID NO: 154564 - RNA, 64 nt, Homo Sapiens
guggcauuuucauuacaggacucugguuguucacugccaaaacugaaaauccuaauggggauuc

SEQ ID NO: 154565 - RNA, 64 nt, Homo Sapiens
aucggccaugguuugcauuuucuuaagaaauaauugccaaaaaaaggacuuuugugcaauaugg

SEQ ID NO: 154566 - RNA, 64 nt, Homo Sapiens
uguauucacuuucuuuaaaaaauccaaguaaaagugccaaaacuacacuucuguaaaucucuug

SEQ ID NO: 154567 - RNA, 64 nt, Homo Sapiens
cagcccucaagcuaugcuaggaaaaguuauaaaaugccaaaauauuuauaaacauuuacuuugu

SEQ ID NO: 154568 - RNA, 64 nt, Homo Sapiens
uugucacugcuguaaagcaaaauauuugugaaagugccaaaauaaagucugucaugccaaaagu

SEQ ID NO: 154569 - RNA, 64 nt, Homo Sapiens
aauauuugugaaagugccaaaauaaagucugucaugccaaaaguaaaucauuguauagacugac

SEQ ID NO: 154570 - RNA, 64 nt, Homo Sapiens
uagagccagcuugaaggggcaaauagagguauauugccaaaacagaaaguaauguuaaaaaaaa

SEQ ID NO: 154571 - RNA, 64 nt, Homo Sapiens
gcuuagacacaaaaacaccuuuacuaauccuaucugccaaaaugguguauacacaugcauauau

SEQ ID NO: 154572 - RNA, 64 nt, Homo Sapiens
gagacugcugaugucuguaaccacuggggagcacugccaaaaauacagcuuucugguuugugag

SEQ ID NO: 154573 - RNA, 64 nt, Homo Sapiens
uuaauuaguaugguauaaucuuuaauaaauuucgugccaaaaugcaugguuuuccacuuagcau

SEQ ID NO: 154574 - RNA, 64 nt, Homo Sapiens
aguauaaaauuuccucaccugaaguaacuuuguuugccaaaaaaguuguuuuaauaaacuauaa

SEQ ID NO: 154575 - RNA, 64 nt, Homo Sapiens
aaacaugucccaaauuucuaaaauucugcuucucugccaaaagcaaugucuuucuugguugaua

SEQ ID NO: 154576 - RNA, 64 nt, Homo Sapiens
agcucauuuauuuucuucaagcuaugaaagcagcugccaaaauauucugcuuuuggggaauugu

SEQ ID NO: 154577 - RNA, 64 nt, Homo Sapiens
guuggggaccacugcucuagaaacuggucccuggugccaaaaauuggaaaaauugucuuccaca

SEQ ID NO: 154578 - RNA, 64 nt, Homo Sapiens
cagaaaaugaacuaagacaaugcccuagaugagcugccaaaaucugagcagauaugagccauca

SEQ ID NO: 154579 - RNA, 64 nt, Homo Sapiens
uagcuugauuuaaucaucccacacuguauacauaugccaaaauaucauuuuguaugccauaaua

SEQ ID NO: 154580 - RNA, 64 nt, Homo Sapiens
uaagaugaauccaaaugugaaagaugcauguuacugccaaaaccaaauugagcucagcuuccua

SEQ ID NO: 154581 - RNA, 64 nt, Homo Sapiens
uucgcaaauguugcucuagucaguccagcucaucugccaaaauguagggcuaccgucuuggaug

SEQ ID NO: 154582 - RNA, 64 nt, Homo Sapiens
caaaaaaacaaugugcccccagaugucagaaugaggcgacuagggcaccauacucacuuuccag

SEQ ID NO: 154583 - RNA, 64 nt, Homo Sapiens
cguggguccaucguucuuccgagaggguuuguguggcgacuacacccucagcgucccuggcaag

SEQ ID NO: 154584 - RNA, 64 nt, Homo Sapiens
uuuucucuccucucuucugccucuuuucacuuuuggcgacuagaaacaauuccaguaaauguga

SEQ ID NO: 154585 - RNA, 64 nt, Homo Sapiens
ucauccuuugggaggcugacuuggacccaaacugggcgacuagggcuuugagcugggcaguuuu

SEQ ID NO: 154586 - RNA, 64 nt, Homo Sapiens
agacagccuccuuggcaagguguaggacacccaaggcgacuaaguggcauuuucggaggaaacu

SEQ ID NO: 154587 - RNA, 64 nt, Homo Sapiens
ucucaggacacccugccacaccccacggggcuugggcgacuacagggucuucgggccccagccc

SEQ ID NO: 154588 - RNA, 64 nt, Homo Sapiens
acagccuuaagaauugcagucaggaaauuaaaguggcgacuaaaacagaagacuucaagccagc

SEQ ID NO: 154589 - RNA, 64 nt, Homo Sapiens
agacugagggucuugugccucuggcuggcugucaggcgacuacacuuuccacauuauguuguag

SEQ ID NO: 154590 - RNA, 64 nt, Homo Sapiens
ccagugccccccccgcuccauagauuuuggagggggcgacuaccucauaccccaagccaggcac

SEQ ID NO: 154591 - RNA, 64 nt, Homo Sapiens
aguuaucgguuguggugcugugcagcgcucugugggcgacuaagugccacucacgcagcauguu

SEQ ID NO: 154592 - RNA, 64 nt, Homo Sapiens; identical to SEQ ID NO: 148065

SEQ ID NO: 154593 - RNA, 64 nt, Homo Sapiens; identical to SEQ ID NO: 148066

SEQ ID NO: 154594 - RNA, 64 nt, Homo Sapiens; identical to SEQ ID NO: 148067

SEQ ID NO: 154595 - RNA, 64 nt, Homo Sapiens; identical to SEQ ID NO: 148068

SEQ ID NO: 154596 - RNA, 64 nt, Homo Sapiens; identical to SEQ ID NO: 148069

SEQ ID NO: 154597 - RNA, 64 nt, Homo Sapiens; identical to SEQ ID NO: 148070

SEQ ID NO: 154598 - RNA, 64 nt, Homo Sapiens; identical to SEQ ID NO: 148071

SEQ ID NO: 154599 - RNA, 64 nt, Homo Sapiens; identical to SEQ ID NO: 148072

SEQ ID NO: 154600 - RNA, 64 nt, Homo Sapiens; identical to SEQ ID NO: 148073

SEQ ID NO: 154601 - RNA, 64 nt, Homo Sapiens; identical to SEQ ID NO: 148074

SEQ ID NO: 154602 - RNA, 64 nt, Homo Sapiens; identical to SEQ ID NO: 148075

SEQ ID NO: 154603 - RNA, 64 nt, Homo Sapiens; identical to SEQ ID NO: 148076

SEQ ID NO: 154604 - RNA, 64 nt, Homo Sapiens; identical to SEQ ID NO: 148077

SEQ ID NO: 154605 - RNA, 64 nt, Homo Sapiens; identical to SEQ ID NO: 148078

SEQ ID NO: 154606 - RNA, 64 nt, Homo Sapiens; identical to SEQ ID NO: 148079

SEQ ID NO: 154607 - RNA, 64 nt, Homo Sapiens; identical to SEQ ID NO: 148080

SEQ ID NO: 154608 - RNA, 64 nt, Homo Sapiens; identical to SEQ ID NO: 148081

SEQ ID NO: 154609 - RNA, 64 nt, Homo Sapiens; identical to SEQ ID NO: 148082

SEQ ID NO: 154610 - RNA, 64 nt, Homo Sapiens; identical to SEQ ID NO: 148083

SEQ ID NO: 154611 - RNA, 64 nt, Homo Sapiens; identical to SEQ ID NO: 148084

SEQ ID NO: 154612 - RNA, 64 nt, Homo Sapiens; identical to SEQ ID NO: 148085

SEQ ID NO: 154613 - RNA, 64 nt, Homo Sapiens; identical to SEQ ID NO: 148086

SEQ ID NO: 154614 - RNA, 64 nt, Homo Sapiens; identical to SEQ ID NO: 148087

SEQ ID NO: 154615 - RNA, 64 nt, Homo Sapiens; identical to SEQ ID NO: 148088

SEQ ID NO: 154616 - RNA, 64 nt, Homo Sapiens; identical to SEQ ID NO: 148089

SEQ ID NO: 154617 - RNA, 64 nt, Homo Sapiens; identical to SEQ ID NO: 148090

SEQ ID NO: 154618 - RNA, 64 nt, Homo Sapiens; identical to SEQ ID NO: 148091

SEQ ID NO: 154619 - RNA, 64 nt, Homo Sapiens; identical to SEQ ID NO: 148092

SEQ ID NO: 154620 - RNA, 64 nt, Homo Sapiens; identical to SEQ ID NO: 148093

SEQ ID NO: 154621 - RNA, 64 nt, Homo Sapiens; identical to SEQ ID NO: 148094

SEQ ID NO: 154622 - RNA, 64 nt, Homo Sapiens; identical to SEQ ID NO: 148095

SEQ ID NO: 154623 - RNA, 64 nt, Homo Sapiens; identical to SEQ ID NO: 148096

SEQ ID NO: 154624 - RNA, 64 nt, Homo Sapiens; identical to SEQ ID NO: 148097

SEQ ID NO: 154625 - RNA, 64 nt, Homo Sapiens; identical to SEQ ID NO: 148098

SEQ ID NO: 154626 - RNA, 64 nt, Homo Sapiens; identical to SEQ ID NO: 148099

SEQ ID NO: 154627 - RNA, 64 nt, Homo Sapiens; identical to SEQ ID NO: 148100

SEQ ID NO: 154628 - RNA, 64 nt, Homo Sapiens; identical to SEQ ID NO: 148101

SEQ ID NO: 154629 - RNA, 64 nt, Homo Sapiens; identical to SEQ ID NO: 148102

SEQ ID NO: 154630 - RNA, 63 nt, Homo Sapiens
gagauauuuugcucacuaucccuccccacuugcuucccugauaugugcucugagcuucccuga

SEQ ID NO: 154631 - RNA, 63 nt, Homo Sapiens
uccccacuugcuucccugauaugugcucugagcuucccugaaccaggaucugccuauuacugc

SEQ ID NO: 154632 - RNA, 63 nt, Homo Sapiens
agucuccagcccagcuuuuccccaaccaguggguucccugaguccagagccuaugccccuaga

SEQ ID NO: 154633 - RNA, 63 nt, Homo Sapiens
cuggggcggcccaccccugccaagcuugccaacuucccugagguggaugucuuugugcuauua

SEQ ID NO: 154634 - RNA, 63 nt, Homo Sapiens
uuguuuggcugauggaauaaagggcuuagggacuucccugaggccucuggacccaucugucuu

SEQ ID NO: 154635 - RNA, 63 nt, Homo Sapiens
aagccugaaccaugccugccaugucuugucuuauucccugaggcucccuugacucaggacugu

SEQ ID NO: 154636 - RNA, 63 nt, Homo Sapiens
cagacugccuucuuucacccuguccugauagacuucccugaucuagauauccuucgucaugac

SEQ ID NO: 154637 - RNA, 63 nt, Homo Sapiens
auuuggcccaccuccugugugggugacugacuguucccugauggcaugcccucagccacaagc

SEQ ID NO: 154638 - RNA, 63 nt, Homo Sapiens
caggaaaaugaacauggacucuuugcuaccaucuucccugaagggaagggauucggcuuucaa

SEQ ID NO: 154639 - RNA, 63 nt, Homo Sapiens
ccuaggccgucacaccacacaagaacauauuguuucccugacccagcagguguagggccugac

SEQ ID NO: 154640 - RNA, 63 nt, Homo Sapiens
cucugagcuuaugaucacacuucaaaugaccauuucccugauguuugaaucuguuuucuuagu

SEQ ID NO: 154641 - RNA, 63 nt, Homo Sapiens
cucugcaaagaguagcucauaggcauaccuuaguucccugauccauuugggugggguuucccc

SEQ ID NO: 154642 - RNA, 63 nt, Homo Sapiens
ggugggaggcgggugggugggugucugggaaguuucccugaaaccccucaccccugugugcua

SEQ ID NO: 154643 - RNA, 63 nt, Homo Sapiens
ggagcuaaaucccaccagccuuagaaauucuacuucccugacuggaagcagcuuccugggaga

SEQ ID NO: 154644 - RNA, 63 nt, Homo Sapiens
cugcccccugcuugaauugauggugccauuugauucccugacacagcaagcaaaaguugucug

SEQ ID NO: 154645 - RNA, 63 nt, Homo Sapiens
uuugucuugagcaggcaccacagaaguuguugguucccugauuaggcagccagaccucuuuuu

SEQ ID NO: 154646 - RNA, 63 nt, Homo Sapiens
agccuugaaggggguugaggccucuccuucucuuucccugaaaccccagaggaacugcuccca

SEQ ID NO: 154647 - RNA, 63 nt, Homo Sapiens
gaaccaaagcgaauuuuaaauauauauauauauuucccugaagaaaagauaaauauuauauua

SEQ ID NO: 154648 - RNA, 63 nt, Homo Sapiens
ugggagauguggaaaagccaacagaguggacuguucccugaggcucaggcccaaagccucgac

SEQ ID NO: 154649 - RNA, 63 nt, Homo Sapiens
cuucugaagguugcugucugcugagaacaccucuucccugaggguccaucuuuagcgcauggg

SEQ ID NO: 154650 - RNA, 63 nt, Homo Sapiens
ggcuugaauguguuugcccaaagaaaaaggaacuucccugaguucuacaagcuucaguaacua

SEQ ID NO: 154651 - RNA, 63 nt, Homo Sapiens
ucugcagccauggcuuugcagaacugcaccagcuucccugaugaaaucgaggaggcgagacua

SEQ ID NO: 154652 - RNA, 63 nt, Homo Sapiens
ccugggagccucacguauuugcgaaaagcgagguucccugauccaacuauugccugggaucuu

SEQ ID NO: 154653 - RNA, 63 nt, Homo Sapiens
aucugcugguagcaggcugggacagucccuuccuucccugaaacccugcucuauugcaauucc

SEQ ID NO: 154654 - RNA, 63 nt, Homo Sapiens
cucugacuuguccuaggccgauuucucuauggcuucccugagaaaggugaggcccaaaggaga

SEQ ID NO: 154655 - RNA, 63 nt, Homo Sapiens
aaccaagaacauguucuaugaaacaugccccucuucccugaaucagggcuucugauuacucag

SEQ ID NO: 154656 - RNA, 63 nt, Homo Sapiens
acagggaagcaccuggcucaguggagccacacauucccugaccuaucucaggguaggaaccau

SEQ ID NO: 154657 - RNA, 63 nt, Homo Sapiens
cgggagguguccucgccuggcagaaacguguguuucccugaugugccuucagccuccucacuc

SEQ ID NO: 154658 - RNA, 63 nt, Homo Sapiens
caguucgucccacacauccugcauuucuuaugguucccugaguguuucuccuguuuggugaaa

SEQ ID NO: 154659 - RNA, 63 nt, Homo Sapiens
acuguguugauuucuuuaaugguuugacuuuuuuucccugagggugagggaugggugggaaga

SEQ ID NO: 154660 - RNA, 63 nt, Homo Sapiens
guggucuugugaguugugcagggugaagaccgcuucccugagacaggggcaguggugcugaug

SEQ ID NO: 154661 - RNA, 63 nt, Homo Sapiens
acccagagaggaaucagacuccugcauccguaguucccugaaacuggaagcuguguccuugca

SEQ ID NO: 154662 - RNA, 63 nt, Homo Sapiens
caccaggaauguuaaagucagaaugcggccgcauucccugagugaucagugcuugaguuuggg

SEQ ID NO: 154663 - RNA, 63 nt, Homo Sapiens
ccagcuuucugcuuccugaguuaauuuuaugcuuucccugauuuccucuccucucugguaggu

SEQ ID NO: 154664 - RNA, 63 nt, Homo Sapiens
uucucuaguuagaugucaguuucuccugccucauucccugacuguucaugaggacuuugccuc

SEQ ID NO: 154665 - RNA, 63 nt, Homo Sapiens
cucgccuccuucagccuccuccucccucaucuguucccugaugucacauucccugugcaaucu

SEQ ID NO: 154666 - RNA, 63 nt, Homo Sapiens
caccaugugccagguggcaucugccuuacugccuucccugaggagcugggacaugcugggcag

SEQ ID NO: 154667 - RNA, 63 nt, Homo Sapiens
cuggauuccgaaaaggccgggaagccagucuccuucccugaagcaagcccaggagaagacucu

SEQ ID NO: 154668 - RNA, 63 nt, Homo Sapiens
uucacugguucggggcugacuuugagaucuuuguucccugaggugccaggcaggcaacuuuag

SEQ ID NO: 154669 - RNA, 63 nt, Homo Sapiens
acacccucaggccgagggugcagacugaugcucuucccugauggagacccugagaucuucccc

SEQ ID NO: 154670 - RNA, 63 nt, Homo Sapiens
guuaauccccaccgcuuucagugguagaaagaauucccugagugggccaggcuggugcccucc

SEQ ID NO: 154671 - RNA, 63 nt, Homo Sapiens
acagauaaugucuuuuaaucagcuccgcucauguucccugagcgagccacuuguaggcacauu

SEQ ID NO: 154672 - RNA, 63 nt, Homo Sapiens
cgggagucaaaaucagcauccuauaauaaagauuucccugagaucagggucaauuacagauag

SEQ ID NO: 154673 - RNA, 63 nt, Homo Sapiens
cuuccgucuaucaaaaagcccccuuggcccagguucccugagcugugggauucugcacuggug

SEQ ID NO: 154674 - RNA, 63 nt, Homo Sapiens
cugagcugugggauucugcacuggugcuuuggauucccugauauguuccuucaaaucugcuga

SEQ ID NO: 154675 - RNA, 63 nt, Homo Sapiens
uuucucaguucaggaacauugagccuuugaaaguucccugaaggaagaaacugugaaguauau

SEQ ID NO: 154676 - RNA, 63 nt, Homo Sapiens
uuuuacugaggggcugugugcauccccuccccuuucccugaucccuggacaauugaggaugcc

SEQ ID NO: 154677 - RNA, 63 nt, Homo Sapiens
uccugucuaaaaugucacccuucccugagaggcuucccugaccgucccugcucaggugucacc

SEQ ID NO: 154678 - RNA, 63 nt, Homo Sapiens
ggcuucccugaccuccuguccucaggugucaccuucccugagaucacuuuauucaagucccug

SEQ ID NO: 154679 - RNA, 63 nt, Homo Sapiens
gcagugggagaggcccucuggaaucaugggcauuucccugagaguuguugauacagcauaagu

SEQ ID NO: 154680 - RNA, 63 nt, Homo Sapiens
cacacaggcucagcucucuccaccacccagcucuucccugaccuucacgaagggauggcucuc

SEQ ID NO: 154681 - RNA, 63 nt, Homo Sapiens
aaaggagccugagugauucucuuuucuucuuguuucccugauuaugaugagcuuccauuguuc

SEQ ID NO: 154682 - RNA, 64 nt, Homo Sapiens; identical to SEQ ID NO: 128910

SEQ ID NO: 154683 - RNA, 64 nt, Homo Sapiens; identical to SEQ ID NO: 128911

SEQ ID NO: 154684 - RNA, 64 nt, Homo Sapiens; identical to SEQ ID NO: 128912

SEQ ID NO: 154685 - RNA, 64 nt, Homo Sapiens; identical to SEQ ID NO: 128913

SEQ ID NO: 154686 - RNA, 64 nt, Homo Sapiens; identical to SEQ ID NO: 128914

SEQ ID NO: 154687 - RNA, 64 nt, Homo Sapiens; identical to SEQ ID NO: 128915

SEQ ID NO: 154688 - RNA, 64 nt, Homo Sapiens; identical to SEQ ID NO: 128916

SEQ ID NO: 154689 - RNA, 64 nt, Homo Sapiens; identical to SEQ ID NO: 128917

SEQ ID NO: 154690 - RNA, 64 nt, Homo Sapiens; identical to SEQ ID NO: 128918

SEQ ID NO: 154691 - RNA, 64 nt, Homo Sapiens; identical to SEQ ID NO: 128919

SEQ ID NO: 154692 - RNA, 64 nt, Homo Sapiens; identical to SEQ ID NO: 128920

SEQ ID NO: 154693 - RNA, 64 nt, Homo Sapiens; identical to SEQ ID NO: 128921

SEQ ID NO: 154694 - RNA, 64 nt, Homo Sapiens; identical to SEQ ID NO: 128922

SEQ ID NO: 154695 - RNA, 64 nt, Homo Sapiens; identical to SEQ ID NO: 128923

SEQ ID NO: 154696 - RNA, 64 nt, Homo Sapiens; identical to SEQ ID NO: 128924

SEQ ID NO: 154697 - RNA, 64 nt, Homo Sapiens; identical to SEQ ID NO: 128925

SEQ ID NO: 154698 - RNA, 64 nt, Homo Sapiens; identical to SEQ ID NO: 128926

SEQ ID NO: 154699 - RNA, 64 nt, Homo Sapiens; identical to SEQ ID NO: 128927

SEQ ID NO: 154700 - RNA, 64 nt, Homo Sapiens; identical to SEQ ID NO: 128928

SEQ ID NO: 154701 - RNA, 64 nt, Homo Sapiens; identical to SEQ ID NO: 128929

SEQ ID NO: 154702 - RNA, 64 nt, Homo Sapiens; identical to SEQ ID NO: 128930

SEQ ID NO: 154703 - RNA, 64 nt, Homo Sapiens; identical to SEQ ID NO: 128931

SEQ ID NO: 154704 - RNA, 64 nt, Homo Sapiens; identical to SEQ ID NO: 128932

SEQ ID NO: 154705 - RNA, 64 nt, Homo Sapiens; identical to SEQ ID NO: 128933

SEQ ID NO: 154706 - RNA, 64 nt, Homo Sapiens; identical to SEQ ID NO: 128934

SEQ ID NO: 154707 - RNA, 64 nt, Homo Sapiens; identical to SEQ ID NO: 128935

SEQ ID NO: 154708 - RNA, 64 nt, Homo Sapiens; identical to SEQ ID NO: 128936

SEQ ID NO: 154709 - RNA, 64 nt, Homo Sapiens; identical to SEQ ID NO: 128937

SEQ ID NO: 154710 - RNA, 64 nt, Homo Sapiens; identical to SEQ ID NO: 128938

SEQ ID NO: 154711 - RNA, 64 nt, Homo Sapiens; identical to SEQ ID NO: 128939

SEQ ID NO: 154712 - RNA, 64 nt, Homo Sapiens; identical to SEQ ID NO: 128940

SEQ ID NO: 154713 - RNA, 64 nt, Homo Sapiens; identical to SEQ ID NO: 128941

SEQ ID NO: 154714 - RNA, 64 nt, Homo Sapiens; identical to SEQ ID NO: 128942

SEQ ID NO: 154715 - RNA, 64 nt, Homo Sapiens; identical to SEQ ID NO: 128943

SEQ ID NO: 154716 - RNA, 64 nt, Homo Sapiens
gauguuuuuaggcacagaaguuggagaagagauuucaugaaagacaacaucacugcauugagag

SEQ ID NO: 154717 - RNA, 64 nt, Homo Sapiens
auuuccuaaaaucaugucuugaaaacauguuuucucaugaaacuugaauacuaucucaaauagg

SEQ ID NO: 154718 - RNA, 64 nt, Homo Sapiens
cagaauuaggcauauguacaaaaccaaaauuuugucaugaaauuuugccuuuccacgcuucccu

SEQ ID NO: 154719 - RNA, 64 nt, Homo Sapiens
ggccuaaugaggugauuaggugaagucucugcccucaugaaaagauuaaucccauuaucucagg

SEQ ID NO: 154720 - RNA, 64 nt, Homo Sapiens
cguucuaaaagugaaucaauagacaagcaauccaucaugaaauuaucuaugaauucaucaugaa

SEQ ID NO: 154721 - RNA, 64 nt, Homo Sapiens
caagcaauccaucaugaaaucaucuaugaauucaucaugaaagaaauuuaagaaauaggaaagu

SEQ ID NO: 154722 - RNA, 63 nt, Homo Sapiens
gcuaguucuuuuaaguuuguagaaauaaaauuuaucaugaaaucagaacuguaugaccccuuu

SEQ ID NO: 154723 - RNA, 64 nt, Homo Sapiens
uuauugugaacaauuuagauauaagcauguuuuaucaugaaaaauaagcauguguauauaauaa

SEQ ID NO: 154724 - RNA, 64 nt, Homo Sapiens
uaacaaaucaaauugcacuuuuggaagcccggugucaugaaaugaaaccaaaccucggugccau

SEQ ID NO: 154725 - RNA, 64 nt, Homo Sapiens
ugaguuguauaaaauacauacucccuaaacuagaucaugaaacugguuucuguuuuaugcaguu

SEQ ID NO: 154726 - RNA, 64 nt, Homo Sapiens
accuaggauuguacaguuuaccauaaaauuuacuucaugaaagugggaaucacugaacauguag

SEQ ID NO: 154727 - RNA, 64 nt, Homo Sapiens
guuuaagagagauuuuggucuuaaaggcuucacaucaugaaaguguacaugcauaugcaagugu

SEQ ID NO: 154728 - RNA, 64 nt, Homo Sapiens
guuguuuucaugugguuauuacgugauauuugguucaugaaagaaguuagacauaaugcauaua

SEQ ID NO: 154729 - RNA, 64 nt, Homo Sapiens
aauauauuauuaacaugaauaaaccauuuuucuuucaugaaaaucacuuguguuucuacacagc

SEQ ID NO: 154730 - RNA, 64 nt, Homo Sapiens
gacuuuuacagguaagugcaaaggagaagugguuucaugaaauguucuaauguauaauaacauu

SEQ ID NO: 154731 - RNA, 64 nt, Homo Sapiens
auuugauuaucuuaaaaauuguuaaauaccguuuucaugaaauuucucaguauuguaacagcaa

SEQ ID NO: 154732 - RNA, 64 nt, Homo Sapiens
cauuccaaaguuauugccuacuaaguaaugacugucaugaaagcagcauugaaauaauuuguuu

SEQ ID NO: 154733 - RNA, 64 nt, Homo Sapiens
cagaaacauaugggcugauaaacccggggugaccucaugaaaugaguugcagcagaaguuuauu

SEQ ID NO: 154734 - RNA, 64 nt, Homo Sapiens
guaaaauacuucaucauauuauaaguugcagacaucaugaaaauuauucuugaaccuucugaaa

SEQ ID NO: 154735 - RNA, 64 nt, Homo Sapiens
uuuguccaagcuaagaaaggacaaaagacuagaaucaugaaaucuaaagcccucuguggcugcc

SEQ ID NO: 154736 - RNA, 64 nt, Homo Sapiens
aaacuuuguaacuuauuguagcuuaacuucaucuucaugaaauggggagggaggguuuaucacu

SEQ ID NO: 154737 - RNA, 64 nt, Homo Sapiens
cugaugaaaaaugccuccaacaccauuuugaugaucaugaaacgugggagaaacuuugugaaug

SEQ ID NO: 154738 - RNA, 64 nt, Homo Sapiens
uugaggaagauuggguaaugcugauguguuccauucaugaaacuguauuugauacauaauccua

SEQ ID NO: 154739 - RNA, 64 nt, Homo Sapiens
uccauauuuuaaggaaggagcuaaaaauggaaauucaugaaacauaaaugguaucaagaacuuu

SEQ ID NO: 154740 - RNA, 64 nt, Homo Sapiens
ccucuccgcauugccuauugauacacuuuacuaaucaugaaauucuaaccuaaaaggaaaacau

SEQ ID NO: 154741 - RNA, 64 nt, Homo Sapiens
uuguacuuuuuaauaagauggucuuguugaaaguucaugaaacuccuggcauauuuauuuugca

SEQ ID NO: 154742 - RNA, 64 nt, Homo Sapiens
uuuggugauaaaguauuuugcaauaaaugucauuucaugaaauccagacucacgcuuuuuuaaa

SEQ ID NO: 154743 - RNA, 64 nt, Homo Sapiens
ugggaacagccauguuaacgugagcaaauuccucucaugaaauagccugcagcuauuaagaagc

SEQ ID NO: 154744 - RNA, 64 nt, Homo Sapiens
ccucaccgcgccagcgugaaguucccgggcauggucaugaaagcgugguucuguaagaaaucag

SEQ ID NO: 154745 - RNA, 64 nt, Homo Sapiens
cuuguaagauacuuauuuugaggaaaacaauguuucaugaaacauaauguugaauuugccuuuu

SEQ ID NO: 154746 - RNA, 64 nt, Homo Sapiens
caaaaaguauuugaaacguaaggaaaaaacagcaucaugaaaggagagucacccguggcuccua

SEQ ID NO: 154747 - RNA, 64 nt, Homo Sapiens
aaaacucagcaauaauuugggcagcuaaugaaugucaugaaagcuguagaaucuacaucaccau

SEQ ID NO: 154748 - RNA, 64 nt, Homo Sapiens
uaaugucuguuuccaggguucagaaaaggcaaacucaugaaaugccacugaaaagaacuuucaa

SEQ ID NO: 154749 - RNA, 64 nt, Homo Sapiens
ugcccauccaggagaaguggguaguaauucuucaucaugaaaaugauauauuacauauuuagua

SEQ ID NO: 154750 - RNA, 64 nt, Homo Sapiens
ggagcagaggaauugcaauuaauccuccuugguaucaugaaacuucagagauaccaucuugaga

SEQ ID NO: 154751 - RNA, 64 nt, Homo Sapiens
acagagcucagagauaccauuuccuugguguggcucaugaaaucuucaguuguaguuuggaagg

SEQ ID NO: 154752 - RNA, 64 nt, Homo Sapiens
ggaaagccuuuguuuccuucacuuccuuucgauaucaugaaaggacucacacuggagagaaccc

SEQ ID NO: 154753 - RNA, 64 nt, Homo Sapiens
gcaaagcuuucacuucuuccaguucuuuucaauaucaugaaagaacacacuagggagaaacccu

SEQ ID NO: 154754 - RNA, 64 nt, Homo Sapiens
caaaagccuuuauuucuuccacuucuuuucaauaucaugaaaggacucacaugggagagaaacc

SEQ ID NO: 154755 - RNA, 64 nt, Homo Sapiens
ggaaagccuucauuucuucuaguucccuucaauaucaugaaaggacucacacuggagagaagcc

SEQ ID NO: 154756 - RNA, 64 nt, Homo Sapiens
guaaagccuucaaucuuuccaguuccuuucaguaucaugaaaggacucacacuggagagaaacc

SEQ ID NO: 154757 - RNA, 64 nt, Homo Sapiens
ggaaagccuucagaucugccucacaccuucaaauucaugaaaggacacaaacacacauaagaau

SEQ ID NO: 154758 - RNA, 64 nt, Homo Sapiens
ggaaagccuucagaucugccaagaaccuucgaauucaugaaaggacacaaacacacguaagaau

SEQ ID NO: 154759 - RNA, 64 nt, Homo Sapiens
caaauuuuaucuuuuacaugagauagaugagagaucaugaaaacuauaaacaauacagaaggag

SEQ ID NO: 154760 - RNA, 64 nt, Homo Sapiens
acuugccuuacaaggcucuagguaaguguccuugucaugaaaacggaccacaugaguucugguu

SEQ ID NO: 154761 - RNA, 64 nt, Homo Sapiens
acauaugauaaugauaccaaaggaaagauaauuaucaugaaaccaacuuuuggaucauucccuu

SEQ ID NO: 154762 - RNA, 64 nt, Homo Sapiens
uagcaagguuugagaugcuauauuaacauuuaaaucaugaaaaugagcaaguaaauagaauaau

SEQ ID NO: 154763 - RNA, 64 nt, Homo Sapiens
gcccuggccucccucccccuaccucacacgcugcucaugaaaguuuccacccacgcugucucca

SEQ ID NO: 154764 - RNA, 64 nt, Homo Sapiens
aaauaaauccuaccugguuuuuaaauuuuauuuuucaugaaaaugcuccuuucucuacauuuau

SEQ ID NO: 154765 - RNA, 64 nt, Homo Sapiens
uggucccauuccagacaggggccucuggccuggcugaguucacagcccagucuggggacagcug

SEQ ID NO: 154766 - RNA, 64 nt, Homo Sapiens
uugggaggacucacugacauaccuaccuucaagaugaguucaggugggcucaguucuggggcuu

SEQ ID NO: 154767 - RNA, 64 nt, Homo Sapiens
agaggauagcgguuuccaucauaaaccaagaugaugaguucagccuuuaucccucgugguucca

SEQ ID NO: 154768 - RNA, 64 nt, Homo Sapiens
agaggauagcgguuuccaucauaaaccaagaugaugaguucagccuuuaucccucgugguuccg

SEQ ID NO: 154769 - RNA, 64 nt, Homo Sapiens
uuuuauuuucugaacuugauguuuuugcauucuuugaguucaguuuaaagacaacuacgagcau

SEQ ID NO: 154770 - RNA, 64 nt, Homo Sapiens
gguuagaguucaucagaaacagaauucuaaaaugugaguucaauucaauaaauuugaauuucug

SEQ ID NO: 154771 - RNA, 64 nt, Homo Sapiens
aggcagagguaugcuccugcuguaaucaggcaaaugaguucaacuggauuucuuuugacaauac

SEQ ID NO: 154772 - RNA, 64 nt, Homo Sapiens
uuuguaacauugugcuuccuuguaguuuguaaugugaguucaaucaguauuuauguugaaauuu

SEQ ID NO: 154773 - RNA, 64 nt, Homo Sapiens
ucaauaaauuugaauuucugagaauucuaaaaugugaguucaaugguuagaguucaucagaaac

SEQ ID NO: 154774 - RNA, 64 nt, Homo Sapiens
uuaaagacaacuacgagcauguuuuugcauucuuugaguucaguuuuuauuuucugaacuugau

SEQ ID NO: 154775 - RNA, 64 nt, Homo Sapiens
ucggaaaauucacccuaaaagucucacaaaagaaugaguucauggggagauucuguaaagugau

SEQ ID NO: 154776 - RNA, 64 nt, Homo Sapiens
aagcugucagcugaaccugacugaguguucuuccugaguucacgaggauaggcuagagugcauu

SEQ ID NO: 154777 - RNA, 64 nt, Homo Sapiens
aaaaauaauuguccuuuuuucuuucuuucuuuuuuuacaauaaggcucuugaaaauugucauua

SEQ ID NO: 154778 - RNA, 64 nt, Homo Sapiens
acucuagcccugacuaugaugccccugugugcauuuacaauaaagacuccaacggagggagccu

SEQ ID NO: 154779 - RNA, 64 nt, Homo Sapiens
aaauccuucccauccaucuguuuacuacaauagguuacaauaauucacugaucacauccauuuu

SEQ ID NO: 154780 - RNA, 64 nt, Homo Sapiens
acuuucacacaagggucuguaacaauuguauaucuuacaauauuuuuccuugcauuguaauuuu

SEQ ID NO: 154781 - RNA, 64 nt, Homo Sapiens
uaacccccuuaaauuuaauaccagauaccuuaucuuacaauauugauugggaaaacauuugcug

SEQ ID NO: 154782 - RNA, 64 nt, Homo Sapiens
uguagaggcuuguuuaccuuucucucucuaagguuuacaauaggaguggugauuugaaaaauau

SEQ ID NO: 154783 - RNA, 64 nt, Homo Sapiens
gaacaacuguuaagauggaaucacauauaaaaucuuacaauacauuauaguaguacauuaugaa

SEQ ID NO: 154784 - RNA, 64 nt, Homo Sapiens
aacaugcacauggaaacccaguaguuaauuuucauuacaauagagcagaaaacguucagauuuu

SEQ ID NO: 154785 - RNA, 64 nt, Homo Sapiens
ugcacuaaauagugcacugcaagaccagaaaauuuuacaauauuuuuucuuuacaauauguucu

SEQ ID NO: 154786 - RNA, 64 nt, Homo Sapiens
cugcaagaccagaaaauuuuacaauauuuuuucuuuacaauauguucuguaguauguuuacccu

SEQ ID NO: 154787 - RNA, 64 nt, Homo Sapiens
cuacuuuaacuaguuuuauaaauuucuuaauauguuacaauaacuuagggacauuuugacaccc

SEQ ID NO: 154788 - RNA, 64 nt, Homo Sapiens
agcuauauuuccacuuagaaaaacuaagguaauuuuacaauauaugcugagauuaaaaaccaag

SEQ ID NO: 154789 - RNA, 64 nt, Homo Sapiens
ugaaauacaaggaaaugcaguaaagccagggaauuuacaauaacauuuccguuuccaucauuga

SEQ ID NO: 154790 - RNA, 64 nt, Homo Sapiens
gguuuguguauauauacauauacaaauacaacauuuacaauaaauaaaauacuugaaauucucu

SEQ ID NO: 154791 - RNA, 64 nt, Homo Sapiens
uuuuuacuaugauauccauuuuccagaauugugauuacaauaugcaaagagucauaaauaugcc

SEQ ID NO: 154792 - RNA, 64 nt, Homo Sapiens
gauuacaauaugcaaagagucauaaauaugccauuuacaauaaggaggaggcaaggcaaaugca

SEQ ID NO: 154793 - RNA, 64 nt, Homo Sapiens
gaguucuuaaaauuuugucagagccuucuucauuuuacaauauuuuguuauuuuuauuuuaccu

SEQ ID NO: 154794 - RNA, 64 nt, Homo Sapiens
aauauuuuguuauuuuuauuuuaccuuuuucauuuuacaauauuucguuauuuuuauuuuaccu

SEQ ID NO: 154795 - RNA, 64 nt, Homo Sapiens
augaaauuucacuucaggagguauuuuuguuaguuuacaauauuuuauuuugggaagaaaaccu

SEQ ID NO: 154796 - RNA, 64 nt, Homo Sapiens
ugaagauuacccucaaaugcagguaaccuuauauuuacaauaaaaaacaaaauugcaauuucuu

SEQ ID NO: 154797 - RNA, 64 nt, Homo Sapiens
caauugucuauauggaauuuaggauaaagaauauuuacaauaaagaauauuuacaauaaagagu

SEQ ID NO: 154798 - RNA, 64 nt, Homo Sapiens
auuuaggauaaagaauauuuacaauaaagaauauuuacaauaaagaguuuauuauuauuuguaa

SEQ ID NO: 154799 - RNA, 64 nt, Homo Sapiens
auuaauuggcuauauggaauuuaggauagaauauuuacaauaaagaguauuuacaauaaagagu

SEQ ID NO: 154800 - RNA, 64 nt, Homo Sapiens
gaauuuaggauagaauauuuacaauaaagaguauuuacaauaaagaguuuguuauuauuuguaa

SEQ ID NO: 154801 - RNA, 64 nt, Homo Sapiens
gcuaaguuugcaugaaaacucuaucuaaaagaagaaaacugauguccauauggacuguggauac

SEQ ID NO: 154802 - RNA, 64 nt, Homo Sapiens
aaaaaauuaguuuaaauuugugauucaaccugagaaaacugauuuuacauuucaaaagugaacu

SEQ ID NO: 154803 - RNA, 64 nt, Homo Sapiens
guugggaaaaggacuucccuaaugucuaacauccaaaacugagguuuguaauuuuuuuucuaca

SEQ ID NO: 154804 - RNA, 64 nt, Homo Sapiens
ucccauuucacagcaauaguugcagaagaauugcaaaacugacaaucccagcuuggugggaaag

SEQ ID NO: 154805 - RNA, 64 nt, Homo Sapiens
ccuuuaaacagcaguuuguaaacuaugcaacugaaaaacugaggaugauuguuagcuccacgag

SEQ ID NO: 154806 - RNA, 64 nt, Homo Sapiens
acuaauaaauguguuuuuacuuuuuauucccguuaaaacugauguaaaacaggauaaaggcuug

SEQ ID NO: 154807 - RNA, 64 nt, Homo Sapiens
uguucucaauaucaacauauuguuagcaaaacugaaaacugaaauuaugauuaagcuuaaaccc

SEQ ID NO: 154808 - RNA, 64 nt, Homo Sapiens
acugaaauguucucaauaucuaaacccuguuagcaaaacugaaagcaauuguuaugauuaagcu

SEQ ID NO: 154809 - RNA, 64 nt, Homo Sapiens
agccuguggcccauugggugauuuccuguauuuuaaaacugacaguagccugaucaaagugaua

SEQ ID NO: 154810 - RNA, 64 nt, Homo Sapiens
ucauauccacaauuccaaaaucuccaaaccucugaaaacugaaauauuuuucauaaauuaggcg

SEQ ID NO: 154811 - RNA, 64 nt, Homo Sapiens
acagaaacuacauuguaaccuguuugucuuucuuaaaacugacauuuguuguuaaugucauuug

SEQ ID NO: 154812 - RNA, 64 nt, Homo Sapiens
guaaauccuaaucuuagaguuaucaaaagaagaaaaaacugaagguacuuuacucccuauagag

SEQ ID NO: 154813 - RNA, 64 nt, Homo Sapiens
agcugggaggcauuacauagucaugugcgaggucaaaacugagucaccaccacaaccaaguucc

SEQ ID NO: 154814 - RNA, 64 nt, Homo Sapiens
ugagacuuggucucuaaaaaagaaaaaaaaaaauaaaacugauguaaugaauauauaauuacaa

SEQ ID NO: 154815 - RNA, 64 nt, Homo Sapiens
uucauagacuuuuccaauccuuaguuaaauauuaaaaacugaguauuguaguuauuugcuaggu

SEQ ID NO: 154816 - RNA, 64 nt, Homo Sapiens
aaauuugauguuaugcaaacccaacucaaaagcuaaaacugaaccuuuaagcaaacuacuacag

SEQ ID NO: 154817 - RNA, 64 nt, Homo Sapiens
cccucuuuccaggaccucagaacucgugcaagacaaaacugaaaucaacgaauaguaaauaaug

SEQ ID NO: 154818 - RNA, 64 nt, Homo Sapiens
ugauuauguggucacacccaagucacagaaauaaaaaacugacuuuaccgcugcaauuuuucug

SEQ ID NO: 154819 - RNA, 64 nt, Homo Sapiens
aacagugguuuuauuuuuuccucuacucaaaguuaaaacugaccaaaguuacuggcuuuuuacu

SEQ ID NO: 154820 - RNA, 64 nt, Homo Sapiens
aacuaagguuauuugaauguaacuccuugauuguaaaacugaaaaaaaaaauagcaucuagucc

SEQ ID NO: 154821 - RNA, 64 nt, Homo Sapiens
gaaauaugaaugucgagggguaaaaucuauauugaaaacugacaguuugcauacagugaacaca

SEQ ID NO: 154822 - RNA, 64 nt, Homo Sapiens
aagauguugcaugcucuugauuacaaugaagacuaaaacugaacuuaacuaaaggguaguuguu

SEQ ID NO: 154823 - RNA, 64 nt, Homo Sapiens
ugaaauaaugcuuguaaucauaagaaccgcaaugaaaacugacuuuggauaaauagcacauuua

SEQ ID NO: 154824 - RNA, 64 nt, Homo Sapiens
auaaaauaccugcucaauuuaaaaaucugucguuaaaacugaggaacuugcaauauuuuugcaa

SEQ ID NO: 154825 - RNA, 64 nt, Homo Sapiens
aguuuugagagaucguuaauugguuuacuugcacaaaacugaucaagucuuuuuaaaagaaaca

SEQ ID NO: 154826 - RNA, 64 nt, Homo Sapiens
agcaacacugaauacuguagcuguuuuaaguuagaaaacugaauuugcugccaguuaucauagg

SEQ ID NO: 154827 - RNA, 64 nt, Homo Sapiens
gugucuacaguuuauccauauaacuucucuucugaaaacugaggaguguccucuguucuuccag

SEQ ID NO: 154828 - RNA, 64 nt, Homo Sapiens
caucacauggaacuguaaggccauauaacuacacaaaacugaccaaucuggguugccaaagcag

SEQ ID NO: 154829 - RNA, 64 nt, Homo Sapiens
aaauuuagcaggaaaaaagagaacaucaccuuguaaaacugaagauugugaccagucagaauaa

SEQ ID NO: 154830 - RNA, 64 nt, Homo Sapiens
acuacaagaagaauguaguugugcaaaucuaugcaaaacugaugguggccugcuauuuccuuca

SEQ ID NO: 154831 - RNA, 64 nt, Homo Sapiens
cagcugugugauauucugcugugcaaauccaugcaaaacugacugugguagugaaaagucugua

SEQ ID NO: 154832 - RNA, 64 nt, Homo Sapiens
aguuucacauaauuacacacaauaguaugggaaaaaaacugaaggcuucaggauugucugguua

SEQ ID NO: 154833 - RNA, 64 nt, Homo Sapiens
aguguaaaaaggaaaacccagugcaucgacacuaaaaacugaucucaaccaucuuuaagguauu

SEQ ID NO: 154834 - RNA, 64 nt, Homo Sapiens
uguguaucauuaaaauauauguucugcaagaauuaaaacugaguccaugaaaauaccauaggaa

SEQ ID NO: 154835 - RNA, 64 nt, Homo Sapiens
ucaguaucuuagaguuuacaguuuguguuuuaaaaaaacugaagguuuuuuuuuuaagugcaac

SEQ ID NO: 154836 - RNA, 64 nt, Homo Sapiens
cacgagcaaagugaagacacuauuuuacaauuguaaaacugaggcaguauucuagguagugccc

SEQ ID NO: 154837 - RNA, 64 nt, Homo Sapiens
cucagacaggaaagggaaggcaggcugcuggaggaaaacugagaacugugccuuugaguuuccu

SEQ ID NO: 154838 - RNA, 64 nt, Homo Sapiens
uaacugggacuguagcccguccaaguugacacauaaaacugaccaucgggccgggggcgguggc

SEQ ID NO: 154839 - RNA, 64 nt, Homo Sapiens
gcgacagggcaagacucugucucaaaaaaaauaaaaaacugaccaucuaguccuugucaucugg

SEQ ID NO: 154840 - RNA, 64 nt, Homo Sapiens
ccaacuagauuagcaaauguagagcauugugggaaaaacugaguucaaaacuaggugagaaaau

SEQ ID NO: 154841 - RNA, 64 nt, Homo Sapiens
gauaauggagaaaauaauuuucaaguuaugaaauaaaacugagauagccgacaaugguagcuuc

SEQ ID NO: 154842 - RNA, 64 nt, Homo Sapiens
aacuuuggggggaauuuuguaaacugaaaaaaaaaaaacugaaguuauuacuuuguaauuuaaa

SEQ ID NO: 154843 - RNA, 64 nt, Homo Sapiens
aaaaaaaaacugaagaacuuacuuuguaauuuaaaaaacugaaaaaagagcaaagcuuuuuauu

SEQ ID NO: 154844 - RNA, 64 nt, Homo Sapiens
gguauuguuggaaagcaggaaaauguuugcuuuuaaaacugauauuuucuuuaguuuuaauuga

SEQ ID NO: 154845 - RNA, 64 nt, Homo Sapiens
ggaauuuuuccacaccuugaauccugagagcuaaaaaacugaaaacaguauugcagucuugaaa

SEQ ID NO: 154846 - RNA, 64 nt, Homo Sapiens
uaaucuaguucaaugcccuuauuuuacagaugggaaaacugaggccuggagguaggaagggacu

SEQ ID NO: 154847 - RNA, 64 nt, Homo Sapiens
agcugccugagaaccuaaauuucagcaacagugaaaaacugagaugaaagauguauaauguaga

SEQ ID NO: 154848 - RNA, 64 nt, Homo Sapiens
uagguaucauuccaaccucuauuuuacagaugagaaaacugaagcacagagaaguuaagugacu

SEQ ID NO: 154849 - RNA, 64 nt, Homo Sapiens; identical to SEQ ID NO: 138852

SEQ ID NO: 154850 - RNA, 64 nt, Homo Sapiens; identical to SEQ ID NO: 138853

SEQ ID NO: 154851 - RNA, 64 nt, Homo Sapiens; identical to SEQ ID NO: 138854

SEQ ID NO: 154852 - RNA, 64 nt, Homo Sapiens; identical to SEQ ID NO: 138855

SEQ ID NO: 154853 - RNA, 64 nt, Homo Sapiens; identical to SEQ ID NO: 138856

SEQ ID NO: 154854 - RNA, 64 nt, Homo Sapiens; identical to SEQ ID NO: 138857

SEQ ID NO: 154855 - RNA, 64 nt, Homo Sapiens; identical to SEQ ID NO: 138858

SEQ ID NO: 154856 - RNA, 64 nt, Homo Sapiens; identical to SEQ ID NO: 138859

SEQ ID NO: 154857 - RNA, 64 nt, Homo Sapiens; identical to SEQ ID NO: 138860

SEQ ID NO: 154858 - RNA, 64 nt, Homo Sapiens; identical to SEQ ID NO: 138861

SEQ ID NO: 154859 - RNA, 64 nt, Homo Sapiens; identical to SEQ ID NO: 138862

SEQ ID NO: 154860 - RNA, 64 nt, Homo Sapiens; identical to SEQ ID NO: 138863

SEQ ID NO: 154861 - RNA, 64 nt, Homo Sapiens; identical to SEQ ID NO: 138864

SEQ ID NO: 154862 - RNA, 64 nt, Homo Sapiens; identical to SEQ ID NO: 138865

SEQ ID NO: 154863 - RNA, 64 nt, Homo Sapiens; identical to SEQ ID NO: 138866

SEQ ID NO: 154864 - RNA, 64 nt, Homo Sapiens; identical to SEQ ID NO: 138867

SEQ ID NO: 154865 - RNA, 64 nt, Homo Sapiens; identical to SEQ ID NO: 138868

SEQ ID NO: 154866 - RNA, 64 nt, Homo Sapiens; identical to SEQ ID NO: 138869

SEQ ID NO: 154867 - RNA, 64 nt, Homo Sapiens; identical to SEQ ID NO: 138870

SEQ ID NO: 154868 - RNA, 64 nt, Homo Sapiens; identical to SEQ ID NO: 138871

SEQ ID NO: 154869 - RNA, 64 nt, Homo Sapiens; identical to SEQ ID NO: 138872

SEQ ID NO: 154870 - RNA, 64 nt, Homo Sapiens; identical to SEQ ID NO: 138873

SEQ ID NO: 154871 - RNA, 64 nt, Homo Sapiens; identical to SEQ ID NO: 138874

SEQ ID NO: 154872 - RNA, 64 nt, Homo Sapiens; identical to SEQ ID NO: 138875

SEQ ID NO: 154873 - RNA, 64 nt, Homo Sapiens; identical to SEQ ID NO: 138876

SEQ ID NO: 154874 - RNA, 64 nt, Homo Sapiens; identical to SEQ ID NO: 138877

SEQ ID NO: 154875 - RNA, 64 nt, Homo Sapiens; identical to SEQ ID NO: 138878

SEQ ID NO: 154876 - RNA, 64 nt, Homo Sapiens; identical to SEQ ID NO: 138879

SEQ ID NO: 154877 - RNA, 64 nt, Homo Sapiens; identical to SEQ ID NO: 138880

SEQ ID NO: 154878 - RNA, 64 nt, Homo Sapiens; identical to SEQ ID NO: 138881

SEQ ID NO: 154879 - RNA, 64 nt, Homo Sapiens; identical to SEQ ID NO: 138882

SEQ ID NO: 154880 - RNA, 64 nt, Homo Sapiens; identical to SEQ ID NO: 138883

SEQ ID NO: 154881 - RNA, 64 nt, Homo Sapiens; identical to SEQ ID NO: 138884

SEQ ID NO: 154882 - RNA, 64 nt, Homo Sapiens; identical to SEQ ID NO: 138885

SEQ ID NO: 154883 - RNA, 64 nt, Homo Sapiens; identical to SEQ ID NO: 138886

SEQ ID NO: 154884 - RNA, 64 nt, Homo Sapiens; identical to SEQ ID NO: 138887

SEQ ID NO: 154885 - RNA, 64 nt, Homo Sapiens; identical to SEQ ID NO: 138888

SEQ ID NO: 154886 - RNA, 64 nt, Homo Sapiens; identical to SEQ ID NO: 138889

SEQ ID NO: 154887 - RNA, 64 nt, Homo Sapiens; identical to SEQ ID NO: 138890

SEQ ID NO: 154888 - RNA, 64 nt, Homo Sapiens; identical to SEQ ID NO: 138891

SEQ ID NO: 154889 - RNA, 64 nt, Homo Sapiens; identical to SEQ ID NO: 138892

SEQ ID NO: 154890 - RNA, 64 nt, Homo Sapiens
uauggagagauccuccuuuacccucuugaaauuucuuagccagcaacuuguucugcaggggccc

SEQ ID NO: 154891 - RNA, 64 nt, Homo Sapiens
uuguccuccacuagaggggcuaagcuugacugcccuuagccaggcaagcacaguaauguguguu

SEQ ID NO: 154892 - RNA, 64 nt, Homo Sapiens
ugcuaaaaugccuuuguuuuuuuguuauuauuuucuuagccagaacaucucucuuugaacucac

SEQ ID NO: 154893 - RNA, 64 nt, Homo Sapiens
uagugcuggugaaaagguagggcugagugauuaccuuagccacaggguggcugagcaggaacuu

SEQ ID NO: 154894 - RNA, 64 nt, Homo Sapiens
gcagccaaaacaccaggaaacacauuucuguggccuuagccaagcaguuuguuaguuacauauu

SEQ ID NO: 154895 - RNA, 64 nt, Homo Sapiens
gggguggucaaccugagaacauuuauuugaaccucuuagccacauuuccagcagggcaaaccaa

SEQ ID NO: 154896 - RNA, 64 nt, Homo Sapiens
cauccccugccugaacgaagacuuccgccgcgaagcccgauagaucgggggaaaauggggccuu

SEQ ID NO: 154897 - RNA, 64 nt, Homo Sapiens
gucuuuuaaauguuugaggauuuaaagugguaaugcccgauaauugcuaguacagugucaguua

SEQ ID NO: 154898 - RNA, 64 nt, Homo Sapiens
aguccucugaagacaaugagaggauuuaggaugagcccgauagguguggcagaccaaauggaca

SEQ ID NO: 154899 - RNA, 64 nt, Homo Sapiens
caaaugaguaagcagugccaccaacuaguguuuugcccgauagaagagccagcauguucacguu

SEQ ID NO: 154900 - RNA, 64 nt, Homo Sapiens
gccagcagccacaaggccuucaugagacaaaggggcccgauaggcaggagaagugcucaaucuu

SEQ ID NO: 154901 - RNA, 55 nt, Homo Sapiens
gacuuacuguggaaagcugagaacugcccgauacacggcaucaucccaucucuaa

SEQ ID NO: 154902 - RNA, 64 nt, Homo Sapiens
cccaccuugagccagagucaagggcugcagcacugcccgauagaacacgcccgcccucacugcu

SEQ ID NO: 154903 - RNA, 64 nt, Homo Sapiens
ucugaagaaaaggucagaucuauuggaaaugacagcccgauacuugagccuccucuuuaaaagg

SEQ ID NO: 154904 - RNA, 64 nt, Homo Sapiens
gguaagaggaauaauauggguaaaacaagaaauggcccgauaguuucacacuauuccuauaccu

SEQ ID NO: 154905 - RNA, 64 nt, Homo Sapiens
gcugcauccaggacugugccagcacaaagugggagcccgauaaauauuuauugaagaaaugaaa

SEQ ID NO: 154906 - RNA, 64 nt, Homo Sapiens
cuaacauaaguuuucacuguggugggauggugccgcccgauaugcuugauaugcuuuuccuucc

SEQ ID NO: 154907 - RNA, 64 nt, Homo Sapiens
aggcaucuccaggcaaggaaaacugaagucauuggcccgauacaaaacauuuccugcaacgaag

SEQ ID NO: 154908 - RNA, 64 nt, Homo Sapiens
ucuacagccgucccgcguucaagacuugagcggagcccgauauucucccugaccuuagcguucu

SEQ ID NO: 154909 - RNA, 64 nt, Homo Sapiens
gacggauucuaaggacucuaugcgaaggaugaucgcccgauaaagcccguggacaccccagacc

SEQ ID NO: 154910 - RNA, 64 nt, Homo Sapiens
uguaaagaucuacucucacagaagccuaaugaaagcccgauaugaacagaauuuguacagguga

SEQ ID NO: 154911 - RNA, 64 nt, Homo Sapiens
aaccauuugaagcuuucugggacuucuguggagggcccgauaguugcuguauggagagugggca

SEQ ID NO: 154912 - RNA, 64 nt, Homo Sapiens; identical to SEQ ID NO: 128601

SEQ ID NO: 154913 - RNA, 64 nt, Homo Sapiens; identical to SEQ ID NO: 128602

SEQ ID NO: 154914 - RNA, 64 nt, Homo Sapiens; identical to SEQ ID NO: 128603

SEQ ID NO: 154915 - RNA, 64 nt, Homo Sapiens; identical to SEQ ID NO: 128604

SEQ ID NO: 154916 - RNA, 64 nt, Homo Sapiens; identical to SEQ ID NO: 128605

SEQ ID NO: 154917 - RNA, 64 nt, Homo Sapiens; identical to SEQ ID NO: 128606

SEQ ID NO: 154918 - RNA, 64 nt, Homo Sapiens; identical to SEQ ID NO: 128607

SEQ ID NO: 154919 - RNA, 64 nt, Homo Sapiens; identical to SEQ ID NO: 128608

SEQ ID NO: 154920 - RNA, 64 nt, Homo Sapiens; identical to SEQ ID NO: 128609

SEQ ID NO: 154921 - RNA, 64 nt, Homo Sapiens; identical to SEQ ID NO: 128610

SEQ ID NO: 154922 - RNA, 64 nt, Homo Sapiens; identical to SEQ ID NO: 128611

SEQ ID NO: 154923 - RNA, 64 nt, Homo Sapiens; identical to SEQ ID NO: 128612

SEQ ID NO: 154924 - RNA, 64 nt, Homo Sapiens; identical to SEQ ID NO: 128613

SEQ ID NO: 154925 - RNA, 64 nt, Homo Sapiens; identical to SEQ ID NO: 128614

SEQ ID NO: 154926 - RNA, 64 nt, Homo Sapiens; identical to SEQ ID NO: 128615

SEQ ID NO: 154927 - RNA, 64 nt, Homo Sapiens; identical to SEQ ID NO: 128616

SEQ ID NO: 154928 - RNA, 64 nt, Homo Sapiens; identical to SEQ ID NO: 128617

SEQ ID NO: 154929 - RNA, 64 nt, Homo Sapiens; identical to SEQ ID NO: 128618

SEQ ID NO: 154930 - RNA, 64 nt, Homo Sapiens; identical to SEQ ID NO: 128619

SEQ ID NO: 154931 - RNA, 64 nt, Homo Sapiens; identical to SEQ ID NO: 128620

SEQ ID NO: 154932 - RNA, 64 nt, Homo Sapiens; identical to SEQ ID NO: 128621

SEQ ID NO: 154933 - RNA, 64 nt, Homo Sapiens; identical to SEQ ID NO: 128622

SEQ ID NO: 154934 - RNA, 64 nt, Homo Sapiens; identical to SEQ ID NO: 128623

SEQ ID NO: 154935 - RNA, 64 nt, Homo Sapiens; identical to SEQ ID NO: 128624

SEQ ID NO: 154936 - RNA, 64 nt, Homo Sapiens; identical to SEQ ID NO: 128625

SEQ ID NO: 154937 - RNA, 64 nt, Homo Sapiens; identical to SEQ ID NO: 128626

SEQ ID NO: 154938 - RNA, 64 nt, Homo Sapiens; identical to SEQ ID NO: 128627

SEQ ID NO: 154939 - RNA, 64 nt, Homo Sapiens; identical to SEQ ID NO: 128628

SEQ ID NO: 154940 - RNA, 64 nt, Homo Sapiens; identical to SEQ ID NO: 128629

SEQ ID NO: 154941 - RNA, 64 nt, Homo Sapiens; identical to SEQ ID NO: 128630

SEQ ID NO: 154942 - RNA, 64 nt, Homo Sapiens; identical to SEQ ID NO: 128631

SEQ ID NO: 154943 - RNA, 64 nt, Homo Sapiens; identical to SEQ ID NO: 128632

SEQ ID NO: 154944 - RNA, 64 nt, Homo Sapiens; identical to SEQ ID NO: 128633

SEQ ID NO: 154945 - RNA, 64 nt, Homo Sapiens; identical to SEQ ID NO: 128634

SEQ ID NO: 154946 - RNA, 64 nt, Homo Sapiens; identical to SEQ ID NO: 128635

SEQ ID NO: 154947 - RNA, 64 nt, Homo Sapiens; identical to SEQ ID NO: 128636

SEQ ID NO: 154948 - RNA, 64 nt, Homo Sapiens; identical to SEQ ID NO: 128637

SEQ ID NO: 154949 - RNA, 64 nt, Homo Sapiens; identical to SEQ ID NO: 128638

SEQ ID NO: 154950 - RNA, 64 nt, Homo Sapiens; identical to SEQ ID NO: 128639

SEQ ID NO: 154951 - RNA, 64 nt, Homo Sapiens; identical to SEQ ID NO: 128640

SEQ ID NO: 154952 - RNA, 64 nt, Homo Sapiens; identical to SEQ ID NO: 128641

SEQ ID NO: 154953 - RNA, 64 nt, Homo Sapiens; identical to SEQ ID NO: 128642

SEQ ID NO: 154954 - RNA, 64 nt, Homo Sapiens; identical to SEQ ID NO: 128643

SEQ ID NO: 154955 - RNA, 64 nt, Homo Sapiens; identical to SEQ ID NO: 128644

SEQ ID NO: 154956 - RNA, 64 nt, Homo Sapiens; identical to SEQ ID NO: 128645

SEQ ID NO: 154957 - RNA, 64 nt, Homo Sapiens; identical to SEQ ID NO: 128646

SEQ ID NO: 154958 - RNA, 64 nt, Homo Sapiens; identical to SEQ ID NO: 128647

SEQ ID NO: 154959 - RNA, 60 nt, Homo Sapiens
ccucuuguccugcuggaaagauagcaguguucuccugacuucgcccuacugcaugcagcc

SEQ ID NO: 154960 - RNA, 60 nt, Homo Sapiens
guuucaccauguuggccaggguggucucaaucuccugaccucgugauccacccaccucga

SEQ ID NO: 154961 - RNA, 60 nt, Homo Sapiens
gaccucuuuaguuugggggauccuccucacucuccugaagugucucaaguauaccagugg

SEQ ID NO: 154962 - RNA, 60 nt, Homo Sapiens
gcuugagauagggggcugugguccuuccuuucuccugaggagaaaguccuugcucuggug

SEQ ID NO: 154963 - RNA, 60 nt, Homo Sapiens
guuucaccauguuggccaggauggucucgaucuccugaccucgugauccacccgacucgg

SEQ ID NO: 154964 - RNA, 60 nt, Homo Sapiens
cuaaacaucauucuugagagcauugggauaucuccugaaaagguuuaugaaaaagaagaa

SEQ ID NO: 154965 - RNA, 60 nt, Homo Sapiens
augacaacuggugggaaaccuagcauuuccucuccugaagaauaaauguauaaauguuau

SEQ ID NO: 154966 - RNA, 60 nt, Homo Sapiens
guguagcuggucagggacuuuuuuuucuuuucuccugaacuacaugauucuaauuggaau

SEQ ID NO: 154967 - RNA, 60 nt, Homo Sapiens
aacaucugcucuucggguuccaccaaagagucuccugagcccugagggauggaugucucc

SEQ ID NO: 154968 - RNA, 60 nt, Homo Sapiens
aagagucuccugagcccugagggauggaugucuccugacccuuccaccccgccucacucc

SEQ ID NO: 154969 - RNA, 60 nt, Homo Sapiens
gucuuucugcucuccuuaucgucuuucuacucuccugagcucucuuguucucuccugagu

SEQ ID NO: 154970 - RNA, 60 nt, Homo Sapiens
gucuuucuacucuccugagcucucuuguucucuccugagucauaauaagaaugggcagga

SEQ ID NO: 154971 - RNA, 60 nt, Homo Sapiens
uuagaaccuggagcugcagaugucugaagcucuccugaucuuauaucugguuuucccacu

SEQ ID NO: 154972 - RNA, 60 nt, Homo Sapiens
ucgugauccgcccaccuuggauggucucgaucuccugaccguuucacuguguuagccagg

SEQ ID NO: 154973 - RNA, 60 nt, Homo Sapiens
agcuuuccucuguuucacuucccgcagucaucuccugagcucaaggauucuaauaaauau

SEQ ID NO: 154974 - RNA, 60 nt, Homo Sapiens
aaaaggcuuacuauccaugggaauucugagucuccugaaccaguauuauucuuguuuucu

SEQ ID NO: 154975 - RNA, 60 nt, Homo Sapiens
uucagguaccaccuuugacguguggcucuuucuccugaccaucaugggaagugucugcug

SEQ ID NO: 154976 - RNA, 60 nt, Homo Sapiens
uccugaauuucaaauaccucaugcaaaaugucuccugaaauaagggaaaaaaaaaaaacc

SEQ ID NO: 154977 - RNA, 60 nt, Homo Sapiens
ccuugugaagaaggugcuuuccucacucuuucuccugaagagggcucugccccuuuaacu

SEQ ID NO: 154978 - RNA, 60 nt, Homo Sapiens
gugggugaguucucacaagaccuacgauguucuccugauaggaucaugggggugguuucc

SEQ ID NO: 154979 - RNA, 60 nt, Homo Sapiens
accacauggacaugccuuacacuggcguccucuccugagucccuccgcacucuccaucag

SEQ ID NO: 154980 - RNA, 60 nt, Homo Sapiens
cugccccagcuccucucugcaacccagcccucuccugagcucuaggcugggauuacaccc

SEQ ID NO: 154981 - RNA, 60 nt, Homo Sapiens
uucacauuucuauucuaaaaucucagguuaucuccugaacacuuuugggcagaugaaguu

SEQ ID NO: 154982 - RNA, 60 nt, Homo Sapiens
guuucaccguguuggccaggauggucuugaucuccugaccgcauaauccacccaccucgg

SEQ ID NO: 154983 - RNA, 60 nt, Homo Sapiens
gaucaccaggucaagcaccuaggccuggcuucuccugagacagaggacucagaaguggcc

SEQ ID NO: 154984 - RNA, 60 nt, Homo Sapiens
gauuuacuggggugggcugguccagguagcucuccugaaccuccuccuuccccaagcuga

SEQ ID NO: 154985 - RNA, 60 nt, Homo Sapiens
ggaugacaggucuucauucuugguucagugucuccugagugccguguugucccagugccc

SEQ ID NO: 154986 - RNA, 60 nt, Homo Sapiens
aaggcaaaaaaaaaaagcuuccucgaauaaucuccugacuuaguucaguucuuuacuguu

SEQ ID NO: 154987 - RNA, 60 nt, Homo Sapiens
uucggccucagcuccuagaggauuucuuuuucuccugauuuuuuuuuuuuuuuuuuacug

SEQ ID NO: 154988 - RNA, 60 nt, Homo Sapiens
uugugaucugcccgccuuggauggucuccaucuccugaguguuucaccauguuagacagg

SEQ ID NO: 154989 - RNA, 60 nt, Homo Sapiens
uugugauccacccaccucggauggucucaaucuccugaccguuucaccauguugaccagg

SEQ ID NO: 154990 - RNA, 60 nt, Homo Sapiens
ucgugauccgcccuccucggauagucuugaucuccugaccguuucaccguguuagccagg

SEQ ID NO: 154991 - RNA, 60 nt, Homo Sapiens
ucgugaucugcccaccucggauggucucgaucuccugaccguuucaucguguuaaccagg

SEQ ID NO: 154992 - RNA, 60 nt, Homo Sapiens
uugucauccaccugucuuggauggucucgaucuccugaccguuucaccauguuggccagg

SEQ ID NO: 154993 - RNA, 60 nt, Homo Sapiens
uuguggauuuaaauguccaaauuuauuguuucuccugauuauaugcaccagcccuugugc

SEQ ID NO: 154994 - RNA, 60 nt, Homo Sapiens
guccucugaauauuuauagucauacgcuugucuccugaauugcugauauuguacuuuaga

SEQ ID NO: 154995 - RNA, 60 nt, Homo Sapiens
cuagguuggggcccacccugugcuuuucucucuccugaugccucugcuggggacgguagu

SEQ ID NO: 154996 - RNA, 60 nt, Homo Sapiens
agcagguggcucgaggcgguacgggcagggucuccugagcgccccaugcagaugaaaagg

SEQ ID NO: 154997 - RNA, 60 nt, Homo Sapiens
gaauggaggcucuaauugaauuuucaagcaucuccugaggaucagaaaguaauuucuucu

SEQ ID NO: 154998 - RNA, 60 nt, Homo Sapiens
uaagaguuagguuuaacauaaagguuauuuucuccugauauagaucacauaacagaaugc

SEQ ID NO: 154999 - RNA, 64 nt, Homo Sapiens
augaacaagguaaaccucgguugccauggggaagaaggaugauguggaaaccauauugguaaag

SEQ ID NO: 155000 - RNA, 64 nt, Homo Sapiens
ccuuuguacaaucacagauauccuauggagauuuaaggaugaaagcccugaguuguucuugggu

SEQ ID NO: 155001 - RNA, 64 nt, Homo Sapiens
auacaugcuuaugcaugaaacaauucugcaaaaaaaggaugaauuuccuccaucacccagauuu

SEQ ID NO: 155002 - RNA, 64 nt, Homo Sapiens
gaggcaggagaauaggguacagagauagggaucuaaggaugacuuggacacacucccuggcacu

SEQ ID NO: 155003 - RNA, 64 nt, Homo Sapiens
auuugaccuuaagagggaagggaaaaaagugugaaaggaugaugaagaaaauaauuuuacuauu

SEQ ID NO: 155004 - RNA, 64 nt, Homo Sapiens
cuaaaaagcccaugauaccuuacuguugaugaaaaaggaugaucauauauauagaacuugauua

SEQ ID NO: 155005 - RNA, 64 nt, Homo Sapiens
agggcagauauuggacacuccuuauuugucaccaaaggaugacuguaggccgugugcuggccuu

SEQ ID NO: 155006 - RNA, 64 nt, Homo Sapiens
caucuucauuccuuuuuauggggcuccaggucauaaggaugagauauauuugggguacuggcag

SEQ ID NO: 155007 - RNA, 64 nt, Homo Sapiens
ugucucuguucagaugugcauuucaccugugacaaaggaugaagaacacagcaugugccaagau

SEQ ID NO: 155008 - RNA, 64 nt, Homo Sapiens
uuauucuaauaaauauacuaugaaauaaaaaaaaaaggaugaaagcuacuuuugcuuuuguggu

SEQ ID NO: 155009 - RNA, 64 nt, Homo Sapiens
acucagcacugucccuuagcagggaugacacagcaaggaugacucagcacugccccucagcaag

SEQ ID NO: 155010 - RNA, 64 nt, Homo Sapiens
acacagcaaggaugacucagcacugccccucagcaaggaugacucagcacugccgcucaacaga

SEQ ID NO: 155011 - RNA, 64 nt, Homo Sapiens; identical to SEQ ID NO: 155009

SEQ ID NO: 155012 - RNA, 64 nt, Homo Sapiens
acacagcaaggaugacucagcacugccccucagcaaggaugacucagcacugccgcucaacagg

SEQ ID NO: 155013 - RNA, 64 nt, Homo Sapiens
acucagcacugucccuuagcagugaugacacagcaaggaugacucagcacugccccucagcaag

SEQ ID NO: 155014 - RNA, 64 nt, Homo Sapiens; identical to SEQ ID NO: 155010

SEQ ID NO: 155015 - RNA, 64 nt, Homo Sapiens
acucagcagugucccuuagcagcgaugacacagcaaggaugacucagcacugccccucaccaag

SEQ ID NO: 155016 - RNA, 64 nt, Homo Sapiens
acacagcaaggaugacucagcacugccccucaccaaggaugacucagcacugccgcucaacaga

SEQ ID NO: 155017 - RNA, 64 nt, Homo Sapiens
acucagcagggaugacucagcaccgccccucagcaaggaugacucagcagggaugauucagcag

SEQ ID NO: 155018 - RNA, 64 nt, Homo Sapiens
cucugcuguucucuggggccgcucagcacagaagaaggaugagggggcucagcggggggagcug

SEQ ID NO: 155019 - RNA, 64 nt, Homo Sapiens
gcucuagaggaauuaaugcuggaaugggguguugaaggaugaguaggaguuaguuaggcauuga

SEQ ID NO: 155020 - RNA, 64 nt, Homo Sapiens
aaggaaagccacgcaaguuggggagaaaacccccaaggaugaaucugccaauguaagucaggga

SEQ ID NO: 155021 - RNA, 64 nt, Homo Sapiens
ggagacccugggagaagaacagcacaaccuugccaaggaugaagucgucuucuucggugaccac

SEQ ID NO: 155022 - RNA, 64 nt, Homo Sapiens
cugaucuggggagagggccguuguauuauaagucaaggaugagcccaucacaaccaagucagac

SEQ ID NO: 155023 - RNA, 64 nt, Homo Sapiens
ucugcugugaagagcaagccggguauaagggaauaaggaugaacuagaccuugaacaacaaaaa

SEQ ID NO: 155024 - RNA, 64 nt, Homo Sapiens
aacucauacauguacaccaggagauguguacaagaauauucauagcaacccuauucacaaaagc

SEQ ID NO: 155025 - RNA, 64 nt, Homo Sapiens
ugcccaugagcaagagaguggacaaguaaacuggaauauucacauaauagaacauuauacaauu

SEQ ID NO: 155026 - RNA, 64 nt, Homo Sapiens
gaaaauuuuuguacuccaaauuuacuucccaauaaauauucagcaaaguaguaaaaugaccuua

SEQ ID NO: 155027 - RNA, 64 nt, Homo Sapiens
ugaaaagcaacuauuguuguguuacaguguuaaaaauauucaguuuucuuugacaaaaaugugu

SEQ ID NO: 155028 - RNA, 64 nt, Homo Sapiens
uaacaguucugaauucauguuuaauuuuuuauuaaauauucaggaccuaugauccucauggaac

SEQ ID NO: 155029 - RNA, 64 nt, Homo Sapiens
cacauuaucacggaauuuaugguacugcuauauaaauauucacuauacauguagcucaacuuga

SEQ ID NO: 155030 - RNA, 64 nt, Homo Sapiens
cggaaaauucuaaaaaucaacauuugguaacuuaaauauucauuggcacaugauucugugccug

SEQ ID NO: 155031 - RNA, 64 nt, Homo Sapiens
auuuuacggcuuuauugaaaacauugauauauugaauauucauaaauuuuaauuuaacuuucuu

SEQ ID NO: 155032 - RNA, 64 nt, Homo Sapiens
agguauauuuuugaauuuuguauauaguucuuuuaauauucauaacugugucuuagcaauguug

SEQ ID NO: 155033 - RNA, 64 nt, Homo Sapiens
uaaggcagccuauuaacuguaaugucuucucuuuaauauucacaaauaucugucaaacuugaau

SEQ ID NO: 155034 - RNA, 64 nt, Homo Sapiens
caaaaucaaaugagcaaaacuaaggaugaaauguaauauucaucagaacaaggaucacugagaa

SEQ ID NO: 155035 - RNA, 64 nt, Homo Sapiens
guaauauucaucagaacaaggaucacugagaaaaaauauucagaaacaacuuuaauaaaaccug

SEQ ID NO: 155036 - RNA, 64 nt, Homo Sapiens
uauaaaacaguuuugucaguccaaccuggaguauaauauucagauaaaaucauauugaauguuu

SEQ ID NO: 155037 - RNA, 64 nt, Homo Sapiens
cuucuuccuuacccugcgauggucccaaguuggaaauauucauggaaaauuaaaauaagugugu

SEQ ID NO: 155038 - RNA, 64 nt, Homo Sapiens
uaauguauauaguugauuggaaugagguuuuaugaauauucauguuuuugaaggccuuuaauuu

SEQ ID NO: 155039 - RNA, 64 nt, Homo Sapiens
aaucaaaauacuacucuuuauaagacauuucacaaauauucacuuacauuacaggcuggaagua

SEQ ID NO: 155040 - RNA, 64 nt, Homo Sapiens
aauguauugggggguggagguaaauggauuaaaaaauauucagauauaugcaaguacucaguga

SEQ ID NO: 155041 - RNA, 64 nt, Homo Sapiens
guuacaccuuggggacuucuuauuuucuuaaagcaauauucacucuuauuuaaaauuguuuuug

SEQ ID NO: 155042 - RNA, 64 nt, Homo Sapiens
gaauguuuuauuauaguccugggggaauuauuuuaauauucaaauaaagcuuaauauagguuuu

SEQ ID NO: 155043 - RNA, 64 nt, Homo Sapiens
auaauccaggagggucuccuuugauucagagcuaaauauucaccuuagagauuuaaacauucau

SEQ ID NO: 155044 - RNA, 64 nt, Homo Sapiens
ucuugcugucagacccauucaugucucaagacauaauauucauccccugccucuugcacuacca

SEQ ID NO: 155045 - RNA, 64 nt, Homo Sapiens
ucuauuugaauguuaaguggucuuucuuguuuuuaauauucaugcauguauauucaucauauuu

SEQ ID NO: 155046 - RNA, 64 nt, Homo Sapiens
aaauagauuuuuaaaauucagaauggacaaagagaauauucauuuucuuauuaauaagauaaag

SEQ ID NO: 155047 - RNA, 64 nt, Homo Sapiens
cauuuuuaguguaguacuguuggcucguauuuagaauauucagcuacgacaguuuuggacuguu

SEQ ID NO: 155048 - RNA, 64 nt, Homo Sapiens
acguauauccaaauuuguccuguaguaauagauuaauauucauagauuguugguguuuaaagau

SEQ ID NO: 155049 - RNA, 64 nt, Homo Sapiens
auagaacccagcaugacauaacagugcagggcaaaauauucacugggccaauucaauacaaaca

SEQ ID NO: 155050 - RNA, 64 nt, Homo Sapiens
gcaaaaaguggggcagagccucccaaggagaacaaauauucagaauauucauauuggaaaaauc

SEQ ID NO: 155051 - RNA, 64 nt, Homo Sapiens
ggggcagagccucccaaggagaacaaauauucagaauauucauauuggaaaaaucacaauuuuu

SEQ ID NO: 155052 - RNA, 64 nt, Homo Sapiens
augaaguuugaugguuguuauguggagaguugucaauauucacccaggggugguggguguggca

SEQ ID NO: 155053 - RNA, 64 nt, Homo Sapiens
cuuccuauucauuaacaugguuugacaucauuaaaauauucaauguagaacaauuugggggcca

SEQ ID NO: 155054 - RNA, 64 nt, Homo Sapiens
aacuguaagcccccuuuuggauagggcugggaaaaauauucaauaaacuugaauuugauuuaaa

SEQ ID NO: 155055 - RNA, 64 nt, Homo Sapiens
auguguuuguuucccaugggauacuucuuuaaaaaauauucaaacaguaaaauuagaaucagaa

SEQ ID NO: 155056 - RNA, 64 nt, Homo Sapiens
gguuaacaauaaagugacaacucuaauuuuggauaauauucauucaauuaaguuacaauuacau

SEQ ID NO: 155057 - RNA, 64 nt, Homo Sapiens
uguucuaauacuuuguuuauuagaaggagguucuaauauucacaacugaagaaaucuuuccagu

SEQ ID NO: 155058 - RNA, 64 nt, Homo Sapiens
uuaacacauugcucucagaucauuuagaagaauuaauauucauaaggaaauaaggaugaauauu

SEQ ID NO: 155059 - RNA, 64 nt, Homo Sapiens
uagaagaauuaauauucauaaggaaauaaggaugaauauucauuauucauccaccuauacaagu

SEQ ID NO: 155060 - RNA, 64 nt, Homo Sapiens
acauugaacccaggaggcggugaaaugcauuaagaauauucacaaucauauuguauauaaauaa

SEQ ID NO: 155061 - RNA, 64 nt, Homo Sapiens
uagucaucuuugauuuuucauaauuauacacuggaauauucaggcauuucaugagguuguacug

SEQ ID NO: 155062 - RNA, 64 nt, Homo Sapiens
gaaugaaaauucugaaauuguaaaugucuauuuuaauauucaccuaugaaagaaucugugaaua

SEQ ID NO: 155063 - RNA, 64 nt, Homo Sapiens
aaauccaguuucuccuauaacaugauguaaauuaaauauucaggaauauuucaggucugaaauc

SEQ ID NO: 155064 - RNA, 64 nt, Homo Sapiens
aauaagcccaauucuaaguugauagguaauuuuaaauauucaaaccaaaucuucccaacaguug

SEQ ID NO: 155065 - RNA, 64 nt, Homo Sapiens
cauggacauuugaucaaccuuuaguuggaauaauaauauucauauuugcuaugaauccuuuuaa

SEQ ID NO: 155066 - RNA, 64 nt, Homo Sapiens
ggggauguuuggggguggggguauguaacaaaguaauauucaaagauguuguucuuuaguuuaa

SEQ ID NO: 155067 - RNA, 64 nt, Homo Sapiens
agccaacauaguauuuuugcaucuuuugucuauuaauauucacuuuccucuaacucccccauuu

SEQ ID NO: 155068 - RNA, 64 nt, Homo Sapiens
ggguccccuccuuuaccccugaguuccuuacuguucccccaagccugggagcagucuauccccc

SEQ ID NO: 155069 - RNA, 64 nt, Homo Sapiens
uccuuacuguucccccaagccugggagcagucuaucccccaacccugccaucucccuuacucau

SEQ ID NO: 155070 - RNA, 64 nt, Homo Sapiens
gcccccucuaaggaggguguuaaaacucacugccucccccaagggauuccugggcucccagccu

SEQ ID NO: 155071 - RNA, 64 nt, Homo Sapiens
gugggccuguucuacccgugcguuuguacuugccucccccaacagacaggccuucuguacccag

SEQ ID NO: 155072 - RNA, 64 nt, Homo Sapiens
uggaacacaucccugccuccgggaaguguggcucucccccaacccuccccaccguccccccuuc

SEQ ID NO: 155073 - RNA, 64 nt, Homo Sapiens
uuuuuuuucuuuuugagacggaguuucgcuuuugucccccaagcuggaguacaaugacaggauc

SEQ ID NO: 155074 - RNA, 64 nt, Homo Sapiens
auggucagccauuucuuccccacauacuuuauuaucccccaagggggacaagacugguugcuag

SEQ ID NO: 155075 - RNA, 64 nt, Homo Sapiens
cagagcaggggugaacuguaggaauuggaacucuucccccaagacucagcuuugggggccccag

SEQ ID NO: 155076 - RNA, 64 nt, Homo Sapiens
ugccugaagacuuaaguuuucuagaaccuuugagucccccaaacaauccaccaguuuuucuaag

SEQ ID NO: 155077 - RNA, 64 nt, Homo Sapiens
gaucacugcacaguccuacuaagugaaagcaucaucccccaaaguaaccuugacgaggauacaa

SEQ ID NO: 155078 - RNA, 64 nt, Homo Sapiens
ugagauguaugaaggcuuuuuucccccuuuuuugucccccaacuaugagccuucgugccccccc

SEQ ID NO: 155079 - RNA, 64 nt, Homo Sapiens
uucacaauguggccgaggacgguuggagcgagcaucccccaaagcggugaaggugacagcaguc

SEQ ID NO: 155080 - RNA, 64 nt, Homo Sapiens
gcauuuuggagaguccacaccacggaccagguuuucccccaaggcuuggcuuuguguagcuacu

SEQ ID NO: 155081 - RNA, 64 nt, Homo Sapiens
gagugugggcagagagaauuauguggccucauccucccccaaggcugugcuugcagcccgggca

SEQ ID NO: 155082 - RNA, 64 nt, Homo Sapiens
cacacuugcucucucaauauuguggccaucuccaucccccaaagagggcuugcagcagcagcag

SEQ ID NO: 155083 - RNA, 64 nt, Homo Sapiens
gguguccguucuuaauucccaaaaacacagccucucccccaaagcacuuuuuuaaaggggauua

SEQ ID NO: 155084 - RNA, 64 nt, Homo Sapiens
ugacacccaccgucgucaggccccggcaccucacucccccaaaacgggaggagcagcugugugu

SEQ ID NO: 155085 - RNA, 64 nt, Homo Sapiens
ggcgcuccgcucccugcccuccccuucuugcuggucccccaaaguccuggccgaguuuccucug

SEQ ID NO: 155086 - RNA, 64 nt, Homo Sapiens
gucccucagcuucacccagcggcuucccaugcccucccccaacaaacccaggacaucugugcca

SEQ ID NO: 155087 - RNA, 64 nt, Homo Sapiens
cacugcucuccagccugggaggcacagcaaacugucccccaaaaaaaaaaaagaguccuuacca

SEQ ID NO: 155088 - RNA, 64 nt, Homo Sapiens
acuaaagguggccacaaauucuuugacacucaagucccccaagaccuaaggguuuuaucuccuc

SEQ ID NO: 155089 - RNA, 64 nt, Homo Sapiens
aggaaagcugaaagaugcacuccacagucaaaaaucccccaaggauuuccuucacuuaauucua

SEQ ID NO: 155090 - RNA, 64 nt, Homo Sapiens
aaauacacaaguaaacauucaaaagaugggcguuucccccaaugaaauaaguuugauaacauuu

SEQ ID NO: 155091 - RNA, 64 nt, Homo Sapiens
ugauugagcuucagagcuaaaaugccuucacccuucccccaaguuggaauauauccucccccaa

SEQ ID NO: 155092 - RNA, 64 nt, Homo Sapiens
ugccuucacccuucccccaaguuggaauauauccucccccaaauuaaggacccauuugucuucu

SEQ ID NO: 155093 - RNA, 64 nt, Homo Sapiens
guguuuuaggacauugcaaaucuucuagaaguucucccccaaaucaggucaaugugugcccucc

SEQ ID NO: 155094 - RNA, 64 nt, Homo Sapiens
ccacccaggcaucuccagugcucaugaucaugugucccccaacuccaccccucacaguuugggc

SEQ ID NO: 155095 - RNA, 64 nt, Homo Sapiens
gaauaauuuuucuuucaaguagguuagcuagcucucccccaauaaaaauaccacuaucagagua

SEQ ID NO: 155096 - RNA, 64 nt, Homo Sapiens
gaaaaaugcuacuuuuaucuucucuaaaauuauuucccccaagguagugaaguaauuggaauga

SEQ ID NO: 155097 - RNA, 64 nt, Homo Sapiens
uuuuaaaugauagagguuuuugugggaaucaaaaucccccaaauguuaagguauaugguaaaaa

SEQ ID NO: 155098 - RNA, 64 nt, Homo Sapiens
cauaaacuuuguuuuaacauaauuaguacuguuuucccccaaaaguacaaguuuuugaguagca

SEQ ID NO: 155099 - RNA, 64 nt, Homo Sapiens
cugaugcauucccggugcagaaugcaggagagcuucccccaagguugcucacacuacuugagaa

SEQ ID NO: 155100 - RNA, 64 nt, Homo Sapiens
auccuuaaacuagcuaaaaccauucagcagucagucccccaauauccuuuguguccauugaugu

SEQ ID NO: 155101 - RNA, 64 nt, Homo Sapiens
gaacgaggagcgccuccgggcccccccgcccccgucccccaaccagaacaacaacgccauagac

SEQ ID NO: 155102 - RNA, 64 nt, Homo Sapiens
ggcagugugggcaccugguggccaagccucaguuucccccaaaugagcaaaggggauaaagagg

SEQ ID NO: 155103 - RNA, 62 nt, Homo Sapiens
uaccuucaggcuauguguauaaaguauauaugagccauaaaugaauuuuguguuuagacuuu

SEQ ID NO: 155104 - RNA, 62 nt, Homo Sapiens
cugcuggacacugagggacccaaagcucaaucagccauaaucccugcuuucagaguuuauau

SEQ ID NO: 155105 - RNA, 64 nt, Homo Sapiens
gcuggagugcagugaugcaaucuuggcucacugcagccucuaccucccagguucaagugauuau

SEQ ID NO: 155106 - RNA, 64 nt, Homo Sapiens
guuauagguugauuuccuaaguguggcugaugguagccucuaguuugaagugagggaagaauga

SEQ ID NO: 155107 - RNA, 64 nt, Homo Sapiens
uggaguguagggucacugggagagcagaggucacagccucuagagaagggagaggggcgugugc

SEQ ID NO: 155108 - RNA, 64 nt, Homo Sapiens
uucccguucacucugcccccacccccaaaggcucagccucuaaaucucagacuccaccaccucu

SEQ ID NO: 155109 - RNA, 64 nt, Homo Sapiens; identical to SEQ ID NO: 77130

SEQ ID NO: 155110 - RNA, 64 nt, Homo Sapiens; identical to SEQ ID NO: 77131

SEQ ID NO: 155111 - RNA, 64 nt, Homo Sapiens; identical to SEQ ID NO: 77132

SEQ ID NO: 155112 - RNA, 64 nt, Homo Sapiens; identical to SEQ ID NO: 77133

SEQ ID NO: 155113 - RNA, 64 nt, Homo Sapiens; identical to SEQ ID NO: 77134

SEQ ID NO: 155114 - RNA, 64 nt, Homo Sapiens; identical to SEQ ID NO: 77135

SEQ ID NO: 155115 - RNA, 64 nt, Homo Sapiens; identical to SEQ ID NO: 77136

SEQ ID NO: 155116 - RNA, 62 nt, Homo Sapiens; identical to SEQ ID NO: 77137

SEQ ID NO: 155117 - RNA, 64 nt, Homo Sapiens; identical to SEQ ID NO: 77138

SEQ ID NO: 155118 - RNA, 64 nt, Homo Sapiens; identical to SEQ ID NO: 77139

SEQ ID NO: 155119 - RNA, 64 nt, Homo Sapiens; identical to SEQ ID NO: 77140

SEQ ID NO: 155120 - RNA, 64 nt, Homo Sapiens; identical to SEQ ID NO: 77141

SEQ ID NO: 155121 - RNA, 64 nt, Homo Sapiens; identical to SEQ ID NO: 77142

SEQ ID NO: 155122 - RNA, 64 nt, Homo Sapiens; identical to SEQ ID NO: 77143

SEQ ID NO: 155123 - RNA, 64 nt, Homo Sapiens; identical to SEQ ID NO: 77144

SEQ ID NO: 155124 - RNA, 64 nt, Homo Sapiens; identical to SEQ ID NO: 77145

SEQ ID NO: 155125 - RNA, 64 nt, Homo Sapiens; identical to SEQ ID NO: 77146

SEQ ID NO: 155126 - RNA, 64 nt, Homo Sapiens; identical to SEQ ID NO: 77147

SEQ ID NO: 155127 - RNA, 64 nt, Homo Sapiens; identical to SEQ ID NO: 77148

SEQ ID NO: 155128 - RNA, 64 nt, Homo Sapiens; identical to SEQ ID NO: 77149

SEQ ID NO: 155129 - RNA, 64 nt, Homo Sapiens; identical to SEQ ID NO: 77150

SEQ ID NO: 155130 - RNA, 64 nt, Homo Sapiens; identical to SEQ ID NO: 77151

SEQ ID NO: 155131 - RNA, 64 nt, Homo Sapiens; identical to SEQ ID NO: 77152

SEQ ID NO: 155132 - RNA, 64 nt, Homo Sapiens; identical to SEQ ID NO: 77153

SEQ ID NO: 155133 - RNA, 64 nt, Homo Sapiens; identical to SEQ ID NO: 77154

SEQ ID NO: 155134 - RNA, 64 nt, Homo Sapiens; identical to SEQ ID NO: 77155

SEQ ID NO: 155135 - RNA, 64 nt, Homo Sapiens; identical to SEQ ID NO: 77156

SEQ ID NO: 155136 - RNA, 64 nt, Homo Sapiens; identical to SEQ ID NO: 77157

SEQ ID NO: 155137 - RNA, 64 nt, Homo Sapiens; identical to SEQ ID NO: 77158

SEQ ID NO: 155138 - RNA, 64 nt, Homo Sapiens; identical to SEQ ID NO: 77159

SEQ ID NO: 155139 - RNA, 64 nt, Homo Sapiens; identical to SEQ ID NO: 77160

SEQ ID NO: 155140 - RNA, 64 nt, Homo Sapiens
gccccuccagguuuacagaauguugcuacuucacaauggcgauguggugagaaacuccugaaug

SEQ ID NO: 155141 - RNA, 64 nt, Homo Sapiens
cggugacgcugcccacaagcgcuacaugccggccaauggcgagaccgggguccaggggucaacu

SEQ ID NO: 155142 - RNA, 64 nt, Homo Sapiens
gaauggaagcgaauaaaguuuccaguuuucuguuaauggcgaaacacgaaacauuuuugcuuuc

SEQ ID NO: 155143 - RNA, 64 nt, Homo Sapiens
auuccccgugaguuaaugaaaacugauucaaccaaauggcgaagucagagacuaucgggggcca

SEQ ID NO: 155144 - RNA, 64 nt, Homo Sapiens
guugcuucuuagcuauugcuaagccacuuuuccaaauggcgacauccccaacugaagcuucaaa

SEQ ID NO: 155145 - RNA, 64 nt, Homo Sapiens
uccuguugagcugguaggauguaagccuggagcuaauggcgaucaucuuugccaccaccugggg

SEQ ID NO: 155146 - RNA, 64 nt, Homo Sapiens
cagagcauggaaaaucguuuauaauuguuaauagaauggcgauuuuuuuuuaagaacuucagau

SEQ ID NO: 155147 - RNA, 64 nt, Homo Sapiens
gucauacacaugagaugguaucugguaggggagaaauggcgaauuuuuccuuugucuuaaucga

SEQ ID NO: 155148 - RNA, 64 nt, Homo Sapiens
uggggggaagggagccacccggaggcuuaaauuuaauggcgacuuucugacucuugaguaggau

SEQ ID NO: 155149 - RNA, 64 nt, Homo Sapiens
gaaauguuacaacagagauuauuauuucagagggaauggcgauucucaaauaaagugcuuuguu

SEQ ID NO: 155150 - RNA, 57 nt, Homo Sapiens
ggcaggagucgaggcgcugaucccuaaaauggcgaacauguguuuucaucauuucag

SEQ ID NO: 155151 - RNA, 64 nt, Homo Sapiens
guaacugaaaucuucaaugacacauuaacaucacaauggcgaauggugacuuuucuuucacgau

SEQ ID NO: 155152 - RNA, 64 nt, Homo Sapiens
acaugaaacaaccagugauccuuuugcccagaaaaauggcgaauuuucagaggaaguggaauua

SEQ ID NO: 155153 - RNA, 64 nt, Homo Sapiens
ugacuacucaagcucuguuuacagaagaaaauugaauggcgaggguguggccauaugaacugac

SEQ ID NO: 155154 - RNA, 64 nt, Homo Sapiens
ugagaaacaacugugccuucuugguugaauugaaaauggcgacuaauggaagaauuuaguuuug

SEQ ID NO: 155155 - RNA, 64 nt, Homo Sapiens
uguacacccuuauuuuauaccguuuuucuucaacaauggcgaaauugacuguagugcugaacca

SEQ ID NO: 155156 - RNA, 64 nt, Homo Sapiens
gcagcacagggagagaaacaggauaggaaagcagaauggcgagcagccuauggcccagggccug

SEQ ID NO: 155157 - RNA, 64 nt, Homo Sapiens
acaaauguacagauguuaauauauuuuuggugccaauggcgauguuuuuaagagugggauggag

SEQ ID NO: 155158 - RNA, 64 nt, Homo Sapiens
ccucacccuggucaaccuacaugauccuuaagcuaauggcgaaucacgaugaccuuguagacau

SEQ ID NO: 155159 - RNA, 64 nt, Homo Sapiens
uuggcucaggccucugcggguccagcccagggcgaauggcgagcgucuccuuccggagcugaga

SEQ ID NO: 155160 - RNA, 64 nt, Homo Sapiens
auccuacuauguggucagugggaaugacccugccaauggcgagccaagccgggcugugcuggau

SEQ ID NO: 155161 - RNA, 64 nt, Homo Sapiens
auucggcucgaagaagaccccguucuuccgggaaaauggcgacucccgcucgugccccggaguc

SEQ ID NO: 155162 - RNA, 64 nt, Homo Sapiens
uccuggcuuggagggaucuuugggcucauggaugaauggcgagccaccuguugucagcugcccc

SEQ ID NO: 155163 - RNA, 64 nt, Homo Sapiens
acccugcagcugggcgggcauccccagcaguggcaauggcgagcuuucucggcccaaaccaugc

SEQ ID NO: 155164 - RNA, 64 nt, Homo Sapiens
aacccucccauuaggaagcaugcuuuugcaguuaaauggcgaugguggaggugauagggacuuc

SEQ ID NO: 155165 - RNA, 54 nt, Homo Sapiens
ugaagagcaagguagagugaagccaauggcgagagaucagguccgaaaugcugc

SEQ ID NO: 155166 - RNA, 64 nt, Homo Sapiens
gacuguuccguuccacccccgaaccauacuaucaaauggcgacagugguuuuguuuucauucug

SEQ ID NO: 155167 - RNA, 64 nt, Homo Sapiens
uuccguguccuucugauacaccugcauaauuaucaauggcgacuauggcgcaugcagggggcaa

SEQ ID NO: 155168 - RNA, 64 nt, Homo Sapiens
cuauacucuccgcccgccccuccuccagguggcaaauggcgacuguggggaggagagcuggcau

SEQ ID NO: 155169 - RNA, 64 nt, Homo Sapiens
agaggaggggguuggggaggacccaccucuccagaauggcgacuguccccauccgccuggcuga

SEQ ID NO: 155170 - RNA, 64 nt, Homo Sapiens
gcccgcugcgccccuaauugccaaaggguagggaaauggcgaagccagccaccaggucgcuggu

SEQ ID NO: 155171 - RNA, 64 nt, Homo Sapiens
uguuuuucaguugucguggaacuuuguguaauaaaauggcgaguauucagcccaaucugguuca

SEQ ID NO: 155172 - RNA, 64 nt, Homo Sapiens
gauugcuuuccuucagagaagaggaauugccaagaauggcgaguguuuggucucaaaaaccuuu

SEQ ID NO: 155173 - RNA, 64 nt, Homo Sapiens
cucucugguuguaaccuggagacauguggaggggaauggcgaugggauuauaggacucucccca

SEQ ID NO: 155174 - RNA, 64 nt, Homo Sapiens
uugaguccagacaguugggaagugccuguaggaaaauggcgauggcugagaaaagcccggagga

SEQ ID NO: 155175 - RNA, 64 nt, Homo Sapiens
auuacaauaaaaucaaguuuaaauccucacuaccaauggcgaugauggagaaaccaaauuggac

SEQ ID NO: 155176 - RNA, 64 nt, Homo Sapiens
ucucuuuagcucaauuucugguggcaaggcccagaauggcgaccucaccucugcuggcacacca

SEQ ID NO: 155177 - RNA, 65 nt, Homo Sapiens
gaagcgggguugcagugagccaaagguacaccacuacacuccagccugggcaacagagcaagacu

SEQ ID NO: 155178 - RNA, 65 nt, Homo Sapiens
gaccacccagacaucugacuaauggcucugugcccacacuccaagaccugugccuuuuagagaag

SEQ ID NO: 155179 - RNA, 65 nt, Homo Sapiens
auuaauauuugugcuaccauuuuagacaaaaaugcacacuccaguacuuuaaaauguauauacau

SEQ ID NO: 155180 - RNA, 65 nt, Homo Sapiens
auaucgggugaguuuuagggaaaauguuuauuuuuacacuccagcgacaacuaaaacaaaugaua

SEQ ID NO: 155181 - RNA, 65 nt, Homo Sapiens
aagccuuaacuuagcaaacaguuguuagaagugggacacuccaaccacauuccaagcugagauaa

SEQ ID NO: 155182 - RNA, 65 nt, Homo Sapiens
gacuggcuaggaccuagaacuaagaucuuauaaccacacuccaugcaacuaugagucucuaaauc

SEQ ID NO: 155183 - RNA, 65 nt, Homo Sapiens
gaaaccccagacugggacaccuuaacuucguguucacacuccaugggcucugaagcagccucacu

SEQ ID NO: 155184 - RNA, 65 nt, Homo Sapiens
uggagucuggauggacacauugcccugggagcccuacacuccacucugccccucccaccccucuc

SEQ ID NO: 155185 - RNA, 65 nt, Homo Sapiens
ugcagaccaucgcacaccaacagucaagugaggugacacuccagugugagcucacaaccaccauu

SEQ ID NO: 155186 - RNA, 65 nt, Homo Sapiens
ucuacacagcucagcagacaaaaagucacccagggacacuccaacuuucuucucuacacccaccc

SEQ ID NO: 155187 - RNA, 64 nt, Homo Sapiens; identical to SEQ ID NO: 44076

SEQ ID NO: 155188 - RNA, 64 nt, Homo Sapiens; identical to SEQ ID NO: 44077

SEQ ID NO: 155189 - RNA, 64 nt, Homo Sapiens; identical to SEQ ID NO: 44078

SEQ ID NO: 155190 - RNA, 64 nt, Homo Sapiens; identical to SEQ ID NO: 44079

SEQ ID NO: 155191 - RNA, 64 nt, Homo Sapiens; identical to SEQ ID NO: 44080

SEQ ID NO: 155192 - RNA, 64 nt, Homo Sapiens; identical to SEQ ID NO: 44081

SEQ ID NO: 155193 - RNA, 64 nt, Homo Sapiens; identical to SEQ ID NO: 44082

SEQ ID NO: 155194 - RNA, 64 nt, Homo Sapiens; identical to SEQ ID NO: 44083

SEQ ID NO: 155195 - RNA, 64 nt, Homo Sapiens; identical to SEQ ID NO: 44084

SEQ ID NO: 155196 - RNA, 64 nt, Homo Sapiens; identical to SEQ ID NO: 44085

SEQ ID NO: 155197 - RNA, 64 nt, Homo Sapiens; identical to SEQ ID NO: 44086

SEQ ID NO: 155198 - RNA, 64 nt, Homo Sapiens; identical to SEQ ID NO: 44087

SEQ ID NO: 155199 - RNA, 64 nt, Homo Sapiens; identical to SEQ ID NO: 44088

SEQ ID NO: 155200 - RNA, 64 nt, Homo Sapiens; identical to SEQ ID NO: 44089

SEQ ID NO: 155201 - RNA, 64 nt, Homo Sapiens; identical to SEQ ID NO: 44090

SEQ ID NO: 155202 - RNA, 64 nt, Homo Sapiens; identical to SEQ ID NO: 44091

SEQ ID NO: 155203 - RNA, 64 nt, Homo Sapiens; identical to SEQ ID NO: 44092

SEQ ID NO: 155204 - RNA, 64 nt, Homo Sapiens; identical to SEQ ID NO: 44093

SEQ ID NO: 155205 - RNA, 64 nt, Homo Sapiens; identical to SEQ ID NO: 44094

SEQ ID NO: 155206 - RNA, 64 nt, Homo Sapiens; identical to SEQ ID NO: 44095

SEQ ID NO: 155207 - RNA, 64 nt, Homo Sapiens; identical to SEQ ID NO: 44096

SEQ ID NO: 155208 - RNA, 64 nt, Homo Sapiens; identical to SEQ ID NO: 44097

SEQ ID NO: 155209 - RNA, 64 nt, Homo Sapiens; identical to SEQ ID NO: 44098

SEQ ID NO: 155210 - RNA, 64 nt, Homo Sapiens; identical to SEQ ID NO: 44099

SEQ ID NO: 155211 - RNA, 64 nt, Homo Sapiens; identical to SEQ ID NO: 23251

SEQ ID NO: 155212 - RNA, 64 nt, Homo Sapiens; identical to SEQ ID NO: 23252

SEQ ID NO: 155213 - RNA, 64 nt, Homo Sapiens; identical to SEQ ID NO: 23253

SEQ ID NO: 155214 - RNA, 64 nt, Homo Sapiens; identical to SEQ ID NO: 23254

SEQ ID NO: 155215 - RNA, 64 nt, Homo Sapiens; identical to SEQ ID NO: 23255

SEQ ID NO: 155216 - RNA, 64 nt, Homo Sapiens; identical to SEQ ID NO: 23256

SEQ ID NO: 155217 - RNA, 64 nt, Homo Sapiens; identical to SEQ ID NO: 23257

SEQ ID NO: 155218 - RNA, 64 nt, Homo Sapiens; identical to SEQ ID NO: 23258

SEQ ID NO: 155219 - RNA, 64 nt, Homo Sapiens; identical to SEQ ID NO: 23259

SEQ ID NO: 155220 - RNA, 64 nt, Homo Sapiens; identical to SEQ ID NO: 23260

SEQ ID NO: 155221 - RNA, 64 nt, Homo Sapiens; identical to SEQ ID NO: 23261

SEQ ID NO: 155222 - RNA, 64 nt, Homo Sapiens; identical to SEQ ID NO: 23262

SEQ ID NO: 155223 - RNA, 64 nt, Homo Sapiens; identical to SEQ ID NO: 23263

SEQ ID NO: 155224 - RNA, 64 nt, Homo Sapiens; identical to SEQ ID NO: 23264

SEQ ID NO: 155225 - RNA, 64 nt, Homo Sapiens; identical to SEQ ID NO: 23265

SEQ ID NO: 155226 - RNA, 64 nt, Homo Sapiens; identical to SEQ ID NO: 23266

SEQ ID NO: 155227 - RNA, 64 nt, Homo Sapiens; identical to SEQ ID NO: 23267

SEQ ID NO: 155228 - RNA, 64 nt, Homo Sapiens; identical to SEQ ID NO: 23268

SEQ ID NO: 155229 - RNA, 64 nt, Homo Sapiens; identical to SEQ ID NO: 23269

SEQ ID NO: 155230 - RNA, 64 nt, Homo Sapiens; identical to SEQ ID NO: 23270

SEQ ID NO: 155231 - RNA, 64 nt, Homo Sapiens; identical to SEQ ID NO: 23271

SEQ ID NO: 155232 - RNA, 64 nt, Homo Sapiens; identical to SEQ ID NO: 23272

SEQ ID NO: 155233 - RNA, 64 nt, Homo Sapiens; identical to SEQ ID NO: 23273

SEQ ID NO: 155234 - RNA, 64 nt, Homo Sapiens; identical to SEQ ID NO: 23274

SEQ ID NO: 155235 - RNA, 64 nt, Homo Sapiens; identical to SEQ ID NO: 23275

SEQ ID NO: 155236 - RNA, 64 nt, Homo Sapiens; identical to SEQ ID NO: 23276

SEQ ID NO: 155237 - RNA, 64 nt, Homo Sapiens; identical to SEQ ID NO: 23277

SEQ ID NO: 155238 - RNA, 64 nt, Homo Sapiens; identical to SEQ ID NO: 23278

SEQ ID NO: 155239 - RNA, 64 nt, Homo Sapiens; identical to SEQ ID NO: 23279

SEQ ID NO: 155240 - RNA, 64 nt, Homo Sapiens; identical to SEQ ID NO: 23280

SEQ ID NO: 155241 - RNA, 64 nt, Homo Sapiens; identical to SEQ ID NO: 23281

SEQ ID NO: 155242 - RNA, 64 nt, Homo Sapiens; identical to SEQ ID NO: 23282

SEQ ID NO: 155243 - RNA, 64 nt, Homo Sapiens; identical to SEQ ID NO: 23283

SEQ ID NO: 155244 - RNA, 64 nt, Homo Sapiens; identical to SEQ ID NO: 23284

SEQ ID NO: 155245 - RNA, 64 nt, Homo Sapiens; identical to SEQ ID NO: 23285

SEQ ID NO: 155246 - RNA, 64 nt, Homo Sapiens; identical to SEQ ID NO: 23286

SEQ ID NO: 155247 - RNA, 64 nt, Homo Sapiens; identical to SEQ ID NO: 23287

SEQ ID NO: 155248 - RNA, 64 nt, Homo Sapiens; identical to SEQ ID NO: 23288

SEQ ID NO: 155249 - RNA, 64 nt, Homo Sapiens; identical to SEQ ID NO: 23289

SEQ ID NO: 155250 - RNA, 64 nt, Homo Sapiens; identical to SEQ ID NO: 23290

SEQ ID NO: 155251 - RNA, 64 nt, Homo Sapiens; identical to SEQ ID NO: 23291

SEQ ID NO: 155252 - RNA, 64 nt, Homo Sapiens; identical to SEQ ID NO: 23292

SEQ ID NO: 155253 - RNA, 64 nt, Homo Sapiens; identical to SEQ ID NO: 23293

SEQ ID NO: 155254 - RNA, 64 nt, Homo Sapiens; identical to SEQ ID NO: 23294

SEQ ID NO: 155255 - RNA, 64 nt, Homo Sapiens; identical to SEQ ID NO: 23295

SEQ ID NO: 155256 - RNA, 64 nt, Homo Sapiens; identical to SEQ ID NO: 23296

SEQ ID NO: 155257 - RNA, 64 nt, Homo Sapiens; identical to SEQ ID NO: 23297

SEQ ID NO: 155258 - RNA, 64 nt, Homo Sapiens; identical to SEQ ID NO: 23298

SEQ ID NO: 155259 - RNA, 64 nt, Homo Sapiens; identical to SEQ ID NO: 23299

SEQ ID NO: 155260 - RNA, 64 nt, Homo Sapiens; identical to SEQ ID NO: 23300

SEQ ID NO: 155261 - RNA, 64 nt, Homo Sapiens; identical to SEQ ID NO: 23301

SEQ ID NO: 155262 - RNA, 64 nt, Homo Sapiens; identical to SEQ ID NO: 23302

SEQ ID NO: 155263 - RNA, 64 nt, Homo Sapiens; identical to SEQ ID NO: 23303

SEQ ID NO: 155264 - RNA, 64 nt, Homo Sapiens; identical to SEQ ID NO: 23304

SEQ ID NO: 155265 - RNA, 64 nt, Homo Sapiens; identical to SEQ ID NO: 23305

SEQ ID NO: 155266 - RNA, 64 nt, Homo Sapiens; identical to SEQ ID NO: 23306

SEQ ID NO: 155267 - RNA, 64 nt, Homo Sapiens; identical to SEQ ID NO: 23307

SEQ ID NO: 155268 - RNA, 64 nt, Homo Sapiens; identical to SEQ ID NO: 23308

SEQ ID NO: 155269 - RNA, 64 nt, Homo Sapiens; identical to SEQ ID NO: 23309

SEQ ID NO: 155270 - RNA, 64 nt, Homo Sapiens; identical to SEQ ID NO: 23310

SEQ ID NO: 155271 - RNA, 64 nt, Homo Sapiens; identical to SEQ ID NO: 23311

SEQ ID NO: 155272 - RNA, 64 nt, Homo Sapiens; identical to SEQ ID NO: 23312

SEQ ID NO: 155273 - RNA, 64 nt, Homo Sapiens; identical to SEQ ID NO: 23313

SEQ ID NO: 155274 - RNA, 64 nt, Homo Sapiens; identical to SEQ ID NO: 23314

SEQ ID NO: 155275 - RNA, 64 nt, Homo Sapiens; identical to SEQ ID NO: 23315

SEQ ID NO: 155276 - RNA, 64 nt, Homo Sapiens; identical to SEQ ID NO: 23316

SEQ ID NO: 155277 - RNA, 64 nt, Homo Sapiens; identical to SEQ ID NO: 23317

SEQ ID NO: 155278 - RNA, 64 nt, Homo Sapiens; identical to SEQ ID NO: 23318

SEQ ID NO: 155279 - RNA, 64 nt, Homo Sapiens; identical to SEQ ID NO: 23319

SEQ ID NO: 155280 - RNA, 64 nt, Homo Sapiens; identical to SEQ ID NO: 23320

SEQ ID NO: 155281 - RNA, 64 nt, Homo Sapiens; identical to SEQ ID NO: 23321

SEQ ID NO: 155282 - RNA, 64 nt, Homo Sapiens; identical to SEQ ID NO: 23322

SEQ ID NO: 155283 - RNA, 64 nt, Homo Sapiens; identical to SEQ ID NO: 23323

SEQ ID NO: 155284 - RNA, 64 nt, Homo Sapiens; identical to SEQ ID NO: 23324

SEQ ID NO: 155285 - RNA, 64 nt, Homo Sapiens; identical to SEQ ID NO: 23325

SEQ ID NO: 155286 - RNA, 64 nt, Homo Sapiens; identical to SEQ ID NO: 23326

SEQ ID NO: 155287 - RNA, 64 nt, Homo Sapiens; identical to SEQ ID NO: 23327

SEQ ID NO: 155288 - RNA, 64 nt, Homo Sapiens; identical to SEQ ID NO: 23328

SEQ ID NO: 155289 - RNA, 64 nt, Homo Sapiens; identical to SEQ ID NO: 23329

SEQ ID NO: 155290 - RNA, 64 nt, Homo Sapiens
agcacugccccucagcaaggaugacucagcacugccgcucaacagacaugacucagggauggcu

SEQ ID NO: 155291 - RNA, 64 nt, Homo Sapiens
agcacugccccucagcaaggaugacucagcacugccgcucaacagggaugacucagggauggcu

SEQ ID NO: 155292 - RNA, 64 nt, Homo Sapiens; identical to SEQ ID NO: 155290

SEQ ID NO: 155293 - RNA, 64 nt, Homo Sapiens
agcacugccccucaccaaggaugacucagcacugccgcucaacagacaugacucagggauggcu

SEQ ID NO: 155294 - RNA, 64 nt, Homo Sapiens
guuuuauuaaaagcuacauuuuauaacacuggcacacacaaaaaaguaguuuuaagcuuguuug

SEQ ID NO: 155295 - RNA, 64 nt, Homo Sapiens
agggagaauaaagauaauuguauuuuauguuuugcacacaaacgcagaauuuguauaaccauau

SEQ ID NO: 155296 - RNA, 64 nt, Homo Sapiens
aaaagaggcugagaugagcagugaacuaagaggccacacaaaagcagagguuugggaauuccag

SEQ ID NO: 155297 - RNA, 64 nt, Homo Sapiens
agaaauugacgcaagugaacugaaaacuuauguucacacaaaaacucgcacaugacuguuuaua

SEQ ID NO: 155298 - RNA, 64 nt, Homo Sapiens
ugaccugggacaugauuuuuaccucccccgcacacacacaaagacaugccuuuuccucccaucc

SEQ ID NO: 155299 - RNA, 64 nt, Homo Sapiens
agagggugucuucauauuaaaaaggugaaaaaagcacacaaaaguauuugcaaacuucuuuaua

SEQ ID NO: 155300 - RNA, 64 nt, Homo Sapiens
caauuagaguuugguuuuuuuuagcaaauucauccacacaaacaggguuagcuacugucaucag

SEQ ID NO: 155301 - RNA, 64 nt, Homo Sapiens
auugcaacccccagcauaaaaaggucugauuuuucacacaaaaauacugcucaaagucauugcc

SEQ ID NO: 155302 - RNA, 64 nt, Homo Sapiens
agccucaacuuacacuuggugaacaaaagcgaaacacacaaaccaguaucacaucacacaaaag

SEQ ID NO: 155303 - RNA, 64 nt, Homo Sapiens
gaacaaaagcgaaacacacaucugaguaucacaucacacaaaagccccccaggcaaagcagugc

SEQ ID NO: 155304 - RNA, 64 nt, Homo Sapiens
uguguguauacauuuggguuauagcauacauguacacacaaaaaauguaccugugguauaccaa

SEQ ID NO: 155305 - RNA, 64 nt, Homo Sapiens
uucugcaaccuaacguuuaaagaggcaaaaguuucacacaaaguccgagggaugagauuaaggc

SEQ ID NO: 155306 - RNA, 64 nt, Homo Sapiens
ggacuuuuguuuacucuaucuucauuugcucaagcacacaaaagguguuuuucuccucuugguu

SEQ ID NO: 155307 - RNA, 64 nt, Homo Sapiens
aaugacauggaaauagaugcacacacgugcagugcacacaaagacuccaagccaugugcacagc

SEQ ID NO: 155308 - RNA, 64 nt, Homo Sapiens
gagaaauuuaaacucgaaccacuauagucauacucacacaaaggauagaaaacaccaggccaga

SEQ ID NO: 155309 - RNA, 64 nt, Homo Sapiens
agagggcuuggcucccuuccgcagccauagacaacacacaaacgucugccguccuagcacaaaa

SEQ ID NO: 155310 - RNA, 64 nt, Homo Sapiens
ugaauugaaaauaucccuuaggaaaaaaaaaaaacacacaaaaaaccacaagagccccagccag

SEQ ID NO: 155311 - RNA, 64 nt, Homo Sapiens
cauuaaguaauuuucuuuuugacuuaguauccggcacacaaaguggguuaguacuacaguauuu

SEQ ID NO: 155312 - RNA, 64 nt, Homo Sapiens
uagggaacauuuucuuaaagugaguuugccaaggcacacaaaaagcaacccuugcauuccaccc

SEQ ID NO: 155313 - RNA, 64 nt, Homo Sapiens
uuaugcuagggccccaugcccucccagcccuguucacacaaauucuuccuugucaggcagccaa

SEQ ID NO: 155314 - RNA, 64 nt, Homo Sapiens
agcacaagcccgcugcaugaaaaacacacaaacacacacaaaaacauuuggagauguauggugu

SEQ ID NO: 155315 - RNA, 64 nt, Homo Sapiens
cacacaaaaaagcacaagccuguaugguguaaaacacacaaacaauaaauacuucauuuggaga

SEQ ID NO: 155316 - RNA, 64 nt, Homo Sapiens
uuuaaacacacagauacacacacacacacacacacacacaaaccuucugccuuugauguuacag

SEQ ID NO: 155317 - RNA, 64 nt, Homo Sapiens
uaggugagaaaaaaacaaucuggaagaaaaaaaccacacaaagacauugauucagccuguuugg

SEQ ID NO: 155318 - RNA, 64 nt, Homo Sapiens
ggguugugacccuucauacacacacgcacgcacgcacacaaacaugcacacacgcaugcacaca

SEQ ID NO: 155319 - RNA, 64 nt, Homo Sapiens
cgcacgcacacaaacaugcacacacgcaugcacacacacaaagccuuaagcagaagaaugucuu

SEQ ID NO: 155320 - RNA, 64 nt, Homo Sapiens
gcucacggaccuugaacgagcaaaggcugagucacacacaaaaccgacuccagggugaucugcu

SEQ ID NO: 155321 - RNA, 64 nt, Homo Sapiens
gaagcaggccugccaugagaaggugggcucuagccacacaaagguggggaaaggagaaccggcu

SEQ ID NO: 155322 - RNA, 64 nt, Homo Sapiens
aaaacaaauaaaugaauaaagcugcugugacacacacacaaaaggaauuuaauaguauaauaua

SEQ ID NO: 155323 - RNA, 64 nt, Homo Sapiens
uccgaaaagcaagagacaaagcaagacaaauauucacacaaaaaugaaguguguccucuggagg

SEQ ID NO: 155324 - RNA, 64 nt, Homo Sapiens
aacagacauaagaugucaucaacacgcacacaaacacacaaauaugggaaggaccuggcuuuaa

SEQ ID NO: 155325 - RNA, 64 nt, Homo Sapiens
cacaaauaaacagacauaagggcuuuaaaacacgcacacaaacaaacgaaugugggaaggaccu

SEQ ID NO: 155326 - RNA, 64 nt, Homo Sapiens
cuucgucaauugcacaccggguucugaggucagacacacaaaacuccccugccagagcccuucc

SEQ ID NO: 155327 - RNA, 64 nt, Homo Sapiens
agcagaaauaggaugauguuucccucaaggcugccacacaaaguuccaggggucugggccuccu

SEQ ID NO: 155328 - RNA, 64 nt, Homo Sapiens
auauaucuaucuaucuauacuauauauauaucuacacacaaauuaauacguaauaaagaauaca

SEQ ID NO: 155329 - RNA, 64 nt, Homo Sapiens
aaaaaaucacuaaaaauucccaaauggggaaaaacacacaaaaauuuaagggggggaaagguuu

SEQ ID NO: 155330 - RNA, 64 nt, Homo Sapiens
ggcugaacaggggacuagugcccaggugacacugcacacaaagccaagggcaaacccuauagag

SEQ ID NO: 155331 - RNA, 64 nt, Homo Sapiens
uaugcuguucuuuccauuccuuuucccucugaaacacacaaaauaccaaaggaacuuacgcaac

SEQ ID NO: 155332 - RNA, 64 nt, Homo Sapiens
auuuggugguucugcaugugugaugaaucucuuucacacaaauagacgagaggauauuuagggc

SEQ ID NO: 155333 - RNA, 64 nt, Homo Sapiens
uauuguagagagaugcucaguguuaaaacugaaacacacaaacacacacacacacacauuuuuc

SEQ ID NO: 155334 - RNA, 64 nt, Homo Sapiens
auaauaauaauaacacaucuuuggucaucuaugucacacaaaaauuuuccuuuguuugcggggg

SEQ ID NO: 155335 - RNA, 64 nt, Homo Sapiens
ggugagccacaggcaacucuucucucggaaccugcacacaaacuggggcuauagagauucucca

SEQ ID NO: 155336 - RNA, 64 nt, Homo Sapiens
uucuguccaaacaaacaaacaaaaacuaaacacacacacaaacccccagaaacccacaauaugu

SEQ ID NO: 155337 - RNA, 64 nt, Homo Sapiens
acugaugauauuugaauguuuauuaaauuauuaucacacaaauguguugauauuguggcuauug

SEQ ID NO: 155338 - RNA, 64 nt, Homo Sapiens
aauuguucaguucuuaaaauguaauuaugucacacacacaaaaaaauccuuuucaauccugaga

SEQ ID NO: 155339 - RNA, 64 nt, Homo Sapiens; identical to SEQ ID NO: 118126

SEQ ID NO: 155340 - RNA, 64 nt, Homo Sapiens; identical to SEQ ID NO: 118127

SEQ ID NO: 155341 - RNA, 64 nt, Homo Sapiens; identical to SEQ ID NO: 118128

SEQ ID NO: 155342 - RNA, 64 nt, Homo Sapiens; identical to SEQ ID NO: 118129

SEQ ID NO: 155343 - RNA, 64 nt, Homo Sapiens; identical to SEQ ID NO: 118130

SEQ ID NO: 155344 - RNA, 64 nt, Homo Sapiens; identical to SEQ ID NO: 118131

SEQ ID NO: 155345 - RNA, 64 nt, Homo Sapiens; identical to SEQ ID NO: 118132

SEQ ID NO: 155346 - RNA, 64 nt, Homo Sapiens; identical to SEQ ID NO: 118133

SEQ ID NO: 155347 - RNA, 64 nt, Homo Sapiens; identical to SEQ ID NO: 118134

SEQ ID NO: 155348 - RNA, 64 nt, Homo Sapiens; identical to SEQ ID NO: 118135

SEQ ID NO: 155349 - RNA, 64 nt, Homo Sapiens; identical to SEQ ID NO: 118136

SEQ ID NO: 155350 - RNA, 64 nt, Homo Sapiens; identical to SEQ ID NO: 118137

SEQ ID NO: 155351 - RNA, 64 nt, Homo Sapiens; identical to SEQ ID NO: 118138

SEQ ID NO: 155352 - RNA, 64 nt, Homo Sapiens; identical to SEQ ID NO: 118139

SEQ ID NO: 155353 - RNA, 64 nt, Homo Sapiens; identical to SEQ ID NO: 118140

SEQ ID NO: 155354 - RNA, 64 nt, Homo Sapiens; identical to SEQ ID NO: 118141

SEQ ID NO: 155355 - RNA, 64 nt, Homo Sapiens; identical to SEQ ID NO: 118142

SEQ ID NO: 155356 - RNA, 64 nt, Homo Sapiens; identical to SEQ ID NO: 118143

SEQ ID NO: 155357 - RNA, 64 nt, Homo Sapiens; identical to SEQ ID NO: 118144

SEQ ID NO: 155358 - RNA, 64 nt, Homo Sapiens; identical to SEQ ID NO: 118145

SEQ ID NO: 155359 - RNA, 64 nt, Homo Sapiens; identical to SEQ ID NO: 118146

SEQ ID NO: 155360 - RNA, 64 nt, Homo Sapiens; identical to SEQ ID NO: 118147

SEQ ID NO: 155361 - RNA, 64 nt, Homo Sapiens; identical to SEQ ID NO: 118148

SEQ ID NO: 155362 - RNA, 64 nt, Homo Sapiens; identical to SEQ ID NO: 118149

SEQ ID NO: 155363 - RNA, 64 nt, Homo Sapiens; identical to SEQ ID NO: 118150

SEQ ID NO: 155364 - RNA, 64 nt, Homo Sapiens; identical to SEQ ID NO: 118151

SEQ ID NO: 155365 - RNA, 64 nt, Homo Sapiens; identical to SEQ ID NO: 118152

SEQ ID NO: 155366 - RNA, 64 nt, Homo Sapiens; identical to SEQ ID NO: 118153

SEQ ID NO: 155367 - RNA, 64 nt, Homo Sapiens; identical to SEQ ID NO: 118154

SEQ ID NO: 155368 - RNA, 64 nt, Homo Sapiens; identical to SEQ ID NO: 118155

SEQ ID NO: 155369 - RNA, 64 nt, Homo Sapiens; identical to SEQ ID NO: 118156

SEQ ID NO: 155370 - RNA, 64 nt, Homo Sapiens; identical to SEQ ID NO: 118157

SEQ ID NO: 155371 - RNA, 64 nt, Homo Sapiens; identical to SEQ ID NO: 118158

SEQ ID NO: 155372 - RNA, 64 nt, Homo Sapiens; identical to SEQ ID NO: 118159

SEQ ID NO: 155373 - RNA, 64 nt, Homo Sapiens
gcaggaggucggggcacucugagagagggacagagagagauagagaggcagagagacagagagg

SEQ ID NO: 155374 - RNA, 64 nt, Homo Sapiens
aggagagagagacagaggagguggggagaggggagagagauauggaggggagagagaaagagag

SEQ ID NO: 155375 - RNA, 64 nt, Homo Sapiens
aauugauaguacaaaauccaacaacaauacugagaugaucuaagaagguuauaacaaaaugcuc

SEQ ID NO: 155376 - RNA, 64 nt, Homo Sapiens
uauggaaguuuaaagaaaggacaucaucauagauaugaucuaacaguauuucuaacuauauuug

SEQ ID NO: 155377 - RNA, 64 nt, Homo Sapiens
gagcuaguauugcuguguaucuacucuaaaugagaugaucuauuuuuuugcuagccaucucucc

SEQ ID NO: 155378 - RNA, 64 nt, Homo Sapiens
acacauuuuaucugguguucaaaccaaagaaacaaugaucuacucaaacauuggagaaaaaaac

SEQ ID NO: 155379 - RNA, 64 nt, Homo Sapiens
aaagaggucugucaucuucccccugggauauaagaugaucuagcucccgguagaggaucaccgg

SEQ ID NO: 155380 - RNA, 64 nt, Homo Sapiens
augcugugagucugaaguaugugccuggugugaaaugaucuauggccuguuucuuacacaggaa

SEQ ID NO: 155381 - RNA, 64 nt, Homo Sapiens
uauuauuauugguuauauacuguccauagucuccugucccuacaucauggaucauguccaccuu

SEQ ID NO: 155382 - RNA, 64 nt, Homo Sapiens
uucucuuagaggguggcaaaaugccuuugcccagugucccuauuuuaggcaucuuuuccuuccu

SEQ ID NO: 155383 - RNA, 64 nt, Homo Sapiens
ggcuguucuguuacuuuccuuccaccugugcccucccugggauauguaugccucgcccgcccuc

SEQ ID NO: 155384 - RNA, 64 nt, Homo Sapiens
cucuagcucucucugcaucucccaccccccgacacccugggacccucgaccccacccuucuuuc

SEQ ID NO: 155385 - RNA, 64 nt, Homo Sapiens
caaagaaugaagagccccaugggcccagccccugcccugggaaccaggcagccuuccagaccuc

SEQ ID NO: 155386 - RNA, 64 nt, Homo Sapiens
auuuggggccaaaugaggaaggacacagacucugcccugggaucuccugugcuagcggccaaug

SEQ ID NO: 155387 - RNA, 64 nt, Homo Sapiens
uggggcggggcuucucuccgcgggugggacucuucccugggaaccgcccuccugauuaaggcgu

SEQ ID NO: 155388 - RNA, 64 nt, Homo Sapiens
guuccaugaagcgagucggguccccaacccgugccccugggauccgagggccccucuccaagcg

SEQ ID NO: 155389 - RNA, 64 nt, Homo Sapiens
ggcgccugaacccagaacaucugcgcuuucucagcccugggagggaacagaaagcugucccugg

SEQ ID NO: 155390 - RNA, 64 nt, Homo Sapiens
gaacagaaagcugucccugguacuaaccuagccacccugggagacaguuuuuugucauguaaga

SEQ ID NO: 155391 - RNA, 64 nt, Homo Sapiens
agcuggaagcugccugucaucaugcccgcugcagcccugggaucgguauuuaugggccacugca

SEQ ID NO: 155392 - RNA, 64 nt, Homo Sapiens
ggaagucgcccagcccguauuuuuuggugcuaggcccugggacuccacuguccuccaggcaggc

SEQ ID NO: 155393 - RNA, 64 nt, Homo Sapiens
gggcuauuucucuccccacuuucccggagcacagcccugggaggaauaguuagcccucagucag

SEQ ID NO: 155394 - RNA, 64 nt, Homo Sapiens
gcuaaguucaguucuguuuugggcaugguuccuucccugggaagcaucacucccuggaugugug

SEQ ID NO: 155395 - RNA, 64 nt, Homo Sapiens
ugggugcucugggcugaaccuucucccccacccacccugggaugucccuucagcucagcugcuc

SEQ ID NO: 155396 - RNA, 64 nt, Homo Sapiens
aauuuuuucaccauguuauuaucauucucugcuucccugggagggccccccauguggcacuggc

SEQ ID NO: 155397 - RNA, 64 nt, Homo Sapiens
acgagggaaacgcugaugagugcaccacaggcuccccugggaggcaggcagcaucccaccagcc

SEQ ID NO: 155398 - RNA, 64 nt, Homo Sapiens
ccucccgaccccugcaccuuggauaagccucaggcccugggaaaagaggcagcauuggcccaca

SEQ ID NO: 155399 - RNA, 64 nt, Homo Sapiens
ccuacaggccagaaagaucaggcagcacagaggccccugggacacucuggcuguuuagcuugag

SEQ ID NO: 155400 - RNA, 64 nt, Homo Sapiens
gggcaaccucccuuucacugcacagugccuguugcccugggaaaucagacauguccgugguggg

SEQ ID NO: 155401 - RNA, 64 nt, Homo Sapiens
uccagcauaugacaguggacgcuccuccagcucccccugggaccccucacagcccuuggcuggg

SEQ ID NO: 155402 - RNA, 64 nt, Homo Sapiens
uuguggaaggaaaggugacucuugcuuucauugucccugggauacuuucagcaucuugguugaa

SEQ ID NO: 155403 - RNA, 64 nt, Homo Sapiens
auucucccaccuccucccuuacuucaguugucaccccugggaagucauuccacacugguuagau

SEQ ID NO: 155404 - RNA, 64 nt, Homo Sapiens
uguagcaaauugagugugggugccuuggccccaccccugggagacuucuccuuuugcucacagc

SEQ ID NO: 155405 - RNA, 64 nt, Homo Sapiens
ugggcuuguguuuugucacugcaaauacuccaggcccugggaugugccgucuaugcaaaugcau

SEQ ID NO: 155406 - RNA, 64 nt, Homo Sapiens
uaaccuggcuuccuggaguuguccuucauggaagcccugggagacugcuguucucccuuucucc

SEQ ID NO: 155407 - RNA, 64 nt, Homo Sapiens
uccgaaagcuacaccacagauaggccacaacacccccugggacaauuuaagaagcuaggggaau

SEQ ID NO: 155408 - RNA, 64 nt, Homo Sapiens
ccagaccucagaugaggacuccagaugaaugggucccugggaacggguaggggcuccugggcgg

SEQ ID NO: 155409 - RNA, 64 nt, Homo Sapiens
ccaacuccugucuucccugccuccagcuccacagcccugggaccuacaaagggagaguuggcug

SEQ ID NO: 155410 - RNA, 64 nt, Homo Sapiens
cggaaaguagcugccacuaugcuuucaucagccacccugggaaguucuucucugugacauguug

SEQ ID NO: 155411 - RNA, 64 nt, Homo Sapiens
gcacugcaugcaugugaagcgcugaugcugcuggcccugggacucuaacauguucccaggggau

SEQ ID NO: 155412 - RNA, 64 nt, Homo Sapiens
ccaggaccuagugcaugccagcagcuaucuggggcccugggaaaaaugugcgagucuugagcgc

SEQ ID NO: 155413 - RNA, 64 nt, Homo Sapiens
ccucuagagaagcagaaaccaaagucccccugugcccugggaggguggggccgucuaauuuauu

SEQ ID NO: 155414 - RNA, 64 nt, Homo Sapiens
auguugacagccuugcacuuccacaggcuacaagcccugggaccaucuuucugccuuaagggca

SEQ ID NO: 155415 - RNA, 64 nt, Homo Sapiens
gggcaggagcccacuucuguggcaccagauuccacccugggaacuguggaaaaaguaggagagg

SEQ ID NO: 155416 - RNA, 64 nt, Homo Sapiens
cuggggccccuaagcuccuagagggccuggcucucccugggagguguagaaaugugucacccca

SEQ ID NO: 155417 - RNA, 64 nt, Homo Sapiens
ucugugauguucccaccugccccugggccccaggcccugggacgagcccuucuguaccuggcag

SEQ ID NO: 155418 - RNA, 64 nt, Homo Sapiens
cccagaguugguccaaggaguuggcaccuuacuucccugggauccaccaacccugcauugcagg

SEQ ID NO: 155419 - RNA, 64 nt, Homo Sapiens
auucuuggaguuacugaggugagaccgaaucccucccugggaagcucccuggcugacagguggg

SEQ ID NO: 155420 - RNA, 64 nt, Homo Sapiens
uucuguagaugccaaagggcucuuuuucagcuaacccugggaaggcucugugggagggaggucg

SEQ ID NO: 155421 - RNA, 64 nt, Homo Sapiens
uguuccagucugcccaccugugcucaggaugcagcccugggauccagcacccauggaagcuucu

SEQ ID NO: 155422 - RNA, 64 nt, Homo Sapiens
agcccacucagcuuaauugcggcaggcuucucugcccugggaaguaggaugguggcuggagaca

SEQ ID NO: 155423 - RNA, 64 nt, Homo Sapiens
ugagaggugccagcaauugcaacacacucagcaucccugggaacaggcgguucaagugaaaacc

SEQ ID NO: 155424 - RNA, 64 nt, Homo Sapiens
gcuccaaggccugcucuaggggaucuguguuagucccugggaugagaagccugcgccccaggaa

SEQ ID NO: 155425 - RNA, 64 nt, Homo Sapiens
cauccaguucucaaaucguucacacaccugccaacccugggaagaaagaauucagggaaccauc

SEQ ID NO: 155426 - RNA, 64 nt, Homo Sapiens
aggcuguggccucagggcgcgacccugccagcagcccugggaaaaccccugccagcagcccugg

SEQ ID NO: 155427 - RNA, 64 nt, Homo Sapiens
cugccagcagcccugggaaaaccccugccagcagcccugggacccucugcucaacaggaccaca

SEQ ID NO: 155428 - RNA, 64 nt, Homo Sapiens
augagcguccggucuugcccgacagauuuuuuaucccugggaucgggcccccugcccgcucgcg

SEQ ID NO: 155429 - RNA, 64 nt, Homo Sapiens
cgcacucccccugcccgggcuuaagcgaauggugcccugggaagggacaagucauuaacacacu

SEQ ID NO: 155430 - RNA, 64 nt, Homo Sapiens
uggggccccucgcacuccugggcuccaucggccgcccugggagcuggagaaggugaccguguga

SEQ ID NO: 155431 - RNA, 64 nt, Homo Sapiens
cccugucucagauggccuggucagacggaggggccccugggauuguucagcagacgccgaccac

SEQ ID NO: 155432 - RNA, 64 nt, Homo Sapiens
ugcgucucuccuucucaugcgcgcgcucuccugucccugggacgucucgugcugggaggucuca

SEQ ID NO: 155433 - RNA, 64 nt, Homo Sapiens
ggcacaggcugggcagaggcgggacugaggggaacccugggacaguguggaugggggugaugca

SEQ ID NO: 155434 - RNA, 64 nt, Homo Sapiens
ugagggccugaucaaggcacacccugaacccuuccccugggaggcaaagcacuugacaucaggg

SEQ ID NO: 155435 - RNA, 64 nt, Homo Sapiens
ccagggccuuggggaagggucagagaugccagcccccugggaccucccccauccuuuuugccuc

SEQ ID NO: 155436 - RNA, 64 nt, Homo Sapiens
ucuuagcuggcaggucugggugccccuuuuccuccccugggaagggcuggaauaggauagaaag

SEQ ID NO: 155437 - RNA, 64 nt, Homo Sapiens
gacuugggcacccccagccugggccuauggagagcccugggaccgcuacaccacucuggcagcc

SEQ ID NO: 155438 - RNA, 64 nt, Homo Sapiens
ugcugagaaccuggccuucaguguaccgcgucuacccugggauucaggaaaaggccugggguga

SEQ ID NO: 155439 - RNA, 64 nt, Homo Sapiens
cugaggagagcauuggcugagugcccauuccauacccugggagaugcuuucccccucccuagag

SEQ ID NO: 155440 - RNA, 64 nt, Homo Sapiens
aagggugcuuucccccucccauauuaaaugccuucccugggagguaacccucaggacggaucug

SEQ ID NO: 155441 - RNA, 64 nt, Homo Sapiens
gagaggucuccuaacucgauauuucuggauccuucccugggaggcccaggccugcacuuuggag

SEQ ID NO: 155442 - RNA, 64 nt, Homo Sapiens
agcguuaagggcuccaggauuuuauuuaugaaggcccugggagcacaaugacauaaacggcucu

SEQ ID NO: 155443 - RNA, 64 nt, Homo Sapiens
uuugaugaguaccuauuuugaugcaaaggaacggcccugggaccucagagggccacagaugggc

SEQ ID NO: 155444 - RNA, 64 nt, Homo Sapiens
ccguuccccaaggcagggagagggaguggcccgucccugggaggcuggcaaagugcucuccagg

SEQ ID NO: 155445 - RNA, 64 nt, Homo Sapiens
augggccauauuccgcacugggcacaggccgucacccugggagcagucggcacagugcagcaag

SEQ ID NO: 155446 - RNA, 64 nt, Homo Sapiens
gaugcugcuguacaacuucugggccucucuuggacccugggagugaggguggguguggguggaa

SEQ ID NO: 155447 - RNA, 64 nt, Homo Sapiens
ggggcaguuuguugcguucuucgugguucccaggcccugggacaucucacuccacuccuaccuc

SEQ ID NO: 155448 - RNA, 64 nt, Homo Sapiens
cuauuggccccaggacugaagcugccucccuucacccugggacugugguuccaaggaugagagc

SEQ ID NO: 155449 - RNA, 64 nt, Homo Sapiens
ggcagcugccuucuggucuggaggugggccccggcccugggacagaguccccaucagaggcagu

SEQ ID NO: 155450 - RNA, 64 nt, Homo Sapiens
gacgccuuuccccacuccuguauccccacccccacccugggaaaggacaccugaggggucagga

SEQ ID NO: 155451 - RNA, 64 nt, Homo Sapiens
cuggcugucucucucacacagauacacgugcgcucccugggauccgggaggcccugggcuuccu

SEQ ID NO: 155452 - RNA, 64 nt, Homo Sapiens
guaaaugagagagaagaauagacaggcuuccaaacccugggaagaaagcugcuuaauuauguga

SEQ ID NO: 155453 - RNA, 64 nt, Homo Sapiens
cucucucugaguuccucugggcugccgcaggcuccccugggaauagagcaagacgugaguccua

SEQ ID NO: 155454 - RNA, 64 nt, Homo Sapiens
gugagcccagcguccccuccuuggcuuccaggagcccugggaagcauuuuuaacuggguagaau

SEQ ID NO: 155455 - RNA, 64 nt, Homo Sapiens
uuuugaaguccagagcuggagcaggcgggcagugcccugggagaccccgcucuggauaagacac

SEQ ID NO: 155456 - RNA, 64 nt, Homo Sapiens
agccgccacccaaggagccccauccgcccacccacccugggacccacgcggccacuccagggau

SEQ ID NO: 155457 - RNA, 64 nt, Homo Sapiens
gccacagguccugggaaagaagugggaucuagggcccugggaggagguugagccuggggaagga

SEQ ID NO: 155458 - RNA, 64 nt, Homo Sapiens
uucaggcccaggaccccaagcuccucagccuggccccugggauugcaguugagaguuauucagu

SEQ ID NO: 155459 - RNA, 64 nt, Homo Sapiens
uugaucucuuaagggaacuuuggcuuccccuacgcccugggaguggcugccucucccuucucgg

SEQ ID NO: 155460 - RNA, 64 nt, Homo Sapiens
ccauccaguuccacacgaaccugcaagucuccuacccugggaucggacugucuuggguuuaaaa

SEQ ID NO: 155461 - RNA, 64 nt, Homo Sapiens
uucuugucaguggagggagcagcuccccacucagcccugggacaggcccugggacugugguggc

SEQ ID NO: 155462 - RNA, 64 nt, Homo Sapiens
gagggagcagcuccccacucagcccugggacaggcccugggacugugguggccgguggcccugg

SEQ ID NO: 155463 - RNA, 64 nt, Homo Sapiens
accagagggacccucuggcucaggaggguugggucccugggaggccggcagccaggccacagaa

SEQ ID NO: 155464 - RNA, 64 nt, Homo Sapiens
aggccacagaauccacacguggaccauugugggucccugggaggccggcagccaggccacggaa

SEQ ID NO: 155465 - RNA, 64 nt, Homo Sapiens
aggugacaucgccgggggaggggcugacggccgacccugggagguugccgucuuguaagggugg

SEQ ID NO: 155466 - RNA, 64 nt, Homo Sapiens
agggaaggugcacguccugggggaagucucugggcccugggaaggaacgugugguguguccccu

SEQ ID NO: 155467 - RNA, 64 nt, Homo Sapiens
ucucugggcccugggaagagacgugugguguguccccugggaagagacucauguccagcaagga

SEQ ID NO: 155468 - RNA, 64 nt, Homo Sapiens
gggggccuuucucccaccauggacaaggaggccucccugggagagagaccucagcccaagcuca

SEQ ID NO: 155469 - RNA, 64 nt, Homo Sapiens
ucucagaaccaggaaggaaaggaaguucugcugucccugggaagcuuccuugggaccagugcaa

SEQ ID NO: 155470 - RNA, 64 nt, Homo Sapiens
cgcaaccuuccagcugcuucacagcugccugugacccugggaccgcucagaaccugucacuaau

SEQ ID NO: 155471 - RNA, 64 nt, Homo Sapiens
gacagggcuggcugucucuccaggagggcgaggccccugggacgccacgagcggaaguagccga

SEQ ID NO: 155472 - RNA, 64 nt, Homo Sapiens
ugucacgcgcuuccccgugcccaacgagaaggugcccugggagacggaguuccugaucuaugac

SEQ ID NO: 155473 - RNA, 64 nt, Homo Sapiens
aagacagggcacaggcuacucagagcugaggggccccugggacccuuggccaucaggcgagggg

SEQ ID NO: 155474 - RNA, 64 nt, Homo Sapiens
cgcagagggccccugccaggguuggccccagggacccugggacgaggcugcagaagcucucccu

SEQ ID NO: 155475 - RNA, 64 nt, Homo Sapiens
ugggacgaggcugcagaagcucucccucccuacucccugggagccacgugcuggccauguggcc

SEQ ID NO: 155476 - RNA, 64 nt, Homo Sapiens
ccuagccauggucagacugugcagaggcugcugucccugggacuaaucacagagucugcccuga

SEQ ID NO: 155477 - RNA, 64 nt, Homo Sapiens
ccggcauauacccagggcacuggcagguauggcacccugggagcucaccacucccugggcuggc

SEQ ID NO: 155478 - RNA, 64 nt, Homo Sapiens
ugaacccaccugcguggaauagggagccccaugccccugggacaacaucccaagucugugcagc

SEQ ID NO: 155479 - RNA, 64 nt, Homo Sapiens
cugcugccaccuccugugcacuuugagcaaugcccccugggaucaccccagccacaagcccuuc

SEQ ID NO: 155480 - RNA, 64 nt, Homo Sapiens
auggcccaccuuggagcagagagccaagcaucuucccugggaagucuuucuggccaagucuggc

SEQ ID NO: 155481 - RNA, 64 nt, Homo Sapiens
acuuacuccugccuccaggggcggggcggggccccccugggaccucuuaaggcccaaggugggc

SEQ ID NO: 155482 - RNA, 64 nt, Homo Sapiens
caggcaguauauaggggccgcccaccuucagcugcccugggaugggaaggacccagcccgaccc

SEQ ID NO: 155483 - RNA, 64 nt, Homo Sapiens
uccucuugcagccccccaaacugggaccgaaugacccugggaaggggaacuuggguagguuggg

SEQ ID NO: 155484 - RNA, 64 nt, Homo Sapiens
guuauucuccccagccagagcccgagcuccugcucccugggaaaaguggcguauggcccugagc

SEQ ID NO: 155485 - RNA, 64 nt, Homo Sapiens
ggacaaaagggcccaugcugacuuagggaacaagcccugggauucugggcaugugcugagguug

SEQ ID NO: 155486 - RNA, 64 nt, Homo Sapiens
aacuuaauguccuaaagcaucuaguauagugugacccugggacuugaaggggugacucccuggc

SEQ ID NO: 155487 - RNA, 64 nt, Homo Sapiens
ucuccuggccuucuaggaaugacccagccccuuccccugggaacaggaacagaagugaggauga

SEQ ID NO: 155488 - RNA, 64 nt, Homo Sapiens
uucccacccaggaaaggaggaggccucaccccuccccugggacuauggaagaggaguccugauc

SEQ ID NO: 155489 - RNA, 64 nt, Homo Sapiens
cgugguuuuucccaccccagcugccccagcacgcgggacccauagcacaccccuuagcgcuugc

SEQ ID NO: 155490 - RNA, 64 nt, Homo Sapiens
ccgggcuucgaugugccuggaggauuuccccacagggacccacgcaccucccuguaucugcgca

SEQ ID NO: 155491 - RNA, 64 nt, Homo Sapiens
gggaggcccacuccuggcucaccucucccucucagggacccacgugggagccuggaucccugga

SEQ ID NO: 155492 - RNA, 64 nt, Homo Sapiens
ccacacuagcagcccugacuccacacuccuccuggggacccaagaggcaguguugcugucugca

SEQ ID NO: 155493 - RNA, 64 nt, Homo Sapiens
aagagggugaugagacaggacuagaaaguagugggggacccagcgaguggacgcccugcuccgg

SEQ ID NO: 155494 - RNA, 64 nt, Homo Sapiens
cagcugugugagaaaaugaaagccgacguccacagggacccaggcaggguuggguguugugacu

SEQ ID NO: 155495 - RNA, 64 nt, Homo Sapiens
gucccgaggaaucugccuccguagccucuggccagggacccaauacagggaaaauggagcccaa

SEQ ID NO: 155496 - RNA, 64 nt, Homo Sapiens
agccuccaggaaguccauaccugaguucccacaggggacccagcucuacaccugggcuccaagu

SEQ ID NO: 155497 - RNA, 64 nt, Homo Sapiens
gagggguuggcagcuucucugugacuaaaagcuggggacccacaauccuggaggagaggaaaca

SEQ ID NO: 155498 - RNA, 64 nt, Homo Sapiens
ccuccgcgggagguggcccucagcugggacaguggggacccaggcuucuccucagagccaggcc

SEQ ID NO: 155499 - RNA, 64 nt, Homo Sapiens
ccaacaggcccgugggaccaugacuuagggaggugggacccacccacccccauccaggaaccgu

SEQ ID NO: 155500 - RNA, 64 nt, Homo Sapiens
auguuaaggugaaccccaccccuucuuacagauggggacccagagccugcucuugggaacagcc

SEQ ID NO: 155501 - RNA, 64 nt, Homo Sapiens
cuuucuuccccagggaauucucuagcagagggaggggacccaccccagugaggaaguagauugc

SEQ ID NO: 155502 - RNA, 64 nt, Homo Sapiens
accuaggacucuucccuggagucaugggcugccugggacccaggacccaugagggggcugagag

SEQ ID NO: 155503 - RNA, 64 nt, Homo Sapiens
agcagggguccagagaggcaggcuggggaggcaagggacccauccuaggcccgcuuucuugccg

SEQ ID NO: 155504 - RNA, 64 nt, Homo Sapiens
cuccuuuugucuggugacuccaugcagucacucagggacccaguguagggguauaagucuguuc

SEQ ID NO: 155505 - RNA, 64 nt, Homo Sapiens
cuuacagaguggguaggaugucugcagucacucagggacccagacaggucagcaggaacccuuu

SEQ ID NO: 155506 - RNA, 64 nt, Homo Sapiens
gucucagugccuucaaaaccaggcagggcagcaugggacccaguccucacccugcuccccaccc

SEQ ID NO: 155507 - RNA, 64 nt, Homo Sapiens
gccaagaaagcugagauaucggagucccaggccugggacccagaugaggaagggaauggaccag

SEQ ID NO: 155508 - RNA, 64 nt, Homo Sapiens
gccggggggagggaggagggcccuuucauaugaggggacccagcugugcuccucgguguuacuu

SEQ ID NO: 155509 - RNA, 64 nt, Homo Sapiens
cuuuuggccccagcgcuggccgugugggaggcuggggacccagaccaaggggcccgaggggcug

SEQ ID NO: 155510 - RNA, 64 nt, Homo Sapiens
ccccuaaauucuccuccuccccuaauaucucuuagggacccagaccagcuccuggaagagaugu

SEQ ID NO: 155511 - RNA, 64 nt, Homo Sapiens
ccucaccucccccagagcuauguugcccuagagugggacccagcgucuccuguugaauggcccu

SEQ ID NO: 155512 - RNA, 64 nt, Homo Sapiens
gcaaggcaguccccccacgcccgagaaagccugggggacccagacaccuguccccacagucaaa

SEQ ID NO: 155513 - RNA, 64 nt, Homo Sapiens
ggacccagacaccuguccccacagucaaagccuggggacccagacauccuguccccacagucag

SEQ ID NO: 155514 - RNA, 61 nt, Homo Sapiens
ccaacccuuuccuucucuagugccugggccugggacccacccagagcaccugugcuggagg

SEQ ID NO: 155515 - RNA, 64 nt, Homo Sapiens
uuugaggccccaacaugacagccacugggccaccgggacccaagaagacagcccccugccccau

SEQ ID NO: 155516 - RNA, 64 nt, Homo Sapiens
gcuagggcuaggugucaagagagggugugggauugggacccaggcccuucuuucuaaacucaac

SEQ ID NO: 155517 - RNA, 64 nt, Homo Sapiens
ccccuacugauugcugccuucucuguggcuacaagggacccacagaauuacagggaaguuacag

SEQ ID NO: 155518 - RNA, 64 nt, Homo Sapiens
gccccaucucccucuccccacucaggggucagcagggacccacuggauccugaccccugcaggg

SEQ ID NO: 155519 - RNA, 64 nt, Homo Sapiens
agcaggcugcauggucuagaggcauucucugccagggacccaugccugagucugcuggggagug

SEQ ID NO: 155520 - RNA, 64 nt, Homo Sapiens
cucagugcucccuccagaucggacuuggccccaugggacccaucgucgcucucccacccagccu

SEQ ID NO: 155521 - RNA, 64 nt, Homo Sapiens
cucuuccucuggguaaagguugcagagguucugagggacccagggggcagguugcuaagucagg

SEQ ID NO: 155522 - RNA, 64 nt, Homo Sapiens
ugcuaaaugguuguagggugagaagugcaagaaugaagaugaagccccacugcucggucagucu

SEQ ID NO: 155523 - RNA, 64 nt, Homo Sapiens
gucugccuccguguguccucugaaauaagcagaugaagaugaaagggcaacuuuguuuucuucu

SEQ ID NO: 155524 - RNA, 64 nt, Homo Sapiens
gucacucagaaauccuucaaacaugauuaauuaugaagaugaaacacuagagucauauaagaaa

SEQ ID NO: 155525 - RNA, 64 nt, Homo Sapiens
aaauauauuugaaaugaaaaucuccaacacauuagaagaugaugauguuagaugcccaucgugu

SEQ ID NO: 155526 - RNA, 64 nt, Homo Sapiens
cacacaggaaccuaaugggcuuuuuuuucucacagaagaugaagaauaaggaaugauauaaggu

SEQ ID NO: 155527 - RNA, 64 nt, Homo Sapiens
ggaaauaugacuucaccaagacuagaaaugaauggaagaugaugguguggaaauguaugaucca

SEQ ID NO: 155528 - RNA, 64 nt, Homo Sapiens
guaaacccuggcgacaguugguaacuccuggugugaagaugaaucgaugugaagaugaaugaau

SEQ ID NO: 155529 - RNA, 64 nt, Homo Sapiens
gaauguaacuccuggugugaagcagcgccgaugugaagaugaauucucgguaaccacggcagag

SEQ ID NO: 155530 - RNA, 64 nt, Homo Sapiens
aggcaugacagcuaacagggacgggcuuucuuuggaagaugaugaaauuguggaaugaugguug

SEQ ID NO: 155531 - RNA, 64 nt, Homo Sapiens
gaauauacuagaaaccaaugaauuaaaaacuuuggaagaugaauuuuauggucugugaauuaua

SEQ ID NO: 155532 - RNA, 64 nt, Homo Sapiens
gaacaagcuggugaauaaccuuggcaguggaagggaagaugaugccauuguccuggaugaugcc

SEQ ID NO: 155533 - RNA, 64 nt, Homo Sapiens
caaaaggaccggcucauuuggucacuagucuauagaagaugacacagaaauuggaaccaacaaa

SEQ ID NO: 155534 - RNA, 64 nt, Homo Sapiens
gaacaugagauacucuuuguaaaacuugaggaaggaagaugauaguuuuacuuaauauucccua

SEQ ID NO: 155535 - RNA, 64 nt, Homo Sapiens
auguauguggcuguauuuuguucuuauauuaucugaagaugaauuaucuauuuuuauuuaaccu

SEQ ID NO: 155536 - RNA, 64 nt, Homo Sapiens
uaugguagugacuguucaucauaugacauuuacugaagaugaacuggguccaugaugaagugug

SEQ ID NO: 155537 - RNA, 64 nt, Homo Sapiens
aaaaggcaaacacaaggaaagaucagaugaaacagaagaugauaguaaaagugauccuaaguaa

SEQ ID NO: 155538 - RNA, 64 nt, Homo Sapiens
gcaguuauuaaaucaggaaugcgugguugggggugaagaugauaaagaauaucacaggcuaaua

SEQ ID NO: 155539 - RNA, 64 nt, Homo Sapiens
cuuauuuuugaauuuguauuacugugcagagcaagaagaugauauuuuacccccuuguuauaaa

SEQ ID NO: 155540 - RNA, 64 nt, Homo Sapiens
gcacuuaguagcugugaaggaaggugcagagucagaagaugaagaagaggaggaugugaaacuc

SEQ ID NO: 155541 - RNA, 64 nt, Homo Sapiens
aaaacuugcugcugcugcugaugaugaugaugaugaagaugaugaugaugaugaugacgaggaa

SEQ ID NO: 155542 - RNA, 64 nt, Homo Sapiens
uacuccuugucaucuuacaacuuacuugcacuuugaagaugaguuuuuugugguuguaaauaga

SEQ ID NO: 155543 - RNA, 64 nt, Homo Sapiens
cuccuacaaaacguaacuccaugacacugaugccgaagaugauggccucauaucccccuuauug

SEQ ID NO: 155544 - RNA, 64 nt, Homo Sapiens
augaggaugaagauaaggaaauccugaugaugaugaagaugaugccucgugggucugguagauu

SEQ ID NO: 155545 - RNA, 64 nt, Homo Sapiens
uggaagauggagaagcuguagguuuaacacagaugaagaugacaagaagaugaagaagagaugu

SEQ ID NO: 155546 - RNA, 64 nt, Homo Sapiens
aagagaugugguuuaacacaaugccagaacacuagaagaugaaggaaucacagauaucgaagag

SEQ ID NO: 155547 - RNA, 64 nt, Homo Sapiens
guuguaguccuaugaugauguaaacuugguacuacauaaugacuugcuccacacaugcaguaaa

SEQ ID NO: 155548 - RNA, 64 nt, Homo Sapiens
acauaaugacuugcuccacacaugcaguaaacuacauaaugauguacugguaaacuagaaacaa

SEQ ID NO: 155549 - RNA, 64 nt, Homo Sapiens
uuauauugucacuagaaucucuuaaguauaauuccauaaugacaugggcauauaccguaacauu

SEQ ID NO: 155550 - RNA, 64 nt, Homo Sapiens
auaacuagaaguuagaaaguuuaaaaguuuuccacauaaugaaaguccuucugauaauuugaca

SEQ ID NO: 155551 - RNA, 64 nt, Homo Sapiens
gaccauucaauuaguggucaguguaaaaaaugucucaugucaauauuucaaaauacauuuguaa

SEQ ID NO: 155552 - RNA, 64 nt, Homo Sapiens
uacauaugcugaucuuuuaaguugcugugaacuuucaugucaccuuaaggugauuugugaaaca

SEQ ID NO: 155553 - RNA, 64 nt, Homo Sapiens
gaacgccaggagugcuuucucuuuccauuugcuaucaugucaguacaccuguugcauuuauauu

SEQ ID NO: 155554 - RNA, 64 nt, Homo Sapiens
ggaaaucagcagugauagaucauaaagucauauuucaugucaaagugagguuuaggaagauuuu

SEQ ID NO: 155555 - RNA, 64 nt, Homo Sapiens
gaaaaaaaaauuaauacuacuagcuuccagacaaucaugucaaaauuuaguugaacugguuuuu

SEQ ID NO: 155556 - RNA, 64 nt, Homo Sapiens
uucacuucaaaucauaaacuuagaauucuguaucucaugucagaaauauguuuauggccuugcu

SEQ ID NO: 155557 - RNA, 64 nt, Homo Sapiens
gauagcucuuugcaagugccguagggacuucaugucaugucaaaucauuaauggcuaacaacac

SEQ ID NO: 155558 - RNA, 64 nt, Homo Sapiens
ucaaagauagcucuuugcaaaacacguagggacuucaugucaugugccaucauuaauggcuaac

SEQ ID NO: 155559 - RNA, 64 nt, Homo Sapiens
auugaaaagauuaaauaagagggaaauauuugccucaugucauauuuuugcuuuuuuaaaggag

SEQ ID NO: 155560 - RNA, 64 nt, Homo Sapiens
cagcaguggaaagaauacggagcaccuggcucaaucaugucacaacauucccugaccacaggga

SEQ ID NO: 155561 - RNA, 64 nt, Homo Sapiens
uuuugcuggcugaaagaguauggaauaauauaucucaugucauuuuuuagaagaaaaacuauuu

SEQ ID NO: 155562 - RNA, 64 nt, Homo Sapiens
cccacaccugagaacucgucucauuacuuuauagucaugucauguauguuuuuuuaaccaugaa

SEQ ID NO: 155563 - RNA, 64 nt, Homo Sapiens
aauauucauaaugguuggugucuuuugaaugaauucaugucaaaaauguuauucagcuggggaa

SEQ ID NO: 155564 - RNA, 64 nt, Homo Sapiens
cuuuaaaaaugaaucuugcuucauuugaugaauuucaugucacaaagcuucucucaagagcucu

SEQ ID NO: 155565 - RNA, 64 nt, Homo Sapiens
ccacaaguccauucugccuucaaaguguaaguucucaugucauuauggauuuggaguuugucag

SEQ ID NO: 155566 - RNA, 64 nt, Homo Sapiens
cccaaauauuugaccuaagggaugugucaugucaucaugucaaagguaauuugacagaguguug

SEQ ID NO: 155567 - RNA, 64 nt, Homo Sapiens
augucaaacccaaauauuuggaguguuggaugugucaugucauccuugugcagguaauuugaca

SEQ ID NO: 155568 - RNA, 64 nt, Homo Sapiens
gaccauuuuaucccuucagucuaacuugaugaggucaugucacacaaacauaguuauguuuucu

SEQ ID NO: 155569 - RNA, 64 nt, Homo Sapiens
ggaauauggaagagauugugucgugcauauuugcucaugucacauuuuguauuauuuuuuuuau

SEQ ID NO: 155570 - RNA, 64 nt, Homo Sapiens
ggcugggugcgguggcuccuaauuugaucaauuuucaugucauuacuguugucucuaccuuccc

SEQ ID NO: 155571 - RNA, 64 nt, Homo Sapiens
cuccuuaccagccacuuuccauuauugccggcugucaugucagcacuuguaaugaucacuaauu

SEQ ID NO: 155572 - RNA, 64 nt, Homo Sapiens
gccuggagagaaacuuccagaccagcccucucacuacagccaggagaggccuuucccgccugga

SEQ ID NO: 155573 - RNA, 64 nt, Homo Sapiens
accgggagagaaacuuccagaccagcccucucacuacagccagaagaggccuuucccaccggga

SEQ ID NO: 155574 - RNA, 64 nt, Homo Sapiens
aauacuauauuuauacuguauauauaauacugacugagaauauaauacuguauuugagaauaua

SEQ ID NO: 155575 - RNA, 64 nt, Homo Sapiens
uauauaauacugacugagaauauaauacuguauuugagaauauaaaaaacuuuuuucagggaag

SEQ ID NO: 155576 - RNA, 64 nt, Homo Sapiens
cauaauuucaugcacaaguugacugagcuaaucuugagaauauauucguaaaauaggagcacau

SEQ ID NO: 155577 - RNA, 64 nt, Homo Sapiens
aaacauuugaaauacuaccauauuugugauuuauugagaauaaaaauccauuuugaaauguaaa

SEQ ID NO: 155578 - RNA, 64 nt, Homo Sapiens
gauuugguucagggcaacuaacugagugcaacauugagaauaauaagguaguaggucucuuuca

SEQ ID NO: 155579 - RNA, 64 nt, Homo Sapiens
uuuuuauuauuauauccuaugaaaauauacacauugagaauaauggacacugucaggcaaauuu

SEQ ID NO: 155580 - RNA, 64 nt, Homo Sapiens
cuagccuuuuaagagagguuuuuaaccugaagcaugagaauauaucaccugugguuuuuccuuu

SEQ ID NO: 155581 - RNA, 64 nt, Homo Sapiens
acccaaaauuaacuuaugcucauauauuaggaugugagaauaucaucuguuuauggacacauga

SEQ ID NO: 155582 - RNA, 64 nt, Homo Sapiens
acuugugcaauauauauguuuuaaaaaacaaauuugagaauacauuuaaucauagggauauaga

SEQ ID NO: 155583 - RNA, 64 nt, Homo Sapiens
uaucuuuauaugucaaacugguugaacacuguaaugagaauaaacugcacagaguuuauucuga

SEQ ID NO: 155584 - RNA, 64 nt, Homo Sapiens
cuuagaaaaucacacuuaucugcaggaagucucgugagaauauacuggucugagacuuacugug

SEQ ID NO: 155585 - RNA, 64 nt, Homo Sapiens
cuguauuauaugaaaccagcaccuuguuuauaggugagaauagggacucuaagaaguauguaga

SEQ ID NO: 155586 - RNA, 64 nt, Homo Sapiens
augauuuccaccaucaggauuaauaaccuguguaugagaauaaagucucuuccuaauugugcug

SEQ ID NO: 155587 - RNA, 64 nt, Homo Sapiens
accuacagagguucauacugacucacuguacacuugagaauaaugaagauuucaagaaaggaca

SEQ ID NO: 155588 - RNA, 64 nt, Homo Sapiens
uuacaugcucauaauacaggauuucuuuaaacccugagaauaauacuuaacauucuuuuucugu

SEQ ID NO: 155589 - RNA, 64 nt, Homo Sapiens
uaacauucuuuuucuguauuaaagcacguuggacugagaauacuugucauuuuguugaugaugc

SEQ ID NO: 155590 - RNA, 64 nt, Homo Sapiens
uaaggagaggagcggcguuggcaaaugugaaccaugagaauaucagugauacugaugagaauaa

SEQ ID NO: 155591 - RNA, 64 nt, Homo Sapiens
caaaugugaaccaugagaauaucagugauacugaugagaauaaacuaaacgccuuuguaacagc

SEQ ID NO: 155592 - RNA, 64 nt, Homo Sapiens
uuuucuaaaauuacauguuuauaaauuuuuuuauugagaauaaauguauuaaccauuauugaga

SEQ ID NO: 155593 - RNA, 64 nt, Homo Sapiens
uuuuuuuauugagaauaaauguauuaaccauuauugagaauaaaaaugcuguuucugaguuauu

SEQ ID NO: 155594 - RNA, 64 nt, Homo Sapiens
aacaaucuaaauccagaaaauuaauauaaauaugugagaauaaauuauguaaaauauuaaagca

SEQ ID NO: 155595 - RNA, 64 nt, Homo Sapiens
ucaggagaacaaaaggaaacgcuagaugaggacaugagaauaauggauucguguagguggcaaa

SEQ ID NO: 155596 - RNA, 64 nt, Homo Sapiens
gauuuccccacagggacccacgcaccucccuguaucugcgcagcuugcucguguggcuggaagc

SEQ ID NO: 155597 - RNA, 64 nt, Homo Sapiens
agcaaucucagggauagccagcagcagcuccaggucugcgcagcaggaauuacuuuuuguuguu

SEQ ID NO: 155598 - RNA, 64 nt, Homo Sapiens
ggaugggccugggggaacucgguggccccugaauucugcgcaagaaaagcaagggguuugucca

SEQ ID NO: 155599 - RNA, 64 nt, Homo Sapiens
gguugcuguccucucauuugaugggaucucaucgucugcgcaguuuccagacggaugucuuaaa

SEQ ID NO: 155600 - RNA, 64 nt, Homo Sapiens
ccugcucgagagcccgcgcuagagucggggaggaucugcgcagagaccgcagcaucacccaaau

SEQ ID NO: 155601 - RNA, 64 nt, Homo Sapiens
ggguuucaccaaggauggagcuuccacguugccuucugcgcaaagagaugaguaaaaacaucag

SEQ ID NO: 155602 - RNA, 64 nt, Homo Sapiens
auccucugaggcggccaccgcgcgccggccgcgcucugcgcacaaaagccaaacgcauccgacu

SEQ ID NO: 155603 - RNA, 64 nt, Homo Sapiens
auaagaaugauuuagacugaccuguccuuuuuuaucugcgcaugcgagaacaucaccuuccucu

SEQ ID NO: 155604 - RNA, 64 nt, Homo Sapiens
aucucaacugccguucaacaucaauaagguccauucugcgcaguaauggauguuggguaggcca

SEQ ID NO: 155605 - RNA, 64 nt, Homo Sapiens
cgcuuccgagggcagaaauaugcuaaccaugcuaucugcgcagauccccaugguuccugccacu

SEQ ID NO: 155606 - RNA, 64 nt, Homo Sapiens
ccacucuggcuuccuuucagaucauuuaguuucuucugcgcaagucucccuccccuaccccucu

SEQ ID NO: 155607 - RNA, 64 nt, Homo Sapiens
aagugagaaagacugaguugcgugucuguaaaugucugcgcagggugcacaugcugcgaggucu

SEQ ID NO: 155608 - RNA, 64 nt, Homo Sapiens
uggcccuguugagcacucuuccuucuauuugaccucugcgcauuauccacugggcacuucuuaa

SEQ ID NO: 155609 - RNA, 64 nt, Homo Sapiens
gucaaucaggguagaggggguugugcagucagggucugcgcacaguuaaucaggggugucuuuc

SEQ ID NO: 155610 - RNA, 64 nt, Homo Sapiens
aguguuauuccauuacuagcgucauggagcuaccucugcgcaucagacuucagaccuugaacaa

SEQ ID NO: 155611 - RNA, 64 nt, Homo Sapiens
gcccagggucgccgccgccccucgcaccgcuaggucugcgcaccaucucgcccccgccgugggg

SEQ ID NO: 155612 - RNA, 64 nt, Homo Sapiens
accaggcuccagcucaucccuccaaggcccugucucugcgcacagcaaccauggacaugggaga

SEQ ID NO: 155613 - RNA, 64 nt, Homo Sapiens
aagaaaagaaucucaguugcgacacacaaggacgucugcgcagcacacacacacacaaaauaaa

SEQ ID NO: 155614 - RNA, 64 nt, Homo Sapiens
uuuuaaguuaauucacauaaccuuuuccagggugucugcgcacauauguauaccugccaagaua

SEQ ID NO: 155615 - RNA, 64 nt, Homo Sapiens
ugcucccugcucuuucugccucugggcucauguaucugcgcagcucugguacccucugugggug

SEQ ID NO: 155616 - RNA, 64 nt, Homo Sapiens
uugugucuuguaggguauggauagccaaggcucgucugcgcaccucuuccugcagcgccgguac

SEQ ID NO: 155617 - RNA, 64 nt, Homo Sapiens
guggugguauucugucauuuuucuguggccgccaucugcgcaggcagaaugaauucgaugcgua

SEQ ID NO: 155618 - RNA, 64 nt, Homo Sapiens
cccgggcugcucaccucuccccuucugcugagcuucugcgcaccccucccuggaacuuagccau

SEQ ID NO: 155619 - RNA, 64 nt, Homo Sapiens
cccauuuccaaaaauaaacuaaauuucgcuuagcucugcgcacuauuuccuuauuaggagaaau

SEQ ID NO: 155620 - RNA, 64 nt, Homo Sapiens
caggauucaguguggggacgaugccggcuugaguucugcgcacgggggcguucccacugccugg

SEQ ID NO: 155621 - RNA, 64 nt, Homo Sapiens
ucacccgcccggcuggccccccugucccuuccucucugcgcauccaccucgugccuuuauccgc

SEQ ID NO: 155622 - RNA, 64 nt, Homo Sapiens
uuuucucccuggccuccagugcccaccaggaggaucugcgcacggugcacagcccaccagagca

SEQ ID NO: 155623 - RNA, 64 nt, Homo Sapiens
cugggcccgagcucagaaacagcugucgccucagucugcgcacaggcaugcaccccaggguagu

SEQ ID NO: 155624 - RNA, 64 nt, Homo Sapiens
ugcuugggccauaacacaggagaccugcucccuaucugcgcacccggagguggggugaggacgg

SEQ ID NO: 155625 - RNA, 64 nt, Homo Sapiens
aaugugacauuaacauucccaucgccuaccauuuucugcgcagauaugcuaggguaagagagaa

SEQ ID NO: 155626 - RNA, 64 nt, Homo Sapiens
aaggaauggagaggaggggauagcugcagaugccucugcgcaccguucauugauggaugucuuc

SEQ ID NO: 155627 - RNA, 61 nt, Homo Sapiens
aauuuccccuuuuuuuaaaaaauggaaauauucaauugagacuugaggggaauaauagaaa

SEQ ID NO: 155628 - RNA, 61 nt, Homo Sapiens
uaacauuguuaaugcacuaagugauuuaaauucaauugaugaagaugugauuuuacagaag

SEQ ID NO: 155629 - RNA, 64 nt, Homo Sapiens
cgggcagaucacgagaucaggaguucaagaccagccuggccaauaugaugaaaccccgucucua

SEQ ID NO: 155630 - RNA, 64 nt, Homo Sapiens
gguggaucaccugaggucagaaguuugagaccagccuggccaacauggugaaaccccgucucua

SEQ ID NO: 155631 - RNA, 64 nt, Homo Sapiens
caaagugcugggauuacaggcaugagccaccacgccuggccaaaaaaauauguuuuaaaugucc

SEQ ID NO: 155632 - RNA, 64 nt, Homo Sapiens
gguggaucacccaaggucaggaguuugagaccagccuggccaaauggugaaaccccaucucuac

SEQ ID NO: 155633 - RNA, 64 nt, Homo Sapiens
caggagcaguccgacuaggccccaggcccgcccuccuggccagcagaguggggcacuggggggc

SEQ ID NO: 155634 - RNA, 64 nt, Homo Sapiens
gcauccugccuugcugcucugucccccacaucuuccuggccacagccccuugccccuccucuaa

SEQ ID NO: 155635 - RNA, 64 nt, Homo Sapiens
cugcuggcuccugggugagcaugguggccacacgccuggccagccacgaggauccucagugacc

SEQ ID NO: 155636 - RNA, 64 nt, Homo Sapiens
gggcuagaccucccaggcuaccuuucacaccuugccuggccaagcucugucccccucuacuguc

SEQ ID NO: 155637 - RNA, 64 nt, Homo Sapiens
guuuaggcacccagacauaagaagaaaaggcucaccuggccacucacagaaucagaaagagcua

SEQ ID NO: 155638 - RNA, 64 nt, Homo Sapiens
aggggcauggccaccucccaugaggggcagggucccuggccagacaugcagaaguagaagcugg

SEQ ID NO: 155639 - RNA, 64 nt, Homo Sapiens
acagugaaaccccaucuguagaguucaagaccauccuggccaacggcagaucaccugaagucag

SEQ ID NO: 155640 - RNA, 64 nt, Homo Sapiens
caugguggcucacaccuauacacauaacauggaaccuggccaggcugucacgaagcagaguugg

SEQ ID NO: 155641 - RNA, 64 nt, Homo Sapiens
ugcccccuuagcauuuguucuugguuccaggguuccuggccagguuccagugaagcacgagguc

SEQ ID NO: 155642 - RNA, 64 nt, Homo Sapiens
gcccuggggaggcagaggguugcccaccuagcucccuggccagggcguucugcagcauguagca

SEQ ID NO: 155643 - RNA, 64 nt, Homo Sapiens
augguaaaaccccgugucuagaguucgagacuagccuggccaauggguagauaccugaagucag

SEQ ID NO: 155644 - RNA, 64 nt, Homo Sapiens
gcguaucaggcuucuggggacgggacucagucucccuggccacuucccaccccaaacccucucc

SEQ ID NO: 155645 - RNA, 64 nt, Homo Sapiens
auggugaaaccccaucucuagaguucgagaccacccuggccaacgccagaucaccugaggucag

SEQ ID NO: 155646 - RNA, 64 nt, Homo Sapiens
auggugaaaccuggccucuaaaguuugagaccagccuggccaacggcggaucaccugagguuag

SEQ ID NO: 155647 - RNA, 64 nt, Homo Sapiens
uuuaauggccagagcuugaacaugaaaaugaugaccuggccauuauuagggcagcuuaccccaa

SEQ ID NO: 155648 - RNA, 64 nt, Homo Sapiens
auggugaaaccccgucucuagaguucaagagcagccuggccaaccgggcggaucacaaggucca

SEQ ID NO: 155649 - RNA, 64 nt, Homo Sapiens
caaacggaucacgaggucaggagaucaagaccauccuggccaacauggugaaaccccaucucua

SEQ ID NO: 155650 - RNA, 64 nt, Homo Sapiens
gguggaucucuugaggucgggaguuugagaccagccuggccaacauggugaaacccugucuuua

SEQ ID NO: 155651 - RNA, 64 nt, Homo Sapiens
agauuuuuucuguugcucuuugaaaacuaugagcccuggccagcuuaaccuggucugaggugag

SEQ ID NO: 155652 - RNA, 64 nt, Homo Sapiens
ggcggaucaccugaugucagggguucgagaccagccuggccaacauggugaaacccuguugcua

SEQ ID NO: 155653 - RNA, 64 nt, Homo Sapiens
auggugaaaccccgucucuagagaucgagaccauccuggccaaccggggggaucacgaggucaa

SEQ ID NO: 155654 - RNA, 64 nt, Homo Sapiens
gccccuccuguggggugcccucucugcaucccaaccuggccaaggacacccuccugccuguuuu

SEQ ID NO: 155655 - RNA, 64 nt, Homo Sapiens
uccccuggcuccagagauggucacaugacccaggccuggccagucaaaguagucucuccccugg

SEQ ID NO: 155656 - RNA, 64 nt, Homo Sapiens
ugacccaggccuggccagucaaaguagucucuccccuggccacaguaauuggucaugugaugca

SEQ ID NO: 155657 - RNA, 64 nt, Homo Sapiens
cugcccugcuaaagacagugcggaugcaagagcaccuggccaagcgagagcagcuggguaagcg

SEQ ID NO: 155658 - RNA, 64 nt, Homo Sapiens
agauggggcgagccaggaccacagagcuccuggcccuggccagaagcaggagugugaggaggag

SEQ ID NO: 155659 - RNA, 64 nt, Homo Sapiens
caaagugcugggauuacagacaugagccaccgagccuggccaauuuuuguguuuuuuguagaga

SEQ ID NO: 155660 - RNA, 64 nt, Homo Sapiens
cgggcagaucacgaggucaagagaucaagaccauccuggccaacauggugaaauccugccucua

SEQ ID NO: 155661 - RNA, 64 nt, Homo Sapiens
caaagggcugagauuacaggugugagcuaccucaccuggccaaaacaguuuuuuuagaaaugaa

SEQ ID NO: 155662 - RNA, 64 nt, Homo Sapiens
uuccuucugccaugggaggaugaaacaugaaggcccuggccagguguggccccuccaucuuccg

SEQ ID NO: 155663 - RNA, 64 nt, Homo Sapiens
ccaaaagagagggauggcuuucccagaagacacuccuggccaucuguggauuugucugugcacc

SEQ ID NO: 155664 - RNA, 64 nt, Homo Sapiens
aguccacuugggucaucagcucugccaagcugagccuggccaagcuagguggacagacccuugc

SEQ ID NO: 155665 - RNA, 64 nt, Homo Sapiens
gacaggccugaggcccugggcacagugacgguggccuggccagcccucgggaccccuccccacc

SEQ ID NO: 155666 - RNA, 64 nt, Homo Sapiens
ucacuaugcaaacuagaauauccucagcagguggccuggccacucuggagaaagaaacccaagg

SEQ ID NO: 155667 - RNA, 64 nt, Homo Sapiens
caagaagacugucaggaaggugcugggcccccagccuggccagacugucucucccuuccaggaa

SEQ ID NO: 155668 - RNA, 64 nt, Homo Sapiens
ucaccuggcugcuaggccaguguacaggaaggugccuggccaugggccaggagcccacagugcc

SEQ ID NO: 155669 - RNA, 64 nt, Homo Sapiens
augguaaaaccccgucucuagaguuugagaccagccuggccaaguggguggaucacaaggucag

SEQ ID NO: 155670 - RNA, 64 nt, Homo Sapiens
agugaucugcccgccuuggcccuggucuugaacuccuggccacaggccuggcugaucucaaacu

SEQ ID NO: 155671 - RNA, 64 nt, Homo Sapiens
gguggaccacaugaggucaggaguuugagaucagccuggccaacauggugaaaccccaucucua

SEQ ID NO: 155672 - RNA, 64 nt, Homo Sapiens
cgggcggaucaugaggucaagagaucaagaucauccuggccaacauggugaaacccugucucua

SEQ ID NO: 155673 - RNA, 64 nt, Homo Sapiens
gguggaucaccugaggucaggaguucaugaccagccuggccagcaugguaaaacccugucucca

SEQ ID NO: 155674 - RNA, 64 nt, Homo Sapiens
ugggcagaucuugaggucgguagauggagaccauccuggccaacauggugaaacccugucucua

SEQ ID NO: 155675 - RNA, 64 nt, Homo Sapiens
ucaccccaccuucaucaucaugcuccagggucacccuggccagcucuugugcugggacagggga

SEQ ID NO: 155676 - RNA, 64 nt, Homo Sapiens
aguagauggugggggacagcggcguggguccuagccuggccagugaugcugcuggcguccagac

SEQ ID NO: 155677 - RNA, 64 nt, Homo Sapiens
aggggaaaaccucaguuggccucugccccucuucccuggccaggggcuucucccccucagcucu

SEQ ID NO: 155678 - RNA, 64 nt, Homo Sapiens
cuuccagggccccacgguccccaggaggacgcuuccuggccaaagccccaagccuuuggugaga

SEQ ID NO: 155679 - RNA, 64 nt, Homo Sapiens
acagugugauucccccagagcagaugguaucuuuccuggccaugaugguauccuucuuggccaa

SEQ ID NO: 155680 - RNA, 64 nt, Homo Sapiens
cagcuuccugcuaugcugggaucagaaaggggaaccuggccagcaguggccguagcaucacccc

SEQ ID NO: 155681 - RNA, 64 nt, Homo Sapiens
uucacagauccuucucuugaauagacaccucugcccuggccacgccaacauuuaagaaacccca

SEQ ID NO: 155682 - RNA, 64 nt, Homo Sapiens
auggugaaaccccaucucuagaguucaagaccagccuggccaacggcagaucaccugagguuag

SEQ ID NO: 155683 - RNA, 64 nt, Homo Sapiens
ucaugaaaauagcucuuucagggggguugugaggccuggccaggcacccccuggagagaaguuu

SEQ ID NO: 155684 - RNA, 64 nt, Homo Sapiens
uggggggaucacaaggucacuagauggcgagcauccuggccaacauggugaaaccccgucucua

SEQ ID NO: 155685 - RNA, 64 nt, Homo Sapiens
ucaucuaccuggagugggccgccucagguuuugcccuggccaugauauccccaggcacacucug

SEQ ID NO: 155686 - RNA, 64 nt, Homo Sapiens
gaaugucuccaggcagauauugggcugcccccaaccuggccacucccacuuccacucaggaaau

SEQ ID NO: 155687 - RNA, 64 nt, Homo Sapiens
auggugaaaccccgucucuagagaucgagaccauccuggccaaccaggcggaucacaaggucca

SEQ ID NO: 155688 - RNA, 64 nt, Homo Sapiens
auggcaaaaucccaucucuagaguucaagaccagccuggccaacggcggaucacuugaggccag

SEQ ID NO: 155689 - RNA, 64 nt, Homo Sapiens
gugucuuuugaauauuuuuuauuaagccaccacuccuggccaacuguaguugaacucagguauu

SEQ ID NO: 155690 - RNA, 64 nt, Homo Sapiens
ggcggaucacuugaggucaggaguucaaaaccagccuggccaagauggugaaaccccaucucua

SEQ ID NO: 155691 - RNA, 64 nt, Homo Sapiens
cacauaagccaaucggggauaccaucagcauccuccuggccagcuuucugcaauaagcucucag

SEQ ID NO: 155692 - RNA, 64 nt, Homo Sapiens
ugcauaaauguauuuuucugaccaucagcauccuccuggccagcuuucugcaauucacucucag

SEQ ID NO: 155693 - RNA, 64 nt, Homo Sapiens
uuuuucuuuuauucuucuuuugugagccaccgugccuggccagacaaagugcugagauugcaga

SEQ ID NO: 155694 - RNA, 64 nt, Homo Sapiens
agccauccucccuccaccucagcagugugaauagccuggccacccgaaaaagaggcauacacac

SEQ ID NO: 155695 - RNA, 64 nt, Homo Sapiens
gccccugcgcagacugucagccuguuccucuuccccuggccaggccugccuagucucacauguc

SEQ ID NO: 155696 - RNA, 64 nt, Homo Sapiens
agccucccuuucugccugacacccagggucccagccuggccaccucaacuaaucacgucucugc

SEQ ID NO: 155697 - RNA, 64 nt, Homo Sapiens
gccucugugcagacagugucccugucccucucgcccuggccaggccugccuagucucacauguc

SEQ ID NO: 155698 - RNA, 64 nt, Homo Sapiens
agcuucccucugccugacccacccagggucccagccuggccaccuuaacuagucuugcaucugc

SEQ ID NO: 155699 - RNA, 64 nt, Homo Sapiens
caaaguguugggauuacaggcaugagccacugcgccuggccagcaaaugcuuuuugugcagaau

SEQ ID NO: 155700 - RNA, 64 nt, Homo Sapiens
aggggcaagcagcauugcauucugggggaacgauccuggccacagccgccaaacaaacauucac

SEQ ID NO: 155701 - RNA, 64 nt, Homo Sapiens
cagacuguugggauuacaggcaugagccaccacgccuggccaguuucuucauuuuacauauggu

SEQ ID NO: 155702 - RNA, 64 nt, Homo Sapiens
cagguggaagaaaguuuccacuguuugcugccuuccuggccagcaucauuccgagucaucaucu

SEQ ID NO: 155703 - RNA, 64 nt, Homo Sapiens
gcguuugaccgacagacaauuucagagcagagcuccuggccagacaguggagccaugccugggu

SEQ ID NO: 155704 - RNA, 64 nt, Homo Sapiens
aggcagggcugccuucugcuccugccuaccugggccuggccagccuccccaugcagagcgggag

SEQ ID NO: 155705 - RNA, 64 nt, Homo Sapiens
gaucucaucaucauccuuagucaagcagcagggcccuggccacguggagcaacacugacuagaa

SEQ ID NO: 155706 - RNA, 64 nt, Homo Sapiens
uucuguucuucccucacuccauccccgcuaccguccuggccagcuaccgucagagagaaccaga

SEQ ID NO: 155707 - RNA, 64 nt, Homo Sapiens
auggugaaaccccaucucuagaguuugagaccagccuggccaacggcaaaucaccugaggucaa

SEQ ID NO: 155708 - RNA, 64 nt, Homo Sapiens
guggugaaacgcugucucuagaguucgagaccagccuggccaacgguggauugcuugaggccag

SEQ ID NO: 155709 - RNA, 64 nt, Homo Sapiens
ccagcacuuugggaggccaggaguucgagaccagccuggccaacauggugaaacccggucucua

SEQ ID NO: 155710 - RNA, 64 nt, Homo Sapiens
ggcggaucaccugaggucaggaguuugagaccagccuggccaacauggcaaaaccccgucucua

SEQ ID NO: 155711 - RNA, 64 nt, Homo Sapiens
ugaucguguuggugacagacucucccugccccgcccuggccaugucccugcugugagccgaagc

SEQ ID NO: 155712 - RNA, 64 nt, Homo Sapiens
cuugcaagaggacugggguccuugacucugccucccuggccagccucuugucgccuuggcagga

SEQ ID NO: 155713 - RNA, 64 nt, Homo Sapiens
ugcgguggcucacuccuguauuugaaagcugagaccuggccagggguggaaauggggaugucag

SEQ ID NO: 155714 - RNA, 64 nt, Homo Sapiens
ggcaucacucuucaggcuggugacaaaaccacucccuggccaaucacuucacagccaacggcua

SEQ ID NO: 155715 - RNA, 64 nt, Homo Sapiens
gggcuucauucccagaucuugcccugucuaucuuccuggccacacuggaggcccagaaguugcu

SEQ ID NO: 155716 - RNA, 64 nt, Homo Sapiens
guaccuuuugauguuuagaaucuccugccgcaccccuggccauuaaggcugcccugcccccgac

SEQ ID NO: 155717 - RNA, 64 nt, Homo Sapiens
cucucccuccuguccuguaccaguggggggugcaccuggccagaucuccugguugaaugagaug

SEQ ID NO: 155718 - RNA, 64 nt, Homo Sapiens
ugcagcugggcugagugaugucgaucuugagagaccuggccacaagagagagccacuuacaaag

SEQ ID NO: 155719 - RNA, 64 nt, Homo Sapiens
uagccugcuccucugcucucuggucuugaggguuccuggccaccucaaccagggcuggccaccc

SEQ ID NO: 155720 - RNA, 64 nt, Homo Sapiens
gccucuuaggaguccucagagagccuucugugccccuggccagcugauaauccuagguucauga

SEQ ID NO: 155721 - RNA, 64 nt, Homo Sapiens
uucuuaacauguugagagaugauucuuucuuggcccuggccaucucgggaagcuugauggcaau

SEQ ID NO: 155722 - RNA, 64 nt, Homo Sapiens
gggugccaagaggggggcagauugggguuagugaccuggccagaguggccucuucaucaggggu

SEQ ID NO: 155723 - RNA, 64 nt, Homo Sapiens
cugggcuuggguaucuccuucccucugucucccuccuggccauugccauccuucggggcucucu

SEQ ID NO: 155724 - RNA, 64 nt, Homo Sapiens
acggugaaaccccaucucuagagcucgagaccagccuggccaacggcggaucacuugaggucag

SEQ ID NO: 155725 - RNA, 64 nt, Homo Sapiens
auggugaaaccccaucucuagagcucaagaccagccuggccaacggcggaucacuugaggucag

SEQ ID NO: 155726 - RNA, 64 nt, Homo Sapiens
gaaggaucaccugagaucaggaguuccagaccagccuggccaacauggcgaaaccccaucucua

SEQ ID NO: 155727 - RNA, 64 nt, Homo Sapiens
ugggcggaucacaaggucaggaguucgagaccagccuggccaauauggugaaaccccaucucua

SEQ ID NO: 155728 - RNA, 64 nt, Homo Sapiens
gggaauuccggccagcagcuuccuccuucagccaccuggccauaccccuuaaauaagccccuca

SEQ ID NO: 155729 - RNA, 64 nt, Homo Sapiens
gauguuaccuugcuuguccacagcagccagucacccuggccagucccacuuccuggauaauucu

SEQ ID NO: 155730 - RNA, 58 nt, Homo Sapiens
ccgagagguuccugaucuaggccccagaccuggccaggccagccucccugugcgugug

SEQ ID NO: 155731 - RNA, 64 nt, Homo Sapiens
cugccucgcccccuacaggccucugggcccagcuccuggccaggcugcugccaaggucaagccc

SEQ ID NO: 155732 - RNA, 64 nt, Homo Sapiens
cccagcauuguauuucccugugaccccuuacucuccuggccagaacuugagccagcugugggau

SEQ ID NO: 155733 - RNA, 64 nt, Homo Sapiens
gguggaucaccugagguuaggaguucgagaucagccuggccaacauggugaaacccugucuacu

SEQ ID NO: 155734 - RNA, 64 nt, Homo Sapiens
cacccuagcaggaaggggcuuggaagcaggccauccuggccagaugugugaaggugaggacucu

SEQ ID NO: 155735 - RNA, 64 nt, Homo Sapiens
uccugccaccuccagcagacugggcucaaggauuccuggccagccucagccaguaccugcccca

SEQ ID NO: 155736 - RNA, 64 nt, Homo Sapiens
auagugaaaccccgucucuagcauuugagaccagccuggccaacgguggaucacucaaggucag

SEQ ID NO: 155737 - RNA, 64 nt, Homo Sapiens
auggcaaaaccccgucucuagaguugcagaccagccuggccaacggcagaucaccugaggcuag

SEQ ID NO: 155738 - RNA, 64 nt, Homo Sapiens
gagaacagccaaauucacaagagcagagacucugccuggccacucuagcugggaaagaagagug

SEQ ID NO: 155739 - RNA, 64 nt, Homo Sapiens
ccgugucccaggaccguaccguccgcaucugggaccuggccacccugcagcaggugggguuugg

SEQ ID NO: 155740 - RNA, 64 nt, Homo Sapiens
cccagcugcugcgaguugacaucggcacucuggaccuggccagcagccgccuggacucagccau

SEQ ID NO: 155741 - RNA, 64 nt, Homo Sapiens
cgaagugcugggauuauaggcguaagccaccaugccuggccaaaaauuaaaagauuuuaugaaa

SEQ ID NO: 155742 - RNA, 64 nt, Homo Sapiens
ugcugauuuccuaaaugcuacccuuugaucauuuccuggccaccaucacaauacuaaggggcuc

SEQ ID NO: 155743 - RNA, 64 nt, Homo Sapiens
ggccucuguaccacccuguggguuuucuuggacaccuggccagugcugaagggcuguugugaug

SEQ ID NO: 155744 - RNA, 64 nt, Homo Sapiens
gugacugacuggugucuucccauuuggacuguggccuggccagagccccuugcauauccccacu

SEQ ID NO: 155745 - RNA, 64 nt, Homo Sapiens
accccuggcuggaguggguuacagaacagcacauccuggccagcgacucagugaccacgucaug

SEQ ID NO: 155746 - RNA, 64 nt, Homo Sapiens
ugccagggcaccugcaacccgccucagccccucaccuggccaccaaguuccugauagcacuugu

SEQ ID NO: 155747 - RNA, 64 nt, Homo Sapiens
ugcaguggcucacgccuauacaaucaaucacuguccuggccaguucucaaaccaaucaaucaau

SEQ ID NO: 155748 - RNA, 64 nt, Homo Sapiens
agugugccucccgccuuggcgcuggucucgaacuccuggccacaagucucgcuauguugcccag

SEQ ID NO: 155749 - RNA, 64 nt, Homo Sapiens
acuuaagcagggagcugggcuagcagaggccggcccuggccaucgggagagcucugaccugcac

SEQ ID NO: 155750 - RNA, 64 nt, Homo Sapiens
cuuccuccuacuucugcuguagccugggaccagaccuggccaaggucagccagcggggagggcc

SEQ ID NO: 155751 - RNA, 64 nt, Homo Sapiens
gcccagcccuaugcucugugcuuggcccugggccccuggccauccacaaacagcagaggccuuc

SEQ ID NO: 155752 - RNA, 64 nt, Homo Sapiens
cacaucacaaggcgaacacaaauggacacacauaccuggccacgaacccacaccuccucagaca

SEQ ID NO: 155753 - RNA, 64 nt, Homo Sapiens
agcccuucaguggcuucuucaggccuaggauaacccuggccaggccccaugguccugcucuggg

SEQ ID NO: 155754 - RNA, 63 nt, Homo Sapiens
cgaaguuugucucagcguagggcaggaggcccuccuggccaggccagcagugaagcaguaugg

SEQ ID NO: 155755 - RNA, 64 nt, Homo Sapiens
ccggcagagagugguugccuuuccauuugcccucccuggccaugccuucuugccuuuggaaaaa

SEQ ID NO: 155756 - RNA, 64 nt, Homo Sapiens
ccuagggaugcucuaaagcugggcucaagcaagcccuggccagagguccuaaagaugcugacug

SEQ ID NO: 155757 - RNA, 64 nt, Homo Sapiens
gccucugccuuguccugaugcugugcucaaucagccuggccaucuggauuuucacacaguaaag

SEQ ID NO: 155758 - RNA, 64 nt, Homo Sapiens
uucgccucugcuggaacaagcaggacccuaacuaccuggccaccauggccauggauggaaugga

SEQ ID NO: 155759 - RNA, 64 nt, Homo Sapiens
gcacccacuguuaccagaagcugcucuaggaguuccuggccagucaccccaucgcccucugugg

SEQ ID NO: 155760 - RNA, 64 nt, Homo Sapiens
gugaugggguuccagccauggugccaucuuucuuccuggccagaggccagaccccagagcccuu

SEQ ID NO: 155761 - RNA, 64 nt, Homo Sapiens
ccccagagcccuugugccauaucgagugcuguagccuggccagacugugccaacccuguacaga

SEQ ID NO: 155762 - RNA, 64 nt, Homo Sapiens
gcucagcaugggcagggguuauccucccuauggcccuggccagaaguucucugugcaucugucc

SEQ ID NO: 155763 - RNA, 64 nt, Homo Sapiens
auaauuaaaaugucucuacuaaguuugagaccagccuggccaacggcggaucaccugaagucag

SEQ ID NO: 155764 - RNA, 64 nt, Homo Sapiens
uuuaaagccccugcauaugaccagaugcccugcuccuggccaccaccuggagauagccagauag

SEQ ID NO: 155765 - RNA, 64 nt, Homo Sapiens
auggugaaaccccaucucuagaguucaagaccagccuggccaacggccgaucacuugaggucag

SEQ ID NO: 155766 - RNA, 64 nt, Homo Sapiens
augaugagaccuccgucucugaguucaagaccagccuggccaacgguggaucacuugaggccag

SEQ ID NO: 155767 - RNA, 64 nt, Homo Sapiens
ggguacugccgacggcacuucacccugcccugccccuggccagacucagcaucacacugacacu

SEQ ID NO: 155768 - RNA, 64 nt, Homo Sapiens
ucaccccuuuuggguguaggcuugccuggccucaccuggccagcuaagggggcccucuaaaccc

SEQ ID NO: 155769 - RNA, 64 nt, Homo Sapiens
gcaggggccugaaacccacucguguggagccaggccuggccagggggguacuccagagaccuca

SEQ ID NO: 155770 - RNA, 64 nt, Homo Sapiens
uggggccacugggacuucaauguuucgaugaagaccuggccacaccuuuuaaggaaagaagccg

SEQ ID NO: 155771 - RNA, 64 nt, Homo Sapiens
aguauuuauugccuccguccagccaggagccccgccuggccauccacccaccccaccugggccc

SEQ ID NO: 155772 - RNA, 64 nt, Homo Sapiens
cugcccccuucccuggacagccagcccaccagugccuggccagcgggugugcugcugcugcucc

SEQ ID NO: 155773 - RNA, 64 nt, Homo Sapiens
ccccuugucgcugucggucccagccccgcugcucccuggccagcgugggggccgggccguccuc

SEQ ID NO: 155774 - RNA, 64 nt, Homo Sapiens
cuugcugggugacccuggguacagugugaccagcccuggccauguguggguccccugucaggcc

SEQ ID NO: 155775 - RNA, 64 nt, Homo Sapiens
uggaccuccccagcaugaucggcagcccucagagccuggccacgugucagugucuguuggcugg

SEQ ID NO: 155776 - RNA, 64 nt, Homo Sapiens
auggugaaaccccaucucuagaguuugagaccacccuggccaaccugagguggguggaucacug

SEQ ID NO: 155777 - RNA, 64 nt, Homo Sapiens
auagugaaaccccaucucuagaguucgagaccagccuggccaacugggcggaucacgaggucag

SEQ ID NO: 155778 - RNA, 64 nt, Homo Sapiens
ccucaccucuucuggauagaggaguucccuggagccuggccagcuccuggcagaacaguacuuu

SEQ ID NO: 155779 - RNA, 64 nt, Homo Sapiens
cccuugaagcccuggacacugugguccccuggagccuggccacggaccacuggucuagagcccu

SEQ ID NO: 155780 - RNA, 64 nt, Homo Sapiens
aagccaggagagggacggcucggacuccugggucccuggccaagggggugcacugacggagaug

SEQ ID NO: 155781 - RNA, 64 nt, Homo Sapiens
gcgggggacuuucucugcacccaccuccugacacccuggccagcacucggggggcaggccccuc

SEQ ID NO: 155782 - RNA, 64 nt, Homo Sapiens
caacacuucucagggccucuugugagccacagcaccuggccaaccaaaguguugggauuacagg

SEQ ID NO: 155783 - RNA, 64 nt, Homo Sapiens
ucacauuuuucuuucuauuacaugagccaccaugccuggccaacugaguagcugggacuacagg

SEQ ID NO: 155784 - RNA, 64 nt, Homo Sapiens
aguccuugucugagugcccccucugcuccucuggccuggccaccaguucugugcacacccugag

SEQ ID NO: 155785 - RNA, 64 nt, Homo Sapiens
gaaccuucuuuauaccaagucgugagccaccgcaccuggccaggcaaagcguugggauuauagg

SEQ ID NO: 155786 - RNA, 64 nt, Homo Sapiens
cccucaaccucagugggcugugugugaaucccagccuggccauaugucccuuucauccugggcc

SEQ ID NO: 155787 - RNA, 53 nt, Homo Sapiens
ccacugggguagggaucaaaucaccuggccaacagggaaccuggaggcucuga

SEQ ID NO: 155788 - RNA, 64 nt, Homo Sapiens
caaugcucuuguguugucccucugucuggacgcgccuggccacuccgaaggcuuuucaccccau

SEQ ID NO: 155789 - RNA, 64 nt, Homo Sapiens
ggacagaucguagugccuuauuccauuguccuccccuggccaggccuccuggcucagcuggaag

SEQ ID NO: 155790 - RNA, 64 nt, Homo Sapiens
cccccaauguggcccucaagagccauccccacugccuggccagagccauuguuguccccuacuu

SEQ ID NO: 155791 - RNA, 64 nt, Homo Sapiens
ggcagaucacuugaggugaggaguucaagaccagccuggccaacauggugaauuaucucuacua

SEQ ID NO: 155792 - RNA, 64 nt, Homo Sapiens
ugcugcccccucccccguggaagccacucacaugccuggccacaagaggggcucuccugagugg

SEQ ID NO: 155793 - RNA, 64 nt, Homo Sapiens
cugaguuuccugauucugccuucacuuucaggccccuggccaauugaggcauuaagcccagggg

SEQ ID NO: 155794 - RNA, 64 nt, Homo Sapiens
agcucuucaggccucccucucaaggccagaguggccuggccaggagccugggcagccaggcugc

SEQ ID NO: 155795 - RNA, 64 nt, Homo Sapiens
cagaucugugccccaugccuaagggccaguccugccuggccaggggugggguagggcugacuag

SEQ ID NO: 155796 - RNA, 64 nt, Homo Sapiens
ggcacaucaccugaguucaggaguucaagaccagccuggccaacauggugaaaucccgucucua

SEQ ID NO: 155797 - RNA, 64 nt, Homo Sapiens
cuccugccccagccgacugcuguucccagacuucccuggccacgcuccaagacgccagcucugc

SEQ ID NO: 155798 - RNA, 64 nt, Homo Sapiens
gaggagguaguaccuuugaagaugcuguugaccaccuggccacagccagucaggggccuggugg

SEQ ID NO: 155799 - RNA, 64 nt, Homo Sapiens
uuggccgggggaacccauucaugcuguuccucugccuggccauccugcuggagcaccgcgacca

SEQ ID NO: 155800 - RNA, 64 nt, Homo Sapiens
auggcaaaacccccaucucugaguucgagaccagccuggccaacgguggaucaccugaggucag

SEQ ID NO: 155801 - RNA, 64 nt, Homo Sapiens
caugguggcucacgccuguauuuaaaauaguuuaccuggccagguggagcaaucacuguauaau

SEQ ID NO: 155802 - RNA, 64 nt, Homo Sapiens
auggugaaaccccaucucuagaguucaagaccagccuggccaacggcagaucacuugaggucag

SEQ ID NO: 155803 - RNA, 64 nt, Homo Sapiens
auagcaaaaccucaucucuaaguuugagaacuggccuggccaacgcagaucacuugagguuagg

SEQ ID NO: 155804 - RNA, 64 nt, Homo Sapiens
auggugaaaccccgucucuagaguucgagaccauccuggccaaccaggcagaucacgaggucag

SEQ ID NO: 155805 - RNA, 64 nt, Homo Sapiens
cgcagugacuuacgccuguauuagaaaaggacucccuggccagguaagagaaaaauaggcucag

SEQ ID NO: 155806 - RNA, 64 nt, Homo Sapiens
aaggcaaaaccccgucucuagaguuagagaccagccuggccaacgguggauugcuugaggccag

SEQ ID NO: 155807 - RNA, 64 nt, Homo Sapiens
caacauggugaaaccucguggaguucgagaccagccuggccaacguggcucacgcugaggucag

SEQ ID NO: 155808 - RNA, 64 nt, Homo Sapiens
auggcgaaaccccgucucuagagaucgagaccagccuggccaacggcagaucagcugaggucag

SEQ ID NO: 155809 - RNA, 64 nt, Homo Sapiens
ugaauagaggcagagcuauuuuauauuaucaaaugagagcuacucuguuacauuucuuaacaua

SEQ ID NO: 155810 - RNA, 64 nt, Homo Sapiens
caaucuggaggcuucuguuucugcauucugccacgagagcuagguccuugaucuuuucuuuaga

SEQ ID NO: 155811 - RNA, 64 nt, Homo Sapiens
uucacuugauaaaugaauauuuauuagcugguuggagagcuagaaccuggagagcuagaaccug

SEQ ID NO: 155812 - RNA, 64 nt, Homo Sapiens
aauauuuauuagcugguuggagagcuagaaccuggagagcuagaaccuggagaacuagaaccug

SEQ ID NO: 155813 - RNA, 64 nt, Homo Sapiens
gcuggaggacuagaaccuggagggcuggaaucuggagagcuagaaccuggagggcuagaaccug

SEQ ID NO: 155814 - RNA, 64 nt, Homo Sapiens
ccuggagggcuagaaccuggagggcuagaaucuggagagcuagaaccuggagggcuagaaucug

SEQ ID NO: 155815 - RNA, 64 nt, Homo Sapiens
ucuggagagcuagaaccuggagggcuagaaucuggagagcuagaaccuggagggcuagaaccug

SEQ ID NO: 155816 - RNA, 64 nt, Homo Sapiens
ucuggagagcuagaaccuggagggcuagaaccuggagagcuagaaccuagaagggcuagaaccu

SEQ ID NO: 155817 - RNA, 64 nt, Homo Sapiens
cuagaagggcuagaaccuggagggcuggaaucuggagagcuagaaccuggagggcuagaaccug

SEQ ID NO: 155818 - RNA, 64 nt, Homo Sapiens; identical to SEQ ID NO: 155817

SEQ ID NO: 155819 - RNA, 64 nt, Homo Sapiens
cuggaagggcuagaaccuguagagcuagaacauggagagcuagaacccggcaggcuagaaccug

SEQ ID NO: 155820 - RNA, 64 nt, Homo Sapiens
uaacacaaauccuaagauuugaugaggguggagggagagcuauuaucuugguacauccagacag

SEQ ID NO: 155821 - RNA, 64 nt, Homo Sapiens
gacuuguuaucaucuccauuuagaacccccaggagagagcuacuaggacauuucacacaguccu

SEQ ID NO: 155822 - RNA, 64 nt, Homo Sapiens; identical to SEQ ID NO: 91262

SEQ ID NO: 155823 - RNA, 64 nt, Homo Sapiens; identical to SEQ ID NO: 91263

SEQ ID NO: 155824 - RNA, 64 nt, Homo Sapiens; identical to SEQ ID NO: 91264

SEQ ID NO: 155825 - RNA, 64 nt, Homo Sapiens; identical to SEQ ID NO: 91265

SEQ ID NO: 155826 - RNA, 64 nt, Homo Sapiens; identical to SEQ ID NO: 91266

SEQ ID NO: 155827 - RNA, 64 nt, Homo Sapiens; identical to SEQ ID NO: 91267

SEQ ID NO: 155828 - RNA, 64 nt, Homo Sapiens; identical to SEQ ID NO: 91268

SEQ ID NO: 155829 - RNA, 64 nt, Homo Sapiens; identical to SEQ ID NO: 91269

SEQ ID NO: 155830 - RNA, 64 nt, Homo Sapiens; identical to SEQ ID NO: 91270

SEQ ID NO: 155831 - RNA, 64 nt, Homo Sapiens; identical to SEQ ID NO: 91271

SEQ ID NO: 155832 - RNA, 64 nt, Homo Sapiens; identical to SEQ ID NO: 91272

SEQ ID NO: 155833 - RNA, 64 nt, Homo Sapiens; identical to SEQ ID NO: 91273

SEQ ID NO: 155834 - RNA, 64 nt, Homo Sapiens; identical to SEQ ID NO: 91274

SEQ ID NO: 155835 - RNA, 64 nt, Homo Sapiens; identical to SEQ ID NO: 91275

SEQ ID NO: 155836 - RNA, 64 nt, Homo Sapiens; identical to SEQ ID NO: 91276

SEQ ID NO: 155837 - RNA, 64 nt, Homo Sapiens; identical to SEQ ID NO: 91277

SEQ ID NO: 155838 - RNA, 64 nt, Homo Sapiens; identical to SEQ ID NO: 91278

SEQ ID NO: 155839 - RNA, 64 nt, Homo Sapiens; identical to SEQ ID NO: 91279

SEQ ID NO: 155840 - RNA, 64 nt, Homo Sapiens; identical to SEQ ID NO: 91280

SEQ ID NO: 155841 - RNA, 64 nt, Homo Sapiens; identical to SEQ ID NO: 91281

SEQ ID NO: 155842 - RNA, 64 nt, Homo Sapiens; identical to SEQ ID NO: 91282

SEQ ID NO: 155843 - RNA, 64 nt, Homo Sapiens; identical to SEQ ID NO: 91283

SEQ ID NO: 155844 - RNA, 64 nt, Homo Sapiens; identical to SEQ ID NO: 91284

SEQ ID NO: 155845 - RNA, 64 nt, Homo Sapiens; identical to SEQ ID NO: 91285

SEQ ID NO: 155846 - RNA, 64 nt, Homo Sapiens; identical to SEQ ID NO: 91286

SEQ ID NO: 155847 - RNA, 64 nt, Homo Sapiens; identical to SEQ ID NO: 91287

SEQ ID NO: 155848 - RNA, 64 nt, Homo Sapiens; identical to SEQ ID NO: 91288

SEQ ID NO: 155849 - RNA, 64 nt, Homo Sapiens; identical to SEQ ID NO: 91289

SEQ ID NO: 155850 - RNA, 64 nt, Homo Sapiens; identical to SEQ ID NO: 91290

SEQ ID NO: 155851 - RNA, 64 nt, Homo Sapiens; identical to SEQ ID NO: 91291

SEQ ID NO: 155852 - RNA, 64 nt, Homo Sapiens; identical to SEQ ID NO: 91292

SEQ ID NO: 155853 - RNA, 64 nt, Homo Sapiens; identical to SEQ ID NO: 91293

SEQ ID NO: 155854 - RNA, 64 nt, Homo Sapiens; identical to SEQ ID NO: 91294

SEQ ID NO: 155855 - RNA, 64 nt, Homo Sapiens; identical to SEQ ID NO: 91295

SEQ ID NO: 155856 - RNA, 64 nt, Homo Sapiens; identical to SEQ ID NO: 91296

SEQ ID NO: 155857 - RNA, 64 nt, Homo Sapiens; identical to SEQ ID NO: 91297

SEQ ID NO: 155858 - RNA, 64 nt, Homo Sapiens; identical to SEQ ID NO: 91298

SEQ ID NO: 155859 - RNA, 64 nt, Homo Sapiens; identical to SEQ ID NO: 91299

SEQ ID NO: 155860 - RNA, 64 nt, Homo Sapiens; identical to SEQ ID NO: 91300

SEQ ID NO: 155861 - RNA, 64 nt, Homo Sapiens; identical to SEQ ID NO: 91301

SEQ ID NO: 155862 - RNA, 64 nt, Homo Sapiens; identical to SEQ ID NO: 91302

SEQ ID NO: 155863 - RNA, 64 nt, Homo Sapiens; identical to SEQ ID NO: 91303

SEQ ID NO: 155864 - RNA, 64 nt, Homo Sapiens; identical to SEQ ID NO: 91304

SEQ ID NO: 155865 - RNA, 64 nt, Homo Sapiens; identical to SEQ ID NO: 91305

SEQ ID NO: 155866 - RNA, 64 nt, Homo Sapiens; identical to SEQ ID NO: 91306

SEQ ID NO: 155867 - RNA, 64 nt, Homo Sapiens; identical to SEQ ID NO: 91307

SEQ ID NO: 155868 - RNA, 64 nt, Homo Sapiens; identical to SEQ ID NO: 91308

SEQ ID NO: 155869 - RNA, 64 nt, Homo Sapiens; identical to SEQ ID NO: 91309

SEQ ID NO: 155870 - RNA, 64 nt, Homo Sapiens; identical to SEQ ID NO: 91310

SEQ ID NO: 155871 - RNA, 64 nt, Homo Sapiens; identical to SEQ ID NO: 91311

SEQ ID NO: 155872 - RNA, 64 nt, Homo Sapiens; identical to SEQ ID NO: 91312

SEQ ID NO: 155873 - RNA, 64 nt, Homo Sapiens; identical to SEQ ID NO: 91313

SEQ ID NO: 155874 - RNA, 64 nt, Homo Sapiens; identical to SEQ ID NO: 91314

SEQ ID NO: 155875 - RNA, 64 nt, Homo Sapiens; identical to SEQ ID NO: 91315

SEQ ID NO: 155876 - RNA, 64 nt, Homo Sapiens; identical to SEQ ID NO: 91316

SEQ ID NO: 155877 - RNA, 64 nt, Homo Sapiens; identical to SEQ ID NO: 91317

SEQ ID NO: 155878 - RNA, 64 nt, Homo Sapiens; identical to SEQ ID NO: 91318

SEQ ID NO: 155879 - RNA, 64 nt, Homo Sapiens; identical to SEQ ID NO: 91319

SEQ ID NO: 155880 - RNA, 64 nt, Homo Sapiens; identical to SEQ ID NO: 91320

SEQ ID NO: 155881 - RNA, 64 nt, Homo Sapiens; identical to SEQ ID NO: 91321

SEQ ID NO: 155882 - RNA, 64 nt, Homo Sapiens; identical to SEQ ID NO: 91322

SEQ ID NO: 155883 - RNA, 64 nt, Homo Sapiens; identical to SEQ ID NO: 91323

SEQ ID NO: 155884 - RNA, 64 nt, Homo Sapiens; identical to SEQ ID NO: 91324

SEQ ID NO: 155885 - RNA, 64 nt, Homo Sapiens; identical to SEQ ID NO: 91325

SEQ ID NO: 155886 - RNA, 64 nt, Homo Sapiens; identical to SEQ ID NO: 91326

SEQ ID NO: 155887 - RNA, 64 nt, Homo Sapiens; identical to SEQ ID NO: 91327

SEQ ID NO: 155888 - RNA, 64 nt, Homo Sapiens; identical to SEQ ID NO: 91328

SEQ ID NO: 155889 - RNA, 64 nt, Homo Sapiens; identical to SEQ ID NO: 91329

SEQ ID NO: 155890 - RNA, 64 nt, Homo Sapiens; identical to SEQ ID NO: 91330

SEQ ID NO: 155891 - RNA, 64 nt, Homo Sapiens; identical to SEQ ID NO: 91331

SEQ ID NO: 155892 - RNA, 64 nt, Homo Sapiens; identical to SEQ ID NO: 91332

SEQ ID NO: 155893 - RNA, 64 nt, Homo Sapiens; identical to SEQ ID NO: 91333

SEQ ID NO: 155894 - RNA, 64 nt, Homo Sapiens; identical to SEQ ID NO: 91334

SEQ ID NO: 155895 - RNA, 64 nt, Homo Sapiens; identical to SEQ ID NO: 91335

SEQ ID NO: 155896 - RNA, 64 nt, Homo Sapiens; identical to SEQ ID NO: 91336

SEQ ID NO: 155897 - RNA, 64 nt, Homo Sapiens; identical to SEQ ID NO: 91337

SEQ ID NO: 155898 - RNA, 64 nt, Homo Sapiens; identical to SEQ ID NO: 91338

SEQ ID NO: 155899 - RNA, 64 nt, Homo Sapiens; identical to SEQ ID NO: 91339

SEQ ID NO: 155900 - RNA, 64 nt, Homo Sapiens; identical to SEQ ID NO: 91340

SEQ ID NO: 155901 - RNA, 64 nt, Homo Sapiens; identical to SEQ ID NO: 91341

SEQ ID NO: 155902 - RNA, 64 nt, Homo Sapiens; identical to SEQ ID NO: 91342

SEQ ID NO: 155903 - RNA, 64 nt, Homo Sapiens; identical to SEQ ID NO: 91343

SEQ ID NO: 155904 - RNA, 64 nt, Homo Sapiens; identical to SEQ ID NO: 91344

SEQ ID NO: 155905 - RNA, 64 nt, Homo Sapiens; identical to SEQ ID NO: 91345

SEQ ID NO: 155906 - RNA, 64 nt, Homo Sapiens; identical to SEQ ID NO: 91346

SEQ ID NO: 155907 - RNA, 64 nt, Homo Sapiens; identical to SEQ ID NO: 91347

SEQ ID NO: 155908 - RNA, 64 nt, Homo Sapiens; identical to SEQ ID NO: 91348

SEQ ID NO: 155909 - RNA, 64 nt, Homo Sapiens; identical to SEQ ID NO: 91349

SEQ ID NO: 155910 - RNA, 64 nt, Homo Sapiens; identical to SEQ ID NO: 91350

SEQ ID NO: 155911 - RNA, 64 nt, Homo Sapiens; identical to SEQ ID NO: 91351

SEQ ID NO: 155912 - RNA, 64 nt, Homo Sapiens; identical to SEQ ID NO: 91352

SEQ ID NO: 155913 - RNA, 64 nt, Homo Sapiens; identical to SEQ ID NO: 91353

SEQ ID NO: 155914 - RNA, 54 nt, Homo Sapiens; identical to SEQ ID NO: 91354

SEQ ID NO: 155915 - RNA, 64 nt, Homo Sapiens; identical to SEQ ID NO: 91355

SEQ ID NO: 155916 - RNA, 64 nt, Homo Sapiens; identical to SEQ ID NO: 91356

SEQ ID NO: 155917 - RNA, 64 nt, Homo Sapiens; identical to SEQ ID NO: 91357

SEQ ID NO: 155918 - RNA, 64 nt, Homo Sapiens; identical to SEQ ID NO: 91358

SEQ ID NO: 155919 - RNA, 64 nt, Homo Sapiens; identical to SEQ ID NO: 91359

SEQ ID NO: 155920 - RNA, 64 nt, Homo Sapiens; identical to SEQ ID NO: 91360

SEQ ID NO: 155921 - RNA, 64 nt, Homo Sapiens; identical to SEQ ID NO: 91361

SEQ ID NO: 155922 - RNA, 64 nt, Homo Sapiens; identical to SEQ ID NO: 91362

SEQ ID NO: 155923 - RNA, 64 nt, Homo Sapiens; identical to SEQ ID NO: 91363

SEQ ID NO: 155924 - RNA, 64 nt, Homo Sapiens; identical to SEQ ID NO: 91364

SEQ ID NO: 155925 - RNA, 64 nt, Homo Sapiens; identical to SEQ ID NO: 91365

SEQ ID NO: 155926 - RNA, 64 nt, Homo Sapiens; identical to SEQ ID NO: 91366

SEQ ID NO: 155927 - RNA, 64 nt, Homo Sapiens; identical to SEQ ID NO: 91367

SEQ ID NO: 155928 - RNA, 64 nt, Homo Sapiens; identical to SEQ ID NO: 91368

SEQ ID NO: 155929 - RNA, 64 nt, Homo Sapiens; identical to SEQ ID NO: 91369

SEQ ID NO: 155930 - RNA, 64 nt, Homo Sapiens; identical to SEQ ID NO: 91370

SEQ ID NO: 155931 - RNA, 64 nt, Homo Sapiens; identical to SEQ ID NO: 91371

SEQ ID NO: 155932 - RNA, 64 nt, Homo Sapiens; identical to SEQ ID NO: 91372

SEQ ID NO: 155933 - RNA, 64 nt, Homo Sapiens; identical to SEQ ID NO: 91373

SEQ ID NO: 155934 - RNA, 64 nt, Homo Sapiens; identical to SEQ ID NO: 91374

SEQ ID NO: 155935 - RNA, 64 nt, Homo Sapiens; identical to SEQ ID NO: 91375

SEQ ID NO: 155936 - RNA, 64 nt, Homo Sapiens; identical to SEQ ID NO: 91376

SEQ ID NO: 155937 - RNA, 64 nt, Homo Sapiens; identical to SEQ ID NO: 91377

SEQ ID NO: 155938 - RNA, 64 nt, Homo Sapiens; identical to SEQ ID NO: 91378

SEQ ID NO: 155939 - RNA, 64 nt, Homo Sapiens; identical to SEQ ID NO: 91379

SEQ ID NO: 155940 - RNA, 64 nt, Homo Sapiens; identical to SEQ ID NO: 91380

SEQ ID NO: 155941 - RNA, 64 nt, Homo Sapiens
uaaaauuacagaaaauauuuaaaugcaacuuauugcuauagaagcaaagaggacuaaagggcaa

SEQ ID NO: 155942 - RNA, 64 nt, Homo Sapiens
aaccuaaaaaaaaaacaacaaaaaaacccauaaagcuauagaccaaagucucauagauuuagau

SEQ ID NO: 155943 - RNA, 64 nt, Homo Sapiens
aucauaaaugaaugaucauggugauaugaaaacagcuauagacaacugaacuugaacuuccauu

SEQ ID NO: 155944 - RNA, 64 nt, Homo Sapiens
aucauaaaugaaugaucauggugguaugaaaacagcuauagacaagcaacucaauucuaccacu

SEQ ID NO: 155945 - RNA, 64 nt, Homo Sapiens
guuaagaccucuuucacagcacaauauuuaugaagcuauagaacuaucuuggucacucugaagc

SEQ ID NO: 155946 - RNA, 64 nt, Homo Sapiens
cugggcaacauagugagaucugaggccaggaguuugagaccagcgcugaagcaggaggaucacu

SEQ ID NO: 155947 - RNA, 64 nt, Homo Sapiens
cuggccaacauggugaaaccugagguuagaaguuugagaccagcgcccaggugggcggaucacc

SEQ ID NO: 155948 - RNA, 64 nt, Homo Sapiens
ugguaugaaaacuuauuaggaaccuuuuuguuuuugagaccauugcauucuggcugguuugugc

SEQ ID NO: 155949 - RNA, 64 nt, Homo Sapiens
ugguuuaacgacaucuaagaagguuuagaaauggugagaccaaaacaauaacuguuaaugaugg

SEQ ID NO: 155950 - RNA, 64 nt, Homo Sapiens
auuuccuggagcugugccucaaguugcuggcuccugagaccaguagggcucaaaacuccuggac

SEQ ID NO: 155951 - RNA, 64 nt, Homo Sapiens
gugugcucacauuacccuuuaggugaguagaccaugagaccaauacugggauuaaucucuaauc

SEQ ID NO: 155952 - RNA, 64 nt, Homo Sapiens
accaaggcgggcagaucacuugaggucagaaguuugagaccagccaggccaacauggugaaacu

SEQ ID NO: 155953 - RNA, 64 nt, Homo Sapiens
gccaagagaggaagauugcuugagcccaggaguuugagaccaaucuaggcaauguagugagacc

SEQ ID NO: 155954 - RNA, 64 nt, Homo Sapiens
ucucuacagaaaaaauuuaacuaaggcaauauagugagaccauggcccaggaguuugagaccag

SEQ ID NO: 155955 - RNA, 64 nt, Homo Sapiens
uaaggcaauauagugagaccugagcccaggaguuugagaccagcgcugagucgggaggauagcg

SEQ ID NO: 155956 - RNA, 64 nt, Homo Sapiens
caucagucauucacugaucagcagcuaaaguccaugagaccaaaugguuuuauauggaaccaac

SEQ ID NO: 155957 - RNA, 64 nt, Homo Sapiens
ccgaggugagcggaucaccugaggucaggaguuuugagaccagccuggccaacaugguaaaauc

SEQ ID NO: 155958 - RNA, 64 nt, Homo Sapiens
uagucuguuuucacgcugcugauaaagacauaccugagaccaggaagaaaaagagguuuaauug

SEQ ID NO: 155959 - RNA, 64 nt, Homo Sapiens
uacuccaguucccaaaaaguuuuucaucuccaucugagaccaccucagccugaauuuuauuguc

SEQ ID NO: 155960 - RNA, 64 nt, Homo Sapiens
agugguuguauacauuucugcaccucaugccagcugagaccaaggcagagagguggguggcggg

SEQ ID NO: 155961 - RNA, 64 nt, Homo Sapiens
accuuggaagauccucagagagaaacacugacucugagaccaugugagagaaggagcaagaggc

SEQ ID NO: 155962 - RNA, 64 nt, Homo Sapiens
gccaaagcugauggaucgcuugagcccaggaguuugagaccagccugggcaacauggcaaaacc

SEQ ID NO: 155963 - RNA, 64 nt, Homo Sapiens
gccgagauagguggaucaccugaagucagguguuugagaccagccuggccaacaugguggaacc

SEQ ID NO: 155964 - RNA, 64 nt, Homo Sapiens
uuggccaacauggugaaaccugaggacagggguuugagaccagcuugggaggccacggaucacu

SEQ ID NO: 155965 - RNA, 64 nt, Homo Sapiens
ucccugcucugaggagacguaacaugaagagcaaugagaccaggcggugcuaagagcuguggga

SEQ ID NO: 155966 - RNA, 64 nt, Homo Sapiens
gccagggugggaggaucacuugagcucaggaguuugagaccagccuagacaacauacuacgacc

SEQ ID NO: 155967 - RNA, 64 nt, Homo Sapiens
uacucgggaggcugagugaggcaggaggaucacuugagaccaggagguuguggcuguagugagu

SEQ ID NO: 155968 - RNA, 64 nt, Homo Sapiens
ucuccgacacaggcugguggaccaccuaccccacugagaccaccucucagggugccugcccugg

SEQ ID NO: 155969 - RNA, 64 nt, Homo Sapiens
cagagcuuugggaggccaaggugggaggaucgcuugagaccaggaguucgagaccagccugggc

SEQ ID NO: 155970 - RNA, 64 nt, Homo Sapiens
ccuggccccacucccaccaucucacucuauccugugagaccacgugagaccacgcccggcccca

SEQ ID NO: 155971 - RNA, 64 nt, Homo Sapiens
cccggccccacucacucuauuucacuccauccugugagaccacguaagacugugcccggcccca

SEQ ID NO: 155972 - RNA, 64 nt, Homo Sapiens
cccggccccacucccaccaucucacaccauccugugagaccacggagccccgcacccggccccu

SEQ ID NO: 155973 - RNA, 64 nt, Homo Sapiens
gccaaggcgggcggaucaccugaggucgggaguuugagaccagcccgaccaacauggagaaacc

SEQ ID NO: 155974 - RNA, 64 nt, Homo Sapiens
gcugaggugggaggauuacuugaaacccacaguuugagaccagccugggcaacauagugagacc

SEQ ID NO: 155975 - RNA, 64 nt, Homo Sapiens
uugggcaacaacaacaaaaaugagcccagggguuugagaccagcgcugaggugggaggguugcu

SEQ ID NO: 155976 - RNA, 64 nt, Homo Sapiens
cuggccaacauaauuaaaauugaagucagaaguuugagaccagcgcugaggcaggcggaucacc

SEQ ID NO: 155977 - RNA, 64 nt, Homo Sapiens
cuaguguuuauuacagcuugugaggccaggaguuugagaccauccuaggcaacauaaugagaca

SEQ ID NO: 155978 - RNA, 64 nt, Homo Sapiens
guacccgauucaaagaaggacucugcucccugucugagaccacccccggcucugacugagagua

SEQ ID NO: 155979 - RNA, 64 nt, Homo Sapiens
ggugcaguggcucacgccuguaauccuagcacuuugagaccacuaaggcagguggaucaccuga

SEQ ID NO: 155980 - RNA, 64 nt, Homo Sapiens
uguugcaagauguaauuuuucuuuuccuuuuuuuugagaccaagucucacucugucacccacgc

SEQ ID NO: 155981 - RNA, 64 nt, Homo Sapiens
gcugagguggguggaucaccugaagucagaaguuugagaccagccuggcaaacauggcaaaacu

SEQ ID NO: 155982 - RNA, 64 nt, Homo Sapiens
aggccaagguggguggaucacgaggucaggagauugagaccauccuggcuaauauggugaaacc

SEQ ID NO: 155983 - RNA, 64 nt, Homo Sapiens
cugaccaacacugagaaaccugaggucgggauuuugagaccagcgccauggcagguggaucacc

SEQ ID NO: 155984 - RNA, 64 nt, Homo Sapiens
cugguuaacauggugaaaccugaggccaggaguuugagaccaacgacaagguggguggaucacu

SEQ ID NO: 155985 - RNA, 64 nt, Homo Sapiens
ugcuguggcucaggccuguacaucaaauuugcgaugagaccagaaaaacugaaacaagaagaaa

SEQ ID NO: 155986 - RNA, 64 nt, Homo Sapiens
cuggccaacagacgggagccugaggucaugaauuugagaccagcgccaagacagguaggucacu

SEQ ID NO: 155987 - RNA, 64 nt, Homo Sapiens
ccuggguugggaggauugcuuaaggccaggaguuugagaccagcuugggcaacauagugaaacc

SEQ ID NO: 155988 - RNA, 64 nt, Homo Sapiens
gccaaggcaggcagaucaccugaggucaggaguuugagaccagccuggccaacaugaugaaacc

SEQ ID NO: 155989 - RNA, 61 nt, Homo Sapiens
agacuggagugagauuuggguguggagggggaggcgccaagguggaggagcuucccacucc

SEQ ID NO: 155990 - RNA, 61 nt, Homo Sapiens
cgugcccucuggaguccccuaccaugacugaaggcgccagagacuggcggugucuuaagac

SEQ ID NO: 155991 - RNA, 61 nt, Homo Sapiens
cugcgugggaugcacacggaugacagaaucaaggcgccaggaugggcacucugcccuggau

SEQ ID NO: 155992 - RNA, 61 nt, Homo Sapiens
gagggcaccgcgcaccagaggccgagacccaaggcgccacucgcaggagugaggcccaggc

SEQ ID NO: 155993 - RNA, 61 nt, Homo Sapiens
gaaagcauggucuugccagugccccuggcggaggcgccauuccuaaaacuucugcagggaa

SEQ ID NO: 155994 - RNA, 54 nt, Homo Sapiens
acugaugccacccaggaccugcccaggcgccacccccugaaugaugugagcuga

SEQ ID NO: 155995 - RNA, 61 nt, Homo Sapiens
cucacagagcccuugugcagcgacauccaacaggcgccaaaccugcagacugggcucagcc

SEQ ID NO: 155996 - RNA, 61 nt, Homo Sapiens
cuucuucaggcccaggcuccccaccuggcugaggcgccaccuggaaugggucucucuugcc

SEQ ID NO: 155997 - RNA, 55 nt, Homo Sapiens
ccaagggggaaaugcucuuuugcacaggcgccaggucagcaucuauuaccacuga

SEQ ID NO: 155998 - RNA, 61 nt, Homo Sapiens
agauuucucugguugucaguuucccuggagaaggcgccagauaggaaucuccaaucaguug

SEQ ID NO: 155999 - RNA, 61 nt, Homo Sapiens
agaacaggcuguccuuggcggcaguaggagcaggcgccagguuuccuggagcucuuggcuu

SEQ ID NO: 156000 - RNA, 61 nt, Homo Sapiens
ccucuccucucccacgcggcuggcccuacccaggcgccaccuucggucucagucuggcaag

SEQ ID NO: 156001 - RNA, 61 nt, Homo Sapiens
agccacuuuuagaagccaucugauucuuuguaggcgccaucuuggugaagaaaagaaugaa

SEQ ID NO: 156002 - RNA, 61 nt, Homo Sapiens
gcuuuugggagacuggaaaaccgcacauuuaaggcgccauucaagacucaccucauccuua

SEQ ID NO: 156003 - RNA, 61 nt, Homo Sapiens
cauccagcagguuggguucuagggcugaaccaggcgccaggcuccagaggacgaagggacu

SEQ ID NO: 156004 - RNA, 61 nt, Homo Sapiens
ugcagacccaggacuccggaagcaggggccaaggcgccagaggaggaggagagcgcgagug

SEQ ID NO: 156005 - RNA, 61 nt, Homo Sapiens
agaguagucuccaugguggguagggacuugaaggcgccaacugcggaaggcucugguucuc

SEQ ID NO: 156006 - RNA, 61 nt, Homo Sapiens
gguggggggagcuggcagcugggcaagauccaggcgccacgcuggcgguucgugagugucg

SEQ ID NO: 156007 - RNA, 61 nt, Homo Sapiens
cuguccaguagcaugaacacuccgcauccucaggcgccagccagcgaccuccgucucaagu

SEQ ID NO: 156008 - RNA, 58 nt, Homo Sapiens
cccggaccuaggaccggugcgguuccgaaggcgccaucggccugggagcggagccuag

SEQ ID NO: 156009 - RNA, 61 nt, Homo Sapiens
ggcauccgucuccagagcccguuuaaagaugaggcgccauaccccugggcuacuaaggaca

SEQ ID NO: 156010 - RNA, 61 nt, Homo Sapiens
gggcguugcaucagcaggacgagucuagccgaggcgccauggacuaaugcacagaggguag

SEQ ID NO: 156011 - RNA, 61 nt, Homo Sapiens
agcaaguaccucaucuucaccgcagugccacaggcgccaaggccacaccaagccacccgag

SEQ ID NO: 156012 - RNA, 61 nt, Homo Sapiens
acagcagggagacuugggugaccccccuuccaggcgccaucuagcacagccuggcccugau

SEQ ID NO: 156013 - RNA, 61 nt, Homo Sapiens
augcuccaggcccccugggccagcuccgagaaggcgccagugaaggaccagggaccaggcc

SEQ ID NO: 156014 - RNA, 61 nt, Homo Sapiens
cugcugccggagccgggcuuccucaugacgcaggcgccaccggcugaagaugcgagcccgu

SEQ ID NO: 156015 - RNA, 61 nt, Homo Sapiens
gacccuagcggggagggcagcccccuucaagaggcgccauagcagggacuggcagcugcca

SEQ ID NO: 156016 - RNA, 61 nt, Homo Sapiens
ccccugcucuuccuccugaccggaaggaacgaggcgccacagaagccccaugagcuccugg

SEQ ID NO: 156017 - RNA, 61 nt, Homo Sapiens
ccccggucgcaggaguccggggagggccgggaggcgccauggucucucucuguagccuuuc

SEQ ID NO: 156018 - RNA, 61 nt, Homo Sapiens
gccaccgugccaagccggcagaggucaugccaggcgccaagggccaugugcccagcugcug

SEQ ID NO: 156019 - RNA, 61 nt, Homo Sapiens
agcacacagggucagggucauuaacaugagaaggcgccaacggagcccuuaggagaguggu

SEQ ID NO: 156020 - RNA, 61 nt, Homo Sapiens
cuaaccauccagccaggccacuucuggguggaggcgccaucggucagcacggaagcuccac

SEQ ID NO: 156021 - RNA, 61 nt, Homo Sapiens
ugauagccuuuucugcaggcaccuuaaguucaggcgccauccuucuagaagggggccuccc

SEQ ID NO: 156022 - RNA, 61 nt, Homo Sapiens
caacacacccggcuaauuuugcugggauuagaggcgccagccugccucagccucccgagua

SEQ ID NO: 156023 - RNA, 61 nt, Homo Sapiens
ccauucugccggaggacagccaugaaaccagaggcgccaucagaagucauucuugaccagc

SEQ ID NO: 156024 - RNA, 61 nt, Homo Sapiens
ugccuguucuuaccuccgccaugugccguggaggcgccagcagagcaucaauagccuaagg

SEQ ID NO: 156025 - RNA, 61 nt, Homo Sapiens
gaguaccgagagacacggucuggacagcccaaggcgccaggaugcaaccugcuuucaccag

SEQ ID NO: 156026 - RNA, 61 nt, Homo Sapiens
ucccacccucaaccgcggccccuguaggccaaggcgccaggcaggacgacagcagcagcag

SEQ ID NO: 156027 - RNA, 54 nt, Homo Sapiens
cauggcugcaguggaggggcggggaggcgccaccgagcccugggcaggcaguag

SEQ ID NO: 156028 - RNA, 61 nt, Homo Sapiens
aacaacagacucuuaaacuaacaauucaagcaggcgccaagugcuaugacagaggugugaa

SEQ ID NO: 156029 - RNA, 61 nt, Homo Sapiens
cucuguugcucccuccucugcagcugcacgaaggcgccaucuggugucugcauggguguug

SEQ ID NO: 156030 - RNA, 61 nt, Homo Sapiens
gggcgaggccaucucugccugccucccuagcaggcgccagcgguggaggcugagucgcagg

SEQ ID NO: 156031 - RNA, 61 nt, Homo Sapiens
auggcggggaagcugaaaccucugaauguggaggcgccagaagcuacugaggaggcugaag

SEQ ID NO: 156032 - RNA, 61 nt, Homo Sapiens
ccaaccuagccagguagccaccacugugcccaggcgccaaauaaacccugguugggaagag

SEQ ID NO: 156033 - RNA, 61 nt, Homo Sapiens
uucgugaaacgacucuugccaaacguucccgaggcgccaaggaguguaguacacccuggcu

SEQ ID NO: 156034 - RNA, 61 nt, Homo Sapiens
cacggacgucagggacaucacaucauggaugaggcgccacuacccuggagcaagugcgcag

SEQ ID NO: 156035 - RNA, 61 nt, Homo Sapiens
ucuuauauacugaagaaagauucaaguauucaggcgccaugcauugaauguacuauguaug

SEQ ID NO: 156036 - RNA, 61 nt, Homo Sapiens
aagugggggagggggauggcagagacuguaaaggcgccacuggacucuggcaaggccuuua

SEQ ID NO: 156037 - RNA, 61 nt, Homo Sapiens
gugacuauccagugagccuucagugggugcaaggcgccauacuugcugugagagagcugag

SEQ ID NO: 156038 - RNA, 61 nt, Homo Sapiens
ccgugcagcccagugaccacugcccagugggaggcgccacuuuguauauuucaggacuggg

SEQ ID NO: 156039 - RNA, 61 nt, Homo Sapiens
uguaaagucuccucuggaaacccaugagaucaggcgccaucaauugagcgcugaaucgugu

SEQ ID NO: 156040 - RNA, 61 nt, Homo Sapiens
gaaccgagaagggacggucacagcacuggggaggcgccacucccucccggcgauccgcccc

SEQ ID NO: 156041 - RNA, 61 nt, Homo Sapiens
ugggcggacagccaggagcuagcucugcccaaggcgccaccauaaucacuuguggagcgcc

SEQ ID NO: 156042 - RNA, 61 nt, Homo Sapiens
uacacuguagucuguacaaccacaacuccagaggcgccauuccuccaggagguuccucaca

SEQ ID NO: 156043 - RNA, 61 nt, Homo Sapiens
ugagcugguucagaccccuccccagcacaccaggcgccaggacuuugacagccauaucccu

SEQ ID NO: 156044 - RNA, 61 nt, Homo Sapiens
auaaauaucaaagcccaagaagaugaagagcaggcgccauuugcucggaaagcguaagaca

SEQ ID NO: 156045 - RNA, 61 nt, Homo Sapiens
uguuguguguagguccccuggggacacaagcaggcgccaaugguaucugggcggagcucac

SEQ ID NO: 156046 - RNA, 61 nt, Homo Sapiens
acccugaccugggcuugucaucugcuggaacaggcgccauggggccugccagcccugccug

SEQ ID NO: 156047 - RNA, 61 nt, Homo Sapiens
agagagugagccccacgccgccccagggaggaggcgccagagcgcggggcagacgcaaagu

SEQ ID NO: 156048 - RNA, 61 nt, Homo Sapiens
gccuaguaagcgccacaggugacucugaugcaggcgccacagccacacuugaagaaacaca

SEQ ID NO: 156049 - RNA, 61 nt, Homo Sapiens
aucaguggcagcagccagggacguggggugcaggcgccaaccuugcgccucgggcauaggg

SEQ ID NO: 156050 - RNA, 61 nt, Homo Sapiens
ggcugggaagaaauaauguuaccaugggcggaggcgccagagccguguacacucuccaggc

SEQ ID NO: 156051 - RNA, 61 nt, Homo Sapiens
agacccggcuaauuuuuugugaauuacaggcaggcgccacccucagccucacgaguagcug

SEQ ID NO: 156052 - RNA, 61 nt, Homo Sapiens
guugagaagcuagagauugucuccccuuuccaggcgccacuccgcccgcaugcagcuucac

SEQ ID NO: 156053 - RNA, 61 nt, Homo Sapiens
gggaacccccuucguguuuuaaggaagaggcaggcgccaggcucggacggaucugcucaga

SEQ ID NO: 156054 - RNA, 59 nt, Homo Sapiens
gcaaggaggggccgguccccgacucucggccaggcgccacugagagguccucagcgucu

SEQ ID NO: 156055 - RNA, 61 nt, Homo Sapiens
ucaguuucaccguccacgucaucacugcccgaggcgccagcuggucucugccagcccaagc

SEQ ID NO: 156056 - RNA, 61 nt, Homo Sapiens
agguguguccuacggacgugugggagguggcaggcgccagccuccgagcaguguggugguu

SEQ ID NO: 156057 - RNA, 61 nt, Homo Sapiens
ggaaagugacgcgcauggacggggcccagcuaggcgccaggacuuggccucacccucuggc

SEQ ID NO: 156058 - RNA, 61 nt, Homo Sapiens
ccgucugugcccugugccuuuccagggagccaggcgccaugggcuucugguccaagcugug

SEQ ID NO: 156059 - RNA, 61 nt, Homo Sapiens
caucuuucugugcucagcgugagucugaagcaggcgccagggccucugguguacggggcuu

SEQ ID NO: 156060 - RNA, 61 nt, Homo Sapiens
uguguggagguggaaacagagcuacgccagcaggcgccaagcacccaacuccagagaugga

SEQ ID NO: 156061 - RNA, 61 nt, Homo Sapiens
uaaccgcaaaacucuagagggggaguugagcaggcgccagggcugucaucaacauggauau

SEQ ID NO: 156062 - RNA, 61 nt, Homo Sapiens
caccaugccuggcuaauuuugcugggacuacaggcgccagccugccucagccuccugagua

SEQ ID NO: 156063 - RNA, 64 nt, Homo Sapiens
ggccacuuucagagcccccagcccugggaaccacucccaccacaggcauaagcuaucaccuagc

SEQ ID NO: 156064 - RNA, 64 nt, Homo Sapiens
cggagggauggagaaagaaguggagacaguccuuucccaccauuccugccuuuaagccaaagaa

SEQ ID NO: 156065 - RNA, 64 nt, Homo Sapiens
uuggaaagcugaggcagguggcucacgccuguaaucccaccacugaaacaggcgggacacagug

SEQ ID NO: 156066 - RNA, 64 nt, Homo Sapiens
cuuggagauugaaguucuuaggcaagacaaagccucccaccagacagaaccuccaggcugacga

SEQ ID NO: 156067 - RNA, 64 nt, Homo Sapiens
agucugcccaccuuucuaggccuucucaggcuauucccaccauuuaaaugaaugaauggccuuc

SEQ ID NO: 156068 - RNA, 64 nt, Homo Sapiens
uccaggcugcaucccaccuuuggcuaccuccuugucccaccacccuuggcgccccuauugucuc

SEQ ID NO: 156069 - RNA, 64 nt, Homo Sapiens
agggauggguaaauucucaggaaaguuaacacaaucccaccaugcacagggcacagauucccca

SEQ ID NO: 156070 - RNA, 64 nt, Homo Sapiens
accaugaaguuuggugacuugacugcccccuaccucccaccaccaccaugugguuggaaggaua

SEQ ID NO: 156071 - RNA, 64 nt, Homo Sapiens
cacacaugcuccaaaagaggccaugaaauacuccucccaccacauauauuuuaaaaguuuacug

SEQ ID NO: 156072 - RNA, 64 nt, Homo Sapiens
guauuccaaagaaaauauuauucuuaaaauuuuuucccaccaagcaugguacauuaaaaugaua

SEQ ID NO: 156073 - RNA, 64 nt, Homo Sapiens
cgcugcucaaccucucuccuuccucccaccacccucccaccaugcccuggccucacgcccagcc

SEQ ID NO: 156074 - RNA, 64 nt, Homo Sapiens
cucccaccaugcgcugcucacacgcccagccuccucccaccacccgcucugcccucccuggccu

SEQ ID NO: 156075 - RNA, 64 nt, Homo Sapiens
gcaggcagcugggcccacuuauugcaggcagacuucccaccauuuccaguggucacuucccacc

SEQ ID NO: 156076 - RNA, 64 nt, Homo Sapiens
gcaggcagacuucccaccaucuccaguggucacuucccaccauuuugccauagaggagcccucc

SEQ ID NO: 156077 - RNA, 64 nt, Homo Sapiens
ugagguccgaggaaagcgggggccagccacuaagucccaccagcagacacaacagccgcaguuu

SEQ ID NO: 156078 - RNA, 64 nt, Homo Sapiens
acugaaccagaagagagugagugaaggcacacugucccaccacagaggaauuucugcauggggc

SEQ ID NO: 156079 - RNA, 64 nt, Homo Sapiens
agguaagaauaacaaguaacuauaaacgggugcaucccaccacucccuggaggcauuagacacc

SEQ ID NO: 156080 - RNA, 64 nt, Homo Sapiens
cagcaucuacacauucaaaagauaagcugaguguucccaccaggaagucacgcgcagagaggag

SEQ ID NO: 156081 - RNA, 64 nt, Homo Sapiens
agaacugagccugccuccucaacugcccaggcgcucccaccagcuuccucgcuccauagcccuc

SEQ ID NO: 156082 - RNA, 64 nt, Homo Sapiens
ucccaggcuguggaaagcccgcugccuccuagucucccaccagggaggccacgcugcuauggag

SEQ ID NO: 156083 - RNA, 64 nt, Homo Sapiens
caaccacacccggugggggcugggaaccagcaccucccaccaacucagccgaugccccccggua

SEQ ID NO: 156084 - RNA, 64 nt, Homo Sapiens
cagccacacccggugggggcugggaaccagcaccucccaccaacucagccgaugccccccagua

SEQ ID NO: 156085 - RNA, 64 nt, Homo Sapiens
cagccacacccagugggggcugggaaccagcaccucccaccaacucagccgaugccccccggug

SEQ ID NO: 156086 - RNA, 64 nt, Homo Sapiens
cagccacucccgguggggaccagaaaacagcaccucccaccaacacccggggggcccccgggug

SEQ ID NO: 156087 - RNA, 64 nt, Homo Sapiens
ggcucacacugcccuuacuuaaagucagcuccucucccaccacaucccauggaaguuuccucac

SEQ ID NO: 156088 - RNA, 64 nt, Homo Sapiens
gcugaagacaaggauguuccccuggaugucacacucccaccaggcagagccccugccccauggc

SEQ ID NO: 156089 - RNA, 64 nt, Homo Sapiens
aguaggugcucauuggcucccuuccaccugucauucccaccacccugaggccccaaccgccaca

SEQ ID NO: 156090 - RNA, 64 nt, Homo Sapiens
aagauucccuccuuacccccaacccacucuuuuuucccaccacccacucuccucugccucagua

SEQ ID NO: 156091 - RNA, 64 nt, Homo Sapiens
cagucagccgaggauguaguuguugcugccgucgucccaccaccucagggaccagagggcuagg

SEQ ID NO: 156092 - RNA, 64 nt, Homo Sapiens
uccuccguuguugcgugagaacccgugugccccuucccaccauauccacccucgcuccaucuuu

SEQ ID NO: 156093 - RNA, 64 nt, Homo Sapiens
cugugaaccccacuccacucacgcccggccccacucccaccaucucacaccauccuaugagccc

SEQ ID NO: 156094 - RNA, 64 nt, Homo Sapiens
cugugagccccacuccuggcacgccuggccccacucccaccaucucacucuauccugugagacc

SEQ ID NO: 156095 - RNA, 64 nt, Homo Sapiens
cugugagccccacucccggcacucccagccccacucccaccauccccaccauccugugagcccc

SEQ ID NO: 156096 - RNA, 64 nt, Homo Sapiens
cugugagccccacucccagcacuuccagccccacucccaccauccccaccauccugugagcccc

SEQ ID NO: 156097 - RNA, 64 nt, Homo Sapiens
cugugagccccacuuccagcacucccagccccacucccaccauccacuccauccugugaguccc

SEQ ID NO: 156098 - RNA, 64 nt, Homo Sapiens
cugugagcccaugcccggccacucccagccccacucccaccauccacuccauccugugaguccc

SEQ ID NO: 156099 - RNA, 64 nt, Homo Sapiens
uuguaagacugugcccagccacgcccggccccacucccaccaucucacaccauccugugagacc

SEQ ID NO: 156100 - RNA, 64 nt, Homo Sapiens
ugugaugugucucgacaccaauacacaacccccuucccaccauccuucaugucacuagauacac

SEQ ID NO: 156101 - RNA, 64 nt, Homo Sapiens
accauccuucaugucacuagauacacaacccccuucccaccaucccuucagucacuaguggaag

SEQ ID NO: 156102 - RNA, 64 nt, Homo Sapiens
gguuccugguccccugggcuguguagacccggugucccaccaggcuccaggcucccaccaucua

SEQ ID NO: 156103 - RNA, 64 nt, Homo Sapiens
cuguguagacccggugucccaccaggcuccaggcucccaccaucuacagaggggcuuacagcgc

SEQ ID NO: 156104 - RNA, 64 nt, Homo Sapiens
ggcaagcugggggcccaucgccguggggagucccucccaccacccucgccgcaggcagcugcag

SEQ ID NO: 156105 - RNA, 64 nt, Homo Sapiens
gcacagcccucacagcucaaacgcccacccccacucccaccaucugcagguggugaaaacaaac

SEQ ID NO: 156106 - RNA, 64 nt, Homo Sapiens
ggcccccacucacagggagcccagggccaucuccucccaccaguguuucucaucccaugggcga

SEQ ID NO: 156107 - RNA, 64 nt, Homo Sapiens
cagcuccagcuguuaccugaaggaaaagaugugcucccaccaggucauuagugaauuacacuca

SEQ ID NO: 156108 - RNA, 64 nt, Homo Sapiens
gcgcagcuccuucccuaggcaccucugugcugcaucccaccagccugagcaagacgcccucucg

SEQ ID NO: 156109 - RNA, 64 nt, Homo Sapiens
agccucccucuccucuguccccauagcugguuuuucccaccaauccucaccuaacaguuacuuu

SEQ ID NO: 156110 - RNA, 64 nt, Homo Sapiens
uucucagggcagcccuugacggagggagggagugucccaccacgacccaggugugggcagucag

SEQ ID NO: 156111 - RNA, 64 nt, Homo Sapiens
ugcccuuucucugagggacgagaucccacuacucucccaccaccccgagcagcaaaaggggaga

SEQ ID NO: 156112 - RNA, 62 nt, Homo Sapiens
aauuggauauuggacucugcucauauaagcuacagacaaaagccaaaagacucucgcugucc

SEQ ID NO: 156113 - RNA, 62 nt, Homo Sapiens
gccuguaaucccagcauuuugggaggcucaggcagacaaaucgcucuagcucagaaguugca

SEQ ID NO: 156114 - RNA, 62 nt, Homo Sapiens
ugggcaacauggugaaacccgucucuaccaaacagacaaaaagcagccaggcgugguggcac

SEQ ID NO: 156115 - RNA, 62 nt, Homo Sapiens
acugaauuugaaauaaucucugaaaauguuuucagacaaagcguccuaacuacaaaugcuaa

SEQ ID NO: 156116 - RNA, 62 nt, Homo Sapiens
gucacaaauuucaaacuugucauguuagugagcagacaaauauaaaagaucacuuacaggau

SEQ ID NO: 156117 - RNA, 62 nt, Homo Sapiens
uaguaagcuaguguuucacaguucaucauugccagacaaaugguccauucugcugaauucag

SEQ ID NO: 156118 - RNA, 62 nt, Homo Sapiens
gcugauguucucuaugauauuaucucccgucucagacaaaugcugcaugugugggacacugg

SEQ ID NO: 156119 - RNA, 62 nt, Homo Sapiens
guaugcuugcuuuggaaugacucagaauuaaacagacaaaaguauaugcauuguguaaucca

SEQ ID NO: 156120 - RNA, 62 nt, Homo Sapiens
gaaacuaguauuaagggaagugucucauugaucagacaaaaaauuuaaaaacaaauuggcuu

SEQ ID NO: 156121 - RNA, 62 nt, Homo Sapiens
caccucugcaccuaguuuuuucccauugguuccagacaaaggugacuuauaaauauauuuag

SEQ ID NO: 156122 - RNA, 62 nt, Homo Sapiens
cuuucucaaagcggugaccacucaggccagcccagacaaaucugagggauggccagugcacu

SEQ ID NO: 156123 - RNA, 62 nt, Homo Sapiens
aguaggagauuuuauaaaagaaagaccugagucagacaaauaauaaaggucugcuguggcua

SEQ ID NO: 156124 - RNA, 62 nt, Homo Sapiens
guggcuaaaaaagcaaaaacaaaaaagcuauccagacaaaauacauagggaucagaaacuuu

SEQ ID NO: 156125 - RNA, 62 nt, Homo Sapiens
cccggacagacagacacagccugaaacagacccagacaaacagacagacagacacagccuga

SEQ ID NO: 156126 - RNA, 62 nt, Homo Sapiens
ccuagacagacagacacagauugaaacagacccagacaaacagacagacacagccugaaaca

SEQ ID NO: 156127 - RNA, 62 nt, Homo Sapiens
cuuuucuccuguguaucuuuuguguuugguuucagacaaaacuguuauuuauuagcccuaau

SEQ ID NO: 156128 - RNA, 62 nt, Homo Sapiens
uaacccuuuucuccuguguauguguuugauuucagacaaaauaguuauuuauuagcccuaau

SEQ ID NO: 156129 - RNA, 62 nt, Homo Sapiens
agcuuuguggcacccucagugcaaccucagaacagacaaaucaugaaugagcuggaacuuug

SEQ ID NO: 156130 - RNA, 62 nt, Homo Sapiens
uggugggagggaagccgggaauguauccuuuucagacaaaauuaaauauuuugaaaugagaa

SEQ ID NO: 156131 - RNA, 62 nt, Homo Sapiens
uucagugaggaaaaaaagggggaaaaaacauucagacaaauggaggaaaacauguucaguga

SEQ ID NO: 156132 - RNA, 62 nt, Homo Sapiens
uucagugugagugaggaaaacagccacaguuucagacaaaugugcaucuugaagcaacaaag

SEQ ID NO: 156133 - RNA, 64 nt, Homo Sapiens
aggcuuucacagacuggggauuuuucuaggugacccuguuuaauauggauuuauaaacuuguuu

SEQ ID NO: 156134 - RNA, 64 nt, Homo Sapiens
ggauuacugguccuacagccagauggagagcaugccuguuuaaguuacugaacuucauccuguu

SEQ ID NO: 156135 - RNA, 64 nt, Homo Sapiens
ccugucuaacuggaugcucauugccugggcaaggccuguuuaggccgguugcgguggcucaugc

SEQ ID NO: 156136 - RNA, 64 nt, Homo Sapiens
agacuccaucucaaaaaaaaaagaaaagaaaaagccuguuuaaugcacaggugugaguggauug

SEQ ID NO: 156137 - RNA, 64 nt, Homo Sapiens
aaguggcaauuccauacauagaacagaaagucugccuguuuaguuaagagcucuagaaaaaagg

SEQ ID NO: 156138 - RNA, 64 nt, Homo Sapiens
gcaguacugaagagaaauggaaucuugcuucccgccuguuuaugauguacauauauauguauau

SEQ ID NO: 156139 - RNA, 64 nt, Homo Sapiens
auuuaagaauauuauccugguuuaacaacagugcccuguuuacaacagauugugcccuaucuca

SEQ ID NO: 156140 - RNA, 64 nt, Homo Sapiens
gauuggcuuguuuuuauguggcgccaagaacgaaccuguuuaacagcuguaaccaaugguacug

SEQ ID NO: 156141 - RNA, 64 nt, Homo Sapiens
uauuggucaugguugacugaggagccaauuaaaaccuguuuaugccuaguguuccauuauugga

SEQ ID NO: 156142 - RNA, 64 nt, Homo Sapiens
cgggccgaguucuaucuaggugugucuuccagaaccuguuuacggcuaacuggauaacugagag

SEQ ID NO: 156143 - RNA, 64 nt, Homo Sapiens
ggcccagccgccucccucucuugggacgcaacuucuuccccacucggaugggcuuuaaauuauu

SEQ ID NO: 156144 - RNA, 64 nt, Homo Sapiens
auuccaagggcccuggcguccucugccuuccccgcuuccccaugagcgucugcaaaacacuugc

SEQ ID NO: 156145 - RNA, 64 nt, Homo Sapiens
cucugugcucacugaagggugagccaggccagugcuuccccagccccugggccuggucacuaca

SEQ ID NO: 156146 - RNA, 64 nt, Homo Sapiens
ggucacuacacaguggaaaacagacaagcggccccuuccccaaaucccaagagugucuugcugc

SEQ ID NO: 156147 - RNA, 64 nt, Homo Sapiens
uauuccuuuccuuucuauccuuuuauauuuuucccuuccccacccccucacucaaugguauaaa

SEQ ID NO: 156148 - RNA, 64 nt, Homo Sapiens
cagaucucucuuuugcaacauuuuacccauuucccuuccccaaaccaugugcuuauuagauggu

SEQ ID NO: 156149 - RNA, 64 nt, Homo Sapiens
ggccuaccccccauauguccgccaagcaaagacccuuccccagauggacuuggcccugccugau

SEQ ID NO: 156150 - RNA, 64 nt, Homo Sapiens
ggccaccaacugaccuggggccccacuccagggccuuccccagcgggaggagggagccugcuca

SEQ ID NO: 156151 - RNA, 64 nt, Homo Sapiens
aggggacagucuggccaacuuuuuuguuuaauaccuuccccaagagaggagauacuuauugguc

SEQ ID NO: 156152 - RNA, 64 nt, Homo Sapiens
cugucaauugaaaucuuaacuagccagcacaucccuuccccaaacucuaaagucauuuaacuaa

SEQ ID NO: 156153 - RNA, 64 nt, Homo Sapiens
uuuaaaggcccugcagaaaucauuauuauaugugcuuccccaagcaaauaacaauauagaacaa

SEQ ID NO: 156154 - RNA, 64 nt, Homo Sapiens
ccaaaccauagcugucuguccuacuuccuaaucucuuccccaauaaaaaagggucuuuaagaac

SEQ ID NO: 156155 - RNA, 64 nt, Homo Sapiens
ucucugugcacucugucuugcaaaguucagcuuccuuccccaggugcaccuguccucaucucug

SEQ ID NO: 156156 - RNA, 64 nt, Homo Sapiens
cuccagagggagggagguggcuggauucucuccucuuccccauugggaggcuggaauggagaau

SEQ ID NO: 156157 - RNA, 64 nt, Homo Sapiens
uuuucucuaagauauacaguaauugagccccucccuuccccagugaagggcuaggcagggggca

SEQ ID NO: 156158 - RNA, 64 nt, Homo Sapiens
cacaguuccaaugugccuguucacucaccucucccuuccccaacccuucucuacuuggcugcug

SEQ ID NO: 156159 - RNA, 64 nt, Homo Sapiens
ccuucucuacuuggcugcuguuuuaaaguuugcccuuccccaaauuuggauuuuuauuacagau

SEQ ID NO: 156160 - RNA, 64 nt, Homo Sapiens
ugucccuuuccagugcuguggcauucuguggcagcuuccccagguguggugacggggggggggc

SEQ ID NO: 156161 - RNA, 64 nt, Homo Sapiens
gcuugaggguggacggcgugccucucccaggagccuuccccauguccuugccuugcugagaauu

SEQ ID NO: 156162 - RNA, 64 nt, Homo Sapiens
cuccucuuccucccccggaaccccuuuacaugcccuuccccaguuacaaauuaaagguuaaagg

SEQ ID NO: 156163 - RNA, 64 nt, Homo Sapiens
uuauuguaaaagaguuuaacuuccuguuuauacccuuccccacgucaaauggaaauugugcacu

SEQ ID NO: 156164 - RNA, 64 nt, Homo Sapiens
gcccuugggugccagagugagacacagcaggacccuuccccaaauacuaggcucagagcaaccu

SEQ ID NO: 156165 - RNA, 64 nt, Homo Sapiens
ucccuguguccuuggacagcagauccacacaccacuuccccacccacacacaguacccugggcu

SEQ ID NO: 156166 - RNA, 64 nt, Homo Sapiens
aaggagggacagcauuucucucuguuugccaccacuuccccagggcagagagagccuuggcgcc

SEQ ID NO: 156167 - RNA, 64 nt, Homo Sapiens
caguuuaucuuccgucacaugggccucaguuucucuuccccacaggggcagcuuuauuccuguu

SEQ ID NO: 156168 - RNA, 64 nt, Homo Sapiens
ccccccguccugccauccccccccgccguccugccuuccccaccccacccuuaggucccaggua

SEQ ID NO: 156169 - RNA, 64 nt, Homo Sapiens
gucucuguuuacugccuuugaacagaacuucuuccuuccccaugcuuugggucaccucgggcug

SEQ ID NO: 156170 - RNA, 64 nt, Homo Sapiens
agaguggugcuuacugugcugacuguguacuuaucuuccccaagagaaaaugcuucuuuugagc

SEQ ID NO: 156171 - RNA, 64 nt, Homo Sapiens
aagagaggaguuugcucugaauuuguaaauaagucuuccccauuccucauacucgagccucucc

SEQ ID NO: 156172 - RNA, 64 nt, Homo Sapiens
gccuucuggggaggggcuccagcacagagagcggcuuccccaucgccuucuggcugcugcaguc

SEQ ID NO: 156173 - RNA, 64 nt, Homo Sapiens
gccuucuggcugcugcagucgacacagaggacagcuuccccauccccauugccuucuggggagg

SEQ ID NO: 156174 - RNA, 64 nt, Homo Sapiens
gccuucuggggagggacacaagcacagagagcggcuuccccauugccuucuggccgcugcaguc

SEQ ID NO: 156175 - RNA, 64 nt, Homo Sapiens
gccuucuggccgcugcagucgacacagaggacggcuuccccauccccauugccuucuggggagg

SEQ ID NO: 156176 - RNA, 64 nt, Homo Sapiens
gccuucuggggagggacacaagcacagaggauggcuuccccauuacugccaggcagcugcaguu

SEQ ID NO: 156177 - RNA, 64 nt, Homo Sapiens
ggacagcuuugcuccgcucccaccgcccccaccccuuccccaggcccaccaucaccaccgccuc

SEQ ID NO: 156178 - RNA, 64 nt, Homo Sapiens
ugucuuugucaccacguggggcucacuuuucauccuuccccaacuucccuaguccccguacuag

SEQ ID NO: 156179 - RNA, 64 nt, Homo Sapiens
uuuacauucuccucuggggcucuaccucuccacacuuccccagaagggaaaagggcacccugga

SEQ ID NO: 156180 - RNA, 64 nt, Homo Sapiens
uggaaaucacuccuuggugggcagcauccugaggcuuccccagaaccaggccucugcucuggcc

SEQ ID NO: 156181 - RNA, 64 nt, Homo Sapiens
aguauaaaugggcccauauuuauagucucacacccuuccccauaucuccaaacucauccuugug

SEQ ID NO: 156182 - RNA, 64 nt, Homo Sapiens
gaucuaaggacugggcuaccgaagggcucagggccuuccccacaucuugccacuccuagcucca

SEQ ID NO: 156183 - RNA, 64 nt, Homo Sapiens
ucagauacugucaacuccauucuucacucucugccuuccccaucccaaccuucccccacagcua

SEQ ID NO: 156184 - RNA, 64 nt, Homo Sapiens
cacucacguucauguccuuauccaucuucacuggcuuccccagccccuugagucucuccucuuc

SEQ ID NO: 156185 - RNA, 64 nt, Homo Sapiens
gauggcgguggaggggguucagcuggugugggaacuuccccacggguggggcuggugggucugc

SEQ ID NO: 156186 - RNA, 64 nt, Homo Sapiens
cugcccacucuggggacccgggacaacacagcugcuuccccaggccugaggcuggcugggggca

SEQ ID NO: 156187 - RNA, 64 nt, Homo Sapiens
uguccugccagcccuucucgucucaggcaccccucuuccccagcccccacccuaccucaccucu

SEQ ID NO: 156188 - RNA, 64 nt, Homo Sapiens
ucggguccccaagccgcuggguuuaccccaaacucuuccccacccuugagcugaacugggcugu

SEQ ID NO: 156189 - RNA, 64 nt, Homo Sapiens
aagggauuacuuagaagacauuuuuguacaugcucuuccccaaggauuguacguauuauacaaa

SEQ ID NO: 156190 - RNA, 64 nt, Homo Sapiens
uuacugaugagaugaaaccuauuuguaaggagaucuuccccaggagcauuucuguugccuucuu

SEQ ID NO: 156191 - RNA, 64 nt, Homo Sapiens
uguggacugggcugcuggccugcuugcuuccucccuuccccauuccuagcagggccugaggccc

SEQ ID NO: 156192 - RNA, 64 nt, Homo Sapiens
augacgggaagcugagugacccugaggccuuaagcuuccccagucuuggccccaaaugcaguca

SEQ ID NO: 156193 - RNA, 64 nt, Homo Sapiens
ugcccuuccaagcccggcuuugggccaggaaaggcuuccccagguggcucuucuaccaggcuuu

SEQ ID NO: 156194 - RNA, 64 nt, Homo Sapiens
ccgccugcagaaaggaccugcccugauaaugucccuuccccagauucucaagcagaugcccaag

SEQ ID NO: 156195 - RNA, 64 nt, Homo Sapiens
gcuccuggcagagggagaggacaggaggaggagccuuccccaggaggaacgaggagagguggcc

SEQ ID NO: 156196 - RNA, 64 nt, Homo Sapiens
augacaagcgacaaguguacccagaguagaaggccuuccccacucccaccucaaacccaggagc

SEQ ID NO: 156197 - RNA, 64 nt, Homo Sapiens
gauguuucuggcaggcccagaagugcuggccguucuuccccagccuccccacugcucccuccuc

SEQ ID NO: 156198 - RNA, 64 nt, Homo Sapiens
gcuggccugacugugcugggcucaugaaugaggccuuccccaggcuuggccccugggguccugc

SEQ ID NO: 156199 - RNA, 64 nt, Homo Sapiens
ugccuccuaccagcaguuuccuggccaucgccaccuuccccagcgggccaggccugccugccca

SEQ ID NO: 156200 - RNA, 64 nt, Homo Sapiens
caccaacccucagggcaaaguggcugcugaucgccuuccccaccgcuccucuuccccagacgcc

SEQ ID NO: 156201 - RNA, 64 nt, Homo Sapiens
cgccuggcugcugaucgccuguggccaugcuccucuuccccagaucucacccuggaggcaccug

SEQ ID NO: 156202 - RNA, 64 nt, Homo Sapiens
ugcccagaaacaagaaacacgauaccauucuggccuuccccaccccacauccucucuuggccuu

SEQ ID NO: 156203 - RNA, 64 nt, Homo Sapiens
uuuuugauuuggugugugcccuaggguauguacccuuccccaucugagccucgguguguccaug

SEQ ID NO: 156204 - RNA, 64 nt, Homo Sapiens
cccuggaucaggguuguucugggaguccugucagcuuccccaggagcucucugcugagcagccc

SEQ ID NO: 156205 - RNA, 64 nt, Homo Sapiens
gccccagaacaauucugcagaguggugaaguucacuuccccaacucuucuccaagucuagcuuu

SEQ ID NO: 156206 - RNA, 64 nt, Homo Sapiens
cuggggcggcuuuggucccuuuuccuggcccuuccuuccccacuucuaagccaaagaaaggaga

SEQ ID NO: 156207 - RNA, 64 nt, Homo Sapiens
gcccgggcagcccugcccagcucaggccccuuuccuuccccauugagguugggguagguggggg

SEQ ID NO: 156208 - RNA, 64 nt, Homo Sapiens
gguugugguuuuucaugcccucuaccaugugggccuuccccaggagaugauccuguuaaguguu

SEQ ID NO: 156209 - RNA, 64 nt, Homo Sapiens
aauguucuagcugauggugagcggcacagucccacuuccccaucuccccaaguaggugguguua

SEQ ID NO: 156210 - RNA, 53 nt, Homo Sapiens
gcagcugcacacugcucugagcccuuccccaggcccaggcuguagaccaccau

SEQ ID NO: 156211 - RNA, 64 nt, Homo Sapiens
cuuuauccucauggugcccacuacgagucauacucuuccccaugcugcucauccuccugggccc

SEQ ID NO: 156212 - RNA, 64 nt, Homo Sapiens
cuaggagcaaagucucaccccuuugucuacguugcuuccccaaaccaugagcagagggacuucg

SEQ ID NO: 156213 - RNA, 64 nt, Homo Sapiens
augccaaaccagacucggguccccuccugcuucccuuccccacuuaucccccaagugccuuccc

SEQ ID NO: 156214 - RNA, 64 nt, Homo Sapiens
aagaaaagaguuccuuuugccuuauuccuuaugccuuccccacugguauugaggguuuugauaa

SEQ ID NO: 156215 - RNA, 64 nt, Homo Sapiens
ugguaggaaaaaaaaguaccuccuagaaggaagccuuccccaccauuuccaggugccaacugcu

SEQ ID NO: 156216 - RNA, 64 nt, Homo Sapiens
uugugcuccaggggagccccugcccaagggucgccuuccccagcccugcguguggagggggugc

SEQ ID NO: 156217 - RNA, 64 nt, Homo Sapiens
cuccagggcagaaagagccccugcugacccaggacuuccccaacgaggacgcccgagcccaccc

SEQ ID NO: 156218 - RNA, 64 nt, Homo Sapiens
ucuuguacacauuuuaauaagucugguccuuuuccuuccccaucguguacauggccacaguaca

SEQ ID NO: 156219 - RNA, 64 nt, Homo Sapiens
uuucaguuauacgaaugccaacugaccugguggucuuccccaacauacaaaaccucuccacucc

SEQ ID NO: 156220 - RNA, 64 nt, Homo Sapiens
gccccaccaccaccacgugccgaccaggcuugggcuuccccagcaccccacccaggcacauuag

SEQ ID NO: 156221 - RNA, 64 nt, Homo Sapiens
cccugguccccgggagcagcacugucuucucacccuuccccacuaucaccugaccuucuccagg

SEQ ID NO: 156222 - RNA, 64 nt, Homo Sapiens
ugggccuucauaaaaugcaguuccagaguucuuccuuccccaucgcccagcaccccuaucccau

SEQ ID NO: 156223 - RNA, 64 nt, Homo Sapiens
ccccucagaggcccccgccacaagggcuaguccucuuccccagugcuacaggccacucuaggcc

SEQ ID NO: 156224 - RNA, 64 nt, Homo Sapiens
ccuuaagggggagggcuagugugggggagggaggcuuccccagccuuaagagacccucucagcc

SEQ ID NO: 156225 - RNA, 64 nt, Homo Sapiens
ccauaaauuuucuuauggaacucucccacauccucuuccccaacuucauuugcuucucucaaca

SEQ ID NO: 156226 - RNA, 64 nt, Homo Sapiens
caaucuuacaaaguguugguccagagucccaucucuuccccaacccuggauaccaguagcuucc

SEQ ID NO: 156227 - RNA, 64 nt, Homo Sapiens
aaagcaagggcacagggauuagaccuguggcacacuuccccaauucccucaucuguaggauuug

SEQ ID NO: 156228 - RNA, 64 nt, Homo Sapiens
uaguguccugggacaugguagaggaauuuccuggcuuccccagaggguuugauggacagaggcu

SEQ ID NO: 156229 - RNA, 64 nt, Homo Sapiens
ccagccaggugucccuccuaacugguccugggcacuuccccaccgcaauaccugcauccccagc

SEQ ID NO: 156230 - RNA, 64 nt, Homo Sapiens
uugaggagagaaguggaagccacugcccuguggucuuccccaggaaggcagguccugaggcagg

SEQ ID NO: 156231 - RNA, 64 nt, Homo Sapiens
aagcugaauaggguagaaccaagaugucuccuggcuuccccaaguguggcgcuacauuaauuuc

SEQ ID NO: 156232 - RNA, 64 nt, Homo Sapiens
agcagagacccuggagcacaauaccccaggaccccuuccccagcugcuuuucuucauuuacuuc

SEQ ID NO: 156233 - RNA, 64 nt, Homo Sapiens
uccuucccaaacccucuuggggccuuccagccuccuuccccaccgagggcagggaggcuuccug

SEQ ID NO: 156234 - RNA, 64 nt, Homo Sapiens
agggacugggguuucugggggacccacccuagaucuuccccaagcuuaccgcucuguuuauagu

SEQ ID NO: 156235 - RNA, 64 nt, Homo Sapiens
ucugcuccuccccuuucacacucugggcauaucccuuccccagaucuuuggucuuguugauuuc

SEQ ID NO: 156236 - RNA, 64 nt, Homo Sapiens
cagcauccccaacugcgacucugucucugccccccuuccccagcuucugcuaggugcccugccc

SEQ ID NO: 156237 - RNA, 64 nt, Homo Sapiens
aggauugcucuccaaggccauaaugaccccuugccuuccccaugauucucuacaaagcucuugc

SEQ ID NO: 156238 - RNA, 64 nt, Homo Sapiens
uccuccucccacauuucuggagcuuuuuuuuuuccuuccccauugaccuuuguggucuucugug

SEQ ID NO: 156239 - RNA, 64 nt, Homo Sapiens
gacccucuggccucucaccccacuucagugcucucuuccccaacuucucucgggcucuuugcuc

SEQ ID NO: 156240 - RNA, 64 nt, Homo Sapiens
auccccucucaaccaggaguggagggcuaggucccuuccccauggggaguacacuuggguguuc

SEQ ID NO: 156241 - RNA, 64 nt, Homo Sapiens
cuacgggcuuagcccucgccucccucacugggagcuuccccauccucccugccuuccccagugg

SEQ ID NO: 156242 - RNA, 64 nt, Homo Sapiens
ccucccucacugggagcuuccccauccucccugccuuccccagugggaaguuagggaagcucag

SEQ ID NO: 156243 - RNA, 64 nt, Homo Sapiens
cacaaagguguuugugauucaucaagcccauuuccuuccccaacuccgcacacacuucuucccc

SEQ ID NO: 156244 - RNA, 64 nt, Homo Sapiens
aagcccauuuccuuccccaacuccgcacacacuucuuccccaucagaacaugcuccgcaaaguu

SEQ ID NO: 156245 - RNA, 64 nt, Homo Sapiens
caggcacccccucccggggcagaccccaacauagcuuccccaccccgggcagggcccccacacc

SEQ ID NO: 156246 - RNA, 64 nt, Homo Sapiens
ucaggcacaacagagucuggccgagacagggucccuuccccagccucauagaacuuugcucuuc

SEQ ID NO: 156247 - RNA, 64 nt, Homo Sapiens
ugccucaggcuccuuccuggucuggcccagcuggcuuccccagccccucagccauccagggcua

SEQ ID NO: 156248 - RNA, 64 nt, Homo Sapiens
ugggcugguccagguagcucuccugaaccuccuccuuccccaagcugagaagcugagagcugga

SEQ ID NO: 156249 - RNA, 64 nt, Homo Sapiens
ccaacauccauuguagggggaaucuaugauucugcuuccccagcggauucccacucuguccacc

SEQ ID NO: 156250 - RNA, 64 nt, Homo Sapiens
ugagccucccucugacacagaggagguggcuccccuuccccacaccuuagaguggcugggaggg

SEQ ID NO: 156251 - RNA, 64 nt, Homo Sapiens
uacuuuaacaccagguuuauggaaaaugucaggccuuccccacaacuccugucuaacugcuguc

SEQ ID NO: 156252 - RNA, 64 nt, Homo Sapiens
accugugaggcagccuucugauggccuggcccaccuuccccagaaccaggggaggccugaggcu

SEQ ID NO: 156253 - RNA, 64 nt, Homo Sapiens
uggagccagggacuguccggggggaucagcuucccuuccccacccagagcagugggaccagcau

SEQ ID NO: 156254 - RNA, 64 nt, Homo Sapiens
ccuuaauuuuaacuuugugguuuuuuucuuucuucuuccccaccacacuggaaagucuguuuuu

SEQ ID NO: 156255 - RNA, 64 nt, Homo Sapiens
uaaagccuagaagagcuucuacaacaacaaaaagcuuccccaacagugagacuccgucacaaca

SEQ ID NO: 156256 - RNA, 64 nt, Homo Sapiens
cuggacgugguggcucacgcgcaguuacaaaaaccuuccccaggccagauucuaccacacagca

SEQ ID NO: 156257 - RNA, 64 nt, Homo Sapiens
gccccagcuuagccucuucuaagaauagcacccccuuccccauuaaccucuuccagauuucucu

SEQ ID NO: 156258 - RNA, 64 nt, Homo Sapiens
gcagcaggccccgagccccuugcuggcuaccacucuuccccagaccagacaugugccccuuugc

SEQ ID NO: 156259 - RNA, 64 nt, Homo Sapiens
accccugagaggggcuuauuucacccacccugcccuuccccagggaggccagagcucggcagag

SEQ ID NO: 156260 - RNA, 64 nt, Homo Sapiens
cugccacccacgcuggcggagggccaggccuccucuuccccaggccagacccaccacagcugga

SEQ ID NO: 156261 - RNA, 64 nt, Homo Sapiens
ucuccuccaggccccccgggacuccugggggggccuuccccaucauuugucucucuguccaccc

SEQ ID NO: 156262 - RNA, 64 nt, Homo Sapiens
uuccugggcuccccuucucuuuucuccaaucccccuuccccaggagggagacagccccaacccu

SEQ ID NO: 156263 - RNA, 64 nt, Homo Sapiens
acggaaggggccccugggcacagagagcacugcacuuccccaaaugcuccagcuucuggguauc

SEQ ID NO: 156264 - RNA, 64 nt, Homo Sapiens
uaaauacccugccugcaacuggagagaauuuccucuuccccagccuuaccuuggagaggguccu

SEQ ID NO: 156265 - RNA, 64 nt, Homo Sapiens
accagucugucuggggacaggaucccugcugcaccuuccccacccccuccugggaagugccccc

SEQ ID NO: 156266 - RNA, 64 nt, Homo Sapiens
gacagcugcccccagaacucccuucaagggaggacuuccccagcuaugggaagugccaucaggg

SEQ ID NO: 156267 - RNA, 64 nt, Homo Sapiens
uuuaaaugcagugccuagagagagaguauugucucuuccccaacacuaaccccacucccaugaa

SEQ ID NO: 156268 - RNA, 64 nt, Homo Sapiens
ucaaaggaccaguuuuccuaggccaaagaagucucuuccccauguuaguccuaugccuugaaau

SEQ ID NO: 156269 - RNA, 64 nt, Homo Sapiens
uccagcaguauuacuuguaaccaaacccccaucccuuccccacccguccuaucccaacucaccc

SEQ ID NO: 156270 - RNA, 64 nt, Homo Sapiens
uggacugggaggucaggaagcagggaccgucuggcuuccccagcuuuaaucucuuggccucacc

SEQ ID NO: 156271 - RNA, 64 nt, Homo Sapiens
gucccccgacccacuucauccacuuccacaccgucuuccccagccaacccccaaacccacgacu

SEQ ID NO: 156272 - RNA, 64 nt, Homo Sapiens
acagcugcauggcucccgcuucacuucucugcuucuuccccaacuuuggaaaagucaaaucaua

SEQ ID NO: 156273 - RNA, 64 nt, Homo Sapiens
cucagcuccaaacgccuccugagcuggcgagaaccuuccccacagaagcucagccugagagaag

SEQ ID NO: 156274 - RNA, 64 nt, Homo Sapiens
auaggcuuagugcuuggcucaaggguggaugucccuuccccacacucuggggucugugaugggg

SEQ ID NO: 156275 - RNA, 64 nt, Homo Sapiens
cucagcucagcauuguguacucuuauaugugccccuuccccauguggagugcauucauucaucc

SEQ ID NO: 156276 - RNA, 64 nt, Homo Sapiens
gucucaccuuuucuuccaauuuccuaggcagucucuuccccaaauucaugcucagcacaucauc

SEQ ID NO: 156277 - RNA, 64 nt, Homo Sapiens
gaccccauaaccccagaccauccccuccaucucucuuccccauaccagaguccccagugucccc

SEQ ID NO: 156278 - RNA, 64 nt, Homo Sapiens
cugcaaggagccuguagcauaugccccagcuggccuuccccagcccucccucggcuccagccca

SEQ ID NO: 156279 - RNA, 64 nt, Homo Sapiens
cugggccuugaccguccagcaccauucuguaccccuuccccagcugcauggggcuucgcccaca

SEQ ID NO: 156280 - RNA, 64 nt, Homo Sapiens
gucacagaaauuugugaucugaaaacccggcucccuuccccacaaggcuccugggccuccggga

SEQ ID NO: 156281 - RNA, 64 nt, Homo Sapiens
gcggacucuccaagggguacccccaccccgcuaccuuccccacggacgggccccuccuggagcc

SEQ ID NO: 156282 - RNA, 64 nt, Homo Sapiens
gcucucuguggugagaaauugugccuccucuugacuuccccacucgguguucugucccagugcg

SEQ ID NO: 156283 - RNA, 64 nt, Homo Sapiens
uggcucuagucacuggcaucaccagagagagauucuuccccaauccugcugaccaugcagccgc

SEQ ID NO: 156284 - RNA, 64 nt, Homo Sapiens
aacccugcccugcucugcccuuuaagcucugccccuuccccaugggaggucccagcccuggggg

SEQ ID NO: 156285 - RNA, 64 nt, Homo Sapiens
ggaaccgcccagugcagguaaugaggcccugcaccuuccccaaaaggcaaggaggaggagucag

SEQ ID NO: 156286 - RNA, 64 nt, Homo Sapiens
uugcauuggaggucccagaaccuacaucuucucucuuccccauccgcagggccugccgccacug

SEQ ID NO: 156287 - RNA, 64 nt, Homo Sapiens
accaugccaaaaggucuuaucucccuucucuacucuuccccagcccuucucugcccugugccca

SEQ ID NO: 156288 - RNA, 64 nt, Homo Sapiens; identical to SEQ ID NO: 139090

SEQ ID NO: 156289 - RNA, 64 nt, Homo Sapiens; identical to SEQ ID NO: 139091

SEQ ID NO: 156290 - RNA, 64 nt, Homo Sapiens; identical to SEQ ID NO: 139092

SEQ ID NO: 156291 - RNA, 64 nt, Homo Sapiens; identical to SEQ ID NO: 139093

SEQ ID NO: 156292 - RNA, 64 nt, Homo Sapiens; identical to SEQ ID NO: 139094

SEQ ID NO: 156293 - RNA, 64 nt, Homo Sapiens; identical to SEQ ID NO: 139095

SEQ ID NO: 156294 - RNA, 64 nt, Homo Sapiens; identical to SEQ ID NO: 139096

SEQ ID NO: 156295 - RNA, 64 nt, Homo Sapiens; identical to SEQ ID NO: 139097

SEQ ID NO: 156296 - RNA, 64 nt, Homo Sapiens; identical to SEQ ID NO: 139098

SEQ ID NO: 156297 - RNA, 64 nt, Homo Sapiens; identical to SEQ ID NO: 139099

SEQ ID NO: 156298 - RNA, 64 nt, Homo Sapiens; identical to SEQ ID NO: 139100

SEQ ID NO: 156299 - RNA, 64 nt, Homo Sapiens; identical to SEQ ID NO: 139101

SEQ ID NO: 156300 - RNA, 64 nt, Homo Sapiens; identical to SEQ ID NO: 139102

SEQ ID NO: 156301 - RNA, 64 nt, Homo Sapiens; identical to SEQ ID NO: 139103

SEQ ID NO: 156302 - RNA, 64 nt, Homo Sapiens; identical to SEQ ID NO: 139104

SEQ ID NO: 156303 - RNA, 64 nt, Homo Sapiens; identical to SEQ ID NO: 139105

SEQ ID NO: 156304 - RNA, 64 nt, Homo Sapiens; identical to SEQ ID NO: 139106

SEQ ID NO: 156305 - RNA, 64 nt, Homo Sapiens; identical to SEQ ID NO: 139107

SEQ ID NO: 156306 - RNA, 64 nt, Homo Sapiens; identical to SEQ ID NO: 139108

SEQ ID NO: 156307 - RNA, 64 nt, Homo Sapiens; identical to SEQ ID NO: 139109

SEQ ID NO: 156308 - RNA, 64 nt, Homo Sapiens; identical to SEQ ID NO: 139110

SEQ ID NO: 156309 - RNA, 64 nt, Homo Sapiens; identical to SEQ ID NO: 139111

SEQ ID NO: 156310 - RNA, 64 nt, Homo Sapiens; identical to SEQ ID NO: 139112

SEQ ID NO: 156311 - RNA, 64 nt, Homo Sapiens; identical to SEQ ID NO: 139113

SEQ ID NO: 156312 - RNA, 64 nt, Homo Sapiens; identical to SEQ ID NO: 139114

SEQ ID NO: 156313 - RNA, 64 nt, Homo Sapiens; identical to SEQ ID NO: 139115

SEQ ID NO: 156314 - RNA, 52 nt, Homo Sapiens; identical to SEQ ID NO: 112167

SEQ ID NO: 156315 - RNA, 64 nt, Homo Sapiens; identical to SEQ ID NO: 139117

SEQ ID NO: 156316 - RNA, 64 nt, Homo Sapiens; identical to SEQ ID NO: 139118

SEQ ID NO: 156317 - RNA, 64 nt, Homo Sapiens; identical to SEQ ID NO: 139119

SEQ ID NO: 156318 - RNA, 64 nt, Homo Sapiens; identical to SEQ ID NO: 139120

SEQ ID NO: 156319 - RNA, 64 nt, Homo Sapiens; identical to SEQ ID NO: 139121

SEQ ID NO: 156320 - RNA, 64 nt, Homo Sapiens; identical to SEQ ID NO: 139122

SEQ ID NO: 156321 - RNA, 64 nt, Homo Sapiens; identical to SEQ ID NO: 139123

SEQ ID NO: 156322 - RNA, 64 nt, Homo Sapiens; identical to SEQ ID NO: 139124

SEQ ID NO: 156323 - RNA, 64 nt, Homo Sapiens; identical to SEQ ID NO: 139125

SEQ ID NO: 156324 - RNA, 64 nt, Homo Sapiens; identical to SEQ ID NO: 139126

SEQ ID NO: 156325 - RNA, 64 nt, Homo Sapiens; identical to SEQ ID NO: 139127

SEQ ID NO: 156326 - RNA, 64 nt, Homo Sapiens; identical to SEQ ID NO: 139128

SEQ ID NO: 156327 - RNA, 64 nt, Homo Sapiens; identical to SEQ ID NO: 139129

SEQ ID NO: 156328 - RNA, 64 nt, Homo Sapiens; identical to SEQ ID NO: 139130

SEQ ID NO: 156329 - RNA, 64 nt, Homo Sapiens; identical to SEQ ID NO: 139131

SEQ ID NO: 156330 - RNA, 64 nt, Homo Sapiens
gagaugacuaaggucauugaauauauucagacuauccagauacauuucagugggcaauuuugua

SEQ ID NO: 156331 - RNA, 64 nt, Homo Sapiens
aagugaggaaugaggugugagcucccugaguguguccagauacccuagcagauugcuucccagg

SEQ ID NO: 156332 - RNA, 64 nt, Homo Sapiens
ugagaagcaggaaauuuauauagguagccaaaaauccagauauucaccaaagacggaagccaaa

SEQ ID NO: 156333 - RNA, 64 nt, Homo Sapiens
auuacauuugaaauuguuauuauugaaguucaaauccagauaguagaauuuuacuuaggaaaag

SEQ ID NO: 156334 - RNA, 64 nt, Homo Sapiens
aguguauccaaacaucuaauaauuuccuucagucuccagauaggaugcaguguacauuucagau

SEQ ID NO: 156335 - RNA, 64 nt, Homo Sapiens
gugagaaaauagccaugucauuccccaacccaccuccagauaauucuggaucagauccgcgcua

SEQ ID NO: 156336 - RNA, 64 nt, Homo Sapiens
cagcuugaagagguagcuagguguuuaaaguuccuccagauacuuuuaccugagugaugcuucc

SEQ ID NO: 156337 - RNA, 64 nt, Homo Sapiens
uucuacuguguagaauacuuugacuuaauuuucuuccagauacagggggauaccugccuguuuu

SEQ ID NO: 156338 - RNA, 64 nt, Homo Sapiens
cccaccuaagugaaauggccuagugaaaaagguguccagauaaauaugugucuucuucuccaga

SEQ ID NO: 156339 - RNA, 64 nt, Homo Sapiens
gaaaaagguguccagauaaauaugugucuucuucuccagauagucagcagcccugaacaaccag

SEQ ID NO: 156340 - RNA, 64 nt, Homo Sapiens
caagaagagugaaugugucccauccaaaggugcauccagauaugucuguguuacuauggcuuca

SEQ ID NO: 156341 - RNA, 64 nt, Homo Sapiens
gaaagcaggauuugagagaacauacaccuugccuuccagauaugugguuuuugugauucaccca

SEQ ID NO: 156342 - RNA, 64 nt, Homo Sapiens; identical to SEQ ID NO: 39289

SEQ ID NO: 156343 - RNA, 64 nt, Homo Sapiens; identical to SEQ ID NO: 39290

SEQ ID NO: 156344 - RNA, 64 nt, Homo Sapiens; identical to SEQ ID NO: 39291

SEQ ID NO: 156345 - RNA, 64 nt, Homo Sapiens; identical to SEQ ID NO: 39292

SEQ ID NO: 156346 - RNA, 64 nt, Homo Sapiens; identical to SEQ ID NO: 39293

SEQ ID NO: 156347 - RNA, 64 nt, Homo Sapiens; identical to SEQ ID NO: 39294

SEQ ID NO: 156348 - RNA, 64 nt, Homo Sapiens; identical to SEQ ID NO: 39295

SEQ ID NO: 156349 - RNA, 64 nt, Homo Sapiens; identical to SEQ ID NO: 39296

SEQ ID NO: 156350 - RNA, 64 nt, Homo Sapiens; identical to SEQ ID NO: 39297

SEQ ID NO: 156351 - RNA, 64 nt, Homo Sapiens; identical to SEQ ID NO: 39298

SEQ ID NO: 156352 - RNA, 64 nt, Homo Sapiens; identical to SEQ ID NO: 39299

SEQ ID NO: 156353 - RNA, 64 nt, Homo Sapiens; identical to SEQ ID NO: 39300

SEQ ID NO: 156354 - RNA, 64 nt, Homo Sapiens; identical to SEQ ID NO: 39301

SEQ ID NO: 156355 - RNA, 64 nt, Homo Sapiens; identical to SEQ ID NO: 39302

SEQ ID NO: 156356 - RNA, 64 nt, Homo Sapiens; identical to SEQ ID NO: 39303

SEQ ID NO: 156357 - RNA, 64 nt, Homo Sapiens; identical to SEQ ID NO: 39304

SEQ ID NO: 156358 - RNA, 64 nt, Homo Sapiens; identical to SEQ ID NO: 39305

SEQ ID NO: 156359 - RNA, 64 nt, Homo Sapiens; identical to SEQ ID NO: 39306

SEQ ID NO: 156360 - RNA, 64 nt, Homo Sapiens; identical to SEQ ID NO: 39307

SEQ ID NO: 156361 - RNA, 64 nt, Homo Sapiens; identical to SEQ ID NO: 39308

SEQ ID NO: 156362 - RNA, 64 nt, Homo Sapiens; identical to SEQ ID NO: 39309

SEQ ID NO: 156363 - RNA, 64 nt, Homo Sapiens; identical to SEQ ID NO: 39310

SEQ ID NO: 156364 - RNA, 64 nt, Homo Sapiens; identical to SEQ ID NO: 39311

SEQ ID NO: 156365 - RNA, 64 nt, Homo Sapiens; identical to SEQ ID NO: 39312

SEQ ID NO: 156366 - RNA, 64 nt, Homo Sapiens; identical to SEQ ID NO: 39313

SEQ ID NO: 156367 - RNA, 64 nt, Homo Sapiens; identical to SEQ ID NO: 39314

SEQ ID NO: 156368 - RNA, 64 nt, Homo Sapiens; identical to SEQ ID NO: 39315

SEQ ID NO: 156369 - RNA, 64 nt, Homo Sapiens; identical to SEQ ID NO: 39316

SEQ ID NO: 156370 - RNA, 64 nt, Homo Sapiens; identical to SEQ ID NO: 39317

SEQ ID NO: 156371 - RNA, 64 nt, Homo Sapiens; identical to SEQ ID NO: 39318

SEQ ID NO: 156372 - RNA, 64 nt, Homo Sapiens; identical to SEQ ID NO: 39319

SEQ ID NO: 156373 - RNA, 64 nt, Homo Sapiens; identical to SEQ ID NO: 39320

SEQ ID NO: 156374 - RNA, 64 nt, Homo Sapiens; identical to SEQ ID NO: 39321

SEQ ID NO: 156375 - RNA, 64 nt, Homo Sapiens; identical to SEQ ID NO: 39322

SEQ ID NO: 156376 - RNA, 64 nt, Homo Sapiens; identical to SEQ ID NO: 39323

SEQ ID NO: 156377 - RNA, 64 nt, Homo Sapiens; identical to SEQ ID NO: 39324

SEQ ID NO: 156378 - RNA, 64 nt, Homo Sapiens; identical to SEQ ID NO: 39325

SEQ ID NO: 156379 - RNA, 64 nt, Homo Sapiens; identical to SEQ ID NO: 39326

SEQ ID NO: 156380 - RNA, 64 nt, Homo Sapiens; identical to SEQ ID NO: 39327

SEQ ID NO: 156381 - RNA, 64 nt, Homo Sapiens; identical to SEQ ID NO: 39328

SEQ ID NO: 156382 - RNA, 64 nt, Homo Sapiens; identical to SEQ ID NO: 39329

SEQ ID NO: 156383 - RNA, 64 nt, Homo Sapiens; identical to SEQ ID NO: 39330

SEQ ID NO: 156384 - RNA, 64 nt, Homo Sapiens; identical to SEQ ID NO: 39331

SEQ ID NO: 156385 - RNA, 64 nt, Homo Sapiens; identical to SEQ ID NO: 39332

SEQ ID NO: 156386 - RNA, 61 nt, Homo Sapiens; identical to SEQ ID NO: 39333

SEQ ID NO: 156387 - RNA, 64 nt, Homo Sapiens; identical to SEQ ID NO: 39334

SEQ ID NO: 156388 - RNA, 64 nt, Homo Sapiens; identical to SEQ ID NO: 39335

SEQ ID NO: 156389 - RNA, 64 nt, Homo Sapiens; identical to SEQ ID NO: 39336

SEQ ID NO: 156390 - RNA, 64 nt, Homo Sapiens; identical to SEQ ID NO: 39337

SEQ ID NO: 156391 - RNA, 64 nt, Homo Sapiens; identical to SEQ ID NO: 39338

SEQ ID NO: 156392 - RNA, 64 nt, Homo Sapiens; identical to SEQ ID NO: 39339

SEQ ID NO: 156393 - RNA, 64 nt, Homo Sapiens; identical to SEQ ID NO: 39340

SEQ ID NO: 156394 - RNA, 64 nt, Homo Sapiens; identical to SEQ ID NO: 39341

SEQ ID NO: 156395 - RNA, 64 nt, Homo Sapiens; identical to SEQ ID NO: 39342

SEQ ID NO: 156396 - RNA, 64 nt, Homo Sapiens; identical to SEQ ID NO: 39343

SEQ ID NO: 156397 - RNA, 64 nt, Homo Sapiens; identical to SEQ ID NO: 39344

SEQ ID NO: 156398 - RNA, 64 nt, Homo Sapiens; identical to SEQ ID NO: 39345

SEQ ID NO: 156399 - RNA, 64 nt, Homo Sapiens; identical to SEQ ID NO: 39346

SEQ ID NO: 156400 - RNA, 64 nt, Homo Sapiens
guaaaaguggcauuuccuggucagugguggucuucaagacgacagcucuguaucugccauguga

SEQ ID NO: 156401 - RNA, 64 nt, Homo Sapiens
ucaguagcagaccccagacuaaaaacagaaagcacaagacgaacuuucucuuaggagauuaaac

SEQ ID NO: 156402 - RNA, 64 nt, Homo Sapiens
aaaguaccuuugaauaaaacuagaagaauaggggcaagacgacauuuaaaaggacuauugauga

SEQ ID NO: 156403 - RNA, 64 nt, Homo Sapiens
gcacugaauuuugcuucaaaaaccacuuuguagucaagacgaaacccucagcuggaguuauugg

SEQ ID NO: 156404 - RNA, 64 nt, Homo Sapiens
gacacauuccccuugggcuuagcauuuuuacuugcaagacgaugucuguagcuauagcuucaga

SEQ ID NO: 156405 - RNA, 64 nt, Homo Sapiens
acaaaggccuuuggccuguguuauaaggacccugcaagacgacgaugcugucugucuuacacau

SEQ ID NO: 156406 - RNA, 64 nt, Homo Sapiens
aacugaaggcaauaauguuggcuuuuggaaggggcaagacgagaaacucugaagaaagcucuga

SEQ ID NO: 156407 - RNA, 64 nt, Homo Sapiens
uuuccauucaugugcauuuuucugccacugaccacaagacgauuuccugaguuuuguaauccuc

SEQ ID NO: 156408 - RNA, 64 nt, Homo Sapiens
gaaauaugagaaggcaaaugaggcaccagauggucaagacgaggagaauguuaaacugcauaac

SEQ ID NO: 156409 - RNA, 64 nt, Homo Sapiens
auguaggggaaaguuucaugaugguaucuauagucaagacgaacauguagcauggugccuaugu

SEQ ID NO: 156410 - RNA, 64 nt, Homo Sapiens
ugagcagcucaccauaugauagccuucagacugucaagacgacaaauguaaaaccaucuuuuaa

SEQ ID NO: 156411 - RNA, 64 nt, Homo Sapiens
acccuaaugaugagggaucuaggagagugagaaucaagacgaggcaucaauggucaguuauaug

SEQ ID NO: 156412 - RNA, 64 nt, Homo Sapiens
caaaaauauuuaacccccaaauggcauaacauuacaagacgagggacuuauuuuuaaucugacu

SEQ ID NO: 156413 - RNA, 64 nt, Homo Sapiens
agaaaauuguuuauuggggagcgauguucucccccaagacgaccauuucaacaucuccccccag

SEQ ID NO: 156414 - RNA, 64 nt, Homo Sapiens
ggcauuguccuacacauuggcccaguaucacagccaagacgagaagucauuucccagcgauguc

SEQ ID NO: 156415 - RNA, 64 nt, Homo Sapiens
ccaacccaacaacaaccagaccuugggacaccugcaagacgacuccgugggugaggccugacca

SEQ ID NO: 156416 - RNA, 64 nt, Homo Sapiens
uuggcaucugaauuguuuuaaggaucaauauugacaagacgacuaauuuauauccagguuuccc

SEQ ID NO: 156417 - RNA, 64 nt, Homo Sapiens
ggauacuuccaaacaagguauauuaucccgguuccaagacgagagcuguggccgcgccucugac

SEQ ID NO: 156418 - RNA, 64 nt, Homo Sapiens
gugaguaugguacguaacaguucuccauauucuucaagacgauuuuuuugucacucagcacuuu

SEQ ID NO: 156419 - RNA, 64 nt, Homo Sapiens
cuuauuucugaggauaagcuguaguucaacaacucaagacgaagacugcagaaaauaguguuuu

SEQ ID NO: 156420 - RNA, 64 nt, Homo Sapiens
gccgagguggguagaucgcuugagcucaggaguucaagacgagccugggcaacauggcaaaugc

SEQ ID NO: 156421 - RNA, 56 nt, Homo Sapiens
uaaaguccagaaggcaguagggaucccaagacgaccucacccaaagggcucccugg

SEQ ID NO: 156422 - RNA, 64 nt, Homo Sapiens
auacaaugguauguuauugccagggagugagguacaagacgauggcucaugucacaggccuacc

SEQ ID NO: 156423 - RNA, 64 nt, Homo Sapiens
ugcgguggcuauaauccuaguuaaaaggcuauuucaagacgaggaggcaagcugaggugaacau

SEQ ID NO: 156424 - RNA, 64 nt, Homo Sapiens
cagcuucgaagaaaagcugaaagggagacguuugcaagacgaguuguacugcugucacaggaaa

SEQ ID NO: 156425 - RNA, 64 nt, Homo Sapiens
accuaaagcccaaucuugaaaauauguugugcaccaagacgacugcuucagcuucuucucuuau

SEQ ID NO: 156426 - RNA, 64 nt, Homo Sapiens
ggcagggaaggacaggacccugccucgcucccuucaagacgaggccaacuguuucccugcugaa

SEQ ID NO: 156427 - RNA, 64 nt, Homo Sapiens
gguuguuggagcaagaggagugagauuguuggaacaagacgagagaagagcaggaagagguugc

SEQ ID NO: 156428 - RNA, 64 nt, Homo Sapiens
acaugcuggaggcugccaagggguuuucauagaacaagacgauguccgugcaaauggcugucuc

SEQ ID NO: 156429 - RNA, 64 nt, Homo Sapiens
gaauccugccaguugcauucuucccccuuggagccaagacgauuggccagacaucaccucagau

SEQ ID NO: 156430 - RNA, 64 nt, Homo Sapiens
ucccuucaacguagucauccccuggugguggaagcaagacgacggccccugacgugcagccaca

SEQ ID NO: 156431 - RNA, 64 nt, Homo Sapiens
gcuuuguccuggggacacuuucccucuggaaucucaagacgacguggcacacauuccacguggg

SEQ ID NO: 156432 - RNA, 64 nt, Homo Sapiens
gcucuuuuugucacacaggauggcaugugauccucaagacgacgaacaaugaacuaaagccaaa

SEQ ID NO: 156433 - RNA, 64 nt, Homo Sapiens
cuguaucuuaucaugauuccuguagguaaaaguacaagacgaccucuagaugucuuuucuuucu

SEQ ID NO: 156434 - RNA, 64 nt, Homo Sapiens
ccgagcucaauaaaugcgcugacggaggcaaggacaagacgaguuggugcccuucuagaugggc

SEQ ID NO: 156435 - RNA, 64 nt, Homo Sapiens
uacaacagguucugcggagacugggguuggaccccaagacgacguucaugaggaaagagaaauc

SEQ ID NO: 156436 - RNA, 64 nt, Homo Sapiens
auguggcuguugagauguggguccaucccaacagcaagacgaggcggcccggaguuguccaucu

SEQ ID NO: 156437 - RNA, 64 nt, Homo Sapiens; identical to SEQ ID NO: 95478

SEQ ID NO: 156438 - RNA, 64 nt, Homo Sapiens; identical to SEQ ID NO: 95479

SEQ ID NO: 156439 - RNA, 64 nt, Homo Sapiens; identical to SEQ ID NO: 95480

SEQ ID NO: 156440 - RNA, 64 nt, Homo Sapiens; identical to SEQ ID NO: 95481

SEQ ID NO: 156441 - RNA, 64 nt, Homo Sapiens; identical to SEQ ID NO: 95482

SEQ ID NO: 156442 - RNA, 64 nt, Homo Sapiens; identical to SEQ ID NO: 95483

SEQ ID NO: 156443 - RNA, 64 nt, Homo Sapiens; identical to SEQ ID NO: 95484

SEQ ID NO: 156444 - RNA, 64 nt, Homo Sapiens; identical to SEQ ID NO: 95485

SEQ ID NO: 156445 - RNA, 64 nt, Homo Sapiens; identical to SEQ ID NO: 95486

SEQ ID NO: 156446 - RNA, 64 nt, Homo Sapiens; identical to SEQ ID NO: 95487

SEQ ID NO: 156447 - RNA, 64 nt, Homo Sapiens; identical to SEQ ID NO: 95488

SEQ ID NO: 156448 - RNA, 64 nt, Homo Sapiens; identical to SEQ ID NO: 95489

SEQ ID NO: 156449 - RNA, 64 nt, Homo Sapiens; identical to SEQ ID NO: 95490

SEQ ID NO: 156450 - RNA, 64 nt, Homo Sapiens; identical to SEQ ID NO: 95491

SEQ ID NO: 156451 - RNA, 64 nt, Homo Sapiens; identical to SEQ ID NO: 95492

SEQ ID NO: 156452 - RNA, 64 nt, Homo Sapiens; identical to SEQ ID NO: 95493

SEQ ID NO: 156453 - RNA, 64 nt, Homo Sapiens; identical to SEQ ID NO: 95494

SEQ ID NO: 156454 - RNA, 64 nt, Homo Sapiens; identical to SEQ ID NO: 95495

SEQ ID NO: 156455 - RNA, 64 nt, Homo Sapiens; identical to SEQ ID NO: 95496

SEQ ID NO: 156456 - RNA, 64 nt, Homo Sapiens; identical to SEQ ID NO: 95497

SEQ ID NO: 156457 - RNA, 64 nt, Homo Sapiens; identical to SEQ ID NO: 95498

SEQ ID NO: 156458 - RNA, 64 nt, Homo Sapiens; identical to SEQ ID NO: 95499

SEQ ID NO: 156459 - RNA, 64 nt, Homo Sapiens; identical to SEQ ID NO: 95500

SEQ ID NO: 156460 - RNA, 64 nt, Homo Sapiens; identical to SEQ ID NO: 95501

SEQ ID NO: 156461 - RNA, 64 nt, Homo Sapiens; identical to SEQ ID NO: 95502

SEQ ID NO: 156462 - RNA, 64 nt, Homo Sapiens; identical to SEQ ID NO: 95503

SEQ ID NO: 156463 - RNA, 64 nt, Homo Sapiens; identical to SEQ ID NO: 95504

SEQ ID NO: 156464 - RNA, 64 nt, Homo Sapiens; identical to SEQ ID NO: 95505

SEQ ID NO: 156465 - RNA, 64 nt, Homo Sapiens; identical to SEQ ID NO: 95506

SEQ ID NO: 156466 - RNA, 64 nt, Homo Sapiens; identical to SEQ ID NO: 95507

SEQ ID NO: 156467 - RNA, 64 nt, Homo Sapiens; identical to SEQ ID NO: 95508

SEQ ID NO: 156468 - RNA, 64 nt, Homo Sapiens; identical to SEQ ID NO: 95509

SEQ ID NO: 156469 - RNA, 64 nt, Homo Sapiens; identical to SEQ ID NO: 95510

SEQ ID NO: 156470 - RNA, 64 nt, Homo Sapiens; identical to SEQ ID NO: 95511

SEQ ID NO: 156471 - RNA, 64 nt, Homo Sapiens; identical to SEQ ID NO: 95512

SEQ ID NO: 156472 - RNA, 64 nt, Homo Sapiens; identical to SEQ ID NO: 95513

SEQ ID NO: 156473 - RNA, 64 nt, Homo Sapiens; identical to SEQ ID NO: 95514

SEQ ID NO: 156474 - RNA, 64 nt, Homo Sapiens; identical to SEQ ID NO: 95515

SEQ ID NO: 156475 - RNA, 64 nt, Homo Sapiens; identical to SEQ ID NO: 95516

SEQ ID NO: 156476 - RNA, 64 nt, Homo Sapiens; identical to SEQ ID NO: 95517

SEQ ID NO: 156477 - RNA, 64 nt, Homo Sapiens; identical to SEQ ID NO: 95518

SEQ ID NO: 156478 - RNA, 64 nt, Homo Sapiens; identical to SEQ ID NO: 95519

SEQ ID NO: 156479 - RNA, 64 nt, Homo Sapiens; identical to SEQ ID NO: 95520

SEQ ID NO: 156480 - RNA, 64 nt, Homo Sapiens; identical to SEQ ID NO: 95521

SEQ ID NO: 156481 - RNA, 64 nt, Homo Sapiens; identical to SEQ ID NO: 95522

SEQ ID NO: 156482 - RNA, 64 nt, Homo Sapiens; identical to SEQ ID NO: 95523

SEQ ID NO: 156483 - RNA, 64 nt, Homo Sapiens; identical to SEQ ID NO: 95524

SEQ ID NO: 156484 - RNA, 64 nt, Homo Sapiens; identical to SEQ ID NO: 95525

SEQ ID NO: 156485 - RNA, 63 nt, Homo Sapiens
gucaguuacaacuugucuguacgaggacauaguggucaccacugggguagcaaaaauaaaguc

SEQ ID NO: 156486 - RNA, 63 nt, Homo Sapiens
caggguggcuccccagguccgccgaggacgaguggucaccaaaaaagcccuuguguugaaaag

SEQ ID NO: 156487 - RNA, 63 nt, Homo Sapiens
aucgcccgaucacagacgagaucacagacgagcggucaccagagcagucaucggacucacccg

SEQ ID NO: 156488 - RNA, 63 nt, Homo Sapiens
cucgcccgaucacagacgagaucacagacgagcggucaccagagcagucaucggacucacccg

SEQ ID NO: 156489 - RNA, 63 nt, Homo Sapiens
gaacaagucauucugaaaggucccucugacccaggucaccaaauuugggccagaacuggcacu

SEQ ID NO: 156490 - RNA, 63 nt, Homo Sapiens
uuacggacuucccggccgccacugggcccugccggucaccaggccacugugcagugggcgcag

SEQ ID NO: 156491 - RNA, 63 nt, Homo Sapiens
aggcuguuuacaaagcagaacuugggugcugugggucaccaacauucucccaaacuaaugauu

SEQ ID NO: 156492 - RNA, 63 nt, Homo Sapiens
acaauuaauuguaauuaaggugaggagaaugauggucaccacccuucuuucucucuuuuucuu

SEQ ID NO: 156493 - RNA, 63 nt, Homo Sapiens
gaaaguuccuuuccccaguuugguuaaguauagggucaccagauaagaugauugaagcuuuac

SEQ ID NO: 156494 - RNA, 63 nt, Homo Sapiens
aaaccuguucuuuaaucaagcuuggcucccucaggucaccaaugugagggucacaaaggagac

SEQ ID NO: 156495 - RNA, 64 nt, Homo Sapiens
ccccuaagaccacaguggccaagaucacaguggccacggccacggccacagucaugguggccac

SEQ ID NO: 156496 - RNA, 64 nt, Homo Sapiens
agaccacaguggccaagaucacaguggccacggccacggccacagucaugguggccacggccac

SEQ ID NO: 156497 - RNA, 64 nt, Homo Sapiens
caguggccacggccacggccacagucaugguggccacggccacagccacuaaucaggaggccag

SEQ ID NO: 156498 - RNA, 64 nt, Homo Sapiens
gccuaggggugccaaguccagggaucugaugggacacggccagucuccaggccgaccagcacuu

SEQ ID NO: 156499 - RNA, 64 nt, Homo Sapiens
ucaggucagccagccugaggggcacaggcccugccacggccaacgccccaggcaggcuagagga

SEQ ID NO: 156500 - RNA, 64 nt, Homo Sapiens
accuccuccccucaaggcaucgacaucaggaacccacggccacccucaccuucagcuccugcac

SEQ ID NO: 156501 - RNA, 64 nt, Homo Sapiens
auaaauugguacuguuuguuaaaaagcaaaaacccacggccaaacacaaagucaucaacuggaa

SEQ ID NO: 156502 - RNA, 64 nt, Homo Sapiens
accgacucaccacagcccuuggucaccucgcccacacggccagcagcaggcccugucaccgacg

SEQ ID NO: 156503 - RNA, 64 nt, Homo Sapiens
ccacgcagaacgaacaugacccaguccccacagucacggccaagccuuucuguccgugggcagc

SEQ ID NO: 156504 - RNA, 64 nt, Homo Sapiens
cacgcacacacgcacacacacacacguacacacacauacaaaaucccucugcaguuuuggggag

SEQ ID NO: 156505 - RNA, 64 nt, Homo Sapiens
ucuuugggacugauucucaguggagggcuuagaucauacaaaaaucuuuauuggguccgugugu

SEQ ID NO: 156506 - RNA, 64 nt, Homo Sapiens
aagccgccugacgaucuaauuguaaaaaguaaagcauacaaauacuagaagaaaauggaggaaa

SEQ ID NO: 156507 - RNA, 64 nt, Homo Sapiens
uguauugacaggauuccaauaauuaagaauacuucauacaaaaagaaauguaaaugaccuuuaa

SEQ ID NO: 156508 - RNA, 64 nt, Homo Sapiens
acaaacaguugcuaccaaagauucuucaaauaaacauacaaauaaauguguauauuuaauguuu

SEQ ID NO: 156509 - RNA, 64 nt, Homo Sapiens
ccuuaaagauuggaguauuuuauaauucaaggagcauacaaaacaaugguugggaacauaugcc

SEQ ID NO: 156510 - RNA, 64 nt, Homo Sapiens
uuauguuaaagaauuacuucguacuguacuucuacauacaaaugcuguacuucuacauacaaau

SEQ ID NO: 156511 - RNA, 64 nt, Homo Sapiens
uacuguacuucuacauacaaauacuguacuucuacauacaaauguuguaaauucuuaucucugu

SEQ ID NO: 156512 - RNA, 64 nt, Homo Sapiens
uaggcuaucuuggcacacuauacauauauacauacauacaaacaaacacacacagagauaucua

SEQ ID NO: 156513 - RNA, 64 nt, Homo Sapiens
agagcugagccaccuuugcucaaagcagacccagcauacaaacacuucaccagcucuucagguu

SEQ ID NO: 156514 - RNA, 64 nt, Homo Sapiens
caauacuauuuugugacuaacuuacaacuaugugcauacaaaagauugacaaaagcaaaguaau

SEQ ID NO: 156515 - RNA, 64 nt, Homo Sapiens
ccacaacaaagcgcaguggucuccaccccucccccauacaaaauccuguugaaaaaaacugguu

SEQ ID NO: 156516 - RNA, 64 nt, Homo Sapiens
ucuuccaaaagagagaggaguuucagccuuuguacauacaaaauuaaaucuacccaaugagacu

SEQ ID NO: 156517 - RNA, 64 nt, Homo Sapiens
caugcaaacauaccuacacaagcacuugcacauacauacaaacauacucacaaacacacacaca

SEQ ID NO: 156518 - RNA, 64 nt, Homo Sapiens
gguaugguuguuuuuguuuuccucccucuccucuggcugcuacaacuuccccuuucugguacaa

SEQ ID NO: 156519 - RNA, 64 nt, Homo Sapiens
aacucaagcaggcauuuuuuuuuucuuaccgaaaggcugcuauugugcaagggcacauaauggg

SEQ ID NO: 156520 - RNA, 64 nt, Homo Sapiens
uuugccuuagcacaggguuucuguagggagugggggcugcuagaggggauuaguuccggagacu

SEQ ID NO: 156521 - RNA, 64 nt, Homo Sapiens
cuggaggaacucugguugcagggcuaaacuuagaggcugcuagaguguagugguuaagaacagg

SEQ ID NO: 156522 - RNA, 64 nt, Homo Sapiens
cacacaaggcagcgucgggugacacucacccccacccacgcacacaggggaaaagagaguuaag

SEQ ID NO: 156523 - RNA, 64 nt, Homo Sapiens
ccugaucgcaggaggccuggcaccugagauggaccccacgcagcgccggcaucaccugcggcca

SEQ ID NO: 156524 - RNA, 64 nt, Homo Sapiens; identical to SEQ ID NO: 123292

SEQ ID NO: 156525 - RNA, 64 nt, Homo Sapiens; identical to SEQ ID NO: 123293

SEQ ID NO: 156526 - RNA, 64 nt, Homo Sapiens; identical to SEQ ID NO: 123294

SEQ ID NO: 156527 - RNA, 64 nt, Homo Sapiens; identical to SEQ ID NO: 123295

SEQ ID NO: 156528 - RNA, 64 nt, Homo Sapiens; identical to SEQ ID NO: 123296

SEQ ID NO: 156529 - RNA, 64 nt, Homo Sapiens; identical to SEQ ID NO: 123297

SEQ ID NO: 156530 - RNA, 64 nt, Homo Sapiens; identical to SEQ ID NO: 123298

SEQ ID NO: 156531 - RNA, 64 nt, Homo Sapiens; identical to SEQ ID NO: 123299

SEQ ID NO: 156532 - RNA, 64 nt, Homo Sapiens; identical to SEQ ID NO: 123300

SEQ ID NO: 156533 - RNA, 64 nt, Homo Sapiens; identical to SEQ ID NO: 123301

SEQ ID NO: 156534 - RNA, 64 nt, Homo Sapiens; identical to SEQ ID NO: 123302

SEQ ID NO: 156535 - RNA, 64 nt, Homo Sapiens; identical to SEQ ID NO: 123303

SEQ ID NO: 156536 - RNA, 64 nt, Homo Sapiens; identical to SEQ ID NO: 123304

SEQ ID NO: 156537 - RNA, 64 nt, Homo Sapiens; identical to SEQ ID NO: 123305

SEQ ID NO: 156538 - RNA, 64 nt, Homo Sapiens; identical to SEQ ID NO: 123306

SEQ ID NO: 156539 - RNA, 64 nt, Homo Sapiens; identical to SEQ ID NO: 123307

SEQ ID NO: 156540 - RNA, 64 nt, Homo Sapiens
agaucccacugagaaaauccacccuggcaucugggcuccugaucagcugauggagcuccugauu

SEQ ID NO: 156541 - RNA, 64 nt, Homo Sapiens
acccuggcaucugggcuccugaucagcugauggagcuccugauuugacaaaggagcuugccucc

SEQ ID NO: 156542 - RNA, 64 nt, Homo Sapiens
gacucaggaaaaugccaacacagagcacaaauaugcuccugacgagccagcucuaaacaacaca

SEQ ID NO: 156543 - RNA, 64 nt, Homo Sapiens
ccugcugcccaagagagccuggucugcccuccgugcuccugaccgagaugccugguccgucuug

SEQ ID NO: 156544 - RNA, 64 nt, Homo Sapiens
ggccuccuuuuccuuugacuaugccaugaugugggcuccugacuuugagugucccaaaacacug

SEQ ID NO: 156545 - RNA, 64 nt, Homo Sapiens
guguggagaaaccaacaggcugaguuggucaaaugcuccugacauaagggacccugagccacag

SEQ ID NO: 156546 - RNA, 64 nt, Homo Sapiens
gaguacuggguacauaacgaaaacaggacaagcugcuccugaauaaaaccgcucaacugcaugg

SEQ ID NO: 156547 - RNA, 64 nt, Homo Sapiens
ucgguuucuugaugucuuuugguucuccuugccugcuccugaugcuuggaccccuuuuauugau

SEQ ID NO: 156548 - RNA, 64 nt, Homo Sapiens
uauuaaaauagaaacagggauugauuaaugucccgcuccugaauacauguaaaauuuguacaaa

SEQ ID NO: 156549 - RNA, 64 nt, Homo Sapiens
cucuggacgaggccuccuuccucagguuccuccugcuccugaccucccagugugauguccgggu

SEQ ID NO: 156550 - RNA, 64 nt, Homo Sapiens
cagugaacuauuccucagugggaucgguucuucagcuccugaugggggcuguguaaugggggca

SEQ ID NO: 156551 - RNA, 64 nt, Homo Sapiens
gagauuuugucaccaccaggccugcccuaaaagagcuccugaaggaagcacuaaacauggaaag

SEQ ID NO: 156552 - RNA, 64 nt, Homo Sapiens
aaaaccgcucaacuacuuggaaacugaacaaccugcuccugaaugacuacuggguacauaacga

SEQ ID NO: 156553 - RNA, 64 nt, Homo Sapiens
ucaagcuuccaaaagugcccugaagcuccccaaggcuccugaggggugcccaagggaccugaag

SEQ ID NO: 156554 - RNA, 64 nt, Homo Sapiens
uuguagagagcaagcugaagagccccggcccgcugcuccugaagcuuugggcuuucccucuugg

SEQ ID NO: 156555 - RNA, 64 nt, Homo Sapiens
uggaguccauucuucuuuagggcaguauaugaaauccuagcagauguaaaauggaaaagaaucc

SEQ ID NO: 156556 - RNA, 64 nt, Homo Sapiens
augcaauauacugugaugccuuccuacucaagccuccuagcauucaaacuuccauccuauuagu

SEQ ID NO: 156557 - RNA, 64 nt, Homo Sapiens
cacugaccuagacauguccagaugggagucccauuccuagcagacaagcugagcaccguuguaa

SEQ ID NO: 156558 - RNA, 64 nt, Homo Sapiens
uguuuaggccgguugcgguggcucaugccuguaauccuagcacuuugggaggcugaggugggug

SEQ ID NO: 156559 - RNA, 64 nt, Homo Sapiens
uuggauuaggagaacagguguuccuccuccccucuccuagcagcccuaaugucugaccuagccu

SEQ ID NO: 156560 - RNA, 64 nt, Homo Sapiens
aaagguaacuucucccuucuccugaccuacuuccuccuagcaaccaacuuuaccucuucuucuc

SEQ ID NO: 156561 - RNA, 64 nt, Homo Sapiens
uugggaggccaaggcagguggcucacaccuguaauccuagcacuuauucuggcugggcacagug

SEQ ID NO: 156562 - RNA, 64 nt, Homo Sapiens
uugggaagacaaugugggaggcucaugccugaaauccuagcacuacuucaggcugggcacagug

SEQ ID NO: 156563 - RNA, 64 nt, Homo Sapiens
cauaucccaagagccauuuauagcaacaacauuguccuagcaacugugauccuuggaauuaucc

SEQ ID NO: 156564 - RNA, 64 nt, Homo Sapiens
aacauuguccuagcaaccaugauccuuggaauuauccuagcaacuguguaauuguuuugcuugu

SEQ ID NO: 156565 - RNA, 64 nt, Homo Sapiens
ucggggcugaggugggaggagcucaugccuguaauccuagcaacgacaguugcuggguguagug

SEQ ID NO: 156566 - RNA, 64 nt, Homo Sapiens
uugggaggccgaggcagguggcucacgccuguaauccuagcacuaaugcaggcugggcgcggug

SEQ ID NO: 156567 - RNA, 64 nt, Homo Sapiens
ugaggacggguacuccagcuccaggccuggagaggcuucccagcaacaccugcaguccagcccc

SEQ ID NO: 156568 - RNA, 64 nt, Homo Sapiens
agggcaggggucagaggcccaggcccugacuucggcuucccagagaucucuccgccuuaguuaa

SEQ ID NO: 156569 - RNA, 64 nt, Homo Sapiens
aacuccugaccucaggcgauccacccccaccucggcuucccaaagugcugagauuacaggugug

SEQ ID NO: 156570 - RNA, 64 nt, Homo Sapiens
gggagucaaagaaacugagccuggggcaaacgaggcuucccacacugccaggggagccucacug

SEQ ID NO: 156571 - RNA, 64 nt, Homo Sapiens
ucagaacauauacugaauggccuauuuuccugcugcuucccagcuaggaucauaggaaaggggc

SEQ ID NO: 156572 - RNA, 64 nt, Homo Sapiens
guuuugccaaucuaaaggcauugcucauacuucugcuucccagacuuucagggacaggaaucua

SEQ ID NO: 156573 - RNA, 64 nt, Homo Sapiens
ggaggaaccaacugcuccacgcaaugggaacccugcuucccaggggucucuccgccuucaccua

SEQ ID NO: 156574 - RNA, 64 nt, Homo Sapiens
aaacucaagagccuccguacgcaaggacuacugggcuucccaagcugaugcugcugcugccuuu

SEQ ID NO: 156575 - RNA, 64 nt, Homo Sapiens
cucgaucuccugaccucacgauuugcccgccucggcuucccagagugcugggauuacaggcgug

SEQ ID NO: 156576 - RNA, 64 nt, Homo Sapiens
caaacuccuggggucaaaugauccgccugcgucggcuucccagagugcugggauuacagguguc

SEQ ID NO: 156577 - RNA, 64 nt, Homo Sapiens
gggcugcuuugagcaaugacgcuggcccagagcagcuucccacaugaccccagagccgaggguc

SEQ ID NO: 156578 - RNA, 64 nt, Homo Sapiens
cuuagcuuucuaggccacugggaguuguggcugggcuucccaucuuccacagagacaucucccu

SEQ ID NO: 156579 - RNA, 64 nt, Homo Sapiens
ugugaaaguggcugguugggagcagagcuaaguggcuucccauuaaccugaggucucuuucuuu

SEQ ID NO: 156580 - RNA, 64 nt, Homo Sapiens
ccgguacacagccaguagccaagaguugaagacagcuucccauguguucuggcgugaguuguga

SEQ ID NO: 156581 - RNA, 64 nt, Homo Sapiens
aacagccccccugcugcugcuggcaaaaccaguagcuucccaaauaugugauucuggaagcaaa

SEQ ID NO: 156582 - RNA, 64 nt, Homo Sapiens
ggacgggugugcuaaggguuucagcuuaggcucugcuucccagucaccagcccaguggccgggg

SEQ ID NO: 156583 - RNA, 64 nt, Homo Sapiens
aacugagggauuuguuuccuauagauaaauuuuagcuucccaguuucuccaagucacuuacauc

SEQ ID NO: 156584 - RNA, 64 nt, Homo Sapiens
gugaaagggaaacugaacuugcuuacuuugcagagcuucccaaauuuuugcuuugcuaguuaaa

SEQ ID NO: 156585 - RNA, 64 nt, Homo Sapiens
uaaagaugcacguuagaugauccuucaagcaucagcuucccaucaaaggaaaacugaaacccag

SEQ ID NO: 156586 - RNA, 64 nt, Homo Sapiens
aagaauccaggagcaagcuuagacgugggaggcugcuucccaguauuccccucaccccagccca

SEQ ID NO: 156587 - RNA, 64 nt, Homo Sapiens
gcuggccaagagagaagacucagcacccugccccgcuucccagguuaccugggggaaccucacc

SEQ ID NO: 156588 - RNA, 64 nt, Homo Sapiens
ugagcucccaagaccaggacgcuguauccuuucggcuucccagucuggggcauauaaaaucucu

SEQ ID NO: 156589 - RNA, 64 nt, Homo Sapiens
ugagcucccaagaccaggacgcuguguccuuucggcuucccagugagggggccugcccuucucu

SEQ ID NO: 156590 - RNA, 64 nt, Homo Sapiens
uuaccuuuuagauucuuuugacucucuuucuaaugcuucccaccccuuuuuuauuuuucuuuuc

SEQ ID NO: 156591 - RNA, 64 nt, Homo Sapiens
uuucacuggggagagaacagggagugcuccuccagcuucccaaagaaauauguuuuuguaagug

SEQ ID NO: 156592 - RNA, 64 nt, Homo Sapiens
cccccugugccagagcacagccucaccggaugcugcuucccacacugaaguguccuguccgacc

SEQ ID NO: 156593 - RNA, 64 nt, Homo Sapiens
cugugccgauuagagccagcuggccagguggagagcuucccaagcagaaacagaaagacagcag

SEQ ID NO: 156594 - RNA, 64 nt, Homo Sapiens
gagggucuggccuugcccaaaaaaucuccuuucugcuucccagaucugcccaggaggcagggga

SEQ ID NO: 156595 - RNA, 64 nt, Homo Sapiens
gugacugggcuaugggauucaggguaggggaucugcuucccacucccuucaagaugccauuugg

SEQ ID NO: 156596 - RNA, 64 nt, Homo Sapiens
gauuuuaagcauuuuguaaauuuagcuuccucuugcuucccaaaaguuaacaugggaccuucug

SEQ ID NO: 156597 - RNA, 64 nt, Homo Sapiens
aucagccccucccacuugaggacucucuucuagggcuucccaccgaggaggccgcuucauccca

SEQ ID NO: 156598 - RNA, 64 nt, Homo Sapiens
augucagggaaggggagggcucggguugacgguggcuucccacugagcaccagcauccaggugc

SEQ ID NO: 156599 - RNA, 64 nt, Homo Sapiens
aucuuccagaagcccagcuccacccgcacacgcagcuucccauccaguccuucaacucaauucu

SEQ ID NO: 156600 - RNA, 64 nt, Homo Sapiens
guccaggaggugggcgcccuccauccuucgagaagcuucccaggcuccucugcuucucugucuc

SEQ ID NO: 156601 - RNA, 64 nt, Homo Sapiens
cuggcccuggagcugcagaagcagcuucugaggggcuucccaggccugcauuucacagaugggg

SEQ ID NO: 156602 - RNA, 64 nt, Homo Sapiens
ggcggcccaggaggcugaagacaggugcacagaugcuucccacgaccuugccauuugggguggg

SEQ ID NO: 156603 - RNA, 64 nt, Homo Sapiens
ccccaacaggucucucuuguuggccagagggccugcuucccaugggcauugcaagugccaccgu

SEQ ID NO: 156604 - RNA, 64 nt, Homo Sapiens
cccucaggauggcgccuucaagcacggagcuccggcuucccaaauuccagcagcuggcaccugc

SEQ ID NO: 156605 - RNA, 64 nt, Homo Sapiens
ggggaacaaggccuggaugacagagaggaaacaagcuucccacgugccucgcuuagauccagga

SEQ ID NO: 156606 - RNA, 64 nt, Homo Sapiens
uucagguccaaauucaccuuccccuaaaccccaagcuucccaacagaucauaugguaggacccu

SEQ ID NO: 156607 - RNA, 64 nt, Homo Sapiens
cauuacccuacagacagcuuacaggagccagccugcuucccacaacuacuagugugacuccuua

SEQ ID NO: 156608 - RNA, 64 nt, Homo Sapiens
augcucagaaacagaaucaggugggaguacugcaaccugacacaacaacugauccgugugugag

SEQ ID NO: 156609 - RNA, 64 nt, Homo Sapiens
augcucagacacagaagggaaugggaguacugcaaccugacacgacgauggaucccaaagucag

SEQ ID NO: 156610 - RNA, 64 nt, Homo Sapiens
augcucagacaagaauaggggugggaguacugcaaccugacaggacaacggaucccaaagucag

SEQ ID NO: 156611 - RNA, 64 nt, Homo Sapiens
gagaaauacaagaugagccugaaucaucucauguaccugacaguaagaaaauacucuggcuggu

SEQ ID NO: 156612 - RNA, 64 nt, Homo Sapiens
ggacauuggagugggcaaagauuucuuguguaauaccugacaaacaggcaaccaaagcaaaagu

SEQ ID NO: 156613 - RNA, 64 nt, Homo Sapiens
accuuaccuggcucugagaagcuggggccaguggaccugacagucuuuuuagggcgugugcagg

SEQ ID NO: 156614 - RNA, 64 nt, Homo Sapiens
uuggcagaaguagaauauuaauugugagcuuccuaccugacauguguaauggcuuauggggaac

SEQ ID NO: 156615 - RNA, 64 nt, Homo Sapiens
ucccucagccucccaaguagcugggauuacaggcacccacgagcaugcccggcuaauuuuuugu

SEQ ID NO: 156616 - RNA, 64 nt, Homo Sapiens
acuaaaaaggggaggaaggcagaccuccugggagacccacgaaggguuuuuagccagggaaaac

SEQ ID NO: 156617 - RNA, 64 nt, Homo Sapiens
aaaucaacaaccuguaucugauuacuagcuugcuacccacgauggagaaagcacuuugaaauuu

SEQ ID NO: 156618 - RNA, 64 nt, Homo Sapiens
agucugaggcugugaauaguaaaaaaaaacaacaacccacgaggaaaucacauacauacauuua

SEQ ID NO: 156619 - RNA, 64 nt, Homo Sapiens
ugucaccuccaaugacuagggugggcaaccacaaacccacgagggcagagugcugcuugcugcu

SEQ ID NO: 156620 - RNA, 64 nt, Homo Sapiens
guauuuuugaauaauuaccaagcagccgaagaccacccacgaaugguuaucuuacgacuguuac

SEQ ID NO: 156621 - RNA, 64 nt, Homo Sapiens
uggguaugaagaugcuucagagcucaugcgcguuacccacgauggcaugacuagcacagagcug

SEQ ID NO: 156622 - RNA, 64 nt, Homo Sapiens
caggccaagguucaauuauuucagcgcagguaucacccacgagaaauuuuuccagaguuucaca

SEQ ID NO: 156623 - RNA, 64 nt, Homo Sapiens
auaucauugucagaccauuuuugcugcuguggucacccacgauuucauuugucuuauacccagg

SEQ ID NO: 156624 - RNA, 64 nt, Homo Sapiens
aaauggugaggcgaggggcuugagaggaacgcccacccacgaaggcccagggcgccagacggcc

SEQ ID NO: 156625 - RNA, 64 nt, Homo Sapiens
uauuaguguggguauggcuaaugaguucugauucacccacgaagguuacauuuaugcugaauac

SEQ ID NO: 156626 - RNA, 64 nt, Homo Sapiens
agggcugcgucgguuugugguaagcagcucuuggacccacgagcagcaugggugcccccagaag

SEQ ID NO: 156627 - RNA, 64 nt, Homo Sapiens
ggcaaaucuccacgcuagaccaagccuugaggacacccacgaauauggaguucuucaugucugu

SEQ ID NO: 156628 - RNA, 64 nt, Homo Sapiens
auaaucagaucaaacaccugcuccuuauugccauacccacgaacuguuaaauauaaaaaaauuc

SEQ ID NO: 156629 - RNA, 64 nt, Homo Sapiens
gugacugaaacauucacacagggcucuuugauggacccacgaacgcucuuagcuuucucagggg

SEQ ID NO: 156630 - RNA, 64 nt, Homo Sapiens
guuuuucuggcauuuucuguuccagguuucuuccacccacgagcacuuuauucuccuccgagac

SEQ ID NO: 156631 - RNA, 64 nt, Homo Sapiens
gaacuuuauucccuuauauuugaggcuaaaugucacccacgaaaaguuacauuccucuccacaa

SEQ ID NO: 156632 - RNA, 64 nt, Homo Sapiens
accuccggggguauccugggggaccucuuucacuacccacgaugagggacaugggaagaccacg

SEQ ID NO: 156633 - RNA, 64 nt, Homo Sapiens
gcccccgugauucaauuaccucccacuuggucccacccacgacacgugggaauugugggagcua

SEQ ID NO: 156634 - RNA, 64 nt, Homo Sapiens
augcccacggccuccuccuguagcuccugccugcacccacgaugcugcacgggcccgcccuggu

SEQ ID NO: 156635 - RNA, 64 nt, Homo Sapiens
gcaggcuuggggagcuuuaagccucaguuauauaacccacgaaaaacagagccuccuagaugua

SEQ ID NO: 156636 - RNA, 58 nt, Homo Sapiens
auguccucugacuuccagccgcccacgaacccacgagaugaggucauuuguacccuag

SEQ ID NO: 156637 - RNA, 64 nt, Homo Sapiens
augaaacguguaucguaaaauguauuuuuauuuuacccacgagaauguuguuauuuuuagcaaa

SEQ ID NO: 156638 - RNA, 64 nt, Homo Sapiens
cuggcucccccagcucaccguggugcuguccuugacccacgagcuguugagaagggugcagagc

SEQ ID NO: 156639 - RNA, 64 nt, Homo Sapiens
accagugcuuccuucgucagcagcgccuccccagacccacgaggauacucacacugcacgccug

SEQ ID NO: 156640 - RNA, 64 nt, Homo Sapiens
uguccugucuuugaucgccucuucccagggagaaacccacgaccgagggaaagggagggaugac

SEQ ID NO: 156641 - RNA, 64 nt, Homo Sapiens
uucuuugggcuuccauuuccuccuugcagaggccacccacgaucuggcccauugccccuggcac

SEQ ID NO: 156642 - RNA, 64 nt, Homo Sapiens
aguucuccagaaucccaggcgaugacaagucugaacccacgaaaauacccagcgcagcaucuac

SEQ ID NO: 156643 - RNA, 64 nt, Homo Sapiens
cggaccccccucgaagcccccuggacugauucccacccacgacucacaggcauuccucccacag

SEQ ID NO: 156644 - RNA, 64 nt, Homo Sapiens
ccuuucgaguagaugugggaaagcccaaagggaaacccacgauuggacugauucccaggaagaa

SEQ ID NO: 156645 - RNA, 64 nt, Homo Sapiens
auuccuggacuugucuuuugccaugaggaagagaacccacgaacaaguggcuuccaauuuuugg

SEQ ID NO: 156646 - RNA, 64 nt, Homo Sapiens
gccucccggccuagggcccggccggccucgggccacccacgaggauggcccugccugagcccgg

SEQ ID NO: 156647 - RNA, 64 nt, Homo Sapiens
cggcugccagcccugaggccaagcacggcuggagacccacgaccuggccugccguugcccugag

SEQ ID NO: 156648 - RNA, 64 nt, Homo Sapiens
uucuccagcucagaacccagacagucuguaucaaacccacgauucuagguucccggucccgagu

SEQ ID NO: 156649 - RNA, 64 nt, Homo Sapiens
ggaauauaaggggguagugggaaaagugguacuaacccacgauucugagcccugaguaugccug

SEQ ID NO: 156650 - RNA, 64 nt, Homo Sapiens
gcgccuucgggacgccggggacucugcggcggcgacccacgagcucgcggcccgcgcccggcuc

SEQ ID NO: 156651 - RNA, 64 nt, Homo Sapiens
gcugccgagguguggagggcccugguugaggaggacccacgaguucaucuguuucucguguccg

SEQ ID NO: 156652 - RNA, 64 nt, Homo Sapiens
uauuuuguuauugaugauuugaaaauauuuuuucacccacgauuucauguguccagagaucuug

SEQ ID NO: 156653 - RNA, 64 nt, Homo Sapiens
uggaggugcccuaccugcauccugcugcacccccacccacgacacucgagugcaagaucgccuc

SEQ ID NO: 156654 - RNA, 64 nt, Homo Sapiens
cuuugaguacuaccggggcuucacacucuuccagacccacgaaaaccgagagcaccuggugaug

SEQ ID NO: 156655 - RNA, 64 nt, Homo Sapiens
ccucuacaccuucugccaccaccugcaccugccuacccacgacaaggagacagaggagcuggua

SEQ ID NO: 156656 - RNA, 64 nt, Homo Sapiens
gguuguuucuguuucugaguggaccaacagcagaacccacgaggauuuguuuugaguauggagc

SEQ ID NO: 156657 - RNA, 64 nt, Homo Sapiens
cuggguggccagcagucuggaacaaaugaggcucacccacgagggaaagcaggacgcagagaag

SEQ ID NO: 156658 - RNA, 64 nt, Homo Sapiens
ucccugaaagacugaagaaaguguagugcaugggacccacgaaacugcccuggcuccagugaaa

SEQ ID NO: 156659 - RNA, 64 nt, Homo Sapiens
auggccuggaacccaugucagagcacgagcuggaacccacgagggaggacacaguggagcccac

SEQ ID NO: 156660 - RNA, 64 nt, Homo Sapiens
cucccccccagcacaacccccccaaaacaacccaacccacgaggaccaucgggggcagagucgu

SEQ ID NO: 156661 - RNA, 64 nt, Homo Sapiens
aaguuacacagcuuuauuggcugcgcccagccacacccacgaucccccacauccccucagaacg

SEQ ID NO: 156662 - RNA, 64 nt, Homo Sapiens
cugccacuguuuuugcugugccaagauccacaucacccacgaccaagugccuuccaagcuuccc

SEQ ID NO: 156663 - RNA, 54 nt, Homo Sapiens
aggaaccaggcuacuuuccccuggacccacgaggccagccagcaguccaaguag

SEQ ID NO: 156664 - RNA, 64 nt, Homo Sapiens
ggggugagagaagugugcaaccagcccuucuaagacccacgagcucuuggaacuuuaacuccug

SEQ ID NO: 156665 - RNA, 64 nt, Homo Sapiens
uagguagggacacguguccacgcaccacagacacacccacgacaccugaucucguaucacuagc

SEQ ID NO: 156666 - RNA, 64 nt, Homo Sapiens
uccugccuccacgcccacccagcgucgacccuugacccacgaagugcguagcaugcaguauuua

SEQ ID NO: 156667 - RNA, 64 nt, Homo Sapiens
cacuuccacaccgucuucccuccccaacccccaaacccacgacuggcccggcccggaacuuuuc

SEQ ID NO: 156668 - RNA, 64 nt, Homo Sapiens
uggaugccgcgagggacggacacacguccggggcacccacgaggagggcccccagccugggaga

SEQ ID NO: 156669 - RNA, 64 nt, Homo Sapiens
uagucuguaguuaaugucaacaguuaauuuaugaacccacgaucguuccacacugcaccaaagu

SEQ ID NO: 156670 - RNA, 64 nt, Homo Sapiens
agggucucagggacuccuccuuuuuaaucugcagacccacgaaagguguuauuauacaaaauaa

SEQ ID NO: 156671 - RNA, 64 nt, Homo Sapiens
gccucccgaagugccaagagugcagccucugcccggccgccaccccgucugggaagugaggagc

SEQ ID NO: 156672 - RNA, 64 nt, Homo Sapiens
ugcccagucuggaaagugaggagcgucucugcccggccgccaucccaucuaggaagugaggagc

SEQ ID NO: 156673 - RNA, 64 nt, Homo Sapiens
ccccuuccccaggcccaccaucaccaccgccucuggccgccacccccaucuuccaccugugccc

SEQ ID NO: 156674 - RNA, 64 nt, Homo Sapiens
cacuuauuguccaggugaggcccaagagcccuguggccgccaccugaggugggcuggggcugcu

SEQ ID NO: 156675 - RNA, 64 nt, Homo Sapiens
gccucccaaagugccgagauugcagccucugcccggccgccaccccgucuggaaagugaggagc

SEQ ID NO: 156676 - RNA, 64 nt, Homo Sapiens
caccccgucuggaaagugaggagcgccucugcccggccgccaucccaucuaggaagugaggagc

SEQ ID NO: 156677 - RNA, 64 nt, Homo Sapiens
ggccuugccacuccagugaaagcuguucuucucuuagacacaauuucuucaucuggacgagcag

SEQ ID NO: 156678 - RNA, 64 nt, Homo Sapiens
uaugucuaaaaauuacuuuacacaugugccuacauagacacaccaagaaguggauguauauaau

SEQ ID NO: 156679 - RNA, 64 nt, Homo Sapiens
caccacauuccuuugcagggaucaacgacagcaguagacacagguuucaaauuaaaacaaaaaa

SEQ ID NO: 156680 - RNA, 64 nt, Homo Sapiens
acacacacgcucaaaccccucauccaugcauacauagacacaagcauacacacacacuccaauc

SEQ ID NO: 156681 - RNA, 64 nt, Homo Sapiens
cuuugaugagcuugggcuacugcuagacacauaauagacacaugauuuagagccauuuuuacua

SEQ ID NO: 156682 - RNA, 64 nt, Homo Sapiens
auagacacaugcuuugaugacauuuuuacuaugcuagacacauaauuuauaugcaauuuagagc

SEQ ID NO: 156683 - RNA, 64 nt, Homo Sapiens
agacaucugagaaagcuucaucccccaucuucccuagacacagcggccucuugcucugaagcca

SEQ ID NO: 156684 - RNA, 64 nt, Homo Sapiens
ugcucacagccgaccuguggagaugcucaacagcuagacacagaggacacucauccacuguugg

SEQ ID NO: 156685 - RNA, 64 nt, Homo Sapiens
ccuaggaaaaaauuaucaccuucaaagauaggcauagacacauaauuaugcuuaagcuuuuaac

SEQ ID NO: 156686 - RNA, 64 nt, Homo Sapiens
ggaguucugagagcuuaagagcuaaacaugaguuuagacacacaagauucuaaaaugcaaaugu

SEQ ID NO: 156687 - RNA, 64 nt, Homo Sapiens
uuucucuuuucuaguuugcucauacuacauugaguagacacauuuaaggaugggguuaugaacc

SEQ ID NO: 156688 - RNA, 64 nt, Homo Sapiens
cuuuuaccagcuuuuaaccaucugauaucuauaguagacacacuaucauaguuaacauaguaag

SEQ ID NO: 156689 - RNA, 64 nt, Homo Sapiens
aaggcccacauagucaagucgaagaaaaauccucuagacacaugcaagguaguuauaugcugga

SEQ ID NO: 156690 - RNA, 64 nt, Homo Sapiens
aucaagcuuuuaacauauaccauagucauauucauagacacagaggauaaaauaguucagaguu

SEQ ID NO: 156691 - RNA, 64 nt, Homo Sapiens
cagacggccgaagaagucuuaggcagggcgcccugggcugcaggccugcccgaggcugggaugg

SEQ ID NO: 156692 - RNA, 64 nt, Homo Sapiens
gcuggcuguguccauggccagguggccagggucagggcugcaagccagggguccagggcccuuc

SEQ ID NO: 156693 - RNA, 64 nt, Homo Sapiens
ucuuccuucagcccaccucaggauccgggcuugagggcugcagggccugcgugcgcucccuccc

SEQ ID NO: 156694 - RNA, 64 nt, Homo Sapiens
caguguggugugaacucagaagaaacgguuacuggggcugcauggagaauuucaccugcgguga

SEQ ID NO: 156695 - RNA, 64 nt, Homo Sapiens
cuuucuugcaucuacaccccagggcccugugguggggcugcagggggaagcugugcaccugaga

SEQ ID NO: 156696 - RNA, 64 nt, Homo Sapiens
aauguuccauaugggagccccaaaggaacuggaugggcugcagugaggugggggcgggugggca

SEQ ID NO: 156697 - RNA, 64 nt, Homo Sapiens
cagucuggccugugccagcagcaggccccaccuagggcugcaggucuagcuuccagggcaggga

SEQ ID NO: 156698 - RNA, 64 nt, Homo Sapiens
ucccauugccccacuucugcuccuccugcugcaggggcugcacaggucaggguucgugugcucc

SEQ ID NO: 156699 - RNA, 64 nt, Homo Sapiens
uaggcagauaaagacaucagggcuggacagcaaugggcugcaauaaucccaaugaauaguccua

SEQ ID NO: 156700 - RNA, 64 nt, Homo Sapiens
uaagcacacucaucccuuugggagagcagaaugugggcugcauauucccccgagugcauggcuu

SEQ ID NO: 156701 - RNA, 64 nt, Homo Sapiens
cuuguugguagcauguacucaacuuguaaaaagggggcugcauucuuuauaauuccuucugccu

SEQ ID NO: 156702 - RNA, 64 nt, Homo Sapiens
cacauugauguaaggacuguggaaugacuggggagggcugcaguauccaacccaaggaccuuuu

SEQ ID NO: 156703 - RNA, 64 nt, Homo Sapiens
gugcaaggcagggguggaggggagggaccagcccgggcugcaccagugggaguggcuccacccu

SEQ ID NO: 156704 - RNA, 64 nt, Homo Sapiens
gagucacccagccaaaggaggagauggcucagcggggcugcaccaaggggccaagaggcccuac

SEQ ID NO: 156705 - RNA, 64 nt, Homo Sapiens
agucuccggaguggcccgcccaaccauugggguggggcugcaucucagacacagcugaguccga

SEQ ID NO: 156706 - RNA, 64 nt, Homo Sapiens
ugcgggccugggaagcauuggccaagggcagagggggcugcacccuggaggggcccacgguugg

SEQ ID NO: 156707 - RNA, 64 nt, Homo Sapiens
aguagcuacgacugcaagcaccugccaccauaaagggcugcauuuugccaccauaaagggcugc

SEQ ID NO: 156708 - RNA, 64 nt, Homo Sapiens
gccaccauaaagggcugcauuuugccaccauaaagggcugcauuuuuuuaaaaagccuaggcag

SEQ ID NO: 156709 - RNA, 64 nt, Homo Sapiens
gagaugagaugcucuuggacuccccacugcaucugggcugcagggccagagcuagucugaccau

SEQ ID NO: 156710 - RNA, 64 nt, Homo Sapiens
uucuguuaggagcuacuccugggaaccccucucagggcugcagcuuacaggugggcagcuguga

SEQ ID NO: 156711 - RNA, 64 nt, Homo Sapiens
aaggcaggcuccuguggcucugcuggcucagugugggcugcaggaggacugcagacucagcugc

SEQ ID NO: 156712 - RNA, 64 nt, Homo Sapiens
uuaguuuuuaaugucaguggcgacucgguuccuggggcugcagccagccugggacuuuuguaag

SEQ ID NO: 156713 - RNA, 64 nt, Homo Sapiens
ggcuucccugagcuggauguauaggcuguuucuggggcugcagggcuggggcgacagauagcac

SEQ ID NO: 156714 - RNA, 64 nt, Homo Sapiens
ucuguuguaggcccagccacgagcccaguccugagggcugcauccgcccuugucagcuuagggg

SEQ ID NO: 156715 - RNA, 64 nt, Homo Sapiens
gccccagguggcgccauucucucacgcaaggauggggcugcagggugagcagcgugggcugcag

SEQ ID NO: 156716 - RNA, 64 nt, Homo Sapiens
ucacgcaaggauggggcugcagggugagcagcgugggcugcagugugucagucccaggagugag

SEQ ID NO: 156717 - RNA, 64 nt, Homo Sapiens
ggcacagacgcagacggcccggcugcacuggugugggcugcacaugaggucugagagggccccg

SEQ ID NO: 156718 - RNA, 64 nt, Homo Sapiens
ggugugggcugcacaggcacucugagagggccccgggcugcacuugggcacgcguguggugagg

SEQ ID NO: 156719 - RNA, 64 nt, Homo Sapiens
ccguuaaguggacaggaagucuuuaccacugcaggggcugcagguucugucuccagggccugau

SEQ ID NO: 156720 - RNA, 64 nt, Homo Sapiens
uuggguccagcuguggaagcgugacccccuucccgggcugcacugccgccugcugcaucagugg

SEQ ID NO: 156721 - RNA, 64 nt, Homo Sapiens
gcagacuuacaaaauagaacugccuacugauuccgggcugcaacaacagaaggcugccuucuga

SEQ ID NO: 156722 - RNA, 64 nt, Homo Sapiens
ugagcacgcugccauguacugguuugagcaguaggggcugcaucgcacagcgcucgucccccgg

SEQ ID NO: 156723 - RNA, 64 nt, Homo Sapiens
aucccccagccagguccccagcagcagccaucgcgggcugcauccggggcaagccaaguacgaa

SEQ ID NO: 156724 - RNA, 50 nt, Homo Sapiens
accaggacucccaggaggccgggcugcagggccugggcauccggugguag

SEQ ID NO: 156725 - RNA, 64 nt, Homo Sapiens
cuccuccccucccaccucacaggcgugggagucagggcugcauggcacccccucccggggcagc

SEQ ID NO: 156726 - RNA, 64 nt, Homo Sapiens
ucuaccagccagcccagggcccugcaggguccgagggcugcaucgccuccagugugggccggcu

SEQ ID NO: 156727 - RNA, 64 nt, Homo Sapiens
ggggccaggccucgcacuugcagaggagcccagugggcugcacgcuccccuccauccccaucgg

SEQ ID NO: 156728 - RNA, 64 nt, Homo Sapiens
gccaucccccucucacgccacccccgcccccaccgggcugcaggugcugcugaugcgcugggau

SEQ ID NO: 156729 - RNA, 64 nt, Homo Sapiens
ugccgggucggcucugguccacagcacggugccggggcugcagguuguugagggcugugacucc

SEQ ID NO: 156730 - RNA, 64 nt, Homo Sapiens
cgguggccugggagcugcuuucuccccacuggcugggcugcaucuggcccuggcuggaggccuu

SEQ ID NO: 156731 - RNA, 64 nt, Homo Sapiens
uggagggggaggcugaccaagggccccgcagggcgggcugcaacuuuucuguugauccuggaau

SEQ ID NO: 156732 - RNA, 64 nt, Homo Sapiens
aguggcugagggagccaggaggccggggggccgggggcugcaggggaggcuguggggguccugg

SEQ ID NO: 156733 - RNA, 64 nt, Homo Sapiens
cgaagcucccucccggugcuggggggcagcugaggggcugcaggggcagucucccuccuccaag

SEQ ID NO: 156734 - RNA, 64 nt, Homo Sapiens
gagcuuuucacuuuaugcaaaauggcuccugugagggcugcaagcuggaggguggugcaggccu

SEQ ID NO: 156735 - RNA, 64 nt, Homo Sapiens
cucuccagguguacagcugcgagcugguucuccagggcugcagucugauccaaagcagccuguu

SEQ ID NO: 156736 - RNA, 64 nt, Homo Sapiens
cugagugcugcccuuguagcuguccugcccaagugggcugcagaaucagcaaagcauuuggcuu

SEQ ID NO: 156737 - RNA, 64 nt, Homo Sapiens
gaggggagagcugcccggugcagacccaggacgagggcugcacuugguguggccguguccugag

SEQ ID NO: 156738 - RNA, 64 nt, Homo Sapiens
gucgggggcaaggggcucagccccacuggacucugggcugcagaggccaccccccagguggggg

SEQ ID NO: 156739 - RNA, 64 nt, Homo Sapiens; identical to SEQ ID NO: 153164

SEQ ID NO: 156740 - RNA, 64 nt, Homo Sapiens; identical to SEQ ID NO: 153165

SEQ ID NO: 156741 - RNA, 64 nt, Homo Sapiens; identical to SEQ ID NO: 153166

SEQ ID NO: 156742 - RNA, 64 nt, Homo Sapiens; identical to SEQ ID NO: 153167

SEQ ID NO: 156743 - RNA, 63 nt, Homo Sapiens; identical to SEQ ID NO: 153168

SEQ ID NO: 156744 - RNA, 64 nt, Homo Sapiens; identical to SEQ ID NO: 153169

SEQ ID NO: 156745 - RNA, 64 nt, Homo Sapiens; identical to SEQ ID NO: 153170

SEQ ID NO: 156746 - RNA, 64 nt, Homo Sapiens; identical to SEQ ID NO: 153171

SEQ ID NO: 156747 - RNA, 64 nt, Homo Sapiens; identical to SEQ ID NO: 153172

SEQ ID NO: 156748 - RNA, 64 nt, Homo Sapiens; identical to SEQ ID NO: 153173

SEQ ID NO: 156749 - RNA, 64 nt, Homo Sapiens; identical to SEQ ID NO: 153174

SEQ ID NO: 156750 - RNA, 64 nt, Homo Sapiens; identical to SEQ ID NO: 153175

SEQ ID NO: 156751 - RNA, 64 nt, Homo Sapiens; identical to SEQ ID NO: 153176

SEQ ID NO: 156752 - RNA, 64 nt, Homo Sapiens; identical to SEQ ID NO: 153177

SEQ ID NO: 156753 - RNA, 64 nt, Homo Sapiens; identical to SEQ ID NO: 153178

SEQ ID NO: 156754 - RNA, 64 nt, Homo Sapiens; identical to SEQ ID NO: 153179

SEQ ID NO: 156755 - RNA, 64 nt, Homo Sapiens; identical to SEQ ID NO: 153180

SEQ ID NO: 156756 - RNA, 64 nt, Homo Sapiens; identical to SEQ ID NO: 153181

SEQ ID NO: 156757 - RNA, 64 nt, Homo Sapiens; identical to SEQ ID NO: 153182

SEQ ID NO: 156758 - RNA, 64 nt, Homo Sapiens; identical to SEQ ID NO: 153183

SEQ ID NO: 156759 - RNA, 64 nt, Homo Sapiens; identical to SEQ ID NO: 153184

SEQ ID NO: 156760 - RNA, 64 nt, Homo Sapiens; identical to SEQ ID NO: 153185

SEQ ID NO: 156761 - RNA, 64 nt, Homo Sapiens; identical to SEQ ID NO: 153186

SEQ ID NO: 156762 - RNA, 64 nt, Homo Sapiens; identical to SEQ ID NO: 153187

SEQ ID NO: 156763 - RNA, 64 nt, Homo Sapiens; identical to SEQ ID NO: 153188

SEQ ID NO: 156764 - RNA, 64 nt, Homo Sapiens; identical to SEQ ID NO: 153189

SEQ ID NO: 156765 - RNA, 64 nt, Homo Sapiens; identical to SEQ ID NO: 153190

SEQ ID NO: 156766 - RNA, 64 nt, Homo Sapiens; identical to SEQ ID NO: 153191

SEQ ID NO: 156767 - RNA, 64 nt, Homo Sapiens
cugacucuccacaaaccacuguuaaaacuuaccugcuaggaaugcuagauugaaugggauggga

SEQ ID NO: 156768 - RNA, 64 nt, Homo Sapiens
gcuaaaguucuuauggaaaaauacacacgcaauagcuaggaaaacacagggaaagaagaguucu

SEQ ID NO: 156769 - RNA, 64 nt, Homo Sapiens
cuaucuucaucugagagaggcuaaaauguuuucagcuaggaacaaaucuuccuggucgaaaguu

SEQ ID NO: 156770 - RNA, 64 nt, Homo Sapiens
caauccuuacaaaugauugcuuuuaaaauuuuaagcuaggaaaagaaaucuauagaaaguguuc

SEQ ID NO: 156771 - RNA, 64 nt, Homo Sapiens
agaugcuuucagugaugcucucuauacucauaaauaagcaaauguggcaggcuuugcuuucugg

SEQ ID NO: 156772 - RNA, 64 nt, Homo Sapiens
accuuuauguauuuucuuaaagcacgccuuuaaauaagcaaaaacuuuaaaaggcaggaaagag

SEQ ID NO: 156773 - RNA, 64 nt, Homo Sapiens
cucagauaaacuuuuaggaccucauauuaagagcuaagcaaauggccacauuuccuauauuuug

SEQ ID NO: 156774 - RNA, 64 nt, Homo Sapiens
uuuacaggcaagauuuuuuuuuucauugcucccauaagcaaauuuguuuuaaaauaauuguaaa

SEQ ID NO: 156775 - RNA, 64 nt, Homo Sapiens
caagguuauaauuuagcuaaaacuuuggcuguacuaagcaaaugcuugugcuuucuguauuuaa

SEQ ID NO: 156776 - RNA, 64 nt, Homo Sapiens
ucauuauuuuuccuauucauauugcugcaugauguaagcaaaagugaauaacaaaugaaugcuu

SEQ ID NO: 156777 - RNA, 64 nt, Homo Sapiens
cuagagauuuucuuggcaguauuccaugggauguuaagcaaaggaaaccaaaggaaucguuuca

SEQ ID NO: 156778 - RNA, 64 nt, Homo Sapiens
uugugcugagaauagugucugauuauacgacuuuuaagcaaaguuggguguaauuaggugaaaa

SEQ ID NO: 156779 - RNA, 64 nt, Homo Sapiens
acccuccuacccaauucuauagugacagugaacuuaagcaaauuuuuuuauuccuggcauccag

SEQ ID NO: 156780 - RNA, 64 nt, Homo Sapiens
uuuccagaauucccaaaauguuuguaaaaaacaguaagcaaaauaaauuuuagauugugaauau

SEQ ID NO: 156781 - RNA, 64 nt, Homo Sapiens
uggugacuuugcuucacuacagguuaaaagaccauaagcaaacugguuauuuaaaauguaaaaa

SEQ ID NO: 156782 - RNA, 64 nt, Homo Sapiens
aaaaugauaaaagcuaagaugccuucuaacuucauaagcaaaccuuuaacuaauuauguaucug

SEQ ID NO: 156783 - RNA, 64 nt, Homo Sapiens
gccaggugcugcaccuggggacugugaccgacuuuaagcaaaccgucaacaaagguaagagaaa

SEQ ID NO: 156784 - RNA, 64 nt, Homo Sapiens
aauuuaaaauguaauuccagaaaaaaaaagggaauaagcaaagggggaagaauugaaagagaga

SEQ ID NO: 156785 - RNA, 64 nt, Homo Sapiens
acugaaaguuuuuauccaacaauuauguucauuuuaagcaaaauuuuaagaaaguuuugaaauu

SEQ ID NO: 156786 - RNA, 64 nt, Homo Sapiens
gaaauguugaguaaggugacauuuugagcgcuaauaagcaaaagagcaugcagugcuguugaau

SEQ ID NO: 156787 - RNA, 64 nt, Homo Sapiens
agccugcugagaugaagaaaucacuucaugaaaauaagcaaagaccacacauuuuuuacuacaa

SEQ ID NO: 156788 - RNA, 64 nt, Homo Sapiens
uguucagaugaugcuauuaaagaaauguguguacuaagcaaaaauauauaaauagugacaaaua

SEQ ID NO: 156789 - RNA, 64 nt, Homo Sapiens
acuuguaaaccacaucuuuuuugcacuuuuuuuauaagcaaaaacgugccguuuaaaccacugg

SEQ ID NO: 156790 - RNA, 64 nt, Homo Sapiens
aaaacaucuuuguacauuuaagucuguauuauaauaagcaaaaagauuguguguauguauguuu

SEQ ID NO: 156791 - RNA, 64 nt, Homo Sapiens
uuuguaaaacucguuuguuuucaaaggucuggacuaagcaaaacaacagugucaguuuaggaaa

SEQ ID NO: 156792 - RNA, 64 nt, Homo Sapiens
ugaaugcucccccaacauuccuuugguuuuccuauaagcaaaaccaaauaccacuauaaauaca

SEQ ID NO: 156793 - RNA, 64 nt, Homo Sapiens
gaaaucacggacaguaguuucaguucugaugguauaagcaaaacaaauaaaacguuuauaaaag

SEQ ID NO: 156794 - RNA, 64 nt, Homo Sapiens
ucauucugacuucauggagaauuaaucccaccuuuaagcaaaggcuacuaaguuaaugguauuu

SEQ ID NO: 156795 - RNA, 64 nt, Homo Sapiens
aggauguucaccauaacccaaguagggugagggauaagcaaaagccaagcaauugcugcaucuu

SEQ ID NO: 156796 - RNA, 64 nt, Homo Sapiens
guagagcccuguaucaacccuuaacaaugucuuguaagcaaaagaaaaaaacucauggugaggc

SEQ ID NO: 156797 - RNA, 64 nt, Homo Sapiens
agaaaagguuauguucauuuuucaaaaagggaaguaagcaaacaaauauugccaacucuucuau

SEQ ID NO: 156798 - RNA, 64 nt, Homo Sapiens
uaaaacucaacauuacuguuaacugugcguuaaauaagcaaauaaacaguggcucauaaaaaua

SEQ ID NO: 156799 - RNA, 64 nt, Homo Sapiens
uguuuguuuguuugcaauacacucagugcagccuuaagcaaaugagaucauuuucagauuucau

SEQ ID NO: 156800 - RNA, 64 nt, Homo Sapiens
aacucuuuccaaccguagcaggguuguuuucuguuaagcaaagccgagauccagugcaauaccu

SEQ ID NO: 156801 - RNA, 64 nt, Homo Sapiens
caauaaaaauuuaaguuuuugauuuuuuauuauguaagcaaaaccuaaaguggcuauaguuacu

SEQ ID NO: 156802 - RNA, 64 nt, Homo Sapiens
gccuuaggauagcuugggauauuuuuauaucuucuaagcaaagugcuuugugcguuccugccua

SEQ ID NO: 156803 - RNA, 64 nt, Homo Sapiens
ggaguuggguuugguuuuucugggacaugguaccuaagcaaauacucuucuucuuuuuuguuca

SEQ ID NO: 156804 - RNA, 64 nt, Homo Sapiens
uuuccucccagauaauugcuuaugggaaaccugguaagcaaaacccuuuuuguguuuagagaau

SEQ ID NO: 156805 - RNA, 64 nt, Homo Sapiens
uuacauuuuuagguggaaauggacuguauggaaguaagcaaacaacccacuggaugaaaaucua

SEQ ID NO: 156806 - RNA, 64 nt, Homo Sapiens
uguaaacuuuucugaacuuuauguaugucauaaauaagcaaauuaggauuagagaaaucuacaa

SEQ ID NO: 156807 - RNA, 64 nt, Homo Sapiens
uugcauauccaaaccuuagugaguuuugaagcuuuaagcaaauucuuuuaaaaaauucuuguau

SEQ ID NO: 156808 - RNA, 64 nt, Homo Sapiens
ucuuguauuucuagcauuacuagauauuaaaaguuaagcaaauagauuaaugacguauacauag

SEQ ID NO: 156809 - RNA, 64 nt, Homo Sapiens
uuugagcucauuugcaaacccgagucugccugggaacccgcacugugccuggguguauucuuua

SEQ ID NO: 156810 - RNA, 64 nt, Homo Sapiens
acccguuuguucucagauaaaaagcaguuuuauaaacccgcaaucugcuccagauucaagcagu

SEQ ID NO: 156811 - RNA, 64 nt, Homo Sapiens
gaccagagcagccaggcuggggccccucugucucaacccgcagacccuugacugaaugagagag

SEQ ID NO: 156812 - RNA, 64 nt, Homo Sapiens
aauauucuuuguuuaaaugaaagcauacuguugaaacccgcaguguugcauuuagaaaacaguu

SEQ ID NO: 156813 - RNA, 64 nt, Homo Sapiens
caaaagcacgguguuugugaaggauuuagauuguaacccgcacaaacguauuuccuucguggaa

SEQ ID NO: 156814 - RNA, 64 nt, Homo Sapiens
auauauauacauauauauauauauauauguaugaaacccgcauggaauuaucuguaugaaauca

SEQ ID NO: 156815 - RNA, 64 nt, Homo Sapiens
auauuucaaagccuugaacuaagacucaauuaccaacccgcaguuuugugucagugcccaaagg

SEQ ID NO: 156816 - RNA, 64 nt, Homo Sapiens
ccugcaggagcaggucaacccccaccggaccuacaacccgcagucccacaucaucucaggcggg

SEQ ID NO: 156817 - RNA, 64 nt, Homo Sapiens
gugagucuggcucagcagccgcgcggugcuggacaacccgcaccgcuggagccggucaucuccc

SEQ ID NO: 156818 - RNA, 64 nt, Homo Sapiens
caccauguuccuuuguauauuuugggauuuacauaacccgcaacacacauuuccuguucauaag

SEQ ID NO: 156819 - RNA, 64 nt, Homo Sapiens
caugucaugcacgugaugcauuucacugggcuguaacccgcaggggcacagguaucuuuggcaa

SEQ ID NO: 156820 - RNA, 64 nt, Homo Sapiens
acccgggugcuuuguggccagcagcacagaaucaaacccgcaucccagcauugggccacccauc

SEQ ID NO: 156821 - RNA, 64 nt, Homo Sapiens
cucucugcacacuaauaaaaaaguagcuuccuccaacccgcagccuucuuguucucuccuccaa

SEQ ID NO: 156822 - RNA, 64 nt, Homo Sapiens
ccagugcggacccuucccaguuuaccugguacuaaacccgcaccuauguaaauaccaagagcaa

SEQ ID NO: 156823 - RNA, 64 nt, Homo Sapiens
gcccaggcgagcguugccacuaacaaauaaacagaacccgcacucccgggccggcggguuucuc

SEQ ID NO: 156824 - RNA, 64 nt, Homo Sapiens
gcucugaaggguucuugaagguguaccgcucagaaacccgcaaguuaaguugaagcccuuacug

SEQ ID NO: 156825 - RNA, 64 nt, Homo Sapiens
agaaacagguccgacucaguggacuuagacucaaaacccgcagguugccucccaggccccuugu

SEQ ID NO: 156826 - RNA, 64 nt, Homo Sapiens
ucuucacugagguggaggcucuugcagcugcaauaacccgcaggacgacugugcuguagcuucc

SEQ ID NO: 156827 - RNA, 64 nt, Homo Sapiens
accuucccugcugggucucuggggcacagugugaaacccgcacccuagccaggccccagggagc

SEQ ID NO: 156828 - RNA, 64 nt, Homo Sapiens
uccucauguccagacgcugcaaagucccccccaaaacccgcaggugcaggcugggcucagggac

SEQ ID NO: 156829 - RNA, 64 nt, Homo Sapiens
cuccugaagacuggccacgccaggaggccagcagaacccgcagggucacgcccccugaggaccu

SEQ ID NO: 156830 - RNA, 64 nt, Homo Sapiens
ugcucacgggcucuggcuggucugugcaauaauaaacccgcaucugggguucaggaugcugcag

SEQ ID NO: 156831 - RNA, 64 nt, Homo Sapiens
cagaacuccugcccacccuaccccgagggaggcgaacccgcacuuccaggcuugggaggaccau

SEQ ID NO: 156832 - RNA, 64 nt, Homo Sapiens
ucuccucuacugaacccacuggauauuacuucucaacccgcacugcccagggcuccaggaucag

SEQ ID NO: 156833 - RNA, 64 nt, Homo Sapiens
aggccuggaucacuuuaggaucaauauuuugacacgggagaaggcagcucagaaaggauuaagg

SEQ ID NO: 156834 - RNA, 64 nt, Homo Sapiens
cugcuccauacauuggguguauauuuauucugaacgggagaaguuauauuguuaaaaguguaaa

SEQ ID NO: 156835 - RNA, 64 nt, Homo Sapiens
cggguaccguaauccuagcuacucgggagacugacgggagaaucgcuugaacccaggaggcgga

SEQ ID NO: 156836 - RNA, 64 nt, Homo Sapiens
gugccuguaaucucagcuacucaguaggcuggagcgggagaacugcuugaaccugggaggugga

SEQ ID NO: 156837 - RNA, 64 nt, Homo Sapiens
ggaaagaaaccaggaacguggaggguuauuacugcgggagaagggacacgaggauggcuuugcu

SEQ ID NO: 156838 - RNA, 64 nt, Homo Sapiens
cgcgccuauaaucccagcuacugggaggcugaggcgggagaaucgcuugagccggggaggcgga

SEQ ID NO: 156839 - RNA, 64 nt, Homo Sapiens
cuuguauauuccccacaaagccguucgcagcuuccgggagaaggggccagagcccgguggggcc

SEQ ID NO: 156840 - RNA, 64 nt, Homo Sapiens
ggccccggccaucuugcagcuuccccuuaaaggacgggagaaaguuugagaagugcugcuguaa

SEQ ID NO: 156841 - RNA, 64 nt, Homo Sapiens
gcuugagcccaggaguucagcugggaggcccaggcgggagaacuaugccuguaaucccaacauu

SEQ ID NO: 156842 - RNA, 64 nt, Homo Sapiens
uccaccauaauaaaacugacgagucgugaagacacgggagaaaaguuagcacacucagcgcugu

SEQ ID NO: 156843 - RNA, 64 nt, Homo Sapiens
cugcccgcugcccucugucaaggagugucaccugcgggagaagugaaccauugggaccugaggc

SEQ ID NO: 156844 - RNA, 64 nt, Homo Sapiens
ugguucuucaagccgagaggagagaacccggggccgggagaaggccauccucagugagaacacc

SEQ ID NO: 156845 - RNA, 64 nt, Homo Sapiens
cuaguuccaaguuuuaaauacauggaaggaaguccgggagaaccauaugaaggagcaggaggag

SEQ ID NO: 156846 - RNA, 64 nt, Homo Sapiens
uggaggugcuggagaggacaccacgguggacccacgggagaagcccagcuacccugcugcagga

SEQ ID NO: 156847 - RNA, 64 nt, Homo Sapiens
aggcaacccaaaugguggccggggagugccacuucgggagaagagcuggggccccugcaaccuc

SEQ ID NO: 156848 - RNA, 64 nt, Homo Sapiens
ugggggugaaucccaaugagggucccucucagagcgggagaacgccagagcccuggauggugau

SEQ ID NO: 156849 - RNA, 64 nt, Homo Sapiens
auuuuuaaauauaaggauuuuccuagauauugcacgggagaauauacaaauagcaaaauugagg

SEQ ID NO: 156850 - RNA, 64 nt, Homo Sapiens
gggucgcguggaucuacccucuaguuuacuugcucgggagaagaaacugacucguuuuauuuag

SEQ ID NO: 156851 - RNA, 64 nt, Homo Sapiens
gucccucccucuugaguuggcucugauuugaaaucgggagaaacagagcugcugccaaugggau

SEQ ID NO: 156852 - RNA, 64 nt, Homo Sapiens
gcaccuguagucccagcuacucaggaggcugaggcgggagaauggcaugaacccgggaggugga

SEQ ID NO: 156853 - RNA, 64 nt, Homo Sapiens
gcuugaacccaggagguggauggggaggcugaggcgggagaaucgugccuguaaucccagcuac

SEQ ID NO: 156854 - RNA, 64 nt, Homo Sapiens
cugccugaagcucuggaaaccgcagccgccugcccgggagaaccagggaggcugagugaggcca

SEQ ID NO: 156855 - RNA, 64 nt, Homo Sapiens
aggauuugauuggaaagcagugugauaauucuuacgggagaaaguuaauuaggcaauuuauguc

SEQ ID NO: 156856 - RNA, 64 nt, Homo Sapiens
ggggaugugagugggaggaaaggggucuguaaagcgggagaacaaggcuagccucccccuaaca

SEQ ID NO: 156857 - RNA, 64 nt, Homo Sapiens
uauuguccagugaauucaagaccaaauacaauaucgggagaaaauacaaacucccuguguuuaa

SEQ ID NO: 156858 - RNA, 64 nt, Homo Sapiens
uguguuccuacaauuggcccagcacccuggggcacgggagaaggguggggaccguugcugucac

SEQ ID NO: 156859 - RNA, 64 nt, Homo Sapiens
gcuugaaccagggagucagauugggaggcugaggcgggagaaucgugccuguaaucccagcuac

SEQ ID NO: 156860 - RNA, 64 nt, Homo Sapiens
aggccuguaaucccagcuccuugggaggcugaggcgggagaauugcuugaacccggggacggag

SEQ ID NO: 156861 - RNA, 64 nt, Homo Sapiens
gaaacauccgggacccucagacacuguuguuuuucgggagaaaaaaccaaaggaggugauggga

SEQ ID NO: 156862 - RNA, 64 nt, Homo Sapiens
cggugaggacucggccaaacgguugucagguucccgggagaaggcucagggucucacaccuugg

SEQ ID NO: 156863 - RNA, 64 nt, Homo Sapiens
agugagcaaacaucgcugaguuuguuuucuuguucgggagaauggggccggggcuggccuggcc

SEQ ID NO: 156864 - RNA, 64 nt, Homo Sapiens
uuauaucagauucuuggcuggugugauaagcaaacgggagaaauuaauuuuuaugaaauacugc

SEQ ID NO: 156865 - RNA, 64 nt, Homo Sapiens
ccaggacucacccuccacaaagcaaaggcagucccgggagaaaagacggauggcaggauccaag

SEQ ID NO: 156866 - RNA, 64 nt, Homo Sapiens
cauggccacucugcccucuggaccugucuuucaucgggagaaaccacucagagauggaucccau

SEQ ID NO: 156867 - RNA, 64 nt, Homo Sapiens
cagugggcagguggccgccccugaggcuucacgccgggagaagccaccuucccaccccuucaua

SEQ ID NO: 156868 - RNA, 64 nt, Homo Sapiens
uuuuuuuuuuuuuucuggcggugagccagagggucgggagaaacgcugcucgccccacaccccg

SEQ ID NO: 156869 - RNA, 64 nt, Homo Sapiens
cgcuugugcuucgcgcaugcgggaaccacugugacgggagaaaccugguuucuaagacaaccgu

SEQ ID NO: 156870 - RNA, 64 nt, Homo Sapiens
cacuaagggccccacaggcuucuggugggcucugcgggagaagacuguuacucacagaaguguu

SEQ ID NO: 156871 - RNA, 64 nt, Homo Sapiens
cuggcaaaggcuggcugugugucuaaacagaguccgggagaaugauguuaguaauggcagagca

SEQ ID NO: 156872 - RNA, 64 nt, Homo Sapiens
uuuccccaauccccaggucuagccccaccuuccccgggagaagccagggggccucucugccucc

SEQ ID NO: 156873 - RNA, 64 nt, Homo Sapiens
cccacugcaggcaaaccgugacgcccuccccacucgggagaagcagagcugaccuuaggaccga

SEQ ID NO: 156874 - RNA, 64 nt, Homo Sapiens
ccuguccuggggcuguugagcagcauaauaaucccgggagaaugauuccccucauagaaagaca

SEQ ID NO: 156875 - RNA, 64 nt, Homo Sapiens
guggcuguagucgcagcuacucaggaggcugaggcgggagaauggcgugaacccaggagacgga

SEQ ID NO: 156876 - RNA, 63 nt, Homo Sapiens
accgcagcaggugggcguacuggagaggccaggcgggagaacuugaggcagucuccaccuuga

SEQ ID NO: 156877 - RNA, 64 nt, Homo Sapiens
ugacggacuggaaggacuucugcagaggcucaugcgggagaagcccagcaccugcaggaccaag

SEQ ID NO: 156878 - RNA, 64 nt, Homo Sapiens
gcuuuaaaagcgaccucucuugagguaggagaggcgggagaacugaaguuuccgcccccgcccc

SEQ ID NO: 156879 - RNA, 64 nt, Homo Sapiens
ccggcagcugcuggcugaaguucaggcccugagccgggagaacagggagcuccuggagcgcagc

SEQ ID NO: 156880 - RNA, 64 nt, Homo Sapiens
uuuucccacaccgaucaagucaacucaguacucacgggagaaaaauagacuuuauuuacaagua

SEQ ID NO: 156881 - RNA, 64 nt, Homo Sapiens
cauuucucacugccuucugucugcccaguuucaccgggagaagucggccucuuccugaugggca

SEQ ID NO: 156882 - RNA, 64 nt, Homo Sapiens
aguccucuacugcaugaagaaaagacucuacuaucgggagaagaaauauaaauauguggaagau

SEQ ID NO: 156883 - RNA, 64 nt, Homo Sapiens
ccggaccacguugcugcccaggucuggaccucagcgggagaacuggcuccggggggaguggggc

SEQ ID NO: 156884 - RNA, 64 nt, Homo Sapiens
aguaucaggagaccauugaccccuguucaaaacccgggagaaggggugauuaaagauacggagu

SEQ ID NO: 156885 - RNA, 64 nt, Homo Sapiens
augugaacccgggacgcagguugggaagcugaggcgggagaaucgcgccuguaaucccagcuac

SEQ ID NO: 156886 - RNA, 52 nt, Homo Sapiens
agcuggcucaggaagccaagugcgggagaagccaagaagcaggaggagguaa

SEQ ID NO: 156887 - RNA, 64 nt, Homo Sapiens
accugagccugggaggucgacugggaggcugaggcgggagaaucacgcuuguagucccaacuac

SEQ ID NO: 156888 - RNA, 64 nt, Homo Sapiens
ggaacuugugccccagaaaguaggcagccagucucgggagaaggaaaguaggaucccagugcau

SEQ ID NO: 156889 - RNA, 64 nt, Homo Sapiens
auccauuuuaguucuauggauuuuuguuacaaaucgggagaaaacaguuuugaucccaaaagcu

SEQ ID NO: 156890 - RNA, 64 nt, Homo Sapiens
cucgccagggcacggagccgucaguccacuguuacgggagaauguugauuucgcgggugcgagg

SEQ ID NO: 156891 - RNA, 64 nt, Homo Sapiens
caugagaaagaauuugagacgagaaaagagaaaccgggagaaggaaaaaaagcaaaaagcaagg

SEQ ID NO: 156892 - RNA, 64 nt, Homo Sapiens
gauccacaccuggucugaggggcaacugagucugcgggagaagagcggcccuaugcauggugua

SEQ ID NO: 156893 - RNA, 64 nt, Homo Sapiens
uuccucacccgccccugccccugcugcuguugcacgggagaacuugcagggagagggcaggcgg

SEQ ID NO: 156894 - RNA, 64 nt, Homo Sapiens
auccucugcuguaacugcagggucacaggcaucccgggagaaugggccuccacccucagccagc

SEQ ID NO: 156895 - RNA, 64 nt, Homo Sapiens
aguacauaagcaggcuggcucugaagacguggaccgggagaaugaccagagccagaggucagug

SEQ ID NO: 156896 - RNA, 64 nt, Homo Sapiens
auguugaaugaauccacguucuggaaccccgaggcgggagaaguagggagcuguucguuuaagc

SEQ ID NO: 156897 - RNA, 64 nt, Homo Sapiens
caugauguuuggaugcuagacuaguugcaucugacgggagaaguuuguguuguaccagcgcaug

SEQ ID NO: 156898 - RNA, 64 nt, Homo Sapiens
agcagcaguguaccagugucacucuggaguacagcgggagaaacacaaaauaguauaacugaaa

SEQ ID NO: 156899 - RNA, 64 nt, Homo Sapiens
cgaggccccucccuccuccucugcccacaugccccgggagaaacgcgggaucccgagggccuuc

SEQ ID NO: 156900 - RNA, 64 nt, Homo Sapiens
cccaggccagccugcuggacccuccgccucugcccgggagaaagugcugcuccuuugcuucgga

SEQ ID NO: 156901 - RNA, 64 nt, Homo Sapiens
ggaaaggcugucuggggucugcgcaccaaagacucgggagaacugacuucccgccggcagcugu

SEQ ID NO: 156902 - RNA, 64 nt, Homo Sapiens
caguaaacagcuuucccacaccaauuacacacagcgggagaacgguguuucagccacacugaac

SEQ ID NO: 156903 - RNA, 64 nt, Homo Sapiens
cugucucaaauaaauaaauaugagauaaugcagucgggagaagggagggagagaauuuuauuaa

SEQ ID NO: 156904 - RNA, 64 nt, Homo Sapiens
cuauauuguacagggcugggggggcccuuggcugcgggagaaggcccagagcccuggaggagcc

SEQ ID NO: 156905 - RNA, 64 nt, Homo Sapiens
ccugccuggcacccacgcuggcucucuccugccgcgggagaaagcaccagcagguucugagccc

SEQ ID NO: 156906 - RNA, 64 nt, Homo Sapiens
augagcgaggggcagauucugagucuaaaggggccgggagaagccuccaccaugucagucuaaa

SEQ ID NO: 156907 - RNA, 64 nt, Homo Sapiens
acuugaaccugggaggcagaucaggaggcugaggcgggagaaucgugucuguaaucccagcuac

SEQ ID NO: 156908 - RNA, 64 nt, Homo Sapiens
gaagccauugcuaacuacuugccugcuuuggacacgggagaaaacagaagucagcgcaggaaga

SEQ ID NO: 156909 - RNA, 64 nt, Homo Sapiens
gggccuguaaucccagcuacucgggaggcugaugcgggagaaucacuugaaacccacaggcgga

SEQ ID NO: 156910 - RNA, 64 nt, Homo Sapiens
augccuguaaucccagcuacuugggagccugaggcgggagaauugcuugaacccgggaggcaga

SEQ ID NO: 156911 - RNA, 64 nt, Homo Sapiens
ggccauugguaaaaagacuugguggcaauaguuccgggagaauuaaagggaggugacuucgccc

SEQ ID NO: 156912 - RNA, 59 nt, Homo Sapiens
uuucuguugucccacuuccuuggaagcaacgggagaagcuagaugagaaauccuuuuag

SEQ ID NO: 156913 - RNA, 64 nt, Homo Sapiens
ccacccucuucagagccugcacacccccgcgucucgggagaaacgagggcugcccccaccacac

SEQ ID NO: 156914 - RNA, 50 nt, Homo Sapiens
cuguguaugcaggggucaugcgggagaaacgacaccagaggacacacuga

SEQ ID NO: 156915 - RNA, 64 nt, Homo Sapiens
ccacuucaaaugacaaguucauauauagaauuuacgggagaaacuugagaccauuuacggggag

SEQ ID NO: 156916 - RNA, 64 nt, Homo Sapiens
uagcaagaugcuaguguguggaacugcaaacaaucgggagaagaccugagugcaaagugugcca

SEQ ID NO: 156917 - RNA, 64 nt, Homo Sapiens
ccugguccucugcguuguagugcuaccucaaucucgggagaaacagcccuauauucuaacaagu

SEQ ID NO: 156918 - RNA, 64 nt, Homo Sapiens
aagaccagguuugcugggcauaagcuucacaggacgggagaaccugcccaugguggacugucgu

SEQ ID NO: 156919 - RNA, 64 nt, Homo Sapiens
auaugggacauuucuugauuauuauacaaagucacgggagaaaaacgcucuacuucguaaaagc

SEQ ID NO: 156920 - RNA, 64 nt, Homo Sapiens
ugugcuguaugauacagauccauucucacgacuccgggagaaacgcugccacggucccuccugu

SEQ ID NO: 156921 - RNA, 64 nt, Homo Sapiens
uugucuccucuggggccagcucagaggugaggggcgggagaaggcagcggcccgcccucuguuc

SEQ ID NO: 156922 - RNA, 64 nt, Homo Sapiens
ucaaugcuuuuccucaggaagccucccuuguguccgggagaacaauucuacuccaagagauucu

SEQ ID NO: 156923 - RNA, 64 nt, Homo Sapiens
agcagaaguguaaucucuguuaacccaaaagcuacgggagaaaaucuucuuuucaucucaguca

SEQ ID NO: 156924 - RNA, 64 nt, Homo Sapiens
ccacguaaccuuugcuuucuuggaaaaggaagcacgggagaaauccugagccgguuuaagucug

SEQ ID NO: 156925 - RNA, 64 nt, Homo Sapiens; identical to SEQ ID NO: 24398

SEQ ID NO: 156926 - RNA, 64 nt, Homo Sapiens; identical to SEQ ID NO: 24399

SEQ ID NO: 156927 - RNA, 64 nt, Homo Sapiens; identical to SEQ ID NO: 24400

SEQ ID NO: 156928 - RNA, 64 nt, Homo Sapiens; identical to SEQ ID NO: 24401

SEQ ID NO: 156929 - RNA, 64 nt, Homo Sapiens; identical to SEQ ID NO: 24402

SEQ ID NO: 156930 - RNA, 64 nt, Homo Sapiens; identical to SEQ ID NO: 24403

SEQ ID NO: 156931 - RNA, 64 nt, Homo Sapiens; identical to SEQ ID NO: 24404

SEQ ID NO: 156932 - RNA, 64 nt, Homo Sapiens; identical to SEQ ID NO: 24405

SEQ ID NO: 156933 - RNA, 64 nt, Homo Sapiens; identical to SEQ ID NO: 24406

SEQ ID NO: 156934 - RNA, 64 nt, Homo Sapiens; identical to SEQ ID NO: 24407

SEQ ID NO: 156935 - RNA, 64 nt, Homo Sapiens; identical to SEQ ID NO: 24408

SEQ ID NO: 156936 - RNA, 64 nt, Homo Sapiens; identical to SEQ ID NO: 24409

SEQ ID NO: 156937 - RNA, 64 nt, Homo Sapiens; identical to SEQ ID NO: 24410

SEQ ID NO: 156938 - RNA, 64 nt, Homo Sapiens; identical to SEQ ID NO: 24411

SEQ ID NO: 156939 - RNA, 64 nt, Homo Sapiens; identical to SEQ ID NO: 24412

SEQ ID NO: 156940 - RNA, 64 nt, Homo Sapiens; identical to SEQ ID NO: 24413

SEQ ID NO: 156941 - RNA, 64 nt, Homo Sapiens; identical to SEQ ID NO: 24414

SEQ ID NO: 156942 - RNA, 64 nt, Homo Sapiens; identical to SEQ ID NO: 24415

SEQ ID NO: 156943 - RNA, 64 nt, Homo Sapiens; identical to SEQ ID NO: 24416

SEQ ID NO: 156944 - RNA, 64 nt, Homo Sapiens; identical to SEQ ID NO: 24417

SEQ ID NO: 156945 - RNA, 64 nt, Homo Sapiens
uggucuauuuagggacaaagaagguauaaaguccagagaugagaaaacugggucagcccucaga

SEQ ID NO: 156946 - RNA, 64 nt, Homo Sapiens
agggcaagacucuuccauaagccugcuaaaaaacagagaugauaccucuuacaaacuuuaccuc

SEQ ID NO: 156947 - RNA, 64 nt, Homo Sapiens
aauaucuuuuuaccagagagugaaccaucucaucagagaugaauucuuggucacugucauauuu

SEQ ID NO: 156948 - RNA, 64 nt, Homo Sapiens
ccuuuacucaaaccugcagggcggcacugaaggaagagaugauugaucucuuacaaagaacaau

SEQ ID NO: 156949 - RNA, 64 nt, Homo Sapiens
ccaauuuuagaaaaucaagcagguuagagaaaauagagaugaauuaggggacacugucuuaugg

SEQ ID NO: 156950 - RNA, 64 nt, Homo Sapiens
gcuuuggcaguguuuugagaacuuaaguggcuaaagagaugagacaaacaugcaggucgcuacu

SEQ ID NO: 156951 - RNA, 64 nt, Homo Sapiens
cccgucagagucaagagaugccagggaaucuaggagagaugaggguagcuuuucacccucuguc

SEQ ID NO: 156952 - RNA, 64 nt, Homo Sapiens
uccuuuaauugaaaacgaagaagugaaaucgcucagagaugagauuucauucuucacuuagggg

SEQ ID NO: 156953 - RNA, 64 nt, Homo Sapiens
gaucauugguuggacacugugguuaugcagaagcagagaugaggaggcuggccccagagaugau

SEQ ID NO: 156954 - RNA, 64 nt, Homo Sapiens
guuaugcagaagcagagaugaggaggcuggccccagagaugaucuugcccuuccuaacuaaagg

SEQ ID NO: 156955 - RNA, 64 nt, Homo Sapiens
caucaagaagccagggccgugccuggagcacugcagagaugacuuuggagaaagcaaagcagug

SEQ ID NO: 156956 - RNA, 64 nt, Homo Sapiens
ugaaccaguuuaaaaacgagguuuuauuuacuguagagaugaaugcaaaucagaaccaaugauc

SEQ ID NO: 156957 - RNA, 64 nt, Homo Sapiens
cuuugaucuggaaacuaagacuagagaagucuuaagagaugacugcucaggugaguaaggcaga

SEQ ID NO: 156958 - RNA, 64 nt, Homo Sapiens
aaaucagcaucauaagggaauguagccuuccaacagagaugaugcuguucguauguuaaucuca

SEQ ID NO: 156959 - RNA, 64 nt, Homo Sapiens
gaugagcagcuggauuuucguucucagaggugacagagaugaugagugcagccucacagugacu

SEQ ID NO: 156960 - RNA, 64 nt, Homo Sapiens
ggaagguggagguggguagccuggggggcgagggagagaugagccgcuagggacuccuggggag

SEQ ID NO: 156961 - RNA, 64 nt, Homo Sapiens
aguuuugauauuuucugaaagaggaacauguguuagagaugaagaaucuuccaaggcucaugca

SEQ ID NO: 156962 - RNA, 64 nt, Homo Sapiens
ccgaagagauaaagcuuacuugacuuucaaauggagagaugaugaaaacccacucauucacucu

SEQ ID NO: 156963 - RNA, 64 nt, Homo Sapiens
uuugccuuuuggguuuuuuguuuguuauuauagaagagaugacuucugcugauuuugcuuuaga

SEQ ID NO: 156964 - RNA, 64 nt, Homo Sapiens
uuugugagcaaguucuauuuguucauugcuugccagagaugaacacagaauguucuguuucauu

SEQ ID NO: 156965 - RNA, 64 nt, Homo Sapiens
gaaaucuggucuguuugcauuucuguuaugacagagagaugauguuugcauuucuguuaugaca

SEQ ID NO: 156966 - RNA, 64 nt, Homo Sapiens
cagagagaugauguuugcauuucuguuaugacagagagaugaugaaaguaggcagggcuguguu

SEQ ID NO: 156967 - RNA, 64 nt, Homo Sapiens
uuucaccauguuggccagacuuuguauuuuuaguagagaugaggcaccaugccuggcuuaauuu

SEQ ID NO: 156968 - RNA, 64 nt, Homo Sapiens
ucugaguuaaauuuguacuuguggcuguguuauuagagaugaauucuguuacaucacugugacu

SEQ ID NO: 156969 - RNA, 64 nt, Homo Sapiens
augagguaauacucccauuucacauauaauacugagagaugaguugcacaagauuauacacugu

SEQ ID NO: 156970 - RNA, 64 nt, Homo Sapiens
cuguaaggaagugcuucuauaaauucuuagguuuagagaugauaccaucuggguaccuuugcuu

SEQ ID NO: 156971 - RNA, 64 nt, Homo Sapiens
cauagacggggaugacucagcacuaccccucaacagagaugacuuugaugacucugccccucag

SEQ ID NO: 156972 - RNA, 64 nt, Homo Sapiens
acuccgcacugccccucaacagggaugacucagcagagaugacucagcacugucccuuagcagg

SEQ ID NO: 156973 - RNA, 64 nt, Homo Sapiens
acucagcaccgccccucaacaggcaugacucugcagagaugacucagcacugucccuuagcagg

SEQ ID NO: 156974 - RNA, 64 nt, Homo Sapiens
acucagcaccgccccucaacaggcaugacucugcagagaugacuuaguacugccccucagcagg

SEQ ID NO: 156975 - RNA, 64 nt, Homo Sapiens
acucagcaccgccccucaacaggcaugacucugcagagaugacucagcacugccccucagcagg

SEQ ID NO: 156976 - RNA, 64 nt, Homo Sapiens
gggaguuaacuauaaauugcacaggguaccuuacagagaugauggaaauguccuaaaacuagau

SEQ ID NO: 156977 - RNA, 64 nt, Homo Sapiens
caccacaccuggauaauuaaaaaauuauuucuguagagaugaagucucacuguguugcccagcc

SEQ ID NO: 156978 - RNA, 64 nt, Homo Sapiens
gccaccaugccuggcuaauuuugguauuuuuaguagagaugagguuuugccauuuuggucaggc

SEQ ID NO: 156979 - RNA, 64 nt, Homo Sapiens
cuccccaaggugccugaaaucugccaaaagucucagagaugaaauucgacuccccgaggugcag

SEQ ID NO: 156980 - RNA, 64 nt, Homo Sapiens
cucccuaaaaugccugagaucucccgaaagucccagagaugaaaugcaccucccggaagugcag

SEQ ID NO: 156981 - RNA, 64 nt, Homo Sapiens
cucccugagaugaaacuccccuuccaaaagucccagagaugaagugcaccucccagaagugcag

SEQ ID NO: 156982 - RNA, 64 nt, Homo Sapiens
gucccugagaugaagcuucccugccgaaagugccagagaugaaaugcggcuuccagaggugcag

SEQ ID NO: 156983 - RNA, 64 nt, Homo Sapiens
cucccagaggugucagaggucugccgaaagugucagagaugaaaugcggcuuccagagguacag

SEQ ID NO: 156984 - RNA, 64 nt, Homo Sapiens
cucccaaaggugccagagaucugcccaaagugucagagaugaaaugcggcuuccagagguagag

SEQ ID NO: 156985 - RNA, 64 nt, Homo Sapiens
cucccaaaggugccagagaucuccccaaggugucagagaugaaauucgacucccagagguggag

SEQ ID NO: 156986 - RNA, 64 nt, Homo Sapiens
auccgaauucuccauauauuucucaacuaaaaauagagaugauaucuauaugguuugugcauuu

SEQ ID NO: 156987 - RNA, 64 nt, Homo Sapiens
uuugacaaaaaaaaauugaaaaaacuaggagaacagagaugagauuccuguaaauauuucugug

SEQ ID NO: 156988 - RNA, 64 nt, Homo Sapiens
aacuaaaaucauuuuuacaggaaggaagagggaaagagaugacuuaaaauuggggguaaggagg

SEQ ID NO: 156989 - RNA, 64 nt, Homo Sapiens
aacaaagaaccugcucugaugacacuuagaggggagagaugaaagccaaacaaaugaauaaaca

SEQ ID NO: 156990 - RNA, 64 nt, Homo Sapiens
agcuggaaagguaagacugaggucagaaaggugcagagaugaaaagauuuugaaggaccuuaug

SEQ ID NO: 156991 - RNA, 64 nt, Homo Sapiens
acugcauugugaagaggaggaaaagugaaucacggagagagaaaggaaaggauagaaucacagg

SEQ ID NO: 156992 - RNA, 64 nt, Homo Sapiens
auccaugucugugacacaggacggugggaagccugagagagagugaaauuaugugauacacuga

SEQ ID NO: 156993 - RNA, 64 nt, Homo Sapiens
ccagcccacagugguggccucugccucuuuccuggagagagaaggacagugcacggagagguuu

SEQ ID NO: 156994 - RNA, 64 nt, Homo Sapiens
ucugcccuaccugucuuuccugaguguuugaggggagagagagacccacaucuccccaaagaga

SEQ ID NO: 156995 - RNA, 64 nt, Homo Sapiens
ugcccuaccugucuuuccugaguguuugaggggagagagagacccacaucuccccaaagagaug

SEQ ID NO: 156996 - RNA, 64 nt, Homo Sapiens
cggcaggcucacugccaggccagccuccgagagggagagagagagagagaggacagcuugagcc

SEQ ID NO: 156997 - RNA, 64 nt, Homo Sapiens
gcaggcucacugccaggccagccuccgagagggagagagagagagagaggacagcuugagccgg

SEQ ID NO: 156998 - RNA, 64 nt, Homo Sapiens
aggcucacugccaggccagccuccgagagggagagagagagagagaggacagcuugagccgggc

SEQ ID NO: 156999 - RNA, 64 nt, Homo Sapiens
gcucacugccaggccagccuccgagagggagagagagagagagaggacagcuugagccgggccc

SEQ ID NO: 157000 - RNA, 64 nt, Homo Sapiens
ucacugccaggccagccuccgagagggagagagagagagagaggacagcuugagccgggccccu

SEQ ID NO: 157001 - RNA, 64 nt, Homo Sapiens
gugagaucuuacagguaucaggcacaggcaggaagagagagagagagguucuggggaggaaggg

SEQ ID NO: 157002 - RNA, 64 nt, Homo Sapiens
gagaucuuacagguaucaggcacaggcaggaagagagagagagagguucuggggaggaagggcc

SEQ ID NO: 157003 - RNA, 64 nt, Homo Sapiens
gaucuuacagguaucaggcacaggcaggaagagagagagagagguucuggggaggaagggccag

SEQ ID NO: 157004 - RNA, 64 nt, Homo Sapiens
gagagagagagagguucuggggaggaagggccaggagagagaucuagaaaguggguucacuaga

SEQ ID NO: 157005 - RNA, 64 nt, Homo Sapiens
ucucccuuucccugucuggcuucucccuuaagaagagagagauacuuguagaauuggguggggg

SEQ ID NO: 157006 - RNA, 64 nt, Homo Sapiens
cuguccuuccauuugggauauguuacauuagagugagagagagaauaaggagccuuucuuaugg

SEQ ID NO: 157007 - RNA, 64 nt, Homo Sapiens
guccuuccauuugggauauguuacauuagagugagagagagaauaaggagccuuucuuauggaa

SEQ ID NO: 157008 - RNA, 64 nt, Homo Sapiens
uagaugggaccucgaggcucgagcugaagcaggcgagagagaaacagcuacugcgugcgugcgc

SEQ ID NO: 157009 - RNA, 64 nt, Homo Sapiens
ucucucugucgaagaaagaagcucugucaaguuagagagagacaauguguaggaaauguucuuu

SEQ ID NO: 157010 - RNA, 64 nt, Homo Sapiens
aggaacucuccguccccccggggcccuccggagggagagagagaggaacugcuguuuaucucac

SEQ ID NO: 157011 - RNA, 64 nt, Homo Sapiens
gaacucuccguccccccggggcccuccggagggagagagagaggaacugcuguuuaucucacuc

SEQ ID NO: 157012 - RNA, 64 nt, Homo Sapiens
gcaaaagagcauguacaugggagugagagaaaaagagagagagagacagaguggcgggggcggg

SEQ ID NO: 157013 - RNA, 64 nt, Homo Sapiens
aaaagagcauguacaugggagugagagaaaaagagagagagagacagaguggcgggggcgggga

SEQ ID NO: 157014 - RNA, 64 nt, Homo Sapiens
aagagcauguacaugggagugagagaaaaagagagagagagacagaguggcgggggcggggagg

SEQ ID NO: 157015 - RNA, 64 nt, Homo Sapiens
cagcaguuccuaaaugauucucacaagcaacccugagagagacagucuugugagggagaucugg

SEQ ID NO: 157016 - RNA, 64 nt, Homo Sapiens
aaacaaacaaaaaacaauggaaaagaugaagcuggagagagaggaaccaguugccaagguagag

SEQ ID NO: 157017 - RNA, 64 nt, Homo Sapiens
cauagcagcagccucagcagcugucuugguaaaggagagagagagacauggggccaguaauucc

SEQ ID NO: 157018 - RNA, 64 nt, Homo Sapiens
uagcagcagccucagcagcugucuugguaaaggagagagagagacauggggccaguaauuccgg

SEQ ID NO: 157019 - RNA, 64 nt, Homo Sapiens
gcagcagccucagcagcugucuugguaaaggagagagagagacauggggccaguaauuccgggg

SEQ ID NO: 157020 - RNA, 64 nt, Homo Sapiens
gugugaaacugaggagucugcaauuuggaauauggagagagagacugauuugcugaauuuccuu

SEQ ID NO: 157021 - RNA, 64 nt, Homo Sapiens
gugaaacugaggagucugcaauuuggaauauggagagagagacugauuugcugaauuuccuucu

SEQ ID NO: 157022 - RNA, 64 nt, Homo Sapiens
uggagaaccacaaugcacauuagcauauuagucugagagagaacuuauaguaaggaaacucacu

SEQ ID NO: 157023 - RNA, 64 nt, Homo Sapiens
guuuccuggaaacuuugacaagcuuuauuaaguugagagagagagaggggaaaaaaaaaagccu

SEQ ID NO: 157024 - RNA, 64 nt, Homo Sapiens
uuccuggaaacuuugacaagcuuuauuaaguugagagagagagaggggaaaaaaaaaagccuuu

SEQ ID NO: 157025 - RNA, 64 nt, Homo Sapiens
ccuggaaacuuugacaagcuuuauuaaguugagagagagagaggggaaaaaaaaaagccuuucg

SEQ ID NO: 157026 - RNA, 64 nt, Homo Sapiens
cagucauggcccccuuccuccccugcaggagggagagagagacaguucggcggccgcggcuggg

SEQ ID NO: 157027 - RNA, 64 nt, Homo Sapiens
cacagucauggcccccuuccggcccugcaggagggagagagagacaguucggcggccgcggcug

SEQ ID NO: 157028 - RNA, 64 nt, Homo Sapiens
guagaugaguacuugccuaggcaaaucuguuugagagagagaaaauaugaaauguccagaauag

SEQ ID NO: 157029 - RNA, 64 nt, Homo Sapiens
aaguagaugaguacuugccuaggcaaaucuguuugagagagagauuauaugaaauguccagaau

SEQ ID NO: 157030 - RNA, 64 nt, Homo Sapiens
cugggcccagccgggccgugccucugcagguggagagagagaagcaggguucuccccccuacac

SEQ ID NO: 157031 - RNA, 64 nt, Homo Sapiens
agcugggcccagccgggccgacccucugcagguggagagagagagccaggguucuccccccuac

SEQ ID NO: 157032 - RNA, 64 nt, Homo Sapiens
gaauggcgugggaugggggauuugccuugcugcagagagagaagagagucucuagagguagaaa

SEQ ID NO: 157033 - RNA, 64 nt, Homo Sapiens
ugccgcaaagcacaaggcugucccugcaccagcugagagagacugaagagacacaggucucccg

SEQ ID NO: 157034 - RNA, 64 nt, Homo Sapiens
aaaagaaaaaugaagaaaaggggaggaagaaagggagagagaagaaugaaauaaaaagaagaga

SEQ ID NO: 157035 - RNA, 64 nt, Homo Sapiens
gacuguuaugaaaaacagaaagaagggggauaaagagagagaaguucccuagggucugcuuuag

SEQ ID NO: 157036 - RNA, 64 nt, Homo Sapiens
ggauccucauaggucagggaaggagagagacagagagagagaauuucugggacuccaggucuug

SEQ ID NO: 157037 - RNA, 64 nt, Homo Sapiens
auggauccucauaggucaggugaggagagagacagagagagagauguucugggacuccaggucu

SEQ ID NO: 157038 - RNA, 64 nt, Homo Sapiens
gagagagagaauggauccuccuccaggucuugaggagagagacauuuggagcacuguucuggga

SEQ ID NO: 157039 - RNA, 64 nt, Homo Sapiens
caucugacacuucuuuuggauuggggacaagggagagagagacuagggagagccccacaaaacu

SEQ ID NO: 157040 - RNA, 64 nt, Homo Sapiens
cucaucugacacuucuuuugcuuuggggacaagggagagagagaaaagggagagccccacaaaa

SEQ ID NO: 157041 - RNA, 64 nt, Homo Sapiens
cucagaguggaaggaggggggagagagagagagagagagagaucgagagagacagaaagagaga

SEQ ID NO: 157042 - RNA, 64 nt, Homo Sapiens
uccucagaguggaaggaggggagagagagagagagagagagagagagagagagacagaaagaga

SEQ ID NO: 157043 - RNA, 64 nt, Homo Sapiens
gauccucagaguggaaggaggagagagagagagagagagagagagagagagagagacagaaaga

SEQ ID NO: 157044 - RNA, 64 nt, Homo Sapiens
gagauccucagaguggaagggagagagagagagagagagagagacagagagagagagacagaaa

SEQ ID NO: 157045 - RNA, 64 nt, Homo Sapiens
gagagauccucagaguggaaaagagagagagagagagagagagaagcagagagagagagacaga

SEQ ID NO: 157046 - RNA, 64 nt, Homo Sapiens
gagagagauccucagagugggaaagagagagagagagagagagaguagcagagagagagagaca

SEQ ID NO: 157047 - RNA, 64 nt, Homo Sapiens
gagagagagauccucagagucagaaagagagagagagagagagaggguagcagagagagagaga

SEQ ID NO: 157048 - RNA, 64 nt, Homo Sapiens
gagagagagagauccucagagacagaaagagagagagagagagaaaggguagcagagagagaga

SEQ ID NO: 157049 - RNA, 64 nt, Homo Sapiens
gagagagagagagauccucagagacagaaagagagagagagagaggaaggguagcagagagaga

SEQ ID NO: 157050 - RNA, 64 nt, Homo Sapiens
gagagagagagagagauccugagagacagaaagagagagagagaugggaaggguagcagagaga

SEQ ID NO: 157051 - RNA, 64 nt, Homo Sapiens
gagagagagagagagagaucgagagagacagaaagagagagagaguugggaaggguagcagaga

SEQ ID NO: 157052 - RNA, 64 nt, Homo Sapiens
gaaagagagagagagagagaaaggguagcagagagagagagacagugucugagggcagguuggg

SEQ ID NO: 157053 - RNA, 64 nt, Homo Sapiens
cagaaagagagagagagagaggaaggguagcagagagagagagacagugucugagggcagguug

SEQ ID NO: 157054 - RNA, 64 nt, Homo Sapiens
gacagaaagagagagagagaugggaaggguagcagagagagagaugcagugucugagggcaggu

SEQ ID NO: 157055 - RNA, 64 nt, Homo Sapiens
acuugauucauuaaaaaguccugugugugugugagagagagaguuaaaaauguguguguguguu

SEQ ID NO: 157056 - RNA, 64 nt, Homo Sapiens
guacuugauucauuaaaaaguucugugugugugugagagagagauauaaaaaugugugugugug

SEQ ID NO: 157057 - RNA, 64 nt, Homo Sapiens
uguauuggagaaggacugggucagagaucuguuggagagagagaauaaagagauuauuuuucau

SEQ ID NO: 157058 - RNA, 64 nt, Homo Sapiens
uauuggagaaggacugggucagagaucuguuggagagagagaauaaagagauuauuuuucauua

SEQ ID NO: 157059 - RNA, 64 nt, Homo Sapiens
cgagcacacauaaaagcacaaagacagagacgcagagagagagagagagccacggagaggaaaa

SEQ ID NO: 157060 - RNA, 64 nt, Homo Sapiens
agcacacauaaaagcacaaagacagagacgcagagagagagagagagccacggagaggaaaagc

SEQ ID NO: 157061 - RNA, 64 nt, Homo Sapiens
cacacauaaaagcacaaagacagagacgcagagagagagagagagccacggagaggaaaagcag

SEQ ID NO: 157062 - RNA, 64 nt, Homo Sapiens
cacauaaaagcacaaagacagagacgcagagagagagagagagccacggagaggaaaagcagau

SEQ ID NO: 157063 - RNA, 64 nt, Homo Sapiens
caucgcccagcaccccugcugauaccaccagacagagagagagagcacuugauucuucccgaga

SEQ ID NO: 157064 - RNA, 64 nt, Homo Sapiens
ucgcccagcaccccugcugauaccaccagacagagagagagagcacuugauucuucccgagaua

SEQ ID NO: 157065 - RNA, 64 nt, Homo Sapiens
acaguccacagguggacaaagggauccccagccagagagagagagaccagccaacagcuugaua

SEQ ID NO: 157066 - RNA, 64 nt, Homo Sapiens
aguccacagguggacaaagggauccccagccagagagagagagaccagccaacagcuugauaga

SEQ ID NO: 157067 - RNA, 64 nt, Homo Sapiens
uccacagguggacaaagggauccccagccagagagagagagaccagccaacagcuugauagacc

SEQ ID NO: 157068 - RNA, 64 nt, Homo Sapiens
guguguguguguguguguguguguguguguggcagagagagagaaagagagagagagagagaaa

SEQ ID NO: 157069 - RNA, 64 nt, Homo Sapiens
guguguguguguguguguguguguguguggcagagagagagaaagagagagagagagagaaauu

SEQ ID NO: 157070 - RNA, 64 nt, Homo Sapiens
guguguguguguguguguggcagagagagagaaagagagagagagagagaaauucuguuaaaau

SEQ ID NO: 157071 - RNA, 64 nt, Homo Sapiens
guguguguguguguguggcagagagagagaaagagagagagagagagaaauucuguuaaaaucu

SEQ ID NO: 157072 - RNA, 64 nt, Homo Sapiens
guguguguguguguggcagagagagagaaagagagagagagagagaaauucuguuaaaaucuau

SEQ ID NO: 157073 - RNA, 64 nt, Homo Sapiens
guguguguguguggcagagagagagaaagagagagagagagagaaauucuguuaaaaucuauuc

SEQ ID NO: 157074 - RNA, 64 nt, Homo Sapiens
guguguguguggcagagagagagaaagagagagagagagagaaauucuguuaaaaucuauucug

SEQ ID NO: 157075 - RNA, 64 nt, Homo Sapiens
aggggauagcagugaggucagaagucuuucccgggagagagauggccuggguuaucauugcuga

SEQ ID NO: 157076 - RNA, 64 nt, Homo Sapiens
cagacauaggacugagccaaggaagagucugccugagagagacgcuuggccugugcuuugcugc

SEQ ID NO: 157077 - RNA, 64 nt, Homo Sapiens
aagaccaugcugcauacauugagaaaaagagagagagagagaaauguuuccaguuccguucuga

SEQ ID NO: 157078 - RNA, 64 nt, Homo Sapiens
aaaagaccaugcugcauacagagagaaaaagagagagagagagagcuguuuccaguuccguucu

SEQ ID NO: 157079 - RNA, 64 nt, Homo Sapiens
gaaaaagaccaugcugcauacugagagaaaaagagagagagagauugcuguuuccaguuccguu

SEQ ID NO: 157080 - RNA, 64 nt, Homo Sapiens
gagaaaaagaccaugcugcauucugagagaaaaagagagagagauguugcuguuuccaguuccg

SEQ ID NO: 157081 - RNA, 64 nt, Homo Sapiens
acugaaaaagcaacuccucugguucacacagagagagagagaguggcuuucugaaagaucuagu

SEQ ID NO: 157082 - RNA, 64 nt, Homo Sapiens
guacugaaaaagcaacuccugugguucacacagagagagagagacaggcuuucugaaagaucua

SEQ ID NO: 157083 - RNA, 64 nt, Homo Sapiens
gaguacugaaaaagcaacucuagugguucacacagagagagagaaccaggcuuucugaaagauc

SEQ ID NO: 157084 - RNA, 64 nt, Homo Sapiens
augugugugugugugugcgugugugcauaagagagagagagaauuuguugggauguggauggau

SEQ ID NO: 157085 - RNA, 64 nt, Homo Sapiens
auaugugugugugugugugcaugugugcauaagagagagagagaaauuguugggauguggaugg

SEQ ID NO: 157086 - RNA, 64 nt, Homo Sapiens
gaauauguguguguguguguggaugugugcauaagagagagagagcaauuguugggauguggau

SEQ ID NO: 157087 - RNA, 64 nt, Homo Sapiens
gauggaggagaagaacuugggagagagagagagagagagagaaaagggggaaaagagagagaga

SEQ ID NO: 157088 - RNA, 64 nt, Homo Sapiens
aagauggaggagaagaacuugagagagagagagagagagagagaggagggggaaaagagagaga

SEQ ID NO: 157089 - RNA, 64 nt, Homo Sapiens
gaaagauggaggagaagaacgagagagagagagagagagagagaggggagggggaaaagagaga

SEQ ID NO: 157090 - RNA, 64 nt, Homo Sapiens
gagaaagauggaggagaagagagagagagagagagagagagagagaggggagggggaaaagaga

SEQ ID NO: 157091 - RNA, 64 nt, Homo Sapiens
gagagaaagauggaggagaagagagagagagagagagagagagacagaggggagggggaaaaga

SEQ ID NO: 157092 - RNA, 64 nt, Homo Sapiens
gagagagaaagauggaggaggagagagagagagagagagagagaugcagaggggagggggaaaa

SEQ ID NO: 157093 - RNA, 64 nt, Homo Sapiens
gagagagagaaagauggaggaagagagagagagagagagagagaauugcagaggggagggggaa

SEQ ID NO: 157094 - RNA, 64 nt, Homo Sapiens
gagagagagagaaagauggaaaaagagagagagagagagagagagaauugcagaggggaggggg

SEQ ID NO: 157095 - RNA, 64 nt, Homo Sapiens
gagagagagagagaaagaugggaaaagagagagagagagagagagugaauugcagaggggaggg

SEQ ID NO: 157096 - RNA, 64 nt, Homo Sapiens
gagagagagagagagaaagaggggaaaagagagagagagagagaaagugaauugcagaggggag

SEQ ID NO: 157097 - RNA, 64 nt, Homo Sapiens
gagagagagagagagagaaaagggggaaaagagagagagagagaggaagugaauugcagagggg

SEQ ID NO: 157098 - RNA, 64 nt, Homo Sapiens
gagagagagagagagagagaggagggggaaaagagagagagagaagggaagugaauugcagagg

SEQ ID NO: 157099 - RNA, 64 nt, Homo Sapiens
gagagagagagagagagagaggggagggggaaaagagagagagaagagggaagugaauugcaga

SEQ ID NO: 157100 - RNA, 64 nt, Homo Sapiens
gagauggaaugugucugguaaguuccuugauggagagagagaaguugaacucaucugaaucauc

SEQ ID NO: 157101 - RNA, 64 nt, Homo Sapiens
aggagauggaaugugucuggucaguuccuugauggagagagagagauugaacucaucugaauca

SEQ ID NO: 157102 - RNA, 64 nt, Homo Sapiens
agagguaaaggagggagccauggaaagaaagagagagagagaaaccuguucgacugggagguuc

SEQ ID NO: 157103 - RNA, 64 nt, Homo Sapiens
aaagagguaaaggagggagcucuggaaagaaagagagagagagauuccuguucgacugggaggu

SEQ ID NO: 157104 - RNA, 64 nt, Homo Sapiens
gaaaagagguaaaggagggaguucuggaaagaaagagagagagauuuuccuguucgacugggag

SEQ ID NO: 157105 - RNA, 64 nt, Homo Sapiens
auggacgugggagaaagcaaggcugugagucagagagagagaggacaaggcuagaaaccuggcu

SEQ ID NO: 157106 - RNA, 64 nt, Homo Sapiens
ggauggacgugggagaaagccuggcugugagucagagagagagaugacaaggcuagaaaccugg

SEQ ID NO: 157107 - RNA, 64 nt, Homo Sapiens
gggauuugcccuauccacaggccacauuucccuugagagagagugcugaucuagggguuucuug

SEQ ID NO: 157108 - RNA, 64 nt, Homo Sapiens
uggguucaaaaagaaaaaaauaauaaaaauaaaagagagagagaaucagaccuggguggaacuc

SEQ ID NO: 157109 - RNA, 64 nt, Homo Sapiens
gguucaaaaagaaaaaaauaauaaaaauaaaagagagagagaaucagaccuggguggaacucuc

SEQ ID NO: 157110 - RNA, 64 nt, Homo Sapiens
cugccugggguggacauucagcagagugcgaguggagagagagagaugguguuuacucagaacc

SEQ ID NO: 157111 - RNA, 64 nt, Homo Sapiens
gccugggguggacauucagcagagugcgaguggagagagagagaugguguuuacucagaaccug

SEQ ID NO: 157112 - RNA, 64 nt, Homo Sapiens
cugggguggacauucagcagagugcgaguggagagagagagaugguguuuacucagaaccugcu

SEQ ID NO: 157113 - RNA, 64 nt, Homo Sapiens
uguucaaggaaucauuguuuggcauugaaaauaggagagagaucaugagaaauuaccaaaaugu

SEQ ID NO: 157114 - RNA, 64 nt, Homo Sapiens
agaugaagucuuguucaggguauggggcuaggaugagagagaaugccacagaguaugaaggaag

SEQ ID NO: 157115 - RNA, 64 nt, Homo Sapiens
uaucaagucaacaaagaacuuaccuuggaggauagagagagagaagggaccaauuaugaggacu

SEQ ID NO: 157116 - RNA, 64 nt, Homo Sapiens
ucaagucaacaaagaacuuaccuuggaggauagagagagagaagggaccaauuaugaggacuga

SEQ ID NO: 157117 - RNA, 64 nt, Homo Sapiens
accccuuaguguuuggguauauucauuucaaagggagagagagagguuuuuuucuguucugucu

SEQ ID NO: 157118 - RNA, 64 nt, Homo Sapiens
cccuuaguguuuggguauauucauuucaaagggagagagagagguuuuuuucuguucugucuca

SEQ ID NO: 157119 - RNA, 64 nt, Homo Sapiens
cuugguuuugaugcuagagaggaaaaaggacuuggagagagagaaggaauggcugguccagagg

SEQ ID NO: 157120 - RNA, 64 nt, Homo Sapiens
ugguuuugaugcuagagaggaaaaaggacuuggagagagagaaggaauggcugguccagaggcu

SEQ ID NO: 157121 - RNA, 50 nt, Homo Sapiens
gguucacugagauggagugagagagagagagagagagagaugacaaggag

SEQ ID NO: 157122 - RNA, 52 nt, Homo Sapiens
gguucacugagauggagugagagagagagagagagagagaugacaaggagca

SEQ ID NO: 157123 - RNA, 54 nt, Homo Sapiens
gguucacugagauggagugagagagagagagagagagagaugacaaggagcaca

SEQ ID NO: 157124 - RNA, 56 nt, Homo Sapiens
gguucacugagauggagugagagagagagagagagagagaugacaaggagcacaag

SEQ ID NO: 157125 - RNA, 58 nt, Homo Sapiens
gguucacugagauggagugagagagagagagagagagagaugacaaggagcacaagaa

SEQ ID NO: 157126 - RNA, 60 nt, Homo Sapiens
gguucacugagauggagugagagagagagagagagagagaugacaaggagcacaagaagu

SEQ ID NO: 157127 - RNA, 62 nt, Homo Sapiens
gguucacugagauggagugagagagagagagagagagagaugacaaggagcacaagaagugg

SEQ ID NO: 157128 - RNA, 64 nt, Homo Sapiens
aaaaagggaauaagcaaagggggaagaauugaaagagagagagaagaaagaauacagagagcuu

SEQ ID NO: 157129 - RNA, 64 nt, Homo Sapiens
aaagggaauaagcaaagggggaagaauugaaagagagagagaagaaagaauacagagagcuuac

SEQ ID NO: 157130 - RNA, 64 nt, Homo Sapiens
gcuucuuuauguguguguaugugugucagagaaagagagagagagagagagaagggaggaugag

SEQ ID NO: 157131 - RNA, 64 nt, Homo Sapiens
uucuuuauguguguguaugugugucagagaaagagagagagagagagagaagggaggaugagaa

SEQ ID NO: 157132 - RNA, 64 nt, Homo Sapiens
cuuuauguguguguaugugugucagagaaagagagagagagagagagaagggaggaugagaacg

SEQ ID NO: 157133 - RNA, 64 nt, Homo Sapiens
uuauguguguguaugugugucagagaaagagagagagagagagagaagggaggaugagaacgaa

SEQ ID NO: 157134 - RNA, 64 nt, Homo Sapiens
auguguguguaugugugucagagaaagagagagagagagagagaagggaggaugagaacgaaug

SEQ ID NO: 157135 - RNA, 64 nt, Homo Sapiens
guguguguaugugugucagagaaagagagagagagagagagaagggaggaugagaacgaauggg

SEQ ID NO: 157136 - RNA, 64 nt, Homo Sapiens
gugaaagaaccaaaagagaucacaauacucaaaagagagagagagagaaaaaagagagaucuug

SEQ ID NO: 157137 - RNA, 64 nt, Homo Sapiens
gaaagaaccaaaagagaucacaauacucaaaagagagagagagagaaaaaagagagaucuugau

SEQ ID NO: 157138 - RNA, 64 nt, Homo Sapiens
aagaaccaaaagagaucacaauacucaaaagagagagagagagaaaaaagagagaucuugaucc

SEQ ID NO: 157139 - RNA, 64 nt, Homo Sapiens
gaaccaaaagagaucacaauacucaaaagagagagagagagaaaaaagagagaucuugauccac

SEQ ID NO: 157140 - RNA, 64 nt, Homo Sapiens
agugugugcagaaaucaaaugacagagaggaagugagagagagaggugucggggaggugccagg

SEQ ID NO: 157141 - RNA, 64 nt, Homo Sapiens
ugugugcagaaaucaaaugacagagaggaagugagagagagaggugucggggaggugccaggcu

SEQ ID NO: 157142 - RNA, 64 nt, Homo Sapiens
cguuggugcuacacagcuagaauagauauauuuagagagagagauauuuuuaagacaaagccca

SEQ ID NO: 157143 - RNA, 64 nt, Homo Sapiens
uuggugcuacacagcuagaauagauauauuuagagagagagauauuuuuaagacaaagcccaca

SEQ ID NO: 157144 - RNA, 64 nt, Homo Sapiens
guuggcauuggaagcuuauucuuuuuguucacuggagagagagagaacuguuuacaguuaaucu

SEQ ID NO: 157145 - RNA, 64 nt, Homo Sapiens
uggcauuggaagcuuauucuuuuuguucacuggagagagagagaacuguuuacaguuaaucugu

SEQ ID NO: 157146 - RNA, 64 nt, Homo Sapiens
gcauuggaagcuuauucuuuuuguucacuggagagagagagaacuguuuacaguuaaucugugu

SEQ ID NO: 157147 - RNA, 64 nt, Homo Sapiens
cuaacaggaccaucacagcuucugaacugagccggagagagagaauggaauugcugaccccugg

SEQ ID NO: 157148 - RNA, 64 nt, Homo Sapiens
aacaggaccaucacagcuucugaacugagccggagagagagaauggaauugcugaccccuggaa

SEQ ID NO: 157149 - RNA, 64 nt, Homo Sapiens
guauaaaaacauagacuggaggagguaauccauggagagagaaaaagaagagggcucaggacaa

SEQ ID NO: 157150 - RNA, 64 nt, Homo Sapiens
ccaauauugauggcaacagucaagauggugugaugagagagaugggaggggcacaaagaggagg

SEQ ID NO: 157151 - RNA, 64 nt, Homo Sapiens
uuauauacuaugaaaagugcaagaaaugaugagagagagagaaagagaccuuguauuagcaucc

SEQ ID NO: 157152 - RNA, 64 nt, Homo Sapiens
aauuauauacuaugaaaaguccaagaaaugaugagagagagagacugagaccuuguauuagcau

SEQ ID NO: 157153 - RNA, 64 nt, Homo Sapiens
gaaauuauauacuaugaaaaauccaagaaaugaugagagagagacacugagaccuuguauuagc

SEQ ID NO: 157154 - RNA, 64 nt, Homo Sapiens
aaaagaguaggaaaaugagacaaaaaaaaaaagagagagagaugaacagagugagacuccaucu

SEQ ID NO: 157155 - RNA, 64 nt, Homo Sapiens
ugaaaagaguaggaaaaugacucaaaaaaaaaaagagagagagagcaacagagugagacuccau

SEQ ID NO: 157156 - RNA, 64 nt, Homo Sapiens
cagacaagcaaacucaaaaucuaauaggucaagagagagagaccaacaccugccccgaagacuc

SEQ ID NO: 157157 - RNA, 64 nt, Homo Sapiens
cccagacaagcaaacucaaauccuaauaggucaagagagagagacaaacaccugccccgaagac

SEQ ID NO: 157158 - RNA, 64 nt, Homo Sapiens
augagcaaauguauugcuucaaaugauaccuggagagagagauuauuuucauuaauaauaugag

SEQ ID NO: 157159 - RNA, 64 nt, Homo Sapiens
uuaugagcaaauguauugcuagaaaugauaccuggagagagagagcauuuucauuaauaauaug

SEQ ID NO: 157160 - RNA, 64 nt, Homo Sapiens
aauaauauuaacacaaaaaaaauauuaaaacgaggagagagaaaggaagagcaagaaaagagaa

SEQ ID NO: 157161 - RNA, 64 nt, Homo Sapiens
ggacaggggagugcuggaacuuugggggagucuggagagagacuuuggguuuuguaggagcggg

SEQ ID NO: 157162 - RNA, 64 nt, Homo Sapiens
auuggagauguccugaauuucaaagaaaaacagagagagagaauuuuaaaaaaaaaaaagauga

SEQ ID NO: 157163 - RNA, 64 nt, Homo Sapiens
auauuggagauguccugaaugacaaagaaaaacagagagagagauauuuaaaaaaaaaaaagau

SEQ ID NO: 157164 - RNA, 64 nt, Homo Sapiens
ccggcucuuaaaaaaaaaaaaaaaaaaaaaaaaagagagagagagaauaaauagaaaagaaugu

SEQ ID NO: 157165 - RNA, 64 nt, Homo Sapiens
ggcucuuaaaaaaaaaaaaaaaaaaaaaaaaagagagagagagaauaaauagaaaagaaugugg

SEQ ID NO: 157166 - RNA, 64 nt, Homo Sapiens
cucuuaaaaaaaaaaaaaaaaaaaaaaaaagagagagagagaauaaauagaaaagaauguggcu

SEQ ID NO: 157167 - RNA, 64 nt, Homo Sapiens
cuucaauaauguucaacugaaucucacagaugaggagagagaagaaacggaagaggaaguuuau

SEQ ID NO: 157168 - RNA, 64 nt, Homo Sapiens
ugguggaauggaggaguuguuuggggagggaaaggagagagaaggaaaggagugagguauuucc

SEQ ID NO: 157169 - RNA, 64 nt, Homo Sapiens
ugcuguucguucaaaagugggagagagagaucuugagagagaaacaucugacaaauucaaaaga

SEQ ID NO: 157170 - RNA, 64 nt, Homo Sapiens
uugagagagaaaugcuguucaaauucaaaagagagagagagaucccugcguaacuccaucugac

SEQ ID NO: 157171 - RNA, 64 nt, Homo Sapiens
ucuugagagagaaaugcuguacaaauucaaaagagagagagagaaaccugcguaacuccaucug

SEQ ID NO: 157172 - RNA, 64 nt, Homo Sapiens
gaucuugagagagaaaugcuugacaaauucaaaagagagagagagaaaccugcguaacuccauc

SEQ ID NO: 157173 - RNA, 64 nt, Homo Sapiens
agugacuguguugugauucauaguacauuaaaaagagagagagagagaaagaaucccacagggc

SEQ ID NO: 157174 - RNA, 64 nt, Homo Sapiens
ugacuguguugugauucauaguacauuaaaaagagagagagagagaaagaaucccacagggcac

SEQ ID NO: 157175 - RNA, 64 nt, Homo Sapiens
acuguguugugauucauaguacauuaaaaagagagagagagagaaagaaucccacagggcacua

SEQ ID NO: 157176 - RNA, 64 nt, Homo Sapiens
uguguugugauucauaguacauuaaaaagagagagagagagaaagaaucccacagggcacuauu

SEQ ID NO: 157177 - RNA, 64 nt, Homo Sapiens
aacugacuucugcuagguagaggcauuugucuuagagagagagagagcgcgggagagagugaga

SEQ ID NO: 157178 - RNA, 64 nt, Homo Sapiens
cugacuucugcuagguagaggcauuugucuuagagagagagagagcgcgggagagagugagaga

SEQ ID NO: 157179 - RNA, 64 nt, Homo Sapiens
gacuucugcuagguagaggcauuugucuuagagagagagagagcgcgggagagagugagagaga

SEQ ID NO: 157180 - RNA, 64 nt, Homo Sapiens
uugucuuagagagagagagagcgcgggagagagugagagagagugagagcacaaagauaacgca

SEQ ID NO: 157181 - RNA, 64 nt, Homo Sapiens
agugagagagagugagagcacaaagauaacgcaggagagagagagagaaagaaugagaaagaaa

SEQ ID NO: 157182 - RNA, 64 nt, Homo Sapiens
ugagagagagugagagcacaaagauaacgcaggagagagagagagaaagaaugagaaagaaaag

SEQ ID NO: 157183 - RNA, 64 nt, Homo Sapiens
agagagagugagagcacaaagauaacgcaggagagagagagagaaagaaugagaaagaaaagga

SEQ ID NO: 157184 - RNA, 64 nt, Homo Sapiens
agagagugagagcacaaagauaacgcaggagagagagagagaaagaaugagaaagaaaaggaau

SEQ ID NO: 157185 - RNA, 64 nt, Homo Sapiens
aggaacaauagauuauuucuguuuuacuccaaaagagagagagagagugagugugagugugugu

SEQ ID NO: 157186 - RNA, 64 nt, Homo Sapiens
gaacaauagauuauuucuguuuuacuccaaaagagagagagagagugagugugagugugugugu

SEQ ID NO: 157187 - RNA, 64 nt, Homo Sapiens
acaauagauuauuucuguuuuacuccaaaagagagagagagagugagugugagugugugugugu

SEQ ID NO: 157188 - RNA, 64 nt, Homo Sapiens
gaggauccaaacuuccugcaacauuuucuuagaggagagagagaaauauuaaaagagaaaugaa

SEQ ID NO: 157189 - RNA, 64 nt, Homo Sapiens
ggauccaaacuuccugcaacauuuucuuagaggagagagagaaauauuaaaagagaaaugaaac

SEQ ID NO: 157190 - RNA, 64 nt, Homo Sapiens
caggaagucgagacaccaucccagguguguguaagagagagagagagaacagggaggauacaga

SEQ ID NO: 157191 - RNA, 64 nt, Homo Sapiens
ggaagucgagacaccaucccagguguguguaagagagagagagagaacagggaggauacagaag

SEQ ID NO: 157192 - RNA, 64 nt, Homo Sapiens
aagucgagacaccaucccagguguguguaagagagagagagagaacagggaggauacagaagua

SEQ ID NO: 157193 - RNA, 64 nt, Homo Sapiens
gucgagacaccaucccagguguguguaagagagagagagagaacagggaggauacagaaguauu

SEQ ID NO: 157194 - RNA, 64 nt, Homo Sapiens
ugugagggacaaaaugcaaaaaaaaaaagagagagagagagagguugcuaagaugcauuuaaua

SEQ ID NO: 157195 - RNA, 64 nt, Homo Sapiens
ggugugagggacaaaaugcauaaaaaaaaagagagagagagagauuuugcuaagaugcauuuaa

SEQ ID NO: 157196 - RNA, 64 nt, Homo Sapiens
gaggugugagggacaaaaugaauaaaaaaaaagagagagagagaacuuuugcuaagaugcauuu

SEQ ID NO: 157197 - RNA, 64 nt, Homo Sapiens
gagaggugugagggacaaaauuaauaaaaaaaaagagagagagacuacuuuugcuaagaugcau

SEQ ID NO: 157198 - RNA, 64 nt, Homo Sapiens
uggaaggggcucuggcucccagggaagaugaagagagagagauuuucuuccuccccuugcuucc

SEQ ID NO: 157199 - RNA, 64 nt, Homo Sapiens
uuuggaaggggcucuggcucccagggaagaugaagagagagagaacuucuuccuccccuugcuu

SEQ ID NO: 157200 - RNA, 64 nt, Homo Sapiens
ggguuuccucagugcccuuuggcuguugaggagugagagagagagagagagagagagagagaga

SEQ ID NO: 157201 - RNA, 64 nt, Homo Sapiens
guuuccucagugcccuuuggcuguugaggagugagagagagagagagagagagagagagagaga

SEQ ID NO: 157202 - RNA, 64 nt, Homo Sapiens
uuccucagugcccuuuggcuguugaggagugagagagagagagagagagagagagagagagaga

SEQ ID NO: 157203 - RNA, 64 nt, Homo Sapiens
ccucagugcccuuuggcuguugaggagugagagagagagagagagagagagagagagagagaga

SEQ ID NO: 157204 - RNA, 64 nt, Homo Sapiens
ucagugcccuuuggcuguugaggagugagagagagagagagagagagagagagagagagagaga

SEQ ID NO: 157205 - RNA, 64 nt, Homo Sapiens
agugcccuuuggcuguugaggagugagagagagagagagagagagagagagagagagagagaga

SEQ ID NO: 157206 - RNA, 64 nt, Homo Sapiens
ugcccuuuggcuguugaggagugagagagagagagagagagagagagagagagagagagagaga

SEQ ID NO: 157207 - RNA, 64 nt, Homo Sapiens
cccuuuggcuguugaggagugagagagagagagagagagagagagagagagagagagagagaca

SEQ ID NO: 157208 - RNA, 64 nt, Homo Sapiens
cuuuggcuguugaggagugagagagagagagagagagagagagagagagagagagagagacaag

SEQ ID NO: 157209 - RNA, 64 nt, Homo Sapiens
uuggcuguugaggagugagagagagagagagagagagagagagagagagagagagagacaagca

SEQ ID NO: 157210 - RNA, 64 nt, Homo Sapiens
ggcuguugaggagugagagagagagagagagagagagagagagagagagagagagacaagcagg

SEQ ID NO: 157211 - RNA, 64 nt, Homo Sapiens
cuguugaggagugagagagagagagagagagagagagagagagagagagagagacaagcaggag

SEQ ID NO: 157212 - RNA, 64 nt, Homo Sapiens
guugaggagugagagagagagagagagagagagagagagagagagagagagacaagcaggagcg

SEQ ID NO: 157213 - RNA, 64 nt, Homo Sapiens
ugaggagugagagagagagagagagagagagagagagagagagagagagacaagcaggagcgug

SEQ ID NO: 157214 - RNA, 64 nt, Homo Sapiens
aggagugagagagagagagagagagagagagagagagagagagagagacaagcaggagcguggc

SEQ ID NO: 157215 - RNA, 64 nt, Homo Sapiens
gagugagagagagagagagagagagagagagagagagagagagagacaagcaggagcguggcug

SEQ ID NO: 157216 - RNA, 64 nt, Homo Sapiens
gugagagagagagagagagagagagagagagagagagagagagacaagcaggagcguggcugcu

SEQ ID NO: 157217 - RNA, 64 nt, Homo Sapiens
gagagagagagagagagagagagagagagagagagagagagacaagcaggagcguggcugcucg

SEQ ID NO: 157218 - RNA, 64 nt, Homo Sapiens
cacagucacauucgaauucggguggcauccuccggagagagagagaggaaggagauuccacaca

SEQ ID NO: 157219 - RNA, 64 nt, Homo Sapiens
cagucacauucgaauucggguggcauccuccggagagagagagaggaaggagauuccacacagg

SEQ ID NO: 157220 - RNA, 64 nt, Homo Sapiens
gucacauucgaauucggguggcauccuccggagagagagagaggaaggagauuccacacagggg

SEQ ID NO: 157221 - RNA, 64 nt, Homo Sapiens
gccaaccuagaaacguuuucauucgucauuccaagagagagagaggaaagaaaaauacaacuuu

SEQ ID NO: 157222 - RNA, 64 nt, Homo Sapiens
caaccuagaaacguuuucauucgucauuccaagagagagagaggaaagaaaaauacaacuuuca

SEQ ID NO: 157223 - RNA, 64 nt, Homo Sapiens
uuucagccuagugggagagagugggggagaggaagagagagagagagcauguauacccguaugu

SEQ ID NO: 157224 - RNA, 64 nt, Homo Sapiens
ucagccuagugggagagagugggggagaggaagagagagagagagcauguauacccguauguua

SEQ ID NO: 157225 - RNA, 64 nt, Homo Sapiens
agccuagugggagagagugggggagaggaagagagagagagagcauguauacccguauguuauc

SEQ ID NO: 157226 - RNA, 64 nt, Homo Sapiens
ggagagagugaggagagugugugauagcuagaaagagagagagacagagagauggcaagcacug

SEQ ID NO: 157227 - RNA, 64 nt, Homo Sapiens
agagagugaggagagugugugauagcuagaaagagagagagacagagagauggcaagcacugag

SEQ ID NO: 157228 - RNA, 64 nt, Homo Sapiens
uaauuuaaaaaguuuauuauuuaaaaaaaaaagagagagagauggacauaaaagagccuugauu

SEQ ID NO: 157229 - RNA, 64 nt, Homo Sapiens
uguaauuuaaaaaguuuauuuuuuaaaaaaaaaagagagagagauugacauaaaagagccuuga

SEQ ID NO: 157230 - RNA, 64 nt, Homo Sapiens
gcauaaauguaauaacugagaagaauccacaugagagagagacucauggccuuauuugacuuca

SEQ ID NO: 157231 - RNA, 64 nt, Homo Sapiens
cugcauaaauguaauaacugcaaagaauccacaugagagagagacacauggccuuauuugacuu

SEQ ID NO: 157232 - RNA, 63 nt, Homo Sapiens
aucuggguguuggugguugcacugaaaauaaagagagagagagaucuggauaacagcaaaaaa

SEQ ID NO: 157233 - RNA, 64 nt, Homo Sapiens
gaucuggguguuggugguugaaacugaaaauaaagagagagagauuaucuggauaacagcaaaa

SEQ ID NO: 157234 - RNA, 64 nt, Homo Sapiens
agagcagauuuuaaaaaaaaccacuggggaaagagagagagaaaaucagcuccauaucugcauu

SEQ ID NO: 157235 - RNA, 64 nt, Homo Sapiens
aaagagcagauuuuaaaaaauuccacuggggaaagagagagagaucaucagcuccauaucugca

SEQ ID NO: 157236 - RNA, 64 nt, Homo Sapiens
aagacccaaguuuugaaucugagagagagagcgcgagagagaucagagacaauggagagagaaa

SEQ ID NO: 157237 - RNA, 64 nt, Homo Sapiens
gcgagagagaucaagacccauggagagagaaagagagagagagccacaguuuuucuagagacaa

SEQ ID NO: 157238 - RNA, 64 nt, Homo Sapiens
gcgcgagagagaucaagaccaauggagagagaaagagagagagagccacaguuuuucuagagac

SEQ ID NO: 157239 - RNA, 64 nt, Homo Sapiens
gagagagagagcgcgagagauucuagagacaauggagagagaaacucuguccuugccacaguuu

SEQ ID NO: 157240 - RNA, 64 nt, Homo Sapiens
ggcuugacauggugggcacacuggcgcccaguaagagagagagagagccaaagcuguccguuuu

SEQ ID NO: 157241 - RNA, 64 nt, Homo Sapiens
cuugacauggugggcacacuggcgcccaguaagagagagagagagccaaagcuguccguuuugc

SEQ ID NO: 157242 - RNA, 64 nt, Homo Sapiens
ugacauggugggcacacuggcgcccaguaagagagagagagagccaaagcuguccguuuugcag

SEQ ID NO: 157243 - RNA, 64 nt, Homo Sapiens
ggagccaggacacagcucagcuugcucacgcccagagagagaaaaaguuaagcugcugacccug

SEQ ID NO: 157244 - RNA, 64 nt, Homo Sapiens
uuuugucccaaagugaguaaaauccccuagagcagagagagagagagagagagagagugucuuc

SEQ ID NO: 157245 - RNA, 64 nt, Homo Sapiens
uugucccaaagugaguaaaauccccuagagcagagagagagagagagagagagagugucuucau

SEQ ID NO: 157246 - RNA, 64 nt, Homo Sapiens
gucccaaagugaguaaaauccccuagagcagagagagagagagagagagagagugucuucaugc

SEQ ID NO: 157247 - RNA, 64 nt, Homo Sapiens
cccaaagugaguaaaauccccuagagcagagagagagagagagagagagagugucuucaugcca

SEQ ID NO: 157248 - RNA, 64 nt, Homo Sapiens
caaagugaguaaaauccccuagagcagagagagagagagagagagagagugucuucaugccaac

SEQ ID NO: 157249 - RNA, 64 nt, Homo Sapiens
aagugaguaaaauccccuagagcagagagagagagagagagagagagugucuucaugccaacca

SEQ ID NO: 157250 - RNA, 64 nt, Homo Sapiens
gugaguaaaauccccuagagcagagagagagagagagagagagagugucuucaugccaaccaca

SEQ ID NO: 157251 - RNA, 64 nt, Homo Sapiens
gaguaaaauccccuagagcagagagagagagagagagagagagugucuucaugccaaccacagc

SEQ ID NO: 157252 - RNA, 64 nt, Homo Sapiens
ccugccuuugggucgacauaguauggaaguauuugagagagagaaccuuuccacucccacugcc

SEQ ID NO: 157253 - RNA, 64 nt, Homo Sapiens
ugccuuugggucgacauaguauggaaguauuugagagagagaaccuuuccacucccacugccag

SEQ ID NO: 157254 - RNA, 64 nt, Homo Sapiens
gcacggcugaggcugagucaaucauucagagugagagagagaaaaaagcaaauguacuuaaguc

SEQ ID NO: 157255 - RNA, 64 nt, Homo Sapiens
aagcacggcugaggcugaguucaucauucagagugagagagagaguaaagcaaauguacuuaag

SEQ ID NO: 157256 - RNA, 64 nt, Homo Sapiens
gaggacccuccucacuacccucucugauaauggagagagagacacauugcaaaugcuuuagaaa

SEQ ID NO: 157257 - RNA, 64 nt, Homo Sapiens
cagaggacccuccucacuacaaucucugauaauggagagagagaagcauugcaaaugcuuuaga

SEQ ID NO: 157258 - RNA, 64 nt, Homo Sapiens
gugauuuuuggccuuguggcgaggagaggagagagagagagaaugcacugaggagaaugguaga

SEQ ID NO: 157259 - RNA, 64 nt, Homo Sapiens
augugauuuuuggccuuguggagaggagaggagagagagagagauggcacugaggagaauggua

SEQ ID NO: 157260 - RNA, 64 nt, Homo Sapiens
gaaugugauuuuuggccuuguagagaggagaggagagagagagaccuggcacugaggagaaugg

SEQ ID NO: 157261 - RNA, 64 nt, Homo Sapiens
gagaaugugauuuuuggccugguagagaggagaggagagagagacaccuggcacugaggagaau

SEQ ID NO: 157262 - RNA, 64 nt, Homo Sapiens
gaaauagaagagaagagccaaaaaaaaagagagagagagagaaaagugagacuccaucucaaaa

SEQ ID NO: 157263 - RNA, 64 nt, Homo Sapiens
aagaaauagaagagaagagcaaaaaaaaaagagagagagagagaagagugagacuccaucucaa

SEQ ID NO: 157264 - RNA, 64 nt, Homo Sapiens
gaaagaaauagaagagaagaaaaaaaaaaaaagagagagagagaacagagugagacuccaucuc

SEQ ID NO: 157265 - RNA, 64 nt, Homo Sapiens
gagaaagaaauagaagagaaucaaaaaaaaaaaagagagagagaucacagagugagacuccauc

SEQ ID NO: 157266 - RNA, 64 nt, Homo Sapiens
gcaguuuccaaggauauguugagaaagacgaagggagagagaaaggaaagaagagggagggaga

SEQ ID NO: 157267 - RNA, 64 nt, Homo Sapiens
gacgaagggagagagaaagcaaagaagagggagggagagagaaacaguacugaagagaaauggg

SEQ ID NO: 157268 - RNA, 64 nt, Homo Sapiens
ugccaaaguaacagcaaaaauguuggggauuggagagagagaaugaugugcacugaacucggga

SEQ ID NO: 157269 - RNA, 64 nt, Homo Sapiens
auugccaaaguaacagcaaagauguuggggauuggagagagagauagaugugcacugaacucgg

SEQ ID NO: 157270 - RNA, 64 nt, Homo Sapiens
uaagcugugaucaugccacugcauuccagccugggagagagagaggaccugucuguugaaaaaa

SEQ ID NO: 157271 - RNA, 64 nt, Homo Sapiens
agcugugaucaugccacugcauuccagccugggagagagagaggaccugucuguugaaaaaaac

SEQ ID NO: 157272 - RNA, 64 nt, Homo Sapiens
gcugugggcucagagcucaggagucgccuuaccugagagagauguucuagcugagagggccugg

SEQ ID NO: 157273 - RNA, 64 nt, Homo Sapiens
uggugucccuguccccagagggaggagcaggcaggagagagaggggaaggagguaugaauccca

SEQ ID NO: 157274 - RNA, 64 nt, Homo Sapiens
aauguugacuuaagugagggggaaauaaaacccagagagagagagagagcgagagagagagaca

SEQ ID NO: 157275 - RNA, 64 nt, Homo Sapiens
uguugacuuaagugagggggaaauaaaacccagagagagagagagagcgagagagagagacaug

SEQ ID NO: 157276 - RNA, 64 nt, Homo Sapiens
uugacuuaagugagggggaaauaaaacccagagagagagagagagcgagagagagagacauguu

SEQ ID NO: 157277 - RNA, 64 nt, Homo Sapiens
gacuuaagugagggggaaauaaaacccagagagagagagagagcgagagagagagacauguuac

SEQ ID NO: 157278 - RNA, 64 nt, Homo Sapiens
agggggaaauaaaacccagagagagagagagagcgagagagagagacauguuacuaugaaagac

SEQ ID NO: 157279 - RNA, 64 nt, Homo Sapiens
ggggaaauaaaacccagagagagagagagagcgagagagagagacauguuacuaugaaagacuu

SEQ ID NO: 157280 - RNA, 64 nt, Homo Sapiens
ggaaauaaaacccagagagagagagagagcgagagagagagacauguuacuaugaaagacuugu

SEQ ID NO: 157281 - RNA, 64 nt, Homo Sapiens
gucccagcaguggagugccgggacccucagaguggagagagagacccgggaugugugugcugua

SEQ ID NO: 157282 - RNA, 64 nt, Homo Sapiens
cccagcaguggagugccgggacccucagaguggagagagagacccgggaugugugugcuguacc

SEQ ID NO: 157283 - RNA, 64 nt, Homo Sapiens
gggcuggcuccucucgccccccccagggccaggagagagagacacccgcccucgcggcgggcgc

SEQ ID NO: 157284 - RNA, 64 nt, Homo Sapiens
cagggcuggcuccucucgccgcccccagggccaggagagagagagccccgcccucgcggcgggc

SEQ ID NO: 157285 - RNA, 64 nt, Homo Sapiens
gauagaaaacaagcgcaggacagcaagaagcggggagagagaggucggaaccaggacacaaaag

SEQ ID NO: 157286 - RNA, 64 nt, Homo Sapiens
gauucacucauccugagacuuucuuuuugcaguggagagagagaauaaucuaguuggggcaaac

SEQ ID NO: 157287 - RNA, 64 nt, Homo Sapiens
uucacucauccugagacuuucuuuuugcaguggagagagagaauaaucuaguuggggcaaacac

SEQ ID NO: 157288 - RNA, 64 nt, Homo Sapiens
uugucugcgugugugugugucugugugugugugagagagagaucaguuugggagcugugugugu

SEQ ID NO: 157289 - RNA, 64 nt, Homo Sapiens
ucuugucugcgugugugugugucugugugugugugagagagagaaaaguuugggagcugugugu

SEQ ID NO: 157290 - RNA, 64 nt, Homo Sapiens
aucaaguuuuaauuuggguauguuucuauucugagagagagauguugucccgacauuuuuuuuc

SEQ ID NO: 157291 - RNA, 64 nt, Homo Sapiens
ugaucaaguuuuaauuugggucuguuucuauucugagagagagaacuugucccgacauuuuuuu

SEQ ID NO: 157292 - RNA, 64 nt, Homo Sapiens
acuauuucuugucccuuuuuaccaccgcaugagagagagagauuuugcagugagccaagaucgc

SEQ ID NO: 157293 - RNA, 64 nt, Homo Sapiens
uuacuauuucuugucccuuugcaccaccgcaugagagagagagagguugcagugagccaagauc

SEQ ID NO: 157294 - RNA, 64 nt, Homo Sapiens
gauuacuauuucuugucccuucgcaccaccgcaugagagagagagagguugcagugagccaaga

SEQ ID NO: 157295 - RNA, 64 nt, Homo Sapiens
uugacgguuguagauauuuuguguguaugagagagagagagacugugugugugugugugugugu

SEQ ID NO: 157296 - RNA, 64 nt, Homo Sapiens
cuuugacgguuguagauauuguguguguaugagagagagagagagugugugugugugugugugu

SEQ ID NO: 157297 - RNA, 64 nt, Homo Sapiens
gacuuugacgguuguagauaguguguguguaugagagagagagagugugugugugugugugugu

SEQ ID NO: 157298 - RNA, 64 nt, Homo Sapiens
gagacuuugacgguuguagaguguguguguguaugagagagagagugugugugugugugugugu

SEQ ID NO: 157299 - RNA, 64 nt, Homo Sapiens
aguaaaugggggccguugggcuaucuggugacaagagagagacagaggcagcgccuuugucugu

SEQ ID NO: 157300 - RNA, 64 nt, Homo Sapiens
caagacuccaucucaaaaaauaaauaaauagaaagagagagagaggaaaaaaaaagaaaagaac

SEQ ID NO: 157301 - RNA, 64 nt, Homo Sapiens
agacuccaucucaaaaaauaaauaaauagaaagagagagagaggaaaaaaaaagaaaagaacac

SEQ ID NO: 157302 - RNA, 64 nt, Homo Sapiens
agcccuaucuccugcaaccucagugccucagccugagagagagaugagaugcucuuggacuccc

SEQ ID NO: 157303 - RNA, 64 nt, Homo Sapiens
cccuaucuccugcaaccucagugccucagccugagagagagaugagaugcucuuggacucccca

SEQ ID NO: 157304 - RNA, 64 nt, Homo Sapiens
gugagagacacagagagaaggagaaagagggagggagagagagaaagagagagaaagagagaga

SEQ ID NO: 157305 - RNA, 64 nt, Homo Sapiens
gagagacacagagagaaggagaaagagggagggagagagagaaagagagagaaagagagagaga

SEQ ID NO: 157306 - RNA, 64 nt, Homo Sapiens
gagagaaggagaaagagggagggagagagagaaagagagagaaagagagagagagagagagaga

SEQ ID NO: 157307 - RNA, 64 nt, Homo Sapiens
gaaagagggagggagagagagaaagagagagaaagagagagagagagagagagagagaaagcug

SEQ ID NO: 157308 - RNA, 64 nt, Homo Sapiens
aagagggagggagagagagaaagagagagaaagagagagagagagagagagagagaaagcugaa

SEQ ID NO: 157309 - RNA, 64 nt, Homo Sapiens
gagggagggagagagagaaagagagagaaagagagagagagagagagagagagaaagcugaacg

SEQ ID NO: 157310 - RNA, 64 nt, Homo Sapiens
gggagggagagagagaaagagagagaaagagagagagagagagagagagagaaagcugaacgug

SEQ ID NO: 157311 - RNA, 64 nt, Homo Sapiens
gagggagagagagaaagagagagaaagagagagagagagagagagagagaaagcugaacgugca

SEQ ID NO: 157312 - RNA, 64 nt, Homo Sapiens
gggagagagagaaagagagagaaagagagagagagagagagagagagaaagcugaacgugcacu

SEQ ID NO: 157313 - RNA, 64 nt, Homo Sapiens
gagagagagaaagagagagaaagagagagagagagagagagagagaaagcugaacgugcacucu

SEQ ID NO: 157314 - RNA, 64 nt, Homo Sapiens
gagagagaaagagagagaaagagagagagagagagagagagagaaagcugaacgugcacucuga

SEQ ID NO: 157315 - RNA, 64 nt, Homo Sapiens
gagagaaagagagagaaagagagagagagagagagagagagaaagcugaacgugcacucugaca

SEQ ID NO: 157316 - RNA, 64 nt, Homo Sapiens
aaaccucaacuguguauuuuagaacugugaaagagagagagaaacugccaggggcugguagaca

SEQ ID NO: 157317 - RNA, 64 nt, Homo Sapiens
aaaaaccucaacuguguauucaagaacugugaaagagagagagauucugccaggggcugguaga

SEQ ID NO: 157318 - RNA, 64 nt, Homo Sapiens
cugauaccucuguggggacugagccagcuggagagagagagaucuggagcagccaggcgcucug

SEQ ID NO: 157319 - RNA, 64 nt, Homo Sapiens
uccugauaccucuguggggauggagccagcuggagagagagagaucuggagcagccaggcgcuc

SEQ ID NO: 157320 - RNA, 64 nt, Homo Sapiens
gauccugauaccucugugggucuggagccagcuggagagagagaucucuggagcagccaggcgc

SEQ ID NO: 157321 - RNA, 64 nt, Homo Sapiens
uauuaaacaaauaccccccuaaacaaaaaugggagagagagaggcuagaaaugcaacuuguaua

SEQ ID NO: 157322 - RNA, 64 nt, Homo Sapiens
gguauuaaacaaauacccccuaaaacaaaaaugggagagagagaggcuagaaaugcaacuugua

SEQ ID NO: 157323 - RNA, 64 nt, Homo Sapiens
agcaucuucaagagaaguaugagagagagagagagagagagaccgugugugugugugugugaga

SEQ ID NO: 157324 - RNA, 64 nt, Homo Sapiens
ccagcaucuucaagagaagugagagagagagagagagagagagaguguguguguguguguguga

SEQ ID NO: 157325 - RNA, 64 nt, Homo Sapiens
gaccagcaucuucaagagaagagagagagagagagagagagagauugugugugugugugugugu

SEQ ID NO: 157326 - RNA, 64 nt, Homo Sapiens
gagaccagcaucuucaagaggugagagagagagagagagagagaguuugugugugugugugugu

SEQ ID NO: 157327 - RNA, 64 nt, Homo Sapiens
gagagaccagcaucuucaaggugugagagagagagagagagagaguguuugugugugugugugu

SEQ ID NO: 157328 - RNA, 64 nt, Homo Sapiens
gagagagaccagcaucuucagugugugagagagagagagagagaguguguuugugugugugugu

SEQ ID NO: 157329 - RNA, 64 nt, Homo Sapiens
gagagagagaccagcaucuugugugugugagagagagagagagaguguguguuugugugugugu

SEQ ID NO: 157330 - RNA, 64 nt, Homo Sapiens
gagagagagagaccagcaucgugugugugugagagagagagagaguguguguguuugugugugu

SEQ ID NO: 157331 - RNA, 64 nt, Homo Sapiens
gagagagagagagaccagcagugugugugugugagagagagagaguguguguguguuugugugu

SEQ ID NO: 157332 - RNA, 64 nt, Homo Sapiens
gagagagagagagagaccaggugugugugugugugagagagagacuguguguguguguuugugu

SEQ ID NO: 157333 - RNA, 64 nt, Homo Sapiens
ccuccgcuccuuaaugugaauuucuaugagacgagagagagaagaugaguauuuucaggauuug

SEQ ID NO: 157334 - RNA, 64 nt, Homo Sapiens
agccuccgcuccuuaauguguguuucuaugagacgagagagagaugaugaguauuuucaggauu

SEQ ID NO: 157335 - RNA, 64 nt, Homo Sapiens
cugagaucauucaggaguuuuguguucagaaaaggagagagaggcuccuuuuucaacaaaggag

SEQ ID NO: 157336 - RNA, 64 nt, Homo Sapiens
gagaaggaggggagccuguccaaccugggaaucagagagagaagagugagagaacucagcaagc

SEQ ID NO: 157337 - RNA, 64 nt, Homo Sapiens
acuuucauauuucuaaaaggggccaaugcaaaaggagagagaaggacuggauuuaagccaguuu

SEQ ID NO: 157338 - RNA, 64 nt, Homo Sapiens
ucccgaacuaauuuuuuuaaggauacugaaaaaugagagagaguggucgaaugccugaaauuuu

SEQ ID NO: 157339 - RNA, 64 nt, Homo Sapiens
uuggagucuuuguugcuauauuuuguggggcugggagagagagauuagauuauuuugacauggg

SEQ ID NO: 157340 - RNA, 64 nt, Homo Sapiens
ggagucuuuguugcuauauuuuguggggcugggagagagagauuagauuauuuugacaugggau

SEQ ID NO: 157341 - RNA, 64 nt, Homo Sapiens
aaagaaaaagauuacccaaaaacugucuuuaaaagagagagagagaaaaaaaaaauaguauuug

SEQ ID NO: 157342 - RNA, 64 nt, Homo Sapiens
agaaaaagauuacccaaaaacugucuuuaaaagagagagagagaaaaaaaaaauaguauuugca

SEQ ID NO: 157343 - RNA, 64 nt, Homo Sapiens
aaaaagauuacccaaaaacugucuuuaaaagagagagagagaaaaaaaaaauaguauuugcaua

SEQ ID NO: 157344 - RNA, 64 nt, Homo Sapiens
uccaucgccuuuuccuuccaucaguugaguggcugagagagaagugccucaucccugagccaca

SEQ ID NO: 157345 - RNA, 64 nt, Homo Sapiens
uaugggacaaaaccgguugaccagaaaaugggcagagagagaugaccucggaagcauuuccaca

SEQ ID NO: 157346 - RNA, 64 nt, Homo Sapiens
uuaaucucauggaugguucucaaagguaaaaaaagagagagaaagagagagagcuagcuguggg

SEQ ID NO: 157347 - RNA, 64 nt, Homo Sapiens
ggaugguucucaaagguaaaaaaagagagagaaagagagagagcuagcugugggauucugugua

SEQ ID NO: 157348 - RNA, 64 nt, Homo Sapiens
acucccuguuuccugggcuagucuuggaccccacgagagagaaucguuccucagccucauggug

SEQ ID NO: 157349 - RNA, 64 nt, Homo Sapiens
uugcaucuccguaaaugugcucugcuccucagcugagagagaaaaaaauaaacuguauuuggcu

SEQ ID NO: 157350 - RNA, 64 nt, Homo Sapiens
gugugcguguguguguauauacaguaaagauggagagagagaguauuaacuggaaaagauguua

SEQ ID NO: 157351 - RNA, 64 nt, Homo Sapiens
gugugugcguguguguguauuaacaguaaagauggagagagagaacauuaacuggaaaagaugu

SEQ ID NO: 157352 - RNA, 64 nt, Homo Sapiens
augcuugugccagguggcacucuuugguuccagagagagagaagaagugcagaauucuuuuggu

SEQ ID NO: 157353 - RNA, 64 nt, Homo Sapiens
agaugcuugugccagguggcguucuuugguuccagagagagagagaaagugcagaauucuuuug

SEQ ID NO: 157354 - RNA, 64 nt, Homo Sapiens
aagaaaugcuguguuuaaucaaaaaaaagagagagagagagaaagaccuuaucucaaaaaaaaa

SEQ ID NO: 157355 - RNA, 64 nt, Homo Sapiens
aaaagaaaugcuguguuuaaaaaaaaaaaagagagagagagagagagaccuuaucucaaaaaaa

SEQ ID NO: 157356 - RNA, 64 nt, Homo Sapiens
gaaaaagaaaugcuguguuuaaaaaaaaaaaagagagagagagagugagaccuuaucucaaaaa

SEQ ID NO: 157357 - RNA, 64 nt, Homo Sapiens
gagaaaaagaaaugcuguguaaaaaaaaaaaaaagagagagagagagugagaccuuaucucaaa

SEQ ID NO: 157358 - RNA, 64 nt, Homo Sapiens
ugcuaaccuuguagcaugugcuguguguguaugagagagagaaauguguguguguguguguacu

SEQ ID NO: 157359 - RNA, 64 nt, Homo Sapiens
aaugcuaaccuuguagcaugcucuguguguguaugagagagagaugugugugugugugugugua

SEQ ID NO: 157360 - RNA, 64 nt, Homo Sapiens
gugugugugugugugugugugagagagagaaugagagagagacuuguuguauggcugagcaaga

SEQ ID NO: 157361 - RNA, 64 nt, Homo Sapiens
cugugugugugugugugugugagagagagagaaugagagagagagguguuguauggcugagcaa

SEQ ID NO: 157362 - RNA, 64 nt, Homo Sapiens
gagagagagacuguguguguggcugagcaagagagagagagaauauccuggagggguguuguau

SEQ ID NO: 157363 - RNA, 64 nt, Homo Sapiens
augagagagagacuguguguauggcugagcaagagagagagagaucauccuggagggguguugu

SEQ ID NO: 157364 - RNA, 64 nt, Homo Sapiens
gaaugagagagagacuguguguauggcugagcaagagagagagauaucauccuggagggguguu

SEQ ID NO: 157365 - RNA, 64 nt, Homo Sapiens
guauugaaauuuuguucugcacuauugagagagagagagagaaauaccaagaaaaauuuccaaa

SEQ ID NO: 157366 - RNA, 64 nt, Homo Sapiens
aaguauugaaauuuuguucuaaacuauugagagagagagagagagguaccaagaaaaauuucca

SEQ ID NO: 157367 - RNA, 64 nt, Homo Sapiens
gaaaguauugaaauuuuguucaaaacuauugagagagagagagauugguaccaagaaaaauuuc

SEQ ID NO: 157368 - RNA, 64 nt, Homo Sapiens
gagaaaguauugaaauuuuguccaaaacuauugagagagagagauauugguaccaagaaaaauu

SEQ ID NO: 157369 - RNA, 64 nt, Homo Sapiens
gagagaaaguauugaaauuuuuuccaaaacuauugagagagagagauauugguaccaagaaaaa

SEQ ID NO: 157370 - RNA, 64 nt, Homo Sapiens
caauuuugaaucuaucuuaaaauacugagguguggagagagagacaggaucaggagcgauagag

SEQ ID NO: 157371 - RNA, 64 nt, Homo Sapiens
auuuugaaucuaucuuaaaauacugagguguggagagagagacaggaucaggagcgauagagag

SEQ ID NO: 157372 - RNA, 64 nt, Homo Sapiens
ccuaguguguguguguguguguguguguguguaugagagagagagagagagacaacagagacag

SEQ ID NO: 157373 - RNA, 64 nt, Homo Sapiens
uaguguguguguguguguguguguguguguaugagagagagagagagagacaacagagacagag

SEQ ID NO: 157374 - RNA, 64 nt, Homo Sapiens
guguguguguguguguguguguguguguaugagagagagagagagagacaacagagacagagag

SEQ ID NO: 157375 - RNA, 64 nt, Homo Sapiens
guguguguguguguguguguguguguaugagagagagagagagagacaacagagacagagagag

SEQ ID NO: 157376 - RNA, 64 nt, Homo Sapiens
guguguguguguguguguguguguaugagagagagagagagagacaacagagacagagagaggc

SEQ ID NO: 157377 - RNA, 64 nt, Homo Sapiens
guguguguguguguguguguguaugagagagagagagagagacaacagagacagagagaggcag

SEQ ID NO: 157378 - RNA, 64 nt, Homo Sapiens
gagacagagagaggcagagaggcauagagagacagagagagagacaagaaacagagauagacag

SEQ ID NO: 157379 - RNA, 64 nt, Homo Sapiens
gacagagagaggcagagaggcauagagagacagagagagagacaagaaacagagauagacagaa

SEQ ID NO: 157380 - RNA, 64 nt, Homo Sapiens
gagaacaauauuugggagagaaaaaaaagagagagagagagaaaacucugucucagaaaaaaaa

SEQ ID NO: 157381 - RNA, 64 nt, Homo Sapiens
aagagaacaauauuugggagaaaaaaaaaagagagagagagagaagacucugucucagaaaaaa

SEQ ID NO: 157382 - RNA, 64 nt, Homo Sapiens
gaaagagaacaauauuugggaaaaaaaaaaaagagagagagagacaagacucugucucagaaaa

SEQ ID NO: 157383 - RNA, 64 nt, Homo Sapiens
gagaaagagaacaauauuugaaaaaaaaaaaaaagagagagagaagcaagacucugucucagaa

SEQ ID NO: 157384 - RNA, 64 nt, Homo Sapiens
uaagaaauuuagagaaaaauaaaagagagagagagagagagacaguaggugcuguucucaggug

SEQ ID NO: 157385 - RNA, 64 nt, Homo Sapiens
cauaagaaauuuagagaaaaugaaaagagagagagagagagagacuguaggugcuguucucagg

SEQ ID NO: 157386 - RNA, 64 nt, Homo Sapiens
gacauaagaaauuuagagaaggugaaaagagagagagagagagaaacuguaggugcuguucuca

SEQ ID NO: 157387 - RNA, 64 nt, Homo Sapiens
gagacauaagaaauuuagagcaggugaaaagagagagagagagagaaacuguaggugcuguucu

SEQ ID NO: 157388 - RNA, 64 nt, Homo Sapiens
gagagacauaagaaauuuagcucaggugaaaagagagagagagauggaaacuguaggugcuguu

SEQ ID NO: 157389 - RNA, 64 nt, Homo Sapiens
gagagagacauaagaaauuuuucucaggugaaaagagagagagaaauggaaacuguaggugcug

SEQ ID NO: 157390 - RNA, 64 nt, Homo Sapiens
gaacccuuucuggguguuucaaauaacagaaggagagagagaauuuuguugaccaugauaaugc

SEQ ID NO: 157391 - RNA, 64 nt, Homo Sapiens
augaacccuuucuggguguugcaaauaacagaaggagagagagacauuuguugaccaugauaau

SEQ ID NO: 157392 - RNA, 64 nt, Homo Sapiens
uugggagugguccccaaagaucaagccauuaggagagagagaaaccgagaggaggcugaauuuc

SEQ ID NO: 157393 - RNA, 64 nt, Homo Sapiens
aauugggagugguccccaaaucucaagccauuaggagagagagacaccgagaggaggcugaauu

SEQ ID NO: 157394 - RNA, 64 nt, Homo Sapiens
guagccaagagaaccccacggaaagagagagaaggagagagacaagaaagagagagagagagga

SEQ ID NO: 157395 - RNA, 64 nt, Homo Sapiens
gagagagacaguagccaagaagagagaggagaaagagagagaagcauuuccuagagaaagagag

SEQ ID NO: 157396 - RNA, 64 nt, Homo Sapiens
agaaagagagagaaggagagccuagagaaagagagagagagaggcugcuucacaacagacauuu

SEQ ID NO: 157397 - RNA, 64 nt, Homo Sapiens
ggagaaagagagagaaggaguuccuagagaaagagagagagagagccugcuucacaacagacau

SEQ ID NO: 157398 - RNA, 64 nt, Homo Sapiens
gaggagaaagagagagaaggauuuccuagagaaagagagagagaaggccugcuucacaacagac

SEQ ID NO: 157399 - RNA, 64 nt, Homo Sapiens
agggccacuugcuugauuuaucaugagagaagaggagagagagagagacugagcgcuaggagug

SEQ ID NO: 157400 - RNA, 64 nt, Homo Sapiens
ggccacuugcuugauuuaucaugagagaagaggagagagagagagacugagcgcuaggagugug

SEQ ID NO: 157401 - RNA, 64 nt, Homo Sapiens
ccacuugcuugauuuaucaugagagaagaggagagagagagagacugagcgcuaggagugugug

SEQ ID NO: 157402 - RNA, 64 nt, Homo Sapiens
acuugcuugauuuaucaugagagaagaggagagagagagagacugagcgcuaggagugugugua

SEQ ID NO: 157403 - RNA, 64 nt, Homo Sapiens
gggagagguggggagggagacagagacagaaacagagagagacagagacagagagagacugagg

SEQ ID NO: 157404 - RNA, 64 nt, Homo Sapiens
gagacagagacagaaacagagagagacagagacagagagagacugagggagagacucugaggac

SEQ ID NO: 157405 - RNA, 64 nt, Homo Sapiens
agagagagacugagggagagacucugaggacauggagagagacucaaagagacuccaagauuca

SEQ ID NO: 157406 - RNA, 64 nt, Homo Sapiens
aaccaagagagcgggagggagggaaggagggagggagagagauagagagagagagagagagaga

SEQ ID NO: 157407 - RNA, 64 nt, Homo Sapiens
gcgggagggagggaaggagggagggagagagauagagagagagagagagagagaggaugugugg

SEQ ID NO: 157408 - RNA, 64 nt, Homo Sapiens
gggagggagggaaggagggagggagagagauagagagagagagagagagagaggaugugugggc

SEQ ID NO: 157409 - RNA, 64 nt, Homo Sapiens
gagggagggaaggagggagggagagagauagagagagagagagagagagaggaugugugggccc

SEQ ID NO: 157410 - RNA, 64 nt, Homo Sapiens
gggagggaaggagggagggagagagauagagagagagagagagagagaggaugugugggcccua

SEQ ID NO: 157411 - RNA, 64 nt, Homo Sapiens
gagggaaggagggagggagagagauagagagagagagagagagagaggaugugugggcccuaag

SEQ ID NO: 157412 - RNA, 64 nt, Homo Sapiens
gggaaggagggagggagagagauagagagagagagagagagagaggaugugugggcccuaaggc

SEQ ID NO: 157413 - RNA, 64 nt, Homo Sapiens
gaaggagggagggagagagauagagagagagagagagagagaggaugugugggcccuaaggcug

SEQ ID NO: 157414 - RNA, 64 nt, Homo Sapiens
cagaccuugucucaaaaaauacugcagccugagagagagagagcgucaagaucgcaccacuugc

SEQ ID NO: 157415 - RNA, 64 nt, Homo Sapiens
gccagaccuugucucaaaaagcacugcagccugagagagagagagggucaagaucgcaccacuu

SEQ ID NO: 157416 - RNA, 64 nt, Homo Sapiens
gagccagaccuugucucaaauugcacugcagccugagagagagacagggucaagaucgcaccac

SEQ ID NO: 157417 - RNA, 64 nt, Homo Sapiens
ggugguggugagaaguguuggugagagagagagagagagagauggugugugugugugugugugu

SEQ ID NO: 157418 - RNA, 64 nt, Homo Sapiens
ugggugguggugagaagugugugugagagagagagagagagagagugugugugugugugugugu

SEQ ID NO: 157419 - RNA, 64 nt, Homo Sapiens
gaugggugguggugagaagugugugugagagagagagagagagagugugugugugugugugugu

SEQ ID NO: 157420 - RNA, 64 nt, Homo Sapiens
gagaugggugguggugagaagugugugugagagagagagagagagugugugugugugugugugu

SEQ ID NO: 157421 - RNA, 64 nt, Homo Sapiens
gagagaugggugguggugaggugugugugugagagagagagagaaagugugugugugugugugu

SEQ ID NO: 157422 - RNA, 64 nt, Homo Sapiens
gagagagauggguggugguggugugugugugugagagagagagaggaagugugugugugugugu

SEQ ID NO: 157423 - RNA, 64 nt, Homo Sapiens
gagagagagauggguggugggugugugugugugugagagagagaauggaagugugugugugugu

SEQ ID NO: 157424 - RNA, 64 nt, Homo Sapiens
acugauggggaaaacaagcuacacacgaaggagagagagagaaaacacacacacacacacacac

SEQ ID NO: 157425 - RNA, 64 nt, Homo Sapiens
aaacugauggggaaaacaagacacacacgaaggagagagagagaacacacacacacacacacac

SEQ ID NO: 157426 - RNA, 64 nt, Homo Sapiens
gaaaacugauggggaaaacaacacacacacgaaggagagagagaacacacacacacacacacac

SEQ ID NO: 157427 - RNA, 64 nt, Homo Sapiens
agucccuggccuuuccuuuuguaauaagaaagaagagagagaacuugaugcaaaguccacgaaa

SEQ ID NO: 157428 - RNA, 64 nt, Homo Sapiens
ggcucucugaccucccugcuugcauugggucugggagagagaguggaauauuugguagggaccu

SEQ ID NO: 157429 - RNA, 64 nt, Homo Sapiens
cccugucauuccccacacacguccuguucaccucgagagagagagagagagagcaccuuucuuc

SEQ ID NO: 157430 - RNA, 64 nt, Homo Sapiens
cugucauuccccacacacguccuguucaccucgagagagagagagagagagcaccuuucuuccg

SEQ ID NO: 157431 - RNA, 64 nt, Homo Sapiens
gucauuccccacacacguccuguucaccucgagagagagagagagagagcaccuuucuuccguc

SEQ ID NO: 157432 - RNA, 64 nt, Homo Sapiens
cauuccccacacacguccuguucaccucgagagagagagagagagagcaccuuucuuccgucug

SEQ ID NO: 157433 - RNA, 64 nt, Homo Sapiens
uuccccacacacguccuguucaccucgagagagagagagagagagcaccuuucuuccgucuguu

SEQ ID NO: 157434 - RNA, 64 nt, Homo Sapiens
ccccacacacguccuguucaccucgagagagagagagagagagcaccuuucuuccgucuguuca

SEQ ID NO: 157435 - RNA, 64 nt, Homo Sapiens
uuagauuuuaaguguugaggagcagaggugagaagagagagagagagagaaagucaaauaaagu

SEQ ID NO: 157436 - RNA, 64 nt, Homo Sapiens
agauuuuaaguguugaggagcagaggugagaagagagagagagagagaaagucaaauaaaguca

SEQ ID NO: 157437 - RNA, 64 nt, Homo Sapiens
auuuuaaguguugaggagcagaggugagaagagagagagagagagaaagucaaauaaagucaaa

SEQ ID NO: 157438 - RNA, 64 nt, Homo Sapiens
uuuaaguguugaggagcagaggugagaagagagagagagagagaaagucaaauaaagucaaaga

SEQ ID NO: 157439 - RNA, 64 nt, Homo Sapiens
uaaguguugaggagcagaggugagaagagagagagagagagaaagucaaauaaagucaaagacc

SEQ ID NO: 157440 - RNA, 64 nt, Homo Sapiens
aguuaaugaacaugagguagauaguaaauagagagagagagaagcccccacccaagacauuuua

SEQ ID NO: 157441 - RNA, 64 nt, Homo Sapiens
agaguuaaugaacaugagguuaauaguaaauagagagagagagacacccccacccaagacauuu

SEQ ID NO: 157442 - RNA, 64 nt, Homo Sapiens
gaagaguuaaugaacaugaguuuaauaguaaauagagagagagacccacccccacccaagacau

SEQ ID NO: 157443 - RNA, 64 nt, Homo Sapiens
ggaacgcgaacgcuuggaaagcaaaaacuagagagagagagaaugagcgccuagaaauugaaag

SEQ ID NO: 157444 - RNA, 64 nt, Homo Sapiens
auggaacgcgaacgcuuggaaggcaaaaacuagagagagagagagagagcgccuagaaauugaa

SEQ ID NO: 157445 - RNA, 64 nt, Homo Sapiens
gaauggaacgcgaacgcuugaaaggcaaaaacuagagagagagagagagagcgccuagaaauug

SEQ ID NO: 157446 - RNA, 64 nt, Homo Sapiens
gccuagaaauugaaaggcaaaacgcuuacagagagagagagagcucgugaacgggaagaacggg

SEQ ID NO: 157447 - RNA, 64 nt, Homo Sapiens
gcgccuagaaauugaaaggcggaacgcuuacagagagagagagaauucgugaacgggaagaacg

SEQ ID NO: 157448 - RNA, 64 nt, Homo Sapiens
gagcgccuagaaauugaaagcgggaacgcuuacagagagagagauaauucgugaacgggaagaa

SEQ ID NO: 157449 - RNA, 64 nt, Homo Sapiens
gucgagagcgagaacgcauugaagagagauugcagagagagagcaauacugauuuuugguagac

SEQ ID NO: 157450 - RNA, 64 nt, Homo Sapiens
agaagacagagagauuaaagcagggagagagagagagagagagggcaacagauggagauccuuu

SEQ ID NO: 157451 - RNA, 64 nt, Homo Sapiens
ggagaagacagagagauuaauucagggagagagagagagagagagugcaacagauggagauccu

SEQ ID NO: 157452 - RNA, 64 nt, Homo Sapiens
gaggagaagacagagagauucuuucagggagagagagagagagauggugcaacagauggagauc

SEQ ID NO: 157453 - RNA, 64 nt, Homo Sapiens
gagaggagaagacagagagauccuuucagggagagagagagagaccuggugcaacagauggaga

SEQ ID NO: 157454 - RNA, 64 nt, Homo Sapiens
gagagaggagaagacagagagauccuuucagggagagagagagaguccuggugcaacagaugga

SEQ ID NO: 157455 - RNA, 64 nt, Homo Sapiens
gagagagaggagaagacagagagauccuuucagggagagagagacaguccuggugcaacagaug

SEQ ID NO: 157456 - RNA, 64 nt, Homo Sapiens
agcugcauuuccugcugggguccugguuccucaggagagagagaccacagggugagagugagcc

SEQ ID NO: 157457 - RNA, 64 nt, Homo Sapiens
cugcauuuccugcugggguccugguuccucaggagagagagaccacagggugagagugagccag

SEQ ID NO: 157458 - RNA, 64 nt, Homo Sapiens
aaaacauggccuuggcaguuauuuuuccaucaccgagagagagagacagagagagaaaauaaac

SEQ ID NO: 157459 - RNA, 64 nt, Homo Sapiens
aacauggccuuggcaguuauuuuuccaucaccgagagagagagacagagagagaaaauaaacua

SEQ ID NO: 157460 - RNA, 64 nt, Homo Sapiens
cauggccuuggcaguuauuuuuccaucaccgagagagagagacagagagagaaaauaaacuacc

SEQ ID NO: 157461 - RNA, 64 nt, Homo Sapiens
gcaguuauuuuuccaucaccgagagagagagacagagagagaaaauaaacuaccccuccuauuc

SEQ ID NO: 157462 - RNA, 64 nt, Homo Sapiens
cuguugaaucagaaacagaugagagagaaagagagagagagauggagagaaagagagugagaga

SEQ ID NO: 157463 - RNA, 64 nt, Homo Sapiens
ugcuguugaaucagaaacaggagagagagaaagagagagagagagagagagaaagagagugaga

SEQ ID NO: 157464 - RNA, 64 nt, Homo Sapiens
gaugcuguugaaucagaaacgagagagagagaaagagagagagagagagagagaaagagaguga

SEQ ID NO: 157465 - RNA, 64 nt, Homo Sapiens
gagagagagagaugcuguugaagagagugagagagagagagaaagccagagagugagagagaga

SEQ ID NO: 157466 - RNA, 64 nt, Homo Sapiens
aagagagagagagaugcugugaaagagagugagagagagagagagagccagagagugagagaga

SEQ ID NO: 157467 - RNA, 64 nt, Homo Sapiens
gaaagagagagagagaugcugagaaagagagugagagagagagagagagccagagagugagaga

SEQ ID NO: 157468 - RNA, 64 nt, Homo Sapiens
gagaaagagagagagagauggagagaaagagagugagagagagacagagagccagagagugaga

SEQ ID NO: 157469 - RNA, 64 nt, Homo Sapiens
gagagugagagagagagagagagccagagagugagagagagaaagagaguaaccaguuuccaga

SEQ ID NO: 157470 - RNA, 64 nt, Homo Sapiens
aagagagugagagagagagagagagccagagagugagagagagaaagagaguaaccaguuucca

SEQ ID NO: 157471 - RNA, 64 nt, Homo Sapiens
gagacagagaaauaagcauucuuuuguuaaaagagagagagacaagccugaggccgcugguaga

SEQ ID NO: 157472 - RNA, 64 nt, Homo Sapiens
cagagacagagaaauaagcagacuuuuguuaaaagagagagagaugagccugaggccgcuggua

SEQ ID NO: 157473 - RNA, 64 nt, Homo Sapiens
ccuuguuguuggauaggaaaugaauaaauggagagagagagaaggccacuuuacaaaggaaauu

SEQ ID NO: 157474 - RNA, 64 nt, Homo Sapiens
agccuuguuguuggauaggauuugaauaaauggagagagagagagggccacuuuacaaaggaaa

SEQ ID NO: 157475 - RNA, 64 nt, Homo Sapiens
gaagccuuguuguuggauagaauuugaauaaauggagagagagagagggccacuuuacaaagga

SEQ ID NO: 157476 - RNA, 64 nt, Homo Sapiens
cccagaagugcuggggcagggaggcccaggagaugagagagaagguccgaguaggugauagaag

SEQ ID NO: 157477 - RNA, 64 nt, Homo Sapiens
gggcacggaguugccaggagcaaaccaaagugaagagagagauaggaagcugccucggggccac

SEQ ID NO: 157478 - RNA, 64 nt, Homo Sapiens
ugugaaaggucuaaaugcccacuugaaugaagcugagagagagaucuagcaaaagcuaaaacuc

SEQ ID NO: 157479 - RNA, 64 nt, Homo Sapiens
ugaaaggucuaaaugcccacuugaaugaagcugagagagagaucuagcaaaagcuaaaacucau

SEQ ID NO: 157480 - RNA, 64 nt, Homo Sapiens
uuucacuccggagugagaagcuuugcccuccuaagagagagagacagagagacagagagagaga

SEQ ID NO: 157481 - RNA, 64 nt, Homo Sapiens
ucacuccggagugagaagcuuugcccuccuaagagagagagacagagagacagagagagagaaa

SEQ ID NO: 157482 - RNA, 64 nt, Homo Sapiens
cuuugcccuccuaagagagagagacagagagacagagagagagaaagagagagugugugggucu

SEQ ID NO: 157483 - RNA, 64 nt, Homo Sapiens
uugcccuccuaagagagagagacagagagacagagagagagaaagagagagugugugggucuau

SEQ ID NO: 157484 - RNA, 64 nt, Homo Sapiens
uuuaauuuaucucugugaccugccagggagaggggagagagagagagaugcuguugagcacaug

SEQ ID NO: 157485 - RNA, 64 nt, Homo Sapiens
uaauuuaucucugugaccugccagggagaggggagagagagagagaugcuguugagcacaugac

SEQ ID NO: 157486 - RNA, 64 nt, Homo Sapiens
auuuaucucugugaccugccagggagaggggagagagagagagaugcuguugagcacaugacaa

SEQ ID NO: 157487 - RNA, 64 nt, Homo Sapiens
uuaucucugugaccugccagggagaggggagagagagagagaugcuguugagcacaugacaaaa

SEQ ID NO: 157488 - RNA, 64 nt, Homo Sapiens
augagagcacaguagcccagauguccaugugggagagagagagccaccugggagcuauuuacaa

SEQ ID NO: 157489 - RNA, 64 nt, Homo Sapiens
gcaugagagcacaguagcccaaauguccaugugggagagagagacccaccugggagcuauuuac

SEQ ID NO: 157490 - RNA, 64 nt, Homo Sapiens
gagcaggaggucggggcacugggagagagggacagagagagauagagaggcagagagacagaga

SEQ ID NO: 157491 - RNA, 64 nt, Homo Sapiens
gaggggaagagaggcagagagagagacagagggagagagagacaagaggagacagagagggaga

SEQ ID NO: 157492 - RNA, 64 nt, Homo Sapiens
cagaggggaagagaggcagagagagagacagagggagagagagaacagaggagacagagaggga

SEQ ID NO: 157493 - RNA, 64 nt, Homo Sapiens
gagggagagagagacagagggagacagagagggagagagagacaagagagggagagaaacagag

SEQ ID NO: 157494 - RNA, 64 nt, Homo Sapiens
cagagggagagagagacagaaggagacagagagggagagagagagcagagagggagagaaacag

SEQ ID NO: 157495 - RNA, 64 nt, Homo Sapiens
gaggaggcagagagggagaggagagauaugaggagagagagacaagagagguggggagagggga

SEQ ID NO: 157496 - RNA, 64 nt, Homo Sapiens
cagaggaggcagagagggaggagagagauaugaggagagagagaaaagagagguggggagaggg

SEQ ID NO: 157497 - RNA, 64 nt, Homo Sapiens
ugaggagagagagacagaggagguggggagaggggagagagauaaggaggggagagagaaagag

SEQ ID NO: 157498 - RNA, 64 nt, Homo Sapiens
gagagguggggagaggggaggauggagaggaggggagagagaaagggaaaggaggagggagaga

SEQ ID NO: 157499 - RNA, 64 nt, Homo Sapiens
gagaggaggggagagagaaagggaaaggaggagggagagagauggcauaaaugggggucaggga

SEQ ID NO: 157500 - RNA, 64 nt, Homo Sapiens
aagaagaagaagagacacaaaaaaaaaagagagagagagagaaggagugccugauuggaaaaaa

SEQ ID NO: 157501 - RNA, 64 nt, Homo Sapiens
agaagaagaagaagagacacaaaaaaaaaagagagagagagagagagagugccugauuggaaaa

SEQ ID NO: 157502 - RNA, 64 nt, Homo Sapiens
gaagaagaagaagaagagacaaaaaaaaaaaagagagagagagacagagagugccugauuggaa

SEQ ID NO: 157503 - RNA, 64 nt, Homo Sapiens
gagaagaagaagaagaagagaaaaaaaaaaaaaagagagagagauacagagagugccugauugg

SEQ ID NO: 157504 - RNA, 64 nt, Homo Sapiens
acagaagaaaagcaauugccaaagcaacaucagagagagagaaccuuaucagcaucuggcaucc

SEQ ID NO: 157505 - RNA, 64 nt, Homo Sapiens
acacagaagaaaagcaauugccaaagcaacaucagagagagagacccuuaucagcaucuggcau

SEQ ID NO: 157506 - RNA, 64 nt, Homo Sapiens
gaaagaaagaaaggcugccugaaagaaagagagagagagagaaaaaaaguuauuuggaaagaaa

SEQ ID NO: 157507 - RNA, 64 nt, Homo Sapiens
aagaaagaaagaaaggcugcaagaaagaaagagagagagagagagaaaaaguuauuuggaaaga

SEQ ID NO: 157508 - RNA, 64 nt, Homo Sapiens
gaaagaaagaaagaaaggcugaaagaaagaaagagagagagagaaggaaaaaguuauuuggaaa

SEQ ID NO: 157509 - RNA, 64 nt, Homo Sapiens
gagaaagaaagaaagaaaggaagaaagaaagaaagagagagagaugaggaaaaaguuauuugga

SEQ ID NO: 157510 - RNA, 64 nt, Homo Sapiens
gaaugcaguugcauugauucgagagagagagaaagagagagaauuugaaugggcagaggugaga

SEQ ID NO: 157511 - RNA, 64 nt, Homo Sapiens
gagagagaaugaaugcaguuagaggugagagagagagagagaaaccagugccuuuugaaugggc

SEQ ID NO: 157512 - RNA, 64 nt, Homo Sapiens
aagagagagaaugaaugcaggcagaggugagagagagagagagacuccagugccuuuugaaugg

SEQ ID NO: 157513 - RNA, 64 nt, Homo Sapiens
gaaagagagagaaugaaugcgggcagaggugagagagagagagagacuccagugccuuuugaau

SEQ ID NO: 157514 - RNA, 64 nt, Homo Sapiens
gagaaagagagagaaugaauaugggcagaggugagagagagagaaggacuccagugccuuuuga

SEQ ID NO: 157515 - RNA, 64 nt, Homo Sapiens
gagagaaagagagagaaugagaaugggcagaggugagagagagacaaggacuccagugccuuuu

SEQ ID NO: 157516 - RNA, 64 nt, Homo Sapiens
gagcggaggcuaaggacuggggcgggcaucuggagagagagaggcugcuauggacacggagugg

SEQ ID NO: 157517 - RNA, 64 nt, Homo Sapiens
gggagcggaggcuaaggacuggggcgggcaucuggagagagagacacugcuauggacacggagu

SEQ ID NO: 157518 - RNA, 64 nt, Homo Sapiens
guguguuuguguguuucaagcuguguguguaugagagagagaguggaggaauuucagugggucu

SEQ ID NO: 157519 - RNA, 64 nt, Homo Sapiens
guguguguuuguguguuucacucuguguguguaugagagagagaaaggaggaauuucagugggu

SEQ ID NO: 157520 - RNA, 64 nt, Homo Sapiens
uggugauacuccaacaccgucuucuuucccaugagagagagaaccucuacaaaguguugauccc

SEQ ID NO: 157521 - RNA, 64 nt, Homo Sapiens
acuggugauacuccaacacccccuucuuucccaugagagagagacucucuacaaaguguugauc

SEQ ID NO: 157522 - RNA, 64 nt, Homo Sapiens
caguagcaucuguaacagcauuaacugucuuaaagagagagagagagaauuccgaauuggggaa

SEQ ID NO: 157523 - RNA, 64 nt, Homo Sapiens
guagcaucuguaacagcauuaacugucuuaaagagagagagagagaauuccgaauuggggaaca

SEQ ID NO: 157524 - RNA, 64 nt, Homo Sapiens
agcaucuguaacagcauuaacugucuuaaagagagagagagagaauuccgaauuggggaacaca

SEQ ID NO: 157525 - RNA, 64 nt, Homo Sapiens
caucuguaacagcauuaacugucuuaaagagagagagagagaauuccgaauuggggaacacacg

SEQ ID NO: 157526 - RNA, 64 nt, Homo Sapiens
ugcugaacgggcccacccacacguuguauauucagagagagagagggagucaaggugugaccgu

SEQ ID NO: 157527 - RNA, 64 nt, Homo Sapiens
cugaacgggcccacccacacguuguauauucagagagagagagggagucaaggugugaccgucg

SEQ ID NO: 157528 - RNA, 64 nt, Homo Sapiens
cugucugaaagaaagagagaaagaaagaaagaaagagagagaaagaaagaaagaaagaaaggga

SEQ ID NO: 157529 - RNA, 64 nt, Homo Sapiens
aagauggaaggaaggaaggaaaaagaaagagaaagagagagagagagaaagaaaaagaaagaaa

SEQ ID NO: 157530 - RNA, 64 nt, Homo Sapiens
gauggaaggaaggaaggaaaaagaaagagaaagagagagagagagaaagaaaaagaaagaaaag

SEQ ID NO: 157531 - RNA, 64 nt, Homo Sapiens
uggaaggaaggaaggaaaaagaaagagaaagagagagagagagaaagaaaaagaaagaaaagua

SEQ ID NO: 157532 - RNA, 64 nt, Homo Sapiens
gaaggaaggaaggaaaaagaaagagaaagagagagagagagaaagaaaaagaaagaaaaguaag

SEQ ID NO: 157533 - RNA, 64 nt, Homo Sapiens
aucacucgagcucaagaauucaagaccugggcaagagagagagacuuugucucuauuaaaaaua

SEQ ID NO: 157534 - RNA, 64 nt, Homo Sapiens
cacucgagcucaagaauucaagaccugggcaagagagagagacuuugucucuauuaaaaauaaa

SEQ ID NO: 157535 - RNA, 64 nt, Homo Sapiens
ucuuuagacacacaaaacaaacaaacacaugggggagagagacuuggaagaggaggaggaggag

SEQ ID NO: 157536 - RNA, 64 nt, Homo Sapiens
agacuuggaagaggaggaggaggaggagaaggaggagagagaggggaagagacaaagugggugu

SEQ ID NO: 157537 - RNA, 64 nt, Homo Sapiens
gagacaccauuucccuccucuagaccucaucuuggagagagagauguuggauggggccaucuau

SEQ ID NO: 157538 - RNA, 64 nt, Homo Sapiens
gacaccauuucccuccucuagaccucaucuuggagagagagauguuggauggggccaucuauuc

SEQ ID NO: 157539 - RNA, 64 nt, Homo Sapiens
ucuccucugcauuuuggguuuggcgggagagagagagagagaagccccguggaaccccgaagcc

SEQ ID NO: 157540 - RNA, 64 nt, Homo Sapiens
agucuccucugcauuuugggccuggcgggagagagagagagagaggccccguggaaccccgaag

SEQ ID NO: 157541 - RNA, 64 nt, Homo Sapiens
gaagucuccucugcauuuugagccuggcgggagagagagagagaugggccccguggaaccccga

SEQ ID NO: 157542 - RNA, 64 nt, Homo Sapiens
gagaagucuccucugcauuugaagccuggcgggagagagagagagaugggccccguggaacccc

SEQ ID NO: 157543 - RNA, 64 nt, Homo Sapiens
gagagaagucuccucugcauccgaagccuggcgggagagagagagggaugggccccguggaacc

SEQ ID NO: 157544 - RNA, 64 nt, Homo Sapiens
gcacacaugugucucuguagugcagugagagagagagagagauuugugugcgcacgcccuuuug

SEQ ID NO: 157545 - RNA, 64 nt, Homo Sapiens
uugcacacaugugucucuguugugcagugagagagagagagagaugugugugcgcacgcccuuu

SEQ ID NO: 157546 - RNA, 64 nt, Homo Sapiens
gauugcacacaugugucucuuuugugcagugagagagagagagaugugugugugcgcacgcccu

SEQ ID NO: 157547 - RNA, 64 nt, Homo Sapiens
gagauugcacacaugugucucuuuugugcagugagagagagagacgugugugugugcgcacgcc

SEQ ID NO: 157548 - RNA, 64 nt, Homo Sapiens
gagagauugcacacaugugucccuuuugugcagugagagagagaaacgugugugugugcgcacg

SEQ ID NO: 157549 - RNA, 64 nt, Homo Sapiens
gagagcagaagaaauuccuagagagagagagcgagagagagagcaaaaaaaaaaaaaagcgagc

SEQ ID NO: 157550 - RNA, 64 nt, Homo Sapiens
gcgagagcagaagaaauuccgcgagagagagagcgagagagagaaaaaaaaaaaaaaaaagcga

SEQ ID NO: 157551 - RNA, 64 nt, Homo Sapiens
gagagagagagcgagagcagaaaaaagcgagcgagagagagagcugaaaagacaaaaaaaaaaa

SEQ ID NO: 157552 - RNA, 64 nt, Homo Sapiens
gcgagagagagagcgagagcaaaaaaaagcgagcgagagagagaguugaaaagacaaaaaaaaa

SEQ ID NO: 157553 - RNA, 64 nt, Homo Sapiens
auccacaaauuccaaugucacagggauggggggagagagagaaaaccccagggucuggugaugg

SEQ ID NO: 157554 - RNA, 64 nt, Homo Sapiens
aaauccacaaauuccaauguggcagggauggggggagagagagagaaccccagggucuggugau

SEQ ID NO: 157555 - RNA, 64 nt, Homo Sapiens
aaaaaucacccaccacccccaagagagagacagagagagagaaagagaaaacagaaacccgaga

SEQ ID NO: 157556 - RNA, 64 nt, Homo Sapiens
aaaaaaaucacccaccacccgaaagagagagacagagagagagaaagagaaaacagaaacccga

SEQ ID NO: 157557 - RNA, 64 nt, Homo Sapiens
gagagagagaaaaaaaaucaagaaacccgagaaagagagagacaaaaaaccaaaaagagaaaac

SEQ ID NO: 157558 - RNA, 64 nt, Homo Sapiens
gggcccaagagagacagcacgaaagagagagagagagagagaaggcagcagagagagagagaga

SEQ ID NO: 157559 - RNA, 64 nt, Homo Sapiens
aggggcccaagagagacagcgagaaagagagagagagagagagagggcagcagagagagagaga

SEQ ID NO: 157560 - RNA, 64 nt, Homo Sapiens
gaaggggcccaagagagacagagagaaagagagagagagagagaccgggcagcagagagagaga

SEQ ID NO: 157561 - RNA, 64 nt, Homo Sapiens
gagaaggggcccaagagagagagagagaaagagagagagagagaccccgggcagcagagagaga

SEQ ID NO: 157562 - RNA, 64 nt, Homo Sapiens
gagagaaggggcccaagagagagagagagaaagagagagagagacuccccgggcagcagagaga

SEQ ID NO: 157563 - RNA, 64 nt, Homo Sapiens
gagagagaaggggcccaagagagagagagagaaagagagagagacccuccccgggcagcagaga

SEQ ID NO: 157564 - RNA, 64 nt, Homo Sapiens
gagagagagagagagagaaggcagcagagagagagagagagaaacccucccacccccuccccgg

SEQ ID NO: 157565 - RNA, 64 nt, Homo Sapiens
aagagagagagagagagagagggcagcagagagagagagagagaugcccucccacccccucccc

SEQ ID NO: 157566 - RNA, 64 nt, Homo Sapiens
gaaagagagagagagagagaccgggcagcagagagagagagagaccugcccucccacccccucc

SEQ ID NO: 157567 - RNA, 64 nt, Homo Sapiens
gagaaagagagagagagagaccccgggcagcagagagagagagacgccugcccucccacccccu

SEQ ID NO: 157568 - RNA, 64 nt, Homo Sapiens
gagagaaagagagagagagacuccccgggcagcagagagagagacccgccugcccucccacccc

SEQ ID NO: 157569 - RNA, 64 nt, Homo Sapiens
guaaaggcaguaaugccuucgccaggaaacaagagagagagaaacuuuuccauuaaguacaugu

SEQ ID NO: 157570 - RNA, 64 nt, Homo Sapiens
aaguaaaggcaguaaugccugugccaggaaacaagagagagagauccuuuuccauuaaguacau

SEQ ID NO: 157571 - RNA, 64 nt, Homo Sapiens
gaggacaccgaacugggcugagagggaggagagcgagagagaguauauuauauauuauauagag

SEQ ID NO: 157572 - RNA, 64 nt, Homo Sapiens
cauauauuauauauuauauaauagagagaauggagagagagaaaauaaagauacagagagucaa

SEQ ID NO: 157573 - RNA, 64 nt, Homo Sapiens
aacauauauuauauauuauaaaauagagagaauggagagagagagaauaaagauacagagaguc

SEQ ID NO: 157574 - RNA, 64 nt, Homo Sapiens
aaugcugugacucaaggccacggcucuacuaaaagagagagaggaagcgagagagagagagaaa

SEQ ID NO: 157575 - RNA, 64 nt, Homo Sapiens
aggccacggcucuacuaaaagagagagaggaagcgagagagagagagaaaaaacaaaaaacaga

SEQ ID NO: 157576 - RNA, 64 nt, Homo Sapiens
gccacggcucuacuaaaagagagagaggaagcgagagagagagagaaaaaacaaaaaacagaaa

SEQ ID NO: 157577 - RNA, 64 nt, Homo Sapiens
cacggcucuacuaaaagagagagaggaagcgagagagagagagaaaaaacaaaaaacagaaaac

SEQ ID NO: 157578 - RNA, 64 nt, Homo Sapiens
cggcucuacuaaaagagagagaggaagcgagagagagagagaaaaaacaaaaaacagaaaacac

SEQ ID NO: 157579 - RNA, 64 nt, Homo Sapiens
cgagaggucccaguacaaggcuuguuggugcugagagagagaaccucucgcuuuaguuuucaac

SEQ ID NO: 157580 - RNA, 64 nt, Homo Sapiens
accgagaggucccaguacaaaccuuguuggugcugagagagagacucucucgcuuuaguuuuca

SEQ ID NO: 157581 - RNA, 64 nt, Homo Sapiens
agagggugggaggucccggacgagcagagccggagagagagacgccagcgccgccuccuagacu

SEQ ID NO: 157582 - RNA, 64 nt, Homo Sapiens
cgagagggugggaggucccgcucgagcagagccggagagagagacgccagcgccgccuccuaga

SEQ ID NO: 157583 - RNA, 64 nt, Homo Sapiens
uccgaagcaauaacaacaccagccuuuauaaagagagagagagcccuuccccuggugucugcac

SEQ ID NO: 157584 - RNA, 64 nt, Homo Sapiens
gcuccgaagcaauaacaacaacagccuuuauaaagagagagagagcccuuccccuggugucugc

SEQ ID NO: 157585 - RNA, 64 nt, Homo Sapiens
ccuuguuacauuuccugcuaauuaacaugcaagagagagagaagcuauuagcacuguucacuac

SEQ ID NO: 157586 - RNA, 64 nt, Homo Sapiens
agccuuguuacauuuccugcacauuaacaugcaagagagagagaggcuauuagcacuguucacu

SEQ ID NO: 157587 - RNA, 64 nt, Homo Sapiens
cagagugcacgugacccgcaagggcagguuugcagagagagaccgcauauucccagacugaggc

SEQ ID NO: 157588 - RNA, 64 nt, Homo Sapiens
uccacuccacucuuccuuaaggccagauuuacaggagagagaaaauccuccuuaccacccacca

SEQ ID NO: 157589 - RNA, 64 nt, Homo Sapiens
agaaaacgacauuaggaauuucuucuuuuuuagagagagagauuaaaauuauaggauuuuuuuu

SEQ ID NO: 157590 - RNA, 64 nt, Homo Sapiens
uuagaaaacgacauuaggaauuucuucuuuuuuagagagagagaccaaaauuauaggauuuuuu

SEQ ID NO: 157591 - RNA, 64 nt, Homo Sapiens
cuggaagacagugguucugauggguucagcccuagagagagagagagaagcggggagaauaaga

SEQ ID NO: 157592 - RNA, 64 nt, Homo Sapiens
ggaagacagugguucugauggguucagcccuagagagagagagagaagcggggagaauaagagu

SEQ ID NO: 157593 - RNA, 64 nt, Homo Sapiens
aagacagugguucugauggguucagcccuagagagagagagagaagcggggagaauaagagugc

SEQ ID NO: 157594 - RNA, 64 nt, Homo Sapiens
gacagugguucugauggguucagcccuagagagagagagagaagcggggagaauaagagugcac

SEQ ID NO: 157595 - RNA, 64 nt, Homo Sapiens
gcugagccagaaaguaacacagagcucaugcuuggagagagagagucuuggccauggcuuuccu

SEQ ID NO: 157596 - RNA, 64 nt, Homo Sapiens
ugagccagaaaguaacacagagcucaugcuuggagagagagagucuuggccauggcuuuccugc

SEQ ID NO: 157597 - RNA, 64 nt, Homo Sapiens
auccucuccggaucugucgauuuggagaccuuccgagagagaaccaagggugcagucagcuuaa

SEQ ID NO: 157598 - RNA, 64 nt, Homo Sapiens
auucauauuuagaaguaaaacacaaaacaaaaaagagagagaaaagaaaagaaaucacaaugua

SEQ ID NO: 157599 - RNA, 64 nt, Homo Sapiens
ggccucugggccuccagcgcuggguuugucgagugagagagagagaggagcuuggguugcuucc

SEQ ID NO: 157600 - RNA, 64 nt, Homo Sapiens
ccucugggccuccagcgcuggguuugucgagugagagagagagaggagcuuggguugcuucccu

SEQ ID NO: 157601 - RNA, 64 nt, Homo Sapiens
ucugggccuccagcgcuggguuugucgagugagagagagagaggagcuuggguugcuucccugu

SEQ ID NO: 157602 - RNA, 64 nt, Homo Sapiens
gaaagucuccagaccaggaagagagaaggaaagagagagagaaaacauagaagagggaaggaaa

SEQ ID NO: 157603 - RNA, 64 nt, Homo Sapiens
aagaaagucuccagaccaggaagagagaaggaaagagagagagacaacauagaagagggaagga

SEQ ID NO: 157604 - RNA, 64 nt, Homo Sapiens
uaugucaaaauguuacaaccgcuguaaaaugacggagagagagagaaagaaucccagacauuaa

SEQ ID NO: 157605 - RNA, 64 nt, Homo Sapiens
ugucaaaauguuacaaccgcuguaaaaugacggagagagagagaaagaaucccagacauuaacg

SEQ ID NO: 157606 - RNA, 64 nt, Homo Sapiens
ucaaaauguuacaaccgcuguaaaaugacggagagagagagaaagaaucccagacauuaacggu

SEQ ID NO: 157607 - RNA, 59 nt, Homo Sapiens
cacaguggaagugggagccugguccuuccccugcccauggagagcucuuuaagggaucc

SEQ ID NO: 157608 - RNA, 59 nt, Homo Sapiens
cagcccccaggugaggcuuccagcugggaccugcccagacaggcugagccugggcgugg

SEQ ID NO: 157609 - RNA, 59 nt, Homo Sapiens
gcccugcccgccucuccccccacgcucaaccugcccacuuguccaggccuggccucuuu

SEQ ID NO: 157610 - RNA, 59 nt, Homo Sapiens
cucacucugccaugagaacaggacaccauccugcccagcccagacgggguugcuccugg

SEQ ID NO: 157611 - RNA, 59 nt, Homo Sapiens
ggcucuggcccacugagccaccgcgcccuccugcccacgggaggacaagcaauaacucu

SEQ ID NO: 157612 - RNA, 59 nt, Homo Sapiens
uuaggaaccuucucccuucuugggucugcccugcccauacugagccugccaaagugccu

SEQ ID NO: 157613 - RNA, 59 nt, Homo Sapiens
gcuuugggaggccaaggcagcguaaugggccugcccaaugcaggugugguggcucaugg

SEQ ID NO: 157614 - RNA, 59 nt, Homo Sapiens
uagccguccauggcaccagcacugcccugccugcccacuugugacugaaggggcacacc

SEQ ID NO: 157615 - RNA, 59 nt, Homo Sapiens
ggugggaacuggaggaguggggcucuaucccugcccagacuaggguuguccugccccuu

SEQ ID NO: 157616 - RNA, 59 nt, Homo Sapiens
ggccgagggacagggugaggcaccaccuuccugcccacacacacauuauagucaugugc

SEQ ID NO: 157617 - RNA, 59 nt, Homo Sapiens
ccucauccccaucuucucagagggcaaccccugcccaacaugugacauggcuucuccuc

SEQ ID NO: 157618 - RNA, 59 nt, Homo Sapiens
agauagaagaccuggacuccugcaagagcccugcccaggcuccugggaccacugccacc

SEQ ID NO: 157619 - RNA, 59 nt, Homo Sapiens
aguggaugaugugggaguugcgaugccuuccugcccagaugaaaggagggugaggcugc

SEQ ID NO: 157620 - RNA, 59 nt, Homo Sapiens
gagcuuuaccuuucccaagccacagggaaccugcccagaacuguccaagcucucagccc

SEQ ID NO: 157621 - RNA, 59 nt, Homo Sapiens
ccucgucaccacagggacucaagaccgugccugcccagcccccugcccuggcagccugg

SEQ ID NO: 157622 - RNA, 59 nt, Homo Sapiens
ggacauguacauuuccccuuaacugucaaccugcccacgccaccccggggucucugggg

SEQ ID NO: 157623 - RNA, 59 nt, Homo Sapiens
cauuccuuucuaaguguguuuuauggcauccugcccacaaagaacucacagucugauua

SEQ ID NO: 157624 - RNA, 59 nt, Homo Sapiens
acagguugacuaguaucuguggguaccucccugcccagguuauucacucacaagccacc

SEQ ID NO: 157625 - RNA, 56 nt, Homo Sapiens; identical to SEQ ID NO: 77590

SEQ ID NO: 157626 - RNA, 59 nt, Homo Sapiens
acaacggucagcacuccucucccagccccccugcccacuguucucaauaaaaugugagu

SEQ ID NO: 157627 - RNA, 59 nt, Homo Sapiens
guuucugggccucacggugcgggaugccgccugcccagugguuggggaccgaaaggaca

SEQ ID NO: 157628 - RNA, 59 nt, Homo Sapiens
cccucucagaggaacggggucccguccagccugcccagauccccccggccaccucucua

SEQ ID NO: 157629 - RNA, 59 nt, Homo Sapiens
caaggggcaaggcugggccccuagcuuguccugcccauuccuccagguguugaucuuga

SEQ ID NO: 157630 - RNA, 59 nt, Homo Sapiens
cccuggcaacaggaaccugggcagcuuauccugcccacagguaagccccugggagcauc

SEQ ID NO: 157631 - RNA, 59 nt, Homo Sapiens
ucccuguguggucccucccuucgugugccccugcccagccucuuggcaccuccuguuua

SEQ ID NO: 157632 - RNA, 59 nt, Homo Sapiens
gguuucaaacaagacaaaaggcauuccucccugcccaaucccagugcagucaaggccaa

SEQ ID NO: 157633 - RNA, 59 nt, Homo Sapiens
gacccuuggccuugugagccagucugguuccugcccaguuggcaccuuucccuucugaa

SEQ ID NO: 157634 - RNA, 59 nt, Homo Sapiens
aacuguggacuuuugcuuccuaccaauuaccugcccagucagccccacacccucauuua

SEQ ID NO: 157635 - RNA, 59 nt, Homo Sapiens
agggaccauggagcaguggcagugcucuuccugcccacccuuuccuaugggcaaggccc

SEQ ID NO: 157636 - RNA, 59 nt, Homo Sapiens
cuucgcucacgccccagcgccgccuccuuccugcccacccagacugcaauaacuggagg

SEQ ID NO: 157637 - RNA, 59 nt, Homo Sapiens
cccugccaggucccgcgcaccaucccugcccugcccacgugguauugcugggcuccugg

SEQ ID NO: 157638 - RNA, 59 nt, Homo Sapiens
ccugaucagcccguaucaucugaggccugccugcccacccugccacccuccccucccuu

SEQ ID NO: 157639 - RNA, 59 nt, Homo Sapiens
agaugccaacuggagggccagaccuguguccugcccauguccuccuugguggacguuuc

SEQ ID NO: 157640 - RNA, 59 nt, Homo Sapiens
ucuguuuacucagagcugcuagagaccauccugcccauccgaguucugagauugggacu

SEQ ID NO: 157641 - RNA, 59 nt, Homo Sapiens
ugcuaugauggugguauccgaggccuuucccugcccagucuggugccugccccacauug

SEQ ID NO: 157642 - RNA, 59 nt, Homo Sapiens
gggauccaagaccugagauaaagcaacagccugcccagaucccucuguucauccuaucc

SEQ ID NO: 157643 - RNA, 59 nt, Homo Sapiens
aaguauuaccugcggcgacuuugcagacgccugcccauccugccauugccuccucucca

SEQ ID NO: 157644 - RNA, 59 nt, Homo Sapiens
gcuccauuuuggaggcaggcauucucauaccugcccacagcucaacuucaccaagaugc

SEQ ID NO: 157645 - RNA, 59 nt, Homo Sapiens
uuccucaccucucagccuccagaucccuuccugcccaucccuucccuacaaugcccacu

SEQ ID NO: 157646 - RNA, 59 nt, Homo Sapiens
gugaguggcaaguggcuuaucuggagccaccugcccaagucuuacuaaaaugcagcugu

SEQ ID NO: 157647 - RNA, 59 nt, Homo Sapiens
aguucuggaaagguggccuucauaguuuaccugcccacggaaagaaagcacauccaaag

SEQ ID NO: 157648 - RNA, 59 nt, Homo Sapiens
ucccgcacccugcguuuagggucaccucuccugcccagccuuuaggaacacaguuggag

SEQ ID NO: 157649 - RNA, 59 nt, Homo Sapiens
aguaguacaagcuccccucagccagccugccugcccagcgaggcccccagguucaaggu

SEQ ID NO: 157650 - RNA, 59 nt, Homo Sapiens
accugguacagguagguggcgcucacguuccugcccaaaugcagcccaucggggaguca

SEQ ID NO: 157651 - RNA, 59 nt, Homo Sapiens
cagacuguggcuccuuccucccuuaccguccugcccauaaauaccauccugcccauugu

SEQ ID NO: 157652 - RNA, 59 nt, Homo Sapiens
guccuuaccguccugcccauuaauaccauccugcccauugagauggcauagagaagauc

SEQ ID NO: 157653 - RNA, 59 nt, Homo Sapiens
gggacacucccccugcucucccuucuccaccugcccaccugcaugggagagcugucccu

SEQ ID NO: 157654 - RNA, 59 nt, Homo Sapiens
uccugggcucucccagggaaucccaaagaccugcccaccgccucguccaggucucuauc

SEQ ID NO: 157655 - RNA, 59 nt, Homo Sapiens
auacugacccauugaaccccccugugcuuccugcccaaggcacacaagacgggagucac

SEQ ID NO: 157656 - RNA, 59 nt, Homo Sapiens
uggaggguccuggggacggcugcuggccuccugcccaggcucucuggccauugcagagc

SEQ ID NO: 157657 - RNA, 59 nt, Homo Sapiens
agcccugagcucagcugcaggcuccuaccccugcccagcgccccaaggcuggggccaca

SEQ ID NO: 157658 - RNA, 59 nt, Homo Sapiens
acauccagccuguggcuuugagcccccagccugcccacuccgaguagagggcaucccgg

SEQ ID NO: 157659 - RNA, 59 nt, Homo Sapiens
cuaggaggcagcggggauagagauggaggccugcccagaugagaggccuaauagggcag

SEQ ID NO: 157660 - RNA, 59 nt, Homo Sapiens
accaggucgguucccgaggcguccgccauccugcccaccccaccuccgcauccaccccc

SEQ ID NO: 157661 - RNA, 59 nt, Homo Sapiens
agggcuucgggggagugguuacccugcucccugcccagugacaagcccuccuuuccccu

SEQ ID NO: 157662 - RNA, 59 nt, Homo Sapiens
uccccugggggcccuccuuuccccugcucccugcccagcuacggggcccuccuuucagc

SEQ ID NO: 157663 - RNA, 59 nt, Homo Sapiens
gaagggaaggccugcagaggcuccagcccccugcccacauguccuggugcccaggagcc

SEQ ID NO: 157664 - RNA, 59 nt, Homo Sapiens
cccuccuuugccuguguccuugugggugcccugcccaccgcagugaagguucuucucug

SEQ ID NO: 157665 - RNA, 59 nt, Homo Sapiens
agaguggaucucacagcccaugcuaaccaccugcccagaagugagggaaaaacguuagg

SEQ ID NO: 157666 - RNA, 59 nt, Homo Sapiens
ggccguggugacucacgggccuccccucgccugcccaggaggaacccaagccaccccgg

SEQ ID NO: 157667 - RNA, 59 nt, Homo Sapiens
ccgccucagccugccaccucauccaccguccugcccacggcugucccuguggacccgcc

SEQ ID NO: 157668 - RNA, 59 nt, Homo Sapiens
cuggguucucuccuucuucuuccugcuguccugcccaagaacugagggucuccccggcc

SEQ ID NO: 157669 - RNA, 59 nt, Homo Sapiens
ugcccugccagagacagacccaugcgcugccugcccaccgugccccuuuguccccaugu

SEQ ID NO: 157670 - RNA, 59 nt, Homo Sapiens
aaugucuaccucugaagccuccuucccugccugcccaccccuccaugcuccacgcaggc

SEQ ID NO: 157671 - RNA, 59 nt, Homo Sapiens
gagacuauuugcugugggcucuccuccagccugcccagggcccacccagaugccucugg

SEQ ID NO: 157672 - RNA, 59 nt, Homo Sapiens
cccuucccagucagggcuccccugcccagccugcccauccgggcacaagaaaccagagu

SEQ ID NO: 157673 - RNA, 59 nt, Homo Sapiens
cugcccauccccuucccaguaaccagaguccugcccagcuagucuuuccgggcacaaga

SEQ ID NO: 157674 - RNA, 59 nt, Homo Sapiens
agcuguggcauccacuguggcaucuccguccugcccaccuucuuaagaggcgagaugga

SEQ ID NO: 157675 - RNA, 59 nt, Homo Sapiens
aauuuaaaaugauccauggccacagggcuccugcccaggggcuugucaccuuccccucc

SEQ ID NO: 157676 - RNA, 59 nt, Homo Sapiens
cauaccgggccucuggcccagaccuaagcccugcccacaaagacuaauggaugccagug

SEQ ID NO: 157677 - RNA, 59 nt, Homo Sapiens
aaguacagccacuguaaauaacccucgucccugcccaggaacccagacuggacuucagu

SEQ ID NO: 157678 - RNA, 59 nt, Homo Sapiens
ccuacugccucccgcugccgcacuccuccccugcccaaguugccuccugaggcgcagcg

SEQ ID NO: 157679 - RNA, 59 nt, Homo Sapiens
cuggggcaccuuugccuccugguccagggccugcccaggggcgcugcucagcuugggcu

SEQ ID NO: 157680 - RNA, 59 nt, Homo Sapiens
gagcggacccuccucuuuggguuguagggccugcccaugagcugccccauucuuuuaac

SEQ ID NO: 157681 - RNA, 59 nt, Homo Sapiens
ugcaacucccccccaacaauagaacccugccugcccaccuuuuaggccucacucccauc

SEQ ID NO: 157682 - RNA, 59 nt, Homo Sapiens
uggccuccuggcccgcccucgacgccugcccugcccaggugccgggcacaugcccgggg

SEQ ID NO: 157683 - RNA, 59 nt, Homo Sapiens
cuaccagcuccuccagcccuacauaguguccugcccaccggccggccggaccucugagc

SEQ ID NO: 157684 - RNA, 59 nt, Homo Sapiens
cagggugaggaaagggcuccucacccgccccugcccagaguugcacgggagaacuuucc

SEQ ID NO: 157685 - RNA, 59 nt, Homo Sapiens
ugcccgugugccuacccacugcugcgggaccugcccagcaucaaguaucugagccagau

SEQ ID NO: 157686 - RNA, 59 nt, Homo Sapiens
gggaaguagagauguggcggcuuucccacccugcccacagcaggcccuccugcccagcu

SEQ ID NO: 157687 - RNA, 59 nt, Homo Sapiens
gcuuucccacccugcccacagcaggcccuccugcccagcugcucuugucagcccucugg

SEQ ID NO: 157688 - RNA, 59 nt, Homo Sapiens
gcccagagugaccaagcagcaccagcaggccugcccaggaugcugaaagcagauuucuu

SEQ ID NO: 157689 - RNA, 59 nt, Homo Sapiens
ugccccacuggugagaggaggaccuugugccugcccagagccugcaggacagcacgccu

SEQ ID NO: 157690 - RNA, 59 nt, Homo Sapiens
gcugcuugcucagaaacaacccgugcaucccugcccauggauucugcaggaccuagaag

SEQ ID NO: 157691 - RNA, 59 nt, Homo Sapiens
cucaggcccaugagguauggcuccagaccccugcccaggcugccugggggcuaugugca

SEQ ID NO: 157692 - RNA, 59 nt, Homo Sapiens
accuggcucaucccucaggcggugugucaccugcccacccagaggccaggaggggaccu

SEQ ID NO: 157693 - RNA, 59 nt, Homo Sapiens
uauccugucuguccccaccccagcuguccccugcccagggagcuggcauaaaagcacga

SEQ ID NO: 157694 - RNA, 59 nt, Homo Sapiens
cugcuugagaacagagacugcuaccccauccugcccaugcaggcaggcucuugccagcc

SEQ ID NO: 157695 - RNA, 59 nt, Homo Sapiens
gagggcagacgccacccuggacugcucucccugcccagcugggccucucuggccuauuc

SEQ ID NO: 157696 - RNA, 59 nt, Homo Sapiens
cuguccccgggacugagcugccaugccagccugcccacagcagccuccuagaguuagca

SEQ ID NO: 157697 - RNA, 59 nt, Homo Sapiens
guagugacacucaggauccaaaagcuagcccugcccaccccagccccuggaccugcuua

SEQ ID NO: 157698 - RNA, 59 nt, Homo Sapiens
agcucgccugcccugcuuggcucugaggaccugcccagcgcucaaagggaacggaagcc

SEQ ID NO: 157699 - RNA, 59 nt, Homo Sapiens
cuugcccuagcaugaggcucugagagccaccugcccaccaaucuggugaggauaauggu

SEQ ID NO: 157700 - RNA, 59 nt, Homo Sapiens
ccuccauuccggaccccaugggcccagccccugcccaucuaguugguuuggggacccug

SEQ ID NO: 157701 - RNA, 59 nt, Homo Sapiens
acccugugacugagccuguguccugucugccugcccagccaugcuccaucggcugugag

SEQ ID NO: 157702 - RNA, 59 nt, Homo Sapiens
ggcagccgccaggcgagcaggcugcuuucccugcccagucaugcaccucccccucuggg

SEQ ID NO: 157703 - RNA, 59 nt, Homo Sapiens
uggcaaucagggccgcaguguguucugcgccugcccagagcugacuccugauuuaaccg

SEQ ID NO: 157704 - RNA, 59 nt, Homo Sapiens
ucuuccuucgugagcuggcccugauccucccugcccaaguggauccuugccaggcgucc

SEQ ID NO: 157705 - RNA, 59 nt, Homo Sapiens
aggaauggguccagguguggcaagcccucccugcccagacacagccucccucccuccag

SEQ ID NO: 157706 - RNA, 59 nt, Homo Sapiens
aaagcuugacaagacacucgaaaaagucaccugcccaauagcccacaagaucugaguga

SEQ ID NO: 157707 - RNA, 59 nt, Homo Sapiens
aaacaccgagugaggccauaagaaagucaccugcccaaggcccccagcuggaaguuaag

SEQ ID NO: 157708 - RNA, 59 nt, Homo Sapiens
accugacccuggcgugugcuacaauuccaccugcccaggugcagacgcagggggacugc

SEQ ID NO: 157709 - RNA, 59 nt, Homo Sapiens
ccagacagacagcaccugcaucccccaacccugcccaaggauggcucuggccucggucc

SEQ ID NO: 157710 - RNA, 59 nt, Homo Sapiens
cucccuccacuccucucaacuccuccagcccugcccaccaucagacgugcucccuccca

SEQ ID NO: 157711 - RNA, 59 nt, Homo Sapiens
caccccucagaugcguucgcccuggugcuccugcccagcacccugaccguguacauagc

SEQ ID NO: 157712 - RNA, 59 nt, Homo Sapiens
ugccccucuguucucuccccucacauccuccugcccagcuccucacauacccacacauu

SEQ ID NO: 157713 - RNA, 59 nt, Homo Sapiens
cguuccuucgcacacugugauuuugcccuccugcccacgcagaccugcagcgggcaaag

SEQ ID NO: 157714 - RNA, 59 nt, Homo Sapiens
guuggcuucuucccaggccuugcaugggcccugcccacaagcacacccucaggccgagg

SEQ ID NO: 157715 - RNA, 59 nt, Homo Sapiens
agugggguuugaagcagaguucagggaacccugcccaagguccuccuguucagacauuc

SEQ ID NO: 157716 - RNA, 59 nt, Homo Sapiens
acugggccgggcccagggccucuggcuucccugcccaauccucccuggagaagggacau

SEQ ID NO: 157717 - RNA, 59 nt, Homo Sapiens
ccacuagcuaagcaagccaggagaagaccccugcccaaguggcucuugggacaacgugc

SEQ ID NO: 157718 - RNA, 59 nt, Homo Sapiens
agguguggaccggccgcagcccccacugaccugcccauguccagagggacuggacagcc

SEQ ID NO: 157719 - RNA, 57 nt, Homo Sapiens; identical to SEQ ID NO: 77684

SEQ ID NO: 157720 - RNA, 59 nt, Homo Sapiens
cagaguggcgugagcugcccggcgccugcccugcccaagugaccagggaagugugugug

SEQ ID NO: 157721 - RNA, 59 nt, Homo Sapiens
uggccagcgccagggcccaggccauguggccugcccagccucaaugucacuugguggcg

SEQ ID NO: 157722 - RNA, 59 nt, Homo Sapiens
ugcaucuuuugcagcccacugucucccugccugcccaucgucuuucugucuguuuaccu

SEQ ID NO: 157723 - RNA, 59 nt, Homo Sapiens
ccucucuugagggagcagcacucccaccuccugcccaucccccgaagcccaccugcaau

SEQ ID NO: 157724 - RNA, 59 nt, Homo Sapiens
ucacucucucccuugaugaucacaucgucccugcccaucgaggccugaagcggaagcac

SEQ ID NO: 157725 - RNA, 59 nt, Homo Sapiens
uuggggugguggcaccagaggggggguacccugcccaccccacaggcauaugguggaga

SEQ ID NO: 157726 - RNA, 59 nt, Homo Sapiens
cuggucauuugcuguccgcuagaagcagcccugcccagcgggaaggucucugaucacac

SEQ ID NO: 157727 - RNA, 59 nt, Homo Sapiens
gcagguggcucuuacagcucggcacacacccugcccauucagggaagugaaagguccca

SEQ ID NO: 157728 - RNA, 59 nt, Homo Sapiens
ugaacacagcggcugccagugggugcacaccugcccaggauaauccagugggggugacu

SEQ ID NO: 157729 - RNA, 59 nt, Homo Sapiens
agacuuuuauuuauuuuuuuucaguaauuccugcccagaauugguuauaauaacaguua

SEQ ID NO: 157730 - RNA, 59 nt, Homo Sapiens
gagaggcuuggucggucuccccccucaguccugcccacacaucuggagauacaggccca

SEQ ID NO: 157731 - RNA, 59 nt, Homo Sapiens
gugcucuaaacccugcucagccucccccuccugcccacuggcccugcugaaguccagac

SEQ ID NO: 157732 - RNA, 59 nt, Homo Sapiens
cugcauucccuggagacucacugcaaguuccugcccaggaggcugagggcaccccaucc

SEQ ID NO: 157733 - RNA, 59 nt, Homo Sapiens
ucguacacggagacuggcagcgccgacguccugcccaccacgcacucccggagagcacg

SEQ ID NO: 157734 - RNA, 59 nt, Homo Sapiens
aagcagcacgugugagcugggccaggagcccugcccaccuccgugcagcugaccugccc

SEQ ID NO: 157735 - RNA, 59 nt, Homo Sapiens
ugcugauacacacuguuguuaggccugcaccugcccauccagaaagcagcagcugccuu

SEQ ID NO: 157736 - RNA, 59 nt, Homo Sapiens
uccggcucacacacgcccugccugcccucccugcccagcuguaaggaccgggggucucc

SEQ ID NO: 157737 - RNA, 59 nt, Homo Sapiens
uaaacagacccccuucugcuccgcuuccuccugcccagccaggcaacacccucaaccgg

SEQ ID NO: 157738 - RNA, 59 nt, Homo Sapiens
aaaugcugagcccugauccaaaguugucuccugcccaugagcaccacagucaggccuug

SEQ ID NO: 157739 - RNA, 59 nt, Homo Sapiens
uagcccacaauucuccauuucacuugaccccugcccaccucuccaaccuaacuggcuua

SEQ ID NO: 157740 - RNA, 59 nt, Homo Sapiens
uccaggccucucccaccucaccuuggggcccugcccaccacacccugauagcacaaucu

SEQ ID NO: 157741 - RNA, 59 nt, Homo Sapiens
ccgaggcagggcuggggcuuuccgcugccccugcccaccccgaggccaccgcccccccc

SEQ ID NO: 157742 - RNA, 59 nt, Homo Sapiens
gcccuggcaccagagacgccucgagucgcccugcccagaccaguccucccagggagucc

SEQ ID NO: 157743 - RNA, 59 nt, Homo Sapiens
gcacucuuugguucucugcuagaagagccccugcccacucaaacaaaccaaccagaggg

SEQ ID NO: 157744 - RNA, 59 nt, Homo Sapiens
cccggccagaucccuggagcugaauucugccugcccaccgcuuguugaagaugaauucu

SEQ ID NO: 157745 - RNA, 59 nt, Homo Sapiens
uggccuauaccccagccgugcugccccugccugcccaucgcugcaggcauggcugucuc

SEQ ID NO: 157746 - RNA, 59 nt, Homo Sapiens
cuucugugaccccgcugugguaaguccagccugcccagggcugcugagggcugccucuu

SEQ ID NO: 157747 - RNA, 59 nt, Homo Sapiens
ggcucaggcuguaaaaguagcugagccauccugcccauuccuggagguccuacagguga

SEQ ID NO: 157748 - RNA, 59 nt, Homo Sapiens
auagacguauccaaugggaaaacagcggaccugcccagagcagggaggugucguggaac

SEQ ID NO: 157749 - RNA, 59 nt, Homo Sapiens
aucgucucaacaccaccaaguuuguaggaccugcccaaguucuaguaguauucaaaacu

SEQ ID NO: 157750 - RNA, 59 nt, Homo Sapiens
uugccugguuccauauggcuccuuccagcccugcccaccaagugcagcucccacuuucc

SEQ ID NO: 157751 - RNA, 59 nt, Homo Sapiens
gcccaccaagugcagcucccacuuuccauccugcccauacgccccucuucccccgacau

SEQ ID NO: 157752 - RNA, 59 nt, Homo Sapiens
agagcuucagugagguuuccgagccucucccugcccauccucaccacugaggccacgac

SEQ ID NO: 157753 - RNA, 59 nt, Homo Sapiens
ccgcucuccaaggugugcuagcagugggcccugcccaacuucaggcagaacagggaggc

SEQ ID NO: 157754 - RNA, 59 nt, Homo Sapiens
gccugggagucgggcggccccggucaggcccugcccagagagcuccugguuccugaacu

SEQ ID NO: 157755 - RNA, 59 nt, Homo Sapiens
cccacccgaggcucugcccaccgccuggaccugcccaccccugaaagacuggccccugg

SEQ ID NO: 157756 - RNA, 59 nt, Homo Sapiens
guaggccuggcaugagggguggcucagcaccugcccagggguuccuggcgcccugaggu

SEQ ID NO: 157757 - RNA, 59 nt, Homo Sapiens
cccucccccaacaagaucucagagggcuaccugcccagcagauggccugccuuuggcug

SEQ ID NO: 157758 - RNA, 59 nt, Homo Sapiens
agccagggcuacacuacaaagauguuagcccugcccaacccugguauguuuuucuuaua

SEQ ID NO: 157759 - RNA, 59 nt, Homo Sapiens
accaagcaagcagcaagcaauacccucggccugcccaccgacagcccagagccugccgc

SEQ ID NO: 157760 - RNA, 59 nt, Homo Sapiens
acccaggcccgccucccccuucaggccacccugcccagguuuuguaccagucccugcuc

SEQ ID NO: 157761 - RNA, 59 nt, Homo Sapiens
cuuaccgagcaagguggguggcggugagcccugcccacuggccaagcgcuggccccuca

SEQ ID NO: 157762 - RNA, 59 nt, Homo Sapiens
aggacagagugcccuggggcauccaccuuccugcccaggggacguggcgcugucggugu

SEQ ID NO: 157763 - RNA, 59 nt, Homo Sapiens
ccccuggcccugccucacugugaccugcuccugcccacgugcagcaccugucaccuuuu

SEQ ID NO: 157764 - RNA, 59 nt, Homo Sapiens
gcugcucucggacuccugaucucaggugaccugcccaccucggccucccgaagugcugg

SEQ ID NO: 157765 - RNA, 59 nt, Homo Sapiens
cugggcauaagcuucacaggacgggagaaccugcccaugguggacugucguucuccaca

SEQ ID NO: 157766 - RNA, 59 nt, Homo Sapiens
cuccgagccccaggcagcggugauucagcccugcccaaccugauucugaugacugcgga

SEQ ID NO: 157767 - RNA, 59 nt, Homo Sapiens
ggcgccugcugagcacuuccgccccucacccugcccagccccugccaugagcucugggc

SEQ ID NO: 157768 - RNA, 59 nt, Homo Sapiens
guccccucucuccacacccagccccugcuccugcccaggcugcccugcccagcgccuca

SEQ ID NO: 157769 - RNA, 59 nt, Homo Sapiens
cacccagccccugcuccugcccaggcugcccugcccagcgccucaucagccucugccuu

SEQ ID NO: 157770 - RNA, 59 nt, Homo Sapiens
uuccccaucaggcugggcucuggcagggaccugcccaggauggagaugagagaggguga

SEQ ID NO: 157771 - RNA, 50 nt, Homo Sapiens; identical to SEQ ID NO: 77736

SEQ ID NO: 157772 - RNA, 59 nt, Homo Sapiens
cacgcacgccccgugcuguguuccugggcccugcccauggccucaauaaacucucugcu

SEQ ID NO: 157773 - RNA, 59 nt, Homo Sapiens
ugggaaucugaggcagaggaucacccccaccugcccacuggugcuacccggagccccau

SEQ ID NO: 157774 - RNA, 59 nt, Homo Sapiens
auaggccucugcuaccugccugggcaaguccugcccaccuccuggccccaccagggccu

SEQ ID NO: 157775 - RNA, 59 nt, Homo Sapiens
aacuguaucugauuucacuacccacccucccugcccaucgcacuggaguugucucuuac

SEQ ID NO: 157776 - RNA, 59 nt, Homo Sapiens
uggcacugcacuggaguugucagugggagccugcccaccggaggagcgucucaagugaa

SEQ ID NO: 157777 - RNA, 59 nt, Homo Sapiens
cacuggccuucccuccugccccuccucagccugcccacgacuugaggggggucauauuc

SEQ ID NO: 157778 - RNA, 59 nt, Homo Sapiens
ucucugccuaccugccugagccauguucaccugcccacuuguccccugcugccugccca

SEQ ID NO: 157779 - RNA, 59 nt, Homo Sapiens
auguucaccugcccacuuguccccugcugccugcccaaacaccccaccauuggccuguc

SEQ ID NO: 157780 - RNA, 64 nt, Homo Sapiens
acuaguuccaaaccuagcagaacaauuaaaggguugacucaagauauuauugacaauggcagag

SEQ ID NO: 157781 - RNA, 64 nt, Homo Sapiens
guacacuauacauuuaccauuuaagacauuuuaaugacucaaagugguaacaagcuguuaucuu

SEQ ID NO: 157782 - RNA, 64 nt, Homo Sapiens
uuacaaccucuucuucucuuggaauaauuugagaugacucaauaccaacauaaaaauuauaaua

SEQ ID NO: 157783 - RNA, 64 nt, Homo Sapiens
gguauuuaagaauugacgagucucuuuacuguaaugacucaaaaccuuuuccauuuuggauuua

SEQ ID NO: 157784 - RNA, 64 nt, Homo Sapiens
auuagauauuuuaccauauauauauguuuuuauuugacucaaaauucagcaaaacuuauaccug

SEQ ID NO: 157785 - RNA, 64 nt, Homo Sapiens
ggaaauugugcacuuuccugacagccuuuaaauuugacucaaauuucucaagauuuuucuaaau

SEQ ID NO: 157786 - RNA, 64 nt, Homo Sapiens
acaguuggcagcagugaccucaguagggaacauguccgucuacccucucgcacucaugacaccu

SEQ ID NO: 157787 - RNA, 64 nt, Homo Sapiens
cagccgggaugggaggcacguggccucucuuuuauccgucuauuuauuuuguaaguguauucgu

SEQ ID NO: 157788 - RNA, 64 nt, Homo Sapiens
uagcauucccccagucccucccucuucaccuugcuccgucuaugucuucccagcucagccuuuu

SEQ ID NO: 157789 - RNA, 64 nt, Homo Sapiens
uguguuucuucugcuucaauacacccuccucaguuccgucuaaacccguggaagaaaacagaac

SEQ ID NO: 157790 - RNA, 64 nt, Homo Sapiens
uaacauuucaagggcaauacggucuccuuggaaauccgucuaguaagacaguauacaguccugu

SEQ ID NO: 157791 - RNA, 64 nt, Homo Sapiens
aaggcuagaucaugaagaaccuugacggcauugcuccgucuaagucaugagcugagcagggaga

SEQ ID NO: 157792 - RNA, 64 nt, Homo Sapiens
uaugugugaauaauguaaguauguucuggaugauuccgucuauaagggggguuggcaguugauu

SEQ ID NO: 157793 - RNA, 64 nt, Homo Sapiens
uaauuuugugcacauucuaauuaauuaaacuucuuccgucuaaaaaaagugggggaaauguaua

SEQ ID NO: 157794 - RNA, 64 nt, Homo Sapiens
ugguacauugauaauuuaguauagugaguguauguccgucuaaccaaguaaaauaguaaagcac

SEQ ID NO: 157795 - RNA, 64 nt, Homo Sapiens
guugacuuccucacgaugcugcgcgagccguguuuccgucuauugcacgguggggcgaugcugg

SEQ ID NO: 157796 - RNA, 64 nt, Homo Sapiens
agaaaauauaguuacugccugcaaagaauuaacauccgucuagugggagaaacaaacacacccc

SEQ ID NO: 157797 - RNA, 64 nt, Homo Sapiens
uuucuugcuguccugccagcacaagggcagagaguccgucuagaagggaagggcuuuucuccac

SEQ ID NO: 157798 - RNA, 64 nt, Homo Sapiens
gccccgcagggggcuuggagggcuggacggcaaguccgucuagcucacgggccccuccagugga

SEQ ID NO: 157799 - RNA, 64 nt, Homo Sapiens
uauaacacaaaacuuuuauaaguucucuaacaucuccgucuacagagaugguguucugagccau

SEQ ID NO: 157800 - RNA, 64 nt, Homo Sapiens
gcaugaauaagaggggagguugugugugugcucuuccgucuaagugugugugugugugugugug

SEQ ID NO: 157801 - RNA, 64 nt, Homo Sapiens
aacaugcgggggaaggauccaaaguagaagucuguccgucuaugcagcucuuuucuagcgacug

SEQ ID NO: 157802 - RNA, 61 nt, Homo Sapiens
gcugcagagacaagagauaauuccagcagaauccgucuaagaagaccuuucauguacuucc

SEQ ID NO: 157803 - RNA, 64 nt, Homo Sapiens
auucaaguauucauuguugauccuccuauucucuuccgucuaaucucucaccugcuaaaggaga

SEQ ID NO: 157804 - RNA, 64 nt, Homo Sapiens
cuaacuuuuugaguguguuuaugaaaggcuuguuuccgucuaguuauguagguuuaucagugaa

SEQ ID NO: 157805 - RNA, 64 nt, Homo Sapiens
uggcucucuggucuaggcccuuugggcaagaauguccgucuacccggcuuccaccacccucugg

SEQ ID NO: 157806 - RNA, 64 nt, Homo Sapiens
auggagcuucaaggaaagaaaccccucaguuuuuuccgucuaguccgccaccucauuccccauu

SEQ ID NO: 157807 - RNA, 64 nt, Homo Sapiens
cacagugaccucacagagagugcuggcuggcuucuccgucuaccugggugcuuuuccuccaguu

SEQ ID NO: 157808 - RNA, 64 nt, Homo Sapiens
cccuguuuaauaacgaaggggugggggagagcaguccgucuacaaccuggaaucagauuugcaa

SEQ ID NO: 157809 - RNA, 64 nt, Homo Sapiens
auaaaguauuauaaauuguugugaauuugaagaauccgucuacuguauuauugcuaaauauuuu

SEQ ID NO: 157810 - RNA, 64 nt, Homo Sapiens
uuccucuucaggaaaugucccacuggccuuucuuuccgucuagcccaccugcucccucucuccu

SEQ ID NO: 157811 - RNA, 64 nt, Homo Sapiens
uuguuuaccuuucgugcgguggauucuuuuuaacuccgucuaccuggcguuuuguuagaaaugu

SEQ ID NO: 157812 - RNA, 64 nt, Homo Sapiens
caguccucauucccagcugccucuuccuacugcuuccgucuaucaaaaagcccccuuggcccag

SEQ ID NO: 157813 - RNA, 64 nt, Homo Sapiens
cacccgcccacccgcccccaaggcugcugcuuuguccgucuauccgggagcccggcugcacacc

SEQ ID NO: 157814 - RNA, 64 nt, Homo Sapiens
agagcgugcacuugugauccugacaaagucauccuccgucuaccaggcccuucagccagaagac

SEQ ID NO: 157815 - RNA, 64 nt, Homo Sapiens; identical to SEQ ID NO: 102876

SEQ ID NO: 157816 - RNA, 64 nt, Homo Sapiens; identical to SEQ ID NO: 102877

SEQ ID NO: 157817 - RNA, 61 nt, Homo Sapiens
ccuccaggccuccuucuggacucccuccauuucuacccagacuccagagaccauauuuucu

SEQ ID NO: 157818 - RNA, 61 nt, Homo Sapiens
aacauucaccaaucauuuaucuuucuuggcuucuacccacaccauagaggucaguuuuccu

SEQ ID NO: 157819 - RNA, 61 nt, Homo Sapiens
gcaucccucuggucagaggcgaagucuauacucuacccaggagguuauccaccucugccug

SEQ ID NO: 157820 - RNA, 61 nt, Homo Sapiens
gcagcagaccaauguguacacagagccaacuucuacccauuaauaacuugaucccugauga

SEQ ID NO: 157821 - RNA, 61 nt, Homo Sapiens
cucccuucuagcagauuuuggcugguggcugucuacccaccuguuugaauuuauaaacaag

SEQ ID NO: 157822 - RNA, 61 nt, Homo Sapiens
cucccuucuagcagauucuuggcggguggcgucuacccaccaaccaaagugccugugacgg

SEQ ID NO: 157823 - RNA, 61 nt, Homo Sapiens
aacuucagugggagagcugucugguucauauucuacccaggaaugguacuuuucagugcag

SEQ ID NO: 157824 - RNA, 61 nt, Homo Sapiens
cacuguaggagauuuacuaauaucccuggccucuacccaguaguaccacuagcaccuauuc

SEQ ID NO: 157825 - RNA, 61 nt, Homo Sapiens
accagcauguucuccccaaagacuggaauauucuacccaaaugucaggaccaggauuuucu

SEQ ID NO: 157826 - RNA, 61 nt, Homo Sapiens
auauucuacccaaaugucaggaccaggauuuucuacccagagaccaagguguucuucccaa

SEQ ID NO: 157827 - RNA, 61 nt, Homo Sapiens
accaagguguucuucccaaagaccaaaauauucuacccauaugucaggaccaggauuuucu

SEQ ID NO: 157828 - RNA, 61 nt, Homo Sapiens
auauucuacccauaugucaggaccaggauuuucuacccagagaccaagguuaucuuccuaa

SEQ ID NO: 157829 - RNA, 61 nt, Homo Sapiens
accaagguuaucuuccuaaagaccaaaauauucuacccauaugucaggaccgggauuuucu

SEQ ID NO: 157830 - RNA, 61 nt, Homo Sapiens
auauucuacccauaugucaggaccgggauuuucuacccagagaccugcauguucucuccaa

SEQ ID NO: 157831 - RNA, 61 nt, Homo Sapiens
accugcauguucucuccaacgaccagaauauucuacccaaaugucaggaccaagauuuucu

SEQ ID NO: 157832 - RNA, 61 nt, Homo Sapiens
ugcacaucaugaugacuuuaccuccauucccucuacccagaacccuaaauuauucuguuau

SEQ ID NO: 157833 - RNA, 61 nt, Homo Sapiens
auuggggagguuggucagggaagagagggguucuacccacagaucaacuguguaaucuuuu

SEQ ID NO: 157834 - RNA, 61 nt, Homo Sapiens
gaagaauggaagguaaggggaaggucugucaucuacccaggacauucccaugaugaguaca

SEQ ID NO: 157835 - RNA, 61 nt, Homo Sapiens
caguauuucacuuuuaaaaagacaaggcaucucuacccauuaacucugcaagccacuccac

SEQ ID NO: 157836 - RNA, 61 nt, Homo Sapiens
aaagaauauacauucuuuucaccccucccagucuacccauccagccuucaugauucauucc

SEQ ID NO: 157837 - RNA, 61 nt, Homo Sapiens
guaaaucagauaaaugcuuggaauuugauugucuacccaaucaacaguuuucccucuuugc

SEQ ID NO: 157838 - RNA, 64 nt, Homo Sapiens
aaaaagguacuuaaacaguuauagucaccaucaccugcuucagaauggucuuuuagauuugugu

SEQ ID NO: 157839 - RNA, 64 nt, Homo Sapiens
ucuuuccaucacaaaacggguagaaacacauucacugcuucaggguucuaaucugugugucucc

SEQ ID NO: 157840 - RNA, 64 nt, Homo Sapiens
cuccugaguagcugggauuauucaagcgauucuccugcuucaacugcaaccuccgccucccagg

SEQ ID NO: 157841 - RNA, 64 nt, Homo Sapiens
cuucuucuccaacccagcucugcgcucugagcuccugcuucauguacaggccagcuugcugugc

SEQ ID NO: 157842 - RNA, 64 nt, Homo Sapiens
aguuacaguucguccugacaagcaucucggggaccugcuucacaccauuugggacaucaagccu

SEQ ID NO: 157843 - RNA, 64 nt, Homo Sapiens
gcagugaagguaggugugagcugcuccacgcagucugcuucaguggagcgucuuggcugccgcc

SEQ ID NO: 157844 - RNA, 64 nt, Homo Sapiens
ggacaaacaacagugaaaaugcagcaucugucuccugcuucacagggucgacugucagggugac

SEQ ID NO: 157845 - RNA, 64 nt, Homo Sapiens
acuccuugccguucagccacugugaaaccagaaucugcuucacagaaaaaagcaucucaguuag

SEQ ID NO: 157846 - RNA, 64 nt, Homo Sapiens
ggggaacuagccuuuugugaaacugccaugugcucugcuucaagguuugaacuguuccaguguc

SEQ ID NO: 157847 - RNA, 64 nt, Homo Sapiens
cugcuacuuuguaacuaggacacagggcuuauagcugcuucauuuuguguucauauaguaacug

SEQ ID NO: 157848 - RNA, 64 nt, Homo Sapiens
cucccaaaguacugggauuagagcucaagcaauccugcuucagcgccuaggcucccgaacuccu

SEQ ID NO: 157849 - RNA, 64 nt, Homo Sapiens
uauaauguuacagcaguuugccucccaccagcugcugcuucaggcacuuucagucuccuauaac

SEQ ID NO: 157850 - RNA, 64 nt, Homo Sapiens
gcugcugcagagcuagaaggcccugcagcuacagcugcuucauucccugcauuagugccugguu

SEQ ID NO: 157851 - RNA, 64 nt, Homo Sapiens
cgggcuacagagcuagaaggcccugcagcuacagcugcuucauucccugcauuagcgagcaguu

SEQ ID NO: 157852 - RNA, 64 nt, Homo Sapiens
ucaaggacuuugcugcuguuuuccuaugucauuucugcuucagcucuuugcugcuucacuucuu

SEQ ID NO: 157853 - RNA, 64 nt, Homo Sapiens
uguuuuccuaugucauuucugcuucagcucuuugcugcuucacuucuuuguaaaguuguaaccu

SEQ ID NO: 157854 - RNA, 64 nt, Homo Sapiens
uaggauacagggcagggauaaauacagugcaugucugcuucaauuagcagaugccgcaacucca

SEQ ID NO: 157855 - RNA, 64 nt, Homo Sapiens
uaaacagaaaugccaaauugaugguuaauuguugcugcuucaaaaauaaguauaaaauuaauau

SEQ ID NO: 157856 - RNA, 64 nt, Homo Sapiens
acauugauuuuauucacuuauggcaaccaccauucugcuucaugucccucuuuuccccagccuc

SEQ ID NO: 157857 - RNA, 64 nt, Homo Sapiens
gcugggcgcgguggcuaacaucuuaucuaaaagccugcuucaggaaauuuucauggacaugcaa

SEQ ID NO: 157858 - RNA, 64 nt, Homo Sapiens
agucggcccaggacggucuacucagcacaacugacugcuucagugcugcuaucagaagaugucu

SEQ ID NO: 157859 - RNA, 64 nt, Homo Sapiens
acuccccuacgccccuucaaccuuuuuucucugucugcuucaccugagaagaaaguguacgaag

SEQ ID NO: 157860 - RNA, 64 nt, Homo Sapiens
uuucuuuugcugguuauaguugcuaauucuaaagcugcuucagacugcuucaugaggagguuaa

SEQ ID NO: 157861 - RNA, 64 nt, Homo Sapiens
ugguuauaguugcuaauucuaaagcugcuucagacugcuucaugaggagguuaaucuacaauua

SEQ ID NO: 157862 - RNA, 64 nt, Homo Sapiens
gcuauuaauaguuaaaugaaauguuugugugcaacugcuucauuaaauguuuacauauguuuac

SEQ ID NO: 157863 - RNA, 64 nt, Homo Sapiens
uuuuuaugagcuuucacauuauguaauaugaaagcugcuucagcuuaugacaaauaaauaugcc

SEQ ID NO: 157864 - RNA, 64 nt, Homo Sapiens
cugcaccccucccuugucucuggcuguugaggcgcugcuucagcucguguugccuacauguccc

SEQ ID NO: 157865 - RNA, 64 nt, Homo Sapiens
gccccuuuucucucugcuagccuggcagacauagcugcuucagucugcaagggagccccuagcc

SEQ ID NO: 157866 - RNA, 64 nt, Homo Sapiens
cucccgaguagucccaggaguucaugccauucuccugcuucagcugcaagcucugucuccuggg

SEQ ID NO: 157867 - RNA, 64 nt, Homo Sapiens
acccccagccagacuauucagcuuccaagacuuccugcuucaaagacaacuuuacaauuuacug

SEQ ID NO: 157868 - RNA, 64 nt, Homo Sapiens
ugauagacucaagcauaaaacuuggcaguuuuaucugcuucaaaaugccauugaucauuauucc

SEQ ID NO: 157869 - RNA, 64 nt, Homo Sapiens
uuuacaaugacuuaauauaagacugacuuuuauccugcuucauaacuuguauggagaacucacc

SEQ ID NO: 157870 - RNA, 64 nt, Homo Sapiens
aguugcagacucaucaccaugguuaccauagugacugcuucauugccaugguuacauacuaauu

SEQ ID NO: 157871 - RNA, 64 nt, Homo Sapiens
cauacuaauugcugcagcucuguggcccagcccacugcuucagcugugggccaucugaggguac

SEQ ID NO: 157872 - RNA, 64 nt, Homo Sapiens
uaggccaaaccucagggcaauagauuccuuucuccugcuucauacuguccaaccuccuuucugg

SEQ ID NO: 157873 - RNA, 64 nt, Homo Sapiens
aacugcuuugcaaugacauuuaacucauaccugucugcuucagcgucacagguugcucuccuug

SEQ ID NO: 157874 - RNA, 64 nt, Homo Sapiens
ggggaccaagcagucauuuguauggagagcuacacugcuucaguuccauaaccaccaaaaauac

SEQ ID NO: 157875 - RNA, 64 nt, Homo Sapiens
auuaccaggacuccuacacauggagguggucaaacugcuucaagugcugugcaguucaaccauc

SEQ ID NO: 157876 - RNA, 64 nt, Homo Sapiens
gggauuggccuguccccuuucguguucugacuuacugcuucagaguuugaguucuguaagucuu

SEQ ID NO: 157877 - RNA, 64 nt, Homo Sapiens
ggaaacccaggaaaugcccuccacuauuucuccucugcuucagaaguccagcagccuggcugac

SEQ ID NO: 157878 - RNA, 64 nt, Homo Sapiens
cacuuugcucugauuauggaaaagucuucaagggcugcuucaaacucaaacacagagagaaacu

SEQ ID NO: 157879 - RNA, 64 nt, Homo Sapiens
cuccuuccaacugcugccccaaaggaagcuuucucugcuucagcuugcuucauugggcuguuuu

SEQ ID NO: 157880 - RNA, 64 nt, Homo Sapiens
caagaggccucaguuuagcaccuuaguaccuccgcugcuucacuugcuuuagccaaagccauaa

SEQ ID NO: 157881 - RNA, 64 nt, Homo Sapiens
gcaugaggaacccucuuuccuccgcucagagaugcugcuucauuuacccaggaggucauauucu

SEQ ID NO: 157882 - RNA, 64 nt, Homo Sapiens
ccaaggaauuucugcucugguuagaaaaaggacucugcuucaguccacuucugcucugguuaga

SEQ ID NO: 157883 - RNA, 64 nt, Homo Sapiens
ucaguccacuucugcucugguuagaaaaaggacucugcuucaguccacaguacauaaaauguac

SEQ ID NO: 157884 - RNA, 64 nt, Homo Sapiens
aaugaagaucacguucagaagaauggaaggaaagcugcuucauuuuugaaagaugauggagacc

SEQ ID NO: 157885 - RNA, 64 nt, Homo Sapiens
accacuacuauaugaugaauagcacuaauacccacugcuucaguguuaacacagcagugauugu

SEQ ID NO: 157886 - RNA, 64 nt, Homo Sapiens
ccugcaaugagccaagaaccucucuuucucuuuccugcuucaccuuccaagcaggccucaccag

SEQ ID NO: 157887 - RNA, 64 nt, Homo Sapiens
cuuguucuuugaccugcugauugcuuagcagguucugcuucacagugagugucacuacuuggcu

SEQ ID NO: 157888 - RNA, 64 nt, Homo Sapiens
cuaagccaguacuccuuguucaggacucagcuuucugcuucagccaucaggaacugagcagguc

SEQ ID NO: 157889 - RNA, 64 nt, Homo Sapiens
cucugccaucuuccaugacuaaacugacuuuggacugcuucaguuuuuucccccguggggaaau

SEQ ID NO: 157890 - RNA, 64 nt, Homo Sapiens
guuggcugguuugaacgauagaaauaugcagcaugcaauauaugcuuauauuucauuuuaauuu

SEQ ID NO: 157891 - RNA, 64 nt, Homo Sapiens
gaaucuuugauguuuuuugucauuguucucaagugcaauauaacaauguaaccaaaucuagaua

SEQ ID NO: 157892 - RNA, 64 nt, Homo Sapiens
auuuucacuaggaaaagaaaucaaauaugcuuaugcaauauauauuuguguguuuuuccuuaau

SEQ ID NO: 157893 - RNA, 64 nt, Homo Sapiens
ucuuuuaucugcuaaguuguaccuuaauuagagggcaauauauguuucauaaagaagagucuuu

SEQ ID NO: 157894 - RNA, 64 nt, Homo Sapiens
auauguaauagggaauaccuuuuauucauuuucugcaauauacucaaauuaaguacaaggaaug

SEQ ID NO: 157895 - RNA, 64 nt, Homo Sapiens
uaaaugaaaacauuuaauuguuggagggaguguugcaauauauaaucucucuaguaugaaagau

SEQ ID NO: 157896 - RNA, 64 nt, Homo Sapiens
auccaaucuucugaacuugaacuuagcaaaauuagcaauauauuauuguuuuguuggcucucaa

SEQ ID NO: 157897 - RNA, 64 nt, Homo Sapiens
gaaagugauccaaaauuugauccuucuuuucuaggcaauauaagauuuugaaaaacacaaugau

SEQ ID NO: 157898 - RNA, 64 nt, Homo Sapiens
aauauuguguuuaaccacaugguauuaaaauuuugcaauauauuguguauuggucugauauuuu

SEQ ID NO: 157899 - RNA, 64 nt, Homo Sapiens
acugcagagaucauguucauuuacauucccauuagcaauauauccaaugcucagaauugaaaau

SEQ ID NO: 157900 - RNA, 64 nt, Homo Sapiens
aauucuuucuuucugccaaguuuagguuuaagauguaagugaacucuacacuuucucugaauca

SEQ ID NO: 157901 - RNA, 64 nt, Homo Sapiens
ugcccaaggucagagccacugagaccugaagaggguaagugacucauucugcagugagauugcc

SEQ ID NO: 157902 - RNA, 64 nt, Homo Sapiens
cugccaaugucugcaccauugcagaaaugugucuguaagugaaaaggacucaaucucugaccca

SEQ ID NO: 157903 - RNA, 64 nt, Homo Sapiens
cuuguagauucucucacagggauaaguuacaauuguaagugaugucaacagaaaucuccgauau

SEQ ID NO: 157904 - RNA, 64 nt, Homo Sapiens
uacagauagcaaaauuuuacgccucugagggucaguaagugaaguuauugucuucuagccuuga

SEQ ID NO: 157905 - RNA, 64 nt, Homo Sapiens
accugccuuuugccacucuuuaggcugaaguggaguaagugaaacuagguaaaauucaguauaa

SEQ ID NO: 157906 - RNA, 64 nt, Homo Sapiens
auccaauccuaaaacuuacauuccaaaggaauuauaucauuauguuccuaaggaguaaauauau

SEQ ID NO: 157907 - RNA, 64 nt, Homo Sapiens
uaccagauuaauaaaaauuuaugaauauuaaaauuaucauuaauaauauaaaacacuuauuuga

SEQ ID NO: 157908 - RNA, 64 nt, Homo Sapiens
ucugcuuucugaacucuaaugugccuucauugauuaucauuaaaauuaucauuaaaauugccuu

SEQ ID NO: 157909 - RNA, 64 nt, Homo Sapiens
acucuaaugugccuucauugauuaucauuaaaauuaucauuaaaauugccuuauuucuauggac

SEQ ID NO: 157910 - RNA, 64 nt, Homo Sapiens
uuuuucucauaguucagaaaccaggugcuuuauguaucauuaaaugcagaggacuugcuauuug

SEQ ID NO: 157911 - RNA, 64 nt, Homo Sapiens
guauuauauacacugauacucuaucauuugguacuaucauuaauauuuaucauuaaauuuaguu

SEQ ID NO: 157912 - RNA, 64 nt, Homo Sapiens
uuuaguucuaucauuugguauucuaucauuaauuuaucauuaaacuuuuuccuuuuaaauuuag

SEQ ID NO: 157913 - RNA, 64 nt, Homo Sapiens
uuaucauuaaauuuaguucuuuuaaauuuaguucuaucauuaauacuuagaaugacuuuuuccu

SEQ ID NO: 157914 - RNA, 64 nt, Homo Sapiens
ccaaaauacaaaauaaagaauuuucagaugcagcuaucauuauuuuaaugugcauauaucauua

SEQ ID NO: 157915 - RNA, 64 nt, Homo Sapiens
uucagaugcagcuaucauuacauuaaugugcauauaucauuauuugcucuuuuucuuaaauacu

SEQ ID NO: 157916 - RNA, 64 nt, Homo Sapiens
aauaaacauuuauacuagauuuuuuauuuccacuuaucauuaaugauuuaauguuggauuucag

SEQ ID NO: 157917 - RNA, 64 nt, Homo Sapiens
acuuuguacaggcuguuuugcaccugauuuuauuuaucauuagugccacgccaagaucauuuag

SEQ ID NO: 157918 - RNA, 64 nt, Homo Sapiens
ucuuuaaaagaaaugaaauaauauacguuuuguauaucauuaaaguguauuacuuaaagauacu

SEQ ID NO: 157919 - RNA, 64 nt, Homo Sapiens
ugauacuggcagauugcaguuaauucaguuggauuaucauuaugguuugugguacuuaagaaau

SEQ ID NO: 157920 - RNA, 64 nt, Homo Sapiens
uugugaacauugcucuucauuuuggccuguacuucucccucagggacguagaacaauggaaugu

SEQ ID NO: 157921 - RNA, 64 nt, Homo Sapiens
aaaacuuuuucuuuaaaauucaauuaagguacuucucccucagggacguagaacaauggaaugu

SEQ ID NO: 157922 - RNA, 64 nt, Homo Sapiens
augaagugccauuucuguuauagccucuuccucccucccucaugugccuuguggcaugucuguc

SEQ ID NO: 157923 - RNA, 64 nt, Homo Sapiens
ccacccugcuuuuaaaaauuuucuuuguaaaauucucccucacccaaaauuauuucaucuugua

SEQ ID NO: 157924 - RNA, 64 nt, Homo Sapiens
ugagcagugaucacuuacucccuccgugaagcuucucccucagcgcaaaacucaagucccucuu

SEQ ID NO: 157925 - RNA, 64 nt, Homo Sapiens
ccuccuuggccccucucccucguagaggucccaccucccucauuggagggccuacggauggguc

SEQ ID NO: 157926 - RNA, 64 nt, Homo Sapiens
ccagaucccguaggcagcccgagcaccucaguggcucccucagacaguccccgaucgcugcugu

SEQ ID NO: 157927 - RNA, 64 nt, Homo Sapiens
aguuuggacaauuugaaauuccacgguucccacccucccucaccggagauugcccuucccuaug

SEQ ID NO: 157928 - RNA, 64 nt, Homo Sapiens
cccaauaggaggaucccaggccugcugucuuccccucccucaacguugcugcucccucaaccuu

SEQ ID NO: 157929 - RNA, 64 nt, Homo Sapiens
cuuccugcugucuuccccucuggccaaguugcugcucccucaaccuaaaguuaaucucuugguc

SEQ ID NO: 157930 - RNA, 64 nt, Homo Sapiens
ugguuucauuuaaugcuuuaaucuggaaagccgucucccucagaaagugggggaggugagacag

SEQ ID NO: 157931 - RNA, 64 nt, Homo Sapiens
cucgucuguccugucaccuggcccagcccauccccucccucaucccucccgugacagccggcag

SEQ ID NO: 157932 - RNA, 64 nt, Homo Sapiens
cucgcagccacucugugcccucaaauucuucugccucccucauguaugguagcuaccucuuacu

SEQ ID NO: 157933 - RNA, 64 nt, Homo Sapiens
ucuuuucccccuggcauggaccuacucuuugugacucccucauauuccucccuuucucagucua

SEQ ID NO: 157934 - RNA, 64 nt, Homo Sapiens
uugcaaggccauaaguguuuagccucacccugaacucccucaucuccccgacuccucaccccug

SEQ ID NO: 157935 - RNA, 64 nt, Homo Sapiens
ucaaaggguccucaaagcuccuaugcaaguccuccucccucaucccuuagcccccuguaugacc

SEQ ID NO: 157936 - RNA, 64 nt, Homo Sapiens
ucaaguugugauaaauuugaucccaauagaauaccucccucauuuaagaaaaaucauaacucac

SEQ ID NO: 157937 - RNA, 64 nt, Homo Sapiens
guuuggaaauggagggaggaauuuucauugccuucucccucaugcaugaagauucgaacagcuu

SEQ ID NO: 157938 - RNA, 64 nt, Homo Sapiens
ucccuuagccgucuuacucaacugccccuuuccucucccucagaauuuguguuugcugccucua

SEQ ID NO: 157939 - RNA, 64 nt, Homo Sapiens
cugucaaguggaauccuucccuuuccaacucuaccucccucacucagcuccuuuccccugauca

SEQ ID NO: 157940 - RNA, 64 nt, Homo Sapiens
cucagacugggaaucccugaagauggggccgugucucccucaaaguggggcucccucaggacag

SEQ ID NO: 157941 - RNA, 64 nt, Homo Sapiens
cugaagauggggccgugucucccucaaaguggggcucccucaggacagcguugugucuccccuc

SEQ ID NO: 157942 - RNA, 64 nt, Homo Sapiens
cucagacugcggcucccugaggacggggcugugucucccucagacuggggcucccugaagaaag

SEQ ID NO: 157943 - RNA, 64 nt, Homo Sapiens
cucagacuggggcucccugaagaaagggcugcuucucccucagacuggagcucccugaagaugg

SEQ ID NO: 157944 - RNA, 64 nt, Homo Sapiens
gcccguguggcagagcuguggacuuucuucucggcucccucaacccuggcucaggcacagaagg

SEQ ID NO: 157945 - RNA, 64 nt, Homo Sapiens
uugccagcguugggugggacacccguggcggcugcucccucagaccucccuucuguggacugac

SEQ ID NO: 157946 - RNA, 64 nt, Homo Sapiens
uguuuccaucucaggcauguaucccaccaagugccucccucacagccaugcccagaagccucac

SEQ ID NO: 157947 - RNA, 64 nt, Homo Sapiens
cuuggcuucuccagggcucucucccucaggcuuucucccucagucccuggggacuggggcgcuc

SEQ ID NO: 157948 - RNA, 64 nt, Homo Sapiens
cuuucucccucagucuuggcggacuggggcgcuccucccucaggugcaccaggccggucccugg

SEQ ID NO: 157949 - RNA, 64 nt, Homo Sapiens
caggacagccuguggccuuucccucagaggaacucucccucaccgacugagccuuuuuggugcu

SEQ ID NO: 157950 - RNA, 62 nt, Homo Sapiens; identical to SEQ ID NO: 115690

SEQ ID NO: 157951 - RNA, 64 nt, Homo Sapiens
cuggcacccacugcuacacuccaccgcaguccagcucccucaguggacucucuggccaccuccu

SEQ ID NO: 157952 - RNA, 64 nt, Homo Sapiens
gucuggggcucuucugggaggcugcccagcguaccucccucaccgccagcccggagcccacagu

SEQ ID NO: 157953 - RNA, 64 nt, Homo Sapiens
cccagcgguccaaugccaccggucccagccccuccucccucagauccccagacccagaggucca

SEQ ID NO: 157954 - RNA, 64 nt, Homo Sapiens
cucagagguccaggcccccagcccccaaccccuccucccucagaccucagacccagggguccag

SEQ ID NO: 157955 - RNA, 64 nt, Homo Sapiens
cccaggaguccagccccuccccccccagccccuccucccucagacucagacccaggaguccaga

SEQ ID NO: 157956 - RNA, 64 nt, Homo Sapiens
cccaggaguccagaccccccgaguccagccccuccucccucagacccuccucccucagacccag

SEQ ID NO: 157957 - RNA, 64 nt, Homo Sapiens; identical to SEQ ID NO: 157955

SEQ ID NO: 157958 - RNA, 64 nt, Homo Sapiens
cccaggaguccagaccccccauccccagccccuccucccucagacccucaaaccaaggguacag

SEQ ID NO: 157959 - RNA, 64 nt, Homo Sapiens
ccaaggguacagauccccaggcccccagccccuccucccucaaaccucaggcccaggaguccag

SEQ ID NO: 157960 - RNA, 64 nt, Homo Sapiens
cccaggaguccaggcccccaguucccagccccuccucccucagggaaggaauucaggaauaucu

SEQ ID NO: 157961 - RNA, 64 nt, Homo Sapiens
cccaggaguccaggccccaggcccccagccccuccucccucagaccucagacccgggaguccag

SEQ ID NO: 157962 - RNA, 64 nt, Homo Sapiens
cccgggaguccaggcccccagcccccagccccuccucccucagaccucagacccaggaguccag

SEQ ID NO: 157963 - RNA, 64 nt, Homo Sapiens
cccaggaguccaggcccccaggccccagccccuccucccucagaacucaggacccaggagucca

SEQ ID NO: 157964 - RNA, 64 nt, Homo Sapiens
cccaggacuccaggcccccaggccccaguaccuccucccucagaccucagacccaggauucccg

SEQ ID NO: 157965 - RNA, 64 nt, Homo Sapiens
cccaggauucccgggccccauccuccagcuccuccucccucagaccucagauccaggagucuag

SEQ ID NO: 157966 - RNA, 64 nt, Homo Sapiens
gcucuggcacaguguaauccccagaggugggauccucccucauguaucaacaccacuaggaauc

SEQ ID NO: 157967 - RNA, 64 nt, Homo Sapiens
ucucugggaccuccuuagccgcuguggccgucuccucccucagccccucucucugggcccaggg

SEQ ID NO: 157968 - RNA, 64 nt, Homo Sapiens
gcugucccaagcccaccccuccucccaccaucaccucccucaccucgggacaguagcccuccac

SEQ ID NO: 157969 - RNA, 64 nt, Homo Sapiens
agaaaaacaggucucagcccaggguccucgcucacucccucacuccccacuuugaagccaucuc

SEQ ID NO: 157970 - RNA, 64 nt, Homo Sapiens
ugugucccgaguuccugaagccgcccacuccugccucccucaucccuggggcucaagcgcuggg

SEQ ID NO: 157971 - RNA, 64 nt, Homo Sapiens
aggcugaauugaaaaagggccuccaggggcuagacucccucaggccaggugguggccagagagg

SEQ ID NO: 157972 - RNA, 64 nt, Homo Sapiens
agccgcuaagacugcaagccuuacaccucaccaucucccucaugaguaagacugaaauaaaacu

SEQ ID NO: 157973 - RNA, 64 nt, Homo Sapiens
aaugaauagaaacuucuuauaagccuuuuuccuacucccucagauuauguaauuuauuuguaag

SEQ ID NO: 157974 - RNA, 64 nt, Homo Sapiens
gaguccccauucuaccuucgagcaacccuucuacccacccuacuaggggcugaguuaucagagc

SEQ ID NO: 157975 - RNA, 64 nt, Homo Sapiens
acuggcccuaggaggggcugccuuggcuuuucgaccacccuagccuguucccagaccugggguc

SEQ ID NO: 157976 - RNA, 64 nt, Homo Sapiens
cuuccaccugucccccagacccaaagcucucuccccacccuaccugcccaccuggggcuccugu

SEQ ID NO: 157977 - RNA, 64 nt, Homo Sapiens
cuggggcuccugugcccccuccccacuccagaggccacccuacaaguuguccucaaggucaucc

SEQ ID NO: 157978 - RNA, 64 nt, Homo Sapiens
cuaugugaucaucuaaaaaagggggagcuggccuccacccuauguuccauggauucggaacaag

SEQ ID NO: 157979 - RNA, 64 nt, Homo Sapiens
aaaaaaaaaaauggccacaacaguugcacagugcccacccuauggccuagcuucagguacuuca

SEQ ID NO: 157980 - RNA, 64 nt, Homo Sapiens
uagaacaaauaauaauacuauuuuugggcaaaauccacccuacuugaugaggaccauuugcuug

SEQ ID NO: 157981 - RNA, 64 nt, Homo Sapiens
gucuucugguuucacaggcuucagcucauggguuccacccuaacuuggggaaacaaaagccuuc

SEQ ID NO: 157982 - RNA, 64 nt, Homo Sapiens
agcuaggucggggccccaguuaagcugugccccaccacccuaggcaaugaggggcaggaaaggg

SEQ ID NO: 157983 - RNA, 64 nt, Homo Sapiens
ccucaaagucauuugacugcccccauccaccccaccacccuaaucuuccaccaccucuccggcu

SEQ ID NO: 157984 - RNA, 64 nt, Homo Sapiens
gaguuuauacucaccuuuuaugaaagcacugcaugaauaaaauuauuccuuuguauuuuuacuu

SEQ ID NO: 157985 - RNA, 64 nt, Homo Sapiens
ccucuuuguguuuuauuuugguguccuauuaaaggaauaaaaugacacaacuugucccuuuuuu

SEQ ID NO: 157986 - RNA, 64 nt, Homo Sapiens
auguacuucacagcuagcauauguccuauggaaagaauaaaagcugugaucauuauuuggaaau

SEQ ID NO: 157987 - RNA, 64 nt, Homo Sapiens
uuccuuucauaucguuauuggcuguguauagguagaauaaaaaaaaguuauaccuuuauuuuga

SEQ ID NO: 157988 - RNA, 64 nt, Homo Sapiens
uuuggcuugccuguguaauguccauuuucuggcugaauaaaaagccauuaaacugaaucagaaa

SEQ ID NO: 157989 - RNA, 64 nt, Homo Sapiens
aauccauccuacaucuucccuuugguaguggcaggaauaaaaaaguguguguagauuuauaguu

SEQ ID NO: 157990 - RNA, 64 nt, Homo Sapiens
auggguucuuagucuuuagcaaguauugaaaguagaauaaaaacuguuuuauccacaacuuuuc

SEQ ID NO: 157991 - RNA, 64 nt, Homo Sapiens
accaauacuccacugcucauaacugagccaaccagaauaaaauaagggccuuuauuuggcaaau

SEQ ID NO: 157992 - RNA, 64 nt, Homo Sapiens
uuaccaaggcuucucaguuaaccaaaucuuaagugaauaaaacuacugggcaucuaacuguuac

SEQ ID NO: 157993 - RNA, 64 nt, Homo Sapiens
uauuucaaauugaauuugugaugcuucuuccauugaauaaaaguucuaguuuugccaauagaaa

SEQ ID NO: 157994 - RNA, 64 nt, Homo Sapiens
aagcaaaaucuuguaguuuuuaaucuuaaacacugaauaaaaaaacuuuccccuaaauuggaau

SEQ ID NO: 157995 - RNA, 64 nt, Homo Sapiens
aaggaccuagaguaccuauaggacaaaaaguauagaauaaaaauaugccuuuagucauuugguu

SEQ ID NO: 157996 - RNA, 64 nt, Homo Sapiens
ggaccccuuaccccaacuuuaugaguaaugcuuggaauaaaaacucuuaaggcaacucacugau

SEQ ID NO: 157997 - RNA, 64 nt, Homo Sapiens
cauuugaaauacuaccauauuugugauuuauugagaauaaaaauccauuuugaaauguaaaauu

SEQ ID NO: 157998 - RNA, 64 nt, Homo Sapiens
uuugaauagcuauuauuaaauguuuuucaaaaaagaauaaaaagaacguuuuuauagagaaucu

SEQ ID NO: 157999 - RNA, 64 nt, Homo Sapiens
agcaaguuaagcuucagggucauuuacguaaaaggaauaaaauaagaauggccauauaccacuu

SEQ ID NO: 158000 - RNA, 64 nt, Homo Sapiens
ggcucuguuagucauuauguaccaggacaucucggaauaaaagggauauaaauuuaucauauaa

SEQ ID NO: 158001 - RNA, 64 nt, Homo Sapiens
gggucuacaauggggagaaccugaaggacuaccagaauaaaacacuguggaaugaagugcuaga

SEQ ID NO: 158002 - RNA, 64 nt, Homo Sapiens
gggccaucccagcacuuauagcuccuaaacaagagaauaaaaauaauaaaacaaucucagagca

SEQ ID NO: 158003 - RNA, 64 nt, Homo Sapiens
aucucagagcagcuccuaaaaauuggacuauuaggaauaaaacaacucucaucaacuuaugaua

SEQ ID NO: 158004 - RNA, 64 nt, Homo Sapiens
auauauccuuggggucaagaccugaucuuucuuggaauaaaauauccugucaucuuuucgccua

SEQ ID NO: 158005 - RNA, 64 nt, Homo Sapiens
aaacauuaacaaauuuuuacagcuuucccaagcugaauaaaaacgcgacguauucauggcacaa

SEQ ID NO: 158006 - RNA, 64 nt, Homo Sapiens
agaaaaauggggauauuuccuaggguuguccugagaauaaaaugaguucugugugacaguuaac

SEQ ID NO: 158007 - RNA, 64 nt, Homo Sapiens
uuccauuaaacggaaagccucccugacauuaacugaauaaaaccucauguugugggacuucugu

SEQ ID NO: 158008 - RNA, 64 nt, Homo Sapiens
uuaagaugaaaagcauugguuuuuuaaaauuagagaauaaaauauguauuuaaauuuuuggugu

SEQ ID NO: 158009 - RNA, 64 nt, Homo Sapiens
uugaaugacagcauauuguaagaaaaaaaaaggugaauaaaauuugacauuagauuauaaaugg

SEQ ID NO: 158010 - RNA, 64 nt, Homo Sapiens
aguuauuauaagaagaucuagauccuagauauuagaauaaaauuuauuuucuacuguauccauu

SEQ ID NO: 158011 - RNA, 64 nt, Homo Sapiens
gagagaaaccuguauaauaguaagaucuuauuuugaauaaaaacgucuauaauuacaaggaguu

SEQ ID NO: 158012 - RNA, 64 nt, Homo Sapiens
uuaagcuacaaauugagaaaaccguuauaaauaagaauaaaauaggccaggcacaguggcucac

SEQ ID NO: 158013 - RNA, 64 nt, Homo Sapiens
gagacccugucuccaaaggaaaaacaaaaaagaagaauaaaauaauuuggaugaaaaucauguu

SEQ ID NO: 158014 - RNA, 64 nt, Homo Sapiens
aauugagcagucauuugcaaucauguuagagcuagaauaaaaguagaguuaauaaaaugcaauu

SEQ ID NO: 158015 - RNA, 64 nt, Homo Sapiens
auguuuuaaagguuacuugacagauguaucgauggaauaaaaguuugauuccccaaaaccuuga

SEQ ID NO: 158016 - RNA, 64 nt, Homo Sapiens
auacauguuguaaaaaauucaaauauacagaauggaauaaaaaaaugaucucccuuuauuaccc

SEQ ID NO: 158017 - RNA, 64 nt, Homo Sapiens
gguuaaauuugugaaugaucauuucaaauauauugaauaaaauaagcaaaagcuauuguuauuu

SEQ ID NO: 158018 - RNA, 64 nt, Homo Sapiens
gaaaucugcauucaugccaaugucucaagaacaagaauaaaauucauaaaauagacaauguuuu

SEQ ID NO: 158019 - RNA, 64 nt, Homo Sapiens
guaaaacuacauuuagacuuauuucuaaaaauaagaauaaaaagaauggcguacaaaucuuauu

SEQ ID NO: 158020 - RNA, 64 nt, Homo Sapiens
cuuuacuaaaauauuguaugaaaguaguaauaaagaauaaaauauuuaaggauaaauaaaaaau

SEQ ID NO: 158021 - RNA, 64 nt, Homo Sapiens
gguaaauauuuuaaguuauuauguccuuguaaaagaauaaaaaaaaccagaagguaaaacuuag

SEQ ID NO: 158022 - RNA, 64 nt, Homo Sapiens
ucacuguaagaucacaagccuguucagaugcuuagaauaaaaugccuggagaauguccaccuug

SEQ ID NO: 158023 - RNA, 64 nt, Homo Sapiens
accuuaguagaauacagagcuuugguaauuacaugaauaaaauuaagaaaauagccauauacaa

SEQ ID NO: 158024 - RNA, 64 nt, Homo Sapiens
ucacuuuauaguuugggagacagaaucaggucuugaauaaaauaauuguaaugagugcuaaaug

SEQ ID NO: 158025 - RNA, 64 nt, Homo Sapiens
uagagguaacuauguuguauuuucaucauaucaugaauaaaauaaauauaauggaaaacagauu

SEQ ID NO: 158026 - RNA, 64 nt, Homo Sapiens
aaaagaccaguaacuuuguuacuucuaguguuaggaauaaaaaaccauuugaugagcaaaaucu

SEQ ID NO: 158027 - RNA, 64 nt, Homo Sapiens
auauccuuuuacaaguggcuacugcuuuaaaaaagaauaaaagaagugugcuucagaaauauau

SEQ ID NO: 158028 - RNA, 64 nt, Homo Sapiens
aaaagcagcaauaugucauuagaaucuuaauaaugaauaaaauaauuucccccacagagugccu

SEQ ID NO: 158029 - RNA, 64 nt, Homo Sapiens
gaacuguggguucucuauaauuuuucuuugcucugaauaaaacuuaguaugauggaaaguuucu

SEQ ID NO: 158030 - RNA, 64 nt, Homo Sapiens
caugggaggcaaagaaaggaauuucagcagggcagaauaaaaacuugccuuugcuuuguucaua

SEQ ID NO: 158031 - RNA, 64 nt, Homo Sapiens
ugcugguuuuaucugagugaaauacuguacaggggaauaaaagagaucuuauuuuuuuuuuuau

SEQ ID NO: 158032 - RNA, 64 nt, Homo Sapiens
gaucuuauuuuuuuuuuuauacuuggcguuuuuugaauaaaaaccuuuugucuuaacucguggc

SEQ ID NO: 158033 - RNA, 64 nt, Homo Sapiens
agcuuuacuaaaagaacauaagucaagggaggaugaauaaaaacagcaaaaccaaauaaagugg

SEQ ID NO: 158034 - RNA, 64 nt, Homo Sapiens
gaaguuaaaagguuguacucauuguauuuacaaagaauaaaaauauauugaauuuaaaugaacu

SEQ ID NO: 158035 - RNA, 64 nt, Homo Sapiens
cugugaagagauccuacuacgaacagaaucaaaagaauaaaaauggugaaaagccaaauuuuag

SEQ ID NO: 158036 - RNA, 64 nt, Homo Sapiens
ugggguuuucaaggaucgcccagcugucuuucaagaauaaaagucuggcuuuugccaguuaauc

SEQ ID NO: 158037 - RNA, 64 nt, Homo Sapiens
aacuagcaaucuauaaagugcaccaggucaacuugaauaaaaacacuaugacagacagguuugc

SEQ ID NO: 158038 - RNA, 64 nt, Homo Sapiens
uaaaucugauggcucacugauuuuugaaaagccugaauaaaauuggaaagacuggaaaguuagg

SEQ ID NO: 158039 - RNA, 64 nt, Homo Sapiens
gauaugaugacaagguugauaauaaaagggugaagaauaaaaggggacugucauaccagugaag

SEQ ID NO: 158040 - RNA, 64 nt, Homo Sapiens
gugaagaauaaaagggauaugucauaccagugaagaauaaaagggcuaagaugguauagggacu

SEQ ID NO: 158041 - RNA, 64 nt, Homo Sapiens
uuuaugaauggacuuuucaaaauucauguaaguggaauaaaaguuguuaagaacacguguauua

SEQ ID NO: 158042 - RNA, 64 nt, Homo Sapiens
gaucauugguuccagucacauuuguccuggcggggaauaaaagggaaaacugccuacauacugg

SEQ ID NO: 158043 - RNA, 64 nt, Homo Sapiens
uguaaaucauuauuuucauuuuuuuuuuuagauugaauaaaauuuauggucuacacauucugau

SEQ ID NO: 158044 - RNA, 64 nt, Homo Sapiens
aaaaccugccaccaaauuauucucaaaaauaaaugaauaaaauaggcaacacagcaagacucug

SEQ ID NO: 158045 - RNA, 64 nt, Homo Sapiens
gucagaacugugcuuugucuuauuuaugaucagugaauaaaaauccuuaaugcucaugagacua

SEQ ID NO: 158046 - RNA, 64 nt, Homo Sapiens
gcugcaccagaaggagggucugagaacaagccaagaauaaaauuuuuuaugauuuuuuaauugu

SEQ ID NO: 158047 - RNA, 64 nt, Homo Sapiens
gaaauuccacacaugaguauugugaugaguaaaugaauaaaacauuugcaaagaccuuuagaga

SEQ ID NO: 158048 - RNA, 64 nt, Homo Sapiens
aaaauacaauuuuguuucuccaaauuugacagcagaauaaaaacccuacccuuucacuguguau

SEQ ID NO: 158049 - RNA, 64 nt, Homo Sapiens
aauaugaguaguguaaucuucuaauuccggaauggaauaaaaacgauauuuagaaaguuaauuu

SEQ ID NO: 158050 - RNA, 64 nt, Homo Sapiens
guuaaauuuccuuauuuuucaaaugaaguguuuagaauaaaauagccacaguugccuuauaugu

SEQ ID NO: 158051 - RNA, 64 nt, Homo Sapiens
uacuuggcauuccuuauuugguaauuucuuuuaggaauaaaagggagccacugcaccuggccaa

SEQ ID NO: 158052 - RNA, 64 nt, Homo Sapiens
agguacauaguaaguguaugaauggaugauucgugaauaaaacuaugggaauuuuuaucuuaga

SEQ ID NO: 158053 - RNA, 64 nt, Homo Sapiens
uuuaaaaauuaagagauauauuuuauuuuuaagggaauaaaaauucuucuauucaaaaucuuuu

SEQ ID NO: 158054 - RNA, 64 nt, Homo Sapiens
uccaaauuuuaaguauuaugguuaauuuuacuaagaauaaaacacuuuuauuuuaugaaguaau

SEQ ID NO: 158055 - RNA, 64 nt, Homo Sapiens
agaacauguauaacaaaaaguuucaacaauaagagaauaaaauacacuugagaacagaauagga

SEQ ID NO: 158056 - RNA, 64 nt, Homo Sapiens
acuucuauuauucuuuuaucguaaaaaaauuaaagaauaaaaauaaaauugaaaaaauuaaaau

SEQ ID NO: 158057 - RNA, 64 nt, Homo Sapiens
auuuccaccaucaggauucuuaaccuguguaugagaauaaaaugucuuccuaauugugcuguaa

SEQ ID NO: 158058 - RNA, 64 nt, Homo Sapiens
uaccaaagugauauacagagaacuugaagaguaagaauaaaaacaaaagaagaaaaaaucaaug

SEQ ID NO: 158059 - RNA, 64 nt, Homo Sapiens
uuacuaaugcuguuguauuuuuuuaucacuuugagaauaaaaagguaaaguauauguuaaaugc

SEQ ID NO: 158060 - RNA, 64 nt, Homo Sapiens
aauccaugcauuguagagucuauuacuuucauaugaauaaaaguuuaaguuagguaacauuuua

SEQ ID NO: 158061 - RNA, 64 nt, Homo Sapiens
guauguauugguaaugaugucauuaaaaguauaugaauaaaaauaugaguaacaucauaaaaau

SEQ ID NO: 158062 - RNA, 64 nt, Homo Sapiens
uuuuguaucauuuguuuuccucaucuaaaaaguugaauaaaaucuguuugauucaguucuccua

SEQ ID NO: 158063 - RNA, 64 nt, Homo Sapiens
aagaaugcaauccuauucacaauugccacaaaaagaauaaaauaccuaggaauacagcuaacca

SEQ ID NO: 158064 - RNA, 64 nt, Homo Sapiens
uccuacacccacagaacccggcuuuguccccaaagaauaaaaacaccucucuaaaagcugcucu

SEQ ID NO: 158065 - RNA, 64 nt, Homo Sapiens
uuuuuugacuuuugaguaaauuuuauauaucagagaauaaaaacauguauuaaaguuuucuugg

SEQ ID NO: 158066 - RNA, 64 nt, Homo Sapiens
uuacauuuauacuuugagaaaauguguuuugcuugaauaaaauggauacaauuaaauuuuauau

SEQ ID NO: 158067 - RNA, 64 nt, Homo Sapiens
aacacuaaccagcccuaguagcuucugugaauuugaauaaaaucgaugaacauauuguaaugau

SEQ ID NO: 158068 - RNA, 64 nt, Homo Sapiens
ugauaguaacauaguagagucuugugaaauagaugaauaaaauguugggaaacaaaugcugucu

SEQ ID NO: 158069 - RNA, 64 nt, Homo Sapiens
ccugaaaugaucaaauaacuacaaaugaucuguugaauaaaaauaguugagcugauauauguua

SEQ ID NO: 158070 - RNA, 64 nt, Homo Sapiens
auuuuaugugcuuucaucacaaauccaaaggaaagaauaaaaauuucuuaacacaacccagcgg

SEQ ID NO: 158071 - RNA, 64 nt, Homo Sapiens
uccguaugcugguucguagagcaguaguaguauagaauaaaagaaguugaaauuaucuuuguua

SEQ ID NO: 158072 - RNA, 64 nt, Homo Sapiens
ucuguauacagauucauuguuuucuuuuaaaauugaauaaaauugcuuugucuaaaguccucau

SEQ ID NO: 158073 - RNA, 64 nt, Homo Sapiens
agucuuauaggaaugacucuggcugcuauguggggaauaaaaucaagacgugcaagaguggaag

SEQ ID NO: 158074 - RNA, 64 nt, Homo Sapiens
auaaggaaaaggagagaaaaaagaaauugguuaugaauaaaagugacaauaaaacaugagauau

SEQ ID NO: 158075 - RNA, 64 nt, Homo Sapiens
cucuaaggaaggcagagaccuggguugagccucagaauaaaagaucuucuuccaagaaaugcaa

SEQ ID NO: 158076 - RNA, 64 nt, Homo Sapiens
ccagcgacaauuugaaucgguuuuguagguagaggaauaaaaugaaauacuaaaucuuucugua

SEQ ID NO: 158077 - RNA, 64 nt, Homo Sapiens
gagccaaaguugaucagaauaguguaugcuuccugaauaaaaagaaaaauguauaaaaagaauu

SEQ ID NO: 158078 - RNA, 64 nt, Homo Sapiens
gccaagagagauauugaacagauguagagagggugaauaaaauuagcgggaagggcuuggucug

SEQ ID NO: 158079 - RNA, 64 nt, Homo Sapiens
auccaaaauggucugcagagagugagcggaggcaccagaucaauguugguucuuugcacuggug

SEQ ID NO: 158080 - RNA, 64 nt, Homo Sapiens
ugggaggaacuaaagcauccuguuuuguaucuguccagaucauuauuucugucucuuguuuuuu

SEQ ID NO: 158081 - RNA, 64 nt, Homo Sapiens
agccgaugggaugaaagaagcuugucucagagauccagaucaugguccuauaauggauauuauu

SEQ ID NO: 158082 - RNA, 64 nt, Homo Sapiens
ucaaggagcagaucuucuaggaguagaucuuauuccagaucauauacaagaucacguagucuag

SEQ ID NO: 158083 - RNA, 64 nt, Homo Sapiens
aaaguaccgggaagaaggagguggcugagaagagccagaucaaccucauugauaagaaauggaa

SEQ ID NO: 158084 - RNA, 64 nt, Homo Sapiens
aacagccuacagccagaacuacuuucccccacacccagaucacagacaauaauuaacacagagg

SEQ ID NO: 158085 - RNA, 64 nt, Homo Sapiens
gaacucaaagaaaacugucuucagcagcucuuuuccagaucaaaucucugggaccgaugcagua

SEQ ID NO: 158086 - RNA, 64 nt, Homo Sapiens
ggaccacgaucaagggguccgggggaccgaggucccagaucagugaggggagaagguugagcuc

SEQ ID NO: 158087 - RNA, 64 nt, Homo Sapiens
ugccaggugccccucacucuuccugaccccaaagccagaucacccccuggguuaaaacuuuuuu

SEQ ID NO: 158088 - RNA, 64 nt, Homo Sapiens
cauggaauaaagcacuguccccagaggcaccauggagaguuaguuaacacauaccaaccauuau

SEQ ID NO: 158089 - RNA, 64 nt, Homo Sapiens
gucugaauaaugaagucguaaacacuaaguacuugagaguuacaucugaucaaugaagaccugu

SEQ ID NO: 158090 - RNA, 64 nt, Homo Sapiens
ggggggcauugaggaugauaucaccuucuggagagagaguuaauucuugaguucacuaacauug

SEQ ID NO: 158091 - RNA, 64 nt, Homo Sapiens
gugaucaugauauugcaaacuuauaucaauucuugagaguuaauugacuucuuuucacuuuggc

SEQ ID NO: 158092 - RNA, 64 nt, Homo Sapiens
gcuuagcuaaccaacagguuuuuuuuguuuccaagagaguuauuugaaaaguuaacagaacaau

SEQ ID NO: 158093 - RNA, 64 nt, Homo Sapiens
aauggaaaauugguuccugcaaaagacaaagggugagaguuagcguccuguagauacacacaga

SEQ ID NO: 158094 - RNA, 64 nt, Homo Sapiens
ccugagaccuuuagacaguucuagauuauaaccuuaaugugacauucuuucuuguucaauucau

SEQ ID NO: 158095 - RNA, 64 nt, Homo Sapiens
ucuggacauugcccauggauaggucuaugagcaauaaugugauuuccauuauaucaaggcuaca

SEQ ID NO: 158096 - RNA, 64 nt, Homo Sapiens
cucucccguauuucauuucuuacaggucucuguguaaugugaagaucaauaaccaggugugagc

SEQ ID NO: 158097 - RNA, 64 nt, Homo Sapiens
uuguagauauuccuugauuaugccugcagguugguaaugugacuugguccccaaaccaaagagu

SEQ ID NO: 158098 - RNA, 64 nt, Homo Sapiens
ggaaagguaacuuauuucucuucugcacagagcauaaugugaaguuuuauaccuacuuuuaaaa

SEQ ID NO: 158099 - RNA, 64 nt, Homo Sapiens
caugguucguauuuuaaaaaucuugcacaaauuguaaugugauacugugaaacaaauugaaaac

SEQ ID NO: 158100 - RNA, 64 nt, Homo Sapiens
ccuaguucucuuaucuuugaucguauauuucucauaaugugaaauaugaugagauucacuuagg

SEQ ID NO: 158101 - RNA, 64 nt, Homo Sapiens
uuccagccauuuuuuuaguuaguaaaaauccuauuaaugugaaccagccaggaauaacaguguu

SEQ ID NO: 158102 - RNA, 64 nt, Homo Sapiens
uuucucuuccucuuuugaauucuuuggaaauaaauaaugugaugggcgcugcauuuggcuauuu

SEQ ID NO: 158103 - RNA, 64 nt, Homo Sapiens
gaagaaaagagccgcuugaaauaaaaauggauaauaaugugaagggcacuuguacccgaucaua

SEQ ID NO: 158104 - RNA, 64 nt, Homo Sapiens
guugggaguuagugcauaucaucagcccuccaucuaaugugauugcuaagaugugcaggauagg

SEQ ID NO: 158105 - RNA, 64 nt, Homo Sapiens
agggcauuccggagaaacuuuugcaacaguguauuaaugugauugguuuucuuuuuguuuuaag

SEQ ID NO: 158106 - RNA, 64 nt, Homo Sapiens
ugcugauuugauggagcuacacagacauuuucaauaaugugaacucuaaauuuguaccuaugug

SEQ ID NO: 158107 - RNA, 64 nt, Homo Sapiens
auucuaaauuuguaccuaugauagccauguacuauaaugugaugugaucuauagaugaccuaga

SEQ ID NO: 158108 - RNA, 64 nt, Homo Sapiens
aacauaagagucuuaaaagaguauaauacccauuuaaugugaaaaagggaugaaaauaauggga

SEQ ID NO: 158109 - RNA, 64 nt, Homo Sapiens
aauuuuuugucucucuccuguaugacuucuauuuuaaugugaagugaguacgcucuaugcauag

SEQ ID NO: 158110 - RNA, 64 nt, Homo Sapiens
ucagauuuuugggucaugucuguuguauuuucaguaaugugauuucagauggucaucuggauuc

SEQ ID NO: 158111 - RNA, 64 nt, Homo Sapiens
cuuccagcaaaccugaaacgugagggagauggauuaaugugaguaacaggaaugugucuuuaaa

SEQ ID NO: 158112 - RNA, 64 nt, Homo Sapiens
uuuaaaugaccugcaucaagcauagacacugugcuaaugugaauaaucuguauuaucaauuucu

SEQ ID NO: 158113 - RNA, 64 nt, Homo Sapiens
ccuggcccagcuugcuggaauaugaaaaguaaauuaaugugaaauuuucauuuucuguauuaua

SEQ ID NO: 158114 - RNA, 64 nt, Homo Sapiens
cuuauuuauaauagcaauaaaaugacagaugccuuaaugugaaguccaaaucuuuuucauaggu

SEQ ID NO: 158115 - RNA, 64 nt, Homo Sapiens
augcaacaugauagccaaugagagauaguucuuuuaaugugacuaaaacucuugagcuguuaua

SEQ ID NO: 158116 - RNA, 64 nt, Homo Sapiens
uacaaaguuguacugaauaacuauuagaauugcauaaugugagauauuuuguuaguccucaaaa

SEQ ID NO: 158117 - RNA, 64 nt, Homo Sapiens
aaaaauacccuuugcuuugugccucaaagugauguaaugugaucacagcuuuuguuguguugaa

SEQ ID NO: 158118 - RNA, 64 nt, Homo Sapiens
aaagauguggaagccaaaauaagcuagcuguagguaaugugagcaacaggcacugauggggaga

SEQ ID NO: 158119 - RNA, 64 nt, Homo Sapiens
uguuucuuaaagcucugaacauuuugaaauaauguaaugugaagaaggaauagcugcauaagac

SEQ ID NO: 158120 - RNA, 64 nt, Homo Sapiens
gugugugcagcguuuuuaccuaggcaccaucauuuaaugugacaguguucaguaaacaaaucag

SEQ ID NO: 158121 - RNA, 64 nt, Homo Sapiens
gaagcaaaugcuacauauaugcaauauaaaauaguaaugugaugcugaugcuguuaaccaaagg

SEQ ID NO: 158122 - RNA, 64 nt, Homo Sapiens
uugaugaaggaggcaaaacaaaggcagcaggagauaaugugauugguacacaaaagcuaaagca

SEQ ID NO: 158123 - RNA, 64 nt, Homo Sapiens
uugugaaugcauauguaugugugguuacuuuuuauaaugugaaauaaugaauaaugaauuuacu

SEQ ID NO: 158124 - RNA, 64 nt, Homo Sapiens
uuccacuccugcuuuccuaaggaugaaacagugauaaugugaacucaaaugagguuuccugggu

SEQ ID NO: 158125 - RNA, 64 nt, Homo Sapiens
agugauaaugugaacucaaaugagguuuccuggguaaugugacaccugcagaaacuauagagcg

SEQ ID NO: 158126 - RNA, 64 nt, Homo Sapiens
aacauuuuguaacauugugcuuccuuguaguuuguaaugugaguucaaucaguauuuauguuga

SEQ ID NO: 158127 - RNA, 64 nt, Homo Sapiens
auucagaaaugacuuggccucauuuuggauuucauaaugugaaguauucaugauuuugaacugg

SEQ ID NO: 158128 - RNA, 64 nt, Homo Sapiens
uguguauauaucucuacacuuuauggauuaguaauaaugugauucucuauggcuucuagcuuca

SEQ ID NO: 158129 - RNA, 64 nt, Homo Sapiens
caguacaagcuuuuacaaaucacacaaaugggggcaaccacaucaccacacacacacaaccaca

SEQ ID NO: 158130 - RNA, 64 nt, Homo Sapiens
cacaaaugggggcaaccacacaaccacacacacacaaccacacacagcuguggccaccaacaca

SEQ ID NO: 158131 - RNA, 64 nt, Homo Sapiens
cacacaaccacacacacaaauggccaccaacacacaaccacacauggugacagaggcucagcug

SEQ ID NO: 158132 - RNA, 64 nt, Homo Sapiens
cacaugcuucgcuguuagugcaggaauccuccaacaaccacaaaccgccaccucaagugaacug

SEQ ID NO: 158133 - RNA, 64 nt, Homo Sapiens
agcugccaguauccagcaguuguacaaacuggcccaaccacaggugaucaagccuaacgccaag

SEQ ID NO: 158134 - RNA, 64 nt, Homo Sapiens
cacgcagccacagcuauaaccacaaucacguucacaaccacaacaaccacgguccccaccacga

SEQ ID NO: 158135 - RNA, 64 nt, Homo Sapiens
acacggcuaugaucaugacaaccaugacaggaugcaaccacaacuccuugaugucugugaucaa

SEQ ID NO: 158136 - RNA, 64 nt, Homo Sapiens
cggugggggcacagcacagacaccucccaccaaccaaccacaccccccccgguaugggaaccag

SEQ ID NO: 158137 - RNA, 64 nt, Homo Sapiens
cauugagauacaaguuuccggaccucuggcaccgcaaccacaguguugaggcccacaacacggu

SEQ ID NO: 158138 - RNA, 64 nt, Homo Sapiens
auucaaaaagcaaaguguuccaagagcugccagccaaccacacuaauugagagauaaacaauga

SEQ ID NO: 158139 - RNA, 64 nt, Homo Sapiens
gauuuuuuauaggaacaacaagggggccaaaaaacaaccacauggcacaccccgaauauugaag

SEQ ID NO: 158140 - RNA, 64 nt, Homo Sapiens
gccuggauccuggggcccccccacuggauccugacaaccacaaucuggaugucaacaaaccuca

SEQ ID NO: 158141 - RNA, 64 nt, Homo Sapiens
agcacggauucccuguaccuggaucccaacaccccaaccacaggucccacacaaaucagugaau

SEQ ID NO: 158142 - RNA, 64 nt, Homo Sapiens
aucccuacucuuuggccacgggagacugaugauccaaccacaggccccccacaccucagccacu

SEQ ID NO: 158143 - RNA, 64 nt, Homo Sapiens
ccuuuguccucucguggaaacagcacacagcaagcaaccacaaaaccagagcggaaggagggac

SEQ ID NO: 158144 - RNA, 64 nt, Homo Sapiens
caccacuccugagcgccacaucccaugaucacuucaaccacaggccuuugacuuugccacaugg

SEQ ID NO: 158145 - RNA, 64 nt, Homo Sapiens
gccacauuaagguugaacaguucacugcccaugugauacugauuccagacaccuaauucuucag

SEQ ID NO: 158146 - RNA, 64 nt, Homo Sapiens
cccacauuaagguugaacaauucacuacucaugugauacugauuccagacaccuaauucuucag

SEQ ID NO: 158147 - RNA, 64 nt, Homo Sapiens
guagugggggcaagaauugaguguuuguuccagugauacugaaagauuguuagaaauugacgau

SEQ ID NO: 158148 - RNA, 64 nt, Homo Sapiens
cccugguuuauugcauuaaacuuucucuaaaggagauacugacuuacuugagaauauagaaagu

SEQ ID NO: 158149 - RNA, 64 nt, Homo Sapiens
aagguagcacgacacugugaauguuccggaccuagauacugacguuccucccgggauggugaaa

SEQ ID NO: 158150 - RNA, 64 nt, Homo Sapiens
gaaagacgucagaugcaaaaaaccuugaaugcaugauacugaauucccuacuacacuguggaug

SEQ ID NO: 158151 - RNA, 64 nt, Homo Sapiens
aguuaauuuguuucugcauauaugcacauacauacguaaggaucuuaaacccagucuugacaga

SEQ ID NO: 158152 - RNA, 64 nt, Homo Sapiens
uguuucauggcuucauggucaucacucaagcucccguaaggauauuaccgucucaggaaaggau

SEQ ID NO: 158153 - RNA, 64 nt, Homo Sapiens
ucagagaccuuaauuuauauucuccuuccugugccguaaggauugcaucggacuaaacuaucug

SEQ ID NO: 158154 - RNA, 64 nt, Homo Sapiens
caaacgucugcaauucuccaguuuuuaguuugcacguaaggauucguaggauugauuucagauu

SEQ ID NO: 158155 - RNA, 64 nt, Homo Sapiens
ggaaagggggucacgcacauggcugugugacacacguaaggaaaucaaacuaaaaugucuuaau

SEQ ID NO: 158156 - RNA, 64 nt, Homo Sapiens
cucaaggcgugaggaugggaaggagggagguauucguaaggaugggaaggagggagguauucgu

SEQ ID NO: 158157 - RNA, 64 nt, Homo Sapiens
ccuguaagcauuuccaccagaacuugaggcaaaucguaaggaagcuguuucuuuuaaaacacaa

SEQ ID NO: 158158 - RNA, 64 nt, Homo Sapiens
ugcuggaacccacugagcccgcagcagggccucgcguaaggaacguguccuggagcugugcugg

SEQ ID NO: 158159 - RNA, 64 nt, Homo Sapiens
cagggucucuugauagacuuucauauuacaaguacguaaggauuacuagugucacagcauaaaa

SEQ ID NO: 158160 - RNA, 64 nt, Homo Sapiens
cucuuucauaaagcacuuuuaauccggacaugaucguaaggaaaugcaaacuacuugaaauuug

SEQ ID NO: 158161 - RNA, 64 nt, Homo Sapiens
cgguucuguguugggacccccaggccaccucauccguaaggacucugcuucuccaagagcagac

SEQ ID NO: 158162 - RNA, 64 nt, Homo Sapiens
caggggaaaccugaugaggagaaggauaagacugcguaaggagaaauccucauaggagcuauaa

SEQ ID NO: 158163 - RNA, 64 nt, Homo Sapiens
uggguuuuuucauaucuguacauaaugccgagugcguaaggaaaccguggcgucgcgcacagug

SEQ ID NO: 158164 - RNA, 64 nt, Homo Sapiens
auugguguaauuuacuacauauuaguacuauauucguaaggauuuuuuauuaaccauuacagau

SEQ ID NO: 158165 - RNA, 64 nt, Homo Sapiens
auauuauuguuacaucuuucugaaaccuucaaaccguaaggaaguguuaacuggcaagcaguug

SEQ ID NO: 158166 - RNA, 64 nt, Homo Sapiens
uuccugcccuuugcguuauauuguauaauaccaacguaaggaaauaaaccuuuggaauuguugg

SEQ ID NO: 158167 - RNA, 64 nt, Homo Sapiens
gcuccuuccgccccuccaaaagaguucaucacuacguaaggaaaugggacccuccccagccugg

SEQ ID NO: 158168 - RNA, 64 nt, Homo Sapiens
cagcuuccuuugggaagcccagcuucuguguucccguaaggauaccuccugccuggaccauggu

SEQ ID NO: 158169 - RNA, 64 nt, Homo Sapiens
aagcugucaaagagguaagcacauuuuauauagacguaaggaaagugauuauuguuuaauaucu

SEQ ID NO: 158170 - RNA, 64 nt, Homo Sapiens
uucuuuuuuuuuugcuaugacagaguaaugcuaacguaaggacaacugaguuugaucaguguuu

SEQ ID NO: 158171 - RNA, 64 nt, Homo Sapiens
cauuuuauguauuaaaauaaaaagguuuacugcucguaaggaaaugaauauagacuuucuggga

SEQ ID NO: 158172 - RNA, 64 nt, Homo Sapiens
cugaacggauugcucgagaauugaacaggaacgucguaaggaagggaaagggaacgcauucgua

SEQ ID NO: 158173 - RNA, 64 nt, Homo Sapiens
aacuccuccagcaagcucgcgcaugcuggugcagcguaaggacggucugcugaugagagacagc

SEQ ID NO: 158174 - RNA, 64 nt, Homo Sapiens
uguuuucuguuuguugguuuguuuguuucuuccacguaaggaaaaguaguguaaacaguagcga

SEQ ID NO: 158175 - RNA, 64 nt, Homo Sapiens
cccuggccaacuuaaagauucauauggugaggugcguaaggaaguaacuugcgcaaacuuuuua

SEQ ID NO: 158176 - RNA, 64 nt, Homo Sapiens
guauagugaggcuuacgauguuuuguagucuuggcguaaggacacagcccaaguaacugacguu

SEQ ID NO: 158177 - RNA, 64 nt, Homo Sapiens
cuguccuucccuaaauguaaagccaucuguccggcguaaggacgacaccgucagcuguccgacu

SEQ ID NO: 158178 - RNA, 64 nt, Homo Sapiens
ugccauguugggcuccucacacaugaucguguuucguaaggagccagaggcagcauagugaaaa

SEQ ID NO: 158179 - RNA, 64 nt, Homo Sapiens
cuuaauccaguuuuucaaacuucucccuguagaccguaaggaugaauuccacaauaggauccuu

SEQ ID NO: 158180 - RNA, 64 nt, Homo Sapiens
aagccuguaauauaugcaacccaauggccuggaccguaaggauaacagucuccacauugcaguu

SEQ ID NO: 158181 - RNA, 64 nt, Homo Sapiens
acagaaaaagaagaauuccaggagagggaaagaucguaaggaugagagaggagaccauccaagc

SEQ ID NO: 158182 - RNA, 64 nt, Homo Sapiens
uuguguggaacacuucacauauuggcgcacaguacguaaggaggucucaugugcuguaggagua

SEQ ID NO: 158183 - RNA, 64 nt, Homo Sapiens
ugugaguuuugcuuuugacuuagaggggugggugcguaaggaugcuuuuuuccugggccagaag

SEQ ID NO: 158184 - RNA, 62 nt, Homo Sapiens
cucauggauuuugucaaauagaugaucuuugacacgauuagacacuccuccccacaaaggcu

SEQ ID NO: 158185 - RNA, 62 nt, Homo Sapiens
uggugucguggaaccucuuacugcuuucaauacacgauuaguaaucaacuguuuuguauacu

SEQ ID NO: 158186 - RNA, 62 nt, Homo Sapiens
auaaauucaaaacauuugguguuguagagaagcacgauuauagcaaaccacaagaaucauua

SEQ ID NO: 158187 - RNA, 62 nt, Homo Sapiens
ugaauaaaaugauggaaccaagauggauccuccacgauuacgccucagcuucccacggaauc

SEQ ID NO: 158188 - RNA, 62 nt, Homo Sapiens
uuagauuucuaccaccguguauuucuaucaugcacgauuauuguugaggaaauaucauugau

SEQ ID NO: 158189 - RNA, 62 nt, Homo Sapiens
acuaaaguaccagauuauaaccuagccagcuucacgauuaugaugcugauauuuacuggaaa

SEQ ID NO: 158190 - RNA, 62 nt, Homo Sapiens
agguucuugauucccuuauacugagaguacuccacgauuacucucucuuccuacauuugucc

SEQ ID NO: 158191 - RNA, 62 nt, Homo Sapiens
aacguuaagaacugcguuagaauggaauaaaacacgauuaaaaagguagaguaggcuguggc

SEQ ID NO: 158192 - RNA, 62 nt, Homo Sapiens
ugugaaauguacgucauuugcuuucuaaccuucacgauuaacuacuaauagaacuuguuaac

SEQ ID NO: 158193 - RNA, 62 nt, Homo Sapiens
gacugagaccggcccucugggugaggcccugccacgauuaaaguguguacgugcgcgcgugc

SEQ ID NO: 158194 - RNA, 62 nt, Homo Sapiens
aaggaagcauuuaccccgaugguuaccuagaccacgauuauuuggauuggggggagggggga

SEQ ID NO: 158195 - RNA, 62 nt, Homo Sapiens
guccugucugguuaucuguuguugaauaagagcacgauuagacuaggcagagacagaagaau

SEQ ID NO: 158196 - RNA, 62 nt, Homo Sapiens
uuuuacgacuuuuacauuugaguaaccaucaacacgauuaguuuacagaacugaaaaggaau

SEQ ID NO: 158197 - RNA, 62 nt, Homo Sapiens
cuggcucugucacccaggcuggagugcaguggcacgauuauggcucauugcagccucgacuu

SEQ ID NO: 158198 - RNA, 62 nt, Homo Sapiens
uuagaugagugcuuuggccccucugugaauagcacgauuaaaauccaguuguauauaaugga

SEQ ID NO: 158199 - RNA, 62 nt, Homo Sapiens
uuggcacuuauuagcuucucucauaaacugaucacgauuauaaauuaaauguuuggguucau

SEQ ID NO: 158200 - RNA, 62 nt, Homo Sapiens
cggccgcccucggucugguguaagcacacaugcacgauuaaagaggagacgccgggaccccc

SEQ ID NO: 158201 - RNA, 62 nt, Homo Sapiens
uugucgguaccuucagaaacuuuuaccaaagucacgauuagcugcuugugguggggccccaa

SEQ ID NO: 158202 - RNA, 62 nt, Homo Sapiens
uauauuucacaggcuguaaauugaacuucccacacgauuagcuuuauuauggcuugugaacu

SEQ ID NO: 158203 - RNA, 62 nt, Homo Sapiens
ucaaagcaggaccuauuuggagcauuacgauccacgauuauugauguugacauguccaugua

SEQ ID NO: 158204 - RNA, 64 nt, Homo Sapiens
uuuaauaagucauggggaugacaauuugauuauuacaauuuaguuuucaguaaucaaaaagauu

SEQ ID NO: 158205 - RNA, 64 nt, Homo Sapiens
auuuuuaaaguauguaacauucccaguuucagccacaauuuagccaagaauaagauaaaaacuu

SEQ ID NO: 158206 - RNA, 64 nt, Homo Sapiens
uaaaaucuaagauugcucuaguucaagauacuuaacaauuuauuuuuuaaaucauaaauaacau

SEQ ID NO: 158207 - RNA, 64 nt, Homo Sapiens
ucuacacagaaaguuuuuaaguauauuacuuggcacaauuuauuuaaaaauguaaauguuacau

SEQ ID NO: 158208 - RNA, 64 nt, Homo Sapiens
ucauaagagaaccacacccuguugcgauguuuguacaauuuaccaaaacauuuuuuagaaauuu

SEQ ID NO: 158209 - RNA, 64 nt, Homo Sapiens
ugaagcucagaaaguuauauaccaguuauacuugacaauuuagucugagagaaauucuguugcc

SEQ ID NO: 158210 - RNA, 64 nt, Homo Sapiens
uugggcuaaaaauuaaaaauaccagagguuauauacaauuuaaaugccacaauuuaaaaauaaa

SEQ ID NO: 158211 - RNA, 64 nt, Homo Sapiens
aauaaaaccagagguuauauuuuaaauuuaugccacaauuuaaaaaauaaaguguauauuagga

SEQ ID NO: 158212 - RNA, 64 nt, Homo Sapiens
gugcuucaaggacauuggugagaguccaacagacacaauuuauacugcgacagaacuucagcau

SEQ ID NO: 158213 - RNA, 64 nt, Homo Sapiens
uaauaauguaacaugauuucccuccagagaaagcacaauuuaaaacaauccuuacuaaguaggu

SEQ ID NO: 158214 - RNA, 64 nt, Homo Sapiens
cuucuaaaggguaagucauaaucuguguaauacuacaauuuaugggaugcucacuaugcccugu

SEQ ID NO: 158215 - RNA, 64 nt, Homo Sapiens
augggaugcucacuaugcccuguuucucuucuaaacaauuuacauguaaugucucauuccucac

SEQ ID NO: 158216 - RNA, 64 nt, Homo Sapiens
uuuaaauauaaaugcauuuugagaaauguuaagaacaauuuagucaaucguucaucugucauug

SEQ ID NO: 158217 - RNA, 64 nt, Homo Sapiens
uagcuucugaaaagggaggaguauuuuuaguuugacaauuuaauaauuuaaaaacaagacaucu

SEQ ID NO: 158218 - RNA, 64 nt, Homo Sapiens
uaugcagaaaaauaggcaauaagaacuucauuuuacaauuuaguuuucaaaaaaaaaaugcagg

SEQ ID NO: 158219 - RNA, 64 nt, Homo Sapiens
caagaaaaaagauuuagcuuaucacaagaagcagacaauuuauaaaacuacacaaugucuaaac

SEQ ID NO: 158220 - RNA, 64 nt, Homo Sapiens
ugucuuacacugagaaauaaauaugucagugagaacaauuuauauuauuuuucuuuuaauaguu

SEQ ID NO: 158221 - RNA, 64 nt, Homo Sapiens
uuucuucuuuuuaaauuguuuuggauucagaaauacaauuuauagcuacacccccacaggugac

SEQ ID NO: 158222 - RNA, 64 nt, Homo Sapiens
uauuuuaagaaaaaaggaaaucaauacaaaucaaacaauuuaaaugagaaaaaguuuaaaauuc

SEQ ID NO: 158223 - RNA, 64 nt, Homo Sapiens
gagaaaaaguuuaaaauucucuuaaaauauuuuuacaauuuaauauaaagaggauagacaaccu

SEQ ID NO: 158224 - RNA, 64 nt, Homo Sapiens
ucaauauuuugaauaucugauuaauuuaaacuuuacaauuuacaauuuugaauaugugaaagga

SEQ ID NO: 158225 - RNA, 64 nt, Homo Sapiens
ucaauauuuugaauaugugaaaggauuaaacuuuacaauuuagauaguacauucuagaauguaa

SEQ ID NO: 158226 - RNA, 64 nt, Homo Sapiens
cacauuucaucuaaguaaagcucaguucuuuaucacaauuuacugaccaaauaccuagcaccag

SEQ ID NO: 158227 - RNA, 64 nt, Homo Sapiens
aacuucuuaucaauuaccuaaaucucaacgaaaaacaauuuacugaagccgacuccccucccca

SEQ ID NO: 158228 - RNA, 64 nt, Homo Sapiens
augucucagugauguuucuguacaagucaguuugacaauuuacguaaauuguaucuaacuggau

SEQ ID NO: 158229 - RNA, 64 nt, Homo Sapiens
gaaguccccuacagucaguuccugggaaaugaaaacaauuuauguaguuaaacucuaaggaaga

SEQ ID NO: 158230 - RNA, 64 nt, Homo Sapiens
uagugguuucaccugugaaauuaaaagguaggaaguaagcuacucugacuguaacuuuauuaau

SEQ ID NO: 158231 - RNA, 64 nt, Homo Sapiens
uuucaucuuguggagauuuuaacaguuugggguaguaagcuaaaaaauuggacccaaaacauug

SEQ ID NO: 158232 - RNA, 64 nt, Homo Sapiens
guauuagauacuaauagaagagaaaaauuguaacacacugaacaauagauacuguauguucuua

SEQ ID NO: 158233 - RNA, 64 nt, Homo Sapiens
gcuaagcgacuguacgugcuacuaaaaaugucugacacugaaauaauuuuacucaacuauguuu

SEQ ID NO: 158234 - RNA, 64 nt, Homo Sapiens
caaucagcugugucgcacuuaaacuggagaaguuacacugaaguauaaucacacugaauguuag

SEQ ID NO: 158235 - RNA, 64 nt, Homo Sapiens
acuuaaacuggagaaguuacacugaaguauaaucacacugaauguuagacuuuuucaucugcca

SEQ ID NO: 158236 - RNA, 64 nt, Homo Sapiens
caccucuaaaacaguccuucaaacuuccagugcaacacugaagcucuugaagacacugaaauau

SEQ ID NO: 158237 - RNA, 64 nt, Homo Sapiens
ucaaacuuccagugcaacacugaagcucuugaagacacugaaauauacacacagcaguagcagu

SEQ ID NO: 158238 - RNA, 64 nt, Homo Sapiens
ucaaauuguguuuaguaucauucaagaugagacaacacugaagaaaucucuguuauuaagauau

SEQ ID NO: 158239 - RNA, 64 nt, Homo Sapiens
uauuagcuacuaaaaaggcaaaaggcauaagauuacacugaacauuuaauauauuaauuacuaa

SEQ ID NO: 158240 - RNA, 64 nt, Homo Sapiens
agcguuccaaccugaggccaacccaucucaccugacacugaauacugccuugguagaaagugag

SEQ ID NO: 158241 - RNA, 64 nt, Homo Sapiens
ggaccuguaauccagcauucuuguuaaagcugaaacacugaaacagccauugccuugaccaaca

SEQ ID NO: 158242 - RNA, 64 nt, Homo Sapiens
agcugcaaaucugauggccuuaauuuccuuuuugacacugaaaguuuuguaaaagaaaucaugu

SEQ ID NO: 158243 - RNA, 64 nt, Homo Sapiens
guccauacacuuuguugcaagaugugaauuauugacacugaacuuaauaacuguguacuguucg

SEQ ID NO: 158244 - RNA, 64 nt, Homo Sapiens
cagcagcuguucaacaagaguaaauauugucacaacacugaaccucuggcuagaggacauauuc

SEQ ID NO: 158245 - RNA, 64 nt, Homo Sapiens
aauuaaggcagcugaaaaguaaauugccuucuagacacugaaggcaaaucuccuuuguccauuu

SEQ ID NO: 158246 - RNA, 64 nt, Homo Sapiens
ccacuauuacagaaauucugaauuuugguaaaucacacugaaacuuucuguauaacuuguauua

SEQ ID NO: 158247 - RNA, 64 nt, Homo Sapiens
aacuuguauuauuagacucucuaguuuuaucuuaacacugaaacuguucuucauuagauguuua

SEQ ID NO: 158248 - RNA, 64 nt, Homo Sapiens; identical to SEQ ID NO: 158246

SEQ ID NO: 158249 - RNA, 64 nt, Homo Sapiens; identical to SEQ ID NO: 158247

SEQ ID NO: 158250 - RNA, 64 nt, Homo Sapiens
ccgauagagucgcuauuucugguuaauauacauauauaaauauauaaauacaaacacacacaca

SEQ ID NO: 158251 - RNA, 64 nt, Homo Sapiens
gucgcuauuucugguuaauauacauauauaaauauauaaauacaaacacacacacacacuuuuu

SEQ ID NO: 158252 - RNA, 64 nt, Homo Sapiens
uggugggauaugcagaacuugggauguguguauauauaaauauauaauauauauaaauauauau

SEQ ID NO: 158253 - RNA, 64 nt, Homo Sapiens
cuugggauguguguauauauaaauauauaauauauauaaauauauauaauacugacuuaaaaaa

SEQ ID NO: 158254 - RNA, 64 nt, Homo Sapiens
ugugugcgagugugugggcuggugugugaauaucuauaaauaaguauauaugguguauauuaua

SEQ ID NO: 158255 - RNA, 64 nt, Homo Sapiens
uauaaauaaguauauaugguguauauuauauguguauaaauaaagucuguacauauuggagcuc

SEQ ID NO: 158256 - RNA, 64 nt, Homo Sapiens
ugcccccuaguaagucuacguguggaaugugagauauaaauauaaauauauaaagcuauauuuu

SEQ ID NO: 158257 - RNA, 64 nt, Homo Sapiens
cuaguaagucuacguguggaaugugagauauaaauauaaauauauaaagcuauauuuucaggcu

SEQ ID NO: 158258 - RNA, 58 nt, Homo Sapiens
aacgugagcuuacugucuaaauauuuuuuauaaauagugaagauacgucuagccagac

SEQ ID NO: 158259 - RNA, 64 nt, Homo Sapiens
guuagcacugaccauccuuaaaaaauguuaacucuauaaauaugauguucaugugguuauguau

SEQ ID NO: 158260 - RNA, 64 nt, Homo Sapiens
uauugugaacuuuaaaagacuauuuugauaaauuuauaaauauauaaaauuauguaaaaacuac

SEQ ID NO: 158261 - RNA, 64 nt, Homo Sapiens
gaaaguuuuuagaaagugauuuuuaugcucgcacuauaaauauggcaggucaguucauucuuuu

SEQ ID NO: 158262 - RNA, 64 nt, Homo Sapiens
uagaagcaaaaaaaaaaagcauagagauguguuuuauaaauagguuuauguguacugguuugca

SEQ ID NO: 158263 - RNA, 64 nt, Homo Sapiens
ugcauagguaaccauuaacuauguacauauaaaguauaaauauguuuauauucuguacauaugg

SEQ ID NO: 158264 - RNA, 61 nt, Homo Sapiens
cucaagaacuuuggaaauaauuuuauauauauauaaauaauauauauauauauacauauau

SEQ ID NO: 158265 - RNA, 64 nt, Homo Sapiens
auauauauaaauaauauauauauauauacauauauauaaauagaucucuauauaguugugguac

SEQ ID NO: 158266 - RNA, 64 nt, Homo Sapiens
uguaaucaauuucuucaaauaguuacccccuauauauaaauauauaaucaaguaaucauuaauu

SEQ ID NO: 158267 - RNA, 64 nt, Homo Sapiens
ugucaguucacauagcaauucuauugcauugauuuauaaauaguuaauuuggucaaacaacagu

SEQ ID NO: 158268 - RNA, 64 nt, Homo Sapiens
uauguauaugugcucgcuugguauguauauauuauauaaauauauggaccaacauaauauuaaa

SEQ ID NO: 158269 - RNA, 64 nt, Homo Sapiens
uuccaaaauauccaauucaucuuauugccuagccuauaaauaaaaucuguguuaaucugaguaa

SEQ ID NO: 158270 - RNA, 64 nt, Homo Sapiens
guauaaaacauuaaaaguuaauauauaaauauuauauaaauaauuauagcaagcuaugauuuuu

SEQ ID NO: 158271 - RNA, 64 nt, Homo Sapiens
auauaaauaauguauaaaaccuaugauuuuuauauauaaauauuucauuucaacuuauagcaag

SEQ ID NO: 158272 - RNA, 64 nt, Homo Sapiens
aaaggcaggcaacuuucauuauuauagacaaauauauaaauaaucaauauaauuuugcuuuugu

SEQ ID NO: 158273 - RNA, 64 nt, Homo Sapiens
acuuuauccuggcuauaaaaagaaaauuauaaauuauaaauauguuuuuauuaaaaaccuggac

SEQ ID NO: 158274 - RNA, 64 nt, Homo Sapiens
ucuuuagccacagcaaaccagcuuguucauccauuauaaauauaaccucuugguaucuagaaaa

SEQ ID NO: 158275 - RNA, 64 nt, Homo Sapiens
gaauucuucaggguaucuuauagaacuaaaaauuuauaaauaugagcuuucuuagagaauuccc

SEQ ID NO: 158276 - RNA, 64 nt, Homo Sapiens
aauugucuagaaugaaagcuauugccuuucccuauauaaauauuugacuggaaaaaacuugcuu

SEQ ID NO: 158277 - RNA, 64 nt, Homo Sapiens
acuuugugcaauauuguuguuagguuaaaucuuauauaaauauuuucucuaaaauauucugaaa

SEQ ID NO: 158278 - RNA, 64 nt, Homo Sapiens
uauauaauauauaaaauauauacauauauauauauauaaauauacacugugcuagguguauaua

SEQ ID NO: 158279 - RNA, 64 nt, Homo Sapiens
uauguaucguaugugcaucuucacuuugguuuccuauaaauaugugccuccccuccccucuuug

SEQ ID NO: 158280 - RNA, 64 nt, Homo Sapiens
ugaugcugagucuguggaaucuguaugaaauauguauaaauauauuacaguuucuaauacuaua

SEQ ID NO: 158281 - RNA, 64 nt, Homo Sapiens
uagaguuuauguugugaagugcagucauaauaucuauaaauacacccacaguauauauuauaca

SEQ ID NO: 158282 - RNA, 64 nt, Homo Sapiens
uugaauauauugguugcucagauguuuuaggagcuauaaauaaaaaaauucacuaugugaauga

SEQ ID NO: 158283 - RNA, 64 nt, Homo Sapiens
agaaugcccaccagauugaacuccagauugaccuuauaaauaaagagacacaugguaacacaua

SEQ ID NO: 158284 - RNA, 64 nt, Homo Sapiens
uugaaggucuguaaauguguacauacaugucuuauauaaauauauaauauauaaauaugguguc

SEQ ID NO: 158285 - RNA, 64 nt, Homo Sapiens
uguguacauacaugucuuauauaaauauauaauauauaaauauggugucuguguacauauagug

SEQ ID NO: 158286 - RNA, 64 nt, Homo Sapiens
uuuauuguauacuguaucauagaaguuggagguauauaaauagaacauuuugcuaaagugaaaa

SEQ ID NO: 158287 - RNA, 64 nt, Homo Sapiens
aacuuguauucauucuuguguauuuauuacaauauauaaauaauggcaacucuuuguuuuauac

SEQ ID NO: 158288 - RNA, 64 nt, Homo Sapiens
acuaaaauuuguaucugaucaaagcacauaagaauauaaauaauagcaaacuacuauuaaacaa

SEQ ID NO: 158289 - RNA, 64 nt, Homo Sapiens
cauguuauguagaaaauggucaauggcaaauuuuuauaaauacagcuaccccaucaaagcugaa

SEQ ID NO: 158290 - RNA, 64 nt, Homo Sapiens
ucaccuagcaauaaaaucuaauuuuuaaaaaguauauaaauauaaaauguauaaaugauggaua

SEQ ID NO: 158291 - RNA, 64 nt, Homo Sapiens
uuuuuuaguguugucacuuguuuauagauaaauauauaaauaaccuguuuggauccugguccuu

SEQ ID NO: 158292 - RNA, 64 nt, Homo Sapiens
acacuaauuguuagcuguuuugaaauuauauauauauaaauauauauaaauauauaaauauaug

SEQ ID NO: 158293 - RNA, 64 nt, Homo Sapiens
uuagcuguuuugaaauuauauauauauaaauauauauaaauauauaaauauaugccagucuugg

SEQ ID NO: 158294 - RNA, 64 nt, Homo Sapiens
uuugaaauuauauauauauaaauauauauaaauauauaaauauaugccagucuuggcugaaaug

SEQ ID NO: 158295 - RNA, 64 nt, Homo Sapiens
uguuuguuuguuuuuuuaauuauauauauauaaauauaaauauaucuucccauuucucuuuaua

SEQ ID NO: 158296 - RNA, 64 nt, Homo Sapiens
aauauauguuuguuuguuuuuuuauauauauauauauaaauauaaauuugucuucccauuucuc

SEQ ID NO: 158297 - RNA, 64 nt, Homo Sapiens
ugccaacauacccuucuuuauuguauauacauauuauaaauaaaaacacauuacuugcacaagc

SEQ ID NO: 158298 - RNA, 64 nt, Homo Sapiens
uauuuuucaaccagcauuuuccaauuaaaauauauauaaauauaauuuuuaaacuaguaauggg

SEQ ID NO: 158299 - RNA, 64 nt, Homo Sapiens
uaugaauauauuuuuuuaaguauaaauauauagauauaaauauauuuaugggcauugauacaua

SEQ ID NO: 158300 - RNA, 64 nt, Homo Sapiens
uagauauaaauauauaugaaggcauugauacauauauaaauauauugggcccacguguuuuaug

SEQ ID NO: 158301 - RNA, 64 nt, Homo Sapiens
uauauauauguauaauauaugcuuaaauuuuagguauaaauaaaagcaaguagcaugaaguauu

SEQ ID NO: 158302 - RNA, 64 nt, Homo Sapiens
gguauuaagucguugccuuuauuuguaaagcuguuauaaauauauauuauauaaauauauuaaa

SEQ ID NO: 158303 - RNA, 64 nt, Homo Sapiens
ccuuuauuuguaaagcuguuauaaauauauauuauauaaauauauuaaaaaggaaaauguuuca

SEQ ID NO: 158304 - RNA, 64 nt, Homo Sapiens
auauuaaagaaaauagaaaaaauuaccuuaaauauauaaauaagagaauuuuggcccuucugug

SEQ ID NO: 158305 - RNA, 64 nt, Homo Sapiens
uuuuccuguaugguaagacguauuuuucucaguuuauaaauacguagcacucagguugagacga

SEQ ID NO: 158306 - RNA, 64 nt, Homo Sapiens
agaaucccuugaaaaggaaauauuuucuguuucuuauaaauaaaagaguaaucuuacuuucaga

SEQ ID NO: 158307 - RNA, 64 nt, Homo Sapiens
auuaaaagaacaaagaucuuuuauauggauaucuuauaaauauauaaucauugcuaaguaagaa

SEQ ID NO: 158308 - RNA, 64 nt, Homo Sapiens
aauauuuuugaaaucccugaguaucaggccuuguuauaaauaagcugcauaaucaauaaauaga

SEQ ID NO: 158309 - RNA, 64 nt, Homo Sapiens
uuaaauuauggaguauuuuaagucuacaaaaagguauaaauaauaauauaaugaauuccuauau

SEQ ID NO: 158310 - RNA, 64 nt, Homo Sapiens
guaaaaauauacugauuuugaaaaguaucaggaauauaaauauuugguaauucuguguaacaag

SEQ ID NO: 158311 - RNA, 64 nt, Homo Sapiens
uuuauucugauauuaaucaguuaagaguggcuuuuauaaauagcuacaaaacaucuuggcauau

SEQ ID NO: 158312 - RNA, 64 nt, Homo Sapiens
agcuucugccccaccugcagcccacuuuuguuuauauaaauaagagcuacuccucagcugaugg

SEQ ID NO: 158313 - RNA, 64 nt, Homo Sapiens
ucucauugcagccagugauuuauauaaauauaaauauaaauauacauauauauauauauacaua

SEQ ID NO: 158314 - RNA, 64 nt, Homo Sapiens
aauauaucucauugcagccauacauauauauaaauauaaauauaacauaacauauauauauaua

SEQ ID NO: 158315 - RNA, 64 nt, Homo Sapiens
aauauaaauauaucucauuguauauauacauauauauaaauauauuuuguacauaacauauaua

SEQ ID NO: 158316 - RNA, 64 nt, Homo Sapiens
cacucacauuaucacggaauuugagguacugcuauauaaauauuaauuauacauguagcucaac

SEQ ID NO: 158317 - RNA, 64 nt, Homo Sapiens
ucauauuuuucugaguaaauauaaauuaaaauuuuauaaauauuuauagauaaacuuacuagau

SEQ ID NO: 158318 - RNA, 64 nt, Homo Sapiens
augcagcucacaucuguuuucugugugacaguuauauaaauagcauuugccucacucauuacuc

SEQ ID NO: 158319 - RNA, 64 nt, Homo Sapiens
auucuaaauuugaguaaauauaacugcuuagaacuauaaauagcaauaaucagaauauuucauc

SEQ ID NO: 158320 - RNA, 64 nt, Homo Sapiens
uaucuaugucucauaaaaauuccaucuaccuuuuuauaaauacauuaaguuaauuucuucucuu

SEQ ID NO: 158321 - RNA, 64 nt, Homo Sapiens
uaauuuuuauuuauguagcuuaaauagauauuucuauaaauagaauuuuaaauuauggaacugc

SEQ ID NO: 158322 - RNA, 64 nt, Homo Sapiens
gucugugggagugagaggcaugcugugucugagguauaaauauacucauuguuuaaauguaacu

SEQ ID NO: 158323 - RNA, 64 nt, Homo Sapiens
ccuuuuuugcugaggaaaugaagauaagcaaaaauauaaauauauauauaaauauaugaguuau

SEQ ID NO: 158324 - RNA, 64 nt, Homo Sapiens
aggaaaugaagauaagcaaaaauauaaauauauauauaaauauaugaguuauuaaaaucagaag

SEQ ID NO: 158325 - RNA, 64 nt, Homo Sapiens
gaagaaaauccauuuccaugacugaagcauuggauauaaauaugguguccugcuuuuuuuguag

SEQ ID NO: 158326 - RNA, 64 nt, Homo Sapiens
guucuacaaagguaguagaaucaaucucgaccuauauaaauaguagauuuuuuauggugaaacu

SEQ ID NO: 158327 - RNA, 64 nt, Homo Sapiens
aaggcaaucauaaggauuuugcacaguaaauguguauaaauaugauugaucaacuuuaaauuaa

SEQ ID NO: 158328 - RNA, 64 nt, Homo Sapiens
uuuuccuucugaaccacguuuuaaaagugcuugauauaaauagcaugacuguauuuuaaaauac

SEQ ID NO: 158329 - RNA, 64 nt, Homo Sapiens
acgucaaucaaaaugucaaauaugugugucagaauauaaauaauuuuucacauuguauuguugc

SEQ ID NO: 158330 - RNA, 64 nt, Homo Sapiens
cuuuggaugauuaucaccuuugccacuuaaaauauauaaauauccuuuuuacuucaugaggaag

SEQ ID NO: 158331 - RNA, 64 nt, Homo Sapiens
augcuaauauuaaauuuuguaaaaauaacuuauuuauaaauaauuuuuaaagagaaaaaucuca

SEQ ID NO: 158332 - RNA, 64 nt, Homo Sapiens
caucauaggucuccuugugcuaccuuuuacucccuauaaauagaaauccaaguauacuuuaaua

SEQ ID NO: 158333 - RNA, 64 nt, Homo Sapiens
ugcgugcuugaguguguucgcguguguggguggauauaaauauauauaaauauauauaaauaaa

SEQ ID NO: 158334 - RNA, 64 nt, Homo Sapiens
aguguguucgcguguguggguggauauaaauauauauaaauauauauaaauaaauauauauauc

SEQ ID NO: 158335 - RNA, 64 nt, Homo Sapiens
cguguguggguggauauaaauauauauaaauauauauaaauaaauauauauauccucuguauaa

SEQ ID NO: 158336 - RNA, 64 nt, Homo Sapiens
aagugccaacuucaucaaguaaugcaugcuuuauuauaaauaaaauucuagcuuugaaaggcgu

SEQ ID NO: 158337 - RNA, 64 nt, Homo Sapiens
uuacugagagaucuucauauacuucauuuuuuaauauaaauaauuuuaauaaauuuuauuuucu

SEQ ID NO: 158338 - RNA, 64 nt, Homo Sapiens
auggaaaacagauuuuucaucaugaauuuaauuuuauaaauauacaagaauauuugcaaugaca

SEQ ID NO: 158339 - RNA, 64 nt, Homo Sapiens
caugaucagaaaauaguacuguugauuucaagauuauaaauacuaagaccacaaauaaucaaga

SEQ ID NO: 158340 - RNA, 64 nt, Homo Sapiens
ggagaaaaauguuuuuggagcuauuuaaggcagcuauaaauauaaauaguguuucacaguauuu

SEQ ID NO: 158341 - RNA, 64 nt, Homo Sapiens
ucauuucccauuugaugagcauacucuucauuacuauaaauauuuuucuucagugauuacaauc

SEQ ID NO: 158342 - RNA, 64 nt, Homo Sapiens
uucuuuacuuuuuguaucaguauauauauauaaauauaaauauacauaucuguauauauacaua

SEQ ID NO: 158343 - RNA, 64 nt, Homo Sapiens
aauauauucuuuacuuuuuguacauauauauauauauaaauauacguauacauaucuguauaua

SEQ ID NO: 158344 - RNA, 64 nt, Homo Sapiens
uuuaaaaaauuguuugcuugaaaauacuacugaauauaaauaagaaugugcacaguaguuuuuu

SEQ ID NO: 158345 - RNA, 64 nt, Homo Sapiens
uugaaacuuguauuauuuuuaaagagaucuauacuauaaauauggugauauauuuacaaguaau

SEQ ID NO: 158346 - RNA, 64 nt, Homo Sapiens
uauaacuggcuuauuuucuuucucuauauaaauauauaaauauauauguuuccaguguagcaga

SEQ ID NO: 158347 - RNA, 64 nt, Homo Sapiens
uaaauauauauaacuggcuuguagcagaucucuauauaaauauaguuuuuuauauguuuccagu

SEQ ID NO: 158348 - RNA, 64 nt, Homo Sapiens
cuagaucuccuauuuuucagaaugcucuucuacguauaaauaugaaaugauaaagaugucaaau

SEQ ID NO: 158349 - RNA, 64 nt, Homo Sapiens
cuucgacccuuucucugagagagaugaucgugccuauaaauaguaggaccaauguugugauuaa

SEQ ID NO: 158350 - RNA, 64 nt, Homo Sapiens
acugauuuuuuuuuaaaugguaaaugaccuuguauauaaauauugccauaucaugguaccuaua

SEQ ID NO: 158351 - RNA, 64 nt, Homo Sapiens
uguaagucuucuaaacuugguuuauugacguuaguauaaauaacauacaauaccagaugucuac

SEQ ID NO: 158352 - RNA, 64 nt, Homo Sapiens
ccaauaccuuuguauacucucaguucucauucaguauaaauaaaauuuuaaaauccuuucauag

SEQ ID NO: 158353 - RNA, 64 nt, Homo Sapiens
aaaaagaaaaaaaaagaaaaaacugggaccuaaguauaaauaucucauccuaaaguaaacaaua

SEQ ID NO: 158354 - RNA, 64 nt, Homo Sapiens
augaaaaacaaaaaauugcaaguaguaugcaaauuauaaauauacagucuucccacuucacuaa

SEQ ID NO: 158355 - RNA, 64 nt, Homo Sapiens
ccugggcuguccagccuuaauggggcugagagaguauaaauaacggucuuuaguccgggggacu

SEQ ID NO: 158356 - RNA, 64 nt, Homo Sapiens
ugaaaacuaauguacuguacgucuaacuguggaauauaaauagcuaaaaccagagaaucuuaag

SEQ ID NO: 158357 - RNA, 64 nt, Homo Sapiens
auaaaguaaacuaaaaugacccucucucucuacauauaaauaccuaugacaauauuuuaacaua

SEQ ID NO: 158358 - RNA, 64 nt, Homo Sapiens
gugagggauccaacauuacugguuauagugggaauauaaauaaagccuaugaaaugaacuuacu

SEQ ID NO: 158359 - RNA, 64 nt, Homo Sapiens
auuguacauagcauguuuauaaaaauaaaauaauuauaaauaucgaaacacuuugaagucuaua

SEQ ID NO: 158360 - RNA, 64 nt, Homo Sapiens
uuuauagccugaguaaaguucugauugaaugauauauaaauauaguuuucauuuacucuaaaaa

SEQ ID NO: 158361 - RNA, 64 nt, Homo Sapiens
gaaccacuagauuaaaaaaggcuucagccuacguuauaaauaaaccuccuacauuguaacaauu

SEQ ID NO: 158362 - RNA, 64 nt, Homo Sapiens
aauuguguaaugugucucccuuguucuaaacuuguauaaauaacaccucucccugugcaguuuu

SEQ ID NO: 158363 - RNA, 64 nt, Homo Sapiens
uuacuuguauguauuuugugauucugauaggauguauaaauacuuagaugcauacaagccgaug

SEQ ID NO: 158364 - RNA, 64 nt, Homo Sapiens
uuaagaagucuaauaugauauacauucauccuaguauaaauaaauaaucucuaaguuuucugaa

SEQ ID NO: 158365 - RNA, 64 nt, Homo Sapiens
ugugccccuucugugguaugcccuugcccuguucuauaaauaucuauaaauacucauauauaua

SEQ ID NO: 158366 - RNA, 64 nt, Homo Sapiens
cugugguaugcccuugcccuguucuauaaauaucuauaaauacucauauauauacacaccuaca

SEQ ID NO: 158367 - RNA, 64 nt, Homo Sapiens
uggauugcguuuugcuuuuuagaagagggacucauauaaauaguaaaacaucuaaagcuguugg

SEQ ID NO: 158368 - RNA, 64 nt, Homo Sapiens
aaaaaaggaaaugcauuaaacgagacuccaucucuauaaauaaagaccagccugggcaacauag

SEQ ID NO: 158369 - RNA, 64 nt, Homo Sapiens
cucugucagaggccugcaggcugugaguuauauuuauaaauauaucuucagaaauuaaucuuaa

SEQ ID NO: 158370 - RNA, 64 nt, Homo Sapiens
gguagccuuaacuucuggccaaguuuguuuuuuauauaaauauauauacauauauacauauuau

SEQ ID NO: 158371 - RNA, 64 nt, Homo Sapiens
cuuauaaagaaaaagaagcuuuucuagggguuuguauaaauaguguugaaacuuuauuuuaugu

SEQ ID NO: 158372 - RNA, 64 nt, Homo Sapiens
aauauauuuugaugaaauagguauuguguaaaucuauaaauauuugaauccaaaccaaauauaa

SEQ ID NO: 158373 - RNA, 64 nt, Homo Sapiens
aucacacugcagcugcuuuccauuuuuauauauauauaaauauauauaaauauauacuuuuuaa

SEQ ID NO: 158374 - RNA, 64 nt, Homo Sapiens
agcugcuuuccauuuuuauauauauauaaauauauauaaauauauacuuuuuaaaaauaauuua

SEQ ID NO: 158375 - RNA, 64 nt, Homo Sapiens
cacacaaagguucuggagauuacuggagaauauauauaaauauauauauguacguauauaugua

SEQ ID NO: 158376 - RNA, 64 nt, Homo Sapiens
uguacguauauauguaaauacacauauacguauauauaaauauauauauacauaugugugugua

SEQ ID NO: 158377 - RNA, 64 nt, Homo Sapiens
uuuaauauacuagucaugauuauaaauaucugaauauaaauaauaauuuucauuugauauuaga

SEQ ID NO: 158378 - RNA, 64 nt, Homo Sapiens
ugaauauaaauaauuuuaaucauuugauauuagauauaaauaucaaaauuugguaguaaauuuu

SEQ ID NO: 158379 - RNA, 64 nt, Homo Sapiens
uucugauuugaagaaacugacauuccuuuaaaaauauaaauauaaauacauacauacauagaua

SEQ ID NO: 158380 - RNA, 64 nt, Homo Sapiens
uuugaagaaacugacauuccuuuaaaaauauaaauauaaauacauacauacauagauauauacc

SEQ ID NO: 158381 - RNA, 64 nt, Homo Sapiens
uaaacugcuuaacuucaaagauaguuauugaccuuauaaauaaauauuucaaaauuuugauucg

SEQ ID NO: 158382 - RNA, 64 nt, Homo Sapiens
uauguguggaagacauucguacucuuaucuuuacuauaaauaaauucauaaaaguuaacaaagg

SEQ ID NO: 158383 - RNA, 64 nt, Homo Sapiens
agcuucauguguauuauugcagcuugaucauuuauauaaauauuugucuaguacaaugcuugac

SEQ ID NO: 158384 - RNA, 64 nt, Homo Sapiens
uuacuguucaaacauuuuuggugagugcugcuuuuauaaauaugugaugucacauauuucagug

SEQ ID NO: 158385 - RNA, 64 nt, Homo Sapiens
cuaauaucaacaguauaucucagugugugagauauauaaauacacauacaccccaugugcuuuu

SEQ ID NO: 158386 - RNA, 64 nt, Homo Sapiens
uguauacauauagauagauagauguagauauaaauauaaauauauaguuucucauagcuuuaca

SEQ ID NO: 158387 - RNA, 64 nt, Homo Sapiens
aauauauguauacauauagauuuacagauguagauauaaauauaacaaguuaguuucucauagc

SEQ ID NO: 158388 - RNA, 64 nt, Homo Sapiens
gaauccugggaaaauuaauaaugauugugagaauuauaaauacagacauaaaaagaggaguaca

SEQ ID NO: 158389 - RNA, 64 nt, Homo Sapiens
cacacacacaccuaauacuacauucaaaguauuuuauaaauacuaacccuugaagaaagcaguu

SEQ ID NO: 158390 - RNA, 64 nt, Homo Sapiens
aauuaaaucccuguuucucuauguagucuggcaguauaaauauaaauauuuaccauauaaucuu

SEQ ID NO: 158391 - RNA, 64 nt, Homo Sapiens
aucccuguuucucuauguagucuggcaguauaaauauaaauauuuaccauauaaucuuggaaua

SEQ ID NO: 158392 - RNA, 64 nt, Homo Sapiens
cacuccugaauacagaggcauauucuuuuuaaacuauaaauaccauuuugagugagaaaguacu

SEQ ID NO: 158393 - RNA, 64 nt, Homo Sapiens
aaacaagaaagaaauuguacauuaugacuaaaguuauaaauacaauauuuauaucuauaaaucu

SEQ ID NO: 158394 - RNA, 64 nt, Homo Sapiens
auuggaaaaauauuuugugaaaagcuguauuuauuauaaauacuagggccaugacauaguacca

SEQ ID NO: 158395 - RNA, 64 nt, Homo Sapiens
cucaguuuaugucucagaugcuaacgugugaaaauauaaauauauauaauauauaaaguaacca

SEQ ID NO: 158396 - RNA, 64 nt, Homo Sapiens
uuauacucacucaucacggcuauaaauauauauauauaaauauaaugccggacacggauuuaua

SEQ ID NO: 158397 - RNA, 64 nt, Homo Sapiens
uauauauaaauauauuauacgacacggauuuauauauaaauauaggugccacagucagaugccg

SEQ ID NO: 158398 - RNA, 64 nt, Homo Sapiens
ccuaaaugguuauauuugaugaucagugacauacuauaaauaauuugucuauacuaguagaagu

SEQ ID NO: 158399 - RNA, 64 nt, Homo Sapiens
aaaaaauaucuuaacagauuuugcagcuuguuuguauaaauacuaaccuauuuuugaauaguag

SEQ ID NO: 158400 - RNA, 64 nt, Homo Sapiens
uugaaaauaacucauuauaccucuccaacuggauuauaaauaaaacuuuuuccaacacauaauc

SEQ ID NO: 158401 - RNA, 64 nt, Homo Sapiens
auucuauucauuuugaaaaaaccucguuuaauacuauaaauaauguuacuacauaucuaguaaa

SEQ ID NO: 158402 - RNA, 64 nt, Homo Sapiens
ccauucauagcauagcuagagaugcaaggaauucuauaaauaaccagggcgcuugaguugcuga

SEQ ID NO: 158403 - RNA, 64 nt, Homo Sapiens
auagaagaagaggugguugcugcucauguagaucuauaaauauguguuguaugucuuuuuugcu

SEQ ID NO: 158404 - RNA, 64 nt, Homo Sapiens
aaaaagguucuuaaacauuauuugaaauaguuaauauaaauacauaauugcauuugcucuguuu

SEQ ID NO: 158405 - RNA, 64 nt, Homo Sapiens
cuaagaucaaacauuuuaauaugugcauguuauauauaaauauguaaauucugugauacucuau

SEQ ID NO: 158406 - RNA, 64 nt, Homo Sapiens
acagauuugguuaguuuagaagaaaagaaagcucuauaaauauaaaucuauauuccuguauuuu

SEQ ID NO: 158407 - RNA, 64 nt, Homo Sapiens
uaaaucuauauuccuguauuuuuauuuaauaauuuauaaauaccaaguucauuugacuuuuauu

SEQ ID NO: 158408 - RNA, 64 nt, Homo Sapiens
cucucaagaacuucagaaaucugcaacauaauuuuauaaauauauaaauacauguauguauguc

SEQ ID NO: 158409 - RNA, 64 nt, Homo Sapiens
aacuucagaaaucugcaacauaauuuuauaaauauauaaauacauguauguaugucaaaacacu

SEQ ID NO: 158410 - RNA, 64 nt, Homo Sapiens
gaaaauuccacaaagauuucugguaacuuugagcuauaaauaccuuaaaaauaauagauugaug

SEQ ID NO: 158411 - RNA, 64 nt, Homo Sapiens
ugaugauuuucuuuauuuccuagagaauuuauuuuauaaauacuuuguuuacauuuuagauugu

SEQ ID NO: 158412 - RNA, 64 nt, Homo Sapiens
accucuuuugcuguacaguuaaauaguguacauauauaaauauuaaaaagacuguuacauauua

SEQ ID NO: 158413 - RNA, 64 nt, Homo Sapiens
uauauuccuuuuauuuugaaauauuuuaauagcauauaaauaagagucuguaauuauuguacag

SEQ ID NO: 158414 - RNA, 64 nt, Homo Sapiens
acaauucaguugacuuugaccuaauauuuaagaauauaaauauauuuuauuugaaaggcugagu

SEQ ID NO: 158415 - RNA, 64 nt, Homo Sapiens
uuguguccucauugaguuuuugggugauacaguuuauaaauauaacaauuauacacccucauac

SEQ ID NO: 158416 - RNA, 64 nt, Homo Sapiens
ggugguggaauuaugggaugggguggaguauugauauaaauauauaaauacaaauguauauuuu

SEQ ID NO: 158417 - RNA, 64 nt, Homo Sapiens
aauuaugggaugggguggaguauugauauaaauauauaaauacaaauguauauuuuucaggaug

SEQ ID NO: 158418 - RNA, 64 nt, Homo Sapiens
acaucugacauaaaaguguaaaauuuuaauuaucuauaaauaaauuugugucauguauaugccu

SEQ ID NO: 158419 - RNA, 64 nt, Homo Sapiens
ucaauuaauuuuacucugaaguaacaaaucguauuauaaauauuuguauauuggaaauaacugu

SEQ ID NO: 158420 - RNA, 64 nt, Homo Sapiens
aaauugcagcauccccaaaauguguaaauguuuauauaaauaccuaggacuguguuuacuaaag

SEQ ID NO: 158421 - RNA, 64 nt, Homo Sapiens
ccgacaugaucaaaacccuuguuuuguauuuacauauaaauauacaauaucuuacagugauaca

SEQ ID NO: 158422 - RNA, 64 nt, Homo Sapiens
uauacacacgauacuccuuuauaugaucguauucuauaaauacaaauauauauuguaugugaua

SEQ ID NO: 158423 - RNA, 64 nt, Homo Sapiens
auauugaagaaaaucuuaucuuuaaguauuucuauauaaauaaaguaauggugcuacuucauuu

SEQ ID NO: 158424 - RNA, 64 nt, Homo Sapiens
auucagugcaaguuacaaaacuuucuaacauuuguauaaauagagucaaaaagaacuguugaug

SEQ ID NO: 158425 - RNA, 64 nt, Homo Sapiens
aggaacggcgacauucuaguugaaaugcaugcucuauaaauaaugccugggaaaccugaacacc

SEQ ID NO: 158426 - RNA, 64 nt, Homo Sapiens
aauuuuuccuuugaaauuauuuauauguucuauauauaaauacauauguacauagauauauggg

SEQ ID NO: 158427 - RNA, 64 nt, Homo Sapiens
uugccuccuugguuucagaagagaguaguuuuauuauaaauauuguauggacuuuguauauuaa

SEQ ID NO: 158428 - RNA, 64 nt, Homo Sapiens
cuaucucaucauagcauaucugcuuuggaauaacuauaaauaaaagaugaaguuaggaaaugug

SEQ ID NO: 158429 - RNA, 64 nt, Homo Sapiens
uuagcaaaaacauucacucuuaacauuuuaaaaauauaaauacuugcucaacaugguuuacuac

SEQ ID NO: 158430 - RNA, 64 nt, Homo Sapiens
agauuccccuacauucuccuauagguaaggguacuauaaauaugggagguaaacuuugucaugu

SEQ ID NO: 158431 - RNA, 64 nt, Homo Sapiens
ugaagguauauaaaaaugagauaucaguguugucuauaaauauucuuucauuauggaaugugaa

SEQ ID NO: 158432 - RNA, 64 nt, Homo Sapiens
agggagaguguauauguguagugguuuuuaagaguauaaauagaucaauucugacuuuuuuaua

SEQ ID NO: 158433 - RNA, 64 nt, Homo Sapiens
gaugcugugaaaucuacauacugguuuuaagugcuauaaauaaagauauauuugcacuguuuuc

SEQ ID NO: 158434 - RNA, 64 nt, Homo Sapiens
uuauaugaauuuuuauugauuuuuauaaauuuuauauaaauaagaaauuguuuuuguaaauggu

SEQ ID NO: 158435 - RNA, 64 nt, Homo Sapiens
aaaucuaaauggugaaauauauacuaaugccaucuauaaauacaaacaaauagaauguuuauag

SEQ ID NO: 158436 - RNA, 64 nt, Homo Sapiens
ggucaaauauucaauuuaagagcaaggaaauucuuauaaauauaacaauagaggcagaacucau

SEQ ID NO: 158437 - RNA, 64 nt, Homo Sapiens
uauuggguauugcaggaguucauuccuuuuuguuuauaaauacucuuccgucauaugaauagua

SEQ ID NO: 158438 - RNA, 64 nt, Homo Sapiens
uucaauuguucuuucuggaagacuuuuaaaaaaauauaaauaugcauauauauauauaaauuau

SEQ ID NO: 158439 - RNA, 64 nt, Homo Sapiens
aaaaaaauauaaauaugcauauauauauauaaauuauaaauagauuccccacgcaguguggugg

SEQ ID NO: 158440 - RNA, 64 nt, Homo Sapiens
uaucucuaccauaugugauguauauauaaauauauauaaauauacguccaaccacaaaagaaau

SEQ ID NO: 158441 - RNA, 64 nt, Homo Sapiens
uauaaauauauaucucuacccaaaagaaauuauauauaaauauaagcuuugggacguccaacca

SEQ ID NO: 158442 - RNA, 64 nt, Homo Sapiens
ucagugcuugcuugauggaagcacuauuuuuuaauauaaauauguauauaaauguugagauuuu

SEQ ID NO: 158443 - RNA, 64 nt, Homo Sapiens
uauaagauaagagaaacuguugcaauauuauauauauaaauauaaaaaccuuuguuuaaagauc

SEQ ID NO: 158444 - RNA, 64 nt, Homo Sapiens
uacaugugaugucuggucugcccaccucccuguguauaaauauugcaucguguggcccuccccu

SEQ ID NO: 158445 - RNA, 64 nt, Homo Sapiens
cuuuuaaacaagucauuuuuuauugucaacacuauauaaauaaguguccauacuaugacaaucu

SEQ ID NO: 158446 - RNA, 64 nt, Homo Sapiens
aggcauaaauuaaaauguaagaaugaaauucuuuuauaaauauuaacaacugugaguagccuau

SEQ ID NO: 158447 - RNA, 64 nt, Homo Sapiens
agcaugauuugaaaaaaagcgaacuugagaucuguauaaauaaguuuuuaaaacuaaugaguau

SEQ ID NO: 158448 - RNA, 64 nt, Homo Sapiens
guuaauguuacuuuaaaauuacauucuauauauauauaaauauauauaaauauauauuaaaaua

SEQ ID NO: 158449 - RNA, 64 nt, Homo Sapiens
cuuuaaaauuacauucuauauauauauaaauauauauaaauauauauuaaaauaccaguuuuuu

SEQ ID NO: 158450 - RNA, 64 nt, Homo Sapiens
acuguuguaaaucaugcaauuaaaguugauuacuuauaaauaugaacuuuggaucacuguauag

SEQ ID NO: 158451 - RNA, 64 nt, Homo Sapiens
aguugauguacccuuauauauauauacauauauauauaaauauaaauauauauaaaaacaacaa

SEQ ID NO: 158452 - RNA, 64 nt, Homo Sapiens
uguacccuuauauauauauacauauauauauaaauauaaauauauauaaaaacaacaaaacaaa

SEQ ID NO: 158453 - RNA, 64 nt, Homo Sapiens
ugaaauauuauuaucucaacagugauucucuguauauaaauauguaucuuggguuaaauuugag

SEQ ID NO: 158454 - RNA, 64 nt, Homo Sapiens
uauauauauacacacacacagugcucuguacguauauaaauauagcaagguugugcuuuucauu

SEQ ID NO: 158455 - RNA, 64 nt, Homo Sapiens
uauuuuuguuaacaaagacaucuaauauaaaaguuauaaauaauuuuuauaucaaauauacagu

SEQ ID NO: 158456 - RNA, 64 nt, Homo Sapiens
uaaaugucucaguagaggaguagcgauagauuuauauaaauaucucauuuuuuuaagaaaggaa

SEQ ID NO: 158457 - RNA, 64 nt, Homo Sapiens
auuaacuuuacugacauggagugaagugcaauauuauaaauauuauagauuaaaaaaaaaauag

SEQ ID NO: 158458 - RNA, 64 nt, Homo Sapiens
ccguaguaugaauguacaucuuguaaaacugagauauaaauaaacuuauaaauauuuguauuca

SEQ ID NO: 158459 - RNA, 64 nt, Homo Sapiens
uguacaucuuguaaaacugagauauaaauaaacuuauaaauauuuguauucaaguguuaaaaaa

SEQ ID NO: 158460 - RNA, 64 nt, Homo Sapiens
guauggcuguauuugcuguugauucagacuuucacaccauuaauggggaaaagcguggccacaa

SEQ ID NO: 158461 - RNA, 64 nt, Homo Sapiens
agaaugccacuuuggcugaacuacaaguguaggccaccauuauaauuuauaaauacagcauacu

SEQ ID NO: 158462 - RNA, 64 nt, Homo Sapiens
cacggggugggggugagggcaggcugggcuuggccaccauuaaaauuagucugcccaccuuucu

SEQ ID NO: 158463 - RNA, 64 nt, Homo Sapiens
cugcccaccuuucuaggcugucucaggcuauucccaccauuaguaugaaugaauggccuucccu

SEQ ID NO: 158464 - RNA, 64 nt, Homo Sapiens
uuuagaaaccagaaugcuuuguuuuuaccagauucaccauuagagguugauggggcaacugcag

SEQ ID NO: 158465 - RNA, 64 nt, Homo Sapiens
ggcaaaauuacacaagaaaacaguauugcaaugacaccauuacauaaggaacauugaacuguua

SEQ ID NO: 158466 - RNA, 64 nt, Homo Sapiens
uacacagacacacacagaaaccgccacagagacacaccauuacacaaucacacgcagccccucc

SEQ ID NO: 158467 - RNA, 64 nt, Homo Sapiens
cacacauacacagaaagacacggccacagaaacacaccauuacacaaucgcagauacgcccuuc

SEQ ID NO: 158468 - RNA, 64 nt, Homo Sapiens
uacacagacacgcaaucgcaccgccacagagacacaccauuacaaaaucacacacacacccucc

SEQ ID NO: 158469 - RNA, 64 nt, Homo Sapiens
uacacagacacacacagaaaccccgccacagagacaccauuacacaaaaucacacacacacccu

SEQ ID NO: 158470 - RNA, 64 nt, Homo Sapiens
uacacagacacacacagaaaccccaccacagagacaccauuacaucaaaucacacacacccccu

SEQ ID NO: 158471 - RNA, 64 nt, Homo Sapiens
cgcgcuguuccggcuucuucacggcugacauucggcuaacgagggauuacuuuggccaaaaccu

SEQ ID NO: 158472 - RNA, 64 nt, Homo Sapiens
ucucaccucgaagcgccuuuuuccuuguuucagugcuaacgauuucuaugaaaaauucuugccu

SEQ ID NO: 158473 - RNA, 64 nt, Homo Sapiens
aagcugccccugacagcacagggccugggggguggcuaacgagagaggccuuacagugccggca

SEQ ID NO: 158474 - RNA, 64 nt, Homo Sapiens
gguucccgccugcuguccccucccugaucacacagcuaacgaggcugccuccagcauuuccuga

SEQ ID NO: 158475 - RNA, 64 nt, Homo Sapiens
agcucauugcuacaaccaguuucugcaggccauugcuaacgaacgggcaagaaccaccucauga

SEQ ID NO: 158476 - RNA, 64 nt, Homo Sapiens
cagcuccaaguaaacuaguuaccuggguaaaagcgcuaacgacccaaaggcucuucuaagagcc

SEQ ID NO: 158477 - RNA, 64 nt, Homo Sapiens
ucauucccuagagacaccaguaaccccgggcuuagcuaacgaaaguggggagccucaggcugaa

SEQ ID NO: 158478 - RNA, 64 nt, Homo Sapiens
cugagaagggggcguauguucccaagauggagaugcuaacgaaaguuucccucaccucggucuu

SEQ ID NO: 158479 - RNA, 64 nt, Homo Sapiens
uagaagcaacauucauucucacacugauuuaauagcuaacgagguguaucucacuuuuucucua

SEQ ID NO: 158480 - RNA, 64 nt, Homo Sapiens
acucauugauccaaaacuuagagcuuucuacucagcuaacgauugcuuauuguaggguagaaaa

SEQ ID NO: 158481 - RNA, 64 nt, Homo Sapiens
aggcaacugaugacuaucauaccgcaagcguccugcuaacgagacuucucaggguccccuccua

SEQ ID NO: 158482 - RNA, 64 nt, Homo Sapiens
acagggucugcacucuaaccugcccaguuucagggcuaacgacccucagggagguuaagugacu

SEQ ID NO: 158483 - RNA, 64 nt, Homo Sapiens
gaaguuacuggggauuacucgaccucauuacuuagcuaacgacuggauaaaauuucuuaauugu

SEQ ID NO: 158484 - RNA, 64 nt, Homo Sapiens
cuaccucccucuuuguaaaugcuaagguugggaggcuaacgagucuggcaacaucacgauuuaa

SEQ ID NO: 158485 - RNA, 64 nt, Homo Sapiens
caaaggaagucugaaggcuuuugauggaaucuaggcuaacgagauaauuggcuuacuugaucau

SEQ ID NO: 158486 - RNA, 64 nt, Homo Sapiens
uaagauggaaucacuaccucugaucacauaucaggcuaacgauagagaaagcauuagguuuaag

SEQ ID NO: 158487 - RNA, 64 nt, Homo Sapiens
acuugaaugaacugcuggggcuaaaauuucacaugcuaacgacaauaacaagcuaaaagcacaa

SEQ ID NO: 158488 - RNA, 64 nt, Homo Sapiens
gaaccuaugcaaguucuuagguuagggaggguaugcuaacgacaacaguucuugagcaaacuga

SEQ ID NO: 158489 - RNA, 64 nt, Homo Sapiens
uugauaaagggaauguugcauuugggacuaugcugcuaacgaaaugguuugaaguauuuucaug

SEQ ID NO: 158490 - RNA, 64 nt, Homo Sapiens
uagguuucauuucucagacuacaaagaucucgaggcuaacgaugucugcagaauaucaucaggg

SEQ ID NO: 158491 - RNA, 64 nt, Homo Sapiens
gacaggcagaccuagauaagaaaagcagagaacuacuuuggaaaacaguuuaucugcuguaauu

SEQ ID NO: 158492 - RNA, 64 nt, Homo Sapiens
gccaggugcgguggcucacgccuguaaucccaaaacuuuggaaggcugaggcagguggaucacc

SEQ ID NO: 158493 - RNA, 64 nt, Homo Sapiens
guucuaauaauuuuuaguugugagugauuaaaaaacuuuggaucaauuuuggucaaacaugcca

SEQ ID NO: 158494 - RNA, 64 nt, Homo Sapiens
uaagugaaaugaguauaauccaaguaacuggugaacuuuggagguuuggagcuugaagagaaug

SEQ ID NO: 158495 - RNA, 64 nt, Homo Sapiens
ugccuuccugccucuacuccaccuccaucccuggacuuuggacccuuggccuaggagccuaagg

SEQ ID NO: 158496 - RNA, 64 nt, Homo Sapiens
gcaccacccaagaaagaggaaaacuuugccuacaacuuuggaaaugcuggggucccuggugugg

SEQ ID NO: 158497 - RNA, 64 nt, Homo Sapiens
ggccagcaccacuuccuuuaaagaugaacucugaacuuuggagagugagcuacagagccgagca

SEQ ID NO: 158498 - RNA, 64 nt, Homo Sapiens
gaauacaaauuuuaaaggaugaaaaucuuaccguacuuuggaacuugcuguuuaaaaagacaga

SEQ ID NO: 158499 - RNA, 64 nt, Homo Sapiens
uuuauuccagcauucgaugcauuuuuauagaaacacuuuggaaacacuuuggaugaaccaaggc

SEQ ID NO: 158500 - RNA, 64 nt, Homo Sapiens
auucgaugcauuuuuauagaaacacuuuggaaacacuuuggaugaaccaaggccuuuuccuuau

SEQ ID NO: 158501 - RNA, 64 nt, Homo Sapiens
gcacagaaaauacacauuuacuguccaauuuaaaacuuuggaauugcugugauuaaagugauca

SEQ ID NO: 158502 - RNA, 64 nt, Homo Sapiens
uauaaaaaaaaaaguacuaucaaucaaucauacuacuuuggauuguugugcugguguaaugugg

SEQ ID NO: 158503 - RNA, 64 nt, Homo Sapiens
ugugaauauacuuccugaagauuucagccagaggacuuuggaacaaauucucucuguugagagc

SEQ ID NO: 158504 - RNA, 64 nt, Homo Sapiens
auccaagagugaaccagaaugcauacaguucuugacuuuggacauggaaccagaacaggcuaag

SEQ ID NO: 158505 - RNA, 64 nt, Homo Sapiens
cuuuuggauggguugggagauguggcuggaaaguacuuuggaaaauauacaaucaagauaucuc

SEQ ID NO: 158506 - RNA, 64 nt, Homo Sapiens
uuuugguaaaucucuuaauguaaguagcuauuugacuuuggaauuuugcauucgagguauacug

SEQ ID NO: 158507 - RNA, 64 nt, Homo Sapiens
caaauuggcuuccauuuccuguuaggguggacuaacuuuggacacccaguuuaaaaagagucca

SEQ ID NO: 158508 - RNA, 64 nt, Homo Sapiens
aagaaagacuucuguugccuuucggaaacuucugacuuuggauucgauauugugcuugaaguuc

SEQ ID NO: 158509 - RNA, 64 nt, Homo Sapiens
gugugaggcauaaaugcuuccucuuagcagaggcacuuuggaagggguguucaaggaagagugg

SEQ ID NO: 158510 - RNA, 64 nt, Homo Sapiens
ugcugggucugaaucggcuucuuaagggaagaaaacuuuggauuuaaguaaggcugucagucug

SEQ ID NO: 158511 - RNA, 64 nt, Homo Sapiens
gaaccuuuuuuuuguuguuugccauugagcacagacuuuggaagagcugcaguuagggaaggga

SEQ ID NO: 158512 - RNA, 64 nt, Homo Sapiens
gauccaaaauggaaaagccaugauuuugcugcagacuuuggaauccccagcaucaaaaaaccaa

SEQ ID NO: 158513 - RNA, 64 nt, Homo Sapiens
uuucuggauccuucccuggggcccccaggccugcacuuuggagagugucgauauccacaaccca

SEQ ID NO: 158514 - RNA, 64 nt, Homo Sapiens
agcauuucuccuccccagaggcacaagcucacccacuuuggagcaagccaccguggccggccaa

SEQ ID NO: 158515 - RNA, 64 nt, Homo Sapiens
ccaagcaggacauggacaaggaugaucuaggaagacuuuggaaagaguaggaagacuuuggaaa

SEQ ID NO: 158516 - RNA, 64 nt, Homo Sapiens
gaugaucuaggaagacuuuggaaagaguaggaagacuuuggaaagacuuuuccaacccucauca

SEQ ID NO: 158517 - RNA, 64 nt, Homo Sapiens
gugggacccuccagccuggagcaucuggggacacacuuuggaaauuucuagaaaagccacaccu

SEQ ID NO: 158518 - RNA, 64 nt, Homo Sapiens
uccggccuuuugaccagaacuagaagcagcaugcacuuuggaaaucugaacucugaccugugaa

SEQ ID NO: 158519 - RNA, 64 nt, Homo Sapiens
guacucuguucaauguuuaaauuuaucuguauuaacuuuggaaugcauuauugcauuauauacc

SEQ ID NO: 158520 - RNA, 64 nt, Homo Sapiens
gggucacaaauccuaaaagacaaggcuuuaaaugacuuuggagagcccaccugugaguuuaaag

SEQ ID NO: 158521 - RNA, 64 nt, Homo Sapiens
aaaagucacaggugacagcccuccugaggcccacacuuuggaggggguccauguccaagagacc

SEQ ID NO: 158522 - RNA, 64 nt, Homo Sapiens
cagcucugccuggcugguguucaggcccucagucacuuuggaagugagaagaacccuucagcca

SEQ ID NO: 158523 - RNA, 64 nt, Homo Sapiens
aauaggguuguuacaacugucacuagcggaggucacuuuggagaagggugggccuuacauccag

SEQ ID NO: 158524 - RNA, 64 nt, Homo Sapiens
agugggugugguggcucacaccugcaaucccagcacuuuggaaggccgaggugggcagaucauc

SEQ ID NO: 158525 - RNA, 64 nt, Homo Sapiens
uuuccauuugucucauacaguuuggaucagaaacacuuuggagauucucaagguuauuuccgac

SEQ ID NO: 158526 - RNA, 64 nt, Homo Sapiens
agaaacacuuuggagauuuccaagguuauuuccgacuuuggaucuuguuguuuuccuacuuucu

SEQ ID NO: 158527 - RNA, 64 nt, Homo Sapiens
acgcacacacgcacacacacacacguacacacacauacaaaaucccucugcaguuuuggggaga

SEQ ID NO: 158528 - RNA, 64 nt, Homo Sapiens
cuuugggacugauucucaguggagggcuuagaucauacaaaaaucuuuauuggguccguguguu

SEQ ID NO: 158529 - RNA, 64 nt, Homo Sapiens
agcuuuuaaacuggugucuuuggaaggaagguagauacaaaaagauugugguaaaaacuggggu

SEQ ID NO: 158530 - RNA, 64 nt, Homo Sapiens
uuuauuuguuuuugagauggagucucuacuaaaaauacaaaaaauuagccaggcauggugccgc

SEQ ID NO: 158531 - RNA, 64 nt, Homo Sapiens
uggccaauauggugaaaccccaucucuacuaagaauacaaaaaauuagcugagcaugguggugg

SEQ ID NO: 158532 - RNA, 64 nt, Homo Sapiens
uggccaauaugaugaaaccccgucucuacuaaaaauacaaaauuagucggguaugguggcacau

SEQ ID NO: 158533 - RNA, 64 nt, Homo Sapiens
uacacugaaaugacuuuuguuuuucuucuaacucauacaaaacugguuuggaaagucuuugcuu

SEQ ID NO: 158534 - RNA, 64 nt, Homo Sapiens
uggccaacauggugaaaccccgucucuacuaaaaauacaaaaaguagccaggcgugguggcgug

SEQ ID NO: 158535 - RNA, 64 nt, Homo Sapiens
cucucauuacuguagugcugagguuauugaaguuauacaaaacacaucucagucucuguuucuu

SEQ ID NO: 158536 - RNA, 64 nt, Homo Sapiens
uugaguugaauauugaacucuaacaguuuucuacauacaaaacacagugucaugaagguuauuc

SEQ ID NO: 158537 - RNA, 64 nt, Homo Sapiens
uggcuaacacggugaaacuccaucucuacuaaaaauacaaaaaauuggccgggcgcagcggcuc

SEQ ID NO: 158538 - RNA, 64 nt, Homo Sapiens
uggccaacauggugacaccccgucucuacuaaaaauacaaaaauuacccaggcauaguggcaca

SEQ ID NO: 158539 - RNA, 64 nt, Homo Sapiens
cucugucucaaaaaaacaaaacaaacaaacaaaaauacaaaaaauuagccgggcgugguggcac

SEQ ID NO: 158540 - RNA, 64 nt, Homo Sapiens
ugggcaacauggugaaacccccgucucuacuaaaauacaaaaaaauuagccaggcauaguggcg

SEQ ID NO: 158541 - RNA, 64 nt, Homo Sapiens
uggccaacauagugaaaccccuuguuuacucaaaauacaaaaauuggcugggugcggugguaca

SEQ ID NO: 158542 - RNA, 64 nt, Homo Sapiens
aagcuuacagacuaacuggggagauguagugugcauacaaaacaguaaaagagccaucucaagg

SEQ ID NO: 158543 - RNA, 64 nt, Homo Sapiens
accacacccggcuaauuuuuuguguuuuuacaaaauacaaaaaaguagagacaggauuucacug

SEQ ID NO: 158544 - RNA, 64 nt, Homo Sapiens
cuggugauaaguuccaaauauguuaagggcuuuaauacaaaaagcaaaaauugucaguguuugg

SEQ ID NO: 158545 - RNA, 64 nt, Homo Sapiens
aauuagccagccaugguggcugucucuacuaaaaauacaaaaaauggcuaacauggugaaaccc

SEQ ID NO: 158546 - RNA, 64 nt, Homo Sapiens
auuagccaggcguggucgugcucuacuaaaaaaaauacaaaaaacgaacacggugaaaccccgu

SEQ ID NO: 158547 - RNA, 64 nt, Homo Sapiens
uagccuggcaugguggugggcaucucuacuaaaaauacaaaaauugaccaacauggcgaaaccc

SEQ ID NO: 158548 - RNA, 64 nt, Homo Sapiens
uauccgggcaugguggcacacgucucuacuaaaaauacaaaaauugaccaacacggugaaaccc

SEQ ID NO: 158549 - RNA, 64 nt, Homo Sapiens
gaaguaguagccacaguacaaauaagauagaaugauacaaaaguaccuagaaauguagcuugcu

SEQ ID NO: 158550 - RNA, 64 nt, Homo Sapiens
cagcuaaagcugccacagaacuguagcaaagccaauacaaaaauauuuguucuuuuacagaauu

SEQ ID NO: 158551 - RNA, 64 nt, Homo Sapiens
uagccaggcaugguggugcacguguuuacaaaaaauacaaaaauugggcaauguggcaaaaccg

SEQ ID NO: 158552 - RNA, 64 nt, Homo Sapiens
cuggguugagccuuucaugaguuguacauagccuauacaaaauguugaauacaaaacuuugccu

SEQ ID NO: 158553 - RNA, 64 nt, Homo Sapiens
uugccuguuguacauagccucgucaaauucuugaauacaaaacucuauaaauugaggcagcuaa

SEQ ID NO: 158554 - RNA, 64 nt, Homo Sapiens
uagccaggcgugguggcggguguaucugcuaaaaauacaaaaauuggcuaacauggugaaaccc

SEQ ID NO: 158555 - RNA, 64 nt, Homo Sapiens
uggcugggcgugguggcacuccaucucuacuaaaauacaaaaaucugaccaacaugguaaaacc

SEQ ID NO: 158556 - RNA, 64 nt, Homo Sapiens
uuaccugggccugguggcacacaguuuuguaaaaauacaaaaaacauggugaaaccccaucucu

SEQ ID NO: 158557 - RNA, 64 nt, Homo Sapiens
auuuuccauuuccguuauuagaaauggaauuuauauacaaaaaucuuuaauuuuacuuaauuaa

SEQ ID NO: 158558 - RNA, 64 nt, Homo Sapiens
uagccgggugugguggugggggccucuacuaaaaauacaaaaauuggccaacauggugaaaccu

SEQ ID NO: 158559 - RNA, 64 nt, Homo Sapiens
acaauccuuguauuuuuucuugucuucauuagaaauacaaaaauguuccauuuuauaauucuga

SEQ ID NO: 158560 - RNA, 64 nt, Homo Sapiens
aauaugugaugaugugucuaauacuaaguaauguauacaaaagaagauuucauagaagucguga

SEQ ID NO: 158561 - RNA, 64 nt, Homo Sapiens
ucagggaagaagcauacaacuuuggacauagcgaauacaaaauuggaagcugucauaaaaagac

SEQ ID NO: 158562 - RNA, 64 nt, Homo Sapiens
uggccaacauggugaaaccccgucucuacuaaaaauacaaaaauuagcugagcauggugguacg

SEQ ID NO: 158563 - RNA, 64 nt, Homo Sapiens
guaauaggguaguucuggagagaugguaugcagcauacaaaaauauauuaaaaauauaaacaau

SEQ ID NO: 158564 - RNA, 64 nt, Homo Sapiens
aacccauuauuccucaccuacccucaaaguagguauacaaaagacuaguuuguuauuaauccac

SEQ ID NO: 158565 - RNA, 64 nt, Homo Sapiens
agcccauuuuauaauauaaauaagucuugaaugaauacaaaaggccugagauguauuuuuucuu

SEQ ID NO: 158566 - RNA, 64 nt, Homo Sapiens
aaugcacaacagaaauaucuggauucuuacuaacauacaaaaauuauguaaauggaaauacaaa

SEQ ID NO: 158567 - RNA, 64 nt, Homo Sapiens
uagcugggcaucauggcacaaaaaaaauacauauauacaaaaauaugaaacaucaucucuacau

SEQ ID NO: 158568 - RNA, 64 nt, Homo Sapiens
ucauuuucucugaaagucgacauuguauguacauauacaaaauuuuugguuagaaguucuacaa

SEQ ID NO: 158569 - RNA, 64 nt, Homo Sapiens
uagccagguguggagguacaugucucuacuaaaaauacaaaaauuggccaacauggugaaaccc

SEQ ID NO: 158570 - RNA, 64 nt, Homo Sapiens
uuagccaggcgugguggcaccgucucuacuaaaaauacaaaaaauggcuaacauggugaaaccc

SEQ ID NO: 158571 - RNA, 64 nt, Homo Sapiens
auggacacucccuaauuccaauguuuuuucauucauacaaaauacauuuggaggcuaaaaugua

SEQ ID NO: 158572 - RNA, 64 nt, Homo Sapiens
uagccgggagugguggugcgcaccucuauuaaaaauacaaaaauucgccaacaaggugaaaccc

SEQ ID NO: 158573 - RNA, 64 nt, Homo Sapiens
uaggccggguacaguggcuccaucucuacuaaaaauacaaaaauuggccaauaugaugaaaccc

SEQ ID NO: 158574 - RNA, 64 nt, Homo Sapiens
ucugauuuuaaugugcugaauaacugcaauucacauacaaaaugucauacacuuaauaguacug

SEQ ID NO: 158575 - RNA, 64 nt, Homo Sapiens
uggaaauuuuucuguaaaaccaugacauuugcagauacaaaagaaugccuuucuguuccccucu

SEQ ID NO: 158576 - RNA, 64 nt, Homo Sapiens
aacuugauuaaaacuggugcucaaagaucuaauaauacaaaacacgaggcacagaaaacaaaua

SEQ ID NO: 158577 - RNA, 64 nt, Homo Sapiens
agaaugaguuaaaccauuuaaacacauuugaaacauacaaaaauagaaaugugaaagcauuugg

SEQ ID NO: 158578 - RNA, 64 nt, Homo Sapiens
uggccaacauagugaaaccccaucucuacugaaaauacaaaaauuagcugggugugguggcacg

SEQ ID NO: 158579 - RNA, 64 nt, Homo Sapiens
gagauaauuagccaaaaacccaguagccuagaagauacaaaacuccacuggccucuaaaauuau

SEQ ID NO: 158580 - RNA, 64 nt, Homo Sapiens
uggcuaacacagugaaaccccgucucuacuaaaaauacaaaaaauuagccggguguggugucgg

SEQ ID NO: 158581 - RNA, 64 nt, Homo Sapiens
ugacuaacauggugaaaucccgucucuacuaaaaauacaaaaaaaaaaaaaaaaaaaagccagg

SEQ ID NO: 158582 - RNA, 64 nt, Homo Sapiens
uggccaacauggugaaauccugccucuacuaaaaauacaaaaaaaaaaaaaaauuagcugggca

SEQ ID NO: 158583 - RNA, 64 nt, Homo Sapiens
uauuugcccauuccuauucugcuuguuauucauuauacaaaaagaugaaaguugccuuugagaa

SEQ ID NO: 158584 - RNA, 64 nt, Homo Sapiens
uuugguuuagcauugaugggcuauuuuuguagaaauacaaaaagguuuguagcucuaugugcau

SEQ ID NO: 158585 - RNA, 64 nt, Homo Sapiens
ugagcaauguggugaaaccccaucucuacuaaaaauacaaaaauuaucugggcuugguggcggg

SEQ ID NO: 158586 - RNA, 64 nt, Homo Sapiens
aaugaaacaacagaaguacaaaaaagaauaucagauacaaaaaucaaucgugaagaaaaucugu

SEQ ID NO: 158587 - RNA, 64 nt, Homo Sapiens
auauguaaaguaguauugcugacauuuuaaaaaaauacaaaauacaaaagaaaccauuagaaau

SEQ ID NO: 158588 - RNA, 64 nt, Homo Sapiens
aaguaguauugcugacauuuuaaaaaaauacaaaauacaaaagaaaccauuagaaauuaauaac

SEQ ID NO: 158589 - RNA, 64 nt, Homo Sapiens
uggccaacauggugaaaccccaucucuacuaaaaauacaaaaauuagccggacgcaguggcacg

SEQ ID NO: 158590 - RNA, 64 nt, Homo Sapiens
uggccaacauggugaaacccugucucuacuaaaaauacaaaaaugagcugggcaugguggggcg

SEQ ID NO: 158591 - RNA, 64 nt, Homo Sapiens
acugucacaucuuuacagucuuguauguuauagaauacaaaauaaguugaugguuuuguuuggu

SEQ ID NO: 158592 - RNA, 64 nt, Homo Sapiens
gggagagguuuuuuuuuuuaauuuuucccccuuuauacaaaaaaaaaagaacauuuccaaaacu

SEQ ID NO: 158593 - RNA, 64 nt, Homo Sapiens
uggccaacaugaugaaaccuugucuuuacuaaaaauacaaaaauuagcugggcaugguggcagg

SEQ ID NO: 158594 - RNA, 64 nt, Homo Sapiens
uggccagcaugguaaaacccugucuccacuaaaaauacaaaaauuagccaggcaugguggcggg

SEQ ID NO: 158595 - RNA, 64 nt, Homo Sapiens
uggccaacauggugaaacccugucucuacuaaaaauacaaaaauuagcugggugugguggugug

SEQ ID NO: 158596 - RNA, 64 nt, Homo Sapiens
aagccuauaaauguguuucauuaccaauuaugguauacaaaaauaaguauugagggggcaaaaa

SEQ ID NO: 158597 - RNA, 64 nt, Homo Sapiens
caauuuguauucaauauuguacauaagaaaaccaauacaaaaaaagggucacuuugaauugugc

SEQ ID NO: 158598 - RNA, 64 nt, Homo Sapiens
cggcuaaaacggugaaaccccgucucuacuaaaaauacaaaaaauuagccgggcguaguggcgg

SEQ ID NO: 158599 - RNA, 64 nt, Homo Sapiens
auauaugaaaaugcuuuuuaaacacaaaagcuuuauacaaaauauuguugaauuuaaauaaggu

SEQ ID NO: 158600 - RNA, 64 nt, Homo Sapiens
uaucuggaauacauuaaagaagcaaaagaaccucauacaaaagucauugaguaaaugacagcca

SEQ ID NO: 158601 - RNA, 64 nt, Homo Sapiens
uggccaucauggcgaaaccucaucucuacuaaaaauacaaaaguuaaccagguguguggugcac

SEQ ID NO: 158602 - RNA, 64 nt, Homo Sapiens
guauuuauugucaguuuuguucacuuguuaucuaauacaaaauuauaaagccuucagaggguuu

SEQ ID NO: 158603 - RNA, 64 nt, Homo Sapiens
aggccaacauggugaaacuucaucucuacuaaaaauacaaaaacuagccaggugugguucucca

SEQ ID NO: 158604 - RNA, 64 nt, Homo Sapiens
uggucuacauggugaaaccccaucucaacuaaaaauacaaaaaauacaaaaaauuagccgggcg

SEQ ID NO: 158605 - RNA, 64 nt, Homo Sapiens
uggugaaaccccaucucaacuaaaaauacaaaaaauacaaaaaauuagccgggcgcgguggcuc

SEQ ID NO: 158606 - RNA, 64 nt, Homo Sapiens
uggccaacauggugaaacccugucucuauuaaaaauacaaaaauuagcugggcgugguggcgca

SEQ ID NO: 158607 - RNA, 64 nt, Homo Sapiens
uggccaauauggugaaacccugucucuacaaaaaauacaaaaauuagcugggcaugguggugcg

SEQ ID NO: 158608 - RNA, 64 nt, Homo Sapiens
cugugugguaguauuuuguuggaagagaauguuuauacaaaaaaugaaauucuuccaacagcag

SEQ ID NO: 158609 - RNA, 64 nt, Homo Sapiens
uggcuaacacugugaaaccccgucucuacuaaaaauacaaaaaauuagcggggcaugguggcac

SEQ ID NO: 158610 - RNA, 64 nt, Homo Sapiens
uaguucuuuaagcauuauuuuaaacacuauauugauacaaaaauaucuugcuuacucuaaacuu

SEQ ID NO: 158611 - RNA, 64 nt, Homo Sapiens
cggcuaacauggugaaacccugccucuacuaaaaauacaaaaaaaaacaaaauuagccgggcgu

SEQ ID NO: 158612 - RNA, 64 nt, Homo Sapiens
ggucaacaugucaaaacccuguaccuacaaaaaaauacaaaaguuaaccaagccuaugcuugua

SEQ ID NO: 158613 - RNA, 64 nt, Homo Sapiens
auuagccgggcgugguggugcgucucuacuaaaaauacaaaaauugaccaacauggagaaaccc

SEQ ID NO: 158614 - RNA, 64 nt, Homo Sapiens
uagcugggugugguggcaugcaacucuacuaaaaauacaaaaauuggcccacauggugagaccc

SEQ ID NO: 158615 - RNA, 64 nt, Homo Sapiens
uagccaggugugguggcacacaucucuacuaaaaauacaaaaauuggccagcauggugaaaccc

SEQ ID NO: 158616 - RNA, 64 nt, Homo Sapiens
aaauguguaaggcuugcuaauuauuaaauauugcauacaaaagaccaaauuauccaaaauuauu

SEQ ID NO: 158617 - RNA, 64 nt, Homo Sapiens
guuuacauauuauguuuguauuuaugcuacuuaaauacaaaacuggacaggccaggcauggugg

SEQ ID NO: 158618 - RNA, 64 nt, Homo Sapiens
ugaccaacauggugaaacuccaucucuacuaaaaauacaaaaauuaaccaggcuugauggugug

SEQ ID NO: 158619 - RNA, 64 nt, Homo Sapiens
uggcuaacauagugagacccuguuucuacuaaaaauacaaaaauaagccaggugugguggugca

SEQ ID NO: 158620 - RNA, 64 nt, Homo Sapiens
uggccaacauggcaaaacuccgucucugcaaaaaauacaaaaaugagcccgguauguuggcaua

SEQ ID NO: 158621 - RNA, 64 nt, Homo Sapiens
uagcugggcguggugguguacaucucuacuaaaaauacaaaaauugaccaacauagugaaaccc

SEQ ID NO: 158622 - RNA, 64 nt, Homo Sapiens
ggaucaagacauucacccuauaauuaaguuuaaaauacaaaauuacagaaggcuaucaaaauuu

SEQ ID NO: 158623 - RNA, 64 nt, Homo Sapiens
cagggcaacauggugaaaccccaucucuacuaaaauacaaaaaguuagcugggcuuggcggugu

SEQ ID NO: 158624 - RNA, 64 nt, Homo Sapiens
uuucuuuuauugcuauuuacacauacauacacacauacaaaaccuuuaaauuuugggaucugaa

SEQ ID NO: 158625 - RNA, 64 nt, Homo Sapiens
uagccaggcgugguggugcaugucucuacuaaaaauacaaaaauuggccaacauggugaaaccu

SEQ ID NO: 158626 - RNA, 64 nt, Homo Sapiens
agccgggcguggugaugcguuaucucuacuaaaaauacaaaaguugaccaacacggagaaaccc

SEQ ID NO: 158627 - RNA, 64 nt, Homo Sapiens
uagcugggcaugguggggcacgucucuacuaaaaauacaaaaauuggccaacauggugaaaccc

SEQ ID NO: 158628 - RNA, 64 nt, Homo Sapiens
ucacaggguguguuggcacacaucucuacuaaaaauacaaaaauuggccaacauggcaaaaucc

SEQ ID NO: 158629 - RNA, 64 nt, Homo Sapiens
uuagcugggcaugguggugcccaucucuauuaaaauacaaaaaacugggcaacacggugaaacc

SEQ ID NO: 158630 - RNA, 64 nt, Homo Sapiens
uaacucaagauggauuaaagcuuccuuaugccauauacaaaaauaaaagauugaaaauggacgc

SEQ ID NO: 158631 - RNA, 64 nt, Homo Sapiens
ugaccaacauggacaaaccccgucucuacuaaaaauacaaaauuggcagggugugguggcacau

SEQ ID NO: 158632 - RNA, 64 nt, Homo Sapiens
ugggcaacauggcgaaacccuaucucuacaaaaaauacaaaaauuagccagacaugguggcaca

SEQ ID NO: 158633 - RNA, 64 nt, Homo Sapiens
uagcugagugugguggcaggcgucuguacuaaaaauacaaaauuuggccaacauggugaaaccu

SEQ ID NO: 158634 - RNA, 64 nt, Homo Sapiens
auuagccaggcgugguggcgugucucuacuaaaaauacaaaaaauggcuaacacggugaaaccc

SEQ ID NO: 158635 - RNA, 64 nt, Homo Sapiens
uaguacuaguuuugcuuuaaaaugcuauguaaauauacaaaaaaacuagaaagaaauauauaua

SEQ ID NO: 158636 - RNA, 64 nt, Homo Sapiens
uggcuaaugcguugaaacuccgucucuacuaaaaauacaaaaaauuagcugggcgugguggugg

SEQ ID NO: 158637 - RNA, 64 nt, Homo Sapiens
cuggccaacauggugaaacccuucucuacugaaaauacaaaaauuagccaggugugguggcgca

SEQ ID NO: 158638 - RNA, 64 nt, Homo Sapiens
uggcuaauauggugaaaccucgucucuacuaaaaauacaaaaauuagcugggcaugguggugcg

SEQ ID NO: 158639 - RNA, 64 nt, Homo Sapiens
acuuuuaaggacuugagauaacuaauuuguuuauauacaaaaauuaauguuacuguguuacuua

SEQ ID NO: 158640 - RNA, 64 nt, Homo Sapiens
ccugagauacccgauucuauauguaaaagcuaauauacaaaaaagcagauuaaauuacaugaua

SEQ ID NO: 158641 - RNA, 64 nt, Homo Sapiens
uggccaacauggggaaaccccgucucuacuaaaaauacaaaaauuagccgggcauggugguggg

SEQ ID NO: 158642 - RNA, 64 nt, Homo Sapiens
uggccaauguggugaaaccccaucucuacuaaaaauacaaaaauuagcugggcgugguggugca

SEQ ID NO: 158643 - RNA, 64 nt, Homo Sapiens
uguugauaagacaaguuuagaauugguuuacuuaauacaaaaaaaaaaaaaagaauuucaaaaa

SEQ ID NO: 158644 - RNA, 64 nt, Homo Sapiens
aaccuguaguuucauuaccuuuuugaauaaugucauacaaaaaauguauuuguuuuuuugugcu

SEQ ID NO: 158645 - RNA, 64 nt, Homo Sapiens
uggccaacacggugaaaccccgccucuacuaaaaauacaaaaaauagccggguguggugguggg

SEQ ID NO: 158646 - RNA, 64 nt, Homo Sapiens
gacaaaacauagugaaaccccgucucuacuaaaaauacaaaaauuagcugggcguggugguggg

SEQ ID NO: 158647 - RNA, 64 nt, Homo Sapiens
cuguucacuacuguguaaaguaaaaacuaaaaaaauacaaaauacaaaacacacacacacacac

SEQ ID NO: 158648 - RNA, 64 nt, Homo Sapiens
cuacuguguaaaguaaaaacuaaaaaaauacaaaauacaaaacacacacacacacacacacaca

SEQ ID NO: 158649 - RNA, 64 nt, Homo Sapiens
uggccaacaugaugaaacccugucucuacuaaaaauacaaaaauuagccgggcaugguggugca

SEQ ID NO: 158650 - RNA, 64 nt, Homo Sapiens
ccugggcaacauggcacaauugucucuacaaaaaauacaaaaauuagccaggcaugguggcaug

SEQ ID NO: 158651 - RNA, 64 nt, Homo Sapiens
agaagaaugaaacuagacccccaucucuuagcauauacaaaaaucaaaauuaauuaaaaaguua

SEQ ID NO: 158652 - RNA, 64 nt, Homo Sapiens
aaauagccaggugugggguguaaaauaaauuuaaauacaaaaaaacucugccucaaaaaaaaau

SEQ ID NO: 158653 - RNA, 64 nt, Homo Sapiens
auagggcugggcgcgguugccugucucuacuaaaauacaaaaaacuggccaacguggugaaacg

SEQ ID NO: 158654 - RNA, 64 nt, Homo Sapiens
gugaccagccugggcaacccugucucuacaaaaaauacaaaaauuaaccaggcaugguggcaug

SEQ ID NO: 158655 - RNA, 64 nt, Homo Sapiens
uggccaacauggugaaacccugucucuacuaaaaauacaaaaauagcugggcaugguggcacgc

SEQ ID NO: 158656 - RNA, 64 nt, Homo Sapiens
uggguaauauggcaagagcccaacucuacuaaaaauacaaaaagaaaagaaaacagccaagcuu

SEQ ID NO: 158657 - RNA, 64 nt, Homo Sapiens
aguuuuuacagauauacaauauggagugacuuauauacaaaaugaccuuaaaaauauauuaaac

SEQ ID NO: 158658 - RNA, 64 nt, Homo Sapiens
cucauuaacaggcaguccuuuaguaugcugauuuauacaaaaugcugaaaagaagagaaauacc

SEQ ID NO: 158659 - RNA, 64 nt, Homo Sapiens
aaauauauacaagcacuuuguaaauuguaaaaugauacaaaauuuaaaguuuauagagccaguu

SEQ ID NO: 158660 - RNA, 64 nt, Homo Sapiens
uggccaacauggugaaaccccgucucuacuaaaaauacaaaaauuagacgagcgugguggugga

SEQ ID NO: 158661 - RNA, 64 nt, Homo Sapiens
uggcuaacaaggcgaaauccugucuguacuaaaaauacaaaaaucagccagacaugguggcaug

SEQ ID NO: 158662 - RNA, 64 nt, Homo Sapiens
ucgccaacauggugaaaccguaucucuaauaaaaauacaaaaauuagcugggcauggugcgggc

SEQ ID NO: 158663 - RNA, 64 nt, Homo Sapiens
aauuuggauguuuuccagcauuuagccaaauuccauacaaaaagugguuugagcacuggguucu

SEQ ID NO: 158664 - RNA, 64 nt, Homo Sapiens
auuuuuuguaacaguuauuuaucccauuacaaaaauacaaaaauuuaccauuguuauagguaaa

SEQ ID NO: 158665 - RNA, 64 nt, Homo Sapiens
cuaccuuuucuaaaaucuguguaaagguaucuauauacaaaagguaaaagucagccuaaagaau

SEQ ID NO: 158666 - RNA, 64 nt, Homo Sapiens
uguaguugaaaaaagaugacuucugguuuacuauauacaaaaacuaacaggguccauacacauc

SEQ ID NO: 158667 - RNA, 64 nt, Homo Sapiens
agcuuggccaaggugauaaaacccgucucuacuaauacaaaaaaaauuagcuggguauguuggu

SEQ ID NO: 158668 - RNA, 64 nt, Homo Sapiens
uggccaacauggcgaaaccccaucucuacuaaaaauacaaaaauuagccgggcgugguggcuua

SEQ ID NO: 158669 - RNA, 64 nt, Homo Sapiens
auuucaugcacugauuaaaauaggauuauuuuaaauacaaaaggcauuuuauaugaauuauaaa

SEQ ID NO: 158670 - RNA, 64 nt, Homo Sapiens
auuauaaacugaagagcuuaaagauaguuacaaaauacaaaaguucaaccucuuacaauaagcu

SEQ ID NO: 158671 - RNA, 64 nt, Homo Sapiens
cuuggcccaaagaauaggaacuuagcuagcauguauacaaaauauauuugagguuacuaaauga

SEQ ID NO: 158672 - RNA, 64 nt, Homo Sapiens
ggaaauuaauacugauaaagacuaucaguaucugauacaaaagggaaccaaacgauauuuaagu

SEQ ID NO: 158673 - RNA, 64 nt, Homo Sapiens
acauucuccaaagauaguauaaguugauuuauaaauacaaaaauuugaaugagacaguuuuuaa

SEQ ID NO: 158674 - RNA, 64 nt, Homo Sapiens
uuagcuggguguaacggcggcgucucuacuaaaaauacaaaaacuggccaacaugguaaaacgc

SEQ ID NO: 158675 - RNA, 64 nt, Homo Sapiens
ugggcaacauggcaaaaccccaucucuacaaaaaauacaaaaaguaggccgggcacggugguuc

SEQ ID NO: 158676 - RNA, 64 nt, Homo Sapiens
uggccaacaugguggaacccaaucucuacuaaaaauacaaaaaaacuagccggauaugguggcg

SEQ ID NO: 158677 - RNA, 64 nt, Homo Sapiens
aauacuauuuugugacuaaauuacaacuaugugcauacaaaagcuugacaaaagcaaaguaauc

SEQ ID NO: 158678 - RNA, 64 nt, Homo Sapiens
cacaacaaagcgcaguggucuccaccccucccccauacaaaauccuguugaaaaaaacugguuc

SEQ ID NO: 158679 - RNA, 64 nt, Homo Sapiens
uagcuggguguggugguaugcgucucuauuaaaaauacaaaaauuggccaacauagugaaaccc

SEQ ID NO: 158680 - RNA, 64 nt, Homo Sapiens
ccgggcguggugggcgccugcgucucuacuaaaaauacaaaaaguggccaacauggcaaaaccc

SEQ ID NO: 158681 - RNA, 64 nt, Homo Sapiens
cuggccaacauggugaaaccccgucucuacuaaaauacaaaaaauuagcugggcaugguggcgc

SEQ ID NO: 158682 - RNA, 64 nt, Homo Sapiens
ugaccaacuuggugaaaucccaucucuacuaaaaauacaaaaauuagcugggugcaguggcgca

SEQ ID NO: 158683 - RNA, 64 nt, Homo Sapiens
aauuagccgggcgugguggccgucuuuacuaaaaauacaaaaaauggcuaacacggugaaaccc

SEQ ID NO: 158684 - RNA, 64 nt, Homo Sapiens
gaacacaauuaaaaucuuaaaaaaucaaguaucaauacaaaauacagacuagaauaggguucuu

SEQ ID NO: 158685 - RNA, 64 nt, Homo Sapiens
uagcugggcgugguggcgugcgucucuauuaaaaauacaaaaauuggcaaacauggugaaaccc

SEQ ID NO: 158686 - RNA, 64 nt, Homo Sapiens
uagcuggacguguagucccaccaucuuuacaaaaauacaaaaaucaaggcaacauagugaggcc

SEQ ID NO: 158687 - RNA, 64 nt, Homo Sapiens
uagccgggcaugguggaaugugucucuccuaaaaauacaaaaauuggccaguauggugaaaccc

SEQ ID NO: 158688 - RNA, 64 nt, Homo Sapiens
ugucuaacacggugaaaccccaucucuacuaaaaauacaaaaaaauuagucggacaugguggca

SEQ ID NO: 158689 - RNA, 64 nt, Homo Sapiens
uggccaacauggugaaaccccaucucuacuaaaaauacaaaaauuagcuaggcgggguagugca

SEQ ID NO: 158690 - RNA, 64 nt, Homo Sapiens
ucagccaagacauaaaaacuaggacucagagcacauacaaaaccaguuauguuucggaaagagg

SEQ ID NO: 158691 - RNA, 64 nt, Homo Sapiens
uugaaauugggccuaaggagugagaacuacaaaaauacaaaaugcuuguccaggacucagccau

SEQ ID NO: 158692 - RNA, 64 nt, Homo Sapiens
auuagucgggcgugguggcgcgucucuacuaaaaauacaaaaaauggcuaacacggugaaaccc

SEQ ID NO: 158693 - RNA, 64 nt, Homo Sapiens
cuagccaggcguggugguggcaucuuuacuaaaaauacaaaaaauggccaacauggugaaaccc

SEQ ID NO: 158694 - RNA, 64 nt, Homo Sapiens
uagccgggcgugguggcccaaaaaaaaaaaaaaaauacaaaaauagacuccgucucaaaaaaaa

SEQ ID NO: 158695 - RNA, 64 nt, Homo Sapiens
uuagccgggcgugguagcggcaucucuacuaaaaauacaaaaaauggccaacaugaugaaaccc

SEQ ID NO: 158696 - RNA, 64 nt, Homo Sapiens
uagccgggcaugguggugugcgucucuacuaaaaauacaaaaauuggccaacaaggcaaaaccc

SEQ ID NO: 158697 - RNA, 64 nt, Homo Sapiens
ccacagugaggccaccuugauugaagauuuuuuuauacaaaaggacucagggaacaaugagcac

SEQ ID NO: 158698 - RNA, 64 nt, Homo Sapiens
uggccaacauggugaaaccucaucucuacuaaaaauacaaaaauuagccaggcgugguggcagg

SEQ ID NO: 158699 - RNA, 64 nt, Homo Sapiens
uggugaacauggcgaaaccccgucucuaauaaaaauacaaaaauuagccgggcaugguggugca

SEQ ID NO: 158700 - RNA, 64 nt, Homo Sapiens
ugagcaacaugguaaaaccccaucucuaccaaaaauacaaaaauuagcugggcuugguggcugg

SEQ ID NO: 158701 - RNA, 64 nt, Homo Sapiens
uggcuaacauggugaaauccuaucucuaccaaaaauacaaaaauuagccaggcguggugguggg

SEQ ID NO: 158702 - RNA, 64 nt, Homo Sapiens
ggagguuuguuuaacacuaucuauauuuaagcuuauacaaaaugggcaaaauauagaauauuug

SEQ ID NO: 158703 - RNA, 64 nt, Homo Sapiens
uggccaauauggugaaaccccaucucuacuaaaaauacaaaaauuagccgggugugguggcgug

SEQ ID NO: 158704 - RNA, 64 nt, Homo Sapiens
uagaucugauaaacaacuucaaaaaaguuucaggauacaaaaucuguguacaaaaauuaguugc

SEQ ID NO: 158705 - RNA, 64 nt, Homo Sapiens
aggauauugaaacuggaccccuauccuucacgauauacaaaaaucaacucaagauggauuaaag

SEQ ID NO: 158706 - RNA, 64 nt, Homo Sapiens
uggguaacauggcaaaauccugucuuuacaaaaaauacaaaaauuagccuagcaugguggcgca

SEQ ID NO: 158707 - RNA, 64 nt, Homo Sapiens
uggcuaauauggugaaacccugucucuacuaaaaauacaaaaaaauuagcuaggcaugguggcg

SEQ ID NO: 158708 - RNA, 64 nt, Homo Sapiens
acacagaaucuuauauugaaaaaaauuugaacauauacaaaaauuuuaaaacuuucuaucauga

SEQ ID NO: 158709 - RNA, 64 nt, Homo Sapiens
uuagcaacagagcgcgauuccaucucuacuaaaaauacaaaaaauggccaacauggugaaaccu

SEQ ID NO: 158710 - RNA, 64 nt, Homo Sapiens
gacccgauuaaaagauucugucugacaauuccuaauacaaaaaucauucaaaauauguuaaauu

SEQ ID NO: 158711 - RNA, 64 nt, Homo Sapiens
agccaggcaugguggugcaucaucucuauuaaagauacaaaauuugaccaacacugagaaaccc

SEQ ID NO: 158712 - RNA, 64 nt, Homo Sapiens
uagccaggcaugguggcacaugucuguacuaaaaauacaaaauuugguuaacauggugaaaccc

SEQ ID NO: 158713 - RNA, 64 nt, Homo Sapiens
aaaauccaacuaaagaccagcuacuuuauaucauauacaaaaauaggagaaaaauuuuagcuuu

SEQ ID NO: 158714 - RNA, 64 nt, Homo Sapiens
ccaagaagauacaggaauucgauagugagcauucauacaaaaauaauaaaucaagcaguaguaa

SEQ ID NO: 158715 - RNA, 64 nt, Homo Sapiens
uagccaggcguggucacaugcaucuccacuaaaaauacaaaaauugaccaucauggugaaaccu

SEQ ID NO: 158716 - RNA, 64 nt, Homo Sapiens
aaaaugaggaugaauaacaaauguccuuuuguucauacaaaagacaggagaugauauaucugga

SEQ ID NO: 158717 - RNA, 64 nt, Homo Sapiens
uagccgggcaugguggugcauaucucuacuaaaaauacaaaaauuggccaacaugaugaaaccc

SEQ ID NO: 158718 - RNA, 64 nt, Homo Sapiens
caaaaaaaauuagccaggcgcaucucuacuaaaaauacaaaaacuggcuaacacggugaaaccc

SEQ ID NO: 158719 - RNA, 64 nt, Homo Sapiens
auuagccgggugcgguggcgcgucucuacuaaaaauacaaaaaauggcuaacacggugaaaccc

SEQ ID NO: 158720 - RNA, 64 nt, Homo Sapiens
uagcugagugugguggcacacaucucuacaaaaaauacaaaaauugggcaacauggugagaccc

SEQ ID NO: 158721 - RNA, 64 nt, Homo Sapiens
uggccaacguggugaaacacugucucuacuaaaaauacaaaaaugagcugggugugaugauaca

SEQ ID NO: 158722 - RNA, 64 nt, Homo Sapiens
uggcuaacacggugaaaccccgucuuuacuaaaaauacaaaaaaaauuagcugggcgugguggc

SEQ ID NO: 158723 - RNA, 64 nt, Homo Sapiens
uggccaacauggcgaaaccccuucucuacuaaaaauacaaaaauuagcugggcgugguagugca

SEQ ID NO: 158724 - RNA, 64 nt, Homo Sapiens
ggcaaacacuuucaaauauaauuuccuucagugaauacaaaauguugauaucauaggugaugua

SEQ ID NO: 158725 - RNA, 64 nt, Homo Sapiens
uaggugugguggcgggcaccccaucucuacuaaaauacaaaaauuggccaacauggcaaaaccc

SEQ ID NO: 158726 - RNA, 64 nt, Homo Sapiens
auuagccgggcaugguggcacucaucucuacaaaauacaaaaaaucugggaaacguggugagac

SEQ ID NO: 158727 - RNA, 64 nt, Homo Sapiens
uagcugggcguaguggcgcgcaucucuacuaaaaauacaaaaauuggccaacauggugaaaccc

SEQ ID NO: 158728 - RNA, 64 nt, Homo Sapiens
uagccgggcgugguggugcgucaucucuacuaaaauacaaaaaucuggccaacauagcaaaacc

SEQ ID NO: 158729 - RNA, 64 nt, Homo Sapiens
uuagcugggcguggugguggcaucucuaucagaaauacaaaaaauggccaacauggugaaaccc

SEQ ID NO: 158730 - RNA, 64 nt, Homo Sapiens
uuuuuaaaauuuagaguagguguaaugacaaaagauacaaaagcuacauuuguauuuauguggc

SEQ ID NO: 158731 - RNA, 64 nt, Homo Sapiens; identical to SEQ ID NO: 158491

SEQ ID NO: 158732 - RNA, 64 nt, Homo Sapiens; identical to SEQ ID NO: 158492

SEQ ID NO: 158733 - RNA, 64 nt, Homo Sapiens; identical to SEQ ID NO: 158493

SEQ ID NO: 158734 - RNA, 64 nt, Homo Sapiens; identical to SEQ ID NO: 158494

SEQ ID NO: 158735 - RNA, 64 nt, Homo Sapiens; identical to SEQ ID NO: 158495

SEQ ID NO: 158736 - RNA, 64 nt, Homo Sapiens; identical to SEQ ID NO: 158496

SEQ ID NO: 158737 - RNA, 64 nt, Homo Sapiens; identical to SEQ ID NO: 158497

SEQ ID NO: 158738 - RNA, 64 nt, Homo Sapiens; identical to SEQ ID NO: 158498

SEQ ID NO: 158739 - RNA, 64 nt, Homo Sapiens; identical to SEQ ID NO: 158499

SEQ ID NO: 158740 - RNA, 64 nt, Homo Sapiens; identical to SEQ ID NO: 158500

SEQ ID NO: 158741 - RNA, 64 nt, Homo Sapiens; identical to SEQ ID NO: 158501

SEQ ID NO: 158742 - RNA, 64 nt, Homo Sapiens; identical to SEQ ID NO: 158502

SEQ ID NO: 158743 - RNA, 64 nt, Homo Sapiens; identical to SEQ ID NO: 158503

SEQ ID NO: 158744 - RNA, 64 nt, Homo Sapiens; identical to SEQ ID NO: 158504

SEQ ID NO: 158745 - RNA, 64 nt, Homo Sapiens; identical to SEQ ID NO: 158505

SEQ ID NO: 158746 - RNA, 64 nt, Homo Sapiens; identical to SEQ ID NO: 158506

SEQ ID NO: 158747 - RNA, 64 nt, Homo Sapiens; identical to SEQ ID NO: 158507

SEQ ID NO: 158748 - RNA, 64 nt, Homo Sapiens; identical to SEQ ID NO: 158508

SEQ ID NO: 158749 - RNA, 64 nt, Homo Sapiens; identical to SEQ ID NO: 158509

SEQ ID NO: 158750 - RNA, 64 nt, Homo Sapiens; identical to SEQ ID NO: 158510

SEQ ID NO: 158751 - RNA, 64 nt, Homo Sapiens; identical to SEQ ID NO: 158511

SEQ ID NO: 158752 - RNA, 64 nt, Homo Sapiens; identical to SEQ ID NO: 158512

SEQ ID NO: 158753 - RNA, 64 nt, Homo Sapiens; identical to SEQ ID NO: 158513

SEQ ID NO: 158754 - RNA, 64 nt, Homo Sapiens; identical to SEQ ID NO: 158514

SEQ ID NO: 158755 - RNA, 64 nt, Homo Sapiens; identical to SEQ ID NO: 158515

SEQ ID NO: 158756 - RNA, 64 nt, Homo Sapiens; identical to SEQ ID NO: 158516

SEQ ID NO: 158757 - RNA, 64 nt, Homo Sapiens; identical to SEQ ID NO: 158517

SEQ ID NO: 158758 - RNA, 64 nt, Homo Sapiens; identical to SEQ ID NO: 158518

SEQ ID NO: 158759 - RNA, 64 nt, Homo Sapiens; identical to SEQ ID NO: 158519

SEQ ID NO: 158760 - RNA, 64 nt, Homo Sapiens; identical to SEQ ID NO: 158520

SEQ ID NO: 158761 - RNA, 64 nt, Homo Sapiens; identical to SEQ ID NO: 158521

SEQ ID NO: 158762 - RNA, 64 nt, Homo Sapiens; identical to SEQ ID NO: 158522

SEQ ID NO: 158763 - RNA, 64 nt, Homo Sapiens; identical to SEQ ID NO: 158523

SEQ ID NO: 158764 - RNA, 64 nt, Homo Sapiens; identical to SEQ ID NO: 158524

SEQ ID NO: 158765 - RNA, 64 nt, Homo Sapiens; identical to SEQ ID NO: 158525

SEQ ID NO: 158766 - RNA, 64 nt, Homo Sapiens; identical to SEQ ID NO: 158526

SEQ ID NO: 158767 - RNA, 64 nt, Homo Sapiens; identical to SEQ ID NO: 158527

SEQ ID NO: 158768 - RNA, 64 nt, Homo Sapiens; identical to SEQ ID NO: 158528

SEQ ID NO: 158769 - RNA, 64 nt, Homo Sapiens; identical to SEQ ID NO: 158529

SEQ ID NO: 158770 - RNA, 64 nt, Homo Sapiens; identical to SEQ ID NO: 158530

SEQ ID NO: 158771 - RNA, 64 nt, Homo Sapiens; identical to SEQ ID NO: 158531

SEQ ID NO: 158772 - RNA, 64 nt, Homo Sapiens; identical to SEQ ID NO: 158532

SEQ ID NO: 158773 - RNA, 64 nt, Homo Sapiens; identical to SEQ ID NO: 158533

SEQ ID NO: 158774 - RNA, 64 nt, Homo Sapiens; identical to SEQ ID NO: 158534

SEQ ID NO: 158775 - RNA, 64 nt, Homo Sapiens; identical to SEQ ID NO: 158535

SEQ ID NO: 158776 - RNA, 64 nt, Homo Sapiens; identical to SEQ ID NO: 158536

SEQ ID NO: 158777 - RNA, 64 nt, Homo Sapiens; identical to SEQ ID NO: 158537

SEQ ID NO: 158778 - RNA, 64 nt, Homo Sapiens; identical to SEQ ID NO: 158538

SEQ ID NO: 158779 - RNA, 64 nt, Homo Sapiens; identical to SEQ ID NO: 158539

SEQ ID NO: 158780 - RNA, 64 nt, Homo Sapiens; identical to SEQ ID NO: 158540

SEQ ID NO: 158781 - RNA, 64 nt, Homo Sapiens; identical to SEQ ID NO: 158541

SEQ ID NO: 158782 - RNA, 64 nt, Homo Sapiens; identical to SEQ ID NO: 158542

SEQ ID NO: 158783 - RNA, 64 nt, Homo Sapiens; identical to SEQ ID NO: 158543

SEQ ID NO: 158784 - RNA, 64 nt, Homo Sapiens; identical to SEQ ID NO: 158544

SEQ ID NO: 158785 - RNA, 64 nt, Homo Sapiens; identical to SEQ ID NO: 158545

SEQ ID NO: 158786 - RNA, 64 nt, Homo Sapiens; identical to SEQ ID NO: 158546

SEQ ID NO: 158787 - RNA, 64 nt, Homo Sapiens; identical to SEQ ID NO: 158547

SEQ ID NO: 158788 - RNA, 64 nt, Homo Sapiens; identical to SEQ ID NO: 158548

SEQ ID NO: 158789 - RNA, 64 nt, Homo Sapiens; identical to SEQ ID NO: 158549

SEQ ID NO: 158790 - RNA, 64 nt, Homo Sapiens; identical to SEQ ID NO: 158550

SEQ ID NO: 158791 - RNA, 64 nt, Homo Sapiens; identical to SEQ ID NO: 158551

SEQ ID NO: 158792 - RNA, 64 nt, Homo Sapiens; identical to SEQ ID NO: 158552

SEQ ID NO: 158793 - RNA, 64 nt, Homo Sapiens; identical to SEQ ID NO: 158553

SEQ ID NO: 158794 - RNA, 64 nt, Homo Sapiens; identical to SEQ ID NO: 158554

SEQ ID NO: 158795 - RNA, 64 nt, Homo Sapiens; identical to SEQ ID NO: 158555

SEQ ID NO: 158796 - RNA, 64 nt, Homo Sapiens; identical to SEQ ID NO: 158556

SEQ ID NO: 158797 - RNA, 64 nt, Homo Sapiens; identical to SEQ ID NO: 158557

SEQ ID NO: 158798 - RNA, 64 nt, Homo Sapiens; identical to SEQ ID NO: 158558

SEQ ID NO: 158799 - RNA, 64 nt, Homo Sapiens; identical to SEQ ID NO: 158559

SEQ ID NO: 158800 - RNA, 64 nt, Homo Sapiens; identical to SEQ ID NO: 158560

SEQ ID NO: 158801 - RNA, 64 nt, Homo Sapiens; identical to SEQ ID NO: 158561

SEQ ID NO: 158802 - RNA, 64 nt, Homo Sapiens; identical to SEQ ID NO: 158562

SEQ ID NO: 158803 - RNA, 64 nt, Homo Sapiens; identical to SEQ ID NO: 158563

SEQ ID NO: 158804 - RNA, 64 nt, Homo Sapiens; identical to SEQ ID NO: 158564

SEQ ID NO: 158805 - RNA, 64 nt, Homo Sapiens; identical to SEQ ID NO: 158565

SEQ ID NO: 158806 - RNA, 64 nt, Homo Sapiens; identical to SEQ ID NO: 158566

SEQ ID NO: 158807 - RNA, 64 nt, Homo Sapiens; identical to SEQ ID NO: 158567

SEQ ID NO: 158808 - RNA, 64 nt, Homo Sapiens; identical to SEQ ID NO: 158568

SEQ ID NO: 158809 - RNA, 64 nt, Homo Sapiens; identical to SEQ ID NO: 158569

SEQ ID NO: 158810 - RNA, 64 nt, Homo Sapiens; identical to SEQ ID NO: 158570

SEQ ID NO: 158811 - RNA, 64 nt, Homo Sapiens; identical to SEQ ID NO: 158571

SEQ ID NO: 158812 - RNA, 64 nt, Homo Sapiens; identical to SEQ ID NO: 158572

SEQ ID NO: 158813 - RNA, 64 nt, Homo Sapiens; identical to SEQ ID NO: 158573

SEQ ID NO: 158814 - RNA, 64 nt, Homo Sapiens; identical to SEQ ID NO: 158574

SEQ ID NO: 158815 - RNA, 64 nt, Homo Sapiens; identical to SEQ ID NO: 158575

SEQ ID NO: 158816 - RNA, 64 nt, Homo Sapiens; identical to SEQ ID NO: 158576

SEQ ID NO: 158817 - RNA, 64 nt, Homo Sapiens; identical to SEQ ID NO: 158577

SEQ ID NO: 158818 - RNA, 64 nt, Homo Sapiens; identical to SEQ ID NO: 158578

SEQ ID NO: 158819 - RNA, 64 nt, Homo Sapiens; identical to SEQ ID NO: 158579

SEQ ID NO: 158820 - RNA, 64 nt, Homo Sapiens; identical to SEQ ID NO: 158580

SEQ ID NO: 158821 - RNA, 64 nt, Homo Sapiens; identical to SEQ ID NO: 158581

SEQ ID NO: 158822 - RNA, 64 nt, Homo Sapiens; identical to SEQ ID NO: 158582

SEQ ID NO: 158823 - RNA, 64 nt, Homo Sapiens; identical to SEQ ID NO: 158583

SEQ ID NO: 158824 - RNA, 64 nt, Homo Sapiens; identical to SEQ ID NO: 158584

SEQ ID NO: 158825 - RNA, 64 nt, Homo Sapiens; identical to SEQ ID NO: 158585

SEQ ID NO: 158826 - RNA, 64 nt, Homo Sapiens; identical to SEQ ID NO: 158586

SEQ ID NO: 158827 - RNA, 64 nt, Homo Sapiens; identical to SEQ ID NO: 158587

SEQ ID NO: 158828 - RNA, 64 nt, Homo Sapiens; identical to SEQ ID NO: 158588

SEQ ID NO: 158829 - RNA, 64 nt, Homo Sapiens; identical to SEQ ID NO: 158589

SEQ ID NO: 158830 - RNA, 64 nt, Homo Sapiens; identical to SEQ ID NO: 158590

SEQ ID NO: 158831 - RNA, 64 nt, Homo Sapiens; identical to SEQ ID NO: 158591

SEQ ID NO: 158832 - RNA, 64 nt, Homo Sapiens; identical to SEQ ID NO: 158592

SEQ ID NO: 158833 - RNA, 64 nt, Homo Sapiens; identical to SEQ ID NO: 158593

SEQ ID NO: 158834 - RNA, 64 nt, Homo Sapiens; identical to SEQ ID NO: 158594

SEQ ID NO: 158835 - RNA, 64 nt, Homo Sapiens; identical to SEQ ID NO: 158595

SEQ ID NO: 158836 - RNA, 64 nt, Homo Sapiens; identical to SEQ ID NO: 158596

SEQ ID NO: 158837 - RNA, 64 nt, Homo Sapiens; identical to SEQ ID NO: 158597

SEQ ID NO: 158838 - RNA, 64 nt, Homo Sapiens; identical to SEQ ID NO: 158598

SEQ ID NO: 158839 - RNA, 64 nt, Homo Sapiens; identical to SEQ ID NO: 158599

SEQ ID NO: 158840 - RNA, 64 nt, Homo Sapiens; identical to SEQ ID NO: 158600

SEQ ID NO: 158841 - RNA, 64 nt, Homo Sapiens; identical to SEQ ID NO: 158601

SEQ ID NO: 158842 - RNA, 64 nt, Homo Sapiens; identical to SEQ ID NO: 158602

SEQ ID NO: 158843 - RNA, 64 nt, Homo Sapiens; identical to SEQ ID NO: 158603

SEQ ID NO: 158844 - RNA, 64 nt, Homo Sapiens; identical to SEQ ID NO: 158604

SEQ ID NO: 158845 - RNA, 64 nt, Homo Sapiens; identical to SEQ ID NO: 158605

SEQ ID NO: 158846 - RNA, 64 nt, Homo Sapiens; identical to SEQ ID NO: 158606

SEQ ID NO: 158847 - RNA, 64 nt, Homo Sapiens; identical to SEQ ID NO: 158607

SEQ ID NO: 158848 - RNA, 64 nt, Homo Sapiens; identical to SEQ ID NO: 158608

SEQ ID NO: 158849 - RNA, 64 nt, Homo Sapiens; identical to SEQ ID NO: 158609

SEQ ID NO: 158850 - RNA, 64 nt, Homo Sapiens; identical to SEQ ID NO: 158610

SEQ ID NO: 158851 - RNA, 64 nt, Homo Sapiens; identical to SEQ ID NO: 158611

SEQ ID NO: 158852 - RNA, 64 nt, Homo Sapiens; identical to SEQ ID NO: 158612

SEQ ID NO: 158853 - RNA, 64 nt, Homo Sapiens; identical to SEQ ID NO: 158613

SEQ ID NO: 158854 - RNA, 64 nt, Homo Sapiens; identical to SEQ ID NO: 158614

SEQ ID NO: 158855 - RNA, 64 nt, Homo Sapiens; identical to SEQ ID NO: 158615

SEQ ID NO: 158856 - RNA, 64 nt, Homo Sapiens; identical to SEQ ID NO: 158616

SEQ ID NO: 158857 - RNA, 64 nt, Homo Sapiens; identical to SEQ ID NO: 158617

SEQ ID NO: 158858 - RNA, 64 nt, Homo Sapiens; identical to SEQ ID NO: 158618

SEQ ID NO: 158859 - RNA, 64 nt, Homo Sapiens; identical to SEQ ID NO: 158619

SEQ ID NO: 158860 - RNA, 64 nt, Homo Sapiens; identical to SEQ ID NO: 158620

SEQ ID NO: 158861 - RNA, 64 nt, Homo Sapiens; identical to SEQ ID NO: 158621

SEQ ID NO: 158862 - RNA, 64 nt, Homo Sapiens; identical to SEQ ID NO: 158622

SEQ ID NO: 158863 - RNA, 64 nt, Homo Sapiens; identical to SEQ ID NO: 158623

SEQ ID NO: 158864 - RNA, 64 nt, Homo Sapiens; identical to SEQ ID NO: 158624

SEQ ID NO: 158865 - RNA, 64 nt, Homo Sapiens; identical to SEQ ID NO: 158625

SEQ ID NO: 158866 - RNA, 64 nt, Homo Sapiens; identical to SEQ ID NO: 158626

SEQ ID NO: 158867 - RNA, 64 nt, Homo Sapiens; identical to SEQ ID NO: 158627

SEQ ID NO: 158868 - RNA, 64 nt, Homo Sapiens; identical to SEQ ID NO: 158628

SEQ ID NO: 158869 - RNA, 64 nt, Homo Sapiens; identical to SEQ ID NO: 158629

SEQ ID NO: 158870 - RNA, 64 nt, Homo Sapiens; identical to SEQ ID NO: 158630

SEQ ID NO: 158871 - RNA, 64 nt, Homo Sapiens; identical to SEQ ID NO: 158631

SEQ ID NO: 158872 - RNA, 64 nt, Homo Sapiens; identical to SEQ ID NO: 158632

SEQ ID NO: 158873 - RNA, 64 nt, Homo Sapiens; identical to SEQ ID NO: 158633

SEQ ID NO: 158874 - RNA, 64 nt, Homo Sapiens; identical to SEQ ID NO: 158634

SEQ ID NO: 158875 - RNA, 64 nt, Homo Sapiens; identical to SEQ ID NO: 158635

SEQ ID NO: 158876 - RNA, 64 nt, Homo Sapiens; identical to SEQ ID NO: 158636

SEQ ID NO: 158877 - RNA, 64 nt, Homo Sapiens; identical to SEQ ID NO: 158637

SEQ ID NO: 158878 - RNA, 64 nt, Homo Sapiens; identical to SEQ ID NO: 158638

SEQ ID NO: 158879 - RNA, 64 nt, Homo Sapiens; identical to SEQ ID NO: 158639

SEQ ID NO: 158880 - RNA, 64 nt, Homo Sapiens; identical to SEQ ID NO: 158640

SEQ ID NO: 158881 - RNA, 64 nt, Homo Sapiens; identical to SEQ ID NO: 158641

SEQ ID NO: 158882 - RNA, 64 nt, Homo Sapiens; identical to SEQ ID NO: 158642

SEQ ID NO: 158883 - RNA, 64 nt, Homo Sapiens; identical to SEQ ID NO: 158643

SEQ ID NO: 158884 - RNA, 64 nt, Homo Sapiens; identical to SEQ ID NO: 158644

SEQ ID NO: 158885 - RNA, 64 nt, Homo Sapiens; identical to SEQ ID NO: 158645

SEQ ID NO: 158886 - RNA, 64 nt, Homo Sapiens; identical to SEQ ID NO: 158646

SEQ ID NO: 158887 - RNA, 64 nt, Homo Sapiens; identical to SEQ ID NO: 158647

SEQ ID NO: 158888 - RNA, 64 nt, Homo Sapiens; identical to SEQ ID NO: 158648

SEQ ID NO: 158889 - RNA, 64 nt, Homo Sapiens; identical to SEQ ID NO: 158649

SEQ ID NO: 158890 - RNA, 64 nt, Homo Sapiens; identical to SEQ ID NO: 158650

SEQ ID NO: 158891 - RNA, 64 nt, Homo Sapiens; identical to SEQ ID NO: 158651

SEQ ID NO: 158892 - RNA, 64 nt, Homo Sapiens; identical to SEQ ID NO: 158652

SEQ ID NO: 158893 - RNA, 64 nt, Homo Sapiens; identical to SEQ ID NO: 158653

SEQ ID NO: 158894 - RNA, 64 nt, Homo Sapiens; identical to SEQ ID NO: 158654

SEQ ID NO: 158895 - RNA, 64 nt, Homo Sapiens; identical to SEQ ID NO: 158655

SEQ ID NO: 158896 - RNA, 64 nt, Homo Sapiens; identical to SEQ ID NO: 158656

SEQ ID NO: 158897 - RNA, 64 nt, Homo Sapiens; identical to SEQ ID NO: 158657

SEQ ID NO: 158898 - RNA, 64 nt, Homo Sapiens; identical to SEQ ID NO: 158658

SEQ ID NO: 158899 - RNA, 64 nt, Homo Sapiens; identical to SEQ ID NO: 158659

SEQ ID NO: 158900 - RNA, 64 nt, Homo Sapiens; identical to SEQ ID NO: 158660

SEQ ID NO: 158901 - RNA, 64 nt, Homo Sapiens; identical to SEQ ID NO: 158661

SEQ ID NO: 158902 - RNA, 64 nt, Homo Sapiens; identical to SEQ ID NO: 158662

SEQ ID NO: 158903 - RNA, 64 nt, Homo Sapiens; identical to SEQ ID NO: 158663

SEQ ID NO: 158904 - RNA, 64 nt, Homo Sapiens; identical to SEQ ID NO: 158664

SEQ ID NO: 158905 - RNA, 64 nt, Homo Sapiens; identical to SEQ ID NO: 158665

SEQ ID NO: 158906 - RNA, 64 nt, Homo Sapiens; identical to SEQ ID NO: 158666

SEQ ID NO: 158907 - RNA, 64 nt, Homo Sapiens; identical to SEQ ID NO: 158667

SEQ ID NO: 158908 - RNA, 64 nt, Homo Sapiens; identical to SEQ ID NO: 158668

SEQ ID NO: 158909 - RNA, 64 nt, Homo Sapiens; identical to SEQ ID NO: 158669

SEQ ID NO: 158910 - RNA, 64 nt, Homo Sapiens; identical to SEQ ID NO: 158670

SEQ ID NO: 158911 - RNA, 64 nt, Homo Sapiens; identical to SEQ ID NO: 158671

SEQ ID NO: 158912 - RNA, 64 nt, Homo Sapiens; identical to SEQ ID NO: 158672

SEQ ID NO: 158913 - RNA, 64 nt, Homo Sapiens; identical to SEQ ID NO: 158673

SEQ ID NO: 158914 - RNA, 64 nt, Homo Sapiens; identical to SEQ ID NO: 158674

SEQ ID NO: 158915 - RNA, 64 nt, Homo Sapiens; identical to SEQ ID NO: 158675

SEQ ID NO: 158916 - RNA, 64 nt, Homo Sapiens; identical to SEQ ID NO: 158676

SEQ ID NO: 158917 - RNA, 64 nt, Homo Sapiens; identical to SEQ ID NO: 158677

SEQ ID NO: 158918 - RNA, 64 nt, Homo Sapiens; identical to SEQ ID NO: 158678

SEQ ID NO: 158919 - RNA, 64 nt, Homo Sapiens; identical to SEQ ID NO: 158679

SEQ ID NO: 158920 - RNA, 64 nt, Homo Sapiens; identical to SEQ ID NO: 158680

SEQ ID NO: 158921 - RNA, 64 nt, Homo Sapiens; identical to SEQ ID NO: 158681

SEQ ID NO: 158922 - RNA, 64 nt, Homo Sapiens; identical to SEQ ID NO: 158682

SEQ ID NO: 158923 - RNA, 64 nt, Homo Sapiens; identical to SEQ ID NO: 158683

SEQ ID NO: 158924 - RNA, 64 nt, Homo Sapiens; identical to SEQ ID NO: 158684

SEQ ID NO: 158925 - RNA, 64 nt, Homo Sapiens; identical to SEQ ID NO: 158685

SEQ ID NO: 158926 - RNA, 64 nt, Homo Sapiens; identical to SEQ ID NO: 158686

SEQ ID NO: 158927 - RNA, 64 nt, Homo Sapiens; identical to SEQ ID NO: 158687

SEQ ID NO: 158928 - RNA, 64 nt, Homo Sapiens; identical to SEQ ID NO: 158688

SEQ ID NO: 158929 - RNA, 64 nt, Homo Sapiens; identical to SEQ ID NO: 158689

SEQ ID NO: 158930 - RNA, 64 nt, Homo Sapiens; identical to SEQ ID NO: 158690

SEQ ID NO: 158931 - RNA, 64 nt, Homo Sapiens; identical to SEQ ID NO: 158691

SEQ ID NO: 158932 - RNA, 64 nt, Homo Sapiens; identical to SEQ ID NO: 158692

SEQ ID NO: 158933 - RNA, 64 nt, Homo Sapiens; identical to SEQ ID NO: 158693

SEQ ID NO: 158934 - RNA, 64 nt, Homo Sapiens; identical to SEQ ID NO: 158694

SEQ ID NO: 158935 - RNA, 64 nt, Homo Sapiens; identical to SEQ ID NO: 158695

SEQ ID NO: 158936 - RNA, 64 nt, Homo Sapiens; identical to SEQ ID NO: 158696

SEQ ID NO: 158937 - RNA, 64 nt, Homo Sapiens; identical to SEQ ID NO: 158697

SEQ ID NO: 158938 - RNA, 64 nt, Homo Sapiens; identical to SEQ ID NO: 158698

SEQ ID NO: 158939 - RNA, 64 nt, Homo Sapiens; identical to SEQ ID NO: 158699

SEQ ID NO: 158940 - RNA, 64 nt, Homo Sapiens; identical to SEQ ID NO: 158700

SEQ ID NO: 158941 - RNA, 64 nt, Homo Sapiens; identical to SEQ ID NO: 158701

SEQ ID NO: 158942 - RNA, 64 nt, Homo Sapiens; identical to SEQ ID NO: 158702

SEQ ID NO: 158943 - RNA, 64 nt, Homo Sapiens; identical to SEQ ID NO: 158703

SEQ ID NO: 158944 - RNA, 64 nt, Homo Sapiens; identical to SEQ ID NO: 158704

SEQ ID NO: 158945 - RNA, 64 nt, Homo Sapiens; identical to SEQ ID NO: 158705

SEQ ID NO: 158946 - RNA, 64 nt, Homo Sapiens; identical to SEQ ID NO: 158706

SEQ ID NO: 158947 - RNA, 64 nt, Homo Sapiens; identical to SEQ ID NO: 158707

SEQ ID NO: 158948 - RNA, 64 nt, Homo Sapiens; identical to SEQ ID NO: 158708

SEQ ID NO: 158949 - RNA, 64 nt, Homo Sapiens; identical to SEQ ID NO: 158709

SEQ ID NO: 158950 - RNA, 64 nt, Homo Sapiens; identical to SEQ ID NO: 158710

SEQ ID NO: 158951 - RNA, 64 nt, Homo Sapiens; identical to SEQ ID NO: 158711

SEQ ID NO: 158952 - RNA, 64 nt, Homo Sapiens; identical to SEQ ID NO: 158712

SEQ ID NO: 158953 - RNA, 64 nt, Homo Sapiens; identical to SEQ ID NO: 158713

SEQ ID NO: 158954 - RNA, 64 nt, Homo Sapiens; identical to SEQ ID NO: 158714

SEQ ID NO: 158955 - RNA, 64 nt, Homo Sapiens; identical to SEQ ID NO: 158715

SEQ ID NO: 158956 - RNA, 64 nt, Homo Sapiens; identical to SEQ ID NO: 158716

SEQ ID NO: 158957 - RNA, 64 nt, Homo Sapiens; identical to SEQ ID NO: 158717

SEQ ID NO: 158958 - RNA, 64 nt, Homo Sapiens; identical to SEQ ID NO: 158718

SEQ ID NO: 158959 - RNA, 64 nt, Homo Sapiens; identical to SEQ ID NO: 158719

SEQ ID NO: 158960 - RNA, 64 nt, Homo Sapiens; identical to SEQ ID NO: 158720

SEQ ID NO: 158961 - RNA, 64 nt, Homo Sapiens; identical to SEQ ID NO: 158721

SEQ ID NO: 158962 - RNA, 64 nt, Homo Sapiens; identical to SEQ ID NO: 158722

SEQ ID NO: 158963 - RNA, 64 nt, Homo Sapiens; identical to SEQ ID NO: 158723

SEQ ID NO: 158964 - RNA, 64 nt, Homo Sapiens; identical to SEQ ID NO: 158724

SEQ ID NO: 158965 - RNA, 64 nt, Homo Sapiens; identical to SEQ ID NO: 158725

SEQ ID NO: 158966 - RNA, 64 nt, Homo Sapiens; identical to SEQ ID NO: 158726

SEQ ID NO: 158967 - RNA, 64 nt, Homo Sapiens; identical to SEQ ID NO: 158727

SEQ ID NO: 158968 - RNA, 64 nt, Homo Sapiens; identical to SEQ ID NO: 158728

SEQ ID NO: 158969 - RNA, 64 nt, Homo Sapiens; identical to SEQ ID NO: 158729

SEQ ID NO: 158970 - RNA, 64 nt, Homo Sapiens; identical to SEQ ID NO: 158730

SEQ ID NO: 158971 - RNA, 64 nt, Homo Sapiens
accuuuccaagugcuaggcaggagaacugaagaacucuuucagugaagugagucagccuagaag

SEQ ID NO: 158972 - RNA, 64 nt, Homo Sapiens
acuuugggccuguucuguugcuccugccuuauuucucuuucaacccuguacaugacucguguuc

SEQ ID NO: 158973 - RNA, 64 nt, Homo Sapiens
agcgccaaucucugccagggcugcugccuccagacucuuucaugggcugcuggagauccaaugc

SEQ ID NO: 158974 - RNA, 64 nt, Homo Sapiens
aaguuaguucuucuucacccugaucucuguuccucucuuucacuguaccugacuuggccaggaa

SEQ ID NO: 158975 - RNA, 64 nt, Homo Sapiens
aucuugguugaacuugcuuuugggaaugauccagcucuuucagcgugaugccacugaaaugaga

SEQ ID NO: 158976 - RNA, 64 nt, Homo Sapiens
uuuuagugugagcuaauuccaaagaggaaagcaccucuuucauucagacuccucaaggagagau

SEQ ID NO: 158977 - RNA, 64 nt, Homo Sapiens
auauuuguuguaaagagguuguuuuguuugaaaacucuuucacuaguccucgagauucuuauga

SEQ ID NO: 158978 - RNA, 64 nt, Homo Sapiens
ggggcgaguguggugagggggcuccaggccagagcucuuucauuggccuggacuucccuggggu

SEQ ID NO: 158979 - RNA, 64 nt, Homo Sapiens
uaagcccacuguuaauauucuauuaacuuuaauucucuuucaaagcuaaauuccacacuaccac

SEQ ID NO: 158980 - RNA, 64 nt, Homo Sapiens
aaugcucuggggucuuuuuaugcauuugcauuugcucuuucaucucugcuuggauuauuuuaaa

SEQ ID NO: 158981 - RNA, 64 nt, Homo Sapiens
gccugugccauaaaguuccgaaucccccaugugucucuuucagagcuggccagaccggaaauaa

SEQ ID NO: 158982 - RNA, 64 nt, Homo Sapiens
guaaaaaggaaauagugauguaaauaaacauguucucuuucaaguaugcuugucugucucuauc

SEQ ID NO: 158983 - RNA, 64 nt, Homo Sapiens
gugcuccugcuacacugacagacugauugcguggcucuuucagaagacccaggaagggcagcuc

SEQ ID NO: 158984 - RNA, 64 nt, Homo Sapiens
gguuuaaaucaaagugauucugggggaagcuaugcucuuucaguggauaauaaaauugguaacu

SEQ ID NO: 158985 - RNA, 64 nt, Homo Sapiens
cuuaguucaucauuguuuucccucacagacauuucucuuucaugccugcuugacugauaagcca

SEQ ID NO: 158986 - RNA, 64 nt, Homo Sapiens
cugcaacuaaugggagcaagauaguacacuuuaacucuuucagacaacuugcauucuguggaug

SEQ ID NO: 158987 - RNA, 64 nt, Homo Sapiens
ugagaaugauaauaaucauuauaugcagaccuuccucuuucaucuuacagaggcuuagugaggc

SEQ ID NO: 158988 - RNA, 64 nt, Homo Sapiens
uaucuauugacucuuucucucucucuuucugucucucuuucaccuugcaccucucccuaaugcu

SEQ ID NO: 158989 - RNA, 64 nt, Homo Sapiens
uugcaguauggauaucuuucacccucccaggaaacucuuucaaaccuaaucuguacuuuugcau

SEQ ID NO: 158990 - RNA, 64 nt, Homo Sapiens
uggguuuccacauuuuuauuccguagauguuaaucucuuucaugugcaaucuuugcuucuugua

SEQ ID NO: 158991 - RNA, 64 nt, Homo Sapiens
cauaaguucuaaauuagagacacauauaguuucucucuuucagcaccagcucuugccccuaugc

SEQ ID NO: 158992 - RNA, 64 nt, Homo Sapiens
uggaugugaagauaugguaccuucucaaguguagcucuuucaaauauagucaaugcugggaaau

SEQ ID NO: 158993 - RNA, 64 nt, Homo Sapiens
ugugcuuuauuagacucuggacuaaaacaaauggcucuuucacagaacauaagauguauuucug

SEQ ID NO: 158994 - RNA, 64 nt, Homo Sapiens
gacugcagugugaauauuggcuuuggcccccuuacucuuucauuccuucuucagaagcucacug

SEQ ID NO: 158995 - RNA, 64 nt, Homo Sapiens
ucuaaauauuuugcuuucuauucuuuuuuccccccucuuucacuuuauauuacauuguagauca

SEQ ID NO: 158996 - RNA, 64 nt, Homo Sapiens
agguuaacaauuaagcauacaauaauuuuuuugccucuuucaaagauuauuuuagguuuucgua

SEQ ID NO: 158997 - RNA, 64 nt, Homo Sapiens
ucggcaguuuaaagacacaauuuacucaucaagucucuuucauuaauguuaacaacuaucacau

SEQ ID NO: 158998 - RNA, 64 nt, Homo Sapiens
cuguaacccauuuuaaaaugcugccuguucccaacucuuucacuugacccaggcccaaaggggg

SEQ ID NO: 158999 - RNA, 64 nt, Homo Sapiens
aggaauaauucaaaagacuucccuaauaucugcucucuuucaaagguagacacugauuuuuccc

SEQ ID NO: 159000 - RNA, 64 nt, Homo Sapiens
cccuucucucccuaucucuccccaaccucucucucucuuucaucucaaucucucucugucuccu

SEQ ID NO: 159001 - RNA, 64 nt, Homo Sapiens
acucgcccucgcuccaucuaccugcccccgcugccucuuucaggaaggagccccuuaggaggac

SEQ ID NO: 159002 - RNA, 64 nt, Homo Sapiens
uggcaacaacuuauaccgucugacaguucaaaaucucuuucagcugcgcucuucccaccgagcc

SEQ ID NO: 159003 - RNA, 64 nt, Homo Sapiens
aaaccccuuccccaguuuuucuucuuucuuuguucucuuucauugauagggccucccuuccccu

SEQ ID NO: 159004 - RNA, 64 nt, Homo Sapiens
ugacuuuuggaaaucaaccuggggccauucuaggcucuuucaagaaucucugugguauauaccu

SEQ ID NO: 159005 - RNA, 64 nt, Homo Sapiens
uguuaaugcuguccagauuuaacagaauucagugcucuuucauuuuacuguaaaucuuuaaaau

SEQ ID NO: 159006 - RNA, 64 nt, Homo Sapiens
guaucucagcggguacuccauaauuuuuaauaugcucuuucaguuuaagaaguuuaauuuuuug

SEQ ID NO: 159007 - RNA, 64 nt, Homo Sapiens
ccccccccgccacccucucggacaguuauucauucucuuucaaucucucucucuccaucucucu

SEQ ID NO: 159008 - RNA, 64 nt, Homo Sapiens
uucauucucuuucaaucucucucucuccaucucucucuuucagucucucucucucaaccucuuu

SEQ ID NO: 159009 - RNA, 64 nt, Homo Sapiens
ugaauuuagggugauuuuaaauuuacuagagaauguucccaauuccacgaagaaugcuguucug

SEQ ID NO: 159010 - RNA, 64 nt, Homo Sapiens
ugucugucccacccugauccgaagagguuuugugguucccaaugguguuuauuuuuaacucuug

SEQ ID NO: 159011 - RNA, 64 nt, Homo Sapiens
gaggaggggcacggggccuccgagcuccagcuccguucccaaggauacucgugaagaccccauc

SEQ ID NO: 159012 - RNA, 64 nt, Homo Sapiens
ugguuuguuaaaagaaaacacugucaugcugucaguucccaauugacaagucacagacugggag

SEQ ID NO: 159013 - RNA, 64 nt, Homo Sapiens
ucaguuauucauguuuucauuuucuacaauuacaguucccaaaguuguuuuuggaaaaacaaaa

SEQ ID NO: 159014 - RNA, 64 nt, Homo Sapiens
acacaguuguucauguuauuuuucuacaauuacaguucccaaaguuguucuuggauaaagaaaa

SEQ ID NO: 159015 - RNA, 64 nt, Homo Sapiens
agucccucaagcaaucaguaguaucuaugcauaaguaucagagacuccaacaugcugaaaaaga

SEQ ID NO: 159016 - RNA, 64 nt, Homo Sapiens
augcuuagggaacaauggauuuacacacauuuagguaucagaaguaauuauuuuaaauaugcau

SEQ ID NO: 159017 - RNA, 64 nt, Homo Sapiens
agaaagcagccauguaagaguguuaaaagucaguguaucagaaaagucuaaucuuggugccuuc

SEQ ID NO: 159018 - RNA, 64 nt, Homo Sapiens
uauuuucaggauggugcgucuauguuagugguauguaucagacaaaaugccauacuuuguuaua

SEQ ID NO: 159019 - RNA, 64 nt, Homo Sapiens
gauuacugcgguguuaagguaaagguggaauugaguaucagaggcuuauaacacuauuuccagu

SEQ ID NO: 159020 - RNA, 64 nt, Homo Sapiens
gcaagcucagugcccgggauaggucaaggcacuaguaucagauggcaagccaagugguucugca

SEQ ID NO: 159021 - RNA, 64 nt, Homo Sapiens
gucguaaguggaguccuggaauuuggacaagugcuguugggauauagucaacuuauucuuugag

SEQ ID NO: 159022 - RNA, 64 nt, Homo Sapiens
uuuuuauuaaagcauuuccuaccagcaaagcaaauguugggaaaguauuuacuuuuucgguuuc

SEQ ID NO: 159023 - RNA, 64 nt, Homo Sapiens
agcugaggccgagcuugcauggagaaaagcugaguguugggagacccaccuguaucucuuguug

SEQ ID NO: 159024 - RNA, 64 nt, Homo Sapiens
aaagcugaguguugggagaaccaccuguaucucuuguugggagacuugucuaccugucuccuac

SEQ ID NO: 159025 - RNA, 64 nt, Homo Sapiens
guggcuucucuuuggcucccaaagagaaggacaguguugggaguaucugccguggcuucucuuu

SEQ ID NO: 159026 - RNA, 64 nt, Homo Sapiens
guggcuucucuuuggcucccaaagagaaggacaguguugggaguaucugccggcgcuguccagg

SEQ ID NO: 159027 - RNA, 64 nt, Homo Sapiens
uccccagcacagccuccugucgcugcaugcgacguguugggauuuuuggaugaaagacucuccc

SEQ ID NO: 159028 - RNA, 64 nt, Homo Sapiens
gaccucgugaucugcccgccuuggccuaucaaaguguugggauuacaggcuugagccaccgcac

SEQ ID NO: 159029 - RNA, 64 nt, Homo Sapiens
uaaaauaacaccugcuuguucuucaucccugggcuguugggaggaacagaugagacaguggcua

SEQ ID NO: 159030 - RNA, 64 nt, Homo Sapiens
gaccucgugauccgcccgccucagccuuccaaaguguugggauuauaggcgugagccaccgcgc

SEQ ID NO: 159031 - RNA, 64 nt, Homo Sapiens
acucaagggauccuccugucuugggcucccaaaguguugggauuacaggcgugagugaccaugc

SEQ ID NO: 159032 - RNA, 64 nt, Homo Sapiens
cuauuuccuuugcgcaaacuaacaaacacugugauguugggaagagaauagucucuggguuuac

SEQ ID NO: 159033 - RNA, 64 nt, Homo Sapiens
cgggcauuuugaaugugaucagauccuccauuuuuguugggaugcagaggaggagaaaagugac

SEQ ID NO: 159034 - RNA, 64 nt, Homo Sapiens
ccugcccauccgaguucugagauugggacugugauguugggaccugaggacuggaugguagaau

SEQ ID NO: 159035 - RNA, 64 nt, Homo Sapiens
gagccccuuggugguucuguccuccaaaugcugcuguugggagcgggcuuccagcucucagugg

SEQ ID NO: 159036 - RNA, 64 nt, Homo Sapiens
augggggaaggcagagacuucagacuucucaguguguugggaaaaccaaaaaccacaacuacag

SEQ ID NO: 159037 - RNA, 64 nt, Homo Sapiens
cucagucucacugguugugauuuggucacuuuaguguugggacaggggaaagggucugugcgug

SEQ ID NO: 159038 - RNA, 64 nt, Homo Sapiens
gccuucugaacaguugccuucauugcucaaaagcuguugggaacagguuuuaugggaggcugug

SEQ ID NO: 159039 - RNA, 64 nt, Homo Sapiens
uuuuuuagcaccugaagcaccaccugcuuguuuguguugggauaucccccaccugucagcuagc

SEQ ID NO: 159040 - RNA, 64 nt, Homo Sapiens
ggcucugacaucucuuagaugucccaacuucagcuguugggagauggugauauuuucaacccua

SEQ ID NO: 159041 - RNA, 64 nt, Homo Sapiens
uuggauagcaguugaagagguugugugggugggcuguugggagugaggauggaguguucagugc

SEQ ID NO: 159042 - RNA, 64 nt, Homo Sapiens
uucaagauguuuaauguguuuaaagcugggaaccuguugggaguucacaagugcugcauauacu

SEQ ID NO: 159043 - RNA, 64 nt, Homo Sapiens
cuggggggaaaaaguugaaacuacuggugaccacuguugggagaggaaacaucuguuuuauaga

SEQ ID NO: 159044 - RNA, 64 nt, Homo Sapiens
ccuuaggugauccgcccgccucagccucccaaaguguugggauuacaggcaugagccacugcgc

SEQ ID NO: 159045 - RNA, 64 nt, Homo Sapiens
ccucaggugauccaccugccucagccucccagacuguugggauuacaggcaugagccaccacgc

SEQ ID NO: 159046 - RNA, 64 nt, Homo Sapiens
ggaaauaacccugugaugauguguuaauauaaaauguugggagggaauauucccaauaaagguc

SEQ ID NO: 159047 - RNA, 64 nt, Homo Sapiens
uaaaaugaagucucuuauuucaauuaccuaguguuguugggaacuaauugaacagcuacaguaa

SEQ ID NO: 159048 - RNA, 64 nt, Homo Sapiens
cagagcaaugaauuuuugaaacuuggaacaaagcuguugggacccacauacuguuaagauguag

SEQ ID NO: 159049 - RNA, 64 nt, Homo Sapiens
aaagugaugugacagggaguauggauaaugaaaguguugggaaauuggaauagcagagcaaaau

SEQ ID NO: 159050 - RNA, 64 nt, Homo Sapiens; identical to SEQ ID NO: 101929

SEQ ID NO: 159051 - RNA, 64 nt, Homo Sapiens; identical to SEQ ID NO: 101930

SEQ ID NO: 159052 - RNA, 64 nt, Homo Sapiens; identical to SEQ ID NO: 101931

SEQ ID NO: 159053 - RNA, 64 nt, Homo Sapiens; identical to SEQ ID NO: 101932

SEQ ID NO: 159054 - RNA, 64 nt, Homo Sapiens; identical to SEQ ID NO: 101933

SEQ ID NO: 159055 - RNA, 64 nt, Homo Sapiens; identical to SEQ ID NO: 101934

SEQ ID NO: 159056 - RNA, 64 nt, Homo Sapiens; identical to SEQ ID NO: 101935

SEQ ID NO: 159057 - RNA, 64 nt, Homo Sapiens; identical to SEQ ID NO: 101936

SEQ ID NO: 159058 - RNA, 64 nt, Homo Sapiens; identical to SEQ ID NO: 101937

SEQ ID NO: 159059 - RNA, 64 nt, Homo Sapiens; identical to SEQ ID NO: 101938

SEQ ID NO: 159060 - RNA, 64 nt, Homo Sapiens; identical to SEQ ID NO: 101939

SEQ ID NO: 159061 - RNA, 64 nt, Homo Sapiens; identical to SEQ ID NO: 101940

SEQ ID NO: 159062 - RNA, 64 nt, Homo Sapiens; identical to SEQ ID NO: 101941

SEQ ID NO: 159063 - RNA, 64 nt, Homo Sapiens; identical to SEQ ID NO: 101942

SEQ ID NO: 159064 - RNA, 64 nt, Homo Sapiens; identical to SEQ ID NO: 101943

SEQ ID NO: 159065 - RNA, 64 nt, Homo Sapiens; identical to SEQ ID NO: 101944

SEQ ID NO: 159066 - RNA, 64 nt, Homo Sapiens; identical to SEQ ID NO: 101945

SEQ ID NO: 159067 - RNA, 64 nt, Homo Sapiens; identical to SEQ ID NO: 101946

SEQ ID NO: 159068 - RNA, 64 nt, Homo Sapiens; identical to SEQ ID NO: 101947

SEQ ID NO: 159069 - RNA, 64 nt, Homo Sapiens
gagccguaggaagacaaaacuucccuuuuguuuuacuccucacuccucuauuuuuguuuuacuc

SEQ ID NO: 159070 - RNA, 64 nt, Homo Sapiens
uuuuuguuuuacucacuucuuuauauuuuguuuuacuccucacuccuguauauuuugguuuacu

SEQ ID NO: 159071 - RNA, 64 nt, Homo Sapiens
ccuggggcgucgccgccugcuaaagaucugagggacuccucaguugcacgcggcaguucuuugu

SEQ ID NO: 159072 - RNA, 64 nt, Homo Sapiens
cagccacgcagcgggugugguucggacagcgggaacuccucaggcugcauucuggcugcccagc

SEQ ID NO: 159073 - RNA, 64 nt, Homo Sapiens
ucaccauuuggucaaauugguucaaucccaccccacuccucauccgccgcugccccggagacuu

SEQ ID NO: 159074 - RNA, 56 nt, Homo Sapiens
cacacaccuuucuuuacccaacccacacuccucaucgaggcugcuacgugauguga

SEQ ID NO: 159075 - RNA, 64 nt, Homo Sapiens
cagaccccuuccagggguuuacagucuauuugagacuccucaguucuugccacuuuuuuuuuua

SEQ ID NO: 159076 - RNA, 64 nt, Homo Sapiens
uuuaaucuccaccagucauuuuucagaccuuuuaacuccucaauuccaacacugauuuccccuu

SEQ ID NO: 159077 - RNA, 64 nt, Homo Sapiens
ugcaauguuuaauuguuaaaaauaguagccacgacuuuaucaggcagccccaaacuggugcaua

SEQ ID NO: 159078 - RNA, 64 nt, Homo Sapiens
agaauuauuuuucucuguagaaacacagauaccacuuuaucagggaaguuagucaaaugaaaug

SEQ ID NO: 159079 - RNA, 64 nt, Homo Sapiens
uauagccccaucuugauagaagaguuacuccgagcuuuaucauggaccagaggaaaaccagaaa

SEQ ID NO: 159080 - RNA, 64 nt, Homo Sapiens
guguuugcucuucagauuccuaaguagcacaagacuuuaucagaaucuauaggcauaccaaccu

SEQ ID NO: 159081 - RNA, 64 nt, Homo Sapiens
uuuauuuguucuuucaucugugacugcuugcugacuuuaucauaauuuucuucaaacaaaaaaa

SEQ ID NO: 159082 - RNA, 64 nt, Homo Sapiens
cugguuguuauucuuagguuauucccacacuugacuuuaucauuguuuacuacuaguaaaaagc

SEQ ID NO: 159083 - RNA, 64 nt, Homo Sapiens
cugaaagcacucagacauguugcuuaaggaaggccuuuaucaugguucuucgggaccuaaauuu

SEQ ID NO: 159084 - RNA, 64 nt, Homo Sapiens
gcacuuuucaucuugguaauaaaccagagcguugcuuuaucaucgcacugagcuugucuucagg

SEQ ID NO: 159085 - RNA, 64 nt, Homo Sapiens
auuuuaaaaauguuaaugcaaauuuuuaaaaacacuuuaucagucugagccagccagcauuagu

SEQ ID NO: 159086 - RNA, 64 nt, Homo Sapiens
cagacuggcgugcaguggcagagacugagucucacuuuaucaccuaguuuguuuguuuguuuuu

SEQ ID NO: 159087 - RNA, 64 nt, Homo Sapiens
ucacauuauucugggcaccacaaaauauacaaaacuuuaucagggaaacuaagauucuuuuaaa

SEQ ID NO: 159088 - RNA, 64 nt, Homo Sapiens
uauauaugcacuuaauuuguuggggcuuuacauacuuuaucaaugugucuuucuaagaaaucaa

SEQ ID NO: 159089 - RNA, 64 nt, Homo Sapiens
cucauucaauauagauaugagccaugguggagaacuuuaucacucaaguagacgguaaacaucc

SEQ ID NO: 159090 - RNA, 64 nt, Homo Sapiens
gcuugacauagguuauuguuugaaaauauuguuacuuuaucaauaguaaucaugcauucuugug

SEQ ID NO: 159091 - RNA, 64 nt, Homo Sapiens
aagcauucauggccauucagaauauauccacauucuuuaucagcuuaccugggauccaguauca

SEQ ID NO: 159092 - RNA, 64 nt, Homo Sapiens
ugaauuauuaacuuaauuugaucaauuucagugccuuuaucacuaugacuuuucaauagcucaa

SEQ ID NO: 159093 - RNA, 64 nt, Homo Sapiens
cugcugauuugcugcccugucuucucuuacuuuacuuuaucaauaccuggcaaacugaccagaa

SEQ ID NO: 159094 - RNA, 64 nt, Homo Sapiens
gacuuugaaugaauagacugcugugcugaaagagcuuuaucacacugucucaaaguauguaaag

SEQ ID NO: 159095 - RNA, 64 nt, Homo Sapiens
gaaagguaaaaucucaaauacuaauguacuguaacuuuaucaguuguaaccuauuaucauggau

SEQ ID NO: 159096 - RNA, 64 nt, Homo Sapiens
caguccuuuuauagcuuucuguuuaaaauccauucuuuaucaaugcuuagcacguuuaccauac

SEQ ID NO: 159097 - RNA, 64 nt, Homo Sapiens
ugggccuggcacccgcucuccgucaguauagaggccuuugcaucuuugcagugucaugugaggg

SEQ ID NO: 159098 - RNA, 64 nt, Homo Sapiens
gucaugugagggcgucaguaccuuugacauuugaccuuugcaguuccuaagccaagacauuuga

SEQ ID NO: 159099 - RNA, 64 nt, Homo Sapiens
agcucaugggccugcaaagguucagacgguuucuccuuugcacccaggaggaacuuuggcugcg

SEQ ID NO: 159100 - RNA, 64 nt, Homo Sapiens
uggagaaaaauaauuacacuuucaaagagaauucccuuugcaauuuuauguuuggaucaccacu

SEQ ID NO: 159101 - RNA, 64 nt, Homo Sapiens
cagcuagccaccaggccugaggggggcccacugcccuuugcagcuguuuguucccaaagguugg

SEQ ID NO: 159102 - RNA, 64 nt, Homo Sapiens
ucuacagagagccaugccccugaaacaucacaugccuuugcacaggccaccccccucuucaggc

SEQ ID NO: 159103 - RNA, 64 nt, Homo Sapiens
cccugauugaggguggguggguggacccaggcucccuuugcacacagagcagcuacuucuaagc

SEQ ID NO: 159104 - RNA, 64 nt, Homo Sapiens
uggggcagugaacagaauaacaacagcaacaaugccuuugcaggcagccugcuccccugagcgc

SEQ ID NO: 159105 - RNA, 64 nt, Homo Sapiens
uaaucaaagcacauuuguuuggucuuccuccaacccuuugcauuugauuucuaaacauuccuuc

SEQ ID NO: 159106 - RNA, 64 nt, Homo Sapiens
auguggaauuguacauuuaaagcuuggucggugaccuuugcauaccaucaacgagcacagcuaa

SEQ ID NO: 159107 - RNA, 64 nt, Homo Sapiens
gacauggauggagcuggagggaacaagaucaugcccuuugcaggauuguucagccauaaagaaa

SEQ ID NO: 159108 - RNA, 64 nt, Homo Sapiens
uaaaccuuucuucuuucccauuacuuccucgcucccuuugcauccucaugucuccuuccacagu

SEQ ID NO: 159109 - RNA, 64 nt, Homo Sapiens
aacuagauugugaaaagcuacauuuauccauaugccuuugcaauuuuuugacuuuguccauuaa

SEQ ID NO: 159110 - RNA, 64 nt, Homo Sapiens
uugcacacaguuuuguuuauagaaaaugauuuucccuuugcaggcuuuccaugaaacgaaguug

SEQ ID NO: 159111 - RNA, 64 nt, Homo Sapiens
gugcuucaccaccugcauccucuugcucagaaugccuuugcaguugaguuuucuggguuucuau

SEQ ID NO: 159112 - RNA, 64 nt, Homo Sapiens
uuggacuggguaauucuuuguucugcagagcuguccuuugcacuguaggagauuuacuaauauc

SEQ ID NO: 159113 - RNA, 64 nt, Homo Sapiens
caaacaaacguuuuuccaaagaauucacagugcuccuuugcaauuuauagauuucauguugaaa

SEQ ID NO: 159114 - RNA, 64 nt, Homo Sapiens
auggacuaaauuuugucaauuucauguaauuuacccuuugcaauaaaaaugauucauuaaauau

SEQ ID NO: 159115 - RNA, 64 nt, Homo Sapiens
ccccugucguuccuccggcaccuccucggaugucccuuugcagguugcucccagcuugcuuccc

SEQ ID NO: 159116 - RNA, 64 nt, Homo Sapiens
gauaauugugggucaggaauaccuacaaaauacuccuuugcaauuuuugggcuccagaggacuu

SEQ ID NO: 159117 - RNA, 64 nt, Homo Sapiens
ggauagguuccagugauagaguuauaauuuugcuccuuugcaaacaaaugguaucuaauuaaua

SEQ ID NO: 159118 - RNA, 64 nt, Homo Sapiens
guguaaucauucugaggugaggcuuuucuuauuuccuuugcauuuugcuagagcugugcugagu

SEQ ID NO: 159119 - RNA, 64 nt, Homo Sapiens
guuuuuauuguuaauguagcuugaguauuacuucccuuugcaauuccaaaaugaugauauucuc

SEQ ID NO: 159120 - RNA, 64 nt, Homo Sapiens
aaaagugugcugccuuagucauucacucucuggcccuuugcagaaugguccacaagccuaacuu

SEQ ID NO: 159121 - RNA, 64 nt, Homo Sapiens
auauuuuaauuacaaacacugucuccaacaaagaccuuugcaauuuauagcuuagauauaaaag

SEQ ID NO: 159122 - RNA, 64 nt, Homo Sapiens
cgcgauggcagccacuagauggcacucaggcagcccuuugcaaucccauuaccugcaaagaaag

SEQ ID NO: 159123 - RNA, 64 nt, Homo Sapiens
cccacaacguccccucaagccccuucucucaaucccuuugcaacgcucacugguuuuggccacc

SEQ ID NO: 159124 - RNA, 64 nt, Homo Sapiens
cccgaccccauccaccuauccaccaccccacccaccuuugcagggaauaccucguuagagaaug

SEQ ID NO: 159125 - RNA, 64 nt, Homo Sapiens
ucuguuugccuucugcauucugcacucugcggggccuuugcagccagacugcugugucaauguu

SEQ ID NO: 159126 - RNA, 64 nt, Homo Sapiens
ugagcucuauccaccaagccagcaccccaccaucccuuugcaggggagucaaagggccagaacu

SEQ ID NO: 159127 - RNA, 64 nt, Homo Sapiens
aaguccccucuguaguugguuuccuuccugugucccuuugcaagcuuccaggcgaucuaaggug

SEQ ID NO: 159128 - RNA, 64 nt, Homo Sapiens
gaugugugacuguuuggcacuugagacaaaccugccuuugcagggaaagugucucucacgggca

SEQ ID NO: 159129 - RNA, 64 nt, Homo Sapiens
uccacacgguuagccgugcaugcacuuuguggccccuuugcaaggggcagaggguacuggaagu

SEQ ID NO: 159130 - RNA, 64 nt, Homo Sapiens
ggccaggaccaaccuucaauuccauuccaaucagccuuugcauuuguuggaucucguggcuucu

SEQ ID NO: 159131 - RNA, 64 nt, Homo Sapiens
ucugccauuuucuacagcuugcugaguugucauuccuuugcaacauuaaaauacaugcugaacu

SEQ ID NO: 159132 - RNA, 63 nt, Homo Sapiens
acauauuucaugaauggcauugaugcuaauaaauccuuugcacaaaaauuugaauaaacuucc

SEQ ID NO: 159133 - RNA, 64 nt, Homo Sapiens
ccugggcugaggccugcagugacccacccaccuaccuuugcaucaccuaccuuugcaccaacua

SEQ ID NO: 159134 - RNA, 64 nt, Homo Sapiens
gcagugacccacccaccuaccuuugcaucaccuaccuuugcaccaacuaccuuuucagauuucc

SEQ ID NO: 159135 - RNA, 64 nt, Homo Sapiens
agucaucugucuuaccccccugggacagcuguuaccuuugcaguguugccgaaucacagcaguu

SEQ ID NO: 159136 - RNA, 64 nt, Homo Sapiens
uuaccuuugcaguguugccgaaucacagcaguuaccuuugcaguguugccgaaucacagcaguu

SEQ ID NO: 159137 - RNA, 64 nt, Homo Sapiens
gcaaaggacuuaaaauuaccaaaugcuucuaaauaugaaggagagguuggggacacgcacccua

SEQ ID NO: 159138 - RNA, 64 nt, Homo Sapiens
caacuugagaagacauuuauaauacaaauaacugaugaaggauucauaaucacaaauauagaga

SEQ ID NO: 159139 - RNA, 64 nt, Homo Sapiens
aaauuucuaacaaucaucaguuaggaauauuaacaugaaggauaaaccaacuuauuuguauacc

SEQ ID NO: 159140 - RNA, 64 nt, Homo Sapiens
auuuuauuggucaugagaacaaauggaugugaucaugaaggaaucagauucccuauguaaagca

SEQ ID NO: 159141 - RNA, 64 nt, Homo Sapiens
uugggauuuucaauggaauagagggaggguugccaugaaggaacccugcuggggugugagggca

SEQ ID NO: 159142 - RNA, 64 nt, Homo Sapiens
uaaauaaacuaagauauuccccugcaaauggccaaugaaggaggucauuuuucaaggagaagag

SEQ ID NO: 159143 - RNA, 64 nt, Homo Sapiens
aauaguucuggccagaccccguuccccuuccucuaugaaggaauaaguuggaccaagggaaguc

SEQ ID NO: 159144 - RNA, 64 nt, Homo Sapiens
ugcaugacaacucguguguaugagaaggagggauaugaaggaagauggcuugcagaguaagucg

SEQ ID NO: 159145 - RNA, 64 nt, Homo Sapiens
guaauuagauuauguauagggguaacuggaagccaugaaggaaggacuuaaccaggcuaccaag

SEQ ID NO: 159146 - RNA, 64 nt, Homo Sapiens
aaaaaguugacucuacccccuaauuugguaggagaugaaggagaaaaggauggcauugaauuau

SEQ ID NO: 159147 - RNA, 64 nt, Homo Sapiens
uacaggugugugugcacaugcugcauaugccuguaugaaggagagaccccgauuggugagggcu

SEQ ID NO: 159148 - RNA, 64 nt, Homo Sapiens
aagucugcccuuugccauacaggcagcagaguggaugaaggaguccaguguguucaccucauca

SEQ ID NO: 159149 - RNA, 64 nt, Homo Sapiens
auugacucaagggugccugggguagcucuggacaaugaaggacaugugcucugaaaugccacuu

SEQ ID NO: 159150 - RNA, 64 nt, Homo Sapiens
uacagccucaguagucugcccaguguccacauuaaugaaggauccauguuuguagugagagaaa

SEQ ID NO: 159151 - RNA, 64 nt, Homo Sapiens
auagaaaguuugcugaaagcaaagggcuaagcuuaugaaggaaugccuccuuuguuacacacuc

SEQ ID NO: 159152 - RNA, 64 nt, Homo Sapiens
ggccauugucauccauuucccaguuagggcaacaaugaaggaggacccagccaagcuagaagga

SEQ ID NO: 159153 - RNA, 64 nt, Homo Sapiens
aaagcccugggccacugccauuggguuagucaagaugaaggaggaggacuggcugccuccauuu

SEQ ID NO: 159154 - RNA, 64 nt, Homo Sapiens
uuucuacaguugauauauuuguaacugguacaagaugaaggacagcagcuuuccaucccuaguu

SEQ ID NO: 159155 - RNA, 64 nt, Homo Sapiens
guucaggggcaguggggggcuccaggcacggucaaugaaggaaacagugccuguccacccaccc

SEQ ID NO: 159156 - RNA, 64 nt, Homo Sapiens
uagguuggaggacaccgacuaauuugggaaacggaugaaggacugagaaggcccccgcucccuc

SEQ ID NO: 159157 - RNA, 64 nt, Homo Sapiens
cagcuggagaaaagaagacaagaaagucuugggcaugaaggagcuuuuugcaucuagugggugg

SEQ ID NO: 159158 - RNA, 64 nt, Homo Sapiens
ugguugggaaaugucccucaaaauccugggcacuaugaaggaacccccugcccccucaccuuuu

SEQ ID NO: 159159 - RNA, 64 nt, Homo Sapiens
aaauuauuucccccaagguagugaaguaauuggaaugaaggaggcugaaaguauugucuaaagu

SEQ ID NO: 159160 - RNA, 64 nt, Homo Sapiens
aaaaaggauacagaauuguaucaguauacauaacaugaaggaauuuauaauuauggacacugca

SEQ ID NO: 159161 - RNA, 64 nt, Homo Sapiens
cucuaaacuccccuuaugguucagauaauuaacaaugaaggaaauauuuagcccuuacucaaaa

SEQ ID NO: 159162 - RNA, 64 nt, Homo Sapiens
agaauagggaaaagcuuucauuagaagaaaccccaugaaggaaaauuuacuagaaaauaucauc

SEQ ID NO: 159163 - RNA, 64 nt, Homo Sapiens
cauguuugagccaaggucuuugcugaguagggcuucugcagagcuuccagccacuuuaagccag

SEQ ID NO: 159164 - RNA, 64 nt, Homo Sapiens
ccucccagccgcagcaccaauggacccagugcccucugcagaccaguucugccuggagggggac

SEQ ID NO: 159165 - RNA, 64 nt, Homo Sapiens
augaaaacugguuggaaacuaaagaaagcccgggucugcagagauuugaaagcaguuuuuauaa

SEQ ID NO: 159166 - RNA, 64 nt, Homo Sapiens
ggaaacccaugccuauuagauuuucuuaguucauucugcagaauaagcaucagcaauguuucuc

SEQ ID NO: 159167 - RNA, 64 nt, Homo Sapiens
augaaugucgugcacuggcaaugcuauuuuagagucugcagagaagagaaagcauguugcuuaa

SEQ ID NO: 159168 - RNA, 64 nt, Homo Sapiens
ugguauaauauauauacuucuccauacacagaccucugcagaaugcaaaauaaaacuugcagug

SEQ ID NO: 159169 - RNA, 64 nt, Homo Sapiens
ucugcaggugcccagcaggagggcauagguggccucugcagaggggaccucagccugucacugg

SEQ ID NO: 159170 - RNA, 64 nt, Homo Sapiens
uggcccugaauccuccucugcuccagggcuggccucugcagagcugauuaaacaguguugugac

SEQ ID NO: 159171 - RNA, 64 nt, Homo Sapiens
uauauguacaaaggcaaacagacacauaacagucucugcagacugauuguauauaguaagaaaa

SEQ ID NO: 159172 - RNA, 64 nt, Homo Sapiens
uucuguuuucauuaacaguacuaaguggaagggaucugcagauuccaaacuggaauaagcucua

SEQ ID NO: 159173 - RNA, 64 nt, Homo Sapiens
uuggccagaauuacaucaugauucccaaugagauucugcagacucuacuugaccuuuucuuccc

SEQ ID NO: 159174 - RNA, 64 nt, Homo Sapiens
gaacugcuuuuagugucucaccagugguuuuacaucugcagaguuuugagggcugugcugaccu

SEQ ID NO: 159175 - RNA, 64 nt, Homo Sapiens
agccuccugcccucucugggucucaguugccccaucugcagagcgaggaggcccgggcugguug

SEQ ID NO: 159176 - RNA, 64 nt, Homo Sapiens
gaugcucugaugcagagggcacgcccauagucccucugcagagccucgcacuggggccagggca

SEQ ID NO: 159177 - RNA, 64 nt, Homo Sapiens
uguucugguucccaaagucauugauauucagacaucugcagaaaugccuuuuagagauagguuc

SEQ ID NO: 159178 - RNA, 64 nt, Homo Sapiens
auuacugagcuguuguuaccuuuuuuuccaugaaucugcagaaaaaagggauaucuuuuuuaua

SEQ ID NO: 159179 - RNA, 64 nt, Homo Sapiens
cgggaaaggugaaccugaacaacccaagucucucucugcagagcccuguuucuaauugugguag

SEQ ID NO: 159180 - RNA, 64 nt, Homo Sapiens
caccauugacauuuuggacuggguaauucuuuguucugcagagcuguccuuugcacuguaggag

SEQ ID NO: 159181 - RNA, 64 nt, Homo Sapiens
ccugccuccccacuuugguuauugccucauguaaucugcagauuaugcuacucugcuguucaca

SEQ ID NO: 159182 - RNA, 64 nt, Homo Sapiens
ucuccaauauggaguacauggguuccccucaccuucugcagaagucugcugagaaccuuccagu

SEQ ID NO: 159183 - RNA, 64 nt, Homo Sapiens
uaaccaucccaccagagcaaaaauaaaaugccauucugcagaauugaaguccaugcugucuguu

SEQ ID NO: 159184 - RNA, 64 nt, Homo Sapiens
aagcacuuaugggaacagucuagagaaagcaucuucugcagagguagagauacuaacagagggc

SEQ ID NO: 159185 - RNA, 64 nt, Homo Sapiens
uaacguguuuucugucauaguuuauaggcagucuucugcagacuuuauucccucucaacaaaac

SEQ ID NO: 159186 - RNA, 64 nt, Homo Sapiens
aagauuuucucauuagaacagaaaaugaucccuaucugcagaucuacuaguccaucauagccua

SEQ ID NO: 159187 - RNA, 64 nt, Homo Sapiens
cagggcuaccugggugguugcugaagagagagucucugcagagaaucaggacccaacccagcca

SEQ ID NO: 159188 - RNA, 64 nt, Homo Sapiens
ugccugugagauauuugcuuacccagaggcaagaucugcagagaguccugguugugauugcugg

SEQ ID NO: 159189 - RNA, 64 nt, Homo Sapiens
ggaugacucagcaccgccccucaacaggcaugacucugcagagaugacucagcacugucccuua

SEQ ID NO: 159190 - RNA, 64 nt, Homo Sapiens
ggaugacucagcaccgccccucaacaggcaugacucugcagagaugacuuaguacugccccuca

SEQ ID NO: 159191 - RNA, 64 nt, Homo Sapiens
ggaugacucagcaccgccccucaacaggcaugacucugcagagaugacucagcacugccccuca

SEQ ID NO: 159192 - RNA, 64 nt, Homo Sapiens
cucuguguguguguguguguaaccucugacuuauucugcagauggacgucaggcucuggguguc

SEQ ID NO: 159193 - RNA, 64 nt, Homo Sapiens
ggaauuugcuggaccuccucguguucagaacccuucugcagacacagcacgcugccaggcggug

SEQ ID NO: 159194 - RNA, 64 nt, Homo Sapiens
gugugagcggggcuuuagccggagaagccuuaugucugcagagacaccagaggacacacacagg

SEQ ID NO: 159195 - RNA, 64 nt, Homo Sapiens
gugugggagggcuuuagccgggggaagcccuacgucugcagagacaccaaaggacacacacagg

SEQ ID NO: 159196 - RNA, 64 nt, Homo Sapiens
cuguggguuuuggugugguuugucagaggcuaauucugcagaguuuccaaaaccagaagacauc

SEQ ID NO: 159197 - RNA, 64 nt, Homo Sapiens
ugggggccgugccacccgugggaaugcugcccgcucugcagacugcugcuagagccagcaacuc

SEQ ID NO: 159198 - RNA, 64 nt, Homo Sapiens
uuguccaugugcaaagaugugggcaagaauggccucugcagauuuuccugaacuucugcuaacu

SEQ ID NO: 159199 - RNA, 64 nt, Homo Sapiens
uuuuuuaaagaucuauuucuguuauaauuuagguucugcagaaauaugauucuuaauugaaaca

SEQ ID NO: 159200 - RNA, 64 nt, Homo Sapiens
ggccaucggcagcaugucaauuagucccagcgauucugcagagcagcuuucuggaccugugguc

SEQ ID NO: 159201 - RNA, 64 nt, Homo Sapiens
cggacaccugugcacucgcuagcgggaaugccuuucugcagagccguguaccugaggcccaggc

SEQ ID NO: 159202 - RNA, 64 nt, Homo Sapiens; identical to SEQ ID NO: 123549

SEQ ID NO: 159203 - RNA, 64 nt, Homo Sapiens; identical to SEQ ID NO: 123550

SEQ ID NO: 159204 - RNA, 64 nt, Homo Sapiens; identical to SEQ ID NO: 123551

SEQ ID NO: 159205 - RNA, 64 nt, Homo Sapiens; identical to SEQ ID NO: 123552

SEQ ID NO: 159206 - RNA, 64 nt, Homo Sapiens; identical to SEQ ID NO: 123553

SEQ ID NO: 159207 - RNA, 64 nt, Homo Sapiens; identical to SEQ ID NO: 123554

SEQ ID NO: 159208 - RNA, 64 nt, Homo Sapiens; identical to SEQ ID NO: 123555

SEQ ID NO: 159209 - RNA, 64 nt, Homo Sapiens; identical to SEQ ID NO: 123556

SEQ ID NO: 159210 - RNA, 64 nt, Homo Sapiens; identical to SEQ ID NO: 123557

SEQ ID NO: 159211 - RNA, 64 nt, Homo Sapiens; identical to SEQ ID NO: 123558

SEQ ID NO: 159212 - RNA, 64 nt, Homo Sapiens; identical to SEQ ID NO: 123559

SEQ ID NO: 159213 - RNA, 64 nt, Homo Sapiens; identical to SEQ ID NO: 123560

SEQ ID NO: 159214 - RNA, 64 nt, Homo Sapiens; identical to SEQ ID NO: 123561

SEQ ID NO: 159215 - RNA, 64 nt, Homo Sapiens; identical to SEQ ID NO: 123562

SEQ ID NO: 159216 - RNA, 64 nt, Homo Sapiens; identical to SEQ ID NO: 123563

SEQ ID NO: 159217 - RNA, 64 nt, Homo Sapiens; identical to SEQ ID NO: 123564

SEQ ID NO: 159218 - RNA, 64 nt, Homo Sapiens; identical to SEQ ID NO: 123565

SEQ ID NO: 159219 - RNA, 64 nt, Homo Sapiens; identical to SEQ ID NO: 123566

SEQ ID NO: 159220 - RNA, 64 nt, Homo Sapiens; identical to SEQ ID NO: 123567

SEQ ID NO: 159221 - RNA, 64 nt, Homo Sapiens; identical to SEQ ID NO: 123568

SEQ ID NO: 159222 - RNA, 64 nt, Homo Sapiens; identical to SEQ ID NO: 123569

SEQ ID NO: 159223 - RNA, 64 nt, Homo Sapiens; identical to SEQ ID NO: 123570

SEQ ID NO: 159224 - RNA, 64 nt, Homo Sapiens; identical to SEQ ID NO: 123571

SEQ ID NO: 159225 - RNA, 64 nt, Homo Sapiens; identical to SEQ ID NO: 123572

SEQ ID NO: 159226 - RNA, 64 nt, Homo Sapiens; identical to SEQ ID NO: 123573

SEQ ID NO: 159227 - RNA, 64 nt, Homo Sapiens; identical to SEQ ID NO: 123574

SEQ ID NO: 159228 - RNA, 64 nt, Homo Sapiens; identical to SEQ ID NO: 123575

SEQ ID NO: 159229 - RNA, 64 nt, Homo Sapiens; identical to SEQ ID NO: 123576

SEQ ID NO: 159230 - RNA, 64 nt, Homo Sapiens; identical to SEQ ID NO: 123577

SEQ ID NO: 159231 - RNA, 64 nt, Homo Sapiens; identical to SEQ ID NO: 123578

SEQ ID NO: 159232 - RNA, 64 nt, Homo Sapiens; identical to SEQ ID NO: 123579

SEQ ID NO: 159233 - RNA, 64 nt, Homo Sapiens; identical to SEQ ID NO: 123580

SEQ ID NO: 159234 - RNA, 64 nt, Homo Sapiens; identical to SEQ ID NO: 123581

SEQ ID NO: 159235 - RNA, 64 nt, Homo Sapiens; identical to SEQ ID NO: 123582

SEQ ID NO: 159236 - RNA, 64 nt, Homo Sapiens; identical to SEQ ID NO: 123583

SEQ ID NO: 159237 - RNA, 64 nt, Homo Sapiens; identical to SEQ ID NO: 123584

SEQ ID NO: 159238 - RNA, 64 nt, Homo Sapiens; identical to SEQ ID NO: 123585

SEQ ID NO: 159239 - RNA, 64 nt, Homo Sapiens; identical to SEQ ID NO: 123586

SEQ ID NO: 159240 - RNA, 64 nt, Homo Sapiens; identical to SEQ ID NO: 123587

SEQ ID NO: 159241 - RNA, 64 nt, Homo Sapiens; identical to SEQ ID NO: 123588

SEQ ID NO: 159242 - RNA, 64 nt, Homo Sapiens; identical to SEQ ID NO: 123589

SEQ ID NO: 159243 - RNA, 64 nt, Homo Sapiens; identical to SEQ ID NO: 123590

SEQ ID NO: 159244 - RNA, 64 nt, Homo Sapiens; identical to SEQ ID NO: 123591

SEQ ID NO: 159245 - RNA, 64 nt, Homo Sapiens; identical to SEQ ID NO: 123592

SEQ ID NO: 159246 - RNA, 64 nt, Homo Sapiens; identical to SEQ ID NO: 123593

SEQ ID NO: 159247 - RNA, 64 nt, Homo Sapiens; identical to SEQ ID NO: 123594

SEQ ID NO: 159248 - RNA, 64 nt, Homo Sapiens; identical to SEQ ID NO: 123595

SEQ ID NO: 159249 - RNA, 64 nt, Homo Sapiens; identical to SEQ ID NO: 123596

SEQ ID NO: 159250 - RNA, 64 nt, Homo Sapiens; identical to SEQ ID NO: 123597

SEQ ID NO: 159251 - RNA, 64 nt, Homo Sapiens; identical to SEQ ID NO: 123598

SEQ ID NO: 159252 - RNA, 64 nt, Homo Sapiens; identical to SEQ ID NO: 123599

SEQ ID NO: 159253 - RNA, 64 nt, Homo Sapiens; identical to SEQ ID NO: 123600

SEQ ID NO: 159254 - RNA, 64 nt, Homo Sapiens; identical to SEQ ID NO: 123601

SEQ ID NO: 159255 - RNA, 64 nt, Homo Sapiens
uaaaaaaucucuucuaucccagacaugggccaaggugcuguaucugagggaugugcuguaauuu

SEQ ID NO: 159256 - RNA, 64 nt, Homo Sapiens
ccagacaugggccaaggugcuguaucugagggaugugcuguaauuugauuuacaugcauuagag

SEQ ID NO: 159257 - RNA, 64 nt, Homo Sapiens
acuuuaccuaccccaaauucauaaaguacauuuagugcuguauagcacuaaaacuuagagauac

SEQ ID NO: 159258 - RNA, 64 nt, Homo Sapiens
caugguaagcucaauggacuuugaauuguuuacagugcuguauguccaauuguuaaauguacca

SEQ ID NO: 159259 - RNA, 64 nt, Homo Sapiens
gaauaucugugucuaagcacaauaucuucacacugugcuguauugcugcugaacuaaaugcacu

SEQ ID NO: 159260 - RNA, 64 nt, Homo Sapiens
caggugaagauauaaaacccuagaaugcuuaaaugugcuguaaaacuauuguagaugucacugg

SEQ ID NO: 159261 - RNA, 64 nt, Homo Sapiens
ccagccuuguccagaauccuccuggaauuucuuggagacgaaaguaucugggggauuguugggu

SEQ ID NO: 159262 - RNA, 64 nt, Homo Sapiens
uuuaugucaaaguggccacaagauuguuuaauaggagacgaacgaauguaacuccauguuuacu

SEQ ID NO: 159263 - RNA, 64 nt, Homo Sapiens
ucagcaagauaagcagggccagucucagggcccggagacgaacacggggacaauugucaaagga

SEQ ID NO: 159264 - RNA, 64 nt, Homo Sapiens
cacagaagaaaacacgacgucguccauuuuggaagagacgaaagaaaggaaaauaaacucuuug

SEQ ID NO: 159265 - RNA, 64 nt, Homo Sapiens
agcuguagagaugaaaacagugggcucugcuggcgagacgaaacaguguacuugguaccauccc

SEQ ID NO: 159266 - RNA, 64 nt, Homo Sapiens
gcuuggaaggagacccccacgcaugggaggaccagagacgaaggguggcuuuuugggagguggg

SEQ ID NO: 159267 - RNA, 64 nt, Homo Sapiens
cugagcagggugagccucgacuuguggguccccugagacgaaggaagacacacuucuaggcugg

SEQ ID NO: 159268 - RNA, 64 nt, Homo Sapiens
uagccagagaggaggaaggagcuccacccaccuggagacgaaugagcaaacgcauuccuccuca

SEQ ID NO: 159269 - RNA, 64 nt, Homo Sapiens
gugguggagccagucgcuguaacacugagccucagagacgaaccaaaaccagcugggcugagcu

SEQ ID NO: 159270 - RNA, 64 nt, Homo Sapiens
uccccaucucuuucucucagagaguggagagcgggagacgaaugagugugggccgcggcagcca

SEQ ID NO: 159271 - RNA, 64 nt, Homo Sapiens
gaagcaauagaauucuaacauaaggccaagaaaugagacgaauguuugggguuuauguuuuuua

SEQ ID NO: 159272 - RNA, 64 nt, Homo Sapiens
augaauuggauugaggcuugaggggaaauggugugagacgaaugggcucuggacauaugccugu

SEQ ID NO: 159273 - RNA, 64 nt, Homo Sapiens
acuacgacccgcucugcucacucugcaccugccagagacgaacggugaucugugacccgguggu

SEQ ID NO: 159274 - RNA, 64 nt, Homo Sapiens
auagagaacagguggcccagaugugcaagucagugagacgaaguacccaucugccuaucgaaau

SEQ ID NO: 159275 - RNA, 64 nt, Homo Sapiens
aggagagcuauguuuugugguuuaguuccucugugagacgaaaguuuuguauauauuuuggaac

SEQ ID NO: 159276 - RNA, 64 nt, Homo Sapiens
agacccugggaagagaugauugggggcgcuucuugagacgaaaacaaagccaaggguggcguuu

SEQ ID NO: 159277 - RNA, 59 nt, Homo Sapiens
ucauuaaacguaucuuuguucuuuaaaaugagacgaaaauguaucguucaauaagguga

SEQ ID NO: 159278 - RNA, 64 nt, Homo Sapiens
ucagauuaggagauauuuuauaguuuccuguccugagacgaaaucugcgaggaagccuauggaa

SEQ ID NO: 159279 - RNA, 64 nt, Homo Sapiens
uuggagaugcagccuucaccauggauccuggauugagacgaaugccauuggaaccuguuaaaug

SEQ ID NO: 159280 - RNA, 58 nt, Homo Sapiens
ccccaggaagucauccugcaagggagcagagacgaagagccacuggcucaagguguag

SEQ ID NO: 159281 - RNA, 64 nt, Homo Sapiens
cagaugcaaauccaauuaggcggccaaguagguggagacgaagcaccuuccuuuccccaucucu

SEQ ID NO: 159282 - RNA, 64 nt, Homo Sapiens
gcacuauccuaguuauggcaucagguaggagaaggagacgaagaugcuuuaggaagauaaaaac

SEQ ID NO: 159283 - RNA, 64 nt, Homo Sapiens
uuacuuaaaguugauuuugaacuuuuuauuugaggagacgaagugaaaacaaaucuauaaauau

SEQ ID NO: 159284 - RNA, 64 nt, Homo Sapiens
gugcgugggcaaagcugaaggugaugaggaagaagagacgaacauuaaagaugucuauuuacua

SEQ ID NO: 159285 - RNA, 64 nt, Homo Sapiens
guguaugauucuggaacagggugaaacucucccagagacgaagaaagaguccugggauuuguac

SEQ ID NO: 159286 - RNA, 64 nt, Homo Sapiens
ggguacaggcucacguaaaggcaaagaaaagggagagacgaaaagugggggcagaacaugagua

SEQ ID NO: 159287 - RNA, 64 nt, Homo Sapiens
caugcucaccggacaaggguuagggaauuugguagagacgaagaggcugccagaaaugucccac

SEQ ID NO: 159288 - RNA, 64 nt, Homo Sapiens
ucgguaauaaaauuauggauccagauuguucugagagacgaagauacuugcugcugauagaggu

SEQ ID NO: 159289 - RNA, 64 nt, Homo Sapiens
cuuaaugauauuuaaguaguuuuuuuuuuuuuuugagacgaaguuuugcucuuguugcccaggc

SEQ ID NO: 159290 - RNA, 64 nt, Homo Sapiens
uggagacugggauuagagccagagaacaucccuugagacgaauuuuuaaaccggccccacauga

SEQ ID NO: 159291 - RNA, 64 nt, Homo Sapiens
aaagggaaaggaaaaaauggacuggaugagcggugagacgaacagugugccucucuggccgccc

SEQ ID NO: 159292 - RNA, 64 nt, Homo Sapiens
uucagugaauagaaagguauccaaggugaagccugagacgaauggcuuucccaggcuaccuucc

SEQ ID NO: 159293 - RNA, 64 nt, Homo Sapiens
uggagcuggccaucccaaauucaaucaguccauagagacgaacagaaugagaccuuccggccca

SEQ ID NO: 159294 - RNA, 64 nt, Homo Sapiens
aaaccccacaaaauaccccaacacaggcgggggagagacgaaaaagaaaaggaaagagcaagau

SEQ ID NO: 159295 - RNA, 64 nt, Homo Sapiens
uuacuugaugauuuuuaacuuuuuauuucuaaaugagacgaaaugcugauguauccuuucauuc

SEQ ID NO: 159296 - RNA, 64 nt, Homo Sapiens
ggaccuaggagaguaggugagcuuuccaaagugagagacgaaucuuucuuucuuuuuuuuuuua

SEQ ID NO: 159297 - RNA, 64 nt, Homo Sapiens
ucccugacagccgagacugguaccacugggcacugagacgaagccgacucuggaagcuucccuc

SEQ ID NO: 159298 - RNA, 64 nt, Homo Sapiens
cuuucuguaacaugcggccguggcaucagcagcagagacgaagcgcgcugggcagggcucgugg

SEQ ID NO: 159299 - RNA, 64 nt, Homo Sapiens
acguucccacauucuugucaaaaggaaaauacuggagacgaacgccgggugacgcguguccccc

SEQ ID NO: 159300 - RNA, 64 nt, Homo Sapiens
cagggguggauucucgagguuccuuuacugaagggagacgaaggaccgagagucacuggugggu

SEQ ID NO: 159301 - RNA, 64 nt, Homo Sapiens
cucugccuaacuaucaaagguguaacgccagaccgagacgaacacacuccguaaacagcccagc

SEQ ID NO: 159302 - RNA, 64 nt, Homo Sapiens
caacuuuuaaaaauuguuuuaauauuuugaaucugagacgaauaagauaaaucaccugugugau

SEQ ID NO: 159303 - RNA, 64 nt, Homo Sapiens
ucauuuucauuuccauuaaccaucucucucugaugagacgaaucccccaacgguugccuggcac

SEQ ID NO: 159304 - RNA, 64 nt, Homo Sapiens
gagaacggugauuauucaugaguacgaggggagcgagacgaaagagagaaucagacaggcgaga

SEQ ID NO: 159305 - RNA, 64 nt, Homo Sapiens
caacacauguccauucagcccucugaauggaucugagacgaagaccuuuuuaaagauaugucug

SEQ ID NO: 159306 - RNA, 64 nt, Homo Sapiens
uuuugguaaccagacaccaaucaaauaaggggaggagacgaaaauggaaugauuucuuccaugc

SEQ ID NO: 159307 - RNA, 64 nt, Homo Sapiens
gaaggguuggugggcuggccucccacuauggugggagacgaacgguucucuaggucccacccgc

SEQ ID NO: 159308 - RNA, 64 nt, Homo Sapiens
gaaggguagccagggagggaggaugucaccaucagagacgaagguuauugcauauuuauuguuu

SEQ ID NO: 159309 - RNA, 64 nt, Homo Sapiens
ggggaaggcccaaggccgcccagggcagagagaggagacgaagaguuugggacagugggggagg

SEQ ID NO: 159310 - RNA, 64 nt, Homo Sapiens
caauuuucuaacucagcaaaucuagaccaauaaagagacgaauaauuccaagucuccaccccuu

SEQ ID NO: 159311 - RNA, 64 nt, Homo Sapiens
ggaaaagcaaaccagaaucuucucucuccuuuacgagacgaaaaacagaaucgaacucugcacu

SEQ ID NO: 159312 - RNA, 64 nt, Homo Sapiens
auagggccugguuuacauucaucuuuuucuggaggagacgaauggccaucagaaaugucuuuuc

SEQ ID NO: 159313 - RNA, 64 nt, Homo Sapiens
uacuggaucugcaaaaagcccgcagccugcuucagagacgaauaguuguuucccugcuagccuc

SEQ ID NO: 159314 - RNA, 64 nt, Homo Sapiens
uucaccauguuggccaggcuuuuaauuuuuuguagagacgaaguucuggcugaauuuuuuuuuu

SEQ ID NO: 159315 - RNA, 64 nt, Homo Sapiens
agcuggacaucggagacuacagacaaggggagaagagacgaagcaggcuccacuggcagacggc

SEQ ID NO: 159316 - RNA, 64 nt, Homo Sapiens
ccuccagacugcagagcucucagaacccagaacagagacgaaaaggcuaccucuccuacccaag

SEQ ID NO: 159317 - RNA, 64 nt, Homo Sapiens
gaugagggaaguuuuagucuuggcggguggaaaugagacgaagccacaguuaucacacuccaga

SEQ ID NO: 159318 - RNA, 64 nt, Homo Sapiens
uccauuuguuuaaauucacaaagcuugaagaagggagacgaaaauaaaugcgugcuuauccucu

SEQ ID NO: 159319 - RNA, 64 nt, Homo Sapiens
cuaggcacugagagcuggagaguuggugauaagcgagacgaacacauuuccugcccucauacac

SEQ ID NO: 159320 - RNA, 64 nt, Homo Sapiens
cccagcgcuuuggaaaccacaguucucaagcucagagacgaacgcuucuuccacaucuccagca

SEQ ID NO: 159321 - RNA, 64 nt, Homo Sapiens
gagaauuauuugaugcaaaaauaauauaugaaaagagacgaaaagcaccaacaaaugaagcuca

SEQ ID NO: 159322 - RNA, 64 nt, Homo Sapiens
uggaggaggaugccacgcacuuccucucucggagcccucagacaucuccagugugccagacaaa

SEQ ID NO: 159323 - RNA, 64 nt, Homo Sapiens
uugugggcaaaggcagggccacuuuugaagucuucccucagauuuccauuguguggccuggugg

SEQ ID NO: 159324 - RNA, 64 nt, Homo Sapiens
auuucccuccaaacugcugagugcugagccagcacccucagaugacagaccuucaucugggaac

SEQ ID NO: 159325 - RNA, 64 nt, Homo Sapiens
gcaaagaggugaacauaaagaugucuccuuuucccccucagaggauucuuuccuugugaucuga

SEQ ID NO: 159326 - RNA, 64 nt, Homo Sapiens
gaaagggcggaaguuauuauuaaaaccaacaauacccucagacuguguaagccacugcuuauaa

SEQ ID NO: 159327 - RNA, 64 nt, Homo Sapiens
gaaacagcaggaggagggaucagcaccucaguuucccucagagguucagccuagaaauucugac

SEQ ID NO: 159328 - RNA, 64 nt, Homo Sapiens
caggacccaggacccugcugcccugaccaauaaacccucagaccgcacaugacaucugccuggg

SEQ ID NO: 159329 - RNA, 64 nt, Homo Sapiens
cagcucuuggaggagaugagaggggcaggacaggcccucagaaggucccucauuacccaaggca

SEQ ID NO: 159330 - RNA, 64 nt, Homo Sapiens
cagggccagggaugcagaagugugagcccugcagcccucagaauggcugggaauguggaggcuc

SEQ ID NO: 159331 - RNA, 64 nt, Homo Sapiens
gggugugugggugcgucuaggccauucugagugacccucagaguucccagccuacagaacaaug

SEQ ID NO: 159332 - RNA, 64 nt, Homo Sapiens
gagacccaauuuuuuaagcccccagacuccuuagcccucagagccggcagcccccuacccucag

SEQ ID NO: 159333 - RNA, 64 nt, Homo Sapiens
agacuccuuagcccucagagccggcagcccccuacccucagacaaggaacucucuccucucuuu

SEQ ID NO: 159334 - RNA, 64 nt, Homo Sapiens
cagccuggggcucccugagucagggcugugucuccccucagacuggggcucccugaggacgggg

SEQ ID NO: 159335 - RNA, 64 nt, Homo Sapiens
aaaguggggcucccucaggacagcguugugucuccccucagacugcggcucccugaggacgggg

SEQ ID NO: 159336 - RNA, 64 nt, Homo Sapiens
cagacugcggcucccugaggacggggcugugucucccucagacuggggcucccugaagaaaggg

SEQ ID NO: 159337 - RNA, 64 nt, Homo Sapiens
cagacuggggcucccugaagaaagggcugcuucucccucagacuggagcucccugaagaugggg

SEQ ID NO: 159338 - RNA, 64 nt, Homo Sapiens
cagacuggagcucccugaagauggggcugugucccccucagacuggggcugccugaggaugagg

SEQ ID NO: 159339 - RNA, 64 nt, Homo Sapiens
caauguuucaucuccaacccucugccaguuuggccccucagagcuugguggcucaagacuguua

SEQ ID NO: 159340 - RNA, 64 nt, Homo Sapiens
gugagugagugguggcggggcugcuccuucccaccccucagaacagcucugauccucguuaaua

SEQ ID NO: 159341 - RNA, 64 nt, Homo Sapiens
aaaaaaaaaggaaacagccucacuuuuuugugcucccucagaauugcuugcuaugucuguuaau

SEQ ID NO: 159342 - RNA, 64 nt, Homo Sapiens
uguuguuguuguuguuguuguuuuaauugggcaacccucagaacugaagagguucagagaacuu

SEQ ID NO: 159343 - RNA, 64 nt, Homo Sapiens
gcaacaagaaacuucucccucacccccuccuuuacccucagauuuggagaugguaaccaaagga

SEQ ID NO: 159344 - RNA, 64 nt, Homo Sapiens
uugcccaucuggagacugcaggcucccuuccuuacccucagagagugcuuaugguggguguuuu

SEQ ID NO: 159345 - RNA, 64 nt, Homo Sapiens
uuucacugccgucucgucuuuccccuuccccucucccucagagugaacuucgcucaggagggcc

SEQ ID NO: 159346 - RNA, 64 nt, Homo Sapiens
uuggguugcaccccaacaaacuuaaaucuggguucccucagacaaaucccuuucuuggugacga

SEQ ID NO: 159347 - RNA, 64 nt, Homo Sapiens
uggaggcagagauuggagugauacauugugggaacccucagaagauaggaaaaaagcauggaau

SEQ ID NO: 159348 - RNA, 64 nt, Homo Sapiens
ucagaagauaggaaaaaagcauggaauagauucucccucagaguuccaguaguugccaacccug

SEQ ID NO: 159349 - RNA, 64 nt, Homo Sapiens
gcccccugccccgcaggccugcuggugccugagccccucagacaaucagugccagccccugcug

SEQ ID NO: 159350 - RNA, 64 nt, Homo Sapiens
ccuuggggcaugacccagugaccacuguggaagucccucagagguaaaaagggcagcccuccuu

SEQ ID NO: 159351 - RNA, 64 nt, Homo Sapiens
guguaacuaauuugugguaaaguaguugauucagcccucagaagaaaacuuuuguuuagagccc

SEQ ID NO: 159352 - RNA, 64 nt, Homo Sapiens
agaaaucuccuaacaaaagaacuaagaggcccagcccucagaaacccuucagugcuacauuuug

SEQ ID NO: 159353 - RNA, 64 nt, Homo Sapiens
gcugucuggcacccagugucuuagaaagaaaauccccucagaagaccuguuccugaggccucau

SEQ ID NO: 159354 - RNA, 64 nt, Homo Sapiens
ugcacucugggugucuccugaggagugagugagccccucagaccugcuuucugccucugguaac

SEQ ID NO: 159355 - RNA, 64 nt, Homo Sapiens
aucucuccacgguagcacuucaccgggagccucccccucagaugacaguucuuggugacugucc

SEQ ID NO: 159356 - RNA, 64 nt, Homo Sapiens
aauccgauucacguagggaaggguguggccucagcccucagaacuuucauccaguuuguucucc

SEQ ID NO: 159357 - RNA, 64 nt, Homo Sapiens
gcaaggguaggggacaagauguaggcuccagcuccccucagaccuccucaucucaugagcuucu

SEQ ID NO: 159358 - RNA, 64 nt, Homo Sapiens
auauucagagaacuauacuacccucacagugaggcccucagaccugccacagggcagagcaggu

SEQ ID NO: 159359 - RNA, 64 nt, Homo Sapiens
gguagugcccacacuauuuuuucccgccuccccucccucagaaagcuuucagaugcauugacuc

SEQ ID NO: 159360 - RNA, 64 nt, Homo Sapiens
uggccagagcaccggccuccccuugucaggaagacccucagaugaccgugucacagcugugucc

SEQ ID NO: 159361 - RNA, 64 nt, Homo Sapiens
uacauucauacacaagccuuuucacacagcacuccccucagacacccucagagaguucacacug

SEQ ID NO: 159362 - RNA, 64 nt, Homo Sapiens
cacaagccuuuucacacagcacuccccucagacacccucagagaguucacacugaugggaaaug

SEQ ID NO: 159363 - RNA, 64 nt, Homo Sapiens
cagcgguccaaugccaccuaucccagccccuccucccucagacccccagacccagagguccagg

SEQ ID NO: 159364 - RNA, 64 nt, Homo Sapiens
cagagguccaggcccccaacccccaaccccuccucccucagacuucagacccagggguccaggc

SEQ ID NO: 159365 - RNA, 64 nt, Homo Sapiens
caggaguccagccccuccucccccagccccuccucccucagacccagacccaggaguccagacc

SEQ ID NO: 159366 - RNA, 64 nt, Homo Sapiens
caggaguccagaccccccagguccagccccuccucccucagacccuccucccucagacccagga

SEQ ID NO: 159367 - RNA, 64 nt, Homo Sapiens; identical to SEQ ID NO: 159365

SEQ ID NO: 159368 - RNA, 64 nt, Homo Sapiens
caggaguccagaccccccagccccagccccuccucccucagacccucaaaccaaggguacagau

SEQ ID NO: 159369 - RNA, 64 nt, Homo Sapiens
caggaguccaggccccagccccccagccccuccucccucagaccucagacccgggaguccaggc

SEQ ID NO: 159370 - RNA, 64 nt, Homo Sapiens
cgggaguccaggcccccagcccccagccccuccucccucagaccucagacccaggaguccaggc

SEQ ID NO: 159371 - RNA, 64 nt, Homo Sapiens
caggaguccaggcccccagcccccagccccuccucccucagaccucaggacccaggaguccagg

SEQ ID NO: 159372 - RNA, 64 nt, Homo Sapiens
caggacuccaggcccccagcccccaguaccuccucccucagaccucagacccaggauucccggg

SEQ ID NO: 159373 - RNA, 64 nt, Homo Sapiens
caggauucccgggccccagucuccagcuccuccucccucagaccucagauccaggagucuaguc

SEQ ID NO: 159374 - RNA, 64 nt, Homo Sapiens
gcaguuugguuucuagcaugaagacagagccccacccucagaugcacaugagcuggcgggauug

SEQ ID NO: 159375 - RNA, 64 nt, Homo Sapiens
gaugcugucuucguacugggaaagggauuuucagcccucagaaucgcuccaccuugcagcucuc

SEQ ID NO: 159376 - RNA, 64 nt, Homo Sapiens
cccagaggcagucccagccuggguggagggcagucccucagaaucucugagcccaggccugcag

SEQ ID NO: 159377 - RNA, 64 nt, Homo Sapiens
ccucaggacccaacagguggccuuguccuucucucccucagaagugcccuccccuuccucccau

SEQ ID NO: 159378 - RNA, 64 nt, Homo Sapiens
ucugguacggagucggugcuccugcccccaucgucacuaccaggguggcuuuguuccgugccuc

SEQ ID NO: 159379 - RNA, 64 nt, Homo Sapiens
ugaaggugaacauucccugugcugaugagaacaacacuaccacuccucugaaagggauggagau

SEQ ID NO: 159380 - RNA, 64 nt, Homo Sapiens
ccacuccauugucacuaacguccggcuccaucggcacuaccaccccgcuccaucaucacuaugu

SEQ ID NO: 159381 - RNA, 64 nt, Homo Sapiens
cccgcuccaucaucacuauguccagcuccgucggcacuaccacccugcuccaucaucacuacgu

SEQ ID NO: 159382 - RNA, 64 nt, Homo Sapiens; identical to SEQ ID NO: 97332

SEQ ID NO: 159383 - RNA, 64 nt, Homo Sapiens; identical to SEQ ID NO: 97333

SEQ ID NO: 159384 - RNA, 64 nt, Homo Sapiens; identical to SEQ ID NO: 97334

SEQ ID NO: 159385 - RNA, 64 nt, Homo Sapiens; identical to SEQ ID NO: 97335

SEQ ID NO: 159386 - RNA, 64 nt, Homo Sapiens; identical to SEQ ID NO: 97336

SEQ ID NO: 159387 - RNA, 64 nt, Homo Sapiens; identical to SEQ ID NO: 97337

SEQ ID NO: 159388 - RNA, 64 nt, Homo Sapiens; identical to SEQ ID NO: 97338

SEQ ID NO: 159389 - RNA, 64 nt, Homo Sapiens; identical to SEQ ID NO: 97339

SEQ ID NO: 159390 - RNA, 64 nt, Homo Sapiens; identical to SEQ ID NO: 97340

SEQ ID NO: 159391 - RNA, 64 nt, Homo Sapiens; identical to SEQ ID NO: 97341

SEQ ID NO: 159392 - RNA, 64 nt, Homo Sapiens; identical to SEQ ID NO: 97342

SEQ ID NO: 159393 - RNA, 64 nt, Homo Sapiens; identical to SEQ ID NO: 97343

SEQ ID NO: 159394 - RNA, 64 nt, Homo Sapiens; identical to SEQ ID NO: 97344

SEQ ID NO: 159395 - RNA, 64 nt, Homo Sapiens; identical to SEQ ID NO: 97345

SEQ ID NO: 159396 - RNA, 64 nt, Homo Sapiens; identical to SEQ ID NO: 97346

SEQ ID NO: 159397 - RNA, 64 nt, Homo Sapiens; identical to SEQ ID NO: 97347

SEQ ID NO: 159398 - RNA, 64 nt, Homo Sapiens; identical to SEQ ID NO: 97348

SEQ ID NO: 159399 - RNA, 64 nt, Homo Sapiens; identical to SEQ ID NO: 97349

SEQ ID NO: 159400 - RNA, 64 nt, Homo Sapiens; identical to SEQ ID NO: 97350

SEQ ID NO: 159401 - RNA, 64 nt, Homo Sapiens; identical to SEQ ID NO: 97351

SEQ ID NO: 159402 - RNA, 64 nt, Homo Sapiens; identical to SEQ ID NO: 97352

SEQ ID NO: 159403 - RNA, 64 nt, Homo Sapiens; identical to SEQ ID NO: 97353

SEQ ID NO: 159404 - RNA, 64 nt, Homo Sapiens; identical to SEQ ID NO: 97354

SEQ ID NO: 159405 - RNA, 64 nt, Homo Sapiens; identical to SEQ ID NO: 97355

SEQ ID NO: 159406 - RNA, 64 nt, Homo Sapiens; identical to SEQ ID NO: 97356

SEQ ID NO: 159407 - RNA, 64 nt, Homo Sapiens; identical to SEQ ID NO: 97357

SEQ ID NO: 159408 - RNA, 64 nt, Homo Sapiens; identical to SEQ ID NO: 97358

SEQ ID NO: 159409 - RNA, 64 nt, Homo Sapiens; identical to SEQ ID NO: 97359

SEQ ID NO: 159410 - RNA, 64 nt, Homo Sapiens; identical to SEQ ID NO: 97360

SEQ ID NO: 159411 - RNA, 64 nt, Homo Sapiens; identical to SEQ ID NO: 97361

SEQ ID NO: 159412 - RNA, 64 nt, Homo Sapiens; identical to SEQ ID NO: 97362

SEQ ID NO: 159413 - RNA, 64 nt, Homo Sapiens; identical to SEQ ID NO: 97363

SEQ ID NO: 159414 - RNA, 64 nt, Homo Sapiens; identical to SEQ ID NO: 97364

SEQ ID NO: 159415 - RNA, 64 nt, Homo Sapiens; identical to SEQ ID NO: 97365

SEQ ID NO: 159416 - RNA, 64 nt, Homo Sapiens; identical to SEQ ID NO: 97366

SEQ ID NO: 159417 - RNA, 64 nt, Homo Sapiens; identical to SEQ ID NO: 97367

SEQ ID NO: 159418 - RNA, 64 nt, Homo Sapiens; identical to SEQ ID NO: 97368

SEQ ID NO: 159419 - RNA, 64 nt, Homo Sapiens; identical to SEQ ID NO: 97369

SEQ ID NO: 159420 - RNA, 64 nt, Homo Sapiens; identical to SEQ ID NO: 97370

SEQ ID NO: 159421 - RNA, 64 nt, Homo Sapiens; identical to SEQ ID NO: 97371

SEQ ID NO: 159422 - RNA, 64 nt, Homo Sapiens; identical to SEQ ID NO: 97372

SEQ ID NO: 159423 - RNA, 64 nt, Homo Sapiens; identical to SEQ ID NO: 97373

SEQ ID NO: 159424 - RNA, 64 nt, Homo Sapiens; identical to SEQ ID NO: 97374

SEQ ID NO: 159425 - RNA, 64 nt, Homo Sapiens; identical to SEQ ID NO: 97375

SEQ ID NO: 159426 - RNA, 64 nt, Homo Sapiens; identical to SEQ ID NO: 97376

SEQ ID NO: 159427 - RNA, 64 nt, Homo Sapiens; identical to SEQ ID NO: 97377

SEQ ID NO: 159428 - RNA, 64 nt, Homo Sapiens; identical to SEQ ID NO: 97378

SEQ ID NO: 159429 - RNA, 64 nt, Homo Sapiens; identical to SEQ ID NO: 97379

SEQ ID NO: 159430 - RNA, 64 nt, Homo Sapiens; identical to SEQ ID NO: 97380

SEQ ID NO: 159431 - RNA, 64 nt, Homo Sapiens; identical to SEQ ID NO: 97381

SEQ ID NO: 159432 - RNA, 64 nt, Homo Sapiens; identical to SEQ ID NO: 97382

SEQ ID NO: 159433 - RNA, 64 nt, Homo Sapiens; identical to SEQ ID NO: 97383

SEQ ID NO: 159434 - RNA, 64 nt, Homo Sapiens; identical to SEQ ID NO: 97384

SEQ ID NO: 159435 - RNA, 64 nt, Homo Sapiens; identical to SEQ ID NO: 97385

SEQ ID NO: 159436 - RNA, 64 nt, Homo Sapiens; identical to SEQ ID NO: 97386

SEQ ID NO: 159437 - RNA, 64 nt, Homo Sapiens; identical to SEQ ID NO: 97387

SEQ ID NO: 159438 - RNA, 64 nt, Homo Sapiens; identical to SEQ ID NO: 97388

SEQ ID NO: 159439 - RNA, 64 nt, Homo Sapiens; identical to SEQ ID NO: 97389

SEQ ID NO: 159440 - RNA, 64 nt, Homo Sapiens; identical to SEQ ID NO: 97390

SEQ ID NO: 159441 - RNA, 64 nt, Homo Sapiens; identical to SEQ ID NO: 97391

SEQ ID NO: 159442 - RNA, 64 nt, Homo Sapiens; identical to SEQ ID NO: 97392

SEQ ID NO: 159443 - RNA, 64 nt, Homo Sapiens; identical to SEQ ID NO: 97393

SEQ ID NO: 159444 - RNA, 64 nt, Homo Sapiens; identical to SEQ ID NO: 97394

SEQ ID NO: 159445 - RNA, 64 nt, Homo Sapiens
uucucaggaugcuucuuaccugucagaggaggugacaaggcagucucuugcucucuuggacuca

SEQ ID NO: 159446 - RNA, 64 nt, Homo Sapiens
ucucuggaaguggucguauuugagcaggaugugcacaaggcaauugaaaugcccauaauuaguu

SEQ ID NO: 159447 - RNA, 64 nt, Homo Sapiens
uagcuagcuuaguguugaacuaaauuuuuuuuaaacaaggcaaggucuaaugcuguuuugagau

SEQ ID NO: 159448 - RNA, 64 nt, Homo Sapiens
guuauuuuuaucauaaagccacaaauguauuauaacaaggcaaauuguaauauauauaauccug

SEQ ID NO: 159449 - RNA, 64 nt, Homo Sapiens
uguuuuucaauaauguccugcuguauuuuguacuacaaggcagcaugacauccguauacuugua

SEQ ID NO: 159450 - RNA, 64 nt, Homo Sapiens
cuguuugaguggauugguuggucaggcauaaagcacaaggcagaugagguaggcacaagaaaaa

SEQ ID NO: 159451 - RNA, 64 nt, Homo Sapiens
cuggaagcagaaaugcaaaccugugucuccccuaacaaggcaauuucccaugacccucucuucc

SEQ ID NO: 159452 - RNA, 64 nt, Homo Sapiens
gcucuguuugcuguucuaguaggaccagaugcacacaaggcauucaccugggauguggaagcug

SEQ ID NO: 159453 - RNA, 64 nt, Homo Sapiens
ggguauaugguauccccaaaaugccagucaccacacaaggcacuauuuauugagugccuaccag

SEQ ID NO: 159454 - RNA, 64 nt, Homo Sapiens
ggaaacuauuauaaggccauaauggaaaaaaauuacaaggcaauuuuuucuauaaaaagaaaaa

SEQ ID NO: 159455 - RNA, 64 nt, Homo Sapiens
guuauucauacaaauaaugagcccuacacagggaacaaggcaggaaguuagcuguuaacuccuu

SEQ ID NO: 159456 - RNA, 64 nt, Homo Sapiens
auucggaggucaagaaagcaguauauauucuuucacaaggcauccauacuguuuaauauuuaua

SEQ ID NO: 159457 - RNA, 63 nt, Homo Sapiens
agagaccaacucccugggcuucauacuggccuuccucuacaauggccuccucuccaucagugc

SEQ ID NO: 159458 - RNA, 63 nt, Homo Sapiens
ucuuguucauguagccgaggggcaggcgggggaccucuacaccucugcugugggcacggggcu

SEQ ID NO: 159459 - RNA, 63 nt, Homo Sapiens
guggcccgucucaucugugaacuugacucugucccucuacaugucucuuuaauggggugaggg

SEQ ID NO: 159460 - RNA, 63 nt, Homo Sapiens
ucagcugggggcucucaccagcccuccuuucagccucuacaacagagcagcuucccagacuuc

SEQ ID NO: 159461 - RNA, 63 nt, Homo Sapiens
cagaugcuggccccuuggucuugaauuuccuagccucuacaacuaagccaaauaaauuucugu

SEQ ID NO: 159462 - RNA, 63 nt, Homo Sapiens
gaauggcuuagaauaaguauacacuugaaaucuccucuacaugaucuuuguucuuuaacagug

SEQ ID NO: 159463 - RNA, 63 nt, Homo Sapiens
uggcuguaagggagacucagucccagccucuccccucuacaacuccugccacuguuggccaug

SEQ ID NO: 159464 - RNA, 63 nt, Homo Sapiens
aauggacuuccauaguauugacuguagaaggagccucuacaauauugacuauauauuuuuaua

SEQ ID NO: 159465 - RNA, 63 nt, Homo Sapiens
gcuccacccugccauggccggccaccuggccacccucuacacguggauggaauccgcgagcug

SEQ ID NO: 159466 - RNA, 63 nt, Homo Sapiens
ugauuuauauuauauguggcuaaaaaccaaaguccucuacacuccaauuauauuuuuaacauu

SEQ ID NO: 159467 - RNA, 63 nt, Homo Sapiens
aaguacaaaaauuagucggguggcaaaaacccaccucuacaaaugagaccagccugggcaaca

SEQ ID NO: 159468 - RNA, 63 nt, Homo Sapiens
ugaagacaaaggcaaagucaacacaaauaggcuccucuacaccagugacucucuaggcuucgg

SEQ ID NO: 159469 - RNA, 63 nt, Homo Sapiens
uaauaggaaaaacggaagaaagugccuauacugccucuacagucacaagaacaacggcaagac

SEQ ID NO: 159470 - RNA, 63 nt, Homo Sapiens
ucucuuaaagguagguuggcgcacaaaaaaccaccucuacauuuuguacuuguggaugguuga

SEQ ID NO: 159471 - RNA, 63 nt, Homo Sapiens
uauuuauaucaauuccuacagauuguucugcucccucuacagauguccuuccuugaaauugcu

SEQ ID NO: 159472 - RNA, 63 nt, Homo Sapiens
ggguagcuucugucagggaaagaccuacuuuguccucuacauaaaccaacuaauauuuauuga

SEQ ID NO: 159473 - RNA, 63 nt, Homo Sapiens
cacaagagcuaauucauucuugagauaugucagccucuacaguagcuugcugacugcagaucu

SEQ ID NO: 159474 - RNA, 63 nt, Homo Sapiens
guugaugcgggcaguguggggaccguccuggugccucuacaugacuucuuccuaaugacacgc

SEQ ID NO: 159475 - RNA, 63 nt, Homo Sapiens
ggcauauuccaugacauuaauaggaguguucugccucuacaguaaucuggugaauguuauuau

SEQ ID NO: 159476 - RNA, 63 nt, Homo Sapiens
auuguuauuuaauaaauauuucaggauauuuuuccucuacaauaaaguaacaauuaacuuaug

SEQ ID NO: 159477 - RNA, 63 nt, Homo Sapiens
aaugugugccaagagggucuccuuuccugucuuccucuacagagaaugcugcucgguccuccu

SEQ ID NO: 159478 - RNA, 63 nt, Homo Sapiens
gggaagggcuuucuugguaauuuagaugugaaaccucuacagagcuaucauguaaaaacuaca

SEQ ID NO: 159479 - RNA, 63 nt, Homo Sapiens
cgguggccuucaagguccuuuaugaguguuaccccucuacacguccacaccacucaccacaca

SEQ ID NO: 159480 - RNA, 63 nt, Homo Sapiens
agagggggcagaaaugaaugaccagguuaaaucccucuacaugugguuucuguuugaaaaaaa

SEQ ID NO: 159481 - RNA, 63 nt, Homo Sapiens
guaggaaacuugauuuuuuuguuuugaucauggccucuacaugcaccuuuccagaguggucuc

SEQ ID NO: 159482 - RNA, 63 nt, Homo Sapiens
cuacccggucacggaggccggccaccugcagagccucuacacagguagugccccgaggggcug

SEQ ID NO: 159483 - RNA, 63 nt, Homo Sapiens
cucccuggcuacauggucaauguuggggcucuuccucuacagcggcgcuguuggggcugcuca

SEQ ID NO: 159484 - RNA, 63 nt, Homo Sapiens
ggacaugcacacacaaguaaccugcagccuuccccucuacacaggguggcacagcagugcccc

SEQ ID NO: 159485 - RNA, 63 nt, Homo Sapiens
uaguuauugauaaacuucuuaguaugugaauauccucuacacuaccuuucccuaugacuuggc

SEQ ID NO: 159486 - RNA, 63 nt, Homo Sapiens
guuugcaucauacaucuucucuuuccuuguuuuccucuacaauuggaggagaaacaaauauau

SEQ ID NO: 159487 - RNA, 63 nt, Homo Sapiens
uuuucagaaacuuuccaaacugcuuuacauagaccucuacaaguagggaauguuuucugaagc

SEQ ID NO: 159488 - RNA, 57 nt, Homo Sapiens
cuggaccugguuaucgauaaggaggcuccucuacaccaauuaauguagcugcuagcu

SEQ ID NO: 159489 - RNA, 63 nt, Homo Sapiens
cuaggaucacaggaagacuuguuuugcuuuuagccucuacaugcugguuuuuguuugguuuuc

SEQ ID NO: 159490 - RNA, 63 nt, Homo Sapiens
gaccaaaacucauucucuuauucuuuuuguguaccucuacagacuaguaguuauuuuuccuuu

SEQ ID NO: 159491 - RNA, 63 nt, Homo Sapiens
uaauuuuuagaagcaagaagaaagccauuguguccucuacaauuaacaaaacuuaucucugau

SEQ ID NO: 159492 - RNA, 63 nt, Homo Sapiens
cuuucauuuacauaggguguaaccaucaagaaaccucuacaggguacuuaagccccagaagau

SEQ ID NO: 159493 - RNA, 63 nt, Homo Sapiens
ccacacuuaaaagauggugauauugaggccuguccucuacauaaaagauaugaagaacuauua

SEQ ID NO: 159494 - RNA, 63 nt, Homo Sapiens
ucuggcuguaguuaugaccucauaggugucuagccucuacagugaauagaauacauuauaccu

SEQ ID NO: 159495 - RNA, 63 nt, Homo Sapiens
uuggaggugauggugcagcaugccuucaucucuccucuacaguuuggaaauuccuccaaaguu

SEQ ID NO: 159496 - RNA, 63 nt, Homo Sapiens
ugaaccuaauacccugcccuugacaucuggaaaccucuacauauuuauauaacgugauacauu

SEQ ID NO: 159497 - RNA, 63 nt, Homo Sapiens
cccaccuccuggugguaccauuauuauagaagcccucuacagccugacuuucucuccagcggu

SEQ ID NO: 159498 - RNA, 63 nt, Homo Sapiens
guaugcgauguaauuaaagaaauuauuggauaaccucuacaaauaaagauaggggaacucuga

SEQ ID NO: 159499 - RNA, 63 nt, Homo Sapiens
uuuuaaaugucuuuauugacuuuaaauucauugccucuacauuauucauuaguucuucuuuuc

SEQ ID NO: 159500 - RNA, 63 nt, Homo Sapiens
aacccaguugaauaggauccaaucccugguuagccucuacacaauaauagggagacaaggauu

SEQ ID NO: 159501 - RNA, 63 nt, Homo Sapiens
auuugggcuaucagagguaccccugggcaggagccucuacauccccuucccccuccucucucc

SEQ ID NO: 159502 - RNA, 63 nt, Homo Sapiens
uuguaugauauguaaaacagugagcugcacugaccucuacauugacugaauagugugguucag

SEQ ID NO: 159503 - RNA, 63 nt, Homo Sapiens
gccugggccucggcgucaaucaucgauaagaagccucuacagcaccccugcccccuaauuuau

SEQ ID NO: 159504 - RNA, 63 nt, Homo Sapiens
uugguuccugagaggucugagggccagagcugcccucuacauuaacaugcugucucuaagggu

SEQ ID NO: 159505 - RNA, 63 nt, Homo Sapiens
guuuuauggaauaccugguagaaauguaaauggccucuacagagguguaauuacagaauuuac

SEQ ID NO: 159506 - RNA, 55 nt, Homo Sapiens
acacuaccgcaaaaccaacggcuuaccucuacaguuuuauggcuucggcggcuga

SEQ ID NO: 159507 - RNA, 63 nt, Homo Sapiens
uauuucauuccccucaucuugcauccuaggaugccucuacauguaauucuuuuuagaacugaa

SEQ ID NO: 159508 - RNA, 63 nt, Homo Sapiens
cuucaugccccaugcauuagguggcucugccacccucuacagcacauaggcuccaucuauuuu

SEQ ID NO: 159509 - RNA, 63 nt, Homo Sapiens
aagagaacuauaacaugaaccuauaacagucuaccucuacacuuaagucaaguuucacuggcu

SEQ ID NO: 159510 - RNA, 63 nt, Homo Sapiens
uaggagacuucaucuaaagcaugaaaccuagcuccucuacacacaaauuccuauggaaauacc

SEQ ID NO: 159511 - RNA, 63 nt, Homo Sapiens
cuaaguggucucuguucuacacuuuaaugucacccucuacaucaucuuaccuagcccacccaa

SEQ ID NO: 159512 - RNA, 63 nt, Homo Sapiens
caaauggagaaguucaggaaagcuugauccagaccucuacaaggaugaaggacgugucucagg

SEQ ID NO: 159513 - RNA, 63 nt, Homo Sapiens
cuugugauuccuauucgauaccuuccuucauguccucuacacacuugguagcucugggauuug

SEQ ID NO: 159514 - RNA, 63 nt, Homo Sapiens
ucauucugcacgcagaagucuuccacucuugcuccucuacaauagccuuccagcuguuccugc

SEQ ID NO: 159515 - RNA, 63 nt, Homo Sapiens
gcuacucccuguuauugugugguuugucguaauccucuacaaauaccucauuuaaucuguaaa

SEQ ID NO: 159516 - RNA, 63 nt, Homo Sapiens
gggcggcuggcuggaaagccacgcguaugcugcccucuacaggcugcucggccucccugcagc

SEQ ID NO: 159517 - RNA, 63 nt, Homo Sapiens
guuguaaaagcugaugaaccugaaauuguguagccucuacaggcugcugagguucuaaauaaa

SEQ ID NO: 159518 - RNA, 63 nt, Homo Sapiens
gugaaguugcacuauguaccaaugugugucgaaccucuacauugcacagaaaaacacgcauug

SEQ ID NO: 159519 - RNA, 63 nt, Homo Sapiens
cuacuacucauuccagaauugcugucuuuugugccucuacaagugauagaaauugagauucuu

SEQ ID NO: 159520 - RNA, 63 nt, Homo Sapiens
cacaauccucaaaccaacaauucuuuuuuuuaaccucuacagacugugccuucuuuucuuucu

SEQ ID NO: 159521 - RNA, 63 nt, Homo Sapiens
acucucaccuuccaaaucuugacaagaggcuggccucuacaucuaaacagaagcaacagaagg

SEQ ID NO: 159522 - RNA, 63 nt, Homo Sapiens
acgcaugcauuuagaagcuucagaaaauauuagccucuacauuuuucaggaaccaaggacugc

SEQ ID NO: 159523 - RNA, 63 nt, Homo Sapiens
uggacaggaugacagacagggacgaagcagagaccucuacagacccaagucaccaaguggagc

SEQ ID NO: 159524 - RNA, 63 nt, Homo Sapiens
auacuuuuuauugagcacuuuuucuuguauuacccucuacaauugcccucuucuuaccccaau

SEQ ID NO: 159525 - RNA, 63 nt, Homo Sapiens
acagcauugaucuccuggaggcugguucugcugccucuacacaggggcccuguacagugaaug

SEQ ID NO: 159526 - RNA, 63 nt, Homo Sapiens
ggaugcccugcccuguauccacuugggagagagccucuacaacaugcuggcaacuucccccuc

SEQ ID NO: 159527 - RNA, 63 nt, Homo Sapiens
guuggaccuccauggagccacuaggccuggccuccucuacacauccccagggcuaucugguua

SEQ ID NO: 159528 - RNA, 63 nt, Homo Sapiens
uucuguuugucaguucauuccuguguguucuuaccucuacaaaguaaauuacacauuuaguuu

SEQ ID NO: 159529 - RNA, 63 nt, Homo Sapiens
gaaaugcagaagaguucauuuguaauauaucagccucuacaauuuguuugaaugauuccggcu

SEQ ID NO: 159530 - RNA, 63 nt, Homo Sapiens
gcuucccugacucauucugagagugcucugaucccucuacagauuccagcuggaugagaauuu

SEQ ID NO: 159531 - RNA, 55 nt, Homo Sapiens
uuacuguucugcccgggauucucuuccucuacauccaaagcuuccaaaaaucuaa

SEQ ID NO: 159532 - RNA, 63 nt, Homo Sapiens
ucacucagacuaguacaucuaaaaggcuuacugccucuacauuuauuuaagacuuuaagacuu

SEQ ID NO: 159533 - RNA, 63 nt, Homo Sapiens
gccuuuuagggggagggggugggcugggccuggccucuacagauuugcccccccaguggcccu

SEQ ID NO: 159534 - RNA, 63 nt, Homo Sapiens
gugauuccaaugcaggugucuucauuaccauuaccucuacacugcagaagaagcaaaacuccu

SEQ ID NO: 159535 - RNA, 63 nt, Homo Sapiens
uuggaagcaggcucccaauagggagggggcugcccucuacagucucuuugacuguaagacagg

SEQ ID NO: 159536 - RNA, 63 nt, Homo Sapiens
ucaggguucuaaccuuucuaacccacuaaguaaccucuacaggcauuuaacugccuuacagac

SEQ ID NO: 159537 - RNA, 63 nt, Homo Sapiens
gguccauggucuauuuauucucgcccagcucacccucuacacagacacuguccugggugcaca

SEQ ID NO: 159538 - RNA, 63 nt, Homo Sapiens
cucccucucugcucuccugucccuugagcccuuccucuacagguggggcagagaggguggugg

SEQ ID NO: 159539 - RNA, 63 nt, Homo Sapiens
agauggcaguguucuccucuggggccugauccaccucuacaccagcccaggaagccccaucug

SEQ ID NO: 159540 - RNA, 63 nt, Homo Sapiens
cucacuuuaauaccucuuaggaaccaaagaaugccucuacaagcaaaaagauaguugaaaaua

SEQ ID NO: 159541 - RNA, 63 nt, Homo Sapiens
gauaaccaaguagccauuuuccucuuaagguuuccucuacaaccccaaggacuuucaugauua

SEQ ID NO: 159542 - RNA, 63 nt, Homo Sapiens
uauauauacguacagagccugcgcgugugugagccucuacacagccgcucugcgugugcgugu

SEQ ID NO: 159543 - RNA, 63 nt, Homo Sapiens
uguauuuuccacuugcauaacuucuaucucgucccucuacagacuuggaguuagaucuagguc

SEQ ID NO: 159544 - RNA, 63 nt, Homo Sapiens
ucaagaaauagcgcaguguccacugauggaaucccucuacaggauaaauaauuauaaauugag

SEQ ID NO: 159545 - RNA, 63 nt, Homo Sapiens
aaucuucaggaagccugcuaaaaacacugaaaaccucuacaacagcugaaaaggggauccuug

SEQ ID NO: 159546 - RNA, 63 nt, Homo Sapiens
aaguuuugcauuguagaauuauaaucagucuggccucuacaacuguucgagcacagaacggau

SEQ ID NO: 159547 - RNA, 63 nt, Homo Sapiens
gccugguagacaagugcuacuccucaucacuccccucuacaguuccuaagcaguccuggcuuu

SEQ ID NO: 159548 - RNA, 63 nt, Homo Sapiens
uaauuuucuuuuuuggcccuaggcugguugggaccucuacagcuucauucuuucaccauuaaa

SEQ ID NO: 159549 - RNA, 63 nt, Homo Sapiens
gcagauccccagccucuggccuccuguucgccuccucuacaauuugccauuguuucuccuggg

SEQ ID NO: 159550 - RNA, 63 nt, Homo Sapiens
uggaccagugggaaggauaggauuagcacugcaccucuacauccaucaagagagacagagcgc

SEQ ID NO: 159551 - RNA, 51 nt, Homo Sapiens
gagaagauuaugccgaauagaccucuacauccugugcuuuucuccuaguuu

SEQ ID NO: 159552 - RNA, 63 nt, Homo Sapiens
gagcaaagugaccugguuaaacaaaccagaaucccucuacauggacucagagaaaagagauug

SEQ ID NO: 159553 - RNA, 63 nt, Homo Sapiens
ucugcuugagauauuuccucugugucuuucauaccucuacaugaugccccggcaccucugccc

SEQ ID NO: 159554 - RNA, 63 nt, Homo Sapiens
uccaucuuguuucacccaccacugcucucuuuuccucuacagccuaagggauuccugggugcc

SEQ ID NO: 159555 - RNA, 63 nt, Homo Sapiens
cuuuacuaacauucauguuauggcaagaguuguccucuacauuggaaagcuaauccuaccuug

SEQ ID NO: 159556 - RNA, 63 nt, Homo Sapiens
ccccccacucuacuuaucauggaggagaccaggccucuacacaaguugggaggggcaccgucc

SEQ ID NO: 159557 - RNA, 63 nt, Homo Sapiens
gcuugcccuuguccgugugcccccaggacuuugccucuacagcauuuucuuacacccccuccc

SEQ ID NO: 159558 - RNA, 63 nt, Homo Sapiens
aacgccaagggcagcaccauccucagacaacagccucuacaccacugcagaccaacuaccccu

SEQ ID NO: 159559 - RNA, 63 nt, Homo Sapiens
cucuuugccacacuagaggcugagccuguggcuccucuacauacgccacaacauggcucuuug

SEQ ID NO: 159560 - RNA, 63 nt, Homo Sapiens
aauuaacaucgugggucacuuuuugcaaacuguccucuacaucauuaagggcaaaucuauuac

SEQ ID NO: 159561 - RNA, 63 nt, Homo Sapiens
aggucgaauucaugaccugagaaaaaaccuacaccucuacagcgguugcugaugagagaaccu

SEQ ID NO: 159562 - RNA, 63 nt, Homo Sapiens
gaacauccuguuugugaauucugaguuugaaacccucuacaaugagcacaagguauugguggg

SEQ ID NO: 159563 - RNA, 63 nt, Homo Sapiens
aauaacugcugcaggugugauguaccuucugaaccucuacaccuuauuucuguaguuggaauc

SEQ ID NO: 159564 - RNA, 63 nt, Homo Sapiens
acaccaaagaggaagaagagcuguggaggccacccucuacaaagcuuuauagaacuucuggau

SEQ ID NO: 159565 - RNA, 63 nt, Homo Sapiens
gucucggcuguaggaaucaacagaaggagacguccucuacauaaaagcuccaugugaaaagcu

SEQ ID NO: 159566 - RNA, 63 nt, Homo Sapiens
cguccuggaggaggugaugcuggucccuggccaccucuacagcccugaacucuugagacaacu

SEQ ID NO: 159567 - RNA, 63 nt, Homo Sapiens
ucugaggcugagaggacaccuauaugcguauuuccucuacacacaucaccccccuucuauaau

SEQ ID NO: 159568 - RNA, 63 nt, Homo Sapiens
cauaguguuacaggaagugaccugaaggcauuuccucuacagauauggcacucuccgaauccu

SEQ ID NO: 159569 - RNA, 63 nt, Homo Sapiens
uuuguaauuaacucugggggccgggccuauuuuccucuacauuacuuuaaauugcaaagucuu

SEQ ID NO: 159570 - RNA, 63 nt, Homo Sapiens
gcagcagggcuccauucucuggccuggcccaggccucuacauacuuacuccagccauuugggg

SEQ ID NO: 159571 - RNA, 63 nt, Homo Sapiens
uggagaacauugcauaggaaugucuggaaaaagccucuacaacuuguuacagccuucacauuu

SEQ ID NO: 159572 - RNA, 63 nt, Homo Sapiens
gagcaugcucacccagcucugcuccaaggccuuccucuacaccuucugccaccaccugcaccu

SEQ ID NO: 159573 - RNA, 63 nt, Homo Sapiens
cuucccucccgauuucccgauucccccacccucccucuacacuugaggaccacaguugggggu

SEQ ID NO: 159574 - RNA, 63 nt, Homo Sapiens
gcugcaaggggaaucgucagaguccaaugugugccucuacaguaaugucggaaauaaauacca

SEQ ID NO: 159575 - RNA, 63 nt, Homo Sapiens
cguuguauguccuuuuuuaaccaagagcccagaccucuacaaagaagagugaaagaacuccug

SEQ ID NO: 159576 - RNA, 63 nt, Homo Sapiens
uggccuauucugggcuagacacaccucuuucugccucuacauagcaaaagagguaagcagauc

SEQ ID NO: 159577 - RNA, 63 nt, Homo Sapiens
gccccuuggggccugcgcccaugcccaccccgcccucuacacggcacugcaggccaggccagg

SEQ ID NO: 159578 - RNA, 63 nt, Homo Sapiens
uaccucuucuauggacugguaacaugcgugugaccucuacagcgcaggagccugagccuuggg

SEQ ID NO: 159579 - RNA, 63 nt, Homo Sapiens
caggggcgcugcugcagaugugcgcuccucaccccucuacagauugcccacccccgauccccg

SEQ ID NO: 159580 - RNA, 63 nt, Homo Sapiens
ucugcuuacuggugugggcauauggauuucaggccucuacacugaaaaaugcuaagucccagc

SEQ ID NO: 159581 - RNA, 63 nt, Homo Sapiens
cuuccucaggccccugucucaguuccgccccacccucuacagccaggaggcguucggaggagg

SEQ ID NO: 159582 - RNA, 63 nt, Homo Sapiens
cacuaggagcaccuuucucagacguagcguuucccucuacaagagggagagccauacugcacg

SEQ ID NO: 159583 - RNA, 63 nt, Homo Sapiens
uuucugagaaagguuuggaugacugaaauauuuccucuacagucaaggacuuuggcauguggu

SEQ ID NO: 159584 - RNA, 63 nt, Homo Sapiens
acauauuuucuucauagucccuaauauagucauccucuacagaguuggcgugcugugugcacu

SEQ ID NO: 159585 - RNA, 63 nt, Homo Sapiens
uuaauugacacagaauacauuucacauauuuaaccucuacaauaaguucugacacauuuucca

SEQ ID NO: 159586 - RNA, 63 nt, Homo Sapiens
gcugucuaggacucacgggguucggaagccacaccucuacaugucuaaaacaaaaaacaacaa

SEQ ID NO: 159587 - RNA, 63 nt, Homo Sapiens
uuuuaguuugcuucaccuaacguuguaguggaaccucuacaugccaacucuucaugccccugc

SEQ ID NO: 159588 - RNA, 63 nt, Homo Sapiens
ugcauggcauccuccagccccuguagaacucaaccucuacaggguuagaguuuggagagagca

SEQ ID NO: 159589 - RNA, 63 nt, Homo Sapiens
agggucgggggaggggggagccuuguagggaggccucuacacagaagaaagcagcccccaugu

SEQ ID NO: 159590 - RNA, 63 nt, Homo Sapiens
caagagcaucaggcucagcuagaagauccacauccucuacaggucggggaccaaaggcugauu

SEQ ID NO: 159591 - RNA, 63 nt, Homo Sapiens
ccaagcguuccuggccuucugaacuccauacagccucuacagccgucccgcguucaagacuug

SEQ ID NO: 159592 - RNA, 63 nt, Homo Sapiens
ugauucugagauggcuuuugcugcucuguucucccucuacauuucucugcagaacucgcguua

SEQ ID NO: 159593 - RNA, 63 nt, Homo Sapiens
guccggcuucgggaagugccccuccacgcucguccucuacagagcugcccccacccgaaagac

SEQ ID NO: 159594 - RNA, 63 nt, Homo Sapiens
uuauggaaagaaaauauuuuaagaaacaaaccaccucuacauaaagaaaagaaaaaaaaaaaa

SEQ ID NO: 159595 - RNA, 63 nt, Homo Sapiens
ccuauaagaagcagguacuuugaucucgcuuuuccucuacaggccuaguccuggccagaagga

SEQ ID NO: 159596 - RNA, 63 nt, Homo Sapiens
gacauccggguacuacauuucuuccuucugaguccucuacaaacacuuaagaccccuccucua

SEQ ID NO: 159597 - RNA, 63 nt, Homo Sapiens
caggaaugagucccuaggggcugcucccagcaaccucuacaucacgcccaguggaugauccua

SEQ ID NO: 159598 - RNA, 63 nt, Homo Sapiens
aaaaaaaaaaaauaauaauacauagcgagacuaccucuacaaauuugagaccacccugggcaa

SEQ ID NO: 159599 - RNA, 63 nt, Homo Sapiens
cccacgcgcaccaccucuccggucgcguggcugccucuacagccuaccuauacgucccuuuuu

SEQ ID NO: 159600 - RNA, 63 nt, Homo Sapiens
agauaccccuucuccucacagucagaacagcagccucuacacauguuguccugccccuggcaa

SEQ ID NO: 159601 - RNA, 63 nt, Homo Sapiens
gggaguggaaauucagccugcuuagaggacugaccucuacaguucauauuugcagugacauaa

SEQ ID NO: 159602 - RNA, 63 nt, Homo Sapiens
cguggcuauaacaucuauaacaaaacgacgauuccucuacaagaggcuguuucucacugcuaa

SEQ ID NO: 159603 - RNA, 63 nt, Homo Sapiens
gcuagauuguaagcuccuggaggacagggaccaccucuacaaaaaauaaaaaaaguaccuccc

SEQ ID NO: 159604 - RNA, 63 nt, Homo Sapiens
uuaaagggggagagggaaaaucuucuucuccuuccucuacauuucacucacaaaccucuuauc

SEQ ID NO: 159605 - RNA, 63 nt, Homo Sapiens
aagcuaucucugggaugccucuaggcccccuucccucuacacaccucugggaaaagauuacac

SEQ ID NO: 159606 - RNA, 63 nt, Homo Sapiens
cugucuucuugcacacgcuggaagcuagccagcccucuacaagauguggcuacaaagugagga

SEQ ID NO: 159607 - RNA, 63 nt, Homo Sapiens
gagucacaggaaggguauaaugaguuagucuucccucuacacguuuuggauucuuauggacug

SEQ ID NO: 159608 - RNA, 63 nt, Homo Sapiens
uuccaagcuagcugcugccuccuuacuccuggcccucuacaugaagaagcucggauacugggu

SEQ ID NO: 159609 - RNA, 63 nt, Homo Sapiens
cgagaccagccuggccaacauggugaaaccccaccucuacaaaaaauacaaaaauuagccggg

SEQ ID NO: 159610 - RNA, 63 nt, Homo Sapiens
uacuguaaacaucuuugcaugucaauaaauaugccucuacaacauauuuuugaaucacuuaau

SEQ ID NO: 159611 - RNA, 63 nt, Homo Sapiens
aaugccaccuaggaggauccaaagucugaaucuccucuacaauguuuccuuucucccaaaaca

SEQ ID NO: 159612 - RNA, 63 nt, Homo Sapiens
uguucauuguuccugguuuuuuccagccagcagccucuacacuccaucauaggacaucgaguc

SEQ ID NO: 159613 - RNA, 63 nt, Homo Sapiens
uucgacgucgcauuugcgcaugaacuccauccaccucuacaccuaucgccuuuuaugaugcuu

SEQ ID NO: 159614 - RNA, 63 nt, Homo Sapiens
aacugagauguguuaaauaauucauaugucacuccucuacacuuaaccuuguggaaagacaug

SEQ ID NO: 159615 - RNA, 63 nt, Homo Sapiens
auacagcccugucacauugaacuacagcauaccccucuacaacagguuaggaaaggauucagc

SEQ ID NO: 159616 - RNA, 63 nt, Homo Sapiens
uuucaaacacauauuaguccuaccaccuuaguuccucuacagcaaaagaggcuuuucuucuua

SEQ ID NO: 159617 - RNA, 64 nt, Homo Sapiens
guugcuggccacucccaccaagaggagcugcuccugccuccauguggggacuacucagaggcaa

SEQ ID NO: 159618 - RNA, 64 nt, Homo Sapiens
caugugucauaagaguaggcacucugguuacccuugccuccaccaaucaaaagaaagaacaagg

SEQ ID NO: 159619 - RNA, 64 nt, Homo Sapiens
caacucuguaucuguuggcuucaagagaauauuuugccuccacauauguaccccuucuccuuuu

SEQ ID NO: 159620 - RNA, 64 nt, Homo Sapiens
uucuccuuuuuuuaaagauggauuuaaaccaagaugccuccaggaaagaggacgaaaugaguau

SEQ ID NO: 159621 - RNA, 64 nt, Homo Sapiens
augacagcaccugacauucugcaccagcuaccucugccuccauggcagagaaaaggccauaaga

SEQ ID NO: 159622 - RNA, 64 nt, Homo Sapiens
ucccuguucuuggaucugccauggagggaucuggugccuccagacgugugcacauaaauccaua

SEQ ID NO: 159623 - RNA, 64 nt, Homo Sapiens
uaccuaaaacugagguggggauggggagaggcuuugccuccaccauucccaccccacccucccc

SEQ ID NO: 159624 - RNA, 64 nt, Homo Sapiens
gcccaggaacaugacaacgugaccacaccacacaugccuccaacacacacccacagucuaaaca

SEQ ID NO: 159625 - RNA, 64 nt, Homo Sapiens
cuuuuaagccagugguucuucagaaucaccuagaugccuccacccuccagagauccugagucca

SEQ ID NO: 159626 - RNA, 64 nt, Homo Sapiens
accagauaaucuucugaaaguguaacucagaugaugccuccaacccuguggcugcccuucacac

SEQ ID NO: 159627 - RNA, 64 nt, Homo Sapiens
aaccaucuuucuguuugucgucuuguugauuugcugccuccacacugucagcuccuugggaaca

SEQ ID NO: 159628 - RNA, 64 nt, Homo Sapiens
gccuccagcagccaugcaugugcgcccgcagcccugccuccacagcucgccacacacucacgcu

SEQ ID NO: 159629 - RNA, 64 nt, Homo Sapiens
cacacucacgcuucgccagagacaggaagugcgcugccuccacggccccuugcccuugcucagg

SEQ ID NO: 159630 - RNA, 64 nt, Homo Sapiens
gccugcuccaguuccgcagccccugccacuucugugccuccacaaacgacaaacuugaguguuu

SEQ ID NO: 159631 - RNA, 64 nt, Homo Sapiens
gccucuccuuggaaggucuugcacccuacccaguugccuccaggcagccaaagcaugccguucu

SEQ ID NO: 159632 - RNA, 64 nt, Homo Sapiens
uuauuuuguacgaguaagggcuuuggaacuaaauugccuccauuugggaaagccugagaaguca

SEQ ID NO: 159633 - RNA, 64 nt, Homo Sapiens
cauuuuucuguacucauacuacgcugaugaaaaaugccuccaaaaccauuuugaugaucaugaa

SEQ ID NO: 159634 - RNA, 64 nt, Homo Sapiens
ggagcacccuagugagaguugaaccccuuccuucugccuccagggccugucugccuccacauca

SEQ ID NO: 159635 - RNA, 64 nt, Homo Sapiens
guugaaccccuuccuucugccuccagggccugucugccuccacaucacucugaggacagggaca

SEQ ID NO: 159636 - RNA, 64 nt, Homo Sapiens
ucuaggaugcagcugccagauccacucacucugcugccuccagcaggacccaaggccacuuuca

SEQ ID NO: 159637 - RNA, 64 nt, Homo Sapiens
cuucacagcucacaggggcaggaggcagcuccccugccuccaggacccuguugcuauggugaca

SEQ ID NO: 159638 - RNA, 64 nt, Homo Sapiens
auccauucccaagaugccugguccugaaagcggcugccuccauuaggagccccuggacaugccu

SEQ ID NO: 159639 - RNA, 64 nt, Homo Sapiens
caaacgggagcuuuuggugaagagccacagggucugccuccagcgcugccagagaagucugguc

SEQ ID NO: 159640 - RNA, 64 nt, Homo Sapiens
gggcuuugaacucuccuagcuccugucccagcccugccuccagggcuccugggcugccagggac

SEQ ID NO: 159641 - RNA, 64 nt, Homo Sapiens
ccucgccaagccucuaugcaccccacaaaguuucugccuccaugccguccacagcgccucuucc

SEQ ID NO: 159642 - RNA, 64 nt, Homo Sapiens
gucuguugggagcagaugugcucacugacguuugugccuccagggcagauuccuaagcagcugg

SEQ ID NO: 159643 - RNA, 64 nt, Homo Sapiens
cuccuguggaagaggguggugggccuuggaacgcugccuccacugaggcgggcacacaaggcgg

SEQ ID NO: 159644 - RNA, 64 nt, Homo Sapiens
cagccaucauaggaagggaccaaggcaaggcaggugccuccaggugugcacguggcauguggcc

SEQ ID NO: 159645 - RNA, 64 nt, Homo Sapiens
uggccugugucccaugacccaccccugugcuccgugccuccaccaccacuggccaccaggcugg

SEQ ID NO: 159646 - RNA, 64 nt, Homo Sapiens
auucccacccacccuccccuauggggagagccuuugccuccaccuaccuaaaacugaggugggg

SEQ ID NO: 159647 - RNA, 64 nt, Homo Sapiens
caugugcacaugaauccauaauggagggaucuggugccuccagacuguccccaacagaucugcc

SEQ ID NO: 159648 - RNA, 64 nt, Homo Sapiens
ggaagguggacuuuuuuggucagccccugguuggugccuccaaacugggcaguugaggaaagga

SEQ ID NO: 159649 - RNA, 64 nt, Homo Sapiens
gcuaccuuuaggagacagagucugccuccaucucugccuccauggaaaccugugaagaguggau

SEQ ID NO: 159650 - RNA, 64 nt, Homo Sapiens
ucugccuccauggcuaccuuugaagaguggauucugccuccaucauguucuauguggaaaccug

SEQ ID NO: 159651 - RNA, 64 nt, Homo Sapiens
gaagcccugggucacccccacucugccucauuucugccuccaggaugccacugccucugcuucc

SEQ ID NO: 159652 - RNA, 64 nt, Homo Sapiens
ugacucaaaagaguuucuggcugaucuguggcuuugccuccaccaucccuaaccaaccucucau

SEQ ID NO: 159653 - RNA, 64 nt, Homo Sapiens
acaugcggcuuccgagggcaccuugccuccaacgugccuccagcucaagucgcggcugcaggau

SEQ ID NO: 159654 - RNA, 64 nt, Homo Sapiens
gugccuccagcacaugcggcggcugcaggauccuugccuccaacacccaugcgauucaagucgc

SEQ ID NO: 159655 - RNA, 64 nt, Homo Sapiens
aacaucaagcaggaaacagacgacugagccuuccugccuccagccuggcuucuagcuggaagcc

SEQ ID NO: 159656 - RNA, 64 nt, Homo Sapiens
aagccagcccagcguuucucuaccaccaccaccaugccuccaccugacuuuggcuuggagacug

SEQ ID NO: 159657 - RNA, 64 nt, Homo Sapiens
ugucuguccgucugugcuuguggcuaugagcgugugccuccacccaccccacgacccgugacua

SEQ ID NO: 159658 - RNA, 64 nt, Homo Sapiens
ccuggcccaggaggccaggaaggagggcccugucugccuccaccucugggugcacccccugccu

SEQ ID NO: 159659 - RNA, 64 nt, Homo Sapiens
gaaugccagccaccuuguaaaacugcugggagaaaagcaugauucccacaaggacuaaguauca

SEQ ID NO: 159660 - RNA, 64 nt, Homo Sapiens
guagacaagaguuaacugaguagcaugcuuuauuaagcaugagaaagaaucuuaagaauuguca

SEQ ID NO: 159661 - RNA, 64 nt, Homo Sapiens
ucccauugcuguuaguuuuagaacuauacccgugaagcaugacuuauuguaagauguuggcuga

SEQ ID NO: 159662 - RNA, 64 nt, Homo Sapiens
cgugaagcaugacuuauuguaagauguuggcugaaagcaugaacuugcagaacucccucggaga

SEQ ID NO: 159663 - RNA, 64 nt, Homo Sapiens
caugugcuucuuugcccuucuaaaaacaccuuuaaagcaugagccucgcccccuugucuuggca

SEQ ID NO: 159664 - RNA, 64 nt, Homo Sapiens
agccugcuuacagggagcgugacucggauuucacaagcaugaccugcugggauuccucccuuag

SEQ ID NO: 159665 - RNA, 64 nt, Homo Sapiens
gacaggcacuauaauuucuguaacacacuaacaaaagcaugaaaaauaggaaccacaccaaugc

SEQ ID NO: 159666 - RNA, 64 nt, Homo Sapiens
uaugaaacuuuccuuugucauuauuagucuucaaaagcaugauuuuuaauaguuguugaguauu

SEQ ID NO: 159667 - RNA, 64 nt, Homo Sapiens
auuccugggguggggggaaacaaaacaaauacugaagcaugaaggacaugaaggcaagaaacag

SEQ ID NO: 159668 - RNA, 64 nt, Homo Sapiens
aggaacagaggugauguuagaggcacugcuaaucaagcaugaaguugguguagucaugggauuu

SEQ ID NO: 159669 - RNA, 64 nt, Homo Sapiens; identical to SEQ ID NO: 68831

SEQ ID NO: 159670 - RNA, 64 nt, Homo Sapiens; identical to SEQ ID NO: 68832

SEQ ID NO: 159671 - RNA, 64 nt, Homo Sapiens; identical to SEQ ID NO: 68833

SEQ ID NO: 159672 - RNA, 64 nt, Homo Sapiens; identical to SEQ ID NO: 68834

SEQ ID NO: 159673 - RNA, 64 nt, Homo Sapiens; identical to SEQ ID NO: 68835

SEQ ID NO: 159674 - RNA, 64 nt, Homo Sapiens; identical to SEQ ID NO: 68836

SEQ ID NO: 159675 - RNA, 64 nt, Homo Sapiens; identical to SEQ ID NO: 68837

SEQ ID NO: 159676 - RNA, 64 nt, Homo Sapiens; identical to SEQ ID NO: 68838

SEQ ID NO: 159677 - RNA, 64 nt, Homo Sapiens; identical to SEQ ID NO: 68839

SEQ ID NO: 159678 - RNA, 64 nt, Homo Sapiens; identical to SEQ ID NO: 68840

SEQ ID NO: 159679 - RNA, 64 nt, Homo Sapiens; identical to SEQ ID NO: 68841

SEQ ID NO: 159680 - RNA, 64 nt, Homo Sapiens; identical to SEQ ID NO: 68842

SEQ ID NO: 159681 - RNA, 64 nt, Homo Sapiens; identical to SEQ ID NO: 68843

SEQ ID NO: 159682 - RNA, 64 nt, Homo Sapiens; identical to SEQ ID NO: 68844

SEQ ID NO: 159683 - RNA, 64 nt, Homo Sapiens; identical to SEQ ID NO: 68845

SEQ ID NO: 159684 - RNA, 64 nt, Homo Sapiens; identical to SEQ ID NO: 68846

SEQ ID NO: 159685 - RNA, 64 nt, Homo Sapiens; identical to SEQ ID NO: 68847

SEQ ID NO: 159686 - RNA, 64 nt, Homo Sapiens; identical to SEQ ID NO: 68848

SEQ ID NO: 159687 - RNA, 64 nt, Homo Sapiens; identical to SEQ ID NO: 68849

SEQ ID NO: 159688 - RNA, 64 nt, Homo Sapiens; identical to SEQ ID NO: 68850

SEQ ID NO: 159689 - RNA, 64 nt, Homo Sapiens; identical to SEQ ID NO: 68851

SEQ ID NO: 159690 - RNA, 64 nt, Homo Sapiens; identical to SEQ ID NO: 68852

SEQ ID NO: 159691 - RNA, 64 nt, Homo Sapiens; identical to SEQ ID NO: 68853

SEQ ID NO: 159692 - RNA, 64 nt, Homo Sapiens; identical to SEQ ID NO: 68854

SEQ ID NO: 159693 - RNA, 64 nt, Homo Sapiens; identical to SEQ ID NO: 68855

SEQ ID NO: 159694 - RNA, 64 nt, Homo Sapiens; identical to SEQ ID NO: 68856

SEQ ID NO: 159695 - RNA, 64 nt, Homo Sapiens; identical to SEQ ID NO: 68857

SEQ ID NO: 159696 - RNA, 64 nt, Homo Sapiens; identical to SEQ ID NO: 68858

SEQ ID NO: 159697 - RNA, 64 nt, Homo Sapiens; identical to SEQ ID NO: 68859

SEQ ID NO: 159698 - RNA, 64 nt, Homo Sapiens; identical to SEQ ID NO: 68860

SEQ ID NO: 159699 - RNA, 64 nt, Homo Sapiens; identical to SEQ ID NO: 68861

SEQ ID NO: 159700 - RNA, 64 nt, Homo Sapiens; identical to SEQ ID NO: 68862

SEQ ID NO: 159701 - RNA, 64 nt, Homo Sapiens; identical to SEQ ID NO: 68863

SEQ ID NO: 159702 - RNA, 64 nt, Homo Sapiens; identical to SEQ ID NO: 68864

SEQ ID NO: 159703 - RNA, 64 nt, Homo Sapiens; identical to SEQ ID NO: 68865

SEQ ID NO: 159704 - RNA, 64 nt, Homo Sapiens; identical to SEQ ID NO: 68866

SEQ ID NO: 159705 - RNA, 64 nt, Homo Sapiens; identical to SEQ ID NO: 68867

SEQ ID NO: 159706 - RNA, 64 nt, Homo Sapiens; identical to SEQ ID NO: 68868

SEQ ID NO: 159707 - RNA, 64 nt, Homo Sapiens; identical to SEQ ID NO: 68869

SEQ ID NO: 159708 - RNA, 64 nt, Homo Sapiens; identical to SEQ ID NO: 68870

SEQ ID NO: 159709 - RNA, 64 nt, Homo Sapiens; identical to SEQ ID NO: 68871

SEQ ID NO: 159710 - RNA, 64 nt, Homo Sapiens; identical to SEQ ID NO: 68872

SEQ ID NO: 159711 - RNA, 64 nt, Homo Sapiens; identical to SEQ ID NO: 68873

SEQ ID NO: 159712 - RNA, 64 nt, Homo Sapiens; identical to SEQ ID NO: 68874

SEQ ID NO: 159713 - RNA, 64 nt, Homo Sapiens; identical to SEQ ID NO: 68875

SEQ ID NO: 159714 - RNA, 64 nt, Homo Sapiens; identical to SEQ ID NO: 68876

SEQ ID NO: 159715 - RNA, 64 nt, Homo Sapiens; identical to SEQ ID NO: 68877

SEQ ID NO: 159716 - RNA, 64 nt, Homo Sapiens; identical to SEQ ID NO: 68877

SEQ ID NO: 159717 - RNA, 64 nt, Homo Sapiens; identical to SEQ ID NO: 68879

SEQ ID NO: 159718 - RNA, 64 nt, Homo Sapiens; identical to SEQ ID NO: 68880

SEQ ID NO: 159719 - RNA, 64 nt, Homo Sapiens; identical to SEQ ID NO: 68881

SEQ ID NO: 159720 - RNA, 64 nt, Homo Sapiens; identical to SEQ ID NO: 68882

SEQ ID NO: 159721 - RNA, 64 nt, Homo Sapiens; identical to SEQ ID NO: 68883

SEQ ID NO: 159722 - RNA, 64 nt, Homo Sapiens; identical to SEQ ID NO: 68884

SEQ ID NO: 159723 - RNA, 64 nt, Homo Sapiens; identical to SEQ ID NO: 68885

SEQ ID NO: 159724 - RNA, 64 nt, Homo Sapiens; identical to SEQ ID NO: 68886

SEQ ID NO: 159725 - RNA, 64 nt, Homo Sapiens; identical to SEQ ID NO: 68887

SEQ ID NO: 159726 - RNA, 64 nt, Homo Sapiens; identical to SEQ ID NO: 68888

SEQ ID NO: 159727 - RNA, 64 nt, Homo Sapiens; identical to SEQ ID NO: 68889

SEQ ID NO: 159728 - RNA, 64 nt, Homo Sapiens; identical to SEQ ID NO: 68890

SEQ ID NO: 159729 - RNA, 64 nt, Homo Sapiens; identical to SEQ ID NO: 68891

SEQ ID NO: 159730 - RNA, 64 nt, Homo Sapiens; identical to SEQ ID NO: 68892

SEQ ID NO: 159731 - RNA, 64 nt, Homo Sapiens; identical to SEQ ID NO: 68893

SEQ ID NO: 159732 - RNA, 64 nt, Homo Sapiens; identical to SEQ ID NO: 68894

SEQ ID NO: 159733 - RNA, 64 nt, Homo Sapiens; identical to SEQ ID NO: 68895

SEQ ID NO: 159734 - RNA, 64 nt, Homo Sapiens; identical to SEQ ID NO: 68896

SEQ ID NO: 159735 - RNA, 64 nt, Homo Sapiens; identical to SEQ ID NO: 68897

SEQ ID NO: 159736 - RNA, 64 nt, Homo Sapiens; identical to SEQ ID NO: 68898

SEQ ID NO: 159737 - RNA, 64 nt, Homo Sapiens; identical to SEQ ID NO: 68899

SEQ ID NO: 159738 - RNA, 64 nt, Homo Sapiens; identical to SEQ ID NO: 68900

SEQ ID NO: 159739 - RNA, 64 nt, Homo Sapiens; identical to SEQ ID NO: 68901

SEQ ID NO: 159740 - RNA, 64 nt, Homo Sapiens; identical to SEQ ID NO: 68902

SEQ ID NO: 159741 - RNA, 64 nt, Homo Sapiens; identical to SEQ ID NO: 68903

SEQ ID NO: 159742 - RNA, 64 nt, Homo Sapiens; identical to SEQ ID NO: 68904

SEQ ID NO: 159743 - RNA, 64 nt, Homo Sapiens; identical to SEQ ID NO: 68905

SEQ ID NO: 159744 - RNA, 64 nt, Homo Sapiens; identical to SEQ ID NO: 68906

SEQ ID NO: 159745 - RNA, 64 nt, Homo Sapiens; identical to SEQ ID NO: 68907

SEQ ID NO: 159746 - RNA, 64 nt, Homo Sapiens; identical to SEQ ID NO: 68908

SEQ ID NO: 159747 - RNA, 64 nt, Homo Sapiens; identical to SEQ ID NO: 68909

SEQ ID NO: 159748 - RNA, 64 nt, Homo Sapiens; identical to SEQ ID NO: 68910

SEQ ID NO: 159749 - RNA, 64 nt, Homo Sapiens; identical to SEQ ID NO: 68911

SEQ ID NO: 159750 - RNA, 64 nt, Homo Sapiens; identical to SEQ ID NO: 68912

SEQ ID NO: 159751 - RNA, 64 nt, Homo Sapiens; identical to SEQ ID NO: 68913

SEQ ID NO: 159752 - RNA, 64 nt, Homo Sapiens; identical to SEQ ID NO: 68914

SEQ ID NO: 159753 - RNA, 64 nt, Homo Sapiens; identical to SEQ ID NO: 68915

SEQ ID NO: 159754 - RNA, 64 nt, Homo Sapiens; identical to SEQ ID NO: 68916

SEQ ID NO: 159755 - RNA, 64 nt, Homo Sapiens; identical to SEQ ID NO: 68917

SEQ ID NO: 159756 - RNA, 64 nt, Homo Sapiens; identical to SEQ ID NO: 68918

SEQ ID NO: 159757 - RNA, 64 nt, Homo Sapiens; identical to SEQ ID NO: 68919

SEQ ID NO: 159758 - RNA, 64 nt, Homo Sapiens; identical to SEQ ID NO: 68920

SEQ ID NO: 159759 - RNA, 64 nt, Homo Sapiens; identical to SEQ ID NO: 68921

SEQ ID NO: 159760 - RNA, 64 nt, Homo Sapiens; identical to SEQ ID NO: 68922

SEQ ID NO: 159761 - RNA, 64 nt, Homo Sapiens; identical to SEQ ID NO: 68923

SEQ ID NO: 159762 - RNA, 64 nt, Homo Sapiens; identical to SEQ ID NO: 68924

SEQ ID NO: 159763 - RNA, 64 nt, Homo Sapiens; identical to SEQ ID NO: 68925

SEQ ID NO: 159764 - RNA, 64 nt, Homo Sapiens; identical to SEQ ID NO: 68926

SEQ ID NO: 159765 - RNA, 64 nt, Homo Sapiens; identical to SEQ ID NO: 68927

SEQ ID NO: 159766 - RNA, 64 nt, Homo Sapiens; identical to SEQ ID NO: 68928

SEQ ID NO: 159767 - RNA, 64 nt, Homo Sapiens; identical to SEQ ID NO: 68929

SEQ ID NO: 159768 - RNA, 64 nt, Homo Sapiens; identical to SEQ ID NO: 68930

SEQ ID NO: 159769 - RNA, 64 nt, Homo Sapiens; identical to SEQ ID NO: 68931

SEQ ID NO: 159770 - RNA, 64 nt, Homo Sapiens; identical to SEQ ID NO: 68932

SEQ ID NO: 159771 - RNA, 64 nt, Homo Sapiens; identical to SEQ ID NO: 68933

SEQ ID NO: 159772 - RNA, 64 nt, Homo Sapiens; identical to SEQ ID NO: 68934

SEQ ID NO: 159773 - RNA, 64 nt, Homo Sapiens; identical to SEQ ID NO: 68935

SEQ ID NO: 159774 - RNA, 64 nt, Homo Sapiens
uucagcuagggaaagcaguugcgggcaggggguggggggagauuauauucacuccugccaagga

SEQ ID NO: 159775 - RNA, 64 nt, Homo Sapiens
agccuccuacuucugggauugcagaucagggguggggggagaauguugcauguuguuuucuggu

SEQ ID NO: 159776 - RNA, 64 nt, Homo Sapiens
cugaggagagugugacaugugggagagcaggguugggggagaggugggcuagggcaggggagga

SEQ ID NO: 159777 - RNA, 64 nt, Homo Sapiens
agagaggagcugggcuauggaagaauugguaguagggggagaacuaaaaauuguguaagagcca

SEQ ID NO: 159778 - RNA, 64 nt, Homo Sapiens
augacuucugccuucaucugagaaguugaggggugggggagagauccuaucuccacaucucuga

SEQ ID NO: 159779 - RNA, 64 nt, Homo Sapiens
ggagauuuaaaggaccagggguuuauuaguuauggggggagaggggaaaauuuauuuauuuauu

SEQ ID NO: 159780 - RNA, 64 nt, Homo Sapiens
gggcugaagcugcuccaccucauccuugcugagugggggagacauuuucccugaaagucagaag

SEQ ID NO: 159781 - RNA, 64 nt, Homo Sapiens
aggccuagagcagacccuuuagaaaucagcccaagggggagagcaagagaaaacacucuaggga

SEQ ID NO: 159782 - RNA, 64 nt, Homo Sapiens
ggucagcacuugggcccacugacagugacugacugggggagaagguccugcagcccccuucccc

SEQ ID NO: 159783 - RNA, 64 nt, Homo Sapiens
uuccugcaccucaggaugggcgagggugggcauugggggagagggggaccugggaccugcggcu

SEQ ID NO: 159784 - RNA, 64 nt, Homo Sapiens
cgcugcauuccagaaacgucaccauguugacuaugggggagagagauagauuacagauauaaua

SEQ ID NO: 159785 - RNA, 64 nt, Homo Sapiens
uaacagagcguggaagggggccuuucccccuucugggggagacuugugcuacugaagggaacug

SEQ ID NO: 159786 - RNA, 64 nt, Homo Sapiens
uagagaugagacaagagguaagaggcaggggucagggggagagggauuugcugcaaaaugaccc

SEQ ID NO: 159787 - RNA, 64 nt, Homo Sapiens
caggaauaaggggauccccauccaggugggggaggggggagaguggugcagggccuaggucucu

SEQ ID NO: 159788 - RNA, 64 nt, Homo Sapiens
gcugggggccggagggcagggcaucugaaugugcgggggagaggcuuuugcccugcgcacaauu

SEQ ID NO: 159789 - RNA, 64 nt, Homo Sapiens
aggcagauaauuaaaccaucgcuggguggggguggggggagaaaagucuguccgacaggaagcu

SEQ ID NO: 159790 - RNA, 64 nt, Homo Sapiens
aguucaucugagucagugcauucuuaucaaagaagggggagaaccagaggcugcugccaccuac

SEQ ID NO: 159791 - RNA, 64 nt, Homo Sapiens
ggaaggacaggucaggucucuggaugggaaucuggggggagagacagcuaugcuuuuggagucc

SEQ ID NO: 159792 - RNA, 64 nt, Homo Sapiens
ggcgagaaggggaaaaauggguuacuuuuaggaugggggagagguuucuuguaagccaucagaa

SEQ ID NO: 159793 - RNA, 64 nt, Homo Sapiens
gaagauaggacguauuuauaaauuaugauguccagggggagaaggaguccuuaagacggaagua

SEQ ID NO: 159794 - RNA, 64 nt, Homo Sapiens
gacacuccuccucggaagagugaagcacagcaccgggggagaggccgcgugcuggagaauugac

SEQ ID NO: 159795 - RNA, 64 nt, Homo Sapiens
gagcagggugcugugggugauauggacagcagaagggggagaccaagguuccagcucaaccaau

SEQ ID NO: 159796 - RNA, 64 nt, Homo Sapiens
cugagaccccccaccaccagccgguaccugggaagggggagagugcaggccugcucagggacug

SEQ ID NO: 159797 - RNA, 64 nt, Homo Sapiens
auggaccuacauccccagcagauggggguggcaagggggagacgggugggggucgcugacuaua

SEQ ID NO: 159798 - RNA, 64 nt, Homo Sapiens
gaugaccgcgauggccugcagcaacucuaugguagggggagagggaccugccgcgaaaccauca

SEQ ID NO: 159799 - RNA, 64 nt, Homo Sapiens
accuucucuaagaugaacagggucucugaauuaagggggagacguuuguuaaaucaaauuagcu

SEQ ID NO: 159800 - RNA, 64 nt, Homo Sapiens
guuacagguuggacaugaugcucauggaagaagagggggagagaaggaauccuggucucaggac

SEQ ID NO: 159801 - RNA, 64 nt, Homo Sapiens
aacaacaaaaugagaagaagagguuccucgaaaggggggagaagaaauuuugagaauggaaaaa

SEQ ID NO: 159802 - RNA, 64 nt, Homo Sapiens
uccagcuucuucccccagcugcucccgaccaggagggggagagcagccuccacuuaccccaccc

SEQ ID NO: 159803 - RNA, 64 nt, Homo Sapiens
ugccccccuccuccuugagaugcugcuuguaguugggggagaggccuccuuggcuuggcuuugc

SEQ ID NO: 159804 - RNA, 64 nt, Homo Sapiens
gcuuguggcuccuguccgagaugcauuguggguggggggagaaaagauggguccccugggguag

SEQ ID NO: 159805 - RNA, 64 nt, Homo Sapiens
aacagccauuaacacaguaugggagaaauggguggggggagaggccuaaaaagcauguagaugg

SEQ ID NO: 159806 - RNA, 64 nt, Homo Sapiens
uggguggggggagaggaacaaaaagcauguagaugggggagaaaaaggggagagguuuggccua

SEQ ID NO: 159807 - RNA, 64 nt, Homo Sapiens
uuauaugggcuuuuaaguaaagcuuagaacccuggggggagaaaagcagucaggugagguuuga

SEQ ID NO: 159808 - RNA, 64 nt, Homo Sapiens
ccaguaauccucuucuguggugggaugggagggugggggagagggguggaauggagaggaaaca

SEQ ID NO: 159809 - RNA, 64 nt, Homo Sapiens
gagagauacagagccggcuuagagaacagcuguugggggagaagagggcaccccucaucuugga

SEQ ID NO: 159810 - RNA, 64 nt, Homo Sapiens
cucccuggcuugggagaccgcucucugcaagggagggggagagaagcagagggagagagaaggu

SEQ ID NO: 159811 - RNA, 64 nt, Homo Sapiens
gagggcaggagggcucggccugagcagggugcuggggggagagcgcaauaccucacgcgggcug

SEQ ID NO: 159812 - RNA, 64 nt, Homo Sapiens
gccaccucguugcacuggaucccaguggcugcuugggggagaggcguuugccaucacugguguu

SEQ ID NO: 159813 - RNA, 64 nt, Homo Sapiens
ucggaugcaucucuccaaaacuugagaguuugccagcagcgagcgagggagccgcacacuugga

SEQ ID NO: 159814 - RNA, 64 nt, Homo Sapiens
gccucugcggagcugccaguacggcuguguucccagcagcgaagagaugaguuccgacacuguc

SEQ ID NO: 159815 - RNA, 64 nt, Homo Sapiens
aacucuggcuggacaagggucagucuucggggucagcagcgagauugcucugcagccagugagg

SEQ ID NO: 159816 - RNA, 64 nt, Homo Sapiens
uuugguguguaugcaccuuggcagccagcaggaaagcagcgaagagccgcgcgcccucuggccu

SEQ ID NO: 159817 - RNA, 64 nt, Homo Sapiens
ggaaaacgacauuauaugugacuuaaaaccuagaagaaauaaauaaaacuauugaucaauuuua

SEQ ID NO: 159818 - RNA, 64 nt, Homo Sapiens
guauaaaaacaacuguauugaguugaggcuguggagaaauaaggacacauauaugggaauggaa

SEQ ID NO: 159819 - RNA, 64 nt, Homo Sapiens
uuaaaguuuauuagacaaaaaaaaguauaaggagagaaauaacuacuccgucucgaaaaaaaaa

SEQ ID NO: 159820 - RNA, 64 nt, Homo Sapiens
gcaaaagagaacaucuuuuuuucccacuauagcaagaaauaaagcccagguagcagaacucacg

SEQ ID NO: 159821 - RNA, 64 nt, Homo Sapiens
aaugacaugugggaauugcaauuuuacuauggaaagaaauaacaccaguuuucuaucacuuuaa

SEQ ID NO: 159822 - RNA, 64 nt, Homo Sapiens
uuuuaguuaauggaagaauucagcauguaucuguagaaauaacuguugauacuuuaaaucucuu

SEQ ID NO: 159823 - RNA, 64 nt, Homo Sapiens
uagagauuuuuaaacucugaaagugguguuuguuagaaauaaacaagccugugagucaagcauc

SEQ ID NO: 159824 - RNA, 64 nt, Homo Sapiens
uauuaaaauuuacaucuuaauucaaguucaaaaaagaaauaaugucaucccauucugguucccg

SEQ ID NO: 159825 - RNA, 64 nt, Homo Sapiens
cuuugaauauuucaagaauaccaauguauagcuuagaaauaaaauaaugguuuauuauagaaua

SEQ ID NO: 159826 - RNA, 64 nt, Homo Sapiens
auacugcaauuuugugcuggaugcaauacuaaagagaaauaagaaguuuaagcuuuauucauuc

SEQ ID NO: 159827 - RNA, 64 nt, Homo Sapiens
gugacgacaaagauucuguuucaaauauagccacagaaauaaaggagggaccaauaucugggac

SEQ ID NO: 159828 - RNA, 64 nt, Homo Sapiens
gugacgagaaagauucuguuucaaauauagccacagaaauaaagaagggacaacaaucugggac

SEQ ID NO: 159829 - RNA, 64 nt, Homo Sapiens
gugacaagacagauucugcuuugaauauagcuacagaaauaaaggauggacuacagugugggac

SEQ ID NO: 159830 - RNA, 64 nt, Homo Sapiens
cugacgaggaagacucuguuucgaauauagccacagaaauaaaggauggagaaaaaucugggac

SEQ ID NO: 159831 - RNA, 64 nt, Homo Sapiens
cugaugagaaagauucuguuucgaacauagccacagaaauaaaggauggagaaaaaucugggac

SEQ ID NO: 159832 - RNA, 64 nt, Homo Sapiens
aaugaucaguaugcugugccagcuucauuuggggagaaauaacuaguagaaaguucugggugug

SEQ ID NO: 159833 - RNA, 64 nt, Homo Sapiens
guaccuacuugaaaggaucauugugcggauuaaaagaaauaauauauguaaagcacuuuaacac

SEQ ID NO: 159834 - RNA, 64 nt, Homo Sapiens
cuguaaauacucuugcuguguuauaaauauggcaagaaauaaacaugaccaauaucaauagacu

SEQ ID NO: 159835 - RNA, 64 nt, Homo Sapiens
aucaauagacuucuugaggcuacuauaaguuuugagaaauaagguucaaaaaauaagaaugcua

SEQ ID NO: 159836 - RNA, 64 nt, Homo Sapiens
cgucgcauuuaauaacaagcaacacacggcauauagaaauaacuuuaauuaaaaaacuuacaua

SEQ ID NO: 159837 - RNA, 64 nt, Homo Sapiens
caucugguuguuccuccagggauacugcucauuuagaaauaaauugcaugaguauaacaauuuu

SEQ ID NO: 159838 - RNA, 61 nt, Homo Sapiens
uggugauagucugguguuacgggcagggaggagaaauaaagauaaaaaauucaguaguuag

SEQ ID NO: 159839 - RNA, 64 nt, Homo Sapiens
gugcucccaaauauucaguaaaccaguagaaaacagaaauaauggaguauauuuucaagccaag

SEQ ID NO: 159840 - RNA, 64 nt, Homo Sapiens
aaguagguuucaguugucuuccuuuuggaaucacagaaauaaacaccaguuggguuuuuugcgu

SEQ ID NO: 159841 - RNA, 64 nt, Homo Sapiens
aaaaucauguauaccaucuuaauuaaaggaauggagaaauaaucacuugagggggacgucccaa

SEQ ID NO: 159842 - RNA, 64 nt, Homo Sapiens
aaaaaaaauuagguguuuagcauuuacagucaauagaaauaauggugagcaguagaagagacca

SEQ ID NO: 159843 - RNA, 64 nt, Homo Sapiens
gacaaaaggacaucacucuuaguugugagcaaauagaaauaaaaaaaccuuuauuuuaaaguca

SEQ ID NO: 159844 - RNA, 64 nt, Homo Sapiens
auuuaugaauuauaaauaugaauuuaauuacuaaagaaauaaaaauaaugguguaaagccaacu

SEQ ID NO: 159845 - RNA, 64 nt, Homo Sapiens
gaaucugaauaagcuuccaaaauuuuuuuuuuuaagaaauaaagggagcuguguagugggucag

SEQ ID NO: 159846 - RNA, 64 nt, Homo Sapiens
guuccacauuuggaagacaauuuaaugauggugaagaaauaauaaaccucacuuuacuuguuaa

SEQ ID NO: 159847 - RNA, 64 nt, Homo Sapiens
auauauauauauauauaugucugcaacuucagggagaaauaagauuguguuugaauauuguagg

SEQ ID NO: 159848 - RNA, 64 nt, Homo Sapiens
agacauaauaagagguguaaaaacuaucacaggaagaaauaaaaacagauuuuugaaggugaga

SEQ ID NO: 159849 - RNA, 64 nt, Homo Sapiens
uccaaagaaagcagaaagaaggaaagccuagaacagaaauaaaugaaauagagaauagaaaagc

SEQ ID NO: 159850 - RNA, 64 nt, Homo Sapiens
gaaacaaaagucaagauuuuauuaccaaacuuauagaaauaaaaauuauuagaaagaaauacua

SEQ ID NO: 159851 - RNA, 64 nt, Homo Sapiens
uuuuucaaauaagaaaauugaacaauaagaaauaagaaauaauucuguaaagucuauucuguuu

SEQ ID NO: 159852 - RNA, 64 nt, Homo Sapiens
aauaauuuuuuucaaauaagucuguuuaacaauaagaaauaagaguuguuacuguaaagucuau

SEQ ID NO: 159853 - RNA, 64 nt, Homo Sapiens
ggccaggcacaguggcucacauucagccauaaaaagaaauaaaguccauacaauggacuauauu

SEQ ID NO: 159854 - RNA, 64 nt, Homo Sapiens
gaaaguaguaagucguuaacucuucuguuuauggagaaauaauauuuccucuucuggucuuucc

SEQ ID NO: 159855 - RNA, 64 nt, Homo Sapiens
guuacacaauuugcauuggauuaaaaaucaaggaagaaauaaauuuaagaauacuaaaguauuu

SEQ ID NO: 159856 - RNA, 64 nt, Homo Sapiens
uggaauuagcagcuaugacuuucaagguguguagagaaauaauauaccaguaauacacuaaauu

SEQ ID NO: 159857 - RNA, 64 nt, Homo Sapiens
uggcuuacugugucugaagauacugacaugcagaagaaauaagugcauucuucugcuuuucacc

SEQ ID NO: 159858 - RNA, 64 nt, Homo Sapiens
ggguugauuuuuuugcucuccauuuugacuugcaagaaauaauaccucaagauaaucugauuua

SEQ ID NO: 159859 - RNA, 64 nt, Homo Sapiens
uggagauguugaaaaucauuuucccuucuuaaacagaaauaaauauuuggaaugaaggggaaug

SEQ ID NO: 159860 - RNA, 64 nt, Homo Sapiens
uuuuuguucacaugaccaaaaaaagccuuuuuuaagaaauaaauccuugaaaaacaaagaccua

SEQ ID NO: 159861 - RNA, 64 nt, Homo Sapiens
aguaaagccagaggccauuagaacgcagggaaggagaaauaaagcacaguggaacgcaggcuga

SEQ ID NO: 159862 - RNA, 64 nt, Homo Sapiens
cuguagcauauucacuaaacagauuuucaaacauagaaauaaaggugauuuaaaacguuuguug

SEQ ID NO: 159863 - RNA, 64 nt, Homo Sapiens
uaaucaacguacaacucuuuccuauuaugauuuuagaaauaagagccuguuuuguaauucaggg

SEQ ID NO: 159864 - RNA, 64 nt, Homo Sapiens
cuccuaguaaaguuauucaucuuuuggauuggaaagaaauaaagaagucacuaucuuauguuuu

SEQ ID NO: 159865 - RNA, 64 nt, Homo Sapiens
acuucuuuggugauacacuguagccacuagaaagagaaauaaacccaauggcauguguuuacag

SEQ ID NO: 159866 - RNA, 64 nt, Homo Sapiens
aaccuaacuuuaguagcaaaucuugauuaauugaagaaauaaaauauuucggauaagguuucau

SEQ ID NO: 159867 - RNA, 64 nt, Homo Sapiens
ccccaucuacuauaaagaaaugucuucgagauguagaaauaaggaauauucugaaaauaaaaau

SEQ ID NO: 159868 - RNA, 64 nt, Homo Sapiens
cugcaggagugcccugcauuguuuucuuuuaauuagaaauaaaaaguauuagucuaaauguggu

SEQ ID NO: 159869 - RNA, 64 nt, Homo Sapiens
uuuugaucacuucaaauacauacucuucaagucaagaaauaaauuucuuuacauagaaaaggau

SEQ ID NO: 159870 - RNA, 64 nt, Homo Sapiens
uuaucguauucauacuacuguucaaucuuuauuuagaaauaaacuuuaucuaugauuucauuuu

SEQ ID NO: 159871 - RNA, 64 nt, Homo Sapiens
gcaugcccucagcuuuuaauaaguagggucauagagaaauaaaaaggauaauacaguccaugca

SEQ ID NO: 159872 - RNA, 64 nt, Homo Sapiens
acaccccaauaguuuccuaguuauuuucauguuuagaaauaaucucuuacaauuauuaauuauu

SEQ ID NO: 159873 - RNA, 64 nt, Homo Sapiens
caaggcacugauaaaaccgcaacaaaaacauguaagaaauaaaauagaaaugcuuuauauaauu

SEQ ID NO: 159874 - RNA, 64 nt, Homo Sapiens
ucuuuuuguguuuggaguguaguccauuugcaauagaaauaaaaaaauccgucaccaaauugua

SEQ ID NO: 159875 - RNA, 64 nt, Homo Sapiens
cauugcuaaaauaaaaaauacaccuuaauuuuuaagaaauaauuuaaaugaaacaauuuccauu

SEQ ID NO: 159876 - RNA, 64 nt, Homo Sapiens
uuuuuauauauugguguaaacauaauauucuucaagaaauaauguugaaagccuacucaggaau

SEQ ID NO: 159877 - RNA, 64 nt, Homo Sapiens
acugucuggggaugugugguuauaguucugugggagaaauaauuuugucaguguucaccagcuu

SEQ ID NO: 159878 - RNA, 64 nt, Homo Sapiens
uaauuuugaaccaauuuauuauuguguacugaggagaaauaauguauaguagaggacagccuug

SEQ ID NO: 159879 - RNA, 64 nt, Homo Sapiens
auuauuuuauguugugccagugaauccaguugccagaaauaagucugaauguuuucaugcaucu

SEQ ID NO: 159880 - RNA, 64 nt, Homo Sapiens
uguaaugugacccuagaaaacuguagcaagcuucagaaauaaaucuuuugaucuuucccuaucu

SEQ ID NO: 159881 - RNA, 64 nt, Homo Sapiens
uucuauuguuuaagucacccccuccaaaacuaugagaaauaaauccuugaucuuggacuuccag

SEQ ID NO: 159882 - RNA, 64 nt, Homo Sapiens
acuacggguagaaaacauaaaucuuuuacgcagaagaaauaaaaauaucaaauaaguaucacaa

SEQ ID NO: 159883 - RNA, 64 nt, Homo Sapiens
gugugacauaaagugcccuucaaauaacaauagcagaaauaacaaaagaguauugaaggaacaa

SEQ ID NO: 159884 - RNA, 64 nt, Homo Sapiens
acaaaaaacaagaagcaagucaaccuuagcauuaagaaauaaaaacaaacaaacaaacaaaaaa

SEQ ID NO: 159885 - RNA, 64 nt, Homo Sapiens
gaaaaugaagagagaggguuuuaccauccugagaagaaauaaugauggaaacauguuuaauguu

SEQ ID NO: 159886 - RNA, 64 nt, Homo Sapiens
auaacacugaccucuggaaaauauuuuguucacaagaaauaauaaaguauaaugauuuguugca

SEQ ID NO: 159887 - RNA, 64 nt, Homo Sapiens
uguuauuucuguucagaucuaacagugacaauacagaaauaaggccaagccagauagucucgug

SEQ ID NO: 159888 - RNA, 64 nt, Homo Sapiens
auaguuuuuauuuacccauuuugcuauuuugcaaagaaauaauuaaccaguuaaguuauaccug

SEQ ID NO: 159889 - RNA, 64 nt, Homo Sapiens
uacauuggccuuugugaaauaacuuugauaaaauagaaauaaucuuacaccaacugugcaaaug

SEQ ID NO: 159890 - RNA, 64 nt, Homo Sapiens
cucaguuuuccaucuguuuuauaucaaauccugaagaaauaagcguagaauaacuccugaguuu

SEQ ID NO: 159891 - RNA, 64 nt, Homo Sapiens
uugacuuugaaucugcaacauuccuguagaacugagaaauaagauuugaaucugucuuagccag

SEQ ID NO: 159892 - RNA, 64 nt, Homo Sapiens
caugauucaacugcaucuccucugaauucagugaagaaauaauuauuugaaauaauuguauuuc

SEQ ID NO: 159893 - RNA, 64 nt, Homo Sapiens
ucuaaaauugcuauccugauuguaagcaguaccuagaaauaaucauucaguacaagagaaguac

SEQ ID NO: 159894 - RNA, 64 nt, Homo Sapiens
uaaaacugcagaaggaucugaaagguaccucuguagaaauaaccaaugugguauucauucacuu

SEQ ID NO: 159895 - RNA, 64 nt, Homo Sapiens
cuguaaggaaauuuaaaaaacucaguugucuagaagaaauaacacacuuuucuuucuccaccca

SEQ ID NO: 159896 - RNA, 64 nt, Homo Sapiens
caacaaaggggaacuauaucagaauguauauuuaagaaauaaaaacaugaaaauauuccuuagu

SEQ ID NO: 159897 - RNA, 64 nt, Homo Sapiens
guagcaguagagaauuuauaagugugguagaaaaagaaauaaugugcagaaaaguugauugcaa

SEQ ID NO: 159898 - RNA, 64 nt, Homo Sapiens
ccuuccacuuugaccccaugcuacugagcccugaagaaauaaguggugcgcgccaggaugugga

SEQ ID NO: 159899 - RNA, 64 nt, Homo Sapiens
aagauccgagcagaacugaagcuagcagaaggcaagaaauaacuaagagcaaacacauucaaaa

SEQ ID NO: 159900 - RNA, 64 nt, Homo Sapiens
auauucucugaaagcaaugaaacgaaaugaaggcagaaauaaagugaaugaguacuggguacau

SEQ ID NO: 159901 - RNA, 64 nt, Homo Sapiens
aaaggcgaacucugccuuggagagguagaugauaagaaauaaaaagguguuuauaacuauuuug

SEQ ID NO: 159902 - RNA, 64 nt, Homo Sapiens
guguuucaggaugauacaaagaaaaauauagaauagaaauaagugcaggcuuggaaucagcuac

SEQ ID NO: 159903 - RNA, 64 nt, Homo Sapiens
cuguugucuaaagccaaggagucauaaaaccaugagaaauaaauaggaaucaauaguuaguagu

SEQ ID NO: 159904 - RNA, 64 nt, Homo Sapiens
aagacaaaaugcuaugacuuugaaauucacagaaagaaauaacaguuuagauuaggucuucagg

SEQ ID NO: 159905 - RNA, 64 nt, Homo Sapiens
uuauuccuccuuaaaaaaaaugaguggauggaggagaaauaaacacugguguuaagauauauuu

SEQ ID NO: 159906 - RNA, 64 nt, Homo Sapiens
agcaugacuauuuccaccaucauuccuagagagcagaaauaaaacugaccugcugugcaccuua

SEQ ID NO: 159907 - RNA, 64 nt, Homo Sapiens
augcuuacugcguagaauuuuaucuacuuguuccagaaauaauacauuaaccaaaaaggauuua

SEQ ID NO: 159908 - RNA, 64 nt, Homo Sapiens
cuauccauaaugggauucaccuccaaauuaucaaagaaauaacucagaguaauuugacaccagc

SEQ ID NO: 159909 - RNA, 64 nt, Homo Sapiens
cccgacucaacccggccguugcuucuguauauagagaaauaaguuauuggccgcgcgccucccu

SEQ ID NO: 159910 - RNA, 64 nt, Homo Sapiens
aggcggcugcucucauauuuucagauguugcuguagaaauaaagacgguuuaaaucugagcugg

SEQ ID NO: 159911 - RNA, 64 nt, Homo Sapiens
ucuaaccauccucugaaaaaaauagaaaagcauuagaaauaacuauuuuuucuuucuguacaga

SEQ ID NO: 159912 - RNA, 64 nt, Homo Sapiens
aagacagagcaggaaauggauacucuuguuucuuagaaauaagccugggauggcucucucauca

SEQ ID NO: 159913 - RNA, 64 nt, Homo Sapiens
aggaagaaaauguagauuagggaagagguagagcagaaauaaaacagaaucaugugagaacuca

SEQ ID NO: 159914 - RNA, 64 nt, Homo Sapiens
aaacaauauaaagagacacguggaaauaaacaguagaaauaagcggcaagaucaaagcauacau

SEQ ID NO: 159915 - RNA, 64 nt, Homo Sapiens
aauuuauauaagaaaauaaaggcugucugcccagagaaauaaguuauuagugcaauaaggugaa

SEQ ID NO: 159916 - RNA, 64 nt, Homo Sapiens
ggagcucagcugcagcguuguccuugcuucccucagaaauaaaaacaaaugagcaaaagaugag

SEQ ID NO: 159917 - RNA, 64 nt, Homo Sapiens
aguuucauuacgauuauuuuaacuuuuaaaauaaagaaauaaguuugagagguuuccuuuuauu

SEQ ID NO: 159918 - RNA, 64 nt, Homo Sapiens
gauggcgagaguuugcuaguacuaaauguaguugagaaauaauuaaucuaaaacugcgaagaau

SEQ ID NO: 159919 - RNA, 64 nt, Homo Sapiens
ucauuauuuuaaguugaauuugaauaaagauuccagaaauaaacauggagcucaguauucagga

SEQ ID NO: 159920 - RNA, 64 nt, Homo Sapiens
ggagagcuuauuggugagagaggauggagcuaagagaaauaagaucaaauauuaaaauuaggaa

SEQ ID NO: 159921 - RNA, 64 nt, Homo Sapiens
aagauguaugcaguuguccuaucacaguuauauuagaaauaacaacuaguguggaaaguaaccc

SEQ ID NO: 159922 - RNA, 64 nt, Homo Sapiens
caccuggcagaaaaguaacugccaaguaagauuaagaaauaaguugagcauuucuggaguauau

SEQ ID NO: 159923 - RNA, 64 nt, Homo Sapiens
caauuuaaccuucacaguuaaucauaaaaauaaaagaaauaauguuuuuuuugguauuaaaaaa

SEQ ID NO: 159924 - RNA, 64 nt, Homo Sapiens
gcacaaggcagggcagugcuaggaaaauguguuuagaaauaaaaagucaucagaaaaauacauu

SEQ ID NO: 159925 - RNA, 64 nt, Homo Sapiens
uagguaacuugauaauaaggcauggccauucagaagaaauaaauauucuuuaucagcaagcauu

SEQ ID NO: 159926 - RNA, 64 nt, Homo Sapiens
cagucacaugucacuuaauguguauaaggcaguuagaaauaauauucaauauucaaguuacaaa

SEQ ID NO: 159927 - RNA, 64 nt, Homo Sapiens
cauuuggcacauuguuuacauacuugcauaugagagaaauaaaaaaaaugcuuugagagguaau

SEQ ID NO: 159928 - RNA, 64 nt, Homo Sapiens
cauugguaaaguguaauaauuaaucuccagggacagaaauaauuuguaacauuuugauuugauu

SEQ ID NO: 159929 - RNA, 64 nt, Homo Sapiens
uguuuccaauucagguacaaguauguuuuaaagaagaaauaaguuucccaaucagccaauuuaa

SEQ ID NO: 159930 - RNA, 64 nt, Homo Sapiens
uuaguuuuaacuuuucaaaguuuggccuccuauuagaaauaaucaugucucagaugaguaaugu

SEQ ID NO: 159931 - RNA, 64 nt, Homo Sapiens
uggaaguccucgccacagcaaucaggcaagagaaagaaauaaaaggcaaccaaaaagaaaggaa

SEQ ID NO: 159932 - RNA, 64 nt, Homo Sapiens
gacacauagaucaauggaacagaauagagggcccagaaauaaagcuacacaccuacaaccaucu

SEQ ID NO: 159933 - RNA, 64 nt, Homo Sapiens
aacccccauucccugguguccuucuuagagaugaagaaauaauaaggaaacaucuuucauagcc

SEQ ID NO: 159934 - RNA, 64 nt, Homo Sapiens
auaagaacccugaaauuuauauaggugagacaauagaaauaaaaagaucuucagccaggccuuu

SEQ ID NO: 159935 - RNA, 64 nt, Homo Sapiens
guuauauaggaaccgucugacuacuuuaacuuccagaaauaaacuuuuugguauauugcuguau

SEQ ID NO: 159936 - RNA, 64 nt, Homo Sapiens
acaauuaaagggcaaaaaacuucuuuuuaaauuaagaaauaauaggacuaucuaagcccuaggu

SEQ ID NO: 159937 - RNA, 64 nt, Homo Sapiens
auuugcucauaacagguaucgaaacuuuauacauagaaauaaugcaugauugaagccuuuggcu

SEQ ID NO: 159938 - RNA, 64 nt, Homo Sapiens
aaggugccauuuggcugcucgaggcugcgaucuuagaaauaauguuuuaugaaaauuaaguaca

SEQ ID NO: 159939 - RNA, 64 nt, Homo Sapiens
cauauccagccaaacuaagcuucauaagugaaggagaaauaaaauacuuuacagacaagcaaau

SEQ ID NO: 159940 - RNA, 64 nt, Homo Sapiens
aagagcaaacacagucaaaaacuagcagaaggcaagaaauaacuaaaaucagcagaacucaagg

SEQ ID NO: 159941 - RNA, 64 nt, Homo Sapiens
gagauauagaucaauagaacagaacagagcccucagaaauaaugccacauaucuacaacuaucu

SEQ ID NO: 159942 - RNA, 64 nt, Homo Sapiens
uaugaucagcauuuccauuuccagauuaaaauauagaaauaacagaaaacaguauggcagaucc

SEQ ID NO: 159943 - RNA, 64 nt, Homo Sapiens
guuuguugauuaauuaagcuccucccaaaccaugagaaauaaaucuugauauuggacuucccag

SEQ ID NO: 159944 - RNA, 64 nt, Homo Sapiens
gauuacauggauguuaaauuauauggagacgcuaagaaauaauugauggagccauugaugcaaa

SEQ ID NO: 159945 - RNA, 64 nt, Homo Sapiens
uuuaagcuuguuuuaauggucaaaaaauuaggacagaaauaauauggacauuuauuaguaucuu

SEQ ID NO: 159946 - RNA, 64 nt, Homo Sapiens
auuuauauugguaaaauagccaguagaauaugaaagaaauaagguuaguagugaaauucauucu

SEQ ID NO: 159947 - RNA, 64 nt, Homo Sapiens
cuugaucuuggacuucucagccuccagaauugugagaaauaaauuucuguuguugauaaaccac

SEQ ID NO: 159948 - RNA, 64 nt, Homo Sapiens
ugaagucauagaaaauagguaacuaucuaauuagagaaauaauuguuguauuuuaagaucugag

SEQ ID NO: 159949 - RNA, 64 nt, Homo Sapiens
agaauuuauaugaaagauuuguaucauuagagccagaaauaauuuuauauuaauauauaauaca

SEQ ID NO: 159950 - RNA, 64 nt, Homo Sapiens
cuuuuuacuuuaauaguuuaguguaaaguacaucagaaauaaagcuguaucugccauuuuaagc

SEQ ID NO: 159951 - RNA, 64 nt, Homo Sapiens
caucaaacagaauuuuaaggaaaaaugcagagggagaaauaaggcacaugacugcuucuugcag

SEQ ID NO: 159952 - RNA, 64 nt, Homo Sapiens
cuuuuuacuuuaauaguuuaguguaaaguacaucagaaauaaaacuguaucugacauuuuaagc

SEQ ID NO: 159953 - RNA, 64 nt, Homo Sapiens; identical to SEQ ID NO: 159951

SEQ ID NO: 159954 - RNA, 64 nt, Homo Sapiens
aggaaggaggcagagcuguccgugggagguggaggccgaggacauuuuccugaagggcaggggu

SEQ ID NO: 159955 - RNA, 64 nt, Homo Sapiens
cuacucaggaggcugaggugggaggaucccuugagccgaggaguuugagucugcagugagcuau

SEQ ID NO: 159956 - RNA, 64 nt, Homo Sapiens
cacguggagggccuccuucccgcccugccagaaggccgaggaggucugcagucccuuccccgcc

SEQ ID NO: 159957 - RNA, 64 nt, Homo Sapiens
gguuuggggacuggagggcuaaccuggcugcagggccgaggacuaccacuguccacugaccaga

SEQ ID NO: 159958 - RNA, 64 nt, Homo Sapiens
cuggcucuggccaggggcccggugccccuggcuggccgaggagaugggcuuggacacuugccgu

SEQ ID NO: 159959 - RNA, 64 nt, Homo Sapiens
agaaggagcugugagagcuuguugcuucccagaagccgaggagcugggcucucagcuauuucua

SEQ ID NO: 159960 - RNA, 64 nt, Homo Sapiens; identical to SEQ ID NO: 108616

SEQ ID NO: 159961 - RNA, 64 nt, Homo Sapiens; identical to SEQ ID NO: 108617

SEQ ID NO: 159962 - RNA, 64 nt, Homo Sapiens; identical to SEQ ID NO: 108618

SEQ ID NO: 159963 - RNA, 64 nt, Homo Sapiens; identical to SEQ ID NO: 108619

SEQ ID NO: 159964 - RNA, 64 nt, Homo Sapiens; identical to SEQ ID NO: 108620

SEQ ID NO: 159965 - RNA, 64 nt, Homo Sapiens; identical to SEQ ID NO: 108621

SEQ ID NO: 159966 - RNA, 64 nt, Homo Sapiens; identical to SEQ ID NO: 108622

SEQ ID NO: 159967 - RNA, 64 nt, Homo Sapiens; identical to SEQ ID NO: 108623

SEQ ID NO: 159968 - RNA, 61 nt, Homo Sapiens; identical to SEQ ID NO: 108624

SEQ ID NO: 159969 - RNA, 64 nt, Homo Sapiens; identical to SEQ ID NO: 108625

SEQ ID NO: 159970 - RNA, 64 nt, Homo Sapiens; identical to SEQ ID NO: 108626

SEQ ID NO: 159971 - RNA, 64 nt, Homo Sapiens; identical to SEQ ID NO: 108627

SEQ ID NO: 159972 - RNA, 64 nt, Homo Sapiens; identical to SEQ ID NO: 108628

SEQ ID NO: 159973 - RNA, 64 nt, Homo Sapiens; identical to SEQ ID NO: 108629

SEQ ID NO: 159974 - RNA, 64 nt, Homo Sapiens; identical to SEQ ID NO: 108630

SEQ ID NO: 159975 - RNA, 64 nt, Homo Sapiens; identical to SEQ ID NO: 108631

SEQ ID NO: 159976 - RNA, 64 nt, Homo Sapiens; identical to SEQ ID NO: 108632

SEQ ID NO: 159977 - RNA, 64 nt, Homo Sapiens; identical to SEQ ID NO: 108633

SEQ ID NO: 159978 - RNA, 64 nt, Homo Sapiens; identical to SEQ ID NO: 108634

SEQ ID NO: 159979 - RNA, 64 nt, Homo Sapiens; identical to SEQ ID NO: 108635

SEQ ID NO: 159980 - RNA, 64 nt, Homo Sapiens; identical to SEQ ID NO: 108636

SEQ ID NO: 159981 - RNA, 64 nt, Homo Sapiens; identical to SEQ ID NO: 108637

SEQ ID NO: 159982 - RNA, 64 nt, Homo Sapiens; identical to SEQ ID NO: 108638

SEQ ID NO: 159983 - RNA, 64 nt, Homo Sapiens; identical to SEQ ID NO: 108639

SEQ ID NO: 159984 - RNA, 64 nt, Homo Sapiens; identical to SEQ ID NO: 108640

SEQ ID NO: 159985 - RNA, 64 nt, Homo Sapiens; identical to SEQ ID NO: 108641

SEQ ID NO: 159986 - RNA, 64 nt, Homo Sapiens; identical to SEQ ID NO: 108642

SEQ ID NO: 159987 - RNA, 64 nt, Homo Sapiens; identical to SEQ ID NO: 108643

SEQ ID NO: 159988 - RNA, 64 nt, Homo Sapiens; identical to SEQ ID NO: 108644

SEQ ID NO: 159989 - RNA, 64 nt, Homo Sapiens; identical to SEQ ID NO: 108645

SEQ ID NO: 159990 - RNA, 64 nt, Homo Sapiens; identical to SEQ ID NO: 108646

SEQ ID NO: 159991 - RNA, 64 nt, Homo Sapiens; identical to SEQ ID NO: 108647

SEQ ID NO: 159992 - RNA, 64 nt, Homo Sapiens; identical to SEQ ID NO: 108648

SEQ ID NO: 159993 - RNA, 64 nt, Homo Sapiens; identical to SEQ ID NO: 108649

SEQ ID NO: 159994 - RNA, 64 nt, Homo Sapiens; identical to SEQ ID NO: 108650

SEQ ID NO: 159995 - RNA, 64 nt, Homo Sapiens; identical to SEQ ID NO: 108651

SEQ ID NO: 159996 - RNA, 64 nt, Homo Sapiens; identical to SEQ ID NO: 108652

SEQ ID NO: 159997 - RNA, 64 nt, Homo Sapiens; identical to SEQ ID NO: 108653

SEQ ID NO: 159998 - RNA, 64 nt, Homo Sapiens; identical to SEQ ID NO: 108654

SEQ ID NO: 159999 - RNA, 64 nt, Homo Sapiens; identical to SEQ ID NO: 108655

SEQ ID NO: 160000 - RNA, 64 nt, Homo Sapiens; identical to SEQ ID NO: 108656

SEQ ID NO: 160001 - RNA, 64 nt, Homo Sapiens; identical to SEQ ID NO: 108657

SEQ ID NO: 160002 - RNA, 64 nt, Homo Sapiens; identical to SEQ ID NO: 108658

SEQ ID NO: 160003 - RNA, 64 nt, Homo Sapiens; identical to SEQ ID NO: 108659

SEQ ID NO: 160004 - RNA, 64 nt, Homo Sapiens; identical to SEQ ID NO: 108660

SEQ ID NO: 160005 - RNA, 64 nt, Homo Sapiens; identical to SEQ ID NO: 108661

SEQ ID NO: 160006 - RNA, 64 nt, Homo Sapiens; identical to SEQ ID NO: 108662

SEQ ID NO: 160007 - RNA, 64 nt, Homo Sapiens; identical to SEQ ID NO: 108663

SEQ ID NO: 160008 - RNA, 64 nt, Homo Sapiens; identical to SEQ ID NO: 108664

SEQ ID NO: 160009 - RNA, 64 nt, Homo Sapiens; identical to SEQ ID NO: 108665

SEQ ID NO: 160010 - RNA, 64 nt, Homo Sapiens; identical to SEQ ID NO: 108666

SEQ ID NO: 160011 - RNA, 64 nt, Homo Sapiens; identical to SEQ ID NO: 108667

SEQ ID NO: 160012 - RNA, 64 nt, Homo Sapiens; identical to SEQ ID NO: 108668

SEQ ID NO: 160013 - RNA, 64 nt, Homo Sapiens; identical to SEQ ID NO: 108669

SEQ ID NO: 160014 - RNA, 64 nt, Homo Sapiens; identical to SEQ ID NO: 108670

SEQ ID NO: 160015 - RNA, 64 nt, Homo Sapiens; identical to SEQ ID NO: 108671

SEQ ID NO: 160016 - RNA, 64 nt, Homo Sapiens; identical to SEQ ID NO: 108672

SEQ ID NO: 160017 - RNA, 64 nt, Homo Sapiens; identical to SEQ ID NO: 108673

SEQ ID NO: 160018 - RNA, 64 nt, Homo Sapiens; identical to SEQ ID NO: 108674

SEQ ID NO: 160019 - RNA, 64 nt, Homo Sapiens; identical to SEQ ID NO: 108675

SEQ ID NO: 160020 - RNA, 64 nt, Homo Sapiens; identical to SEQ ID NO: 108676

SEQ ID NO: 160021 - RNA, 64 nt, Homo Sapiens; identical to SEQ ID NO: 108677

SEQ ID NO: 160022 - RNA, 64 nt, Homo Sapiens; identical to SEQ ID NO: 108678

SEQ ID NO: 160023 - RNA, 64 nt, Homo Sapiens; identical to SEQ ID NO: 108679

SEQ ID NO: 160024 - RNA, 64 nt, Homo Sapiens; identical to SEQ ID NO: 108680

SEQ ID NO: 160025 - RNA, 64 nt, Homo Sapiens; identical to SEQ ID NO: 108681

SEQ ID NO: 160026 - RNA, 64 nt, Homo Sapiens; identical to SEQ ID NO: 108682

SEQ ID NO: 160027 - RNA, 64 nt, Homo Sapiens; identical to SEQ ID NO: 108683

SEQ ID NO: 160028 - RNA, 64 nt, Homo Sapiens; identical to SEQ ID NO: 108684

SEQ ID NO: 160029 - RNA, 64 nt, Homo Sapiens; identical to SEQ ID NO: 108685

SEQ ID NO: 160030 - RNA, 64 nt, Homo Sapiens; identical to SEQ ID NO: 108686

SEQ ID NO: 160031 - RNA, 64 nt, Homo Sapiens; identical to SEQ ID NO: 108687

SEQ ID NO: 160032 - RNA, 64 nt, Homo Sapiens; identical to SEQ ID NO: 108688

SEQ ID NO: 160033 - RNA, 64 nt, Homo Sapiens; identical to SEQ ID NO: 108689

SEQ ID NO: 160034 - RNA, 64 nt, Homo Sapiens; identical to SEQ ID NO: 108690

SEQ ID NO: 160035 - RNA, 64 nt, Homo Sapiens; identical to SEQ ID NO: 108691

SEQ ID NO: 160036 - RNA, 64 nt, Homo Sapiens; identical to SEQ ID NO: 108692

SEQ ID NO: 160037 - RNA, 64 nt, Homo Sapiens; identical to SEQ ID NO: 108693

SEQ ID NO: 160038 - RNA, 64 nt, Homo Sapiens; identical to SEQ ID NO: 108694

SEQ ID NO: 160039 - RNA, 64 nt, Homo Sapiens; identical to SEQ ID NO: 108695

SEQ ID NO: 160040 - RNA, 64 nt, Homo Sapiens; identical to SEQ ID NO: 108696

SEQ ID NO: 160041 - RNA, 64 nt, Homo Sapiens; identical to SEQ ID NO: 108697

SEQ ID NO: 160042 - RNA, 64 nt, Homo Sapiens; identical to SEQ ID NO: 108698

SEQ ID NO: 160043 - RNA, 64 nt, Homo Sapiens; identical to SEQ ID NO: 108699

SEQ ID NO: 160044 - RNA, 64 nt, Homo Sapiens; identical to SEQ ID NO: 108700

SEQ ID NO: 160045 - RNA, 64 nt, Homo Sapiens; identical to SEQ ID NO: 108701

SEQ ID NO: 160046 - RNA, 64 nt, Homo Sapiens; identical to SEQ ID NO: 108702

SEQ ID NO: 160047 - RNA, 64 nt, Homo Sapiens; identical to SEQ ID NO: 108703

SEQ ID NO: 160048 - RNA, 64 nt, Homo Sapiens; identical to SEQ ID NO: 108704

SEQ ID NO: 160049 - RNA, 64 nt, Homo Sapiens; identical to SEQ ID NO: 108705

SEQ ID NO: 160050 - RNA, 64 nt, Homo Sapiens; identical to SEQ ID NO: 108706

SEQ ID NO: 160051 - RNA, 64 nt, Homo Sapiens; identical to SEQ ID NO: 108707

SEQ ID NO: 160052 - RNA, 64 nt, Homo Sapiens; identical to SEQ ID NO: 108708

SEQ ID NO: 160053 - RNA, 64 nt, Homo Sapiens; identical to SEQ ID NO: 108709

SEQ ID NO: 160054 - RNA, 64 nt, Homo Sapiens; identical to SEQ ID NO: 108710

SEQ ID NO: 160055 - RNA, 64 nt, Homo Sapiens; identical to SEQ ID NO: 108711

SEQ ID NO: 160056 - RNA, 64 nt, Homo Sapiens; identical to SEQ ID NO: 108712

SEQ ID NO: 160057 - RNA, 64 nt, Homo Sapiens; identical to SEQ ID NO: 108713

SEQ ID NO: 160058 - RNA, 64 nt, Homo Sapiens; identical to SEQ ID NO: 108714

SEQ ID NO: 160059 - RNA, 64 nt, Homo Sapiens; identical to SEQ ID NO: 108715

SEQ ID NO: 160060 - RNA, 64 nt, Homo Sapiens; identical to SEQ ID NO: 108716

SEQ ID NO: 160061 - RNA, 64 nt, Homo Sapiens; identical to SEQ ID NO: 108717

SEQ ID NO: 160062 - RNA, 64 nt, Homo Sapiens; identical to SEQ ID NO: 108718

SEQ ID NO: 160063 - RNA, 64 nt, Homo Sapiens; identical to SEQ ID NO: 108719

SEQ ID NO: 160064 - RNA, 64 nt, Homo Sapiens; identical to SEQ ID NO: 108720

SEQ ID NO: 160065 - RNA, 64 nt, Homo Sapiens; identical to SEQ ID NO: 108721

SEQ ID NO: 160066 - RNA, 64 nt, Homo Sapiens; identical to SEQ ID NO: 108722

SEQ ID NO: 160067 - RNA, 64 nt, Homo Sapiens; identical to SEQ ID NO: 108723

SEQ ID NO: 160068 - RNA, 64 nt, Homo Sapiens; identical to SEQ ID NO: 108724

SEQ ID NO: 160069 - RNA, 64 nt, Homo Sapiens; identical to SEQ ID NO: 108725

SEQ ID NO: 160070 - RNA, 64 nt, Homo Sapiens; identical to SEQ ID NO: 108726

SEQ ID NO: 160071 - RNA, 64 nt, Homo Sapiens; identical to SEQ ID NO: 108727

SEQ ID NO: 160072 - RNA, 64 nt, Homo Sapiens; identical to SEQ ID NO: 108728

SEQ ID NO: 160073 - RNA, 64 nt, Homo Sapiens; identical to SEQ ID NO: 108729

SEQ ID NO: 160074 - RNA, 64 nt, Homo Sapiens; identical to SEQ ID NO: 108730

SEQ ID NO: 160075 - RNA, 64 nt, Homo Sapiens; identical to SEQ ID NO: 108731

SEQ ID NO: 160076 - RNA, 64 nt, Homo Sapiens; identical to SEQ ID NO: 108732

SEQ ID NO: 160077 - RNA, 64 nt, Homo Sapiens; identical to SEQ ID NO: 108733

SEQ ID NO: 160078 - RNA, 64 nt, Homo Sapiens; identical to SEQ ID NO: 108734

SEQ ID NO: 160079 - RNA, 64 nt, Homo Sapiens; identical to SEQ ID NO: 108735

SEQ ID NO: 160080 - RNA, 64 nt, Homo Sapiens; identical to SEQ ID NO: 108736

SEQ ID NO: 160081 - RNA, 64 nt, Homo Sapiens; identical to SEQ ID NO: 108737

SEQ ID NO: 160082 - RNA, 64 nt, Homo Sapiens; identical to SEQ ID NO: 108738

SEQ ID NO: 160083 - RNA, 64 nt, Homo Sapiens; identical to SEQ ID NO: 108739

SEQ ID NO: 160084 - RNA, 64 nt, Homo Sapiens; identical to SEQ ID NO: 108740

SEQ ID NO: 160085 - RNA, 64 nt, Homo Sapiens; identical to SEQ ID NO: 108741

SEQ ID NO: 160086 - RNA, 64 nt, Homo Sapiens; identical to SEQ ID NO: 108742

SEQ ID NO: 160087 - RNA, 64 nt, Homo Sapiens; identical to SEQ ID NO: 108743

SEQ ID NO: 160088 - RNA, 64 nt, Homo Sapiens; identical to SEQ ID NO: 108744

SEQ ID NO: 160089 - RNA, 64 nt, Homo Sapiens; identical to SEQ ID NO: 108745

SEQ ID NO: 160090 - RNA, 64 nt, Homo Sapiens; identical to SEQ ID NO: 108746

SEQ ID NO: 160091 - RNA, 64 nt, Homo Sapiens; identical to SEQ ID NO: 108747

SEQ ID NO: 160092 - RNA, 64 nt, Homo Sapiens; identical to SEQ ID NO: 108748

SEQ ID NO: 160093 - RNA, 64 nt, Homo Sapiens; identical to SEQ ID NO: 108749

SEQ ID NO: 160094 - RNA, 64 nt, Homo Sapiens; identical to SEQ ID NO: 108750

SEQ ID NO: 160095 - RNA, 64 nt, Homo Sapiens; identical to SEQ ID NO: 108751

SEQ ID NO: 160096 - RNA, 64 nt, Homo Sapiens; identical to SEQ ID NO: 108752

SEQ ID NO: 160097 - RNA, 64 nt, Homo Sapiens; identical to SEQ ID NO: 108753

SEQ ID NO: 160098 - RNA, 64 nt, Homo Sapiens; identical to SEQ ID NO: 108754

SEQ ID NO: 160099 - RNA, 64 nt, Homo Sapiens; identical to SEQ ID NO: 108755

SEQ ID NO: 160100 - RNA, 64 nt, Homo Sapiens; identical to SEQ ID NO: 108756

SEQ ID NO: 160101 - RNA, 64 nt, Homo Sapiens; identical to SEQ ID NO: 108757

SEQ ID NO: 160102 - RNA, 64 nt, Homo Sapiens; identical to SEQ ID NO: 108758

SEQ ID NO: 160103 - RNA, 64 nt, Homo Sapiens; identical to SEQ ID NO: 108759

SEQ ID NO: 160104 - RNA, 64 nt, Homo Sapiens; identical to SEQ ID NO: 108760

SEQ ID NO: 160105 - RNA, 64 nt, Homo Sapiens; identical to SEQ ID NO: 108761

SEQ ID NO: 160106 - RNA, 64 nt, Homo Sapiens; identical to SEQ ID NO: 108762

SEQ ID NO: 160107 - RNA, 64 nt, Homo Sapiens; identical to SEQ ID NO: 108763

SEQ ID NO: 160108 - RNA, 64 nt, Homo Sapiens; identical to SEQ ID NO: 108764

SEQ ID NO: 160109 - RNA, 64 nt, Homo Sapiens; identical to SEQ ID NO: 108765

SEQ ID NO: 160110 - RNA, 64 nt, Homo Sapiens
ugcaauugaguuuugcauggagaaucccauccauauauccaauuuaaacuuuaaguaauaauaa

SEQ ID NO: 160111 - RNA, 64 nt, Homo Sapiens
cauuucuucuugaaauggugaaauaaauuccaaaauauccaauuuaacuuauugccuagccuau

SEQ ID NO: 160112 - RNA, 64 nt, Homo Sapiens
uuuaugagucuugcaaucaauuccucaagaauuaauauccaauggaaaaguagccucacucuua

SEQ ID NO: 160113 - RNA, 64 nt, Homo Sapiens
aucagagucucuuucuaagcgauuguuuuaaaaaauauccaaggaggauuaaauaaauaauaug

SEQ ID NO: 160114 - RNA, 64 nt, Homo Sapiens; identical to SEQ ID NO: 55166

SEQ ID NO: 160115 - RNA, 64 nt, Homo Sapiens; identical to SEQ ID NO: 55167

SEQ ID NO: 160116 - RNA, 64 nt, Homo Sapiens; identical to SEQ ID NO: 55168

SEQ ID NO: 160117 - RNA, 64 nt, Homo Sapiens; identical to SEQ ID NO: 55169

SEQ ID NO: 160118 - RNA, 64 nt, Homo Sapiens; identical to SEQ ID NO: 55170

SEQ ID NO: 160119 - RNA, 64 nt, Homo Sapiens; identical to SEQ ID NO: 55171

SEQ ID NO: 160120 - RNA, 64 nt, Homo Sapiens; identical to SEQ ID NO: 55172

SEQ ID NO: 160121 - RNA, 64 nt, Homo Sapiens; identical to SEQ ID NO: 55173

SEQ ID NO: 160122 - RNA, 64 nt, Homo Sapiens; identical to SEQ ID NO: 55174

SEQ ID NO: 160123 - RNA, 64 nt, Homo Sapiens; identical to SEQ ID NO: 55175

SEQ ID NO: 160124 - RNA, 64 nt, Homo Sapiens; identical to SEQ ID NO: 55176

SEQ ID NO: 160125 - RNA, 64 nt, Homo Sapiens; identical to SEQ ID NO: 55177

SEQ ID NO: 160126 - RNA, 64 nt, Homo Sapiens
aaggccuggaucacuuuaggaucaauauuuugacacgggagaaggcagcucagaaaggauuaag

SEQ ID NO: 160127 - RNA, 64 nt, Homo Sapiens
ccugcuccauacauuggguguauauuuauucugaacgggagaaguuauauuguuaaaaguguaa

SEQ ID NO: 160128 - RNA, 64 nt, Homo Sapiens
gcggguaccguaauccuagcuacucgggagacugacgggagaaucgcuugaacccaggaggcgg

SEQ ID NO: 160129 - RNA, 64 nt, Homo Sapiens
gggccccggccaucuugcagauuccccuuaaaggacgggagaaaauuugagaagugcugcugua

SEQ ID NO: 160130 - RNA, 64 nt, Homo Sapiens
auccaccauaauaaaacugaugagucgugaagacacgggagaaagguuagcacacucagcgcug

SEQ ID NO: 160131 - RNA, 64 nt, Homo Sapiens
cccgaucacuggcauucaccuggucucugccucgacgggagauccuggggcggucuuggaggcc

SEQ ID NO: 160132 - RNA, 64 nt, Homo Sapiens
uuggcugaaacaaagaauuuguccuguauggaaaacgggagacuuuguacaguggccucucuaa

SEQ ID NO: 160133 - RNA, 64 nt, Homo Sapiens
cuggaggugcuggagaggacaccacgguggacccacgggagaaggccagcuacccugcugcagg

SEQ ID NO: 160134 - RNA, 64 nt, Homo Sapiens
agucucgucuccuguguguacauaacuaggggucacgggagagcgcccccacaucccagugggg

SEQ ID NO: 160135 - RNA, 64 nt, Homo Sapiens
aaaagaggaagggaacuuauaaaucgaaagacaaacgggagagagaaaaaaugagcaaacaaaa

SEQ ID NO: 160136 - RNA, 64 nt, Homo Sapiens
aauuuuuaaauauaaggauuuuccuagauauugcacgggagaauauacaaauagcaaaauugag

SEQ ID NO: 160137 - RNA, 64 nt, Homo Sapiens
ucuuguugcucaaaaaaugacaguaugacauuucacgggagauucaccaagucucacuggcugu

SEQ ID NO: 160138 - RNA, 64 nt, Homo Sapiens
cccugagaccacuggucacaguuggccaccuccaacgggagaccuuguccuuggccuagagucc

SEQ ID NO: 160139 - RNA, 64 nt, Homo Sapiens
uuguggcggcgauuaugcagguuuguucuugcgcacgggagaguacuuuuucugucccacgcgc

SEQ ID NO: 160140 - RNA, 64 nt, Homo Sapiens
gaggauuugauuggaaagcacugugauaauucuuacgggagaaaauuaauuaggcaauuuaugu

SEQ ID NO: 160141 - RNA, 64 nt, Homo Sapiens
ggguuuguaaucaaaacauauuugauaggaggcuacgggagaguugucuagaagagguaagacc

SEQ ID NO: 160142 - RNA, 64 nt, Homo Sapiens
cuguguuccuacaauuggcccagcacccuggggcacgggagaaggguggggaccguugcuguca

SEQ ID NO: 160143 - RNA, 54 nt, Homo Sapiens
gagugaugagaaauaauuaauuggacgggagacagagugacgcacugacucacc

SEQ ID NO: 160144 - RNA, 54 nt, Homo Sapiens
gagugaagcaucaaccuacuuuggacgggagacagaaugaugagaaauaauuaa

SEQ ID NO: 160145 - RNA, 64 nt, Homo Sapiens
aaccaccugcagagguccccagacccaaagcaggacgggagacaacugcuuggaggagcgaaga

SEQ ID NO: 160146 - RNA, 64 nt, Homo Sapiens
uuuauaucagauucuuggcucgugugauaagcaaacgggagaaaguaauuuuuaugaaauacug

SEQ ID NO: 160147 - RNA, 64 nt, Homo Sapiens
guuugggcaggugcagauccaagggcugugguaaacgggagagcuuguguuuuugaaguggaaa

SEQ ID NO: 160148 - RNA, 64 nt, Homo Sapiens
cagcagugccgggcugggcucugcggugcgguccacgggagagcaggccuccagcuggaaaggc

SEQ ID NO: 160149 - RNA, 64 nt, Homo Sapiens
gggacugucuucaacccugcccugcaccuugggcacgggagagcgccacccgcccgcccccgcc

SEQ ID NO: 160150 - RNA, 64 nt, Homo Sapiens
ccgcuugugcuucgcgcaugugggaaccacugugacgggagaaaacugguuucuaagacaaccg

SEQ ID NO: 160151 - RNA, 64 nt, Homo Sapiens
cugacucccagaacaaagaacuugggagaacaguacgggagacugagcagaaaggauggguuug

SEQ ID NO: 160152 - RNA, 64 nt, Homo Sapiens
gaaguggcagcaugcaugcuugucugccuugggcacgggagaggagugccgagauagauagcca

SEQ ID NO: 160153 - RNA, 64 nt, Homo Sapiens
ugcagagggugggggucucagggucuuaggugauacgggagagaaagaacgugccaggcaggag

SEQ ID NO: 160154 - RNA, 64 nt, Homo Sapiens
uuuuucccacaccgaucaagucaacucaguacucacgggagaaaaauagacuuuauuuacaagu

SEQ ID NO: 160155 - RNA, 58 nt, Homo Sapiens
accccuugaggacacugugagggccuggacgggagaugccagccaucacucacugcca

SEQ ID NO: 160156 - RNA, 64 nt, Homo Sapiens
ggcugcuuguuuuuuuauugccaaagucaaauaaacgggagacugucaugcucaugcaugaaua

SEQ ID NO: 160157 - RNA, 64 nt, Homo Sapiens
gguagaacuggaucauuuccaaucuuaagcuucuacgggagagucucucuucucgguagcuuug

SEQ ID NO: 160158 - RNA, 64 nt, Homo Sapiens
acucgccagggcacggagccgucaguccacuguuacgggagaauguugauuucgcgggugcgag

SEQ ID NO: 160159 - RNA, 64 nt, Homo Sapiens
caguuccuaccuugggaaugaagguccugugagaacgggagaggcuugugauaacccugucauc

SEQ ID NO: 160160 - RNA, 64 nt, Homo Sapiens
uuagugucuuucccucuaucaaugucaagaacagacgggagauaagagcuuccuaaccuaguaa

SEQ ID NO: 160161 - RNA, 64 nt, Homo Sapiens
uuuccucacccgccccugccgcugcugcuguugcacgggagaaccugcagggagagggcaggcg

SEQ ID NO: 160162 - RNA, 64 nt, Homo Sapiens
ccucacucagugugaccuggagggggucagacagacgggagaguccagaaacagacccagggcu

SEQ ID NO: 160163 - RNA, 64 nt, Homo Sapiens
gggaguucccgaggggccccagcuuucaagggcgacgggagagacacaggauaaaagguuaaaa

SEQ ID NO: 160164 - RNA, 64 nt, Homo Sapiens
ggguggugggccgacuugaaccuuagcaguccccacgggagauggcagggcaccuuggggaagg

SEQ ID NO: 160165 - RNA, 64 nt, Homo Sapiens
cucagacccuaaaucaauaaucacaaaccccaaaacgggagagagcagugaaaacaugcagggc

SEQ ID NO: 160166 - RNA, 64 nt, Homo Sapiens
gcaugauguuuggaugcuagacuaguugcaucugacgggagaaguuuguguuguaccagcgcau

SEQ ID NO: 160167 - RNA, 64 nt, Homo Sapiens
caugagggacuuggagggagcugggaguucauccacgggagacccugccccgaugagaaggggc

SEQ ID NO: 160168 - RNA, 64 nt, Homo Sapiens
uuaggcacacgucacgggugcgggagacccgggcacgggagacccgggccgccuucaggccgcu

SEQ ID NO: 160169 - RNA, 64 nt, Homo Sapiens
ggagaccaagagcacagcaggacugaaauuuuggacgggagagaggggcuauuccaucuugcuu

SEQ ID NO: 160170 - RNA, 64 nt, Homo Sapiens
gccccggacacgcgcguuuuucugugguggaaggacgggagaggccggggcccugccucggagc

SEQ ID NO: 160171 - RNA, 64 nt, Homo Sapiens
ucacugggccuguuuucuccagggguccaagggaacgggagagggggucccuguguccucuucc

SEQ ID NO: 160172 - RNA, 64 nt, Homo Sapiens
cauuaugagaacuaccgggccugaaggaugugacacgggagacauacguacccacaugcaggac

SEQ ID NO: 160173 - RNA, 64 nt, Homo Sapiens
cuggcccagcugcagacugcgcugcucugcacccacgggagagguuaaugauggccacaucugg

SEQ ID NO: 160174 - RNA, 64 nt, Homo Sapiens
ucaugacaacagaagggagguggccgggcugagcacgggagacccaccgugcaggggccuuuca

SEQ ID NO: 160175 - RNA, 64 nt, Homo Sapiens
gcagugcaaugggaaguaaaaagcuacgagggggacgggagaggucucucucuuugaucccaua

SEQ ID NO: 160176 - RNA, 64 nt, Homo Sapiens
agaagccauugcuaacuacuagccugcuuuggacacgggagaaaucagaagucagcgcaggaag

SEQ ID NO: 160177 - RNA, 64 nt, Homo Sapiens
ccgcaggacuggagggccaggccccgccacccccacgggagacccgggacagggcgucuuccua

SEQ ID NO: 160178 - RNA, 64 nt, Homo Sapiens
cugagguuggccacgggggagcuggccuccagggacgggagagauugugucaugugccacacga

SEQ ID NO: 160179 - RNA, 58 nt, Homo Sapiens
cuuucuguugucccacuuccuggaagcaacgggagaaguagaugagaaauccuuuuag

SEQ ID NO: 160180 - RNA, 64 nt, Homo Sapiens
uuuauuuuaagcuguucaugcgagcagcaaccagacgggagauuugcauuucuuggagccucuc

SEQ ID NO: 160181 - RNA, 64 nt, Homo Sapiens
ucuugcguaugccugcccaguuuucagccucuuaacgggagacucaagcacauugguauuguau

SEQ ID NO: 160182 - RNA, 64 nt, Homo Sapiens
uucuguuacguaacgaaaaggauaaacaucucccacgggagaggccacagauggccacuuccag

SEQ ID NO: 160183 - RNA, 64 nt, Homo Sapiens
augcacuguguuuugaaaguuaaaggaugugugaacgggagaugaguuccaucaggcuguuucc

SEQ ID NO: 160184 - RNA, 64 nt, Homo Sapiens
cccacuucaaaugacaaguucauauauagaauuuacgggagaaacuugagaccauuuacgggga

SEQ ID NO: 160185 - RNA, 64 nt, Homo Sapiens
gaagaccagguuugcugggcauaagcuucacaggacgggagaaccugcccaugguggacugucg

SEQ ID NO: 160186 - RNA, 64 nt, Homo Sapiens
aauaugggacauuucuugaucauuauacaaagucacgggagaaaaacgcucuacuucguaaaag

SEQ ID NO: 160187 - RNA, 64 nt, Homo Sapiens
ugagcccagccuucugacugccacccagcuggacacgggagacugaggggagcgacccucaagg

SEQ ID NO: 160188 - RNA, 64 nt, Homo Sapiens
gcaaccuuccaagugcggagugucaaccaacuggacgggagagaguacugcuccuacuccagga

SEQ ID NO: 160189 - RNA, 64 nt, Homo Sapiens
ugugugcacacgccacacacugggcguucccggcacgggagaggcccagaguuuccuucacccu

SEQ ID NO: 160190 - RNA, 64 nt, Homo Sapiens
gcauccucucccccacaagagccccaaagaucccacgggagaggggagagggacgcacagcacu

SEQ ID NO: 160191 - RNA, 64 nt, Homo Sapiens
aagcagaaguguaaucucugauaacccaaaagcuacgggagaaauucuucuuuucaucucaguc

SEQ ID NO: 160192 - RNA, 64 nt, Homo Sapiens
uccacguaaccuuugcuuucguggaaaaggaagcacgggagaaauccugagccgguuuaagucu

SEQ ID NO: 160193 - RNA, 64 nt, Homo Sapiens
ccagcugggggauccaggguaugggucccucuagccuguggacaaggcaccagccucugcagca

SEQ ID NO: 160194 - RNA, 64 nt, Homo Sapiens
ucuggguuccuguuuucucaugcgaggccuugccccuguggaaccaucucgggcuuggcugguc

SEQ ID NO: 160195 - RNA, 64 nt, Homo Sapiens
ugacuuggcaccacucuccuaagaaacacugacuccuguggagauuagaaaagaaagcaaacuu

SEQ ID NO: 160196 - RNA, 64 nt, Homo Sapiens
agccauucuuuauucuuuuacauaggcugcucugccuguggaguagacguaaaaagaaaaaaac

SEQ ID NO: 160197 - RNA, 64 nt, Homo Sapiens
ccaaguacgguguacagaaaccaaccagcagaagccuguggacaucugugaaagcuacagagca

SEQ ID NO: 160198 - RNA, 64 nt, Homo Sapiens
cccguggauguagacauugccuccagcucccagcccuguggaucgcaguggaccucauaccugu

SEQ ID NO: 160199 - RNA, 59 nt, Homo Sapiens
uccggaggucugggccauagcauggcugcccuguggaugccuugucagugccgccagcc

SEQ ID NO: 160200 - RNA, 64 nt, Homo Sapiens
agaaaccuucuuaucccccucaucucuggggcccccuguggaucuggcauacccaaguucagua

SEQ ID NO: 160201 - RNA, 64 nt, Homo Sapiens
aagcuuuuaaaauguagaaacuuaaacacaccuuccuguggaggcugagaugaaaacuagggcu

SEQ ID NO: 160202 - RNA, 64 nt, Homo Sapiens
aguaugugcaggggggcgaucugggaaucaguccccuguggauaccaagguacaacuguauuua

SEQ ID NO: 160203 - RNA, 64 nt, Homo Sapiens
ugauguugacuuaauuccaaaugggaucuccauaccuguggaccaaaccaacaaguaaguuuug

SEQ ID NO: 160204 - RNA, 64 nt, Homo Sapiens
ggcucuugagccacuugcucuagcccacucccacccuguggaauguacuuucacuuuugcugcu

SEQ ID NO: 160205 - RNA, 64 nt, Homo Sapiens
uagugacgcuguugggauggcacaguccaggaggccuguggacugcagccugcugugcugagcc

SEQ ID NO: 160206 - RNA, 64 nt, Homo Sapiens
gcuguguuuccugggaaguggugcuuuacuuagcccuguggacaacuucucuaugcaucugugu

SEQ ID NO: 160207 - RNA, 64 nt, Homo Sapiens
cccacgaagauacugcacggagagcagugccaagccuguggaucaggaauaucaacagccccca

SEQ ID NO: 160208 - RNA, 64 nt, Homo Sapiens
ugcgccauggccuggaucugcugcaguguccuuuccuguggaggcuccacucaaagcuggcauc

SEQ ID NO: 160209 - RNA, 64 nt, Homo Sapiens
cacacauuauuuuauguaaaguuauugguaugacccuguggaaauauaucuaguaccauacuga

SEQ ID NO: 160210 - RNA, 64 nt, Homo Sapiens
agaagcuggauuccaucagacuuacugaagacaaccuguggaauuccaucuucggacguugauu

SEQ ID NO: 160211 - RNA, 64 nt, Homo Sapiens
gguugcccagccuggagcggagcuugccugccugccuguggagacagcccugccuauccucugu

SEQ ID NO: 160212 - RNA, 64 nt, Homo Sapiens
gaguaggaaaggaauaaggauguuguuaugaucgccuguggauuuuguccauucaucucaugcu

SEQ ID NO: 160213 - RNA, 64 nt, Homo Sapiens
ccccccugccaccacgacugugggcauccaguggccuguggaccaagguuugacaggcuuaaug

SEQ ID NO: 160214 - RNA, 64 nt, Homo Sapiens
ugccagggcccaccaugucgugccgaggccagggccuguggagggugaggcagggggcggaggc

SEQ ID NO: 160215 - RNA, 64 nt, Homo Sapiens
cugaguuuugaaggauguagagcuggacauucagccuguggaguaauucugucuuggaggaaga

SEQ ID NO: 160216 - RNA, 64 nt, Homo Sapiens
ggacacuuaggguccccuccuacauagccaccucccuguggagaagacucucccuccuguccug

SEQ ID NO: 160217 - RNA, 64 nt, Homo Sapiens
ucccucugaaccaagauuuuuggugcucagaaacccuguggauugaagcugaagucagugucuc

SEQ ID NO: 160218 - RNA, 64 nt, Homo Sapiens
aaaccuguuuuccaggugucuggggcaagugcuaccuguggaauccaaaauucagagauggcuu

SEQ ID NO: 160219 - RNA, 64 nt, Homo Sapiens
gaaaccaucuccuaaaauucgaaguucagucaguccuguggaauacauuuuccaugguagaaag

SEQ ID NO: 160220 - RNA, 64 nt, Homo Sapiens
gaaugcaagcaugauuuuggguucuuuuuggucaccuguggaauuuuggugaacuucaaacucu

SEQ ID NO: 160221 - RNA, 64 nt, Homo Sapiens
ccccacauuccgacaaccgaugcuccagccaaccccuguggagcccgcacccccacccuuuggg

SEQ ID NO: 160222 - RNA, 64 nt, Homo Sapiens
caaccaccgcuccccagcccaggguucccccagcccuguggaagggacuaggagcacuguagua

SEQ ID NO: 160223 - RNA, 64 nt, Homo Sapiens
gauggcugcuuguuuaggaggccaucaguuccuuccuguggagaagggucugaaauggaaguca

SEQ ID NO: 160224 - RNA, 64 nt, Homo Sapiens
ucuggaaaccaacaacuuuugagauuucccuugcccuguggacgcccagcuccugucauccuuc

SEQ ID NO: 160225 - RNA, 64 nt, Homo Sapiens
ugggcagguggcucggggccacuggcggagccagccuguggauccaagagacaguccccaccug

SEQ ID NO: 160226 - RNA, 64 nt, Homo Sapiens
acuugcgucccccaugccugcuggguggcuggguccuguggaggccagcagcgguguggccccc

SEQ ID NO: 160227 - RNA, 64 nt, Homo Sapiens
ccuaggcaagagcggcccucgccccaucgucgcgccuguggacgugcugcggacuccuccgcga

SEQ ID NO: 160228 - RNA, 64 nt, Homo Sapiens
cugcgccucccaucgcccggcggugggggcgcuuccuguggacggacagccggagcucggccug

SEQ ID NO: 160229 - RNA, 64 nt, Homo Sapiens
acagucuacucugucucugcugcuagagaagccaccuguggaggacugggcugugguugggccu

SEQ ID NO: 160230 - RNA, 64 nt, Homo Sapiens
ccuguggaggacugggcugugguugggccugaggccuguggaggaggugaguguagccagcagc

SEQ ID NO: 160231 - RNA, 64 nt, Homo Sapiens
aaaagaagcggauaguguuuauggagaauggguuccuguggagaaaaauggugaagaaaacaaa

SEQ ID NO: 160232 - RNA, 64 nt, Homo Sapiens
ugauaauguuuucagcagcaauuugcccucagagccuguggacaucucuacagcaaugagugaa

SEQ ID NO: 160233 - RNA, 64 nt, Homo Sapiens
ugaagaguuuacaaagaaauauggggaaaagcgaccuguggacuaaaaucugccacgauugguu

SEQ ID NO: 160234 - RNA, 64 nt, Homo Sapiens
ggcuucccuucuuggcucuugggggggacuagauccuguggagaagaugacuuaaacuuugcuu

SEQ ID NO: 160235 - RNA, 64 nt, Homo Sapiens
ggaaggggaagcuugggguuuccagcuguggagcccuguggaggggcaggaaucaccacccauc

SEQ ID NO: 160236 - RNA, 64 nt, Homo Sapiens
gaccucugccgugccucucuggcugagcuguauuccuguggaggaaccuaaaugccacagcugg

SEQ ID NO: 160237 - RNA, 64 nt, Homo Sapiens
aaaugacaccgguuuguguaguauguaauacugauaaugacaauagcacauucaguuauguaca

SEQ ID NO: 160238 - RNA, 64 nt, Homo Sapiens
uacaauaguggucccauaaaaguuauguacugcauaaugacauacugguuuugcagaagauuac

SEQ ID NO: 160239 - RNA, 64 nt, Homo Sapiens
aaucacaguagcguaaacgagaggccuuccuuucuaaugacaaugacagguauuggugaaggag

SEQ ID NO: 160240 - RNA, 64 nt, Homo Sapiens
uccaugaagaaaaauauauguucuuuugaauacuuaaugacagaacaaauacuuggcaaacucc

SEQ ID NO: 160241 - RNA, 64 nt, Homo Sapiens
ugccuuaaugugaagcuuauaucuuuuucauagguaaugacagauuccuuuguuuugaauccaa

SEQ ID NO: 160242 - RNA, 64 nt, Homo Sapiens
agaaugaaagaaaaaaaauuacugauaauaucuguaaugacaucacaaaaacuuaacauuuaaa

SEQ ID NO: 160243 - RNA, 64 nt, Homo Sapiens
uggaucuuuugcuagugugaaaacauugggaauuuaaugacauuauugagcugaaagaaauuac

SEQ ID NO: 160244 - RNA, 64 nt, Homo Sapiens
guaucuuuuauaaucauaucgguuucugcuguauuaaugacaauuauucaugaaaauaaaaaau

SEQ ID NO: 160245 - RNA, 64 nt, Homo Sapiens
uaauguuauguugagguuauaccucuacuggcuuuaaugacaaacuugccuaaagauaucuggg

SEQ ID NO: 160246 - RNA, 64 nt, Homo Sapiens
auauucuuucauaaaacuauuucugaauuucauguaaugacaacgaauggaaaauugugguuaa

SEQ ID NO: 160247 - RNA, 64 nt, Homo Sapiens
acaaauccuguaacuacccaaguuuuuuagcugcuaaugacaaacuuuaagaacauguggaaua

SEQ ID NO: 160248 - RNA, 64 nt, Homo Sapiens
ugccuuuuuuuccaccauuaaugauccaccaugcuaaugacacuguuugugugcagagaaguau

SEQ ID NO: 160249 - RNA, 64 nt, Homo Sapiens
aaaauuccaaacuagagcagugguuuaaacucgauaaugacaggaaaccagacaacacauguau

SEQ ID NO: 160250 - RNA, 64 nt, Homo Sapiens
uaugcagcaggggucuaucgaaauuguaccuuucuaaugacaucucugccaguaaaaaguaaug

SEQ ID NO: 160251 - RNA, 64 nt, Homo Sapiens
ccaucuuggcucacugcaaccucuaccuccuggguucaagcaaaucuccugccucagccuccaa

SEQ ID NO: 160252 - RNA, 64 nt, Homo Sapiens
caaucucggcucacugcaaccuccgccucccagguucaagcaauucuccugccucagccucccg

SEQ ID NO: 160253 - RNA, 64 nt, Homo Sapiens
aauauuucuaacauccuuaaauauacaaucggaauucaagcaucucccauugucccacaaaugu

SEQ ID NO: 160254 - RNA, 64 nt, Homo Sapiens
ggcuguuuuuguaguuggauuguuuguauuaggauucaagcaaggcccauauauugcauuuauu

SEQ ID NO: 160255 - RNA, 64 nt, Homo Sapiens
uuuauucguaucauuggccuaucaagggcuacaauucaagcacuauuuguacgcacaacauuaa

SEQ ID NO: 160256 - RNA, 64 nt, Homo Sapiens
agaauaugacuagauuucagacagauaaauggguuucaagcacaugugugcuuccagaaagcuu

SEQ ID NO: 160257 - RNA, 64 nt, Homo Sapiens
ucuccugccucagccacccacucugccucccggguucaagcaauugaucucggcucacugcaac

SEQ ID NO: 160258 - RNA, 64 nt, Homo Sapiens
uuuaagggcauuuucuuugacacaguguucagaauucaagcauaaauugggagccaucauaugu

SEQ ID NO: 160259 - RNA, 64 nt, Homo Sapiens
ucuccugccucagccucccgcuccgucucuuagguucaagcaauugaucucagcucacugcaac

SEQ ID NO: 160260 - RNA, 64 nt, Homo Sapiens
ucuccugccucagucuccugcuccaccucccagguucaagcaaucaaucucggcucacugcaac

SEQ ID NO: 160261 - RNA, 64 nt, Homo Sapiens
uucucuaggaaaaaaaaaaaggaaaugauugauauucaagcaaguuucuacccuuggcaugagg

SEQ ID NO: 160262 - RNA, 64 nt, Homo Sapiens
aauccaacccagagcagggggaccuggaguccucuucaagcagcuuacgacccucuccagacca

SEQ ID NO: 160263 - RNA, 64 nt, Homo Sapiens
cgaucucggcucaccacaaucgcugccuccuggguucaagcaauucuccugccucagccucccg

SEQ ID NO: 160264 - RNA, 64 nt, Homo Sapiens
uaaucauaccucauugcagccucagacuccuggguucaagcaauccuccugccucagccuccca

SEQ ID NO: 160265 - RNA, 64 nt, Homo Sapiens
ugaucucggcucacugcaaccucugccucccgaguucaagcaauucuccugccucagccuccug

SEQ ID NO: 160266 - RNA, 64 nt, Homo Sapiens
guaaaggagaauuuuuuggacucaagcugucaucuucaagcacgccaacuucaggcaguguuuu

SEQ ID NO: 160267 - RNA, 64 nt, Homo Sapiens
gugagaaguuaaaauacccuuacccuuaaggagguucaagcagaagcagagugagaaguuaaaa

SEQ ID NO: 160268 - RNA, 64 nt, Homo Sapiens
gugagaaguuaaaauacccuccgaaggacggagguucaagcagagcucccugaauccuugcguc

SEQ ID NO: 160269 - RNA, 64 nt, Homo Sapiens
cucuaaaaucaaagguuuugacuguauacuuguuuucaagcauccuuugaaaaaaaagaugcuu

SEQ ID NO: 160270 - RNA, 64 nt, Homo Sapiens
ugacaccagccucaaaguaaaucauccauuguuuuucaagcacguccagugaaacaaaguucau

SEQ ID NO: 160271 - RNA, 64 nt, Homo Sapiens
auuuauaguuugguuuugaguucacaucauaguauucaagcaucuuaaacuuuugguuauugug

SEQ ID NO: 160272 - RNA, 64 nt, Homo Sapiens
uugcuuuuguucaaaucguguaaacuggacucauuucaagcaguacaucacugauuauuugggu

SEQ ID NO: 160273 - RNA, 64 nt, Homo Sapiens
ccuccugcuucaacauacagcuugaacuccugaguucaagcagugcuaugucguccaggcuggu

SEQ ID NO: 160274 - RNA, 64 nt, Homo Sapiens
ucuccugccucagccuccagcucugccuccuggguucaagcaaucgaucuuggcucacugcaac

SEQ ID NO: 160275 - RNA, 64 nt, Homo Sapiens
uuuuaaugagacccaaaugacucucucuuaacaauucaagcaguagacaaaguugcucacaaau

SEQ ID NO: 160276 - RNA, 64 nt, Homo Sapiens
aaaaauaauaugucaugggauuaaaauguuuguuuucaagcauuuuuaacaguuuuacacacuu

SEQ ID NO: 160277 - RNA, 64 nt, Homo Sapiens
ugaaaguacucacacuggaggucuccuuuagguuuucaagcacacugugugggaaaacuuacuu

SEQ ID NO: 160278 - RNA, 64 nt, Homo Sapiens
ugaaagaacucacacuggagaucuucuguagguuuucaagcacacaauguggaaaaaccuacau

SEQ ID NO: 160279 - RNA, 64 nt, Homo Sapiens
ucuccugccucagccuccugcuccacuucucagguucaagcaaucaaucuuggcucacugcaac

SEQ ID NO: 160280 - RNA, 64 nt, Homo Sapiens
ucuucugccucagccuuccacuguaaccucuggguucaagcaauaguggugugauccuggcuca

SEQ ID NO: 160281 - RNA, 64 nt, Homo Sapiens
ucuccugccgcagccucccacuccgccucccggauucaagcaaucgaucgcggcucaccgcaac

SEQ ID NO: 160282 - RNA, 64 nt, Homo Sapiens
ucuccugccucagucucccacuccuccucccagguucaagcaaucgaucucagcucacugcaac

SEQ ID NO: 160283 - RNA, 64 nt, Homo Sapiens
aauugccauuaaacuguuuagauuuaacauugauuucaagcauuagccuugaccugaguuuguu

SEQ ID NO: 160284 - RNA, 64 nt, Homo Sapiens
uguccccagaccugccgccuggcuucuggagugcuucaagcagagcauggugggucauugagga

SEQ ID NO: 160285 - RNA, 64 nt, Homo Sapiens
uugaucucggcucacugcaaccucgccucccggguucaagcaauucucugccgcagccuccaga

SEQ ID NO: 160286 - RNA, 64 nt, Homo Sapiens
guacaugacuguuggaccugaucaaaccauuuucuucaagcaaaaucuugaccauaacauauuc

SEQ ID NO: 160287 - RNA, 64 nt, Homo Sapiens
ucaaagauuaucuauacacauugaaaauagaauuuucaagcaacaaauaaacugggaaaagagu

SEQ ID NO: 160288 - RNA, 64 nt, Homo Sapiens
ucuccugccucagccucccacucugccuccugacuucaagcaauggcaguuguuucaccguaac

SEQ ID NO: 160289 - RNA, 64 nt, Homo Sapiens
ucuccuucuucagccucccgcuccaccuccuggguucaagcaaucagucuuggcucacugcaac

SEQ ID NO: 160290 - RNA, 64 nt, Homo Sapiens
ucuccuucuucagccucccgcuccaccucccggguucaagcaaucgaucuuggcucacugcaac

SEQ ID NO: 160291 - RNA, 58 nt, Homo Sapiens
gugcugcggggugcugcugagagugcccgcugggcagugaacagaccacuagccccgg

SEQ ID NO: 160292 - RNA, 64 nt, Homo Sapiens
aacuccaaggucccuuaaaaagugccuuuuagaggcugggcaugguggcucacgcuuguaaucc

SEQ ID NO: 160293 - RNA, 64 nt, Homo Sapiens
cgaccugcugacccacgguccuccuggggggccugcugggcagggccaggggcgcccgagcccu

SEQ ID NO: 160294 - RNA, 64 nt, Homo Sapiens
gcacaucccccaggacuugaucuccccgagggcggcugggcagacccaugggaggcggcgcugc

SEQ ID NO: 160295 - RNA, 64 nt, Homo Sapiens
gagaaaccccgucucuucuaaaaauacaaaauuagcugggcaugguggugcaugccuguaauuc

SEQ ID NO: 160296 - RNA, 64 nt, Homo Sapiens
uggaaguuauucuucauaaaaaauguuaacgugggcugggcaugguggcucaugccuguaaucc

SEQ ID NO: 160297 - RNA, 64 nt, Homo Sapiens
auguaaauguugcaaaaagaguuuuccaaguagagcugggcacuacguaaucagccccacaagu

SEQ ID NO: 160298 - RNA, 64 nt, Homo Sapiens
ccucuacuaaaaauacaaaaaaaaaaaaaaauuagcugggcaugguggcacacaccuguagucc

SEQ ID NO: 160299 - RNA, 64 nt, Homo Sapiens
gcaaaacccugugucuacaaaaaauaaaaaauuagcugggcaugacggccagagcccauggucc

SEQ ID NO: 160300 - RNA, 64 nt, Homo Sapiens
cuuugaucugguuuuugaagucucuuaauuauuggcugggcauggugacucaugccuguaaucc

SEQ ID NO: 160301 - RNA, 64 nt, Homo Sapiens
uagugagacuccgucucuacaaaaaauaaauuuagcugggcaugguggugcacaucuguagucc

SEQ ID NO: 160302 - RNA, 64 nt, Homo Sapiens
guggcucacuuugggaggcuaacuggagccucuggcugggcacagccucacccaacaccagugg

SEQ ID NO: 160303 - RNA, 64 nt, Homo Sapiens
cacucuauugaccaaacauugcuucuggggaagugcugggcauuccucccuuggggaaagaggu

SEQ ID NO: 160304 - RNA, 64 nt, Homo Sapiens
ucauagaugggaugaaugaccccuccaggcugcugcugggcaugucccugcugucauuggcucu

SEQ ID NO: 160305 - RNA, 64 nt, Homo Sapiens
agggaucacaucacucuuaaggauggggagggaggcugggcauccugucuuuaggaguagggug

SEQ ID NO: 160306 - RNA, 64 nt, Homo Sapiens
gucugcucugguaggacuguccagcccacgccgagcugggcagcucggggccaggcaggccagc

SEQ ID NO: 160307 - RNA, 64 nt, Homo Sapiens
guccccugcaaggaggcagggccugccccuuccagcugggcagacggucagggccugccgagcu

SEQ ID NO: 160308 - RNA, 64 nt, Homo Sapiens
guggauguagggauagcugauuuuaaaacacucggcugggcacaguggcucacaccuguaaucc

SEQ ID NO: 160309 - RNA, 64 nt, Homo Sapiens
ugaaacccugucucuacaaaaaauacaaaaauuagcugggcaugguggugcgugccugaagucc

SEQ ID NO: 160310 - RNA, 64 nt, Homo Sapiens
acgcaggacgccgccucacgcaagcugggacacugcugggcacggcccuggcguucggcacuag

SEQ ID NO: 160311 - RNA, 64 nt, Homo Sapiens
uaggaacaguugacuucccagaaugcagugggcugcugggcaccccucucacgguuggggagga

SEQ ID NO: 160312 - RNA, 64 nt, Homo Sapiens
uguguguacugcaugcccacccggguagcaggcugcugggcaguucugcucuguggaggggcgg

SEQ ID NO: 160313 - RNA, 64 nt, Homo Sapiens
uggccccacgaagcccccaguggcuggcuguccagcugggcaaacaguggcaccccucccagcu

SEQ ID NO: 160314 - RNA, 64 nt, Homo Sapiens
uccuucuguuucaacaacuccuccacugggcagagcugggcaucuggcagggcuggcucugucc

SEQ ID NO: 160315 - RNA, 64 nt, Homo Sapiens
gggggaacacaggaaccuaggggaggaggggagcgcugggcauccucaggcuggcggccaaggc

SEQ ID NO: 160316 - RNA, 64 nt, Homo Sapiens
guccugugggucccugcagucgacaucauguuuggcugggcaucgaugccuccuuucugggacu

SEQ ID NO: 160317 - RNA, 64 nt, Homo Sapiens
agccuggaaaaugugaaacugucuccugcaaccugcugggcaugugggccuggcuguguucaau

SEQ ID NO: 160318 - RNA, 64 nt, Homo Sapiens
gccuguaagucuguucauuuuaacaacauacagggcugggcacgguggcucacgccuguaaucc

SEQ ID NO: 160319 - RNA, 64 nt, Homo Sapiens
caaaaccccgucucuaugaaaaauauaaaaauuagcugggcaugguggcaggcaccuguaaucc

SEQ ID NO: 160320 - RNA, 64 nt, Homo Sapiens
gaguugaauccauaguguggggcccaugacucuagcugggcaccuuggaccuccagcuggccaa

SEQ ID NO: 160321 - RNA, 64 nt, Homo Sapiens
uauaguaaguccucuuccaaagagauggcaauaugcugggcaucuacuuuaaaacaaaguuguc

SEQ ID NO: 160322 - RNA, 64 nt, Homo Sapiens
ccacucuccccaccccuggcccacuguggugugugcugggcaaauguggccugaaugcuaggua

SEQ ID NO: 160323 - RNA, 64 nt, Homo Sapiens
cugcucugccugggacugagcgaguggacuuagggcugggcaggcaguagccaccagagggcag

SEQ ID NO: 160324 - RNA, 64 nt, Homo Sapiens
aaauagagaucuccucugcaguguagagaccagagcugggcagugcagggcauggagaccugca

SEQ ID NO: 160325 - RNA, 64 nt, Homo Sapiens
ucaaaaaauaauaauaauaacaauauaagaacuagcugggcaugguggcgcaugcauguagucc

SEQ ID NO: 160326 - RNA, 64 nt, Homo Sapiens
auggcacgcaccugcaguccaaguacaaaaauuagcugggcaugugaaacuccaucucuacuaa

SEQ ID NO: 160327 - RNA, 64 nt, Homo Sapiens
guggcucacaccuguaauccaaugauauauucuggcugggcacagcaccugcagaguccaguga

SEQ ID NO: 160328 - RNA, 64 nt, Homo Sapiens
guggcucaugccugaaauccgaaaaguacuucaggcugggcacaggcagcaaugcugaguucaa

SEQ ID NO: 160329 - RNA, 64 nt, Homo Sapiens
guggcgcacgccuguaguucaauauaaaaaauuagcugggcauggaaaccccaucgcuacuaaa

SEQ ID NO: 160330 - RNA, 64 nt, Homo Sapiens
guggcucacgccuguaauccauaagcacaugauggcugggcaccucauccaccucgcuuuaaaa

SEQ ID NO: 160331 - RNA, 64 nt, Homo Sapiens
auuuuggaauuuccuggaugagaaggaagucugggcugggcaugguggcucacgccuguaaccc

SEQ ID NO: 160332 - RNA, 64 nt, Homo Sapiens
caaaaccccauuucuacaaaaaauacaaaaauuagcugggcaugguggcacccgccuguagucc

SEQ ID NO: 160333 - RNA, 64 nt, Homo Sapiens
gcucugggaagugaagucaucaggcugcugggcagcugggcagacccauuguucuggaaaucuc

SEQ ID NO: 160334 - RNA, 64 nt, Homo Sapiens
ugggcagagcucugggaagugaaaucuccaggcugcugggcagcaccuacuccccauuguucug

SEQ ID NO: 160335 - RNA, 64 nt, Homo Sapiens
auggcgagugucuguaauccaaauacaaaaauuagcugggcaugugaaaugccgucucuacuaa

SEQ ID NO: 160336 - RNA, 64 nt, Homo Sapiens
guggcuuaugccuguaauccaagcguaagcuuuggcugggcauggauuuaaauaauuucuuuaa

SEQ ID NO: 160337 - RNA, 64 nt, Homo Sapiens
ggauguggcagugagggacgauggggugaagucagcugggcauucaaagaagcuagacugagaa

SEQ ID NO: 160338 - RNA, 64 nt, Homo Sapiens
ugaaaccccaugucuacuaaaaauacaaaaauuagcugggcaugguggcacacacuuguagucc

SEQ ID NO: 160339 - RNA, 64 nt, Homo Sapiens
cuuccaguuuuguuauuuuaacaaauuucucuaggcugggcaugguggcucaugccuauaaucc

SEQ ID NO: 160340 - RNA, 64 nt, Homo Sapiens
aagaccuuaucucuacaaaaaaauuuagaaauuagcugggcaugguggcacccaucuguagucc

SEQ ID NO: 160341 - RNA, 64 nt, Homo Sapiens
guggcgggugccuguaauccaaauacaaaaauuggcugggcaugugaaaccccaucucuacuaa

SEQ ID NO: 160342 - RNA, 64 nt, Homo Sapiens
gcauaguggcuuaugccuguagcagaaaagaagggcugggcaagcgguagggggcaggaagagg

SEQ ID NO: 160343 - RNA, 64 nt, Homo Sapiens
guggugcacaccugucgucuaaaauauaaaauuagcugggcauggugaaauccugucucuacua

SEQ ID NO: 160344 - RNA, 64 nt, Homo Sapiens
ugggagcaccagcugcggcggagguggacagcgagcugggcaccacggcuaugacagugaugag

SEQ ID NO: 160345 - RNA, 64 nt, Homo Sapiens
ugaggaaaggacagccccugagaauguuugcagagcugggcagucuucuccaccuucucuccac

SEQ ID NO: 160346 - RNA, 64 nt, Homo Sapiens
agugcagcugauaucguuugaagcuugacaggcagcugggcaucgcccugggacuccuaucagg

SEQ ID NO: 160347 - RNA, 64 nt, Homo Sapiens
gugacagugcuagaagaccccagacaccuccugggcugggcagaaguaccaggcuucgugggca

SEQ ID NO: 160348 - RNA, 64 nt, Homo Sapiens
acugguccuugugaggaugcgcaugcccaagggugcugggcaucgucuggccggugugcuggau

SEQ ID NO: 160349 - RNA, 64 nt, Homo Sapiens
ugggagagcuuccagaauccucccaugcccggcugcugggcaccucucugcugccacaugccgu

SEQ ID NO: 160350 - RNA, 64 nt, Homo Sapiens
uggacagccccagccaccacacugaccccgggaggcugggcaggguucugccacagcccugcau

SEQ ID NO: 160351 - RNA, 64 nt, Homo Sapiens
ccuucaguguggcuggcguugccgucccugccccgcugggcagcuacccacucccugcacgccu

SEQ ID NO: 160352 - RNA, 64 nt, Homo Sapiens
acaguguuuccaagagcaaguaugcucacgggaggcugggcaccagggcaaccguugucaaggc

SEQ ID NO: 160353 - RNA, 64 nt, Homo Sapiens
gguacucaggaccucauagggacagcaccccugagcugggcaaaauuccaagagagcuuaggau

SEQ ID NO: 160354 - RNA, 64 nt, Homo Sapiens
cuugggauuguuuuacaccauccuuuacuucccuugcucagaccucucuguuucaccauugcuc

SEQ ID NO: 160355 - RNA, 64 nt, Homo Sapiens
gcaaaauauggccucaccaccagccccaaaucagugcucagacccucucugugucugugugccc

SEQ ID NO: 160356 - RNA, 64 nt, Homo Sapiens
uacauguggcuaccccagcaacaagcgcauccugugcucagauaagcugcaugguugggagugu

SEQ ID NO: 160357 - RNA, 64 nt, Homo Sapiens
uugaggcuuaguggagaugggcaccacugccauuugcucagaagaaggcuggucugguccuaac

SEQ ID NO: 160358 - RNA, 64 nt, Homo Sapiens
gaugggaugguugcuaugccaagccuuguuucucugcucagaagaaguagagaagcuauuauca

SEQ ID NO: 160359 - RNA, 64 nt, Homo Sapiens
ucuuaaucaagaauuaagcuugcaacauuggcuuugcucagaugcagauggaagugugaucaca

SEQ ID NO: 160360 - RNA, 64 nt, Homo Sapiens
gugcaccgcugucccaucuacagacccuuccccgugcucagacaggcagcucuuuucuucugcu

SEQ ID NO: 160361 - RNA, 64 nt, Homo Sapiens
cuuccccgugcucagacagucagcucuuuucuucugcucagacccucauuccaugcaucuuugg

SEQ ID NO: 160362 - RNA, 64 nt, Homo Sapiens
uaaagccucugcaacaagucuuuucagauccaagugcucagaucaggcaucuaaagagaaacug

SEQ ID NO: 160363 - RNA, 64 nt, Homo Sapiens
acuguggccacacuuugcugauaugacugagcauugcucagaucgagcagauuuuaaaaaaaag

SEQ ID NO: 160364 - RNA, 64 nt, Homo Sapiens
gaagggacuguggucgcuccgcaaccugacgcgaugcucagacacagcgucaggugggaguacu

SEQ ID NO: 160365 - RNA, 64 nt, Homo Sapiens
cagaaucaguguccuagagagcaaccugacacaaugcucagaaagugugugaggugggaguacu

SEQ ID NO: 160366 - RNA, 64 nt, Homo Sapiens
cagaagggacugcagucguggcaaccugacacgaugcucagacacaaagucagaugggaguacu

SEQ ID NO: 160367 - RNA, 64 nt, Homo Sapiens
agaauagggcuguggccgcggcaaccugacaggaugcucagacacaaagucaggugggaguacu

SEQ ID NO: 160368 - RNA, 64 nt, Homo Sapiens
gcucccaguucccucgucccagagcaguaaucccugcucagaaugagagcucagaccacugcuc

SEQ ID NO: 160369 - RNA, 64 nt, Homo Sapiens
aguaaucccugcucagaaugagagcucagaccacugcucagagccuccuaaggcuaagauguug

SEQ ID NO: 160370 - RNA, 64 nt, Homo Sapiens
uuucauaauucuucccccaauuggcuuuucauagugcucagauguaacccaccuugaccauaaa

SEQ ID NO: 160371 - RNA, 64 nt, Homo Sapiens
uuuucugaucucagagcauuuggcaucacgucagugcucagaaacguguggaauuuuccacuuc

SEQ ID NO: 160372 - RNA, 64 nt, Homo Sapiens
cccacugcccccucucucugcucccagcuaaaggugcucagagccucauaggugcccagccagc

SEQ ID NO: 160373 - RNA, 64 nt, Homo Sapiens
uucuggauauuaccucuucuccuuuguuuuguucugcucagauaccucaaacugugcauguaag

SEQ ID NO: 160374 - RNA, 64 nt, Homo Sapiens
cagaacaagugaugaccuaacaccucuggaucucugcucagaaggugcagauauugcacugugu

SEQ ID NO: 160375 - RNA, 64 nt, Homo Sapiens
agcuuuuuucauaauucagguggcaaaccaaguaugcucagauaagucaccuccaguaacaaga

SEQ ID NO: 160376 - RNA, 64 nt, Homo Sapiens
cacuuagccacuugagaaccccggauuuaaaacuugcucagagcuccaaaggguacuugcgaug

SEQ ID NO: 160377 - RNA, 64 nt, Homo Sapiens
cucacaugggcacccccauuugaggcagaggaguugcucagaggcaucucucagaccagcucac

SEQ ID NO: 160378 - RNA, 64 nt, Homo Sapiens
agcuggaauuauaggcgugcuucuccugccucagccucccgaguugccucccgaguucaagcga

SEQ ID NO: 160379 - RNA, 64 nt, Homo Sapiens
ucaagcgauucuccugccuccacugcaacuucugccucccgagugcaguggcaccaucucaguu

SEQ ID NO: 160380 - RNA, 64 nt, Homo Sapiens
cgccucccggguucucaccauucuccugccucagccucccgaguagcugggacuacaggcgccc

SEQ ID NO: 160381 - RNA, 64 nt, Homo Sapiens
ugccuccuggguucaagugauucuccagccucagccucccgaguagcugggauuaugggcgccc

SEQ ID NO: 160382 - RNA, 64 nt, Homo Sapiens
cagcuccuaaccgcgagugauccgccagccucggccucccgaggugccgggauugcagacggag

SEQ ID NO: 160383 - RNA, 64 nt, Homo Sapiens
gcuacaaccuccaccucccagcugccugccuuggccucccgaagugccaagagugcagccucug

SEQ ID NO: 160384 - RNA, 64 nt, Homo Sapiens
cuucuccuggguccaagcaauuauugugccucagccucccgaguagcugagacuucaggugcau

SEQ ID NO: 160385 - RNA, 64 nt, Homo Sapiens
ugccucccagguucaagcgauucuucugccucagccucccgaguagcugggaccacaggugccu

SEQ ID NO: 160386 - RNA, 64 nt, Homo Sapiens
ccucaggugcuacacaguauaguucuaggguuucccucccgauaucaaaaagacuguggccugc

SEQ ID NO: 160387 - RNA, 64 nt, Homo Sapiens
cgccucucuaguucaagcgauuuuccugccucagccucccgaguagcugggauuccaggcgccc

SEQ ID NO: 160388 - RNA, 64 nt, Homo Sapiens
agcaugaagaaggagccaugaggaguucccaugaccucccgagacuugccauaaguguucuagu

SEQ ID NO: 160389 - RNA, 64 nt, Homo Sapiens
ugcugggauuauaggugugauccgccugucucggccucccgaaggaauuccucaccucagguca

SEQ ID NO: 160390 - RNA, 64 nt, Homo Sapiens
agcugggacuacgggcacgcuucuccugccucagccucccgagucaccuuccagguucaaguga

SEQ ID NO: 160391 - RNA, 64 nt, Homo Sapiens
gcuguggugcaaucucggcucacugcaaccucugccucccgaguucaagcaauucuccugccuc

SEQ ID NO: 160392 - RNA, 64 nt, Homo Sapiens
ugccucccgaguucaagcaauucuccugccucagccucccgaguagcugggauuacaggcgacc

SEQ ID NO: 160393 - RNA, 64 nt, Homo Sapiens
cgucuccuggguucaagugauucuucugccucagccucccgagcagcugggauuacaggcgccc

SEQ ID NO: 160394 - RNA, 64 nt, Homo Sapiens
ucaaucucuugaccucuugauccacccgacuuggccucccgaagugaugagauuauaggcguga

SEQ ID NO: 160395 - RNA, 64 nt, Homo Sapiens
cgccucuuggguucaagcgauucuucugcuucagccucccgaguagcugggacuacaggcaccc

SEQ ID NO: 160396 - RNA, 64 nt, Homo Sapiens
caaccuccugggcuaagugauccucccaccucagccucccgaauagcugggacuacagguguga

SEQ ID NO: 160397 - RNA, 64 nt, Homo Sapiens
agcugggauuacaggugccuuucuccugccucagccucccgagucgccucccgaguucaagcaa

SEQ ID NO: 160398 - RNA, 64 nt, Homo Sapiens
ucaagcaauucuccugccuccacugcaagcuccgccucccgagugcaguggcgcgaucuuggcu

SEQ ID NO: 160399 - RNA, 64 nt, Homo Sapiens
agcugggauuacaggcgcccuucuccugccucagccucccgaguugccucccgaguucaaggga

SEQ ID NO: 160400 - RNA, 64 nt, Homo Sapiens
ucaagggauucuccugccuccacugcaacuucugccucccgagugcaguggcgccaucucagcu

SEQ ID NO: 160401 - RNA, 64 nt, Homo Sapiens
ggacuccugaucucaggugaccugcccaccucggccucccgaagugcugggauuacaaggguga

SEQ ID NO: 160402 - RNA, 64 nt, Homo Sapiens
ccccuuccggguucaugccauucuccugccucagccucccgaguagcugggacuacaggcacgu

SEQ ID NO: 160403 - RNA, 64 nt, Homo Sapiens
agcugggauuacaggcaugcuucuccuucuucagccucccgagucaccuccuggguucaagcaa

SEQ ID NO: 160404 - RNA, 64 nt, Homo Sapiens
agcugagauuauaggcgugcuucuccuucuucagccucccgagucaccucccggguucaagcaa

SEQ ID NO: 160405 - RNA, 64 nt, Homo Sapiens
guuauugccaauauuguuguuggucaauggcuugaagauaaacuuucuaauaauuauuauuucu

SEQ ID NO: 160406 - RNA, 64 nt, Homo Sapiens
cauucccaguuucagccacaauuuagccaagaauaagauaaaaacuugaauaagaaguaaguag

SEQ ID NO: 160407 - RNA, 64 nt, Homo Sapiens
cuaggccaggcaugguggcuaaaacugccauauaaagauaaagucucaauuuugcugugaaccu

SEQ ID NO: 160408 - RNA, 64 nt, Homo Sapiens
cucucauaggcacuggggaccccuccacuguccuaagauaaagcuaucuuuuaaaaccucaagg

SEQ ID NO: 160409 - RNA, 64 nt, Homo Sapiens
ugguggaauagguuuuaucaacaugcuguggaugaagauaaagaccaggcacugaaugucuagg

SEQ ID NO: 160410 - RNA, 64 nt, Homo Sapiens
uauuuucacacaguccacaauguucaaauacauaaagauaaauuagaggcacaucuauggcuac

SEQ ID NO: 160411 - RNA, 64 nt, Homo Sapiens
uaauauauaaagggugaggaaugcucuauuuauaaagauaaauguuauggccacucgagucagg

SEQ ID NO: 160412 - RNA, 64 nt, Homo Sapiens
guaauccagacaccuaauucuuuuggaaacuguuaagauaaacuagacggcugaaagacagguu

SEQ ID NO: 160413 - RNA, 64 nt, Homo Sapiens
gucagaagaccaccugugcccuuuucucucguggaagauaaaaccuggacucagggagcaacca

SEQ ID NO: 160414 - RNA, 64 nt, Homo Sapiens
aauuuuguuccuuuucaucauagaaaacauguuuaagauaaaauacaaacuuuaccuaccccaa

SEQ ID NO: 160415 - RNA, 64 nt, Homo Sapiens
auuguagagcuugguggcugagcuuggcccuauuaagauaaauagaguuccaaauaaggauuug

SEQ ID NO: 160416 - RNA, 64 nt, Homo Sapiens
uagggcagucaguaguauucuaaagcuuucugacaagauaaaggaagucaccaaaauuucuuuu

SEQ ID NO: 160417 - RNA, 64 nt, Homo Sapiens
uguugugcuuuaacucauuucaaauggcauucccaagauaaagcuuaguaagaugguuuuucag

SEQ ID NO: 160418 - RNA, 64 nt, Homo Sapiens
ugaaaaauccauaaugaaaugaaauucaguuuauaagauaaaucccaauuauuuugaugcaaaa

SEQ ID NO: 160419 - RNA, 64 nt, Homo Sapiens
agaagucuuucaucuuuacuuucaugaagcacagaagauaaagaagggaugccugagauggcag

SEQ ID NO: 160420 - RNA, 64 nt, Homo Sapiens
uauggcaucauuuagggaugcuggacacaaaaauaagauaaaugggaauucuucaaguuuaaau

SEQ ID NO: 160421 - RNA, 64 nt, Homo Sapiens
gcuuaugauuucaauagucaaauauaaccuuuucaagauaaaucuauacuugcauccaccuaca

SEQ ID NO: 160422 - RNA, 64 nt, Homo Sapiens
gcuguaauucggacaaacauaaucuuaaaguugcaagauaaacaaguuacauuugcauuuaauu

SEQ ID NO: 160423 - RNA, 64 nt, Homo Sapiens
aauuuauaauugaacaauuugcaauaauguacagaagauaaaaauaauuuuguggcucccuaau

SEQ ID NO: 160424 - RNA, 64 nt, Homo Sapiens
aauguauuuucuuuauuucacuguaagagaauaaaagauaaaauaaaguagcuuugaauuuucu

SEQ ID NO: 160425 - RNA, 64 nt, Homo Sapiens
agcuuaaacaaauaacuuugggcugaugguguugaagauaaauaggcuaaaauaaacagguugu

SEQ ID NO: 160426 - RNA, 64 nt, Homo Sapiens
gauugugaaaagagcauuuaaaaaagaaaagaaaaagauaaaggacucugucucaaaaaaaaaa

SEQ ID NO: 160427 - RNA, 64 nt, Homo Sapiens
ggccgggugugguggcucacuuuucaggaaucaaaagauaaagguacugaaguuaagugcauug

SEQ ID NO: 160428 - RNA, 64 nt, Homo Sapiens
uagaaagucugaacauuuuaagcaaaggcaaauuaagauaaagcauaacuacauaaagcaguga

SEQ ID NO: 160429 - RNA, 64 nt, Homo Sapiens
ugguguccucauaacuuuaauuucucuaauauagaagauaaaauaucacggaauuuauguauag

SEQ ID NO: 160430 - RNA, 64 nt, Homo Sapiens
auuuuuaaagguuaugaaaaccacuaaauuguugaagauaaauuugaagaaauugauuacaguu

SEQ ID NO: 160431 - RNA, 61 nt, Homo Sapiens
gaagugacaucucuuguacaguauguuaaugaagauaaaaaauauuucaggaggagaauga

SEQ ID NO: 160432 - RNA, 64 nt, Homo Sapiens
uuuuuucacguuagaagacaugaagaaauuuuaaaagauaaacaucuauauugugaaccaucag

SEQ ID NO: 160433 - RNA, 64 nt, Homo Sapiens
agauaaacaucuauauugugaaccaucagcugaaaagauaaauuuguguucaauauauaggcag

SEQ ID NO: 160434 - RNA, 64 nt, Homo Sapiens
ucacaccugagggcugaaaauuuuagaauaaugcaagauaaaaacagcuuuggcucuggcugcu

SEQ ID NO: 160435 - RNA, 64 nt, Homo Sapiens
aacuguuaccagauaacaaacaaguaauuguaggaagauaaaaaccccgaagacacuccuuccc

SEQ ID NO: 160436 - RNA, 64 nt, Homo Sapiens
ccugggucccucccacaacaugugggaauuccagaagauaaauucaaguugcaauuucaguggg

SEQ ID NO: 160437 - RNA, 64 nt, Homo Sapiens
guuaauuugaggacugggcugucuuggggcucagaagauaaagaacuauuugagcagaugugug

SEQ ID NO: 160438 - RNA, 64 nt, Homo Sapiens
agacuccaucucaaaaaaaaaaaaaaaaaaaaaaaagauaaaaagucagaaaucugaaaagugg

SEQ ID NO: 160439 - RNA, 64 nt, Homo Sapiens
agggccugaugacauccaauacagaguucugguaaagauaaaauuugauacagguuugguguca

SEQ ID NO: 160440 - RNA, 64 nt, Homo Sapiens
gauaggaaaagauucaaagcucccuguaggaguaaagauaaaaggagaagggagcugaggccau

SEQ ID NO: 160441 - RNA, 64 nt, Homo Sapiens
acgaauccccuaaacaaaaaaaucuuaagauuacaagauaaaaaguaaaguugaggggagagga

SEQ ID NO: 160442 - RNA, 64 nt, Homo Sapiens
gggucuuggcugaaaaaaaaaaaugcuuuuaaaaaagauaaaaugaaaaggagagcucucuuuu

SEQ ID NO: 160443 - RNA, 64 nt, Homo Sapiens
cacccuguguggcucauucccacccaggaaacugaagauaaaagauuugggaaaacacaccaag

SEQ ID NO: 160444 - RNA, 64 nt, Homo Sapiens
cagaaaguuaaguguauacuacaaacucuaauuaaagauaaaaaucuuuucuacuuuucuuugu

SEQ ID NO: 160445 - RNA, 64 nt, Homo Sapiens
augcuuuuuuauguguuuuuacauuuuuugaaagaagauaaaugguucauccagagcuuuauua

SEQ ID NO: 160446 - RNA, 64 nt, Homo Sapiens
uaucuuuaccuuauuaauauauaaauaagugaauaagauaaaaacauacuuauccucugaacac

SEQ ID NO: 160447 - RNA, 64 nt, Homo Sapiens
cauauuauuaaauaccuauauaaacgaaaugauaaagauaaaacguuuuugugauuuaugcgau

SEQ ID NO: 160448 - RNA, 64 nt, Homo Sapiens
uuuauucuuuaguguuaaaaauaagauaaauacgaagauaaagccauugauaagaguccuauaa

SEQ ID NO: 160449 - RNA, 64 nt, Homo Sapiens
cgaagauaaagcuuuauucuagaguccuauaaauaagauaaauauacaaaguucuucauugaua

SEQ ID NO: 160450 - RNA, 64 nt, Homo Sapiens
uucuagguuagucaagauuuaugauaauuauguaaagauaaauacguauauuaaaccuguugaa

SEQ ID NO: 160451 - RNA, 64 nt, Homo Sapiens
aaaguaauaaguuuaacguaacuuuuuuaacuucaagauaaaucuuugugugcuugcguugaug

SEQ ID NO: 160452 - RNA, 64 nt, Homo Sapiens
gguauacuggaauccgaugcuggcagagcacgucaagauaaauggccuuagugauaagcuuuca

SEQ ID NO: 160453 - RNA, 64 nt, Homo Sapiens
acagaagacuggccccagagcuugcaaaaggagaaagauaaaauacucuucaugugaaucuuaa

SEQ ID NO: 160454 - RNA, 64 nt, Homo Sapiens
cauacauuguccacaggugacuuucggauuaguuaagauaaaaggaguuugguuaucaauauaa

SEQ ID NO: 160455 - RNA, 64 nt, Homo Sapiens
uuaaguguaagaaaauuauauauauguuagucuaaagauaaaccuugauuuacauauaguuaaa

SEQ ID NO: 160456 - RNA, 64 nt, Homo Sapiens
aaaguuauuauaacagugaucuucuguaaaaugcaagauaaauuuuuuuaaaaucguucauaga

SEQ ID NO: 160457 - RNA, 64 nt, Homo Sapiens
agcugccaagauuuuuggcgguuguauuaaaaacaagauaaaaagccaucagaguggauauacc

SEQ ID NO: 160458 - RNA, 64 nt, Homo Sapiens
acuuugaauguuuuaacagcaagaauuuuaagaaaagauaaacaccauuuuauuuauuuauaaa

SEQ ID NO: 160459 - RNA, 64 nt, Homo Sapiens
aacaguucuccagagcaucuugaacaggaauauuaagauaaaugugaaucugcaauggcugaaa

SEQ ID NO: 160460 - RNA, 64 nt, Homo Sapiens
ccugaauuugaaauauuuuuaucaaauaauuucuaagauaaaaguaguuuuaauuaucauugcu

SEQ ID NO: 160461 - RNA, 64 nt, Homo Sapiens
guugucauauuuguugggucucucauacauuggcaagauaaauaucuaaccaauagucacuaca

SEQ ID NO: 160462 - RNA, 64 nt, Homo Sapiens
uuccuuuuuauaccucaguuaguuguauuuuuaaaagauaaauagagaugccaguaguguucaa

SEQ ID NO: 160463 - RNA, 64 nt, Homo Sapiens
aauguacugagcaagcaaaguugagucucaauugaagauaaaaguaaugcaagcauacccuccc

SEQ ID NO: 160464 - RNA, 64 nt, Homo Sapiens
uguguuggacaagcauagaaaacuugggauccugaagauaaauaccuaaaucucuuugccuaac

SEQ ID NO: 160465 - RNA, 64 nt, Homo Sapiens
aaucucaggugggacuuggcgcucucucuuuucugcaugucaaguucugagcgcggacauguuu

SEQ ID NO: 160466 - RNA, 64 nt, Homo Sapiens
gaggccuuguuggcacuagauuuggguauuuucugcaugucauaacauauccuaacugcuauuu

SEQ ID NO: 160467 - RNA, 64 nt, Homo Sapiens
ccaccugccccauguccacugggcugcccaagcugcaugucaccugagggcuggcaggaagggg

SEQ ID NO: 160468 - RNA, 64 nt, Homo Sapiens
aaauguacauucauuuuuaggucuagagacaauugcaugucaaaugguaauagguaucagagca

SEQ ID NO: 160469 - RNA, 64 nt, Homo Sapiens
gccuuauuugguuagcagacagaaaauuguuuuggcaugucagauacuauauagcaagauacag

SEQ ID NO: 160470 - RNA, 64 nt, Homo Sapiens
ccaaagugaaagggaagcccccgucucucuaacugcaugucaucaggggugagccugccuuucc

SEQ ID NO: 160471 - RNA, 64 nt, Homo Sapiens
gcagggcaccacagcgcccccuacugaaccaucagcaugucaguggcauuuaaagccaugcagc

SEQ ID NO: 160472 - RNA, 64 nt, Homo Sapiens
uggccuguuuucuaaauaauuccgcagaguaguugcaugucauuugauuccugcuucgucugua

SEQ ID NO: 160473 - RNA, 64 nt, Homo Sapiens
gagcgacacugucccugccuacagucauguuucugcaugucagcucaucaucaucaucucugcu

SEQ ID NO: 160474 - RNA, 64 nt, Homo Sapiens
gugcugcagagauuuuguuucauagccaucacgagcaugucacagcagccuccagcaugggcgu

SEQ ID NO: 160475 - RNA, 64 nt, Homo Sapiens
agugaaaccauccauaacugauggauccugcagagcaugucaggcaagguucucuucuguuccc

SEQ ID NO: 160476 - RNA, 64 nt, Homo Sapiens
uuaaaaaaauuaacuauacaguuaaugguuuagaacuuagaacuacuuagaauuaaugcuaaag

SEQ ID NO: 160477 - RNA, 64 nt, Homo Sapiens
uaacuauacaguuaaugguuuagaacuuagaacuacuuagaauuaaugcuaaagugucaggaag

SEQ ID NO: 160478 - RNA, 64 nt, Homo Sapiens
uacguagguagagaauacaacaaagaguucuaagacuuagaaaagacaauuuuguggugucauu

SEQ ID NO: 160479 - RNA, 64 nt, Homo Sapiens
ccuauaauauacaaauuuuccuguaauaaagucaacuuagaaacuccaaggagguuacauguuu

SEQ ID NO: 160480 - RNA, 64 nt, Homo Sapiens
caaugaauacguaaacauacagugacaacauuaaacuuagaaaaguuuuaaaacuuaauggauc

SEQ ID NO: 160481 - RNA, 64 nt, Homo Sapiens
auuucuucgcacuucugagacggcaaagccaaccacuuagaagccuuccacaucuuugucaccu

SEQ ID NO: 160482 - RNA, 64 nt, Homo Sapiens
auuauaaaacccuucauaaaucaagaaggccaucacuuagaacgaaccccaaacaaaaaugcca

SEQ ID NO: 160483 - RNA, 64 nt, Homo Sapiens
caaaucuaagcaaucauuuuuccccccagaaguuacuuagaaggagaacugggaacacuugggg

SEQ ID NO: 160484 - RNA, 64 nt, Homo Sapiens
cauuucucccuucucugccaaaaugacuuauuucacuuagaauagaacucagucuugauaacug

SEQ ID NO: 160485 - RNA, 64 nt, Homo Sapiens
cagucuugauaacugaaaugaguaaaaauagauaacuuagaacuuuaaauagcauuuuugcacc

SEQ ID NO: 160486 - RNA, 64 nt, Homo Sapiens
auuuuuauguuuauaaaguguaauuuuuagguucacuuagaauauauuuuauuuaauaaguuaa

SEQ ID NO: 160487 - RNA, 64 nt, Homo Sapiens
caaauucuuauuuuuguacaguuuugaaguuuauacuuagaacugaccaccuccccggccacgc

SEQ ID NO: 160488 - RNA, 64 nt, Homo Sapiens
cgguaccaauccuaggaacuguauacuaguuccuacuuagaacaaaaguaucaaguuugcacac

SEQ ID NO: 160489 - RNA, 64 nt, Homo Sapiens
uucuaaguacuuuacuuguauuaucccauuuaauacuuagaacaaccccgugagauaaguaguu

SEQ ID NO: 160490 - RNA, 64 nt, Homo Sapiens
gaucuugguuuuuccaaacuggcaccuauuuggaacuuagaaaaaugacucuugggugagcaac

SEQ ID NO: 160491 - RNA, 64 nt, Homo Sapiens
agcugaaauacaaaagcagaucuagaggaagggaacuuagaagauuuccucgaugccucagguu

SEQ ID NO: 160492 - RNA, 64 nt, Homo Sapiens
uucuacagucgucgauuuuuccaaauugugguacacuuagaaaauuguuacucugguuguugug

SEQ ID NO: 160493 - RNA, 64 nt, Homo Sapiens
uuuuuggauaugccacugcacaaccuaaaagcccacuuagaaacccacaaggaggaaggaaggg

SEQ ID NO: 160494 - RNA, 64 nt, Homo Sapiens
accacuaauagcagucauagugaagauuagcacuacuuagaauuaaauuaggaagucuuuuauc

SEQ ID NO: 160495 - RNA, 64 nt, Homo Sapiens
aggauuuagauguauagaaaaguaagaaaaucuuacuuagaaaaaagccccuugaaacuugcag

SEQ ID NO: 160496 - RNA, 64 nt, Homo Sapiens
uacacagauccuaaguagaauaaaggagagaaagacuuagaacaucagauuaucucuuuuuuuc

SEQ ID NO: 160497 - RNA, 64 nt, Homo Sapiens
uacacagauccaaaauagaauaaaugagagaaagacuuagaauggacuugagaauguuuuucuc

SEQ ID NO: 160498 - RNA, 64 nt, Homo Sapiens
uugcucugugguaagagauaugcucauuauuaccacuuagaagauguuguuaaaaacaugugaa

SEQ ID NO: 160499 - RNA, 64 nt, Homo Sapiens
uaguaucacugcuuuuuccuuagcuuaaugacuuacuuagaauuuauccuuuauuuuaaaugau

SEQ ID NO: 160500 - RNA, 64 nt, Homo Sapiens
aaauuuauuuuucuggaauuaaagacugacacagacuuagaauccaguugauuaauuuugcguu

SEQ ID NO: 160501 - RNA, 64 nt, Homo Sapiens
auaaggaauaagucuuugaaccuugaaguuuuuuacuuagaaaugaaacugacuuuaaaagccu

SEQ ID NO: 160502 - RNA, 64 nt, Homo Sapiens
guaagugacaaguauuuuuucugaacagaaguuuacuuagaaauaccaugcacuuggggguacc

SEQ ID NO: 160503 - RNA, 64 nt, Homo Sapiens
uauuauucauuacugcauccccaguaaugaaaguacuuagaaaauaauuauugaaugaaugaaa

SEQ ID NO: 160504 - RNA, 64 nt, Homo Sapiens
guuaauuggaaaucagaguuacuuaaagaauaauacuuagaaggucaccauggaugaaacuaua

SEQ ID NO: 160505 - RNA, 64 nt, Homo Sapiens
ucaaguucuagcauuuuagugcagugggauguggacuuagaaaaaaugcuucauccuguugcug

SEQ ID NO: 160506 - RNA, 64 nt, Homo Sapiens
ugcgaacgugaacacaguggugccagaugccccagugccagagcagacaucucuuuuaaaaaag

SEQ ID NO: 160507 - RNA, 64 nt, Homo Sapiens
ccccagugccagagcugcgaucucuuuuaaaaaagugccagauguucaucuagaggcagagaca

SEQ ID NO: 160508 - RNA, 64 nt, Homo Sapiens
aagggguuuguaguauauauacacagggccuugugugccagacuaaaagaaaugggagcugguc

SEQ ID NO: 160509 - RNA, 64 nt, Homo Sapiens
acagacagguucaaaacugguaucaggaagcccagugccagaggggagaggacccucaguguca

SEQ ID NO: 160510 - RNA, 64 nt, Homo Sapiens
ccaggucucuccaagugcauuucccaggcccugugugccagaggcuauccugggcugcucagug

SEQ ID NO: 160511 - RNA, 64 nt, Homo Sapiens
gugggagugggugcgcgugugcaggggaggaugggugccagagggcugcucccucgugcacagc

SEQ ID NO: 160512 - RNA, 64 nt, Homo Sapiens
uucgacuccccgaggugcagugccugagauggcugugccagaggagagaugaaacucccuaaaa

SEQ ID NO: 160513 - RNA, 64 nt, Homo Sapiens
ugaaagucccugagaugaagugcagcugccgaaagugccagagaagaggugcggcuuccagagg

SEQ ID NO: 160514 - RNA, 64 nt, Homo Sapiens
ugcggcuuccagaggugcagugucagagguggcugugccagaggagagaugaaacucccagagg

SEQ ID NO: 160515 - RNA, 64 nt, Homo Sapiens
uggcugugccggaggugcggugaaacucccaaaggugccagagagcugcugaaagugucggaga

SEQ ID NO: 160516 - RNA, 64 nt, Homo Sapiens
uggcugugccggaggugcggugaaacucccaaaggugccagagagcugcccaaagugucagaga

SEQ ID NO: 160517 - RNA, 64 nt, Homo Sapiens
uggcugugccggaggugcggugaaacucccaaaggugccagagagcuccccaaggugucagaga

SEQ ID NO: 160518 - RNA, 63 nt, Homo Sapiens
aucccaguccggcuaagcuugguggagcauuuucccauugagagccuuccaugggaacucaau

SEQ ID NO: 160519 - RNA, 63 nt, Homo Sapiens
auuugaggguacucugacugcaacaucuuucaccccauugaucgccaggauugauuugguuga

SEQ ID NO: 160520 - RNA, 63 nt, Homo Sapiens
gaugagaggucugaagccuuggcaucacucuggcccauugacaggguuucuagcggugccuga

SEQ ID NO: 160521 - RNA, 63 nt, Homo Sapiens
gagccucuuaaggcagcuggguucugaagcuggcccauugaaaccgcugcgguacacuggaug

SEQ ID NO: 160522 - RNA, 62 nt, Homo Sapiens
agcacaaagcccguuugggguggccccgaauccccauugagcagccgcggcaucgcuucuga

SEQ ID NO: 160523 - RNA, 63 nt, Homo Sapiens
ccucuggaugcacucugaugauaccaugguuaccccauugagcucuguuuaaauaaauauugu

SEQ ID NO: 160524 - RNA, 63 nt, Homo Sapiens
uagugaugugacuuccaaguagaauuuaaucuccccauugagugugucaugguacaaaucacu

SEQ ID NO: 160525 - RNA, 64 nt, Homo Sapiens
cugcaaugagcuggguagaagagguuaguuuuauagacaggaaggggcugucaaaggcagaaag

SEQ ID NO: 160526 - RNA, 64 nt, Homo Sapiens
agaacaaaaaaaaagauugauuuuuuuuuuuuugagacaggaucucacucugucauccaggcug

SEQ ID NO: 160527 - RNA, 64 nt, Homo Sapiens
cucacacuuguaaucccagcaauuugggaggcugagacaggaggauugccugaggccaggaguu

SEQ ID NO: 160528 - RNA, 64 nt, Homo Sapiens
uccauggggcuauaguagagaguuaguggaauauagacaggacucugaaaacacaacuuccagc

SEQ ID NO: 160529 - RNA, 64 nt, Homo Sapiens
accaggaugcuucauguccaccagagagcuguagagacaggacccgcuaaggcuaagguaggag

SEQ ID NO: 160530 - RNA, 64 nt, Homo Sapiens
gcagugguuaaaagaauuaaccugacuuuaucugagacaggaaguagaaacucagccaaggaga

SEQ ID NO: 160531 - RNA, 64 nt, Homo Sapiens
gaagauauuagugauuagacagacauuagugauuagacaggaggcagugauuagacaggaagga

SEQ ID NO: 160532 - RNA, 64 nt, Homo Sapiens
gaagacauuagugauuagacuuaacucagugauuagacaggaagaguaaaugacuauuuuuccc

SEQ ID NO: 160533 - RNA, 64 nt, Homo Sapiens
cggccagugcagugaugccuggcgcuuccagcugagacaggaguccggacagaggugggcaggg

SEQ ID NO: 160534 - RNA, 64 nt, Homo Sapiens
ugucuaucccagccggauuuaaagcagucacuucagacaggagccacagggagccugugaggga

SEQ ID NO: 160535 - RNA, 64 nt, Homo Sapiens
agcagugaguuacagcgagaggcagagaaagaagagacaggagggcaagggccaugcugaaggg

SEQ ID NO: 160536 - RNA, 64 nt, Homo Sapiens
cgggcgccuguagucccagccacucgggaggcugagacaggagaaucgcuuaaaccugggaggc

SEQ ID NO: 160537 - RNA, 64 nt, Homo Sapiens
uaaagaaauagccaaucaucugcuaauuaggcaaagacaggaggaaucagagagcucacuaaaa

SEQ ID NO: 160538 - RNA, 64 nt, Homo Sapiens
agcuggauuuccuaggcugagaugggggacugagagacaggacucacuuagguuuuccuguuga

SEQ ID NO: 160539 - RNA, 64 nt, Homo Sapiens
uucuaaaagcuagaaaaaaaaaccggaaaaugggagacaggauuacaaaugagggccagggagg

SEQ ID NO: 160540 - RNA, 64 nt, Homo Sapiens
ugaugagaaaagcucaccgccagaucugaagugaagacaggagaaauccccucacagugggcga

SEQ ID NO: 160541 - RNA, 64 nt, Homo Sapiens
ccccucacagugggcgacagagaggcaaugggugagacaggaauaguccaaaaagcacccacag

SEQ ID NO: 160542 - RNA, 64 nt, Homo Sapiens
cagggaguucauuuggccacauggaaaucaccugagacaggaaaaaagggaacaucagggucaa

SEQ ID NO: 160543 - RNA, 64 nt, Homo Sapiens
aguuuuacggaaacaacucauagccaucuccaggagacaggaucugcacugggggacuggaugc

SEQ ID NO: 160544 - RNA, 64 nt, Homo Sapiens
ugggcaccuuggaccuccagcuggccaauagaagagacaggagacaggaagccuucccauuuuu

SEQ ID NO: 160545 - RNA, 64 nt, Homo Sapiens
cuuggaccuccagcuggccaauagaagagacaggagacaggaagccuucccauuuuuucaaagu

SEQ ID NO: 160546 - RNA, 64 nt, Homo Sapiens
uaaaaaccuuuaaagagcauccauuugcuccaccagacaggagucuuucuuauacagauggugu

SEQ ID NO: 160547 - RNA, 64 nt, Homo Sapiens
uaacuuguauuagaauuguuccauuugcucaaccagacaggagucguuuguauacagauggugu

SEQ ID NO: 160548 - RNA, 64 nt, Homo Sapiens
ucccuguuuccuaggcugguacuguauuuuuugcagacaggaucgacuacaggugugagucacc

SEQ ID NO: 160549 - RNA, 64 nt, Homo Sapiens
ucacucuggcgcucuggagucggggagggguuaaagacaggaucacuuuucuuucuuuuuuuuu

SEQ ID NO: 160550 - RNA, 64 nt, Homo Sapiens
auccucuggcuggcuaacugcacaagauucccagagacaggaaaccccaaaaugcaagauuuuc

SEQ ID NO: 160551 - RNA, 64 nt, Homo Sapiens
aaugcauccauuccucaggggauguugagggaacagacaggagaugccuaaguggcugcugacu

SEQ ID NO: 160552 - RNA, 64 nt, Homo Sapiens
ucaccauguuggccaggcuguguauuuuuaguagagacaggauucagcacgcccagcuaauuuu

SEQ ID NO: 160553 - RNA, 64 nt, Homo Sapiens
uugcuggaccuccucucagccagaacccuucugcagacaggaaucgcugccaggcggugguguu

SEQ ID NO: 160554 - RNA, 62 nt, Homo Sapiens
guguacauaucuuaggaggguuaucuauguuaucugaguauauguuuggguaaccaaauugg

SEQ ID NO: 160555 - RNA, 62 nt, Homo Sapiens
aggaauguguuuucauuguuuuaaguuuuucuucugaguaaaacaaaauuauagaaaacaaa

SEQ ID NO: 160556 - RNA, 62 nt, Homo Sapiens
uggaagaccuuuuaaagcauuguuuuagaaugucugaguauuaagauacagauuaauuggga

SEQ ID NO: 160557 - RNA, 62 nt, Homo Sapiens
cugaguauuaagauacagauuaauugggaauaucugaguauuaaguacuuucuucagaguau

SEQ ID NO: 160558 - RNA, 62 nt, Homo Sapiens
aaagaaccaaauguaaauuuuuucugaguaguucugaguagguaaccugaaauauauaguug

SEQ ID NO: 160559 - RNA, 62 nt, Homo Sapiens
ucugaguaggaaagaaccaauauauaguuguuucugaguaguugugcucagauaaccugaaa

SEQ ID NO: 160560 - RNA, 62 nt, Homo Sapiens
uggugcacaauggaaauuauuuuaauuuguguucugaguauucacauccauuuuguuuuugc

SEQ ID NO: 160561 - RNA, 62 nt, Homo Sapiens
uacugaucuuucauaauccaagcaccccguuuucugaguacaucugagacuuuucuuuguuu

SEQ ID NO: 160562 - RNA, 62 nt, Homo Sapiens
ccuuucagauuuugaacaaguuagagaaagccucugaguauguuugaugggaacagaggugu

SEQ ID NO: 160563 - RNA, 62 nt, Homo Sapiens
ucagguguggcuuuuggcugacuuucuuggcuucugaguagcgugcuguguuacauacacau

SEQ ID NO: 160564 - RNA, 62 nt, Homo Sapiens
ugggacuacaggugcaugcccugucucagccuucugaguagcccucccggguucaagcaguu

SEQ ID NO: 160565 - RNA, 62 nt, Homo Sapiens
acgaauugggaugucuaaacguuauucuugcuucugaguauaaguaguuacuaaguuaacua

SEQ ID NO: 160566 - RNA, 62 nt, Homo Sapiens
acuuugccgaccugggcauguuuccaccguuuucugaguagcugcggccagagugaggcucc

SEQ ID NO: 160567 - RNA, 62 nt, Homo Sapiens
uccagcucuguccuaggagcauaggcgggaaaucugaguagagucugacugcaguuuuugcu

SEQ ID NO: 160568 - RNA, 62 nt, Homo Sapiens
uguccaucacuuugaggacugguuuuuuacuuucugaguaguaucacguuguacugauccca

SEQ ID NO: 160569 - RNA, 62 nt, Homo Sapiens
uagcuauuguucuauauacuucgccauaccucucugaguauuucucucucucucucucucuc

SEQ ID NO: 160570 - RNA, 64 nt, Homo Sapiens
uuacugaaaccaaaauauauuugcuucaucugccccuacuaaccaucccccugccugcugccuc

SEQ ID NO: 160571 - RNA, 64 nt, Homo Sapiens
cugcccugcgugcugguuccuucagaccccuaacccuacuaaccagcaggcucaucucaccucc

SEQ ID NO: 160572 - RNA, 64 nt, Homo Sapiens
uucauuuaaacaguugacaaguauaauuguuaauucaaaugaaauguaggaccucugaguggcu

SEQ ID NO: 160573 - RNA, 64 nt, Homo Sapiens
ccaucaacuggaugccaacuccaaaccauuuaauucaaaugaacuuaaaaaaucacguuagccu

SEQ ID NO: 160574 - RNA, 64 nt, Homo Sapiens
uauuuuauucuuuaauggaaaaagccauuaauauucaaaugaagggaucacauuaaaaaaaacc

SEQ ID NO: 160575 - RNA, 64 nt, Homo Sapiens
ucuugagaugcaaaaguucacuguugcaguguuuucaaaugaccaaucaaguacuacuucuugg

SEQ ID NO: 160576 - RNA, 64 nt, Homo Sapiens
ccauguuggccaggcugguuucaaacuccugagcucaaaugauccuccugccuuggccucccaa

SEQ ID NO: 160577 - RNA, 64 nt, Homo Sapiens
auucauagcaaagggcagccagugugugcagaaaucaaaugacagagaggaagugagagagaga

SEQ ID NO: 160578 - RNA, 64 nt, Homo Sapiens
ugaaaugaaauucauuuauuugucuugacaauguucaaaugauguagauugucuuagaaugaau

SEQ ID NO: 160579 - RNA, 64 nt, Homo Sapiens
ucgucucauauuugccucauucauccuauuaauuucaaaugauacugugggggaaaaacagggu

SEQ ID NO: 160580 - RNA, 64 nt, Homo Sapiens
cuaaaaauaaguucaacaacagcacaaaggcuuaucaaaugacacagugggaugucucucugug

SEQ ID NO: 160581 - RNA, 64 nt, Homo Sapiens
uagucacuuucgauacuguacugaagaaaaaagcucaaaugaucgugggggaggaaggcagcag

SEQ ID NO: 160582 - RNA, 64 nt, Homo Sapiens
auuucccagccuuucuucacaacacuuucuaacaucaaaugacucucaucaucaacaaauugua

SEQ ID NO: 160583 - RNA, 64 nt, Homo Sapiens
gaauuuggggaaaauauccugaaacucacuuuggucaaaugauuauuguguugucacuggaagu

SEQ ID NO: 160584 - RNA, 64 nt, Homo Sapiens
ugucauuggcacuuucagucagagguaucugugaucaaaugacuuuagagcuauguaggaacau

SEQ ID NO: 160585 - RNA, 64 nt, Homo Sapiens
aaucuguugacaccuuauaauguuuuauuuugauucaaaugaugagcagugaugauauucagau

SEQ ID NO: 160586 - RNA, 64 nt, Homo Sapiens
cagcucucagugauguuagauggaaacuuauaucucaaaugauaggauugugaugcuuuuuuug

SEQ ID NO: 160587 - RNA, 64 nt, Homo Sapiens
gaucuuggcucacugcaaccuccaucucccggguucaaaugauucuccugccucagccucuuga

SEQ ID NO: 160588 - RNA, 64 nt, Homo Sapiens
uuaaaauacaagaccauugcacccuguaauuuauucaaaugauagcaauaugcuuucccuuuac

SEQ ID NO: 160589 - RNA, 64 nt, Homo Sapiens
augaugagucacuguaauaucagauuauuuucauucaaaugagguaauguaauaggucaaaaau

SEQ ID NO: 160590 - RNA, 64 nt, Homo Sapiens
uuauaaaagaggauucugaccccguuuuuguaaaucaaaugaaagaccuaaguuauuuugcugu

SEQ ID NO: 160591 - RNA, 64 nt, Homo Sapiens
ggagucagcagugaucauggucguaguuaagaccucaaaugaggcagaaaagugaacugaguuu

SEQ ID NO: 160592 - RNA, 64 nt, Homo Sapiens
uuuccaaaacuguggcagcuaacuuuuuaaaaucucaaaugacaugcagugugaguagaaggaa

SEQ ID NO: 160593 - RNA, 64 nt, Homo Sapiens
ggugcuaagaauuucaggauuauuguauuuacguucaaaugaagauggcuuuuguacuuccugu

SEQ ID NO: 160594 - RNA, 64 nt, Homo Sapiens
gucauguacaaauauugggacugauggguaacuuucaaaugagguuugaaagauuucauuaaga

SEQ ID NO: 160595 - RNA, 64 nt, Homo Sapiens
cuacaaaucuggcauguuuuauuugcuguugguuucaaaugaaaauuuuucaugacguuucaug

SEQ ID NO: 160596 - RNA, 64 nt, Homo Sapiens
uuggucuuuauuuccaguaguucauuuuugcuuuucaaaugacaugaacaguauuaggcaacuu

SEQ ID NO: 160597 - RNA, 64 nt, Homo Sapiens
uuauuugguauguguuuugccugguguaguaaaaucaaaugagauauguucgguuugccuucac

SEQ ID NO: 160598 - RNA, 64 nt, Homo Sapiens
auaugaugagaagcaacaacauauuguauauuguucaaaugaucuucuaggagauuuguuuggc

SEQ ID NO: 160599 - RNA, 64 nt, Homo Sapiens
ggaauaagcccugcccaguauguagacaaccaauucaaaugauugugcuaacuuauuuccccua

SEQ ID NO: 160600 - RNA, 64 nt, Homo Sapiens
uaauagaaugggcauguauuguaacaguuuuaugucaaaugaucugugcuguagaaaaacauua

SEQ ID NO: 160601 - RNA, 64 nt, Homo Sapiens
ucaaguuacaguggcuuauguuuuucauaguaauucaaaugaacuuccuauuuuugauaguaaa

SEQ ID NO: 160602 - RNA, 64 nt, Homo Sapiens
cccgugugacccguuccagguccccugggcucccucaaaugacagaccuaacuauuccugugua

SEQ ID NO: 160603 - RNA, 64 nt, Homo Sapiens
caaaaucauuucuuuagagggaaggaauaaucauucaaaugaacuuuaaaaaagcaaauuucau

SEQ ID NO: 160604 - RNA, 64 nt, Homo Sapiens
auagauacuuauaaugaaacuauguagaaaauaaucaaaugauauuaaacuuuuugcaugcuuc

SEQ ID NO: 160605 - RNA, 51 nt, Homo Sapiens
cugaauuuuaaacuuuuugcgucaaaugaaauccauuacagucaaggcuaa

SEQ ID NO: 160606 - RNA, 64 nt, Homo Sapiens
ugcuguagaaaauauuccuuuucauucuacuuuuucaaaugauacauguggaccaugaacagua

SEQ ID NO: 160607 - RNA, 64 nt, Homo Sapiens
agcugcagagaacucagcacuaaguggaauccuuucaaaugacgucaugcaguuuguuugaagu

SEQ ID NO: 160608 - RNA, 64 nt, Homo Sapiens
aaauaaacccagcacaaccugccauaagacccaaucaaaugaaggaagauagaggauaugaaau

SEQ ID NO: 160609 - RNA, 64 nt, Homo Sapiens
uuuaaaguuguuuacuuuuugaagaagccaacacucaaaugacuaagcauguguaauuucuugu

SEQ ID NO: 160610 - RNA, 64 nt, Homo Sapiens
uucaaaauaaaaccuuauuuucaaaugacuuucaucaaaugacuccuucccuccucagugucuu

SEQ ID NO: 160611 - RNA, 64 nt, Homo Sapiens
uucaucaaaugacuuucaaacuccucagugucuuucaaaugacuugggucuuaggccuccuucc

SEQ ID NO: 160612 - RNA, 64 nt, Homo Sapiens
uaccuuuuauuuccauauaaugaugagccauuuuucaaaugaaaguauuaaccagcaggagagg

SEQ ID NO: 160613 - RNA, 64 nt, Homo Sapiens
agaaaaagaaaaacagcauuuacuuuaaaaaaauucaaaugaagaauaaagaaagugugagguc

SEQ ID NO: 160614 - RNA, 64 nt, Homo Sapiens
aucaaauaauauucaugaagaguuguuuauaaugucaaaugaaaccuacaggaaucucugauua

SEQ ID NO: 160615 - RNA, 64 nt, Homo Sapiens
cuaaagaccauuuaaucuugaaggaacacaaagaucaaaugaaaaguaaaacacucuaaauaaa

SEQ ID NO: 160616 - RNA, 64 nt, Homo Sapiens
auuauagugacugaagaaagaauaggcaaacuuuucaaaugaaaauggauauuuaguguauuuu

SEQ ID NO: 160617 - RNA, 64 nt, Homo Sapiens
acaguuugcuugaguuauagaaaccagccugucaucaaaugauucuaguucuaggacuuuguag

SEQ ID NO: 160618 - RNA, 64 nt, Homo Sapiens
gcuauuugagggacuaagggauggagauauucugucaaaugaaucucuucaguauaccaguuug

SEQ ID NO: 160619 - RNA, 64 nt, Homo Sapiens
aaaauguguggcaagaugauacagcuacacaguaucaaaugaaugggucaauucagcaccccca

SEQ ID NO: 160620 - RNA, 64 nt, Homo Sapiens
aaaaauauaguuauaauuuuagcuccaguauuauucaaaugaucuucucuuauggauuuuaaua

SEQ ID NO: 160621 - RNA, 64 nt, Homo Sapiens
aaaucccaacuauugagcaucaaaacuucuugcuucaaaugaaauuucaccaucugaaaauuca

SEQ ID NO: 160622 - RNA, 64 nt, Homo Sapiens
ggaaauauaugugugugguaacacagcaccauuccugagaaauacgauuuugugcauaguaaug

SEQ ID NO: 160623 - RNA, 64 nt, Homo Sapiens
uucuuaaacucugaguuuauuugccugacacguccugagaaaucgguucugugcguguaccaug

SEQ ID NO: 160624 - RNA, 64 nt, Homo Sapiens
gucuucucagaaaccaccaaccuugaagugucuucugagaaaccaccaggcuugaagguaauga

SEQ ID NO: 160625 - RNA, 64 nt, Homo Sapiens
aacaaggauggagaaaaaucuaggacagugucuucugagaaaccaccaggcuugaagguaauga

SEQ ID NO: 160626 - RNA, 64 nt, Homo Sapiens
uagacagcuacccaugaucugcagaggauggaggcugagaaagggcagggugucaugcaugggu

SEQ ID NO: 160627 - RNA, 64 nt, Homo Sapiens
accuugucuggugauuuucugagcugaaaagaagcugagaaaucacuugagauguauaaaacua

SEQ ID NO: 160628 - RNA, 64 nt, Homo Sapiens
ccugugaauguggguaaugucagaaaauucauaccugagaaaaagcucaucccuuauuaagcau

SEQ ID NO: 160629 - RNA, 64 nt, Homo Sapiens
acugagccaggaacuacaagggggugccacuccccugagaaaagggaucugccaaguggauacu

SEQ ID NO: 160630 - RNA, 64 nt, Homo Sapiens
ccauauucuccuaauacaacucauucugggaaaacugagaaaacaggggcauugaggagcuucc

SEQ ID NO: 160631 - RNA, 64 nt, Homo Sapiens
cgaccuuaauuuaacuuuccagucuuagcugaggcugagaaagcuaaaguuugguuuugacagg

SEQ ID NO: 160632 - RNA, 64 nt, Homo Sapiens
acuuucuauuuuuaugaugacaaucaaagccggccugagaaacacuauuugugacuuuuuaaac

SEQ ID NO: 160633 - RNA, 54 nt, Homo Sapiens
gucaagaaucauggaaguaaacaucugagaaaccuguugaagauuauuucauuc

SEQ ID NO: 160634 - RNA, 64 nt, Homo Sapiens
aacucuucaguuaauucuuagauacacuaaaaaucugagaaacucuacauguaacuauuucuuc

SEQ ID NO: 160635 - RNA, 64 nt, Homo Sapiens
ggagcacacaguacugggaaaugggcauacaguacugagaaaugugggagcacaguacugggaa

SEQ ID NO: 160636 - RNA, 64 nt, Homo Sapiens
ggagcacaguacugggaaauaugggaguacacuacugagaaaugugggagcacaguacugagaa

SEQ ID NO: 160637 - RNA, 64 nt, Homo Sapiens
ggaguacacuacugagaaaugugggagcacaguacugagaaaugugggagcacaguacugagaa

SEQ ID NO: 160638 - RNA, 64 nt, Homo Sapiens
aauaauguggugacagucacuagauccucacaugcugagaaacagccucuacucucucugcccc

SEQ ID NO: 160639 - RNA, 64 nt, Homo Sapiens
aacuguacagacuguuuacuaaggagcuaaaccacugagaaaacguuauuaaaauuguaauacc

SEQ ID NO: 160640 - RNA, 64 nt, Homo Sapiens
gauuuguguacaauauacccauugaauguauauccugagaaaaauuggggccaaagaagcagga

SEQ ID NO: 160641 - RNA, 64 nt, Homo Sapiens
aaacugcucauaagugaaaauuauaugucuuacacugagaaauauauaugucagugagaacaau

SEQ ID NO: 160642 - RNA, 64 nt, Homo Sapiens
ggauggaagagugaccauguuacuguagugacaucugagaaauggagacuaccguaauugagac

SEQ ID NO: 160643 - RNA, 64 nt, Homo Sapiens
aucacagaccacaugagacuaaaauaagggaauccugagaaacacaaaacuguaaaaaucaugg

SEQ ID NO: 160644 - RNA, 64 nt, Homo Sapiens
guaggcauguuugauacacauuaacauauacuagcugagaaauugauuuggcaucuacuuagau

SEQ ID NO: 160645 - RNA, 64 nt, Homo Sapiens
aucuggacuuaagaguuucucagguuuaguuauccugagaaaacuucuauauaggugauuuuac

SEQ ID NO: 160646 - RNA, 64 nt, Homo Sapiens
aaaaauagcaucuaguccaaaauuauaguuagagcugagaaaaacgucuucuuauguugacuaa

SEQ ID NO: 160647 - RNA, 64 nt, Homo Sapiens
cauuuuguagagcuauggauaugauauuggcacacugagaaauuguaauauaauucauauuuuu

SEQ ID NO: 160648 - RNA, 64 nt, Homo Sapiens
aaagccauggucaucugguguuccagagaauuugcugagaaaucaaaucauuucugcauuguug

SEQ ID NO: 160649 - RNA, 64 nt, Homo Sapiens
acacauuugggaguauuuaaucagguguggcuaucugagaaaucaacuuugggggaaauguaag

SEQ ID NO: 160650 - RNA, 64 nt, Homo Sapiens
cucucucucuguuuuguucuagccaugaauuugccugagaaacuuguaaccuaugugccucaau

SEQ ID NO: 160651 - RNA, 64 nt, Homo Sapiens
aaucaaccaacauaucugaaaaggaucaugaaaccugagaaaugcuaauggagauuugcuggua

SEQ ID NO: 160652 - RNA, 64 nt, Homo Sapiens
aauucagaguauuagacaguuuuaaggcauucaacugagaaaacuuuauuugucaaagucagaa

SEQ ID NO: 160653 - RNA, 64 nt, Homo Sapiens
uuguacugucauugaagguguuuuauagagaaaucugagaaaucacauucacaaauuagaaguc

SEQ ID NO: 160654 - RNA, 64 nt, Homo Sapiens
guucaaggaauaaagauuguagaaaauaagacuucugagaaaaaaaaggaagaaaauguagauu

SEQ ID NO: 160655 - RNA, 64 nt, Homo Sapiens
agcucugaauuuauuugacagaaaaaaaucugaacugagaaagguuaucaaaccuuuuauuaca

SEQ ID NO: 160656 - RNA, 64 nt, Homo Sapiens
uuuggcuugcagacugccuucuaucccagaacagcugagaaaucuaugaagcugagauucugaa

SEQ ID NO: 160657 - RNA, 64 nt, Homo Sapiens
ggggguguugugguuuuuuguuuuuguuuugcuucugagaaagcauuugccuuucuuccucucc

SEQ ID NO: 160658 - RNA, 64 nt, Homo Sapiens
aguuacaucuuaagugaccuugcucacagguggacugagaaauccauauauuuguguguuuaua

SEQ ID NO: 160659 - RNA, 64 nt, Homo Sapiens
augaauaguacauguauauggcucuaaaacuguucugagaaacauguaaguuuaaagagcuaaa

SEQ ID NO: 160660 - RNA, 64 nt, Homo Sapiens
uuagguuuuaucacugcuauacuuaaaacuauuucugagaaaucgguaggauuagaggcuuccc

SEQ ID NO: 160661 - RNA, 64 nt, Homo Sapiens
cacaggaaagcacuguccaggguuuggacucaugcugagaaaccacuuugaaggugcuuuguga

SEQ ID NO: 160662 - RNA, 64 nt, Homo Sapiens
ccuuugaacagaagggccuggaaggccccuggggcugagaaaggguccgcccgguggccuggag

SEQ ID NO: 160663 - RNA, 64 nt, Homo Sapiens
uucuguuccggugccuuuccuauccaggcaccaccugagaaaguugucauuugaggucgcacuu

SEQ ID NO: 160664 - RNA, 64 nt, Homo Sapiens
uagagaggaaaaagugggugcacaguguccuaaacugagaaaacucuagugaauguauuuuaac

SEQ ID NO: 160665 - RNA, 64 nt, Homo Sapiens
ggucucuuuuaaaagacgaaagccuuuccucagucugagaaauuggacaccauaggguaggaau

SEQ ID NO: 160666 - RNA, 64 nt, Homo Sapiens
ccuauguaccuuugugaaauagccucaguguggccugagaaaucauuauucacugccugucaca

SEQ ID NO: 160667 - RNA, 64 nt, Homo Sapiens
auuuuaucaaagggcugaguggacagugaacaagcugagaaauuaacucagauucauuucaaaa

SEQ ID NO: 160668 - RNA, 64 nt, Homo Sapiens
cauuggaagguuaacuuuaaaaugagcccuaucacugagaaauacguguuucaugauuuaacuc

SEQ ID NO: 160669 - RNA, 64 nt, Homo Sapiens
cuugugagucuguaacaguucuuaaaaagaauaucugagaaacuacucuguuuuagaccuuuga

SEQ ID NO: 160670 - RNA, 64 nt, Homo Sapiens
cagaggaggggauccaguagcuucucuucacuugcugagaaagucucauacccaccugcugaau

SEQ ID NO: 160671 - RNA, 64 nt, Homo Sapiens
agauucaaaagcugcauuccucacucaugcuguccugagaaaugugguagugagccucccagga

SEQ ID NO: 160672 - RNA, 64 nt, Homo Sapiens
caucagagaacagucauguaugcaaguuuugugacugagaaauuucugugcuuccaauccacaa

SEQ ID NO: 160673 - RNA, 64 nt, Homo Sapiens
aagauucgucaacuuucuuagcucaagagagaggcugagaaaugcagagaagaauaagacauaa

SEQ ID NO: 160674 - RNA, 64 nt, Homo Sapiens
aaagaucacaccaauuuagaaugaauauuaaagucugagaaauuuacaaaagggacucuaugga

SEQ ID NO: 160675 - RNA, 64 nt, Homo Sapiens
cacauggcacuuggaagaaaaagacccacugaaucugagaaaguacuuucugguggcaaaugaa

SEQ ID NO: 160676 - RNA, 64 nt, Homo Sapiens
aacaucaccaacuuaauuuucuuccauagcaaaacugagaaaauaccuuguuucaguauaacac

SEQ ID NO: 160677 - RNA, 64 nt, Homo Sapiens
auuaugucacacacacaaaaaauccuuuucaauccugagaaaauuaaaggcguuuuacucacau

SEQ ID NO: 160678 - RNA, 64 nt, Homo Sapiens
aucauuuuaaagggcauagcaauggaauuuuacccugagaaauucaagcaagaacacauaucca

SEQ ID NO: 160679 - RNA, 64 nt, Homo Sapiens
uggguuggacugguggugguuuggaaaucagcugcugagaaagagcaaaucaaagaagauaaua

SEQ ID NO: 160680 - RNA, 64 nt, Homo Sapiens
aacaucaccaacuugauuuucuuccauagcaaaacugagaaaauaccuuguuucaguauaacac

SEQ ID NO: 160681 - RNA, 64 nt, Homo Sapiens
uuaugucacacacacaaaaaaauccuuuucaauccugagaaaauuaaagguguuuuacucacau

SEQ ID NO: 160682 - RNA, 64 nt, Homo Sapiens
uuuugcuguauuucaaaauuuuccuucuguuaaaggaaaauauugugaauaaccacuggugugu

SEQ ID NO: 160683 - RNA, 64 nt, Homo Sapiens
gcauaauuuaaaaaaucaguguuuuuaggauuugggaaaauaaacuguaaauguuuauuugaua

SEQ ID NO: 160684 - RNA, 64 nt, Homo Sapiens
cugccccucaggggaauucggagcuagaggacauggaaaauaaagccaggaaagucaaaaaaac

SEQ ID NO: 160685 - RNA, 64 nt, Homo Sapiens
aaaaagcgcaaagaggagaaugaagauccagaaaggaaaauaaagaagaagggcuucggcgcca

SEQ ID NO: 160686 - RNA, 64 nt, Homo Sapiens
gcaucaguuugcuacagugagcucagaucaaauaggaaaauacuugaaaugcaugucucaagcu

SEQ ID NO: 160687 - RNA, 64 nt, Homo Sapiens
uucaaugaagucuucuguucaucuguugaaacuaggaaaauacccaaacuuaaauggaagaauu

SEQ ID NO: 160688 - RNA, 64 nt, Homo Sapiens
agaaacuacagaguuugcgaagaaacuucuauguggaaaauauugguacuauguggaaaauauu

SEQ ID NO: 160689 - RNA, 64 nt, Homo Sapiens
agaaacuucuauguggaaaauguugguacuauguggaaaauauuucauaucuuggauuugcagc

SEQ ID NO: 160690 - RNA, 64 nt, Homo Sapiens
gggcaaacaggugggacuguuagugacccauuugggaaaauagagcaucucagagaaggaggug

SEQ ID NO: 160691 - RNA, 64 nt, Homo Sapiens
uuuccuccuccccuuuccccuucuccccaccaaaggaaaauaucccucuuaaugauuucguagu

SEQ ID NO: 160692 - RNA, 64 nt, Homo Sapiens
agcauuugugguaguaaaggaaaaccaacccucuggaaaauacauuuugagaaucucaaacauc

SEQ ID NO: 160693 - RNA, 64 nt, Homo Sapiens
aauugauauauaauaaccguucuaaccucuuccaggaaaauauuuuuagaacuacuagcuuuuc

SEQ ID NO: 160694 - RNA, 64 nt, Homo Sapiens
auuaagaaguuuugauguuagaauaauugcuuuuggaaaauaccaaaugaacguacaguacaac

SEQ ID NO: 160695 - RNA, 64 nt, Homo Sapiens
uguagggcuaucuuuuuaaaaaaugucaacaaagggaaaauaaacuaucagcuuggauggucac

SEQ ID NO: 160696 - RNA, 64 nt, Homo Sapiens
ucugaagaggggcuuucauaacauauggccaaguggaaaauauagucaugcuaagguauguguu

SEQ ID NO: 160697 - RNA, 64 nt, Homo Sapiens
cauauaguggcauauuuuuauuugugacuaagaaggaaaauaugaaaaacaaaaacaagcagcu

SEQ ID NO: 160698 - RNA, 64 nt, Homo Sapiens
uuugacacuuuauggaauuuauuuuauauaaacaggaaaauacauauauuugaagagagaauac

SEQ ID NO: 160699 - RNA, 64 nt, Homo Sapiens
ucagaugaaagggaugacaacugaguaaccacugggaaaauauuuguuuuuugugugcaaaaua

SEQ ID NO: 160700 - RNA, 64 nt, Homo Sapiens
uuguguugaugagagaauaaucuugggcagucugggaaaauaaggaaggcaucuccuucuuacu

SEQ ID NO: 160701 - RNA, 64 nt, Homo Sapiens
guaucauuaauaaauauaccuuugcucuuuucagggaaaauaacaaccacccuuacugauaguu

SEQ ID NO: 160702 - RNA, 64 nt, Homo Sapiens
caucucuaacauuaugguaaaugcaguguaagaaggaaaauacuccuacagaguaauauaugug

SEQ ID NO: 160703 - RNA, 64 nt, Homo Sapiens
gauuuuuuguuuaccuuggugccaagagacuugaggaaaauacaaaaaguauuguuaguaagug

SEQ ID NO: 160704 - RNA, 64 nt, Homo Sapiens
agcuggauaaauuaaaaucugagguuaaugaaauggaaaauaaucuaacucgaaggcgccugaa

SEQ ID NO: 160705 - RNA, 64 nt, Homo Sapiens
agcaucucuuuauuuugaugauauauuuuuguaaggaaaauauucagaugaucaggaauguaua

SEQ ID NO: 160706 - RNA, 64 nt, Homo Sapiens
acaugcaacuugaugugcuuagaaaaaaauaguuggaaaauaagucugcuaaagguaaaagaaa

SEQ ID NO: 160707 - RNA, 64 nt, Homo Sapiens
aggucuguucuugcucucaaguaggaaauugcaaggaaaauagaacauacucuccuaagugguu

SEQ ID NO: 160708 - RNA, 64 nt, Homo Sapiens
aaagaaccuuuguaaaauauaaauaccaaaagagggaaaauaaauucagacgaggcuguaguuu

SEQ ID NO: 160709 - RNA, 64 nt, Homo Sapiens
aaccuuccauuugguuucccuaaaaaaacuagggggaaaauagcuauagcauauauuuuauuuu

SEQ ID NO: 160710 - RNA, 64 nt, Homo Sapiens
ucaaacccaaagaaaguuuauaaaauuuauuauaggaaaauaaaaaacauuuuacauaaaaugc

SEQ ID NO: 160711 - RNA, 64 nt, Homo Sapiens
uuuucuaugacacaagucauaagcaauaggcagaggaaaauagcaacuaaauauuugguaacug

SEQ ID NO: 160712 - RNA, 64 nt, Homo Sapiens
cugacuuuuauaaugaaucucgaaacacagaaagggaaaauaaaacugacaaaaagggaaaaua

SEQ ID NO: 160713 - RNA, 64 nt, Homo Sapiens
aaacacagaaagggaaaauauuacugacaaaaagggaaaauacgccaaucaguguauugcucau

SEQ ID NO: 160714 - RNA, 64 nt, Homo Sapiens
ccccaucuaauauguauaggcuucaaggguuguuggaaaauagucucagguugucagguucugc

SEQ ID NO: 160715 - RNA, 64 nt, Homo Sapiens
ugaagaacccaucauuuuauuuugucaucuuauaggaaaauauaaauccaggaauauuaggcuc

SEQ ID NO: 160716 - RNA, 64 nt, Homo Sapiens
cagaaugauuuccaaaauugaaaccaaguucaaaggaaaauagaacccuuucaaaaguguuugu

SEQ ID NO: 160717 - RNA, 51 nt, Homo Sapiens
agaugaaugccagacugugaaggaaaauauaaaaaaaaagucgacugcuau

SEQ ID NO: 160718 - RNA, 64 nt, Homo Sapiens
uugauaacuagcuuuccagguggacuuagccauaggaaaauauuacuaauguaauuuaacaaau

SEQ ID NO: 160719 - RNA, 64 nt, Homo Sapiens
aaggauucuaaaaguuugaucucuuuucagagaaggaaaauaaacuugcugaacauauuuuauu

SEQ ID NO: 160720 - RNA, 64 nt, Homo Sapiens
ggauaccaacuguaugcuacauagaggauacaauggaaaauagaugugcuauccugaauggaaa

SEQ ID NO: 160721 - RNA, 52 nt, Homo Sapiens
ggauacaauggaaaauagagauggaaaauagaggacaauugugcuauccuga

SEQ ID NO: 160722 - RNA, 64 nt, Homo Sapiens
aagcuuuauaaaauagcaauuucuaauauuuuuaggaaaauauuauuuuuuguucugauuuuuu

SEQ ID NO: 160723 - RNA, 64 nt, Homo Sapiens
ucuuacagaacaacuggugggguuguuucugucaggaaaauaaauguaaaaauaauaaugcagu

SEQ ID NO: 160724 - RNA, 64 nt, Homo Sapiens
aaaacagcugauuuguuuuaccuuaauuuuaagaggaaaauacagaacuguagccauuucauug

SEQ ID NO: 160725 - RNA, 64 nt, Homo Sapiens
uguauauuuuuguuccguaaccugaacuugaggaggaaaauacaucacuaaucauacucugaug

SEQ ID NO: 160726 - RNA, 64 nt, Homo Sapiens
ggcgaguuuugguuugguugaggaucuaacacuaggaaaauaaaguuagauaugcaaauugaua

SEQ ID NO: 160727 - RNA, 64 nt, Homo Sapiens
uccaaagcugaaagagccagcuguaucacuguguggaaaauaccaacaaaaacaaaacccuuug

SEQ ID NO: 160728 - RNA, 64 nt, Homo Sapiens
cuugaguagucuuugguccauugugucaguuggaggaaaauagaccauacacugaggcagaaac

SEQ ID NO: 160729 - RNA, 64 nt, Homo Sapiens
acaauuuuagaagcaaggaacauuuuccuacagaggaaaauagauauuuguaagaaaaaacuuu

SEQ ID NO: 160730 - RNA, 64 nt, Homo Sapiens
uguaucauuuccuuuuuagaacaacauuuuuauaggaaaauauuuuuauacuuuauaguaaugc

SEQ ID NO: 160731 - RNA, 64 nt, Homo Sapiens
gaacaaaugaaaguguucauaaacucucacuagaggaaaauaauaaaucuuagaaguuauaagg

SEQ ID NO: 160732 - RNA, 64 nt, Homo Sapiens
aggucuaugcucauaacuguacugucaaacaucuggaaaauaaauguauuuuauguauguuuac

SEQ ID NO: 160733 - RNA, 64 nt, Homo Sapiens
uccauaucuaaccagugauucugauguacaguugggaaaauaugacuaaugaaagcacuccucc

SEQ ID NO: 160734 - RNA, 64 nt, Homo Sapiens
gcuuaaaaaaaauguauuuauuuuauggcaaguuggaaaauauguaacuggaaucucaaaaguu

SEQ ID NO: 160735 - RNA, 64 nt, Homo Sapiens
gagcuuaaaaaaaaaguauacaugacuuuaaugaggaaaauaaaaaugaauauugaaauguugu

SEQ ID NO: 160736 - RNA, 64 nt, Homo Sapiens
auuaaugcucucugagucuucugucaugagcagaggaaaauauuauuuacagggugagcucagc

SEQ ID NO: 160737 - RNA, 64 nt, Homo Sapiens
gccagaaacuucugagcagaauuauuuuauggagggaaaauaagcaucuucucuaagccaagca

SEQ ID NO: 160738 - RNA, 64 nt, Homo Sapiens
uugaguucuacugaguagggcuuccuuaaguuuaggaaaauagaaauuacuuugugugaaauuc

SEQ ID NO: 160739 - RNA, 64 nt, Homo Sapiens
auugcaaaaaagcaucuauauauggaggagggugggaaaauagagguaggaaauaguagccuaa

SEQ ID NO: 160740 - RNA, 64 nt, Homo Sapiens
uuuauaauccauuuaaagugugucauguuuugugggaaaauaaucuaguccaaauauaagaaac

SEQ ID NO: 160741 - RNA, 64 nt, Homo Sapiens
uaaaugucauucuccaucucaucuuaucuauauaggaaaauagcuguuaagaguacaauugcaa

SEQ ID NO: 160742 - RNA, 64 nt, Homo Sapiens
uuuuucaauggauugcuuuaaagagaaugaguagggaaaauaguaguuaauuuuagguuauguu

SEQ ID NO: 160743 - RNA, 64 nt, Homo Sapiens
aauuaacagaaaugacacugugaacaauguaguuggaaaauagguauguguauaugcauuauuu

SEQ ID NO: 160744 - RNA, 64 nt, Homo Sapiens
gcucucugcucacugguuuucaauaccaccaagaggaaaauauugacaaguuuaaaggcugugu

SEQ ID NO: 160745 - RNA, 64 nt, Homo Sapiens
cugugacuuaugugcagcuuuccaguugagcagaggaaaauaguggcaggacugucccccagga

SEQ ID NO: 160746 - RNA, 64 nt, Homo Sapiens
ccuguagacuguuaauuacuuaauaaucucauugggaaaauacuaguaguuuuauauuuggaug

SEQ ID NO: 160747 - RNA, 64 nt, Homo Sapiens
ugcaucccggagguugaaguuggaguuugagguuggaaaauaucuuugaaggcagaaucaguug

SEQ ID NO: 160748 - RNA, 64 nt, Homo Sapiens
agugcccuccacagccgcagccucccucugaccugcaggccaagagcagaggcagcgaguugug

SEQ ID NO: 160749 - RNA, 64 nt, Homo Sapiens
cauggugugaaagucagaugcccagagggcccaggcaggccaccauauucagugcuguggccug

SEQ ID NO: 160750 - RNA, 64 nt, Homo Sapiens
gcuguccuagcagugcacuggcgggucucuccaugcaggccacaacacagggucaguguucacc

SEQ ID NO: 160751 - RNA, 64 nt, Homo Sapiens
gaggaccccagaaucuggaccccagagucuggaagcaggccagaaaggauaaggcaaaugacug

SEQ ID NO: 160752 - RNA, 64 nt, Homo Sapiens
uacccaugacguaaacggcggagauccgugaacugcaggccacgcagucaacaggaugggccug

SEQ ID NO: 160753 - RNA, 64 nt, Homo Sapiens
uccacaguucugagaggccaagaggaugaacccugcaggccaugcuucuaacuucugugguuug

SEQ ID NO: 160754 - RNA, 64 nt, Homo Sapiens
caaagucccuacgccucccuggagcugugauagagcaggccacaucagaucuguaauucuccca

SEQ ID NO: 160755 - RNA, 64 nt, Homo Sapiens
ccuuccuguccaggucugcaggcccagcacagcagcaggccaggucugguggcaggagaagaga

SEQ ID NO: 160756 - RNA, 64 nt, Homo Sapiens
cgggcccgugcagcuuguggagagggcaggccaggcaggccaggauauucuccucugaaccacu

SEQ ID NO: 160757 - RNA, 64 nt, Homo Sapiens
caggccaggcgggcccgugcugaaccacuagagggcaggccaggccacugugaauauucuccuc

SEQ ID NO: 160758 - RNA, 64 nt, Homo Sapiens
cacacagaaacauacauucgugccuggagacccugcaggccagaguccaaauauuuaacaauca

SEQ ID NO: 160759 - RNA, 64 nt, Homo Sapiens
uuccccaggaggaacgaggagagguggccacguggcaggccacagugcccuaugggcuuuucug

SEQ ID NO: 160760 - RNA, 64 nt, Homo Sapiens
gaggaggugugggacauaauuagaguugacagaagcaggccagcgccgagaucuucuaccagcg

SEQ ID NO: 160761 - RNA, 64 nt, Homo Sapiens
uuccugguccagacuguacuacacauauuaaacugcaggccaccuguguuugugccagagggau

SEQ ID NO: 160762 - RNA, 64 nt, Homo Sapiens
ccagccugggacaggcccccuuuccccucucucugcaggccaggagggccuccuuccugccacg

SEQ ID NO: 160763 - RNA, 64 nt, Homo Sapiens
cugcggggcgccugcccgggcgaggucggaagcugcaggccagcugggcccgggccggagcgug

SEQ ID NO: 160764 - RNA, 64 nt, Homo Sapiens
gggucaagccagcauccccuugguaaagacccccgcaggccaccaggcauucuggacacgcaca

SEQ ID NO: 160765 - RNA, 64 nt, Homo Sapiens
cacacacacacacacacacacacaaaacuucacagcaggccagcugcagugacuugucaucaag

SEQ ID NO: 160766 - RNA, 64 nt, Homo Sapiens
aagagcagaggugaggaccugggaccccugaggggcaggccaggaggagcucgggcgcaggcca

SEQ ID NO: 160767 - RNA, 64 nt, Homo Sapiens
gaccccugaggggcaggccaggaggagcucgggcgcaggccaggcccccuuggugaagcagagg

SEQ ID NO: 160768 - RNA, 64 nt, Homo Sapiens
ggguggggccagaaggccugauagaagggucagggcaggccagggggguggggggccgcccuca

SEQ ID NO: 160769 - RNA, 64 nt, Homo Sapiens
ccuuuccucuucccugccccacccccuggccgcagcaggccagcacugcagaguuugggugcug

SEQ ID NO: 160770 - RNA, 64 nt, Homo Sapiens
uuuggggggccucaacccucgacccaggauggcugcaggccaggcgccagcuccucggaggcca

SEQ ID NO: 160771 - RNA, 61 nt, Homo Sapiens
gcacacggugcgcccgccgcgcgccaucccugcaggccaggugacaggcugcugaggguaa

SEQ ID NO: 160772 - RNA, 64 nt, Homo Sapiens
uuucaguucaagugcucuucagcacugucuugucucccaauauaccaacccacuggcacauuuu

SEQ ID NO: 160773 - RNA, 64 nt, Homo Sapiens
guggaguugucuccagauaagaggagaugugccuucccaauaacucuuuuuuuuuuuccuuuca

SEQ ID NO: 160774 - RNA, 64 nt, Homo Sapiens
gccuguggugaugguuugcauccuuccuccuuugucccaauaaaguaugggaguugaaugugug

SEQ ID NO: 160775 - RNA, 64 nt, Homo Sapiens
ucgucugcagugagggaagguggguggguauucuucccaauaaagacuuagagccccucucuuc

SEQ ID NO: 160776 - RNA, 64 nt, Homo Sapiens
aaaagucuagguuuuaaggcugugccagaacccaucccaauaaagagaccgagucugaagucac

SEQ ID NO: 160777 - RNA, 64 nt, Homo Sapiens
accaaccgauugccuuuauuuugcuuccacauuuucccaauaaauacuugccugugacauuuug

SEQ ID NO: 160778 - RNA, 64 nt, Homo Sapiens
uuccuucccagcccuuguggcucuguccaccugaucccaauaccagcuucccccagccccugcc

SEQ ID NO: 160779 - RNA, 64 nt, Homo Sapiens
ugagacuguguuguacagcuagaaaaggccuucuucccaauagcaaggcugugcaucuagccuc

SEQ ID NO: 160780 - RNA, 64 nt, Homo Sapiens
aaguggacugcacacuaagguugaaaauucagugucccaauaaaauuugugcaagucaguguuu

SEQ ID NO: 160781 - RNA, 64 nt, Homo Sapiens
ggaauggggacccagaggcucaagugcuaccacuucccaauaaauauauuuagugggucagugc

SEQ ID NO: 160782 - RNA, 64 nt, Homo Sapiens
cuagccccgcucucuuccccggcuuccuccaaagucccaauacuuuguaaauauugauagcacu

SEQ ID NO: 160783 - RNA, 64 nt, Homo Sapiens
gaaaaaaaaucuccauaaaaccaagucuuacguuucccaauaaaauugguuuuauuugauguac

SEQ ID NO: 160784 - RNA, 64 nt, Homo Sapiens
gaagggcuuccaaaggcaugacucuguauuuauuucccaauaaauuggccggcccaccuguuua

SEQ ID NO: 160785 - RNA, 64 nt, Homo Sapiens
gagaucauauggaauguacuaugcacauauuuuuucccaauauguccucccaaucuuuugacuu

SEQ ID NO: 160786 - RNA, 64 nt, Homo Sapiens
agaaacaaccauccuagcuuaaguguacaaugggucccaauaucauuugggcacugguuuggcc

SEQ ID NO: 160787 - RNA, 64 nt, Homo Sapiens
aaggacaaccacccuagcuuccaagucuacaaugucccaauaucauauuugggcauuggucugg

SEQ ID NO: 160788 - RNA, 64 nt, Homo Sapiens
uucuacucugcccuacucacagagcuuuccuuuuucccaauaaacaagaccccugucuuugcug

SEQ ID NO: 160789 - RNA, 64 nt, Homo Sapiens
agaauaagucauggagccugucuguuuuccuucuucccaauagaacguauuauugauauuauug

SEQ ID NO: 160790 - RNA, 64 nt, Homo Sapiens
uuuuuacuuuaauuuuucccgcuuuccauucuucucccaauauuagcuaaucauuuauccaaag

SEQ ID NO: 160791 - RNA, 64 nt, Homo Sapiens
uuuucuauuccuuggaccaacuccuguuacauuuucccaauaucguaaauucacauuuuccuuc

SEQ ID NO: 160792 - RNA, 64 nt, Homo Sapiens
gccgugucugcagccacugcuaggagccuccgcuucccaauacagacgugccucuccuacugug

SEQ ID NO: 160793 - RNA, 64 nt, Homo Sapiens
gugcuguugcagcuaugaugacuguagacucagaucccaauaaaggcuucaccucccuauguga

SEQ ID NO: 160794 - RNA, 64 nt, Homo Sapiens
cccaggccacaagaguggaccuucauccccgcauucccaauauauguggggcugugaauucuuu

SEQ ID NO: 160795 - RNA, 64 nt, Homo Sapiens
cauuaacauuugcagccauucguggaccgcguguucccaauauuccauucuccucuccacuucu

SEQ ID NO: 160796 - RNA, 64 nt, Homo Sapiens
agccccccaguggugaacagguccuaggaccuuuucccaauacugauuacaugcccaucccagu

SEQ ID NO: 160797 - RNA, 64 nt, Homo Sapiens
aagcuaugaugauauaaauaaaaacagcucucuaucccaauacgcaccuuuguauuuucaagaa

SEQ ID NO: 160798 - RNA, 64 nt, Homo Sapiens
uggcuuggcaacaaugacauugucaugcuuauugucccaauauccauccugucguagaucuuaa

SEQ ID NO: 160799 - RNA, 64 nt, Homo Sapiens
aauucacuuacaccuccugcuugccaaccuccccucccaauaaauuuauuugcugcuguuuaag

SEQ ID NO: 160800 - RNA, 64 nt, Homo Sapiens
uucaggccugcucuacaaaaugacaacccaaucuucccaauacuauucccauuugucccagugc

SEQ ID NO: 160801 - RNA, 64 nt, Homo Sapiens
ugagaauaaagucgagacucuguccaggcuacuuucccaauauugagaggaggucccgcuaugu

SEQ ID NO: 160802 - RNA, 64 nt, Homo Sapiens
uaucucuuucccuggaaucauuuaaauauguuucucccaauaauaauauagguuaaaacaauga

SEQ ID NO: 160803 - RNA, 64 nt, Homo Sapiens
guggguugccuuuccuuguccuagagguuccauuucccaauagguguguauuacaugggacugu

SEQ ID NO: 160804 - RNA, 64 nt, Homo Sapiens
acagaaaaauacaugccaguauuaauacuuugucucccaauaucuuugagaugguguguccugg

SEQ ID NO: 160805 - RNA, 64 nt, Homo Sapiens
agacaaaggagagugauugaggguggggcaguggucccaauaggaauuacccuuuuguuggggg

SEQ ID NO: 160806 - RNA, 64 nt, Homo Sapiens
auguacccaauguguauauuuuucuuuuuaaucuucccaauagcugaauaaaguauagauacua

SEQ ID NO: 160807 - RNA, 64 nt, Homo Sapiens
ccacaugagaaaauuuuuguacuccaaauuuacuucccaauaaauauucagcaaaguaguaaaa

SEQ ID NO: 160808 - RNA, 64 nt, Homo Sapiens
ucucugcuggcuucuuuuuccaugcguuaacuuuucccaauagcagaggaggcaaauaugagca

SEQ ID NO: 160809 - RNA, 64 nt, Homo Sapiens
uaugguuucauaggcaaaaauaauggucuaagccucccaauagggauaaauuuagggugacugu

SEQ ID NO: 160810 - RNA, 64 nt, Homo Sapiens
uuugaauauucacagcagagaucuaccgguaauuucccaauagccgaaaaaaaaaaacagaaaa

SEQ ID NO: 160811 - RNA, 64 nt, Homo Sapiens
uugucuuggugggcuuacucgguuauuauugacaucccaauauugaaccagccauuuuuaaaaa

SEQ ID NO: 160812 - RNA, 64 nt, Homo Sapiens
agaaaauuaauaaaaaauuucguauucaagaucuucccaauacauuuuucuucucauccuggag

SEQ ID NO: 160813 - RNA, 64 nt, Homo Sapiens
ugccucuagauacauagccacacgcaucucuuggucccaauaaccaugacagaccuccagcauc

SEQ ID NO: 160814 - RNA, 64 nt, Homo Sapiens
uuucauagaaaauaaguaagcagauuuuuugaguucccaauacgucaaugaucaaaaaaugcug

SEQ ID NO: 160815 - RNA, 64 nt, Homo Sapiens
gauguguguguuuuucuggauacuauuggacuuaucccaauacaccugaaaaucauuugugucc

SEQ ID NO: 160816 - RNA, 64 nt, Homo Sapiens
uauuaauguauguaauucuacaguuuugcuuuccucccaauaaaaugccaaagacuacguuuug

SEQ ID NO: 160817 - RNA, 64 nt, Homo Sapiens
uguuguacuuuuuuguagcaauguuaaaguugauucccaauauuauucuuuuuagacaucagaa

SEQ ID NO: 160818 - RNA, 64 nt, Homo Sapiens
accauccuauugcaaagguuccaacuguauauauucccaauagcaacguagcuucuaccaugaa

SEQ ID NO: 160819 - RNA, 64 nt, Homo Sapiens
ccagagguacaucaaguaaacauuauuucuaucuucccaauaacucagugauuuuuauuuuggu

SEQ ID NO: 160820 - RNA, 64 nt, Homo Sapiens
uaccacuuugaauaggaugaugggggcagauauuucccaauacaauccucucagcucucuuccc

SEQ ID NO: 160821 - RNA, 64 nt, Homo Sapiens
gggugcagacaagagcaaucugccacucuguggcucccaauauaugcaaaggcuuccucagaca

SEQ ID NO: 160822 - RNA, 64 nt, Homo Sapiens
aacaucaucaggccgggugcaguggcuccuauaaucccaauauuuugggaggccgaggagagag

SEQ ID NO: 160823 - RNA, 64 nt, Homo Sapiens
gacuuuucacagucguuaaauguguauggcucuuucccaauaugaauuuuuuugauguuaacua

SEQ ID NO: 160824 - RNA, 64 nt, Homo Sapiens
uucaucuuaaccccgcaaacaagaauuaagaugaucccaauaaaagaaaaauugcucaggaaac

SEQ ID NO: 160825 - RNA, 64 nt, Homo Sapiens
aaauaaccccauucuuugcuugaacacaguauuuucccaauagcacuuucauugccagugucuu

SEQ ID NO: 160826 - RNA, 64 nt, Homo Sapiens
caccuucacccucaccuguguucucuucccucucucccaauaaaagggcucccauuauaaaugc

SEQ ID NO: 160827 - RNA, 64 nt, Homo Sapiens
gaucaaaaagggaauaagaaacccuucuucuguaucccaauaauccaccaggauaaaggagaaa

SEQ ID NO: 160828 - RNA, 64 nt, Homo Sapiens
auuaauuugaauguuuuuuacacuaacuaacuuuucccaauaaaguccacuaugaaaccacgac

SEQ ID NO: 160829 - RNA, 64 nt, Homo Sapiens
aucacuggagucacaggacccugcccaccugaguucccaauaaagaaaaaccuccccuucugag

SEQ ID NO: 160830 - RNA, 64 nt, Homo Sapiens
auguucacuccgggucaaguugugauaaauuugaucccaauagaauaccucccucauuuaagaa

SEQ ID NO: 160831 - RNA, 64 nt, Homo Sapiens
cuggcuggagagcugcuaugcuaaaccuccugccucccaauaccagcaggagguucugggccuc

SEQ ID NO: 160832 - RNA, 64 nt, Homo Sapiens
uaauauaaauauaccauauauuacaacauugguuucccaauauuaagcauuauaagcaucaaau

SEQ ID NO: 160833 - RNA, 64 nt, Homo Sapiens
uaaaaauuuuuaagggaauugcuuggggacaacaucccaauagaaaacccaauuaauuugauaa

SEQ ID NO: 160834 - RNA, 64 nt, Homo Sapiens
cagccuccuggguuuccccaguccucauuuuuccucccaauacccacccuucucucucgaggga

SEQ ID NO: 160835 - RNA, 64 nt, Homo Sapiens
auaaacugagccuguucauucugauguccauuugucccaauagcucuacugcccuccccuuccc

SEQ ID NO: 160836 - RNA, 64 nt, Homo Sapiens
aucccaaacuucggaaacaaguuauucucuucacucccaauaacuaaugcuaagaaaugcugaa

SEQ ID NO: 160837 - RNA, 64 nt, Homo Sapiens
agaguuggccagguguggugacucacaccuauaaucccaauacuuugggaggccaaggcaggag

SEQ ID NO: 160838 - RNA, 64 nt, Homo Sapiens
caauuuguugugauuuucagcaccugggaaguaaucccaauaauacuuuagaaaaucuaagaca

SEQ ID NO: 160839 - RNA, 64 nt, Homo Sapiens
caaugcuuaagguggacuuuguucguaaacaauaucccaauagauuuguugacuugaggucugg

SEQ ID NO: 160840 - RNA, 64 nt, Homo Sapiens
uuuauggauauugacuauauguaaugcagugcuaucccaauauuuucaauaaaggacuuuaugc

SEQ ID NO: 160841 - RNA, 64 nt, Homo Sapiens
auggauaauucucaauauguuaacaccuagguguucccaauaccuuuuuccccucaugucacua

SEQ ID NO: 160842 - RNA, 64 nt, Homo Sapiens
gggcucaagucaagcagucggugacagauuucauucccaauaacagaaucgguuugcaugacuc

SEQ ID NO: 160843 - RNA, 64 nt, Homo Sapiens
cacaaagcuucgccuuugcucaccacggccuacuucccaauaucaucccugugugcugcagcau

SEQ ID NO: 160844 - RNA, 64 nt, Homo Sapiens
caauuuuaaaaugaaaugcagcauuugccaagucucccaauauccuuuacuaaguaaucucaca

SEQ ID NO: 160845 - RNA, 64 nt, Homo Sapiens
uaggaaacaccugaagcuggagggaacgauggccucccaauagaaaugaguggcagcuggcgcc

SEQ ID NO: 160846 - RNA, 64 nt, Homo Sapiens
augcuuccuguguuuuuugguuugcugccaaaguucccaauaagaauacauagauaaaaacaug

SEQ ID NO: 160847 - RNA, 64 nt, Homo Sapiens
ccagguauucuaaacuuguuucauuaugaaguuuucccaauaaagaaaaagcuaauuguaguuu

SEQ ID NO: 160848 - RNA, 64 nt, Homo Sapiens
cccaucauaaguuaaaaaugacauugugguuaauucccaauaaaauacagaugguccucgauuu

SEQ ID NO: 160849 - RNA, 64 nt, Homo Sapiens
aaaaugauaaccaguuacuucgagauuucuuaaaucccaauauagcacgucgccucuugaaacu

SEQ ID NO: 160850 - RNA, 64 nt, Homo Sapiens
cagaguauuucccuuggccgagauggaaguuuugucccaauagaugagcugcugagcaucaaca

SEQ ID NO: 160851 - RNA, 64 nt, Homo Sapiens
caagaaaaaaaauagaaaagcacuugaagaauauucccaauauucccggucagcaguaucaagg

SEQ ID NO: 160852 - RNA, 64 nt, Homo Sapiens
aucuuguagauuacauugagcaguauagacaucuucccaauauuucaacuuuugaacaaaagca

SEQ ID NO: 160853 - RNA, 64 nt, Homo Sapiens
ccagcagccaacuggcuucaaagccccccaucgaucccaauaacagaaugagagcggcggagac

SEQ ID NO: 160854 - RNA, 64 nt, Homo Sapiens
ugcuaaacauuugcuggagauuugaauuggcauuucccaauauugaacacaauucguuuuuuca

SEQ ID NO: 160855 - RNA, 64 nt, Homo Sapiens
ugagcugcugagcaucaacaagauggaaguuuugucccaauagacagaguauuucccuuggccg

SEQ ID NO: 160856 - RNA, 64 nt, Homo Sapiens
ucgcauugauguauuaaauuuauaauuuuagcauucccaauagauccuaucauuccuuaaacau

SEQ ID NO: 160857 - RNA, 64 nt, Homo Sapiens
ccacuguacuccugccuuaaaaaaaaaaaaaaaaucccaauaguccaugaaggcuuugaucucu

SEQ ID NO: 160858 - RNA, 64 nt, Homo Sapiens
gccugcauaggagccucgcuuccgauuauucccuucccaauauuauucauccagacuuagccac

SEQ ID NO: 160859 - RNA, 64 nt, Homo Sapiens
cuccuuuccaauagaaagaaacuaaacagaaaacucccaauacaaagaugacuggucccucaua

SEQ ID NO: 160860 - RNA, 64 nt, Homo Sapiens
ggcaugaaccacugcacccaugccugccuuggucucccaauacaacuccugacgucaagugauc

SEQ ID NO: 160861 - RNA, 64 nt, Homo Sapiens
aucuuacauuccaaauaaagcauaagaaccauuaucccaauaaaugaacuaagggaauuuaagg

SEQ ID NO: 160862 - RNA, 64 nt, Homo Sapiens
ccagaggccaagccacagagaggauaauaguucuucccaauaaaggugauauuaaucagacuaa

SEQ ID NO: 160863 - RNA, 64 nt, Homo Sapiens
aaaaauaacuuuaggaaccaccauauuauaucacucccaauagcacugaccuggugaucaaaaa

SEQ ID NO: 160864 - RNA, 64 nt, Homo Sapiens
uguguguguauguauauauauauauaaauaucuuucccaauaugccccguugacaguguuuaaa

SEQ ID NO: 160865 - RNA, 64 nt, Homo Sapiens
ccguuuauucagguggggcuaguuuguggaaaaaucccaauauguccuuuuucauuaggcucau

SEQ ID NO: 160866 - RNA, 64 nt, Homo Sapiens
aucccagcuagugcuuuuucauaaauuuaauaaaucccaauauaagcguuccuggaauuaauuu

SEQ ID NO: 160867 - RNA, 64 nt, Homo Sapiens
ucacccuugggauguguuuacauccucucuggucucccaauaaccaguucccuuguccugaucu

SEQ ID NO: 160868 - RNA, 64 nt, Homo Sapiens
caacagcaaaauuauaggucugugccauaccaccucccaauaauaggccucugccccuaaccac

SEQ ID NO: 160869 - RNA, 64 nt, Homo Sapiens
ucucuuaugcugucccuuugaacaguuccuucacucccaauagccacuacugcagucgguacag

SEQ ID NO: 160870 - RNA, 64 nt, Homo Sapiens
uguccaaaugccugugucaucuugucccguuuccucccaauauuccuucucaaacuuggagagg

SEQ ID NO: 160871 - RNA, 64 nt, Homo Sapiens
ucuauuccccagacuccucauuauucaguacauuucccaauaaucucuuuuucucaucucuugc

SEQ ID NO: 160872 - RNA, 64 nt, Homo Sapiens
auucucaaacacaguuacacuugugcacccucuaucccaauaggcagacuggguuucuagccca

SEQ ID NO: 160873 - RNA, 64 nt, Homo Sapiens
gaaccaauccgucucucuuucuuuucuuugaaguucccaauaaaaugaaaacaggaaauguauu

SEQ ID NO: 160874 - RNA, 64 nt, Homo Sapiens
gcuguuuuuuucucacuuccaaaauaaacuugagucccaauagaauuuauggggauuuuaauug

SEQ ID NO: 160875 - RNA, 64 nt, Homo Sapiens
ccuucucaaacuuggagaggcuugucccguuuccucccaauauuuguccaaaugccugugucau

SEQ ID NO: 160876 - RNA, 64 nt, Homo Sapiens
uuauugcuacugcugugagggcuucucccuuuuaucccaauaagggauucauuccucagccucu

SEQ ID NO: 160877 - RNA, 64 nt, Homo Sapiens
uggguggcacuucuuaaaaaauggugguucaaguucccaauauguuuuuuacuacaucaaaagg

SEQ ID NO: 160878 - RNA, 64 nt, Homo Sapiens
aagcagacuggcuccaauagauaucaggcagcaaucccaauaaauucugacauguccuuggcaa

SEQ ID NO: 160879 - RNA, 64 nt, Homo Sapiens
gaaagaauuauuuuuguguuucuaaaacuaugguucccaauaaaagugacucucagcgagccuc

SEQ ID NO: 160880 - RNA, 64 nt, Homo Sapiens
gcucucaauggugcucacuugcuuggaagcaggcucccaauagggagggggcugcccucuacag

SEQ ID NO: 160881 - RNA, 64 nt, Homo Sapiens
ggguuccucugcccuggaagggcuccaggacccgucccaauaaccacccacggccaggagggcc

SEQ ID NO: 160882 - RNA, 64 nt, Homo Sapiens
uuaacagauaauucagcauuggcguauuugcuugucccaauacaagaaugccaaaggaggaaac

SEQ ID NO: 160883 - RNA, 64 nt, Homo Sapiens
ccucaugccuggccccccuccaggcaugcuggccucccaauaaagcuggacaagaagcugcuau

SEQ ID NO: 160884 - RNA, 64 nt, Homo Sapiens
ugauguguuaauauaaaauguugggagggaauauucccaauaaaggucuuaagagaaaagucac

SEQ ID NO: 160885 - RNA, 64 nt, Homo Sapiens
ucucaugaccuaaucaccucccaaaggccccaccucccaauaccaucacauuagggguuaggau

SEQ ID NO: 160886 - RNA, 64 nt, Homo Sapiens
ccaaaaaaaugcugcgcauacauuagaugggcuuucccaauaggagauacagucuucaggacac

SEQ ID NO: 160887 - RNA, 64 nt, Homo Sapiens
uucccaaccacuguucaaaauacuugaccaaaguucccaauaaccuguaaagugauaucuuuca

SEQ ID NO: 160888 - RNA, 64 nt, Homo Sapiens
guauuuaauguuucuguuguguuuugguccaaguucccaauaaucccuaauagaguaaaauuug

SEQ ID NO: 160889 - RNA, 64 nt, Homo Sapiens
uuccauucucuuuuuuagggaacauuaagcaaaaucccaauacacagagucugucacagacagg

SEQ ID NO: 160890 - RNA, 64 nt, Homo Sapiens
gggauuacaggcgugagccaccgugcccggccucucccaauaggucuuuauuccucaauccucc

SEQ ID NO: 160891 - RNA, 64 nt, Homo Sapiens
cucgcgccaccagaacgcgccgcccgcgccggccucccaauagccgccgcccgcugccugcacu

SEQ ID NO: 160892 - RNA, 64 nt, Homo Sapiens
cucuaggguagccaugcagaggagggcuucauauucccaauaaaccccacguuguggcaggugc

SEQ ID NO: 160893 - RNA, 64 nt, Homo Sapiens
gauagauagaaaaacggaaggguucagcugcugcucccaauaccucagcaugguaaggggacag

SEQ ID NO: 160894 - RNA, 64 nt, Homo Sapiens
aaaccccaacagguaaacuaauauagaacaccuuucccaauagguucaccgccuuccucacucc

SEQ ID NO: 160895 - RNA, 64 nt, Homo Sapiens
gggaagccaaggugggaguagcucacaccuguaaucccaauacugaagcaagccagacauggug

SEQ ID NO: 160896 - RNA, 64 nt, Homo Sapiens
ucauuuugugcugcuccaacaccagcaggguaucucccaauaaaguguuccuaagcagccugua

SEQ ID NO: 160897 - RNA, 64 nt, Homo Sapiens
ucuauuuucuuuaccagaaauguugcuaaguaauucccaauagaaagcugcuuauuuucauuaa

SEQ ID NO: 160898 - RNA, 64 nt, Homo Sapiens
aaagguacuaugugauaugguacugaaauuuugaucccaauagaauucauuucucuuacguuga

SEQ ID NO: 160899 - RNA, 64 nt, Homo Sapiens
auuuggguucauggcuuuugaguuaauaaaaaucucccaauaugaaauuaagaaugucaauuua

SEQ ID NO: 160900 - RNA, 64 nt, Homo Sapiens
ggguggccuguuggucacugugcagcagucugcuucccaauaaagcgugcucuuucacaaacac

SEQ ID NO: 160901 - RNA, 64 nt, Homo Sapiens
acugggcagauggaauccuauauaaugcccuuguucccaauaaacccuucucuuugauagcagu

SEQ ID NO: 160902 - RNA, 64 nt, Homo Sapiens
ggcaaacaaccuggucaaccccaacauucguugaucccaauacaauaacuaaacauaguauagu

SEQ ID NO: 160903 - RNA, 64 nt, Homo Sapiens
ggaauuuugguacuuuuuuuacaggaaaucuaacucccaauauuucaauauuaauaacacugaa

SEQ ID NO: 160904 - RNA, 64 nt, Homo Sapiens
uuguacauagcauaaaaacucugcagagaaguauucccaauaaggaaauagcauugaaauguua

SEQ ID NO: 160905 - RNA, 64 nt, Homo Sapiens
uaguguucagcugcuucagcaguguccccaaccaucccaauagggugggggccugugggccaga

SEQ ID NO: 160906 - RNA, 64 nt, Homo Sapiens
uuauccugugauuuaccuuaaaaaaacagaguuaucccaauacauguaaggcuuuuuuauuuua

SEQ ID NO: 160907 - RNA, 64 nt, Homo Sapiens
aauuguuuauauucauaauuuguaauguauuuucucccaauaguucaugguuccaagcaaugag

SEQ ID NO: 160908 - RNA, 64 nt, Homo Sapiens
gggagaauauugacccagacggcugcagagccccucccaauauuaccuuaggccucagcuggag

SEQ ID NO: 160909 - RNA, 64 nt, Homo Sapiens
uuuuguuucucuggggaaauccgccucagcucauucccaauaaauuaauacucuugauagcuua

SEQ ID NO: 160910 - RNA, 64 nt, Homo Sapiens
uauccgagacgcgauuauugcuaauuggaaauuuucccaauaccccaccgugaugacuugaaau

SEQ ID NO: 160911 - RNA, 64 nt, Homo Sapiens
cgacgcuucuguucggcccgaccuccaccccggcucccaauaaaauuuaacugaucuuuguuuc

SEQ ID NO: 160912 - RNA, 64 nt, Homo Sapiens
agacucaaguggacccuacaaugaagccuacacaucccaauagaagccccuucuuaugcugagg

SEQ ID NO: 160913 - RNA, 64 nt, Homo Sapiens
cuaggcacucacgcuguuuccuccucccuccucuucccaauacuauucccacuccuccagaugc

SEQ ID NO: 160914 - RNA, 64 nt, Homo Sapiens
aacccagccugugugccagcuuuauuuauguuucucccaauaaaccccucucaaauacccuuau

SEQ ID NO: 160915 - RNA, 64 nt, Homo Sapiens
agccuuuaguuguguacuggagucaauuucccuuucccaauaaagaaauuggaggccauuuuuc

SEQ ID NO: 160916 - RNA, 64 nt, Homo Sapiens
caguaaguacgugagccaguacuucuucacuucuucccaauauacaagaaauucuucacuucuc

SEQ ID NO: 160917 - RNA, 64 nt, Homo Sapiens
gagcaguucccaaggacaguagcugauaacauuuucccaauauuggagagcuggcagugugcgg

SEQ ID NO: 160918 - RNA, 64 nt, Homo Sapiens
uaaauaauucauuucugggcuaauuucaaaagaaucccaauauugcuguauagaaagagaacua

SEQ ID NO: 160919 - RNA, 64 nt, Homo Sapiens
cugaacuuggauuucuaguucaugaagaaaucucucccaauacccauuuauccuauuuuuagca

SEQ ID NO: 160920 - RNA, 64 nt, Homo Sapiens
aauaauauuuccaccggggaugcaucauuuuuacucccaauauucuguagagagggagucagga

SEQ ID NO: 160921 - RNA, 64 nt, Homo Sapiens
cgaacauuucuauuuuccguauuuugagcucucuucccaauauuuccuuuuggugugagucugg

SEQ ID NO: 160922 - RNA, 64 nt, Homo Sapiens
uucgcugagguuuccuccuccaccccucccccauucccaauauccuccgggggcucccuggagg

SEQ ID NO: 160923 - RNA, 64 nt, Homo Sapiens
cuucauuucucuggcauaauagacuucauuuacuucccaauaaauucucuggaaugcaaggagg

SEQ ID NO: 160924 - RNA, 64 nt, Homo Sapiens
guuaacucugcauuuuuacaacccacagccuucuucccaauagucuucaaagagcaucuccaca

SEQ ID NO: 160925 - RNA, 64 nt, Homo Sapiens
cgaauucugucuccccgugcccuccacccagugaucccaauaaagccacucaguucuuccucca

SEQ ID NO: 160926 - RNA, 64 nt, Homo Sapiens
guuucuugguagauuauucauaaugugagaugguucccaauaucaugugauuuuuuuuuuccuc

SEQ ID NO: 160927 - RNA, 64 nt, Homo Sapiens
gacacuggaauaacagcacagaaaaaucuaugacucccaauaucuucuagaauaaagaauuuuc

SEQ ID NO: 160928 - RNA, 64 nt, Homo Sapiens
aguggaccaguuccucauaacuaacagcucaaauucccaauauaaagaaagguggcaagguaaa

SEQ ID NO: 160929 - RNA, 64 nt, Homo Sapiens
ggcucugucugaguaagaaaacgcaccccccaacucccaauacuuauauucauauauuuuggau

SEQ ID NO: 160930 - RNA, 64 nt, Homo Sapiens
caagcuuguuuugcaguaguauaaauguuaauguucccaauagugaugagugauucuugggaag

SEQ ID NO: 160931 - RNA, 64 nt, Homo Sapiens
ccacugggcugugggggaaggggucaaggccauaucccaauacguguagggcgagggucccugc

SEQ ID NO: 160932 - RNA, 64 nt, Homo Sapiens
ucaguagccugggcauaguggcucacaccuguaaucccaauacuuuagaaggccaaggcuggag

SEQ ID NO: 160933 - RNA, 64 nt, Homo Sapiens
cuggaauucacccucucauguuucccuacuaacaucccaauaaaguccucuucccuaccaggcc

SEQ ID NO: 160934 - RNA, 64 nt, Homo Sapiens
ugaaggugggggguagguugguuguucagagucuucccaauaaagaugaguuuuugagccuccg

SEQ ID NO: 160935 - RNA, 64 nt, Homo Sapiens
ugcaccuaagaauaaaugguauuugggcauguauucccaauauguguauauuuauuuauaaaua

SEQ ID NO: 160936 - RNA, 64 nt, Homo Sapiens
acaccugggacuuuccccuucugguuccugugucucccaauaaacucucugaccaacccuagcu

SEQ ID NO: 160937 - RNA, 64 nt, Homo Sapiens
caccuccacugacagaggcggccccucccacggcucccaauaaaaaugugaaaaccaacccccg

SEQ ID NO: 160938 - RNA, 64 nt, Homo Sapiens
auguuccucauuccccaaugguauuuucuuuauuucccaauagcacuacuucguaucaaggguu

SEQ ID NO: 160939 - RNA, 64 nt, Homo Sapiens
auguuccucauuccccaauggucuuuucuucauuucccaauagcaccacuuuauaucaaggguu

SEQ ID NO: 160940 - RNA, 64 nt, Homo Sapiens
cugcuugcuggagccuccgaaaggugaacucaacucccaauaaacuugcuucacaucacaaggc

SEQ ID NO: 160941 - RNA, 62 nt, Homo Sapiens
gccugcuaccuggcaguaccggcuuugucccuucccaauaaacuggggcacccagcuccuga

SEQ ID NO: 160942 - RNA, 64 nt, Homo Sapiens
ugugcuagagcucugccaacucccaggcuuacucucccaauaaagccaccacucccuuagucuu

SEQ ID NO: 160943 - RNA, 64 nt, Homo Sapiens
uuugugugagcuacagaagauggguuauuuauuuucccaauaaugugggcaaagggggcucccc

SEQ ID NO: 160944 - RNA, 64 nt, Homo Sapiens
caugacuuuagccucugcugggcauguccucaucucccaauaaaauagacacacuaguggucau

SEQ ID NO: 160945 - RNA, 64 nt, Homo Sapiens
aaugaacacagagauauugccuugcauacagggcucccaauagaggaaauguggcucucuccau

SEQ ID NO: 160946 - RNA, 64 nt, Homo Sapiens; identical to SEQ ID NO: 160945

SEQ ID NO: 160947 - RNA, 64 nt, Homo Sapiens
agcuuugguguauaggcucacugcccugccccacucccaauaaaugucucugugacuguaaauc

SEQ ID NO: 160948 - RNA, 64 nt, Homo Sapiens
guguugcacaaaggcauccucguguguaaaucuuucccaauaaacuuggccuaugacaggucac

SEQ ID NO: 160949 - RNA, 64 nt, Homo Sapiens
gugcccggcacgagcugaaccucauguguuccacucccaauaaaagguugacaggggcuucucc

SEQ ID NO: 160950 - RNA, 64 nt, Homo Sapiens
cugcuccugccccugaaccuaugacauacccaagucccaauacuuucgagccaucugccacugc

SEQ ID NO: 160951 - RNA, 64 nt, Homo Sapiens
agcugggaaaguuuuacauugucuguuuuucuucucccaauagcuuucaauuguucuuucugga

SEQ ID NO: 160952 - RNA, 64 nt, Homo Sapiens
uuuacauagcauuuguguaaagacuaugaucucaucccaauaaaaugauauauuaaaccuucag

SEQ ID NO: 160953 - RNA, 64 nt, Homo Sapiens
ggaguagaauaauaucuacuucugcuauuuugcaucccaauauaccagcauagacuguaugauu

SEQ ID NO: 160954 - RNA, 64 nt, Homo Sapiens
gaccacaucuuauuugucucuucugcccucccugucccaauagguguucuucuaaagugucauc

SEQ ID NO: 160955 - RNA, 64 nt, Homo Sapiens
ggcugagccggagccagggcccuggguccccuccucccaauagaguguucaguggcacccccag

SEQ ID NO: 160956 - RNA, 64 nt, Homo Sapiens
ugaucuuaauuacuuucagauugauuucuuuccuucccaauaggucuuccuaaauuucauugug

SEQ ID NO: 160957 - RNA, 64 nt, Homo Sapiens
ucuugucgccgcccaggauugaccuguguguaagucccaauaaacucaccuacucaucaagcug

SEQ ID NO: 160958 - RNA, 64 nt, Homo Sapiens
cugaucaccugacagggcaccccaaacccccaacucccaauaaaagccgugacguucggacaaa

SEQ ID NO: 160959 - RNA, 64 nt, Homo Sapiens
gcccggggcuacuuccacugcccucccuuggccgucccaauagaggugccucuggcuggaggcu

SEQ ID NO: 160960 - RNA, 64 nt, Homo Sapiens
cucaccuacucaccaagcuggaccuguguguaagucccaauaaauccugucgcugcccaggauu

SEQ ID NO: 160961 - RNA, 64 nt, Homo Sapiens
aaaauaccuacugcugagagagaggaccuuggguucccaauacacaagcguugagccacuaagc

SEQ ID NO: 160962 - RNA, 64 nt, Homo Sapiens
uggucagcacaaaaaagauaccuggucagucaagucccaauaaauuguguccauucuuacaagc

SEQ ID NO: 160963 - RNA, 64 nt, Homo Sapiens
ugcuccuauguuggaaauuuguucauuaaaauucucccaauaaagcuuuacagccuucugcaaa

SEQ ID NO: 160964 - RNA, 64 nt, Homo Sapiens; identical to SEQ ID NO: 160963

SEQ ID NO: 160965 - RNA, 64 nt, Homo Sapiens
ugcuccuauguuggaaaauucuucauugaaguucucccaauaaagcuuuacagccuucugcaaa

SEQ ID NO: 160966 - RNA, 64 nt, Homo Sapiens
cagaaggcucgccucuccccguggacccuguuaaucccaauaaaauucugagcaaguucagagu

SEQ ID NO: 160967 - RNA, 64 nt, Homo Sapiens
ccacccucuaguguauuucacagaaaacaaaaccucccaauaaaacgguugaaaccugaaucuc

SEQ ID NO: 160968 - RNA, 64 nt, Homo Sapiens
gcuuuacagccuucugcaaagaccauuaaaauucucccaauaaaugcuccuguguuggaaauuu

SEQ ID NO: 160969 - RNA, 64 nt, Homo Sapiens
cuugagcaguugccugugaauacacaacuguauuucccaauacacaggccagucaacugcacaa

SEQ ID NO: 160970 - RNA, 64 nt, Homo Sapiens
acuguaauguugcugaacacacucugcauagguuucccaauaauuguaacuugcauuuaugugc

SEQ ID NO: 160971 - RNA, 64 nt, Homo Sapiens
gugaggccaguagcaggaauagggcuccauacugucccaauaagcucgggggguaauuuccgga

SEQ ID NO: 160972 - RNA, 64 nt, Homo Sapiens
cccuucuuccugcccccacaugccuuagugugccucccaauacuaaguccuuugucacuucucu

SEQ ID NO: 160973 - RNA, 64 nt, Homo Sapiens; identical to SEQ ID NO: 106190

SEQ ID NO: 160974 - RNA, 64 nt, Homo Sapiens; identical to SEQ ID NO: 106191

SEQ ID NO: 160975 - RNA, 64 nt, Homo Sapiens; identical to SEQ ID NO: 106192

SEQ ID NO: 160976 - RNA, 64 nt, Homo Sapiens; identical to SEQ ID NO: 106193

SEQ ID NO: 160977 - RNA, 64 nt, Homo Sapiens; identical to SEQ ID NO: 106194

SEQ ID NO: 160978 - RNA, 64 nt, Homo Sapiens; identical to SEQ ID NO: 106195

SEQ ID NO: 160979 - RNA, 64 nt, Homo Sapiens
auccaguagaguuggagauuuaaagcuuggggcuccaggaaauccucguguccccagggacuuc

SEQ ID NO: 160980 - RNA, 64 nt, Homo Sapiens
ucccagccccaccagcagccguaaauaauuucugccaggaaacuaaagccagugucuuucugag

SEQ ID NO: 160981 - RNA, 64 nt, Homo Sapiens
cuuuuuuuaaagauggauuuaaaccaagaugccuccaggaaagaggacgaaaugaguauauuca

SEQ ID NO: 160982 - RNA, 64 nt, Homo Sapiens
cugacuuucuaguucuagaaguuccgcugcaaggccaggaaagcuugagaaagguauuguggaa

SEQ ID NO: 160983 - RNA, 64 nt, Homo Sapiens
ggggaggaugacaagccgcugcccaccuccaagcccaggaaacaguacaagauggcuaaggaga

SEQ ID NO: 160984 - RNA, 64 nt, Homo Sapiens
ggccaaggaggagcggcgcauggaccagaugaugccaggaaagaccaaagcagaugcugcugac

SEQ ID NO: 160985 - RNA, 64 nt, Homo Sapiens
cugggccagagaagauaauguucuuuaauguuguccaggaaacccuggcuugcuugccgagccu

SEQ ID NO: 160986 - RNA, 64 nt, Homo Sapiens
ugucucuuguagaagauggacucugaaaaacauuccaggaaaccauggcagcauggagagccuc

SEQ ID NO: 160987 - RNA, 64 nt, Homo Sapiens
uaggguggguaagaguccaugggggugcccagucccaggaaaggggacaaugaagggacaggcc

SEQ ID NO: 160988 - RNA, 64 nt, Homo Sapiens
cuuuacuccccagcccagagagacgcugcuuuuaccaggaaagacuauugaaagauguuuuauu

SEQ ID NO: 160989 - RNA, 64 nt, Homo Sapiens
cuuauuuauuuugccugaaagaccauuauuacuaccaggaaagucuuauuuuucuaauaaauag

SEQ ID NO: 160990 - RNA, 64 nt, Homo Sapiens
acagaggacaaaguuaauucccaagaccuuaauuccaggaaagccugcaacugaagaacugcag

SEQ ID NO: 160991 - RNA, 64 nt, Homo Sapiens
ugauggugcaagguccagucaggaggcuggaaacccaggaaagccaaaagcuggagugugaggc

SEQ ID NO: 160992 - RNA, 64 nt, Homo Sapiens
auacccuugaaagggucuccggacugagaguaccccaggaaagaaagagagcuaugauguccua

SEQ ID NO: 160993 - RNA, 64 nt, Homo Sapiens
auugaucaccaugaaagaagaaugccuuuuguuuccaggaaaaucuuaguuaaauuggauugag

SEQ ID NO: 160994 - RNA, 64 nt, Homo Sapiens
aacuugcagcuuuaaccugcggauuugccauuguccaggaaagauuuucucucuuagaauugga

SEQ ID NO: 160995 - RNA, 64 nt, Homo Sapiens
cugcuuggggcagcauuuguuucugcaagguuuuccaggaaaaugcggcaaaaauagacccagc

SEQ ID NO: 160996 - RNA, 64 nt, Homo Sapiens
cauuuuuucugggcugaugucugcccaggccuucccaggaaaauauagagagcccuauucaucg

SEQ ID NO: 160997 - RNA, 64 nt, Homo Sapiens
uagggaccucagggagccccagcuucuuacccacccaggaaacccuugguccagagaggacagg

SEQ ID NO: 160998 - RNA, 64 nt, Homo Sapiens
uaagcccuaagggugguaggaacccaggagggacccaggaaacuaagauuugagauucagugcc

SEQ ID NO: 160999 - RNA, 64 nt, Homo Sapiens
cagacuacauauuuuucauguaaaugaagcagagccaggaaaaacucagugguuugcccuuggc

SEQ ID NO: 161000 - RNA, 64 nt, Homo Sapiens
gaggcugcagugagccaugaaggauugcuggagcccaggaaauucucagggagguugaggcagc

SEQ ID NO: 161001 - RNA, 64 nt, Homo Sapiens
acaauagcuguuaaggaaagaaaagcaaccaaguccaggaaauuucuucuuaacugcccaagug

SEQ ID NO: 161002 - RNA, 64 nt, Homo Sapiens
cacuggaauugucacacggcggcaucugauggugccaggaaagcgacccaagcuuguggcacca

SEQ ID NO: 161003 - RNA, 64 nt, Homo Sapiens
ccaucagucccaggcagauugaaagucucuugccccaggaaaccacucucccuguuuuagcacu

SEQ ID NO: 161004 - RNA, 64 nt, Homo Sapiens
aagaugccuccccagcccugcuuugaggagggcaccaggaaacacguccccaaagugucagcaa

SEQ ID NO: 161005 - RNA, 64 nt, Homo Sapiens
auucuuacggaaaaaaauugggacuuauuucuccccaggaaaugggguuucugaaauauuuuau

SEQ ID NO: 161006 - RNA, 64 nt, Homo Sapiens
uuuguacagcuuuaaguuguagagaagauuucucccaggaaaucagguauaaaccucuguauga

SEQ ID NO: 161007 - RNA, 64 nt, Homo Sapiens
aaaaucgguguauccuaucuguggcauuauagggccaggaaaagugccagagggaccucagggu

SEQ ID NO: 161008 - RNA, 64 nt, Homo Sapiens
gcucaucccagagaaggagagagccagacugugaccaggaaacagaacaugagaugagccagcc

SEQ ID NO: 161009 - RNA, 64 nt, Homo Sapiens
ccacacaggaauucccauccccuauucacaggcaccaggaaaccggcucccagacaccucaagc

SEQ ID NO: 161010 - RNA, 64 nt, Homo Sapiens
caaucaugagguccuugugcccaaucccaaguccccaggaaaccggaaucccaaauuugaaaau

SEQ ID NO: 161011 - RNA, 64 nt, Homo Sapiens
caagguggaggcugagguggcgccgcuccuccccccaggaaagccaggcagcccggcuggccgc

SEQ ID NO: 161012 - RNA, 64 nt, Homo Sapiens
cagauuccagccugagugcucaggcuacuucgaaccaggaaagcgcuugcuagggguccugaac

SEQ ID NO: 161013 - RNA, 64 nt, Homo Sapiens
gcaaucugcuuuuuuucuaaaaucugauuugcagccaggaaagaauuuucucacccaaggaaca

SEQ ID NO: 161014 - RNA, 64 nt, Homo Sapiens
gugguucauucucaggcugggguggacucagaugccaggaaagggacagccucccauugucagg

SEQ ID NO: 161015 - RNA, 64 nt, Homo Sapiens
ucuccaccuguguuuauggcaaguaaugagaagcccaggaaauuuguuuggggaagaugcaagg

SEQ ID NO: 161016 - RNA, 64 nt, Homo Sapiens
uccggagccaacaccaccacacauuuuccuuuacccaggaaaucaccagugcccaggaauuuga

SEQ ID NO: 161017 - RNA, 64 nt, Homo Sapiens
cagucucaucuaauuucuuaacauucccagcuccccaggaaagcuucagauauauuuuaguaac

SEQ ID NO: 161018 - RNA, 64 nt, Homo Sapiens
ugggaagcccauccugaccagcugcuccgaggacccaggaaaggcaggauugaaaauguccagg

SEQ ID NO: 161019 - RNA, 64 nt, Homo Sapiens
uccgaggacccaggaaaggcaggauugaaaauguccaggaaaguggccaagaagcaguggccuu

SEQ ID NO: 161020 - RNA, 64 nt, Homo Sapiens
agcaggugccucgauucccugcccuugugaccucccaggaaacagaacugaucugggacacuau

SEQ ID NO: 161021 - RNA, 64 nt, Homo Sapiens
ggcucccuccuccccaucaagcacaagagagggcccaggaaaaaagguuucacauaaguguaga

SEQ ID NO: 161022 - RNA, 64 nt, Homo Sapiens
uugugcuggaauugcugaugauucugccuaccauccaggaaaacaugaacccuuggguagcuug

SEQ ID NO: 161023 - RNA, 64 nt, Homo Sapiens
uuuaggggcaggagacagacgaaagggaugggagccaggaaagauucugcccagaggggcuggg

SEQ ID NO: 161024 - RNA, 64 nt, Homo Sapiens
cuggaagccuucccccagcagggaccuccccagcccaggaaaaaaugaaggaaggggcuauccu

SEQ ID NO: 161025 - RNA, 64 nt, Homo Sapiens
aggaccagucaggaugaggcugggacuuucccacccaggaaaggaucaggccucaccccucccc

SEQ ID NO: 161026 - RNA, 64 nt, Homo Sapiens
uguuggggaggguagggggauguguucagacauugcugugcaauaaauuguucuugucaccaga

SEQ ID NO: 161027 - RNA, 64 nt, Homo Sapiens
caggcacccuggcugagcuauguuugaacccaaagcugugcaguuaggcucagagugagucagc

SEQ ID NO: 161028 - RNA, 64 nt, Homo Sapiens
caggagcugacgaaccacgaaugcuucugccugugcugugcauucccaggcccgcagcucccgg

SEQ ID NO: 161029 - RNA, 64 nt, Homo Sapiens
guguuuuccagucugccuggagcagcgagaagcagcugugcagacugguggcggugggaggguu

SEQ ID NO: 161030 - RNA, 64 nt, Homo Sapiens
aggaacacauccuauuuauuauaaagcgugcugugcugugcaguaaagacuuggcagcuuccug

SEQ ID NO: 161031 - RNA, 64 nt, Homo Sapiens
gcaguggcugauucuauuagagcucuugcccagagcugugcaguauagccgcaucaccaccagc

SEQ ID NO: 161032 - RNA, 64 nt, Homo Sapiens
cguacauucaucccuuaauguuauagagugugaggcugugcauagaaauucaggacacauacau

SEQ ID NO: 161033 - RNA, 64 nt, Homo Sapiens
auggaacgccacaggauuuuggaggaacucuguagcugugcaucaacuacggagcccaugcccu

SEQ ID NO: 161034 - RNA, 64 nt, Homo Sapiens
caggagccucgccuucugugucagauggccgugugcugugcauggcguccacugcagcacagga

SEQ ID NO: 161035 - RNA, 50 nt, Homo Sapiens
gaggcgcuggagcggcacgugcugugcauaauucacccccagcucuguga

SEQ ID NO: 161036 - RNA, 64 nt, Homo Sapiens
ucagagcacccugaaguuuuugcuccugaauccagcugugcacuuugcccaaguggugaaggaa

SEQ ID NO: 161037 - RNA, 64 nt, Homo Sapiens
ggaggucaaagcuaccuuuggccccgccauugcugcugugcagaaggucaguccuaccuuuuuc

SEQ ID NO: 161038 - RNA, 64 nt, Homo Sapiens
gcuucucaagugauucaguucgcacaacucgggagcugugcacgcauguaaucagaauucuaaa

SEQ ID NO: 161039 - RNA, 64 nt, Homo Sapiens
gugagggccuggcuuccccgccagggcccuguaagcugugcagugccagcucacagcccccacc

SEQ ID NO: 161040 - RNA, 64 nt, Homo Sapiens
caugcguuacguguacccguguauauguggggaggcugugcacacgagcgaggggugaguggcc

SEQ ID NO: 161041 - RNA, 64 nt, Homo Sapiens
ugcacgagggccuaaaacagugggcucagcuuuggcugugcauuggaaucaccuggggagauuu

SEQ ID NO: 161042 - RNA, 64 nt, Homo Sapiens
acacugugauuguguugaugcagcuggcuccacagcugugcauuccacagagauucagaaggca

SEQ ID NO: 161043 - RNA, 64 nt, Homo Sapiens
agccuaaagcccaagucgagcagcucccagcacugcugugcagaccuagagguccuuagaacau

SEQ ID NO: 161044 - RNA, 64 nt, Homo Sapiens
ugaaggccagugcugugcugauuaccaucuccgugcugugcaucuaaagguuuugguuuugugg

SEQ ID NO: 161045 - RNA, 64 nt, Homo Sapiens
auucaggguuugcagaaauucucccuugaauguggcugugcagguaaaugugcauccgugaaug

SEQ ID NO: 161046 - RNA, 64 nt, Homo Sapiens
guaaaugaugacauauuuauugguguuacucaaagcugugcagggaacgugugacaggguccua

SEQ ID NO: 161047 - RNA, 64 nt, Homo Sapiens
uuacauuugcucuggaaacagcucuguguacagcgcugugcauguguggccugcuggcccugug

SEQ ID NO: 161048 - RNA, 64 nt, Homo Sapiens
cuaaaagaccucgggcaagucucacagaaacugagcugcagacggggaguagcuuuguggaaac

SEQ ID NO: 161049 - RNA, 64 nt, Homo Sapiens
agccaauuuaagaagacccuuauggagaccugaggcugcagaaacugguagguuucaucaggug

SEQ ID NO: 161050 - RNA, 64 nt, Homo Sapiens
gagaaggaauggcgugggauuagaaauuugccuugcugcagagaaauggcagagucucuagagg

SEQ ID NO: 161051 - RNA, 64 nt, Homo Sapiens
gacgaaaugaaaagcauuugcagcuccacacaaagcugcagaagagcuauuucaucuuccagcu

SEQ ID NO: 161052 - RNA, 64 nt, Homo Sapiens
ggucugggggccucucauccggcaccgggcccuggcugcagagaccuucagugccauccugacu

SEQ ID NO: 161053 - RNA, 64 nt, Homo Sapiens
caguccaggagauggacuggcuggugcugggggagcugcagauggcccuggagugggcaggcag

SEQ ID NO: 161054 - RNA, 64 nt, Homo Sapiens
gcccugggcugggugcccgaggggcucauaugcugcugcagaaugagcucuuccugaacguggg

SEQ ID NO: 161055 - RNA, 64 nt, Homo Sapiens
caagaggauccccugagcccaaaaaaauuauuaggcugcagagguacaaaaaaauaaaaauuaa

SEQ ID NO: 161056 - RNA, 64 nt, Homo Sapiens
ugccuccaagguugaaaagguuguuacuauuauugcugcagaucaguacacccauugcuccuac

SEQ ID NO: 161057 - RNA, 64 nt, Homo Sapiens
cuucugccccaugacaggccgccucucaucccaggcugcagaccgcccucggcuccaaauucug

SEQ ID NO: 161058 - RNA, 64 nt, Homo Sapiens
agaggccuggaacucgggcaauuugguggggacagcugcagagacacagggcuccuucuggagc

SEQ ID NO: 161059 - RNA, 64 nt, Homo Sapiens
ccagguucagugcggccccuggaggcagguggacgcugcagacccugagcauguggagcgagag

SEQ ID NO: 161060 - RNA, 64 nt, Homo Sapiens
gguggggauaucagggcacaacguugcugagccagcugcagaaguguggggagggugucugggg

SEQ ID NO: 161061 - RNA, 64 nt, Homo Sapiens
aaaggggcaggcuugcguuauuggccuagauuuugcugcagauuaaauccuuugaggauucucu

SEQ ID NO: 161062 - RNA, 64 nt, Homo Sapiens
cgcagacagggcccagaagcuuuagagguaugaggcugcagaaccggagagauuuuccucugug

SEQ ID NO: 161063 - RNA, 64 nt, Homo Sapiens
uggagggugggcgugguacgguggcccuuggggggcugcagagcagggcucgcacgccugggag

SEQ ID NO: 161064 - RNA, 64 nt, Homo Sapiens
gagaugaaggaggacgacgucaugagaucgagcggcugcagaugaggagacggaggugcuggca

SEQ ID NO: 161065 - RNA, 64 nt, Homo Sapiens
cugacaggcccugggaggcuaccuccuuccagcugcugcagauguaugucucagaagagcuggg

SEQ ID NO: 161066 - RNA, 64 nt, Homo Sapiens
uuaaauuuugauaccauguaagguguggcuuuuggcugcagaugucuuggcuucugaguagcuc

SEQ ID NO: 161067 - RNA, 64 nt, Homo Sapiens
uggggagcccggaaacaccucccggcccacgcgugcugcagaugauguggggagucuggaaaca

SEQ ID NO: 161068 - RNA, 64 nt, Homo Sapiens
uggggagucuggaaacaccccccggcccacgcgugcugcagaugauguggggagccuggaaaca

SEQ ID NO: 161069 - RNA, 64 nt, Homo Sapiens
uggggagccuggaaacaccccccggcccacgcgugcugcagaugauguggggagccuggaaaca

SEQ ID NO: 161070 - RNA, 64 nt, Homo Sapiens
uggggagccuggaaacaccccccggcccacgcgugcugcagaugacguggggagccuggaaaca

SEQ ID NO: 161071 - RNA, 64 nt, Homo Sapiens
uaucugcacaaacaucuccaucccucaaaacaacgcugcagauuaauuggucauggccuugguu

SEQ ID NO: 161072 - RNA, 64 nt, Homo Sapiens
uguacccgccaugaagccgaggaagagaauuggugcugcagaagugucuuguuuaguguagaag

SEQ ID NO: 161073 - RNA, 64 nt, Homo Sapiens
accugacucaauuauuugcauauuuugagaaacugcugcagauuaguucuuuuugccaguuuuc

SEQ ID NO: 161074 - RNA, 64 nt, Homo Sapiens
gaccauauuaccuggauuaccagggacuaucuuugcugcagagaucaaggguuaagaucuaugg

SEQ ID NO: 161075 - RNA, 64 nt, Homo Sapiens
ucaagaguuuguuauuuucauuuuccacuugauugcugcagauauaguuuacauaaaaaugaug

SEQ ID NO: 161076 - RNA, 64 nt, Homo Sapiens
auuagaaauaauacaauugugaaaauuaaagauagcugcagaccaaauguauacaccuaacaua

SEQ ID NO: 161077 - RNA, 62 nt, Homo Sapiens
uccucgagaucaaacacuaaggcacggggcuggcugcagagcagccuuaggacccugggacc

SEQ ID NO: 161078 - RNA, 64 nt, Homo Sapiens
ucugcccuuuggcugcauuggaauuucagagaaggcugcagaggccuggguuacacagccugag

SEQ ID NO: 161079 - RNA, 64 nt, Homo Sapiens
cccuccauugccucgccucuauuccagaaucaaugcugcagaauguguuagcugcagauaggca

SEQ ID NO: 161080 - RNA, 64 nt, Homo Sapiens
cucuauuccagaaucaaugcugcagaauguguuagcugcagauaggcauggucucagguaugaa

SEQ ID NO: 161081 - RNA, 64 nt, Homo Sapiens
uggaggcgaagggaguguggagcaccucugccaggcugcagaccguggguggccauccauuuug

SEQ ID NO: 161082 - RNA, 64 nt, Homo Sapiens
auuuauaaaacugucuuuuauuaaagaaaaaagagcugcagaguauuaauuauauguuuaaaag

SEQ ID NO: 161083 - RNA, 64 nt, Homo Sapiens
ucaugggaugugcugggccugccuuuggcgccaugcugcagacuccagugggccugguuucugc

SEQ ID NO: 161084 - RNA, 64 nt, Homo Sapiens
ugggccugguuucugcagaauguccaugguggccgcugcagaguugcagaggucccuguagaga

SEQ ID NO: 161085 - RNA, 64 nt, Homo Sapiens
acaaagucccgggcuguuagccacugggccucuggcugcagaauacacucucaguuuacagagg

SEQ ID NO: 161086 - RNA, 64 nt, Homo Sapiens
gcacagcccuugccuggagcucguggggcucccugcugcagagaauuaguucuuuucuucugac

SEQ ID NO: 161087 - RNA, 64 nt, Homo Sapiens
uggacccagugccccucacggcugccgcaagucugcugcagaugaccucaugaacuggaagggg

SEQ ID NO: 161088 - RNA, 64 nt, Homo Sapiens
cugccaggguuggccccagggacccugggacgaggcugcagaagcucucccucccuacucccug

SEQ ID NO: 161089 - RNA, 64 nt, Homo Sapiens
gucuccgcccgcagcugaggcgcaugcaggagaugcugcagaggaugaagcagcagaugcagga

SEQ ID NO: 161090 - RNA, 64 nt, Homo Sapiens
uucccaggauccugggucuguucccugccccagugcugcagaacggacuugggagcccuccuuu

SEQ ID NO: 161091 - RNA, 64 nt, Homo Sapiens
ucgggccugcgucugagguggcccaggaccccaagcugcagagcccagggaagagcagcuccag

SEQ ID NO: 161092 - RNA, 64 nt, Homo Sapiens
gagaaagcaccuaccugucuucugugcagcuagggcugcagagcuguauucagguccaagguuc

SEQ ID NO: 161093 - RNA, 64 nt, Homo Sapiens
gcacagggagggucagaagucagggccuggcacagcugcagaguugccugggcugggugugggg

SEQ ID NO: 161094 - RNA, 64 nt, Homo Sapiens
uuucccucuuccucucauuguagggccaaggcaggcugcagaacggucugguuaagagucucac

SEQ ID NO: 161095 - RNA, 64 nt, Homo Sapiens
gugggccuugggcuggccggaguggaccaugcaggcugcagagggcagugaggaaacgggguaa

SEQ ID NO: 161096 - RNA, 64 nt, Homo Sapiens
acgaagcaggaagcaugccgggaguccccuacuggcugcagaggacaaggaaguccuggccaca

SEQ ID NO: 161097 - RNA, 64 nt, Homo Sapiens
uaaaaauggcauuuuuuuaguaaauuaagagcauaaacaauauugcuagagguggcauguuuag

SEQ ID NO: 161098 - RNA, 64 nt, Homo Sapiens
aauauugcuagagguggcauguuuagucuaccaaaaacaauacuuuucaggcacuuuagaaaua

SEQ ID NO: 161099 - RNA, 64 nt, Homo Sapiens
cagucuuacagauaacuaaggcaaaaagcuaaauaaacaauauguaaccucuaacauuugguaa

SEQ ID NO: 161100 - RNA, 64 nt, Homo Sapiens
aaaauacuagggccaugguauguaauaaaauuugaaacaauaauuucaaauaauaaagauugaa

SEQ ID NO: 161101 - RNA, 64 nt, Homo Sapiens
uuuuaugaacuuguuuuauauauguaacagagaaaaacaauaaaaaggcagaauggaacuaaua

SEQ ID NO: 161102 - RNA, 64 nt, Homo Sapiens
acucaaugaaggauguauuaugucuuugguaaugaaacaauaaccaaaacauuaaaaguccuua

SEQ ID NO: 161103 - RNA, 64 nt, Homo Sapiens
augguuacuacacaucacaguuacuaccucauacaaacaauauaacauggccaaaauaauuuag

SEQ ID NO: 161104 - RNA, 64 nt, Homo Sapiens
uuugaacauuuuugaaucacuugucuuugcuuaaaaacaauaccgcagaauccuguaagauugc

SEQ ID NO: 161105 - RNA, 64 nt, Homo Sapiens
uuuaacacuauuguauuuuuggaugcuggcaaugaaacaauacauguggcuauauuacaaaaug

SEQ ID NO: 161106 - RNA, 64 nt, Homo Sapiens
uugccuuuagcagcaguuuauuuuuuuuuugccgaaacaauaaaacacagcuucuuagcaauuu

SEQ ID NO: 161107 - RNA, 64 nt, Homo Sapiens
ucacaacacaguaaaguguguuacaaacuaagagaaacaauauuuagucaaaagaccagacaag

SEQ ID NO: 161108 - RNA, 64 nt, Homo Sapiens
cagaaaguuuaagcauauaaauaggaaaucagacaaacaauauuuaaugaugucugauauuuaa

SEQ ID NO: 161109 - RNA, 64 nt, Homo Sapiens
gcuuuuuagagcagacuuugauuaauagguagugaaacaauaagaaugaauccagaguucucau

SEQ ID NO: 161110 - RNA, 64 nt, Homo Sapiens
aauugcagacauuuaauuucacuugucugagguaaaacaauaaacuaaaauacaugggcaugca

SEQ ID NO: 161111 - RNA, 64 nt, Homo Sapiens
ugauuuuugacagauacggcaagcucuauggggaaaacaauauguacuaccuuauacccuuccc

SEQ ID NO: 161112 - RNA, 64 nt, Homo Sapiens
uuacuuggaaaaugacaggucaugcauuauccaaaaacaauaccaaaaagacauauuuuauaaa

SEQ ID NO: 161113 - RNA, 64 nt, Homo Sapiens
aagauuuuuaugaucauagaaacaucuauuuucaaaacaauauaaauuaagcuuuuccccuuga

SEQ ID NO: 161114 - RNA, 64 nt, Homo Sapiens
aauauagguguuuuguagauucuugugucacugcaaacaauaugaacuccuuuuucguauugcc

SEQ ID NO: 161115 - RNA, 64 nt, Homo Sapiens
uuagaggagagagagaaauauuaaaagagaaaugaaacaauagaguauuuuggguuuuuaauua

SEQ ID NO: 161116 - RNA, 64 nt, Homo Sapiens
uuugcaaacuuguuagaucaugcauuaacugcacaaacaauaugacauauuuuagacacuuccc

SEQ ID NO: 161117 - RNA, 64 nt, Homo Sapiens
uauaguauaccacuaauuuucaccagagggauaaaaacaauacugugccagaugcuccgcuagg

SEQ ID NO: 161118 - RNA, 64 nt, Homo Sapiens
aggagacauucugucuuucaucuagaaaguaagaaaacaauaugauggcaaggugcuuguuaug

SEQ ID NO: 161119 - RNA, 64 nt, Homo Sapiens
agaaggaaaaauuugaaguacuguguggcaaauuaaacaauauauuguucucuuauucccuagu

SEQ ID NO: 161120 - RNA, 64 nt, Homo Sapiens
uuauuaguagucacuuguuuuuacagacucagcuaaacaauaaguguuuuguuccugcugaauu

SEQ ID NO: 161121 - RNA, 64 nt, Homo Sapiens
uaacacacagagaauuaagagagugaauaggagaaaacaauauauggauuuugugauuauauuu

SEQ ID NO: 161122 - RNA, 64 nt, Homo Sapiens
ucucacaguauagaagagaacuuaaagagggaaaaaacaauaugaagauagggaaugcaggaaa

SEQ ID NO: 161123 - RNA, 64 nt, Homo Sapiens
auacuagagauugguugugccuugucacaacugcaaacaauaccugaguggaguauucaaaaac

SEQ ID NO: 161124 - RNA, 64 nt, Homo Sapiens
aagagacacgggaaaugcuucaguagaaauaagcaaacaauauaaagcauacauuggaaauaaa

SEQ ID NO: 161125 - RNA, 64 nt, Homo Sapiens
ggcaacacuccuauuggcuuguuuacugaacauaaaacaauaguuauguauuuaaaauucugau

SEQ ID NO: 161126 - RNA, 64 nt, Homo Sapiens
cuagaagacauuuuggcagagguuauuaaaauuaaaacaauaugcuugauuuuuuuaaaaauua

SEQ ID NO: 161127 - RNA, 64 nt, Homo Sapiens
gcaacaucuauuuauuaaccguuacaucugcaucaaacaauauguuauuaacuucaguaggaaa

SEQ ID NO: 161128 - RNA, 64 nt, Homo Sapiens
cccacauauucaagaagcucuccaaaucuggugaaaacaauaccuaaauaauggcuaaagauuu

SEQ ID NO: 161129 - RNA, 64 nt, Homo Sapiens
ucucgcugaauugaagagacaguucagggaagggaaacaauaaacauggcaguuccuagguugc

SEQ ID NO: 161130 - RNA, 64 nt, Homo Sapiens
gauugaaucgguaaaaacaaccucagggguccauaaacaauaucugccaacucaaccuguuguc

SEQ ID NO: 161131 - RNA, 64 nt, Homo Sapiens
gcuuucuuuucaccaugacuuuauaaugucuaguaaacaauauuucuacuucccacaucuuugc

SEQ ID NO: 161132 - RNA, 64 nt, Homo Sapiens
uuucuucauccaaaacaaggugaugggaagacaaaaacaauagcuacuacaaacaauaggaguu

SEQ ID NO: 161133 - RNA, 64 nt, Homo Sapiens
aaggugaugggaagacaaaaacaauagcuacuacaaacaauaggaguuuauaauuaugugcuga

SEQ ID NO: 161134 - RNA, 64 nt, Homo Sapiens
uuauaaacauaaaagcucauuuuuuaugguauaaaaacaauaauuuaaacugcacuuuugacuu

SEQ ID NO: 161135 - RNA, 64 nt, Homo Sapiens
caucucuauugcuuggugucacucuauucaguggaaacaauaauuuaaaccaaucaaggaacuu

SEQ ID NO: 161136 - RNA, 64 nt, Homo Sapiens
guauuuugacauguuauaauacgcaaguaaaauaaaacaauaguuuacucagcucauguuacua

SEQ ID NO: 161137 - RNA, 64 nt, Homo Sapiens
acauaaauuaaaacucaaaugccaggacaaaauaaaacaauauaccagauggagaggaugcccg

SEQ ID NO: 161138 - RNA, 64 nt, Homo Sapiens
aaagccaauauaaauucucacagacaaccuuaucaaacaauauaagauggaagucuggggggca

SEQ ID NO: 161139 - RNA, 64 nt, Homo Sapiens
uauuucauaauuuacaaaggauauuacucagucuaaacaauaaacagguuuguuguuucauguc

SEQ ID NO: 161140 - RNA, 64 nt, Homo Sapiens
uuagguaaaagcuguccuaccaaagagucuagcaaaacaauauaguauuuuuuugcagaggcau

SEQ ID NO: 161141 - RNA, 64 nt, Homo Sapiens
uuauggaauaaagucacuugaucagaaggaauugaaacaauagaucauuuuguuaccuacugga

SEQ ID NO: 161142 - RNA, 64 nt, Homo Sapiens
gaaggagagauagaugagagaugugucacauuauaaacaauacacccuagucaaugcucugaaa

SEQ ID NO: 161143 - RNA, 64 nt, Homo Sapiens
gaaggggagauaggugagauucacauuauauuauaaacaauacggucagugcucugaagaugug

SEQ ID NO: 161144 - RNA, 64 nt, Homo Sapiens
uuccuuucccacuggcucuguauaaaaaacuucuggaccaaaagccaucauuggaagauuuaaa

SEQ ID NO: 161145 - RNA, 64 nt, Homo Sapiens
gagaugcgcucugcauacgcuuuucuauacacugggaccaaaaugauguugacuuaauuccaaa

SEQ ID NO: 161146 - RNA, 64 nt, Homo Sapiens
uugacuuaauuccaaaugggaucuccauaccuguggaccaaaccaacaaguaaguuuugacagc

SEQ ID NO: 161147 - RNA, 64 nt, Homo Sapiens
gacucucuccccuacacccacuaccuggcauccaggaccaaauaccuggacuaucaaccuuguu

SEQ ID NO: 161148 - RNA, 64 nt, Homo Sapiens
aacuuuaccacuuggaggacacgggguuaguccaggaccaaagaggccaauggauuuuucaaag

SEQ ID NO: 161149 - RNA, 64 nt, Homo Sapiens
uuaacccucagaggccuucaaguccuuuccaccucucacccauugcccaccauuaauaagcuua

SEQ ID NO: 161150 - RNA, 64 nt, Homo Sapiens
uggaauagugaacuggggccaugucaguuugucacucacccaaacugaccaauaaaaccuuuau

SEQ ID NO: 161151 - RNA, 64 nt, Homo Sapiens
aaacccccgggacuuuacccgguggcaucucaaccucacccaagaaggaggguccuacagacaa

SEQ ID NO: 161152 - RNA, 64 nt, Homo Sapiens
aagcaucuugccgggggcaggcugguccccagagcucacccagauauuccccagucacgaaagg

SEQ ID NO: 161153 - RNA, 64 nt, Homo Sapiens
cuucccuuccccauggcugggggcugggguaggacucacccauucuaauuuauuuugucuuuug

SEQ ID NO: 161154 - RNA, 64 nt, Homo Sapiens
augugagggauggaaaugaccuccuggcaccaggcucacccacccaaggcccccugccccagca

SEQ ID NO: 161155 - RNA, 64 nt, Homo Sapiens
cuugcaugccaaauuguaguucuugucugauuggcucacccaagcaaggccaaaauuaccaaaa

SEQ ID NO: 161156 - RNA, 64 nt, Homo Sapiens
gcucagcccugacuggugcuauaggcuggagaagcucacccaauaaacauuaagauugaggccu

SEQ ID NO: 161157 - RNA, 64 nt, Homo Sapiens
ucagggaucuugcauucccaguggucaaaccgcacucacccaugugccaaggugggguauuuac

SEQ ID NO: 161158 - RNA, 64 nt, Homo Sapiens
gcccacucucuggacaccaaaggcaugcaguagacucacccacauggauccacucacaugcugc

SEQ ID NO: 161159 - RNA, 64 nt, Homo Sapiens
cuucugcucauuggucucaaacccugcccccacccucacccacggucugccaccagcccacccc

SEQ ID NO: 161160 - RNA, 64 nt, Homo Sapiens
ggaucacugccuucuuccucaccggguagugccccucacccaucaagccuggcaaagcugccca

SEQ ID NO: 161161 - RNA, 64 nt, Homo Sapiens
acccugccccgcuucccagguuaccugggggaaccucacccagcggugggggccguuuguucag

SEQ ID NO: 161162 - RNA, 64 nt, Homo Sapiens
ggccuugaagaggugagcuuggcaugagcaguggcucacccaccguauguaugagguccauccu

SEQ ID NO: 161163 - RNA, 64 nt, Homo Sapiens
acaucgacgggcagggucggucgccuacauccgccucacccaguuggggaggacgcagcgugca

SEQ ID NO: 161164 - RNA, 64 nt, Homo Sapiens
cuggagugcaguggcacaauaccacagucucacucucacccagguguuccccauuuuuuuuuga

SEQ ID NO: 161165 - RNA, 64 nt, Homo Sapiens
cugugccccagauggaguaagguaaugagcaaagcucacccaaaguuguuaaaauguuaccuau

SEQ ID NO: 161166 - RNA, 64 nt, Homo Sapiens
ucgguggccagagccgaggguccucccacacgugcucacccacccgcagccuaggcaggcucug

SEQ ID NO: 161167 - RNA, 64 nt, Homo Sapiens
gagaacaguaagaggagcugcucuccuaucugcacucacccaggccuucacccagacuuuacca

SEQ ID NO: 161168 - RNA, 64 nt, Homo Sapiens
gagauuacagacaugagccuccgcgccuugccuccucacccaccucuucacucugaauccucau

SEQ ID NO: 161169 - RNA, 64 nt, Homo Sapiens
gaggcuucucagcccuggauuuccugcugccauccucacccagcacccacaacuagcgccuggg

SEQ ID NO: 161170 - RNA, 64 nt, Homo Sapiens
ccagagccccacagccccaucugcgggggcagugcucacccacaccauaagcuacugccauccu

SEQ ID NO: 161171 - RNA, 64 nt, Homo Sapiens
cacuggcaaacagggccucugcggagcacacuggcucacccaguccugcccgccaccguuaucg

SEQ ID NO: 161172 - RNA, 64 nt, Homo Sapiens
gaacucucugaugugccaguuguuccuuccuaugcucacccagacccuuuccuuccuggggguc

SEQ ID NO: 161173 - RNA, 64 nt, Homo Sapiens
gccuguagccuccccaacuaaggcagccaagaaacucacccaaauggcuggaguugcccgcgua

SEQ ID NO: 161174 - RNA, 64 nt, Homo Sapiens
cugggggagcucuggcggggaccacgggccacugcucacccacuggccccgagggggguguaga

SEQ ID NO: 161175 - RNA, 64 nt, Homo Sapiens
caggccugcagacccagacuccagccagaccugccucacccaccaaugcagccggggcuggcga

SEQ ID NO: 161176 - RNA, 64 nt, Homo Sapiens
gugaacugcccccagggaacugcugcagcagaggcucacccagcuccguggaaacacagccuuc

SEQ ID NO: 161177 - RNA, 64 nt, Homo Sapiens
gcagggccaggcucucaguccccgagcccccagccucacccacuaggcggaugaggucccuacu

SEQ ID NO: 161178 - RNA, 64 nt, Homo Sapiens
cagagauggagcugcucugccccaugcagcaccucucacccaccuauugggauacuauagugag

SEQ ID NO: 161179 - RNA, 64 nt, Homo Sapiens
augacuggaguccuuaucggcauuggggugggcccucacccaauugaucuaguugagaugaggu

SEQ ID NO: 161180 - RNA, 64 nt, Homo Sapiens
guaaaagccuagugacucccuccuuggccaggcccucacccaguucagauccacggccuccacc

SEQ ID NO: 161181 - RNA, 64 nt, Homo Sapiens
cagguaccuuggcugcaccgguguguggcccgcucucacccaggcacagccccgccaccaugga

SEQ ID NO: 161182 - RNA, 64 nt, Homo Sapiens
uugcaugcccccccgccauugggcacugcccucccucacccauagcucaggucugggaugagaa

SEQ ID NO: 161183 - RNA, 64 nt, Homo Sapiens
ccaccccaccccuccuauccccauugucaccacacucacccaucacccccaccacccccaguca

SEQ ID NO: 161184 - RNA, 64 nt, Homo Sapiens
ucaauuuuuugcuaaacgacaauaauucuuccagugcaacaaaauuuuaaaagagauguagcag

SEQ ID NO: 161185 - RNA, 64 nt, Homo Sapiens
gcaaaaugaugcuuuccgcagugugucuguugagugcaacaagauaaaaacaaaaagacagugu

SEQ ID NO: 161186 - RNA, 64 nt, Homo Sapiens
caaaagccaagaaaguauaauuuuuuuuuuuaauugcaacaaugaauacugggcagccuuuuuu

SEQ ID NO: 161187 - RNA, 64 nt, Homo Sapiens
augugggugucuccaggcacugguggcaguaacaugcaacaaaauucccucugauaagcuguuc

SEQ ID NO: 161188 - RNA, 64 nt, Homo Sapiens
auucaucaaguaaucauggcauucucauugggguugcaacaauauuuuuuuuuuguuccugugu

SEQ ID NO: 161189 - RNA, 60 nt, Homo Sapiens
ggacaauucauaugggauagaaacuacaaaugcaacaaaugcgucaaagaauuuagugug

SEQ ID NO: 161190 - RNA, 64 nt, Homo Sapiens
ggaaaagacuuaaugaugaacaccccaaagcaauugcaacaaaaacaaaaauugacaaguggga

SEQ ID NO: 161191 - RNA, 64 nt, Homo Sapiens
aaguuaaccaccaccaucucguggcaggaaagaaugcaacaaaaaaguuccugaaagcuuuucu

SEQ ID NO: 161192 - RNA, 64 nt, Homo Sapiens
ugaugcugagcgugaacacacuaggaagcaaggaugcaacaagaaggaguuguugaacccacug

SEQ ID NO: 161193 - RNA, 64 nt, Homo Sapiens
ccaguaguuaaaccaaacuauauucgaggauuauugcaacaaagcaaaagcugccacugugugg

SEQ ID NO: 161194 - RNA, 64 nt, Homo Sapiens
ucugcaugguccagcgcucccugucugaaguucuugcaacaaaucaucucuaguuuuuccacgu

SEQ ID NO: 161195 - RNA, 64 nt, Homo Sapiens
gaagcacuugugauaaagacaggcuccugagaaaugcaacaaguggucuuacauauacaugaga

SEQ ID NO: 161196 - RNA, 64 nt, Homo Sapiens
guguccaacaaggaauucacaccucugccuccuuugcaacaacaacauuuacacaguugguaag

SEQ ID NO: 161197 - RNA, 64 nt, Homo Sapiens
ugagaugggcgcucccgacacagcgcagacccaccaggaggaaagaggcccagcucucagcuga

SEQ ID NO: 161198 - RNA, 64 nt, Homo Sapiens
aguuagcugcgggcugcccugugggcuggugcuucaggaggaauccagagaaguguucagaugc

SEQ ID NO: 161199 - RNA, 64 nt, Homo Sapiens
ccuccuccccagcugaccagaaccaggcugagcgcaggaggacaggcaccaccggaugccacac

SEQ ID NO: 161200 - RNA, 64 nt, Homo Sapiens
caggaggacaggcaccaccggaugccacaccaggcaggaggagguguggacagugaugguacgg

SEQ ID NO: 161201 - RNA, 64 nt, Homo Sapiens
gugccuguggucccagcuacucaggaggcugaggcaggaggaucacuugagcacaggaguuuga

SEQ ID NO: 161202 - RNA, 64 nt, Homo Sapiens
uuuggaaggcugaggcagguggaucaccugaggucaggaggaguucaagaccagccuggccaac

SEQ ID NO: 161203 - RNA, 64 nt, Homo Sapiens
gcccugggaggaagggggagucauuuauauucugcaggaggaaggggccccagcugucgccuuu

SEQ ID NO: 161204 - RNA, 64 nt, Homo Sapiens
gccuggucugacugcaguguagggaauaggucaccaggaggagcccuucauccuggcaggccgg

SEQ ID NO: 161205 - RNA, 64 nt, Homo Sapiens
augccuguaaucccgacacuuugggaggccaaggcaggaggauggcuugaagccaguaguucaa

SEQ ID NO: 161206 - RNA, 64 nt, Homo Sapiens
acaccuguaguccuagcuacuugggaggcugaggcaggaggaucccuugaguccaggagguuga

SEQ ID NO: 161207 - RNA, 64 nt, Homo Sapiens
uauccaucccuccccuccuuuucagguaaggagacaggaggaguaggaggaggcagggccucuc

SEQ ID NO: 161208 - RNA, 64 nt, Homo Sapiens
cagcgcaauacuugaaccuucucccagguaggggcaggaggagccacaugagagagggagaagg

SEQ ID NO: 161209 - RNA, 64 nt, Homo Sapiens
gacccucuguuuggagcauuucaugcccuaaggacaggaggaaaggccguguagacacuaaacc

SEQ ID NO: 161210 - RNA, 64 nt, Homo Sapiens
uagacuuagacgaaagaaaggagucaagugacaacaggaggaaacaaguuggguggacauaaau

SEQ ID NO: 161211 - RNA, 64 nt, Homo Sapiens
ugggccuggacgacacggccgcaggagagcaagccaggaggacaggacacucucgggguugucu

SEQ ID NO: 161212 - RNA, 64 nt, Homo Sapiens
ggcaggagccaguccgugcaacacagagaacaggcaggaggaaagggugucauccugugaaggg

SEQ ID NO: 161213 - RNA, 64 nt, Homo Sapiens
ugugccuauagucccacuacuuguggggcuaaggcaggaggaucacuugagccccggaggucga

SEQ ID NO: 161214 - RNA, 64 nt, Homo Sapiens
acaccuguaauccuugcauuuuggaaggcugaggcaggaggaucacuuuaggccugguguguuc

SEQ ID NO: 161215 - RNA, 64 nt, Homo Sapiens
ccgagggccccaggaugucuccugggaggggaggcaggaggagggggguccugucaucacaucc

SEQ ID NO: 161216 - RNA, 64 nt, Homo Sapiens
ggggagcccccucuggcuguccguggccggacggcaggaggagaccaguggacagcguggugag

SEQ ID NO: 161217 - RNA, 64 nt, Homo Sapiens
ccuguaaucccaacacuuuguugggaggccaaagcaggaggauagcuugaggccaggaguucca

SEQ ID NO: 161218 - RNA, 64 nt, Homo Sapiens
acgccuguguucccagcuacucaggaggcugaagcaggaggauagcuugagcccaggaguuuga

SEQ ID NO: 161219 - RNA, 64 nt, Homo Sapiens
ugacccccauacauuccucccugcuccccacugccaggaggaccacuguccccagccagccaaa

SEQ ID NO: 161220 - RNA, 64 nt, Homo Sapiens
uccuguccaugcgcuuccagggccccacgguccccaggaggacgcuuccuggccaaagccccaa

SEQ ID NO: 161221 - RNA, 64 nt, Homo Sapiens
cagcauuauucuagugcuguaugaguauguguaacaggaggacaaagggagaguaggagagacc

SEQ ID NO: 161222 - RNA, 64 nt, Homo Sapiens
acauuagauaaugacacaauuggagcuuagaguccaggaggaauagacaaagcauuuguucauu

SEQ ID NO: 161223 - RNA, 64 nt, Homo Sapiens
acuggccauuaugcauccccucagggaggcugcccaggaggaagugcuucacuccuggcucugu

SEQ ID NO: 161224 - RNA, 64 nt, Homo Sapiens
accgggcuugggcuuccucuggcaguguagacagcaggaggagcucagacagguacuauucgua

SEQ ID NO: 161225 - RNA, 64 nt, Homo Sapiens
acacagaaacaccguaagugcucucuaaaagacacaggaggaugauggcaguccucacccccac

SEQ ID NO: 161226 - RNA, 64 nt, Homo Sapiens
ucuugagcccaggaggucaaucaggaggaugaggcaggaggaucaugcuuguggucccagcugu

SEQ ID NO: 161227 - RNA, 64 nt, Homo Sapiens
aggcaggaggaucucuugaguggucccagcuguucaggaggaugggcgugguggcucaugcuug

SEQ ID NO: 161228 - RNA, 64 nt, Homo Sapiens
aggggccggggcggugccagaaccgggugagcaacaggaggacgcacugcuggcagccugggca

SEQ ID NO: 161229 - RNA, 64 nt, Homo Sapiens
agccgugacccuguggaaggauggagcugagcagcaggaggaggccaugcaaucuagcgagucc

SEQ ID NO: 161230 - RNA, 64 nt, Homo Sapiens
uaauguauggaaaacauuuaggcuuauaaauccacaggaggagauagagauuuugauaucauuu

SEQ ID NO: 161231 - RNA, 64 nt, Homo Sapiens
guugagcccaggaguuugaguugagaggcugaggcaggaggauuaugccuauagucccagcuac

SEQ ID NO: 161232 - RNA, 64 nt, Homo Sapiens
acagugaccuauaaugagccucaggaggcugaggcaggaggaucgcaugugcagucccagcuac

SEQ ID NO: 161233 - RNA, 60 nt, Homo Sapiens
acuuggagccaggaguuugagaggccaaggcaggaggauccuguaaucccagcauuuuag

SEQ ID NO: 161234 - RNA, 64 nt, Homo Sapiens
ugggauaaggggaaggagaagagggagaauggagcaggaggaaaagcagaguuggucuagagag

SEQ ID NO: 161235 - RNA, 64 nt, Homo Sapiens
cagcccugguuuccugucacucagagcugauucacaggaggaggggagguuggggggcgggaga

SEQ ID NO: 161236 - RNA, 64 nt, Homo Sapiens
gaugauuuagauuuugauauugauuuagaagacacaggaggagaccaucaaaugaauuaauauc

SEQ ID NO: 161237 - RNA, 64 nt, Homo Sapiens
augccuguaaucccagcuacucaggaggcugaggcaggaggauugcuugaacccuggaggcgga

SEQ ID NO: 161238 - RNA, 64 nt, Homo Sapiens
cagggagcacuuggcuccuggcagagggagaggacaggaggaggagccuuccccaggaggaacg

SEQ ID NO: 161239 - RNA, 64 nt, Homo Sapiens
ggcagagggagaggacaggaggaggagccuuccccaggaggaacgaggagagguggccacgugg

SEQ ID NO: 161240 - RNA, 64 nt, Homo Sapiens
caugguggcccuguucugggggagcaggguaaggcaggaggaagugggugagcuccgagaugau

SEQ ID NO: 161241 - RNA, 64 nt, Homo Sapiens
ggcuccuguggcucugcuggcucagugugggcugcaggaggacugcagacucagcugcaauucu

SEQ ID NO: 161242 - RNA, 64 nt, Homo Sapiens
cuuggggugcugaggcgggaggauuacuugagcccaggaggauuacuucaaccugggagguuga

SEQ ID NO: 161243 - RNA, 64 nt, Homo Sapiens
caugcauguaauucuagcacuuuggaggccaaggcaggaggacugcuugagcccaggaguuuga

SEQ ID NO: 161244 - RNA, 64 nt, Homo Sapiens
uugauuuuagccaugccugcuccucugccuggaccaggaggagggccccuggggcagaaguuag

SEQ ID NO: 161245 - RNA, 64 nt, Homo Sapiens
ccaggcccugcagggcuggucagggugucuggggcaggaggaggccaacucacugaacuagugc

SEQ ID NO: 161246 - RNA, 64 nt, Homo Sapiens
ccugcuuaggccacucgagcaucagagcuuccagcaggaggaagggcuguaggaauggaagcuu

SEQ ID NO: 161247 - RNA, 64 nt, Homo Sapiens
acuggaaccugggagguugcacucggggcugaggcaggaggaucucacaccuguagucccggcc

SEQ ID NO: 161248 - RNA, 64 nt, Homo Sapiens
acuugaguccagaaauucaauugggaggccaaggcaggaggaucaccccuauaaucccaggacu

SEQ ID NO: 161249 - RNA, 64 nt, Homo Sapiens
uggucugcggggauccuguuacaaaggugaaacccaggaggagaguguggaguccagagugcug

SEQ ID NO: 161250 - RNA, 64 nt, Homo Sapiens
gggaucuucugccaccaucagggacaaacgggggcaggaggaaagucacugaugcccagauguu

SEQ ID NO: 161251 - RNA, 64 nt, Homo Sapiens
uggcacugaagguggaacagaggcugaugccugccaggaggagcccaacugcaggaagcccagg

SEQ ID NO: 161252 - RNA, 64 nt, Homo Sapiens
cccaggaggcugaugccugcguguaaaugagcuccaggaggaaggcggauccagcugcaagacc

SEQ ID NO: 161253 - RNA, 64 nt, Homo Sapiens
aaugagagugauguuggccagaugccauucuugccaggaggaggcgcgggcccuaggacccuag

SEQ ID NO: 161254 - RNA, 64 nt, Homo Sapiens
uucuauguguauguauauguauguggauuuagaacaggaggauaguaggccugccuguguucuc

SEQ ID NO: 161255 - RNA, 64 nt, Homo Sapiens
auagaggagaccagucaguacuucuuggagggggcaggaggagagaggaaaagggagggcgaga

SEQ ID NO: 161256 - RNA, 64 nt, Homo Sapiens
ccaaacccacccgcgcccugggacgcagccacgccaggaggaggacacggccgccgagagcaag

SEQ ID NO: 161257 - RNA, 64 nt, Homo Sapiens
cuggacagaucugaggaaggccguaaaauggggacaggaggauucagcucaggaguaagggaag

SEQ ID NO: 161258 - RNA, 64 nt, Homo Sapiens
gagccacagggcuagaagcacaggcccgucaccccaggaggaaaagcccagggucuggggcagc

SEQ ID NO: 161259 - RNA, 64 nt, Homo Sapiens
ucgugagaaagagagcuucaaccucaagagggcucaggaggacaucucacggcugcggcgcaag

SEQ ID NO: 161260 - RNA, 64 nt, Homo Sapiens
gguggaggucuacgcagaugccgacgaaauccuccaggaggagaucaaggaguacaaggugggg

SEQ ID NO: 161261 - RNA, 64 nt, Homo Sapiens
aggggccagagccuuggaggacacuaagaggaggcaggaggagcaacucaaauccccaagaaca

SEQ ID NO: 161262 - RNA, 64 nt, Homo Sapiens
auggaauggcagcaugcaaacuuggaucagauagcaggaggaacuuucaaaagucuggcccacu

SEQ ID NO: 161263 - RNA, 64 nt, Homo Sapiens
gcuugagcucaggaguucaauugggagccugaggcaggaggauuacgccuguagucccagguac

SEQ ID NO: 161264 - RNA, 64 nt, Homo Sapiens
acuugagcccgggagguugauagggaggcugagccaggaggaucgcaccuguagucccagcuac

SEQ ID NO: 161265 - RNA, 64 nt, Homo Sapiens
cacaccuauaaucgagcacuuugggaggccaagacaggaggaucacuugaggccaggagucuga

SEQ ID NO: 161266 - RNA, 64 nt, Homo Sapiens
augccuguagucccagccacucagaaggcugaggcaggaggaucgcuugagaccaagaguuuga

SEQ ID NO: 161267 - RNA, 64 nt, Homo Sapiens
caccggaagaccuugccucugugccgcggagguccaggaggaaacggggcggccgcuaggccuc

SEQ ID NO: 161268 - RNA, 64 nt, Homo Sapiens
gaaggcacacgcucaaugccccacgugccuucuccaggaggaacgaagcaggguuugaggguug

SEQ ID NO: 161269 - RNA, 64 nt, Homo Sapiens
ggggcgggggcagcugugucaucuuucuggggcccaggaggaucugggcugguuugucugggga

SEQ ID NO: 161270 - RNA, 64 nt, Homo Sapiens
augacuauaaucccagcuguuugagaggccaaugcaggaggaugguugagcucaggaguucgag

SEQ ID NO: 161271 - RNA, 64 nt, Homo Sapiens
acgcuugcaaucccagugcuuugggagacugaggcaggaggaucacuuaaggccaggaguucga

SEQ ID NO: 161272 - RNA, 64 nt, Homo Sapiens
augccuguaauccgagugcuuugggaggcugaggcaggaggaucacucgagcucaagaauucaa

SEQ ID NO: 161273 - RNA, 64 nt, Homo Sapiens
agcuuggaguucucuauacuuaagaggcuuucuccaggaggauuaccugaucucauguuaggcc

SEQ ID NO: 161274 - RNA, 64 nt, Homo Sapiens
acaggcaaauguacuucucaauaaaaaggaaggacaggaggaaggucuauaaauguaucuuaua

SEQ ID NO: 161275 - RNA, 64 nt, Homo Sapiens
ugaacuuggccgaguaggggugggggugggauggcaggaggagccgcaggaggaaggagguugu

SEQ ID NO: 161276 - RNA, 64 nt, Homo Sapiens
aguaggggugggggugggauggcaggaggagccgcaggaggaaggagguugugcagggucugga

SEQ ID NO: 161277 - RNA, 64 nt, Homo Sapiens
cugugaagaagaaaaaaaccccuggccuuugggccaggaggaaucuguuacucgaauccaccca

SEQ ID NO: 161278 - RNA, 64 nt, Homo Sapiens
cugugaacucugaagucacuaguccagcugggugcaggaggacuucaaguguguggacgaaaga

SEQ ID NO: 161279 - RNA, 64 nt, Homo Sapiens
ugggccuugggcuccgugugggagaccggccugccaggaggacccagggcucuguaaguagaug

SEQ ID NO: 161280 - RNA, 63 nt, Homo Sapiens
gacccagggcucuguaaguagaugcauuuggguccaggaggaagcguggacaccucguaggga

SEQ ID NO: 161281 - RNA, 64 nt, Homo Sapiens
ggaugaagaccuagacuuaccugaaggaucuucacaggaggauaaagacguagaauuaccugaa

SEQ ID NO: 161282 - RNA, 64 nt, Homo Sapiens
ggauaaagacguagaauuaccugaaggaucuucacaggaggaugaagaccuagagaaaaagcga

SEQ ID NO: 161283 - RNA, 64 nt, Homo Sapiens
aagaccuaggguuaucugaacugaaggaucuucacaggaggaugggaugaagaccuacaauuac

SEQ ID NO: 161284 - RNA, 64 nt, Homo Sapiens
aagaccuagacucaucugcaacgaaggauccucacaggaggauguccaguccaagaggaggagg

SEQ ID NO: 161285 - RNA, 65 nt, Homo Sapiens
acuuuugggauagggugcuggcagcugucccaagcaauggguaaugaugauggcaaaaagggugu

SEQ ID NO: 161286 - RNA, 65 nt, Homo Sapiens
agauuuacuuauggucaugugcucagaaaugcucaaauggguacaaccaucaccaagggugggau

SEQ ID NO: 161287 - RNA, 65 nt, Homo Sapiens
cccacccccaacaaagcacuaucauuuucauuuggaauggguauuuucuguuucaugauguauuu

SEQ ID NO: 161288 - RNA, 65 nt, Homo Sapiens
ugaaucaucaccuuaaauauuuaaagguguuaauuaauggguauaaaauuuaaaucaguauuacu

SEQ ID NO: 161289 - RNA, 65 nt, Homo Sapiens
uuauaccugaugaagaaauggcaacagcugacagaaauggguacagcucaucaaaaaugugcagc

SEQ ID NO: 161290 - RNA, 65 nt, Homo Sapiens
cagacaugagacauagggauuuggaggccccuuagaauggguagaugguguuauguucccuuucu

SEQ ID NO: 161291 - RNA, 65 nt, Homo Sapiens
gugagugggugggauggggacauuugaacauguuuaauggguaugcucaggucaacugaccugac

SEQ ID NO: 161292 - RNA, 65 nt, Homo Sapiens
ucugaaaaguaguuaaugcuuuuugguauugaaguaauggguaacuaaaauggacuuccauagua

SEQ ID NO: 161293 - RNA, 65 nt, Homo Sapiens
ugccuuccaggcugcagucagauguccugaugcucaauggguagacguuuucaggaggaaccugg

SEQ ID NO: 161294 - RNA, 65 nt, Homo Sapiens
caauaaaugauaguuucuacuacaguauaugaaauaauggguauuaaugaauguaaagcacuuag

SEQ ID NO: 161295 - RNA, 65 nt, Homo Sapiens
aggcacugggugcugacucagcugguauagaagggaauggguaggugugaaaugggagccuacca

SEQ ID NO: 161296 - RNA, 65 nt, Homo Sapiens
uacagccugaacucaggaggggucuugguuucauaaauggguauagaaugugcuguggcagaggg

SEQ ID NO: 161297 - RNA, 65 nt, Homo Sapiens
gguuuuucaauaccaauuacauggaacuuuucuguaauggguacaaugaagaaguuucuaaaaac

SEQ ID NO: 161298 - RNA, 65 nt, Homo Sapiens
cacacgcuuauggauguguguaccauugagaugagaauggguagauggaacggagaccaucaagc

SEQ ID NO: 161299 - RNA, 65 nt, Homo Sapiens
ccuucacuaaaagggcucuuaccaagaucaaaucuaauggguacauuuuaguuccuaugugauuu

SEQ ID NO: 161300 - RNA, 65 nt, Homo Sapiens
uuccacguaagggagaccuuugcaaagggcauccaaauggguaggcaggugacagccgccguauu

SEQ ID NO: 161301 - RNA, 65 nt, Homo Sapiens
caccuuucuccuguccaacuucaccaccaccugauaauggguauauaacaggaagcugaagguac

SEQ ID NO: 161302 - RNA, 65 nt, Homo Sapiens
auaaaaaauagucccacaaaauaccuuuugugacuaauggguagcaaucguauuauuugcuggcc

SEQ ID NO: 161303 - RNA, 65 nt, Homo Sapiens
ugguguacucauuuaugcauagagacucguuuaugaauggguagagccacagaacguauagaguu

SEQ ID NO: 161304 - RNA, 65 nt, Homo Sapiens
aucgcuguuuaguuacuagaugaacaaauccacagaauggguaaagaguagaaucugaacuauau

SEQ ID NO: 161305 - RNA, 65 nt, Homo Sapiens
uaauaauacagccaaagauaaucucucagcuuuuaaauggguagagaaacacuaaagcauucaau

SEQ ID NO: 161306 - RNA, 65 nt, Homo Sapiens
uucugcauuuaguuucuaucuuuccaggcaaaacaaauggguauucuuuucauacaaccauuuuc

SEQ ID NO: 161307 - RNA, 65 nt, Homo Sapiens
guacaaauguuaaugcaacaagucuccuaauuuggaauggguaaaucauuugcauauugauuuca

SEQ ID NO: 161308 - RNA, 65 nt, Homo Sapiens
gacuugucaaagcuugcaacugaaaaacaggccagaauggguaaaaaauugcucaucccuaaucc

SEQ ID NO: 161309 - RNA, 65 nt, Homo Sapiens
cagcauccgauuuugguuguuguagcauccucuuuaauggguaaaggcuuuaaugaauaaacauu

SEQ ID NO: 161310 - RNA, 65 nt, Homo Sapiens
uuuugagguauguauuuaacccuaucuggcagcuuaauggguaauuuuuuuuaauucuauggcuu

SEQ ID NO: 161311 - RNA, 65 nt, Homo Sapiens
gaaaaucaguucgccuggccuccaagucgugaggaaauggguaugcaaggcugagauuucuacag

SEQ ID NO: 161312 - RNA, 65 nt, Homo Sapiens
uauuucagaaagcugagagaguuuuauacauggaaaauggguaugcuuaaagauugcaggguagg

SEQ ID NO: 161313 - RNA, 65 nt, Homo Sapiens
uuucauagugugguaagaccuuaaguaaaaggcacaauggguacuacagaauuaaaauguagguc

SEQ ID NO: 161314 - RNA, 65 nt, Homo Sapiens
uuucaucucccaugaacucauuuccccauaaaugaaauggguaaauaaugccccauuuguagaag

SEQ ID NO: 161315 - RNA, 65 nt, Homo Sapiens
ugcuacuuguugguaaaaauugguggacugguuucaauggguaaauguguuguggcaaauuaaug

SEQ ID NO: 161316 - RNA, 65 nt, Homo Sapiens
ugauaauucaguuuauauucaccacaugaaagaaaaauggguaacagaagaacccuuaaaacagg

SEQ ID NO: 161317 - RNA, 65 nt, Homo Sapiens
aaugcuaauauuuccagggauaaguuggaggauaaaauggguaucuuuuacuuucccuuccccca

SEQ ID NO: 161318 - RNA, 65 nt, Homo Sapiens
uuuuaacaaacucaguaguaauauuuugaguaaauaauggguacacgguuuucuuguaacaauaa

SEQ ID NO: 161319 - RNA, 65 nt, Homo Sapiens
auuaaauauauaauuuuauaucaguccuauuuauuaauggguagaaacuuuaacaaagaaaaccc

SEQ ID NO: 161320 - RNA, 65 nt, Homo Sapiens
caaaaauggggaucugugguuuucucuugucuuaaaauggguauugcuguaaucaaccuucuagg

SEQ ID NO: 161321 - RNA, 65 nt, Homo Sapiens
uuuuuacauauacauacucacauaauuuuauguucaauggguauuauguugcauagauuucaaaa

SEQ ID NO: 161322 - RNA, 65 nt, Homo Sapiens
ggauuucuuuaugguucaugguacaggauucaucuaauggguacauugggggugaugaaugggga

SEQ ID NO: 161323 - RNA, 65 nt, Homo Sapiens
gacuuaaaauuuuauguauuauuaaauguuagauaaauggguaguaccauacuacaaauauuuaa

SEQ ID NO: 161324 - RNA, 65 nt, Homo Sapiens
agaaagguggcaaugaacugugcauguaaauuuuaaauggguacuuugugcaauucguuaaaaga

SEQ ID NO: 161325 - RNA, 65 nt, Homo Sapiens
acuguaaaagauaaaucaggagauggcugauucauaauggguaauaaaauaaauagcacuuucga

SEQ ID NO: 161326 - RNA, 65 nt, Homo Sapiens
cauuaagaaauguuuuuauuuauguaaagucucucaauggguaacucuagaagauaucaugauuu

SEQ ID NO: 161327 - RNA, 65 nt, Homo Sapiens
cugaacucauuaacauugacucaucaaaauguacuaauggguacuaacagaaacuuguuaugcac

SEQ ID NO: 161328 - RNA, 65 nt, Homo Sapiens
guggccauuucaccagucacgucuuauuguucagaaauggguaaucucuccucaugucuccucau

SEQ ID NO: 161329 - RNA, 65 nt, Homo Sapiens
uuucauccuacccauugccaauaucaugaacucucaauggguaggcuagugguauuucacaauga

SEQ ID NO: 161330 - RNA, 65 nt, Homo Sapiens
acauauggagguuugcugccaaaaaacacaguacuaauggguaacuagugcuucauccccauuua

SEQ ID NO: 161331 - RNA, 65 nt, Homo Sapiens
auguacauuauucagggggugaugauaauuuacuuaauggguacauuggaggguuggcagggggc

SEQ ID NO: 161332 - RNA, 65 nt, Homo Sapiens
aaauaucaaguguugggaaagaaaaaaggaaguggaauggguaacucuucuugauuaaaaguuau

SEQ ID NO: 161333 - RNA, 65 nt, Homo Sapiens; identical to SEQ ID NO: 161332

SEQ ID NO: 161334 - RNA, 65 nt, Homo Sapiens
uguucugguucaaggcuccaccucagaaauucugaaauggguaguaagagcaaauuuucauuuua

SEQ ID NO: 161335 - RNA, 65 nt, Homo Sapiens
gagaggcagauaagcugccuggggggcuguuagcuaauggguacaaggacacccccucccgagaa

SEQ ID NO: 161336 - RNA, 65 nt, Homo Sapiens
ccucuggaugucucgucugugguugaguuuaugguaauggguacaugggucaggccauguauuaa

SEQ ID NO: 161337 - RNA, 65 nt, Homo Sapiens
uaggaugaaggguuauuuaaaaaggaagcaagauaaauggguauguagugggacaaaagggagaa

SEQ ID NO: 161338 - RNA, 65 nt, Homo Sapiens
agaacaacaacugccccucaaagagccaugggcuaaauggguacuucccagugugaauuggcuug

SEQ ID NO: 161339 - RNA, 65 nt, Homo Sapiens
aaauuauagaauguauaagaaacuugagguuaaauaauggguagucaugacgauuccauaaaaua

SEQ ID NO: 161340 - RNA, 65 nt, Homo Sapiens
uuuuagagucuuccauuuugguuuuuuagcaguuuaauggguacaguauucucaccacucaauuu

SEQ ID NO: 161341 - RNA, 65 nt, Homo Sapiens
agaagagcucacagagaaaaaacuaccaaauauccaauggguaagcccaugauguagccacuagu

SEQ ID NO: 161342 - RNA, 65 nt, Homo Sapiens
cuaaauugcucauuuuagccgcaaguuguauggggaauggguaguaauauaauuaauguaagugg

SEQ ID NO: 161343 - RNA, 65 nt, Homo Sapiens
uaauuuuagggagagauuuuuugaagagaauuuuuaauggguauuauuuuuguuaaucuuaauuc

SEQ ID NO: 161344 - RNA, 65 nt, Homo Sapiens
agccacauuuaggaggugguucaacuguagccuguaauggguaaaagcagcugcuccugccugau

SEQ ID NO: 161345 - RNA, 65 nt, Homo Sapiens
ggacaaauuguguaaaaaaaccuccccuucucugaaauggguaaaaaaugcugugaauuacucuu

SEQ ID NO: 161346 - RNA, 65 nt, Homo Sapiens
uuucuuugacucugucacacuguaaauacaucaaaaauggguaauuggaaauauaggcuauguaa

SEQ ID NO: 161347 - RNA, 65 nt, Homo Sapiens
aguuguacuacagacugcuauggcuuugcucuaagaauggguaaugucuauuucuauuuuaguug

SEQ ID NO: 161348 - RNA, 65 nt, Homo Sapiens
gccuguuugucuugcuucccagacaaaaggagggaaauggguagaucuuaggugcuggcuugugg

SEQ ID NO: 161349 - RNA, 65 nt, Homo Sapiens
cagauuuuucacucccacgagugccaagacggugcaauggguaguccccuagaugugaaaaugaa

SEQ ID NO: 161350 - RNA, 65 nt, Homo Sapiens
uguaauaauacugagcucuuuuuauuucuaguauaaauggguaccgaaguaaaugauuguaucag

SEQ ID NO: 161351 - RNA, 65 nt, Homo Sapiens
cuauaguauauuauacuacaccuuccugguucuuuaauggguaguucuuaaggcuagcggaauau

SEQ ID NO: 161352 - RNA, 65 nt, Homo Sapiens
cuuaauagaggagcugcuuguuugacccccacaacaauggguaucacauccaguccugcugacua

SEQ ID NO: 161353 - RNA, 65 nt, Homo Sapiens
uuuuauucuuuaugaugucugcaugccauauaauuaauggguaaccccaccaaugcacugcugau

SEQ ID NO: 161354 - RNA, 65 nt, Homo Sapiens
cuugauuuccucagaacugauacuuuuucauucaaaauggguauugaacuggaaugcaaagugca

SEQ ID NO: 161355 - RNA, 65 nt, Homo Sapiens
uuagacccaacacagguucucuugugggagugggaaauggguauuagcagccuggucaucaucug

SEQ ID NO: 161356 - RNA, 65 nt, Homo Sapiens
uuguuaaguacagggauuuaauauauuuugaauauaauggguauguucuaaauuugaacuuugag

SEQ ID NO: 161357 - RNA, 65 nt, Homo Sapiens
agcacucugguucucucucugccugugagaagcggaauggguacugucuaggaggacugggcagg

SEQ ID NO: 161358 - RNA, 65 nt, Homo Sapiens
aagccacgcugugucccucaauuacagaggguaggaauggguauaccucuaacugugcaaagcag

SEQ ID NO: 161359 - RNA, 65 nt, Homo Sapiens
acagcucacaucacugaauguuacacaugaguuuaaauggguaauauacagguuuuguuauaaua

SEQ ID NO: 161360 - RNA, 65 nt, Homo Sapiens
ccguaagaagcaggaaaugcagcccaaguuuuacaaauggguaaacagaggcacugagagauaga

SEQ ID NO: 161361 - RNA, 65 nt, Homo Sapiens
uaaucuauuauuuggagccugccaagagguacuguaauggguaauucugacgucagcgcaccaaa

SEQ ID NO: 161362 - RNA, 65 nt, Homo Sapiens
uuuuauucucuccaaacacuaccgugcccagccagaauggguaguugggauuacaggcgugagcc

SEQ ID NO: 161363 - RNA, 65 nt, Homo Sapiens
cuagacuucagagagaaugaauaauggguccccaaaauggguaacgggaacuguguuuauugccu

SEQ ID NO: 161364 - RNA, 65 nt, Homo Sapiens
auugaggaugaaagggaauuggaaggagcauacuuaauggguaguagggaagcacgcuguuugga

SEQ ID NO: 161365 - RNA, 65 nt, Homo Sapiens
aaaugaauuugcuagaacacuaaucucauuauuugaauggguagagacuggacuuugaugagaua

SEQ ID NO: 161366 - RNA, 65 nt, Homo Sapiens
agauagcgagaggauauguuuaaugcuuuggaaauaauggguaacaaguguucauuuaaaaugcg

SEQ ID NO: 161367 - RNA, 65 nt, Homo Sapiens
aaaaaaaaaaaaaaaaaaacguaaaaauuguuagaaauggguaaacuuugaccaaaaauuuuaca

SEQ ID NO: 161368 - RNA, 65 nt, Homo Sapiens
agguaaaaucuucauuuaaauuaauguacaaacuaaauggguaagagaagcaaaugcaaguuauu

SEQ ID NO: 161369 - RNA, 65 nt, Homo Sapiens
gacuuuaggaaauguuuugguggaguagagacaguaauggguagaugccucucugcguuuccagg

SEQ ID NO: 161370 - RNA, 65 nt, Homo Sapiens
guuuaagaaaucauuggccccuucccagcacauugaauggguaagcagacaggccaugauuuagu

SEQ ID NO: 161371 - RNA, 65 nt, Homo Sapiens
cauucacacgcuuaaaagcaauggugugaguuauuaauggguaaacuaagaaguguuauaggcaa

SEQ ID NO: 161372 - RNA, 65 nt, Homo Sapiens
auuccucaaauuuguguguuccaguccuggccuggaauggguaauggggugaguuaacccaccgc

SEQ ID NO: 161373 - RNA, 65 nt, Homo Sapiens
gcguuugauuguuugagauuuagacccucuucuguaauggguaauaggauguuuuguacuauugc

SEQ ID NO: 161374 - RNA, 65 nt, Homo Sapiens
cagagucugaauuuauacuacaguuacuuauagucaauggguaagaaagacuugaaaacaaaaaa

SEQ ID NO: 161375 - RNA, 65 nt, Homo Sapiens
uguugcuuacaccccugaaagucuguuuuuaagcaaauggguaauaguagaaaauagguuagaau

SEQ ID NO: 161376 - RNA, 65 nt, Homo Sapiens
ucuaagccaucaucuccuccuaauccucccauaacaauggguauaaguuaugaagguggguuaga

SEQ ID NO: 161377 - RNA, 65 nt, Homo Sapiens
aaauaacuuuggaaacaugggaaggugccacugguaauggguaagguucuaauaggccauguuua

SEQ ID NO: 161378 - RNA, 65 nt, Homo Sapiens
aaaaaugauauauauaggcauuaaccacacacuuuaauggguauaauuuccuggcugccucccuu

SEQ ID NO: 161379 - RNA, 65 nt, Homo Sapiens
uagugcauaauggauacaaaccuguggggauggagaauggguaguugcgaagugaaauaagccac

SEQ ID NO: 161380 - RNA, 65 nt, Homo Sapiens
auaaagauuugauguggucuccuguucaaaggaagaauggguagaaguuugacuugguuucucuu

SEQ ID NO: 161381 - RNA, 65 nt, Homo Sapiens
gcccagucguccgcucagccaaggagucagauggcaauggguacuccagcagguaggggcacagu

SEQ ID NO: 161382 - RNA, 65 nt, Homo Sapiens
gauuuuggagacuuaaaaccagguuaauggcuaagaauggguaacaugacucuuguuggauuguu

SEQ ID NO: 161383 - RNA, 65 nt, Homo Sapiens
ucagggcagggauacaaagcggggagaggguacacaauggguaucuaauaaauacuuaagaggug

SEQ ID NO: 161384 - RNA, 65 nt, Homo Sapiens
cauugcauagaaugaauuaaauauccaguuacuugaauggguauaacgcaugaauauuugugugu

SEQ ID NO: 161385 - RNA, 65 nt, Homo Sapiens
ccugaagcagaaccacuuuggccuccccugcccaaaauggguagugucuacacguccccgggcuc

SEQ ID NO: 161386 - RNA, 65 nt, Homo Sapiens
auuuuugcguauguuuauauuguauuguucuaaauaauggguagccugugaaauaagaucuugcc

SEQ ID NO: 161387 - RNA, 65 nt, Homo Sapiens
uggcuuggggggugggggagauaaaaagaacuuaaaauggguaaaguaagaaauguuaaaaaguc

SEQ ID NO: 161388 - RNA, 65 nt, Homo Sapiens
uacguacaguuuucucuaauuaggugacuguucauaauggguauauuuggaauuuagaagaaaua

SEQ ID NO: 161389 - RNA, 65 nt, Homo Sapiens
gucuaauucguagggaugugagguucugcugaggaaauggguaugaaugugccuugaacacaaag

SEQ ID NO: 161390 - RNA, 65 nt, Homo Sapiens
uaaccagcagcuagguuuuggucuguuuucacuugaauggguaaauugcaacugugccucccucu

SEQ ID NO: 161391 - RNA, 65 nt, Homo Sapiens
uugauaaauuuuaaaauuggcucagaaagaaucguaauggguauaugaauuugugugguauguca

SEQ ID NO: 161392 - RNA, 65 nt, Homo Sapiens
agccaaacucacaaauuggacugcacuugagcaugaauggguaguuuuuguaaaaucaucuacua

SEQ ID NO: 161393 - RNA, 65 nt, Homo Sapiens
auuguagcuuccucagaaaucugaaaccuacaguaaauggguaugugaggguuguuuuucuuucu

SEQ ID NO: 161394 - RNA, 65 nt, Homo Sapiens
uuaaauaacuauaucuauacuuuaguuucuccuacaauggguauggagaaaucauaguuuuauau

SEQ ID NO: 161395 - RNA, 65 nt, Homo Sapiens
aguagaaccagggccggguauuuccacauuucaauaauggguaagcuuagauuucuagguaaguc

SEQ ID NO: 161396 - RNA, 65 nt, Homo Sapiens
uacaaugcugugaaaaaaguucugcuucuuaggugaauggguacuuucuauuuuguuucuaaacg

SEQ ID NO: 161397 - RNA, 65 nt, Homo Sapiens
agaauuggagacacuucuuuacuguucaccaaagaaauggguaaucugugcugaucuccuuauuu

SEQ ID NO: 161398 - RNA, 65 nt, Homo Sapiens
uauauucauaagacuaggucuuuuucuuauauaaaaauggguaucugauauggagcccuguaauu

SEQ ID NO: 161399 - RNA, 65 nt, Homo Sapiens
cuucaguuucaaaaaaauuggugagcagucaaguuaauggguagcucccuucacagaaaucagca

SEQ ID NO: 161400 - RNA, 65 nt, Homo Sapiens
acuguuuaccuaacuaccucuuacuguguaauuaaaauggguaguucacuuacccgugcuucugu

SEQ ID NO: 161401 - RNA, 65 nt, Homo Sapiens
gaaugaaucaaauacuucaugauauuuagcuugagaauggguauggcuguuggugguacaaguuu

SEQ ID NO: 161402 - RNA, 65 nt, Homo Sapiens
acaccaaacuugaaaucagauaugagaggccuggcaauggguaaaggcaaaucugaauauuguuu

SEQ ID NO: 161403 - RNA, 65 nt, Homo Sapiens
uguguuugaauggggcauguuuaaauggcuaaguaaauggguauacuggccuccccugugucauu

SEQ ID NO: 161404 - RNA, 65 nt, Homo Sapiens
gcaaaaaaaaacuuaauuucuaguaaaucuauaaaaauggguaagucccuaaauuacaaaugaga

SEQ ID NO: 161405 - RNA, 65 nt, Homo Sapiens
gcccuuuucauaccuuaaauauauucugcacaacaaauggguauuguuagucuccauuucauaga

SEQ ID NO: 161406 - RNA, 65 nt, Homo Sapiens
agacuuuaaauuuuaaaaaaggaaguuuuauagugaauggguauaaaaacaaauuuguggcauuu

SEQ ID NO: 161407 - RNA, 65 nt, Homo Sapiens
aaaauauaguuagaacgaaugaagugagguugauuaauggguacggcauugaagggauggggagg

SEQ ID NO: 161408 - RNA, 65 nt, Homo Sapiens
ucagauuccaaguguauuuacuauuguuuauuuuuaauggguauuacagucuuuagcuaugguga

SEQ ID NO: 161409 - RNA, 65 nt, Homo Sapiens
ggugcauugcuuauugaaguaguauaauggaaaauaauggguaggagcaguucacauuuuuccac

SEQ ID NO: 161410 - RNA, 65 nt, Homo Sapiens
uauuuauccaaauauauuaacuauagacuuuuaccaauggguagcuauaagguuacagcuuauuu

SEQ ID NO: 161411 - RNA, 65 nt, Homo Sapiens
uaaugauucuuaaaugcuguaugguuuauuauuuaaauggguaaagccauuuacauaauauagaa

SEQ ID NO: 161412 - RNA, 65 nt, Homo Sapiens
uacaccaaaaaucuguaguuuagaguguaagaaguaauggguacagagaaaaaaaauuuaagacc

SEQ ID NO: 161413 - RNA, 65 nt, Homo Sapiens
uuugaguuauuuugauguggcuuuuuaaaaaaguuaauggguagcuaauguuguauuguuuuauu

SEQ ID NO: 161414 - RNA, 65 nt, Homo Sapiens
aaagaaguaaauguauuuacaaaugcaacuauuuuaauggguacccugcccuaaacauccucugc

SEQ ID NO: 161415 - RNA, 65 nt, Homo Sapiens
uuauuaggcucagugacauaaaaaggauccagguaaauggguauaggauuugcuggauuuacuaa

SEQ ID NO: 161416 - RNA, 65 nt, Homo Sapiens
auauaacuuacaaauaaguacuuaaaacagagcuuaauggguaaagcaacagcuguguaaucaca

SEQ ID NO: 161417 - RNA, 65 nt, Homo Sapiens
aaguauuaaagccuuucucucaaauucauauuugcaauggguaaagguucauaagacaugugaag

SEQ ID NO: 161418 - RNA, 65 nt, Homo Sapiens
augaauugcaguauauacguuggaacaguccacugaauggguauaaaccugugacuuuaauaagc

SEQ ID NO: 161419 - RNA, 65 nt, Homo Sapiens
cauugugauuuguacagccuacgcugggguaaggaaauggguauccaagguccuacuuuuuuaau

SEQ ID NO: 161420 - RNA, 65 nt, Homo Sapiens
ugugacauggcccccaagcagagcggguaaagugcaauggguaagggagggaaggggaauggaag

SEQ ID NO: 161421 - RNA, 65 nt, Homo Sapiens
uauagaaugcagagauuuuuuuuuccauuaaaauaaauggguauuggugguuaaaacugcuggac

SEQ ID NO: 161422 - RNA, 65 nt, Homo Sapiens
aucaccucgaagguuuacucucucccacuccgugaaauggguaacccaccuccucucugagccug

SEQ ID NO: 161423 - RNA, 65 nt, Homo Sapiens
aagccuggagcgaggaaggaaagcacagcgaacccaauggguaacgugguuuacucucccggacg

SEQ ID NO: 161424 - RNA, 65 nt, Homo Sapiens
ggccaauggagacagaggcuuagugcagagcagccaauggguacugagcuggcugagccuauggc

SEQ ID NO: 161425 - RNA, 65 nt, Homo Sapiens
aacacauaauugcuuauguaugccuauucagaauaaauggguaacacugauuacuuuugggaggg

SEQ ID NO: 161426 - RNA, 65 nt, Homo Sapiens
uaucagcuauucagucuuaauuucacuaguaguauaauggguauacauuuuuguaaauagcaucc

SEQ ID NO: 161427 - RNA, 65 nt, Homo Sapiens
aucccagugggaaccuucaugccuuauuuauuucuaauggguaaagggguuuucuuaccaagcau

SEQ ID NO: 161428 - RNA, 65 nt, Homo Sapiens
acuaagaagaggcugugauccucaugacauguauaaauggguauguucuuucuuuggcaaugacc

SEQ ID NO: 161429 - RNA, 65 nt, Homo Sapiens
gauuugcuaaguaugauguggaaaccuauugauucaauggguagaguacuuucuccugaaguauu

SEQ ID NO: 161430 - RNA, 65 nt, Homo Sapiens
uugaugauaauacccacauuuuuccucuucuguaaaauggguauacuugaccuuuccagccuaua

SEQ ID NO: 161431 - RNA, 65 nt, Homo Sapiens
cauagccacuggugggauauuuuacccaucuguaaaauggguaagcuacuaccuuggugccucag

SEQ ID NO: 161432 - RNA, 65 nt, Homo Sapiens
gucuguauugcugcuacaaggguaaaaccaggaccaauggguaaaaguaacaggcgggcagauuu

SEQ ID NO: 161433 - RNA, 65 nt, Homo Sapiens
uguucaaaauaaugaaguuauuuucuuacacacuaaauggguauuaguauaacuauaaaacuaau

SEQ ID NO: 161434 - RNA, 65 nt, Homo Sapiens
cuggaauccgaugccguuucgagcacgucaagauaaauggguauaagugauaagcuuucauggca

SEQ ID NO: 161435 - RNA, 65 nt, Homo Sapiens
guuucugacacuuguuguugaacauggcuaaauacaauggguaucgcugagacuaaguuguagaa

SEQ ID NO: 161436 - RNA, 65 nt, Homo Sapiens
agucugagggcggcgacggcuaccuggcuccggagaauggguauuugauggaggcugcgccggag

SEQ ID NO: 161437 - RNA, 65 nt, Homo Sapiens
aaugggcagacacagguguaugccaauguuucugaaauggguauaauuucguccucuccuucgga

SEQ ID NO: 161438 - RNA, 65 nt, Homo Sapiens
aaagccacaaugagauaccaucucagaccugucugaauggguauuaucagaauggguauuauuaa

SEQ ID NO: 161439 - RNA, 65 nt, Homo Sapiens
uaccaucucagaccugucugaauggguauuaucagaauggguauuauuaaaaaaucaaaacauag

SEQ ID NO: 161440 - RNA, 65 nt, Homo Sapiens
ggaaaggauuguccuugagguuuccccaucugaagaauggguacauaacgccuccauggccucag

SEQ ID NO: 161441 - RNA, 65 nt, Homo Sapiens
acaacuaauaggugaaauaugaaaacaugaucuucaauggguacuuuaauggaauaaugggucca

SEQ ID NO: 161442 - RNA, 65 nt, Homo Sapiens
cagcauuaaaaccuuagacuuugaaugauuaugaaaauggguauaccgugcccggccugauguuu

SEQ ID NO: 161443 - RNA, 65 nt, Homo Sapiens
cuucucauguggcucauucuaugcugcuugauuaaaauggguaggaguugcaaaaauuaacaaau

SEQ ID NO: 161444 - RNA, 65 nt, Homo Sapiens
ugcccacgagcuagagcggggaaauguugagcucaaauggguaaauugagaccagaaaauuauuu

SEQ ID NO: 161445 - RNA, 65 nt, Homo Sapiens
acaggccucucuuucuuucuagguugcuggggagaaauggguacccuaugaucccccuccccuuc

SEQ ID NO: 161446 - RNA, 65 nt, Homo Sapiens
uuaaugcuuuguguaauugguuugaaaaacagugaaauggguaaacgcaaaacuuuuguacuuua

SEQ ID NO: 161447 - RNA, 65 nt, Homo Sapiens
uacauaucuaucaauaucagagauuuggguaaaagaauggguaauguuuaaacauguggaggcau

SEQ ID NO: 161448 - RNA, 65 nt, Homo Sapiens
ugaccgauguaucuuuuccuuaaaguuauuauaauaauggguaauuugucaauaaagcauuccuu

SEQ ID NO: 161449 - RNA, 65 nt, Homo Sapiens
caggagaaaagcaggugcccuuguuuuuucuauaaaauggguaggagccacggaaggagccucuc

SEQ ID NO: 161450 - RNA, 65 nt, Homo Sapiens
auguucccuuguggccaaaucagugcccuuucucaaauggguacagcacaccacaauguuucccu

SEQ ID NO: 161451 - RNA, 65 nt, Homo Sapiens
uagcuaaguccuaaucuauguugcagaagguuaggaauggguagaggaauuguuggaagaagagu

SEQ ID NO: 161452 - RNA, 65 nt, Homo Sapiens
ugugaucacacuacgggaauugagauguuucuguaaauggguacuaacuagaaccaccugcaccu

SEQ ID NO: 161453 - RNA, 65 nt, Homo Sapiens
aacaaaacaaaacuuuuuuuuuuuuuuuccuguugaauggguaaaauuucaucgugugugucuaa

SEQ ID NO: 161454 - RNA, 65 nt, Homo Sapiens
uuuugcagacaguccuuaaugcugaaaacacagagaauggguaauucaagaggccuuucuuuuaa

SEQ ID NO: 161455 - RNA, 65 nt, Homo Sapiens
aggcagggggagaguggcauggggagugacuucuuaauggguaaggggcugcuuacuucuggggu

SEQ ID NO: 161456 - RNA, 65 nt, Homo Sapiens
aaugccagacuucuaaaauaaauguuuuggaauucaauggguaaauaaaugcugcuuuggggaua

SEQ ID NO: 161457 - RNA, 65 nt, Homo Sapiens
ugccugaaaauaaaucaauaaauaaacucaaccgaaauggguaugaaaguugaaauggguaugua

SEQ ID NO: 161458 - RNA, 65 nt, Homo Sapiens
uaaauaaacucaaccgaaauggguaugaaaguugaaauggguauguaaguugaaaaccagaaguu

SEQ ID NO: 161459 - RNA, 65 nt, Homo Sapiens
agaucuggggaggcccugccccuguggcccuuugcaauggguagguguuguuuucucguguccac

SEQ ID NO: 161460 - RNA, 65 nt, Homo Sapiens
ucagaaaaggaugaguuuguuuaguaguuuuuuugaauggguauggcaggauuguggacauuugg

SEQ ID NO: 161461 - RNA, 65 nt, Homo Sapiens
uucacacagugagaaauagagcaggcugccccauaaauggguaacauauuccuaaucugagugug

SEQ ID NO: 161462 - RNA, 65 nt, Homo Sapiens
acuuuuuauucaucuuuguguuuuuauuuaucuaaaauggguauugauuuuuaggacgguuuuga

SEQ ID NO: 161463 - RNA, 65 nt, Homo Sapiens
uuugcagauucccuucauaguguuccaguugcacaaauggguaacuaucaggaauaucugaagac

SEQ ID NO: 161464 - RNA, 65 nt, Homo Sapiens
agagacugaggcuugagugacauuguacagggggaaauggguaugggaaggccuguugcugcaau

SEQ ID NO: 161465 - RNA, 65 nt, Homo Sapiens
ggagcauuuuuuuauucagcccugagaggaggucgaauggguaaauuggcaaacccacugcagcc

SEQ ID NO: 161466 - RNA, 65 nt, Homo Sapiens
uauuuuugugugugauuauacaaugcccuucauccaauggguaucuuucgucugcacuaccaauu

SEQ ID NO: 161467 - RNA, 64 nt, Homo Sapiens
aagauuuuguagaauauugcuugauuaccuacugugugccaaacaauucuugcaacaugcauuc

SEQ ID NO: 161468 - RNA, 64 nt, Homo Sapiens
gggagggaugaggagugaacggcauggaaguagaugugccaauggaucccaacaaugaauagga

SEQ ID NO: 161469 - RNA, 64 nt, Homo Sapiens
gaccaaucgcaugguucuccuggcaggccugcugugugccaaaaacucccacccaaggucccuc

SEQ ID NO: 161470 - RNA, 64 nt, Homo Sapiens
cuuucucuuucccauauuccuuuucuuuuucucuugugccaaacugacagaaaccgucaccaca

SEQ ID NO: 161471 - RNA, 64 nt, Homo Sapiens
cauuaaaaacaaacuggcuugcagaaggguccgaugugccaagugaucaugauucugcuggaaa

SEQ ID NO: 161472 - RNA, 64 nt, Homo Sapiens
uuuauugccuuuugagauucuccaacuugacaaaugugccaaagaucaacagacagaaaauauc

SEQ ID NO: 161473 - RNA, 64 nt, Homo Sapiens
uuauaaugcaucuaaaccaccuguccccaguuaaugugccaaaaugucaauuuuuaacuuaucu

SEQ ID NO: 161474 - RNA, 64 nt, Homo Sapiens
aaaccugugcuuucauguuuaagaaaugagaaauugugccaaagauagcagaagaguagauaag

SEQ ID NO: 161475 - RNA, 64 nt, Homo Sapiens
gaacuagcaacuagccuuuuccaccuuuaaaaguugugccaagucauaaucauauuguguauaa

SEQ ID NO: 161476 - RNA, 64 nt, Homo Sapiens
caaaaaagaaaaaaaguaccccauguucagccccugugccaaauuugccuagguuuuccagcug

SEQ ID NO: 161477 - RNA, 64 nt, Homo Sapiens
cccuaagugccguucgggggagaggaguccuuuuugugccaaaugugugguagcaaaaggaggg

SEQ ID NO: 161478 - RNA, 64 nt, Homo Sapiens
cuuagucccaugaucuguccggagaauguuuccaugugccaaauccagcuuuggccauauuuca

SEQ ID NO: 161479 - RNA, 64 nt, Homo Sapiens
uaggagaaaaccaaucuuuuuugcucaguaaauuugugccaagauuucuuacccuugcccuaga

SEQ ID NO: 161480 - RNA, 64 nt, Homo Sapiens
ccagggcagagcuucuaguuuauucaaguaaucaugugccaaagaacuccugguaaauacugug

SEQ ID NO: 161481 - RNA, 64 nt, Homo Sapiens
gcuucaaagaccccugagcugccaaccacggagaugugccaagcaucucaucucuccugcacac

SEQ ID NO: 161482 - RNA, 64 nt, Homo Sapiens
augcuccucuuggcuaauuuucuuuugacuuuaaugugccaauguaacuuccuuuaaaggaucu

SEQ ID NO: 161483 - RNA, 64 nt, Homo Sapiens
uuuuguauuuuauuuggagaaagauuaaaaugucugugccaaaauuuccuuacauugucuugac

SEQ ID NO: 161484 - RNA, 64 nt, Homo Sapiens
gaguauuuucacaaaguucaucuuccuguuuaugugugccaaggauuguguauaucuuugugug

SEQ ID NO: 161485 - RNA, 64 nt, Homo Sapiens
uagugaucacagcagcuucuacgguguaugguucugugccaauguauugauaagagggcacaca

SEQ ID NO: 161486 - RNA, 64 nt, Homo Sapiens
cccagcauuuuacugauucauacauuaucucacuugugccaacacucaagaagcaggcuacacu

SEQ ID NO: 161487 - RNA, 64 nt, Homo Sapiens
caucuccucugccugugucugcgacccccauccaugugccaaagugucccuugggucacacagc

SEQ ID NO: 161488 - RNA, 64 nt, Homo Sapiens
cauugcaggcacucugccgcccgaccuugagggcugugccaauccuagugaaccaaaaugcaaa

SEQ ID NO: 161489 - RNA, 64 nt, Homo Sapiens
ucccacccuccaccuggggggucucgccaccuccugugccaauggggaugggcaccucaugccu

SEQ ID NO: 161490 - RNA, 64 nt, Homo Sapiens
aggacuggggccugcccggccagagagagccgagugugccaacaccccagcaucccagcugggc

SEQ ID NO: 161491 - RNA, 64 nt, Homo Sapiens
cccccguggcucccggucuccugugggccugcugugugccaaaccugagcuaccugcacccgag

SEQ ID NO: 161492 - RNA, 64 nt, Homo Sapiens
acaagcaaucauguuugcguccccguccgucacaugugccaaaucccuggcaggcagauggcuc

SEQ ID NO: 161493 - RNA, 64 nt, Homo Sapiens
aggcgacugucccauggaggcauccaaggcuuucugugccaagaaucccaagugacuggggcug

SEQ ID NO: 161494 - RNA, 64 nt, Homo Sapiens
uuguucacauaccaccuucggagggugaggccugugugccaacccuugggaaucugaggcagag

SEQ ID NO: 161495 - RNA, 64 nt, Homo Sapiens
cagccuacagauguuccugcggcgucuccuagguugugccaaaccggcugcuggggccaggaca

SEQ ID NO: 161496 - RNA, 64 nt, Homo Sapiens
ggcaacaccacgucuaaagcaguucauuuacucuugugccaaauucugagguccacaucauggc

SEQ ID NO: 161497 - RNA, 64 nt, Homo Sapiens
gguauaggaacaacuguacuagguaaaaaacuagugugccaaauuuucaaaggguauauauaaa

SEQ ID NO: 161498 - RNA, 64 nt, Homo Sapiens
auuauguaauauauuguacaauuaggaucugcaaacaaugaagaauaaaagcuauaaaguauau

SEQ ID NO: 161499 - RNA, 64 nt, Homo Sapiens
gcuuuuccucaagcaauaauuaugaagaaaaaguacaaugaacuggcacuuaagugcacuuuuu

SEQ ID NO: 161500 - RNA, 64 nt, Homo Sapiens
ugccuuaaaaggaaugcauaguugagauauuuggacaaugaaaaauauaaaccuugauguacau

SEQ ID NO: 161501 - RNA, 64 nt, Homo Sapiens
acuacagccugugcugucuuguuguagccaccucacaaugaaguaucacugugcauauuauaga

SEQ ID NO: 161502 - RNA, 64 nt, Homo Sapiens
gaguauauuuaaccuuuucuuacauuuucugaaaacaaugaaaauguuacaaauuggaccuuua

SEQ ID NO: 161503 - RNA, 64 nt, Homo Sapiens
augaauaccgcagggcagcccaccuuugugguaaacaaugaauuuaaagcuuaaauuuaugaac

SEQ ID NO: 161504 - RNA, 64 nt, Homo Sapiens
ggauagcacuuuaucuagauguggccauuuugcaacaaugaagaaauugaaauggaaaauguua

SEQ ID NO: 161505 - RNA, 64 nt, Homo Sapiens
guuauuuucguaccuuucuaggaaguuuuuguggacaaugaaaaggcagacaaagucaagagga

SEQ ID NO: 161506 - RNA, 64 nt, Homo Sapiens
caauccuaaauaauuacaccgaaaaggucucauuacaaugaaaccaaugaauccaagugacugu

SEQ ID NO: 161507 - RNA, 64 nt, Homo Sapiens
caagugacugugaaaaggucuuuaauauauuuacacaaugaaucucuaauaagcugagugacuc

SEQ ID NO: 161508 - RNA, 64 nt, Homo Sapiens
agacuuggagaagaggaagagguaguccaucagcacaaugaaggacccccuggcccugccagcu

SEQ ID NO: 161509 - RNA, 64 nt, Homo Sapiens
aagggcacgaaggccaggccgagcggauuuauugacaaugaauacgaagcagcuguaauggucu

SEQ ID NO: 161510 - RNA, 64 nt, Homo Sapiens
ggaggcauggaaguagauguacucaaagaucccaacaaugaauauuagauaacauuuucuccca

SEQ ID NO: 161511 - RNA, 64 nt, Homo Sapiens
ucauaccuagcguggagcuauuaugauaauucacacaaugaauugcucuggacucuauccaagc

SEQ ID NO: 161512 - RNA, 64 nt, Homo Sapiens
ggaaggggaagauuuccaccguuugaaaacuuuaacaaugaaggucucuuuagcacuauuuuaa

SEQ ID NO: 161513 - RNA, 64 nt, Homo Sapiens
guauggccucuggaguuagugucauaaaagaaacacaaugaaguugaaaugaccauucugugua

SEQ ID NO: 161514 - RNA, 64 nt, Homo Sapiens
ugaucauauuucauuuugcauuguuuuuauaucgacaaugaagaaaauuacccauaacuuucau

SEQ ID NO: 161515 - RNA, 64 nt, Homo Sapiens
agaagaauuaugcacacauccuuggcccccagcuacaaugaaaaaaauauuaauugaccacuuc

SEQ ID NO: 161516 - RNA, 64 nt, Homo Sapiens
aaaauugcuaaaaucauggagauuuuuuuuucauacaaugaauuuggauucuccuagcauucau

SEQ ID NO: 161517 - RNA, 64 nt, Homo Sapiens
gcaaaauuguuccuuuuuuuagguauucaguaauacaaugaaaacauuuuuacucaacuaccuc

SEQ ID NO: 161518 - RNA, 64 nt, Homo Sapiens
uauuaaguaacagcuucucauuacacucguggugacaaugaagcaagugaugagaccccacacu

SEQ ID NO: 161519 - RNA, 64 nt, Homo Sapiens
cuuugagugcccguagcgggggcugauauuucagacaaugaaaccuaaacauaaacuacguuua

SEQ ID NO: 161520 - RNA, 64 nt, Homo Sapiens
ccugaaguuuaugcuuuuccuguuuuaccaagagacaaugaaauacuucuaggugggauuuuuu

SEQ ID NO: 161521 - RNA, 64 nt, Homo Sapiens
cauuauuuccuggucuacuggugggucaguaccaacaaugaacauagguuccacacuaaauuaa

SEQ ID NO: 161522 - RNA, 64 nt, Homo Sapiens
uaagcccaaauuguggaauuauauuucugggauuacaaugaaugcaugaggguaaauggagaaa

SEQ ID NO: 161523 - RNA, 64 nt, Homo Sapiens
uuccagauagcaccguuuugacgaaagcaucuucacaaugaagcugaaaacaaaaaacaaaaaa

SEQ ID NO: 161524 - RNA, 64 nt, Homo Sapiens
ucccuuuuucaaugaauuuucaagacaaaaagccacaaugaacaccuaucccuaggcacuuaac

SEQ ID NO: 161525 - RNA, 64 nt, Homo Sapiens
cucuuugcugcugcccauguauuugggugaacaaacaaugaaaaucuucucuguugucguaaag

SEQ ID NO: 161526 - RNA, 64 nt, Homo Sapiens
gaacaggugcacagcacuguagcccaaagucaucacaaugaagauauuuucaagucauguggaa

SEQ ID NO: 161527 - RNA, 64 nt, Homo Sapiens
gccaaacucacuacaccauauuggaaauuucauuacaaugaaguuguagauaaggacugugcca

SEQ ID NO: 161528 - RNA, 64 nt, Homo Sapiens
auaauacauuuuuaaacaugucaacauugauaauacaaugaagauuuaccauaaaaaguaucau

SEQ ID NO: 161529 - RNA, 64 nt, Homo Sapiens
cgauuugaaugcacaguaaguggauaaucugaguacaaugaaauuucuuaaguuuuagaacaug

SEQ ID NO: 161530 - RNA, 64 nt, Homo Sapiens
ugccuggaacuaaaagcagugaaggcuuggauguacaaugaaacgccuuugcucucacgcagag

SEQ ID NO: 161531 - RNA, 64 nt, Homo Sapiens
ggccugcgccuccugccuugccugugacaugugaacaaugaagagccuuugcucagagccuccu

SEQ ID NO: 161532 - RNA, 64 nt, Homo Sapiens
uuaccacauuaacugacgcuaauuuguuaaaacaacaaugaaauaauauugaagugguuguaac

SEQ ID NO: 161533 - RNA, 64 nt, Homo Sapiens
uaaacuugguaauaaucuuucagaagaccuugagacaaugaaaacacagccuagauccagaguu

SEQ ID NO: 161534 - RNA, 64 nt, Homo Sapiens
uucuuccagaugugaugcuugauauuuucuauaugcgaguuagccauccacacccaggcauagc

SEQ ID NO: 161535 - RNA, 64 nt, Homo Sapiens
aaaaauagagacuauugguauguucuccccaucagcgaguuauuguaacuggucaccacuggac

SEQ ID NO: 161536 - RNA, 64 nt, Homo Sapiens
gagacuagacauaguaccgaagaacuaugacguagcgaguuaguauacauuccuuuuagaguua

SEQ ID NO: 161537 - RNA, 64 nt, Homo Sapiens
uucugcucuacuaacuguagauauuuaugacucugcgaguuaucuauuuuuauaaccaccugug

SEQ ID NO: 161538 - RNA, 64 nt, Homo Sapiens
agaccgaugcugcaagcagaccauaugcagaugugcgaguuauugacuguggaguacuugccac

SEQ ID NO: 161539 - RNA, 64 nt, Homo Sapiens
uuggaugagugugauuuugcuaaagcaagaggaggcgaguuaauugcacagugauuacaaccuu

SEQ ID NO: 161540 - RNA, 64 nt, Homo Sapiens
agcuuccggacuugucugcacccccagcaagaaggcgaguuaguuuucuagagacuugaaggag

SEQ ID NO: 161541 - RNA, 64 nt, Homo Sapiens
ugcagguguuaguggugugcuaaaagcaaggaaagcgaguuagucuuuucagugucuuuugcaa

SEQ ID NO: 161542 - RNA, 64 nt, Homo Sapiens
aguuugaauuucaacacugcugcaaaauaacagagcgaguuaucuuggauuaucaccagauuaa

SEQ ID NO: 161543 - RNA, 64 nt, Homo Sapiens
cccggacggacuccuucaccgacugcacccccgggcgaguuacgcggccucucugugccgcuuc

SEQ ID NO: 161544 - RNA, 64 nt, Homo Sapiens
aaaugucggcaaaaugacuauuuuauuguuugaagcgaguuaauauucucaguugucuuuaaaa

SEQ ID NO: 161545 - RNA, 64 nt, Homo Sapiens
gaagcugaaauucguacuauauuggccaaagugagcgaguuaggugaucuugguuucaauuucc

SEQ ID NO: 161546 - RNA, 64 nt, Homo Sapiens
cuauuuuauuuacugucugucuuguaaaagauuugcgaguuaaaagaauauuguuuugaacauc

SEQ ID NO: 161547 - RNA, 64 nt, Homo Sapiens
aaaaggcuuuagcaugaaauaucuuucugagcuggcgaguuagaagaauggaagguaaggggaa

SEQ ID NO: 161548 - RNA, 64 nt, Homo Sapiens
uaggcaagguacccagugauagugguauuugcuggcgaguuaaaugggaaugagaaacagaaga

SEQ ID NO: 161549 - RNA, 64 nt, Homo Sapiens
uacugcuuccauucauuguuagccugguagcccugcgaguuaagugcgugugguccguauggaa

SEQ ID NO: 161550 - RNA, 64 nt, Homo Sapiens
uccuagaauuuauuuauuuccugacuuacagcaagcgaguuaucgucuucuguauuuuguagac

SEQ ID NO: 161551 - RNA, 64 nt, Homo Sapiens
ucuguaaauauccaaguauaaagcccaggaacuucuagaauaacccagaugcgcuuuaauuuuu

SEQ ID NO: 161552 - RNA, 64 nt, Homo Sapiens
uaauuuuuuuuaauauguuuugaucacagaacuucuagaauaacccagaugcucuuucauauuc

SEQ ID NO: 161553 - RNA, 64 nt, Homo Sapiens
uugaaauauugaaacauauuaaauugugcaacaccuagaauagugcuagacauacaguaaguac

SEQ ID NO: 161554 - RNA, 64 nt, Homo Sapiens
ugguuuuguuugacuaaagaauaaucucauauaacuagaauacuuguggcuuuuauuaucuuua

SEQ ID NO: 161555 - RNA, 64 nt, Homo Sapiens
guuucauuuuaugaauggaggcacuuuacuaggucuagaauauuuuuuuaaaagccucugaacu

SEQ ID NO: 161556 - RNA, 64 nt, Homo Sapiens
gcugcgucugacuuuaauacaggcagugcucaaacuagaauaagcacuaauuaaaggaauuguu

SEQ ID NO: 161557 - RNA, 64 nt, Homo Sapiens
acaucuuuugauauucuuauaaauggaacuuacacagaagaaauagggauaugauaaccacuaa

SEQ ID NO: 161558 - RNA, 64 nt, Homo Sapiens
cagagaacaguuaaucccuaaggucuugacaaaacagaagaaaaacaagccuccucguccuagu

SEQ ID NO: 161559 - RNA, 64 nt, Homo Sapiens
gaaauccaacuagacaaauaaacaauaaauuuuccagaagaaauucaagggucacaugccaaua

SEQ ID NO: 161560 - RNA, 64 nt, Homo Sapiens
uugaagaccagaucauggguagugggguggaauucagaagaaauuaguaacugcuacuguauuu

SEQ ID NO: 161561 - RNA, 64 nt, Homo Sapiens
auuagauuucugacuugcaaauauguuuguacuccagaagaauuagaggaaaagcagauacuag

SEQ ID NO: 161562 - RNA, 64 nt, Homo Sapiens
ucucaauuuuagucuggucuuuuguacuuuucuucagaagaaaugaauuaaaggguacaguugc

SEQ ID NO: 161563 - RNA, 64 nt, Homo Sapiens
uguguucagguuuagaucauaugacacucgagcacagaagaauaauuucaaggaggucaucuug

SEQ ID NO: 161564 - RNA, 64 nt, Homo Sapiens
ucccagaguacaaagggguauguagaaaggauuccagaagaaguaauacuuuauucucuaaugu

SEQ ID NO: 161565 - RNA, 64 nt, Homo Sapiens
ccauucuuaguggcacuggggaaaucuuggcacccagaagaauucaacugcgcucacugcaaaa

SEQ ID NO: 161566 - RNA, 64 nt, Homo Sapiens
aguuaauccugugaaauaaauauugaacauaauccagaagaaucucucuguuucccuuggggaa

SEQ ID NO: 161567 - RNA, 64 nt, Homo Sapiens
uacucauuuuucaugauaaugaacagaacauagacagaagaaacaagguuuucaguccccacag

SEQ ID NO: 161568 - RNA, 64 nt, Homo Sapiens
ccucucugaguggacuggccucaaagcaagcauucagaagaaaaagaagcaaccucaguaauuu

SEQ ID NO: 161569 - RNA, 64 nt, Homo Sapiens
aaguugggacucuggagagcggaggagagagaggcagaagaacccuggccugagaagguuuggu

SEQ ID NO: 161570 - RNA, 64 nt, Homo Sapiens
ggacgcuuugggagaaugucaguucauguauguucagaagaaauucugucauagaaagugccag

SEQ ID NO: 161571 - RNA, 64 nt, Homo Sapiens
gcaugaacagucuucagccauugagaucucauuucagaagaacguuguuuugaacuauacugcu

SEQ ID NO: 161572 - RNA, 64 nt, Homo Sapiens
agagcagaugaucggagcagcaugaauugaggaacagaagaagcuuuuuuaccagguuucuaag

SEQ ID NO: 161573 - RNA, 64 nt, Homo Sapiens
uucauauuuauggccuuuggaauccaaagaaaaacagaagaauaauucauggauuuguucauug

SEQ ID NO: 161574 - RNA, 64 nt, Homo Sapiens
uuuguccacaagaugguguuuaaaacaauuuguucagaagaacugagcaaacuaacagaaauac

SEQ ID NO: 161575 - RNA, 64 nt, Homo Sapiens
uucugagcaggaaauuuauaagaaauugaaagagcagaagaauuacagcccugucacaugugcc

SEQ ID NO: 161576 - RNA, 64 nt, Homo Sapiens
auauggagugccauccugcuaggugaguacagaccagaagaaaauuuaguugggaaaauacuug

SEQ ID NO: 161577 - RNA, 64 nt, Homo Sapiens
ccccuauuaccuuuguagcagccacaucagaaagcagaagaaaacaguauuucugaaggcauug

SEQ ID NO: 161578 - RNA, 64 nt, Homo Sapiens
caacccugccaacaccuugaagaagagagggccucagaagaaacggacaacucuuuacaagcua

SEQ ID NO: 161579 - RNA, 64 nt, Homo Sapiens
aaaaacuacggguagaaaacacaaaucuuuuacgcagaagaaauaauuauaucaaauaaguauc

SEQ ID NO: 161580 - RNA, 64 nt, Homo Sapiens
uccugaaucccuuucaguuugcagaguaaaauuacagaagaagccacuauguccaugaaaaaca

SEQ ID NO: 161581 - RNA, 64 nt, Homo Sapiens
uccuggaucccuuucacuaucuacagccaaauugcagaagaaacaaguuuuuuucaaaguccaa

SEQ ID NO: 161582 - RNA, 64 nt, Homo Sapiens
aaacacagauaaauggaaaccauucuuuucaaugcagaagaaaucuagauauccccuacuguga

SEQ ID NO: 161583 - RNA, 64 nt, Homo Sapiens
uagauuuaaugaauuucacucgaaaauaaaugaucagaagaauuuucaucuaaggcauagagug

SEQ ID NO: 161584 - RNA, 64 nt, Homo Sapiens
ugaggauguuuccuuucacacuguggcaucuagccagaagaaauccuuugggauaauuuauuuc

SEQ ID NO: 161585 - RNA, 64 nt, Homo Sapiens
uuagccgcccacuucugccucagcaaucggcucucagaagaaguuucugcaccaccauuuccag

SEQ ID NO: 161586 - RNA, 64 nt, Homo Sapiens
gagacuccugaaugauuuagacaacuucaaaauacagaagaaaagcaaaugacuaguaaacaug

SEQ ID NO: 161587 - RNA, 64 nt, Homo Sapiens
aucgaggaaaucuaccaagacuaguaggguaguccagaagaagcuguuucagggccuguugcca

SEQ ID NO: 161588 - RNA, 64 nt, Homo Sapiens
aggggacccacaaacaagagugcucuuguauguccagaagaaagagaaagaccaucaaucaggg

SEQ ID NO: 161589 - RNA, 64 nt, Homo Sapiens
ggggucaggggaaggcaugggggggaccagaaaccagaagaacaaucaagacugcaaugaaaaa

SEQ ID NO: 161590 - RNA, 64 nt, Homo Sapiens
auaaauggugcugggaaaacuggauauccauaugcagaagaaugaaacuagacccccaucucuu

SEQ ID NO: 161591 - RNA, 64 nt, Homo Sapiens
aagcccuuuacauuuccauaccacaaggcaacuccagaagaaaguggguugucucaaauccugu

SEQ ID NO: 161592 - RNA, 64 nt, Homo Sapiens
auccuguuuagugaugacccgaaucucagaugcucagaagaaagcacagcccugauuuggacca

SEQ ID NO: 161593 - RNA, 64 nt, Homo Sapiens
augauggcugcacacgaugacucauuggaugggacagaagaagaggaugaggaugagauggaag

SEQ ID NO: 161594 - RNA, 64 nt, Homo Sapiens
agcuuccuuucuucauucuguccuucagggaaggcagaagaaacauuggaaagcaucuagucca

SEQ ID NO: 161595 - RNA, 64 nt, Homo Sapiens
caugcugccagauagauagaccacgcagaagaaacagaagaacugccugaugcccauggucaac

SEQ ID NO: 161596 - RNA, 64 nt, Homo Sapiens
agaagaacucaugcugccagauggucaacccacgcagaagaaacaucucugaugccugaugccc

SEQ ID NO: 161597 - RNA, 64 nt, Homo Sapiens
gaacccaggagguggagguuucaggaggcugaggcagaagaauuaagccuguaaucccagcuac

SEQ ID NO: 161598 - RNA, 64 nt, Homo Sapiens
ugacagcugucccugucacccaaaaacagccucacagaagaauaacccaaggaggaaaaacaga

SEQ ID NO: 161599 - RNA, 64 nt, Homo Sapiens
gcuugaaccugugaggcagaucaggaggcugagacagaagaaucgcgccuguaaucccagcuac

SEQ ID NO: 161600 - RNA, 64 nt, Homo Sapiens
ccuucuagaaagcauuuuagcgugguuaacgguccagaagaaucgugugguuuuccuuugggga

SEQ ID NO: 161601 - RNA, 64 nt, Homo Sapiens
uucccgggcccagaaacucuggaaagauuuuguccagaagaauucaccguguguacugagugca

SEQ ID NO: 161602 - RNA, 64 nt, Homo Sapiens
cucucucccuuauauuuuacuacucgaagaaaggcagaagaaguuacaaauaguucugaacauu

SEQ ID NO: 161603 - RNA, 64 nt, Homo Sapiens
uuguacaaauuaaaaauaaccauaagggagaaaccagaagaauuccucugaccacuuacaauua

SEQ ID NO: 161604 - RNA, 64 nt, Homo Sapiens
uuacauuuguuggcauacgaaaccuuaguggcuacagaagaaaguugaccuugugucacuauuu

SEQ ID NO: 161605 - RNA, 64 nt, Homo Sapiens
uggggaccugucugcauauacacacggggaaugccagaagaaggcccagucugcaccaggcguc

SEQ ID NO: 161606 - RNA, 64 nt, Homo Sapiens
aacaacccauaguaucucauucugucaucagauccagaagaaauauccugguuuuccagcaugu

SEQ ID NO: 161607 - RNA, 64 nt, Homo Sapiens
cccuagaaugaggccuugugaaauugauguaaaucagaagaauagggacaaucagccucaugaa

SEQ ID NO: 161608 - RNA, 64 nt, Homo Sapiens
uacccugauguaaaucucuguaaggauugcacuacagaagaauggcacuaaucucugggauuuu

SEQ ID NO: 161609 - RNA, 64 nt, Homo Sapiens
gagcagcgugggaagaagacucugucaagacucucagaagaaccuggaguaauugugccugaag

SEQ ID NO: 161610 - RNA, 64 nt, Homo Sapiens
gccugaagcucagcgugaagucugaaauaugcaacagaagaaauauaucucuaucucucuacuc

SEQ ID NO: 161611 - RNA, 64 nt, Homo Sapiens
uucuccccacuuuacugcaagguagacugaaguucagaagaaauacugaauuucugcucccaga

SEQ ID NO: 161612 - RNA, 64 nt, Homo Sapiens
cugaaguucagaagaaauacugaauuucugcucccagaagaauaguuucucuggcucacaggcc

SEQ ID NO: 161613 - RNA, 64 nt, Homo Sapiens
ucaugugaauggggccagcagagugaguuucacacagaagaauuaucuccugggagaggcagac

SEQ ID NO: 161614 - RNA, 64 nt, Homo Sapiens
gagcacaggcugggguggauuguuucucuggccucagaagaagcgaguuacagaaaugggagac

SEQ ID NO: 161615 - RNA, 64 nt, Homo Sapiens
guugcuuuucaaagaggaagaagaauaugcaggccagaagaaaaaauugccagcugucuacaca

SEQ ID NO: 161616 - RNA, 64 nt, Homo Sapiens
cauagaugaagaugaagauaugcuaagccaaauccagaagaaccauuuccccccaaaguagaga

SEQ ID NO: 161617 - RNA, 64 nt, Homo Sapiens
agaaugaacuuuuuuuuagauauucuggacucagcagaagaauucucggcaaaaguugauaucg

SEQ ID NO: 161618 - RNA, 64 nt, Homo Sapiens
gagugguuugaucuauauacacugugacgauggacagaagaaaauugugaaaguucaaauucga

SEQ ID NO: 161619 - RNA, 64 nt, Homo Sapiens
uggauuuagggauauuuuccagccagaauggauccagaagaauugaauggugcuuaaauugaga

SEQ ID NO: 161620 - RNA, 64 nt, Homo Sapiens
gcgccuguagucccagcuacucgggaggcugaagcagaagaaucgcuugaacccgggaggcgga

SEQ ID NO: 161621 - RNA, 64 nt, Homo Sapiens
guuuuaugcuaguuauugcacuucagaacaugagcagaagaaucaauucagguucugcuguugg

SEQ ID NO: 161622 - RNA, 64 nt, Homo Sapiens
auggcaaacugcucugugcugagaaugguaggcacagaagaaacuacagaaguugaggccaagg

SEQ ID NO: 161623 - RNA, 64 nt, Homo Sapiens; identical to SEQ ID NO: 90267

SEQ ID NO: 161624 - RNA, 64 nt, Homo Sapiens; identical to SEQ ID NO: 90268

SEQ ID NO: 161625 - RNA, 64 nt, Homo Sapiens; identical to SEQ ID NO: 90269

SEQ ID NO: 161626 - RNA, 64 nt, Homo Sapiens; identical to SEQ ID NO: 90270

SEQ ID NO: 161627 - RNA, 64 nt, Homo Sapiens; identical to SEQ ID NO: 90271

SEQ ID NO: 161628 - RNA, 64 nt, Homo Sapiens; identical to SEQ ID NO: 90272

SEQ ID NO: 161629 - RNA, 64 nt, Homo Sapiens; identical to SEQ ID NO: 90273

SEQ ID NO: 161630 - RNA, 64 nt, Homo Sapiens; identical to SEQ ID NO: 90274

SEQ ID NO: 161631 - RNA, 64 nt, Homo Sapiens; identical to SEQ ID NO: 90275

SEQ ID NO: 161632 - RNA, 64 nt, Homo Sapiens; identical to SEQ ID NO: 90276

SEQ ID NO: 161633 - RNA, 64 nt, Homo Sapiens; identical to SEQ ID NO: 90277

SEQ ID NO: 161634 - RNA, 64 nt, Homo Sapiens; identical to SEQ ID NO: 90278

SEQ ID NO: 161635 - RNA, 64 nt, Homo Sapiens; identical to SEQ ID NO: 90279

SEQ ID NO: 161636 - RNA, 64 nt, Homo Sapiens; identical to SEQ ID NO: 90280

SEQ ID NO: 161637 - RNA, 64 nt, Homo Sapiens; identical to SEQ ID NO: 90281

SEQ ID NO: 161638 - RNA, 64 nt, Homo Sapiens; identical to SEQ ID NO: 90282

SEQ ID NO: 161639 - RNA, 64 nt, Homo Sapiens; identical to SEQ ID NO: 90283

SEQ ID NO: 161640 - RNA, 64 nt, Homo Sapiens; identical to SEQ ID NO: 90284

SEQ ID NO: 161641 - RNA, 64 nt, Homo Sapiens; identical to SEQ ID NO: 90285

SEQ ID NO: 161642 - RNA, 64 nt, Homo Sapiens; identical to SEQ ID NO: 90286

SEQ ID NO: 161643 - RNA, 64 nt, Homo Sapiens; identical to SEQ ID NO: 90287

SEQ ID NO: 161644 - RNA, 64 nt, Homo Sapiens
guccuucaauggaaaaguaacauuuaaaaauccuuuggguaauucgaauuacagauuuaaaaga

SEQ ID NO: 161645 - RNA, 64 nt, Homo Sapiens
aaaaauaacauuggaauacaggacuuguugccaauuggguaauuuucauuaguuguuuuguuug

SEQ ID NO: 161646 - RNA, 64 nt, Homo Sapiens
augaauguguauuuucuacacuuccauauuuagauuggguaagcacuuaagugaucaugagguc

SEQ ID NO: 161647 - RNA, 64 nt, Homo Sapiens
caggcccaggucaaggucuuagagagcaugggccuuggguaaagccaucaagaugaccuggagc

SEQ ID NO: 161648 - RNA, 64 nt, Homo Sapiens
uuugauaacuuacaugugugacgucaaaauuaccuuggguaacuauuguuuaaagcugcauuca

SEQ ID NO: 161649 - RNA, 64 nt, Homo Sapiens
acagugggauuuaugugaacaacacgcuaucagcuuggguaaggaguagccauaguacacacac

SEQ ID NO: 161650 - RNA, 64 nt, Homo Sapiens; identical to SEQ ID NO: 51559

SEQ ID NO: 161651 - RNA, 64 nt, Homo Sapiens; identical to SEQ ID NO: 51560

SEQ ID NO: 161652 - RNA, 64 nt, Homo Sapiens; identical to SEQ ID NO: 51561

SEQ ID NO: 161653 - RNA, 64 nt, Homo Sapiens; identical to SEQ ID NO: 51562

SEQ ID NO: 161654 - RNA, 64 nt, Homo Sapiens; identical to SEQ ID NO: 51563

SEQ ID NO: 161655 - RNA, 64 nt, Homo Sapiens; identical to SEQ ID NO: 51564

SEQ ID NO: 161656 - RNA, 64 nt, Homo Sapiens; identical to SEQ ID NO: 51565

SEQ ID NO: 161657 - RNA, 64 nt, Homo Sapiens; identical to SEQ ID NO: 51566

SEQ ID NO: 161658 - RNA, 64 nt, Homo Sapiens; identical to SEQ ID NO: 51567

SEQ ID NO: 161659 - RNA, 64 nt, Homo Sapiens; identical to SEQ ID NO: 51568

SEQ ID NO: 161660 - RNA, 64 nt, Homo Sapiens; identical to SEQ ID NO: 51569

SEQ ID NO: 161661 - RNA, 64 nt, Homo Sapiens; identical to SEQ ID NO: 51570

SEQ ID NO: 161662 - RNA, 64 nt, Homo Sapiens; identical to SEQ ID NO: 51571

SEQ ID NO: 161663 - RNA, 64 nt, Homo Sapiens; identical to SEQ ID NO: 51572

SEQ ID NO: 161664 - RNA, 64 nt, Homo Sapiens; identical to SEQ ID NO: 51573

SEQ ID NO: 161665 - RNA, 64 nt, Homo Sapiens; identical to SEQ ID NO: 51574

SEQ ID NO: 161666 - RNA, 64 nt, Homo Sapiens; identical to SEQ ID NO: 51575

SEQ ID NO: 161667 - RNA, 64 nt, Homo Sapiens; identical to SEQ ID NO: 51576

SEQ ID NO: 161668 - RNA, 64 nt, Homo Sapiens; identical to SEQ ID NO: 51577

SEQ ID NO: 161669 - RNA, 64 nt, Homo Sapiens; identical to SEQ ID NO: 51578

SEQ ID NO: 161670 - RNA, 64 nt, Homo Sapiens
gagcugaagagucuugagaggggcugucaucuguagcugccaucacagugaguuggcagaagug

SEQ ID NO: 161671 - RNA, 64 nt, Homo Sapiens
ccccagccccugugccaggcuaagcugguacaagagcugccaaccucacagaguguuugcuagg

SEQ ID NO: 161672 - RNA, 64 nt, Homo Sapiens
cgagauagccaaggccaaagcuguggguuucuaaagcugccagccuucauccuccucagaucuu

SEQ ID NO: 161673 - RNA, 64 nt, Homo Sapiens
ugccuguugggccaggagccggcuuggggaccagagcugccacccguccccuguccccgcacug

SEQ ID NO: 161674 - RNA, 64 nt, Homo Sapiens
gugcacuggggggaauguucucucuggcuccagaagcugccagaauaguguacacccaccugcc

SEQ ID NO: 161675 - RNA, 64 nt, Homo Sapiens
uaggacaugacuaggagugugcaguaggggucccagcugccaagugauacgagcauugcagauu

SEQ ID NO: 161676 - RNA, 64 nt, Homo Sapiens
uuuaaacaacauaaaggaauaauaaagaaagagcagcugccacuauacucauugauuaaaaugg

SEQ ID NO: 161677 - RNA, 64 nt, Homo Sapiens
auagacagcuacauuuuuauaaauucugcaauauagcugccaaacugauuaaaagauagucaag

SEQ ID NO: 161678 - RNA, 64 nt, Homo Sapiens
cacucccucccuggcuucaggagugugcccaggcagcugccaagccuggcaacuggacugaggg

SEQ ID NO: 161679 - RNA, 64 nt, Homo Sapiens
cacuguauaauuucgccugguagcaucucuguggagcugccaucgacacuuagaccucaaacuu

SEQ ID NO: 161680 - RNA, 64 nt, Homo Sapiens
uccucccuggaggccagcucugccccaggggcugagcugccaccagagguccugggacccucac

SEQ ID NO: 161681 - RNA, 64 nt, Homo Sapiens
uuucuguggcugucggccagagggaauguucuggagcugccaaggagggaggagacucggguug

SEQ ID NO: 161682 - RNA, 64 nt, Homo Sapiens
cugcugcucucucaggaccauccgaucaagcugcagcugccacccucaccuagaaacaugccuu

SEQ ID NO: 161683 - RNA, 64 nt, Homo Sapiens
gucuuuuggaauguccuggucacagggucaugucagcugccaguucucgucucccguccuggag

SEQ ID NO: 161684 - RNA, 64 nt, Homo Sapiens
uaggaccccacgauuuaggguaacuguuaucaucagcugccauuucugauagggucuaccacau

SEQ ID NO: 161685 - RNA, 64 nt, Homo Sapiens
auaguccugugucaucacugcagcgguccucaggagcugccagggccaauugcuacagaguguc

SEQ ID NO: 161686 - RNA, 64 nt, Homo Sapiens
cccccgacacuccugcuguccagggacccaggccagcugccacaccugagggcagacacagcuc

SEQ ID NO: 161687 - RNA, 64 nt, Homo Sapiens
ccagccccaucuggaaggaggaggcaaucgcuguagcugccaggggcuggauguucugggggag

SEQ ID NO: 161688 - RNA, 64 nt, Homo Sapiens
ggccuaaggcugagugagguuccacccgccaggcagcugccacacacauccucucacucacuuc

SEQ ID NO: 161689 - RNA, 64 nt, Homo Sapiens
ccagccuguggccaggucacccagauauaaaacuagcugccaacuccccugcgcuccugcgaga

SEQ ID NO: 161690 - RNA, 64 nt, Homo Sapiens
caggagucgguaggacugugaccugggcuccuccagcugccaggacagacuccuuugugcugga

SEQ ID NO: 161691 - RNA, 64 nt, Homo Sapiens
ugggaugguggcucaggcgcacugcuacgccagcagcugccacaaaacgaugccagcccgaggc

SEQ ID NO: 161692 - RNA, 64 nt, Homo Sapiens
ggcucccagaaagccuuauuccuuccaucccaccagcugccaguucugcccuuuuccaccuccc

SEQ ID NO: 161693 - RNA, 64 nt, Homo Sapiens
cuuggagcacauugauuuuuacacagagcauuugagcugccacuauaagccaagauggcuguaa

SEQ ID NO: 161694 - RNA, 64 nt, Homo Sapiens
ccuccagagauggccccuccucaccugggacggaagcugccagcucgcuucccccaagcugccu

SEQ ID NO: 161695 - RNA, 64 nt, Homo Sapiens
cuuucucugugucucagauggcgauuuugcugacagcugccaagaaaaugcuucacucaacagu

SEQ ID NO: 161696 - RNA, 64 nt, Homo Sapiens
aagaccccugggcaugauuugccauugcagagcaagcugccacgccugguuuggugugguguuu

SEQ ID NO: 161697 - RNA, 64 nt, Homo Sapiens
augccuaugugcccaagagcuggagcccuggcauagcugccacccagcugaagaaggcauggga

SEQ ID NO: 161698 - RNA, 64 nt, Homo Sapiens
aucucaaacagcaaagucagcauuugcuguauagagcugccacccaacucuaagcaggagaaac

SEQ ID NO: 161699 - RNA, 64 nt, Homo Sapiens
gccagaauuugaccucccagagccaguuuccauuagcugccaugcucugcugccucuaauucac

SEQ ID NO: 161700 - RNA, 64 nt, Homo Sapiens
ggggccuggcccccucagccaucucagggugaggagcugccagucauguccagauggaaugacu

SEQ ID NO: 161701 - RNA, 64 nt, Homo Sapiens
uggaugggaagaugugcauccguggucaaaagucagcugccagcccugcggaaccagagccuca

SEQ ID NO: 161702 - RNA, 64 nt, Homo Sapiens
gugugguauucgaggauuauuuuaugaugccaaaagcugccacucccuucaguuaugucccauu

SEQ ID NO: 161703 - RNA, 64 nt, Homo Sapiens
acccaccuggcccuccuccucaguggugcaggacagcugccagcgcaacuccacccgaccccag

SEQ ID NO: 161704 - RNA, 64 nt, Homo Sapiens
gacucaaggugugugaaagauguuauacaccaggagcugccacugcaugucccaaccagacugu

SEQ ID NO: 161705 - RNA, 64 nt, Homo Sapiens
uuguaucuucaguucauuccacuuuaggaaacagagcugccaauugaaacagaagaagaaaaaa

SEQ ID NO: 161706 - RNA, 64 nt, Homo Sapiens
cuaaacacccugaaauugugacccccugggggacagcugccagacacagcuggcggcagcacca

SEQ ID NO: 161707 - RNA, 64 nt, Homo Sapiens
ccuccagaggucaugaagggaccucuguggcuccagcugccaacccuggagcccagaccgaggu

SEQ ID NO: 161708 - RNA, 64 nt, Homo Sapiens
auaaaaguuuccuuuuuuauucucucaagccaccagcugccagccaccagcagccagcugccag

SEQ ID NO: 161709 - RNA, 64 nt, Homo Sapiens
cucucaagccaccagcugccagccaccagcagccagcugccagccuagcuuuuuuuuuuuuuuu

SEQ ID NO: 161710 - RNA, 64 nt, Homo Sapiens; identical to SEQ ID NO: 143960

SEQ ID NO: 161711 - RNA, 64 nt, Homo Sapiens; identical to SEQ ID NO: 143961

SEQ ID NO: 161712 - RNA, 64 nt, Homo Sapiens; identical to SEQ ID NO: 143962

SEQ ID NO: 161713 - RNA, 64 nt, Homo Sapiens; identical to SEQ ID NO: 143963

SEQ ID NO: 161714 - RNA, 64 nt, Homo Sapiens; identical to SEQ ID NO: 143964

SEQ ID NO: 161715 - RNA, 54 nt, Homo Sapiens; identical to SEQ ID NO: 143965

SEQ ID NO: 161716 - RNA, 64 nt, Homo Sapiens; identical to SEQ ID NO: 143966

SEQ ID NO: 161717 - RNA, 64 nt, Homo Sapiens; identical to SEQ ID NO: 143967

SEQ ID NO: 161718 - RNA, 64 nt, Homo Sapiens; identical to SEQ ID NO: 143968

SEQ ID NO: 161719 - RNA, 64 nt, Homo Sapiens; identical to SEQ ID NO: 143969

SEQ ID NO: 161720 - RNA, 64 nt, Homo Sapiens; identical to SEQ ID NO: 143970

SEQ ID NO: 161721 - RNA, 64 nt, Homo Sapiens; identical to SEQ ID NO: 143971

SEQ ID NO: 161722 - RNA, 64 nt, Homo Sapiens; identical to SEQ ID NO: 143972

SEQ ID NO: 161723 - RNA, 64 nt, Homo Sapiens; identical to SEQ ID NO: 143973

SEQ ID NO: 161724 - RNA, 64 nt, Homo Sapiens; identical to SEQ ID NO: 143974

SEQ ID NO: 161725 - RNA, 64 nt, Homo Sapiens; identical to SEQ ID NO: 143975

SEQ ID NO: 161726 - RNA, 64 nt, Homo Sapiens; identical to SEQ ID NO: 143976

SEQ ID NO: 161727 - RNA, 64 nt, Homo Sapiens; identical to SEQ ID NO: 143977

SEQ ID NO: 161728 - RNA, 64 nt, Homo Sapiens; identical to SEQ ID NO: 143978

SEQ ID NO: 161729 - RNA, 64 nt, Homo Sapiens; identical to SEQ ID NO: 143979

SEQ ID NO: 161730 - RNA, 64 nt, Homo Sapiens; identical to SEQ ID NO: 143980

SEQ ID NO: 161731 - RNA, 64 nt, Homo Sapiens; identical to SEQ ID NO: 143981

SEQ ID NO: 161732 - RNA, 64 nt, Homo Sapiens; identical to SEQ ID NO: 143982

SEQ ID NO: 161733 - RNA, 64 nt, Homo Sapiens; identical to SEQ ID NO: 143983

SEQ ID NO: 161734 - RNA, 64 nt, Homo Sapiens; identical to SEQ ID NO: 143984

SEQ ID NO: 161735 - RNA, 64 nt, Homo Sapiens; identical to SEQ ID NO: 143985

SEQ ID NO: 161736 - RNA, 64 nt, Homo Sapiens; identical to SEQ ID NO: 143986

SEQ ID NO: 161737 - RNA, 64 nt, Homo Sapiens; identical to SEQ ID NO: 143987

SEQ ID NO: 161738 - RNA, 64 nt, Homo Sapiens; identical to SEQ ID NO: 143988

SEQ ID NO: 161739 - RNA, 64 nt, Homo Sapiens; identical to SEQ ID NO: 143989

SEQ ID NO: 161740 - RNA, 64 nt, Homo Sapiens; identical to SEQ ID NO: 143990

SEQ ID NO: 161741 - RNA, 64 nt, Homo Sapiens; identical to SEQ ID NO: 143991

SEQ ID NO: 161742 - RNA, 64 nt, Homo Sapiens; identical to SEQ ID NO: 143992

SEQ ID NO: 161743 - RNA, 64 nt, Homo Sapiens; identical to SEQ ID NO: 143993

SEQ ID NO: 161744 - RNA, 64 nt, Homo Sapiens; identical to SEQ ID NO: 143994

SEQ ID NO: 161745 - RNA, 64 nt, Homo Sapiens; identical to SEQ ID NO: 143995

SEQ ID NO: 161746 - RNA, 64 nt, Homo Sapiens; identical to SEQ ID NO: 143996

SEQ ID NO: 161747 - RNA, 64 nt, Homo Sapiens; identical to SEQ ID NO: 143997

SEQ ID NO: 161748 - RNA, 64 nt, Homo Sapiens; identical to SEQ ID NO: 143998

SEQ ID NO: 161749 - RNA, 64 nt, Homo Sapiens; identical to SEQ ID NO: 143999

SEQ ID NO: 161750 - RNA, 64 nt, Homo Sapiens; identical to SEQ ID NO: 144000

SEQ ID NO: 161751 - RNA, 64 nt, Homo Sapiens; identical to SEQ ID NO: 144001

SEQ ID NO: 161752 - RNA, 64 nt, Homo Sapiens; identical to SEQ ID NO: 144002

SEQ ID NO: 161753 - RNA, 64 nt, Homo Sapiens; identical to SEQ ID NO: 144003

SEQ ID NO: 161754 - RNA, 64 nt, Homo Sapiens; identical to SEQ ID NO: 144004

SEQ ID NO: 161755 - RNA, 64 nt, Homo Sapiens; identical to SEQ ID NO: 144005

SEQ ID NO: 161756 - RNA, 64 nt, Homo Sapiens; identical to SEQ ID NO: 144006

SEQ ID NO: 161757 - RNA, 64 nt, Homo Sapiens; identical to SEQ ID NO: 144007

SEQ ID NO: 161758 - RNA, 64 nt, Homo Sapiens
agagaaacuguccuaguuguccagagauaaaaaucauauagaccaauugaagcaugaacgugga

SEQ ID NO: 161759 - RNA, 64 nt, Homo Sapiens
ccaccagcgaacucucagaaauaaaucacagaugcauauagacacacauacauaaugguacucc

SEQ ID NO: 161760 - RNA, 64 nt, Homo Sapiens
auauuaucagacaagaugagaaucagauugacagcauauagaauuucuagcauauagacuauau

SEQ ID NO: 161761 - RNA, 64 nt, Homo Sapiens
auauaaucagauugacagcaucagcaacuucuagcauauagacuucuugguggcagaaugaaaa
